United States Patent 11,293,017 (OLIGONUCLEOTIDE PROBES AND USES THEREOF) - sequence listing, part 2

SEQ ID NO: 20343 - DNA, 35 bp, Artificial Sequence
  Synthetic oligonucleotide
gccagactcctggtaagcccatttctctttttcaa

SEQ ID NO: 20344 - DNA, 36 bp, Artificial Sequence
  Synthetic oligonucleotide
atgtgcccgacgttttccctgccttccctggattca

SEQ ID NO: 20345 - DNA, 35 bp, Artificial Sequence
  Synthetic oligonucleotide
tacatacatcacattcgtctgccaggcccccaata

SEQ ID NO: 20346 - DNA, 35 bp, Artificial Sequence
  Synthetic oligonucleotide
ttgggcccaatggcgtatattatcgcatctcctac

SEQ ID NO: 20347 - DNA, 35 bp, Artificial Sequence
  Synthetic oligonucleotide
ttggatcggtgggtgcacttctctgcatttttccc

SEQ ID NO: 20348 - DNA, 35 bp, Artificial Sequence
  Synthetic oligonucleotide
tcaacacctatgcctaagttcacgaggccaatatc

SEQ ID NO: 20349 - DNA, 35 bp, Artificial Sequence
  Synthetic oligonucleotide
gccaccagtccgctttatccgttcgtacgagtgtc

SEQ ID NO: 20350 - DNA, 35 bp, Artificial Sequence
  Synthetic oligonucleotide
gaaaacttcatgggatgcccgccatgtctccctct

SEQ ID NO: 20351 - DNA, 38 bp, Artificial Sequence
  Synthetic oligonucleotide
ttacctcgctgccatcctgtacccggcaaacacattga

SEQ ID NO: 20352 - DNA, 37 bp, Artificial Sequence
  Synthetic oligonucleotide
accgcggattccgaatctgactaacgccttcacttga

SEQ ID NO: 20353 - DNA, 35 bp, Artificial Sequence
  Synthetic oligonucleotide
tgcccagtagctggcccgccacattcgaacacccg

SEQ ID NO: 20354 - DNA, 35 bp, Artificial Sequence
  Synthetic oligonucleotide
tcgcacgtatcctgctagcctcgtacatctccgtg

SEQ ID NO: 20355 - DNA, 35 bp, Artificial Sequence
  Synthetic oligonucleotide
acccagtagccggccgcactaataatctcacttgt

SEQ ID NO: 20356 - DNA, 36 bp, Artificial Sequence
  Synthetic oligonucleotide
gacttgccatcacatagccgcactcagtctactgaa

SEQ ID NO: 20357 - DNA, 36 bp, Artificial Sequence
  Synthetic oligonucleotide
tcacgcctatcccttcatgtccgccactccgccaca

SEQ ID NO: 20358 - DNA, 37 bp, Artificial Sequence
  Synthetic oligonucleotide
tgtgagcgcgttcttccccatgtccccttgtctacga

SEQ ID NO: 20359 - DNA, 36 bp, Artificial Sequence
  Synthetic oligonucleotide
tgtctcaccgagccccacccgtattgcacctttcta

SEQ ID NO: 20360 - DNA, 35 bp, Artificial Sequence
  Synthetic oligonucleotide
tgacgccctaccccagcaaactgagcatgtgctac

SEQ ID NO: 20361 - DNA, 35 bp, Artificial Sequence
  Synthetic oligonucleotide
tgcccaacactcagtctttttttccacaatgttgc

SEQ ID NO: 20362 - DNA, 35 bp, Artificial Sequence
  Synthetic oligonucleotide
tgctttgcacgttcttgccacgacatcttgctctc

SEQ ID NO: 20363 - DNA, 37 bp, Artificial Sequence
  Synthetic oligonucleotide
tcacaccgccgcccctttgacactacattagcctgga

SEQ ID NO: 20364 - DNA, 38 bp, Artificial Sequence
  Synthetic oligonucleotide
gagagagagggggaaagtagggcaacgtgggccggtga

SEQ ID NO: 20365 - DNA, 38 bp, Artificial Sequence
  Synthetic oligonucleotide
atgttcaacgccgctttggtttagccttccattgttga

SEQ ID NO: 20366 - DNA, 35 bp, Artificial Sequence
  Synthetic oligonucleotide
tagtacttcctagccgcagtctctgcctttcacgc

SEQ ID NO: 20367 - DNA, 35 bp, Artificial Sequence
  Synthetic oligonucleotide
ggaatacgtgggaggaaagtaaaaatgcggggggg

SEQ ID NO: 20368 - DNA, 35 bp, Artificial Sequence
  Synthetic oligonucleotide
tacaccctgccacagccttgtaacgcccgggtatt

SEQ ID NO: 20369 - DNA, 36 bp, Artificial Sequence
  Synthetic oligonucleotide
ttcactcccccacacgttctgaccgccgcctgtcaa

SEQ ID NO: 20370 - DNA, 36 bp, Artificial Sequence
  Synthetic oligonucleotide
tgtgaacggcccatccgccccccgtgattgtttcca

SEQ ID NO: 20371 - DNA, 37 bp, Artificial Sequence
  Synthetic oligonucleotide
ttccaccccttcccaggccctatacatgggtccgaga

SEQ ID NO: 20372 - DNA, 37 bp, Artificial Sequence
  Synthetic oligonucleotide
gtcggtaaagggaaggcaaaattagggaggggagcga

SEQ ID NO: 20373 - DNA, 37 bp, Artificial Sequence
  Synthetic oligonucleotide
gtgatcccccaccttcccagtcttgtgatacaagtga

SEQ ID NO: 20374 - DNA, 36 bp, Artificial Sequence
  Synthetic oligonucleotide
tgccactgggcaactgaaaacactgccattaaaata

SEQ ID NO: 20375 - DNA, 36 bp, Artificial Sequence
  Synthetic oligonucleotide
taacccatgcgtgtcacgtctcttcatcgccttgta

SEQ ID NO: 20376 - DNA, 35 bp, Artificial Sequence
  Synthetic oligonucleotide
acctctgccaatactacctaggatacacttccttg

SEQ ID NO: 20377 - DNA, 35 bp, Artificial Sequence
  Synthetic oligonucleotide
acccgagtacgtatcgttggaacttctcccttaat

SEQ ID NO: 20378 - DNA, 35 bp, Artificial Sequence
  Synthetic oligonucleotide
gggcgaaccgccgcatccgtagctctcctctctat

SEQ ID NO: 20379 - DNA, 35 bp, Artificial Sequence
  Synthetic oligonucleotide
ttggctctgggctctcgtgccttcattcgttcact

SEQ ID NO: 20380 - DNA, 35 bp, Artificial Sequence
  Synthetic oligonucleotide
ttcacgttggcactgccttctgcccgtccccgcct

SEQ ID NO: 20381 - DNA, 36 bp, Artificial Sequence
  Synthetic oligonucleotide
gtaccgcgcaattctacacccaactggccttagcca

SEQ ID NO: 20382 - DNA, 37 bp, Artificial Sequence
  Synthetic oligonucleotide
ttacctcgcctcagactctctttgttcatgaccgcga

SEQ ID NO: 20383 - DNA, 36 bp, Artificial Sequence
  Synthetic oligonucleotide
ttccgccccaactttgatcacgtcttgcagaatgga

SEQ ID NO: 20384 - DNA, 38 bp, Artificial Sequence
  Synthetic oligonucleotide
gcaaccgcctgcttcctctgcaattcatgacctcgtga

SEQ ID NO: 20385 - DNA, 36 bp, Artificial Sequence
  Synthetic oligonucleotide
atgtagccccgctctggcctctcttcaccgggatta

SEQ ID NO: 20386 - DNA, 35 bp, Artificial Sequence
  Synthetic oligonucleotide
gtgtggccccttcatgttgtcgcaaccctcctcac

SEQ ID NO: 20387 - DNA, 35 bp, Artificial Sequence
  Synthetic oligonucleotide
tgtatctccatcttgtatgtacgcaaccattgtcc

SEQ ID NO: 20388 - DNA, 35 bp, Artificial Sequence
  Synthetic oligonucleotide
tgtgggagtatggaggaaaggcgggaagagttcag

SEQ ID NO: 20389 - DNA, 35 bp, Artificial Sequence
  Synthetic oligonucleotide
attagcgtcgcgccatcctccaccgttgtgaaccg

SEQ ID NO: 20390 - DNA, 36 bp, Artificial Sequence
  Synthetic oligonucleotide
acgcccaccgcctctgcggcttatcgaccgttaaaa

SEQ ID NO: 20391 - DNA, 36 bp, Artificial Sequence
  Synthetic oligonucleotide
tttgccgtgatcctgctcccgaccgcgcttctatca

SEQ ID NO: 20392 - DNA, 37 bp, Artificial Sequence
  Synthetic oligonucleotide
gcgcccttccggatgtttacacgccacccttcaccga

SEQ ID NO: 20393 - DNA, 36 bp, Artificial Sequence
  Synthetic oligonucleotide
ttaaccagccacatatctgattcccttgcgtaacta

SEQ ID NO: 20394 - DNA, 35 bp, Artificial Sequence
  Synthetic oligonucleotide
ggtgcggcccttactatgcactcctctgccttgac

SEQ ID NO: 20395 - DNA, 36 bp, Artificial Sequence
  Synthetic oligonucleotide
accgagctcaccgaccgctttatcgcctcgtttcaa

SEQ ID NO: 20396 - DNA, 37 bp, Artificial Sequence
  Synthetic oligonucleotide
ttccgcccctgcctcccctcaaatgagtttgcataga

SEQ ID NO: 20397 - DNA, 37 bp, Artificial Sequence
  Synthetic oligonucleotide
ttagggaacggaagggggcagggagtccggcagggga

SEQ ID NO: 20398 - DNA, 36 bp, Artificial Sequence
  Synthetic oligonucleotide
gtctaacatccggtgtccgcgacctcttcatactga

SEQ ID NO: 20399 - DNA, 38 bp, Artificial Sequence
  Synthetic oligonucleotide
gatcacggcggggaggagggaaacggtatccaaattga

SEQ ID NO: 20400 - DNA, 37 bp, Artificial Sequence
  Synthetic oligonucleotide
gatactgccatcacgtgcctgccggtcctttcgttga

SEQ ID NO: 20401 - DNA, 36 bp, Artificial Sequence
  Synthetic oligonucleotide
gttgacccgtcccatgttccatcacactgttaacta

SEQ ID NO: 20402 - DNA, 35 bp, Artificial Sequence
  Synthetic oligonucleotide
gggacgcacgcacacgcgttctctatcttataacc

SEQ ID NO: 20403 - DNA, 35 bp, Artificial Sequence
  Synthetic oligonucleotide
tgtcttgcagtgacgtcatcctctgtttcatctgc

SEQ ID NO: 20404 - DNA, 35 bp, Artificial Sequence
  Synthetic oligonucleotide
attaccgcgattgtcagcccacgcttttccttcat

SEQ ID NO: 20405 - DNA, 35 bp, Artificial Sequence
  Synthetic oligonucleotide
tgcctcaccagttgttagcgttcccagtcctgttt

SEQ ID NO: 20406 - DNA, 36 bp, Artificial Sequence
  Synthetic oligonucleotide
gatgggtagcgggagggtgggtaccgtttcttaaca

SEQ ID NO: 20407 - DNA, 38 bp, Artificial Sequence
  Synthetic oligonucleotide
tcgttacgccgccactgtgatccgtgcccttagtttga

SEQ ID NO: 20408 - DNA, 35 bp, Artificial Sequence
  Synthetic oligonucleotide
gagaagggtgaaggggcaaggcagaagcaacaggc

SEQ ID NO: 20409 - DNA, 35 bp, Artificial Sequence
  Synthetic oligonucleotide
tcatctgtgtctgacttgtaaccacgcgtcctctc

SEQ ID NO: 20410 - DNA, 35 bp, Artificial Sequence
  Synthetic oligonucleotide
aaattgtcgtatagggctgagggggggagggcgat

SEQ ID NO: 20411 - DNA, 35 bp, Artificial Sequence
  Synthetic oligonucleotide
atgtcgcccccagtgctttatctcaatcatttggt

SEQ ID NO: 20412 - DNA, 37 bp, Artificial Sequence
  Synthetic oligonucleotide
agaatagcagtcggtaagggaggcgggagggagcgga

SEQ ID NO: 20413 - DNA, 37 bp, Artificial Sequence
  Synthetic oligonucleotide
tgacccacccttggctcattactatttgtcatactga

SEQ ID NO: 20414 - DNA, 38 bp, Artificial Sequence
  Synthetic oligonucleotide
gtcatacggaagatgtcaacctcatgcccacctgctga

SEQ ID NO: 20415 - DNA, 38 bp, Artificial Sequence
  Synthetic oligonucleotide
acaaaggacaatgggaagaaggggggcaagaacggtga

SEQ ID NO: 20416 - DNA, 35 bp, Artificial Sequence
  Synthetic oligonucleotide
ttggttgagtctgtcactcccgttcccctcccccc

SEQ ID NO: 20417 - DNA, 35 bp, Artificial Sequence
  Synthetic oligonucleotide
aaatgcagcgacaccattgccttccctccactcct

SEQ ID NO: 20418 - DNA, 35 bp, Artificial Sequence
  Synthetic oligonucleotide
atatacgcccgctgtaccggtcttccggtcgcccc

SEQ ID NO: 20419 - DNA, 35 bp, Artificial Sequence
  Synthetic oligonucleotide
ccaccacacgaacaccagtttacgcgcccacgccc

SEQ ID NO: 20420 - DNA, 35 bp, Artificial Sequence
  Synthetic oligonucleotide
tggacgccccttccgcacctgagatgcaacccgcc

SEQ ID NO: 20421 - DNA, 35 bp, Artificial Sequence
  Synthetic oligonucleotide
acctcccgccggcctaatatcctatcgggcaacgc

SEQ ID NO: 20422 - DNA, 35 bp, Artificial Sequence
  Synthetic oligonucleotide
tcacgtccctggaccatctccttgctaccgatagg

SEQ ID NO: 20423 - DNA, 35 bp, Artificial Sequence
  Synthetic oligonucleotide
gcatcctgacctacgcgaccacccttctaattagg

SEQ ID NO: 20424 - DNA, 35 bp, Artificial Sequence
  Synthetic oligonucleotide
gagagggtggggtcagggcggggatacgggtagat

SEQ ID NO: 20425 - DNA, 35 bp, Artificial Sequence
  Synthetic oligonucleotide
tccgactgagccggggtacgcgcgacttccacttt

SEQ ID NO: 20426 - DNA, 36 bp, Artificial Sequence
  Synthetic oligonucleotide
gcacgccaggttcaattgcgaacacacacgccccca

SEQ ID NO: 20427 - DNA, 37 bp, Artificial Sequence
  Synthetic oligonucleotide
ttccaccccctgacagtacattggtgttggccaccga

SEQ ID NO: 20428 - DNA, 37 bp, Artificial Sequence
  Synthetic oligonucleotide
gaaccaccgttctttcctggtctgaatcaatcaccga

SEQ ID NO: 20429 - DNA, 37 bp, Artificial Sequence
  Synthetic oligonucleotide
atcccacctcacagtactggggcatttcccattttga

SEQ ID NO: 20430 - DNA, 38 bp, Artificial Sequence
  Synthetic oligonucleotide
ggacatccggatcttcgtcgctagacacccccttttga

SEQ ID NO: 20431 - DNA, 35 bp, Artificial Sequence
  Synthetic oligonucleotide
gtaccactagccggtaaaggtgcccttctgtctcc

SEQ ID NO: 20432 - DNA, 35 bp, Artificial Sequence
  Synthetic oligonucleotide
tcccacgcgcactcgcatatcggtgcgtgcctctc

SEQ ID NO: 20433 - DNA, 35 bp, Artificial Sequence
  Synthetic oligonucleotide
tgctgtctttgtccgttccactttcgtccctccag

SEQ ID NO: 20434 - DNA, 35 bp, Artificial Sequence
  Synthetic oligonucleotide
actcccaccacagaccaaccttgcttagatgccct

SEQ ID NO: 20435 - DNA, 34 bp, Artificial Sequence
  Synthetic oligonucleotide
aaccggaggaacacttgcgaaagcctcaccgcct

SEQ ID NO: 20436 - DNA, 33 bp, Artificial Sequence
  Synthetic oligonucleotide
agtcaaagaggccctccgctacgtccttcccaa

SEQ ID NO: 20437 - DNA, 36 bp, Artificial Sequence
  Synthetic oligonucleotide
gactgcctgtcatcctcttagttggccccgttccca

SEQ ID NO: 20438 - DNA, 37 bp, Artificial Sequence
  Synthetic oligonucleotide
tgcctgtgcagcctcgacctggcctttacacccatga

SEQ ID NO: 20439 - DNA, 35 bp, Artificial Sequence
  Synthetic oligonucleotide
actcacagcctaacgcacctacccctgcacgcacg

SEQ ID NO: 20440 - DNA, 35 bp, Artificial Sequence
  Synthetic oligonucleotide
gagacggggtcgggttgaaaggggcgaaggatatg

SEQ ID NO: 20441 - DNA, 35 bp, Artificial Sequence
  Synthetic oligonucleotide
tgcgtggctcagtccatgctaaccgcccctctttt

SEQ ID NO: 20442 - DNA, 36 bp, Artificial Sequence
  Synthetic oligonucleotide
accgaacagctggacacggggcggtggggggggaaa

SEQ ID NO: 20443 - DNA, 35 bp, Artificial Sequence
  Synthetic oligonucleotide
gacccccgtatagtctccgtccctccttcatcgca

SEQ ID NO: 20444 - DNA, 37 bp, Artificial Sequence
  Synthetic oligonucleotide
gcacgccacacgccctcacgccactgaccttttacga

SEQ ID NO: 20445 - DNA, 36 bp, Artificial Sequence
  Synthetic oligonucleotide
gtgccaggcccggacttatacatgcattgatatcga

SEQ ID NO: 20446 - DNA, 37 bp, Artificial Sequence
  Synthetic oligonucleotide
gaagggggcaagggttgtgcaaaaaaagggatgtcga

SEQ ID NO: 20447 - DNA, 38 bp, Artificial Sequence
  Synthetic oligonucleotide
atcgcgagacaggggggaagtggggttgatgcggcgga

SEQ ID NO: 20448 - DNA, 37 bp, Artificial Sequence
  Synthetic oligonucleotide
gattccgcccgcacctcgcgtgtctatttccttgtga

SEQ ID NO: 20449 - DNA, 36 bp, Artificial Sequence
  Synthetic oligonucleotide
agccacatcaagtccgtaaccgacacccatgtacta

SEQ ID NO: 20450 - DNA, 35 bp, Artificial Sequence
  Synthetic oligonucleotide
accgacgaccgggcggtgcttgcggtctctcccac

SEQ ID NO: 20451 - DNA, 35 bp, Artificial Sequence
  Synthetic oligonucleotide
gccatgcaggacctgctattttatctatccgtgcc

SEQ ID NO: 20452 - DNA, 35 bp, Artificial Sequence
  Synthetic oligonucleotide
tctaagtcacgctatccctgtgtcttttaaccctc

SEQ ID NO: 20453 - DNA, 31 bp, Artificial Sequence
  Synthetic oligonucleotide
atgtctctcatcacactcagcctggttgctc

SEQ ID NO: 20454 - DNA, 35 bp, Artificial Sequence
  Synthetic oligonucleotide
cctaatccttgccgtcctgtcacgacgtagctttc

SEQ ID NO: 20455 - DNA, 37 bp, Artificial Sequence
  Synthetic oligonucleotide
acttgacgcaacaactgtcaggggaccacacacacga

SEQ ID NO: 20456 - DNA, 36 bp, Artificial Sequence
  Synthetic oligonucleotide
agcactatcccaccgagcgcatcaccgcaaccacga

SEQ ID NO: 20457 - DNA, 37 bp, Artificial Sequence
  Synthetic oligonucleotide
tcacctcgccctagagcgatatggaattgccctccga

SEQ ID NO: 20458 - DNA, 35 bp, Artificial Sequence
  Synthetic oligonucleotide
ttgacgtcgttccccggaatcatgcgcaccacctc

SEQ ID NO: 20459 - DNA, 35 bp, Artificial Sequence
  Synthetic oligonucleotide
ggaagggggggcggaagtaacaaaacaagtgggcg

SEQ ID NO: 20460 - DNA, 35 bp, Artificial Sequence
  Synthetic oligonucleotide
ttaccccccacggaagacatcgtaataacacgtgt

SEQ ID NO: 20461 - DNA, 36 bp, Artificial Sequence
  Synthetic oligonucleotide
gcccagctgtagcacgtttctccgtaattaacataa

SEQ ID NO: 20462 - DNA, 36 bp, Artificial Sequence
  Synthetic oligonucleotide
tacgaccgcagtgaaccgcgcgcttcatcctaacca

SEQ ID NO: 20463 - DNA, 36 bp, Artificial Sequence
  Synthetic oligonucleotide
ttcaccccagctgttggcacaaattttcaaactcca

SEQ ID NO: 20464 - DNA, 38 bp, Artificial Sequence
  Synthetic oligonucleotide
ttgccctccagcactagtcgttactaccccagatctga

SEQ ID NO: 20465 - DNA, 35 bp, Artificial Sequence
  Synthetic oligonucleotide
agcccagggaggtgaggaaatggataggtctgagg

SEQ ID NO: 20466 - DNA, 35 bp, Artificial Sequence
  Synthetic oligonucleotide
aaatgcgccggctttgatccacttcctctgttcct

SEQ ID NO: 20467 - DNA, 35 bp, Artificial Sequence
  Synthetic oligonucleotide
aagcagaccccccaccggtttgcctcattcgtatt

SEQ ID NO: 20468 - DNA, 36 bp, Artificial Sequence
  Synthetic oligonucleotide
gtccagagggttgagtgggaaaaggggtgtatcgaa

SEQ ID NO: 20469 - DNA, 36 bp, Artificial Sequence
  Synthetic oligonucleotide
acacgagcctgatcagcactcccgatccctaaacga

SEQ ID NO: 20470 - DNA, 36 bp, Artificial Sequence
  Synthetic oligonucleotide
acaccctttcaactgaccacacgtcgccgacattga

SEQ ID NO: 20471 - DNA, 35 bp, Artificial Sequence
  Synthetic oligonucleotide
gatggcgctatcttgtcctgcatatcacccttctc

SEQ ID NO: 20472 - DNA, 35 bp, Artificial Sequence
  Synthetic oligonucleotide
tatgaacggcaatcacaatgcgacctctcacctat

SEQ ID NO: 20473 - DNA, 36 bp, Artificial Sequence
  Synthetic oligonucleotide
gcacgacgcaaatttaccaactgtgcctcccttgaa

SEQ ID NO: 20474 - DNA, 37 bp, Artificial Sequence
  Synthetic oligonucleotide
gcatggctgtgactctgcactgattgccgaaccccga

SEQ ID NO: 20475 - DNA, 35 bp, Artificial Sequence
  Synthetic oligonucleotide
tctactgctctggtttctggccgatcaccccccga

SEQ ID NO: 20476 - DNA, 37 bp, Artificial Sequence
  Synthetic oligonucleotide
gcgggggggcgggttggggcacgggtactggactgga

SEQ ID NO: 20477 - DNA, 36 bp, Artificial Sequence
  Synthetic oligonucleotide
tgatcgcacccgcctcgcctctatcagccgcctgga

SEQ ID NO: 20478 - DNA, 38 bp, Artificial Sequence
  Synthetic oligonucleotide
ggaccgccgcgaaatatattaagccctgcccttcctga

SEQ ID NO: 20479 - DNA, 35 bp, Artificial Sequence
  Synthetic oligonucleotide
atcacagtcaggcctggttcaccatccttccttac

SEQ ID NO: 20480 - DNA, 35 bp, Artificial Sequence
  Synthetic oligonucleotide
ttgaggcacttccagctatcctccgccccgcttac

SEQ ID NO: 20481 - DNA, 35 bp, Artificial Sequence
  Synthetic oligonucleotide
agagaggccctactggtctttttcgcactcacccc

SEQ ID NO: 20482 - DNA, 35 bp, Artificial Sequence
  Synthetic oligonucleotide
tgatccctctcgtcgcgacttcggttacaccttct

SEQ ID NO: 20483 - DNA, 35 bp, Artificial Sequence
  Synthetic oligonucleotide
gcacactgccgccacctgtagagtccccaaatagt

SEQ ID NO: 20484 - DNA, 35 bp, Artificial Sequence
  Synthetic oligonucleotide
accagtccatcaccgctcaccactacagatcgttt

SEQ ID NO: 20485 - DNA, 37 bp, Artificial Sequence
  Synthetic oligonucleotide
tcaacactgtcgaatttatgcccgccttcccgtgaga

SEQ ID NO: 20486 - DNA, 38 bp, Artificial Sequence
  Synthetic oligonucleotide
tgatgtgccaggtctctatccgttcgttcctatcatga

SEQ ID NO: 20487 - DNA, 37 bp, Artificial Sequence
  Synthetic oligonucleotide
tccgaacctcatcttaaactgcactatctacttgtga

SEQ ID NO: 20488 - DNA, 35 bp, Artificial Sequence
  Synthetic oligonucleotide
gatctctcgccccgtaacatgactccccttgactc

SEQ ID NO: 20489 - DNA, 35 bp, Artificial Sequence
  Synthetic oligonucleotide
acatcttcgccactgtcctgactccctgctaagcg

SEQ ID NO: 20490 - DNA, 35 bp, Artificial Sequence
  Synthetic oligonucleotide
gccccatggcgtactttgagtctgttcctaccctg

SEQ ID NO: 20491 - DNA, 37 bp, Artificial Sequence
  Synthetic oligonucleotide
aatggaccgccctcgattgatcgcacatcccccctga

SEQ ID NO: 20492 - DNA, 35 bp, Artificial Sequence
  Synthetic oligonucleotide
tcatccgatcccgtgccaatgaccccacctaaccc

SEQ ID NO: 20493 - DNA, 35 bp, Artificial Sequence
  Synthetic oligonucleotide
tacccccacctggatcccagcatctgctatggacg

SEQ ID NO: 20494 - DNA, 35 bp, Artificial Sequence
  Synthetic oligonucleotide
atgttaacccggaccgaaccatcgaaagacgccct

SEQ ID NO: 20495 - DNA, 35 bp, Artificial Sequence
  Synthetic oligonucleotide
gaccagtccaccgaggttcgccatttacagccgca

SEQ ID NO: 20496 - DNA, 37 bp, Artificial Sequence
  Synthetic oligonucleotide
ttgtcatgggagagtaggagtgggggacgggggagga

SEQ ID NO: 20497 - DNA, 36 bp, Artificial Sequence
  Synthetic oligonucleotide
gcctatcacactggtaaaatccacacggttcacgga

SEQ ID NO: 20498 - DNA, 35 bp, Artificial Sequence
  Synthetic oligonucleotide
gactgcacgaacatggcaattgccctcttaactcc

SEQ ID NO: 20499 - DNA, 35 bp, Artificial Sequence
  Synthetic oligonucleotide
atcccagcttgccatccattgaaacccgtcacccg

SEQ ID NO: 20500 - DNA, 35 bp, Artificial Sequence
  Synthetic oligonucleotide
gcactgccaccggtaatattaggcctcccgagtat

SEQ ID NO: 20501 - DNA, 36 bp, Artificial Sequence
  Synthetic oligonucleotide
gcatcccttacgtgcctattgtcccaggctctccaa

SEQ ID NO: 20502 - DNA, 36 bp, Artificial Sequence
  Synthetic oligonucleotide
ggatggtaaagagggaaacggaatgaggcaatgaga

SEQ ID NO: 20503 - DNA, 37 bp, Artificial Sequence
  Synthetic oligonucleotide
ttgacgcatccattgccatcactctcaatctcgtaga

SEQ ID NO: 20504 - DNA, 38 bp, Artificial Sequence
  Synthetic oligonucleotide
tgagacggcaatgggccgggtggggttatagggactga

SEQ ID NO: 20505 - DNA, 37 bp, Artificial Sequence
  Synthetic oligonucleotide
accgcaagcccccctaccctagattctttggtcctga

SEQ ID NO: 20506 - DNA, 35 bp, Artificial Sequence
  Synthetic oligonucleotide
tgtgacgtcatgtcagatccgtttccgcctccgta

SEQ ID NO: 20507 - DNA, 35 bp, Artificial Sequence
  Synthetic oligonucleotide
gactcccgaggaccgctcccgctccgcatctgcct

SEQ ID NO: 20508 - DNA, 35 bp, Artificial Sequence
  Synthetic oligonucleotide
actcctcccctcgtgtagacgtttgctcgttttct

SEQ ID NO: 20509 - DNA, 35 bp, Artificial Sequence
  Synthetic oligonucleotide
gtgagcaggggaagtctagtgaagggggggttagt

SEQ ID NO: 20510 - DNA, 36 bp, Artificial Sequence
  Synthetic oligonucleotide
gtgcacgtacccgattccatctcaaccgcacaagaa

SEQ ID NO: 20511 - DNA, 35 bp, Artificial Sequence
  Synthetic oligonucleotide
gccccccctccttaacgaccgtactgactacagca

SEQ ID NO: 20512 - DNA, 37 bp, Artificial Sequence
  Synthetic oligonucleotide
tcaaacactgaatgcccttgcccatctctcccagaga

SEQ ID NO: 20513 - DNA, 37 bp, Artificial Sequence
  Synthetic oligonucleotide
tttgcctcagtagtagcgtcgccctcctcatgcccga

SEQ ID NO: 20514 - DNA, 36 bp, Artificial Sequence
  Synthetic oligonucleotide
tacaggtcgcttgcctagcactggtttgaattccta

SEQ ID NO: 20515 - DNA, 35 bp, Artificial Sequence
  Synthetic oligonucleotide
aaccacgctcccggctcatttcttcttcgatgacc

SEQ ID NO: 20516 - DNA, 35 bp, Artificial Sequence
  Synthetic oligonucleotide
gaaacctggcagttggcatccagccatatccccct

SEQ ID NO: 20517 - DNA, 36 bp, Artificial Sequence
  Synthetic oligonucleotide
tttccgtgtagtccaccctgcgcattcttgttctca

SEQ ID NO: 20518 - DNA, 37 bp, Artificial Sequence
  Synthetic oligonucleotide
ggtcaccgctgcctggccacctccgaaacattcgcga

SEQ ID NO: 20519 - DNA, 37 bp, Artificial Sequence
  Synthetic oligonucleotide
acgcggggcgaatacaagggggagggggataaggcga

SEQ ID NO: 20520 - DNA, 37 bp, Artificial Sequence
  Synthetic oligonucleotide
taaagcaggtggtgagctttggggtggggaatactga

SEQ ID NO: 20521 - DNA, 38 bp, Artificial Sequence
  Synthetic oligonucleotide
gagaagtggacgtatgagtaggggaggaaggaatgtga

SEQ ID NO: 20522 - DNA, 35 bp, Artificial Sequence
  Synthetic oligonucleotide
gacccccgggcccgcggttcctccgtttgccgtgc

SEQ ID NO: 20523 - DNA, 35 bp, Artificial Sequence
  Synthetic oligonucleotide
gcaaccgttctttattacctatggtctggcctttg

SEQ ID NO: 20524 - DNA, 35 bp, Artificial Sequence
  Synthetic oligonucleotide
gtagcaaagggaaaaagggtacgggtggcaaggct

SEQ ID NO: 20525 - DNA, 35 bp, Artificial Sequence
  Synthetic oligonucleotide
actccccagccatgtcgtcatcccgagctatctct

SEQ ID NO: 20526 - DNA, 35 bp, Artificial Sequence
  Synthetic oligonucleotide
tccatccctttgtaattgtcctttgggttaccctt

SEQ ID NO: 20527 - DNA, 36 bp, Artificial Sequence
  Synthetic oligonucleotide
accccccctcgaccagctgactagacgcatccgttt

SEQ ID NO: 20528 - DNA, 36 bp, Artificial Sequence
  Synthetic oligonucleotide
gagacgccccggccctcgtgacccatgctttaggaa

SEQ ID NO: 20529 - DNA, 37 bp, Artificial Sequence
  Synthetic oligonucleotide
ttgacgggcaggcaatagaaaggggcggttgcttgga

SEQ ID NO: 20530 - DNA, 37 bp, Artificial Sequence
  Synthetic oligonucleotide
ggtgctcggcgtccatcatcaccacacttcgcgctga

SEQ ID NO: 20531 - DNA, 36 bp, Artificial Sequence
  Synthetic oligonucleotide
acacacctcctgtcgcgaattttccccaccccttga

SEQ ID NO: 20532 - DNA, 35 bp, Artificial Sequence
  Synthetic oligonucleotide
gagggggggaggcgatgattcgacggaagattgtg

SEQ ID NO: 20533 - DNA, 35 bp, Artificial Sequence
  Synthetic oligonucleotide
ttcccaccgggtggttactattccttctgcctgtt

SEQ ID NO: 20534 - DNA, 35 bp, Artificial Sequence
  Synthetic oligonucleotide
acccaaagcgtcacccctctactcactcgtcattt

SEQ ID NO: 20535 - DNA, 35 bp, Artificial Sequence
  Synthetic oligonucleotide
taagggcgctctccccctgcactttccgtgattaa

SEQ ID NO: 20536 - DNA, 35 bp, Artificial Sequence
  Synthetic oligonucleotide
tatgcacaccgtaatctctcaccttagcatgttca

SEQ ID NO: 20537 - DNA, 38 bp, Artificial Sequence
  Synthetic oligonucleotide
gtgccgcccccccccctgctttgcctgtcactttgcga

SEQ ID NO: 20538 - DNA, 36 bp, Artificial Sequence
  Synthetic oligonucleotide
acatgtgaagggggaggaagcatgggatgaaggtga

SEQ ID NO: 20539 - DNA, 35 bp, Artificial Sequence
  Synthetic oligonucleotide
tcaccgcattcacccaaggcgcctcttttagcact

SEQ ID NO: 20540 - DNA, 36 bp, Artificial Sequence
  Synthetic oligonucleotide
agtcactcagatcggggggggtggcaaactgggtaa

SEQ ID NO: 20541 - DNA, 35 bp, Artificial Sequence
  Synthetic oligonucleotide
tgaccggaagagggaacggcgggaaaacagtgcca

SEQ ID NO: 20542 - DNA, 37 bp, Artificial Sequence
  Synthetic oligonucleotide
tccactcacacttttcttgatttccgggccctaggga

SEQ ID NO: 20543 - DNA, 35 bp, Artificial Sequence
  Synthetic oligonucleotide
ttcgatcaccaggcgctgtgctttccggaattacc

SEQ ID NO: 20544 - DNA, 35 bp, Artificial Sequence
  Synthetic oligonucleotide
gtaacctccatgcccccgagatgccctgcttcggc

SEQ ID NO: 20545 - DNA, 35 bp, Artificial Sequence
  Synthetic oligonucleotide
gccaacccgcctggatgtactggactacatccatc

SEQ ID NO: 20546 - DNA, 35 bp, Artificial Sequence
  Synthetic oligonucleotide
tgtgccgtgtactctgtcttactacctcccaagcg

SEQ ID NO: 20547 - DNA, 35 bp, Artificial Sequence
  Synthetic oligonucleotide
gattaactggccccggcacactctgccactctttg

SEQ ID NO: 20548 - DNA, 35 bp, Artificial Sequence
  Synthetic oligonucleotide
ttgccatcctgcgaaactggccttgaacattatct

SEQ ID NO: 20549 - DNA, 35 bp, Artificial Sequence
  Synthetic oligonucleotide
gatctcccaatgtacgtttagtccccgcacactct

SEQ ID NO: 20550 - DNA, 35 bp, Artificial Sequence
  Synthetic oligonucleotide
ttgatcttccccggcgacctgcctctcacgattct

SEQ ID NO: 20551 - DNA, 35 bp, Artificial Sequence
  Synthetic oligonucleotide
aatacaccacaaatgcgcattctgcccagttctaa

SEQ ID NO: 20552 - DNA, 37 bp, Artificial Sequence
  Synthetic oligonucleotide
ttccacatgccacgagttgtgcccaccttcccgatga

SEQ ID NO: 20553 - DNA, 38 bp, Artificial Sequence
  Synthetic oligonucleotide
taacatcgccgctgcataagctcgtttttccacactga

SEQ ID NO: 20554 - DNA, 36 bp, Artificial Sequence
  Synthetic oligonucleotide
tcatttacgcactcctatggcctgagccctccctga

SEQ ID NO: 20555 - DNA, 36 bp, Artificial Sequence
  Synthetic oligonucleotide
gccccgcaccacctctatcatagtcaacgctctata

SEQ ID NO: 20556 - DNA, 35 bp, Artificial Sequence
  Synthetic oligonucleotide
tcgctccgtccctcctccgcaacagttcttttcgc

SEQ ID NO: 20557 - DNA, 35 bp, Artificial Sequence
  Synthetic oligonucleotide
aactgctccatctcgcgacacctcccctgtcatat

SEQ ID NO: 20558 - DNA, 35 bp, Artificial Sequence
  Synthetic oligonucleotide
ttacgacccatggcggagctgcttgccacatcttt

SEQ ID NO: 20559 - DNA, 36 bp, Artificial Sequence
  Synthetic oligonucleotide
tccctcctacactcagcctacagtcgtcgctgacaa

SEQ ID NO: 20560 - DNA, 35 bp, Artificial Sequence
  Synthetic oligonucleotide
tgccattcactgaacccttcgcgctgctcctcaca

SEQ ID NO: 20561 - DNA, 36 bp, Artificial Sequence
  Synthetic oligonucleotide
attacagtcggcgtcagcagcctccctgcctttcca

SEQ ID NO: 20562 - DNA, 37 bp, Artificial Sequence
  Synthetic oligonucleotide
accgcagggaagatcggctaaccccatcctacataga

SEQ ID NO: 20563 - DNA, 36 bp, Artificial Sequence
  Synthetic oligonucleotide
gagtagtagggtgtttaaaacgcaggtgaaggggga

SEQ ID NO: 20564 - DNA, 38 bp, Artificial Sequence
  Synthetic oligonucleotide
attcgcgcgctggtctatctatcccctgctccacatga

SEQ ID NO: 20565 - DNA, 37 bp, Artificial Sequence
  Synthetic oligonucleotide
tgatcggtcctattggcattccaccacctgtacttga

SEQ ID NO: 20566 - DNA, 35 bp, Artificial Sequence
  Synthetic oligonucleotide
gagcccccgccctttatatcccgggcccgagtttc

SEQ ID NO: 20567 - DNA, 35 bp, Artificial Sequence
  Synthetic oligonucleotide
tgagcaaacccgttccgctcttactttgacgtttc

SEQ ID NO: 20568 - DNA, 35 bp, Artificial Sequence
  Synthetic oligonucleotide
gtgaaggcacggagggcggaggttcttaaatatgg

SEQ ID NO: 20569 - DNA, 35 bp, Artificial Sequence
  Synthetic oligonucleotide
tgcacctacctactgctttaccttgacccatgtgg

SEQ ID NO: 20570 - DNA, 35 bp, Artificial Sequence
  Synthetic oligonucleotide
gaatgtgacgaaaggggagaggtggatcggttgtg

SEQ ID NO: 20571 - DNA, 35 bp, Artificial Sequence
  Synthetic oligonucleotide
acctccgccatgaacacacgtactacttcctccat

SEQ ID NO: 20572 - DNA, 35 bp, Artificial Sequence
  Synthetic oligonucleotide
atggggtgggcccaggaatgggggtcgcaaaaagt

SEQ ID NO: 20573 - DNA, 36 bp, Artificial Sequence
  Synthetic oligonucleotide
gactccatccgccgcgtttagccatatatctcacaa

SEQ ID NO: 20574 - DNA, 36 bp, Artificial Sequence
  Synthetic oligonucleotide
actagcggggccgtcacgcttcctctcatcaccaca

SEQ ID NO: 20575 - DNA, 36 bp, Artificial Sequence
  Synthetic oligonucleotide
gatgcgcccttccggcaatccagcactgccttccca

SEQ ID NO: 20576 - DNA, 36 bp, Artificial Sequence
  Synthetic oligonucleotide
tcagggcaccatatcgttctagtccttgttgctcca

SEQ ID NO: 20577 - DNA, 37 bp, Artificial Sequence
  Synthetic oligonucleotide
gaatgggggggaggggtttatggtgccggggactaga

SEQ ID NO: 20578 - DNA, 37 bp, Artificial Sequence
  Synthetic oligonucleotide
tgccatacgcctccgtaccgttgtaatcactcttgga

SEQ ID NO: 20579 - DNA, 37 bp, Artificial Sequence
  Synthetic oligonucleotide
gatctccccgccgacgcctgtttctcgccttcaatga

SEQ ID NO: 20580 - DNA, 37 bp, Artificial Sequence
  Synthetic oligonucleotide
tgatgcccttcctcccattcagacaacagcacgctga

SEQ ID NO: 20581 - DNA, 37 bp, Artificial Sequence
  Synthetic oligonucleotide
gaccgctccttccatctcacgctgcccagccttgtga

SEQ ID NO: 20582 - DNA, 38 bp, Artificial Sequence
  Synthetic oligonucleotide
attcgagctagcctccaccgttatcccgacttttttga

SEQ ID NO: 20583 - DNA, 35 bp, Artificial Sequence
  Synthetic oligonucleotide
ttgatcttcctctgaggggacaccccccctgacac

SEQ ID NO: 20584 - DNA, 35 bp, Artificial Sequence
  Synthetic oligonucleotide
gccgattcacatcccagtctggcctcctgttgcac

SEQ ID NO: 20585 - DNA, 35 bp, Artificial Sequence
  Synthetic oligonucleotide
gcactcggctgtactcttttaattgtcggccctcc

SEQ ID NO: 20586 - DNA, 35 bp, Artificial Sequence
  Synthetic oligonucleotide
aacccccactccactaattggcactggatcaattc

SEQ ID NO: 20587 - DNA, 35 bp, Artificial Sequence
  Synthetic oligonucleotide
acccctcatcctcacctccacctgctttggaggca

SEQ ID NO: 20588 - DNA, 35 bp, Artificial Sequence
  Synthetic oligonucleotide
atggtaacgaaaggaggaacgggcaaaggtgaaga

SEQ ID NO: 20589 - DNA, 37 bp, Artificial Sequence
  Synthetic oligonucleotide
gttgcgtacaagggaggggcgaacaggggaggtgcga

SEQ ID NO: 20590 - DNA, 38 bp, Artificial Sequence
  Synthetic oligonucleotide
acttccccgttcacctaggactcaccgaaggcccttga

SEQ ID NO: 20591 - DNA, 35 bp, Artificial Sequence
  Synthetic oligonucleotide
tgacccgatacacaactgcaacaatcaacgttcta

SEQ ID NO: 20592 - DNA, 35 bp, Artificial Sequence
  Synthetic oligonucleotide
atagacgaaaggagtgggtggatggcggtgtagta

SEQ ID NO: 20593 - DNA, 35 bp, Artificial Sequence
  Synthetic oligonucleotide
aatcacggcatcactctcatgcgccgttcacaatc

SEQ ID NO: 20594 - DNA, 35 bp, Artificial Sequence
  Synthetic oligonucleotide
gcgatgaaaagtagagaggggttggatgagaggcg

SEQ ID NO: 20595 - DNA, 35 bp, Artificial Sequence
  Synthetic oligonucleotide
ttcggagtgcacctgcgttgtgccctttgcccctt

SEQ ID NO: 20596 - DNA, 36 bp, Artificial Sequence
  Synthetic oligonucleotide
tccccgtcagtctcgctgatggctctatccccccaa

SEQ ID NO: 20597 - DNA, 36 bp, Artificial Sequence
  Synthetic oligonucleotide
tattgtcaccagccgcctgtcccccaccaatgcgaa

SEQ ID NO: 20598 - DNA, 35 bp, Artificial Sequence
  Synthetic oligonucleotide
gtggagacttccattttgttcgttcatttcctgca

SEQ ID NO: 20599 - DNA, 37 bp, Artificial Sequence
  Synthetic oligonucleotide
agccggtcgccagatcgctgcgtccctctttcccaga

SEQ ID NO: 20600 - DNA, 37 bp, Artificial Sequence
  Synthetic oligonucleotide
tcatacctcacatgtcatcagttcccgcgtgtgccga

SEQ ID NO: 20601 - DNA, 35 bp, Artificial Sequence
  Synthetic oligonucleotide
tcatgttcgggacgattctgtacgacctctccacc

SEQ ID NO: 20602 - DNA, 35 bp, Artificial Sequence
  Synthetic oligonucleotide
tatgccaaccgcatttcagggaccctcacgcatcc

SEQ ID NO: 20603 - DNA, 35 bp, Artificial Sequence
  Synthetic oligonucleotide
ttgagcaaacctgtgcaccatgttacctttagctc

SEQ ID NO: 20604 - DNA, 35 bp, Artificial Sequence
  Synthetic oligonucleotide
ttgctcgacaatgcaccccgaccctgtcttcccat

SEQ ID NO: 20605 - DNA, 35 bp, Artificial Sequence
  Synthetic oligonucleotide
gcatcacgcgcgtgtgccccccgcgtgtccactct

SEQ ID NO: 20606 - DNA, 36 bp, Artificial Sequence
  Synthetic oligonucleotide
gcaccgcatcacgctccttcatccgcgggcctgcca

SEQ ID NO: 20607 - DNA, 37 bp, Artificial Sequence
  Synthetic oligonucleotide
gccaacccacgtgcctccgaatccagtctgatcagga

SEQ ID NO: 20608 - DNA, 35 bp, Artificial Sequence
  Synthetic oligonucleotide
aataaggcggagggagggaacggttaatgatggga

SEQ ID NO: 20609 - DNA, 37 bp, Artificial Sequence
  Synthetic oligonucleotide
tgttcgacggggggaggggaggggatgagctggtgga

SEQ ID NO: 20610 - DNA, 35 bp, Artificial Sequence
  Synthetic oligonucleotide
tcaggcggtacgtttgttactactgtccaccgccc

SEQ ID NO: 20611 - DNA, 35 bp, Artificial Sequence
  Synthetic oligonucleotide
gctaatgcaacaatccgccgcccctccgcctgagc

SEQ ID NO: 20612 - DNA, 35 bp, Artificial Sequence
  Synthetic oligonucleotide
gccactgccctcagatttactctcgctcttgtccg

SEQ ID NO: 20613 - DNA, 35 bp, Artificial Sequence
  Synthetic oligonucleotide
tcataaaggggcgaggggcggttgggaaggtcggg

SEQ ID NO: 20614 - DNA, 38 bp, Artificial Sequence
  Synthetic oligonucleotide
gttgggcggaccggaaaaaggcagggataacggggtga

SEQ ID NO: 20615 - DNA, 35 bp, Artificial Sequence
  Synthetic oligonucleotide
gatctaccctcggccgatacctcgtccccatgctc

SEQ ID NO: 20616 - DNA, 35 bp, Artificial Sequence
  Synthetic oligonucleotide
acccgcctcttaccaacgcccttacgcgatctcat

SEQ ID NO: 20617 - DNA, 35 bp, Artificial Sequence
  Synthetic oligonucleotide
tgcgagtctacacatccactgccatcaatgtacct

SEQ ID NO: 20618 - DNA, 35 bp, Artificial Sequence
  Synthetic oligonucleotide
tgacaacagtacatccgtcgtcctaccagctataa

SEQ ID NO: 20619 - DNA, 37 bp, Artificial Sequence
  Synthetic oligonucleotide
actgtccgccgcctcagcaccatcattttctgccgga

SEQ ID NO: 20620 - DNA, 37 bp, Artificial Sequence
  Synthetic oligonucleotide
tctgacaacacccacccggccatccgcacctctgtga

SEQ ID NO: 20621 - DNA, 37 bp, Artificial Sequence
  Synthetic oligonucleotide
gcagggaccgcgggtcgttgtttttcttcccttttga

SEQ ID NO: 20622 - DNA, 36 bp, Artificial Sequence
  Synthetic oligonucleotide
taaccgtcacaagcaatctggttgtcatctctcgta

SEQ ID NO: 20623 - DNA, 35 bp, Artificial Sequence
  Synthetic oligonucleotide
accccactcgtcttaagctcccgttctgttgacgc

SEQ ID NO: 20624 - DNA, 35 bp, Artificial Sequence
  Synthetic oligonucleotide
atgcccgccttcgctgtcgttcacataatttccgt

SEQ ID NO: 20625 - DNA, 36 bp, Artificial Sequence
  Synthetic oligonucleotide
gcaccggtccactcgtgggacacgcccaccacctaa

SEQ ID NO: 20626 - DNA, 37 bp, Artificial Sequence
  Synthetic oligonucleotide
tccacctacatacactttatgtccgtcccgtagggga

SEQ ID NO: 20627 - DNA, 35 bp, Artificial Sequence
  Synthetic oligonucleotide
gacccccaggcctccatgaattgcttttccgctga

SEQ ID NO: 20628 - DNA, 35 bp, Artificial Sequence
  Synthetic oligonucleotide
tgctacctttcgatcagtttagcccttccactgta

SEQ ID NO: 20629 - DNA, 35 bp, Artificial Sequence
  Synthetic oligonucleotide
gtcaaggtccatcctgttgcttactttacttacgc

SEQ ID NO: 20630 - DNA, 35 bp, Artificial Sequence
  Synthetic oligonucleotide
tacgacgacccacgacactgcggaatcactcgctc

SEQ ID NO: 20631 - DNA, 35 bp, Artificial Sequence
  Synthetic oligonucleotide
atcatcacagccttctggcacctgagttccaacca

SEQ ID NO: 20632 - DNA, 35 bp, Artificial Sequence
  Synthetic oligonucleotide
gaggaacgggaatgaggggtacggggggtcactga

SEQ ID NO: 20633 - DNA, 36 bp, Artificial Sequence
  Synthetic oligonucleotide
gacccgcccatagtttagctccatgtacggctttta

SEQ ID NO: 20634 - DNA, 33 bp, Artificial Sequence
  Synthetic oligonucleotide
tctccaccctcaattcgccatgggagcccgtcc

SEQ ID NO: 20635 - DNA, 35 bp, Artificial Sequence
  Synthetic oligonucleotide
ttatgcccttcgttcccagcagtctctaccgactc

SEQ ID NO: 20636 - DNA, 38 bp, Artificial Sequence
  Synthetic oligonucleotide
agcgggtggtaggggggggtgttactgcgtggtggtga

SEQ ID NO: 20637 - DNA, 37 bp, Artificial Sequence
  Synthetic oligonucleotide
tctacacctcgcggtccgcctggcgactattccttga

SEQ ID NO: 20638 - DNA, 37 bp, Artificial Sequence
  Synthetic oligonucleotide
tgagactcaggcaagacagcgaggaaggaggggaaga

SEQ ID NO: 20639 - DNA, 37 bp, Artificial Sequence
  Synthetic oligonucleotide
acctgcacgaccattttgccgtgtggcacacccccga

SEQ ID NO: 20640 - DNA, 37 bp, Artificial Sequence
  Synthetic oligonucleotide
ggatgggaggggaatagacgggttcagtcgcaaagga

SEQ ID NO: 20641 - DNA, 35 bp, Artificial Sequence
  Synthetic oligonucleotide
gggatgaccaattaaagtacttaggaggggaggga

SEQ ID NO: 20642 - DNA, 35 bp, Artificial Sequence
  Synthetic oligonucleotide
tacctaccgggaccgtaagaaggggtgggatgggc

SEQ ID NO: 20643 - DNA, 35 bp, Artificial Sequence
  Synthetic oligonucleotide
accttcacctatacgcgttacaacgcctgggcttc

SEQ ID NO: 20644 - DNA, 36 bp, Artificial Sequence
  Synthetic oligonucleotide
gacgttcgccctagccctcttgcgggaccattcaca

SEQ ID NO: 20645 - DNA, 35 bp, Artificial Sequence
  Synthetic oligonucleotide
tcacgctccatctcaattctatctcagccgtgcca

SEQ ID NO: 20646 - DNA, 36 bp, Artificial Sequence
  Synthetic oligonucleotide
agccccctgtgctgcctaaattctggtgctaatcca

SEQ ID NO: 20647 - DNA, 38 bp, Artificial Sequence
  Synthetic oligonucleotide
gccgcccgttgttcctgcccgcgtcaccactcccatga

SEQ ID NO: 20648 - DNA, 36 bp, Artificial Sequence
  Synthetic oligonucleotide
ccccgcgtcccgctcactgctcctccgtgaatttga

SEQ ID NO: 20649 - DNA, 35 bp, Artificial Sequence
  Synthetic oligonucleotide
tgctccacccgtgcgtaactaatccgtctcttata

SEQ ID NO: 20650 - DNA, 35 bp, Artificial Sequence
  Synthetic oligonucleotide
actgttcgcctgttgtttcgttttatcctggaatc

SEQ ID NO: 20651 - DNA, 35 bp, Artificial Sequence
  Synthetic oligonucleotide
ataccaacaccaccgaagccgcccacccatagagg

SEQ ID NO: 20652 - DNA, 35 bp, Artificial Sequence
  Synthetic oligonucleotide
gcgagggtccaccggagtatgggggcgtggaaggg

SEQ ID NO: 20653 - DNA, 35 bp, Artificial Sequence
  Synthetic oligonucleotide
agaggtaggcctgacgtccatttcgcccgatgcct

SEQ ID NO: 20654 - DNA, 35 bp, Artificial Sequence
  Synthetic oligonucleotide
aaccctgacatccttcagacattaggtcgatcttt

SEQ ID NO: 20655 - DNA, 37 bp, Artificial Sequence
  Synthetic oligonucleotide
gagcacaaattgacggttagggaacggggcggaggga

SEQ ID NO: 20656 - DNA, 36 bp, Artificial Sequence
  Synthetic oligonucleotide
ttagtgggatgggggtggaatatgggtagggagtga

SEQ ID NO: 20657 - DNA, 35 bp, Artificial Sequence
  Synthetic oligonucleotide
acaacgaccccgctatgattcaatgccccatgttc

SEQ ID NO: 20658 - DNA, 35 bp, Artificial Sequence
  Synthetic oligonucleotide
aatggggggcccggtctgtcctgcaaatccttttc

SEQ ID NO: 20659 - DNA, 35 bp, Artificial Sequence
  Synthetic oligonucleotide
tcaacaaacccccgttcgcacatcaccttggatat

SEQ ID NO: 20660 - DNA, 35 bp, Artificial Sequence
  Synthetic oligonucleotide
gcgccctccacctgaactcttatctcatgtgtact

SEQ ID NO: 20661 - DNA, 35 bp, Artificial Sequence
  Synthetic oligonucleotide
gatgcccgtgccggatgtgacccttctcgtctgct

SEQ ID NO: 20662 - DNA, 38 bp, Artificial Sequence
  Synthetic oligonucleotide
gtgccggtcaaagctaatttacataccgccttgcctga

SEQ ID NO: 20663 - DNA, 37 bp, Artificial Sequence
  Synthetic oligonucleotide
atgaacatcagaaagggcatgggggggggtagattga

SEQ ID NO: 20664 - DNA, 38 bp, Artificial Sequence
  Synthetic oligonucleotide
tcccatcggtcataggatccgtggctacccctttttga

SEQ ID NO: 20665 - DNA, 35 bp, Artificial Sequence
  Synthetic oligonucleotide
actaccctgcgcttaagctgaagcccttttccttc

SEQ ID NO: 20666 - DNA, 35 bp, Artificial Sequence
  Synthetic oligonucleotide
attgcctgactgactctcatagttgcactcttgtt

SEQ ID NO: 20667 - DNA, 38 bp, Artificial Sequence
  Synthetic oligonucleotide
acgtgccccctgccgatgggccttttgctggttggtga

SEQ ID NO: 20668 - DNA, 38 bp, Artificial Sequence
  Synthetic oligonucleotide
tgtttaacacacatgaccttaggcctgcacccctgtga

SEQ ID NO: 20669 - DNA, 35 bp, Artificial Sequence
  Synthetic oligonucleotide
tgccaccacctcgttacagttgatcattggtcccg

SEQ ID NO: 20670 - DNA, 35 bp, Artificial Sequence
  Synthetic oligonucleotide
ttgcacccttcttgctggacatgtacctaccatcg

SEQ ID NO: 20671 - DNA, 35 bp, Artificial Sequence
  Synthetic oligonucleotide
tcacactcgctttctaggtcttcatccgttttcat

SEQ ID NO: 20672 - DNA, 35 bp, Artificial Sequence
  Synthetic oligonucleotide
aggtaacccctggggccccttcgtgcttattccct

SEQ ID NO: 20673 - DNA, 35 bp, Artificial Sequence
  Synthetic oligonucleotide
gctgctccacgtagtactggcggtgcaccccttct

SEQ ID NO: 20674 - DNA, 35 bp, Artificial Sequence
  Synthetic oligonucleotide
gacatccaccgacctacctctataatactgggaaa

SEQ ID NO: 20675 - DNA, 36 bp, Artificial Sequence
  Synthetic oligonucleotide
gcaacggtcagtccaccgctttactccaccctacca

SEQ ID NO: 20676 - DNA, 37 bp, Artificial Sequence
  Synthetic oligonucleotide
tctgaggaagaggggaagaaggagagaggttaacaga

SEQ ID NO: 20677 - DNA, 38 bp, Artificial Sequence
  Synthetic oligonucleotide
gtacacgtcgtaggctctctcattacttctttgcgtga

SEQ ID NO: 20678 - DNA, 38 bp, Artificial Sequence
  Synthetic oligonucleotide
gaagcgaacgctagcttggcccatcatcacacacttga

SEQ ID NO: 20679 - DNA, 38 bp, Artificial Sequence
  Synthetic oligonucleotide
tgacattgaaggaagcggatctgggggggcgggcttga

SEQ ID NO: 20680 - DNA, 35 bp, Artificial Sequence
  Synthetic oligonucleotide
ttaacccgaccaccactagaggatccatctgcccc

SEQ ID NO: 20681 - DNA, 35 bp, Artificial Sequence
  Synthetic oligonucleotide
aacaaggtagcatgcccaagcctgaagcctctctc

SEQ ID NO: 20682 - DNA, 35 bp, Artificial Sequence
  Synthetic oligonucleotide
gaccaaggcacgattccgctcacacagcatatggt

SEQ ID NO: 20683 - DNA, 36 bp, Artificial Sequence
  Synthetic oligonucleotide
atggtacgggcacttttgtactcttgcaaccataca

SEQ ID NO: 20684 - DNA, 37 bp, Artificial Sequence
  Synthetic oligonucleotide
gtgcattatctccatagtatccagctcccctcgccga

SEQ ID NO: 20685 - DNA, 36 bp, Artificial Sequence
  Synthetic oligonucleotide
acccgctatcagctgccgatccaccgcacctagtga

SEQ ID NO: 20686 - DNA, 38 bp, Artificial Sequence
  Synthetic oligonucleotide
gcacaggcgggagagagggcggtcggaatatgaggtga

SEQ ID NO: 20687 - DNA, 35 bp, Artificial Sequence
  Synthetic oligonucleotide
aaccagacccaccgattagtcccgtcggcttttcc

SEQ ID NO: 20688 - DNA, 35 bp, Artificial Sequence
  Synthetic oligonucleotide
tttcgtcgcggggcctcttcgccttgcttcctcct

SEQ ID NO: 20689 - DNA, 38 bp, Artificial Sequence
  Synthetic oligonucleotide
tgatcactacatttggtcccacgttgtctttccattga

SEQ ID NO: 20690 - DNA, 35 bp, Artificial Sequence
  Synthetic oligonucleotide
ttccccgaacctgcaactcgtaccaccaagtgacc

SEQ ID NO: 20691 - DNA, 35 bp, Artificial Sequence
  Synthetic oligonucleotide
acaaccaaggctctgaccacgaccgtccctgtcat

SEQ ID NO: 20692 - DNA, 35 bp, Artificial Sequence
  Synthetic oligonucleotide
gtgtgcgttacatcaccgtaaactgttggctcttt

SEQ ID NO: 20693 - DNA, 35 bp, Artificial Sequence
  Synthetic oligonucleotide
agatcgcgccggccctcatttccgtcgatatatca

SEQ ID NO: 20694 - DNA, 38 bp, Artificial Sequence
  Synthetic oligonucleotide
ttgagcaaatgggagaagggagcggggagggcatctga

SEQ ID NO: 20695 - DNA, 38 bp, Artificial Sequence
  Synthetic oligonucleotide
gacggggagtaggagggaggatgatgacagctccgtga

SEQ ID NO: 20696 - DNA, 36 bp, Artificial Sequence
  Synthetic oligonucleotide
acgtgtggggtggtgggcatgggcgggtaggattga

SEQ ID NO: 20697 - DNA, 38 bp, Artificial Sequence
  Synthetic oligonucleotide
tatcatgcgcggtgtactaccctatctgcacttcttga

SEQ ID NO: 20698 - DNA, 35 bp, Artificial Sequence
  Synthetic oligonucleotide
ttgacacggctcatacctctcttcactgaatgtcc

SEQ ID NO: 20699 - DNA, 35 bp, Artificial Sequence
  Synthetic oligonucleotide
gccgggaggggtagggtggtgacacggaacacggc

SEQ ID NO: 20700 - DNA, 35 bp, Artificial Sequence
  Synthetic oligonucleotide
ttcccgccgccggttcctcttgctacccttggttg

SEQ ID NO: 20701 - DNA, 36 bp, Artificial Sequence
  Synthetic oligonucleotide
tccaccgtggttctcgcgttaattttccaatgccca

SEQ ID NO: 20702 - DNA, 36 bp, Artificial Sequence
  Synthetic oligonucleotide
tatggtccatccctcgtgccgctccaagtgctccca

SEQ ID NO: 20703 - DNA, 37 bp, Artificial Sequence
  Synthetic oligonucleotide
tgggtggcgatggggggtgggaatgctgagcatacga

SEQ ID NO: 20704 - DNA, 37 bp, Artificial Sequence
  Synthetic oligonucleotide
gtggggctggggagatcaaggtagtaggggttttgga

SEQ ID NO: 20705 - DNA, 38 bp, Artificial Sequence
  Synthetic oligonucleotide
tgcctgtccctccacacgtttaggccaccccagtttga

SEQ ID NO: 20706 - DNA, 35 bp, Artificial Sequence
  Synthetic oligonucleotide
gcgagatcctcgatcgacgttttttacctgtttgc

SEQ ID NO: 20707 - DNA, 35 bp, Artificial Sequence
  Synthetic oligonucleotide
aacgcggttggccgccgtgttttttgcctctaatc

SEQ ID NO: 20708 - DNA, 35 bp, Artificial Sequence
  Synthetic oligonucleotide
gaacgggtccgggtttgaggggcggtaaggtggtg

SEQ ID NO: 20709 - DNA, 36 bp, Artificial Sequence
  Synthetic oligonucleotide
tccgctccttacgttgctgaccgtcttacccccgaa

SEQ ID NO: 20710 - DNA, 36 bp, Artificial Sequence
  Synthetic oligonucleotide
tcatcactgtcattatcctgatatgaacctcccaca

SEQ ID NO: 20711 - DNA, 36 bp, Artificial Sequence
  Synthetic oligonucleotide
cttgtcgcaacatcttccttccccgggcttgaccga

SEQ ID NO: 20712 - DNA, 38 bp, Artificial Sequence
  Synthetic oligonucleotide
tcattagccctgtgccaccgctacctacactcgcttga

SEQ ID NO: 20713 - DNA, 35 bp, Artificial Sequence
  Synthetic oligonucleotide
gtctccatcggtcatgcccacctcgcgatgcacta

SEQ ID NO: 20714 - DNA, 35 bp, Artificial Sequence
  Synthetic oligonucleotide
tgttccgctgtctcactcccccgagtttcccaccc

SEQ ID NO: 20715 - DNA, 35 bp, Artificial Sequence
  Synthetic oligonucleotide
tctattcccatgcctcgttgtcgacgtactaacgc

SEQ ID NO: 20716 - DNA, 35 bp, Artificial Sequence
  Synthetic oligonucleotide
tgcaccttcccccgcatcatggtacagcgttacgc

SEQ ID NO: 20717 - DNA, 35 bp, Artificial Sequence
  Synthetic oligonucleotide
tcaggcacgatcgcatctaggttttcgccctccct

SEQ ID NO: 20718 - DNA, 35 bp, Artificial Sequence
  Synthetic oligonucleotide
tgcgttcgatcgctttgtcccccctcgccctaggt

SEQ ID NO: 20719 - DNA, 35 bp, Artificial Sequence
  Synthetic oligonucleotide
aacacgtcgccccgctgcctgccttatgattcgtt

SEQ ID NO: 20720 - DNA, 36 bp, Artificial Sequence
  Synthetic oligonucleotide
tagcaaaccggcggcccagctatttgcaccatctca

SEQ ID NO: 20721 - DNA, 37 bp, Artificial Sequence
  Synthetic oligonucleotide
atgcatgcccgctctcgataacgttacctacatccga

SEQ ID NO: 20722 - DNA, 37 bp, Artificial Sequence
  Synthetic oligonucleotide
gtaccaacccaccgttgacgaaattttcaaatttcga

SEQ ID NO: 20723 - DNA, 35 bp, Artificial Sequence
  Synthetic oligonucleotide
acatgccttccgcgtgttttttacctttgccacat

SEQ ID NO: 20724 - DNA, 36 bp, Artificial Sequence
  Synthetic oligonucleotide
ttggggggaaggggataggacaggtcagcatacaca

SEQ ID NO: 20725 - DNA, 36 bp, Artificial Sequence
  Synthetic oligonucleotide
atgccgggatggagtaccgagcatacgtttttctca

SEQ ID NO: 20726 - DNA, 37 bp, Artificial Sequence
  Synthetic oligonucleotide
gaggacgggggggaggttgttgtcgtgggaaaacgga

SEQ ID NO: 20727 - DNA, 37 bp, Artificial Sequence
  Synthetic oligonucleotide
gatcctcgactagcacacatgcgcggcccacacctga

SEQ ID NO: 20728 - DNA, 37 bp, Artificial Sequence
  Synthetic oligonucleotide
gtgggagggtggggaaggcgagtgacggattgtttga

SEQ ID NO: 20729 - DNA, 35 bp, Artificial Sequence
  Synthetic oligonucleotide
tagtgccctttgccccgcccggctatgtagccctc

SEQ ID NO: 20730 - DNA, 35 bp, Artificial Sequence
  Synthetic oligonucleotide
gacctaacgcgggagctacgggtggtgtgggggtc

SEQ ID NO: 20731 - DNA, 35 bp, Artificial Sequence
  Synthetic oligonucleotide
gagtgcgtaacgcgatctatctatcttcacggttc

SEQ ID NO: 20732 - DNA, 35 bp, Artificial Sequence
  Synthetic oligonucleotide
tgtgcgcctgacgtcttctggtcttattcatccct

SEQ ID NO: 20733 - DNA, 36 bp, Artificial Sequence
  Synthetic oligonucleotide
gctcacaccgttcaatcaatcatcggatcactccaa

SEQ ID NO: 20734 - DNA, 35 bp, Artificial Sequence
  Synthetic oligonucleotide
gttacctcctgcctcactcgccacttttggcggaa

SEQ ID NO: 20735 - DNA, 36 bp, Artificial Sequence
  Synthetic oligonucleotide
tccaccgtgcccggccggtttcttgtttctagttca

SEQ ID NO: 20736 - DNA, 37 bp, Artificial Sequence
  Synthetic oligonucleotide
gtttcagcagcccgatctatctcccacttcaaggcga

SEQ ID NO: 20737 - DNA, 38 bp, Artificial Sequence
  Synthetic oligonucleotide
tccacttgccgttgcccgtccattatggtctcacttga

SEQ ID NO: 20738 - DNA, 35 bp, Artificial Sequence
  Synthetic oligonucleotide
ttattgtgcccctgttatggttcccgtatggtctc

SEQ ID NO: 20739 - DNA, 35 bp, Artificial Sequence
  Synthetic oligonucleotide
gccaaaggcaagcacaaaacggagagggggtacgg

SEQ ID NO: 20740 - DNA, 38 bp, Artificial Sequence
  Synthetic oligonucleotide
tacagacagcccctgaaacgccacttcttgcatgctga

SEQ ID NO: 20741 - DNA, 38 bp, Artificial Sequence
  Synthetic oligonucleotide
tttaccgccgtatctgtcttgcgcccttacacacgtga

SEQ ID NO: 20742 - DNA, 38 bp, Artificial Sequence
  Synthetic oligonucleotide
tcatcagccgtatggaggttggggggctagggggttga

SEQ ID NO: 20743 - DNA, 38 bp, Artificial Sequence
  Synthetic oligonucleotide
actggagccaccgcaaccttacagccctgccactttga

SEQ ID NO: 20744 - DNA, 36 bp, Artificial Sequence
  Synthetic oligonucleotide
tcacgcctggcccccatacaatgtatctgttacata

SEQ ID NO: 20745 - DNA, 35 bp, Artificial Sequence
  Synthetic oligonucleotide
gttatgcgcgcaccgtttgccttaccacccgccgc

SEQ ID NO: 20746 - DNA, 35 bp, Artificial Sequence
  Synthetic oligonucleotide
gacttgtacccggggtgcctcgccaattattttgc

SEQ ID NO: 20747 - DNA, 35 bp, Artificial Sequence
  Synthetic oligonucleotide
acgtccgaccctaaaacctgcccagccgccaccaa

SEQ ID NO: 20748 - DNA, 36 bp, Artificial Sequence
  Synthetic oligonucleotide
gagcttgccactcgagcttcccattgtttgcatcca

SEQ ID NO: 20749 - DNA, 37 bp, Artificial Sequence
  Synthetic oligonucleotide
accggagcatctgttgccagcaagccctccccacaga

SEQ ID NO: 20750 - DNA, 37 bp, Artificial Sequence
  Synthetic oligonucleotide
taaggactgggggaaggagttgatgggggatgtggga

SEQ ID NO: 20751 - DNA, 35 bp, Artificial Sequence
  Synthetic oligonucleotide
tgaaaccgcacgatacggccaccaccgacttgcac

SEQ ID NO: 20752 - DNA, 35 bp, Artificial Sequence
  Synthetic oligonucleotide
attgactgagggcggtgaggatagcgtgtgccggg

SEQ ID NO: 20753 - DNA, 35 bp, Artificial Sequence
  Synthetic oligonucleotide
gtcggtaagcctcccgtactaactcaccttctcat

SEQ ID NO: 20754 - DNA, 35 bp, Artificial Sequence
  Synthetic oligonucleotide
gaccccttcatggcctccttcccttgagactctat

SEQ ID NO: 20755 - DNA, 35 bp, Artificial Sequence
  Synthetic oligonucleotide
ttcactggttgtaacccaggtgtgcctccacccga

SEQ ID NO: 20756 - DNA, 37 bp, Artificial Sequence
  Synthetic oligonucleotide
gcacacgcacgtgcgtcgcatacctatctttgtggga

SEQ ID NO: 20757 - DNA, 35 bp, Artificial Sequence
  Synthetic oligonucleotide
gtctgcgcctcctatatggtcttctgcccgccgcc

SEQ ID NO: 20758 - DNA, 35 bp, Artificial Sequence
  Synthetic oligonucleotide
gccgtggcagtagggggaagaaggggtcatgaagt

SEQ ID NO: 20759 - DNA, 35 bp, Artificial Sequence
  Synthetic oligonucleotide
aacacacacctccaggcgccgcttccagaccgagt

SEQ ID NO: 20760 - DNA, 36 bp, Artificial Sequence
  Synthetic oligonucleotide
tcactgccctcaggctgcctttactcttggggtcca

SEQ ID NO: 20761 - DNA, 37 bp, Artificial Sequence
  Synthetic oligonucleotide
atcagccgagcgctatctgactactcactcctctgga

SEQ ID NO: 20762 - DNA, 38 bp, Artificial Sequence
  Synthetic oligonucleotide
gacacacgctctgctccccttcactcctgacaacgtga

SEQ ID NO: 20763 - DNA, 38 bp, Artificial Sequence
  Synthetic oligonucleotide
atccgcatcagcctacgggcccaatctttgcctcttga

SEQ ID NO: 20764 - DNA, 35 bp, Artificial Sequence
  Synthetic oligonucleotide
acataccatcgcgtacagaacgtcgggcccttgtt

SEQ ID NO: 20765 - DNA, 36 bp, Artificial Sequence
  Synthetic oligonucleotide
atgacccggtccgtaatagcagccaccccatagcca

SEQ ID NO: 20766 - DNA, 37 bp, Artificial Sequence
  Synthetic oligonucleotide
attgtccggcgatggatgcgcctttctacctccctga

SEQ ID NO: 20767 - DNA, 35 bp, Artificial Sequence
  Synthetic oligonucleotide
tgctcaccagatgcaaccctgtccgtccttgttcc

SEQ ID NO: 20768 - DNA, 35 bp, Artificial Sequence
  Synthetic oligonucleotide
gagctgggccacaccccggatataacggtaaacct

SEQ ID NO: 20769 - DNA, 36 bp, Artificial Sequence
  Synthetic oligonucleotide
ataacaaccgggtagggagggggcatggtgaaggaa

SEQ ID NO: 20770 - DNA, 36 bp, Artificial Sequence
  Synthetic oligonucleotide
tcacgtcacgcctctagtatcgcaactctgataaca

SEQ ID NO: 20771 - DNA, 37 bp, Artificial Sequence
  Synthetic oligonucleotide
tctgcgccagccttgttcccctttttgttaccgccga

SEQ ID NO: 20772 - DNA, 37 bp, Artificial Sequence
  Synthetic oligonucleotide
ttgctgctccctttccgcccgaccttgctttcctgga

SEQ ID NO: 20773 - DNA, 36 bp, Artificial Sequence
  Synthetic oligonucleotide
tagaatccacccgctctgtcccttctcgagacatta

SEQ ID NO: 20774 - DNA, 36 bp, Artificial Sequence
  Synthetic oligonucleotide
atctccaccgcactgcttgtcaacccgggcccggac

SEQ ID NO: 20775 - DNA, 35 bp, Artificial Sequence
  Synthetic oligonucleotide
ttcgctggccactgtttccttcaatttggatttct

SEQ ID NO: 20776 - DNA, 35 bp, Artificial Sequence
  Synthetic oligonucleotide
ttctcctgcaccagtccctgcaagccccatgagtt

SEQ ID NO: 20777 - DNA, 36 bp, Artificial Sequence
  Synthetic oligonucleotide
ggcgggggggagggaggaaagggggagaaggacaaa

SEQ ID NO: 20778 - DNA, 32 bp, Artificial Sequence
  Synthetic oligonucleotide
gtgcctcccgctattttcgaactgtcaaggaa

SEQ ID NO: 20779 - DNA, 36 bp, Artificial Sequence
  Synthetic oligonucleotide
tccatctctcgggtgctttgatccggtctatctcca

SEQ ID NO: 20780 - DNA, 35 bp, Artificial Sequence
  Synthetic oligonucleotide
tgccgtgcccacctttaaactttgattctcgctca

SEQ ID NO: 20781 - DNA, 35 bp, Artificial Sequence
  Synthetic oligonucleotide
actgccggtgggggatccaggagagggtacggaga

SEQ ID NO: 20782 - DNA, 37 bp, Artificial Sequence
  Synthetic oligonucleotide
accacccctccatttgccactcgggctcttgttgaga

SEQ ID NO: 20783 - DNA, 38 bp, Artificial Sequence
  Synthetic oligonucleotide
gccttgcatcctccccccgcattggaagtgcacactga

SEQ ID NO: 20784 - DNA, 38 bp, Artificial Sequence
  Synthetic oligonucleotide
taggggtgccttgactggaggtaacagggagggggtga

SEQ ID NO: 20785 - DNA, 37 bp, Artificial Sequence
  Synthetic oligonucleotide
gcaagggggggcggaaatcacggagtccaggatttga

SEQ ID NO: 20786 - DNA, 36 bp, Artificial Sequence
  Synthetic oligonucleotide
gatccagcgttcgtatcatcaccactcccgctttga

SEQ ID NO: 20787 - DNA, 35 bp, Artificial Sequence
  Synthetic oligonucleotide
aacaccatgttgttgctgctgttcactatcacacc

SEQ ID NO: 20788 - DNA, 35 bp, Artificial Sequence
  Synthetic oligonucleotide
gacggtcgccggtccaagcggtctgtcttcgcccc

SEQ ID NO: 20789 - DNA, 35 bp, Artificial Sequence
  Synthetic oligonucleotide
aacgggtgctttacgtttggcattttgtttcctcc

SEQ ID NO: 20790 - DNA, 35 bp, Artificial Sequence
  Synthetic oligonucleotide
actcatcccgaccccatcccaggacaaaagagttc

SEQ ID NO: 20791 - DNA, 35 bp, Artificial Sequence
  Synthetic oligonucleotide
tcttgacaccatcctgcgatcaccagtcttatgca

SEQ ID NO: 20792 - DNA, 35 bp, Artificial Sequence
  Synthetic oligonucleotide
agccaacgacgtccccttctctgatagcttgttca

SEQ ID NO: 20793 - DNA, 36 bp, Artificial Sequence
  Synthetic oligonucleotide
accacctgtcgccaatcagccgtcgtaacaccccga

SEQ ID NO: 20794 - DNA, 37 bp, Artificial Sequence
  Synthetic oligonucleotide
gtacactctccgccacatctccactagactcaggcga

SEQ ID NO: 20795 - DNA, 38 bp, Artificial Sequence
  Synthetic oligonucleotide
tgtaacaccgccctctatactatgatgcacccatgtga

SEQ ID NO: 20796 - DNA, 36 bp, Artificial Sequence
  Synthetic oligonucleotide
attcgaccccactcctctcctgttattgacctgtta

SEQ ID NO: 20797 - DNA, 35 bp, Artificial Sequence
  Synthetic oligonucleotide
tggacaccctccctcgttagtggctcacaactgac

SEQ ID NO: 20798 - DNA, 35 bp, Artificial Sequence
  Synthetic oligonucleotide
taacccgttagtggttttctcccgttcgcatcccg

SEQ ID NO: 20799 - DNA, 35 bp, Artificial Sequence
  Synthetic oligonucleotide
gtactgcccacccgctacacgccccggattattgg

SEQ ID NO: 20800 - DNA, 32 bp, Artificial Sequence
  Synthetic oligonucleotide
gatggtgctatcttgaatctataccagcccct

SEQ ID NO: 20801 - DNA, 35 bp, Artificial Sequence
  Synthetic oligonucleotide
tccagtgcacaaaccaggtgcttgcgtgtttccct

SEQ ID NO: 20802 - DNA, 36 bp, Artificial Sequence
  Synthetic oligonucleotide
gacaaaccccggcaccccccccatcttggacgcaaa

SEQ ID NO: 20803 - DNA, 37 bp, Artificial Sequence
  Synthetic oligonucleotide
tgtcgccgctatggtctcatgctcaccgcctcattga

SEQ ID NO: 20804 - DNA, 35 bp, Artificial Sequence
  Synthetic oligonucleotide
actaggccgacttaaatgcctgatcctacgccccc

SEQ ID NO: 20805 - DNA, 35 bp, Artificial Sequence
  Synthetic oligonucleotide
tgcgcgcctcagtttcctcttttcatgtctctcgg

SEQ ID NO: 20806 - DNA, 35 bp, Artificial Sequence
  Synthetic oligonucleotide
ggcacacgcgcaccgcttatcaccaccctcccctg

SEQ ID NO: 20807 - DNA, 35 bp, Artificial Sequence
  Synthetic oligonucleotide
tgttccacaaccgtccgtccgcattctcccaactt

SEQ ID NO: 20808 - DNA, 35 bp, Artificial Sequence
  Synthetic oligonucleotide
tcgtacctctcatcgccgttcttcgacgctagttt

SEQ ID NO: 20809 - DNA, 35 bp, Artificial Sequence
  Synthetic oligonucleotide
gcctcactcgatcgatttccacatgcccttataca

SEQ ID NO: 20810 - DNA, 35 bp, Artificial Sequence
  Synthetic oligonucleotide
aaacgagaagtaggggaggaacactcgacacagga

SEQ ID NO: 20811 - DNA, 36 bp, Artificial Sequence
  Synthetic oligonucleotide
accaacgtgctgcagttaactttggaaaggttggta

SEQ ID NO: 20812 - DNA, 36 bp, Artificial Sequence
  Synthetic oligonucleotide
atgtactgcgccgcattcccccgcttccgacctgta

SEQ ID NO: 20813 - DNA, 35 bp, Artificial Sequence
  Synthetic oligonucleotide
tgattcaccctcttgccccgtctccagcttggtta

SEQ ID NO: 20814 - DNA, 35 bp, Artificial Sequence
  Synthetic oligonucleotide
ttgacacccccatgagccggcgaggccgacttcac

SEQ ID NO: 20815 - DNA, 35 bp, Artificial Sequence
  Synthetic oligonucleotide
gcgatgaccttgcaaacaccgccctgcccctcctc

SEQ ID NO: 20816 - DNA, 35 bp, Artificial Sequence
  Synthetic oligonucleotide
agccactacctacagagacttgtactttgatcccg

SEQ ID NO: 20817 - DNA, 35 bp, Artificial Sequence
  Synthetic oligonucleotide
ttccgcgagctacacgttccgtttccacctttcgg

SEQ ID NO: 20818 - DNA, 35 bp, Artificial Sequence
  Synthetic oligonucleotide
actgtactgtgcaccaccatgtaactctgatcgct

SEQ ID NO: 20819 - DNA, 35 bp, Artificial Sequence
  Synthetic oligonucleotide
tgtgcaaaggggggggcgaaaattacagggcagtt

SEQ ID NO: 20820 - DNA, 37 bp, Artificial Sequence
  Synthetic oligonucleotide
gagttgggcgaaaaggcggtaggataacggtgaggga

SEQ ID NO: 20821 - DNA, 38 bp, Artificial Sequence
  Synthetic oligonucleotide
acgagagtacgtaaaagcaaaaatgggtggacgggtga

SEQ ID NO: 20822 - DNA, 35 bp, Artificial Sequence
  Synthetic oligonucleotide
tcctgcgctatcgaggttcttctgcgtttggtccc

SEQ ID NO: 20823 - DNA, 35 bp, Artificial Sequence
  Synthetic oligonucleotide
acccaggtccccgacttccgcctccgagttaattg

SEQ ID NO: 20824 - DNA, 35 bp, Artificial Sequence
  Synthetic oligonucleotide
accatctcactatgtaaccgacctccccgttccct

SEQ ID NO: 20825 - DNA, 36 bp, Artificial Sequence
  Synthetic oligonucleotide
tatcgtaaaaagggggagatggaacggggcggataa

SEQ ID NO: 20826 - DNA, 37 bp, Artificial Sequence
  Synthetic oligonucleotide
gatccgccttgttctgctgatgaagcctcctgcccga

SEQ ID NO: 20827 - DNA, 38 bp, Artificial Sequence
  Synthetic oligonucleotide
aggacacgtagccatccatgcctttcgcctctgcctga

SEQ ID NO: 20828 - DNA, 35 bp, Artificial Sequence
  Synthetic oligonucleotide
tgcactgtacgccggttcaagttccccccacgata

SEQ ID NO: 20829 - DNA, 35 bp, Artificial Sequence
  Synthetic oligonucleotide
tagctgctccgaccgacttcaaccgtacacagcac

SEQ ID NO: 20830 - DNA, 35 bp, Artificial Sequence
  Synthetic oligonucleotide
atgtacagcgaattccgaccaagctccgtgttacc

SEQ ID NO: 20831 - DNA, 35 bp, Artificial Sequence
  Synthetic oligonucleotide
acacggcccctcctgttatccgcacgtgagctact

SEQ ID NO: 20832 - DNA, 35 bp, Artificial Sequence
  Synthetic oligonucleotide
tatgacctgtgacgtcattgttcccaactccttct

SEQ ID NO: 20833 - DNA, 35 bp, Artificial Sequence
  Synthetic oligonucleotide
gcacctatgaccgacgcacgtttcctctgccctaa

SEQ ID NO: 20834 - DNA, 36 bp, Artificial Sequence
  Synthetic oligonucleotide
gatccccccgaattattacatcgccgcactgtcaca

SEQ ID NO: 20835 - DNA, 35 bp, Artificial Sequence
  Synthetic oligonucleotide
tctatctccgccgaggaccgtcccacatatagcca

SEQ ID NO: 20836 - DNA, 36 bp, Artificial Sequence
  Synthetic oligonucleotide
tgtacctgcaacctataacatctgtccccccccgca

SEQ ID NO: 20837 - DNA, 36 bp, Artificial Sequence
  Synthetic oligonucleotide
ggttgtgccctcctgttcgcgccgacgtttcctgca

SEQ ID NO: 20838 - DNA, 37 bp, Artificial Sequence
  Synthetic oligonucleotide
gagacgcgagtacatgggtgtgggggaagaagggaga

SEQ ID NO: 20839 - DNA, 38 bp, Artificial Sequence
  Synthetic oligonucleotide
ggggggaggcggggagcgtggtggcccttaagaaatga

SEQ ID NO: 20840 - DNA, 38 bp, Artificial Sequence
  Synthetic oligonucleotide
aacacatcttgcctgccatttacgactacaatcgctga

SEQ ID NO: 20841 - DNA, 38 bp, Artificial Sequence
  Synthetic oligonucleotide
tgaccccgtcgaccccccgtgctgttgttcgactttga

SEQ ID NO: 20842 - DNA, 34 bp, Artificial Sequence
  Synthetic oligonucleotide
gaggtaatgtcgggtgggttggcggggcggaata

SEQ ID NO: 20843 - DNA, 37 bp, Artificial Sequence
  Synthetic oligonucleotide
gcgccacgcattgcccaagccacacccatgcctcgta

SEQ ID NO: 20844 - DNA, 36 bp, Artificial Sequence
  Synthetic oligonucleotide
agaccacctccacaaacgcgcgccgcgagccgctta

SEQ ID NO: 20845 - DNA, 35 bp, Artificial Sequence
  Synthetic oligonucleotide
gaaaagcgcatccgcctcttcaatttcccgctgac

SEQ ID NO: 20846 - DNA, 35 bp, Artificial Sequence
  Synthetic oligonucleotide
tagatcctgctccaagcagtggaccactcgatacc

SEQ ID NO: 20847 - DNA, 35 bp, Artificial Sequence
  Synthetic oligonucleotide
ggaacggggtaggtacggataggaaagacgaagat

SEQ ID NO: 20848 - DNA, 35 bp, Artificial Sequence
  Synthetic oligonucleotide
ccctctgcatgtctttccgtgcattttccacgtat

SEQ ID NO: 20849 - DNA, 35 bp, Artificial Sequence
  Synthetic oligonucleotide
gatccaccgcactacttaaccctaaccagtcactt

SEQ ID NO: 20850 - DNA, 36 bp, Artificial Sequence
  Synthetic oligonucleotide
gtctctcctcggtcactattacgacctgctttacaa

SEQ ID NO: 20851 - DNA, 36 bp, Artificial Sequence
  Synthetic oligonucleotide
ttccacctcaacctccagtctgtttgcagacttgca

SEQ ID NO: 20852 - DNA, 36 bp, Artificial Sequence
  Synthetic oligonucleotide
ttcagcaataagcggggagggggagggaatggatca

SEQ ID NO: 20853 - DNA, 37 bp, Artificial Sequence
  Synthetic oligonucleotide
tgcgaaacggggggagtgaaattatggggagtgtgga

SEQ ID NO: 20854 - DNA, 38 bp, Artificial Sequence
  Synthetic oligonucleotide
aattcaccgccgaccgtgcgaaggcgcccacctcctga

SEQ ID NO: 20855 - DNA, 35 bp, Artificial Sequence
  Synthetic oligonucleotide
atgtcacctcgccgaagacgctccttcccaacacc

SEQ ID NO: 20856 - DNA, 35 bp, Artificial Sequence
  Synthetic oligonucleotide
tccgacgccttagggcaatttaccaccgcattagc

SEQ ID NO: 20857 - DNA, 35 bp, Artificial Sequence
  Synthetic oligonucleotide
tagtgtggggggagaagtaagggtggaagacggaa

SEQ ID NO: 20858 - DNA, 35 bp, Artificial Sequence
  Synthetic oligonucleotide
tccagccacattaccgccaagcagatccattatca

SEQ ID NO: 20859 - DNA, 36 bp, Artificial Sequence
  Synthetic oligonucleotide
gacggggggatagttaaaataacggaggagaggaga

SEQ ID NO: 20860 - DNA, 37 bp, Artificial Sequence
  Synthetic oligonucleotide
gagagagcccccgctgcttcccactattccaccgcga

SEQ ID NO: 20861 - DNA, 37 bp, Artificial Sequence
  Synthetic oligonucleotide
ttgacactctgctgctcagctacaacacctctctcga

SEQ ID NO: 20862 - DNA, 35 bp, Artificial Sequence
  Synthetic oligonucleotide
gatccgacggccacacgattctggttttccgcata

SEQ ID NO: 20863 - DNA, 36 bp, Artificial Sequence
  Synthetic oligonucleotide
tcctcctacacatgactaccgatacccccggtacaa

SEQ ID NO: 20864 - DNA, 36 bp, Artificial Sequence
  Synthetic oligonucleotide
gagccctgcttcccgaatttgcaccatgcacaccaa

SEQ ID NO: 20865 - DNA, 36 bp, Artificial Sequence
  Synthetic oligonucleotide
gctgcaacagagcactctgccgccgctttttacaca

SEQ ID NO: 20866 - DNA, 37 bp, Artificial Sequence
  Synthetic oligonucleotide
tcaccactcctcgtcgcaatatatcaccccgtgccga

SEQ ID NO: 20867 - DNA, 37 bp, Artificial Sequence
  Synthetic oligonucleotide
gacgccctggttggtgggggggtaaggaaggatggga

SEQ ID NO: 20868 - DNA, 38 bp, Artificial Sequence
  Synthetic oligonucleotide
tgatctcctacgactgctattttcacctgacctcatga

SEQ ID NO: 20869 - DNA, 35 bp, Artificial Sequence
  Synthetic oligonucleotide
tcaccatcatcatcgatgctcccctattcgcttga

SEQ ID NO: 20870 - DNA, 35 bp, Artificial Sequence
  Synthetic oligonucleotide
tcatacgccctgcttcacgcgcatacccgggttta

SEQ ID NO: 20871 - DNA, 35 bp, Artificial Sequence
  Synthetic oligonucleotide
tttgcgctcccatgggactctcccgttgccaacac

SEQ ID NO: 20872 - DNA, 35 bp, Artificial Sequence
  Synthetic oligonucleotide
tgtacgtcaccattccattgtctcggggcccctcg

SEQ ID NO: 20873 - DNA, 35 bp, Artificial Sequence
  Synthetic oligonucleotide
tcaccccacctgtatgccatattatctacagttat

SEQ ID NO: 20874 - DNA, 30 bp, Artificial Sequence
  Synthetic oligonucleotide
tccccatgctcgtttgcctctacctcttaa

SEQ ID NO: 20875 - DNA, 36 bp, Artificial Sequence
  Synthetic oligonucleotide
agccaacaccccgccgcaccacctcatcacggagca

SEQ ID NO: 20876 - DNA, 37 bp, Artificial Sequence
  Synthetic oligonucleotide
tgttaccttcgttctccctggtgccttcgcttttcga

SEQ ID NO: 20877 - DNA, 37 bp, Artificial Sequence
  Synthetic oligonucleotide
aagcactcgcacttcttgttcattttggcccttctga

SEQ ID NO: 20878 - DNA, 35 bp, Artificial Sequence
  Synthetic oligonucleotide
gtttgcgccccgcttattatgtcaaggaaccgcat

SEQ ID NO: 20879 - DNA, 35 bp, Artificial Sequence
  Synthetic oligonucleotide
gaacggacatacctgcctgcttgctctcatgctct

SEQ ID NO: 20880 - DNA, 35 bp, Artificial Sequence
  Synthetic oligonucleotide
gtgcaactgctgcaatggtcaagcccccttattca

SEQ ID NO: 20881 - DNA, 36 bp, Artificial Sequence
  Synthetic oligonucleotide
tgaacgccctgtggtgcttgccgttcccctggttca

SEQ ID NO: 20882 - DNA, 38 bp, Artificial Sequence
  Synthetic oligonucleotide
gccgcaccgaggcgttccatcctgcgttacctacatga

SEQ ID NO: 20883 - DNA, 38 bp, Artificial Sequence
  Synthetic oligonucleotide
gccgccgcgcgctcctcccagcccccctctctggttga

SEQ ID NO: 20884 - DNA, 35 bp, Artificial Sequence
  Synthetic oligonucleotide
tcctccgctggagcactttcacgccatcttgtcac

SEQ ID NO: 20885 - DNA, 32 bp, Artificial Sequence
  Synthetic oligonucleotide
acacccctagaaccgacgtactggtaactgac

SEQ ID NO: 20886 - DNA, 35 bp, Artificial Sequence
  Synthetic oligonucleotide
tccattcgcacctgatcctggttgatttacacgcc

SEQ ID NO: 20887 - DNA, 35 bp, Artificial Sequence
  Synthetic oligonucleotide
tccacatccattctgtggaacaatcattcccatgc

SEQ ID NO: 20888 - DNA, 35 bp, Artificial Sequence
  Synthetic oligonucleotide
atccaccgtagtctcgtgctgtttgccctttggtc

SEQ ID NO: 20889 - DNA, 35 bp, Artificial Sequence
  Synthetic oligonucleotide
acctctaccctggccctcggtaccattcgaccacg

SEQ ID NO: 20890 - DNA, 35 bp, Artificial Sequence
  Synthetic oligonucleotide
atcaagcgcccggtttttagttcctccccccacgg

SEQ ID NO: 20891 - DNA, 35 bp, Artificial Sequence
  Synthetic oligonucleotide
agtggaggagggcaaggaagggcttatacgaggtg

SEQ ID NO: 20892 - DNA, 35 bp, Artificial Sequence
  Synthetic oligonucleotide
atccccgcccctaagtaactgccccttgattagaa

SEQ ID NO: 20893 - DNA, 36 bp, Artificial Sequence
  Synthetic oligonucleotide
atgacccgctttaacatctgcgatacgcaattcgaa

SEQ ID NO: 20894 - DNA, 36 bp, Artificial Sequence
  Synthetic oligonucleotide
gtgcactcccgagcctcacaggcattccacaaatca

SEQ ID NO: 20895 - DNA, 36 bp, Artificial Sequence
  Synthetic oligonucleotide
gttacgcgcggtcccatcctgactcccacccaccga

SEQ ID NO: 20896 - DNA, 37 bp, Artificial Sequence
  Synthetic oligonucleotide
acctgcgcataacactatcatcagcgaccccccatga

SEQ ID NO: 20897 - DNA, 38 bp, Artificial Sequence
  Synthetic oligonucleotide
gcaccaggcgcccccgcgtaactaccccgtactcctga

SEQ ID NO: 20898 - DNA, 36 bp, Artificial Sequence
  Synthetic oligonucleotide
ttggtacacgccttcgcttcatataacatccccgta

SEQ ID NO: 20899 - DNA, 35 bp, Artificial Sequence
  Synthetic oligonucleotide
tgcccgctctcctccccctcgtcgtgcgtaggccc

SEQ ID NO: 20900 - DNA, 35 bp, Artificial Sequence
  Synthetic oligonucleotide
gtaccttccgaaattcctgcatatgtgcgctagcc

SEQ ID NO: 20901 - DNA, 35 bp, Artificial Sequence
  Synthetic oligonucleotide
gcgcccttcctggtgtcccctgctcctttatgtgc

SEQ ID NO: 20902 - DNA, 35 bp, Artificial Sequence
  Synthetic oligonucleotide
ataaagcacggcacctggccccaataatgtctatc

SEQ ID NO: 20903 - DNA, 33 bp, Artificial Sequence
  Synthetic oligonucleotide
atggagcaaggggggtgccgggggggtgaaggg

SEQ ID NO: 20904 - DNA, 35 bp, Artificial Sequence
  Synthetic oligonucleotide
gtctcaggcactgttttttattcgcccggggttat

SEQ ID NO: 20905 - DNA, 36 bp, Artificial Sequence
  Synthetic oligonucleotide
agaggcccagtacgcacgcatcttagcactcttaca

SEQ ID NO: 20906 - DNA, 37 bp, Artificial Sequence
  Synthetic oligonucleotide
gacgcaccggtagtgccgccacctcgatttgccccga

SEQ ID NO: 20907 - DNA, 37 bp, Artificial Sequence
  Synthetic oligonucleotide
accccactctcatacattgccagccactctacaggga

SEQ ID NO: 20908 - DNA, 38 bp, Artificial Sequence
  Synthetic oligonucleotide
acggaacccaaggtggaagaaggatggacggggcgtga

SEQ ID NO: 20909 - DNA, 33 bp, Artificial Sequence
  Synthetic oligonucleotide
tccgaaagcttacacaggcgtactctccctcta

SEQ ID NO: 20910 - DNA, 36 bp, Artificial Sequence
  Synthetic oligonucleotide
gtgctagacatgaggagtagggtggaaggtgacgta

SEQ ID NO: 20911 - DNA, 35 bp, Artificial Sequence
  Synthetic oligonucleotide
gttccccagcacatgcatgtagcgcctctaaaatc

SEQ ID NO: 20912 - DNA, 35 bp, Artificial Sequence
  Synthetic oligonucleotide
agaacagagcgccacccttatttgctcgcctattg

SEQ ID NO: 20913 - DNA, 35 bp, Artificial Sequence
  Synthetic oligonucleotide
tgccacacggagtactttccacgacaatgcccgct

SEQ ID NO: 20914 - DNA, 35 bp, Artificial Sequence
  Synthetic oligonucleotide
ggacgggtgatttgatgctgggtgggcttgggtaa

SEQ ID NO: 20915 - DNA, 35 bp, Artificial Sequence
  Synthetic oligonucleotide
accaccacctgacgttatttatactggtgttcaca

SEQ ID NO: 20916 - DNA, 37 bp, Artificial Sequence
  Synthetic oligonucleotide
gtgggtaagtcgaggaggccggaggacaaggtggaga

SEQ ID NO: 20917 - DNA, 36 bp, Artificial Sequence
  Synthetic oligonucleotide
gtagtaacggataaatggtgggacgggcgaagagga

SEQ ID NO: 20918 - DNA, 38 bp, Artificial Sequence
  Synthetic oligonucleotide
accccacccccgccccctcgaacttgacgtattactga

SEQ ID NO: 20919 - DNA, 38 bp, Artificial Sequence
  Synthetic oligonucleotide
tcccgatcacctctaccgtgctaatatgcctcccgtga

SEQ ID NO: 20920 - DNA, 35 bp, Artificial Sequence
  Synthetic oligonucleotide
tcccaaccaagaatccacgcgctcactctgccgta

SEQ ID NO: 20921 - DNA, 35 bp, Artificial Sequence
  Synthetic oligonucleotide
gcagaccaacagcccccgaacccggaacccgcatc

SEQ ID NO: 20922 - DNA, 35 bp, Artificial Sequence
  Synthetic oligonucleotide
aacactgccgcaccccgctcgtctcacggtatgtc

SEQ ID NO: 20923 - DNA, 36 bp, Artificial Sequence
  Synthetic oligonucleotide
tgccattcctcatctttgcgcctgcgttcatacgca

SEQ ID NO: 20924 - DNA, 37 bp, Artificial Sequence
  Synthetic oligonucleotide
tctccgcggccatctcgcgctttcccgtataccctga

SEQ ID NO: 20925 - DNA, 37 bp, Artificial Sequence
  Synthetic oligonucleotide
agtcctaccacccccgaacgcccagggtttcccctga

SEQ ID NO: 20926 - DNA, 35 bp, Artificial Sequence
  Synthetic oligonucleotide
gacccccgtttggtatcttaggcccagctcgcacc

SEQ ID NO: 20927 - DNA, 36 bp, Artificial Sequence
  Synthetic oligonucleotide
tgtgcgcctcgagtcacccgtcttatatctcgcatc

SEQ ID NO: 20928 - DNA, 35 bp, Artificial Sequence
  Synthetic oligonucleotide
gtctatcacatgccacgaatctatgtaggtacctc

SEQ ID NO: 20929 - DNA, 35 bp, Artificial Sequence
  Synthetic oligonucleotide
tcctcgccatatctggatgggccccaaaacctctc

SEQ ID NO: 20930 - DNA, 35 bp, Artificial Sequence
  Synthetic oligonucleotide
acctgctccagttattaccgcctacatttgatccg

SEQ ID NO: 20931 - DNA, 35 bp, Artificial Sequence
  Synthetic oligonucleotide
acatgccccagttacttccagtctgtcgtgactcg

SEQ ID NO: 20932 - DNA, 36 bp, Artificial Sequence
  Synthetic oligonucleotide
gtagggagggaatatgaggggggagggaccgtccgg

SEQ ID NO: 20933 - DNA, 35 bp, Artificial Sequence
  Synthetic oligonucleotide
gttatgcgcacatcgctctgcagacacccgcccat

SEQ ID NO: 20934 - DNA, 35 bp, Artificial Sequence
  Synthetic oligonucleotide
accctgtccatgatcttgaattcccccattagcct

SEQ ID NO: 20935 - DNA, 36 bp, Artificial Sequence
  Synthetic oligonucleotide
gctcatccccgtctcgactcatccactgtgggccca

SEQ ID NO: 20936 - DNA, 35 bp, Artificial Sequence
  Synthetic oligonucleotide
ggacaacctctaccgtgaccgatggtctcccctca

SEQ ID NO: 20937 - DNA, 38 bp, Artificial Sequence
  Synthetic oligonucleotide
gtgggtcgacaggagcggaaagtggggttaaaatatga

SEQ ID NO: 20938 - DNA, 38 bp, Artificial Sequence
  Synthetic oligonucleotide
tcgcaacgggcaggtgttttctgcttttttttctgtga

SEQ ID NO: 20939 - DNA, 37 bp, Artificial Sequence
  Synthetic oligonucleotide
gaccattccgcccttttatcgagcgcactttttttga

SEQ ID NO: 20940 - DNA, 35 bp, Artificial Sequence
  Synthetic oligonucleotide
acctgctagcaggccccacccattgtccacggccc

SEQ ID NO: 20941 - DNA, 35 bp, Artificial Sequence
  Synthetic oligonucleotide
tcctaggcgtgccatttgccttaaacctgccgctc

SEQ ID NO: 20942 - DNA, 35 bp, Artificial Sequence
  Synthetic oligonucleotide
ttgtacctcgacccatgttcttggaatcttgtctc

SEQ ID NO: 20943 - DNA, 35 bp, Artificial Sequence
  Synthetic oligonucleotide
atcccgggcccacgaagtgtttacctcgccaacct

SEQ ID NO: 20944 - DNA, 36 bp, Artificial Sequence
  Synthetic oligonucleotide
gccccaccgccttcttcgcagaggcctttagttcga

SEQ ID NO: 20945 - DNA, 37 bp, Artificial Sequence
  Synthetic oligonucleotide
gacagacttcaagtcaacatcagcactccactttcga

SEQ ID NO: 20946 - DNA, 36 bp, Artificial Sequence
  Synthetic oligonucleotide
taaaacagggagaagcaggctaaggatcggaaggga

SEQ ID NO: 20947 - DNA, 38 bp, Artificial Sequence
  Synthetic oligonucleotide
tgttgtcgtggtgaggtggaggtgggtgggcagtatga

SEQ ID NO: 20948 - DNA, 38 bp, Artificial Sequence
  Synthetic oligonucleotide
aacagtaagccgccgaggtttactaatttccatcttga

SEQ ID NO: 20949 - DNA, 36 bp, Artificial Sequence
  Synthetic oligonucleotide
gagagcgtagtgccgctcatcctaccaccgaactta

SEQ ID NO: 20950 - DNA, 35 bp, Artificial Sequence
  Synthetic oligonucleotide
accggtcctgagcatgccgatactcgcacccttcc

SEQ ID NO: 20951 - DNA, 35 bp, Artificial Sequence
  Synthetic oligonucleotide
acccagctatcctacgcggttactatgcccaatgc

SEQ ID NO: 20952 - DNA, 35 bp, Artificial Sequence
  Synthetic oligonucleotide
gacgagcatagcctcccgacacgtccctgtctttc

SEQ ID NO: 20953 - DNA, 35 bp, Artificial Sequence
  Synthetic oligonucleotide
gccaccactactgtccgtcgaagacattcttcatg

SEQ ID NO: 20954 - DNA, 37 bp, Artificial Sequence
  Synthetic oligonucleotide
gatgccacgcaaatccacatagccctgaccaccggga

SEQ ID NO: 20955 - DNA, 37 bp, Artificial Sequence
  Synthetic oligonucleotide
gaccgtgcctgccggagaatacataaagtggggggga

SEQ ID NO: 20956 - DNA, 38 bp, Artificial Sequence
  Synthetic oligonucleotide
gtcgcacgtgaaatgagcatccgtgccacccatcttga

SEQ ID NO: 20957 - DNA, 36 bp, Artificial Sequence
  Synthetic oligonucleotide
atacccgcgctacggcactgctattcctgtttcgta

SEQ ID NO: 20958 - DNA, 35 bp, Artificial Sequence
  Synthetic oligonucleotide
gcaaccccgcgcattcctttcgccaccccccctcg

SEQ ID NO: 20959 - DNA, 35 bp, Artificial Sequence
  Synthetic oligonucleotide
tccacagccgctcctctaacttacatctggcttaa

SEQ ID NO: 20960 - DNA, 35 bp, Artificial Sequence
  Synthetic oligonucleotide
gcactgcgactcaaagtcaacgttccatcctgcga

SEQ ID NO: 20961 - DNA, 37 bp, Artificial Sequence
  Synthetic oligonucleotide
gcaccccccgcctcgatgttttttctatcccactgga

SEQ ID NO: 20962 - DNA, 37 bp, Artificial Sequence
  Synthetic oligonucleotide
gaagcctcggtttcgcccaatcacacacactctctga

SEQ ID NO: 20963 - DNA, 36 bp, Artificial Sequence
  Synthetic oligonucleotide
gactcgacgtcgttttatcgcatgttttctaccgta

SEQ ID NO: 20964 - DNA, 35 bp, Artificial Sequence
  Synthetic oligonucleotide
agctgaaacccgcccgatcaccacgcctgttttac

SEQ ID NO: 20965 - DNA, 35 bp, Artificial Sequence
  Synthetic oligonucleotide
atacacccctgggaaagcattgactcctggcctgc

SEQ ID NO: 20966 - DNA, 35 bp, Artificial Sequence
  Synthetic oligonucleotide
acctgggaggggaaagggggtaaagttcgcaaaag

SEQ ID NO: 20967 - DNA, 35 bp, Artificial Sequence
  Synthetic oligonucleotide
tgagtgcgcacttcaattcgtttctatccgacccg

SEQ ID NO: 20968 - DNA, 35 bp, Artificial Sequence
  Synthetic oligonucleotide
aacccactcacattctatttctaatctgccttggg

SEQ ID NO: 20969 - DNA, 35 bp, Artificial Sequence
  Synthetic oligonucleotide
agctgagcgacatacacaagccgttcttcccctct

SEQ ID NO: 20970 - DNA, 35 bp, Artificial Sequence
  Synthetic oligonucleotide
ggtgggtgggaggatagggccgagggatttggtgt

SEQ ID NO: 20971 - DNA, 35 bp, Artificial Sequence
  Synthetic oligonucleotide
gcaccggtggttggctacccacatatgcaccattt

SEQ ID NO: 20972 - DNA, 37 bp, Artificial Sequence
  Synthetic oligonucleotide
gattagcacaccccgcctgtaaagcatcataccttga

SEQ ID NO: 20973 - DNA, 35 bp, Artificial Sequence
  Synthetic oligonucleotide
gacatcacgtactaccgcattgcaaatttccaata

SEQ ID NO: 20974 - DNA, 35 bp, Artificial Sequence
  Synthetic oligonucleotide
gactcgcaaactgcaacctccgactcttcgtgtta

SEQ ID NO: 20975 - DNA, 35 bp, Artificial Sequence
  Synthetic oligonucleotide
atcccaagtctgtcttcccatcgtgtcgtatcatc

SEQ ID NO: 20976 - DNA, 35 bp, Artificial Sequence
  Synthetic oligonucleotide
tgtgactgcccatcacttacccatatcacgtttcg

SEQ ID NO: 20977 - DNA, 36 bp, Artificial Sequence
  Synthetic oligonucleotide
agccgctgtatcgcctttctctgtgcatcccacaca

SEQ ID NO: 20978 - DNA, 36 bp, Artificial Sequence
  Synthetic oligonucleotide
tcacgaaactgccggtaggcctaatctccgctacca

SEQ ID NO: 20979 - DNA, 38 bp, Artificial Sequence
  Synthetic oligonucleotide
tgatgccccctcccggtttaaagtcgctcgctcgctga

SEQ ID NO: 20980 - DNA, 37 bp, Artificial Sequence
  Synthetic oligonucleotide
acacctcactatccgtcgtagctaccggccattttga

SEQ ID NO: 20981 - DNA, 35 bp, Artificial Sequence
  Synthetic oligonucleotide
tgtacctacagcagccattttcttgctaaccattc

SEQ ID NO: 20982 - DNA, 35 bp, Artificial Sequence
  Synthetic oligonucleotide
gagagccggctaaactgtataccttatctctctct

SEQ ID NO: 20983 - DNA, 35 bp, Artificial Sequence
  Synthetic oligonucleotide
gttcccacgcacactcgcacaggcccaaaaacaca

SEQ ID NO: 20984 - DNA, 35 bp, Artificial Sequence
  Synthetic oligonucleotide
tttgcccacctgttaatactgtcttttttagtcca

SEQ ID NO: 20985 - DNA, 37 bp, Artificial Sequence
  Synthetic oligonucleotide
atcgcccctgacaaccctgccaacccccgggccctga

SEQ ID NO: 20986 - DNA, 35 bp, Artificial Sequence
  Synthetic oligonucleotide
tccacgaacagccgagcaatcctaacctaccgagg

SEQ ID NO: 20987 - DNA, 35 bp, Artificial Sequence
  Synthetic oligonucleotide
tcgacgccgtcgctacaaatatcgcctggaccact

SEQ ID NO: 20988 - DNA, 35 bp, Artificial Sequence
  Synthetic oligonucleotide
tccgatgggatgggcactgatggctggggggggca

SEQ ID NO: 20989 - DNA, 35 bp, Artificial Sequence
  Synthetic oligonucleotide
aacatgtgtcctctcccagggccccctcctccgga

SEQ ID NO: 20990 - DNA, 37 bp, Artificial Sequence
  Synthetic oligonucleotide
gtagccccagcccgccaattaaacacatgaactttga

SEQ ID NO: 20991 - DNA, 35 bp, Artificial Sequence
  Synthetic oligonucleotide
atcgttaaacgcctgtcgacgcccgatacactccc

SEQ ID NO: 20992 - DNA, 35 bp, Artificial Sequence
  Synthetic oligonucleotide
gtgtccctcatcttattgcgtcaacatccttttgt

SEQ ID NO: 20993 - DNA, 35 bp, Artificial Sequence
  Synthetic oligonucleotide
acgcacatcgcccattgcctcatcgggtttagctt

SEQ ID NO: 20994 - DNA, 36 bp, Artificial Sequence
  Synthetic oligonucleotide
taaacccagcgcgtgctgtccgtcggttgccttcca

SEQ ID NO: 20995 - DNA, 37 bp, Artificial Sequence
  Synthetic oligonucleotide
aacacgatgtggggtatggtggaagctataaacggga

SEQ ID NO: 20996 - DNA, 38 bp, Artificial Sequence
  Synthetic oligonucleotide
tactgactcgcctccttgccatgatgaagctcttttga

SEQ ID NO: 20997 - DNA, 36 bp, Artificial Sequence
  Synthetic oligonucleotide
atcagcccatccggtatgtcttctcgttccaccata

SEQ ID NO: 20998 - DNA, 35 bp, Artificial Sequence
  Synthetic oligonucleotide
agcacgtgctacttctcgccctcgccgccctttta

SEQ ID NO: 20999 - DNA, 37 bp, Artificial Sequence
  Synthetic oligonucleotide
aacgtccaccctctgagtcccgcttctccttcgacga

SEQ ID NO: 21000 - DNA, 37 bp, Artificial Sequence
  Synthetic oligonucleotide
tgttacagccctatcctccccatgctagtcttttgga

SEQ ID NO: 21001 - DNA, 37 bp, Artificial Sequence
  Synthetic oligonucleotide
gagcacacaggtcccctccacgccatcttgccgctga

SEQ ID NO: 21002 - DNA, 35 bp, Artificial Sequence
  Synthetic oligonucleotide
atgtgtgtgcactcttcgctggctccgaaccatcc

SEQ ID NO: 21003 - DNA, 35 bp, Artificial Sequence
  Synthetic oligonucleotide
tgattccacaacaccgctcatgcctgaacgctatc

SEQ ID NO: 21004 - DNA, 35 bp, Artificial Sequence
  Synthetic oligonucleotide
atccgcaggcccattaggcttttgcttgtattctc

SEQ ID NO: 21005 - DNA, 35 bp, Artificial Sequence
  Synthetic oligonucleotide
tccccatgcatccctcgttgcacgtctcccccgca

SEQ ID NO: 21006 - DNA, 37 bp, Artificial Sequence
  Synthetic oligonucleotide
gtagccaccgctcacctattgccctttctgctgacga

SEQ ID NO: 21007 - DNA, 38 bp, Artificial Sequence
  Synthetic oligonucleotide
aggagagggtagggtaggggggggtaggctccaggtga

SEQ ID NO: 21008 - DNA, 35 bp, Artificial Sequence
  Synthetic oligonucleotide
gctgtccccatgactcattaaccctcgactttaac

SEQ ID NO: 21009 - DNA, 35 bp, Artificial Sequence
  Synthetic oligonucleotide
ttgcgactgtcgttacgtccatgcagtttggcccc

SEQ ID NO: 21010 - DNA, 35 bp, Artificial Sequence
  Synthetic oligonucleotide
tgtgagctcacggttgactcttgctgctgttactc

SEQ ID NO: 21011 - DNA, 33 bp, Artificial Sequence
  Synthetic oligonucleotide
aacggggcgcccacaccaccgaggcccccattc

SEQ ID NO: 21012 - DNA, 35 bp, Artificial Sequence
  Synthetic oligonucleotide
ttgacgcgtgtaagcgttctgtatccttccacctg

SEQ ID NO: 21013 - DNA, 35 bp, Artificial Sequence
  Synthetic oligonucleotide
tgtagcacggccttcgcgtatttcttttggtggtt

SEQ ID NO: 21014 - DNA, 36 bp, Artificial Sequence
  Synthetic oligonucleotide
gccaccaacactatcgcagggctattccttccgcaa

SEQ ID NO: 21015 - DNA, 37 bp, Artificial Sequence
  Synthetic oligonucleotide
gaggtcgggaggaaggcgaggagaccagacagttcga

SEQ ID NO: 21016 - DNA, 37 bp, Artificial Sequence
  Synthetic oligonucleotide
accaaccctatccattttctacgtcagtcaaacgtga

SEQ ID NO: 21017 - DNA, 38 bp, Artificial Sequence
  Synthetic oligonucleotide
atgagtgggagtgggggaaaagttatgcgcggggttga

SEQ ID NO: 21018 - DNA, 35 bp, Artificial Sequence
  Synthetic oligonucleotide
tactcatcaacgacacccgccaccccccatgagtc

SEQ ID NO: 21019 - DNA, 35 bp, Artificial Sequence
  Synthetic oligonucleotide
acgagtcgctgcttccacatatgctcctacttgtt

SEQ ID NO: 21020 - DNA, 37 bp, Artificial Sequence
  Synthetic oligonucleotide
accctcgtgacactgccttagcttccttgcccatcga

SEQ ID NO: 21021 - DNA, 38 bp, Artificial Sequence
  Synthetic oligonucleotide
gagacggcccccacgttgacaacatccaccgtctttga

SEQ ID NO: 21022 - DNA, 36 bp, Artificial Sequence
  Synthetic oligonucleotide
atctcatgccacccccgaagcccgactgtgcaagta

SEQ ID NO: 21023 - DNA, 35 bp, Artificial Sequence
  Synthetic oligonucleotide
agcgactccccggtttgaacttggcatgactcctc

SEQ ID NO: 21024 - DNA, 35 bp, Artificial Sequence
  Synthetic oligonucleotide
tgacatgttgacgctttgttttcggtccttcactt

SEQ ID NO: 21025 - DNA, 35 bp, Artificial Sequence
  Synthetic oligonucleotide
tctccgtggcaccgctgctcccgtcttcgttcgtt

SEQ ID NO: 21026 - DNA, 35 bp, Artificial Sequence
  Synthetic oligonucleotide
ttgctgtcactgacggtcttgttgttctttgtttt

SEQ ID NO: 21027 - DNA, 36 bp, Artificial Sequence
  Synthetic oligonucleotide
tacccaccgcatgtacccatctgagtctcatagtaa

SEQ ID NO: 21028 - DNA, 38 bp, Artificial Sequence
  Synthetic oligonucleotide
actccctcgcgcccccaatgaaagccgaccaaacatga

SEQ ID NO: 21029 - DNA, 35 bp, Artificial Sequence
  Synthetic oligonucleotide
acctaacattcacgcttgacacctcgtgacagacc

SEQ ID NO: 21030 - DNA, 35 bp, Artificial Sequence
  Synthetic oligonucleotide
tatgttctgccgcaaatcaagtgttcgccccctcg

SEQ ID NO: 21031 - DNA, 33 bp, Artificial Sequence
  Synthetic oligonucleotide
gtgacgtaccccgcctatatcccgaaggatcca

SEQ ID NO: 21032 - DNA, 37 bp, Artificial Sequence
  Synthetic oligonucleotide
aatgccctgggcggacaagaatgatggagtgggggga

SEQ ID NO: 21033 - DNA, 36 bp, Artificial Sequence
  Synthetic oligonucleotide
gtgatccttccaattgtttagacctatccgaccata

SEQ ID NO: 21034 - DNA, 35 bp, Artificial Sequence
  Synthetic oligonucleotide
gcctactctgacctgtcccatactctagataacta

SEQ ID NO: 21035 - DNA, 35 bp, Artificial Sequence
  Synthetic oligonucleotide
acccccgttccttccatcagggcctgcttttacag

SEQ ID NO: 21036 - DNA, 35 bp, Artificial Sequence
  Synthetic oligonucleotide
acctcaacacccccctgggcatcaacgggaactat

SEQ ID NO: 21037 - DNA, 35 bp, Artificial Sequence
  Synthetic oligonucleotide
gcatccgttgagccggccctgtccaaccatcacca

SEQ ID NO: 21038 - DNA, 36 bp, Artificial Sequence
  Synthetic oligonucleotide
gccgccgtttcgatctgcctcgatttacttcctgca

SEQ ID NO: 21039 - DNA, 36 bp, Artificial Sequence
  Synthetic oligonucleotide
gttcgagctgttggctctaccgatacactcacttca

SEQ ID NO: 21040 - DNA, 37 bp, Artificial Sequence
  Synthetic oligonucleotide
gacgactcatccaccctcttacgtttcatggaaacga

SEQ ID NO: 21041 - DNA, 37 bp, Artificial Sequence
  Synthetic oligonucleotide
gccaagggaagccgggaagggttattcagggggtgga

SEQ ID NO: 21042 - DNA, 35 bp, Artificial Sequence
  Synthetic oligonucleotide
gccccccgtcgacacgaccagcaacgcctaacaac

SEQ ID NO: 21043 - DNA, 35 bp, Artificial Sequence
  Synthetic oligonucleotide
tgctggcaacaccaccggcgccccaattaatgtcc

SEQ ID NO: 21044 - DNA, 35 bp, Artificial Sequence
  Synthetic oligonucleotide
gatgacacgagtctgttacttcgccgctattccgc

SEQ ID NO: 21045 - DNA, 35 bp, Artificial Sequence
  Synthetic oligonucleotide
actccaccgcccacagttcgcaggcctgtacatat

SEQ ID NO: 21046 - DNA, 35 bp, Artificial Sequence
  Synthetic oligonucleotide
ttgatgccgatgtcgaaggcgtcctgcccccatct

SEQ ID NO: 21047 - DNA, 35 bp, Artificial Sequence
  Synthetic oligonucleotide
gctcaccggctcatacccgctcctcgtactactgt

SEQ ID NO: 21048 - DNA, 35 bp, Artificial Sequence
  Synthetic oligonucleotide
tcaacacgtttgacgacatccccacacaactactt

SEQ ID NO: 21049 - DNA, 35 bp, Artificial Sequence
  Synthetic oligonucleotide
aacaaatcacatgcacagacctggcctttctttca

SEQ ID NO: 21050 - DNA, 38 bp, Artificial Sequence
  Synthetic oligonucleotide
atcccaccgcctcgaagccatgagcccctggcgattga

SEQ ID NO: 21051 - DNA, 36 bp, Artificial Sequence
  Synthetic oligonucleotide
acgccacccttctgaactaagcttaccctctctgta

SEQ ID NO: 21052 - DNA, 35 bp, Artificial Sequence
  Synthetic oligonucleotide
tacgagcccatacaaccgatcttccgccactcctg

SEQ ID NO: 21053 - DNA, 35 bp, Artificial Sequence
  Synthetic oligonucleotide
gcgaagagactatgttctacgccttcttcctttct

SEQ ID NO: 21054 - DNA, 35 bp, Artificial Sequence
  Synthetic oligonucleotide
tatcccccctccgcttttaccagcccgccatggga

SEQ ID NO: 21055 - DNA, 38 bp, Artificial Sequence
  Synthetic oligonucleotide
acggagttggggcaggcttgtgggaaaggggggagtga

SEQ ID NO: 21056 - DNA, 35 bp, Artificial Sequence
  Synthetic oligonucleotide
gagacgacggctctcatcccagccactgtgccatc

SEQ ID NO: 21057 - DNA, 35 bp, Artificial Sequence
  Synthetic oligonucleotide
gtgatgccgcgaagccatgacctaccctttttatc

SEQ ID NO: 21058 - DNA, 35 bp, Artificial Sequence
  Synthetic oligonucleotide
gttgacccacctggcaccctctgtcgtaatggctc

SEQ ID NO: 21059 - DNA, 35 bp, Artificial Sequence
  Synthetic oligonucleotide
aacaatcacgccgttttgcgcacaacaggacgttc

SEQ ID NO: 21060 - DNA, 35 bp, Artificial Sequence
  Synthetic oligonucleotide
ccactacgcccttccgctgcctcatcggtttcctg

SEQ ID NO: 21061 - DNA, 35 bp, Artificial Sequence
  Synthetic oligonucleotide
gccgtcctgatctccaccagtctccgagttcacct

SEQ ID NO: 21062 - DNA, 35 bp, Artificial Sequence
  Synthetic oligonucleotide
accccccgcatgtgggcgcctttatacagcacctt

SEQ ID NO: 21063 - DNA, 36 bp, Artificial Sequence
  Synthetic oligonucleotide
tccaccgacgccttaacgcactggttcgaatctcaa

SEQ ID NO: 21064 - DNA, 36 bp, Artificial Sequence
  Synthetic oligonucleotide
cattccggcccacatcacgtatacctcgctctcgca

SEQ ID NO: 21065 - DNA, 36 bp, Artificial Sequence
  Synthetic oligonucleotide
acagcggtcacctcgcgaaccctaagctgctcttca

SEQ ID NO: 21066 - DNA, 36 bp, Artificial Sequence
  Synthetic oligonucleotide
gcccacgccatgagaattctccagttttgcaaccga

SEQ ID NO: 21067 - DNA, 38 bp, Artificial Sequence
  Synthetic oligonucleotide
ggcgtacagccacgactccaagactatattactgctga

SEQ ID NO: 21068 - DNA, 35 bp, Artificial Sequence
  Synthetic oligonucleotide
gccccccctcaatcgctcctgttgaagaccactta

SEQ ID NO: 21069 - DNA, 35 bp, Artificial Sequence
  Synthetic oligonucleotide
gagtccacctgtcacgtgcctgattcgcttatacc

SEQ ID NO: 21070 - DNA, 35 bp, Artificial Sequence
  Synthetic oligonucleotide
tgagctggtcacaaatgtctttatctcaccctgtc

SEQ ID NO: 21071 - DNA, 35 bp, Artificial Sequence
  Synthetic oligonucleotide
gctgaccaccgtgcctccccccccacggaatcaat

SEQ ID NO: 21072 - DNA, 35 bp, Artificial Sequence
  Synthetic oligonucleotide
ggacagtcagcttctttccttgactgcctacctct

SEQ ID NO: 21073 - DNA, 35 bp, Artificial Sequence
  Synthetic oligonucleotide
gcctacgaccactcctcgcatcaagtttcgacgtt

SEQ ID NO: 21074 - DNA, 36 bp, Artificial Sequence
  Synthetic oligonucleotide
accaacccctgacactacagtctcgcctggcgagaa

SEQ ID NO: 21075 - DNA, 36 bp, Artificial Sequence
  Synthetic oligonucleotide
atgaaatcgcaccgcccccaaggtgctacactttaa

SEQ ID NO: 21076 - DNA, 36 bp, Artificial Sequence
  Synthetic oligonucleotide
aatgtcccactccgcatggctaatgccttctcctca

SEQ ID NO: 21077 - DNA, 36 bp, Artificial Sequence
  Synthetic oligonucleotide
ttccatccgagacgcagcccatgtctcgcactttca

SEQ ID NO: 21078 - DNA, 35 bp, Artificial Sequence
  Synthetic oligonucleotide
atggggacgggcaaccgggggaagtgacgggtaga

SEQ ID NO: 21079 - DNA, 36 bp, Artificial Sequence
  Synthetic oligonucleotide
tctacgcaaagcaacgtcttcttagcctctccatga

SEQ ID NO: 21080 - DNA, 35 bp, Artificial Sequence
  Synthetic oligonucleotide
gcacaccctgcactttgcgtgactttatggcctga

SEQ ID NO: 21081 - DNA, 35 bp, Artificial Sequence
  Synthetic oligonucleotide
tccgcggcccctagcttgttctaaccctcatctta

SEQ ID NO: 21082 - DNA, 35 bp, Artificial Sequence
  Synthetic oligonucleotide
agacccgcacgtgaacttggcttctatcttcgtac

SEQ ID NO: 21083 - DNA, 35 bp, Artificial Sequence
  Synthetic oligonucleotide
tgtgcactcacagccgctcggacccatgctgcacc

SEQ ID NO: 21084 - DNA, 35 bp, Artificial Sequence
  Synthetic oligonucleotide
tcccacttgtccgagtacttcgcagtctgttccat

SEQ ID NO: 21085 - DNA, 35 bp, Artificial Sequence
  Synthetic oligonucleotide
actcgtccagctcgctcatctcttaggcacctcat

SEQ ID NO: 21086 - DNA, 35 bp, Artificial Sequence
  Synthetic oligonucleotide
gacgatggtagctatctttggtctctgtttgccct

SEQ ID NO: 21087 - DNA, 35 bp, Artificial Sequence
  Synthetic oligonucleotide
gtcgctccacggaaatacgtcgtccatgcccttct

SEQ ID NO: 21088 - DNA, 36 bp, Artificial Sequence
  Synthetic oligonucleotide
gctcatgcacaggaccctcccaacaccgacaggcca

SEQ ID NO: 21089 - DNA, 36 bp, Artificial Sequence
  Synthetic oligonucleotide
tgatcgtcctccgcctgtctgttagtcctctcttca

SEQ ID NO: 21090 - DNA, 38 bp, Artificial Sequence
  Synthetic oligonucleotide
gcaagcaaatggtgttccgtgcgtgccttatcttctga

SEQ ID NO: 21091 - DNA, 37 bp, Artificial Sequence
  Synthetic oligonucleotide
aatccaagggtgggagggggaggagattgtacggtga

SEQ ID NO: 21092 - DNA, 35 bp, Artificial Sequence
  Synthetic oligonucleotide
tcgattagcactctggcgctacgctaccacctacc

SEQ ID NO: 21093 - DNA, 35 bp, Artificial Sequence
  Synthetic oligonucleotide
acagccgccgcagctatctgttcaccaaatggtcc

SEQ ID NO: 21094 - DNA, 35 bp, Artificial Sequence
  Synthetic oligonucleotide
acatcccgtatccgtactgttacccttagctatcg

SEQ ID NO: 21095 - DNA, 35 bp, Artificial Sequence
  Synthetic oligonucleotide
ttggaaccccgccccctcttgtcgcaactgtaagg

SEQ ID NO: 21096 - DNA, 35 bp, Artificial Sequence
  Synthetic oligonucleotide
gcagggccgtcgacccaacacctgccccatgattg

SEQ ID NO: 21097 - DNA, 35 bp, Artificial Sequence
  Synthetic oligonucleotide
ggactaccgccttacacaatgactatcttcgccat

SEQ ID NO: 21098 - DNA, 35 bp, Artificial Sequence
  Synthetic oligonucleotide
gatctggacatgtttgtcttttcttccccccgact

SEQ ID NO: 21099 - DNA, 35 bp, Artificial Sequence
  Synthetic oligonucleotide
gtcccaccccgaccactacttagaatctaagagct

SEQ ID NO: 21100 - DNA, 38 bp, Artificial Sequence
  Synthetic oligonucleotide
tgcactccagcccccattccacctcgcaccggcggtga

SEQ ID NO: 21101 - DNA, 35 bp, Artificial Sequence
  Synthetic oligonucleotide
taagtcgcacgcagttactcatcctcctctgttta

SEQ ID NO: 21102 - DNA, 35 bp, Artificial Sequence
  Synthetic oligonucleotide
gagacagcatcgactccggcatccccgacaatccc

SEQ ID NO: 21103 - DNA, 35 bp, Artificial Sequence
  Synthetic oligonucleotide
gctcgcggcccctctcattccctttgctgactggc

SEQ ID NO: 21104 - DNA, 35 bp, Artificial Sequence
  Synthetic oligonucleotide
tcagatggggtgagggtttgtcgggaaggtgggtc

SEQ ID NO: 21105 - DNA, 35 bp, Artificial Sequence
  Synthetic oligonucleotide
gaagcagcctcttttcctgttcgatctgcttcttc

SEQ ID NO: 21106 - DNA, 35 bp, Artificial Sequence
  Synthetic oligonucleotide
aatcacccccatgatcttaacagacaaaaaccgcg

SEQ ID NO: 21107 - DNA, 35 bp, Artificial Sequence
  Synthetic oligonucleotide
tcgccgggcctcaatccccgtctcctgcgcatcct

SEQ ID NO: 21108 - DNA, 36 bp, Artificial Sequence
  Synthetic oligonucleotide
acccacccggacttcacgtttagactacctgcgaaa

SEQ ID NO: 21109 - DNA, 36 bp, Artificial Sequence
  Synthetic oligonucleotide
acccatcatcctcggtccgtgttttctggcatgcaa

SEQ ID NO: 21110 - DNA, 36 bp, Artificial Sequence
  Synthetic oligonucleotide
ttccacgcaactcgtatctaaactgtcgtcctttca

SEQ ID NO: 21111 - DNA, 37 bp, Artificial Sequence
  Synthetic oligonucleotide
tctcccaccatcgggtcttccactgtcagtcacagga

SEQ ID NO: 21112 - DNA, 38 bp, Artificial Sequence
  Synthetic oligonucleotide
gccgagggagggtgtgcaagggcagatgcgcggaatga

SEQ ID NO: 21113 - DNA, 35 bp, Artificial Sequence
  Synthetic oligonucleotide
accatccgccgatatggtccctttctacgcccctg

SEQ ID NO: 21114 - DNA, 35 bp, Artificial Sequence
  Synthetic oligonucleotide
atagcataccgcgaacatccacctatccagctgct

SEQ ID NO: 21115 - DNA, 35 bp, Artificial Sequence
  Synthetic oligonucleotide
tcccgggacagcctggacacttcctacttctgctt

SEQ ID NO: 21116 - DNA, 37 bp, Artificial Sequence
  Synthetic oligonucleotide
tcctgagcccgggtgacttggcctgcatccctatcga

SEQ ID NO: 21117 - DNA, 37 bp, Artificial Sequence
  Synthetic oligonucleotide
gcgtaccgtcacttgccgcgggcgctgtccttcctga

SEQ ID NO: 21118 - DNA, 38 bp, Artificial Sequence
  Synthetic oligonucleotide
gatcaccacaggcctccatcccctaaggaccagcttga

SEQ ID NO: 21119 - DNA, 35 bp, Artificial Sequence
  Synthetic oligonucleotide
gcgcctgtgcaccttcgtcgtcccagaactgcctc

SEQ ID NO: 21120 - DNA, 35 bp, Artificial Sequence
  Synthetic oligonucleotide
gcacggttgccgggggctggagaagaataggggtg

SEQ ID NO: 21121 - DNA, 36 bp, Artificial Sequence
  Synthetic oligonucleotide
acccaaaccccgaggagtcttgtgcctgttttcgca

SEQ ID NO: 21122 - DNA, 36 bp, Artificial Sequence
  Synthetic oligonucleotide
acccacatcacaggttttttgccgcgcgcgagtgca

SEQ ID NO: 21123 - DNA, 37 bp, Artificial Sequence
  Synthetic oligonucleotide
atggggacgttggaggaagggatgggagggaccagga

SEQ ID NO: 21124 - DNA, 37 bp, Artificial Sequence
  Synthetic oligonucleotide
gcgaggtggaatgaggatcgaggaaaggggacggtga

SEQ ID NO: 21125 - DNA, 35 bp, Artificial Sequence
  Synthetic oligonucleotide
acgacatccgctccctcaacttccacgggttaccc

SEQ ID NO: 21126 - DNA, 35 bp, Artificial Sequence
  Synthetic oligonucleotide
ttgcaggcacacatcactgagaacttcgcaacttc

SEQ ID NO: 21127 - DNA, 35 bp, Artificial Sequence
  Synthetic oligonucleotide
aacaccaaccggacgacgctatgacatcagctcgg

SEQ ID NO: 21128 - DNA, 35 bp, Artificial Sequence
  Synthetic oligonucleotide
gttggactccctctgccattggatcaccagtacat

SEQ ID NO: 21129 - DNA, 37 bp, Artificial Sequence
  Synthetic oligonucleotide
gcatcccaatgcgctccacctctttatacatgttcga

SEQ ID NO: 21130 - DNA, 37 bp, Artificial Sequence
  Synthetic oligonucleotide
gataggcaagtagggtggggcaggaagaatgcaagga

SEQ ID NO: 21131 - DNA, 37 bp, Artificial Sequence
  Synthetic oligonucleotide
acatgggacgcgtaaggcagggcttatacggggagga

SEQ ID NO: 21132 - DNA, 38 bp, Artificial Sequence
  Synthetic oligonucleotide
ggagtgggggggaacaatagtccggtgacggatggtga

SEQ ID NO: 21133 - DNA, 36 bp, Artificial Sequence
  Synthetic oligonucleotide
tgttcccgcacagcatttgccttctcgttatagcta

SEQ ID NO: 21134 - DNA, 35 bp, Artificial Sequence
  Synthetic oligonucleotide
atcgacccgcccatgccaccctccgggtcagctcg

SEQ ID NO: 21135 - DNA, 35 bp, Artificial Sequence
  Synthetic oligonucleotide
tgtgaagggtacggggggaatggtgctgccgccgg

SEQ ID NO: 21136 - DNA, 38 bp, Artificial Sequence
  Synthetic oligonucleotide
tcccatcccgcaccggcccgcacctccacctgttctga

SEQ ID NO: 21137 - DNA, 37 bp, Artificial Sequence
  Synthetic oligonucleotide
agagggaggagtgggtcgggcggagggtaccaggtga

SEQ ID NO: 21138 - DNA, 35 bp, Artificial Sequence
  Synthetic oligonucleotide
aagacataaatgaggcggaaaaagggggattgctt

SEQ ID NO: 21139 - DNA, 37 bp, Artificial Sequence
  Synthetic oligonucleotide
gaaggatgaggggcggacgggtaggggagtgagctga

SEQ ID NO: 21140 - DNA, 35 bp, Artificial Sequence
  Synthetic oligonucleotide
gcgcgagcaccctttagtcttcttttgaacggtcc

SEQ ID NO: 21141 - DNA, 36 bp, Artificial Sequence
  Synthetic oligonucleotide
agaccaccacagcctcttattagcgtccattacgga

SEQ ID NO: 21142 - DNA, 36 bp, Artificial Sequence
  Synthetic oligonucleotide
tatggcgaggtacaggtgggggagtgggcggtggga

SEQ ID NO: 21143 - DNA, 37 bp, Artificial Sequence
  Synthetic oligonucleotide
tacgtgtcacgcacaatattacgctcaccatcctgga

SEQ ID NO: 21144 - DNA, 38 bp, Artificial Sequence
  Synthetic oligonucleotide
gccgcctcggaacgactgggctctttactctcccttga

SEQ ID NO: 21145 - DNA, 38 bp, Artificial Sequence
  Synthetic oligonucleotide
tagacctgcgctccatgtcctcagcgctctgttcttga

SEQ ID NO: 21146 - DNA, 38 bp, Artificial Sequence
  Synthetic oligonucleotide
tatgcccggcctttgcgcattggacgccttccttttga

SEQ ID NO: 21147 - DNA, 36 bp, Artificial Sequence
  Synthetic oligonucleotide
gcgccacaatcctatggcttccttggacctactcga

SEQ ID NO: 21148 - DNA, 37 bp, Artificial Sequence
  Synthetic oligonucleotide
tagtaggcaagtaggaacagggaatagaaggtaagga

SEQ ID NO: 21149 - DNA, 38 bp, Artificial Sequence
  Synthetic oligonucleotide
ggagggatcggaaaggggcgggagggctggattaatga

SEQ ID NO: 21150 - DNA, 38 bp, Artificial Sequence
  Synthetic oligonucleotide
gccacccgcctttggtaattccaagcccctcatgctga

SEQ ID NO: 21151 - DNA, 35 bp, Artificial Sequence
  Synthetic oligonucleotide
tcatcagccgaaggacagggaggagggtaatcaag

SEQ ID NO: 21152 - DNA, 35 bp, Artificial Sequence
  Synthetic oligonucleotide
taagcccgctgaaatctgctgttgattcactctct

SEQ ID NO: 21153 - DNA, 35 bp, Artificial Sequence
  Synthetic oligonucleotide
gtgccccgtctccttcgctgattgtcttagccctt

SEQ ID NO: 21154 - DNA, 37 bp, Artificial Sequence
  Synthetic oligonucleotide
gtcaccctgcttagcataaggctttccgtttcttcga

SEQ ID NO: 21155 - DNA, 37 bp, Artificial Sequence
  Synthetic oligonucleotide
tgcccccacctccaatatttatgcactatgagcctga

SEQ ID NO: 21156 - DNA, 36 bp, Artificial Sequence
  Synthetic oligonucleotide
agccaaggaccgctgaatgtcgccctaccccgctta

SEQ ID NO: 21157 - DNA, 35 bp, Artificial Sequence
  Synthetic oligonucleotide
tgagctcacaaacgcactcactccgccaccgcagc

SEQ ID NO: 21158 - DNA, 35 bp, Artificial Sequence
  Synthetic oligonucleotide
gatgtgggtcgcaagtagggtcgggtgaatgatgg

SEQ ID NO: 21159 - DNA, 35 bp, Artificial Sequence
  Synthetic oligonucleotide
tcagcctcccccacgacctccggtttcagctgcat

SEQ ID NO: 21160 - DNA, 35 bp, Artificial Sequence
  Synthetic oligonucleotide
tgatgagcacatctccatacctcctttagtgaact

SEQ ID NO: 21161 - DNA, 37 bp, Artificial Sequence
  Synthetic oligonucleotide
gttgcctctgttccactgaattgctccttcattctga

SEQ ID NO: 21162 - DNA, 35 bp, Artificial Sequence
  Synthetic oligonucleotide
gtcctccatcgctacacttgtggccacaggccata

SEQ ID NO: 21163 - DNA, 35 bp, Artificial Sequence
  Synthetic oligonucleotide
gtcccgatcctcacaccagcctctgtactacgttc

SEQ ID NO: 21164 - DNA, 35 bp, Artificial Sequence
  Synthetic oligonucleotide
gactacctacactcgatgtctaaatcctcatctcg

SEQ ID NO: 21165 - DNA, 35 bp, Artificial Sequence
  Synthetic oligonucleotide
gtaagggtgaggaggcagaaatacaggttggaggg

SEQ ID NO: 21166 - DNA, 35 bp, Artificial Sequence
  Synthetic oligonucleotide
gcaaccacgcataaaacatccgcgcatcacatctg

SEQ ID NO: 21167 - DNA, 35 bp, Artificial Sequence
  Synthetic oligonucleotide
gtcaatcccggaatcagcaaaaagtcgcacaccat

SEQ ID NO: 21168 - DNA, 37 bp, Artificial Sequence
  Synthetic oligonucleotide
tccccatcctgtccacagtacttatgcctgtttccga

SEQ ID NO: 21169 - DNA, 36 bp, Artificial Sequence
  Synthetic oligonucleotide
tcccaagtccactcattgtatgtcacccgctcttga

SEQ ID NO: 21170 - DNA, 38 bp, Artificial Sequence
  Synthetic oligonucleotide
tacgagagcggggggactgcggggggtgatcgatttga

SEQ ID NO: 21171 - DNA, 36 bp, Artificial Sequence
  Synthetic oligonucleotide
agtgccggccttctggttactcagcatttctcctta

SEQ ID NO: 21172 - DNA, 35 bp, Artificial Sequence
  Synthetic oligonucleotide
tacagaaacacatacgtaccgctgatctaatgctc

SEQ ID NO: 21173 - DNA, 35 bp, Artificial Sequence
  Synthetic oligonucleotide
ggaccaggcaccaaggttatagctccgcccctgtc

SEQ ID NO: 21174 - DNA, 36 bp, Artificial Sequence
  Synthetic oligonucleotide
attggcgcccccgactgccccgtattgcctattaaa

SEQ ID NO: 21175 - DNA, 35 bp, Artificial Sequence
  Synthetic oligonucleotide
taccccgctttaaccccacccctccagttcttgaa

SEQ ID NO: 21176 - DNA, 38 bp, Artificial Sequence
  Synthetic oligonucleotide
tatcgactcccgctggtgcaacgccttccacctcctga

SEQ ID NO: 21177 - DNA, 35 bp, Artificial Sequence
  Synthetic oligonucleotide
gttatgaccatcatagcctcctgagtttttgcacc

SEQ ID NO: 21178 - DNA, 35 bp, Artificial Sequence
  Synthetic oligonucleotide
agcctccacctatcctttaacagattccgatccgc

SEQ ID NO: 21179 - DNA, 34 bp, Artificial Sequence
  Synthetic oligonucleotide
acaccctccaaatcattctctctaagtgacaggc

SEQ ID NO: 21180 - DNA, 35 bp, Artificial Sequence
  Synthetic oligonucleotide
atgcaaccctccgcttcccatatcggtgtgaaccg

SEQ ID NO: 21181 - DNA, 35 bp, Artificial Sequence
  Synthetic oligonucleotide
gaccgccctccgctttgtgctctactgctcgcagg

SEQ ID NO: 21182 - DNA, 35 bp, Artificial Sequence
  Synthetic oligonucleotide
tcacgagctccaccaatagttgtgccctgcctacc

SEQ ID NO: 21183 - DNA, 35 bp, Artificial Sequence
  Synthetic oligonucleotide
tatgtggctgagcttgccccttcaccgttctcccg

SEQ ID NO: 21184 - DNA, 35 bp, Artificial Sequence
  Synthetic oligonucleotide
tcccctccaacgcccatcgataggccatacactgg

SEQ ID NO: 21185 - DNA, 35 bp, Artificial Sequence
  Synthetic oligonucleotide
ggtgaaggttatgaggggatgggacggaaaatgtg

SEQ ID NO: 21186 - DNA, 35 bp, Artificial Sequence
  Synthetic oligonucleotide
tagtcccccgggcgtttttcctcttgtccttgact

SEQ ID NO: 21187 - DNA, 35 bp, Artificial Sequence
  Synthetic oligonucleotide
taggtacccctcctgctctgtccctctgaaccctt

SEQ ID NO: 21188 - DNA, 36 bp, Artificial Sequence
  Synthetic oligonucleotide
tagcgcggaggttattcctttgctgcatccttccaa

SEQ ID NO: 21189 - DNA, 36 bp, Artificial Sequence
  Synthetic oligonucleotide
ggggcaacatccttgggagggtggggttttaattaa

SEQ ID NO: 21190 - DNA, 35 bp, Artificial Sequence
  Synthetic oligonucleotide
attgcccggcgtacctgataacaccccaatttaca

SEQ ID NO: 21191 - DNA, 37 bp, Artificial Sequence
  Synthetic oligonucleotide
gctggccccttacgatgaatgctccaactccccccga

SEQ ID NO: 21192 - DNA, 37 bp, Artificial Sequence
  Synthetic oligonucleotide
atcgcccagccgatagctcagtccgttcctgccccga

SEQ ID NO: 21193 - DNA, 36 bp, Artificial Sequence
  Synthetic oligonucleotide
attcgatccggcaagcatctgctatcttatcacgga

SEQ ID NO: 21194 - DNA, 38 bp, Artificial Sequence
  Synthetic oligonucleotide
aaccgcctcccccctctcaaggaccaggaataccatga

SEQ ID NO: 21195 - DNA, 37 bp, Artificial Sequence
  Synthetic oligonucleotide
tatgcccccctccccgtgcgataaacacgtctactga

SEQ ID NO: 21196 - DNA, 35 bp, Artificial Sequence
  Synthetic oligonucleotide
ttccagtcgatgtgatcaccacactctccatcatc

SEQ ID NO: 21197 - DNA, 35 bp, Artificial Sequence
  Synthetic oligonucleotide
gcgcacaaattccttcatgtcttatccgatcgctc

SEQ ID NO: 21198 - DNA, 35 bp, Artificial Sequence
  Synthetic oligonucleotide
ttttcgcgcctccacagccccactctaggattctc

SEQ ID NO: 21199 - DNA, 35 bp, Artificial Sequence
  Synthetic oligonucleotide
gtcgtgtgccacaacttgttcttcgtttatttttc

SEQ ID NO: 21200 - DNA, 35 bp, Artificial Sequence
  Synthetic oligonucleotide
gcaccccacattcagaacagacctcactgacccgg

SEQ ID NO: 21201 - DNA, 35 bp, Artificial Sequence
  Synthetic oligonucleotide
gcactgacccacataacgacccacactatcttcgg

SEQ ID NO: 21202 - DNA, 35 bp, Artificial Sequence
  Synthetic oligonucleotide
gcgtccgtcctccatctccataattgcctcgcttg

SEQ ID NO: 21203 - DNA, 36 bp, Artificial Sequence
  Synthetic oligonucleotide
gcctccgttgtatgtcttctgcgctccatctttgaa

SEQ ID NO: 21204 - DNA, 38 bp, Artificial Sequence
  Synthetic oligonucleotide
tgtgcgcacttgagtttttcttgtttgaccacctctga

SEQ ID NO: 21205 - DNA, 35 bp, Artificial Sequence
  Synthetic oligonucleotide
ttctgtctctgccccatgcccgtcccccaataggc

SEQ ID NO: 21206 - DNA, 35 bp, Artificial Sequence
  Synthetic oligonucleotide
tatgtctcgcccggcaccatacgtaccccaatccg

SEQ ID NO: 21207 - DNA, 35 bp, Artificial Sequence
  Synthetic oligonucleotide
tggacgggtcgcacgcaccttcgccgcctttaaat

SEQ ID NO: 21208 - DNA, 35 bp, Artificial Sequence
  Synthetic oligonucleotide
acgcgggccacgaacttccgcgcccacatgaacct

SEQ ID NO: 21209 - DNA, 35 bp, Artificial Sequence
  Synthetic oligonucleotide
tagtcccctcggcacagtttcctttccactccctt

SEQ ID NO: 21210 - DNA, 36 bp, Artificial Sequence
  Synthetic oligonucleotide
gaaggtggagtggggtaaaagagaggttggaagaaa

SEQ ID NO: 21211 - DNA, 35 bp, Artificial Sequence
  Synthetic oligonucleotide
gcaacacacccttcatgccccagtcgtgcccgaaa

SEQ ID NO: 21212 - DNA, 36 bp, Artificial Sequence
  Synthetic oligonucleotide
tccgagcgcgctcacactcggcttttttctgctcaa

SEQ ID NO: 21213 - DNA, 35 bp, Artificial Sequence
  Synthetic oligonucleotide
ttgcgccgcacaaccgcgcttacacattggatcca

SEQ ID NO: 21214 - DNA, 35 bp, Artificial Sequence
  Synthetic oligonucleotide
atgttgatgtcctcccctgccctctgatatggtca

SEQ ID NO: 21215 - DNA, 36 bp, Artificial Sequence
  Synthetic oligonucleotide
gttccaccgcccatacttgttcacaggccggtagga

SEQ ID NO: 21216 - DNA, 38 bp, Artificial Sequence
  Synthetic oligonucleotide
gactcacctcccctggtggaatttcgaccccattctga

SEQ ID NO: 21217 - DNA, 35 bp, Artificial Sequence
  Synthetic oligonucleotide
gtccatccgccctttcggccgccgagcttggcgac

SEQ ID NO: 21218 - DNA, 35 bp, Artificial Sequence
  Synthetic oligonucleotide
gcggacactgcccattcacgcctctcttccggtgc

SEQ ID NO: 21219 - DNA, 35 bp, Artificial Sequence
  Synthetic oligonucleotide
tgaaagggggagggaggggcaaacaggcggctctg

SEQ ID NO: 21220 - DNA, 35 bp, Artificial Sequence
  Synthetic oligonucleotide
accccacattcgccctcggccactcgcttggacct

SEQ ID NO: 21221 - DNA, 36 bp, Artificial Sequence
  Synthetic oligonucleotide
gcaatgtgcgaccatcacgccatccattcgccccca

SEQ ID NO: 21222 - DNA, 37 bp, Artificial Sequence
  Synthetic oligonucleotide
tcgtgcacgggtaagggcgggatgggtcacccacgga

SEQ ID NO: 21223 - DNA, 37 bp, Artificial Sequence
  Synthetic oligonucleotide
agactgacgggggtggtgggccgtacggcggggtgga

SEQ ID NO: 21224 - DNA, 36 bp, Artificial Sequence
  Synthetic oligonucleotide
agtatcctggccatccgtcctcaaagcccccattga

SEQ ID NO: 21225 - DNA, 35 bp, Artificial Sequence
  Synthetic oligonucleotide
gatcgccaggccattacgacccatgcgactttcac

SEQ ID NO: 21226 - DNA, 35 bp, Artificial Sequence
  Synthetic oligonucleotide
gacaacgggacaggatagtgtttagggaaaggagg

SEQ ID NO: 21227 - DNA, 35 bp, Artificial Sequence
  Synthetic oligonucleotide
tctgtacacatagccttccactgcccactctagtg

SEQ ID NO: 21228 - DNA, 35 bp, Artificial Sequence
  Synthetic oligonucleotide
gtcgccaccactcatgtctgttcaacacgcttgtt

SEQ ID NO: 21229 - DNA, 37 bp, Artificial Sequence
  Synthetic oligonucleotide
atccgtgcccccgatccacttgtttctgtatgtacga

SEQ ID NO: 21230 - DNA, 36 bp, Artificial Sequence
  Synthetic oligonucleotide
tctgcatatcccactcatccctgccgtcgtccggga

SEQ ID NO: 21231 - DNA, 37 bp, Artificial Sequence
  Synthetic oligonucleotide
agcaacggtcagtgggagggggacgtgaaagggggga

SEQ ID NO: 21232 - DNA, 37 bp, Artificial Sequence
  Synthetic oligonucleotide
gttgcacggcgagggacttttgggatggggcgtggga

SEQ ID NO: 21233 - DNA, 37 bp, Artificial Sequence
  Synthetic oligonucleotide
atgtgggggcaaaaggagttggggtgctagggagtga

SEQ ID NO: 21234 - DNA, 35 bp, Artificial Sequence
  Synthetic oligonucleotide
tcaggaccctcctggatagttatcactcccccccc

SEQ ID NO: 21235 - DNA, 35 bp, Artificial Sequence
  Synthetic oligonucleotide
tgcgaaacatcccacgtactgacaaccgaaacacg

SEQ ID NO: 21236 - DNA, 35 bp, Artificial Sequence
  Synthetic oligonucleotide
tcactaacatcactttcagcacatgctacaacatg

SEQ ID NO: 21237 - DNA, 35 bp, Artificial Sequence
  Synthetic oligonucleotide
gcactatgccgactttactctgttcactatacgct

SEQ ID NO: 21238 - DNA, 35 bp, Artificial Sequence
  Synthetic oligonucleotide
tggaacggaacagccatacatataccctcgttcaa

SEQ ID NO: 21239 - DNA, 35 bp, Artificial Sequence
  Synthetic oligonucleotide
gccacgctaaggagcacatccccgacacctgcaca

SEQ ID NO: 21240 - DNA, 35 bp, Artificial Sequence
  Synthetic oligonucleotide
atcccgccgcccggccaccataccctatgtatcga

SEQ ID NO: 21241 - DNA, 38 bp, Artificial Sequence
  Synthetic oligonucleotide
tcaactgcaacatctccagcgcgttccactggccatga

SEQ ID NO: 21242 - DNA, 38 bp, Artificial Sequence
  Synthetic oligonucleotide
gaccatcgcctcttctggtcaagatcaccgctccctga

SEQ ID NO: 21243 - DNA, 36 bp, Artificial Sequence
  Synthetic oligonucleotide
gctcactgcgtcctcatcgcacttattgatctcgta

SEQ ID NO: 21244 - DNA, 36 bp, Artificial Sequence
  Synthetic oligonucleotide
ggtgagggggtatgaagggagggcgggccaggggta

SEQ ID NO: 21245 - DNA, 35 bp, Artificial Sequence
  Synthetic oligonucleotide
gccggggcccggacgcaagcctatctcctttctcg

SEQ ID NO: 21246 - DNA, 35 bp, Artificial Sequence
  Synthetic oligonucleotide
gtactgccatctacgacgctctatcatgggtgctt

SEQ ID NO: 21247 - DNA, 35 bp, Artificial Sequence
  Synthetic oligonucleotide
tcatccaacccccgacgaaagtaacaagccttgaa

SEQ ID NO: 21248 - DNA, 36 bp, Artificial Sequence
  Synthetic oligonucleotide
acgataggtcggcccatcttatagtttgtttcccca

SEQ ID NO: 21249 - DNA, 35 bp, Artificial Sequence
  Synthetic oligonucleotide
accgtgcccagcatacggagaatacacaccatcca

SEQ ID NO: 21250 - DNA, 37 bp, Artificial Sequence
  Synthetic oligonucleotide
gccacaccgccaccttctaatcttgagtcctactaga

SEQ ID NO: 21251 - DNA, 36 bp, Artificial Sequence
  Synthetic oligonucleotide
gacctggtgctagtacggggggaattgggggcagga

SEQ ID NO: 21252 - DNA, 38 bp, Artificial Sequence
  Synthetic oligonucleotide
gagccctccccggttccttgcacctttgtttacggtga

SEQ ID NO: 21253 - DNA, 35 bp, Artificial Sequence
  Synthetic oligonucleotide
tcccaccactagcccccctatcggttcttgctcgc

SEQ ID NO: 21254 - DNA, 35 bp, Artificial Sequence
  Synthetic oligonucleotide
actgttacacatcgccgacaccactcatgcccgtt

SEQ ID NO: 21255 - DNA, 36 bp, Artificial Sequence
  Synthetic oligonucleotide
gaccctccgccgccggccattgtcaacatcctccaa

SEQ ID NO: 21256 - DNA, 35 bp, Artificial Sequence
  Synthetic oligonucleotide
atatcctgcccggcttccattgctttgacgtccaa

SEQ ID NO: 21257 - DNA, 37 bp, Artificial Sequence
  Synthetic oligonucleotide
gtaacgctcgcccttcatcatgccctcctctcaagga

SEQ ID NO: 21258 - DNA, 38 bp, Artificial Sequence
  Synthetic oligonucleotide
tcccgctctggtgattttgcactcttctaccctcatga

SEQ ID NO: 21259 - DNA, 38 bp, Artificial Sequence
  Synthetic oligonucleotide
tccacctcgagcgatatttgctcagtctccgacgctga

SEQ ID NO: 21260 - DNA, 36 bp, Artificial Sequence
  Synthetic oligonucleotide
gggttgggtgggtgtgggatggggttgcatcggtga

SEQ ID NO: 21261 - DNA, 35 bp, Artificial Sequence
  Synthetic oligonucleotide
aacctaacgcatgttgcatagttgccatccccgac

SEQ ID NO: 21262 - DNA, 35 bp, Artificial Sequence
  Synthetic oligonucleotide
aaaggccaacgcagccgctctaactcctaccatcg

SEQ ID NO: 21263 - DNA, 35 bp, Artificial Sequence
  Synthetic oligonucleotide
tgcgtacggcctattttcttgtacactgcctaact

SEQ ID NO: 21264 - DNA, 35 bp, Artificial Sequence
  Synthetic oligonucleotide
tacagacgtcacctgctccactccttctatttggt

SEQ ID NO: 21265 - DNA, 36 bp, Artificial Sequence
  Synthetic oligonucleotide
accaaagaccccgattcgctccttcagcctgcctca

SEQ ID NO: 21266 - DNA, 36 bp, Artificial Sequence
  Synthetic oligonucleotide
gcagaaggtggcatgggtcatttagggtggggcgga

SEQ ID NO: 21267 - DNA, 35 bp, Artificial Sequence
  Synthetic oligonucleotide
gtccctagcgcgctttgtacgatctggctctccta

SEQ ID NO: 21268 - DNA, 35 bp, Artificial Sequence
  Synthetic oligonucleotide
gctcatggtcacatcaccatgtaatgcccacacac

SEQ ID NO: 21269 - DNA, 35 bp, Artificial Sequence
  Synthetic oligonucleotide
gtgccattttcgcattgccataccacgcccagtcc

SEQ ID NO: 21270 - DNA, 35 bp, Artificial Sequence
  Synthetic oligonucleotide
gtctactcctgtgctttcctgccctgcccgacggc

SEQ ID NO: 21271 - DNA, 35 bp, Artificial Sequence
  Synthetic oligonucleotide
gccacaactgagggaggggggtactgagggtggcg

SEQ ID NO: 21272 - DNA, 35 bp, Artificial Sequence
  Synthetic oligonucleotide
agtgggcccggggataaaggaggtaaaaaacggat

SEQ ID NO: 21273 - DNA, 35 bp, Artificial Sequence
  Synthetic oligonucleotide
acgacccacccacaaacctacgaaacgagctcctt

SEQ ID NO: 21274 - DNA, 36 bp, Artificial Sequence
  Synthetic oligonucleotide
gagaccatgggggagaagtggacgttgtggggggca

SEQ ID NO: 21275 - DNA, 38 bp, Artificial Sequence
  Synthetic oligonucleotide
tcccgatcatggtggccctgcatgtatttcgttcttga

SEQ ID NO: 21276 - DNA, 37 bp, Artificial Sequence
  Synthetic oligonucleotide
gtcgctagtctccctcattgtacacccacctcgttga

SEQ ID NO: 21277 - DNA, 36 bp, Artificial Sequence
  Synthetic oligonucleotide
tcaccccagttggcgtcacggtccatcaccctttga

SEQ ID NO: 21278 - DNA, 35 bp, Artificial Sequence
  Synthetic oligonucleotide
tccacgaaccatttttcggtcgtgtacctgtaccc

SEQ ID NO: 21279 - DNA, 35 bp, Artificial Sequence
  Synthetic oligonucleotide
tgcccacccatgtagccggaacttcgggcctatcc

SEQ ID NO: 21280 - DNA, 35 bp, Artificial Sequence
  Synthetic oligonucleotide
agtgtgcaccccctgaccgcagtgacctcccctcc

SEQ ID NO: 21281 - DNA, 36 bp, Artificial Sequence
  Synthetic oligonucleotide
gctcatacagccgacaccgccgatttctgacctcca

SEQ ID NO: 21282 - DNA, 37 bp, Artificial Sequence
  Synthetic oligonucleotide
tcacacgagcccccacctgcaagtagcctcaagacga

SEQ ID NO: 21283 - DNA, 36 bp, Artificial Sequence
  Synthetic oligonucleotide
accccggcgtaccgcacgttccttccacccattcga

SEQ ID NO: 21284 - DNA, 37 bp, Artificial Sequence
  Synthetic oligonucleotide
tgccattgcctcgtacgcccttatttctccacctgga

SEQ ID NO: 21285 - DNA, 36 bp, Artificial Sequence
  Synthetic oligonucleotide
gttgcaggagcaagccactcctattttacaccctga

SEQ ID NO: 21286 - DNA, 35 bp, Artificial Sequence
  Synthetic oligonucleotide
acaacttccgatcctgctacttgaccaacatctgc

SEQ ID NO: 21287 - DNA, 35 bp, Artificial Sequence
  Synthetic oligonucleotide
tccacatggtggtcgaatatcttactggtacttct

SEQ ID NO: 21288 - DNA, 35 bp, Artificial Sequence
  Synthetic oligonucleotide
gactacatgaactggtggcccccctactgcacgca

SEQ ID NO: 21289 - DNA, 35 bp, Artificial Sequence
  Synthetic oligonucleotide
atcccgcaggctcaaccaccgttcaattcaggtca

SEQ ID NO: 21290 - DNA, 35 bp, Artificial Sequence
  Synthetic oligonucleotide
gagcccaagctgctcgttcgcgataaccttgcact

SEQ ID NO: 21291 - DNA, 35 bp, Artificial Sequence
  Synthetic oligonucleotide
gaagcctcgctagggcactttcacttatcaatttt

SEQ ID NO: 21292 - DNA, 37 bp, Artificial Sequence
  Synthetic oligonucleotide
taacaccactcacacgtgcaccacttcgttaccgcga

SEQ ID NO: 21293 - DNA, 37 bp, Artificial Sequence
  Synthetic oligonucleotide
gggggcgatgaagggctggaaaggagggctaggggga

SEQ ID NO: 21294 - DNA, 37 bp, Artificial Sequence
  Synthetic oligonucleotide
ttccgccgcctgaaagggccctgttcaatttccctga

SEQ ID NO: 21295 - DNA, 38 bp, Artificial Sequence
  Synthetic oligonucleotide
gctcagcaccggattcttttcaacctgccttctcctga

SEQ ID NO: 21296 - DNA, 38 bp, Artificial Sequence
  Synthetic oligonucleotide
tcatctacgaccgtttcgccggaccccgactccattga

SEQ ID NO: 21297 - DNA, 35 bp, Artificial Sequence
  Synthetic oligonucleotide
gtctaccatcccttgcaccagaggcgctacgctac

SEQ ID NO: 21298 - DNA, 35 bp, Artificial Sequence
  Synthetic oligonucleotide
atgaccaccacacgtaccagctcatgtactcaatt

SEQ ID NO: 21299 - DNA, 35 bp, Artificial Sequence
  Synthetic oligonucleotide
tacgccgatgactgatcgtaatcccccccccgctt

SEQ ID NO: 21300 - DNA, 37 bp, Artificial Sequence
  Synthetic oligonucleotide
gcaccaaggtaggaggaggtaaggtagttaggcgcga

SEQ ID NO: 21301 - DNA, 37 bp, Artificial Sequence
  Synthetic oligonucleotide
gcatagaaaatgagggggcatggtgagtaggcacgga

SEQ ID NO: 21302 - DNA, 38 bp, Artificial Sequence
  Synthetic oligonucleotide
atgtagggtgggagggcaaaaggtgtattgggccttga

SEQ ID NO: 21303 - DNA, 35 bp, Artificial Sequence
  Synthetic oligonucleotide
gatgacgacacactgtgccagaccccgaccgctcc

SEQ ID NO: 21304 - DNA, 35 bp, Artificial Sequence
  Synthetic oligonucleotide
tcaggccacccaagttgacccttaatggaatctcc

SEQ ID NO: 21305 - DNA, 35 bp, Artificial Sequence
  Synthetic oligonucleotide
gtgcccaactccccgttcagtcatcggtattgtcc

SEQ ID NO: 21306 - DNA, 35 bp, Artificial Sequence
  Synthetic oligonucleotide
tcacggagcatacacagttccatcgtcttactgtc

SEQ ID NO: 21307 - DNA, 35 bp, Artificial Sequence
  Synthetic oligonucleotide
gatgacgtcgacgtaggttctggcccttaactaat

SEQ ID NO: 21308 - DNA, 35 bp, Artificial Sequence
  Synthetic oligonucleotide
actgcgcccactcgccatatcaccgaacgcatcat

SEQ ID NO: 21309 - DNA, 35 bp, Artificial Sequence
  Synthetic oligonucleotide
tccaagtcgcacctgctttccgttcctgggttgct

SEQ ID NO: 21310 - DNA, 36 bp, Artificial Sequence
  Synthetic oligonucleotide
tcccaccactctcctcatagtacgaggaacacaaca

SEQ ID NO: 21311 - DNA, 38 bp, Artificial Sequence
  Synthetic oligonucleotide
gagggtggggagagattacacaggggagtggggtttga

SEQ ID NO: 21312 - DNA, 37 bp, Artificial Sequence
  Synthetic oligonucleotide
gtgatcacggcgcacaccttccatgttgccattttga

SEQ ID NO: 21313 - DNA, 35 bp, Artificial Sequence
  Synthetic oligonucleotide
atcgctacgaagcgcttccttgtcatgccgcctcc

SEQ ID NO: 21314 - DNA, 35 bp, Artificial Sequence
  Synthetic oligonucleotide
atattcacaccggctaccatctgcacgacacacgc

SEQ ID NO: 21315 - DNA, 35 bp, Artificial Sequence
  Synthetic oligonucleotide
tatggttgcaccgatcctcgttcccatctgttttc

SEQ ID NO: 21316 - DNA, 35 bp, Artificial Sequence
  Synthetic oligonucleotide
ttgtgtggtcggggggaaggtgttgtggaggggtg

SEQ ID NO: 21317 - DNA, 35 bp, Artificial Sequence
  Synthetic oligonucleotide
actattccgccgctttgtatttacaatctgtcctt

SEQ ID NO: 21318 - DNA, 36 bp, Artificial Sequence
  Synthetic oligonucleotide
tcaccattataccccacatctgtactgcagacgtaa

SEQ ID NO: 21319 - DNA, 36 bp, Artificial Sequence
  Synthetic oligonucleotide
tccttcatgctccgacttcgattattagctctcaca

SEQ ID NO: 21320 - DNA, 36 bp, Artificial Sequence
  Synthetic oligonucleotide
tgacccattccacgattttcatacgttcacactcga

SEQ ID NO: 21321 - DNA, 36 bp, Artificial Sequence
  Synthetic oligonucleotide
gcccttcgccagggcctaaacgcattgaattcccta

SEQ ID NO: 21322 - DNA, 35 bp, Artificial Sequence
  Synthetic oligonucleotide
ttgcgatgtcggagccccacttcggtcttgtaacc

SEQ ID NO: 21323 - DNA, 35 bp, Artificial Sequence
  Synthetic oligonucleotide
tcattctcgatcgttgcattaccccgcctgggacc

SEQ ID NO: 21324 - DNA, 35 bp, Artificial Sequence
  Synthetic oligonucleotide
gaacagatcgctcactgtaccacatcacttattgc

SEQ ID NO: 21325 - DNA, 35 bp, Artificial Sequence
  Synthetic oligonucleotide
acacgccttccgatggctaccagtgctgtactatc

SEQ ID NO: 21326 - DNA, 35 bp, Artificial Sequence
  Synthetic oligonucleotide
gccacacctcactgtaaccgaccctcctttgtaag

SEQ ID NO: 21327 - DNA, 35 bp, Artificial Sequence
  Synthetic oligonucleotide
atgctcataccagccgatggaccttcacacgtacg

SEQ ID NO: 21328 - DNA, 35 bp, Artificial Sequence
  Synthetic oligonucleotide
acgctcccgttctcttcctggcctcacagtttgcg

SEQ ID NO: 21329 - DNA, 35 bp, Artificial Sequence
  Synthetic oligonucleotide
tcaacctgagggcaaagggggtgaaagtgggtgct

SEQ ID NO: 21330 - DNA, 36 bp, Artificial Sequence
  Synthetic oligonucleotide
tcccgcctgcatgtccctgccgctattatgttacgt

SEQ ID NO: 21331 - DNA, 36 bp, Artificial Sequence
  Synthetic oligonucleotide
ttccaccccgttaaaccgcacctgactagggaccga

SEQ ID NO: 21332 - DNA, 36 bp, Artificial Sequence
  Synthetic oligonucleotide
ttgggtgacagaggttacggatgaggggcgggtgga

SEQ ID NO: 21333 - DNA, 35 bp, Artificial Sequence
  Synthetic oligonucleotide
tttcgccccgccttcttccgactattcagtcatac

SEQ ID NO: 21334 - DNA, 35 bp, Artificial Sequence
  Synthetic oligonucleotide
gtcaaccttaccccctttgcctgcggttgtgaacc

SEQ ID NO: 21335 - DNA, 35 bp, Artificial Sequence
  Synthetic oligonucleotide
aatctgccacagcacttgctggaacatacctaacc

SEQ ID NO: 21336 - DNA, 35 bp, Artificial Sequence
  Synthetic oligonucleotide
gtgtccacgcatcattatcttcgcacttaaacagc

SEQ ID NO: 21337 - DNA, 35 bp, Artificial Sequence
  Synthetic oligonucleotide
tcgacgctaagcatctcaatcactcactgcatgtc

SEQ ID NO: 21338 - DNA, 35 bp, Artificial Sequence
  Synthetic oligonucleotide
acccaccgtctcattacttactactactcatctag

SEQ ID NO: 21339 - DNA, 35 bp, Artificial Sequence
  Synthetic oligonucleotide
taaacgccccacccgactggtcatgatccaaatcg

SEQ ID NO: 21340 - DNA, 35 bp, Artificial Sequence
  Synthetic oligonucleotide
accccacccctcattgccgacatcgctgaagcggt

SEQ ID NO: 21341 - DNA, 35 bp, Artificial Sequence
  Synthetic oligonucleotide
gcaccacctcctagtgccagttgaagcctcacaca

SEQ ID NO: 21342 - DNA, 35 bp, Artificial Sequence
  Synthetic oligonucleotide
gttacctgcctcacggtcttacaatatgctatgca

SEQ ID NO: 21343 - DNA, 37 bp, Artificial Sequence
  Synthetic oligonucleotide
gtgagcgatccaagcacctcatccccccgtgacatga

SEQ ID NO: 21344 - DNA, 35 bp, Artificial Sequence
  Synthetic oligonucleotide
gtctcatccattgatctcacacgccattcatggcc

SEQ ID NO: 21345 - DNA, 35 bp, Artificial Sequence
  Synthetic oligonucleotide
acaactccaccgcacaaggttactcgtatcgcttg

SEQ ID NO: 21346 - DNA, 35 bp, Artificial Sequence
  Synthetic oligonucleotide
tgacgctctctgtttcacctgctttctcattgggt

SEQ ID NO: 21347 - DNA, 35 bp, Artificial Sequence
  Synthetic oligonucleotide
gacctctgcccgccttctcatctgtcattgcattt

SEQ ID NO: 21348 - DNA, 37 bp, Artificial Sequence
  Synthetic oligonucleotide
tatagcccaggaagggggaaggaaatgtacgatggga

SEQ ID NO: 21349 - DNA, 38 bp, Artificial Sequence
  Synthetic oligonucleotide
tgtaccgcgcacatcacagcttcccgccattctcctga

SEQ ID NO: 21350 - DNA, 35 bp, Artificial Sequence
  Synthetic oligonucleotide
tgaccatacccgctcagcctgctatgcaatactcc

SEQ ID NO: 21351 - DNA, 35 bp, Artificial Sequence
  Synthetic oligonucleotide
tccgactcctctacatttgccacctatggctcacg

SEQ ID NO: 21352 - DNA, 35 bp, Artificial Sequence
  Synthetic oligonucleotide
tacctgccacgtcccgttcttcgcattcaaaccgt

SEQ ID NO: 21353 - DNA, 35 bp, Artificial Sequence
  Synthetic oligonucleotide
aaacacagccagacaggggggaaaggtagggcgtt

SEQ ID NO: 21354 - DNA, 36 bp, Artificial Sequence
  Synthetic oligonucleotide
tccgcaccgcagggactccacttaactattgcccaa

SEQ ID NO: 21355 - DNA, 35 bp, Artificial Sequence
  Synthetic oligonucleotide
tacgaagggtgcagataatcactataggctgggaa

SEQ ID NO: 21356 - DNA, 36 bp, Artificial Sequence
  Synthetic oligonucleotide
gactcacactcctcactgtatctaccactaggtgaa

SEQ ID NO: 21357 - DNA, 36 bp, Artificial Sequence
  Synthetic oligonucleotide
gttacatgtcccgccatataggcccacttgactcca

SEQ ID NO: 21358 - DNA, 35 bp, Artificial Sequence
  Synthetic oligonucleotide
tctccccctcaatgttaacatcatggcaaaccgca

SEQ ID NO: 21359 - DNA, 37 bp, Artificial Sequence
  Synthetic oligonucleotide
actggaggagaggggctgcattcgagggacggagtga

SEQ ID NO: 21360 - DNA, 36 bp, Artificial Sequence
  Synthetic oligonucleotide
attccctcgccgtgtcttttatagccgcaattccta

SEQ ID NO: 21361 - DNA, 35 bp, Artificial Sequence
  Synthetic oligonucleotide
gttcagctcgtacccagactctgccgaactgtcta

SEQ ID NO: 21362 - DNA, 36 bp, Artificial Sequence
  Synthetic oligonucleotide
gcacgaccggcccacgtgctaatgttcctccattta

SEQ ID NO: 21363 - DNA, 35 bp, Artificial Sequence
  Synthetic oligonucleotide
tactcgccctggtaccctctgcttgcattgtttac

SEQ ID NO: 21364 - DNA, 35 bp, Artificial Sequence
  Synthetic oligonucleotide
gatttggcccccaccaatggtcccccgttagaccc

SEQ ID NO: 21365 - DNA, 35 bp, Artificial Sequence
  Synthetic oligonucleotide
tatcgtgcgcattgcatgtcccgttttgctgttcc

SEQ ID NO: 21366 - DNA, 35 bp, Artificial Sequence
  Synthetic oligonucleotide
ttggccaaccttaacatgtttgttttcaatgcctg

SEQ ID NO: 21367 - DNA, 34 bp, Artificial Sequence
  Synthetic oligonucleotide
tgagtacgatcgatagcgtcctcctgctaccact

SEQ ID NO: 21368 - DNA, 35 bp, Artificial Sequence
  Synthetic oligonucleotide
gtggtgcgatgcccggtgccttaacttcctcctgt

SEQ ID NO: 21369 - DNA, 35 bp, Artificial Sequence
  Synthetic oligonucleotide
tgaacctcccagtctcagctatcaagcccccattt

SEQ ID NO: 21370 - DNA, 36 bp, Artificial Sequence
  Synthetic oligonucleotide
gtgacacacacgtgttcactctcccgattggaacaa

SEQ ID NO: 21371 - DNA, 36 bp, Artificial Sequence
  Synthetic oligonucleotide
actccacttgtgctgctgctgcatatacctacgcca

SEQ ID NO: 21372 - DNA, 35 bp, Artificial Sequence
  Synthetic oligonucleotide
gacatacgctccttctcacatcgcgtgacaattca

SEQ ID NO: 21373 - DNA, 37 bp, Artificial Sequence
  Synthetic oligonucleotide
atgtcgcgacctgctctggccaccctgctccatgcga

SEQ ID NO: 21374 - DNA, 36 bp, Artificial Sequence
  Synthetic oligonucleotide
aagaggggggcaagggtgtaggccggaagtaatcga

SEQ ID NO: 21375 - DNA, 37 bp, Artificial Sequence
  Synthetic oligonucleotide
gactagggtgaatggacggtgatttgggggctaggga

SEQ ID NO: 21376 - DNA, 37 bp, Artificial Sequence
  Synthetic oligonucleotide
atgtcacccggcactgactgattgaactcaccgggga

SEQ ID NO: 21377 - DNA, 37 bp, Artificial Sequence
  Synthetic oligonucleotide
gtgtaccgccactcgcattttttgagacaatacatga

SEQ ID NO: 21378 - DNA, 36 bp, Artificial Sequence
  Synthetic oligonucleotide
cgtaatgtgcaccgacgtactgtccaatccgcttta

SEQ ID NO: 21379 - DNA, 35 bp, Artificial Sequence
  Synthetic oligonucleotide
gccaacaactggcggtaataccactccataagccc

SEQ ID NO: 21380 - DNA, 35 bp, Artificial Sequence
  Synthetic oligonucleotide
acgctgccataacttcccccagagccactttcatg

SEQ ID NO: 21381 - DNA, 35 bp, Artificial Sequence
  Synthetic oligonucleotide
gtcaccctatcctgcttttagtggcgtacgaccat

SEQ ID NO: 21382 - DNA, 35 bp, Artificial Sequence
  Synthetic oligonucleotide
tcatctgtcgaatttctgggctaccttcccctgct

SEQ ID NO: 21383 - DNA, 35 bp, Artificial Sequence
  Synthetic oligonucleotide
ttgacccgccagcctgttgtgggctgaatccctct

SEQ ID NO: 21384 - DNA, 36 bp, Artificial Sequence
  Synthetic oligonucleotide
atccatcgtatcgcctcacctatagtcactggccca

SEQ ID NO: 21385 - DNA, 37 bp, Artificial Sequence
  Synthetic oligonucleotide
gattatccaccgcccgcttaggccttgctctgcagga

SEQ ID NO: 21386 - DNA, 36 bp, Artificial Sequence
  Synthetic oligonucleotide
agacagaacgtccctagacccgactcccgcccttta

SEQ ID NO: 21387 - DNA, 35 bp, Artificial Sequence
  Synthetic oligonucleotide
attgcgcacttcgggcttagcacatacttccgact

SEQ ID NO: 21388 - DNA, 35 bp, Artificial Sequence
  Synthetic oligonucleotide
agatctccaatactgtgtttcccagcctgccatct

SEQ ID NO: 21389 - DNA, 36 bp, Artificial Sequence
  Synthetic oligonucleotide
aaccttacacatgctagctccagcgcctccaccaca

SEQ ID NO: 21390 - DNA, 35 bp, Artificial Sequence
  Synthetic oligonucleotide
gcccttcgtaccacatgtgaactcttgccacatca

SEQ ID NO: 21391 - DNA, 36 bp, Artificial Sequence
  Synthetic oligonucleotide
gccacccaccatttgaagcataactttgcacttcga

SEQ ID NO: 21392 - DNA, 35 bp, Artificial Sequence
  Synthetic oligonucleotide
tcctcagccgtgccacgacgccctcggacctctga

SEQ ID NO: 21393 - DNA, 37 bp, Artificial Sequence
  Synthetic oligonucleotide
gatgggggccggataggagatgggcggaagggcgtga

SEQ ID NO: 21394 - DNA, 35 bp, Artificial Sequence
  Synthetic oligonucleotide
acaacgcaccatattccggttgctcggttttccac

SEQ ID NO: 21395 - DNA, 35 bp, Artificial Sequence
  Synthetic oligonucleotide
tagtcctccccgtcatatcaccactgacgtttcac

SEQ ID NO: 21396 - DNA, 35 bp, Artificial Sequence
  Synthetic oligonucleotide
tcacgtcgtatgccggttctattcccaacgtcctc

SEQ ID NO: 21397 - DNA, 35 bp, Artificial Sequence
  Synthetic oligonucleotide
ttgctcaacctccgggttatatcaccttctcattg

SEQ ID NO: 21398 - DNA, 35 bp, Artificial Sequence
  Synthetic oligonucleotide
gtccccctcaatcgcttcaagagtctccagactct

SEQ ID NO: 21399 - DNA, 36 bp, Artificial Sequence
  Synthetic oligonucleotide
accacccaccgccgcaagcaaatcgtccccgggcaa

SEQ ID NO: 21400 - DNA, 37 bp, Artificial Sequence
  Synthetic oligonucleotide
aacacacgccccacagacggtctcctcttctcagcga

SEQ ID NO: 21401 - DNA, 38 bp, Artificial Sequence
  Synthetic oligonucleotide
ggatggtctgacgctccccgacgcctccttatgcttga

SEQ ID NO: 21402 - DNA, 36 bp, Artificial Sequence
  Synthetic oligonucleotide
gccggagacttgcccaagcccgcctgcctccctata

SEQ ID NO: 21403 - DNA, 35 bp, Artificial Sequence
  Synthetic oligonucleotide
gtgtcatccgactgcatacgcacgacacttacacc

SEQ ID NO: 21404 - DNA, 35 bp, Artificial Sequence
  Synthetic oligonucleotide
tttccaccactacgtacagtccggcattcccgccc

SEQ ID NO: 21405 - DNA, 35 bp, Artificial Sequence
  Synthetic oligonucleotide
tttacctagcgctactatcggcactgggcccttct

SEQ ID NO: 21406 - DNA, 36 bp, Artificial Sequence
  Synthetic oligonucleotide
aaacctcacttctgtattttgcccgtcctcttcgca

SEQ ID NO: 21407 - DNA, 37 bp, Artificial Sequence
  Synthetic oligonucleotide
atcacgcactcgctgtctacacttcctggcctaccga

SEQ ID NO: 21408 - DNA, 37 bp, Artificial Sequence
  Synthetic oligonucleotide
cccactacgccatcaatcacgcctttcatacgcagga

SEQ ID NO: 21409 - DNA, 37 bp, Artificial Sequence
  Synthetic oligonucleotide
gttcccacccctgtccacgaatgtaggattgcatgga

SEQ ID NO: 21410 - DNA, 36 bp, Artificial Sequence
  Synthetic oligonucleotide
gtcccctcggggtgtgctggatccatttcctcgtta

SEQ ID NO: 21411 - DNA, 35 bp, Artificial Sequence
  Synthetic oligonucleotide
tccctcggccccatattaccgttttggacaaatcc

SEQ ID NO: 21412 - DNA, 35 bp, Artificial Sequence
  Synthetic oligonucleotide
tgccccatcatgggccagacactcgcaaacggtgg

SEQ ID NO: 21413 - DNA, 35 bp, Artificial Sequence
  Synthetic oligonucleotide
ttcctcccacatgcccaacgcgagaccggcctatg

SEQ ID NO: 21414 - DNA, 35 bp, Artificial Sequence
  Synthetic oligonucleotide
ggtaccaccacctacgtcatcagacctatcatctg

SEQ ID NO: 21415 - DNA, 35 bp, Artificial Sequence
  Synthetic oligonucleotide
tacgaccaaccctccccgctagtatatgaactagt

SEQ ID NO: 21416 - DNA, 36 bp, Artificial Sequence
  Synthetic oligonucleotide
agaccatctgcatcttgcccaccactacgctgagca

SEQ ID NO: 21417 - DNA, 37 bp, Artificial Sequence
  Synthetic oligonucleotide
gacccactgatctgacaataactcaccgcccatcgga

SEQ ID NO: 21418 - DNA, 36 bp, Artificial Sequence
  Synthetic oligonucleotide
gtcgagtagggggacgatcacggagggcaaactgga

SEQ ID NO: 21419 - DNA, 38 bp, Artificial Sequence
  Synthetic oligonucleotide
tagccaaccagcctgcccgtcgcccacattcagcttga

SEQ ID NO: 21420 - DNA, 36 bp, Artificial Sequence
  Synthetic oligonucleotide
tcattggcgtgacggccgcccccatatcacctacca

SEQ ID NO: 21421 - DNA, 36 bp, Artificial Sequence
  Synthetic oligonucleotide
atacacgcccacaacagccccgcctcctagccgtca

SEQ ID NO: 21422 - DNA, 37 bp, Artificial Sequence
  Synthetic oligonucleotide
ggaaagggaggggtgtggaagtgggaaagagttcaga

SEQ ID NO: 21423 - DNA, 37 bp, Artificial Sequence
  Synthetic oligonucleotide
acgctgtagcctacactcacccttctcgtttcgcgga

SEQ ID NO: 21424 - DNA, 36 bp, Artificial Sequence
  Synthetic oligonucleotide
acatcttccgcaccttgtggcgtacctcctgcatta

SEQ ID NO: 21425 - DNA, 35 bp, Artificial Sequence
  Synthetic oligonucleotide
atgtcggggctgctgtaccccttccgagccttctc

SEQ ID NO: 21426 - DNA, 36 bp, Artificial Sequence
  Synthetic oligonucleotide
acgtcccttcgcccaaccgttctcatctgtgacaca

SEQ ID NO: 21427 - DNA, 36 bp, Artificial Sequence
  Synthetic oligonucleotide
gatgtgcagaaaatgggagggcggggggtttgacca

SEQ ID NO: 21428 - DNA, 36 bp, Artificial Sequence
  Synthetic oligonucleotide
atctacccacgacgcgtatagttactcgcaatccca

SEQ ID NO: 21429 - DNA, 37 bp, Artificial Sequence
  Synthetic oligonucleotide
acacactttaccgcggtccatgactgagccaccacga

SEQ ID NO: 21430 - DNA, 38 bp, Artificial Sequence
  Synthetic oligonucleotide
tcacgtccgttcccccctgttaggttgccctgtaatga

SEQ ID NO: 21431 - DNA, 38 bp, Artificial Sequence
  Synthetic oligonucleotide
gtacacgtctggttctctcttcttttactgctacctga

SEQ ID NO: 21432 - DNA, 38 bp, Artificial Sequence
  Synthetic oligonucleotide
acagttcccccctgcactcccccagtcacagaccttga

SEQ ID NO: 21433 - DNA, 36 bp, Artificial Sequence
  Synthetic oligonucleotide
tcccgcatgcataatgtcccttcccgcacccactta

SEQ ID NO: 21434 - DNA, 35 bp, Artificial Sequence
  Synthetic oligonucleotide
acaccaacacaaagttgggcattacatagcaatcc

SEQ ID NO: 21435 - DNA, 35 bp, Artificial Sequence
  Synthetic oligonucleotide
tttcgcgggctcatctctgctggggcgcatttctc

SEQ ID NO: 21436 - DNA, 35 bp, Artificial Sequence
  Synthetic oligonucleotide
gtgggaaccgagcacaggagataggggggtcgagg

SEQ ID NO: 21437 - DNA, 35 bp, Artificial Sequence
  Synthetic oligonucleotide
ttgcaaccccgctttcacacgaaacccgtagccct

SEQ ID NO: 21438 - DNA, 35 bp, Artificial Sequence
  Synthetic oligonucleotide
taacccgtagaggtttgccctgtgtctccatccct

SEQ ID NO: 21439 - DNA, 35 bp, Artificial Sequence
  Synthetic oligonucleotide
atgcatgactcccagccggcgtaaacatattccca

SEQ ID NO: 21440 - DNA, 36 bp, Artificial Sequence
  Synthetic oligonucleotide
gcaaccccctcggcacatgagaccaattcatgggca

SEQ ID NO: 21441 - DNA, 37 bp, Artificial Sequence
  Synthetic oligonucleotide
taaaccccatcatcctgtcctataaggactatcctga

SEQ ID NO: 21442 - DNA, 38 bp, Artificial Sequence
  Synthetic oligonucleotide
agcgccgtcgagctccatttagccccctcctctagtga

SEQ ID NO: 21443 - DNA, 38 bp, Artificial Sequence
  Synthetic oligonucleotide
gaacccgtttcatccccatatgcgcgccctgcccttga

SEQ ID NO: 21444 - DNA, 35 bp, Artificial Sequence
  Synthetic oligonucleotide
tcccgaacaccacttgccttaggtatcgtatgata

SEQ ID NO: 21445 - DNA, 36 bp, Artificial Sequence
  Synthetic oligonucleotide
gcaccgtggactctgcggacctccatttcctctcta

SEQ ID NO: 21446 - DNA, 35 bp, Artificial Sequence
  Synthetic oligonucleotide
tgtaccgttgcggacgtactacactacacactggc

SEQ ID NO: 21447 - DNA, 35 bp, Artificial Sequence
  Synthetic oligonucleotide
gtatagcctagtgtgctgctcatatcctgtttttc

SEQ ID NO: 21448 - DNA, 35 bp, Artificial Sequence
  Synthetic oligonucleotide
acaggggtatattacgggtgggtatggtgatgggg

SEQ ID NO: 21449 - DNA, 38 bp, Artificial Sequence
  Synthetic oligonucleotide
gttgcgcgcctgtacggattacgcctcccccccactga

SEQ ID NO: 21450 - DNA, 34 bp, Artificial Sequence
  Synthetic oligonucleotide
tactcagctgccgtagtcaccttaccagtttttc

SEQ ID NO: 21451 - DNA, 35 bp, Artificial Sequence
  Synthetic oligonucleotide
accaagggggtggggggggaagggtagtagatagg

SEQ ID NO: 21452 - DNA, 35 bp, Artificial Sequence
  Synthetic oligonucleotide
gttcacagcacgtcaccctccgaatttgccccatg

SEQ ID NO: 21453 - DNA, 36 bp, Artificial Sequence
  Synthetic oligonucleotide
gacgactcctgtccgctattactccagttaatttaa

SEQ ID NO: 21454 - DNA, 38 bp, Artificial Sequence
  Synthetic oligonucleotide
atgcacccctcccagtattccgtcaatccatgaacgga

SEQ ID NO: 21455 - DNA, 37 bp, Artificial Sequence
  Synthetic oligonucleotide
gcaccacgccaggtcgccctccccttcgatttctgga

SEQ ID NO: 21456 - DNA, 38 bp, Artificial Sequence
  Synthetic oligonucleotide
gcctcctccctcatccagctgtcgcgggtctccgctga

SEQ ID NO: 21457 - DNA, 37 bp, Artificial Sequence
  Synthetic oligonucleotide
gtccccactctatctgtctcttcagccacgaagttga

SEQ ID NO: 21458 - DNA, 35 bp, Artificial Sequence
  Synthetic oligonucleotide
acacccgcctggcttttccactagtcctatgctac

SEQ ID NO: 21459 - DNA, 35 bp, Artificial Sequence
  Synthetic oligonucleotide
tgagacacgccaaaatcccataccacgccgtttcc

SEQ ID NO: 21460 - DNA, 35 bp, Artificial Sequence
  Synthetic oligonucleotide
gagtccatcattatgctcttgcaacactgtctcgc

SEQ ID NO: 21461 - DNA, 35 bp, Artificial Sequence
  Synthetic oligonucleotide
gacacggatcgcgtcttttgtgctggcttccttcg

SEQ ID NO: 21462 - DNA, 35 bp, Artificial Sequence
  Synthetic oligonucleotide
accatcactcctgtttaggcccttcgcatccaact

SEQ ID NO: 21463 - DNA, 36 bp, Artificial Sequence
  Synthetic oligonucleotide
tcccctgccctaagtgagccaagcccccctcctcaa

SEQ ID NO: 21464 - DNA, 38 bp, Artificial Sequence
  Synthetic oligonucleotide
tctcccctccgaactggttttgtccccatgatctatga

SEQ ID NO: 21465 - DNA, 37 bp, Artificial Sequence
  Synthetic oligonucleotide
tgaacatccggcccttatggcgtaccatccaccgtga

SEQ ID NO: 21466 - DNA, 35 bp, Artificial Sequence
  Synthetic oligonucleotide
gacccaaccgggtcgctacctgaatcaataccgta

SEQ ID NO: 21467 - DNA, 35 bp, Artificial Sequence
  Synthetic oligonucleotide
ttacttagcggcactcagctccatcggaccccccc

SEQ ID NO: 21468 - DNA, 35 bp, Artificial Sequence
  Synthetic oligonucleotide
acatgaccctgttgcacattccagcccacaagagc

SEQ ID NO: 21469 - DNA, 35 bp, Artificial Sequence
  Synthetic oligonucleotide
gcactggcacactacgctttctcatggttacacgc

SEQ ID NO: 21470 - DNA, 35 bp, Artificial Sequence
  Synthetic oligonucleotide
gccattgctctgagactcttttagaccactgcctc

SEQ ID NO: 21471 - DNA, 35 bp, Artificial Sequence
  Synthetic oligonucleotide
ggactgcaagccgcctccgaacacgtgacacccat

SEQ ID NO: 21472 - DNA, 35 bp, Artificial Sequence
  Synthetic oligonucleotide
taccgttgaccgttgttatccagccacacactctt

SEQ ID NO: 21473 - DNA, 35 bp, Artificial Sequence
  Synthetic oligonucleotide
tgtatatccgcgcacccgctttccaccgttcacaa

SEQ ID NO: 21474 - DNA, 36 bp, Artificial Sequence
  Synthetic oligonucleotide
tcccaaatcccgttcccgttacccatggagcacgaa

SEQ ID NO: 21475 - DNA, 36 bp, Artificial Sequence
  Synthetic oligonucleotide
tcactactcgtgccacttcttgacatactgcactca

SEQ ID NO: 21476 - DNA, 37 bp, Artificial Sequence
  Synthetic oligonucleotide
taaaccagccactaagagtatccaccgcctccactga

SEQ ID NO: 21477 - DNA, 38 bp, Artificial Sequence
  Synthetic oligonucleotide
gcctcccatactcgccgttgcttctacacagttgctga

SEQ ID NO: 21478 - DNA, 34 bp, Artificial Sequence
  Synthetic oligonucleotide
accccgccacctggcacaggtgttacttcacaac

SEQ ID NO: 21479 - DNA, 35 bp, Artificial Sequence
  Synthetic oligonucleotide
acaaacgccctatgccgctcgtgttccaaccatct

SEQ ID NO: 21480 - DNA, 36 bp, Artificial Sequence
  Synthetic oligonucleotide
tcctaacacgcagatatcacatgcccttcacgcaca

SEQ ID NO: 21481 - DNA, 36 bp, Artificial Sequence
  Synthetic oligonucleotide
tctacgtccggccctgttaatgcaaccgctcgcaca

SEQ ID NO: 21482 - DNA, 36 bp, Artificial Sequence
  Synthetic oligonucleotide
acactctgcccaatgcaccgtaacttcaatgcccca

SEQ ID NO: 21483 - DNA, 36 bp, Artificial Sequence
  Synthetic oligonucleotide
gtgcatccacaggcgcccgccgatcccatctagcca

SEQ ID NO: 21484 - DNA, 35 bp, Artificial Sequence
  Synthetic oligonucleotide
atcccatgctcgtattccacccctaactccacgga

SEQ ID NO: 21485 - DNA, 36 bp, Artificial Sequence
  Synthetic oligonucleotide
cctcagtcactccgcccaagtgtcatctcggaggga

SEQ ID NO: 21486 - DNA, 37 bp, Artificial Sequence
  Synthetic oligonucleotide
aaccggagatgaagtaaagggctgtgggtggggggga

SEQ ID NO: 21487 - DNA, 37 bp, Artificial Sequence
  Synthetic oligonucleotide
ataagtgcgacggggcggataggactaggggtttgga

SEQ ID NO: 21488 - DNA, 38 bp, Artificial Sequence
  Synthetic oligonucleotide
tgactacccccagtgccgtgccgtttatcgcattatga

SEQ ID NO: 21489 - DNA, 38 bp, Artificial Sequence
  Synthetic oligonucleotide
tccacctcgacgcacgacttcattcccttctggcttga

SEQ ID NO: 21490 - DNA, 36 bp, Artificial Sequence
  Synthetic oligonucleotide
tacacgatgggcgatcgctgtaccatccttttttga

SEQ ID NO: 21491 - DNA, 35 bp, Artificial Sequence
  Synthetic oligonucleotide
ggaccgccgcttcctcccctcacggcccgttgcta

SEQ ID NO: 21492 - DNA, 35 bp, Artificial Sequence
  Synthetic oligonucleotide
accgacccccggacgccgtgccctgggactctcta

SEQ ID NO: 21493 - DNA, 34 bp, Artificial Sequence
  Synthetic oligonucleotide
acatggcacgcacctccgcaatgccactctgtta

SEQ ID NO: 21494 - DNA, 35 bp, Artificial Sequence
  Synthetic oligonucleotide
ttagtctaacacctgtccgccatcgagctccgatc

SEQ ID NO: 21495 - DNA, 35 bp, Artificial Sequence
  Synthetic oligonucleotide
atgcccattgcccggctaggttttcccgacctcat

SEQ ID NO: 21496 - DNA, 35 bp, Artificial Sequence
  Synthetic oligonucleotide
gactcccggatggccaattaactttacgctgcatt

SEQ ID NO: 21497 - DNA, 35 bp, Artificial Sequence
  Synthetic oligonucleotide
tcagcccttgttccccacagcatgtggacctccca

SEQ ID NO: 21498 - DNA, 37 bp, Artificial Sequence
  Synthetic oligonucleotide
accaaccacacactgagtacacatcagaccttggaga

SEQ ID NO: 21499 - DNA, 36 bp, Artificial Sequence
  Synthetic oligonucleotide
gtgggagggctcgaaaagcaggcttaggggacggga

SEQ ID NO: 21500 - DNA, 35 bp, Artificial Sequence
  Synthetic oligonucleotide
gaatcacacttgtctcgccctgctcacgggtacac

SEQ ID NO: 21501 - DNA, 35 bp, Artificial Sequence
  Synthetic oligonucleotide
tccctggtccgctcgacagctgtcattcctaccac

SEQ ID NO: 21502 - DNA, 35 bp, Artificial Sequence
  Synthetic oligonucleotide
tagtggcatacatctgactttctcccgtggctacc

SEQ ID NO: 21503 - DNA, 35 bp, Artificial Sequence
  Synthetic oligonucleotide
gtttcgccggaattcccattttagtgcccgcatcc

SEQ ID NO: 21504 - DNA, 35 bp, Artificial Sequence
  Synthetic oligonucleotide
atcgaaccacctctcctgctcagaaggaacccgtc

SEQ ID NO: 21505 - DNA, 35 bp, Artificial Sequence
  Synthetic oligonucleotide
acctcacgccatacgtttccatacattgatccaag

SEQ ID NO: 21506 - DNA, 35 bp, Artificial Sequence
  Synthetic oligonucleotide
tagcacaacctccactcccattcgcttttcctgtg

SEQ ID NO: 21507 - DNA, 35 bp, Artificial Sequence
  Synthetic oligonucleotide
attgacactcgctgcgtactcttcattttccctgt

SEQ ID NO: 21508 - DNA, 35 bp, Artificial Sequence
  Synthetic oligonucleotide
tatgcccccctcgatgagatatctagttctcaatt

SEQ ID NO: 21509 - DNA, 35 bp, Artificial Sequence
  Synthetic oligonucleotide
tttgctcgcccaacaggtctatcactgcaatcaca

SEQ ID NO: 21510 - DNA, 38 bp, Artificial Sequence
  Synthetic oligonucleotide
ggttggcggtgaaggtctgggaaaggaggggaggctga

SEQ ID NO: 21511 - DNA, 38 bp, Artificial Sequence
  Synthetic oligonucleotide
tcagagcgccctgccattgctatccttgttctatttga

SEQ ID NO: 21512 - DNA, 37 bp, Artificial Sequence
  Synthetic oligonucleotide
tgtacacccttgctgcctggttccggttctactcgta

SEQ ID NO: 21513 - DNA, 35 bp, Artificial Sequence
  Synthetic oligonucleotide
ttggccagacgaacgcaccgacttgcctctctcat

SEQ ID NO: 21514 - DNA, 36 bp, Artificial Sequence
  Synthetic oligonucleotide
gtcatgcacatcgctgtacctgtcccttagctagca

SEQ ID NO: 21515 - DNA, 35 bp, Artificial Sequence
  Synthetic oligonucleotide
gacgtcacgcgctatcttcactcccagtacgtgca

SEQ ID NO: 21516 - DNA, 36 bp, Artificial Sequence
  Synthetic oligonucleotide
gcaggacctgcctgctttacacaccctatcaactca

SEQ ID NO: 21517 - DNA, 37 bp, Artificial Sequence
  Synthetic oligonucleotide
gcgagtgggaaagggcggttgcagggacacagtgcga

SEQ ID NO: 21518 - DNA, 36 bp, Artificial Sequence
  Synthetic oligonucleotide
attgccacccaacaccaggacacaagtgaggtccta

SEQ ID NO: 21519 - DNA, 35 bp, Artificial Sequence
  Synthetic oligonucleotide
gatctgcgcactgtagttcgcccgtatctgtccta

SEQ ID NO: 21520 - DNA, 36 bp, Artificial Sequence
  Synthetic oligonucleotide
tagccgtcctttggtctactccctttcctcgtcgta

SEQ ID NO: 21521 - DNA, 35 bp, Artificial Sequence
  Synthetic oligonucleotide
gttcccatcatctgcgagacccacgctaacgtgcc

SEQ ID NO: 21522 - DNA, 35 bp, Artificial Sequence
  Synthetic oligonucleotide
tcacccggtcccacttaacgtcatgcccctctgct

SEQ ID NO: 21523 - DNA, 35 bp, Artificial Sequence
  Synthetic oligonucleotide
actgactccgggagcgtactcgttgccacattttt

SEQ ID NO: 21524 - DNA, 36 bp, Artificial Sequence
  Synthetic oligonucleotide
ggtcaccacaactatagaattgagttcacctatcca

SEQ ID NO: 21525 - DNA, 35 bp, Artificial Sequence
  Synthetic oligonucleotide
aaccccgcgttcaacaagccctgtcccttctcaac

SEQ ID NO: 21526 - DNA, 35 bp, Artificial Sequence
  Synthetic oligonucleotide
tccatgaggacaattggcatggctttgtattttcg

SEQ ID NO: 21527 - DNA, 35 bp, Artificial Sequence
  Synthetic oligonucleotide
taccgccccttccattctggtactttgttgccgtg

SEQ ID NO: 21528 - DNA, 35 bp, Artificial Sequence
  Synthetic oligonucleotide
ttcgtggtggcccggattcgcaagtcacactccat

SEQ ID NO: 21529 - DNA, 35 bp, Artificial Sequence
  Synthetic oligonucleotide
agacttgaccgcctccaaccctgagtgacacctca

SEQ ID NO: 21530 - DNA, 36 bp, Artificial Sequence
  Synthetic oligonucleotide
atcgccggcctagcatataccgtcccatacctacga

SEQ ID NO: 21531 - DNA, 37 bp, Artificial Sequence
  Synthetic oligonucleotide
aacgtacccacccctctttgaacgatagtcaccttga

SEQ ID NO: 21532 - DNA, 36 bp, Artificial Sequence
  Synthetic oligonucleotide
tagacgcagaccgggccattggtagtcccctcttta

SEQ ID NO: 21533 - DNA, 35 bp, Artificial Sequence
  Synthetic oligonucleotide
gaaccgtctagaccatttttgtgccgcttgtaccc

SEQ ID NO: 21534 - DNA, 35 bp, Artificial Sequence
  Synthetic oligonucleotide
acgaccccgtactttcctgagtagccaatatctcc

SEQ ID NO: 21535 - DNA, 35 bp, Artificial Sequence
  Synthetic oligonucleotide
tggagccgcctatctagcatgtctcgtctgtctcc

SEQ ID NO: 21536 - DNA, 35 bp, Artificial Sequence
  Synthetic oligonucleotide
gagtctagcacctttcctcgtttgcatcggccctc

SEQ ID NO: 21537 - DNA, 35 bp, Artificial Sequence
  Synthetic oligonucleotide
acacgattgcgttccggtcgtgcccttttaccgct

SEQ ID NO: 21538 - DNA, 35 bp, Artificial Sequence
  Synthetic oligonucleotide
acacaggagggcgtacatgatccttctctttgtct

SEQ ID NO: 21539 - DNA, 36 bp, Artificial Sequence
  Synthetic oligonucleotide
gatcgccttccttgcatgcccccaatagagccccaa

SEQ ID NO: 21540 - DNA, 36 bp, Artificial Sequence
  Synthetic oligonucleotide
ttcgtcgaacgcacctccgagcttaatgtctttcaa

SEQ ID NO: 21541 - DNA, 36 bp, Artificial Sequence
  Synthetic oligonucleotide
tgcacctagtttctgttccttcgcccgtccccgtaa

SEQ ID NO: 21542 - DNA, 37 bp, Artificial Sequence
  Synthetic oligonucleotide
ggtgggggagggtctgtgggggctggcttcgatagga

SEQ ID NO: 21543 - DNA, 38 bp, Artificial Sequence
  Synthetic oligonucleotide
gcaaaccgcccaatatctgtacatggtctcacttctga

SEQ ID NO: 21544 - DNA, 36 bp, Artificial Sequence
  Synthetic oligonucleotide
gatcccacccgagcccgttcctctttaacgccctta

SEQ ID NO: 21545 - DNA, 35 bp, Artificial Sequence
  Synthetic oligonucleotide
tcatatggtcggcccaatacataaacgccctgccc

SEQ ID NO: 21546 - DNA, 35 bp, Artificial Sequence
  Synthetic oligonucleotide
tcccgacccgcgcaatctgttactttgtcgaatgc

SEQ ID NO: 21547 - DNA, 35 bp, Artificial Sequence
  Synthetic oligonucleotide
gacacccgccgtgttcctttatggtgatccctgat

SEQ ID NO: 21548 - DNA, 35 bp, Artificial Sequence
  Synthetic oligonucleotide
gttaacgccagattatacccatctcgcccgcacct

SEQ ID NO: 21549 - DNA, 35 bp, Artificial Sequence
  Synthetic oligonucleotide
tcaaccatacacttgtatacaagacgtctccttct

SEQ ID NO: 21550 - DNA, 35 bp, Artificial Sequence
  Synthetic oligonucleotide
actaccatccccccgcagtctccatggcctggttt

SEQ ID NO: 21551 - DNA, 36 bp, Artificial Sequence
  Synthetic oligonucleotide
gccaagtgcacttcaccgtccccctggcattgcaca

SEQ ID NO: 21552 - DNA, 37 bp, Artificial Sequence
  Synthetic oligonucleotide
tgaatgcgccacactgcactcttgttttacttgccga

SEQ ID NO: 21553 - DNA, 38 bp, Artificial Sequence
  Synthetic oligonucleotide
gtgacatccacccagcgtacatattggttttcgcctga

SEQ ID NO: 21554 - DNA, 38 bp, Artificial Sequence
  Synthetic oligonucleotide
gagggaaaatggcaggattgggagaaagctgcagctga

SEQ ID NO: 21555 - DNA, 38 bp, Artificial Sequence
  Synthetic oligonucleotide
tagcgggatggggcggggagggtactatggggtattga

SEQ ID NO: 21556 - DNA, 38 bp, Artificial Sequence
  Synthetic oligonucleotide
gaggtgcacaaaggagagaggtgggtgggatgagttga

SEQ ID NO: 21557 - DNA, 35 bp, Artificial Sequence
  Synthetic oligonucleotide
gcgccacgcacataactagaatcgcaacaacctta

SEQ ID NO: 21558 - DNA, 35 bp, Artificial Sequence
  Synthetic oligonucleotide
agctgccccaacaccggctacctttcgagttctac

SEQ ID NO: 21559 - DNA, 35 bp, Artificial Sequence
  Synthetic oligonucleotide
gcatgccccctacgcactccgcgattcaaattcgc

SEQ ID NO: 21560 - DNA, 35 bp, Artificial Sequence
  Synthetic oligonucleotide
acagggccccaccgtgcgactccacctgccgtagg

SEQ ID NO: 21561 - DNA, 38 bp, Artificial Sequence
  Synthetic oligonucleotide
gccgcactgtctcttcacctgaacttcacccacgctga

SEQ ID NO: 21562 - DNA, 34 bp, Artificial Sequence
  Synthetic oligonucleotide
tccacccagccaattgggctttattcacaggtga

SEQ ID NO: 21563 - DNA, 38 bp, Artificial Sequence
  Synthetic oligonucleotide
acctcgcgcgaagttccgcactcgaccctccaccttga

SEQ ID NO: 21564 - DNA, 38 bp, Artificial Sequence
  Synthetic oligonucleotide
gcggatcgcccccggtatgcgtaacgcccactctttga

SEQ ID NO: 21565 - DNA, 35 bp, Artificial Sequence
  Synthetic oligonucleotide
taacctgctacaaccgcagccttagcccgatcgcc

SEQ ID NO: 21566 - DNA, 35 bp, Artificial Sequence
  Synthetic oligonucleotide
tcacgcacctacccgtgcaacgacactgggaaatc

SEQ ID NO: 21567 - DNA, 35 bp, Artificial Sequence
  Synthetic oligonucleotide
gactacctgcgcttacggacgtctgacccctcctc

SEQ ID NO: 21568 - DNA, 35 bp, Artificial Sequence
  Synthetic oligonucleotide
gacacttgcgataaccaccgctgctacctttctgt

SEQ ID NO: 21569 - DNA, 36 bp, Artificial Sequence
  Synthetic oligonucleotide
acctcccacctgacagccgtaccgcgtcatccttaa

SEQ ID NO: 21570 - DNA, 36 bp, Artificial Sequence
  Synthetic oligonucleotide
aaaggaggaggagggtgtcatggcggaacgggcaga

SEQ ID NO: 21571 - DNA, 37 bp, Artificial Sequence
  Synthetic oligonucleotide
acttcacccctaggtgatatctcatgtccaaccccga

SEQ ID NO: 21572 - DNA, 35 bp, Artificial Sequence
  Synthetic oligonucleotide
accgagcaccggccttttcctgttcttcgaggtac

SEQ ID NO: 21573 - DNA, 35 bp, Artificial Sequence
  Synthetic oligonucleotide
gctgtccgcttaacatgctgcgtttcaccttccct

SEQ ID NO: 21574 - DNA, 36 bp, Artificial Sequence
  Synthetic oligonucleotide
acgcaatgcgtgttgctaccgaccccatcccatcaa

SEQ ID NO: 21575 - DNA, 38 bp, Artificial Sequence
  Synthetic oligonucleotide
ggaccatctctcctctcgcttgtcataccggaccctga

SEQ ID NO: 21576 - DNA, 37 bp, Artificial Sequence
  Synthetic oligonucleotide
tgacacctcgcaccgaagtggctgccttcattcctga

SEQ ID NO: 21577 - DNA, 37 bp, Artificial Sequence
  Synthetic oligonucleotide
atccaccactttgccctgcagacagtccgttggggga

SEQ ID NO: 21578 - DNA, 37 bp, Artificial Sequence
  Synthetic oligonucleotide
acattgcgccatatcgctctgcctttatctacatgga

SEQ ID NO: 21579 - DNA, 38 bp, Artificial Sequence
  Synthetic oligonucleotide
gagcccgcgcaccttgtcccccaagccttgcccattga

SEQ ID NO: 21580 - DNA, 35 bp, Artificial Sequence
  Synthetic oligonucleotide
gtcgagccaggaaatgttcccatgctctctgtccc

SEQ ID NO: 21581 - DNA, 35 bp, Artificial Sequence
  Synthetic oligonucleotide
gagagcacgcaggtttttcgtctccggtccggctc

SEQ ID NO: 21582 - DNA, 35 bp, Artificial Sequence
  Synthetic oligonucleotide
accgccgggccaacacatacatgggatgtcatctc

SEQ ID NO: 21583 - DNA, 35 bp, Artificial Sequence
  Synthetic oligonucleotide
actgacctccgcaggtcgttcaatacccaaactat

SEQ ID NO: 21584 - DNA, 35 bp, Artificial Sequence
  Synthetic oligonucleotide
gtacacagtaactgtgagtggcgcacactatcctt

SEQ ID NO: 21585 - DNA, 34 bp, Artificial Sequence
  Synthetic oligonucleotide
gctaacgacgctatcctcaatgtcttcttcattt

SEQ ID NO: 21586 - DNA, 36 bp, Artificial Sequence
  Synthetic oligonucleotide
ccctgtccgcaatcgcctcctaacactcctggtgaa

SEQ ID NO: 21587 - DNA, 37 bp, Artificial Sequence
  Synthetic oligonucleotide
tacaagcagccctgtatacgcttttggccccccccga

SEQ ID NO: 21588 - DNA, 37 bp, Artificial Sequence
  Synthetic oligonucleotide
aagacaaacggcaaaaacaaagcggcgggcaatgcga

SEQ ID NO: 21589 - DNA, 37 bp, Artificial Sequence
  Synthetic oligonucleotide
ttgccccgcatcggacgtccacttgccgtaacatcga

SEQ ID NO: 21590 - DNA, 37 bp, Artificial Sequence
  Synthetic oligonucleotide
tagccggccacactaggcttctactttaccacctcga

SEQ ID NO: 21591 - DNA, 38 bp, Artificial Sequence
  Synthetic oligonucleotide
cacgcactgccatgaatcctgtttttgtttccctctga

SEQ ID NO: 21592 - DNA, 36 bp, Artificial Sequence
  Synthetic oligonucleotide
tccgccacacctctttagatagcttccgtgacttga

SEQ ID NO: 21593 - DNA, 36 bp, Artificial Sequence
  Synthetic oligonucleotide
gaccgccgaccctctcacagcgcgaagcgtgtctta

SEQ ID NO: 21594 - DNA, 35 bp, Artificial Sequence
  Synthetic oligonucleotide
tcatcgtgagcagaggaaattgaatatgggggaag

SEQ ID NO: 21595 - DNA, 35 bp, Artificial Sequence
  Synthetic oligonucleotide
ggtgggagggtctaggggtaagcgctggaaaaggg

SEQ ID NO: 21596 - DNA, 36 bp, Artificial Sequence
  Synthetic oligonucleotide
cgatacatccagtgttggtacatcttctgttggtca

SEQ ID NO: 21597 - DNA, 35 bp, Artificial Sequence
  Synthetic oligonucleotide
gcacccgtaaatccttgaccacgaacttgaattga

SEQ ID NO: 21598 - DNA, 36 bp, Artificial Sequence
  Synthetic oligonucleotide
gactgcgggggcttgagagggatgggagtgaggtta

SEQ ID NO: 21599 - DNA, 35 bp, Artificial Sequence
  Synthetic oligonucleotide
tcaggccatgtggttcgtgccccctttgatttggc

SEQ ID NO: 21600 - DNA, 35 bp, Artificial Sequence
  Synthetic oligonucleotide
tcatttgccccgtgtctctatgacaatctccgctc

SEQ ID NO: 21601 - DNA, 35 bp, Artificial Sequence
  Synthetic oligonucleotide
gaccaccctccggtaggaaaaatcgccggaaattc

SEQ ID NO: 21602 - DNA, 35 bp, Artificial Sequence
  Synthetic oligonucleotide
tacacgtggagtacctacttgccgacgctaccttt

SEQ ID NO: 21603 - DNA, 36 bp, Artificial Sequence
  Synthetic oligonucleotide
tacgacgctaaccatccgcccatacgatagtaacaa

SEQ ID NO: 21604 - DNA, 37 bp, Artificial Sequence
  Synthetic oligonucleotide
agagacgggaggggaacaatacgtgggtagggataca

SEQ ID NO: 21605 - DNA, 35 bp, Artificial Sequence
  Synthetic oligonucleotide
gccactgaagctatgcacctccgtctgaccgccca

SEQ ID NO: 21606 - DNA, 36 bp, Artificial Sequence
  Synthetic oligonucleotide
tcttcatccctctgcctcctatatacggtcaaacga

SEQ ID NO: 21607 - DNA, 37 bp, Artificial Sequence
  Synthetic oligonucleotide
atctacgccgcactttctggaaaccactacgactcga

SEQ ID NO: 21608 - DNA, 37 bp, Artificial Sequence
  Synthetic oligonucleotide
tgacactcgcacattattcgctatccgcgcctctcga

SEQ ID NO: 21609 - DNA, 37 bp, Artificial Sequence
  Synthetic oligonucleotide
gtaccatcgccctaatatttctttaagctaccttcga

SEQ ID NO: 21610 - DNA, 38 bp, Artificial Sequence
  Synthetic oligonucleotide
tgaccggccccccgtctactcctctgcaggtgccctga

SEQ ID NO: 21611 - DNA, 35 bp, Artificial Sequence
  Synthetic oligonucleotide
ggagggaaagtgggacgggatggatgcggaaggac

SEQ ID NO: 21612 - DNA, 35 bp, Artificial Sequence
  Synthetic oligonucleotide
tcccaccggactcttttatatcgtaccaccagtcg

SEQ ID NO: 21613 - DNA, 35 bp, Artificial Sequence
  Synthetic oligonucleotide
gagaggaaaggggaaacggcgtaatgcacatcgtg

SEQ ID NO: 21614 - DNA, 35 bp, Artificial Sequence
  Synthetic oligonucleotide
agcaaccccaggcagtaaacattttggctccatca

SEQ ID NO: 21615 - DNA, 36 bp, Artificial Sequence
  Synthetic oligonucleotide
acacacttgcccactttgggtacagttcttacctca

SEQ ID NO: 21616 - DNA, 36 bp, Artificial Sequence
  Synthetic oligonucleotide
tcatgttccatcgttttaccctgcgctatctatcga

SEQ ID NO: 21617 - DNA, 37 bp, Artificial Sequence
  Synthetic oligonucleotide
acaagtgtaggtgggaggagaggaatggtaaagggga

SEQ ID NO: 21618 - DNA, 37 bp, Artificial Sequence
  Synthetic oligonucleotide
gtagcaccgccttgcactctatcccgtttagttatga

SEQ ID NO: 21619 - DNA, 38 bp, Artificial Sequence
  Synthetic oligonucleotide
tcacgtgcccaggtttcccccctgtttggatctgctga

SEQ ID NO: 21620 - DNA, 38 bp, Artificial Sequence
  Synthetic oligonucleotide
atctggggcgatcgatgcgggggggcattaatgggtga

SEQ ID NO: 21621 - DNA, 38 bp, Artificial Sequence
  Synthetic oligonucleotide
gacgcccatggttatatattttagtgcttccttcttga

SEQ ID NO: 21622 - DNA, 35 bp, Artificial Sequence
  Synthetic oligonucleotide
gagcctagcgaaccccacagcacggtacactttcc

SEQ ID NO: 21623 - DNA, 37 bp, Artificial Sequence
  Synthetic oligonucleotide
gacaatgtagggagcaggagaatagacaggggttgga

SEQ ID NO: 21624 - DNA, 38 bp, Artificial Sequence
  Synthetic oligonucleotide
gtgaaagcgctctaactgcatcccatgtccccaactga

SEQ ID NO: 21625 - DNA, 37 bp, Artificial Sequence
  Synthetic oligonucleotide
actagctcgcgccctcgtatttgttcacctctcctga

SEQ ID NO: 21626 - DNA, 35 bp, Artificial Sequence
  Synthetic oligonucleotide
tccctgcgcaccctaacttaaagggtcggcccatc

SEQ ID NO: 21627 - DNA, 35 bp, Artificial Sequence
  Synthetic oligonucleotide
accccgccacatccggctttccttcatcagccgag

SEQ ID NO: 21628 - DNA, 36 bp, Artificial Sequence
  Synthetic oligonucleotide
gaattgggtcatggttggggggacacggagggaagg

SEQ ID NO: 21629 - DNA, 35 bp, Artificial Sequence
  Synthetic oligonucleotide
gtaatatggcggatggagggcacggagggggtggg

SEQ ID NO: 21630 - DNA, 35 bp, Artificial Sequence
  Synthetic oligonucleotide
tactggtcgctcttccgacttcgcaaccctgccat

SEQ ID NO: 21631 - DNA, 35 bp, Artificial Sequence
  Synthetic oligonucleotide
tcccgccattacacggccgccctctctgcgatcct

SEQ ID NO: 21632 - DNA, 37 bp, Artificial Sequence
  Synthetic oligonucleotide
tgtgtcggaaacaatgcaagaaagggagggaacggga

SEQ ID NO: 21633 - DNA, 37 bp, Artificial Sequence
  Synthetic oligonucleotide
ttcagcatccacctgtaccatccgttccaactagtga

SEQ ID NO: 21634 - DNA, 35 bp, Artificial Sequence
  Synthetic oligonucleotide
tacgagccatatgctcaagtccacccgctataccc

SEQ ID NO: 21635 - DNA, 35 bp, Artificial Sequence
  Synthetic oligonucleotide
gcctacgcggctagcccgtgctccacccgctacct

SEQ ID NO: 21636 - DNA, 35 bp, Artificial Sequence
  Synthetic oligonucleotide
gaactccgacacaattcgtgctgtaacaacttgct

SEQ ID NO: 21637 - DNA, 35 bp, Artificial Sequence
  Synthetic oligonucleotide
aacgcccgccccctagatctgcaacgccaaggcaa

SEQ ID NO: 21638 - DNA, 36 bp, Artificial Sequence
  Synthetic oligonucleotide
ttgcgtagtcccacatcccgcgtgcgtcccctacca

SEQ ID NO: 21639 - DNA, 38 bp, Artificial Sequence
  Synthetic oligonucleotide
tgagtcatgaaggaagggggttatgattggggtgtaga

SEQ ID NO: 21640 - DNA, 37 bp, Artificial Sequence
  Synthetic oligonucleotide
gtgccctccccaaattgttcttctgcgtgctgcacga

SEQ ID NO: 21641 - DNA, 37 bp, Artificial Sequence
  Synthetic oligonucleotide
tggatagatgggtggtacgtgaaaaaggggggcagga

SEQ ID NO: 21642 - DNA, 37 bp, Artificial Sequence
  Synthetic oligonucleotide
tcaccccgttattcggttcacggacgtcactccctga

SEQ ID NO: 21643 - DNA, 38 bp, Artificial Sequence
  Synthetic oligonucleotide
agtacggagggcgggtagggtagcttacgtgggggtga

SEQ ID NO: 21644 - DNA, 36 bp, Artificial Sequence
  Synthetic oligonucleotide
acacccggtcgatgaacccccgtcccctctaaatta

SEQ ID NO: 21645 - DNA, 35 bp, Artificial Sequence
  Synthetic oligonucleotide
acagtgagagggtagtaggatgtcggaatgggaag

SEQ ID NO: 21646 - DNA, 35 bp, Artificial Sequence
  Synthetic oligonucleotide
gatggcccggttttccgcctcgcccccttgtttag

SEQ ID NO: 21647 - DNA, 36 bp, Artificial Sequence
  Synthetic oligonucleotide
atcgtgaaagggggtggtgaggcagtaagatatggg

SEQ ID NO: 21648 - DNA, 36 bp, Artificial Sequence
  Synthetic oligonucleotide
aagcaatgcaagccttgatgcaccacccttcccgga

SEQ ID NO: 21649 - DNA, 37 bp, Artificial Sequence
  Synthetic oligonucleotide
tcagtccccctcccccgtgctcaagaatttccttgga

SEQ ID NO: 21650 - DNA, 35 bp, Artificial Sequence
  Synthetic oligonucleotide
ttactcgaccctcacacgcttgttctcaaccatta

SEQ ID NO: 21651 - DNA, 35 bp, Artificial Sequence
  Synthetic oligonucleotide
agaccattccgtcgttcgatttccagtgatccctg

SEQ ID NO: 21652 - DNA, 35 bp, Artificial Sequence
  Synthetic oligonucleotide
gtgtgctagcgttactggtccaccgcacaacacct

SEQ ID NO: 21653 - DNA, 35 bp, Artificial Sequence
  Synthetic oligonucleotide
acaccctcccaaagatgatcttgttcccgggtctt

SEQ ID NO: 21654 - DNA, 37 bp, Artificial Sequence
  Synthetic oligonucleotide
aacatgtccaatccgcctcagcaataccgccctccga

SEQ ID NO: 21655 - DNA, 37 bp, Artificial Sequence
  Synthetic oligonucleotide
gactaccccctcacacctgggactgtctctcatagga

SEQ ID NO: 21656 - DNA, 37 bp, Artificial Sequence
  Synthetic oligonucleotide
gagtgggaaagtaaattgggtacgggctatgaaggga

SEQ ID NO: 21657 - DNA, 38 bp, Artificial Sequence
  Synthetic oligonucleotide
gtccgcccattcgctttcgagtaccacttcttccatga

SEQ ID NO: 21658 - DNA, 35 bp, Artificial Sequence
  Synthetic oligonucleotide
gacttcctcactcactgacgcctatgcgcgcctta

SEQ ID NO: 21659 - DNA, 36 bp, Artificial Sequence
  Synthetic oligonucleotide
gccagcccgcccatgtctcgcctccccactaagtta

SEQ ID NO: 21660 - DNA, 35 bp, Artificial Sequence
  Synthetic oligonucleotide
gacctacctcatggacccaaaaaaagcacgatcct

SEQ ID NO: 21661 - DNA, 35 bp, Artificial Sequence
  Synthetic oligonucleotide
ggaccgttccagccgaccttcactagcgcattctt

SEQ ID NO: 21662 - DNA, 36 bp, Artificial Sequence
  Synthetic oligonucleotide
gatccttgccgcaattcctcgacctacctgcaggca

SEQ ID NO: 21663 - DNA, 37 bp, Artificial Sequence
  Synthetic oligonucleotide
tgtgaggctatggtgggcggaggggaatgcaatcgga

SEQ ID NO: 21664 - DNA, 37 bp, Artificial Sequence
  Synthetic oligonucleotide
tctaggccccatcgcttcttgccctgaccgcacatga

SEQ ID NO: 21665 - DNA, 36 bp, Artificial Sequence
  Synthetic oligonucleotide
gcctcaaccaccagccgtcttttcgctattcactga

SEQ ID NO: 21666 - DNA, 38 bp, Artificial Sequence
  Synthetic oligonucleotide
tagcactcaccgtcattgtcgtcctcgaccctctctga

SEQ ID NO: 21667 - DNA, 36 bp, Artificial Sequence
  Synthetic oligonucleotide
gaacaccgcgcgtgcctccctcttgctgcacaggta

SEQ ID NO: 21668 - DNA, 37 bp, Artificial Sequence
  Synthetic oligonucleotide
aaccggactgaccaatcattgtctcacatcacgtgcc

SEQ ID NO: 21669 - DNA, 35 bp, Artificial Sequence
  Synthetic oligonucleotide
aacactacctggctgtaccattgaagtcccccacg

SEQ ID NO: 21670 - DNA, 35 bp, Artificial Sequence
  Synthetic oligonucleotide
tgatacaacgcaccatcaccacatgtctaaaagcg

SEQ ID NO: 21671 - DNA, 36 bp, Artificial Sequence
  Synthetic oligonucleotide
tcagctccctcgatgcacccattcctcagcttgcga

SEQ ID NO: 21672 - DNA, 38 bp, Artificial Sequence
  Synthetic oligonucleotide
ttgaccacctggcaattatgaaactatccccgttgtga

SEQ ID NO: 21673 - DNA, 35 bp, Artificial Sequence
  Synthetic oligonucleotide
tgccgtgcctaggttgaactagccaccctctcgcc

SEQ ID NO: 21674 - DNA, 35 bp, Artificial Sequence
  Synthetic oligonucleotide
ggtcacccccaccatctgtacgcagctggcatgcc

SEQ ID NO: 21675 - DNA, 35 bp, Artificial Sequence
  Synthetic oligonucleotide
gactggacgaaggcacaatgggaggatagtaacgg

SEQ ID NO: 21676 - DNA, 35 bp, Artificial Sequence
  Synthetic oligonucleotide
tgagcgcaatccgtttgccggttgaccacctatct

SEQ ID NO: 21677 - DNA, 36 bp, Artificial Sequence
  Synthetic oligonucleotide
ttcaccactcctcaccaatgttcgggtcagccctaa

SEQ ID NO: 21678 - DNA, 36 bp, Artificial Sequence
  Synthetic oligonucleotide
tacgtcaccacctcacgtcttcctctggtctccgca

SEQ ID NO: 21679 - DNA, 38 bp, Artificial Sequence
  Synthetic oligonucleotide
gatccagaacggcacgtcctcaagccacacccccctga

SEQ ID NO: 21680 - DNA, 38 bp, Artificial Sequence
  Synthetic oligonucleotide
tggggtgaaggggaggggcggattcggaaagggattga

SEQ ID NO: 21681 - DNA, 35 bp, Artificial Sequence
  Synthetic oligonucleotide
gccacttgagccgtggtcgctcggcctttactccc

SEQ ID NO: 21682 - DNA, 35 bp, Artificial Sequence
  Synthetic oligonucleotide
gaccgggtgagggggtgatgagggtaaagattgcg

SEQ ID NO: 21683 - DNA, 36 bp, Artificial Sequence
  Synthetic oligonucleotide
aacacgcacatctggattttagcgcatccgaccgca

SEQ ID NO: 21684 - DNA, 37 bp, Artificial Sequence
  Synthetic oligonucleotide
gcccgacgcgccctcgactcctttcactgtctcccga

SEQ ID NO: 21685 - DNA, 38 bp, Artificial Sequence
  Synthetic oligonucleotide
gacccctagtgtgccatcgattctgttcctactcgtga

SEQ ID NO: 21686 - DNA, 36 bp, Artificial Sequence
  Synthetic oligonucleotide
gccccatccccgtccgcgttggccgtccctttgtga

SEQ ID NO: 21687 - DNA, 35 bp, Artificial Sequence
  Synthetic oligonucleotide
taacacgccccgacccaagtgaatttctggtaatc

SEQ ID NO: 21688 - DNA, 35 bp, Artificial Sequence
  Synthetic oligonucleotide
ttcgatggtggagggtaagacagttgtcgggcggg

SEQ ID NO: 21689 - DNA, 35 bp, Artificial Sequence
  Synthetic oligonucleotide
tgaggggcgacatgttcgactgccactatcaccct

SEQ ID NO: 21690 - DNA, 36 bp, Artificial Sequence
  Synthetic oligonucleotide
tgcaacacgtgctcttacatgcctcagtcattttca

SEQ ID NO: 21691 - DNA, 38 bp, Artificial Sequence
  Synthetic oligonucleotide
gacgaacgccaatcccatcgtgcctcattagttcctga

SEQ ID NO: 21692 - DNA, 38 bp, Artificial Sequence
  Synthetic oligonucleotide
acatacgcgccaccccacaccgcacagatatatcgtga

SEQ ID NO: 21693 - DNA, 35 bp, Artificial Sequence
  Synthetic oligonucleotide
gttcccatcccacgacttgcccttgtagcttgtga

SEQ ID NO: 21694 - DNA, 38 bp, Artificial Sequence
  Synthetic oligonucleotide
tcacgactgagcctcgcaccaccgctccatccatttga

SEQ ID NO: 21695 - DNA, 36 bp, Artificial Sequence
  Synthetic oligonucleotide
ttgattggccccaacatgcgactcccccggttccta

SEQ ID NO: 21696 - DNA, 35 bp, Artificial Sequence
  Synthetic oligonucleotide
aactactcgccccctttgctgtcgttttactagcc

SEQ ID NO: 21697 - DNA, 35 bp, Artificial Sequence
  Synthetic oligonucleotide
gtccactcaacaagtctgtaaccaccccgaaacgg

SEQ ID NO: 21698 - DNA, 35 bp, Artificial Sequence
  Synthetic oligonucleotide
agcatgagacaaaaaggggaggggttaggggtggg

SEQ ID NO: 21699 - DNA, 35 bp, Artificial Sequence
  Synthetic oligonucleotide
acatacttgctacagtcccatacacgctacaccat

SEQ ID NO: 21700 - DNA, 35 bp, Artificial Sequence
  Synthetic oligonucleotide
tcagacggagccgcccagttcatccccctcagtat

SEQ ID NO: 21701 - DNA, 36 bp, Artificial Sequence
  Synthetic oligonucleotide
aaccagtggacggtgattgggcatggggaaaaaaca

SEQ ID NO: 21702 - DNA, 36 bp, Artificial Sequence
  Synthetic oligonucleotide
gagcaaggcgccattctaaccggcatgaccacccca

SEQ ID NO: 21703 - DNA, 37 bp, Artificial Sequence
  Synthetic oligonucleotide
ttgcgtgtgggagggacggggatttctagggctggga

SEQ ID NO: 21704 - DNA, 36 bp, Artificial Sequence
  Synthetic oligonucleotide
atgacgcctatgcacatcggtctacctcccattgga

SEQ ID NO: 21705 - DNA, 38 bp, Artificial Sequence
  Synthetic oligonucleotide
ggattaagggtggggtggaattggggtatacggggtga

SEQ ID NO: 21706 - DNA, 34 bp, Artificial Sequence
  Synthetic oligonucleotide
ttgccgtgcaagtgccttcttacatcatacaacg

SEQ ID NO: 21707 - DNA, 35 bp, Artificial Sequence
  Synthetic oligonucleotide
tccgcaacctcaccatctgaaaatgtccgtacatg

SEQ ID NO: 21708 - DNA, 35 bp, Artificial Sequence
  Synthetic oligonucleotide
tcattgcaccgagcgatcaccccaatcaatgcact

SEQ ID NO: 21709 - DNA, 35 bp, Artificial Sequence
  Synthetic oligonucleotide
acttgacggcaagttgtccgcacttcgcccccgca

SEQ ID NO: 21710 - DNA, 36 bp, Artificial Sequence
  Synthetic oligonucleotide
tcctccaaccggaatgtcgacttgttcttgccatca

SEQ ID NO: 21711 - DNA, 37 bp, Artificial Sequence
  Synthetic oligonucleotide
gacatacggaggggagtgacataagggaggggagaga

SEQ ID NO: 21712 - DNA, 36 bp, Artificial Sequence
  Synthetic oligonucleotide
acgccacctgcctcatcgttctagcgtactcgtaga

SEQ ID NO: 21713 - DNA, 35 bp, Artificial Sequence
  Synthetic oligonucleotide
tactcacctcacccaatattagcggtcacctgcga

SEQ ID NO: 21714 - DNA, 38 bp, Artificial Sequence
  Synthetic oligonucleotide
accgacttagcctcccggatgcgcgaggcccgccctga

SEQ ID NO: 21715 - DNA, 36 bp, Artificial Sequence
  Synthetic oligonucleotide
gcgacgctacctctgggctgcccttacgttccttga

SEQ ID NO: 21716 - DNA, 38 bp, Artificial Sequence
  Synthetic oligonucleotide
acctgccctacacgattcttcgcgatacatctttttga

SEQ ID NO: 21717 - DNA, 35 bp, Artificial Sequence
  Synthetic oligonucleotide
gacacgcatctggttcttcgtatgccctctgatta

SEQ ID NO: 21718 - DNA, 35 bp, Artificial Sequence
  Synthetic oligonucleotide
agtgagccaagcggaaggctcctctcctgtcgacc

SEQ ID NO: 21719 - DNA, 35 bp, Artificial Sequence
  Synthetic oligonucleotide
tgcaaagggggggcaagggtggtcggaggtggcgg

SEQ ID NO: 21720 - DNA, 35 bp, Artificial Sequence
  Synthetic oligonucleotide
actccctacaccaacaggtatcgcacccacattgt

SEQ ID NO: 21721 - DNA, 36 bp, Artificial Sequence
  Synthetic oligonucleotide
taccgcccacctggcatggtttcaggaacctctcga

SEQ ID NO: 21722 - DNA, 37 bp, Artificial Sequence
  Synthetic oligonucleotide
tcatcacgtaccaattttctttgttgctctccctgga

SEQ ID NO: 21723 - DNA, 38 bp, Artificial Sequence
  Synthetic oligonucleotide
atgccacgtactcgccccttaccagtccaattggttga

SEQ ID NO: 21724 - DNA, 35 bp, Artificial Sequence
  Synthetic oligonucleotide
acgccccgggctctctcggtgacacccttcccgtg

SEQ ID NO: 21725 - DNA, 35 bp, Artificial Sequence
  Synthetic oligonucleotide
gcccccctgcatagacctctcgtggtactttcttg

SEQ ID NO: 21726 - DNA, 35 bp, Artificial Sequence
  Synthetic oligonucleotide
tccactggttcctccgcatgacttgttttaaacct

SEQ ID NO: 21727 - DNA, 35 bp, Artificial Sequence
  Synthetic oligonucleotide
taccgtatcaacccgcctccacagtaacttaggtt

SEQ ID NO: 21728 - DNA, 36 bp, Artificial Sequence
  Synthetic oligonucleotide
agcacccgcccccgttaaacctctacgcttctgcca

SEQ ID NO: 21729 - DNA, 38 bp, Artificial Sequence
  Synthetic oligonucleotide
gtgtcagggagacgcaggagggacgggatgggtgatga

SEQ ID NO: 21730 - DNA, 36 bp, Artificial Sequence
  Synthetic oligonucleotide
ttcgcacccctcatcctcgcacgctgggccatcata

SEQ ID NO: 21731 - DNA, 35 bp, Artificial Sequence
  Synthetic oligonucleotide
acacccccccgtgtactgttgatatccgattaagc

SEQ ID NO: 21732 - DNA, 35 bp, Artificial Sequence
  Synthetic oligonucleotide
tacacgtaggaccgctgcctgacctgacgtttttt

SEQ ID NO: 21733 - DNA, 36 bp, Artificial Sequence
  Synthetic oligonucleotide
tctgaccgaatgtcccggcagtccctccttcgcgca

SEQ ID NO: 21734 - DNA, 36 bp, Artificial Sequence
  Synthetic oligonucleotide
gggtcgggtcataaggagggtgggagtggatcgtga

SEQ ID NO: 21735 - DNA, 35 bp, Artificial Sequence
  Synthetic oligonucleotide
ttcgcttccgacaatctcctcgtgcgctttatttg

SEQ ID NO: 21736 - DNA, 36 bp, Artificial Sequence
  Synthetic oligonucleotide
aatgagcgggcctcctcacaccgtcgccttatcaca

SEQ ID NO: 21737 - DNA, 37 bp, Artificial Sequence
  Synthetic oligonucleotide
tcggtcccacgtcaatctgacctacacctgctcacga

SEQ ID NO: 21738 - DNA, 36 bp, Artificial Sequence
  Synthetic oligonucleotide
acatacccaactcacgctggcggcccgcccatccta

SEQ ID NO: 21739 - DNA, 36 bp, Artificial Sequence
  Synthetic oligonucleotide
acctgggcacatatgaacgtcgcgctttgcccttta

SEQ ID NO: 21740 - DNA, 36 bp, Artificial Sequence
  Synthetic oligonucleotide
gagaccccgcgcacgcctatcccggaatacgtttcc

SEQ ID NO: 21741 - DNA, 35 bp, Artificial Sequence
  Synthetic oligonucleotide
gatgagcggcgcctccccttgcaatatgtttcctc

SEQ ID NO: 21742 - DNA, 35 bp, Artificial Sequence
  Synthetic oligonucleotide
tagccttcccatgcaccgatatctggcgctatctc

SEQ ID NO: 21743 - DNA, 35 bp, Artificial Sequence
  Synthetic oligonucleotide
gacgcagacgcaaagtcccacctcaaccgtatctg

SEQ ID NO: 21744 - DNA, 36 bp, Artificial Sequence
  Synthetic oligonucleotide
gtccgtctcaccccgtctgtactggcctcctttaca

SEQ ID NO: 21745 - DNA, 37 bp, Artificial Sequence
  Synthetic oligonucleotide
tgccacgcacaacactccgagcacacacgaacacaga

SEQ ID NO: 21746 - DNA, 37 bp, Artificial Sequence
  Synthetic oligonucleotide
ttcgacgcaccgcgctgcttatacccactgggcccga

SEQ ID NO: 21747 - DNA, 37 bp, Artificial Sequence
  Synthetic oligonucleotide
gcacctcgccgtgcttattactctctctcagtcgtga

SEQ ID NO: 21748 - DNA, 36 bp, Artificial Sequence
  Synthetic oligonucleotide
tcagtactgcagggggcagctagagatgagttggta

SEQ ID NO: 21749 - DNA, 35 bp, Artificial Sequence
  Synthetic oligonucleotide
tcccggcgaacttggtccactggacaccgctttta

SEQ ID NO: 21750 - DNA, 35 bp, Artificial Sequence
  Synthetic oligonucleotide
gtagggggggcgaggaaacggggttaggtaggacc

SEQ ID NO: 21751 - DNA, 35 bp, Artificial Sequence
  Synthetic oligonucleotide
gtggctagcccgttacttgccacaagcctttcccc

SEQ ID NO: 21752 - DNA, 35 bp, Artificial Sequence
  Synthetic oligonucleotide
gaccacacaaatgcgtccgcgccgcccctaacttc

SEQ ID NO: 21753 - DNA, 37 bp, Artificial Sequence
  Synthetic oligonucleotide
ttcaacctcaccctcggaataactgtagctatcgcga

SEQ ID NO: 21754 - DNA, 37 bp, Artificial Sequence
  Synthetic oligonucleotide
acctgaccctatcactatgatccgcccaccttgtcga

SEQ ID NO: 21755 - DNA, 38 bp, Artificial Sequence
  Synthetic oligonucleotide
gccacccgtgtcaactgtgttcctgcccacttatatga

SEQ ID NO: 21756 - DNA, 37 bp, Artificial Sequence
  Synthetic oligonucleotide
tgccctgctcactgtaggaacccattccataatctga

SEQ ID NO: 21757 - DNA, 35 bp, Artificial Sequence
  Synthetic oligonucleotide
gcacttccacacttgctgagctcccagctatctat

SEQ ID NO: 21758 - DNA, 35 bp, Artificial Sequence
  Synthetic oligonucleotide
ttagagcaaccatgacccccccacctgcactggga

SEQ ID NO: 21759 - DNA, 35 bp, Artificial Sequence
  Synthetic oligonucleotide
gtgtcttaaaggtgctgattcccgttgttgttccc

SEQ ID NO: 21760 - DNA, 35 bp, Artificial Sequence
  Synthetic oligonucleotide
agtccgccatcctcgtttcaggacctgactgccca

SEQ ID NO: 21761 - DNA, 37 bp, Artificial Sequence
  Synthetic oligonucleotide
gtatccccctcgacagtgaaacgtactatctccaaga

SEQ ID NO: 21762 - DNA, 35 bp, Artificial Sequence
  Synthetic oligonucleotide
tgtgtaccgacacgcccacacgccccccatctcga

SEQ ID NO: 21763 - DNA, 36 bp, Artificial Sequence
  Synthetic oligonucleotide
aaacaacatagcacctcacctcccttggattttgga

SEQ ID NO: 21764 - DNA, 36 bp, Artificial Sequence
  Synthetic oligonucleotide
acatcatctcagaggctcagctgcctccgtacttga

SEQ ID NO: 21765 - DNA, 36 bp, Artificial Sequence
  Synthetic oligonucleotide
tagccttgacatctcatgcttcgttgagcccgccta

SEQ ID NO: 21766 - DNA, 35 bp, Artificial Sequence
  Synthetic oligonucleotide
tacaccaagcagggatctagtctgcctccctctgc

SEQ ID NO: 21767 - DNA, 35 bp, Artificial Sequence
  Synthetic oligonucleotide
gcacccccgtcgtaatcaactgttttgctactccg

SEQ ID NO: 21768 - DNA, 36 bp, Artificial Sequence
  Synthetic oligonucleotide
tccttcgcattgggccatttacatcctgtttccaaa

SEQ ID NO: 21769 - DNA, 35 bp, Artificial Sequence
  Synthetic oligonucleotide
gtccacccagtgttctaatgtcgccattttctaca

SEQ ID NO: 21770 - DNA, 38 bp, Artificial Sequence
  Synthetic oligonucleotide
gcccgccacctcgttcttcctatctgacggtcatttga

SEQ ID NO: 21771 - DNA, 35 bp, Artificial Sequence
  Synthetic oligonucleotide
ttcgccgaagggccctgtctcgatcatccactata

SEQ ID NO: 21772 - DNA, 35 bp, Artificial Sequence
  Synthetic oligonucleotide
ccagctcggcgtacaacatctacttcggagttccc

SEQ ID NO: 21773 - DNA, 35 bp, Artificial Sequence
  Synthetic oligonucleotide
tgcgttctagccccccgcaggtcctgtcctttgcg

SEQ ID NO: 21774 - DNA, 35 bp, Artificial Sequence
  Synthetic oligonucleotide
taccgatgttcatcccgcctcccttgtgtcctctg

SEQ ID NO: 21775 - DNA, 36 bp, Artificial Sequence
  Synthetic oligonucleotide
gttgaaacaaagggggacggaaggggacatgattca

SEQ ID NO: 21776 - DNA, 37 bp, Artificial Sequence
  Synthetic oligonucleotide
tagactccgtgagaaggcaggggggaggggctcaaga

SEQ ID NO: 21777 - DNA, 35 bp, Artificial Sequence
  Synthetic oligonucleotide
cgcccagacccatgcccgtccgtctccgtttccga

SEQ ID NO: 21778 - DNA, 37 bp, Artificial Sequence
  Synthetic oligonucleotide
aacacccgcaagaccagcctccaacatattggctcga

SEQ ID NO: 21779 - DNA, 37 bp, Artificial Sequence
  Synthetic oligonucleotide
gactcagggtggggaagcaaagcaggaaacatctgga

SEQ ID NO: 21780 - DNA, 38 bp, Artificial Sequence
  Synthetic oligonucleotide
atgcgtgcgaacgcttgaattggctcccactaccttga

SEQ ID NO: 21781 - DNA, 38 bp, Artificial Sequence
  Synthetic oligonucleotide
ggaacgccccctatgtcttccgtttgcggtgcccttga

SEQ ID NO: 21782 - DNA, 35 bp, Artificial Sequence
  Synthetic oligonucleotide
acccacgcgtcggccacaggcaacccctgcaccat

SEQ ID NO: 21783 - DNA, 35 bp, Artificial Sequence
  Synthetic oligonucleotide
acgcctatgctgcacgccactccgatcgtctttct

SEQ ID NO: 21784 - DNA, 36 bp, Artificial Sequence
  Synthetic oligonucleotide
gaacgtcaatctgcaccccggactgacctcgctcca

SEQ ID NO: 21785 - DNA, 38 bp, Artificial Sequence
  Synthetic oligonucleotide
tgagccctgcgcttatgcaccatcttgtcctcacttga

SEQ ID NO: 21786 - DNA, 35 bp, Artificial Sequence
  Synthetic oligonucleotide
ccactcgcacggttcgttcttttacttgctgcctt

SEQ ID NO: 21787 - DNA, 35 bp, Artificial Sequence
  Synthetic oligonucleotide
taccaaggtcggtcgtgcgttcgactttccacttt

SEQ ID NO: 21788 - DNA, 35 bp, Artificial Sequence
  Synthetic oligonucleotide
taatccgtccccgtaggttcttgcgtaatctccca

SEQ ID NO: 21789 - DNA, 36 bp, Artificial Sequence
  Synthetic oligonucleotide
tgcacctacatttgtgcttacccctgtcaatcgcca

SEQ ID NO: 21790 - DNA, 37 bp, Artificial Sequence
  Synthetic oligonucleotide
gaggaaggaggggggggcgtgtacggagtggctcaga

SEQ ID NO: 21791 - DNA, 36 bp, Artificial Sequence
  Synthetic oligonucleotide
gtcaagaggagggggcaaaccaagaaggactgggga

SEQ ID NO: 21792 - DNA, 37 bp, Artificial Sequence
  Synthetic oligonucleotide
agtacgcaggcatgagggtagaacggggtacatctga

SEQ ID NO: 21793 - DNA, 38 bp, Artificial Sequence
  Synthetic oligonucleotide
gacttgccgggcatggggggggaggtgagggatggtga

SEQ ID NO: 21794 - DNA, 35 bp, Artificial Sequence
  Synthetic oligonucleotide
tcctgcactgcgccattcaactctccgtacttttc

SEQ ID NO: 21795 - DNA, 35 bp, Artificial Sequence
  Synthetic oligonucleotide
ggtggtaggtagtcgggggaggggcatctgtggtg

SEQ ID NO: 21796 - DNA, 36 bp, Artificial Sequence
  Synthetic oligonucleotide
tcacaagggccgccacaaccacatcctctgtgcaca

SEQ ID NO: 21797 - DNA, 36 bp, Artificial Sequence
  Synthetic oligonucleotide
gcgtatgcgcaactggaactgcgctacttacaccca

SEQ ID NO: 21798 - DNA, 37 bp, Artificial Sequence
  Synthetic oligonucleotide
attgcccgatccaccgctatgctaatgtagtcaacga

SEQ ID NO: 21799 - DNA, 35 bp, Artificial Sequence
  Synthetic oligonucleotide
tccccagctggcccgccgtcccgacgccctatcga

SEQ ID NO: 21800 - DNA, 37 bp, Artificial Sequence
  Synthetic oligonucleotide
accaccaccgggctaatagccacctctgtacgaggga

SEQ ID NO: 21801 - DNA, 37 bp, Artificial Sequence
  Synthetic oligonucleotide
gcacgcacacgaatgggccggtgtgcacttttttgga

SEQ ID NO: 21802 - DNA, 36 bp, Artificial Sequence
  Synthetic oligonucleotide
ttgaatgcaccgtcctacagctagtactatccatga

SEQ ID NO: 21803 - DNA, 38 bp, Artificial Sequence
  Synthetic oligonucleotide
gctatcccacctgagtcttattgctgccctattcctga

SEQ ID NO: 21804 - DNA, 37 bp, Artificial Sequence
  Synthetic oligonucleotide
tccacctacacatccggcacagtgacgcggggcgtga

SEQ ID NO: 21805 - DNA, 35 bp, Artificial Sequence
  Synthetic oligonucleotide
gcaccgtgctcttcacctcccatacctgtgcacta

SEQ ID NO: 21806 - DNA, 36 bp, Artificial Sequence
  Synthetic oligonucleotide
gccgctccctggccatgactccagaacgctttctta

SEQ ID NO: 21807 - DNA, 35 bp, Artificial Sequence
  Synthetic oligonucleotide
gtgtaacgggccactgacctctccgctctgccgac

SEQ ID NO: 21808 - DNA, 35 bp, Artificial Sequence
  Synthetic oligonucleotide
gcattgccccctcatttcccttggctttgggttac

SEQ ID NO: 21809 - DNA, 35 bp, Artificial Sequence
  Synthetic oligonucleotide
tcaaccctcccccggtcctaccgctgggtacaacc

SEQ ID NO: 21810 - DNA, 35 bp, Artificial Sequence
  Synthetic oligonucleotide
atgatcccgcctccccttccgcaaggatgagagtc

SEQ ID NO: 21811 - DNA, 35 bp, Artificial Sequence
  Synthetic oligonucleotide
gcgatgtagggtagggaatgttggtgttggattag

SEQ ID NO: 21812 - DNA, 35 bp, Artificial Sequence
  Synthetic oligonucleotide
tcagcgtacccgtcgttcggtcccatggcttctct

SEQ ID NO: 21813 - DNA, 36 bp, Artificial Sequence
  Synthetic oligonucleotide
gttgacctccagtctcccattcttgtcccactacga

SEQ ID NO: 21814 - DNA, 37 bp, Artificial Sequence
  Synthetic oligonucleotide
acacccctatgtccgcacccggaacgaatgcccccga

SEQ ID NO: 21815 - DNA, 35 bp, Artificial Sequence
  Synthetic oligonucleotide
tacacgctcgatgcttctccgcttttttccttcga

SEQ ID NO: 21816 - DNA, 36 bp, Artificial Sequence
  Synthetic oligonucleotide
tgtgaccacgccacttccgtacatcgcccgcccgta

SEQ ID NO: 21817 - DNA, 35 bp, Artificial Sequence
  Synthetic oligonucleotide
tgttgggcgcacactgcagcacgacctaccatatc

SEQ ID NO: 21818 - DNA, 34 bp, Artificial Sequence
  Synthetic oligonucleotide
tctgacatcagccagtagtcctgtccagcaccct

SEQ ID NO: 21819 - DNA, 35 bp, Artificial Sequence
  Synthetic oligonucleotide
tcaaccatgtaagctacagcgcacctctttacctt

SEQ ID NO: 21820 - DNA, 35 bp, Artificial Sequence
  Synthetic oligonucleotide
gcgctaacacctgaagcggttatagcctttatttt

SEQ ID NO: 21821 - DNA, 36 bp, Artificial Sequence
  Synthetic oligonucleotide
atgggactgggggggaggatatgagcggtgttagaa

SEQ ID NO: 21822 - DNA, 38 bp, Artificial Sequence
  Synthetic oligonucleotide
gtctgtacgcccccacccgtgctttccacgaggcctga

SEQ ID NO: 21823 - DNA, 38 bp, Artificial Sequence
  Synthetic oligonucleotide
tgctacacggtccattctgaagttgtacctctccttga

SEQ ID NO: 21824 - DNA, 35 bp, Artificial Sequence
  Synthetic oligonucleotide
ttgagacgcagaccgcttcgctctggccatccacc

SEQ ID NO: 21825 - DNA, 35 bp, Artificial Sequence
  Synthetic oligonucleotide
ggggcctcaatccttatacgccgccctatcccgcc

SEQ ID NO: 21826 - DNA, 35 bp, Artificial Sequence
  Synthetic oligonucleotide
tccacctgatagcaagcggccctaacctcaccctc

SEQ ID NO: 21827 - DNA, 35 bp, Artificial Sequence
  Synthetic oligonucleotide
tatcgacccgtccaggccccatgaagatcattctc

SEQ ID NO: 21828 - DNA, 36 bp, Artificial Sequence
  Synthetic oligonucleotide
ttgggcgggccgggtgaggacaagtagaaggcttag

SEQ ID NO: 21829 - DNA, 35 bp, Artificial Sequence
  Synthetic oligonucleotide
tgcctgggaaccattcatttctgccaacaccttgt

SEQ ID NO: 21830 - DNA, 36 bp, Artificial Sequence
  Synthetic oligonucleotide
ttgcaatacccacttgtcgcatacggacattcatca

SEQ ID NO: 21831 - DNA, 36 bp, Artificial Sequence
  Synthetic oligonucleotide
accgctcgtgaactacctagccccttcgctgcccga

SEQ ID NO: 21832 - DNA, 38 bp, Artificial Sequence
  Synthetic oligonucleotide
agatacgccccctagaccccgtccacagtctcacatga

SEQ ID NO: 21833 - DNA, 37 bp, Artificial Sequence
  Synthetic oligonucleotide
tccgtagtgggaagggggggtaagggttcgctggtga

SEQ ID NO: 21834 - DNA, 35 bp, Artificial Sequence
  Synthetic oligonucleotide
ttaacacgcgttctccttagcagccgcactccccc

SEQ ID NO: 21835 - DNA, 35 bp, Artificial Sequence
  Synthetic oligonucleotide
acacacggtctggtattacgtgtctctcatgccgc

SEQ ID NO: 21836 - DNA, 35 bp, Artificial Sequence
  Synthetic oligonucleotide
ggtgccctcccatcctccattaagcttctgcagct

SEQ ID NO: 21837 - DNA, 38 bp, Artificial Sequence
  Synthetic oligonucleotide
aagaggaggaggggctggggaacggatccagctgatga

SEQ ID NO: 21838 - DNA, 37 bp, Artificial Sequence
  Synthetic oligonucleotide
tgttccacaccgcctccaaatatggctcccctggtga

SEQ ID NO: 21839 - DNA, 36 bp, Artificial Sequence
  Synthetic oligonucleotide
gacgaaggtgaaaattgtaggaatgagtgggatgta

SEQ ID NO: 21840 - DNA, 35 bp, Artificial Sequence
  Synthetic oligonucleotide
tggacacacctctctcacgtctaatctgaaagcac

SEQ ID NO: 21841 - DNA, 35 bp, Artificial Sequence
  Synthetic oligonucleotide
tgtagtgcacgccggtcctctacccctggtcttac

SEQ ID NO: 21842 - DNA, 35 bp, Artificial Sequence
  Synthetic oligonucleotide
tgaaacacctacgcccatcggttcaattgtactcc

SEQ ID NO: 21843 - DNA, 35 bp, Artificial Sequence
  Synthetic oligonucleotide
acgtacgactaaccatgggtctcttgttctttctc

SEQ ID NO: 21844 - DNA, 35 bp, Artificial Sequence
  Synthetic oligonucleotide
ttcccacccggacctgggtctacttcgctacaacg

SEQ ID NO: 21845 - DNA, 35 bp, Artificial Sequence
  Synthetic oligonucleotide
tacgcaccgtctcgctccaccttcccccgacgacg

SEQ ID NO: 21846 - DNA, 35 bp, Artificial Sequence
  Synthetic oligonucleotide
tgcccgttcactaatcccaccgcgctcgcacccgg

SEQ ID NO: 21847 - DNA, 35 bp, Artificial Sequence
  Synthetic oligonucleotide
gcaaccgacgagagttcgctggcctcaaaaccatt

SEQ ID NO: 21848 - DNA, 36 bp, Artificial Sequence
  Synthetic oligonucleotide
gaaaccgctgttcccttatctcgacttgtagactca

SEQ ID NO: 21849 - DNA, 37 bp, Artificial Sequence
  Synthetic oligonucleotide
actagccgaagcgcagattcagccactctgcacccga

SEQ ID NO: 21850 - DNA, 36 bp, Artificial Sequence
  Synthetic oligonucleotide
tcgaatcaccacaccacccacaggcgcctcctagga

SEQ ID NO: 21851 - DNA, 38 bp, Artificial Sequence
  Synthetic oligonucleotide
gccgtccacgcaccctatattgttccggttacccatga

SEQ ID NO: 21852 - DNA, 36 bp, Artificial Sequence
  Synthetic oligonucleotide
tcagacgcatcaaccatccaattagctcacgttata

SEQ ID NO: 21853 - DNA, 35 bp, Artificial Sequence
  Synthetic oligonucleotide
attcacgccctcaattaccgacgatgtcggcttct

SEQ ID NO: 21854 - DNA, 35 bp, Artificial Sequence
  Synthetic oligonucleotide
aatgcacgcatccttgtctcacgttacccgtatgt

SEQ ID NO: 21855 - DNA, 35 bp, Artificial Sequence
  Synthetic oligonucleotide
gacggatggtgaggggtcgtaatgccttgttgttt

SEQ ID NO: 21856 - DNA, 36 bp, Artificial Sequence
  Synthetic oligonucleotide
atggttccacgcagaccggcctcctgatttttccaa

SEQ ID NO: 21857 - DNA, 36 bp, Artificial Sequence
  Synthetic oligonucleotide
tcactcccacgccggacctatattcacttgttttaa

SEQ ID NO: 21858 - DNA, 36 bp, Artificial Sequence
  Synthetic oligonucleotide
tcagagggaggcgaagaggagcggaggacgtgagca

SEQ ID NO: 21859 - DNA, 35 bp, Artificial Sequence
  Synthetic oligonucleotide
tgcctatggccgctcctatattctgctctgcttca

SEQ ID NO: 21860 - DNA, 37 bp, Artificial Sequence
  Synthetic oligonucleotide
gcacccattccaggccccgacaatcctccgtcctaga

SEQ ID NO: 21861 - DNA, 37 bp, Artificial Sequence
  Synthetic oligonucleotide
gagatggagggtggaatgtcagtcggggaggggacga

SEQ ID NO: 21862 - DNA, 38 bp, Artificial Sequence
  Synthetic oligonucleotide
tgtagcccgcctatttttcacccgaccctgacccgtga

SEQ ID NO: 21863 - DNA, 38 bp, Artificial Sequence
  Synthetic oligonucleotide
gttaggtggaccgggtggggtatggttgggggcattga

SEQ ID NO: 21864 - DNA, 38 bp, Artificial Sequence
  Synthetic oligonucleotide
gtgaccgtcgtatcgttacccggctacacattttttga

SEQ ID NO: 21865 - DNA, 36 bp, Artificial Sequence
  Synthetic oligonucleotide
atagcatcctcccgccctgctctccccgtgcgacca

SEQ ID NO: 21866 - DNA, 36 bp, Artificial Sequence
  Synthetic oligonucleotide
tcgagccccaccactgctcacttgacacacccccca

SEQ ID NO: 21867 - DNA, 37 bp, Artificial Sequence
  Synthetic oligonucleotide
aacatgaaaacgtaggaaagaggcgtgggcgtgagga

SEQ ID NO: 21868 - DNA, 37 bp, Artificial Sequence
  Synthetic oligonucleotide
tgtccatgcccttcccctcctgctatgtctatacgga

SEQ ID NO: 21869 - DNA, 38 bp, Artificial Sequence
  Synthetic oligonucleotide
gttgcggtcctatcctgttcacgtgtcatccactctga

SEQ ID NO: 21870 - DNA, 38 bp, Artificial Sequence
  Synthetic oligonucleotide
acacatccccgcctttgcatcaactgtccagaacttga

SEQ ID NO: 21871 - DNA, 35 bp, Artificial Sequence
  Synthetic oligonucleotide
gatcgccagtggcctatagccccctaacgctgccc

SEQ ID NO: 21872 - DNA, 35 bp, Artificial Sequence
  Synthetic oligonucleotide
attgcccgccccattctccgtacgtccacctctgg

SEQ ID NO: 21873 - DNA, 32 bp, Artificial Sequence
  Synthetic oligonucleotide
tagtactcccgctgtttacgcaccgacccact

SEQ ID NO: 21874 - DNA, 34 bp, Artificial Sequence
  Synthetic oligonucleotide
ataccccacagactactccgaccatccctgttca

SEQ ID NO: 21875 - DNA, 35 bp, Artificial Sequence
  Synthetic oligonucleotide
tcatcaccgcccttcgcccttcctggtgtcaagta

SEQ ID NO: 21876 - DNA, 35 bp, Artificial Sequence
  Synthetic oligonucleotide
actcgcatacagtgacactgcgcccgtctcctcgc

SEQ ID NO: 21877 - DNA, 35 bp, Artificial Sequence
  Synthetic oligonucleotide
tgcccccactgggatgacatttgaactggattccg

SEQ ID NO: 21878 - DNA, 35 bp, Artificial Sequence
  Synthetic oligonucleotide
aaccgacgccttacatgtaacctctaccacctact

SEQ ID NO: 21879 - DNA, 37 bp, Artificial Sequence
  Synthetic oligonucleotide
gggagggggcggttgtttgaataggtggataggcgga

SEQ ID NO: 21880 - DNA, 36 bp, Artificial Sequence
  Synthetic oligonucleotide
gggtggaagacggcaatagggggttcagggtgggta

SEQ ID NO: 21881 - DNA, 35 bp, Artificial Sequence
  Synthetic oligonucleotide
gcgactccccgctatgtttgaacggttaccctccg

SEQ ID NO: 21882 - DNA, 35 bp, Artificial Sequence
  Synthetic oligonucleotide
gagaggtgggtggagaaaccaaaggatctgggggg

SEQ ID NO: 21883 - DNA, 35 bp, Artificial Sequence
  Synthetic oligonucleotide
gatgcccgtgcccggcctcacctttcactccttgt

SEQ ID NO: 21884 - DNA, 35 bp, Artificial Sequence
  Synthetic oligonucleotide
acatgcgtacggttagtctcattcttttgttgttt

SEQ ID NO: 21885 - DNA, 35 bp, Artificial Sequence
  Synthetic oligonucleotide
atgccccacctgcctctcgcgtaactgtacctgca

SEQ ID NO: 21886 - DNA, 36 bp, Artificial Sequence
  Synthetic oligonucleotide
tctccattgcacgcccgctttagttctctaggctca

SEQ ID NO: 21887 - DNA, 37 bp, Artificial Sequence
  Synthetic oligonucleotide
tgtccccccttaggtctcgacttccatggtctatcga

SEQ ID NO: 21888 - DNA, 38 bp, Artificial Sequence
  Synthetic oligonucleotide
ggaagtgggggtggggtaggcaattgaaggcgtggtga

SEQ ID NO: 21889 - DNA, 37 bp, Artificial Sequence
  Synthetic oligonucleotide
accacgcgcacaagttactgtaacgcatccctcttga

SEQ ID NO: 21890 - DNA, 36 bp, Artificial Sequence
  Synthetic oligonucleotide
ttaggcccaccttgtcatagcttccgtctctaacta

SEQ ID NO: 21891 - DNA, 35 bp, Artificial Sequence
  Synthetic oligonucleotide
gccctagttcggactccatcgaacacctgccttgc

SEQ ID NO: 21892 - DNA, 35 bp, Artificial Sequence
  Synthetic oligonucleotide
tatgaatccacctgcccgcaatctcacgattggtc

SEQ ID NO: 21893 - DNA, 35 bp, Artificial Sequence
  Synthetic oligonucleotide
tctgtcccgcaggttttaattgccgcccttctttt

SEQ ID NO: 21894 - DNA, 36 bp, Artificial Sequence
  Synthetic oligonucleotide
tctgacagacctcgctgagcatgaccgcctcataca

SEQ ID NO: 21895 - DNA, 35 bp, Artificial Sequence
  Synthetic oligonucleotide
agcacccctacatccccgcagctgacttatctcca

SEQ ID NO: 21896 - DNA, 37 bp, Artificial Sequence
  Synthetic oligonucleotide
ttgccttataccaccactgctgcctgaccagtcgaga

SEQ ID NO: 21897 - DNA, 37 bp, Artificial Sequence
  Synthetic oligonucleotide
gccgcccggcacccatctccgtctacattaccgatga

SEQ ID NO: 21898 - DNA, 38 bp, Artificial Sequence
  Synthetic oligonucleotide
gagggaggggaaaggggagggcgggcgatatggagtga

SEQ ID NO: 21899 - DNA, 36 bp, Artificial Sequence
  Synthetic oligonucleotide
acgcgatgccttatattgatcccatgccaggttata

SEQ ID NO: 21900 - DNA, 36 bp, Artificial Sequence
  Synthetic oligonucleotide
tctgattcctcagaccctcatcccttagtcgaccta

SEQ ID NO: 21901 - DNA, 35 bp, Artificial Sequence
  Synthetic oligonucleotide
gatccaactcctctgtcccgggtacccatctggcc

SEQ ID NO: 21902 - DNA, 35 bp, Artificial Sequence
  Synthetic oligonucleotide
gcacgattatcccggagccctgtcgtactttcctg

SEQ ID NO: 21903 - DNA, 35 bp, Artificial Sequence
  Synthetic oligonucleotide
gtaagacagtgtggaagcaggatcgtgaggtggtg

SEQ ID NO: 21904 - DNA, 36 bp, Artificial Sequence
  Synthetic oligonucleotide
accgcactgatcctttgtttcgttgccgccccatca

SEQ ID NO: 21905 - DNA, 37 bp, Artificial Sequence
  Synthetic oligonucleotide
tgttgcccagaaggctgcctacctctattcctatcga

SEQ ID NO: 21906 - DNA, 35 bp, Artificial Sequence
  Synthetic oligonucleotide
atgaatacacccgacccgctcgccccaactctgga

SEQ ID NO: 21907 - DNA, 36 bp, Artificial Sequence
  Synthetic oligonucleotide
tacacgttccaggctgcctttttccccccatacata

SEQ ID NO: 21908 - DNA, 35 bp, Artificial Sequence
  Synthetic oligonucleotide
atgcacagcctacatccccttgcttgtctatccag

SEQ ID NO: 21909 - DNA, 35 bp, Artificial Sequence
  Synthetic oligonucleotide
agcgattaccgcctcccacccacgtgacgtctagt

SEQ ID NO: 21910 - DNA, 37 bp, Artificial Sequence
  Synthetic oligonucleotide
gtcgcagtggtgagggtgggttggagggtgtggacga

SEQ ID NO: 21911 - DNA, 36 bp, Artificial Sequence
  Synthetic oligonucleotide
gactaatgcccagcagttcatttatcttgcctccga

SEQ ID NO: 21912 - DNA, 35 bp, Artificial Sequence
  Synthetic oligonucleotide
gataggaacgaacgagggagcgacgggagaacgga

SEQ ID NO: 21913 - DNA, 38 bp, Artificial Sequence
  Synthetic oligonucleotide
tccttgcccaccattactttatacagcccgccacgtga

SEQ ID NO: 21914 - DNA, 35 bp, Artificial Sequence
  Synthetic oligonucleotide
tgtcggctcaatgtacttatcctgcgccttcttcc

SEQ ID NO: 21915 - DNA, 35 bp, Artificial Sequence
  Synthetic oligonucleotide
tcagtctgtcggggggcactcgcaacatcactatc

SEQ ID NO: 21916 - DNA, 35 bp, Artificial Sequence
  Synthetic oligonucleotide
tcgtacgacacacatctataaaccgtcctgatctc

SEQ ID NO: 21917 - DNA, 35 bp, Artificial Sequence
  Synthetic oligonucleotide
tgggatcaccgccacctccacgtgttctatactct

SEQ ID NO: 21918 - DNA, 37 bp, Artificial Sequence
  Synthetic oligonucleotide
aacgagcgtaagcttcaccttcccacgaccctgccga

SEQ ID NO: 21919 - DNA, 37 bp, Artificial Sequence
  Synthetic oligonucleotide
tctccaacaatccacacgaatatgcctgcccttccga

SEQ ID NO: 21920 - DNA, 35 bp, Artificial Sequence
  Synthetic oligonucleotide
tcacgacccgccccgcccgatcggtatccactgga

SEQ ID NO: 21921 - DNA, 38 bp, Artificial Sequence
  Synthetic oligonucleotide
gcacccaacatccggatctgcaaaccactctgtaatga

SEQ ID NO: 21922 - DNA, 36 bp, Artificial Sequence
  Synthetic oligonucleotide
aaatcaggccccaaatcgtaccccgccatgccgtta

SEQ ID NO: 21923 - DNA, 35 bp, Artificial Sequence
  Synthetic oligonucleotide
tgacacacgaggccccctgctgactccactatacc

SEQ ID NO: 21924 - DNA, 35 bp, Artificial Sequence
  Synthetic oligonucleotide
gactcccctcaaatgtcaagttatcacatttctcc

SEQ ID NO: 21925 - DNA, 35 bp, Artificial Sequence
  Synthetic oligonucleotide
tcttccctccacagattactgcttatcctgggtcc

SEQ ID NO: 21926 - DNA, 35 bp, Artificial Sequence
  Synthetic oligonucleotide
acgaccacatccacctgcgcggtggcaaagcacct

SEQ ID NO: 21927 - DNA, 36 bp, Artificial Sequence
  Synthetic oligonucleotide
gagccgcccccatccgtcaaccacactgtgatctaa

SEQ ID NO: 21928 - DNA, 37 bp, Artificial Sequence
  Synthetic oligonucleotide
tagcacaggccctgcattttatagccaccgcccccga

SEQ ID NO: 21929 - DNA, 38 bp, Artificial Sequence
  Synthetic oligonucleotide
acgatcactcaatcacaagccacactcgttcctcttga

SEQ ID NO: 21930 - DNA, 35 bp, Artificial Sequence
  Synthetic oligonucleotide
gatccacacatgtcaacgcattccacacaattgcc

SEQ ID NO: 21931 - DNA, 35 bp, Artificial Sequence
  Synthetic oligonucleotide
tgcatccccatcctcccacttgcagaaatcgcagc

SEQ ID NO: 21932 - DNA, 35 bp, Artificial Sequence
  Synthetic oligonucleotide
tatgatcattgcgcatggcacgagtacctaccatc

SEQ ID NO: 21933 - DNA, 35 bp, Artificial Sequence
  Synthetic oligonucleotide
tctcactgccccacccagcaacgaagtgatcacaa

SEQ ID NO: 21934 - DNA, 36 bp, Artificial Sequence
  Synthetic oligonucleotide
tcgtgcctgccccccctcaaggcgtcgacctttcca

SEQ ID NO: 21935 - DNA, 36 bp, Artificial Sequence
  Synthetic oligonucleotide
gagaggagtggaagggggttcaaggggtgtagtgca

SEQ ID NO: 21936 - DNA, 38 bp, Artificial Sequence
  Synthetic oligonucleotide
gcccaccacccgtcactttgttgcgttacccacattga

SEQ ID NO: 21937 - DNA, 35 bp, Artificial Sequence
  Synthetic oligonucleotide
gcacattcctcaatgaaatctacggtccctacgcc

SEQ ID NO: 21938 - DNA, 35 bp, Artificial Sequence
  Synthetic oligonucleotide
acctcgagattatgaactgtctacgccacctacgc

SEQ ID NO: 21939 - DNA, 35 bp, Artificial Sequence
  Synthetic oligonucleotide
ttgttcaccccaggttccggtatttttgcgctttc

SEQ ID NO: 21940 - DNA, 35 bp, Artificial Sequence
  Synthetic oligonucleotide
agatagggcagggagacgaagtgtggtaggtggag

SEQ ID NO: 21941 - DNA, 35 bp, Artificial Sequence
  Synthetic oligonucleotide
tccacactctccatcgagcactctatatactaacg

SEQ ID NO: 21942 - DNA, 35 bp, Artificial Sequence
  Synthetic oligonucleotide
ttgcaacctactgcgagttgttgctgatttcatct

SEQ ID NO: 21943 - DNA, 35 bp, Artificial Sequence
  Synthetic oligonucleotide
accgggcccgaacgcgttttaccacgccatccttt

SEQ ID NO: 21944 - DNA, 36 bp, Artificial Sequence
  Synthetic oligonucleotide
cactccatgcgccctgttcggccccttccccttaga

SEQ ID NO: 21945 - DNA, 37 bp, Artificial Sequence
  Synthetic oligonucleotide
atgccggtacacatgcacctttgttacctcccccgga

SEQ ID NO: 21946 - DNA, 36 bp, Artificial Sequence
  Synthetic oligonucleotide
tcaggggggcctcatccgtaactaccgcacatccta

SEQ ID NO: 21947 - DNA, 35 bp, Artificial Sequence
  Synthetic oligonucleotide
ttccctatccgctcaactgacgcctccgagaggac

SEQ ID NO: 21948 - DNA, 35 bp, Artificial Sequence
  Synthetic oligonucleotide
gtccgacgctgttttcccttggcacttgagttacc

SEQ ID NO: 21949 - DNA, 35 bp, Artificial Sequence
  Synthetic oligonucleotide
tgactccagaactccctgagtgccactctatactc

SEQ ID NO: 21950 - DNA, 35 bp, Artificial Sequence
  Synthetic oligonucleotide
tctagggggcgtactgcgtggtctcctttgctcct

SEQ ID NO: 21951 - DNA, 35 bp, Artificial Sequence
  Synthetic oligonucleotide
accccatgatggcccttctgtctatgcttctattt

SEQ ID NO: 21952 - DNA, 35 bp, Artificial Sequence
  Synthetic oligonucleotide
gcctgtcctagtacgccgcccctctacctccgcca

SEQ ID NO: 21953 - DNA, 37 bp, Artificial Sequence
  Synthetic oligonucleotide
acgactccgccgccttccttgaccacctccagtttga

SEQ ID NO: 21954 - DNA, 36 bp, Artificial Sequence
  Synthetic oligonucleotide
tacagggggggaatgagaatgattgctgggaaggta

SEQ ID NO: 21955 - DNA, 35 bp, Artificial Sequence
  Synthetic oligonucleotide
acacaccacgacacgccataccgggcaaaacactc

SEQ ID NO: 21956 - DNA, 35 bp, Artificial Sequence
  Synthetic oligonucleotide
tgagggggggggaatgggtctcaaggtgggatgga

SEQ ID NO: 21957 - DNA, 37 bp, Artificial Sequence
  Synthetic oligonucleotide
gcttgccacaaggtcatccccgagtcccgctcctgga

SEQ ID NO: 21958 - DNA, 36 bp, Artificial Sequence
  Synthetic oligonucleotide
ttcccctgctgccgtttacacctgcgctattacgta

SEQ ID NO: 21959 - DNA, 35 bp, Artificial Sequence
  Synthetic oligonucleotide
ggtgatcccgaaacctgactcattagtactctcgc

SEQ ID NO: 21960 - DNA, 35 bp, Artificial Sequence
  Synthetic oligonucleotide
tgcgctaacggtcttattccatcacatgtactatc

SEQ ID NO: 21961 - DNA, 35 bp, Artificial Sequence
  Synthetic oligonucleotide
acaccacctcgactaaacccctatgtctttagctc

SEQ ID NO: 21962 - DNA, 35 bp, Artificial Sequence
  Synthetic oligonucleotide
tcacgcctgatctttcggtcttattccctcgtttc

SEQ ID NO: 21963 - DNA, 35 bp, Artificial Sequence
  Synthetic oligonucleotide
tcctcaaacaccgctcaccaagcacaacggactat

SEQ ID NO: 21964 - DNA, 37 bp, Artificial Sequence
  Synthetic oligonucleotide
acagtagcccgcttctgactgcctacatactccacga

SEQ ID NO: 21965 - DNA, 38 bp, Artificial Sequence
  Synthetic oligonucleotide
acgtacgcatctcggccgagctcactccccatgcctga

SEQ ID NO: 21966 - DNA, 37 bp, Artificial Sequence
  Synthetic oligonucleotide
tacaccccgccctactccgtagcttcccagactttga

SEQ ID NO: 21967 - DNA, 35 bp, Artificial Sequence
  Synthetic oligonucleotide
gcctggcctcacgtcactgccgtattttgtttttg

SEQ ID NO: 21968 - DNA, 35 bp, Artificial Sequence
  Synthetic oligonucleotide
tctcgccgtccccttgcattcctccaccgtcctgt

SEQ ID NO: 21969 - DNA, 36 bp, Artificial Sequence
  Synthetic oligonucleotide
gtctcccccataatgctaatcagccttcgtgcacca

SEQ ID NO: 21970 - DNA, 37 bp, Artificial Sequence
  Synthetic oligonucleotide
gtgttgtcgccgatctatcacctacttccttttgcga

SEQ ID NO: 21971 - DNA, 37 bp, Artificial Sequence
  Synthetic oligonucleotide
gacgactctcgctcttttattatgatcaccgcctgga

SEQ ID NO: 21972 - DNA, 37 bp, Artificial Sequence
  Synthetic oligonucleotide
tccgcccccttgcccgtatgcgtgtgaatacacctga

SEQ ID NO: 21973 - DNA, 36 bp, Artificial Sequence
  Synthetic oligonucleotide
acaaagccgcatctcgtacgtcttcacctcgctgta

SEQ ID NO: 21974 - DNA, 35 bp, Artificial Sequence
  Synthetic oligonucleotide
gtagggaaaggagagggcaggtagggcagagaacc

SEQ ID NO: 21975 - DNA, 35 bp, Artificial Sequence
  Synthetic oligonucleotide
agcccagacctcgactctgaccacgacccccctgc

SEQ ID NO: 21976 - DNA, 35 bp, Artificial Sequence
  Synthetic oligonucleotide
acaccgctcaccgctcataaccttccgtaacagcg

SEQ ID NO: 21977 - DNA, 35 bp, Artificial Sequence
  Synthetic oligonucleotide
tccccttaccacagtatttgttaaaactctgcttt

SEQ ID NO: 21978 - DNA, 35 bp, Artificial Sequence
  Synthetic oligonucleotide
ggaccacaacttgttgtgctctcatccccaccaca

SEQ ID NO: 21979 - DNA, 36 bp, Artificial Sequence
  Synthetic oligonucleotide
attccgcccctacgcgtggtgacgcaacaatccaca

SEQ ID NO: 21980 - DNA, 36 bp, Artificial Sequence
  Synthetic oligonucleotide
tcccacatacactgcgattcatacaggccatcacga

SEQ ID NO: 21981 - DNA, 36 bp, Artificial Sequence
  Synthetic oligonucleotide
ttggctcacccccctgccgtctaaagactctcccga

SEQ ID NO: 21982 - DNA, 37 bp, Artificial Sequence
  Synthetic oligonucleotide
tgagcgaatcgcaccgccgtggcaaccatccttctga

SEQ ID NO: 21983 - DNA, 38 bp, Artificial Sequence
  Synthetic oligonucleotide
atgcgtgggtggcgaaaagagggaaatgtggtgtgtga

SEQ ID NO: 21984 - DNA, 38 bp, Artificial Sequence
  Synthetic oligonucleotide
tgagcatcccagtttttcactgcccacgctctccttga

SEQ ID NO: 21985 - DNA, 38 bp, Artificial Sequence
  Synthetic oligonucleotide
aatgtcgtaggtcgctctgttcaacccccctgctttga

SEQ ID NO: 21986 - DNA, 36 bp, Artificial Sequence
  Synthetic oligonucleotide
gtcccccaccgcaatgaactattgaatctctgaata

SEQ ID NO: 21987 - DNA, 36 bp, Artificial Sequence
  Synthetic oligonucleotide
gtgaccctgcacgaggatccttgtctcacttgctta

SEQ ID NO: 21988 - DNA, 35 bp, Artificial Sequence
  Synthetic oligonucleotide
atccttgtcccatcaccactgagtgcccctctcac

SEQ ID NO: 21989 - DNA, 35 bp, Artificial Sequence
  Synthetic oligonucleotide
atcgagagttacatccttatgcgcttgcccccgac

SEQ ID NO: 21990 - DNA, 35 bp, Artificial Sequence
  Synthetic oligonucleotide
acgcggcctcgacgcccataccctccaattgcacc

SEQ ID NO: 21991 - DNA, 35 bp, Artificial Sequence
  Synthetic oligonucleotide
tccgtccccggtccctccgaacccccacgtctgcc

SEQ ID NO: 21992 - DNA, 35 bp, Artificial Sequence
  Synthetic oligonucleotide
ttggaccagttaacagggaagggcacgggcgggtc

SEQ ID NO: 21993 - DNA, 35 bp, Artificial Sequence
  Synthetic oligonucleotide
tctatccacattcgatcgttgcatcactcacttcg

SEQ ID NO: 21994 - DNA, 35 bp, Artificial Sequence
  Synthetic oligonucleotide
tagataggatggctgggggtagagggtggtcacgt

SEQ ID NO: 21995 - DNA, 35 bp, Artificial Sequence
  Synthetic oligonucleotide
tacgaggtgagttagggagtaggggagcatgatgt

SEQ ID NO: 21996 - DNA, 35 bp, Artificial Sequence
  Synthetic oligonucleotide
ggaggggaggaggggttattacggggcaagttaca

SEQ ID NO: 21997 - DNA, 37 bp, Artificial Sequence
  Synthetic oligonucleotide
aacagccgcccaactttgcgacatcatgactccccga

SEQ ID NO: 21998 - DNA, 37 bp, Artificial Sequence
  Synthetic oligonucleotide
atcagggcatggtccctacgcctcacctcttcatgga

SEQ ID NO: 21999 - DNA, 37 bp, Artificial Sequence
  Synthetic oligonucleotide
ttgcaagtgtagacccccactcgcccgactatactga

SEQ ID NO: 22000 - DNA, 38 bp, Artificial Sequence
  Synthetic oligonucleotide
acgtcccccggatgctactgccctgccccacacgctga

SEQ ID NO: 22001 - DNA, 35 bp, Artificial Sequence
  Synthetic oligonucleotide
tcactcgcacgcaagaagccactagttacatcgcc

SEQ ID NO: 22002 - DNA, 35 bp, Artificial Sequence
  Synthetic oligonucleotide
tagacacgccgagtgaatgcttgtctgtccgttcc

SEQ ID NO: 22003 - DNA, 35 bp, Artificial Sequence
  Synthetic oligonucleotide
actgacacccctcatccgcacgcttaggctgttcc

SEQ ID NO: 22004 - DNA, 35 bp, Artificial Sequence
  Synthetic oligonucleotide
gttcaatgtcagaccccatctcccttagtctttgc

SEQ ID NO: 22005 - DNA, 35 bp, Artificial Sequence
  Synthetic oligonucleotide
aaaggtggtgggaacgggtgtgagtgagcagagcg

SEQ ID NO: 22006 - DNA, 35 bp, Artificial Sequence
  Synthetic oligonucleotide
gaactgaccggcctggctaccgaatttctcccgtg

SEQ ID NO: 22007 - DNA, 36 bp, Artificial Sequence
  Synthetic oligonucleotide
gtacatccgtaagtacgtccccttctgcctggccaa

SEQ ID NO: 22008 - DNA, 35 bp, Artificial Sequence
  Synthetic oligonucleotide
ccaccccacatatcgtagcctcgccgtgcctggaa

SEQ ID NO: 22009 - DNA, 35 bp, Artificial Sequence
  Synthetic oligonucleotide
tccccgcatccctcacaccgttgcaagtagcaaca

SEQ ID NO: 22010 - DNA, 37 bp, Artificial Sequence
  Synthetic oligonucleotide
tacgactcgtgctttgcttatgaatttccactcccga

SEQ ID NO: 22011 - DNA, 37 bp, Artificial Sequence
  Synthetic oligonucleotide
tggacgcaatcgggcggagggaaggcaaaggttagga

SEQ ID NO: 22012 - DNA, 36 bp, Artificial Sequence
  Synthetic oligonucleotide
cctcacacgtggaacactatcatgtgctattatcta

SEQ ID NO: 22013 - DNA, 35 bp, Artificial Sequence
  Synthetic oligonucleotide
aactgcggcaccgagcctatgccactatccagtcc

SEQ ID NO: 22014 - DNA, 35 bp, Artificial Sequence
  Synthetic oligonucleotide
gtacaccccagcatactcacagtagcatctgtgtc

SEQ ID NO: 22015 - DNA, 35 bp, Artificial Sequence
  Synthetic oligonucleotide
acgcgctacattcacatcctcccggtctacgcttc

SEQ ID NO: 22016 - DNA, 35 bp, Artificial Sequence
  Synthetic oligonucleotide
tgactcccctttatctgctcgcgtactccctaacg

SEQ ID NO: 22017 - DNA, 35 bp, Artificial Sequence
  Synthetic oligonucleotide
ggatcgaccaccgttttcctttagccattctgtct

SEQ ID NO: 22018 - DNA, 36 bp, Artificial Sequence
  Synthetic oligonucleotide
ttgaccgagccccccacgtagcgttttgtacaccaa

SEQ ID NO: 22019 - DNA, 35 bp, Artificial Sequence
  Synthetic oligonucleotide
accctcgccattccttggtttaggggccaccctca

SEQ ID NO: 22020 - DNA, 36 bp, Artificial Sequence
  Synthetic oligonucleotide
ggtacgcacagcattcctttctggcatcctacccga

SEQ ID NO: 22021 - DNA, 36 bp, Artificial Sequence
  Synthetic oligonucleotide
tgtaaccgaactgggccgtgcctactgaaactacta

SEQ ID NO: 22022 - DNA, 35 bp, Artificial Sequence
  Synthetic oligonucleotide
aatcacatcaggcccaaccatccgcctggcaaagc

SEQ ID NO: 22023 - DNA, 35 bp, Artificial Sequence
  Synthetic oligonucleotide
tatcgcatcaggctggccgccttacctcctacttc

SEQ ID NO: 22024 - DNA, 35 bp, Artificial Sequence
  Synthetic oligonucleotide
agtccctccccactggtccaagctagtgcaaccct

SEQ ID NO: 22025 - DNA, 36 bp, Artificial Sequence
  Synthetic oligonucleotide
ttacgtcgctccccccatttgccgcagataatctca

SEQ ID NO: 22026 - DNA, 37 bp, Artificial Sequence
  Synthetic oligonucleotide
aaagagatgggctgaggtggggcaggtgtacagtgga

SEQ ID NO: 22027 - DNA, 35 bp, Artificial Sequence
  Synthetic oligonucleotide
ttagccatcccagagccttccaggtctttcgctgc

SEQ ID NO: 22028 - DNA, 35 bp, Artificial Sequence
  Synthetic oligonucleotide
atccgagaacctggccaaacacaactgacagcttg

SEQ ID NO: 22029 - DNA, 35 bp, Artificial Sequence
  Synthetic oligonucleotide
ttactgcacacttgcccgttccgtttgcgccccct

SEQ ID NO: 22030 - DNA, 35 bp, Artificial Sequence
  Synthetic oligonucleotide
tatccgtgttgtctcccctactccccctctgcggt

SEQ ID NO: 22031 - DNA, 35 bp, Artificial Sequence
  Synthetic oligonucleotide
taaaccgccgatttgaccgcactgtatcaggttaa

SEQ ID NO: 22032 - DNA, 36 bp, Artificial Sequence
  Synthetic oligonucleotide
tgttgaccaattcgtgatatcgttcccgcaccccca

SEQ ID NO: 22033 - DNA, 36 bp, Artificial Sequence
  Synthetic oligonucleotide
tcgcatgtgacgcctgaccttttcttttacccagca

SEQ ID NO: 22034 - DNA, 36 bp, Artificial Sequence
  Synthetic oligonucleotide
gcatacaccgtccgtttatcgcgtctcgcatcttca

SEQ ID NO: 22035 - DNA, 38 bp, Artificial Sequence
  Synthetic oligonucleotide
actgatgccctgaagcccttgcctaccacttaacgtga

SEQ ID NO: 22036 - DNA, 35 bp, Artificial Sequence
  Synthetic oligonucleotide
acaccaaccctcgcatgttctgtcttcagtgcggc

SEQ ID NO: 22037 - DNA, 35 bp, Artificial Sequence
  Synthetic oligonucleotide
tgtgacgtactacccatcctacacaggcacgcctc

SEQ ID NO: 22038 - DNA, 35 bp, Artificial Sequence
  Synthetic oligonucleotide
accgtcctgccctatgaccatacgtggttatctct

SEQ ID NO: 22039 - DNA, 35 bp, Artificial Sequence
  Synthetic oligonucleotide
gcactcgcatttttgttcctgcccctagctttcgt

SEQ ID NO: 22040 - DNA, 35 bp, Artificial Sequence
  Synthetic oligonucleotide
gcagatagccacaacggtggtaataaccccctctt

SEQ ID NO: 22041 - DNA, 35 bp, Artificial Sequence
  Synthetic oligonucleotide
tctcgccacctgcgccgtttgttggtccggtcttt

SEQ ID NO: 22042 - DNA, 36 bp, Artificial Sequence
  Synthetic oligonucleotide
tgactgcccctagctttctgtggcgccccgttttaa

SEQ ID NO: 22043 - DNA, 36 bp, Artificial Sequence
  Synthetic oligonucleotide
tcatgtgtccctctcagcctcccttgctgcatccga

SEQ ID NO: 22044 - DNA, 37 bp, Artificial Sequence
  Synthetic oligonucleotide
tcgttcgaccctcatgtaattctctgccaccttatga

SEQ ID NO: 22045 - DNA, 35 bp, Artificial Sequence
  Synthetic oligonucleotide
tcatagctgtctccctgtacagccattgccctccc

SEQ ID NO: 22046 - DNA, 35 bp, Artificial Sequence
  Synthetic oligonucleotide
ttccccccgcccatcctggtgtatgcaaacgctcc

SEQ ID NO: 22047 - DNA, 35 bp, Artificial Sequence
  Synthetic oligonucleotide
gacccgttcccccgacctcctgtcttaataggctc

SEQ ID NO: 22048 - DNA, 35 bp, Artificial Sequence
  Synthetic oligonucleotide
tgtccataccacttaactccgatccatgtgccaag

SEQ ID NO: 22049 - DNA, 35 bp, Artificial Sequence
  Synthetic oligonucleotide
accacctctgccgctgttcttatacggggctaaat

SEQ ID NO: 22050 - DNA, 35 bp, Artificial Sequence
  Synthetic oligonucleotide
tgtcccgcggccccccccgttgttccccttttcat

SEQ ID NO: 22051 - DNA, 35 bp, Artificial Sequence
  Synthetic oligonucleotide
gcaccaatatggcctcccctagtctccgccggaca

SEQ ID NO: 22052 - DNA, 35 bp, Artificial Sequence
  Synthetic oligonucleotide
tgtaccccgagtgatccctatgttatgccctgcca

SEQ ID NO: 22053 - DNA, 37 bp, Artificial Sequence
  Synthetic oligonucleotide
aactccaccttcacactacagtcatgtccgtactgga

SEQ ID NO: 22054 - DNA, 38 bp, Artificial Sequence
  Synthetic oligonucleotide
gagcgaacgggaggggggaggttttagcctagagttga

SEQ ID NO: 22055 - DNA, 37 bp, Artificial Sequence
  Synthetic oligonucleotide
gtgccccacctacagcacgtttcctactgtccgttga

SEQ ID NO: 22056 - DNA, 36 bp, Artificial Sequence
  Synthetic oligonucleotide
ttgtgtgacgccctgccctgctgattgcctgctata

SEQ ID NO: 22057 - DNA, 35 bp, Artificial Sequence
  Synthetic oligonucleotide
tacgacttacccccatctcgtggctcgtgactagc

SEQ ID NO: 22058 - DNA, 35 bp, Artificial Sequence
  Synthetic oligonucleotide
tccgcagtaacagcctcggcattttctccaccttc

SEQ ID NO: 22059 - DNA, 35 bp, Artificial Sequence
  Synthetic oligonucleotide
tttcgatcccgcatctccctctgtttgctaccccg

SEQ ID NO: 22060 - DNA, 35 bp, Artificial Sequence
  Synthetic oligonucleotide
gctttgccagatacccccctgtcattcgtgccttt

SEQ ID NO: 22061 - DNA, 35 bp, Artificial Sequence
  Synthetic oligonucleotide
tagacaagcaaggcaagaaaaatcgggggggaaaa

SEQ ID NO: 22062 - DNA, 36 bp, Artificial Sequence
  Synthetic oligonucleotide
tcgcatccgctactagctcaccatccgtaccttaga

SEQ ID NO: 22063 - DNA, 35 bp, Artificial Sequence
  Synthetic oligonucleotide
gcgtccggacgcagcatagcctccccacaccacga

SEQ ID NO: 22064 - DNA, 35 bp, Artificial Sequence
  Synthetic oligonucleotide
gaagcgggtagggagggtctccggggattagacga

SEQ ID NO: 22065 - DNA, 37 bp, Artificial Sequence
  Synthetic oligonucleotide
gtagacgtcgggcgggactttaggatagcaaggggga

SEQ ID NO: 22066 - DNA, 37 bp, Artificial Sequence
  Synthetic oligonucleotide
gccgacttgccctccgactcgccctttaattgctgga

SEQ ID NO: 22067 - DNA, 37 bp, Artificial Sequence
  Synthetic oligonucleotide
gcaaccatccccctaccgctcctccggcccccgtgga

SEQ ID NO: 22068 - DNA, 38 bp, Artificial Sequence
  Synthetic oligonucleotide
acccacaatcccgatgttcccccagactctctgcctga

SEQ ID NO: 22069 - DNA, 38 bp, Artificial Sequence
  Synthetic oligonucleotide
gccccccgccaccttcctctgcgatctacccctggtga

SEQ ID NO: 22070 - DNA, 38 bp, Artificial Sequence
  Synthetic oligonucleotide
tgatgcgcgtagcttatctccaccaactctgcctgtga

SEQ ID NO: 22071 - DNA, 37 bp, Artificial Sequence
  Synthetic oligonucleotide
ggcgccagccacagcttgaccttccatgttactttga

SEQ ID NO: 22072 - DNA, 35 bp, Artificial Sequence
  Synthetic oligonucleotide
gtgccccttttgtagtgatctgcctgggcctttga

SEQ ID NO: 22073 - DNA, 35 bp, Artificial Sequence
  Synthetic oligonucleotide
ttcaaaccagccttcccatcgtccgaccagtggac

SEQ ID NO: 22074 - DNA, 35 bp, Artificial Sequence
  Synthetic oligonucleotide
tggccgccacacttcaccctgctgttcattcctcc

SEQ ID NO: 22075 - DNA, 35 bp, Artificial Sequence
  Synthetic oligonucleotide
tccccacggggaaactatgtgacgcgttttcttcc

SEQ ID NO: 22076 - DNA, 35 bp, Artificial Sequence
  Synthetic oligonucleotide
tcactcgccgcatgcgatactctcgtgggcgcttc

SEQ ID NO: 22077 - DNA, 35 bp, Artificial Sequence
  Synthetic oligonucleotide
tcaccgtacacgcccctccgaccatgcactaaaag

SEQ ID NO: 22078 - DNA, 35 bp, Artificial Sequence
  Synthetic oligonucleotide
ggtacctccagttcacctattccaatgctaccgct

SEQ ID NO: 22079 - DNA, 36 bp, Artificial Sequence
  Synthetic oligonucleotide
gcggagggggggaaaaaggatcgtgggcggggtggt

SEQ ID NO: 22080 - DNA, 36 bp, Artificial Sequence
  Synthetic oligonucleotide
tcttcccatccgccttgtacctcgtgcattttctca

SEQ ID NO: 22081 - DNA, 38 bp, Artificial Sequence
  Synthetic oligonucleotide
tcagacagtacgggggggagaggcgggtagtttactga

SEQ ID NO: 22082 - DNA, 35 bp, Artificial Sequence
  Synthetic oligonucleotide
aggggccgaacggggcatgaggggaaggcggggcc

SEQ ID NO: 22083 - DNA, 35 bp, Artificial Sequence
  Synthetic oligonucleotide
atcgttcatccagcgcgactaccgcatctcctggc

SEQ ID NO: 22084 - DNA, 35 bp, Artificial Sequence
  Synthetic oligonucleotide
tgagaacaaacgctcagcagcccgtaaccgccatc

SEQ ID NO: 22085 - DNA, 35 bp, Artificial Sequence
  Synthetic oligonucleotide
gtcgacctcacgccaacctctaccggtaacttttc

SEQ ID NO: 22086 - DNA, 35 bp, Artificial Sequence
  Synthetic oligonucleotide
ttactaccaccatcttgtctaccaccgcaactggg

SEQ ID NO: 22087 - DNA, 35 bp, Artificial Sequence
  Synthetic oligonucleotide
gatgcccaccacggactaagtgctacagtcttgct

SEQ ID NO: 22088 - DNA, 36 bp, Artificial Sequence
  Synthetic oligonucleotide
tgcccgcatctaaaacccgcccgaactcgtcctgca

SEQ ID NO: 22089 - DNA, 35 bp, Artificial Sequence
  Synthetic oligonucleotide
gagaggatgggcccggggaaggaaagatggctaga

SEQ ID NO: 22090 - DNA, 37 bp, Artificial Sequence
  Synthetic oligonucleotide
gcgcccttcagcccctaattaaggccttctgtaccga

SEQ ID NO: 22091 - DNA, 35 bp, Artificial Sequence
  Synthetic oligonucleotide
tccgatatcgtaaacactgtaccgttgctccctgc

SEQ ID NO: 22092 - DNA, 35 bp, Artificial Sequence
  Synthetic oligonucleotide
tccacatacttacaccgtgatgacagcatgccaag

SEQ ID NO: 22093 - DNA, 35 bp, Artificial Sequence
  Synthetic oligonucleotide
acccatgacgtgactcctctattcttcgcccacat

SEQ ID NO: 22094 - DNA, 35 bp, Artificial Sequence
  Synthetic oligonucleotide
tatgtgtagcccgccctagctcccgcattattgat

SEQ ID NO: 22095 - DNA, 36 bp, Artificial Sequence
  Synthetic oligonucleotide
gcgttcaccgctacttccacctgggctttactgaca

SEQ ID NO: 22096 - DNA, 36 bp, Artificial Sequence
  Synthetic oligonucleotide
tcgaacttcccgtcacgcgtttcccagttcacccca

SEQ ID NO: 22097 - DNA, 36 bp, Artificial Sequence
  Synthetic oligonucleotide
accgaacgcccactcgtgtccgttctttcgccccca

SEQ ID NO: 22098 - DNA, 37 bp, Artificial Sequence
  Synthetic oligonucleotide
gacagtgaataggtggttatggttggggggtacggga

SEQ ID NO: 22099 - DNA, 37 bp, Artificial Sequence
  Synthetic oligonucleotide
gttggccccgcatttatcgttgaaccccctttatgga

SEQ ID NO: 22100 - DNA, 38 bp, Artificial Sequence
  Synthetic oligonucleotide
atccactctcgcccagttgtctctggtttgccacttga

SEQ ID NO: 22101 - DNA, 36 bp, Artificial Sequence
  Synthetic oligonucleotide
tcagcccggaatacctgccgctcccaccgtgcgcta

SEQ ID NO: 22102 - DNA, 35 bp, Artificial Sequence
  Synthetic oligonucleotide
ttgaatacgactgcctgcttttatcctccccccgg

SEQ ID NO: 22103 - DNA, 35 bp, Artificial Sequence
  Synthetic oligonucleotide
accccctcgccagtatctctcgtcttgtcatccaa

SEQ ID NO: 22104 - DNA, 36 bp, Artificial Sequence
  Synthetic oligonucleotide
accgacaggcccttttgctcatcagtccatacttaa

SEQ ID NO: 22105 - DNA, 38 bp, Artificial Sequence
  Synthetic oligonucleotide
tctcacccctgccaatgcctgacagctgcttgcgctga

SEQ ID NO: 22106 - DNA, 38 bp, Artificial Sequence
  Synthetic oligonucleotide
gtgacagtcaggaggctggatgggtgggaagagagtga

SEQ ID NO: 22107 - DNA, 38 bp, Artificial Sequence
  Synthetic oligonucleotide
tcgatcaaccaccgtgcttagtgcctttgttttattga

SEQ ID NO: 22108 - DNA, 37 bp, Artificial Sequence
  Synthetic oligonucleotide
gcaccgcatcccggccagaaatgccgccttccgttga

SEQ ID NO: 22109 - DNA, 37 bp, Artificial Sequence
  Synthetic oligonucleotide
acatggccccgtccggcgctattttcctatcgtttga

SEQ ID NO: 22110 - DNA, 35 bp, Artificial Sequence
  Synthetic oligonucleotide
tgattcaccggtcactccctgcctcaaagatctta

SEQ ID NO: 22111 - DNA, 35 bp, Artificial Sequence
  Synthetic oligonucleotide
agccgctccgtatcgttgaccttattacctccgcc

SEQ ID NO: 22112 - DNA, 35 bp, Artificial Sequence
  Synthetic oligonucleotide
gtctctcaccccgattgtcaaatcatcgtacttgc

SEQ ID NO: 22113 - DNA, 35 bp, Artificial Sequence
  Synthetic oligonucleotide
acatggagccgtgaaccgtcttaacattgctttcg

SEQ ID NO: 22114 - DNA, 37 bp, Artificial Sequence
  Synthetic oligonucleotide
ttggtccgccgccacttgctacatcccttacggtcga

SEQ ID NO: 22115 - DNA, 38 bp, Artificial Sequence
  Synthetic oligonucleotide
gtcgcaccgcccactggaatataaatgatcccacctga

SEQ ID NO: 22116 - DNA, 38 bp, Artificial Sequence
  Synthetic oligonucleotide
gtcaccccatccgatcgccctgctagtgtccacagtga

SEQ ID NO: 22117 - DNA, 35 bp, Artificial Sequence
  Synthetic oligonucleotide
tggtacctctgaacactgacccagccttcctttta

SEQ ID NO: 22118 - DNA, 35 bp, Artificial Sequence
  Synthetic oligonucleotide
aacaacaggcgaatcgctgcttgtcaatcaatacc

SEQ ID NO: 22119 - DNA, 35 bp, Artificial Sequence
  Synthetic oligonucleotide
ttgggaggattcctgagcaagggggggggtgaggg

SEQ ID NO: 22120 - DNA, 35 bp, Artificial Sequence
  Synthetic oligonucleotide
atcgcatgacgggaggacgctgcgatttgtacgat

SEQ ID NO: 22121 - DNA, 35 bp, Artificial Sequence
  Synthetic oligonucleotide
atgccccgccaattacccaaacgtaccttagcggt

SEQ ID NO: 22122 - DNA, 35 bp, Artificial Sequence
  Synthetic oligonucleotide
tccactctcggaccgtgattcgctctggcctcgaa

SEQ ID NO: 22123 - DNA, 36 bp, Artificial Sequence
  Synthetic oligonucleotide
tggtcaactcaccctcccaccaagagtccactccca

SEQ ID NO: 22124 - DNA, 37 bp, Artificial Sequence
  Synthetic oligonucleotide
gagggggaggaacggtagttatagctgaaatcgaaga

SEQ ID NO: 22125 - DNA, 36 bp, Artificial Sequence
  Synthetic oligonucleotide
tgcacgtaccatgtcccatcgtaattggcccttaga

SEQ ID NO: 22126 - DNA, 37 bp, Artificial Sequence
  Synthetic oligonucleotide
aacgccgggaacgagagctgaaaaagggttcgaggga

SEQ ID NO: 22127 - DNA, 38 bp, Artificial Sequence
  Synthetic oligonucleotide
agcgactcccgccacgctgataaccttcacaatcatga

SEQ ID NO: 22128 - DNA, 36 bp, Artificial Sequence
  Synthetic oligonucleotide
agtacagcatggaggggcagggagttgggatgatga

SEQ ID NO: 22129 - DNA, 38 bp, Artificial Sequence
  Synthetic oligonucleotide
acgagtgggggcaaagtgggggatgacaaagtcagtga

SEQ ID NO: 22130 - DNA, 38 bp, Artificial Sequence
  Synthetic oligonucleotide
aacgaggagtgacaggtagatggtaggtcggggggtga

SEQ ID NO: 22131 - DNA, 37 bp, Artificial Sequence
  Synthetic oligonucleotide
accaccaccagttctcgcgagcctttacgacgattga

SEQ ID NO: 22132 - DNA, 38 bp, Artificial Sequence
  Synthetic oligonucleotide
tcagggtcgccggcctgctcaatctccgtgtcctttga

SEQ ID NO: 22133 - DNA, 35 bp, Artificial Sequence
  Synthetic oligonucleotide
gtgcccgccagcacaattgtcctcccacgcgcata

SEQ ID NO: 22134 - DNA, 35 bp, Artificial Sequence
  Synthetic oligonucleotide
atctcacacatatcgcatgaacgaagtgcgccccc

SEQ ID NO: 22135 - DNA, 35 bp, Artificial Sequence
  Synthetic oligonucleotide
tacaggcacacccagctaatccccgtcagcttttc

SEQ ID NO: 22136 - DNA, 35 bp, Artificial Sequence
  Synthetic oligonucleotide
tcatcaggaaccaattgctgctatcatacataaat

SEQ ID NO: 22137 - DNA, 35 bp, Artificial Sequence
  Synthetic oligonucleotide
gcgcacagtaggaaaacggaggggaggaacgctaa

SEQ ID NO: 22138 - DNA, 36 bp, Artificial Sequence
  Synthetic oligonucleotide
atgccgtgctggtttctgcctctattttggacccga

SEQ ID NO: 22139 - DNA, 37 bp, Artificial Sequence
  Synthetic oligonucleotide
tcctggggaggggtgtagcaaggaagggtggccggga

SEQ ID NO: 22140 - DNA, 37 bp, Artificial Sequence
  Synthetic oligonucleotide
gatccgccgtctacacaccttctctgccgtcccatga

SEQ ID NO: 22141 - DNA, 35 bp, Artificial Sequence
  Synthetic oligonucleotide
acccgaacgatccgacctcatggtcagtcaattac

SEQ ID NO: 22142 - DNA, 35 bp, Artificial Sequence
  Synthetic oligonucleotide
ttgcgccactcgccatctcggtcccatatagcgcc

SEQ ID NO: 22143 - DNA, 35 bp, Artificial Sequence
  Synthetic oligonucleotide
gtcaagccctctccccgtgatacgtttctttcagc

SEQ ID NO: 22144 - DNA, 35 bp, Artificial Sequence
  Synthetic oligonucleotide
tgttggagacggaagggtgtcgtggagggggtgcg

SEQ ID NO: 22145 - DNA, 35 bp, Artificial Sequence
  Synthetic oligonucleotide
acctgccccttgtctgagcagttcacgctatctcg

SEQ ID NO: 22146 - DNA, 35 bp, Artificial Sequence
  Synthetic oligonucleotide
tatctgccacttctgcttctcctctggacgccatg

SEQ ID NO: 22147 - DNA, 35 bp, Artificial Sequence
  Synthetic oligonucleotide
gactcaacacgaccaaccttgccctgaggccacat

SEQ ID NO: 22148 - DNA, 35 bp, Artificial Sequence
  Synthetic oligonucleotide
atccaacaccctgctcctagcgcctcccagcacat

SEQ ID NO: 22149 - DNA, 34 bp, Artificial Sequence
  Synthetic oligonucleotide
agcgtggtcgccacaccacattgcactgatttct

SEQ ID NO: 22150 - DNA, 36 bp, Artificial Sequence
  Synthetic oligonucleotide
gtccaccctctgaactaagctcctggttccatacaa

SEQ ID NO: 22151 - DNA, 35 bp, Artificial Sequence
  Synthetic oligonucleotide
atggtcgcccagcctttactacccggatcctaata

SEQ ID NO: 22152 - DNA, 35 bp, Artificial Sequence
  Synthetic oligonucleotide
ggagcatactccgccccgctcttgccacagcccac

SEQ ID NO: 22153 - DNA, 35 bp, Artificial Sequence
  Synthetic oligonucleotide
tcctgaccccggttttcagtctctcctctgttggc

SEQ ID NO: 22154 - DNA, 35 bp, Artificial Sequence
  Synthetic oligonucleotide
agcgacctgctcgcctcacggatattcccttttgc

SEQ ID NO: 22155 - DNA, 35 bp, Artificial Sequence
  Synthetic oligonucleotide
tcacggttcgcatgggatctgcccccgtgttttct

SEQ ID NO: 22156 - DNA, 36 bp, Artificial Sequence
  Synthetic oligonucleotide
acgccctacgccgtgagcaccccgcaccaattgaca

SEQ ID NO: 22157 - DNA, 38 bp, Artificial Sequence
  Synthetic oligonucleotide
acatcctcacgccttttctgtggccagccattggctga

SEQ ID NO: 22158 - DNA, 35 bp, Artificial Sequence
  Synthetic oligonucleotide
ttaagacagcccgcgttctgcaacgaccatcctta

SEQ ID NO: 22159 - DNA, 35 bp, Artificial Sequence
  Synthetic oligonucleotide
acgcactcctaagacgccgccttatgcaagccccc

SEQ ID NO: 22160 - DNA, 35 bp, Artificial Sequence
  Synthetic oligonucleotide
ttgtgctactgcatacccttcgctcctacgcattg

SEQ ID NO: 22161 - DNA, 35 bp, Artificial Sequence
  Synthetic oligonucleotide
gagccttggagccccttgacctgttatgtttttat

SEQ ID NO: 22162 - DNA, 35 bp, Artificial Sequence
  Synthetic oligonucleotide
accgtcccaaccctaatatgcaccaacgctactgt

SEQ ID NO: 22163 - DNA, 36 bp, Artificial Sequence
  Synthetic oligonucleotide
gcacaagcctcaccttcattgaacggccagtcctaa

SEQ ID NO: 22164 - DNA, 36 bp, Artificial Sequence
  Synthetic oligonucleotide
accccgcccaatctgcttcgtacgcttgaccgctaa

SEQ ID NO: 22165 - DNA, 35 bp, Artificial Sequence
  Synthetic oligonucleotide
tcacctccccctttatccgattgccgttggaccca

SEQ ID NO: 22166 - DNA, 37 bp, Artificial Sequence
  Synthetic oligonucleotide
tcgaacgtcttgctccggatccccgccattcacccga

SEQ ID NO: 22167 - DNA, 38 bp, Artificial Sequence
  Synthetic oligonucleotide
acagagcagtatgcaagaaaagcatggggtgggaatga

SEQ ID NO: 22168 - DNA, 38 bp, Artificial Sequence
  Synthetic oligonucleotide
acccaagcagggtagtaccttcttgcatcctgggttga

SEQ ID NO: 22169 - DNA, 37 bp, Artificial Sequence
  Synthetic oligonucleotide
gaggagtcggtctatcctgttaccgtgccacatttga

SEQ ID NO: 22170 - DNA, 35 bp, Artificial Sequence
  Synthetic oligonucleotide
gatcgctggaccccaatcatgtgtcggttcttccc

SEQ ID NO: 22171 - DNA, 35 bp, Artificial Sequence
  Synthetic oligonucleotide
acagcgcacctcattccacggtataacctcctctc

SEQ ID NO: 22172 - DNA, 35 bp, Artificial Sequence
  Synthetic oligonucleotide
tcacactcaggtaaatgcccctcacacgacgtctg

SEQ ID NO: 22173 - DNA, 34 bp, Artificial Sequence
  Synthetic oligonucleotide
gaatgtgcctgctttgtccaacgcgtttcctggt

SEQ ID NO: 22174 - DNA, 36 bp, Artificial Sequence
  Synthetic oligonucleotide
agccactgcccaacctaccacagctgccaacacgaa

SEQ ID NO: 22175 - DNA, 36 bp, Artificial Sequence
  Synthetic oligonucleotide
atttcgaccagcgctctcttcagccctacccaccca

SEQ ID NO: 22176 - DNA, 36 bp, Artificial Sequence
  Synthetic oligonucleotide
gaatacttgcgccgtacaaccatctcttctacgcga

SEQ ID NO: 22177 - DNA, 37 bp, Artificial Sequence
  Synthetic oligonucleotide
gtcacccactcccactccctgtgctatcttgtaagga

SEQ ID NO: 22178 - DNA, 38 bp, Artificial Sequence
  Synthetic oligonucleotide
agtacgaataggagcgggggggagatgtccttgtgtga

SEQ ID NO: 22179 - DNA, 35 bp, Artificial Sequence
  Synthetic oligonucleotide
gaggtcaccctcggtatcgcactttactaacagtc

SEQ ID NO: 22180 - DNA, 35 bp, Artificial Sequence
  Synthetic oligonucleotide
aaacgcgcctaccttagcctccccctccagctttg

SEQ ID NO: 22181 - DNA, 35 bp, Artificial Sequence
  Synthetic oligonucleotide
gcttggggatcgccacacgtgccttctaacattct

SEQ ID NO: 22182 - DNA, 35 bp, Artificial Sequence
  Synthetic oligonucleotide
acccctcccccgtctattgtcaggtcaccgttaaa

SEQ ID NO: 22183 - DNA, 35 bp, Artificial Sequence
  Synthetic oligonucleotide
gcacgggagggaatggtaggggagtggagaaacaa

SEQ ID NO: 22184 - DNA, 36 bp, Artificial Sequence
  Synthetic oligonucleotide
tcccactccaccacttccggttagtgccaacttgaa

SEQ ID NO: 22185 - DNA, 35 bp, Artificial Sequence
  Synthetic oligonucleotide
gcaacctcctttgggttccgggcctacacccctca

SEQ ID NO: 22186 - DNA, 37 bp, Artificial Sequence
  Synthetic oligonucleotide
tcatccacacctatgtagtccttagctttcgcgtaga

SEQ ID NO: 22187 - DNA, 37 bp, Artificial Sequence
  Synthetic oligonucleotide
aacttcctcagtaggtgcttcgccgtgccactcccga

SEQ ID NO: 22188 - DNA, 35 bp, Artificial Sequence
  Synthetic oligonucleotide
gaaccctcccatgatatgtcgcaccggactcggga

SEQ ID NO: 22189 - DNA, 37 bp, Artificial Sequence
  Synthetic oligonucleotide
agcataggaggacatcggggtgggggtggagagtgga

SEQ ID NO: 22190 - DNA, 35 bp, Artificial Sequence
  Synthetic oligonucleotide
atgggcgggtaagggggggacgcacatagaggtta

SEQ ID NO: 22191 - DNA, 35 bp, Artificial Sequence
  Synthetic oligonucleotide
taccctgccgacaaaagcgccggctgtccgcctcc

SEQ ID NO: 22192 - DNA, 35 bp, Artificial Sequence
  Synthetic oligonucleotide
tgcgccactcccccgggacccggtaccactttggc

SEQ ID NO: 22193 - DNA, 35 bp, Artificial Sequence
  Synthetic oligonucleotide
aagacagtagctgttggcctaatccgcgctccatc

SEQ ID NO: 22194 - DNA, 36 bp, Artificial Sequence
  Synthetic oligonucleotide
aagcatgccaggtctttccgcgcgcgaccctccctc

SEQ ID NO: 22195 - DNA, 35 bp, Artificial Sequence
  Synthetic oligonucleotide
atgtgcgagggccaatttgctttttctttactgtc

SEQ ID NO: 22196 - DNA, 35 bp, Artificial Sequence
  Synthetic oligonucleotide
accacctagccccatcgctaatattcttgtttgat

SEQ ID NO: 22197 - DNA, 35 bp, Artificial Sequence
  Synthetic oligonucleotide
tgttagtggcctggtcccgaactgcccatcctttt

SEQ ID NO: 22198 - DNA, 36 bp, Artificial Sequence
  Synthetic oligonucleotide
gaacacatcgatgcgtgcccttatccccagctccaa

SEQ ID NO: 22199 - DNA, 36 bp, Artificial Sequence
  Synthetic oligonucleotide
aaaatggaacaaaaaaggagctgaaggggactggca

SEQ ID NO: 22200 - DNA, 36 bp, Artificial Sequence
  Synthetic oligonucleotide
acttccgagccatccatcacctcccggttcaccgga

SEQ ID NO: 22201 - DNA, 37 bp, Artificial Sequence
  Synthetic oligonucleotide
gtgcaacccctccgacctagccagtatatacacgtga

SEQ ID NO: 22202 - DNA, 35 bp, Artificial Sequence
  Synthetic oligonucleotide
tcccaagagccgactgctgcaaaacctgccgaacc

SEQ ID NO: 22203 - DNA, 35 bp, Artificial Sequence
  Synthetic oligonucleotide
gatgatcacaccgaggcccccaatggctatcctcc

SEQ ID NO: 22204 - DNA, 35 bp, Artificial Sequence
  Synthetic oligonucleotide
tgaggggcaaaatagggttaaactgggtggacgtg

SEQ ID NO: 22205 - DNA, 35 bp, Artificial Sequence
  Synthetic oligonucleotide
atcctgcgcttatccttctctgaccatcgctctgt

SEQ ID NO: 22206 - DNA, 36 bp, Artificial Sequence
  Synthetic oligonucleotide
gcaccctctgcccatacccgtcagatccaccttaaa

SEQ ID NO: 22207 - DNA, 36 bp, Artificial Sequence
  Synthetic oligonucleotide
acgcgaggaccgaagcgtacactcctcaaatctgca

SEQ ID NO: 22208 - DNA, 38 bp, Artificial Sequence
  Synthetic oligonucleotide
actcctcctcctgtgtccccagccatctgcacttctga

SEQ ID NO: 22209 - DNA, 35 bp, Artificial Sequence
  Synthetic oligonucleotide
gagccccactttattccatgccatgccctgcgtga

SEQ ID NO: 22210 - DNA, 35 bp, Artificial Sequence
  Synthetic oligonucleotide
actcctccgcgccgaggccacctcacacccttttg

SEQ ID NO: 22211 - DNA, 35 bp, Artificial Sequence
  Synthetic oligonucleotide
tgaccaaccgccaactttcggaaagtccctgtact

SEQ ID NO: 22212 - DNA, 35 bp, Artificial Sequence
  Synthetic oligonucleotide
ttgccacctgtcttctggcaactagtgccgcccct

SEQ ID NO: 22213 - DNA, 35 bp, Artificial Sequence
  Synthetic oligonucleotide
tcactgcatcactccttggcaagcgtaatccccca

SEQ ID NO: 22214 - DNA, 37 bp, Artificial Sequence
  Synthetic oligonucleotide
gacactgcagctttattcgccctgccacttccaccga

SEQ ID NO: 22215 - DNA, 38 bp, Artificial Sequence
  Synthetic oligonucleotide
tccccctgccgttaccgcaacgccgatcacgttagtga

SEQ ID NO: 22216 - DNA, 38 bp, Artificial Sequence
  Synthetic oligonucleotide
ttccccacacccctatgagcatcatttcacatccgtga

SEQ ID NO: 22217 - DNA, 37 bp, Artificial Sequence
  Synthetic oligonucleotide
aacccgaaccaccgtcatgaatctgcaccttatttga

SEQ ID NO: 22218 - DNA, 35 bp, Artificial Sequence
  Synthetic oligonucleotide
gtgggggaccccgcagtcgtgccatcccgtttctc

SEQ ID NO: 22219 - DNA, 35 bp, Artificial Sequence
  Synthetic oligonucleotide
acctctccgtggctatccaagactgcacttacttc

SEQ ID NO: 22220 - DNA, 35 bp, Artificial Sequence
  Synthetic oligonucleotide
tccgtccagagaaccatcgctgtccgtaactgtat

SEQ ID NO: 22221 - DNA, 35 bp, Artificial Sequence
  Synthetic oligonucleotide
gagaggggaagagtggctggtggcacgaagggtaa

SEQ ID NO: 22222 - DNA, 35 bp, Artificial Sequence
  Synthetic oligonucleotide
gacgcggtccatccatcttaacttctcagctgtaa

SEQ ID NO: 22223 - DNA, 35 bp, Artificial Sequence
  Synthetic oligonucleotide
gccaccgaatgcgccgtcttctgggcccctcttaa

SEQ ID NO: 22224 - DNA, 37 bp, Artificial Sequence
  Synthetic oligonucleotide
aacgtgcgaataggggcggagtgggacggatggcaga

SEQ ID NO: 22225 - DNA, 36 bp, Artificial Sequence
  Synthetic oligonucleotide
ggtcgggtggaagggggagagggttccaggccggga

SEQ ID NO: 22226 - DNA, 37 bp, Artificial Sequence
  Synthetic oligonucleotide
gccaaaagtggtggcgcaatggggactgtgggtggga

SEQ ID NO: 22227 - DNA, 38 bp, Artificial Sequence
  Synthetic oligonucleotide
tgatccctcgctcctccttgtttatcgcaagcccttga

SEQ ID NO: 22228 - DNA, 36 bp, Artificial Sequence
  Synthetic oligonucleotide
ttacatccactgttgtcctattgcctttatcgatta

SEQ ID NO: 22229 - DNA, 35 bp, Artificial Sequence
  Synthetic oligonucleotide
gttgtcgatcggcctgatccccaacaagtaccacc

SEQ ID NO: 22230 - DNA, 35 bp, Artificial Sequence
  Synthetic oligonucleotide
gaccacaacagccctatggacaatagttcgcattc

SEQ ID NO: 22231 - DNA, 37 bp, Artificial Sequence
  Synthetic oligonucleotide
tagctctcccctgtttcgctccagcttttgtactcga

SEQ ID NO: 22232 - DNA, 38 bp, Artificial Sequence
  Synthetic oligonucleotide
tgccctacaccgcgatcctttaggaccctcccacttga

SEQ ID NO: 22233 - DNA, 35 bp, Artificial Sequence
  Synthetic oligonucleotide
gtgcctcccatccgatttcagcgcgacagtaattc

SEQ ID NO: 22234 - DNA, 35 bp, Artificial Sequence
  Synthetic oligonucleotide
acctgggcaacgagggtagaactaaggggggtggg

SEQ ID NO: 22235 - DNA, 35 bp, Artificial Sequence
  Synthetic oligonucleotide
gtccccgcctccctctgcctttacacttctttgtg

SEQ ID NO: 22236 - DNA, 35 bp, Artificial Sequence
  Synthetic oligonucleotide
gacctccgtggccctattagcttccttttgaccct

SEQ ID NO: 22237 - DNA, 35 bp, Artificial Sequence
  Synthetic oligonucleotide
acaccaccttaacagatcagtgtgacgtcttctct

SEQ ID NO: 22238 - DNA, 37 bp, Artificial Sequence
  Synthetic oligonucleotide
tcccccgcaacctcttggtttacttgtcttacattaa

SEQ ID NO: 22239 - DNA, 36 bp, Artificial Sequence
  Synthetic oligonucleotide
atgcttagctgctgacactaccctgttatcccaaca

SEQ ID NO: 22240 - DNA, 36 bp, Artificial Sequence
  Synthetic oligonucleotide
acccgtcgctattgcactatgcccttccgctttaca

SEQ ID NO: 22241 - DNA, 36 bp, Artificial Sequence
  Synthetic oligonucleotide
gtcctactcaggttcaacctggcaacttttttttca

SEQ ID NO: 22242 - DNA, 37 bp, Artificial Sequence
  Synthetic oligonucleotide
aacccccgtccacgttctgtatgttctctgtgctgga

SEQ ID NO: 22243 - DNA, 37 bp, Artificial Sequence
  Synthetic oligonucleotide
aacgcgatagcgacctgctccaccactcgacacgtga

SEQ ID NO: 22244 - DNA, 35 bp, Artificial Sequence
  Synthetic oligonucleotide
tgtacagatgcctcattgcatgagcacttattacc

SEQ ID NO: 22245 - DNA, 35 bp, Artificial Sequence
  Synthetic oligonucleotide
atgaacccatcgccgctgcaggccctgcttcctct

SEQ ID NO: 22246 - DNA, 36 bp, Artificial Sequence
  Synthetic oligonucleotide
acctaagcagcgcatccacctgtctactctccctca

SEQ ID NO: 22247 - DNA, 37 bp, Artificial Sequence
  Synthetic oligonucleotide
gacggtccctgcgctgcccttatctgtaccgacgtga

SEQ ID NO: 22248 - DNA, 38 bp, Artificial Sequence
  Synthetic oligonucleotide
tccgttgacccctccatccgtggatcgcctgttattga

SEQ ID NO: 22249 - DNA, 37 bp, Artificial Sequence
  Synthetic oligonucleotide
gacattgtgcagcctcccttcctatcgccttgtttga

SEQ ID NO: 22250 - DNA, 35 bp, Artificial Sequence
  Synthetic oligonucleotide
tgacgcgttctgacaccatccttgctccattgcgc

SEQ ID NO: 22251 - DNA, 35 bp, Artificial Sequence
  Synthetic oligonucleotide
tagggtgggcggaggaaatcaaggggcgttctgtc

SEQ ID NO: 22252 - DNA, 36 bp, Artificial Sequence
  Synthetic oligonucleotide
tgcctgatcgaaatggttcactacacgctctctaca

SEQ ID NO: 22253 - DNA, 35 bp, Artificial Sequence
  Synthetic oligonucleotide
gtgcgcccctagcacttactaacctctaccctgca

SEQ ID NO: 22254 - DNA, 36 bp, Artificial Sequence
  Synthetic oligonucleotide
tccaccgccgggcatacaaattaaacgggtccatca

SEQ ID NO: 22255 - DNA, 37 bp, Artificial Sequence
  Synthetic oligonucleotide
tcattgcggtggggtggggatcgggggcagagggaga

SEQ ID NO: 22256 - DNA, 37 bp, Artificial Sequence
  Synthetic oligonucleotide
tgccggtggcgcattcgttccccctcctgtcatgaga

SEQ ID NO: 22257 - DNA, 37 bp, Artificial Sequence
  Synthetic oligonucleotide
accggactgttcacctcctagagcctgcctaccccga

SEQ ID NO: 22258 - DNA, 37 bp, Artificial Sequence
  Synthetic oligonucleotide
aatccctgccacgtgccgccattcagcaatttcctga

SEQ ID NO: 22259 - DNA, 37 bp, Artificial Sequence
  Synthetic oligonucleotide
atggatgagggtgaagggggggagggtagagttctga

SEQ ID NO: 22260 - DNA, 37 bp, Artificial Sequence
  Synthetic oligonucleotide
tcgaacatgggggaggaaagggtaggatatgagttga

SEQ ID NO: 22261 - DNA, 37 bp, Artificial Sequence
  Synthetic oligonucleotide
tcatgcactgccggcatgtacttccctttagctttga

SEQ ID NO: 22262 - DNA, 35 bp, Artificial Sequence
  Synthetic oligonucleotide
acgacttgtcaccctctctgctcgattcatgttac

SEQ ID NO: 22263 - DNA, 35 bp, Artificial Sequence
  Synthetic oligonucleotide
gtcccccgcacagttagcatcttcggacccgctct

SEQ ID NO: 22264 - DNA, 35 bp, Artificial Sequence
  Synthetic oligonucleotide
gcagacccgtagcgtttccctaatctggtgattct

SEQ ID NO: 22265 - DNA, 36 bp, Artificial Sequence
  Synthetic oligonucleotide
tcactcactgccagcctgtcacatcgatttctgcaa

SEQ ID NO: 22266 - DNA, 35 bp, Artificial Sequence
  Synthetic oligonucleotide
acccgcaggcacaatcttccgtctccagtagcgaa

SEQ ID NO: 22267 - DNA, 36 bp, Artificial Sequence
  Synthetic oligonucleotide
gaacatccagacgcgtacgggcctcctcaatcccca

SEQ ID NO: 22268 - DNA, 37 bp, Artificial Sequence
  Synthetic oligonucleotide
gccccaaccagcagacgttcggttccgtcccctccga

SEQ ID NO: 22269 - DNA, 37 bp, Artificial Sequence
  Synthetic oligonucleotide
tcacttcctcctgtcgtgcctataatccacgctccga

SEQ ID NO: 22270 - DNA, 37 bp, Artificial Sequence
  Synthetic oligonucleotide
aaccctgcctccgacgccacctacctgcacagaatga

SEQ ID NO: 22271 - DNA, 34 bp, Artificial Sequence
  Synthetic oligonucleotide
ggagccgcattatccctctattggccaaacctga

SEQ ID NO: 22272 - DNA, 38 bp, Artificial Sequence
  Synthetic oligonucleotide
gtgggtgggtgtggtgaagcgggagggtaatggtgtga

SEQ ID NO: 22273 - DNA, 38 bp, Artificial Sequence
  Synthetic oligonucleotide
tacgagcgcagacggaatgctgtgggggggagtgttga

SEQ ID NO: 22274 - DNA, 35 bp, Artificial Sequence
  Synthetic oligonucleotide
acattgccactaacgtgctactattcgcaacatcc

SEQ ID NO: 22275 - DNA, 35 bp, Artificial Sequence
  Synthetic oligonucleotide
tccgccccataggcaggccgccccatgctaacgtc

SEQ ID NO: 22276 - DNA, 35 bp, Artificial Sequence
  Synthetic oligonucleotide
gaatcacctgtccctccacccgggtactaccctgg

SEQ ID NO: 22277 - DNA, 35 bp, Artificial Sequence
  Synthetic oligonucleotide
taagcgcacttgccgctggattccttcactacatg

SEQ ID NO: 22278 - DNA, 35 bp, Artificial Sequence
  Synthetic oligonucleotide
atacaccgttacgctggaccgtgttccttctccgt

SEQ ID NO: 22279 - DNA, 37 bp, Artificial Sequence
  Synthetic oligonucleotide
gtttagccacatctgcacttttcttctgttctactga

SEQ ID NO: 22280 - DNA, 38 bp, Artificial Sequence
  Synthetic oligonucleotide
tatccatctgcacgccgcatatctctggtacgccgtga

SEQ ID NO: 22281 - DNA, 35 bp, Artificial Sequence
  Synthetic oligonucleotide
gcctacccttgaacgatcgaagagcacctaccccc

SEQ ID NO: 22282 - DNA, 35 bp, Artificial Sequence
  Synthetic oligonucleotide
gcaatggtactgggggatgggaggggggcgcagcg

SEQ ID NO: 22283 - DNA, 35 bp, Artificial Sequence
  Synthetic oligonucleotide
atcatgccaagttatcattgcctgttggtctcatt

SEQ ID NO: 22284 - DNA, 35 bp, Artificial Sequence
  Synthetic oligonucleotide
gaacgacccatcccttgtccagtgatcttttaaca

SEQ ID NO: 22285 - DNA, 35 bp, Artificial Sequence
  Synthetic oligonucleotide
agtcacgcgactactcaaagccactcgcccctcta

SEQ ID NO: 22286 - DNA, 35 bp, Artificial Sequence
  Synthetic oligonucleotide
gagtgggcctggggcatgtggggaaggaattggta

SEQ ID NO: 22287 - DNA, 35 bp, Artificial Sequence
  Synthetic oligonucleotide
atgtgtgcaccggtacaccaaattataagcctccc

SEQ ID NO: 22288 - DNA, 35 bp, Artificial Sequence
  Synthetic oligonucleotide
tcccgctatatgctgctcgcgcccttacccatgtc

SEQ ID NO: 22289 - DNA, 35 bp, Artificial Sequence
  Synthetic oligonucleotide
tagtaatcatcgccgcccccactgcaacggttttc

SEQ ID NO: 22290 - DNA, 35 bp, Artificial Sequence
  Synthetic oligonucleotide
tagcattaccactgtcgcgttcctggccttaacat

SEQ ID NO: 22291 - DNA, 25 bp, Artificial Sequence
  Synthetic oligonucleotide
tactggactttcaccaccccgtact

SEQ ID NO: 22292 - DNA, 36 bp, Artificial Sequence
  Synthetic oligonucleotide
tccctgccccggagtcgctaattcactgcaatgtaa

SEQ ID NO: 22293 - DNA, 36 bp, Artificial Sequence
  Synthetic oligonucleotide
ttggatcctcaaactcgcttactgccttgattctca

SEQ ID NO: 22294 - DNA, 35 bp, Artificial Sequence
  Synthetic oligonucleotide
ataagcgcacacgcagcgtaccatcatgcctttca

SEQ ID NO: 22295 - DNA, 37 bp, Artificial Sequence
  Synthetic oligonucleotide
atgtgcgccgaaccccaacagccctacctctccgaga

SEQ ID NO: 22296 - DNA, 37 bp, Artificial Sequence
  Synthetic oligonucleotide
aatcgagacggaagggaagtgtcgaggagggggacga

SEQ ID NO: 22297 - DNA, 37 bp, Artificial Sequence
  Synthetic oligonucleotide
tttcatcacgcacatacaacctagccgctctcaccga

SEQ ID NO: 22298 - DNA, 38 bp, Artificial Sequence
  Synthetic oligonucleotide
gaaaaacggcgacaaaaaggagggtgggggcaatctga

SEQ ID NO: 22299 - DNA, 37 bp, Artificial Sequence
  Synthetic oligonucleotide
aaaccgacgaaagtgagggaatagtgggggtggttga

SEQ ID NO: 22300 - DNA, 35 bp, Artificial Sequence
  Synthetic oligonucleotide
aaagcgcactcctggccggctcgcacctctacgta

SEQ ID NO: 22301 - DNA, 35 bp, Artificial Sequence
  Synthetic oligonucleotide
gggacccgactctccatgcaatctagccctgttac

SEQ ID NO: 22302 - DNA, 35 bp, Artificial Sequence
  Synthetic oligonucleotide
ttgggccgagcgttcacctgctcatgtagcctccc

SEQ ID NO: 22303 - DNA, 35 bp, Artificial Sequence
  Synthetic oligonucleotide
gcaccgacatacggtgtttccttcctatgttgctc

SEQ ID NO: 22304 - DNA, 35 bp, Artificial Sequence
  Synthetic oligonucleotide
gcaggtgccggcctccgtcactttttctggggttc

SEQ ID NO: 22305 - DNA, 35 bp, Artificial Sequence
  Synthetic oligonucleotide
agcgcaacatcctgtgcgcctggatgcctctgttc

SEQ ID NO: 22306 - DNA, 35 bp, Artificial Sequence
  Synthetic oligonucleotide
gctgccctcccaccaatgtaagctctgatttaact

SEQ ID NO: 22307 - DNA, 34 bp, Artificial Sequence
  Synthetic oligonucleotide
tgtcctgctgggatcgttgctgttgcccttctct

SEQ ID NO: 22308 - DNA, 35 bp, Artificial Sequence
  Synthetic oligonucleotide
tatcgaacgttccccagtgcctagcccccgcccgt

SEQ ID NO: 22309 - DNA, 35 bp, Artificial Sequence
  Synthetic oligonucleotide
tccgaccgcccgttgccgtatcgttgtctatcaaa

SEQ ID NO: 22310 - DNA, 37 bp, Artificial Sequence
  Synthetic oligonucleotide
accaccaacgcgggcttcctttggactttttacacga

SEQ ID NO: 22311 - DNA, 35 bp, Artificial Sequence
  Synthetic oligonucleotide
taggtcagcccacattcttcattcgtcttgcctga

SEQ ID NO: 22312 - DNA, 35 bp, Artificial Sequence
  Synthetic oligonucleotide
tgccaaggggcaggaataggggaaaggggtgcatt

SEQ ID NO: 22313 - DNA, 36 bp, Artificial Sequence
  Synthetic oligonucleotide
taaaggaacggtgaaagtggagggggatgtcgacca

SEQ ID NO: 22314 - DNA, 37 bp, Artificial Sequence
  Synthetic oligonucleotide
gtcttcctgcctcacctcgtaccatgggccccgccga

SEQ ID NO: 22315 - DNA, 38 bp, Artificial Sequence
  Synthetic oligonucleotide
gcgtgagcacggacgacaagtctggaggtacatgatga

SEQ ID NO: 22316 - DNA, 37 bp, Artificial Sequence
  Synthetic oligonucleotide
tgaacgcggcctgactgaatccatcttcccaccttga

SEQ ID NO: 22317 - DNA, 35 bp, Artificial Sequence
  Synthetic oligonucleotide
acgccgacccctcgaactgttccttgccccgaacc

SEQ ID NO: 22318 - DNA, 35 bp, Artificial Sequence
  Synthetic oligonucleotide
gcaggccacattagtgtcaaaccacctcgtctacc

SEQ ID NO: 22319 - DNA, 35 bp, Artificial Sequence
  Synthetic oligonucleotide
gccattacatcacgcgacacatttgccctcccact

SEQ ID NO: 22320 - DNA, 36 bp, Artificial Sequence
  Synthetic oligonucleotide
ttctgacgccgaatctaatagaattgccttttccaa

SEQ ID NO: 22321 - DNA, 30 bp, Artificial Sequence
  Synthetic oligonucleotide
gacggcccaccacacatttgccctcctcaa

SEQ ID NO: 22322 - DNA, 36 bp, Artificial Sequence
  Synthetic oligonucleotide
ttcgcccacaaagcacattgtgctctcacctgccca

SEQ ID NO: 22323 - DNA, 35 bp, Artificial Sequence
  Synthetic oligonucleotide
agtctggacgccttgcccgttcccatctgccctca

SEQ ID NO: 22324 - DNA, 37 bp, Artificial Sequence
  Synthetic oligonucleotide
actccaccgtgaacttccccctgtatttggctaacga

SEQ ID NO: 22325 - DNA, 37 bp, Artificial Sequence
  Synthetic oligonucleotide
ggacgcactgtgtagcccttacgcttttacccaccga

SEQ ID NO: 22326 - DNA, 35 bp, Artificial Sequence
  Synthetic oligonucleotide
gttgcctgtgtcagatgcctactctccgcccccga

SEQ ID NO: 22327 - DNA, 35 bp, Artificial Sequence
  Synthetic oligonucleotide
gtccacactattgccttaaatgagaattcccgtga

SEQ ID NO: 22328 - DNA, 35 bp, Artificial Sequence
  Synthetic oligonucleotide
gactccccatgtgcggtatttactgtcgctttcct

SEQ ID NO: 22329 - DNA, 35 bp, Artificial Sequence
  Synthetic oligonucleotide
gtccacgtctcccacatttaagttaacgcttctct

SEQ ID NO: 22330 - DNA, 36 bp, Artificial Sequence
  Synthetic oligonucleotide
tgcatccgtcccggtttactttcatgcccactcgaa

SEQ ID NO: 22331 - DNA, 36 bp, Artificial Sequence
  Synthetic oligonucleotide
tcccaccgatgtcggttacaggctaaaccctctcca

SEQ ID NO: 22332 - DNA, 36 bp, Artificial Sequence
  Synthetic oligonucleotide
aggaccaccctcaacattcgggcacaaatacacgca

SEQ ID NO: 22333 - DNA, 37 bp, Artificial Sequence
  Synthetic oligonucleotide
aatgggtgggtaagctgtggtcggggggaaaagtgga

SEQ ID NO: 22334 - DNA, 38 bp, Artificial Sequence
  Synthetic oligonucleotide
acactccagccatctactacacatacgaaccgctctga

SEQ ID NO: 22335 - DNA, 37 bp, Artificial Sequence
  Synthetic oligonucleotide
gacacaccactcaacgcgtattgccaccttggtttga

SEQ ID NO: 22336 - DNA, 35 bp, Artificial Sequence
  Synthetic oligonucleotide
gccacgaccgcacacgctaacgaacagctcttata

SEQ ID NO: 22337 - DNA, 35 bp, Artificial Sequence
  Synthetic oligonucleotide
acatccaccgccttgagcttatcctccgcctgtta

SEQ ID NO: 22338 - DNA, 35 bp, Artificial Sequence
  Synthetic oligonucleotide
acacgggtctcggggggtcccgtggtttcatttac

SEQ ID NO: 22339 - DNA, 35 bp, Artificial Sequence
  Synthetic oligonucleotide
tctacctactcactcagttgtcttctctagcactg

SEQ ID NO: 22340 - DNA, 35 bp, Artificial Sequence
  Synthetic oligonucleotide
ttatcccccctgattactcaggacacagtgaatct

SEQ ID NO: 22341 - DNA, 36 bp, Artificial Sequence
  Synthetic oligonucleotide
accgtgatcgccctgtctcctctggcacaatgcaaa

SEQ ID NO: 22342 - DNA, 35 bp, Artificial Sequence
  Synthetic oligonucleotide
tactgtccaccgcccaaatcgagtattattgtaca

SEQ ID NO: 22343 - DNA, 38 bp, Artificial Sequence
  Synthetic oligonucleotide
gtaccccgcatcccaacatcgtactacgacctgcttga

SEQ ID NO: 22344 - DNA, 35 bp, Artificial Sequence
  Synthetic oligonucleotide
gtcttgtcgagtgcatctcgccttaaccctactgc

SEQ ID NO: 22345 - DNA, 35 bp, Artificial Sequence
  Synthetic oligonucleotide
tctcgcccacagtggctatcagtaccatcatttgc

SEQ ID NO: 22346 - DNA, 35 bp, Artificial Sequence
  Synthetic oligonucleotide
aacatcgcgcgaactcgttatgaacccctgttatc

SEQ ID NO: 22347 - DNA, 35 bp, Artificial Sequence
  Synthetic oligonucleotide
gctaacgtggcctccatggaatctatctcacactc

SEQ ID NO: 22348 - DNA, 35 bp, Artificial Sequence
  Synthetic oligonucleotide
tcagccgagttttctcgtgccatttgcacaccttc

SEQ ID NO: 22349 - DNA, 35 bp, Artificial Sequence
  Synthetic oligonucleotide
aaacacatccgcaggaaacgccacccatctccgcg

SEQ ID NO: 22350 - DNA, 36 bp, Artificial Sequence
  Synthetic oligonucleotide
ttgtgtgcgatacactgcgcgtatggtcattcccca

SEQ ID NO: 22351 - DNA, 35 bp, Artificial Sequence
  Synthetic oligonucleotide
tacgtgcgatctcttcttgcgcgtaaccatactac

SEQ ID NO: 22352 - DNA, 35 bp, Artificial Sequence
  Synthetic oligonucleotide
gtgtcaccgaacgggttccgcgctctttcatacgc

SEQ ID NO: 22353 - DNA, 35 bp, Artificial Sequence
  Synthetic oligonucleotide
atcgcttcctcccacctgcttctgtttcggctatc

SEQ ID NO: 22354 - DNA, 35 bp, Artificial Sequence
  Synthetic oligonucleotide
agcgcacgcacccttcgctccgtatatgcttagtc

SEQ ID NO: 22355 - DNA, 35 bp, Artificial Sequence
  Synthetic oligonucleotide
ggagcgggggggtggggagggagcaatatcgtacg

SEQ ID NO: 22356 - DNA, 35 bp, Artificial Sequence
  Synthetic oligonucleotide
gaagggatggaggttacaagggaggaacgggcgct

SEQ ID NO: 22357 - DNA, 35 bp, Artificial Sequence
  Synthetic oligonucleotide
tattatgccatcctgtttgttgccatctgtcttgt

SEQ ID NO: 22358 - DNA, 36 bp, Artificial Sequence
  Synthetic oligonucleotide
tgatccccaggtcgtcacctctggcccgtgcccaaa

SEQ ID NO: 22359 - DNA, 36 bp, Artificial Sequence
  Synthetic oligonucleotide
aacgtccggcgtgaagtcattggccgctcctcctaa

SEQ ID NO: 22360 - DNA, 36 bp, Artificial Sequence
  Synthetic oligonucleotide
gcaaccgctccccacacattgtcgctatctgtcaca

SEQ ID NO: 22361 - DNA, 35 bp, Artificial Sequence
  Synthetic oligonucleotide
gttgccccgatcctgtaacttactcggtttcacca

SEQ ID NO: 22362 - DNA, 37 bp, Artificial Sequence
  Synthetic oligonucleotide
tgacccacacgctgctcaacgagcatcctttatccga

SEQ ID NO: 22363 - DNA, 36 bp, Artificial Sequence
  Synthetic oligonucleotide
gacgcaaaggcgacttcaaagtgagggttgatggga

SEQ ID NO: 22364 - DNA, 38 bp, Artificial Sequence
  Synthetic oligonucleotide
gaagagagaggaggtgcgtaggttcaggccataggtga

SEQ ID NO: 22365 - DNA, 35 bp, Artificial Sequence
  Synthetic oligonucleotide
taagtgcgtgatccaatgtgcccactcgccccacc

SEQ ID NO: 22366 - DNA, 35 bp, Artificial Sequence
  Synthetic oligonucleotide
atctgtccccagccttttaacatctggccgaaagc

SEQ ID NO: 22367 - DNA, 35 bp, Artificial Sequence
  Synthetic oligonucleotide
actcgatcgagcacctcaccatttgcatacttcgc

SEQ ID NO: 22368 - DNA, 35 bp, Artificial Sequence
  Synthetic oligonucleotide
gggaccgtccccgtcacacttttagccgtattctc

SEQ ID NO: 22369 - DNA, 35 bp, Artificial Sequence
  Synthetic oligonucleotide
gcacggatacgtttcgcgccacatgtcacccttcg

SEQ ID NO: 22370 - DNA, 36 bp, Artificial Sequence
  Synthetic oligonucleotide
accaggggggagggagtgggactatggtgtgatcca

SEQ ID NO: 22371 - DNA, 36 bp, Artificial Sequence
  Synthetic oligonucleotide
gtcatccacccacgtaaagcattatacaggcctgca

SEQ ID NO: 22372 - DNA, 36 bp, Artificial Sequence
  Synthetic oligonucleotide
ttcagcaaccattccgactcctgttttaggccccga

SEQ ID NO: 22373 - DNA, 35 bp, Artificial Sequence
  Synthetic oligonucleotide
acactgcgcatcgcgatcgcaccatccgtactata

SEQ ID NO: 22374 - DNA, 35 bp, Artificial Sequence
  Synthetic oligonucleotide
tttgaccctgtagagcgcatattagaccccccgcc

SEQ ID NO: 22375 - DNA, 35 bp, Artificial Sequence
  Synthetic oligonucleotide
tcgcgatagcgcggtctctatacccacctcattcg

SEQ ID NO: 22376 - DNA, 35 bp, Artificial Sequence
  Synthetic oligonucleotide
gttaggccccatactgtacctatacgtgtgtctct

SEQ ID NO: 22377 - DNA, 35 bp, Artificial Sequence
  Synthetic oligonucleotide
gagccgatccgcttttttgacaaactcgacgcatt

SEQ ID NO: 22378 - DNA, 35 bp, Artificial Sequence
  Synthetic oligonucleotide
gagagagaggggggtggacaagggagtggtttctt

SEQ ID NO: 22379 - DNA, 36 bp, Artificial Sequence
  Synthetic oligonucleotide
gaggtgaagaagggggagggagggcttacagaagca

SEQ ID NO: 22380 - DNA, 36 bp, Artificial Sequence
  Synthetic oligonucleotide
ttagtaccatacctgctgtgccctcctccgtgctca

SEQ ID NO: 22381 - DNA, 37 bp, Artificial Sequence
  Synthetic oligonucleotide
aaagtaaggcgtggtggaaggaggaaaagggcatcga

SEQ ID NO: 22382 - DNA, 37 bp, Artificial Sequence
  Synthetic oligonucleotide
tcaccctgtcacgagccatctcgtcccagttatttga

SEQ ID NO: 22383 - DNA, 35 bp, Artificial Sequence
  Synthetic oligonucleotide
agcctaccaccctctattgtaactgcctccggata

SEQ ID NO: 22384 - DNA, 36 bp, Artificial Sequence
  Synthetic oligonucleotide
gcaccagcccccagccgctacttgttatttaccgta

SEQ ID NO: 22385 - DNA, 35 bp, Artificial Sequence
  Synthetic oligonucleotide
tatgggagtcaggttcgagggggagggtgaagcag

SEQ ID NO: 22386 - DNA, 35 bp, Artificial Sequence
  Synthetic oligonucleotide
gcaaaccaaccctgctttctttattctgctccccg

SEQ ID NO: 22387 - DNA, 35 bp, Artificial Sequence
  Synthetic oligonucleotide
gaccccgcattactgctcctcgtcctaagtaggaa

SEQ ID NO: 22388 - DNA, 36 bp, Artificial Sequence
  Synthetic oligonucleotide
gcccccttcgaactagacatcagtctactccgctaa

SEQ ID NO: 22389 - DNA, 36 bp, Artificial Sequence
  Synthetic oligonucleotide
acccccgtgtcgttcaaccccacgccgccctcacca

SEQ ID NO: 22390 - DNA, 35 bp, Artificial Sequence
  Synthetic oligonucleotide
ggtgacgacatcaacacctgccctgttcttaatca

SEQ ID NO: 22391 - DNA, 38 bp, Artificial Sequence
  Synthetic oligonucleotide
gtgctacccgacattgaacttttgctccacccacgtga

SEQ ID NO: 22392 - DNA, 38 bp, Artificial Sequence
  Synthetic oligonucleotide
actctgggtgcgttcggggaaagaaaggggacgggtga

SEQ ID NO: 22393 - DNA, 36 bp, Artificial Sequence
  Synthetic oligonucleotide
gcatgcgaaaggatcgcgcgtacttcttccctgtga

SEQ ID NO: 22394 - DNA, 35 bp, Artificial Sequence
  Synthetic oligonucleotide
tgcaaaccgaaacacatgcgagcacctaaacacac

SEQ ID NO: 22395 - DNA, 35 bp, Artificial Sequence
  Synthetic oligonucleotide
gaacgctactactatcgccctgccccgcgcgccac

SEQ ID NO: 22396 - DNA, 35 bp, Artificial Sequence
  Synthetic oligonucleotide
gtagccactgaatacgtattttccttgcctactac

SEQ ID NO: 22397 - DNA, 35 bp, Artificial Sequence
  Synthetic oligonucleotide
ttccacctcaaccatgtatttgcgttcccatgttg

SEQ ID NO: 22398 - DNA, 35 bp, Artificial Sequence
  Synthetic oligonucleotide
ttgtacaggctcccccccgcccggatacaggtaat

SEQ ID NO: 22399 - DNA, 35 bp, Artificial Sequence
  Synthetic oligonucleotide
gactcgccactatactaccccgagctgtacataca

SEQ ID NO: 22400 - DNA, 36 bp, Artificial Sequence
  Synthetic oligonucleotide
gccatgctccggtagcacagcgtacgctcatctcca

SEQ ID NO: 22401 - DNA, 35 bp, Artificial Sequence
  Synthetic oligonucleotide
taactcactgtctggtttgctgttcccgtgtcgca

SEQ ID NO: 22402 - DNA, 35 bp, Artificial Sequence
  Synthetic oligonucleotide
accctgcgtggctcgtttttgcacccgtaatgtca

SEQ ID NO: 22403 - DNA, 37 bp, Artificial Sequence
  Synthetic oligonucleotide
taacgacatgggcgggcaagaaaaaagagaggaggga

SEQ ID NO: 22404 - DNA, 37 bp, Artificial Sequence
  Synthetic oligonucleotide
gacaggagacacgtgctgcatctctgttccatatgga

SEQ ID NO: 22405 - DNA, 38 bp, Artificial Sequence
  Synthetic oligonucleotide
attccaccctccatgagtaaactgttttctcgcactga

SEQ ID NO: 22406 - DNA, 38 bp, Artificial Sequence
  Synthetic oligonucleotide
gtgagcatgaccgcacatcgttacatctatccctttga

SEQ ID NO: 22407 - DNA, 36 bp, Artificial Sequence
  Synthetic oligonucleotide
ggtggctcatgaagctccacgcacgcacacctcata

SEQ ID NO: 22408 - DNA, 36 bp, Artificial Sequence
  Synthetic oligonucleotide
gctctgtccgtcgagtgccatctgaaccctccacta

SEQ ID NO: 22409 - DNA, 35 bp, Artificial Sequence
  Synthetic oligonucleotide
tatttcacgcctccttgtctctttgcggaccctta

SEQ ID NO: 22410 - DNA, 35 bp, Artificial Sequence
  Synthetic oligonucleotide
tcatacgtcctgcgcgcgttccttgttgtttctcc

SEQ ID NO: 22411 - DNA, 35 bp, Artificial Sequence
  Synthetic oligonucleotide
tttcccctcccatgtttacagccactggcctggat

SEQ ID NO: 22412 - DNA, 35 bp, Artificial Sequence
  Synthetic oligonucleotide
gcaccacacgactttaatcaatttttgcccctggt

SEQ ID NO: 22413 - DNA, 35 bp, Artificial Sequence
  Synthetic oligonucleotide
gacactcaggtctcgtccccgggccttcacctgtt

SEQ ID NO: 22414 - DNA, 36 bp, Artificial Sequence
  Synthetic oligonucleotide
atgctatccactcgggccgcactacgccggttacca

SEQ ID NO: 22415 - DNA, 37 bp, Artificial Sequence
  Synthetic oligonucleotide
gacacctctcccccatccgacgtggcagctcgcttca

SEQ ID NO: 22416 - DNA, 35 bp, Artificial Sequence
  Synthetic oligonucleotide
tcaccccgaggaccttcgcagcccgcctactggga

SEQ ID NO: 22417 - DNA, 38 bp, Artificial Sequence
  Synthetic oligonucleotide
tgcacagtccgcacccacgaggcgcctctcatacctga

SEQ ID NO: 22418 - DNA, 35 bp, Artificial Sequence
  Synthetic oligonucleotide
acacatccgcccacccggatgaagtggtgaacacc

SEQ ID NO: 22419 - DNA, 35 bp, Artificial Sequence
  Synthetic oligonucleotide
gaacatccgccaagctcggcttccgcgcccttccc

SEQ ID NO: 22420 - DNA, 35 bp, Artificial Sequence
  Synthetic oligonucleotide
agcaaacccgaatctgttttattccgccgctccgc

SEQ ID NO: 22421 - DNA, 35 bp, Artificial Sequence
  Synthetic oligonucleotide
ggagcccgtcccctctactgtacgaccctatgcgc

SEQ ID NO: 22422 - DNA, 35 bp, Artificial Sequence
  Synthetic oligonucleotide
tgagacacggaaggagtaggcaggaacttaagagg

SEQ ID NO: 22423 - DNA, 35 bp, Artificial Sequence
  Synthetic oligonucleotide
acaccccagccgtcgtgcaatgcagtgccattctt

SEQ ID NO: 22424 - DNA, 35 bp, Artificial Sequence
  Synthetic oligonucleotide
acacaccgttatctccgaacgacggacacatccca

SEQ ID NO: 22425 - DNA, 36 bp, Artificial Sequence
  Synthetic oligonucleotide
acgatccgccttgttactttcactttgcccgctgga

SEQ ID NO: 22426 - DNA, 38 bp, Artificial Sequence
  Synthetic oligonucleotide
ggacgggagggaaagttgcagttgagggggcagagtga

SEQ ID NO: 22427 - DNA, 35 bp, Artificial Sequence
  Synthetic oligonucleotide
tcgagtgcgccctcatgtactatctttgggcagtc

SEQ ID NO: 22428 - DNA, 36 bp, Artificial Sequence
  Synthetic oligonucleotide
aatcaaccccgtttacatcacctcaactgcctccga

SEQ ID NO: 22429 - DNA, 37 bp, Artificial Sequence
  Synthetic oligonucleotide
gatgaggagaggcctgaaagggacggtatgtttggga

SEQ ID NO: 22430 - DNA, 37 bp, Artificial Sequence
  Synthetic oligonucleotide
tcacgatgttgctgttgcgcgctcttatccctactga

SEQ ID NO: 22431 - DNA, 36 bp, Artificial Sequence
  Synthetic oligonucleotide
gacccacggaagtttaatattccgtccttccctcta

SEQ ID NO: 22432 - DNA, 35 bp, Artificial Sequence
  Synthetic oligonucleotide
acagtaccttaagccgcactgccccgactacgacc

SEQ ID NO: 22433 - DNA, 35 bp, Artificial Sequence
  Synthetic oligonucleotide
tatccgccgtaccagtgctcgcctcacttggtccc

SEQ ID NO: 22434 - DNA, 35 bp, Artificial Sequence
  Synthetic oligonucleotide
gtccaccactaagctccgctgaaaagccacatgcc

SEQ ID NO: 22435 - DNA, 35 bp, Artificial Sequence
  Synthetic oligonucleotide
gcgaagcccttactacttggttcacccttgtcatc

SEQ ID NO: 22436 - DNA, 35 bp, Artificial Sequence
  Synthetic oligonucleotide
tccgccaactaggctctcgtggacggccatccctc

SEQ ID NO: 22437 - DNA, 35 bp, Artificial Sequence
  Synthetic oligonucleotide
gttgacgctccgcattgcctcctgtaaaactcccg

SEQ ID NO: 22438 - DNA, 35 bp, Artificial Sequence
  Synthetic oligonucleotide
agctgaagcctcgctccgtaacccgataccatgct

SEQ ID NO: 22439 - DNA, 35 bp, Artificial Sequence
  Synthetic oligonucleotide
atcgtcgtaggtcaagttttgctcccatccgatct

SEQ ID NO: 22440 - DNA, 35 bp, Artificial Sequence
  Synthetic oligonucleotide
ccatcactcgccactttgtctagcttgctccggtt

SEQ ID NO: 22441 - DNA, 36 bp, Artificial Sequence
  Synthetic oligonucleotide
tgctcgcctcccgcggtctgtccacattctgtagca

SEQ ID NO: 22442 - DNA, 36 bp, Artificial Sequence
  Synthetic oligonucleotide
acacgactaacagtcgcttcatgatccccgccttca

SEQ ID NO: 22443 - DNA, 37 bp, Artificial Sequence
  Synthetic oligonucleotide
tcttgttgccccgccacatttgtgacaaccataccga

SEQ ID NO: 22444 - DNA, 38 bp, Artificial Sequence
  Synthetic oligonucleotide
accaccgtatcaacggtactctgttactctcctactga

SEQ ID NO: 22445 - DNA, 35 bp, Artificial Sequence
  Synthetic oligonucleotide
gtgcggaccgcgctcgctttacccactgaacatcc

SEQ ID NO: 22446 - DNA, 35 bp, Artificial Sequence
  Synthetic oligonucleotide
gaacaaacggcaaagggtaccgctctccaccttcg

SEQ ID NO: 22447 - DNA, 35 bp, Artificial Sequence
  Synthetic oligonucleotide
gtggacgacgggttgggaggatgaaccaggggggg

SEQ ID NO: 22448 - DNA, 35 bp, Artificial Sequence
  Synthetic oligonucleotide
gtttgcgtccgtctgttctttccttcatcaatcct

SEQ ID NO: 22449 - DNA, 35 bp, Artificial Sequence
  Synthetic oligonucleotide
gtcctagcccctatcacatatatgttcactgattt

SEQ ID NO: 22450 - DNA, 36 bp, Artificial Sequence
  Synthetic oligonucleotide
ggaacggaggcggggtggccaggtaagggaagaaaa

SEQ ID NO: 22451 - DNA, 36 bp, Artificial Sequence
  Synthetic oligonucleotide
aaagcgcccccgcctcccacaccacagggcatgcca

SEQ ID NO: 22452 - DNA, 37 bp, Artificial Sequence
  Synthetic oligonucleotide
gtcactccctttgtctttcttacagtttttctttcga

SEQ ID NO: 22453 - DNA, 38 bp, Artificial Sequence
  Synthetic oligonucleotide
gaagacgctgggggggctagcagggcgggagtcattga

SEQ ID NO: 22454 - DNA, 35 bp, Artificial Sequence
  Synthetic oligonucleotide
gtaggacccccccgtgaccccatgccgtttcccta

SEQ ID NO: 22455 - DNA, 35 bp, Artificial Sequence
  Synthetic oligonucleotide
atatcctcgctaccacctggaactcaatggacacc

SEQ ID NO: 22456 - DNA, 35 bp, Artificial Sequence
  Synthetic oligonucleotide
gtccgacatagcaaatgcgcctctcacctgggatc

SEQ ID NO: 22457 - DNA, 35 bp, Artificial Sequence
  Synthetic oligonucleotide
acccatgtacgtggttatgtggtgtctcaactctc

SEQ ID NO: 22458 - DNA, 35 bp, Artificial Sequence
  Synthetic oligonucleotide
atcatgatcgccccctttcttgcatgcactttgcg

SEQ ID NO: 22459 - DNA, 34 bp, Artificial Sequence
  Synthetic oligonucleotide
ttctattcccgccctcccgccgtttccaacggct

SEQ ID NO: 22460 - DNA, 35 bp, Artificial Sequence
  Synthetic oligonucleotide
tgaatgcccctccgttgtagggctacacacttaca

SEQ ID NO: 22461 - DNA, 36 bp, Artificial Sequence
  Synthetic oligonucleotide
tactgccgtaacagcttcttgcatctccgtccatca

SEQ ID NO: 22462 - DNA, 35 bp, Artificial Sequence
  Synthetic oligonucleotide
acgcgactgtttacccgccctccccttacggatca

SEQ ID NO: 22463 - DNA, 36 bp, Artificial Sequence
  Synthetic oligonucleotide
gtgtcaccactgtcattccggccttcaacttcttga

SEQ ID NO: 22464 - DNA, 36 bp, Artificial Sequence
  Synthetic oligonucleotide
gcccagtgcgccaactgtcactttcaattatagcta

SEQ ID NO: 22465 - DNA, 35 bp, Artificial Sequence
  Synthetic oligonucleotide
tagggacgcatggcggtcacaatatccactcaacc

SEQ ID NO: 22466 - DNA, 35 bp, Artificial Sequence
  Synthetic oligonucleotide
ttccgtcccatattaggtgcttatgtcccttcctc

SEQ ID NO: 22467 - DNA, 35 bp, Artificial Sequence
  Synthetic oligonucleotide
atccccagtccgctgatattctctagctcagtctc

SEQ ID NO: 22468 - DNA, 35 bp, Artificial Sequence
  Synthetic oligonucleotide
gtcaccttgtctgagtatcttccattccttcgcag

SEQ ID NO: 22469 - DNA, 35 bp, Artificial Sequence
  Synthetic oligonucleotide
tgcaagcaataggttccatcccccttactctcctg

SEQ ID NO: 22470 - DNA, 35 bp, Artificial Sequence
  Synthetic oligonucleotide
acatacaggcagtttggaggaaaggtggtggtgtg

SEQ ID NO: 22471 - DNA, 35 bp, Artificial Sequence
  Synthetic oligonucleotide
tcctggcatacgcagaccccctttgactgcccact

SEQ ID NO: 22472 - DNA, 35 bp, Artificial Sequence
  Synthetic oligonucleotide
gcaccagtgcctctaccccattggttttttcccct

SEQ ID NO: 22473 - DNA, 35 bp, Artificial Sequence
  Synthetic oligonucleotide
gatgtcagctacgtaggctatccccaactcacctt

SEQ ID NO: 22474 - DNA, 36 bp, Artificial Sequence
  Synthetic oligonucleotide
gatgatcacgcccgccttgaagtaccgatatacaaa

SEQ ID NO: 22475 - DNA, 36 bp, Artificial Sequence
  Synthetic oligonucleotide
gccacctcagcccgtaacatccttatggcactagca

SEQ ID NO: 22476 - DNA, 37 bp, Artificial Sequence
  Synthetic oligonucleotide
tcacatcccgcccgtgactcccatatggtccttgcga

SEQ ID NO: 22477 - DNA, 37 bp, Artificial Sequence
  Synthetic oligonucleotide
gtgggatagcagagggatgggaggccggatggaggga

SEQ ID NO: 22478 - DNA, 38 bp, Artificial Sequence
  Synthetic oligonucleotide
actgctaccattgtgctgctatagctctccttacctga

SEQ ID NO: 22479 - DNA, 37 bp, Artificial Sequence
  Synthetic oligonucleotide
ttcaccgtcatccttacctccaccctacttgccgtga

SEQ ID NO: 22480 - DNA, 38 bp, Artificial Sequence
  Synthetic oligonucleotide
ggacaaccacccacttcattagatcgggctcttcgtga

SEQ ID NO: 22481 - DNA, 35 bp, Artificial Sequence
  Synthetic oligonucleotide
gtcaaggcttacctgcccactagatacctcaactg

SEQ ID NO: 22482 - DNA, 35 bp, Artificial Sequence
  Synthetic oligonucleotide
tccgttcctcccatcgtgtcttgatcctcgagaat

SEQ ID NO: 22483 - DNA, 36 bp, Artificial Sequence
  Synthetic oligonucleotide
gcacactacggttccgtctgaactccttgcttacca

SEQ ID NO: 22484 - DNA, 37 bp, Artificial Sequence
  Synthetic oligonucleotide
ttcccatcaccatgctacctgcgtacacactctccga

SEQ ID NO: 22485 - DNA, 37 bp, Artificial Sequence
  Synthetic oligonucleotide
ttgggggtgggacaacaaagggggacgacgtgatcga

SEQ ID NO: 22486 - DNA, 37 bp, Artificial Sequence
  Synthetic oligonucleotide
tcccctcgctctcagcactcgttgatctttacccgga

SEQ ID NO: 22487 - DNA, 36 bp, Artificial Sequence
  Synthetic oligonucleotide
aacgatccgtgtcgttactgtttcctccctctctga

SEQ ID NO: 22488 - DNA, 37 bp, Artificial Sequence
  Synthetic oligonucleotide
ttcgaaccaccacacttcatcacgcttagcccggtga

SEQ ID NO: 22489 - DNA, 38 bp, Artificial Sequence
  Synthetic oligonucleotide
gacacgtacatgctgttcccccatctgcgttttattga

SEQ ID NO: 22490 - DNA, 35 bp, Artificial Sequence
  Synthetic oligonucleotide
gtcgtgcccgacttttccgtttcctcgctggtaca

SEQ ID NO: 22491 - DNA, 36 bp, Artificial Sequence
  Synthetic oligonucleotide
aggagacgcaccagttatttcacggtcaccacccca

SEQ ID NO: 22492 - DNA, 36 bp, Artificial Sequence
  Synthetic oligonucleotide
tcaggtcgggcgcacaacactcttgcccataattca

SEQ ID NO: 22493 - DNA, 35 bp, Artificial Sequence
  Synthetic oligonucleotide
gacgggtggggtcgcaatgacgttgggaagggtga

SEQ ID NO: 22494 - DNA, 38 bp, Artificial Sequence
  Synthetic oligonucleotide
gatccccacctcggacgttaaacactgtttacatttga

SEQ ID NO: 22495 - DNA, 35 bp, Artificial Sequence
  Synthetic oligonucleotide
accagctcctcgttcccgcgccctaatgcaggtta

SEQ ID NO: 22496 - DNA, 36 bp, Artificial Sequence
  Synthetic oligonucleotide
tgcagacccatctccttaggtcctctgacgacgacc

SEQ ID NO: 22497 - DNA, 35 bp, Artificial Sequence
  Synthetic oligonucleotide
gtttggctcagaacggctctcgatacccaatttcc

SEQ ID NO: 22498 - DNA, 35 bp, Artificial Sequence
  Synthetic oligonucleotide
actaccgcacatggcctctaaaatgctgggaactc

SEQ ID NO: 22499 - DNA, 35 bp, Artificial Sequence
  Synthetic oligonucleotide
attaccaccggggcccgctacatgctttacacaag

SEQ ID NO: 22500 - DNA, 35 bp, Artificial Sequence
  Synthetic oligonucleotide
acgaagcgcacaccatgctctttttggatttaccg

SEQ ID NO: 22501 - DNA, 35 bp, Artificial Sequence
  Synthetic oligonucleotide
ctgaccccggctcgatttcctgtcccgacggtttg

SEQ ID NO: 22502 - DNA, 35 bp, Artificial Sequence
  Synthetic oligonucleotide
ttgcccccatctgccgttgtacctgtcccacctct

SEQ ID NO: 22503 - DNA, 35 bp, Artificial Sequence
  Synthetic oligonucleotide
atcgtcaacgcttcgtttttcgatcctttccctca

SEQ ID NO: 22504 - DNA, 38 bp, Artificial Sequence
  Synthetic oligonucleotide
gtccaccagtccgactttctctccgatgccacccctga

SEQ ID NO: 22505 - DNA, 36 bp, Artificial Sequence
  Synthetic oligonucleotide
tcaccccctacagtgctcattcctgcatttaattta

SEQ ID NO: 22506 - DNA, 35 bp, Artificial Sequence
  Synthetic oligonucleotide
ttgctctgcccacggtcaccaacaacgaccacgcc

SEQ ID NO: 22507 - DNA, 35 bp, Artificial Sequence
  Synthetic oligonucleotide
agctccatcgggcatcatacgcactagcactatct

SEQ ID NO: 22508 - DNA, 34 bp, Artificial Sequence
  Synthetic oligonucleotide
tctgaccccatttcacttgccgatacctgcgtaa

SEQ ID NO: 22509 - DNA, 35 bp, Artificial Sequence
  Synthetic oligonucleotide
agtgtgcgtactgtggggggggcggggagggttaa

SEQ ID NO: 22510 - DNA, 37 bp, Artificial Sequence
  Synthetic oligonucleotide
acacctacgccattggcttttcttttctccagtagga

SEQ ID NO: 22511 - DNA, 37 bp, Artificial Sequence
  Synthetic oligonucleotide
accacacggagaggaaatgacggggtacaggttagga

SEQ ID NO: 22512 - DNA, 38 bp, Artificial Sequence
  Synthetic oligonucleotide
attagggggtggaacgggaaggggtaaagggtaactga

SEQ ID NO: 22513 - DNA, 35 bp, Artificial Sequence
  Synthetic oligonucleotide
attgctctgtagcgtgaagtccattgctcaccacc

SEQ ID NO: 22514 - DNA, 35 bp, Artificial Sequence
  Synthetic oligonucleotide
gccgcacgttgttacgtgcatcatcctctgggcct

SEQ ID NO: 22515 - DNA, 35 bp, Artificial Sequence
  Synthetic oligonucleotide
gattgagctcggggggctggggaaaggaacggcaa

SEQ ID NO: 22516 - DNA, 36 bp, Artificial Sequence
  Synthetic oligonucleotide
ttgatccagcgccactaccctccccatcttaggtaa

SEQ ID NO: 22517 - DNA, 36 bp, Artificial Sequence
  Synthetic oligonucleotide
gtaccgacgatgaagtctaggcatttccaccaccca

SEQ ID NO: 22518 - DNA, 36 bp, Artificial Sequence
  Synthetic oligonucleotide
aacgccggttacggggtaatttgttatctgttttca

SEQ ID NO: 22519 - DNA, 37 bp, Artificial Sequence
  Synthetic oligonucleotide
gagtggagtagttgggtggaggtggggcccatagcga

SEQ ID NO: 22520 - DNA, 37 bp, Artificial Sequence
  Synthetic oligonucleotide
gacgtggggagagggcgggtagggcttatagtgggga

SEQ ID NO: 22521 - DNA, 38 bp, Artificial Sequence
  Synthetic oligonucleotide
tccgatccccgccccgttcagacagacgctgcccatga

SEQ ID NO: 22522 - DNA, 38 bp, Artificial Sequence
  Synthetic oligonucleotide
tgaggggagggcgggtcctggggtacaggactccgtga

SEQ ID NO: 22523 - DNA, 38 bp, Artificial Sequence
  Synthetic oligonucleotide
gataagtggggggtggtgttggcaggggccgtcggtga

SEQ ID NO: 22524 - DNA, 35 bp, Artificial Sequence
  Synthetic oligonucleotide
tcaccaacacccatgactccctgtggtctgttcta

SEQ ID NO: 22525 - DNA, 36 bp, Artificial Sequence
  Synthetic oligonucleotide
gccaacggccatgatccacttcgacctttccctgta

SEQ ID NO: 22526 - DNA, 35 bp, Artificial Sequence
  Synthetic oligonucleotide
tactaccggacgggcaattagcctggactatatcc

SEQ ID NO: 22527 - DNA, 35 bp, Artificial Sequence
  Synthetic oligonucleotide
gccaggtgtaactgtcatcgtctcctccgccgctc

SEQ ID NO: 22528 - DNA, 35 bp, Artificial Sequence
  Synthetic oligonucleotide
gacgcgggaccgggccgtgtttccctctcctcttc

SEQ ID NO: 22529 - DNA, 35 bp, Artificial Sequence
  Synthetic oligonucleotide
gcagtttactcacccgccacgccaccctcattttc

SEQ ID NO: 22530 - DNA, 35 bp, Artificial Sequence
  Synthetic oligonucleotide
atacccgcattccacttcggagagagccatcttcg

SEQ ID NO: 22531 - DNA, 35 bp, Artificial Sequence
  Synthetic oligonucleotide
tgcctggtagccttgtcctctgtttccctccttgg

SEQ ID NO: 22532 - DNA, 35 bp, Artificial Sequence
  Synthetic oligonucleotide
gttactgctccatttggtcatctattgccatgcct

SEQ ID NO: 22533 - DNA, 35 bp, Artificial Sequence
  Synthetic oligonucleotide
gttagtatggtgggcatgaggaggtggaggaaggt

SEQ ID NO: 22534 - DNA, 35 bp, Artificial Sequence
  Synthetic oligonucleotide
gacgctctcgcctccgcactgacgagtgctacttt

SEQ ID NO: 22535 - DNA, 36 bp, Artificial Sequence
  Synthetic oligonucleotide
atctgctacgcagcatcactccacacctgccttgca

SEQ ID NO: 22536 - DNA, 38 bp, Artificial Sequence
  Synthetic oligonucleotide
acgtacgcaagatcagcggaccacactccccactctga

SEQ ID NO: 22537 - DNA, 35 bp, Artificial Sequence
  Synthetic oligonucleotide
gcccagggccggcacattccatcgtcattccgcac

SEQ ID NO: 22538 - DNA, 35 bp, Artificial Sequence
  Synthetic oligonucleotide
gctgtcctctcaggctccactccttatcacatgcc

SEQ ID NO: 22539 - DNA, 35 bp, Artificial Sequence
  Synthetic oligonucleotide
atgtcgccgggcatgcgtaccgctccaaactttgc

SEQ ID NO: 22540 - DNA, 35 bp, Artificial Sequence
  Synthetic oligonucleotide
atgtccctggcatcccgccctcaatgcataacatc

SEQ ID NO: 22541 - DNA, 35 bp, Artificial Sequence
  Synthetic oligonucleotide
tccagactgcgttggttctagttcacccgttcgtc

SEQ ID NO: 22542 - DNA, 35 bp, Artificial Sequence
  Synthetic oligonucleotide
ccctacacaccgcacatttaggttacaccttgttc

SEQ ID NO: 22543 - DNA, 36 bp, Artificial Sequence
  Synthetic oligonucleotide
acgaccctgctcccccttacaccgtcagcacgccaa

SEQ ID NO: 22544 - DNA, 36 bp, Artificial Sequence
  Synthetic oligonucleotide
gtgaccgagtcggcctttcttgcctgttacgaccca

SEQ ID NO: 22545 - DNA, 35 bp, Artificial Sequence
  Synthetic oligonucleotide
cacgattgtcctggtacccggccgcaccccatcca

SEQ ID NO: 22546 - DNA, 36 bp, Artificial Sequence
  Synthetic oligonucleotide
gccactgacgtccgcgtcttcatggctcgatttcca

SEQ ID NO: 22547 - DNA, 37 bp, Artificial Sequence
  Synthetic oligonucleotide
accaaacagcatggtccacgcccgactccccctgcga

SEQ ID NO: 22548 - DNA, 37 bp, Artificial Sequence
  Synthetic oligonucleotide
aagacagaaggcggaaatatgaaagtgaggggatgga

SEQ ID NO: 22549 - DNA, 37 bp, Artificial Sequence
  Synthetic oligonucleotide
ttggcgccacctatgcccttaccgtgatgcccattga

SEQ ID NO: 22550 - DNA, 35 bp, Artificial Sequence
  Synthetic oligonucleotide
tcaactcttcacctgcgccccacgtcttttgcatc

SEQ ID NO: 22551 - DNA, 35 bp, Artificial Sequence
  Synthetic oligonucleotide
gtgtgttgtccgttatcttctttttgtaccgcccg

SEQ ID NO: 22552 - DNA, 35 bp, Artificial Sequence
  Synthetic oligonucleotide
atacaccatcattgactcatggtgccttattgcct

SEQ ID NO: 22553 - DNA, 35 bp, Artificial Sequence
  Synthetic oligonucleotide
gatcatggccagcagttccttcaggtcctccgtct

SEQ ID NO: 22554 - DNA, 36 bp, Artificial Sequence
  Synthetic oligonucleotide
tacatacgcacccattgttgtaccttacattctgga

SEQ ID NO: 22555 - DNA, 38 bp, Artificial Sequence
  Synthetic oligonucleotide
acgcactatcaccatgctgatagcattcctatacctga

SEQ ID NO: 22556 - DNA, 36 bp, Artificial Sequence
  Synthetic oligonucleotide
tcatactattgcccaactgtgtgtgatacctttgta

SEQ ID NO: 22557 - DNA, 35 bp, Artificial Sequence
  Synthetic oligonucleotide
gatgtatgcttcggctctctggtctcgcactgccc

SEQ ID NO: 22558 - DNA, 35 bp, Artificial Sequence
  Synthetic oligonucleotide
aaggagggaggggagggtcagcaaggggtcaatgc

SEQ ID NO: 22559 - DNA, 35 bp, Artificial Sequence
  Synthetic oligonucleotide
tgccgtccccggtccgtttccttatgtggctctca

SEQ ID NO: 22560 - DNA, 37 bp, Artificial Sequence
  Synthetic oligonucleotide
gcgaaggggaggacggttggaaagtggtgatgcacga

SEQ ID NO: 22561 - DNA, 36 bp, Artificial Sequence
  Synthetic oligonucleotide
tcagatcaagtggaggataatggggcgaatggtgga

SEQ ID NO: 22562 - DNA, 38 bp, Artificial Sequence
  Synthetic oligonucleotide
acccgccggcccggatttgcccgcttatgcccccctga

SEQ ID NO: 22563 - DNA, 37 bp, Artificial Sequence
  Synthetic oligonucleotide
tttcgcctggccgttgagcgcgctatccctgccttga

SEQ ID NO: 22564 - DNA, 35 bp, Artificial Sequence
  Synthetic oligonucleotide
tctgctgactgccccgatcacggccatctttcacc

SEQ ID NO: 22565 - DNA, 35 bp, Artificial Sequence
  Synthetic oligonucleotide
gcaaacctactgttgggccaacagactctaactcc

SEQ ID NO: 22566 - DNA, 35 bp, Artificial Sequence
  Synthetic oligonucleotide
tcccgctccccccgtagaaagatgtaacgtctctg

SEQ ID NO: 22567 - DNA, 34 bp, Artificial Sequence
  Synthetic oligonucleotide
tcccttcactccggtgctgatataattctcgttt

SEQ ID NO: 22568 - DNA, 37 bp, Artificial Sequence
  Synthetic oligonucleotide
gatagaggggctaggggacgggattggaaagggagga

SEQ ID NO: 22569 - DNA, 38 bp, Artificial Sequence
  Synthetic oligonucleotide
accaccaactatccgcggagagcctcccttcttagtga

SEQ ID NO: 22570 - DNA, 37 bp, Artificial Sequence
  Synthetic oligonucleotide
tgcctgctcacttcgacctacctcgtcccatacttga

SEQ ID NO: 22571 - DNA, 37 bp, Artificial Sequence
  Synthetic oligonucleotide
tgagcgtgtcgcctctcaaatcctgtctggcccttga

SEQ ID NO: 22572 - DNA, 35 bp, Artificial Sequence
  Synthetic oligonucleotide
accgtcgccaccgcatcaccttacctacactgaac

SEQ ID NO: 22573 - DNA, 35 bp, Artificial Sequence
  Synthetic oligonucleotide
gtcacccacgctctcgcacaacgatccggcatacc

SEQ ID NO: 22574 - DNA, 35 bp, Artificial Sequence
  Synthetic oligonucleotide
gaacaagcttgttcgcgaccaatcacctcaccccg

SEQ ID NO: 22575 - DNA, 35 bp, Artificial Sequence
  Synthetic oligonucleotide
accctgctgttcgctcgcctaagtcaccattcgcg

SEQ ID NO: 22576 - DNA, 35 bp, Artificial Sequence
  Synthetic oligonucleotide
gagtgggtgggagcgaagggccggtcccctagggt

SEQ ID NO: 22577 - DNA, 36 bp, Artificial Sequence
  Synthetic oligonucleotide
ttatgcaagcccaccatcttatgcaccgtatactaa

SEQ ID NO: 22578 - DNA, 35 bp, Artificial Sequence
  Synthetic oligonucleotide
gacaccacgcatcgctgcttctaactctccaggga

SEQ ID NO: 22579 - DNA, 38 bp, Artificial Sequence
  Synthetic oligonucleotide
gatgccgtccgataagcacgcgcccccccgccatttga

SEQ ID NO: 22580 - DNA, 35 bp, Artificial Sequence
  Synthetic oligonucleotide
tcccacgcacacacgtgaaacactctcaacccatc

SEQ ID NO: 22581 - DNA, 35 bp, Artificial Sequence
  Synthetic oligonucleotide
actgtcacacgcttaacacgcccctgtcaactcgt

SEQ ID NO: 22582 - DNA, 35 bp, Artificial Sequence
  Synthetic oligonucleotide
tccaccccgccagtatccaatgtagcatgcatatt

SEQ ID NO: 22583 - DNA, 35 bp, Artificial Sequence
  Synthetic oligonucleotide
ttcaccgccagaccgcttcgtttgcttgtactcaa

SEQ ID NO: 22584 - DNA, 36 bp, Artificial Sequence
  Synthetic oligonucleotide
gtgtggtgaggtggtcatgcgtatgggtttcaagga

SEQ ID NO: 22585 - DNA, 37 bp, Artificial Sequence
  Synthetic oligonucleotide
gatgggtgcgggtgggcgtgcgagatacaggatggga

SEQ ID NO: 22586 - DNA, 35 bp, Artificial Sequence
  Synthetic oligonucleotide
acttgagcactagcgacgacttcattccacacacc

SEQ ID NO: 22587 - DNA, 35 bp, Artificial Sequence
  Synthetic oligonucleotide
ggtggtccatgctacccccccgccatttcatccct

SEQ ID NO: 22588 - DNA, 35 bp, Artificial Sequence
  Synthetic oligonucleotide
tccagttccacatctctatggagcggactccgcct

SEQ ID NO: 22589 - DNA, 35 bp, Artificial Sequence
  Synthetic oligonucleotide
tccgctcccttagattctcttgctcggtacccgct

SEQ ID NO: 22590 - DNA, 35 bp, Artificial Sequence
  Synthetic oligonucleotide
acatacgctgggtcctctctctcacttgctcttgt

SEQ ID NO: 22591 - DNA, 36 bp, Artificial Sequence
  Synthetic oligonucleotide
acatcccacctatcatctccagtgggttcgcaacca

SEQ ID NO: 22592 - DNA, 36 bp, Artificial Sequence
  Synthetic oligonucleotide
tgacctcatccactgcctcctgggcccttccgctca

SEQ ID NO: 22593 - DNA, 35 bp, Artificial Sequence
  Synthetic oligonucleotide
gccattccacaggcgagcgatacggctcactttca

SEQ ID NO: 22594 - DNA, 36 bp, Artificial Sequence
  Synthetic oligonucleotide
tcaaggtcccgtctgttcctattagcccctcaccga

SEQ ID NO: 22595 - DNA, 37 bp, Artificial Sequence
  Synthetic oligonucleotide
ggatagcccttgccctctgcccatcatgccattcgga

SEQ ID NO: 22596 - DNA, 37 bp, Artificial Sequence
  Synthetic oligonucleotide
atgttcgcccctgaaatgccttcgtcttccctcgtga

SEQ ID NO: 22597 - DNA, 38 bp, Artificial Sequence
  Synthetic oligonucleotide
gcaggtggagagggaattcgtgggggccaaagatgtga

SEQ ID NO: 22598 - DNA, 36 bp, Artificial Sequence
  Synthetic oligonucleotide
gacttccgccgactcctcccaggggggatcacttta

SEQ ID NO: 22599 - DNA, 35 bp, Artificial Sequence
  Synthetic oligonucleotide
tccgtgcgtctaatcctgcactctagcctcacccc

SEQ ID NO: 22600 - DNA, 35 bp, Artificial Sequence
  Synthetic oligonucleotide
gcgtccaacagcttggttcatcgttcttctccccc

SEQ ID NO: 22601 - DNA, 35 bp, Artificial Sequence
  Synthetic oligonucleotide
acccacacattgcgcctttcagcgaacctgaccgc

SEQ ID NO: 22602 - DNA, 36 bp, Artificial Sequence
  Synthetic oligonucleotide
gtctgacccgcatcatcctcaactaataggtgccca

SEQ ID NO: 22603 - DNA, 38 bp, Artificial Sequence
  Synthetic oligonucleotide
ccatccgcgctgcccctctcccatcctaactgccatga

SEQ ID NO: 22604 - DNA, 37 bp, Artificial Sequence
  Synthetic oligonucleotide
gaactgcccggttgcatatctaacgtttctctcatga

SEQ ID NO: 22605 - DNA, 38 bp, Artificial Sequence
  Synthetic oligonucleotide
agcactcgcacctgcgttacatctcgtcccgttagtga

SEQ ID NO: 22606 - DNA, 38 bp, Artificial Sequence
  Synthetic oligonucleotide
gcatacacggctgaactgcactgaactccttcgcttga

SEQ ID NO: 22607 - DNA, 35 bp, Artificial Sequence
  Synthetic oligonucleotide
gtagtgccacccaacctcacaacgaccacgctctc

SEQ ID NO: 22608 - DNA, 35 bp, Artificial Sequence
  Synthetic oligonucleotide
atgcatcctggtgcgctattccctctcctcgaaat

SEQ ID NO: 22609 - DNA, 35 bp, Artificial Sequence
  Synthetic oligonucleotide
atcctccagcgcgttacacctctatcaattgcgtt

SEQ ID NO: 22610 - DNA, 36 bp, Artificial Sequence
  Synthetic oligonucleotide
aagaaccaagcggcacatatctgttccctttaccga

SEQ ID NO: 22611 - DNA, 37 bp, Artificial Sequence
  Synthetic oligonucleotide
tgttcgccactgcatctgaatcactcgtcacacccga

SEQ ID NO: 22612 - DNA, 37 bp, Artificial Sequence
  Synthetic oligonucleotide
gcacaacacattcgtaacctcgactctgccatgtcga

SEQ ID NO: 22613 - DNA, 36 bp, Artificial Sequence
  Synthetic oligonucleotide
gcaaggggaagaaaacgcggcacgaaggggggctga

SEQ ID NO: 22614 - DNA, 38 bp, Artificial Sequence
  Synthetic oligonucleotide
tggacacgttgctctgccattactatcctgccccgtga

SEQ ID NO: 22615 - DNA, 36 bp, Artificial Sequence
  Synthetic oligonucleotide
atacaccctccggtactcgttgctattctgcaccta

SEQ ID NO: 22616 - DNA, 35 bp, Artificial Sequence
  Synthetic oligonucleotide
gggggtacatccacgttcccctcgcccctctgccc

SEQ ID NO: 22617 - DNA, 35 bp, Artificial Sequence
  Synthetic oligonucleotide
tgagtcacccctgctggacctgagttcctggtctc

SEQ ID NO: 22618 - DNA, 35 bp, Artificial Sequence
  Synthetic oligonucleotide
tcctatggcctctcacttgctgtcacctccctcat

SEQ ID NO: 22619 - DNA, 35 bp, Artificial Sequence
  Synthetic oligonucleotide
tgctcccactctgtcaatacgaacctgtagcacct

SEQ ID NO: 22620 - DNA, 35 bp, Artificial Sequence
  Synthetic oligonucleotide
taggagctgatccggcgctttttcccctgttggca

SEQ ID NO: 22621 - DNA, 36 bp, Artificial Sequence
  Synthetic oligonucleotide
gtgcccctgaaatttgaccccgcctcccagtcaaga

SEQ ID NO: 22622 - DNA, 35 bp, Artificial Sequence
  Synthetic oligonucleotide
gctcactcctcactgccaaaactcttggctctcga

SEQ ID NO: 22623 - DNA, 35 bp, Artificial Sequence
  Synthetic oligonucleotide
ttcccatcctcccgtcaccactcgcaagagcgtgc

SEQ ID NO: 22624 - DNA, 35 bp, Artificial Sequence
  Synthetic oligonucleotide
gaggtgccatctgcctccctacccccagcatcctc

SEQ ID NO: 22625 - DNA, 35 bp, Artificial Sequence
  Synthetic oligonucleotide
ggtgggtgtgaaggggggaggtatgcatgttgcgg

SEQ ID NO: 22626 - DNA, 35 bp, Artificial Sequence
  Synthetic oligonucleotide
aagatggggaggtatggagcctagaacaggtgggg

SEQ ID NO: 22627 - DNA, 35 bp, Artificial Sequence
  Synthetic oligonucleotide
gacgaagatcgcagtccctaaacattcatcccctg

SEQ ID NO: 22628 - DNA, 35 bp, Artificial Sequence
  Synthetic oligonucleotide
tcaccatcctcgcaagtgtgaaatcccgcacttct

SEQ ID NO: 22629 - DNA, 36 bp, Artificial Sequence
  Synthetic oligonucleotide
gagtgaggtgggagagggactatagaacaggttgaa

SEQ ID NO: 22630 - DNA, 37 bp, Artificial Sequence
  Synthetic oligonucleotide
gttgcacatgcaggtaattgcccttcctttccttgga

SEQ ID NO: 22631 - DNA, 35 bp, Artificial Sequence
  Synthetic oligonucleotide
acccgcaggcatcctatttgtgcctatacaccggc

SEQ ID NO: 22632 - DNA, 35 bp, Artificial Sequence
  Synthetic oligonucleotide
aatcacaccgctgccgtaccccggaggctttcaag

SEQ ID NO: 22633 - DNA, 34 bp, Artificial Sequence
  Synthetic oligonucleotide
acgcactagacgccctcctgattgatagctccat

SEQ ID NO: 22634 - DNA, 36 bp, Artificial Sequence
  Synthetic oligonucleotide
taccagacgtcccccggctgagctccaaccccttaa

SEQ ID NO: 22635 - DNA, 37 bp, Artificial Sequence
  Synthetic oligonucleotide
gcccatttagtcagtgctcgctcgtacttccccccga

SEQ ID NO: 22636 - DNA, 37 bp, Artificial Sequence
  Synthetic oligonucleotide
gagaggggtggggtcgggacatgagggaacagggcga

SEQ ID NO: 22637 - DNA, 36 bp, Artificial Sequence
  Synthetic oligonucleotide
tcaccgttagtctcccatcgccccttaccgaaagga

SEQ ID NO: 22638 - DNA, 37 bp, Artificial Sequence
  Synthetic oligonucleotide
tccgccgccacagggcctgctgctggttcctacttga

SEQ ID NO: 22639 - DNA, 38 bp, Artificial Sequence
  Synthetic oligonucleotide
gacgcgcaatgcataccctactgccacgtactctttga

SEQ ID NO: 22640 - DNA, 35 bp, Artificial Sequence
  Synthetic oligonucleotide
gccagtccgcccgctctgctttagtaactcttgta

SEQ ID NO: 22641 - DNA, 36 bp, Artificial Sequence
  Synthetic oligonucleotide
gcacaatcgcgtcctttctcttccccccgtatctta

SEQ ID NO: 22642 - DNA, 35 bp, Artificial Sequence
  Synthetic oligonucleotide
gactcgctgtccgcccgatactgctccaatcggcc

SEQ ID NO: 22643 - DNA, 35 bp, Artificial Sequence
  Synthetic oligonucleotide
tgcctcatcaatacgctactgtagcactcaagttc

SEQ ID NO: 22644 - DNA, 35 bp, Artificial Sequence
  Synthetic oligonucleotide
gtacccacccccgcccacatatccctcctgggtag

SEQ ID NO: 22645 - DNA, 35 bp, Artificial Sequence
  Synthetic oligonucleotide
actcataacacccgccgcgcgagacaccatgcatt

SEQ ID NO: 22646 - DNA, 36 bp, Artificial Sequence
  Synthetic oligonucleotide
aacgagtcgagtgaagtgggggagggaacggcaaaa

SEQ ID NO: 22647 - DNA, 36 bp, Artificial Sequence
  Synthetic oligonucleotide
gcagaggggtggcctggttgggtgcgtgctggaaaa

SEQ ID NO: 22648 - DNA, 35 bp, Artificial Sequence
  Synthetic oligonucleotide
tcaacctgccacccatgttttgcggttgtttttaa

SEQ ID NO: 22649 - DNA, 36 bp, Artificial Sequence
  Synthetic oligonucleotide
tagtacggccagtcttcatgcgcgtctgctctccca

SEQ ID NO: 22650 - DNA, 36 bp, Artificial Sequence
  Synthetic oligonucleotide
aaacaccgcccagccgctacgagtttattcgtccca

SEQ ID NO: 22651 - DNA, 36 bp, Artificial Sequence
  Synthetic oligonucleotide
agccggagggtggggggagaaaaaattaggcgcaga

SEQ ID NO: 22652 - DNA, 37 bp, Artificial Sequence
  Synthetic oligonucleotide
acatcccgctgtttttttcatatccgctcttcgagga

SEQ ID NO: 22653 - DNA, 35 bp, Artificial Sequence
  Synthetic oligonucleotide
accgaacggtcataaattcctaggcacataccatc

SEQ ID NO: 22654 - DNA, 35 bp, Artificial Sequence
  Synthetic oligonucleotide
tctatgcccacttagcctgccacctctggtgccct

SEQ ID NO: 22655 - DNA, 35 bp, Artificial Sequence
  Synthetic oligonucleotide
tccgactggctacattgtcaactcacatttttggt

SEQ ID NO: 22656 - DNA, 35 bp, Artificial Sequence
  Synthetic oligonucleotide
ttctcgactacgcgatccttcgtgacacccgcctt

SEQ ID NO: 22657 - DNA, 35 bp, Artificial Sequence
  Synthetic oligonucleotide
gagcatgtagctgactacaccttcttttcccctaa

SEQ ID NO: 22658 - DNA, 36 bp, Artificial Sequence
  Synthetic oligonucleotide
atcgcttgccgtctgccctggaactgcatctctcga

SEQ ID NO: 22659 - DNA, 38 bp, Artificial Sequence
  Synthetic oligonucleotide
tagcgggaggacctaacgggcaagaggggaggtattga

SEQ ID NO: 22660 - DNA, 35 bp, Artificial Sequence
  Synthetic oligonucleotide
tcttccgtacgtcataatacgcacaccctgcctgt

SEQ ID NO: 22661 - DNA, 36 bp, Artificial Sequence
  Synthetic oligonucleotide
taccaccgacggccgaatatctctccagaccgccca

SEQ ID NO: 22662 - DNA, 35 bp, Artificial Sequence
  Synthetic oligonucleotide
aaacacattgcctggtgatcaccgccccgtatcca

SEQ ID NO: 22663 - DNA, 37 bp, Artificial Sequence
  Synthetic oligonucleotide
tcctccctgccttagccgtgccacacatgtacccaga

SEQ ID NO: 22664 - DNA, 37 bp, Artificial Sequence
  Synthetic oligonucleotide
gcgatgccaagcacgcttatttttgtacgtcttccga

SEQ ID NO: 22665 - DNA, 37 bp, Artificial Sequence
  Synthetic oligonucleotide
accacaaccccttagttgttcctgtccctatgccgga

SEQ ID NO: 22666 - DNA, 38 bp, Artificial Sequence
  Synthetic oligonucleotide
aacaccgccacttaataaccgttgctgacaccacatga

SEQ ID NO: 22667 - DNA, 38 bp, Artificial Sequence
  Synthetic oligonucleotide
gccttcgcccagcccttctctctttcgacactctctga

SEQ ID NO: 22668 - DNA, 35 bp, Artificial Sequence
  Synthetic oligonucleotide
acttgttgcaccctgccgcggtcttacgtagaacg

SEQ ID NO: 22669 - DNA, 35 bp, Artificial Sequence
  Synthetic oligonucleotide
gtgcaatagccccggccttcacagcctttacttct

SEQ ID NO: 22670 - DNA, 36 bp, Artificial Sequence
  Synthetic oligonucleotide
accgaagggcggaaaaagtagcgggagcggggggca

SEQ ID NO: 22671 - DNA, 36 bp, Artificial Sequence
  Synthetic oligonucleotide
atggttccaccgtccgtcttactctgatccgctgca

SEQ ID NO: 22672 - DNA, 36 bp, Artificial Sequence
  Synthetic oligonucleotide
acccactcacaccccaggtgcgctttacatagctca

SEQ ID NO: 22673 - DNA, 38 bp, Artificial Sequence
  Synthetic oligonucleotide
ggggtgggcttgggaggggtgaccgagtgcgagattga

SEQ ID NO: 22674 - DNA, 36 bp, Artificial Sequence
  Synthetic oligonucleotide
aactccacacctccattgcatccccgcccggtacta

SEQ ID NO: 22675 - DNA, 35 bp, Artificial Sequence
  Synthetic oligonucleotide
gaatcgcagccgaatcacagtcccgttgtcttcta

SEQ ID NO: 22676 - DNA, 36 bp, Artificial Sequence
  Synthetic oligonucleotide
atgtgctgcagaattatgtggcttagtcgttgcgta

SEQ ID NO: 22677 - DNA, 35 bp, Artificial Sequence
  Synthetic oligonucleotide
gcatcagccccagcttctacatcactttactagcc

SEQ ID NO: 22678 - DNA, 35 bp, Artificial Sequence
  Synthetic oligonucleotide
acgctagcgcttgtcccgtctcattccctgctggc

SEQ ID NO: 22679 - DNA, 36 bp, Artificial Sequence
  Synthetic oligonucleotide
acccacagccttccctgccccgactcttatgtcaaa

SEQ ID NO: 22680 - DNA, 36 bp, Artificial Sequence
  Synthetic oligonucleotide
acaccttggctcgcccttcccctgtccatgttctaa

SEQ ID NO: 22681 - DNA, 37 bp, Artificial Sequence
  Synthetic oligonucleotide
acctcgcattcccctctctctaatagcgtccagccga

SEQ ID NO: 22682 - DNA, 37 bp, Artificial Sequence
  Synthetic oligonucleotide
acctcgccctcactcctcgcccatacctgcttgccga

SEQ ID NO: 22683 - DNA, 35 bp, Artificial Sequence
  Synthetic oligonucleotide
ttgtccccccatctatggtcgagacgcatgacccc

SEQ ID NO: 22684 - DNA, 35 bp, Artificial Sequence
  Synthetic oligonucleotide
gccatcggtcatccaccagtgagccccttagtccc

SEQ ID NO: 22685 - DNA, 35 bp, Artificial Sequence
  Synthetic oligonucleotide
accgccaaaccctgtgcagtccatacccccactgc

SEQ ID NO: 22686 - DNA, 35 bp, Artificial Sequence
  Synthetic oligonucleotide
atgccactgtccgaacttgatccatctgctttgcg

SEQ ID NO: 22687 - DNA, 35 bp, Artificial Sequence
  Synthetic oligonucleotide
agccactacccggtcattccctttgggctgccaat

SEQ ID NO: 22688 - DNA, 36 bp, Artificial Sequence
  Synthetic oligonucleotide
ggtgcacctgtttcatcgcttttccctgccatcaca

SEQ ID NO: 22689 - DNA, 37 bp, Artificial Sequence
  Synthetic oligonucleotide
gtactgccctccatgcctcgtctcgtcccgtacacga

SEQ ID NO: 22690 - DNA, 37 bp, Artificial Sequence
  Synthetic oligonucleotide
gtcaactgcatgtctccctctcgccggttccgtgcga

SEQ ID NO: 22691 - DNA, 36 bp, Artificial Sequence
  Synthetic oligonucleotide
tgagggaccaccggctgactattacgcctcgatcta

SEQ ID NO: 22692 - DNA, 36 bp, Artificial Sequence
  Synthetic oligonucleotide
tctcgctactgctcctggtctgttcatcttgttcta

SEQ ID NO: 22693 - DNA, 35 bp, Artificial Sequence
  Synthetic oligonucleotide
tacaccgcccggcctgttggctccaccggaaagcc

SEQ ID NO: 22694 - DNA, 35 bp, Artificial Sequence
  Synthetic oligonucleotide
tccacgaccgtacagccgagtgaaatttactgttc

SEQ ID NO: 22695 - DNA, 36 bp, Artificial Sequence
  Synthetic oligonucleotide
taagcccacacccctgaagttttggtccagccgacg

SEQ ID NO: 22696 - DNA, 35 bp, Artificial Sequence
  Synthetic oligonucleotide
tcaccggcgagcatctattcattgcctttttcctg

SEQ ID NO: 22697 - DNA, 35 bp, Artificial Sequence
  Synthetic oligonucleotide
gatctacctcaactgcctcctttacttcagtgctg

SEQ ID NO: 22698 - DNA, 35 bp, Artificial Sequence
  Synthetic oligonucleotide
gcgcaatggtccggcgccgtcctaacgcatcatct

SEQ ID NO: 22699 - DNA, 37 bp, Artificial Sequence
  Synthetic oligonucleotide
atcgatccccgcgctgactcctatacatccaactcga

SEQ ID NO: 22700 - DNA, 37 bp, Artificial Sequence
  Synthetic oligonucleotide
atcacgttcagctctcgccccccaactctgcaacgga

SEQ ID NO: 22701 - DNA, 38 bp, Artificial Sequence
  Synthetic oligonucleotide
gccgactgcgcttgctgacctccgtatcgtacttttga

SEQ ID NO: 22702 - DNA, 36 bp, Artificial Sequence
  Synthetic oligonucleotide
ggacccacgattctagcctatgccagggcaccctta

SEQ ID NO: 22703 - DNA, 35 bp, Artificial Sequence
  Synthetic oligonucleotide
tgtgttcccccccagatcctatcaaacgcctcccc

SEQ ID NO: 22704 - DNA, 35 bp, Artificial Sequence
  Synthetic oligonucleotide
tctggcccccatctcccctaggcacgctcacttcg

SEQ ID NO: 22705 - DNA, 35 bp, Artificial Sequence
  Synthetic oligonucleotide
tattacccctctgccacgtcgtagcggactcctct

SEQ ID NO: 22706 - DNA, 35 bp, Artificial Sequence
  Synthetic oligonucleotide
gacccaccgtcttacgatattctgctttctcactt

SEQ ID NO: 22707 - DNA, 35 bp, Artificial Sequence
  Synthetic oligonucleotide
gtggccacctcatgttgatacccatccagtacttt

SEQ ID NO: 22708 - DNA, 36 bp, Artificial Sequence
  Synthetic oligonucleotide
aacgatccctgcctggtggtgtccattgatcctcca

SEQ ID NO: 22709 - DNA, 37 bp, Artificial Sequence
  Synthetic oligonucleotide
actcccctgctccgacatatcgatccatctcttaaga

SEQ ID NO: 22710 - DNA, 38 bp, Artificial Sequence
  Synthetic oligonucleotide
gtacaccggccgaaagttacaccctcctcactttatga

SEQ ID NO: 22711 - DNA, 36 bp, Artificial Sequence
  Synthetic oligonucleotide
tcaaccactccgcgtgacaccgctgacgatctccta

SEQ ID NO: 22712 - DNA, 36 bp, Artificial Sequence
  Synthetic oligonucleotide
gacacacggggccgccctcaatacagtctggtagta

SEQ ID NO: 22713 - DNA, 35 bp, Artificial Sequence
  Synthetic oligonucleotide
aatcgcacggttggagtctctcgacctgtccctcc

SEQ ID NO: 22714 - DNA, 35 bp, Artificial Sequence
  Synthetic oligonucleotide
gcgatcgccgcatgtacgtcactctacgttcactt

SEQ ID NO: 22715 - DNA, 36 bp, Artificial Sequence
  Synthetic oligonucleotide
tgtacaccccggcatacagcgcctcttgcacctaca

SEQ ID NO: 22716 - DNA, 36 bp, Artificial Sequence
  Synthetic oligonucleotide
gccactcgtgcgtagtgttcttcaatatcctttcca

SEQ ID NO: 22717 - DNA, 36 bp, Artificial Sequence
  Synthetic oligonucleotide
atgatccattctgcctgccgcaccacgcgttattca

SEQ ID NO: 22718 - DNA, 37 bp, Artificial Sequence
  Synthetic oligonucleotide
acggggaggtaggggagaggatggatcatgtggagga

SEQ ID NO: 22719 - DNA, 38 bp, Artificial Sequence
  Synthetic oligonucleotide
tgccactgcctattgctcctgaacctcgctgtacatga

SEQ ID NO: 22720 - DNA, 36 bp, Artificial Sequence
  Synthetic oligonucleotide
gacaagtggaagagggagggccgactagggttatga

SEQ ID NO: 22721 - DNA, 35 bp, Artificial Sequence
  Synthetic oligonucleotide
gatcaacctacatcgggtacatactagaactacac

SEQ ID NO: 22722 - DNA, 35 bp, Artificial Sequence
  Synthetic oligonucleotide
tgtacaccattatacgcggtcctatctgtctcctc

SEQ ID NO: 22723 - DNA, 35 bp, Artificial Sequence
  Synthetic oligonucleotide
tcggtgcccggtttgtcgtcgttcccctgctgttt

SEQ ID NO: 22724 - DNA, 36 bp, Artificial Sequence
  Synthetic oligonucleotide
gccgccccccgaacgcctgagtgcaggctcaaccca

SEQ ID NO: 22725 - DNA, 37 bp, Artificial Sequence
  Synthetic oligonucleotide
tgcatcccacgcgcttaacactctcatgctttccaga

SEQ ID NO: 22726 - DNA, 37 bp, Artificial Sequence
  Synthetic oligonucleotide
tgtggaggaaggagcgaaaacatagggcatagcgcga

SEQ ID NO: 22727 - DNA, 37 bp, Artificial Sequence
  Synthetic oligonucleotide
tccgcacctctcctctcagccatcgttggacaggtga

SEQ ID NO: 22728 - DNA, 38 bp, Artificial Sequence
  Synthetic oligonucleotide
actggccatcactgcacctctgaacgcatctcccttga

SEQ ID NO: 22729 - DNA, 35 bp, Artificial Sequence
  Synthetic oligonucleotide
tgtccgagtgcatacccgccaccgctcccattcac

SEQ ID NO: 22730 - DNA, 35 bp, Artificial Sequence
  Synthetic oligonucleotide
gagcacctttgcttactctccgacttatcgacctg

SEQ ID NO: 22731 - DNA, 35 bp, Artificial Sequence
  Synthetic oligonucleotide
gccacgtacgacggacctatcctggccccttaaat

SEQ ID NO: 22732 - DNA, 35 bp, Artificial Sequence
  Synthetic oligonucleotide
tagtcccgccaccgacgggtacggatcatccattt

SEQ ID NO: 22733 - DNA, 35 bp, Artificial Sequence
  Synthetic oligonucleotide
acaaccgccgggggccactcaattgttcatgaaaa

SEQ ID NO: 22734 - DNA, 36 bp, Artificial Sequence
  Synthetic oligonucleotide
agtcccaccgttttctatgcttcatttccggcttca

SEQ ID NO: 22735 - DNA, 38 bp, Artificial Sequence
  Synthetic oligonucleotide
aaccactgacggcgttgtaaattgcctttgcctcctga

SEQ ID NO: 22736 - DNA, 37 bp, Artificial Sequence
  Synthetic oligonucleotide
tggggggggtacagggcccaggagggaaatgcggtga

SEQ ID NO: 22737 - DNA, 38 bp, Artificial Sequence
  Synthetic oligonucleotide
tgaggtggtaggaaggggggaatgcgaatacatggtga

SEQ ID NO: 22738 - DNA, 35 bp, Artificial Sequence
  Synthetic oligonucleotide
tgaaacgcaatgccgtcccaaattaggcacttctc

SEQ ID NO: 22739 - DNA, 35 bp, Artificial Sequence
  Synthetic oligonucleotide
tcctctcactgcccacctgaatccgacagcaccgg

SEQ ID NO: 22740 - DNA, 35 bp, Artificial Sequence
  Synthetic oligonucleotide
tgaacagacatcctcaccatactgcacactgggaa

SEQ ID NO: 22741 - DNA, 36 bp, Artificial Sequence
  Synthetic oligonucleotide
tcccacctcctggttagtttcaacggtcgattatca

SEQ ID NO: 22742 - DNA, 35 bp, Artificial Sequence
  Synthetic oligonucleotide
aaggaggaacacagtaagagagagcggactgtaga

SEQ ID NO: 22743 - DNA, 37 bp, Artificial Sequence
  Synthetic oligonucleotide
tgcccccgctagcaccatcaccacgcgaaccactcga

SEQ ID NO: 22744 - DNA, 37 bp, Artificial Sequence
  Synthetic oligonucleotide
gaccgatgccgcttgcacacacgatatcactcctgga

SEQ ID NO: 22745 - DNA, 38 bp, Artificial Sequence
  Synthetic oligonucleotide
gccaccaaccttgcattttactcagtcactttaactga

SEQ ID NO: 22746 - DNA, 36 bp, Artificial Sequence
  Synthetic oligonucleotide
gtgcgagcaccccggatatttgcccgttccgcctta

SEQ ID NO: 22747 - DNA, 35 bp, Artificial Sequence
  Synthetic oligonucleotide
gacgtgcctaaccctccctccatcgctatgtgcac

SEQ ID NO: 22748 - DNA, 35 bp, Artificial Sequence
  Synthetic oligonucleotide
gactgactctgcctcctgtgctggtcctgttattc

SEQ ID NO: 22749 - DNA, 35 bp, Artificial Sequence
  Synthetic oligonucleotide
ccaggccgcaccattttccgatcttgtaacgcact

SEQ ID NO: 22750 - DNA, 35 bp, Artificial Sequence
  Synthetic oligonucleotide
acatacccgactggctatttatggtttgtccacct

SEQ ID NO: 22751 - DNA, 35 bp, Artificial Sequence
  Synthetic oligonucleotide
gtgtcaacccgtacctctgcctatctgggtaatct

SEQ ID NO: 22752 - DNA, 35 bp, Artificial Sequence
  Synthetic oligonucleotide
agagagagcggagggggggaaaagttagacagagt

SEQ ID NO: 22753 - DNA, 36 bp, Artificial Sequence
  Synthetic oligonucleotide
gtcacaccaatatgtcacacctctcttcacttgaaa

SEQ ID NO: 22754 - DNA, 35 bp, Artificial Sequence
  Synthetic oligonucleotide
gattgccgcccaatgatccattccgcacactataa

SEQ ID NO: 22755 - DNA, 37 bp, Artificial Sequence
  Synthetic oligonucleotide
actcacctgaattcagccgcttacctgaggaccccga

SEQ ID NO: 22756 - DNA, 36 bp, Artificial Sequence
  Synthetic oligonucleotide
gtacccaacacctcgccatccgactagctctacgga

SEQ ID NO: 22757 - DNA, 37 bp, Artificial Sequence
  Synthetic oligonucleotide
gggggggtggagaaatgagggaaagagacttcaggga

SEQ ID NO: 22758 - DNA, 38 bp, Artificial Sequence
  Synthetic oligonucleotide
aacgaccacgaccggcgctctgtagtacatgctcatga

SEQ ID NO: 22759 - DNA, 35 bp, Artificial Sequence
  Synthetic oligonucleotide
gcgacctttcacgccctctgcccgttgacacacgc

SEQ ID NO: 22760 - DNA, 35 bp, Artificial Sequence
  Synthetic oligonucleotide
tcatggtgcccctaaaagtgcgtttccgttcatgc

SEQ ID NO: 22761 - DNA, 35 bp, Artificial Sequence
  Synthetic oligonucleotide
tatcgcactcatcacgtgcgggtttccgttttttc

SEQ ID NO: 22762 - DNA, 34 bp, Artificial Sequence
  Synthetic oligonucleotide
gtcaatatgggggcgaggaaggtggtctggggct

SEQ ID NO: 22763 - DNA, 35 bp, Artificial Sequence
  Synthetic oligonucleotide
tacacatcttccgttccgtcttgctttttggctca

SEQ ID NO: 22764 - DNA, 37 bp, Artificial Sequence
  Synthetic oligonucleotide
gcatgggggggaccgaaaaagaaggacgaatggcaga

SEQ ID NO: 22765 - DNA, 36 bp, Artificial Sequence
  Synthetic oligonucleotide
gtccattccgcccgttgctttgttcctaacttcaga

SEQ ID NO: 22766 - DNA, 37 bp, Artificial Sequence
  Synthetic oligonucleotide
acagccacgttgccagacgcagctcccacaccctaga

SEQ ID NO: 22767 - DNA, 37 bp, Artificial Sequence
  Synthetic oligonucleotide
gtcctcccttccgcaagcaacagtctcactagttaga

SEQ ID NO: 22768 - DNA, 37 bp, Artificial Sequence
  Synthetic oligonucleotide
tacgtccccaacatgcctggcctgtagcccccatcga

SEQ ID NO: 22769 - DNA, 35 bp, Artificial Sequence
  Synthetic oligonucleotide
aagcctccccacggttcgagtatacatcttgcccc

SEQ ID NO: 22770 - DNA, 35 bp, Artificial Sequence
  Synthetic oligonucleotide
ttaagccgccgttccccgttctgcttttgccctat

SEQ ID NO: 22771 - DNA, 35 bp, Artificial Sequence
  Synthetic oligonucleotide
ttcgtaccatcctgacgccattatgcgagagttct

SEQ ID NO: 22772 - DNA, 37 bp, Artificial Sequence
  Synthetic oligonucleotide
gacaccgagctcatctacccatcacgtctgactacga

SEQ ID NO: 22773 - DNA, 37 bp, Artificial Sequence
  Synthetic oligonucleotide
gggtgctgcaagcaataagccggcggagagggaggga

SEQ ID NO: 22774 - DNA, 37 bp, Artificial Sequence
  Synthetic oligonucleotide
aatgggatctgtgtgtggggtctcgggggtagtggga

SEQ ID NO: 22775 - DNA, 38 bp, Artificial Sequence
  Synthetic oligonucleotide
gcttacctccccctgcgatatcgaaactgcctacatga

SEQ ID NO: 22776 - DNA, 35 bp, Artificial Sequence
  Synthetic oligonucleotide
tcctgcacgggtggccttaatcgtctatccttgcc

SEQ ID NO: 22777 - DNA, 35 bp, Artificial Sequence
  Synthetic oligonucleotide
atccgccgccttccgcttcccttaagcatcttatc

SEQ ID NO: 22778 - DNA, 36 bp, Artificial Sequence
  Synthetic oligonucleotide
ataccgcgacccgcagcacctctctgtccaacctaa

SEQ ID NO: 22779 - DNA, 35 bp, Artificial Sequence
  Synthetic oligonucleotide
aaaccacctctcgacccgcacacctttcaagagca

SEQ ID NO: 22780 - DNA, 37 bp, Artificial Sequence
  Synthetic oligonucleotide
actccagacccgacccagctacgaggctcccctatga

SEQ ID NO: 22781 - DNA, 37 bp, Artificial Sequence
  Synthetic oligonucleotide
gagtagtcaaaatggtgtggtggtaggaagggagtga

SEQ ID NO: 22782 - DNA, 37 bp, Artificial Sequence
  Synthetic oligonucleotide
tagggtgacgcgagggggagggttagggtaagcgtga

SEQ ID NO: 22783 - DNA, 35 bp, Artificial Sequence
  Synthetic oligonucleotide
gatcccggcctcacgtgactccttcagccgtacta

SEQ ID NO: 22784 - DNA, 35 bp, Artificial Sequence
  Synthetic oligonucleotide
actgcaccttactaggtgacagttgcctccacttc

SEQ ID NO: 22785 - DNA, 35 bp, Artificial Sequence
  Synthetic oligonucleotide
gacgatgcactcggggaagaagggctgaaaagggg

SEQ ID NO: 22786 - DNA, 35 bp, Artificial Sequence
  Synthetic oligonucleotide
tacaggtcgggtctaaatggcgcgccccactccct

SEQ ID NO: 22787 - DNA, 35 bp, Artificial Sequence
  Synthetic oligonucleotide
tagatccgctaaacacgctcctttggccgtacgct

SEQ ID NO: 22788 - DNA, 35 bp, Artificial Sequence
  Synthetic oligonucleotide
actttccctccacgttgtgctcaggtctcgccatt

SEQ ID NO: 22789 - DNA, 35 bp, Artificial Sequence
  Synthetic oligonucleotide
gttagcgtggtcctcgccctctgtcaccatcgttt

SEQ ID NO: 22790 - DNA, 36 bp, Artificial Sequence
  Synthetic oligonucleotide
gctgccctctccggagtctaccccacgttttgtaca

SEQ ID NO: 22791 - DNA, 36 bp, Artificial Sequence
  Synthetic oligonucleotide
tccactcctccgccgcaataggcccctgcggaacga

SEQ ID NO: 22792 - DNA, 31 bp, Artificial Sequence
  Synthetic oligonucleotide
gacgctcgacaaacatttcacaaaagccccc

SEQ ID NO: 22793 - DNA, 35 bp, Artificial Sequence
  Synthetic oligonucleotide
acttggggcgccgtgtcccgcaccaatcccatccc

SEQ ID NO: 22794 - DNA, 35 bp, Artificial Sequence
  Synthetic oligonucleotide
accattgccctcactaatgtaatgatcgtaggttt

SEQ ID NO: 22795 - DNA, 36 bp, Artificial Sequence
  Synthetic oligonucleotide
acagggagtacgggataacggtgggtgggacgagaa

SEQ ID NO: 22796 - DNA, 36 bp, Artificial Sequence
  Synthetic oligonucleotide
tcactacctcccgactgacaggaaaatgcccgcaca

SEQ ID NO: 22797 - DNA, 36 bp, Artificial Sequence
  Synthetic oligonucleotide
agatccacctctgacgaaaacgatcaaccttgcaca

SEQ ID NO: 22798 - DNA, 37 bp, Artificial Sequence
  Synthetic oligonucleotide
atcctagtgtgggggggtagagggacggatgacgaga

SEQ ID NO: 22799 - DNA, 37 bp, Artificial Sequence
  Synthetic oligonucleotide
acacctccattaccatctcacttgcgcgccatgccga

SEQ ID NO: 22800 - DNA, 35 bp, Artificial Sequence
  Synthetic oligonucleotide
gcatcctttgcctccccttcgcgacaatctatgga

SEQ ID NO: 22801 - DNA, 37 bp, Artificial Sequence
  Synthetic oligonucleotide
gagccgacggctcgttttccgtacaacaatcatctga

SEQ ID NO: 22802 - DNA, 38 bp, Artificial Sequence
  Synthetic oligonucleotide
accacctagctggtcctggccccactcccataggttga

SEQ ID NO: 22803 - DNA, 36 bp, Artificial Sequence
  Synthetic oligonucleotide
agagagcgcaaatatcctgctgcgaattcccttcta

SEQ ID NO: 22804 - DNA, 35 bp, Artificial Sequence
  Synthetic oligonucleotide
atagccggagtgcgttggcgtacacccctctttac

SEQ ID NO: 22805 - DNA, 35 bp, Artificial Sequence
  Synthetic oligonucleotide
ttgagtgcggagtctcttttctgcctgaccaaatc

SEQ ID NO: 22806 - DNA, 35 bp, Artificial Sequence
  Synthetic oligonucleotide
ggacacaaaactgatggtggggtggggccgggaat

SEQ ID NO: 22807 - DNA, 36 bp, Artificial Sequence
  Synthetic oligonucleotide
gacgtgcgaagggggacacgcacgaggggagaagca

SEQ ID NO: 22808 - DNA, 37 bp, Artificial Sequence
  Synthetic oligonucleotide
tccatctctgcccctcgcgataatgtcctcttgtaga

SEQ ID NO: 22809 - DNA, 36 bp, Artificial Sequence
  Synthetic oligonucleotide
gacccctggaccctacatctcccccaccggagagga

SEQ ID NO: 22810 - DNA, 37 bp, Artificial Sequence
  Synthetic oligonucleotide
gttgtaccgtctgtccagcctccctcgtgatctctga

SEQ ID NO: 22811 - DNA, 36 bp, Artificial Sequence
  Synthetic oligonucleotide
ttccgcccccagccaccatatcgttatgtcgattga

SEQ ID NO: 22812 - DNA, 35 bp, Artificial Sequence
  Synthetic oligonucleotide
acgcgctcaccgctcgtagggcacactctgccatc

SEQ ID NO: 22813 - DNA, 36 bp, Artificial Sequence
  Synthetic oligonucleotide
gtgacacggaggagtcgttctttgccttttcaccaa

SEQ ID NO: 22814 - DNA, 37 bp, Artificial Sequence
  Synthetic oligonucleotide
ggtggggatggaaggcgggcaggagggaatagcggga

SEQ ID NO: 22815 - DNA, 37 bp, Artificial Sequence
  Synthetic oligonucleotide
accacccgccgtcaattatccatgccgttgccattga

SEQ ID NO: 22816 - DNA, 38 bp, Artificial Sequence
  Synthetic oligonucleotide
tggtacacgcgcgttgcgttagctccttgcctccttga

SEQ ID NO: 22817 - DNA, 36 bp, Artificial Sequence
  Synthetic oligonucleotide
gttccacgagggtttgccgcgtgaccatatacctta

SEQ ID NO: 22818 - DNA, 35 bp, Artificial Sequence
  Synthetic oligonucleotide
actctagccgatctcaccaccattcatgtgtttcc

SEQ ID NO: 22819 - DNA, 35 bp, Artificial Sequence
  Synthetic oligonucleotide
gccctccgtaaccgggttgcctacactgatcttgg

SEQ ID NO: 22820 - DNA, 35 bp, Artificial Sequence
  Synthetic oligonucleotide
accacctatgcacagagggtgacgccttgacccat

SEQ ID NO: 22821 - DNA, 35 bp, Artificial Sequence
  Synthetic oligonucleotide
gaagggagaactgacggggtgctggacaagggact

SEQ ID NO: 22822 - DNA, 35 bp, Artificial Sequence
  Synthetic oligonucleotide
gttgactatgcacccttgcctcgtgcgaataacct

SEQ ID NO: 22823 - DNA, 35 bp, Artificial Sequence
  Synthetic oligonucleotide
gctggaggaccccctgcatggttcctagtttccct

SEQ ID NO: 22824 - DNA, 36 bp, Artificial Sequence
  Synthetic oligonucleotide
gagaccctgacgccccagtcccaactcttatagaca

SEQ ID NO: 22825 - DNA, 36 bp, Artificial Sequence
  Synthetic oligonucleotide
tccagcatggcccccgaactcaccacggacatccca

SEQ ID NO: 22826 - DNA, 35 bp, Artificial Sequence
  Synthetic oligonucleotide
atagatcagaccgcccccccccgcgtttaccgcca

SEQ ID NO: 22827 - DNA, 37 bp, Artificial Sequence
  Synthetic oligonucleotide
gacagggtgacacgggagaagacagggggggccgaga

SEQ ID NO: 22828 - DNA, 36 bp, Artificial Sequence
  Synthetic oligonucleotide
gttcattcacaaccagggactccccacatgcacgga

SEQ ID NO: 22829 - DNA, 35 bp, Artificial Sequence
  Synthetic oligonucleotide
gtccggagggggaaggggaggactctgttggtggc

SEQ ID NO: 22830 - DNA, 35 bp, Artificial Sequence
  Synthetic oligonucleotide
tcccacgtacattccaacttggttcgggaattctc

SEQ ID NO: 22831 - DNA, 35 bp, Artificial Sequence
  Synthetic oligonucleotide
tttggccaccctttctgtttgcaaccctgctgtct

SEQ ID NO: 22832 - DNA, 35 bp, Artificial Sequence
  Synthetic oligonucleotide
gaggtcccctcaaccgcacattggctttgccttct

SEQ ID NO: 22833 - DNA, 35 bp, Artificial Sequence
  Synthetic oligonucleotide
gtgctcaaccggggagggggcgaagggagatgatt

SEQ ID NO: 22834 - DNA, 35 bp, Artificial Sequence
  Synthetic oligonucleotide
ttcaccgatccgtttcctgttttgaactctttgaa

SEQ ID NO: 22835 - DNA, 36 bp, Artificial Sequence
  Synthetic oligonucleotide
ttaggacatggccgaaaagtaaaacgggagtacgca

SEQ ID NO: 22836 - DNA, 37 bp, Artificial Sequence
  Synthetic oligonucleotide
tgaccgttgccaatcctgctgacacttctccgaccga

SEQ ID NO: 22837 - DNA, 38 bp, Artificial Sequence
  Synthetic oligonucleotide
tgctcgtcactcagacacagcccccccttgactcctga

SEQ ID NO: 22838 - DNA, 35 bp, Artificial Sequence
  Synthetic oligonucleotide
gtgagcacttgcaatagccgaccccggacaatacc

SEQ ID NO: 22839 - DNA, 35 bp, Artificial Sequence
  Synthetic oligonucleotide
gcactcctgcgaccttacttctccgttcctccgcg

SEQ ID NO: 22840 - DNA, 35 bp, Artificial Sequence
  Synthetic oligonucleotide
gccactgcccttttccccgcgcaacattaagtggg

SEQ ID NO: 22841 - DNA, 35 bp, Artificial Sequence
  Synthetic oligonucleotide
cccgtcctgaatctcacgtgtaagagcaagcatgg

SEQ ID NO: 22842 - DNA, 36 bp, Artificial Sequence
  Synthetic oligonucleotide
gagtaagggagggccgaaagcgggtgtgggtgaaaa

SEQ ID NO: 22843 - DNA, 36 bp, Artificial Sequence
  Synthetic oligonucleotide
atgcactcctgcaagcccgctagtatcatgccccaa

SEQ ID NO: 22844 - DNA, 35 bp, Artificial Sequence
  Synthetic oligonucleotide
ttctaccagccccgcaacactaaccacacggaaca

SEQ ID NO: 22845 - DNA, 37 bp, Artificial Sequence
  Synthetic oligonucleotide
gtgatagggcggaggctgggggtcgccgggggggaga

SEQ ID NO: 22846 - DNA, 38 bp, Artificial Sequence
  Synthetic oligonucleotide
acatacctgctcttcgccctgtccagtccgatccatga

SEQ ID NO: 22847 - DNA, 38 bp, Artificial Sequence
  Synthetic oligonucleotide
actcgcatcctcgttctttcatttgggccttgttatga

SEQ ID NO: 22848 - DNA, 38 bp, Artificial Sequence
  Synthetic oligonucleotide
gtggccgcgcacgccttgcattaccacctctgctctga

SEQ ID NO: 22849 - DNA, 38 bp, Artificial Sequence
  Synthetic oligonucleotide
gagcaggggagggagggacgtagaggcaaacgtggtga

SEQ ID NO: 22850 - DNA, 36 bp, Artificial Sequence
  Synthetic oligonucleotide
tgagcaaacgccaggtccccacacagccccagccta

SEQ ID NO: 22851 - DNA, 36 bp, Artificial Sequence
  Synthetic oligonucleotide
ggaggtcagcaggaccaaacgggggagtgggaatta

SEQ ID NO: 22852 - DNA, 35 bp, Artificial Sequence
  Synthetic oligonucleotide
acatccacatcggccgcgattacgttacatctaac

SEQ ID NO: 22853 - DNA, 35 bp, Artificial Sequence
  Synthetic oligonucleotide
tcacctccattcgctggtactcccgtcagggtacc

SEQ ID NO: 22854 - DNA, 34 bp, Artificial Sequence
  Synthetic oligonucleotide
atgtctctttgccctcacggttgtgccctccgcc

SEQ ID NO: 22855 - DNA, 35 bp, Artificial Sequence
  Synthetic oligonucleotide
actacgcctcatgctccaccgtgaagccattgtcc

SEQ ID NO: 22856 - DNA, 35 bp, Artificial Sequence
  Synthetic oligonucleotide
acccattccactcttgtacgactcggctctattgc

SEQ ID NO: 22857 - DNA, 35 bp, Artificial Sequence
  Synthetic oligonucleotide
actactccacgtcaccagcgaaacattaccttgtc

SEQ ID NO: 22858 - DNA, 35 bp, Artificial Sequence
  Synthetic oligonucleotide
ttcgacgtcaaactatactagcgccccgacacact

SEQ ID NO: 22859 - DNA, 36 bp, Artificial Sequence
  Synthetic oligonucleotide
aaacaagatggggcggggggggaaaaaaatcgttca

SEQ ID NO: 22860 - DNA, 35 bp, Artificial Sequence
  Synthetic oligonucleotide
tgctcgcaggccgccaccacacgcattcataccga

SEQ ID NO: 22861 - DNA, 37 bp, Artificial Sequence
  Synthetic oligonucleotide
tcacccccacctggcccgccgcttagaccgcctcgga

SEQ ID NO: 22862 - DNA, 37 bp, Artificial Sequence
  Synthetic oligonucleotide
gcaggtaacggagggaggtcgaacggggtgcggggga

SEQ ID NO: 22863 - DNA, 38 bp, Artificial Sequence
  Synthetic oligonucleotide
gtttgagaggaagatggggcctgggtaggtgtgggtga

SEQ ID NO: 22864 - DNA, 37 bp, Artificial Sequence
  Synthetic oligonucleotide
gttccaacagcgcgatctattcctgcaccatcattga

SEQ ID NO: 22865 - DNA, 35 bp, Artificial Sequence
  Synthetic oligonucleotide
cgacatccctaacttgaacagcttgacgttgctta

SEQ ID NO: 22866 - DNA, 35 bp, Artificial Sequence
  Synthetic oligonucleotide
actgcctccacgtgaccgcaccgggtctccttcgc

SEQ ID NO: 22867 - DNA, 35 bp, Artificial Sequence
  Synthetic oligonucleotide
atccccgcccactttattccgttccgtaagtgact

SEQ ID NO: 22868 - DNA, 36 bp, Artificial Sequence
  Synthetic oligonucleotide
tgacttgggccgtgggaggggagagggacatgaaca

SEQ ID NO: 22869 - DNA, 35 bp, Artificial Sequence
  Synthetic oligonucleotide
tgaacatcgagctcgacgctttcctaaccttgaca

SEQ ID NO: 22870 - DNA, 35 bp, Artificial Sequence
  Synthetic oligonucleotide
ttagcaaccccactctcacgttttacccctgtgca

SEQ ID NO: 22871 - DNA, 37 bp, Artificial Sequence
  Synthetic oligonucleotide
tgcgtgacacggggagggggtactaataagataggga

SEQ ID NO: 22872 - DNA, 38 bp, Artificial Sequence
  Synthetic oligonucleotide
tactgcctccacctgcggttctcactcctcacaagtga

SEQ ID NO: 22873 - DNA, 38 bp, Artificial Sequence
  Synthetic oligonucleotide
acacgcccatcctgcgtacgctctaacttttcatgtga

SEQ ID NO: 22874 - DNA, 37 bp, Artificial Sequence
  Synthetic oligonucleotide
ttctaccgccataatcgcccctatagtgcctctgtga

SEQ ID NO: 22875 - DNA, 35 bp, Artificial Sequence
  Synthetic oligonucleotide
ttcgcgcacccaccactgttacttccgttgctcta

SEQ ID NO: 22876 - DNA, 36 bp, Artificial Sequence
  Synthetic oligonucleotide
attccagctactgccctgaccccacctcgccccgta

SEQ ID NO: 22877 - DNA, 36 bp, Artificial Sequence
  Synthetic oligonucleotide
gctgcccaatgtccatcgcgcacgtttcactgttta

SEQ ID NO: 22878 - DNA, 35 bp, Artificial Sequence
  Synthetic oligonucleotide
gataatacccctgtcgtctcccaccgccttttagc

SEQ ID NO: 22879 - DNA, 34 bp, Artificial Sequence
  Synthetic oligonucleotide
acactgcaccccaatttggccccagcaattacag

SEQ ID NO: 22880 - DNA, 35 bp, Artificial Sequence
  Synthetic oligonucleotide
atatgcgagggatggtagggcggtgaggtggagcg

SEQ ID NO: 22881 - DNA, 36 bp, Artificial Sequence
  Synthetic oligonucleotide
ggatagggagggtgtcagtagcatgaggaatggcgt

SEQ ID NO: 22882 - DNA, 35 bp, Artificial Sequence
  Synthetic oligonucleotide
aactccgatcactcgctacgacccgcactcccgca

SEQ ID NO: 22883 - DNA, 38 bp, Artificial Sequence
  Synthetic oligonucleotide
tgtcgcaggggggcaaagggaaaaatatcggatgatga

SEQ ID NO: 22884 - DNA, 38 bp, Artificial Sequence
  Synthetic oligonucleotide
ttaagcacgccccatgcctcccggcccaacccgtatga

SEQ ID NO: 22885 - DNA, 36 bp, Artificial Sequence
  Synthetic oligonucleotide
tagggtggtggtgggaaggccgcagacgcggtggta

SEQ ID NO: 22886 - DNA, 35 bp, Artificial Sequence
  Synthetic oligonucleotide
tcacgctgacggggcgatttgctcatctttggttc

SEQ ID NO: 22887 - DNA, 35 bp, Artificial Sequence
  Synthetic oligonucleotide
tactccttccgaaactcgtataatgtcacaatttc

SEQ ID NO: 22888 - DNA, 35 bp, Artificial Sequence
  Synthetic oligonucleotide
acaggtatgggggggttaaaatggggacttgggag

SEQ ID NO: 22889 - DNA, 36 bp, Artificial Sequence
  Synthetic oligonucleotide
tcaccttcgtaccgcttgcccctccgtgccaataaa

SEQ ID NO: 22890 - DNA, 36 bp, Artificial Sequence
  Synthetic oligonucleotide
gtgggcgcaccatcaatatgcaagtcttcctgtcca

SEQ ID NO: 22891 - DNA, 36 bp, Artificial Sequence
  Synthetic oligonucleotide
atcttgccacctccgagccttcaccggattccagga

SEQ ID NO: 22892 - DNA, 37 bp, Artificial Sequence
  Synthetic oligonucleotide
gaaaggagcggaactggaatgctgggggtggagtgga

SEQ ID NO: 22893 - DNA, 38 bp, Artificial Sequence
  Synthetic oligonucleotide
acacacttcaccgctggcccgacccacccatgatctga

SEQ ID NO: 22894 - DNA, 36 bp, Artificial Sequence
  Synthetic oligonucleotide
gactcctcaatgctgatgcgtgacccaccctgccta

SEQ ID NO: 22895 - DNA, 35 bp, Artificial Sequence
  Synthetic oligonucleotide
agagtgctaccgaattactgccttgcccgggttac

SEQ ID NO: 22896 - DNA, 35 bp, Artificial Sequence
  Synthetic oligonucleotide
gaccatcttgccgtgtattatttcccccgtgcctc

SEQ ID NO: 22897 - DNA, 34 bp, Artificial Sequence
  Synthetic oligonucleotide
tttgacgagcctccccaatgttacgaatcatttc

SEQ ID NO: 22898 - DNA, 35 bp, Artificial Sequence
  Synthetic oligonucleotide
ttgtgccctggcatgcgcacttctttacaatcccg

SEQ ID NO: 22899 - DNA, 36 bp, Artificial Sequence
  Synthetic oligonucleotide
ggacatatcgcctaccttttaccgagcacgtaacca

SEQ ID NO: 22900 - DNA, 36 bp, Artificial Sequence
  Synthetic oligonucleotide
gtagccgcagtcgacttcgttctctctatactttca

SEQ ID NO: 22901 - DNA, 38 bp, Artificial Sequence
  Synthetic oligonucleotide
tccagtgaggggacaggcgttagaggggggtggagtga

SEQ ID NO: 22902 - DNA, 35 bp, Artificial Sequence
  Synthetic oligonucleotide
tccaccttcggtttacgatcgccgttcgcatccta

SEQ ID NO: 22903 - DNA, 35 bp, Artificial Sequence
  Synthetic oligonucleotide
gtcacgcctttattcgggcccctctccgcactgac

SEQ ID NO: 22904 - DNA, 36 bp, Artificial Sequence
  Synthetic oligonucleotide
attccccgaacacgtaggtgctcgaactacacatcc

SEQ ID NO: 22905 - DNA, 35 bp, Artificial Sequence
  Synthetic oligonucleotide
gcaccgctcaatttttagcacctgaacacatcggc

SEQ ID NO: 22906 - DNA, 35 bp, Artificial Sequence
  Synthetic oligonucleotide
gcatggaactgagggagagagggtagaaagtcggg

SEQ ID NO: 22907 - DNA, 35 bp, Artificial Sequence
  Synthetic oligonucleotide
gcaccatcaagcgagtagcctgaccgttgaacctt

SEQ ID NO: 22908 - DNA, 36 bp, Artificial Sequence
  Synthetic oligonucleotide
acgccgcccccgccactagaacatgcctggtaataa

SEQ ID NO: 22909 - DNA, 36 bp, Artificial Sequence
  Synthetic oligonucleotide
acacatccccagcgggtacatacctaccctcaccca

SEQ ID NO: 22910 - DNA, 37 bp, Artificial Sequence
  Synthetic oligonucleotide
aactgactgcccttgacatatagcccctcgttaccga

SEQ ID NO: 22911 - DNA, 38 bp, Artificial Sequence
  Synthetic oligonucleotide
gcatgcgcaacatccgtccgcaccatcgcctataatga

SEQ ID NO: 22912 - DNA, 35 bp, Artificial Sequence
  Synthetic oligonucleotide
gaccacgtacgcgtttaccacttctatcactggaa

SEQ ID NO: 22913 - DNA, 35 bp, Artificial Sequence
  Synthetic oligonucleotide
tcaccacctgtgctcaatacctctgtgcgtagcca

SEQ ID NO: 22914 - DNA, 37 bp, Artificial Sequence
  Synthetic oligonucleotide
actcccgcacatgacctttattttcgacacttacgga

SEQ ID NO: 22915 - DNA, 37 bp, Artificial Sequence
  Synthetic oligonucleotide
tccgctggccgatcctcactaaagccaccctacttga

SEQ ID NO: 22916 - DNA, 35 bp, Artificial Sequence
  Synthetic oligonucleotide
tcatcactgtctttccgcgcatatatccctctgta

SEQ ID NO: 22917 - DNA, 35 bp, Artificial Sequence
  Synthetic oligonucleotide
atcgccaaggcgcacatccgtgcttgaacctaacc

SEQ ID NO: 22918 - DNA, 35 bp, Artificial Sequence
  Synthetic oligonucleotide
gacctacatacagtagggttcttctcttccccacc

SEQ ID NO: 22919 - DNA, 35 bp, Artificial Sequence
  Synthetic oligonucleotide
tgaccctcgaccttggtaggtcctttacttgctcc

SEQ ID NO: 22920 - DNA, 35 bp, Artificial Sequence
  Synthetic oligonucleotide
tgacttccccccgcatggagccgctaaccctttgc

SEQ ID NO: 22921 - DNA, 35 bp, Artificial Sequence
  Synthetic oligonucleotide
tgcgcttcccatcacattgaccagattactgcatc

SEQ ID NO: 22922 - DNA, 35 bp, Artificial Sequence
  Synthetic oligonucleotide
taccctcgcaccgatttcacctgctgtacgtcatc

SEQ ID NO: 22923 - DNA, 35 bp, Artificial Sequence
  Synthetic oligonucleotide
tcgctcacctcggcgttatagctggccgctccctc

SEQ ID NO: 22924 - DNA, 35 bp, Artificial Sequence
  Synthetic oligonucleotide
gtcactcgggccaccttctttatgtagtctgtttc

SEQ ID NO: 22925 - DNA, 35 bp, Artificial Sequence
  Synthetic oligonucleotide
accaagggggggtgtaatttctgggacggaagggg

SEQ ID NO: 22926 - DNA, 35 bp, Artificial Sequence
  Synthetic oligonucleotide
ttacggatcactaccccaccgttttgaattgcctg

SEQ ID NO: 22927 - DNA, 35 bp, Artificial Sequence
  Synthetic oligonucleotide
gttctcaaacaggccacctccccatggtgctatct

SEQ ID NO: 22928 - DNA, 35 bp, Artificial Sequence
  Synthetic oligonucleotide
tgaacaccgcgtttgtccgcctcttccaaatctgt

SEQ ID NO: 22929 - DNA, 35 bp, Artificial Sequence
  Synthetic oligonucleotide
cacatcctgcccccgagctacgagcctacttccaa

SEQ ID NO: 22930 - DNA, 36 bp, Artificial Sequence
  Synthetic oligonucleotide
ttgcacccacctcatattaaacggtcttacctcgca

SEQ ID NO: 22931 - DNA, 36 bp, Artificial Sequence
  Synthetic oligonucleotide
gagagcgcactctggtttcaggcatctttactctca

SEQ ID NO: 22932 - DNA, 38 bp, Artificial Sequence
  Synthetic oligonucleotide
gagcaatcccatgacatagcacctgttccccctcgtga

SEQ ID NO: 22933 - DNA, 37 bp, Artificial Sequence
  Synthetic oligonucleotide
gacacggggctttgtctggctgctcccttttctgtga

SEQ ID NO: 22934 - DNA, 35 bp, Artificial Sequence
  Synthetic oligonucleotide
gtcgcgcgcatcccctcttcattagcagtttcatc

SEQ ID NO: 22935 - DNA, 35 bp, Artificial Sequence
  Synthetic oligonucleotide
ggtggattagggaagaagggtgggtaaagacctgg

SEQ ID NO: 22936 - DNA, 35 bp, Artificial Sequence
  Synthetic oligonucleotide
accttagcctttccagacctgtcctttctccacaa

SEQ ID NO: 22937 - DNA, 36 bp, Artificial Sequence
  Synthetic oligonucleotide
gtaaccttccgtagccagcccctggtaccccccgaa

SEQ ID NO: 22938 - DNA, 35 bp, Artificial Sequence
  Synthetic oligonucleotide
tgtcactctcacaccctctttggtgaatgtttcca

SEQ ID NO: 22939 - DNA, 35 bp, Artificial Sequence
  Synthetic oligonucleotide
gtacaggcacggtagggtgacggggagggcgagga

SEQ ID NO: 22940 - DNA, 38 bp, Artificial Sequence
  Synthetic oligonucleotide
ttgcgtggtccgcgcgttaaactactcacccaccctga

SEQ ID NO: 22941 - DNA, 37 bp, Artificial Sequence
  Synthetic oligonucleotide
gaggaggggacaacattgtacagtagggaggtattga

SEQ ID NO: 22942 - DNA, 38 bp, Artificial Sequence
  Synthetic oligonucleotide
acaacgtcatttgtacctcgttcctgcccggcccttga

SEQ ID NO: 22943 - DNA, 35 bp, Artificial Sequence
  Synthetic oligonucleotide
gatcatgttcgctctatgcttgcaattggcccatc

SEQ ID NO: 22944 - DNA, 35 bp, Artificial Sequence
  Synthetic oligonucleotide
aactatcagcccatctctccacccatacgtagtgg

SEQ ID NO: 22945 - DNA, 35 bp, Artificial Sequence
  Synthetic oligonucleotide
taaatcgccatgtccttctcagtgcctgccccgct

SEQ ID NO: 22946 - DNA, 36 bp, Artificial Sequence
  Synthetic oligonucleotide
actcgcatatcgggtctgagcgtttttcttgcccca

SEQ ID NO: 22947 - DNA, 37 bp, Artificial Sequence
  Synthetic oligonucleotide
gccaaacactgcgcccactactgaagtacctcttcga

SEQ ID NO: 22948 - DNA, 38 bp, Artificial Sequence
  Synthetic oligonucleotide
atgtgcacgcgcacgtctgcacattgccactgttgtga

SEQ ID NO: 22949 - DNA, 35 bp, Artificial Sequence
  Synthetic oligonucleotide
gggacagtagcgcaaaaggggtgggggaagggtta

SEQ ID NO: 22950 - DNA, 35 bp, Artificial Sequence
  Synthetic oligonucleotide
tgtccagcttttgccacatgtcgtccatctgtttc

SEQ ID NO: 22951 - DNA, 35 bp, Artificial Sequence
  Synthetic oligonucleotide
tacatgcaatcacctcgcacacgacttactgctct

SEQ ID NO: 22952 - DNA, 37 bp, Artificial Sequence
  Synthetic oligonucleotide
ttccaccctcagacgctacataatcctaaccgatcga

SEQ ID NO: 22953 - DNA, 37 bp, Artificial Sequence
  Synthetic oligonucleotide
atcccactgccacaacttataactgtcatcacgcgga

SEQ ID NO: 22954 - DNA, 37 bp, Artificial Sequence
  Synthetic oligonucleotide
tacatccgaacggtttctggctcactcttccctctga

SEQ ID NO: 22955 - DNA, 38 bp, Artificial Sequence
  Synthetic oligonucleotide
gagtgagccctcgcccgcccccatagctacaggcttga

SEQ ID NO: 22956 - DNA, 36 bp, Artificial Sequence
  Synthetic oligonucleotide
taatccacctgcacacatcccaccgccagtttggta

SEQ ID NO: 22957 - DNA, 35 bp, Artificial Sequence
  Synthetic oligonucleotide
taatccactctagcccgtgaacttcgctgacctat

SEQ ID NO: 22958 - DNA, 35 bp, Artificial Sequence
  Synthetic oligonucleotide
gtgcccaggccgcctcctcatcgccagtcaacact

SEQ ID NO: 22959 - DNA, 36 bp, Artificial Sequence
  Synthetic oligonucleotide
tacacgcttggcgtgacttccttacacttttctgaa

SEQ ID NO: 22960 - DNA, 36 bp, Artificial Sequence
  Synthetic oligonucleotide
tacagtgggggaggggggtcgctggggcatgaaaca

SEQ ID NO: 22961 - DNA, 35 bp, Artificial Sequence
  Synthetic oligonucleotide
atgcatgtcgcaccacgtcgccattatatgccacc

SEQ ID NO: 22962 - DNA, 35 bp, Artificial Sequence
  Synthetic oligonucleotide
gagcgcacagaaggccactaatctgtgcttgatcc

SEQ ID NO: 22963 - DNA, 36 bp, Artificial Sequence
  Synthetic oligonucleotide
gcgattgcacgctccttgtctctgcattggcttaat

SEQ ID NO: 22964 - DNA, 36 bp, Artificial Sequence
  Synthetic oligonucleotide
ttacgcacggctccgttccctgtacaatcccggcca

SEQ ID NO: 22965 - DNA, 36 bp, Artificial Sequence
  Synthetic oligonucleotide
atctacctcgatgatttccacctttgcccgttggca

SEQ ID NO: 22966 - DNA, 37 bp, Artificial Sequence
  Synthetic oligonucleotide
tccccaacatgctgtacattttagccctcacttccga

SEQ ID NO: 22967 - DNA, 35 bp, Artificial Sequence
  Synthetic oligonucleotide
gagggaccataggggagcatggagaacgtgaggga

SEQ ID NO: 22968 - DNA, 38 bp, Artificial Sequence
  Synthetic oligonucleotide
agccacgccaacccggttacccacacattctgtcatga

SEQ ID NO: 22969 - DNA, 38 bp, Artificial Sequence
  Synthetic oligonucleotide
tcgcaccatcaccttacttcaggagcttctacatctga

SEQ ID NO: 22970 - DNA, 38 bp, Artificial Sequence
  Synthetic oligonucleotide
tcagacaccggcctggaaactgcgtgccttctttttga

SEQ ID NO: 22971 - DNA, 36 bp, Artificial Sequence
  Synthetic oligonucleotide
ggatcacccgttactttgatacgtgcctcctcctta

SEQ ID NO: 22972 - DNA, 36 bp, Artificial Sequence
  Synthetic oligonucleotide
gtggcctcactcaagtactttggtccgaatcgctta

SEQ ID NO: 22973 - DNA, 35 bp, Artificial Sequence
  Synthetic oligonucleotide
aacactcggttagatgacctcctccgctgtcaccg

SEQ ID NO: 22974 - DNA, 35 bp, Artificial Sequence
  Synthetic oligonucleotide
atggtcggaaggagggctaggactgacgggggcgg

SEQ ID NO: 22975 - DNA, 36 bp, Artificial Sequence
  Synthetic oligonucleotide
gtgagtgtcggaaagtgggggatgtaggtagggtgg

SEQ ID NO: 22976 - DNA, 35 bp, Artificial Sequence
  Synthetic oligonucleotide
accgcaaaacattctgtcgttaattctgctccgtt

SEQ ID NO: 22977 - DNA, 36 bp, Artificial Sequence
  Synthetic oligonucleotide
ggagccctcgatcttactctttgcgacctgctacca

SEQ ID NO: 22978 - DNA, 37 bp, Artificial Sequence
  Synthetic oligonucleotide
taaggcgggggtcggaggacacaacaaggggtggaga

SEQ ID NO: 22979 - DNA, 37 bp, Artificial Sequence
  Synthetic oligonucleotide
tggtagacctgccaccgccttctcttgttcaagccga

SEQ ID NO: 22980 - DNA, 35 bp, Artificial Sequence
  Synthetic oligonucleotide
gcgacgacaattctctagccgcaccgaacccaccc

SEQ ID NO: 22981 - DNA, 35 bp, Artificial Sequence
  Synthetic oligonucleotide
agcacgccgaccgatcccttatcaatgtctttgcc

SEQ ID NO: 22982 - DNA, 35 bp, Artificial Sequence
  Synthetic oligonucleotide
agcacagcgaaagtcccgcttacccttcgtttgtc

SEQ ID NO: 22983 - DNA, 35 bp, Artificial Sequence
  Synthetic oligonucleotide
tgcaagacccccacgccttttccccgcactggttc

SEQ ID NO: 22984 - DNA, 31 bp, Artificial Sequence
  Synthetic oligonucleotide
ttcccgccccggtcctccggttctcatccca

SEQ ID NO: 22985 - DNA, 35 bp, Artificial Sequence
  Synthetic oligonucleotide
ttcccccgcttactggcatgtgcacaacctttcga

SEQ ID NO: 22986 - DNA, 37 bp, Artificial Sequence
  Synthetic oligonucleotide
gcctcccccccagagcatcatgccgcagggcccctga

SEQ ID NO: 22987 - DNA, 38 bp, Artificial Sequence
  Synthetic oligonucleotide
gacggggagcacgggtaagtttggacgggtgagagtga

SEQ ID NO: 22988 - DNA, 35 bp, Artificial Sequence
  Synthetic oligonucleotide
tacccacgcacctccgccccatgagctacactatc

SEQ ID NO: 22989 - DNA, 35 bp, Artificial Sequence
  Synthetic oligonucleotide
tttccctgcccgttggctacatcacaaatcctgtc

SEQ ID NO: 22990 - DNA, 35 bp, Artificial Sequence
  Synthetic oligonucleotide
ggagcacgcacatcggcatttcgcactacgctatt

SEQ ID NO: 22991 - DNA, 36 bp, Artificial Sequence
  Synthetic oligonucleotide
gtcttccgtcacacacacttctgcggtccagtagca

SEQ ID NO: 22992 - DNA, 37 bp, Artificial Sequence
  Synthetic oligonucleotide
tcgcatcactgaacgacaccgtaaccccctctctcga

SEQ ID NO: 22993 - DNA, 38 bp, Artificial Sequence
  Synthetic oligonucleotide
gcgggggtaggctgggtgggtgggttacgtagatgtga

SEQ ID NO: 22994 - DNA, 35 bp, Artificial Sequence
  Synthetic oligonucleotide
tcggaggccatccatcaccctatcgcccctgccac

SEQ ID NO: 22995 - DNA, 35 bp, Artificial Sequence
  Synthetic oligonucleotide
gaatggtcgaggcttattatcctgccatatctttc

SEQ ID NO: 22996 - DNA, 35 bp, Artificial Sequence
  Synthetic oligonucleotide
tcctggctcacattctgccgataccgattacttcg

SEQ ID NO: 22997 - DNA, 35 bp, Artificial Sequence
  Synthetic oligonucleotide
gtacccaacacgactattacacgttcctcccaggt

SEQ ID NO: 22998 - DNA, 35 bp, Artificial Sequence
  Synthetic oligonucleotide
taagctgatcagcacttaagctgcccttccctctt

SEQ ID NO: 22999 - DNA, 36 bp, Artificial Sequence
  Synthetic oligonucleotide
accccgcgcctattaaactacactgcctcgacgaca

SEQ ID NO: 23000 - DNA, 36 bp, Artificial Sequence
  Synthetic oligonucleotide
agccaacgcacacctgatgatcaagcttcgccacca

SEQ ID NO: 23001 - DNA, 36 bp, Artificial Sequence
  Synthetic oligonucleotide
tccgccctaaagacgtctcctcccttcccgatgcca

SEQ ID NO: 23002 - DNA, 37 bp, Artificial Sequence
  Synthetic oligonucleotide
acaactgtgccccttcatctgcgattaagcctttcga

SEQ ID NO: 23003 - DNA, 35 bp, Artificial Sequence
  Synthetic oligonucleotide
gttgcggaaaagggctactgagtggaattggtgga

SEQ ID NO: 23004 - DNA, 38 bp, Artificial Sequence
  Synthetic oligonucleotide
tctcaaccccgaccgtagttgccaccagtgctccctga

SEQ ID NO: 23005 - DNA, 38 bp, Artificial Sequence
  Synthetic oligonucleotide
ggaggacgagggctgaggcgaaagaaagcgcgtcttga

SEQ ID NO: 23006 - DNA, 35 bp, Artificial Sequence
  Synthetic oligonucleotide
tcttggcactcagctatccgtcaaagtcccgtttc

SEQ ID NO: 23007 - DNA, 35 bp, Artificial Sequence
  Synthetic oligonucleotide
accgtccacaagcatatgtttacacctgaaaccct

SEQ ID NO: 23008 - DNA, 35 bp, Artificial Sequence
  Synthetic oligonucleotide
gccacgcccttcccccagcgattaccccgtccatt

SEQ ID NO: 23009 - DNA, 36 bp, Artificial Sequence
  Synthetic oligonucleotide
tgttgtgggtgaagtgggcggggaaggtgggcggaa

SEQ ID NO: 23010 - DNA, 35 bp, Artificial Sequence
  Synthetic oligonucleotide
taccgtgctcagcgatccgtccgccctttgaccca

SEQ ID NO: 23011 - DNA, 37 bp, Artificial Sequence
  Synthetic oligonucleotide
gccacacaccgctgtacgccacaacttccaggcggga

SEQ ID NO: 23012 - DNA, 37 bp, Artificial Sequence
  Synthetic oligonucleotide
tagaggggggggcgggttagtaggaccaagaattgga

SEQ ID NO: 23013 - DNA, 35 bp, Artificial Sequence
  Synthetic oligonucleotide
accctatggggtgacccatccgccagtactacccc

SEQ ID NO: 23014 - DNA, 35 bp, Artificial Sequence
  Synthetic oligonucleotide
tcccgactgttgcacactcacacttgcacccacgc

SEQ ID NO: 23015 - DNA, 35 bp, Artificial Sequence
  Synthetic oligonucleotide
gagagggccggttgcttcaatctttcacactcgtt

SEQ ID NO: 23016 - DNA, 36 bp, Artificial Sequence
  Synthetic oligonucleotide
gagcacgcacacctacagttccctcactgcatcaca

SEQ ID NO: 23017 - DNA, 35 bp, Artificial Sequence
  Synthetic oligonucleotide
gccactcgacagttacacacctcaggccacaccca

SEQ ID NO: 23018 - DNA, 36 bp, Artificial Sequence
  Synthetic oligonucleotide
tctcaatgagcgtgctttctgctttgtcatccctca

SEQ ID NO: 23019 - DNA, 35 bp, Artificial Sequence
  Synthetic oligonucleotide
aaccaccgcgttctccccttcgtaccaccgaccga

SEQ ID NO: 23020 - DNA, 36 bp, Artificial Sequence
  Synthetic oligonucleotide
acacctcaagttggctccgaaggccaatctcctcga

SEQ ID NO: 23021 - DNA, 38 bp, Artificial Sequence
  Synthetic oligonucleotide
gcaagaagaatgggtggagtgggcgtccccttgggtga

SEQ ID NO: 23022 - DNA, 38 bp, Artificial Sequence
  Synthetic oligonucleotide
cacaccccgaccctctgaactacggtctgtccatttga

SEQ ID NO: 23023 - DNA, 35 bp, Artificial Sequence
  Synthetic oligonucleotide
atgcacttcgcccgatccatgccgcacaatagcta

SEQ ID NO: 23024 - DNA, 36 bp, Artificial Sequence
  Synthetic oligonucleotide
gcgaacgtgatcacattgccctttgcactactggta

SEQ ID NO: 23025 - DNA, 35 bp, Artificial Sequence
  Synthetic oligonucleotide
gttaccgactatgtatcacccgcgtgtttcccacc

SEQ ID NO: 23026 - DNA, 35 bp, Artificial Sequence
  Synthetic oligonucleotide
gcgatgcccttctctaatcggtgtcctccccagtc

SEQ ID NO: 23027 - DNA, 35 bp, Artificial Sequence
  Synthetic oligonucleotide
gtgagacgaaagtggagggattgtggctagtttgg

SEQ ID NO: 23028 - DNA, 35 bp, Artificial Sequence
  Synthetic oligonucleotide
gtcccaccgaacacgggcactgtaaactatctatt

SEQ ID NO: 23029 - DNA, 35 bp, Artificial Sequence
  Synthetic oligonucleotide
gataaccacgacctgctcgccaaggagacacattt

SEQ ID NO: 23030 - DNA, 36 bp, Artificial Sequence
  Synthetic oligonucleotide
ttctgccccggataacctttgtaacgcgccccacaa

SEQ ID NO: 23031 - DNA, 36 bp, Artificial Sequence
  Synthetic oligonucleotide
tacatcacgccctaatgcatatctacacccaaatca

SEQ ID NO: 23032 - DNA, 36 bp, Artificial Sequence
  Synthetic oligonucleotide
atgcggtctcgcataccacttctatcatagggctca

SEQ ID NO: 23033 - DNA, 36 bp, Artificial Sequence
  Synthetic oligonucleotide
gagggaacgcagtggatcggggcgggtggaagcgga

SEQ ID NO: 23034 - DNA, 37 bp, Artificial Sequence
  Synthetic oligonucleotide
ggagggggagagtaggtggggtcgttcctacagggga

SEQ ID NO: 23035 - DNA, 37 bp, Artificial Sequence
  Synthetic oligonucleotide
aagggttgagctggggcacaggaaacgggatggggga

SEQ ID NO: 23036 - DNA, 37 bp, Artificial Sequence
  Synthetic oligonucleotide
ttgtgggggaaggtagggcacaagggacgacagtgga

SEQ ID NO: 23037 - DNA, 38 bp, Artificial Sequence
  Synthetic oligonucleotide
tccgaatctgcccgccgtgacgttcttttcctaactga

SEQ ID NO: 23038 - DNA, 38 bp, Artificial Sequence
  Synthetic oligonucleotide
tcccactaccgtgttcgtaacctcgatcctccccctga

SEQ ID NO: 23039 - DNA, 38 bp, Artificial Sequence
  Synthetic oligonucleotide
accaaccgcagccggcaacctctctgttcatcccctga

SEQ ID NO: 23040 - DNA, 36 bp, Artificial Sequence
  Synthetic oligonucleotide
gacagggccgtattgcgcaagccctcacttcccata

SEQ ID NO: 23041 - DNA, 35 bp, Artificial Sequence
  Synthetic oligonucleotide
gcttgcaccacttacggttcgatcctccttgcacc

SEQ ID NO: 23042 - DNA, 35 bp, Artificial Sequence
  Synthetic oligonucleotide
gttggtcgccgccccaccgtgcctgcaatttattc

SEQ ID NO: 23043 - DNA, 36 bp, Artificial Sequence
  Synthetic oligonucleotide
ggagcaaatcgcagcgctcgtctacccccgcttttc

SEQ ID NO: 23044 - DNA, 35 bp, Artificial Sequence
  Synthetic oligonucleotide
gccagttggtagtctctgcttttcgctcctttttg

SEQ ID NO: 23045 - DNA, 35 bp, Artificial Sequence
  Synthetic oligonucleotide
gaactgcgcctcataatcatactgctcggctccca

SEQ ID NO: 23046 - DNA, 37 bp, Artificial Sequence
  Synthetic oligonucleotide
gccacacttgttcccgatatcctctacagaccgccga

SEQ ID NO: 23047 - DNA, 37 bp, Artificial Sequence
  Synthetic oligonucleotide
gcttgccctcagcgctaccacgattcaaccttgccga

SEQ ID NO: 23048 - DNA, 38 bp, Artificial Sequence
  Synthetic oligonucleotide
gttgcacgcacacctcataccagccccggtttacctga

SEQ ID NO: 23049 - DNA, 34 bp, Artificial Sequence
  Synthetic oligonucleotide
gtcccgtgccctcccttaaagagctctctatcac

SEQ ID NO: 23050 - DNA, 35 bp, Artificial Sequence
  Synthetic oligonucleotide
gatttaactcgccccactgccagctttcaagcgcc

SEQ ID NO: 23051 - DNA, 35 bp, Artificial Sequence
  Synthetic oligonucleotide
gccatccagcgcgctattcctgtttctaggcctgc

SEQ ID NO: 23052 - DNA, 35 bp, Artificial Sequence
  Synthetic oligonucleotide
gatgcactgggcctttcacggttagccgtaacctc

SEQ ID NO: 23053 - DNA, 35 bp, Artificial Sequence
  Synthetic oligonucleotide
gtcctaactgccctatgctgccctgagcttcgtct

SEQ ID NO: 23054 - DNA, 35 bp, Artificial Sequence
  Synthetic oligonucleotide
gtagtgggttatgaggggaagggagtgtgcgtggt

SEQ ID NO: 23055 - DNA, 36 bp, Artificial Sequence
  Synthetic oligonucleotide
ggtcatgggtgggcgcaagggcggggcggtgtgaca

SEQ ID NO: 23056 - DNA, 35 bp, Artificial Sequence
  Synthetic oligonucleotide
accgccaacggggtccatcgcatattctccgtcca

SEQ ID NO: 23057 - DNA, 35 bp, Artificial Sequence
  Synthetic oligonucleotide
caccccatcccggctacctcactgcccgtgtcgca

SEQ ID NO: 23058 - DNA, 36 bp, Artificial Sequence
  Synthetic oligonucleotide
aaccatgcagccgtccttcctcactctatggcttca

SEQ ID NO: 23059 - DNA, 37 bp, Artificial Sequence
  Synthetic oligonucleotide
gaccagacttgcaaccctgtattccaccgcttatcga

SEQ ID NO: 23060 - DNA, 38 bp, Artificial Sequence
  Synthetic oligonucleotide
acccatacaccgatctctttgggccactaacgtagtga

SEQ ID NO: 23061 - DNA, 38 bp, Artificial Sequence
  Synthetic oligonucleotide
gtgtacagcctcccctgtctctgaaccttctgtcttga

SEQ ID NO: 23062 - DNA, 35 bp, Artificial Sequence
  Synthetic oligonucleotide
gcaccgtacgcgtgcacacctctgctaccaaacac

SEQ ID NO: 23063 - DNA, 34 bp, Artificial Sequence
  Synthetic oligonucleotide
tgcgccatctgcaagtactcatgttacacacccc

SEQ ID NO: 23064 - DNA, 35 bp, Artificial Sequence
  Synthetic oligonucleotide
gaggagtacgggagggtgggaatcgtcctgttggc

SEQ ID NO: 23065 - DNA, 35 bp, Artificial Sequence
  Synthetic oligonucleotide
ggagtggggggtggagatatatgatcggcattggg

SEQ ID NO: 23066 - DNA, 35 bp, Artificial Sequence
  Synthetic oligonucleotide
tatgcgacctgctctgcccgcaaccttccccgtat

SEQ ID NO: 23067 - DNA, 35 bp, Artificial Sequence
  Synthetic oligonucleotide
gatgccctgccacactctgacttgtaacaggtact

SEQ ID NO: 23068 - DNA, 35 bp, Artificial Sequence
  Synthetic oligonucleotide
gccctcgacatctttcgtttctgactatacgccct

SEQ ID NO: 23069 - DNA, 35 bp, Artificial Sequence
  Synthetic oligonucleotide
ggacaaacgaaaccacgctgcatgcctattgccct

SEQ ID NO: 23070 - DNA, 35 bp, Artificial Sequence
  Synthetic oligonucleotide
cctcacctccggtcacgttgtctccctttaggcct

SEQ ID NO: 23071 - DNA, 36 bp, Artificial Sequence
  Synthetic oligonucleotide
aacaagctgcctagcgagtcccagccgcattccaca

SEQ ID NO: 23072 - DNA, 36 bp, Artificial Sequence
  Synthetic oligonucleotide
acactgcccaccgaggcgacacgacctgtaatccca

SEQ ID NO: 23073 - DNA, 37 bp, Artificial Sequence
  Synthetic oligonucleotide
gatggggagcaggaatgcgggcaggttgggaaaagga

SEQ ID NO: 23074 - DNA, 37 bp, Artificial Sequence
  Synthetic oligonucleotide
acgtgaggccccgcatcctgttcaatcctccacatga

SEQ ID NO: 23075 - DNA, 35 bp, Artificial Sequence
  Synthetic oligonucleotide
acatccgctcgatccccttctctcattgcctttga

SEQ ID NO: 23076 - DNA, 36 bp, Artificial Sequence
  Synthetic oligonucleotide
tccatcaacaatcgtggctctggaaccaacactata

SEQ ID NO: 23077 - DNA, 35 bp, Artificial Sequence
  Synthetic oligonucleotide
gccgggtacatcgatttctttgccaggcatcttcc

SEQ ID NO: 23078 - DNA, 35 bp, Artificial Sequence
  Synthetic oligonucleotide
ttcaccttgtccctgatgtccttgttatcgtctgc

SEQ ID NO: 23079 - DNA, 35 bp, Artificial Sequence
  Synthetic oligonucleotide
atccatgcccggcattccagcacagtaatctaccg

SEQ ID NO: 23080 - DNA, 35 bp, Artificial Sequence
  Synthetic oligonucleotide
gttcccatgccgagaacatcggagatttaacacct

SEQ ID NO: 23081 - DNA, 35 bp, Artificial Sequence
  Synthetic oligonucleotide
aactgcctagcccgcacgccccgtagcgttccgct

SEQ ID NO: 23082 - DNA, 36 bp, Artificial Sequence
  Synthetic oligonucleotide
ggtcgagcacgcaatggtacaactcctcccgtccca

SEQ ID NO: 23083 - DNA, 37 bp, Artificial Sequence
  Synthetic oligonucleotide
gacactccacacatccactccagactacaggtcggga

SEQ ID NO: 23084 - DNA, 36 bp, Artificial Sequence
  Synthetic oligonucleotide
accgacacgttacccgatattcctttgccaggtgga

SEQ ID NO: 23085 - DNA, 38 bp, Artificial Sequence
  Synthetic oligonucleotide
gcagacgacacgggtgggagcggcggggaacaatatga

SEQ ID NO: 23086 - DNA, 37 bp, Artificial Sequence
  Synthetic oligonucleotide
acccgctcccgagaatccagcactcctgctttactga

SEQ ID NO: 23087 - DNA, 38 bp, Artificial Sequence
  Synthetic oligonucleotide
acccgcggccacccctgaatgtgctgctcccactttga

SEQ ID NO: 23088 - DNA, 35 bp, Artificial Sequence
  Synthetic oligonucleotide
gtttacgcagctgcccccgaccacaccgaacaata

SEQ ID NO: 23089 - DNA, 35 bp, Artificial Sequence
  Synthetic oligonucleotide
gtgaccatgtcttggttatacgtactcatttccac

SEQ ID NO: 23090 - DNA, 35 bp, Artificial Sequence
  Synthetic oligonucleotide
tccagtccccgttcacccacactctagcgctttag

SEQ ID NO: 23091 - DNA, 35 bp, Artificial Sequence
  Synthetic oligonucleotide
gatggcaccccgctaccccagctccctccgacccg

SEQ ID NO: 23092 - DNA, 35 bp, Artificial Sequence
  Synthetic oligonucleotide
atagctcatgagggctggggggacggttaggaagg

SEQ ID NO: 23093 - DNA, 35 bp, Artificial Sequence
  Synthetic oligonucleotide
tactaggcgccatctcacttccccaggcccttgtg

SEQ ID NO: 23094 - DNA, 35 bp, Artificial Sequence
  Synthetic oligonucleotide
cctcacctccggtcacgttgtctcccgttaggcat

SEQ ID NO: 23095 - DNA, 35 bp, Artificial Sequence
  Synthetic oligonucleotide
gtaacatcgcgggcctgttcttcggtaaatttgct

SEQ ID NO: 23096 - DNA, 35 bp, Artificial Sequence
  Synthetic oligonucleotide
atccgaggctccccgtttcatgcacatcacctggt

SEQ ID NO: 23097 - DNA, 36 bp, Artificial Sequence
  Synthetic oligonucleotide
aaatacggcggcccatctgcccccttgcgcaacgaa

SEQ ID NO: 23098 - DNA, 35 bp, Artificial Sequence
  Synthetic oligonucleotide
aacccggagcccgtaatctgactatttttcacgca

SEQ ID NO: 23099 - DNA, 37 bp, Artificial Sequence
  Synthetic oligonucleotide
acaagcgcacaccgtacgacatctcctcacatctcga

SEQ ID NO: 23100 - DNA, 36 bp, Artificial Sequence
  Synthetic oligonucleotide
gtaccgctcccatcccgaaaacgtacgacctttcga

SEQ ID NO: 23101 - DNA, 38 bp, Artificial Sequence
  Synthetic oligonucleotide
gaacagacttacccggcgcgcctcccacctgcacctga

SEQ ID NO: 23102 - DNA, 38 bp, Artificial Sequence
  Synthetic oligonucleotide
gaaacggactgctaaaaaggcaggaggagagtacctga

SEQ ID NO: 23103 - DNA, 38 bp, Artificial Sequence
  Synthetic oligonucleotide
atgcgccggcgcgaccccccccagctgccctgaattga

SEQ ID NO: 23104 - DNA, 38 bp, Artificial Sequence
  Synthetic oligonucleotide
gcagactctcgtgccagtagttccctcccccgtgttga

SEQ ID NO: 23105 - DNA, 35 bp, Artificial Sequence
  Synthetic oligonucleotide
atttgccgcgtgtaagctcctataccgtcacacac

SEQ ID NO: 23106 - DNA, 35 bp, Artificial Sequence
  Synthetic oligonucleotide
gcacactacaagggttacttccatcccagccgccc

SEQ ID NO: 23107 - DNA, 35 bp, Artificial Sequence
  Synthetic oligonucleotide
gccattatcgccctttgaacgcaagctatttactg

SEQ ID NO: 23108 - DNA, 36 bp, Artificial Sequence
  Synthetic oligonucleotide
aatgtcaaaggcggggtgagtggaggagggttggaa

SEQ ID NO: 23109 - DNA, 35 bp, Artificial Sequence
  Synthetic oligonucleotide
agacggccggagagggcctcattcaccaccattca

SEQ ID NO: 23110 - DNA, 37 bp, Artificial Sequence
  Synthetic oligonucleotide
ggtgagggaggtagccatggtagtcatgggatgggga

SEQ ID NO: 23111 - DNA, 37 bp, Artificial Sequence
  Synthetic oligonucleotide
accggggggcaggtggcggggacgagtaagggtggga

SEQ ID NO: 23112 - DNA, 35 bp, Artificial Sequence
  Synthetic oligonucleotide
gatcggtgccggactcgacacaaaccctgccctcc

SEQ ID NO: 23113 - DNA, 35 bp, Artificial Sequence
  Synthetic oligonucleotide
ttccattcgggcacacaccatctgtcctgctcttt

SEQ ID NO: 23114 - DNA, 36 bp, Artificial Sequence
  Synthetic oligonucleotide
tgacatcgcccccgatcggccagactattaccccca

SEQ ID NO: 23115 - DNA, 36 bp, Artificial Sequence
  Synthetic oligonucleotide
gtaccattcggcaaatatgctacctgcgccctgcca

SEQ ID NO: 23116 - DNA, 36 bp, Artificial Sequence
  Synthetic oligonucleotide
ataccccccgtgagagccagtgattaccaccgccga

SEQ ID NO: 23117 - DNA, 38 bp, Artificial Sequence
  Synthetic oligonucleotide
accacccgcgcagctaccaccgatcccgcctgcgctga

SEQ ID NO: 23118 - DNA, 36 bp, Artificial Sequence
  Synthetic oligonucleotide
tcacccggtctcacccatagtcgttatctcctctta

SEQ ID NO: 23119 - DNA, 35 bp, Artificial Sequence
  Synthetic oligonucleotide
actcgcggccagtccaatcacagctcacctataac

SEQ ID NO: 23120 - DNA, 35 bp, Artificial Sequence
  Synthetic oligonucleotide
gcagccaccgttgcgctcctccggtccactccaat

SEQ ID NO: 23121 - DNA, 35 bp, Artificial Sequence
  Synthetic oligonucleotide
gtccgggccgggctcctctccttatcaacgaccat

SEQ ID NO: 23122 - DNA, 35 bp, Artificial Sequence
  Synthetic oligonucleotide
acccatgagcttcagacttttggcacaacctctct

SEQ ID NO: 23123 - DNA, 36 bp, Artificial Sequence
  Synthetic oligonucleotide
gccgacagggcaatcccatctctacatactgtacca

SEQ ID NO: 23124 - DNA, 37 bp, Artificial Sequence
  Synthetic oligonucleotide
accacactctgctgctagtaactatttaccactggga

SEQ ID NO: 23125 - DNA, 38 bp, Artificial Sequence
  Synthetic oligonucleotide
tgaaccccacgcaccattgcactgtaccctcacagtga

SEQ ID NO: 23126 - DNA, 36 bp, Artificial Sequence
  Synthetic oligonucleotide
acatcggtcactccactgaatatcgcaccttcctaa

SEQ ID NO: 23127 - DNA, 35 bp, Artificial Sequence
  Synthetic oligonucleotide
gccgagccgcccagtcctgtccctgctgagcttca

SEQ ID NO: 23128 - DNA, 37 bp, Artificial Sequence
  Synthetic oligonucleotide
gagagccaccctgtgtcccacgataactcctcaccga

SEQ ID NO: 23129 - DNA, 37 bp, Artificial Sequence
  Synthetic oligonucleotide
gcactgtgggattgggtgggcgggaattcctaccgga

SEQ ID NO: 23130 - DNA, 38 bp, Artificial Sequence
  Synthetic oligonucleotide
gcggttcagcccgatcatctcattccacttgcctctga

SEQ ID NO: 23131 - DNA, 38 bp, Artificial Sequence
  Synthetic oligonucleotide
atcaccactcccgcgtgtagccccgacctgacctgtga

SEQ ID NO: 23132 - DNA, 36 bp, Artificial Sequence
  Synthetic oligonucleotide
gtccgatcgctccccagaaagttgatcttgcaaata

SEQ ID NO: 23133 - DNA, 35 bp, Artificial Sequence
  Synthetic oligonucleotide
gcgtggcccatctcccgtatctggtttgtcagcac

SEQ ID NO: 23134 - DNA, 35 bp, Artificial Sequence
  Synthetic oligonucleotide
tctgagctgcttggtgcgtcgtccactcttattac

SEQ ID NO: 23135 - DNA, 35 bp, Artificial Sequence
  Synthetic oligonucleotide
gccgacttatccgccatgccgatcgacaaacatgc

SEQ ID NO: 23136 - DNA, 35 bp, Artificial Sequence
  Synthetic oligonucleotide
gctaaaggtgggagggtgtgccgacacggtggggg

SEQ ID NO: 23137 - DNA, 34 bp, Artificial Sequence
  Synthetic oligonucleotide
caccccccatctacccgtccccctgtgagatatt

SEQ ID NO: 23138 - DNA, 36 bp, Artificial Sequence
  Synthetic oligonucleotide
atatcgcccctccagacatgaaccattttagcctaa

SEQ ID NO: 23139 - DNA, 36 bp, Artificial Sequence
  Synthetic oligonucleotide
tccagactatccattcgctgtacgccgttctcctaa

SEQ ID NO: 23140 - DNA, 36 bp, Artificial Sequence
  Synthetic oligonucleotide
tccatgaaatgctcatcacgactacgcctcgacgca

SEQ ID NO: 23141 - DNA, 36 bp, Artificial Sequence
  Synthetic oligonucleotide
gctggtctcatacgctctcacagctgttcccactca

SEQ ID NO: 23142 - DNA, 37 bp, Artificial Sequence
  Synthetic oligonucleotide
acccgtacgttctatctgtcttcatcctccgtttgga

SEQ ID NO: 23143 - DNA, 37 bp, Artificial Sequence
  Synthetic oligonucleotide
tcgcatagcccgccggtctcaagttccttttccctga

SEQ ID NO: 23144 - DNA, 36 bp, Artificial Sequence
  Synthetic oligonucleotide
tctcgaccttgcgtacgcactccgacctcctgtcta

SEQ ID NO: 23145 - DNA, 32 bp, Artificial Sequence
  Synthetic oligonucleotide
gacccacacaggggtccctagtacgacgactc

SEQ ID NO: 23146 - DNA, 35 bp, Artificial Sequence
  Synthetic oligonucleotide
acactccgaaaggttgtactgtatgtttcccgctc

SEQ ID NO: 23147 - DNA, 35 bp, Artificial Sequence
  Synthetic oligonucleotide
gcataacatctgacctgtgctcatgcttgcttctc

SEQ ID NO: 23148 - DNA, 35 bp, Artificial Sequence
  Synthetic oligonucleotide
tcaaactaagtgacgagggataggtggtggtcgag

SEQ ID NO: 23149 - DNA, 35 bp, Artificial Sequence
  Synthetic oligonucleotide
gcacaccttcgagccccctgtcaatttccggagca

SEQ ID NO: 23150 - DNA, 36 bp, Artificial Sequence
  Synthetic oligonucleotide
tgagcaccacgaatctgttcttttagggcttcatca

SEQ ID NO: 23151 - DNA, 37 bp, Artificial Sequence
  Synthetic oligonucleotide
cgcacgtactcgccgatttttggactctactacagga

SEQ ID NO: 23152 - DNA, 36 bp, Artificial Sequence
  Synthetic oligonucleotide
tacgtaccatctgcccagacgtaggtcgatacctga

SEQ ID NO: 23153 - DNA, 38 bp, Artificial Sequence
  Synthetic oligonucleotide
gactggggaagttaggaggctgaagagctgggaattga

SEQ ID NO: 23154 - DNA, 38 bp, Artificial Sequence
  Synthetic oligonucleotide
acgccgccccaatgcaatacgctcgcattacctgttga

SEQ ID NO: 23155 - DNA, 35 bp, Artificial Sequence
  Synthetic oligonucleotide
gcctgccccccatttaactccaggaggattgtccc

SEQ ID NO: 23156 - DNA, 35 bp, Artificial Sequence
  Synthetic oligonucleotide
tcatgagcacgcgcctatccgactttattcctttc

SEQ ID NO: 23157 - DNA, 35 bp, Artificial Sequence
  Synthetic oligonucleotide
gtgcacggccctaccccgtcctttcacgtattcat

SEQ ID NO: 23158 - DNA, 36 bp, Artificial Sequence
  Synthetic oligonucleotide
gtccccgcatctggttaccttcgcctttaatgaaaa

SEQ ID NO: 23159 - DNA, 35 bp, Artificial Sequence
  Synthetic oligonucleotide
aatcacgccttccctgaccccactgtggactccaa

SEQ ID NO: 23160 - DNA, 36 bp, Artificial Sequence
  Synthetic oligonucleotide
agctacacatctgacccacgtaccctgccctggaca

SEQ ID NO: 23161 - DNA, 36 bp, Artificial Sequence
  Synthetic oligonucleotide
atagcccacctgcctgactccaagtttctgaagaga

SEQ ID NO: 23162 - DNA, 37 bp, Artificial Sequence
  Synthetic oligonucleotide
atcgccccggcgagggaggggagaatggggaggccga

SEQ ID NO: 23163 - DNA, 36 bp, Artificial Sequence
  Synthetic oligonucleotide
aacggtcaagggaggggggcgttgaaaaagtacgga

SEQ ID NO: 23164 - DNA, 38 bp, Artificial Sequence
  Synthetic oligonucleotide
gatgcccgggcacttatgcgggactcttcccttcctga

SEQ ID NO: 23165 - DNA, 38 bp, Artificial Sequence
  Synthetic oligonucleotide
tacatcgcgaggcggggatgaggggggggtggttgtga

SEQ ID NO: 23166 - DNA, 35 bp, Artificial Sequence
  Synthetic oligonucleotide
gccccatgtgccattgtcctcctttgacttcatcc

SEQ ID NO: 23167 - DNA, 35 bp, Artificial Sequence
  Synthetic oligonucleotide
tgtagccccactgctgacttactgtccacgagtcc

SEQ ID NO: 23168 - DNA, 35 bp, Artificial Sequence
  Synthetic oligonucleotide
acacttcctgtcttcacgatcattgcagttccttc

SEQ ID NO: 23169 - DNA, 35 bp, Artificial Sequence
  Synthetic oligonucleotide
actctcacgggtccgcttccgatcacggcctgttc

SEQ ID NO: 23170 - DNA, 35 bp, Artificial Sequence
  Synthetic oligonucleotide
agtgctgcgggtcggggaggtcaaggggggactag

SEQ ID NO: 23171 - DNA, 35 bp, Artificial Sequence
  Synthetic oligonucleotide
gatggggtaggcgggtgcgctggggctgaggaggg

SEQ ID NO: 23172 - DNA, 35 bp, Artificial Sequence
  Synthetic oligonucleotide
tatagcgcgatgatggacgtgtgtttgtgtgttgg

SEQ ID NO: 23173 - DNA, 35 bp, Artificial Sequence
  Synthetic oligonucleotide
aacggacagggggaggggggatcaaactaccgttg

SEQ ID NO: 23174 - DNA, 35 bp, Artificial Sequence
  Synthetic oligonucleotide
gacgttcgcatggctctttctaatctgcaatctgt

SEQ ID NO: 23175 - DNA, 35 bp, Artificial Sequence
  Synthetic oligonucleotide
attgcctcacgaactcgacccgacgtcttgcccaa

SEQ ID NO: 23176 - DNA, 36 bp, Artificial Sequence
  Synthetic oligonucleotide
tagtcgtcccctgtcgctgccctatctgatcttcca

SEQ ID NO: 23177 - DNA, 36 bp, Artificial Sequence
  Synthetic oligonucleotide
gcatgccatagaccacactgacaacaccagagagca

SEQ ID NO: 23178 - DNA, 37 bp, Artificial Sequence
  Synthetic oligonucleotide
tgccaagcctctccgttatcgcgttagttcttatcga

SEQ ID NO: 23179 - DNA, 37 bp, Artificial Sequence
  Synthetic oligonucleotide
gggaagggaggaaggatagcgaagggttgcttaagga

SEQ ID NO: 23180 - DNA, 38 bp, Artificial Sequence
  Synthetic oligonucleotide
gtggaccttccggctgtgtttcccaccttccattctga

SEQ ID NO: 23181 - DNA, 38 bp, Artificial Sequence
  Synthetic oligonucleotide
atcactccctcaatgcgcattgcgcccgtgcctcgtga

SEQ ID NO: 23182 - DNA, 37 bp, Artificial Sequence
  Synthetic oligonucleotide
gaaccgcctatttgaaacgacgtacctccctgattga

SEQ ID NO: 23183 - DNA, 35 bp, Artificial Sequence
  Synthetic oligonucleotide
gttgcgaaagtagcacacccgcctttcttccttga

SEQ ID NO: 23184 - DNA, 35 bp, Artificial Sequence
  Synthetic oligonucleotide
agcacacaccgatacccgctaggccctgtattccc

SEQ ID NO: 23185 - DNA, 35 bp, Artificial Sequence
  Synthetic oligonucleotide
gcgctcctccctgcattgcgtcatttcgactaatc

SEQ ID NO: 23186 - DNA, 35 bp, Artificial Sequence
  Synthetic oligonucleotide
atgcacacatcgtatctcctcctattctcttcgtg

SEQ ID NO: 23187 - DNA, 35 bp, Artificial Sequence
  Synthetic oligonucleotide
gtgtgggaatggaggcaataatggtggtagatcgt

SEQ ID NO: 23188 - DNA, 34 bp, Artificial Sequence
  Synthetic oligonucleotide
gtcgctgttccacggcctgttaccgcttcgcctt

SEQ ID NO: 23189 - DNA, 35 bp, Artificial Sequence
  Synthetic oligonucleotide
tcgatgctaccgatcgcatactcattgctactgtt

SEQ ID NO: 23190 - DNA, 35 bp, Artificial Sequence
  Synthetic oligonucleotide
gatggtgccgtagaagccacctctcgattcaattt

SEQ ID NO: 23191 - DNA, 37 bp, Artificial Sequence
  Synthetic oligonucleotide
gcaactgcctatatcaataaactgcgctcgctcccga

SEQ ID NO: 23192 - DNA, 37 bp, Artificial Sequence
  Synthetic oligonucleotide
tccaccacgcatagccgccaccaccctgcttgactga

SEQ ID NO: 23193 - DNA, 38 bp, Artificial Sequence
  Synthetic oligonucleotide
gtccgccactcgcttccgatcacgactcattgacctga

SEQ ID NO: 23194 - DNA, 36 bp, Artificial Sequence
  Synthetic oligonucleotide
gacacctccgtccaatatcttcttacactgtatcta

SEQ ID NO: 23195 - DNA, 35 bp, Artificial Sequence
  Synthetic oligonucleotide
agagtgccgcccattttcgttacctctcgactcta

SEQ ID NO: 23196 - DNA, 35 bp, Artificial Sequence
  Synthetic oligonucleotide
tccaagcatcccgaccatcgcgcaaattcaggcac

SEQ ID NO: 23197 - DNA, 35 bp, Artificial Sequence
  Synthetic oligonucleotide
tagccaatacgcagcgataccgctacggacccctc

SEQ ID NO: 23198 - DNA, 35 bp, Artificial Sequence
  Synthetic oligonucleotide
tactgcccgcaccccactgctaaggcctctctgag

SEQ ID NO: 23199 - DNA, 35 bp, Artificial Sequence
  Synthetic oligonucleotide
tctgttcatctgttccgttaggccccccctcacct

SEQ ID NO: 23200 - DNA, 35 bp, Artificial Sequence
  Synthetic oligonucleotide
gcatggggggggggagttctgaaagggattcgggt

SEQ ID NO: 23201 - DNA, 35 bp, Artificial Sequence
  Synthetic oligonucleotide
gtctgcgcacggggagaggaaagcagaggggaaaa

SEQ ID NO: 23202 - DNA, 38 bp, Artificial Sequence
  Synthetic oligonucleotide
cccgccgtcaccccctacccgcacgcagaagtacctga

SEQ ID NO: 23203 - DNA, 35 bp, Artificial Sequence
  Synthetic oligonucleotide
acccattttcgtacctttgcttgcccgacggtgcc

SEQ ID NO: 23204 - DNA, 35 bp, Artificial Sequence
  Synthetic oligonucleotide
tacgcacaccacaaaccagcgtagaaagctagccg

SEQ ID NO: 23205 - DNA, 35 bp, Artificial Sequence
  Synthetic oligonucleotide
gacctagcctaggcccatctcgatccgctgtttct

SEQ ID NO: 23206 - DNA, 36 bp, Artificial Sequence
  Synthetic oligonucleotide
tgcccataggttccgttgtcttccgttgccatccga

SEQ ID NO: 23207 - DNA, 38 bp, Artificial Sequence
  Synthetic oligonucleotide
agtgagagcagggggcgggtaagttggtcgggttgtga

SEQ ID NO: 23208 - DNA, 37 bp, Artificial Sequence
  Synthetic oligonucleotide
gaccccgctccgccccacgttagtaagattcccttga

SEQ ID NO: 23209 - DNA, 38 bp, Artificial Sequence
  Synthetic oligonucleotide
acattcccagcctctcaacccgtcatatcgcccgttga

SEQ ID NO: 23210 - DNA, 35 bp, Artificial Sequence
  Synthetic oligonucleotide
tatccctccaccgcccctcaatgccgttgaccgcc

SEQ ID NO: 23211 - DNA, 35 bp, Artificial Sequence
  Synthetic oligonucleotide
agccgccggtttcccatgtcgtcacacctggctcc

SEQ ID NO: 23212 - DNA, 35 bp, Artificial Sequence
  Synthetic oligonucleotide
gagggtcaaaaatggaagtgaatggtggggttgag

SEQ ID NO: 23213 - DNA, 35 bp, Artificial Sequence
  Synthetic oligonucleotide
gatagtcagccctcgccacgttgtgctcccatcct

SEQ ID NO: 23214 - DNA, 36 bp, Artificial Sequence
  Synthetic oligonucleotide
tatcaaggggaaggggcgggacagaagtatcggcaa

SEQ ID NO: 23215 - DNA, 36 bp, Artificial Sequence
  Synthetic oligonucleotide
tcatgccttcctcccattgcgcacagactgcggtaa

SEQ ID NO: 23216 - DNA, 36 bp, Artificial Sequence
  Synthetic oligonucleotide
ataccctcacaccagcggctagctgtttcctcccca

SEQ ID NO: 23217 - DNA, 35 bp, Artificial Sequence
  Synthetic oligonucleotide
tcagtctactctgacccgactacttatgctcctca

SEQ ID NO: 23218 - DNA, 36 bp, Artificial Sequence
  Synthetic oligonucleotide
gccggttgggagggcatggggtgaaaatgtttggga

SEQ ID NO: 23219 - DNA, 38 bp, Artificial Sequence
  Synthetic oligonucleotide
gacaccgctgcccttgcaccccagcatcgccccaatga

SEQ ID NO: 23220 - DNA, 38 bp, Artificial Sequence
  Synthetic oligonucleotide
tcccagcatgccgcccttctcctcgcattggttactga

SEQ ID NO: 23221 - DNA, 36 bp, Artificial Sequence
  Synthetic oligonucleotide
tacgcactcagactccatcccctgacgcctgcagta

SEQ ID NO: 23222 - DNA, 35 bp, Artificial Sequence
  Synthetic oligonucleotide
tcgaaacttcgcccctgttgcaccccatgttgtac

SEQ ID NO: 23223 - DNA, 35 bp, Artificial Sequence
  Synthetic oligonucleotide
ttgtgcataccgcggactgctcctttataccttgc

SEQ ID NO: 23224 - DNA, 35 bp, Artificial Sequence
  Synthetic oligonucleotide
tgtaccccctgcaatgtagaatatgtctcctcagg

SEQ ID NO: 23225 - DNA, 35 bp, Artificial Sequence
  Synthetic oligonucleotide
gtctcaccagcgcaccttctctgtcctacgttatg

SEQ ID NO: 23226 - DNA, 37 bp, Artificial Sequence
  Synthetic oligonucleotide
aacgcccacatccgaacctacgtagacgagtcatcga

SEQ ID NO: 23227 - DNA, 37 bp, Artificial Sequence
  Synthetic oligonucleotide
tccaccgccattcccattcgctcatattttcgtagga

SEQ ID NO: 23228 - DNA, 37 bp, Artificial Sequence
  Synthetic oligonucleotide
aatactaaggcggggtaggagggggataacttgcgga

SEQ ID NO: 23229 - DNA, 36 bp, Artificial Sequence
  Synthetic oligonucleotide
ggggccagtgggaggggagtggctttgaatggggga

SEQ ID NO: 23230 - DNA, 37 bp, Artificial Sequence
  Synthetic oligonucleotide
ttgtgagtgagtgggaaagcggggtgaggggtctgga

SEQ ID NO: 23231 - DNA, 34 bp, Artificial Sequence
  Synthetic oligonucleotide
tcttcacctcaccgttccttggtttgactcgcta

SEQ ID NO: 23232 - DNA, 35 bp, Artificial Sequence
  Synthetic oligonucleotide
aaggtcactccctgggccccttctaagcttgcacc

SEQ ID NO: 23233 - DNA, 35 bp, Artificial Sequence
  Synthetic oligonucleotide
gagagcaaaccgcctgtcgagcctccgcatagctc

SEQ ID NO: 23234 - DNA, 35 bp, Artificial Sequence
  Synthetic oligonucleotide
tcgccctggcacacggtaaaccacgctttcaattc

SEQ ID NO: 23235 - DNA, 35 bp, Artificial Sequence
  Synthetic oligonucleotide
atgctccagccattcagatctcccctcgcttcaat

SEQ ID NO: 23236 - DNA, 35 bp, Artificial Sequence
  Synthetic oligonucleotide
tgaccctgcagctgttcctgcacaggtctatttct

SEQ ID NO: 23237 - DNA, 36 bp, Artificial Sequence
  Synthetic oligonucleotide
acctagcccctcgtgttatcacacgctacctcacaa

SEQ ID NO: 23238 - DNA, 37 bp, Artificial Sequence
  Synthetic oligonucleotide
tgctgaccaggaaataaagggaacgcgcagggaggga

SEQ ID NO: 23239 - DNA, 37 bp, Artificial Sequence
  Synthetic oligonucleotide
tgtgtgctgcttgcccgtgcccctggattccttctga

SEQ ID NO: 23240 - DNA, 36 bp, Artificial Sequence
  Synthetic oligonucleotide
gacaccacgctttagcatgtccttttccccggttga

SEQ ID NO: 23241 - DNA, 35 bp, Artificial Sequence
  Synthetic oligonucleotide
acccaccgtagttgttggcaccgcgaccaccacac

SEQ ID NO: 23242 - DNA, 35 bp, Artificial Sequence
  Synthetic oligonucleotide
attaacactcgccggaccacccaattgaactgtac

SEQ ID NO: 23243 - DNA, 35 bp, Artificial Sequence
  Synthetic oligonucleotide
gccacgcaccgcaacccgacacatcccgtgacccc

SEQ ID NO: 23244 - DNA, 35 bp, Artificial Sequence
  Synthetic oligonucleotide
gctcagccaacgcgagtctctccactccctctagc

SEQ ID NO: 23245 - DNA, 35 bp, Artificial Sequence
  Synthetic oligonucleotide
tcgatcccgtaagccgccactccagccagctcatt

SEQ ID NO: 23246 - DNA, 35 bp, Artificial Sequence
  Synthetic oligonucleotide
tcacgctcgattctctcgtgccctgcataattttt

SEQ ID NO: 23247 - DNA, 36 bp, Artificial Sequence
  Synthetic oligonucleotide
gcccaccccctacctttctttgttcgttattgcgca

SEQ ID NO: 23248 - DNA, 35 bp, Artificial Sequence
  Synthetic oligonucleotide
ttggccctttccatcgcgctgagatcacatctgca

SEQ ID NO: 23249 - DNA, 36 bp, Artificial Sequence
  Synthetic oligonucleotide
tcaacccaggtcctcattgatcttgtcgcctttaga

SEQ ID NO: 23250 - DNA, 36 bp, Artificial Sequence
  Synthetic oligonucleotide
tgacccacgcatcggtccagaacctctccatcgtga

SEQ ID NO: 23251 - DNA, 38 bp, Artificial Sequence
  Synthetic oligonucleotide
acttccagcgaccgcttccgttccgttcaccaagttga

SEQ ID NO: 23252 - DNA, 36 bp, Artificial Sequence
  Synthetic oligonucleotide
gtttgtgcaattgaaggcgtgggggggacgggagta

SEQ ID NO: 23253 - DNA, 36 bp, Artificial Sequence
  Synthetic oligonucleotide
ataacccacatgcgcccctgtaccctgcctggtgta

SEQ ID NO: 23254 - DNA, 35 bp, Artificial Sequence
  Synthetic oligonucleotide
tcgttgccatcctcccacgcggcgccacctttctc

SEQ ID NO: 23255 - DNA, 35 bp, Artificial Sequence
  Synthetic oligonucleotide
gacttcccgccctcaatgtaacgcaatgctctccg

SEQ ID NO: 23256 - DNA, 36 bp, Artificial Sequence
  Synthetic oligonucleotide
gacctaacgcctgacccccctgaccgagctctacaa

SEQ ID NO: 23257 - DNA, 36 bp, Artificial Sequence
  Synthetic oligonucleotide
gaacatgccaaatcctaatgacgacccacctgttaa

SEQ ID NO: 23258 - DNA, 37 bp, Artificial Sequence
  Synthetic oligonucleotide
gtccgcctctatctatccacggttgttctttacccga

SEQ ID NO: 23259 - DNA, 37 bp, Artificial Sequence
  Synthetic oligonucleotide
tctctcccgcccgctcaccattgtttcacttgctcga

SEQ ID NO: 23260 - DNA, 37 bp, Artificial Sequence
  Synthetic oligonucleotide
attgcttcccaatatgccatctgtcgacacccctgga

SEQ ID NO: 23261 - DNA, 35 bp, Artificial Sequence
  Synthetic oligonucleotide
ggcctgacaccaacacgcttcacactgctccctga

SEQ ID NO: 23262 - DNA, 38 bp, Artificial Sequence
  Synthetic oligonucleotide
ttatcccaacctcacatgttctactgagaacatcttga

SEQ ID NO: 23263 - DNA, 35 bp, Artificial Sequence
  Synthetic oligonucleotide
actccccgccatctcttatctttcttttgaggcta

SEQ ID NO: 23264 - DNA, 36 bp, Artificial Sequence
  Synthetic oligonucleotide
gtatcacgccctctgccattaagcgtcgttcactta

SEQ ID NO: 23265 - DNA, 35 bp, Artificial Sequence
  Synthetic oligonucleotide
atggagtggcctgcttcaccgttcgtcatcactcc

SEQ ID NO: 23266 - DNA, 35 bp, Artificial Sequence
  Synthetic oligonucleotide
atccatgtcccaaccgcacagagcgcatttcgtcg

SEQ ID NO: 23267 - DNA, 35 bp, Artificial Sequence
  Synthetic oligonucleotide
gactgcctgtatcctgcttttcggctttgcttgct

SEQ ID NO: 23268 - DNA, 36 bp, Artificial Sequence
  Synthetic oligonucleotide
gtgacagacgtattcttcctattgtccgctgaaaca

SEQ ID NO: 23269 - DNA, 36 bp, Artificial Sequence
  Synthetic oligonucleotide
taacgccgccattcgggtcgattacgcattactcca

SEQ ID NO: 23270 - DNA, 36 bp, Artificial Sequence
  Synthetic oligonucleotide
tcatcccgcttacacttctcgatccctcacgttgca

SEQ ID NO: 23271 - DNA, 37 bp, Artificial Sequence
  Synthetic oligonucleotide
agtagagggggtaggggatatgatcaaggtagagaga

SEQ ID NO: 23272 - DNA, 37 bp, Artificial Sequence
  Synthetic oligonucleotide
tatggcaacagggctaagtagggggcagggctgtgga

SEQ ID NO: 23273 - DNA, 36 bp, Artificial Sequence
  Synthetic oligonucleotide
gatctcccatccggtgaaagcctttgctatactcta

SEQ ID NO: 23274 - DNA, 35 bp, Artificial Sequence
  Synthetic oligonucleotide
ggtgggaagaggtatggggcggctggagaggtgag

SEQ ID NO: 23275 - DNA, 35 bp, Artificial Sequence
  Synthetic oligonucleotide
acaccccaggccgttcgcatatgcaaacattttcg

SEQ ID NO: 23276 - DNA, 35 bp, Artificial Sequence
  Synthetic oligonucleotide
tctacccacggccaggaccgcgcatctttacacat

SEQ ID NO: 23277 - DNA, 36 bp, Artificial Sequence
  Synthetic oligonucleotide
ttcgacacatccgcatttacccagtccagcgaggca

SEQ ID NO: 23278 - DNA, 36 bp, Artificial Sequence
  Synthetic oligonucleotide
gcactggtcatctcctggtcgttgctcgtgctctca

SEQ ID NO: 23279 - DNA, 37 bp, Artificial Sequence
  Synthetic oligonucleotide
aaggtgagatagggggggtgagatgaaggttgaggga

SEQ ID NO: 23280 - DNA, 37 bp, Artificial Sequence
  Synthetic oligonucleotide
atagcctccatccccttagggcacctgctcctctgga

SEQ ID NO: 23281 - DNA, 37 bp, Artificial Sequence
  Synthetic oligonucleotide
ttttgcaacgcatccccgccgccgtaccccctgctga

SEQ ID NO: 23282 - DNA, 38 bp, Artificial Sequence
  Synthetic oligonucleotide
ggaacgtggaagggacataggggtgagtcaaagggtga

SEQ ID NO: 23283 - DNA, 37 bp, Artificial Sequence
  Synthetic oligonucleotide
aatcaaccctccgacggatacgcacctcattcattga

SEQ ID NO: 23284 - DNA, 36 bp, Artificial Sequence
  Synthetic oligonucleotide
gactgccccatcgtgtcgccttccgtctttacgcta

SEQ ID NO: 23285 - DNA, 35 bp, Artificial Sequence
  Synthetic oligonucleotide
tgatacgtcgcagccttgccaacctacatttgaac

SEQ ID NO: 23286 - DNA, 35 bp, Artificial Sequence
  Synthetic oligonucleotide
ggggagcacagctttaccccgctgccttgacttcc

SEQ ID NO: 23287 - DNA, 35 bp, Artificial Sequence
  Synthetic oligonucleotide
tacggtagcaacattgccgaaggtactccccctgc

SEQ ID NO: 23288 - DNA, 35 bp, Artificial Sequence
  Synthetic oligonucleotide
agctcatccagcgatggtacactttgcttttcttc

SEQ ID NO: 23289 - DNA, 35 bp, Artificial Sequence
  Synthetic oligonucleotide
tgtgagctgccctcaactgtcttgcaccgagtttc

SEQ ID NO: 23290 - DNA, 35 bp, Artificial Sequence
  Synthetic oligonucleotide
gttcgcaggccctcaatcgaccattccgtcccact

SEQ ID NO: 23291 - DNA, 36 bp, Artificial Sequence
  Synthetic oligonucleotide
gcacgccgcaccgtttagggcctcgacccacccaaa

SEQ ID NO: 23292 - DNA, 36 bp, Artificial Sequence
  Synthetic oligonucleotide
tcctctcgtactatatggctctcgactcctgtccaa

SEQ ID NO: 23293 - DNA, 35 bp, Artificial Sequence
  Synthetic oligonucleotide
acccatccctgcccttcagacttgaggggacctaa

SEQ ID NO: 23294 - DNA, 36 bp, Artificial Sequence
  Synthetic oligonucleotide
tcatcctcaggccatccctttgccatctgtagaaca

SEQ ID NO: 23295 - DNA, 36 bp, Artificial Sequence
  Synthetic oligonucleotide
gcaacaatgcgtcgttgcccctatcccccgctagca

SEQ ID NO: 23296 - DNA, 37 bp, Artificial Sequence
  Synthetic oligonucleotide
atcgtacaagctcattcgcccgttcccatctcttaga

SEQ ID NO: 23297 - DNA, 38 bp, Artificial Sequence
  Synthetic oligonucleotide
tccctcaggaacagtattgactaaccctcagtctttga

SEQ ID NO: 23298 - DNA, 38 bp, Artificial Sequence
  Synthetic oligonucleotide
tgctcccatcctctcgtgagttcttgcatgccttttga

SEQ ID NO: 23299 - DNA, 35 bp, Artificial Sequence
  Synthetic oligonucleotide
acaccccgtcctcgtattcggggcccaaccccaac

SEQ ID NO: 23300 - DNA, 35 bp, Artificial Sequence
  Synthetic oligonucleotide
tcataacacaccccatcagtagtatccatagggcc

SEQ ID NO: 23301 - DNA, 35 bp, Artificial Sequence
  Synthetic oligonucleotide
tgctcgctcgctcatctctatgtagtttcggttct

SEQ ID NO: 23302 - DNA, 36 bp, Artificial Sequence
  Synthetic oligonucleotide
atcaatcatggttcgcctgctcgcccgttccactaa

SEQ ID NO: 23303 - DNA, 35 bp, Artificial Sequence
  Synthetic oligonucleotide
tcatcgcacgtatacctctcctcgggccctgcaca

SEQ ID NO: 23304 - DNA, 37 bp, Artificial Sequence
  Synthetic oligonucleotide
tgattccctcgttgccttatatcgccttgttcctcga

SEQ ID NO: 23305 - DNA, 37 bp, Artificial Sequence
  Synthetic oligonucleotide
aacagacgaaaaggggggaaagctgcagggcgcggga

SEQ ID NO: 23306 - DNA, 37 bp, Artificial Sequence
  Synthetic oligonucleotide
gttggaaagggtggggccagaggctaggttcatggga

SEQ ID NO: 23307 - DNA, 35 bp, Artificial Sequence
  Synthetic oligonucleotide
acctgcctattgatccactatcccaggccctaacc

SEQ ID NO: 23308 - DNA, 35 bp, Artificial Sequence
  Synthetic oligonucleotide
agtactcgcactaacgttctgcgccggcttcatgc

SEQ ID NO: 23309 - DNA, 35 bp, Artificial Sequence
  Synthetic oligonucleotide
gatggtgtcgcgtagatcattgggcggggaaaagg

SEQ ID NO: 23310 - DNA, 35 bp, Artificial Sequence
  Synthetic oligonucleotide
aacgcgcctatcctcccgtacgaattgacccagtg

SEQ ID NO: 23311 - DNA, 35 bp, Artificial Sequence
  Synthetic oligonucleotide
gtcacgggaagggttggacgatatcggagggtagt

SEQ ID NO: 23312 - DNA, 37 bp, Artificial Sequence
  Synthetic oligonucleotide
atgagaaggggacgggcgtggattggacggaggaaga

SEQ ID NO: 23313 - DNA, 37 bp, Artificial Sequence
  Synthetic oligonucleotide
atcgaccttactttcccgtccgaccccacacatggga

SEQ ID NO: 23314 - DNA, 38 bp, Artificial Sequence
  Synthetic oligonucleotide
tactggcgcgatccatctctaggtttcacttccactga

SEQ ID NO: 23315 - DNA, 38 bp, Artificial Sequence
  Synthetic oligonucleotide
tcatgaagcccgcatatcctgcctccgtctgtcggtga

SEQ ID NO: 23316 - DNA, 36 bp, Artificial Sequence
  Synthetic oligonucleotide
gaaaggaggggaaggcaaaacgtgagactgggaata

SEQ ID NO: 23317 - DNA, 35 bp, Artificial Sequence
  Synthetic oligonucleotide
agatactcacctaccctcacagcatgcatacgtgc

SEQ ID NO: 23318 - DNA, 35 bp, Artificial Sequence
  Synthetic oligonucleotide
tcctggtgaaccttccgctcattgcaaccttgatc

SEQ ID NO: 23319 - DNA, 35 bp, Artificial Sequence
  Synthetic oligonucleotide
gccactccagccaccaccccttacgacaagttatg

SEQ ID NO: 23320 - DNA, 35 bp, Artificial Sequence
  Synthetic oligonucleotide
gttgatcattacacctccccggtgcccctgtccat

SEQ ID NO: 23321 - DNA, 35 bp, Artificial Sequence
  Synthetic oligonucleotide
ttgccgcacataccgttattggcgtcctaacacct

SEQ ID NO: 23322 - DNA, 36 bp, Artificial Sequence
  Synthetic oligonucleotide
tgaaggtcaaagctgtaccgcccctccattccacga

SEQ ID NO: 23323 - DNA, 37 bp, Artificial Sequence
  Synthetic oligonucleotide
atccgcggtcatctctgcgctttcatcatggacccga

SEQ ID NO: 23324 - DNA, 37 bp, Artificial Sequence
  Synthetic oligonucleotide
atggaaggggaggtacgggtaaatcaggggtgctcga

SEQ ID NO: 23325 - DNA, 35 bp, Artificial Sequence
  Synthetic oligonucleotide
atgggaggggtgcaaatggtcgtagaagggtggga

SEQ ID NO: 23326 - DNA, 35 bp, Artificial Sequence
  Synthetic oligonucleotide
tttgcgccccagaatgattgctgcttcacttgttc

SEQ ID NO: 23327 - DNA, 35 bp, Artificial Sequence
  Synthetic oligonucleotide
ttcgcgcgggaggggggacctagagagagtgggag

SEQ ID NO: 23328 - DNA, 35 bp, Artificial Sequence
  Synthetic oligonucleotide
atccacctggtcgtacatttgctcccgttgccccg

SEQ ID NO: 23329 - DNA, 36 bp, Artificial Sequence
  Synthetic oligonucleotide
gtgcttaacgcccgggcttaacggttcctctgccaa

SEQ ID NO: 23330 - DNA, 36 bp, Artificial Sequence
  Synthetic oligonucleotide
agcatctgccactccccttttggcccctgtttcgaa

SEQ ID NO: 23331 - DNA, 36 bp, Artificial Sequence
  Synthetic oligonucleotide
gcagtaagagcgggtggggggggacggcggggttca

SEQ ID NO: 23332 - DNA, 37 bp, Artificial Sequence
  Synthetic oligonucleotide
cccgccctccacggctttacatcttgttgtcgctaga

SEQ ID NO: 23333 - DNA, 37 bp, Artificial Sequence
  Synthetic oligonucleotide
gaaaggtggggaggaagagtacacacaggagactcga

SEQ ID NO: 23334 - DNA, 37 bp, Artificial Sequence
  Synthetic oligonucleotide
tgcaatgtatgtgctttcacgccccgccttccttcga

SEQ ID NO: 23335 - DNA, 37 bp, Artificial Sequence
  Synthetic oligonucleotide
agtccactctgcagccattgtcccctctccgctatga

SEQ ID NO: 23336 - DNA, 38 bp, Artificial Sequence
  Synthetic oligonucleotide
gtacccgccgtccttaacgacagctccctcatgcctga

SEQ ID NO: 23337 - DNA, 38 bp, Artificial Sequence
  Synthetic oligonucleotide
acttgcccggcgcgagccctatctttcgctttctgtga

SEQ ID NO: 23338 - DNA, 36 bp, Artificial Sequence
  Synthetic oligonucleotide
tgacgtggggagtgggtgggttttgacgggtcctta

SEQ ID NO: 23339 - DNA, 35 bp, Artificial Sequence
  Synthetic oligonucleotide
gatgctctcatcacattttccgcgtggcaccaccc

SEQ ID NO: 23340 - DNA, 35 bp, Artificial Sequence
  Synthetic oligonucleotide
tccggtgccaggtcttgctccattgtgatcgtttc

SEQ ID NO: 23341 - DNA, 35 bp, Artificial Sequence
  Synthetic oligonucleotide
aaccgcccgtcttttccatgcctgtacctctacct

SEQ ID NO: 23342 - DNA, 36 bp, Artificial Sequence
  Synthetic oligonucleotide
gacctgcgcaaatttcaatctggaactgccgataaa

SEQ ID NO: 23343 - DNA, 36 bp, Artificial Sequence
  Synthetic oligonucleotide
tttcgctgactccctgtgaacgtttccccgctctca

SEQ ID NO: 23344 - DNA, 37 bp, Artificial Sequence
  Synthetic oligonucleotide
gccacccgctccctgccgcttagcaacattacacaga

SEQ ID NO: 23345 - DNA, 37 bp, Artificial Sequence
  Synthetic oligonucleotide
gtggggcaacactcgagacggagggtgggaggggaga

SEQ ID NO: 23346 - DNA, 36 bp, Artificial Sequence
  Synthetic oligonucleotide
ttcaccccccctatgaacataggcatccccccacga

SEQ ID NO: 23347 - DNA, 37 bp, Artificial Sequence
  Synthetic oligonucleotide
tgccgttcgacgcacatggccgtaccctatcctccga

SEQ ID NO: 23348 - DNA, 35 bp, Artificial Sequence
  Synthetic oligonucleotide
ggaggggtgacaaaagggggaatcagaacaaggga

SEQ ID NO: 23349 - DNA, 38 bp, Artificial Sequence
  Synthetic oligonucleotide
gagacaggcggtgggattcaacgggaggggaaacgtga

SEQ ID NO: 23350 - DNA, 35 bp, Artificial Sequence
  Synthetic oligonucleotide
gccagacccaagtccatcgttcacttccttgccac

SEQ ID NO: 23351 - DNA, 35 bp, Artificial Sequence
  Synthetic oligonucleotide
tccgttgagcgcccacctccctccacccttggtgg

SEQ ID NO: 23352 - DNA, 35 bp, Artificial Sequence
  Synthetic oligonucleotide
tctcaggccgtacccatgtcccgctcgaccttttg

SEQ ID NO: 23353 - DNA, 35 bp, Artificial Sequence
  Synthetic oligonucleotide
tttacaacgcttctgaactgccgccgcgcccctgt

SEQ ID NO: 23354 - DNA, 35 bp, Artificial Sequence
  Synthetic oligonucleotide
gatccacctcactactgaaccctaaccagtcactt

SEQ ID NO: 23355 - DNA, 36 bp, Artificial Sequence
  Synthetic oligonucleotide
attgccccctccgttgtgacacccctgctactctaa

SEQ ID NO: 23356 - DNA, 36 bp, Artificial Sequence
  Synthetic oligonucleotide
gacactgtccatcggctaatatctcatctttgagca

SEQ ID NO: 23357 - DNA, 35 bp, Artificial Sequence
  Synthetic oligonucleotide
tcacaaggaggagggaaggaaacgcacgggttgca

SEQ ID NO: 23358 - DNA, 36 bp, Artificial Sequence
  Synthetic oligonucleotide
atccacctctatgtttacccgaatcggttctgctca

SEQ ID NO: 23359 - DNA, 36 bp, Artificial Sequence
  Synthetic oligonucleotide
attgatcatccgtatggtttacccccacccccccga

SEQ ID NO: 23360 - DNA, 37 bp, Artificial Sequence
  Synthetic oligonucleotide
gggatagagggggcgtagggagaaagcagaggtcgga

SEQ ID NO: 23361 - DNA, 38 bp, Artificial Sequence
  Synthetic oligonucleotide
ggtggtcgcgtctcgccttagttgtactcccctcatga

SEQ ID NO: 23362 - DNA, 36 bp, Artificial Sequence
  Synthetic oligonucleotide
tcaagagggagggggggatgggtgtttagtaaatta

SEQ ID NO: 23363 - DNA, 35 bp, Artificial Sequence
  Synthetic oligonucleotide
gacactgctgtatacctttaagaatccacgtgcac

SEQ ID NO: 23364 - DNA, 35 bp, Artificial Sequence
  Synthetic oligonucleotide
tctggccaccgactctcattgtacactggctcacg

SEQ ID NO: 23365 - DNA, 35 bp, Artificial Sequence
  Synthetic oligonucleotide
actgcccgccattacccatgcacccagtactcctt

SEQ ID NO: 23366 - DNA, 35 bp, Artificial Sequence
  Synthetic oligonucleotide
gtgaaaccgcattcgttggcttagtgaacctcttt

SEQ ID NO: 23367 - DNA, 35 bp, Artificial Sequence
  Synthetic oligonucleotide
tctacgtcagccacatacccgagcctgcccactaa

SEQ ID NO: 23368 - DNA, 35 bp, Artificial Sequence
  Synthetic oligonucleotide
accctatgcaacggcagtcttgccccattcgctca

SEQ ID NO: 23369 - DNA, 36 bp, Artificial Sequence
  Synthetic oligonucleotide
acattcccccgcctccccagcccgttctgtaataga

SEQ ID NO: 23370 - DNA, 37 bp, Artificial Sequence
  Synthetic oligonucleotide
gaatcacctcacgacggacaaatagcatcttccccga

SEQ ID NO: 23371 - DNA, 36 bp, Artificial Sequence
  Synthetic oligonucleotide
gttccccccctacgtgactcaggtcctatcctcgga

SEQ ID NO: 23372 - DNA, 37 bp, Artificial Sequence
  Synthetic oligonucleotide
tccacccgcagcatatccctttagctctataccatga

SEQ ID NO: 23373 - DNA, 35 bp, Artificial Sequence
  Synthetic oligonucleotide
ttcgcacgcaatcgccgtccccgcccgaaaccaac

SEQ ID NO: 23374 - DNA, 35 bp, Artificial Sequence
  Synthetic oligonucleotide
gctcaccccagcaggtagctggcttcacatttacc

SEQ ID NO: 23375 - DNA, 35 bp, Artificial Sequence
  Synthetic oligonucleotide
gagaaccgccgtcatcgtcgcaccgcccgactcct

SEQ ID NO: 23376 - DNA, 35 bp, Artificial Sequence
  Synthetic oligonucleotide
gatgcgcaaaaatgggttgacggggcaacgggatt

SEQ ID NO: 23377 - DNA, 36 bp, Artificial Sequence
  Synthetic oligonucleotide
gaatgagtactaggggaagggggaggatggggcaaa

SEQ ID NO: 23378 - DNA, 35 bp, Artificial Sequence
  Synthetic oligonucleotide
gtgaactatccctcaataccattccgcccagccca

SEQ ID NO: 23379 - DNA, 38 bp, Artificial Sequence
  Synthetic oligonucleotide
ggacaacccccggtggtctatcgatatccctctcatga

SEQ ID NO: 23380 - DNA, 38 bp, Artificial Sequence
  Synthetic oligonucleotide
gagccactaacagctgtatcgccccatcgtccgcctga

SEQ ID NO: 23381 - DNA, 38 bp, Artificial Sequence
  Synthetic oligonucleotide
gtcgaggagttacgaaaaggaggggaagagacatgtga

SEQ ID NO: 23382 - DNA, 35 bp, Artificial Sequence
  Synthetic oligonucleotide
ttgactccggtccctgtgatctaatgcgttttccc

SEQ ID NO: 23383 - DNA, 35 bp, Artificial Sequence
  Synthetic oligonucleotide
tcccagacgcacacctaagcggccctatttaatgc

SEQ ID NO: 23384 - DNA, 36 bp, Artificial Sequence
  Synthetic oligonucleotide
tgccaacgctttcttggttctttgctcgtgctccaa

SEQ ID NO: 23385 - DNA, 36 bp, Artificial Sequence
  Synthetic oligonucleotide
gccaggggaccgacctatttgaccacgtctgcacca

SEQ ID NO: 23386 - DNA, 37 bp, Artificial Sequence
  Synthetic oligonucleotide
ggtggaagacggtgtggggagggttgtagggatcgga

SEQ ID NO: 23387 - DNA, 37 bp, Artificial Sequence
  Synthetic oligonucleotide
gtagcccaggaaaaggggggaaagtgtgggtaaatga

SEQ ID NO: 23388 - DNA, 38 bp, Artificial Sequence
  Synthetic oligonucleotide
gccgccctatggcccttaaattcctgtcgcactcttga

SEQ ID NO: 23389 - DNA, 36 bp, Artificial Sequence
  Synthetic oligonucleotide
tattctgccatggatcttgctaacgccccacctgta

SEQ ID NO: 23390 - DNA, 36 bp, Artificial Sequence
  Synthetic oligonucleotide
gcccgccctggacgtcccatatcacctcccgcttta

SEQ ID NO: 23391 - DNA, 35 bp, Artificial Sequence
  Synthetic oligonucleotide
gaacgcgtaccctcctccaatgtcattgtcctatc

SEQ ID NO: 23392 - DNA, 35 bp, Artificial Sequence
  Synthetic oligonucleotide
ttgccaatccgagcctacccgttacccgagttgtc

SEQ ID NO: 23393 - DNA, 35 bp, Artificial Sequence
  Synthetic oligonucleotide
tgcgatacgggtacgccactcctcccccatccgtt

SEQ ID NO: 23394 - DNA, 35 bp, Artificial Sequence
  Synthetic oligonucleotide
gcctccccacgaacccacatagacgatcatgacaa

SEQ ID NO: 23395 - DNA, 35 bp, Artificial Sequence
  Synthetic oligonucleotide
atgaggcctcccatataggttcttagttctgcaca

SEQ ID NO: 23396 - DNA, 36 bp, Artificial Sequence
  Synthetic oligonucleotide
tgagccaccggaccgtgatccgcaagcctcctcaca

SEQ ID NO: 23397 - DNA, 37 bp, Artificial Sequence
  Synthetic oligonucleotide
tacgccactgcacaccgccttcatttatgttgcctga

SEQ ID NO: 23398 - DNA, 35 bp, Artificial Sequence
  Synthetic oligonucleotide
atcaggccacgatcaatttttgccttgtcctccat

SEQ ID NO: 23399 - DNA, 35 bp, Artificial Sequence
  Synthetic oligonucleotide
gacatccacatttcccctcatggctacctctcgat

SEQ ID NO: 23400 - DNA, 35 bp, Artificial Sequence
  Synthetic oligonucleotide
gcgcactgccctattcgaccaaccttgcctttgat

SEQ ID NO: 23401 - DNA, 35 bp, Artificial Sequence
  Synthetic oligonucleotide
tcacctacactagtgcgatcctttgcacgcactct

SEQ ID NO: 23402 - DNA, 35 bp, Artificial Sequence
  Synthetic oligonucleotide
acactcacgactgaaaacttgaagatcgccacctt

SEQ ID NO: 23403 - DNA, 36 bp, Artificial Sequence
  Synthetic oligonucleotide
atccaccgaccggctacatcctactggcctatgcaa

SEQ ID NO: 23404 - DNA, 35 bp, Artificial Sequence
  Synthetic oligonucleotide
ttgaccactactgcagttctatgacgcacctataa

SEQ ID NO: 23405 - DNA, 35 bp, Artificial Sequence
  Synthetic oligonucleotide
acacgaacagttccgccctaccatatgtcgactca

SEQ ID NO: 23406 - DNA, 35 bp, Artificial Sequence
  Synthetic oligonucleotide
tttgttcgccggaactgcctagtttgtccttgtca

SEQ ID NO: 23407 - DNA, 36 bp, Artificial Sequence
  Synthetic oligonucleotide
gtaccttcaccgcctttaccctgccacagttaccga

SEQ ID NO: 23408 - DNA, 35 bp, Artificial Sequence
  Synthetic oligonucleotide
tgcccccgattgacctccgctacgtatgactcgag

SEQ ID NO: 23409 - DNA, 35 bp, Artificial Sequence
  Synthetic oligonucleotide
gaccgaacgaccgtacggtaacaattgtgacacct

SEQ ID NO: 23410 - DNA, 35 bp, Artificial Sequence
  Synthetic oligonucleotide
acatgcactactcgtagttgcctttcaagattctt

SEQ ID NO: 23411 - DNA, 36 bp, Artificial Sequence
  Synthetic oligonucleotide
gaccaaccaccactgtcaatcagggtacatcactaa

SEQ ID NO: 23412 - DNA, 37 bp, Artificial Sequence
  Synthetic oligonucleotide
gacacgcaccgtgactagggcgcgctctttttcccga

SEQ ID NO: 23413 - DNA, 35 bp, Artificial Sequence
  Synthetic oligonucleotide
gtgacatacgcctcacttcctgttgattagtcgac

SEQ ID NO: 23414 - DNA, 35 bp, Artificial Sequence
  Synthetic oligonucleotide
gtatcccgtaccacccgctcttcttactggcactg

SEQ ID NO: 23415 - DNA, 35 bp, Artificial Sequence
  Synthetic oligonucleotide
gtacgcgtgcggtgaggtagaacgggtggaggttg

SEQ ID NO: 23416 - DNA, 35 bp, Artificial Sequence
  Synthetic oligonucleotide
agtcccatccaaacggctcttggacgaatttagtt

SEQ ID NO: 23417 - DNA, 36 bp, Artificial Sequence
  Synthetic oligonucleotide
tccacccgctacacaaaccgacgaaactgctcctca

SEQ ID NO: 23418 - DNA, 38 bp, Artificial Sequence
  Synthetic oligonucleotide
tacaacatgcctatgtcgccacctcaaaaccgccctga

SEQ ID NO: 23419 - DNA, 38 bp, Artificial Sequence
  Synthetic oligonucleotide
tcactgctgcacctcgtcacgccggcctgttcacttga

SEQ ID NO: 23420 - DNA, 36 bp, Artificial Sequence
  Synthetic oligonucleotide
gcgcaaccataggccgccactcagtacctctgccta

SEQ ID NO: 23421 - DNA, 35 bp, Artificial Sequence
  Synthetic oligonucleotide
gtccgaccctctactttttttgatactgatgcccc

SEQ ID NO: 23422 - DNA, 35 bp, Artificial Sequence
  Synthetic oligonucleotide
tgcgatacccatacctagcccacgccctctcgcgc

SEQ ID NO: 23423 - DNA, 35 bp, Artificial Sequence
  Synthetic oligonucleotide
acacgccttccttgcataaaccgaaatgggatcgc

SEQ ID NO: 23424 - DNA, 35 bp, Artificial Sequence
  Synthetic oligonucleotide
ccgtatcccaattcgttgccaccttccttggtgtg

SEQ ID NO: 23425 - DNA, 35 bp, Artificial Sequence
  Synthetic oligonucleotide
agcaccaccacgttgctctttgatgggacccgttg

SEQ ID NO: 23426 - DNA, 35 bp, Artificial Sequence
  Synthetic oligonucleotide
gacacccacactgggtccattgtcatatcaccact

SEQ ID NO: 23427 - DNA, 37 bp, Artificial Sequence
  Synthetic oligonucleotide
gccgccgcattgcctcatttgcctcaactctgaaaga

SEQ ID NO: 23428 - DNA, 37 bp, Artificial Sequence
  Synthetic oligonucleotide
agatagcaaggggtgcgggtggggggcctgggagcga

SEQ ID NO: 23429 - DNA, 37 bp, Artificial Sequence
  Synthetic oligonucleotide
ggactcccactgccgagccgccaattccgatatagga

SEQ ID NO: 23430 - DNA, 37 bp, Artificial Sequence
  Synthetic oligonucleotide
gctgacacctctcaagatctcttgtcactccattgga

SEQ ID NO: 23431 - DNA, 36 bp, Artificial Sequence
  Synthetic oligonucleotide
ggatgcccctctccttcgtgctctgtgagtgcttga

SEQ ID NO: 23432 - DNA, 35 bp, Artificial Sequence
  Synthetic oligonucleotide
gtcccctccctaaccatgtgctaacccacattacc

SEQ ID NO: 23433 - DNA, 35 bp, Artificial Sequence
  Synthetic oligonucleotide
tcgtgcccgcctgccctttccgcctactgtgcagc

SEQ ID NO: 23434 - DNA, 35 bp, Artificial Sequence
  Synthetic oligonucleotide
tattccactcaccgctctcgatttgggtttcgttc

SEQ ID NO: 23435 - DNA, 35 bp, Artificial Sequence
  Synthetic oligonucleotide
gaaccgtagggttaatagtcaaagggagtggggcg

SEQ ID NO: 23436 - DNA, 35 bp, Artificial Sequence
  Synthetic oligonucleotide
ttggccgccgctgcccactccggttcttccaaact

SEQ ID NO: 23437 - DNA, 35 bp, Artificial Sequence
  Synthetic oligonucleotide
agcgggctgtggcacttgtctcctcactgttacct

SEQ ID NO: 23438 - DNA, 35 bp, Artificial Sequence
  Synthetic oligonucleotide
ttgatcgacggggctgcgggaatcagggagggggt

SEQ ID NO: 23439 - DNA, 35 bp, Artificial Sequence
  Synthetic oligonucleotide
gcaccaccttataggcctctacacggactcgttgt

SEQ ID NO: 23440 - DNA, 35 bp, Artificial Sequence
  Synthetic oligonucleotide
agtccgctgccccggcgaattccacaatgctttgt

SEQ ID NO: 23441 - DNA, 35 bp, Artificial Sequence
  Synthetic oligonucleotide
actcagccgccgccgaacccttagaacccgtaaaa

SEQ ID NO: 23442 - DNA, 36 bp, Artificial Sequence
  Synthetic oligonucleotide
tccagccccacccttcttttacgccgcaggggcaaa

SEQ ID NO: 23443 - DNA, 35 bp, Artificial Sequence
  Synthetic oligonucleotide
tccccacccgttgtaacggactggcttatgaccca

SEQ ID NO: 23444 - DNA, 37 bp, Artificial Sequence
  Synthetic oligonucleotide
acggggatggtggtggtgggtagtggcggtggtaaga

SEQ ID NO: 23445 - DNA, 36 bp, Artificial Sequence
  Synthetic oligonucleotide
agctagggggaggttacatgggtggaaggggggaga

SEQ ID NO: 23446 - DNA, 37 bp, Artificial Sequence
  Synthetic oligonucleotide
tcgtggcccctcgtcgcctgccatgcccttccatcga

SEQ ID NO: 23447 - DNA, 36 bp, Artificial Sequence
  Synthetic oligonucleotide
ttgacacgcccacccgttaatacacgctgattatga

SEQ ID NO: 23448 - DNA, 38 bp, Artificial Sequence
  Synthetic oligonucleotide
tgcgacctctctgttgtccggtgcttcccttccattga

SEQ ID NO: 23449 - DNA, 38 bp, Artificial Sequence
  Synthetic oligonucleotide
gaccaccccttaacttcgctgattgccacctggcttga

SEQ ID NO: 23450 - DNA, 35 bp, Artificial Sequence
  Synthetic oligonucleotide
tagtacaccgatcttctaatgcgattccacgccta

SEQ ID NO: 23451 - DNA, 35 bp, Artificial Sequence
  Synthetic oligonucleotide
gcccccggccaacccgagatctctatttttacacg

SEQ ID NO: 23452 - DNA, 35 bp, Artificial Sequence
  Synthetic oligonucleotide
gtcgcttccccatccccgggtcataccctcgcccg

SEQ ID NO: 23453 - DNA, 35 bp, Artificial Sequence
  Synthetic oligonucleotide
ttgagccgtaacccagtacttgttcattgaaatcg

SEQ ID NO: 23454 - DNA, 35 bp, Artificial Sequence
  Synthetic oligonucleotide
ttaccagcccagacgcctcttccgacctccgccat

SEQ ID NO: 23455 - DNA, 35 bp, Artificial Sequence
  Synthetic oligonucleotide
gctgacctgggcctcactttacgttccgtacgcct

SEQ ID NO: 23456 - DNA, 35 bp, Artificial Sequence
  Synthetic oligonucleotide
tcaaatagggggggcggggatgggacggtgcgcct

SEQ ID NO: 23457 - DNA, 35 bp, Artificial Sequence
  Synthetic oligonucleotide
gactcactccgcatgaattcaatgtcggacatttt

SEQ ID NO: 23458 - DNA, 36 bp, Artificial Sequence
  Synthetic oligonucleotide
atggaccgctcccttgctccacctcctctaaaggca

SEQ ID NO: 23459 - DNA, 35 bp, Artificial Sequence
  Synthetic oligonucleotide
atacagagtaggggggagggcgcaggtaaggggga

SEQ ID NO: 23460 - DNA, 38 bp, Artificial Sequence
  Synthetic oligonucleotide
gccgcctcgcccttctgtgcacacctagatcctactga

SEQ ID NO: 23461 - DNA, 37 bp, Artificial Sequence
  Synthetic oligonucleotide
gccccctcacggtatctcctcgtaatgtatttactga

SEQ ID NO: 23462 - DNA, 37 bp, Artificial Sequence
  Synthetic oligonucleotide
tcctcggactggtcaccatctcttacgtttgtcctga

SEQ ID NO: 23463 - DNA, 37 bp, Artificial Sequence
  Synthetic oligonucleotide
ttgggccgtgctatggcctcactactccttattctga

SEQ ID NO: 23464 - DNA, 38 bp, Artificial Sequence
  Synthetic oligonucleotide
tgatccctgttccctcgtatatctcgccttgcccgtga

SEQ ID NO: 23465 - DNA, 37 bp, Artificial Sequence
  Synthetic oligonucleotide
taccatatccctgagtgccctgaaacaccccgtgtga

SEQ ID NO: 23466 - DNA, 35 bp, Artificial Sequence
  Synthetic oligonucleotide
ggtacgtgggggggaagaaaccaagcagtagggtc

SEQ ID NO: 23467 - DNA, 35 bp, Artificial Sequence
  Synthetic oligonucleotide
tgtgtacatgcagggggtcgtaaggaggagtggag

SEQ ID NO: 23468 - DNA, 35 bp, Artificial Sequence
  Synthetic oligonucleotide
tgttacccggaccacacttacgcgccttccattgg

SEQ ID NO: 23469 - DNA, 35 bp, Artificial Sequence
  Synthetic oligonucleotide
acgctggccagcactactcagttttccttctgctg

SEQ ID NO: 23470 - DNA, 35 bp, Artificial Sequence
  Synthetic oligonucleotide
tcacgtccccgctttcagtctgcttcgttttacct

SEQ ID NO: 23471 - DNA, 35 bp, Artificial Sequence
  Synthetic oligonucleotide
gcgccctgcgccctaaagcttggcttactgtttct

SEQ ID NO: 23472 - DNA, 35 bp, Artificial Sequence
  Synthetic oligonucleotide
gtgatcctacaagcttgccccggctcccctgcctt

SEQ ID NO: 23473 - DNA, 37 bp, Artificial Sequence
  Synthetic oligonucleotide
gtgaggtgggcggggagggggaaatgtaggattgaga

SEQ ID NO: 23474 - DNA, 37 bp, Artificial Sequence
  Synthetic oligonucleotide
gctcggggccgttctctctatgttccatcttagctga

SEQ ID NO: 23475 - DNA, 36 bp, Artificial Sequence
  Synthetic oligonucleotide
gtcgcaccgctcctcttgtttccctgcttggtctga

SEQ ID NO: 23476 - DNA, 36 bp, Artificial Sequence
  Synthetic oligonucleotide
tcactcccaggacaccagcctttctggctctaccaa

SEQ ID NO: 23477 - DNA, 36 bp, Artificial Sequence
  Synthetic oligonucleotide
ttgtaacctggccacccgtcccacctccgtgtgcga

SEQ ID NO: 23478 - DNA, 37 bp, Artificial Sequence
  Synthetic oligonucleotide
tcccacggctcctcatctgcctcaaacacctacgtga

SEQ ID NO: 23479 - DNA, 35 bp, Artificial Sequence
  Synthetic oligonucleotide
gttgagcttgagccacctttcccattgtctgccac

SEQ ID NO: 23480 - DNA, 35 bp, Artificial Sequence
  Synthetic oligonucleotide
tttcaccctgcccatctaccattaaagcccgtacg

SEQ ID NO: 23481 - DNA, 35 bp, Artificial Sequence
  Synthetic oligonucleotide
gcacggttcacagtctccctataacgttgtggcct

SEQ ID NO: 23482 - DNA, 35 bp, Artificial Sequence
  Synthetic oligonucleotide
acacaagcacaggtccctattcgaagtttcgttct

SEQ ID NO: 23483 - DNA, 35 bp, Artificial Sequence
  Synthetic oligonucleotide
tacgtaatgggaaaggcaagaaagggacagctagt

SEQ ID NO: 23484 - DNA, 35 bp, Artificial Sequence
  Synthetic oligonucleotide
gtcatccggtctcctgttactacccaccctttatt

SEQ ID NO: 23485 - DNA, 35 bp, Artificial Sequence
  Synthetic oligonucleotide
tattccgccgatcccaaattgtctctgctgttaca

SEQ ID NO: 23486 - DNA, 36 bp, Artificial Sequence
  Synthetic oligonucleotide
gccacagggccgggccacctcctctccatgtaagca

SEQ ID NO: 23487 - DNA, 36 bp, Artificial Sequence
  Synthetic oligonucleotide
tacgcgcacctcccaattttcgaacgcccgtgttca

SEQ ID NO: 23488 - DNA, 36 bp, Artificial Sequence
  Synthetic oligonucleotide
tcagccaccctgttcggcctcgatattgctacgtga

SEQ ID NO: 23489 - DNA, 38 bp, Artificial Sequence
  Synthetic oligonucleotide
accacgttcgtacgtggtcctctcttgtacaaccttga

SEQ ID NO: 23490 - DNA, 35 bp, Artificial Sequence
  Synthetic oligonucleotide
tcattccaccttagctatgtcctgcaccttaagta

SEQ ID NO: 23491 - DNA, 35 bp, Artificial Sequence
  Synthetic oligonucleotide
gtcccctctcttctctttggcccagtggctcaacc

SEQ ID NO: 23492 - DNA, 35 bp, Artificial Sequence
  Synthetic oligonucleotide
tgcacgtcccggcacgcgaaagaaacaccacctgc

SEQ ID NO: 23493 - DNA, 35 bp, Artificial Sequence
  Synthetic oligonucleotide
tccggggtcccactatccgtcgtttcatttccatc

SEQ ID NO: 23494 - DNA, 35 bp, Artificial Sequence
  Synthetic oligonucleotide
gcccagtgaggggtatcaaaggggaaggtgtgggg

SEQ ID NO: 23495 - DNA, 35 bp, Artificial Sequence
  Synthetic oligonucleotide
tctaccgctcccgacctaggtctttgctgctctat

SEQ ID NO: 23496 - DNA, 35 bp, Artificial Sequence
  Synthetic oligonucleotide
gagtgtgccccaaactgtcttcttacccgttcttt

SEQ ID NO: 23497 - DNA, 36 bp, Artificial Sequence
  Synthetic oligonucleotide
gtgggacgtggtaagggttgcgggcgaagaagataa

SEQ ID NO: 23498 - DNA, 35 bp, Artificial Sequence
  Synthetic oligonucleotide
gacaacgggggagggatggaaaacggttggctaca

SEQ ID NO: 23499 - DNA, 35 bp, Artificial Sequence
  Synthetic oligonucleotide
gcatgcccccctgagctctacaccgctcgtaacga

SEQ ID NO: 23500 - DNA, 37 bp, Artificial Sequence
  Synthetic oligonucleotide
tagcacggctcatcgcgtcaaaccctgccaccagtga

SEQ ID NO: 23501 - DNA, 38 bp, Artificial Sequence
  Synthetic oligonucleotide
tgccggggatcgcctgctttacgctccatcaacattga

SEQ ID NO: 23502 - DNA, 37 bp, Artificial Sequence
  Synthetic oligonucleotide
tccatcacccgacctttgcgtatttctgcctgtttga

SEQ ID NO: 23503 - DNA, 35 bp, Artificial Sequence
  Synthetic oligonucleotide
gcctccgtccatggaaggcacccctgaccctgaac

SEQ ID NO: 23504 - DNA, 35 bp, Artificial Sequence
  Synthetic oligonucleotide
gtgcgatccggcactaggcctaatttcccacaacc

SEQ ID NO: 23505 - DNA, 35 bp, Artificial Sequence
  Synthetic oligonucleotide
taaagccaccacatatctatggtactcatcgttcc

SEQ ID NO: 23506 - DNA, 35 bp, Artificial Sequence
  Synthetic oligonucleotide
acaacagcacttgcacctctggcactgagcacttc

SEQ ID NO: 23507 - DNA, 35 bp, Artificial Sequence
  Synthetic oligonucleotide
tctgctccacttcaatttttctgcctctgcaatcg

SEQ ID NO: 23508 - DNA, 35 bp, Artificial Sequence
  Synthetic oligonucleotide
gtcccgcaacttcacgtctactagtcttaccacat

SEQ ID NO: 23509 - DNA, 34 bp, Artificial Sequence
  Synthetic oligonucleotide
tgtcagtcgtgcaccctcgacctatagtggttct

SEQ ID NO: 23510 - DNA, 35 bp, Artificial Sequence
  Synthetic oligonucleotide
attggacaggagaacgagcggaggggacgattaga

SEQ ID NO: 23511 - DNA, 38 bp, Artificial Sequence
  Synthetic oligonucleotide
tccagcacccacattctgacacatccgccagctgctga

SEQ ID NO: 23512 - DNA, 38 bp, Artificial Sequence
  Synthetic oligonucleotide
gtcacgacgactacgtgcggttgggccctctttcttga

SEQ ID NO: 23513 - DNA, 35 bp, Artificial Sequence
  Synthetic oligonucleotide
tttcccccgtcgatacttcctcctgcaattggtcc

SEQ ID NO: 23514 - DNA, 35 bp, Artificial Sequence
  Synthetic oligonucleotide
taacggtcaatgctgtcacttcgggccgtcttttc

SEQ ID NO: 23515 - DNA, 35 bp, Artificial Sequence
  Synthetic oligonucleotide
aacgaatcatcagctccggctctcctcttgttgcg

SEQ ID NO: 23516 - DNA, 35 bp, Artificial Sequence
  Synthetic oligonucleotide
agcccacactacgatcattatcacctcttcaggtg

SEQ ID NO: 23517 - DNA, 36 bp, Artificial Sequence
  Synthetic oligonucleotide
tgtcaacggactgcagggtcttggtcctattcaaca

SEQ ID NO: 23518 - DNA, 36 bp, Artificial Sequence
  Synthetic oligonucleotide
aacacacgacctcgttaaaagctctgcccctataca

SEQ ID NO: 23519 - DNA, 36 bp, Artificial Sequence
  Synthetic oligonucleotide
tgaatgcgaatgcagaggagaaaaggtgatggaaga

SEQ ID NO: 23520 - DNA, 37 bp, Artificial Sequence
  Synthetic oligonucleotide
accctcggagcacacccaagcgctgccatcctttcga

SEQ ID NO: 23521 - DNA, 38 bp, Artificial Sequence
  Synthetic oligonucleotide
gaccggactgcaggagaatattggtcatcatgtagtga

SEQ ID NO: 23522 - DNA, 38 bp, Artificial Sequence
  Synthetic oligonucleotide
tagaggtggagaaagggtgggacggcgcctgggggtga

SEQ ID NO: 23523 - DNA, 36 bp, Artificial Sequence
  Synthetic oligonucleotide
tgccatcagcacccgttccttctccgacactaggta

SEQ ID NO: 23524 - DNA, 35 bp, Artificial Sequence
  Synthetic oligonucleotide
ctggacttcactgctcctcccccgagacaggtgtc

SEQ ID NO: 23525 - DNA, 36 bp, Artificial Sequence
  Synthetic oligonucleotide
gatcttgccctccctgtaaataatactgcattacaa

SEQ ID NO: 23526 - DNA, 35 bp, Artificial Sequence
  Synthetic oligonucleotide
atggcctgtaccccccatcccgtaccatccgatca

SEQ ID NO: 23527 - DNA, 37 bp, Artificial Sequence
  Synthetic oligonucleotide
gacaaaacggtggtaagtggaaggggggacgcacaga

SEQ ID NO: 23528 - DNA, 36 bp, Artificial Sequence
  Synthetic oligonucleotide
tccttccacccgcagctacacttgtctcagcattga

SEQ ID NO: 23529 - DNA, 36 bp, Artificial Sequence
  Synthetic oligonucleotide
atacgcatcacctcgatctctggaatttggccttga

SEQ ID NO: 23530 - DNA, 38 bp, Artificial Sequence
  Synthetic oligonucleotide
gcacgtgctgttcacgcccccatcccggactgttttga

SEQ ID NO: 23531 - DNA, 35 bp, Artificial Sequence
  Synthetic oligonucleotide
ttagggcgcgcactgcccatcttccctctcacgcc

SEQ ID NO: 23532 - DNA, 35 bp, Artificial Sequence
  Synthetic oligonucleotide
gtgattgccgcattcttgtttacgtcccgcctttt

SEQ ID NO: 23533 - DNA, 36 bp, Artificial Sequence
  Synthetic oligonucleotide
acacacacacggggcatctcgcctgagctccttaaa

SEQ ID NO: 23534 - DNA, 36 bp, Artificial Sequence
  Synthetic oligonucleotide
tcacagaagcgaattccatcacggcccagtccccca

SEQ ID NO: 23535 - DNA, 35 bp, Artificial Sequence
  Synthetic oligonucleotide
gccagcctgcatccccgtttggactgacttcttca

SEQ ID NO: 23536 - DNA, 37 bp, Artificial Sequence
  Synthetic oligonucleotide
tcagacggacgaggacgaggtaggaaagtactgcaga

SEQ ID NO: 23537 - DNA, 37 bp, Artificial Sequence
  Synthetic oligonucleotide
tccggacacaccgcttctggttatcttgcactaccga

SEQ ID NO: 23538 - DNA, 37 bp, Artificial Sequence
  Synthetic oligonucleotide
gtgcagtgcacacgaacaaacagacgaggagtacgga

SEQ ID NO: 23539 - DNA, 37 bp, Artificial Sequence
  Synthetic oligonucleotide
tgggcgagccctccacacgcggttaccgattaccgga

SEQ ID NO: 23540 - DNA, 37 bp, Artificial Sequence
  Synthetic oligonucleotide
gttatccaccccagccttcagtcctgtgatcctggga

SEQ ID NO: 23541 - DNA, 38 bp, Artificial Sequence
  Synthetic oligonucleotide
atgctcctcaccacatccatcatcgcatatcgcactga

SEQ ID NO: 23542 - DNA, 35 bp, Artificial Sequence
  Synthetic oligonucleotide
ttctgttccagctacccatcggagccctgccttga

SEQ ID NO: 23543 - DNA, 36 bp, Artificial Sequence
  Synthetic oligonucleotide
ttgacaccatagcaacgcacgcttcctccttcggta

SEQ ID NO: 23544 - DNA, 35 bp, Artificial Sequence
  Synthetic oligonucleotide
gccctacctcgagtatagcgtgcggttcactcacc

SEQ ID NO: 23545 - DNA, 34 bp, Artificial Sequence
  Synthetic oligonucleotide
gattatcgcagacatccggttccactcttggttc

SEQ ID NO: 23546 - DNA, 36 bp, Artificial Sequence
  Synthetic oligonucleotide
acatgcccctggccacatcctttaagccgtattaaa

SEQ ID NO: 23547 - DNA, 35 bp, Artificial Sequence
  Synthetic oligonucleotide
tcgtgaactgaacgtgcgaagctgcccaccatcaa

SEQ ID NO: 23548 - DNA, 36 bp, Artificial Sequence
  Synthetic oligonucleotide
accatccccctctctgatactcgggacgtactaaca

SEQ ID NO: 23549 - DNA, 37 bp, Artificial Sequence
  Synthetic oligonucleotide
gacacccgcacattcccgcagaccagcgcatacgaga

SEQ ID NO: 23550 - DNA, 36 bp, Artificial Sequence
  Synthetic oligonucleotide
taacttgcccccccggttggacccttgatctctaga

SEQ ID NO: 23551 - DNA, 37 bp, Artificial Sequence
  Synthetic oligonucleotide
actaccgacgcatatcccacctcccgtgaactacgga

SEQ ID NO: 23552 - DNA, 37 bp, Artificial Sequence
  Synthetic oligonucleotide
gtagagtgcggagggggaaaggagcgtttcggctgga

SEQ ID NO: 23553 - DNA, 38 bp, Artificial Sequence
  Synthetic oligonucleotide
tgaccacccgcccagtcgacctgtgatctatcccatga

SEQ ID NO: 23554 - DNA, 35 bp, Artificial Sequence
  Synthetic oligonucleotide
aagcacctcggtgcagaccacgttcgcccttgatc

SEQ ID NO: 23555 - DNA, 35 bp, Artificial Sequence
  Synthetic oligonucleotide
actcccatccgtgcgatagtccaccctgtgttttg

SEQ ID NO: 23556 - DNA, 35 bp, Artificial Sequence
  Synthetic oligonucleotide
tcatgcacactggtttcctgggctgtcgaccctct

SEQ ID NO: 23557 - DNA, 36 bp, Artificial Sequence
  Synthetic oligonucleotide
gccacttcctcccaggttgctaattgccgttgcaca

SEQ ID NO: 23558 - DNA, 36 bp, Artificial Sequence
  Synthetic oligonucleotide
gagagagggaacgggagggtctagttgcctggggca

SEQ ID NO: 23559 - DNA, 36 bp, Artificial Sequence
  Synthetic oligonucleotide
atcgactcagtatgttcctctccgtccccatttgca

SEQ ID NO: 23560 - DNA, 37 bp, Artificial Sequence
  Synthetic oligonucleotide
ttcccatgccatcgtgtcgcgttcccatgtccactga

SEQ ID NO: 23561 - DNA, 38 bp, Artificial Sequence
  Synthetic oligonucleotide
gaagtcgaccatgctgcactatgcttccacctcgctga

SEQ ID NO: 23562 - DNA, 35 bp, Artificial Sequence
  Synthetic oligonucleotide
gacgatgtacgccaatcctaaccgccgacaaacac

SEQ ID NO: 23563 - DNA, 35 bp, Artificial Sequence
  Synthetic oligonucleotide
gtgaccccatctgcccggcgtacacaacataggtc

SEQ ID NO: 23564 - DNA, 35 bp, Artificial Sequence
  Synthetic oligonucleotide
gaagggtgacggggaattgtgggagaagaaaagcg

SEQ ID NO: 23565 - DNA, 35 bp, Artificial Sequence
  Synthetic oligonucleotide
tgtgaccgcaaattgctactttttcctagatctct

SEQ ID NO: 23566 - DNA, 35 bp, Artificial Sequence
  Synthetic oligonucleotide
gaccccggtcacaacatttgaagtgagtttctttt

SEQ ID NO: 23567 - DNA, 36 bp, Artificial Sequence
  Synthetic oligonucleotide
gcctagtgggcaagggggaggtgacgcaggggggga

SEQ ID NO: 23568 - DNA, 38 bp, Artificial Sequence
  Synthetic oligonucleotide
gacatcgctgacctcggcccattgaaccatcttgttga

SEQ ID NO: 23569 - DNA, 38 bp, Artificial Sequence
  Synthetic oligonucleotide
attgcaatcgggcggtgggaaggggaatgcacctttga

SEQ ID NO: 23570 - DNA, 35 bp, Artificial Sequence
  Synthetic oligonucleotide
aacacagtgcgtgtacgtgcgtgtacatttacccc

SEQ ID NO: 23571 - DNA, 35 bp, Artificial Sequence
  Synthetic oligonucleotide
gacccctggccttaccgcttcttcttgacaacacg

SEQ ID NO: 23572 - DNA, 35 bp, Artificial Sequence
  Synthetic oligonucleotide
tctccccctaacatcgtgtacaggacctcccaccg

SEQ ID NO: 23573 - DNA, 36 bp, Artificial Sequence
  Synthetic oligonucleotide
tagagggggagaagggggtgagagccatgtttcgca

SEQ ID NO: 23574 - DNA, 35 bp, Artificial Sequence
  Synthetic oligonucleotide
gctgtcgggggggggatctggggcggaacggcgga

SEQ ID NO: 23575 - DNA, 37 bp, Artificial Sequence
  Synthetic oligonucleotide
atccgcgcgatcacctcacttctaccatttagctgga

SEQ ID NO: 23576 - DNA, 38 bp, Artificial Sequence
  Synthetic oligonucleotide
gaccccccttacgatggttctacggtgtttttgcttga

SEQ ID NO: 23577 - DNA, 38 bp, Artificial Sequence
  Synthetic oligonucleotide
tcactcccgccggtggtcctattcctagtagttgttga

SEQ ID NO: 23578 - DNA, 35 bp, Artificial Sequence
  Synthetic oligonucleotide
gacgtggccccgccgttccacttttttctgtaaac

SEQ ID NO: 23579 - DNA, 35 bp, Artificial Sequence
  Synthetic oligonucleotide
gaaccgatggaagtctcccggctaaccgccccccc

SEQ ID NO: 23580 - DNA, 35 bp, Artificial Sequence
  Synthetic oligonucleotide
gcgccaccccgtactttgcttgtcgcgaccgtgcc

SEQ ID NO: 23581 - DNA, 35 bp, Artificial Sequence
  Synthetic oligonucleotide
gaagccccggcctcgcctttttcgggaccacttcc

SEQ ID NO: 23582 - DNA, 35 bp, Artificial Sequence
  Synthetic oligonucleotide
gatcccgcgcatttcatcattatactcggccgtgc

SEQ ID NO: 23583 - DNA, 35 bp, Artificial Sequence
  Synthetic oligonucleotide
atagccgacccagtgcaatttgtttcttttcccgt

SEQ ID NO: 23584 - DNA, 37 bp, Artificial Sequence
  Synthetic oligonucleotide
aagtgacggaagttaaggaaaaaaaaggtggtgtaga

SEQ ID NO: 23585 - DNA, 37 bp, Artificial Sequence
  Synthetic oligonucleotide
gacgcatcggtccatccttctcataatgctcgtacga

SEQ ID NO: 23586 - DNA, 38 bp, Artificial Sequence
  Synthetic oligonucleotide
ttagcggggggcaaaggttatggggcctatgggtgtga

SEQ ID NO: 23587 - DNA, 36 bp, Artificial Sequence
  Synthetic oligonucleotide
gcccgccgccaatgcctccgtctgccataataccta

SEQ ID NO: 23588 - DNA, 36 bp, Artificial Sequence
  Synthetic oligonucleotide
tgccaccagtaccgcgagggcgcatcactcccctta

SEQ ID NO: 23589 - DNA, 36 bp, Artificial Sequence
  Synthetic oligonucleotide
attgacccaagccacactgttatgtgagggttgtta

SEQ ID NO: 23590 - DNA, 35 bp, Artificial Sequence
  Synthetic oligonucleotide
gcgacgggtctgccccaatgttccgaatcctgtcc

SEQ ID NO: 23591 - DNA, 35 bp, Artificial Sequence
  Synthetic oligonucleotide
tgcccacatacggacgtaattatcaacactattgc

SEQ ID NO: 23592 - DNA, 35 bp, Artificial Sequence
  Synthetic oligonucleotide
actggcctccgcgacccgccttcccctcgtgctgg

SEQ ID NO: 23593 - DNA, 35 bp, Artificial Sequence
  Synthetic oligonucleotide
gaagcgacggggacaagtttggggcagggggaatg

SEQ ID NO: 23594 - DNA, 35 bp, Artificial Sequence
  Synthetic oligonucleotide
tcaccaacgcggtggtgttttaatgtcctttcttg

SEQ ID NO: 23595 - DNA, 36 bp, Artificial Sequence
  Synthetic oligonucleotide
tcacccaatgcgattcagttagccacaccatcttgt

SEQ ID NO: 23596 - DNA, 36 bp, Artificial Sequence
  Synthetic oligonucleotide
taggttatcccagctccgtacctagtcctgctccca

SEQ ID NO: 23597 - DNA, 36 bp, Artificial Sequence
  Synthetic oligonucleotide
atgcacacgatcccgcttgccccgcactcgcttgca

SEQ ID NO: 23598 - DNA, 37 bp, Artificial Sequence
  Synthetic oligonucleotide
tagacgcccgtccgtttcctgtaaccatctgttgcga

SEQ ID NO: 23599 - DNA, 37 bp, Artificial Sequence
  Synthetic oligonucleotide
ttgagggggcccgaaacagtaagagggcgggcgggga

SEQ ID NO: 23600 - DNA, 35 bp, Artificial Sequence
  Synthetic oligonucleotide
tacaacgtacattccgcctccgctatctatgccgc

SEQ ID NO: 23601 - DNA, 35 bp, Artificial Sequence
  Synthetic oligonucleotide
gttcacccttactcccgccattacaccactgcgtc

SEQ ID NO: 23602 - DNA, 35 bp, Artificial Sequence
  Synthetic oligonucleotide
gcacgcccgtcctccttcgctggtgaccctcaaag

SEQ ID NO: 23603 - DNA, 35 bp, Artificial Sequence
  Synthetic oligonucleotide
ccgtggacacacaggagccaggaccgaatgaaacg

SEQ ID NO: 23604 - DNA, 35 bp, Artificial Sequence
  Synthetic oligonucleotide
tgcccactggtagtttcgtacatccctcacaattg

SEQ ID NO: 23605 - DNA, 35 bp, Artificial Sequence
  Synthetic oligonucleotide
agaccgcgctcgctcaactgttagttacaccctgt

SEQ ID NO: 23606 - DNA, 37 bp, Artificial Sequence
  Synthetic oligonucleotide
taccgtcccaccacatcgtttagccgccgaatagcga

SEQ ID NO: 23607 - DNA, 37 bp, Artificial Sequence
  Synthetic oligonucleotide
ttcatccaccagtattctcgaagcacatgcccatcga

SEQ ID NO: 23608 - DNA, 36 bp, Artificial Sequence
  Synthetic oligonucleotide
ttgtggaaaggggatattgggcaggggtggaacgga

SEQ ID NO: 23609 - DNA, 37 bp, Artificial Sequence
  Synthetic oligonucleotide
gttgcacaacaattgggtgggggtgacctagggcgga

SEQ ID NO: 23610 - DNA, 37 bp, Artificial Sequence
  Synthetic oligonucleotide
gtggaaagacgacgcggtgtcaaggggggggtcggga

SEQ ID NO: 23611 - DNA, 37 bp, Artificial Sequence
  Synthetic oligonucleotide
tcaccccgccgacctacaggtatattccccaactgga

SEQ ID NO: 23612 - DNA, 37 bp, Artificial Sequence
  Synthetic oligonucleotide
gtaggaggggaggagggagtagatgcgtcgggttgga

SEQ ID NO: 23613 - DNA, 38 bp, Artificial Sequence
  Synthetic oligonucleotide
tggagtgatggaggcgtggtaagggggggagtggatga

SEQ ID NO: 23614 - DNA, 38 bp, Artificial Sequence
  Synthetic oligonucleotide
gatgtagggcccgggcaaaaagggtgagactcgcgtga

SEQ ID NO: 23615 - DNA, 35 bp, Artificial Sequence
  Synthetic oligonucleotide
aacatccttcgttggccttttatgctttcgtttac

SEQ ID NO: 23616 - DNA, 35 bp, Artificial Sequence
  Synthetic oligonucleotide
atgttcccttgcaccgccatcgctatcacggatcc

SEQ ID NO: 23617 - DNA, 35 bp, Artificial Sequence
  Synthetic oligonucleotide
agaccccagccctgatcaactatgcaaaacactcc

SEQ ID NO: 23618 - DNA, 35 bp, Artificial Sequence
  Synthetic oligonucleotide
ggtgggagaacgggaatggtggtgtaactgcggcg

SEQ ID NO: 23619 - DNA, 35 bp, Artificial Sequence
  Synthetic oligonucleotide
tccagcacgccgtactctttcaccactgattattg

SEQ ID NO: 23620 - DNA, 35 bp, Artificial Sequence
  Synthetic oligonucleotide
tgctcattgcccctgacgctgaaaaacgttcccat

SEQ ID NO: 23621 - DNA, 35 bp, Artificial Sequence
  Synthetic oligonucleotide
ttggaggtcgccagtgttctcgaatttgtcctcct

SEQ ID NO: 23622 - DNA, 35 bp, Artificial Sequence
  Synthetic oligonucleotide
agcatcgagtgatcagcgcccatgctcctatcctt

SEQ ID NO: 23623 - DNA, 35 bp, Artificial Sequence
  Synthetic oligonucleotide
acacccaaaccgtatcatagctgcacccttgacaa

SEQ ID NO: 23624 - DNA, 36 bp, Artificial Sequence
  Synthetic oligonucleotide
gtaccccgccctgtaggttactatgcaatgccatca

SEQ ID NO: 23625 - DNA, 34 bp, Artificial Sequence
  Synthetic oligonucleotide
gtgccaataacctacccagcacccgtttctgtca

SEQ ID NO: 23626 - DNA, 36 bp, Artificial Sequence
  Synthetic oligonucleotide
tgtcttacccgccttgccccttgtgttctcctcaga

SEQ ID NO: 23627 - DNA, 37 bp, Artificial Sequence
  Synthetic oligonucleotide
tagtcgcctcccgttccgcgccgtgatcccaccccga

SEQ ID NO: 23628 - DNA, 35 bp, Artificial Sequence
  Synthetic oligonucleotide
gttccgacctacgcaccacgtgtccccactccgac

SEQ ID NO: 23629 - DNA, 35 bp, Artificial Sequence
  Synthetic oligonucleotide
agtgcacaacccccatgaagtccgaccagcccgcc

SEQ ID NO: 23630 - DNA, 35 bp, Artificial Sequence
  Synthetic oligonucleotide
gagcgtgcgtaccatgcttccaaaccgtttcttcc

SEQ ID NO: 23631 - DNA, 35 bp, Artificial Sequence
  Synthetic oligonucleotide
gcacgtcctcttattctggcatccacccaccgcct

SEQ ID NO: 23632 - DNA, 35 bp, Artificial Sequence
  Synthetic oligonucleotide
gcactcccgtttcggaccagcgtgtcatgccttct

SEQ ID NO: 23633 - DNA, 34 bp, Artificial Sequence
  Synthetic oligonucleotide
cttcgcacacatcccgtggtcttgtaccctgctt

SEQ ID NO: 23634 - DNA, 36 bp, Artificial Sequence
  Synthetic oligonucleotide
tctgagctcgggaacggggggattaactaggcggaa

SEQ ID NO: 23635 - DNA, 35 bp, Artificial Sequence
  Synthetic oligonucleotide
gatgatcgatcctctgtcctgcaccgcactcacga

SEQ ID NO: 23636 - DNA, 37 bp, Artificial Sequence
  Synthetic oligonucleotide
gtgcaacgcagcttctcgtttttcctatcgttttcga

SEQ ID NO: 23637 - DNA, 35 bp, Artificial Sequence
  Synthetic oligonucleotide
acgccagaagcgctcccagttccctcgctctacac

SEQ ID NO: 23638 - DNA, 35 bp, Artificial Sequence
  Synthetic oligonucleotide
tggtcgattagcgctgcccgccactgtgctcccac

SEQ ID NO: 23639 - DNA, 35 bp, Artificial Sequence
  Synthetic oligonucleotide
gacatagttggggagggcgaggtgggatcgagtac

SEQ ID NO: 23640 - DNA, 35 bp, Artificial Sequence
  Synthetic oligonucleotide
atactgcaggatcgatcccctcatccgtgatttcc

SEQ ID NO: 23641 - DNA, 35 bp, Artificial Sequence
  Synthetic oligonucleotide
gcccaattcaccctccacatgctttagactagggc

SEQ ID NO: 23642 - DNA, 35 bp, Artificial Sequence
  Synthetic oligonucleotide
gagagggccatttggcgtgagtcctttccatcatc

SEQ ID NO: 23643 - DNA, 35 bp, Artificial Sequence
  Synthetic oligonucleotide
ggggaaggacgacaggacgttgggggaaggtgcag

SEQ ID NO: 23644 - DNA, 35 bp, Artificial Sequence
  Synthetic oligonucleotide
tcacacttgcacggtctatcacaattcgagcctag

SEQ ID NO: 23645 - DNA, 35 bp, Artificial Sequence
  Synthetic oligonucleotide
aatgagggtaatgagaggatggatcgtgaaacagg

SEQ ID NO: 23646 - DNA, 35 bp, Artificial Sequence
  Synthetic oligonucleotide
tgtcccaccgctatccctagaataggttcttccct

SEQ ID NO: 23647 - DNA, 34 bp, Artificial Sequence
  Synthetic oligonucleotide
gatgagcgtattctgcatttcgacgttctgcttt

SEQ ID NO: 23648 - DNA, 36 bp, Artificial Sequence
  Synthetic oligonucleotide
tctcacacacacgggaacggatcaattggcttacaa

SEQ ID NO: 23649 - DNA, 37 bp, Artificial Sequence
  Synthetic oligonucleotide
actcgcgcataggtaacctccctgccttttctccgga

SEQ ID NO: 23650 - DNA, 35 bp, Artificial Sequence
  Synthetic oligonucleotide
atgttgcaacggccgctcgcaatctatccaattcc

SEQ ID NO: 23651 - DNA, 35 bp, Artificial Sequence
  Synthetic oligonucleotide
gtgtagccccccttctgtgctcgaaaaaccatccg

SEQ ID NO: 23652 - DNA, 35 bp, Artificial Sequence
  Synthetic oligonucleotide
atcggtgcgcgctggtcactgctgtccttgcccat

SEQ ID NO: 23653 - DNA, 35 bp, Artificial Sequence
  Synthetic oligonucleotide
ttggtccggttgctacctggttctcttattccact

SEQ ID NO: 23654 - DNA, 35 bp, Artificial Sequence
  Synthetic oligonucleotide
tcagccaccccctcccacggttcgaaggcagtact

SEQ ID NO: 23655 - DNA, 37 bp, Artificial Sequence
  Synthetic oligonucleotide
ttacgcgcatcaaatctttctacatcgtccgtctcga

SEQ ID NO: 23656 - DNA, 37 bp, Artificial Sequence
  Synthetic oligonucleotide
aagtagggtggggcggatgagcgggctcgcgggagga

SEQ ID NO: 23657 - DNA, 37 bp, Artificial Sequence
  Synthetic oligonucleotide
gcaaacggaggtgtcaagatggcggtgggggggttga

SEQ ID NO: 23658 - DNA, 35 bp, Artificial Sequence
  Synthetic oligonucleotide
tgatagcgcgccgcactaccacatgatcacaccta

SEQ ID NO: 23659 - DNA, 36 bp, Artificial Sequence
  Synthetic oligonucleotide
gaacacgccctcgttattaccacgtgattatgccta

SEQ ID NO: 23660 - DNA, 36 bp, Artificial Sequence
  Synthetic oligonucleotide
atagctccagcgccttgtcttgtcctctgccgctta

SEQ ID NO: 23661 - DNA, 34 bp, Artificial Sequence
  Synthetic oligonucleotide
gtggaccgatcgtatcattcccgtcctactctta

SEQ ID NO: 23662 - DNA, 35 bp, Artificial Sequence
  Synthetic oligonucleotide
ggtcctagtcagccaatatcacacccacgtacccc

SEQ ID NO: 23663 - DNA, 35 bp, Artificial Sequence
  Synthetic oligonucleotide
gacacggccgatattaatcctgctcccgaaagccc

SEQ ID NO: 23664 - DNA, 35 bp, Artificial Sequence
  Synthetic oligonucleotide
atcactccctgggtttgggcatttatttactcccg

SEQ ID NO: 23665 - DNA, 35 bp, Artificial Sequence
  Synthetic oligonucleotide
gccacctgcccgtatccgctgaaccacaacatcgg

SEQ ID NO: 23666 - DNA, 35 bp, Artificial Sequence
  Synthetic oligonucleotide
tcaccacatctccctgtcgtcccacatatcgcgtg

SEQ ID NO: 23667 - DNA, 36 bp, Artificial Sequence
  Synthetic oligonucleotide
attgtcccatggacagccccagcccgaacccatcca

SEQ ID NO: 23668 - DNA, 35 bp, Artificial Sequence
  Synthetic oligonucleotide
tccagccacccctgacccttcctaccaatgtcaga

SEQ ID NO: 23669 - DNA, 37 bp, Artificial Sequence
  Synthetic oligonucleotide
aaccctccacgtagtgctacgctcccacccaaggtga

SEQ ID NO: 23670 - DNA, 38 bp, Artificial Sequence
  Synthetic oligonucleotide
acaaccccggatccgtaaatactacctcaaccgattga

SEQ ID NO: 23671 - DNA, 38 bp, Artificial Sequence
  Synthetic oligonucleotide
acccctgcagccctcccttcgtcctattctgcgtttga

SEQ ID NO: 23672 - DNA, 35 bp, Artificial Sequence
  Synthetic oligonucleotide
tgtacacacactttcttgcatcaagcctgagaaac

SEQ ID NO: 23673 - DNA, 35 bp, Artificial Sequence
  Synthetic oligonucleotide
tcgatcgtgtagatcggtttcccatccatgctact

SEQ ID NO: 23674 - DNA, 35 bp, Artificial Sequence
  Synthetic oligonucleotide
gtcacgtctcgcttaccacggtacctgctatccct

SEQ ID NO: 23675 - DNA, 35 bp, Artificial Sequence
  Synthetic oligonucleotide
tttgcgaacgttcacgtcggttctatctttccatt

SEQ ID NO: 23676 - DNA, 35 bp, Artificial Sequence
  Synthetic oligonucleotide
ggtgacggatagtactcacaccatgctacactaca

SEQ ID NO: 23677 - DNA, 36 bp, Artificial Sequence
  Synthetic oligonucleotide
taacgctgctgcacggccttaattgaacactcctca

SEQ ID NO: 23678 - DNA, 37 bp, Artificial Sequence
  Synthetic oligonucleotide
tgccggtgcgcacatcgtttcgtattttttttgccga

SEQ ID NO: 23679 - DNA, 37 bp, Artificial Sequence
  Synthetic oligonucleotide
gcactgtgaggaggggaatggggagaagaaaatggga

SEQ ID NO: 23680 - DNA, 37 bp, Artificial Sequence
  Synthetic oligonucleotide
ttgccggtcgaacgtacttggcttgggggaattggga

SEQ ID NO: 23681 - DNA, 37 bp, Artificial Sequence
  Synthetic oligonucleotide
actcctgccacactttgggcctttacgtcatctatga

SEQ ID NO: 23682 - DNA, 34 bp, Artificial Sequence
  Synthetic oligonucleotide
gtactcccgacgttgacttgaaccgttttgctta

SEQ ID NO: 23683 - DNA, 35 bp, Artificial Sequence
  Synthetic oligonucleotide
gtgcccagccaagtattttacccctcgtcctgtta

SEQ ID NO: 23684 - DNA, 35 bp, Artificial Sequence
  Synthetic oligonucleotide
ggatctactgctgactctcctgcgacagtctaccc

SEQ ID NO: 23685 - DNA, 35 bp, Artificial Sequence
  Synthetic oligonucleotide
tccaagggcgtaccttgagttatcgttttttgtcc

SEQ ID NO: 23686 - DNA, 35 bp, Artificial Sequence
  Synthetic oligonucleotide
agcaaacccagctgaaccttctagaccacgcaagc

SEQ ID NO: 23687 - DNA, 35 bp, Artificial Sequence
  Synthetic oligonucleotide
acgcacccgagatacactgtccgcataccatcttc

SEQ ID NO: 23688 - DNA, 35 bp, Artificial Sequence
  Synthetic oligonucleotide
tttgctcccggcgccaccattttcagctcccgctg

SEQ ID NO: 23689 - DNA, 35 bp, Artificial Sequence
  Synthetic oligonucleotide
tcttgacacgcccaccattggcaaacccccagttt

SEQ ID NO: 23690 - DNA, 36 bp, Artificial Sequence
  Synthetic oligonucleotide
aaaaaggcacccctagcccccacgtgctgccataca

SEQ ID NO: 23691 - DNA, 35 bp, Artificial Sequence
  Synthetic oligonucleotide
gtctgcgcaaatctcgcaccactccgtagtaccca

SEQ ID NO: 23692 - DNA, 35 bp, Artificial Sequence
  Synthetic oligonucleotide
acactcatgcgactgccgcccctgcaggtccctca

SEQ ID NO: 23693 - DNA, 37 bp, Artificial Sequence
  Synthetic oligonucleotide
aagggaggaaacacaagcaggtaggggagattgagga

SEQ ID NO: 23694 - DNA, 37 bp, Artificial Sequence
  Synthetic oligonucleotide
ggagagagaagacagtgtaccaaggtgggcggcggga

SEQ ID NO: 23695 - DNA, 38 bp, Artificial Sequence
  Synthetic oligonucleotide
tccacctacggaacgcttacataccccatggtccttga

SEQ ID NO: 23696 - DNA, 30 bp, Artificial Sequence
  Synthetic oligonucleotide
tcaacatctcatacattcgtccgcctctgc

SEQ ID NO: 23697 - DNA, 35 bp, Artificial Sequence
  Synthetic oligonucleotide
atgccccgaataaatgcttgcaactgcttcttgtc

SEQ ID NO: 23698 - DNA, 35 bp, Artificial Sequence
  Synthetic oligonucleotide
acctcacgcgacggcggcacctaccttttctcggg

SEQ ID NO: 23699 - DNA, 35 bp, Artificial Sequence
  Synthetic oligonucleotide
tcatccctacatcatcttgatgcttgctttttact

SEQ ID NO: 23700 - DNA, 35 bp, Artificial Sequence
  Synthetic oligonucleotide
ttgccactcattgtgagtgattgtaagccctccct

SEQ ID NO: 23701 - DNA, 35 bp, Artificial Sequence
  Synthetic oligonucleotide
gagactcgacgcctgggcacacttctatcactttt

SEQ ID NO: 23702 - DNA, 35 bp, Artificial Sequence
  Synthetic oligonucleotide
gaccgcgctcgtgcggccctttccccctcaacaca

SEQ ID NO: 23703 - DNA, 35 bp, Artificial Sequence
  Synthetic oligonucleotide
tgcatctaagcctctgacccccctccggcacccca

SEQ ID NO: 23704 - DNA, 35 bp, Artificial Sequence
  Synthetic oligonucleotide
gagaatgtgtggggagggtgggatggagagcgtac

SEQ ID NO: 23705 - DNA, 35 bp, Artificial Sequence
  Synthetic oligonucleotide
gtgcgggagagttctgtaacgaccgccccctccat

SEQ ID NO: 23706 - DNA, 35 bp, Artificial Sequence
  Synthetic oligonucleotide
gtatccatgcaggctgccattaactctgtcccctt

SEQ ID NO: 23707 - DNA, 37 bp, Artificial Sequence
  Synthetic oligonucleotide
tatgctcgcctttcgtggcgtacctcctccttcccga

SEQ ID NO: 23708 - DNA, 37 bp, Artificial Sequence
  Synthetic oligonucleotide
ttgggggcctcttgagcacccacttcctgttcttcga

SEQ ID NO: 23709 - DNA, 38 bp, Artificial Sequence
  Synthetic oligonucleotide
gtcaaagccctccatcctgccaacgggtaactccatga

SEQ ID NO: 23710 - DNA, 38 bp, Artificial Sequence
  Synthetic oligonucleotide
agaacgtggagacgtttagggggagtgatgtgggatga

SEQ ID NO: 23711 - DNA, 35 bp, Artificial Sequence
  Synthetic oligonucleotide
tgatacacctcctactgactattcgggatatgcta

SEQ ID NO: 23712 - DNA, 36 bp, Artificial Sequence
  Synthetic oligonucleotide
acacgcctaacaccggccctctatattatgactgta

SEQ ID NO: 23713 - DNA, 36 bp, Artificial Sequence
  Synthetic oligonucleotide
tgatgaccgatggcatatggtcctcgttcttcctta

SEQ ID NO: 23714 - DNA, 36 bp, Artificial Sequence
  Synthetic oligonucleotide
agaggaaacggtagtggggtagggtagaacgagtta

SEQ ID NO: 23715 - DNA, 36 bp, Artificial Sequence
  Synthetic oligonucleotide
gccccagccttctgttccttcagccatgctgattta

SEQ ID NO: 23716 - DNA, 35 bp, Artificial Sequence
  Synthetic oligonucleotide
ttgaccttcctggcccctgactttacccggctgtc

SEQ ID NO: 23717 - DNA, 35 bp, Artificial Sequence
  Synthetic oligonucleotide
gcgaaggaaggggatgaccgatatggcgggggggg

SEQ ID NO: 23718 - DNA, 35 bp, Artificial Sequence
  Synthetic oligonucleotide
accatcctgccgctgctcactatccaaatcaggat

SEQ ID NO: 23719 - DNA, 35 bp, Artificial Sequence
  Synthetic oligonucleotide
aacctcgatacagccggacgtcccattactccttt

SEQ ID NO: 23720 - DNA, 35 bp, Artificial Sequence
  Synthetic oligonucleotide
gagccccgccacggcactgattaccttggctccaa

SEQ ID NO: 23721 - DNA, 36 bp, Artificial Sequence
  Synthetic oligonucleotide
ttagcggtgcttctgcccataggtcccttgtttcca

SEQ ID NO: 23722 - DNA, 35 bp, Artificial Sequence
  Synthetic oligonucleotide
atggacgagtcggaaataggcttgggggaggtgca

SEQ ID NO: 23723 - DNA, 38 bp, Artificial Sequence
  Synthetic oligonucleotide
gaagagggtaacagtagtaggggggagcatgcgtgtga

SEQ ID NO: 23724 - DNA, 36 bp, Artificial Sequence
  Synthetic oligonucleotide
agaccctccaccccgactccctcgtgcactgtgata

SEQ ID NO: 23725 - DNA, 36 bp, Artificial Sequence
  Synthetic oligonucleotide
tccaacgccccatgtgcaacgcactgacacttagta

SEQ ID NO: 23726 - DNA, 35 bp, Artificial Sequence
  Synthetic oligonucleotide
actcctcaacgtcatgcaccctccgtaaacgatcc

SEQ ID NO: 23727 - DNA, 35 bp, Artificial Sequence
  Synthetic oligonucleotide
gctgaatagctcctgttgaagtcccttacacactc

SEQ ID NO: 23728 - DNA, 35 bp, Artificial Sequence
  Synthetic oligonucleotide
tggggcccatcctcgttctatcttcttgcgcgttc

SEQ ID NO: 23729 - DNA, 35 bp, Artificial Sequence
  Synthetic oligonucleotide
tatgcgccctgccgccaaccagacaacaacagttt

SEQ ID NO: 23730 - DNA, 35 bp, Artificial Sequence
  Synthetic oligonucleotide
aaatgtagggtgagggggctaaaaaaaaacggaca

SEQ ID NO: 23731 - DNA, 35 bp, Artificial Sequence
  Synthetic oligonucleotide
tctggccaacaaatggcatccttctggcttaacca

SEQ ID NO: 23732 - DNA, 36 bp, Artificial Sequence
  Synthetic oligonucleotide
gatcgccccactcctttgggactgcttaggttctca

SEQ ID NO: 23733 - DNA, 37 bp, Artificial Sequence
  Synthetic oligonucleotide
tcacaaccaccacagtccaaacaagcaagaggtacga

SEQ ID NO: 23734 - DNA, 37 bp, Artificial Sequence
  Synthetic oligonucleotide
ttgaccccgcccacgtcgttttccggacccgattcga

SEQ ID NO: 23735 - DNA, 37 bp, Artificial Sequence
  Synthetic oligonucleotide
gccaccccccgtatgtgattcgttcctgctcagcgga

SEQ ID NO: 23736 - DNA, 38 bp, Artificial Sequence
  Synthetic oligonucleotide
accccccaggcttcacttccgccattacagtcctttga

SEQ ID NO: 23737 - DNA, 36 bp, Artificial Sequence
  Synthetic oligonucleotide
gcagttggaagggagagtgaaggtgggggccgagta

SEQ ID NO: 23738 - DNA, 35 bp, Artificial Sequence
  Synthetic oligonucleotide
gttcgtcacccacggcccacgaatagtacctgttc

SEQ ID NO: 23739 - DNA, 35 bp, Artificial Sequence
  Synthetic oligonucleotide
gaagggcgggggtccggggcgagggtacactgcag

SEQ ID NO: 23740 - DNA, 35 bp, Artificial Sequence
  Synthetic oligonucleotide
tccgccaccccctcgatttttggtttggtacaatg

SEQ ID NO: 23741 - DNA, 35 bp, Artificial Sequence
  Synthetic oligonucleotide
gcctgaccatgatcgactcaaataccacttgcaat

SEQ ID NO: 23742 - DNA, 35 bp, Artificial Sequence
  Synthetic oligonucleotide
acgcggcccttccgacccgtgcgttaatccaccat

SEQ ID NO: 23743 - DNA, 35 bp, Artificial Sequence
  Synthetic oligonucleotide
gcccgcccccgagcgattagcctgcttttctaaca

SEQ ID NO: 23744 - DNA, 36 bp, Artificial Sequence
  Synthetic oligonucleotide
gtcacgtcgccatgtctccccttatccttcctcgca

SEQ ID NO: 23745 - DNA, 36 bp, Artificial Sequence
  Synthetic oligonucleotide
accacccgcgaaccaatcagcacatgacacgattca

SEQ ID NO: 23746 - DNA, 37 bp, Artificial Sequence
  Synthetic oligonucleotide
gggagtgaaactggggtgggtgaggattaggcggaga

SEQ ID NO: 23747 - DNA, 38 bp, Artificial Sequence
  Synthetic oligonucleotide
aacgcgcccccgctagcttgaaaacgactttaacttga

SEQ ID NO: 23748 - DNA, 36 bp, Artificial Sequence
  Synthetic oligonucleotide
gactctctccagcataccttaactgcgaccacttga

SEQ ID NO: 23749 - DNA, 36 bp, Artificial Sequence
  Synthetic oligonucleotide
gtagcggtcgcacccatcctcacccctgtacaccta

SEQ ID NO: 23750 - DNA, 36 bp, Artificial Sequence
  Synthetic oligonucleotide
taagcgcacctctgatctgctaatgctgccactcta

SEQ ID NO: 23751 - DNA, 35 bp, Artificial Sequence
  Synthetic oligonucleotide
tcttcatccgcctattccttctcacccgagagact

SEQ ID NO: 23752 - DNA, 35 bp, Artificial Sequence
  Synthetic oligonucleotide
tcctgccatgctatcgttcgccccgtccccgccaa

SEQ ID NO: 23753 - DNA, 35 bp, Artificial Sequence
  Synthetic oligonucleotide
tgcccgcacgctctaccgttctatcctgactttaa

SEQ ID NO: 23754 - DNA, 37 bp, Artificial Sequence
  Synthetic oligonucleotide
aacctcacaggcacacgttttccgtccatcgccctga

SEQ ID NO: 23755 - DNA, 36 bp, Artificial Sequence
  Synthetic oligonucleotide
aaatccgcccctggttagtgccacttctagccttta

SEQ ID NO: 23756 - DNA, 35 bp, Artificial Sequence
  Synthetic oligonucleotide
atcgaccctgttccgcggagttttcttgttcgtcc

SEQ ID NO: 23757 - DNA, 35 bp, Artificial Sequence
  Synthetic oligonucleotide
acagtggtcaccggaccataccctcgccgttttgc

SEQ ID NO: 23758 - DNA, 35 bp, Artificial Sequence
  Synthetic oligonucleotide
acaccccctatgcagatgtaactcgcatgtaaact

SEQ ID NO: 23759 - DNA, 35 bp, Artificial Sequence
  Synthetic oligonucleotide
aactcctagccgcgtgtcgcgatcacactttactt

SEQ ID NO: 23760 - DNA, 36 bp, Artificial Sequence
  Synthetic oligonucleotide
actcacaccccttgcagacgtcaacccacacttaca

SEQ ID NO: 23761 - DNA, 37 bp, Artificial Sequence
  Synthetic oligonucleotide
tatgcaaactaatgggaggggacgggacaattcggga

SEQ ID NO: 23762 - DNA, 37 bp, Artificial Sequence
  Synthetic oligonucleotide
accgttgtcgcctcgaaacgtctttgcccaaccctga

SEQ ID NO: 23763 - DNA, 36 bp, Artificial Sequence
  Synthetic oligonucleotide
accctcccccatcctggaataagcacacatacgtga

SEQ ID NO: 23764 - DNA, 35 bp, Artificial Sequence
  Synthetic oligonucleotide
tcccgaccctcggctcacacgcaccagtaggctta

SEQ ID NO: 23765 - DNA, 35 bp, Artificial Sequence
  Synthetic oligonucleotide
tcaccatccggagcccacgcctatgttgagttttc

SEQ ID NO: 23766 - DNA, 35 bp, Artificial Sequence
  Synthetic oligonucleotide
gtagagatggggggtgtcgggaaggcatgagtgcg

SEQ ID NO: 23767 - DNA, 35 bp, Artificial Sequence
  Synthetic oligonucleotide
gttacgcctcgcctttatcaccattgatctgactt

SEQ ID NO: 23768 - DNA, 35 bp, Artificial Sequence
  Synthetic oligonucleotide
acctcacgagctcacgacgcatgcgcatacctttt

SEQ ID NO: 23769 - DNA, 36 bp, Artificial Sequence
  Synthetic oligonucleotide
tgaagaatcgcaagggagggcgggaaaacaggggaa

SEQ ID NO: 23770 - DNA, 36 bp, Artificial Sequence
  Synthetic oligonucleotide
tacaccgatccccggatcgcactccagtacctctca

SEQ ID NO: 23771 - DNA, 37 bp, Artificial Sequence
  Synthetic oligonucleotide
acaccatttgcctctgttgctcctcaattacaggtga

SEQ ID NO: 23772 - DNA, 36 bp, Artificial Sequence
  Synthetic oligonucleotide
atgcgaaggggtaagggaatacaaacgggaacaata

SEQ ID NO: 23773 - DNA, 35 bp, Artificial Sequence
  Synthetic oligonucleotide
accacgtcaaaaacgccgctccattcctccctgta

SEQ ID NO: 23774 - DNA, 35 bp, Artificial Sequence
  Synthetic oligonucleotide
gtgtgatcatgctgatcttcccttttaatgccacc

SEQ ID NO: 23775 - DNA, 35 bp, Artificial Sequence
  Synthetic oligonucleotide
gccaccgagttgacgatatgctacctccctaggcc

SEQ ID NO: 23776 - DNA, 35 bp, Artificial Sequence
  Synthetic oligonucleotide
acagttggcgtcccctgttcccttgatgaattcgc

SEQ ID NO: 23777 - DNA, 35 bp, Artificial Sequence
  Synthetic oligonucleotide
ttatgatgcgccacgttggaccttacaaccccctg

SEQ ID NO: 23778 - DNA, 35 bp, Artificial Sequence
  Synthetic oligonucleotide
tgactgccacataggatctccgccgaccaccattg

SEQ ID NO: 23779 - DNA, 35 bp, Artificial Sequence
  Synthetic oligonucleotide
tcccatccctctttcccggcttgacttacaatggt

SEQ ID NO: 23780 - DNA, 36 bp, Artificial Sequence
  Synthetic oligonucleotide
gacccgcacggggtgccccatcctatataactgcaa

SEQ ID NO: 23781 - DNA, 37 bp, Artificial Sequence
  Synthetic oligonucleotide
ggaggacagaggggtgggctgggctgggagtgataga

SEQ ID NO: 23782 - DNA, 37 bp, Artificial Sequence
  Synthetic oligonucleotide
gcctgccacaccacggccccggtgccctccataatga

SEQ ID NO: 23783 - DNA, 38 bp, Artificial Sequence
  Synthetic oligonucleotide
tcaccccacccgcaccccacggatctcgaactcgatga

SEQ ID NO: 23784 - DNA, 37 bp, Artificial Sequence
  Synthetic oligonucleotide
ttgaccagggggagtggggattagagcaaggggatga

SEQ ID NO: 23785 - DNA, 37 bp, Artificial Sequence
  Synthetic oligonucleotide
acataaggaaggggatggggtggggccatgtgagtga

SEQ ID NO: 23786 - DNA, 34 bp, Artificial Sequence
  Synthetic oligonucleotide
gcctgtctggtcggtatcttctgcccacccccgc

SEQ ID NO: 23787 - DNA, 35 bp, Artificial Sequence
  Synthetic oligonucleotide
gccggagtatccgttttctgcccgccttaacctgc

SEQ ID NO: 23788 - DNA, 35 bp, Artificial Sequence
  Synthetic oligonucleotide
ttccgctcgcacagaaactagcattcaaactcact

SEQ ID NO: 23789 - DNA, 35 bp, Artificial Sequence
  Synthetic oligonucleotide
ttcgccccactgcctgtgtcatactatccacttgt

SEQ ID NO: 23790 - DNA, 35 bp, Artificial Sequence
  Synthetic oligonucleotide
acgatccgctcttccgtacccctcgatcactttgt

SEQ ID NO: 23791 - DNA, 35 bp, Artificial Sequence
  Synthetic oligonucleotide
gtggagccaccatctgcgacacgaaacaatgccaa

SEQ ID NO: 23792 - DNA, 38 bp, Artificial Sequence
  Synthetic oligonucleotide
gcgagagggacggtaggaggggtgatggtggttactga

SEQ ID NO: 23793 - DNA, 37 bp, Artificial Sequence
  Synthetic oligonucleotide
tccaaccaacatatacacgagccactcatgggcctga

SEQ ID NO: 23794 - DNA, 38 bp, Artificial Sequence
  Synthetic oligonucleotide
accccgaccacggtcctgttatttgcgctgcattttga

SEQ ID NO: 23795 - DNA, 35 bp, Artificial Sequence
  Synthetic oligonucleotide
atgctcggcgtacccatatagtcgaaaccgttccc

SEQ ID NO: 23796 - DNA, 35 bp, Artificial Sequence
  Synthetic oligonucleotide
tcagagatcccggtccacatccactgagcattgcc

SEQ ID NO: 23797 - DNA, 35 bp, Artificial Sequence
  Synthetic oligonucleotide
ttcaccatccgttaaggctatttaattatcgacgc

SEQ ID NO: 23798 - DNA, 35 bp, Artificial Sequence
  Synthetic oligonucleotide
gagcaaccctccgccttttaaagaatcttagcctc

SEQ ID NO: 23799 - DNA, 35 bp, Artificial Sequence
  Synthetic oligonucleotide
tatggccctgcttaaagttgtaggctgttttattc

SEQ ID NO: 23800 - DNA, 35 bp, Artificial Sequence
  Synthetic oligonucleotide
ttggaggagaaaacgggtgcggatggacagaatgg

SEQ ID NO: 23801 - DNA, 35 bp, Artificial Sequence
  Synthetic oligonucleotide
tccactctctccagtacttgtcacagctccgcgtt

SEQ ID NO: 23802 - DNA, 35 bp, Artificial Sequence
  Synthetic oligonucleotide
gtgacccacatgtacgttgccaatcgacgctctaa

SEQ ID NO: 23803 - DNA, 35 bp, Artificial Sequence
  Synthetic oligonucleotide
tgaccgacattgtaggtctaccctctccttaacca

SEQ ID NO: 23804 - DNA, 36 bp, Artificial Sequence
  Synthetic oligonucleotide
tccaccatcatttgcgccccctcaaagtctagcgca

SEQ ID NO: 23805 - DNA, 36 bp, Artificial Sequence
  Synthetic oligonucleotide
ttcacacgccccctgtcgccatccattcactgtgca

SEQ ID NO: 23806 - DNA, 36 bp, Artificial Sequence
  Synthetic oligonucleotide
gtgctggacagccctcacgccacgcttacatgctca

SEQ ID NO: 23807 - DNA, 36 bp, Artificial Sequence
  Synthetic oligonucleotide
ttacgccgatccgcccgccaatcattctcgtattca

SEQ ID NO: 23808 - DNA, 36 bp, Artificial Sequence
  Synthetic oligonucleotide
gtatgtccgcctgagtatcactctgcattctcttca

SEQ ID NO: 23809 - DNA, 37 bp, Artificial Sequence
  Synthetic oligonucleotide
gtgctgaaagagggagtagagaaaacgaggagagaga

SEQ ID NO: 23810 - DNA, 37 bp, Artificial Sequence
  Synthetic oligonucleotide
gaaacccaccacccatgccagcacgtagacacgcgga

SEQ ID NO: 23811 - DNA, 37 bp, Artificial Sequence
  Synthetic oligonucleotide
tacgtaggtagtggggggccggggaacatttgatgga

SEQ ID NO: 23812 - DNA, 38 bp, Artificial Sequence
  Synthetic oligonucleotide
gcactccacaagccgttgccctgacccctacatactga

SEQ ID NO: 23813 - DNA, 38 bp, Artificial Sequence
  Synthetic oligonucleotide
gatatcatccgctgttcccgcccgcattgtttcctgac

SEQ ID NO: 23814 - DNA, 35 bp, Artificial Sequence
  Synthetic oligonucleotide
gctccgcacccccccatttaatgcaggtttacagc

SEQ ID NO: 23815 - DNA, 35 bp, Artificial Sequence
  Synthetic oligonucleotide
actccgaaccgtcgccgaatttcccacatttccaa

SEQ ID NO: 23816 - DNA, 37 bp, Artificial Sequence
  Synthetic oligonucleotide
gaaggagtgcaatggggaggtgggcattggctggaga

SEQ ID NO: 23817 - DNA, 37 bp, Artificial Sequence
  Synthetic oligonucleotide
tccgttgccccggtgttcaccctttatccctagtaga

SEQ ID NO: 23818 - DNA, 37 bp, Artificial Sequence
  Synthetic oligonucleotide
gaactgagccattatacctacaccgtacaccttcgga

SEQ ID NO: 23819 - DNA, 37 bp, Artificial Sequence
  Synthetic oligonucleotide
gtgcatgtaggacggggaggggcaggcatggtaggga

SEQ ID NO: 23820 - DNA, 37 bp, Artificial Sequence
  Synthetic oligonucleotide
aatccggaagaatggataggggattagggggggatga

SEQ ID NO: 23821 - DNA, 38 bp, Artificial Sequence
  Synthetic oligonucleotide
gtgcgtccctgtgcaccacccgtttctcccgttcgtga

SEQ ID NO: 23822 - DNA, 36 bp, Artificial Sequence
  Synthetic oligonucleotide
tgcgcccccctgttcgccctttcagtatttgtaata

SEQ ID NO: 23823 - DNA, 35 bp, Artificial Sequence
  Synthetic oligonucleotide
atccatccgtcccacgtcagacggtaggccccacc

SEQ ID NO: 23824 - DNA, 35 bp, Artificial Sequence
  Synthetic oligonucleotide
tacattgaccgctttggtgggtcctttcaaccttc

SEQ ID NO: 23825 - DNA, 35 bp, Artificial Sequence
  Synthetic oligonucleotide
tcttgaaccaaccggatgggcgtggcctacccttc

SEQ ID NO: 23826 - DNA, 35 bp, Artificial Sequence
  Synthetic oligonucleotide
ggactagcactgaatacacctggtctactttgttc

SEQ ID NO: 23827 - DNA, 35 bp, Artificial Sequence
  Synthetic oligonucleotide
gtagtccccgcccttacgcccgatacagtggtttc

SEQ ID NO: 23828 - DNA, 35 bp, Artificial Sequence
  Synthetic oligonucleotide
gttcgcactcccatcgctccatacagactgtccct

SEQ ID NO: 23829 - DNA, 35 bp, Artificial Sequence
  Synthetic oligonucleotide
aataccgttccgccctcgccagggttactgctctt

SEQ ID NO: 23830 - DNA, 35 bp, Artificial Sequence
  Synthetic oligonucleotide
actgtagacagccgattacgctctatccccctgtt

SEQ ID NO: 23831 - DNA, 34 bp, Artificial Sequence
  Synthetic oligonucleotide
atgccatgaggataggggatgaaaatgggaataa

SEQ ID NO: 23832 - DNA, 36 bp, Artificial Sequence
  Synthetic oligonucleotide
gtgatgtaccgccggtcaccgatccagtttgcataa

SEQ ID NO: 23833 - DNA, 35 bp, Artificial Sequence
  Synthetic oligonucleotide
gcaacaccggcgcgactcaattccatcttgctcga

SEQ ID NO: 23834 - DNA, 37 bp, Artificial Sequence
  Synthetic oligonucleotide
tcaacaggacactgcgttgttaatcttcactcttgga

SEQ ID NO: 23835 - DNA, 37 bp, Artificial Sequence
  Synthetic oligonucleotide
tgcgaagttccgacccctgtgcaccacaccttgctga

SEQ ID NO: 23836 - DNA, 38 bp, Artificial Sequence
  Synthetic oligonucleotide
gcgcacccccccacgactgatcacacagctttgattga

SEQ ID NO: 23837 - DNA, 36 bp, Artificial Sequence
  Synthetic oligonucleotide
gattcctgacctcgattgcccacctagcccctagta

SEQ ID NO: 23838 - DNA, 34 bp, Artificial Sequence
  Synthetic oligonucleotide
gtagacaccctcccctgcactaagttccttagta

SEQ ID NO: 23839 - DNA, 35 bp, Artificial Sequence
  Synthetic oligonucleotide
aatgtcccatcacgacgtcgtgtcgttctccctac

SEQ ID NO: 23840 - DNA, 35 bp, Artificial Sequence
  Synthetic oligonucleotide
tcgcgtccgtacatttctgctctgcaccccggtcc

SEQ ID NO: 23841 - DNA, 35 bp, Artificial Sequence
  Synthetic oligonucleotide
acatcggtgggaccaaaatggatggagtagggaag

SEQ ID NO: 23842 - DNA, 35 bp, Artificial Sequence
  Synthetic oligonucleotide
gcgcgtaccggttgctcggcgtactatctcttgtt

SEQ ID NO: 23843 - DNA, 35 bp, Artificial Sequence
  Synthetic oligonucleotide
tgtgcgtgcccgcgaattgagctcaactgtccttt

SEQ ID NO: 23844 - DNA, 35 bp, Artificial Sequence
  Synthetic oligonucleotide
ttttgcaccactgacctagtacgaacttccatgca

SEQ ID NO: 23845 - DNA, 37 bp, Artificial Sequence
  Synthetic oligonucleotide
gatcactcctctcgtcagtgcgcgcctgcctccccga

SEQ ID NO: 23846 - DNA, 35 bp, Artificial Sequence
  Synthetic oligonucleotide
gacgcacacacatgaacctgggagtaatcgctgga

SEQ ID NO: 23847 - DNA, 38 bp, Artificial Sequence
  Synthetic oligonucleotide
tacaccatcagcctttgggcgacgacgaacattcctga

SEQ ID NO: 23848 - DNA, 38 bp, Artificial Sequence
  Synthetic oligonucleotide
atgccggtgaacggcaagttccaacgcttctaccttga

SEQ ID NO: 23849 - DNA, 38 bp, Artificial Sequence
  Synthetic oligonucleotide
acccagagccaagcaggtctcaccaccgtcccccttga

SEQ ID NO: 23850 - DNA, 35 bp, Artificial Sequence
  Synthetic oligonucleotide
gttgactccgtggtaactctagccgtggccctgta

SEQ ID NO: 23851 - DNA, 36 bp, Artificial Sequence
  Synthetic oligonucleotide
tgcaccaaaactggccctatctcttcactgcttgta

SEQ ID NO: 23852 - DNA, 35 bp, Artificial Sequence
  Synthetic oligonucleotide
ggtggctgccgtaacgtttttctgcactcgcccac

SEQ ID NO: 23853 - DNA, 35 bp, Artificial Sequence
  Synthetic oligonucleotide
aactccgcaaatgtgaacccacccacctacctggc

SEQ ID NO: 23854 - DNA, 35 bp, Artificial Sequence
  Synthetic oligonucleotide
aatgaaaacacgcgcctccgatatgtctctgctgc

SEQ ID NO: 23855 - DNA, 35 bp, Artificial Sequence
  Synthetic oligonucleotide
gcccgcacgccggtgttccgttcgatcctatctgc

SEQ ID NO: 23856 - DNA, 35 bp, Artificial Sequence
  Synthetic oligonucleotide
gcactccacataccctaactatcagggtgacttct

SEQ ID NO: 23857 - DNA, 36 bp, Artificial Sequence
  Synthetic oligonucleotide
ttgggacgctgtcctctcccagtcaatgaaccacca

SEQ ID NO: 23858 - DNA, 36 bp, Artificial Sequence
  Synthetic oligonucleotide
gcgagagaggggaaagtaaggagcggacgagccgga

SEQ ID NO: 23859 - DNA, 38 bp, Artificial Sequence
  Synthetic oligonucleotide
tgccgaccacacatgctatattttccggctaccaatga

SEQ ID NO: 23860 - DNA, 38 bp, Artificial Sequence
  Synthetic oligonucleotide
tcaacagagcaaatactgcgccccacatccacctgtga

SEQ ID NO: 23861 - DNA, 38 bp, Artificial Sequence
  Synthetic oligonucleotide
tgccatgggggtgggtaggggtagtaatgatgggttga

SEQ ID NO: 23862 - DNA, 35 bp, Artificial Sequence
  Synthetic oligonucleotide
acctcctacgcatgtgtggccgtatgcgctttccc

SEQ ID NO: 23863 - DNA, 35 bp, Artificial Sequence
  Synthetic oligonucleotide
tgacctatcgcccaagtttggtacggtcctccttt

SEQ ID NO: 23864 - DNA, 35 bp, Artificial Sequence
  Synthetic oligonucleotide
atccgatccaccgcctcatatcgattctgcataaa

SEQ ID NO: 23865 - DNA, 37 bp, Artificial Sequence
  Synthetic oligonucleotide
tgcaccggtaggcatcccttattacgtcaatccccga

SEQ ID NO: 23866 - DNA, 37 bp, Artificial Sequence
  Synthetic oligonucleotide
gcggggaacgaggtggaggtggggaggcttcaaggga

SEQ ID NO: 23867 - DNA, 38 bp, Artificial Sequence
  Synthetic oligonucleotide
tacaccctcccacccttaattgtatcatctattgatga

SEQ ID NO: 23868 - DNA, 36 bp, Artificial Sequence
  Synthetic oligonucleotide
atccccccctactctgactgaaatcagtcgcactga

SEQ ID NO: 23869 - DNA, 38 bp, Artificial Sequence
  Synthetic oligonucleotide
gtcaaccctccctctgtgtaggtttccacacttcctga

SEQ ID NO: 23870 - DNA, 36 bp, Artificial Sequence
  Synthetic oligonucleotide
tgcacccatctgatctccactttgcgttagctctga

SEQ ID NO: 23871 - DNA, 35 bp, Artificial Sequence
  Synthetic oligonucleotide
acaacacgtgtgctacgattgcttttgccccagac

SEQ ID NO: 23872 - DNA, 35 bp, Artificial Sequence
  Synthetic oligonucleotide
gcctcgcttccctcgtttgttcctcagcctttccc

SEQ ID NO: 23873 - DNA, 35 bp, Artificial Sequence
  Synthetic oligonucleotide
atcgcattctctagtctggcccaatgcaacccttc

SEQ ID NO: 23874 - DNA, 36 bp, Artificial Sequence
  Synthetic oligonucleotide
tccgagccctctaccccagtgcgatttctacgacaa

SEQ ID NO: 23875 - DNA, 36 bp, Artificial Sequence
  Synthetic oligonucleotide
tactcgcccttatcaggcctgacatcgagccctaca

SEQ ID NO: 23876 - DNA, 35 bp, Artificial Sequence
  Synthetic oligonucleotide
cattcctgcctccgtgacgtccaccaagctagcca

SEQ ID NO: 23877 - DNA, 34 bp, Artificial Sequence
  Synthetic oligonucleotide
tagcactcaacccctcacgccctagccatccgca

SEQ ID NO: 23878 - DNA, 35 bp, Artificial Sequence
  Synthetic oligonucleotide
tcttccgcccggcgatccctactcttgtacttgca

SEQ ID NO: 23879 - DNA, 37 bp, Artificial Sequence
  Synthetic oligonucleotide
gtcagacgcatcgcgcacaattctatcacttgccgga

SEQ ID NO: 23880 - DNA, 37 bp, Artificial Sequence
  Synthetic oligonucleotide
gcccaaccccatatttaccatctgactactgtctgga

SEQ ID NO: 23881 - DNA, 38 bp, Artificial Sequence
  Synthetic oligonucleotide
gatgccgcaggggaatgacagggggggtgatgtgatga

SEQ ID NO: 23882 - DNA, 37 bp, Artificial Sequence
  Synthetic oligonucleotide
ttaccacgccacctggtccacttatacttctatttga

SEQ ID NO: 23883 - DNA, 38 bp, Artificial Sequence
  Synthetic oligonucleotide
agcgaagctacggggctggttcctactctttactttga

SEQ ID NO: 23884 - DNA, 36 bp, Artificial Sequence
  Synthetic oligonucleotide
gtgacgactaagcgaccttcaggcccctaccaccta

SEQ ID NO: 23885 - DNA, 35 bp, Artificial Sequence
  Synthetic oligonucleotide
gtcacttctcagccaccctttgtcatctattgcgc

SEQ ID NO: 23886 - DNA, 35 bp, Artificial Sequence
  Synthetic oligonucleotide
tcaccacggttaatgtatgccttctgcccttgtgc

SEQ ID NO: 23887 - DNA, 35 bp, Artificial Sequence
  Synthetic oligonucleotide
gacactcctcaggtacttgaagcccagttatccag

SEQ ID NO: 23888 - DNA, 35 bp, Artificial Sequence
  Synthetic oligonucleotide
ttacctcctggctggtatggacccccccacccgcg

SEQ ID NO: 23889 - DNA, 35 bp, Artificial Sequence
  Synthetic oligonucleotide
tagttggggcgaactggaagggttaggagggggtg

SEQ ID NO: 23890 - DNA, 35 bp, Artificial Sequence
  Synthetic oligonucleotide
gtgacagtctaatgactctgaccgttacacctcct

SEQ ID NO: 23891 - DNA, 37 bp, Artificial Sequence
  Synthetic oligonucleotide
gcaagggaaagttcggtggaaatagggagggtgtaga

SEQ ID NO: 23892 - DNA, 37 bp, Artificial Sequence
  Synthetic oligonucleotide
tgagcaagtactgccttcatgtccctgtccgccccga

SEQ ID NO: 23893 - DNA, 37 bp, Artificial Sequence
  Synthetic oligonucleotide
tgcatgggaggcatggagggcgggtggagacaccgga

SEQ ID NO: 23894 - DNA, 35 bp, Artificial Sequence
  Synthetic oligonucleotide
gatcgcggtgcagtgcgccctctcttgcctacaac

SEQ ID NO: 23895 - DNA, 35 bp, Artificial Sequence
  Synthetic oligonucleotide
gtggtggtcccggcaccctctcgcttaccctacac

SEQ ID NO: 23896 - DNA, 35 bp, Artificial Sequence
  Synthetic oligonucleotide
gtgaccatctctttcccaccgccgcgggacgctac

SEQ ID NO: 23897 - DNA, 35 bp, Artificial Sequence
  Synthetic oligonucleotide
acgacggacactaggtcttacatctttccccaacc

SEQ ID NO: 23898 - DNA, 35 bp, Artificial Sequence
  Synthetic oligonucleotide
gacaccggcccttacacacttatctgactagtgcc

SEQ ID NO: 23899 - DNA, 36 bp, Artificial Sequence
  Synthetic oligonucleotide
tcttacgccctctttccctacgctccccgttcgtgg

SEQ ID NO: 23900 - DNA, 36 bp, Artificial Sequence
  Synthetic oligonucleotide
acacccccggggcgtatacccatttgatctcgctaa

SEQ ID NO: 23901 - DNA, 36 bp, Artificial Sequence
  Synthetic oligonucleotide
acgcacgtataccattctatccgtcccatgttgaca

SEQ ID NO: 23902 - DNA, 35 bp, Artificial Sequence
  Synthetic oligonucleotide
tcgatacccgtctccttcatcctctagatctgcca

SEQ ID NO: 23903 - DNA, 35 bp, Artificial Sequence
  Synthetic oligonucleotide
agacgcaagagtcacttccgcatatcgctcctcca

SEQ ID NO: 23904 - DNA, 37 bp, Artificial Sequence
  Synthetic oligonucleotide
atggaaaggggggagtggagtagtaaatttctggcga

SEQ ID NO: 23905 - DNA, 36 bp, Artificial Sequence
  Synthetic oligonucleotide
gcttacatcgcggctcattctccacccctgtttgga

SEQ ID NO: 23906 - DNA, 38 bp, Artificial Sequence
  Synthetic oligonucleotide
acaccatcccacacatgactacccacagctacttatga

SEQ ID NO: 23907 - DNA, 36 bp, Artificial Sequence
  Synthetic oligonucleotide
gtggaaacacctccatgaccatatggaccctgcata

SEQ ID NO: 23908 - DNA, 35 bp, Artificial Sequence
  Synthetic oligonucleotide
tcacattgtccttcgcttcttcgacggctcccaac

SEQ ID NO: 23909 - DNA, 36 bp, Artificial Sequence
  Synthetic oligonucleotide
tgactcactgtacccttgagatcacgagatcacccc

SEQ ID NO: 23910 - DNA, 35 bp, Artificial Sequence
  Synthetic oligonucleotide
acacactacctcactagctttccttgttgccacat

SEQ ID NO: 23911 - DNA, 35 bp, Artificial Sequence
  Synthetic oligonucleotide
ttatgctcagccaccgcgttttcccatgttaacct

SEQ ID NO: 23912 - DNA, 35 bp, Artificial Sequence
  Synthetic oligonucleotide
tgatccttcctccaagccgttattgcctacatttt

SEQ ID NO: 23913 - DNA, 36 bp, Artificial Sequence
  Synthetic oligonucleotide
gggttacgggaagggggggtacgataggggtggcaa

SEQ ID NO: 23914 - DNA, 38 bp, Artificial Sequence
  Synthetic oligonucleotide
tgacaggccactagcacatacgccccttattcccgtga

SEQ ID NO: 23915 - DNA, 37 bp, Artificial Sequence
  Synthetic oligonucleotide
aacacctgacttcccgacgacggttccacattggtga

SEQ ID NO: 23916 - DNA, 36 bp, Artificial Sequence
  Synthetic oligonucleotide
tcatccgacgtcaccacccatgacccgcagtgcgta

SEQ ID NO: 23917 - DNA, 36 bp, Artificial Sequence
  Synthetic oligonucleotide
tgctggtccctaacctcgctttcgttgcctctcgta

SEQ ID NO: 23918 - DNA, 35 bp, Artificial Sequence
  Synthetic oligonucleotide
gacacacatcctgaaccccgagtttattgcctgcc

SEQ ID NO: 23919 - DNA, 35 bp, Artificial Sequence
  Synthetic oligonucleotide
aagaacgatgagagggcagagtagggaaggagggg

SEQ ID NO: 23920 - DNA, 35 bp, Artificial Sequence
  Synthetic oligonucleotide
gtcaacgcacaggaatggagcccctcttatcgttg

SEQ ID NO: 23921 - DNA, 35 bp, Artificial Sequence
  Synthetic oligonucleotide
ggaccccccacaaagcgctcttcagaactgcgcct

SEQ ID NO: 23922 - DNA, 35 bp, Artificial Sequence
  Synthetic oligonucleotide
gtgcgatgtccaggtatcacctcctttctggctct

SEQ ID NO: 23923 - DNA, 35 bp, Artificial Sequence
  Synthetic oligonucleotide
tccgcatgggatctgcggactaatcatcatgcctt

SEQ ID NO: 23924 - DNA, 35 bp, Artificial Sequence
  Synthetic oligonucleotide
gattccaccgtaggccaaagtccacgcacacctca

SEQ ID NO: 23925 - DNA, 37 bp, Artificial Sequence
  Synthetic oligonucleotide
accgcctccctagctgccgttcatccagtctgaagga

SEQ ID NO: 23926 - DNA, 38 bp, Artificial Sequence
  Synthetic oligonucleotide
ggggcgggagttgggcgggtcaatgggtgaggtggtga

SEQ ID NO: 23927 - DNA, 36 bp, Artificial Sequence
  Synthetic oligonucleotide
acatcacctcacgtccatgccgcatgggccggccta

SEQ ID NO: 23928 - DNA, 35 bp, Artificial Sequence
  Synthetic oligonucleotide
gcatccgcattttcatattaaactctgtcccgcac

SEQ ID NO: 23929 - DNA, 35 bp, Artificial Sequence
  Synthetic oligonucleotide
gtgataaccaaggtcacaagcccctgtccgctccc

SEQ ID NO: 23930 - DNA, 35 bp, Artificial Sequence
  Synthetic oligonucleotide
ttcgacccgagctctatgcaatggactcaactgcc

SEQ ID NO: 23931 - DNA, 35 bp, Artificial Sequence
  Synthetic oligonucleotide
acgactccccgtccgccctgaggcttttaccacgc

SEQ ID NO: 23932 - DNA, 35 bp, Artificial Sequence
  Synthetic oligonucleotide
tgtgactcagtatctcaccgctacaacacggtttc

SEQ ID NO: 23933 - DNA, 35 bp, Artificial Sequence
  Synthetic oligonucleotide
tcgtgctccatccactacccatgagtctaccacat

SEQ ID NO: 23934 - DNA, 35 bp, Artificial Sequence
  Synthetic oligonucleotide
ttcacctctggatcacccactctccgcgatgccct

SEQ ID NO: 23935 - DNA, 35 bp, Artificial Sequence
  Synthetic oligonucleotide
gtcccgacctattgtgctgtgccccatgtgcttct

SEQ ID NO: 23936 - DNA, 35 bp, Artificial Sequence
  Synthetic oligonucleotide
gaacaggcggccctgctattactctgtctacgttt

SEQ ID NO: 23937 - DNA, 36 bp, Artificial Sequence
  Synthetic oligonucleotide
acttaccccccccactcgctctgtattgcgaggtaa

SEQ ID NO: 23938 - DNA, 36 bp, Artificial Sequence
  Synthetic oligonucleotide
ttgaccccgcatattcatcttgctcgctcgcttaca

SEQ ID NO: 23939 - DNA, 38 bp, Artificial Sequence
  Synthetic oligonucleotide
ggtgcccgtgtgatacgtcgccgctccccccctgttga

SEQ ID NO: 23940 - DNA, 36 bp, Artificial Sequence
  Synthetic oligonucleotide
tgtagggagggggggcattggtgggttaaagccata

SEQ ID NO: 23941 - DNA, 35 bp, Artificial Sequence
  Synthetic oligonucleotide
gtgaacccttctgcgctaactggcccgacctcctc

SEQ ID NO: 23942 - DNA, 35 bp, Artificial Sequence
  Synthetic oligonucleotide
tctgaccccgtcccacgggatcttgatttctgttc

SEQ ID NO: 23943 - DNA, 35 bp, Artificial Sequence
  Synthetic oligonucleotide
gccgcccctacatgcgctagtggtaccctacatct

SEQ ID NO: 23944 - DNA, 35 bp, Artificial Sequence
  Synthetic oligonucleotide
gcccctcacactacatctgcaatcctgttccgtgt

SEQ ID NO: 23945 - DNA, 36 bp, Artificial Sequence
  Synthetic oligonucleotide
gcacgactgggtcagggacatgagtgagggagggca

SEQ ID NO: 23946 - DNA, 35 bp, Artificial Sequence
  Synthetic oligonucleotide
attagcaccgccacatactgatattcagccgatca

SEQ ID NO: 23947 - DNA, 37 bp, Artificial Sequence
  Synthetic oligonucleotide
gacaggggatgcggcagagtaagggagggggagagga

SEQ ID NO: 23948 - DNA, 37 bp, Artificial Sequence
  Synthetic oligonucleotide
gggagacggaaacaaggggagtgcgggtacaagggga

SEQ ID NO: 23949 - DNA, 38 bp, Artificial Sequence
  Synthetic oligonucleotide
tgcctgagccacgctgcatctactcttggttatcttga

SEQ ID NO: 23950 - DNA, 38 bp, Artificial Sequence
  Synthetic oligonucleotide
gatccactccttaatcgtgccataacgatgcactttga

SEQ ID NO: 23951 - DNA, 34 bp, Artificial Sequence
  Synthetic oligonucleotide
taggtgcccatcttaagtcgctgacacctttcac

SEQ ID NO: 23952 - DNA, 35 bp, Artificial Sequence
  Synthetic oligonucleotide
gatgccgcaaaattgaggttccggttccaacttcc

SEQ ID NO: 23953 - DNA, 35 bp, Artificial Sequence
  Synthetic oligonucleotide
tcttgcatccacaccgccatgcacaacactactat

SEQ ID NO: 23954 - DNA, 35 bp, Artificial Sequence
  Synthetic oligonucleotide
tctccatcctgtcacttgaaccttcgtaacgcctt

SEQ ID NO: 23955 - DNA, 36 bp, Artificial Sequence
  Synthetic oligonucleotide
ttcacaccatccgccttgtttccagtggctcttcca

SEQ ID NO: 23956 - DNA, 36 bp, Artificial Sequence
  Synthetic oligonucleotide
gcacaccccgcagagcacaattgtcacgtttcccga

SEQ ID NO: 23957 - DNA, 35 bp, Artificial Sequence
  Synthetic oligonucleotide
ttctgccacttgaaatcatcttgttcgctctccga

SEQ ID NO: 23958 - DNA, 38 bp, Artificial Sequence
  Synthetic oligonucleotide
aacccacccgcatgagctagagaacccgcctcaactga

SEQ ID NO: 23959 - DNA, 38 bp, Artificial Sequence
  Synthetic oligonucleotide
gccccctacgccatggaacgcccatcttcgactcctga

SEQ ID NO: 23960 - DNA, 38 bp, Artificial Sequence
  Synthetic oligonucleotide
atcccccgcctcatttgtactctgtaattttacattga

SEQ ID NO: 23961 - DNA, 36 bp, Artificial Sequence
  Synthetic oligonucleotide
ataggatggagggaaatggggtgaggagggctcgta

SEQ ID NO: 23962 - DNA, 36 bp, Artificial Sequence
  Synthetic oligonucleotide
tacgtgcggtagcagactcatttcggttttctttta

SEQ ID NO: 23963 - DNA, 35 bp, Artificial Sequence
  Synthetic oligonucleotide
tccaccatagtcacctcgggacacgcccgccaaac

SEQ ID NO: 23964 - DNA, 35 bp, Artificial Sequence
  Synthetic oligonucleotide
atcacccgttaagacccccccattggcacaggtac

SEQ ID NO: 23965 - DNA, 35 bp, Artificial Sequence
  Synthetic oligonucleotide
aggatcatccaggacccatattgcccttctttagc

SEQ ID NO: 23966 - DNA, 35 bp, Artificial Sequence
  Synthetic oligonucleotide
gcctcatagctgtgccttctggatctgtccccaag

SEQ ID NO: 23967 - DNA, 35 bp, Artificial Sequence
  Synthetic oligonucleotide
ttcgcccaccgctactggaagctactcttaaccat

SEQ ID NO: 23968 - DNA, 35 bp, Artificial Sequence
  Synthetic oligonucleotide
gcccgttgtcctaagccgaactcgccgatcatact

SEQ ID NO: 23969 - DNA, 35 bp, Artificial Sequence
  Synthetic oligonucleotide
tgatcgcgaggccaccgaccggaacccccttccct

SEQ ID NO: 23970 - DNA, 36 bp, Artificial Sequence
  Synthetic oligonucleotide
gacgatcacgcctccatagccatgcatacctgctgt

SEQ ID NO: 23971 - DNA, 36 bp, Artificial Sequence
  Synthetic oligonucleotide
ggtcatcagccgaatgttgcggccctcccttatgca

SEQ ID NO: 23972 - DNA, 36 bp, Artificial Sequence
  Synthetic oligonucleotide
tgcctccgccacttcctctatccccctgatgtatca

SEQ ID NO: 23973 - DNA, 37 bp, Artificial Sequence
  Synthetic oligonucleotide
ggggtggataaatggagggaagaaaaggcgattggga

SEQ ID NO: 23974 - DNA, 36 bp, Artificial Sequence
  Synthetic oligonucleotide
tctcgccaccatcctccatatacttgaccgctgtta

SEQ ID NO: 23975 - DNA, 35 bp, Artificial Sequence
  Synthetic oligonucleotide
tgggcgggggggtggggagggagcaatatcgtacg

SEQ ID NO: 23976 - DNA, 35 bp, Artificial Sequence
  Synthetic oligonucleotide
gtccaaccaccttcaatcgagaacagtactcaagt

SEQ ID NO: 23977 - DNA, 35 bp, Artificial Sequence
  Synthetic oligonucleotide
atggtcggtcacctgcattcaccgcggtataccac

SEQ ID NO: 23978 - DNA, 35 bp, Artificial Sequence
  Synthetic oligonucleotide
tgcacgtggtccagtgtaccatggttaccccccgc

SEQ ID NO: 23979 - DNA, 35 bp, Artificial Sequence
  Synthetic oligonucleotide
atcgtggccggtcgactaattcggtcctagttatc

SEQ ID NO: 23980 - DNA, 36 bp, Artificial Sequence
  Synthetic oligonucleotide
ggacattagtcctggtccccgacactgcaacaccca

SEQ ID NO: 23981 - DNA, 36 bp, Artificial Sequence
  Synthetic oligonucleotide
tatgcgccctccccccgggtaaaaaggctcaattca

SEQ ID NO: 23982 - DNA, 35 bp, Artificial Sequence
  Synthetic oligonucleotide
agatagccacagcctagcattactgtacacctcga

SEQ ID NO: 23983 - DNA, 38 bp, Artificial Sequence
  Synthetic oligonucleotide
acccgacacctccaggccctcacatcagacgctcgtga

SEQ ID NO: 23984 - DNA, 38 bp, Artificial Sequence
  Synthetic oligonucleotide
gataccgccccaccgcacatactcatcacctctcgtga

SEQ ID NO: 23985 - DNA, 38 bp, Artificial Sequence
  Synthetic oligonucleotide
tggacattcccccctggtcgtatcatctcgtagcttga

SEQ ID NO: 23986 - DNA, 36 bp, Artificial Sequence
  Synthetic oligonucleotide
accatggccaagtaaggggaaatgaaactgggtgta

SEQ ID NO: 23987 - DNA, 35 bp, Artificial Sequence
  Synthetic oligonucleotide
accttgccatccttgtatcatccactcggtgtccg

SEQ ID NO: 23988 - DNA, 35 bp, Artificial Sequence
  Synthetic oligonucleotide
gcatcatcccccggcaatgacttagtttagtcgct

SEQ ID NO: 23989 - DNA, 36 bp, Artificial Sequence
  Synthetic oligonucleotide
accccggttgactggctccatttctcccttgtcgca

SEQ ID NO: 23990 - DNA, 37 bp, Artificial Sequence
  Synthetic oligonucleotide
ggtgggagggggggatttggcttgtaacctgtgggga

SEQ ID NO: 23991 - DNA, 37 bp, Artificial Sequence
  Synthetic oligonucleotide
tccgctcccctgcattaaatgctctaaccctcctgga

SEQ ID NO: 23992 - DNA, 38 bp, Artificial Sequence
  Synthetic oligonucleotide
tatccacctgctagctgacacgcgataccacctcatga

SEQ ID NO: 23993 - DNA, 37 bp, Artificial Sequence
  Synthetic oligonucleotide
gcaagagcgctattgcctcttttttgttcgaccctga

SEQ ID NO: 23994 - DNA, 38 bp, Artificial Sequence
  Synthetic oligonucleotide
gtggacaaccgacttcgggccctcgaactccatcttga

SEQ ID NO: 23995 - DNA, 35 bp, Artificial Sequence
  Synthetic oligonucleotide
gacggggctcaagctgactcccctgttttctccta

SEQ ID NO: 23996 - DNA, 35 bp, Artificial Sequence
  Synthetic oligonucleotide
gtcactcgtcaactccctcctgcgtcgcgagccac

SEQ ID NO: 23997 - DNA, 35 bp, Artificial Sequence
  Synthetic oligonucleotide
tacgtccacggttttcgccatctttgcttgtgctc

SEQ ID NO: 23998 - DNA, 35 bp, Artificial Sequence
  Synthetic oligonucleotide
gcaccccctacgtgacacctcttgcatacgctagt

SEQ ID NO: 23999 - DNA, 35 bp, Artificial Sequence
  Synthetic oligonucleotide
gtcgacaggcccggtggtgctcatggtctctcttt

SEQ ID NO: 24000 - DNA, 36 bp, Artificial Sequence
  Synthetic oligonucleotide
acgccagagggggtagtgaggaaaggaaggaaccaa

SEQ ID NO: 24001 - DNA, 37 bp, Artificial Sequence
  Synthetic oligonucleotide
tgatacaacgcgccggtacaccatgccctgctcccga

SEQ ID NO: 24002 - DNA, 35 bp, Artificial Sequence
  Synthetic oligonucleotide
gtaccgaaattggtggggggtagggggctcacgga

SEQ ID NO: 24003 - DNA, 38 bp, Artificial Sequence
  Synthetic oligonucleotide
gcaaggcatagggacgagggagggccggcaaggtggga

SEQ ID NO: 24004 - DNA, 37 bp, Artificial Sequence
  Synthetic oligonucleotide
tccacgttacatggcctcagaaacccgaccaacctga

SEQ ID NO: 24005 - DNA, 36 bp, Artificial Sequence
  Synthetic oligonucleotide
gaccgaatcgccccgttgctaccagtcacttgctga

SEQ ID NO: 24006 - DNA, 38 bp, Artificial Sequence
  Synthetic oligonucleotide
tcacccactctacaccataggataccgtacccttgtga

SEQ ID NO: 24007 - DNA, 38 bp, Artificial Sequence
  Synthetic oligonucleotide
tgaccactaccctgatcgtcaaacgcaccactacttga

SEQ ID NO: 24008 - DNA, 35 bp, Artificial Sequence
  Synthetic oligonucleotide
gcacgaacctggcagtcccgcacaatgtctggcct

SEQ ID NO: 24009 - DNA, 35 bp, Artificial Sequence
  Synthetic oligonucleotide
ttgtcaccccgaggttacagtcccctccgttcatt

SEQ ID NO: 24010 - DNA, 35 bp, Artificial Sequence
  Synthetic oligonucleotide
tccccagactgccaaggttatcgtcctctcaccaa

SEQ ID NO: 24011 - DNA, 36 bp, Artificial Sequence
  Synthetic oligonucleotide
tccattcgtatatcctgtccgagtcttcggttccca

SEQ ID NO: 24012 - DNA, 37 bp, Artificial Sequence
  Synthetic oligonucleotide
gtacctctccgccaatcctgtcatgcactcaaacgga

SEQ ID NO: 24013 - DNA, 37 bp, Artificial Sequence
  Synthetic oligonucleotide
tagagccatgtggcgggggaactaaggggaggtatga

SEQ ID NO: 24014 - DNA, 38 bp, Artificial Sequence
  Synthetic oligonucleotide
ggaccgagagccacccaccgcctgcgttcctatcctga

SEQ ID NO: 24015 - DNA, 37 bp, Artificial Sequence
  Synthetic oligonucleotide
tgtggccagtggggggggtgcaatggtgagggcgtga

SEQ ID NO: 24016 - DNA, 35 bp, Artificial Sequence
  Synthetic oligonucleotide
actccgccaactgggcctacgcactgcttccacta

SEQ ID NO: 24017 - DNA, 36 bp, Artificial Sequence
  Synthetic oligonucleotide
gacgtgattctgtgccttttatgtcattacctctta

SEQ ID NO: 24018 - DNA, 35 bp, Artificial Sequence
  Synthetic oligonucleotide
gtcgccgcgaaactatctgacacttatgctgcacc

SEQ ID NO: 24019 - DNA, 35 bp, Artificial Sequence
  Synthetic oligonucleotide
ttcaccgatccgagctccttggttggtgttttacc

SEQ ID NO: 24020 - DNA, 35 bp, Artificial Sequence
  Synthetic oligonucleotide
tgcatccgcatctgagatccgtcacatcgtctcgc

SEQ ID NO: 24021 - DNA, 35 bp, Artificial Sequence
  Synthetic oligonucleotide
gctaaccccgccggacttgcgtcattcactccgtc

SEQ ID NO: 24022 - DNA, 35 bp, Artificial Sequence
  Synthetic oligonucleotide
acgccagtagacacattgccatactccctcctttc

SEQ ID NO: 24023 - DNA, 35 bp, Artificial Sequence
  Synthetic oligonucleotide
tgacgcagtcgaaacaaccgttgacactatacctg

SEQ ID NO: 24024 - DNA, 35 bp, Artificial Sequence
  Synthetic oligonucleotide
aacccgccgccaccaattattacatccgtttggat

SEQ ID NO: 24025 - DNA, 35 bp, Artificial Sequence
  Synthetic oligonucleotide
gaaaagcactcgggaggtacggggaggggtagggt

SEQ ID NO: 24026 - DNA, 37 bp, Artificial Sequence
  Synthetic oligonucleotide
atcccaacacctcacaacgccgtagactctccacgga

SEQ ID NO: 24027 - DNA, 36 bp, Artificial Sequence
  Synthetic oligonucleotide
actggaaaacgacgggaggggggcggagggtttcta

SEQ ID NO: 24028 - DNA, 35 bp, Artificial Sequence
  Synthetic oligonucleotide
tatacccgcatccgcctgcctatgagtcttaacac

SEQ ID NO: 24029 - DNA, 35 bp, Artificial Sequence
  Synthetic oligonucleotide
cgattccacagcctttcaccttgtaaattgagggg

SEQ ID NO: 24030 - DNA, 36 bp, Artificial Sequence
  Synthetic oligonucleotide
gcctggcgcctagacttcgaacgtttcctttgctgg

SEQ ID NO: 24031 - DNA, 35 bp, Artificial Sequence
  Synthetic oligonucleotide
actgctgaaagaatcaggggaaaggaaaggggctg

SEQ ID NO: 24032 - DNA, 35 bp, Artificial Sequence
  Synthetic oligonucleotide
actgcataccgcgaacgcctaggaccttttgctct

SEQ ID NO: 24033 - DNA, 35 bp, Artificial Sequence
  Synthetic oligonucleotide
ttccgacgctgtagccctttccacgcatgtacctt

SEQ ID NO: 24034 - DNA, 35 bp, Artificial Sequence
  Synthetic oligonucleotide
gactcacacctgctcctgccccatgagcgaatttt

SEQ ID NO: 24035 - DNA, 35 bp, Artificial Sequence
  Synthetic oligonucleotide
accactgccgcccgtttcaatttagtcgttgcgaa

SEQ ID NO: 24036 - DNA, 36 bp, Artificial Sequence
  Synthetic oligonucleotide
tcaaccccgtgcgcccggcttgtttcccttccgtaa

SEQ ID NO: 24037 - DNA, 37 bp, Artificial Sequence
  Synthetic oligonucleotide
actccccctgccttccctttggatcaggcgcatacga

SEQ ID NO: 24038 - DNA, 37 bp, Artificial Sequence
  Synthetic oligonucleotide
tcttccgcactacctcggtacttacagccccctccga

SEQ ID NO: 24039 - DNA, 38 bp, Artificial Sequence
  Synthetic oligonucleotide
tgaccaatccgtccaacggctttacggcccacacctga

SEQ ID NO: 24040 - DNA, 36 bp, Artificial Sequence
  Synthetic oligonucleotide
acgcaagcgacaagaccacttacgccacccatctga

SEQ ID NO: 24041 - DNA, 35 bp, Artificial Sequence
  Synthetic oligonucleotide
gacgacgtcaatcggcaacaactctaatcgcacta

SEQ ID NO: 24042 - DNA, 35 bp, Artificial Sequence
  Synthetic oligonucleotide
taccacccgctgtcgtacgatatcctcttcgtcgc

SEQ ID NO: 24043 - DNA, 35 bp, Artificial Sequence
  Synthetic oligonucleotide
atcccgatccgtatcaagttacggtccttaacatc

SEQ ID NO: 24044 - DNA, 35 bp, Artificial Sequence
  Synthetic oligonucleotide
attcgaactgccaaagctccccacacacttgtgct

SEQ ID NO: 24045 - DNA, 36 bp, Artificial Sequence
  Synthetic oligonucleotide
acgtgtacgcagccgttttatcacgcatctggccaa

SEQ ID NO: 24046 - DNA, 36 bp, Artificial Sequence
  Synthetic oligonucleotide
taagaggacacggggtgtgggggctgggaggcataa

SEQ ID NO: 24047 - DNA, 35 bp, Artificial Sequence
  Synthetic oligonucleotide
tgtgcctagggcggggaacgaaaaagcgagggtaa

SEQ ID NO: 24048 - DNA, 35 bp, Artificial Sequence
  Synthetic oligonucleotide
atgcccgccgaacaggaaacgcacacattcaggca

SEQ ID NO: 24049 - DNA, 38 bp, Artificial Sequence
  Synthetic oligonucleotide
gatcagcatctagaacctctctaccgaccctgcgctga

SEQ ID NO: 24050 - DNA, 38 bp, Artificial Sequence
  Synthetic oligonucleotide
atcgctggtgccaggccgccacacccatacttttctga

SEQ ID NO: 24051 - DNA, 38 bp, Artificial Sequence
  Synthetic oligonucleotide
tcccaagcccccctttacgtcgcgaacatgtcgtgtga

SEQ ID NO: 24052 - DNA, 38 bp, Artificial Sequence
  Synthetic oligonucleotide
tagcgggaaccgcgtcctccgaccaccttaccacttga

SEQ ID NO: 24053 - DNA, 35 bp, Artificial Sequence
  Synthetic oligonucleotide
gactccgtactgggccaattactactttcgcctcg

SEQ ID NO: 24054 - DNA, 36 bp, Artificial Sequence
  Synthetic oligonucleotide
ggacggggcacgaccggggaagcgggaagaggaagg

SEQ ID NO: 24055 - DNA, 35 bp, Artificial Sequence
  Synthetic oligonucleotide
gtgttcgcccgccatctcgatttgctgcaacttgt

SEQ ID NO: 24056 - DNA, 38 bp, Artificial Sequence
  Synthetic oligonucleotide
tcatcgcagtccatttgttcttatcacctccagcctga

SEQ ID NO: 24057 - DNA, 38 bp, Artificial Sequence
  Synthetic oligonucleotide
acccatgactccaccctaaaggacagtactgtttctga

SEQ ID NO: 24058 - DNA, 35 bp, Artificial Sequence
  Synthetic oligonucleotide
aagcacacatccatgtaatctcccgctcccagcta

SEQ ID NO: 24059 - DNA, 36 bp, Artificial Sequence
  Synthetic oligonucleotide
tccggagcttagcacgcattcgcaaccccctcgtta

SEQ ID NO: 24060 - DNA, 35 bp, Artificial Sequence
  Synthetic oligonucleotide
gacacccctaccatctgtcctgaaatttcaatagc

SEQ ID NO: 24061 - DNA, 35 bp, Artificial Sequence
  Synthetic oligonucleotide
gtccatgtcacacccaagcgccgttcgaaccgatc

SEQ ID NO: 24062 - DNA, 35 bp, Artificial Sequence
  Synthetic oligonucleotide
tcaacggactcatccttctttttacagacgctgtc

SEQ ID NO: 24063 - DNA, 35 bp, Artificial Sequence
  Synthetic oligonucleotide
tattgagccccatgtccgctacccgcttcgtactt

SEQ ID NO: 24064 - DNA, 35 bp, Artificial Sequence
  Synthetic oligonucleotide
gatacatggggcgttgatattccattggctccctt

SEQ ID NO: 24065 - DNA, 36 bp, Artificial Sequence
  Synthetic oligonucleotide
gtcaggcacagcaagggagtgggggaggaaaaacaa

SEQ ID NO: 24066 - DNA, 36 bp, Artificial Sequence
  Synthetic oligonucleotide
accacctgcacgcgccccccaactggccagctttaa

SEQ ID NO: 24067 - DNA, 36 bp, Artificial Sequence
  Synthetic oligonucleotide
agaccccactgaggcggaatctgccactttcctaca

SEQ ID NO: 24068 - DNA, 35 bp, Artificial Sequence
  Synthetic oligonucleotide
gcctgcggtcgccggcctttgtcctatgcaactca

SEQ ID NO: 24069 - DNA, 37 bp, Artificial Sequence
  Synthetic oligonucleotide
gggtggtgtagggcggtggcttggggctgctggacga

SEQ ID NO: 24070 - DNA, 36 bp, Artificial Sequence
  Synthetic oligonucleotide
agtgacgggtgaggctgggcatggtgagatctggga

SEQ ID NO: 24071 - DNA, 37 bp, Artificial Sequence
  Synthetic oligonucleotide
gctgagaaaaacgagaggggaagtaaaaacggtggga

SEQ ID NO: 24072 - DNA, 37 bp, Artificial Sequence
  Synthetic oligonucleotide
tctcccgcgcaccatctcaattgtctgccaacatgga

SEQ ID NO: 24073 - DNA, 36 bp, Artificial Sequence
  Synthetic oligonucleotide
ggaacgcactgcttattgaagctatctgcccctgta

SEQ ID NO: 24074 - DNA, 35 bp, Artificial Sequence
  Synthetic oligonucleotide
gttccagcacctgtcacattttggtgcctccccgc

SEQ ID NO: 24075 - DNA, 35 bp, Artificial Sequence
  Synthetic oligonucleotide
gtctcccactccagtcaacaccaacgctctaggtc

SEQ ID NO: 24076 - DNA, 35 bp, Artificial Sequence
  Synthetic oligonucleotide
ttgccgctgcattagcctttcatctctgctcgttc

SEQ ID NO: 24077 - DNA, 35 bp, Artificial Sequence
  Synthetic oligonucleotide
gacgctaggggcggggtacttgggagggaagctat

SEQ ID NO: 24078 - DNA, 35 bp, Artificial Sequence
  Synthetic oligonucleotide
gttacacgcccctgttggatatgcccgtcgctcct

SEQ ID NO: 24079 - DNA, 35 bp, Artificial Sequence
  Synthetic oligonucleotide
tctacaccaccgcccctgcagcagtacggaccaaa

SEQ ID NO: 24080 - DNA, 36 bp, Artificial Sequence
  Synthetic oligonucleotide
actcagagggcaaagggaggaaacaagtgttgggaa

SEQ ID NO: 24081 - DNA, 35 bp, Artificial Sequence
  Synthetic oligonucleotide
gcccaagccacaattcgctatttgcatgaactaca

SEQ ID NO: 24082 - DNA, 36 bp, Artificial Sequence
  Synthetic oligonucleotide
agccccatgtgtcccgtcttgttttgtcaatttgca

SEQ ID NO: 24083 - DNA, 35 bp, Artificial Sequence
  Synthetic oligonucleotide
taccagccgatcctcacccctgtcacgaatgctca

SEQ ID NO: 24084 - DNA, 37 bp, Artificial Sequence
  Synthetic oligonucleotide
acccgggaacggagggggaagaatgtcaaatcgcaga

SEQ ID NO: 24085 - DNA, 37 bp, Artificial Sequence
  Synthetic oligonucleotide
gcctgcctccgagaacatcgactgcttaccttataga

SEQ ID NO: 24086 - DNA, 37 bp, Artificial Sequence
  Synthetic oligonucleotide
gccacatactggtgtctgccatctcagtcgcacccga

SEQ ID NO: 24087 - DNA, 36 bp, Artificial Sequence
  Synthetic oligonucleotide
gatgacaccgccgatcctccccaaaactatcgatga

SEQ ID NO: 24088 - DNA, 36 bp, Artificial Sequence
  Synthetic oligonucleotide
attcatgtagccctgcccgtttttgtagttttccta

SEQ ID NO: 24089 - DNA, 36 bp, Artificial Sequence
  Synthetic oligonucleotide
tatctcccctgccagcctccggtctgacatgcctta

SEQ ID NO: 24090 - DNA, 35 bp, Artificial Sequence
  Synthetic oligonucleotide
gatcccaccctataggttatgccaacatgcatacc

SEQ ID NO: 24091 - DNA, 35 bp, Artificial Sequence
  Synthetic oligonucleotide
gctaagctccctcgatgccaacaatgcctttttct

SEQ ID NO: 24092 - DNA, 35 bp, Artificial Sequence
  Synthetic oligonucleotide
acgcgctacacagttcccaggttcgctcttcttgt

SEQ ID NO: 24093 - DNA, 35 bp, Artificial Sequence
  Synthetic oligonucleotide
gtcacactgaacctgcttgcaagtggtaacccatt

SEQ ID NO: 24094 - DNA, 36 bp, Artificial Sequence
  Synthetic oligonucleotide
tccaccgaacgcatttagtgtcggattgtttttaca

SEQ ID NO: 24095 - DNA, 37 bp, Artificial Sequence
  Synthetic oligonucleotide
tccgctccctcacccgaaattcagcgttcttcgacga

SEQ ID NO: 24096 - DNA, 38 bp, Artificial Sequence
  Synthetic oligonucleotide
gacataccttgtgatttgggcccatccccttccgttga

SEQ ID NO: 24097 - DNA, 36 bp, Artificial Sequence
  Synthetic oligonucleotide
tgcctcactgacgcctgctataatcttccgcctata

SEQ ID NO: 24098 - DNA, 35 bp, Artificial Sequence
  Synthetic oligonucleotide
ttgccgccttgttatagtctcgcccatgcctctct

SEQ ID NO: 24099 - DNA, 35 bp, Artificial Sequence
  Synthetic oligonucleotide
ataccccgacagtcgggccccgcttaccttcccca

SEQ ID NO: 24100 - DNA, 37 bp, Artificial Sequence
  Synthetic oligonucleotide
gctccgccccccttgtactgcccagaggcatgtacga

SEQ ID NO: 24101 - DNA, 38 bp, Artificial Sequence
  Synthetic oligonucleotide
tccaacgcctcatcatctgcgccaagatggatccctga

SEQ ID NO: 24102 - DNA, 37 bp, Artificial Sequence
  Synthetic oligonucleotide
tccgcccccaagcctcatgggccttccatcactctga

SEQ ID NO: 24103 - DNA, 36 bp, Artificial Sequence
  Synthetic oligonucleotide
atacaccatcacgtgcagggcaccatctatttgata

SEQ ID NO: 24104 - DNA, 35 bp, Artificial Sequence
  Synthetic oligonucleotide
ttcgcattcgaacttgttagcacccccttctgccc

SEQ ID NO: 24105 - DNA, 35 bp, Artificial Sequence
  Synthetic oligonucleotide
gcatgcccctcaccgccagtggttgtagtcttgcc

SEQ ID NO: 24106 - DNA, 35 bp, Artificial Sequence
  Synthetic oligonucleotide
accgacctgacaaacgagggcttatcgtacttttc

SEQ ID NO: 24107 - DNA, 35 bp, Artificial Sequence
  Synthetic oligonucleotide
ggatcaacgtgccgaccttgccctactcactttcg

SEQ ID NO: 24108 - DNA, 35 bp, Artificial Sequence
  Synthetic oligonucleotide
aaccgagcactcacccgtcacaccctaggtatctg

SEQ ID NO: 24109 - DNA, 35 bp, Artificial Sequence
  Synthetic oligonucleotide
gctcagccagcgtagctttttctcctctcatgcat

SEQ ID NO: 24110 - DNA, 35 bp, Artificial Sequence
  Synthetic oligonucleotide
ttcagatgggatcctgcttacacccgcgtttctct

SEQ ID NO: 24111 - DNA, 35 bp, Artificial Sequence
  Synthetic oligonucleotide
gccgcacctgcacccgagccctagaggcctagctt

SEQ ID NO: 24112 - DNA, 35 bp, Artificial Sequence
  Synthetic oligonucleotide
tgagacgtccccggtaagaccccaaccactgccaa

SEQ ID NO: 24113 - DNA, 36 bp, Artificial Sequence
  Synthetic oligonucleotide
gcgctacggggtgggaaaaaaggaaggcgataggaa

SEQ ID NO: 24114 - DNA, 37 bp, Artificial Sequence
  Synthetic oligonucleotide
gacgaataggtgacatgggaggggcggtgaaacagga

SEQ ID NO: 24115 - DNA, 37 bp, Artificial Sequence
  Synthetic oligonucleotide
gaccgtactacggtcagaaacaccataccctcctgga

SEQ ID NO: 24116 - DNA, 37 bp, Artificial Sequence
  Synthetic oligonucleotide
gtgtgcacccacttttgttattctctctgcctgatga

SEQ ID NO: 24117 - DNA, 35 bp, Artificial Sequence
  Synthetic oligonucleotide
actacgcgcctccagtacctagtactcccccccta

SEQ ID NO: 24118 - DNA, 35 bp, Artificial Sequence
  Synthetic oligonucleotide
gagaccagccacatgcgccctggttaaacttcgac

SEQ ID NO: 24119 - DNA, 35 bp, Artificial Sequence
  Synthetic oligonucleotide
gtcctgctcagccggtgcctccgtctgaatccccc

SEQ ID NO: 24120 - DNA, 35 bp, Artificial Sequence
  Synthetic oligonucleotide
atacctatggtatccgtcgccctcacccttcctat

SEQ ID NO: 24121 - DNA, 36 bp, Artificial Sequence
  Synthetic oligonucleotide
tgccactcctgaaggtccttcttgctagacacacct

SEQ ID NO: 24122 - DNA, 35 bp, Artificial Sequence
  Synthetic oligonucleotide
agttggccccggcctccacattgtttgctgtttct

SEQ ID NO: 24123 - DNA, 35 bp, Artificial Sequence
  Synthetic oligonucleotide
gtccgtgcccctcaacattcgtcatgaccccaatt

SEQ ID NO: 24124 - DNA, 36 bp, Artificial Sequence
  Synthetic oligonucleotide
atcatccgcccccgacaggctagttgcctcgcaaca

SEQ ID NO: 24125 - DNA, 35 bp, Artificial Sequence
  Synthetic oligonucleotide
gtgccgcatacgcatgctgacctccgttttctgca

SEQ ID NO: 24126 - DNA, 37 bp, Artificial Sequence
  Synthetic oligonucleotide
acctcgcctcagaccatccgttgttccctagcgctca

SEQ ID NO: 24127 - DNA, 36 bp, Artificial Sequence
  Synthetic oligonucleotide
gtccgacctgtgacgccatcccaccgtcttctttca

SEQ ID NO: 24128 - DNA, 37 bp, Artificial Sequence
  Synthetic oligonucleotide
gaacacgtcaatggccagtcaaggaggggggggagga

SEQ ID NO: 24129 - DNA, 37 bp, Artificial Sequence
  Synthetic oligonucleotide
gacgccgacgcacctctcaatatgccgaacgacttga

SEQ ID NO: 24130 - DNA, 35 bp, Artificial Sequence
  Synthetic oligonucleotide
tgttgtcacccgctatccgtcgcgcacttttcctg

SEQ ID NO: 24131 - DNA, 36 bp, Artificial Sequence
  Synthetic oligonucleotide
ggagggaggatagagaagataaatgggggcgaggaa

SEQ ID NO: 24132 - DNA, 35 bp, Artificial Sequence
  Synthetic oligonucleotide
tcaatgggggggaataggggatgccgggaacgaga

SEQ ID NO: 24133 - DNA, 37 bp, Artificial Sequence
  Synthetic oligonucleotide
gtgggctataatgtaggggggggagccctgtacggga

SEQ ID NO: 24134 - DNA, 37 bp, Artificial Sequence
  Synthetic oligonucleotide
gtcgaggcctccgtatctgcgtcgctcaccgccctga

SEQ ID NO: 24135 - DNA, 38 bp, Artificial Sequence
  Synthetic oligonucleotide
tgatccacatcgcccgccctgacatccagttggcctga

SEQ ID NO: 24136 - DNA, 37 bp, Artificial Sequence
  Synthetic oligonucleotide
taagccaccatctgttgccccacttgccaggctctga

SEQ ID NO: 24137 - DNA, 35 bp, Artificial Sequence
  Synthetic oligonucleotide
accgccccttactccgcagcctcttgaatccagtg

SEQ ID NO: 24138 - DNA, 35 bp, Artificial Sequence
  Synthetic oligonucleotide
acccccaccgagtaccaggcacactccggaatctt

SEQ ID NO: 24139 - DNA, 35 bp, Artificial Sequence
  Synthetic oligonucleotide
acctcagcctcaactcatttcggccacaactcaca

SEQ ID NO: 24140 - DNA, 36 bp, Artificial Sequence
  Synthetic oligonucleotide
aacaacccgcccccgtggtatccttgagatacacga

SEQ ID NO: 24141 - DNA, 36 bp, Artificial Sequence
  Synthetic oligonucleotide
aaaatggggtaatgcggagaggagggctatgggcga

SEQ ID NO: 24142 - DNA, 38 bp, Artificial Sequence
  Synthetic oligonucleotide
aaatgcacgagggaggggaccagggggtgacaagatga

SEQ ID NO: 24143 - DNA, 37 bp, Artificial Sequence
  Synthetic oligonucleotide
tagagccgcccggtccccagctcactcccttctctga

SEQ ID NO: 24144 - DNA, 38 bp, Artificial Sequence
  Synthetic oligonucleotide
acgcccaattgcatgtgctacctccgtgtcctgtttga

SEQ ID NO: 24145 - DNA, 35 bp, Artificial Sequence
  Synthetic oligonucleotide
agtttgcgcatactctatcttccgaccgttcatac

SEQ ID NO: 24146 - DNA, 35 bp, Artificial Sequence
  Synthetic oligonucleotide
gcaccctcctggtccccaacgatcgaacatattct

SEQ ID NO: 24147 - DNA, 35 bp, Artificial Sequence
  Synthetic oligonucleotide
atgctcaccatccacctcgcttcacgttgaaatgt

SEQ ID NO: 24148 - DNA, 37 bp, Artificial Sequence
  Synthetic oligonucleotide
tcaaaaagaggatggaaaagcagtgggcgggtggaga

SEQ ID NO: 24149 - DNA, 35 bp, Artificial Sequence
  Synthetic oligonucleotide
tgctatgctgcactgccccccatcccgttatttga

SEQ ID NO: 24150 - DNA, 35 bp, Artificial Sequence
  Synthetic oligonucleotide
gtaccatccacacatatacatgagtttcggctcta

SEQ ID NO: 24151 - DNA, 35 bp, Artificial Sequence
  Synthetic oligonucleotide
acacgctggtccaccaccacagatcttcccgccgc

SEQ ID NO: 24152 - DNA, 35 bp, Artificial Sequence
  Synthetic oligonucleotide
tatcatagcgacgttcacattcctattctgatctc

SEQ ID NO: 24153 - DNA, 35 bp, Artificial Sequence
  Synthetic oligonucleotide
acgaacgtcaacccgcccacacactccatgtgatg

SEQ ID NO: 24154 - DNA, 35 bp, Artificial Sequence
  Synthetic oligonucleotide
acccaatcccaccagtcatgtcttccatgtgcact

SEQ ID NO: 24155 - DNA, 36 bp, Artificial Sequence
  Synthetic oligonucleotide
tagcccacacatcatcctttgccgtttttgcctaca

SEQ ID NO: 24156 - DNA, 37 bp, Artificial Sequence
  Synthetic oligonucleotide
gtgcgagggacgaatcaaggcaaacaagggggcggga

SEQ ID NO: 24157 - DNA, 38 bp, Artificial Sequence
  Synthetic oligonucleotide
atcccgctcccaacagtttccccgcaggcagtccatga

SEQ ID NO: 24158 - DNA, 37 bp, Artificial Sequence
  Synthetic oligonucleotide
gctccgggcgactcgttacgtaccttcttcctgctga

SEQ ID NO: 24159 - DNA, 38 bp, Artificial Sequence
  Synthetic oligonucleotide
accgccatccgttgtttcatcaagccatcaacacgtga

SEQ ID NO: 24160 - DNA, 35 bp, Artificial Sequence
  Synthetic oligonucleotide
gggaggggggaagcgatggggaggagtggagagta

SEQ ID NO: 24161 - DNA, 35 bp, Artificial Sequence
  Synthetic oligonucleotide
tgtgcctaccccctctcagccatgatggcctttta

SEQ ID NO: 24162 - DNA, 35 bp, Artificial Sequence
  Synthetic oligonucleotide
gcctaggcgcttgcataattagtccggttgccccc

SEQ ID NO: 24163 - DNA, 35 bp, Artificial Sequence
  Synthetic oligonucleotide
tcccaacacttccaacagcgttccgcaccgctgtc

SEQ ID NO: 24164 - DNA, 35 bp, Artificial Sequence
  Synthetic oligonucleotide
ttccaccttcactcataccgcctggtcacaatacg

SEQ ID NO: 24165 - DNA, 35 bp, Artificial Sequence
  Synthetic oligonucleotide
ggtgagagagtaggaagaagggtggtaaaataatg

SEQ ID NO: 24166 - DNA, 35 bp, Artificial Sequence
  Synthetic oligonucleotide
gagccagtgcccatgaagtcacctattctgccctg

SEQ ID NO: 24167 - DNA, 35 bp, Artificial Sequence
  Synthetic oligonucleotide
cctgtaaagccgtcgacgtggggtttttggttgat

SEQ ID NO: 24168 - DNA, 35 bp, Artificial Sequence
  Synthetic oligonucleotide
gtccggactgtcctttgttttgccgtcctgttact

SEQ ID NO: 24169 - DNA, 35 bp, Artificial Sequence
  Synthetic oligonucleotide
tccacgtatcccgcgccccgccacggagtcccgtt

SEQ ID NO: 24170 - DNA, 35 bp, Artificial Sequence
  Synthetic oligonucleotide
attgcccggcaatacatcggagcccgaatccccga

SEQ ID NO: 24171 - DNA, 37 bp, Artificial Sequence
  Synthetic oligonucleotide
tcgaatgttcaggagggaaggcggggagctcggagga

SEQ ID NO: 24172 - DNA, 35 bp, Artificial Sequence
  Synthetic oligonucleotide
ttgacccacactgctattttccagataccatcgga

SEQ ID NO: 24173 - DNA, 38 bp, Artificial Sequence
  Synthetic oligonucleotide
gtccctccgatcccctcgtgaagtccgttcttaactga

SEQ ID NO: 24174 - DNA, 37 bp, Artificial Sequence
  Synthetic oligonucleotide
atcacgctggcgtaaatggcgcgctaacctctcctga

SEQ ID NO: 24175 - DNA, 38 bp, Artificial Sequence
  Synthetic oligonucleotide
taaccacgcgaattgacaggaggcggtaggtgaagtga

SEQ ID NO: 24176 - DNA, 38 bp, Artificial Sequence
  Synthetic oligonucleotide
ttcagcccgtggtgcgtgggtagggagggcttaagtga

SEQ ID NO: 24177 - DNA, 36 bp, Artificial Sequence
  Synthetic oligonucleotide
tatccatcccgcgtctcatccaccggctcctagcta

SEQ ID NO: 24178 - DNA, 36 bp, Artificial Sequence
  Synthetic oligonucleotide
taatggaagagatcggaagggcgagtaggaagggta

SEQ ID NO: 24179 - DNA, 35 bp, Artificial Sequence
  Synthetic oligonucleotide
gccatgcgcgacacagtagcaaactaccaccttcc

SEQ ID NO: 24180 - DNA, 35 bp, Artificial Sequence
  Synthetic oligonucleotide
gtagaggaaaggtaggtggtggagcacgcggtggg

SEQ ID NO: 24181 - DNA, 35 bp, Artificial Sequence
  Synthetic oligonucleotide
gagcaacattggcccagcttatactttcacttctg

SEQ ID NO: 24182 - DNA, 35 bp, Artificial Sequence
  Synthetic oligonucleotide
atggtacgctcaaccagcccactttctgccatcca

SEQ ID NO: 24183 - DNA, 38 bp, Artificial Sequence
  Synthetic oligonucleotide
tgacccagccgttgtcttctctatcacttcttctctga

SEQ ID NO: 24184 - DNA, 37 bp, Artificial Sequence
  Synthetic oligonucleotide
gaacgtcggagcgcacccgttaccatgcattcattga

SEQ ID NO: 24185 - DNA, 35 bp, Artificial Sequence
  Synthetic oligonucleotide
ttaatactccagcaagcgcgcccactatcgcttta

SEQ ID NO: 24186 - DNA, 35 bp, Artificial Sequence
  Synthetic oligonucleotide
ttgcatgcccgccccacatcatcgtttcatttgtc

SEQ ID NO: 24187 - DNA, 35 bp, Artificial Sequence
  Synthetic oligonucleotide
gaacgacaatccatcccgcgccttaccaatttttg

SEQ ID NO: 24188 - DNA, 35 bp, Artificial Sequence
  Synthetic oligonucleotide
accttagagcgtcgtatagctgccaccccccccct

SEQ ID NO: 24189 - DNA, 35 bp, Artificial Sequence
  Synthetic oligonucleotide
tgccaaccgacctcctgattactgctgctggtagt

SEQ ID NO: 24190 - DNA, 37 bp, Artificial Sequence
  Synthetic oligonucleotide
gtttcccacctgccgaccatgtcttcgttcccacgga

SEQ ID NO: 24191 - DNA, 37 bp, Artificial Sequence
  Synthetic oligonucleotide
gtgagaaggcgggtgataggggttacacaaagaggga

SEQ ID NO: 24192 - DNA, 37 bp, Artificial Sequence
  Synthetic oligonucleotide
ttccctgcgcatccgtagtctacccacactccctgga

SEQ ID NO: 24193 - DNA, 38 bp, Artificial Sequence
  Synthetic oligonucleotide
gagcacatctagcaccgtagtcctggcccttgttttga

SEQ ID NO: 24194 - DNA, 35 bp, Artificial Sequence
  Synthetic oligonucleotide
tcctccctccgcggtgttaaagcatactccctctc

SEQ ID NO: 24195 - DNA, 35 bp, Artificial Sequence
  Synthetic oligonucleotide
ttgcggggtgacgggaccggtagggagaggagacg

SEQ ID NO: 24196 - DNA, 35 bp, Artificial Sequence
  Synthetic oligonucleotide
tagcttgtgccctgacgaatcactgcacctgccct

SEQ ID NO: 24197 - DNA, 35 bp, Artificial Sequence
  Synthetic oligonucleotide
gggaggggtacaggagggagggacgtccaaccggt

SEQ ID NO: 24198 - DNA, 35 bp, Artificial Sequence
  Synthetic oligonucleotide
ttcgttgatcagtgctctcctcggccgttactctt

SEQ ID NO: 24199 - DNA, 35 bp, Artificial Sequence
  Synthetic oligonucleotide
aatcacctccgccaccaagtacacctgctgatcaa

SEQ ID NO: 24200 - DNA, 37 bp, Artificial Sequence
  Synthetic oligonucleotide
gacaaactgcgccgttccccagccaaccaactttaga

SEQ ID NO: 24201 - DNA, 37 bp, Artificial Sequence
  Synthetic oligonucleotide
aacgagaggtggccgaaggggtttttgagggagggga

SEQ ID NO: 24202 - DNA, 37 bp, Artificial Sequence
  Synthetic oligonucleotide
ttggagggaaaggggatacaaaaggaggactcatgga

SEQ ID NO: 24203 - DNA, 34 bp, Artificial Sequence
  Synthetic oligonucleotide
agacccatcgaaaccgcacaataccgcatgctga

SEQ ID NO: 24204 - DNA, 38 bp, Artificial Sequence
  Synthetic oligonucleotide
gacgtcacgagtcttccgcttccatcgttaccccttga

SEQ ID NO: 24205 - DNA, 36 bp, Artificial Sequence
  Synthetic oligonucleotide
tacgtgaaccacctgccctgtacttacggtcgttta

SEQ ID NO: 24206 - DNA, 35 bp, Artificial Sequence
  Synthetic oligonucleotide
gcacactgtctacccagtctcgatatagccggccc

SEQ ID NO: 24207 - DNA, 35 bp, Artificial Sequence
  Synthetic oligonucleotide
acacccagtgggtcattgtccctgggtctctttca

SEQ ID NO: 24208 - DNA, 37 bp, Artificial Sequence
  Synthetic oligonucleotide
ttcacgcagtgagccatcgccgacctcccacaaagga

SEQ ID NO: 24209 - DNA, 38 bp, Artificial Sequence
  Synthetic oligonucleotide
gtgcaaagcctgtgtgtgcaactcgctcctttccctga

SEQ ID NO: 24210 - DNA, 35 bp, Artificial Sequence
  Synthetic oligonucleotide
ggacccaaaattctctaagctgactgttcctgccc

SEQ ID NO: 24211 - DNA, 35 bp, Artificial Sequence
  Synthetic oligonucleotide
gacccgtgcgcgctccgacatcttttgtacattcc

SEQ ID NO: 24212 - DNA, 35 bp, Artificial Sequence
  Synthetic oligonucleotide
tgctccgataccatgcgatacctactgcccacgtc

SEQ ID NO: 24213 - DNA, 35 bp, Artificial Sequence
  Synthetic oligonucleotide
atgggagggctgctacgtgggaaggtcattgggat

SEQ ID NO: 24214 - DNA, 35 bp, Artificial Sequence
  Synthetic oligonucleotide
gggacacacacagacaggttatttctcatctcatt

SEQ ID NO: 24215 - DNA, 35 bp, Artificial Sequence
  Synthetic oligonucleotide
atccgaccacttagggcctctgcctcgcaccacaa

SEQ ID NO: 24216 - DNA, 35 bp, Artificial Sequence
  Synthetic oligonucleotide
taaccgtcaagacctcactgtacactcccgcccga

SEQ ID NO: 24217 - DNA, 38 bp, Artificial Sequence
  Synthetic oligonucleotide
tcgacctcaccttgttcctggtatgacccttcccgtga

SEQ ID NO: 24218 - DNA, 37 bp, Artificial Sequence
  Synthetic oligonucleotide
attgcacccccctgaaatttacatgccgactccgtga

SEQ ID NO: 24219 - DNA, 38 bp, Artificial Sequence
  Synthetic oligonucleotide
gaacgtcaaagagggcactggaggagggaggtatgtga

SEQ ID NO: 24220 - DNA, 38 bp, Artificial Sequence
  Synthetic oligonucleotide
acatagcagtcgctcacggtaggcctggttcacattga

SEQ ID NO: 24221 - DNA, 35 bp, Artificial Sequence
  Synthetic oligonucleotide
ggatcgcaggaaacccagttctcgttctagccacc

SEQ ID NO: 24222 - DNA, 35 bp, Artificial Sequence
  Synthetic oligonucleotide
tgcgttgcgcatgcctatcgtaaactcatcttttg

SEQ ID NO: 24223 - DNA, 35 bp, Artificial Sequence
  Synthetic oligonucleotide
tagtacgcccgggatccacagacatacccccctca

SEQ ID NO: 24224 - DNA, 36 bp, Artificial Sequence
  Synthetic oligonucleotide
gtgacaccgctggcgtcccgcaccttatcatcgaga

SEQ ID NO: 24225 - DNA, 35 bp, Artificial Sequence
  Synthetic oligonucleotide
gcaatgacatcggcatccgtttttggcctaacttc

SEQ ID NO: 24226 - DNA, 35 bp, Artificial Sequence
  Synthetic oligonucleotide
ggtgcgcccctgctgctacccaaacatcctcctag

SEQ ID NO: 24227 - DNA, 35 bp, Artificial Sequence
  Synthetic oligonucleotide
agccacacacacgggaatacaggtcatcgacttgg

SEQ ID NO: 24228 - DNA, 36 bp, Artificial Sequence
  Synthetic oligonucleotide
agctcacactgcccttgtggacttagcttatctcca

SEQ ID NO: 24229 - DNA, 37 bp, Artificial Sequence
  Synthetic oligonucleotide
acacccctcgctcgtctacccgccactgcgccacgga

SEQ ID NO: 24230 - DNA, 35 bp, Artificial Sequence
  Synthetic oligonucleotide
accgacaactcactctggttgcgcccgccccctga

SEQ ID NO: 24231 - DNA, 35 bp, Artificial Sequence
  Synthetic oligonucleotide
acgccggaggtggtccgtctttccacaaccttctc

SEQ ID NO: 24232 - DNA, 35 bp, Artificial Sequence
  Synthetic oligonucleotide
gacgaacgtggggaattgcggcaagaagaaggggg

SEQ ID NO: 24233 - DNA, 35 bp, Artificial Sequence
  Synthetic oligonucleotide
attgacggcctcattgttgtttccttgattggggg

SEQ ID NO: 24234 - DNA, 35 bp, Artificial Sequence
  Synthetic oligonucleotide
atgtgccacaccacgctacccctatatcgatacgt

SEQ ID NO: 24235 - DNA, 35 bp, Artificial Sequence
  Synthetic oligonucleotide
gcgtggctctgcgcgcaaatattgtctcccttgtt

SEQ ID NO: 24236 - DNA, 36 bp, Artificial Sequence
  Synthetic oligonucleotide
taggagtgggaggaagtggtaaatggtgatgagcga

SEQ ID NO: 24237 - DNA, 37 bp, Artificial Sequence
  Synthetic oligonucleotide
acacgccgcctgtaaccgcatcatctgcaatcgagga

SEQ ID NO: 24238 - DNA, 35 bp, Artificial Sequence
  Synthetic oligonucleotide
aacgttccatagccctacctgttcagccacccgga

SEQ ID NO: 24239 - DNA, 38 bp, Artificial Sequence
  Synthetic oligonucleotide
aacaccaccaggtaccatcctttcagcatgtgttatga

SEQ ID NO: 24240 - DNA, 37 bp, Artificial Sequence
  Synthetic oligonucleotide
gaggggttgagtagcagggaggggctccctggggtga

SEQ ID NO: 24241 - DNA, 37 bp, Artificial Sequence
  Synthetic oligonucleotide
actccaccgcatttctgacatagttgactatccttga

SEQ ID NO: 24242 - DNA, 37 bp, Artificial Sequence
  Synthetic oligonucleotide
tctaccaccatcgcgaatcgttcttacgtctgcttga

SEQ ID NO: 24243 - DNA, 35 bp, Artificial Sequence
  Synthetic oligonucleotide
gatactccgcctcaaacagcacttgctacatcata

SEQ ID NO: 24244 - DNA, 36 bp, Artificial Sequence
  Synthetic oligonucleotide
gacgccataccccgcaactgtgttgcctcgcttgta

SEQ ID NO: 24245 - DNA, 35 bp, Artificial Sequence
  Synthetic oligonucleotide
taacacgttcattgcggaccctgtttctctttctc

SEQ ID NO: 24246 - DNA, 35 bp, Artificial Sequence
  Synthetic oligonucleotide
gccctccgctctgaggttcctacggaccgaccccg

SEQ ID NO: 24247 - DNA, 35 bp, Artificial Sequence
  Synthetic oligonucleotide
tccatacttcactgtttgcgggctgacctcccccg

SEQ ID NO: 24248 - DNA, 35 bp, Artificial Sequence
  Synthetic oligonucleotide
tgtaccaggtccggcatgtcctcctctcgaccgcg

SEQ ID NO: 24249 - DNA, 35 bp, Artificial Sequence
  Synthetic oligonucleotide
atccacccgcgaatacgtctaagtccttcccacct

SEQ ID NO: 24250 - DNA, 35 bp, Artificial Sequence
  Synthetic oligonucleotide
atctgcacaccatcaccttcccagagtcagcggtt

SEQ ID NO: 24251 - DNA, 36 bp, Artificial Sequence
  Synthetic oligonucleotide
gacaaccctgacatcccgcgccatcagtcttcacaa

SEQ ID NO: 24252 - DNA, 38 bp, Artificial Sequence
  Synthetic oligonucleotide
attggccggcacgagcacctgcttcccactagccctga

SEQ ID NO: 24253 - DNA, 36 bp, Artificial Sequence
  Synthetic oligonucleotide
gcggtacaacccgaccactgccggccgatcgcttga

SEQ ID NO: 24254 - DNA, 35 bp, Artificial Sequence
  Synthetic oligonucleotide
atgagaccgtcagatcccctcagttcacacgcccc

SEQ ID NO: 24255 - DNA, 35 bp, Artificial Sequence
  Synthetic oligonucleotide
ggacctggccctgattaatggttgttgttggcccc

SEQ ID NO: 24256 - DNA, 35 bp, Artificial Sequence
  Synthetic oligonucleotide
gacctgatcacttccaacggcgaccaccttaatgg

SEQ ID NO: 24257 - DNA, 35 bp, Artificial Sequence
  Synthetic oligonucleotide
acgaacatccgacattttccgacgcacaccaagct

SEQ ID NO: 24258 - DNA, 35 bp, Artificial Sequence
  Synthetic oligonucleotide
atgcgacgaaggagccatcgttcgcattccactct

SEQ ID NO: 24259 - DNA, 35 bp, Artificial Sequence
  Synthetic oligonucleotide
taagcacccgcctcttatactatttattgcacaca

SEQ ID NO: 24260 - DNA, 36 bp, Artificial Sequence
  Synthetic oligonucleotide
tccccactgcttggaaatgaccctgaaatcgaccca

SEQ ID NO: 24261 - DNA, 35 bp, Artificial Sequence
  Synthetic oligonucleotide
acccgcaccccctcgcaccctccgccttgcactca

SEQ ID NO: 24262 - DNA, 36 bp, Artificial Sequence
  Synthetic oligonucleotide
agctaaagccgcgatgactgccccccccaatgttca

SEQ ID NO: 24263 - DNA, 37 bp, Artificial Sequence
  Synthetic oligonucleotide
ttccaacgctgttgggtttattcctgccccattccga

SEQ ID NO: 24264 - DNA, 35 bp, Artificial Sequence
  Synthetic oligonucleotide
acattccgactcacgttgcccacgttcctttgtga

SEQ ID NO: 24265 - DNA, 38 bp, Artificial Sequence
  Synthetic oligonucleotide
tcccaccggtagcttatttgctcttgtcccgctcttga

SEQ ID NO: 24266 - DNA, 35 bp, Artificial Sequence
  Synthetic oligonucleotide
tatgacgcgaccagagcggcgcttccctcatactc

SEQ ID NO: 24267 - DNA, 35 bp, Artificial Sequence
  Synthetic oligonucleotide
aacacaatccatgattctagccacctaaatttttg

SEQ ID NO: 24268 - DNA, 35 bp, Artificial Sequence
  Synthetic oligonucleotide
acgcgtgtagcgttcaactctccggcatcaacctt

SEQ ID NO: 24269 - DNA, 35 bp, Artificial Sequence
  Synthetic oligonucleotide
tccgacattcgaaccctgtgacatccatctgttaa

SEQ ID NO: 24270 - DNA, 37 bp, Artificial Sequence
  Synthetic oligonucleotide
tgtgtcacgatagggtggagggtggagagggcaaaga

SEQ ID NO: 24271 - DNA, 36 bp, Artificial Sequence
  Synthetic oligonucleotide
tatccgccgaagccgaacagcccatcccctgcacga

SEQ ID NO: 24272 - DNA, 38 bp, Artificial Sequence
  Synthetic oligonucleotide
gaagagggcgggagatagggtaggggccgtcccactga

SEQ ID NO: 24273 - DNA, 34 bp, Artificial Sequence
  Synthetic oligonucleotide
ggtcctactccggtgtcggttcgatcacatccac

SEQ ID NO: 24274 - DNA, 35 bp, Artificial Sequence
  Synthetic oligonucleotide
gaggtagcacgccaccagccgaagcaccacacgcc

SEQ ID NO: 24275 - DNA, 35 bp, Artificial Sequence
  Synthetic oligonucleotide
gatcctcgcgtcccgcccttcgaaatgtgctttcc

SEQ ID NO: 24276 - DNA, 35 bp, Artificial Sequence
  Synthetic oligonucleotide
tacgcacctcacacccccactgttccatcttcgag

SEQ ID NO: 24277 - DNA, 35 bp, Artificial Sequence
  Synthetic oligonucleotide
agcattcactgctttgtactcccctttctttgccg

SEQ ID NO: 24278 - DNA, 35 bp, Artificial Sequence
  Synthetic oligonucleotide
acaaatggccaaggggagtggtagcgggtggccat

SEQ ID NO: 24279 - DNA, 37 bp, Artificial Sequence
  Synthetic oligonucleotide
gttctggacggaaggaaagggttataggggcagacga

SEQ ID NO: 24280 - DNA, 35 bp, Artificial Sequence
  Synthetic oligonucleotide
aactccacctggccagacagtcagacggccggcga

SEQ ID NO: 24281 - DNA, 36 bp, Artificial Sequence
  Synthetic oligonucleotide
gcactatgcactcgtaattacggcccttcacctcga

SEQ ID NO: 24282 - DNA, 36 bp, Artificial Sequence
  Synthetic oligonucleotide
gatcacgcttcaactatttacaatacacgccaccta

SEQ ID NO: 24283 - DNA, 36 bp, Artificial Sequence
  Synthetic oligonucleotide
gcagtgtgaaatcgccctctcttgccgtgccactta

SEQ ID NO: 24284 - DNA, 36 bp, Artificial Sequence
  Synthetic oligonucleotide
tgtgcgccgcaccttagtgccttatctttcacttta

SEQ ID NO: 24285 - DNA, 35 bp, Artificial Sequence
  Synthetic oligonucleotide
acgagggaccatctgccgaccccggaccctacatc

SEQ ID NO: 24286 - DNA, 35 bp, Artificial Sequence
  Synthetic oligonucleotide
gctacccctgccattgtactttatagcttctaact

SEQ ID NO: 24287 - DNA, 36 bp, Artificial Sequence
  Synthetic oligonucleotide
tctcaggtcgccgccacggttgccttcatctcataa

SEQ ID NO: 24288 - DNA, 35 bp, Artificial Sequence
  Synthetic oligonucleotide
gtgcctggtcaaggccactaatttggaatgctcca

SEQ ID NO: 24289 - DNA, 37 bp, Artificial Sequence
  Synthetic oligonucleotide
ttggaggcctcgacctaatatagcaccttcccttaga

SEQ ID NO: 24290 - DNA, 37 bp, Artificial Sequence
  Synthetic oligonucleotide
taccagcctagcactacgcccacgatttcaacatgga

SEQ ID NO: 24291 - DNA, 38 bp, Artificial Sequence
  Synthetic oligonucleotide
gttgcatcgccccagttcctttcgttagtctttgttga

SEQ ID NO: 24292 - DNA, 36 bp, Artificial Sequence
  Synthetic oligonucleotide
gaccaccgcggtccgtacgttcccctctctgtttga

SEQ ID NO: 24293 - DNA, 35 bp, Artificial Sequence
  Synthetic oligonucleotide
tctatcgaccggctgatcctccccctcaccggcta

SEQ ID NO: 24294 - DNA, 36 bp, Artificial Sequence
  Synthetic oligonucleotide
gcgcacggcgcatgcacgccacaacacaatcacgta

SEQ ID NO: 24295 - DNA, 35 bp, Artificial Sequence
  Synthetic oligonucleotide
gttacgccttagaccccacgcactccgtcccttta

SEQ ID NO: 24296 - DNA, 35 bp, Artificial Sequence
  Synthetic oligonucleotide
gcacagcctatgtccatccgtacaccttactgtcc

SEQ ID NO: 24297 - DNA, 35 bp, Artificial Sequence
  Synthetic oligonucleotide
tctgtgctttgccgctaccattgaccaccctgtcc

SEQ ID NO: 24298 - DNA, 35 bp, Artificial Sequence
  Synthetic oligonucleotide
gttcgccgtatggtaaacgtaactgccattatctc

SEQ ID NO: 24299 - DNA, 35 bp, Artificial Sequence
  Synthetic oligonucleotide
ggccgaccatctttaactgccgagtacctccgttt

SEQ ID NO: 24300 - DNA, 36 bp, Artificial Sequence
  Synthetic oligonucleotide
gaaaggcgagggggacctgggagctagggtttggaa

SEQ ID NO: 24301 - DNA, 36 bp, Artificial Sequence
  Synthetic oligonucleotide
tctgggcaacacgccacttatcgtaaaacctctgca

SEQ ID NO: 24302 - DNA, 37 bp, Artificial Sequence
  Synthetic oligonucleotide
atggtcacctcaaccgcgttttgctcttatctcacga

SEQ ID NO: 24303 - DNA, 37 bp, Artificial Sequence
  Synthetic oligonucleotide
gacataataactggcctcaaagcagtcattcccatga

SEQ ID NO: 24304 - DNA, 38 bp, Artificial Sequence
  Synthetic oligonucleotide
tagacgcccaccttctctttcagctagctcccttgtga

SEQ ID NO: 24305 - DNA, 36 bp, Artificial Sequence
  Synthetic oligonucleotide
gtgacccagtcggctcgtcacttggtcctcgctcta

SEQ ID NO: 24306 - DNA, 35 bp, Artificial Sequence
  Synthetic oligonucleotide
tccactctcaacgaacggcctttcctcacactcgg

SEQ ID NO: 24307 - DNA, 35 bp, Artificial Sequence
  Synthetic oligonucleotide
ttcgctcccgaccgaatggtcccaggctctcctat

SEQ ID NO: 24308 - DNA, 35 bp, Artificial Sequence
  Synthetic oligonucleotide
gcctccatgtatgcctgcccctcatgtaattttct

SEQ ID NO: 24309 - DNA, 35 bp, Artificial Sequence
  Synthetic oligonucleotide
acaccatgcctccctcagcgtatcatattcgaatt

SEQ ID NO: 24310 - DNA, 36 bp, Artificial Sequence
  Synthetic oligonucleotide
aacacacccccctgaaagtgccctgaagttgcctaa

SEQ ID NO: 24311 - DNA, 36 bp, Artificial Sequence
  Synthetic oligonucleotide
gtgcatgaccctgggctgcatcaaatcatcaaatca

SEQ ID NO: 24312 - DNA, 38 bp, Artificial Sequence
  Synthetic oligonucleotide
gtgactgcgcggcctctttgtgccggttccttccctga

SEQ ID NO: 24313 - DNA, 38 bp, Artificial Sequence
  Synthetic oligonucleotide
gagtatctgcagggggagaaggaggggctgtcggttga

SEQ ID NO: 24314 - DNA, 35 bp, Artificial Sequence
  Synthetic oligonucleotide
tcattgacgtggcttacttgcgttggtcccactcc

SEQ ID NO: 24315 - DNA, 35 bp, Artificial Sequence
  Synthetic oligonucleotide
tgcccctttgccttgcgtaggcctgtctttcaatc

SEQ ID NO: 24316 - DNA, 35 bp, Artificial Sequence
  Synthetic oligonucleotide
gactaacccgtatagtaatgaccccggaccctctc

SEQ ID NO: 24317 - DNA, 35 bp, Artificial Sequence
  Synthetic oligonucleotide
acccctctggcctattcgtacttcatctatctggg

SEQ ID NO: 24318 - DNA, 35 bp, Artificial Sequence
  Synthetic oligonucleotide
ttaccccactctcataacgtacgaaacttctagtt

SEQ ID NO: 24319 - DNA, 36 bp, Artificial Sequence
  Synthetic oligonucleotide
actggccggactgggtcgcctgtcatcatccttcca

SEQ ID NO: 24320 - DNA, 37 bp, Artificial Sequence
  Synthetic oligonucleotide
ttgaacccgccgttaggatattattcccatgccacga

SEQ ID NO: 24321 - DNA, 38 bp, Artificial Sequence
  Synthetic oligonucleotide
tgacgtggagaggggggctaaggaaataaggatcttga

SEQ ID NO: 24322 - DNA, 33 bp, Artificial Sequence
  Synthetic oligonucleotide
gcatcctttgcatcatcacttgctgaactctta

SEQ ID NO: 24323 - DNA, 35 bp, Artificial Sequence
  Synthetic oligonucleotide
atgcatgtccccacaactccgtggtctcaccggac

SEQ ID NO: 24324 - DNA, 35 bp, Artificial Sequence
  Synthetic oligonucleotide
atagtccgacgggccacccactccttccccacgag

SEQ ID NO: 24325 - DNA, 35 bp, Artificial Sequence
  Synthetic oligonucleotide
acctgaactacacacggttgctgcctttacctctt

SEQ ID NO: 24326 - DNA, 37 bp, Artificial Sequence
  Synthetic oligonucleotide
gacggacaatcctgtatttacccctcaccacacccga

SEQ ID NO: 24327 - DNA, 36 bp, Artificial Sequence
  Synthetic oligonucleotide
ttctcctgcacaccttgtcgtctttagttctgccga

SEQ ID NO: 24328 - DNA, 37 bp, Artificial Sequence
  Synthetic oligonucleotide
atcccattgccaacgtgcgtcccaccgatccatttga

SEQ ID NO: 24329 - DNA, 36 bp, Artificial Sequence
  Synthetic oligonucleotide
gttgtccccccctcaggatctttgtagacctcgcta

SEQ ID NO: 24330 - DNA, 35 bp, Artificial Sequence
  Synthetic oligonucleotide
aagcagtcacatctccatcctgttacatctccggc

SEQ ID NO: 24331 - DNA, 35 bp, Artificial Sequence
  Synthetic oligonucleotide
ttcgcactcacaggtattcccgtccggttcattct

SEQ ID NO: 24332 - DNA, 35 bp, Artificial Sequence
  Synthetic oligonucleotide
tacaccccaccagaatgtgcgttgtcccattactt

SEQ ID NO: 24333 - DNA, 36 bp, Artificial Sequence
  Synthetic oligonucleotide
tttagagccaccgtcccctcgtccctgccatgccaa

SEQ ID NO: 24334 - DNA, 36 bp, Artificial Sequence
  Synthetic oligonucleotide
gccgaatacacccacccgacggttttgctaatgcca

SEQ ID NO: 24335 - DNA, 37 bp, Artificial Sequence
  Synthetic oligonucleotide
atgagcccatgcaacctgagccgtgtcttcctgccga

SEQ ID NO: 24336 - DNA, 37 bp, Artificial Sequence
  Synthetic oligonucleotide
gtgcgcaccgctttttgcgtcatttctcctcgcgcga

SEQ ID NO: 24337 - DNA, 37 bp, Artificial Sequence
  Synthetic oligonucleotide
gtatacgcaagacggaggtggggtggtggtgctagga

SEQ ID NO: 24338 - DNA, 37 bp, Artificial Sequence
  Synthetic oligonucleotide
aacgcccaccctctcacactggaattacaacctctga

SEQ ID NO: 24339 - DNA, 37 bp, Artificial Sequence
  Synthetic oligonucleotide
gcaagcctcaagtctcttcaacccgcacgtatcgtga

SEQ ID NO: 24340 - DNA, 35 bp, Artificial Sequence
  Synthetic oligonucleotide
ttgactcacttcccatctttgtttaaggcctttac

SEQ ID NO: 24341 - DNA, 35 bp, Artificial Sequence
  Synthetic oligonucleotide
aaccttccaccgcgccctcgttacgttaacatagc

SEQ ID NO: 24342 - DNA, 35 bp, Artificial Sequence
  Synthetic oligonucleotide
acctcccaacaaggagacatctctcatgccgtggc

SEQ ID NO: 24343 - DNA, 35 bp, Artificial Sequence
  Synthetic oligonucleotide
tatgcccattgggaatgtcctccatgccagtttgc

SEQ ID NO: 24344 - DNA, 35 bp, Artificial Sequence
  Synthetic oligonucleotide
cacccatcacgaccccttgttttggccgccccgat

SEQ ID NO: 24345 - DNA, 34 bp, Artificial Sequence
  Synthetic oligonucleotide
aatccgccttgtatcggccattccattcacatct

SEQ ID NO: 24346 - DNA, 35 bp, Artificial Sequence
  Synthetic oligonucleotide
ggtgagccactcagccccctgtcaataatccgttt

SEQ ID NO: 24347 - DNA, 35 bp, Artificial Sequence
  Synthetic oligonucleotide
tcttcacctcggccatatttcgaaggcattaccca

SEQ ID NO: 24348 - DNA, 35 bp, Artificial Sequence
  Synthetic oligonucleotide
tctccccggtgtccccgtactgcaaccactatcca

SEQ ID NO: 24349 - DNA, 37 bp, Artificial Sequence
  Synthetic oligonucleotide
accaggtggcgggtgggagggtggttcagcctcgaga

SEQ ID NO: 24350 - DNA, 37 bp, Artificial Sequence
  Synthetic oligonucleotide
aacatccgaaaggtcccttattagcctgaacacccga

SEQ ID NO: 24351 - DNA, 35 bp, Artificial Sequence
  Synthetic oligonucleotide
tgcacacgttttcatccctgtaccagcttcccgga

SEQ ID NO: 24352 - DNA, 38 bp, Artificial Sequence
  Synthetic oligonucleotide
gccggagggtggagcaggggatcgagaacgggtagtga

SEQ ID NO: 24353 - DNA, 36 bp, Artificial Sequence
  Synthetic oligonucleotide
atcgccactctatgctctacccctgtcgttctgtta

SEQ ID NO: 24354 - DNA, 35 bp, Artificial Sequence
  Synthetic oligonucleotide
gtacatccagacattttcgtttcctagccttcccg

SEQ ID NO: 24355 - DNA, 35 bp, Artificial Sequence
  Synthetic oligonucleotide
gtgggcagggataagaatgataggggatgataggg

SEQ ID NO: 24356 - DNA, 35 bp, Artificial Sequence
  Synthetic oligonucleotide
tcccaccatgcctagcccgttggacttctcctgtg

SEQ ID NO: 24357 - DNA, 35 bp, Artificial Sequence
  Synthetic oligonucleotide
gaagggggtgggggtgcgatgggttagactcgggt

SEQ ID NO: 24358 - DNA, 35 bp, Artificial Sequence
  Synthetic oligonucleotide
acccggacgcatccttgtcgatatctgccattatt

SEQ ID NO: 24359 - DNA, 37 bp, Artificial Sequence
  Synthetic oligonucleotide
gtgacaagggagaagtagttgggggggtagaacaaga

SEQ ID NO: 24360 - DNA, 37 bp, Artificial Sequence
  Synthetic oligonucleotide
ggatcgccccaccagcctccggatgacattacacgga

SEQ ID NO: 24361 - DNA, 36 bp, Artificial Sequence
  Synthetic oligonucleotide
ggtgcctcaccttcgtccctgaacaccgacgcctta

SEQ ID NO: 24362 - DNA, 35 bp, Artificial Sequence
  Synthetic oligonucleotide
atctcgcattctgaacttcctatgcgctttacacc

SEQ ID NO: 24363 - DNA, 35 bp, Artificial Sequence
  Synthetic oligonucleotide
tgcacctttcgcccacgctcgggatcaatcttgtc

SEQ ID NO: 24364 - DNA, 35 bp, Artificial Sequence
  Synthetic oligonucleotide
ttctccactgctcacctgctacctggttaattttc

SEQ ID NO: 24365 - DNA, 35 bp, Artificial Sequence
  Synthetic oligonucleotide
gggaacggagaacgggaggcgcggtgagggctagg

SEQ ID NO: 24366 - DNA, 35 bp, Artificial Sequence
  Synthetic oligonucleotide
tcccagagccacctctttttgatttgccatttttg

SEQ ID NO: 24367 - DNA, 35 bp, Artificial Sequence
  Synthetic oligonucleotide
tgcgcctcgcactctccgccataggacgcgtatct

SEQ ID NO: 24368 - DNA, 35 bp, Artificial Sequence
  Synthetic oligonucleotide
tatctacccaccgctccgtttggcttttcccttct

SEQ ID NO: 24369 - DNA, 35 bp, Artificial Sequence
  Synthetic oligonucleotide
ttacgcaacaaattctgaaactggcctctgcgctt

SEQ ID NO: 24370 - DNA, 37 bp, Artificial Sequence
  Synthetic oligonucleotide
ggatgcccccactagaccgcacgcgtcgtttgcccga

SEQ ID NO: 24371 - DNA, 35 bp, Artificial Sequence
  Synthetic oligonucleotide
gctccatccctttgcctttgttgccttcttgagga

SEQ ID NO: 24372 - DNA, 38 bp, Artificial Sequence
  Synthetic oligonucleotide
aatgcatgcccctcgctatggaaactgccttcatctga

SEQ ID NO: 24373 - DNA, 35 bp, Artificial Sequence
  Synthetic oligonucleotide
tctcatgactatctgtacacctattacccgtgact

SEQ ID NO: 24374 - DNA, 35 bp, Artificial Sequence
  Synthetic oligonucleotide
tccatgcgcactgtctcttggccggggaccctcct

SEQ ID NO: 24375 - DNA, 38 bp, Artificial Sequence
  Synthetic oligonucleotide
gtggttcatccccccgacctccgccagttccctgctga

SEQ ID NO: 24376 - DNA, 38 bp, Artificial Sequence
  Synthetic oligonucleotide
gcgtggcatctccggcgtactgctcttgccttccttga

SEQ ID NO: 24377 - DNA, 38 bp, Artificial Sequence
  Synthetic oligonucleotide
acaaggggagaaataggggggtggtaagtggcggttga

SEQ ID NO: 24378 - DNA, 35 bp, Artificial Sequence
  Synthetic oligonucleotide
taacagtgcgatgtctccggtccctccatcgctgc

SEQ ID NO: 24379 - DNA, 35 bp, Artificial Sequence
  Synthetic oligonucleotide
gaaatcggggcggcgatacttccgtgcggtttctc

SEQ ID NO: 24380 - DNA, 35 bp, Artificial Sequence
  Synthetic oligonucleotide
tgtatcccggccccccgttcccaaccgctttacag

SEQ ID NO: 24381 - DNA, 35 bp, Artificial Sequence
  Synthetic oligonucleotide
gctccctgagcatcgcttaccccgacgaccactct

SEQ ID NO: 24382 - DNA, 35 bp, Artificial Sequence
  Synthetic oligonucleotide
atcacagatgggtctctttgtacccgtttttcctt

SEQ ID NO: 24383 - DNA, 37 bp, Artificial Sequence
  Synthetic oligonucleotide
tgcagtcacgtgtgcacgtccccccttcgctctccga

SEQ ID NO: 24384 - DNA, 36 bp, Artificial Sequence
  Synthetic oligonucleotide
ggtggggcaagaacagggggactgcaatttggggga

SEQ ID NO: 24385 - DNA, 38 bp, Artificial Sequence
  Synthetic oligonucleotide
acacccgaccccccacgccgatgctggaaagcttatga

SEQ ID NO: 24386 - DNA, 38 bp, Artificial Sequence
  Synthetic oligonucleotide
atgcaacgcttacatatcgcccaatttactccgcctga

SEQ ID NO: 24387 - DNA, 38 bp, Artificial Sequence
  Synthetic oligonucleotide
gagccatacgccgctttcactctcctgctcatagctga

SEQ ID NO: 24388 - DNA, 38 bp, Artificial Sequence
  Synthetic oligonucleotide
actatgcctccgttatgctggtactcttcctttgctga

SEQ ID NO: 24389 - DNA, 35 bp, Artificial Sequence
  Synthetic oligonucleotide
tagacttgcttccctctccgccgggccgcccgtac

SEQ ID NO: 24390 - DNA, 35 bp, Artificial Sequence
  Synthetic oligonucleotide
acactgctactgcccagtcctccgtcatcctctcg

SEQ ID NO: 24391 - DNA, 35 bp, Artificial Sequence
  Synthetic oligonucleotide
aagtgcgctgtccttggcatctttttcctccgtcg

SEQ ID NO: 24392 - DNA, 35 bp, Artificial Sequence
  Synthetic oligonucleotide
agctcgccctctacgtactcctatccgatccggat

SEQ ID NO: 24393 - DNA, 37 bp, Artificial Sequence
  Synthetic oligonucleotide
acgccactcaacctgtgtgcggccttcctccaaccga

SEQ ID NO: 24394 - DNA, 35 bp, Artificial Sequence
  Synthetic oligonucleotide
gtgggtggagaccaggggcgaggcagtgggaggga

SEQ ID NO: 24395 - DNA, 37 bp, Artificial Sequence
  Synthetic oligonucleotide
agatgactacgtatggaaggaggggggtggttaggga

SEQ ID NO: 24396 - DNA, 37 bp, Artificial Sequence
  Synthetic oligonucleotide
tacaccaccctctcgttgcatttgcgcataccactga

SEQ ID NO: 24397 - DNA, 38 bp, Artificial Sequence
  Synthetic oligonucleotide
tatgacccaccccagattgacttcgctttccacattga

SEQ ID NO: 24398 - DNA, 37 bp, Artificial Sequence
  Synthetic oligonucleotide
gacgcccagtcacctgcaccccgaaacgagccattga

SEQ ID NO: 24399 - DNA, 36 bp, Artificial Sequence
  Synthetic oligonucleotide
ttgtcactccccacccagtacaagcgataacaccta

SEQ ID NO: 24400 - DNA, 35 bp, Artificial Sequence
  Synthetic oligonucleotide
tgccactggggtcgcactccccctgcctacctcta

SEQ ID NO: 24401 - DNA, 35 bp, Artificial Sequence
  Synthetic oligonucleotide
tgatcagtcctgtagactgtaccttcttagccgcc

SEQ ID NO: 24402 - DNA, 35 bp, Artificial Sequence
  Synthetic oligonucleotide
gaacccaccacagataccttattcgcgctacccgc

SEQ ID NO: 24403 - DNA, 35 bp, Artificial Sequence
  Synthetic oligonucleotide
agacaccgacaccccattatctaggttatcactgc

SEQ ID NO: 24404 - DNA, 35 bp, Artificial Sequence
  Synthetic oligonucleotide
gtgcagaatatcacgcttgcacttttttgccgact

SEQ ID NO: 24405 - DNA, 34 bp, Artificial Sequence
  Synthetic oligonucleotide
gttgtgtcatggcgcatcatcaccgccctccctt

SEQ ID NO: 24406 - DNA, 36 bp, Artificial Sequence
  Synthetic oligonucleotide
tcaagacgtcaccggcgatccgacatccatttgcaa

SEQ ID NO: 24407 - DNA, 36 bp, Artificial Sequence
  Synthetic oligonucleotide
ttagcctcctatgccatgccatcccaagtgctacca

SEQ ID NO: 24408 - DNA, 38 bp, Artificial Sequence
  Synthetic oligonucleotide
acttaccatgcacgtggtgtcatcgcctcactttatga

SEQ ID NO: 24409 - DNA, 38 bp, Artificial Sequence
  Synthetic oligonucleotide
tgcacccgacgttccaacctgattgccccgattgctga

SEQ ID NO: 24410 - DNA, 36 bp, Artificial Sequence
  Synthetic oligonucleotide
tgtcgtccgttatcctgcaatgaacctcgcccacta

SEQ ID NO: 24411 - DNA, 37 bp, Artificial Sequence
  Synthetic oligonucleotide
acctcgcccgaagagtcctgcctccgttgctccgcta

SEQ ID NO: 24412 - DNA, 35 bp, Artificial Sequence
  Synthetic oligonucleotide
gtgccagacgcaaatcgctaaaccatctttatatc

SEQ ID NO: 24413 - DNA, 36 bp, Artificial Sequence
  Synthetic oligonucleotide
tgacccccccgagccgcccatcaaacagagctaaca

SEQ ID NO: 24414 - DNA, 37 bp, Artificial Sequence
  Synthetic oligonucleotide
tgctcgtcacatacttccgaccgccctatcctcatga

SEQ ID NO: 24415 - DNA, 38 bp, Artificial Sequence
  Synthetic oligonucleotide
ttagagtgtgggacgggaggggatacgtgggcacctga

SEQ ID NO: 24416 - DNA, 38 bp, Artificial Sequence
  Synthetic oligonucleotide
gaaggctgcatttagcggggtagggggtgtgggggtga

SEQ ID NO: 24417 - DNA, 36 bp, Artificial Sequence
  Synthetic oligonucleotide
gctacgtgcacgttaccaaaggtaattgcggtaata

SEQ ID NO: 24418 - DNA, 36 bp, Artificial Sequence
  Synthetic oligonucleotide
gttcagctgtaccaccatggccccgcggatctcata

SEQ ID NO: 24419 - DNA, 35 bp, Artificial Sequence
  Synthetic oligonucleotide
gcacctggtcagcccggctcgcatcaggccgcacc

SEQ ID NO: 24420 - DNA, 36 bp, Artificial Sequence
  Synthetic oligonucleotide
tctcgactcccgaactccgttataaatagcacactg

SEQ ID NO: 24421 - DNA, 36 bp, Artificial Sequence
  Synthetic oligonucleotide
gttgctccagagctgcacccttatgtcagtacacaa

SEQ ID NO: 24422 - DNA, 37 bp, Artificial Sequence
  Synthetic oligonucleotide
ggacaggtggaggaggttcgaggggtagcggatcaga

SEQ ID NO: 24423 - DNA, 37 bp, Artificial Sequence
  Synthetic oligonucleotide
tccgcgtgttcgcgatcacgtttcatcttcactccga

SEQ ID NO: 24424 - DNA, 35 bp, Artificial Sequence
  Synthetic oligonucleotide
gttccacccaaccgcttctgcgcgattccaaagga

SEQ ID NO: 24425 - DNA, 36 bp, Artificial Sequence
  Synthetic oligonucleotide
accatcatctgcctgcccttctatttccgtaaagga

SEQ ID NO: 24426 - DNA, 37 bp, Artificial Sequence
  Synthetic oligonucleotide
gactgccactgtttcatcgtttctaagcccacctgga

SEQ ID NO: 24427 - DNA, 38 bp, Artificial Sequence
  Synthetic oligonucleotide
aacccgcactatgcttacccattcccaattactggtga

SEQ ID NO: 24428 - DNA, 38 bp, Artificial Sequence
  Synthetic oligonucleotide
aggacacctggcctatctacgcttgtaagcacccttga

SEQ ID NO: 24429 - DNA, 36 bp, Artificial Sequence
  Synthetic oligonucleotide
tccggacccacacatggccaggtttcgaccgaccta

SEQ ID NO: 24430 - DNA, 35 bp, Artificial Sequence
  Synthetic oligonucleotide
taggcccggtacgtgcagctccacctattgcatcc

SEQ ID NO: 24431 - DNA, 35 bp, Artificial Sequence
  Synthetic oligonucleotide
tgaactacccatcgaatcgcacacgtgatcacacg

SEQ ID NO: 24432 - DNA, 35 bp, Artificial Sequence
  Synthetic oligonucleotide
ggactcaagcccgtttgtccaattacgcctatact

SEQ ID NO: 24433 - DNA, 35 bp, Artificial Sequence
  Synthetic oligonucleotide
gacacgatgcagacttactatcgttctatgtccct

SEQ ID NO: 24434 - DNA, 35 bp, Artificial Sequence
  Synthetic oligonucleotide
acacgcaacgcggactttccactctccccgttcgt

SEQ ID NO: 24435 - DNA, 36 bp, Artificial Sequence
  Synthetic oligonucleotide
atcccagtccacaacccggcgtatttttacgatcca

SEQ ID NO: 24436 - DNA, 36 bp, Artificial Sequence
  Synthetic oligonucleotide
tgacaaggcggtcaaccctcgcgcctcgtactttca

SEQ ID NO: 24437 - DNA, 37 bp, Artificial Sequence
  Synthetic oligonucleotide
ggaccccctcatgctacctatcgcaaacagtttgcga

SEQ ID NO: 24438 - DNA, 35 bp, Artificial Sequence
  Synthetic oligonucleotide
acccaacctcttgccctgttgccctatcttagtga

SEQ ID NO: 24439 - DNA, 35 bp, Artificial Sequence
  Synthetic oligonucleotide
gagaagacggaaaggggttttggagttgcgggtga

SEQ ID NO: 24440 - DNA, 38 bp, Artificial Sequence
  Synthetic oligonucleotide
accgggtccgtatcctgctcccactgtctccccgttga

SEQ ID NO: 24441 - DNA, 35 bp, Artificial Sequence
  Synthetic oligonucleotide
agctgaacccgcatcacctgcataatggccctcgc

SEQ ID NO: 24442 - DNA, 35 bp, Artificial Sequence
  Synthetic oligonucleotide
ttaagctcacgacctgcagccgcgattgtcccttc

SEQ ID NO: 24443 - DNA, 35 bp, Artificial Sequence
  Synthetic oligonucleotide
tcatctcagcccctaccatcgcatgttggcaactg

SEQ ID NO: 24444 - DNA, 35 bp, Artificial Sequence
  Synthetic oligonucleotide
gccgccgtcttatccgtactatcttcttcgttttg

SEQ ID NO: 24445 - DNA, 35 bp, Artificial Sequence
  Synthetic oligonucleotide
acgtgccacaccccagcgctaatatcagccgcgct

SEQ ID NO: 24446 - DNA, 35 bp, Artificial Sequence
  Synthetic oligonucleotide
tcgcacttgcccgcacccctcagtaacgccacgtt

SEQ ID NO: 24447 - DNA, 36 bp, Artificial Sequence
  Synthetic oligonucleotide
tcatccaccctgagtcgactcttctgtagagcgaca

SEQ ID NO: 24448 - DNA, 35 bp, Artificial Sequence
  Synthetic oligonucleotide
gaaacagggagctgatcgctgcttctcactctcca

SEQ ID NO: 24449 - DNA, 35 bp, Artificial Sequence
  Synthetic oligonucleotide
gcccactgatcgtatgcggccacttttcacttcga

SEQ ID NO: 24450 - DNA, 37 bp, Artificial Sequence
  Synthetic oligonucleotide
tgtcagtcaccctgttagtcccattcgccttctatga

SEQ ID NO: 24451 - DNA, 38 bp, Artificial Sequence
  Synthetic oligonucleotide
gcaccaccacttttctgccatttcgtgtcaactgctga

SEQ ID NO: 24452 - DNA, 38 bp, Artificial Sequence
  Synthetic oligonucleotide
tagtgcgcactgcaatttagggatgttgggaggggtga

SEQ ID NO: 24453 - DNA, 35 bp, Artificial Sequence
  Synthetic oligonucleotide
gtcgaaagcaccaccctgccgaccctgtcaatgcc

SEQ ID NO: 24454 - DNA, 35 bp, Artificial Sequence
  Synthetic oligonucleotide
ttggcgaccaccacaccctctatccgagcagctcc

SEQ ID NO: 24455 - DNA, 35 bp, Artificial Sequence
  Synthetic oligonucleotide
gtatggaggtgcggtaggtagggtcacggctaaat

SEQ ID NO: 24456 - DNA, 36 bp, Artificial Sequence
  Synthetic oligonucleotide
gccgcacctaagggatctgctcaaccgactgccaca

SEQ ID NO: 24457 - DNA, 34 bp, Artificial Sequence
  Synthetic oligonucleotide
tcataagccggcacactctggttctgccctgcca

SEQ ID NO: 24458 - DNA, 35 bp, Artificial Sequence
  Synthetic oligonucleotide
gagtaacgggtaggataggtggagggcagggggca

SEQ ID NO: 24459 - DNA, 37 bp, Artificial Sequence
  Synthetic oligonucleotide
ggactctgcccgtacgaccacccgacctcatcaccga

SEQ ID NO: 24460 - DNA, 38 bp, Artificial Sequence
  Synthetic oligonucleotide
gtggagatcacggggcaagggggggcaatgagagttga

SEQ ID NO: 24461 - DNA, 35 bp, Artificial Sequence
  Synthetic oligonucleotide
ttcctgtccacccctcgtgccgtgatacttgagtc

SEQ ID NO: 24462 - DNA, 35 bp, Artificial Sequence
  Synthetic oligonucleotide
tccacaacatggccaccacccacatagggatccat

SEQ ID NO: 24463 - DNA, 35 bp, Artificial Sequence
  Synthetic oligonucleotide
tcatcctcaaacctcctttcttgccacagctcgct

SEQ ID NO: 24464 - DNA, 36 bp, Artificial Sequence
  Synthetic oligonucleotide
ggtgaagctccgtcccgtcctccgcacctctcaaca

SEQ ID NO: 24465 - DNA, 37 bp, Artificial Sequence
  Synthetic oligonucleotide
taccacatcctggttttcgcccttaatcccatcggga

SEQ ID NO: 24466 - DNA, 37 bp, Artificial Sequence
  Synthetic oligonucleotide
aatgcctgacgtaggtcgggaattcaatctatactga

SEQ ID NO: 24467 - DNA, 38 bp, Artificial Sequence
  Synthetic oligonucleotide
acccccgccatccacataacgcgcgtttcgcgcgctga

SEQ ID NO: 24468 - DNA, 36 bp, Artificial Sequence
  Synthetic oligonucleotide
actccccagcctctcagcaatctgacccccaagtga

SEQ ID NO: 24469 - DNA, 38 bp, Artificial Sequence
  Synthetic oligonucleotide
gatgccgcactcgccctttcatgtcatagacttcgtga

SEQ ID NO: 24470 - DNA, 35 bp, Artificial Sequence
  Synthetic oligonucleotide
gttcccactgccatattcgctttactgttggtcac

SEQ ID NO: 24471 - DNA, 35 bp, Artificial Sequence
  Synthetic oligonucleotide
accgtgaggtcaccatctttcccccgcgcccttcc

SEQ ID NO: 24472 - DNA, 35 bp, Artificial Sequence
  Synthetic oligonucleotide
ttcctcaccccattcacgcgtacgacataccgtgc

SEQ ID NO: 24473 - DNA, 35 bp, Artificial Sequence
  Synthetic oligonucleotide
tcctgtccagctcccttccttctcagttacttatc

SEQ ID NO: 24474 - DNA, 35 bp, Artificial Sequence
  Synthetic oligonucleotide
accgtaacctacacgcgtgccttaatccttgctat

SEQ ID NO: 24475 - DNA, 35 bp, Artificial Sequence
  Synthetic oligonucleotide
gcccctcctgctcaggccctccctggtcacttggt

SEQ ID NO: 24476 - DNA, 35 bp, Artificial Sequence
  Synthetic oligonucleotide
tcatcacctgtccgcctttactattccttgaagtt

SEQ ID NO: 24477 - DNA, 37 bp, Artificial Sequence
  Synthetic oligonucleotide
gctgccatccctctgttcatgtccgaccccatggaga

SEQ ID NO: 24478 - DNA, 37 bp, Artificial Sequence
  Synthetic oligonucleotide
acttgggcgcagagctcaacaccgcttctctttccga

SEQ ID NO: 24479 - DNA, 36 bp, Artificial Sequence
  Synthetic oligonucleotide
gtagggcacactccgtgtcttgcttactccccctga

SEQ ID NO: 24480 - DNA, 38 bp, Artificial Sequence
  Synthetic oligonucleotide
gcaatggagggataatggagcgtggtggggtgggctga

SEQ ID NO: 24481 - DNA, 36 bp, Artificial Sequence
  Synthetic oligonucleotide
ttcagacattggcacgggtgggagtggagggcgcta

SEQ ID NO: 24482 - DNA, 36 bp, Artificial Sequence
  Synthetic oligonucleotide
gtctcacctacatcgccgtcaccatgcccacacgta

SEQ ID NO: 24483 - DNA, 36 bp, Artificial Sequence
  Synthetic oligonucleotide
tcactacgccggacttttgcattacacccctactta

SEQ ID NO: 24484 - DNA, 35 bp, Artificial Sequence
  Synthetic oligonucleotide
tagtacccctgtcgcctttctctcggttcgtatcc

SEQ ID NO: 24485 - DNA, 35 bp, Artificial Sequence
  Synthetic oligonucleotide
tgttacctgcctcccccctatagagtctaggggtc

SEQ ID NO: 24486 - DNA, 35 bp, Artificial Sequence
  Synthetic oligonucleotide
ggtccgacgtgcctcgtttaaaccagcccctgttc

SEQ ID NO: 24487 - DNA, 35 bp, Artificial Sequence
  Synthetic oligonucleotide
gtcaccacccgcattaaacctcgagatggctatcg

SEQ ID NO: 24488 - DNA, 35 bp, Artificial Sequence
  Synthetic oligonucleotide
acgtagtacggcccctctagcaacccacccacatg

SEQ ID NO: 24489 - DNA, 35 bp, Artificial Sequence
  Synthetic oligonucleotide
agttaccagcgctgtctcatctcagtcacttatct

SEQ ID NO: 24490 - DNA, 36 bp, Artificial Sequence
  Synthetic oligonucleotide
agtacgtccgcctgctcagccgccgacaaatgccaa

SEQ ID NO: 24491 - DNA, 36 bp, Artificial Sequence
  Synthetic oligonucleotide
tgttccaccactcactattcattaggcactaccgaa

SEQ ID NO: 24492 - DNA, 35 bp, Artificial Sequence
  Synthetic oligonucleotide
gcccgaactggtccttgatcacatcttgtccccca

SEQ ID NO: 24493 - DNA, 37 bp, Artificial Sequence
  Synthetic oligonucleotide
aacactcactaggcctgtatgccatcccttcacgaga

SEQ ID NO: 24494 - DNA, 37 bp, Artificial Sequence
  Synthetic oligonucleotide
gacccgcccgccaatgcacactgtttgctatcactga

SEQ ID NO: 24495 - DNA, 38 bp, Artificial Sequence
  Synthetic oligonucleotide
aacgcaacgtcgcggccgtgattttcctcctacgttga

SEQ ID NO: 24496 - DNA, 35 bp, Artificial Sequence
  Synthetic oligonucleotide
tctgatccactacgcccgacaccacgtctatagcc

SEQ ID NO: 24497 - DNA, 35 bp, Artificial Sequence
  Synthetic oligonucleotide
tcttgcgccggtactttttgtaactccatctccgc

SEQ ID NO: 24498 - DNA, 35 bp, Artificial Sequence
  Synthetic oligonucleotide
acacgcgtacgcaccatttgctcaaccagtccctt

SEQ ID NO: 24499 - DNA, 36 bp, Artificial Sequence
  Synthetic oligonucleotide
gaacatagggggaggggggtagtcaaggcaatcaaa

SEQ ID NO: 24500 - DNA, 37 bp, Artificial Sequence
  Synthetic oligonucleotide
gccacgggcgattctacttgttacatttacgcttgga

SEQ ID NO: 24501 - DNA, 38 bp, Artificial Sequence
  Synthetic oligonucleotide
tgaccaacacccgttgtgacttctttgtctggccatga

SEQ ID NO: 24502 - DNA, 35 bp, Artificial Sequence
  Synthetic oligonucleotide
tagccattcttgcccatcctagaccgtgccgaacc

SEQ ID NO: 24503 - DNA, 35 bp, Artificial Sequence
  Synthetic oligonucleotide
ttacgcccactcatacagcctacatatcctgcacc

SEQ ID NO: 24504 - DNA, 35 bp, Artificial Sequence
  Synthetic oligonucleotide
gcattacgaacgttcgtgacttgcttttaaccccc

SEQ ID NO: 24505 - DNA, 35 bp, Artificial Sequence
  Synthetic oligonucleotide
gccgtccggtcctagctccaaattcgcacctgctg

SEQ ID NO: 24506 - DNA, 35 bp, Artificial Sequence
  Synthetic oligonucleotide
gccatcaaacgcaagtgcgatcgattacatctcct

SEQ ID NO: 24507 - DNA, 35 bp, Artificial Sequence
  Synthetic oligonucleotide
tctaggttgcgaccacgccgccgcccttccgagtt

SEQ ID NO: 24508 - DNA, 36 bp, Artificial Sequence
  Synthetic oligonucleotide
tgccctcttcccgtatgccccctttgtatcacacca

SEQ ID NO: 24509 - DNA, 36 bp, Artificial Sequence
  Synthetic oligonucleotide
atcgcagacagctagcacacacaactctcacctgca

SEQ ID NO: 24510 - DNA, 37 bp, Artificial Sequence
  Synthetic oligonucleotide
gcaccctattctcttggcctccctgtgcgacactgga

SEQ ID NO: 24511 - DNA, 38 bp, Artificial Sequence
  Synthetic oligonucleotide
tcaagcaaaggtggggcaaagagagagtgggggaatga

SEQ ID NO: 24512 - DNA, 38 bp, Artificial Sequence
  Synthetic oligonucleotide
tatcagccgtatacatctcgttacctacactaccttga

SEQ ID NO: 24513 - DNA, 36 bp, Artificial Sequence
  Synthetic oligonucleotide
tctgccatccatgctgttcgtagtgcgccccactta

SEQ ID NO: 24514 - DNA, 35 bp, Artificial Sequence
  Synthetic oligonucleotide
gaaccagctcacacacacgtgatcatactcctaag

SEQ ID NO: 24515 - DNA, 35 bp, Artificial Sequence
  Synthetic oligonucleotide
tgagaaggaaggcaggctgggggggaatgcaaagg

SEQ ID NO: 24516 - DNA, 35 bp, Artificial Sequence
  Synthetic oligonucleotide
tccgaccgttacaggcaaattatcaccccatcatg

SEQ ID NO: 24517 - DNA, 35 bp, Artificial Sequence
  Synthetic oligonucleotide
tcccaacctgttctcttattgtcttctgggatcct

SEQ ID NO: 24518 - DNA, 35 bp, Artificial Sequence
  Synthetic oligonucleotide
gtggaccttacccctgtggtacctaaccatacatt

SEQ ID NO: 24519 - DNA, 35 bp, Artificial Sequence
  Synthetic oligonucleotide
gcccatgtgctctctttgccctaaggtggaccctt

SEQ ID NO: 24520 - DNA, 36 bp, Artificial Sequence
  Synthetic oligonucleotide
atctacgctccaccggcccatttcgcactgagacaa

SEQ ID NO: 24521 - DNA, 37 bp, Artificial Sequence
  Synthetic oligonucleotide
gaagtgggggagtaggatccgggagtaacgagaacga

SEQ ID NO: 24522 - DNA, 37 bp, Artificial Sequence
  Synthetic oligonucleotide
aagaacaaaaggtggggtagggtgatgctgggaacga

SEQ ID NO: 24523 - DNA, 35 bp, Artificial Sequence
  Synthetic oligonucleotide
tcgatcggctccccgacgcccctcccaccctcgga

SEQ ID NO: 24524 - DNA, 36 bp, Artificial Sequence
  Synthetic oligonucleotide
gtgggtaggcataactcgagggatgaatgggaggga

SEQ ID NO: 24525 - DNA, 36 bp, Artificial Sequence
  Synthetic oligonucleotide
tccctccgccccatcctggttccgcctgtttttgga

SEQ ID NO: 24526 - DNA, 37 bp, Artificial Sequence
  Synthetic oligonucleotide
gcccccacctcatattgcatcgccttcgcgatcctga

SEQ ID NO: 24527 - DNA, 35 bp, Artificial Sequence
  Synthetic oligonucleotide
tgctcttggcccaatctgtccgacctttgttttac

SEQ ID NO: 24528 - DNA, 35 bp, Artificial Sequence
  Synthetic oligonucleotide
gatatcctgcccgtttccttcgtcgttgacgatcc

SEQ ID NO: 24529 - DNA, 35 bp, Artificial Sequence
  Synthetic oligonucleotide
tgtccaacccctattctgtttcttagagttcttag

SEQ ID NO: 24530 - DNA, 35 bp, Artificial Sequence
  Synthetic oligonucleotide
gctcgactgttagttgtttcgttctcccttttttg

SEQ ID NO: 24531 - DNA, 35 bp, Artificial Sequence
  Synthetic oligonucleotide
tctagcccgtggtagtctccttagcgtggtcccct

SEQ ID NO: 24532 - DNA, 36 bp, Artificial Sequence
  Synthetic oligonucleotide
tgacatcaggtcgatctcacagcacaccaacgaaca

SEQ ID NO: 24533 - DNA, 36 bp, Artificial Sequence
  Synthetic oligonucleotide
gacgccccagcccctattacccacgttgccgtcgca

SEQ ID NO: 24534 - DNA, 36 bp, Artificial Sequence
  Synthetic oligonucleotide
caggaccacctccaccgtttttagcccgcacattca

SEQ ID NO: 24535 - DNA, 36 bp, Artificial Sequence
  Synthetic oligonucleotide
actgaccgggaggtatgagaattgggagggctggga

SEQ ID NO: 24536 - DNA, 38 bp, Artificial Sequence
  Synthetic oligonucleotide
ggtgggatgggtggaggattgcaaaggagggcgactga

SEQ ID NO: 24537 - DNA, 37 bp, Artificial Sequence
  Synthetic oligonucleotide
accgagcgcatctctcgtgggggccctctcacattga

SEQ ID NO: 24538 - DNA, 38 bp, Artificial Sequence
  Synthetic oligonucleotide
gcgcatctgccgatctccttgaagccattttcttttga

SEQ ID NO: 24539 - DNA, 36 bp, Artificial Sequence
  Synthetic oligonucleotide
gacatccacccgttgcgaactcattgagagctgcta

SEQ ID NO: 24540 - DNA, 36 bp, Artificial Sequence
  Synthetic oligonucleotide
gtatgcgcgaggagttcgcgctattgttacttatta

SEQ ID NO: 24541 - DNA, 35 bp, Artificial Sequence
  Synthetic oligonucleotide
gccgattcgtccattgcccacgttgccagtcacac

SEQ ID NO: 24542 - DNA, 35 bp, Artificial Sequence
  Synthetic oligonucleotide
ttgtacgcactcattggcatcttatatgtatcccc

SEQ ID NO: 24543 - DNA, 36 bp, Artificial Sequence
  Synthetic oligonucleotide
ggagtggggaggcgaaagtgggatgagggtgcatgc

SEQ ID NO: 24544 - DNA, 35 bp, Artificial Sequence
  Synthetic oligonucleotide
agctccatgcctcgtgatcttccctagtggaactc

SEQ ID NO: 24545 - DNA, 35 bp, Artificial Sequence
  Synthetic oligonucleotide
acatctcgccccgtaccgagtacaccacacaaacg

SEQ ID NO: 24546 - DNA, 35 bp, Artificial Sequence
  Synthetic oligonucleotide
tgacccccccatctgcatgcttctgtacaatcttt

SEQ ID NO: 24547 - DNA, 35 bp, Artificial Sequence
  Synthetic oligonucleotide
agctgccctctccaggaaccgccctcgtcctcgca

SEQ ID NO: 24548 - DNA, 37 bp, Artificial Sequence
  Synthetic oligonucleotide
gttcgaggggcgtggggaggggcggagaagatggtga

SEQ ID NO: 24549 - DNA, 38 bp, Artificial Sequence
  Synthetic oligonucleotide
gtgccccccgagccgctccttgtgccatctccctgtga

SEQ ID NO: 24550 - DNA, 38 bp, Artificial Sequence
  Synthetic oligonucleotide
tccgcccgccctttgaacgttggaccatgcatgattga

SEQ ID NO: 24551 - DNA, 38 bp, Artificial Sequence
  Synthetic oligonucleotide
aatgccccggccctgtctttaacgtcttgctaacttga

SEQ ID NO: 24552 - DNA, 38 bp, Artificial Sequence
  Synthetic oligonucleotide
gaccaccccagtgcatttttcagtatccgctccgttga

SEQ ID NO: 24553 - DNA, 36 bp, Artificial Sequence
  Synthetic oligonucleotide
tcgtacccgcgacaacgcatacgttctgccacccta

SEQ ID NO: 24554 - DNA, 36 bp, Artificial Sequence
  Synthetic oligonucleotide
atgtctacaccgccgcttgatatgggtccttctcta

SEQ ID NO: 24555 - DNA, 36 bp, Artificial Sequence
  Synthetic oligonucleotide
gattccagcggtccgtcgccctgcacttcgcgttta

SEQ ID NO: 24556 - DNA, 35 bp, Artificial Sequence
  Synthetic oligonucleotide
tgctaccagctttctacctgcattcagcaacgcac

SEQ ID NO: 24557 - DNA, 35 bp, Artificial Sequence
  Synthetic oligonucleotide
tgttaccctgctttgtttggttatgcactatttcc

SEQ ID NO: 24558 - DNA, 35 bp, Artificial Sequence
  Synthetic oligonucleotide
actcccgcctggttgaaatctcttaagtatccacg

SEQ ID NO: 24559 - DNA, 35 bp, Artificial Sequence
  Synthetic oligonucleotide
taccctgccacgatgtcagcgttgcgcatctctct

SEQ ID NO: 24560 - DNA, 35 bp, Artificial Sequence
  Synthetic oligonucleotide
gcacagacctgcaaacctcgactggtgtcctcctt

SEQ ID NO: 24561 - DNA, 35 bp, Artificial Sequence
  Synthetic oligonucleotide
gtgcgctacggcttgacgtccttctccatattcca

SEQ ID NO: 24562 - DNA, 37 bp, Artificial Sequence
  Synthetic oligonucleotide
tagaccagccaccaatcctcatatactccgcgagcga

SEQ ID NO: 24563 - DNA, 37 bp, Artificial Sequence
  Synthetic oligonucleotide
gggtcaactgcccccgcctcctgccatcatcttagga

SEQ ID NO: 24564 - DNA, 38 bp, Artificial Sequence
  Synthetic oligonucleotide
tacctccacctgactgccccgtatacttatcgtagtga

SEQ ID NO: 24565 - DNA, 38 bp, Artificial Sequence
  Synthetic oligonucleotide
aatgtaagaagggggtaggtgtgggtggggactgttga

SEQ ID NO: 24566 - DNA, 36 bp, Artificial Sequence
  Synthetic oligonucleotide
gaccaccctctttggccctctatgcgggttttccta

SEQ ID NO: 24567 - DNA, 35 bp, Artificial Sequence
  Synthetic oligonucleotide
acctccgtgacctggtttggtattcgttattggtc

SEQ ID NO: 24568 - DNA, 35 bp, Artificial Sequence
  Synthetic oligonucleotide
aaggagaataagggttgaggtgccggaatgatggt

SEQ ID NO: 24569 - DNA, 37 bp, Artificial Sequence
  Synthetic oligonucleotide
accctgctacagcctcaaaaaagcccctcgtccgcga

SEQ ID NO: 24570 - DNA, 37 bp, Artificial Sequence
  Synthetic oligonucleotide
accataccgccttgttccagcccagttctttgaagga

SEQ ID NO: 24571 - DNA, 37 bp, Artificial Sequence
  Synthetic oligonucleotide
ggggtaggaacagaactaggcaaggggggttagagga

SEQ ID NO: 24572 - DNA, 37 bp, Artificial Sequence
  Synthetic oligonucleotide
atcaaggatggggaaaccagagagggggcgggaggga

SEQ ID NO: 24573 - DNA, 37 bp, Artificial Sequence
  Synthetic oligonucleotide
tacacctcgctacgtcactccacctttcccgtgatga

SEQ ID NO: 24574 - DNA, 38 bp, Artificial Sequence
  Synthetic oligonucleotide
gcgcaggaaactgcgccataccaagtgatcatacctga

SEQ ID NO: 24575 - DNA, 37 bp, Artificial Sequence
  Synthetic oligonucleotide
ttgggtgcccgttcctctcaataattgcctgggttga

SEQ ID NO: 24576 - DNA, 36 bp, Artificial Sequence
  Synthetic oligonucleotide
tgctctgaccccatgggcgccactgcctccgcttta

SEQ ID NO: 24577 - DNA, 35 bp, Artificial Sequence
  Synthetic oligonucleotide
atggttgactagggccccttcagcaccccccccgc

SEQ ID NO: 24578 - DNA, 35 bp, Artificial Sequence
  Synthetic oligonucleotide
accgccccgccgggatcttttacatgccgcttaat

SEQ ID NO: 24579 - DNA, 36 bp, Artificial Sequence
  Synthetic oligonucleotide
acgtgggtcacagcaccgagtctgcaccttcataaa

SEQ ID NO: 24580 - DNA, 35 bp, Artificial Sequence
  Synthetic oligonucleotide
acaacccacccacgagaccgcccaggtgtagggaa

SEQ ID NO: 24581 - DNA, 36 bp, Artificial Sequence
  Synthetic oligonucleotide
tccaccctatgcgtggcattgacgaccacactgaca

SEQ ID NO: 24582 - DNA, 35 bp, Artificial Sequence
  Synthetic oligonucleotide
gtgcaccgtaacaagtattgctctggtccctccca

SEQ ID NO: 24583 - DNA, 37 bp, Artificial Sequence
  Synthetic oligonucleotide
atgctcgggggaagccgtaggggcggaaactgggcga

SEQ ID NO: 24584 - DNA, 38 bp, Artificial Sequence
  Synthetic oligonucleotide
gacacccactcacacatgcggatacttccttccgcgga

SEQ ID NO: 24585 - DNA, 37 bp, Artificial Sequence
  Synthetic oligonucleotide
tcatccccactgtctcacgtgtaacgcactacttgga

SEQ ID NO: 24586 - DNA, 38 bp, Artificial Sequence
  Synthetic oligonucleotide
actgttcaacaccagccttagtgcctgccaacttgtga

SEQ ID NO: 24587 - DNA, 35 bp, Artificial Sequence
  Synthetic oligonucleotide
gaagccccgactcaacactgccatggcgttcgtcc

SEQ ID NO: 24588 - DNA, 35 bp, Artificial Sequence
  Synthetic oligonucleotide
tttgacgccggtttctatcatatttatctgggttc

SEQ ID NO: 24589 - DNA, 35 bp, Artificial Sequence
  Synthetic oligonucleotide
gccgcatccacattgcggtatgttgccacatattt

SEQ ID NO: 24590 - DNA, 37 bp, Artificial Sequence
  Synthetic oligonucleotide
accgcccgggaggtgaggtacgggggtaatcaaaaga

SEQ ID NO: 24591 - DNA, 37 bp, Artificial Sequence
  Synthetic oligonucleotide
gacaccctccattgccccgattcgcgttctttcccga

SEQ ID NO: 24592 - DNA, 38 bp, Artificial Sequence
  Synthetic oligonucleotide
gcaaggatcggctcaaagggaaggggagaaaggggtga

SEQ ID NO: 24593 - DNA, 36 bp, Artificial Sequence
  Synthetic oligonucleotide
aaacctcacctcacgacccccgtagcacacgtaata

SEQ ID NO: 24594 - DNA, 35 bp, Artificial Sequence
  Synthetic oligonucleotide
ggtggtccgtgcatccccgtatacattactctccc

SEQ ID NO: 24595 - DNA, 35 bp, Artificial Sequence
  Synthetic oligonucleotide
tcaaatatcctcctgcaccagacacgcactgccgc

SEQ ID NO: 24596 - DNA, 35 bp, Artificial Sequence
  Synthetic oligonucleotide
gcagttcactcactgtttaacgttctttcccctcg

SEQ ID NO: 24597 - DNA, 35 bp, Artificial Sequence
  Synthetic oligonucleotide
tgacgcttccgtaaccacatcgtagcccttccatg

SEQ ID NO: 24598 - DNA, 34 bp, Artificial Sequence
  Synthetic oligonucleotide
atgccatccctcgcatgcaatacgtcttgttttg

SEQ ID NO: 24599 - DNA, 35 bp, Artificial Sequence
  Synthetic oligonucleotide
gtaggggtcaggaaagggttggatgggagatgggt

SEQ ID NO: 24600 - DNA, 36 bp, Artificial Sequence
  Synthetic oligonucleotide
acacagacgaatggccgttacacttgcatactccaa

SEQ ID NO: 24601 - DNA, 36 bp, Artificial Sequence
  Synthetic oligonucleotide
acctaccctaacttctcatcaggccggcctctggca

SEQ ID NO: 24602 - DNA, 36 bp, Artificial Sequence
  Synthetic oligonucleotide
gttcatgtcacacggtaccaaccttccgcaccacga

SEQ ID NO: 24603 - DNA, 37 bp, Artificial Sequence
  Synthetic oligonucleotide
atcgacaacgggaggagaaaggagatttgggagcgga

SEQ ID NO: 24604 - DNA, 36 bp, Artificial Sequence
  Synthetic oligonucleotide
gtcctgccctgccacagaacagtttcctacgctgga

SEQ ID NO: 24605 - DNA, 38 bp, Artificial Sequence
  Synthetic oligonucleotide
acgttccgcatttcggtccccctagccaccctccgtga

SEQ ID NO: 24606 - DNA, 37 bp, Artificial Sequence
  Synthetic oligonucleotide
atggaggagtgacgggtgggaaggtaggatggggtga

SEQ ID NO: 24607 - DNA, 37 bp, Artificial Sequence
  Synthetic oligonucleotide
tcctcgagcctcccatcctgtacgctccaaactgtga

SEQ ID NO: 24608 - DNA, 35 bp, Artificial Sequence
  Synthetic oligonucleotide
gcatttgccggacttagcgcacaaaacctacccta

SEQ ID NO: 24609 - DNA, 36 bp, Artificial Sequence
  Synthetic oligonucleotide
gtcattcgcctatatgttcctgccttcttgtatgta

SEQ ID NO: 24610 - DNA, 36 bp, Artificial Sequence
  Synthetic oligonucleotide
agatgtccgccacctttgtctgcctgtaggttttta

SEQ ID NO: 24611 - DNA, 35 bp, Artificial Sequence
  Synthetic oligonucleotide
tacacgtggtcctagtgctgctaccgtccctcaac

SEQ ID NO: 24612 - DNA, 35 bp, Artificial Sequence
  Synthetic oligonucleotide
gtcccaacggaccaaacattcaacgaggccccacc

SEQ ID NO: 24613 - DNA, 35 bp, Artificial Sequence
  Synthetic oligonucleotide
tcccaccctcgggtgagtcgaagatgaaccacccc

SEQ ID NO: 24614 - DNA, 35 bp, Artificial Sequence
  Synthetic oligonucleotide
tgagaccgaccccacctgtcccatgcataggtttc

SEQ ID NO: 24615 - DNA, 35 bp, Artificial Sequence
  Synthetic oligonucleotide
acctgtgctgcgtaataagcccttacctcatcctg

SEQ ID NO: 24616 - DNA, 35 bp, Artificial Sequence
  Synthetic oligonucleotide
accgtgccgtatcggtctaattctcgttcattcca

SEQ ID NO: 24617 - DNA, 36 bp, Artificial Sequence
  Synthetic oligonucleotide
taggcccccacacacgaccaccgtgacgacaaagca

SEQ ID NO: 24618 - DNA, 36 bp, Artificial Sequence
  Synthetic oligonucleotide
aggaggtgagcaagaggataagggggaagagggcga

SEQ ID NO: 24619 - DNA, 37 bp, Artificial Sequence
  Synthetic oligonucleotide
tcgttgccggtgcccctgtttaactctctctcgtgga

SEQ ID NO: 24620 - DNA, 38 bp, Artificial Sequence
  Synthetic oligonucleotide
accacctgcgcgacatcttgagccgcacttgaacctga

SEQ ID NO: 24621 - DNA, 38 bp, Artificial Sequence
  Synthetic oligonucleotide
tcacctggcgatgtcctagccccacatgatgcccctga

SEQ ID NO: 24622 - DNA, 38 bp, Artificial Sequence
  Synthetic oligonucleotide
gaagtgtgggacgggggtgtatgggtattatgatgtga

SEQ ID NO: 24623 - DNA, 36 bp, Artificial Sequence
  Synthetic oligonucleotide
acccgcagaggcacgggaacacttcggcactggcta

SEQ ID NO: 24624 - DNA, 36 bp, Artificial Sequence
  Synthetic oligonucleotide
gcccacattctccccgtgccgaagactctcattgta

SEQ ID NO: 24625 - DNA, 36 bp, Artificial Sequence
  Synthetic oligonucleotide
aattacgcagggggacaacggggggagcgacggtta

SEQ ID NO: 24626 - DNA, 35 bp, Artificial Sequence
  Synthetic oligonucleotide
acgcgcacgctcctatctattcccgccgtcattta

SEQ ID NO: 24627 - DNA, 35 bp, Artificial Sequence
  Synthetic oligonucleotide
actcattcgaccccttcggtaattggacacaacac

SEQ ID NO: 24628 - DNA, 35 bp, Artificial Sequence
  Synthetic oligonucleotide
aagtgggaggaccgaggggaggaacttacagagat

SEQ ID NO: 24629 - DNA, 35 bp, Artificial Sequence
  Synthetic oligonucleotide
ttgccgccgcccgcgttgggccccatgctccacct

SEQ ID NO: 24630 - DNA, 35 bp, Artificial Sequence
  Synthetic oligonucleotide
gagccgattgtgccttgcttttgcaattgttcctt

SEQ ID NO: 24631 - DNA, 35 bp, Artificial Sequence
  Synthetic oligonucleotide
acagcccaatcaacctcgttccggaccgcactgtt

SEQ ID NO: 24632 - DNA, 35 bp, Artificial Sequence
  Synthetic oligonucleotide
gaccgagcccgggcccttaccgatcataacaccca

SEQ ID NO: 24633 - DNA, 36 bp, Artificial Sequence
  Synthetic oligonucleotide
aatccggggggtgagggtggaacggacttaaaggca

SEQ ID NO: 24634 - DNA, 37 bp, Artificial Sequence
  Synthetic oligonucleotide
accacaccgccccgactccaaacccatctaaggtgga

SEQ ID NO: 24635 - DNA, 37 bp, Artificial Sequence
  Synthetic oligonucleotide
atcccgccactgcacaactcgattagccttgggctga

SEQ ID NO: 24636 - DNA, 37 bp, Artificial Sequence
  Synthetic oligonucleotide
acccgacatacggcccgcccccccaagtcccttctga

SEQ ID NO: 24637 - DNA, 36 bp, Artificial Sequence
  Synthetic oligonucleotide
gtgatccggctgtacgtgccaactcccatcacttta

SEQ ID NO: 24638 - DNA, 35 bp, Artificial Sequence
  Synthetic oligonucleotide
agacccgccggcttaaatcaccaccactctaccgc

SEQ ID NO: 24639 - DNA, 35 bp, Artificial Sequence
  Synthetic oligonucleotide
tccatccactgcttaagtttctagccggttctggt

SEQ ID NO: 24640 - DNA, 36 bp, Artificial Sequence
  Synthetic oligonucleotide
cctagctgtcccgctatccacccgactcctggccaa

SEQ ID NO: 24641 - DNA, 36 bp, Artificial Sequence
  Synthetic oligonucleotide
tcgcgaaccgccctctcgttacaccagtgtctcata

SEQ ID NO: 24642 - DNA, 35 bp, Artificial Sequence
  Synthetic oligonucleotide
gagagcgctatatcctctgtatggtccaccttcac

SEQ ID NO: 24643 - DNA, 35 bp, Artificial Sequence
  Synthetic oligonucleotide
atcccgagcgctggtagtgcgtacatccacccggc

SEQ ID NO: 24644 - DNA, 35 bp, Artificial Sequence
  Synthetic oligonucleotide
tgtagggtcgacatgttggggggatggtgtgtggg

SEQ ID NO: 24645 - DNA, 35 bp, Artificial Sequence
  Synthetic oligonucleotide
gccctatgctcatccgtacctgcgaggtctccaaa

SEQ ID NO: 24646 - DNA, 36 bp, Artificial Sequence
  Synthetic oligonucleotide
ggaaaacaacttccagcctcccgcccttgctctgca

SEQ ID NO: 24647 - DNA, 37 bp, Artificial Sequence
  Synthetic oligonucleotide
tccctcctcgtcccgcgtatctcctcgacccctcgga

SEQ ID NO: 24648 - DNA, 38 bp, Artificial Sequence
  Synthetic oligonucleotide
gatctgctgtcgcatagtctaccccacccaccctgtga

SEQ ID NO: 24649 - DNA, 37 bp, Artificial Sequence
  Synthetic oligonucleotide
tgacctgggttgggtgggagtcatgggctgggtgtga

SEQ ID NO: 24650 - DNA, 38 bp, Artificial Sequence
  Synthetic oligonucleotide
aacgcagggcacttgatttatcgcgccaaaccacctta

SEQ ID NO: 24651 - DNA, 35 bp, Artificial Sequence
  Synthetic oligonucleotide
tagcgagggaagccgccgtccacttcgccttcacc

SEQ ID NO: 24652 - DNA, 35 bp, Artificial Sequence
  Synthetic oligonucleotide
gaacacgagttatcgttccgtgccttaccacatcc

SEQ ID NO: 24653 - DNA, 35 bp, Artificial Sequence
  Synthetic oligonucleotide
accctccaggctggtttttcacggttcgcccaatc

SEQ ID NO: 24654 - DNA, 35 bp, Artificial Sequence
  Synthetic oligonucleotide
tctccatccggacggtaactatggtaccttcacat

SEQ ID NO: 24655 - DNA, 35 bp, Artificial Sequence
  Synthetic oligonucleotide
gctcatacacgagtgtgtccacttgcggtttttct

SEQ ID NO: 24656 - DNA, 34 bp, Artificial Sequence
  Synthetic oligonucleotide
gaccaccttcgtgacgaacatgccgtgcctattt

SEQ ID NO: 24657 - DNA, 36 bp, Artificial Sequence
  Synthetic oligonucleotide
tccatcccatgctttccgcctaagttcactaaggca

SEQ ID NO: 24658 - DNA, 36 bp, Artificial Sequence
  Synthetic oligonucleotide
gggtaacgccctctcgatcgtacacccaccctatca

SEQ ID NO: 24659 - DNA, 37 bp, Artificial Sequence
  Synthetic oligonucleotide
gctccaatcgcttagtggaccatttacacacctccga

SEQ ID NO: 24660 - DNA, 37 bp, Artificial Sequence
  Synthetic oligonucleotide
tcgcattccttatcgctcctgtgctcgcgccttccga

SEQ ID NO: 24661 - DNA, 37 bp, Artificial Sequence
  Synthetic oligonucleotide
atcccatccagctcctgcccattgccgtgcgtatcga

SEQ ID NO: 24662 - DNA, 37 bp, Artificial Sequence
  Synthetic oligonucleotide
tcacgggggcaatggtgggaccgtgatcgggaaagga

SEQ ID NO: 24663 - DNA, 36 bp, Artificial Sequence
  Synthetic oligonucleotide
tcactcgtagccgtccggaatcctggcccatcatga

SEQ ID NO: 24664 - DNA, 37 bp, Artificial Sequence
  Synthetic oligonucleotide
tgttaaaggcgggggtgcgggtagggggaaaggatga

SEQ ID NO: 24665 - DNA, 38 bp, Artificial Sequence
  Synthetic oligonucleotide
ctggtctcctccgctggaatagcatactgaattgctga

SEQ ID NO: 24666 - DNA, 37 bp, Artificial Sequence
  Synthetic oligonucleotide
gtctgccactcacatggcctccccacctgtacggtga

SEQ ID NO: 24667 - DNA, 38 bp, Artificial Sequence
  Synthetic oligonucleotide
ttcccactgccttcagcttagctgtccttcgttcttga

SEQ ID NO: 24668 - DNA, 35 bp, Artificial Sequence
  Synthetic oligonucleotide
tacgccccagcccttccatatcgtcaaccggctcc

SEQ ID NO: 24669 - DNA, 35 bp, Artificial Sequence
  Synthetic oligonucleotide
tcacgcctcattcctgctgtccgctatccacttcc

SEQ ID NO: 24670 - DNA, 35 bp, Artificial Sequence
  Synthetic oligonucleotide
gtccattgagcccgtgccgttttcagtccgcttgc

SEQ ID NO: 24671 - DNA, 35 bp, Artificial Sequence
  Synthetic oligonucleotide
tcctacgagcgtgcaacactatcttcacaatgttc

SEQ ID NO: 24672 - DNA, 35 bp, Artificial Sequence
  Synthetic oligonucleotide
tactcgtactttggccaacctcgcatggtttttcg

SEQ ID NO: 24673 - DNA, 35 bp, Artificial Sequence
  Synthetic oligonucleotide
taatatccctgcctccgtacgctactgacgtgagt

SEQ ID NO: 24674 - DNA, 35 bp, Artificial Sequence
  Synthetic oligonucleotide
gcagtaggaaagcggttggataaactggggggtgt

SEQ ID NO: 24675 - DNA, 36 bp, Artificial Sequence
  Synthetic oligonucleotide
tgaaaccactctcagtggatttacaatgcccttaca

SEQ ID NO: 24676 - DNA, 35 bp, Artificial Sequence
  Synthetic oligonucleotide
acgcgtagccccattctttgttagtcctctattca

SEQ ID NO: 24677 - DNA, 36 bp, Artificial Sequence
  Synthetic oligonucleotide
tcctgatcgcttgtatcgtgcctccactccccgcga

SEQ ID NO: 24678 - DNA, 37 bp, Artificial Sequence
  Synthetic oligonucleotide
aaccgcgcaggacggccaatccgcaccccctcactga

SEQ ID NO: 24679 - DNA, 36 bp, Artificial Sequence
  Synthetic oligonucleotide
gcactcgcacactatatgctttgcacccggtatcta

SEQ ID NO: 24680 - DNA, 35 bp, Artificial Sequence
  Synthetic oligonucleotide
gttactcccactgctttactgttgcccggtataac

SEQ ID NO: 24681 - DNA, 35 bp, Artificial Sequence
  Synthetic oligonucleotide
gacgtgttccacagtgatcccttgcccgtaaccgc

SEQ ID NO: 24682 - DNA, 35 bp, Artificial Sequence
  Synthetic oligonucleotide
gccttagcacttgcctgcacgacccctgttgcctc

SEQ ID NO: 24683 - DNA, 35 bp, Artificial Sequence
  Synthetic oligonucleotide
tctgggtctgcatcacctattcccgtgtcgcgctc

SEQ ID NO: 24684 - DNA, 35 bp, Artificial Sequence
  Synthetic oligonucleotide
tgcaaaccgccttgttcacgccctgccttcacgag

SEQ ID NO: 24685 - DNA, 35 bp, Artificial Sequence
  Synthetic oligonucleotide
tgctctctccaattgtaaccgtgcccgaatactag

SEQ ID NO: 24686 - DNA, 35 bp, Artificial Sequence
  Synthetic oligonucleotide
gacccattgatagcgagcctcccccttctggtgct

SEQ ID NO: 24687 - DNA, 36 bp, Artificial Sequence
  Synthetic oligonucleotide
gttgcgaccgagactgcccataatgtcccctcctgt

SEQ ID NO: 24688 - DNA, 32 bp, Artificial Sequence
  Synthetic oligonucleotide
gccaaacaccgagttgtccgcataaaatcctt

SEQ ID NO: 24689 - DNA, 36 bp, Artificial Sequence
  Synthetic oligonucleotide
acatccctccgacgagtctgacacgagtcagaccca

SEQ ID NO: 24690 - DNA, 36 bp, Artificial Sequence
  Synthetic oligonucleotide
tctgcatggaagatcattagtcccaccaaccctgca

SEQ ID NO: 24691 - DNA, 35 bp, Artificial Sequence
  Synthetic oligonucleotide
ttgacgccggcccctccaggtcccttctatcatca

SEQ ID NO: 24692 - DNA, 37 bp, Artificial Sequence
  Synthetic oligonucleotide
accccccacgaaaatgatttcccgccacccgatagga

SEQ ID NO: 24693 - DNA, 38 bp, Artificial Sequence
  Synthetic oligonucleotide
gcttgcctcacccttacagacgtccatgctccctctga

SEQ ID NO: 24694 - DNA, 35 bp, Artificial Sequence
  Synthetic oligonucleotide
gccggaacccggtttacccgccaccctgcatatta

SEQ ID NO: 24695 - DNA, 35 bp, Artificial Sequence
  Synthetic oligonucleotide
ttgacctggcgagcgataacattctgccggttttc

SEQ ID NO: 24696 - DNA, 35 bp, Artificial Sequence
  Synthetic oligonucleotide
tgtgaactgcctcaccgttctgaaaacgaatgcct

SEQ ID NO: 24697 - DNA, 35 bp, Artificial Sequence
  Synthetic oligonucleotide
gtctgcccttccgcctcgaccaccccgtctgcgtt

SEQ ID NO: 24698 - DNA, 35 bp, Artificial Sequence
  Synthetic oligonucleotide
gaccgtgcacatctgtaacgcattgccctctggtt

SEQ ID NO: 24699 - DNA, 37 bp, Artificial Sequence
  Synthetic oligonucleotide
agtgtgggcaggggtgacatggtacggggggtagcga

SEQ ID NO: 24700 - DNA, 36 bp, Artificial Sequence
  Synthetic oligonucleotide
gaatgggagggatcgggaaagttggaagtggaggga

SEQ ID NO: 24701 - DNA, 38 bp, Artificial Sequence
  Synthetic oligonucleotide
tgacacacaactcctgtgtaacaactcttgcctattga

SEQ ID NO: 24702 - DNA, 38 bp, Artificial Sequence
  Synthetic oligonucleotide
gcatcgctgcaacacccccgctcgccacacttggttga

SEQ ID NO: 24703 - DNA, 35 bp, Artificial Sequence
  Synthetic oligonucleotide
gcccctggtgagcaccttccccatcctttgcatgc

SEQ ID NO: 24704 - DNA, 35 bp, Artificial Sequence
  Synthetic oligonucleotide
tcctcaccttggggggatactgttttctgctttgc

SEQ ID NO: 24705 - DNA, 35 bp, Artificial Sequence
  Synthetic oligonucleotide
agaacacgccacccaatcttttagaatcagcaatc

SEQ ID NO: 24706 - DNA, 35 bp, Artificial Sequence
  Synthetic oligonucleotide
acaatccgcaacactatactcgcagttcctgctcg

SEQ ID NO: 24707 - DNA, 35 bp, Artificial Sequence
  Synthetic oligonucleotide
tgatgctcctttgcatgctataccagtaccccttg

SEQ ID NO: 24708 - DNA, 35 bp, Artificial Sequence
  Synthetic oligonucleotide
gctgacacgcatacaaagcctttttaatgtaacct

SEQ ID NO: 24709 - DNA, 35 bp, Artificial Sequence
  Synthetic oligonucleotide
acagccagttgagtcgtctctttcttcctactcgt

SEQ ID NO: 24710 - DNA, 36 bp, Artificial Sequence
  Synthetic oligonucleotide
gcgaagggagtggctctgcaagggttagggaagaaa

SEQ ID NO: 24711 - DNA, 36 bp, Artificial Sequence
  Synthetic oligonucleotide
atcgagccgtgcacgttactttgcgctttactttca

SEQ ID NO: 24712 - DNA, 38 bp, Artificial Sequence
  Synthetic oligonucleotide
tgtccctacctgcccctcaacgttatgcctgtcaccga

SEQ ID NO: 24713 - DNA, 37 bp, Artificial Sequence
  Synthetic oligonucleotide
tgttcacacctgccacctctcgtttccaaacgatcga

SEQ ID NO: 24714 - DNA, 36 bp, Artificial Sequence
  Synthetic oligonucleotide
gctgtcggggggggggatctggggcggaacggcgga

SEQ ID NO: 24715 - DNA, 37 bp, Artificial Sequence
  Synthetic oligonucleotide
gacggatccagcatggaataggggggtaagggcggga

SEQ ID NO: 24716 - DNA, 37 bp, Artificial Sequence
  Synthetic oligonucleotide
ggtgtaggcacagacggggatgggctatggtggtgga

SEQ ID NO: 24717 - DNA, 35 bp, Artificial Sequence
  Synthetic oligonucleotide
gtctcgcaccctgcgattagctgttttgcccatga

SEQ ID NO: 24718 - DNA, 38 bp, Artificial Sequence
  Synthetic oligonucleotide
atgcgcaacgagcctgagctccatccccctatacctga

SEQ ID NO: 24719 - DNA, 35 bp, Artificial Sequence
  Synthetic oligonucleotide
tcgctgtccattgtctgccctggccgttgtactcc

SEQ ID NO: 24720 - DNA, 35 bp, Artificial Sequence
  Synthetic oligonucleotide
tctagcgtgcactccgacccggccagtaccccgtc

SEQ ID NO: 24721 - DNA, 35 bp, Artificial Sequence
  Synthetic oligonucleotide
ggaggcgatcaccggagggggggaaggcaggagag

SEQ ID NO: 24722 - DNA, 35 bp, Artificial Sequence
  Synthetic oligonucleotide
gactcaaccacttatttttcacgctacaacagtag

SEQ ID NO: 24723 - DNA, 35 bp, Artificial Sequence
  Synthetic oligonucleotide
acccgctctcgagtaacgggatacattccacccct

SEQ ID NO: 24724 - DNA, 35 bp, Artificial Sequence
  Synthetic oligonucleotide
tcgacggtgccgtctatgcctcttctttgcaccgt

SEQ ID NO: 24725 - DNA, 35 bp, Artificial Sequence
  Synthetic oligonucleotide
gagaagagtaggggccagagagaaggggaaggcgt

SEQ ID NO: 24726 - DNA, 35 bp, Artificial Sequence
  Synthetic oligonucleotide
ttacgcgtagtcaagcattggctcattccgctttt

SEQ ID NO: 24727 - DNA, 37 bp, Artificial Sequence
  Synthetic oligonucleotide
tgatcccggtgctttcagttcagctccatcaaaacga

SEQ ID NO: 24728 - DNA, 37 bp, Artificial Sequence
  Synthetic oligonucleotide
accagctccaccagcttacagggtgccctatttatga

SEQ ID NO: 24729 - DNA, 36 bp, Artificial Sequence
  Synthetic oligonucleotide
gacccacgatcgcatgagtggtcattgccctttgta

SEQ ID NO: 24730 - DNA, 36 bp, Artificial Sequence
  Synthetic oligonucleotide
acatacgcacctgggcaaagaatcctagtcctctta

SEQ ID NO: 24731 - DNA, 35 bp, Artificial Sequence
  Synthetic oligonucleotide
gccccagctacggcgtctactgccatccccacaat

SEQ ID NO: 24732 - DNA, 35 bp, Artificial Sequence
  Synthetic oligonucleotide
tgggccacctaagcctgggctgccaacatccacct

SEQ ID NO: 24733 - DNA, 36 bp, Artificial Sequence
  Synthetic oligonucleotide
ttgcgtagggtggcgtgagcggaggggaggggggaa

SEQ ID NO: 24734 - DNA, 37 bp, Artificial Sequence
  Synthetic oligonucleotide
tatccacgacacaccggaatttgcgaccaccacgcga

SEQ ID NO: 24735 - DNA, 38 bp, Artificial Sequence
  Synthetic oligonucleotide
acacgtaagcgtatcttggcctcgttctccgtctctga

SEQ ID NO: 24736 - DNA, 38 bp, Artificial Sequence
  Synthetic oligonucleotide
aacaccccccgcaacagtacccgtaggaacttcagtga

SEQ ID NO: 24737 - DNA, 36 bp, Artificial Sequence
  Synthetic oligonucleotide
ttcccaatcgtatcatccgcgtttgcgttttgctta

SEQ ID NO: 24738 - DNA, 35 bp, Artificial Sequence
  Synthetic oligonucleotide
ggagccgcattataaccgctgttacgccttccgcc

SEQ ID NO: 24739 - DNA, 35 bp, Artificial Sequence
  Synthetic oligonucleotide
tccggtacatcacataccaggtttcgatccctttc

SEQ ID NO: 24740 - DNA, 35 bp, Artificial Sequence
  Synthetic oligonucleotide
actgtcgtaacggagtagagagagagaagggagag

SEQ ID NO: 24741 - DNA, 35 bp, Artificial Sequence
  Synthetic oligonucleotide
gatcaatcgtcccacgttgtttgctccccccattg

SEQ ID NO: 24742 - DNA, 35 bp, Artificial Sequence
  Synthetic oligonucleotide
taacaggacatgggagagattggggagaaaggcat

SEQ ID NO: 24743 - DNA, 34 bp, Artificial Sequence
  Synthetic oligonucleotide
tgcttcctcgctagagcaacctcctgcccactgt

SEQ ID NO: 24744 - DNA, 36 bp, Artificial Sequence
  Synthetic oligonucleotide
tttcgccctgctccacctgttagtcgaaccgcatca

SEQ ID NO: 24745 - DNA, 36 bp, Artificial Sequence
  Synthetic oligonucleotide
agtccgtcctgctttggggtcccgcgcgcattttca

SEQ ID NO: 24746 - DNA, 38 bp, Artificial Sequence
  Synthetic oligonucleotide
tagtccctcccacacgattggcatctggcccatgctga

SEQ ID NO: 24747 - DNA, 35 bp, Artificial Sequence
  Synthetic oligonucleotide
actcgtacgccatctaagccacatgcactgactcc

SEQ ID NO: 24748 - DNA, 35 bp, Artificial Sequence
  Synthetic oligonucleotide
accaacgtcatcgtaggtgacgttgctcaaaactt

SEQ ID NO: 24749 - DNA, 37 bp, Artificial Sequence
  Synthetic oligonucleotide
ttggtgggaggacgggcgggtggggctcggacacaga

SEQ ID NO: 24750 - DNA, 36 bp, Artificial Sequence
  Synthetic oligonucleotide
actctccagcgccgaccttccttaatctgccagcga

SEQ ID NO: 24751 - DNA, 37 bp, Artificial Sequence
  Synthetic oligonucleotide
tgctacgccaaccaccgtactccgcctctatatgcga

SEQ ID NO: 24752 - DNA, 36 bp, Artificial Sequence
  Synthetic oligonucleotide
tcaagtgatgggcgggtgtagggttgtaatgaggga

SEQ ID NO: 24753 - DNA, 37 bp, Artificial Sequence
  Synthetic oligonucleotide
tccccaccctccgtaacgagtcctggtcgcaccggga

SEQ ID NO: 24754 - DNA, 38 bp, Artificial Sequence
  Synthetic oligonucleotide
gccaagcctgagctacaacgtacaccaaccgcctatga

SEQ ID NO: 24755 - DNA, 38 bp, Artificial Sequence
  Synthetic oligonucleotide
tagtgcgtccaatcaacgccagcacctcccttccctga

SEQ ID NO: 24756 - DNA, 37 bp, Artificial Sequence
  Synthetic oligonucleotide
ttgacagcccctcgccacaactctccgctcgcagtga

SEQ ID NO: 24757 - DNA, 38 bp, Artificial Sequence
  Synthetic oligonucleotide
gagacgccccaggtcgtccttcttaatcacatacttga

SEQ ID NO: 24758 - DNA, 35 bp, Artificial Sequence
  Synthetic oligonucleotide
attgacgaacatgtgagcgccactctatctccccc

SEQ ID NO: 24759 - DNA, 35 bp, Artificial Sequence
  Synthetic oligonucleotide
gcccgtccgtccccctgcttccttattgcggacgc

SEQ ID NO: 24760 - DNA, 36 bp, Artificial Sequence
  Synthetic oligonucleotide
gcaccactctggaaacccaccttgtccgcaggaaaa

SEQ ID NO: 24761 - DNA, 36 bp, Artificial Sequence
  Synthetic oligonucleotide
gacgccccccgttagtactccgagcttttttgcaca

SEQ ID NO: 24762 - DNA, 37 bp, Artificial Sequence
  Synthetic oligonucleotide
tcactcacctggcaattgattgtgccgccttctccga

SEQ ID NO: 24763 - DNA, 36 bp, Artificial Sequence
  Synthetic oligonucleotide
tccaccatcccatctgtttctgcccgcgagagcgga

SEQ ID NO: 24764 - DNA, 36 bp, Artificial Sequence
  Synthetic oligonucleotide
actgggcgggtgagagtcaaactagggacgaaggga

SEQ ID NO: 24765 - DNA, 38 bp, Artificial Sequence
  Synthetic oligonucleotide
aaccgactacacacgcgccagctaccgcaccatcctga

SEQ ID NO: 24766 - DNA, 38 bp, Artificial Sequence
  Synthetic oligonucleotide
ggacacccactccactaggggcacatcaacacacttga

SEQ ID NO: 24767 - DNA, 38 bp, Artificial Sequence
  Synthetic oligonucleotide
tgcactactctggcgtacacgggcctatctactcttga

SEQ ID NO: 24768 - DNA, 36 bp, Artificial Sequence
  Synthetic oligonucleotide
gccgaggggggtggaaggagcatgaaggagggttga

SEQ ID NO: 24769 - DNA, 36 bp, Artificial Sequence
  Synthetic oligonucleotide
tcccacggtacaaatctcgtcccacaggacatccta

SEQ ID NO: 24770 - DNA, 36 bp, Artificial Sequence
  Synthetic oligonucleotide
aatgtcgcactcacttgttctaacgcccccacgtta

SEQ ID NO: 24771 - DNA, 35 bp, Artificial Sequence
  Synthetic oligonucleotide
gtgacctgaccccatattgacttgttgcttaccgc

SEQ ID NO: 24772 - DNA, 35 bp, Artificial Sequence
  Synthetic oligonucleotide
gagcaggtgcgggtagtggaggagggtagtaggag

SEQ ID NO: 24773 - DNA, 35 bp, Artificial Sequence
  Synthetic oligonucleotide
tcctgcaccccctccttgttgagcccctcctctcg

SEQ ID NO: 24774 - DNA, 35 bp, Artificial Sequence
  Synthetic oligonucleotide
aatgctgaaacgggggggacgggaattattgaggg

SEQ ID NO: 24775 - DNA, 35 bp, Artificial Sequence
  Synthetic oligonucleotide
aacagtgacctggcccttgttccttagtttgtcct

SEQ ID NO: 24776 - DNA, 35 bp, Artificial Sequence
  Synthetic oligonucleotide
tcacatcctcattcccgtgtgtcgttactccctgt

SEQ ID NO: 24777 - DNA, 36 bp, Artificial Sequence
  Synthetic oligonucleotide
acacaaccgcttcggctttgctacttaacaggcaaa

SEQ ID NO: 24778 - DNA, 38 bp, Artificial Sequence
  Synthetic oligonucleotide
tcagcgccggatcccctattcctgcccgttgtttgtga

SEQ ID NO: 24779 - DNA, 37 bp, Artificial Sequence
  Synthetic oligonucleotide
gccacccccaacccacccagctcctgttgccatttga

SEQ ID NO: 24780 - DNA, 35 bp, Artificial Sequence
  Synthetic oligonucleotide
tgcacacacaatgcttgacagtccctgcaccccac

SEQ ID NO: 24781 - DNA, 35 bp, Artificial Sequence
  Synthetic oligonucleotide
ttcgccgatatccaacgctttttgcactcctcagc

SEQ ID NO: 24782 - DNA, 35 bp, Artificial Sequence
  Synthetic oligonucleotide
gcaactctccatcgatcgcctaacccggcgcttgc

SEQ ID NO: 24783 - DNA, 35 bp, Artificial Sequence
  Synthetic oligonucleotide
tgccacctaagcactgttcattcatttgcgcttgc

SEQ ID NO: 24784 - DNA, 35 bp, Artificial Sequence
  Synthetic oligonucleotide
ttcaccccgctgccgtatatccacgcaaacctggg

SEQ ID NO: 24785 - DNA, 35 bp, Artificial Sequence
  Synthetic oligonucleotide
tgagcaacccccctgatcgagtcacatacaagcct

SEQ ID NO: 24786 - DNA, 35 bp, Artificial Sequence
  Synthetic oligonucleotide
gacctcccaaatatccccagctcccaagctgtgca

SEQ ID NO: 24787 - DNA, 35 bp, Artificial Sequence
  Synthetic oligonucleotide
gccccgtcccgaccctacacctctgagggatctca

SEQ ID NO: 24788 - DNA, 37 bp, Artificial Sequence
  Synthetic oligonucleotide
accgcctgccaccccgatcctccccgtcatgcatcga

SEQ ID NO: 24789 - DNA, 35 bp, Artificial Sequence
  Synthetic oligonucleotide
tccgaaacccaatcatcctggctcaccagccggga

SEQ ID NO: 24790 - DNA, 38 bp, Artificial Sequence
  Synthetic oligonucleotide
accgttaccgcccagtttatgcatgaatcttctactga

SEQ ID NO: 24791 - DNA, 37 bp, Artificial Sequence
  Synthetic oligonucleotide
tagacaagccaccgcacccgtattttgcaccacctga

SEQ ID NO: 24792 - DNA, 38 bp, Artificial Sequence
  Synthetic oligonucleotide
actccgctccctggcctcccgactcagtttccctctga

SEQ ID NO: 24793 - DNA, 38 bp, Artificial Sequence
  Synthetic oligonucleotide
gagggaggcggagttgggctagcggaggtgggtggtga

SEQ ID NO: 24794 - DNA, 34 bp, Artificial Sequence
  Synthetic oligonucleotide
gcatccgggcagtctcctttctacctttcttacc

SEQ ID NO: 24795 - DNA, 35 bp, Artificial Sequence
  Synthetic oligonucleotide
taacaccatcgcatcgtagagggccatgccatccg

SEQ ID NO: 24796 - DNA, 35 bp, Artificial Sequence
  Synthetic oligonucleotide
atctcagcagtacgcatcccccacgacaccaaatg

SEQ ID NO: 24797 - DNA, 35 bp, Artificial Sequence
  Synthetic oligonucleotide
gctgagctcatgtttaggccccagctcccccctat

SEQ ID NO: 24798 - DNA, 37 bp, Artificial Sequence
  Synthetic oligonucleotide
taacccccatcgatctgcctgacccaggtccgtacga

SEQ ID NO: 24799 - DNA, 35 bp, Artificial Sequence
  Synthetic oligonucleotide
tcacgagtccgcctgtcaacatcatccgtttccga

SEQ ID NO: 24800 - DNA, 38 bp, Artificial Sequence
  Synthetic oligonucleotide
tacagcctgagtgggcggaaaagggggcgttgaaatga

SEQ ID NO: 24801 - DNA, 35 bp, Artificial Sequence
  Synthetic oligonucleotide
gaaaacaaccctcaccgatgctcatcaggctttta

SEQ ID NO: 24802 - DNA, 35 bp, Artificial Sequence
  Synthetic oligonucleotide
tacatctcagctgcatacgtaactgaacttctgcc

SEQ ID NO: 24803 - DNA, 35 bp, Artificial Sequence
  Synthetic oligonucleotide
tgccggaaaatcggcccggctcccgccctccatgc

SEQ ID NO: 24804 - DNA, 35 bp, Artificial Sequence
  Synthetic oligonucleotide
tgcgacctccctcacaattgacacgatcatattag

SEQ ID NO: 24805 - DNA, 35 bp, Artificial Sequence
  Synthetic oligonucleotide
accatgcacacttattttttgggactctatcttcg

SEQ ID NO: 24806 - DNA, 35 bp, Artificial Sequence
  Synthetic oligonucleotide
tgaatgaggaagggaatgaggctggaatttaatgg

SEQ ID NO: 24807 - DNA, 35 bp, Artificial Sequence
  Synthetic oligonucleotide
tcctgcggctcgcccgactgccaccgtaccacaat

SEQ ID NO: 24808 - DNA, 35 bp, Artificial Sequence
  Synthetic oligonucleotide
gaacaacatatgtcgcatgatcgcgtggcacccct

SEQ ID NO: 24809 - DNA, 35 bp, Artificial Sequence
  Synthetic oligonucleotide
tgacgcccgtcgcttcccgcctcggtctattcgtt

SEQ ID NO: 24810 - DNA, 36 bp, Artificial Sequence
  Synthetic oligonucleotide
gggaagggtggtggaaggagaagtattggggggtaa

SEQ ID NO: 24811 - DNA, 37 bp, Artificial Sequence
  Synthetic oligonucleotide
gatacgaaggggaaacgtaaggaagtaaatgggcaga

SEQ ID NO: 24812 - DNA, 35 bp, Artificial Sequence
  Synthetic oligonucleotide
gtccacccaacttgtcacttatgtcatcggtccga

SEQ ID NO: 24813 - DNA, 37 bp, Artificial Sequence
  Synthetic oligonucleotide
tcccgacatgccacatctttatccccaccgtatcgga

SEQ ID NO: 24814 - DNA, 38 bp, Artificial Sequence
  Synthetic oligonucleotide
gactccccatccttgacttacagacgcaattaacctga

SEQ ID NO: 24815 - DNA, 38 bp, Artificial Sequence
  Synthetic oligonucleotide
tagtttgggggaggtgggaggggtgcggtataagctga

SEQ ID NO: 24816 - DNA, 35 bp, Artificial Sequence
  Synthetic oligonucleotide
agtcacctgtcgaatgtaccacgtcttcccgctac

SEQ ID NO: 24817 - DNA, 35 bp, Artificial Sequence
  Synthetic oligonucleotide
accaagggggtgggtacaaagccgttatgggaagg

SEQ ID NO: 24818 - DNA, 35 bp, Artificial Sequence
  Synthetic oligonucleotide
acccggtgcgccaggtcgctctccgtcatccccct

SEQ ID NO: 24819 - DNA, 35 bp, Artificial Sequence
  Synthetic oligonucleotide
tgcggagcaatcggtgcgtctcctggttacctgct

SEQ ID NO: 24820 - DNA, 36 bp, Artificial Sequence
  Synthetic oligonucleotide
gtgatgcgagggggactaattaggggcgggacagga

SEQ ID NO: 24821 - DNA, 36 bp, Artificial Sequence
  Synthetic oligonucleotide
aacagccatgccaaaggtttcccacccgccgttcta

SEQ ID NO: 24822 - DNA, 35 bp, Artificial Sequence
  Synthetic oligonucleotide
gatcagcgctcggatataactcacctgccacttac

SEQ ID NO: 24823 - DNA, 35 bp, Artificial Sequence
  Synthetic oligonucleotide
gtgagtcgtacgagctcaccgcctatcttggttac

SEQ ID NO: 24824 - DNA, 35 bp, Artificial Sequence
  Synthetic oligonucleotide
gttacgcctcgcatgtaactcgattaccgtttacc

SEQ ID NO: 24825 - DNA, 34 bp, Artificial Sequence
  Synthetic oligonucleotide
gactccattgatgatgcccgcattcatgcccccc

SEQ ID NO: 24826 - DNA, 35 bp, Artificial Sequence
  Synthetic oligonucleotide
tgcaaaccctgctccccacgcccataacttactcc

SEQ ID NO: 24827 - DNA, 35 bp, Artificial Sequence
  Synthetic oligonucleotide
tttcacgcacctcttttctggtactcctcccaggc

SEQ ID NO: 24828 - DNA, 33 bp, Artificial Sequence
  Synthetic oligonucleotide
ttagtccaccccgcaccgcagccatcctagggc

SEQ ID NO: 24829 - DNA, 35 bp, Artificial Sequence
  Synthetic oligonucleotide
tagaacactttgcccagtgtccttttcattcctgc

SEQ ID NO: 24830 - DNA, 35 bp, Artificial Sequence
  Synthetic oligonucleotide
acactcccgccactgctagataatattcgttagtc

SEQ ID NO: 24831 - DNA, 35 bp, Artificial Sequence
  Synthetic oligonucleotide
tgcgcctttcttacactgtccgtttttgccacccg

SEQ ID NO: 24832 - DNA, 35 bp, Artificial Sequence
  Synthetic oligonucleotide
gttgcctcttatctctactctagcggttccacccg

SEQ ID NO: 24833 - DNA, 35 bp, Artificial Sequence
  Synthetic oligonucleotide
atgaacccatcgccgctgcatgccctgcttcctat

SEQ ID NO: 24834 - DNA, 36 bp, Artificial Sequence
  Synthetic oligonucleotide
gccacgagagccggcacactagctccttcatcccca

SEQ ID NO: 24835 - DNA, 37 bp, Artificial Sequence
  Synthetic oligonucleotide
agcacccactcactccctcacatttggttgtagacga

SEQ ID NO: 24836 - DNA, 38 bp, Artificial Sequence
  Synthetic oligonucleotide
acaccgaaggccctctcatgcacaagacaccctgatga

SEQ ID NO: 24837 - DNA, 38 bp, Artificial Sequence
  Synthetic oligonucleotide
gccccgccgatctatacttcgtcagaacatcccactga

SEQ ID NO: 24838 - DNA, 38 bp, Artificial Sequence
  Synthetic oligonucleotide
gtgtacagtcatataggagtggcgggggatagtagtga

SEQ ID NO: 24839 - DNA, 36 bp, Artificial Sequence
  Synthetic oligonucleotide
gcacacactgtgcctggtttccaatccttagttcta

SEQ ID NO: 24840 - DNA, 35 bp, Artificial Sequence
  Synthetic oligonucleotide
aagtgagcttcacatcccgttttcacgccgctgtc

SEQ ID NO: 24841 - DNA, 35 bp, Artificial Sequence
  Synthetic oligonucleotide
aaacgctgccccgggcatttactaaccacagttat

SEQ ID NO: 24842 - DNA, 35 bp, Artificial Sequence
  Synthetic oligonucleotide
gtcactctatggcattcgctggccaacactatgct

SEQ ID NO: 24843 - DNA, 35 bp, Artificial Sequence
  Synthetic oligonucleotide
taaccacccgacgaaccgtgactgaacttggtaca

SEQ ID NO: 24844 - DNA, 35 bp, Artificial Sequence
  Synthetic oligonucleotide
tctgcacccgatatcaccacgccgaatactttgca

SEQ ID NO: 24845 - DNA, 38 bp, Artificial Sequence
  Synthetic oligonucleotide
gaccaggggtgcagggcagggaacaactgggctggtga

SEQ ID NO: 24846 - DNA, 38 bp, Artificial Sequence
  Synthetic oligonucleotide
gccaccccacagcccttgcatgcgaccacatatattga

SEQ ID NO: 24847 - DNA, 35 bp, Artificial Sequence
  Synthetic oligonucleotide
tgctacgccccgacgacccgctgaccttcgtaaac

SEQ ID NO: 24848 - DNA, 35 bp, Artificial Sequence
  Synthetic oligonucleotide
tgtatcccacgtcgtccagcgctcgtcctcttgac

SEQ ID NO: 24849 - DNA, 35 bp, Artificial Sequence
  Synthetic oligonucleotide
tccctgactccctgtgctcgatatctactgcgacc

SEQ ID NO: 24850 - DNA, 35 bp, Artificial Sequence
  Synthetic oligonucleotide
taactaacctttgcgcgtactgacacctgcgttcc

SEQ ID NO: 24851 - DNA, 35 bp, Artificial Sequence
  Synthetic oligonucleotide
tcacttcccgctctttctgctggacactgttttgc

SEQ ID NO: 24852 - DNA, 35 bp, Artificial Sequence
  Synthetic oligonucleotide
gccacatcattagccctggacgactactaccggtc

SEQ ID NO: 24853 - DNA, 35 bp, Artificial Sequence
  Synthetic oligonucleotide
tcacgacaccgcattattcttcctgcctgtcctcg

SEQ ID NO: 24854 - DNA, 36 bp, Artificial Sequence
  Synthetic oligonucleotide
accacccacccggatcagggctccactccggtaaca

SEQ ID NO: 24855 - DNA, 31 bp, Artificial Sequence
  Synthetic oligonucleotide
tcaccgttggcactcccagcccccccaccga

SEQ ID NO: 24856 - DNA, 32 bp, Artificial Sequence
  Synthetic oligonucleotide
gagggaaggtaggaggttagttgagtggggga

SEQ ID NO: 24857 - DNA, 37 bp, Artificial Sequence
  Synthetic oligonucleotide
gatgcacccatgcggtgcttgataatgattttcctga

SEQ ID NO: 24858 - DNA, 37 bp, Artificial Sequence
  Synthetic oligonucleotide
ggagctagaagcggaggggaaggggggtgacctgtga

SEQ ID NO: 24859 - DNA, 38 bp, Artificial Sequence
  Synthetic oligonucleotide
aacaccccggctgccttccctttgatctggttgcttga

SEQ ID NO: 24860 - DNA, 35 bp, Artificial Sequence
  Synthetic oligonucleotide
acttgacccctcttgttctgtaacctatcgttgtc

SEQ ID NO: 24861 - DNA, 35 bp, Artificial Sequence
  Synthetic oligonucleotide
aacaacatatcccacgagaccacagcgccctccgt

SEQ ID NO: 24862 - DNA, 35 bp, Artificial Sequence
  Synthetic oligonucleotide
gcactaccatagctattagtcctactctggccttt

SEQ ID NO: 24863 - DNA, 36 bp, Artificial Sequence
  Synthetic oligonucleotide
gtacccacaccttacacttcgctgtctcatattgaa

SEQ ID NO: 24864 - DNA, 35 bp, Artificial Sequence
  Synthetic oligonucleotide
ggcccatcgccactctttacctctgctgtaacgca

SEQ ID NO: 24865 - DNA, 36 bp, Artificial Sequence
  Synthetic oligonucleotide
accgacagggtctgggggaggaaatgctacgggtca

SEQ ID NO: 24866 - DNA, 37 bp, Artificial Sequence
  Synthetic oligonucleotide
taccccgccattcttttatgtccactcgaccactaga

SEQ ID NO: 24867 - DNA, 36 bp, Artificial Sequence
  Synthetic oligonucleotide
gaacacggaaatgcaaggggggtgtgagctgtagga

SEQ ID NO: 24868 - DNA, 37 bp, Artificial Sequence
  Synthetic oligonucleotide
tgaatcgccgcacgatctgaactcttccttaacctga

SEQ ID NO: 24869 - DNA, 35 bp, Artificial Sequence
  Synthetic oligonucleotide
tcccccgggtcgacgctacgaagacccttcatacc

SEQ ID NO: 24870 - DNA, 35 bp, Artificial Sequence
  Synthetic oligonucleotide
gtgcccgccctcacttaatccacgacctgtatggc

SEQ ID NO: 24871 - DNA, 35 bp, Artificial Sequence
  Synthetic oligonucleotide
tcccgctccgagttctatcaccgttacacttcgtc

SEQ ID NO: 24872 - DNA, 35 bp, Artificial Sequence
  Synthetic oligonucleotide
ttagcaggaagggcaatgcagtgacggggggggcg

SEQ ID NO: 24873 - DNA, 35 bp, Artificial Sequence
  Synthetic oligonucleotide
gacaccaaccaatggtacgcaaccttgctgaatcg

SEQ ID NO: 24874 - DNA, 35 bp, Artificial Sequence
  Synthetic oligonucleotide
actaccgtcaagtttttcacccccctgttcctcgg

SEQ ID NO: 24875 - DNA, 35 bp, Artificial Sequence
  Synthetic oligonucleotide
acatccgttacgacgccctcgaagtgcctccacat

SEQ ID NO: 24876 - DNA, 35 bp, Artificial Sequence
  Synthetic oligonucleotide
ttggggcacttgtgaaaacagcctccaccctcttt

SEQ ID NO: 24877 - DNA, 37 bp, Artificial Sequence
  Synthetic oligonucleotide
gatgtgtcggtgggaaagaaagagggactcgatggga

SEQ ID NO: 24878 - DNA, 37 bp, Artificial Sequence
  Synthetic oligonucleotide
tgtgcgacgtgtggggtaggggggggtgatgtatgga

SEQ ID NO: 24879 - DNA, 36 bp, Artificial Sequence
  Synthetic oligonucleotide
gccaactcctcgcttgatcccatatgatccctctga

SEQ ID NO: 24880 - DNA, 36 bp, Artificial Sequence
  Synthetic oligonucleotide
acaacgcgcgtcactatctcatcatagtgccttgta

SEQ ID NO: 24881 - DNA, 35 bp, Artificial Sequence
  Synthetic oligonucleotide
atgttcttgcgcctccaccctgtcctgatgcccac

SEQ ID NO: 24882 - DNA, 35 bp, Artificial Sequence
  Synthetic oligonucleotide
atcgggcatgggctcaatcctgttccgcatcatac

SEQ ID NO: 24883 - DNA, 35 bp, Artificial Sequence
  Synthetic oligonucleotide
accgcctctactgaatacaccacggatcctatcgc

SEQ ID NO: 24884 - DNA, 35 bp, Artificial Sequence
  Synthetic oligonucleotide
tacgatagtccgttcccaccgtcataatccgcctc

SEQ ID NO: 24885 - DNA, 36 bp, Artificial Sequence
  Synthetic oligonucleotide
agcaatcacccgcctggaccctctttatcgccgtaa

SEQ ID NO: 24886 - DNA, 35 bp, Artificial Sequence
  Synthetic oligonucleotide
tccgaccggtcttgaaacgctcctcccggtattaa

SEQ ID NO: 24887 - DNA, 35 bp, Artificial Sequence
  Synthetic oligonucleotide
acaacaggaaaggcttaggaagggaaaacaaggga

SEQ ID NO: 24888 - DNA, 38 bp, Artificial Sequence
  Synthetic oligonucleotide
tgttagcccactgctttccgaacgccttcttgctatga

SEQ ID NO: 24889 - DNA, 38 bp, Artificial Sequence
  Synthetic oligonucleotide
gtagcccctcccgttattagcccatcccgctaccctga

SEQ ID NO: 24890 - DNA, 38 bp, Artificial Sequence
  Synthetic oligonucleotide
aagccacgcccaacgatgtctcttcctctctttgctga

SEQ ID NO: 24891 - DNA, 36 bp, Artificial Sequence
  Synthetic oligonucleotide
gcacaaacaggtggaaaagggttacagagagtgtga

SEQ ID NO: 24892 - DNA, 36 bp, Artificial Sequence
  Synthetic oligonucleotide
atcactgcaggcgccgccgctagtctctttccctta

SEQ ID NO: 24893 - DNA, 35 bp, Artificial Sequence
  Synthetic oligonucleotide
aagccctgccacccttagcatagtttttcgtctta

SEQ ID NO: 24894 - DNA, 35 bp, Artificial Sequence
  Synthetic oligonucleotide
tctggcccggaatagccaccgccataactgcctcc

SEQ ID NO: 24895 - DNA, 35 bp, Artificial Sequence
  Synthetic oligonucleotide
tcgtactccgaccgctgctgtgctcaaccgctttc

SEQ ID NO: 24896 - DNA, 35 bp, Artificial Sequence
  Synthetic oligonucleotide
actcgccgcatacacaggtcccaggcttttttttt

SEQ ID NO: 24897 - DNA, 35 bp, Artificial Sequence
  Synthetic oligonucleotide
aatggagtgtagaagggcgaatgggaaacaataga

SEQ ID NO: 24898 - DNA, 35 bp, Artificial Sequence
  Synthetic oligonucleotide
gttgcgggctctctcttcagcacctctttcctaga

SEQ ID NO: 24899 - DNA, 36 bp, Artificial Sequence
  Synthetic oligonucleotide
tccacgtactttgtgcgcattactcaccctttccga

SEQ ID NO: 24900 - DNA, 37 bp, Artificial Sequence
  Synthetic oligonucleotide
tccgatcaagccgccaatacttattgctctccatgga

SEQ ID NO: 24901 - DNA, 38 bp, Artificial Sequence
  Synthetic oligonucleotide
ggtgggagggtgagggtgcgcaggcacgagttgactga

SEQ ID NO: 24902 - DNA, 35 bp, Artificial Sequence
  Synthetic oligonucleotide
atcgtcagacccctgcccttttccatactcttcac

SEQ ID NO: 24903 - DNA, 35 bp, Artificial Sequence
  Synthetic oligonucleotide
gctaccccattccgtcggtatataaaccgcgcccc

SEQ ID NO: 24904 - DNA, 35 bp, Artificial Sequence
  Synthetic oligonucleotide
agaacgcaccggttcgtcgcccaaacccccttggc

SEQ ID NO: 24905 - DNA, 35 bp, Artificial Sequence
  Synthetic oligonucleotide
tgccgccttctgcacgtcccccacatcaaacatgg

SEQ ID NO: 24906 - DNA, 35 bp, Artificial Sequence
  Synthetic oligonucleotide
acctgacgcccattccgttgatcatcagaataact

SEQ ID NO: 24907 - DNA, 35 bp, Artificial Sequence
  Synthetic oligonucleotide
tcctcacttccaagtgcctgtaccctcctagctgt

SEQ ID NO: 24908 - DNA, 35 bp, Artificial Sequence
  Synthetic oligonucleotide
gatccgcttgccccatcgcgatactgtctacgttt

SEQ ID NO: 24909 - DNA, 35 bp, Artificial Sequence
  Synthetic oligonucleotide
gtgcgtttctgctgcttttacgtcgtcactctcca

SEQ ID NO: 24910 - DNA, 36 bp, Artificial Sequence
  Synthetic oligonucleotide
aatcagacagcccctgcacgccaatcgatctgcgca

SEQ ID NO: 24911 - DNA, 37 bp, Artificial Sequence
  Synthetic oligonucleotide
gcacaccctatttgccgacgtgacctgttcggttcga

SEQ ID NO: 24912 - DNA, 36 bp, Artificial Sequence
  Synthetic oligonucleotide
tactggggcccggataggtggtggataggggaagga

SEQ ID NO: 24913 - DNA, 35 bp, Artificial Sequence
  Synthetic oligonucleotide
tcccccccgaactacattattcgtacgtccacgga

SEQ ID NO: 24914 - DNA, 38 bp, Artificial Sequence
  Synthetic oligonucleotide
atcggagggcagggaagggatattggccgggatgatga

SEQ ID NO: 24915 - DNA, 38 bp, Artificial Sequence
  Synthetic oligonucleotide
gcctccgccctacaaactatccgactgtcttttggtga

SEQ ID NO: 24916 - DNA, 38 bp, Artificial Sequence
  Synthetic oligonucleotide
tacatcctccatcatcgtgtcagtaacaccggccttga

SEQ ID NO: 24917 - DNA, 38 bp, Artificial Sequence
  Synthetic oligonucleotide
acccacgcctccattatgcaaaccatcgtagtgcttga

SEQ ID NO: 24918 - DNA, 35 bp, Artificial Sequence
  Synthetic oligonucleotide
tatcatgccccctctcaccgtaatggtcctggtac

SEQ ID NO: 24919 - DNA, 35 bp, Artificial Sequence
  Synthetic oligonucleotide
tccatcctgtagtaaatgtatcgaatctgccgccc

SEQ ID NO: 24920 - DNA, 35 bp, Artificial Sequence
  Synthetic oligonucleotide
gacccctccacggttacttgattcctgccatacgc

SEQ ID NO: 24921 - DNA, 35 bp, Artificial Sequence
  Synthetic oligonucleotide
tacccacacatctgccttcctccgtcgtggatttc

SEQ ID NO: 24922 - DNA, 35 bp, Artificial Sequence
  Synthetic oligonucleotide
atcgtagcaccacacatttattcacggtttgtttc

SEQ ID NO: 24923 - DNA, 35 bp, Artificial Sequence
  Synthetic oligonucleotide
acatcgcgcaggtcgccttcaccttagaatcccgg

SEQ ID NO: 24924 - DNA, 35 bp, Artificial Sequence
  Synthetic oligonucleotide
atgtggagattgagtggtgaaggcgggaggtaggg

SEQ ID NO: 24925 - DNA, 35 bp, Artificial Sequence
  Synthetic oligonucleotide
tgatttccctctcggtggtttcgtactcggttatt

SEQ ID NO: 24926 - DNA, 36 bp, Artificial Sequence
  Synthetic oligonucleotide
gagaggggggcctgtgggtaccaaggggtgagagaa

SEQ ID NO: 24927 - DNA, 36 bp, Artificial Sequence
  Synthetic oligonucleotide
tacattccgactaaccttcataagtgccgcccccca

SEQ ID NO: 24928 - DNA, 35 bp, Artificial Sequence
  Synthetic oligonucleotide
gattgcccacatcgaatagtccatttgccctccca

SEQ ID NO: 24929 - DNA, 36 bp, Artificial Sequence
  Synthetic oligonucleotide
gacgccaccttttccgcgagtaatcccctccgctca

SEQ ID NO: 24930 - DNA, 37 bp, Artificial Sequence
  Synthetic oligonucleotide
taccatccctctccgcgcccttggctcacgttcttga

SEQ ID NO: 24931 - DNA, 35 bp, Artificial Sequence
  Synthetic oligonucleotide
accgacggaccggtctgtctccacttttttgccta

SEQ ID NO: 24932 - DNA, 35 bp, Artificial Sequence
  Synthetic oligonucleotide
tttgccctcctgttgccccccaaattccagaatta

SEQ ID NO: 24933 - DNA, 35 bp, Artificial Sequence
  Synthetic oligonucleotide
aattgcgcacaggatccgtctacccctctcattac

SEQ ID NO: 24934 - DNA, 35 bp, Artificial Sequence
  Synthetic oligonucleotide
aatggacccacatctgccctggtaacctcttaccc

SEQ ID NO: 24935 - DNA, 32 bp, Artificial Sequence
  Synthetic oligonucleotide
aaccctcactagtcttactgcacctctgtccc

SEQ ID NO: 24936 - DNA, 35 bp, Artificial Sequence
  Synthetic oligonucleotide
gagcggcctaccatggcttgatacgtttccccgcc

SEQ ID NO: 24937 - DNA, 34 bp, Artificial Sequence
  Synthetic oligonucleotide
atgaacagtgcgtcctgccgctcatacattcttt

SEQ ID NO: 24938 - DNA, 37 bp, Artificial Sequence
  Synthetic oligonucleotide
gaacatgaggagaagttgggaacggggaatgggcaga

SEQ ID NO: 24939 - DNA, 37 bp, Artificial Sequence
  Synthetic oligonucleotide
gacaccctccatggcccctattcgcgttctttcccga

SEQ ID NO: 24940 - DNA, 36 bp, Artificial Sequence
  Synthetic oligonucleotide
aaagtgacggaggagggggaagtttgcaggccagga

SEQ ID NO: 24941 - DNA, 36 bp, Artificial Sequence
  Synthetic oligonucleotide
tgtcggagggggagcaggaacgaaagaagtgatgga

SEQ ID NO: 24942 - DNA, 35 bp, Artificial Sequence
  Synthetic oligonucleotide
gaacgctatcctaccagcagcttttggctttctcc

SEQ ID NO: 24943 - DNA, 35 bp, Artificial Sequence
  Synthetic oligonucleotide
tgctgagcacctgtctttactccaatccctgtatc

SEQ ID NO: 24944 - DNA, 35 bp, Artificial Sequence
  Synthetic oligonucleotide
gtctccgaccacgcactcatttggcccctgttaaa

SEQ ID NO: 24945 - DNA, 36 bp, Artificial Sequence
  Synthetic oligonucleotide
tgtcgtgaacgacctgtatttccctctgctaccgaa

SEQ ID NO: 24946 - DNA, 37 bp, Artificial Sequence
  Synthetic oligonucleotide
agccatccctcgcactgagccgctgtacggtccccga

SEQ ID NO: 24947 - DNA, 36 bp, Artificial Sequence
  Synthetic oligonucleotide
gatgagactgaaaacaaaggagggcgtggtgtagga

SEQ ID NO: 24948 - DNA, 38 bp, Artificial Sequence
  Synthetic oligonucleotide
atcccgtcgatcggcgctaacggtaccatcctctatga

SEQ ID NO: 24949 - DNA, 38 bp, Artificial Sequence
  Synthetic oligonucleotide
attgcatccgccatccttcactgcgaaaattctgctga

SEQ ID NO: 24950 - DNA, 37 bp, Artificial Sequence
  Synthetic oligonucleotide
tctggggtgggagggagtatatgatcgaacggggtga

SEQ ID NO: 24951 - DNA, 34 bp, Artificial Sequence
  Synthetic oligonucleotide
actgctcacgacggcacttcttgtcactgcacac

SEQ ID NO: 24952 - DNA, 35 bp, Artificial Sequence
  Synthetic oligonucleotide
gcgcacattttggtttgccccattaccccctggac

SEQ ID NO: 24953 - DNA, 35 bp, Artificial Sequence
  Synthetic oligonucleotide
tcagagccgcactttccccccatggtcagtagacc

SEQ ID NO: 24954 - DNA, 35 bp, Artificial Sequence
  Synthetic oligonucleotide
agcctccactgtaggtacaacgctttgccttgccc

SEQ ID NO: 24955 - DNA, 35 bp, Artificial Sequence
  Synthetic oligonucleotide
gttgtggggggtgagttagggattagggagcaggc

SEQ ID NO: 24956 - DNA, 35 bp, Artificial Sequence
  Synthetic oligonucleotide
atccccgagggctcaccttctttcacgatcggtgc

SEQ ID NO: 24957 - DNA, 35 bp, Artificial Sequence
  Synthetic oligonucleotide
agtgtgccatcgcctctttaactcatagcattacg

SEQ ID NO: 24958 - DNA, 35 bp, Artificial Sequence
  Synthetic oligonucleotide
tcatcctagctgtgatcctcgcctcaggctgcctt

SEQ ID NO: 24959 - DNA, 35 bp, Artificial Sequence
  Synthetic oligonucleotide
aacatcacaggcatattttgcatttagcctttaca

SEQ ID NO: 24960 - DNA, 36 bp, Artificial Sequence
  Synthetic oligonucleotide
ccctgcaacaggcactgttcacacttgcttccgcca

SEQ ID NO: 24961 - DNA, 36 bp, Artificial Sequence
  Synthetic oligonucleotide
gccataccctgtccgaatgcattgcatcatgccgca

SEQ ID NO: 24962 - DNA, 37 bp, Artificial Sequence
  Synthetic oligonucleotide
tgacattgcctcaccggccccatccatctatttgaga

SEQ ID NO: 24963 - DNA, 37 bp, Artificial Sequence
  Synthetic oligonucleotide
tcactcactcgctcgtaacacactgcatggaactgga

SEQ ID NO: 24964 - DNA, 36 bp, Artificial Sequence
  Synthetic oligonucleotide
gccgccggaccactttgccaccgttgccttgtaata

SEQ ID NO: 24965 - DNA, 36 bp, Artificial Sequence
  Synthetic oligonucleotide
aatgctcacctctctgtccgacctccttgcttagta

SEQ ID NO: 24966 - DNA, 35 bp, Artificial Sequence
  Synthetic oligonucleotide
tccagtcagccagttgtccatcacgtcgattcccc

SEQ ID NO: 24967 - DNA, 35 bp, Artificial Sequence
  Synthetic oligonucleotide
aacccacgccaactaaattgctccttggaagtgcc

SEQ ID NO: 24968 - DNA, 35 bp, Artificial Sequence
  Synthetic oligonucleotide
atgcgcatttttccgccccactgtggtgctcatcc

SEQ ID NO: 24969 - DNA, 35 bp, Artificial Sequence
  Synthetic oligonucleotide
gacgaacggacgtgggggccgtgagtggttttgtc

SEQ ID NO: 24970 - DNA, 35 bp, Artificial Sequence
  Synthetic oligonucleotide
tgcaagaaccgcaaatgcaccctccacctcccggg

SEQ ID NO: 24971 - DNA, 35 bp, Artificial Sequence
  Synthetic oligonucleotide
tcaccacacgacggtctcccaacaaaggatcatgg

SEQ ID NO: 24972 - DNA, 35 bp, Artificial Sequence
  Synthetic oligonucleotide
gccgttctggcccgtattactccacctatatgcct

SEQ ID NO: 24973 - DNA, 35 bp, Artificial Sequence
  Synthetic oligonucleotide
tactatcccaccgtcacagtcgcgcttttaaaatt

SEQ ID NO: 24974 - DNA, 35 bp, Artificial Sequence
  Synthetic oligonucleotide
gatgttgccactttccgcgccaccgcactcacttt

SEQ ID NO: 24975 - DNA, 35 bp, Artificial Sequence
  Synthetic oligonucleotide
gtatccccgccgtgccgtcccagccaaaatcgaaa

SEQ ID NO: 24976 - DNA, 35 bp, Artificial Sequence
  Synthetic oligonucleotide
gatgtcctctcgccccccacatactcgacggttaa

SEQ ID NO: 24977 - DNA, 35 bp, Artificial Sequence
  Synthetic oligonucleotide
aatgctccacatttgttcccatcctttgcccgaca

SEQ ID NO: 24978 - DNA, 36 bp, Artificial Sequence
  Synthetic oligonucleotide
tccggtcgcacgtcctgccctgactttaatccttca

SEQ ID NO: 24979 - DNA, 37 bp, Artificial Sequence
  Synthetic oligonucleotide
tcacacgtcgggggtcgttcaacgggagggtgggaga

SEQ ID NO: 24980 - DNA, 37 bp, Artificial Sequence
  Synthetic oligonucleotide
tgccgcccccccactggcatacaggtgccttgaccga

SEQ ID NO: 24981 - DNA, 35 bp, Artificial Sequence
  Synthetic oligonucleotide
taacaacagtgaacgggggatgacaaaagggggga

SEQ ID NO: 24982 - DNA, 38 bp, Artificial Sequence
  Synthetic oligonucleotide
taccacgccacctaatagtgctttagtctcgcacctga

SEQ ID NO: 24983 - DNA, 38 bp, Artificial Sequence
  Synthetic oligonucleotide
ttgtgctccgtgctatcatctctgctgacccttgctga

SEQ ID NO: 24984 - DNA, 38 bp, Artificial Sequence
  Synthetic oligonucleotide
tgttggggaggcctgggggggtcaacggacgggggtga

SEQ ID NO: 24985 - DNA, 35 bp, Artificial Sequence
  Synthetic oligonucleotide
gtccacattcatgctgcccttgggtctctacacta

SEQ ID NO: 24986 - DNA, 36 bp, Artificial Sequence
  Synthetic oligonucleotide
tcccccgacttgaatcgacccactcggatctccgta

SEQ ID NO: 24987 - DNA, 35 bp, Artificial Sequence
  Synthetic oligonucleotide
tcgacgtcccgatctcctctggtcgttcactcttc

SEQ ID NO: 24988 - DNA, 35 bp, Artificial Sequence
  Synthetic oligonucleotide
taaagcaacccgtaggtattatccatgtttccctg

SEQ ID NO: 24989 - DNA, 35 bp, Artificial Sequence
  Synthetic oligonucleotide
acgctggcacactggggtcttctttaatgcctact

SEQ ID NO: 24990 - DNA, 35 bp, Artificial Sequence
  Synthetic oligonucleotide
agcgaagcgaggctgcaccattttcgtaacacctt

SEQ ID NO: 24991 - DNA, 35 bp, Artificial Sequence
  Synthetic oligonucleotide
tctgtgcccctctggacttggctccatctacgttt

SEQ ID NO: 24992 - DNA, 36 bp, Artificial Sequence
  Synthetic oligonucleotide
tgctacactatgtccccgttattcgccctcgccgaa

SEQ ID NO: 24993 - DNA, 36 bp, Artificial Sequence
  Synthetic oligonucleotide
ttctgtgtcgcggggggaagggggggcggatactaa

SEQ ID NO: 24994 - DNA, 36 bp, Artificial Sequence
  Synthetic oligonucleotide
gcaacgttgacccgcctccgtagccctatacggcca

SEQ ID NO: 24995 - DNA, 37 bp, Artificial Sequence
  Synthetic oligonucleotide
gataccgcaccccatggccatagagacccccgtccga

SEQ ID NO: 24996 - DNA, 38 bp, Artificial Sequence
  Synthetic oligonucleotide
tacaggaaaggaggagggatggaacgtgtggctaatga

SEQ ID NO: 24997 - DNA, 37 bp, Artificial Sequence
  Synthetic oligonucleotide
tacatctgttgctgatctccccctgtcgtatgactga

SEQ ID NO: 24998 - DNA, 36 bp, Artificial Sequence
  Synthetic oligonucleotide
gcaccctcaagctgtccgccacccatgcctgcgcta

SEQ ID NO: 24999 - DNA, 36 bp, Artificial Sequence
  Synthetic oligonucleotide
gcccacataccagcaattgctagcctcgtacctcta

SEQ ID NO: 25000 - DNA, 35 bp, Artificial Sequence
  Synthetic oligonucleotide
gcccccttcatggctcttggtacatgcgaatccac

SEQ ID NO: 25001 - DNA, 35 bp, Artificial Sequence
  Synthetic oligonucleotide
gtatccaccgttccatttatcacgtagggcgtacc

SEQ ID NO: 25002 - DNA, 35 bp, Artificial Sequence
  Synthetic oligonucleotide
aaaacaccaggcacgattgttacaccccacttctc

SEQ ID NO: 25003 - DNA, 35 bp, Artificial Sequence
  Synthetic oligonucleotide
ttcgcgcaccacccccattggctctaatactacag

SEQ ID NO: 25004 - DNA, 35 bp, Artificial Sequence
  Synthetic oligonucleotide
tgtgggtaaacggtaggggggatggggcggttcgg

SEQ ID NO: 25005 - DNA, 34 bp, Artificial Sequence
  Synthetic oligonucleotide
ttagtacgcccacatcgtcctaatcctaaacttt

SEQ ID NO: 25006 - DNA, 36 bp, Artificial Sequence
  Synthetic oligonucleotide
aaacccctcccgtcagtcacgccctgttctttgtaa

SEQ ID NO: 25007 - DNA, 37 bp, Artificial Sequence
  Synthetic oligonucleotide
tatgccgtgggcatctgtccttactccctcgattaga

SEQ ID NO: 25008 - DNA, 38 bp, Artificial Sequence
  Synthetic oligonucleotide
atacagcccgctgacaccacaccgatactagtccctga

SEQ ID NO: 25009 - DNA, 36 bp, Artificial Sequence
  Synthetic oligonucleotide
gcacactttggctcaaacaccctggtaccttcctga

SEQ ID NO: 25010 - DNA, 36 bp, Artificial Sequence
  Synthetic oligonucleotide
tagttctgcgccccccacctgtaatgtttgtcccta

SEQ ID NO: 25011 - DNA, 35 bp, Artificial Sequence
  Synthetic oligonucleotide
gtcactcagagcttgccgacgattttctgctaccc

SEQ ID NO: 25012 - DNA, 35 bp, Artificial Sequence
  Synthetic oligonucleotide
atccgggcggttctctgccgagattattttttgcc

SEQ ID NO: 25013 - DNA, 36 bp, Artificial Sequence
  Synthetic oligonucleotide
ttgtacgccgactcattgccgcttctttcccgtcca

SEQ ID NO: 25014 - DNA, 37 bp, Artificial Sequence
  Synthetic oligonucleotide
tcgaggtcgagcgagggagaagggcctgggggtgaga

SEQ ID NO: 25015 - DNA, 38 bp, Artificial Sequence
  Synthetic oligonucleotide
tagtcacccctcctgctacatgcgtggccttaacatga

SEQ ID NO: 25016 - DNA, 38 bp, Artificial Sequence
  Synthetic oligonucleotide
aacgcggtctggctgcctcatctaacgctttctcatga

SEQ ID NO: 25017 - DNA, 37 bp, Artificial Sequence
  Synthetic oligonucleotide
gcatccgcgacagcacctacgcccatcgctctcctga

SEQ ID NO: 25018 - DNA, 34 bp, Artificial Sequence
  Synthetic oligonucleotide
tcctttgcctcgtcatccgccgtggtctcgctcc

SEQ ID NO: 25019 - DNA, 35 bp, Artificial Sequence
  Synthetic oligonucleotide
aatgtcagccaccccaagggcgtactcttgttctc

SEQ ID NO: 25020 - DNA, 35 bp, Artificial Sequence
  Synthetic oligonucleotide
acgaccctctcaaacttgcttggattaacttgttc

SEQ ID NO: 25021 - DNA, 35 bp, Artificial Sequence
  Synthetic oligonucleotide
agactgggaaggggcgagaactagtgtgggaaggg

SEQ ID NO: 25022 - DNA, 35 bp, Artificial Sequence
  Synthetic oligonucleotide
gtctcgcacatacgcttgcaatccgtagttcctat

SEQ ID NO: 25023 - DNA, 37 bp, Artificial Sequence
  Synthetic oligonucleotide
aatgggaggccgaataaggggaacgggggactgaaga

SEQ ID NO: 25024 - DNA, 36 bp, Artificial Sequence
  Synthetic oligonucleotide
tgaggggggggggaatgggtctcaaggtgggatgga

SEQ ID NO: 25025 - DNA, 36 bp, Artificial Sequence
  Synthetic oligonucleotide
aaccccacacccaacacagaggacattattgcatga

SEQ ID NO: 25026 - DNA, 35 bp, Artificial Sequence
  Synthetic oligonucleotide
gaacgacacctacgccccaccctcgccatctatga

SEQ ID NO: 25027 - DNA, 37 bp, Artificial Sequence
  Synthetic oligonucleotide
gcgaagcgcctgcccacgattccctcctgcttactga

SEQ ID NO: 25028 - DNA, 38 bp, Artificial Sequence
  Synthetic oligonucleotide
tcagccgatcagccaacgccggcacatcaataacctga

SEQ ID NO: 25029 - DNA, 38 bp, Artificial Sequence
  Synthetic oligonucleotide
acctgccataatctcgtgcaagcccatccgcccgctga

SEQ ID NO: 25030 - DNA, 38 bp, Artificial Sequence
  Synthetic oligonucleotide
gcatctgtgaccgagcttttacatgtacctccccttga

SEQ ID NO: 25031 - DNA, 35 bp, Artificial Sequence
  Synthetic oligonucleotide
atccttcaccgaatcgccatccacagtcttgtacc

SEQ ID NO: 25032 - DNA, 35 bp, Artificial Sequence
  Synthetic oligonucleotide
gttcggtgtgccctacctttgccggtgtttatccc

SEQ ID NO: 25033 - DNA, 35 bp, Artificial Sequence
  Synthetic oligonucleotide
gatagggtccagctctacacccgcaaagtacttcc

SEQ ID NO: 25034 - DNA, 35 bp, Artificial Sequence
  Synthetic oligonucleotide
gcacctacgtcgcgaagacatcttgccccgacctc

SEQ ID NO: 25035 - DNA, 35 bp, Artificial Sequence
  Synthetic oligonucleotide
gccgaccgtgacagggatttcccccgccgtccccg

SEQ ID NO: 25036 - DNA, 35 bp, Artificial Sequence
  Synthetic oligonucleotide
gaatagcccccctccacactgtcactggtgtctcg

SEQ ID NO: 25037 - DNA, 35 bp, Artificial Sequence
  Synthetic oligonucleotide
acctcagttccgttcaatcctcagctctagcccgg

SEQ ID NO: 25038 - DNA, 35 bp, Artificial Sequence
  Synthetic oligonucleotide
ttgccagttattgtttccctttgatgccctccctg

SEQ ID NO: 25039 - DNA, 35 bp, Artificial Sequence
  Synthetic oligonucleotide
aacgtcggctacacactggggcaacttcaccctct

SEQ ID NO: 25040 - DNA, 35 bp, Artificial Sequence
  Synthetic oligonucleotide
atcccaacatccgccactacaagagcgcctttcaa

SEQ ID NO: 25041 - DNA, 37 bp, Artificial Sequence
  Synthetic oligonucleotide
tcgaacggccgacgtatcgaacctcccctctccaaga

SEQ ID NO: 25042 - DNA, 37 bp, Artificial Sequence
  Synthetic oligonucleotide
gtgtggtggtagagggtgggggtatggaggtagcaga

SEQ ID NO: 25043 - DNA, 36 bp, Artificial Sequence
  Synthetic oligonucleotide
tcacacgcgagagaaacctccgcacttcactcccga

SEQ ID NO: 25044 - DNA, 36 bp, Artificial Sequence
  Synthetic oligonucleotide
agcggccggcacttctgtccccccacacccatccga

SEQ ID NO: 25045 - DNA, 37 bp, Artificial Sequence
  Synthetic oligonucleotide
ttcccgcatcgcccctccgcgcccgcccgctatgcga

SEQ ID NO: 25046 - DNA, 36 bp, Artificial Sequence
  Synthetic oligonucleotide
gcccgccccggcgtccccaccatctcaagctttcga

SEQ ID NO: 25047 - DNA, 37 bp, Artificial Sequence
  Synthetic oligonucleotide
agtccagagcatctggcccgacaacaccacacactga

SEQ ID NO: 25048 - DNA, 37 bp, Artificial Sequence
  Synthetic oligonucleotide
tgcgtcgggcaacaggaggggaactagggttgggtga

SEQ ID NO: 25049 - DNA, 36 bp, Artificial Sequence
  Synthetic oligonucleotide
tccatgcatctcgtaggtcggctcacacaacctcta

SEQ ID NO: 25050 - DNA, 36 bp, Artificial Sequence
  Synthetic oligonucleotide
gcccagcctccaaaaagccatgcgtgcctcaattta

SEQ ID NO: 25051 - DNA, 35 bp, Artificial Sequence
  Synthetic oligonucleotide
acagccacgtatcccctactgcatctcttgttgcc

SEQ ID NO: 25052 - DNA, 35 bp, Artificial Sequence
  Synthetic oligonucleotide
gttctaccggcaaggttcctagccactcccgactc

SEQ ID NO: 25053 - DNA, 35 bp, Artificial Sequence
  Synthetic oligonucleotide
tgttcaatcaccccctcgaagtaccgacccctccg

SEQ ID NO: 25054 - DNA, 35 bp, Artificial Sequence
  Synthetic oligonucleotide
gtcgctccctgttcctgccaccctgctcagcacgg

SEQ ID NO: 25055 - DNA, 35 bp, Artificial Sequence
  Synthetic oligonucleotide
gtacgcgagtggttgtcattatactattcttcctg

SEQ ID NO: 25056 - DNA, 35 bp, Artificial Sequence
  Synthetic oligonucleotide
attggcggaaccacgcaccaccacatggcctatat

SEQ ID NO: 25057 - DNA, 35 bp, Artificial Sequence
  Synthetic oligonucleotide
gtccgactctgctgccgggattatccctcgtgcca

SEQ ID NO: 25058 - DNA, 37 bp, Artificial Sequence
  Synthetic oligonucleotide
gacaccagccaccgcccgcaccccatgttcgtgacga

SEQ ID NO: 25059 - DNA, 37 bp, Artificial Sequence
  Synthetic oligonucleotide
gaccaaccaccctgtattgtgttttctctcataccga

SEQ ID NO: 25060 - DNA, 37 bp, Artificial Sequence
  Synthetic oligonucleotide
gtgcactgtccgcccataacttcagcgtgcctttcga

SEQ ID NO: 25061 - DNA, 38 bp, Artificial Sequence
  Synthetic oligonucleotide
gccatgcacgtggtctcgcctctttttgccttctatga

SEQ ID NO: 25062 - DNA, 38 bp, Artificial Sequence
  Synthetic oligonucleotide
agagccatccaacctgtagtccatagcaactccattga

SEQ ID NO: 25063 - DNA, 38 bp, Artificial Sequence
  Synthetic oligonucleotide
attgagcatctcacggctctgtaccatccatatcttga

SEQ ID NO: 25064 - DNA, 37 bp, Artificial Sequence
  Synthetic oligonucleotide
gatcctgcccgctctatgtcctctattttgctgttga

SEQ ID NO: 25065 - DNA, 36 bp, Artificial Sequence
  Synthetic oligonucleotide
acctcgaacctgcccgctgcattgttgctttcctta

SEQ ID NO: 25066 - DNA, 35 bp, Artificial Sequence
  Synthetic oligonucleotide
ttcgattctggccctcttgtcatcgttcctgttta

SEQ ID NO: 25067 - DNA, 35 bp, Artificial Sequence
  Synthetic oligonucleotide
gtaccacctcccgctgaaaggaccatggcatttta

SEQ ID NO: 25068 - DNA, 35 bp, Artificial Sequence
  Synthetic oligonucleotide
tagtcccacgacaaggttcttcccccacccccgag

SEQ ID NO: 25069 - DNA, 35 bp, Artificial Sequence
  Synthetic oligonucleotide
gtgaagaggtgggcgtgggtcttgtacggggggag

SEQ ID NO: 25070 - DNA, 35 bp, Artificial Sequence
  Synthetic oligonucleotide
gctgcccacgctcacatatccctcatccactattg

SEQ ID NO: 25071 - DNA, 35 bp, Artificial Sequence
  Synthetic oligonucleotide
gttcagcatgccctgtcattttgccactccatctt

SEQ ID NO: 25072 - DNA, 36 bp, Artificial Sequence
  Synthetic oligonucleotide
tctgccactagccccgaccatcttcgtgtttataca

SEQ ID NO: 25073 - DNA, 36 bp, Artificial Sequence
  Synthetic oligonucleotide
acgggcatccccccactctctggttcgctggtccca

SEQ ID NO: 25074 - DNA, 36 bp, Artificial Sequence
  Synthetic oligonucleotide
gtgataagtgggtgggaatattcggactgaggagga

SEQ ID NO: 25075 - DNA, 35 bp, Artificial Sequence
  Synthetic oligonucleotide
gcgaatcggattcgcgtcctatcctgcccctgacc

SEQ ID NO: 25076 - DNA, 35 bp, Artificial Sequence
  Synthetic oligonucleotide
gtaggtgctacacctctgagccccaggctattctc

SEQ ID NO: 25077 - DNA, 35 bp, Artificial Sequence
  Synthetic oligonucleotide
atcgaagccttacctcaccgtggtgccgcccctag

SEQ ID NO: 25078 - DNA, 35 bp, Artificial Sequence
  Synthetic oligonucleotide
tagagtggacggggggcaaaaacgatatatggaaa

SEQ ID NO: 25079 - DNA, 36 bp, Artificial Sequence
  Synthetic oligonucleotide
tccggttgcccccctggcctaggatccataccatca

SEQ ID NO: 25080 - DNA, 36 bp, Artificial Sequence
  Synthetic oligonucleotide
gatgcagaatcccccttctccataacctgtctttca

SEQ ID NO: 25081 - DNA, 38 bp, Artificial Sequence
  Synthetic oligonucleotide
gtatgcgccctgaacactaccttatgacccgcacctga

SEQ ID NO: 25082 - DNA, 38 bp, Artificial Sequence
  Synthetic oligonucleotide
attgcgctccgcctctgctgaaattgccctctccttga

SEQ ID NO: 25083 - DNA, 36 bp, Artificial Sequence
  Synthetic oligonucleotide
agtgtacgccctgccaatgtcacagtttccgcccta

SEQ ID NO: 25084 - DNA, 35 bp, Artificial Sequence
  Synthetic oligonucleotide
gcccactttccgctcactatactctagatggacac

SEQ ID NO: 25085 - DNA, 35 bp, Artificial Sequence
  Synthetic oligonucleotide
gaagcgcgttcccatctgcgttttccccagcctgc

SEQ ID NO: 25086 - DNA, 35 bp, Artificial Sequence
  Synthetic oligonucleotide
ggggccgccgctcccctccgcgttatttaccagtc

SEQ ID NO: 25087 - DNA, 35 bp, Artificial Sequence
  Synthetic oligonucleotide
tgtcatccctcaagacttgatcacggtgatgccct

SEQ ID NO: 25088 - DNA, 36 bp, Artificial Sequence
  Synthetic oligonucleotide
acgccatgcatcgcatgcccacaccaccaagaaaaa

SEQ ID NO: 25089 - DNA, 36 bp, Artificial Sequence
  Synthetic oligonucleotide
atccgcggccgccagcagcatccgccaatctaccca

SEQ ID NO: 25090 - DNA, 36 bp, Artificial Sequence
  Synthetic oligonucleotide
acacctccgaacgcagccacgacacatccttacaga

SEQ ID NO: 25091 - DNA, 37 bp, Artificial Sequence
  Synthetic oligonucleotide
accctccgacactaaccaagagcccacgcgcgaacga

SEQ ID NO: 25092 - DNA, 37 bp, Artificial Sequence
  Synthetic oligonucleotide
gacgccggtcgaaggggaagatcaaaggggaaacgga

SEQ ID NO: 25093 - DNA, 37 bp, Artificial Sequence
  Synthetic oligonucleotide
aggatgcaaacgggtgatcgatggggggggattggga

SEQ ID NO: 25094 - DNA, 38 bp, Artificial Sequence
  Synthetic oligonucleotide
gtccacccatcctggtctacctgtccatctaatgctga

SEQ ID NO: 25095 - DNA, 38 bp, Artificial Sequence
  Synthetic oligonucleotide
tcagcgacccctcctccttgcgtttcttgcctgtctga

SEQ ID NO: 25096 - DNA, 38 bp, Artificial Sequence
  Synthetic oligonucleotide
ttagcaaggcataggtggggaaagggtgaatgatgtga

SEQ ID NO: 25097 - DNA, 38 bp, Artificial Sequence
  Synthetic oligonucleotide
accgccacgcttctccatttgcctgcccttccgtgtga

SEQ ID NO: 25098 - DNA, 36 bp, Artificial Sequence
  Synthetic oligonucleotide
gtgggcagttctacgggaggcggaaggggggtgtga

SEQ ID NO: 25099 - DNA, 35 bp, Artificial Sequence
  Synthetic oligonucleotide
agaacatcgggggggcaccaagggaagtcagcaac

SEQ ID NO: 25100 - DNA, 35 bp, Artificial Sequence
  Synthetic oligonucleotide
ggaattgtcagcgtaccgtcctgctccatgtccac

SEQ ID NO: 25101 - DNA, 35 bp, Artificial Sequence
  Synthetic oligonucleotide
gattatgctcccgccccgctcgacacgtggcctac

SEQ ID NO: 25102 - DNA, 35 bp, Artificial Sequence
  Synthetic oligonucleotide
tattccacacaggctggttacctccgattcgggcc

SEQ ID NO: 25103 - DNA, 35 bp, Artificial Sequence
  Synthetic oligonucleotide
tcaacgcacgaattttcccatattccacccgcatc

SEQ ID NO: 25104 - DNA, 35 bp, Artificial Sequence
  Synthetic oligonucleotide
atgctcgcggtctgacgcatcatcttctgtctatc

SEQ ID NO: 25105 - DNA, 35 bp, Artificial Sequence
  Synthetic oligonucleotide
gggaacacaggatcgtggggggggtagggctaggg

SEQ ID NO: 25106 - DNA, 35 bp, Artificial Sequence
  Synthetic oligonucleotide
gagtgacccgcccgagagatacctgcattttcctt

SEQ ID NO: 25107 - DNA, 37 bp, Artificial Sequence
  Synthetic oligonucleotide
ttcacagtggggaggtagggggacggatatgggccga

SEQ ID NO: 25108 - DNA, 37 bp, Artificial Sequence
  Synthetic oligonucleotide
atgggcgggtgggatatgcgggcatccgatgagtcga

SEQ ID NO: 25109 - DNA, 38 bp, Artificial Sequence
  Synthetic oligonucleotide
ttcccccctgtgcccagtgttcatagcccttcggctga

SEQ ID NO: 25110 - DNA, 37 bp, Artificial Sequence
  Synthetic oligonucleotide
atcgacgcgactatcctttgactcacccaccttttga

SEQ ID NO: 25111 - DNA, 36 bp, Artificial Sequence
  Synthetic oligonucleotide
gtataacgcctttgggcccaccgctctacctgagta

SEQ ID NO: 25112 - DNA, 35 bp, Artificial Sequence
  Synthetic oligonucleotide
gtcagggagtacaggcaaaggggtgggggaggtgc

SEQ ID NO: 25113 - DNA, 35 bp, Artificial Sequence
  Synthetic oligonucleotide
tatcctcctgtccacctaattgttgctcttgggtc

SEQ ID NO: 25114 - DNA, 35 bp, Artificial Sequence
  Synthetic oligonucleotide
atccgccatcacgaccagtcttgcatcttccattc

SEQ ID NO: 25115 - DNA, 35 bp, Artificial Sequence
  Synthetic oligonucleotide
acgacgtggagagggggacggaggcagtatagcag

SEQ ID NO: 25116 - DNA, 35 bp, Artificial Sequence
  Synthetic oligonucleotide
actcaaccccaaattggcctgtgccaggtaccccg

SEQ ID NO: 25117 - DNA, 35 bp, Artificial Sequence
  Synthetic oligonucleotide
ttgcctccctcacttcggcaacgcatctgctcccg

SEQ ID NO: 25118 - DNA, 35 bp, Artificial Sequence
  Synthetic oligonucleotide
tctctcagtcggccctctctttcgcatggttctat

SEQ ID NO: 25119 - DNA, 35 bp, Artificial Sequence
  Synthetic oligonucleotide
tcatcccgacacgcttctcatctaggaagggccct

SEQ ID NO: 25120 - DNA, 35 bp, Artificial Sequence
  Synthetic oligonucleotide
atacaccttcgccgagctttcttgcctcccccggt

SEQ ID NO: 25121 - DNA, 35 bp, Artificial Sequence
  Synthetic oligonucleotide
attgacacgcattgcgtacgctggctatccttctt

SEQ ID NO: 25122 - DNA, 37 bp, Artificial Sequence
  Synthetic oligonucleotide
agccccgcacgctacccagtaactgcacactcttcga

SEQ ID NO: 25123 - DNA, 38 bp, Artificial Sequence
  Synthetic oligonucleotide
gcctggctgccccactgtaatcgaatacaccttcctga

SEQ ID NO: 25124 - DNA, 35 bp, Artificial Sequence
  Synthetic oligonucleotide
gagaaagcaggtgtgggggggggcgggcaaggtac

SEQ ID NO: 25125 - DNA, 35 bp, Artificial Sequence
  Synthetic oligonucleotide
acatcagctacaatgctacgttctccctggtcgtc

SEQ ID NO: 25126 - DNA, 35 bp, Artificial Sequence
  Synthetic oligonucleotide
tccaacccatgtctgtcttctctttctcacttggg

SEQ ID NO: 25127 - DNA, 35 bp, Artificial Sequence
  Synthetic oligonucleotide
actaagccctgcccctttcttttacacgctcactg

SEQ ID NO: 25128 - DNA, 35 bp, Artificial Sequence
  Synthetic oligonucleotide
tctccccccccgtcagtgagtctctcttctcagct

SEQ ID NO: 25129 - DNA, 35 bp, Artificial Sequence
  Synthetic oligonucleotide
gtcagatgctacgtcaccatgtcccctcctcattt

SEQ ID NO: 25130 - DNA, 37 bp, Artificial Sequence
  Synthetic oligonucleotide
agagagggaaaaaggacgtgggggagaatagcgcaga

SEQ ID NO: 25131 - DNA, 38 bp, Artificial Sequence
  Synthetic oligonucleotide
ttgatccacgacacttgtagtccatccttcacccatga

SEQ ID NO: 25132 - DNA, 38 bp, Artificial Sequence
  Synthetic oligonucleotide
tgcgtactaacctctgcgtgtttctcttctatacttga

SEQ ID NO: 25133 - DNA, 35 bp, Artificial Sequence
  Synthetic oligonucleotide
gatgtagccctgctagctttctaatgaatcatcac

SEQ ID NO: 25134 - DNA, 35 bp, Artificial Sequence
  Synthetic oligonucleotide
tagccccaataccaccgaacaaggctgttgacttc

SEQ ID NO: 25135 - DNA, 35 bp, Artificial Sequence
  Synthetic oligonucleotide
atccccgccgtgcccgaactccataggtgaaaccg

SEQ ID NO: 25136 - DNA, 35 bp, Artificial Sequence
  Synthetic oligonucleotide
attgcgacctcttatgtacttactattgcacgcct

SEQ ID NO: 25137 - DNA, 35 bp, Artificial Sequence
  Synthetic oligonucleotide
tctagcacagcaagttaatagcttgtcctcccttt

SEQ ID NO: 25138 - DNA, 36 bp, Artificial Sequence
  Synthetic oligonucleotide
tgaggtggaatacgaaaaaatatagggctgacggaa

SEQ ID NO: 25139 - DNA, 36 bp, Artificial Sequence
  Synthetic oligonucleotide
tctcccagctgtccgcttctgccgttagcctttcca

SEQ ID NO: 25140 - DNA, 37 bp, Artificial Sequence
  Synthetic oligonucleotide
aaccgcctgccccctccttttggtactgaatcttcga

SEQ ID NO: 25141 - DNA, 37 bp, Artificial Sequence
  Synthetic oligonucleotide
gaccctaacctgatctgctatgtttgtttcatcatga

SEQ ID NO: 25142 - DNA, 38 bp, Artificial Sequence
  Synthetic oligonucleotide
actacacctcccgatccctcgcgtcaccttttgactga

SEQ ID NO: 25143 - DNA, 38 bp, Artificial Sequence
  Synthetic oligonucleotide
gctgccgcaacctacatcatttgggccacacctgctga

SEQ ID NO: 25144 - DNA, 38 bp, Artificial Sequence
  Synthetic oligonucleotide
gttcacatccggtgtctcggcaccacacccatccttga

SEQ ID NO: 25145 - DNA, 36 bp, Artificial Sequence
  Synthetic oligonucleotide
gccccccttcgtgttatacttgtgttatctccttga

SEQ ID NO: 25146 - DNA, 36 bp, Artificial Sequence
  Synthetic oligonucleotide
gtacagtcgctccgtagtctttgcgcacttccacta

SEQ ID NO: 25147 - DNA, 36 bp, Artificial Sequence
  Synthetic oligonucleotide
accgatctgacatccattcctctataaagctatcta

SEQ ID NO: 25148 - DNA, 35 bp, Artificial Sequence
  Synthetic oligonucleotide
atcgtcgcagaccgtccttaacaactgccatcgta

SEQ ID NO: 25149 - DNA, 36 bp, Artificial Sequence
  Synthetic oligonucleotide
gaacgtccacctcatggtgataccaacactttctta

SEQ ID NO: 25150 - DNA, 35 bp, Artificial Sequence
  Synthetic oligonucleotide
tcttaacaggcaacgcccatcccccgtcccgccgc

SEQ ID NO: 25151 - DNA, 35 bp, Artificial Sequence
  Synthetic oligonucleotide
gggatgacgtgggtctcagggatttggggtgaggg

SEQ ID NO: 25152 - DNA, 37 bp, Artificial Sequence
  Synthetic oligonucleotide
agtagggaggtatgaccaaggagaagggaattgggga

SEQ ID NO: 25153 - DNA, 38 bp, Artificial Sequence
  Synthetic oligonucleotide
gttacaacagcggcgtggaggagggccggggggagtga

SEQ ID NO: 25154 - DNA, 36 bp, Artificial Sequence
  Synthetic oligonucleotide
tatgaccgctatgtataccatcgtactactccacta

SEQ ID NO: 25155 - DNA, 35 bp, Artificial Sequence
  Synthetic oligonucleotide
gcaaccgaataggttgttagcccttttaaccatac

SEQ ID NO: 25156 - DNA, 35 bp, Artificial Sequence
  Synthetic oligonucleotide
tgagccactggtgcaacctgaatccttctccttcc

SEQ ID NO: 25157 - DNA, 35 bp, Artificial Sequence
  Synthetic oligonucleotide
gtcagagcagacctgccccgttaccagacccccgc

SEQ ID NO: 25158 - DNA, 35 bp, Artificial Sequence
  Synthetic oligonucleotide
tgctacctctcacgcatgcccctgtgtccacagct

SEQ ID NO: 25159 - DNA, 35 bp, Artificial Sequence
  Synthetic oligonucleotide
atcccccgaattgtcaccgtcccggcgtctctttt

SEQ ID NO: 25160 - DNA, 36 bp, Artificial Sequence
  Synthetic oligonucleotide
atctccgcaatgccatccgaaacatcctgtagcaaa

SEQ ID NO: 25161 - DNA, 36 bp, Artificial Sequence
  Synthetic oligonucleotide
gcaacgcaggtcggcataaccctccttgtccatgaa

SEQ ID NO: 25162 - DNA, 36 bp, Artificial Sequence
  Synthetic oligonucleotide
tgaacgaggaccgtgaagggtggagggcatgtgtaa

SEQ ID NO: 25163 - DNA, 36 bp, Artificial Sequence
  Synthetic oligonucleotide
attgtccccaccctgctattagtgctcacccaaaga

SEQ ID NO: 25164 - DNA, 37 bp, Artificial Sequence
  Synthetic oligonucleotide
gatcatccccgacgcgagccacgcctgacctcccaga

SEQ ID NO: 25165 - DNA, 36 bp, Artificial Sequence
  Synthetic oligonucleotide
gatgccccatatccccgagcaccccatatccgccga

SEQ ID NO: 25166 - DNA, 37 bp, Artificial Sequence
  Synthetic oligonucleotide
gtctgagtagggcgaaatcagaggcagggggcgggga

SEQ ID NO: 25167 - DNA, 37 bp, Artificial Sequence
  Synthetic oligonucleotide
tccgcgcattcaatttctcccaacgtggcccgcatga

SEQ ID NO: 25168 - DNA, 38 bp, Artificial Sequence
  Synthetic oligonucleotide
gaactgccacccctaatttttcagcacacttggtgtga

SEQ ID NO: 25169 - DNA, 35 bp, Artificial Sequence
  Synthetic oligonucleotide
agacgtaccgcaacgatacccgccgatcctccgac

SEQ ID NO: 25170 - DNA, 35 bp, Artificial Sequence
  Synthetic oligonucleotide
ggttcccgcttgcttgtttccccgttacggtctcc

SEQ ID NO: 25171 - DNA, 35 bp, Artificial Sequence
  Synthetic oligonucleotide
aactagcccaatggaactctcctcgcatcccgagc

SEQ ID NO: 25172 - DNA, 34 bp, Artificial Sequence
  Synthetic oligonucleotide
aatcggagggggacggaggggaatatctattggg

SEQ ID NO: 25173 - DNA, 35 bp, Artificial Sequence
  Synthetic oligonucleotide
accccctatccgtgacgtcgtgccaaatttatcgt

SEQ ID NO: 25174 - DNA, 35 bp, Artificial Sequence
  Synthetic oligonucleotide
actgacatcctctggctgcgaaatcgcactctcaa

SEQ ID NO: 25175 - DNA, 36 bp, Artificial Sequence
  Synthetic oligonucleotide
ggatcacggtcgcagttggtgggtgaatcgggggaa

SEQ ID NO: 25176 - DNA, 38 bp, Artificial Sequence
  Synthetic oligonucleotide
ttcacaacacttggcgaactgttacatctcaaccatga

SEQ ID NO: 25177 - DNA, 37 bp, Artificial Sequence
  Synthetic oligonucleotide
ttcgataactcatgccatccctcgtcatctccgatga

SEQ ID NO: 25178 - DNA, 38 bp, Artificial Sequence
  Synthetic oligonucleotide
atgagggagggacgggcggaggggcaagacttgtgtga

SEQ ID NO: 25179 - DNA, 37 bp, Artificial Sequence
  Synthetic oligonucleotide
gtcacatcttctggtctcgcaatgctgctactcttga

SEQ ID NO: 25180 - DNA, 35 bp, Artificial Sequence
  Synthetic oligonucleotide
gtaggtcggccgtctgtctctccatactctttcac

SEQ ID NO: 25181 - DNA, 35 bp, Artificial Sequence
  Synthetic oligonucleotide
taacactccctctagctgctagctatgcatctgcc

SEQ ID NO: 25182 - DNA, 35 bp, Artificial Sequence
  Synthetic oligonucleotide
gacatccgcccggccctgctttgtttcctgatctg

SEQ ID NO: 25183 - DNA, 35 bp, Artificial Sequence
  Synthetic oligonucleotide
tgccagacccacactgccgaacgttcaaactcaaa

SEQ ID NO: 25184 - DNA, 35 bp, Artificial Sequence
  Synthetic oligonucleotide
actagcagtagtccgaccgcagcccctcacccaca

SEQ ID NO: 25185 - DNA, 35 bp, Artificial Sequence
  Synthetic oligonucleotide
gcacccctcgaatcctcacacagccggtggataca

SEQ ID NO: 25186 - DNA, 35 bp, Artificial Sequence
  Synthetic oligonucleotide
ttcgcggttcgggccatcatgttcctcacccacca

SEQ ID NO: 25187 - DNA, 35 bp, Artificial Sequence
  Synthetic oligonucleotide
gtttgctacactgctcttacgctgcctcctgggca

SEQ ID NO: 25188 - DNA, 37 bp, Artificial Sequence
  Synthetic oligonucleotide
ggacgccacagcgcctaagcatcctcttgcctcccga

SEQ ID NO: 25189 - DNA, 38 bp, Artificial Sequence
  Synthetic oligonucleotide
ggagtgaaggaagggcaccaagggctaggactacgtga

SEQ ID NO: 25190 - DNA, 35 bp, Artificial Sequence
  Synthetic oligonucleotide
tctcacaccactgttgttcttcaccgcaaatggac

SEQ ID NO: 25191 - DNA, 35 bp, Artificial Sequence
  Synthetic oligonucleotide
gcccatcgcttgcaaactgacactatccgctatac

SEQ ID NO: 25192 - DNA, 35 bp, Artificial Sequence
  Synthetic oligonucleotide
tactctgagtcccgccgctgagccttcattggtcc

SEQ ID NO: 25193 - DNA, 35 bp, Artificial Sequence
  Synthetic oligonucleotide
tacgtcgggctcccaggttctctcccggctcacgc

SEQ ID NO: 25194 - DNA, 35 bp, Artificial Sequence
  Synthetic oligonucleotide
tccctagcacccccctaatcttcatttttccggtg

SEQ ID NO: 25195 - DNA, 35 bp, Artificial Sequence
  Synthetic oligonucleotide
gcgaccacatcacaacggtttttgtccaagttaat

SEQ ID NO: 25196 - DNA, 35 bp, Artificial Sequence
  Synthetic oligonucleotide
ttccaaccctagaggccctctcaaatcagaccttt

SEQ ID NO: 25197 - DNA, 35 bp, Artificial Sequence
  Synthetic oligonucleotide
ccacgcctcctgtgcgcattcaccctccccaccaa

SEQ ID NO: 25198 - DNA, 36 bp, Artificial Sequence
  Synthetic oligonucleotide
tagccactccaacaaacaccgtcaacaggcttgcca

SEQ ID NO: 25199 - DNA, 36 bp, Artificial Sequence
  Synthetic oligonucleotide
acacatccttgcacccgccacggcgccaatcacgca

SEQ ID NO: 25200 - DNA, 37 bp, Artificial Sequence
  Synthetic oligonucleotide
actatcgcacccccttcgagttcctgtgtcctcccga

SEQ ID NO: 25201 - DNA, 38 bp, Artificial Sequence
  Synthetic oligonucleotide
tagaaggcgacgtgcagaagacggggtaggggtagtga

SEQ ID NO: 25202 - DNA, 36 bp, Artificial Sequence
  Synthetic oligonucleotide
accgcgcgagggtcaagcagggggggtgggcgtgta

SEQ ID NO: 25203 - DNA, 35 bp, Artificial Sequence
  Synthetic oligonucleotide
gcactctgcccttatcgctcgggaattatctttgc

SEQ ID NO: 25204 - DNA, 35 bp, Artificial Sequence
  Synthetic oligonucleotide
tcatttcccgcacaggactcacacgcgatacgtcg

SEQ ID NO: 25205 - DNA, 35 bp, Artificial Sequence
  Synthetic oligonucleotide
gtccacgactctccgctttcaactactctcgcagg

SEQ ID NO: 25206 - DNA, 35 bp, Artificial Sequence
  Synthetic oligonucleotide
tgtaccccgacacattagcgatccacgtccccaat

SEQ ID NO: 25207 - DNA, 35 bp, Artificial Sequence
  Synthetic oligonucleotide
atcacatcccagtaaggccttccaccgcaagacat

SEQ ID NO: 25208 - DNA, 35 bp, Artificial Sequence
  Synthetic oligonucleotide
tcagccggtgcacaatctctaacccacagctgact

SEQ ID NO: 25209 - DNA, 35 bp, Artificial Sequence
  Synthetic oligonucleotide
tcgcacgccatctctcttacccgagtctgacccaa

SEQ ID NO: 25210 - DNA, 36 bp, Artificial Sequence
  Synthetic oligonucleotide
gatagtgccggacaaggtgggaggatgcagccagaa

SEQ ID NO: 25211 - DNA, 36 bp, Artificial Sequence
  Synthetic oligonucleotide
tcagttacccgcctgtcccgtttaccacccgttcca

SEQ ID NO: 25212 - DNA, 37 bp, Artificial Sequence
  Synthetic oligonucleotide
gaccactcacactatcccgggacactcctgtatacga

SEQ ID NO: 25213 - DNA, 35 bp, Artificial Sequence
  Synthetic oligonucleotide
ccactcccatccgagtaccttaacacttccttgga

SEQ ID NO: 25214 - DNA, 35 bp, Artificial Sequence
  Synthetic oligonucleotide
tggtctccacctgcctgctgccaaacatggtatcc

SEQ ID NO: 25215 - DNA, 35 bp, Artificial Sequence
  Synthetic oligonucleotide
aactcagggcgctgtcaccgaccacactactcatg

SEQ ID NO: 25216 - DNA, 35 bp, Artificial Sequence
  Synthetic oligonucleotide
atggaccgaatcgccaatacctgcggaaatacctt

SEQ ID NO: 25217 - DNA, 36 bp, Artificial Sequence
  Synthetic oligonucleotide
gatggacaggggtagcaaagggcagaaaaaggataa

SEQ ID NO: 25218 - DNA, 36 bp, Artificial Sequence
  Synthetic oligonucleotide
ttaccgcgcatgcctcagctctcgttcctttacgca

SEQ ID NO: 25219 - DNA, 37 bp, Artificial Sequence
  Synthetic oligonucleotide
tgccacccccgcactcgagcataccacccacacgcga

SEQ ID NO: 25220 - DNA, 38 bp, Artificial Sequence
  Synthetic oligonucleotide
tccacacgtacgagcaggtcacggagacggggatatga

SEQ ID NO: 25221 - DNA, 36 bp, Artificial Sequence
  Synthetic oligonucleotide
tacgacgcacttgggtccctcgctatatcccgttga

SEQ ID NO: 25222 - DNA, 35 bp, Artificial Sequence
  Synthetic oligonucleotide
aactggcactgcgcgttgccagtttcaacacctac

SEQ ID NO: 25223 - DNA, 35 bp, Artificial Sequence
  Synthetic oligonucleotide
acacttacacgctggacagcctcactccgttcatc

SEQ ID NO: 25224 - DNA, 35 bp, Artificial Sequence
  Synthetic oligonucleotide
tgcgcccaccacttcctcctcttttcgttagttcg

SEQ ID NO: 25225 - DNA, 35 bp, Artificial Sequence
  Synthetic oligonucleotide
acacgcagtggccttttcccatctaaacaatctgg

SEQ ID NO: 25226 - DNA, 35 bp, Artificial Sequence
  Synthetic oligonucleotide
gttatcatccgtagaccgccaccccacaagccatg

SEQ ID NO: 25227 - DNA, 35 bp, Artificial Sequence
  Synthetic oligonucleotide
ggtcgccttgttcttgtacgtgctcccctccacct

SEQ ID NO: 25228 - DNA, 35 bp, Artificial Sequence
  Synthetic oligonucleotide
ccacgccacccacctcgagcaccacctgtcgtgct

SEQ ID NO: 25229 - DNA, 35 bp, Artificial Sequence
  Synthetic oligonucleotide
tcccaccacaaccccgaaatgacctgtccacttct

SEQ ID NO: 25230 - DNA, 35 bp, Artificial Sequence
  Synthetic oligonucleotide
attgtaggggtgatagtggtggaaaaatgattcgt

SEQ ID NO: 25231 - DNA, 38 bp, Artificial Sequence
  Synthetic oligonucleotide
gaacgacgcacgcatcttgccctcccattcattgttga

SEQ ID NO: 25232 - DNA, 36 bp, Artificial Sequence
  Synthetic oligonucleotide
tatgagcctcactaagggtacccccctatcccccgc

SEQ ID NO: 25233 - DNA, 35 bp, Artificial Sequence
  Synthetic oligonucleotide
atcccaccctcgtatttcgcctacactaaaggcgc

SEQ ID NO: 25234 - DNA, 35 bp, Artificial Sequence
  Synthetic oligonucleotide
tccaatggcccctgaggcacttctgcctgatctct

SEQ ID NO: 25235 - DNA, 35 bp, Artificial Sequence
  Synthetic oligonucleotide
gaagccacgtttgacatactccttccgactctgtt

SEQ ID NO: 25236 - DNA, 35 bp, Artificial Sequence
  Synthetic oligonucleotide
tcattcaccattgactcgtcacttgactgccccca

SEQ ID NO: 25237 - DNA, 36 bp, Artificial Sequence
  Synthetic oligonucleotide
attgagcaccaaccccccacaacgctgacagttcca

SEQ ID NO: 25238 - DNA, 36 bp, Artificial Sequence
  Synthetic oligonucleotide
attggcgctcctagccttccctacattgccgttcca

SEQ ID NO: 25239 - DNA, 37 bp, Artificial Sequence
  Synthetic oligonucleotide
gcaccgcaaatcgccctgaaactccatgcaaaaagga

SEQ ID NO: 25240 - DNA, 37 bp, Artificial Sequence
  Synthetic oligonucleotide
ggggtgggaggttaagttgtgggtgaattcctgggga

SEQ ID NO: 25241 - DNA, 37 bp, Artificial Sequence
  Synthetic oligonucleotide
gttgcccgcgcccacgccgtatcaaaacatacatgga

SEQ ID NO: 25242 - DNA, 38 bp, Artificial Sequence
  Synthetic oligonucleotide
tccaggtaccgccctcactcgacatcatcagtcactga

SEQ ID NO: 25243 - DNA, 37 bp, Artificial Sequence
  Synthetic oligonucleotide
tacacgaacacttgatgatggccccctctgatgctga

SEQ ID NO: 25244 - DNA, 38 bp, Artificial Sequence
  Synthetic oligonucleotide
tgcataacccaccctggtcctatctgcctgtaacttga

SEQ ID NO: 25245 - DNA, 37 bp, Artificial Sequence
  Synthetic oligonucleotide
gccacctcctgctttcagtcaaacactcgtctcttga

SEQ ID NO: 25246 - DNA, 35 bp, Artificial Sequence
  Synthetic oligonucleotide
gtggatcccatgcccgaaacgagaaaccctgtccc

SEQ ID NO: 25247 - DNA, 35 bp, Artificial Sequence
  Synthetic oligonucleotide
gaaacgccgctccctgccttaatacgcgtctgctc

SEQ ID NO: 25248 - DNA, 35 bp, Artificial Sequence
  Synthetic oligonucleotide
acgatgtacaccgtccatcatgactcttacctctc

SEQ ID NO: 25249 - DNA, 35 bp, Artificial Sequence
  Synthetic oligonucleotide
tctgaagacgaacgaggagaagagaggggagtgcg

SEQ ID NO: 25250 - DNA, 35 bp, Artificial Sequence
  Synthetic oligonucleotide
gactgacacgccatctataaaaggttccgttccat

SEQ ID NO: 25251 - DNA, 35 bp, Artificial Sequence
  Synthetic oligonucleotide
gaacagcagcctcttctgcactactcctgcctatt

SEQ ID NO: 25252 - DNA, 36 bp, Artificial Sequence
  Synthetic oligonucleotide
gtgtgcctagctctcctctctgtctctccgtgttca

SEQ ID NO: 25253 - DNA, 37 bp, Artificial Sequence
  Synthetic oligonucleotide
ttcgccccagcactcaccatacggtcaacgtacacga

SEQ ID NO: 25254 - DNA, 36 bp, Artificial Sequence
  Synthetic oligonucleotide
ttgcacgaacggaaatcaaccaacactgccctacga

SEQ ID NO: 25255 - DNA, 37 bp, Artificial Sequence
  Synthetic oligonucleotide
atccagcatcggctcccgaaccacactgcttcaccga

SEQ ID NO: 25256 - DNA, 37 bp, Artificial Sequence
  Synthetic oligonucleotide
acagtcggaggagagaaaaaggattggttatacggga

SEQ ID NO: 25257 - DNA, 38 bp, Artificial Sequence
  Synthetic oligonucleotide
gattgaggtagaatgtgggggatggtaggggtgtatga

SEQ ID NO: 25258 - DNA, 35 bp, Artificial Sequence
  Synthetic oligonucleotide
tcatagtccatacccactgggtcccgcccattacc

SEQ ID NO: 25259 - DNA, 35 bp, Artificial Sequence
  Synthetic oligonucleotide
tgcctgcccccatccctacacttttgcaaaaagcc

SEQ ID NO: 25260 - DNA, 35 bp, Artificial Sequence
  Synthetic oligonucleotide
ggagtcgccgcggttcgcgtaccatcactgcatgc

SEQ ID NO: 25261 - DNA, 35 bp, Artificial Sequence
  Synthetic oligonucleotide
tgattgcgtaactgtcccgtcactgactctccgcg

SEQ ID NO: 25262 - DNA, 35 bp, Artificial Sequence
  Synthetic oligonucleotide
tccaacgccgctgtatcaagcgttgcttccgtatt

SEQ ID NO: 25263 - DNA, 35 bp, Artificial Sequence
  Synthetic oligonucleotide
tcccgactgacccgattccgttacattaggtgctt

SEQ ID NO: 25264 - DNA, 37 bp, Artificial Sequence
  Synthetic oligonucleotide
gcaccttgccactcctgtaatcgcctccaaatggaga

SEQ ID NO: 25265 - DNA, 37 bp, Artificial Sequence
  Synthetic oligonucleotide
atgggggggaaatgatagagggagatagaaagaagga

SEQ ID NO: 25266 - DNA, 35 bp, Artificial Sequence
  Synthetic oligonucleotide
ttgttggggccagcactcgttctcctgcctttggc

SEQ ID NO: 25267 - DNA, 35 bp, Artificial Sequence
  Synthetic oligonucleotide
atgcgacggaacattctacgtactccatcctgtag

SEQ ID NO: 25268 - DNA, 35 bp, Artificial Sequence
  Synthetic oligonucleotide
gcaatcccgcctcacttatcgcattccgtgtgtaa

SEQ ID NO: 25269 - DNA, 36 bp, Artificial Sequence
  Synthetic oligonucleotide
accatgcactagccgtccagactttatcgatttcca

SEQ ID NO: 25270 - DNA, 37 bp, Artificial Sequence
  Synthetic oligonucleotide
tgcacgtgtgggaggagggaggtagggtcggtgacga

SEQ ID NO: 25271 - DNA, 37 bp, Artificial Sequence
  Synthetic oligonucleotide
accctcctgcccgttactgtaagcttgcccttttcga

SEQ ID NO: 25272 - DNA, 35 bp, Artificial Sequence
  Synthetic oligonucleotide
taccccacctcgtacacagtttattaggctctgga

SEQ ID NO: 25273 - DNA, 35 bp, Artificial Sequence
  Synthetic oligonucleotide
gcctctacgctccacccacatgctaccagtgtacc

SEQ ID NO: 25274 - DNA, 35 bp, Artificial Sequence
  Synthetic oligonucleotide
tttttacccctgcctctgcctgaatggtgcctgcc

SEQ ID NO: 25275 - DNA, 35 bp, Artificial Sequence
  Synthetic oligonucleotide
gagatgccgccacgacgcagacaacacaacaatcc

SEQ ID NO: 25276 - DNA, 36 bp, Artificial Sequence
  Synthetic oligonucleotide
acgaaccgcatctgggagtgggtggagtgtgggcaa

SEQ ID NO: 25277 - DNA, 36 bp, Artificial Sequence
  Synthetic oligonucleotide
tcacgcctcccatttgctgcgatcataacctggcaa

SEQ ID NO: 25278 - DNA, 35 bp, Artificial Sequence
  Synthetic oligonucleotide
gactcaactcgcgtggtccatccttatgcacttaa

SEQ ID NO: 25279 - DNA, 36 bp, Artificial Sequence
  Synthetic oligonucleotide
tccatctcaaccattccactcacgaaacagtagcca

SEQ ID NO: 25280 - DNA, 35 bp, Artificial Sequence
  Synthetic oligonucleotide
ttgtagcccgcctacaccccgccaccgattcatgc

SEQ ID NO: 25281 - DNA, 35 bp, Artificial Sequence
  Synthetic oligonucleotide
tctaccggctccgttcgttaaaattgtccctgccg

SEQ ID NO: 25282 - DNA, 35 bp, Artificial Sequence
  Synthetic oligonucleotide
agcacagccccaccacaggatttttctattgtccg

SEQ ID NO: 25283 - DNA, 35 bp, Artificial Sequence
  Synthetic oligonucleotide
tcagccccaaaaagaactgtcccctgttagccact

SEQ ID NO: 25284 - DNA, 35 bp, Artificial Sequence
  Synthetic oligonucleotide
tccaagggcacggagccgttctttagtcttgccct

SEQ ID NO: 25285 - DNA, 35 bp, Artificial Sequence
  Synthetic oligonucleotide
tcaacctgcccccgcttgattatttagcgcgcctt

SEQ ID NO: 25286 - DNA, 36 bp, Artificial Sequence
  Synthetic oligonucleotide
ttggagacgacgcagtctcctaatggacccactcaa

SEQ ID NO: 25287 - DNA, 37 bp, Artificial Sequence
  Synthetic oligonucleotide
tgcccctcaccctcgcataaggcttccagcatttaga

SEQ ID NO: 25288 - DNA, 37 bp, Artificial Sequence
  Synthetic oligonucleotide
atgtcctcgccattcgaatatttactgtttccctgga

SEQ ID NO: 25289 - DNA, 38 bp, Artificial Sequence
  Synthetic oligonucleotide
ggacccaacaccgggattcgcacttcagcctacgctga

SEQ ID NO: 25290 - DNA, 38 bp, Artificial Sequence
  Synthetic oligonucleotide
gacatcggctctgcacctgcattatgttcctccgctga

SEQ ID NO: 25291 - DNA, 38 bp, Artificial Sequence
  Synthetic oligonucleotide
tccgcgattgtttgcttttaggccatgcccacctctga

SEQ ID NO: 25292 - DNA, 35 bp, Artificial Sequence
  Synthetic oligonucleotide
aatgaccgcactcaccatctgttttttcaattgcc

SEQ ID NO: 25293 - DNA, 35 bp, Artificial Sequence
  Synthetic oligonucleotide
tgtacctttgctcccatgacttccgggccgaacgc

SEQ ID NO: 25294 - DNA, 35 bp, Artificial Sequence
  Synthetic oligonucleotide
acctgtcaacctacgtacgatccgcccgttccgaa

SEQ ID NO: 25295 - DNA, 36 bp, Artificial Sequence
  Synthetic oligonucleotide
agctaccctcggaatgtttcaactctgtcactttca

SEQ ID NO: 25296 - DNA, 36 bp, Artificial Sequence
  Synthetic oligonucleotide
atgcgcctggcagtagactcgcgttggcctttttca

SEQ ID NO: 25297 - DNA, 37 bp, Artificial Sequence
  Synthetic oligonucleotide
tgcggttgataggtgggaggagggatgggggggtcga

SEQ ID NO: 25298 - DNA, 38 bp, Artificial Sequence
  Synthetic oligonucleotide
ctggcgcaacgtcgattctcgatcacttccaaccctga

SEQ ID NO: 25299 - DNA, 38 bp, Artificial Sequence
  Synthetic oligonucleotide
atggaaaggaatggggcggaggggtcgcatgtaggtga

SEQ ID NO: 25300 - DNA, 38 bp, Artificial Sequence
  Synthetic oligonucleotide
ttacagccacgcacgaccactctgtccactccgattga

SEQ ID NO: 25301 - DNA, 38 bp, Artificial Sequence
  Synthetic oligonucleotide
gccatgcccaatccccgctcgtgacttcaccccgttga

SEQ ID NO: 25302 - DNA, 35 bp, Artificial Sequence
  Synthetic oligonucleotide
gacacgggaagaactggcgataaactggagtaata

SEQ ID NO: 25303 - DNA, 35 bp, Artificial Sequence
  Synthetic oligonucleotide
ggagcatgtcagcacctctttgtacggcctccacc

SEQ ID NO: 25304 - DNA, 35 bp, Artificial Sequence
  Synthetic oligonucleotide
tctcagcgcacgcctcggctaaactttctgctccc

SEQ ID NO: 25305 - DNA, 35 bp, Artificial Sequence
  Synthetic oligonucleotide
ataccattacaggcgtcagccggtccatcactctc

SEQ ID NO: 25306 - DNA, 35 bp, Artificial Sequence
  Synthetic oligonucleotide
atagaacggaggggaagggtggagcaaaggcatcg

SEQ ID NO: 25307 - DNA, 36 bp, Artificial Sequence
  Synthetic oligonucleotide
tctactccacccacgatagtgccgatctctaccaca

SEQ ID NO: 25308 - DNA, 33 bp, Artificial Sequence
  Synthetic oligonucleotide
tctggaccctgttcgttagcccacgctcgctta

SEQ ID NO: 25309 - DNA, 36 bp, Artificial Sequence
  Synthetic oligonucleotide
tactcatccggaggtcatacagcaatcatcctctta

SEQ ID NO: 25310 - DNA, 35 bp, Artificial Sequence
  Synthetic oligonucleotide
accaccagttctttgagccgctcttgcatgtttcg

SEQ ID NO: 25311 - DNA, 35 bp, Artificial Sequence
  Synthetic oligonucleotide
gtgcaacagcaatcataaacgcggcatctatctct

SEQ ID NO: 25312 - DNA, 35 bp, Artificial Sequence
  Synthetic oligonucleotide
gccgataccttcattgcctgtctagcctaagactt

SEQ ID NO: 25313 - DNA, 35 bp, Artificial Sequence
  Synthetic oligonucleotide
atccccagccacccggatctcctttcgaccacgca

SEQ ID NO: 25314 - DNA, 35 bp, Artificial Sequence
  Synthetic oligonucleotide
atccgcctcgcataccactgcgtacttgtttttca

SEQ ID NO: 25315 - DNA, 37 bp, Artificial Sequence
  Synthetic oligonucleotide
ttcaggatgggacaggggcgatgaacttggggatgga

SEQ ID NO: 25316 - DNA, 38 bp, Artificial Sequence
  Synthetic oligonucleotide
gtgaatccccagccgcacaccacgttccatctttatga

SEQ ID NO: 25317 - DNA, 38 bp, Artificial Sequence
  Synthetic oligonucleotide
tccacgaggcgcatctgggcacgctctctcactactga

SEQ ID NO: 25318 - DNA, 37 bp, Artificial Sequence
  Synthetic oligonucleotide
tcgcaacatccggttgtgccatttcaccccgccctga

SEQ ID NO: 25319 - DNA, 37 bp, Artificial Sequence
  Synthetic oligonucleotide
acttcccgtcgctccgtacctttcacccccgtcgtga

SEQ ID NO: 25320 - DNA, 37 bp, Artificial Sequence
  Synthetic oligonucleotide
gatccgacgtacgcgcatctctactaaacacccttga

SEQ ID NO: 25321 - DNA, 35 bp, Artificial Sequence
  Synthetic oligonucleotide
tactccagtcccatagttacatttccatttgtggc

SEQ ID NO: 25322 - DNA, 35 bp, Artificial Sequence
  Synthetic oligonucleotide
gtgcacgtcctctattaatgcatttgtccgcgtgc

SEQ ID NO: 25323 - DNA, 35 bp, Artificial Sequence
  Synthetic oligonucleotide
aatgagccagcgtggagggcgggggatgacaaagg

SEQ ID NO: 25324 - DNA, 36 bp, Artificial Sequence
  Synthetic oligonucleotide
gcatcccgccgtgcacgtagtgtgcccttcatgaca

SEQ ID NO: 25325 - DNA, 34 bp, Artificial Sequence
  Synthetic oligonucleotide
gcatgtcacaggcttctttccgtgcactcaccca

SEQ ID NO: 25326 - DNA, 37 bp, Artificial Sequence
  Synthetic oligonucleotide
gagagacggttgaagggagaggagacggtgatagaga

SEQ ID NO: 25327 - DNA, 37 bp, Artificial Sequence
  Synthetic oligonucleotide
ttcattgcccgccccccatgattgagtacatccagga

SEQ ID NO: 25328 - DNA, 37 bp, Artificial Sequence
  Synthetic oligonucleotide
gtaaggggaggaagggatctcaaaggacgctgtatga

SEQ ID NO: 25329 - DNA, 38 bp, Artificial Sequence
  Synthetic oligonucleotide
gtgcgagtggaggtgagggtgttaggggggggcggtga

SEQ ID NO: 25330 - DNA, 38 bp, Artificial Sequence
  Synthetic oligonucleotide
accgcacttcaactgtgcatccctcctattctctgtga

SEQ ID NO: 25331 - DNA, 35 bp, Artificial Sequence
  Synthetic oligonucleotide
tcgacatccatcctgttaaccctcgagttgccata

SEQ ID NO: 25332 - DNA, 36 bp, Artificial Sequence
  Synthetic oligonucleotide
ttgaggcctgaccgcgatgcccattctttgccatta

SEQ ID NO: 25333 - DNA, 35 bp, Artificial Sequence
  Synthetic oligonucleotide
atgggaagtctgcgtggtgggggggggaggggtac

SEQ ID NO: 25334 - DNA, 35 bp, Artificial Sequence
  Synthetic oligonucleotide
gaacctcattcgtttcgtcccctgggtcttttgcc

SEQ ID NO: 25335 - DNA, 35 bp, Artificial Sequence
  Synthetic oligonucleotide
tcatgccatggatgacgaattaacgcccatgctcc

SEQ ID NO: 25336 - DNA, 35 bp, Artificial Sequence
  Synthetic oligonucleotide
gtgcgcacctcatctattcatcactgagcgtatct

SEQ ID NO: 25337 - DNA, 35 bp, Artificial Sequence
  Synthetic oligonucleotide
cccatgcacgatgacatgtacctttccccacataa

SEQ ID NO: 25338 - DNA, 37 bp, Artificial Sequence
  Synthetic oligonucleotide
gaagcgaggggaggctgtaaccagaagggagggtaga

SEQ ID NO: 25339 - DNA, 37 bp, Artificial Sequence
  Synthetic oligonucleotide
tgtgagaaggccgggtgcttaagggcggggcggggga

SEQ ID NO: 25340 - DNA, 38 bp, Artificial Sequence
  Synthetic oligonucleotide
tccactcatcacctgttcttgtacgcccctgtcaatga

SEQ ID NO: 25341 - DNA, 37 bp, Artificial Sequence
  Synthetic oligonucleotide
attcgacgccacactacgtgatacgttaccccattga

SEQ ID NO: 25342 - DNA, 36 bp, Artificial Sequence
  Synthetic oligonucleotide
gactacttcctgggcataattggccacccccttcta

SEQ ID NO: 25343 - DNA, 36 bp, Artificial Sequence
  Synthetic oligonucleotide
tgctcgggcctccaatatgttcgtttctctcttcta

SEQ ID NO: 25344 - DNA, 35 bp, Artificial Sequence
  Synthetic oligonucleotide
tgctacgacccgacgacccgctgaccttcgtaacc

SEQ ID NO: 25345 - DNA, 35 bp, Artificial Sequence
  Synthetic oligonucleotide
atggccaatgtctggttaccacgtcgttcctcctc

SEQ ID NO: 25346 - DNA, 35 bp, Artificial Sequence
  Synthetic oligonucleotide
gaggccgtccttcgtttgaatcttggctccatctc

SEQ ID NO: 25347 - DNA, 35 bp, Artificial Sequence
  Synthetic oligonucleotide
gacgcccccactacgcatcgaatacccactgtaag

SEQ ID NO: 25348 - DNA, 35 bp, Artificial Sequence
  Synthetic oligonucleotide
tcgttccgtaccgcgccacctatcctgatcctttt

SEQ ID NO: 25349 - DNA, 35 bp, Artificial Sequence
  Synthetic oligonucleotide
gtacaggagtaccggctaccctccccaatacctaa

SEQ ID NO: 25350 - DNA, 37 bp, Artificial Sequence
  Synthetic oligonucleotide
tcaatcatggccatctggacaagactcctccctatga

SEQ ID NO: 25351 - DNA, 38 bp, Artificial Sequence
  Synthetic oligonucleotide
tgggcccatcctatttgcctgcccgtgccccctagtga

SEQ ID NO: 25352 - DNA, 38 bp, Artificial Sequence
  Synthetic oligonucleotide
ttggaggggagtacggtattgggaggtgaggcagttga

SEQ ID NO: 25353 - DNA, 36 bp, Artificial Sequence
  Synthetic oligonucleotide
tgaagagctcaatgaaaatgggagggtggtggtata

SEQ ID NO: 25354 - DNA, 36 bp, Artificial Sequence
  Synthetic oligonucleotide
tactgccaccgtctctgggccttgtttatctctcta

SEQ ID NO: 25355 - DNA, 35 bp, Artificial Sequence
  Synthetic oligonucleotide
tcaatacgctgttggttttgcgttggccactctta

SEQ ID NO: 25356 - DNA, 35 bp, Artificial Sequence
  Synthetic oligonucleotide
aacacgcacgtctaatattccttgccgctgcgtat

SEQ ID NO: 25357 - DNA, 35 bp, Artificial Sequence
  Synthetic oligonucleotide
tcatcatggctgatgccagctttatgatttcacct

SEQ ID NO: 25358 - DNA, 36 bp, Artificial Sequence
  Synthetic oligonucleotide
atcgcccccgctccatcatcctcagctgctggtaaa

SEQ ID NO: 25359 - DNA, 36 bp, Artificial Sequence
  Synthetic oligonucleotide
ggacacgtatcaattttcctgcccgttttgttcgaa

SEQ ID NO: 25360 - DNA, 36 bp, Artificial Sequence
  Synthetic oligonucleotide
tcagtcccccgccttgcccatgtagttacctaccca

SEQ ID NO: 25361 - DNA, 37 bp, Artificial Sequence
  Synthetic oligonucleotide
tcccgccggcctcatgccctcggttttatccaactga

SEQ ID NO: 25362 - DNA, 38 bp, Artificial Sequence
  Synthetic oligonucleotide
acttcaccgacgcgtgcgctctccacactctcaactga

SEQ ID NO: 25363 - DNA, 36 bp, Artificial Sequence
  Synthetic oligonucleotide
atattcccaccaagactccgctatgacagtccgtga

SEQ ID NO: 25364 - DNA, 38 bp, Artificial Sequence
  Synthetic oligonucleotide
gttgcaactgtgcctggaacctcgctattatccattga

SEQ ID NO: 25365 - DNA, 36 bp, Artificial Sequence
  Synthetic oligonucleotide
tgaccgatccacccgtagtactcagggaacttgcta

SEQ ID NO: 25366 - DNA, 36 bp, Artificial Sequence
  Synthetic oligonucleotide
atgtcgcgaatggctaccaccgtccccttccgctta

SEQ ID NO: 25367 - DNA, 35 bp, Artificial Sequence
  Synthetic oligonucleotide
tagtcgcccaccgttctttcgcctgatttctggag

SEQ ID NO: 25368 - DNA, 35 bp, Artificial Sequence
  Synthetic oligonucleotide
accgacttcgcgatacacctctttgttatgcctct

SEQ ID NO: 25369 - DNA, 35 bp, Artificial Sequence
  Synthetic oligonucleotide
gccaccattgtctgtgtacccatcctgtttaccgt

SEQ ID NO: 25370 - DNA, 36 bp, Artificial Sequence
  Synthetic oligonucleotide
tcgagtgccccagcaggtacaatccattcctctcca

SEQ ID NO: 25371 - DNA, 35 bp, Artificial Sequence
  Synthetic oligonucleotide
atgccaccttacattccgctcgggccacttttcca

SEQ ID NO: 25372 - DNA, 35 bp, Artificial Sequence
  Synthetic oligonucleotide
tgcgcaggagaacaggggaggtggtgtggttgtca

SEQ ID NO: 25373 - DNA, 35 bp, Artificial Sequence
  Synthetic oligonucleotide
acttcccctcccgaccagtcttgtcatgaacttca

SEQ ID NO: 25374 - DNA, 38 bp, Artificial Sequence
  Synthetic oligonucleotide
gccaacatcgggcatagcaaaccgcctcttaatcgtga

SEQ ID NO: 25375 - DNA, 38 bp, Artificial Sequence
  Synthetic oligonucleotide
tgccacagcttaccgaacaccctcgtctttcatcgtga

SEQ ID NO: 25376 - DNA, 38 bp, Artificial Sequence
  Synthetic oligonucleotide
ggggtaggtggtcggggggagtaggcacttaggcttga

SEQ ID NO: 25377 - DNA, 35 bp, Artificial Sequence
  Synthetic oligonucleotide
gtccatcctcggtctggccgttaacctctgtctta

SEQ ID NO: 25378 - DNA, 35 bp, Artificial Sequence
  Synthetic oligonucleotide
ttgtagcccgcctaccccacgccaccgattcatgc

SEQ ID NO: 25379 - DNA, 35 bp, Artificial Sequence
  Synthetic oligonucleotide
gtgcccccaacatgtgccatggtaaatacactctc

SEQ ID NO: 25380 - DNA, 35 bp, Artificial Sequence
  Synthetic oligonucleotide
tagtatgcgacttccctcccccgctcttccctgcg

SEQ ID NO: 25381 - DNA, 35 bp, Artificial Sequence
  Synthetic oligonucleotide
ttccgatccttccgtcagggcaactttctcgccct

SEQ ID NO: 25382 - DNA, 35 bp, Artificial Sequence
  Synthetic oligonucleotide
gctcgtccacacctcattgaccgctatctcatgct

SEQ ID NO: 25383 - DNA, 35 bp, Artificial Sequence
  Synthetic oligonucleotide
actcagaccgcagccctaaacgccatgcaccgctt

SEQ ID NO: 25384 - DNA, 35 bp, Artificial Sequence
  Synthetic oligonucleotide
gacgccacatgcagcttagcgcgccctcctcttaa

SEQ ID NO: 25385 - DNA, 36 bp, Artificial Sequence
  Synthetic oligonucleotide
ttgacctgctgtcctgtccacaccaaaaatgcaaca

SEQ ID NO: 25386 - DNA, 36 bp, Artificial Sequence
  Synthetic oligonucleotide
cacattcccccctctcgatctgcgacgccaggccca

SEQ ID NO: 25387 - DNA, 35 bp, Artificial Sequence
  Synthetic oligonucleotide
tcgacacgccacgacccactcattgacttccttca

SEQ ID NO: 25388 - DNA, 37 bp, Artificial Sequence
  Synthetic oligonucleotide
tctgacgggggaaatggggttgtgcaacatggggaga

SEQ ID NO: 25389 - DNA, 36 bp, Artificial Sequence
  Synthetic oligonucleotide
ttgagtgctgcggaagggcttggcgggagtggcgga

SEQ ID NO: 25390 - DNA, 37 bp, Artificial Sequence
  Synthetic oligonucleotide
aacgccctccttcgcctgcctcctaagacctctcgga

SEQ ID NO: 25391 - DNA, 38 bp, Artificial Sequence
  Synthetic oligonucleotide
tgcgacctcggccacctggaacctcctgactagaatga

SEQ ID NO: 25392 - DNA, 38 bp, Artificial Sequence
  Synthetic oligonucleotide
acaccgcaacgcccggctatccttctatgtccaattga

SEQ ID NO: 25393 - DNA, 35 bp, Artificial Sequence
  Synthetic oligonucleotide
gcctgcagcccccttgccagacacgcattcaccac

SEQ ID NO: 25394 - DNA, 35 bp, Artificial Sequence
  Synthetic oligonucleotide
acactgatcgtatccctaccgtccgacgcacctcc

SEQ ID NO: 25395 - DNA, 33 bp, Artificial Sequence
  Synthetic oligonucleotide
acgatcggacacagacttactaatggtggctcc

SEQ ID NO: 25396 - DNA, 35 bp, Artificial Sequence
  Synthetic oligonucleotide
gagtcgtctggaaaagggtacggttgggaggtgag

SEQ ID NO: 25397 - DNA, 35 bp, Artificial Sequence
  Synthetic oligonucleotide
atctcccccctcgcagcatcccggactcccacatg

SEQ ID NO: 25398 - DNA, 35 bp, Artificial Sequence
  Synthetic oligonucleotide
tccatccttccaccgaataacccacgcctcctctg

SEQ ID NO: 25399 - DNA, 35 bp, Artificial Sequence
  Synthetic oligonucleotide
gtcagttcatccggcaccacttcctgctcccacca

SEQ ID NO: 25400 - DNA, 36 bp, Artificial Sequence
  Synthetic oligonucleotide
agccccagctccaatggctcaccaaaacccccggca

SEQ ID NO: 25401 - DNA, 35 bp, Artificial Sequence
  Synthetic oligonucleotide
gcatatcgcaccccagttattctgcactatcgtga

SEQ ID NO: 25402 - DNA, 37 bp, Artificial Sequence
  Synthetic oligonucleotide
tcagacagtcatcatctgactcagagtgcccccttga

SEQ ID NO: 25403 - DNA, 35 bp, Artificial Sequence
  Synthetic oligonucleotide
aatttgcaagcccacactttgcgcatcccgactta

SEQ ID NO: 25404 - DNA, 35 bp, Artificial Sequence
  Synthetic oligonucleotide
accctggccaccgctaaccgaccattaaccttggc

SEQ ID NO: 25405 - DNA, 35 bp, Artificial Sequence
  Synthetic oligonucleotide
tagcaatgatccctcgcgttttgcatgcctccctc

SEQ ID NO: 25406 - DNA, 35 bp, Artificial Sequence
  Synthetic oligonucleotide
tacggtaatcgcctatcgtctctagttcccccttg

SEQ ID NO: 25407 - DNA, 35 bp, Artificial Sequence
  Synthetic oligonucleotide
agccaaccgcatggttcacccgacttccatcttct

SEQ ID NO: 25408 - DNA, 35 bp, Artificial Sequence
  Synthetic oligonucleotide
gtggggccctctctttcgccgttttgtagacagca

SEQ ID NO: 25409 - DNA, 36 bp, Artificial Sequence
  Synthetic oligonucleotide
tccccgtggcgctctccctggctgcgacctcctgca

SEQ ID NO: 25410 - DNA, 35 bp, Artificial Sequence
  Synthetic oligonucleotide
gcccgccacctggtaccgtaccacacacgaccgga

SEQ ID NO: 25411 - DNA, 38 bp, Artificial Sequence
  Synthetic oligonucleotide
tgaccacgaaaactagggatgggccgtgtggtggttga

SEQ ID NO: 25412 - DNA, 35 bp, Artificial Sequence
  Synthetic oligonucleotide
gtgcctacgccagtcgcgatctctggcttttacta

SEQ ID NO: 25413 - DNA, 36 bp, Artificial Sequence
  Synthetic oligonucleotide
tcatcccgcccgtcacgaaccctgccgccagtttta

SEQ ID NO: 25414 - DNA, 35 bp, Artificial Sequence
  Synthetic oligonucleotide
tgacaagacctgcctacggattacgccccatttac

SEQ ID NO: 25415 - DNA, 35 bp, Artificial Sequence
  Synthetic oligonucleotide
tccaaagtttgtagcgtgcctccccctccttcacc

SEQ ID NO: 25416 - DNA, 35 bp, Artificial Sequence
  Synthetic oligonucleotide
gatcagccgccccaccgttccattctgctacgtcc

SEQ ID NO: 25417 - DNA, 35 bp, Artificial Sequence
  Synthetic oligonucleotide
acgtccgtcctcccccctgtcctagccatgtatgc

SEQ ID NO: 25418 - DNA, 35 bp, Artificial Sequence
  Synthetic oligonucleotide
atgcacacctcttaagtcctgtcttctcacgtttc

SEQ ID NO: 25419 - DNA, 35 bp, Artificial Sequence
  Synthetic oligonucleotide
gcatacggccgggcgccaacatgatcacccctccg

SEQ ID NO: 25420 - DNA, 35 bp, Artificial Sequence
  Synthetic oligonucleotide
accgccaacctgcttacgtacagttttcctacggt

SEQ ID NO: 25421 - DNA, 35 bp, Artificial Sequence
  Synthetic oligonucleotide
tcatgtctggccgcctatgctacgcttcatctgtt

SEQ ID NO: 25422 - DNA, 36 bp, Artificial Sequence
  Synthetic oligonucleotide
gatccactccggccgttgaacccgtgccttagtaaa

SEQ ID NO: 25423 - DNA, 36 bp, Artificial Sequence
  Synthetic oligonucleotide
tggataacttcctgggtttacgctgccattcctaca

SEQ ID NO: 25424 - DNA, 38 bp, Artificial Sequence
  Synthetic oligonucleotide
acgtgggggggagggttgcaatgcatttaacgggatga

SEQ ID NO: 25425 - DNA, 38 bp, Artificial Sequence
  Synthetic oligonucleotide
gacgcaccatgctcttgttcgaatttctgctctcgtga

SEQ ID NO: 25426 - DNA, 38 bp, Artificial Sequence
  Synthetic oligonucleotide
tgctcaccatccctttgtctttaggagctccaccttga

SEQ ID NO: 25427 - DNA, 35 bp, Artificial Sequence
  Synthetic oligonucleotide
tagacgcccgatacgacattccctccctacgccta

SEQ ID NO: 25428 - DNA, 36 bp, Artificial Sequence
  Synthetic oligonucleotide
tcctcgccatcgccctgcatcattctcaaccttgta

SEQ ID NO: 25429 - DNA, 35 bp, Artificial Sequence
  Synthetic oligonucleotide
tgaatcgcccgatcgctcctcttgcgtcaacctta

SEQ ID NO: 25430 - DNA, 36 bp, Artificial Sequence
  Synthetic oligonucleotide
atgcccctgacgttattgaccgcactaacctgctta

SEQ ID NO: 25431 - DNA, 35 bp, Artificial Sequence
  Synthetic oligonucleotide
aatgccctcctcacgctcaggccataacgcaccgg

SEQ ID NO: 25432 - DNA, 36 bp, Artificial Sequence
  Synthetic oligonucleotide
gtatcaacccgccgcatgagctacccccgtcacaaa

SEQ ID NO: 25433 - DNA, 35 bp, Artificial Sequence
  Synthetic oligonucleotide
tcaccaacagtccagcgcacgtcgcgatacccaca

SEQ ID NO: 25434 - DNA, 35 bp, Artificial Sequence
  Synthetic oligonucleotide
gcaagccgcaatagtaccattcgctcttaccacca

SEQ ID NO: 25435 - DNA, 35 bp, Artificial Sequence
  Synthetic oligonucleotide
atgtgcgacccttccctgacccaccccgcccggca

SEQ ID NO: 25436 - DNA, 36 bp, Artificial Sequence
  Synthetic oligonucleotide
aatggaatcgccccacatcgcataactagcactgca

SEQ ID NO: 25437 - DNA, 37 bp, Artificial Sequence
  Synthetic oligonucleotide
gacgcagtgaggcggaaggtgcgggggtgagtgtaga

SEQ ID NO: 25438 - DNA, 38 bp, Artificial Sequence
  Synthetic oligonucleotide
tcctacctaccattgttctaaacagcacctcgtattga

SEQ ID NO: 25439 - DNA, 35 bp, Artificial Sequence
  Synthetic oligonucleotide
gaatacccggcatcattcccattgttcactgccta

SEQ ID NO: 25440 - DNA, 36 bp, Artificial Sequence
  Synthetic oligonucleotide
agtagacgccgaagcgataccctacccccatggcta

SEQ ID NO: 25441 - DNA, 35 bp, Artificial Sequence
  Synthetic oligonucleotide
atctttgtcacaacgtgcaccatggaactatctac

SEQ ID NO: 25442 - DNA, 35 bp, Artificial Sequence
  Synthetic oligonucleotide
gacctagctcatttgactcgcaccccccgcaagcc

SEQ ID NO: 25443 - DNA, 35 bp, Artificial Sequence
  Synthetic oligonucleotide
gtgggagtcgcccctctatctgtaaagcttcatcc

SEQ ID NO: 25444 - DNA, 35 bp, Artificial Sequence
  Synthetic oligonucleotide
tctcgccagtatcggcctattgaaccctgcccagc

SEQ ID NO: 25445 - DNA, 35 bp, Artificial Sequence
  Synthetic oligonucleotide
tcctcccgatcgcgcatttaagctagtactttttg

SEQ ID NO: 25446 - DNA, 35 bp, Artificial Sequence
  Synthetic oligonucleotide
tgaagtgcagtcgttttctcctggcatctaaccat

SEQ ID NO: 25447 - DNA, 35 bp, Artificial Sequence
  Synthetic oligonucleotide
gagcaccattaaggtttgaccgtgtctcttccact

SEQ ID NO: 25448 - DNA, 35 bp, Artificial Sequence
  Synthetic oligonucleotide
gggactgcatattcgcctcatgtacgctcccctgt

SEQ ID NO: 25449 - DNA, 35 bp, Artificial Sequence
  Synthetic oligonucleotide
agcgacattcccgttgctcacatgatttccacctt

SEQ ID NO: 25450 - DNA, 36 bp, Artificial Sequence
  Synthetic oligonucleotide
gtacacaagggagggaagaataaacggattgactaa

SEQ ID NO: 25451 - DNA, 35 bp, Artificial Sequence
  Synthetic oligonucleotide
ggccacacatcagtccggccgccatccccgcacca

SEQ ID NO: 25452 - DNA, 35 bp, Artificial Sequence
  Synthetic oligonucleotide
tccagtccgcccgctcaacaaacggtttcacttca

SEQ ID NO: 25453 - DNA, 36 bp, Artificial Sequence
  Synthetic oligonucleotide
gtatctgtggcctgtgttgctccaatctcttccaga

SEQ ID NO: 25454 - DNA, 36 bp, Artificial Sequence
  Synthetic oligonucleotide
ggacacgactttggcggggacacgtgagctgggaga

SEQ ID NO: 25455 - DNA, 37 bp, Artificial Sequence
  Synthetic oligonucleotide
gtcccccacgcccggtccctagaatattcgccttcga

SEQ ID NO: 25456 - DNA, 37 bp, Artificial Sequence
  Synthetic oligonucleotide
tactgtcgcatatcatccccgcgggccaccccttgga

SEQ ID NO: 25457 - DNA, 38 bp, Artificial Sequence
  Synthetic oligonucleotide
atcacggcaacctgtgtccccctcaatcttccacctga

SEQ ID NO: 25458 - DNA, 38 bp, Artificial Sequence
  Synthetic oligonucleotide
gccccccctaagcccacatacgtcgcgttccacgctga

SEQ ID NO: 25459 - DNA, 38 bp, Artificial Sequence
  Synthetic oligonucleotide
gccaccccactccactgtatctcgcagccaggggctga

SEQ ID NO: 25460 - DNA, 38 bp, Artificial Sequence
  Synthetic oligonucleotide
ggtgatcccacatccactgcctccgagccacccggtga

SEQ ID NO: 25461 - DNA, 38 bp, Artificial Sequence
  Synthetic oligonucleotide
gaagagggcggacgggggagctagggcggaagatttga

SEQ ID NO: 25462 - DNA, 36 bp, Artificial Sequence
  Synthetic oligonucleotide
gttccatgtcgccgtggcatactaccaaattccata

SEQ ID NO: 25463 - DNA, 35 bp, Artificial Sequence
  Synthetic oligonucleotide
gttccctcgtccggccgtctaaactcgtccttact

SEQ ID NO: 25464 - DNA, 34 bp, Artificial Sequence
  Synthetic oligonucleotide
gatgatagggtagggtagtactggctagattggt

SEQ ID NO: 25465 - DNA, 36 bp, Artificial Sequence
  Synthetic oligonucleotide
gccccacccgaccaatccgcagtgtgctttcatcaa

SEQ ID NO: 25466 - DNA, 36 bp, Artificial Sequence
  Synthetic oligonucleotide
tgcacatacagcactcctccgctttagtttgagcca

SEQ ID NO: 25467 - DNA, 36 bp, Artificial Sequence
  Synthetic oligonucleotide
tgtccacccatctctctcagcgtagcaggcagtcca

SEQ ID NO: 25468 - DNA, 35 bp, Artificial Sequence
  Synthetic oligonucleotide
tacaccccgagaagaagaatgcaccaggcctgtca

SEQ ID NO: 25469 - DNA, 37 bp, Artificial Sequence
  Synthetic oligonucleotide
gcccagctctacgcgatcacctacgcattctctccga

SEQ ID NO: 25470 - DNA, 36 bp, Artificial Sequence
  Synthetic oligonucleotide
accgctcccatccaggtttgccctagccacccgtga

SEQ ID NO: 25471 - DNA, 38 bp, Artificial Sequence
  Synthetic oligonucleotide
tgagggtcgcgagtagtagaatgggattggaagggtga

SEQ ID NO: 25472 - DNA, 36 bp, Artificial Sequence
  Synthetic oligonucleotide
gagcggaacgccgtccttccacctcgcgccactgta

SEQ ID NO: 25473 - DNA, 35 bp, Artificial Sequence
  Synthetic oligonucleotide
agaggggacgccagcaccctcaaccttgtactacc

SEQ ID NO: 25474 - DNA, 35 bp, Artificial Sequence
  Synthetic oligonucleotide
caactcccaccttgagattctgtatcggttccaat

SEQ ID NO: 25475 - DNA, 35 bp, Artificial Sequence
  Synthetic oligonucleotide
agacttcccccctctcgcgctagtgtgctcttcat

SEQ ID NO: 25476 - DNA, 35 bp, Artificial Sequence
  Synthetic oligonucleotide
tcttgcccctgagctgatgaacccctcccttgctt

SEQ ID NO: 25477 - DNA, 35 bp, Artificial Sequence
  Synthetic oligonucleotide
gcctccaccgcactttactcccaagtgtacttaaa

SEQ ID NO: 25478 - DNA, 36 bp, Artificial Sequence
  Synthetic oligonucleotide
gagccgcccgggtggcgcaaaacctccattctatca

SEQ ID NO: 25479 - DNA, 37 bp, Artificial Sequence
  Synthetic oligonucleotide
tcctcctcatccggaattgtggcacttaggaccacga

SEQ ID NO: 25480 - DNA, 37 bp, Artificial Sequence
  Synthetic oligonucleotide
aggagatcggagaggggtgagggcaaggggaatagga

SEQ ID NO: 25481 - DNA, 37 bp, Artificial Sequence
  Synthetic oligonucleotide
tctcgccaccatactcatacctcaggcgtagccctga

SEQ ID NO: 25482 - DNA, 38 bp, Artificial Sequence
  Synthetic oligonucleotide
ggaccggcgtttccgacttctacactctcgcccgctga

SEQ ID NO: 25483 - DNA, 38 bp, Artificial Sequence
  Synthetic oligonucleotide
tcctgctcgagcgaatgcgatccactgcaaccacttga

SEQ ID NO: 25484 - DNA, 38 bp, Artificial Sequence
  Synthetic oligonucleotide
gtgcggtcgaaagggagggcgggtaatgtcggtgttga

SEQ ID NO: 25485 - DNA, 36 bp, Artificial Sequence
  Synthetic oligonucleotide
ttccgccaccatggctacttatcagttgatactata

SEQ ID NO: 25486 - DNA, 35 bp, Artificial Sequence
  Synthetic oligonucleotide
tcaccacgctatttggttatgaatcccccaccacc

SEQ ID NO: 25487 - DNA, 35 bp, Artificial Sequence
  Synthetic oligonucleotide
aagtggagaaagggataattactgggtgggagacg

SEQ ID NO: 25488 - DNA, 35 bp, Artificial Sequence
  Synthetic oligonucleotide
aagcccaacggctcgctgcccatcaacctgtctgg

SEQ ID NO: 25489 - DNA, 35 bp, Artificial Sequence
  Synthetic oligonucleotide
ttcacccgatcgtgagcccctgagtctttcctcct

SEQ ID NO: 25490 - DNA, 35 bp, Artificial Sequence
  Synthetic oligonucleotide
tccgtccacatcattcgaccgagtcctctgccttt

SEQ ID NO: 25491 - DNA, 35 bp, Artificial Sequence
  Synthetic oligonucleotide
tatcacgcttaggttagttgtggtcctggtgtttt

SEQ ID NO: 25492 - DNA, 36 bp, Artificial Sequence
  Synthetic oligonucleotide
gcaacctcacattccagcgacaagccattttcacga

SEQ ID NO: 25493 - DNA, 35 bp, Artificial Sequence
  Synthetic oligonucleotide
tactccctcctttcgtgactggtccgtcaagacga

SEQ ID NO: 25494 - DNA, 37 bp, Artificial Sequence
  Synthetic oligonucleotide
gtgctccatcccatcccgcaatgacccccgccaggga

SEQ ID NO: 25495 - DNA, 35 bp, Artificial Sequence
  Synthetic oligonucleotide
gcgtagcgccgacctttacgtcgtccacctgccta

SEQ ID NO: 25496 - DNA, 35 bp, Artificial Sequence
  Synthetic oligonucleotide
gcacggcccactccattgactgttctagccgttac

SEQ ID NO: 25497 - DNA, 35 bp, Artificial Sequence
  Synthetic oligonucleotide
tattccgcctggctgccttacatccttcgtaaccg

SEQ ID NO: 25498 - DNA, 35 bp, Artificial Sequence
  Synthetic oligonucleotide
ttcgatagcggggacatgaggtggggtggttggtt

SEQ ID NO: 25499 - DNA, 36 bp, Artificial Sequence
  Synthetic oligonucleotide
atgacctgactcccatttgcttctaagtcgacttaa

SEQ ID NO: 25500 - DNA, 35 bp, Artificial Sequence
  Synthetic oligonucleotide
atgcacacaacaagtgccccattgccgcacctcca

SEQ ID NO: 25501 - DNA, 37 bp, Artificial Sequence
  Synthetic oligonucleotide
acttccccacgccgctcatcgtcaagtccttcaccga

SEQ ID NO: 25502 - DNA, 38 bp, Artificial Sequence
  Synthetic oligonucleotide
accgacggctacatatcctctgctttcgcgacacctga

SEQ ID NO: 25503 - DNA, 38 bp, Artificial Sequence
  Synthetic oligonucleotide
taagcgcgccgcatgacccaccttccctttcgttctga

SEQ ID NO: 25504 - DNA, 38 bp, Artificial Sequence
  Synthetic oligonucleotide
tgtcctgcaactcatccgttttgcctactcttacgtga

SEQ ID NO: 25505 - DNA, 35 bp, Artificial Sequence
  Synthetic oligonucleotide
tttgacacccggttaatgtggttgttttttttgcc

SEQ ID NO: 25506 - DNA, 35 bp, Artificial Sequence
  Synthetic oligonucleotide
actcgcgtgcgctgtgccaccacgtcatcaatact

SEQ ID NO: 25507 - DNA, 35 bp, Artificial Sequence
  Synthetic oligonucleotide
gccgcccactgttctgtacgcacgtgtcgtaacct

SEQ ID NO: 25508 - DNA, 36 bp, Artificial Sequence
  Synthetic oligonucleotide
tgcaccacactggtccctataatgttcgctgattaa

SEQ ID NO: 25509 - DNA, 37 bp, Artificial Sequence
  Synthetic oligonucleotide
actacctgccccacatttaggttttcttgtgacgaga

SEQ ID NO: 25510 - DNA, 37 bp, Artificial Sequence
  Synthetic oligonucleotide
aaagcacgtatacctccatacccctcccgtctcgcga

SEQ ID NO: 25511 - DNA, 37 bp, Artificial Sequence
  Synthetic oligonucleotide
attcccaacgcctaacgagggcgtaacagtctctcga

SEQ ID NO: 25512 - DNA, 37 bp, Artificial Sequence
  Synthetic oligonucleotide
tgctcctagcagccccccttgtgcacttcttgcagga

SEQ ID NO: 25513 - DNA, 38 bp, Artificial Sequence
  Synthetic oligonucleotide
atcgcgcgggtgggtcgggaaatcgagggtagcactga

SEQ ID NO: 25514 - DNA, 38 bp, Artificial Sequence
  Synthetic oligonucleotide
tgccctgcccacgttgtcatctccgattctccgcgtga

SEQ ID NO: 25515 - DNA, 36 bp, Artificial Sequence
  Synthetic oligonucleotide
tcaccatggctgtgtaaacccgtcctcctgcatata

SEQ ID NO: 25516 - DNA, 35 bp, Artificial Sequence
  Synthetic oligonucleotide
gctaacccgctagacctgccttgagtggcccccac

SEQ ID NO: 25517 - DNA, 35 bp, Artificial Sequence
  Synthetic oligonucleotide
tctgacatgtgccaaaggtacaccagttacatccc

SEQ ID NO: 25518 - DNA, 34 bp, Artificial Sequence
  Synthetic oligonucleotide
tcctcccccaccctccatacgctgtgaacatgcc

SEQ ID NO: 25519 - DNA, 35 bp, Artificial Sequence
  Synthetic oligonucleotide
ttaggcactcctctccgtcagcatccctgtccttc

SEQ ID NO: 25520 - DNA, 35 bp, Artificial Sequence
  Synthetic oligonucleotide
atgtgggcaccgcaatttaacaccttatccttggt

SEQ ID NO: 25521 - DNA, 36 bp, Artificial Sequence
  Synthetic oligonucleotide
gcccctccgcagcgaacctctcagctacacccgctt

SEQ ID NO: 25522 - DNA, 36 bp, Artificial Sequence
  Synthetic oligonucleotide
accaaaccacgtactcgttgcgaaacatacattcaa

SEQ ID NO: 25523 - DNA, 36 bp, Artificial Sequence
  Synthetic oligonucleotide
tcaggccccctacaatctgtgcctgctacccgttaa

SEQ ID NO: 25524 - DNA, 35 bp, Artificial Sequence
  Synthetic oligonucleotide
ttagcattcgcacgtttcttggagcgccctcacca

SEQ ID NO: 25525 - DNA, 36 bp, Artificial Sequence
  Synthetic oligonucleotide
ttcacctccacggtacattgttctctgcctctgaga

SEQ ID NO: 25526 - DNA, 36 bp, Artificial Sequence
  Synthetic oligonucleotide
tcactagcacgtaactgtcctggccatatcgtacga

SEQ ID NO: 25527 - DNA, 37 bp, Artificial Sequence
  Synthetic oligonucleotide
gatggggccacctgatatagtaacaccgttccctcga

SEQ ID NO: 25528 - DNA, 37 bp, Artificial Sequence
  Synthetic oligonucleotide
tctcacccatgtaagcccgtatccgttctccgaggga

SEQ ID NO: 25529 - DNA, 38 bp, Artificial Sequence
  Synthetic oligonucleotide
gccattcgcgaaagcctttatcaccgggccaccaatga

SEQ ID NO: 25530 - DNA, 37 bp, Artificial Sequence
  Synthetic oligonucleotide
agctggtgggtcacggaatgcgtgggtggggcaatga

SEQ ID NO: 25531 - DNA, 35 bp, Artificial Sequence
  Synthetic oligonucleotide
tccatcctgagcccccagaaccgccaatttatgta

SEQ ID NO: 25532 - DNA, 35 bp, Artificial Sequence
  Synthetic oligonucleotide
taccgggcccgcctctaatgcaccatgtactcgcc

SEQ ID NO: 25533 - DNA, 35 bp, Artificial Sequence
  Synthetic oligonucleotide
actcccgcgtaacgcaactgcctggctccgtttcc

SEQ ID NO: 25534 - DNA, 35 bp, Artificial Sequence
  Synthetic oligonucleotide
tacgtgccacacatggttcatctcttgcgctgggc

SEQ ID NO: 25535 - DNA, 35 bp, Artificial Sequence
  Synthetic oligonucleotide
gtctcaatccgcagttccgttgtcgcaaccctctc

SEQ ID NO: 25536 - DNA, 35 bp, Artificial Sequence
  Synthetic oligonucleotide
gcctgggagaagaggttgtggaacgtagatagagg

SEQ ID NO: 25537 - DNA, 36 bp, Artificial Sequence
  Synthetic oligonucleotide
gcccgccctctctggacatgcacctatccatcagca

SEQ ID NO: 25538 - DNA, 36 bp, Artificial Sequence
  Synthetic oligonucleotide
gaacggggggggatgaagtttgtatggaagggtaga

SEQ ID NO: 25539 - DNA, 37 bp, Artificial Sequence
  Synthetic oligonucleotide
gccagggttcggggtagagggggaaagggcacaccga

SEQ ID NO: 25540 - DNA, 36 bp, Artificial Sequence
  Synthetic oligonucleotide
gacaccgcccatcaatcctacgagatccctttccga

SEQ ID NO: 25541 - DNA, 38 bp, Artificial Sequence
  Synthetic oligonucleotide
ttcaaggtcaacgcagactttttgcctccacaccctga

SEQ ID NO: 25542 - DNA, 38 bp, Artificial Sequence
  Synthetic oligonucleotide
tgcccgcattgccgtaacttgttaccccccactggtga

SEQ ID NO: 25543 - DNA, 36 bp, Artificial Sequence
  Synthetic oligonucleotide
gataggcacagttaatcctgaagcgccactatttga

SEQ ID NO: 25544 - DNA, 36 bp, Artificial Sequence
  Synthetic oligonucleotide
tccttcgccccgtctgtcctgatccaactcacccta

SEQ ID NO: 25545 - DNA, 36 bp, Artificial Sequence
  Synthetic oligonucleotide
taatggccacgtatccttgcttctctggtcctccta

SEQ ID NO: 25546 - DNA, 35 bp, Artificial Sequence
  Synthetic oligonucleotide
cccggacctcccattatggaactcgatcccctgac

SEQ ID NO: 25547 - DNA, 35 bp, Artificial Sequence
  Synthetic oligonucleotide
gcccaacccactagtgaatcacgtaacttgacgcc

SEQ ID NO: 25548 - DNA, 35 bp, Artificial Sequence
  Synthetic oligonucleotide
gtgcgggctccccaccttatgctatgtccaggtcc

SEQ ID NO: 25549 - DNA, 35 bp, Artificial Sequence
  Synthetic oligonucleotide
tagtacgacctggtatcccacatcctgtctgttat

SEQ ID NO: 25550 - DNA, 35 bp, Artificial Sequence
  Synthetic oligonucleotide
atatcgaacggcgggggaacaagggaaggcgcagt

SEQ ID NO: 25551 - DNA, 35 bp, Artificial Sequence
  Synthetic oligonucleotide
acacgctcggttgcgagttaccttcgatctccctt

SEQ ID NO: 25552 - DNA, 35 bp, Artificial Sequence
  Synthetic oligonucleotide
tagaacaacaccaccacgtcgcgttaactttcctt

SEQ ID NO: 25553 - DNA, 35 bp, Artificial Sequence
  Synthetic oligonucleotide
tagcccccgtcccttcccggtcctaaggttcattt

SEQ ID NO: 25554 - DNA, 35 bp, Artificial Sequence
  Synthetic oligonucleotide
gactcagtacgtcgcccttccttgccacactttaa

SEQ ID NO: 25555 - DNA, 35 bp, Artificial Sequence
  Synthetic oligonucleotide
attgcctacgaaagcccgtccaccatttcaccaca

SEQ ID NO: 25556 - DNA, 38 bp, Artificial Sequence
  Synthetic oligonucleotide
acatggccagtgtatagcctctccaccccgccatatga

SEQ ID NO: 25557 - DNA, 37 bp, Artificial Sequence
  Synthetic oligonucleotide
ttcctcacccccgaggcgtatgcctttgcctttatga

SEQ ID NO: 25558 - DNA, 38 bp, Artificial Sequence
  Synthetic oligonucleotide
ggtcgccccgtatatactacttccagctcaccacctga

SEQ ID NO: 25559 - DNA, 37 bp, Artificial Sequence
  Synthetic oligonucleotide
tgcgccctcaccctttcacgttcccactaaaacgtga

SEQ ID NO: 25560 - DNA, 35 bp, Artificial Sequence
  Synthetic oligonucleotide
atacagggcacggggggtgggaggggatcaaggtc

SEQ ID NO: 25561 - DNA, 35 bp, Artificial Sequence
  Synthetic oligonucleotide
gtctccgatccgtcccattgtaatccctgctggtc

SEQ ID NO: 25562 - DNA, 35 bp, Artificial Sequence
  Synthetic oligonucleotide
tctaacgtgcgcgcctgcccggctccatctcttag

SEQ ID NO: 25563 - DNA, 35 bp, Artificial Sequence
  Synthetic oligonucleotide
gcaaggggaggggtggttgcggaagggctgacagg

SEQ ID NO: 25564 - DNA, 35 bp, Artificial Sequence
  Synthetic oligonucleotide
tctgccatcacctatcgtgaactctagctgtacct

SEQ ID NO: 25565 - DNA, 37 bp, Artificial Sequence
  Synthetic oligonucleotide
tctaggccccgagcaccttgttttcaccctttccgga

SEQ ID NO: 25566 - DNA, 37 bp, Artificial Sequence
  Synthetic oligonucleotide
aaatccagcgaagtgccccctatcatcccccctgtga

SEQ ID NO: 25567 - DNA, 35 bp, Artificial Sequence
  Synthetic oligonucleotide
attccggaacagcatcttggcacaccccccctacc

SEQ ID NO: 25568 - DNA, 35 bp, Artificial Sequence
  Synthetic oligonucleotide
gaccacccatgatttgactttttgctccgactccc

SEQ ID NO: 25569 - DNA, 35 bp, Artificial Sequence
  Synthetic oligonucleotide
tgcttcacccaccagtagccatgcacagtatccgc

SEQ ID NO: 25570 - DNA, 35 bp, Artificial Sequence
  Synthetic oligonucleotide
ttgcacggccagagcctctgcctgaccttattcgc

SEQ ID NO: 25571 - DNA, 35 bp, Artificial Sequence
  Synthetic oligonucleotide
acatcacggggatgttccgtgtagtcgctttgcct

SEQ ID NO: 25572 - DNA, 38 bp, Artificial Sequence
  Synthetic oligonucleotide
accaccgcctctattcgccaccgtgacacggactttaa

SEQ ID NO: 25573 - DNA, 35 bp, Artificial Sequence
  Synthetic oligonucleotide
tacacctcccacgagacctgaacgagactctaaca

SEQ ID NO: 25574 - DNA, 38 bp, Artificial Sequence
  Synthetic oligonucleotide
acataccgccagttctgccttacatctggattaaatga

SEQ ID NO: 25575 - DNA, 38 bp, Artificial Sequence
  Synthetic oligonucleotide
acgctaaccctgcccgtgtagcaccactacttttatga

SEQ ID NO: 25576 - DNA, 38 bp, Artificial Sequence
  Synthetic oligonucleotide
accacgcacagcccccctccagacgcgacactcactga

SEQ ID NO: 25577 - DNA, 38 bp, Artificial Sequence
  Synthetic oligonucleotide
accccccccgatctgtctacacgccatccgttgactga

SEQ ID NO: 25578 - DNA, 38 bp, Artificial Sequence
  Synthetic oligonucleotide
atagtcgcagttgagggtggtcggggtggatatgctga

SEQ ID NO: 25579 - DNA, 36 bp, Artificial Sequence
  Synthetic oligonucleotide
ttgggcggatccagtgtgggaatcatgtgggggtga

SEQ ID NO: 25580 - DNA, 38 bp, Artificial Sequence
  Synthetic oligonucleotide
agatactggccacccccaatgcgttctcacgacattga

SEQ ID NO: 25581 - DNA, 38 bp, Artificial Sequence
  Synthetic oligonucleotide
tacgccccttttgacctatattacactgccctggttga

SEQ ID NO: 25582 - DNA, 35 bp, Artificial Sequence
  Synthetic oligonucleotide
acacatgcagttaccatctccgcacctctcaggta

SEQ ID NO: 25583 - DNA, 35 bp, Artificial Sequence
  Synthetic oligonucleotide
accccaccgatgttgggccctctaagtttgcatta

SEQ ID NO: 25584 - DNA, 37 bp, Artificial Sequence
  Synthetic oligonucleotide
gaccaccttcaagcgtctgccgcagtgctctggctcc

SEQ ID NO: 25585 - DNA, 35 bp, Artificial Sequence
  Synthetic oligonucleotide
tatgatccaacctagccgcacctagcttctcctgc

SEQ ID NO: 25586 - DNA, 35 bp, Artificial Sequence
  Synthetic oligonucleotide
tttgcttcccgggctggccttctttctgtctctgt

SEQ ID NO: 25587 - DNA, 35 bp, Artificial Sequence
  Synthetic oligonucleotide
tcagcccacttggaccatatgctaacgctgtctca

SEQ ID NO: 25588 - DNA, 37 bp, Artificial Sequence
  Synthetic oligonucleotide
gcggaccccgctcttttgccgtttcccacactttaga

SEQ ID NO: 25589 - DNA, 37 bp, Artificial Sequence
  Synthetic oligonucleotide
aataaccccgaccgttctgtctacatttctggcttga

SEQ ID NO: 25590 - DNA, 35 bp, Artificial Sequence
  Synthetic oligonucleotide
gattacccccagagactccctttctgtccagttta

SEQ ID NO: 25591 - DNA, 35 bp, Artificial Sequence
  Synthetic oligonucleotide
tccctgatgccagttggtcccgccccctaaatcac

SEQ ID NO: 25592 - DNA, 35 bp, Artificial Sequence
  Synthetic oligonucleotide
tgaacctccatagcgtgacgtcgcttttattaacc

SEQ ID NO: 25593 - DNA, 35 bp, Artificial Sequence
  Synthetic oligonucleotide
ctgtacgggcactggaacgcctccccatgccccgc

SEQ ID NO: 25594 - DNA, 35 bp, Artificial Sequence
  Synthetic oligonucleotide
accaggccctcagctggcaacccttctaacgccct

SEQ ID NO: 25595 - DNA, 35 bp, Artificial Sequence
  Synthetic oligonucleotide
atagtgccgcgggttcaacccacattttcatctct

SEQ ID NO: 25596 - DNA, 35 bp, Artificial Sequence
  Synthetic oligonucleotide
taccgccccaagaccttgcgattcggagtttcctt

SEQ ID NO: 25597 - DNA, 35 bp, Artificial Sequence
  Synthetic oligonucleotide
aaaccgtgcgcttacctcctcgacgtcttgttctt

SEQ ID NO: 25598 - DNA, 35 bp, Artificial Sequence
  Synthetic oligonucleotide
tgcactgccgagaaggccaacattaaacccgccca

SEQ ID NO: 25599 - DNA, 37 bp, Artificial Sequence
  Synthetic oligonucleotide
gactactccccacgttcgactcccagacgtcggtaga

SEQ ID NO: 25600 - DNA, 37 bp, Artificial Sequence
  Synthetic oligonucleotide
gacacatctgtatttccgcgtactaacatccctgcga

SEQ ID NO: 25601 - DNA, 37 bp, Artificial Sequence
  Synthetic oligonucleotide
tactgtgcaatgcctgcacgtacttcctctctctgga

SEQ ID NO: 25602 - DNA, 36 bp, Artificial Sequence
  Synthetic oligonucleotide
gaccacccgcgtacacaaacaacttcactctacgta

SEQ ID NO: 25603 - DNA, 35 bp, Artificial Sequence
  Synthetic oligonucleotide
ttgtgccacctagggtccacttttgcccacctacc

SEQ ID NO: 25604 - DNA, 35 bp, Artificial Sequence
  Synthetic oligonucleotide
tgactcctggcacgtcctatagctcaccctgtacc

SEQ ID NO: 25605 - DNA, 35 bp, Artificial Sequence
  Synthetic oligonucleotide
acccctgggcctcgagctgccttttagtgccactc

SEQ ID NO: 25606 - DNA, 35 bp, Artificial Sequence
  Synthetic oligonucleotide
atccgatcgaccattaccctccaagtgcaccctcg

SEQ ID NO: 25607 - DNA, 35 bp, Artificial Sequence
  Synthetic oligonucleotide
tagtgacgttagggagggctacggattagaaaagg

SEQ ID NO: 25608 - DNA, 35 bp, Artificial Sequence
  Synthetic oligonucleotide
tggggagggcctgggaggggtacaatagtacggtt

SEQ ID NO: 25609 - DNA, 35 bp, Artificial Sequence
  Synthetic oligonucleotide
accgacccatctatggcaaccagacacacacaaca

SEQ ID NO: 25610 - DNA, 36 bp, Artificial Sequence
  Synthetic oligonucleotide
gctgaaggcacgtgagcccaggcctggaattgttca

SEQ ID NO: 25611 - DNA, 37 bp, Artificial Sequence
  Synthetic oligonucleotide
ttcccccgcctgcacatagcgcacaccccccgtgcga

SEQ ID NO: 25612 - DNA, 37 bp, Artificial Sequence
  Synthetic oligonucleotide
tgtgacagcccctactttccataatgcctcgaatcga

SEQ ID NO: 25613 - DNA, 36 bp, Artificial Sequence
  Synthetic oligonucleotide
tgtggaacgtctgttttttttgccgctaacccccta

SEQ ID NO: 25614 - DNA, 35 bp, Artificial Sequence
  Synthetic oligonucleotide
tgctatcccccaaccttgtacatgaaccatggaac

SEQ ID NO: 25615 - DNA, 35 bp, Artificial Sequence
  Synthetic oligonucleotide
gatccaggatggcggcccacacccactcttcacac

SEQ ID NO: 25616 - DNA, 35 bp, Artificial Sequence
  Synthetic oligonucleotide
ttgccctccaagtgggttaactcatcatacccccc

SEQ ID NO: 25617 - DNA, 35 bp, Artificial Sequence
  Synthetic oligonucleotide
tgtctcggtcaagcatctctattcttccccctgcc

SEQ ID NO: 25618 - DNA, 35 bp, Artificial Sequence
  Synthetic oligonucleotide
gttgctgggcacgctgtcacccatatccatactcc

SEQ ID NO: 25619 - DNA, 35 bp, Artificial Sequence
  Synthetic oligonucleotide
agctacgcacaccattaacggccatgcaacatatc

SEQ ID NO: 25620 - DNA, 35 bp, Artificial Sequence
  Synthetic oligonucleotide
tccaccctaactcgcgcatgattggttcctcctcg

SEQ ID NO: 25621 - DNA, 35 bp, Artificial Sequence
  Synthetic oligonucleotide
actgaagaaatgaggattggaatacgggtgagggg

SEQ ID NO: 25622 - DNA, 35 bp, Artificial Sequence
  Synthetic oligonucleotide
gatcaacagcatcccattaaaccgtgcctgccatg

SEQ ID NO: 25623 - DNA, 36 bp, Artificial Sequence
  Synthetic oligonucleotide
ttacacccgagccccatgtacaacaatcttcgttca

SEQ ID NO: 25624 - DNA, 36 bp, Artificial Sequence
  Synthetic oligonucleotide
tacctagcctcctgaacaccagtcacccgtctcaga

SEQ ID NO: 25625 - DNA, 37 bp, Artificial Sequence
  Synthetic oligonucleotide
tccacctatcacgcttctcaatgagctcttgcctcga

SEQ ID NO: 25626 - DNA, 37 bp, Artificial Sequence
  Synthetic oligonucleotide
tactcccgctcaactgcgaccttgtcgttcgcttcga

SEQ ID NO: 25627 - DNA, 33 bp, Artificial Sequence
  Synthetic oligonucleotide
acgatgccccgctccacattctgtttgctagga

SEQ ID NO: 25628 - DNA, 37 bp, Artificial Sequence
  Synthetic oligonucleotide
acccacccccaaactgcccgtgttgtcgctcccttga

SEQ ID NO: 25629 - DNA, 38 bp, Artificial Sequence
  Synthetic oligonucleotide
gttgtagtgaagaggtgcgtataagggcggggggttga

SEQ ID NO: 25630 - DNA, 38 bp, Artificial Sequence
  Synthetic oligonucleotide
atgcgggtcgcccgttaaactgccctcttccgtgttga

SEQ ID NO: 25631 - DNA, 35 bp, Artificial Sequence
  Synthetic oligonucleotide
tgccgaactccctgcagctccctcctcggcacaac

SEQ ID NO: 25632 - DNA, 35 bp, Artificial Sequence
  Synthetic oligonucleotide
taacatcgccttgcccgagattccgaattcttccc

SEQ ID NO: 25633 - DNA, 35 bp, Artificial Sequence
  Synthetic oligonucleotide
gtaccccgccccgtgcaccgactcgagttacatgt

SEQ ID NO: 25634 - DNA, 36 bp, Artificial Sequence
  Synthetic oligonucleotide
gcgaccgcctcctactggctggaacacacctacaaa

SEQ ID NO: 25635 - DNA, 36 bp, Artificial Sequence
  Synthetic oligonucleotide
gaccggtctacacgagcatcaacccctgttttcaca

SEQ ID NO: 25636 - DNA, 36 bp, Artificial Sequence
  Synthetic oligonucleotide
tgctaccccttctttatgccgacgcctgtcctagca

SEQ ID NO: 25637 - DNA, 35 bp, Artificial Sequence
  Synthetic oligonucleotide
atgccaaccgcgcgagagcagtccacgcccactca

SEQ ID NO: 25638 - DNA, 36 bp, Artificial Sequence
  Synthetic oligonucleotide
attgataggggagggctggaacgggtaaaggggcga

SEQ ID NO: 25639 - DNA, 37 bp, Artificial Sequence
  Synthetic oligonucleotide
ggggggggtgggggtaggtgtgggttaagagaacgga

SEQ ID NO: 25640 - DNA, 37 bp, Artificial Sequence
  Synthetic oligonucleotide
tactggcaaactcaaggaggaacggggggtgggtgga

SEQ ID NO: 25641 - DNA, 38 bp, Artificial Sequence
  Synthetic oligonucleotide
atgccccgtccttgccatccggtaccccttcctcatga

SEQ ID NO: 25642 - DNA, 38 bp, Artificial Sequence
  Synthetic oligonucleotide
cccgtgtcctatttatttgttcctcagcccatccctga

SEQ ID NO: 25643 - DNA, 38 bp, Artificial Sequence
  Synthetic oligonucleotide
gaccgcccgccggtaattcacctcaactgaccttctga

SEQ ID NO: 25644 - DNA, 38 bp, Artificial Sequence
  Synthetic oligonucleotide
aacgacgacaacgatgcattacccccttctccctgtga

SEQ ID NO: 25645 - DNA, 36 bp, Artificial Sequence
  Synthetic oligonucleotide
actgacacgccgctcgccagttatcctgcaatctta

SEQ ID NO: 25646 - DNA, 35 bp, Artificial Sequence
  Synthetic oligonucleotide
gtgagaacccgaaagggtccattgagaattttgtc

SEQ ID NO: 25647 - DNA, 35 bp, Artificial Sequence
  Synthetic oligonucleotide
tgcaaactcgctatgtcccgctatacttacatcat

SEQ ID NO: 25648 - DNA, 35 bp, Artificial Sequence
  Synthetic oligonucleotide
attatcacaactgagccgccaaatctgccaccggt

SEQ ID NO: 25649 - DNA, 35 bp, Artificial Sequence
  Synthetic oligonucleotide
ttgacaccccggaaatagcgacgacatcttgctaa

SEQ ID NO: 25650 - DNA, 36 bp, Artificial Sequence
  Synthetic oligonucleotide
tatcatgtgcaccatgcgtgtcacctcgtgacttaa

SEQ ID NO: 25651 - DNA, 36 bp, Artificial Sequence
  Synthetic oligonucleotide
ggactccgagcagtcctttccttcgcccctctcaga

SEQ ID NO: 25652 - DNA, 37 bp, Artificial Sequence
  Synthetic oligonucleotide
gcacccctcatctcatccgggtcacttggacctccga

SEQ ID NO: 25653 - DNA, 36 bp, Artificial Sequence
  Synthetic oligonucleotide
gaggtgaagggtagatcgggctacgaagaggaagga

SEQ ID NO: 25654 - DNA, 37 bp, Artificial Sequence
  Synthetic oligonucleotide
agagggctggtggcctattggaacgtgggggaatgga

SEQ ID NO: 25655 - DNA, 37 bp, Artificial Sequence
  Synthetic oligonucleotide
aagcgactacagcgggttctgagggatggggggtgga

SEQ ID NO: 25656 - DNA, 38 bp, Artificial Sequence
  Synthetic oligonucleotide
tacacacagagtgtgaccgcgccttcccatgcacctga

SEQ ID NO: 25657 - DNA, 38 bp, Artificial Sequence
  Synthetic oligonucleotide
gcccagcctccgacgccacagcacacaaaatttcctga

SEQ ID NO: 25658 - DNA, 38 bp, Artificial Sequence
  Synthetic oligonucleotide
gcccaaaccctcacgaacccagtctgaagatcacttga

SEQ ID NO: 25659 - DNA, 35 bp, Artificial Sequence
  Synthetic oligonucleotide
ggaccaacccaggggctcaacacacacatcgagac

SEQ ID NO: 25660 - DNA, 35 bp, Artificial Sequence
  Synthetic oligonucleotide
gtacgcacagcggcatttcgcggctactcctaacc

SEQ ID NO: 25661 - DNA, 35 bp, Artificial Sequence
  Synthetic oligonucleotide
tactactgcgtgtaattgtctctctcgtcgccggc

SEQ ID NO: 25662 - DNA, 35 bp, Artificial Sequence
  Synthetic oligonucleotide
gagcccacaatgccattcccgcttttaactatttg

SEQ ID NO: 25663 - DNA, 35 bp, Artificial Sequence
  Synthetic oligonucleotide
ttgtgcccggctcatgtacggcctcactgactcca

SEQ ID NO: 25664 - DNA, 35 bp, Artificial Sequence
  Synthetic oligonucleotide
taggcgatggggtggggaaatgggaaaagcgggca

SEQ ID NO: 25665 - DNA, 38 bp, Artificial Sequence
  Synthetic oligonucleotide
gggactcgctctccatactgttaccccgccattcttga

SEQ ID NO: 25666 - DNA, 35 bp, Artificial Sequence
  Synthetic oligonucleotide
gtgttgcaagccgacgctgcacccccatattatac

SEQ ID NO: 25667 - DNA, 35 bp, Artificial Sequence
  Synthetic oligonucleotide
tgacaacactacgcctccacgatcggtttttatcg

SEQ ID NO: 25668 - DNA, 35 bp, Artificial Sequence
  Synthetic oligonucleotide
ttacgcagaacaccttcgggactcttccccctctg

SEQ ID NO: 25669 - DNA, 35 bp, Artificial Sequence
  Synthetic oligonucleotide
attgggagcggttagcgggggtggaaaggtgtttg

SEQ ID NO: 25670 - DNA, 35 bp, Artificial Sequence
  Synthetic oligonucleotide
tccaaggccaacgcccgactctcctcgatcactct

SEQ ID NO: 25671 - DNA, 36 bp, Artificial Sequence
  Synthetic oligonucleotide
aatggaggcctcaccctggtcgccctggtcttttca

SEQ ID NO: 25672 - DNA, 37 bp, Artificial Sequence
  Synthetic oligonucleotide
tcccgcctggttccgccccctcgttctcacgaagaga

SEQ ID NO: 25673 - DNA, 37 bp, Artificial Sequence
  Synthetic oligonucleotide
tactcgcaccatcgtaatgccagttttttaacctcga

SEQ ID NO: 25674 - DNA, 37 bp, Artificial Sequence
  Synthetic oligonucleotide
gggagagcgggggaacgcgcaaagggggaaaggggga

SEQ ID NO: 25675 - DNA, 37 bp, Artificial Sequence
  Synthetic oligonucleotide
gtgaatcagcgcactctatcttccgctcggtccctga

SEQ ID NO: 25676 - DNA, 37 bp, Artificial Sequence
  Synthetic oligonucleotide
gatagacgggagggtggaaaaaaaatgtggctagtga

SEQ ID NO: 25677 - DNA, 38 bp, Artificial Sequence
  Synthetic oligonucleotide
aatcaccacgacccgtgctaccaaacgtacgaccttga

SEQ ID NO: 25678 - DNA, 36 bp, Artificial Sequence
  Synthetic oligonucleotide
aacgcagtccagccacagctgaatcccaatccccta

SEQ ID NO: 25679 - DNA, 36 bp, Artificial Sequence
  Synthetic oligonucleotide
ttgtggactgagggggaaggggggaacatacggtta

SEQ ID NO: 25680 - DNA, 36 bp, Artificial Sequence
  Synthetic oligonucleotide
gcaacaccccacggtgtgccacccgacactccttta

SEQ ID NO: 25681 - DNA, 35 bp, Artificial Sequence
  Synthetic oligonucleotide
atcgcctaacctctgaggccatggttggttacccc

SEQ ID NO: 25682 - DNA, 35 bp, Artificial Sequence
  Synthetic oligonucleotide
tacccacctcattaggtcgcacttttggttagctc

SEQ ID NO: 25683 - DNA, 35 bp, Artificial Sequence
  Synthetic oligonucleotide
tcgagtgaggggacgggcttgaagggagcatgggg

SEQ ID NO: 25684 - DNA, 35 bp, Artificial Sequence
  Synthetic oligonucleotide
ggatcatcgtatcgcacgcacctccacgcaactgg

SEQ ID NO: 25685 - DNA, 36 bp, Artificial Sequence
  Synthetic oligonucleotide
gttcatcccggcgcccctacggtaaactgccttcaa

SEQ ID NO: 25686 - DNA, 37 bp, Artificial Sequence
  Synthetic oligonucleotide
acgatgggggagtgacgggaagaggggtacgggtaga

SEQ ID NO: 25687 - DNA, 38 bp, Artificial Sequence
  Synthetic oligonucleotide
atcacggggtggagggtacgggatcaaagcgccgctga

SEQ ID NO: 25688 - DNA, 37 bp, Artificial Sequence
  Synthetic oligonucleotide
ggtggaggaggggggaatacataaaagatgcacgtga

SEQ ID NO: 25689 - DNA, 37 bp, Artificial Sequence
  Synthetic oligonucleotide
aacagacgcactgggtcctcctactctattcgattga

SEQ ID NO: 25690 - DNA, 36 bp, Artificial Sequence
  Synthetic oligonucleotide
gctcgggggaagggtgggtggagagaaactgggcta

SEQ ID NO: 25691 - DNA, 35 bp, Artificial Sequence
  Synthetic oligonucleotide
tcctgcacagtttttccgctgtctttccccaggta

SEQ ID NO: 25692 - DNA, 35 bp, Artificial Sequence
  Synthetic oligonucleotide
gacaatcctccacgccgctcccgttttgaattacg

SEQ ID NO: 25693 - DNA, 35 bp, Artificial Sequence
  Synthetic oligonucleotide
tgaacccccaccgaaggcttggtttcttaaacact

SEQ ID NO: 25694 - DNA, 35 bp, Artificial Sequence
  Synthetic oligonucleotide
gtacacaccctttttttttgagcaaagagacttgt

SEQ ID NO: 25695 - DNA, 35 bp, Artificial Sequence
  Synthetic oligonucleotide
gccccggagcgcactgagaatcaattgccacactt

SEQ ID NO: 25696 - DNA, 35 bp, Artificial Sequence
  Synthetic oligonucleotide
gaggccggcctactcctcgtattatgcctgttgtt

SEQ ID NO: 25697 - DNA, 36 bp, Artificial Sequence
  Synthetic oligonucleotide
gcgcaacctcttggccattagccccgcgcattttaa

SEQ ID NO: 25698 - DNA, 36 bp, Artificial Sequence
  Synthetic oligonucleotide
ttcactcaggtctgtctcgccttacgccacgccaca

SEQ ID NO: 25699 - DNA, 36 bp, Artificial Sequence
  Synthetic oligonucleotide
tcactgcccccggtatttgttacgcatccggccaca

SEQ ID NO: 25700 - DNA, 36 bp, Artificial Sequence
  Synthetic oligonucleotide
tgcgtactacacagcttccattacactgaccgcaca

SEQ ID NO: 25701 - DNA, 36 bp, Artificial Sequence
  Synthetic oligonucleotide
accgaacgtgaggctatttagttctttcgcccttca

SEQ ID NO: 25702 - DNA, 37 bp, Artificial Sequence
  Synthetic oligonucleotide
tcccgctgggaaaggaaataggggaattaggcaagga

SEQ ID NO: 25703 - DNA, 36 bp, Artificial Sequence
  Synthetic oligonucleotide
gcaaaacccgccacctttttattggtcgctaccgga

SEQ ID NO: 25704 - DNA, 38 bp, Artificial Sequence
  Synthetic oligonucleotide
atccaccgttgcgttacacctcgtccttgactttatga

SEQ ID NO: 25705 - DNA, 36 bp, Artificial Sequence
  Synthetic oligonucleotide
taagctactccgtgcgcatcccccttcctgccttga

SEQ ID NO: 25706 - DNA, 38 bp, Artificial Sequence
  Synthetic oligonucleotide
gttgctccacattgatcatgctcatacacacactttga

SEQ ID NO: 25707 - DNA, 36 bp, Artificial Sequence
  Synthetic oligonucleotide
acgcctcaatcggtgcgtggccttttgctctaccta

SEQ ID NO: 25708 - DNA, 35 bp, Artificial Sequence
  Synthetic oligonucleotide
aacacgctggacgacccttcctttatttgcttacc

SEQ ID NO: 25709 - DNA, 35 bp, Artificial Sequence
  Synthetic oligonucleotide
gaatggggggagttggggcattcaatatggacgtg

SEQ ID NO: 25710 - DNA, 35 bp, Artificial Sequence
  Synthetic oligonucleotide
actcactcgccctcccgattcttctgtcttgtcct

SEQ ID NO: 25711 - DNA, 35 bp, Artificial Sequence
  Synthetic oligonucleotide
gtggttagcacaccccctaagttcggtctttcatt

SEQ ID NO: 25712 - DNA, 36 bp, Artificial Sequence
  Synthetic oligonucleotide
aaacgcacgctccctcatcggcctcttcagcacaaa

SEQ ID NO: 25713 - DNA, 36 bp, Artificial Sequence
  Synthetic oligonucleotide
tgcatccccccagccgagctttgttgagggaaataa

SEQ ID NO: 25714 - DNA, 35 bp, Artificial Sequence
  Synthetic oligonucleotide
tatcggtggtctcctcccccgtggaccctgccaca

SEQ ID NO: 25715 - DNA, 35 bp, Artificial Sequence
  Synthetic oligonucleotide
cctccctccccgacggttattcctgcccccgtgca

SEQ ID NO: 25716 - DNA, 37 bp, Artificial Sequence
  Synthetic oligonucleotide
tgactgtcccacccgcgccaccatgctttagatccga

SEQ ID NO: 25717 - DNA, 37 bp, Artificial Sequence
  Synthetic oligonucleotide
gtccgagtcccccccttagtgcgtccgaggcttccga

SEQ ID NO: 25718 - DNA, 37 bp, Artificial Sequence
  Synthetic oligonucleotide
gagtgtaggcgtgctagggggggcagtagggatggga

SEQ ID NO: 25719 - DNA, 38 bp, Artificial Sequence
  Synthetic oligonucleotide
tgccccgcgggcctgatattacgccaactctcttctga

SEQ ID NO: 25720 - DNA, 38 bp, Artificial Sequence
  Synthetic oligonucleotide
tgtacgatccacccccttctgaacagactgcccgttga

SEQ ID NO: 25721 - DNA, 36 bp, Artificial Sequence
  Synthetic oligonucleotide
acgttctccgctgatccctcctgccatcaatctcta

SEQ ID NO: 25722 - DNA, 37 bp, Artificial Sequence
  Synthetic oligonucleotide
ggggataggagtgataggattggagggtgggagggta

SEQ ID NO: 25723 - DNA, 35 bp, Artificial Sequence
  Synthetic oligonucleotide
gcctgacacgacctacgacaccagcggacccaccc

SEQ ID NO: 25724 - DNA, 35 bp, Artificial Sequence
  Synthetic oligonucleotide
tgcactgcccacgctctttgtccttccgaatggcc

SEQ ID NO: 25725 - DNA, 35 bp, Artificial Sequence
  Synthetic oligonucleotide
tatgcatggcctcgctctcttttaatttgatccgc

SEQ ID NO: 25726 - DNA, 35 bp, Artificial Sequence
  Synthetic oligonucleotide
gcaacttgcatgcactcaagcaccacctttctccg

SEQ ID NO: 25727 - DNA, 35 bp, Artificial Sequence
  Synthetic oligonucleotide
gtgtgggcaggaaggaaggggagcggctaaacaat

SEQ ID NO: 25728 - DNA, 35 bp, Artificial Sequence
  Synthetic oligonucleotide
gcgattacatctttggcgtatgcatctgctctcct

SEQ ID NO: 25729 - DNA, 35 bp, Artificial Sequence
  Synthetic oligonucleotide
gaaacaccctccccccgatagatgcatgagaatct

SEQ ID NO: 25730 - DNA, 36 bp, Artificial Sequence
  Synthetic oligonucleotide
gatcgccatgtcctgctctctcgtgcagtgcaatca

SEQ ID NO: 25731 - DNA, 35 bp, Artificial Sequence
  Synthetic oligonucleotide
gtaacaccgttcttccctgtcaaggtcatagttca

SEQ ID NO: 25732 - DNA, 37 bp, Artificial Sequence
  Synthetic oligonucleotide
ccacaccactccgacgtttactcgcgcactttgacga

SEQ ID NO: 25733 - DNA, 37 bp, Artificial Sequence
  Synthetic oligonucleotide
gctcgccaccccatttgaattgcccgtttcctctcga

SEQ ID NO: 25734 - DNA, 37 bp, Artificial Sequence
  Synthetic oligonucleotide
gtcatagtcgccgacggacaaggggagggtggtggga

SEQ ID NO: 25735 - DNA, 35 bp, Artificial Sequence
  Synthetic oligonucleotide
tgtgatccattgattcagccgatgccccgccgtta

SEQ ID NO: 25736 - DNA, 36 bp, Artificial Sequence
  Synthetic oligonucleotide
acgcgtggaggagggtaggtttgggtgggggtgtta

SEQ ID NO: 25737 - DNA, 35 bp, Artificial Sequence
  Synthetic oligonucleotide
ccccacccatcccgttttattcgtgcgcacccggc

SEQ ID NO: 25738 - DNA, 35 bp, Artificial Sequence
  Synthetic oligonucleotide
gaaccgcgcctcttgttacagctgctatctacatc

SEQ ID NO: 25739 - DNA, 35 bp, Artificial Sequence
  Synthetic oligonucleotide
gtacccgctcacctctcgctgtccgtaacaggatc

SEQ ID NO: 25740 - DNA, 35 bp, Artificial Sequence
  Synthetic oligonucleotide
gattcccgctcctcgtggctatactctaccgactc

SEQ ID NO: 25741 - DNA, 35 bp, Artificial Sequence
  Synthetic oligonucleotide
tgcatcagcctccacggtatcctgcgcctcgcttc

SEQ ID NO: 25742 - DNA, 35 bp, Artificial Sequence
  Synthetic oligonucleotide
gccgtgcgtgtaggtcgtctattaccatccttttc

SEQ ID NO: 25743 - DNA, 35 bp, Artificial Sequence
  Synthetic oligonucleotide
gccgactgttttgccttcccgttcaccccttaccg

SEQ ID NO: 25744 - DNA, 35 bp, Artificial Sequence
  Synthetic oligonucleotide
gaacgcatcgagggcattcctggtttctgtcttcg

SEQ ID NO: 25745 - DNA, 35 bp, Artificial Sequence
  Synthetic oligonucleotide
accacccctatcttggcctacctgtggtgacctat

SEQ ID NO: 25746 - DNA, 36 bp, Artificial Sequence
  Synthetic oligonucleotide
gttggcctcaccccgcctctaagctgttgattccaa

SEQ ID NO: 25747 - DNA, 36 bp, Artificial Sequence
  Synthetic oligonucleotide
gttgtgccacaacggatcgccgacttccttcgccca

SEQ ID NO: 25748 - DNA, 37 bp, Artificial Sequence
  Synthetic oligonucleotide
tccgatccgtcacagcagcaccatgaaccttgcacga

SEQ ID NO: 25749 - DNA, 37 bp, Artificial Sequence
  Synthetic oligonucleotide
tcaacaccaccgattttgtccgatcttttctgaatga

SEQ ID NO: 25750 - DNA, 38 bp, Artificial Sequence
  Synthetic oligonucleotide
ttggccgtcatatccaaacgttacctccgcctgcctga

SEQ ID NO: 25751 - DNA, 38 bp, Artificial Sequence
  Synthetic oligonucleotide
gatggtggaaggggctagatagcacagcatggaggtga

SEQ ID NO: 25752 - DNA, 37 bp, Artificial Sequence
  Synthetic oligonucleotide
gcatcggtcggagtgcgtgtgtggggttcgggggtga

SEQ ID NO: 25753 - DNA, 36 bp, Artificial Sequence
  Synthetic oligonucleotide
gtacgatcgaacattgccctccgtccagttttccta

SEQ ID NO: 25754 - DNA, 36 bp, Artificial Sequence
  Synthetic oligonucleotide
tatgcatggccatccattcatttgcccgtttccgta

SEQ ID NO: 25755 - DNA, 35 bp, Artificial Sequence
  Synthetic oligonucleotide
ccgataccgtcctgtcctgcaatcaaacacatacc

SEQ ID NO: 25756 - DNA, 35 bp, Artificial Sequence
  Synthetic oligonucleotide
aacttagcagcatactcgctaaatagttgccactc

SEQ ID NO: 25757 - DNA, 35 bp, Artificial Sequence
  Synthetic oligonucleotide
accatccgaccgcagtttgcttgtgcttgctattc

SEQ ID NO: 25758 - DNA, 35 bp, Artificial Sequence
  Synthetic oligonucleotide
actcacccggaatcattgaagcatagcccccgtag

SEQ ID NO: 25759 - DNA, 35 bp, Artificial Sequence
  Synthetic oligonucleotide
gtcatccacgccccctatacaatgtaccatctacg

SEQ ID NO: 25760 - DNA, 35 bp, Artificial Sequence
  Synthetic oligonucleotide
tcagcccgccgcggcaccttattcaatcctatggt

SEQ ID NO: 25761 - DNA, 36 bp, Artificial Sequence
  Synthetic oligonucleotide
gtggtggttcggtctgggcggcgggacgggaggaga

SEQ ID NO: 25762 - DNA, 37 bp, Artificial Sequence
  Synthetic oligonucleotide
tcccccgctgagcccgttcacccagattttcacgcga

SEQ ID NO: 25763 - DNA, 37 bp, Artificial Sequence
  Synthetic oligonucleotide
gcacgacggggcttcgcatgttcacttctttcttcga

SEQ ID NO: 25764 - DNA, 37 bp, Artificial Sequence
  Synthetic oligonucleotide
gcacatacccgtgagccttaaagtcctgacgtttcga

SEQ ID NO: 25765 - DNA, 38 bp, Artificial Sequence
  Synthetic oligonucleotide
accacccgggcaatggcgtttttgcctcccgtacatga

SEQ ID NO: 25766 - DNA, 38 bp, Artificial Sequence
  Synthetic oligonucleotide
gcccaaacgctccagttgtcacaccacctcaatcatga

SEQ ID NO: 25767 - DNA, 36 bp, Artificial Sequence
  Synthetic oligonucleotide
tccaccgagctccagtgcttgctttttctgttctga

SEQ ID NO: 25768 - DNA, 38 bp, Artificial Sequence
  Synthetic oligonucleotide
tcgaataactcaccggtggtgaactgccccctacttga

SEQ ID NO: 25769 - DNA, 35 bp, Artificial Sequence
  Synthetic oligonucleotide
gcatcgcctgcccccccttttgtgtcgtacacata

SEQ ID NO: 25770 - DNA, 35 bp, Artificial Sequence
  Synthetic oligonucleotide
gccgccactccactatatcgccagagattttcacc

SEQ ID NO: 25771 - DNA, 35 bp, Artificial Sequence
  Synthetic oligonucleotide
atcgccatctcctgactaacttgccgggatgcccc

SEQ ID NO: 25772 - DNA, 35 bp, Artificial Sequence
  Synthetic oligonucleotide
gacattgtgtaccgcaaatcaccgccctcgccgcc

SEQ ID NO: 25773 - DNA, 35 bp, Artificial Sequence
  Synthetic oligonucleotide
ttaaaccccgccgtgatgcggcccccttcctccgc

SEQ ID NO: 25774 - DNA, 35 bp, Artificial Sequence
  Synthetic oligonucleotide
atgcggtcgcgcaactagcctccaccgttccactg

SEQ ID NO: 25775 - DNA, 35 bp, Artificial Sequence
  Synthetic oligonucleotide
gtaaccccggccgaacaatccgttctgtttcacct

SEQ ID NO: 25776 - DNA, 36 bp, Artificial Sequence
  Synthetic oligonucleotide
gcacttgctcacattccacccgttagaccgctagca

SEQ ID NO: 25777 - DNA, 36 bp, Artificial Sequence
  Synthetic oligonucleotide
ttgcaccacccgccatccatgtctcacaatcgtgca

SEQ ID NO: 25778 - DNA, 38 bp, Artificial Sequence
  Synthetic oligonucleotide
tagcaaccactacccttacgcacccagtccagtcatga

SEQ ID NO: 25779 - DNA, 35 bp, Artificial Sequence
  Synthetic oligonucleotide
tccagctccgctcaagtttgacgtttgatcccccc

SEQ ID NO: 25780 - DNA, 35 bp, Artificial Sequence
  Synthetic oligonucleotide
accctatgtgtcgggcctcttcctaccgtcccgcc

SEQ ID NO: 25781 - DNA, 36 bp, Artificial Sequence
  Synthetic oligonucleotide
gttacagcacactcgctctatgtgctccttcgttgc

SEQ ID NO: 25782 - DNA, 35 bp, Artificial Sequence
  Synthetic oligonucleotide
tcaattccgcccctagttgccttcccctttttggt

SEQ ID NO: 25783 - DNA, 36 bp, Artificial Sequence
  Synthetic oligonucleotide
gcgaacaggatggacgggggggtgagtgagtgtgaa

SEQ ID NO: 25784 - DNA, 35 bp, Artificial Sequence
  Synthetic oligonucleotide
gtctccgcccgttcactctctgactcaacagtcca

SEQ ID NO: 25785 - DNA, 36 bp, Artificial Sequence
  Synthetic oligonucleotide
tgttaaggagggggaatggagagcgggtaagaagga

SEQ ID NO: 25786 - DNA, 37 bp, Artificial Sequence
  Synthetic oligonucleotide
gcgccggcctccttgtacttgttctcatcaccccgga

SEQ ID NO: 25787 - DNA, 36 bp, Artificial Sequence
  Synthetic oligonucleotide
gcctcgacgggggagtggtgggggggtgagtaggga

SEQ ID NO: 25788 - DNA, 37 bp, Artificial Sequence
  Synthetic oligonucleotide
agccacccaccgtgacctccctagcagaattgcgtga

SEQ ID NO: 25789 - DNA, 35 bp, Artificial Sequence
  Synthetic oligonucleotide
agcgcccgcaagaacgccttccccttatgatgaac

SEQ ID NO: 25790 - DNA, 35 bp, Artificial Sequence
  Synthetic oligonucleotide
tcaccgctgggggtagctccgagtcccgaccctac

SEQ ID NO: 25791 - DNA, 35 bp, Artificial Sequence
  Synthetic oligonucleotide
ataacgggaacgcactgcttacccatccatcctcc

SEQ ID NO: 25792 - DNA, 35 bp, Artificial Sequence
  Synthetic oligonucleotide
gtgggcaatggggagttaggcgaaaatcgaggttg

SEQ ID NO: 25793 - DNA, 35 bp, Artificial Sequence
  Synthetic oligonucleotide
aatatcgcactcgcccccgcaacgctcccctacct

SEQ ID NO: 25794 - DNA, 36 bp, Artificial Sequence
  Synthetic oligonucleotide
tagaggtggcacgggaaacagggatagaggaggaaa

SEQ ID NO: 25795 - DNA, 38 bp, Artificial Sequence
  Synthetic oligonucleotide
accaccttcgcaggtgtcccataacgtcgccctcctga

SEQ ID NO: 25796 - DNA, 38 bp, Artificial Sequence
  Synthetic oligonucleotide
gcacactccgccgcacacgccaaccaccggtgaggtga

SEQ ID NO: 25797 - DNA, 36 bp, Artificial Sequence
  Synthetic oligonucleotide
taccctcggccactttgtcctcgcactcttcaatta

SEQ ID NO: 25798 - DNA, 35 bp, Artificial Sequence
  Synthetic oligonucleotide
gacctccttgtcgtccagacgttccactccacccc

SEQ ID NO: 25799 - DNA, 36 bp, Artificial Sequence
  Synthetic oligonucleotide
tccattcgactcgatgtgaccgctctataccccccc

SEQ ID NO: 25800 - DNA, 35 bp, Artificial Sequence
  Synthetic oligonucleotide
tggtctcgcagagcgcccttcgtttcacctgcctc

SEQ ID NO: 25801 - DNA, 35 bp, Artificial Sequence
  Synthetic oligonucleotide
tccttcgcacccgacacttaccgtatggtacgcct

SEQ ID NO: 25802 - DNA, 35 bp, Artificial Sequence
  Synthetic oligonucleotide
tccccttcctccgtgacgtatcatgcaatgtgctt

SEQ ID NO: 25803 - DNA, 35 bp, Artificial Sequence
  Synthetic oligonucleotide
aatcaaccaccctcacatcgtccgagagccatgaa

SEQ ID NO: 25804 - DNA, 37 bp, Artificial Sequence
  Synthetic oligonucleotide
tccgacccccctcgatagcccgttttcctttcgtaga

SEQ ID NO: 25805 - DNA, 37 bp, Artificial Sequence
  Synthetic oligonucleotide
tccggggccacaattctaccaaggttactaccctcga

SEQ ID NO: 25806 - DNA, 38 bp, Artificial Sequence
  Synthetic oligonucleotide
gaataacaaggagggagcggggggagacggaggggtga

SEQ ID NO: 25807 - DNA, 35 bp, Artificial Sequence
  Synthetic oligonucleotide
gcaagtgggccgggggtggagatgcaggagtgtga

SEQ ID NO: 25808 - DNA, 38 bp, Artificial Sequence
  Synthetic oligonucleotide
tacctcgcacatttctacaggtccatcatatcctttga

SEQ ID NO: 25809 - DNA, 35 bp, Artificial Sequence
  Synthetic oligonucleotide
ttgatgctttgcgtttgactcgccctcctttcccc

SEQ ID NO: 25810 - DNA, 35 bp, Artificial Sequence
  Synthetic oligonucleotide
attcatccgagctattgccctgttgtttgccctcc

SEQ ID NO: 25811 - DNA, 35 bp, Artificial Sequence
  Synthetic oligonucleotide
accccccccatgatgcatagcccacggttccctcc

SEQ ID NO: 25812 - DNA, 35 bp, Artificial Sequence
  Synthetic oligonucleotide
aatgtgtgcaggaatttggataatcatagggacgg

SEQ ID NO: 25813 - DNA, 35 bp, Artificial Sequence
  Synthetic oligonucleotide
aatgcaccttggaccccaccccgacacctaggcct

SEQ ID NO: 25814 - DNA, 35 bp, Artificial Sequence
  Synthetic oligonucleotide
tctgcaagacgcctatccgcttttctgaccgaaca

SEQ ID NO: 25815 - DNA, 35 bp, Artificial Sequence
  Synthetic oligonucleotide
accttggccccggcccagagttctgtcactcccca

SEQ ID NO: 25816 - DNA, 37 bp, Artificial Sequence
  Synthetic oligonucleotide
tattgccagcacacctgtaccatcttatacaccccga

SEQ ID NO: 25817 - DNA, 37 bp, Artificial Sequence
  Synthetic oligonucleotide
atggcccagggattgccactcgccacatttctatcga

SEQ ID NO: 25818 - DNA, 35 bp, Artificial Sequence
  Synthetic oligonucleotide
taagcatgcccatctattcaaacgcattcctccac

SEQ ID NO: 25819 - DNA, 35 bp, Artificial Sequence
  Synthetic oligonucleotide
atgcccgtcccttaccatccgtgagtagttccacc

SEQ ID NO: 25820 - DNA, 35 bp, Artificial Sequence
  Synthetic oligonucleotide
gatgcaacagttcgaattacagctcgactaccctc

SEQ ID NO: 25821 - DNA, 35 bp, Artificial Sequence
  Synthetic oligonucleotide
gttgccacgcattccagcgggtagcctggaaccct

SEQ ID NO: 25822 - DNA, 35 bp, Artificial Sequence
  Synthetic oligonucleotide
gcgggctaactagtcgcgcgtttcattgcctgcct

SEQ ID NO: 25823 - DNA, 35 bp, Artificial Sequence
  Synthetic oligonucleotide
gtgacaagcatcccacacccaaggactccaaagtt

SEQ ID NO: 25824 - DNA, 36 bp, Artificial Sequence
  Synthetic oligonucleotide
actgtccccgtactcctgactctcaccccgtctgaa

SEQ ID NO: 25825 - DNA, 38 bp, Artificial Sequence
  Synthetic oligonucleotide
tcatcgcagtccccttgtgcactgcgccttacctttga

SEQ ID NO: 25826 - DNA, 35 bp, Artificial Sequence
  Synthetic oligonucleotide
tagcgagcgccatgtcattctttgtggcctgttac

SEQ ID NO: 25827 - DNA, 35 bp, Artificial Sequence
  Synthetic oligonucleotide
tcgcgctcccacttcgcccacccacaacgttgacc

SEQ ID NO: 25828 - DNA, 35 bp, Artificial Sequence
  Synthetic oligonucleotide
gaccccggtcccggtactccgctaggagtccatcc

SEQ ID NO: 25829 - DNA, 36 bp, Artificial Sequence
  Synthetic oligonucleotide
gtcacgtcgccatgtcgccccttatccttcctcgaa

SEQ ID NO: 25830 - DNA, 37 bp, Artificial Sequence
  Synthetic oligonucleotide
ggacgacgtgggcggggtggcaaaagttgatgtgaga

SEQ ID NO: 25831 - DNA, 37 bp, Artificial Sequence
  Synthetic oligonucleotide
ggggtgcgcaactgaacctccacctcccaaacacgga

SEQ ID NO: 25832 - DNA, 37 bp, Artificial Sequence
  Synthetic oligonucleotide
actgagacacatgggggaggcaacgaagcgggatgga

SEQ ID NO: 25833 - DNA, 38 bp, Artificial Sequence
  Synthetic oligonucleotide
gtaggggggacacgattgaggagggactgggtaggtga

SEQ ID NO: 25834 - DNA, 38 bp, Artificial Sequence
  Synthetic oligonucleotide
aacagagagacggggaagcggggtggcaatatgtttga

SEQ ID NO: 25835 - DNA, 35 bp, Artificial Sequence
  Synthetic oligonucleotide
gttgaaacaatgccctagcgaagccagttcccatc

SEQ ID NO: 25836 - DNA, 37 bp, Artificial Sequence
  Synthetic oligonucleotide
tgcctgccgctccttcatggcatctaaaactgaccga

SEQ ID NO: 25837 - DNA, 36 bp, Artificial Sequence
  Synthetic oligonucleotide
tctaggccaccccccgggccccctttctcttgtgga

SEQ ID NO: 25838 - DNA, 38 bp, Artificial Sequence
  Synthetic oligonucleotide
agtcaagacgctcctgcccatcccccgccatgctgtga

SEQ ID NO: 25839 - DNA, 36 bp, Artificial Sequence
  Synthetic oligonucleotide
gtgctggccagcctgctacgacccaaccaatgaata

SEQ ID NO: 25840 - DNA, 35 bp, Artificial Sequence
  Synthetic oligonucleotide
atgtcgcccattcctctgttcgctttctgaagaac

SEQ ID NO: 25841 - DNA, 35 bp, Artificial Sequence
  Synthetic oligonucleotide
tcctcgacgccgaaattttcatgcctatctgacac

SEQ ID NO: 25842 - DNA, 35 bp, Artificial Sequence
  Synthetic oligonucleotide
attatcgcccacctacccgccatacgtttcccacg

SEQ ID NO: 25843 - DNA, 35 bp, Artificial Sequence
  Synthetic oligonucleotide
tggaccccaaggtggaggggaaaggggctggatgg

SEQ ID NO: 25844 - DNA, 33 bp, Artificial Sequence
  Synthetic oligonucleotide
agtacccagctccgcctgccattgccgatatct

SEQ ID NO: 25845 - DNA, 35 bp, Artificial Sequence
  Synthetic oligonucleotide
tgtgatgccatggtctgcgcttttaacccctttgt

SEQ ID NO: 25846 - DNA, 35 bp, Artificial Sequence
  Synthetic oligonucleotide
acgtccgacccgcctgattttaggcacccttcctt

SEQ ID NO: 25847 - DNA, 35 bp, Artificial Sequence
  Synthetic oligonucleotide
gtctgcctactgttttcaagccccacttatagctt

SEQ ID NO: 25848 - DNA, 35 bp, Artificial Sequence
  Synthetic oligonucleotide
tgacccgttcaatggttgcgtactctcgatctttt

SEQ ID NO: 25849 - DNA, 36 bp, Artificial Sequence
  Synthetic oligonucleotide
ttaccgaacctgaccacccggggacccgggcctgca

SEQ ID NO: 25850 - DNA, 36 bp, Artificial Sequence
  Synthetic oligonucleotide
ggagcatacgccggcctctcgaacaccctcgttgca

SEQ ID NO: 25851 - DNA, 36 bp, Artificial Sequence
  Synthetic oligonucleotide
gccttgcgcaaatcgagttaccttatccgcgtttca

SEQ ID NO: 25852 - DNA, 37 bp, Artificial Sequence
  Synthetic oligonucleotide
aacacgccggtttcaatgctccactctccattatgga

SEQ ID NO: 25853 - DNA, 37 bp, Artificial Sequence
  Synthetic oligonucleotide
tccgtgctaacgtttcctctacccgctgtctcactga

SEQ ID NO: 25854 - DNA, 35 bp, Artificial Sequence
  Synthetic oligonucleotide
gttgcgactgcctccaaccacatcgttaaccctga

SEQ ID NO: 25855 - DNA, 38 bp, Artificial Sequence
  Synthetic oligonucleotide
tacggggggggatgacgagggccagggtgatgacgtga

SEQ ID NO: 25856 - DNA, 35 bp, Artificial Sequence
  Synthetic oligonucleotide
gtgaccagcacgttgtatttcctgacctatctccc

SEQ ID NO: 25857 - DNA, 35 bp, Artificial Sequence
  Synthetic oligonucleotide
gatggttagtgtgcatgcgttaatattgttccgtc

SEQ ID NO: 25858 - DNA, 35 bp, Artificial Sequence
  Synthetic oligonucleotide
acagcccgcaattccggttttcgcaggcggtcttc

SEQ ID NO: 25859 - DNA, 35 bp, Artificial Sequence
  Synthetic oligonucleotide
gccacccaatcgggctaacgctttccgcatcccat

SEQ ID NO: 25860 - DNA, 35 bp, Artificial Sequence
  Synthetic oligonucleotide
acagccctcgtggaagtccatcgcatctattccct

SEQ ID NO: 25861 - DNA, 35 bp, Artificial Sequence
  Synthetic oligonucleotide
agatcgttcacatgcccatccttagggtgcctcct

SEQ ID NO: 25862 - DNA, 35 bp, Artificial Sequence
  Synthetic oligonucleotide
gcgctcctcctgccaccaaacgtgttatttaacca

SEQ ID NO: 25863 - DNA, 36 bp, Artificial Sequence
  Synthetic oligonucleotide
gcaacctcccccgcccatacgcggatattcccacca

SEQ ID NO: 25864 - DNA, 35 bp, Artificial Sequence
  Synthetic oligonucleotide
tcgatcctgagcaagaactctacatccacgtgcca

SEQ ID NO: 25865 - DNA, 35 bp, Artificial Sequence
  Synthetic oligonucleotide
gtcactccctagctccctattgtttgtgtcatgca

SEQ ID NO: 25866 - DNA, 36 bp, Artificial Sequence
  Synthetic oligonucleotide
gacggaagcgcttgcccgttcgctccattccactca

SEQ ID NO: 25867 - DNA, 37 bp, Artificial Sequence
  Synthetic oligonucleotide
ttttgacgcgcccaccatgtttgcccccttgtaccga

SEQ ID NO: 25868 - DNA, 36 bp, Artificial Sequence
  Synthetic oligonucleotide
tttaccgccctgcttaccctcgtccagtttccgcga

SEQ ID NO: 25869 - DNA, 37 bp, Artificial Sequence
  Synthetic oligonucleotide
actacgcctagcaagtgcccagcctaacaaccctcga

SEQ ID NO: 25870 - DNA, 37 bp, Artificial Sequence
  Synthetic oligonucleotide
tgcccacatctgcctgccctttatttagccactctga

SEQ ID NO: 25871 - DNA, 38 bp, Artificial Sequence
  Synthetic oligonucleotide
gcgtgtacgccacaaaaactgcgctgccactcccttga

SEQ ID NO: 25872 - DNA, 36 bp, Artificial Sequence
  Synthetic oligonucleotide
gttacccacttgattgaccgcactcgcccttccgta

SEQ ID NO: 25873 - DNA, 35 bp, Artificial Sequence
  Synthetic oligonucleotide
aaccgcccaccgtgcgttaatcgacggacctcccc

SEQ ID NO: 25874 - DNA, 35 bp, Artificial Sequence
  Synthetic oligonucleotide
gcgccaatgccaccactccgtacttacctagctgc

SEQ ID NO: 25875 - DNA, 35 bp, Artificial Sequence
  Synthetic oligonucleotide
ggtagccgcaactctctatcacgtccgtcttcact

SEQ ID NO: 25876 - DNA, 36 bp, Artificial Sequence
  Synthetic oligonucleotide
tgtaccatccgttgcacgcggaaacgctcttacgca

SEQ ID NO: 25877 - DNA, 37 bp, Artificial Sequence
  Synthetic oligonucleotide
attgaccgccgacccatacacaccagcgcttgtacga

SEQ ID NO: 25878 - DNA, 37 bp, Artificial Sequence
  Synthetic oligonucleotide
agtcgccacgccacgatactggccccccccatcccga

SEQ ID NO: 25879 - DNA, 37 bp, Artificial Sequence
  Synthetic oligonucleotide
gcccacccagacccataccgggacactcaatcgccga

SEQ ID NO: 25880 - DNA, 37 bp, Artificial Sequence
  Synthetic oligonucleotide
atgcactacctacgtatgtcctatagtttgccctcga

SEQ ID NO: 25881 - DNA, 36 bp, Artificial Sequence
  Synthetic oligonucleotide
gaagtgcatggactggcggtggttagtgaggaggga

SEQ ID NO: 25882 - DNA, 36 bp, Artificial Sequence
  Synthetic oligonucleotide
ttacgcccaatccgtattgcaccgacttttccggga

SEQ ID NO: 25883 - DNA, 37 bp, Artificial Sequence
  Synthetic oligonucleotide
gtgtagtcgggacgcccctccatcactccgtgcctga

SEQ ID NO: 25884 - DNA, 38 bp, Artificial Sequence
  Synthetic oligonucleotide
tgagggagatgtaggtcgcgggggagggcggaacgtga

SEQ ID NO: 25885 - DNA, 36 bp, Artificial Sequence
  Synthetic oligonucleotide
agcaactacaccacatttacaccccaggagtgccta

SEQ ID NO: 25886 - DNA, 35 bp, Artificial Sequence
  Synthetic oligonucleotide
tctgacaccatcctgtaaatactcacttatgctta

SEQ ID NO: 25887 - DNA, 35 bp, Artificial Sequence
  Synthetic oligonucleotide
acactgctcaacattggttccctcaaggctcattc

SEQ ID NO: 25888 - DNA, 35 bp, Artificial Sequence
  Synthetic oligonucleotide
gcatcttggagtggtccttgcgtactgttcctttc

SEQ ID NO: 25889 - DNA, 35 bp, Artificial Sequence
  Synthetic oligonucleotide
gagggaggtgagtggaagtggggtggttgtcattg

SEQ ID NO: 25890 - DNA, 36 bp, Artificial Sequence
  Synthetic oligonucleotide
tgggcccgctctagagccaccacctactgccacgaa

SEQ ID NO: 25891 - DNA, 36 bp, Artificial Sequence
  Synthetic oligonucleotide
acatacccttagcccatgtaaagctacactccctca

SEQ ID NO: 25892 - DNA, 37 bp, Artificial Sequence
  Synthetic oligonucleotide
taacccacggggctcctgtacctactaccaatttgga

SEQ ID NO: 25893 - DNA, 38 bp, Artificial Sequence
  Synthetic oligonucleotide
aaccaccctgcctcatttctgcgtcccatgacgagtga

SEQ ID NO: 25894 - DNA, 35 bp, Artificial Sequence
  Synthetic oligonucleotide
aacccaccagtgcctcaccatccattcagccgtga

SEQ ID NO: 25895 - DNA, 38 bp, Artificial Sequence
  Synthetic oligonucleotide
tttagcctccccatacccaatagcttgtcaccgtgtga

SEQ ID NO: 25896 - DNA, 33 bp, Artificial Sequence
  Synthetic oligonucleotide
tgacccgtatatccgcaacacacaccgcacgtc

SEQ ID NO: 25897 - DNA, 35 bp, Artificial Sequence
  Synthetic oligonucleotide
aaaaagggcggtataaggtaggtggatcgggttag

SEQ ID NO: 25898 - DNA, 35 bp, Artificial Sequence
  Synthetic oligonucleotide
ttctactcaccctcgtttttctgcgccctcgttcg

SEQ ID NO: 25899 - DNA, 35 bp, Artificial Sequence
  Synthetic oligonucleotide
gtaagaaagggtgggtgtacggggggactggtggg

SEQ ID NO: 25900 - DNA, 35 bp, Artificial Sequence
  Synthetic oligonucleotide
gactcgcaggataccttactcaaagtcatgctcct

SEQ ID NO: 25901 - DNA, 35 bp, Artificial Sequence
  Synthetic oligonucleotide
tacacaccgtacaagcctcccttcggtttctgtct

SEQ ID NO: 25902 - DNA, 35 bp, Artificial Sequence
  Synthetic oligonucleotide
gtatccgctccacgaccccagtctaaatgcctctt

SEQ ID NO: 25903 - DNA, 37 bp, Artificial Sequence
  Synthetic oligonucleotide
aatacgcactcgcatcagctgatcacaccattcccga

SEQ ID NO: 25904 - DNA, 37 bp, Artificial Sequence
  Synthetic oligonucleotide
tacttccactatgcgtgttcataccttcttcctggga

SEQ ID NO: 25905 - DNA, 38 bp, Artificial Sequence
  Synthetic oligonucleotide
atcactcctatccccatgcgtatgcgcgaagtcactga

SEQ ID NO: 25906 - DNA, 38 bp, Artificial Sequence
  Synthetic oligonucleotide
gttgggcgcaatcctgctcatctgttacctttctgtga

SEQ ID NO: 25907 - DNA, 36 bp, Artificial Sequence
  Synthetic oligonucleotide
gtctcgcaggcttggggccttcccaccaccactgta

SEQ ID NO: 25908 - DNA, 35 bp, Artificial Sequence
  Synthetic oligonucleotide
gtccctaccgcctaccctcgggtgttctaaccgac

SEQ ID NO: 25909 - DNA, 35 bp, Artificial Sequence
  Synthetic oligonucleotide
tgacgcaacccaagctgaacactatccatttggcc

SEQ ID NO: 25910 - DNA, 35 bp, Artificial Sequence
  Synthetic oligonucleotide
atcccaccactatgaccactcgcacgggccatcgc

SEQ ID NO: 25911 - DNA, 35 bp, Artificial Sequence
  Synthetic oligonucleotide
acccttccactcctgatcgttttgccttgatcgtt

SEQ ID NO: 25912 - DNA, 36 bp, Artificial Sequence
  Synthetic oligonucleotide
tatgcacagtgttcccgccgtccacttctagccaca

SEQ ID NO: 25913 - DNA, 36 bp, Artificial Sequence
  Synthetic oligonucleotide
ggagggagggtgtgggggggctttggcctattgaca

SEQ ID NO: 25914 - DNA, 35 bp, Artificial Sequence
  Synthetic oligonucleotide
tacgcgaagtgcacacacgcggcccccccgaacca

SEQ ID NO: 25915 - DNA, 36 bp, Artificial Sequence
  Synthetic oligonucleotide
gatccatgagttggactcatgcatgcctctccacca

SEQ ID NO: 25916 - DNA, 35 bp, Artificial Sequence
  Synthetic oligonucleotide
atcctcgaccctgccatccgaatcgggcatgccca

SEQ ID NO: 25917 - DNA, 35 bp, Artificial Sequence
  Synthetic oligonucleotide
tcccacccgcatggtcacccctcatctgaatgcga

SEQ ID NO: 25918 - DNA, 38 bp, Artificial Sequence
  Synthetic oligonucleotide
gttcgatccgccatatccgcaattacacagtaatttga

SEQ ID NO: 25919 - DNA, 35 bp, Artificial Sequence
  Synthetic oligonucleotide
atttggtgcctcccctctccgacccgtaccccata

SEQ ID NO: 25920 - DNA, 35 bp, Artificial Sequence
  Synthetic oligonucleotide
aacactgctatgtgcctcacccaccctcctggata

SEQ ID NO: 25921 - DNA, 35 bp, Artificial Sequence
  Synthetic oligonucleotide
ggacgggcccaatgcactccctttctatcattcta

SEQ ID NO: 25922 - DNA, 35 bp, Artificial Sequence
  Synthetic oligonucleotide
tagaccgacgttcaccgcatacttgtaccttcaac

SEQ ID NO: 25923 - DNA, 35 bp, Artificial Sequence
  Synthetic oligonucleotide
gttcaattcacgaggtcctatcaaacacgtactac

SEQ ID NO: 25924 - DNA, 35 bp, Artificial Sequence
  Synthetic oligonucleotide
gtgtgactcgccatccgcccaaccacctagggtac

SEQ ID NO: 25925 - DNA, 35 bp, Artificial Sequence
  Synthetic oligonucleotide
agccccgggcgacatcgactataggccctccatcc

SEQ ID NO: 25926 - DNA, 35 bp, Artificial Sequence
  Synthetic oligonucleotide
tgcctcgctcatactcgaatccacctgcactcggt

SEQ ID NO: 25927 - DNA, 36 bp, Artificial Sequence
  Synthetic oligonucleotide
ttagacgggtaggaggggaggggagttggatgagaa

SEQ ID NO: 25928 - DNA, 36 bp, Artificial Sequence
  Synthetic oligonucleotide
gccgctacccggctctttggtcgcacacatactaca

SEQ ID NO: 25929 - DNA, 36 bp, Artificial Sequence
  Synthetic oligonucleotide
gacatcccgcactatcaccaggcgccgcctgcttca

SEQ ID NO: 25930 - DNA, 36 bp, Artificial Sequence
  Synthetic oligonucleotide
actcctacacccgactgcgatccatacccgtgttca

SEQ ID NO: 25931 - DNA, 37 bp, Artificial Sequence
  Synthetic oligonucleotide
gacgagaacgtgcggaagacggggacaaggtggcgga

SEQ ID NO: 25932 - DNA, 36 bp, Artificial Sequence
  Synthetic oligonucleotide
tctgaagagaacgggcaagtggaatggaaggatgga

SEQ ID NO: 25933 - DNA, 37 bp, Artificial Sequence
  Synthetic oligonucleotide
tgatccccactctgcatccttaagtcctttctatgga

SEQ ID NO: 25934 - DNA, 37 bp, Artificial Sequence
  Synthetic oligonucleotide
gaccgttgcgctaatttgcctttcctgaccccgtgga

SEQ ID NO: 25935 - DNA, 38 bp, Artificial Sequence
  Synthetic oligonucleotide
gccgacctcgaggcagtggtggcttattcccttcctga

SEQ ID NO: 25936 - DNA, 38 bp, Artificial Sequence
  Synthetic oligonucleotide
gacgaacgtaggagcgagaatagtcagcgaaagggtga

SEQ ID NO: 25937 - DNA, 38 bp, Artificial Sequence
  Synthetic oligonucleotide
gttcagaagctggctgcctatttctcctctgtccttga

SEQ ID NO: 25938 - DNA, 38 bp, Artificial Sequence
  Synthetic oligonucleotide
aaaccctacattggtctccagaggtccttcgactttga

SEQ ID NO: 25939 - DNA, 36 bp, Artificial Sequence
  Synthetic oligonucleotide
acacccacatgcaacaccctataggccttttcggta

SEQ ID NO: 25940 - DNA, 35 bp, Artificial Sequence
  Synthetic oligonucleotide
tgcatcattcactctgcgaactactcgaccgatcc

SEQ ID NO: 25941 - DNA, 35 bp, Artificial Sequence
  Synthetic oligonucleotide
ttgtcgccgctactaccctttactcgagcccgtgc

SEQ ID NO: 25942 - DNA, 35 bp, Artificial Sequence
  Synthetic oligonucleotide
gtgcgccgatctgcccgacccgactatttttcgat

SEQ ID NO: 25943 - DNA, 35 bp, Artificial Sequence
  Synthetic oligonucleotide
atgcccacgctagccttagttggttacccctgttt

SEQ ID NO: 25944 - DNA, 36 bp, Artificial Sequence
  Synthetic oligonucleotide
ttccgccgagcaacgcgcttattctctgcttttcaa

SEQ ID NO: 25945 - DNA, 36 bp, Artificial Sequence
  Synthetic oligonucleotide
aaccgaccgaaggccccaatgaccgctcactgctaa

SEQ ID NO: 25946 - DNA, 36 bp, Artificial Sequence
  Synthetic oligonucleotide
tgcattgcagaccacatcatcgctgggaaacatcca

SEQ ID NO: 25947 - DNA, 37 bp, Artificial Sequence
  Synthetic oligonucleotide
gtcaccctccaatcccctgtgctaaattgccttcaga

SEQ ID NO: 25948 - DNA, 38 bp, Artificial Sequence
  Synthetic oligonucleotide
gacggtccccacatgctcgtttttcgtccgaaccttga

SEQ ID NO: 25949 - DNA, 36 bp, Artificial Sequence
  Synthetic oligonucleotide
ttgaacatctatcccgataacacccgtaggtaacta

SEQ ID NO: 25950 - DNA, 35 bp, Artificial Sequence
  Synthetic oligonucleotide
tgacaccatggtggctaccttgcaacaacatttta

SEQ ID NO: 25951 - DNA, 36 bp, Artificial Sequence
  Synthetic oligonucleotide
atgcgacgctgaaagccagcagcctactttctttta

SEQ ID NO: 25952 - DNA, 35 bp, Artificial Sequence
  Synthetic oligonucleotide
aacatcagcactgacacacattaatcatcgtatcg

SEQ ID NO: 25953 - DNA, 35 bp, Artificial Sequence
  Synthetic oligonucleotide
gaataccccgcccaataatcgcacctgttccagtg

SEQ ID NO: 25954 - DNA, 35 bp, Artificial Sequence
  Synthetic oligonucleotide
aaccgcctcccaagtgcattgaattgcccagtgtg

SEQ ID NO: 25955 - DNA, 35 bp, Artificial Sequence
  Synthetic oligonucleotide
tgttgcgacaaccatccgtaccaagtccgccgttg

SEQ ID NO: 25956 - DNA, 35 bp, Artificial Sequence
  Synthetic oligonucleotide
gtgcaccaccccctatttgatcatctgtgatgtct

SEQ ID NO: 25957 - DNA, 38 bp, Artificial Sequence
  Synthetic oligonucleotide
tttgcacgtcccgcggccatctcacgcagactccctga

SEQ ID NO: 25958 - DNA, 38 bp, Artificial Sequence
  Synthetic oligonucleotide
tccaccgcaccataacatgtccgcgaacccactgctga

SEQ ID NO: 25959 - DNA, 36 bp, Artificial Sequence
  Synthetic oligonucleotide
gtgacgtctccaccgcctataccagccttttgttga

SEQ ID NO: 25960 - DNA, 35 bp, Artificial Sequence
  Synthetic oligonucleotide
gtcgcacgcataactgtaccaaacccgccaccgta

SEQ ID NO: 25961 - DNA, 35 bp, Artificial Sequence
  Synthetic oligonucleotide
atccgacatcagccttccaacgcccgtttagtccc

SEQ ID NO: 25962 - DNA, 35 bp, Artificial Sequence
  Synthetic oligonucleotide
aactgcacagacggccccctggtatccatacatcc

SEQ ID NO: 25963 - DNA, 35 bp, Artificial Sequence
  Synthetic oligonucleotide
tgatacccctagtgcctgtcctgtcccccgatttg

SEQ ID NO: 25964 - DNA, 36 bp, Artificial Sequence
  Synthetic oligonucleotide
gtaccgacatcgatctacaagcgcgtgacccaccca

SEQ ID NO: 25965 - DNA, 36 bp, Artificial Sequence
  Synthetic oligonucleotide
actgcgaacctcactccacgcgcgcccctacgtcca

SEQ ID NO: 25966 - DNA, 36 bp, Artificial Sequence
  Synthetic oligonucleotide
tgcacatgacgcccctccccttaccgtttactagca

SEQ ID NO: 25967 - DNA, 36 bp, Artificial Sequence
  Synthetic oligonucleotide
aagccacacactccagtatcccttggagcgcaatca

SEQ ID NO: 25968 - DNA, 36 bp, Artificial Sequence
  Synthetic oligonucleotide
gtaactgggtcgggaggggggggctcagttgtatga

SEQ ID NO: 25969 - DNA, 38 bp, Artificial Sequence
  Synthetic oligonucleotide
gattgagccagagagtaaaacggggtggtggtttctga

SEQ ID NO: 25970 - DNA, 38 bp, Artificial Sequence
  Synthetic oligonucleotide
gaccaggtatgcaggggaagcgaggggaacgaatgtga

SEQ ID NO: 25971 - DNA, 36 bp, Artificial Sequence
  Synthetic oligonucleotide
accggtgccagcgcccgtacccccccgtgcttgtga

SEQ ID NO: 25972 - DNA, 35 bp, Artificial Sequence
  Synthetic oligonucleotide
accctacgaccatccatggcggctacttttgccac

SEQ ID NO: 25973 - DNA, 35 bp, Artificial Sequence
  Synthetic oligonucleotide
ggaactccgctcctgcccagccgtttacctggtac

SEQ ID NO: 25974 - DNA, 35 bp, Artificial Sequence
  Synthetic oligonucleotide
ttcacacgccgcgatgctctaactcgttgcctccc

SEQ ID NO: 25975 - DNA, 35 bp, Artificial Sequence
  Synthetic oligonucleotide
actcagtcccatccttccacctttgtgctagccgc

SEQ ID NO: 25976 - DNA, 35 bp, Artificial Sequence
  Synthetic oligonucleotide
gatcccccaccagcctttgtaccatggagtgccgt

SEQ ID NO: 25977 - DNA, 35 bp, Artificial Sequence
  Synthetic oligonucleotide
tcgcacccattggccgtacccgacaccgtagtaaa

SEQ ID NO: 25978 - DNA, 35 bp, Artificial Sequence
  Synthetic oligonucleotide
gacaaccactcatcaaggttgtgtcctaacacaca

SEQ ID NO: 25979 - DNA, 37 bp, Artificial Sequence
  Synthetic oligonucleotide
gacaagccgaaagggtagagggcttagagggagggga

SEQ ID NO: 25980 - DNA, 37 bp, Artificial Sequence
  Synthetic oligonucleotide
gttgactacccatgggctttgccactatccctaatga

SEQ ID NO: 25981 - DNA, 38 bp, Artificial Sequence
  Synthetic oligonucleotide
gtccacttcccttgccgccctaagtagccgaatgctga

SEQ ID NO: 25982 - DNA, 36 bp, Artificial Sequence
  Synthetic oligonucleotide
tcacgcctcacctagctctcattgctgataccacta

SEQ ID NO: 25983 - DNA, 36 bp, Artificial Sequence
  Synthetic oligonucleotide
acatgtgttcggccctatgctctctgcccattcgta

SEQ ID NO: 25984 - DNA, 36 bp, Artificial Sequence
  Synthetic oligonucleotide
ttcccctcctgcattggccttttctgacccagctta

SEQ ID NO: 25985 - DNA, 35 bp, Artificial Sequence
  Synthetic oligonucleotide
tcccgatccccaatgccggccctggtggacgttta

SEQ ID NO: 25986 - DNA, 35 bp, Artificial Sequence
  Synthetic oligonucleotide
taccgacacggttgccgacgtaatgcctagctgcc

SEQ ID NO: 25987 - DNA, 35 bp, Artificial Sequence
  Synthetic oligonucleotide
gcccccgcccccacagtaatgatctagtttcaggc

SEQ ID NO: 25988 - DNA, 35 bp, Artificial Sequence
  Synthetic oligonucleotide
actgagggcccactggaaccagaattacctcgatc

SEQ ID NO: 25989 - DNA, 35 bp, Artificial Sequence
  Synthetic oligonucleotide
atttggagtgggattagatgaggaatttgggggag

SEQ ID NO: 25990 - DNA, 36 bp, Artificial Sequence
  Synthetic oligonucleotide
gtgaagggaaatcggttggacagggatgtagggatg

SEQ ID NO: 25991 - DNA, 35 bp, Artificial Sequence
  Synthetic oligonucleotide
acatgccaactactgatttggtctatgcaaatcct

SEQ ID NO: 25992 - DNA, 35 bp, Artificial Sequence
  Synthetic oligonucleotide
ttcccagccggggccctcgttactttgattctctt

SEQ ID NO: 25993 - DNA, 35 bp, Artificial Sequence
  Synthetic oligonucleotide
actcgaccaggtccctctgttactccgaattcttt

SEQ ID NO: 25994 - DNA, 37 bp, Artificial Sequence
  Synthetic oligonucleotide
gtcgtagcattagggggcgggaaaacttggggaggga

SEQ ID NO: 25995 - DNA, 37 bp, Artificial Sequence
  Synthetic oligonucleotide
gacaaccgtggcggggacagggaatcgggctatggga

SEQ ID NO: 25996 - DNA, 36 bp, Artificial Sequence
  Synthetic oligonucleotide
gtcctggccccaatgagcgtgcacaccctactgtta

SEQ ID NO: 25997 - DNA, 35 bp, Artificial Sequence
  Synthetic oligonucleotide
atctaccggcaacatgcacgaacggcacactcccc

SEQ ID NO: 25998 - DNA, 35 bp, Artificial Sequence
  Synthetic oligonucleotide
taacccgaccagccttcttgacgtgcatggtgccg

SEQ ID NO: 25999 - DNA, 35 bp, Artificial Sequence
  Synthetic oligonucleotide
agaaagtaggaaacgggaaggggcggcactagggg

SEQ ID NO: 26000 - DNA, 35 bp, Artificial Sequence
  Synthetic oligonucleotide
tcaaactgtgtgggggtaaaaacggtgaaactggg

SEQ ID NO: 26001 - DNA, 36 bp, Artificial Sequence
  Synthetic oligonucleotide
gccccctcagtgcaccgcaccctattgaatcgccca

SEQ ID NO: 26002 - DNA, 36 bp, Artificial Sequence
  Synthetic oligonucleotide
aatccacgctttccattggccatagccatgttccca

SEQ ID NO: 26003 - DNA, 36 bp, Artificial Sequence
  Synthetic oligonucleotide
tagcgacacagtaccgtttttcttgccacgcccgca

SEQ ID NO: 26004 - DNA, 36 bp, Artificial Sequence
  Synthetic oligonucleotide
gactggtagggggttcagggaggtatgggtggggca

SEQ ID NO: 26005 - DNA, 36 bp, Artificial Sequence
  Synthetic oligonucleotide
gtgagacatcagaccgcttccattcaacactgctca

SEQ ID NO: 26006 - DNA, 37 bp, Artificial Sequence
  Synthetic oligonucleotide
tccggaaggggactgcaattagcagacggagaggaga

SEQ ID NO: 26007 - DNA, 36 bp, Artificial Sequence
  Synthetic oligonucleotide
ttccacccctgacgaccatttgagcctagttggaga

SEQ ID NO: 26008 - DNA, 36 bp, Artificial Sequence
  Synthetic oligonucleotide
tcccgttgaggcgtatcgctccttctcctatactga

SEQ ID NO: 26009 - DNA, 38 bp, Artificial Sequence
  Synthetic oligonucleotide
gaatcccattcgtgtcatggcactattctccttcctga

SEQ ID NO: 26010 - DNA, 36 bp, Artificial Sequence
  Synthetic oligonucleotide
ggagtggggtatgggcgggataagggtcctcgttga

SEQ ID NO: 26011 - DNA, 35 bp, Artificial Sequence
  Synthetic oligonucleotide
gagtgacgcatgcagttatatcatttggcttttga

SEQ ID NO: 26012 - DNA, 36 bp, Artificial Sequence
  Synthetic oligonucleotide
gaacgtaacgcctgttgccaaccatctcgttcttta

SEQ ID NO: 26013 - DNA, 35 bp, Artificial Sequence
  Synthetic oligonucleotide
tccacctgtacgcccgtgctacgccattgaggagc

SEQ ID NO: 26014 - DNA, 35 bp, Artificial Sequence
  Synthetic oligonucleotide
ggtcgtgaacaagggtagggggtgggacagccaag

SEQ ID NO: 26015 - DNA, 35 bp, Artificial Sequence
  Synthetic oligonucleotide
gaggggggaaaggattggctgtgacgcatgctatg

SEQ ID NO: 26016 - DNA, 35 bp, Artificial Sequence
  Synthetic oligonucleotide
tacccgggcgcctgccgcgacgaccctattatcct

SEQ ID NO: 26017 - DNA, 35 bp, Artificial Sequence
  Synthetic oligonucleotide
gaacatcacggacggaaattgcggtgtgcacctct

SEQ ID NO: 26018 - DNA, 35 bp, Artificial Sequence
  Synthetic oligonucleotide
gattgacgcacgtggagtagcggagtggtgtggtt

SEQ ID NO: 26019 - DNA, 36 bp, Artificial Sequence
  Synthetic oligonucleotide
gggagggcatggtggagtagggcgggagggggtaaa

SEQ ID NO: 26020 - DNA, 37 bp, Artificial Sequence
  Synthetic oligonucleotide
tgagggtctccccctcaccctgttcttgccaccacga

SEQ ID NO: 26021 - DNA, 38 bp, Artificial Sequence
  Synthetic oligonucleotide
tgccaatccgtgaccggctccctccctcttacaagtga

SEQ ID NO: 26022 - DNA, 38 bp, Artificial Sequence
  Synthetic oligonucleotide
acactggcctcattgcttatacaaccaccgccccgtga

SEQ ID NO: 26023 - DNA, 37 bp, Artificial Sequence
  Synthetic oligonucleotide
tgtacacgtcctccgttttcggggcctccttctgtga

SEQ ID NO: 26024 - DNA, 35 bp, Artificial Sequence
  Synthetic oligonucleotide
gacgaagtgcacgtgcaggagaaaacgggagggac

SEQ ID NO: 26025 - DNA, 35 bp, Artificial Sequence
  Synthetic oligonucleotide
actccttccgaacaggtaccgctctacaccgcttg

SEQ ID NO: 26026 - DNA, 35 bp, Artificial Sequence
  Synthetic oligonucleotide
tcgtgagggaggacagggggggcggtgtggtgttg

SEQ ID NO: 26027 - DNA, 35 bp, Artificial Sequence
  Synthetic oligonucleotide
gtgagtggtgtggggggttgtagtacgggtcttgt

SEQ ID NO: 26028 - DNA, 35 bp, Artificial Sequence
  Synthetic oligonucleotide
tcagcccactgcccccttacgatgcacgcagcctt

SEQ ID NO: 26029 - DNA, 35 bp, Artificial Sequence
  Synthetic oligonucleotide
ggagtcgtcgcatacccatgggccgtcaacttctt

SEQ ID NO: 26030 - DNA, 37 bp, Artificial Sequence
  Synthetic oligonucleotide
tcattcgccacatcgtaaccttcccacgcccccaaga

SEQ ID NO: 26031 - DNA, 38 bp, Artificial Sequence
  Synthetic oligonucleotide
gccggtccattcattcggcctactgtaccactctatga

SEQ ID NO: 26032 - DNA, 35 bp, Artificial Sequence
  Synthetic oligonucleotide
atgcacgcagcttttagctaactctactccgcgac

SEQ ID NO: 26033 - DNA, 35 bp, Artificial Sequence
  Synthetic oligonucleotide
tgaccacaccggtcgcccgtcgtcttcccatcaag

SEQ ID NO: 26034 - DNA, 35 bp, Artificial Sequence
  Synthetic oligonucleotide
tgccaccgggacgcctttcccctccggagccctcg

SEQ ID NO: 26035 - DNA, 35 bp, Artificial Sequence
  Synthetic oligonucleotide
gccatctccgatcgtccttaccgttggtccattcg

SEQ ID NO: 26036 - DNA, 35 bp, Artificial Sequence
  Synthetic oligonucleotide
gcttgaggagtcaagcttcatcctcgttatccact

SEQ ID NO: 26037 - DNA, 35 bp, Artificial Sequence
  Synthetic oligonucleotide
gttcacccgtctactgaaataacccatgtcgccct

SEQ ID NO: 26038 - DNA, 36 bp, Artificial Sequence
  Synthetic oligonucleotide
agcgaccaccagttgcttgtcgcccactactcctca

SEQ ID NO: 26039 - DNA, 37 bp, Artificial Sequence
  Synthetic oligonucleotide
atcgcgatctagcggtttacattgaccccattcccga

SEQ ID NO: 26040 - DNA, 36 bp, Artificial Sequence
  Synthetic oligonucleotide
tgacttgtcccgcctccattcacaccactcttcgga

SEQ ID NO: 26041 - DNA, 37 bp, Artificial Sequence
  Synthetic oligonucleotide
ttccgccgccccccctaatcccgttattgcgattgga

SEQ ID NO: 26042 - DNA, 38 bp, Artificial Sequence
  Synthetic oligonucleotide
tagagcgcagaaaaggggtgacggggacttagaggtga

SEQ ID NO: 26043 - DNA, 38 bp, Artificial Sequence
  Synthetic oligonucleotide
tacccagggtcacacggcttctccatcacgtaacttga

SEQ ID NO: 26044 - DNA, 38 bp, Artificial Sequence
  Synthetic oligonucleotide
accccactcctaggatcgcattaactgccttactttga

SEQ ID NO: 26045 - DNA, 35 bp, Artificial Sequence
  Synthetic oligonucleotide
tcaaccccgctcatccctgcccccggtcgcgcata

SEQ ID NO: 26046 - DNA, 36 bp, Artificial Sequence
  Synthetic oligonucleotide
tagatgcctgccggtcacacgctcgtccctacgcta

SEQ ID NO: 26047 - DNA, 35 bp, Artificial Sequence
  Synthetic oligonucleotide
acccgaacacatttgatcacgtgccctgttgtcac

SEQ ID NO: 26048 - DNA, 34 bp, Artificial Sequence
  Synthetic oligonucleotide
tcaaccttcgctcacacataccgtcgccgccgac

SEQ ID NO: 26049 - DNA, 35 bp, Artificial Sequence
  Synthetic oligonucleotide
tatctaccactgccaatgcatgttcttttcgaccc

SEQ ID NO: 26050 - DNA, 35 bp, Artificial Sequence
  Synthetic oligonucleotide
gattcgaaccgatggtttcgagtgaacatactccc

SEQ ID NO: 26051 - DNA, 35 bp, Artificial Sequence
  Synthetic oligonucleotide
tccacacactatgctggccctatgccacgtcactc

SEQ ID NO: 26052 - DNA, 35 bp, Artificial Sequence
  Synthetic oligonucleotide
gtgacgctagctaggaggatggggggggttgccag

SEQ ID NO: 26053 - DNA, 35 bp, Artificial Sequence
  Synthetic oligonucleotide
tatgccccgcatattgatcttcgttttgtttgccg

SEQ ID NO: 26054 - DNA, 35 bp, Artificial Sequence
  Synthetic oligonucleotide
gtagggtgggggatgagacaggggatggcataagg

SEQ ID NO: 26055 - DNA, 35 bp, Artificial Sequence
  Synthetic oligonucleotide
acaaccgtcgatcacaccccgctccataataactg

SEQ ID NO: 26056 - DNA, 35 bp, Artificial Sequence
  Synthetic oligonucleotide
tgagacgatcccagctcctgatagccaatcaccat

SEQ ID NO: 26057 - DNA, 35 bp, Artificial Sequence
  Synthetic oligonucleotide
gccactgtccctggcactccaaaaacggattacct

SEQ ID NO: 26058 - DNA, 36 bp, Artificial Sequence
  Synthetic oligonucleotide
gtgctgcccacctgccgaccacaacagtctagccga

SEQ ID NO: 26059 - DNA, 37 bp, Artificial Sequence
  Synthetic oligonucleotide
gacacaatcattccggcccgatcagcctagcggccga

SEQ ID NO: 26060 - DNA, 37 bp, Artificial Sequence
  Synthetic oligonucleotide
aacgaggcgatagaggcgaacttggcttcgtggagga

SEQ ID NO: 26061 - DNA, 38 bp, Artificial Sequence
  Synthetic oligonucleotide
aacaaagaacgcatgggcggagaggagggtatgaatga

SEQ ID NO: 26062 - DNA, 38 bp, Artificial Sequence
  Synthetic oligonucleotide
tgtcacacccctgtcaatatattaactgcctcctgtga

SEQ ID NO: 26063 - DNA, 35 bp, Artificial Sequence
  Synthetic oligonucleotide
acttccatctcacgctactcgggttacgtgcccta

SEQ ID NO: 26064 - DNA, 36 bp, Artificial Sequence
  Synthetic oligonucleotide
atcctcatccaaacatgcgtcatagctccacacgta

SEQ ID NO: 26065 - DNA, 34 bp, Artificial Sequence
  Synthetic oligonucleotide
atcctaccaccgtcattcgtagctcccaatgtac

SEQ ID NO: 26066 - DNA, 36 bp, Artificial Sequence
  Synthetic oligonucleotide
agggcggtcctcctctttcgctttggcctgttaccc

SEQ ID NO: 26067 - DNA, 35 bp, Artificial Sequence
  Synthetic oligonucleotide
agcacgaacatttttactccaagttgctgtccccc

SEQ ID NO: 26068 - DNA, 35 bp, Artificial Sequence
  Synthetic oligonucleotide
gtgtcgatactgtcggccctccgtccacttcatgc

SEQ ID NO: 26069 - DNA, 35 bp, Artificial Sequence
  Synthetic oligonucleotide
gatgactcccctacctgccgcgctgggccaccatc

SEQ ID NO: 26070 - DNA, 36 bp, Artificial Sequence
  Synthetic oligonucleotide
aagtgacgaagatgggagccgggctagggggggaaa

SEQ ID NO: 26071 - DNA, 36 bp, Artificial Sequence
  Synthetic oligonucleotide
gaaatgagcgcaatctaaggtggcaaatggggggaa

SEQ ID NO: 26072 - DNA, 36 bp, Artificial Sequence
  Synthetic oligonucleotide
tacgcgtgcgatatatccgtctcactcccatccaca

SEQ ID NO: 26073 - DNA, 35 bp, Artificial Sequence
  Synthetic oligonucleotide
tgtcgaatccgacgatgacttttgctctaccacca

SEQ ID NO: 26074 - DNA, 36 bp, Artificial Sequence
  Synthetic oligonucleotide
tgcccagtgccaccgcccgcctcccatactgtaaga

SEQ ID NO: 26075 - DNA, 37 bp, Artificial Sequence
  Synthetic oligonucleotide
taacggtaatacgggtgtaaggggcggggttgggaga

SEQ ID NO: 26076 - DNA, 36 bp, Artificial Sequence
  Synthetic oligonucleotide
tgcttgtcctcggtctattggtcttatcctgtctta

SEQ ID NO: 26077 - DNA, 35 bp, Artificial Sequence
  Synthetic oligonucleotide
ttcgatcgccagggatctcgagccctcatcacacc

SEQ ID NO: 26078 - DNA, 35 bp, Artificial Sequence
  Synthetic oligonucleotide
tcccaccaaatattgattttgacttgtcctgtgcc

SEQ ID NO: 26079 - DNA, 35 bp, Artificial Sequence
  Synthetic oligonucleotide
tacccctcggaagtatacatccggcgcaactttgc

SEQ ID NO: 26080 - DNA, 35 bp, Artificial Sequence
  Synthetic oligonucleotide
accctagggcccactgtactgccggaaatcctaaa

SEQ ID NO: 26081 - DNA, 36 bp, Artificial Sequence
  Synthetic oligonucleotide
atgggcacatttcctgcccgttactctaccacgaga

SEQ ID NO: 26082 - DNA, 37 bp, Artificial Sequence
  Synthetic oligonucleotide
accacccgcggacctcagcatcggacacccactccga

SEQ ID NO: 26083 - DNA, 37 bp, Artificial Sequence
  Synthetic oligonucleotide
tccaagcctcactagtagtttgacccagcaccatcga

SEQ ID NO: 26084 - DNA, 37 bp, Artificial Sequence
  Synthetic oligonucleotide
aagcaacgggcgcgagggggggcaatgtcttggagga

SEQ ID NO: 26085 - DNA, 35 bp, Artificial Sequence
  Synthetic oligonucleotide
gacgacatccttttgcattgagttccttctcttga

SEQ ID NO: 26086 - DNA, 36 bp, Artificial Sequence
  Synthetic oligonucleotide
atcggaccccccctcctgcttgagcgatgacaaata

SEQ ID NO: 26087 - DNA, 36 bp, Artificial Sequence
  Synthetic oligonucleotide
ttacacctccatcattatattagccactattttgta

SEQ ID NO: 26088 - DNA, 35 bp, Artificial Sequence
  Synthetic oligonucleotide
tgcggtaccgcctcatgacgctcccttcacaagac

SEQ ID NO: 26089 - DNA, 35 bp, Artificial Sequence
  Synthetic oligonucleotide
gcctgaccgaacctggtaatacgttagccaacccc

SEQ ID NO: 26090 - DNA, 35 bp, Artificial Sequence
  Synthetic oligonucleotide
atgacaaagcgtactaggcgcacccgttcatgtcc

SEQ ID NO: 26091 - DNA, 35 bp, Artificial Sequence
  Synthetic oligonucleotide
gtggaggtccattggcagcttaacccactattatc

SEQ ID NO: 26092 - DNA, 35 bp, Artificial Sequence
  Synthetic oligonucleotide
gtcaaacttcgctccgccgcatcacgaactgcttc

SEQ ID NO: 26093 - DNA, 35 bp, Artificial Sequence
  Synthetic oligonucleotide
aacgaggtactggtggagaaaggggtggttcgtcg

SEQ ID NO: 26094 - DNA, 35 bp, Artificial Sequence
  Synthetic oligonucleotide
aacaaaacggcattggaaggactctctggtggggg

SEQ ID NO: 26095 - DNA, 35 bp, Artificial Sequence
  Synthetic oligonucleotide
tcatatcctcgctctggatccgtcattcctacgtt

SEQ ID NO: 26096 - DNA, 36 bp, Artificial Sequence
  Synthetic oligonucleotide
attgcctcgcaggcgtacggaccttaccaactttga

SEQ ID NO: 26097 - DNA, 35 bp, Artificial Sequence
  Synthetic oligonucleotide
gcacagcctatgtccatccgtacaccttactggac

SEQ ID NO: 26098 - DNA, 35 bp, Artificial Sequence
  Synthetic oligonucleotide
gtgagctcctaatcgacgtgggcggtgtgggcggg

SEQ ID NO: 26099 - DNA, 35 bp, Artificial Sequence
  Synthetic oligonucleotide
gtccatcagtcctgcgcgcttgacagacctggtct

SEQ ID NO: 26100 - DNA, 35 bp, Artificial Sequence
  Synthetic oligonucleotide
gtaccgcgggtgaaaccgggtctgtcctcacttct

SEQ ID NO: 26101 - DNA, 35 bp, Artificial Sequence
  Synthetic oligonucleotide
accctggaccgccacacgcgtcgccatcgacgcca

SEQ ID NO: 26102 - DNA, 35 bp, Artificial Sequence
  Synthetic oligonucleotide
gctcggagagcaataacatcactacgctcctgcca

SEQ ID NO: 26103 - DNA, 35 bp, Artificial Sequence
  Synthetic oligonucleotide
gtagtggggggtcgcgggagtcgggacatggtgca

SEQ ID NO: 26104 - DNA, 37 bp, Artificial Sequence
  Synthetic oligonucleotide
atgacaacccacatcttgagctcctgttttgagccga

SEQ ID NO: 26105 - DNA, 36 bp, Artificial Sequence
  Synthetic oligonucleotide
tgtgaaagcaggaggaagagctagagggctggtgga

SEQ ID NO: 26106 - DNA, 37 bp, Artificial Sequence
  Synthetic oligonucleotide
atgcctcagtcacccaaggtctttcctctctgcctga

SEQ ID NO: 26107 - DNA, 37 bp, Artificial Sequence
  Synthetic oligonucleotide
gggagtggaggggttggggtacgacggaacgtgctga

SEQ ID NO: 26108 - DNA, 37 bp, Artificial Sequence
  Synthetic oligonucleotide
tcacactgccacacgaaggatttgcactgaactttga

SEQ ID NO: 26109 - DNA, 35 bp, Artificial Sequence
  Synthetic oligonucleotide
ggatggactgggctctgcatctatatattatcctc

SEQ ID NO: 26110 - DNA, 35 bp, Artificial Sequence
  Synthetic oligonucleotide
tagcctcacgcatgccctccgacgaagccgtattc

SEQ ID NO: 26111 - DNA, 35 bp, Artificial Sequence
  Synthetic oligonucleotide
acatcaactacgagcccccgttaaaaacagccgcg

SEQ ID NO: 26112 - DNA, 34 bp, Artificial Sequence
  Synthetic oligonucleotide
gctccccgactcgtaatcgcaccgtacctacttg

SEQ ID NO: 26113 - DNA, 35 bp, Artificial Sequence
  Synthetic oligonucleotide
tagcgccgaacggttctcctgtccacgtttcccat

SEQ ID NO: 26114 - DNA, 35 bp, Artificial Sequence
  Synthetic oligonucleotide
gcgccgtatcagcggaaccctactttctgtaactt

SEQ ID NO: 26115 - DNA, 35 bp, Artificial Sequence
  Synthetic oligonucleotide
tacgaagttggcccgcaacacctagtttacaattt

SEQ ID NO: 26116 - DNA, 36 bp, Artificial Sequence
  Synthetic oligonucleotide
tccaccatctcgtgtggtgcttttcttcctgtcgaa

SEQ ID NO: 26117 - DNA, 36 bp, Artificial Sequence
  Synthetic oligonucleotide
gacgaagacatgggaaacgggaatgactgcggaaca

SEQ ID NO: 26118 - DNA, 35 bp, Artificial Sequence
  Synthetic oligonucleotide
gccgaggcgggactgaaaggaaacgaagggaagca

SEQ ID NO: 26119 - DNA, 36 bp, Artificial Sequence
  Synthetic oligonucleotide
gccaacttcactgcgtacctgagcgtccatgtctca

SEQ ID NO: 26120 - DNA, 36 bp, Artificial Sequence
  Synthetic oligonucleotide
acatcctgcagccatcaccatcgcggggactcccga

SEQ ID NO: 26121 - DNA, 38 bp, Artificial Sequence
  Synthetic oligonucleotide
gcgagagcgataaagtaagggtaggatggcttggctga

SEQ ID NO: 26122 - DNA, 38 bp, Artificial Sequence
  Synthetic oligonucleotide
tacacgctacacttgcgatctttcgggcccctccgtga

SEQ ID NO: 26123 - DNA, 35 bp, Artificial Sequence
  Synthetic oligonucleotide
atcacacccccgccgctgacaatttcgtgttgctc

SEQ ID NO: 26124 - DNA, 35 bp, Artificial Sequence
  Synthetic oligonucleotide
agccactaacagctccctagcatccgacgtgacct

SEQ ID NO: 26125 - DNA, 35 bp, Artificial Sequence
  Synthetic oligonucleotide
gtcgtatgccgtggttcttttatgtacgcccttgt

SEQ ID NO: 26126 - DNA, 37 bp, Artificial Sequence
  Synthetic oligonucleotide
tagggcgggaggtgggcggagcgggacatacaagaga

SEQ ID NO: 26127 - DNA, 36 bp, Artificial Sequence
  Synthetic oligonucleotide
gacgggagggagcgttctgggaatatccgggttcga

SEQ ID NO: 26128 - DNA, 37 bp, Artificial Sequence
  Synthetic oligonucleotide
agcgtgaggtagtggggattggcggctggaagtagga

SEQ ID NO: 26129 - DNA, 35 bp, Artificial Sequence
  Synthetic oligonucleotide
gagtacgccttaccgactagaccccagttccccta

SEQ ID NO: 26130 - DNA, 36 bp, Artificial Sequence
  Synthetic oligonucleotide
atcccgaatccaccatgatatcgaaccccgtactta

SEQ ID NO: 26131 - DNA, 35 bp, Artificial Sequence
  Synthetic oligonucleotide
gtacgcccacacacaaatcggtcatgtactagccc

SEQ ID NO: 26132 - DNA, 35 bp, Artificial Sequence
  Synthetic oligonucleotide
atgataccgtaggtcgcgaaccgggtctgcctttc

SEQ ID NO: 26133 - DNA, 35 bp, Artificial Sequence
  Synthetic oligonucleotide
atccagctgtgcgcccggagcttttcctgctacat

SEQ ID NO: 26134 - DNA, 34 bp, Artificial Sequence
  Synthetic oligonucleotide
gatcgctcggcccgggacttgacttctgcacaca

SEQ ID NO: 26135 - DNA, 37 bp, Artificial Sequence
  Synthetic oligonucleotide
acgacaacctcttttcactgcacagagctcctgacga

SEQ ID NO: 26136 - DNA, 37 bp, Artificial Sequence
  Synthetic oligonucleotide
gtgcaagcccataacgagtgctcaccagccccaccga

SEQ ID NO: 26137 - DNA, 37 bp, Artificial Sequence
  Synthetic oligonucleotide
ttacccctacccactggtgtctccgattcttcaccga

SEQ ID NO: 26138 - DNA, 37 bp, Artificial Sequence
  Synthetic oligonucleotide
tcacccgtaccaccgtgccagaatatgatcactcgga

SEQ ID NO: 26139 - DNA, 37 bp, Artificial Sequence
  Synthetic oligonucleotide
tcaccttgcctacatgagttcttacatctttcctgga

SEQ ID NO: 26140 - DNA, 36 bp, Artificial Sequence
  Synthetic oligonucleotide
ttcaaccgccgccgcttagcttattgcaccgcatga

SEQ ID NO: 26141 - DNA, 38 bp, Artificial Sequence
  Synthetic oligonucleotide
atgagcgccgtttactatttgcgtcgaccccacactga

SEQ ID NO: 26142 - DNA, 38 bp, Artificial Sequence
  Synthetic oligonucleotide
atcaggggacgggtgcgggcgggccgtcaagggagtga

SEQ ID NO: 26143 - DNA, 38 bp, Artificial Sequence
  Synthetic oligonucleotide
acccggtggagagggggtgaggtaacaacaggggttga

SEQ ID NO: 26144 - DNA, 34 bp, Artificial Sequence
  Synthetic oligonucleotide
aatgcgtcacacattgcaatccagcgcacgatcc

SEQ ID NO: 26145 - DNA, 35 bp, Artificial Sequence
  Synthetic oligonucleotide
gagcgaagctcctggcagtccaccaacatacacgc

SEQ ID NO: 26146 - DNA, 35 bp, Artificial Sequence
  Synthetic oligonucleotide
acccttcacatgcattaagtcgacctgtttccctc

SEQ ID NO: 26147 - DNA, 35 bp, Artificial Sequence
  Synthetic oligonucleotide
ttcaacgttccgagtccgtcccattataccatccg

SEQ ID NO: 26148 - DNA, 35 bp, Artificial Sequence
  Synthetic oligonucleotide
ttgttccatccgtccggcgccatcctgtttgacct

SEQ ID NO: 26149 - DNA, 35 bp, Artificial Sequence
  Synthetic oligonucleotide
tagcgcaacatcgatgcagcccgtgcaccttcctt

SEQ ID NO: 26150 - DNA, 35 bp, Artificial Sequence
  Synthetic oligonucleotide
gtgcttccttccctgtccgtaattagccttccgtt

SEQ ID NO: 26151 - DNA, 36 bp, Artificial Sequence
  Synthetic oligonucleotide
gacgttgcgtctcgttctcttctacgcttcactcca

SEQ ID NO: 26152 - DNA, 35 bp, Artificial Sequence
  Synthetic oligonucleotide
tccaacgatcctccattcaacattacctgtgtcca

SEQ ID NO: 26153 - DNA, 36 bp, Artificial Sequence
  Synthetic oligonucleotide
ttccgccgattcctctagttggtacctttcgtttca

SEQ ID NO: 26154 - DNA, 37 bp, Artificial Sequence
  Synthetic oligonucleotide
actgggggggaaatctgaaacgggcactgatggcaga

SEQ ID NO: 26155 - DNA, 37 bp, Artificial Sequence
  Synthetic oligonucleotide
cccaccatacacacctatcgctgctgtacatttatga

SEQ ID NO: 26156 - DNA, 38 bp, Artificial Sequence
  Synthetic oligonucleotide
gcgcctcaccgtccgcgctcttgcctctttggaactga

SEQ ID NO: 26157 - DNA, 38 bp, Artificial Sequence
  Synthetic oligonucleotide
tccatcggcgtcacacctttccacctcatgagccttga

SEQ ID NO: 26158 - DNA, 35 bp, Artificial Sequence
  Synthetic oligonucleotide
gctcgtgcgctcgtttttttccatatggcatccta

SEQ ID NO: 26159 - DNA, 35 bp, Artificial Sequence
  Synthetic oligonucleotide
gatcgcaagtgctctcattctatgatactaccccc

SEQ ID NO: 26160 - DNA, 35 bp, Artificial Sequence
  Synthetic oligonucleotide
gatcgcggtatggttcttcttctttcacttggccc

SEQ ID NO: 26161 - DNA, 35 bp, Artificial Sequence
  Synthetic oligonucleotide
gtgtccccgcatcaagtgccgccacttgcgttccc

SEQ ID NO: 26162 - DNA, 35 bp, Artificial Sequence
  Synthetic oligonucleotide
acaccccttcagcgaaccgcccttcctagcatccg

SEQ ID NO: 26163 - DNA, 35 bp, Artificial Sequence
  Synthetic oligonucleotide
tgctgtcgtcctccgactattcgccgaatgccctg

SEQ ID NO: 26164 - DNA, 35 bp, Artificial Sequence
  Synthetic oligonucleotide
tacatccagttcagacaatcctgcctctcgccact

SEQ ID NO: 26165 - DNA, 33 bp, Artificial Sequence
  Synthetic oligonucleotide
gattaccgctgaggatatgcccaactcgccttt

SEQ ID NO: 26166 - DNA, 36 bp, Artificial Sequence
  Synthetic oligonucleotide
tagttgcgcctccccactttagcgcccccattgaaa

SEQ ID NO: 26167 - DNA, 37 bp, Artificial Sequence
  Synthetic oligonucleotide
acgcgccgtaggcaggagggaggcgagtggagaaaga

SEQ ID NO: 26168 - DNA, 37 bp, Artificial Sequence
  Synthetic oligonucleotide
actaaggtgggagggaatagggccaggcgagagacga

SEQ ID NO: 26169 - DNA, 38 bp, Artificial Sequence
  Synthetic oligonucleotide
gtcccgacaggtcttacagctccccccatctctcatga

SEQ ID NO: 26170 - DNA, 38 bp, Artificial Sequence
  Synthetic oligonucleotide
gatgcaacgccttacgacccattccacccccagtctga

SEQ ID NO: 26171 - DNA, 38 bp, Artificial Sequence
  Synthetic oligonucleotide
gacgcaacttggtgccatgttccctgtttactccgtga

SEQ ID NO: 26172 - DNA, 36 bp, Artificial Sequence
  Synthetic oligonucleotide
gacccatcagaacctccaccaattgcgcacatttta

SEQ ID NO: 26173 - DNA, 35 bp, Artificial Sequence
  Synthetic oligonucleotide
gcaccacaactcgcagtcgttccttaacacccagg

SEQ ID NO: 26174 - DNA, 35 bp, Artificial Sequence
  Synthetic oligonucleotide
tattacctcagtccagttccgggccggtcttccat

SEQ ID NO: 26175 - DNA, 35 bp, Artificial Sequence
  Synthetic oligonucleotide
acagaggcaccctatgacctcttgaccatgttcct

SEQ ID NO: 26176 - DNA, 35 bp, Artificial Sequence
  Synthetic oligonucleotide
tcccatgactgcgggttaagcctatatgcatctct

SEQ ID NO: 26177 - DNA, 35 bp, Artificial Sequence
  Synthetic oligonucleotide
attcgccgagcgcatatcgtccattatctgcctgt

SEQ ID NO: 26178 - DNA, 37 bp, Artificial Sequence
  Synthetic oligonucleotide
acgattcgaccacacactgcctcagagcctgggccaa

SEQ ID NO: 26179 - DNA, 36 bp, Artificial Sequence
  Synthetic oligonucleotide
ttatgccccggagtaagtcgcgccacatttcatcaa

SEQ ID NO: 26180 - DNA, 36 bp, Artificial Sequence
  Synthetic oligonucleotide
tgaacatgactctctgtatcgcccgcttttttggaa

SEQ ID NO: 26181 - DNA, 36 bp, Artificial Sequence
  Synthetic oligonucleotide
gtgtgtaggggagtgcgtagggaagggaagtaagca

SEQ ID NO: 26182 - DNA, 36 bp, Artificial Sequence
  Synthetic oligonucleotide
gtaacgctcgagtcttacatgaacctgcacccctca

SEQ ID NO: 26183 - DNA, 36 bp, Artificial Sequence
  Synthetic oligonucleotide
gactacctctctacttcttaagcaactgtactttca

SEQ ID NO: 26184 - DNA, 37 bp, Artificial Sequence
  Synthetic oligonucleotide
gtaaatgggcgggtgggtagctgcagacatgggacga

SEQ ID NO: 26185 - DNA, 37 bp, Artificial Sequence
  Synthetic oligonucleotide
accgggggtagtgggggtaatagctggggaatggcga

SEQ ID NO: 26186 - DNA, 37 bp, Artificial Sequence
  Synthetic oligonucleotide
ttgcacctctgctggctaacctacatctcgtgatcga

SEQ ID NO: 26187 - DNA, 36 bp, Artificial Sequence
  Synthetic oligonucleotide
gaccactaaaagggcaaagggggatccgtggaggga

SEQ ID NO: 26188 - DNA, 38 bp, Artificial Sequence
  Synthetic oligonucleotide
ggtgccacgccactccgcgatttgaccatcttatatga

SEQ ID NO: 26189 - DNA, 38 bp, Artificial Sequence
  Synthetic oligonucleotide
gttagccaaccgccgcctcagggaatcacgcctcttga

SEQ ID NO: 26190 - DNA, 35 bp, Artificial Sequence
  Synthetic oligonucleotide
tgcgataccgcccacacctacattaatacgtgata

SEQ ID NO: 26191 - DNA, 36 bp, Artificial Sequence
  Synthetic oligonucleotide
gaagagaccacacgcttcctctccgctccttctata

SEQ ID NO: 26192 - DNA, 35 bp, Artificial Sequence
  Synthetic oligonucleotide
tcatacatgtccgtaccgcctgccgtattatcgtc

SEQ ID NO: 26193 - DNA, 36 bp, Artificial Sequence
  Synthetic oligonucleotide
gaccgcaacaacggcggaaggggaaaaaggttggaa

SEQ ID NO: 26194 - DNA, 35 bp, Artificial Sequence
  Synthetic oligonucleotide
atccctacgccccgtatttttacgcataatgtaca

SEQ ID NO: 26195 - DNA, 34 bp, Artificial Sequence
  Synthetic oligonucleotide
tccaccgcgccggcattgccctctgtaggttcca

SEQ ID NO: 26196 - DNA, 36 bp, Artificial Sequence
  Synthetic oligonucleotide
gcatccgaatgacggtagggggggagggggcacgca

SEQ ID NO: 26197 - DNA, 38 bp, Artificial Sequence
  Synthetic oligonucleotide
atcctctcgctcctgttcacccagatgctcatgcatga

SEQ ID NO: 26198 - DNA, 38 bp, Artificial Sequence
  Synthetic oligonucleotide
gtgccgtaagccgttgttcccgtgccctaaacccgtga

SEQ ID NO: 26199 - DNA, 38 bp, Artificial Sequence
  Synthetic oligonucleotide
tcgaccacggctatacgccttcaccatcactctattga

SEQ ID NO: 26200 - DNA, 35 bp, Artificial Sequence
  Synthetic oligonucleotide
agcctccccaccgggccatgtattggtacttcaac

SEQ ID NO: 26201 - DNA, 35 bp, Artificial Sequence
  Synthetic oligonucleotide
tgaacacctctttgtccaactcgcacttcctctcg

SEQ ID NO: 26202 - DNA, 35 bp, Artificial Sequence
  Synthetic oligonucleotide
gcattacctaccatctaccgtatgcacgccacttg

SEQ ID NO: 26203 - DNA, 35 bp, Artificial Sequence
  Synthetic oligonucleotide
gagccaactactgtcccgtccgcgcgagccttcat

SEQ ID NO: 26204 - DNA, 35 bp, Artificial Sequence
  Synthetic oligonucleotide
atgccacgccctctcatacgacctgcccatccact

SEQ ID NO: 26205 - DNA, 35 bp, Artificial Sequence
  Synthetic oligonucleotide
tttgtcctggctcacaacccgcataaagcattcct

SEQ ID NO: 26206 - DNA, 35 bp, Artificial Sequence
  Synthetic oligonucleotide
aaccgtgctgcgcgccccgacctatacctgtcttt

SEQ ID NO: 26207 - DNA, 36 bp, Artificial Sequence
  Synthetic oligonucleotide
taccccgacccgaccccttagacttgaagacgccaa

SEQ ID NO: 26208 - DNA, 36 bp, Artificial Sequence
  Synthetic oligonucleotide
gatagccatatctggtacttcgacgcctaccatcca

SEQ ID NO: 26209 - DNA, 37 bp, Artificial Sequence
  Synthetic oligonucleotide
gccccttcctcccgcccgttttgaacgtgtctgctga

SEQ ID NO: 26210 - DNA, 37 bp, Artificial Sequence
  Synthetic oligonucleotide
acaccaacacccgttgatcgattgaactactcattga

SEQ ID NO: 26211 - DNA, 35 bp, Artificial Sequence
  Synthetic oligonucleotide
acgcatcaagcgaggccgcctttcgtagctccaac

SEQ ID NO: 26212 - DNA, 35 bp, Artificial Sequence
  Synthetic oligonucleotide
tcatccacccaggcgcaggagtcctccgttgcaac

SEQ ID NO: 26213 - DNA, 35 bp, Artificial Sequence
  Synthetic oligonucleotide
ttgcgtgcgcccgcgttaggtctccccaattttac

SEQ ID NO: 26214 - DNA, 35 bp, Artificial Sequence
  Synthetic oligonucleotide
tgatcagacatgtcgctgtcacccagtccgccacc

SEQ ID NO: 26215 - DNA, 35 bp, Artificial Sequence
  Synthetic oligonucleotide
gggacacgctactttctcccgttgtcttaccgacc

SEQ ID NO: 26216 - DNA, 35 bp, Artificial Sequence
  Synthetic oligonucleotide
gcacgtgtacccgggttgcatcgagggtcctttcc

SEQ ID NO: 26217 - DNA, 35 bp, Artificial Sequence
  Synthetic oligonucleotide
tctgatgccgtaccctatttgccttcccaccactc

SEQ ID NO: 26218 - DNA, 35 bp, Artificial Sequence
  Synthetic oligonucleotide
tgccgtaaggcggagaaaaaatgggggacggggcg

SEQ ID NO: 26219 - DNA, 35 bp, Artificial Sequence
  Synthetic oligonucleotide
aaggggaggtggtgaagggctatgatcgactatat

SEQ ID NO: 26220 - DNA, 35 bp, Artificial Sequence
  Synthetic oligonucleotide
tgccggttcgacaccggttggcttacatacttcct

SEQ ID NO: 26221 - DNA, 35 bp, Artificial Sequence
  Synthetic oligonucleotide
tcttccagaactcatcgcgtactagcccccccgct

SEQ ID NO: 26222 - DNA, 35 bp, Artificial Sequence
  Synthetic oligonucleotide
tctgacacttgcggacttcacaccgatttgccctt

SEQ ID NO: 26223 - DNA, 35 bp, Artificial Sequence
  Synthetic oligonucleotide
agcaaccccgtggttctgaagttgctctccttgtt

SEQ ID NO: 26224 - DNA, 36 bp, Artificial Sequence
  Synthetic oligonucleotide
tatcatttgcgcctgctgatatttttcttcaccaca

SEQ ID NO: 26225 - DNA, 36 bp, Artificial Sequence
  Synthetic oligonucleotide
gtccattgcgccatctatgccgtgcctgtgcgctca

SEQ ID NO: 26226 - DNA, 37 bp, Artificial Sequence
  Synthetic oligonucleotide
tgcagtctccgtatacgcctgctcaacttcattaaga

SEQ ID NO: 26227 - DNA, 38 bp, Artificial Sequence
  Synthetic oligonucleotide
gagggaaaggggagggtgtagatgtaaccccgggatga

SEQ ID NO: 26228 - DNA, 38 bp, Artificial Sequence
  Synthetic oligonucleotide
tacactccgtccctgtacctgcatttcctgcccgctga

SEQ ID NO: 26229 - DNA, 38 bp, Artificial Sequence
  Synthetic oligonucleotide
gacccccaccgcgggcatggctgaactgccttacttga

SEQ ID NO: 26230 - DNA, 38 bp, Artificial Sequence
  Synthetic oligonucleotide
gtcccgcccctgttactgaattctcacattagtcttga

SEQ ID NO: 26231 - DNA, 38 bp, Artificial Sequence
  Synthetic oligonucleotide
accccctgcgcagccggtcctccccgaacccgttttga

SEQ ID NO: 26232 - DNA, 35 bp, Artificial Sequence
  Synthetic oligonucleotide
gaggacacacaactttcgtgacttctaacacacta

SEQ ID NO: 26233 - DNA, 36 bp, Artificial Sequence
  Synthetic oligonucleotide
tggggcctccgcaatttctcgagctcacgttcccta

SEQ ID NO: 26234 - DNA, 35 bp, Artificial Sequence
  Synthetic oligonucleotide
tcgtccacacgggcaacatttctataccgaactac

SEQ ID NO: 26235 - DNA, 34 bp, Artificial Sequence
  Synthetic oligonucleotide
tcaaagacagccgcttcgaatgtcctttaccgcg

SEQ ID NO: 26236 - DNA, 35 bp, Artificial Sequence
  Synthetic oligonucleotide
actggtggcggtctaatcaaggggggggagtgggg

SEQ ID NO: 26237 - DNA, 35 bp, Artificial Sequence
  Synthetic oligonucleotide
ataaccaactcgcccacctgatcgctccagcgact

SEQ ID NO: 26238 - DNA, 35 bp, Artificial Sequence
  Synthetic oligonucleotide
tcgctacgcacttagcattttcccggccttgccct

SEQ ID NO: 26239 - DNA, 35 bp, Artificial Sequence
  Synthetic oligonucleotide
tgactgtgcgtgggggggtccgagctaggggtggt

SEQ ID NO: 26240 - DNA, 35 bp, Artificial Sequence
  Synthetic oligonucleotide
gaagctcggatcatgtgcaagggtggtggggtggt

SEQ ID NO: 26241 - DNA, 35 bp, Artificial Sequence
  Synthetic oligonucleotide
gactatctgtcctgttttttgcaagcaacaccttt

SEQ ID NO: 26242 - DNA, 36 bp, Artificial Sequence
  Synthetic oligonucleotide
tttgtagtacgccgccaatccataagcaccgagcca

SEQ ID NO: 26243 - DNA, 35 bp, Artificial Sequence
  Synthetic oligonucleotide
attatgggagggcggaggggcctgacacatggaga

SEQ ID NO: 26244 - DNA, 38 bp, Artificial Sequence
  Synthetic oligonucleotide
ggatcaccggtccgcattgtgcctatcctccctgatga

SEQ ID NO: 26245 - DNA, 38 bp, Artificial Sequence
  Synthetic oligonucleotide
aaccaccatgggccgcgtacccaactgaccctacctga

SEQ ID NO: 26246 - DNA, 35 bp, Artificial Sequence
  Synthetic oligonucleotide
ttccagccacacctagggttttcccttgacaccac

SEQ ID NO: 26247 - DNA, 35 bp, Artificial Sequence
  Synthetic oligonucleotide
tgtaccacgtgctggcttttagcctgtcccgaccc

SEQ ID NO: 26248 - DNA, 35 bp, Artificial Sequence
  Synthetic oligonucleotide
attgcagagcacgtaaccaccacgcaccatgacgc

SEQ ID NO: 26249 - DNA, 35 bp, Artificial Sequence
  Synthetic oligonucleotide
tagtacaccctgggaatcctatccgtgcacccctc

SEQ ID NO: 26250 - DNA, 35 bp, Artificial Sequence
  Synthetic oligonucleotide
acccattccgcaaaattcctatgtaaacaccgagg

SEQ ID NO: 26251 - DNA, 35 bp, Artificial Sequence
  Synthetic oligonucleotide
tcagttggcgttagcaccactatctgcctcgacgt

SEQ ID NO: 26252 - DNA, 35 bp, Artificial Sequence
  Synthetic oligonucleotide
acagccactcgagcattttaaccctttccatattt

SEQ ID NO: 26253 - DNA, 35 bp, Artificial Sequence
  Synthetic oligonucleotide
gagcctcggcactttcccgtactatccgaagcttt

SEQ ID NO: 26254 - DNA, 36 bp, Artificial Sequence
  Synthetic oligonucleotide
accccccgccgttctaggccctgaaacgctaccgaa

SEQ ID NO: 26255 - DNA, 35 bp, Artificial Sequence
  Synthetic oligonucleotide
tcacgctccatctcaatgctatctcagccgttcca

SEQ ID NO: 26256 - DNA, 36 bp, Artificial Sequence
  Synthetic oligonucleotide
tgaccgccttctctcttattgaatcatccctcggca

SEQ ID NO: 26257 - DNA, 36 bp, Artificial Sequence
  Synthetic oligonucleotide
agaccacccttacacacccccggagtagtcttacga

SEQ ID NO: 26258 - DNA, 37 bp, Artificial Sequence
  Synthetic oligonucleotide
atccgcgcactcctgacgattcttgcgctacacccga

SEQ ID NO: 26259 - DNA, 37 bp, Artificial Sequence
  Synthetic oligonucleotide
gatcatgaaaaggggggtaaacggagggcagtctgga

SEQ ID NO: 26260 - DNA, 38 bp, Artificial Sequence
  Synthetic oligonucleotide
gttgcaaaccaactgcacttctccagtcctgacgctga

SEQ ID NO: 26261 - DNA, 38 bp, Artificial Sequence
  Synthetic oligonucleotide
aaacaacccgagcgtgttccctactaccattctgctga

SEQ ID NO: 26262 - DNA, 35 bp, Artificial Sequence
  Synthetic oligonucleotide
accacatcgcgtcgctccttacatcactctcggac

SEQ ID NO: 26263 - DNA, 35 bp, Artificial Sequence
  Synthetic oligonucleotide
tacgaccaccattcgttctgggaatctacgtcttc

SEQ ID NO: 26264 - DNA, 35 bp, Artificial Sequence
  Synthetic oligonucleotide
gtggaacggcgtggcgggcaagaaaagaagggtgt

SEQ ID NO: 26265 - DNA, 35 bp, Artificial Sequence
  Synthetic oligonucleotide
ggaggatcctgaggcggaaggggaggaggtgagaa

SEQ ID NO: 26266 - DNA, 36 bp, Artificial Sequence
  Synthetic oligonucleotide
gtagaccgagtacttgggaggggaggcggtgcggaa

SEQ ID NO: 26267 - DNA, 35 bp, Artificial Sequence
  Synthetic oligonucleotide
aaagggtggtgagagggaggtcttcggggagctaa

SEQ ID NO: 26268 - DNA, 36 bp, Artificial Sequence
  Synthetic oligonucleotide
acctcgcagtgcttatgacttcatacgcctctgcca

SEQ ID NO: 26269 - DNA, 36 bp, Artificial Sequence
  Synthetic oligonucleotide
atcagcacgcctttgcatcgatcactcgtttactca

SEQ ID NO: 26270 - DNA, 37 bp, Artificial Sequence
  Synthetic oligonucleotide
gtctcctcccccgatcttcgtgtaagccaccaggcga

SEQ ID NO: 26271 - DNA, 38 bp, Artificial Sequence
  Synthetic oligonucleotide
acctagccgtctgccttccgattacaccgccatattga

SEQ ID NO: 26272 - DNA, 37 bp, Artificial Sequence
  Synthetic oligonucleotide
cctgcccgctctaccactcgcgtactgatatccttga

SEQ ID NO: 26273 - DNA, 35 bp, Artificial Sequence
  Synthetic oligonucleotide
gcacttccaacgccggctctccttcaataagctta

SEQ ID NO: 26274 - DNA, 36 bp, Artificial Sequence
  Synthetic oligonucleotide
ttcccagctcctgcgcgtccagtcctaccatgttta

SEQ ID NO: 26275 - DNA, 35 bp, Artificial Sequence
  Synthetic oligonucleotide
tggtgaaggcctatttactctgttgccatgttccc

SEQ ID NO: 26276 - DNA, 35 bp, Artificial Sequence
  Synthetic oligonucleotide
tcctatccccactcactggtgtctatacctatact

SEQ ID NO: 26277 - DNA, 35 bp, Artificial Sequence
  Synthetic oligonucleotide
gagcccggtaccgtgcctgcgcttgtttgccgcct

SEQ ID NO: 26278 - DNA, 35 bp, Artificial Sequence
  Synthetic oligonucleotide
gtgggagcaaaagcaaaggggggtaacacacgagt

SEQ ID NO: 26279 - DNA, 35 bp, Artificial Sequence
  Synthetic oligonucleotide
tttgcacgtgctctcactccggttctgtcttcatt

SEQ ID NO: 26280 - DNA, 35 bp, Artificial Sequence
  Synthetic oligonucleotide
gtcgcgcctttctctgtctagtccgtcccttgctt

SEQ ID NO: 26281 - DNA, 37 bp, Artificial Sequence
  Synthetic oligonucleotide
gaatccaggaggaagaggtagggtgggccacacggga

SEQ ID NO: 26282 - DNA, 37 bp, Artificial Sequence
  Synthetic oligonucleotide
gacagtcggaaaaacaagggcagggtaggtagatgga

SEQ ID NO: 26283 - DNA, 38 bp, Artificial Sequence
  Synthetic oligonucleotide
gcgcgctcctgcgcttaagatcctccccccaccgttga

SEQ ID NO: 26284 - DNA, 36 bp, Artificial Sequence
  Synthetic oligonucleotide
gccggcctcattgaagctgctttgcgttacctccta

SEQ ID NO: 26285 - DNA, 34 bp, Artificial Sequence
  Synthetic oligonucleotide
tcaacccacccatgcgagagcagtgcctacttta

SEQ ID NO: 26286 - DNA, 35 bp, Artificial Sequence
  Synthetic oligonucleotide
gcacccagctctcctgacggtcctgcagtatcgcc

SEQ ID NO: 26287 - DNA, 35 bp, Artificial Sequence
  Synthetic oligonucleotide
gatcaacagtccccgtgcctcctgttaggcacctc

SEQ ID NO: 26288 - DNA, 35 bp, Artificial Sequence
  Synthetic oligonucleotide
tgctaccttctgagcgccgtttggcccttgccctc

SEQ ID NO: 26289 - DNA, 35 bp, Artificial Sequence
  Synthetic oligonucleotide
gacacccggtagtttgacctctgcgaatacctttc

SEQ ID NO: 26290 - DNA, 35 bp, Artificial Sequence
  Synthetic oligonucleotide
atgggacaatggaagagtagataggaaggatgtag

SEQ ID NO: 26291 - DNA, 35 bp, Artificial Sequence
  Synthetic oligonucleotide
gtacgccccagtgatttcgcgtgctcgatctaacg

SEQ ID NO: 26292 - DNA, 35 bp, Artificial Sequence
  Synthetic oligonucleotide
actgaactgaggctggcctttactgatctctcctg

SEQ ID NO: 26293 - DNA, 35 bp, Artificial Sequence
  Synthetic oligonucleotide
agccgcccgagcaccagcccataactagctcacct

SEQ ID NO: 26294 - DNA, 35 bp, Artificial Sequence
  Synthetic oligonucleotide
aaccgcatgcctctatctggcccctcaacgctagt

SEQ ID NO: 26295 - DNA, 35 bp, Artificial Sequence
  Synthetic oligonucleotide
aacacactgcccgccaccatccagacaatgggttt

SEQ ID NO: 26296 - DNA, 36 bp, Artificial Sequence
  Synthetic oligonucleotide
tgacccacctgatctggcgactacacaataacacca

SEQ ID NO: 26297 - DNA, 36 bp, Artificial Sequence
  Synthetic oligonucleotide
gtggcgcacgcatttgaacatatcttcctgctggca

SEQ ID NO: 26298 - DNA, 38 bp, Artificial Sequence
  Synthetic oligonucleotide
gagtctatccctcctgtgccgttcccaccacttcatga

SEQ ID NO: 26299 - DNA, 38 bp, Artificial Sequence
  Synthetic oligonucleotide
agccaggtaccgacctctatctttggctcattccttga

SEQ ID NO: 26300 - DNA, 35 bp, Artificial Sequence
  Synthetic oligonucleotide
gtctggtgcgccttacctcctataacatgtctccc

SEQ ID NO: 26301 - DNA, 35 bp, Artificial Sequence
  Synthetic oligonucleotide
atcatctaccccagtctcggaccctgccttatctg

SEQ ID NO: 26302 - DNA, 35 bp, Artificial Sequence
  Synthetic oligonucleotide
ttcgacctgccatgtatagatccgttccatcctgt

SEQ ID NO: 26303 - DNA, 36 bp, Artificial Sequence
  Synthetic oligonucleotide
ggtaatgccttgggaggggaaggaaggagaggacaa

SEQ ID NO: 26304 - DNA, 35 bp, Artificial Sequence
  Synthetic oligonucleotide
gtaagccatactccatcttcatcttgcgtaccaca

SEQ ID NO: 26305 - DNA, 37 bp, Artificial Sequence
  Synthetic oligonucleotide
tgcagaggttgcggaggaggggggcgggcaatagaga

SEQ ID NO: 26306 - DNA, 36 bp, Artificial Sequence
  Synthetic oligonucleotide
tatccaggcgcctctttctttatacctcactctgga

SEQ ID NO: 26307 - DNA, 36 bp, Artificial Sequence
  Synthetic oligonucleotide
tgtcccccaccgttgcgagtgatttccacaccacta

SEQ ID NO: 26308 - DNA, 37 bp, Artificial Sequence
  Synthetic oligonucleotide
tgcgttcacgccctaattcgtactgactgaacacacc

SEQ ID NO: 26309 - DNA, 35 bp, Artificial Sequence
  Synthetic oligonucleotide
atgaagggagggggagagtacgatagagcaaggtc

SEQ ID NO: 26310 - DNA, 35 bp, Artificial Sequence
  Synthetic oligonucleotide
gacaactgcatggtagtacgcctcttgtttaacct

SEQ ID NO: 26311 - DNA, 35 bp, Artificial Sequence
  Synthetic oligonucleotide
tccacacgagtgcattttctatggtgttcttattt

SEQ ID NO: 26312 - DNA, 36 bp, Artificial Sequence
  Synthetic oligonucleotide
taggtgccacgcattgcgctgaaatatctactctca

SEQ ID NO: 26313 - DNA, 37 bp, Artificial Sequence
  Synthetic oligonucleotide
tgagaccaggaggggggcggggttacggactaaaaga

SEQ ID NO: 26314 - DNA, 37 bp, Artificial Sequence
  Synthetic oligonucleotide
atgactcgcccagctttcattattccgtctagcccga

SEQ ID NO: 26315 - DNA, 37 bp, Artificial Sequence
  Synthetic oligonucleotide
atttggccccgtctcccgtctgcccctttacctcgga

SEQ ID NO: 26316 - DNA, 35 bp, Artificial Sequence
  Synthetic oligonucleotide
tcacccaccgcatggaaccgtcacggatccccata

SEQ ID NO: 26317 - DNA, 35 bp, Artificial Sequence
  Synthetic oligonucleotide
tgtccatggaccagcataacagccactacttcacc

SEQ ID NO: 26318 - DNA, 35 bp, Artificial Sequence
  Synthetic oligonucleotide
gtagccacggctagttccaccgttcattcatctcc

SEQ ID NO: 26319 - DNA, 35 bp, Artificial Sequence
  Synthetic oligonucleotide
ttctggaatgacgtcagccgccctacctgttctcc

SEQ ID NO: 26320 - DNA, 35 bp, Artificial Sequence
  Synthetic oligonucleotide
atgccgtgcttccccccatccgaagtgatttctgc

SEQ ID NO: 26321 - DNA, 35 bp, Artificial Sequence
  Synthetic oligonucleotide
ggagatctgcctgcgttcttacagctgcttttttc

SEQ ID NO: 26322 - DNA, 35 bp, Artificial Sequence
  Synthetic oligonucleotide
tacactcctaatagcctgttcgtagcaacctcttg

SEQ ID NO: 26323 - DNA, 35 bp, Artificial Sequence
  Synthetic oligonucleotide
tgctactcacgagaactggcattgcaactttacct

SEQ ID NO: 26324 - DNA, 35 bp, Artificial Sequence
  Synthetic oligonucleotide
gctgcccctcgcaaattcactgacccagtcaccct

SEQ ID NO: 26325 - DNA, 35 bp, Artificial Sequence
  Synthetic oligonucleotide
acccatgatacacgatactcgtggcctagtactct

SEQ ID NO: 26326 - DNA, 36 bp, Artificial Sequence
  Synthetic oligonucleotide
agtgtagcacccctgggccctgttcgtaaccttcca

SEQ ID NO: 26327 - DNA, 36 bp, Artificial Sequence
  Synthetic oligonucleotide
tgggatagggaatagtgaggggggaagaaaagagga

SEQ ID NO: 26328 - DNA, 37 bp, Artificial Sequence
  Synthetic oligonucleotide
accgcggtagaactggcgagcggggagagggaaggga

SEQ ID NO: 26329 - DNA, 37 bp, Artificial Sequence
  Synthetic oligonucleotide
ttgccacatcaaggcgccctttacaggacctgctgga

SEQ ID NO: 26330 - DNA, 38 bp, Artificial Sequence
  Synthetic oligonucleotide
tccatcacccggccctggatcaagctgttgcaacctga

SEQ ID NO: 26331 - DNA, 37 bp, Artificial Sequence
  Synthetic oligonucleotide
tcacactcgaactatcccccgtggagacacacagtga

SEQ ID NO: 26332 - DNA, 37 bp, Artificial Sequence
  Synthetic oligonucleotide
tctctcagccacacccgcagcccgatttacccagtga

SEQ ID NO: 26333 - DNA, 38 bp, Artificial Sequence
  Synthetic oligonucleotide
gaagcaaaatagaggagagcggaaacgggctatagtga

SEQ ID NO: 26334 - DNA, 37 bp, Artificial Sequence
  Synthetic oligonucleotide
ttgctcccccgcccaccgtgaccccttgcaaaggtga

SEQ ID NO: 26335 - DNA, 36 bp, Artificial Sequence
  Synthetic oligonucleotide
tgtgccgtacgcgctgtcccgtaatccccttcaata

SEQ ID NO: 26336 - DNA, 35 bp, Artificial Sequence
  Synthetic oligonucleotide
gttacccataaggttattagcacggttttgccccc

SEQ ID NO: 26337 - DNA, 35 bp, Artificial Sequence
  Synthetic oligonucleotide
tcagtcacagttcacttgatagcaatgactccgcc

SEQ ID NO: 26338 - DNA, 35 bp, Artificial Sequence
  Synthetic oligonucleotide
gtacggtcacggtcaggaaagtaggttggggatgg

SEQ ID NO: 26339 - DNA, 35 bp, Artificial Sequence
  Synthetic oligonucleotide
tcacccacgaccgtcttaggtttttgaccggtact

SEQ ID NO: 26340 - DNA, 35 bp, Artificial Sequence
  Synthetic oligonucleotide
gactgtcggcttctcgttgtcaccgctactatctt

SEQ ID NO: 26341 - DNA, 36 bp, Artificial Sequence
  Synthetic oligonucleotide
tatgtgggaatggaaaggtgggctttagggagggaa

SEQ ID NO: 26342 - DNA, 36 bp, Artificial Sequence
  Synthetic oligonucleotide
accagagaagcccccgccagtgattcgcccccctaa

SEQ ID NO: 26343 - DNA, 36 bp, Artificial Sequence
  Synthetic oligonucleotide
atacacgcgcgccccatcttatcaattacaccgtca

SEQ ID NO: 26344 - DNA, 37 bp, Artificial Sequence
  Synthetic oligonucleotide
tgacacccccccccaatggcttcgttttgtctccgga

SEQ ID NO: 26345 - DNA, 37 bp, Artificial Sequence
  Synthetic oligonucleotide
acaccttccgatccgtcatttctaaggtcacactgga

SEQ ID NO: 26346 - DNA, 36 bp, Artificial Sequence
  Synthetic oligonucleotide
atcgcccgtgcgcacaccttacacaatcggactgga

SEQ ID NO: 26347 - DNA, 38 bp, Artificial Sequence
  Synthetic oligonucleotide
tgacggagccctggtttcagccactccacccataatga

SEQ ID NO: 26348 - DNA, 37 bp, Artificial Sequence
  Synthetic oligonucleotide
ggatcgcgtctactttctgtaccatccttctcgctga

SEQ ID NO: 26349 - DNA, 35 bp, Artificial Sequence
  Synthetic oligonucleotide
gcatccaccacctttgcgacctccctgttgttcta

SEQ ID NO: 26350 - DNA, 35 bp, Artificial Sequence
  Synthetic oligonucleotide
atctgccgcgcatgcgccattggtccttcgcctcc

SEQ ID NO: 26351 - DNA, 35 bp, Artificial Sequence
  Synthetic oligonucleotide
taatgtcgatggccgctcccttacccgtactcttc

SEQ ID NO: 26352 - DNA, 35 bp, Artificial Sequence
  Synthetic oligonucleotide
gcacgcacgcttaaccttcggagctcgcaccccct

SEQ ID NO: 26353 - DNA, 35 bp, Artificial Sequence
  Synthetic oligonucleotide
ttcccccctcagtgactccaacagtcatagtctct

SEQ ID NO: 26354 - DNA, 35 bp, Artificial Sequence
  Synthetic oligonucleotide
agccacgtaacgctttagttcagcaattatcactt

SEQ ID NO: 26355 - DNA, 36 bp, Artificial Sequence
  Synthetic oligonucleotide
tacgctttgccaccatgtaaccgactttctcgacaa

SEQ ID NO: 26356 - DNA, 36 bp, Artificial Sequence
  Synthetic oligonucleotide
ttacctaccacttgtgcattatcgttccacctacca

SEQ ID NO: 26357 - DNA, 37 bp, Artificial Sequence
  Synthetic oligonucleotide
ggttgggggagaaggggtttggaagaagagctgggga

SEQ ID NO: 26358 - DNA, 37 bp, Artificial Sequence
  Synthetic oligonucleotide
aaatgagggtgcaagctaggtagagggataggaatga

SEQ ID NO: 26359 - DNA, 38 bp, Artificial Sequence
  Synthetic oligonucleotide
tgaccgccagagtctactttccgggtcccctgtcatga

SEQ ID NO: 26360 - DNA, 38 bp, Artificial Sequence
  Synthetic oligonucleotide
accccggtcactgccattctccctaccctctccgatga

SEQ ID NO: 26361 - DNA, 38 bp, Artificial Sequence
  Synthetic oligonucleotide
tgacattacgtcagctttccttctttgcctgttactga

SEQ ID NO: 26362 - DNA, 36 bp, Artificial Sequence
  Synthetic oligonucleotide
acagtgcgaatcagaacctcacatgcctctatctga

SEQ ID NO: 26363 - DNA, 38 bp, Artificial Sequence
  Synthetic oligonucleotide
tgatgtgtcacacacgtatcttcataccacgcccttga

SEQ ID NO: 26364 - DNA, 38 bp, Artificial Sequence
  Synthetic oligonucleotide
atccttgcgcgccatttccatcgctatatcgctcttga

SEQ ID NO: 26365 - DNA, 38 bp, Artificial Sequence
  Synthetic oligonucleotide
tgtgacgcatctgccttttcgactctctatctatttga

SEQ ID NO: 26366 - DNA, 35 bp, Artificial Sequence
  Synthetic oligonucleotide
cccatgcaatacttgcaccgcccctagccccacac

SEQ ID NO: 26367 - DNA, 35 bp, Artificial Sequence
  Synthetic oligonucleotide
atccccagcactaacctctacctgccggaactacc

SEQ ID NO: 26368 - DNA, 35 bp, Artificial Sequence
  Synthetic oligonucleotide
acccgcacgcccactctgcaccaggaacgtaaccc

SEQ ID NO: 26369 - DNA, 35 bp, Artificial Sequence
  Synthetic oligonucleotide
gccgtaatcgtccattctcgagttttgttccctgc

SEQ ID NO: 26370 - DNA, 35 bp, Artificial Sequence
  Synthetic oligonucleotide
ggtgtcccttaccacctggcgcgatacatcccatc

SEQ ID NO: 26371 - DNA, 35 bp, Artificial Sequence
  Synthetic oligonucleotide
tacttgcgtacccgccccctcagcccatcgctatc

SEQ ID NO: 26372 - DNA, 35 bp, Artificial Sequence
  Synthetic oligonucleotide
aagagggaaaagggggcacagggcagacggggggg

SEQ ID NO: 26373 - DNA, 35 bp, Artificial Sequence
  Synthetic oligonucleotide
gagtaccggaaaaatggaagtggtggttgaaaatg

SEQ ID NO: 26374 - DNA, 35 bp, Artificial Sequence
  Synthetic oligonucleotide
ataccttgcctccacctacgaatgcgagccacaaa

SEQ ID NO: 26375 - DNA, 36 bp, Artificial Sequence
  Synthetic oligonucleotide
gccgggcactgtacttatcatttgtcacaacatcca

SEQ ID NO: 26376 - DNA, 36 bp, Artificial Sequence
  Synthetic oligonucleotide
actaacacgcctgggtctatctcctgttctgccaga

SEQ ID NO: 26377 - DNA, 37 bp, Artificial Sequence
  Synthetic oligonucleotide
gcacagggaccactgcttgacgccttactccatacga

SEQ ID NO: 26378 - DNA, 37 bp, Artificial Sequence
  Synthetic oligonucleotide
tcccatcagccgcggttcgcttatcctagttgttcga

SEQ ID NO: 26379 - DNA, 37 bp, Artificial Sequence
  Synthetic oligonucleotide
tgtggccacaatgaatttagtttcgtctccagcctga

SEQ ID NO: 26380 - DNA, 38 bp, Artificial Sequence
  Synthetic oligonucleotide
gttgacacatctgttgtgcaactcaataccctccttga

SEQ ID NO: 26381 - DNA, 38 bp, Artificial Sequence
  Synthetic oligonucleotide
gatgggaccaaaggagggggaaggtggggcgaagttga

SEQ ID NO: 26382 - DNA, 38 bp, Artificial Sequence
  Synthetic oligonucleotide
tgcaccgcagctcccgtggctacgtttctccgctttga

SEQ ID NO: 26383 - DNA, 35 bp, Artificial Sequence
  Synthetic oligonucleotide
atgccgtactctgtcctctgtacctttactgtaac

SEQ ID NO: 26384 - DNA, 35 bp, Artificial Sequence
  Synthetic oligonucleotide
gcacgtaccaattgaaagcccccgcttccgtaacc

SEQ ID NO: 26385 - DNA, 35 bp, Artificial Sequence
  Synthetic oligonucleotide
gctggctcttggtgtcgtccgctctcgtcttcttc

SEQ ID NO: 26386 - DNA, 35 bp, Artificial Sequence
  Synthetic oligonucleotide
accacccagcacacgtttgtccagcctccgttgct

SEQ ID NO: 26387 - DNA, 35 bp, Artificial Sequence
  Synthetic oligonucleotide
gcaggaactccgccccgccatctcatgccccctgt

SEQ ID NO: 26388 - DNA, 35 bp, Artificial Sequence
  Synthetic oligonucleotide
tagaatgtcagctcttatggctgccctgttcactt

SEQ ID NO: 26389 - DNA, 35 bp, Artificial Sequence
  Synthetic oligonucleotide
acctccaccctcaaatatgtctcatcacgaaagtt

SEQ ID NO: 26390 - DNA, 35 bp, Artificial Sequence
  Synthetic oligonucleotide
gactccgaccaggatcactcgatgccccgtacttt

SEQ ID NO: 26391 - DNA, 36 bp, Artificial Sequence
  Synthetic oligonucleotide
tccccgcatccggtttcgagtcttgtctcctacaca

SEQ ID NO: 26392 - DNA, 36 bp, Artificial Sequence
  Synthetic oligonucleotide
aaccatagcgcgctacacacggcccctgcgccccca

SEQ ID NO: 26393 - DNA, 35 bp, Artificial Sequence
  Synthetic oligonucleotide
gcacatgccccgtgttttcttgtatccactatgca

SEQ ID NO: 26394 - DNA, 36 bp, Artificial Sequence
  Synthetic oligonucleotide
tgtgctcccagaactgcacttcccatctggtttcga

SEQ ID NO: 26395 - DNA, 36 bp, Artificial Sequence
  Synthetic oligonucleotide
gaacgagagaaggttgcgaaaaaggagtgattggga

SEQ ID NO: 26396 - DNA, 37 bp, Artificial Sequence
  Synthetic oligonucleotide
gcctccccacggatactcgcctcctgaattagctgga

SEQ ID NO: 26397 - DNA, 38 bp, Artificial Sequence
  Synthetic oligonucleotide
acaccccctctcacctgtcgctggacggacgcctttga

SEQ ID NO: 26398 - DNA, 36 bp, Artificial Sequence
  Synthetic oligonucleotide
acgatcgcgcacctccccacccccttcccagtttga

SEQ ID NO: 26399 - DNA, 35 bp, Artificial Sequence
  Synthetic oligonucleotide
gtaagccgtcgttactttatgcatgcacatccgcc

SEQ ID NO: 26400 - DNA, 35 bp, Artificial Sequence
  Synthetic oligonucleotide
gtcccaacttcagcgccttgccacctcagcacatg

SEQ ID NO: 26401 - DNA, 35 bp, Artificial Sequence
  Synthetic oligonucleotide
accctcccggctttgcatatatatctatggcccct

SEQ ID NO: 26402 - DNA, 35 bp, Artificial Sequence
  Synthetic oligonucleotide
gctccccactcgcatccccgcgctggcatttcctt

SEQ ID NO: 26403 - DNA, 35 bp, Artificial Sequence
  Synthetic oligonucleotide
gtatagctgcgttctgcctttgtttgtttcgtttt

SEQ ID NO: 26404 - DNA, 36 bp, Artificial Sequence
  Synthetic oligonucleotide
tgttccgcaattatgccgcccccccattgtagtaca

SEQ ID NO: 26405 - DNA, 37 bp, Artificial Sequence
  Synthetic oligonucleotide
atgcaccccatcaacacgtttattccttgccatccga

SEQ ID NO: 26406 - DNA, 34 bp, Artificial Sequence
  Synthetic oligonucleotide
tgcatgacgcccatcatcagcaccgcctgttcga

SEQ ID NO: 26407 - DNA, 37 bp, Artificial Sequence
  Synthetic oligonucleotide
tacagtgcctctccgtctcgcaccaccttgctttgga

SEQ ID NO: 26408 - DNA, 36 bp, Artificial Sequence
  Synthetic oligonucleotide
tgcgagtctcacctggcccccgtgtcccttttatga

SEQ ID NO: 26409 - DNA, 36 bp, Artificial Sequence
  Synthetic oligonucleotide
atgttggaggagggggggcctagagtagatcacgta

SEQ ID NO: 26410 - DNA, 35 bp, Artificial Sequence
  Synthetic oligonucleotide
atgccggtgtgcccgttcgctttatcctgttcgta

SEQ ID NO: 26411 - DNA, 35 bp, Artificial Sequence
  Synthetic oligonucleotide
aacacagcgccccgcgacactccctcttcacatta

SEQ ID NO: 26412 - DNA, 35 bp, Artificial Sequence
  Synthetic oligonucleotide
tgccatacctcctgagtgtacaactctattttagc

SEQ ID NO: 26413 - DNA, 35 bp, Artificial Sequence
  Synthetic oligonucleotide
gaagaatggatgaaaggggcgcggaaggagctcgg

SEQ ID NO: 26414 - DNA, 35 bp, Artificial Sequence
  Synthetic oligonucleotide
gtgtaccagtcccagcgctaccacttccatcttgg

SEQ ID NO: 26415 - DNA, 35 bp, Artificial Sequence
  Synthetic oligonucleotide
attgcggtagccccggcttgctctctcgcaccact

SEQ ID NO: 26416 - DNA, 36 bp, Artificial Sequence
  Synthetic oligonucleotide
aataccccccaccgctgagcctgtccccaagcgcaa

SEQ ID NO: 26417 - DNA, 36 bp, Artificial Sequence
  Synthetic oligonucleotide
gtggggacagtggaacggataggggatgggggcgca

SEQ ID NO: 26418 - DNA, 37 bp, Artificial Sequence
  Synthetic oligonucleotide
atagcatccctgctcagctgccagcacgcccatccga

SEQ ID NO: 26419 - DNA, 35 bp, Artificial Sequence
  Synthetic oligonucleotide
tcccgtgctcgtccgctcactgccctccgtatgga

SEQ ID NO: 26420 - DNA, 37 bp, Artificial Sequence
  Synthetic oligonucleotide
accctggccacatgcgtgctcgctaaccctatctgga

SEQ ID NO: 26421 - DNA, 36 bp, Artificial Sequence
  Synthetic oligonucleotide
atgcacccgcaatcgatcatgtccctttaaccctga

SEQ ID NO: 26422 - DNA, 38 bp, Artificial Sequence
  Synthetic oligonucleotide
gacgttagctcacgtacgccattgaccagttctgctga

SEQ ID NO: 26423 - DNA, 35 bp, Artificial Sequence
  Synthetic oligonucleotide
ggagccacagattcgcgttcgcactgtcctcccac

SEQ ID NO: 26424 - DNA, 35 bp, Artificial Sequence
  Synthetic oligonucleotide
gggtcgcggggccattttcgggggcgggtgggacc

SEQ ID NO: 26425 - DNA, 35 bp, Artificial Sequence
  Synthetic oligonucleotide
tgtccagagcatacccgcagacccgtgcccttcat

SEQ ID NO: 26426 - DNA, 36 bp, Artificial Sequence
  Synthetic oligonucleotide
tgctcaccctggacctctcggtaaaaaaacactgca

SEQ ID NO: 26427 - DNA, 37 bp, Artificial Sequence
  Synthetic oligonucleotide
gacactggacatccgccttaccgttcttcgtcgaaga

SEQ ID NO: 26428 - DNA, 37 bp, Artificial Sequence
  Synthetic oligonucleotide
actctcccacctgtgccccttttcaggactcgctaga

SEQ ID NO: 26429 - DNA, 35 bp, Artificial Sequence
  Synthetic oligonucleotide
atcgggtcacaccattagtcaatccgccactccga

SEQ ID NO: 26430 - DNA, 35 bp, Artificial Sequence
  Synthetic oligonucleotide
atccgcggtcactacaaccctgattatgcaacatc

SEQ ID NO: 26431 - DNA, 35 bp, Artificial Sequence
  Synthetic oligonucleotide
ttagcccccacataggaatctaccgcattcctccg

SEQ ID NO: 26432 - DNA, 35 bp, Artificial Sequence
  Synthetic oligonucleotide
gccgtccgagcggcctactttagcccctcctgtct

SEQ ID NO: 26433 - DNA, 35 bp, Artificial Sequence
  Synthetic oligonucleotide
actcatgtcacttccccacatctgctaccggcatt

SEQ ID NO: 26434 - DNA, 36 bp, Artificial Sequence
  Synthetic oligonucleotide
atgtaagggtgggagtttggtagggctgaggataca

SEQ ID NO: 26435 - DNA, 35 bp, Artificial Sequence
  Synthetic oligonucleotide
tttccgcctcaccatccggccttgctggttttaca

SEQ ID NO: 26436 - DNA, 37 bp, Artificial Sequence
  Synthetic oligonucleotide
ttacgaatccagctgccttttgagcataccccaccga

SEQ ID NO: 26437 - DNA, 37 bp, Artificial Sequence
  Synthetic oligonucleotide
gacccctcccgaaacgccttaggatagttcccgttga

SEQ ID NO: 26438 - DNA, 38 bp, Artificial Sequence
  Synthetic oligonucleotide
gccgaacccacccttgtatctaggcctttgtatgttga

SEQ ID NO: 26439 - DNA, 36 bp, Artificial Sequence
  Synthetic oligonucleotide
accgaccgtggttcctgtctaaattcgccgtggtta

SEQ ID NO: 26440 - DNA, 35 bp, Artificial Sequence
  Synthetic oligonucleotide
gtcgatccgcttttctgcagctttcctacatcccc

SEQ ID NO: 26441 - DNA, 35 bp, Artificial Sequence
  Synthetic oligonucleotide
tgatggcaccacagtattctctgcattcttacgcc

SEQ ID NO: 26442 - DNA, 35 bp, Artificial Sequence
  Synthetic oligonucleotide
acgcccccccgagagctagagcgcacaccgccttc

SEQ ID NO: 26443 - DNA, 35 bp, Artificial Sequence
  Synthetic oligonucleotide
gaacgcagacattctggatggatcttcccccctcg

SEQ ID NO: 26444 - DNA, 35 bp, Artificial Sequence
  Synthetic oligonucleotide
taggtcactccatgttcgcacgcctccaaagccat

SEQ ID NO: 26445 - DNA, 35 bp, Artificial Sequence
  Synthetic oligonucleotide
aatgcccactcacctgcaaccgccatagaacaact

SEQ ID NO: 26446 - DNA, 35 bp, Artificial Sequence
  Synthetic oligonucleotide
tgttggcgcccccccctgtgtccgtatcctgggtt

SEQ ID NO: 26447 - DNA, 36 bp, Artificial Sequence
  Synthetic oligonucleotide
ggtgcctatgccccagtccaactccacctattgcaa

SEQ ID NO: 26448 - DNA, 36 bp, Artificial Sequence
  Synthetic oligonucleotide
accccccaccctcggaacgcggagcctgaaccgcca

SEQ ID NO: 26449 - DNA, 36 bp, Artificial Sequence
  Synthetic oligonucleotide
gggatgctctcggttcagctgcctctctctcctcga

SEQ ID NO: 26450 - DNA, 37 bp, Artificial Sequence
  Synthetic oligonucleotide
gcaccactccacacttatgtacctcggacgaattcga

SEQ ID NO: 26451 - DNA, 37 bp, Artificial Sequence
  Synthetic oligonucleotide
tgcgccctagctatgtactgcgcttctctacctgtga

SEQ ID NO: 26452 - DNA, 36 bp, Artificial Sequence
  Synthetic oligonucleotide
gcccacctccgcatgccaccgttacagcaccattga

SEQ ID NO: 26453 - DNA, 36 bp, Artificial Sequence
  Synthetic oligonucleotide
acagtccatcgccattaacccccctctcgactggta

SEQ ID NO: 26454 - DNA, 35 bp, Artificial Sequence
  Synthetic oligonucleotide
atctctcgccgcccgatttccgccccggctttgac

SEQ ID NO: 26455 - DNA, 35 bp, Artificial Sequence
  Synthetic oligonucleotide
aatggcctcagttccgcctacgtctcttccctacc

SEQ ID NO: 26456 - DNA, 35 bp, Artificial Sequence
  Synthetic oligonucleotide
gatccctgctgtcccccgattgcgagcgctacctc

SEQ ID NO: 26457 - DNA, 35 bp, Artificial Sequence
  Synthetic oligonucleotide
ggtgagagcgggggggaggatggaatcgcatctag

SEQ ID NO: 26458 - DNA, 35 bp, Artificial Sequence
  Synthetic oligonucleotide
gcgcccctcacttcttgttttctgttcggtgctcg

SEQ ID NO: 26459 - DNA, 35 bp, Artificial Sequence
  Synthetic oligonucleotide
gaggtcaccctattgctccaacgccgtagttccat

SEQ ID NO: 26460 - DNA, 35 bp, Artificial Sequence
  Synthetic oligonucleotide
tatgcacagccctgagcgttccaccactcctgcct

SEQ ID NO: 26461 - DNA, 35 bp, Artificial Sequence
  Synthetic oligonucleotide
acaaccgacccgccttcctgcctaactagaccgct

SEQ ID NO: 26462 - DNA, 36 bp, Artificial Sequence
  Synthetic oligonucleotide
gtagagctcgctcaggtctttctccactgttcctct

SEQ ID NO: 26463 - DNA, 37 bp, Artificial Sequence
  Synthetic oligonucleotide
atccgggccgggaggaagagggaagccgtagtaacga

SEQ ID NO: 26464 - DNA, 36 bp, Artificial Sequence
  Synthetic oligonucleotide
tacgcttgcccgatgatatcacaccaacgctgccta

SEQ ID NO: 26465 - DNA, 36 bp, Artificial Sequence
  Synthetic oligonucleotide
tcaaagtccgggtaggcagggcggggagggaacgta

SEQ ID NO: 26466 - DNA, 35 bp, Artificial Sequence
  Synthetic oligonucleotide
actgcatcttaggcgcagaacccgcacccccttac

SEQ ID NO: 26467 - DNA, 35 bp, Artificial Sequence
  Synthetic oligonucleotide
tccccccccggtcgtatccccatggcgctgccagc

SEQ ID NO: 26468 - DNA, 35 bp, Artificial Sequence
  Synthetic oligonucleotide
ataacatccgccagtcgcctccgctgcgtaccttc

SEQ ID NO: 26469 - DNA, 35 bp, Artificial Sequence
  Synthetic oligonucleotide
atctcaccgtgcactccacttgctactccgtctcg

SEQ ID NO: 26470 - DNA, 35 bp, Artificial Sequence
  Synthetic oligonucleotide
acaacacaactccacctcagacgctatatctggtt

SEQ ID NO: 26471 - DNA, 36 bp, Artificial Sequence
  Synthetic oligonucleotide
accgagcgggctcagtatcatttccttctagcgcaa

SEQ ID NO: 26472 - DNA, 36 bp, Artificial Sequence
  Synthetic oligonucleotide
tcatcccaggccctgtccgcatcacgctaaactcga

SEQ ID NO: 26473 - DNA, 38 bp, Artificial Sequence
  Synthetic oligonucleotide
gccccacctcacgactcgattgaacaccctggcattga

SEQ ID NO: 26474 - DNA, 37 bp, Artificial Sequence
  Synthetic oligonucleotide
gaatgcgctcgttcagcaggcgggtgaagggggttga

SEQ ID NO: 26475 - DNA, 35 bp, Artificial Sequence
  Synthetic oligonucleotide
tcaacaaccgaccaggattcctccccgatccacta

SEQ ID NO: 26476 - DNA, 35 bp, Artificial Sequence
  Synthetic oligonucleotide
tccagtggccgtccagcgtgtttccctatccgccc

SEQ ID NO: 26477 - DNA, 35 bp, Artificial Sequence
  Synthetic oligonucleotide
gtgccgcgcccctgtgcctgctcatatccactatc

SEQ ID NO: 26478 - DNA, 35 bp, Artificial Sequence
  Synthetic oligonucleotide
gttcactcattgcatacccggtacttgtcattttc

SEQ ID NO: 26479 - DNA, 35 bp, Artificial Sequence
  Synthetic oligonucleotide
acgtcgcaccccccaccaattgcgcttaaatccat

SEQ ID NO: 26480 - DNA, 35 bp, Artificial Sequence
  Synthetic oligonucleotide
gaacgtggaaccgcctccctacgctcctgtttgtt

SEQ ID NO: 26481 - DNA, 35 bp, Artificial Sequence
  Synthetic oligonucleotide
ttttacgtccaccttacctccctgccgcaggtgca

SEQ ID NO: 26482 - DNA, 37 bp, Artificial Sequence
  Synthetic oligonucleotide
gtggtggtgggggagaaaactgcagcagggtatcaga

SEQ ID NO: 26483 - DNA, 37 bp, Artificial Sequence
  Synthetic oligonucleotide
ggggaatctggccggagggaggggaatgcgataggga

SEQ ID NO: 26484 - DNA, 35 bp, Artificial Sequence
  Synthetic oligonucleotide
gcacctttgcctatctgcaccgacatgccatgcta

SEQ ID NO: 26485 - DNA, 35 bp, Artificial Sequence
  Synthetic oligonucleotide
attcccccagtttgcatggtcccgtaattcccgta

SEQ ID NO: 26486 - DNA, 36 bp, Artificial Sequence
  Synthetic oligonucleotide
tcctacaccttgctgtgcttcttcgtttaccgctta

SEQ ID NO: 26487 - DNA, 36 bp, Artificial Sequence
  Synthetic oligonucleotide
gatccgtatcgccctggtgcctttcgggtaaccccc

SEQ ID NO: 26488 - DNA, 35 bp, Artificial Sequence
  Synthetic oligonucleotide
gaaccccgctggtgcctatgttgccgttcaagccc

SEQ ID NO: 26489 - DNA, 35 bp, Artificial Sequence
  Synthetic oligonucleotide
agctacacgctagctctctagttttatatgctccc

SEQ ID NO: 26490 - DNA, 35 bp, Artificial Sequence
  Synthetic oligonucleotide
gacaccgacgccccttctaactgccaccctagcgc

SEQ ID NO: 26491 - DNA, 35 bp, Artificial Sequence
  Synthetic oligonucleotide
actccatgtagtacaaccggaggctccaccccatc

SEQ ID NO: 26492 - DNA, 35 bp, Artificial Sequence
  Synthetic oligonucleotide
ggagtgtgtgtaagggtggaaaaacgaagatggag

SEQ ID NO: 26493 - DNA, 35 bp, Artificial Sequence
  Synthetic oligonucleotide
aacgcacctgcctcatgccaacagtcgtcgagact

SEQ ID NO: 26494 - DNA, 35 bp, Artificial Sequence
  Synthetic oligonucleotide
gtcatggcccagcagttattccatgaccctcaatt

SEQ ID NO: 26495 - DNA, 35 bp, Artificial Sequence
  Synthetic oligonucleotide
tgatacccaccccgtgacccattggttaacagttt

SEQ ID NO: 26496 - DNA, 36 bp, Artificial Sequence
  Synthetic oligonucleotide
ggggggggaggactaggagtaaattggtggagggaa

SEQ ID NO: 26497 - DNA, 35 bp, Artificial Sequence
  Synthetic oligonucleotide
gatgccccgggatttcactactcgcctcagacaca

SEQ ID NO: 26498 - DNA, 36 bp, Artificial Sequence
  Synthetic oligonucleotide
atcgctctgccgagttaaacccactgatcctcgaca

SEQ ID NO: 26499 - DNA, 36 bp, Artificial Sequence
  Synthetic oligonucleotide
gcgatcggccattccacgcgtgccgtctgttctaca

SEQ ID NO: 26500 - DNA, 35 bp, Artificial Sequence
  Synthetic oligonucleotide
tagcaagtgggggggaggcgggattagaagcaata

SEQ ID NO: 26501 - DNA, 36 bp, Artificial Sequence
  Synthetic oligonucleotide
tcatgcacctcacctgctttcattttgcgcgcctta

SEQ ID NO: 26502 - DNA, 35 bp, Artificial Sequence
  Synthetic oligonucleotide
tgcagacatccccccagggtctattctccacacac

SEQ ID NO: 26503 - DNA, 35 bp, Artificial Sequence
  Synthetic oligonucleotide
actccgctcccacatctcgatatcgatgctaaacc

SEQ ID NO: 26504 - DNA, 35 bp, Artificial Sequence
  Synthetic oligonucleotide
taaattgcaacgtccccccccacttttctgctgtc

SEQ ID NO: 26505 - DNA, 35 bp, Artificial Sequence
  Synthetic oligonucleotide
acgctcccctgcatacctttaacaccgcacgaccg

SEQ ID NO: 26506 - DNA, 35 bp, Artificial Sequence
  Synthetic oligonucleotide
tgctgcccacaacaccacgttcgattagttcccgg

SEQ ID NO: 26507 - DNA, 35 bp, Artificial Sequence
  Synthetic oligonucleotide
aacgggacgtggagcgggttggaaatatctgatgg

SEQ ID NO: 26508 - DNA, 35 bp, Artificial Sequence
  Synthetic oligonucleotide
gcaattcagccacactattcctttcacagcaatct

SEQ ID NO: 26509 - DNA, 35 bp, Artificial Sequence
  Synthetic oligonucleotide
aatagccaagcccgcccccgtcctcggtacataca

SEQ ID NO: 26510 - DNA, 37 bp, Artificial Sequence
  Synthetic oligonucleotide
gcgaccgtcgctccttcccaccgagccttcttagcga

SEQ ID NO: 26511 - DNA, 37 bp, Artificial Sequence
  Synthetic oligonucleotide
atgcaccctccctcgccgccagaccggaaccgatcga

SEQ ID NO: 26512 - DNA, 37 bp, Artificial Sequence
  Synthetic oligonucleotide
tcctgtgtaccgtccctgcgtcaattgaccaccatga

SEQ ID NO: 26513 - DNA, 36 bp, Artificial Sequence
  Synthetic oligonucleotide
ggaggaggatggggtggtgagtgtgggatgtgagta

SEQ ID NO: 26514 - DNA, 35 bp, Artificial Sequence
  Synthetic oligonucleotide
tttgcctcaccactcatgttcctcatgctcctgta

SEQ ID NO: 26515 - DNA, 35 bp, Artificial Sequence
  Synthetic oligonucleotide
tgtgtgccaaatctcgcctagccacagcatttcac

SEQ ID NO: 26516 - DNA, 35 bp, Artificial Sequence
  Synthetic oligonucleotide
acgtgaccacgcctatttttcctagctatgcctac

SEQ ID NO: 26517 - DNA, 35 bp, Artificial Sequence
  Synthetic oligonucleotide
gtaaccctcactgcgtattatatagcgtgtccccc

SEQ ID NO: 26518 - DNA, 35 bp, Artificial Sequence
  Synthetic oligonucleotide
gtaacgccgcgcctcattcacgggcccgattctcc

SEQ ID NO: 26519 - DNA, 35 bp, Artificial Sequence
  Synthetic oligonucleotide
gtcgccttggacccccctcttagccaccgtgaatc

SEQ ID NO: 26520 - DNA, 35 bp, Artificial Sequence
  Synthetic oligonucleotide
gtcgccactcaagtctccgtactgtcgtactaact

SEQ ID NO: 26521 - DNA, 35 bp, Artificial Sequence
  Synthetic oligonucleotide
ggagggcgggcggggactaagggtgttagcaaaca

SEQ ID NO: 26522 - DNA, 36 bp, Artificial Sequence
  Synthetic oligonucleotide
ggaggcccccgccaccgactatacaatgtacaccca

SEQ ID NO: 26523 - DNA, 37 bp, Artificial Sequence
  Synthetic oligonucleotide
gcataccgtccctttttttcttctgtcacatcgcaga

SEQ ID NO: 26524 - DNA, 37 bp, Artificial Sequence
  Synthetic oligonucleotide
acgcccgaggcctaacactcccgccactgaccgccga

SEQ ID NO: 26525 - DNA, 37 bp, Artificial Sequence
  Synthetic oligonucleotide
gtgggaggggcccgctggggcgaaggagaattgccga

SEQ ID NO: 26526 - DNA, 37 bp, Artificial Sequence
  Synthetic oligonucleotide
aggaggaccgagtagagagggaggaaggcggggatga

SEQ ID NO: 26527 - DNA, 37 bp, Artificial Sequence
  Synthetic oligonucleotide
tagccaccgtacattcgcgattgggctcccttgttga

SEQ ID NO: 26528 - DNA, 35 bp, Artificial Sequence
  Synthetic oligonucleotide
acctggatgcccctcgccttctactgttttacata

SEQ ID NO: 26529 - DNA, 35 bp, Artificial Sequence
  Synthetic oligonucleotide
tcacatgtttatgcccctcgccgctgccaaggcta

SEQ ID NO: 26530 - DNA, 35 bp, Artificial Sequence
  Synthetic oligonucleotide
acaccacactcacctaacaattaccgggtctctcc

SEQ ID NO: 26531 - DNA, 35 bp, Artificial Sequence
  Synthetic oligonucleotide
taccgggccgccacggtgagcttctttcgccctct

SEQ ID NO: 26532 - DNA, 35 bp, Artificial Sequence
  Synthetic oligonucleotide
gtcactgcaagactcccccgtaacgacccgacggt

SEQ ID NO: 26533 - DNA, 35 bp, Artificial Sequence
  Synthetic oligonucleotide
ggtgcccctgccgcggtaaaaagatccctgcactt

SEQ ID NO: 26534 - DNA, 36 bp, Artificial Sequence
  Synthetic oligonucleotide
gtggagccgcccaggcaccctattatactatctaaa

SEQ ID NO: 26535 - DNA, 35 bp, Artificial Sequence
  Synthetic oligonucleotide
gttgcctccctgcttttggttccttgccaacccca

SEQ ID NO: 26536 - DNA, 37 bp, Artificial Sequence
  Synthetic oligonucleotide
tccgaagcctcgtttcccgacctatacgtcccccaga

SEQ ID NO: 26537 - DNA, 36 bp, Artificial Sequence
  Synthetic oligonucleotide
gtgcccacctttgcggcacaccccctccccgtccta

SEQ ID NO: 26538 - DNA, 36 bp, Artificial Sequence
  Synthetic oligonucleotide
gttttacacgtgcttcccacaccgccgagaccttta

SEQ ID NO: 26539 - DNA, 35 bp, Artificial Sequence
  Synthetic oligonucleotide
gcccctccgaacggccacttcgtttaagccatcac

SEQ ID NO: 26540 - DNA, 35 bp, Artificial Sequence
  Synthetic oligonucleotide
tgctggctcccggaccctggcctaaacacccatac

SEQ ID NO: 26541 - DNA, 35 bp, Artificial Sequence
  Synthetic oligonucleotide
tcatcgaaccactgcttgcgcccgttaccccatcc

SEQ ID NO: 26542 - DNA, 35 bp, Artificial Sequence
  Synthetic oligonucleotide
aactggtgtggccatccccgaacctgcccctgtcc

SEQ ID NO: 26543 - DNA, 35 bp, Artificial Sequence
  Synthetic oligonucleotide
gaccgttaccacgccttctcgccctagcccgctag

SEQ ID NO: 26544 - DNA, 35 bp, Artificial Sequence
  Synthetic oligonucleotide
ttcgcacggtcactatggcaaactccacttccatg

SEQ ID NO: 26545 - DNA, 35 bp, Artificial Sequence
  Synthetic oligonucleotide
tctcgccggtatcgcctctgctcgcctcggaccct

SEQ ID NO: 26546 - DNA, 35 bp, Artificial Sequence
  Synthetic oligonucleotide
cctcaactccggtcacgttgtctcccgttaggcct

SEQ ID NO: 26547 - DNA, 35 bp, Artificial Sequence
  Synthetic oligonucleotide
ggtgacagggagatcaaagggggggcgggaccagt

SEQ ID NO: 26548 - DNA, 35 bp, Artificial Sequence
  Synthetic oligonucleotide
aacaaacagtgggcggtaaagggggggtggcgatt

SEQ ID NO: 26549 - DNA, 35 bp, Artificial Sequence
  Synthetic oligonucleotide
actaccaccctctaagcgatgtcacccacgggcca

SEQ ID NO: 26550 - DNA, 37 bp, Artificial Sequence
  Synthetic oligonucleotide
acagctcgttccgccttcacccatgctccatcgccga

SEQ ID NO: 26551 - DNA, 35 bp, Artificial Sequence
  Synthetic oligonucleotide
ataccctccagctccaccacttgtttacctgcgga

SEQ ID NO: 26552 - DNA, 37 bp, Artificial Sequence
  Synthetic oligonucleotide
gcttagcaagcacggaaggaatagggataacggggga

SEQ ID NO: 26553 - DNA, 36 bp, Artificial Sequence
  Synthetic oligonucleotide
acaccatcgacaagctcaagtccccggcccactgta

SEQ ID NO: 26554 - DNA, 35 bp, Artificial Sequence
  Synthetic oligonucleotide
acagcccttccctctccgacacttgactcgctgta

SEQ ID NO: 26555 - DNA, 35 bp, Artificial Sequence
  Synthetic oligonucleotide
acccggggtcgctttgccgaaatgaactcttttac

SEQ ID NO: 26556 - DNA, 35 bp, Artificial Sequence
  Synthetic oligonucleotide
gaaggtgggaggggtgttattaagcttatgccaag

SEQ ID NO: 26557 - DNA, 35 bp, Artificial Sequence
  Synthetic oligonucleotide
gaccccatcacgctcgtttcttgtgaacgccctag

SEQ ID NO: 26558 - DNA, 35 bp, Artificial Sequence
  Synthetic oligonucleotide
tgcacaacacggcgtatcacctggaactggcacct

SEQ ID NO: 26559 - DNA, 35 bp, Artificial Sequence
  Synthetic oligonucleotide
gattacaccggtgggttgggccattgtaacctcct

SEQ ID NO: 26560 - DNA, 35 bp, Artificial Sequence
  Synthetic oligonucleotide
tgaagaggcggagctatagggcgagggggaggcgt

SEQ ID NO: 26561 - DNA, 35 bp, Artificial Sequence
  Synthetic oligonucleotide
gacccagctcactttactacaacagaccacccttt

SEQ ID NO: 26562 - DNA, 35 bp, Artificial Sequence
  Synthetic oligonucleotide
tcccccccccccggtgagatatgtcccttatgttt

SEQ ID NO: 26563 - DNA, 35 bp, Artificial Sequence
  Synthetic oligonucleotide
tccacctggcccagccttaggctacgttgcttttt

SEQ ID NO: 26564 - DNA, 35 bp, Artificial Sequence
  Synthetic oligonucleotide
tcatcgaacacccgcatccgtccctccaccggaaa

SEQ ID NO: 26565 - DNA, 37 bp, Artificial Sequence
  Synthetic oligonucleotide
gaaaggcaaatgggaaggtagggggacggtgggggga

SEQ ID NO: 26566 - DNA, 38 bp, Artificial Sequence
  Synthetic oligonucleotide
gcccacacctaccgctcgcggacaagaactccctttga

SEQ ID NO: 26567 - DNA, 36 bp, Artificial Sequence
  Synthetic oligonucleotide
tgcaccctcagactcattctcacgtggttctagtta

SEQ ID NO: 26568 - DNA, 35 bp, Artificial Sequence
  Synthetic oligonucleotide
atcctctcacgttcgccgcattacacatctcgtat

SEQ ID NO: 26569 - DNA, 35 bp, Artificial Sequence
  Synthetic oligonucleotide
acccaatccggatgttaactcggatttccatttat

SEQ ID NO: 26570 - DNA, 35 bp, Artificial Sequence
  Synthetic oligonucleotide
aaactacgcaatgtacctcgacgccaccagcactt

SEQ ID NO: 26571 - DNA, 36 bp, Artificial Sequence
  Synthetic oligonucleotide
attgccccgctaaactatgttacaccgtcatgtcca

SEQ ID NO: 26572 - DNA, 37 bp, Artificial Sequence
  Synthetic oligonucleotide
tcgtcccctggctcctgttccgtggccctttgaccga

SEQ ID NO: 26573 - DNA, 35 bp, Artificial Sequence
  Synthetic oligonucleotide
gatctgccacaccgagttccgcgattcaccatcga

SEQ ID NO: 26574 - DNA, 37 bp, Artificial Sequence
  Synthetic oligonucleotide
gtcatgagtcaagggaaaacgggaatatcgggtagga

SEQ ID NO: 26575 - DNA, 37 bp, Artificial Sequence
  Synthetic oligonucleotide
atcgcgcacgcaaccaaatgcctgcaaatacccggga

SEQ ID NO: 26576 - DNA, 37 bp, Artificial Sequence
  Synthetic oligonucleotide
attgcgggcccccgttcccattgcctaccatccatga

SEQ ID NO: 26577 - DNA, 35 bp, Artificial Sequence
  Synthetic oligonucleotide
gaagtatcgcgccacatccttgcccatgatcatga

SEQ ID NO: 26578 - DNA, 38 bp, Artificial Sequence
  Synthetic oligonucleotide
atgtgtggggtgggtggacggggtacagaatgggatga

SEQ ID NO: 26579 - DNA, 38 bp, Artificial Sequence
  Synthetic oligonucleotide
gccaacgtgcttctcacttcgtagcccttcgcccctga

SEQ ID NO: 26580 - DNA, 35 bp, Artificial Sequence
  Synthetic oligonucleotide
gacccgtttcaccaccctgacctccttacgggttc

SEQ ID NO: 26581 - DNA, 35 bp, Artificial Sequence
  Synthetic oligonucleotide
tcatactacccgtacgccctgccaaccttccgtag

SEQ ID NO: 26582 - DNA, 35 bp, Artificial Sequence
  Synthetic oligonucleotide
tacggctcctcctgacgcacaatccccgccgcccg

SEQ ID NO: 26583 - DNA, 36 bp, Artificial Sequence
  Synthetic oligonucleotide
atgttctgcagccgccccccgccgctgtgccgcaca

SEQ ID NO: 26584 - DNA, 36 bp, Artificial Sequence
  Synthetic oligonucleotide
gtccccagtctagccctgtcatgcgttgtccgccca

SEQ ID NO: 26585 - DNA, 37 bp, Artificial Sequence
  Synthetic oligonucleotide
taggacccatccgcctcgatattttcgcccacataga

SEQ ID NO: 26586 - DNA, 37 bp, Artificial Sequence
  Synthetic oligonucleotide
tgaggaggaaggcgggggaataggaagtaagtgtaga

SEQ ID NO: 26587 - DNA, 37 bp, Artificial Sequence
  Synthetic oligonucleotide
gcccccaacccgcctgttcggcctgcctcttggacga

SEQ ID NO: 26588 - DNA, 38 bp, Artificial Sequence
  Synthetic oligonucleotide
acgcaccttgtgccatgtggtaccttctacttcgctga

SEQ ID NO: 26589 - DNA, 38 bp, Artificial Sequence
  Synthetic oligonucleotide
tccagcccgccgccggtttgactctgaacgcacattga

SEQ ID NO: 26590 - DNA, 38 bp, Artificial Sequence
  Synthetic oligonucleotide
gccggacccacggatgccattggatccttctcacttga

SEQ ID NO: 26591 - DNA, 35 bp, Artificial Sequence
  Synthetic oligonucleotide
acactcctaactggttactagtgacgttgtactac

SEQ ID NO: 26592 - DNA, 35 bp, Artificial Sequence
  Synthetic oligonucleotide
tgtgacccgaaagggctatacatcctagcctgccc

SEQ ID NO: 26593 - DNA, 35 bp, Artificial Sequence
  Synthetic oligonucleotide
gcactactgtttgtcgttaccttgcagcccttgcc

SEQ ID NO: 26594 - DNA, 35 bp, Artificial Sequence
  Synthetic oligonucleotide
acagagcctgcttctttctattttgcatcacatcc

SEQ ID NO: 26595 - DNA, 35 bp, Artificial Sequence
  Synthetic oligonucleotide
tgttccccctgcactgcatccaggaaagttcccgc

SEQ ID NO: 26596 - DNA, 35 bp, Artificial Sequence
  Synthetic oligonucleotide
tgaccctctaggattgcatgtcagcttccctccgc

SEQ ID NO: 26597 - DNA, 35 bp, Artificial Sequence
  Synthetic oligonucleotide
agtgtggccatcaatcctctcgtgacgtattactc

SEQ ID NO: 26598 - DNA, 35 bp, Artificial Sequence
  Synthetic oligonucleotide
tagatcctcctcagctttttttaggcctgaatctc

SEQ ID NO: 26599 - DNA, 35 bp, Artificial Sequence
  Synthetic oligonucleotide
gtcactggaagaactggataaggagggcgggtggg

SEQ ID NO: 26600 - DNA, 34 bp, Artificial Sequence
  Synthetic oligonucleotide
gtacgaaacactctgacgcaaatcgcctcaccat

SEQ ID NO: 26601 - DNA, 36 bp, Artificial Sequence
  Synthetic oligonucleotide
acccaacgcctagttaacctatggtcttttgtccaa

SEQ ID NO: 26602 - DNA, 37 bp, Artificial Sequence
  Synthetic oligonucleotide
gtgtgcctcctcattgtccttataagccccatagaga

SEQ ID NO: 26603 - DNA, 36 bp, Artificial Sequence
  Synthetic oligonucleotide
gaccacccacccccactccttgtacctggccataga

SEQ ID NO: 26604 - DNA, 37 bp, Artificial Sequence
  Synthetic oligonucleotide
gccgtaccatcctggagaaacactgcccactcaatga

SEQ ID NO: 26605 - DNA, 37 bp, Artificial Sequence
  Synthetic oligonucleotide
gcgctgccttccgtaacctgtctggcccattagttga

SEQ ID NO: 26606 - DNA, 37 bp, Artificial Sequence
  Synthetic oligonucleotide
tcacgaccaccgccctctcaacctaacgagtcgttga

SEQ ID NO: 26607 - DNA, 38 bp, Artificial Sequence
  Synthetic oligonucleotide
tgtggcccgaaagtagtacgccactcgcttttatttga

SEQ ID NO: 26608 - DNA, 36 bp, Artificial Sequence
  Synthetic oligonucleotide
gatgtcgcccgctaactatgaaccagcccatgacta

SEQ ID NO: 26609 - DNA, 36 bp, Artificial Sequence
  Synthetic oligonucleotide
tcagaaccgtaccacagggctctaatacgtattcta

SEQ ID NO: 26610 - DNA, 35 bp, Artificial Sequence
  Synthetic oligonucleotide
tccatgcgcattcgatgccttgctctgtttcatct

SEQ ID NO: 26611 - DNA, 35 bp, Artificial Sequence
  Synthetic oligonucleotide
tccccgttcacatcacaatcctgttcgtacaaggt

SEQ ID NO: 26612 - DNA, 35 bp, Artificial Sequence
  Synthetic oligonucleotide
ttcgcatgcgcaacaataaaatggaaatgtcctgt

SEQ ID NO: 26613 - DNA, 35 bp, Artificial Sequence
  Synthetic oligonucleotide
tcagaacgccaacgacaatctgcccgatctgctaa

SEQ ID NO: 26614 - DNA, 35 bp, Artificial Sequence
  Synthetic oligonucleotide
gaaacaccgaggcgccgcccaccatcttattgtaa

SEQ ID NO: 26615 - DNA, 36 bp, Artificial Sequence
  Synthetic oligonucleotide
gcgtgtgcaacaagggcggagtcgcgggtggggcca

SEQ ID NO: 26616 - DNA, 36 bp, Artificial Sequence
  Synthetic oligonucleotide
gaggagggatagggatctttacgataacggacggca

SEQ ID NO: 26617 - DNA, 37 bp, Artificial Sequence
  Synthetic oligonucleotide
tgaacggaaataaaggtggagaatgccggggttaaga

SEQ ID NO: 26618 - DNA, 37 bp, Artificial Sequence
  Synthetic oligonucleotide
tttcaccaaccgccgcaccgtagtactatctgcacga

SEQ ID NO: 26619 - DNA, 36 bp, Artificial Sequence
  Synthetic oligonucleotide
acatggcaccgaacagccatttctgccctactacga

SEQ ID NO: 26620 - DNA, 37 bp, Artificial Sequence
  Synthetic oligonucleotide
ttatgcggtcggacaccccctatttgctcgtcttcga

SEQ ID NO: 26621 - DNA, 36 bp, Artificial Sequence
  Synthetic oligonucleotide
acataccaactgccccacacaagggaaccctccgga

SEQ ID NO: 26622 - DNA, 38 bp, Artificial Sequence
  Synthetic oligonucleotide
atgcccggcgtagccctccccgtgccctcctaacttga

SEQ ID NO: 26623 - DNA, 38 bp, Artificial Sequence
  Synthetic oligonucleotide
acgaccgagtatggctaagccgcccctgaatcccttga

SEQ ID NO: 26624 - DNA, 37 bp, Artificial Sequence
  Synthetic oligonucleotide
tcagtgccaggtgctccgttgttcgtcccccctttga

SEQ ID NO: 26625 - DNA, 35 bp, Artificial Sequence
  Synthetic oligonucleotide
accccaatcccccgcctctgtgcaggtcctgtgac

SEQ ID NO: 26626 - DNA, 35 bp, Artificial Sequence
  Synthetic oligonucleotide
tcgatcgtgcgaacacaaccgttatccacttgccc

SEQ ID NO: 26627 - DNA, 35 bp, Artificial Sequence
  Synthetic oligonucleotide
tatttgaccgcccgttcgtgagccccgactttcgc

SEQ ID NO: 26628 - DNA, 35 bp, Artificial Sequence
  Synthetic oligonucleotide
aaggggggatgggggtggtggtctctatactcgcg

SEQ ID NO: 26629 - DNA, 35 bp, Artificial Sequence
  Synthetic oligonucleotide
tacaccatattcgtgacgctttccacctttcctgg

SEQ ID NO: 26630 - DNA, 36 bp, Artificial Sequence
  Synthetic oligonucleotide
gaagccacctcttgtcttatccaccgatggttttca

SEQ ID NO: 26631 - DNA, 37 bp, Artificial Sequence
  Synthetic oligonucleotide
agtgcccacaaattgcccgtcccccatccccgtgaga

SEQ ID NO: 26632 - DNA, 38 bp, Artificial Sequence
  Synthetic oligonucleotide
atgccccctcaactgctcccctctgtccatcttgatga

SEQ ID NO: 26633 - DNA, 37 bp, Artificial Sequence
  Synthetic oligonucleotide
tcatctgccacctatctctaaagcgccccttccctga

SEQ ID NO: 26634 - DNA, 35 bp, Artificial Sequence
  Synthetic oligonucleotide
accgttcacatcccaccaccaattcagaccgacac

SEQ ID NO: 26635 - DNA, 34 bp, Artificial Sequence
  Synthetic oligonucleotide
gctacagcccatgcaactgtacactttttcaccg

SEQ ID NO: 26636 - DNA, 35 bp, Artificial Sequence
  Synthetic oligonucleotide
aaccatacccggtgtgcctatccgctacctccctg

SEQ ID NO: 26637 - DNA, 35 bp, Artificial Sequence
  Synthetic oligonucleotide
ggaacggcacacaacaccatgtaatcaacccgcct

SEQ ID NO: 26638 - DNA, 35 bp, Artificial Sequence
  Synthetic oligonucleotide
gagactgcccccttaattgcgctctaccccacatt

SEQ ID NO: 26639 - DNA, 36 bp, Artificial Sequence
  Synthetic oligonucleotide
gagcggatgcgagcgggagacaacaagttgtgcaaa

SEQ ID NO: 26640 - DNA, 36 bp, Artificial Sequence
  Synthetic oligonucleotide
aatacggggtagggcgtggggaacgggaaggtaaca

SEQ ID NO: 26641 - DNA, 37 bp, Artificial Sequence
  Synthetic oligonucleotide
gtatagccgcagtcgtttcgtcccccgtccaccccga

SEQ ID NO: 26642 - DNA, 37 bp, Artificial Sequence
  Synthetic oligonucleotide
gtgccccgtccacctgcttgtagcgctatctattcga

SEQ ID NO: 26643 - DNA, 37 bp, Artificial Sequence
  Synthetic oligonucleotide
aagtgcgtgggagtaaatagggggagagggatgggga

SEQ ID NO: 26644 - DNA, 38 bp, Artificial Sequence
  Synthetic oligonucleotide
atatgcgcccaccgaccgcggccctcactttgcaatga

SEQ ID NO: 26645 - DNA, 38 bp, Artificial Sequence
  Synthetic oligonucleotide
actcaccactgcgtagcgtgccacccacatccctatga

SEQ ID NO: 26646 - DNA, 36 bp, Artificial Sequence
  Synthetic oligonucleotide
ggtggtcggtgggggaggggtagggatgtgtggtga

SEQ ID NO: 26647 - DNA, 38 bp, Artificial Sequence
  Synthetic oligonucleotide
tcaccgtaccttccaccctgggtgtctgtctttcttga

SEQ ID NO: 26648 - DNA, 38 bp, Artificial Sequence
  Synthetic oligonucleotide
gttatgcgggaggggtattagggaggggccacggttga

SEQ ID NO: 26649 - DNA, 38 bp, Artificial Sequence
  Synthetic oligonucleotide
tctgctccccccagccatgtaagttctggccgctttga

SEQ ID NO: 26650 - DNA, 36 bp, Artificial Sequence
  Synthetic oligonucleotide
atagcgagtgcgggggggtgttaggggtgtcggata

SEQ ID NO: 26651 - DNA, 36 bp, Artificial Sequence
  Synthetic oligonucleotide
tcagccacgaagctctgcgttgcatgcactgcccta

SEQ ID NO: 26652 - DNA, 35 bp, Artificial Sequence
  Synthetic oligonucleotide
tactccatgccgtagcaccccgaattaggacctta

SEQ ID NO: 26653 - DNA, 35 bp, Artificial Sequence
  Synthetic oligonucleotide
aaccttgcctctgttcttaatacctgccgccgtta

SEQ ID NO: 26654 - DNA, 35 bp, Artificial Sequence
  Synthetic oligonucleotide
tcctcaacccgcttgtgccgtgcctcaagctacac

SEQ ID NO: 26655 - DNA, 35 bp, Artificial Sequence
  Synthetic oligonucleotide
tcagaggtgacccccttttgtgcgctttggaagtc

SEQ ID NO: 26656 - DNA, 35 bp, Artificial Sequence
  Synthetic oligonucleotide
tcacacgtgcgtacggtccgcatccatatccattc

SEQ ID NO: 26657 - DNA, 35 bp, Artificial Sequence
  Synthetic oligonucleotide
gcaataaccgggaggaaggtgggggtcagggagca

SEQ ID NO: 26658 - DNA, 36 bp, Artificial Sequence
  Synthetic oligonucleotide
gttaccgcgctcacccagcttcacctaacccaggga

SEQ ID NO: 26659 - DNA, 37 bp, Artificial Sequence
  Synthetic oligonucleotide
atgcccaagcgctcctccctttatggtacgtcctgga

SEQ ID NO: 26660 - DNA, 38 bp, Artificial Sequence
  Synthetic oligonucleotide
gatgtgttagaaggtggaaaatgaggtaaggctgatga

SEQ ID NO: 26661 - DNA, 38 bp, Artificial Sequence
  Synthetic oligonucleotide
gtcgccccatgagatctaactgcctcctcattttttga

SEQ ID NO: 26662 - DNA, 36 bp, Artificial Sequence
  Synthetic oligonucleotide
gcaacccgatcgctccacgaaaacgctattaccgta

SEQ ID NO: 26663 - DNA, 35 bp, Artificial Sequence
  Synthetic oligonucleotide
tccccgttcaccgcactgctgagttacttcaatta

SEQ ID NO: 26664 - DNA, 35 bp, Artificial Sequence
  Synthetic oligonucleotide
gccagaccatcccccccgtatgctctgtattgtta

SEQ ID NO: 26665 - DNA, 35 bp, Artificial Sequence
  Synthetic oligonucleotide
gcctcccgccgctccattaacaattcgcgtttcac

SEQ ID NO: 26666 - DNA, 35 bp, Artificial Sequence
  Synthetic oligonucleotide
gacgtgcggatctatcctggtttctttgctcgccc

SEQ ID NO: 26667 - DNA, 35 bp, Artificial Sequence
  Synthetic oligonucleotide
tccgtgtctcaccctgctacgatatccttacatcc

SEQ ID NO: 26668 - DNA, 35 bp, Artificial Sequence
  Synthetic oligonucleotide
gcagacacttgctgtccttaaatgtaccatactcc

SEQ ID NO: 26669 - DNA, 35 bp, Artificial Sequence
  Synthetic oligonucleotide
gactccacctcccagtcttccctccccggtgcatc

SEQ ID NO: 26670 - DNA, 35 bp, Artificial Sequence
  Synthetic oligonucleotide
tcccacctcccggaaacatctgtatagtacccttg

SEQ ID NO: 26671 - DNA, 35 bp, Artificial Sequence
  Synthetic oligonucleotide
accacaacgacgtattttgtcgcccgattacaact

SEQ ID NO: 26672 - DNA, 35 bp, Artificial Sequence
  Synthetic oligonucleotide
acaccctatcccaacggtcagttcgctttgctact

SEQ ID NO: 26673 - DNA, 36 bp, Artificial Sequence
  Synthetic oligonucleotide
gatgaccgcgatacgcactctcatgaattgttcaca

SEQ ID NO: 26674 - DNA, 36 bp, Artificial Sequence
  Synthetic oligonucleotide
ggaccaggtcacttgttcttcgcccttaaccccgca

SEQ ID NO: 26675 - DNA, 33 bp, Artificial Sequence
  Synthetic oligonucleotide
gcgctgatcgcccggccgctccttaccctatca

SEQ ID NO: 26676 - DNA, 37 bp, Artificial Sequence
  Synthetic oligonucleotide
ggggagggctgggggggttcgaacaattgtaccgtga

SEQ ID NO: 26677 - DNA, 37 bp, Artificial Sequence
  Synthetic oligonucleotide
gggaaacatgggggtggatagatgttcatgggggtga

SEQ ID NO: 26678 - DNA, 37 bp, Artificial Sequence
  Synthetic oligonucleotide
tcgagggggtgagggaggatggtgactgtgggtttga

SEQ ID NO: 26679 - DNA, 36 bp, Artificial Sequence
  Synthetic oligonucleotide
gtgagcaagtgcatggggggaatgtaagggcagata

SEQ ID NO: 26680 - DNA, 35 bp, Artificial Sequence
  Synthetic oligonucleotide
ttacccccgattcgatgccatccttatatgcacta

SEQ ID NO: 26681 - DNA, 35 bp, Artificial Sequence
  Synthetic oligonucleotide
tcccatgagcgggactattacagcgactctaacac

SEQ ID NO: 26682 - DNA, 35 bp, Artificial Sequence
  Synthetic oligonucleotide
gcgagagccgagattcctggtttctgtactgcact

SEQ ID NO: 26683 - DNA, 35 bp, Artificial Sequence
  Synthetic oligonucleotide
gttggagggcaaacttcgtattctggttctcgcct

SEQ ID NO: 26684 - DNA, 35 bp, Artificial Sequence
  Synthetic oligonucleotide
gcaccatcaggcgcgttttaatacgtagtttccgt

SEQ ID NO: 26685 - DNA, 36 bp, Artificial Sequence
  Synthetic oligonucleotide
taacacattcccccggctccacctcttgttggcgaa

SEQ ID NO: 26686 - DNA, 36 bp, Artificial Sequence
  Synthetic oligonucleotide
atccggtgggaaacgggtggggcaggagcaatgaca

SEQ ID NO: 26687 - DNA, 35 bp, Artificial Sequence
  Synthetic oligonucleotide
gagtcgcgccaccgttgcgtctctttattttctca

SEQ ID NO: 26688 - DNA, 37 bp, Artificial Sequence
  Synthetic oligonucleotide
tccacagtctctctgcgcttaaatatgattcccagga

SEQ ID NO: 26689 - DNA, 37 bp, Artificial Sequence
  Synthetic oligonucleotide
gatgtgcatggggctggggaatgatcgacgggtatga

SEQ ID NO: 26690 - DNA, 34 bp, Artificial Sequence
  Synthetic oligonucleotide
gctgaacctacacatccacctagacggatctatt

SEQ ID NO: 26691 - DNA, 35 bp, Artificial Sequence
  Synthetic oligonucleotide
ttcaccccaccaacggtacaatagactatttcttt

SEQ ID NO: 26692 - DNA, 35 bp, Artificial Sequence
  Synthetic oligonucleotide
gctgtccctcgtgctaccttggcccttttcaggca

SEQ ID NO: 26693 - DNA, 37 bp, Artificial Sequence
  Synthetic oligonucleotide
ttaccacccgcacgtacattttaaacactggctggga

SEQ ID NO: 26694 - DNA, 37 bp, Artificial Sequence
  Synthetic oligonucleotide
gtgaacacggaggagcatagggagggagcaattggga

SEQ ID NO: 26695 - DNA, 38 bp, Artificial Sequence
  Synthetic oligonucleotide
tagacaccccccctgtcgcgcacccgggtctcctctga

SEQ ID NO: 26696 - DNA, 37 bp, Artificial Sequence
  Synthetic oligonucleotide
gacactgcaccttgcgtggtgtcgctcacatatgtga

SEQ ID NO: 26697 - DNA, 37 bp, Artificial Sequence
  Synthetic oligonucleotide
actctgccctgcctcgaaccttatgactgtgcgttga

SEQ ID NO: 26698 - DNA, 37 bp, Artificial Sequence
  Synthetic oligonucleotide
gttaacagccgccacgtccaaatttctccctggttga

SEQ ID NO: 26699 - DNA, 38 bp, Artificial Sequence
  Synthetic oligonucleotide
tgcagtgcctcatggctcttctgcatccccctatttga

SEQ ID NO: 26700 - DNA, 36 bp, Artificial Sequence
  Synthetic oligonucleotide
actaccacacaaatctgattctgtcaccttttgcta

SEQ ID NO: 26701 - DNA, 35 bp, Artificial Sequence
  Synthetic oligonucleotide
tagtccacccatccccaggttgcgtactgtattac

SEQ ID NO: 26702 - DNA, 35 bp, Artificial Sequence
  Synthetic oligonucleotide
atgaccaaacctgtcactcacccgcattttcgggc

SEQ ID NO: 26703 - DNA, 35 bp, Artificial Sequence
  Synthetic oligonucleotide
tacgacttcccagagcagccgcgcatctcactatc

SEQ ID NO: 26704 - DNA, 35 bp, Artificial Sequence
  Synthetic oligonucleotide
gaacgaacaccaaacacggcgcacatctacccagt

SEQ ID NO: 26705 - DNA, 37 bp, Artificial Sequence
  Synthetic oligonucleotide
tgcaccccctgttccgctcattagtgttccttgcgaa

SEQ ID NO: 26706 - DNA, 36 bp, Artificial Sequence
  Synthetic oligonucleotide
tgtccgacacgtatccgtataccttactcccaacca

SEQ ID NO: 26707 - DNA, 36 bp, Artificial Sequence
  Synthetic oligonucleotide
aatttgcaccccctcgctgtactgtaacttcattca

SEQ ID NO: 26708 - DNA, 36 bp, Artificial Sequence
  Synthetic oligonucleotide
tgtgaccctctctgctcccccgacccctgaaggaga

SEQ ID NO: 26709 - DNA, 37 bp, Artificial Sequence
  Synthetic oligonucleotide
ttagggacgaacaaaaaagcaaatcagggcatcagga

SEQ ID NO: 26710 - DNA, 38 bp, Artificial Sequence
  Synthetic oligonucleotide
tccccgcccgatctctacatcgcccatatcgctcctga

SEQ ID NO: 26711 - DNA, 38 bp, Artificial Sequence
  Synthetic oligonucleotide
ttatgacccgccactgcccccctctatgtcagttgtga

SEQ ID NO: 26712 - DNA, 38 bp, Artificial Sequence
  Synthetic oligonucleotide
tagacctaccaccttgttcgaatgccaccaattattga

SEQ ID NO: 26713 - DNA, 36 bp, Artificial Sequence
  Synthetic oligonucleotide
atgacaccgtggcgctatctcctgcatttgacatta

SEQ ID NO: 26714 - DNA, 35 bp, Artificial Sequence
  Synthetic oligonucleotide
tcatcactctcgctgaatgggcgatcgactcatcc

SEQ ID NO: 26715 - DNA, 35 bp, Artificial Sequence
  Synthetic oligonucleotide
gtatcaacgcaacgcctattgctctatcgtaccgc

SEQ ID NO: 26716 - DNA, 35 bp, Artificial Sequence
  Synthetic oligonucleotide
gggtcgacctcctccggtgcatcccaaacccgtgc

SEQ ID NO: 26717 - DNA, 35 bp, Artificial Sequence
  Synthetic oligonucleotide
tatcgaacgcctacagaccttcacaacctcgttgc

SEQ ID NO: 26718 - DNA, 35 bp, Artificial Sequence
  Synthetic oligonucleotide
gagtcacacctggacccgacgtttgctttgcactc

SEQ ID NO: 26719 - DNA, 35 bp, Artificial Sequence
  Synthetic oligonucleotide
acatgccgctatggtcccttcggaacgacctcccg

SEQ ID NO: 26720 - DNA, 35 bp, Artificial Sequence
  Synthetic oligonucleotide
gctgcaggggatgcggagggtagcaaggggtggat

SEQ ID NO: 26721 - DNA, 35 bp, Artificial Sequence
  Synthetic oligonucleotide
acagggaggttggtagagggtggggttgcgttact

SEQ ID NO: 26722 - DNA, 35 bp, Artificial Sequence
  Synthetic oligonucleotide
tttacacgaccgctcctatgccaggtggttcccct

SEQ ID NO: 26723 - DNA, 35 bp, Artificial Sequence
  Synthetic oligonucleotide
gtggccccccaccaccttgtagctgatattctctt

SEQ ID NO: 26724 - DNA, 36 bp, Artificial Sequence
  Synthetic oligonucleotide
gcctgggctcctcgtgcgcaagtccacgcacccttt

SEQ ID NO: 26725 - DNA, 36 bp, Artificial Sequence
  Synthetic oligonucleotide
tcatgacccgtactatccacccgcatttgccgctaa

SEQ ID NO: 26726 - DNA, 36 bp, Artificial Sequence
  Synthetic oligonucleotide
gaatgcgacccgccaccctatatgatgccacttgca

SEQ ID NO: 26727 - DNA, 36 bp, Artificial Sequence
  Synthetic oligonucleotide
gccgagcaacttctgatcatcacaactccactctca

SEQ ID NO: 26728 - DNA, 37 bp, Artificial Sequence
  Synthetic oligonucleotide
aaggtgcaggtctataggtcatggaggatggggggga

SEQ ID NO: 26729 - DNA, 38 bp, Artificial Sequence
  Synthetic oligonucleotide
acatgtgccctgttcgatcttcactcctgttggcatga

SEQ ID NO: 26730 - DNA, 36 bp, Artificial Sequence
  Synthetic oligonucleotide
gtaggggggtaggggagtaggtatggggttcggtga

SEQ ID NO: 26731 - DNA, 36 bp, Artificial Sequence
  Synthetic oligonucleotide
gccacgcactttcagtcgttctattattcccaccta

SEQ ID NO: 26732 - DNA, 35 bp, Artificial Sequence
  Synthetic oligonucleotide
gccccgccacggagtagtcgatcaccgctgcaccc

SEQ ID NO: 26733 - DNA, 35 bp, Artificial Sequence
  Synthetic oligonucleotide
tccccctgtaggctactgaactactgttttgatcc

SEQ ID NO: 26734 - DNA, 35 bp, Artificial Sequence
  Synthetic oligonucleotide
acgccctgcccactgcttaatttgtaataaattcc

SEQ ID NO: 26735 - DNA, 35 bp, Artificial Sequence
  Synthetic oligonucleotide
gagcggggttcgtaaggaggggatcgtgggggagg

SEQ ID NO: 26736 - DNA, 35 bp, Artificial Sequence
  Synthetic oligonucleotide
gctcaagccacattagcatagaattccccacacgt

SEQ ID NO: 26737 - DNA, 36 bp, Artificial Sequence
  Synthetic oligonucleotide
ttcaccctcggtccaagtcacgggctcttccatcaa

SEQ ID NO: 26738 - DNA, 36 bp, Artificial Sequence
  Synthetic oligonucleotide
gtcaactgccacatttcgcgacatgaacatcctaca

SEQ ID NO: 26739 - DNA, 35 bp, Artificial Sequence
  Synthetic oligonucleotide
taacgcccaagccgcattatcacctataacctcca

SEQ ID NO: 26740 - DNA, 36 bp, Artificial Sequence
  Synthetic oligonucleotide
gggatggacctgctcgtttctttctccgggatttca

SEQ ID NO: 26741 - DNA, 37 bp, Artificial Sequence
  Synthetic oligonucleotide
tcacgctccaccatgttaacaaatctacccggcacga

SEQ ID NO: 26742 - DNA, 35 bp, Artificial Sequence
  Synthetic oligonucleotide
tcactaccacggctgtagtccgctaacttccgcga

SEQ ID NO: 26743 - DNA, 37 bp, Artificial Sequence
  Synthetic oligonucleotide
tgccagccccggtcgtctacccctaccccgcatgcga

SEQ ID NO: 26744 - DNA, 35 bp, Artificial Sequence
  Synthetic oligonucleotide
gagttgacctgggagaagaagatagagcgggagga

SEQ ID NO: 26745 - DNA, 37 bp, Artificial Sequence
  Synthetic oligonucleotide
gccgaacggtgcagttaacggcctcctcttccatgga

SEQ ID NO: 26746 - DNA, 38 bp, Artificial Sequence
  Synthetic oligonucleotide
gagtgagggagcgggggggacaaaggctgattggatga

SEQ ID NO: 26747 - DNA, 37 bp, Artificial Sequence
  Synthetic oligonucleotide
atcgcaacgtgcctacaccatacccgcttcaccgtga

SEQ ID NO: 26748 - DNA, 38 bp, Artificial Sequence
  Synthetic oligonucleotide
gatggcctcactttgacttacattttcccaccctgtga

SEQ ID NO: 26749 - DNA, 38 bp, Artificial Sequence
  Synthetic oligonucleotide
agtaggggcgaacgggaaggagggatcagggatattga

SEQ ID NO: 26750 - DNA, 37 bp, Artificial Sequence
  Synthetic oligonucleotide
taccggccccctaatctgccgcccatgctggagccta

SEQ ID NO: 26751 - DNA, 35 bp, Artificial Sequence
  Synthetic oligonucleotide
acactccccgttcctccgatgcgcagtccggaagc

SEQ ID NO: 26752 - DNA, 35 bp, Artificial Sequence
  Synthetic oligonucleotide
gagggagcacaattgaactattacgccacacccgc

SEQ ID NO: 26753 - DNA, 35 bp, Artificial Sequence
  Synthetic oligonucleotide
tcccgaacccaactggtggtatcatctaacattct

SEQ ID NO: 26754 - DNA, 35 bp, Artificial Sequence
  Synthetic oligonucleotide
tgggagggcgggctggggtatttagtgcgatttct

SEQ ID NO: 26755 - DNA, 35 bp, Artificial Sequence
  Synthetic oligonucleotide
tgcgttggcgacactatctgccttcgagtccatca

SEQ ID NO: 26756 - DNA, 37 bp, Artificial Sequence
  Synthetic oligonucleotide
gaagagtagagagcaggataggagtggcggaaaaaga

SEQ ID NO: 26757 - DNA, 35 bp, Artificial Sequence
  Synthetic oligonucleotide
tagatccggtctgtttatgcctgcttccccttcga

SEQ ID NO: 26758 - DNA, 35 bp, Artificial Sequence
  Synthetic oligonucleotide
acatgcgtcaaccctgcctaacgctactagccccc

SEQ ID NO: 26759 - DNA, 35 bp, Artificial Sequence
  Synthetic oligonucleotide
gccggatcactgcacccccgcaacccctacacacg

SEQ ID NO: 26760 - DNA, 35 bp, Artificial Sequence
  Synthetic oligonucleotide
tgagaaagggggtgcaggggggcggtccgtgttaa

SEQ ID NO: 26761 - DNA, 36 bp, Artificial Sequence
  Synthetic oligonucleotide
accccctgagcttttgtgatgtaccaccatcagtca

SEQ ID NO: 26762 - DNA, 37 bp, Artificial Sequence
  Synthetic oligonucleotide
gtaaggggcgatgtaggcaagggggttatgaaagcga

SEQ ID NO: 26763 - DNA, 38 bp, Artificial Sequence
  Synthetic oligonucleotide
ggtcgtagggagggggacggagcattactaaggggtga

SEQ ID NO: 26764 - DNA, 38 bp, Artificial Sequence
  Synthetic oligonucleotide
tccccatcgtaggcacggcttattctcccagcttttga

SEQ ID NO: 26765 - DNA, 36 bp, Artificial Sequence
  Synthetic oligonucleotide
aatgagcacccgctgatactctcctcgtgatcgcta

SEQ ID NO: 26766 - DNA, 36 bp, Artificial Sequence
  Synthetic oligonucleotide
tgaacacccactctcagccgattagctatcactgta

SEQ ID NO: 26767 - DNA, 36 bp, Artificial Sequence
  Synthetic oligonucleotide
tgtcccgtactactgcccctcgttcgtgcctttgta

SEQ ID NO: 26768 - DNA, 35 bp, Artificial Sequence
  Synthetic oligonucleotide
gattggcatcactagcctggagctcgtttttagcc

SEQ ID NO: 26769 - DNA, 35 bp, Artificial Sequence
  Synthetic oligonucleotide
agaacatcgcgcccattatctttgctcacgcacgc

SEQ ID NO: 26770 - DNA, 35 bp, Artificial Sequence
  Synthetic oligonucleotide
ttacaacatcacgtgtaagccctctcgttccactc

SEQ ID NO: 26771 - DNA, 35 bp, Artificial Sequence
  Synthetic oligonucleotide
gcaccgagatcatcgagtaaccgacccatagcctc

SEQ ID NO: 26772 - DNA, 35 bp, Artificial Sequence
  Synthetic oligonucleotide
accacatgctgtcaaatctccccttcaccacgtgg

SEQ ID NO: 26773 - DNA, 35 bp, Artificial Sequence
  Synthetic oligonucleotide
gaagcaacattgcgtacctatgccactcctcattg

SEQ ID NO: 26774 - DNA, 36 bp, Artificial Sequence
  Synthetic oligonucleotide
gtgatgctctgtcgctgtcacttgtcttgcttacca

SEQ ID NO: 26775 - DNA, 37 bp, Artificial Sequence
  Synthetic oligonucleotide
gttaacgcaatcgtgtagtgcgtcccttgcccctcga

SEQ ID NO: 26776 - DNA, 37 bp, Artificial Sequence
  Synthetic oligonucleotide
gcgatagtcacacgttttttgcttcgttttttcatga

SEQ ID NO: 26777 - DNA, 38 bp, Artificial Sequence
  Synthetic oligonucleotide
ggaccccacctctacgggtaacgtacacctgtctctga

SEQ ID NO: 26778 - DNA, 36 bp, Artificial Sequence
  Synthetic oligonucleotide
gatcgccgcgcgtgtagtcttctccccttccccgta

SEQ ID NO: 26779 - DNA, 36 bp, Artificial Sequence
  Synthetic oligonucleotide
gtcaccgccacctgctgttatcgctgctttgggtta

SEQ ID NO: 26780 - DNA, 35 bp, Artificial Sequence
  Synthetic oligonucleotide
gctccatacatcaccgcctgaggtacctcagggcc

SEQ ID NO: 26781 - DNA, 35 bp, Artificial Sequence
  Synthetic oligonucleotide
ggaccgcgcaccgtgccccaaccactctcacaggc

SEQ ID NO: 26782 - DNA, 35 bp, Artificial Sequence
  Synthetic oligonucleotide
ctgcaatacccctgctttcccgttcgctagacgcg

SEQ ID NO: 26783 - DNA, 35 bp, Artificial Sequence
  Synthetic oligonucleotide
gatcacatcacctaagtgaccctaacatgtttagg

SEQ ID NO: 26784 - DNA, 35 bp, Artificial Sequence
  Synthetic oligonucleotide
gcccatcacaccttctattctactcagagttgact

SEQ ID NO: 26785 - DNA, 35 bp, Artificial Sequence
  Synthetic oligonucleotide
gagttgacccgcctgaataatttgttaccgcttct

SEQ ID NO: 26786 - DNA, 35 bp, Artificial Sequence
  Synthetic oligonucleotide
taccgaccagcagatcttgaattcccgcgccttgt

SEQ ID NO: 26787 - DNA, 36 bp, Artificial Sequence
  Synthetic oligonucleotide
tgcttgcccacccctgcctgaagaacgatatcgaca

SEQ ID NO: 26788 - DNA, 35 bp, Artificial Sequence
  Synthetic oligonucleotide
ggtactgccacgcacttccttttatgtcacataca

SEQ ID NO: 26789 - DNA, 38 bp, Artificial Sequence
  Synthetic oligonucleotide
gcgatgccgcagtaacagggaaacgggaaggggggcga

SEQ ID NO: 26790 - DNA, 36 bp, Artificial Sequence
  Synthetic oligonucleotide
tgtgacactcaggcatcacgctaccacacaatcgga

SEQ ID NO: 26791 - DNA, 37 bp, Artificial Sequence
  Synthetic oligonucleotide
gagggtggtggaatagagtgatgggggcatggtatga

SEQ ID NO: 26792 - DNA, 37 bp, Artificial Sequence
  Synthetic oligonucleotide
aacaaacgcgccccctggttaccgctatccgccctga

SEQ ID NO: 26793 - DNA, 37 bp, Artificial Sequence
  Synthetic oligonucleotide
cctacatcacagtgtccccgcctccagtctggtctga

SEQ ID NO: 26794 - DNA, 36 bp, Artificial Sequence
  Synthetic oligonucleotide
tctcaagccgcacctttctgactagacacccctata

SEQ ID NO: 26795 - DNA, 35 bp, Artificial Sequence
  Synthetic oligonucleotide
gccatctgcaacaacggttcacagtacacttattc

SEQ ID NO: 26796 - DNA, 35 bp, Artificial Sequence
  Synthetic oligonucleotide
gttcccattcgcgtcgcgacccgcccaaaatgcct

SEQ ID NO: 26797 - DNA, 35 bp, Artificial Sequence
  Synthetic oligonucleotide
ttgaggctacatttggtggttgttctgcatcttct

SEQ ID NO: 26798 - DNA, 35 bp, Artificial Sequence
  Synthetic oligonucleotide
tcacgcggcataaccaatcgagcccctttctccgt

SEQ ID NO: 26799 - DNA, 35 bp, Artificial Sequence
  Synthetic oligonucleotide
cggacacttacactctctgccgctttgaacataaa

SEQ ID NO: 26800 - DNA, 37 bp, Artificial Sequence
  Synthetic oligonucleotide
gaccaccgcatttattttatctattgacacaggtaga

SEQ ID NO: 26801 - DNA, 37 bp, Artificial Sequence
  Synthetic oligonucleotide
acgttacgccatcgtctcacctctcgcctcgattcga

SEQ ID NO: 26802 - DNA, 37 bp, Artificial Sequence
  Synthetic oligonucleotide
tgtacccattccgctttcgtttagtgatcatacatga

SEQ ID NO: 26803 - DNA, 38 bp, Artificial Sequence
  Synthetic oligonucleotide
gagggctttaggagggacgggagggggacgggagatga

SEQ ID NO: 26804 - DNA, 37 bp, Artificial Sequence
  Synthetic oligonucleotide
tcctgacgcctgttatcctttatctcacctgaagtga

SEQ ID NO: 26805 - DNA, 38 bp, Artificial Sequence
  Synthetic oligonucleotide
tatatcgcccgcctttgttctatctcttgccaccgtga

SEQ ID NO: 26806 - DNA, 37 bp, Artificial Sequence
  Synthetic oligonucleotide
tccaccagatcatacctgattatttgcctacccttga

SEQ ID NO: 26807 - DNA, 38 bp, Artificial Sequence
  Synthetic oligonucleotide
ttccatctcacacgttataggcccgtcttcttccttga

SEQ ID NO: 26808 - DNA, 35 bp, Artificial Sequence
  Synthetic oligonucleotide
gtccattgcatatgcccggtccacaacactagccc

SEQ ID NO: 26809 - DNA, 36 bp, Artificial Sequence
  Synthetic oligonucleotide
ttgggccccatcttacttgtagtcgttcctcctagc

SEQ ID NO: 26810 - DNA, 35 bp, Artificial Sequence
  Synthetic oligonucleotide
tcgccgatggctgttgccgccctgttttctttagc

SEQ ID NO: 26811 - DNA, 35 bp, Artificial Sequence
  Synthetic oligonucleotide
ccgccacccttagaatctgctaccctttgaatggc

SEQ ID NO: 26812 - DNA, 35 bp, Artificial Sequence
  Synthetic oligonucleotide
tccaccacgcctgtggcagtaataactgcagttcg

SEQ ID NO: 26813 - DNA, 34 bp, Artificial Sequence
  Synthetic oligonucleotide
gtccattctgacggttcactgtatcttatccttg

SEQ ID NO: 26814 - DNA, 35 bp, Artificial Sequence
  Synthetic oligonucleotide
ggtgctcgcgggccgagccttacaccctcactctt

SEQ ID NO: 26815 - DNA, 36 bp, Artificial Sequence
  Synthetic oligonucleotide
gaaggtgggcgcaaagaaaatagtgcaggtgtcaaa

SEQ ID NO: 26816 - DNA, 36 bp, Artificial Sequence
  Synthetic oligonucleotide
atctccctgcccccgagttccatatgccacctctaa

SEQ ID NO: 26817 - DNA, 35 bp, Artificial Sequence
  Synthetic oligonucleotide
tgcataaccactggcgctaatggagccttacatca

SEQ ID NO: 26818 - DNA, 37 bp, Artificial Sequence
  Synthetic oligonucleotide
gtacatcagccctgccatatcacagacctgaaataga

SEQ ID NO: 26819 - DNA, 36 bp, Artificial Sequence
  Synthetic oligonucleotide
ggaccggtccgatcccgccaacactccccattgcga

SEQ ID NO: 26820 - DNA, 37 bp, Artificial Sequence
  Synthetic oligonucleotide
aaactgcatagccggggaaggaggaactgctttggga

SEQ ID NO: 26821 - DNA, 37 bp, Artificial Sequence
  Synthetic oligonucleotide
aacgtcgaacgatctaaaggggatggcagggggtgga

SEQ ID NO: 26822 - DNA, 37 bp, Artificial Sequence
  Synthetic oligonucleotide
aactcaaccggggccacattcgcctgacgatccatga

SEQ ID NO: 26823 - DNA, 38 bp, Artificial Sequence
  Synthetic oligonucleotide
tctgcgccgccgtaaactttgatatgccccccaactga

SEQ ID NO: 26824 - DNA, 37 bp, Artificial Sequence
  Synthetic oligonucleotide
gacaccgaaattgacctccctgatgtgacctgagtga

SEQ ID NO: 26825 - DNA, 37 bp, Artificial Sequence
  Synthetic oligonucleotide
agtgggaggcgaaagcagggagtggcgtgtggtttga

SEQ ID NO: 26826 - DNA, 35 bp, Artificial Sequence
  Synthetic oligonucleotide
gatctactcgccactgctcggtctcgacccatcta

SEQ ID NO: 26827 - DNA, 35 bp, Artificial Sequence
  Synthetic oligonucleotide
gtcttgtccgcacttgtttttgcttcccgccatta

SEQ ID NO: 26828 - DNA, 35 bp, Artificial Sequence
  Synthetic oligonucleotide
acacgcgctctcccacctggatcaactacctctta

SEQ ID NO: 26829 - DNA, 35 bp, Artificial Sequence
  Synthetic oligonucleotide
atctctcatcagttgcccggagcctttgcttccac

SEQ ID NO: 26830 - DNA, 35 bp, Artificial Sequence
  Synthetic oligonucleotide
tccctgcacgcgccttggttcccacccccctaccc

SEQ ID NO: 26831 - DNA, 35 bp, Artificial Sequence
  Synthetic oligonucleotide
ttgtccaccttccgcactgccaccatcgtttcatc

SEQ ID NO: 26832 - DNA, 35 bp, Artificial Sequence
  Synthetic oligonucleotide
accgattccccgcgcattacaccttatgtttaccg

SEQ ID NO: 26833 - DNA, 35 bp, Artificial Sequence
  Synthetic oligonucleotide
tccggtgatgtcgcttgttcccgtccctccttccg

SEQ ID NO: 26834 - DNA, 35 bp, Artificial Sequence
  Synthetic oligonucleotide
gacacctccggctctcttctggcccccgcacaggg

SEQ ID NO: 26835 - DNA, 35 bp, Artificial Sequence
  Synthetic oligonucleotide
gagatcctcttccccctgatgagttttagcccctt

SEQ ID NO: 26836 - DNA, 36 bp, Artificial Sequence
  Synthetic oligonucleotide
tccccgtagatgttccgccccctttgcctttataga

SEQ ID NO: 26837 - DNA, 36 bp, Artificial Sequence
  Synthetic oligonucleotide
tcacacctgagcatctgtgccttactatcccgccga

SEQ ID NO: 26838 - DNA, 36 bp, Artificial Sequence
  Synthetic oligonucleotide
acatccatcctacccagacgtggcttcccctgggga

SEQ ID NO: 26839 - DNA, 38 bp, Artificial Sequence
  Synthetic oligonucleotide
gttgcacgctcttgttctacacacccacgaatacctga

SEQ ID NO: 26840 - DNA, 37 bp, Artificial Sequence
  Synthetic oligonucleotide
gacacctatcacaacgcaactcgcccagttcccctga

SEQ ID NO: 26841 - DNA, 38 bp, Artificial Sequence
  Synthetic oligonucleotide
tttgcgggcggtgggagggccattggtcatgctgctga

SEQ ID NO: 26842 - DNA, 37 bp, Artificial Sequence
  Synthetic oligonucleotide
taggacagagaggtaggaggggaggtgaaggaattga

SEQ ID NO: 26843 - DNA, 38 bp, Artificial Sequence
  Synthetic oligonucleotide
gatgcctgggatggaaagggaggtagagggcgagttga

SEQ ID NO: 26844 - DNA, 36 bp, Artificial Sequence
  Synthetic oligonucleotide
tatccaccgcactactctacagtatgcaggagaata

SEQ ID NO: 26845 - DNA, 36 bp, Artificial Sequence
  Synthetic oligonucleotide
acagccgagcctctatccgtgcacgagggcctccta

SEQ ID NO: 26846 - DNA, 36 bp, Artificial Sequence
  Synthetic oligonucleotide
tcatcgcaggtctcgccgcatgccctcttcaatgta

SEQ ID NO: 26847 - DNA, 35 bp, Artificial Sequence
  Synthetic oligonucleotide
tccatcacctggccgtcaggactcctttgcaaaac

SEQ ID NO: 26848 - DNA, 35 bp, Artificial Sequence
  Synthetic oligonucleotide
tgcacgttgagccgcggcctactgagccctcaccc

SEQ ID NO: 26849 - DNA, 35 bp, Artificial Sequence
  Synthetic oligonucleotide
gacgccccactagagtcacctttgtacaccgtccc

SEQ ID NO: 26850 - DNA, 35 bp, Artificial Sequence
  Synthetic oligonucleotide
gcctcgttaactctgctgttacatccttgcgtgcc

SEQ ID NO: 26851 - DNA, 35 bp, Artificial Sequence
  Synthetic oligonucleotide
tccaaccacaaccgggcctctacacctactgtaag

SEQ ID NO: 26852 - DNA, 35 bp, Artificial Sequence
  Synthetic oligonucleotide
tgagacacctaaccattggacgggagctttccccg

SEQ ID NO: 26853 - DNA, 35 bp, Artificial Sequence
  Synthetic oligonucleotide
aacctgaccgcctatcctggccatatcgcactatg

SEQ ID NO: 26854 - DNA, 35 bp, Artificial Sequence
  Synthetic oligonucleotide
gacgctccctttcacgtagacacatcaacttctat

SEQ ID NO: 26855 - DNA, 36 bp, Artificial Sequence
  Synthetic oligonucleotide
tagttggggggggaagaacggggtgcgatacgttaa

SEQ ID NO: 26856 - DNA, 35 bp, Artificial Sequence
  Synthetic oligonucleotide
tttcgctccgggtccggcctcgcttaaccttgcta

SEQ ID NO: 26857 - DNA, 36 bp, Artificial Sequence
  Synthetic oligonucleotide
gctccgtgagtgaaggggtaaggggttgagcgggta

SEQ ID NO: 26858 - DNA, 35 bp, Artificial Sequence
  Synthetic oligonucleotide
tgctcaccctcgtgtaccaatactcttcccgggcc

SEQ ID NO: 26859 - DNA, 35 bp, Artificial Sequence
  Synthetic oligonucleotide
atggtaaccttataaccgtccctccctcaccgggc

SEQ ID NO: 26860 - DNA, 35 bp, Artificial Sequence
  Synthetic oligonucleotide
gtacctcccggtagacgtgcactgacgatcccctc

SEQ ID NO: 26861 - DNA, 35 bp, Artificial Sequence
  Synthetic oligonucleotide
accttgcatccttccagaacgaccttctccttgcg

SEQ ID NO: 26862 - DNA, 35 bp, Artificial Sequence
  Synthetic oligonucleotide
gggcccgcacaatgcctacgctccactctcctctt

SEQ ID NO: 26863 - DNA, 36 bp, Artificial Sequence
  Synthetic oligonucleotide
ccatacttcaatctcacgcgtacgggcctgttacca

SEQ ID NO: 26864 - DNA, 37 bp, Artificial Sequence
  Synthetic oligonucleotide
actagggaataggtgggaaaaggagttggtgtgtcga

SEQ ID NO: 26865 - DNA, 38 bp, Artificial Sequence
  Synthetic oligonucleotide
aagccgcccggcctttcgtccctgaccactccctctga

SEQ ID NO: 26866 - DNA, 35 bp, Artificial Sequence
  Synthetic oligonucleotide
atcattccgttctggcacactcgcacatttcgaac

SEQ ID NO: 26867 - DNA, 35 bp, Artificial Sequence
  Synthetic oligonucleotide
ttccgcccccaacctctagagcatgcgtctcgcgc

SEQ ID NO: 26868 - DNA, 35 bp, Artificial Sequence
  Synthetic oligonucleotide
acacctgtttgccaatcgctaagactccgcatggc

SEQ ID NO: 26869 - DNA, 35 bp, Artificial Sequence
  Synthetic oligonucleotide
acctccaccttgctgtacgtcctactcgatcatgc

SEQ ID NO: 26870 - DNA, 35 bp, Artificial Sequence
  Synthetic oligonucleotide
gttcaaacttccgccttgtccttgttggctattgc

SEQ ID NO: 26871 - DNA, 35 bp, Artificial Sequence
  Synthetic oligonucleotide
agtcctgctacaagcgagccagcgctttccttctc

SEQ ID NO: 26872 - DNA, 35 bp, Artificial Sequence
  Synthetic oligonucleotide
tccaattggccacttattgtccgaccctgttgttc

SEQ ID NO: 26873 - DNA, 35 bp, Artificial Sequence
  Synthetic oligonucleotide
tgctgtcgggccgacgatcaatctaagtttctttc

SEQ ID NO: 26874 - DNA, 35 bp, Artificial Sequence
  Synthetic oligonucleotide
tggaatgtgaagttgggaaggtgaaggtgggtagg

SEQ ID NO: 26875 - DNA, 36 bp, Artificial Sequence
  Synthetic oligonucleotide
tccgagggagctcctactgcccacccccgcctcaat

SEQ ID NO: 26876 - DNA, 35 bp, Artificial Sequence
  Synthetic oligonucleotide
tcaccgcacagttctccttcgcccgtagataacat

SEQ ID NO: 26877 - DNA, 35 bp, Artificial Sequence
  Synthetic oligonucleotide
tacatccactagactgacccctacacaccgaccgt

SEQ ID NO: 26878 - DNA, 35 bp, Artificial Sequence
  Synthetic oligonucleotide
tcacacccgcggaggcacaaaaaacactaacgcgt

SEQ ID NO: 26879 - DNA, 35 bp, Artificial Sequence
  Synthetic oligonucleotide
gtgcaccctaacacgcctccgaccctcacgcgatt

SEQ ID NO: 26880 - DNA, 36 bp, Artificial Sequence
  Synthetic oligonucleotide
acgctgtgtccgtctctcgtcacgcccccccccaca

SEQ ID NO: 26881 - DNA, 36 bp, Artificial Sequence
  Synthetic oligonucleotide
gtcccgctgagtttgcccgatcaccctccaccccga

SEQ ID NO: 26882 - DNA, 35 bp, Artificial Sequence
  Synthetic oligonucleotide
ttcgatcgcagtccacttgtctacacttgattcga

SEQ ID NO: 26883 - DNA, 37 bp, Artificial Sequence
  Synthetic oligonucleotide
tgttcccccatccgcccggacgttccggatacttcga

SEQ ID NO: 26884 - DNA, 36 bp, Artificial Sequence
  Synthetic oligonucleotide
actccatccacggccttgctatttacttagacatga

SEQ ID NO: 26885 - DNA, 38 bp, Artificial Sequence
  Synthetic oligonucleotide
ggaatgggacatgggtggaaggaactggcagtgcgtga

SEQ ID NO: 26886 - DNA, 37 bp, Artificial Sequence
  Synthetic oligonucleotide
tacgccgaccggtcagtatcacctctcgtttagttga

SEQ ID NO: 26887 - DNA, 38 bp, Artificial Sequence
  Synthetic oligonucleotide
ccatagggcgggagttgtttgggcgggcaaaaatttga

SEQ ID NO: 26888 - DNA, 36 bp, Artificial Sequence
  Synthetic oligonucleotide
tccaccccaacactgtcgtttgctcaatacagaata

SEQ ID NO: 26889 - DNA, 35 bp, Artificial Sequence
  Synthetic oligonucleotide
gtcacgccaatcataatggctgtctttcgctttta

SEQ ID NO: 26890 - DNA, 35 bp, Artificial Sequence
  Synthetic oligonucleotide
acgacaccacttactgacgcgtgcccaatacagcc

SEQ ID NO: 26891 - DNA, 35 bp, Artificial Sequence
  Synthetic oligonucleotide
gacacgggactgttgagttgggggagtggaatcgg

SEQ ID NO: 26892 - DNA, 35 bp, Artificial Sequence
  Synthetic oligonucleotide
gaacgaaccgaggaagtcaagggtaggagtgcggg

SEQ ID NO: 26893 - DNA, 35 bp, Artificial Sequence
  Synthetic oligonucleotide
gagggctcggtgcccggtgtgaagggatggggtgg

SEQ ID NO: 26894 - DNA, 36 bp, Artificial Sequence
  Synthetic oligonucleotide
tatgcacatggtgccaatcgctgactttcccctcat

SEQ ID NO: 26895 - DNA, 35 bp, Artificial Sequence
  Synthetic oligonucleotide
tcatctccccggcccgcacgcatatcttttactat

SEQ ID NO: 26896 - DNA, 35 bp, Artificial Sequence
  Synthetic oligonucleotide
gctcatggctcttgtgcttcccccaggctactact

SEQ ID NO: 26897 - DNA, 35 bp, Artificial Sequence
  Synthetic oligonucleotide
accacagccgtgctcgcttaactctactctcgcct

SEQ ID NO: 26898 - DNA, 35 bp, Artificial Sequence
  Synthetic oligonucleotide
acgagcccagtatccaagccgccacccctttatgt

SEQ ID NO: 26899 - DNA, 36 bp, Artificial Sequence
  Synthetic oligonucleotide
aagagggagggagggaggtggacttatggaccaaga

SEQ ID NO: 26900 - DNA, 35 bp, Artificial Sequence
  Synthetic oligonucleotide
ttgggacatggccggggtggggtatggtcggggga

SEQ ID NO: 26901 - DNA, 36 bp, Artificial Sequence
  Synthetic oligonucleotide
tgaaggggggggttgctggcgaattaggctgaatga

SEQ ID NO: 26902 - DNA, 37 bp, Artificial Sequence
  Synthetic oligonucleotide
agccccatagcgcttacatcgcctcgcccccctatga

SEQ ID NO: 26903 - DNA, 35 bp, Artificial Sequence
  Synthetic oligonucleotide
atctcgactcatctgacattcctccctgtttatga

SEQ ID NO: 26904 - DNA, 37 bp, Artificial Sequence
  Synthetic oligonucleotide
ttgtgccctcattgttcctcggtacgcatcctgctga

SEQ ID NO: 26905 - DNA, 37 bp, Artificial Sequence
  Synthetic oligonucleotide
gtacgggaggccaacctgtaaactactgcccttttga

SEQ ID NO: 26906 - DNA, 35 bp, Artificial Sequence
  Synthetic oligonucleotide
atcgccactgtccaccccataatctagcgcgaacc

SEQ ID NO: 26907 - DNA, 35 bp, Artificial Sequence
  Synthetic oligonucleotide
tacgtcacatgttgaacccccagtcgatctacctc

SEQ ID NO: 26908 - DNA, 35 bp, Artificial Sequence
  Synthetic oligonucleotide
gtcaggtccccccactggtactggttcgcttatcg

SEQ ID NO: 26909 - DNA, 35 bp, Artificial Sequence
  Synthetic oligonucleotide
tcacgacacctcattattctgcctgcctgtcctcg

SEQ ID NO: 26910 - DNA, 32 bp, Artificial Sequence
  Synthetic oligonucleotide
tagtactcccgctgtttccgcaccgacccaat

SEQ ID NO: 26911 - DNA, 35 bp, Artificial Sequence
  Synthetic oligonucleotide
tgcaccctctccgtcagcgcgtcttattcggccat

SEQ ID NO: 26912 - DNA, 35 bp, Artificial Sequence
  Synthetic oligonucleotide
tcacgccgttttgctcccgatcggtcggttacctt

SEQ ID NO: 26913 - DNA, 35 bp, Artificial Sequence
  Synthetic oligonucleotide
tcacggatggtacgtttgcttttgtcccgcctgtt

SEQ ID NO: 26914 - DNA, 36 bp, Artificial Sequence
  Synthetic oligonucleotide
ttacgtcactacatccaccgtggaacgcaccaccca

SEQ ID NO: 26915 - DNA, 36 bp, Artificial Sequence
  Synthetic oligonucleotide
tatcccgctgtatggggccatacttttacacttcca

SEQ ID NO: 26916 - DNA, 36 bp, Artificial Sequence
  Synthetic oligonucleotide
tcacgttcctgcatcacctagtggcttcctgctaga

SEQ ID NO: 26917 - DNA, 37 bp, Artificial Sequence
  Synthetic oligonucleotide
atcatgccttgccgcattgccctccgctcccatacga

SEQ ID NO: 26918 - DNA, 35 bp, Artificial Sequence
  Synthetic oligonucleotide
tgacgcgttcctggtttctcttagtgcccccccga

SEQ ID NO: 26919 - DNA, 37 bp, Artificial Sequence
  Synthetic oligonucleotide
tcacgggtgacagagaaggtgtgggtgcgtttgggga

SEQ ID NO: 26920 - DNA, 37 bp, Artificial Sequence
  Synthetic oligonucleotide
tcaatccctcttgtcgtcccgcgcgaacattccctga

SEQ ID NO: 26921 - DNA, 37 bp, Artificial Sequence
  Synthetic oligonucleotide
acatgcacttgcccgacggtatctggttagcacttga

SEQ ID NO: 26922 - DNA, 38 bp, Artificial Sequence
  Synthetic oligonucleotide
acaccatcccgggctttatcttagccagtaaattttga

SEQ ID NO: 26923 - DNA, 36 bp, Artificial Sequence
  Synthetic oligonucleotide
atcctcagaacggcgggggagggtattggggtgtta

SEQ ID NO: 26924 - DNA, 35 bp, Artificial Sequence
  Synthetic oligonucleotide
tgtagctccaacccgatacgaaccgccctcccccc

SEQ ID NO: 26925 - DNA, 35 bp, Artificial Sequence
  Synthetic oligonucleotide
gcctaggagcgttctagccccgtaaccgattgccc

SEQ ID NO: 26926 - DNA, 35 bp, Artificial Sequence
  Synthetic oligonucleotide
gattaccttcgagtgccaccgcccccgtttgttcc

SEQ ID NO: 26927 - DNA, 35 bp, Artificial Sequence
  Synthetic oligonucleotide
agcaactaccgctcacctagacccgtgccttatgc

SEQ ID NO: 26928 - DNA, 35 bp, Artificial Sequence
  Synthetic oligonucleotide
cccaattcccaggtgcatctgtgcctgctactctc

SEQ ID NO: 26929 - DNA, 35 bp, Artificial Sequence
  Synthetic oligonucleotide
tgtacacccggtcttaggactcctacttgtctccg

SEQ ID NO: 26930 - DNA, 35 bp, Artificial Sequence
  Synthetic oligonucleotide
gagaggaaacctgtaggagtagaaatggtgggtgg

SEQ ID NO: 26931 - DNA, 36 bp, Artificial Sequence
  Synthetic oligonucleotide
gaccttcccacccgttcgcaattcggtatcgacgaa

SEQ ID NO: 26932 - DNA, 36 bp, Artificial Sequence
  Synthetic oligonucleotide
gatgggggaacggagaaaggaacgaggagtgaccca

SEQ ID NO: 26933 - DNA, 35 bp, Artificial Sequence
  Synthetic oligonucleotide
agccggacccacacctgctacaagcccataaccga

SEQ ID NO: 26934 - DNA, 36 bp, Artificial Sequence
  Synthetic oligonucleotide
gtgagccaggctcatttttttcgttctttcatccga

SEQ ID NO: 26935 - DNA, 36 bp, Artificial Sequence
  Synthetic oligonucleotide
accgaagccatcgtgatctattttgctatcctgcga

SEQ ID NO: 26936 - DNA, 36 bp, Artificial Sequence
  Synthetic oligonucleotide
acgtgaaagggggtggcggggcattttggcggagga

SEQ ID NO: 26937 - DNA, 38 bp, Artificial Sequence
  Synthetic oligonucleotide
agtaccgagagggagggggggcagtcggagataactga

SEQ ID NO: 26938 - DNA, 37 bp, Artificial Sequence
  Synthetic oligonucleotide
taagccaccatcaattttggccatcatggatccctga

SEQ ID NO: 26939 - DNA, 38 bp, Artificial Sequence
  Synthetic oligonucleotide
atagtaggggggtggaaggtacggtattcaccaggtga

SEQ ID NO: 26940 - DNA, 38 bp, Artificial Sequence
  Synthetic oligonucleotide
tgcgggggggggcgaagatgatgcaggggcgatcttga

SEQ ID NO: 26941 - DNA, 36 bp, Artificial Sequence
  Synthetic oligonucleotide
tcagtgcacctctggttgagcctcccgttgtccata

SEQ ID NO: 26942 - DNA, 35 bp, Artificial Sequence
  Synthetic oligonucleotide
gcctacgccgatacttccattcgcggtgataccta

SEQ ID NO: 26943 - DNA, 36 bp, Artificial Sequence
  Synthetic oligonucleotide
gcctcacgggttccagatcgcacactcttctccgta

SEQ ID NO: 26944 - DNA, 35 bp, Artificial Sequence
  Synthetic oligonucleotide
gaaactgtgaacacatggctcttctaacaactatt

SEQ ID NO: 26945 - DNA, 35 bp, Artificial Sequence
  Synthetic oligonucleotide
atgtcggcaactgacgccgtaccttagccctcttt

SEQ ID NO: 26946 - DNA, 36 bp, Artificial Sequence
  Synthetic oligonucleotide
gctaacgcagggtaggaaaaattggtgagatgggaa

SEQ ID NO: 26947 - DNA, 37 bp, Artificial Sequence
  Synthetic oligonucleotide
tcacggtcttattttgcattatccgccgtattcccga

SEQ ID NO: 26948 - DNA, 36 bp, Artificial Sequence
  Synthetic oligonucleotide
acgtggagctgtttaagcttattccccttctgccga

SEQ ID NO: 26949 - DNA, 38 bp, Artificial Sequence
  Synthetic oligonucleotide
gattgccatccttctctgttttcgtacatacttgttga

SEQ ID NO: 26950 - DNA, 36 bp, Artificial Sequence
  Synthetic oligonucleotide
acctgggagggggaggagtggtatggggtagcggta

SEQ ID NO: 26951 - DNA, 36 bp, Artificial Sequence
  Synthetic oligonucleotide
tttaccgtcccatccgtttccgtttatatcctggta

SEQ ID NO: 26952 - DNA, 35 bp, Artificial Sequence
  Synthetic oligonucleotide
gcgaatatcacctgtatgcccgttatcgatttcac

SEQ ID NO: 26953 - DNA, 35 bp, Artificial Sequence
  Synthetic oligonucleotide
tgccccaacccggttagagtccctcacaccactcc

SEQ ID NO: 26954 - DNA, 35 bp, Artificial Sequence
  Synthetic oligonucleotide
gatcactctgcgaacctgtgccaccatgtaatcgc

SEQ ID NO: 26955 - DNA, 35 bp, Artificial Sequence
  Synthetic oligonucleotide
tgccccctccattactgcttttccccttcacatgc

SEQ ID NO: 26956 - DNA, 35 bp, Artificial Sequence
  Synthetic oligonucleotide
tgcctcgctcaacctgcatccggtcgtcttagctc

SEQ ID NO: 26957 - DNA, 35 bp, Artificial Sequence
  Synthetic oligonucleotide
gcgacacgttactaaccctgatccttgctacatcg

SEQ ID NO: 26958 - DNA, 35 bp, Artificial Sequence
  Synthetic oligonucleotide
gccacatacacagccaattttcaccactgtcacat

SEQ ID NO: 26959 - DNA, 35 bp, Artificial Sequence
  Synthetic oligonucleotide
gtatggccatctgttaagacttgttgcccccccct

SEQ ID NO: 26960 - DNA, 35 bp, Artificial Sequence
  Synthetic oligonucleotide
gcacatgcgttttcgtgctcccctttgttcccgct

SEQ ID NO: 26961 - DNA, 35 bp, Artificial Sequence
  Synthetic oligonucleotide
tattgccactagtgttggaatgccatcttccctgt

SEQ ID NO: 26962 - DNA, 37 bp, Artificial Sequence
  Synthetic oligonucleotide
tgtcccggcggagagagaaatgggatagggatgtaga

SEQ ID NO: 26963 - DNA, 37 bp, Artificial Sequence
  Synthetic oligonucleotide
tcaggtgtaggggtggggataagacgcgatggtggga

SEQ ID NO: 26964 - DNA, 37 bp, Artificial Sequence
  Synthetic oligonucleotide
tcaatcccacgcccgaagacctgattacttatgatga

SEQ ID NO: 26965 - DNA, 37 bp, Artificial Sequence
  Synthetic oligonucleotide
gaacaccacctgtaattatctgcaagggccccattga

SEQ ID NO: 26966 - DNA, 38 bp, Artificial Sequence
  Synthetic oligonucleotide
tgtccccgtacttgaaccgtcaccgaaactgccattga

SEQ ID NO: 26967 - DNA, 36 bp, Artificial Sequence
  Synthetic oligonucleotide
gatacggccgggtgcgttgcctcgttccccacaata

SEQ ID NO: 26968 - DNA, 36 bp, Artificial Sequence
  Synthetic oligonucleotide
gtacatgacccctgcgcgtatagggccccgcaacta

SEQ ID NO: 26969 - DNA, 35 bp, Artificial Sequence
  Synthetic oligonucleotide
tccccacgcccgctctgtcgtttttcagtccgtac

SEQ ID NO: 26970 - DNA, 35 bp, Artificial Sequence
  Synthetic oligonucleotide
aagccaccacggctaccgttggccccacttcattc

SEQ ID NO: 26971 - DNA, 35 bp, Artificial Sequence
  Synthetic oligonucleotide
gcaccacttttttccgccggcttatcaagacgttc

SEQ ID NO: 26972 - DNA, 35 bp, Artificial Sequence
  Synthetic oligonucleotide
tcacttgccccacgtctcacttatccgtgcgccat

SEQ ID NO: 26973 - DNA, 36 bp, Artificial Sequence
  Synthetic oligonucleotide
gtcccccgcacagaccaccctacccttcagtaccaa

SEQ ID NO: 26974 - DNA, 35 bp, Artificial Sequence
  Synthetic oligonucleotide
tccacacccctgtccgtgagcgattgtactcaaca

SEQ ID NO: 26975 - DNA, 36 bp, Artificial Sequence
  Synthetic oligonucleotide
tgtagcaccaccgccgacgtcgactgatcgcaccca

SEQ ID NO: 26976 - DNA, 36 bp, Artificial Sequence
  Synthetic oligonucleotide
tagcccgactggcatcttgaagtcgcaacacgccca

SEQ ID NO: 26977 - DNA, 35 bp, Artificial Sequence
  Synthetic oligonucleotide
atattccgcgccgcctcgtcccatgctgtacagca

SEQ ID NO: 26978 - DNA, 35 bp, Artificial Sequence
  Synthetic oligonucleotide
acatgctgccgggttccatcgcccatcgacattca

SEQ ID NO: 26979 - DNA, 37 bp, Artificial Sequence
  Synthetic oligonucleotide
agttaccgccccgccgagttctttgcccctctcaaga

SEQ ID NO: 26980 - DNA, 37 bp, Artificial Sequence
  Synthetic oligonucleotide
atgacacgtcctcccgcctccattactacagtgtaga

SEQ ID NO: 26981 - DNA, 38 bp, Artificial Sequence
  Synthetic oligonucleotide
tgacggaggtcaacgaattagacgacagagatgagtga

SEQ ID NO: 26982 - DNA, 38 bp, Artificial Sequence
  Synthetic oligonucleotide
tgcccacgatgtattaggcccttccctttgctccgtga

SEQ ID NO: 26983 - DNA, 38 bp, Artificial Sequence
  Synthetic oligonucleotide
acagacgctgaagcccgccaatggtccgcccttcttga

SEQ ID NO: 26984 - DNA, 38 bp, Artificial Sequence
  Synthetic oligonucleotide
gacctagatgcagcccgactcccttccagccactttga

SEQ ID NO: 26985 - DNA, 35 bp, Artificial Sequence
  Synthetic oligonucleotide
ttccccgaaccaccccaaagtctcagtacctgcta

SEQ ID NO: 26986 - DNA, 36 bp, Artificial Sequence
  Synthetic oligonucleotide
gagtcccggccagctcccttacgtcgctcatctgta

SEQ ID NO: 26987 - DNA, 36 bp, Artificial Sequence
  Synthetic oligonucleotide
acacgcccacacgctccgactcagtttttaacgtta

SEQ ID NO: 26988 - DNA, 35 bp, Artificial Sequence
  Synthetic oligonucleotide
agtcacatcgaacacctgtttgggccactgtcacc

SEQ ID NO: 26989 - DNA, 36 bp, Artificial Sequence
  Synthetic oligonucleotide
agcatggaagcacataatgtcctgcgtaataccccc

SEQ ID NO: 26990 - DNA, 35 bp, Artificial Sequence
  Synthetic oligonucleotide
agccgattccgactttccatccttaggttgcctgc

SEQ ID NO: 26991 - DNA, 35 bp, Artificial Sequence
  Synthetic oligonucleotide
gcccacatgccgagggaataacggtacttccgctc

SEQ ID NO: 26992 - DNA, 35 bp, Artificial Sequence
  Synthetic oligonucleotide
gcgagcccatcctgccacatagcttactcgaggtc

SEQ ID NO: 26993 - DNA, 35 bp, Artificial Sequence
  Synthetic oligonucleotide
acgatgccctggtgtctcccgcacatctaacaccg

SEQ ID NO: 26994 - DNA, 35 bp, Artificial Sequence
  Synthetic oligonucleotide
ggtccagttcattccgtccaagtccgggtcctgct

SEQ ID NO: 26995 - DNA, 35 bp, Artificial Sequence
  Synthetic oligonucleotide
gtacccacgatcgactacatgaaacctgaacgctt

SEQ ID NO: 26996 - DNA, 36 bp, Artificial Sequence
  Synthetic oligonucleotide
gcccaggttacctgccaccactcacttcgatacgaa

SEQ ID NO: 26997 - DNA, 37 bp, Artificial Sequence
  Synthetic oligonucleotide
agaccacgcggactagccccttccgtttcgccactga

SEQ ID NO: 26998 - DNA, 38 bp, Artificial Sequence
  Synthetic oligonucleotide
gctcccccacgtgcgcacagacccctccctgaacctga

SEQ ID NO: 26999 - DNA, 38 bp, Artificial Sequence
  Synthetic oligonucleotide
ttgcctcaatgaccattgtacactctccttcccattga

SEQ ID NO: 27000 - DNA, 38 bp, Artificial Sequence
  Synthetic oligonucleotide
atcaccgccaatccttcatcatcaacgccggaacttga

SEQ ID NO: 27001 - DNA, 35 bp, Artificial Sequence
  Synthetic oligonucleotide
gcaacaggcctgaagacatcacctacccatcgacc

SEQ ID NO: 27002 - DNA, 35 bp, Artificial Sequence
  Synthetic oligonucleotide
agccacaacggaatcggtgcgccatcatcctgtcc

SEQ ID NO: 27003 - DNA, 35 bp, Artificial Sequence
  Synthetic oligonucleotide
gattccacgtcctcttcgtccctttgcgtgcaagc

SEQ ID NO: 27004 - DNA, 35 bp, Artificial Sequence
  Synthetic oligonucleotide
gcatgatggaagggtggtcggaggggggtgacgtc

SEQ ID NO: 27005 - DNA, 35 bp, Artificial Sequence
  Synthetic oligonucleotide
gccacccctcctcggccagttgtcataccctctgg

SEQ ID NO: 27006 - DNA, 35 bp, Artificial Sequence
  Synthetic oligonucleotide
tgattctccaatgctccgaccccccgtgaggctca

SEQ ID NO: 27007 - DNA, 37 bp, Artificial Sequence
  Synthetic oligonucleotide
gcaccgaccggaactccctatctaccagcgctggaga

SEQ ID NO: 27008 - DNA, 36 bp, Artificial Sequence
  Synthetic oligonucleotide
tacacgcgcatatgtccatcccgctccatccgccga

SEQ ID NO: 27009 - DNA, 37 bp, Artificial Sequence
  Synthetic oligonucleotide
gtacgccccgcttaattcgtcaactactccccccgga

SEQ ID NO: 27010 - DNA, 37 bp, Artificial Sequence
  Synthetic oligonucleotide
gacctcactttgccttacagacccttcccattgatga

SEQ ID NO: 27011 - DNA, 38 bp, Artificial Sequence
  Synthetic oligonucleotide
attgctgcctccagtttgcctgccgcgacccgtactga

SEQ ID NO: 27012 - DNA, 37 bp, Artificial Sequence
  Synthetic oligonucleotide
gaatacgtacgagcccatctgcacacccgccgcttga

SEQ ID NO: 27013 - DNA, 35 bp, Artificial Sequence
  Synthetic oligonucleotide
gaacccctgcaccagagtccccgcaacattcaata

SEQ ID NO: 27014 - DNA, 36 bp, Artificial Sequence
  Synthetic oligonucleotide
acccaccgttacttaccatttgaacatacatagcta

SEQ ID NO: 27015 - DNA, 36 bp, Artificial Sequence
  Synthetic oligonucleotide
acacgtcaacgccttttcgtcagaagtcacctcgta

SEQ ID NO: 27016 - DNA, 36 bp, Artificial Sequence
  Synthetic oligonucleotide
gtgaacgatccaactctggccaaacgagccacgtta

SEQ ID NO: 27017 - DNA, 35 bp, Artificial Sequence
  Synthetic oligonucleotide
tatttccccgcgatctatcctacgcacagggtaac

SEQ ID NO: 27018 - DNA, 35 bp, Artificial Sequence
  Synthetic oligonucleotide
agccacgtagtggttaaacccatccggagtccccc

SEQ ID NO: 27019 - DNA, 35 bp, Artificial Sequence
  Synthetic oligonucleotide
gcactggccatcactaccaccctacagttcttcag

SEQ ID NO: 27020 - DNA, 35 bp, Artificial Sequence
  Synthetic oligonucleotide
aagaacaggaaggagcagaaaggtcattgaggggg

SEQ ID NO: 27021 - DNA, 35 bp, Artificial Sequence
  Synthetic oligonucleotide
acacgtcggcctttttattagtttctctgtacctg

SEQ ID NO: 27022 - DNA, 35 bp, Artificial Sequence
  Synthetic oligonucleotide
acacctagggttggtgttttttatttgtcgccact

SEQ ID NO: 27023 - DNA, 35 bp, Artificial Sequence
  Synthetic oligonucleotide
tacagtccgccctctcgctataacggtcgaatact

SEQ ID NO: 27024 - DNA, 35 bp, Artificial Sequence
  Synthetic oligonucleotide
gacttagtaacccagcgtcgacctctctttctcca

SEQ ID NO: 27025 - DNA, 37 bp, Artificial Sequence
  Synthetic oligonucleotide
atcactcccaccttggccattcggtgtactcaccaga

SEQ ID NO: 27026 - DNA, 38 bp, Artificial Sequence
  Synthetic oligonucleotide
acgtgtgcaggagagatacggggagtgtggtgtcgtga

SEQ ID NO: 27027 - DNA, 35 bp, Artificial Sequence
  Synthetic oligonucleotide
ctgcagtgcccctcgctcgcggttttcggaaaccc

SEQ ID NO: 27028 - DNA, 35 bp, Artificial Sequence
  Synthetic oligonucleotide
gagaccggtgaggggagtcatgggggagttggtcg

SEQ ID NO: 27029 - DNA, 35 bp, Artificial Sequence
  Synthetic oligonucleotide
tgaacccctagcctccgcacccacaaagctccctg

SEQ ID NO: 27030 - DNA, 35 bp, Artificial Sequence
  Synthetic oligonucleotide
gcacacgcatttctctaattcgtacagtacgcctt

SEQ ID NO: 27031 - DNA, 36 bp, Artificial Sequence
  Synthetic oligonucleotide
tttccacacctgattgtttttcggcctgtactacca

SEQ ID NO: 27032 - DNA, 36 bp, Artificial Sequence
  Synthetic oligonucleotide
tctgacctcccgtcttatgtctacactatcctcgca

SEQ ID NO: 27033 - DNA, 36 bp, Artificial Sequence
  Synthetic oligonucleotide
tcatgccgccgccagtcctacaccaccgtggcatca

SEQ ID NO: 27034 - DNA, 38 bp, Artificial Sequence
  Synthetic oligonucleotide
tgaccttcgcgcctcatcttttcttagccaactggtga

SEQ ID NO: 27035 - DNA, 35 bp, Artificial Sequence
  Synthetic oligonucleotide
gcgtgatgtcatcgccggccactttccgccactct

SEQ ID NO: 27036 - DNA, 35 bp, Artificial Sequence
  Synthetic oligonucleotide
agcccagtgcctggtacccgctacgtattgccctt

SEQ ID NO: 27037 - DNA, 35 bp, Artificial Sequence
  Synthetic oligonucleotide
tgaggacaagcccccaccattcttctgttgctgaa

SEQ ID NO: 27038 - DNA, 37 bp, Artificial Sequence
  Synthetic oligonucleotide
tatggccaggtcatcattacgctcctgtgctccccga

SEQ ID NO: 27039 - DNA, 38 bp, Artificial Sequence
  Synthetic oligonucleotide
tccggaccacgcgccccgacctatcacaaccggcatga

SEQ ID NO: 27040 - DNA, 38 bp, Artificial Sequence
  Synthetic oligonucleotide
tgctgtaaacgcgtggtaggagggacggggggatatga

SEQ ID NO: 27041 - DNA, 37 bp, Artificial Sequence
  Synthetic oligonucleotide
tgtacgctgagtcgccatacgcccggaactcacttga

SEQ ID NO: 27042 - DNA, 38 bp, Artificial Sequence
  Synthetic oligonucleotide
tcagaccagcttggtagcctataccctgtttctcttga

SEQ ID NO: 27043 - DNA, 35 bp, Artificial Sequence
  Synthetic oligonucleotide
gattccagcgccgtccttctcaggtctactcccta

SEQ ID NO: 27044 - DNA, 35 bp, Artificial Sequence
  Synthetic oligonucleotide
gtggacggccaccacatttatagcctgcctcctac

SEQ ID NO: 27045 - DNA, 35 bp, Artificial Sequence
  Synthetic oligonucleotide
tgtccttgccaccttggcgccttcttatgactccc

SEQ ID NO: 27046 - DNA, 35 bp, Artificial Sequence
  Synthetic oligonucleotide
gacgtgctcagcgccgcgatcgcgttttctccgtc

SEQ ID NO: 27047 - DNA, 35 bp, Artificial Sequence
  Synthetic oligonucleotide
tttgaggcctgatgttgtcccgccctgctgcttat

SEQ ID NO: 27048 - DNA, 36 bp, Artificial Sequence
  Synthetic oligonucleotide
acacccatggacctcacgagtatgaccaccattgca

SEQ ID NO: 27049 - DNA, 37 bp, Artificial Sequence
  Synthetic oligonucleotide
tctatgcgacatccggcccctcgagcccgccctttga

SEQ ID NO: 27050 - DNA, 35 bp, Artificial Sequence
  Synthetic oligonucleotide
tcagtagcgaccacgacctaatcacatactatcac

SEQ ID NO: 27051 - DNA, 35 bp, Artificial Sequence
  Synthetic oligonucleotide
attcaacaccccccagaatccatccactgccgtcc

SEQ ID NO: 27052 - DNA, 35 bp, Artificial Sequence
  Synthetic oligonucleotide
gcaaagtctgacggctatttcctctgctcgtttcc

SEQ ID NO: 27053 - DNA, 35 bp, Artificial Sequence
  Synthetic oligonucleotide
tcaaagcaggaaaggagtcggtgaaaacggtaggc

SEQ ID NO: 27054 - DNA, 35 bp, Artificial Sequence
  Synthetic oligonucleotide
tacggaaagaggtgaagggtgcgggtagactattg

SEQ ID NO: 27055 - DNA, 35 bp, Artificial Sequence
  Synthetic oligonucleotide
ggatgcgcaacaaccgcactgatccgcaacaccat

SEQ ID NO: 27056 - DNA, 35 bp, Artificial Sequence
  Synthetic oligonucleotide
catacccgagcttccgtgttcggccaatttttcat

SEQ ID NO: 27057 - DNA, 35 bp, Artificial Sequence
  Synthetic oligonucleotide
acctccatcctgcttggtcgcattcactagggact

SEQ ID NO: 27058 - DNA, 35 bp, Artificial Sequence
  Synthetic oligonucleotide
gaaacctcggcggtttagcacgtaccacctcttgt

SEQ ID NO: 27059 - DNA, 36 bp, Artificial Sequence
  Synthetic oligonucleotide
gccatgagcccactgaggaatctctctaccttatca

SEQ ID NO: 27060 - DNA, 37 bp, Artificial Sequence
  Synthetic oligonucleotide
gaccacctccctacgggttatgcacaggtcctttaga

SEQ ID NO: 27061 - DNA, 35 bp, Artificial Sequence
  Synthetic oligonucleotide
gtaagccccgaccgaaatgcaccatcaagactcga

SEQ ID NO: 27062 - DNA, 37 bp, Artificial Sequence
  Synthetic oligonucleotide
atcacccaccagactatggtctcagtcgttccacgga

SEQ ID NO: 27063 - DNA, 37 bp, Artificial Sequence
  Synthetic oligonucleotide
accgtgcgtttgccccgtctatcaccctcttacatga

SEQ ID NO: 27064 - DNA, 38 bp, Artificial Sequence
  Synthetic oligonucleotide
gttgcgcccgcccttccaccataggcctccgtctctga

SEQ ID NO: 27065 - DNA, 34 bp, Artificial Sequence
  Synthetic oligonucleotide
gagccacgtgctgcttatatcactgcttacctac

SEQ ID NO: 27066 - DNA, 35 bp, Artificial Sequence
  Synthetic oligonucleotide
acgcactcctaagacgccgccttatgaacgccccc

SEQ ID NO: 27067 - DNA, 35 bp, Artificial Sequence
  Synthetic oligonucleotide
accgtcctctagtacgcctcacacttacctaaccg

SEQ ID NO: 27068 - DNA, 35 bp, Artificial Sequence
  Synthetic oligonucleotide
atgcaaacggaaggaaaacgtagcaagggggggcg

SEQ ID NO: 27069 - DNA, 35 bp, Artificial Sequence
  Synthetic oligonucleotide
ttgacctgatacgttaactgccgcactaagcccct

SEQ ID NO: 27070 - DNA, 35 bp, Artificial Sequence
  Synthetic oligonucleotide
atgccgtagttcctgtcgcttgtcttatcgcttct

SEQ ID NO: 27071 - DNA, 35 bp, Artificial Sequence
  Synthetic oligonucleotide
acttcaacccgcaccatgatataccccgttaaatt

SEQ ID NO: 27072 - DNA, 36 bp, Artificial Sequence
  Synthetic oligonucleotide
tcccaacccagaactaacttaaggcctccccaaaca

SEQ ID NO: 27073 - DNA, 35 bp, Artificial Sequence
  Synthetic oligonucleotide
aagcacctgagccccttagtctgtcctcgtaccca

SEQ ID NO: 27074 - DNA, 36 bp, Artificial Sequence
  Synthetic oligonucleotide
tgacaggcccaccacaatctaatgcagtaaacagca

SEQ ID NO: 27075 - DNA, 36 bp, Artificial Sequence
  Synthetic oligonucleotide
tgatcggcctccgcctgtctgttagtcctctcttca

SEQ ID NO: 27076 - DNA, 37 bp, Artificial Sequence
  Synthetic oligonucleotide
gcattcctcattctttcccgtccgggccgtaagcgga

SEQ ID NO: 27077 - DNA, 37 bp, Artificial Sequence
  Synthetic oligonucleotide
ttatgagcggtacagacggtgtgtgggtgggtgcgga

SEQ ID NO: 27078 - DNA, 35 bp, Artificial Sequence
  Synthetic oligonucleotide
tacgaaagcaatgtactgctcagccacctaacgac

SEQ ID NO: 27079 - DNA, 35 bp, Artificial Sequence
  Synthetic oligonucleotide
tcccaaatcaccatcgtgtccatctctatatccgc

SEQ ID NO: 27080 - DNA, 35 bp, Artificial Sequence
  Synthetic oligonucleotide
tgtaaccgccacttcaccttcagtttagatcagtc

SEQ ID NO: 27081 - DNA, 35 bp, Artificial Sequence
  Synthetic oligonucleotide
tgcaacacctaccccatcgcgagtactcaacgccg

SEQ ID NO: 27082 - DNA, 35 bp, Artificial Sequence
  Synthetic oligonucleotide
accccctgagcccaatgatgcaccccgattattcg

SEQ ID NO: 27083 - DNA, 35 bp, Artificial Sequence
  Synthetic oligonucleotide
gagatgtgggaaatatatgaagggaattgtgcagg

SEQ ID NO: 27084 - DNA, 35 bp, Artificial Sequence
  Synthetic oligonucleotide
gctgccccagatccccatgtaccgctactttctct

SEQ ID NO: 27085 - DNA, 35 bp, Artificial Sequence
  Synthetic oligonucleotide
tcctcaggctccgacctccaggtaatacaccactt

SEQ ID NO: 27086 - DNA, 36 bp, Artificial Sequence
  Synthetic oligonucleotide
tccgcagagcctgtcttttggttccccgtactctaa

SEQ ID NO: 27087 - DNA, 36 bp, Artificial Sequence
  Synthetic oligonucleotide
gttgacagtccgtgcgctctgttttcgggtgttcca

SEQ ID NO: 27088 - DNA, 36 bp, Artificial Sequence
  Synthetic oligonucleotide
atgcccccacatggtcccgttgcacataatcgggca

SEQ ID NO: 27089 - DNA, 37 bp, Artificial Sequence
  Synthetic oligonucleotide
gtcacaccgtccacacaccatacgccgtatagtacga

SEQ ID NO: 27090 - DNA, 37 bp, Artificial Sequence
  Synthetic oligonucleotide
tgagagcctcagtaatccatctcgtcccgatttccga

SEQ ID NO: 27091 - DNA, 37 bp, Artificial Sequence
  Synthetic oligonucleotide
tcttcgaccaatggtctattaacgcaccttccctcga

SEQ ID NO: 27092 - DNA, 38 bp, Artificial Sequence
  Synthetic oligonucleotide
gatcttccgccatagtgcaatttgccctctttacgtga

SEQ ID NO: 27093 - DNA, 38 bp, Artificial Sequence
  Synthetic oligonucleotide
ttaggacgtgggtaggtaacgggtggggtaggcggtga

SEQ ID NO: 27094 - DNA, 38 bp, Artificial Sequence
  Synthetic oligonucleotide
gtggccgcccacccttcgtctgcgacgttcttccttga

SEQ ID NO: 27095 - DNA, 35 bp, Artificial Sequence
  Synthetic oligonucleotide
atatcccaccactgatttttatagcgggactctta

SEQ ID NO: 27096 - DNA, 35 bp, Artificial Sequence
  Synthetic oligonucleotide
accacacctacctaacttctaagtccgggctgacc

SEQ ID NO: 27097 - DNA, 35 bp, Artificial Sequence
  Synthetic oligonucleotide
ttgcaccgcttgtcgtcgctgtcaacgttttccgc

SEQ ID NO: 27098 - DNA, 35 bp, Artificial Sequence
  Synthetic oligonucleotide
atccccatgcacctctggtaattaacgtgagcctc

SEQ ID NO: 27099 - DNA, 35 bp, Artificial Sequence
  Synthetic oligonucleotide
agtacccgtcctgcactctcccagggcccggtcct

SEQ ID NO: 27100 - DNA, 35 bp, Artificial Sequence
  Synthetic oligonucleotide
tgtgtgcccagagctcgtcattttttgctccgttt

SEQ ID NO: 27101 - DNA, 37 bp, Artificial Sequence
  Synthetic oligonucleotide
aacgcaccagcaccgtccatcatactaccgacactga

SEQ ID NO: 27102 - DNA, 37 bp, Artificial Sequence
  Synthetic oligonucleotide
ttcaccaccaccgcgctattgacccagaaatgactga

SEQ ID NO: 27103 - DNA, 38 bp, Artificial Sequence
  Synthetic oligonucleotide
gtgccatccagccggtgagaacccacgcctaaaattga

SEQ ID NO: 27104 - DNA, 38 bp, Artificial Sequence
  Synthetic oligonucleotide
tcctgccgaagcacgctttcatgataaacttcccttga

SEQ ID NO: 27105 - DNA, 36 bp, Artificial Sequence
  Synthetic oligonucleotide
atgaccgccgaatgagccgctgttacctgccctcta

SEQ ID NO: 27106 - DNA, 35 bp, Artificial Sequence
  Synthetic oligonucleotide
gatctgaccgatacctgactgccgttgacattccg

SEQ ID NO: 27107 - DNA, 35 bp, Artificial Sequence
  Synthetic oligonucleotide
acgggggcgggagggaggggctgtgaaggtttact

SEQ ID NO: 27108 - DNA, 35 bp, Artificial Sequence
  Synthetic oligonucleotide
gcacgagtagccccctcctctataggccgcctcct

SEQ ID NO: 27109 - DNA, 35 bp, Artificial Sequence
  Synthetic oligonucleotide
gccttcccttccgatactcgtgttcgacactgggt

SEQ ID NO: 27110 - DNA, 35 bp, Artificial Sequence
  Synthetic oligonucleotide
tatgaacgccggacccttgtctggaaccttttttt

SEQ ID NO: 27111 - DNA, 35 bp, Artificial Sequence
  Synthetic oligonucleotide
gggacccatactgaactgaacaactgcaaccgcca

SEQ ID NO: 27112 - DNA, 36 bp, Artificial Sequence
  Synthetic oligonucleotide
aagctccccggccatccgtacaacgcccctccgaga

SEQ ID NO: 27113 - DNA, 38 bp, Artificial Sequence
  Synthetic oligonucleotide
tgcctatctgtggcatgtgcctaccaccttcaccttga

SEQ ID NO: 27114 - DNA, 38 bp, Artificial Sequence
  Synthetic oligonucleotide
gtaggggcgaggggggtaggaggtatatggagggttga

SEQ ID NO: 27115 - DNA, 38 bp, Artificial Sequence
  Synthetic oligonucleotide
gtcaccacagtcgccgaaacgtaattgctcctttttga

SEQ ID NO: 27116 - DNA, 36 bp, Artificial Sequence
  Synthetic oligonucleotide
acccccccgccctgatgcaccggaattaacccagta

SEQ ID NO: 27117 - DNA, 35 bp, Artificial Sequence
  Synthetic oligonucleotide
gcctccgggctatgtatcctctctttacccctttg

SEQ ID NO: 27118 - DNA, 36 bp, Artificial Sequence
  Synthetic oligonucleotide
actcgcgtaccggtaccttgccagcctttacactaa

SEQ ID NO: 27119 - DNA, 36 bp, Artificial Sequence
  Synthetic oligonucleotide
gccaccggggagcagtgagcggttgaggagggaaca

SEQ ID NO: 27120 - DNA, 36 bp, Artificial Sequence
  Synthetic oligonucleotide
atgcgagggcgggaaaggagggagctcgttttatca

SEQ ID NO: 27121 - DNA, 35 bp, Artificial Sequence
  Synthetic oligonucleotide
gtgttgccggacatccgttttgctcttgtatttca

SEQ ID NO: 27122 - DNA, 37 bp, Artificial Sequence
  Synthetic oligonucleotide
acacgtgtccatccgtcctgcgcctcatctgattaga

SEQ ID NO: 27123 - DNA, 38 bp, Artificial Sequence
  Synthetic oligonucleotide
gtccaacacacagttttgtctctcacttgcacttatga

SEQ ID NO: 27124 - DNA, 38 bp, Artificial Sequence
  Synthetic oligonucleotide
tgcgtaccaccccagctatataacggtgtcgcttttga

SEQ ID NO: 27125 - DNA, 34 bp, Artificial Sequence
  Synthetic oligonucleotide
tatgccacacaccccgacgcacgttacgagcaac

SEQ ID NO: 27126 - DNA, 35 bp, Artificial Sequence
  Synthetic oligonucleotide
tcccacgaacgtacaaccagctatgcgttggcacc

SEQ ID NO: 27127 - DNA, 35 bp, Artificial Sequence
  Synthetic oligonucleotide
accccccagttattgcccagctagttcctgatccc

SEQ ID NO: 27128 - DNA, 35 bp, Artificial Sequence
  Synthetic oligonucleotide
gttgaacgtgctttgttttagcccttctgtcttgc

SEQ ID NO: 27129 - DNA, 35 bp, Artificial Sequence
  Synthetic oligonucleotide
tcgccacaccctcagttaactaattccgggccatc

SEQ ID NO: 27130 - DNA, 35 bp, Artificial Sequence
  Synthetic oligonucleotide
tcccaacctcaccgttccctcattgtaccgaagtc

SEQ ID NO: 27131 - DNA, 35 bp, Artificial Sequence
  Synthetic oligonucleotide
gactgccaactcggcgtccaatcccctcacacttg

SEQ ID NO: 27132 - DNA, 35 bp, Artificial Sequence
  Synthetic oligonucleotide
accacttgtcaactcgctcgacaccttctcctaat

SEQ ID NO: 27133 - DNA, 35 bp, Artificial Sequence
  Synthetic oligonucleotide
atcgccccgagccctattttgttggtttggacact

SEQ ID NO: 27134 - DNA, 36 bp, Artificial Sequence
  Synthetic oligonucleotide
gtattctacgcccctatgctaatgcctatcacctga

SEQ ID NO: 27135 - DNA, 38 bp, Artificial Sequence
  Synthetic oligonucleotide
atagcccctccacgcctgcttaccatccacgaccgtga

SEQ ID NO: 27136 - DNA, 38 bp, Artificial Sequence
  Synthetic oligonucleotide
agacgagggtaaagggggtggagaattgatcattttga

SEQ ID NO: 27137 - DNA, 36 bp, Artificial Sequence
  Synthetic oligonucleotide
gtgcacgattccgtcgatccatctcccttcgcgata

SEQ ID NO: 27138 - DNA, 35 bp, Artificial Sequence
  Synthetic oligonucleotide
ccactcacacgccgtattgttcgttcacccgttta

SEQ ID NO: 27139 - DNA, 35 bp, Artificial Sequence
  Synthetic oligonucleotide
attagccacattcccgctcccttcaggatggccac

SEQ ID NO: 27140 - DNA, 35 bp, Artificial Sequence
  Synthetic oligonucleotide
tgcacacaatcatcccctaccgcgagacctgtcgc

SEQ ID NO: 27141 - DNA, 35 bp, Artificial Sequence
  Synthetic oligonucleotide
atccgcgaggcgaactaattggtcctcccatcttc

SEQ ID NO: 27142 - DNA, 36 bp, Artificial Sequence
  Synthetic oligonucleotide
ggagccacccatcttattagcagcctttctcctaaa

SEQ ID NO: 27143 - DNA, 35 bp, Artificial Sequence
  Synthetic oligonucleotide
tgtaccatcccccgtgatgtcgccacccagcctaa

SEQ ID NO: 27144 - DNA, 35 bp, Artificial Sequence
  Synthetic oligonucleotide
taccttacccgcagtacatcttaagcgcgccgcca

SEQ ID NO: 27145 - DNA, 36 bp, Artificial Sequence
  Synthetic oligonucleotide
gcccgatcggtcggagggtggcgagggaagggcgca

SEQ ID NO: 27146 - DNA, 37 bp, Artificial Sequence
  Synthetic oligonucleotide
gatccgtaaagcggagggagggggaggtggggataga

SEQ ID NO: 27147 - DNA, 35 bp, Artificial Sequence
  Synthetic oligonucleotide
agtccaccctccgaccgcgattgaacttgcgccga

SEQ ID NO: 27148 - DNA, 37 bp, Artificial Sequence
  Synthetic oligonucleotide
ttgcccggacggaagatacagcgggggcgggtgggga

SEQ ID NO: 27149 - DNA, 38 bp, Artificial Sequence
  Synthetic oligonucleotide
tagccaaccactttcctagcctatggaccaggcaatga

SEQ ID NO: 27150 - DNA, 38 bp, Artificial Sequence
  Synthetic oligonucleotide
tgaggacagaggacgggagcgagtagggtgcggcatga

SEQ ID NO: 27151 - DNA, 38 bp, Artificial Sequence
  Synthetic oligonucleotide
gcctggtccatatgacttcgccttccgactttgcctga

SEQ ID NO: 27152 - DNA, 38 bp, Artificial Sequence
  Synthetic oligonucleotide
atacaagccacaggtagtgggacggggatgacgggtga

SEQ ID NO: 27153 - DNA, 38 bp, Artificial Sequence
  Synthetic oligonucleotide
tgtgggttgtggtgggggagtggatgggagatgtgtga

SEQ ID NO: 27154 - DNA, 35 bp, Artificial Sequence
  Synthetic oligonucleotide
tcaccccgactgtttcatgagtctccggttatgac

SEQ ID NO: 27155 - DNA, 35 bp, Artificial Sequence
  Synthetic oligonucleotide
tggagccctacgccgtatcgaaactttctggtctc

SEQ ID NO: 27156 - DNA, 35 bp, Artificial Sequence
  Synthetic oligonucleotide
ttgctccaccaggccctgagcgcacgttcgacgtc

SEQ ID NO: 27157 - DNA, 35 bp, Artificial Sequence
  Synthetic oligonucleotide
tcaccactccagtttcctcatctgaaatcgcctgg

SEQ ID NO: 27158 - DNA, 36 bp, Artificial Sequence
  Synthetic oligonucleotide
gtcaccttcacggagtgtttctgcgccttcaccaaa

SEQ ID NO: 27159 - DNA, 35 bp, Artificial Sequence
  Synthetic oligonucleotide
ttggaaatatggggcggagggtaatggggcaagaa

SEQ ID NO: 27160 - DNA, 36 bp, Artificial Sequence
  Synthetic oligonucleotide
gaagaggagggggcggacggacagtacatcgatcca

SEQ ID NO: 27161 - DNA, 36 bp, Artificial Sequence
  Synthetic oligonucleotide
gtccagcggagtctttgtgatccgctgcctattcca

SEQ ID NO: 27162 - DNA, 37 bp, Artificial Sequence
  Synthetic oligonucleotide
tctgagggtggggtgttcggggtgaaaaggtttgcga

SEQ ID NO: 27163 - DNA, 37 bp, Artificial Sequence
  Synthetic oligonucleotide
agtcaccccatcggtctaccttccgccctcttcgtga

SEQ ID NO: 27164 - DNA, 37 bp, Artificial Sequence
  Synthetic oligonucleotide
tctaccccatctcgtccacattgtaactggtacttga

SEQ ID NO: 27165 - DNA, 38 bp, Artificial Sequence
  Synthetic oligonucleotide
acgcactgttcagcctattatgctcctgggccccttga

SEQ ID NO: 27166 - DNA, 36 bp, Artificial Sequence
  Synthetic oligonucleotide
taacatgccccgatcgatccgttccatattaatgta

SEQ ID NO: 27167 - DNA, 35 bp, Artificial Sequence
  Synthetic oligonucleotide
tgacgatcctctttgtgatcctgccgaataccacc

SEQ ID NO: 27168 - DNA, 35 bp, Artificial Sequence
  Synthetic oligonucleotide
gatggccctccttcgaattatcccgtggccaaccc

SEQ ID NO: 27169 - DNA, 35 bp, Artificial Sequence
  Synthetic oligonucleotide
ttactaaccgtacatgtcacttacgccacattcat

SEQ ID NO: 27170 - DNA, 35 bp, Artificial Sequence
  Synthetic oligonucleotide
accgtgggccatcctaataacgacgaagcctcact

SEQ ID NO: 27171 - DNA, 36 bp, Artificial Sequence
  Synthetic oligonucleotide
tatctggtccgggcccatctgtacacaggtcctcca

SEQ ID NO: 27172 - DNA, 35 bp, Artificial Sequence
  Synthetic oligonucleotide
gccctgcctcctaaaccctcactaaacgtgactga

SEQ ID NO: 27173 - DNA, 38 bp, Artificial Sequence
  Synthetic oligonucleotide
gcgaagcacgtcggaacactccggttcgttgctactga

SEQ ID NO: 27174 - DNA, 38 bp, Artificial Sequence
  Synthetic oligonucleotide
ttcactgccctatctcttttagcgaccttccttattga

SEQ ID NO: 27175 - DNA, 36 bp, Artificial Sequence
  Synthetic oligonucleotide
tcacccatggggcaaataagctttttgaaacctgta

SEQ ID NO: 27176 - DNA, 36 bp, Artificial Sequence
  Synthetic oligonucleotide
tcacgcatcctatttgccattgaccaccatgggtta

SEQ ID NO: 27177 - DNA, 36 bp, Artificial Sequence
  Synthetic oligonucleotide
tgcccctacccggtggggctatacactaggtccccc

SEQ ID NO: 27178 - DNA, 35 bp, Artificial Sequence
  Synthetic oligonucleotide
gccctcctacgccggattcaaccactgcctgttcg

SEQ ID NO: 27179 - DNA, 35 bp, Artificial Sequence
  Synthetic oligonucleotide
gtgaaagggtagtgttggggtgggcatacagggtg

SEQ ID NO: 27180 - DNA, 35 bp, Artificial Sequence
  Synthetic oligonucleotide
actgccctggtccctgcccagtctacgcccacttg

SEQ ID NO: 27181 - DNA, 35 bp, Artificial Sequence
  Synthetic oligonucleotide
gcactctaatctttgcgcgcgcctgcccatgccat

SEQ ID NO: 27182 - DNA, 35 bp, Artificial Sequence
  Synthetic oligonucleotide
gatactagagcctcctacacgcgttccaccccgtt

SEQ ID NO: 27183 - DNA, 36 bp, Artificial Sequence
  Synthetic oligonucleotide
tcaacccatgcatctcttgtctcttcataagagcca

SEQ ID NO: 27184 - DNA, 36 bp, Artificial Sequence
  Synthetic oligonucleotide
ggtcctccctatccgtgcccctccagccatttgtca

SEQ ID NO: 27185 - DNA, 37 bp, Artificial Sequence
  Synthetic oligonucleotide
gtcattcgtctatgccccgaacctgcatctcctccga

SEQ ID NO: 27186 - DNA, 37 bp, Artificial Sequence
  Synthetic oligonucleotide
gtaggtgcaaaagaaggaatgggacaagaatgtagga

SEQ ID NO: 27187 - DNA, 37 bp, Artificial Sequence
  Synthetic oligonucleotide
gatcaggatggaagaaggggaaggatacggaattgga

SEQ ID NO: 27188 - DNA, 38 bp, Artificial Sequence
  Synthetic oligonucleotide
accgacggagcgaatttagcctgccacctgttcaatga

SEQ ID NO: 27189 - DNA, 37 bp, Artificial Sequence
  Synthetic oligonucleotide
tgtgacctcgcccatcttgctgcctgatccatgttga

SEQ ID NO: 27190 - DNA, 36 bp, Artificial Sequence
  Synthetic oligonucleotide
atgccatcgtagaaagtctttgccctgtttccccta

SEQ ID NO: 27191 - DNA, 35 bp, Artificial Sequence
  Synthetic oligonucleotide
ccctggccgtttctcttacccgaagcgtgtcccac

SEQ ID NO: 27192 - DNA, 35 bp, Artificial Sequence
  Synthetic oligonucleotide
agactgccccccgcgaccgcccgctcgagaaagac

SEQ ID NO: 27193 - DNA, 35 bp, Artificial Sequence
  Synthetic oligonucleotide
tcacttatccgaacgctctgctgcctgaccgtggc

SEQ ID NO: 27194 - DNA, 35 bp, Artificial Sequence
  Synthetic oligonucleotide
actgatatcgggggtggaggaagggtagtcaagtt

SEQ ID NO: 27195 - DNA, 35 bp, Artificial Sequence
  Synthetic oligonucleotide
gcgccggtcccattgttctcatgtactctactcca

SEQ ID NO: 27196 - DNA, 35 bp, Artificial Sequence
  Synthetic oligonucleotide
tcatcgcgtcgtactgctgcttcctgcttatctca

SEQ ID NO: 27197 - DNA, 36 bp, Artificial Sequence
  Synthetic oligonucleotide
ctcatcatccgcgaactctggatttggttccattca

SEQ ID NO: 27198 - DNA, 37 bp, Artificial Sequence
  Synthetic oligonucleotide
tgacgcatcaccccggcgcagccccttgcctttccga

SEQ ID NO: 27199 - DNA, 38 bp, Artificial Sequence
  Synthetic oligonucleotide
tacgcgttcgccacgtgacgctacttacccatcaatga

SEQ ID NO: 27200 - DNA, 38 bp, Artificial Sequence
  Synthetic oligonucleotide
aatccaccgccaaggctgtcgacaatttttctgcctga

SEQ ID NO: 27201 - DNA, 35 bp, Artificial Sequence
  Synthetic oligonucleotide
tatcacatccgacattcgtattccgttcgctctcc

SEQ ID NO: 27202 - DNA, 35 bp, Artificial Sequence
  Synthetic oligonucleotide
atcccgccacgagaacacacgtatcacgccgccgc

SEQ ID NO: 27203 - DNA, 35 bp, Artificial Sequence
  Synthetic oligonucleotide
tctatgacagctgcggagctatcgcttaacccctc

SEQ ID NO: 27204 - DNA, 35 bp, Artificial Sequence
  Synthetic oligonucleotide
atccgtcccccgtccagtttacttaaatcaccagg

SEQ ID NO: 27205 - DNA, 37 bp, Artificial Sequence
  Synthetic oligonucleotide
tggttgggacggggagagaggggggcactggtggaga

SEQ ID NO: 27206 - DNA, 38 bp, Artificial Sequence
  Synthetic oligonucleotide
tttcgatcgcgcgcttatctctttaacacacgccctga

SEQ ID NO: 27207 - DNA, 36 bp, Artificial Sequence
  Synthetic oligonucleotide
acgcccatcggtcgaactcctgacctggtcccgtta

SEQ ID NO: 27208 - DNA, 36 bp, Artificial Sequence
  Synthetic oligonucleotide
gaagccaattgccgtggtctggcctatttccattta

SEQ ID NO: 27209 - DNA, 35 bp, Artificial Sequence
  Synthetic oligonucleotide
ttcgatccatctcgcatttcaggttctcgttgcac

SEQ ID NO: 27210 - DNA, 35 bp, Artificial Sequence
  Synthetic oligonucleotide
gtctcgataaatcatggcctattgtcctgcccatc

SEQ ID NO: 27211 - DNA, 35 bp, Artificial Sequence
  Synthetic oligonucleotide
gacggggggtagtggatggaggatggctacggtag

SEQ ID NO: 27212 - DNA, 35 bp, Artificial Sequence
  Synthetic oligonucleotide
gagccactgctttgaccctcccctgagccgcttgg

SEQ ID NO: 27213 - DNA, 34 bp, Artificial Sequence
  Synthetic oligonucleotide
gtacaacaggctcgtatcctcgcgaatcttccat

SEQ ID NO: 27214 - DNA, 35 bp, Artificial Sequence
  Synthetic oligonucleotide
ataccgtcgccacacagggtagtttcttccatcat

SEQ ID NO: 27215 - DNA, 35 bp, Artificial Sequence
  Synthetic oligonucleotide
tgggccttcaccacatctgtctacgcaaccaccgt

SEQ ID NO: 27216 - DNA, 35 bp, Artificial Sequence
  Synthetic oligonucleotide
tcgaatacgtactggtcccgggcttcgagttcttt

SEQ ID NO: 27217 - DNA, 35 bp, Artificial Sequence
  Synthetic oligonucleotide
ggaatgggaatggtaggaatgaactttaaggggca

SEQ ID NO: 27218 - DNA, 36 bp, Artificial Sequence
  Synthetic oligonucleotide
aaactgcctggggggaagggggatggatgactggca

SEQ ID NO: 27219 - DNA, 36 bp, Artificial Sequence
  Synthetic oligonucleotide
tcctcggagccgtgcctagcttctgccataacctca

SEQ ID NO: 27220 - DNA, 34 bp, Artificial Sequence
  Synthetic oligonucleotide
ataccaccctcacatgcacctccatcgtcgctca

SEQ ID NO: 27221 - DNA, 37 bp, Artificial Sequence
  Synthetic oligonucleotide
tgacaggggaacggatcgtagtcaaggggatcgaaga

SEQ ID NO: 27222 - DNA, 35 bp, Artificial Sequence
  Synthetic oligonucleotide
gccactttccacgatacagccctccctaacgtaga

SEQ ID NO: 27223 - DNA, 37 bp, Artificial Sequence
  Synthetic oligonucleotide
gagcccacgtttcgcatttggttccgcctccccagga

SEQ ID NO: 27224 - DNA, 38 bp, Artificial Sequence
  Synthetic oligonucleotide
ttccatccgccctgtacacgttacggttcaacaactga

SEQ ID NO: 27225 - DNA, 38 bp, Artificial Sequence
  Synthetic oligonucleotide
aagcgagccacgcgatcactcccacatccctgccctga

SEQ ID NO: 27226 - DNA, 38 bp, Artificial Sequence
  Synthetic oligonucleotide
gacgggcaatagctaagggcggggtagggagcgggtga

SEQ ID NO: 27227 - DNA, 35 bp, Artificial Sequence
  Synthetic oligonucleotide
gttgatcaggctctgtaatcagctccaccttcgac

SEQ ID NO: 27228 - DNA, 35 bp, Artificial Sequence
  Synthetic oligonucleotide
agtacgatccggttagtcctccaagaactgcgtcc

SEQ ID NO: 27229 - DNA, 35 bp, Artificial Sequence
  Synthetic oligonucleotide
cctgattgctcgaaggcttttggtccgggaatatc

SEQ ID NO: 27230 - DNA, 35 bp, Artificial Sequence
  Synthetic oligonucleotide
gaccactcctttttagtatgcctcgtatctggagg

SEQ ID NO: 27231 - DNA, 35 bp, Artificial Sequence
  Synthetic oligonucleotide
tacgtcgacagttatcttcctcgtgctacttctct

SEQ ID NO: 27232 - DNA, 36 bp, Artificial Sequence
  Synthetic oligonucleotide
gcgatctcaaagcacgggttaacgccagcccccaca

SEQ ID NO: 27233 - DNA, 34 bp, Artificial Sequence
  Synthetic oligonucleotide
gtctcccgtcacgcctgctcgcaatagaacttca

SEQ ID NO: 27234 - DNA, 37 bp, Artificial Sequence
  Synthetic oligonucleotide
agccgccccactctccagcacaattcacggttgccga

SEQ ID NO: 27235 - DNA, 38 bp, Artificial Sequence
  Synthetic oligonucleotide
gcgacaaccccgaggtctcgtcgccttctttttaatga

SEQ ID NO: 27236 - DNA, 36 bp, Artificial Sequence
  Synthetic oligonucleotide
gaacccccacctggttgcccgacagccccctatcta

SEQ ID NO: 27237 - DNA, 36 bp, Artificial Sequence
  Synthetic oligonucleotide
ggtgaacccccccccgtcatgtcctgacccttcaac

SEQ ID NO: 27238 - DNA, 35 bp, Artificial Sequence
  Synthetic oligonucleotide
gacccgccatgaacttaggctccagactgacccac

SEQ ID NO: 27239 - DNA, 35 bp, Artificial Sequence
  Synthetic oligonucleotide
tcgaggcaccctcaacctgcaaacctatcccatac

SEQ ID NO: 27240 - DNA, 35 bp, Artificial Sequence
  Synthetic oligonucleotide
tattgtaatccgatccacctgccacctctgtttgc

SEQ ID NO: 27241 - DNA, 35 bp, Artificial Sequence
  Synthetic oligonucleotide
accacaccatctagcgttttcgagtaaaaccagtc

SEQ ID NO: 27242 - DNA, 35 bp, Artificial Sequence
  Synthetic oligonucleotide
ttcccaccgccttattacaactgccatcgtgacag

SEQ ID NO: 27243 - DNA, 35 bp, Artificial Sequence
  Synthetic oligonucleotide
tccgtatgcgcacatctgcattcttttacaccgat

SEQ ID NO: 27244 - DNA, 35 bp, Artificial Sequence
  Synthetic oligonucleotide
tctagcaccaacacggcccgagagcccttcgttat

SEQ ID NO: 27245 - DNA, 35 bp, Artificial Sequence
  Synthetic oligonucleotide
tgagcagaccaatctgcaaagtgcccttctactct

SEQ ID NO: 27246 - DNA, 35 bp, Artificial Sequence
  Synthetic oligonucleotide
ttccagtgtccatcgctgtatctcttgctccttct

SEQ ID NO: 27247 - DNA, 35 bp, Artificial Sequence
  Synthetic oligonucleotide
tccaccctgacttcctactcagagacagagtgggt

SEQ ID NO: 27248 - DNA, 35 bp, Artificial Sequence
  Synthetic oligonucleotide
ggtcaaagagtaggggtagtggacgggatatagaa

SEQ ID NO: 27249 - DNA, 36 bp, Artificial Sequence
  Synthetic oligonucleotide
acaacgctgaaggtgttgcacctcgtattccccgca

SEQ ID NO: 27250 - DNA, 36 bp, Artificial Sequence
  Synthetic oligonucleotide
gtccgcctcctgtctcgaccacctttttaattggca

SEQ ID NO: 27251 - DNA, 35 bp, Artificial Sequence
  Synthetic oligonucleotide
gccatccccctgtgcacctcccgagtcacgcctca

SEQ ID NO: 27252 - DNA, 36 bp, Artificial Sequence
  Synthetic oligonucleotide
tgagactcggggagtgggggggaagggggtcaaaga

SEQ ID NO: 27253 - DNA, 37 bp, Artificial Sequence
  Synthetic oligonucleotide
gcaacgctacttagtgattccgatctattgcctccga

SEQ ID NO: 27254 - DNA, 38 bp, Artificial Sequence
  Synthetic oligonucleotide
gacgcaccttgaccgcactagaaacacctccctcatga

SEQ ID NO: 27255 - DNA, 38 bp, Artificial Sequence
  Synthetic oligonucleotide
acgagctgcttaactgccgtccctattccgttgcctga

SEQ ID NO: 27256 - DNA, 38 bp, Artificial Sequence
  Synthetic oligonucleotide
gcctccgtatcatgccgcccctccactcagtaagctga

SEQ ID NO: 27257 - DNA, 38 bp, Artificial Sequence
  Synthetic oligonucleotide
atccccgcgcccagtatttacactatccttgtcgctga

SEQ ID NO: 27258 - DNA, 37 bp, Artificial Sequence
  Synthetic oligonucleotide
tacgtccatcacatctcaaatcttgtccacccagtga

SEQ ID NO: 27259 - DNA, 36 bp, Artificial Sequence
  Synthetic oligonucleotide
acacaccctgtgctgcctccgtgttttctgttcgta

SEQ ID NO: 27260 - DNA, 35 bp, Artificial Sequence
  Synthetic oligonucleotide
atgggagtcgggaggggatagaaccgctaatgggc

SEQ ID NO: 27261 - DNA, 35 bp, Artificial Sequence
  Synthetic oligonucleotide
atcgaggctcgttgcgcaaattggccatatacctc

SEQ ID NO: 27262 - DNA, 35 bp, Artificial Sequence
  Synthetic oligonucleotide
gacagagtccccattaattggtccctgccttcgtc

SEQ ID NO: 27263 - DNA, 35 bp, Artificial Sequence
  Synthetic oligonucleotide
tagtccacccttccaaatggccttcacatggacat

SEQ ID NO: 27264 - DNA, 35 bp, Artificial Sequence
  Synthetic oligonucleotide
gtgaccatccacccctgaccacacctgcgaccact

SEQ ID NO: 27265 - DNA, 35 bp, Artificial Sequence
  Synthetic oligonucleotide
gctgtccccgtatgcaatcacgtccatctgcctct

SEQ ID NO: 27266 - DNA, 35 bp, Artificial Sequence
  Synthetic oligonucleotide
agcgagggcatcgggttgcagcactattctctttt

SEQ ID NO: 27267 - DNA, 35 bp, Artificial Sequence
  Synthetic oligonucleotide
tatggtgggaaggatgattaggggagctaacggca

SEQ ID NO: 27268 - DNA, 37 bp, Artificial Sequence
  Synthetic oligonucleotide
tctctccgccgcattgcatcgtccctcaatccaacga

SEQ ID NO: 27269 - DNA, 37 bp, Artificial Sequence
  Synthetic oligonucleotide
gatctctcgccaaatatccgacgccgctttatcccga

SEQ ID NO: 27270 - DNA, 37 bp, Artificial Sequence
  Synthetic oligonucleotide
atacacggagggcaggggggggccggaattaatgcga

SEQ ID NO: 27271 - DNA, 38 bp, Artificial Sequence
  Synthetic oligonucleotide
gccctaagccgcgtcctgttcccccgcctcctgcatga

SEQ ID NO: 27272 - DNA, 35 bp, Artificial Sequence
  Synthetic oligonucleotide
tgtttgtgcacattgtcgacttcccgccggtcacc

SEQ ID NO: 27273 - DNA, 35 bp, Artificial Sequence
  Synthetic oligonucleotide
acaccctgagttcagactgttaaccctcccgcgcc

SEQ ID NO: 27274 - DNA, 35 bp, Artificial Sequence
  Synthetic oligonucleotide
accagacgtcctcaccaacccgtacccagtagtcc

SEQ ID NO: 27275 - DNA, 35 bp, Artificial Sequence
  Synthetic oligonucleotide
tacgacgagtcgtctctacttcccggtggcctggc

SEQ ID NO: 27276 - DNA, 35 bp, Artificial Sequence
  Synthetic oligonucleotide
tcctcctccagtttattggtcactttattccactc

SEQ ID NO: 27277 - DNA, 35 bp, Artificial Sequence
  Synthetic oligonucleotide
tgtcacgccttctttccccggccgacgcttccagg

SEQ ID NO: 27278 - DNA, 35 bp, Artificial Sequence
  Synthetic oligonucleotide
gccgcgcctcgaatacctcactggacccctttatg

SEQ ID NO: 27279 - DNA, 35 bp, Artificial Sequence
  Synthetic oligonucleotide
gttgagcatcgtacacattcctttgccattactct

SEQ ID NO: 27280 - DNA, 35 bp, Artificial Sequence
  Synthetic oligonucleotide
gtctgcgcattgtaatccccaacacccagcctgaa

SEQ ID NO: 27281 - DNA, 36 bp, Artificial Sequence
  Synthetic oligonucleotide
accgtgcgctccgacctcgcatctggaacgaattca

SEQ ID NO: 27282 - DNA, 37 bp, Artificial Sequence
  Synthetic oligonucleotide
acctacgcctccccaccctcccaccggtattgagcga

SEQ ID NO: 27283 - DNA, 37 bp, Artificial Sequence
  Synthetic oligonucleotide
aatggggggcggtgggttcatggataaacgggggcga

SEQ ID NO: 27284 - DNA, 37 bp, Artificial Sequence
  Synthetic oligonucleotide
tgcaccctctcatagggaatgactcccatattctcga

SEQ ID NO: 27285 - DNA, 36 bp, Artificial Sequence
  Synthetic oligonucleotide
gaacacgcaggaaaagggagttacacgagaggagga

SEQ ID NO: 27286 - DNA, 36 bp, Artificial Sequence
  Synthetic oligonucleotide
gccgggcccagctgctatacgctatcacctcacgga

SEQ ID NO: 27287 - DNA, 38 bp, Artificial Sequence
  Synthetic oligonucleotide
gtgagccataaccgtacgcccccgccactatgcactga

SEQ ID NO: 27288 - DNA, 38 bp, Artificial Sequence
  Synthetic oligonucleotide
gtgtagtgagtgagattgagggatgggggtcgggctga

SEQ ID NO: 27289 - DNA, 38 bp, Artificial Sequence
  Synthetic oligonucleotide
ggagaggggaactataaaagcgagggtgggagatctga

SEQ ID NO: 27290 - DNA, 36 bp, Artificial Sequence
  Synthetic oligonucleotide
aaccctcagatcgctctattgtggtgccttcttata

SEQ ID NO: 27291 - DNA, 35 bp, Artificial Sequence
  Synthetic oligonucleotide
acgcccaacctctttaatggtgaagactcgattcc

SEQ ID NO: 27292 - DNA, 35 bp, Artificial Sequence
  Synthetic oligonucleotide
atgctgacccacttttcacgcgctacgccccaagc

SEQ ID NO: 27293 - DNA, 35 bp, Artificial Sequence
  Synthetic oligonucleotide
gttgggtgcgcgagtagttcatgcccgctttcatc

SEQ ID NO: 27294 - DNA, 35 bp, Artificial Sequence
  Synthetic oligonucleotide
tgaccgacctcgcattagctcatgttagcccttcg

SEQ ID NO: 27295 - DNA, 34 bp, Artificial Sequence
  Synthetic oligonucleotide
aaactccaactgcagccttccccgacggtcctaa

SEQ ID NO: 27296 - DNA, 37 bp, Artificial Sequence
  Synthetic oligonucleotide
tacgcacgccaccatcacgaactttcttacaattcga

SEQ ID NO: 27297 - DNA, 37 bp, Artificial Sequence
  Synthetic oligonucleotide
acatccatcgcccttcatgaatcccgagccctcctga

SEQ ID NO: 27298 - DNA, 37 bp, Artificial Sequence
  Synthetic oligonucleotide
atgctgagggggtgggggtaagcgcctgagggcttga

SEQ ID NO: 27299 - DNA, 36 bp, Artificial Sequence
  Synthetic oligonucleotide
atatggctgacgaacaaggctggcggaatgggggta

SEQ ID NO: 27300 - DNA, 36 bp, Artificial Sequence
  Synthetic oligonucleotide
acacgcgcctcaacggaacaccctcctacacggtta

SEQ ID NO: 27301 - DNA, 35 bp, Artificial Sequence
  Synthetic oligonucleotide
tccgcgatccaatccgattcctcgcggaccctctc

SEQ ID NO: 27302 - DNA, 35 bp, Artificial Sequence
  Synthetic oligonucleotide
ttgccccatcgcccatcgccacagctatcctgccg

SEQ ID NO: 27303 - DNA, 35 bp, Artificial Sequence
  Synthetic oligonucleotide
gtgccggactgactgtccccccatccacgtgttgt

SEQ ID NO: 27304 - DNA, 36 bp, Artificial Sequence
  Synthetic oligonucleotide
tacgaatcgtagcacgtgttatcaacaccccctcaa

SEQ ID NO: 27305 - DNA, 35 bp, Artificial Sequence
  Synthetic oligonucleotide
aaccccgtccagacccggatccgccgaacgccgca

SEQ ID NO: 27306 - DNA, 36 bp, Artificial Sequence
  Synthetic oligonucleotide
tgttacccccatggctgtcactttatgggcccctca

SEQ ID NO: 27307 - DNA, 37 bp, Artificial Sequence
  Synthetic oligonucleotide
acatgccccatctgtaacgtttgcgagtcattgctga

SEQ ID NO: 27308 - DNA, 37 bp, Artificial Sequence
  Synthetic oligonucleotide
ggacaaagcgggagggtgggaggggttaggcgcgtga

SEQ ID NO: 27309 - DNA, 38 bp, Artificial Sequence
  Synthetic oligonucleotide
tgtgtgccctctacagtttttcgtcgtcttccctgtga

SEQ ID NO: 27310 - DNA, 38 bp, Artificial Sequence
  Synthetic oligonucleotide
ttgggacagggagggggaccggggtggacacatgttga

SEQ ID NO: 27311 - DNA, 35 bp, Artificial Sequence
  Synthetic oligonucleotide
gactctccatcggctatgacttacggtcctctagc

SEQ ID NO: 27312 - DNA, 35 bp, Artificial Sequence
  Synthetic oligonucleotide
ggatacccacggcctccttgtcttcatctgattag

SEQ ID NO: 27313 - DNA, 35 bp, Artificial Sequence
  Synthetic oligonucleotide
tccacccatcccgcttgctcgcggagacgcttagg

SEQ ID NO: 27314 - DNA, 35 bp, Artificial Sequence
  Synthetic oligonucleotide
tcgtgagcgagaaagggaaatggtggggaatgggg

SEQ ID NO: 27315 - DNA, 35 bp, Artificial Sequence
  Synthetic oligonucleotide
tgtatacacgcctcaccttataaaacagatactgg

SEQ ID NO: 27316 - DNA, 35 bp, Artificial Sequence
  Synthetic oligonucleotide
tctcggtccttctccttcgccatttatcgccatgt

SEQ ID NO: 27317 - DNA, 35 bp, Artificial Sequence
  Synthetic oligonucleotide
gtggcccaccctggttaccttccttggcattttgt

SEQ ID NO: 27318 - DNA, 36 bp, Artificial Sequence
  Synthetic oligonucleotide
tccatacaacccaactcatgcgcaaataggctgaca

SEQ ID NO: 27319 - DNA, 36 bp, Artificial Sequence
  Synthetic oligonucleotide
tagataccacaacttgaatattagtgcccttaccca

SEQ ID NO: 27320 - DNA, 36 bp, Artificial Sequence
  Synthetic oligonucleotide
ttccccctcctccgcttgtgtgatgtaggcctatca

SEQ ID NO: 27321 - DNA, 37 bp, Artificial Sequence
  Synthetic oligonucleotide
ttactacacgacctgagacggagaagggggggtggga

SEQ ID NO: 27322 - DNA, 38 bp, Artificial Sequence
  Synthetic oligonucleotide
tctggtcacgccatacttaccctgactgctatttctga

SEQ ID NO: 27323 - DNA, 38 bp, Artificial Sequence
  Synthetic oligonucleotide
tcctacgccggctggttacaaattcctcttcaaagtga

SEQ ID NO: 27324 - DNA, 38 bp, Artificial Sequence
  Synthetic oligonucleotide
tgcacccggactcgttgcgaaactccagaaacccttga

SEQ ID NO: 27325 - DNA, 34 bp, Artificial Sequence
  Synthetic oligonucleotide
tatcgcatacgcacgtactagctttgcctacaac

SEQ ID NO: 27326 - DNA, 35 bp, Artificial Sequence
  Synthetic oligonucleotide
gaactgcctcctgggacccaccaacacttcggtct

SEQ ID NO: 27327 - DNA, 35 bp, Artificial Sequence
  Synthetic oligonucleotide
tgcgatgcagtgccgtcgtgtcgatccatcttcgt

SEQ ID NO: 27328 - DNA, 35 bp, Artificial Sequence
  Synthetic oligonucleotide
gttcccgtccggaactgaagttctttgctccgttt

SEQ ID NO: 27329 - DNA, 36 bp, Artificial Sequence
  Synthetic oligonucleotide
gcgaccggcctcactctgttactaataccgcgcaca

SEQ ID NO: 27330 - DNA, 36 bp, Artificial Sequence
  Synthetic oligonucleotide
acgcggaacgcctacattgaactaacatcttcacca

SEQ ID NO: 27331 - DNA, 36 bp, Artificial Sequence
  Synthetic oligonucleotide
tgttacgcgccgctcaccttacccccccagatccca

SEQ ID NO: 27332 - DNA, 36 bp, Artificial Sequence
  Synthetic oligonucleotide
taccgccggaaggacggcaccacctctggactccca

SEQ ID NO: 27333 - DNA, 36 bp, Artificial Sequence
  Synthetic oligonucleotide
ggttaccccgcacatgtctgccccctaatccatgca

SEQ ID NO: 27334 - DNA, 37 bp, Artificial Sequence
  Synthetic oligonucleotide
atcgtaccactccgagctcacctggactttttaatga

SEQ ID NO: 27335 - DNA, 38 bp, Artificial Sequence
  Synthetic oligonucleotide
ttctaccccgccgccaatttcattgagcagcaacctga

SEQ ID NO: 27336 - DNA, 38 bp, Artificial Sequence
  Synthetic oligonucleotide
gtgacacacccaccgcgtacgaccccaaccactcctga

SEQ ID NO: 27337 - DNA, 36 bp, Artificial Sequence
  Synthetic oligonucleotide
tagccacaaccttggcctcctgtccttcttccggta

SEQ ID NO: 27338 - DNA, 36 bp, Artificial Sequence
  Synthetic oligonucleotide
accatcctcgccatcgaactaagctacctacaatta

SEQ ID NO: 27339 - DNA, 34 bp, Artificial Sequence
  Synthetic oligonucleotide
gagcgacatgcaccctgccggctctttttattac

SEQ ID NO: 27340 - DNA, 35 bp, Artificial Sequence
  Synthetic oligonucleotide
taaggtaggtggagcggggtgaagggttgtaggtc

SEQ ID NO: 27341 - DNA, 35 bp, Artificial Sequence
  Synthetic oligonucleotide
tcacaaccggttattgtctattcttcgtctttctg

SEQ ID NO: 27342 - DNA, 35 bp, Artificial Sequence
  Synthetic oligonucleotide
gcatccgccgccgctgtacccttcttgctgtcctt

SEQ ID NO: 27343 - DNA, 36 bp, Artificial Sequence
  Synthetic oligonucleotide
gccaccacaatcttaacaccaaccgcacgctagcaa

SEQ ID NO: 27344 - DNA, 36 bp, Artificial Sequence
  Synthetic oligonucleotide
ttcaacacgccccattcgccctgagttgcttttcaa

SEQ ID NO: 27345 - DNA, 35 bp, Artificial Sequence
  Synthetic oligonucleotide
gtacccccaccgtgaaactcatcgccccagtcaca

SEQ ID NO: 27346 - DNA, 36 bp, Artificial Sequence
  Synthetic oligonucleotide
gccgcccaaccttgcaatatacctggagttcatcca

SEQ ID NO: 27347 - DNA, 35 bp, Artificial Sequence
  Synthetic oligonucleotide
gccccacttgaagtcgcgctccaccgtttggcgac

SEQ ID NO: 27348 - DNA, 35 bp, Artificial Sequence
  Synthetic oligonucleotide
tcagaccgggttttttctacctcgcctctcgttac

SEQ ID NO: 27349 - DNA, 35 bp, Artificial Sequence
  Synthetic oligonucleotide
gaatgcaatcctgctcgctctccactttagtgccc

SEQ ID NO: 27350 - DNA, 35 bp, Artificial Sequence
  Synthetic oligonucleotide
tgcttgccgattcacacttgtaacgcctcgccctg

SEQ ID NO: 27351 - DNA, 35 bp, Artificial Sequence
  Synthetic oligonucleotide
tcctcatccccccacagcctatgtagacccctgct

SEQ ID NO: 27352 - DNA, 35 bp, Artificial Sequence
  Synthetic oligonucleotide
tcacacacttcttcggcctgccctgtgcagttgct

SEQ ID NO: 27353 - DNA, 36 bp, Artificial Sequence
  Synthetic oligonucleotide
taattcacagaaggggacataggatggggggtgtaa

SEQ ID NO: 27354 - DNA, 34 bp, Artificial Sequence
  Synthetic oligonucleotide
gccagcacccaggccattcctagcattttctgca

SEQ ID NO: 27355 - DNA, 35 bp, Artificial Sequence
  Synthetic oligonucleotide
ggggaccacggttgcagtttagccccacctttaga

SEQ ID NO: 27356 - DNA, 37 bp, Artificial Sequence
  Synthetic oligonucleotide
gacaaagggtgaaggagagtatgtagtagatggacga

SEQ ID NO: 27357 - DNA, 37 bp, Artificial Sequence
  Synthetic oligonucleotide
gcctctggccggcaatattcctcgcctcggatcctga

SEQ ID NO: 27358 - DNA, 37 bp, Artificial Sequence
  Synthetic oligonucleotide
gggcacacgcgctattgtccctgccgtttccccttga

SEQ ID NO: 27359 - DNA, 38 bp, Artificial Sequence
  Synthetic oligonucleotide
gaccactggcggagggaagggagtgcgcggggttttga

SEQ ID NO: 27360 - DNA, 35 bp, Artificial Sequence
  Synthetic oligonucleotide
ttagtatgccgcctgcaccagactcacattctcta

SEQ ID NO: 27361 - DNA, 35 bp, Artificial Sequence
  Synthetic oligonucleotide
ttgccaccctcagttcttcaccatttaggcttgta

SEQ ID NO: 27362 - DNA, 35 bp, Artificial Sequence
  Synthetic oligonucleotide
gcctaccgtagtagggactgtcgtaaccatcctcc

SEQ ID NO: 27363 - DNA, 35 bp, Artificial Sequence
  Synthetic oligonucleotide
atgctagcgatcgcaacccgctgcccctccacggc

SEQ ID NO: 27364 - DNA, 35 bp, Artificial Sequence
  Synthetic oligonucleotide
accactgtaaacttagtgcccccgcccgtgccatc

SEQ ID NO: 27365 - DNA, 35 bp, Artificial Sequence
  Synthetic oligonucleotide
acagacgctatccatcccacggcgcgccttggctc

SEQ ID NO: 27366 - DNA, 35 bp, Artificial Sequence
  Synthetic oligonucleotide
atccgtaggtgcgtgacttcctgttctttttggtc

SEQ ID NO: 27367 - DNA, 35 bp, Artificial Sequence
  Synthetic oligonucleotide
ttggtcctgtgactctggtcttcccgctctcgttc

SEQ ID NO: 27368 - DNA, 35 bp, Artificial Sequence
  Synthetic oligonucleotide
gacaccccctcgactaaggcagccctgcaccagcg

SEQ ID NO: 27369 - DNA, 36 bp, Artificial Sequence
  Synthetic oligonucleotide
gatcctctccgcagcacctatcactctcagttgcaa

SEQ ID NO: 27370 - DNA, 36 bp, Artificial Sequence
  Synthetic oligonucleotide
tgaacgtacgagcgtttgtacattcatttcccccga

SEQ ID NO: 27371 - DNA, 37 bp, Artificial Sequence
  Synthetic oligonucleotide
ggagaggaggtaggatggggtggggcattcatgtcga

SEQ ID NO: 27372 - DNA, 36 bp, Artificial Sequence
  Synthetic oligonucleotide
tgggtgccgggaaaggtagggggagagtagacagga

SEQ ID NO: 27373 - DNA, 36 bp, Artificial Sequence
  Synthetic oligonucleotide
acatgcgcacatccgttgaacctttctggcgctgga

SEQ ID NO: 27374 - DNA, 35 bp, Artificial Sequence
  Synthetic oligonucleotide
tagcgaaccagcgtaacttctcttttctcccctga

SEQ ID NO: 27375 - DNA, 38 bp, Artificial Sequence
  Synthetic oligonucleotide
gcgaggggggagggacgggtagagacatcactagctga

SEQ ID NO: 27376 - DNA, 37 bp, Artificial Sequence
  Synthetic oligonucleotide
tacggtgcagcacccgttttgccgttcctgttcgtga

SEQ ID NO: 27377 - DNA, 35 bp, Artificial Sequence
  Synthetic oligonucleotide
tgtacgcctgccctcctcctgggcgccctttttac

SEQ ID NO: 27378 - DNA, 35 bp, Artificial Sequence
  Synthetic oligonucleotide
tgacctagtacgcgttccgctactgcttcccttat

SEQ ID NO: 27379 - DNA, 35 bp, Artificial Sequence
  Synthetic oligonucleotide
gcccacgcatgacgttataccgcgtctcctgcgct

SEQ ID NO: 27380 - DNA, 35 bp, Artificial Sequence
  Synthetic oligonucleotide
gtcgtttgcccccttttcatctactcgtcccggtt

SEQ ID NO: 27381 - DNA, 36 bp, Artificial Sequence
  Synthetic oligonucleotide
aacgcccgcattgcctgagcataccagtctcatcca

SEQ ID NO: 27382 - DNA, 36 bp, Artificial Sequence
  Synthetic oligonucleotide
ggaccctcgctatctgattcatcgtgccatgcctca

SEQ ID NO: 27383 - DNA, 37 bp, Artificial Sequence
  Synthetic oligonucleotide
tttacgccacctcatcactcccaggccgcctgagcga

SEQ ID NO: 27384 - DNA, 38 bp, Artificial Sequence
  Synthetic oligonucleotide
tcacgtacgcagtattaaccctatctccctgtgcatga

SEQ ID NO: 27385 - DNA, 38 bp, Artificial Sequence
  Synthetic oligonucleotide
aacccctgcctctagttgtggcctgccccattcgctga

SEQ ID NO: 27386 - DNA, 38 bp, Artificial Sequence
  Synthetic oligonucleotide
ttgatctcgcccgctgctggttacctacatgcctgtga

SEQ ID NO: 27387 - DNA, 35 bp, Artificial Sequence
  Synthetic oligonucleotide
gcgccctcgcactcttccttcctttcgcataacta

SEQ ID NO: 27388 - DNA, 35 bp, Artificial Sequence
  Synthetic oligonucleotide
gggtcacatcactacgtttaggccgccgctcgctc

SEQ ID NO: 27389 - DNA, 36 bp, Artificial Sequence
  Synthetic oligonucleotide
atgccacccattggtttcagttacactctttcgcaa

SEQ ID NO: 27390 - DNA, 36 bp, Artificial Sequence
  Synthetic oligonucleotide
tgatgccgaccggagcaaggggagggataaacgtaa

SEQ ID NO: 27391 - DNA, 36 bp, Artificial Sequence
  Synthetic oligonucleotide
tcccgcccaggaccatctgacgtacgcacattggca

SEQ ID NO: 27392 - DNA, 37 bp, Artificial Sequence
  Synthetic oligonucleotide
aatgccgctaacacattttcatcggacctctctaaga

SEQ ID NO: 27393 - DNA, 37 bp, Artificial Sequence
  Synthetic oligonucleotide
gccgcactggtaggtgggatttagggggaattggaga

SEQ ID NO: 27394 - DNA, 37 bp, Artificial Sequence
  Synthetic oligonucleotide
tcgatacgtcactgcacactacccactcacccaacga

SEQ ID NO: 27395 - DNA, 37 bp, Artificial Sequence
  Synthetic oligonucleotide
acaggacaacgcggttggactcctcttctcaccccga

SEQ ID NO: 27396 - DNA, 36 bp, Artificial Sequence
  Synthetic oligonucleotide
acctcaccaccccattagtcaagaaccgccctccga

SEQ ID NO: 27397 - DNA, 37 bp, Artificial Sequence
  Synthetic oligonucleotide
tacctcgcccacatcgctcccaagacagtttagtgga

SEQ ID NO: 27398 - DNA, 38 bp, Artificial Sequence
  Synthetic oligonucleotide
acgccatcccccaaagccagcgccccacatgcccgtga

SEQ ID NO: 27399 - DNA, 36 bp, Artificial Sequence
  Synthetic oligonucleotide
acaaagggtgaaagggggggccggaaagggttaata

SEQ ID NO: 27400 - DNA, 36 bp, Artificial Sequence
  Synthetic oligonucleotide
tcctccgtacaccggtcattatcacgagctttgcta

SEQ ID NO: 27401 - DNA, 35 bp, Artificial Sequence
  Synthetic oligonucleotide
gttggaactgggagtgcgtagggaggaggacgagg

SEQ ID NO: 27402 - DNA, 36 bp, Artificial Sequence
  Synthetic oligonucleotide
gatgtcggagaagtaagtgggggaggaggatattgg

SEQ ID NO: 27403 - DNA, 35 bp, Artificial Sequence
  Synthetic oligonucleotide
aagccacctcgaagcaaaactgtacccatcgttct

SEQ ID NO: 27404 - DNA, 35 bp, Artificial Sequence
  Synthetic oligonucleotide
tgaaccaccctcagtgcgttcctcccccctatggt

SEQ ID NO: 27405 - DNA, 37 bp, Artificial Sequence
  Synthetic oligonucleotide
gccccaacccgcactcatccgtgctacgatttattga

SEQ ID NO: 27406 - DNA, 37 bp, Artificial Sequence
  Synthetic oligonucleotide
acggaacctgatcactgcctccatttccgtttgttga

SEQ ID NO: 27407 - DNA, 37 bp, Artificial Sequence
  Synthetic oligonucleotide
tccagcctggtcacgcttctgactttagtacatttga

SEQ ID NO: 27408 - DNA, 35 bp, Artificial Sequence
  Synthetic oligonucleotide
gccactgtctggcgcatgacggccccggatcaccc

SEQ ID NO: 27409 - DNA, 35 bp, Artificial Sequence
  Synthetic oligonucleotide
ggagcacgatcatcggtactatccgccgttatccc

SEQ ID NO: 27410 - DNA, 35 bp, Artificial Sequence
  Synthetic oligonucleotide
gacccttccaccgcccgatgcttggacaacgcatc

SEQ ID NO: 27411 - DNA, 35 bp, Artificial Sequence
  Synthetic oligonucleotide
taccgctgccaattctgtccacccaggctatgacg

SEQ ID NO: 27412 - DNA, 35 bp, Artificial Sequence
  Synthetic oligonucleotide
tgccacatccacggtctaattttgcagtacactgg

SEQ ID NO: 27413 - DNA, 35 bp, Artificial Sequence
  Synthetic oligonucleotide
tgaccatagcaggctatcccttcccccccgctact

SEQ ID NO: 27414 - DNA, 35 bp, Artificial Sequence
  Synthetic oligonucleotide
cttcatggccctcctcccagccgttcacaaggttt

SEQ ID NO: 27415 - DNA, 36 bp, Artificial Sequence
  Synthetic oligonucleotide
atgtcacacacacgcccatgaaatcgaggcccacaa

SEQ ID NO: 27416 - DNA, 34 bp, Artificial Sequence
  Synthetic oligonucleotide
gatgcctcctgtctactcatcctccttcttgcaa

SEQ ID NO: 27417 - DNA, 36 bp, Artificial Sequence
  Synthetic oligonucleotide
tgtgtaacgcttctactgcgctcgactaacactcca

SEQ ID NO: 27418 - DNA, 36 bp, Artificial Sequence
  Synthetic oligonucleotide
taatctgcccagctcgtccactagtcttcgtccgca

SEQ ID NO: 27419 - DNA, 35 bp, Artificial Sequence
  Synthetic oligonucleotide
ttctcaccggttgatgccggttttaacacccctca

SEQ ID NO: 27420 - DNA, 37 bp, Artificial Sequence
  Synthetic oligonucleotide
tacttgcccagcaagcgtaccacccttccatctcaga

SEQ ID NO: 27421 - DNA, 37 bp, Artificial Sequence
  Synthetic oligonucleotide
accaccgtcgtcctctctgggttatttcttccgccga

SEQ ID NO: 27422 - DNA, 38 bp, Artificial Sequence
  Synthetic oligonucleotide
gaacatgagtggacggtgggggtagcagaagcaagtga

SEQ ID NO: 27423 - DNA, 36 bp, Artificial Sequence
  Synthetic oligonucleotide
tagtgactgaacgcacaatctgtctatcctgtctta

SEQ ID NO: 27424 - DNA, 35 bp, Artificial Sequence
  Synthetic oligonucleotide
atgcccgcacagttccacaccggctgcctcgttcc

SEQ ID NO: 27425 - DNA, 35 bp, Artificial Sequence
  Synthetic oligonucleotide
gttcagccctcatttctcgctttggttctcgcgtc

SEQ ID NO: 27426 - DNA, 35 bp, Artificial Sequence
  Synthetic oligonucleotide
gccgaggtaggtggcggggggattggaaggtggag

SEQ ID NO: 27427 - DNA, 36 bp, Artificial Sequence
  Synthetic oligonucleotide
tgacagataaagaagggcaaagggggagtgtggaaa

SEQ ID NO: 27428 - DNA, 37 bp, Artificial Sequence
  Synthetic oligonucleotide
atggacagacaacgtatgaggatagtaagggggaaga

SEQ ID NO: 27429 - DNA, 37 bp, Artificial Sequence
  Synthetic oligonucleotide
gaacacccctgacttgcatgttcatacatttattgga

SEQ ID NO: 27430 - DNA, 38 bp, Artificial Sequence
  Synthetic oligonucleotide
gtcacgcgcatccgcctcgacgtccccacaaccactga

SEQ ID NO: 27431 - DNA, 37 bp, Artificial Sequence
  Synthetic oligonucleotide
tttgcctgcccttacctgtatcttaaccacggcctga

SEQ ID NO: 27432 - DNA, 35 bp, Artificial Sequence
  Synthetic oligonucleotide
tccgatcgcctgtgcaattacccaaatgcccccta

SEQ ID NO: 27433 - DNA, 35 bp, Artificial Sequence
  Synthetic oligonucleotide
gattcaatctcacgcgcccctttgctatgcactta

SEQ ID NO: 27434 - DNA, 35 bp, Artificial Sequence
  Synthetic oligonucleotide
ttagccacacgctatgtgcactttcacccacttcc

SEQ ID NO: 27435 - DNA, 35 bp, Artificial Sequence
  Synthetic oligonucleotide
ggaaccacaagtgacgccgttctatcgccattcat

SEQ ID NO: 27436 - DNA, 35 bp, Artificial Sequence
  Synthetic oligonucleotide
gtcccctcggccacggacgtcttgatctacctcgt

SEQ ID NO: 27437 - DNA, 35 bp, Artificial Sequence
  Synthetic oligonucleotide
tgaacctccgttcacctcactgcccctgcaaacaa

SEQ ID NO: 27438 - DNA, 36 bp, Artificial Sequence
  Synthetic oligonucleotide
accatcacaactgcccaaagcttgacgggttcacca

SEQ ID NO: 27439 - DNA, 36 bp, Artificial Sequence
  Synthetic oligonucleotide
tcctggcacagggcccaacactcactggtcattcca

SEQ ID NO: 27440 - DNA, 37 bp, Artificial Sequence
  Synthetic oligonucleotide
tgtagcgggagagagctgcacagggaggggggataga

SEQ ID NO: 27441 - DNA, 37 bp, Artificial Sequence
  Synthetic oligonucleotide
gtcgccacctatgctaccctagtcgaagtcatttaga

SEQ ID NO: 27442 - DNA, 37 bp, Artificial Sequence
  Synthetic oligonucleotide
gccccacccatactggttctgtagctttctctgacga

SEQ ID NO: 27443 - DNA, 37 bp, Artificial Sequence
  Synthetic oligonucleotide
acagagtgggagccgtagaaaggtagttagggcgcga

SEQ ID NO: 27444 - DNA, 38 bp, Artificial Sequence
  Synthetic oligonucleotide
tcccccttcgccgcaccgcccgactggcttgaccctga

SEQ ID NO: 27445 - DNA, 38 bp, Artificial Sequence
  Synthetic oligonucleotide
atgccacgtgccgggtcgtttttttgcccgtttcttga

SEQ ID NO: 27446 - DNA, 35 bp, Artificial Sequence
  Synthetic oligonucleotide
gactcgcagcccaaccacatatatcgtatcaatcc

SEQ ID NO: 27447 - DNA, 35 bp, Artificial Sequence
  Synthetic oligonucleotide
gcgtggctcgcctgccgcgtgtcgtccccttcttc

SEQ ID NO: 27448 - DNA, 35 bp, Artificial Sequence
  Synthetic oligonucleotide
tgacggtccccagccatatcaatcctacactcgag

SEQ ID NO: 27449 - DNA, 36 bp, Artificial Sequence
  Synthetic oligonucleotide
tagtccacatgccttcacccgcgtaacatgccgcca

SEQ ID NO: 27450 - DNA, 36 bp, Artificial Sequence
  Synthetic oligonucleotide
acactctgaacaccatccaccttgaagagactgaga

SEQ ID NO: 27451 - DNA, 37 bp, Artificial Sequence
  Synthetic oligonucleotide
atggggaagtcgcagttggtgggctaaagtatgggga

SEQ ID NO: 27452 - DNA, 38 bp, Artificial Sequence
  Synthetic oligonucleotide
gatggagggggggagcatatatacagtggagggtgtga

SEQ ID NO: 27453 - DNA, 37 bp, Artificial Sequence
  Synthetic oligonucleotide
atgatcgtcaccggacgcatatggccttccctcttga

SEQ ID NO: 27454 - DNA, 35 bp, Artificial Sequence
  Synthetic oligonucleotide
gacggtgtgacaagtggagggtggaaagtaaaata

SEQ ID NO: 27455 - DNA, 35 bp, Artificial Sequence
  Synthetic oligonucleotide
atcaccttgcctatgcaatccttgagggtgctacc

SEQ ID NO: 27456 - DNA, 35 bp, Artificial Sequence
  Synthetic oligonucleotide
gtttaccatctcccctgaagtcagagttacttccc

SEQ ID NO: 27457 - DNA, 35 bp, Artificial Sequence
  Synthetic oligonucleotide
gcaacctggccaactaatccttcccgacactgacg

SEQ ID NO: 27458 - DNA, 35 bp, Artificial Sequence
  Synthetic oligonucleotide
tcatgcgaccggctacccttactactgcccttccg

SEQ ID NO: 27459 - DNA, 35 bp, Artificial Sequence
  Synthetic oligonucleotide
acccctccactattgcacctttattgccctttgcg

SEQ ID NO: 27460 - DNA, 35 bp, Artificial Sequence
  Synthetic oligonucleotide
actccgtcccgattgggtgtctccctcgccttgct

SEQ ID NO: 27461 - DNA, 35 bp, Artificial Sequence
  Synthetic oligonucleotide
tacactgcagcccattatatttgcgtgtcctcgtt

SEQ ID NO: 27462 - DNA, 37 bp, Artificial Sequence
  Synthetic oligonucleotide
gaggagatacgaaggaagggtggtgcatctggacaga

SEQ ID NO: 27463 - DNA, 37 bp, Artificial Sequence
  Synthetic oligonucleotide
gagtggacgcggaaaaggagaggatgggaaaagtgga

SEQ ID NO: 27464 - DNA, 38 bp, Artificial Sequence
  Synthetic oligonucleotide
gttcccccttgccgtgcctgcctcttacttaggactga

SEQ ID NO: 27465 - DNA, 38 bp, Artificial Sequence
  Synthetic oligonucleotide
gtttgccgagcatctgcgccccgctcccgccactttga

SEQ ID NO: 27466 - DNA, 35 bp, Artificial Sequence
  Synthetic oligonucleotide
gtgtatcagctccccaccatcgaattccggatcac

SEQ ID NO: 27467 - DNA, 35 bp, Artificial Sequence
  Synthetic oligonucleotide
acttgcctccgactattataactcactcacttacc

SEQ ID NO: 27468 - DNA, 35 bp, Artificial Sequence
  Synthetic oligonucleotide
tcctgtgtcgcccggctcatatctcggaatccctc

SEQ ID NO: 27469 - DNA, 35 bp, Artificial Sequence
  Synthetic oligonucleotide
gcccatcaatcttcatcactgtcatgacttccagg

SEQ ID NO: 27470 - DNA, 35 bp, Artificial Sequence
  Synthetic oligonucleotide
tccaccccccaacgatcaaccttttacggttacat

SEQ ID NO: 27471 - DNA, 35 bp, Artificial Sequence
  Synthetic oligonucleotide
gaggcccaaacacgtggccgatccacacaccctgt

SEQ ID NO: 27472 - DNA, 36 bp, Artificial Sequence
  Synthetic oligonucleotide
agagtgtgagatagcaagaaggcgggggttggtgaa

SEQ ID NO: 27473 - DNA, 36 bp, Artificial Sequence
  Synthetic oligonucleotide
accaaccaagtccggcgccattcaactgccatctca

SEQ ID NO: 27474 - DNA, 37 bp, Artificial Sequence
  Synthetic oligonucleotide
gtggcggcccctgcttcaatttatgtcacctcccaga

SEQ ID NO: 27475 - DNA, 37 bp, Artificial Sequence
  Synthetic oligonucleotide
tggagctgccatcgcttatccctcggcttcaacctga

SEQ ID NO: 27476 - DNA, 37 bp, Artificial Sequence
  Synthetic oligonucleotide
gcgaacgacgtccttcaccttcactatttcacgttga

SEQ ID NO: 27477 - DNA, 37 bp, Artificial Sequence
  Synthetic oligonucleotide
gcctcgcgcaatttacccgatccacttcccatgttga

SEQ ID NO: 27478 - DNA, 35 bp, Artificial Sequence
  Synthetic oligonucleotide
attcactacaccttatgcgcctggttcatacctac

SEQ ID NO: 27479 - DNA, 35 bp, Artificial Sequence
  Synthetic oligonucleotide
atgagaacatcaccatgcccggagccaacaccgcc

SEQ ID NO: 27480 - DNA, 35 bp, Artificial Sequence
  Synthetic oligonucleotide
gtatctgcacccagcgcgtcccccctcaccagggc

SEQ ID NO: 27481 - DNA, 35 bp, Artificial Sequence
  Synthetic oligonucleotide
gaattgccattcccgtatgccctttactatccatg

SEQ ID NO: 27482 - DNA, 35 bp, Artificial Sequence
  Synthetic oligonucleotide
gtacacatccaccccgtccttaattatgaacgatg

SEQ ID NO: 27483 - DNA, 35 bp, Artificial Sequence
  Synthetic oligonucleotide
ttgcatccgtacttcctaaagtcttctgtcctctg

SEQ ID NO: 27484 - DNA, 35 bp, Artificial Sequence
  Synthetic oligonucleotide
aaccccgtcagtcccccccgtccaccttggtaaat

SEQ ID NO: 27485 - DNA, 35 bp, Artificial Sequence
  Synthetic oligonucleotide
gcccagcttagagcttccaactgttccgccgcaat

SEQ ID NO: 27486 - DNA, 35 bp, Artificial Sequence
  Synthetic oligonucleotide
gaccgaacgatcctctaggccttcacgcattttat

SEQ ID NO: 27487 - DNA, 35 bp, Artificial Sequence
  Synthetic oligonucleotide
attctcgtaccgccgctgactttcaggccgattct

SEQ ID NO: 27488 - DNA, 35 bp, Artificial Sequence
  Synthetic oligonucleotide
tcacgcaatttggtggcacagaaggagggcgtggt

SEQ ID NO: 27489 - DNA, 34 bp, Artificial Sequence
  Synthetic oligonucleotide
acttcacccggagaattcatgaatctgacttttt

SEQ ID NO: 27490 - DNA, 35 bp, Artificial Sequence
  Synthetic oligonucleotide
gccccctgccgcattatagattaggccactccgaa

SEQ ID NO: 27491 - DNA, 35 bp, Artificial Sequence
  Synthetic oligonucleotide
agacacccgccccttgctcgccttctgataataca

SEQ ID NO: 27492 - DNA, 37 bp, Artificial Sequence
  Synthetic oligonucleotide
acacgccccattaactcagctcgtcagtgttccccga

SEQ ID NO: 27493 - DNA, 36 bp, Artificial Sequence
  Synthetic oligonucleotide
acgcgctactgcgggaaggggctgaagggagggcga

SEQ ID NO: 27494 - DNA, 37 bp, Artificial Sequence
  Synthetic oligonucleotide
aaagggtggatggaggaggtatacgcagatgggggga

SEQ ID NO: 27495 - DNA, 35 bp, Artificial Sequence
  Synthetic oligonucleotide
gatcaagccccaccgaccgtatacccgtgaaatga

SEQ ID NO: 27496 - DNA, 38 bp, Artificial Sequence
  Synthetic oligonucleotide
tgctgtgcaccccttaggcctcgttattcacctgctga

SEQ ID NO: 27497 - DNA, 38 bp, Artificial Sequence
  Synthetic oligonucleotide
taggaaccgatcgcacctgtttttgttcatttacttga

SEQ ID NO: 27498 - DNA, 37 bp, Artificial Sequence
  Synthetic oligonucleotide
tcatcccccgccggcctactcctttccgagactttga

SEQ ID NO: 27499 - DNA, 38 bp, Artificial Sequence
  Synthetic oligonucleotide
gccgagcacggtcctggggcttggtgggtagtttttga

SEQ ID NO: 27500 - DNA, 35 bp, Artificial Sequence
  Synthetic oligonucleotide
gtgtagaggggcgtggggatagaccacgggaagta

SEQ ID NO: 27501 - DNA, 35 bp, Artificial Sequence
  Synthetic oligonucleotide
tccccaggctagaacgtactacgcgaacttgaaac

SEQ ID NO: 27502 - DNA, 35 bp, Artificial Sequence
  Synthetic oligonucleotide
tacccttgtgttgtgttctgtcgattgcattctcc

SEQ ID NO: 27503 - DNA, 35 bp, Artificial Sequence
  Synthetic oligonucleotide
tcacacgagtcgtgcggttcatcctacacccttgc

SEQ ID NO: 27504 - DNA, 35 bp, Artificial Sequence
  Synthetic oligonucleotide
taccgaccgggactgacaccctgaagaaccaactc

SEQ ID NO: 27505 - DNA, 35 bp, Artificial Sequence
  Synthetic oligonucleotide
tccactcctgctaatcacgcattgttcttgcagtc

SEQ ID NO: 27506 - DNA, 35 bp, Artificial Sequence
  Synthetic oligonucleotide
atagaagaggggaggtgcaggggggacactaggtg

SEQ ID NO: 27507 - DNA, 35 bp, Artificial Sequence
  Synthetic oligonucleotide
tcatccctcattgcgcctctgctaatttccacgat

SEQ ID NO: 27508 - DNA, 36 bp, Artificial Sequence
  Synthetic oligonucleotide
tcaacgctacacccggccaacgtttgcactcacgaa

SEQ ID NO: 27509 - DNA, 35 bp, Artificial Sequence
  Synthetic oligonucleotide
tctcaggcctctcggggtcacgtaacattggccca

SEQ ID NO: 27510 - DNA, 36 bp, Artificial Sequence
  Synthetic oligonucleotide
attccagcagtacgatccttccggtgcgtgccatca

SEQ ID NO: 27511 - DNA, 37 bp, Artificial Sequence
  Synthetic oligonucleotide
gagggcggaacaaggaggaatggggtaagttcgaaga

SEQ ID NO: 27512 - DNA, 37 bp, Artificial Sequence
  Synthetic oligonucleotide
tcctgcctgcttgatatctattgtctctggcttccga

SEQ ID NO: 27513 - DNA, 37 bp, Artificial Sequence
  Synthetic oligonucleotide
gatgtgcgcccgttgctctggagcctgcattatggga

SEQ ID NO: 27514 - DNA, 37 bp, Artificial Sequence
  Synthetic oligonucleotide
agcccctcgccccacgggttgatcttgacccctatga

SEQ ID NO: 27515 - DNA, 35 bp, Artificial Sequence
  Synthetic oligonucleotide
gagaacgcccgctgacagtgccccatctgcccata

SEQ ID NO: 27516 - DNA, 35 bp, Artificial Sequence
  Synthetic oligonucleotide
ttgacgtcatcaaacagcatgtagtccatcctcac

SEQ ID NO: 27517 - DNA, 35 bp, Artificial Sequence
  Synthetic oligonucleotide
ttcgggccgccgtagcactcgccatctcttcagcc

SEQ ID NO: 27518 - DNA, 35 bp, Artificial Sequence
  Synthetic oligonucleotide
gacgacccattgtcgccgatccacgcattagtgcc

SEQ ID NO: 27519 - DNA, 35 bp, Artificial Sequence
  Synthetic oligonucleotide
taggatgcttactcctctctctccactgagccttg

SEQ ID NO: 27520 - DNA, 36 bp, Artificial Sequence
  Synthetic oligonucleotide
gacacccgaggcccggatccataacgttttgttcaa

SEQ ID NO: 27521 - DNA, 35 bp, Artificial Sequence
  Synthetic oligonucleotide
tgtgagcggaaatcagcctgcaccacccctcgaga

SEQ ID NO: 27522 - DNA, 35 bp, Artificial Sequence
  Synthetic oligonucleotide
tcaccgcccccatatgtttcgatacttttcacgga

SEQ ID NO: 27523 - DNA, 37 bp, Artificial Sequence
  Synthetic oligonucleotide
tcaccccctcttttaactagaccacagtccggaggga

SEQ ID NO: 27524 - DNA, 37 bp, Artificial Sequence
  Synthetic oligonucleotide
gaggtggaagtttgagggagtttgcgaggtggaggga

SEQ ID NO: 27525 - DNA, 37 bp, Artificial Sequence
  Synthetic oligonucleotide
gttagcccgcctgaacaactaccatcgtgaccctgga

SEQ ID NO: 27526 - DNA, 37 bp, Artificial Sequence
  Synthetic oligonucleotide
gccactacaacactcattggaaccgtcctacgttgga

SEQ ID NO: 27527 - DNA, 38 bp, Artificial Sequence
  Synthetic oligonucleotide
tccatctcccgactcacatcatagcagagcggttttga

SEQ ID NO: 27528 - DNA, 35 bp, Artificial Sequence
  Synthetic oligonucleotide
atgctctgcccccgctggtatgtgccaacctgatc

SEQ ID NO: 27529 - DNA, 35 bp, Artificial Sequence
  Synthetic oligonucleotide
gtgcccgtctagcacgcatcgtaccagtccctccg

SEQ ID NO: 27530 - DNA, 35 bp, Artificial Sequence
  Synthetic oligonucleotide
tcccactcgggtgaggaaggccacatcatctctat

SEQ ID NO: 27531 - DNA, 35 bp, Artificial Sequence
  Synthetic oligonucleotide
tcagcaccagccgctccccgcaccctgcggaccct

SEQ ID NO: 27532 - DNA, 36 bp, Artificial Sequence
  Synthetic oligonucleotide
gccactccaccccagacaaactttaagcgttgcaaa

SEQ ID NO: 27533 - DNA, 35 bp, Artificial Sequence
  Synthetic oligonucleotide
tatcacccctctattgaacggacgacgtaattcca

SEQ ID NO: 27534 - DNA, 36 bp, Artificial Sequence
  Synthetic oligonucleotide
agacacatgttacttagcagccttccaccatctcga

SEQ ID NO: 27535 - DNA, 36 bp, Artificial Sequence
  Synthetic oligonucleotide
atcgcctagccacttcaccgcggtactgactttcga

SEQ ID NO: 27536 - DNA, 37 bp, Artificial Sequence
  Synthetic oligonucleotide
tcctcctgccctgacgtcttgttctcgctatttcgga

SEQ ID NO: 27537 - DNA, 37 bp, Artificial Sequence
  Synthetic oligonucleotide
tgacatgtaagaggaagctgtgagcaaatgggaggga

SEQ ID NO: 27538 - DNA, 38 bp, Artificial Sequence
  Synthetic oligonucleotide
tgacgggtcctgtcatttcagctgtctctctcttctga

SEQ ID NO: 27539 - DNA, 38 bp, Artificial Sequence
  Synthetic oligonucleotide
acaacaggggacaagcggtggtaggcttacgggagtga

SEQ ID NO: 27540 - DNA, 36 bp, Artificial Sequence
  Synthetic oligonucleotide
gagcatcctcagcgctatccgagtcacccaccccta

SEQ ID NO: 27541 - DNA, 35 bp, Artificial Sequence
  Synthetic oligonucleotide
taccgccctgttacgaccgcgtacgtctcctttta

SEQ ID NO: 27542 - DNA, 35 bp, Artificial Sequence
  Synthetic oligonucleotide
ttaagtaccagccacacccatgccaatacacttac

SEQ ID NO: 27543 - DNA, 35 bp, Artificial Sequence
  Synthetic oligonucleotide
tgcatctccgatagttctgctgcctaaacgctccc

SEQ ID NO: 27544 - DNA, 35 bp, Artificial Sequence
  Synthetic oligonucleotide
gtgccacgacgtcctgctccctgcgccagagggcc

SEQ ID NO: 27545 - DNA, 35 bp, Artificial Sequence
  Synthetic oligonucleotide
attgttctgcacccaagtttggtgttgtcccttcc

SEQ ID NO: 27546 - DNA, 35 bp, Artificial Sequence
  Synthetic oligonucleotide
ttgatctcagcccaacacgtaccccgagtcctgtc

SEQ ID NO: 27547 - DNA, 35 bp, Artificial Sequence
  Synthetic oligonucleotide
ttccccatcccagaacattgttgtctgtctgcacg

SEQ ID NO: 27548 - DNA, 35 bp, Artificial Sequence
  Synthetic oligonucleotide
agacacctaccacaccagccctgtcggtcctatcg

SEQ ID NO: 27549 - DNA, 35 bp, Artificial Sequence
  Synthetic oligonucleotide
aaactcactgtcacatcgcccctcccacattcttg

SEQ ID NO: 27550 - DNA, 36 bp, Artificial Sequence
  Synthetic oligonucleotide
gaacccacaaggagatcactgagccattactgcaaa

SEQ ID NO: 27551 - DNA, 35 bp, Artificial Sequence
  Synthetic oligonucleotide
acaccaacgactgtcacccgtcttatagggcataa

SEQ ID NO: 27552 - DNA, 36 bp, Artificial Sequence
  Synthetic oligonucleotide
gccatgccacatcacatctgtttgttttgttgaaca

SEQ ID NO: 27553 - DNA, 35 bp, Artificial Sequence
  Synthetic oligonucleotide
tcacgccctctcagttactagcgctgggcctcaca

SEQ ID NO: 27554 - DNA, 35 bp, Artificial Sequence
  Synthetic oligonucleotide
gttccacccgggttgaaacctgtctcattaggaca

SEQ ID NO: 27555 - DNA, 36 bp, Artificial Sequence
  Synthetic oligonucleotide
atccgcctcattcatgtttgtttcttcacgccccca

SEQ ID NO: 27556 - DNA, 36 bp, Artificial Sequence
  Synthetic oligonucleotide
aattcccgcctgccatcattacaggtcgttacctca

SEQ ID NO: 27557 - DNA, 35 bp, Artificial Sequence
  Synthetic oligonucleotide
ggtcacctccctatctaccctgcacattgctgcga

SEQ ID NO: 27558 - DNA, 37 bp, Artificial Sequence
  Synthetic oligonucleotide
tgttaatgcgcacccaccggtccttacctgtcttcga

SEQ ID NO: 27559 - DNA, 35 bp, Artificial Sequence
  Synthetic oligonucleotide
gataacgccgtatcgcacttaactcacctacagga

SEQ ID NO: 27560 - DNA, 38 bp, Artificial Sequence
  Synthetic oligonucleotide
accaccaggctgacttgccgacatcattccgaccttga

SEQ ID NO: 27561 - DNA, 37 bp, Artificial Sequence
  Synthetic oligonucleotide
gacctgcatgtcgccccacctggagcacccctcacta

SEQ ID NO: 27562 - DNA, 36 bp, Artificial Sequence
  Synthetic oligonucleotide
agtaccccccaccctggcgcttcgcgttgcatatta

SEQ ID NO: 27563 - DNA, 35 bp, Artificial Sequence
  Synthetic oligonucleotide
tccagacacgaacggtgatctccttgctgtcccac

SEQ ID NO: 27564 - DNA, 35 bp, Artificial Sequence
  Synthetic oligonucleotide
gtcccgcatggacgagattgtctgcttcccttatc

SEQ ID NO: 27565 - DNA, 35 bp, Artificial Sequence
  Synthetic oligonucleotide
gtcacgaccgtgacttatttttgcccttgttaccg

SEQ ID NO: 27566 - DNA, 35 bp, Artificial Sequence
  Synthetic oligonucleotide
actccccggagctgctaccccatccttatttgagg

SEQ ID NO: 27567 - DNA, 35 bp, Artificial Sequence
  Synthetic oligonucleotide
gagagggagtgggaatgtgcaatgtaacgggctgt

SEQ ID NO: 27568 - DNA, 35 bp, Artificial Sequence
  Synthetic oligonucleotide
gcacctgtagtcttccgcagctgcccacgttaaca

SEQ ID NO: 27569 - DNA, 36 bp, Artificial Sequence
  Synthetic oligonucleotide
gcagactccgtaggctattccgcgcccccaatcaca

SEQ ID NO: 27570 - DNA, 36 bp, Artificial Sequence
  Synthetic oligonucleotide
tgtaagggaggggtagcacaagaatgggggttgaca

SEQ ID NO: 27571 - DNA, 36 bp, Artificial Sequence
  Synthetic oligonucleotide
catccccatgcccgactccgctgaatcacagtgcca

SEQ ID NO: 27572 - DNA, 37 bp, Artificial Sequence
  Synthetic oligonucleotide
accgaccgttcctcatcgcttgttcccgttttctaga

SEQ ID NO: 27573 - DNA, 37 bp, Artificial Sequence
  Synthetic oligonucleotide
gacccagcccttacggttcttacaccgtgcttcgcga

SEQ ID NO: 27574 - DNA, 37 bp, Artificial Sequence
  Synthetic oligonucleotide
aatgcgtatgaggagggccagggtgatgcaaaaggga

SEQ ID NO: 27575 - DNA, 38 bp, Artificial Sequence
  Synthetic oligonucleotide
atgccacaccaaaaactcaggaacactcagctacctga

SEQ ID NO: 27576 - DNA, 38 bp, Artificial Sequence
  Synthetic oligonucleotide
ggtggagaagatgaaagatagggccggcgagaagttga

SEQ ID NO: 27577 - DNA, 37 bp, Artificial Sequence
  Synthetic oligonucleotide
gccgaccctgcctcatgtcattcggttgatcttttga

SEQ ID NO: 27578 - DNA, 36 bp, Artificial Sequence
  Synthetic oligonucleotide
gaggaaggtttagggtgggaggtcctggcaggatta

SEQ ID NO: 27579 - DNA, 35 bp, Artificial Sequence
  Synthetic oligonucleotide
tgcctcgctcgacttgactaccctattgaccgtta

SEQ ID NO: 27580 - DNA, 35 bp, Artificial Sequence
  Synthetic oligonucleotide
acccgcggtgcgcacaccctcgacgtatctcccac

SEQ ID NO: 27581 - DNA, 35 bp, Artificial Sequence
  Synthetic oligonucleotide
ttgcagagccgcaccacactacctgctaatagccc

SEQ ID NO: 27582 - DNA, 36 bp, Artificial Sequence
  Synthetic oligonucleotide
tccacgggcgtgctagctctaccaaatccgttgccc

SEQ ID NO: 27583 - DNA, 35 bp, Artificial Sequence
  Synthetic oligonucleotide
tccaactgaatacatcgcgttcctgttcacttgtc

SEQ ID NO: 27584 - DNA, 35 bp, Artificial Sequence
  Synthetic oligonucleotide
tccacttgcgtagcagcccgctttccttcgtcccg

SEQ ID NO: 27585 - DNA, 35 bp, Artificial Sequence
  Synthetic oligonucleotide
agacatcgcgttcccaggctttcgacccacctctg

SEQ ID NO: 27586 - DNA, 35 bp, Artificial Sequence
  Synthetic oligonucleotide
gccatccaacgggatacggccccccacttggccat

SEQ ID NO: 27587 - DNA, 35 bp, Artificial Sequence
  Synthetic oligonucleotide
ttcacctcaaattgcactgatcgtgctaacctcat

SEQ ID NO: 27588 - DNA, 35 bp, Artificial Sequence
  Synthetic oligonucleotide
gcatccgccctagttttatgctatccgtgtaccct

SEQ ID NO: 27589 - DNA, 35 bp, Artificial Sequence
  Synthetic oligonucleotide
gcactctacctatcggtctacagacctttacttgt

SEQ ID NO: 27590 - DNA, 35 bp, Artificial Sequence
  Synthetic oligonucleotide
aacccccgcccctctctccgcaaaatcggcattca

SEQ ID NO: 27591 - DNA, 38 bp, Artificial Sequence
  Synthetic oligonucleotide
gactcacagcgcaccaccttttgccactttgcacatga

SEQ ID NO: 27592 - DNA, 38 bp, Artificial Sequence
  Synthetic oligonucleotide
acgccactatcgcctgaccgcccgtatcatttcgttga

SEQ ID NO: 27593 - DNA, 36 bp, Artificial Sequence
  Synthetic oligonucleotide
tagccgccggccggacttagcctattgccactttta

SEQ ID NO: 27594 - DNA, 35 bp, Artificial Sequence
  Synthetic oligonucleotide
ttgtccccatggcaactcctgctaccagccctgac

SEQ ID NO: 27595 - DNA, 35 bp, Artificial Sequence
  Synthetic oligonucleotide
tcattccctgactcgtcaccagttctgtctcgtac

SEQ ID NO: 27596 - DNA, 35 bp, Artificial Sequence
  Synthetic oligonucleotide
tgcaccatcaaagttttcttacgaccacgtccacc

SEQ ID NO: 27597 - DNA, 35 bp, Artificial Sequence
  Synthetic oligonucleotide
ttaccccctttggaccccgcctagcctgctagcgc

SEQ ID NO: 27598 - DNA, 35 bp, Artificial Sequence
  Synthetic oligonucleotide
gcaagtaggagggagaggggcgaagtgcgcggagg

SEQ ID NO: 27599 - DNA, 36 bp, Artificial Sequence
  Synthetic oligonucleotide
gcccgccttgcaacatccaggcaccctcatcttgca

SEQ ID NO: 27600 - DNA, 35 bp, Artificial Sequence
  Synthetic oligonucleotide
tccccccgtaggggttcgctatccctactgtttca

SEQ ID NO: 27601 - DNA, 38 bp, Artificial Sequence
  Synthetic oligonucleotide
gtaacatccgggtatcccgtgctctcttcttcccatga

SEQ ID NO: 27602 - DNA, 38 bp, Artificial Sequence
  Synthetic oligonucleotide
accgtcgctcccacttgatcttagcacctcttccttga

SEQ ID NO: 27603 - DNA, 35 bp, Artificial Sequence
  Synthetic oligonucleotide
tactcactagcccaccacatgatggccggtacacc

SEQ ID NO: 27604 - DNA, 35 bp, Artificial Sequence
  Synthetic oligonucleotide
tcccggcccatcgtttaatgaaaaccatcacttcc

SEQ ID NO: 27605 - DNA, 35 bp, Artificial Sequence
  Synthetic oligonucleotide
ggaacatcagcacttgacgtgatactccccccctc

SEQ ID NO: 27606 - DNA, 35 bp, Artificial Sequence
  Synthetic oligonucleotide
atccgggccccggtgtttttggctctcacaccttc

SEQ ID NO: 27607 - DNA, 35 bp, Artificial Sequence
  Synthetic oligonucleotide
tcccagcatccctccataccacacatggcctcttc

SEQ ID NO: 27608 - DNA, 35 bp, Artificial Sequence
  Synthetic oligonucleotide
gatgcgcactcttccgttttcaagttcaccgtggg

SEQ ID NO: 27609 - DNA, 35 bp, Artificial Sequence
  Synthetic oligonucleotide
gcacatgtccggactctacatatctagcctgatgg

SEQ ID NO: 27610 - DNA, 35 bp, Artificial Sequence
  Synthetic oligonucleotide
gtctgccacattctaccaggccagataattccttg

SEQ ID NO: 27611 - DNA, 35 bp, Artificial Sequence
  Synthetic oligonucleotide
tgtgccgccaggtatcctgttttactcgtttccat

SEQ ID NO: 27612 - DNA, 35 bp, Artificial Sequence
  Synthetic oligonucleotide
tcatgagacctcagatgtccactctttcccgctat

SEQ ID NO: 27613 - DNA, 35 bp, Artificial Sequence
  Synthetic oligonucleotide
tcatcatcctgtaaatggccacacattcattctat

SEQ ID NO: 27614 - DNA, 35 bp, Artificial Sequence
  Synthetic oligonucleotide
gctctccgccctttgacgctgacatgctttggttt

SEQ ID NO: 27615 - DNA, 36 bp, Artificial Sequence
  Synthetic oligonucleotide
atgacaccggcacgcaatgaccgccccctctgcaca

SEQ ID NO: 27616 - DNA, 36 bp, Artificial Sequence
  Synthetic oligonucleotide
tcagtacgatcatcttcccgttggaaccagccccca

SEQ ID NO: 27617 - DNA, 37 bp, Artificial Sequence
  Synthetic oligonucleotide
gtccatccaccaatgctgatctcacactagatataga

SEQ ID NO: 27618 - DNA, 37 bp, Artificial Sequence
  Synthetic oligonucleotide
ttgacccgaagacgtagcgggcaccacctccgctgga

SEQ ID NO: 27619 - DNA, 35 bp, Artificial Sequence
  Synthetic oligonucleotide
gtgacgcggacattatctcacactctctttttgga

SEQ ID NO: 27620 - DNA, 38 bp, Artificial Sequence
  Synthetic oligonucleotide
gccaccactaatcagaggcccctccctctccacgctga

SEQ ID NO: 27621 - DNA, 35 bp, Artificial Sequence
  Synthetic oligonucleotide
ttcccatctgaacccatcttacatgcaagcatgta

SEQ ID NO: 27622 - DNA, 35 bp, Artificial Sequence
  Synthetic oligonucleotide
taacatacgcttgggaactcgtgccggatctcccc

SEQ ID NO: 27623 - DNA, 35 bp, Artificial Sequence
  Synthetic oligonucleotide
actccgtgtcgacaccccgtccacctttcatgggc

SEQ ID NO: 27624 - DNA, 35 bp, Artificial Sequence
  Synthetic oligonucleotide
atggaccgcccgttcttttcacaaacacttgatag

SEQ ID NO: 27625 - DNA, 35 bp, Artificial Sequence
  Synthetic oligonucleotide
tgcggtcgaagagggtataggtcgggggaatcggg

SEQ ID NO: 27626 - DNA, 35 bp, Artificial Sequence
  Synthetic oligonucleotide
accccagactccccataatgtaccgtcatttggct

SEQ ID NO: 27627 - DNA, 35 bp, Artificial Sequence
  Synthetic oligonucleotide
tctcccatcctcaggcttcttcgtataattcgtct

SEQ ID NO: 27628 - DNA, 35 bp, Artificial Sequence
  Synthetic oligonucleotide
tctctcatctggccgaactctctcatgcccgctca

SEQ ID NO: 27629 - DNA, 37 bp, Artificial Sequence
  Synthetic oligonucleotide
taaccccgcgcagggtcccattccagttttctttcga

SEQ ID NO: 27630 - DNA, 36 bp, Artificial Sequence
  Synthetic oligonucleotide
tagtccccggtccttccctaccgcgatatccgcgga

SEQ ID NO: 27631 - DNA, 38 bp, Artificial Sequence
  Synthetic oligonucleotide
gtgtatgtcctgggcccctcatctcgccacttacgtga

SEQ ID NO: 27632 - DNA, 38 bp, Artificial Sequence
  Synthetic oligonucleotide
taacccccgccattctcccatcacagcccagcccgtga

SEQ ID NO: 27633 - DNA, 38 bp, Artificial Sequence
  Synthetic oligonucleotide
gagacatgccagccgtaccattctgcctccactattga

SEQ ID NO: 27634 - DNA, 37 bp, Artificial Sequence
  Synthetic oligonucleotide
tcaacctccagctgacctctttgtaactagcccttga

SEQ ID NO: 27635 - DNA, 36 bp, Artificial Sequence
  Synthetic oligonucleotide
gcctctaccgcacacacttacatcgccctgttctta

SEQ ID NO: 27636 - DNA, 35 bp, Artificial Sequence
  Synthetic oligonucleotide
tcgtcgccccactagaaaacgtgcgcaccatccac

SEQ ID NO: 27637 - DNA, 35 bp, Artificial Sequence
  Synthetic oligonucleotide
agccccgcctgtctcccgcctccgcagcctgacgg

SEQ ID NO: 27638 - DNA, 35 bp, Artificial Sequence
  Synthetic oligonucleotide
tgtaggccggggtaatcatcctcattcatgtcctg

SEQ ID NO: 27639 - DNA, 35 bp, Artificial Sequence
  Synthetic oligonucleotide
acggaggagcgaggtacggctagggagaggtggtg

SEQ ID NO: 27640 - DNA, 35 bp, Artificial Sequence
  Synthetic oligonucleotide
ttgcctagcgcagccacgccctcctaaccaccttg

SEQ ID NO: 27641 - DNA, 35 bp, Artificial Sequence
  Synthetic oligonucleotide
ttgaccgtcaaccaccccttcgcgccataccacgt

SEQ ID NO: 27642 - DNA, 36 bp, Artificial Sequence
  Synthetic oligonucleotide
tctgacactgagcctatcgcgcctcccatgacgcca

SEQ ID NO: 27643 - DNA, 37 bp, Artificial Sequence
  Synthetic oligonucleotide
gactacgtatgtcaaggcctaccactggtccccccga

SEQ ID NO: 27644 - DNA, 37 bp, Artificial Sequence
  Synthetic oligonucleotide
acgcccaggacctagccgtcgcctttgcccactccga

SEQ ID NO: 27645 - DNA, 37 bp, Artificial Sequence
  Synthetic oligonucleotide
tttgcccaaccccgtgttcctatttgcccacactcga

SEQ ID NO: 27646 - DNA, 37 bp, Artificial Sequence
  Synthetic oligonucleotide
tgcctcactgttgttcgtgctcccgtcgccatttgga

SEQ ID NO: 27647 - DNA, 38 bp, Artificial Sequence
  Synthetic oligonucleotide
ggacggcacgcaagttgggggggaaggaaggtgaatga

SEQ ID NO: 27648 - DNA, 37 bp, Artificial Sequence
  Synthetic oligonucleotide
gtcaggcgtagatcctactgcgtcttcctcaccctga

SEQ ID NO: 27649 - DNA, 37 bp, Artificial Sequence
  Synthetic oligonucleotide
ggcgtggtacacgccaatcgatcccttccacccgtga

SEQ ID NO: 27650 - DNA, 38 bp, Artificial Sequence
  Synthetic oligonucleotide
gtcccgccgcccgacagttcaaacgcacccaccattga

SEQ ID NO: 27651 - DNA, 37 bp, Artificial Sequence
  Synthetic oligonucleotide
tatgccctggagccgcgcgactagttctactccttga

SEQ ID NO: 27652 - DNA, 36 bp, Artificial Sequence
  Synthetic oligonucleotide
gcggagcctccccgcccgccttagcctctcatggta

SEQ ID NO: 27653 - DNA, 35 bp, Artificial Sequence
  Synthetic oligonucleotide
gatgactccacgtgtgtgggtctcgtttgttcttc

SEQ ID NO: 27654 - DNA, 35 bp, Artificial Sequence
  Synthetic oligonucleotide
ataagcaaagggagggagtcgatagggttggtacg

SEQ ID NO: 27655 - DNA, 35 bp, Artificial Sequence
  Synthetic oligonucleotide
gtagacatacggccacaatctgcagaaaacaccct

SEQ ID NO: 27656 - DNA, 35 bp, Artificial Sequence
  Synthetic oligonucleotide
ttcgtcgcccgtccccagtaggccacccccaatgt

SEQ ID NO: 27657 - DNA, 35 bp, Artificial Sequence
  Synthetic oligonucleotide
tacccgcgccagttcaaaccacttcctccatatgt

SEQ ID NO: 27658 - DNA, 36 bp, Artificial Sequence
  Synthetic oligonucleotide
aacgtcgggtcacgtccaaccttcgccgcctaaaca

SEQ ID NO: 27659 - DNA, 36 bp, Artificial Sequence
  Synthetic oligonucleotide
agccccgaccacgggcctctagctatacacttcaca

SEQ ID NO: 27660 - DNA, 36 bp, Artificial Sequence
  Synthetic oligonucleotide
aacacatccacgccacctcggctaccctatgcccca

SEQ ID NO: 27661 - DNA, 36 bp, Artificial Sequence
  Synthetic oligonucleotide
gatccaccggatcccgcagtgactttcctacctcca

SEQ ID NO: 27662 - DNA, 37 bp, Artificial Sequence
  Synthetic oligonucleotide
acgactcacctcttgctactaacgcgtcgctcctaga

SEQ ID NO: 27663 - DNA, 37 bp, Artificial Sequence
  Synthetic oligonucleotide
gcgacgcccactcgggtgctctcttaacactgtacga

SEQ ID NO: 27664 - DNA, 33 bp, Artificial Sequence
  Synthetic oligonucleotide
accacaacccaccatttataccgtttctcgcga

SEQ ID NO: 27665 - DNA, 37 bp, Artificial Sequence
  Synthetic oligonucleotide
gaccacagtcacgttgtacatgggcggtggggaagga

SEQ ID NO: 27666 - DNA, 37 bp, Artificial Sequence
  Synthetic oligonucleotide
tgaggtcaagctgcccgttttcaccttcatacattga

SEQ ID NO: 27667 - DNA, 35 bp, Artificial Sequence
  Synthetic oligonucleotide
tccaatccagcgcgtatcttcgtcttatcttaccc

SEQ ID NO: 27668 - DNA, 35 bp, Artificial Sequence
  Synthetic oligonucleotide
gttaagcgcatccgttctctctctcttcgcgccgc

SEQ ID NO: 27669 - DNA, 35 bp, Artificial Sequence
  Synthetic oligonucleotide
tcccccccgagagtccccaattcgtacgccgaggc

SEQ ID NO: 27670 - DNA, 35 bp, Artificial Sequence
  Synthetic oligonucleotide
gagtatagggggatgggataggtggcgtgatattg

SEQ ID NO: 27671 - DNA, 35 bp, Artificial Sequence
  Synthetic oligonucleotide
gtaccatcctggccgcgcaatcgcagtacaccggt

SEQ ID NO: 27672 - DNA, 35 bp, Artificial Sequence
  Synthetic oligonucleotide
ttcaccttgtgccccattccctgcttgcccgtggt

SEQ ID NO: 27673 - DNA, 35 bp, Artificial Sequence
  Synthetic oligonucleotide
acgacgacttccccgggataacgggcctacatttt

SEQ ID NO: 27674 - DNA, 36 bp, Artificial Sequence
  Synthetic oligonucleotide
tgccagatgtcgctcgatttttgccctgagttcaca

SEQ ID NO: 27675 - DNA, 36 bp, Artificial Sequence
  Synthetic oligonucleotide
aatcacgccacccaccgtctgcctagctcattcgca

SEQ ID NO: 27676 - DNA, 35 bp, Artificial Sequence
  Synthetic oligonucleotide
atggatccgcagtacgcacgaaccaccaattatca

SEQ ID NO: 27677 - DNA, 36 bp, Artificial Sequence
  Synthetic oligonucleotide
gcagtatgtaggagtatggggaagcatgcggataga

SEQ ID NO: 27678 - DNA, 35 bp, Artificial Sequence
  Synthetic oligonucleotide
tccgacgtccaggtcatacgtttttcatggctcac

SEQ ID NO: 27679 - DNA, 35 bp, Artificial Sequence
  Synthetic oligonucleotide
gtcaacccaacgcgttttgtacagctctacacacc

SEQ ID NO: 27680 - DNA, 35 bp, Artificial Sequence
  Synthetic oligonucleotide
tacacacacaccccccgcattagttacggtgacgc

SEQ ID NO: 27681 - DNA, 35 bp, Artificial Sequence
  Synthetic oligonucleotide
tcttgcgatcagcaacaactgcattcgattcccgc

SEQ ID NO: 27682 - DNA, 35 bp, Artificial Sequence
  Synthetic oligonucleotide
agacgactcctggtccgtacggtcactcccgcttc

SEQ ID NO: 27683 - DNA, 35 bp, Artificial Sequence
  Synthetic oligonucleotide
atgttgccaacagtgctaacctagccttctccccg

SEQ ID NO: 27684 - DNA, 35 bp, Artificial Sequence
  Synthetic oligonucleotide
acaacgcaaaccgaaacctgacacgtgaagtatct

SEQ ID NO: 27685 - DNA, 35 bp, Artificial Sequence
  Synthetic oligonucleotide
gtattccagtgtttgctcctcgccgtgtccctcgt

SEQ ID NO: 27686 - DNA, 35 bp, Artificial Sequence
  Synthetic oligonucleotide
gatccaccgcactactgaaacctaaccagtcactt

SEQ ID NO: 27687 - DNA, 35 bp, Artificial Sequence
  Synthetic oligonucleotide
tcgtacgatcccgcgactaacaggtcttacttttt

SEQ ID NO: 27688 - DNA, 36 bp, Artificial Sequence
  Synthetic oligonucleotide
gaccacaccaacacagccacgatctgcaattcggaa

SEQ ID NO: 27689 - DNA, 36 bp, Artificial Sequence
  Synthetic oligonucleotide
taagcgcaaacactcagttcacctcgcccccgccca

SEQ ID NO: 27690 - DNA, 36 bp, Artificial Sequence
  Synthetic oligonucleotide
tcctaactgccctttccgaaacgttgctgcccgcca

SEQ ID NO: 27691 - DNA, 35 bp, Artificial Sequence
  Synthetic oligonucleotide
aagtcgcacgtcgataccagcccgcgcatccatca

SEQ ID NO: 27692 - DNA, 37 bp, Artificial Sequence
  Synthetic oligonucleotide
atccccccccctctaagccgactccgatgtacgtcga

SEQ ID NO: 27693 - DNA, 35 bp, Artificial Sequence
  Synthetic oligonucleotide
gacgatggtatggaaaggaaggcttagcaggtgga

SEQ ID NO: 27694 - DNA, 38 bp, Artificial Sequence
  Synthetic oligonucleotide
gcctagggcacgggtggatatattcttttctgtgatga

SEQ ID NO: 27695 - DNA, 38 bp, Artificial Sequence
  Synthetic oligonucleotide
tccgcctttatcacatgcttgcccgttacttgacctga

SEQ ID NO: 27696 - DNA, 38 bp, Artificial Sequence
  Synthetic oligonucleotide
gcatctgcgttacagcgtcattaccaccatcattctga

SEQ ID NO: 27697 - DNA, 34 bp, Artificial Sequence
  Synthetic oligonucleotide
ttcgatcacgcccccgtcccactgcaatttggta

SEQ ID NO: 27698 - DNA, 35 bp, Artificial Sequence
  Synthetic oligonucleotide
accccagtgggtatctttgggaatgggtgggtgta

SEQ ID NO: 27699 - DNA, 36 bp, Artificial Sequence
  Synthetic oligonucleotide
gtgccagtgggtatccagggtggggggttgcggtta

SEQ ID NO: 27700 - DNA, 35 bp, Artificial Sequence
  Synthetic oligonucleotide
gccatccccgatcacgagatctcaagtctcaagac

SEQ ID NO: 27701 - DNA, 35 bp, Artificial Sequence
  Synthetic oligonucleotide
atacgatggtcggctttttccggtgcctgtcctac

SEQ ID NO: 27702 - DNA, 35 bp, Artificial Sequence
  Synthetic oligonucleotide
tatcacctcaccggttctcaccgagcaatcgctac

SEQ ID NO: 27703 - DNA, 35 bp, Artificial Sequence
  Synthetic oligonucleotide
agtacttaactgcttagaaccaaccacccctggcc

SEQ ID NO: 27704 - DNA, 35 bp, Artificial Sequence
  Synthetic oligonucleotide
tcgatggagcacgttggttttttgctcgtatcatc

SEQ ID NO: 27705 - DNA, 35 bp, Artificial Sequence
  Synthetic oligonucleotide
atgacccggcgcgtgggccctaactcactgtcatc

SEQ ID NO: 27706 - DNA, 35 bp, Artificial Sequence
  Synthetic oligonucleotide
acgttccgcaaacctgtccccttgaggctacgctc

SEQ ID NO: 27707 - DNA, 35 bp, Artificial Sequence
  Synthetic oligonucleotide
acaccggggtcaagtcacacgccactccatatccg

SEQ ID NO: 27708 - DNA, 35 bp, Artificial Sequence
  Synthetic oligonucleotide
tatccacgtactgtgcacttacacctgtggtcctg

SEQ ID NO: 27709 - DNA, 35 bp, Artificial Sequence
  Synthetic oligonucleotide
gtccaccagccgtcatccaccctggctcacgacct

SEQ ID NO: 27710 - DNA, 36 bp, Artificial Sequence
  Synthetic oligonucleotide
tgcctcggtccacctgaggcgccctgaccttcctaa

SEQ ID NO: 27711 - DNA, 37 bp, Artificial Sequence
  Synthetic oligonucleotide
aagcccccgccggtttgcctctacatcccgttataga

SEQ ID NO: 27712 - DNA, 35 bp, Artificial Sequence
  Synthetic oligonucleotide
gatacaacgccccacgtacgtcgatgtcttttcga

SEQ ID NO: 27713 - DNA, 35 bp, Artificial Sequence
  Synthetic oligonucleotide
tcgcattgctgaccatccgccgtttggggcctcta

SEQ ID NO: 27714 - DNA, 35 bp, Artificial Sequence
  Synthetic oligonucleotide
tgaacgtcgccacgcgcgcatatcatattccccac

SEQ ID NO: 27715 - DNA, 35 bp, Artificial Sequence
  Synthetic oligonucleotide
taccgccccttccacaaagcgggagtgattacctc

SEQ ID NO: 27716 - DNA, 35 bp, Artificial Sequence
  Synthetic oligonucleotide
gcctgtcccggttcagttcctgtcagcccccattc

SEQ ID NO: 27717 - DNA, 35 bp, Artificial Sequence
  Synthetic oligonucleotide
tgtgtatggggcggagaattaagggcagttaggag

SEQ ID NO: 27718 - DNA, 35 bp, Artificial Sequence
  Synthetic oligonucleotide
acaaccacagcctgctccccgcactgtctggaagg

SEQ ID NO: 27719 - DNA, 35 bp, Artificial Sequence
  Synthetic oligonucleotide
ttcaaggcaaaagcgttccttcgcctccacccctg

SEQ ID NO: 27720 - DNA, 37 bp, Artificial Sequence
  Synthetic oligonucleotide
gccgcgactcatcctactcagccctacttccccgttg

SEQ ID NO: 27721 - DNA, 35 bp, Artificial Sequence
  Synthetic oligonucleotide
gacacagtgagtatgccacataaagctcaccacct

SEQ ID NO: 27722 - DNA, 35 bp, Artificial Sequence
  Synthetic oligonucleotide
cgacccgtctacacgcaccctatcagctttacatt

SEQ ID NO: 27723 - DNA, 36 bp, Artificial Sequence
  Synthetic oligonucleotide
taacactggcctggttattggcaccacctacgcgaa

SEQ ID NO: 27724 - DNA, 37 bp, Artificial Sequence
  Synthetic oligonucleotide
tgcgggtagggggaaatggaatggagggtatgataga

SEQ ID NO: 27725 - DNA, 37 bp, Artificial Sequence
  Synthetic oligonucleotide
aacacgtgtccagctatactcctgcgaacttccacga

SEQ ID NO: 27726 - DNA, 37 bp, Artificial Sequence
  Synthetic oligonucleotide
tcgccctcttgccgttatatacccctgcccacgcgga

SEQ ID NO: 27727 - DNA, 37 bp, Artificial Sequence
  Synthetic oligonucleotide
ggagcatgctccacgaaaactaaaatggtctggggga

SEQ ID NO: 27728 - DNA, 38 bp, Artificial Sequence
  Synthetic oligonucleotide
gtgaccgtccccgctgcagcacctctggtccaccatga

SEQ ID NO: 27729 - DNA, 38 bp, Artificial Sequence
  Synthetic oligonucleotide
tttgacgcggtttgggtgggataaatgggtgggagtga

SEQ ID NO: 27730 - DNA, 38 bp, Artificial Sequence
  Synthetic oligonucleotide
gatccccgatggtccgcctcctctcctgccctgtttga

SEQ ID NO: 27731 - DNA, 35 bp, Artificial Sequence
  Synthetic oligonucleotide
tcccgatgcggaaagcacctcatttccttttgcta

SEQ ID NO: 27732 - DNA, 36 bp, Artificial Sequence
  Synthetic oligonucleotide
ggtgcctagtgtcagtcatccaatgcgcccctctta

SEQ ID NO: 27733 - DNA, 35 bp, Artificial Sequence
  Synthetic oligonucleotide
tcccggcggtagacctggcccatcccccacaagac

SEQ ID NO: 27734 - DNA, 35 bp, Artificial Sequence
  Synthetic oligonucleotide
acgaacctgggtcgacgtctgtaacaacacccgcc

SEQ ID NO: 27735 - DNA, 35 bp, Artificial Sequence
  Synthetic oligonucleotide
tcatcttcgaggaaacgccacattgcaaaccctgc

SEQ ID NO: 27736 - DNA, 35 bp, Artificial Sequence
  Synthetic oligonucleotide
acacacactgccacaagttcatttgggcgatcccg

SEQ ID NO: 27737 - DNA, 35 bp, Artificial Sequence
  Synthetic oligonucleotide
tgttacgtctggccgtcagacactcctctaacctg

SEQ ID NO: 27738 - DNA, 35 bp, Artificial Sequence
  Synthetic oligonucleotide
ttccccgcagagttcgtcagcagttccctccacgt

SEQ ID NO: 27739 - DNA, 35 bp, Artificial Sequence
  Synthetic oligonucleotide
tctgtgcccaaagtgcatcatgacatccctctcgt

SEQ ID NO: 27740 - DNA, 35 bp, Artificial Sequence
  Synthetic oligonucleotide
tccaacgttgcccatcattctgcgcctgcaccgtt

SEQ ID NO: 27741 - DNA, 36 bp, Artificial Sequence
  Synthetic oligonucleotide
gccgggtcaaaggcacgtacaggtaatgcaaggtaa

SEQ ID NO: 27742 - DNA, 36 bp, Artificial Sequence
  Synthetic oligonucleotide
tcttacctgaccgatggccccccgaccgcacctaca

SEQ ID NO: 27743 - DNA, 37 bp, Artificial Sequence
  Synthetic oligonucleotide
gacccctccgttggtgcgcttacgcatctctccaaga

SEQ ID NO: 27744 - DNA, 37 bp, Artificial Sequence
  Synthetic oligonucleotide
gccacgcaaactgcgcccttcgatccactcttatcga

SEQ ID NO: 27745 - DNA, 37 bp, Artificial Sequence
  Synthetic oligonucleotide
tctgccgtcccaccccccagcgacaaatcacctcgga

SEQ ID NO: 27746 - DNA, 37 bp, Artificial Sequence
  Synthetic oligonucleotide
tccgctagcgcagccactgctatctcgccgtccctga

SEQ ID NO: 27747 - DNA, 38 bp, Artificial Sequence
  Synthetic oligonucleotide
ggatgacgccgctcctgtactatcgtgtttctttgtga

SEQ ID NO: 27748 - DNA, 35 bp, Artificial Sequence
  Synthetic oligonucleotide
gcccgttcaagctatcgccccctcacgttggccac

SEQ ID NO: 27749 - DNA, 35 bp, Artificial Sequence
  Synthetic oligonucleotide
atcattacgcccacatcatgttaccgcctaagggc

SEQ ID NO: 27750 - DNA, 35 bp, Artificial Sequence
  Synthetic oligonucleotide
tctggccacccgctctgcaattgctctctcgtttc

SEQ ID NO: 27751 - DNA, 35 bp, Artificial Sequence
  Synthetic oligonucleotide
atccgtcccgcgcccatcactcttatgccccggag

SEQ ID NO: 27752 - DNA, 35 bp, Artificial Sequence
  Synthetic oligonucleotide
ttcaacccgtcaccttggtccatcgctagctgtag

SEQ ID NO: 27753 - DNA, 35 bp, Artificial Sequence
  Synthetic oligonucleotide
gcaatgccgggcctagtgtcagcctccccttactg

SEQ ID NO: 27754 - DNA, 35 bp, Artificial Sequence
  Synthetic oligonucleotide
gccgctatccgatcgacctcacatttcaccgtttg

SEQ ID NO: 27755 - DNA, 34 bp, Artificial Sequence
  Synthetic oligonucleotide
tgaccacggcgattgttatccgcaacctgtcact

SEQ ID NO: 27756 - DNA, 35 bp, Artificial Sequence
  Synthetic oligonucleotide
gcccaccccgaccatgacttggggatttatttgct

SEQ ID NO: 27757 - DNA, 36 bp, Artificial Sequence
  Synthetic oligonucleotide
acgcccctcaactcggctacccagtctgacccaaca

SEQ ID NO: 27758 - DNA, 36 bp, Artificial Sequence
  Synthetic oligonucleotide
aactacgatccgttagtcatctaacgaccacccaca

SEQ ID NO: 27759 - DNA, 36 bp, Artificial Sequence
  Synthetic oligonucleotide
tgtacgacgcccggtcgggatcctaaacttctcaca

SEQ ID NO: 27760 - DNA, 35 bp, Artificial Sequence
  Synthetic oligonucleotide
tccagccgaaggcgaaataccggaaacctccctca

SEQ ID NO: 27761 - DNA, 37 bp, Artificial Sequence
  Synthetic oligonucleotide
gacctagacgcagccgattcctgtctttccatccaga

SEQ ID NO: 27762 - DNA, 37 bp, Artificial Sequence
  Synthetic oligonucleotide
acaccgtctgaccgctacatcggcaccatcctaacga

SEQ ID NO: 27763 - DNA, 37 bp, Artificial Sequence
  Synthetic oligonucleotide
gatgtccatgtcctatccctgacttctccccatagga

SEQ ID NO: 27764 - DNA, 38 bp, Artificial Sequence
  Synthetic oligonucleotide
gaaccacccgcacagaccgcccacaaaaagccgaatga

SEQ ID NO: 27765 - DNA, 38 bp, Artificial Sequence
  Synthetic oligonucleotide
atcagttgcgcccacccccccctcttacttgctgatga

SEQ ID NO: 27766 - DNA, 38 bp, Artificial Sequence
  Synthetic oligonucleotide
gaccctcggtgtccgttccaatcctgctaatctattga

SEQ ID NO: 27767 - DNA, 35 bp, Artificial Sequence
  Synthetic oligonucleotide
tgaccttcctattgcaccgaccgcttgtcaccagc

SEQ ID NO: 27768 - DNA, 35 bp, Artificial Sequence
  Synthetic oligonucleotide
aacacggagcagggtctccagtgggggagggtggg

SEQ ID NO: 27769 - DNA, 35 bp, Artificial Sequence
  Synthetic oligonucleotide
acccgcgcgcaaaaaatcccccccgcctttcctgg

SEQ ID NO: 27770 - DNA, 35 bp, Artificial Sequence
  Synthetic oligonucleotide
ggtgtggggaacggggaagaagaattgtggaacgt

SEQ ID NO: 27771 - DNA, 35 bp, Artificial Sequence
  Synthetic oligonucleotide
gaacgggagaggggagatttgagtgtgctgtgggt

SEQ ID NO: 27772 - DNA, 35 bp, Artificial Sequence
  Synthetic oligonucleotide
attgcctcacgtctccgaggcatcgtttttgaatt

SEQ ID NO: 27773 - DNA, 37 bp, Artificial Sequence
  Synthetic oligonucleotide
gtgggtaacggggggcgagaacggggaagggggtgga

SEQ ID NO: 27774 - DNA, 38 bp, Artificial Sequence
  Synthetic oligonucleotide
acacatatcggagggggggaaactggccagggatatga

SEQ ID NO: 27775 - DNA, 36 bp, Artificial Sequence
  Synthetic oligonucleotide
tgggccacctgtatcccatgcccttctactccttga

SEQ ID NO: 27776 - DNA, 35 bp, Artificial Sequence
  Synthetic oligonucleotide
gaccccctcggtccccgccgatggtaggccttacc

SEQ ID NO: 27777 - DNA, 35 bp, Artificial Sequence
  Synthetic oligonucleotide
tagcaaccccatggctgaatccactagaccctgtc

SEQ ID NO: 27778 - DNA, 35 bp, Artificial Sequence
  Synthetic oligonucleotide
tatacccgccaccctcatacctacttaataagtag

SEQ ID NO: 27779 - DNA, 35 bp, Artificial Sequence
  Synthetic oligonucleotide
gcatgcttaacatgattcatttcgtcctccacctg

SEQ ID NO: 27780 - DNA, 36 bp, Artificial Sequence
  Synthetic oligonucleotide
gtagggggacggagaaagcataagggatgagggaca

SEQ ID NO: 27781 - DNA, 36 bp, Artificial Sequence
  Synthetic oligonucleotide
ggaaggcatgtgcctccccattatactgctctctca

SEQ ID NO: 27782 - DNA, 37 bp, Artificial Sequence
  Synthetic oligonucleotide
ccgtcgcagccacacccggctcgaacaatacctaaga

SEQ ID NO: 27783 - DNA, 36 bp, Artificial Sequence
  Synthetic oligonucleotide
tccccgctatgtggctcccttgtccgcgtacttcga

SEQ ID NO: 27784 - DNA, 38 bp, Artificial Sequence
  Synthetic oligonucleotide
ttacgcccagtagaaggagcgtcccctggcccccctga

SEQ ID NO: 27785 - DNA, 38 bp, Artificial Sequence
  Synthetic oligonucleotide
gccaccggctggtactaacgcgttgctccattctctga

SEQ ID NO: 27786 - DNA, 38 bp, Artificial Sequence
  Synthetic oligonucleotide
ttgcgggagtgatttattggtgcaggggggcggggtga

SEQ ID NO: 27787 - DNA, 35 bp, Artificial Sequence
  Synthetic oligonucleotide
atcgagcctccccggccccgcttatatagatctac

SEQ ID NO: 27788 - DNA, 35 bp, Artificial Sequence
  Synthetic oligonucleotide
tatattgcgtccaatccagtttgtctccgctcatc

SEQ ID NO: 27789 - DNA, 35 bp, Artificial Sequence
  Synthetic oligonucleotide
gtcgaggaaacgactcatgcgatgatacacctctc

SEQ ID NO: 27790 - DNA, 35 bp, Artificial Sequence
  Synthetic oligonucleotide
tgcctcgatgcccctgtcccgttgcagttttcccg

SEQ ID NO: 27791 - DNA, 35 bp, Artificial Sequence
  Synthetic oligonucleotide
gccacatcaaagcggggcacgaaggaaaaggggct

SEQ ID NO: 27792 - DNA, 36 bp, Artificial Sequence
  Synthetic oligonucleotide
gaaccattcccatctgtacagttccctccttccgca

SEQ ID NO: 27793 - DNA, 37 bp, Artificial Sequence
  Synthetic oligonucleotide
tccacagtcgccatgaccttgttcatgtatccctaga

SEQ ID NO: 27794 - DNA, 37 bp, Artificial Sequence
  Synthetic oligonucleotide
tacgtcctgaggccacgcagccccacatttacatcga

SEQ ID NO: 27795 - DNA, 38 bp, Artificial Sequence
  Synthetic oligonucleotide
acgcccctccgccatcggtatttactggttctttttga

SEQ ID NO: 27796 - DNA, 35 bp, Artificial Sequence
  Synthetic oligonucleotide
ttggggagctcttcgcccaccgcagttgcaccacc

SEQ ID NO: 27797 - DNA, 35 bp, Artificial Sequence
  Synthetic oligonucleotide
tcgatggcacatgggttttcgtcttcggccctctc

SEQ ID NO: 27798 - DNA, 35 bp, Artificial Sequence
  Synthetic oligonucleotide
tcgcacgcttaccctccatgatccccgacttctgg

SEQ ID NO: 27799 - DNA, 35 bp, Artificial Sequence
  Synthetic oligonucleotide
accccgccaccactaagaagcttgctatggatcct

SEQ ID NO: 27800 - DNA, 35 bp, Artificial Sequence
  Synthetic oligonucleotide
gtcaagccctccccttttatgccatcatagtccgt

SEQ ID NO: 27801 - DNA, 35 bp, Artificial Sequence
  Synthetic oligonucleotide
caccaggacaaaagcaacacagctccctacgactt

SEQ ID NO: 27802 - DNA, 35 bp, Artificial Sequence
  Synthetic oligonucleotide
acagtaacgtcatcttctattcctggccggctcca

SEQ ID NO: 27803 - DNA, 37 bp, Artificial Sequence
  Synthetic oligonucleotide
aaatgccccagcctaactccacgccagtaactacgga

SEQ ID NO: 27804 - DNA, 36 bp, Artificial Sequence
  Synthetic oligonucleotide
ttgcaccacgtacgtcgcccctacgcaactcctgga

SEQ ID NO: 27805 - DNA, 37 bp, Artificial Sequence
  Synthetic oligonucleotide
agtccccgccatttccagtttgctccctgtcattgga

SEQ ID NO: 27806 - DNA, 36 bp, Artificial Sequence
  Synthetic oligonucleotide
accaaggggaggtggtgggatgggtgtcgtatatga

SEQ ID NO: 27807 - DNA, 38 bp, Artificial Sequence
  Synthetic oligonucleotide
gacgccctcatctcttcatatatgggtacccttcgtga

SEQ ID NO: 27808 - DNA, 35 bp, Artificial Sequence
  Synthetic oligonucleotide
tagccaacgggtggtcttcttctgtacggcaactc

SEQ ID NO: 27809 - DNA, 35 bp, Artificial Sequence
  Synthetic oligonucleotide
gaatatgtgggcgtggcggagtggcctggggaaag

SEQ ID NO: 27810 - DNA, 35 bp, Artificial Sequence
  Synthetic oligonucleotide
gacccgcactagggattctgttcatttatgctccg

SEQ ID NO: 27811 - DNA, 35 bp, Artificial Sequence
  Synthetic oligonucleotide
atttggactgagtgggggatggtgggggcaatggg

SEQ ID NO: 27812 - DNA, 35 bp, Artificial Sequence
  Synthetic oligonucleotide
gttcaggagcatccggggccccatcctagttccat

SEQ ID NO: 27813 - DNA, 35 bp, Artificial Sequence
  Synthetic oligonucleotide
atgacctgcttccactcagtttagttcttccagtt

SEQ ID NO: 27814 - DNA, 36 bp, Artificial Sequence
  Synthetic oligonucleotide
gacccctggttccccacacgccagtgctcgctcgca

SEQ ID NO: 27815 - DNA, 36 bp, Artificial Sequence
  Synthetic oligonucleotide
tgcgcctgaccggccccgaatgtcttttcttatgca

SEQ ID NO: 27816 - DNA, 33 bp, Artificial Sequence
  Synthetic oligonucleotide
tcgcatttgcgaaactcccctatctccactgca

SEQ ID NO: 27817 - DNA, 37 bp, Artificial Sequence
  Synthetic oligonucleotide
aaacgatcgcgccgggtggctgaaggggggatgaaga

SEQ ID NO: 27818 - DNA, 37 bp, Artificial Sequence
  Synthetic oligonucleotide
gcaggcacgttttgcgcctgccattttgccaccccga

SEQ ID NO: 27819 - DNA, 37 bp, Artificial Sequence
  Synthetic oligonucleotide
tagacacgccacctcacccgtattttgcaccacctga

SEQ ID NO: 27820 - DNA, 37 bp, Artificial Sequence
  Synthetic oligonucleotide
tttgtcagcccagctctgtcattacgcattaccctga

SEQ ID NO: 27821 - DNA, 37 bp, Artificial Sequence
  Synthetic oligonucleotide
ccaccttcagcgcatgcaatcctccgagtcggcctga

SEQ ID NO: 27822 - DNA, 38 bp, Artificial Sequence
  Synthetic oligonucleotide
agcagatgagaggggcggaggaggactggtgatgctga

SEQ ID NO: 27823 - DNA, 37 bp, Artificial Sequence
  Synthetic oligonucleotide
aataccaccctggtgccccatccgccactcacattga

SEQ ID NO: 27824 - DNA, 37 bp, Artificial Sequence
  Synthetic oligonucleotide
acccccccgttaggtagctttttgcgcatcatcttga

SEQ ID NO: 27825 - DNA, 38 bp, Artificial Sequence
  Synthetic oligonucleotide
acacctcatcatcacggtgccttgaccgctctctttga

SEQ ID NO: 27826 - DNA, 35 bp, Artificial Sequence
  Synthetic oligonucleotide
accctccgccggggaccaatactgctttctattag

SEQ ID NO: 27827 - DNA, 35 bp, Artificial Sequence
  Synthetic oligonucleotide
gcattcgtcctttccgcccttgcctctgatagccg

SEQ ID NO: 27828 - DNA, 35 bp, Artificial Sequence
  Synthetic oligonucleotide
gatcatccctaccagaacccttcctcttctcggtg

SEQ ID NO: 27829 - DNA, 35 bp, Artificial Sequence
  Synthetic oligonucleotide
tccagacagcagtacctgttattgcaatttttact

SEQ ID NO: 27830 - DNA, 35 bp, Artificial Sequence
  Synthetic oligonucleotide
tcaactggctgaggggggagggatggttgggggct

SEQ ID NO: 27831 - DNA, 35 bp, Artificial Sequence
  Synthetic oligonucleotide
ggacgctacgggccgtttttctctcatacatatct

SEQ ID NO: 27832 - DNA, 35 bp, Artificial Sequence
  Synthetic oligonucleotide
tccagctccgcattgcccgtagcgctatccctatt

SEQ ID NO: 27833 - DNA, 37 bp, Artificial Sequence
  Synthetic oligonucleotide
ttcacatccattccgccgggccgccatcatttcacga

SEQ ID NO: 27834 - DNA, 37 bp, Artificial Sequence
  Synthetic oligonucleotide
acacaacactacacgcgccacatcgctgcattttcga

SEQ ID NO: 27835 - DNA, 37 bp, Artificial Sequence
  Synthetic oligonucleotide
ggggagggatggaagggggtatgagggacgcatatga

SEQ ID NO: 27836 - DNA, 38 bp, Artificial Sequence
  Synthetic oligonucleotide
gttccatcacccatactgtacgggggccatttctatga

SEQ ID NO: 27837 - DNA, 37 bp, Artificial Sequence
  Synthetic oligonucleotide
taccacccgacctgcccttgtcgcctctgagccttga

SEQ ID NO: 27838 - DNA, 37 bp, Artificial Sequence
  Synthetic oligonucleotide
tagtccacgcagagtcctgtcttctgccccttgttga

SEQ ID NO: 27839 - DNA, 36 bp, Artificial Sequence
  Synthetic oligonucleotide
gggaaggagggcggggtatgctatggtaggcggata

SEQ ID NO: 27840 - DNA, 36 bp, Artificial Sequence
  Synthetic oligonucleotide
gaccgatcggagtgcggtttttggtttctccttgta

SEQ ID NO: 27841 - DNA, 35 bp, Artificial Sequence
  Synthetic oligonucleotide
ttagcctccgacaggctcgtacaatgccgatcccc

SEQ ID NO: 27842 - DNA, 35 bp, Artificial Sequence
  Synthetic oligonucleotide
ttccgcatggggcgttgctcctgtctgccttgttc

SEQ ID NO: 27843 - DNA, 35 bp, Artificial Sequence
  Synthetic oligonucleotide
ttgaactctccccaacgcgactccttggcgaactg

SEQ ID NO: 27844 - DNA, 35 bp, Artificial Sequence
  Synthetic oligonucleotide
tagtctacgcccctgccttaatagtaggtttctct

SEQ ID NO: 27845 - DNA, 35 bp, Artificial Sequence
  Synthetic oligonucleotide
gggagggaagtggaggtgggagtttgcgtagaatt

SEQ ID NO: 27846 - DNA, 35 bp, Artificial Sequence
  Synthetic oligonucleotide
tcccgctacctcgctaaatgacggactgtacgttt

SEQ ID NO: 27847 - DNA, 36 bp, Artificial Sequence
  Synthetic oligonucleotide
gagccaccctacaacacgcttgaccccgagccggaa

SEQ ID NO: 27848 - DNA, 36 bp, Artificial Sequence
  Synthetic oligonucleotide
gccaacgacctccaatttctggtggccacccccaca

SEQ ID NO: 27849 - DNA, 35 bp, Artificial Sequence
  Synthetic oligonucleotide
tccaaccgaacacccatgctattataatttccaca

SEQ ID NO: 27850 - DNA, 35 bp, Artificial Sequence
  Synthetic oligonucleotide
acaccgccgcctatcgttcgccccgttagggacca

SEQ ID NO: 27851 - DNA, 35 bp, Artificial Sequence
  Synthetic oligonucleotide
gccgctggcctgctgctatactatgttccaaccca

SEQ ID NO: 27852 - DNA, 37 bp, Artificial Sequence
  Synthetic oligonucleotide
aacccgttgcataaggttggccccctctctcccgcga

SEQ ID NO: 27853 - DNA, 37 bp, Artificial Sequence
  Synthetic oligonucleotide
attgatggcgggagggtaaggaaggcgctgaggtgga

SEQ ID NO: 27854 - DNA, 35 bp, Artificial Sequence
  Synthetic oligonucleotide
gctgtgtgtttcttgttagccgcctgccaccttcc

SEQ ID NO: 27855 - DNA, 35 bp, Artificial Sequence
  Synthetic oligonucleotide
tacgccatgctctccaagtcttctcaaccgaccgc

SEQ ID NO: 27856 - DNA, 35 bp, Artificial Sequence
  Synthetic oligonucleotide
gacgaacgcaggtcccccctagctttattgttcgc

SEQ ID NO: 27857 - DNA, 35 bp, Artificial Sequence
  Synthetic oligonucleotide
atcggtctcacacatggtcgagttccgtacacctc

SEQ ID NO: 27858 - DNA, 35 bp, Artificial Sequence
  Synthetic oligonucleotide
ttgaactgtgtaggcccatggctcatcctcgcttc

SEQ ID NO: 27859 - DNA, 35 bp, Artificial Sequence
  Synthetic oligonucleotide
gaacagccctcgtctttcggctccctgccccaact

SEQ ID NO: 27860 - DNA, 35 bp, Artificial Sequence
  Synthetic oligonucleotide
gcactacggccattttcggtggctagcctacccct

SEQ ID NO: 27861 - DNA, 35 bp, Artificial Sequence
  Synthetic oligonucleotide
tacacgatccacactcagcccctagaggcaaggca

SEQ ID NO: 27862 - DNA, 36 bp, Artificial Sequence
  Synthetic oligonucleotide
ttatccacccgccagaagtacttcgatcctacacga

SEQ ID NO: 27863 - DNA, 36 bp, Artificial Sequence
  Synthetic oligonucleotide
tcacagacactggccttgactatatctttctcccga

SEQ ID NO: 27864 - DNA, 37 bp, Artificial Sequence
  Synthetic oligonucleotide
agggacataggggtggggagggagcatggtagtcgga

SEQ ID NO: 27865 - DNA, 38 bp, Artificial Sequence
  Synthetic oligonucleotide
accggtgcggagaaaagcaaatggtgcaggggggatga

SEQ ID NO: 27866 - DNA, 38 bp, Artificial Sequence
  Synthetic oligonucleotide
gtgtgccgcccatccaatctgacccccgcgggacgtga

SEQ ID NO: 27867 - DNA, 37 bp, Artificial Sequence
  Synthetic oligonucleotide
gagcgggcccgccattatcctgcccctcgtacattga

SEQ ID NO: 27868 - DNA, 37 bp, Artificial Sequence
  Synthetic oligonucleotide
gactcctccgctcgcaccaataggaccaccatcttga

SEQ ID NO: 27869 - DNA, 35 bp, Artificial Sequence
  Synthetic oligonucleotide
acgaaagctgtcagcgcttctctacctgtccacta

SEQ ID NO: 27870 - DNA, 35 bp, Artificial Sequence
  Synthetic oligonucleotide
tcctgcacccccgccttgtttagcccctcctctcg

SEQ ID NO: 27871 - DNA, 35 bp, Artificial Sequence
  Synthetic oligonucleotide
tcacatccattggatggttttctcagttcactctt

SEQ ID NO: 27872 - DNA, 35 bp, Artificial Sequence
  Synthetic oligonucleotide
tgtgcgagctagcacctccgcctggcctattagtt

SEQ ID NO: 27873 - DNA, 36 bp, Artificial Sequence
  Synthetic oligonucleotide
accacgtggcaactaaggcccgcttccactaccaaa

SEQ ID NO: 27874 - DNA, 36 bp, Artificial Sequence
  Synthetic oligonucleotide
tcgatccccgcgggttctatatactgtcctttttaa

SEQ ID NO: 27875 - DNA, 36 bp, Artificial Sequence
  Synthetic oligonucleotide
ttcgaaccgtggttcaaccgatgccctccccttaga

SEQ ID NO: 27876 - DNA, 37 bp, Artificial Sequence
  Synthetic oligonucleotide
tactgcacaatcgcctaccccatccggcttatacgga

SEQ ID NO: 27877 - DNA, 37 bp, Artificial Sequence
  Synthetic oligonucleotide
gacggttacagtaagagcggggacagggatggcggga

SEQ ID NO: 27878 - DNA, 36 bp, Artificial Sequence
  Synthetic oligonucleotide
tgcactgtttggcctgctctccgctctggtccccta

SEQ ID NO: 27879 - DNA, 36 bp, Artificial Sequence
  Synthetic oligonucleotide
gacacgagctacacaactgcatatcccatgctcgta

SEQ ID NO: 27880 - DNA, 35 bp, Artificial Sequence
  Synthetic oligonucleotide
tcaaatccgacagatgtatggaacccctgccctcc

SEQ ID NO: 27881 - DNA, 35 bp, Artificial Sequence
  Synthetic oligonucleotide
gagagcggaacgttatcatgcctaccactctgtcc

SEQ ID NO: 27882 - DNA, 35 bp, Artificial Sequence
  Synthetic oligonucleotide
acgtcggggcgctgtagaccgtttcttctcattcc

SEQ ID NO: 27883 - DNA, 35 bp, Artificial Sequence
  Synthetic oligonucleotide
acgtgccgacgccttccttatcctgctgatcaagc

SEQ ID NO: 27884 - DNA, 35 bp, Artificial Sequence
  Synthetic oligonucleotide
ggagagaggtggagggagggcctgtgactgtcggg

SEQ ID NO: 27885 - DNA, 35 bp, Artificial Sequence
  Synthetic oligonucleotide
acactggggcttaggtcgatcgctcaatgtcctct

SEQ ID NO: 27886 - DNA, 35 bp, Artificial Sequence
  Synthetic oligonucleotide
tactcgtcaacatatcttcctcctgtccaaccgca

SEQ ID NO: 27887 - DNA, 37 bp, Artificial Sequence
  Synthetic oligonucleotide
tattcaccccccaacgatgaaccacgggactggacga

SEQ ID NO: 27888 - DNA, 35 bp, Artificial Sequence
  Synthetic oligonucleotide
attgccgtctcatggcctccctgttctttacgcga

SEQ ID NO: 27889 - DNA, 37 bp, Artificial Sequence
  Synthetic oligonucleotide
gacacctctatgacgcctgcaacgaaaacatcctcga

SEQ ID NO: 27890 - DNA, 38 bp, Artificial Sequence
  Synthetic oligonucleotide
gtcacgagtgggggagacgatgtagggtgggagggtga

SEQ ID NO: 27891 - DNA, 38 bp, Artificial Sequence
  Synthetic oligonucleotide
gccgtctcggccgtactcgttttggaacacctctgtga

SEQ ID NO: 27892 - DNA, 37 bp, Artificial Sequence
  Synthetic oligonucleotide
tacgcgcccgactacggtaattctacgcacgcattga

SEQ ID NO: 27893 - DNA, 36 bp, Artificial Sequence
  Synthetic oligonucleotide
gaagactagaggaacggaaagtggatgggacaaata

SEQ ID NO: 27894 - DNA, 36 bp, Artificial Sequence
  Synthetic oligonucleotide
agcataccgaccgctcttcactctgcagcttattta

SEQ ID NO: 27895 - DNA, 35 bp, Artificial Sequence
  Synthetic oligonucleotide
cccaccactcgccatgctgacctcccctcacgagc

SEQ ID NO: 27896 - DNA, 35 bp, Artificial Sequence
  Synthetic oligonucleotide
atggacgtcaagtctaccctcccgccacctctcag

SEQ ID NO: 27897 - DNA, 35 bp, Artificial Sequence
  Synthetic oligonucleotide
aacctgacgaagtagtagaacgggaggatgaggcg

SEQ ID NO: 27898 - DNA, 35 bp, Artificial Sequence
  Synthetic oligonucleotide
gcacctccaatcgcttgccggatcacgttcatcct

SEQ ID NO: 27899 - DNA, 35 bp, Artificial Sequence
  Synthetic oligonucleotide
tgagctacctgccatgtccctcagccgcctcatct

SEQ ID NO: 27900 - DNA, 36 bp, Artificial Sequence
  Synthetic oligonucleotide
gaccacgtccgttccccccttcgattagtgaaacca

SEQ ID NO: 27901 - DNA, 35 bp, Artificial Sequence
  Synthetic oligonucleotide
tgttgccccaatacggcaccgcactactccaccca

SEQ ID NO: 27902 - DNA, 37 bp, Artificial Sequence
  Synthetic oligonucleotide
acatgcacaatccagcctcacggtcgcgcttcaccga

SEQ ID NO: 27903 - DNA, 37 bp, Artificial Sequence
  Synthetic oligonucleotide
tccgaggctccctgtgaatctcaaaacccgccctcga

SEQ ID NO: 27904 - DNA, 37 bp, Artificial Sequence
  Synthetic oligonucleotide
tccatcccagccgtgtcagcgctcctcgccacatgga

SEQ ID NO: 27905 - DNA, 37 bp, Artificial Sequence
  Synthetic oligonucleotide
aacggatggggattgggtgtagcggggggcgggttga

SEQ ID NO: 27906 - DNA, 35 bp, Artificial Sequence
  Synthetic oligonucleotide
attgacacacctgtggtatctccgttattgcacta

SEQ ID NO: 27907 - DNA, 36 bp, Artificial Sequence
  Synthetic oligonucleotide
tcgcccatcccttcagttagctcccttcacgattta

SEQ ID NO: 27908 - DNA, 35 bp, Artificial Sequence
  Synthetic oligonucleotide
acacccgaatacatacccggagtcacttacatgac

SEQ ID NO: 27909 - DNA, 35 bp, Artificial Sequence
  Synthetic oligonucleotide
aatgcgctggtcacatggaccatatagcagatgcc

SEQ ID NO: 27910 - DNA, 35 bp, Artificial Sequence
  Synthetic oligonucleotide
accccgcccccgccctagtatcagactttctgcag

SEQ ID NO: 27911 - DNA, 35 bp, Artificial Sequence
  Synthetic oligonucleotide
tcataccggggcctaccatttcttttgttccatgg

SEQ ID NO: 27912 - DNA, 35 bp, Artificial Sequence
  Synthetic oligonucleotide
ggagctcaacattgtccctcttatcgcctcccatg

SEQ ID NO: 27913 - DNA, 35 bp, Artificial Sequence
  Synthetic oligonucleotide
ttggtccacgccttaccttacagcttcctttcgtg

SEQ ID NO: 27914 - DNA, 35 bp, Artificial Sequence
  Synthetic oligonucleotide
tagttcctaacttaccccgcgcccgagcctcccct

SEQ ID NO: 27915 - DNA, 35 bp, Artificial Sequence
  Synthetic oligonucleotide
tatccaccccagaaactcctatgctctacacggaa

SEQ ID NO: 27916 - DNA, 38 bp, Artificial Sequence
  Synthetic oligonucleotide
ggatcgggccggggtaggaattgaggagttaatgctga

SEQ ID NO: 27917 - DNA, 38 bp, Artificial Sequence
  Synthetic oligonucleotide
agcaaactaagcggattggagcatggggatgggggtga

SEQ ID NO: 27918 - DNA, 36 bp, Artificial Sequence
  Synthetic oligonucleotide
ttccctgacccccgccatccagtctagtagcccata

SEQ ID NO: 27919 - DNA, 36 bp, Artificial Sequence
  Synthetic oligonucleotide
atgaacccgcccaaactgttatagcctctagtccta

SEQ ID NO: 27920 - DNA, 35 bp, Artificial Sequence
  Synthetic oligonucleotide
ttagcgaacctattgccccccgattgccagccaac

SEQ ID NO: 27921 - DNA, 35 bp, Artificial Sequence
  Synthetic oligonucleotide
tacaactacgaggcctgtgcggaccgcatactacc

SEQ ID NO: 27922 - DNA, 35 bp, Artificial Sequence
  Synthetic oligonucleotide
ttccacccgcgtatcccagggcatacgggcccccc

SEQ ID NO: 27923 - DNA, 35 bp, Artificial Sequence
  Synthetic oligonucleotide
gacccaatctgccggtaaatacgggagattctttc

SEQ ID NO: 27924 - DNA, 35 bp, Artificial Sequence
  Synthetic oligonucleotide
gtgggggatgaaggaggaacgggacgggggactct

SEQ ID NO: 27925 - DNA, 35 bp, Artificial Sequence
  Synthetic oligonucleotide
attccggccagatgtgaacacgcaccttcccttgt

SEQ ID NO: 27926 - DNA, 36 bp, Artificial Sequence
  Synthetic oligonucleotide
aatcgcatccccactgtgaccccctcattcgctcaa

SEQ ID NO: 27927 - DNA, 36 bp, Artificial Sequence
  Synthetic oligonucleotide
gccaaccactagaaagttcttcgggctcacattaca

SEQ ID NO: 27928 - DNA, 36 bp, Artificial Sequence
  Synthetic oligonucleotide
acgaccgatcactcatatatcacccttgtccaaaga

SEQ ID NO: 27929 - DNA, 34 bp, Artificial Sequence
  Synthetic oligonucleotide
accaagcaggggggagttgggagagtgacgagga

SEQ ID NO: 27930 - DNA, 38 bp, Artificial Sequence
  Synthetic oligonucleotide
gcgcaggcacggctgctctcctaattctccttcagtga

SEQ ID NO: 27931 - DNA, 38 bp, Artificial Sequence
  Synthetic oligonucleotide
tccagaatcgcaccgctgcctgactttagccaccttga

SEQ ID NO: 27932 - DNA, 35 bp, Artificial Sequence
  Synthetic oligonucleotide
acccatcacagggcgcagcttcccctacccagcgc

SEQ ID NO: 27933 - DNA, 35 bp, Artificial Sequence
  Synthetic oligonucleotide
gaacttggcccccgcaatgtccacttagtgccttc

SEQ ID NO: 27934 - DNA, 35 bp, Artificial Sequence
  Synthetic oligonucleotide
acagtccagcatcctgttgacttctcccgggtttc

SEQ ID NO: 27935 - DNA, 35 bp, Artificial Sequence
  Synthetic oligonucleotide
gcacgacatttgcgctcttacttcggccccaatat

SEQ ID NO: 27936 - DNA, 35 bp, Artificial Sequence
  Synthetic oligonucleotide
actcacctggtcaagtggcctcaacccggatacct

SEQ ID NO: 27937 - DNA, 35 bp, Artificial Sequence
  Synthetic oligonucleotide
gctgctcggtaatgaatcgtctgttcccttcctct

SEQ ID NO: 27938 - DNA, 35 bp, Artificial Sequence
  Synthetic oligonucleotide
gcccagggccacggctttccttcatccaccgcctt

SEQ ID NO: 27939 - DNA, 35 bp, Artificial Sequence
  Synthetic oligonucleotide
tgagtcccacctgcgtaatcattcagcccattctt

SEQ ID NO: 27940 - DNA, 35 bp, Artificial Sequence
  Synthetic oligonucleotide
gttcgcccataaacgtcccatcgttacccagtaca

SEQ ID NO: 27941 - DNA, 36 bp, Artificial Sequence
  Synthetic oligonucleotide
atgcccaacgtgaccactctttcatccgagccctca

SEQ ID NO: 27942 - DNA, 37 bp, Artificial Sequence
  Synthetic oligonucleotide
gactggccagggaaaaacagggaagggatgagcggga

SEQ ID NO: 27943 - DNA, 38 bp, Artificial Sequence
  Synthetic oligonucleotide
gccttgacatccctgtgcatcagcacattgcccactga

SEQ ID NO: 27944 - DNA, 38 bp, Artificial Sequence
  Synthetic oligonucleotide
ggtgcacgaccctcctgcgaacaagcccactatcctga

SEQ ID NO: 27945 - DNA, 38 bp, Artificial Sequence
  Synthetic oligonucleotide
tgcacattccctgagtacacttttcgtttcattcgtga

SEQ ID NO: 27946 - DNA, 37 bp, Artificial Sequence
  Synthetic oligonucleotide
tgtcatacgaaaaggggcagttgagggcagggggtga

SEQ ID NO: 27947 - DNA, 38 bp, Artificial Sequence
  Synthetic oligonucleotide
gattgaggcgggggggaaagggtgcgcgcctgggttga

SEQ ID NO: 27948 - DNA, 35 bp, Artificial Sequence
  Synthetic oligonucleotide
tgcggaccgtcaacgcccaaggcccacacacagac

SEQ ID NO: 27949 - DNA, 35 bp, Artificial Sequence
  Synthetic oligonucleotide
gctcaactggccaagatcctgtgccacttacattc

SEQ ID NO: 27950 - DNA, 35 bp, Artificial Sequence
  Synthetic oligonucleotide
gtggaggctcgtctcgtgtttgtcccttgttctcg

SEQ ID NO: 27951 - DNA, 35 bp, Artificial Sequence
  Synthetic oligonucleotide
aaaatcccaaccgcactcgtcgttactcctttggt

SEQ ID NO: 27952 - DNA, 37 bp, Artificial Sequence
  Synthetic oligonucleotide
tatgaccagcctcaccgaactcagcttttattcccga

SEQ ID NO: 27953 - DNA, 37 bp, Artificial Sequence
  Synthetic oligonucleotide
gagcacctcagggaatgggggattgggaataccagga

SEQ ID NO: 27954 - DNA, 37 bp, Artificial Sequence
  Synthetic oligonucleotide
gccatgacggagtcgcataaacccgttctttctcgga

SEQ ID NO: 27955 - DNA, 37 bp, Artificial Sequence
  Synthetic oligonucleotide
gagagaggggtagcggggttctgggaatgaagtggga

SEQ ID NO: 27956 - DNA, 38 bp, Artificial Sequence
  Synthetic oligonucleotide
acacgtcacattcgccctggtctctgcatatacactga

SEQ ID NO: 27957 - DNA, 37 bp, Artificial Sequence
  Synthetic oligonucleotide
gatacctctgcttaccgacattagacccaatctctga

SEQ ID NO: 27958 - DNA, 37 bp, Artificial Sequence
  Synthetic oligonucleotide
gacacccgttcccctctggtctactgaagacggttga

SEQ ID NO: 27959 - DNA, 36 bp, Artificial Sequence
  Synthetic oligonucleotide
gtaagcacccttactgcccatccacggccctgccta

SEQ ID NO: 27960 - DNA, 35 bp, Artificial Sequence
  Synthetic oligonucleotide
ccagctcaggacagatgccttcaccgcccaagcta

SEQ ID NO: 27961 - DNA, 36 bp, Artificial Sequence
  Synthetic oligonucleotide
attcaacgcctgctccacgtaacagccacccgatta

SEQ ID NO: 27962 - DNA, 35 bp, Artificial Sequence
  Synthetic oligonucleotide
agttgccaccgattctgacacgcccttgagtccac

SEQ ID NO: 27963 - DNA, 35 bp, Artificial Sequence
  Synthetic oligonucleotide
atcatggtagccgtgcgctttaatctcgtttcccc

SEQ ID NO: 27964 - DNA, 35 bp, Artificial Sequence
  Synthetic oligonucleotide
gtcatcaccacacttaaatgcgcgcatattcattc

SEQ ID NO: 27965 - DNA, 35 bp, Artificial Sequence
  Synthetic oligonucleotide
tcctacacttctctgctgccgtgcccaccccgctg

SEQ ID NO: 27966 - DNA, 35 bp, Artificial Sequence
  Synthetic oligonucleotide
tcaagtgacgcgagcattaatgtcctagtgcccct

SEQ ID NO: 27967 - DNA, 36 bp, Artificial Sequence
  Synthetic oligonucleotide
aactgactacctatctttgcgttttgacgacacgca

SEQ ID NO: 27968 - DNA, 36 bp, Artificial Sequence
  Synthetic oligonucleotide
accacgcaaccaacgatccctccctacagacttcga

SEQ ID NO: 27969 - DNA, 38 bp, Artificial Sequence
  Synthetic oligonucleotide
gactggtgaggggggaagaaccgcttcgggagtgatga

SEQ ID NO: 27970 - DNA, 38 bp, Artificial Sequence
  Synthetic oligonucleotide
gccacccatcatactcgtgctcagtgttggaacactga

SEQ ID NO: 27971 - DNA, 38 bp, Artificial Sequence
  Synthetic oligonucleotide
gtgcacgcaggggcgttcttccatctctctcaatgtga

SEQ ID NO: 27972 - DNA, 38 bp, Artificial Sequence
  Synthetic oligonucleotide
acacacaccccgccactaccggtttaaagcagccttga

SEQ ID NO: 27973 - DNA, 38 bp, Artificial Sequence
  Synthetic oligonucleotide
tgtcgcaccaattccctccgatgcagtttcctccttga

SEQ ID NO: 27974 - DNA, 36 bp, Artificial Sequence
  Synthetic oligonucleotide
accgatggatcagtgtccctagcctgcacgtactta

SEQ ID NO: 27975 - DNA, 35 bp, Artificial Sequence
  Synthetic oligonucleotide
gcccgatacgtgttaacatggccctatgttctttc

SEQ ID NO: 27976 - DNA, 35 bp, Artificial Sequence
  Synthetic oligonucleotide
gaccgacacagttctcctagttcatccatgtgctg

SEQ ID NO: 27977 - DNA, 36 bp, Artificial Sequence
  Synthetic oligonucleotide
tccaccccaaaccctataagccatgtcttacttgtg

SEQ ID NO: 27978 - DNA, 35 bp, Artificial Sequence
  Synthetic oligonucleotide
gaccgccctacgatagcgcaatagtttgctcctct

SEQ ID NO: 27979 - DNA, 35 bp, Artificial Sequence
  Synthetic oligonucleotide
gattggcctcaggcgcgatttttcttattccttct

SEQ ID NO: 27980 - DNA, 35 bp, Artificial Sequence
  Synthetic oligonucleotide
gatgcacgatcacccacattataaatagctgcatt

SEQ ID NO: 27981 - DNA, 35 bp, Artificial Sequence
  Synthetic oligonucleotide
tgaccctccgacacccatttgtagcgtgccagctt

SEQ ID NO: 27982 - DNA, 36 bp, Artificial Sequence
  Synthetic oligonucleotide
ttgaggggcaaggttgggaaaattctgagctgaaaa

SEQ ID NO: 27983 - DNA, 35 bp, Artificial Sequence
  Synthetic oligonucleotide
gccagactgccgttttgaatgccctttatttgcaa

SEQ ID NO: 27984 - DNA, 36 bp, Artificial Sequence
  Synthetic oligonucleotide
atagatctcactgccgataagccgctcccgttcaca

SEQ ID NO: 27985 - DNA, 35 bp, Artificial Sequence
  Synthetic oligonucleotide
acacgtaagccatctgcacgcacgcccaaacacca

SEQ ID NO: 27986 - DNA, 37 bp, Artificial Sequence
  Synthetic oligonucleotide
agaccgactctattcgctcactcccgtttaacttgga

SEQ ID NO: 27987 - DNA, 38 bp, Artificial Sequence
  Synthetic oligonucleotide
ttcaccgtcgctttcaaataacctcctgccacttatga

SEQ ID NO: 27988 - DNA, 38 bp, Artificial Sequence
  Synthetic oligonucleotide
aaacacaacagtaggcgaatagaagcgggtggaattga

SEQ ID NO: 27989 - DNA, 36 bp, Artificial Sequence
  Synthetic oligonucleotide
ccgtgtaccatctcggtgtaagcctatggtctctta

SEQ ID NO: 27990 - DNA, 35 bp, Artificial Sequence
  Synthetic oligonucleotide
tcccactcacgtctctctgtttcccctgttagtcc

SEQ ID NO: 27991 - DNA, 35 bp, Artificial Sequence
  Synthetic oligonucleotide
gccctgaccacaccacgcggagcccgctagattag

SEQ ID NO: 27992 - DNA, 35 bp, Artificial Sequence
  Synthetic oligonucleotide
aacccgctgctgttcgggttcactttcttcaaccg

SEQ ID NO: 27993 - DNA, 35 bp, Artificial Sequence
  Synthetic oligonucleotide
gcaagcacatctcttgtgctcagtacacaccactg

SEQ ID NO: 27994 - DNA, 36 bp, Artificial Sequence
  Synthetic oligonucleotide
gtgtcctccagcctagaatcgttctccttcccacga

SEQ ID NO: 27995 - DNA, 37 bp, Artificial Sequence
  Synthetic oligonucleotide
tgtatgtcggagagggtgggtgtggagcgaagtgcga

SEQ ID NO: 27996 - DNA, 37 bp, Artificial Sequence
  Synthetic oligonucleotide
agtgcgccctccgctcatgctaccaacactacttcga

SEQ ID NO: 27997 - DNA, 37 bp, Artificial Sequence
  Synthetic oligonucleotide
gcaacctcaaccacttgcttaaatacacttgcttcga

SEQ ID NO: 27998 - DNA, 37 bp, Artificial Sequence
  Synthetic oligonucleotide
gatgctggtggggtgcaagaagcgggtggtgtaggga

SEQ ID NO: 27999 - DNA, 37 bp, Artificial Sequence
  Synthetic oligonucleotide
gcaacgacccggccccgataacttccactactttgga

SEQ ID NO: 28000 - DNA, 38 bp, Artificial Sequence
  Synthetic oligonucleotide
tcttgtcaccgtccactcctgcgctaatcacttcatga

SEQ ID NO: 28001 - DNA, 37 bp, Artificial Sequence
  Synthetic oligonucleotide
gccgccccccagggtcctactaaatgcacacacgtga

SEQ ID NO: 28002 - DNA, 35 bp, Artificial Sequence
  Synthetic oligonucleotide
gatcccgttagcagtgaggggctggtggagggata

SEQ ID NO: 28003 - DNA, 36 bp, Artificial Sequence
  Synthetic oligonucleotide
gttagtgggggagggcggagagacggtcttggttta

SEQ ID NO: 28004 - DNA, 35 bp, Artificial Sequence
  Synthetic oligonucleotide
tcacgaacccccacctactggatcagtttaggtcc

SEQ ID NO: 28005 - DNA, 35 bp, Artificial Sequence
  Synthetic oligonucleotide
ttacatccccacgacgatactacggttttgcctgc

SEQ ID NO: 28006 - DNA, 35 bp, Artificial Sequence
  Synthetic oligonucleotide
gtgaatgagagtggggggtaaaaacagaggtaatt

SEQ ID NO: 28007 - DNA, 35 bp, Artificial Sequence
  Synthetic oligonucleotide
tgctacccttccccccttcataccgcgggagcgaa

SEQ ID NO: 28008 - DNA, 36 bp, Artificial Sequence
  Synthetic oligonucleotide
gtttcacctcaagctctcactgcccctcatctggaa

SEQ ID NO: 28009 - DNA, 35 bp, Artificial Sequence
  Synthetic oligonucleotide
gtgacgcacatatagaatactacgcacgtcccaca

SEQ ID NO: 28010 - DNA, 37 bp, Artificial Sequence
  Synthetic oligonucleotide
actgggggcgaagggcattggaagaggcggggagaga

SEQ ID NO: 28011 - DNA, 36 bp, Artificial Sequence
  Synthetic oligonucleotide
atcacctgaggttcatcggcactgccgcttcttcga

SEQ ID NO: 28012 - DNA, 35 bp, Artificial Sequence
  Synthetic oligonucleotide
agacactcccccatccaattcgagttcactcgtga

SEQ ID NO: 28013 - DNA, 35 bp, Artificial Sequence
  Synthetic oligonucleotide
gatctaacagggggcggaggaaagggtgtgcgata

SEQ ID NO: 28014 - DNA, 36 bp, Artificial Sequence
  Synthetic oligonucleotide
gcacgcccagcatcccccccagcatacggaaatata

SEQ ID NO: 28015 - DNA, 36 bp, Artificial Sequence
  Synthetic oligonucleotide
tcaattcacgccactcatgtactttatgctctttta

SEQ ID NO: 28016 - DNA, 36 bp, Artificial Sequence
  Synthetic oligonucleotide
gcccatcccacctaccgcctattcaggttcgtgacc

SEQ ID NO: 28017 - DNA, 35 bp, Artificial Sequence
  Synthetic oligonucleotide
ttctgacctcctgcccgcgtgactccctcttgtag

SEQ ID NO: 28018 - DNA, 35 bp, Artificial Sequence
  Synthetic oligonucleotide
actacccctcgtgtccactacagagtttcaccccg

SEQ ID NO: 28019 - DNA, 35 bp, Artificial Sequence
  Synthetic oligonucleotide
tcccatctagacccccccattgcccaggcctgccg

SEQ ID NO: 28020 - DNA, 35 bp, Artificial Sequence
  Synthetic oligonucleotide
gcaggcccctctgtcttctcccggttcgcaccttt

SEQ ID NO: 28021 - DNA, 36 bp, Artificial Sequence
  Synthetic oligonucleotide
gatacccgtcgactttttattgctgtcgaactttaa

SEQ ID NO: 28022 - DNA, 36 bp, Artificial Sequence
  Synthetic oligonucleotide
acacgcaaaccaggctcccgccgtgccaatggcaca

SEQ ID NO: 28023 - DNA, 35 bp, Artificial Sequence
  Synthetic oligonucleotide
tatcatcgacggccttcactacatcttaaacgcca

SEQ ID NO: 28024 - DNA, 36 bp, Artificial Sequence
  Synthetic oligonucleotide
tgtttcccaccgactggctatacgtatgcccaagca

SEQ ID NO: 28025 - DNA, 35 bp, Artificial Sequence
  Synthetic oligonucleotide
gcgtagccccatcatcctcagcctcctgttgaaga

SEQ ID NO: 28026 - DNA, 36 bp, Artificial Sequence
  Synthetic oligonucleotide
atgggagggggggcgtagcgcttgagagggcaagga

SEQ ID NO: 28027 - DNA, 38 bp, Artificial Sequence
  Synthetic oligonucleotide
cacacggtccaagccttagtctgctcaccaccccttga

SEQ ID NO: 28028 - DNA, 38 bp, Artificial Sequence
  Synthetic oligonucleotide
ttaggggcgggagggggttggaattgcgcagggcttga

SEQ ID NO: 28029 - DNA, 35 bp, Artificial Sequence
  Synthetic oligonucleotide
tcagttgggccaccattacctcccccgggatcatc

SEQ ID NO: 28030 - DNA, 35 bp, Artificial Sequence
  Synthetic oligonucleotide
agtaccatcacttctcgtcgataaggcttatctct

SEQ ID NO: 28031 - DNA, 35 bp, Artificial Sequence
  Synthetic oligonucleotide
gtgcttcggcacgtgccaagcccactctccacttt

SEQ ID NO: 28032 - DNA, 35 bp, Artificial Sequence
  Synthetic oligonucleotide
gatcaatctgccgccttcctgccaccccgagataa

SEQ ID NO: 28033 - DNA, 36 bp, Artificial Sequence
  Synthetic oligonucleotide
gcaagtcggtcctcccataagctgcccttcttatca

SEQ ID NO: 28034 - DNA, 37 bp, Artificial Sequence
  Synthetic oligonucleotide
gtctcccaccattgttcgtgcgttaacgtacctacga

SEQ ID NO: 28035 - DNA, 36 bp, Artificial Sequence
  Synthetic oligonucleotide
tctgaatcggacgtaccatcactgcctacaggccta

SEQ ID NO: 28036 - DNA, 35 bp, Artificial Sequence
  Synthetic oligonucleotide
ttgcgcaacacctcccagtatccggtccgctctta

SEQ ID NO: 28037 - DNA, 35 bp, Artificial Sequence
  Synthetic oligonucleotide
accaaggcgcgtggaaatcgatcgcctgtccctac

SEQ ID NO: 28038 - DNA, 35 bp, Artificial Sequence
  Synthetic oligonucleotide
gccattgtgcgactatcattcatgtccctgttacc

SEQ ID NO: 28039 - DNA, 35 bp, Artificial Sequence
  Synthetic oligonucleotide
tttgcggggctgacatcgccgtatccaacacatcc

SEQ ID NO: 28040 - DNA, 35 bp, Artificial Sequence
  Synthetic oligonucleotide
atggtcgccgtttacgagtcttgccacctaacttc

SEQ ID NO: 28041 - DNA, 35 bp, Artificial Sequence
  Synthetic oligonucleotide
actgcagaaataggggatcggaggggcgagggttg

SEQ ID NO: 28042 - DNA, 35 bp, Artificial Sequence
  Synthetic oligonucleotide
gactcgttccccgggttctcgtccactttccatgt

SEQ ID NO: 28043 - DNA, 35 bp, Artificial Sequence
  Synthetic oligonucleotide
atctcactgcaattccatctgtttctggttgccaa

SEQ ID NO: 28044 - DNA, 36 bp, Artificial Sequence
  Synthetic oligonucleotide
gcaggccctgcaatgccccgatgaaacacccacgca

SEQ ID NO: 28045 - DNA, 37 bp, Artificial Sequence
  Synthetic oligonucleotide
agcctccaatcactgctccattatgtctggtctccga

SEQ ID NO: 28046 - DNA, 36 bp, Artificial Sequence
  Synthetic oligonucleotide
aacctaccgccggtttttggtcacaccttattatga

SEQ ID NO: 28047 - DNA, 38 bp, Artificial Sequence
  Synthetic oligonucleotide
acccgacccccagtaactcctttcgtttcttcgcctga

SEQ ID NO: 28048 - DNA, 37 bp, Artificial Sequence
  Synthetic oligonucleotide
gttacgcacccgattacgagtttccgtcccatggtga

SEQ ID NO: 28049 - DNA, 37 bp, Artificial Sequence
  Synthetic oligonucleotide
tctggcgtatcacctcttgactctctcgaccctgtga

SEQ ID NO: 28050 - DNA, 38 bp, Artificial Sequence
  Synthetic oligonucleotide
accacccgccgaaatcacacaggcaacgcaatacttga

SEQ ID NO: 28051 - DNA, 38 bp, Artificial Sequence
  Synthetic oligonucleotide
ggacaccttgactgaaaccctgcacaatgccactttga

SEQ ID NO: 28052 - DNA, 35 bp, Artificial Sequence
  Synthetic oligonucleotide
accttccgcacgacccgccacagcaagacttgtcc

SEQ ID NO: 28053 - DNA, 35 bp, Artificial Sequence
  Synthetic oligonucleotide
tacccacacgaatccgttagctgcctaagcctatc

SEQ ID NO: 28054 - DNA, 35 bp, Artificial Sequence
  Synthetic oligonucleotide
gacccttctaatgctattgttcgtctgtcttgctc

SEQ ID NO: 28055 - DNA, 35 bp, Artificial Sequence
  Synthetic oligonucleotide
gtgaccccttgtgtcaccgtgtattcctgttatcg

SEQ ID NO: 28056 - DNA, 35 bp, Artificial Sequence
  Synthetic oligonucleotide
tgcccacctatcggtccctatgcagaccacctatt

SEQ ID NO: 28057 - DNA, 35 bp, Artificial Sequence
  Synthetic oligonucleotide
gcacggatgtgtgggttgttggggggggcattatt

SEQ ID NO: 28058 - DNA, 36 bp, Artificial Sequence
  Synthetic oligonucleotide
gaacaccactcgacgttattaatttcgacaaaccaa

SEQ ID NO: 28059 - DNA, 36 bp, Artificial Sequence
  Synthetic oligonucleotide
gtcataccggtcaaatcgacgcatctgcacccttca

SEQ ID NO: 28060 - DNA, 37 bp, Artificial Sequence
  Synthetic oligonucleotide
tgccatcctgccccccatatccgtttgtgtaacggga

SEQ ID NO: 28061 - DNA, 38 bp, Artificial Sequence
  Synthetic oligonucleotide
tcacgcattagccactgttcactcactccaagacatga

SEQ ID NO: 28062 - DNA, 37 bp, Artificial Sequence
  Synthetic oligonucleotide
aagcgcactctggctgtgcctcctacaatttgcctga

SEQ ID NO: 28063 - DNA, 38 bp, Artificial Sequence
  Synthetic oligonucleotide
tgaatgcacaaggatcgagacagtgagggtgtgggtga

SEQ ID NO: 28064 - DNA, 35 bp, Artificial Sequence
  Synthetic oligonucleotide
gtaacgttacgcctgtgctctttcccttttgttga

SEQ ID NO: 28065 - DNA, 36 bp, Artificial Sequence
  Synthetic oligonucleotide
tcagcccctcccattcgtttccggttcaagcgcata

SEQ ID NO: 28066 - DNA, 35 bp, Artificial Sequence
  Synthetic oligonucleotide
gtaacctacgcttgcgtactacccatatgtcccgc

SEQ ID NO: 28067 - DNA, 35 bp, Artificial Sequence
  Synthetic oligonucleotide
tgttggtcatcctgacgcccctaaagtacgtactc

SEQ ID NO: 28068 - DNA, 35 bp, Artificial Sequence
  Synthetic oligonucleotide
atggtggtgggagacgacggagagggggcacacag

SEQ ID NO: 28069 - DNA, 35 bp, Artificial Sequence
  Synthetic oligonucleotide
tgcaccgcatctccttacgatccctgtagcttgcg

SEQ ID NO: 28070 - DNA, 35 bp, Artificial Sequence
  Synthetic oligonucleotide
aagcggtggtgggcacggggaggcttaggtaattg

SEQ ID NO: 28071 - DNA, 35 bp, Artificial Sequence
  Synthetic oligonucleotide
gcgggaagggataacggggggatactgagtcacgt

SEQ ID NO: 28072 - DNA, 36 bp, Artificial Sequence
  Synthetic oligonucleotide
tcacataggggtggtactatggagagatgagccaaa

SEQ ID NO: 28073 - DNA, 35 bp, Artificial Sequence
  Synthetic oligonucleotide
gatgacgcctgtattttgcttaactcacccataga

SEQ ID NO: 28074 - DNA, 37 bp, Artificial Sequence
  Synthetic oligonucleotide
tatgtgcagccaccctcagctcactggctttcccgga

SEQ ID NO: 28075 - DNA, 36 bp, Artificial Sequence
  Synthetic oligonucleotide
gcaagccagacaccccccaccatccaattcgtcgga

SEQ ID NO: 28076 - DNA, 38 bp, Artificial Sequence
  Synthetic oligonucleotide
acacgcgctaaaaaatgccccccccagcactcggttga

SEQ ID NO: 28077 - DNA, 36 bp, Artificial Sequence
  Synthetic oligonucleotide
tgtgccacttcccaggtaccggtcgttcctctcgta

SEQ ID NO: 28078 - DNA, 36 bp, Artificial Sequence
  Synthetic oligonucleotide
gccactttcactcagtctcgaactccggtatctgta

SEQ ID NO: 28079 - DNA, 35 bp, Artificial Sequence
  Synthetic oligonucleotide
gccatgtccgagcactatgagtttgctccctcgac

SEQ ID NO: 28080 - DNA, 35 bp, Artificial Sequence
  Synthetic oligonucleotide
atgccgaggaggactgagagggggtgaccgaacgg

SEQ ID NO: 28081 - DNA, 35 bp, Artificial Sequence
  Synthetic oligonucleotide
ttgtacgtccggcttgcttctctacacacctcggg

SEQ ID NO: 28082 - DNA, 36 bp, Artificial Sequence
  Synthetic oligonucleotide
tgtccagcccacactccctacacgttcgccggacaa

SEQ ID NO: 28083 - DNA, 35 bp, Artificial Sequence
  Synthetic oligonucleotide
gcaccacctctgtgctgtgtgcacacctctcgtga

SEQ ID NO: 28084 - DNA, 38 bp, Artificial Sequence
  Synthetic oligonucleotide
gtcaaccgttctcttagcatatacgccatcctgattga

SEQ ID NO: 28085 - DNA, 38 bp, Artificial Sequence
  Synthetic oligonucleotide
tatgcccccacatgtcaacgacatatgctctaatttga

SEQ ID NO: 28086 - DNA, 38 bp, Artificial Sequence
  Synthetic oligonucleotide
gtggtagctgcctcccgtactgtttatgctccgtttga

SEQ ID NO: 28087 - DNA, 36 bp, Artificial Sequence
  Synthetic oligonucleotide
gacgctggtcctcgtccccccggtcccacctcgtta

SEQ ID NO: 28088 - DNA, 35 bp, Artificial Sequence
  Synthetic oligonucleotide
aagccccgaatagctttctccgtaacagccccaac

SEQ ID NO: 28089 - DNA, 35 bp, Artificial Sequence
  Synthetic oligonucleotide
acccgacgcaggacaatcatggggtacgtacgcac

SEQ ID NO: 28090 - DNA, 35 bp, Artificial Sequence
  Synthetic oligonucleotide
aaccgacgctctccctgtctctattgtacgctccc

SEQ ID NO: 28091 - DNA, 35 bp, Artificial Sequence
  Synthetic oligonucleotide
gtgggggccagttattaccatggaatgctcatcgc

SEQ ID NO: 28092 - DNA, 35 bp, Artificial Sequence
  Synthetic oligonucleotide
acgcatcaatctgcggaatctcgtacatctctggc

SEQ ID NO: 28093 - DNA, 35 bp, Artificial Sequence
  Synthetic oligonucleotide
gtagccctgattcacccccgccgttccacacaatc

SEQ ID NO: 28094 - DNA, 35 bp, Artificial Sequence
  Synthetic oligonucleotide
ttcgccccaagacccgctcgtttaccgcactgtag

SEQ ID NO: 28095 - DNA, 35 bp, Artificial Sequence
  Synthetic oligonucleotide
actgccagtactcatgtcttttcgctcaacgcacg

SEQ ID NO: 28096 - DNA, 35 bp, Artificial Sequence
  Synthetic oligonucleotide
accgcccctgtatgatacttgccattagtcacact

SEQ ID NO: 28097 - DNA, 35 bp, Artificial Sequence
  Synthetic oligonucleotide
tctgttcctggtgcgttgcaatagttcggtcccct

SEQ ID NO: 28098 - DNA, 35 bp, Artificial Sequence
  Synthetic oligonucleotide
gtggacctgggcccttttccgatagtttcctttgt

SEQ ID NO: 28099 - DNA, 35 bp, Artificial Sequence
  Synthetic oligonucleotide
gtggatctgcgtattccatctttgaggcccctgtt

SEQ ID NO: 28100 - DNA, 36 bp, Artificial Sequence
  Synthetic oligonucleotide
gcgttgctccacaccccgtcttaccagttcttccaa

SEQ ID NO: 28101 - DNA, 36 bp, Artificial Sequence
  Synthetic oligonucleotide
acgtactgcaatgatatttgtcaccctacccttgca

SEQ ID NO: 28102 - DNA, 37 bp, Artificial Sequence
  Synthetic oligonucleotide
gttggtgcacacatcgccgttttcctccccgcacgga

SEQ ID NO: 28103 - DNA, 35 bp, Artificial Sequence
  Synthetic oligonucleotide
attggaggaaatgaggtgaggtggaaaaggtggga

SEQ ID NO: 28104 - DNA, 37 bp, Artificial Sequence
  Synthetic oligonucleotide
gactgtatgcccattgttgtcccccactataccttga

SEQ ID NO: 28105 - DNA, 38 bp, Artificial Sequence
  Synthetic oligonucleotide
ggtgggggcgggggcggataggtatatcacggttttga

SEQ ID NO: 28106 - DNA, 35 bp, Artificial Sequence
  Synthetic oligonucleotide
attgctcacgtgccatgccatcggtctttactcta

SEQ ID NO: 28107 - DNA, 35 bp, Artificial Sequence
  Synthetic oligonucleotide
ttcccgcactgcatagctgcaacactctagggccc

SEQ ID NO: 28108 - DNA, 35 bp, Artificial Sequence
  Synthetic oligonucleotide
accatcccgcccctggctcttctccagagttggcc

SEQ ID NO: 28109 - DNA, 35 bp, Artificial Sequence
  Synthetic oligonucleotide
gcctgtcacctcgcccatgatgttcgtccgcatcc

SEQ ID NO: 28110 - DNA, 35 bp, Artificial Sequence
  Synthetic oligonucleotide
tgtgtgccactccaacccttgcgcctccaccctag

SEQ ID NO: 28111 - DNA, 35 bp, Artificial Sequence
  Synthetic oligonucleotide
gatcgggtaaccacctcagcccctcatccctatcg

SEQ ID NO: 28112 - DNA, 35 bp, Artificial Sequence
  Synthetic oligonucleotide
accgaaacacgccggggttctcctttctcctccat

SEQ ID NO: 28113 - DNA, 35 bp, Artificial Sequence
  Synthetic oligonucleotide
gcacccccctctgtgcaatcttctactgtaggtat

SEQ ID NO: 28114 - DNA, 35 bp, Artificial Sequence
  Synthetic oligonucleotide
gtgacatgccgttagggctagtttgtgctccccct

SEQ ID NO: 28115 - DNA, 35 bp, Artificial Sequence
  Synthetic oligonucleotide
ccagccccagccgcgccccagcatttttacaccgt

SEQ ID NO: 28116 - DNA, 35 bp, Artificial Sequence
  Synthetic oligonucleotide
ttactgacccagcctactcgactgccgcacccaca

SEQ ID NO: 28117 - DNA, 36 bp, Artificial Sequence
  Synthetic oligonucleotide
tacgagcccaacgccccgactcctggcggttcacca

SEQ ID NO: 28118 - DNA, 36 bp, Artificial Sequence
  Synthetic oligonucleotide
ggtcacccccagtcctcttcgtacaccctgcgatca

SEQ ID NO: 28119 - DNA, 37 bp, Artificial Sequence
  Synthetic oligonucleotide
gcaacatcaaacgccgccttacatggtcaaccgagga

SEQ ID NO: 28120 - DNA, 37 bp, Artificial Sequence
  Synthetic oligonucleotide
gccgaggggggagcaaattttggaagggcagacgtga

SEQ ID NO: 28121 - DNA, 38 bp, Artificial Sequence
  Synthetic oligonucleotide
ttcaccaccgaaccagtttctttcgttttgccacttga

SEQ ID NO: 28122 - DNA, 37 bp, Artificial Sequence
  Synthetic oligonucleotide
aacaccgcctcccttcgatctgctaacctggtgttga

SEQ ID NO: 28123 - DNA, 35 bp, Artificial Sequence
  Synthetic oligonucleotide
gttacgttcgccccttggtcccctttataacggta

SEQ ID NO: 28124 - DNA, 36 bp, Artificial Sequence
  Synthetic oligonucleotide
gtctagcaacacctgcgcctattttctgctgattta

SEQ ID NO: 28125 - DNA, 35 bp, Artificial Sequence
  Synthetic oligonucleotide
gggtcacgtactgacaatatatctcacctttcacc

SEQ ID NO: 28126 - DNA, 35 bp, Artificial Sequence
  Synthetic oligonucleotide
ttgtcccttacgtcctctatttcagcggttcgccc

SEQ ID NO: 28127 - DNA, 35 bp, Artificial Sequence
  Synthetic oligonucleotide
gccttgcgcctcacctcctcgaatcaactgcatcc

SEQ ID NO: 28128 - DNA, 35 bp, Artificial Sequence
  Synthetic oligonucleotide
aacgcggagacacttcagcgaccgtccccgtatcc

SEQ ID NO: 28129 - DNA, 35 bp, Artificial Sequence
  Synthetic oligonucleotide
ttgtagcccgcctacccaccgccaccgattcatgc

SEQ ID NO: 28130 - DNA, 35 bp, Artificial Sequence
  Synthetic oligonucleotide
tcatcgaggccgcctcccgaatttgtccattggtc

SEQ ID NO: 28131 - DNA, 35 bp, Artificial Sequence
  Synthetic oligonucleotide
tctaccctgctctcatgggatgcctgatataccct

SEQ ID NO: 28132 - DNA, 35 bp, Artificial Sequence
  Synthetic oligonucleotide
gacgcctgctctcatcgtatctctagtatcacgct

SEQ ID NO: 28133 - DNA, 35 bp, Artificial Sequence
  Synthetic oligonucleotide
aacgtccgcatgcgagcccttcccgattacactgt

SEQ ID NO: 28134 - DNA, 35 bp, Artificial Sequence
  Synthetic oligonucleotide
tgtatcccagccttctctcgccgagtcgcagtttt

SEQ ID NO: 28135 - DNA, 36 bp, Artificial Sequence
  Synthetic oligonucleotide
accacgcagtctttgaaactttgcgcttgacctaaa

SEQ ID NO: 28136 - DNA, 36 bp, Artificial Sequence
  Synthetic oligonucleotide
tccacacccatggttgttataccactcttaggataa

SEQ ID NO: 28137 - DNA, 35 bp, Artificial Sequence
  Synthetic oligonucleotide
attcccctacgcagatcttaaaatatccctaccca

SEQ ID NO: 28138 - DNA, 36 bp, Artificial Sequence
  Synthetic oligonucleotide
gccccggctgtccttttaaatactgcacctacgcca

SEQ ID NO: 28139 - DNA, 36 bp, Artificial Sequence
  Synthetic oligonucleotide
tggtcaactgtccgacactcccacagccctgcctca

SEQ ID NO: 28140 - DNA, 37 bp, Artificial Sequence
  Synthetic oligonucleotide
tcacaaacatcaaacccatggagcctctcgtgaacga

SEQ ID NO: 28141 - DNA, 36 bp, Artificial Sequence
  Synthetic oligonucleotide
tcgctccacgctgcgtttacttacaattgccaccga

SEQ ID NO: 28142 - DNA, 38 bp, Artificial Sequence
  Synthetic oligonucleotide
gtggccaccactctgtattctgtgcacacaaccactga

SEQ ID NO: 28143 - DNA, 38 bp, Artificial Sequence
  Synthetic oligonucleotide
actgtagggggggggaagtaactgagcacgggaggtga

SEQ ID NO: 28144 - DNA, 36 bp, Artificial Sequence
  Synthetic oligonucleotide
gccatcccactgcaaacaactagtcaaacttcgtta

SEQ ID NO: 28145 - DNA, 35 bp, Artificial Sequence
  Synthetic oligonucleotide
ataggccctcctgcttgtaactccctgcgctagcc

SEQ ID NO: 28146 - DNA, 35 bp, Artificial Sequence
  Synthetic oligonucleotide
gggggaggggcaacaggttcgtagggaggaaggcc

SEQ ID NO: 28147 - DNA, 35 bp, Artificial Sequence
  Synthetic oligonucleotide
tcacgtgacccgcgctttcactgattccacacttc

SEQ ID NO: 28148 - DNA, 35 bp, Artificial Sequence
  Synthetic oligonucleotide
acactcccgggggtaatacctctctcgcttaaacg

SEQ ID NO: 28149 - DNA, 35 bp, Artificial Sequence
  Synthetic oligonucleotide
atgcccaccgagtagcacttgccacgtctcgcccg

SEQ ID NO: 28150 - DNA, 35 bp, Artificial Sequence
  Synthetic oligonucleotide
tcgattcaccctccatattatctgggtcattccat

SEQ ID NO: 28151 - DNA, 36 bp, Artificial Sequence
  Synthetic oligonucleotide
tgccttgtcccccgcttttcctccgtcgccttgcca

SEQ ID NO: 28152 - DNA, 36 bp, Artificial Sequence
  Synthetic oligonucleotide
tcgatccgtacattgacttccacctatagacatgca

SEQ ID NO: 28153 - DNA, 35 bp, Artificial Sequence
  Synthetic oligonucleotide
tagtacctcacacactcatgattcgccacggatca

SEQ ID NO: 28154 - DNA, 36 bp, Artificial Sequence
  Synthetic oligonucleotide
gcgaacgtagctctgcggagtctcataccattctca

SEQ ID NO: 28155 - DNA, 36 bp, Artificial Sequence
  Synthetic oligonucleotide
tccacatcttgtgtccggggcactcctaatacttca

SEQ ID NO: 28156 - DNA, 36 bp, Artificial Sequence
  Synthetic oligonucleotide
accacgccggttccctagttccaacctaattctcga

SEQ ID NO: 28157 - DNA, 38 bp, Artificial Sequence
  Synthetic oligonucleotide
gcccaggtcacagcgacatatttttcaccaccttctga

SEQ ID NO: 28158 - DNA, 38 bp, Artificial Sequence
  Synthetic oligonucleotide
ggaccctctggtacctctatctgtgcctccatacttga

SEQ ID NO: 28159 - DNA, 36 bp, Artificial Sequence
  Synthetic oligonucleotide
gcagagggtcgtcagtactttccgttcccactgtta

SEQ ID NO: 28160 - DNA, 34 bp, Artificial Sequence
  Synthetic oligonucleotide
gaaatcccgcctaccacgctgcactccaggaaac

SEQ ID NO: 28161 - DNA, 35 bp, Artificial Sequence
  Synthetic oligonucleotide
acgccatgtatcatcgctagtccatcgagccttcc

SEQ ID NO: 28162 - DNA, 35 bp, Artificial Sequence
  Synthetic oligonucleotide
gcgatgagaacgatcggctttacctctgccccagc

SEQ ID NO: 28163 - DNA, 35 bp, Artificial Sequence
  Synthetic oligonucleotide
acgaacgttgccctgatgtttcgctcacctctatc

SEQ ID NO: 28164 - DNA, 35 bp, Artificial Sequence
  Synthetic oligonucleotide
gtcggttggccgctctttccgtctcctggcatttc

SEQ ID NO: 28165 - DNA, 35 bp, Artificial Sequence
  Synthetic oligonucleotide
gagggagggacaagaaaggagtagcacttcgtgag

SEQ ID NO: 28166 - DNA, 35 bp, Artificial Sequence
  Synthetic oligonucleotide
ttcagccccttgcattgctatgacgtctttatcct

SEQ ID NO: 28167 - DNA, 35 bp, Artificial Sequence
  Synthetic oligonucleotide
ttccgcgccatcctggttctcgcctttaaactgct

SEQ ID NO: 28168 - DNA, 35 bp, Artificial Sequence
  Synthetic oligonucleotide
gacaacggacttatgggagtgcggggaaaggaggt

SEQ ID NO: 28169 - DNA, 35 bp, Artificial Sequence
  Synthetic oligonucleotide
gtgaccgctgaggagaaatctatgatggagggggt

SEQ ID NO: 28170 - DNA, 36 bp, Artificial Sequence
  Synthetic oligonucleotide
ggaatggactggtggagcataaggaagagggggtaa

SEQ ID NO: 28171 - DNA, 36 bp, Artificial Sequence
  Synthetic oligonucleotide
gttgtcgcagtaaaacacgtactgaaggacgccaca

SEQ ID NO: 28172 - DNA, 37 bp, Artificial Sequence
  Synthetic oligonucleotide
gccctcacatgtatgattatgctatccctctgccaga

SEQ ID NO: 28173 - DNA, 35 bp, Artificial Sequence
  Synthetic oligonucleotide
gaaggaagggcaggctgacaaggcgggaacaacga

SEQ ID NO: 28174 - DNA, 36 bp, Artificial Sequence
  Synthetic oligonucleotide
gaccgccacgattcttcatgccccccatcggttgga

SEQ ID NO: 28175 - DNA, 37 bp, Artificial Sequence
  Synthetic oligonucleotide
gtgtcctacccccccactgcattgaacactctcctga

SEQ ID NO: 28176 - DNA, 38 bp, Artificial Sequence
  Synthetic oligonucleotide
ttccgggggaggggtgagagctgggaatgatcagttga

SEQ ID NO: 28177 - DNA, 35 bp, Artificial Sequence
  Synthetic oligonucleotide
tgttctgacccccctatgcgtccatctattgctta

SEQ ID NO: 28178 - DNA, 35 bp, Artificial Sequence
  Synthetic oligonucleotide
atccgacttgaccacaaccgatcactgtataattc

SEQ ID NO: 28179 - DNA, 35 bp, Artificial Sequence
  Synthetic oligonucleotide
gacacacggggtcccccactgcccaccctccccgg

SEQ ID NO: 28180 - DNA, 36 bp, Artificial Sequence
  Synthetic oligonucleotide
gaaggagagggcgaacgggagggacaggaacgacaa

SEQ ID NO: 28181 - DNA, 36 bp, Artificial Sequence
  Synthetic oligonucleotide
gggttgtcggaggagggaggcggggtggcatgtaca

SEQ ID NO: 28182 - DNA, 36 bp, Artificial Sequence
  Synthetic oligonucleotide
ttcaaccatcccgcccttttggagtagtaaccttca

SEQ ID NO: 28183 - DNA, 37 bp, Artificial Sequence
  Synthetic oligonucleotide
gagggacagggcgggtggcgacgagtaagactgaaga

SEQ ID NO: 28184 - DNA, 37 bp, Artificial Sequence
  Synthetic oligonucleotide
gtcaccatcgtaacccgagccgcaatctctctctcga

SEQ ID NO: 28185 - DNA, 37 bp, Artificial Sequence
  Synthetic oligonucleotide
acgtgatagtgggccgaggtggaaggatggttcagga

SEQ ID NO: 28186 - DNA, 38 bp, Artificial Sequence
  Synthetic oligonucleotide
gacgctcccaacctcagtttgcacttttgctcccatga

SEQ ID NO: 28187 - DNA, 38 bp, Artificial Sequence
  Synthetic oligonucleotide
ttgtcccacagtcagatatcccaccacctaccaactga

SEQ ID NO: 28188 - DNA, 37 bp, Artificial Sequence
  Synthetic oligonucleotide
ccctcagtcccgattcggcctcacgctcatcccttga

SEQ ID NO: 28189 - DNA, 38 bp, Artificial Sequence
  Synthetic oligonucleotide
acccgctgcccactattgagcccgtgtttcatttttga

SEQ ID NO: 28190 - DNA, 36 bp, Artificial Sequence
  Synthetic oligonucleotide
acaacccatactgccaccaatcgttatgtagttcta

SEQ ID NO: 28191 - DNA, 35 bp, Artificial Sequence
  Synthetic oligonucleotide
tgaccattgcgccacgtcacctttcccgaccacac

SEQ ID NO: 28192 - DNA, 35 bp, Artificial Sequence
  Synthetic oligonucleotide
atgctcaggaacagtaagtgctgccaccctacccc

SEQ ID NO: 28193 - DNA, 35 bp, Artificial Sequence
  Synthetic oligonucleotide
tccgattccctcacctcatggagctcctgtccttg

SEQ ID NO: 28194 - DNA, 35 bp, Artificial Sequence
  Synthetic oligonucleotide
atcaaagggcatacacactcgcctggtccactaat

SEQ ID NO: 28195 - DNA, 35 bp, Artificial Sequence
  Synthetic oligonucleotide
tcagcattgccgtgagcgcactttcttccacaact

SEQ ID NO: 28196 - DNA, 35 bp, Artificial Sequence
  Synthetic oligonucleotide
accagcaagaagccgttccgctggcccgctcccct

SEQ ID NO: 28197 - DNA, 35 bp, Artificial Sequence
  Synthetic oligonucleotide
tccaaacaccgtgccccgttggaaaactcattctt

SEQ ID NO: 28198 - DNA, 36 bp, Artificial Sequence
  Synthetic oligonucleotide
aatcagtgtccccgaatgtttctcgccgcctttcca

SEQ ID NO: 28199 - DNA, 35 bp, Artificial Sequence
  Synthetic oligonucleotide
tcccccccggtgccgacctagcttgcgtacatgca

SEQ ID NO: 28200 - DNA, 36 bp, Artificial Sequence
  Synthetic oligonucleotide
tcacagaccctgccctaagtcgaatgacggatatca

SEQ ID NO: 28201 - DNA, 37 bp, Artificial Sequence
  Synthetic oligonucleotide
gtggtggtaagtgcaggagggtgagggaatcttgaga

SEQ ID NO: 28202 - DNA, 37 bp, Artificial Sequence
  Synthetic oligonucleotide
gccatgccctgtactgtcctctatgagtctagctaga

SEQ ID NO: 28203 - DNA, 37 bp, Artificial Sequence
  Synthetic oligonucleotide
tgccaccccccctagtgattcggtttcgtgttagcga

SEQ ID NO: 28204 - DNA, 37 bp, Artificial Sequence
  Synthetic oligonucleotide
taactgtccgccctcgcttcacttgcccaccctgcga

SEQ ID NO: 28205 - DNA, 37 bp, Artificial Sequence
  Synthetic oligonucleotide
tgaaacgtgggggccaggggggtaggtagagtgagga

SEQ ID NO: 28206 - DNA, 35 bp, Artificial Sequence
  Synthetic oligonucleotide
atgggcggctggggggggagatatttgggtacgga

SEQ ID NO: 28207 - DNA, 37 bp, Artificial Sequence
  Synthetic oligonucleotide
tatgacacgccctctccggtggtaggaatctcctgga

SEQ ID NO: 28208 - DNA, 36 bp, Artificial Sequence
  Synthetic oligonucleotide
accgatcccttccaacgacctgttgtctccctctta

SEQ ID NO: 28209 - DNA, 35 bp, Artificial Sequence
  Synthetic oligonucleotide
taggatcccgcccctttgacagtgcattccttcac

SEQ ID NO: 28210 - DNA, 35 bp, Artificial Sequence
  Synthetic oligonucleotide
aattcagcccggtcgcttttatccttgtcacttac

SEQ ID NO: 28211 - DNA, 35 bp, Artificial Sequence
  Synthetic oligonucleotide
gccactgccccccccatacatcgggttctatgacc

SEQ ID NO: 28212 - DNA, 35 bp, Artificial Sequence
  Synthetic oligonucleotide
ttaggcgccgccgttttactgtatccgttatctcc

SEQ ID NO: 28213 - DNA, 35 bp, Artificial Sequence
  Synthetic oligonucleotide
accagttacaacactgccgaccatgtcgtgagtcc

SEQ ID NO: 28214 - DNA, 35 bp, Artificial Sequence
  Synthetic oligonucleotide
cccaccagggacctctgctattgccattccagttc

SEQ ID NO: 28215 - DNA, 35 bp, Artificial Sequence
  Synthetic oligonucleotide
tgagatcgccttactgtcattgctatctacttcct

SEQ ID NO: 28216 - DNA, 35 bp, Artificial Sequence
  Synthetic oligonucleotide
atgaacaggcatctacacgcaatctgaccctactt

SEQ ID NO: 28217 - DNA, 36 bp, Artificial Sequence
  Synthetic oligonucleotide
ttccacacacgccgcacccctcagctccgtgcgtaa

SEQ ID NO: 28218 - DNA, 37 bp, Artificial Sequence
  Synthetic oligonucleotide
gaagccggggagcctaaggaaagggagggggaaccga

SEQ ID NO: 28219 - DNA, 38 bp, Artificial Sequence
  Synthetic oligonucleotide
tacgacactgtctctgttgtcgccacctaaacccttga

SEQ ID NO: 28220 - DNA, 36 bp, Artificial Sequence
  Synthetic oligonucleotide
tattccgctcgacctagctttagacgcccatccata

SEQ ID NO: 28221 - DNA, 36 bp, Artificial Sequence
  Synthetic oligonucleotide
gacaacagcggaattaaagggcggggggattaccta

SEQ ID NO: 28222 - DNA, 35 bp, Artificial Sequence
  Synthetic oligonucleotide
gttgcactccacacccgcactaagggtaagggccc

SEQ ID NO: 28223 - DNA, 35 bp, Artificial Sequence
  Synthetic oligonucleotide
actatcccggcccatgctgtcgtaggctcgcaatc

SEQ ID NO: 28224 - DNA, 35 bp, Artificial Sequence
  Synthetic oligonucleotide
ggacacgcaccccactatcaatgaataaacgcacg

SEQ ID NO: 28225 - DNA, 35 bp, Artificial Sequence
  Synthetic oligonucleotide
ttccgccacgtcctaattcccgttcacgtcgttcg

SEQ ID NO: 28226 - DNA, 35 bp, Artificial Sequence
  Synthetic oligonucleotide
gcgaaagccttccttcaccgttatcccgctccctg

SEQ ID NO: 28227 - DNA, 35 bp, Artificial Sequence
  Synthetic oligonucleotide
tgtcccgtcgccacacatcactgaattctgccggt

SEQ ID NO: 28228 - DNA, 35 bp, Artificial Sequence
  Synthetic oligonucleotide
gttgaccgcctgaatcctcgttgaagtcctactgt

SEQ ID NO: 28229 - DNA, 35 bp, Artificial Sequence
  Synthetic oligonucleotide
gggccccctcccgatcgagcaccttctctcagcaa

SEQ ID NO: 28230 - DNA, 36 bp, Artificial Sequence
  Synthetic oligonucleotide
tccctgccctacaattggcttcttttctaccaggaa

SEQ ID NO: 28231 - DNA, 36 bp, Artificial Sequence
  Synthetic oligonucleotide
tgccgatccgcgcactattctctttccacgtctaca

SEQ ID NO: 28232 - DNA, 35 bp, Artificial Sequence
  Synthetic oligonucleotide
ggacctccccctatcttatgtgcgactaagcacca

SEQ ID NO: 28233 - DNA, 35 bp, Artificial Sequence
  Synthetic oligonucleotide
tcatactcatactgccctagttccatcagcttgca

SEQ ID NO: 28234 - DNA, 36 bp, Artificial Sequence
  Synthetic oligonucleotide
atgaccctacgcgtgctaaaagctttcgcaacacta

SEQ ID NO: 28235 - DNA, 35 bp, Artificial Sequence
  Synthetic oligonucleotide
tccagcctcaagatcggcctgctataacccgccac

SEQ ID NO: 28236 - DNA, 35 bp, Artificial Sequence
  Synthetic oligonucleotide
ttgcgggccgctatcacccaccttatttcgatccc

SEQ ID NO: 28237 - DNA, 35 bp, Artificial Sequence
  Synthetic oligonucleotide
ggactgacgccattctcattcgtacggaaatatcc

SEQ ID NO: 28238 - DNA, 35 bp, Artificial Sequence
  Synthetic oligonucleotide
ggagtggccacatgtcgggagggggaggggtggag

SEQ ID NO: 28239 - DNA, 35 bp, Artificial Sequence
  Synthetic oligonucleotide
agtatccatcgtcgccattcttactcctgtccacg

SEQ ID NO: 28240 - DNA, 35 bp, Artificial Sequence
  Synthetic oligonucleotide
atcccatcttcccccgtccccctttgaggtcatcg

SEQ ID NO: 28241 - DNA, 35 bp, Artificial Sequence
  Synthetic oligonucleotide
actcccttccgtgacatctgcgcaacaatttttgg

SEQ ID NO: 28242 - DNA, 35 bp, Artificial Sequence
  Synthetic oligonucleotide
acacccggagattgatcctggcaaatacctaccct

SEQ ID NO: 28243 - DNA, 35 bp, Artificial Sequence
  Synthetic oligonucleotide
gccatcggtggatttgctttgtccgccgctcccca

SEQ ID NO: 28244 - DNA, 36 bp, Artificial Sequence
  Synthetic oligonucleotide
tgctgctccataccactggaacgcgctatgctctca

SEQ ID NO: 28245 - DNA, 36 bp, Artificial Sequence
  Synthetic oligonucleotide
tcccattatcctatcgcactcgccaccgcacttgga

SEQ ID NO: 28246 - DNA, 38 bp, Artificial Sequence
  Synthetic oligonucleotide
gacgaagtcacggcatcccaaaacgtgggtgggactga

SEQ ID NO: 28247 - DNA, 35 bp, Artificial Sequence
  Synthetic oligonucleotide
gcctcacaggtcccatcgagttgttcgcctcctga

SEQ ID NO: 28248 - DNA, 38 bp, Artificial Sequence
  Synthetic oligonucleotide
accatcagcacatgaatcagcacatccatatcccttga

SEQ ID NO: 28249 - DNA, 38 bp, Artificial Sequence
  Synthetic oligonucleotide
tcagtccaccaatcgattattcactgtacgtgccttga

SEQ ID NO: 28250 - DNA, 37 bp, Artificial Sequence
  Synthetic oligonucleotide
gtaccctgcaacgtgtcgttgttacctcctcctttga

SEQ ID NO: 28251 - DNA, 38 bp, Artificial Sequence
  Synthetic oligonucleotide
gacagaccacgaacgtggggggataggggtgggtttga

SEQ ID NO: 28252 - DNA, 36 bp, Artificial Sequence
  Synthetic oligonucleotide
ttcacaccccacgcacaacggtatagccaaaggcta

SEQ ID NO: 28253 - DNA, 35 bp, Artificial Sequence
  Synthetic oligonucleotide
gaagtcaggagggcacgtgggtcctgaaactggta

SEQ ID NO: 28254 - DNA, 35 bp, Artificial Sequence
  Synthetic oligonucleotide
gtcgctcttcggcctcgacctctacctgagccccc

SEQ ID NO: 28255 - DNA, 35 bp, Artificial Sequence
  Synthetic oligonucleotide
acgaacccgcaatcctccgttgcagccttgcatgc

SEQ ID NO: 28256 - DNA, 35 bp, Artificial Sequence
  Synthetic oligonucleotide
tgctcctggtccacatcattacactagtccacccg

SEQ ID NO: 28257 - DNA, 35 bp, Artificial Sequence
  Synthetic oligonucleotide
tcatacgggtggggtgggccggctatcataggggt

SEQ ID NO: 28258 - DNA, 37 bp, Artificial Sequence
  Synthetic oligonucleotide
gcatcgagtcagggtccccttcgcttctgccttccga

SEQ ID NO: 28259 - DNA, 37 bp, Artificial Sequence
  Synthetic oligonucleotide
tgagggtgatagggtaagggggtcgtaagtgacagga

SEQ ID NO: 28260 - DNA, 37 bp, Artificial Sequence
  Synthetic oligonucleotide
taggggcaatgaggcaaatagggtgagggattcggga

SEQ ID NO: 28261 - DNA, 38 bp, Artificial Sequence
  Synthetic oligonucleotide
gagggggagacagggtagggctaatgagtggaatgtga

SEQ ID NO: 28262 - DNA, 35 bp, Artificial Sequence
  Synthetic oligonucleotide
acttcgccacctttcgttccagcgcaaactggaac

SEQ ID NO: 28263 - DNA, 35 bp, Artificial Sequence
  Synthetic oligonucleotide
tccaccactacatcaggcttccgcgctcctgaccc

SEQ ID NO: 28264 - DNA, 35 bp, Artificial Sequence
  Synthetic oligonucleotide
tgccatttctcattcccgtatctggtttcgttgcc

SEQ ID NO: 28265 - DNA, 35 bp, Artificial Sequence
  Synthetic oligonucleotide
gaaacgaggcctcttcttgtcctatcgaaaacctc

SEQ ID NO: 28266 - DNA, 35 bp, Artificial Sequence
  Synthetic oligonucleotide
gtgctggccgcttctaccgagcatctttgcaattc

SEQ ID NO: 28267 - DNA, 34 bp, Artificial Sequence
  Synthetic oligonucleotide
gtccagcatcccccaaccccatgcacggttaccg

SEQ ID NO: 28268 - DNA, 34 bp, Artificial Sequence
  Synthetic oligonucleotide
ccatcccaacatgcgcgacaagcgatctcctggg

SEQ ID NO: 28269 - DNA, 35 bp, Artificial Sequence
  Synthetic oligonucleotide
actctgccgctccctaccccgtctctggagatatg

SEQ ID NO: 28270 - DNA, 35 bp, Artificial Sequence
  Synthetic oligonucleotide
taccacgcctagcccccgctagtttgctacaatct

SEQ ID NO: 28271 - DNA, 36 bp, Artificial Sequence
  Synthetic oligonucleotide
tgctacctctgctaaactctttgggcccagaaccaa

SEQ ID NO: 28272 - DNA, 36 bp, Artificial Sequence
  Synthetic oligonucleotide
tgcacctacgacgaatcgttgttcatttccttgcca

SEQ ID NO: 28273 - DNA, 36 bp, Artificial Sequence
  Synthetic oligonucleotide
tctcacaccgtggttccaaagtttggttgactctca

SEQ ID NO: 28274 - DNA, 36 bp, Artificial Sequence
  Synthetic oligonucleotide
taagggaaccgtccaaccaatatagtcccgttctca

SEQ ID NO: 28275 - DNA, 37 bp, Artificial Sequence
  Synthetic oligonucleotide
gacatgcccagctaatagcgcgccaaactgaccacga

SEQ ID NO: 28276 - DNA, 35 bp, Artificial Sequence
  Synthetic oligonucleotide
tgtacagttgagggcggaacgagggaaagggcgga

SEQ ID NO: 28277 - DNA, 37 bp, Artificial Sequence
  Synthetic oligonucleotide
taccacgtgcctctcgtttttgctcggtcctccatga

SEQ ID NO: 28278 - DNA, 35 bp, Artificial Sequence
  Synthetic oligonucleotide
tcgcaatgcaagttgccacctgcctcacctagcta

SEQ ID NO: 28279 - DNA, 36 bp, Artificial Sequence
  Synthetic oligonucleotide
ttgcactgccataaacccacacctagcagcctgcta

SEQ ID NO: 28280 - DNA, 35 bp, Artificial Sequence
  Synthetic oligonucleotide
tttagccccagcagctcatcaagctttccatgcac

SEQ ID NO: 28281 - DNA, 35 bp, Artificial Sequence
  Synthetic oligonucleotide
tcgagcgaccacccatctgcccaagtaaaccaacc

SEQ ID NO: 28282 - DNA, 35 bp, Artificial Sequence
  Synthetic oligonucleotide
ttacacctgccccctccctgctccgtttcgggccc

SEQ ID NO: 28283 - DNA, 35 bp, Artificial Sequence
  Synthetic oligonucleotide
atagcgagtgcccactgccacttccggttactaat

SEQ ID NO: 28284 - DNA, 36 bp, Artificial Sequence
  Synthetic oligonucleotide
tcaccttgccatagctttgcgtgttatcccctgaaa

SEQ ID NO: 28285 - DNA, 36 bp, Artificial Sequence
  Synthetic oligonucleotide
tgttcccgaaccccttgccatagttgaagcaccaca

SEQ ID NO: 28286 - DNA, 36 bp, Artificial Sequence
  Synthetic oligonucleotide
gctgtgtcacattcgcttgctctaactgttttatca

SEQ ID NO: 28287 - DNA, 37 bp, Artificial Sequence
  Synthetic oligonucleotide
gcaccgtgcaaaacagttcccacacaccgtcccccga

SEQ ID NO: 28288 - DNA, 37 bp, Artificial Sequence
  Synthetic oligonucleotide
atcaaaacaagtgtatccgggcagggcacgggaggga

SEQ ID NO: 28289 - DNA, 37 bp, Artificial Sequence
  Synthetic oligonucleotide
gtcatccgtggtctatttgcaccaccccacttgctga

SEQ ID NO: 28290 - DNA, 37 bp, Artificial Sequence
  Synthetic oligonucleotide
agtggtgtgagggggagttctcaagaaaaggaagtga

SEQ ID NO: 28291 - DNA, 38 bp, Artificial Sequence
  Synthetic oligonucleotide
tccgccggatgaagcggaatgccctgcccgacccgtga

SEQ ID NO: 28292 - DNA, 36 bp, Artificial Sequence
  Synthetic oligonucleotide
agccgggaggaatggatggggttcgtggagggatta

SEQ ID NO: 28293 - DNA, 35 bp, Artificial Sequence
  Synthetic oligonucleotide
tccaccccctcccgatactgcattgtggggttcac

SEQ ID NO: 28294 - DNA, 35 bp, Artificial Sequence
  Synthetic oligonucleotide
tgcaaacccttctccccacgcccataacttacgcc

SEQ ID NO: 28295 - DNA, 35 bp, Artificial Sequence
  Synthetic oligonucleotide
gttgccatagtttgcccatacccatacctcgatcc

SEQ ID NO: 28296 - DNA, 35 bp, Artificial Sequence
  Synthetic oligonucleotide
ttcaccgccaagatagactttcttactctcccatc

SEQ ID NO: 28297 - DNA, 35 bp, Artificial Sequence
  Synthetic oligonucleotide
acactctccgtctccctttcgtcgtcgcctaacat

SEQ ID NO: 28298 - DNA, 35 bp, Artificial Sequence
  Synthetic oligonucleotide
tggtacggtcgcgctcgtccttcttctggcttact

SEQ ID NO: 28299 - DNA, 36 bp, Artificial Sequence
  Synthetic oligonucleotide
gtgccccccccgcatcggtcccaaccggaactccca

SEQ ID NO: 28300 - DNA, 36 bp, Artificial Sequence
  Synthetic oligonucleotide
atgccgcccagttcccgacttagccccactgtccca

SEQ ID NO: 28301 - DNA, 35 bp, Artificial Sequence
  Synthetic oligonucleotide
tcgagagccatatcatctgaatctctgctttgcca

SEQ ID NO: 28302 - DNA, 36 bp, Artificial Sequence
  Synthetic oligonucleotide
gtcaatcgcaaatttctatcctacgtcgccaatgca

SEQ ID NO: 28303 - DNA, 37 bp, Artificial Sequence
  Synthetic oligonucleotide
atgcccggtggctggtggagcgggatagcttagggga

SEQ ID NO: 28304 - DNA, 37 bp, Artificial Sequence
  Synthetic oligonucleotide
atattgccacgctcgcaccatgccctcttacattgga

SEQ ID NO: 28305 - DNA, 37 bp, Artificial Sequence
  Synthetic oligonucleotide
gccccgcccaggtccgtctgctcgctctgttacctga

SEQ ID NO: 28306 - DNA, 38 bp, Artificial Sequence
  Synthetic oligonucleotide
gccatgtccgggtcttctggcaactcctctcttcctga

SEQ ID NO: 28307 - DNA, 38 bp, Artificial Sequence
  Synthetic oligonucleotide
aatgagggagggggggtgaaggttgtcactaccagtga

SEQ ID NO: 28308 - DNA, 38 bp, Artificial Sequence
  Synthetic oligonucleotide
taggatgggatgaaaggtgtgggtgtaaagaggagtga

SEQ ID NO: 28309 - DNA, 38 bp, Artificial Sequence
  Synthetic oligonucleotide
ttcaccacccgatcgcagctctctcaacatcacgttga

SEQ ID NO: 28310 - DNA, 35 bp, Artificial Sequence
  Synthetic oligonucleotide
aacaccactatcggcatagcgaactcaattgccac

SEQ ID NO: 28311 - DNA, 35 bp, Artificial Sequence
  Synthetic oligonucleotide
tctaccatcaccgtagcccccccatattagactac

SEQ ID NO: 28312 - DNA, 35 bp, Artificial Sequence
  Synthetic oligonucleotide
atcagggccctatccactccgctacgcctagtccc

SEQ ID NO: 28313 - DNA, 35 bp, Artificial Sequence
  Synthetic oligonucleotide
taggcacccccgctttacctaagtatcctaccggc

SEQ ID NO: 28314 - DNA, 35 bp, Artificial Sequence
  Synthetic oligonucleotide
gatcgacacttccccgaatgtgtcccctttgccat

SEQ ID NO: 28315 - DNA, 36 bp, Artificial Sequence
  Synthetic oligonucleotide
tgacctccccccagttcgtgcgggtttgatactcaa

SEQ ID NO: 28316 - DNA, 34 bp, Artificial Sequence
  Synthetic oligonucleotide
ttggataggctcgggggtggggcgggcgaacgaa

SEQ ID NO: 28317 - DNA, 36 bp, Artificial Sequence
  Synthetic oligonucleotide
atggccatcctgttagctctctatgatcaccctaca

SEQ ID NO: 28318 - DNA, 36 bp, Artificial Sequence
  Synthetic oligonucleotide
gatgtgtcccagtttagaatccttgccgcaccccca

SEQ ID NO: 28319 - DNA, 36 bp, Artificial Sequence
  Synthetic oligonucleotide
agactcaccggtacttggatccattggattggccca

SEQ ID NO: 28320 - DNA, 36 bp, Artificial Sequence
  Synthetic oligonucleotide
tgtccccatcctgcgacacatccttaaatcgttcca

SEQ ID NO: 28321 - DNA, 37 bp, Artificial Sequence
  Synthetic oligonucleotide
gccatcacggggcgtcatacccgatccgtttctccga

SEQ ID NO: 28322 - DNA, 37 bp, Artificial Sequence
  Synthetic oligonucleotide
tgactggctcaccacgttctttacgactatacatcga

SEQ ID NO: 28323 - DNA, 38 bp, Artificial Sequence
  Synthetic oligonucleotide
gacacggaaggaaaggggggggaaactctagtagatga

SEQ ID NO: 28324 - DNA, 37 bp, Artificial Sequence
  Synthetic oligonucleotide
attcgaccccatccatacccgcgctctgaggcgctga

SEQ ID NO: 28325 - DNA, 37 bp, Artificial Sequence
  Synthetic oligonucleotide
tgcaagggaaacggaggggaagaacgactggccgtga

SEQ ID NO: 28326 - DNA, 35 bp, Artificial Sequence
  Synthetic oligonucleotide
gatgtgcctgcttgcttgccgacttgcccacatta

SEQ ID NO: 28327 - DNA, 35 bp, Artificial Sequence
  Synthetic oligonucleotide
attgcgcgaccgcacacggcttttccaacggaacc

SEQ ID NO: 28328 - DNA, 35 bp, Artificial Sequence
  Synthetic oligonucleotide
taagacccctcagcctgacatacgccattacataa

SEQ ID NO: 28329 - DNA, 37 bp, Artificial Sequence
  Synthetic oligonucleotide
taggcacgttacacttgtagttctccgcccgttctca

SEQ ID NO: 28330 - DNA, 36 bp, Artificial Sequence
  Synthetic oligonucleotide
tcccccgctccccacagacatgtctttatgaaacga

SEQ ID NO: 28331 - DNA, 36 bp, Artificial Sequence
  Synthetic oligonucleotide
acatccccagatcttctgaccgcacttgcttgacga

SEQ ID NO: 28332 - DNA, 38 bp, Artificial Sequence
  Synthetic oligonucleotide
acctcagacgcctcaaaccgcccgcacttctggcgtga

SEQ ID NO: 28333 - DNA, 35 bp, Artificial Sequence
  Synthetic oligonucleotide
ttccatccccgcaattgacgcgaggcttttactta

SEQ ID NO: 28334 - DNA, 36 bp, Artificial Sequence
  Synthetic oligonucleotide
aaacgcaggcggggaatacgggaaatatgcggttta

SEQ ID NO: 28335 - DNA, 35 bp, Artificial Sequence
  Synthetic oligonucleotide
tacgtccatgacggatatgtcacatcgctcgcccc

SEQ ID NO: 28336 - DNA, 35 bp, Artificial Sequence
  Synthetic oligonucleotide
tttcacacttggccatgttcaatgactctcgctcc

SEQ ID NO: 28337 - DNA, 35 bp, Artificial Sequence
  Synthetic oligonucleotide
tcctccacgccacctcgcgccaaggtatctgggtc

SEQ ID NO: 28338 - DNA, 35 bp, Artificial Sequence
  Synthetic oligonucleotide
acacctcgtcccgatcgtcgatcaatgccgttttg

SEQ ID NO: 28339 - DNA, 35 bp, Artificial Sequence
  Synthetic oligonucleotide
gatctcgcctcacagtcctctcacgatagttaaaa

SEQ ID NO: 28340 - DNA, 35 bp, Artificial Sequence
  Synthetic oligonucleotide
tgagacgtcgcttttttgttacctgtctctacaca

SEQ ID NO: 28341 - DNA, 35 bp, Artificial Sequence
  Synthetic oligonucleotide
gcgcccttgtactgcgacctcacgcctacccccca

SEQ ID NO: 28342 - DNA, 36 bp, Artificial Sequence
  Synthetic oligonucleotide
gtgacaccaacgccttcctgatctagtgctcagcca

SEQ ID NO: 28343 - DNA, 37 bp, Artificial Sequence
  Synthetic oligonucleotide
tctggcccacctcacaatcccccgcatcatcttgcga

SEQ ID NO: 28344 - DNA, 37 bp, Artificial Sequence
  Synthetic oligonucleotide
gttgcgcgccgcggctggtactcccccccatttgcga

SEQ ID NO: 28345 - DNA, 37 bp, Artificial Sequence
  Synthetic oligonucleotide
acatcatggcaagtgagggcgggggggaatcctagga

SEQ ID NO: 28346 - DNA, 36 bp, Artificial Sequence
  Synthetic oligonucleotide
agtggggggtgggtgttggcgtgaggtgcgtgggga

SEQ ID NO: 28347 - DNA, 38 bp, Artificial Sequence
  Synthetic oligonucleotide
gatgctacactgctcgctttcttggtccaagttcctga

SEQ ID NO: 28348 - DNA, 38 bp, Artificial Sequence
  Synthetic oligonucleotide
tgactctgcccccgtgctacccacacgttactaggtga

SEQ ID NO: 28349 - DNA, 35 bp, Artificial Sequence
  Synthetic oligonucleotide
gccattttgccgcctcacagggtaccgacgcccac

SEQ ID NO: 28350 - DNA, 35 bp, Artificial Sequence
  Synthetic oligonucleotide
ttaggcgcacactacactgcggaatctcgccgacc

SEQ ID NO: 28351 - DNA, 35 bp, Artificial Sequence
  Synthetic oligonucleotide
gcaaatccccctagccccactaccaggcatttggc

SEQ ID NO: 28352 - DNA, 35 bp, Artificial Sequence
  Synthetic oligonucleotide
catcaccgttttagctaacatgattctttcgcttc

SEQ ID NO: 28353 - DNA, 35 bp, Artificial Sequence
  Synthetic oligonucleotide
gggggtgaattgggtgcggggccggtatgggggtg

SEQ ID NO: 28354 - DNA, 35 bp, Artificial Sequence
  Synthetic oligonucleotide
gagtgtggtcctgttccttccgtcctttcaacttg

SEQ ID NO: 28355 - DNA, 35 bp, Artificial Sequence
  Synthetic oligonucleotide
gcgcactgccctattctaccaaccttgcctttgct

SEQ ID NO: 28356 - DNA, 35 bp, Artificial Sequence
  Synthetic oligonucleotide
acccggattccgggtctcatcgtggctccctctct

SEQ ID NO: 28357 - DNA, 36 bp, Artificial Sequence
  Synthetic oligonucleotide
gtagggcgggcgggtgttcgattgttgtgggagaaa

SEQ ID NO: 28358 - DNA, 35 bp, Artificial Sequence
  Synthetic oligonucleotide
gattgggtgcgggtatggagggggacacgaggaaa

SEQ ID NO: 28359 - DNA, 36 bp, Artificial Sequence
  Synthetic oligonucleotide
gcgatcgaccacatcagccatcctcgcttcgtgaca

SEQ ID NO: 28360 - DNA, 36 bp, Artificial Sequence
  Synthetic oligonucleotide
tactcgtgcaactgggccttgtactgctgattacca

SEQ ID NO: 28361 - DNA, 36 bp, Artificial Sequence
  Synthetic oligonucleotide
cccgccctgcctctatgaacccttatcacagctcca

SEQ ID NO: 28362 - DNA, 37 bp, Artificial Sequence
  Synthetic oligonucleotide
gcgaaggtgaagccggggaaaaagtagggtatcaaga

SEQ ID NO: 28363 - DNA, 37 bp, Artificial Sequence
  Synthetic oligonucleotide
tcccactccatccactatgcgcgcccgtttccaacga

SEQ ID NO: 28364 - DNA, 37 bp, Artificial Sequence
  Synthetic oligonucleotide
tcatgcggaggactccccatttcttcatctgccacga

SEQ ID NO: 28365 - DNA, 37 bp, Artificial Sequence
  Synthetic oligonucleotide
atgtgtcgtggcggggcgaactaggggcaattgggga

SEQ ID NO: 28366 - DNA, 37 bp, Artificial Sequence
  Synthetic oligonucleotide
gaactgggagggagggcggggtagtaagcgagaatga

SEQ ID NO: 28367 - DNA, 38 bp, Artificial Sequence
  Synthetic oligonucleotide
gctgccaacccggctgagggccttctccacctacatga

SEQ ID NO: 28368 - DNA, 37 bp, Artificial Sequence
  Synthetic oligonucleotide
taaatgccgcgccgttccgctacctcttacgttgtga

SEQ ID NO: 28369 - DNA, 37 bp, Artificial Sequence
  Synthetic oligonucleotide
tatcctccaccgctccctattatacagggccaattga

SEQ ID NO: 28370 - DNA, 38 bp, Artificial Sequence
  Synthetic oligonucleotide
tttcgcatccactacgctgtcagccacccctcctttga

SEQ ID NO: 28371 - DNA, 35 bp, Artificial Sequence
  Synthetic oligonucleotide
tcctggctctattgtttcactgttcctcccttgac

SEQ ID NO: 28372 - DNA, 35 bp, Artificial Sequence
  Synthetic oligonucleotide
tcatccgcattatacgcgatgtctacccccattac

SEQ ID NO: 28373 - DNA, 35 bp, Artificial Sequence
  Synthetic oligonucleotide
agaccttacacgactgccaacgcgcaatgaacacc

SEQ ID NO: 28374 - DNA, 35 bp, Artificial Sequence
  Synthetic oligonucleotide
tgctggtaccgggtacgaccagttcttctcttccc

SEQ ID NO: 28375 - DNA, 35 bp, Artificial Sequence
  Synthetic oligonucleotide
gattggggtgtggtaggggggtcgtaggaactgag

SEQ ID NO: 28376 - DNA, 35 bp, Artificial Sequence
  Synthetic oligonucleotide
accatcctagtacgcgataagccaattgcccacat

SEQ ID NO: 28377 - DNA, 35 bp, Artificial Sequence
  Synthetic oligonucleotide
tgccccacacgtaccagttagtctcgccccggctt

SEQ ID NO: 28378 - DNA, 36 bp, Artificial Sequence
  Synthetic oligonucleotide
gctacacatctgcacgcctttctctactttcggcga

SEQ ID NO: 28379 - DNA, 37 bp, Artificial Sequence
  Synthetic oligonucleotide
ttggtggggagtttgcttggggtaagggtcggaggga

SEQ ID NO: 28380 - DNA, 37 bp, Artificial Sequence
  Synthetic oligonucleotide
tgcaacaccgcccgacgcttctctctccttagggtga

SEQ ID NO: 28381 - DNA, 35 bp, Artificial Sequence
  Synthetic oligonucleotide
gtatgcccgcagaggacaccctgggaactgaacac

SEQ ID NO: 28382 - DNA, 35 bp, Artificial Sequence
  Synthetic oligonucleotide
ttgcacgagccttccgccttccctatttccctacg

SEQ ID NO: 28383 - DNA, 35 bp, Artificial Sequence
  Synthetic oligonucleotide
aactaacctgtacttccacataaaccgccgtcctg

SEQ ID NO: 28384 - DNA, 35 bp, Artificial Sequence
  Synthetic oligonucleotide
gccctccccagtacttcctacgctctatcatggtg

SEQ ID NO: 28385 - DNA, 35 bp, Artificial Sequence
  Synthetic oligonucleotide
acgccctcacgcaacgtcacatctaccccagtctt

SEQ ID NO: 28386 - DNA, 36 bp, Artificial Sequence
  Synthetic oligonucleotide
gacgaacgggcaattggccgtcctcttggaccccca

SEQ ID NO: 28387 - DNA, 36 bp, Artificial Sequence
  Synthetic oligonucleotide
agccacccctacgtggtccactcaaacatcctatga

SEQ ID NO: 28388 - DNA, 38 bp, Artificial Sequence
  Synthetic oligonucleotide
gtgttaggggggggaatgaaggaggatgtaacgggtga

SEQ ID NO: 28389 - DNA, 38 bp, Artificial Sequence
  Synthetic oligonucleotide
gtgaaacgcgagttggccctacgaacccacagccttga

SEQ ID NO: 28390 - DNA, 38 bp, Artificial Sequence
  Synthetic oligonucleotide
tacctgcccgatccgttccctaggcgacgcaaatttga

SEQ ID NO: 28391 - DNA, 35 bp, Artificial Sequence
  Synthetic oligonucleotide
acacctgatcctcggtacgtggcctcctaatttga

SEQ ID NO: 28392 - DNA, 36 bp, Artificial Sequence
  Synthetic oligonucleotide
gccgcacatggctactttcgacccacacgccctata

SEQ ID NO: 28393 - DNA, 35 bp, Artificial Sequence
  Synthetic oligonucleotide
atccctccgtccctgctaagctcttaaccctctac

SEQ ID NO: 28394 - DNA, 35 bp, Artificial Sequence
  Synthetic oligonucleotide
gtaggacctgaccgcacccgcgcaattcttcaacc

SEQ ID NO: 28395 - DNA, 35 bp, Artificial Sequence
  Synthetic oligonucleotide
ttctgttcctgcttccgttgccacgatcttggccc

SEQ ID NO: 28396 - DNA, 35 bp, Artificial Sequence
  Synthetic oligonucleotide
actcgaacgcttttcctttttacgcgggcctatcc

SEQ ID NO: 28397 - DNA, 35 bp, Artificial Sequence
  Synthetic oligonucleotide
agttcaccatccgccgcatgagccctattgtatcc

SEQ ID NO: 28398 - DNA, 35 bp, Artificial Sequence
  Synthetic oligonucleotide
aggaacaccttcaagcatgccccgtcacaccattc

SEQ ID NO: 28399 - DNA, 35 bp, Artificial Sequence
  Synthetic oligonucleotide
tacacccttcaaatctgttaggcgtctgcttcttc

SEQ ID NO: 28400 - DNA, 35 bp, Artificial Sequence
  Synthetic oligonucleotide
tcgaactatcggccactctattcttctttccttgg

SEQ ID NO: 28401 - DNA, 35 bp, Artificial Sequence
  Synthetic oligonucleotide
actccgcacccctctccatcgagccaccggtttat

SEQ ID NO: 28402 - DNA, 35 bp, Artificial Sequence
  Synthetic oligonucleotide
tgacgccttagcacgttcgtgggcgcttcacctct

SEQ ID NO: 28403 - DNA, 36 bp, Artificial Sequence
  Synthetic oligonucleotide
tcatcatcacatacgacaccggagacctcccgcgca

SEQ ID NO: 28404 - DNA, 37 bp, Artificial Sequence
  Synthetic oligonucleotide
tagtacttgcgttcagagcacccatctgccttctcga

SEQ ID NO: 28405 - DNA, 36 bp, Artificial Sequence
  Synthetic oligonucleotide
gtaccccacccgtccctcgtaatgaaccgttgtgga

SEQ ID NO: 28406 - DNA, 38 bp, Artificial Sequence
  Synthetic oligonucleotide
acctgaaagtccgagtggcggagggtggggcggggtga

SEQ ID NO: 28407 - DNA, 37 bp, Artificial Sequence
  Synthetic oligonucleotide
tttaagagggcggggttggggtggatgtgtggggtga

SEQ ID NO: 28408 - DNA, 36 bp, Artificial Sequence
  Synthetic oligonucleotide
ttcactcgaacgctggtacccgcccttctatcgcta

SEQ ID NO: 28409 - DNA, 35 bp, Artificial Sequence
  Synthetic oligonucleotide
tgcggacgcccctttatgccacacttgtttattac

SEQ ID NO: 28410 - DNA, 35 bp, Artificial Sequence
  Synthetic oligonucleotide
tcccgcactcacaactgagccatcaaatacaaacc

SEQ ID NO: 28411 - DNA, 35 bp, Artificial Sequence
  Synthetic oligonucleotide
acctccaccgagtttatattcaacgaccttgccgc

SEQ ID NO: 28412 - DNA, 35 bp, Artificial Sequence
  Synthetic oligonucleotide
gatctgaacaattggtttatgaccccgactccttc

SEQ ID NO: 28413 - DNA, 35 bp, Artificial Sequence
  Synthetic oligonucleotide
atgtcgaacacacaatgaggctaatgttgcccttt

SEQ ID NO: 28414 - DNA, 35 bp, Artificial Sequence
  Synthetic oligonucleotide
agagtgcacacatatcgaggaccacacctgaccaa

SEQ ID NO: 28415 - DNA, 35 bp, Artificial Sequence
  Synthetic oligonucleotide
ttccccagccctggactatgacaccgaaccgtaca

SEQ ID NO: 28416 - DNA, 36 bp, Artificial Sequence
  Synthetic oligonucleotide
gaccacccccttattttgggtattgctcccacacca

SEQ ID NO: 28417 - DNA, 37 bp, Artificial Sequence
  Synthetic oligonucleotide
tagccccctcactgactaactttgggatcattcgcca

SEQ ID NO: 28418 - DNA, 36 bp, Artificial Sequence
  Synthetic oligonucleotide
tcgactgtcctgctccagctattttttgccgactca

SEQ ID NO: 28419 - DNA, 36 bp, Artificial Sequence
  Synthetic oligonucleotide
tagtacgcatatgcatctgcactccctcgtcgccga

SEQ ID NO: 28420 - DNA, 38 bp, Artificial Sequence
  Synthetic oligonucleotide
ttgtcctctctcctgctatctctaaccgtgacagctga

SEQ ID NO: 28421 - DNA, 35 bp, Artificial Sequence
  Synthetic oligonucleotide
gaacgacttgccaattgcctccatactcccgctga

SEQ ID NO: 28422 - DNA, 38 bp, Artificial Sequence
  Synthetic oligonucleotide
acacactgtcctggtaccgctccgccgcatttggctga

SEQ ID NO: 28423 - DNA, 36 bp, Artificial Sequence
  Synthetic oligonucleotide
aagccacccgtactgttcctagctctggttaatcta

SEQ ID NO: 28424 - DNA, 35 bp, Artificial Sequence
  Synthetic oligonucleotide
aatccaccgatggaccatccaacttaatgcattta

SEQ ID NO: 28425 - DNA, 35 bp, Artificial Sequence
  Synthetic oligonucleotide
gtgttcccgccttaatatcactgctgcactgagcc

SEQ ID NO: 28426 - DNA, 35 bp, Artificial Sequence
  Synthetic oligonucleotide
cctgacgccacatccgcattcaaagtcctcatttc

SEQ ID NO: 28427 - DNA, 35 bp, Artificial Sequence
  Synthetic oligonucleotide
gatcccgcttattctgtaaactcccaccttgtgat

SEQ ID NO: 28428 - DNA, 35 bp, Artificial Sequence
  Synthetic oligonucleotide
tcaacctcgtgcctcgcgcgatacatacctctgct

SEQ ID NO: 28429 - DNA, 35 bp, Artificial Sequence
  Synthetic oligonucleotide
cattcccctgactggtgccccttctttaagcatct

SEQ ID NO: 28430 - DNA, 35 bp, Artificial Sequence
  Synthetic oligonucleotide
ttcggtcattccgccttcctgactctaacgtttct

SEQ ID NO: 28431 - DNA, 35 bp, Artificial Sequence
  Synthetic oligonucleotide
gcgcacccacatcacccagctaatgttctttgctt

SEQ ID NO: 28432 - DNA, 36 bp, Artificial Sequence
  Synthetic oligonucleotide
gaggaccaaggtaagtatgtgggaaggggaggggca

SEQ ID NO: 28433 - DNA, 36 bp, Artificial Sequence
  Synthetic oligonucleotide
tcaacccacatgaatacttctttctcgttcgtacga

SEQ ID NO: 28434 - DNA, 37 bp, Artificial Sequence
  Synthetic oligonucleotide
gacgcgggagctaaggttagaaagggggttgagggga

SEQ ID NO: 28435 - DNA, 35 bp, Artificial Sequence
  Synthetic oligonucleotide
tgagaagggggactgggccggaatgggagtgtgga

SEQ ID NO: 28436 - DNA, 38 bp, Artificial Sequence
  Synthetic oligonucleotide
gagcacactcccatttgttccctcggttcctgttatga

SEQ ID NO: 28437 - DNA, 38 bp, Artificial Sequence
  Synthetic oligonucleotide
gcgagaacgccgggaggacaagggagggtcactgttga

SEQ ID NO: 28438 - DNA, 35 bp, Artificial Sequence
  Synthetic oligonucleotide
gtcccccaacccaggtctggataccattaaccgta

SEQ ID NO: 28439 - DNA, 35 bp, Artificial Sequence
  Synthetic oligonucleotide
ttgaaatcccactgtctgacctgctcctccaatta

SEQ ID NO: 28440 - DNA, 36 bp, Artificial Sequence
  Synthetic oligonucleotide
gcaccactgcatcggtaaccgagtttagctatctta

SEQ ID NO: 28441 - DNA, 35 bp, Artificial Sequence
  Synthetic oligonucleotide
ttctgccgcctcatcgcttttacctagatcccgac

SEQ ID NO: 28442 - DNA, 35 bp, Artificial Sequence
  Synthetic oligonucleotide
tcacgacctattcgtttcccatagcttggtgatac

SEQ ID NO: 28443 - DNA, 35 bp, Artificial Sequence
  Synthetic oligonucleotide
gattttaccgcccaccaattgtgctcacagccacc

SEQ ID NO: 28444 - DNA, 35 bp, Artificial Sequence
  Synthetic oligonucleotide
ttggtccaccccgcctatgttccgttgccgctgcc

SEQ ID NO: 28445 - DNA, 35 bp, Artificial Sequence
  Synthetic oligonucleotide
tcacccttgtctattttctcacggcgcatcatcgc

SEQ ID NO: 28446 - DNA, 36 bp, Artificial Sequence
  Synthetic oligonucleotide
aactacctgcctatatgtctcagtgcgcccttctaa

SEQ ID NO: 28447 - DNA, 36 bp, Artificial Sequence
  Synthetic oligonucleotide
gcgccacccctggatggctccactcgttttatttca

SEQ ID NO: 28448 - DNA, 37 bp, Artificial Sequence
  Synthetic oligonucleotide
gccccgacccgaacccgctgctcctccaagtgtcaga

SEQ ID NO: 28449 - DNA, 37 bp, Artificial Sequence
  Synthetic oligonucleotide
ttgagagggagcacgggagtggtgggagtctcctaga

SEQ ID NO: 28450 - DNA, 37 bp, Artificial Sequence
  Synthetic oligonucleotide
acgtcccgcctgacgcccaccctaacgatcgacgcga

SEQ ID NO: 28451 - DNA, 37 bp, Artificial Sequence
  Synthetic oligonucleotide
tgtcgacgtaggtacagtatgggggcgcaatggtgga

SEQ ID NO: 28452 - DNA, 38 bp, Artificial Sequence
  Synthetic oligonucleotide
gaacggtgggggttgataggggtggaacgatgggctga

SEQ ID NO: 28453 - DNA, 38 bp, Artificial Sequence
  Synthetic oligonucleotide
gccacgtgttggaagttggaacggttttgcttgggtga

SEQ ID NO: 28454 - DNA, 35 bp, Artificial Sequence
  Synthetic oligonucleotide
gtccatccgctatgtaagcacccccactctcagta

SEQ ID NO: 28455 - DNA, 35 bp, Artificial Sequence
  Synthetic oligonucleotide
acgacctccacgataggaatccccctaccacacac

SEQ ID NO: 28456 - DNA, 35 bp, Artificial Sequence
  Synthetic oligonucleotide
gcataacacagacctgcctcccctagtgaactccc

SEQ ID NO: 28457 - DNA, 35 bp, Artificial Sequence
  Synthetic oligonucleotide
tctcatactctgcccagtgcgtaccatctgttggg

SEQ ID NO: 28458 - DNA, 35 bp, Artificial Sequence
  Synthetic oligonucleotide
attgcccgccccattctccgtacttccaccgctgg

SEQ ID NO: 28459 - DNA, 35 bp, Artificial Sequence
  Synthetic oligonucleotide
aacaaggtggtcgacgtagtgatagggtaggggtg

SEQ ID NO: 28460 - DNA, 35 bp, Artificial Sequence
  Synthetic oligonucleotide
gatgatgcgcacatcccatcagtgggctaccacat

SEQ ID NO: 28461 - DNA, 35 bp, Artificial Sequence
  Synthetic oligonucleotide
gcagggagcaaaccggggggggtggcaatgggtgt

SEQ ID NO: 28462 - DNA, 35 bp, Artificial Sequence
  Synthetic oligonucleotide
aacgtgtctcacgttgtacctgtactttcttcttt

SEQ ID NO: 28463 - DNA, 35 bp, Artificial Sequence
  Synthetic oligonucleotide
tccgttgccctacttgtaattgtctaaatcttttt

SEQ ID NO: 28464 - DNA, 36 bp, Artificial Sequence
  Synthetic oligonucleotide
gacaggttgaagggggggagaaacggggtatggaaa

SEQ ID NO: 28465 - DNA, 36 bp, Artificial Sequence
  Synthetic oligonucleotide
gccccaccgcagcatggccatctaatcgttacctaa

SEQ ID NO: 28466 - DNA, 36 bp, Artificial Sequence
  Synthetic oligonucleotide
gggtccgccccgtaggcaatacaccacgcttctcca

SEQ ID NO: 28467 - DNA, 36 bp, Artificial Sequence
  Synthetic oligonucleotide
gagcaacgtaatatgtttccacacctttcatccgca

SEQ ID NO: 28468 - DNA, 36 bp, Artificial Sequence
  Synthetic oligonucleotide
accacaccacatagctaagcagttcgattcaaaaga

SEQ ID NO: 28469 - DNA, 36 bp, Artificial Sequence
  Synthetic oligonucleotide
gcaaatggtgagggagggagggccaataccaacaga

SEQ ID NO: 28470 - DNA, 37 bp, Artificial Sequence
  Synthetic oligonucleotide
aaggggcgggaggggaggagggaatatcaaacggcga

SEQ ID NO: 28471 - DNA, 37 bp, Artificial Sequence
  Synthetic oligonucleotide
aacagcatgccactctcatacagccccacgacacgga

SEQ ID NO: 28472 - DNA, 38 bp, Artificial Sequence
  Synthetic oligonucleotide
actgagccaggatgtatggcgttgtgtgttgtgcgtga

SEQ ID NO: 28473 - DNA, 37 bp, Artificial Sequence
  Synthetic oligonucleotide
atcagggacggagggggtatggctaaaggctaggtga

SEQ ID NO: 28474 - DNA, 37 bp, Artificial Sequence
  Synthetic oligonucleotide
gacgccgccctgtgcattactgattcgcccattgtga

SEQ ID NO: 28475 - DNA, 37 bp, Artificial Sequence
  Synthetic oligonucleotide
gcctcctctgcccagaccccataccgaagcttattga

SEQ ID NO: 28476 - DNA, 36 bp, Artificial Sequence
  Synthetic oligonucleotide
tcacggacctcttgcctgcctcccctacctacagta

SEQ ID NO: 28477 - DNA, 35 bp, Artificial Sequence
  Synthetic oligonucleotide
acccatgtaactagctagtgcgggaccgcatctcc

SEQ ID NO: 28478 - DNA, 35 bp, Artificial Sequence
  Synthetic oligonucleotide
tcatgcacgtatcgcctcgccggtgacgttacctc

SEQ ID NO: 28479 - DNA, 35 bp, Artificial Sequence
  Synthetic oligonucleotide
gtcgagcattatctttcccgttgactgcccctctc

SEQ ID NO: 28480 - DNA, 35 bp, Artificial Sequence
  Synthetic oligonucleotide
gacctggggactgcatgaaactaaggagtgaaggg

SEQ ID NO: 28481 - DNA, 35 bp, Artificial Sequence
  Synthetic oligonucleotide
ggggggagaacccgaggggagggtataacagggtg

SEQ ID NO: 28482 - DNA, 35 bp, Artificial Sequence
  Synthetic oligonucleotide
gcacagagccccatcatacaagttacgtagccgat

SEQ ID NO: 28483 - DNA, 35 bp, Artificial Sequence
  Synthetic oligonucleotide
acattgactcacccggccagacaactgggagttgt

SEQ ID NO: 28484 - DNA, 35 bp, Artificial Sequence
  Synthetic oligonucleotide
tcgctcaccgctgcctcttaatactctgttttttt

SEQ ID NO: 28485 - DNA, 36 bp, Artificial Sequence
  Synthetic oligonucleotide
tgcgcccacgcaccatggcattcttcattgactcaa

SEQ ID NO: 28486 - DNA, 36 bp, Artificial Sequence
  Synthetic oligonucleotide
agccaccgcttggtttctcgcccatccctgtggcca

SEQ ID NO: 28487 - DNA, 37 bp, Artificial Sequence
  Synthetic oligonucleotide
gcaggaggggaagaagggatggggacgcccgttgaga

SEQ ID NO: 28488 - DNA, 37 bp, Artificial Sequence
  Synthetic oligonucleotide
tgtaccgtactgccttgtgcctctaatgccatgccga

SEQ ID NO: 28489 - DNA, 37 bp, Artificial Sequence
  Synthetic oligonucleotide
tgcaccgcaacttagcgatcacagtttcgccttccga

SEQ ID NO: 28490 - DNA, 38 bp, Artificial Sequence
  Synthetic oligonucleotide
ggaccacccgcagccgggacgccctttacgcattatga

SEQ ID NO: 28491 - DNA, 38 bp, Artificial Sequence
  Synthetic oligonucleotide
tactgcctcctggactgtttgtctaacttgcaccctga

SEQ ID NO: 28492 - DNA, 36 bp, Artificial Sequence
  Synthetic oligonucleotide
gtacgacggagtcgcgtacgttctacctttgcttga

SEQ ID NO: 28493 - DNA, 35 bp, Artificial Sequence
  Synthetic oligonucleotide
cagtcaccacgccgcacatctgatcctccgcctac

SEQ ID NO: 28494 - DNA, 35 bp, Artificial Sequence
  Synthetic oligonucleotide
agatgcggcacaggattctgcccctctgcccagcc

SEQ ID NO: 28495 - DNA, 35 bp, Artificial Sequence
  Synthetic oligonucleotide
aactgggggcgaccatctcctaattattgtcctgc

SEQ ID NO: 28496 - DNA, 35 bp, Artificial Sequence
  Synthetic oligonucleotide
tccgaccaccggcgtttcatatcttgactattggg

SEQ ID NO: 28497 - DNA, 35 bp, Artificial Sequence
  Synthetic oligonucleotide
acccaggtcgatgggcggtaaggttgggtgggatg

SEQ ID NO: 28498 - DNA, 35 bp, Artificial Sequence
  Synthetic oligonucleotide
atcacgtcgtcgcattttcaaactctcctctctgt

SEQ ID NO: 28499 - DNA, 35 bp, Artificial Sequence
  Synthetic oligonucleotide
tcacccactgaatgccactcacctcgcttggtaaa

SEQ ID NO: 28500 - DNA, 36 bp, Artificial Sequence
  Synthetic oligonucleotide
tcccccccgcgccactatgacctctggcttttggaa

SEQ ID NO: 28501 - DNA, 35 bp, Artificial Sequence
  Synthetic oligonucleotide
accgaccgtgcccacaggcttttgtactccgccca

SEQ ID NO: 28502 - DNA, 37 bp, Artificial Sequence
  Synthetic oligonucleotide
gcttggctgggtggggttgggtgaggaggttgtccga

SEQ ID NO: 28503 - DNA, 38 bp, Artificial Sequence
  Synthetic oligonucleotide
gggaggaggaaggaaatcgggcgggcgagggcgtttga

SEQ ID NO: 28504 - DNA, 36 bp, Artificial Sequence
  Synthetic oligonucleotide
attgccctccgtttgcctcctgttattcagttgata

SEQ ID NO: 28505 - DNA, 35 bp, Artificial Sequence
  Synthetic oligonucleotide
tacaatcagccaccccacctgcagtcatcgcgaac

SEQ ID NO: 28506 - DNA, 35 bp, Artificial Sequence
  Synthetic oligonucleotide
gtagggcgtgtctgcccttcggacctgctttcctc

SEQ ID NO: 28507 - DNA, 35 bp, Artificial Sequence
  Synthetic oligonucleotide
gtgttcccttcagccggcctttcctctcgtaccag

SEQ ID NO: 28508 - DNA, 34 bp, Artificial Sequence
  Synthetic oligonucleotide
ttagggttggaggttgagtaggggttaaggggag

SEQ ID NO: 28509 - DNA, 35 bp, Artificial Sequence
  Synthetic oligonucleotide
tcgagccgccatcattatactgctcatcctcgtcg

SEQ ID NO: 28510 - DNA, 36 bp, Artificial Sequence
  Synthetic oligonucleotide
gtgcggaggtggaggacttgggagcaggacggacaa

SEQ ID NO: 28511 - DNA, 36 bp, Artificial Sequence
  Synthetic oligonucleotide
tgacgtctaccaatctcaatgtaagctgcctttcca

SEQ ID NO: 28512 - DNA, 36 bp, Artificial Sequence
  Synthetic oligonucleotide
tatggagctgcccacttgtccttccggtcattttca

SEQ ID NO: 28513 - DNA, 38 bp, Artificial Sequence
  Synthetic oligonucleotide
accacctacagttcgttgtctcatctggactttgctga

SEQ ID NO: 28514 - DNA, 38 bp, Artificial Sequence
  Synthetic oligonucleotide
ataccaccctcggagcttgacgatctcgctatctttga

SEQ ID NO: 28515 - DNA, 35 bp, Artificial Sequence
  Synthetic oligonucleotide
ggtgaaatgcctcccgacccaattgacatgttctc

SEQ ID NO: 28516 - DNA, 35 bp, Artificial Sequence
  Synthetic oligonucleotide
tagagggcaacccattgttttagaccccaccaccg

SEQ ID NO: 28517 - DNA, 35 bp, Artificial Sequence
  Synthetic oligonucleotide
tccgccccgccgtggcccgaactaaatttattttg

SEQ ID NO: 28518 - DNA, 35 bp, Artificial Sequence
  Synthetic oligonucleotide
gcgaggccctcatggctcttctgggcatactccct

SEQ ID NO: 28519 - DNA, 35 bp, Artificial Sequence
  Synthetic oligonucleotide
aacaacacaccatggtacttatgtcatgggattct

SEQ ID NO: 28520 - DNA, 35 bp, Artificial Sequence
  Synthetic oligonucleotide
tcctccaatcgcggatttttagctatctcctccgt

SEQ ID NO: 28521 - DNA, 37 bp, Artificial Sequence
  Synthetic oligonucleotide
tcagatgcatccttatcatcgttacgtccttccacga

SEQ ID NO: 28522 - DNA, 37 bp, Artificial Sequence
  Synthetic oligonucleotide
gcgggctgctgcctccacgtatcctgcgctccatcga

SEQ ID NO: 28523 - DNA, 37 bp, Artificial Sequence
  Synthetic oligonucleotide
gatccacagtcatcggccctacgccactgcctttcga

SEQ ID NO: 28524 - DNA, 37 bp, Artificial Sequence
  Synthetic oligonucleotide
tcttgccggcccagatcatttttccgtttgctttcga

SEQ ID NO: 28525 - DNA, 37 bp, Artificial Sequence
  Synthetic oligonucleotide
tcagaactgacacggggaaaaatacggggtggaagga

SEQ ID NO: 28526 - DNA, 36 bp, Artificial Sequence
  Synthetic oligonucleotide
acggtagggtggaagggaaaaccgggtgtaggggga

SEQ ID NO: 28527 - DNA, 38 bp, Artificial Sequence
  Synthetic oligonucleotide
tccgactcccaccccttaggctcaggcatactgcatga

SEQ ID NO: 28528 - DNA, 38 bp, Artificial Sequence
  Synthetic oligonucleotide
gtacgccattggaattgctgccaccgtttactcactga

SEQ ID NO: 28529 - DNA, 36 bp, Artificial Sequence
  Synthetic oligonucleotide
actcacgcggggaggggggatggaaggcgtcgagta

SEQ ID NO: 28530 - DNA, 35 bp, Artificial Sequence
  Synthetic oligonucleotide
cccgtgagccccggcctattagcttccttcccctg

SEQ ID NO: 28531 - DNA, 35 bp, Artificial Sequence
  Synthetic oligonucleotide
ggtgcctccaccctcaacacctgctgggatgcaca

SEQ ID NO: 28532 - DNA, 37 bp, Artificial Sequence
  Synthetic oligonucleotide
taccttcccacctgtccgaatctcaacagtcgaacga

SEQ ID NO: 28533 - DNA, 35 bp, Artificial Sequence
  Synthetic oligonucleotide
atacgtctggctcaaggcaccccgcattcctacga

SEQ ID NO: 28534 - DNA, 37 bp, Artificial Sequence
  Synthetic oligonucleotide
gtcccatactgccgccacttgttactccgttcgatga

SEQ ID NO: 28535 - DNA, 38 bp, Artificial Sequence
  Synthetic oligonucleotide
agttcacccggccgccttgtgcttccgtactttcgtga

SEQ ID NO: 28536 - DNA, 35 bp, Artificial Sequence
  Synthetic oligonucleotide
tctgcggggacttgcctgcatctctagctcttaac

SEQ ID NO: 28537 - DNA, 35 bp, Artificial Sequence
  Synthetic oligonucleotide
gctgtccatcttttgtccccgtgcaagactccacc

SEQ ID NO: 28538 - DNA, 35 bp, Artificial Sequence
  Synthetic oligonucleotide
tactgaacaatgcacttttgtacgacccacccgcc

SEQ ID NO: 28539 - DNA, 35 bp, Artificial Sequence
  Synthetic oligonucleotide
gaagccctctcactatctacgcctgcattttatcc

SEQ ID NO: 28540 - DNA, 35 bp, Artificial Sequence
  Synthetic oligonucleotide
ttacatcccccgtatggccaccatggtcaaagctc

SEQ ID NO: 28541 - DNA, 35 bp, Artificial Sequence
  Synthetic oligonucleotide
gtgtgacgtcctactttgtccctcgtattatgttc

SEQ ID NO: 28542 - DNA, 35 bp, Artificial Sequence
  Synthetic oligonucleotide
tccaaccgctgcccactcgcgccattatgcccctg

SEQ ID NO: 28543 - DNA, 35 bp, Artificial Sequence
  Synthetic oligonucleotide
acgcataggcggaagacatctacactcccctcgtt

SEQ ID NO: 28544 - DNA, 36 bp, Artificial Sequence
  Synthetic oligonucleotide
acgactaccttcgacatgctccgtgaactatctcaa

SEQ ID NO: 28545 - DNA, 36 bp, Artificial Sequence
  Synthetic oligonucleotide
aaactgggggtctgccatgtctacatcctgtcctaa

SEQ ID NO: 28546 - DNA, 35 bp, Artificial Sequence
  Synthetic oligonucleotide
atcacacgtaaccgaccgtctaacccgctctttaa

SEQ ID NO: 28547 - DNA, 36 bp, Artificial Sequence
  Synthetic oligonucleotide
accacattccgtacattgcagaacgcccggtatcca

SEQ ID NO: 28548 - DNA, 35 bp, Artificial Sequence
  Synthetic oligonucleotide
gcctgtcagtggtgttcccccccgtcatactctca

SEQ ID NO: 28549 - DNA, 37 bp, Artificial Sequence
  Synthetic oligonucleotide
gcctaccatcgtttcgtttttgcaacctccccgccga

SEQ ID NO: 28550 - DNA, 37 bp, Artificial Sequence
  Synthetic oligonucleotide
gaaccagccgccaccatgatttattcaagcgctctga

SEQ ID NO: 28551 - DNA, 35 bp, Artificial Sequence
  Synthetic oligonucleotide
gacaagccgccgtcgtgccaaccgaactgcctgac

SEQ ID NO: 28552 - DNA, 35 bp, Artificial Sequence
  Synthetic oligonucleotide
tcgacaagggcctacatgtattctgtttcgccacc

SEQ ID NO: 28553 - DNA, 35 bp, Artificial Sequence
  Synthetic oligonucleotide
atcccccgatgtcgcaataccccccctcggtcacg

SEQ ID NO: 28554 - DNA, 35 bp, Artificial Sequence
  Synthetic oligonucleotide
aatcgcaccactcttccgccacgatcaaatctctg

SEQ ID NO: 28555 - DNA, 35 bp, Artificial Sequence
  Synthetic oligonucleotide
gccgtcacctaccagctccctaatcgttccttgat

SEQ ID NO: 28556 - DNA, 35 bp, Artificial Sequence
  Synthetic oligonucleotide
atccaccatctagggggtgttatctacacccagtt

SEQ ID NO: 28557 - DNA, 35 bp, Artificial Sequence
  Synthetic oligonucleotide
ttcgaacggccgacactattatctcagcactacaa

SEQ ID NO: 28558 - DNA, 35 bp, Artificial Sequence
  Synthetic oligonucleotide
accgtgcctcccattttccttaggtctcttggtaa

SEQ ID NO: 28559 - DNA, 35 bp, Artificial Sequence
  Synthetic oligonucleotide
tgacgaccctcttcgtcctgtacttttctttcaca

SEQ ID NO: 28560 - DNA, 35 bp, Artificial Sequence
  Synthetic oligonucleotide
acatccctcctgctcatatgctttcctggcttaga

SEQ ID NO: 28561 - DNA, 36 bp, Artificial Sequence
  Synthetic oligonucleotide
ttatcccgccacagaatttcccaacacagacggcga

SEQ ID NO: 28562 - DNA, 37 bp, Artificial Sequence
  Synthetic oligonucleotide
tccctccaccaccgaggccccgtagaacccatttcga

SEQ ID NO: 28563 - DNA, 36 bp, Artificial Sequence
  Synthetic oligonucleotide
aaccctcctcacagggaacttggacaattttcatga

SEQ ID NO: 28564 - DNA, 38 bp, Artificial Sequence
  Synthetic oligonucleotide
atcagccagggagggatgggcaatgggacgtttgatga

SEQ ID NO: 28565 - DNA, 37 bp, Artificial Sequence
  Synthetic oligonucleotide
acacgcgtactcctttggcccgcacgcccactcctga

SEQ ID NO: 28566 - DNA, 36 bp, Artificial Sequence
  Synthetic oligonucleotide
tttgactgctcgtcacccgggccctccctttcctga

SEQ ID NO: 28567 - DNA, 38 bp, Artificial Sequence
  Synthetic oligonucleotide
tagacggcgatgacgccgcgtacatatcccttccttga

SEQ ID NO: 28568 - DNA, 35 bp, Artificial Sequence
  Synthetic oligonucleotide
tgtgagtgcgacaaatccctcgtgttccacccgcc

SEQ ID NO: 28569 - DNA, 35 bp, Artificial Sequence
  Synthetic oligonucleotide
gcgaatacgttaccaccacatgagtttaccctgcc

SEQ ID NO: 28570 - DNA, 35 bp, Artificial Sequence
  Synthetic oligonucleotide
ggacaatccgccaagctacctactgactcgtacgc

SEQ ID NO: 28571 - DNA, 35 bp, Artificial Sequence
  Synthetic oligonucleotide
accgggggggggttggggtggttaatgcagaagcg

SEQ ID NO: 28572 - DNA, 35 bp, Artificial Sequence
  Synthetic oligonucleotide
agttcgccccgcgcattttctcaccatcatagagg

SEQ ID NO: 28573 - DNA, 35 bp, Artificial Sequence
  Synthetic oligonucleotide
ggacccacctaccctcccaatgactagaactacgt

SEQ ID NO: 28574 - DNA, 35 bp, Artificial Sequence
  Synthetic oligonucleotide
tagtacgtccccggccggtttgtcttactgccttt

SEQ ID NO: 28575 - DNA, 35 bp, Artificial Sequence
  Synthetic oligonucleotide
gcgatcacagcagtgagcgcgacccgaaccccgaa

SEQ ID NO: 28576 - DNA, 35 bp, Artificial Sequence
  Synthetic oligonucleotide
ggatacccgccatcgggtatacctcctaacttcca

SEQ ID NO: 28577 - DNA, 38 bp, Artificial Sequence
  Synthetic oligonucleotide
tcacctccgcagcacattgccccgcatacccgccctga

SEQ ID NO: 28578 - DNA, 38 bp, Artificial Sequence
  Synthetic oligonucleotide
gaagcccttccctgttccagccacccttgccttagtga

SEQ ID NO: 28579 - DNA, 38 bp, Artificial Sequence
  Synthetic oligonucleotide
gcagtcaggagtcgggaggacggtgtgatggagggtga

SEQ ID NO: 28580 - DNA, 35 bp, Artificial Sequence
  Synthetic oligonucleotide
acgcaacaggtcctcctgccgaacttcggacacac

SEQ ID NO: 28581 - DNA, 35 bp, Artificial Sequence
  Synthetic oligonucleotide
gcaacccaccacacaagaagtatgcgacaaagctc

SEQ ID NO: 28582 - DNA, 35 bp, Artificial Sequence
  Synthetic oligonucleotide
tgtacaatggtggagggtgacgggtgggggataat

SEQ ID NO: 28583 - DNA, 34 bp, Artificial Sequence
  Synthetic oligonucleotide
aacgcgcccttttccgtttcttgccgagttgcat

SEQ ID NO: 28584 - DNA, 35 bp, Artificial Sequence
  Synthetic oligonucleotide
tgcgaccatcacattacgctcgcttctgcccatct

SEQ ID NO: 28585 - DNA, 35 bp, Artificial Sequence
  Synthetic oligonucleotide
gtggccccatccaaagccagggccgggtttctatt

SEQ ID NO: 28586 - DNA, 36 bp, Artificial Sequence
  Synthetic oligonucleotide
aatctcaaccgcggttgcactgtgcttcctcataca

SEQ ID NO: 28587 - DNA, 35 bp, Artificial Sequence
  Synthetic oligonucleotide
ttagccgtcccgctatataagcttctatgctgcca

SEQ ID NO: 28588 - DNA, 36 bp, Artificial Sequence
  Synthetic oligonucleotide
gagcacgtaaactcctctccatctaggcccttgcca

SEQ ID NO: 28589 - DNA, 36 bp, Artificial Sequence
  Synthetic oligonucleotide
aactacccatcgctcgatccccgtttcgttattgca

SEQ ID NO: 28590 - DNA, 36 bp, Artificial Sequence
  Synthetic oligonucleotide
ttgtccccattctgccttattcaggaccacccttca

SEQ ID NO: 28591 - DNA, 37 bp, Artificial Sequence
  Synthetic oligonucleotide
gctgcacgcattgaaggaggagggaggcggaggcgga

SEQ ID NO: 28592 - DNA, 38 bp, Artificial Sequence
  Synthetic oligonucleotide
gaacttcccacctgtgtatagcgctcacccacccctga

SEQ ID NO: 28593 - DNA, 37 bp, Artificial Sequence
  Synthetic oligonucleotide
gttgtaagcccaccactgggtcatccagtgccattga

SEQ ID NO: 28594 - DNA, 38 bp, Artificial Sequence
  Synthetic oligonucleotide
tacatctgtagctgccactccaactcccgtaccgttga

SEQ ID NO: 28595 - DNA, 36 bp, Artificial Sequence
  Synthetic oligonucleotide
gagtgctggtaaagggtagtttggagggggtatgta

SEQ ID NO: 28596 - DNA, 35 bp, Artificial Sequence
  Synthetic oligonucleotide
gcctcttgaactctgctgttacatccttgcgtgcc

SEQ ID NO: 28597 - DNA, 35 bp, Artificial Sequence
  Synthetic oligonucleotide
ggaccgccctccgaagcttaaagggcgttatctcc

SEQ ID NO: 28598 - DNA, 35 bp, Artificial Sequence
  Synthetic oligonucleotide
ccctccccctgcagagcacccattccttcggtcgc

SEQ ID NO: 28599 - DNA, 35 bp, Artificial Sequence
  Synthetic oligonucleotide
gctcatcatcgcctgggttcctctagttttcgttc

SEQ ID NO: 28600 - DNA, 35 bp, Artificial Sequence
  Synthetic oligonucleotide
tcgcacgtgaactgtcttctcatccgcccatcaag

SEQ ID NO: 28601 - DNA, 35 bp, Artificial Sequence
  Synthetic oligonucleotide
tgcatgcccattgcccctcatcgcagcagattacg

SEQ ID NO: 28602 - DNA, 35 bp, Artificial Sequence
  Synthetic oligonucleotide
gatggacagggtcgagggcgaagggaaaggatgcg

SEQ ID NO: 28603 - DNA, 35 bp, Artificial Sequence
  Synthetic oligonucleotide
tgcctgagtagtctctattagccacccagccaact

SEQ ID NO: 28604 - DNA, 35 bp, Artificial Sequence
  Synthetic oligonucleotide
tacgcctcgcttgcccataaaggtcgacactgcct

SEQ ID NO: 28605 - DNA, 35 bp, Artificial Sequence
  Synthetic oligonucleotide
tccgagagcatctttgcacgacaacttttaactct

SEQ ID NO: 28606 - DNA, 35 bp, Artificial Sequence
  Synthetic oligonucleotide
gtccggacgtgagtctacgcaccttccctctttaa

SEQ ID NO: 28607 - DNA, 35 bp, Artificial Sequence
  Synthetic oligonucleotide
aagccccctactcgatggacccatcacccaccaca

SEQ ID NO: 28608 - DNA, 35 bp, Artificial Sequence
  Synthetic oligonucleotide
tcaacaaacgtgtgctgtctttttttttcggggca

SEQ ID NO: 28609 - DNA, 35 bp, Artificial Sequence
  Synthetic oligonucleotide
tcatcgggcgtaacaagctcgtctctttcactgca

SEQ ID NO: 28610 - DNA, 37 bp, Artificial Sequence
  Synthetic oligonucleotide
gccttgccactgcgttttgttttggcctccgttccga

SEQ ID NO: 28611 - DNA, 35 bp, Artificial Sequence
  Synthetic oligonucleotide
accacctcgtgtccatgccccatccttccattgga

SEQ ID NO: 28612 - DNA, 38 bp, Artificial Sequence
  Synthetic oligonucleotide
tcctccgccaagttactcaccacggttcatcttactga

SEQ ID NO: 28613 - DNA, 38 bp, Artificial Sequence
  Synthetic oligonucleotide
tgctgacaccagcatttctcttgtttgactgctcctga

SEQ ID NO: 28614 - DNA, 36 bp, Artificial Sequence
  Synthetic oligonucleotide
ttgacccgccaggcaatttaacgttactgctttata

SEQ ID NO: 28615 - DNA, 36 bp, Artificial Sequence
  Synthetic oligonucleotide
aacgatgtgggggtgtctcattgtgaaggttgctta

SEQ ID NO: 28616 - DNA, 35 bp, Artificial Sequence
  Synthetic oligonucleotide
ttcctgtgcatccttctaacgccggcgctcgctcc

SEQ ID NO: 28617 - DNA, 35 bp, Artificial Sequence
  Synthetic oligonucleotide
ggaggggggtggctgtatggcatgataatttggag

SEQ ID NO: 28618 - DNA, 35 bp, Artificial Sequence
  Synthetic oligonucleotide
tacgccttacctcctaggagttgtgacaccacacg

SEQ ID NO: 28619 - DNA, 35 bp, Artificial Sequence
  Synthetic oligonucleotide
ccattgataatcacacactctgatctgcctctggg

SEQ ID NO: 28620 - DNA, 35 bp, Artificial Sequence
  Synthetic oligonucleotide
acaaacgcccctcccggtgaacattgaatgcctgg

SEQ ID NO: 28621 - DNA, 35 bp, Artificial Sequence
  Synthetic oligonucleotide
aaccaccgcacagccttctatcgaccgtagcagtg

SEQ ID NO: 28622 - DNA, 35 bp, Artificial Sequence
  Synthetic oligonucleotide
tgactcgcttgttccacgctttgagccccttacct

SEQ ID NO: 28623 - DNA, 35 bp, Artificial Sequence
  Synthetic oligonucleotide
gtgcactagccccggtcttggcgttaaccccattt

SEQ ID NO: 28624 - DNA, 35 bp, Artificial Sequence
  Synthetic oligonucleotide
tacagcttgctgcctgctcttgtcaatctccgcca

SEQ ID NO: 28625 - DNA, 36 bp, Artificial Sequence
  Synthetic oligonucleotide
tcaccatcctagttctgtgcgcctacatttgttgca

SEQ ID NO: 28626 - DNA, 36 bp, Artificial Sequence
  Synthetic oligonucleotide
gccgactgtacaccagctgctcacaattcgtactca

SEQ ID NO: 28627 - DNA, 35 bp, Artificial Sequence
  Synthetic oligonucleotide
ttgtctgaactgatcccgcaacatgtcccacctca

SEQ ID NO: 28628 - DNA, 36 bp, Artificial Sequence
  Synthetic oligonucleotide
tagtgctgcgcagatcccgaggcctacctggtttca

SEQ ID NO: 28629 - DNA, 36 bp, Artificial Sequence
  Synthetic oligonucleotide
gtctgtccccctatttgcctaatgaaactagcccga

SEQ ID NO: 28630 - DNA, 37 bp, Artificial Sequence
  Synthetic oligonucleotide
gggtggaacgttgggggggtcaagggagtagactcga

SEQ ID NO: 28631 - DNA, 37 bp, Artificial Sequence
  Synthetic oligonucleotide
gcccgcctatgctaccaaccttcacttcgttcacgga

SEQ ID NO: 28632 - DNA, 37 bp, Artificial Sequence
  Synthetic oligonucleotide
gactgcactagtcgcgcggagaataccacctttctga

SEQ ID NO: 28633 - DNA, 38 bp, Artificial Sequence
  Synthetic oligonucleotide
atcagccccgctcacttgtcctccaccacgtctagtga

SEQ ID NO: 28634 - DNA, 38 bp, Artificial Sequence
  Synthetic oligonucleotide
atcatcgtcgcaagcccatttgaaacccgcctatttga

SEQ ID NO: 28635 - DNA, 38 bp, Artificial Sequence
  Synthetic oligonucleotide
gtacgcgcgccgcccctcagctctatccacgtttttga

SEQ ID NO: 28636 - DNA, 36 bp, Artificial Sequence
  Synthetic oligonucleotide
gcccgaccacaggatgtgggcccccatctcccccta

SEQ ID NO: 28637 - DNA, 35 bp, Artificial Sequence
  Synthetic oligonucleotide
acgtccagccgcctcgtttctcttgcttctacctc

SEQ ID NO: 28638 - DNA, 35 bp, Artificial Sequence
  Synthetic oligonucleotide
tgacaaggtccctaagtcacgttccctccctgctc

SEQ ID NO: 28639 - DNA, 36 bp, Artificial Sequence
  Synthetic oligonucleotide
gtactgcccaccaatggcgacgttagcagacccaca

SEQ ID NO: 28640 - DNA, 37 bp, Artificial Sequence
  Synthetic oligonucleotide
taggaaacgagcgcgctacgaggagggagggctggga

SEQ ID NO: 28641 - DNA, 38 bp, Artificial Sequence
  Synthetic oligonucleotide
acatccccgctccctaaagtgtcagtacctacctctga

SEQ ID NO: 28642 - DNA, 35 bp, Artificial Sequence
  Synthetic oligonucleotide
atgtccgccactccacgttattaacttcgacacta

SEQ ID NO: 28643 - DNA, 35 bp, Artificial Sequence
  Synthetic oligonucleotide
ttctcccgtgtacgctcctgagttgctcattacac

SEQ ID NO: 28644 - DNA, 35 bp, Artificial Sequence
  Synthetic oligonucleotide
gcaaccgcttacccctgcctgggaggtgacgaccc

SEQ ID NO: 28645 - DNA, 35 bp, Artificial Sequence
  Synthetic oligonucleotide
tgcttcacattcgcccgattatggccccacttccc

SEQ ID NO: 28646 - DNA, 35 bp, Artificial Sequence
  Synthetic oligonucleotide
gacccacaatacaatcagttccccggctatggtgc

SEQ ID NO: 28647 - DNA, 35 bp, Artificial Sequence
  Synthetic oligonucleotide
tcccaggtccgatccatgctatccggtaattactc

SEQ ID NO: 28648 - DNA, 35 bp, Artificial Sequence
  Synthetic oligonucleotide
gacttacctgccaacaccatctatcttagaggcaa

SEQ ID NO: 28649 - DNA, 37 bp, Artificial Sequence
  Synthetic oligonucleotide
gaaggggacgggggggtaaaacaataacgttgccaga

SEQ ID NO: 28650 - DNA, 37 bp, Artificial Sequence
  Synthetic oligonucleotide
atctaccccatatgttttcttgctccagacctttaga

SEQ ID NO: 28651 - DNA, 38 bp, Artificial Sequence
  Synthetic oligonucleotide
taggggagaggacagggagggaaattcggaatgcgtga

SEQ ID NO: 28652 - DNA, 38 bp, Artificial Sequence
  Synthetic oligonucleotide
gacacacgggaaggggatggcgactgagggctcggtga

SEQ ID NO: 28653 - DNA, 36 bp, Artificial Sequence
  Synthetic oligonucleotide
actcacctgtcgaacccgtgcatctgccgcgcgcta

SEQ ID NO: 28654 - DNA, 35 bp, Artificial Sequence
  Synthetic oligonucleotide
catcgacgccccagaatccattgcctgttcctcta

SEQ ID NO: 28655 - DNA, 35 bp, Artificial Sequence
  Synthetic oligonucleotide
gagctcattcctgtttgcacgtaatcgatcctccc

SEQ ID NO: 28656 - DNA, 35 bp, Artificial Sequence
  Synthetic oligonucleotide
ttacgaacaccctctccggaccgtttagcctatcc

SEQ ID NO: 28657 - DNA, 35 bp, Artificial Sequence
  Synthetic oligonucleotide
gccctcccctacgccgccatcttccaaatggctgg

SEQ ID NO: 28658 - DNA, 35 bp, Artificial Sequence
  Synthetic oligonucleotide
gcctctccttgcgtaacccccccgcgactctcgtg

SEQ ID NO: 28659 - DNA, 35 bp, Artificial Sequence
  Synthetic oligonucleotide
aactgtcgcaccagcgatgactcttcgctccccat

SEQ ID NO: 28660 - DNA, 35 bp, Artificial Sequence
  Synthetic oligonucleotide
tccgcgccggcacccactcatcgctccatcggcat

SEQ ID NO: 28661 - DNA, 34 bp, Artificial Sequence
  Synthetic oligonucleotide
tcctcactatcgactgttacgttgtcctctagtt

SEQ ID NO: 28662 - DNA, 36 bp, Artificial Sequence
  Synthetic oligonucleotide
tcctcctaccctgatatcgacccatgaactgggaaa

SEQ ID NO: 28663 - DNA, 36 bp, Artificial Sequence
  Synthetic oligonucleotide
acccccgcaccaggtcaaacttacaggtccgtctca

SEQ ID NO: 28664 - DNA, 36 bp, Artificial Sequence
  Synthetic oligonucleotide
gagtaggcggagcatgaggggcgaggggggccaaga

SEQ ID NO: 28665 - DNA, 38 bp, Artificial Sequence
  Synthetic oligonucleotide
gtactggggaaaagttggggtttgggagctgtgggaga

SEQ ID NO: 28666 - DNA, 35 bp, Artificial Sequence
  Synthetic oligonucleotide
tttgccgacccgcgccgtatgcctagcctagccga

SEQ ID NO: 28667 - DNA, 36 bp, Artificial Sequence
  Synthetic oligonucleotide
agacccgcacctcctcgcccatgctgtgtccttcga

SEQ ID NO: 28668 - DNA, 37 bp, Artificial Sequence
  Synthetic oligonucleotide
tccctgtgctctcgcctttttgttagcccctctagga

SEQ ID NO: 28669 - DNA, 36 bp, Artificial Sequence
  Synthetic oligonucleotide
gcccacattacactttatcatacggtcccggttgga

SEQ ID NO: 28670 - DNA, 38 bp, Artificial Sequence
  Synthetic oligonucleotide
ttgcccctctatggcccccttgtacagtaatcaactga

SEQ ID NO: 28671 - DNA, 37 bp, Artificial Sequence
  Synthetic oligonucleotide
acacccgccgttaccagttccgacactgccatgttga

SEQ ID NO: 28672 - DNA, 36 bp, Artificial Sequence
  Synthetic oligonucleotide
tccgtacccgacgttcatgccagatctttaattgta

SEQ ID NO: 28673 - DNA, 36 bp, Artificial Sequence
  Synthetic oligonucleotide
tccgctcacctcctgaaatttcccgagccacattta

SEQ ID NO: 28674 - DNA, 35 bp, Artificial Sequence
  Synthetic oligonucleotide
aataccccccggcctggtccacctcgcgcaacggc

SEQ ID NO: 28675 - DNA, 35 bp, Artificial Sequence
  Synthetic oligonucleotide
gctgttcgccacgcttattttgggcatgatcctgc

SEQ ID NO: 28676 - DNA, 35 bp, Artificial Sequence
  Synthetic oligonucleotide
aacacgcgtatgctttcgtaggtccatcgtcgttc

SEQ ID NO: 28677 - DNA, 35 bp, Artificial Sequence
  Synthetic oligonucleotide
ggaggacaccgtccgctatgttcttcacttggtct

SEQ ID NO: 28678 - DNA, 35 bp, Artificial Sequence
  Synthetic oligonucleotide
gaacacccccctggaacatccctgaactatgtggt

SEQ ID NO: 28679 - DNA, 35 bp, Artificial Sequence
  Synthetic oligonucleotide
attcctggctgcaccacgcaccgttactgaccatt

SEQ ID NO: 28680 - DNA, 35 bp, Artificial Sequence
  Synthetic oligonucleotide
tcacacctatacggggcatttccatcattgctctt

SEQ ID NO: 28681 - DNA, 36 bp, Artificial Sequence
  Synthetic oligonucleotide
gctatgacacggcgggtgaagggatgaggggtggaa

SEQ ID NO: 28682 - DNA, 36 bp, Artificial Sequence
  Synthetic oligonucleotide
acatcgctcagtcactgcgtctctctatctgcaaca

SEQ ID NO: 28683 - DNA, 35 bp, Artificial Sequence
  Synthetic oligonucleotide
agtgaaccgtacagcttgtccgcccaccaccgcca

SEQ ID NO: 28684 - DNA, 37 bp, Artificial Sequence
  Synthetic oligonucleotide
gacgagtgggaacgaataaatgaggaataggtataga

SEQ ID NO: 28685 - DNA, 37 bp, Artificial Sequence
  Synthetic oligonucleotide
aatcaccgtccacatatcaacttgcgcactgggccga

SEQ ID NO: 28686 - DNA, 37 bp, Artificial Sequence
  Synthetic oligonucleotide
ttgacaccggacgccgtgacatctgctcactcttcga

SEQ ID NO: 28687 - DNA, 35 bp, Artificial Sequence
  Synthetic oligonucleotide
gtgccctccgattaccttgctctcatctaccagga

SEQ ID NO: 28688 - DNA, 37 bp, Artificial Sequence
  Synthetic oligonucleotide
atgcatacactgcctgttccctcattttgtcgtagga

SEQ ID NO: 28689 - DNA, 37 bp, Artificial Sequence
  Synthetic oligonucleotide
ggtgtgagcgaaaggaattagagtgggagggtaggga

SEQ ID NO: 28690 - DNA, 38 bp, Artificial Sequence
  Synthetic oligonucleotide
accgcctccactgactctccacccttcggccgttatga

SEQ ID NO: 28691 - DNA, 37 bp, Artificial Sequence
  Synthetic oligonucleotide
tgcgggagggtaaagcggaggagtaggaacatggtga

SEQ ID NO: 28692 - DNA, 36 bp, Artificial Sequence
  Synthetic oligonucleotide
atgactaaagccgaagaagggagttagggtaaagta

SEQ ID NO: 28693 - DNA, 36 bp, Artificial Sequence
  Synthetic oligonucleotide
ttcatttgccacacatcatatatctggtcccccgta

SEQ ID NO: 28694 - DNA, 35 bp, Artificial Sequence
  Synthetic oligonucleotide
agcacgacgaaataggggtgagggaagctatggta

SEQ ID NO: 28695 - DNA, 33 bp, Artificial Sequence
  Synthetic oligonucleotide
atgtaggcccaccatctcgtactatcgcgagcc

SEQ ID NO: 28696 - DNA, 35 bp, Artificial Sequence
  Synthetic oligonucleotide
taggcccaacaacaatggcactaatccacgccacg

SEQ ID NO: 28697 - DNA, 35 bp, Artificial Sequence
  Synthetic oligonucleotide
gaagaacgagggataggaaggaaaaatgctgcccg

SEQ ID NO: 28698 - DNA, 35 bp, Artificial Sequence
  Synthetic oligonucleotide
gttactcgcagaaccggtaccgaggccactaccat

SEQ ID NO: 28699 - DNA, 36 bp, Artificial Sequence
  Synthetic oligonucleotide
actagcacaaacctgttcaacctgcctacctgtaca

SEQ ID NO: 28700 - DNA, 37 bp, Artificial Sequence
  Synthetic oligonucleotide
gcatctgcccgttttatctgttccatcttttcgcaga

SEQ ID NO: 28701 - DNA, 37 bp, Artificial Sequence
  Synthetic oligonucleotide
aaccctacccggcccgtatttcgcatccttatccgga

SEQ ID NO: 28702 - DNA, 38 bp, Artificial Sequence
  Synthetic oligonucleotide
tgcgccatcattgcggttatccccacttccatatttga

SEQ ID NO: 28703 - DNA, 38 bp, Artificial Sequence
  Synthetic oligonucleotide
gcacccgaccctgtggatgttctctcgtgcccttttga

SEQ ID NO: 28704 - DNA, 35 bp, Artificial Sequence
  Synthetic oligonucleotide
actggcgaacgacagctttccttttttgtacgtta

SEQ ID NO: 28705 - DNA, 35 bp, Artificial Sequence
  Synthetic oligonucleotide
tgtgtcgcaacccgacgctggacacacctacttta

SEQ ID NO: 28706 - DNA, 35 bp, Artificial Sequence
  Synthetic oligonucleotide
gacacactagcgacatgtcaacccagccatcttta

SEQ ID NO: 28707 - DNA, 35 bp, Artificial Sequence
  Synthetic oligonucleotide
gccagccaacaaatgtccatcatcattcctcctcg

SEQ ID NO: 28708 - DNA, 35 bp, Artificial Sequence
  Synthetic oligonucleotide
gatgttaatcgccgcctggccgttcctcttcccct

SEQ ID NO: 28709 - DNA, 36 bp, Artificial Sequence
  Synthetic oligonucleotide
caaggggcgcggtcccccttgctggccttcttttaa

SEQ ID NO: 28710 - DNA, 36 bp, Artificial Sequence
  Synthetic oligonucleotide
aagctgcccagccattttcactcattctctcctcca

SEQ ID NO: 28711 - DNA, 36 bp, Artificial Sequence
  Synthetic oligonucleotide
tcagctcattgtcccggccaccttgtactgtctgca

SEQ ID NO: 28712 - DNA, 38 bp, Artificial Sequence
  Synthetic oligonucleotide
ttggctaccgtcatatccccgtccaatcctgcccctga

SEQ ID NO: 28713 - DNA, 35 bp, Artificial Sequence
  Synthetic oligonucleotide
ttcgacgccgccccgaacgcctttatagacaagac

SEQ ID NO: 28714 - DNA, 35 bp, Artificial Sequence
  Synthetic oligonucleotide
tgaccccgtactggacttcccctgatccacaatac

SEQ ID NO: 28715 - DNA, 35 bp, Artificial Sequence
  Synthetic oligonucleotide
gagcacaaaacactgcactggtccctgacttccat

SEQ ID NO: 28716 - DNA, 35 bp, Artificial Sequence
  Synthetic oligonucleotide
tttccgtgcctgcccgatctcacctgcctttcgat

SEQ ID NO: 28717 - DNA, 35 bp, Artificial Sequence
  Synthetic oligonucleotide
tcagcctctcagtgcaagcaaaacctcctttccct

SEQ ID NO: 28718 - DNA, 35 bp, Artificial Sequence
  Synthetic oligonucleotide
acgcccccgctgtcccctaggtctttccaataggt

SEQ ID NO: 28719 - DNA, 35 bp, Artificial Sequence
  Synthetic oligonucleotide
tatcgctgttagcgcacctacacttctattcttgt

SEQ ID NO: 28720 - DNA, 35 bp, Artificial Sequence
  Synthetic oligonucleotide
actatccatccttctatgtcagtcagccccccgca

SEQ ID NO: 28721 - DNA, 37 bp, Artificial Sequence
  Synthetic oligonucleotide
ttagggaggaaggattcggaggggcggggagcagaga

SEQ ID NO: 28722 - DNA, 36 bp, Artificial Sequence
  Synthetic oligonucleotide
gttcatcacgccagctgattgcttctgtaccaccga

SEQ ID NO: 28723 - DNA, 38 bp, Artificial Sequence
  Synthetic oligonucleotide
gcccatacctgcagcgcaaaatccccgctccgatctga

SEQ ID NO: 28724 - DNA, 35 bp, Artificial Sequence
  Synthetic oligonucleotide
tcaggcccggggatctgcatcacacctccacttga

SEQ ID NO: 28725 - DNA, 36 bp, Artificial Sequence
  Synthetic oligonucleotide
tagcccacaacaatgttgcgacaagacccacatata

SEQ ID NO: 28726 - DNA, 35 bp, Artificial Sequence
  Synthetic oligonucleotide
atccagctccatccaacatgtgggccatccatccc

SEQ ID NO: 28727 - DNA, 35 bp, Artificial Sequence
  Synthetic oligonucleotide
tccgatcagcgtttacgctctctaccacctgatcc

SEQ ID NO: 28728 - DNA, 35 bp, Artificial Sequence
  Synthetic oligonucleotide
tccaccatccgctctgacgccgcttattgccccgc

SEQ ID NO: 28729 - DNA, 35 bp, Artificial Sequence
  Synthetic oligonucleotide
tgtttccatcgagtgccctatctactgatcacttc

SEQ ID NO: 28730 - DNA, 35 bp, Artificial Sequence
  Synthetic oligonucleotide
taccggtgggcgggagggcgtggcaactctgtttc

SEQ ID NO: 28731 - DNA, 35 bp, Artificial Sequence
  Synthetic oligonucleotide
tacagcccaatgtcctcatataccggttctccact

SEQ ID NO: 28732 - DNA, 35 bp, Artificial Sequence
  Synthetic oligonucleotide
tgctgccataaatggcttcgacgctctcgtttcct

SEQ ID NO: 28733 - DNA, 36 bp, Artificial Sequence
  Synthetic oligonucleotide
ttcgcgcctccctccatgccatcggtttcattaaca

SEQ ID NO: 28734 - DNA, 36 bp, Artificial Sequence
  Synthetic oligonucleotide
gttgcccgccgccattgagtgcgttatctttctgca

SEQ ID NO: 28735 - DNA, 36 bp, Artificial Sequence
  Synthetic oligonucleotide
atccacctggctggcgtggaaacatccatactgtca

SEQ ID NO: 28736 - DNA, 35 bp, Artificial Sequence
  Synthetic oligonucleotide
gccttaacgcccgcaaccgatacacgcgtttttca

SEQ ID NO: 28737 - DNA, 37 bp, Artificial Sequence
  Synthetic oligonucleotide
tcccatctgcccctgagtaattcttagatccaccaga

SEQ ID NO: 28738 - DNA, 37 bp, Artificial Sequence
  Synthetic oligonucleotide
gcccacgccgccctgtaaatctccaataccgcaacga

SEQ ID NO: 28739 - DNA, 37 bp, Artificial Sequence
  Synthetic oligonucleotide
accatctggacggcacagttcatccccccgtacctga

SEQ ID NO: 28740 - DNA, 36 bp, Artificial Sequence
  Synthetic oligonucleotide
tgagaacagcctctcgttcaagattccacactctga

SEQ ID NO: 28741 - DNA, 38 bp, Artificial Sequence
  Synthetic oligonucleotide
tcaccggctgatatctttcttttgtgcgtgccgtttga

SEQ ID NO: 28742 - DNA, 36 bp, Artificial Sequence
  Synthetic oligonucleotide
attgtctcccgcaccttgggatcatagggtactcta

SEQ ID NO: 28743 - DNA, 35 bp, Artificial Sequence
  Synthetic oligonucleotide
atcccagtccagatcccattctcaggcgccctcta

SEQ ID NO: 28744 - DNA, 35 bp, Artificial Sequence
  Synthetic oligonucleotide
accaccatctccgacagcatgcacgcgccccgtac

SEQ ID NO: 28745 - DNA, 35 bp, Artificial Sequence
  Synthetic oligonucleotide
gcacaagacacacaccgctacaacgcagggaacgc

SEQ ID NO: 28746 - DNA, 35 bp, Artificial Sequence
  Synthetic oligonucleotide
gctcgtgcaactatcctgtaaactcgcccctacgc

SEQ ID NO: 28747 - DNA, 35 bp, Artificial Sequence
  Synthetic oligonucleotide
tacccacgcaccgccgccccatgatctacactatc

SEQ ID NO: 28748 - DNA, 35 bp, Artificial Sequence
  Synthetic oligonucleotide
gtgtacacttcaggcactttgtacggttaccattc

SEQ ID NO: 28749 - DNA, 35 bp, Artificial Sequence
  Synthetic oligonucleotide
accgctaggagcgtctcacacacccccgcacaacg

SEQ ID NO: 28750 - DNA, 35 bp, Artificial Sequence
  Synthetic oligonucleotide
tcatcgggtcaagaccgttcccttgcttcctgccg

SEQ ID NO: 28751 - DNA, 35 bp, Artificial Sequence
  Synthetic oligonucleotide
tccggaatgacgttccggaagacctaacatactat

SEQ ID NO: 28752 - DNA, 35 bp, Artificial Sequence
  Synthetic oligonucleotide
tcatcgtgggcttaatattgccgtaaccacaccct

SEQ ID NO: 28753 - DNA, 36 bp, Artificial Sequence
  Synthetic oligonucleotide
gtacgtctgcactgcctcccctaagcactgcgtgca

SEQ ID NO: 28754 - DNA, 35 bp, Artificial Sequence
  Synthetic oligonucleotide
gccggggacggggaaggggtatgggcgcacatgga

SEQ ID NO: 28755 - DNA, 37 bp, Artificial Sequence
  Synthetic oligonucleotide
gcgcactccagcacattgccgaactccgatgacatga

SEQ ID NO: 28756 - DNA, 38 bp, Artificial Sequence
  Synthetic oligonucleotide
tatccacatcgatgccgttgccgctactgactccatga

SEQ ID NO: 28757 - DNA, 38 bp, Artificial Sequence
  Synthetic oligonucleotide
gtggtcacccttccgaactagtactgttgaactcatga

SEQ ID NO: 28758 - DNA, 37 bp, Artificial Sequence
  Synthetic oligonucleotide
gcatgcccctgacgccagttatctacccccgctatga

SEQ ID NO: 28759 - DNA, 38 bp, Artificial Sequence
  Synthetic oligonucleotide
gaatgcgacgcacaagtaaggggaatggtaaggtatga

SEQ ID NO: 28760 - DNA, 37 bp, Artificial Sequence
  Synthetic oligonucleotide
tgcaactgcacccagcccgcctaatccatgcgcttga

SEQ ID NO: 28761 - DNA, 36 bp, Artificial Sequence
  Synthetic oligonucleotide
ttgttcctcctcggtgtgcaaaccgcttcctccata

SEQ ID NO: 28762 - DNA, 35 bp, Artificial Sequence
  Synthetic oligonucleotide
gtgacctccattgcgattttcggtttgccattagc

SEQ ID NO: 28763 - DNA, 35 bp, Artificial Sequence
  Synthetic oligonucleotide
gcctgacgcacctctctccgcataacacgtagtag

SEQ ID NO: 28764 - DNA, 36 bp, Artificial Sequence
  Synthetic oligonucleotide
gcgcacctcctccatatgctttgatagcgtttgcca

SEQ ID NO: 28765 - DNA, 36 bp, Artificial Sequence
  Synthetic oligonucleotide
accaccgatcctcactgaagcacatgtagcagtgca

SEQ ID NO: 28766 - DNA, 37 bp, Artificial Sequence
  Synthetic oligonucleotide
gcgctagcacgagttgccaccacctcttcaccccaga

SEQ ID NO: 28767 - DNA, 37 bp, Artificial Sequence
  Synthetic oligonucleotide
tacgttcctcaccctatgccatctgctgtcaatcaga

SEQ ID NO: 28768 - DNA, 38 bp, Artificial Sequence
  Synthetic oligonucleotide
agcaccgacgctctccccagccatcccgcgtttctgga

SEQ ID NO: 28769 - DNA, 38 bp, Artificial Sequence
  Synthetic oligonucleotide
gcagagaggggagaggtaagggggggtgccgaatctga

SEQ ID NO: 28770 - DNA, 38 bp, Artificial Sequence
  Synthetic oligonucleotide
gacaccgacgcaatgtcctcaccgacctgtagccttga

SEQ ID NO: 28771 - DNA, 35 bp, Artificial Sequence
  Synthetic oligonucleotide
tcaaaccagtcacaaatgcccttgcgtcaacctac

SEQ ID NO: 28772 - DNA, 35 bp, Artificial Sequence
  Synthetic oligonucleotide
gtgagcatatcaggctatcccctcactgtcgaacc

SEQ ID NO: 28773 - DNA, 35 bp, Artificial Sequence
  Synthetic oligonucleotide
tcaatgccccctcatgcactagcttatgcataacg

SEQ ID NO: 28774 - DNA, 35 bp, Artificial Sequence
  Synthetic oligonucleotide
gcaacccactgcaccagcaaaccgcgcccattggt

SEQ ID NO: 28775 - DNA, 35 bp, Artificial Sequence
  Synthetic oligonucleotide
taggtcaacggcaacatatgcaccagccactcatt

SEQ ID NO: 28776 - DNA, 35 bp, Artificial Sequence
  Synthetic oligonucleotide
tgcttccgcctcgccccattgcacattatttgctt

SEQ ID NO: 28777 - DNA, 35 bp, Artificial Sequence
  Synthetic oligonucleotide
gtgaacctgtattccctatggtccttggagttctt

SEQ ID NO: 28778 - DNA, 36 bp, Artificial Sequence
  Synthetic oligonucleotide
agaccgtccatggcgtcctcttcaccgtttctgtaa

SEQ ID NO: 28779 - DNA, 36 bp, Artificial Sequence
  Synthetic oligonucleotide
gtgcctatcaggcaacccgactacctgttcttgcca

SEQ ID NO: 28780 - DNA, 36 bp, Artificial Sequence
  Synthetic oligonucleotide
acaccacgtacggtctcatcaggaatttactgcgca

SEQ ID NO: 28781 - DNA, 37 bp, Artificial Sequence
  Synthetic oligonucleotide
gaggccgaacataagccaccgtgaccgccactaccga

SEQ ID NO: 28782 - DNA, 37 bp, Artificial Sequence
  Synthetic oligonucleotide
tgacatccgtgctttttgttagatgccctttcctcga

SEQ ID NO: 28783 - DNA, 38 bp, Artificial Sequence
  Synthetic oligonucleotide
gttgcagagtaacgggagggcgggtaggctggcggtga

SEQ ID NO: 28784 - DNA, 38 bp, Artificial Sequence
  Synthetic oligonucleotide
gccgagctccgcctatacattgagtccccgctttttga

SEQ ID NO: 28785 - DNA, 36 bp, Artificial Sequence
  Synthetic oligonucleotide
gacattcaccgagatcccgggcctgactctattata

SEQ ID NO: 28786 - DNA, 35 bp, Artificial Sequence
  Synthetic oligonucleotide
gtatgcgtagccgccccccacaacgtgcgacttgc

SEQ ID NO: 28787 - DNA, 35 bp, Artificial Sequence
  Synthetic oligonucleotide
gtcacgagcctcgggggaatcgtgacaaacttatc

SEQ ID NO: 28788 - DNA, 35 bp, Artificial Sequence
  Synthetic oligonucleotide
aacaactaccacaggctgtatgcctgagctttact

SEQ ID NO: 28789 - DNA, 35 bp, Artificial Sequence
  Synthetic oligonucleotide
ggggccggggagggaaaggggtgtggcccactggt

SEQ ID NO: 28790 - DNA, 35 bp, Artificial Sequence
  Synthetic oligonucleotide
ggtgacgctcagttctcagcgaaccctctgtcctt

SEQ ID NO: 28791 - DNA, 35 bp, Artificial Sequence
  Synthetic oligonucleotide
taagccgtcgccgccataacctcttcttctagctt

SEQ ID NO: 28792 - DNA, 34 bp, Artificial Sequence
  Synthetic oligonucleotide
gcggttcgcagaatcctgtctttcctatcctttt

SEQ ID NO: 28793 - DNA, 36 bp, Artificial Sequence
  Synthetic oligonucleotide
atgcccatcttccctctgacctccgcccgcgagtca

SEQ ID NO: 28794 - DNA, 37 bp, Artificial Sequence
  Synthetic oligonucleotide
gacccaccacatatgcactatcgaccttgctgtgaga

SEQ ID NO: 28795 - DNA, 37 bp, Artificial Sequence
  Synthetic oligonucleotide
acggagcccgacgccctgccccactttcttttctgga

SEQ ID NO: 28796 - DNA, 35 bp, Artificial Sequence
  Synthetic oligonucleotide
acatgcaacagcgtgtaggtgctcttggctctccc

SEQ ID NO: 28797 - DNA, 35 bp, Artificial Sequence
  Synthetic oligonucleotide
aactacctacactagaccgtgacatttgccgttcc

SEQ ID NO: 28798 - DNA, 35 bp, Artificial Sequence
  Synthetic oligonucleotide
attatgcccacctgcacgcgcttaccctctgcttg

SEQ ID NO: 28799 - DNA, 36 bp, Artificial Sequence
  Synthetic oligonucleotide
acactaccgacaggtctcacggggtctttttttcaa

SEQ ID NO: 28800 - DNA, 36 bp, Artificial Sequence
  Synthetic oligonucleotide
gtttaccgcacgtccgggctggcacctattcctaca

SEQ ID NO: 28801 - DNA, 35 bp, Artificial Sequence
  Synthetic oligonucleotide
gacccgctgctatatgaaggccctcacctctacca

SEQ ID NO: 28802 - DNA, 36 bp, Artificial Sequence
  Synthetic oligonucleotide
tttgcactactatgcgtgccgttccacgtttctcca

SEQ ID NO: 28803 - DNA, 36 bp, Artificial Sequence
  Synthetic oligonucleotide
gtgtccgttacgctgccaaatagcctgtcccgatca

SEQ ID NO: 28804 - DNA, 37 bp, Artificial Sequence
  Synthetic oligonucleotide
agagagggaggacaggagaaaggtgagtgcggatcga

SEQ ID NO: 28805 - DNA, 37 bp, Artificial Sequence
  Synthetic oligonucleotide
acgagagggaaaggtggctgtcaaaaaaactggggga

SEQ ID NO: 28806 - DNA, 37 bp, Artificial Sequence
  Synthetic oligonucleotide
gtgatccgggtgtgggggatagggttagggacttgga

SEQ ID NO: 28807 - DNA, 37 bp, Artificial Sequence
  Synthetic oligonucleotide
gaggacgccccgaaacacctaccgacccagtctatga

SEQ ID NO: 28808 - DNA, 35 bp, Artificial Sequence
  Synthetic oligonucleotide
gttgcagggggggtgggggaagggccactgcacta

SEQ ID NO: 28809 - DNA, 35 bp, Artificial Sequence
  Synthetic oligonucleotide
acctgacgtagtctcttttaatcctgttctatcac

SEQ ID NO: 28810 - DNA, 35 bp, Artificial Sequence
  Synthetic oligonucleotide
ttggcccaaccttgcactattgttgcgttgccatc

SEQ ID NO: 28811 - DNA, 35 bp, Artificial Sequence
  Synthetic oligonucleotide
tgacaggtaatctaccgaacgacccccgcctgctc

SEQ ID NO: 28812 - DNA, 35 bp, Artificial Sequence
  Synthetic oligonucleotide
caccctcgcccctttttgaccttgctgtttattag

SEQ ID NO: 28813 - DNA, 35 bp, Artificial Sequence
  Synthetic oligonucleotide
caacaccacccacgcgccttgcctttgtcccaccg

SEQ ID NO: 28814 - DNA, 35 bp, Artificial Sequence
  Synthetic oligonucleotide
actggagctcgccgttatgtttgcccctgatcatt

SEQ ID NO: 28815 - DNA, 35 bp, Artificial Sequence
  Synthetic oligonucleotide
tagtgcttccgcctcagtctctgtccgcctcctaa

SEQ ID NO: 28816 - DNA, 35 bp, Artificial Sequence
  Synthetic oligonucleotide
acagtggtaatgggcgaaatgggaaaggatatgca

SEQ ID NO: 28817 - DNA, 37 bp, Artificial Sequence
  Synthetic oligonucleotide
tcccaccatcggtttactccatttcagcccaagtgga

SEQ ID NO: 28818 - DNA, 38 bp, Artificial Sequence
  Synthetic oligonucleotide
accgtgtcccggccccattgcgctttcgcttactctga

SEQ ID NO: 28819 - DNA, 36 bp, Artificial Sequence
  Synthetic oligonucleotide
gcccaacatgccccgtaaaccacggtgagctacacc

SEQ ID NO: 28820 - DNA, 35 bp, Artificial Sequence
  Synthetic oligonucleotide
tgggtcaccactcattagtgtttcacctggcttcc

SEQ ID NO: 28821 - DNA, 35 bp, Artificial Sequence
  Synthetic oligonucleotide
atttaggggaggggtggggcggtgggcggggcggc

SEQ ID NO: 28822 - DNA, 35 bp, Artificial Sequence
  Synthetic oligonucleotide
acaccaacacacatcctgtcgacttctcgaaccag

SEQ ID NO: 28823 - DNA, 35 bp, Artificial Sequence
  Synthetic oligonucleotide
tcaacccacacacaacatcgcggttaacacgtgtt

SEQ ID NO: 28824 - DNA, 35 bp, Artificial Sequence
  Synthetic oligonucleotide
ttagacatggctgacgaatgcctctcctccccttt

SEQ ID NO: 28825 - DNA, 36 bp, Artificial Sequence
  Synthetic oligonucleotide
gttcagtgccccatgttcgtgttcgctctcccacca

SEQ ID NO: 28826 - DNA, 36 bp, Artificial Sequence
  Synthetic oligonucleotide
tcccgccctgagcccgcccgtattcgacctgctcca

SEQ ID NO: 28827 - DNA, 36 bp, Artificial Sequence
  Synthetic oligonucleotide
tacagtgtccccgtcgtatccccaactctccgctca

SEQ ID NO: 28828 - DNA, 36 bp, Artificial Sequence
  Synthetic oligonucleotide
gagatggagggaggtattcgggggagaatctggtca

SEQ ID NO: 28829 - DNA, 37 bp, Artificial Sequence
  Synthetic oligonucleotide
ggtcggtcaccacccatgtcctactttctgttcacga

SEQ ID NO: 28830 - DNA, 37 bp, Artificial Sequence
  Synthetic oligonucleotide
gacgggggtggaaggggttacacggtgagtggacgga

SEQ ID NO: 28831 - DNA, 37 bp, Artificial Sequence
  Synthetic oligonucleotide
gagtacgagggagataggaaggcttgaatcaggggga

SEQ ID NO: 28832 - DNA, 36 bp, Artificial Sequence
  Synthetic oligonucleotide
atgctggccccagggtcggtgggaatggggtgggga

SEQ ID NO: 28833 - DNA, 38 bp, Artificial Sequence
  Synthetic oligonucleotide
agcgagtaaagagagcggtgagagagaggggagtatga

SEQ ID NO: 28834 - DNA, 38 bp, Artificial Sequence
  Synthetic oligonucleotide
tcatcagtcgctggatcaccatgcatcgcccgccctga

SEQ ID NO: 28835 - DNA, 38 bp, Artificial Sequence
  Synthetic oligonucleotide
gcaacgcacgacgctctctctcataacggtggtcctga

SEQ ID NO: 28836 - DNA, 35 bp, Artificial Sequence
  Synthetic oligonucleotide
ttcaacgcgcccacgacttcgcaggaccttcttac

SEQ ID NO: 28837 - DNA, 35 bp, Artificial Sequence
  Synthetic oligonucleotide
aacccgaccctgagtagcttaacacttcgtcgccc

SEQ ID NO: 28838 - DNA, 35 bp, Artificial Sequence
  Synthetic oligonucleotide
gcgggacgcccaatttcacatactcgccccgcttc

SEQ ID NO: 28839 - DNA, 35 bp, Artificial Sequence
  Synthetic oligonucleotide
tgaggggacgaaaatttggaagtgcgggggggaag

SEQ ID NO: 28840 - DNA, 35 bp, Artificial Sequence
  Synthetic oligonucleotide
tatcgcgtgggtaggggacgggagaagtatgaaat

SEQ ID NO: 28841 - DNA, 35 bp, Artificial Sequence
  Synthetic oligonucleotide
agagatggacgggggggaatacgtactacagtgaa

SEQ ID NO: 28842 - DNA, 35 bp, Artificial Sequence
  Synthetic oligonucleotide
tatccccgtgcgcccctccccgaggaaacctgtaa

SEQ ID NO: 28843 - DNA, 35 bp, Artificial Sequence
  Synthetic oligonucleotide
tccacctccctccgatttgcattcgcttggtttaa

SEQ ID NO: 28844 - DNA, 35 bp, Artificial Sequence
  Synthetic oligonucleotide
acaaccacccgagccttacggccttatttacgcca

SEQ ID NO: 28845 - DNA, 36 bp, Artificial Sequence
  Synthetic oligonucleotide
tatcaccacataggtatccgttagcgcatacttgca

SEQ ID NO: 28846 - DNA, 36 bp, Artificial Sequence
  Synthetic oligonucleotide
tttgagtgcgcggatttttaccctctcctgtgatca

SEQ ID NO: 28847 - DNA, 36 bp, Artificial Sequence
  Synthetic oligonucleotide
gcccggtttcgtcgtcccgcccagttctcctactca

SEQ ID NO: 28848 - DNA, 36 bp, Artificial Sequence
  Synthetic oligonucleotide
gactatcgacgagttgcatccattccagccctgtca

SEQ ID NO: 28849 - DNA, 37 bp, Artificial Sequence
  Synthetic oligonucleotide
agccccccccactgagtcccggagatcctccttcaga

SEQ ID NO: 28850 - DNA, 36 bp, Artificial Sequence
  Synthetic oligonucleotide
agacaacccaatactctcctgtccattcattcacga

SEQ ID NO: 28851 - DNA, 37 bp, Artificial Sequence
  Synthetic oligonucleotide
gcacaaccgcttctagcacgtaccttagttttaccga

SEQ ID NO: 28852 - DNA, 36 bp, Artificial Sequence
  Synthetic oligonucleotide
tcgaaggggcttgcaaggcaaagtgggggagttgga

SEQ ID NO: 28853 - DNA, 38 bp, Artificial Sequence
  Synthetic oligonucleotide
tcgatccaccaccacgcgtcgttcctaggacttactga

SEQ ID NO: 28854 - DNA, 37 bp, Artificial Sequence
  Synthetic oligonucleotide
atgcgagggtgtcgtggaaggaacgggcggaggctga

SEQ ID NO: 28855 - DNA, 38 bp, Artificial Sequence
  Synthetic oligonucleotide
gcgtagccggcaacttacactcgatctccttaccgtga

SEQ ID NO: 28856 - DNA, 38 bp, Artificial Sequence
  Synthetic oligonucleotide
atctggcaatcaggccagaaggggggggaatagggtga

SEQ ID NO: 28857 - DNA, 35 bp, Artificial Sequence
  Synthetic oligonucleotide
gtaccgccaagactttttcacctccgcgcaccata

SEQ ID NO: 28858 - DNA, 36 bp, Artificial Sequence
  Synthetic oligonucleotide
gatccgtcatccatgtattcggcaccgcttcttgta

SEQ ID NO: 28859 - DNA, 35 bp, Artificial Sequence
  Synthetic oligonucleotide
actgtaggcggagtaggaggggggtcgcacatggc

SEQ ID NO: 28860 - DNA, 35 bp, Artificial Sequence
  Synthetic oligonucleotide
tcagcacttcgtacgctccggccatttttgcattg

SEQ ID NO: 28861 - DNA, 35 bp, Artificial Sequence
  Synthetic oligonucleotide
tgcccggtaacggatcgtcctctcgccctgtatca

SEQ ID NO: 28862 - DNA, 35 bp, Artificial Sequence
  Synthetic oligonucleotide
tcttgcgccccgatcacacctgtgctgtctcttca

SEQ ID NO: 28863 - DNA, 37 bp, Artificial Sequence
  Synthetic oligonucleotide
tgacacacccacttgatcggagccgcaaatcccccga

SEQ ID NO: 28864 - DNA, 36 bp, Artificial Sequence
  Synthetic oligonucleotide
atccgtgctgttactgtgcctgccttttgcctccga

SEQ ID NO: 28865 - DNA, 37 bp, Artificial Sequence
  Synthetic oligonucleotide
tcgtgcctcatgactgatctcaataactgcccctcga

SEQ ID NO: 28866 - DNA, 37 bp, Artificial Sequence
  Synthetic oligonucleotide
agcaacgtccgtcgcctcgttctatctctccagtgga

SEQ ID NO: 28867 - DNA, 38 bp, Artificial Sequence
  Synthetic oligonucleotide
gccacactgtttggttacatcgcccctccaagaaatga

SEQ ID NO: 28868 - DNA, 38 bp, Artificial Sequence
  Synthetic oligonucleotide
acagagcgtgggggaggacaatatgggatgtaggctga

SEQ ID NO: 28869 - DNA, 38 bp, Artificial Sequence
  Synthetic oligonucleotide
gcctccactcgtactgtaggaaatacacctccacttga

SEQ ID NO: 28870 - DNA, 35 bp, Artificial Sequence
  Synthetic oligonucleotide
tatcacactcgccgcaacttgacactgtgggtcta

SEQ ID NO: 28871 - DNA, 35 bp, Artificial Sequence
  Synthetic oligonucleotide
gtgtcaatcggggaaccatatgtctgtcaatcgcc

SEQ ID NO: 28872 - DNA, 35 bp, Artificial Sequence
  Synthetic oligonucleotide
ggctacccacacgatctgcaccgcaccaaaacttc

SEQ ID NO: 28873 - DNA, 35 bp, Artificial Sequence
  Synthetic oligonucleotide
aaattcacatcgccccgaccgttccagccttttag

SEQ ID NO: 28874 - DNA, 35 bp, Artificial Sequence
  Synthetic oligonucleotide
gaagtgagtgggggaaattaaggaccaaaatgggg

SEQ ID NO: 28875 - DNA, 35 bp, Artificial Sequence
  Synthetic oligonucleotide
tcgcaccacttcattatgtatcatctcgttttcat

SEQ ID NO: 28876 - DNA, 35 bp, Artificial Sequence
  Synthetic oligonucleotide
acctgcccatgctgcacttttcacagttatctatt

SEQ ID NO: 28877 - DNA, 35 bp, Artificial Sequence
  Synthetic oligonucleotide
acccggtggaggtggattaaaaaaagtaaatggtt

SEQ ID NO: 28878 - DNA, 36 bp, Artificial Sequence
  Synthetic oligonucleotide
atgccccatgccgccttcctatgatcgttacagcaa

SEQ ID NO: 28879 - DNA, 36 bp, Artificial Sequence
  Synthetic oligonucleotide
gccacctcccgattcgcccgttacttcctgaggcaa

SEQ ID NO: 28880 - DNA, 36 bp, Artificial Sequence
  Synthetic oligonucleotide
gtcgcgttgacctcctttttgggcccgttccttcca

SEQ ID NO: 28881 - DNA, 36 bp, Artificial Sequence
  Synthetic oligonucleotide
gagtccctgtaggtggctttctgtgcctcgccctca

SEQ ID NO: 28882 - DNA, 37 bp, Artificial Sequence
  Synthetic oligonucleotide
gcccgaccatctataacccgcatgagccacatgacga

SEQ ID NO: 28883 - DNA, 38 bp, Artificial Sequence
  Synthetic oligonucleotide
tcagccaccattgctttatctttatgggtcaatcctga

SEQ ID NO: 28884 - DNA, 38 bp, Artificial Sequence
  Synthetic oligonucleotide
gtcatcagtcgcactcgggctcacgttactctctctga

SEQ ID NO: 28885 - DNA, 38 bp, Artificial Sequence
  Synthetic oligonucleotide
tcataagcaggggaaagcattaaggggaacggaggtga

SEQ ID NO: 28886 - DNA, 38 bp, Artificial Sequence
  Synthetic oligonucleotide
taggcggacagggggacgtaggtggacgggcggggtga

SEQ ID NO: 28887 - DNA, 34 bp, Artificial Sequence
  Synthetic oligonucleotide
tcatccatcggaggcaataccccgccaatacgta

SEQ ID NO: 28888 - DNA, 36 bp, Artificial Sequence
  Synthetic oligonucleotide
tccacacgcctgggatcaacactctcacgccaatta

SEQ ID NO: 28889 - DNA, 36 bp, Artificial Sequence
  Synthetic oligonucleotide
tgactacctccgcggttgtacccgaccccgacctta

SEQ ID NO: 28890 - DNA, 35 bp, Artificial Sequence
  Synthetic oligonucleotide
gtatcgcaatacttacagtcgcttctagctccccc

SEQ ID NO: 28891 - DNA, 35 bp, Artificial Sequence
  Synthetic oligonucleotide
gctgtgctgtgctgtcactacttatatactcccgc

SEQ ID NO: 28892 - DNA, 35 bp, Artificial Sequence
  Synthetic oligonucleotide
atcgcacgtatcccttcccaacagcccattacctg

SEQ ID NO: 28893 - DNA, 35 bp, Artificial Sequence
  Synthetic oligonucleotide
ttctgaccgtccaacaacccccttcatcgcgttct

SEQ ID NO: 28894 - DNA, 35 bp, Artificial Sequence
  Synthetic oligonucleotide
atgcactgctttggttctccgccaggcccttcgtt

SEQ ID NO: 28895 - DNA, 36 bp, Artificial Sequence
  Synthetic oligonucleotide
acacggaggcccacttggctattttttcttccggaa

SEQ ID NO: 28896 - DNA, 35 bp, Artificial Sequence
  Synthetic oligonucleotide
accgcccttatgcttcgtagacccgcactatccga

SEQ ID NO: 28897 - DNA, 37 bp, Artificial Sequence
  Synthetic oligonucleotide
caggggtggtgggcaataggtttaggagtgtggggga

SEQ ID NO: 28898 - DNA, 37 bp, Artificial Sequence
  Synthetic oligonucleotide
tgcctcccctgcaccgttccccccgtcataatgctga

SEQ ID NO: 28899 - DNA, 36 bp, Artificial Sequence
  Synthetic oligonucleotide
gtgagccctggacgcccctcttgcagatgactggta

SEQ ID NO: 28900 - DNA, 35 bp, Artificial Sequence
  Synthetic oligonucleotide
atccaccacagtaggctctgacatccgatcgggcc

SEQ ID NO: 28901 - DNA, 35 bp, Artificial Sequence
  Synthetic oligonucleotide
tctcctccctgatacttcccttgccaccctcgtgg

SEQ ID NO: 28902 - DNA, 35 bp, Artificial Sequence
  Synthetic oligonucleotide
tgcattgcgcacaccctgcctgaaaatgattacat

SEQ ID NO: 28903 - DNA, 35 bp, Artificial Sequence
  Synthetic oligonucleotide
ggattggtgggtggtgaatgctgggtttagtgcat

SEQ ID NO: 28904 - DNA, 35 bp, Artificial Sequence
  Synthetic oligonucleotide
aacggcccgtcgactgccccataatcgacgtggct

SEQ ID NO: 28905 - DNA, 35 bp, Artificial Sequence
  Synthetic oligonucleotide
tcacctctgcaataggcctctttacacttgtttgt

SEQ ID NO: 28906 - DNA, 35 bp, Artificial Sequence
  Synthetic oligonucleotide
gatcctagcccctaccttattaataagtgtccatt

SEQ ID NO: 28907 - DNA, 35 bp, Artificial Sequence
  Synthetic oligonucleotide
gatgcgaccgggtacgtctatggcctcttgatttt

SEQ ID NO: 28908 - DNA, 36 bp, Artificial Sequence
  Synthetic oligonucleotide
gacactgaattgtcgtccgctccagtactccaccca

SEQ ID NO: 28909 - DNA, 36 bp, Artificial Sequence
  Synthetic oligonucleotide
gtctacatccattgctttccctgtcttgttttctca

SEQ ID NO: 28910 - DNA, 36 bp, Artificial Sequence
  Synthetic oligonucleotide
tccccccccacgtaatcctgttgagctcccttgtca

SEQ ID NO: 28911 - DNA, 36 bp, Artificial Sequence
  Synthetic oligonucleotide
tcgtacccacctcgtacaaaagtgtactcttcttca

SEQ ID NO: 28912 - DNA, 37 bp, Artificial Sequence
  Synthetic oligonucleotide
tagacggagggggagcgggtgggtaaggaggggaaga

SEQ ID NO: 28913 - DNA, 36 bp, Artificial Sequence
  Synthetic oligonucleotide
tagccctacatcctgcaacgattgaccaatcataga

SEQ ID NO: 28914 - DNA, 37 bp, Artificial Sequence
  Synthetic oligonucleotide
gtgctcgcaccatacttccctctgcgatcgtccccga

SEQ ID NO: 28915 - DNA, 35 bp, Artificial Sequence
  Synthetic oligonucleotide
tcagcccaacgtggcacgtctgtcatcttccccga

SEQ ID NO: 28916 - DNA, 38 bp, Artificial Sequence
  Synthetic oligonucleotide
actttgcgccatatgtcctccccaacgccacaccatga

SEQ ID NO: 28917 - DNA, 37 bp, Artificial Sequence
  Synthetic oligonucleotide
tcagggaccatctgccggcatcagggtccgaccatga

SEQ ID NO: 28918 - DNA, 38 bp, Artificial Sequence
  Synthetic oligonucleotide
tgtgcccctacaacctctactgggttcctcccagctga

SEQ ID NO: 28919 - DNA, 38 bp, Artificial Sequence
  Synthetic oligonucleotide
ttagagggccgtccaccgctgtttctcgtgcccattga

SEQ ID NO: 28920 - DNA, 36 bp, Artificial Sequence
  Synthetic oligonucleotide
tcagtctgcccaaacttgctctactgccaatattga

SEQ ID NO: 28921 - DNA, 38 bp, Artificial Sequence
  Synthetic oligonucleotide
gttgtcaccgttaattactgccttctctacaccgttga

SEQ ID NO: 28922 - DNA, 38 bp, Artificial Sequence
  Synthetic oligonucleotide
gacagaaaggggggggccgggagaatggaaacgtttga

SEQ ID NO: 28923 - DNA, 35 bp, Artificial Sequence
  Synthetic oligonucleotide
ataccccccgcatcactgggtttttattttcacta

SEQ ID NO: 28924 - DNA, 36 bp, Artificial Sequence
  Synthetic oligonucleotide
tagaccgtgcgtctgtccctttatcatggtttcgta

SEQ ID NO: 28925 - DNA, 34 bp, Artificial Sequence
  Synthetic oligonucleotide
acagatgtcaacccgcttccgttccgtgtgcaac

SEQ ID NO: 28926 - DNA, 35 bp, Artificial Sequence
  Synthetic oligonucleotide
tcagcctgtatcgctctttcgccgcactattggac

SEQ ID NO: 28927 - DNA, 35 bp, Artificial Sequence
  Synthetic oligonucleotide
tagctccccacacccggtgaacggcacaggcgccc

SEQ ID NO: 28928 - DNA, 35 bp, Artificial Sequence
  Synthetic oligonucleotide
ggaccacctgccactgtcttccatgctctacattc

SEQ ID NO: 28929 - DNA, 35 bp, Artificial Sequence
  Synthetic oligonucleotide
ttctgtccctcgcccgcatctttaacatcactccg

SEQ ID NO: 28930 - DNA, 35 bp, Artificial Sequence
  Synthetic oligonucleotide
actagcacggtctcgtccatttactatctgccctg

SEQ ID NO: 28931 - DNA, 35 bp, Artificial Sequence
  Synthetic oligonucleotide
gtgcctacacttgtgcctttttttcttacgcccct

SEQ ID NO: 28932 - DNA, 35 bp, Artificial Sequence
  Synthetic oligonucleotide
tcacgtgctcgttaggtcgccgatccactcataaa

SEQ ID NO: 28933 - DNA, 36 bp, Artificial Sequence
  Synthetic oligonucleotide
atgtgccaactgtggtctctaccgattcatacctca

SEQ ID NO: 28934 - DNA, 37 bp, Artificial Sequence
  Synthetic oligonucleotide
ggtcaggaaggggagggttaggtctgcaaggaggcga

SEQ ID NO: 28935 - DNA, 36 bp, Artificial Sequence
  Synthetic oligonucleotide
tggggcatctcccaccccctccgtccagtcgatcga

SEQ ID NO: 28936 - DNA, 37 bp, Artificial Sequence
  Synthetic oligonucleotide
ttgccctgaagccctaccgtttacctgccgtcttcga

SEQ ID NO: 28937 - DNA, 38 bp, Artificial Sequence
  Synthetic oligonucleotide
tgtgtccgttcctgccgttttcatccattctcctctga

SEQ ID NO: 28938 - DNA, 37 bp, Artificial Sequence
  Synthetic oligonucleotide
acgacactactcagtcccttacccactcgcatcttga

SEQ ID NO: 28939 - DNA, 37 bp, Artificial Sequence
  Synthetic oligonucleotide
tgctctcactccaatgccggttctcaatgccacgcta

SEQ ID NO: 28940 - DNA, 35 bp, Artificial Sequence
  Synthetic oligonucleotide
tcacactagttgcccgcctttggcctgcctccaac

SEQ ID NO: 28941 - DNA, 35 bp, Artificial Sequence
  Synthetic oligonucleotide
tcagaacacccagacgttcatataccaccttaatg

SEQ ID NO: 28942 - DNA, 35 bp, Artificial Sequence
  Synthetic oligonucleotide
tatgcaacacatagtctcctcctccgccgaacgtg

SEQ ID NO: 28943 - DNA, 35 bp, Artificial Sequence
  Synthetic oligonucleotide
tctgtgcgctagactctcttatccccctgctagat

SEQ ID NO: 28944 - DNA, 36 bp, Artificial Sequence
  Synthetic oligonucleotide
ggaccaccccgtctcctctacgtcactgcacgccaa

SEQ ID NO: 28945 - DNA, 36 bp, Artificial Sequence
  Synthetic oligonucleotide
gggggaatggggtagccgggtagggcgggcaaagaa

SEQ ID NO: 28946 - DNA, 36 bp, Artificial Sequence
  Synthetic oligonucleotide
gttgaaccccttcccgcatatatgctaccgtgaaca

SEQ ID NO: 28947 - DNA, 35 bp, Artificial Sequence
  Synthetic oligonucleotide
gcgaggagcaggagggagctaacaggccgaaacca

SEQ ID NO: 28948 - DNA, 35 bp, Artificial Sequence
  Synthetic oligonucleotide
gaccacttgccaccagtttagccccaatgttgtca

SEQ ID NO: 28949 - DNA, 37 bp, Artificial Sequence
  Synthetic oligonucleotide
gttaccatctgggccacccacagtcgtctgcacacga

SEQ ID NO: 28950 - DNA, 37 bp, Artificial Sequence
  Synthetic oligonucleotide
ttcgagcagttagttagggaggagggaagggcaggga

SEQ ID NO: 28951 - DNA, 36 bp, Artificial Sequence
  Synthetic oligonucleotide
actcccagctcaaccatcccgccactactattagta

SEQ ID NO: 28952 - DNA, 35 bp, Artificial Sequence
  Synthetic oligonucleotide
gagtctgctctcatcatccccgtcgccctctggcc

SEQ ID NO: 28953 - DNA, 35 bp, Artificial Sequence
  Synthetic oligonucleotide
ttgtggcccagcgatcaaccatttacattttcctg

SEQ ID NO: 28954 - DNA, 35 bp, Artificial Sequence
  Synthetic oligonucleotide
gccacatacacccgattgggtctcgccttcaacct

SEQ ID NO: 28955 - DNA, 38 bp, Artificial Sequence
  Synthetic oligonucleotide
gcaccgcacccgcatttctactgatacgtcgtccactt

SEQ ID NO: 28956 - DNA, 35 bp, Artificial Sequence
  Synthetic oligonucleotide
tcagcattgtcttggtccgccttttcttttacctt

SEQ ID NO: 28957 - DNA, 36 bp, Artificial Sequence
  Synthetic oligonucleotide
tagccagccatacccctctgttatatcaacctgcaa

SEQ ID NO: 28958 - DNA, 36 bp, Artificial Sequence
  Synthetic oligonucleotide
tactccttccagacgctcatgcgcatccatgtacca

SEQ ID NO: 28959 - DNA, 37 bp, Artificial Sequence
  Synthetic oligonucleotide
gctgcatgagggatcggaaacggggggaacgcgagga

SEQ ID NO: 28960 - DNA, 38 bp, Artificial Sequence
  Synthetic oligonucleotide
ttccacacacacacatggtttgcgaccgcacaatatga

SEQ ID NO: 28961 - DNA, 38 bp, Artificial Sequence
  Synthetic oligonucleotide
cctgccagtcccctggcctaccccagtcacaaatctga

SEQ ID NO: 28962 - DNA, 35 bp, Artificial Sequence
  Synthetic oligonucleotide
acacacgcggtcatacgaattcacgcgggttgtta

SEQ ID NO: 28963 - DNA, 35 bp, Artificial Sequence
  Synthetic oligonucleotide
tgcacgccgccctggacttgcgctgtccgcccacc

SEQ ID NO: 28964 - DNA, 35 bp, Artificial Sequence
  Synthetic oligonucleotide
tcaaaccggctcactcaaggaacgatccgccttcc

SEQ ID NO: 28965 - DNA, 35 bp, Artificial Sequence
  Synthetic oligonucleotide
tgtgctggggatgtgtcggccctgctttatctctc

SEQ ID NO: 28966 - DNA, 35 bp, Artificial Sequence
  Synthetic oligonucleotide
actcgacctcgtcacaccttattgggttctacttc

SEQ ID NO: 28967 - DNA, 35 bp, Artificial Sequence
  Synthetic oligonucleotide
gccatccgcctgtcgcattgtacatacccgaatcg

SEQ ID NO: 28968 - DNA, 35 bp, Artificial Sequence
  Synthetic oligonucleotide
tgatcacaagcactcttacgacacacatgttcatg

SEQ ID NO: 28969 - DNA, 35 bp, Artificial Sequence
  Synthetic oligonucleotide
acctcacgtgtaggtcttctttatcgtatttagtg

SEQ ID NO: 28970 - DNA, 35 bp, Artificial Sequence
  Synthetic oligonucleotide
tttcgccaccgtatcacaactcaccccgacaattg

SEQ ID NO: 28971 - DNA, 35 bp, Artificial Sequence
  Synthetic oligonucleotide
acagctgcccacatccgtccgagtctcccgttcat

SEQ ID NO: 28972 - DNA, 35 bp, Artificial Sequence
  Synthetic oligonucleotide
agttgaacgccgaactctatctttgcccgtttcct

SEQ ID NO: 28973 - DNA, 35 bp, Artificial Sequence
  Synthetic oligonucleotide
gtccagtcacgctcgctacttcctgctagttttct

SEQ ID NO: 28974 - DNA, 36 bp, Artificial Sequence
  Synthetic oligonucleotide
acccccagcacagcgtgaagctgaatcgcgctctaa

SEQ ID NO: 28975 - DNA, 36 bp, Artificial Sequence
  Synthetic oligonucleotide
tttagccactgttcctgttccattatcttccgttaa

SEQ ID NO: 28976 - DNA, 36 bp, Artificial Sequence
  Synthetic oligonucleotide
tccatgcatccagccgcaatatagccaaatggtaca

SEQ ID NO: 28977 - DNA, 36 bp, Artificial Sequence
  Synthetic oligonucleotide
ttcgctgtctcttcattgaaaggccctgtcctccca

SEQ ID NO: 28978 - DNA, 35 bp, Artificial Sequence
  Synthetic oligonucleotide
gtttgtagcaccgcaccgcccccccgtaacagcca

SEQ ID NO: 28979 - DNA, 36 bp, Artificial Sequence
  Synthetic oligonucleotide
gaccatccacccgtctaccgcaacacccccgagcca

SEQ ID NO: 28980 - DNA, 36 bp, Artificial Sequence
  Synthetic oligonucleotide
gatctcgatcctgacgtgctcacctatcccgcttca

SEQ ID NO: 28981 - DNA, 35 bp, Artificial Sequence
  Synthetic oligonucleotide
gtgcctgacacacaacataacgccatccaggtaga

SEQ ID NO: 28982 - DNA, 37 bp, Artificial Sequence
  Synthetic oligonucleotide
tccgcccacttaatgatctttaaacgtcccctttcga

SEQ ID NO: 28983 - DNA, 37 bp, Artificial Sequence
  Synthetic oligonucleotide
gcatcaggagcggggagggggcgcgctaggcggagga

SEQ ID NO: 28984 - DNA, 36 bp, Artificial Sequence
  Synthetic oligonucleotide
gcttgccggagcctcgcattctagccgtttacctga

SEQ ID NO: 28985 - DNA, 38 bp, Artificial Sequence
  Synthetic oligonucleotide
aacaactcccccgccactgccgtctctcaacctagtga

SEQ ID NO: 28986 - DNA, 37 bp, Artificial Sequence
  Synthetic oligonucleotide
tccgaactgcgcacaccccactgccggacttatgtga

SEQ ID NO: 28987 - DNA, 35 bp, Artificial Sequence
  Synthetic oligonucleotide
gacccgctcgcactaacccacagcaccttcggcta

SEQ ID NO: 28988 - DNA, 35 bp, Artificial Sequence
  Synthetic oligonucleotide
accttcacttgggaattccagcctggcccgccccc

SEQ ID NO: 28989 - DNA, 35 bp, Artificial Sequence
  Synthetic oligonucleotide
gctccgcacgttacggttttctccctcgtgtcccc

SEQ ID NO: 28990 - DNA, 35 bp, Artificial Sequence
  Synthetic oligonucleotide
ttggtaacccaccccaggggcccacgccttttccc

SEQ ID NO: 28991 - DNA, 35 bp, Artificial Sequence
  Synthetic oligonucleotide
gccgacggttaacgaccccatccaccatgtatccg

SEQ ID NO: 28992 - DNA, 35 bp, Artificial Sequence
  Synthetic oligonucleotide
tgaggcttaccaccccacggtcccatcttcattgg

SEQ ID NO: 28993 - DNA, 35 bp, Artificial Sequence
  Synthetic oligonucleotide
gcgccgaatcgttcacaccagtccaccagcctact

SEQ ID NO: 28994 - DNA, 35 bp, Artificial Sequence
  Synthetic oligonucleotide
aatcaccgacgggcctcttcttcaaacattattct

SEQ ID NO: 28995 - DNA, 36 bp, Artificial Sequence
  Synthetic oligonucleotide
ttcattacccgatcgcgtgttcctcaggcattacca

SEQ ID NO: 28996 - DNA, 36 bp, Artificial Sequence
  Synthetic oligonucleotide
taccggatccgcctatcgtttgacatccatttgcca

SEQ ID NO: 28997 - DNA, 37 bp, Artificial Sequence
  Synthetic oligonucleotide
gcatggaggaatcagaggagaaaggtgaaggagcaga

SEQ ID NO: 28998 - DNA, 37 bp, Artificial Sequence
  Synthetic oligonucleotide
aactaccgttcacaacacagcctgccgccccgcgaga

SEQ ID NO: 28999 - DNA, 37 bp, Artificial Sequence
  Synthetic oligonucleotide
ttgtcaccgcccacaccctatcgttcgattaccacga

SEQ ID NO: 29000 - DNA, 37 bp, Artificial Sequence
  Synthetic oligonucleotide
taagcacaccgcacaaattatggctatcacttcacga

SEQ ID NO: 29001 - DNA, 37 bp, Artificial Sequence
  Synthetic oligonucleotide
gacacatccccatgattctttgcctaaccggatacga

SEQ ID NO: 29002 - DNA, 36 bp, Artificial Sequence
  Synthetic oligonucleotide
atgacgcatcgcccgtttttacctaactctggccga

SEQ ID NO: 29003 - DNA, 36 bp, Artificial Sequence
  Synthetic oligonucleotide
atttctaccccacgcccgaatgacagacagctccga

SEQ ID NO: 29004 - DNA, 37 bp, Artificial Sequence
  Synthetic oligonucleotide
taccacgcgcactttcttttcttcaaggacagagcga

SEQ ID NO: 29005 - DNA, 37 bp, Artificial Sequence
  Synthetic oligonucleotide
gatctaatccggccattcatccccacacgcatgtgga

SEQ ID NO: 29006 - DNA, 38 bp, Artificial Sequence
  Synthetic oligonucleotide
gggacacgtagctactttcccgcccccaccgtaactga

SEQ ID NO: 29007 - DNA, 37 bp, Artificial Sequence
  Synthetic oligonucleotide
actccgcacttgcctccttttcgtatgtatccgttga

SEQ ID NO: 29008 - DNA, 36 bp, Artificial Sequence
  Synthetic oligonucleotide
tcacgagccaccgtactgggcccatctgattcccta

SEQ ID NO: 29009 - DNA, 35 bp, Artificial Sequence
  Synthetic oligonucleotide
tgctgacgcatgtcttgcgctctcctgtccccaac

SEQ ID NO: 29010 - DNA, 35 bp, Artificial Sequence
  Synthetic oligonucleotide
acctaccgcagcttatctggggtctttgttccaac

SEQ ID NO: 29011 - DNA, 35 bp, Artificial Sequence
  Synthetic oligonucleotide
tcttgccggggtcgtcatttaaccgcgtgcaccac

SEQ ID NO: 29012 - DNA, 35 bp, Artificial Sequence
  Synthetic oligonucleotide
atcattcctcgcgccaaaaggccgaactgccctac

SEQ ID NO: 29013 - DNA, 35 bp, Artificial Sequence
  Synthetic oligonucleotide
tccctgacctttgttacttatcactcggggggacc

SEQ ID NO: 29014 - DNA, 35 bp, Artificial Sequence
  Synthetic oligonucleotide
tgcaaccacctggaaatgatcccatgaatctgtcc

SEQ ID NO: 29015 - DNA, 35 bp, Artificial Sequence
  Synthetic oligonucleotide
agtgcccgtctcaatcccccctctaccccacttgc

SEQ ID NO: 29016 - DNA, 35 bp, Artificial Sequence
  Synthetic oligonucleotide
gaatcatcccgccaggtcctggagctcggaccatc

SEQ ID NO: 29017 - DNA, 35 bp, Artificial Sequence
  Synthetic oligonucleotide
gatcctcccagcatactacgtcctcatgtacactc

SEQ ID NO: 29018 - DNA, 35 bp, Artificial Sequence
  Synthetic oligonucleotide
ataccgaccggtgatatctcttctgcccttacgtc

SEQ ID NO: 29019 - DNA, 35 bp, Artificial Sequence
  Synthetic oligonucleotide
gtcgcccctcgcagcgctttcaaagcaactctttc

SEQ ID NO: 29020 - DNA, 35 bp, Artificial Sequence
  Synthetic oligonucleotide
tcatggcccccccctccgagcctcccatagcagcg

SEQ ID NO: 29021 - DNA, 35 bp, Artificial Sequence
  Synthetic oligonucleotide
gaggggggagaggggatagtcggggttcagaggcg

SEQ ID NO: 29022 - DNA, 35 bp, Artificial Sequence
  Synthetic oligonucleotide
actcattgcatctctgaaccgcccaattgtctctg

SEQ ID NO: 29023 - DNA, 35 bp, Artificial Sequence
  Synthetic oligonucleotide
attgcgacacaactgattcgatcaacgtcaccact

SEQ ID NO: 29024 - DNA, 35 bp, Artificial Sequence
  Synthetic oligonucleotide
tacgaagtgctttccgcccgtactaccgcgcccct

SEQ ID NO: 29025 - DNA, 35 bp, Artificial Sequence
  Synthetic oligonucleotide
tcttccaacccactacttgactgcagaggttttct

SEQ ID NO: 29026 - DNA, 35 bp, Artificial Sequence
  Synthetic oligonucleotide
ttagctcgtccatccatctgcctatctagttactt

SEQ ID NO: 29027 - DNA, 35 bp, Artificial Sequence
  Synthetic oligonucleotide
gaagtagctcaccaagctgatcagccctactccaa

SEQ ID NO: 29028 - DNA, 36 bp, Artificial Sequence
  Synthetic oligonucleotide
gcgctctgtccgcttagtttgccccctatgctctca

SEQ ID NO: 29029 - DNA, 37 bp, Artificial Sequence
  Synthetic oligonucleotide
gagtttacaccgaccactgcttttgccctgtttacga

SEQ ID NO: 29030 - DNA, 35 bp, Artificial Sequence
  Synthetic oligonucleotide
tagtaccgcagccgtatttagcattactttctcga

SEQ ID NO: 29031 - DNA, 37 bp, Artificial Sequence
  Synthetic oligonucleotide
taccaccccgcttactggcctgctttgacggtttcga

SEQ ID NO: 29032 - DNA, 37 bp, Artificial Sequence
  Synthetic oligonucleotide
gtcgaccagcacgtactgcgttggcctcttcaccgga

SEQ ID NO: 29033 - DNA, 37 bp, Artificial Sequence
  Synthetic oligonucleotide
gccgaagggcacagacctgacttatcgttccaactga

SEQ ID NO: 29034 - DNA, 37 bp, Artificial Sequence
  Synthetic oligonucleotide
atgccgaggtccagatcggccacttttacccccctga

SEQ ID NO: 29035 - DNA, 36 bp, Artificial Sequence
  Synthetic oligonucleotide
gggggtgggcgagtggtggaaatgggtgggcgctga

SEQ ID NO: 29036 - DNA, 38 bp, Artificial Sequence
  Synthetic oligonucleotide
aacagagcgtggccggttaaggggggatggaagggtga

SEQ ID NO: 29037 - DNA, 38 bp, Artificial Sequence
  Synthetic oligonucleotide
gcgagggggtaaaagagggcttaggggtgggagggtga

SEQ ID NO: 29038 - DNA, 38 bp, Artificial Sequence
  Synthetic oligonucleotide
gacacaaggactgcaggggggatcggacagatcattga

SEQ ID NO: 29039 - DNA, 38 bp, Artificial Sequence
  Synthetic oligonucleotide
accactcacgtcctctttgattcgtcaggccatgttga

SEQ ID NO: 29040 - DNA, 38 bp, Artificial Sequence
  Synthetic oligonucleotide
tgcacctacctaggctgtctcctgaaccatgtctttga

SEQ ID NO: 29041 - DNA, 38 bp, Artificial Sequence
  Synthetic oligonucleotide
gtcaggatacgggtggagagggggatcagggggtttga

SEQ ID NO: 29042 - DNA, 36 bp, Artificial Sequence
  Synthetic oligonucleotide
tgcccatgccggtcgctcgagcccaccttctccgta

SEQ ID NO: 29043 - DNA, 35 bp, Artificial Sequence
  Synthetic oligonucleotide
atcccgacgttgggtcgtcacgttatactatcctc

SEQ ID NO: 29044 - DNA, 35 bp, Artificial Sequence
  Synthetic oligonucleotide
tgcaccgactccaccttgacctttgaacatctagg

SEQ ID NO: 29045 - DNA, 35 bp, Artificial Sequence
  Synthetic oligonucleotide
accgcaagaacctggcgattcccctttcttccctg

SEQ ID NO: 29046 - DNA, 35 bp, Artificial Sequence
  Synthetic oligonucleotide
tcaacagttcggcccccatccccctccctgttgtg

SEQ ID NO: 29047 - DNA, 35 bp, Artificial Sequence
  Synthetic oligonucleotide
gctctagctcagtggttccgcacctcgtcatcact

SEQ ID NO: 29048 - DNA, 35 bp, Artificial Sequence
  Synthetic oligonucleotide
gcaccggacagacgattacccctgctttagtcctt

SEQ ID NO: 29049 - DNA, 36 bp, Artificial Sequence
  Synthetic oligonucleotide
acgccaaaccccaatgccgtgatggcgccctgtaaa

SEQ ID NO: 29050 - DNA, 37 bp, Artificial Sequence
  Synthetic oligonucleotide
tcactaccgttctctagcaccccgccggtcctttaga

SEQ ID NO: 29051 - DNA, 38 bp, Artificial Sequence
  Synthetic oligonucleotide
tacctccgaccacactgatactatacgccatttcttga

SEQ ID NO: 29052 - DNA, 36 bp, Artificial Sequence
  Synthetic oligonucleotide
atgggagggggagggtgtcaggggtacccaactata

SEQ ID NO: 29053 - DNA, 35 bp, Artificial Sequence
  Synthetic oligonucleotide
tcatgacccctacgttcaatctgctactatctaac

SEQ ID NO: 29054 - DNA, 35 bp, Artificial Sequence
  Synthetic oligonucleotide
tgtcggtgccccgcgtgcgaacctgcccaactgac

SEQ ID NO: 29055 - DNA, 35 bp, Artificial Sequence
  Synthetic oligonucleotide
tcgcgcttgcactgcctcatccccgtttctctacc

SEQ ID NO: 29056 - DNA, 35 bp, Artificial Sequence
  Synthetic oligonucleotide
gcacacctccccaccaatatcgccaggagactaag

SEQ ID NO: 29057 - DNA, 35 bp, Artificial Sequence
  Synthetic oligonucleotide
tcacgtatccggaggcctcacagtgttaccccctg

SEQ ID NO: 29058 - DNA, 35 bp, Artificial Sequence
  Synthetic oligonucleotide
ggatgccaccgcctgaaaatacgtgatacatcgat

SEQ ID NO: 29059 - DNA, 35 bp, Artificial Sequence
  Synthetic oligonucleotide
atgttcacagcgttctacttggttctcattgcgct

SEQ ID NO: 29060 - DNA, 36 bp, Artificial Sequence
  Synthetic oligonucleotide
cccacgtcgaacatgacgtcccctatctgccaccaa

SEQ ID NO: 29061 - DNA, 36 bp, Artificial Sequence
  Synthetic oligonucleotide
ttccacctgcctcttcagcaccaagagtccattaca

SEQ ID NO: 29062 - DNA, 36 bp, Artificial Sequence
  Synthetic oligonucleotide
agccacggtcctcacccgtttgccaatttagcacca

SEQ ID NO: 29063 - DNA, 36 bp, Artificial Sequence
  Synthetic oligonucleotide
ttgatgcagcatctggccgcttccctcgttcaccca

SEQ ID NO: 29064 - DNA, 35 bp, Artificial Sequence
  Synthetic oligonucleotide
gccacactatggtcctggatatttgcctccacgca

SEQ ID NO: 29065 - DNA, 36 bp, Artificial Sequence
  Synthetic oligonucleotide
gacctccgtcgacactcgcgctgtgttctcgcctca

SEQ ID NO: 29066 - DNA, 35 bp, Artificial Sequence
  Synthetic oligonucleotide
gaggaccctcaagcacttccaacccacccttgtca

SEQ ID NO: 29067 - DNA, 37 bp, Artificial Sequence
  Synthetic oligonucleotide
gacgatgtttggcgggtggatggaggggatggcacga

SEQ ID NO: 29068 - DNA, 36 bp, Artificial Sequence
  Synthetic oligonucleotide
tacaccacaaacgtctccgatcctgtagatagccga

SEQ ID NO: 29069 - DNA, 37 bp, Artificial Sequence
  Synthetic oligonucleotide
accaccgcatttacctcacacgccgagtcactaatga

SEQ ID NO: 29070 - DNA, 37 bp, Artificial Sequence
  Synthetic oligonucleotide
agatagggggagggcagaagggagaagcggtgagtga

SEQ ID NO: 29071 - DNA, 36 bp, Artificial Sequence
  Synthetic oligonucleotide
atctgccacacccatcgctttggttaatgaccgtga

SEQ ID NO: 29072 - DNA, 37 bp, Artificial Sequence
  Synthetic oligonucleotide
gaaatgtgctgttggctggggaggaatggaggggtga

SEQ ID NO: 29073 - DNA, 36 bp, Artificial Sequence
  Synthetic oligonucleotide
tacgccaccacaatctatagcactaataacgaatta

SEQ ID NO: 29074 - DNA, 35 bp, Artificial Sequence
  Synthetic oligonucleotide
gcaagctcgccctctcatcaacaaccacggtttac

SEQ ID NO: 29075 - DNA, 35 bp, Artificial Sequence
  Synthetic oligonucleotide
acctccaccggcgcgcttataatataaccctgccc

SEQ ID NO: 29076 - DNA, 35 bp, Artificial Sequence
  Synthetic oligonucleotide
actccctggtgcctcttttagtaagccagttctcc

SEQ ID NO: 29077 - DNA, 35 bp, Artificial Sequence
  Synthetic oligonucleotide
gacaaggtgagaagcacgatagaggattcgaagtg

SEQ ID NO: 29078 - DNA, 36 bp, Artificial Sequence
  Synthetic oligonucleotide
gaggccatcacatgacgattccgaactcctgctcct

SEQ ID NO: 29079 - DNA, 35 bp, Artificial Sequence
  Synthetic oligonucleotide
tgagcgcactacgagttcttgtcaacggtctctct

SEQ ID NO: 29080 - DNA, 36 bp, Artificial Sequence
  Synthetic oligonucleotide
atgactccgccaagcacaaacgtttgtcccttcgtt

SEQ ID NO: 29081 - DNA, 36 bp, Artificial Sequence
  Synthetic oligonucleotide
gttgcctacaagttattcgacctctgtcctgctcaa

SEQ ID NO: 29082 - DNA, 36 bp, Artificial Sequence
  Synthetic oligonucleotide
atccgatccgtggtgcacggccatccctcgttgtaa

SEQ ID NO: 29083 - DNA, 36 bp, Artificial Sequence
  Synthetic oligonucleotide
tggttccttcctgtgctcgtacctttgctgatccca

SEQ ID NO: 29084 - DNA, 36 bp, Artificial Sequence
  Synthetic oligonucleotide
ttccacccgcccggtctagcctcacttcggactaga

SEQ ID NO: 29085 - DNA, 36 bp, Artificial Sequence
  Synthetic oligonucleotide
gagtaggggttggagatgcgggtgggtgaagttcga

SEQ ID NO: 29086 - DNA, 36 bp, Artificial Sequence
  Synthetic oligonucleotide
gacagggtgaaaggggttcatgaaagtgaaggcgga

SEQ ID NO: 29087 - DNA, 36 bp, Artificial Sequence
  Synthetic oligonucleotide
atctcccacggagatagcctccattctttacctgga

SEQ ID NO: 29088 - DNA, 35 bp, Artificial Sequence
  Synthetic oligonucleotide
taggagggtgacccatgcccatgctgacttgttga

SEQ ID NO: 29089 - DNA, 36 bp, Artificial Sequence
  Synthetic oligonucleotide
gtgcagtgcccctgctcactattggaacttttgcta

SEQ ID NO: 29090 - DNA, 35 bp, Artificial Sequence
  Synthetic oligonucleotide
ttccaccccgccatcgtagcctattgtagtggtta

SEQ ID NO: 29091 - DNA, 35 bp, Artificial Sequence
  Synthetic oligonucleotide
gctatggccggcatccacattagcatcgcctcctc

SEQ ID NO: 29092 - DNA, 35 bp, Artificial Sequence
  Synthetic oligonucleotide
ggtggcccctgtactgtacactcgtctaccgcccg

SEQ ID NO: 29093 - DNA, 35 bp, Artificial Sequence
  Synthetic oligonucleotide
gtcactcagtcagtaatctatcctacttgtctctg

SEQ ID NO: 29094 - DNA, 35 bp, Artificial Sequence
  Synthetic oligonucleotide
gaagcagggaatacatggaatctggcaggggattg

SEQ ID NO: 29095 - DNA, 35 bp, Artificial Sequence
  Synthetic oligonucleotide
gtacccctgccttctacctgacttcacagttgaat

SEQ ID NO: 29096 - DNA, 36 bp, Artificial Sequence
  Synthetic oligonucleotide
ggtgtcggacaatctgcctacatgtaacatctacct

SEQ ID NO: 29097 - DNA, 35 bp, Artificial Sequence
  Synthetic oligonucleotide
tgccggagactcgatgcctcatgcacatccctcct

SEQ ID NO: 29098 - DNA, 35 bp, Artificial Sequence
  Synthetic oligonucleotide
ggaacaagggagggatgaaggcatggagggcaagt

SEQ ID NO: 29099 - DNA, 36 bp, Artificial Sequence
  Synthetic oligonucleotide
gtcccgccagccccacctacgccaaaagtgctgcaa

SEQ ID NO: 29100 - DNA, 36 bp, Artificial Sequence
  Synthetic oligonucleotide
tacgccccatcgagaaaacacaggtgcctcattgca

SEQ ID NO: 29101 - DNA, 36 bp, Artificial Sequence
  Synthetic oligonucleotide
tgagctccacagcttacctagccatcacgtacctca

SEQ ID NO: 29102 - DNA, 36 bp, Artificial Sequence
  Synthetic oligonucleotide
ggtaggagcagggaagccgaggcggaagaaagagga

SEQ ID NO: 29103 - DNA, 38 bp, Artificial Sequence
  Synthetic oligonucleotide
gaccgcaatcctcagtactctgccgtcaccttgcctga

SEQ ID NO: 29104 - DNA, 37 bp, Artificial Sequence
  Synthetic oligonucleotide
tacacgccccacctcagcactaacgtcccgacgttga

SEQ ID NO: 29105 - DNA, 36 bp, Artificial Sequence
  Synthetic oligonucleotide
gtcccaccctaactagatgctccctgatcgtttcca

SEQ ID NO: 29106 - DNA, 37 bp, Artificial Sequence
  Synthetic oligonucleotide
gtggaggatgaacaggttgacgggaaggagtaaggga

SEQ ID NO: 29107 - DNA, 36 bp, Artificial Sequence
  Synthetic oligonucleotide
gtccaagctgcgttcccacgttggccaatttcctga

SEQ ID NO: 29108 - DNA, 37 bp, Artificial Sequence
  Synthetic oligonucleotide
ttggaagcgctccgaaccgctcttctttgtcctttga

SEQ ID NO: 29109 - DNA, 35 bp, Artificial Sequence
  Synthetic oligonucleotide
gtatgcgaccacgcgactgcatcacaccctcttac

SEQ ID NO: 29110 - DNA, 35 bp, Artificial Sequence
  Synthetic oligonucleotide
taatcgcacagtgttaactgcgcgggtctcccttc

SEQ ID NO: 29111 - DNA, 35 bp, Artificial Sequence
  Synthetic oligonucleotide
gttcgcctatgtcctcgagtttgcccatagccttc

SEQ ID NO: 29112 - DNA, 35 bp, Artificial Sequence
  Synthetic oligonucleotide
tacctgcgttccagccccgcaccgcattcattttc

SEQ ID NO: 29113 - DNA, 35 bp, Artificial Sequence
  Synthetic oligonucleotide
acctgcccaggcatccgggtcacatcaacatgtcg

SEQ ID NO: 29114 - DNA, 35 bp, Artificial Sequence
  Synthetic oligonucleotide
tctacctgtcagcatttacggtactctctcttatg

SEQ ID NO: 29115 - DNA, 35 bp, Artificial Sequence
  Synthetic oligonucleotide
tcagagacccgagataaaattcccgctcccacctg

SEQ ID NO: 29116 - DNA, 35 bp, Artificial Sequence
  Synthetic oligonucleotide
accgcccacgccttaggtctcacgcgaagcgaact

SEQ ID NO: 29117 - DNA, 35 bp, Artificial Sequence
  Synthetic oligonucleotide
gccaaattgctcactcctggtctggactcttaggt

SEQ ID NO: 29118 - DNA, 35 bp, Artificial Sequence
  Synthetic oligonucleotide
gaccgtagggggcaaaagtagtgtatgggacaatt

SEQ ID NO: 29119 - DNA, 36 bp, Artificial Sequence
  Synthetic oligonucleotide
gcatacaccgccgacgccctgacggttgccgtgcca

SEQ ID NO: 29120 - DNA, 36 bp, Artificial Sequence
  Synthetic oligonucleotide
ttgccctgcagtccaaattattgccacatttatcca

SEQ ID NO: 29121 - DNA, 35 bp, Artificial Sequence
  Synthetic oligonucleotide
gcttacccgtatgtattgcctttcctttggtctca

SEQ ID NO: 29122 - DNA, 37 bp, Artificial Sequence
  Synthetic oligonucleotide
accaacacgttcctattttgtccgtcatcctgcccga

SEQ ID NO: 29123 - DNA, 37 bp, Artificial Sequence
  Synthetic oligonucleotide
gacaacccccctgtttaatgaccctgactcccgccga

SEQ ID NO: 29124 - DNA, 37 bp, Artificial Sequence
  Synthetic oligonucleotide
tgccacccagccagaatcgccacgtgggatccctcga

SEQ ID NO: 29125 - DNA, 36 bp, Artificial Sequence
  Synthetic oligonucleotide
acttcacccacctggctctcagacacttttacagga

SEQ ID NO: 29126 - DNA, 37 bp, Artificial Sequence
  Synthetic oligonucleotide
tgccccccgattgatctcccatcccgtaaggccatga

SEQ ID NO: 29127 - DNA, 38 bp, Artificial Sequence
  Synthetic oligonucleotide
gagccgccacgtttgcccgtgagtgattcttcccctga

SEQ ID NO: 29128 - DNA, 38 bp, Artificial Sequence
  Synthetic oligonucleotide
ggagggtgggggaaatattacggataagcaaaggctga

SEQ ID NO: 29129 - DNA, 36 bp, Artificial Sequence
  Synthetic oligonucleotide
ggatccccaggtccgcagcaccctccatcaacttga

SEQ ID NO: 29130 - DNA, 37 bp, Artificial Sequence
  Synthetic oligonucleotide
gtggaacgctgaacgcattgaaaccctccgaacttga

SEQ ID NO: 29131 - DNA, 35 bp, Artificial Sequence
  Synthetic oligonucleotide
gcatcaccttgtcccccgcgccttgtcgaagcata

SEQ ID NO: 29132 - DNA, 36 bp, Artificial Sequence
  Synthetic oligonucleotide
tcaacaccacagtcgcaaacgttcttctttctcata

SEQ ID NO: 29133 - DNA, 35 bp, Artificial Sequence
  Synthetic oligonucleotide
tacgacgccgtatataccaatcgcgagcccaccta

SEQ ID NO: 29134 - DNA, 35 bp, Artificial Sequence
  Synthetic oligonucleotide
acctcatacgtcttacctgcccactctcgcgtgac

SEQ ID NO: 29135 - DNA, 35 bp, Artificial Sequence
  Synthetic oligonucleotide
ccaaccaccttccgcttggatcactcgtacgctac

SEQ ID NO: 29136 - DNA, 35 bp, Artificial Sequence
  Synthetic oligonucleotide
gcgcactcaggtattcgtcgctttgttccccttac

SEQ ID NO: 29137 - DNA, 35 bp, Artificial Sequence
  Synthetic oligonucleotide
gtactccagcaactgcatacgtcaactcttccagc

SEQ ID NO: 29138 - DNA, 35 bp, Artificial Sequence
  Synthetic oligonucleotide
atgattgggcgggtgggttgttacaaggcgggggc

SEQ ID NO: 29139 - DNA, 35 bp, Artificial Sequence
  Synthetic oligonucleotide
tgaacattacacagacgattcacgcaccgcattgc

SEQ ID NO: 29140 - DNA, 35 bp, Artificial Sequence
  Synthetic oligonucleotide
tatgacccgccccccagtcctatgacagagaatgg

SEQ ID NO: 29141 - DNA, 35 bp, Artificial Sequence
  Synthetic oligonucleotide
actgtcaattcaccactcgatgctacatgcctgct

SEQ ID NO: 29142 - DNA, 35 bp, Artificial Sequence
  Synthetic oligonucleotide
gaccttacccccagcatagtgaacttctgaacttt

SEQ ID NO: 29143 - DNA, 35 bp, Artificial Sequence
  Synthetic oligonucleotide
cacctctgctcgaatattacttagatttacaccca

SEQ ID NO: 29144 - DNA, 37 bp, Artificial Sequence
  Synthetic oligonucleotide
ggtggggccgtcaagcattgggcatgggcgtagggga

SEQ ID NO: 29145 - DNA, 38 bp, Artificial Sequence
  Synthetic oligonucleotide
gcagcaagccgccgccgttctctttggtccccttatga

SEQ ID NO: 29146 - DNA, 38 bp, Artificial Sequence
  Synthetic oligonucleotide
tatcgcgccgtgaggtgcgaccccctcaaccatggtga

SEQ ID NO: 29147 - DNA, 36 bp, Artificial Sequence
  Synthetic oligonucleotide
gatgcaggaagggaggttaaggaaatgcgatgttga

SEQ ID NO: 29148 - DNA, 38 bp, Artificial Sequence
  Synthetic oligonucleotide
acgcggtcacatctcttggccatcactctgtactttga

SEQ ID NO: 29149 - DNA, 35 bp, Artificial Sequence
  Synthetic oligonucleotide
ttcatcgccgcccacattcgacgtctgacttggta

SEQ ID NO: 29150 - DNA, 36 bp, Artificial Sequence
  Synthetic oligonucleotide
aaccaccaccagcccgagactttgattcggttttta

SEQ ID NO: 29151 - DNA, 35 bp, Artificial Sequence
  Synthetic oligonucleotide
aatcacattccaaaggaccccccaagcaattggcc

SEQ ID NO: 29152 - DNA, 35 bp, Artificial Sequence
  Synthetic oligonucleotide
tgtcccagctagccaatgttggcccaatcttttcc

SEQ ID NO: 29153 - DNA, 35 bp, Artificial Sequence
  Synthetic oligonucleotide
tcaggtcccgcctacgcgcttcaccatggctcctc

SEQ ID NO: 29154 - DNA, 35 bp, Artificial Sequence
  Synthetic oligonucleotide
tcgctgacctcctgttctctcctggtagcatttcg

SEQ ID NO: 29155 - DNA, 35 bp, Artificial Sequence
  Synthetic oligonucleotide
gataaggcgttagggaaaaggaaaagggtggttgg

SEQ ID NO: 29156 - DNA, 35 bp, Artificial Sequence
  Synthetic oligonucleotide
tgaagcgcatgtccctcactggtctctctacaaaa

SEQ ID NO: 29157 - DNA, 36 bp, Artificial Sequence
  Synthetic oligonucleotide
ttagttccgcctcaccttgcagagctagcccctaaa

SEQ ID NO: 29158 - DNA, 35 bp, Artificial Sequence
  Synthetic oligonucleotide
acatgcccgggatgtctgtctgtaatcctcgccaa

SEQ ID NO: 29159 - DNA, 35 bp, Artificial Sequence
  Synthetic oligonucleotide
gagccggagccatgtctacgtgtcttgaacctgaa

SEQ ID NO: 29160 - DNA, 36 bp, Artificial Sequence
  Synthetic oligonucleotide
atcgtcgcctccctgttctacacgttttagataaca

SEQ ID NO: 29161 - DNA, 36 bp, Artificial Sequence
  Synthetic oligonucleotide
acctcgctacgggctatcatttgactgcatcttcca

SEQ ID NO: 29162 - DNA, 35 bp, Artificial Sequence
  Synthetic oligonucleotide
ttccctgtccggccttccctctgttctccttgcga

SEQ ID NO: 29163 - DNA, 37 bp, Artificial Sequence
  Synthetic oligonucleotide
gacaacatcccgaccccgcaccgaggtgccctctcga

SEQ ID NO: 29164 - DNA, 37 bp, Artificial Sequence
  Synthetic oligonucleotide
tcatccgcgcaaatcttaactttatccctccgcagga

SEQ ID NO: 29165 - DNA, 36 bp, Artificial Sequence
  Synthetic oligonucleotide
gtccgccccccccggtaatgaaggttgcccatagga

SEQ ID NO: 29166 - DNA, 38 bp, Artificial Sequence
  Synthetic oligonucleotide
gtgaaacggtcggtgggtgggtttgggtgaggtaatga

SEQ ID NO: 29167 - DNA, 38 bp, Artificial Sequence
  Synthetic oligonucleotide
tgaacccaaccgccccatcgttccatcgaatgttatga

SEQ ID NO: 29168 - DNA, 37 bp, Artificial Sequence
  Synthetic oligonucleotide
tagcactcccggttgttcccatgcgtacttcaactga

SEQ ID NO: 29169 - DNA, 38 bp, Artificial Sequence
  Synthetic oligonucleotide
tgacccgtacgcattagttacgctccactctgaattga

SEQ ID NO: 29170 - DNA, 38 bp, Artificial Sequence
  Synthetic oligonucleotide
gcctgcggtcaccacgtttcggcctccaccacccttga

SEQ ID NO: 29171 - DNA, 38 bp, Artificial Sequence
  Synthetic oligonucleotide
tcgaacgcaccccatatgctctgtcacttcccctctta

SEQ ID NO: 29172 - DNA, 35 bp, Artificial Sequence
  Synthetic oligonucleotide
aaaggctcgctcctgtcgccttgcccaacctggcc

SEQ ID NO: 29173 - DNA, 35 bp, Artificial Sequence
  Synthetic oligonucleotide
ttcacgaccatcatagccgtttcataccccagtgc

SEQ ID NO: 29174 - DNA, 35 bp, Artificial Sequence
  Synthetic oligonucleotide
tacgccactcgcatcctttgcacttctcgaatacg

SEQ ID NO: 29175 - DNA, 35 bp, Artificial Sequence
  Synthetic oligonucleotide
atgcgcagccagttatatccctgcgctgccctcct

SEQ ID NO: 29176 - DNA, 35 bp, Artificial Sequence
  Synthetic oligonucleotide
gctgaccacaaccttaaaaccgcgtatacggcgct

SEQ ID NO: 29177 - DNA, 35 bp, Artificial Sequence
  Synthetic oligonucleotide
atggacatgggcgacatcctcggttttggttcatt

SEQ ID NO: 29178 - DNA, 36 bp, Artificial Sequence
  Synthetic oligonucleotide
tacccgagctcagcaattcttaccggtcctgcttaa

SEQ ID NO: 29179 - DNA, 36 bp, Artificial Sequence
  Synthetic oligonucleotide
tacgcgccgattccctattttgtttacctcatttca

SEQ ID NO: 29180 - DNA, 37 bp, Artificial Sequence
  Synthetic oligonucleotide
tcccactcccatcttaattgtaactacgcctacgaga

SEQ ID NO: 29181 - DNA, 37 bp, Artificial Sequence
  Synthetic oligonucleotide
acccgcacaccctcggctctgatgctaaaccttccga

SEQ ID NO: 29182 - DNA, 37 bp, Artificial Sequence
  Synthetic oligonucleotide
aaccccggggtgagtgggggaagaagggacttcgcga

SEQ ID NO: 29183 - DNA, 37 bp, Artificial Sequence
  Synthetic oligonucleotide
gactcggtgtgaggggccgggataggatctaggggga

SEQ ID NO: 29184 - DNA, 38 bp, Artificial Sequence
  Synthetic oligonucleotide
aacgccctatccagctagaaaacgctcctgtcctctga

SEQ ID NO: 29185 - DNA, 35 bp, Artificial Sequence
  Synthetic oligonucleotide
tcacagtcctttgccggtcattgggggttccttcg

SEQ ID NO: 29186 - DNA, 35 bp, Artificial Sequence
  Synthetic oligonucleotide
aagagacggtggggggcgagattggacgttgtagg

SEQ ID NO: 29187 - DNA, 35 bp, Artificial Sequence
  Synthetic oligonucleotide
tgttatccatcctcgtcgtactctcaatgatcctg

SEQ ID NO: 29188 - DNA, 35 bp, Artificial Sequence
  Synthetic oligonucleotide
acacactcccaagctccatgttctatgctctgctg

SEQ ID NO: 29189 - DNA, 35 bp, Artificial Sequence
  Synthetic oligonucleotide
tactgacctccccccagtcttgatgaactaaccat

SEQ ID NO: 29190 - DNA, 35 bp, Artificial Sequence
  Synthetic oligonucleotide
gcaacccacatgtcccacgatgctcgctgtaatgt

SEQ ID NO: 29191 - DNA, 35 bp, Artificial Sequence
  Synthetic oligonucleotide
acgacactcacagtaacggcgccgttaaccctttt

SEQ ID NO: 29192 - DNA, 35 bp, Artificial Sequence
  Synthetic oligonucleotide
tttgcgacggcacccggctttaaacgtccctttca

SEQ ID NO: 29193 - DNA, 36 bp, Artificial Sequence
  Synthetic oligonucleotide
tacgccctactcatcacgttctacacagcggtttca

SEQ ID NO: 29194 - DNA, 37 bp, Artificial Sequence
  Synthetic oligonucleotide
gtcatacccaccaatgcaaacaatctctcgacggaga

SEQ ID NO: 29195 - DNA, 37 bp, Artificial Sequence
  Synthetic oligonucleotide
actccctgtgtcgttggtcttttcccgccttcgccga

SEQ ID NO: 29196 - DNA, 37 bp, Artificial Sequence
  Synthetic oligonucleotide
gaatcagagggaaaggtgggaaaggctggttttgcga

SEQ ID NO: 29197 - DNA, 37 bp, Artificial Sequence
  Synthetic oligonucleotide
taacacccccacgatttaccggcctttagcctttcga

SEQ ID NO: 29198 - DNA, 38 bp, Artificial Sequence
  Synthetic oligonucleotide
tccccccctcaagcccaggtgcctaggcgcacccatga

SEQ ID NO: 29199 - DNA, 38 bp, Artificial Sequence
  Synthetic oligonucleotide
tgccacggccagcccactctgactagcccgcacactga

SEQ ID NO: 29200 - DNA, 38 bp, Artificial Sequence
  Synthetic oligonucleotide
tccacccccacgcccccatgatcggagataacatctga

SEQ ID NO: 29201 - DNA, 38 bp, Artificial Sequence
  Synthetic oligonucleotide
tccataccgaacccgagtcgaatcgaccatatccttga

SEQ ID NO: 29202 - DNA, 37 bp, Artificial Sequence
  Synthetic oligonucleotide
acctcccctgtctcagccccgtccaagacgatcttga

SEQ ID NO: 29203 - DNA, 38 bp, Artificial Sequence
  Synthetic oligonucleotide
gacgacacccgaatctgctttagcacgcgcccctttga

SEQ ID NO: 29204 - DNA, 36 bp, Artificial Sequence
  Synthetic oligonucleotide
gagcaggcgggacttcaccacccctgccaactgtta

SEQ ID NO: 29205 - DNA, 35 bp, Artificial Sequence
  Synthetic oligonucleotide
acatgggcgacgcgacttgcctctacaactgaacc

SEQ ID NO: 29206 - DNA, 35 bp, Artificial Sequence
  Synthetic oligonucleotide
tgtgggctgtagcgcatcaacccttcttcttgttc

SEQ ID NO: 29207 - DNA, 35 bp, Artificial Sequence
  Synthetic oligonucleotide
aagctagggcgggacgatgggtggggaaaacgagg

SEQ ID NO: 29208 - DNA, 35 bp, Artificial Sequence
  Synthetic oligonucleotide
gggagcacattttgattcaccgtcaccccccactg

SEQ ID NO: 29209 - DNA, 35 bp, Artificial Sequence
  Synthetic oligonucleotide
atccctggcccatcatatcaccctgctctgttcat

SEQ ID NO: 29210 - DNA, 35 bp, Artificial Sequence
  Synthetic oligonucleotide
gcattcctattcgaacctccacgctaccgccgggt

SEQ ID NO: 29211 - DNA, 36 bp, Artificial Sequence
  Synthetic oligonucleotide
acccacgccgtttggcgactgtcgcaccctcgtaca

SEQ ID NO: 29212 - DNA, 36 bp, Artificial Sequence
  Synthetic oligonucleotide
tcacgtaacccgcatgaggcaccttatttagcacca

SEQ ID NO: 29213 - DNA, 36 bp, Artificial Sequence
  Synthetic oligonucleotide
gttgcagtgcgcccctttgctcagtcatacttttca

SEQ ID NO: 29214 - DNA, 37 bp, Artificial Sequence
  Synthetic oligonucleotide
tccctacgctaccgacctgccttatttttctgccgga

SEQ ID NO: 29215 - DNA, 38 bp, Artificial Sequence
  Synthetic oligonucleotide
gtgcccacaccaacctgcataacggaatgtaagcatga

SEQ ID NO: 29216 - DNA, 35 bp, Artificial Sequence
  Synthetic oligonucleotide
aacaacacaactgcccgaccactctctggcgctga

SEQ ID NO: 29217 - DNA, 38 bp, Artificial Sequence
  Synthetic oligonucleotide
tagcgccgatgctgtggaatagtgtagggtgggggtga

SEQ ID NO: 29218 - DNA, 35 bp, Artificial Sequence
  Synthetic oligonucleotide
gttgcacacgtagcgtaataaatctccagccctta

SEQ ID NO: 29219 - DNA, 36 bp, Artificial Sequence
  Synthetic oligonucleotide
atctgtggccggctttctcccgacgttttcgcaccc

SEQ ID NO: 29220 - DNA, 35 bp, Artificial Sequence
  Synthetic oligonucleotide
accatagtccgcttccgtaactggttctttcccat

SEQ ID NO: 29221 - DNA, 35 bp, Artificial Sequence
  Synthetic oligonucleotide
aacacgcccctgtaacactacgcccgatgtcacct

SEQ ID NO: 29222 - DNA, 35 bp, Artificial Sequence
  Synthetic oligonucleotide
tatctccaattgtcgtactgcacacatacacctgt

SEQ ID NO: 29223 - DNA, 35 bp, Artificial Sequence
  Synthetic oligonucleotide
gttgcacctgctatcatagcttcacccaagtaatt

SEQ ID NO: 29224 - DNA, 35 bp, Artificial Sequence
  Synthetic oligonucleotide
actccactcagcgcccttcgggttccgcgttactt

SEQ ID NO: 29225 - DNA, 35 bp, Artificial Sequence
  Synthetic oligonucleotide
gtgctactgctgtgacacgccctttgcttactttt

SEQ ID NO: 29226 - DNA, 37 bp, Artificial Sequence
  Synthetic oligonucleotide
gactgcataactcgatgtcttcggtctcacactgcaa

SEQ ID NO: 29227 - DNA, 36 bp, Artificial Sequence
  Synthetic oligonucleotide
gtccatccacgtcagcgccgcgctcacactaccgca

SEQ ID NO: 29228 - DNA, 37 bp, Artificial Sequence
  Synthetic oligonucleotide
tagatggagccggtggaggggttaggggtttgggcga

SEQ ID NO: 29229 - DNA, 36 bp, Artificial Sequence
  Synthetic oligonucleotide
gccacagtcaggacagcaggtgggaggggagacgga

SEQ ID NO: 29230 - DNA, 38 bp, Artificial Sequence
  Synthetic oligonucleotide
tacacgtccgctttactcttgccggataccgccactga

SEQ ID NO: 29231 - DNA, 38 bp, Artificial Sequence
  Synthetic oligonucleotide
gcactgctccatctcatgcaacgtctattccatattga

SEQ ID NO: 29232 - DNA, 37 bp, Artificial Sequence
  Synthetic oligonucleotide
accgccgcacctcctactaggcgctcactctacttga

SEQ ID NO: 29233 - DNA, 35 bp, Artificial Sequence
  Synthetic oligonucleotide
tgcgggagggagggccataacgcgggataagttga

SEQ ID NO: 29234 - DNA, 35 bp, Artificial Sequence
  Synthetic oligonucleotide
gtaccccgaacctcgtgaaaccccggaactccgta

SEQ ID NO: 29235 - DNA, 35 bp, Artificial Sequence
  Synthetic oligonucleotide
actctgacccttcttcgcctaccagtatctggtta

SEQ ID NO: 29236 - DNA, 35 bp, Artificial Sequence
  Synthetic oligonucleotide
accaaccccgctcaattgagcagccaacgagatac

SEQ ID NO: 29237 - DNA, 35 bp, Artificial Sequence
  Synthetic oligonucleotide
aattgcgcccaacgttcacccatctagcgcgtacc

SEQ ID NO: 29238 - DNA, 36 bp, Artificial Sequence
  Synthetic oligonucleotide
ggttacgcgggaaaggaggggggcagtagatagggc

SEQ ID NO: 29239 - DNA, 35 bp, Artificial Sequence
  Synthetic oligonucleotide
gccccccacgcacgttacattctgtgtttacaccg

SEQ ID NO: 29240 - DNA, 35 bp, Artificial Sequence
  Synthetic oligonucleotide
gcatcgctgtgattcgctttttgatcctttcctcg

SEQ ID NO: 29241 - DNA, 35 bp, Artificial Sequence
  Synthetic oligonucleotide
tgcgatgcatgctttctaccggtgccccttctcgg

SEQ ID NO: 29242 - DNA, 35 bp, Artificial Sequence
  Synthetic oligonucleotide
aaccgcgaacctggcctgatttagcgctccaaact

SEQ ID NO: 29243 - DNA, 35 bp, Artificial Sequence
  Synthetic oligonucleotide
gtcgagcacttacttaccatgtctttccgctgcct

SEQ ID NO: 29244 - DNA, 35 bp, Artificial Sequence
  Synthetic oligonucleotide
tccttgacgcctaacatcgaaccacactgacccgt

SEQ ID NO: 29245 - DNA, 35 bp, Artificial Sequence
  Synthetic oligonucleotide
tacagacctcaatcctagagcccccatctacagtt

SEQ ID NO: 29246 - DNA, 36 bp, Artificial Sequence
  Synthetic oligonucleotide
tccaacctccatcgcctttgtgtcctggttctgaaa

SEQ ID NO: 29247 - DNA, 35 bp, Artificial Sequence
  Synthetic oligonucleotide
gcctgctcgcctgccatacttatgcctacccctaa

SEQ ID NO: 29248 - DNA, 35 bp, Artificial Sequence
  Synthetic oligonucleotide
tccccccacatggtttgagagctacgcgccactca

SEQ ID NO: 29249 - DNA, 36 bp, Artificial Sequence
  Synthetic oligonucleotide
gtgctgtggatgggcggggggtgatggcttcgggga

SEQ ID NO: 29250 - DNA, 38 bp, Artificial Sequence
  Synthetic oligonucleotide
tgaactccactcgccctacaatcggcatcccttggtga

SEQ ID NO: 29251 - DNA, 38 bp, Artificial Sequence
  Synthetic oligonucleotide
acacgtctccctcagctgcaccagtcctgtcgatgtga

SEQ ID NO: 29252 - DNA, 37 bp, Artificial Sequence
  Synthetic oligonucleotide
gacgcaatcaacatatatgcccaatagccctgcttga

SEQ ID NO: 29253 - DNA, 36 bp, Artificial Sequence
  Synthetic oligonucleotide
gatgatacacgcgagtttaacagtcccttctccata

SEQ ID NO: 29254 - DNA, 35 bp, Artificial Sequence
  Synthetic oligonucleotide
agctatgtcgcagtccgcgatgcacactcttccta

SEQ ID NO: 29255 - DNA, 36 bp, Artificial Sequence
  Synthetic oligonucleotide
tcgagcaccatccccaccaggcccccgagccatcta

SEQ ID NO: 29256 - DNA, 35 bp, Artificial Sequence
  Synthetic oligonucleotide
aagtggcctctgcccccggttgaaactcgtactta

SEQ ID NO: 29257 - DNA, 35 bp, Artificial Sequence
  Synthetic oligonucleotide
tttggagcccctagtcgttgtttgcacaccatccc

SEQ ID NO: 29258 - DNA, 35 bp, Artificial Sequence
  Synthetic oligonucleotide
ttccactcgaacactatccatctacactttgggag

SEQ ID NO: 29259 - DNA, 35 bp, Artificial Sequence
  Synthetic oligonucleotide
ggttggtccacagccggcgatcgattccctgctct

SEQ ID NO: 29260 - DNA, 36 bp, Artificial Sequence
  Synthetic oligonucleotide
gtgacaccgtctctctcatcagccattccccgcgaa

SEQ ID NO: 29261 - DNA, 36 bp, Artificial Sequence
  Synthetic oligonucleotide
gccaccgctcacacaaggcttcctacctcaaggtca

SEQ ID NO: 29262 - DNA, 37 bp, Artificial Sequence
  Synthetic oligonucleotide
aaccacacccaccgaacgcccgcctccgcttatgaga

SEQ ID NO: 29263 - DNA, 37 bp, Artificial Sequence
  Synthetic oligonucleotide
gttccacgtccggttcccctcatacttgacatctgga

SEQ ID NO: 29264 - DNA, 37 bp, Artificial Sequence
  Synthetic oligonucleotide
gacacctagtaggagggggggccgggtatgtcggtga

SEQ ID NO: 29265 - DNA, 38 bp, Artificial Sequence
  Synthetic oligonucleotide
ttcgggggtgggattgggaaaagaaattgggcgggtga

SEQ ID NO: 29266 - DNA, 35 bp, Artificial Sequence
  Synthetic oligonucleotide
aacacgcgtatacgatttacacgcccatgcttcac

SEQ ID NO: 29267 - DNA, 35 bp, Artificial Sequence
  Synthetic oligonucleotide
atgtgggtagtgggcgggtgggtgtattgttcgac

SEQ ID NO: 29268 - DNA, 35 bp, Artificial Sequence
  Synthetic oligonucleotide
gacgtcgttccaccaatccgtttctgtacgcatac

SEQ ID NO: 29269 - DNA, 34 bp, Artificial Sequence
  Synthetic oligonucleotide
aacgtcccacccctgtctagtcggttatctgtac

SEQ ID NO: 29270 - DNA, 35 bp, Artificial Sequence
  Synthetic oligonucleotide
cacaccatcctcctcagagtacctgcccgtactgc

SEQ ID NO: 29271 - DNA, 35 bp, Artificial Sequence
  Synthetic oligonucleotide
attgatcataccaccagatcggacttttttgcatt

SEQ ID NO: 29272 - DNA, 35 bp, Artificial Sequence
  Synthetic oligonucleotide
ttcatcaccgtagttacgccatttgatgatcactt

SEQ ID NO: 29273 - DNA, 35 bp, Artificial Sequence
  Synthetic oligonucleotide
accactgaaacacccggcttaactcgtgcactaca

SEQ ID NO: 29274 - DNA, 35 bp, Artificial Sequence
  Synthetic oligonucleotide
acatccatggatgtcatgtactactaccggtccca

SEQ ID NO: 29275 - DNA, 37 bp, Artificial Sequence
  Synthetic oligonucleotide
gtgggatgagtgaagggtggagcaatggatcggcaga

SEQ ID NO: 29276 - DNA, 37 bp, Artificial Sequence
  Synthetic oligonucleotide
accaccaccaaccggttaagcgtggctgattccccga

SEQ ID NO: 29277 - DNA, 37 bp, Artificial Sequence
  Synthetic oligonucleotide
tgtgagtgacggtgggtggggtgaggagactgaggga

SEQ ID NO: 29278 - DNA, 38 bp, Artificial Sequence
  Synthetic oligonucleotide
actcagccctcccccgttcgtcctgctatctggactga

SEQ ID NO: 29279 - DNA, 36 bp, Artificial Sequence
  Synthetic oligonucleotide
tcagcggtgcgcccgttgaagtcccgaaccgcccta

SEQ ID NO: 29280 - DNA, 36 bp, Artificial Sequence
  Synthetic oligonucleotide
gaaccatcccgtcgctatcctaaagcctagattcta

SEQ ID NO: 29281 - DNA, 35 bp, Artificial Sequence
  Synthetic oligonucleotide
gtacccttccgatttgcggaccattggctttctta

SEQ ID NO: 29282 - DNA, 35 bp, Artificial Sequence
  Synthetic oligonucleotide
tctaggcacgccaataccctgtccacccgctgtta

SEQ ID NO: 29283 - DNA, 35 bp, Artificial Sequence
  Synthetic oligonucleotide
tggatcaccctggccgtgcttccacaatcccgaac

SEQ ID NO: 29284 - DNA, 35 bp, Artificial Sequence
  Synthetic oligonucleotide
aaccgtatacactctccgtccctggccttcgccac

SEQ ID NO: 29285 - DNA, 34 bp, Artificial Sequence
  Synthetic oligonucleotide
tcccaccgcgaggtccgtcgctacacaccaatcc

SEQ ID NO: 29286 - DNA, 35 bp, Artificial Sequence
  Synthetic oligonucleotide
tgactcggatcgaaccgactacacttacacatgag

SEQ ID NO: 29287 - DNA, 35 bp, Artificial Sequence
  Synthetic oligonucleotide
tacgaccagccatctcctagacctgtatgacccgg

SEQ ID NO: 29288 - DNA, 35 bp, Artificial Sequence
  Synthetic oligonucleotide
tagttcaacccgcaattcgagccctgatagctgct

SEQ ID NO: 29289 - DNA, 35 bp, Artificial Sequence
  Synthetic oligonucleotide
gcgcaaaccgattcacctcggtaaatgactcatct

SEQ ID NO: 29290 - DNA, 35 bp, Artificial Sequence
  Synthetic oligonucleotide
tagcctcccggacgcctttcctttgtcaaacgctt

SEQ ID NO: 29291 - DNA, 35 bp, Artificial Sequence
  Synthetic oligonucleotide
tgaactcactggcctgaataccgctgtacttattt

SEQ ID NO: 29292 - DNA, 35 bp, Artificial Sequence
  Synthetic oligonucleotide
acccaccccaagccccgttacgtatttagaataca

SEQ ID NO: 29293 - DNA, 36 bp, Artificial Sequence
  Synthetic oligonucleotide
attcctcacccatctagggtccgagacactgctcca

SEQ ID NO: 29294 - DNA, 36 bp, Artificial Sequence
  Synthetic oligonucleotide
gccttccagccagacgcatatcctccttatcttcca

SEQ ID NO: 29295 - DNA, 37 bp, Artificial Sequence
  Synthetic oligonucleotide
acgttcatccgcccgacaaccttaatgcctcagacga

SEQ ID NO: 29296 - DNA, 37 bp, Artificial Sequence
  Synthetic oligonucleotide
tcgagccatcagcaattcgtgcactttaccttgccga

SEQ ID NO: 29297 - DNA, 37 bp, Artificial Sequence
  Synthetic oligonucleotide
actccgcctagtgttatcccatcagcgcctactccga

SEQ ID NO: 29298 - DNA, 37 bp, Artificial Sequence
  Synthetic oligonucleotide
acccgcctgcctccgttacccagaccacgtagcatga

SEQ ID NO: 29299 - DNA, 38 bp, Artificial Sequence
  Synthetic oligonucleotide
ggttcgacaactcttctacacacaacaccccgcattga

SEQ ID NO: 29300 - DNA, 35 bp, Artificial Sequence
  Synthetic oligonucleotide
gttcacaactgcagccctccattctccttatggac

SEQ ID NO: 29301 - DNA, 35 bp, Artificial Sequence
  Synthetic oligonucleotide
gaggaacaacgggcgaccacatgacccatcccacc

SEQ ID NO: 29302 - DNA, 35 bp, Artificial Sequence
  Synthetic oligonucleotide
gtcagggagaaatacgggttggctggggacggggc

SEQ ID NO: 29303 - DNA, 35 bp, Artificial Sequence
  Synthetic oligonucleotide
gcacctgcttaatatgaccacctcttgctcgttcg

SEQ ID NO: 29304 - DNA, 35 bp, Artificial Sequence
  Synthetic oligonucleotide
ttaacctctatcatgcgcgcactgcacaccatgct

SEQ ID NO: 29305 - DNA, 35 bp, Artificial Sequence
  Synthetic oligonucleotide
atcatacgggcgaacggatgggaagtggtgcgtgt

SEQ ID NO: 29306 - DNA, 35 bp, Artificial Sequence
  Synthetic oligonucleotide
tagactggccaagcggtcaccagcgcacacatatt

SEQ ID NO: 29307 - DNA, 36 bp, Artificial Sequence
  Synthetic oligonucleotide
gcacctcctgaacctgcacctgtagactgtagcaaa

SEQ ID NO: 29308 - DNA, 36 bp, Artificial Sequence
  Synthetic oligonucleotide
cactttgcccgttgaccatgctcattttccccacaa

SEQ ID NO: 29309 - DNA, 35 bp, Artificial Sequence
  Synthetic oligonucleotide
gtcgccgtatcaaggcccttcacccacctttgtaa

SEQ ID NO: 29310 - DNA, 35 bp, Artificial Sequence
  Synthetic oligonucleotide
tgttccctcagagcacctcgacaccagctttaaca

SEQ ID NO: 29311 - DNA, 35 bp, Artificial Sequence
  Synthetic oligonucleotide
aacaacgcatatgtctcctcgtaccacctgaacca

SEQ ID NO: 29312 - DNA, 36 bp, Artificial Sequence
  Synthetic oligonucleotide
agaccccactccatcggctgcctcatttcactgtca

SEQ ID NO: 29313 - DNA, 37 bp, Artificial Sequence
  Synthetic oligonucleotide
tagacctcaacactcctcacctgcgacgccctgcgga

SEQ ID NO: 29314 - DNA, 36 bp, Artificial Sequence
  Synthetic oligonucleotide
gtaccagcaccacgcagcaccccacaccaaatctga

SEQ ID NO: 29315 - DNA, 38 bp, Artificial Sequence
  Synthetic oligonucleotide
agtggtccatgcgtcaccgtttccctctaccccgttga

SEQ ID NO: 29316 - DNA, 38 bp, Artificial Sequence
  Synthetic oligonucleotide
actcccactactgcatctctattgtctctctgttttga

SEQ ID NO: 29317 - DNA, 35 bp, Artificial Sequence
  Synthetic oligonucleotide
gctcaggtcgaatcctcccaaatgtagtccctgta

SEQ ID NO: 29318 - DNA, 35 bp, Artificial Sequence
  Synthetic oligonucleotide
ggacttctcatcagactgcaccttctgcctcccag

SEQ ID NO: 29319 - DNA, 35 bp, Artificial Sequence
  Synthetic oligonucleotide
atcgccaccctctatgctatatctatgtcacccat

SEQ ID NO: 29320 - DNA, 35 bp, Artificial Sequence
  Synthetic oligonucleotide
atatggggggaggggcggaattagccagagcggat

SEQ ID NO: 29321 - DNA, 35 bp, Artificial Sequence
  Synthetic oligonucleotide
tgcatacgctcgacgctgcaaactggcacccctct

SEQ ID NO: 29322 - DNA, 36 bp, Artificial Sequence
  Synthetic oligonucleotide
gagaccgcccgccaaatgctcatcactaggccccaa

SEQ ID NO: 29323 - DNA, 35 bp, Artificial Sequence
  Synthetic oligonucleotide
tgctcaccgcccgagtctagccccgcaaacttgaa

SEQ ID NO: 29324 - DNA, 35 bp, Artificial Sequence
  Synthetic oligonucleotide
gatgcacggtgaggatggctctgctctttcggtaa

SEQ ID NO: 29325 - DNA, 35 bp, Artificial Sequence
  Synthetic oligonucleotide
tgtgtatacgccatcaccatctcccgcccagccca

SEQ ID NO: 29326 - DNA, 37 bp, Artificial Sequence
  Synthetic oligonucleotide
aggtcagggtaggtggctaaacgtggggggatgagga

SEQ ID NO: 29327 - DNA, 38 bp, Artificial Sequence
  Synthetic oligonucleotide
atgcatcggtaggatgtcctttcccccgcccccgatga

SEQ ID NO: 29328 - DNA, 37 bp, Artificial Sequence
  Synthetic oligonucleotide
acaccgtcgcctctgcctccttccgctggacttatga

SEQ ID NO: 29329 - DNA, 38 bp, Artificial Sequence
  Synthetic oligonucleotide
taaagccacccgcttaatcgtgaaccattctccattga

SEQ ID NO: 29330 - DNA, 38 bp, Artificial Sequence
  Synthetic oligonucleotide
gctcagggaaaggggtgggagatggagcccttgattga

SEQ ID NO: 29331 - DNA, 36 bp, Artificial Sequence
  Synthetic oligonucleotide
cagtgccgtcaccttccatacaccagttatccttga

SEQ ID NO: 29332 - DNA, 36 bp, Artificial Sequence
  Synthetic oligonucleotide
agggagggtggggtggaagtggttacggtttgggta

SEQ ID NO: 29333 - DNA, 35 bp, Artificial Sequence
  Synthetic oligonucleotide
tgcacgccaatcgcacgtcttgcactctcctgtcc

SEQ ID NO: 29334 - DNA, 35 bp, Artificial Sequence
  Synthetic oligonucleotide
tacaccgacgccccttcgaactgccaccctagcgc

SEQ ID NO: 29335 - DNA, 35 bp, Artificial Sequence
  Synthetic oligonucleotide
aacctggttccgcaccttctcccgctcggacgttc

SEQ ID NO: 29336 - DNA, 35 bp, Artificial Sequence
  Synthetic oligonucleotide
tgggtggggccgaacgggggacaatggaagaatag

SEQ ID NO: 29337 - DNA, 35 bp, Artificial Sequence
  Synthetic oligonucleotide
tctagatggctcgcatggccccgcggtttctccat

SEQ ID NO: 29338 - DNA, 35 bp, Artificial Sequence
  Synthetic oligonucleotide
ggacatccccagttggctttagcttttttcatcat

SEQ ID NO: 29339 - DNA, 35 bp, Artificial Sequence
  Synthetic oligonucleotide
attcctgatcccgacggtaactcgccccacctgct

SEQ ID NO: 29340 - DNA, 35 bp, Artificial Sequence
  Synthetic oligonucleotide
taagggcggggaatcgggaggaggggccaacacgt

SEQ ID NO: 29341 - DNA, 35 bp, Artificial Sequence
  Synthetic oligonucleotide
atgactccaggcctggtttcgaaccctcgttttgt

SEQ ID NO: 29342 - DNA, 36 bp, Artificial Sequence
  Synthetic oligonucleotide
tgccaccctccccctaccttagcgataatagcgaca

SEQ ID NO: 29343 - DNA, 36 bp, Artificial Sequence
  Synthetic oligonucleotide
ttttgacaccccactccgcccgcctcttgtggctca

SEQ ID NO: 29344 - DNA, 37 bp, Artificial Sequence
  Synthetic oligonucleotide
gcctcaccacatggccaagccccgtccacgttaacga

SEQ ID NO: 29345 - DNA, 37 bp, Artificial Sequence
  Synthetic oligonucleotide
aactgcaaagggaaggtgataaggtgattgtaccgga

SEQ ID NO: 29346 - DNA, 38 bp, Artificial Sequence
  Synthetic oligonucleotide
acgcaccgcccgcaactgtcacagcactttcagactga

SEQ ID NO: 29347 - DNA, 36 bp, Artificial Sequence
  Synthetic oligonucleotide
gcctgcgcctgggaaacacgcaccgtcctaccatta

SEQ ID NO: 29348 - DNA, 35 bp, Artificial Sequence
  Synthetic oligonucleotide
tacacgaatgtgttggctcctctaaagcacccgcc

SEQ ID NO: 29349 - DNA, 35 bp, Artificial Sequence
  Synthetic oligonucleotide
tatcgcatacatccgcaaggctgtcccttcctgtc

SEQ ID NO: 29350 - DNA, 35 bp, Artificial Sequence
  Synthetic oligonucleotide
gacaagtgtggagccagcagtcaccctcgcctttc

SEQ ID NO: 29351 - DNA, 35 bp, Artificial Sequence
  Synthetic oligonucleotide
gatgctgcaccatccctcttatgattgctgttgcg

SEQ ID NO: 29352 - DNA, 35 bp, Artificial Sequence
  Synthetic oligonucleotide
tctcgcactacatggcaacaaggggaaacatatcg

SEQ ID NO: 29353 - DNA, 35 bp, Artificial Sequence
  Synthetic oligonucleotide
acgtgccaccattgtcaagaccttgcctacacctg

SEQ ID NO: 29354 - DNA, 35 bp, Artificial Sequence
  Synthetic oligonucleotide
tagcgtgcctaatgccgccgtaccacgcccccgtg

SEQ ID NO: 29355 - DNA, 35 bp, Artificial Sequence
  Synthetic oligonucleotide
agccctcctctcgcgttgtaacggaactgccccat

SEQ ID NO: 29356 - DNA, 35 bp, Artificial Sequence
  Synthetic oligonucleotide
atgacgcccaagtcaccggccttcaccggaccctt

SEQ ID NO: 29357 - DNA, 35 bp, Artificial Sequence
  Synthetic oligonucleotide
gcccagcccgagcttctccatgaacagcctcaaaa

SEQ ID NO: 29358 - DNA, 35 bp, Artificial Sequence
  Synthetic oligonucleotide
gttctgcccctcgtattaggtttgcctcacccaca

SEQ ID NO: 29359 - DNA, 35 bp, Artificial Sequence
  Synthetic oligonucleotide
acctcccccacgatgtcatgacacgcgttggccca

SEQ ID NO: 29360 - DNA, 38 bp, Artificial Sequence
  Synthetic oligonucleotide
ttctcaccccggccgtcgactctatcacttgtcaatga

SEQ ID NO: 29361 - DNA, 35 bp, Artificial Sequence
  Synthetic oligonucleotide
gcaatccgtccaccatcccgactcagagcctcgta

SEQ ID NO: 29362 - DNA, 35 bp, Artificial Sequence
  Synthetic oligonucleotide
gtaacaccgtgtgctatgggtcgcctactttacac

SEQ ID NO: 29363 - DNA, 35 bp, Artificial Sequence
  Synthetic oligonucleotide
tcacgactccatcgctcgcgcgatcgtcgccatac

SEQ ID NO: 29364 - DNA, 35 bp, Artificial Sequence
  Synthetic oligonucleotide
gactgagcaggcctaaatttgagttgaccccgccc

SEQ ID NO: 29365 - DNA, 35 bp, Artificial Sequence
  Synthetic oligonucleotide
tctattacaccgctccgactattaaacactcgttc

SEQ ID NO: 29366 - DNA, 35 bp, Artificial Sequence
  Synthetic oligonucleotide
attgacaccgtggggggggggtgaggtaggggaag

SEQ ID NO: 29367 - DNA, 35 bp, Artificial Sequence
  Synthetic oligonucleotide
aaacacccgacctaatcgtgacaacgcatgctacg

SEQ ID NO: 29368 - DNA, 35 bp, Artificial Sequence
  Synthetic oligonucleotide
atgggtgcggctcacaattctcttcacctcccagg

SEQ ID NO: 29369 - DNA, 35 bp, Artificial Sequence
  Synthetic oligonucleotide
tcgcccctggccatcccacttccctcggccgaatg

SEQ ID NO: 29370 - DNA, 35 bp, Artificial Sequence
  Synthetic oligonucleotide
acccagatctacgtcttagcctgcctctcactctg

SEQ ID NO: 29371 - DNA, 35 bp, Artificial Sequence
  Synthetic oligonucleotide
gcccacgccttgctacacccctgaattttccttat

SEQ ID NO: 29372 - DNA, 35 bp, Artificial Sequence
  Synthetic oligonucleotide
ttaccagcgtgctccgtcgattcctaactgcctct

SEQ ID NO: 29373 - DNA, 35 bp, Artificial Sequence
  Synthetic oligonucleotide
taaccattccgatcttacctcagcaagcctgctca

SEQ ID NO: 29374 - DNA, 36 bp, Artificial Sequence
  Synthetic oligonucleotide
gcttgcaacaactcacgcgacaccttgcttcattca

SEQ ID NO: 29375 - DNA, 37 bp, Artificial Sequence
  Synthetic oligonucleotide
acacgcgtcctcacacgctgacctcccgcatcaacga

SEQ ID NO: 29376 - DNA, 37 bp, Artificial Sequence
  Synthetic oligonucleotide
gaccgccacaacaatttgcaatgcttgaacagctcga

SEQ ID NO: 29377 - DNA, 37 bp, Artificial Sequence
  Synthetic oligonucleotide
gttctaaccgccacgctcacaccacacacctcttcga

SEQ ID NO: 29378 - DNA, 37 bp, Artificial Sequence
  Synthetic oligonucleotide
acacgagacagtaaggggagacgaggggtaacagtga

SEQ ID NO: 29379 - DNA, 35 bp, Artificial Sequence
  Synthetic oligonucleotide
gatagatcggagatagggggggatagataaggtga

SEQ ID NO: 29380 - DNA, 35 bp, Artificial Sequence
  Synthetic oligonucleotide
actacctgcctaaccgttgaggacctagatcaccc

SEQ ID NO: 29381 - DNA, 35 bp, Artificial Sequence
  Synthetic oligonucleotide
ctagacgtgactacgggcccaaccgtccttccatc

SEQ ID NO: 29382 - DNA, 35 bp, Artificial Sequence
  Synthetic oligonucleotide
gcaatccaccgtcacgccacgctcctcctagcctc

SEQ ID NO: 29383 - DNA, 35 bp, Artificial Sequence
  Synthetic oligonucleotide
tagttcgtacagtccgctgccccttcacgctcctc

SEQ ID NO: 29384 - DNA, 35 bp, Artificial Sequence
  Synthetic oligonucleotide
gtgaaggagtgggaagttgtactgtacagggtggg

SEQ ID NO: 29385 - DNA, 35 bp, Artificial Sequence
  Synthetic oligonucleotide
tacgcccctttcatgccaaccagcctgtaccaggt

SEQ ID NO: 29386 - DNA, 35 bp, Artificial Sequence
  Synthetic oligonucleotide
tgcgggggccgggataggcaaaggggaagcaaatt

SEQ ID NO: 29387 - DNA, 36 bp, Artificial Sequence
  Synthetic oligonucleotide
tctagcacgtagcctctcttttcgacgcctcatcaa

SEQ ID NO: 29388 - DNA, 36 bp, Artificial Sequence
  Synthetic oligonucleotide
tttgctcgcgcggtatctcgcatccgtctcctctca

SEQ ID NO: 29389 - DNA, 37 bp, Artificial Sequence
  Synthetic oligonucleotide
ttccatcgcagtagtatctgcgttccctgacttacga

SEQ ID NO: 29390 - DNA, 37 bp, Artificial Sequence
  Synthetic oligonucleotide
tccacccgcatggatccccccacccgactcgacccga

SEQ ID NO: 29391 - DNA, 37 bp, Artificial Sequence
  Synthetic oligonucleotide
tgagcgccccacgacacgtagtttacgctttacccga

SEQ ID NO: 29392 - DNA, 37 bp, Artificial Sequence
  Synthetic oligonucleotide
ttgagtgcaagaaggcgggatggggccaatggggcga

SEQ ID NO: 29393 - DNA, 38 bp, Artificial Sequence
  Synthetic oligonucleotide
gcgaagggcgtttgtctctcatcgttttgcccccatga

SEQ ID NO: 29394 - DNA, 38 bp, Artificial Sequence
  Synthetic oligonucleotide
gccccatggctgctccgccacgatacctccttctatga

SEQ ID NO: 29395 - DNA, 37 bp, Artificial Sequence
  Synthetic oligonucleotide
gcaaccttcccgcgtaccaccttaggtttccacctga

SEQ ID NO: 29396 - DNA, 37 bp, Artificial Sequence
  Synthetic oligonucleotide
ttcacgtagctgttttttttcgcccttattgtgctga

SEQ ID NO: 29397 - DNA, 36 bp, Artificial Sequence
  Synthetic oligonucleotide
gactcgccccgtggtacagacgtccccctggctcta

SEQ ID NO: 29398 - DNA, 35 bp, Artificial Sequence
  Synthetic oligonucleotide
tgtgtggcgctaccattgccctcgtttgtcttacc

SEQ ID NO: 29399 - DNA, 34 bp, Artificial Sequence
  Synthetic oligonucleotide
agcccttgcgagttattgctgctcctgtactccc

SEQ ID NO: 29400 - DNA, 35 bp, Artificial Sequence
  Synthetic oligonucleotide
aaaccgtgaagccggagcgaccattacgtccttcc

SEQ ID NO: 29401 - DNA, 35 bp, Artificial Sequence
  Synthetic oligonucleotide
gctggactgccgtgagttctacggtgccacctcgc

SEQ ID NO: 29402 - DNA, 35 bp, Artificial Sequence
  Synthetic oligonucleotide
tgattgactaccgaataccccaactgagcccctgc

SEQ ID NO: 29403 - DNA, 35 bp, Artificial Sequence
  Synthetic oligonucleotide
acacttcatacgcactgtcccgcgacctcgttccg

SEQ ID NO: 29404 - DNA, 35 bp, Artificial Sequence
  Synthetic oligonucleotide
gaacacccttgctcctaccacgagtatagcgagtg

SEQ ID NO: 29405 - DNA, 35 bp, Artificial Sequence
  Synthetic oligonucleotide
ggacaagttgcgtcgctccctttagtcccttcctt

SEQ ID NO: 29406 - DNA, 36 bp, Artificial Sequence
  Synthetic oligonucleotide
gccagggataggggaggatcgaggttgggtgcgaaa

SEQ ID NO: 29407 - DNA, 35 bp, Artificial Sequence
  Synthetic oligonucleotide
tccctacccgtcgcgcccttattacatggtggtaa

SEQ ID NO: 29408 - DNA, 36 bp, Artificial Sequence
  Synthetic oligonucleotide
tcgacactctttacgcttacgaactgctgccaacca

SEQ ID NO: 29409 - DNA, 36 bp, Artificial Sequence
  Synthetic oligonucleotide
atcccactcccctgacgaagagcaccccagtctcca

SEQ ID NO: 29410 - DNA, 37 bp, Artificial Sequence
  Synthetic oligonucleotide
tggtactacggtgggggaagggaggggtcaatgccga

SEQ ID NO: 29411 - DNA, 37 bp, Artificial Sequence
  Synthetic oligonucleotide
gtctccctcccgtattagtttgcaatgtggccctcga

SEQ ID NO: 29412 - DNA, 37 bp, Artificial Sequence
  Synthetic oligonucleotide
gtgcacgagggagggaagagggtgactgaagaaagga

SEQ ID NO: 29413 - DNA, 37 bp, Artificial Sequence
  Synthetic oligonucleotide
gagggatggggcgaggggcgcggatgttggatcagga

SEQ ID NO: 29414 - DNA, 38 bp, Artificial Sequence
  Synthetic oligonucleotide
tgttgctccacccacatccagccgtaatacggtcgtga

SEQ ID NO: 29415 - DNA, 36 bp, Artificial Sequence
  Synthetic oligonucleotide
aaccaagcgtattagtctgctgcctttgctcccata

SEQ ID NO: 29416 - DNA, 35 bp, Artificial Sequence
  Synthetic oligonucleotide
gtactgccgggtgctccggcctaacttgccttacc

SEQ ID NO: 29417 - DNA, 35 bp, Artificial Sequence
  Synthetic oligonucleotide
gtccgtcgactctaggtccccacactatgcttacc

SEQ ID NO: 29418 - DNA, 35 bp, Artificial Sequence
  Synthetic oligonucleotide
gaggacggaaggcgcttttcctcttattgcaattc

SEQ ID NO: 29419 - DNA, 35 bp, Artificial Sequence
  Synthetic oligonucleotide
gaaatcagaggtagcggaggcgatttagggggagg

SEQ ID NO: 29420 - DNA, 35 bp, Artificial Sequence
  Synthetic oligonucleotide
gtctctctcctgtctgccgccaccgtctatcctgg

SEQ ID NO: 29421 - DNA, 35 bp, Artificial Sequence
  Synthetic oligonucleotide
gtgatggctccatgcggtacgccgtgcttttttat

SEQ ID NO: 29422 - DNA, 36 bp, Artificial Sequence
  Synthetic oligonucleotide
tacgcctttgcctggacatgtcctcttcactttaca

SEQ ID NO: 29423 - DNA, 36 bp, Artificial Sequence
  Synthetic oligonucleotide
gcacgaagacgcacgtaccacggtttcacaattcca

SEQ ID NO: 29424 - DNA, 36 bp, Artificial Sequence
  Synthetic oligonucleotide
caccaagcctagcgtctacatgcggggtcatctgca

SEQ ID NO: 29425 - DNA, 38 bp, Artificial Sequence
  Synthetic oligonucleotide
taccgactcctccgaacgtactgctaattagacactga

SEQ ID NO: 29426 - DNA, 36 bp, Artificial Sequence
  Synthetic oligonucleotide
gggactggtcgccagcctctgtcactctactacgta

SEQ ID NO: 29427 - DNA, 35 bp, Artificial Sequence
  Synthetic oligonucleotide
aggacatggccacctgagtcctgtattcatccccc

SEQ ID NO: 29428 - DNA, 35 bp, Artificial Sequence
  Synthetic oligonucleotide
atcccccgaagtgcaccctagatccccgtatattg

SEQ ID NO: 29429 - DNA, 35 bp, Artificial Sequence
  Synthetic oligonucleotide
tcaaggaacttcagcgcagccattcgctcatccat

SEQ ID NO: 29430 - DNA, 35 bp, Artificial Sequence
  Synthetic oligonucleotide
acgacgcccttgccgtcctccttacactctaatat

SEQ ID NO: 29431 - DNA, 35 bp, Artificial Sequence
  Synthetic oligonucleotide
tgcacgccacccctccccactacgaatgcagcact

SEQ ID NO: 29432 - DNA, 35 bp, Artificial Sequence
  Synthetic oligonucleotide
gatacgcctgtcgcccgtccgcctgcagcactgct

SEQ ID NO: 29433 - DNA, 35 bp, Artificial Sequence
  Synthetic oligonucleotide
gcctacatgccggggtgatcgctcgttgtacactt

SEQ ID NO: 29434 - DNA, 34 bp, Artificial Sequence
  Synthetic oligonucleotide
gacaacggtgcccgttaacccccgaccttaggaa

SEQ ID NO: 29435 - DNA, 35 bp, Artificial Sequence
  Synthetic oligonucleotide
tgcactcccgcactaacttattgttgatcttttca

SEQ ID NO: 29436 - DNA, 37 bp, Artificial Sequence
  Synthetic oligonucleotide
gatcacccgccggtcgctattctacccccgacaacga

SEQ ID NO: 29437 - DNA, 37 bp, Artificial Sequence
  Synthetic oligonucleotide
agaaggacggggatgacatgcggagcttacgggggga

SEQ ID NO: 29438 - DNA, 37 bp, Artificial Sequence
  Synthetic oligonucleotide
gatggagggggttcaaacggggtagggtcttagtgga

SEQ ID NO: 29439 - DNA, 38 bp, Artificial Sequence
  Synthetic oligonucleotide
actcacaccgtccccggtgcgttatctatgacctatga

SEQ ID NO: 29440 - DNA, 37 bp, Artificial Sequence
  Synthetic oligonucleotide
acacatcgcgcatgtcacattgagccccttaccctga

SEQ ID NO: 29441 - DNA, 38 bp, Artificial Sequence
  Synthetic oligonucleotide
aacacactctgccactacctagtagtcaatccggttga

SEQ ID NO: 29442 - DNA, 36 bp, Artificial Sequence
  Synthetic oligonucleotide
gtccgtgaagatgcttcggcccgcattcgctctcta

SEQ ID NO: 29443 - DNA, 36 bp, Artificial Sequence
  Synthetic oligonucleotide
gtggacatggctctatcgtcttttgccttcctcgta

SEQ ID NO: 29444 - DNA, 36 bp, Artificial Sequence
  Synthetic oligonucleotide
tcactcccgtatctgggctcatcaaacaccgcttta

SEQ ID NO: 29445 - DNA, 35 bp, Artificial Sequence
  Synthetic oligonucleotide
acaagccccgctccctccgtgtcgttttgtctcac

SEQ ID NO: 29446 - DNA, 35 bp, Artificial Sequence
  Synthetic oligonucleotide
acgacgagcttaaactctcctatcgaatagcctgc

SEQ ID NO: 29447 - DNA, 35 bp, Artificial Sequence
  Synthetic oligonucleotide
gatgatgcgccttgccgccctattccctatgcatc

SEQ ID NO: 29448 - DNA, 35 bp, Artificial Sequence
  Synthetic oligonucleotide
gaacctgaggagctggctgtagaatacgttttttc

SEQ ID NO: 29449 - DNA, 35 bp, Artificial Sequence
  Synthetic oligonucleotide
accgcccctcccaaccagactttgtaatgttgtcg

SEQ ID NO: 29450 - DNA, 35 bp, Artificial Sequence
  Synthetic oligonucleotide
acaccctgaccggcgagctgaaacgagcttgaaat

SEQ ID NO: 29451 - DNA, 35 bp, Artificial Sequence
  Synthetic oligonucleotide
gtggccgccctgctcatcgcgtggtgactccacat

SEQ ID NO: 29452 - DNA, 35 bp, Artificial Sequence
  Synthetic oligonucleotide
tcccctgcacagacccgatctgcgatgaatcttct

SEQ ID NO: 29453 - DNA, 36 bp, Artificial Sequence
  Synthetic oligonucleotide
atgtcacatcctgttcgatagttcgcaccatctcgt

SEQ ID NO: 29454 - DNA, 37 bp, Artificial Sequence
  Synthetic oligonucleotide
taacacgcgaaaaaaaaggaatgggggataacttcga

SEQ ID NO: 29455 - DNA, 38 bp, Artificial Sequence
  Synthetic oligonucleotide
tcagaggggaggcggtaactgaggcgtagggggagtga

SEQ ID NO: 29456 - DNA, 35 bp, Artificial Sequence
  Synthetic oligonucleotide
tctgtggggcacatgcgatttctgttcctccgtac

SEQ ID NO: 29457 - DNA, 36 bp, Artificial Sequence
  Synthetic oligonucleotide
acgtagtatcgccgccaggaaaccacctgcattgcc

SEQ ID NO: 29458 - DNA, 35 bp, Artificial Sequence
  Synthetic oligonucleotide
actgaggcgacgtacattttcctgcgttctctatc

SEQ ID NO: 29459 - DNA, 35 bp, Artificial Sequence
  Synthetic oligonucleotide
acaagggaggtaaggagtgggaaaggtgcggcccg

SEQ ID NO: 29460 - DNA, 35 bp, Artificial Sequence
  Synthetic oligonucleotide
tgcttactccgcagttgcccttaattcccgacgcg

SEQ ID NO: 29461 - DNA, 35 bp, Artificial Sequence
  Synthetic oligonucleotide
accccctgacacctgatgggagaaaaggtctccat

SEQ ID NO: 29462 - DNA, 35 bp, Artificial Sequence
  Synthetic oligonucleotide
acctgcgagcttcgttaacatccacgtccttacct

SEQ ID NO: 29463 - DNA, 35 bp, Artificial Sequence
  Synthetic oligonucleotide
atctggcctcagtcccaataacatctcatcgctct

SEQ ID NO: 29464 - DNA, 35 bp, Artificial Sequence
  Synthetic oligonucleotide
tccatcctgtattgtgttgtcttccgaacttgggt

SEQ ID NO: 29465 - DNA, 35 bp, Artificial Sequence
  Synthetic oligonucleotide
atcccccagtcgactgcttccttggcacaccgatt

SEQ ID NO: 29466 - DNA, 35 bp, Artificial Sequence
  Synthetic oligonucleotide
tgataaccgacgctggtgccctctccagtttgatt

SEQ ID NO: 29467 - DNA, 36 bp, Artificial Sequence
  Synthetic oligonucleotide
gcgcccccgcgcggctccgactcggtccctccataa

SEQ ID NO: 29468 - DNA, 37 bp, Artificial Sequence
  Synthetic oligonucleotide
atcggggagaaagagaggggtgtgaaggttccgaaga

SEQ ID NO: 29469 - DNA, 37 bp, Artificial Sequence
  Synthetic oligonucleotide
tgactgaaaaggggggaggggaatggaggcactacga

SEQ ID NO: 29470 - DNA, 36 bp, Artificial Sequence
  Synthetic oligonucleotide
aaggacacctcaatatcatgcccctgctccgcccga

SEQ ID NO: 29471 - DNA, 37 bp, Artificial Sequence
  Synthetic oligonucleotide
ttcccttgtcagactcacactgttccacccgtctcga

SEQ ID NO: 29472 - DNA, 37 bp, Artificial Sequence
  Synthetic oligonucleotide
gagcaggttgggaggacgggtgagggtttgcggggga

SEQ ID NO: 29473 - DNA, 37 bp, Artificial Sequence
  Synthetic oligonucleotide
gtgggcctgtacacgagagggagggaggatgacatga

SEQ ID NO: 29474 - DNA, 37 bp, Artificial Sequence
  Synthetic oligonucleotide
ttcaccccccttcgttctacgccgacctgccatatga

SEQ ID NO: 29475 - DNA, 38 bp, Artificial Sequence
  Synthetic oligonucleotide
gtggatcaggagggcaaaatagggggaagaggttgtga

SEQ ID NO: 29476 - DNA, 38 bp, Artificial Sequence
  Synthetic oligonucleotide
taacgaagcgtaatctatccttctgtgccactcattga

SEQ ID NO: 29477 - DNA, 38 bp, Artificial Sequence
  Synthetic oligonucleotide
tgcggagtaactgcctatcacgtacatctttcccttga

SEQ ID NO: 29478 - DNA, 38 bp, Artificial Sequence
  Synthetic oligonucleotide
gccccatggtctggtttctttctacgttgttctgttga

SEQ ID NO: 29479 - DNA, 35 bp, Artificial Sequence
  Synthetic oligonucleotide
agcccagaccccccacgggttgtttcctgccaccc

SEQ ID NO: 29480 - DNA, 35 bp, Artificial Sequence
  Synthetic oligonucleotide
tcccgttggtcgttccctttcgcctggatgtaccc

SEQ ID NO: 29481 - DNA, 35 bp, Artificial Sequence
  Synthetic oligonucleotide
acatcccgatcctttagtgcctcactgctggcgcc

SEQ ID NO: 29482 - DNA, 35 bp, Artificial Sequence
  Synthetic oligonucleotide
tgcatttggcctccatgcatttacactattacctc

SEQ ID NO: 29483 - DNA, 35 bp, Artificial Sequence
  Synthetic oligonucleotide
gccacctttgtttttgagtctccctgccctacttc

SEQ ID NO: 29484 - DNA, 35 bp, Artificial Sequence
  Synthetic oligonucleotide
gagcgcaacgcgttagtccttccttctgtatccgt

SEQ ID NO: 29485 - DNA, 35 bp, Artificial Sequence
  Synthetic oligonucleotide
ttcagccgcctcttttcggcccctacaccgttttt

SEQ ID NO: 29486 - DNA, 36 bp, Artificial Sequence
  Synthetic oligonucleotide
accccgagcccaatatgactaccggagaactacaca

SEQ ID NO: 29487 - DNA, 36 bp, Artificial Sequence
  Synthetic oligonucleotide
gaacccacgcacttcgccggctcacatcacacacca

SEQ ID NO: 29488 - DNA, 37 bp, Artificial Sequence
  Synthetic oligonucleotide
atttgcccacccctcgaccgaatggtttcattgagga

SEQ ID NO: 29489 - DNA, 37 bp, Artificial Sequence
  Synthetic oligonucleotide
ggttccgccgccactctataacctcagtcaaccctga

SEQ ID NO: 29490 - DNA, 38 bp, Artificial Sequence
  Synthetic oligonucleotide
ttcggatcgaccatctgcctacccatacgcccctgtga

SEQ ID NO: 29491 - DNA, 38 bp, Artificial Sequence
  Synthetic oligonucleotide
aattcccatctccgtgttgcaacatcccgttctgttga

SEQ ID NO: 29492 - DNA, 35 bp, Artificial Sequence
  Synthetic oligonucleotide
tagattacgcctgaccgcatagtgcaccagcacac

SEQ ID NO: 29493 - DNA, 35 bp, Artificial Sequence
  Synthetic oligonucleotide
gtgccgtcttccgtttcatcatctcaacactttcc

SEQ ID NO: 29494 - DNA, 35 bp, Artificial Sequence
  Synthetic oligonucleotide
gccgcggaacatctccgcaacgatgctcaccgctc

SEQ ID NO: 29495 - DNA, 35 bp, Artificial Sequence
  Synthetic oligonucleotide
atactcaaccctgccacactcatgtatgtctagtc

SEQ ID NO: 29496 - DNA, 35 bp, Artificial Sequence
  Synthetic oligonucleotide
ttagggcgcgctatctgccagacaaccttctcttc

SEQ ID NO: 29497 - DNA, 35 bp, Artificial Sequence
  Synthetic oligonucleotide
atcgtcacgaggggcaggttacgggtggggggatg

SEQ ID NO: 29498 - DNA, 35 bp, Artificial Sequence
  Synthetic oligonucleotide
tgacatgtagaggttggtttcgtcttgtgcacctg

SEQ ID NO: 29499 - DNA, 36 bp, Artificial Sequence
  Synthetic oligonucleotide
gacggaaacatgggtagtactcagggattggcggaa

SEQ ID NO: 29500 - DNA, 36 bp, Artificial Sequence
  Synthetic oligonucleotide
gcaatgaccagtgttctgtttcggtttgccttctca

SEQ ID NO: 29501 - DNA, 36 bp, Artificial Sequence
  Synthetic oligonucleotide
gatagcaatggggcatgggttgggggggagagacga

SEQ ID NO: 29502 - DNA, 37 bp, Artificial Sequence
  Synthetic oligonucleotide
ggatcgggccaccgaaatagtttttacctcccctgga

SEQ ID NO: 29503 - DNA, 37 bp, Artificial Sequence
  Synthetic oligonucleotide
aatgccgtggtggggggtgaaggtggggccctaatga

SEQ ID NO: 29504 - DNA, 35 bp, Artificial Sequence
  Synthetic oligonucleotide
gagtttgaccgctcgttttcttatacaccatgccc

SEQ ID NO: 29505 - DNA, 35 bp, Artificial Sequence
  Synthetic oligonucleotide
aacggtcgcgctaccaatagtgattttcgttctcc

SEQ ID NO: 29506 - DNA, 35 bp, Artificial Sequence
  Synthetic oligonucleotide
atggccggctcggctttgccacccagcaactcttc

SEQ ID NO: 29507 - DNA, 35 bp, Artificial Sequence
  Synthetic oligonucleotide
tactgatgccacacttatagtaccacccaattagg

SEQ ID NO: 29508 - DNA, 35 bp, Artificial Sequence
  Synthetic oligonucleotide
ttatgcccgccctttccgtccatgtcaggcgatct

SEQ ID NO: 29509 - DNA, 35 bp, Artificial Sequence
  Synthetic oligonucleotide
tcacacggagaccctggcatgcaacctaccacctt

SEQ ID NO: 29510 - DNA, 35 bp, Artificial Sequence
  Synthetic oligonucleotide
accccctctactgtatcgctcacgcttaccggaca

SEQ ID NO: 29511 - DNA, 36 bp, Artificial Sequence
  Synthetic oligonucleotide
acacccacccctccgtatgggagaccgtccagacca

SEQ ID NO: 29512 - DNA, 35 bp, Artificial Sequence
  Synthetic oligonucleotide
tactgcgcaagtcgtaggcctctttttaccttcca

SEQ ID NO: 29513 - DNA, 37 bp, Artificial Sequence
  Synthetic oligonucleotide
gtggctgcctccatccgcaatattttgatcaacacga

SEQ ID NO: 29514 - DNA, 37 bp, Artificial Sequence
  Synthetic oligonucleotide
atgcaaatagggagagggtggggtacacattggggga

SEQ ID NO: 29515 - DNA, 38 bp, Artificial Sequence
  Synthetic oligonucleotide
aagcctccggtcgcatgacatccacctacaacccctga

SEQ ID NO: 29516 - DNA, 38 bp, Artificial Sequence
  Synthetic oligonucleotide
tgacgatcgggcggagggcgggcttgaaacttggctga

SEQ ID NO: 29517 - DNA, 37 bp, Artificial Sequence
  Synthetic oligonucleotide
cccaccactgcctccgcctagtccaccatggccttga

SEQ ID NO: 29518 - DNA, 38 bp, Artificial Sequence
  Synthetic oligonucleotide
ccgtgggggtaatgggaggggtgggacgcacgatttga

SEQ ID NO: 29519 - DNA, 35 bp, Artificial Sequence
  Synthetic oligonucleotide
ttcacacatgtggtttacagatctgctccacccta

SEQ ID NO: 29520 - DNA, 35 bp, Artificial Sequence
  Synthetic oligonucleotide
tgccaacttacacgcccggcgaatcggtcatcacc

SEQ ID NO: 29521 - DNA, 35 bp, Artificial Sequence
  Synthetic oligonucleotide
attcagcaggcaagtccgtaccacccgtctatacc

SEQ ID NO: 29522 - DNA, 35 bp, Artificial Sequence
  Synthetic oligonucleotide
tctgccaggcggttaggaatccggcaccatctccc

SEQ ID NO: 29523 - DNA, 35 bp, Artificial Sequence
  Synthetic oligonucleotide
acagatgcctattgctgctgcctgatctcttccgc

SEQ ID NO: 29524 - DNA, 35 bp, Artificial Sequence
  Synthetic oligonucleotide
atcgagccgggtaactagcaagcccccgttccatc

SEQ ID NO: 29525 - DNA, 35 bp, Artificial Sequence
  Synthetic oligonucleotide
accacggacgggacaagcctcgcgcttcgccgctc

SEQ ID NO: 29526 - DNA, 35 bp, Artificial Sequence
  Synthetic oligonucleotide
acgagaccgtacgttgagcactcttgtagcctttc

SEQ ID NO: 29527 - DNA, 35 bp, Artificial Sequence
  Synthetic oligonucleotide
ttgaatggtggacgtagggcaaggggggttcggag

SEQ ID NO: 29528 - DNA, 35 bp, Artificial Sequence
  Synthetic oligonucleotide
acgtggggaactgttaagtgtagggagggagggat

SEQ ID NO: 29529 - DNA, 35 bp, Artificial Sequence
  Synthetic oligonucleotide
gtcattctcgcctgctaccgacatcatcactggat

SEQ ID NO: 29530 - DNA, 35 bp, Artificial Sequence
  Synthetic oligonucleotide
gaagccagcctcaaccgcggtcccggttcatctat

SEQ ID NO: 29531 - DNA, 35 bp, Artificial Sequence
  Synthetic oligonucleotide
ggtccggccacatctaaacacggaaacactgctct

SEQ ID NO: 29532 - DNA, 35 bp, Artificial Sequence
  Synthetic oligonucleotide
tccccaatccgaggctattttacgctgtgccgttt

SEQ ID NO: 29533 - DNA, 35 bp, Artificial Sequence
  Synthetic oligonucleotide
gtcgacttgcccccggtcaccccgttcacgccgaa

SEQ ID NO: 29534 - DNA, 36 bp, Artificial Sequence
  Synthetic oligonucleotide
aatctcgccaccccgtctatctttcgcgtagcctaa

SEQ ID NO: 29535 - DNA, 36 bp, Artificial Sequence
  Synthetic oligonucleotide
tcagacgtgaacacacgttcccctcgccgcccacca

SEQ ID NO: 29536 - DNA, 35 bp, Artificial Sequence
  Synthetic oligonucleotide
gtgtcccccgaaaacgccgccggcctatcatccca

SEQ ID NO: 29537 - DNA, 36 bp, Artificial Sequence
  Synthetic oligonucleotide
gacgcacgcctcaggtaagttcttttctatctgtca

SEQ ID NO: 29538 - DNA, 36 bp, Artificial Sequence
  Synthetic oligonucleotide
gtgtcgcccaatgtccttaccgattcacacttacga

SEQ ID NO: 29539 - DNA, 37 bp, Artificial Sequence
  Synthetic oligonucleotide
agacagaggacggggtaaattgttgagtgggcggcga

SEQ ID NO: 29540 - DNA, 35 bp, Artificial Sequence
  Synthetic oligonucleotide
gcacttggccccatccgtatgtaggcttccttcga

SEQ ID NO: 29541 - DNA, 35 bp, Artificial Sequence
  Synthetic oligonucleotide
gcaaatcgaggaagagtaggtaaaggatgtgggga

SEQ ID NO: 29542 - DNA, 37 bp, Artificial Sequence
  Synthetic oligonucleotide
agtccgcccgcagattcacaatatgctcctcctctga

SEQ ID NO: 29543 - DNA, 37 bp, Artificial Sequence
  Synthetic oligonucleotide
gaccactgagactccgaagacccatccagtccattga

SEQ ID NO: 29544 - DNA, 38 bp, Artificial Sequence
  Synthetic oligonucleotide
gtcatcctgcgcccaaagccatcctacctatacgttga

SEQ ID NO: 29545 - DNA, 36 bp, Artificial Sequence
  Synthetic oligonucleotide
gacgatgctgccgtcaacccggagtccctgctatta

SEQ ID NO: 29546 - DNA, 35 bp, Artificial Sequence
  Synthetic oligonucleotide
acacgagctattccgtacctggttccgttccgtta

SEQ ID NO: 29547 - DNA, 35 bp, Artificial Sequence
  Synthetic oligonucleotide
gcccaaccgatccaaggtcgaagtacccagaacac

SEQ ID NO: 29548 - DNA, 35 bp, Artificial Sequence
  Synthetic oligonucleotide
ggagtggaggagaggttaggtggtagaggtgtagg

SEQ ID NO: 29549 - DNA, 35 bp, Artificial Sequence
  Synthetic oligonucleotide
accccacccctcatttccgacatcgctgaagcggg

SEQ ID NO: 29550 - DNA, 35 bp, Artificial Sequence
  Synthetic oligonucleotide
taacacgtccaccccgacccagctctcatctatgg

SEQ ID NO: 29551 - DNA, 35 bp, Artificial Sequence
  Synthetic oligonucleotide
tgatctccctcccgtccaatctctaggctgacgaa

SEQ ID NO: 29552 - DNA, 36 bp, Artificial Sequence
  Synthetic oligonucleotide
tccacccccgcctgccacatctccggcttcccctaa

SEQ ID NO: 29553 - DNA, 34 bp, Artificial Sequence
  Synthetic oligonucleotide
tgtctcacctcggtcgcagcctattccacgcaca

SEQ ID NO: 29554 - DNA, 35 bp, Artificial Sequence
  Synthetic oligonucleotide
atggccggagcggtatcggcctactttctcattca

SEQ ID NO: 29555 - DNA, 36 bp, Artificial Sequence
  Synthetic oligonucleotide
gcaatcctcgccgtgcagccctacaattccacgaga

SEQ ID NO: 29556 - DNA, 37 bp, Artificial Sequence
  Synthetic oligonucleotide
tacgagacgcgacagtcctcggccgccctttccccga

SEQ ID NO: 29557 - DNA, 37 bp, Artificial Sequence
  Synthetic oligonucleotide
tcagtgtcccccgttgaccacaagctgcgcacctcga

SEQ ID NO: 29558 - DNA, 37 bp, Artificial Sequence
  Synthetic oligonucleotide
tgatcacgctccacacttgaaaacacgcaaaccagga

SEQ ID NO: 29559 - DNA, 38 bp, Artificial Sequence
  Synthetic oligonucleotide
tgtctctcccaccacctcacgcagacaccattgattga

SEQ ID NO: 29560 - DNA, 37 bp, Artificial Sequence
  Synthetic oligonucleotide
tacccacacctctcaggcggtacccgattttccttga

SEQ ID NO: 29561 - DNA, 36 bp, Artificial Sequence
  Synthetic oligonucleotide
atccattgcccactattatgcaagagcctcctcgta

SEQ ID NO: 29562 - DNA, 36 bp, Artificial Sequence
  Synthetic oligonucleotide
ttgctaggacggtgtctactctgccccacatttgta

SEQ ID NO: 29563 - DNA, 35 bp, Artificial Sequence
  Synthetic oligonucleotide
atgtgctgttcctgtccttgttcaacggtttctgc

SEQ ID NO: 29564 - DNA, 35 bp, Artificial Sequence
  Synthetic oligonucleotide
ttctgccgacgtttcatctcttgtccgtgtgcttc

SEQ ID NO: 29565 - DNA, 35 bp, Artificial Sequence
  Synthetic oligonucleotide
tccaatgccccagcctatacatcaagcttagtttc

SEQ ID NO: 29566 - DNA, 35 bp, Artificial Sequence
  Synthetic oligonucleotide
taacgcacccccgctgtagcacgaaagttttctcg

SEQ ID NO: 29567 - DNA, 35 bp, Artificial Sequence
  Synthetic oligonucleotide
tgcatccccaacacccccctcggtacttcagctct

SEQ ID NO: 29568 - DNA, 35 bp, Artificial Sequence
  Synthetic oligonucleotide
aaccatccctgggggctttcacagtgacgatcctt

SEQ ID NO: 29569 - DNA, 35 bp, Artificial Sequence
  Synthetic oligonucleotide
agcaatccgcccgcacctaccgcaccgctttagtt

SEQ ID NO: 29570 - DNA, 36 bp, Artificial Sequence
  Synthetic oligonucleotide
ggacaccttcgcgctttgacttctgatccgcccaaa

SEQ ID NO: 29571 - DNA, 36 bp, Artificial Sequence
  Synthetic oligonucleotide
gatggtaaaaacgcgtgagggaagggtagtgaagaa

SEQ ID NO: 29572 - DNA, 36 bp, Artificial Sequence
  Synthetic oligonucleotide
tctggcgcccttcacacccgattttaacgttcgcca

SEQ ID NO: 29573 - DNA, 37 bp, Artificial Sequence
  Synthetic oligonucleotide
gggaggggttgagggggttggtaggcgacagagagga

SEQ ID NO: 29574 - DNA, 38 bp, Artificial Sequence
  Synthetic oligonucleotide
atggtcggacgcagtggggaaatgggggttttaaatga

SEQ ID NO: 29575 - DNA, 35 bp, Artificial Sequence
  Synthetic oligonucleotide
gaccccccggcctccatgaattgcttttcctctga

SEQ ID NO: 29576 - DNA, 35 bp, Artificial Sequence
  Synthetic oligonucleotide
tgaaggccgccttgacttcttcttagttacccgta

SEQ ID NO: 29577 - DNA, 35 bp, Artificial Sequence
  Synthetic oligonucleotide
tcagtgccacgtcatttgcctgttgtccttattta

SEQ ID NO: 29578 - DNA, 35 bp, Artificial Sequence
  Synthetic oligonucleotide
gtttaagtgcacgccgccaccccacactgccctac

SEQ ID NO: 29579 - DNA, 35 bp, Artificial Sequence
  Synthetic oligonucleotide
actcctgcggatcttgactatcccacgcagaaacc

SEQ ID NO: 29580 - DNA, 35 bp, Artificial Sequence
  Synthetic oligonucleotide
atgatgggctggtgcttcatcatatagttttaacc

SEQ ID NO: 29581 - DNA, 35 bp, Artificial Sequence
  Synthetic oligonucleotide
tccacgccacctggtagttctcgggggatctctgc

SEQ ID NO: 29582 - DNA, 35 bp, Artificial Sequence
  Synthetic oligonucleotide
tagcacgtctgcctggcttaatttttacgtcattc

SEQ ID NO: 29583 - DNA, 35 bp, Artificial Sequence
  Synthetic oligonucleotide
cctcacctccgttcacgttgtctcccgttaggcct

SEQ ID NO: 29584 - DNA, 35 bp, Artificial Sequence
  Synthetic oligonucleotide
atgccacccgggtcgtgtccatgaaaccattccgt

SEQ ID NO: 29585 - DNA, 35 bp, Artificial Sequence
  Synthetic oligonucleotide
gtgcctcccacaatcagtagccattgcattgcttt

SEQ ID NO: 29586 - DNA, 35 bp, Artificial Sequence
  Synthetic oligonucleotide
gcgagccgctgcaaacttgctactcctcgtaccaa

SEQ ID NO: 29587 - DNA, 36 bp, Artificial Sequence
  Synthetic oligonucleotide
aaagccaggccttgaggggtgggaatgatggatgaa

SEQ ID NO: 29588 - DNA, 37 bp, Artificial Sequence
  Synthetic oligonucleotide
ttcatgcgctacccttgtccatacctgccactcaaga

SEQ ID NO: 29589 - DNA, 37 bp, Artificial Sequence
  Synthetic oligonucleotide
gatgaggaggcctagaggcaagtgagaggttgaggga

SEQ ID NO: 29590 - DNA, 37 bp, Artificial Sequence
  Synthetic oligonucleotide
gtgcgtgccgcaactaaattgcctttcccgccctgga

SEQ ID NO: 29591 - DNA, 37 bp, Artificial Sequence
  Synthetic oligonucleotide
aaccgagcaaacgaggaataggggataacttgttgga

SEQ ID NO: 29592 - DNA, 38 bp, Artificial Sequence
  Synthetic oligonucleotide
atcgactggcgtgtttcggcctctaatcccatctctga

SEQ ID NO: 29593 - DNA, 38 bp, Artificial Sequence
  Synthetic oligonucleotide
acagtgccaatgcatccaaccccgcctaatttcggtga

SEQ ID NO: 29594 - DNA, 37 bp, Artificial Sequence
  Synthetic oligonucleotide
gctcaaccggtctcttgcttgaagactccccccttga

SEQ ID NO: 29595 - DNA, 36 bp, Artificial Sequence
  Synthetic oligonucleotide
gcactcttcatgcgaaagctcgacttcccttctata

SEQ ID NO: 29596 - DNA, 36 bp, Artificial Sequence
  Synthetic oligonucleotide
gaaccgtgggtgtcacctctacgaagctttctctta

SEQ ID NO: 29597 - DNA, 35 bp, Artificial Sequence
  Synthetic oligonucleotide
tggacgtcggtcgtcaccatcagtcccttcatcgc

SEQ ID NO: 29598 - DNA, 35 bp, Artificial Sequence
  Synthetic oligonucleotide
tcaccaatcacgcgtagctgcatattttcacaatc

SEQ ID NO: 29599 - DNA, 35 bp, Artificial Sequence
  Synthetic oligonucleotide
attccgccaccaatttagttcgtatgcattggttc

SEQ ID NO: 29600 - DNA, 35 bp, Artificial Sequence
  Synthetic oligonucleotide
gacgccgatctatattccgtatcatattacctccg

SEQ ID NO: 29601 - DNA, 35 bp, Artificial Sequence
  Synthetic oligonucleotide
attatcccagcgctccctcctgatctgtagcccgg

SEQ ID NO: 29602 - DNA, 35 bp, Artificial Sequence
  Synthetic oligonucleotide
agacagacccagcccgtatgtattttccgtactgt

SEQ ID NO: 29603 - DNA, 35 bp, Artificial Sequence
  Synthetic oligonucleotide
accaaccgaattcgggctaaagttcacgcaccatt

SEQ ID NO: 29604 - DNA, 35 bp, Artificial Sequence
  Synthetic oligonucleotide
gattgcgacgttgcgcctgctcgattgacccgttt

SEQ ID NO: 29605 - DNA, 35 bp, Artificial Sequence
  Synthetic oligonucleotide
tgccatccccctctcagcacaattagccgtaaaaa

SEQ ID NO: 29606 - DNA, 35 bp, Artificial Sequence
  Synthetic oligonucleotide
gacaaacaggacgggagagggacggactgggtcaa

SEQ ID NO: 29607 - DNA, 36 bp, Artificial Sequence
  Synthetic oligonucleotide
gggacactcgcacacccaatgttcgcttaactggaa

SEQ ID NO: 29608 - DNA, 36 bp, Artificial Sequence
  Synthetic oligonucleotide
gtccgatggccgctcggactgcttacactatctaca

SEQ ID NO: 29609 - DNA, 35 bp, Artificial Sequence
  Synthetic oligonucleotide
tccctactaccgcctcttcagccctgtgacaacca

SEQ ID NO: 29610 - DNA, 37 bp, Artificial Sequence
  Synthetic oligonucleotide
tgccacttgttatcccgttttatgtcacacccctaga

SEQ ID NO: 29611 - DNA, 36 bp, Artificial Sequence
  Synthetic oligonucleotide
tccccatgcctcaattccacctccgtagggacatga

SEQ ID NO: 29612 - DNA, 38 bp, Artificial Sequence
  Synthetic oligonucleotide
gagaaggacggggacaagcggagaaaggaggcgtatga

SEQ ID NO: 29613 - DNA, 38 bp, Artificial Sequence
  Synthetic oligonucleotide
atcgcacacgctattccctcgccttcatgtccttctga

SEQ ID NO: 29614 - DNA, 38 bp, Artificial Sequence
  Synthetic oligonucleotide
acccacgacgcaatccagcaatactagtccgcacttga

SEQ ID NO: 29615 - DNA, 35 bp, Artificial Sequence
  Synthetic oligonucleotide
attaaccgcaccatcataccgacgtatttcccgtc

SEQ ID NO: 29616 - DNA, 36 bp, Artificial Sequence
  Synthetic oligonucleotide
gccaacgccccctgcgtagtgccatcaccacgagag

SEQ ID NO: 29617 - DNA, 35 bp, Artificial Sequence
  Synthetic oligonucleotide
gtgtgtcgctggtttacgctcatctatccacttcg

SEQ ID NO: 29618 - DNA, 35 bp, Artificial Sequence
  Synthetic oligonucleotide
ttcgctcagcaaccttttcacacgaccaacctcgg

SEQ ID NO: 29619 - DNA, 35 bp, Artificial Sequence
  Synthetic oligonucleotide
aacgcctgcccatcgataatcgcggcgcctcacct

SEQ ID NO: 29620 - DNA, 35 bp, Artificial Sequence
  Synthetic oligonucleotide
tgccaccgaacggaccatcaactagcagtgtacct

SEQ ID NO: 29621 - DNA, 35 bp, Artificial Sequence
  Synthetic oligonucleotide
tacgccaacataccatcccggtaaactctagccct

SEQ ID NO: 29622 - DNA, 35 bp, Artificial Sequence
  Synthetic oligonucleotide
gtcccgccgtaggtccattgatcggtaatctctct

SEQ ID NO: 29623 - DNA, 35 bp, Artificial Sequence
  Synthetic oligonucleotide
gaactcactatccgatcgcaccaattccttggctt

SEQ ID NO: 29624 - DNA, 36 bp, Artificial Sequence
  Synthetic oligonucleotide
tccgtccacgtccacatcgtcgcaccatctgtgaaa

SEQ ID NO: 29625 - DNA, 35 bp, Artificial Sequence
  Synthetic oligonucleotide
attcgccgagccctcttcccttcgtgcttccgcaa

SEQ ID NO: 29626 - DNA, 36 bp, Artificial Sequence
  Synthetic oligonucleotide
taccctccgtccaccatcccaaccttgaccggtcaa

SEQ ID NO: 29627 - DNA, 36 bp, Artificial Sequence
  Synthetic oligonucleotide
gacaccccaacccttgagaaagtgtggaaacacaca

SEQ ID NO: 29628 - DNA, 36 bp, Artificial Sequence
  Synthetic oligonucleotide
ttgccccagagtccgttcctgctttagtcacgtgca

SEQ ID NO: 29629 - DNA, 37 bp, Artificial Sequence
  Synthetic oligonucleotide
tagtacggggtattggagggggggaggaaataagaga

SEQ ID NO: 29630 - DNA, 37 bp, Artificial Sequence
  Synthetic oligonucleotide
gtgtgctgcagactactttattgggaacccgcaacga

SEQ ID NO: 29631 - DNA, 37 bp, Artificial Sequence
  Synthetic oligonucleotide
agactccgccccagtattccacgctttccgtagcgga

SEQ ID NO: 29632 - DNA, 37 bp, Artificial Sequence
  Synthetic oligonucleotide
ggtgtgagggaagacgaaagggatgggccggggtgga

SEQ ID NO: 29633 - DNA, 36 bp, Artificial Sequence
  Synthetic oligonucleotide
ggacccgacctcgattccggttgagcccatccatga

SEQ ID NO: 29634 - DNA, 38 bp, Artificial Sequence
  Synthetic oligonucleotide
gacacgacgtagagggggtgtgtgtgtggtcgagctga

SEQ ID NO: 29635 - DNA, 38 bp, Artificial Sequence
  Synthetic oligonucleotide
aacaagtgcatgtgggcacgaaagggtggtgagggtga

SEQ ID NO: 29636 - DNA, 38 bp, Artificial Sequence
  Synthetic oligonucleotide
tcgattatcccattgtttcactgctacagtacccttga

SEQ ID NO: 29637 - DNA, 37 bp, Artificial Sequence
  Synthetic oligonucleotide
tcagggtagaggggatgatagcgggtgggggtcttga

SEQ ID NO: 29638 - DNA, 38 bp, Artificial Sequence
  Synthetic oligonucleotide
gtgtctgtgaagggaaaacgggtagggcgggttgttga

SEQ ID NO: 29639 - DNA, 38 bp, Artificial Sequence
  Synthetic oligonucleotide
gtgaccgcgatgctatatcttgtacaccttgcttttga

SEQ ID NO: 29640 - DNA, 35 bp, Artificial Sequence
  Synthetic oligonucleotide
tcaccgcctaaaaggccagctacgcgacctcccta

SEQ ID NO: 29641 - DNA, 35 bp, Artificial Sequence
  Synthetic oligonucleotide
tacccgtcaacgcaacacctctttgttctgtatgc

SEQ ID NO: 29642 - DNA, 35 bp, Artificial Sequence
  Synthetic oligonucleotide
gtgcccagtccctgtgcctgcgctataacctgctc

SEQ ID NO: 29643 - DNA, 35 bp, Artificial Sequence
  Synthetic oligonucleotide
tttgcgcgtagcggaacccttcctgtcttactctc

SEQ ID NO: 29644 - DNA, 35 bp, Artificial Sequence
  Synthetic oligonucleotide
tgccaccttgggtaggcgtacgcaacctctctctc

SEQ ID NO: 29645 - DNA, 35 bp, Artificial Sequence
  Synthetic oligonucleotide
gtggggcgggagaggtgggaggactactgattgtc

SEQ ID NO: 29646 - DNA, 35 bp, Artificial Sequence
  Synthetic oligonucleotide
gtgaaacctaacatgaactcaactgagacgttgtc

SEQ ID NO: 29647 - DNA, 35 bp, Artificial Sequence
  Synthetic oligonucleotide
tcgactcccaagtggtttaggtttgcccctcccat

SEQ ID NO: 29648 - DNA, 35 bp, Artificial Sequence
  Synthetic oligonucleotide
tttgcagagggttgaacgggggaataatgaatggt

SEQ ID NO: 29649 - DNA, 35 bp, Artificial Sequence
  Synthetic oligonucleotide
tgtccccatggtgaatttcgatttgctgctttttt

SEQ ID NO: 29650 - DNA, 36 bp, Artificial Sequence
  Synthetic oligonucleotide
acaccaccaagcctctaagcacctgtattggcgcca

SEQ ID NO: 29651 - DNA, 36 bp, Artificial Sequence
  Synthetic oligonucleotide
aaagacaccaatcccgaatgcgatcactgcctgtca

SEQ ID NO: 29652 - DNA, 37 bp, Artificial Sequence
  Synthetic oligonucleotide
tgagcgggtgcggggggtggggtggatcatgtgtaga

SEQ ID NO: 29653 - DNA, 37 bp, Artificial Sequence
  Synthetic oligonucleotide
tagccggtacacatcctacatatagctatcagtccga

SEQ ID NO: 29654 - DNA, 37 bp, Artificial Sequence
  Synthetic oligonucleotide
agcacactcgctcactcaccgccgtaaacggactcga

SEQ ID NO: 29655 - DNA, 36 bp, Artificial Sequence
  Synthetic oligonucleotide
taacccgctcccgtgtccctcttttgcgtccaccta

SEQ ID NO: 29656 - DNA, 36 bp, Artificial Sequence
  Synthetic oligonucleotide
tcacgtccctctagccgatcaccgccccatcagcta

SEQ ID NO: 29657 - DNA, 36 bp, Artificial Sequence
  Synthetic oligonucleotide
actgcccctggtgatgcgcccaccactttgcatgta

SEQ ID NO: 29658 - DNA, 35 bp, Artificial Sequence
  Synthetic oligonucleotide
agctcatcccgcacactccgacgcgtccaccgtta

SEQ ID NO: 29659 - DNA, 36 bp, Artificial Sequence
  Synthetic oligonucleotide
atggtcgccggtaagggcgggtgggggagaggttta

SEQ ID NO: 29660 - DNA, 35 bp, Artificial Sequence
  Synthetic oligonucleotide
tcgtccagacatcctcgtactcggttctccccagc

SEQ ID NO: 29661 - DNA, 35 bp, Artificial Sequence
  Synthetic oligonucleotide
ctaatcacgctatccatcctggcaccggggaactc

SEQ ID NO: 29662 - DNA, 35 bp, Artificial Sequence
  Synthetic oligonucleotide
attcgcggggggaggggtgacgagaacaaacacag

SEQ ID NO: 29663 - DNA, 35 bp, Artificial Sequence
  Synthetic oligonucleotide
aaccaccgtaacttgttcgttctcggggccatact

SEQ ID NO: 29664 - DNA, 34 bp, Artificial Sequence
  Synthetic oligonucleotide
acacgagtcactcgggctgacatccacctcacct

SEQ ID NO: 29665 - DNA, 35 bp, Artificial Sequence
  Synthetic oligonucleotide
atgaacgtgaggggagcaaatatcgcgaagggtgt

SEQ ID NO: 29666 - DNA, 35 bp, Artificial Sequence
  Synthetic oligonucleotide
ctcatgacgttactccttaggctttctctcattgt

SEQ ID NO: 29667 - DNA, 35 bp, Artificial Sequence
  Synthetic oligonucleotide
atccacagagacgtcctttcgccggcctttacaca

SEQ ID NO: 29668 - DNA, 36 bp, Artificial Sequence
  Synthetic oligonucleotide
ttccgaccgcaccactaaagtaatcttgccttgaca

SEQ ID NO: 29669 - DNA, 37 bp, Artificial Sequence
  Synthetic oligonucleotide
gctcacggaggggcctaagggtgtaggggatgggaga

SEQ ID NO: 29670 - DNA, 38 bp, Artificial Sequence
  Synthetic oligonucleotide
atcaccgcctgacaataattcctgccttcatcatatga

SEQ ID NO: 29671 - DNA, 38 bp, Artificial Sequence
  Synthetic oligonucleotide
acccatccattaatggtgccttttgacttcccgcttga

SEQ ID NO: 29672 - DNA, 38 bp, Artificial Sequence
  Synthetic oligonucleotide
atgcgcccctgcgccctgttgccattcgggatctttga

SEQ ID NO: 29673 - DNA, 36 bp, Artificial Sequence
  Synthetic oligonucleotide
acactcgttctatccgcccagccttcgtagtccata

SEQ ID NO: 29674 - DNA, 36 bp, Artificial Sequence
  Synthetic oligonucleotide
agcgaacgtgaactggggtggacgggggaggtcgta

SEQ ID NO: 29675 - DNA, 35 bp, Artificial Sequence
  Synthetic oligonucleotide
accgtgcgatccactggacccatgcgcactttacc

SEQ ID NO: 29676 - DNA, 35 bp, Artificial Sequence
  Synthetic oligonucleotide
tacgtcacgcactgaaaaccacgctgcatacgtcc

SEQ ID NO: 29677 - DNA, 35 bp, Artificial Sequence
  Synthetic oligonucleotide
gcaagggggagaaggggtatacgcgcgaacgttag

SEQ ID NO: 29678 - DNA, 35 bp, Artificial Sequence
  Synthetic oligonucleotide
gacggagtgccccgtccccctgaactttcactgat

SEQ ID NO: 29679 - DNA, 36 bp, Artificial Sequence
  Synthetic oligonucleotide
aagcacgcatgctctctggccacacacttcggtgct

SEQ ID NO: 29680 - DNA, 36 bp, Artificial Sequence
  Synthetic oligonucleotide
ggggaaaacatgggttggagggaagggtggatgaaa

SEQ ID NO: 29681 - DNA, 36 bp, Artificial Sequence
  Synthetic oligonucleotide
gttcatgccgccttgaacgtgatacaatctccaaca

SEQ ID NO: 29682 - DNA, 36 bp, Artificial Sequence
  Synthetic oligonucleotide
aacacctcaggcacttactccgctccattatatgca

SEQ ID NO: 29683 - DNA, 36 bp, Artificial Sequence
  Synthetic oligonucleotide
ttgacgcaccacatcttcgggccatctatctaagga

SEQ ID NO: 29684 - DNA, 35 bp, Artificial Sequence
  Synthetic oligonucleotide
ttcaactcccccgtccctcctgacacgccgctgga

SEQ ID NO: 29685 - DNA, 38 bp, Artificial Sequence
  Synthetic oligonucleotide
tcgatccgccctgctaagagccttacccccctcactga

SEQ ID NO: 29686 - DNA, 37 bp, Artificial Sequence
  Synthetic oligonucleotide
gattcgccctcacccagtttgcacttagcgaccctga

SEQ ID NO: 29687 - DNA, 35 bp, Artificial Sequence
  Synthetic oligonucleotide
aagggccaccccctccccccttgttatcttcctga

SEQ ID NO: 29688 - DNA, 38 bp, Artificial Sequence
  Synthetic oligonucleotide
acgcgaggggaaatttggcgcaaggggggaaacagtga

SEQ ID NO: 29689 - DNA, 38 bp, Artificial Sequence
  Synthetic oligonucleotide
gtgtgcccgctctctttgcgcagaataaccttgcttga

SEQ ID NO: 29690 - DNA, 36 bp, Artificial Sequence
  Synthetic oligonucleotide
tcagggtgggaactagggttgggaagtacgattata

SEQ ID NO: 29691 - DNA, 35 bp, Artificial Sequence
  Synthetic oligonucleotide
gccaaaagacccctccgtggcctagccccacatta

SEQ ID NO: 29692 - DNA, 35 bp, Artificial Sequence
  Synthetic oligonucleotide
gagcccatacacacaggacactccgcggtatccac

SEQ ID NO: 29693 - DNA, 35 bp, Artificial Sequence
  Synthetic oligonucleotide
gcatccggcacacttaccaacaagtcggggacgcc

SEQ ID NO: 29694 - DNA, 35 bp, Artificial Sequence
  Synthetic oligonucleotide
gcaccttagcccgaccttattgccccagtaagtcc

SEQ ID NO: 29695 - DNA, 35 bp, Artificial Sequence
  Synthetic oligonucleotide
agacggcgagcctgttcctgcggccactcttttcc

SEQ ID NO: 29696 - DNA, 35 bp, Artificial Sequence
  Synthetic oligonucleotide
aatggccacgctttctcccactgtcctgtagccat

SEQ ID NO: 29697 - DNA, 35 bp, Artificial Sequence
  Synthetic oligonucleotide
tgctaagcccctgggccctgtggatgcccctccct

SEQ ID NO: 29698 - DNA, 35 bp, Artificial Sequence
  Synthetic oligonucleotide
cccacatgcccttggtaacactcactgcaccccgt

SEQ ID NO: 29699 - DNA, 35 bp, Artificial Sequence
  Synthetic oligonucleotide
gactgtcgccgtcgacttcctaattttagttcctt

SEQ ID NO: 29700 - DNA, 33 bp, Artificial Sequence
  Synthetic oligonucleotide
gaggagggatgaggtttccagggagggcataca

SEQ ID NO: 29701 - DNA, 36 bp, Artificial Sequence
  Synthetic oligonucleotide
accccctgacattcgatgcacaaggtcttaccacca

SEQ ID NO: 29702 - DNA, 37 bp, Artificial Sequence
  Synthetic oligonucleotide
atgtgggcgaggtagggcgggttacgtgatgatagga

SEQ ID NO: 29703 - DNA, 37 bp, Artificial Sequence
  Synthetic oligonucleotide
ggatgggaggaaggtagaccgtggggcagtggtagga

SEQ ID NO: 29704 - DNA, 37 bp, Artificial Sequence
  Synthetic oligonucleotide
gtggatgaacggtaggagattagggttatcaggggga

SEQ ID NO: 29705 - DNA, 38 bp, Artificial Sequence
  Synthetic oligonucleotide
gaaatgtggggggggctaggaggcgggacgggtactga

SEQ ID NO: 29706 - DNA, 35 bp, Artificial Sequence
  Synthetic oligonucleotide
tcgccactcgctacactatccccgcgcatgcccta

SEQ ID NO: 29707 - DNA, 35 bp, Artificial Sequence
  Synthetic oligonucleotide
gcaccacataggttgccgttatttttcgccacgta

SEQ ID NO: 29708 - DNA, 35 bp, Artificial Sequence
  Synthetic oligonucleotide
gccggtccccgtttacggccaattttctcaactac

SEQ ID NO: 29709 - DNA, 35 bp, Artificial Sequence
  Synthetic oligonucleotide
atttcgcccgtccctctcggctctccagccgcacc

SEQ ID NO: 29710 - DNA, 35 bp, Artificial Sequence
  Synthetic oligonucleotide
aagcactgcaaattcgtttctgtctcgttcttccc

SEQ ID NO: 29711 - DNA, 35 bp, Artificial Sequence
  Synthetic oligonucleotide
gtcattccacggtttttcactaagtagctgccgcc

SEQ ID NO: 29712 - DNA, 35 bp, Artificial Sequence
  Synthetic oligonucleotide
gtataccaccgttcgcaggcacatgtttaacgtcc

SEQ ID NO: 29713 - DNA, 35 bp, Artificial Sequence
  Synthetic oligonucleotide
acaacgccaactcgccggaattgactactcgcctc

SEQ ID NO: 29714 - DNA, 35 bp, Artificial Sequence
  Synthetic oligonucleotide
gtcacgagcgcatcgcggcctctatttcccctctg

SEQ ID NO: 29715 - DNA, 35 bp, Artificial Sequence
  Synthetic oligonucleotide
tccacatgcaaacacttatagcggtcccgccccat

SEQ ID NO: 29716 - DNA, 35 bp, Artificial Sequence
  Synthetic oligonucleotide
atgaccaaccacacacaacctgtccactatgcctt

SEQ ID NO: 29717 - DNA, 35 bp, Artificial Sequence
  Synthetic oligonucleotide
agcacacccaactatggttgttcctactattcctt

SEQ ID NO: 29718 - DNA, 35 bp, Artificial Sequence
  Synthetic oligonucleotide
tcccactctgagtatatgttctgcccccaactttt

SEQ ID NO: 29719 - DNA, 35 bp, Artificial Sequence
  Synthetic oligonucleotide
tcgcgaagcagcctcattacattctgtcgcgtttt

SEQ ID NO: 29720 - DNA, 35 bp, Artificial Sequence
  Synthetic oligonucleotide
actacgccctacttgcaatgcaatcacagttccca

SEQ ID NO: 29721 - DNA, 36 bp, Artificial Sequence
  Synthetic oligonucleotide
gtccgccctcccaccccgatctacggcccgcctgca

SEQ ID NO: 29722 - DNA, 36 bp, Artificial Sequence
  Synthetic oligonucleotide
aacaacgcaactataacgtgcctttacccgccatca

SEQ ID NO: 29723 - DNA, 37 bp, Artificial Sequence
  Synthetic oligonucleotide
agccaacgaccaatcgcgtcccaattacttccgcaga

SEQ ID NO: 29724 - DNA, 37 bp, Artificial Sequence
  Synthetic oligonucleotide
atgtcatggatgggagggggagtcgtgaagtggcaga

SEQ ID NO: 29725 - DNA, 36 bp, Artificial Sequence
  Synthetic oligonucleotide
aatgaagcagggagggaggcaacttgggaatctgga

SEQ ID NO: 29726 - DNA, 35 bp, Artificial Sequence
  Synthetic oligonucleotide
gtgacatctctagctgtttcttccctcctgtagta

SEQ ID NO: 29727 - DNA, 35 bp, Artificial Sequence
  Synthetic oligonucleotide
acttagacacagtcgctgacctgaacacaccatac

SEQ ID NO: 29728 - DNA, 35 bp, Artificial Sequence
  Synthetic oligonucleotide
tgcatgaagcccagcgagccccacacctacgctcc

SEQ ID NO: 29729 - DNA, 35 bp, Artificial Sequence
  Synthetic oligonucleotide
gaggaactgcactcatgtttcgtcaatcgctttcc

SEQ ID NO: 29730 - DNA, 35 bp, Artificial Sequence
  Synthetic oligonucleotide
atgacaggcccgcccgcctcgtaccccccaacggc

SEQ ID NO: 29731 - DNA, 35 bp, Artificial Sequence
  Synthetic oligonucleotide
tgcaaaacgtgcatggaggggcgaggggtgggggg

SEQ ID NO: 29732 - DNA, 35 bp, Artificial Sequence
  Synthetic oligonucleotide
agatcgtagcggtgcctatatcgtcttcctcacct

SEQ ID NO: 29733 - DNA, 36 bp, Artificial Sequence
  Synthetic oligonucleotide
aacgacacaccacgtaagtggctatttttgaactaa

SEQ ID NO: 29734 - DNA, 36 bp, Artificial Sequence
  Synthetic oligonucleotide
tccacgataggccacttacccgttgtcacatcacca

SEQ ID NO: 29735 - DNA, 36 bp, Artificial Sequence
  Synthetic oligonucleotide
gtctgtgacaggagagggtggagtgaaccgggaaga

SEQ ID NO: 29736 - DNA, 37 bp, Artificial Sequence
  Synthetic oligonucleotide
tccattcccctagcctagagcgccgcttcattcccga

SEQ ID NO: 29737 - DNA, 38 bp, Artificial Sequence
  Synthetic oligonucleotide
attgcgcctcctgacccttgtatgcgcttctggaatga

SEQ ID NO: 29738 - DNA, 38 bp, Artificial Sequence
  Synthetic oligonucleotide
tttacgcgtgactatactgctgcccggaccctgactga

SEQ ID NO: 29739 - DNA, 38 bp, Artificial Sequence
  Synthetic oligonucleotide
gttccacctcagctacctctaggccttgatccgcctga

SEQ ID NO: 29740 - DNA, 38 bp, Artificial Sequence
  Synthetic oligonucleotide
gagacccccgcacccaccaggcctgtcccataccttga

SEQ ID NO: 29741 - DNA, 37 bp, Artificial Sequence
  Synthetic oligonucleotide
gccatacgatcgggggaggagatgggaaggctgttga

SEQ ID NO: 29742 - DNA, 35 bp, Artificial Sequence
  Synthetic oligonucleotide
gcccactgtcggttgcatttccgtccccattttga

SEQ ID NO: 29743 - DNA, 35 bp, Artificial Sequence
  Synthetic oligonucleotide
ttgcgacgccttatcataccgcctctcctaggaac

SEQ ID NO: 29744 - DNA, 35 bp, Artificial Sequence
  Synthetic oligonucleotide
gacacagtttattgtttcgctcacaccccgcacac

SEQ ID NO: 29745 - DNA, 35 bp, Artificial Sequence
  Synthetic oligonucleotide
gccgatgctccgttgctatcgtacgcctccttgcc

SEQ ID NO: 29746 - DNA, 35 bp, Artificial Sequence
  Synthetic oligonucleotide
gcaaaggggcatggaggacagggttgccagtgagg

SEQ ID NO: 29747 - DNA, 35 bp, Artificial Sequence
  Synthetic oligonucleotide
gcagacctcactaccaccctatctttcacaacatg

SEQ ID NO: 29748 - DNA, 35 bp, Artificial Sequence
  Synthetic oligonucleotide
attgcaacgacaagtttctccccaatcacctctct

SEQ ID NO: 29749 - DNA, 36 bp, Artificial Sequence
  Synthetic oligonucleotide
gatgccatccgtgataacggcgtatcccattctgaa

SEQ ID NO: 29750 - DNA, 35 bp, Artificial Sequence
  Synthetic oligonucleotide
agacctctccaagtcccgtcctgtctggccacaca

SEQ ID NO: 29751 - DNA, 37 bp, Artificial Sequence
  Synthetic oligonucleotide
gggcgaaaggcaagaaaggtggggagatggtggatga

SEQ ID NO: 29752 - DNA, 38 bp, Artificial Sequence
  Synthetic oligonucleotide
tcacacgccaggcttccattatgattgcccatccgtga

SEQ ID NO: 29753 - DNA, 37 bp, Artificial Sequence
  Synthetic oligonucleotide
cagcggatccgtccctggcctactacctctgcggtga

SEQ ID NO: 29754 - DNA, 35 bp, Artificial Sequence
  Synthetic oligonucleotide
atcactcagcaccctctgacctttttgattcgaac

SEQ ID NO: 29755 - DNA, 35 bp, Artificial Sequence
  Synthetic oligonucleotide
gcgtaccgccccctattaggaatatcttcacccgc

SEQ ID NO: 29756 - DNA, 35 bp, Artificial Sequence
  Synthetic oligonucleotide
acatcaagccatggcaaagacacttctccaatcgc

SEQ ID NO: 29757 - DNA, 35 bp, Artificial Sequence
  Synthetic oligonucleotide
aaccatccccctggcccattatcacgcacgggatc

SEQ ID NO: 29758 - DNA, 35 bp, Artificial Sequence
  Synthetic oligonucleotide
gatccatcgcatgctagatactgcgggccatcttc

SEQ ID NO: 29759 - DNA, 35 bp, Artificial Sequence
  Synthetic oligonucleotide
ggagagggtggaaaagggaaaatggcgagtcctag

SEQ ID NO: 29760 - DNA, 35 bp, Artificial Sequence
  Synthetic oligonucleotide
gacgattagtttgtgtttgttccacccctccgccg

SEQ ID NO: 29761 - DNA, 35 bp, Artificial Sequence
  Synthetic oligonucleotide
gttgaagactcccctgcgatatccattcgttctat

SEQ ID NO: 29762 - DNA, 35 bp, Artificial Sequence
  Synthetic oligonucleotide
acgacacgtcacctgccaaattagcgcgctaccct

SEQ ID NO: 29763 - DNA, 35 bp, Artificial Sequence
  Synthetic oligonucleotide
acctcgcaccctgaacatgcgttatgcctttccct

SEQ ID NO: 29764 - DNA, 35 bp, Artificial Sequence
  Synthetic oligonucleotide
tccgctccggcacccactcatcgctccatcggcct

SEQ ID NO: 29765 - DNA, 35 bp, Artificial Sequence
  Synthetic oligonucleotide
gatccgggggggaggtggattcacatctgatgagt

SEQ ID NO: 29766 - DNA, 35 bp, Artificial Sequence
  Synthetic oligonucleotide
atttaggtccctcgcattatgttccctgtacctgt

SEQ ID NO: 29767 - DNA, 35 bp, Artificial Sequence
  Synthetic oligonucleotide
aagcaccctccccagacttcatctctacgcacgtt

SEQ ID NO: 29768 - DNA, 35 bp, Artificial Sequence
  Synthetic oligonucleotide
tccaccacgtttaccctgcctagcgttacttattt

SEQ ID NO: 29769 - DNA, 35 bp, Artificial Sequence
  Synthetic oligonucleotide
gttggccagggcgagtcaatcaccctatctacttt

SEQ ID NO: 29770 - DNA, 36 bp, Artificial Sequence
  Synthetic oligonucleotide
aaacaccccgggcctgtctcattatgtcaaccaaaa

SEQ ID NO: 29771 - DNA, 36 bp, Artificial Sequence
  Synthetic oligonucleotide
ttagccgccttcagcccacgctcatcctgttaccaa

SEQ ID NO: 29772 - DNA, 36 bp, Artificial Sequence
  Synthetic oligonucleotide
aaggaccaagaaaagggaacgaggaaagagtggcaa

SEQ ID NO: 29773 - DNA, 35 bp, Artificial Sequence
  Synthetic oligonucleotide
ttaaccgacttccttgcctcgctggccaaagcaca

SEQ ID NO: 29774 - DNA, 36 bp, Artificial Sequence
  Synthetic oligonucleotide
aagtgcggtcctaatcgtgctgccctactctgccca

SEQ ID NO: 29775 - DNA, 37 bp, Artificial Sequence
  Synthetic oligonucleotide
gcgcccgacgtttgccgatctgttgccccccgcccga

SEQ ID NO: 29776 - DNA, 35 bp, Artificial Sequence
  Synthetic oligonucleotide
gtgacccgtatgcgctgcacccggtacatccttcc

SEQ ID NO: 29777 - DNA, 35 bp, Artificial Sequence
  Synthetic oligonucleotide
gaaccccctcagaaacagcatgcctggaattaccg

SEQ ID NO: 29778 - DNA, 35 bp, Artificial Sequence
  Synthetic oligonucleotide
acccacccaaatgcacgaacgcccggtgttcgtct

SEQ ID NO: 29779 - DNA, 36 bp, Artificial Sequence
  Synthetic oligonucleotide
tctacgcccctctgcgcacgttttcctattatggaa

SEQ ID NO: 29780 - DNA, 36 bp, Artificial Sequence
  Synthetic oligonucleotide
tccggacacccacttggctattatttgtccatctaa

SEQ ID NO: 29781 - DNA, 36 bp, Artificial Sequence
  Synthetic oligonucleotide
taccgcaccgttccccggcaatccctacgccctcca

SEQ ID NO: 29782 - DNA, 36 bp, Artificial Sequence
  Synthetic oligonucleotide
atgtcacactcaatcgcggacaaaagtcgcccttca

SEQ ID NO: 29783 - DNA, 37 bp, Artificial Sequence
  Synthetic oligonucleotide
gccacgctatagggtcatcgtctcccgccacttccga

SEQ ID NO: 29784 - DNA, 37 bp, Artificial Sequence
  Synthetic oligonucleotide
tctgccccatggcacatgttgacaatacctctatcga

SEQ ID NO: 29785 - DNA, 37 bp, Artificial Sequence
  Synthetic oligonucleotide
gcccccccccttgtccctccgttagcacctgaacgga

SEQ ID NO: 29786 - DNA, 38 bp, Artificial Sequence
  Synthetic oligonucleotide
tcgttggcgaggagcgaactgaggggggagggaaatga

SEQ ID NO: 29787 - DNA, 38 bp, Artificial Sequence
  Synthetic oligonucleotide
gacaccttgacgttgtgccccaacaccctttgtcctga

SEQ ID NO: 29788 - DNA, 38 bp, Artificial Sequence
  Synthetic oligonucleotide
cgtacaagccacagcccccacgtacacttgcttgctga

SEQ ID NO: 29789 - DNA, 36 bp, Artificial Sequence
  Synthetic oligonucleotide
gaccaggtgcctcctttccatctaccacgtgtgcta

SEQ ID NO: 29790 - DNA, 35 bp, Artificial Sequence
  Synthetic oligonucleotide
aaacacctcataattacggcggactgcccactccc

SEQ ID NO: 29791 - DNA, 35 bp, Artificial Sequence
  Synthetic oligonucleotide
ggaacctccctacatagtttgattgatgcctgctc

SEQ ID NO: 29792 - DNA, 35 bp, Artificial Sequence
  Synthetic oligonucleotide
ggaaaggaggaacggaggggttgtggcaaggacag

SEQ ID NO: 29793 - DNA, 35 bp, Artificial Sequence
  Synthetic oligonucleotide
gccccaacccacctgcgtcctttgcgtccaagtgg

SEQ ID NO: 29794 - DNA, 35 bp, Artificial Sequence
  Synthetic oligonucleotide
tcacgatggaggggtaatgagtggtggatgtggct

SEQ ID NO: 29795 - DNA, 36 bp, Artificial Sequence
  Synthetic oligonucleotide
gcaagaatagtgaggaaaggggattgtggatggaaa

SEQ ID NO: 29796 - DNA, 35 bp, Artificial Sequence
  Synthetic oligonucleotide
gcaccacactgactagttattttctctcgttacaa

SEQ ID NO: 29797 - DNA, 36 bp, Artificial Sequence
  Synthetic oligonucleotide
tcatacataccgtttggtcgcctgtaaccatgttaa

SEQ ID NO: 29798 - DNA, 35 bp, Artificial Sequence
  Synthetic oligonucleotide
gacactccgatccgaacttacgccacgggaaacca

SEQ ID NO: 29799 - DNA, 37 bp, Artificial Sequence
  Synthetic oligonucleotide
aaccgttatgccccagtttccacttcactatcaagga

SEQ ID NO: 29800 - DNA, 36 bp, Artificial Sequence
  Synthetic oligonucleotide
gtctcatccgcattacgatatcgatcctcctcatga

SEQ ID NO: 29801 - DNA, 38 bp, Artificial Sequence
  Synthetic oligonucleotide
acgctgccaacgccccccatttcgccgccttagcctga

SEQ ID NO: 29802 - DNA, 38 bp, Artificial Sequence
  Synthetic oligonucleotide
gcgagccacgcctcaccgccccattgtcctttagttga

SEQ ID NO: 29803 - DNA, 35 bp, Artificial Sequence
  Synthetic oligonucleotide
gtccgttcatccgcactgctctgtgacaacaggcc

SEQ ID NO: 29804 - DNA, 35 bp, Artificial Sequence
  Synthetic oligonucleotide
tccgctcatcgcgcccctcctggttttgcatacgc

SEQ ID NO: 29805 - DNA, 35 bp, Artificial Sequence
  Synthetic oligonucleotide
gcaagcctcccccgagatttgatgcacttattttc

SEQ ID NO: 29806 - DNA, 35 bp, Artificial Sequence
  Synthetic oligonucleotide
aaatgcgcagtcattccggctcctccttctcgtgg

SEQ ID NO: 29807 - DNA, 35 bp, Artificial Sequence
  Synthetic oligonucleotide
gacggggaaggaatcgaaatttaggcaggaacatg

SEQ ID NO: 29808 - DNA, 35 bp, Artificial Sequence
  Synthetic oligonucleotide
gagggaaggtgggccctggtagtgtggggatcgtg

SEQ ID NO: 29809 - DNA, 35 bp, Artificial Sequence
  Synthetic oligonucleotide
gcaacgcacgatcctgttatttcatgcttaccttg

SEQ ID NO: 29810 - DNA, 35 bp, Artificial Sequence
  Synthetic oligonucleotide
gtggtacgctgaacattcttttgggttggcactct

SEQ ID NO: 29811 - DNA, 35 bp, Artificial Sequence
  Synthetic oligonucleotide
tccaacgcccttccccgcatcttctgccatctgaa

SEQ ID NO: 29812 - DNA, 37 bp, Artificial Sequence
  Synthetic oligonucleotide
tacaggtcgcaatatcctgctttatcacatcctagga

SEQ ID NO: 29813 - DNA, 36 bp, Artificial Sequence
  Synthetic oligonucleotide
tgcaaatgtcgcatcatcccttcaagtcacggcata

SEQ ID NO: 29814 - DNA, 35 bp, Artificial Sequence
  Synthetic oligonucleotide
tcgacaaaccccctgctagtgaattcaaccctgac

SEQ ID NO: 29815 - DNA, 35 bp, Artificial Sequence
  Synthetic oligonucleotide
gaccgcacgccggccttacaccgaacgatcctgac

SEQ ID NO: 29816 - DNA, 35 bp, Artificial Sequence
  Synthetic oligonucleotide
cacacagaaacctgggacaggcccatgctactctc

SEQ ID NO: 29817 - DNA, 35 bp, Artificial Sequence
  Synthetic oligonucleotide
gctctaccatcctcaccatctggatagtggctctc

SEQ ID NO: 29818 - DNA, 35 bp, Artificial Sequence
  Synthetic oligonucleotide
aacaccacacctgcatcgagacgggttgacaacag

SEQ ID NO: 29819 - DNA, 35 bp, Artificial Sequence
  Synthetic oligonucleotide
ttcgccgctgtggcatcctcacacccaaaatttcg

SEQ ID NO: 29820 - DNA, 35 bp, Artificial Sequence
  Synthetic oligonucleotide
ggaaagtcgccacattctctccttcgtccgatcat

SEQ ID NO: 29821 - DNA, 35 bp, Artificial Sequence
  Synthetic oligonucleotide
gacgatcaaacttggccagcgccccgccttatgct

SEQ ID NO: 29822 - DNA, 35 bp, Artificial Sequence
  Synthetic oligonucleotide
tactccatttcgccagcactgctcacgctcgtaaa

SEQ ID NO: 29823 - DNA, 34 bp, Artificial Sequence
  Synthetic oligonucleotide
aacctcagcacctatcaccgccggtcacaaatca

SEQ ID NO: 29824 - DNA, 36 bp, Artificial Sequence
  Synthetic oligonucleotide
ttcttcatcccagccttatcccagcttcgtgtctca

SEQ ID NO: 29825 - DNA, 37 bp, Artificial Sequence
  Synthetic oligonucleotide
acccgccacacttaggggttacacgccacttgaacga

SEQ ID NO: 29826 - DNA, 36 bp, Artificial Sequence
  Synthetic oligonucleotide
gcgacgtcccgacctgaccagtacacccatctctga

SEQ ID NO: 29827 - DNA, 38 bp, Artificial Sequence
  Synthetic oligonucleotide
tacagcgtacatcctgttacgttctttcatccctgtga

SEQ ID NO: 29828 - DNA, 38 bp, Artificial Sequence
  Synthetic oligonucleotide
ttccccgccatcactttgagcacggtccctccttttga

SEQ ID NO: 29829 - DNA, 36 bp, Artificial Sequence
  Synthetic oligonucleotide
tatgagggcaaatggatggggaaggggctggcgata

SEQ ID NO: 29830 - DNA, 35 bp, Artificial Sequence
  Synthetic oligonucleotide
ttcccaacgcacttccacattcgttcaccagtata

SEQ ID NO: 29831 - DNA, 35 bp, Artificial Sequence
  Synthetic oligonucleotide
ttcagtcgccaaaatcgcactagcactacttccac

SEQ ID NO: 29832 - DNA, 35 bp, Artificial Sequence
  Synthetic oligonucleotide
atacctacggcgtgaaaatgccgcacctccctgcc

SEQ ID NO: 29833 - DNA, 35 bp, Artificial Sequence
  Synthetic oligonucleotide
gttgagacacaagcagccttatgcattcccgttcc

SEQ ID NO: 29834 - DNA, 35 bp, Artificial Sequence
  Synthetic oligonucleotide
accccaatcccccgcctctgtgcaggtcctgttcc

SEQ ID NO: 29835 - DNA, 35 bp, Artificial Sequence
  Synthetic oligonucleotide
agccccctccgaataataccgacccttttaccggc

SEQ ID NO: 29836 - DNA, 35 bp, Artificial Sequence
  Synthetic oligonucleotide
gttcccccaccgggcccttcgtatctgggttgatc

SEQ ID NO: 29837 - DNA, 35 bp, Artificial Sequence
  Synthetic oligonucleotide
atgcccccaccctactccacttttcagtcgcgccg

SEQ ID NO: 29838 - DNA, 35 bp, Artificial Sequence
  Synthetic oligonucleotide
agagggggggggcaactggatcgaatacacggggg

SEQ ID NO: 29839 - DNA, 35 bp, Artificial Sequence
  Synthetic oligonucleotide
atttggcacccaggtaccttgtcagcctctcctat

SEQ ID NO: 29840 - DNA, 35 bp, Artificial Sequence
  Synthetic oligonucleotide
accgccatacacatcttcccctgaatgtctgaact

SEQ ID NO: 29841 - DNA, 35 bp, Artificial Sequence
  Synthetic oligonucleotide
tcctggcactccctctatccagtggttgtttgtct

SEQ ID NO: 29842 - DNA, 35 bp, Artificial Sequence
  Synthetic oligonucleotide
tgagccggtagtggggcgcctctttgtttctgtgt

SEQ ID NO: 29843 - DNA, 35 bp, Artificial Sequence
  Synthetic oligonucleotide
gcatgtttcgccgcccctagtccttcgggcctatt

SEQ ID NO: 29844 - DNA, 36 bp, Artificial Sequence
  Synthetic oligonucleotide
gagaacacctcttgtctgtacccaaccgagttgaaa

SEQ ID NO: 29845 - DNA, 36 bp, Artificial Sequence
  Synthetic oligonucleotide
taggaccgcatccatcgaaggttacgaactcaacca

SEQ ID NO: 29846 - DNA, 36 bp, Artificial Sequence
  Synthetic oligonucleotide
aagtatgagtcagccccgtcgcccaccgcctgccca

SEQ ID NO: 29847 - DNA, 35 bp, Artificial Sequence
  Synthetic oligonucleotide
tctacctcgtttgacacctgttaggctcaactcca

SEQ ID NO: 29848 - DNA, 35 bp, Artificial Sequence
  Synthetic oligonucleotide
aaccccccgcatgtcccgttttgcaggcctacgca

SEQ ID NO: 29849 - DNA, 35 bp, Artificial Sequence
  Synthetic oligonucleotide
tcccaccggtagtcagtttaccatcccgtcatgca

SEQ ID NO: 29850 - DNA, 38 bp, Artificial Sequence
  Synthetic oligonucleotide
tactgcgtgcggcaccgttttctgcccactcttaatga

SEQ ID NO: 29851 - DNA, 36 bp, Artificial Sequence
  Synthetic oligonucleotide
gccgacggccctgtacgatttcgcttccacaactga

SEQ ID NO: 29852 - DNA, 38 bp, Artificial Sequence
  Synthetic oligonucleotide
gtatcgcgcagtatgcactccgcccacaacctatctga

SEQ ID NO: 29853 - DNA, 36 bp, Artificial Sequence
  Synthetic oligonucleotide
tgtacctcggacaacacgctccatctgcgccctcta

SEQ ID NO: 29854 - DNA, 35 bp, Artificial Sequence
  Synthetic oligonucleotide
aacccccccacgcgtacccgtgtaacaggttgcac

SEQ ID NO: 29855 - DNA, 35 bp, Artificial Sequence
  Synthetic oligonucleotide
gatgggctttctaatggttccgctctcgcccctgc

SEQ ID NO: 29856 - DNA, 35 bp, Artificial Sequence
  Synthetic oligonucleotide
ataggacgcggccatatacgcacacaacattgatc

SEQ ID NO: 29857 - DNA, 35 bp, Artificial Sequence
  Synthetic oligonucleotide
gcgcacgttaggaaagggggctggcaatcaataag

SEQ ID NO: 29858 - DNA, 35 bp, Artificial Sequence
  Synthetic oligonucleotide
ggatccgccgaataccccgctttactgcttccgcg

SEQ ID NO: 29859 - DNA, 35 bp, Artificial Sequence
  Synthetic oligonucleotide
gagccccgtgccgactaacatctcccttcagctgg

SEQ ID NO: 29860 - DNA, 35 bp, Artificial Sequence
  Synthetic oligonucleotide
gctggttccgacgaattccgttacatctctgccct

SEQ ID NO: 29861 - DNA, 35 bp, Artificial Sequence
  Synthetic oligonucleotide
tccaaatgcccagtgcaccttatatacgccccgca

SEQ ID NO: 29862 - DNA, 36 bp, Artificial Sequence
  Synthetic oligonucleotide
acgcctcgctgtggcctgttttgctacattcattca

SEQ ID NO: 29863 - DNA, 35 bp, Artificial Sequence
  Synthetic oligonucleotide
tatccctcccatgcagacgaaccctcgccctttca

SEQ ID NO: 29864 - DNA, 37 bp, Artificial Sequence
  Synthetic oligonucleotide
gtacgggagggaggggagacaccattgcgggcaacga

SEQ ID NO: 29865 - DNA, 37 bp, Artificial Sequence
  Synthetic oligonucleotide
tgaagggagggggggtggattgatgccgagtagacga

SEQ ID NO: 29866 - DNA, 36 bp, Artificial Sequence
  Synthetic oligonucleotide
gtactcagcccagctcgctcaccgtcatttcctcga

SEQ ID NO: 29867 - DNA, 38 bp, Artificial Sequence
  Synthetic oligonucleotide
ttgtgtggcactgcgcctcatttctatcgcacacttga

SEQ ID NO: 29868 - DNA, 36 bp, Artificial Sequence
  Synthetic oligonucleotide
acccatccctacgcaggcttgtactgaccacacgta

SEQ ID NO: 29869 - DNA, 35 bp, Artificial Sequence
  Synthetic oligonucleotide
tgtacgaccgcgccgctcggcctccctctgcatta

SEQ ID NO: 29870 - DNA, 34 bp, Artificial Sequence
  Synthetic oligonucleotide
acaagtcagccgaatttgcctctcatggtgcacc

SEQ ID NO: 29871 - DNA, 35 bp, Artificial Sequence
  Synthetic oligonucleotide
taggcgcaaccgcccaccccaccgctaactagccc

SEQ ID NO: 29872 - DNA, 35 bp, Artificial Sequence
  Synthetic oligonucleotide
gaatgcgcgggatcactccgaaaaggcaaactctc

SEQ ID NO: 29873 - DNA, 35 bp, Artificial Sequence
  Synthetic oligonucleotide
acccgtgacaccttaactatctgtattcttcagtc

SEQ ID NO: 29874 - DNA, 35 bp, Artificial Sequence
  Synthetic oligonucleotide
atgacatcaacacatgccgtggccccagcaccccg

SEQ ID NO: 29875 - DNA, 35 bp, Artificial Sequence
  Synthetic oligonucleotide
aaggggaggggggtgttctcgtaaggactgggagg

SEQ ID NO: 29876 - DNA, 35 bp, Artificial Sequence
  Synthetic oligonucleotide
ggataacctgctcatgtgacatgtcccatccattg

SEQ ID NO: 29877 - DNA, 36 bp, Artificial Sequence
  Synthetic oligonucleotide
tacgatggccagtgcgacccgtccgaccctaaccaa

SEQ ID NO: 29878 - DNA, 36 bp, Artificial Sequence
  Synthetic oligonucleotide
gcccccagccagtataaacaacgccaccgctctcaa

SEQ ID NO: 29879 - DNA, 36 bp, Artificial Sequence
  Synthetic oligonucleotide
aaccatccgtagcctatgctaattctgttatctaca

SEQ ID NO: 29880 - DNA, 35 bp, Artificial Sequence
  Synthetic oligonucleotide
gccggagccccaacatgtcgcttcgtttacaatca

SEQ ID NO: 29881 - DNA, 37 bp, Artificial Sequence
  Synthetic oligonucleotide
acgccaacagtggggaaacgaaaagggcatggacaga

SEQ ID NO: 29882 - DNA, 37 bp, Artificial Sequence
  Synthetic oligonucleotide
gagacgccgtgatcctgacccagccctgtctttgcga

SEQ ID NO: 29883 - DNA, 37 bp, Artificial Sequence
  Synthetic oligonucleotide
ttcccggcccgttctgcacccgcctcaatgccttcga

SEQ ID NO: 29884 - DNA, 38 bp, Artificial Sequence
  Synthetic oligonucleotide
acgacgctgtaggggcgggatcatgtggggcgggatga

SEQ ID NO: 29885 - DNA, 35 bp, Artificial Sequence
  Synthetic oligonucleotide
ggtcccacgcactccaccaaattgatcatgtccta

SEQ ID NO: 29886 - DNA, 36 bp, Artificial Sequence
  Synthetic oligonucleotide
aacaccgaaggaggtttgcggggctaagcatgagta

SEQ ID NO: 29887 - DNA, 35 bp, Artificial Sequence
  Synthetic oligonucleotide
ttgccggtccatggcaacgtgcaatcgagtaccac

SEQ ID NO: 29888 - DNA, 35 bp, Artificial Sequence
  Synthetic oligonucleotide
gttgtgacccctgttggtgcctatccgatccctac

SEQ ID NO: 29889 - DNA, 35 bp, Artificial Sequence
  Synthetic oligonucleotide
ccagcctacactgcccgttgttctcttcaccagcc

SEQ ID NO: 29890 - DNA, 35 bp, Artificial Sequence
  Synthetic oligonucleotide
accctgacactacgccgtgttgcacatccccgagc

SEQ ID NO: 29891 - DNA, 35 bp, Artificial Sequence
  Synthetic oligonucleotide
gtccaggaaaaggcggtagggagaaggactgttag

SEQ ID NO: 29892 - DNA, 35 bp, Artificial Sequence
  Synthetic oligonucleotide
agtgctcctctcggtcccttatccttcccctatgg

SEQ ID NO: 29893 - DNA, 35 bp, Artificial Sequence
  Synthetic oligonucleotide
gaacggttgcaccgccccctccaccatcataggtg

SEQ ID NO: 29894 - DNA, 35 bp, Artificial Sequence
  Synthetic oligonucleotide
accacccgactatatccacatggttcattttgcct

SEQ ID NO: 29895 - DNA, 35 bp, Artificial Sequence
  Synthetic oligonucleotide
gacgagttggtacggcaaaggggcttcatgttggt

SEQ ID NO: 29896 - DNA, 35 bp, Artificial Sequence
  Synthetic oligonucleotide
tccatttcagctggaaccattgtcattctatcctt

SEQ ID NO: 29897 - DNA, 36 bp, Artificial Sequence
  Synthetic oligonucleotide
gacacccccgtagtccgacgccaccctgaggttaca

SEQ ID NO: 29898 - DNA, 36 bp, Artificial Sequence
  Synthetic oligonucleotide
gatcaccggaaccgcgcgtccctttcccactcccca

SEQ ID NO: 29899 - DNA, 36 bp, Artificial Sequence
  Synthetic oligonucleotide
tttgtcgcctatccgatcgcctccagttggacgcca

SEQ ID NO: 29900 - DNA, 37 bp, Artificial Sequence
  Synthetic oligonucleotide
ggttgaccaagtggttgggacggaggagggtgggaga

SEQ ID NO: 29901 - DNA, 37 bp, Artificial Sequence
  Synthetic oligonucleotide
gatcccgctcacatcagttactaccttcgtcatgcga

SEQ ID NO: 29902 - DNA, 37 bp, Artificial Sequence
  Synthetic oligonucleotide
ggaccacctgtgcgcaccctggcctaacacttatcga

SEQ ID NO: 29903 - DNA, 37 bp, Artificial Sequence
  Synthetic oligonucleotide
agggaggtcctccatctgctttcttcttcatcctcga

SEQ ID NO: 29904 - DNA, 37 bp, Artificial Sequence
  Synthetic oligonucleotide
tgcacagtgtgcgggagaccatataggtgggtgggga

SEQ ID NO: 29905 - DNA, 38 bp, Artificial Sequence
  Synthetic oligonucleotide
agacaatggggggtgtgggggggatgtcttcatgatga

SEQ ID NO: 29906 - DNA, 38 bp, Artificial Sequence
  Synthetic oligonucleotide
gtaccatgaccatatctcttatcgagcccgttctctga

SEQ ID NO: 29907 - DNA, 38 bp, Artificial Sequence
  Synthetic oligonucleotide
tcacctcgatctcctgttacctattgtttgcccattga

SEQ ID NO: 29908 - DNA, 38 bp, Artificial Sequence
  Synthetic oligonucleotide
agtactgctggggggtgatgaagggtggatagccttga

SEQ ID NO: 29909 - DNA, 38 bp, Artificial Sequence
  Synthetic oligonucleotide
ggacaatggtggaaacgaataggacggaggatgcttga

SEQ ID NO: 29910 - DNA, 36 bp, Artificial Sequence
  Synthetic oligonucleotide
gtggggagtggtgggggggaatcggatctgatatta

SEQ ID NO: 29911 - DNA, 35 bp, Artificial Sequence
  Synthetic oligonucleotide
tctcatccctatgcttttggatccgttctggtccc

SEQ ID NO: 29912 - DNA, 35 bp, Artificial Sequence
  Synthetic oligonucleotide
atcacgtgcacacatgcgcttacatttagctagcc

SEQ ID NO: 29913 - DNA, 35 bp, Artificial Sequence
  Synthetic oligonucleotide
gcgaaccacgactgttctgcccccccgcccctcgc

SEQ ID NO: 29914 - DNA, 35 bp, Artificial Sequence
  Synthetic oligonucleotide
tgcgcatactccaggctgtactatcctcccccggc

SEQ ID NO: 29915 - DNA, 35 bp, Artificial Sequence
  Synthetic oligonucleotide
tacctacacgtggtatagcttggctgtttttcctc

SEQ ID NO: 29916 - DNA, 35 bp, Artificial Sequence
  Synthetic oligonucleotide
atcatcgccctactatgccacaagttttgcttgct

SEQ ID NO: 29917 - DNA, 35 bp, Artificial Sequence
  Synthetic oligonucleotide
accccatcagtggaggctcactacgcgctacatct

SEQ ID NO: 29918 - DNA, 36 bp, Artificial Sequence
  Synthetic oligonucleotide
tcctactgggcctgcaattatcaatatcgttcccaa

SEQ ID NO: 29919 - DNA, 36 bp, Artificial Sequence
  Synthetic oligonucleotide
gtgaccaacggtgtcacgcataactaccaggcccca

SEQ ID NO: 29920 - DNA, 36 bp, Artificial Sequence
  Synthetic oligonucleotide
atcgcccgttcgtcgcattacacaagcccccagcca

SEQ ID NO: 29921 - DNA, 37 bp, Artificial Sequence
  Synthetic oligonucleotide
gatgccctcttatccatgcctcgatcttccggttgga

SEQ ID NO: 29922 - DNA, 38 bp, Artificial Sequence
  Synthetic oligonucleotide
gattgaccgcctgccctgattgacacccgcccacctga

SEQ ID NO: 29923 - DNA, 37 bp, Artificial Sequence
  Synthetic oligonucleotide
agtgcgaagcctccatcatatgatctctcctagctga

SEQ ID NO: 29924 - DNA, 35 bp, Artificial Sequence
  Synthetic oligonucleotide
ttcatactgcctctgctatcctccccctgtaaata

SEQ ID NO: 29925 - DNA, 36 bp, Artificial Sequence
  Synthetic oligonucleotide
tccgcccttccttgctacgcctgtacatgtctacta

SEQ ID NO: 29926 - DNA, 35 bp, Artificial Sequence
  Synthetic oligonucleotide
tcttgaggccatgacccgcgagcctcctgtcatac

SEQ ID NO: 29927 - DNA, 35 bp, Artificial Sequence
  Synthetic oligonucleotide
tcgacgttcatcatctgtcctctcacgctccctgc

SEQ ID NO: 29928 - DNA, 35 bp, Artificial Sequence
  Synthetic oligonucleotide
acacctgcctgatagttcctctgttatttactgtc

SEQ ID NO: 29929 - DNA, 35 bp, Artificial Sequence
  Synthetic oligonucleotide
atcggtccacccctagccactcattctcaggtacg

SEQ ID NO: 29930 - DNA, 35 bp, Artificial Sequence
  Synthetic oligonucleotide
gatagatcgatcatggggaaggtgggaggagttcg

SEQ ID NO: 29931 - DNA, 36 bp, Artificial Sequence
  Synthetic oligonucleotide
gcaccaccgctctctcctcgtcgaagctccgctagg

SEQ ID NO: 29932 - DNA, 35 bp, Artificial Sequence
  Synthetic oligonucleotide
tccagctcaacacgatctcccgcacactctctagg

SEQ ID NO: 29933 - DNA, 35 bp, Artificial Sequence
  Synthetic oligonucleotide
gtgggcccatctcccggcttataggtactctcaat

SEQ ID NO: 29934 - DNA, 35 bp, Artificial Sequence
  Synthetic oligonucleotide
ggggcgatcaccaccactgctagcactgttgccct

SEQ ID NO: 29935 - DNA, 35 bp, Artificial Sequence
  Synthetic oligonucleotide
tcactgcacatctagtatgtctggctcattctgct

SEQ ID NO: 29936 - DNA, 35 bp, Artificial Sequence
  Synthetic oligonucleotide
gtgcatgtgcattactcctgggctctctgtggctt

SEQ ID NO: 29937 - DNA, 35 bp, Artificial Sequence
  Synthetic oligonucleotide
tgtctacctcaccctgataagaatctcctgccttt

SEQ ID NO: 29938 - DNA, 35 bp, Artificial Sequence
  Synthetic oligonucleotide
tgtacatgcgtcacgtcgtacctcccgcacacaca

SEQ ID NO: 29939 - DNA, 35 bp, Artificial Sequence
  Synthetic oligonucleotide
gcacctcgtaatttgctcgatcgtagtacctacca

SEQ ID NO: 29940 - DNA, 35 bp, Artificial Sequence
  Synthetic oligonucleotide
ttactgcctcgcttatgacaccccctctgcaggca

SEQ ID NO: 29941 - DNA, 35 bp, Artificial Sequence
  Synthetic oligonucleotide
gattgtgccacgtcctgcaactctagctcccctca

SEQ ID NO: 29942 - DNA, 38 bp, Artificial Sequence
  Synthetic oligonucleotide
gaacccacctccgctgattactgcatatctacaaatga

SEQ ID NO: 29943 - DNA, 38 bp, Artificial Sequence
  Synthetic oligonucleotide
gcatatgcaccccctctgacccgccagtctcgccatga

SEQ ID NO: 29944 - DNA, 37 bp, Artificial Sequence
  Synthetic oligonucleotide
gacatcctcaagtatgtatgctcacacccatcactga

SEQ ID NO: 29945 - DNA, 35 bp, Artificial Sequence
  Synthetic oligonucleotide
tcacgcctagctctccctcgtctcagggattacgc

SEQ ID NO: 29946 - DNA, 35 bp, Artificial Sequence
  Synthetic oligonucleotide
gtcacctactagcccaccggttgttttgtatcctc

SEQ ID NO: 29947 - DNA, 35 bp, Artificial Sequence
  Synthetic oligonucleotide
gacgccctgatgtaccctccatgtctcacccgttc

SEQ ID NO: 29948 - DNA, 35 bp, Artificial Sequence
  Synthetic oligonucleotide
tctacgcagtgcagacgtgaaccacccacctaatg

SEQ ID NO: 29949 - DNA, 35 bp, Artificial Sequence
  Synthetic oligonucleotide
gccgtacatccatcgcctgcctaatgcggtcgcat

SEQ ID NO: 29950 - DNA, 35 bp, Artificial Sequence
  Synthetic oligonucleotide
tccgctccttcgtggtacttccgttgcctcatcat

SEQ ID NO: 29951 - DNA, 36 bp, Artificial Sequence
  Synthetic oligonucleotide
gggatggggtgggagggtagttgtgttacgaggaaa

SEQ ID NO: 29952 - DNA, 36 bp, Artificial Sequence
  Synthetic oligonucleotide
attcccgccgttcttcactctattggtggttctaca

SEQ ID NO: 29953 - DNA, 34 bp, Artificial Sequence
  Synthetic oligonucleotide
accacgacgacaatcggcctctaataagctatca

SEQ ID NO: 29954 - DNA, 37 bp, Artificial Sequence
  Synthetic oligonucleotide
ttgaggtcggaatgtcggggaatgctaggatggagga

SEQ ID NO: 29955 - DNA, 38 bp, Artificial Sequence
  Synthetic oligonucleotide
tcgatcgccacacatactcttcgcctctaggttacgga

SEQ ID NO: 29956 - DNA, 37 bp, Artificial Sequence
  Synthetic oligonucleotide
gggtcgagacaggaggagaaggaagaacaaggcggga

SEQ ID NO: 29957 - DNA, 35 bp, Artificial Sequence
  Synthetic oligonucleotide
gccacactcgcttccggatcgttttcccctatgga

SEQ ID NO: 29958 - DNA, 38 bp, Artificial Sequence
  Synthetic oligonucleotide
tgtaccatccgctccttagcgtttgtcaactatgttga

SEQ ID NO: 29959 - DNA, 35 bp, Artificial Sequence
  Synthetic oligonucleotide
gccacccactgcccctcacagggtgcacatttgac

SEQ ID NO: 29960 - DNA, 35 bp, Artificial Sequence
  Synthetic oligonucleotide
gcctctacccttgcttgacgtaagtacagctgccc

SEQ ID NO: 29961 - DNA, 35 bp, Artificial Sequence
  Synthetic oligonucleotide
gtcacgccaacccccctgatgcaacatgccagacg

SEQ ID NO: 29962 - DNA, 35 bp, Artificial Sequence
  Synthetic oligonucleotide
tcccaccatccggccttcaactgctgcaggtattg

SEQ ID NO: 29963 - DNA, 35 bp, Artificial Sequence
  Synthetic oligonucleotide
ttgttaccgtgctctgagtcccttccccggccttg

SEQ ID NO: 29964 - DNA, 35 bp, Artificial Sequence
  Synthetic oligonucleotide
ttcaatcaccatccattgctgttcaagcaaaatgt

SEQ ID NO: 29965 - DNA, 36 bp, Artificial Sequence
  Synthetic oligonucleotide
gtgccccctgctgcttccaaagtcgacgccggtaaa

SEQ ID NO: 29966 - DNA, 36 bp, Artificial Sequence
  Synthetic oligonucleotide
ggtcactgttctgccgtctcttctcaccttgcgcaa

SEQ ID NO: 29967 - DNA, 36 bp, Artificial Sequence
  Synthetic oligonucleotide
tctacccaggcatcgccacacacctcggctcttgaa

SEQ ID NO: 29968 - DNA, 36 bp, Artificial Sequence
  Synthetic oligonucleotide
tcaaccggagccaaccactgaaacaccacgctgaca

SEQ ID NO: 29969 - DNA, 36 bp, Artificial Sequence
  Synthetic oligonucleotide
tacccagcctcgggctgccacgccctcttacaccca

SEQ ID NO: 29970 - DNA, 35 bp, Artificial Sequence
  Synthetic oligonucleotide
gcctcacctgtcacatcccgtaccgtagtcatcca

SEQ ID NO: 29971 - DNA, 37 bp, Artificial Sequence
  Synthetic oligonucleotide
gtttgggggggccatggggggaacggactacagcgga

SEQ ID NO: 29972 - DNA, 37 bp, Artificial Sequence
  Synthetic oligonucleotide
tccgtgcgaagtcgagcatgggtggggtaggggcgga

SEQ ID NO: 29973 - DNA, 37 bp, Artificial Sequence
  Synthetic oligonucleotide
gctgtgggggggaatcggtagggtggcccgaggggga

SEQ ID NO: 29974 - DNA, 38 bp, Artificial Sequence
  Synthetic oligonucleotide
ggactcacgagggcgtgaaaggggtgtgaggggaatga

SEQ ID NO: 29975 - DNA, 37 bp, Artificial Sequence
  Synthetic oligonucleotide
tccgcctcccaaccgtgcgcctagcccgttaatctga

SEQ ID NO: 29976 - DNA, 38 bp, Artificial Sequence
  Synthetic oligonucleotide
tagtggtaggggggtacggggttcaaggcggttggtga

SEQ ID NO: 29977 - DNA, 38 bp, Artificial Sequence
  Synthetic oligonucleotide
aagggccgccctccgaagctatccctcaccataattga

SEQ ID NO: 29978 - DNA, 37 bp, Artificial Sequence
  Synthetic oligonucleotide
gtcgtgcccctccatcgctctgttgcacatgcattga

SEQ ID NO: 29979 - DNA, 36 bp, Artificial Sequence
  Synthetic oligonucleotide
accgtccctatttgccttggttccgtagccgtggta

SEQ ID NO: 29980 - DNA, 35 bp, Artificial Sequence
  Synthetic oligonucleotide
gtggagggatcggtggactaaatcggggatgcagg

SEQ ID NO: 29981 - DNA, 35 bp, Artificial Sequence
  Synthetic oligonucleotide
gtcccatccgatatgccatacaatttgcgccgctg

SEQ ID NO: 29982 - DNA, 35 bp, Artificial Sequence
  Synthetic oligonucleotide
taaagccagcccccacacgccccagctgacataaa

SEQ ID NO: 29983 - DNA, 35 bp, Artificial Sequence
  Synthetic oligonucleotide
acatgaggcctgaaagaagaagaataggggaggaa

SEQ ID NO: 29984 - DNA, 37 bp, Artificial Sequence
  Synthetic oligonucleotide
agtgcgtacaagtggggggggagggagtggtactcga

SEQ ID NO: 29985 - DNA, 36 bp, Artificial Sequence
  Synthetic oligonucleotide
gacctctctgcttattgctgttcgccctgtcttgga

SEQ ID NO: 29986 - DNA, 38 bp, Artificial Sequence
  Synthetic oligonucleotide
gaaggagatgctggggggagatggtaggcatcatatga

SEQ ID NO: 29987 - DNA, 37 bp, Artificial Sequence
  Synthetic oligonucleotide
tccgactggtcaatcgtttgcttcgtgatcctgctga

SEQ ID NO: 29988 - DNA, 38 bp, Artificial Sequence
  Synthetic oligonucleotide
tgtcgtacccgccgaatccgttaagtcttgccccttga

SEQ ID NO: 29989 - DNA, 37 bp, Artificial Sequence
  Synthetic oligonucleotide
tcaagtctgcgcataatggttgctctttgctttttga

SEQ ID NO: 29990 - DNA, 35 bp, Artificial Sequence
  Synthetic oligonucleotide
gccccgggccgcgcgcctcatcctcacaggccccc

SEQ ID NO: 29991 - DNA, 35 bp, Artificial Sequence
  Synthetic oligonucleotide
taagccgccttcgtgtctagtttgcccaccctttc

SEQ ID NO: 29992 - DNA, 35 bp, Artificial Sequence
  Synthetic oligonucleotide
aagccctcatgacttatcccaccaaccgccaatcg

SEQ ID NO: 29993 - DNA, 35 bp, Artificial Sequence
  Synthetic oligonucleotide
acccgagctgatgacccatgcttgtcctaccctcg

SEQ ID NO: 29994 - DNA, 35 bp, Artificial Sequence
  Synthetic oligonucleotide
aacccgcttgactcggggcctgttacatcccttat

SEQ ID NO: 29995 - DNA, 35 bp, Artificial Sequence
  Synthetic oligonucleotide
gccacttctccgccgggttccacggatcacgtggt

SEQ ID NO: 29996 - DNA, 35 bp, Artificial Sequence
  Synthetic oligonucleotide
tccgcccatcgttcctcggaagctgtactactctt

SEQ ID NO: 29997 - DNA, 36 bp, Artificial Sequence
  Synthetic oligonucleotide
gatcattagggggggaggagagagatgaagactaaa

SEQ ID NO: 29998 - DNA, 35 bp, Artificial Sequence
  Synthetic oligonucleotide
gctgggtacagtcccgtgctcgctgttcaccttca

SEQ ID NO: 29999 - DNA, 35 bp, Artificial Sequence
  Synthetic oligonucleotide
acacgcccaccgtactcaggtcacaggattgttca

SEQ ID NO: 30000 - DNA, 36 bp, Artificial Sequence
  Synthetic oligonucleotide
gctgaggggagtggtgtgtgggggatcgcatgaaga

SEQ ID NO: 30001 - DNA, 37 bp, Artificial Sequence
  Synthetic oligonucleotide
taccacccaacataaccctgagactgtcataggacga

SEQ ID NO: 30002 - DNA, 38 bp, Artificial Sequence
  Synthetic oligonucleotide
aacgacggccaggggggggatagttgggtgttgtatga

SEQ ID NO: 30003 - DNA, 38 bp, Artificial Sequence
  Synthetic oligonucleotide
ttcaagccagcactccattttggcccttttcagactga

SEQ ID NO: 30004 - DNA, 37 bp, Artificial Sequence
  Synthetic oligonucleotide
gcacacttcgcgcctcatcccaactgcataccggtga

SEQ ID NO: 30005 - DNA, 37 bp, Artificial Sequence
  Synthetic oligonucleotide
gctcaacgccggtacgtacttttcgcttcattggtga

SEQ ID NO: 30006 - DNA, 38 bp, Artificial Sequence
  Synthetic oligonucleotide
gccgcgcgcattgcgttggctctttcgtctttccttga

SEQ ID NO: 30007 - DNA, 37 bp, Artificial Sequence
  Synthetic oligonucleotide
gatatccacacccgtatagtacctgccacggagttga

SEQ ID NO: 30008 - DNA, 35 bp, Artificial Sequence
  Synthetic oligonucleotide
gaccctccactgtgcactatgactttgtagtccac

SEQ ID NO: 30009 - DNA, 35 bp, Artificial Sequence
  Synthetic oligonucleotide
tttgacgccatgcaggcgtttctcaatacactacc

SEQ ID NO: 30010 - DNA, 35 bp, Artificial Sequence
  Synthetic oligonucleotide
aaatccatcccacgccacctaagacctgccgcgcc

SEQ ID NO: 30011 - DNA, 35 bp, Artificial Sequence
  Synthetic oligonucleotide
ttctcgctgccacttagtgcactatcttcccgagg

SEQ ID NO: 30012 - DNA, 35 bp, Artificial Sequence
  Synthetic oligonucleotide
gtagaagcctcctgacttgctccatcacccttcgg

SEQ ID NO: 30013 - DNA, 35 bp, Artificial Sequence
  Synthetic oligonucleotide
ttgagcctcactctgaacgccacacttctttcctg

SEQ ID NO: 30014 - DNA, 36 bp, Artificial Sequence
  Synthetic oligonucleotide
aatgagtaggctggggaagggagggggatatcaaga

SEQ ID NO: 30015 - DNA, 36 bp, Artificial Sequence
  Synthetic oligonucleotide
gccgttccctctcgatttgcttaccgtactttcaga

SEQ ID NO: 30016 - DNA, 37 bp, Artificial Sequence
  Synthetic oligonucleotide
tgatcgccgcccattccgtcatcggaaccatctgcga

SEQ ID NO: 30017 - DNA, 36 bp, Artificial Sequence
  Synthetic oligonucleotide
aagacgtggtacgggaggatgggatgttaggtggga

SEQ ID NO: 30018 - DNA, 38 bp, Artificial Sequence
  Synthetic oligonucleotide
gcccccatcgaccggtggaatttcgcttttacccctga

SEQ ID NO: 30019 - DNA, 38 bp, Artificial Sequence
  Synthetic oligonucleotide
gcctgccgccgtagggaaccaacctagcccttgcctga

SEQ ID NO: 30020 - DNA, 37 bp, Artificial Sequence
  Synthetic oligonucleotide
tgcctaccccatgacgagaagttgcacttcttcctga

SEQ ID NO: 30021 - DNA, 37 bp, Artificial Sequence
  Synthetic oligonucleotide
gcatagcatgtgtcgccgtatttccctcaccttgtga

SEQ ID NO: 30022 - DNA, 37 bp, Artificial Sequence
  Synthetic oligonucleotide
gacttgaccgcatatatcttgccacttccctgattga

SEQ ID NO: 30023 - DNA, 36 bp, Artificial Sequence
  Synthetic oligonucleotide
gacctgttcactaagccccgccccacttctcgggta

SEQ ID NO: 30024 - DNA, 35 bp, Artificial Sequence
  Synthetic oligonucleotide
actcgctcgcctcgttcgtgcgcattgtccaccgc

SEQ ID NO: 30025 - DNA, 35 bp, Artificial Sequence
  Synthetic oligonucleotide
tgcctatccactcaagagtatgccacccgtcttcg

SEQ ID NO: 30026 - DNA, 35 bp, Artificial Sequence
  Synthetic oligonucleotide
taccgagacgccactcgcccctttgagcccgcttg

SEQ ID NO: 30027 - DNA, 35 bp, Artificial Sequence
  Synthetic oligonucleotide
acagccaagccctttctgtttcacccgttgtgact

SEQ ID NO: 30028 - DNA, 36 bp, Artificial Sequence
  Synthetic oligonucleotide
ggacaggcccttctctgttagtctcggtcttgccaa

SEQ ID NO: 30029 - DNA, 36 bp, Artificial Sequence
  Synthetic oligonucleotide
atgcagtgcgcgcattgctcatctgtctcatccgaa

SEQ ID NO: 30030 - DNA, 36 bp, Artificial Sequence
  Synthetic oligonucleotide
acgatccccgtatgctgaaaccaaacgccctccgca

SEQ ID NO: 30031 - DNA, 37 bp, Artificial Sequence
  Synthetic oligonucleotide
gccctgctaccgtttgtctcactttgtgccctttaga

SEQ ID NO: 30032 - DNA, 36 bp, Artificial Sequence
  Synthetic oligonucleotide
gcaacgcaactcaactcacacctcaggtcatatcga

SEQ ID NO: 30033 - DNA, 37 bp, Artificial Sequence
  Synthetic oligonucleotide
tggggagggggttcgaggcatctaggagcttggggga

SEQ ID NO: 30034 - DNA, 36 bp, Artificial Sequence
  Synthetic oligonucleotide
ttaagtgcggaaggggaggagcctaaaggggtggga

SEQ ID NO: 30035 - DNA, 37 bp, Artificial Sequence
  Synthetic oligonucleotide
taaacccccagccgcctgcctcgtccgcggtagtgga

SEQ ID NO: 30036 - DNA, 38 bp, Artificial Sequence
  Synthetic oligonucleotide
ttgtacacccgctctcccgtatgccggaccataactga

SEQ ID NO: 30037 - DNA, 35 bp, Artificial Sequence
  Synthetic oligonucleotide
tcacggaagatatgtgaccatgttcgtctccctcc

SEQ ID NO: 30038 - DNA, 35 bp, Artificial Sequence
  Synthetic oligonucleotide
gtagtgccacctatttcgtatgttccgcttcctcc

SEQ ID NO: 30039 - DNA, 35 bp, Artificial Sequence
  Synthetic oligonucleotide
accgagctggcgcacctgtcttcctaattcaccag

SEQ ID NO: 30040 - DNA, 35 bp, Artificial Sequence
  Synthetic oligonucleotide
tcccgctgcctgtagggctacaccccttattgcat

SEQ ID NO: 30041 - DNA, 36 bp, Artificial Sequence
  Synthetic oligonucleotide
accgtaccccagagtgctccacctattccgccaaca

SEQ ID NO: 30042 - DNA, 36 bp, Artificial Sequence
  Synthetic oligonucleotide
gccctgaccatcattattctttaacggagtggttca

SEQ ID NO: 30043 - DNA, 37 bp, Artificial Sequence
  Synthetic oligonucleotide
gagccatttccgccatgtgctttccatctttcccaga

SEQ ID NO: 30044 - DNA, 37 bp, Artificial Sequence
  Synthetic oligonucleotide
gtggggaggggtgtggtagggtgccactggagccaga

SEQ ID NO: 30045 - DNA, 36 bp, Artificial Sequence
  Synthetic oligonucleotide
gtgacatctcacatttgatagcctttgccctctaga

SEQ ID NO: 30046 - DNA, 35 bp, Artificial Sequence
  Synthetic oligonucleotide
aaggggggttcggtatggttagggttaaaggtgga

SEQ ID NO: 30047 - DNA, 35 bp, Artificial Sequence
  Synthetic oligonucleotide
tatgaactgtcctgaagcggggaaacaaatccatc

SEQ ID NO: 30048 - DNA, 35 bp, Artificial Sequence
  Synthetic oligonucleotide
ggaggctactgcgtgcatcgggcccgtctttcttc

SEQ ID NO: 30049 - DNA, 35 bp, Artificial Sequence
  Synthetic oligonucleotide
tgaaggggacccgggttgggtactaagtgggggag

SEQ ID NO: 30050 - DNA, 35 bp, Artificial Sequence
  Synthetic oligonucleotide
gaaataggggggaggtgtacattgtcgtgggggcg

SEQ ID NO: 30051 - DNA, 35 bp, Artificial Sequence
  Synthetic oligonucleotide
aaggtggggtagaatgctggacaagggtggggttg

SEQ ID NO: 30052 - DNA, 35 bp, Artificial Sequence
  Synthetic oligonucleotide
cctgcactcgaggagatgcgtaggtcagttttttg

SEQ ID NO: 30053 - DNA, 35 bp, Artificial Sequence
  Synthetic oligonucleotide
gacccccactcagaacaggatttaccggcaaaatt

SEQ ID NO: 30054 - DNA, 35 bp, Artificial Sequence
  Synthetic oligonucleotide
tccccccgcaacttttgcactcttgctgcctaatt

SEQ ID NO: 30055 - DNA, 35 bp, Artificial Sequence
  Synthetic oligonucleotide
tccgcccccaaatgatttcttgcaggcaaaaccaa

SEQ ID NO: 30056 - DNA, 35 bp, Artificial Sequence
  Synthetic oligonucleotide
tatgtgcggacgggcaaggtattggggggcggcaa

SEQ ID NO: 30057 - DNA, 35 bp, Artificial Sequence
  Synthetic oligonucleotide
attagcgctcccattgactctagcgtcactcacca

SEQ ID NO: 30058 - DNA, 36 bp, Artificial Sequence
  Synthetic oligonucleotide
acttccagcaccatccgacactgcggttaccatgca

SEQ ID NO: 30059 - DNA, 36 bp, Artificial Sequence
  Synthetic oligonucleotide
gccacctcgtagacccctgctgtttcttagcctgca

SEQ ID NO: 30060 - DNA, 36 bp, Artificial Sequence
  Synthetic oligonucleotide
tgcccaacgctaatctgtacttcagtctgtacctca

SEQ ID NO: 30061 - DNA, 37 bp, Artificial Sequence
  Synthetic oligonucleotide
gacatctcgccccatttgtcgctcctccggctacgga

SEQ ID NO: 30062 - DNA, 38 bp, Artificial Sequence
  Synthetic oligonucleotide
acacaccacagtacgcactataagtcagtccccgatga

SEQ ID NO: 30063 - DNA, 38 bp, Artificial Sequence
  Synthetic oligonucleotide
gcacccctctgtttgaatctgttcgcactcctatctga

SEQ ID NO: 30064 - DNA, 37 bp, Artificial Sequence
  Synthetic oligonucleotide
atgatgccggcctgacttcgctcctcacctccagtga

SEQ ID NO: 30065 - DNA, 36 bp, Artificial Sequence
  Synthetic oligonucleotide
tgttcatccagactttattgcccggtaacccacata

SEQ ID NO: 30066 - DNA, 36 bp, Artificial Sequence
  Synthetic oligonucleotide
taggtccggaaaagggggtggttgaaagtaggtata

SEQ ID NO: 30067 - DNA, 36 bp, Artificial Sequence
  Synthetic oligonucleotide
aacacaccccgcattgactgagcgtacacgcacgta

SEQ ID NO: 30068 - DNA, 35 bp, Artificial Sequence
  Synthetic oligonucleotide
gccgcccacattccctgcgcccttccgaagtcccc

SEQ ID NO: 30069 - DNA, 35 bp, Artificial Sequence
  Synthetic oligonucleotide
acaactgcagcgaagtcgtcgtccgcaacccctcc

SEQ ID NO: 30070 - DNA, 34 bp, Artificial Sequence
  Synthetic oligonucleotide
gctctgccacctcagttcacaaactcatctaggc

SEQ ID NO: 30071 - DNA, 35 bp, Artificial Sequence
  Synthetic oligonucleotide
ttgcaccctcacttgccttctagtgatctcttgtc

SEQ ID NO: 30072 - DNA, 35 bp, Artificial Sequence
  Synthetic oligonucleotide
gcacgtaagctcgacgcgcctgacattcttctttc

SEQ ID NO: 30073 - DNA, 35 bp, Artificial Sequence
  Synthetic oligonucleotide
gccatcacagccatccatgtgccttaatagttctg

SEQ ID NO: 30074 - DNA, 35 bp, Artificial Sequence
  Synthetic oligonucleotide
aaagagcgctagcgatgtcctcattcacactccat

SEQ ID NO: 30075 - DNA, 35 bp, Artificial Sequence
  Synthetic oligonucleotide
gttcacagccgtacagaacctcgcagaaaccctct

SEQ ID NO: 30076 - DNA, 35 bp, Artificial Sequence
  Synthetic oligonucleotide
gcgattccttaccatcagttgttcatccttgcctt

SEQ ID NO: 30077 - DNA, 35 bp, Artificial Sequence
  Synthetic oligonucleotide
aaccctctgtcctgggcttattcgcctaatgcttt

SEQ ID NO: 30078 - DNA, 36 bp, Artificial Sequence
  Synthetic oligonucleotide
taccaactccgtttggctacctacgtactattacaa

SEQ ID NO: 30079 - DNA, 35 bp, Artificial Sequence
  Synthetic oligonucleotide
acacgtgcaaccctgcgccggctaatacctctcaa

SEQ ID NO: 30080 - DNA, 35 bp, Artificial Sequence
  Synthetic oligonucleotide
attccccacaggctcggtgacgcgagtcttcctca

SEQ ID NO: 30081 - DNA, 37 bp, Artificial Sequence
  Synthetic oligonucleotide
gtgatgccccacgctacccctggacgttatttaccga

SEQ ID NO: 30082 - DNA, 37 bp, Artificial Sequence
  Synthetic oligonucleotide
gaggaacgggagtacacgggggggaggaggaggccga

SEQ ID NO: 30083 - DNA, 37 bp, Artificial Sequence
  Synthetic oligonucleotide
tcacaccgtagcctttggcagacccctaatcaatcga

SEQ ID NO: 30084 - DNA, 37 bp, Artificial Sequence
  Synthetic oligonucleotide
aacacaaccgactctatggaattcttgctactctcga

SEQ ID NO: 30085 - DNA, 35 bp, Artificial Sequence
  Synthetic oligonucleotide
acttacacccgggcgcaataggtacttcttaccta

SEQ ID NO: 30086 - DNA, 35 bp, Artificial Sequence
  Synthetic oligonucleotide
gctcctgtcccctcccgtttttagaaacgctctac

SEQ ID NO: 30087 - DNA, 35 bp, Artificial Sequence
  Synthetic oligonucleotide
atgtcaccatccctagtttcttagttgtacgactc

SEQ ID NO: 30088 - DNA, 35 bp, Artificial Sequence
  Synthetic oligonucleotide
gcctgccattcttcagacccctgttcctacacgcg

SEQ ID NO: 30089 - DNA, 35 bp, Artificial Sequence
  Synthetic oligonucleotide
agttgggagcgggagagggcgggtgtcggttgatt

SEQ ID NO: 30090 - DNA, 35 bp, Artificial Sequence
  Synthetic oligonucleotide
gcaatcactccgccgtccagctacaagcgcacctt

SEQ ID NO: 30091 - DNA, 35 bp, Artificial Sequence
  Synthetic oligonucleotide
tctgctccatcctcaggtcaccttcgatatgccaa

SEQ ID NO: 30092 - DNA, 36 bp, Artificial Sequence
  Synthetic oligonucleotide
acatcttgtaccagaaccgtgcttggccatttcgaa

SEQ ID NO: 30093 - DNA, 36 bp, Artificial Sequence
  Synthetic oligonucleotide
tacctaacccaagttcaacaagatcacggggtaaca

SEQ ID NO: 30094 - DNA, 35 bp, Artificial Sequence
  Synthetic oligonucleotide
gccgccaggccggttgtccctatcctgacccttca

SEQ ID NO: 30095 - DNA, 35 bp, Artificial Sequence
  Synthetic oligonucleotide
gaagggatggtgagaaatgggcggtagtgcgttca

SEQ ID NO: 30096 - DNA, 35 bp, Artificial Sequence
  Synthetic oligonucleotide
gaccccctgccctacagtatcatccgatacccaga

SEQ ID NO: 30097 - DNA, 37 bp, Artificial Sequence
  Synthetic oligonucleotide
acgtagcacgtagcattttacccccacgcctccatga

SEQ ID NO: 30098 - DNA, 37 bp, Artificial Sequence
  Synthetic oligonucleotide
tcacccgaagaagaagtacgatccttgcccttcctga

SEQ ID NO: 30099 - DNA, 35 bp, Artificial Sequence
  Synthetic oligonucleotide
aagtacacccacgtcaggtacccacccaacacgcc

SEQ ID NO: 30100 - DNA, 35 bp, Artificial Sequence
  Synthetic oligonucleotide
tagccggcacagctctgctcctcctagaagtttcc

SEQ ID NO: 30101 - DNA, 35 bp, Artificial Sequence
  Synthetic oligonucleotide
gacatactagcaccactgtgcttaccccgcttatc

SEQ ID NO: 30102 - DNA, 34 bp, Artificial Sequence
  Synthetic oligonucleotide
gtcaatgcgtgcctctcgccctcgacactgaaca

SEQ ID NO: 30103 - DNA, 36 bp, Artificial Sequence
  Synthetic oligonucleotide
atgtagatcactacatccggccccaattgccctgca

SEQ ID NO: 30104 - DNA, 36 bp, Artificial Sequence
  Synthetic oligonucleotide
tcccctcacggccaatcctctcgtagatctacatca

SEQ ID NO: 30105 - DNA, 37 bp, Artificial Sequence
  Synthetic oligonucleotide
acaccacccgcaatcacaactagtcactgctaataga

SEQ ID NO: 30106 - DNA, 37 bp, Artificial Sequence
  Synthetic oligonucleotide
agcccgcctactctgctacacgcacatgaatcctcga

SEQ ID NO: 30107 - DNA, 37 bp, Artificial Sequence
  Synthetic oligonucleotide
tgtgagcccatcgtgcctcctccatctgttgatcgga

SEQ ID NO: 30108 - DNA, 38 bp, Artificial Sequence
  Synthetic oligonucleotide
gcatcacgccagaccaactctgaccgccaatgccctga

SEQ ID NO: 30109 - DNA, 36 bp, Artificial Sequence
  Synthetic oligonucleotide
gacaagctggacggggaggtaatatgactggggata

SEQ ID NO: 30110 - DNA, 35 bp, Artificial Sequence
  Synthetic oligonucleotide
tagtgctgctctttcgggtcccggtgcgcttgccc

SEQ ID NO: 30111 - DNA, 35 bp, Artificial Sequence
  Synthetic oligonucleotide
gtagacacagtgattttggtgtctcgatcttcctc

SEQ ID NO: 30112 - DNA, 35 bp, Artificial Sequence
  Synthetic oligonucleotide
gccttggcgctgaaccctccgaccgtaaccgtgtc

SEQ ID NO: 30113 - DNA, 35 bp, Artificial Sequence
  Synthetic oligonucleotide
taacgtcaggctgattctgtctccgctctctgttc

SEQ ID NO: 30114 - DNA, 35 bp, Artificial Sequence
  Synthetic oligonucleotide
gcctcccacacgcaatggccccagaaaactgaccg

SEQ ID NO: 30115 - DNA, 35 bp, Artificial Sequence
  Synthetic oligonucleotide
taactgcaccccactatagctgacccgcttgggct

SEQ ID NO: 30116 - DNA, 35 bp, Artificial Sequence
  Synthetic oligonucleotide
agtgatgcgcgggaggtcctgtgcaggcggggggt

SEQ ID NO: 30117 - DNA, 35 bp, Artificial Sequence
  Synthetic oligonucleotide
ttctacgctcgacctcccgtcttgtacgctcccca

SEQ ID NO: 30118 - DNA, 37 bp, Artificial Sequence
  Synthetic oligonucleotide
gtttgggtgggtaggatctggagtgcgggggcggaga

SEQ ID NO: 30119 - DNA, 37 bp, Artificial Sequence
  Synthetic oligonucleotide
gagaccagaggtgtcggcggaagatgaggaatcggga

SEQ ID NO: 30120 - DNA, 36 bp, Artificial Sequence
  Synthetic oligonucleotide
taagagatacaagtggcggaaaggaggatgggggga

SEQ ID NO: 30121 - DNA, 37 bp, Artificial Sequence
  Synthetic oligonucleotide
agcacccacttgacgtgtaacacgcaccctatactga

SEQ ID NO: 30122 - DNA, 38 bp, Artificial Sequence
  Synthetic oligonucleotide
tccatctacaccaggacggccatcatgctacctcttga

SEQ ID NO: 30123 - DNA, 37 bp, Artificial Sequence
  Synthetic oligonucleotide
gactatatccgccgcccatcttccgctttggctttga

SEQ ID NO: 30124 - DNA, 36 bp, Artificial Sequence
  Synthetic oligonucleotide
gcagacctcagcgatatcgaattcaccggccccgta

SEQ ID NO: 30125 - DNA, 35 bp, Artificial Sequence
  Synthetic oligonucleotide
gagcgccgcctttgaccttctatttgtcgaatcac

SEQ ID NO: 30126 - DNA, 35 bp, Artificial Sequence
  Synthetic oligonucleotide
ccgtggctcgccgtagctttggttttgttctgtcc

SEQ ID NO: 30127 - DNA, 35 bp, Artificial Sequence
  Synthetic oligonucleotide
tcgtggccccccgttcgaaggggtgaaaactcctc

SEQ ID NO: 30128 - DNA, 35 bp, Artificial Sequence
  Synthetic oligonucleotide
tgcatgcatggggtattcgtctttctgtttgcgtg

SEQ ID NO: 30129 - DNA, 35 bp, Artificial Sequence
  Synthetic oligonucleotide
tagttcggctcacttcctcctttccggcacccaat

SEQ ID NO: 30130 - DNA, 35 bp, Artificial Sequence
  Synthetic oligonucleotide
gacaagctgcccagccggcttacttccctctcttt

SEQ ID NO: 30131 - DNA, 35 bp, Artificial Sequence
  Synthetic oligonucleotide
ttgactcggctttccctgcttccttcctgggtttt

SEQ ID NO: 30132 - DNA, 36 bp, Artificial Sequence
  Synthetic oligonucleotide
gatgcgtttcatgtcctcgtcctttcgtctttacca

SEQ ID NO: 30133 - DNA, 36 bp, Artificial Sequence
  Synthetic oligonucleotide
gcacacagacccggaaagtctgtgtcaaccatctca

SEQ ID NO: 30134 - DNA, 36 bp, Artificial Sequence
  Synthetic oligonucleotide
atacgcccgtcttcgtctaccttttgcgtcatttca

SEQ ID NO: 30135 - DNA, 36 bp, Artificial Sequence
  Synthetic oligonucleotide
aactcgtgagaggaacctacccgcccatccatcgga

SEQ ID NO: 30136 - DNA, 38 bp, Artificial Sequence
  Synthetic oligonucleotide
tccgcggtcacgttgattgttccccccttccatcctga

SEQ ID NO: 30137 - DNA, 37 bp, Artificial Sequence
  Synthetic oligonucleotide
agacgtcgaccacctgttcttatggcttaccctgtga

SEQ ID NO: 30138 - DNA, 36 bp, Artificial Sequence
  Synthetic oligonucleotide
tcacgggggagggttcacggggcatgtgatgattga

SEQ ID NO: 30139 - DNA, 37 bp, Artificial Sequence
  Synthetic oligonucleotide
acactcgccccaactggctttacaagagccatattga

SEQ ID NO: 30140 - DNA, 37 bp, Artificial Sequence
  Synthetic oligonucleotide
taagcctctccgcctttattgtgtctctctccgttga

SEQ ID NO: 30141 - DNA, 38 bp, Artificial Sequence
  Synthetic oligonucleotide
gcacgccgcaaccaagccacattttaacgcgtatttga

SEQ ID NO: 30142 - DNA, 35 bp, Artificial Sequence
  Synthetic oligonucleotide
tccacctgcctcacccggacacatactcgccctta

SEQ ID NO: 30143 - DNA, 35 bp, Artificial Sequence
  Synthetic oligonucleotide
accaccgactatcctctcatggctacgaaccttta

SEQ ID NO: 30144 - DNA, 35 bp, Artificial Sequence
  Synthetic oligonucleotide
tgcactcggtacagccagtacttccccgtactatc

SEQ ID NO: 30145 - DNA, 35 bp, Artificial Sequence
  Synthetic oligonucleotide
gttaatcactcgccccccattctgttcggttatcg

SEQ ID NO: 30146 - DNA, 35 bp, Artificial Sequence
  Synthetic oligonucleotide
agaaacggcccctgttctatcacccttgtagccat

SEQ ID NO: 30147 - DNA, 35 bp, Artificial Sequence
  Synthetic oligonucleotide
acagatccatgctcactacccggtatctcgcacct

SEQ ID NO: 30148 - DNA, 35 bp, Artificial Sequence
  Synthetic oligonucleotide
gttgcacttcgctccgcccttttcctgattgtggt

SEQ ID NO: 30149 - DNA, 36 bp, Artificial Sequence
  Synthetic oligonucleotide
tgatgaccgaaccgctatttgctgtaagctcccgaa

SEQ ID NO: 30150 - DNA, 36 bp, Artificial Sequence
  Synthetic oligonucleotide
gtgatcgtcctctgtcttatatcgcgcccccgacca

SEQ ID NO: 30151 - DNA, 35 bp, Artificial Sequence
  Synthetic oligonucleotide
atagacacgcctgacgccgaaaacgaccctaagca

SEQ ID NO: 30152 - DNA, 37 bp, Artificial Sequence
  Synthetic oligonucleotide
ttaccctcacgaacatacacgtccctttcccggtgga

SEQ ID NO: 30153 - DNA, 38 bp, Artificial Sequence
  Synthetic oligonucleotide
acgattgcctccattggttacgcgtactccttcactga

SEQ ID NO: 30154 - DNA, 37 bp, Artificial Sequence
  Synthetic oligonucleotide
gagaggtaagggcggttgaaacggtggagctgagtga

SEQ ID NO: 30155 - DNA, 38 bp, Artificial Sequence
  Synthetic oligonucleotide
acccgccccctcccagtcgctgctctcagtagacgtga

SEQ ID NO: 30156 - DNA, 35 bp, Artificial Sequence
  Synthetic oligonucleotide
gacctacgggggtaaaaacattcaaaggggtggac

SEQ ID NO: 30157 - DNA, 35 bp, Artificial Sequence
  Synthetic oligonucleotide
tccacccacatcgagcattaagctgatcaggcacc

SEQ ID NO: 30158 - DNA, 35 bp, Artificial Sequence
  Synthetic oligonucleotide
aacgcagccccgctacctttgtctttaagccttgc

SEQ ID NO: 30159 - DNA, 35 bp, Artificial Sequence
  Synthetic oligonucleotide
tccactggcaccatacctgtttgaaatgcttgcct

SEQ ID NO: 30160 - DNA, 35 bp, Artificial Sequence
  Synthetic oligonucleotide
gttccctcaccgtgcgttctcatcattctcgactt

SEQ ID NO: 30161 - DNA, 36 bp, Artificial Sequence
  Synthetic oligonucleotide
agtacccggtctccaacagttcgctgctaggccaaa

SEQ ID NO: 30162 - DNA, 35 bp, Artificial Sequence
  Synthetic oligonucleotide
agtcctcccgcctgccccgtttagcattccggaaa

SEQ ID NO: 30163 - DNA, 36 bp, Artificial Sequence
  Synthetic oligonucleotide
atcgccccgtaagttctccccacttgatcgcaccaa

SEQ ID NO: 30164 - DNA, 37 bp, Artificial Sequence
  Synthetic oligonucleotide
tgaccccgcctccctgctttattggcgcattaccgga

SEQ ID NO: 30165 - DNA, 37 bp, Artificial Sequence
  Synthetic oligonucleotide
gggggtggggaaaggggttgtaacagcacaacaggga

SEQ ID NO: 30166 - DNA, 37 bp, Artificial Sequence
  Synthetic oligonucleotide
gcgagggcaatgggaggggccaaggcgggatatctga

SEQ ID NO: 30167 - DNA, 38 bp, Artificial Sequence
  Synthetic oligonucleotide
gcccaccgaaggggcccactcccatttcatcctattga

SEQ ID NO: 30168 - DNA, 37 bp, Artificial Sequence
  Synthetic oligonucleotide
atgcccctccccacacttagtgggttactcctgttga

SEQ ID NO: 30169 - DNA, 36 bp, Artificial Sequence
  Synthetic oligonucleotide
tcaccataaacagggcgttacaagtcccatctcgta

SEQ ID NO: 30170 - DNA, 36 bp, Artificial Sequence
  Synthetic oligonucleotide
gagggtgggcgtgtgagggggatgacgggtcatgta

SEQ ID NO: 30171 - DNA, 35 bp, Artificial Sequence
  Synthetic oligonucleotide
gtgacatccccatcgacgtcgcccggaggccctta

SEQ ID NO: 30172 - DNA, 36 bp, Artificial Sequence
  Synthetic oligonucleotide
tgcgataacccgctaatctcctcccgctcgcgctta

SEQ ID NO: 30173 - DNA, 35 bp, Artificial Sequence
  Synthetic oligonucleotide
atcaccacatatggcgcgcgacccccccgagttta

SEQ ID NO: 30174 - DNA, 35 bp, Artificial Sequence
  Synthetic oligonucleotide
gcctgccggcgagccgctcgtctttttggctacac

SEQ ID NO: 30175 - DNA, 35 bp, Artificial Sequence
  Synthetic oligonucleotide
gtagtgcacgtccggctttcccagcaatacactac

SEQ ID NO: 30176 - DNA, 34 bp, Artificial Sequence
  Synthetic oligonucleotide
actgatccgactaaagctgacgtcctttctctcc

SEQ ID NO: 30177 - DNA, 38 bp, Artificial Sequence
  Synthetic oligonucleotide
acacaggcgccaaccatcgtaaacatcctgtattctga

SEQ ID NO: 30178 - DNA, 38 bp, Artificial Sequence
  Synthetic oligonucleotide
gccgcctacaccactgccggtccaattcagtcacgtga

SEQ ID NO: 30179 - DNA, 38 bp, Artificial Sequence
  Synthetic oligonucleotide
tccgaatggaacgatgggagggtgaaggagcgatgtga

SEQ ID NO: 30180 - DNA, 35 bp, Artificial Sequence
  Synthetic oligonucleotide
acactaaccacatcccgtggacgaacactgtaata

SEQ ID NO: 30181 - DNA, 36 bp, Artificial Sequence
  Synthetic oligonucleotide
accacctgtgctgacattgaattcatcttcgtacta

SEQ ID NO: 30182 - DNA, 36 bp, Artificial Sequence
  Synthetic oligonucleotide
gacttgccccaattttgcctcgccgtctataagcta

SEQ ID NO: 30183 - DNA, 35 bp, Artificial Sequence
  Synthetic oligonucleotide
tgcatagaggagggggatcacaggaatagaagtag

SEQ ID NO: 30184 - DNA, 35 bp, Artificial Sequence
  Synthetic oligonucleotide
acgcgaaggcctcggttccaactattttctgtgct

SEQ ID NO: 30185 - DNA, 35 bp, Artificial Sequence
  Synthetic oligonucleotide
gaccgcggtggcgttgcctataacctttctttcgt

SEQ ID NO: 30186 - DNA, 36 bp, Artificial Sequence
  Synthetic oligonucleotide
accgccaccagcattccagaaaagacgttcactcca

SEQ ID NO: 30187 - DNA, 35 bp, Artificial Sequence
  Synthetic oligonucleotide
atcatcctgcaacaacccgcgctcaaactcgagca

SEQ ID NO: 30188 - DNA, 36 bp, Artificial Sequence
  Synthetic oligonucleotide
acctgaacggacaggggagcagtgagaaggggtgca

SEQ ID NO: 30189 - DNA, 36 bp, Artificial Sequence
  Synthetic oligonucleotide
ttagcatccaatgcctcaacccacctcgtgcttgca

SEQ ID NO: 30190 - DNA, 38 bp, Artificial Sequence
  Synthetic oligonucleotide
ggagcgaggggtgggaatataggggggcaccaggctga

SEQ ID NO: 30191 - DNA, 38 bp, Artificial Sequence
  Synthetic oligonucleotide
agttccgccattgccgcgcccatcccgcccctgggtga

SEQ ID NO: 30192 - DNA, 36 bp, Artificial Sequence
  Synthetic oligonucleotide
ttgtggtaccgctgcgacacatggcctcctttcgta

SEQ ID NO: 30193 - DNA, 36 bp, Artificial Sequence
  Synthetic oligonucleotide
tctccagccgtatatagtcccaccgatgctgcctta

SEQ ID NO: 30194 - DNA, 28 bp, Artificial Sequence
  Synthetic oligonucleotide
acacccagtcgggaacacacgtgccatc

SEQ ID NO: 30195 - DNA, 35 bp, Artificial Sequence
  Synthetic oligonucleotide
atgacatcaccgcacactgcgtttccgaactcatc

SEQ ID NO: 30196 - DNA, 35 bp, Artificial Sequence
  Synthetic oligonucleotide
gcactgacccatatgcgttcccgcctctaaatgtc

SEQ ID NO: 30197 - DNA, 35 bp, Artificial Sequence
  Synthetic oligonucleotide
tgccaccggccctgaatgcccagctacatccttcg

SEQ ID NO: 30198 - DNA, 35 bp, Artificial Sequence
  Synthetic oligonucleotide
gaactgcgcctggtaatagtccgccgcccccccct

SEQ ID NO: 30199 - DNA, 36 bp, Artificial Sequence
  Synthetic oligonucleotide
tccagcccctcaaatcgctctagtatagtcactggt

SEQ ID NO: 30200 - DNA, 36 bp, Artificial Sequence
  Synthetic oligonucleotide
tcgtcccctcacttcgcttaattggttcggtccaca

SEQ ID NO: 30201 - DNA, 35 bp, Artificial Sequence
  Synthetic oligonucleotide
gtctcagtcaccgattcttcatttgcgcctgtaca

SEQ ID NO: 30202 - DNA, 36 bp, Artificial Sequence
  Synthetic oligonucleotide
tctgcccgattgcctgtgaccccgccgcatcgacca

SEQ ID NO: 30203 - DNA, 37 bp, Artificial Sequence
  Synthetic oligonucleotide
tgacacgggttaatgggggggattgccgggattagga

SEQ ID NO: 30204 - DNA, 37 bp, Artificial Sequence
  Synthetic oligonucleotide
ataggtgcccagaaggggggtacgggtgtggatggga

SEQ ID NO: 30205 - DNA, 37 bp, Artificial Sequence
  Synthetic oligonucleotide
gtcgcctcaacgctccctctcatcactctggactgga

SEQ ID NO: 30206 - DNA, 37 bp, Artificial Sequence
  Synthetic oligonucleotide
gttcactcgtctgctcctctacgtctcgtcctaatga

SEQ ID NO: 30207 - DNA, 35 bp, Artificial Sequence
  Synthetic oligonucleotide
tcgcccacacatatgatgctgctcccgacccctga

SEQ ID NO: 30208 - DNA, 38 bp, Artificial Sequence
  Synthetic oligonucleotide
gccactcaccacgcaataactagaactggtctccgtga

SEQ ID NO: 30209 - DNA, 37 bp, Artificial Sequence
  Synthetic oligonucleotide
gtcctgtacgtctcgcgctctcggcccacttttttga

SEQ ID NO: 30210 - DNA, 36 bp, Artificial Sequence
  Synthetic oligonucleotide
ttcctccacagtatcgcgtagctgcccgaccactta

SEQ ID NO: 30211 - DNA, 35 bp, Artificial Sequence
  Synthetic oligonucleotide
gtggccgccctccctcaaaggataccacgcccgcc

SEQ ID NO: 30212 - DNA, 35 bp, Artificial Sequence
  Synthetic oligonucleotide
acctacaacgcctgagcctgggcctctccgtttcc

SEQ ID NO: 30213 - DNA, 35 bp, Artificial Sequence
  Synthetic oligonucleotide
tgttgccgatccgcgccttcgctcccgcctcgagc

SEQ ID NO: 30214 - DNA, 35 bp, Artificial Sequence
  Synthetic oligonucleotide
aataactgcaccatcgccccggcttcattccgccg

SEQ ID NO: 30215 - DNA, 35 bp, Artificial Sequence
  Synthetic oligonucleotide
gtgagagaaaggtggtaggataagcggtgacggtg

SEQ ID NO: 30216 - DNA, 35 bp, Artificial Sequence
  Synthetic oligonucleotide
taactaagcatgacaacatgtgcctccccttccct

SEQ ID NO: 30217 - DNA, 35 bp, Artificial Sequence
  Synthetic oligonucleotide
tccctcaactgcaatgtccacgtctagcctcgcct

SEQ ID NO: 30218 - DNA, 35 bp, Artificial Sequence
  Synthetic oligonucleotide
tacgccctgcaaatgcttggtccacatttcctctt

SEQ ID NO: 30219 - DNA, 35 bp, Artificial Sequence
  Synthetic oligonucleotide
gcgtagcgccgtcggcctaattcgtaacgcacttt

SEQ ID NO: 30220 - DNA, 36 bp, Artificial Sequence
  Synthetic oligonucleotide
tcccacaacacaatatatagctgccatttacagtaa

SEQ ID NO: 30221 - DNA, 35 bp, Artificial Sequence
  Synthetic oligonucleotide
gtgggagagggcataagggaagggggtccaggtaa

SEQ ID NO: 30222 - DNA, 36 bp, Artificial Sequence
  Synthetic oligonucleotide
aacccgtacggagacgttttcgtccatttcgcccca

SEQ ID NO: 30223 - DNA, 36 bp, Artificial Sequence
  Synthetic oligonucleotide
tccacttccgttcgttcacttcagccccgcccttca

SEQ ID NO: 30224 - DNA, 38 bp, Artificial Sequence
  Synthetic oligonucleotide
tatgaggggggggttggtggaaatacaacaaggtatga

SEQ ID NO: 30225 - DNA, 38 bp, Artificial Sequence
  Synthetic oligonucleotide
agtgtgtcgctggcgggggtcaagggaaaggagggtga

SEQ ID NO: 30226 - DNA, 37 bp, Artificial Sequence
  Synthetic oligonucleotide
agctcagcccggctgtctatcatccttgcacctgtga

SEQ ID NO: 30227 - DNA, 38 bp, Artificial Sequence
  Synthetic oligonucleotide
ttccaacccaacctgtgagtgcactttccacatcttga

SEQ ID NO: 30228 - DNA, 38 bp, Artificial Sequence
  Synthetic oligonucleotide
actccacctcgataaagcactgctctacccccctttga

SEQ ID NO: 30229 - DNA, 34 bp, Artificial Sequence
  Synthetic oligonucleotide
aacgtcgcgcgcgcacactccatcttcatccaac

SEQ ID NO: 30230 - DNA, 35 bp, Artificial Sequence
  Synthetic oligonucleotide
gttacaacccactggacttgctttctatgagatcc

SEQ ID NO: 30231 - DNA, 35 bp, Artificial Sequence
  Synthetic oligonucleotide
acacccattatccattgagatccattccacggttc

SEQ ID NO: 30232 - DNA, 35 bp, Artificial Sequence
  Synthetic oligonucleotide
gtcatcacgctcggacgcccatgctcacactctgg

SEQ ID NO: 30233 - DNA, 36 bp, Artificial Sequence
  Synthetic oligonucleotide
attacaccctcccgccaaggccgcctgcggaccgtt

SEQ ID NO: 30234 - DNA, 35 bp, Artificial Sequence
  Synthetic oligonucleotide
tagcacaatgcgtggccgggctagcttccaccttt

SEQ ID NO: 30235 - DNA, 36 bp, Artificial Sequence
  Synthetic oligonucleotide
atctacgcggaatgatcgctgctgccccccgataaa

SEQ ID NO: 30236 - DNA, 36 bp, Artificial Sequence
  Synthetic oligonucleotide
tcccctgtcgttggtatcatcctgcctgaaccgcaa

SEQ ID NO: 30237 - DNA, 37 bp, Artificial Sequence
  Synthetic oligonucleotide
acaccacgccaaattgagttcaccaccgcgatgccga

SEQ ID NO: 30238 - DNA, 38 bp, Artificial Sequence
  Synthetic oligonucleotide
gcaccctgtcttcccacccgcctaagtattccgcgtga

SEQ ID NO: 30239 - DNA, 35 bp, Artificial Sequence
  Synthetic oligonucleotide
aaccatcgggcgctttctgtatgacttttctccac

SEQ ID NO: 30240 - DNA, 35 bp, Artificial Sequence
  Synthetic oligonucleotide
acccacgaccactcgccaccctagcttgttgtgcc

SEQ ID NO: 30241 - DNA, 35 bp, Artificial Sequence
  Synthetic oligonucleotide
tcagtcggttcctccttgtccacccccaacgacgc

SEQ ID NO: 30242 - DNA, 35 bp, Artificial Sequence
  Synthetic oligonucleotide
atcctgtcgagaggcccacctccccttggcccttc

SEQ ID NO: 30243 - DNA, 35 bp, Artificial Sequence
  Synthetic oligonucleotide
tcgtacgatcgccgcccactcaagtcacatcaaag

SEQ ID NO: 30244 - DNA, 35 bp, Artificial Sequence
  Synthetic oligonucleotide
tacatggccacacgtaagccacctcctcactctcg

SEQ ID NO: 30245 - DNA, 35 bp, Artificial Sequence
  Synthetic oligonucleotide
tcaagtcttcgccacatgtcaccgcccaataactg

SEQ ID NO: 30246 - DNA, 35 bp, Artificial Sequence
  Synthetic oligonucleotide
atattcaccgccactaactattctgcatgattcat

SEQ ID NO: 30247 - DNA, 35 bp, Artificial Sequence
  Synthetic oligonucleotide
ggagaatgggggtagtggggggagacaaactcgat

SEQ ID NO: 30248 - DNA, 35 bp, Artificial Sequence
  Synthetic oligonucleotide
tcaacaacgcactttccggcgcttcttccccatat

SEQ ID NO: 30249 - DNA, 35 bp, Artificial Sequence
  Synthetic oligonucleotide
tttgcccaccctcacctccatgagatttgccgctt

SEQ ID NO: 30250 - DNA, 35 bp, Artificial Sequence
  Synthetic oligonucleotide
aacaccacacgactaaggggcctttcgcccctgtt

SEQ ID NO: 30251 - DNA, 36 bp, Artificial Sequence
  Synthetic oligonucleotide
ttggggacagccccaacaaggggggtaggaggggaa

SEQ ID NO: 30252 - DNA, 36 bp, Artificial Sequence
  Synthetic oligonucleotide
tctagcctctagatcgcccaccttcttctcccagca

SEQ ID NO: 30253 - DNA, 37 bp, Artificial Sequence
  Synthetic oligonucleotide
atcgaaccacgtactcacactcatgtcgcactgacga

SEQ ID NO: 30254 - DNA, 34 bp, Artificial Sequence
  Synthetic oligonucleotide
gacgaacatcaccactcagagccgggtaccgcga

SEQ ID NO: 30255 - DNA, 35 bp, Artificial Sequence
  Synthetic oligonucleotide
actgccctacccgctttcatgtttttatcgatcga

SEQ ID NO: 30256 - DNA, 38 bp, Artificial Sequence
  Synthetic oligonucleotide
tagacccgccccggttcaaactcccagactggacatga

SEQ ID NO: 30257 - DNA, 38 bp, Artificial Sequence
  Synthetic oligonucleotide
gaatacgcatgagaatggaagagagtccaagggagtga

SEQ ID NO: 30258 - DNA, 38 bp, Artificial Sequence
  Synthetic oligonucleotide
tacctcgaccacatctcccggccactttcctgccgtga

SEQ ID NO: 30259 - DNA, 36 bp, Artificial Sequence
  Synthetic oligonucleotide
gaagcgccgaactctgaagcatcccaacacactcta

SEQ ID NO: 30260 - DNA, 36 bp, Artificial Sequence
  Synthetic oligonucleotide
acgtactcgtgcctgatcacccgctattttgtctta

SEQ ID NO: 30261 - DNA, 35 bp, Artificial Sequence
  Synthetic oligonucleotide
gtcagtccattatgtctcaacgccacagccaacac

SEQ ID NO: 30262 - DNA, 35 bp, Artificial Sequence
  Synthetic oligonucleotide
gccaaacccttgcctgaccacgccttagaccctag

SEQ ID NO: 30263 - DNA, 35 bp, Artificial Sequence
  Synthetic oligonucleotide
gccactaaagtgatttagtacccacgttgttcccg

SEQ ID NO: 30264 - DNA, 35 bp, Artificial Sequence
  Synthetic oligonucleotide
gacttacgtagtaagtacagtgctatcctttttcg

SEQ ID NO: 30265 - DNA, 35 bp, Artificial Sequence
  Synthetic oligonucleotide
acattcccatacgacagccgtggaagccctctctg

SEQ ID NO: 30266 - DNA, 35 bp, Artificial Sequence
  Synthetic oligonucleotide
gcccatcccccatgcgaccgcattgactttcagtg

SEQ ID NO: 30267 - DNA, 35 bp, Artificial Sequence
  Synthetic oligonucleotide
agagatcgcagcccaacggacgcaagcactatact

SEQ ID NO: 30268 - DNA, 35 bp, Artificial Sequence
  Synthetic oligonucleotide
agcaggagggaaatggctttgaaggtgatcggtgt

SEQ ID NO: 30269 - DNA, 35 bp, Artificial Sequence
  Synthetic oligonucleotide
gaacgcactgctacatctttgtcgtcccaatagtt

SEQ ID NO: 30270 - DNA, 36 bp, Artificial Sequence
  Synthetic oligonucleotide
aaccaacgccacacttcgggtaattgccatcgccaa

SEQ ID NO: 30271 - DNA, 36 bp, Artificial Sequence
  Synthetic oligonucleotide
tgacaaagggatctggaactatggggtgtggtcgca

SEQ ID NO: 30272 - DNA, 36 bp, Artificial Sequence
  Synthetic oligonucleotide
ttgccccggctccctgtcgtctcctagccggcatca

SEQ ID NO: 30273 - DNA, 35 bp, Artificial Sequence
  Synthetic oligonucleotide
gatcgctccaagctgactagcctcccgagaactca

SEQ ID NO: 30274 - DNA, 37 bp, Artificial Sequence
  Synthetic oligonucleotide
aacatcgatcaccgcccctcggccaccctgcatgaga

SEQ ID NO: 30275 - DNA, 36 bp, Artificial Sequence
  Synthetic oligonucleotide
gaaacccccgcctcaccttgtcgtccttctgataga

SEQ ID NO: 30276 - DNA, 37 bp, Artificial Sequence
  Synthetic oligonucleotide
ggggtaggtgaagaagtaggaggatatgaggcttaga

SEQ ID NO: 30277 - DNA, 37 bp, Artificial Sequence
  Synthetic oligonucleotide
acgcacactttgggactaagtggaggttagggatgga

SEQ ID NO: 30278 - DNA, 37 bp, Artificial Sequence
  Synthetic oligonucleotide
gcaacgggggagagggaggataaacggcggctatgga

SEQ ID NO: 30279 - DNA, 38 bp, Artificial Sequence
  Synthetic oligonucleotide
acgctcgctggtcgcatctagtccttgccatcccatga

SEQ ID NO: 30280 - DNA, 38 bp, Artificial Sequence
  Synthetic oligonucleotide
tgtcccgtcgaatttaccacaccactccctggccatga

SEQ ID NO: 30281 - DNA, 38 bp, Artificial Sequence
  Synthetic oligonucleotide
tcacgccaacacacgatattgcttccgtcattgtatga

SEQ ID NO: 30282 - DNA, 38 bp, Artificial Sequence
  Synthetic oligonucleotide
acccactacctcagacaagccgccctgcctgatactga

SEQ ID NO: 30283 - DNA, 38 bp, Artificial Sequence
  Synthetic oligonucleotide
tatgtcctatccgcaacagcagtgaccttccaccttga

SEQ ID NO: 30284 - DNA, 36 bp, Artificial Sequence
  Synthetic oligonucleotide
accctgccggatctcgggccttcactcgttgaccta

SEQ ID NO: 30285 - DNA, 35 bp, Artificial Sequence
  Synthetic oligonucleotide
tcactccgcctcatatactcggttgtctgcacgac

SEQ ID NO: 30286 - DNA, 35 bp, Artificial Sequence
  Synthetic oligonucleotide
gagggagtcccccggttttatgattcttcgttcgc

SEQ ID NO: 30287 - DNA, 35 bp, Artificial Sequence
  Synthetic oligonucleotide
gttgctaccggcattatggttatctcacgcgcctc

SEQ ID NO: 30288 - DNA, 35 bp, Artificial Sequence
  Synthetic oligonucleotide
gagtaacacccatgctctagaacagccagtggttg

SEQ ID NO: 30289 - DNA, 35 bp, Artificial Sequence
  Synthetic oligonucleotide
aaaaggaggggtggtagttgggaagtgacacggat

SEQ ID NO: 30290 - DNA, 35 bp, Artificial Sequence
  Synthetic oligonucleotide
acgtacccggctcactattcgttatacctgaatct

SEQ ID NO: 30291 - DNA, 35 bp, Artificial Sequence
  Synthetic oligonucleotide
tagtactccggccccagaatgcctaaacagtgctt

SEQ ID NO: 30292 - DNA, 36 bp, Artificial Sequence
  Synthetic oligonucleotide
accagagggcgactgacaaacaggggggagtagaaa

SEQ ID NO: 30293 - DNA, 35 bp, Artificial Sequence
  Synthetic oligonucleotide
gatctacacctcacatagtaacgtcacgcttacca

SEQ ID NO: 30294 - DNA, 35 bp, Artificial Sequence
  Synthetic oligonucleotide
ttgccacacccacgtttttattagtttctccgtca

SEQ ID NO: 30295 - DNA, 36 bp, Artificial Sequence
  Synthetic oligonucleotide
gtctcgccatttacaccacccgactttactcggtca

SEQ ID NO: 30296 - DNA, 37 bp, Artificial Sequence
  Synthetic oligonucleotide
gacgcaccactccatgtctttcttgttctcttatcga

SEQ ID NO: 30297 - DNA, 37 bp, Artificial Sequence
  Synthetic oligonucleotide
atacacacacgagtcgcataacgtactagttagtcga

SEQ ID NO: 30298 - DNA, 37 bp, Artificial Sequence
  Synthetic oligonucleotide
tatgcatcgactctgcctctcttccacttcccacgga

SEQ ID NO: 30299 - DNA, 36 bp, Artificial Sequence
  Synthetic oligonucleotide
aacaggagagcatgggtaaatggcatggggtaggga

SEQ ID NO: 30300 - DNA, 38 bp, Artificial Sequence
  Synthetic oligonucleotide
tgacattgtagggtggggcttggtacggaatgcgatga

SEQ ID NO: 30301 - DNA, 38 bp, Artificial Sequence
  Synthetic oligonucleotide
ttcaacgcctcttgcaacccacttgatcatgtctatga

SEQ ID NO: 30302 - DNA, 38 bp, Artificial Sequence
  Synthetic oligonucleotide
gtccccacacgttgttcatgccgtggcattccttctga

SEQ ID NO: 30303 - DNA, 37 bp, Artificial Sequence
  Synthetic oligonucleotide
gaggacggaggagtataggggcgggtgagaacggtga

SEQ ID NO: 30304 - DNA, 35 bp, Artificial Sequence
  Synthetic oligonucleotide
gtcttcccagcacctaaggtctgtcactccgccta

SEQ ID NO: 30305 - DNA, 35 bp, Artificial Sequence
  Synthetic oligonucleotide
gccgcacacctagccaatcactagtttcggtaaac

SEQ ID NO: 30306 - DNA, 35 bp, Artificial Sequence
  Synthetic oligonucleotide
agcccactttcacccattgttgctggtaaacaccc

SEQ ID NO: 30307 - DNA, 35 bp, Artificial Sequence
  Synthetic oligonucleotide
tccaccgccaatccaagcaattttaggtcaagccc

SEQ ID NO: 30308 - DNA, 35 bp, Artificial Sequence
  Synthetic oligonucleotide
tcccatctgcctgttcggtccatccaatcctctgc

SEQ ID NO: 30309 - DNA, 35 bp, Artificial Sequence
  Synthetic oligonucleotide
tatggcctgcccgccgtagtcccgcttaaaatgtc

SEQ ID NO: 30310 - DNA, 35 bp, Artificial Sequence
  Synthetic oligonucleotide
acagctcaaactcgtctctcccaccgtactacagg

SEQ ID NO: 30311 - DNA, 36 bp, Artificial Sequence
  Synthetic oligonucleotide
tcagtagaaggggagggcccagggaggcggagggat

SEQ ID NO: 30312 - DNA, 35 bp, Artificial Sequence
  Synthetic oligonucleotide
gacgacccatgacttctaactgagcaaccgaccaa

SEQ ID NO: 30313 - DNA, 37 bp, Artificial Sequence
  Synthetic oligonucleotide
tgagctgttccgccgtgcccatccacttcgttccgga

SEQ ID NO: 30314 - DNA, 38 bp, Artificial Sequence
  Synthetic oligonucleotide
gcctcagcgcgacttggacctcccgtatcaccacatga

SEQ ID NO: 30315 - DNA, 38 bp, Artificial Sequence
  Synthetic oligonucleotide
tgtctagcatcacatgccccaaccactcggatacctga

SEQ ID NO: 30316 - DNA, 35 bp, Artificial Sequence
  Synthetic oligonucleotide
tcctagctgcttggtttctgatcacttcggctcta

SEQ ID NO: 30317 - DNA, 36 bp, Artificial Sequence
  Synthetic oligonucleotide
gccccacatcatcccgtggagagcttccaccaagta

SEQ ID NO: 30318 - DNA, 35 bp, Artificial Sequence
  Synthetic oligonucleotide
actgcacgttcggccctaggtactacacctgttta

SEQ ID NO: 30319 - DNA, 35 bp, Artificial Sequence
  Synthetic oligonucleotide
ttcgagccgtccagctttcacctctcaccttgcac

SEQ ID NO: 30320 - DNA, 35 bp, Artificial Sequence
  Synthetic oligonucleotide
ttgaccccgcctgttctctcctagagtgacctcac

SEQ ID NO: 30321 - DNA, 35 bp, Artificial Sequence
  Synthetic oligonucleotide
tgctcccccagacagtacagtccacggatgtcacc

SEQ ID NO: 30322 - DNA, 35 bp, Artificial Sequence
  Synthetic oligonucleotide
acacggtggatcaatcgtcgacccccgccctttcc

SEQ ID NO: 30323 - DNA, 36 bp, Artificial Sequence
  Synthetic oligonucleotide
gcactgtagttgcacgcttatccgcccgctctacgc

SEQ ID NO: 30324 - DNA, 35 bp, Artificial Sequence
  Synthetic oligonucleotide
tcacgccgtagcatctcacacgtctccatatatgc

SEQ ID NO: 30325 - DNA, 35 bp, Artificial Sequence
  Synthetic oligonucleotide
ttaccccgcagccccacggctatagtctgcacctc

SEQ ID NO: 30326 - DNA, 35 bp, Artificial Sequence
  Synthetic oligonucleotide
agactcccttgtccactgctccatcgcatgcattc

SEQ ID NO: 30327 - DNA, 35 bp, Artificial Sequence
  Synthetic oligonucleotide
tcagccacaacagtcttcattaccatttcgacacg

SEQ ID NO: 30328 - DNA, 35 bp, Artificial Sequence
  Synthetic oligonucleotide
tgcggtcaccggtcagcgccgcttatcccctcatt

SEQ ID NO: 30329 - DNA, 35 bp, Artificial Sequence
  Synthetic oligonucleotide
acttcgcccgtgcgtgattcctatgtgcgcccctt

SEQ ID NO: 30330 - DNA, 35 bp, Artificial Sequence
  Synthetic oligonucleotide
gctacgtctaatgcccagccattcttgccttccaa

SEQ ID NO: 30331 - DNA, 36 bp, Artificial Sequence
  Synthetic oligonucleotide
atcgcccgttcgtcgcattacacaagccccccgcaa

SEQ ID NO: 30332 - DNA, 35 bp, Artificial Sequence
  Synthetic oligonucleotide
gaacactccccctgtgacttgtcattatctgttaa

SEQ ID NO: 30333 - DNA, 35 bp, Artificial Sequence
  Synthetic oligonucleotide
tccagcacgtcctattcgtccattccttttgtaca

SEQ ID NO: 30334 - DNA, 36 bp, Artificial Sequence
  Synthetic oligonucleotide
tagtgcagacctgcttagtcgccctcctacacccca

SEQ ID NO: 30335 - DNA, 36 bp, Artificial Sequence
  Synthetic oligonucleotide
tagtgtcacctgtctcttgcttctctgggcttgtca

SEQ ID NO: 30336 - DNA, 38 bp, Artificial Sequence
  Synthetic oligonucleotide
gtcaaggggaaaaggggggtcggggaggtcgagtatga

SEQ ID NO: 30337 - DNA, 38 bp, Artificial Sequence
  Synthetic oligonucleotide
gcactgcgggtccagtgggtgggagggaaagcctttga

SEQ ID NO: 30338 - DNA, 36 bp, Artificial Sequence
  Synthetic oligonucleotide
acatcactcgctcctgactccaccctacacccgata

SEQ ID NO: 30339 - DNA, 35 bp, Artificial Sequence
  Synthetic oligonucleotide
tgtgcggtcgtattctccccactctggctagctac

SEQ ID NO: 30340 - DNA, 35 bp, Artificial Sequence
  Synthetic oligonucleotide
atccatctggcagaacacttacctttgctacaccc

SEQ ID NO: 30341 - DNA, 33 bp, Artificial Sequence
  Synthetic oligonucleotide
agccactctgacctttttatgcatcatttgggc

SEQ ID NO: 30342 - DNA, 35 bp, Artificial Sequence
  Synthetic oligonucleotide
acgagtgcgttccatcatatcatcgacttccctgt

SEQ ID NO: 30343 - DNA, 35 bp, Artificial Sequence
  Synthetic oligonucleotide
gggggtagaaagggggtaggggcataatgaggtgt

SEQ ID NO: 30344 - DNA, 35 bp, Artificial Sequence
  Synthetic oligonucleotide
gctgtcgcacgttaaccccgctgcaatgaccactt

SEQ ID NO: 30345 - DNA, 35 bp, Artificial Sequence
  Synthetic oligonucleotide
tacatcgctccttagtcggttaacacatctttctt

SEQ ID NO: 30346 - DNA, 35 bp, Artificial Sequence
  Synthetic oligonucleotide
gtacacctgcatattgaagtacccaatgcccccaa

SEQ ID NO: 30347 - DNA, 36 bp, Artificial Sequence
  Synthetic oligonucleotide
acacgcatcgtaagaaccccgccgccattcaaacca

SEQ ID NO: 30348 - DNA, 36 bp, Artificial Sequence
  Synthetic oligonucleotide
tcttcaaccctagtcgctccatgccgtatccaccca

SEQ ID NO: 30349 - DNA, 36 bp, Artificial Sequence
  Synthetic oligonucleotide
cgcccggcgggtgtgcgatgttacagccgcaaatca

SEQ ID NO: 30350 - DNA, 37 bp, Artificial Sequence
  Synthetic oligonucleotide
tatccaccatcccggccccagagacgtggtccatcga

SEQ ID NO: 30351 - DNA, 37 bp, Artificial Sequence
  Synthetic oligonucleotide
ttgcccccaccttctccctcggttaagatcgacgtga

SEQ ID NO: 30352 - DNA, 36 bp, Artificial Sequence
  Synthetic oligonucleotide
ttcgcccgcacagttcattacattgacctaccttga

SEQ ID NO: 30353 - DNA, 38 bp, Artificial Sequence
  Synthetic oligonucleotide
gtccctacgccgggaatttgcgcaccacactatcttga

SEQ ID NO: 30354 - DNA, 36 bp, Artificial Sequence
  Synthetic oligonucleotide
tatgatccgcctgtatcccccgccatcttagcggta

SEQ ID NO: 30355 - DNA, 35 bp, Artificial Sequence
  Synthetic oligonucleotide
atgggccctctgcacctgccatcatggatttaacc

SEQ ID NO: 30356 - DNA, 35 bp, Artificial Sequence
  Synthetic oligonucleotide
tgcccgcgctcctccccctcgtcgtgcgtaggacc

SEQ ID NO: 30357 - DNA, 36 bp, Artificial Sequence
  Synthetic oligonucleotide
tcactccgcctgccacacgactccgccttcgcctgc

SEQ ID NO: 30358 - DNA, 35 bp, Artificial Sequence
  Synthetic oligonucleotide
tcttacaacgcccatcggaatctgcgcacttctgc

SEQ ID NO: 30359 - DNA, 35 bp, Artificial Sequence
  Synthetic oligonucleotide
tgccactgacggtttacaaatgagttcccctgatc

SEQ ID NO: 30360 - DNA, 35 bp, Artificial Sequence
  Synthetic oligonucleotide
taccgcctcatcactccgactcgcgtttcgacctc

SEQ ID NO: 30361 - DNA, 35 bp, Artificial Sequence
  Synthetic oligonucleotide
gagagggtggggctgaacgttgggcacatctactg

SEQ ID NO: 30362 - DNA, 35 bp, Artificial Sequence
  Synthetic oligonucleotide
accacgcggaatacgatcctcttgctatggtctct

SEQ ID NO: 30363 - DNA, 35 bp, Artificial Sequence
  Synthetic oligonucleotide
ttcactgcataccatttcgcgtacagccctaacgt

SEQ ID NO: 30364 - DNA, 35 bp, Artificial Sequence
  Synthetic oligonucleotide
ataatcatgcctcgacccaccgcgttccttgccgt

SEQ ID NO: 30365 - DNA, 35 bp, Artificial Sequence
  Synthetic oligonucleotide
gccagtctgcggggggagagggagcggtggtggtt

SEQ ID NO: 30366 - DNA, 36 bp, Artificial Sequence
  Synthetic oligonucleotide
gcgaccgacggttgccggcccctatccacacccaaa

SEQ ID NO: 30367 - DNA, 35 bp, Artificial Sequence
  Synthetic oligonucleotide
actgcccccggatctacaatatccttgtgaaacaa

SEQ ID NO: 30368 - DNA, 36 bp, Artificial Sequence
  Synthetic oligonucleotide
acgtggccatatgcccccgctccatctcgaccgaga

SEQ ID NO: 30369 - DNA, 37 bp, Artificial Sequence
  Synthetic oligonucleotide
acttgacatcgcagcctgccccgttcaatgctctcga

SEQ ID NO: 30370 - DNA, 37 bp, Artificial Sequence
  Synthetic oligonucleotide
ccactggcacacttgatcaccggatttccccgttcga

SEQ ID NO: 30371 - DNA, 37 bp, Artificial Sequence
  Synthetic oligonucleotide
acgccgccccacctccatctctgtcagccctatagga

SEQ ID NO: 30372 - DNA, 37 bp, Artificial Sequence
  Synthetic oligonucleotide
tggagccacttacggtgttctcgtttctttctttgga

SEQ ID NO: 30373 - DNA, 38 bp, Artificial Sequence
  Synthetic oligonucleotide
gccgacaggtaggagatgtaccctttgttgctacttga

SEQ ID NO: 30374 - DNA, 37 bp, Artificial Sequence
  Synthetic oligonucleotide
gacaagccacatctttccatacgcttatcgcctttga

SEQ ID NO: 30375 - DNA, 36 bp, Artificial Sequence
  Synthetic oligonucleotide
tcagatgtccactttgcctcacaactgtcctcaata

SEQ ID NO: 30376 - DNA, 36 bp, Artificial Sequence
  Synthetic oligonucleotide
accaggccacccgaacgagctatggcatctccccta

SEQ ID NO: 30377 - DNA, 35 bp, Artificial Sequence
  Synthetic oligonucleotide
tccccaccgcgactgtaacccacgatgtcatttta

SEQ ID NO: 30378 - DNA, 35 bp, Artificial Sequence
  Synthetic oligonucleotide
tctaacccgctagacctgccttgagtggccccccc

SEQ ID NO: 30379 - DNA, 35 bp, Artificial Sequence
  Synthetic oligonucleotide
atcatcctacttgtgattacacctatgggctcttc

SEQ ID NO: 30380 - DNA, 35 bp, Artificial Sequence
  Synthetic oligonucleotide
ttcaacgtcttgggcactttgctccgctctccccg

SEQ ID NO: 30381 - DNA, 35 bp, Artificial Sequence
  Synthetic oligonucleotide
gtcaccgacctgcagcactcgagaacccgcaatcg

SEQ ID NO: 30382 - DNA, 35 bp, Artificial Sequence
  Synthetic oligonucleotide
aacagattggccggagggttaggtagtaaggaggg

SEQ ID NO: 30383 - DNA, 35 bp, Artificial Sequence
  Synthetic oligonucleotide
tattgccaaccctgcgttgtttactttcatctgct

SEQ ID NO: 30384 - DNA, 35 bp, Artificial Sequence
  Synthetic oligonucleotide
gagagccatgagctaataagagaaggatagggagt

SEQ ID NO: 30385 - DNA, 35 bp, Artificial Sequence
  Synthetic oligonucleotide
atctcccccaatcgtaaatgacccgcgaaaccggt

SEQ ID NO: 30386 - DNA, 35 bp, Artificial Sequence
  Synthetic oligonucleotide
gcctgctggcttccacgtaccctctcgcttgcttt

SEQ ID NO: 30387 - DNA, 35 bp, Artificial Sequence
  Synthetic oligonucleotide
tacacacattagatcgtcgggccatacactctcaa

SEQ ID NO: 30388 - DNA, 36 bp, Artificial Sequence
  Synthetic oligonucleotide
acgaccatacttgcatcctggaatcgcacagttcca

SEQ ID NO: 30389 - DNA, 35 bp, Artificial Sequence
  Synthetic oligonucleotide
gtggaagggtcaagcccaccgtaaaacctgcttca

SEQ ID NO: 30390 - DNA, 37 bp, Artificial Sequence
  Synthetic oligonucleotide
aatgtgcggggttaaaaggggatgaggacggctgaga

SEQ ID NO: 30391 - DNA, 38 bp, Artificial Sequence
  Synthetic oligonucleotide
attcacacccgcacgcatgtaagtttttccacccatga

SEQ ID NO: 30392 - DNA, 36 bp, Artificial Sequence
  Synthetic oligonucleotide
tgctctcgcctatgcacacactagtttagcccatga

SEQ ID NO: 30393 - DNA, 38 bp, Artificial Sequence
  Synthetic oligonucleotide
tacccatccatgccgttccggacccgctcaattcttga

SEQ ID NO: 30394 - DNA, 38 bp, Artificial Sequence
  Synthetic oligonucleotide
atcatcacaaccgctgctgtggtatcctctcactttga

SEQ ID NO: 30395 - DNA, 35 bp, Artificial Sequence
  Synthetic oligonucleotide
gcactgcctctcgcacccttaacaggctgcctaac

SEQ ID NO: 30396 - DNA, 35 bp, Artificial Sequence
  Synthetic oligonucleotide
gaaaccatgccgtagtgccccttacaccattcgac

SEQ ID NO: 30397 - DNA, 34 bp, Artificial Sequence
  Synthetic oligonucleotide
ggacacattcgcgttcctgacccttggtccctgc

SEQ ID NO: 30398 - DNA, 35 bp, Artificial Sequence
  Synthetic oligonucleotide
aacggacccccattgttagcccttcccgtctaatc

SEQ ID NO: 30399 - DNA, 35 bp, Artificial Sequence
  Synthetic oligonucleotide
aacgggcccatcacctcgccctcctactgccgtcg

SEQ ID NO: 30400 - DNA, 35 bp, Artificial Sequence
  Synthetic oligonucleotide
tgcttgtcactgtcatctccgttcgacctctccat

SEQ ID NO: 30401 - DNA, 35 bp, Artificial Sequence
  Synthetic oligonucleotide
gtcacatcgtgagcgcccttcgtttccagctttgt

SEQ ID NO: 30402 - DNA, 35 bp, Artificial Sequence
  Synthetic oligonucleotide
gctaatccggcgccttttctatgtctcacccgctt

SEQ ID NO: 30403 - DNA, 35 bp, Artificial Sequence
  Synthetic oligonucleotide
ttgagcagcaacactagcgcactccccttcacaca

SEQ ID NO: 30404 - DNA, 37 bp, Artificial Sequence
  Synthetic oligonucleotide
taagaatgccaccgatgcccgcgccctgctttaccga

SEQ ID NO: 30405 - DNA, 37 bp, Artificial Sequence
  Synthetic oligonucleotide
tccaaccccaaccggttgtcttccatgtactgctcga

SEQ ID NO: 30406 - DNA, 37 bp, Artificial Sequence
  Synthetic oligonucleotide
acacatagacaagacggggaagaagggcgtgtacgga

SEQ ID NO: 30407 - DNA, 38 bp, Artificial Sequence
  Synthetic oligonucleotide
agcctgcacctcccgcaccatcccacccgtgttgctga

SEQ ID NO: 30408 - DNA, 36 bp, Artificial Sequence
  Synthetic oligonucleotide
acgccacccctctgctcataaagcgcgttcttctga

SEQ ID NO: 30409 - DNA, 38 bp, Artificial Sequence
  Synthetic oligonucleotide
tagttcacgcagcctgacttagctttttcccttcgtga

SEQ ID NO: 30410 - DNA, 38 bp, Artificial Sequence
  Synthetic oligonucleotide
ggacaaagtggggaaggtacacaatgggagaggggtga

SEQ ID NO: 30411 - DNA, 37 bp, Artificial Sequence
  Synthetic oligonucleotide
aaccaccccccaactgcccgtgttgtcgctcccttga

SEQ ID NO: 30412 - DNA, 36 bp, Artificial Sequence
  Synthetic oligonucleotide
gtgttgcccctcagcgtactttggaatcaccccgta

SEQ ID NO: 30413 - DNA, 35 bp, Artificial Sequence
  Synthetic oligonucleotide
agaccgccccacctgtcggaaccttacaggtaccc

SEQ ID NO: 30414 - DNA, 35 bp, Artificial Sequence
  Synthetic oligonucleotide
tcccctaccctgaagcatggctccgacttttatgc

SEQ ID NO: 30415 - DNA, 35 bp, Artificial Sequence
  Synthetic oligonucleotide
gactgggcaccgtgatcatgtccaccgtttcttgc

SEQ ID NO: 30416 - DNA, 36 bp, Artificial Sequence
  Synthetic oligonucleotide
ttagagagtgatgacggtgggttggtggatcgcgcg

SEQ ID NO: 30417 - DNA, 35 bp, Artificial Sequence
  Synthetic oligonucleotide
atccattgagccctatgtctatacgtccttccaat

SEQ ID NO: 30418 - DNA, 35 bp, Artificial Sequence
  Synthetic oligonucleotide
gctcgagcttagcgagtaatcatcctctctgttat

SEQ ID NO: 30419 - DNA, 35 bp, Artificial Sequence
  Synthetic oligonucleotide
gatctgcccacaaaacaaggcccacgggactgact

SEQ ID NO: 30420 - DNA, 35 bp, Artificial Sequence
  Synthetic oligonucleotide
gaccccgactcctcaggtttgccttcgctaccgct

SEQ ID NO: 30421 - DNA, 36 bp, Artificial Sequence
  Synthetic oligonucleotide
gccaccaggcctgaactagcatttgaccccacaaca

SEQ ID NO: 30422 - DNA, 36 bp, Artificial Sequence
  Synthetic oligonucleotide
gtccacacctcattctatgggaccgctcttactcca

SEQ ID NO: 30423 - DNA, 35 bp, Artificial Sequence
  Synthetic oligonucleotide
agcgaatgggggggggtgacgatgaggccaggtca

SEQ ID NO: 30424 - DNA, 37 bp, Artificial Sequence
  Synthetic oligonucleotide
tactgggtgggtggggctgttggatctggtagcggga

SEQ ID NO: 30425 - DNA, 38 bp, Artificial Sequence
  Synthetic oligonucleotide
gacactccgacactgggcttccatgacttcacacatga

SEQ ID NO: 30426 - DNA, 38 bp, Artificial Sequence
  Synthetic oligonucleotide
tgatgatgtagccgctgccttcccactccttgctatga

SEQ ID NO: 30427 - DNA, 35 bp, Artificial Sequence
  Synthetic oligonucleotide
gatgcccctttttggttatataacttcccgtgtga

SEQ ID NO: 30428 - DNA, 35 bp, Artificial Sequence
  Synthetic oligonucleotide
ttgctccccactccagaaacctcgccctcacggta

SEQ ID NO: 30429 - DNA, 35 bp, Artificial Sequence
  Synthetic oligonucleotide
ttcactgacaccgaacccgttctatctagcatagc

SEQ ID NO: 30430 - DNA, 35 bp, Artificial Sequence
  Synthetic oligonucleotide
accttaccgcgagctattgggtccttcttctctgc

SEQ ID NO: 30431 - DNA, 35 bp, Artificial Sequence
  Synthetic oligonucleotide
tatgcatgcagatgcccactaccactcccggaatc

SEQ ID NO: 30432 - DNA, 35 bp, Artificial Sequence
  Synthetic oligonucleotide
tgcgttccacaccgcgctttatcctcttcgtcgtc

SEQ ID NO: 30433 - DNA, 35 bp, Artificial Sequence
  Synthetic oligonucleotide
gccatgcctgtaacgtattcgtctgatacctgccg

SEQ ID NO: 30434 - DNA, 35 bp, Artificial Sequence
  Synthetic oligonucleotide
gagctcaatggggtggggatcggatagaagtaggg

SEQ ID NO: 30435 - DNA, 35 bp, Artificial Sequence
  Synthetic oligonucleotide
tgtgaacattgaaagggtcgagggcgggacgggtg

SEQ ID NO: 30436 - DNA, 35 bp, Artificial Sequence
  Synthetic oligonucleotide
tcgcacccagtggcatgccccttatccacggtaca

SEQ ID NO: 30437 - DNA, 36 bp, Artificial Sequence
  Synthetic oligonucleotide
ccctgtccgcaatctcctcctaacactcctggtgca

SEQ ID NO: 30438 - DNA, 37 bp, Artificial Sequence
  Synthetic oligonucleotide
gtctaaagaccgtggtgagaagatggggggggatgga

SEQ ID NO: 30439 - DNA, 37 bp, Artificial Sequence
  Synthetic oligonucleotide
gcccgaccgtagtttcgtttgaccatcgatgcctgga

SEQ ID NO: 30440 - DNA, 37 bp, Artificial Sequence
  Synthetic oligonucleotide
gggggggtgggggttgggatggcgagacaatcgatga

SEQ ID NO: 30441 - DNA, 37 bp, Artificial Sequence
  Synthetic oligonucleotide
acgtgccccacctggaatcacgacaacctttgggtga

SEQ ID NO: 30442 - DNA, 36 bp, Artificial Sequence
  Synthetic oligonucleotide
tagttcaccgccactccgtttaaataccgcgcttga

SEQ ID NO: 30443 - DNA, 35 bp, Artificial Sequence
  Synthetic oligonucleotide
gtcttcggaacacgccatcaccagtccctgcaacc

SEQ ID NO: 30444 - DNA, 35 bp, Artificial Sequence
  Synthetic oligonucleotide
gttcacacgtgtgcaacgtccctaacccaactcgc

SEQ ID NO: 30445 - DNA, 35 bp, Artificial Sequence
  Synthetic oligonucleotide
agtcaacgtgagacgccggctctcttctccacttc

SEQ ID NO: 30446 - DNA, 35 bp, Artificial Sequence
  Synthetic oligonucleotide
tctggcgatcacccatccgcttagttacacccacg

SEQ ID NO: 30447 - DNA, 35 bp, Artificial Sequence
  Synthetic oligonucleotide
gtatcagccgcatgtaaccatcggtcctgtttttt

SEQ ID NO: 30448 - DNA, 36 bp, Artificial Sequence
  Synthetic oligonucleotide
gccccgccgccggtctaacccgtttttacatttaaa

SEQ ID NO: 30449 - DNA, 36 bp, Artificial Sequence
  Synthetic oligonucleotide
ttccgccatctcaccgctgtcctcagtgcccgccaa

SEQ ID NO: 30450 - DNA, 35 bp, Artificial Sequence
  Synthetic oligonucleotide
tgattgccctgtttcacgccgccctatcacatgca

SEQ ID NO: 30451 - DNA, 37 bp, Artificial Sequence
  Synthetic oligonucleotide
gacgacatcagtgaggcggctggggttactggataga

SEQ ID NO: 30452 - DNA, 35 bp, Artificial Sequence
  Synthetic oligonucleotide
gtccgcacaatatgtaatcgcctcattcttcccga

SEQ ID NO: 30453 - DNA, 37 bp, Artificial Sequence
  Synthetic oligonucleotide
accccatcggcctgcacaccgagcgcctgacttccga

SEQ ID NO: 30454 - DNA, 37 bp, Artificial Sequence
  Synthetic oligonucleotide
tgcgggggggtccggaggtggaatggggtgggtcgga

SEQ ID NO: 30455 - DNA, 38 bp, Artificial Sequence
  Synthetic oligonucleotide
tcacagatctgctgaaaactgcccgccacctgttgtga

SEQ ID NO: 30456 - DNA, 35 bp, Artificial Sequence
  Synthetic oligonucleotide
gacatcctcctttcactcatcatcacactgctgta

SEQ ID NO: 30457 - DNA, 35 bp, Artificial Sequence
  Synthetic oligonucleotide
ttcccgacccagggagttaccgatttttgtcttac

SEQ ID NO: 30458 - DNA, 34 bp, Artificial Sequence
  Synthetic oligonucleotide
ggacgccgagctcgaaccagcggatcctcctccc

SEQ ID NO: 30459 - DNA, 35 bp, Artificial Sequence
  Synthetic oligonucleotide
gtatacacccctgctcgcgctctattcttttcagc

SEQ ID NO: 30460 - DNA, 35 bp, Artificial Sequence
  Synthetic oligonucleotide
tactcatctgcaatactactggcctgtgccttgcg

SEQ ID NO: 30461 - DNA, 35 bp, Artificial Sequence
  Synthetic oligonucleotide
acctgggtccgctcccagcccttgaccttattact

SEQ ID NO: 30462 - DNA, 35 bp, Artificial Sequence
  Synthetic oligonucleotide
tgtgcgggcgcccgcctcttgcccagtttgcacct

SEQ ID NO: 30463 - DNA, 35 bp, Artificial Sequence
  Synthetic oligonucleotide
aacccccccgcgatcgtttcctggaggtcgtgcct

SEQ ID NO: 30464 - DNA, 35 bp, Artificial Sequence
  Synthetic oligonucleotide
gacaccgaataggtgttgactatccaccctaccgt

SEQ ID NO: 30465 - DNA, 35 bp, Artificial Sequence
  Synthetic oligonucleotide
agccagagtgccatgtacgtgcccttcaaccgctt

SEQ ID NO: 30466 - DNA, 35 bp, Artificial Sequence
  Synthetic oligonucleotide
tccattggcctgcctctcacctagtccccgtaaca

SEQ ID NO: 30467 - DNA, 35 bp, Artificial Sequence
  Synthetic oligonucleotide
tagccttggtcctcatgcccaccgatctataacca

SEQ ID NO: 30468 - DNA, 37 bp, Artificial Sequence
  Synthetic oligonucleotide
cctgatccacacccgccgcagacagctcatactgaga

SEQ ID NO: 30469 - DNA, 35 bp, Artificial Sequence
  Synthetic oligonucleotide
tagcctccatcttccgttttctgtatcatctccga

SEQ ID NO: 30470 - DNA, 38 bp, Artificial Sequence
  Synthetic oligonucleotide
gcacacgctatcgttgcaattatcacacctgttcgtga

SEQ ID NO: 30471 - DNA, 37 bp, Artificial Sequence
  Synthetic oligonucleotide
acatgctgtaggaggggggtcgtgacagcctgggtga

SEQ ID NO: 30472 - DNA, 38 bp, Artificial Sequence
  Synthetic oligonucleotide
acccgctcgaagcactgcgttcaaaccactctccttga

SEQ ID NO: 30473 - DNA, 38 bp, Artificial Sequence
  Synthetic oligonucleotide
tccggagaccccgctctatttaacctcagtctttttga

SEQ ID NO: 30474 - DNA, 35 bp, Artificial Sequence
  Synthetic oligonucleotide
tcccccgcatctccattaccgtccacgtgaacgta

SEQ ID NO: 30475 - DNA, 35 bp, Artificial Sequence
  Synthetic oligonucleotide
tgtcctcacacggtctaacttgcatgcctggctta

SEQ ID NO: 30476 - DNA, 35 bp, Artificial Sequence
  Synthetic oligonucleotide
gagccaactttccgacgcagtagcctgctaatacc

SEQ ID NO: 30477 - DNA, 35 bp, Artificial Sequence
  Synthetic oligonucleotide
acgtgtaccaggccattcgtttgtcttagtcgccc

SEQ ID NO: 30478 - DNA, 35 bp, Artificial Sequence
  Synthetic oligonucleotide
gtcctgctcctctcacgcggcctatttattcgccc

SEQ ID NO: 30479 - DNA, 35 bp, Artificial Sequence
  Synthetic oligonucleotide
tcaccgacgaatacgctgttgtaatccataccccg

SEQ ID NO: 30480 - DNA, 35 bp, Artificial Sequence
  Synthetic oligonucleotide
gccccccacgacctaagcacgccaaattacctgct

SEQ ID NO: 30481 - DNA, 35 bp, Artificial Sequence
  Synthetic oligonucleotide
tccaccgcttcccgaatacagccactaacggttct

SEQ ID NO: 30482 - DNA, 36 bp, Artificial Sequence
  Synthetic oligonucleotide
gctgtgggatgccggggtaaattctgcggaggggaa

SEQ ID NO: 30483 - DNA, 36 bp, Artificial Sequence
  Synthetic oligonucleotide
gcttgcatccactgcatttcgatacattatacccca

SEQ ID NO: 30484 - DNA, 36 bp, Artificial Sequence
  Synthetic oligonucleotide
gacaggtggtatagtatggggagggagggaactgca

SEQ ID NO: 30485 - DNA, 36 bp, Artificial Sequence
  Synthetic oligonucleotide
tacgccctctagaacacctgggatccttcttgctca

SEQ ID NO: 30486 - DNA, 35 bp, Artificial Sequence
  Synthetic oligonucleotide
atcccgtatcgcccgaatccccttgactacacgga

SEQ ID NO: 30487 - DNA, 37 bp, Artificial Sequence
  Synthetic oligonucleotide
gaccgcgattcctgcacttccaaccgcctgaccctga

SEQ ID NO: 30488 - DNA, 37 bp, Artificial Sequence
  Synthetic oligonucleotide
gagccgccaccgtttatttatattcccgtctccttga

SEQ ID NO: 30489 - DNA, 35 bp, Artificial Sequence
  Synthetic oligonucleotide
acttcaccccgtcaccgcgtagtgaaactaacccc

SEQ ID NO: 30490 - DNA, 35 bp, Artificial Sequence
  Synthetic oligonucleotide
aacacatcaccgcgggcaatgcttgtcttccagcc

SEQ ID NO: 30491 - DNA, 35 bp, Artificial Sequence
  Synthetic oligonucleotide
gtccgaagcttggcgccacccatatgccctctgcc

SEQ ID NO: 30492 - DNA, 35 bp, Artificial Sequence
  Synthetic oligonucleotide
tcactgcactatcagccttaggttggtccacatcc

SEQ ID NO: 30493 - DNA, 35 bp, Artificial Sequence
  Synthetic oligonucleotide
gaccctacccctagcccctatccttagaggtctgc

SEQ ID NO: 30494 - DNA, 36 bp, Artificial Sequence
  Synthetic oligonucleotide
agagtgcacgctatcgagcgttgaggtccatctctc

SEQ ID NO: 30495 - DNA, 35 bp, Artificial Sequence
  Synthetic oligonucleotide
ttggtgcattgggcgtggtacggtggggaggggat

SEQ ID NO: 30496 - DNA, 35 bp, Artificial Sequence
  Synthetic oligonucleotide
agtgactacacctgcattccctccgacgcaagtat

SEQ ID NO: 30497 - DNA, 35 bp, Artificial Sequence
  Synthetic oligonucleotide
gccccccgttcccttgatggatcctccgccagtct

SEQ ID NO: 30498 - DNA, 35 bp, Artificial Sequence
  Synthetic oligonucleotide
aacttttgcatccgactttgccaaccattctctgt

SEQ ID NO: 30499 - DNA, 35 bp, Artificial Sequence
  Synthetic oligonucleotide
tagcccacatattcgttagtgcacatttctccctt

SEQ ID NO: 30500 - DNA, 35 bp, Artificial Sequence
  Synthetic oligonucleotide
tccatcccgcgataccaccaaaccctttcggattt

SEQ ID NO: 30501 - DNA, 35 bp, Artificial Sequence
  Synthetic oligonucleotide
acatccaccgacagccaccgcatcattaggatttt

SEQ ID NO: 30502 - DNA, 36 bp, Artificial Sequence
  Synthetic oligonucleotide
gggaccgggtgggagggccgagactggtatagacaa

SEQ ID NO: 30503 - DNA, 36 bp, Artificial Sequence
  Synthetic oligonucleotide
gcctactcatcactactcgccgtgtacacatcctaa

SEQ ID NO: 30504 - DNA, 36 bp, Artificial Sequence
  Synthetic oligonucleotide
gaagcgagggaggaagtgttggggtgaggggaaaca

SEQ ID NO: 30505 - DNA, 36 bp, Artificial Sequence
  Synthetic oligonucleotide
acccgctgacgtatgctacccttcttggccacctca

SEQ ID NO: 30506 - DNA, 37 bp, Artificial Sequence
  Synthetic oligonucleotide
tcatcacacctcgtttaatgttccttcgatcctgaga

SEQ ID NO: 30507 - DNA, 37 bp, Artificial Sequence
  Synthetic oligonucleotide
tcactcacatgtgaagcgatctcatgcacaccctcga

SEQ ID NO: 30508 - DNA, 37 bp, Artificial Sequence
  Synthetic oligonucleotide
cacccacccctgactgtacgtaaacaaccatcctcga

SEQ ID NO: 30509 - DNA, 37 bp, Artificial Sequence
  Synthetic oligonucleotide
agtcgataaaggggctaggggaccaggggggaacgga

SEQ ID NO: 30510 - DNA, 35 bp, Artificial Sequence
  Synthetic oligonucleotide
agatcacatagggggggaagatggagctgcatgga

SEQ ID NO: 30511 - DNA, 37 bp, Artificial Sequence
  Synthetic oligonucleotide
gaacggacagggacggtgggcatttgggaactttgga

SEQ ID NO: 30512 - DNA, 38 bp, Artificial Sequence
  Synthetic oligonucleotide
tcacacgcctgagctaacatactcttcaccatttttga

SEQ ID NO: 30513 - DNA, 36 bp, Artificial Sequence
  Synthetic oligonucleotide
tcgtcccctccaacttttgaagacttttacgctcta

SEQ ID NO: 30514 - DNA, 35 bp, Artificial Sequence
  Synthetic oligonucleotide
tggacctgctcactacccccgtacactatctgcac

SEQ ID NO: 30515 - DNA, 35 bp, Artificial Sequence
  Synthetic oligonucleotide
gcccaggacggtccttgctttaatacactccgccc

SEQ ID NO: 30516 - DNA, 35 bp, Artificial Sequence
  Synthetic oligonucleotide
tgcgctactcgcgatcttgcatcttcacccctatc

SEQ ID NO: 30517 - DNA, 35 bp, Artificial Sequence
  Synthetic oligonucleotide
tagagcatcctttcccgtatctgttcccgtttagg

SEQ ID NO: 30518 - DNA, 35 bp, Artificial Sequence
  Synthetic oligonucleotide
actgaaccaacccgacgcgtacagcccacctaagt

SEQ ID NO: 30519 - DNA, 36 bp, Artificial Sequence
  Synthetic oligonucleotide
tgcaccacctgtacatgcttgacaccgccgacccaa

SEQ ID NO: 30520 - DNA, 35 bp, Artificial Sequence
  Synthetic oligonucleotide
aggtccgcactactaacctgccgtgtctccttgca

SEQ ID NO: 30521 - DNA, 37 bp, Artificial Sequence
  Synthetic oligonucleotide
gaggagggagtggtccgaataggcggggctcgagaga

SEQ ID NO: 30522 - DNA, 38 bp, Artificial Sequence
  Synthetic oligonucleotide
gtgcccaaccccgtaccactgaatcacctcctacgtga

SEQ ID NO: 30523 - DNA, 38 bp, Artificial Sequence
  Synthetic oligonucleotide
ggacacgacgtcgtgatccacacctagccccccgttga

SEQ ID NO: 30524 - DNA, 38 bp, Artificial Sequence
  Synthetic oligonucleotide
acttaccccactggagggactcaggacatccttgttga

SEQ ID NO: 30525 - DNA, 35 bp, Artificial Sequence
  Synthetic oligonucleotide
agtttgcaccccctgaccgcagtgaccgcccctcc

SEQ ID NO: 30526 - DNA, 35 bp, Artificial Sequence
  Synthetic oligonucleotide
gtccagacctccctctcttcttcaggaaccgcccg

SEQ ID NO: 30527 - DNA, 35 bp, Artificial Sequence
  Synthetic oligonucleotide
tgcgccaacctgcacctccccataggctaacatgg

SEQ ID NO: 30528 - DNA, 35 bp, Artificial Sequence
  Synthetic oligonucleotide
taccacgcgaccgtgcgtgatccaccccttattat

SEQ ID NO: 30529 - DNA, 35 bp, Artificial Sequence
  Synthetic oligonucleotide
gtgagcaagcggcgacacacaccggaatacatcct

SEQ ID NO: 30530 - DNA, 35 bp, Artificial Sequence
  Synthetic oligonucleotide
gttcatgtccccagtcctcacttagagtcatactt

SEQ ID NO: 30531 - DNA, 36 bp, Artificial Sequence
  Synthetic oligonucleotide
tgcctaatcccctccgtttctgcgctttagactgca

SEQ ID NO: 30532 - DNA, 37 bp, Artificial Sequence
  Synthetic oligonucleotide
tccatcccacgtacttgatcctcctaaacagttaaga

SEQ ID NO: 30533 - DNA, 36 bp, Artificial Sequence
  Synthetic oligonucleotide
tcactcaattcacactacagcccccttggccatgga

SEQ ID NO: 30534 - DNA, 37 bp, Artificial Sequence
  Synthetic oligonucleotide
tcagagcagccaccgcgcacccaaacccttccttgga

SEQ ID NO: 30535 - DNA, 37 bp, Artificial Sequence
  Synthetic oligonucleotide
tactccctcttgccgcaccttcagtctgctcccctga

SEQ ID NO: 30536 - DNA, 35 bp, Artificial Sequence
  Synthetic oligonucleotide
ttgatcccgacgccgaaaccccatgttgcaatgac

SEQ ID NO: 30537 - DNA, 35 bp, Artificial Sequence
  Synthetic oligonucleotide
gccttcactctcgcatgtctaaaactcgcctcccc

SEQ ID NO: 30538 - DNA, 35 bp, Artificial Sequence
  Synthetic oligonucleotide
aatgccaaactaggcttacttcacgttggtttccc

SEQ ID NO: 30539 - DNA, 35 bp, Artificial Sequence
  Synthetic oligonucleotide
ttgccccccattgctgcttacgtggctagtgttcc

SEQ ID NO: 30540 - DNA, 35 bp, Artificial Sequence
  Synthetic oligonucleotide
agaatggtgagaaggaagagaaggggaaagggacg

SEQ ID NO: 30541 - DNA, 35 bp, Artificial Sequence
  Synthetic oligonucleotide
gccatgacgggtgggatagttcggtaatatttggg

SEQ ID NO: 30542 - DNA, 35 bp, Artificial Sequence
  Synthetic oligonucleotide
gcataacccgggtactgtggcaccaacacaccttg

SEQ ID NO: 30543 - DNA, 35 bp, Artificial Sequence
  Synthetic oligonucleotide
agtctgacggggtgggcctggggagggtagtaaat

SEQ ID NO: 30544 - DNA, 35 bp, Artificial Sequence
  Synthetic oligonucleotide
acatcactccctttcccggttgcttatgctacgct

SEQ ID NO: 30545 - DNA, 35 bp, Artificial Sequence
  Synthetic oligonucleotide
gattgcgtcccgtccggtcaccgagtccatctatt

SEQ ID NO: 30546 - DNA, 36 bp, Artificial Sequence
  Synthetic oligonucleotide
actgatacatcgcacgatatgactcttcccgcctaa

SEQ ID NO: 30547 - DNA, 37 bp, Artificial Sequence
  Synthetic oligonucleotide
gctcagccgccccgtctactacgctaattgcttgcga

SEQ ID NO: 30548 - DNA, 37 bp, Artificial Sequence
  Synthetic oligonucleotide
tggagggagggaatgcgtggaaacggcacgacaagga

SEQ ID NO: 30549 - DNA, 38 bp, Artificial Sequence
  Synthetic oligonucleotide
gccgcgcggccccgcattagttacgccccaacccatga

SEQ ID NO: 30550 - DNA, 36 bp, Artificial Sequence
  Synthetic oligonucleotide
agggggaaggggaaatggcaatttgaagagtagtga

SEQ ID NO: 30551 - DNA, 37 bp, Artificial Sequence
  Synthetic oligonucleotide
aagaccgagtgagagggacggaaatgggtgacggtga

SEQ ID NO: 30552 - DNA, 35 bp, Artificial Sequence
  Synthetic oligonucleotide
aagtacgccttccattggggcataccatccttgac

SEQ ID NO: 30553 - DNA, 35 bp, Artificial Sequence
  Synthetic oligonucleotide
accgcgcactatccccggatgtttccatctaaacc

SEQ ID NO: 30554 - DNA, 35 bp, Artificial Sequence
  Synthetic oligonucleotide
ggacagtcccacacgcgtcaccgcggcgccacccc

SEQ ID NO: 30555 - DNA, 35 bp, Artificial Sequence
  Synthetic oligonucleotide
gcgctctgccagtatgacgttcatccgtctccagc

SEQ ID NO: 30556 - DNA, 35 bp, Artificial Sequence
  Synthetic oligonucleotide
gtgcagcaatctggtaggcccctcgttgttttatc

SEQ ID NO: 30557 - DNA, 35 bp, Artificial Sequence
  Synthetic oligonucleotide
gcgaccttaggagcgcgtacccacctgccactgtc

SEQ ID NO: 30558 - DNA, 36 bp, Artificial Sequence
  Synthetic oligonucleotide
accccactgacgactcatctaaacctgatagagacg

SEQ ID NO: 30559 - DNA, 35 bp, Artificial Sequence
  Synthetic oligonucleotide
ggaaggagggtccgggaagaattgtggggtggatg

SEQ ID NO: 30560 - DNA, 35 bp, Artificial Sequence
  Synthetic oligonucleotide
tcctcatccctgtgactcaaagggcattactcgct

SEQ ID NO: 30561 - DNA, 35 bp, Artificial Sequence
  Synthetic oligonucleotide
tacctccgccaaggacccgtggccctaacccacgt

SEQ ID NO: 30562 - DNA, 35 bp, Artificial Sequence
  Synthetic oligonucleotide
tcatccataccctggccgcgcttgtcgctggctgt

SEQ ID NO: 30563 - DNA, 36 bp, Artificial Sequence
  Synthetic oligonucleotide
gtacgcctgacttggcctatgcacagcctactgcaa

SEQ ID NO: 30564 - DNA, 35 bp, Artificial Sequence
  Synthetic oligonucleotide
ttcaagccctctgtccaccccataagcgtcgccca

SEQ ID NO: 30565 - DNA, 35 bp, Artificial Sequence
  Synthetic oligonucleotide
attggaagcgcacttccgtcacgccgacactgcca

SEQ ID NO: 30566 - DNA, 37 bp, Artificial Sequence
  Synthetic oligonucleotide
gagatggccgcccccctgattccaacgccctacacga

SEQ ID NO: 30567 - DNA, 37 bp, Artificial Sequence
  Synthetic oligonucleotide
agcacctgccgtccgccctcaatcttcccctgtccga

SEQ ID NO: 30568 - DNA, 38 bp, Artificial Sequence
  Synthetic oligonucleotide
tcatccacacagcccccggctcaggcccatgtacctga

SEQ ID NO: 30569 - DNA, 38 bp, Artificial Sequence
  Synthetic oligonucleotide
gccgtccttgttgcgccctctgtacccttgctaattga

SEQ ID NO: 30570 - DNA, 38 bp, Artificial Sequence
  Synthetic oligonucleotide
gatgcgcggtactgttcactgccattctccagacttga

SEQ ID NO: 30571 - DNA, 35 bp, Artificial Sequence
  Synthetic oligonucleotide
gtctggccctctatgtcttgtttacccacaatcac

SEQ ID NO: 30572 - DNA, 35 bp, Artificial Sequence
  Synthetic oligonucleotide
tgcaatcgtacttctcggttccctgctcctgtgac

SEQ ID NO: 30573 - DNA, 35 bp, Artificial Sequence
  Synthetic oligonucleotide
gttgcggcgcaaccttgccgcttaatctaccatac

SEQ ID NO: 30574 - DNA, 35 bp, Artificial Sequence
  Synthetic oligonucleotide
ttcgacccacccggacaaatgcgcacccttcccgc

SEQ ID NO: 30575 - DNA, 35 bp, Artificial Sequence
  Synthetic oligonucleotide
gacacatgagcctcgctcacgaaccagccacctgc

SEQ ID NO: 30576 - DNA, 35 bp, Artificial Sequence
  Synthetic oligonucleotide
ggtcacctccgactccttctacagtgcctcacgct

SEQ ID NO: 30577 - DNA, 35 bp, Artificial Sequence
  Synthetic oligonucleotide
aaagggcgggggggcgattagggattgatagtgtt

SEQ ID NO: 30578 - DNA, 35 bp, Artificial Sequence
  Synthetic oligonucleotide
acaccacgggtaggtgcgatttcacctctattgaa

SEQ ID NO: 30579 - DNA, 36 bp, Artificial Sequence
  Synthetic oligonucleotide
tccgctacagtgtcccttgattcccccatgccttaa

SEQ ID NO: 30580 - DNA, 35 bp, Artificial Sequence
  Synthetic oligonucleotide
gaagccacaccgccttactacgttgttttctgtca

SEQ ID NO: 30581 - DNA, 37 bp, Artificial Sequence
  Synthetic oligonucleotide
gagtaaggatgaggggaaggctgacgggccagggaga

SEQ ID NO: 30582 - DNA, 37 bp, Artificial Sequence
  Synthetic oligonucleotide
gcatcacctcgcctgtatttagccttttatccctgga

SEQ ID NO: 30583 - DNA, 37 bp, Artificial Sequence
  Synthetic oligonucleotide
gagacgacatacctgaccctgctacagtcctgcatga

SEQ ID NO: 30584 - DNA, 38 bp, Artificial Sequence
  Synthetic oligonucleotide
tgacctcgccgcccaccccagcaatcccttccgtatga

SEQ ID NO: 30585 - DNA, 38 bp, Artificial Sequence
  Synthetic oligonucleotide
agatgcaaacggaatcgaagaggaaaaaggggctgtga

SEQ ID NO: 30586 - DNA, 38 bp, Artificial Sequence
  Synthetic oligonucleotide
gcgcacacactcgtcttgcgtaaacacacctcttttga

SEQ ID NO: 30587 - DNA, 35 bp, Artificial Sequence
  Synthetic oligonucleotide
acccgttgcctcctgggacccacgataatacatta

SEQ ID NO: 30588 - DNA, 35 bp, Artificial Sequence
  Synthetic oligonucleotide
ttttaccgccctactcttatctgccgtgagagcac

SEQ ID NO: 30589 - DNA, 35 bp, Artificial Sequence
  Synthetic oligonucleotide
ttggtcaggcctaaacaatgtcttacctccatacc

SEQ ID NO: 30590 - DNA, 35 bp, Artificial Sequence
  Synthetic oligonucleotide
tagagccggatgccaaggccccccgttgttacctc

SEQ ID NO: 30591 - DNA, 35 bp, Artificial Sequence
  Synthetic oligonucleotide
tcccactctcacacgccatagacccgggcacggct

SEQ ID NO: 30592 - DNA, 35 bp, Artificial Sequence
  Synthetic oligonucleotide
gttcattcgcgccaccactggcttcctttactgtt

SEQ ID NO: 30593 - DNA, 36 bp, Artificial Sequence
  Synthetic oligonucleotide
atactctagcgcgcgatccgtaccacaacctgccca

SEQ ID NO: 30594 - DNA, 36 bp, Artificial Sequence
  Synthetic oligonucleotide
gagcctctatagtttcagcacctcgacccgctctca

SEQ ID NO: 30595 - DNA, 37 bp, Artificial Sequence
  Synthetic oligonucleotide
aacgaagaggctggggttgaataggcgggggtcgaga

SEQ ID NO: 30596 - DNA, 37 bp, Artificial Sequence
  Synthetic oligonucleotide
gccaccacacaggttcttccaattgatcgacatacga

SEQ ID NO: 30597 - DNA, 37 bp, Artificial Sequence
  Synthetic oligonucleotide
tacgtagtgcgccccgtttgatccattgctagcccga

SEQ ID NO: 30598 - DNA, 37 bp, Artificial Sequence
  Synthetic oligonucleotide
tgaacacttcagataggagggggacgggggtacagga

SEQ ID NO: 30599 - DNA, 37 bp, Artificial Sequence
  Synthetic oligonucleotide
ttagaagggccaattaaggggttaagggggtagggga

SEQ ID NO: 30600 - DNA, 36 bp, Artificial Sequence
  Synthetic oligonucleotide
ttcgcgctttacccgccctccgcctacgcctttgga

SEQ ID NO: 30601 - DNA, 37 bp, Artificial Sequence
  Synthetic oligonucleotide
gccatactccagcgcattgaacaccctctcgaactga

SEQ ID NO: 30602 - DNA, 38 bp, Artificial Sequence
  Synthetic oligonucleotide
gcctgcacggccatcattagcaatcacgttcttgctga

SEQ ID NO: 30603 - DNA, 37 bp, Artificial Sequence
  Synthetic oligonucleotide
tcacccccaacacagtatgccgtacaagttcatttga

SEQ ID NO: 30604 - DNA, 36 bp, Artificial Sequence
  Synthetic oligonucleotide
tgtaccattagacccaccgagtccgttccctgaata

SEQ ID NO: 30605 - DNA, 35 bp, Artificial Sequence
  Synthetic oligonucleotide
atcggtgccccctacggtaaacttgccatgatacc

SEQ ID NO: 30606 - DNA, 35 bp, Artificial Sequence
  Synthetic oligonucleotide
tcgacggatggcttacaccttctatgcttcacccc

SEQ ID NO: 30607 - DNA, 35 bp, Artificial Sequence
  Synthetic oligonucleotide
tcacacattctcacgtaaggatacgtacgttcccc

SEQ ID NO: 30608 - DNA, 35 bp, Artificial Sequence
  Synthetic oligonucleotide
gcgcactccatatcacgtctccctgccgcacctat

SEQ ID NO: 30609 - DNA, 35 bp, Artificial Sequence
  Synthetic oligonucleotide
tgtatctgccacgtacatagtccaggtcactgtct

SEQ ID NO: 30610 - DNA, 35 bp, Artificial Sequence
  Synthetic oligonucleotide
atcccgttcactctcaacactgtatcgtgctttgt

SEQ ID NO: 30611 - DNA, 36 bp, Artificial Sequence
  Synthetic oligonucleotide
atcactcatcatgctctctagtatccgtgttccaaa

SEQ ID NO: 30612 - DNA, 35 bp, Artificial Sequence
  Synthetic oligonucleotide
gatgtgctaccctctattcgcttatagctcttcca

SEQ ID NO: 30613 - DNA, 36 bp, Artificial Sequence
  Synthetic oligonucleotide
ttctccccgcaaccccatctaattttaggacagtca

SEQ ID NO: 30614 - DNA, 37 bp, Artificial Sequence
  Synthetic oligonucleotide
gggacataggaaggagtggggcgtacgtggggcaaga

SEQ ID NO: 30615 - DNA, 37 bp, Artificial Sequence
  Synthetic oligonucleotide
accctccgcccttccgaccacgtctcaatatgggaga

SEQ ID NO: 30616 - DNA, 37 bp, Artificial Sequence
  Synthetic oligonucleotide
gaattgtaggtggtagtgtggggtgaaggggttgaga

SEQ ID NO: 30617 - DNA, 37 bp, Artificial Sequence
  Synthetic oligonucleotide
aatcgggcgaagggggaagtaggcacaattgggggga

SEQ ID NO: 30618 - DNA, 37 bp, Artificial Sequence
  Synthetic oligonucleotide
tatccgcgccgaagtacttatctcccttccttgtgga

SEQ ID NO: 30619 - DNA, 38 bp, Artificial Sequence
  Synthetic oligonucleotide
agagcgccgcatgctctcgtgccgtctctgccccctga

SEQ ID NO: 30620 - DNA, 36 bp, Artificial Sequence
  Synthetic oligonucleotide
ttgacccgcttaactcgacctgccatcataaagtga

SEQ ID NO: 30621 - DNA, 37 bp, Artificial Sequence
  Synthetic oligonucleotide
acacacccgtgaccacttcgatacttctcttcgttga

SEQ ID NO: 30622 - DNA, 36 bp, Artificial Sequence
  Synthetic oligonucleotide
taccgcccaatcggtgatccgccctgaactacggta

SEQ ID NO: 30623 - DNA, 36 bp, Artificial Sequence
  Synthetic oligonucleotide
agacgagctgcccgaacgggacttgaaccaccctta

SEQ ID NO: 30624 - DNA, 35 bp, Artificial Sequence
  Synthetic oligonucleotide
tgcgaatacgctccttgataacacctccacgatac

SEQ ID NO: 30625 - DNA, 35 bp, Artificial Sequence
  Synthetic oligonucleotide
ggttcacgacctccgaccgactccattccgtgtac

SEQ ID NO: 30626 - DNA, 35 bp, Artificial Sequence
  Synthetic oligonucleotide
atgggtgcaccaacgcaccagaccacaattccacc

SEQ ID NO: 30627 - DNA, 35 bp, Artificial Sequence
  Synthetic oligonucleotide
tactcagatccagtcgtccgttagcaccaactccc

SEQ ID NO: 30628 - DNA, 35 bp, Artificial Sequence
  Synthetic oligonucleotide
gtactgacggtaagtggtagcgaaccttttccatc

SEQ ID NO: 30629 - DNA, 35 bp, Artificial Sequence
  Synthetic oligonucleotide
gccatggtcttctcctacagtccgagcacccgttc

SEQ ID NO: 30630 - DNA, 35 bp, Artificial Sequence
  Synthetic oligonucleotide
atgtcccagcatctccccttcgcgttgcgtagtcg

SEQ ID NO: 30631 - DNA, 34 bp, Artificial Sequence
  Synthetic oligonucleotide
aagatgggaacagggggggcaatttgtcgaaggg

SEQ ID NO: 30632 - DNA, 35 bp, Artificial Sequence
  Synthetic oligonucleotide
tttgtccgggagggtgggtccgtgggatacgcatg

SEQ ID NO: 30633 - DNA, 36 bp, Artificial Sequence
  Synthetic oligonucleotide
tgatggcgtggggagtcgggaggtacaggataagaa

SEQ ID NO: 30634 - DNA, 36 bp, Artificial Sequence
  Synthetic oligonucleotide
tgcaatcctctggtcctgcacccacctttttcccga

SEQ ID NO: 30635 - DNA, 35 bp, Artificial Sequence
  Synthetic oligonucleotide
tagcatgtagaacggcctgagggaacggggaatga

SEQ ID NO: 30636 - DNA, 37 bp, Artificial Sequence
  Synthetic oligonucleotide
tcagcaagcacatcacgcgccccacgtcaccccctga

SEQ ID NO: 30637 - DNA, 38 bp, Artificial Sequence
  Synthetic oligonucleotide
gctcagctcgcggctatcccactgacctacctgagtga

SEQ ID NO: 30638 - DNA, 37 bp, Artificial Sequence
  Synthetic oligonucleotide
gaaagagggggacaatgaggggttcgggagccggtga

SEQ ID NO: 30639 - DNA, 36 bp, Artificial Sequence
  Synthetic oligonucleotide
atacgctcccctggccgggaatgaatcgacccttga

SEQ ID NO: 30640 - DNA, 38 bp, Artificial Sequence
  Synthetic oligonucleotide
gcgccatcacacatacgctgccgcaaacttacctttga

SEQ ID NO: 30641 - DNA, 36 bp, Artificial Sequence
  Synthetic oligonucleotide
tgtctcgccgcagctactccggtcacatcaccagta

SEQ ID NO: 30642 - DNA, 36 bp, Artificial Sequence
  Synthetic oligonucleotide
gcgaggcgcactccctatacgttatgccgcatttta

SEQ ID NO: 30643 - DNA, 35 bp, Artificial Sequence
  Synthetic oligonucleotide
gttaactgcctcctcattactgatggtgccttcac

SEQ ID NO: 30644 - DNA, 35 bp, Artificial Sequence
  Synthetic oligonucleotide
aagacacccacacttcggcaattaaactagtgccc

SEQ ID NO: 30645 - DNA, 35 bp, Artificial Sequence
  Synthetic oligonucleotide
tccgaatcctccgccgaactccacctcgaccacag

SEQ ID NO: 30646 - DNA, 35 bp, Artificial Sequence
  Synthetic oligonucleotide
tcattcgtcacgccccgccgagacttccacccctg

SEQ ID NO: 30647 - DNA, 35 bp, Artificial Sequence
  Synthetic oligonucleotide
gacatgcaacacttcgcccctgtcataaagtcttt

SEQ ID NO: 30648 - DNA, 36 bp, Artificial Sequence
  Synthetic oligonucleotide
gaaccgaagggttgaacgattccccctgaaccatca

SEQ ID NO: 30649 - DNA, 36 bp, Artificial Sequence
  Synthetic oligonucleotide
aaacgcagggggccggaacgggcgggcgggagctca

SEQ ID NO: 30650 - DNA, 37 bp, Artificial Sequence
  Synthetic oligonucleotide
tccgcatcgttgtccgcaaggcctcacactttctcga

SEQ ID NO: 30651 - DNA, 37 bp, Artificial Sequence
  Synthetic oligonucleotide
tcataccgggggagggcggagaggaaggacaactgga

SEQ ID NO: 30652 - DNA, 37 bp, Artificial Sequence
  Synthetic oligonucleotide
gttgatccaggggggaagaagggagtgtgaagtatga

SEQ ID NO: 30653 - DNA, 38 bp, Artificial Sequence
  Synthetic oligonucleotide
ggggaggcgaagggggttgggggcgcacgcggttgtga

SEQ ID NO: 30654 - DNA, 37 bp, Artificial Sequence
  Synthetic oligonucleotide
tccacacaaccgacagcctgccgcgttggacccttga

SEQ ID NO: 30655 - DNA, 36 bp, Artificial Sequence
  Synthetic oligonucleotide
tgtgcgcacctgacaagggtccgacaaccttttata

SEQ ID NO: 30656 - DNA, 36 bp, Artificial Sequence
  Synthetic oligonucleotide
gtgctcccggccagtctgttctatccgcgctagcta

SEQ ID NO: 30657 - DNA, 36 bp, Artificial Sequence
  Synthetic oligonucleotide
agtccccggtactatgacgtgctctcgccgcctgcc

SEQ ID NO: 30658 - DNA, 35 bp, Artificial Sequence
  Synthetic oligonucleotide
tgtaatccgccgaatggccgaagcctcattactcc

SEQ ID NO: 30659 - DNA, 35 bp, Artificial Sequence
  Synthetic oligonucleotide
aatgcatctccgacgccggttcaaccctattccgc

SEQ ID NO: 30660 - DNA, 35 bp, Artificial Sequence
  Synthetic oligonucleotide
tccgatgcgacagtgcttttcatctgtgtcacctg

SEQ ID NO: 30661 - DNA, 35 bp, Artificial Sequence
  Synthetic oligonucleotide
gaccgtcccatcatgtcttaccaccatattcggtg

SEQ ID NO: 30662 - DNA, 35 bp, Artificial Sequence
  Synthetic oligonucleotide
gcatccaactcactcgtcttcgcacctttgcgttt

SEQ ID NO: 30663 - DNA, 35 bp, Artificial Sequence
  Synthetic oligonucleotide
tgtacgtaggaacggggggcatgaaaagtaaagaa

SEQ ID NO: 30664 - DNA, 36 bp, Artificial Sequence
  Synthetic oligonucleotide
gacaggggagagaggttgtgggcggctcatcgcgaa

SEQ ID NO: 30665 - DNA, 36 bp, Artificial Sequence
  Synthetic oligonucleotide
tgtgcatcggcgcttcaattcacacacgtctgctca

SEQ ID NO: 30666 - DNA, 36 bp, Artificial Sequence
  Synthetic oligonucleotide
ggggaccccccctacgcgattcactccccgtgttca

SEQ ID NO: 30667 - DNA, 38 bp, Artificial Sequence
  Synthetic oligonucleotide
aaccaccccgctttatagtgccttgtaaacatatttga

SEQ ID NO: 30668 - DNA, 35 bp, Artificial Sequence
  Synthetic oligonucleotide
tgcggaaggggtgggcggagagggccgatatgcta

SEQ ID NO: 30669 - DNA, 36 bp, Artificial Sequence
  Synthetic oligonucleotide
aagcaccccgatagccctacaccctcagcactcgta

SEQ ID NO: 30670 - DNA, 35 bp, Artificial Sequence
  Synthetic oligonucleotide
tgtcgcacccgtactccgtttgtccgcttccctta

SEQ ID NO: 30671 - DNA, 35 bp, Artificial Sequence
  Synthetic oligonucleotide
tgtctactgccgtttatatcgcaacatcatgccgc

SEQ ID NO: 30672 - DNA, 35 bp, Artificial Sequence
  Synthetic oligonucleotide
actcatgcacgccctcttgtcgcacctatcgtttc

SEQ ID NO: 30673 - DNA, 35 bp, Artificial Sequence
  Synthetic oligonucleotide
taatactcccccttcccgagcatgacgctgccccg

SEQ ID NO: 30674 - DNA, 35 bp, Artificial Sequence
  Synthetic oligonucleotide
ttgcccaccgagtcgctatcacgccccttcacggt

SEQ ID NO: 30675 - DNA, 35 bp, Artificial Sequence
  Synthetic oligonucleotide
gaatcggtaaaggaagggtaggagtgaagtttggt

SEQ ID NO: 30676 - DNA, 35 bp, Artificial Sequence
  Synthetic oligonucleotide
gagccctacatagatttctgcgcttcctgatcttt

SEQ ID NO: 30677 - DNA, 36 bp, Artificial Sequence
  Synthetic oligonucleotide
ttctgccccggcctttacctctgcgcatagtaccaa

SEQ ID NO: 30678 - DNA, 36 bp, Artificial Sequence
  Synthetic oligonucleotide
aatgacacccggcaggtgcgtcttgtaacccccgca

SEQ ID NO: 30679 - DNA, 36 bp, Artificial Sequence
  Synthetic oligonucleotide
tatggatggtgacggggggctgagggggacgggtca

SEQ ID NO: 30680 - DNA, 37 bp, Artificial Sequence
  Synthetic oligonucleotide
aacgccccagcttaccccccgccatcacgcccgtcga

SEQ ID NO: 30681 - DNA, 38 bp, Artificial Sequence
  Synthetic oligonucleotide
agcgggaatgccgctcagggaagtaggatggggaatga

SEQ ID NO: 30682 - DNA, 38 bp, Artificial Sequence
  Synthetic oligonucleotide
acacacgacatggggatagcagagttaggggaatatga

SEQ ID NO: 30683 - DNA, 38 bp, Artificial Sequence
  Synthetic oligonucleotide
gacactccacaccccgtcgactcatgtttctacactga

SEQ ID NO: 30684 - DNA, 38 bp, Artificial Sequence
  Synthetic oligonucleotide
accagcctccttttgttgggaataccctccttcactga

SEQ ID NO: 30685 - DNA, 37 bp, Artificial Sequence
  Synthetic oligonucleotide
tgcgccacccgttggcccccatgacaagttcttctga

SEQ ID NO: 30686 - DNA, 38 bp, Artificial Sequence
  Synthetic oligonucleotide
gcgaagcccccgttgtgttggttcctatccacgcttga

SEQ ID NO: 30687 - DNA, 38 bp, Artificial Sequence
  Synthetic oligonucleotide
gccctgccgccctctcacatgtctcaggccttgcttga

SEQ ID NO: 30688 - DNA, 35 bp, Artificial Sequence
  Synthetic oligonucleotide
gccacgatccgcattacttgcacaccttgtcttga

SEQ ID NO: 30689 - DNA, 38 bp, Artificial Sequence
  Synthetic oligonucleotide
tcattgtcgccgcctctaacacactatctactggttga

SEQ ID NO: 30690 - DNA, 35 bp, Artificial Sequence
  Synthetic oligonucleotide
gtgcaaatccacagctacctttggcgacccgctac

SEQ ID NO: 30691 - DNA, 35 bp, Artificial Sequence
  Synthetic oligonucleotide
ggggatcactggggaaaaaaaagatggaaggcacc

SEQ ID NO: 30692 - DNA, 35 bp, Artificial Sequence
  Synthetic oligonucleotide
ttgcgcctgctaaccttaactgtgtgctacctccc

SEQ ID NO: 30693 - DNA, 35 bp, Artificial Sequence
  Synthetic oligonucleotide
tttacagcgcagttcggcttcccgtattccactct

SEQ ID NO: 30694 - DNA, 35 bp, Artificial Sequence
  Synthetic oligonucleotide
acagagagggtgaagttggggttaaagctcatagt

SEQ ID NO: 30695 - DNA, 36 bp, Artificial Sequence
  Synthetic oligonucleotide
gctcaccaccctagggcacacccaacgtgatcacca

SEQ ID NO: 30696 - DNA, 37 bp, Artificial Sequence
  Synthetic oligonucleotide
ttcaccggaggtcatccattagttcccctcgacacga

SEQ ID NO: 30697 - DNA, 37 bp, Artificial Sequence
  Synthetic oligonucleotide
gcgtggcgggaggcgggtagcaattgggaaaggagga

SEQ ID NO: 30698 - DNA, 37 bp, Artificial Sequence
  Synthetic oligonucleotide
gcggggtgggagggtcttaaggctgaatcaatgggga

SEQ ID NO: 30699 - DNA, 38 bp, Artificial Sequence
  Synthetic oligonucleotide
actgctacgatcagtccggtcacgatgccgccccctga

SEQ ID NO: 30700 - DNA, 38 bp, Artificial Sequence
  Synthetic oligonucleotide
gtgggtcgtattcataagcgtccttgccttccccctga

SEQ ID NO: 30701 - DNA, 37 bp, Artificial Sequence
  Synthetic oligonucleotide
gtgaggacccagatggcggaaggatgaagctggctga

SEQ ID NO: 30702 - DNA, 36 bp, Artificial Sequence
  Synthetic oligonucleotide
atcttcaccggtacacttattacagacactgcacta

SEQ ID NO: 30703 - DNA, 35 bp, Artificial Sequence
  Synthetic oligonucleotide
gtagtacccagccgaacgcacagccctatcttgta

SEQ ID NO: 30704 - DNA, 35 bp, Artificial Sequence
  Synthetic oligonucleotide
tcccatgcgagcacagcgtaacccttcggccatta

SEQ ID NO: 30705 - DNA, 35 bp, Artificial Sequence
  Synthetic oligonucleotide
ttaattgccctgccgtgcatcaccgagcccacaac

SEQ ID NO: 30706 - DNA, 35 bp, Artificial Sequence
  Synthetic oligonucleotide
aacagtccaggccatgcaacagccacagcgcccac

SEQ ID NO: 30707 - DNA, 35 bp, Artificial Sequence
  Synthetic oligonucleotide
gattaggaaggataagggagtggagacagacagac

SEQ ID NO: 30708 - DNA, 35 bp, Artificial Sequence
  Synthetic oligonucleotide
gttcgcaacgcagcaccccatctgtaaacgccgac

SEQ ID NO: 30709 - DNA, 35 bp, Artificial Sequence
  Synthetic oligonucleotide
gaaactccaaaggcgacgcgctcccccgttagccc

SEQ ID NO: 30710 - DNA, 35 bp, Artificial Sequence
  Synthetic oligonucleotide
ttcgcggtcatccttggcccactcctctatagtcc

SEQ ID NO: 30711 - DNA, 35 bp, Artificial Sequence
  Synthetic oligonucleotide
gacgtcgttccggacggttttgctacaccattttc

SEQ ID NO: 30712 - DNA, 35 bp, Artificial Sequence
  Synthetic oligonucleotide
tacgccgatcgcttttggcatactacgcatttctg

SEQ ID NO: 30713 - DNA, 35 bp, Artificial Sequence
  Synthetic oligonucleotide
gcgcacctttccacaagcactcaccgcgctaccat

SEQ ID NO: 30714 - DNA, 35 bp, Artificial Sequence
  Synthetic oligonucleotide
tccacaacgggcggtgctccatcgacatcgtacct

SEQ ID NO: 30715 - DNA, 35 bp, Artificial Sequence
  Synthetic oligonucleotide
ttggggggcggctgtaatcgtttttcatcacctct

SEQ ID NO: 30716 - DNA, 36 bp, Artificial Sequence
  Synthetic oligonucleotide
gacatgggaactggctaggggtgggaccgaactaaa

SEQ ID NO: 30717 - DNA, 36 bp, Artificial Sequence
  Synthetic oligonucleotide
gccaaccggctcatactaaacgttttgctcctacca

SEQ ID NO: 30718 - DNA, 36 bp, Artificial Sequence
  Synthetic oligonucleotide
atggagctccggcggtttttcatacgttccccccca

SEQ ID NO: 30719 - DNA, 35 bp, Artificial Sequence
  Synthetic oligonucleotide
gaccctgtctttgcgttctctacccttcgtcccca

SEQ ID NO: 30720 - DNA, 35 bp, Artificial Sequence
  Synthetic oligonucleotide
ttgcctgacaccactctatttcgagatccttagca

SEQ ID NO: 30721 - DNA, 37 bp, Artificial Sequence
  Synthetic oligonucleotide
gcaacctgcacctggtcctatttcgagctctagctga

SEQ ID NO: 30722 - DNA, 38 bp, Artificial Sequence
  Synthetic oligonucleotide
gccggaaccaccccttcaccagtacactcacatgttga

SEQ ID NO: 30723 - DNA, 36 bp, Artificial Sequence
  Synthetic oligonucleotide
ttcaccgaaaccagccctccccagtccacgccacta

SEQ ID NO: 30724 - DNA, 35 bp, Artificial Sequence
  Synthetic oligonucleotide
agcaccttaatggcaaccagacctgactctgctta

SEQ ID NO: 30725 - DNA, 35 bp, Artificial Sequence
  Synthetic oligonucleotide
attgtcactgccaaactggtaaaccctcatttccc

SEQ ID NO: 30726 - DNA, 35 bp, Artificial Sequence
  Synthetic oligonucleotide
tcagttcatcggccacctattattttactctcgcc

SEQ ID NO: 30727 - DNA, 35 bp, Artificial Sequence
  Synthetic oligonucleotide
gatgcgctctgtggcggccgttagcaattcactcc

SEQ ID NO: 30728 - DNA, 35 bp, Artificial Sequence
  Synthetic oligonucleotide
agtgcgtattacgcatctgacctctcgtttcctcc

SEQ ID NO: 30729 - DNA, 35 bp, Artificial Sequence
  Synthetic oligonucleotide
tgcactcatgtgggtcccttcacctcaccctacgc

SEQ ID NO: 30730 - DNA, 35 bp, Artificial Sequence
  Synthetic oligonucleotide
gttgtccctgctaccggccatggtgctcctcccgc

SEQ ID NO: 30731 - DNA, 35 bp, Artificial Sequence
  Synthetic oligonucleotide
tccaaacttgctgttctcgtccctttatgctggtc

SEQ ID NO: 30732 - DNA, 35 bp, Artificial Sequence
  Synthetic oligonucleotide
acttgactccacaccgcaacagggttccctcattc

SEQ ID NO: 30733 - DNA, 35 bp, Artificial Sequence
  Synthetic oligonucleotide
atagacaactactgtatgccccttgtctatcgacg

SEQ ID NO: 30734 - DNA, 35 bp, Artificial Sequence
  Synthetic oligonucleotide
gaattggtgctgactgaggggggaggggatttggg

SEQ ID NO: 30735 - DNA, 35 bp, Artificial Sequence
  Synthetic oligonucleotide
agctacctccgcactccatccgttacttcatgcct

SEQ ID NO: 30736 - DNA, 35 bp, Artificial Sequence
  Synthetic oligonucleotide
gaccatgcatagctgcatcaaacaatttctctggt

SEQ ID NO: 30737 - DNA, 36 bp, Artificial Sequence
  Synthetic oligonucleotide
gttgacggctgggtgagcaaggggggatgggcgaaa

SEQ ID NO: 30738 - DNA, 36 bp, Artificial Sequence
  Synthetic oligonucleotide
tgcatgacgacggaccacccttgcgcactcaactca

SEQ ID NO: 30739 - DNA, 37 bp, Artificial Sequence
  Synthetic oligonucleotide
agtcgacacggcgaatcaaggaaggtgggcggggaga

SEQ ID NO: 30740 - DNA, 37 bp, Artificial Sequence
  Synthetic oligonucleotide
aaaccaccctcaccgaccacgctctctcgaaggcgga

SEQ ID NO: 30741 - DNA, 35 bp, Artificial Sequence
  Synthetic oligonucleotide
acgcaccccatggcctctgctactcctttaagtga

SEQ ID NO: 30742 - DNA, 38 bp, Artificial Sequence
  Synthetic oligonucleotide
taagccaggagaggagtcaagaaaggctggatcattga

SEQ ID NO: 30743 - DNA, 38 bp, Artificial Sequence
  Synthetic oligonucleotide
acccgttccatcagcacgttctctattgtacacgttga

SEQ ID NO: 30744 - DNA, 35 bp, Artificial Sequence
  Synthetic oligonucleotide
tgtgcgaacccgcgaatgctcacccggccctgcac

SEQ ID NO: 30745 - DNA, 35 bp, Artificial Sequence
  Synthetic oligonucleotide
ttgcaacagcctccgtagtagcgctatacttatcc

SEQ ID NO: 30746 - DNA, 35 bp, Artificial Sequence
  Synthetic oligonucleotide
gacattccacaggttaaaccgttacacttccctct

SEQ ID NO: 30747 - DNA, 36 bp, Artificial Sequence
  Synthetic oligonucleotide
actgaatgacggctggcctcaactccgctctcacaa

SEQ ID NO: 30748 - DNA, 35 bp, Artificial Sequence
  Synthetic oligonucleotide
atactcctcccagggctagtgacacttctcgctca

SEQ ID NO: 30749 - DNA, 37 bp, Artificial Sequence
  Synthetic oligonucleotide
ggaaaagggaacaatggagggatcaggaggacagcga

SEQ ID NO: 30750 - DNA, 37 bp, Artificial Sequence
  Synthetic oligonucleotide
tcgtgcgagccgaaagaacgatgggggggagggcgga

SEQ ID NO: 30751 - DNA, 38 bp, Artificial Sequence
  Synthetic oligonucleotide
gtgcattggctaggggatgggtgggaggggttcgttga

SEQ ID NO: 30752 - DNA, 38 bp, Artificial Sequence
  Synthetic oligonucleotide
tcatcagccgctcgctttccgctggacccatatgttga

SEQ ID NO: 30753 - DNA, 38 bp, Artificial Sequence
  Synthetic oligonucleotide
gactctcaggaacggtattcggctcctctcttttttga

SEQ ID NO: 30754 - DNA, 36 bp, Artificial Sequence
  Synthetic oligonucleotide
gtctgcctgctgccacgcctccacagagtaagccta

SEQ ID NO: 30755 - DNA, 35 bp, Artificial Sequence
  Synthetic oligonucleotide
tcgatcgcccttcttggtgaagaacctccctcgta

SEQ ID NO: 30756 - DNA, 36 bp, Artificial Sequence
  Synthetic oligonucleotide
gccaccatgctctattcgtttctgtttctgctgtta

SEQ ID NO: 30757 - DNA, 35 bp, Artificial Sequence
  Synthetic oligonucleotide
gacgactgagtccttcagtctttatttcgtccctc

SEQ ID NO: 30758 - DNA, 35 bp, Artificial Sequence
  Synthetic oligonucleotide
gggtcctaccacttctgctattcaaaaacctttcg

SEQ ID NO: 30759 - DNA, 34 bp, Artificial Sequence
  Synthetic oligonucleotide
gccccctctacaccattgcactacgtcccttgtg

SEQ ID NO: 30760 - DNA, 35 bp, Artificial Sequence
  Synthetic oligonucleotide
atcgggcactgtccaccaggcctacaaacttactt

SEQ ID NO: 30761 - DNA, 35 bp, Artificial Sequence
  Synthetic oligonucleotide
gcacccccgtattgcttgtcgtttggtggcctttt

SEQ ID NO: 30762 - DNA, 35 bp, Artificial Sequence
  Synthetic oligonucleotide
agagacctgtcgccgccccacccaacacattcgaa

SEQ ID NO: 30763 - DNA, 35 bp, Artificial Sequence
  Synthetic oligonucleotide
ttggaaggcggagggcgactggcggggggtagaca

SEQ ID NO: 30764 - DNA, 37 bp, Artificial Sequence
  Synthetic oligonucleotide
agtcctgcacctcgctgcgtccccgcaatccaatcga

SEQ ID NO: 30765 - DNA, 37 bp, Artificial Sequence
  Synthetic oligonucleotide
tgggtggggctgtagtgtgggaggggaaaatccggga

SEQ ID NO: 30766 - DNA, 36 bp, Artificial Sequence
  Synthetic oligonucleotide
gaccccttcacccggtgccgcctaatacccccgtga

SEQ ID NO: 30767 - DNA, 38 bp, Artificial Sequence
  Synthetic oligonucleotide
tcagcctcctggcaccatacttcccaccctggcattga

SEQ ID NO: 30768 - DNA, 36 bp, Artificial Sequence
  Synthetic oligonucleotide
tcgaggggccgatggaggaaatgtggggggtggata

SEQ ID NO: 30769 - DNA, 35 bp, Artificial Sequence
  Synthetic oligonucleotide
acttcggccgccatgtcgttttcctcgcgccccta

SEQ ID NO: 30770 - DNA, 35 bp, Artificial Sequence
  Synthetic oligonucleotide
gacctcacccacctcctcgtgcatagctcacatta

SEQ ID NO: 30771 - DNA, 35 bp, Artificial Sequence
  Synthetic oligonucleotide
ttcgccgttccactttcgttagctctgtttgtcac

SEQ ID NO: 30772 - DNA, 35 bp, Artificial Sequence
  Synthetic oligonucleotide
tcacacatagcgacactgcctcaacacttagggac

SEQ ID NO: 30773 - DNA, 35 bp, Artificial Sequence
  Synthetic oligonucleotide
taacgttccaccgcgcgcccctaatacgtgccgcc

SEQ ID NO: 30774 - DNA, 35 bp, Artificial Sequence
  Synthetic oligonucleotide
tatcgacctatccctgtagttttttaccagtttgc

SEQ ID NO: 30775 - DNA, 35 bp, Artificial Sequence
  Synthetic oligonucleotide
gtcgacacacctgaaaacagaaccaacactgaatc

SEQ ID NO: 30776 - DNA, 35 bp, Artificial Sequence
  Synthetic oligonucleotide
gcggactctgcaccatcctgctccaatacttattc

SEQ ID NO: 30777 - DNA, 35 bp, Artificial Sequence
  Synthetic oligonucleotide
tactccgaccagcaacttcctgagtcccatagttg

SEQ ID NO: 30778 - DNA, 35 bp, Artificial Sequence
  Synthetic oligonucleotide
tgttagcggctacgtttttccgtcccttcatccgt

SEQ ID NO: 30779 - DNA, 35 bp, Artificial Sequence
  Synthetic oligonucleotide
gcccgacagtcgcctaaaattcgctcattgtcatt

SEQ ID NO: 30780 - DNA, 36 bp, Artificial Sequence
  Synthetic oligonucleotide
tgcgaactcacgggctggggggggaggattaggctt

SEQ ID NO: 30781 - DNA, 36 bp, Artificial Sequence
  Synthetic oligonucleotide
acacccctacgccgagccaaggagaggcccaaaaaa

SEQ ID NO: 30782 - DNA, 36 bp, Artificial Sequence
  Synthetic oligonucleotide
tacatacaaccatctgatcggccctgccacacgcca

SEQ ID NO: 30783 - DNA, 35 bp, Artificial Sequence
  Synthetic oligonucleotide
gtcaactccctagagcctccatctacgctgggcca

SEQ ID NO: 30784 - DNA, 37 bp, Artificial Sequence
  Synthetic oligonucleotide
gccccctctgttattttgcacttgtccgactctacga

SEQ ID NO: 30785 - DNA, 36 bp, Artificial Sequence
  Synthetic oligonucleotide
ttcactccatcttgcagtgttgcaacatttgcccga

SEQ ID NO: 30786 - DNA, 35 bp, Artificial Sequence
  Synthetic oligonucleotide
tgtcctccgtaaggcctactactgctctgtgccga

SEQ ID NO: 30787 - DNA, 36 bp, Artificial Sequence
  Synthetic oligonucleotide
tccgtcctcctgctcgccaccacgctgtctgccgga

SEQ ID NO: 30788 - DNA, 38 bp, Artificial Sequence
  Synthetic oligonucleotide
gacgcctaactccatgcgcctagtgcttcctttactga

SEQ ID NO: 30789 - DNA, 36 bp, Artificial Sequence
  Synthetic oligonucleotide
aaaaaacgcagattcaacttgaacctgtctcccgta

SEQ ID NO: 30790 - DNA, 36 bp, Artificial Sequence
  Synthetic oligonucleotide
gtgaacccaagccaacgacctcgctcttcccaggta

SEQ ID NO: 30791 - DNA, 35 bp, Artificial Sequence
  Synthetic oligonucleotide
tgtgcatatgcctgcccccatgcctcacacaatta

SEQ ID NO: 30792 - DNA, 36 bp, Artificial Sequence
  Synthetic oligonucleotide
gtgggagggcggaggtgggttttcgaacgacggtta

SEQ ID NO: 30793 - DNA, 35 bp, Artificial Sequence
  Synthetic oligonucleotide
acatacccactctctgactcagccggacccgtgac

SEQ ID NO: 30794 - DNA, 35 bp, Artificial Sequence
  Synthetic oligonucleotide
taatgaccatctgtaggttaacacctggccaaccc

SEQ ID NO: 30795 - DNA, 35 bp, Artificial Sequence
  Synthetic oligonucleotide
gtgcatagcctggttccgttcgtgctccgtcctgc

SEQ ID NO: 30796 - DNA, 35 bp, Artificial Sequence
  Synthetic oligonucleotide
agtttcccccagctgcccttaccattcacttgtgc

SEQ ID NO: 30797 - DNA, 35 bp, Artificial Sequence
  Synthetic oligonucleotide
tcgaggcgcgagcacggttacacactcgttccact

SEQ ID NO: 30798 - DNA, 35 bp, Artificial Sequence
  Synthetic oligonucleotide
gcccccctagtgtgtcttattgctggtggctcatt

SEQ ID NO: 30799 - DNA, 35 bp, Artificial Sequence
  Synthetic oligonucleotide
aagacaagacatcacagtcgcccatctagtccttt

SEQ ID NO: 30800 - DNA, 36 bp, Artificial Sequence
  Synthetic oligonucleotide
acacacacgtccaccactcaagtacgtcagtcacaa

SEQ ID NO: 30801 - DNA, 35 bp, Artificial Sequence
  Synthetic oligonucleotide
tccgacgcccggtacttgcagagctccacccttaa

SEQ ID NO: 30802 - DNA, 35 bp, Artificial Sequence
  Synthetic oligonucleotide
tgtgaactcaccgcgcccggtaccctcttctacca

SEQ ID NO: 30803 - DNA, 35 bp, Artificial Sequence
  Synthetic oligonucleotide
tgcgccggtgcctgctcttgtttcctaggttacca

SEQ ID NO: 30804 - DNA, 37 bp, Artificial Sequence
  Synthetic oligonucleotide
actgcagtaaccgtacctgctccatacttcgtgccga

SEQ ID NO: 30805 - DNA, 37 bp, Artificial Sequence
  Synthetic oligonucleotide
gtccgcactccagtccaaccttgccagtttcttcgga

SEQ ID NO: 30806 - DNA, 37 bp, Artificial Sequence
  Synthetic oligonucleotide
gtcaaggggcgggctgggggtatgaagcttgtgggga

SEQ ID NO: 30807 - DNA, 37 bp, Artificial Sequence
  Synthetic oligonucleotide
gcgaagccgctccctttgtctatcaacctttgcatga

SEQ ID NO: 30808 - DNA, 38 bp, Artificial Sequence
  Synthetic oligonucleotide
atcctgtcgcaggtgttggtgccccccatatccgttga

SEQ ID NO: 30809 - DNA, 35 bp, Artificial Sequence
  Synthetic oligonucleotide
gcaaccgcaacactgagcactccaccttccacgta

SEQ ID NO: 30810 - DNA, 36 bp, Artificial Sequence
  Synthetic oligonucleotide
acccactgcccagtttagattgccgattgccccgta

SEQ ID NO: 30811 - DNA, 36 bp, Artificial Sequence
  Synthetic oligonucleotide
ttgccacctgcctctactgtagcctcctctctggta

SEQ ID NO: 30812 - DNA, 35 bp, Artificial Sequence
  Synthetic oligonucleotide
tctccgcacgcaacacctccctgggtagcctactc

SEQ ID NO: 30813 - DNA, 35 bp, Artificial Sequence
  Synthetic oligonucleotide
tgctcactgaatatagtggaaatggatgtcctgcg

SEQ ID NO: 30814 - DNA, 35 bp, Artificial Sequence
  Synthetic oligonucleotide
acgtaaaccgtccctacctcgtaacttgctgctct

SEQ ID NO: 30815 - DNA, 36 bp, Artificial Sequence
  Synthetic oligonucleotide
tcaacgccgtaggcttttacttaccgtggactttgt

SEQ ID NO: 30816 - DNA, 36 bp, Artificial Sequence
  Synthetic oligonucleotide
tgctccatcactacttgctcaagaacttaatcccaa

SEQ ID NO: 30817 - DNA, 37 bp, Artificial Sequence
  Synthetic oligonucleotide
gtaagccggggtggagattggaaggataggcgaggga

SEQ ID NO: 30818 - DNA, 37 bp, Artificial Sequence
  Synthetic oligonucleotide
tcccgcctccatatagttgattccgtttgctctggga

SEQ ID NO: 30819 - DNA, 38 bp, Artificial Sequence
  Synthetic oligonucleotide
ttgccacagtcgcccctctatactgtcgaaagacatga

SEQ ID NO: 30820 - DNA, 38 bp, Artificial Sequence
  Synthetic oligonucleotide
atctgcgcgtggttctagttccttccatccctacctga

SEQ ID NO: 30821 - DNA, 36 bp, Artificial Sequence
  Synthetic oligonucleotide
tccaccaccttctgcgctgggcttattgatttctga

SEQ ID NO: 30822 - DNA, 38 bp, Artificial Sequence
  Synthetic oligonucleotide
atcacgtggagggttttcggaaccaggagaggaggtga

SEQ ID NO: 30823 - DNA, 38 bp, Artificial Sequence
  Synthetic oligonucleotide
gcagaacagggggatgaaaaaggggtactcggctgtga

SEQ ID NO: 30824 - DNA, 38 bp, Artificial Sequence
  Synthetic oligonucleotide
gccccacgcgctccttgttgcttcctatgtccgtttga

SEQ ID NO: 30825 - DNA, 35 bp, Artificial Sequence
  Synthetic oligonucleotide
gatcatcctccaacgttcaaaaacggagttttata

SEQ ID NO: 30826 - DNA, 36 bp, Artificial Sequence
  Synthetic oligonucleotide
gctacaccgcaacccggggacaacacaaattcctta

SEQ ID NO: 30827 - DNA, 35 bp, Artificial Sequence
  Synthetic oligonucleotide
acaccccctctcccggcggtcttaccctcttcgac

SEQ ID NO: 30828 - DNA, 35 bp, Artificial Sequence
  Synthetic oligonucleotide
tcactcccgccatacatacgcccatcaggaaaacc

SEQ ID NO: 30829 - DNA, 35 bp, Artificial Sequence
  Synthetic oligonucleotide
acgttaccgccacccgtctcctgatcctgagcacc

SEQ ID NO: 30830 - DNA, 35 bp, Artificial Sequence
  Synthetic oligonucleotide
gtcacctttcgggtctctgttctttttgcatgccc

SEQ ID NO: 30831 - DNA, 35 bp, Artificial Sequence
  Synthetic oligonucleotide
gcgcccaccactaccaggaacctatacagaacgcc

SEQ ID NO: 30832 - DNA, 35 bp, Artificial Sequence
  Synthetic oligonucleotide
gttacatccaactgccatttcacgatctgtttcgc

SEQ ID NO: 30833 - DNA, 35 bp, Artificial Sequence
  Synthetic oligonucleotide
accctcagccgcctcctttcccgcacccactcgcg

SEQ ID NO: 30834 - DNA, 35 bp, Artificial Sequence
  Synthetic oligonucleotide
gcgcgatggcagggtgttcggggggggattgtggg

SEQ ID NO: 30835 - DNA, 35 bp, Artificial Sequence
  Synthetic oligonucleotide
tgtatccaactgaacgcgtgtccctttgcccacca

SEQ ID NO: 30836 - DNA, 36 bp, Artificial Sequence
  Synthetic oligonucleotide
actagcccatcagcgcccaaccgacaacactcgcca

SEQ ID NO: 30837 - DNA, 36 bp, Artificial Sequence
  Synthetic oligonucleotide
gcggaacgcaatccttcgctccctggggccaatcca

SEQ ID NO: 30838 - DNA, 36 bp, Artificial Sequence
  Synthetic oligonucleotide
gtgccacggtcaaaatgaatcgtcgcccttcatcca

SEQ ID NO: 30839 - DNA, 35 bp, Artificial Sequence
  Synthetic oligonucleotide
gccccctctggcggtccctctcatatcaataggca

SEQ ID NO: 30840 - DNA, 37 bp, Artificial Sequence
  Synthetic oligonucleotide
acactaccccgccgtcaataacctcaccatggccaga

SEQ ID NO: 30841 - DNA, 37 bp, Artificial Sequence
  Synthetic oligonucleotide
gacacctcagcgatcacggcttttgctacttctccga

SEQ ID NO: 30842 - DNA, 37 bp, Artificial Sequence
  Synthetic oligonucleotide
gtcgtcacgtacatccagcccctaaactccacagcga

SEQ ID NO: 30843 - DNA, 35 bp, Artificial Sequence
  Synthetic oligonucleotide
gaacctcccccctcttcccgtacaagctgaatcga

SEQ ID NO: 30844 - DNA, 35 bp, Artificial Sequence
  Synthetic oligonucleotide
tgacctaccgaccctctcatagccccatggacgga

SEQ ID NO: 30845 - DNA, 38 bp, Artificial Sequence
  Synthetic oligonucleotide
tacaccccgtactcgcactatgcacaagctagccatga

SEQ ID NO: 30846 - DNA, 38 bp, Artificial Sequence
  Synthetic oligonucleotide
gaaaccgcacctgactctggcacataaaccgattttga

SEQ ID NO: 30847 - DNA, 35 bp, Artificial Sequence
  Synthetic oligonucleotide
tacccacgcaccgccgccccatgagctacactacc

SEQ ID NO: 30848 - DNA, 35 bp, Artificial Sequence
  Synthetic oligonucleotide
gccggagacacccctttcccgaccccttccaaaag

SEQ ID NO: 30849 - DNA, 35 bp, Artificial Sequence
  Synthetic oligonucleotide
atctgccccacacctgtctactcaacatgaactat

SEQ ID NO: 30850 - DNA, 35 bp, Artificial Sequence
  Synthetic oligonucleotide
tccgaggccgccagctcttggaactttaatcacct

SEQ ID NO: 30851 - DNA, 35 bp, Artificial Sequence
  Synthetic oligonucleotide
gtgctctcgtcacaaccaccgtaactcctgcgtgt

SEQ ID NO: 30852 - DNA, 36 bp, Artificial Sequence
  Synthetic oligonucleotide
tgcatccgtgcgcggaactcagtgtcttctccctca

SEQ ID NO: 30853 - DNA, 37 bp, Artificial Sequence
  Synthetic oligonucleotide
tcagcaccatcccacccgccggtttcgccgttcgaga

SEQ ID NO: 30854 - DNA, 36 bp, Artificial Sequence
  Synthetic oligonucleotide
gcggtatggtccaactgccaccctgcttccctcgga

SEQ ID NO: 30855 - DNA, 36 bp, Artificial Sequence
  Synthetic oligonucleotide
agctggagcgcgaaatgggggggtgggcgccgtgga

SEQ ID NO: 30856 - DNA, 38 bp, Artificial Sequence
  Synthetic oligonucleotide
tccacctccatgacgaaactaatacggtcacatcatga

SEQ ID NO: 30857 - DNA, 37 bp, Artificial Sequence
  Synthetic oligonucleotide
agaggggggcgggagttgacactgaggtggtgggtga

SEQ ID NO: 30858 - DNA, 35 bp, Artificial Sequence
  Synthetic oligonucleotide
ttccagccgctcctgtccagcctcactactaggac

SEQ ID NO: 30859 - DNA, 34 bp, Artificial Sequence
  Synthetic oligonucleotide
gcccaccgcgaggtccgtcgctacacaccaatac

SEQ ID NO: 30860 - DNA, 35 bp, Artificial Sequence
  Synthetic oligonucleotide
acgcgatcagtcctagttcgcgcctttgtttaacc

SEQ ID NO: 30861 - DNA, 35 bp, Artificial Sequence
  Synthetic oligonucleotide
accatcaagctttgggagcccatccattttcgtgc

SEQ ID NO: 30862 - DNA, 35 bp, Artificial Sequence
  Synthetic oligonucleotide
aagcacccacctgcgtttgacctctcgtgtaattc

SEQ ID NO: 30863 - DNA, 35 bp, Artificial Sequence
  Synthetic oligonucleotide
tcgatgtcgaacacgacacatttagaacgatcttc

SEQ ID NO: 30864 - DNA, 35 bp, Artificial Sequence
  Synthetic oligonucleotide
gcaccatccacatgctttcgtccggtactaataat

SEQ ID NO: 30865 - DNA, 35 bp, Artificial Sequence
  Synthetic oligonucleotide
attcactccagttttcccatatcgaggtcacacct

SEQ ID NO: 30866 - DNA, 35 bp, Artificial Sequence
  Synthetic oligonucleotide
tgaggagggacggggagtgcagagagaagtcaaaa

SEQ ID NO: 30867 - DNA, 35 bp, Artificial Sequence
  Synthetic oligonucleotide
cctcaccccaattccctgtccacgtccacggccaa

SEQ ID NO: 30868 - DNA, 36 bp, Artificial Sequence
  Synthetic oligonucleotide
tccttactgggcctgtcgtgactcaatctgctcaca

SEQ ID NO: 30869 - DNA, 37 bp, Artificial Sequence
  Synthetic oligonucleotide
ctgtcccatccgtagctgattccgacacaggcggaga

SEQ ID NO: 30870 - DNA, 37 bp, Artificial Sequence
  Synthetic oligonucleotide
agggacgcaaggtgggtgaatgggggtgggtttccga

SEQ ID NO: 30871 - DNA, 38 bp, Artificial Sequence
  Synthetic oligonucleotide
tcagcccaactctgctaggtaacttatcttcaccgtga

SEQ ID NO: 30872 - DNA, 37 bp, Artificial Sequence
  Synthetic oligonucleotide
agctccttcccgcctccacctctatcgccagccttga

SEQ ID NO: 30873 - DNA, 35 bp, Artificial Sequence
  Synthetic oligonucleotide
acgaacggcatatggtggcacacacatccgcccta

SEQ ID NO: 30874 - DNA, 35 bp, Artificial Sequence
  Synthetic oligonucleotide
aaccccgctttgaccaactcttgatcagtttgcac

SEQ ID NO: 30875 - DNA, 35 bp, Artificial Sequence
  Synthetic oligonucleotide
ttcgtccagaggtcctgttcttccataattgtcac

SEQ ID NO: 30876 - DNA, 35 bp, Artificial Sequence
  Synthetic oligonucleotide
tgtgtacccgccttatacctgacccttcataatac

SEQ ID NO: 30877 - DNA, 35 bp, Artificial Sequence
  Synthetic oligonucleotide
tccactctcgccgtaaacttccatcatgtttccgc

SEQ ID NO: 30878 - DNA, 35 bp, Artificial Sequence
  Synthetic oligonucleotide
gccactacacgaccgagcccactgcgcgtaattgc

SEQ ID NO: 30879 - DNA, 35 bp, Artificial Sequence
  Synthetic oligonucleotide
ggtgggccctcgccgacggacgccaaacttctctc

SEQ ID NO: 30880 - DNA, 35 bp, Artificial Sequence
  Synthetic oligonucleotide
gcccagccgaaatcccgagcagcatgcgccccttc

SEQ ID NO: 30881 - DNA, 35 bp, Artificial Sequence
  Synthetic oligonucleotide
aatgagggggcgggtgttcacttaggggtttgttc

SEQ ID NO: 30882 - DNA, 35 bp, Artificial Sequence
  Synthetic oligonucleotide
agcacccgattgctcatgcaagttactttccctcg

SEQ ID NO: 30883 - DNA, 35 bp, Artificial Sequence
  Synthetic oligonucleotide
gtgccgcctacttaattcgcccgtcctcatcctgg

SEQ ID NO: 30884 - DNA, 35 bp, Artificial Sequence
  Synthetic oligonucleotide
ggtcagggtagtcggattatagggtgggtgggtgg

SEQ ID NO: 30885 - DNA, 35 bp, Artificial Sequence
  Synthetic oligonucleotide
ttgactaccaattcgtgggcaataactgcctttat

SEQ ID NO: 30886 - DNA, 35 bp, Artificial Sequence
  Synthetic oligonucleotide
gcgcctggccccaagctccctatgatctggcatct

SEQ ID NO: 30887 - DNA, 35 bp, Artificial Sequence
  Synthetic oligonucleotide
agtactggcctcgtgcgcctgcaagacctcattct

SEQ ID NO: 30888 - DNA, 36 bp, Artificial Sequence
  Synthetic oligonucleotide
tcagcgggctaccaaccggttatacgttcgcctcca

SEQ ID NO: 30889 - DNA, 37 bp, Artificial Sequence
  Synthetic oligonucleotide
tgacacctttgcccaatcgtgttacaccgccttaaga

SEQ ID NO: 30890 - DNA, 37 bp, Artificial Sequence
  Synthetic oligonucleotide
gccactctcgtctcaactaactgttcctgtcgcccga

SEQ ID NO: 30891 - DNA, 36 bp, Artificial Sequence
  Synthetic oligonucleotide
gacacccccccgggcgcgttcttcttgcctcatcga

SEQ ID NO: 30892 - DNA, 37 bp, Artificial Sequence
  Synthetic oligonucleotide
aacacactctgtccttgtacatctgatctcctctcga

SEQ ID NO: 30893 - DNA, 37 bp, Artificial Sequence
  Synthetic oligonucleotide
gcctctggtcgttctgccccccctgccatcttgagga

SEQ ID NO: 30894 - DNA, 37 bp, Artificial Sequence
  Synthetic oligonucleotide
aacaacctgcgtacgttcgaaacactcttcagctgga

SEQ ID NO: 30895 - DNA, 37 bp, Artificial Sequence
  Synthetic oligonucleotide
aactaacccacccccgtcgttgtctccatcggactga

SEQ ID NO: 30896 - DNA, 38 bp, Artificial Sequence
  Synthetic oligonucleotide
tgaaccgccgatctttcaccccctctaagctgccgtga

SEQ ID NO: 30897 - DNA, 38 bp, Artificial Sequence
  Synthetic oligonucleotide
taacagggacggaggtggttcgaataatgggggcgtga

SEQ ID NO: 30898 - DNA, 38 bp, Artificial Sequence
  Synthetic oligonucleotide
atggagggcatttgttattatcctgcctgctatcgtga

SEQ ID NO: 30899 - DNA, 38 bp, Artificial Sequence
  Synthetic oligonucleotide
actcacctgcgcatagccttagtgcagttgccttttga

SEQ ID NO: 30900 - DNA, 35 bp, Artificial Sequence
  Synthetic oligonucleotide
gacttcacgccggcattactttctattcgttgaac

SEQ ID NO: 30901 - DNA, 35 bp, Artificial Sequence
  Synthetic oligonucleotide
gagaccctgccacattcggttggctccgaacaacc

SEQ ID NO: 30902 - DNA, 35 bp, Artificial Sequence
  Synthetic oligonucleotide
acaaccaactacgccaacgctgaaagcgtcctacc

SEQ ID NO: 30903 - DNA, 35 bp, Artificial Sequence
  Synthetic oligonucleotide
tccacattgcttcacctatcttaatactagggccc

SEQ ID NO: 30904 - DNA, 35 bp, Artificial Sequence
  Synthetic oligonucleotide
gtgacgcatttcgcataagcctagctactatcatc

SEQ ID NO: 30905 - DNA, 35 bp, Artificial Sequence
  Synthetic oligonucleotide
accctcccccggcgctgtagctcacgtccggtttc

SEQ ID NO: 30906 - DNA, 34 bp, Artificial Sequence
  Synthetic oligonucleotide
accaccccctcgccaggagtatttgtctgggttg

SEQ ID NO: 30907 - DNA, 35 bp, Artificial Sequence
  Synthetic oligonucleotide
acgctcactcgccctgtgcccatttccatcactat

SEQ ID NO: 30908 - DNA, 35 bp, Artificial Sequence
  Synthetic oligonucleotide
tacgcaccgtcgcgctccaccttcccccgacgact

SEQ ID NO: 30909 - DNA, 35 bp, Artificial Sequence
  Synthetic oligonucleotide
gcgatgcgctctcaatggctgctctttcttcttct

SEQ ID NO: 30910 - DNA, 35 bp, Artificial Sequence
  Synthetic oligonucleotide
gacgcccaatcgaaatcaagcgcaagttcttcctt

SEQ ID NO: 30911 - DNA, 35 bp, Artificial Sequence
  Synthetic oligonucleotide
tagatgtccccgcccttgacgctgctttcttggtt

SEQ ID NO: 30912 - DNA, 36 bp, Artificial Sequence
  Synthetic oligonucleotide
tcccgtgctggccccctaccgataaagtaccaccaa

SEQ ID NO: 30913 - DNA, 36 bp, Artificial Sequence
  Synthetic oligonucleotide
agtggggggggggaacagggatcgtgagacatgtca

SEQ ID NO: 30914 - DNA, 37 bp, Artificial Sequence
  Synthetic oligonucleotide
gaccccccgccgctgtaatctcgcacaatattctaga

SEQ ID NO: 30915 - DNA, 37 bp, Artificial Sequence
  Synthetic oligonucleotide
gacacgccagaatatgtgtcacaatttaccccgccga

SEQ ID NO: 30916 - DNA, 36 bp, Artificial Sequence
  Synthetic oligonucleotide
atcaactgatactgcctacttacatccctgccagga

SEQ ID NO: 30917 - DNA, 38 bp, Artificial Sequence
  Synthetic oligonucleotide
ttccaacgtaggggaggggagggacggacttaggatga

SEQ ID NO: 30918 - DNA, 38 bp, Artificial Sequence
  Synthetic oligonucleotide
tctattgccacctgccccgaacgaagagcgtccactga

SEQ ID NO: 30919 - DNA, 38 bp, Artificial Sequence
  Synthetic oligonucleotide
ggaaccgccataatctcccccagcgagcacgcaagtga

SEQ ID NO: 30920 - DNA, 38 bp, Artificial Sequence
  Synthetic oligonucleotide
ttgctatcaaacgtgcaattcgaaccaccaccccttga

SEQ ID NO: 30921 - DNA, 37 bp, Artificial Sequence
  Synthetic oligonucleotide
ttgtgccaaacctcatttaccgctttccgaccgttga

SEQ ID NO: 30922 - DNA, 35 bp, Artificial Sequence
  Synthetic oligonucleotide
gaatgccaccccacaaaacgcgtttatcgaccata

SEQ ID NO: 30923 - DNA, 36 bp, Artificial Sequence
  Synthetic oligonucleotide
gcgcgcaccacttgctgacttttgctacattactta

SEQ ID NO: 30924 - DNA, 36 bp, Artificial Sequence
  Synthetic oligonucleotide
gacccctcgcacatacatttctgcataaactgttta

SEQ ID NO: 30925 - DNA, 35 bp, Artificial Sequence
  Synthetic oligonucleotide
gtggtcggaccctcattcagtctttcttctggccc

SEQ ID NO: 30926 - DNA, 35 bp, Artificial Sequence
  Synthetic oligonucleotide
acgacgcccttaacacataatcatgagcaacacgc

SEQ ID NO: 30927 - DNA, 35 bp, Artificial Sequence
  Synthetic oligonucleotide
gatgctccgtccccctcgtcatcagcctacctgtc

SEQ ID NO: 30928 - DNA, 35 bp, Artificial Sequence
  Synthetic oligonucleotide
gcctaccatcgccgctatatttcagggcctcaatg

SEQ ID NO: 30929 - DNA, 35 bp, Artificial Sequence
  Synthetic oligonucleotide
tgaaccctttggccaaacataatactggtgaaact

SEQ ID NO: 30930 - DNA, 35 bp, Artificial Sequence
  Synthetic oligonucleotide
gacatcagcccgaccttgttgcgtgccctgcgcct

SEQ ID NO: 30931 - DNA, 35 bp, Artificial Sequence
  Synthetic oligonucleotide
tcacgatcgcatcagcgaataagtcctcgcccaaa

SEQ ID NO: 30932 - DNA, 36 bp, Artificial Sequence
  Synthetic oligonucleotide
gattccgtccagcgcgcgtcgatcccaccttttgca

SEQ ID NO: 30933 - DNA, 36 bp, Artificial Sequence
  Synthetic oligonucleotide
gatggcaaaccaactggaaccgacttacatgcctca

SEQ ID NO: 30934 - DNA, 35 bp, Artificial Sequence
  Synthetic oligonucleotide
ggtgtgcaccattcgcatccgccacactggcttca

SEQ ID NO: 30935 - DNA, 38 bp, Artificial Sequence
  Synthetic oligonucleotide
tgaccatcccaaatccattcaccgtcagcgaagcgcga

SEQ ID NO: 30936 - DNA, 37 bp, Artificial Sequence
  Synthetic oligonucleotide
gcccattagcctccgcctagcatccttcttgacagga

SEQ ID NO: 30937 - DNA, 35 bp, Artificial Sequence
  Synthetic oligonucleotide
agtgcggctcaaaaagggaaagggtggagatagga

SEQ ID NO: 30938 - DNA, 35 bp, Artificial Sequence
  Synthetic oligonucleotide
gtttacgcccacccttgttacggacccgatttgga

SEQ ID NO: 30939 - DNA, 38 bp, Artificial Sequence
  Synthetic oligonucleotide
ttgtagacagcagcccatgtccacgacgagaccactga

SEQ ID NO: 30940 - DNA, 35 bp, Artificial Sequence
  Synthetic oligonucleotide
ggtgggcaccccgcctattgtaactccctatcaac

SEQ ID NO: 30941 - DNA, 35 bp, Artificial Sequence
  Synthetic oligonucleotide
tacctcaccgattcggaagcgttgctcaccttccc

SEQ ID NO: 30942 - DNA, 35 bp, Artificial Sequence
  Synthetic oligonucleotide
agtctgtgggtccattgcttactgctgctccgttc

SEQ ID NO: 30943 - DNA, 35 bp, Artificial Sequence
  Synthetic oligonucleotide
tatgtggcggggtgggagtattaaggggaaatcag

SEQ ID NO: 30944 - DNA, 35 bp, Artificial Sequence
  Synthetic oligonucleotide
gccctacgccacttacataccagtcccttttggag

SEQ ID NO: 30945 - DNA, 34 bp, Artificial Sequence
  Synthetic oligonucleotide
tagtaggttagctctgtccgaccgctccccttct

SEQ ID NO: 30946 - DNA, 35 bp, Artificial Sequence
  Synthetic oligonucleotide
tactcgcccgactgttactccagttgtagtgttct

SEQ ID NO: 30947 - DNA, 35 bp, Artificial Sequence
  Synthetic oligonucleotide
gatgcatccatctaagacccctgtggctaacccgt

SEQ ID NO: 30948 - DNA, 35 bp, Artificial Sequence
  Synthetic oligonucleotide
attggcgggtgggaagggctgggtactttctatgt

SEQ ID NO: 30949 - DNA, 35 bp, Artificial Sequence
  Synthetic oligonucleotide
gacacgtccaaggggaacaacctgattggtagatt

SEQ ID NO: 30950 - DNA, 35 bp, Artificial Sequence
  Synthetic oligonucleotide
accatactgcgcatgtacgttactttcttgcgttt

SEQ ID NO: 30951 - DNA, 35 bp, Artificial Sequence
  Synthetic oligonucleotide
tgtggtggtcgccccaatgcttggctaaaactttt

SEQ ID NO: 30952 - DNA, 36 bp, Artificial Sequence
  Synthetic oligonucleotide
tacatcaccgtacatcacctgggctgctagcataaa

SEQ ID NO: 30953 - DNA, 35 bp, Artificial Sequence
  Synthetic oligonucleotide
acagagcacccatttaggaaaccccgctggtacca

SEQ ID NO: 30954 - DNA, 35 bp, Artificial Sequence
  Synthetic oligonucleotide
taatccctgcgtccactatgtctctgcctttacca

SEQ ID NO: 30955 - DNA, 36 bp, Artificial Sequence
  Synthetic oligonucleotide
ttagcccctctgaatggccttacacccctctgatca

SEQ ID NO: 30956 - DNA, 37 bp, Artificial Sequence
  Synthetic oligonucleotide
gactccagcgcacggccccagtttctcacaccgaaga

SEQ ID NO: 30957 - DNA, 37 bp, Artificial Sequence
  Synthetic oligonucleotide
agacaatgcgggctagggggggtagtgctgaaaggga

SEQ ID NO: 30958 - DNA, 35 bp, Artificial Sequence
  Synthetic oligonucleotide
ggtcgaacaagtttgaaggggggagggactatgga

SEQ ID NO: 30959 - DNA, 37 bp, Artificial Sequence
  Synthetic oligonucleotide
acactcgcaaccccaggcccaccaccagtcacgatga

SEQ ID NO: 30960 - DNA, 38 bp, Artificial Sequence
  Synthetic oligonucleotide
tcacggctccatccccagcagtagccactataacctga

SEQ ID NO: 30961 - DNA, 38 bp, Artificial Sequence
  Synthetic oligonucleotide
gacggagtgtcaaatcatcgctgtgccatccctcttga

SEQ ID NO: 30962 - DNA, 38 bp, Artificial Sequence
  Synthetic oligonucleotide
atgctcaccacctttgtcgcttttgcgaggttctttga

SEQ ID NO: 30963 - DNA, 36 bp, Artificial Sequence
  Synthetic oligonucleotide
gatgagccgccgttgcaccactatacaatctgacta

SEQ ID NO: 30964 - DNA, 36 bp, Artificial Sequence
  Synthetic oligonucleotide
gaataccacgaacagtgtaaacaccctcctccgcta

SEQ ID NO: 30965 - DNA, 35 bp, Artificial Sequence
  Synthetic oligonucleotide
acacgacagggtactgatccgttccatgcctttta

SEQ ID NO: 30966 - DNA, 35 bp, Artificial Sequence
  Synthetic oligonucleotide
gaccaccctaggttctcgctcgagaagcccgttcc

SEQ ID NO: 30967 - DNA, 35 bp, Artificial Sequence
  Synthetic oligonucleotide
gatgcgggccagtcggtctcgtcttcaaattttcc

SEQ ID NO: 30968 - DNA, 35 bp, Artificial Sequence
  Synthetic oligonucleotide
accccgagaacgaacaagggcaaccatcgagcttc

SEQ ID NO: 30969 - DNA, 35 bp, Artificial Sequence
  Synthetic oligonucleotide
tcaaccaccgcgcgggttggcttagactcctgttc

SEQ ID NO: 30970 - DNA, 35 bp, Artificial Sequence
  Synthetic oligonucleotide
ggagccgccttccacccgagccttaatcgtagcaa

SEQ ID NO: 30971 - DNA, 35 bp, Artificial Sequence
  Synthetic oligonucleotide
acacccctctcactaactcgtctcgccacagctaa

SEQ ID NO: 30972 - DNA, 35 bp, Artificial Sequence
  Synthetic oligonucleotide
tgcccccgacgagcacccactctcgcctgtgttaa

SEQ ID NO: 30973 - DNA, 36 bp, Artificial Sequence
  Synthetic oligonucleotide
gtggtcgctgcaactgtccttttagctcagtcaaca

SEQ ID NO: 30974 - DNA, 36 bp, Artificial Sequence
  Synthetic oligonucleotide
gactacaccccagcaagctatgcgatttatcctgca

SEQ ID NO: 30975 - DNA, 36 bp, Artificial Sequence
  Synthetic oligonucleotide
gaaccatcaacctgtccgctccgatcccgacagtca

SEQ ID NO: 30976 - DNA, 35 bp, Artificial Sequence
  Synthetic oligonucleotide
tccagcgaacccgaaattagcgatctcacccttca

SEQ ID NO: 30977 - DNA, 37 bp, Artificial Sequence
  Synthetic oligonucleotide
actgaaacggggcacaaggcaaaagggagaaggacga

SEQ ID NO: 30978 - DNA, 38 bp, Artificial Sequence
  Synthetic oligonucleotide
tgggccccgcaattttccacaacccacatcctacgtga

SEQ ID NO: 30979 - DNA, 35 bp, Artificial Sequence
  Synthetic oligonucleotide
gtccggcggcctccgcgctcccttatacaactgcc

SEQ ID NO: 30980 - DNA, 35 bp, Artificial Sequence
  Synthetic oligonucleotide
tctagccggtagtgtatgttcccctcactttttcc

SEQ ID NO: 30981 - DNA, 35 bp, Artificial Sequence
  Synthetic oligonucleotide
gcctccactccgcgtcctatttaatctcccgatgc

SEQ ID NO: 30982 - DNA, 35 bp, Artificial Sequence
  Synthetic oligonucleotide
gtcagtgtacacaccgccatcccgagaattagttc

SEQ ID NO: 30983 - DNA, 35 bp, Artificial Sequence
  Synthetic oligonucleotide
cacaccccagacacacaaccggctccaatgaggag

SEQ ID NO: 30984 - DNA, 35 bp, Artificial Sequence
  Synthetic oligonucleotide
tacagggcgagagatcactgggtgctggggaaagg

SEQ ID NO: 30985 - DNA, 35 bp, Artificial Sequence
  Synthetic oligonucleotide
tgactgcaaacatgtcttgtcctaaatactctctg

SEQ ID NO: 30986 - DNA, 35 bp, Artificial Sequence
  Synthetic oligonucleotide
tatcgccgccatccacctctcgcataagggccggt

SEQ ID NO: 30987 - DNA, 35 bp, Artificial Sequence
  Synthetic oligonucleotide
gctctccgtccaagctcccgactgccttgcacctt

SEQ ID NO: 30988 - DNA, 36 bp, Artificial Sequence
  Synthetic oligonucleotide
acgggaagaaggggtgagggcagattggggtagaaa

SEQ ID NO: 30989 - DNA, 34 bp, Artificial Sequence
  Synthetic oligonucleotide
tccgcgccgcacagcctttgttgccctgcttcaa

SEQ ID NO: 30990 - DNA, 35 bp, Artificial Sequence
  Synthetic oligonucleotide
ttgcgcggttcacgttcccgccgttttccttcaca

SEQ ID NO: 30991 - DNA, 36 bp, Artificial Sequence
  Synthetic oligonucleotide
ttcacaccatccgcctttgttccagtggctcttcca

SEQ ID NO: 30992 - DNA, 35 bp, Artificial Sequence
  Synthetic oligonucleotide
agccacgttcggcttcctcactcgttgtccgctca

SEQ ID NO: 30993 - DNA, 37 bp, Artificial Sequence
  Synthetic oligonucleotide
accggggtggcaaagggtagataggcatggatgaaga

SEQ ID NO: 30994 - DNA, 37 bp, Artificial Sequence
  Synthetic oligonucleotide
acatctctgggccgggagggtgggcgtaaccaaacga

SEQ ID NO: 30995 - DNA, 37 bp, Artificial Sequence
  Synthetic oligonucleotide
accatctaccagcctgccttgatactacccaccatga

SEQ ID NO: 30996 - DNA, 38 bp, Artificial Sequence
  Synthetic oligonucleotide
gcgtatcaccccgtccgccgtcaactgcccacatctga

SEQ ID NO: 30997 - DNA, 38 bp, Artificial Sequence
  Synthetic oligonucleotide
gcaacaagcacgaagggcgatacggaaggctggggtga

SEQ ID NO: 30998 - DNA, 37 bp, Artificial Sequence
  Synthetic oligonucleotide
gattagccctgagcttgtacacctctcgtatctgtga

SEQ ID NO: 30999 - DNA, 38 bp, Artificial Sequence
  Synthetic oligonucleotide
gcgccccctccggttgaccactcgatgcacatgcttga

SEQ ID NO: 31000 - DNA, 38 bp, Artificial Sequence
  Synthetic oligonucleotide
atcgaccgtacctctctgctacatctccttgcctttga

SEQ ID NO: 31001 - DNA, 37 bp, Artificial Sequence
  Synthetic oligonucleotide
tgccgctgtccctgtcctcgtgccatgactcttttga

SEQ ID NO: 31002 - DNA, 35 bp, Artificial Sequence
  Synthetic oligonucleotide
acccgcacgttctgcgcgtacttacggcccccata

SEQ ID NO: 31003 - DNA, 36 bp, Artificial Sequence
  Synthetic oligonucleotide
atgacgcacaataacgccgcgattttcccgcctgta

SEQ ID NO: 31004 - DNA, 36 bp, Artificial Sequence
  Synthetic oligonucleotide
attgcgctcccccggcaccactccgcagttatgtta

SEQ ID NO: 31005 - DNA, 35 bp, Artificial Sequence
  Synthetic oligonucleotide
tgtccatcttcccaccgcgcgaggagacaaccaac

SEQ ID NO: 31006 - DNA, 35 bp, Artificial Sequence
  Synthetic oligonucleotide
acacccacgttgtctccaagcttcatcccatacac

SEQ ID NO: 31007 - DNA, 35 bp, Artificial Sequence
  Synthetic oligonucleotide
ttcatccatactcgctgacgagtctctgcctttgc

SEQ ID NO: 31008 - DNA, 35 bp, Artificial Sequence
  Synthetic oligonucleotide
gtgttgcgtccgtccgcgtgtgcctggcccctatc

SEQ ID NO: 31009 - DNA, 35 bp, Artificial Sequence
  Synthetic oligonucleotide
atgtgaggtacgtaggaggcaggagagcagtcgag

SEQ ID NO: 31010 - DNA, 35 bp, Artificial Sequence
  Synthetic oligonucleotide
atccgatcgaccattaccctccacgtgcaccctag

SEQ ID NO: 31011 - DNA, 35 bp, Artificial Sequence
  Synthetic oligonucleotide
tgaccgacaatcattgctgtacccgtccatcaccg

SEQ ID NO: 31012 - DNA, 35 bp, Artificial Sequence
  Synthetic oligonucleotide
attgcagtgcctggttttttttgtcaactttgcgg

SEQ ID NO: 31013 - DNA, 35 bp, Artificial Sequence
  Synthetic oligonucleotide
atatcgcaacaaccgcgctcgcactttgcccctat

SEQ ID NO: 31014 - DNA, 38 bp, Artificial Sequence
  Synthetic oligonucleotide
tccaaccgattgcgtgccgtttcacactgtactcctga

SEQ ID NO: 31015 - DNA, 38 bp, Artificial Sequence
  Synthetic oligonucleotide
gtgacgcaaacccatcgacccagcttccctacaggtga

SEQ ID NO: 31016 - DNA, 35 bp, Artificial Sequence
  Synthetic oligonucleotide
acccacctctgacctgtttaatgcttctgtctccc

SEQ ID NO: 31017 - DNA, 35 bp, Artificial Sequence
  Synthetic oligonucleotide
ttgataccgaccataggctaatctttcccatctgc

SEQ ID NO: 31018 - DNA, 35 bp, Artificial Sequence
  Synthetic oligonucleotide
tcccgacacccctgttcctacggacacgtccactc

SEQ ID NO: 31019 - DNA, 35 bp, Artificial Sequence
  Synthetic oligonucleotide
gcagatatgacccgtccgcctcagtacagcacctc

SEQ ID NO: 31020 - DNA, 35 bp, Artificial Sequence
  Synthetic oligonucleotide
actttagctccccctccgtcttttgcctcgcccgg

SEQ ID NO: 31021 - DNA, 35 bp, Artificial Sequence
  Synthetic oligonucleotide
gtcaccctccgagggagcaattccccgctctaatt

SEQ ID NO: 31022 - DNA, 36 bp, Artificial Sequence
  Synthetic oligonucleotide
gcaatgtacccgcatgccttcccgattcgtactaca

SEQ ID NO: 31023 - DNA, 36 bp, Artificial Sequence
  Synthetic oligonucleotide
gtccctccgacgcgcccaattttctctgtcattgca

SEQ ID NO: 31024 - DNA, 37 bp, Artificial Sequence
  Synthetic oligonucleotide
agcgaggcccgagagagaggggggaggtaccaaaaga

SEQ ID NO: 31025 - DNA, 37 bp, Artificial Sequence
  Synthetic oligonucleotide
aaactgccctcactgtgctacacctccagaaatacga

SEQ ID NO: 31026 - DNA, 37 bp, Artificial Sequence
  Synthetic oligonucleotide
gagcccgagctagttatccatccgttgctattaccga

SEQ ID NO: 31027 - DNA, 36 bp, Artificial Sequence
  Synthetic oligonucleotide
ggtggccaacctgtaatctacacttcacccgggcga

SEQ ID NO: 31028 - DNA, 37 bp, Artificial Sequence
  Synthetic oligonucleotide
tgcacctcattacccgggcttgcggacactcattcga

SEQ ID NO: 31029 - DNA, 37 bp, Artificial Sequence
  Synthetic oligonucleotide
gtcacccatcagccgcactttgcttgcaccgacatga

SEQ ID NO: 31030 - DNA, 38 bp, Artificial Sequence
  Synthetic oligonucleotide
gcgcccggtcactcggtactttgttccccctgccttga

SEQ ID NO: 31031 - DNA, 35 bp, Artificial Sequence
  Synthetic oligonucleotide
tcccctaccgagcttgcccacataaacagattcta

SEQ ID NO: 31032 - DNA, 35 bp, Artificial Sequence
  Synthetic oligonucleotide
agttgcgttacctgcctctgtcccgtttgcacttc

SEQ ID NO: 31033 - DNA, 35 bp, Artificial Sequence
  Synthetic oligonucleotide
gcaagccgtttcgaagggccgaaacttacattcct

SEQ ID NO: 31034 - DNA, 35 bp, Artificial Sequence
  Synthetic oligonucleotide
actacaccctcctgtactcttcctcccgtgcttgt

SEQ ID NO: 31035 - DNA, 37 bp, Artificial Sequence
  Synthetic oligonucleotide
gtgatggggtagtgcggtaaaggtacagcggtagaga

SEQ ID NO: 31036 - DNA, 37 bp, Artificial Sequence
  Synthetic oligonucleotide
acccgagcctctgcactacctaatgtagcctactaga

SEQ ID NO: 31037 - DNA, 37 bp, Artificial Sequence
  Synthetic oligonucleotide
tagactccactactccccttgtataagatacgttaga

SEQ ID NO: 31038 - DNA, 37 bp, Artificial Sequence
  Synthetic oligonucleotide
aacgaaagggaggggtgggcggtaaccaacgttacga

SEQ ID NO: 31039 - DNA, 37 bp, Artificial Sequence
  Synthetic oligonucleotide
tactcaccacagttatactgtaacaacttgcactgga

SEQ ID NO: 31040 - DNA, 38 bp, Artificial Sequence
  Synthetic oligonucleotide
gagtgctgcaatgcggggggtggggagtgatcacgtga

SEQ ID NO: 31041 - DNA, 38 bp, Artificial Sequence
  Synthetic oligonucleotide
gtgccggttccattatctttcttttgccccagccttga

SEQ ID NO: 31042 - DNA, 35 bp, Artificial Sequence
  Synthetic oligonucleotide
tgcaggggcctgggggtgggggttaatttgcggac

SEQ ID NO: 31043 - DNA, 35 bp, Artificial Sequence
  Synthetic oligonucleotide
gtcctcgatctgatatccgaaggagcactccatcc

SEQ ID NO: 31044 - DNA, 35 bp, Artificial Sequence
  Synthetic oligonucleotide
aacacccctcaacaccattacggtcccacgcaggc

SEQ ID NO: 31045 - DNA, 35 bp, Artificial Sequence
  Synthetic oligonucleotide
gtgacagcgatgccgccgcttgcaaacttcacgct

SEQ ID NO: 31046 - DNA, 35 bp, Artificial Sequence
  Synthetic oligonucleotide
tgtcgtgatgctggttcgttctttctcgcccatct

SEQ ID NO: 31047 - DNA, 35 bp, Artificial Sequence
  Synthetic oligonucleotide
tcaagggcgtgctgcctcttttttcttcatttagt

SEQ ID NO: 31048 - DNA, 35 bp, Artificial Sequence
  Synthetic oligonucleotide
ttgtaagttcggtctgcttatgtctaccctcccgt

SEQ ID NO: 31049 - DNA, 35 bp, Artificial Sequence
  Synthetic oligonucleotide
acccgtgcctggaattttttttgcctgtccatggt

SEQ ID NO: 31050 - DNA, 36 bp, Artificial Sequence
  Synthetic oligonucleotide
tcactcgcaaccgtacccctcgtatgcccttttgaa

SEQ ID NO: 31051 - DNA, 35 bp, Artificial Sequence
  Synthetic oligonucleotide
gatcgcagttgtcgacgcaccgacccttgaactaa

SEQ ID NO: 31052 - DNA, 36 bp, Artificial Sequence
  Synthetic oligonucleotide
tctgaccccgtaagcctgactatcgaatccgtttaa

SEQ ID NO: 31053 - DNA, 37 bp, Artificial Sequence
  Synthetic oligonucleotide
gtaatccccactgagttctgtagctgccctctttaga

SEQ ID NO: 31054 - DNA, 37 bp, Artificial Sequence
  Synthetic oligonucleotide
tgacgacccccgcccagccccggttgcataatactga

SEQ ID NO: 31055 - DNA, 37 bp, Artificial Sequence
  Synthetic oligonucleotide
gtccactccaatagttatttgcctgggcttaccctga

SEQ ID NO: 31056 - DNA, 37 bp, Artificial Sequence
  Synthetic oligonucleotide
taagcacgcaacgctccttccctttatgccacgctga

SEQ ID NO: 31057 - DNA, 38 bp, Artificial Sequence
  Synthetic oligonucleotide
tccaccggtctgtattggctccgtaattgccgccttga

SEQ ID NO: 31058 - DNA, 38 bp, Artificial Sequence
  Synthetic oligonucleotide
gccaccatccgcagtagtctattgcttgtttgcgttga

SEQ ID NO: 31059 - DNA, 37 bp, Artificial Sequence
  Synthetic oligonucleotide
aaacaccaatgctccatcgccgtaaaggctgttttga

SEQ ID NO: 31060 - DNA, 35 bp, Artificial Sequence
  Synthetic oligonucleotide
gacttcgcccgccgtttttattcatgactcgcaac

SEQ ID NO: 31061 - DNA, 35 bp, Artificial Sequence
  Synthetic oligonucleotide
gataagccccacgcgatacttagaccctgctcgac

SEQ ID NO: 31062 - DNA, 35 bp, Artificial Sequence
  Synthetic oligonucleotide
gtgcaatcgctattacttcacggtcacctgcaccc

SEQ ID NO: 31063 - DNA, 35 bp, Artificial Sequence
  Synthetic oligonucleotide
atgcaggcttacaataggctgaactgcactacccc

SEQ ID NO: 31064 - DNA, 35 bp, Artificial Sequence
  Synthetic oligonucleotide
aacccccactcggaggtgtcttctcccgaactcgc

SEQ ID NO: 31065 - DNA, 35 bp, Artificial Sequence
  Synthetic oligonucleotide
tcgaacacactggtgttgcagctcaacaggacctc

SEQ ID NO: 31066 - DNA, 37 bp, Artificial Sequence
  Synthetic oligonucleotide
gagcggggttatagaggaaatgggagatccggtactg

SEQ ID NO: 31067 - DNA, 35 bp, Artificial Sequence
  Synthetic oligonucleotide
acactcctacacctggtcccttggtgccgccaaat

SEQ ID NO: 31068 - DNA, 35 bp, Artificial Sequence
  Synthetic oligonucleotide
tcacacccctaaccaaagagacaagagtgcatgtt

SEQ ID NO: 31069 - DNA, 36 bp, Artificial Sequence
  Synthetic oligonucleotide
aggtgcgcgccacgccctgatgcttctccgccgcca

SEQ ID NO: 31070 - DNA, 34 bp, Artificial Sequence
  Synthetic oligonucleotide
tggtccaccctgctagtatcaatctgcaatctca

SEQ ID NO: 31071 - DNA, 37 bp, Artificial Sequence
  Synthetic oligonucleotide
gtgaaccgcacggtgtactctgccttcttgttgcgga

SEQ ID NO: 31072 - DNA, 36 bp, Artificial Sequence
  Synthetic oligonucleotide
tccccgttcactagccgccctgctctctttctcgga

SEQ ID NO: 31073 - DNA, 37 bp, Artificial Sequence
  Synthetic oligonucleotide
ttgtggtgaaaagcgagggactggggctggacggtga

SEQ ID NO: 31074 - DNA, 35 bp, Artificial Sequence
  Synthetic oligonucleotide
gactacgctcagtgaccgaccagcgcaacttcacc

SEQ ID NO: 31075 - DNA, 35 bp, Artificial Sequence
  Synthetic oligonucleotide
aaatacccatcgtggcgcactctcacatgccatcc

SEQ ID NO: 31076 - DNA, 35 bp, Artificial Sequence
  Synthetic oligonucleotide
actcgttcggcactggtcatcgcattcgttccatc

SEQ ID NO: 31077 - DNA, 36 bp, Artificial Sequence
  Synthetic oligonucleotide
acaagtgcctctttgtcggccccctgcttcgctatc

SEQ ID NO: 31078 - DNA, 35 bp, Artificial Sequence
  Synthetic oligonucleotide
gaacgcacgtcccctggggctttcgttaatcattc

SEQ ID NO: 31079 - DNA, 35 bp, Artificial Sequence
  Synthetic oligonucleotide
aatgcccgcgattggtttcgatcatccttctccat

SEQ ID NO: 31080 - DNA, 35 bp, Artificial Sequence
  Synthetic oligonucleotide
gaaacaccccaactggcgcctgtgggctcgtgcct

SEQ ID NO: 31081 - DNA, 35 bp, Artificial Sequence
  Synthetic oligonucleotide
tgcctgcgccccatacacgtttttgaattgttagt

SEQ ID NO: 31082 - DNA, 35 bp, Artificial Sequence
  Synthetic oligonucleotide
gatgaggctgattcactaatgtaccatcttcctca

SEQ ID NO: 31083 - DNA, 36 bp, Artificial Sequence
  Synthetic oligonucleotide
acgcaatcccacacatctgtactccggttgacacga

SEQ ID NO: 31084 - DNA, 37 bp, Artificial Sequence
  Synthetic oligonucleotide
gtccaactggactgtatcttattatgctgtctgccga

SEQ ID NO: 31085 - DNA, 38 bp, Artificial Sequence
  Synthetic oligonucleotide
gtactgcgcacccaccgctgttctttttgtgtccttga

SEQ ID NO: 31086 - DNA, 37 bp, Artificial Sequence
  Synthetic oligonucleotide
tgaggaacggggggataaagatgggacgggcggttga

SEQ ID NO: 31087 - DNA, 30 bp, Artificial Sequence
  Synthetic oligonucleotide
ttcggagttgcctgctaccctttaattcta

SEQ ID NO: 31088 - DNA, 36 bp, Artificial Sequence
  Synthetic oligonucleotide
gcccactgcttgcactcatctattgatgccttggta

SEQ ID NO: 31089 - DNA, 35 bp, Artificial Sequence
  Synthetic oligonucleotide
gatgacccctcgctgatacgtctatttgcatcaac

SEQ ID NO: 31090 - DNA, 35 bp, Artificial Sequence
  Synthetic oligonucleotide
gaccgtttcgaccacccgtaattgtttgctgtacc

SEQ ID NO: 31091 - DNA, 35 bp, Artificial Sequence
  Synthetic oligonucleotide
tctgggccacctccaaattcgcctaggtacctgcc

SEQ ID NO: 31092 - DNA, 35 bp, Artificial Sequence
  Synthetic oligonucleotide
tgggtctgccctccaccccgcacggtttcgagtgc

SEQ ID NO: 31093 - DNA, 35 bp, Artificial Sequence
  Synthetic oligonucleotide
gatgccacactaggacgacacgatactcgcggttc

SEQ ID NO: 31094 - DNA, 35 bp, Artificial Sequence
  Synthetic oligonucleotide
atccacctgttatccgtcgtgtcctacatcatgcg

SEQ ID NO: 31095 - DNA, 35 bp, Artificial Sequence
  Synthetic oligonucleotide
atcgcctcttacacgatctttttttgggtccctcg

SEQ ID NO: 31096 - DNA, 35 bp, Artificial Sequence
  Synthetic oligonucleotide
ggacagtgaagacgacggggggagtagtaggaggg

SEQ ID NO: 31097 - DNA, 35 bp, Artificial Sequence
  Synthetic oligonucleotide
tcgcatttccattgggtccttccatcaatctttgg

SEQ ID NO: 31098 - DNA, 34 bp, Artificial Sequence
  Synthetic oligonucleotide
atcgctaccgctcttcggtttacatccatccttg

SEQ ID NO: 31099 - DNA, 35 bp, Artificial Sequence
  Synthetic oligonucleotide
tagtacttcgacctagacacatctgcactgcctct

SEQ ID NO: 31100 - DNA, 35 bp, Artificial Sequence
  Synthetic oligonucleotide
aaacccccgcttcgaacatagaggacctcaggtct

SEQ ID NO: 31101 - DNA, 34 bp, Artificial Sequence
  Synthetic oligonucleotide
accagctgacccccccccactgtcagaatcccgt

SEQ ID NO: 31102 - DNA, 35 bp, Artificial Sequence
  Synthetic oligonucleotide
gagcgacgcgacgacgcgaggccttgtttgtttgt

SEQ ID NO: 31103 - DNA, 35 bp, Artificial Sequence
  Synthetic oligonucleotide
gccctcctcacctgacacaaggtaaatatcccctt

SEQ ID NO: 31104 - DNA, 36 bp, Artificial Sequence
  Synthetic oligonucleotide
agtgcctcccgaccgtatttggccgctcttttcaaa

SEQ ID NO: 31105 - DNA, 36 bp, Artificial Sequence
  Synthetic oligonucleotide
tcaacatgttcacgagcttgcatccggtcccataaa

SEQ ID NO: 31106 - DNA, 35 bp, Artificial Sequence
  Synthetic oligonucleotide
atctaatgcagcaccctgcacttgtctcgtttaaa

SEQ ID NO: 31107 - DNA, 35 bp, Artificial Sequence
  Synthetic oligonucleotide
acgattgatccaatgcctgttcctctacgtcacca

SEQ ID NO: 31108 - DNA, 36 bp, Artificial Sequence
  Synthetic oligonucleotide
gaggggtggttacggggtgacaaggggcaagacgga

SEQ ID NO: 31109 - DNA, 38 bp, Artificial Sequence
  Synthetic oligonucleotide
gacccatccccaaagtgatcttgtaatagatcccgtga

SEQ ID NO: 31110 - DNA, 36 bp, Artificial Sequence
  Synthetic oligonucleotide
gccttctccctcaacgcccgtatctcggactgacta

SEQ ID NO: 31111 - DNA, 36 bp, Artificial Sequence
  Synthetic oligonucleotide
gtggatgggttagggggttgggaggttatggggcta

SEQ ID NO: 31112 - DNA, 35 bp, Artificial Sequence
  Synthetic oligonucleotide
gtaccaccggcttcattctgcaactgttccaagta

SEQ ID NO: 31113 - DNA, 35 bp, Artificial Sequence
  Synthetic oligonucleotide
atacgccccccgataacacgaacagctctagctac

SEQ ID NO: 31114 - DNA, 35 bp, Artificial Sequence
  Synthetic oligonucleotide
gcaacatggcatcagctcttctcgctccctatgcc

SEQ ID NO: 31115 - DNA, 35 bp, Artificial Sequence
  Synthetic oligonucleotide
agaacacgggcctagccacgccgcataccccacgc

SEQ ID NO: 31116 - DNA, 35 bp, Artificial Sequence
  Synthetic oligonucleotide
accgcctcgctgtattcaattatctactgtccggc

SEQ ID NO: 31117 - DNA, 34 bp, Artificial Sequence
  Synthetic oligonucleotide
gaacccctactcttattcgtgcccgctggtactc

SEQ ID NO: 31118 - DNA, 35 bp, Artificial Sequence
  Synthetic oligonucleotide
atcccgtgactgaattaagcttacctagatccatg

SEQ ID NO: 31119 - DNA, 35 bp, Artificial Sequence
  Synthetic oligonucleotide
gccgagggctcttcatctgttttccctagtccctg

SEQ ID NO: 31120 - DNA, 35 bp, Artificial Sequence
  Synthetic oligonucleotide
gtcctcgcccaccccgatcccatttaggggccact

SEQ ID NO: 31121 - DNA, 35 bp, Artificial Sequence
  Synthetic oligonucleotide
acccctaggccccatatatttgtttggtcattcct

SEQ ID NO: 31122 - DNA, 35 bp, Artificial Sequence
  Synthetic oligonucleotide
tgactccaccttccgaagttccatctgcagtacgt

SEQ ID NO: 31123 - DNA, 35 bp, Artificial Sequence
  Synthetic oligonucleotide
tttgcccacactgtaatagcatgctctttgaaatt

SEQ ID NO: 31124 - DNA, 35 bp, Artificial Sequence
  Synthetic oligonucleotide
aacggtacagacgtgcaccgctagtcccccctcca

SEQ ID NO: 31125 - DNA, 37 bp, Artificial Sequence
  Synthetic oligonucleotide
ggatggggtggtggccgggtgaggatagatggagaga

SEQ ID NO: 31126 - DNA, 37 bp, Artificial Sequence
  Synthetic oligonucleotide
agtgctccgggggggggaaaagaatggggaatagtga

SEQ ID NO: 31127 - DNA, 35 bp, Artificial Sequence
  Synthetic oligonucleotide
gttcgccccccatttgagaattgtctgactttcta

SEQ ID NO: 31128 - DNA, 36 bp, Artificial Sequence
  Synthetic oligonucleotide
gattactccgccgacgggtcgctcctctaacgatta

SEQ ID NO: 31129 - DNA, 36 bp, Artificial Sequence
  Synthetic oligonucleotide
gaacgggatgggagggctgattcattgggcggttta

SEQ ID NO: 31130 - DNA, 35 bp, Artificial Sequence
  Synthetic oligonucleotide
tcagttctcgcccgcgccgttcaccactgttttcc

SEQ ID NO: 31131 - DNA, 35 bp, Artificial Sequence
  Synthetic oligonucleotide
gtcccccaccccttcacgcacatagagatgacggc

SEQ ID NO: 31132 - DNA, 35 bp, Artificial Sequence
  Synthetic oligonucleotide
tgaaaccacatcaggtgtcgaatgttccgcctctc

SEQ ID NO: 31133 - DNA, 36 bp, Artificial Sequence
  Synthetic oligonucleotide
gatcaccatggagtgcccacctgactaacgtagcca

SEQ ID NO: 31134 - DNA, 37 bp, Artificial Sequence
  Synthetic oligonucleotide
aaacccgagcgcctgccacccgcagatattgccacga

SEQ ID NO: 31135 - DNA, 37 bp, Artificial Sequence
  Synthetic oligonucleotide
gaactccccaccaccgcccccagccttgtcgtcacga

SEQ ID NO: 31136 - DNA, 37 bp, Artificial Sequence
  Synthetic oligonucleotide
actcccgaagcggtgccactcgttcttccatcaccga

SEQ ID NO: 31137 - DNA, 37 bp, Artificial Sequence
  Synthetic oligonucleotide
gatgtgtagttggtataaaccgggcgcggggggagga

SEQ ID NO: 31138 - DNA, 37 bp, Artificial Sequence
  Synthetic oligonucleotide
aacgcgattagaagggtgggtgggattggttggagga

SEQ ID NO: 31139 - DNA, 37 bp, Artificial Sequence
  Synthetic oligonucleotide
tccacgttgcgaaccgacctgcaaaccaatggcctga

SEQ ID NO: 31140 - DNA, 35 bp, Artificial Sequence
  Synthetic oligonucleotide
tcgccgcatcatctatcgggatttgttcgtaaata

SEQ ID NO: 31141 - DNA, 35 bp, Artificial Sequence
  Synthetic oligonucleotide
accaccccgaccggctacgcactccgtcacgtata

SEQ ID NO: 31142 - DNA, 35 bp, Artificial Sequence
  Synthetic oligonucleotide
agaaaccctcccgtacctgcacgctgccaataacc

SEQ ID NO: 31143 - DNA, 35 bp, Artificial Sequence
  Synthetic oligonucleotide
accgcacttaaccgcccctaaactccgccgtgccc

SEQ ID NO: 31144 - DNA, 35 bp, Artificial Sequence
  Synthetic oligonucleotide
gtgttcctgtcctactgtccctgttagggttttgc

SEQ ID NO: 31145 - DNA, 35 bp, Artificial Sequence
  Synthetic oligonucleotide
tctgtaccatcagctcacgcgctcattcattggtc

SEQ ID NO: 31146 - DNA, 35 bp, Artificial Sequence
  Synthetic oligonucleotide
agtatgccgcaccacattatcaaatgaaatcaccg

SEQ ID NO: 31147 - DNA, 35 bp, Artificial Sequence
  Synthetic oligonucleotide
gttgaatccgtgcccgcattattgcctgttcttcg

SEQ ID NO: 31148 - DNA, 35 bp, Artificial Sequence
  Synthetic oligonucleotide
tagcactcagcgcatcttcggtcaccttgttattt

SEQ ID NO: 31149 - DNA, 35 bp, Artificial Sequence
  Synthetic oligonucleotide
atcaacccttgatgcattaaccgctccgccctcca

SEQ ID NO: 31150 - DNA, 35 bp, Artificial Sequence
  Synthetic oligonucleotide
tacgtgcacatcacggcacttacgctccccccgca

SEQ ID NO: 31151 - DNA, 36 bp, Artificial Sequence
  Synthetic oligonucleotide
ggttgctggaggagggagggagggtagacggatgca

SEQ ID NO: 31152 - DNA, 37 bp, Artificial Sequence
  Synthetic oligonucleotide
tcaccgacggaagttagggaggggaagggggcaaaga

SEQ ID NO: 31153 - DNA, 37 bp, Artificial Sequence
  Synthetic oligonucleotide
gtcatcccaacggtaccccacgtctagccctcacaga

SEQ ID NO: 31154 - DNA, 36 bp, Artificial Sequence
  Synthetic oligonucleotide
gcatgcacgcgttatttcttgccccaactagttcga

SEQ ID NO: 31155 - DNA, 37 bp, Artificial Sequence
  Synthetic oligonucleotide
gtcgtggtcggagagagagagggggtgaacgtaagga

SEQ ID NO: 31156 - DNA, 38 bp, Artificial Sequence
  Synthetic oligonucleotide
aagcacacccgcttgtactaccgctcagtccaggttga

SEQ ID NO: 31157 - DNA, 36 bp, Artificial Sequence
  Synthetic oligonucleotide
tactgccctgcgcccttgagctctgccgttgaatta

SEQ ID NO: 31158 - DNA, 35 bp, Artificial Sequence
  Synthetic oligonucleotide
gatcccaccccaactggtgatactttcttgcctac

SEQ ID NO: 31159 - DNA, 35 bp, Artificial Sequence
  Synthetic oligonucleotide
gaaccagcccatcttgacgacccacagcaagtatg

SEQ ID NO: 31160 - DNA, 35 bp, Artificial Sequence
  Synthetic oligonucleotide
ttcgtggcgcattttttcatgtccgtgctggcttg

SEQ ID NO: 31161 - DNA, 35 bp, Artificial Sequence
  Synthetic oligonucleotide
atgaccacgccggacgtcggtcccttacttcacct

SEQ ID NO: 31162 - DNA, 35 bp, Artificial Sequence
  Synthetic oligonucleotide
ttccgcgtgcccactgttttgaaatatcgttgtct

SEQ ID NO: 31163 - DNA, 35 bp, Artificial Sequence
  Synthetic oligonucleotide
atgcggtgtcaccctcagcgtgcactagttcttct

SEQ ID NO: 31164 - DNA, 35 bp, Artificial Sequence
  Synthetic oligonucleotide
gtcattcattctgctcccctcgagtccgtttcgca

SEQ ID NO: 31165 - DNA, 36 bp, Artificial Sequence
  Synthetic oligonucleotide
aacaacaccgttccatatccgcggataccactccga

SEQ ID NO: 31166 - DNA, 37 bp, Artificial Sequence
  Synthetic oligonucleotide
ttggatcctattgacgtgcctctgttcctctttccga

SEQ ID NO: 31167 - DNA, 37 bp, Artificial Sequence
  Synthetic oligonucleotide
gtcatcacgtacatcccttcccccgcccctcaccgga

SEQ ID NO: 31168 - DNA, 37 bp, Artificial Sequence
  Synthetic oligonucleotide
gtcatcccttcccttatgccgatttggaccctctgga

SEQ ID NO: 31169 - DNA, 38 bp, Artificial Sequence
  Synthetic oligonucleotide
tgcttcgcagaactttatctgctggaccacctttctga

SEQ ID NO: 31170 - DNA, 38 bp, Artificial Sequence
  Synthetic oligonucleotide
tgtcccccctctgaatgccttcccagaaccatgagtga

SEQ ID NO: 31171 - DNA, 38 bp, Artificial Sequence
  Synthetic oligonucleotide
atgatagcggaagaagggctggggggatgggcaggtga

SEQ ID NO: 31172 - DNA, 35 bp, Artificial Sequence
  Synthetic oligonucleotide
ataacagccccctgccgtccgaacatacagccgac

SEQ ID NO: 31173 - DNA, 35 bp, Artificial Sequence
  Synthetic oligonucleotide
gcacactctgcgtaccacggttctctctctacgcc

SEQ ID NO: 31174 - DNA, 35 bp, Artificial Sequence
  Synthetic oligonucleotide
gaccccatctttacgtaggtttcatgtcccaccgc

SEQ ID NO: 31175 - DNA, 35 bp, Artificial Sequence
  Synthetic oligonucleotide
tacgttcaggacgccccgttccttatcctgccctc

SEQ ID NO: 31176 - DNA, 35 bp, Artificial Sequence
  Synthetic oligonucleotide
atcgactccagtcgcccggtgacatcttgcccgtc

SEQ ID NO: 31177 - DNA, 35 bp, Artificial Sequence
  Synthetic oligonucleotide
atgcccaccccgtatccccgcatttgctcgccgcg

SEQ ID NO: 31178 - DNA, 35 bp, Artificial Sequence
  Synthetic oligonucleotide
acaccaaaactcccgctctgttagacaccacaggg

SEQ ID NO: 31179 - DNA, 35 bp, Artificial Sequence
  Synthetic oligonucleotide
gcccatccacaaactgtacttgtcaaacaggattg

SEQ ID NO: 31180 - DNA, 35 bp, Artificial Sequence
  Synthetic oligonucleotide
gaccgaatgtacgctggcttaatgatcttcaccct

SEQ ID NO: 31181 - DNA, 35 bp, Artificial Sequence
  Synthetic oligonucleotide
tcgcagatcggttgcaattacccacctccctggct

SEQ ID NO: 31182 - DNA, 35 bp, Artificial Sequence
  Synthetic oligonucleotide
tccactaccttccacggccttgagacccgtcttgt

SEQ ID NO: 31183 - DNA, 36 bp, Artificial Sequence
  Synthetic oligonucleotide
atgctaacgtccctgcaccggcacccgagaactcca

SEQ ID NO: 31184 - DNA, 35 bp, Artificial Sequence
  Synthetic oligonucleotide
tattgggggaggggggcatgcggtggggacaggca

SEQ ID NO: 31185 - DNA, 35 bp, Artificial Sequence
  Synthetic oligonucleotide
gtacacgttcatattccccatgcactacgccgaga

SEQ ID NO: 31186 - DNA, 36 bp, Artificial Sequence
  Synthetic oligonucleotide
ttgcacgtcagcctaccgttctttctatcttgccga

SEQ ID NO: 31187 - DNA, 37 bp, Artificial Sequence
  Synthetic oligonucleotide
tgatgcggtagaacaaggagcgatgacggggaaggga

SEQ ID NO: 31188 - DNA, 37 bp, Artificial Sequence
  Synthetic oligonucleotide
tctgttcgcagccgcacaagcacccgtatttacctga

SEQ ID NO: 31189 - DNA, 37 bp, Artificial Sequence
  Synthetic oligonucleotide
gactgaatacacataggagggagaggtgggatggtga

SEQ ID NO: 31190 - DNA, 37 bp, Artificial Sequence
  Synthetic oligonucleotide
gcccctctaatttgcccccacacgccctcgtgtgtga

SEQ ID NO: 31191 - DNA, 35 bp, Artificial Sequence
  Synthetic oligonucleotide
acaccgtaccgctcctcagatccgccaccggtgac

SEQ ID NO: 31192 - DNA, 35 bp, Artificial Sequence
  Synthetic oligonucleotide
tcaaaccccagggggagtactctcctaattctctc

SEQ ID NO: 31193 - DNA, 36 bp, Artificial Sequence
  Synthetic oligonucleotide
aacaaataggagcgggggtgatcggggcaaacggag

SEQ ID NO: 31194 - DNA, 35 bp, Artificial Sequence
  Synthetic oligonucleotide
tgccatgccatctggtcgcctctgctggaccgccg

SEQ ID NO: 31195 - DNA, 35 bp, Artificial Sequence
  Synthetic oligonucleotide
gaactgatccggcacggtaacgcctacactcatcg

SEQ ID NO: 31196 - DNA, 35 bp, Artificial Sequence
  Synthetic oligonucleotide
tacgctccaacagtctagtacggtctttcgcctct

SEQ ID NO: 31197 - DNA, 36 bp, Artificial Sequence
  Synthetic oligonucleotide
ggacgacatggcagtccatcggccggttcctcacca

SEQ ID NO: 31198 - DNA, 38 bp, Artificial Sequence
  Synthetic oligonucleotide
acctccggcgccatcacgcagttttttgagattttgga

SEQ ID NO: 31199 - DNA, 38 bp, Artificial Sequence
  Synthetic oligonucleotide
tgagctcatcaccatcttctatgcgcacctgccaatga

SEQ ID NO: 31200 - DNA, 38 bp, Artificial Sequence
  Synthetic oligonucleotide
actaccgccccacaagaggatcttgctccattttatga

SEQ ID NO: 31201 - DNA, 37 bp, Artificial Sequence
  Synthetic oligonucleotide
tcacaactcattcgttttcgccggtatccatcactga

SEQ ID NO: 31202 - DNA, 37 bp, Artificial Sequence
  Synthetic oligonucleotide
gacccgcaggcaaactgaccgccctcttagttcctga

SEQ ID NO: 31203 - DNA, 35 bp, Artificial Sequence
  Synthetic oligonucleotide
tccacgcacacacggacgctcattagacgtccaac

SEQ ID NO: 31204 - DNA, 35 bp, Artificial Sequence
  Synthetic oligonucleotide
gcaaacgcctcagtcgactgagtgccctgttcgcc

SEQ ID NO: 31205 - DNA, 35 bp, Artificial Sequence
  Synthetic oligonucleotide
tacgcactaccatcaatcgttttttggtctgggcc

SEQ ID NO: 31206 - DNA, 35 bp, Artificial Sequence
  Synthetic oligonucleotide
aacgacgtagtcgaccataatttccccacgcgatc

SEQ ID NO: 31207 - DNA, 35 bp, Artificial Sequence
  Synthetic oligonucleotide
gtagcgcatcctgctcatgtctataccggtttttc

SEQ ID NO: 31208 - DNA, 35 bp, Artificial Sequence
  Synthetic oligonucleotide
gtaaccacacggcgacattcacgaccccaaaatct

SEQ ID NO: 31209 - DNA, 36 bp, Artificial Sequence
  Synthetic oligonucleotide
ttgcattgccgccatcttctgttactgcccgtacaa

SEQ ID NO: 31210 - DNA, 36 bp, Artificial Sequence
  Synthetic oligonucleotide
atccggacaaggcggtctctggccctcgcaatcaca

SEQ ID NO: 31211 - DNA, 35 bp, Artificial Sequence
  Synthetic oligonucleotide
tcgcatcgcctccggacctccacgtactaccgaca

SEQ ID NO: 31212 - DNA, 36 bp, Artificial Sequence
  Synthetic oligonucleotide
atcgtccacatcgcttgccgtgagcccatcgcacca

SEQ ID NO: 31213 - DNA, 35 bp, Artificial Sequence
  Synthetic oligonucleotide
gtggtcaccatctaagggcctagcactcccgccca

SEQ ID NO: 31214 - DNA, 36 bp, Artificial Sequence
  Synthetic oligonucleotide
tacaaccccatccttatgccactaggcccccaggga

SEQ ID NO: 31215 - DNA, 37 bp, Artificial Sequence
  Synthetic oligonucleotide
gatccgccatctcgcaccacgtgatacctccatatga

SEQ ID NO: 31216 - DNA, 38 bp, Artificial Sequence
  Synthetic oligonucleotide
agcccgcatccaattgaccatccatcgccgggctttga

SEQ ID NO: 31217 - DNA, 35 bp, Artificial Sequence
  Synthetic oligonucleotide
gtctgtcccagctcattttaatggccccacttgta

SEQ ID NO: 31218 - DNA, 35 bp, Artificial Sequence
  Synthetic oligonucleotide
gtctccgcgcaagggccgacgggcggggggggtta

SEQ ID NO: 31219 - DNA, 35 bp, Artificial Sequence
  Synthetic oligonucleotide
agttagagtcagacctccttcccgcctcccacgcc

SEQ ID NO: 31220 - DNA, 35 bp, Artificial Sequence
  Synthetic oligonucleotide
tccctacctgagttcatagcccaatcacgaccgtc

SEQ ID NO: 31221 - DNA, 35 bp, Artificial Sequence
  Synthetic oligonucleotide
gtaattggaagggtgggggagttggtgggaaaaag

SEQ ID NO: 31222 - DNA, 35 bp, Artificial Sequence
  Synthetic oligonucleotide
gtagctcgttctgcagatcataccaccttcctatg

SEQ ID NO: 31223 - DNA, 35 bp, Artificial Sequence
  Synthetic oligonucleotide
gaacaggggccgtaattaggagggttggtttgtgt

SEQ ID NO: 31224 - DNA, 35 bp, Artificial Sequence
  Synthetic oligonucleotide
atggagcgcgtcgtaaaccctggctcccttccttt

SEQ ID NO: 31225 - DNA, 37 bp, Artificial Sequence
  Synthetic oligonucleotide
ggattgggtggagaaagaaggggctaggacagtcaga

SEQ ID NO: 31226 - DNA, 37 bp, Artificial Sequence
  Synthetic oligonucleotide
agtgccggggaagggtgggaacatccgcgatagagga

SEQ ID NO: 31227 - DNA, 37 bp, Artificial Sequence
  Synthetic oligonucleotide
aagagcgggggtggagcaaacaagggcgcaaatcgga

SEQ ID NO: 31228 - DNA, 37 bp, Artificial Sequence
  Synthetic oligonucleotide
acgcacatatatgggggtgaagttaggggttcaggga

SEQ ID NO: 31229 - DNA, 38 bp, Artificial Sequence
  Synthetic oligonucleotide
tcaacagcactgggagggaggggtggcactaggtatga

SEQ ID NO: 31230 - DNA, 35 bp, Artificial Sequence
  Synthetic oligonucleotide
tccccgaacctcttagtgtgctgtttccctttggc

SEQ ID NO: 31231 - DNA, 36 bp, Artificial Sequence
  Synthetic oligonucleotide
ccgacccccctccactcggactgcctcacgtcctgc

SEQ ID NO: 31232 - DNA, 35 bp, Artificial Sequence
  Synthetic oligonucleotide
tagtagcgggggagaacgggggggcttagatgatg

SEQ ID NO: 31233 - DNA, 34 bp, Artificial Sequence
  Synthetic oligonucleotide
ttcatccctcggtgcacacgatttgcgccctaat

SEQ ID NO: 31234 - DNA, 35 bp, Artificial Sequence
  Synthetic oligonucleotide
gaccgaagctgtagatagcggtcttcactttccat

SEQ ID NO: 31235 - DNA, 35 bp, Artificial Sequence
  Synthetic oligonucleotide
agcatgaccggttcttcatagtgctcgtttactct

SEQ ID NO: 31236 - DNA, 35 bp, Artificial Sequence
  Synthetic oligonucleotide
gcctgctacagtgcccctcgcatacccatttaagt

SEQ ID NO: 31237 - DNA, 35 bp, Artificial Sequence
  Synthetic oligonucleotide
gcacacgtgagcggttaaatgcccccttcatacgt

SEQ ID NO: 31238 - DNA, 35 bp, Artificial Sequence
  Synthetic oligonucleotide
tttgcctcccaccagtccccacgaagagtgggttt

SEQ ID NO: 31239 - DNA, 36 bp, Artificial Sequence
  Synthetic oligonucleotide
gtgaacccgcacaagccactgcccctcgaatatgaa

SEQ ID NO: 31240 - DNA, 36 bp, Artificial Sequence
  Synthetic oligonucleotide
acagtgcccaccacgctaacttagacggtctttgaa

SEQ ID NO: 31241 - DNA, 36 bp, Artificial Sequence
  Synthetic oligonucleotide
tatgtgcgcaactatcaggctgctgttaccacccca

SEQ ID NO: 31242 - DNA, 35 bp, Artificial Sequence
  Synthetic oligonucleotide
gacaccctacaactaaatctgccctactgatgcca

SEQ ID NO: 31243 - DNA, 36 bp, Artificial Sequence
  Synthetic oligonucleotide
tcaccagtgcctctccactgcgtgatcctcactcca

SEQ ID NO: 31244 - DNA, 36 bp, Artificial Sequence
  Synthetic oligonucleotide
tctgcggtccactggccccatccttgagattacgca

SEQ ID NO: 31245 - DNA, 35 bp, Artificial Sequence
  Synthetic oligonucleotide
gcacacaccgcatttctgaccgccgacaggactca

SEQ ID NO: 31246 - DNA, 36 bp, Artificial Sequence
  Synthetic oligonucleotide
gtgtacgccggaccgccatctcagttcttaggctca

SEQ ID NO: 31247 - DNA, 37 bp, Artificial Sequence
  Synthetic oligonucleotide
tcacacaacacccgccgctccacaatccggaccgaga

SEQ ID NO: 31248 - DNA, 37 bp, Artificial Sequence
  Synthetic oligonucleotide
tagccgctgtcccgttttcacacgtcctctacttcga

SEQ ID NO: 31249 - DNA, 37 bp, Artificial Sequence
  Synthetic oligonucleotide
taagacgaggtgaacggggggagacatcagcaaagga

SEQ ID NO: 31250 - DNA, 37 bp, Artificial Sequence
  Synthetic oligonucleotide
acttccacccccgtaatgccgtcttgcctgtgcagga

SEQ ID NO: 31251 - DNA, 35 bp, Artificial Sequence
  Synthetic oligonucleotide
gaacggtggcaggaaaaaaggaaaacgattgggga

SEQ ID NO: 31252 - DNA, 37 bp, Artificial Sequence
  Synthetic oligonucleotide
aacgagtgaaaacggagtatcgggtggtgagggtgga

SEQ ID NO: 31253 - DNA, 38 bp, Artificial Sequence
  Synthetic oligonucleotide
ggtgcatctctccatttgtcttcgcctcgctctcctga

SEQ ID NO: 31254 - DNA, 38 bp, Artificial Sequence
  Synthetic oligonucleotide
tagccgaggtgcgcggatctgtcatccttgccttttta

SEQ ID NO: 31255 - DNA, 35 bp, Artificial Sequence
  Synthetic oligonucleotide
ttcgaacacagccaatatcttacagcctctttgac

SEQ ID NO: 31256 - DNA, 35 bp, Artificial Sequence
  Synthetic oligonucleotide
tctgtgactctcgccgggccttttcgtccctcccg

SEQ ID NO: 31257 - DNA, 35 bp, Artificial Sequence
  Synthetic oligonucleotide
accacctctggtcgcatttactccattacttcgct

SEQ ID NO: 31258 - DNA, 36 bp, Artificial Sequence
  Synthetic oligonucleotide
gccgatggactctgggtttcgctgaccttcccccca

SEQ ID NO: 31259 - DNA, 35 bp, Artificial Sequence
  Synthetic oligonucleotide
ttacacactaccttcacgctcagatccggctctca

SEQ ID NO: 31260 - DNA, 36 bp, Artificial Sequence
  Synthetic oligonucleotide
ggtgaccgtctatcctgtcatcataaccacccacga

SEQ ID NO: 31261 - DNA, 35 bp, Artificial Sequence
  Synthetic oligonucleotide
tatgcctgtcctccatttcttatgcgcccactcga

SEQ ID NO: 31262 - DNA, 38 bp, Artificial Sequence
  Synthetic oligonucleotide
tcgtaccatccattctatcatgcagttctgtctcatga

SEQ ID NO: 31263 - DNA, 38 bp, Artificial Sequence
  Synthetic oligonucleotide
attagcgcagccttgccgactacgcacctcctttatga

SEQ ID NO: 31264 - DNA, 38 bp, Artificial Sequence
  Synthetic oligonucleotide
ttgccgcatatgcctgcttcactgaacacctcgactga

SEQ ID NO: 31265 - DNA, 38 bp, Artificial Sequence
  Synthetic oligonucleotide
gtcccatgcccgactacgattacccagcactctactga

SEQ ID NO: 31266 - DNA, 38 bp, Artificial Sequence
  Synthetic oligonucleotide
tcctgccccacataattctgctgttttcgatgccgtga

SEQ ID NO: 31267 - DNA, 36 bp, Artificial Sequence
  Synthetic oligonucleotide
tgcctcttcgccatcagttcaacacgctatgccata

SEQ ID NO: 31268 - DNA, 36 bp, Artificial Sequence
  Synthetic oligonucleotide
tccgcaacccaccacctggcacttggcttgaatata

SEQ ID NO: 31269 - DNA, 35 bp, Artificial Sequence
  Synthetic oligonucleotide
tgaccaggcccgcctttcagcccgacctctgtcac

SEQ ID NO: 31270 - DNA, 35 bp, Artificial Sequence
  Synthetic oligonucleotide
gatcatcctaaagtagccaacgttccaccggaccc

SEQ ID NO: 31271 - DNA, 35 bp, Artificial Sequence
  Synthetic oligonucleotide
gagcctcaccgcttaatggcgcttgttacccagcc

SEQ ID NO: 31272 - DNA, 35 bp, Artificial Sequence
  Synthetic oligonucleotide
tcccactaaccttttgtccggtgactccttttggc

SEQ ID NO: 31273 - DNA, 35 bp, Artificial Sequence
  Synthetic oligonucleotide
tacctgccaatcagtaaacgttcgctcaccctacg

SEQ ID NO: 31274 - DNA, 35 bp, Artificial Sequence
  Synthetic oligonucleotide
gtagccgttacgtctggccactcgtccttgctcct

SEQ ID NO: 31275 - DNA, 35 bp, Artificial Sequence
  Synthetic oligonucleotide
gagaccagggtagagtcggggaggtaggacgtggt

SEQ ID NO: 31276 - DNA, 36 bp, Artificial Sequence
  Synthetic oligonucleotide
gtccactaagactgcttagccctcgaccctatggaa

SEQ ID NO: 31277 - DNA, 36 bp, Artificial Sequence
  Synthetic oligonucleotide
gatcctgtggccgcgtattgctcagtacccccacca

SEQ ID NO: 31278 - DNA, 36 bp, Artificial Sequence
  Synthetic oligonucleotide
aatgcgcgcgacttcttcatgctgccatacatccca

SEQ ID NO: 31279 - DNA, 36 bp, Artificial Sequence
  Synthetic oligonucleotide
gcgtaacacctcagccgacactaagtaactagcgca

SEQ ID NO: 31280 - DNA, 36 bp, Artificial Sequence
  Synthetic oligonucleotide
ggtaccatgccggtggaaggggagaagggggagaga

SEQ ID NO: 31281 - DNA, 37 bp, Artificial Sequence
  Synthetic oligonucleotide
acccgtcctacttgccatccattgtgcgctctaccga

SEQ ID NO: 31282 - DNA, 37 bp, Artificial Sequence
  Synthetic oligonucleotide
atagtcaccccaccctgttgttttcgcttctatgcga

SEQ ID NO: 31283 - DNA, 37 bp, Artificial Sequence
  Synthetic oligonucleotide
aaagggcgtgggggggcggtatacacggtatcgggga

SEQ ID NO: 31284 - DNA, 38 bp, Artificial Sequence
  Synthetic oligonucleotide
taacgccccacacactgtctctatgcgactatttatga

SEQ ID NO: 31285 - DNA, 38 bp, Artificial Sequence
  Synthetic oligonucleotide
gagtagggccggtgaggaaaaaaacttggttaacgtga

SEQ ID NO: 31286 - DNA, 35 bp, Artificial Sequence
  Synthetic oligonucleotide
gactcacactcctggtcgcattattgccaccgcta

SEQ ID NO: 31287 - DNA, 35 bp, Artificial Sequence
  Synthetic oligonucleotide
accgcttccaccaacgctgccgctattctttcgta

SEQ ID NO: 31288 - DNA, 36 bp, Artificial Sequence
  Synthetic oligonucleotide
tgagacagtcggatctacacatgcctgtccccttta

SEQ ID NO: 31289 - DNA, 35 bp, Artificial Sequence
  Synthetic oligonucleotide
aaaccggtgcacatctgacccctcttgcctgatac

SEQ ID NO: 31290 - DNA, 35 bp, Artificial Sequence
  Synthetic oligonucleotide
tcagggctgagcgggccccctttcatgaactctcc

SEQ ID NO: 31291 - DNA, 35 bp, Artificial Sequence
  Synthetic oligonucleotide
gccacagcacacaccgccgacaatgaagaccgctg

SEQ ID NO: 31292 - DNA, 35 bp, Artificial Sequence
  Synthetic oligonucleotide
agccaagtgcctcttcgtgaacgttcacagtctct

SEQ ID NO: 31293 - DNA, 36 bp, Artificial Sequence
  Synthetic oligonucleotide
gagtaagggggggatacggaaggaagactagcacaa

SEQ ID NO: 31294 - DNA, 37 bp, Artificial Sequence
  Synthetic oligonucleotide
acaggaaagccacacctgtgatcccaacctgcccgga

SEQ ID NO: 31295 - DNA, 38 bp, Artificial Sequence
  Synthetic oligonucleotide
gacccactcacgcaggcagtaaaggaccaacttgctga

SEQ ID NO: 31296 - DNA, 37 bp, Artificial Sequence
  Synthetic oligonucleotide
agcccaccatccgctgcacccgtgtcccgcgccttga

SEQ ID NO: 31297 - DNA, 37 bp, Artificial Sequence
  Synthetic oligonucleotide
accaccttacccccaaagtagtcacgcccgacgttga

SEQ ID NO: 31298 - DNA, 36 bp, Artificial Sequence
  Synthetic oligonucleotide
agatgccaacgtcgtacctgcaccctctggccatta

SEQ ID NO: 31299 - DNA, 35 bp, Artificial Sequence
  Synthetic oligonucleotide
ttaccaccgcgggtcctgcagacttaccctactac

SEQ ID NO: 31300 - DNA, 35 bp, Artificial Sequence
  Synthetic oligonucleotide
tgtccgccgcttaggctccatctgttactcggtac

SEQ ID NO: 31301 - DNA, 35 bp, Artificial Sequence
  Synthetic oligonucleotide
tcacgcatctggccgtcctaaagcctgtacgtacc

SEQ ID NO: 31302 - DNA, 35 bp, Artificial Sequence
  Synthetic oligonucleotide
gcccccttcgtaccggtctgccatggaactggccc

SEQ ID NO: 31303 - DNA, 35 bp, Artificial Sequence
  Synthetic oligonucleotide
gtacccctccctggaataaacagatagctcacgcc

SEQ ID NO: 31304 - DNA, 35 bp, Artificial Sequence
  Synthetic oligonucleotide
aagacaaacgggggagggggcctagcaggggtagc

SEQ ID NO: 31305 - DNA, 34 bp, Artificial Sequence
  Synthetic oligonucleotide
tttcaggccgttacgggcccctccatctatactc

SEQ ID NO: 31306 - DNA, 35 bp, Artificial Sequence
  Synthetic oligonucleotide
cccatgcctctgtccacttactgcgcgctcgacct

SEQ ID NO: 31307 - DNA, 36 bp, Artificial Sequence
  Synthetic oligonucleotide
ggggtgaggagaaaagggggacgggacttttgcgaa

SEQ ID NO: 31308 - DNA, 36 bp, Artificial Sequence
  Synthetic oligonucleotide
taccagcccacgacgtcgcaccgcgccccccgataa

SEQ ID NO: 31309 - DNA, 36 bp, Artificial Sequence
  Synthetic oligonucleotide
ttggacgcatctcgccgcctagaaccacggttaaca

SEQ ID NO: 31310 - DNA, 35 bp, Artificial Sequence
  Synthetic oligonucleotide
gcactatacacaccacagactgcaagcaccacaca

SEQ ID NO: 31311 - DNA, 36 bp, Artificial Sequence
  Synthetic oligonucleotide
tatgcgctcgtttgttttgccgccaccacgacacca

SEQ ID NO: 31312 - DNA, 36 bp, Artificial Sequence
  Synthetic oligonucleotide
tgcgcatatgtcgcgtgatcagcaccctttcctcca

SEQ ID NO: 31313 - DNA, 36 bp, Artificial Sequence
  Synthetic oligonucleotide
ggacgccaccctgccatgatagaacacccaggctca

SEQ ID NO: 31314 - DNA, 38 bp, Artificial Sequence
  Synthetic oligonucleotide
aaagggagtagaggatggatttgggaaggaataacaga

SEQ ID NO: 31315 - DNA, 36 bp, Artificial Sequence
  Synthetic oligonucleotide
gaccctcgccacgtaacccctgcgaacaatttacga

SEQ ID NO: 31316 - DNA, 37 bp, Artificial Sequence
  Synthetic oligonucleotide
ataccaagccgtacacatagtactcgacaccttccga

SEQ ID NO: 31317 - DNA, 37 bp, Artificial Sequence
  Synthetic oligonucleotide
atccatctccactttcgtacagtccagtccgtatgga

SEQ ID NO: 31318 - DNA, 38 bp, Artificial Sequence
  Synthetic oligonucleotide
ggtggagggggaagttcaagagggacgagcgaacatga

SEQ ID NO: 31319 - DNA, 38 bp, Artificial Sequence
  Synthetic oligonucleotide
gactacaccctcccgaatgctgcgaactcctgtcatga

SEQ ID NO: 31320 - DNA, 38 bp, Artificial Sequence
  Synthetic oligonucleotide
atcgccggacgcagcgaacagcccatttacaaccctga

SEQ ID NO: 31321 - DNA, 38 bp, Artificial Sequence
  Synthetic oligonucleotide
ggtggatggggctgaaaactctagacggagaacggtga

SEQ ID NO: 31322 - DNA, 38 bp, Artificial Sequence
  Synthetic oligonucleotide
agtcggagcactgagccggatgggcaagggaggggtga

SEQ ID NO: 31323 - DNA, 37 bp, Artificial Sequence
  Synthetic oligonucleotide
ggggtagccaggggggggacaagctgcattggggtga

SEQ ID NO: 31324 - DNA, 37 bp, Artificial Sequence
  Synthetic oligonucleotide
gcacatccacggacctagcttcagccacttgctgtga

SEQ ID NO: 31325 - DNA, 36 bp, Artificial Sequence
  Synthetic oligonucleotide
gacatccacacctcagtcgccgttactctatcccta

SEQ ID NO: 31326 - DNA, 35 bp, Artificial Sequence
  Synthetic oligonucleotide
gtcgccacgaccctgcccctggaaatcgcttggta

SEQ ID NO: 31327 - DNA, 35 bp, Artificial Sequence
  Synthetic oligonucleotide
ggaaccctctccgtatattggccctcgaactctta

SEQ ID NO: 31328 - DNA, 35 bp, Artificial Sequence
  Synthetic oligonucleotide
gtttggaagcccacacccgtcctggaaccttttgc

SEQ ID NO: 31329 - DNA, 35 bp, Artificial Sequence
  Synthetic oligonucleotide
agacacatctgccaccgttcacaccatttggattc

SEQ ID NO: 31330 - DNA, 35 bp, Artificial Sequence
  Synthetic oligonucleotide
acatcaacccctcctgaactgcacatgggcaccat

SEQ ID NO: 31331 - DNA, 35 bp, Artificial Sequence
  Synthetic oligonucleotide
aaccccgccaacaaaccccttatagagttttcgat

SEQ ID NO: 31332 - DNA, 35 bp, Artificial Sequence
  Synthetic oligonucleotide
tacgagcgccctgcttcataccctttactgtcaaa

SEQ ID NO: 31333 - DNA, 35 bp, Artificial Sequence
  Synthetic oligonucleotide
gtatgcgacgcggcctttttcccctgactgctaaa

SEQ ID NO: 31334 - DNA, 36 bp, Artificial Sequence
  Synthetic oligonucleotide
gcaccccacaacgagtgccttactgagtccctgcaa

SEQ ID NO: 31335 - DNA, 36 bp, Artificial Sequence
  Synthetic oligonucleotide
tccgctcctaccacaccgcacgttgtcgcttatcaa

SEQ ID NO: 31336 - DNA, 33 bp, Artificial Sequence
  Synthetic oligonucleotide
gagcctgcgaaatcgtcgccctcataccactaa

SEQ ID NO: 31337 - DNA, 36 bp, Artificial Sequence
  Synthetic oligonucleotide
gctcccgccctcgctgcatctcccgtagttctggca

SEQ ID NO: 31338 - DNA, 36 bp, Artificial Sequence
  Synthetic oligonucleotide
tgcatctgcccgttgcccggctatgactcttgatca

SEQ ID NO: 31339 - DNA, 37 bp, Artificial Sequence
  Synthetic oligonucleotide
aaccacaccacccgtcctgtcgcgccgtgattcccga

SEQ ID NO: 31340 - DNA, 36 bp, Artificial Sequence
  Synthetic oligonucleotide
gcatggtgcacccttactccaccgacgccttatgga

SEQ ID NO: 31341 - DNA, 38 bp, Artificial Sequence
  Synthetic oligonucleotide
tccattgccgcctcaaccgttcttccctcgcttaatga

SEQ ID NO: 31342 - DNA, 38 bp, Artificial Sequence
  Synthetic oligonucleotide
gcgagagggtcagagaaaggagtagtggggtggtgtga

SEQ ID NO: 31343 - DNA, 37 bp, Artificial Sequence
  Synthetic oligonucleotide
ttcgaccatgcgtcctgtttcctattttctgcattga

SEQ ID NO: 31344 - DNA, 36 bp, Artificial Sequence
  Synthetic oligonucleotide
agacacacgacacaacacaggccgacagggcaacta

SEQ ID NO: 31345 - DNA, 35 bp, Artificial Sequence
  Synthetic oligonucleotide
gtcccaccaccatagcggatcttggtctattttta

SEQ ID NO: 31346 - DNA, 35 bp, Artificial Sequence
  Synthetic oligonucleotide
gtactggttcccggcaccttgattcctcgctttac

SEQ ID NO: 31347 - DNA, 35 bp, Artificial Sequence
  Synthetic oligonucleotide
attcgagcctggcaatccgggctatcacctacccc

SEQ ID NO: 31348 - DNA, 35 bp, Artificial Sequence
  Synthetic oligonucleotide
tccaaccgactggccttatgttcggactgttgtcc

SEQ ID NO: 31349 - DNA, 35 bp, Artificial Sequence
  Synthetic oligonucleotide
tgtccgccgaacacagtccctttactcgcacatcg

SEQ ID NO: 31350 - DNA, 35 bp, Artificial Sequence
  Synthetic oligonucleotide
taagcgcccactacctgcctatataacgggtctct

SEQ ID NO: 31351 - DNA, 35 bp, Artificial Sequence
  Synthetic oligonucleotide
tcgctggtcctccggtttttttgccatttccttgt

SEQ ID NO: 31352 - DNA, 35 bp, Artificial Sequence
  Synthetic oligonucleotide
atcacgcttacatgccgttcaacactccagacaaa

SEQ ID NO: 31353 - DNA, 36 bp, Artificial Sequence
  Synthetic oligonucleotide
gacacactaccatcaacaggggcgcccgttgtcaca

SEQ ID NO: 31354 - DNA, 36 bp, Artificial Sequence
  Synthetic oligonucleotide
gaagcaatgtgtccggctcaccatctgtatcactca

SEQ ID NO: 31355 - DNA, 36 bp, Artificial Sequence
  Synthetic oligonucleotide
gtgccaacatcacctgaccctcagggctcgacctca

SEQ ID NO: 31356 - DNA, 36 bp, Artificial Sequence
  Synthetic oligonucleotide
ggatccgcaaggtcctcctctccatatttgtgctca

SEQ ID NO: 31357 - DNA, 36 bp, Artificial Sequence
  Synthetic oligonucleotide
tttactcccgccccaactgtcccgctcgttagcaga

SEQ ID NO: 31358 - DNA, 36 bp, Artificial Sequence
  Synthetic oligonucleotide
aaggggacgagttggggtaggtaggggtgcaatgga

SEQ ID NO: 31359 - DNA, 35 bp, Artificial Sequence
  Synthetic oligonucleotide
gcaggggtagtaaatgcgggcggggttgcagtgga

SEQ ID NO: 31360 - DNA, 38 bp, Artificial Sequence
  Synthetic oligonucleotide
gttgtgcctgaggctagcgtttgttaccaccttattga

SEQ ID NO: 31361 - DNA, 36 bp, Artificial Sequence
  Synthetic oligonucleotide
tccctgcctcggctcttgtttaccctgggccactta

SEQ ID NO: 31362 - DNA, 35 bp, Artificial Sequence
  Synthetic oligonucleotide
tcccactccccagtacgtttgtcttacggatttac

SEQ ID NO: 31363 - DNA, 35 bp, Artificial Sequence
  Synthetic oligonucleotide
tagttggcgatcagcccccttccggttcgctgccc

SEQ ID NO: 31364 - DNA, 35 bp, Artificial Sequence
  Synthetic oligonucleotide
gtttcagtatcgcgtgctagtgccacccacactcc

SEQ ID NO: 31365 - DNA, 35 bp, Artificial Sequence
  Synthetic oligonucleotide
gacccgtaattccctgcagacactttctgaacgcg

SEQ ID NO: 31366 - DNA, 35 bp, Artificial Sequence
  Synthetic oligonucleotide
tttgaacagtccctgttcgaacccccattgtactg

SEQ ID NO: 31367 - DNA, 35 bp, Artificial Sequence
  Synthetic oligonucleotide
atcgggcgcaaacacagccgttctctttccatgct

SEQ ID NO: 31368 - DNA, 35 bp, Artificial Sequence
  Synthetic oligonucleotide
tagcaatacgctccatgccactctatacgttttct

SEQ ID NO: 31369 - DNA, 36 bp, Artificial Sequence
  Synthetic oligonucleotide
gacaacccgcccctttctatcgtctggggacgtaaa

SEQ ID NO: 31370 - DNA, 36 bp, Artificial Sequence
  Synthetic oligonucleotide
tccgagcccacatacaccgtgtcctaggccttaaca

SEQ ID NO: 31371 - DNA, 36 bp, Artificial Sequence
  Synthetic oligonucleotide
tgagtccagtaagggggggtggatagagggaccaca

SEQ ID NO: 31372 - DNA, 37 bp, Artificial Sequence
  Synthetic oligonucleotide
accgaccacctcaccagccgctaaagtcctaatgcga

SEQ ID NO: 31373 - DNA, 37 bp, Artificial Sequence
  Synthetic oligonucleotide
gttacatctgcacgtttatcttgataccacccgagga

SEQ ID NO: 31374 - DNA, 37 bp, Artificial Sequence
  Synthetic oligonucleotide
attgtgggagtagcatgggggtggaggactttaggga

SEQ ID NO: 31375 - DNA, 37 bp, Artificial Sequence
  Synthetic oligonucleotide
tctccaccactattcgctactaagcctatctcatgga

SEQ ID NO: 31376 - DNA, 38 bp, Artificial Sequence
  Synthetic oligonucleotide
ttgagcatgaccagaacggttaacggggggatgaatga

SEQ ID NO: 31377 - DNA, 35 bp, Artificial Sequence
  Synthetic oligonucleotide
ttctacgacgccttctgtccatgcgcggtccttcc

SEQ ID NO: 31378 - DNA, 35 bp, Artificial Sequence
  Synthetic oligonucleotide
tcacggcggtccggcgttcactaccatcttcgcct

SEQ ID NO: 31379 - DNA, 35 bp, Artificial Sequence
  Synthetic oligonucleotide
acacccgtgggaacttgtttgtatgcacccctgct

SEQ ID NO: 31380 - DNA, 35 bp, Artificial Sequence
  Synthetic oligonucleotide
gagtgccctggtccctggtttttgctcgaatcgtt

SEQ ID NO: 31381 - DNA, 35 bp, Artificial Sequence
  Synthetic oligonucleotide
tcctgtgccatacttctcctctgagtgacactttt

SEQ ID NO: 31382 - DNA, 36 bp, Artificial Sequence
  Synthetic oligonucleotide
ttacgctccgactcgacccgctttctgttagtgcca

SEQ ID NO: 31383 - DNA, 37 bp, Artificial Sequence
  Synthetic oligonucleotide
agcgggggacaaaaaatgggtcgcggaggggcaaaga

SEQ ID NO: 31384 - DNA, 35 bp, Artificial Sequence
  Synthetic oligonucleotide
gcgcctgcacaccgccccttcgttagacttctcga

SEQ ID NO: 31385 - DNA, 36 bp, Artificial Sequence
  Synthetic oligonucleotide
agtggggggcgtggggtcgacggagggacgcccgga

SEQ ID NO: 31386 - DNA, 37 bp, Artificial Sequence
  Synthetic oligonucleotide
tagctgaccatcatctgggcctccacccgttcgcgga

SEQ ID NO: 31387 - DNA, 37 bp, Artificial Sequence
  Synthetic oligonucleotide
aacgccaacttcctcatacttccagtccagaaatgga

SEQ ID NO: 31388 - DNA, 38 bp, Artificial Sequence
  Synthetic oligonucleotide
aggaaaggggtgagtcatggtggaagggcgggtggtga

SEQ ID NO: 31389 - DNA, 37 bp, Artificial Sequence
  Synthetic oligonucleotide
gccggacgaagagggttgccgaaaggatggttggtga

SEQ ID NO: 31390 - DNA, 38 bp, Artificial Sequence
  Synthetic oligonucleotide
tccctggtgccgtgcttttgcacctttcacaattgtga

SEQ ID NO: 31391 - DNA, 38 bp, Artificial Sequence
  Synthetic oligonucleotide
ttgaccgttgctatgtaccgccttgatgcgacccttga

SEQ ID NO: 31392 - DNA, 37 bp, Artificial Sequence
  Synthetic oligonucleotide
tcacagtcaccccccgccataagacctagcatcttga

SEQ ID NO: 31393 - DNA, 38 bp, Artificial Sequence
  Synthetic oligonucleotide
gcacatccgctctatctacacgcattttttactgttga

SEQ ID NO: 31394 - DNA, 38 bp, Artificial Sequence
  Synthetic oligonucleotide
tacaccgcccatggaatcacatccaaatcgcgctttga

SEQ ID NO: 31395 - DNA, 35 bp, Artificial Sequence
  Synthetic oligonucleotide
gcggagttgtccgtcagcttccattccccccacta

SEQ ID NO: 31396 - DNA, 35 bp, Artificial Sequence
  Synthetic oligonucleotide
accgccacagccatctcatccgctggcatgtaaac

SEQ ID NO: 31397 - DNA, 35 bp, Artificial Sequence
  Synthetic oligonucleotide
acatacgggcaccgccgcacagtctctccttcccc

SEQ ID NO: 31398 - DNA, 35 bp, Artificial Sequence
  Synthetic oligonucleotide
acattggcaactccatacctagataaccgctggcc

SEQ ID NO: 31399 - DNA, 35 bp, Artificial Sequence
  Synthetic oligonucleotide
attgcgggcccttgtatttgcatcttgttcttctc

SEQ ID NO: 31400 - DNA, 35 bp, Artificial Sequence
  Synthetic oligonucleotide
gtacatccactgcgcgatcgtcatccacccctgag

SEQ ID NO: 31401 - DNA, 35 bp, Artificial Sequence
  Synthetic oligonucleotide
tcagacgacgacggtgggaaggtcgggaagtgatg

SEQ ID NO: 31402 - DNA, 35 bp, Artificial Sequence
  Synthetic oligonucleotide
tgcgtctccgttgccttttgacgtcctcagtcctg

SEQ ID NO: 31403 - DNA, 35 bp, Artificial Sequence
  Synthetic oligonucleotide
gcacctccgacctgtccctggtaggctttccaaat

SEQ ID NO: 31404 - DNA, 36 bp, Artificial Sequence
  Synthetic oligonucleotide
ttgacccgccttcatacggagcttattgaattacca

SEQ ID NO: 31405 - DNA, 36 bp, Artificial Sequence
  Synthetic oligonucleotide
acacgcttatcggcacactacaacttgatccgccca

SEQ ID NO: 31406 - DNA, 34 bp, Artificial Sequence
  Synthetic oligonucleotide
aatggaccccatcccaatactctaaagagatcca

SEQ ID NO: 31407 - DNA, 36 bp, Artificial Sequence
  Synthetic oligonucleotide
atcatcatccgataggcaacccctcaacatgttgca

SEQ ID NO: 31408 - DNA, 36 bp, Artificial Sequence
  Synthetic oligonucleotide
ttaacccacacttgtcatcgtactgttactttctca

SEQ ID NO: 31409 - DNA, 37 bp, Artificial Sequence
  Synthetic oligonucleotide
tcgcacgggggtaaaacgaggggcggtggacacgaga

SEQ ID NO: 31410 - DNA, 36 bp, Artificial Sequence
  Synthetic oligonucleotide
gcaggggcccggggaggttaaaaggggattgggaga

SEQ ID NO: 31411 - DNA, 37 bp, Artificial Sequence
  Synthetic oligonucleotide
acgtacacgccttagcccctgattccctgacatgaga

SEQ ID NO: 31412 - DNA, 37 bp, Artificial Sequence
  Synthetic oligonucleotide
tagagagggggggcctaaggagagtgtaagcgttaga

SEQ ID NO: 31413 - DNA, 36 bp, Artificial Sequence
  Synthetic oligonucleotide
cctccatcattgcgtctcatgtgcgtggcccaccga

SEQ ID NO: 31414 - DNA, 35 bp, Artificial Sequence
  Synthetic oligonucleotide
tgacgagacgcgcccctccctgcctcgtaatccga

SEQ ID NO: 31415 - DNA, 38 bp, Artificial Sequence
  Synthetic oligonucleotide
gatcccgcgggcgggtgggcttgggtagtctacaatga

SEQ ID NO: 31416 - DNA, 38 bp, Artificial Sequence
  Synthetic oligonucleotide
acactccgcactttgctaatcaaagctggccatcctga

SEQ ID NO: 31417 - DNA, 38 bp, Artificial Sequence
  Synthetic oligonucleotide
gcaggtacctgacttacgcacacatcactccaatctga

SEQ ID NO: 31418 - DNA, 36 bp, Artificial Sequence
  Synthetic oligonucleotide
atgatccaactgggtacgtcccctgcctttatctga

SEQ ID NO: 31419 - DNA, 36 bp, Artificial Sequence
  Synthetic oligonucleotide
acaccatccccgccccgcaggtttattcaactctga

SEQ ID NO: 31420 - DNA, 36 bp, Artificial Sequence
  Synthetic oligonucleotide
ttcgtaacacctactgcatccaggccacacctttta

SEQ ID NO: 31421 - DNA, 35 bp, Artificial Sequence
  Synthetic oligonucleotide
gtgtaggccgacacccctaatgcctgtgcaccatc

SEQ ID NO: 31422 - DNA, 35 bp, Artificial Sequence
  Synthetic oligonucleotide
gacatgtgtcgcagtgtcatccctgctctcccatc

SEQ ID NO: 31423 - DNA, 35 bp, Artificial Sequence
  Synthetic oligonucleotide
atcctcaccaaacttgtcatctgggccatagcctc

SEQ ID NO: 31424 - DNA, 35 bp, Artificial Sequence
  Synthetic oligonucleotide
agcccatccacggatcgcataccccactgattctc

SEQ ID NO: 31425 - DNA, 35 bp, Artificial Sequence
  Synthetic oligonucleotide
gatgccacacgcagtccggggggctcaccaatttc

SEQ ID NO: 31426 - DNA, 35 bp, Artificial Sequence
  Synthetic oligonucleotide
gtcaaaggggggttgcgagaatgttggggcggtag

SEQ ID NO: 31427 - DNA, 35 bp, Artificial Sequence
  Synthetic oligonucleotide
aaccacctcgcctcggaacggctcgcattaacgcg

SEQ ID NO: 31428 - DNA, 35 bp, Artificial Sequence
  Synthetic oligonucleotide
ttcccacttctcggatgcgcagcctggcctccact

SEQ ID NO: 31429 - DNA, 35 bp, Artificial Sequence
  Synthetic oligonucleotide
agcaccgtattggcaccaatcgacccttctgccct

SEQ ID NO: 31430 - DNA, 35 bp, Artificial Sequence
  Synthetic oligonucleotide
aagccccgactatcccggcagactatgccgcttct

SEQ ID NO: 31431 - DNA, 36 bp, Artificial Sequence
  Synthetic oligonucleotide
gactccgatcctccttgtccttaatcagtttaacaa

SEQ ID NO: 31432 - DNA, 36 bp, Artificial Sequence
  Synthetic oligonucleotide
gatgccccacccatcccccacgtactcatgcagaca

SEQ ID NO: 31433 - DNA, 36 bp, Artificial Sequence
  Synthetic oligonucleotide
gctgacgatcaccagatcgacggccatctttcccca

SEQ ID NO: 31434 - DNA, 36 bp, Artificial Sequence
  Synthetic oligonucleotide
gccacggaaggtccttctgtcatttatgcgccttca

SEQ ID NO: 31435 - DNA, 36 bp, Artificial Sequence
  Synthetic oligonucleotide
tccctcccaccaagtgcatcgaagcacggcgaacga

SEQ ID NO: 31436 - DNA, 36 bp, Artificial Sequence
  Synthetic oligonucleotide
gctacatgcactgcgtccccgactccgccgtatcga

SEQ ID NO: 31437 - DNA, 37 bp, Artificial Sequence
  Synthetic oligonucleotide
tttgtagccggtgtgaggtagggggtacgggagggga

SEQ ID NO: 31438 - DNA, 38 bp, Artificial Sequence
  Synthetic oligonucleotide
gcaccatcctgcgtacctcttgagcacaccgactatga

SEQ ID NO: 31439 - DNA, 38 bp, Artificial Sequence
  Synthetic oligonucleotide
acagcgggactcgtattgttttttttctcactgcctga

SEQ ID NO: 31440 - DNA, 35 bp, Artificial Sequence
  Synthetic oligonucleotide
gtggaggagaaggggtggggctcgtgcgtcatata

SEQ ID NO: 31441 - DNA, 36 bp, Artificial Sequence
  Synthetic oligonucleotide
gttaccgcacccgatcttacctagtccacattgcta

SEQ ID NO: 31442 - DNA, 35 bp, Artificial Sequence
  Synthetic oligonucleotide
atgctacgtggagcaactttgccttccagccgccc

SEQ ID NO: 31443 - DNA, 35 bp, Artificial Sequence
  Synthetic oligonucleotide
gctgcgcctccaagtgtcaatcgcactatcatctc

SEQ ID NO: 31444 - DNA, 35 bp, Artificial Sequence
  Synthetic oligonucleotide
ttcacgttcgaccgttacctcatgtgcgcccttcg

SEQ ID NO: 31445 - DNA, 35 bp, Artificial Sequence
  Synthetic oligonucleotide
acgcgccacagggtggggtggggtaagggtgccgg

SEQ ID NO: 31446 - DNA, 35 bp, Artificial Sequence
  Synthetic oligonucleotide
tttgaggggggtgggtgaaatggatgcggtgtgtg

SEQ ID NO: 31447 - DNA, 35 bp, Artificial Sequence
  Synthetic oligonucleotide
gtctagctgcaattagttctccgtctcgtttccat

SEQ ID NO: 31448 - DNA, 35 bp, Artificial Sequence
  Synthetic oligonucleotide
gacaccagactcctttgctttcaaacgcctccgat

SEQ ID NO: 31449 - DNA, 35 bp, Artificial Sequence
  Synthetic oligonucleotide
tcccccccgagccttgtagaggaacgcctcactat

SEQ ID NO: 31450 - DNA, 35 bp, Artificial Sequence
  Synthetic oligonucleotide
tgtgtgcttcctcctgttgcttttatgaccttact

SEQ ID NO: 31451 - DNA, 36 bp, Artificial Sequence
  Synthetic oligonucleotide
tgtggggggctcggggaaacgggggtacggtttaaa

SEQ ID NO: 31452 - DNA, 35 bp, Artificial Sequence
  Synthetic oligonucleotide
atggtaacgccctggcaccccacttgctttgagca

SEQ ID NO: 31453 - DNA, 36 bp, Artificial Sequence
  Synthetic oligonucleotide
accaccaccgccgggctagctcttctatggacttca

SEQ ID NO: 31454 - DNA, 36 bp, Artificial Sequence
  Synthetic oligonucleotide
gcacgattagtgtttctccgcaccctgtggccttca

SEQ ID NO: 31455 - DNA, 37 bp, Artificial Sequence
  Synthetic oligonucleotide
gctgacccatcaacatgctttgtgtcatctaccccga

SEQ ID NO: 31456 - DNA, 38 bp, Artificial Sequence
  Synthetic oligonucleotide
accgctagggtgtaagtggggtggaacaaaggagctga

SEQ ID NO: 31457 - DNA, 38 bp, Artificial Sequence
  Synthetic oligonucleotide
aatgccaccggccgttcaagttaatccttccccgctga

SEQ ID NO: 31458 - DNA, 36 bp, Artificial Sequence
  Synthetic oligonucleotide
tacgcccccataaatgccgtgcctgggcacttgata

SEQ ID NO: 31459 - DNA, 36 bp, Artificial Sequence
  Synthetic oligonucleotide
gcctgctgggggttctgcctggggtcccttcaccta

SEQ ID NO: 31460 - DNA, 35 bp, Artificial Sequence
  Synthetic oligonucleotide
atgccccgccaccactttctggcctacggttcccc

SEQ ID NO: 31461 - DNA, 35 bp, Artificial Sequence
  Synthetic oligonucleotide
actcccatgcccgcatgtacgaacgtaacccatcc

SEQ ID NO: 31462 - DNA, 35 bp, Artificial Sequence
  Synthetic oligonucleotide
tcgatcatcaccgacccctgtacgaactagctcgc

SEQ ID NO: 31463 - DNA, 35 bp, Artificial Sequence
  Synthetic oligonucleotide
tgagaagcactatccgctggccttcactcgttctc

SEQ ID NO: 31464 - DNA, 35 bp, Artificial Sequence
  Synthetic oligonucleotide
atcccgactcacgagccgctcccgtttcatacagg

SEQ ID NO: 31465 - DNA, 35 bp, Artificial Sequence
  Synthetic oligonucleotide
acgcgcctcctccacgattggtgactcctttttct

SEQ ID NO: 31466 - DNA, 35 bp, Artificial Sequence
  Synthetic oligonucleotide
tcacccatccatctctctggacccaatgtttaggt

SEQ ID NO: 31467 - DNA, 36 bp, Artificial Sequence
  Synthetic oligonucleotide
gcccctagcccatggtcttccacgtggttccatcaa

SEQ ID NO: 31468 - DNA, 36 bp, Artificial Sequence
  Synthetic oligonucleotide
tgcaccactcatccagggcatgatttccctactaca

SEQ ID NO: 31469 - DNA, 36 bp, Artificial Sequence
  Synthetic oligonucleotide
ggagcgccgtcataatcccttttagcgctactccca

SEQ ID NO: 31470 - DNA, 36 bp, Artificial Sequence
  Synthetic oligonucleotide
gcctctcccccttcccagcctgcctacagtgcagca

SEQ ID NO: 31471 - DNA, 36 bp, Artificial Sequence
  Synthetic oligonucleotide
acactggcgaattgctggtgcctggttacaccctca

SEQ ID NO: 31472 - DNA, 37 bp, Artificial Sequence
  Synthetic oligonucleotide
ttcgagcccttgcgttcacctgcccacccctaacaga

SEQ ID NO: 31473 - DNA, 37 bp, Artificial Sequence
  Synthetic oligonucleotide
actacataccacaatacaagtgcctgcccccacgcga

SEQ ID NO: 31474 - DNA, 35 bp, Artificial Sequence
  Synthetic oligonucleotide
gcaccttccattcatcgctcctgccacatcctcga

SEQ ID NO: 31475 - DNA, 37 bp, Artificial Sequence
  Synthetic oligonucleotide
gcccgacgggtgggagtcttaagaagtttgggtggga

SEQ ID NO: 31476 - DNA, 37 bp, Artificial Sequence
  Synthetic oligonucleotide
gacaaagcataggtagtgggggtctacaggggatgga

SEQ ID NO: 31477 - DNA, 37 bp, Artificial Sequence
  Synthetic oligonucleotide
gtccgtgaccgcgcgtccgcccttgtctttcatctga

SEQ ID NO: 31478 - DNA, 35 bp, Artificial Sequence
  Synthetic oligonucleotide
atgcggtcccccgcttggactttgacatctcgacc

SEQ ID NO: 31479 - DNA, 35 bp, Artificial Sequence
  Synthetic oligonucleotide
gctcgcacactttatacaccaacgttttcagccat

SEQ ID NO: 31480 - DNA, 35 bp, Artificial Sequence
  Synthetic oligonucleotide
gtcaaatccggaggctaaatggaacccagcccact

SEQ ID NO: 31481 - DNA, 35 bp, Artificial Sequence
  Synthetic oligonucleotide
actggagagtcggattttgcgccgttgttccatct

SEQ ID NO: 31482 - DNA, 35 bp, Artificial Sequence
  Synthetic oligonucleotide
gttgcctctttctagcccgttttaatccgccttgt

SEQ ID NO: 31483 - DNA, 35 bp, Artificial Sequence
  Synthetic oligonucleotide
tccgaactcatgccccctttatgcgtggccccatt

SEQ ID NO: 31484 - DNA, 35 bp, Artificial Sequence
  Synthetic oligonucleotide
gttgtactggcgaccgactagcgcacactgacctt

SEQ ID NO: 31485 - DNA, 35 bp, Artificial Sequence
  Synthetic oligonucleotide
tgcgttcggcggatttttttctttgctcacttttt

SEQ ID NO: 31486 - DNA, 35 bp, Artificial Sequence
  Synthetic oligonucleotide
gctgggaccgccattcaatacgcttagggtttttt

SEQ ID NO: 31487 - DNA, 35 bp, Artificial Sequence
  Synthetic oligonucleotide
acgaacgcaccacccaatatgccccacctctagaa

SEQ ID NO: 31488 - DNA, 36 bp, Artificial Sequence
  Synthetic oligonucleotide
gcatgcctgccggtgcatttctcgcgtaatccgtaa

SEQ ID NO: 31489 - DNA, 35 bp, Artificial Sequence
  Synthetic oligonucleotide
tcccaccctctcgtctgggtaacctaaccgtttaa

SEQ ID NO: 31490 - DNA, 36 bp, Artificial Sequence
  Synthetic oligonucleotide
acccaatgctggcccaaatctgaccaaccgatccca

SEQ ID NO: 31491 - DNA, 37 bp, Artificial Sequence
  Synthetic oligonucleotide
tgcatccggccccctgctctcttcacgcttacacaga

SEQ ID NO: 31492 - DNA, 37 bp, Artificial Sequence
  Synthetic oligonucleotide
gaatgccgccaggctgcccacacctcgatcatttaga

SEQ ID NO: 31493 - DNA, 37 bp, Artificial Sequence
  Synthetic oligonucleotide
tgccttgccttcacaccatagctcactgtaatatcga

SEQ ID NO: 31494 - DNA, 37 bp, Artificial Sequence
  Synthetic oligonucleotide
gccctcccccactccgcatctaaagcctggcttcgga

SEQ ID NO: 31495 - DNA, 37 bp, Artificial Sequence
  Synthetic oligonucleotide
agcgtgcagtagggattactttgcgggggggcgggga

SEQ ID NO: 31496 - DNA, 38 bp, Artificial Sequence
  Synthetic oligonucleotide
tcattctccaccgacccccctgcgttcgccagtcctga

SEQ ID NO: 31497 - DNA, 38 bp, Artificial Sequence
  Synthetic oligonucleotide
gatccaccgaggcgcgttatgccatttctcgttgctga

SEQ ID NO: 31498 - DNA, 35 bp, Artificial Sequence
  Synthetic oligonucleotide
taaaccgcattccagcgtaactgacacttcgaaac

SEQ ID NO: 31499 - DNA, 35 bp, Artificial Sequence
  Synthetic oligonucleotide
gagagaggagggccggagtgcggttggggctgaag

SEQ ID NO: 31500 - DNA, 35 bp, Artificial Sequence
  Synthetic oligonucleotide
cgttacctgccccatgttctaccgtttttaatggg

SEQ ID NO: 31501 - DNA, 35 bp, Artificial Sequence
  Synthetic oligonucleotide
tgtaggccgatatgatccgccatccccccgccctg

SEQ ID NO: 31502 - DNA, 36 bp, Artificial Sequence
  Synthetic oligonucleotide
tgcgggaaggcaaaaggggggtcggctcggaggaca

SEQ ID NO: 31503 - DNA, 36 bp, Artificial Sequence
  Synthetic oligonucleotide
accccctgttgtctagcctaggcgccttgttctaca

SEQ ID NO: 31504 - DNA, 36 bp, Artificial Sequence
  Synthetic oligonucleotide
ttatcaccccctcagctcgttgctcaaggtcaagca

SEQ ID NO: 31505 - DNA, 38 bp, Artificial Sequence
  Synthetic oligonucleotide
aacgcaagagaggagttggtggcaaggcaaggttaaga

SEQ ID NO: 31506 - DNA, 35 bp, Artificial Sequence
  Synthetic oligonucleotide
gtccaatcagcgctcccctccgttctatctctaga

SEQ ID NO: 31507 - DNA, 37 bp, Artificial Sequence
  Synthetic oligonucleotide
tctgctgagcccaattaccccgacgctccgttcccga

SEQ ID NO: 31508 - DNA, 37 bp, Artificial Sequence
  Synthetic oligonucleotide
gtacgctcggctctaatgctccacatcccttctagga

SEQ ID NO: 31509 - DNA, 37 bp, Artificial Sequence
  Synthetic oligonucleotide
ctagggggacgaagggtgagggggtatcaatgaggga

SEQ ID NO: 31510 - DNA, 38 bp, Artificial Sequence
  Synthetic oligonucleotide
tgccgcctcccgcgagattacacgtagtcctcccatga

SEQ ID NO: 31511 - DNA, 36 bp, Artificial Sequence
  Synthetic oligonucleotide
tgaacaaggcgcgagagccatcaaacacctcatcta

SEQ ID NO: 31512 - DNA, 36 bp, Artificial Sequence
  Synthetic oligonucleotide
tgacaccactgaagacctcttgcattgacaacctta

SEQ ID NO: 31513 - DNA, 35 bp, Artificial Sequence
  Synthetic oligonucleotide
ttcgcatcctgaagctcttccgcctgctaatggac

SEQ ID NO: 31514 - DNA, 35 bp, Artificial Sequence
  Synthetic oligonucleotide
tactacccatccaagttcttatttcacaggtgtac

SEQ ID NO: 31515 - DNA, 35 bp, Artificial Sequence
  Synthetic oligonucleotide
atgccatcaacacctaccatgggagtagcccaacc

SEQ ID NO: 31516 - DNA, 35 bp, Artificial Sequence
  Synthetic oligonucleotide
gtaccccactcctctgcttaccaaccggagtgtcc

SEQ ID NO: 31517 - DNA, 35 bp, Artificial Sequence
  Synthetic oligonucleotide
aatcccacgtcactgtaatctccaccaatcttcgc

SEQ ID NO: 31518 - DNA, 35 bp, Artificial Sequence
  Synthetic oligonucleotide
acaatcgccgtagtcacactccttctctaagcgtc

SEQ ID NO: 31519 - DNA, 35 bp, Artificial Sequence
  Synthetic oligonucleotide
atatccgacccctggctaaccatacagacgttgtc

SEQ ID NO: 31520 - DNA, 35 bp, Artificial Sequence
  Synthetic oligonucleotide
cccgttccgaattaactcccgcctgccatttcaag

SEQ ID NO: 31521 - DNA, 35 bp, Artificial Sequence
  Synthetic oligonucleotide
tcactacgccgatgtaagaccgctcatcaccccct

SEQ ID NO: 31522 - DNA, 35 bp, Artificial Sequence
  Synthetic oligonucleotide
gcggatgggtgcgaggggggtagggcatccggctt

SEQ ID NO: 31523 - DNA, 35 bp, Artificial Sequence
  Synthetic oligonucleotide
ttgttaccctctcgatccatgtggccccctgctaa

SEQ ID NO: 31524 - DNA, 36 bp, Artificial Sequence
  Synthetic oligonucleotide
aacacatcacatgtcctcccgaacctggggcgaaca

SEQ ID NO: 31525 - DNA, 36 bp, Artificial Sequence
  Synthetic oligonucleotide
agaccatcgctgcccctttccattagttgtttgtca

SEQ ID NO: 31526 - DNA, 37 bp, Artificial Sequence
  Synthetic oligonucleotide
tagacacacaaccatccgcagcccactagcctgtcga

SEQ ID NO: 31527 - DNA, 37 bp, Artificial Sequence
  Synthetic oligonucleotide
gggacaagaggaggggtgaggctaaggtaagttcgga

SEQ ID NO: 31528 - DNA, 38 bp, Artificial Sequence
  Synthetic oligonucleotide
gtgaaggggaggttggaaatggggggcgccactggtga

SEQ ID NO: 31529 - DNA, 35 bp, Artificial Sequence
  Synthetic oligonucleotide
taatcccatcggctgcccttcatctcttcagcctc

SEQ ID NO: 31530 - DNA, 35 bp, Artificial Sequence
  Synthetic oligonucleotide
gccctagcacgtctgcggcatataaaaaggttggg

SEQ ID NO: 31531 - DNA, 36 bp, Artificial Sequence
  Synthetic oligonucleotide
ttgctcaccctcccatactgcagcgatggcaatctg

SEQ ID NO: 31532 - DNA, 35 bp, Artificial Sequence
  Synthetic oligonucleotide
acagccccgagctatgtagtcccatcattaggcat

SEQ ID NO: 31533 - DNA, 35 bp, Artificial Sequence
  Synthetic oligonucleotide
tgatcagagtgtcaatccttgcccgatcgcctcat

SEQ ID NO: 31534 - DNA, 35 bp, Artificial Sequence
  Synthetic oligonucleotide
gaggatgtgggcgggtaccatgtaaggccgggggt

SEQ ID NO: 31535 - DNA, 36 bp, Artificial Sequence
  Synthetic oligonucleotide
tgcaagcccctattgtccatcctttgtagcgttaaa

SEQ ID NO: 31536 - DNA, 36 bp, Artificial Sequence
  Synthetic oligonucleotide
actcgcgcctagggttatgtaacccgtcctttaaca

SEQ ID NO: 31537 - DNA, 36 bp, Artificial Sequence
  Synthetic oligonucleotide
gtcactgtccgctttcccttagccgaaactgtcaca

SEQ ID NO: 31538 - DNA, 35 bp, Artificial Sequence
  Synthetic oligonucleotide
tccaaccggtctcacactgtcccttatcctctaca

SEQ ID NO: 31539 - DNA, 35 bp, Artificial Sequence
  Synthetic oligonucleotide
tcgagatgccgggcgggagggcaagggcggggaga

SEQ ID NO: 31540 - DNA, 37 bp, Artificial Sequence
  Synthetic oligonucleotide
gacttccacactcgctctgccgtacacctttaataga

SEQ ID NO: 31541 - DNA, 37 bp, Artificial Sequence
  Synthetic oligonucleotide
tgaaaggggaaggggggataagcagaaactgagagga

SEQ ID NO: 31542 - DNA, 37 bp, Artificial Sequence
  Synthetic oligonucleotide
gccgacgagggcatcttccgcacatttcttactatga

SEQ ID NO: 31543 - DNA, 36 bp, Artificial Sequence
  Synthetic oligonucleotide
accaccgctctaacactggatagccccccacggtga

SEQ ID NO: 31544 - DNA, 38 bp, Artificial Sequence
  Synthetic oligonucleotide
gaccattgctcccgagtgcatttcataccatccattga

SEQ ID NO: 31545 - DNA, 36 bp, Artificial Sequence
  Synthetic oligonucleotide
tctgacccccccggctagccacataggtcaaaccta

SEQ ID NO: 31546 - DNA, 36 bp, Artificial Sequence
  Synthetic oligonucleotide
aagacgggcaaccggggggggtgggaagcgtgttta

SEQ ID NO: 31547 - DNA, 35 bp, Artificial Sequence
  Synthetic oligonucleotide
gatcccggccctgggctgcgcattagaaccactac

SEQ ID NO: 31548 - DNA, 35 bp, Artificial Sequence
  Synthetic oligonucleotide
attgcgccgtacattctgcatactttctcgattgc

SEQ ID NO: 31549 - DNA, 35 bp, Artificial Sequence
  Synthetic oligonucleotide
tcaggacgagtccagcgtcgccatcattctcgctc

SEQ ID NO: 31550 - DNA, 35 bp, Artificial Sequence
  Synthetic oligonucleotide
tgtgtcgcatgtatagatgctttacccttctcttc

SEQ ID NO: 31551 - DNA, 34 bp, Artificial Sequence
  Synthetic oligonucleotide
gggacgccgcccgctgaacgtttcactccatccg

SEQ ID NO: 31552 - DNA, 34 bp, Artificial Sequence
  Synthetic oligonucleotide
tagcactcacccctccccagcgcgctcccatctg

SEQ ID NO: 31553 - DNA, 35 bp, Artificial Sequence
  Synthetic oligonucleotide
acccccaacaatcacactgtggagtctcttgacct

SEQ ID NO: 31554 - DNA, 35 bp, Artificial Sequence
  Synthetic oligonucleotide
tcgcactgttgccatcgtcaataacttgtttccct

SEQ ID NO: 31555 - DNA, 36 bp, Artificial Sequence
  Synthetic oligonucleotide
tcccatcctccctaggtgtatccagtagaacgcaca

SEQ ID NO: 31556 - DNA, 35 bp, Artificial Sequence
  Synthetic oligonucleotide
aacggaggggaaggaatgattggtacacaaataca

SEQ ID NO: 31557 - DNA, 35 bp, Artificial Sequence
  Synthetic oligonucleotide
gagccctcgccacactcgctcataagccgctagca

SEQ ID NO: 31558 - DNA, 37 bp, Artificial Sequence
  Synthetic oligonucleotide
acgtgggaacggacgaacggagggagggagccataga

SEQ ID NO: 31559 - DNA, 36 bp, Artificial Sequence
  Synthetic oligonucleotide
aaccaaccgccaagcccattatcttgagttcctcga

SEQ ID NO: 31560 - DNA, 37 bp, Artificial Sequence
  Synthetic oligonucleotide
attggcccctcggattcttcgcccattcctttctcga

SEQ ID NO: 31561 - DNA, 37 bp, Artificial Sequence
  Synthetic oligonucleotide
gttaacgccctacttccacccgtcacgctccacatga

SEQ ID NO: 31562 - DNA, 38 bp, Artificial Sequence
  Synthetic oligonucleotide
actcacgaaattgcaaatggcctgccctacactactga

SEQ ID NO: 31563 - DNA, 36 bp, Artificial Sequence
  Synthetic oligonucleotide
tacctccgccgcaactggacaataccaggcatctga

SEQ ID NO: 31564 - DNA, 38 bp, Artificial Sequence
  Synthetic oligonucleotide
acttgaggagggtgtaagggagaagctggggtgggtga

SEQ ID NO: 31565 - DNA, 37 bp, Artificial Sequence
  Synthetic oligonucleotide
ttgacagttctgcttcggccttatacctcctacttga

SEQ ID NO: 31566 - DNA, 36 bp, Artificial Sequence
  Synthetic oligonucleotide
agcgtggcggggaggggagcgaaaacgggcgtccta

SEQ ID NO: 31567 - DNA, 36 bp, Artificial Sequence
  Synthetic oligonucleotide
atagtcgccatgccgtgctgtttttctccgtttgta

SEQ ID NO: 31568 - DNA, 37 bp, Artificial Sequence
  Synthetic oligonucleotide
ggtgaaccccccccccgtcatgtcctgacccttcacc

SEQ ID NO: 31569 - DNA, 35 bp, Artificial Sequence
  Synthetic oligonucleotide
tccgttcaccacccaatgacacctatggtcgtccc

SEQ ID NO: 31570 - DNA, 35 bp, Artificial Sequence
  Synthetic oligonucleotide
atccggtgagtgtacacttcgagccgcttacctcc

SEQ ID NO: 31571 - DNA, 35 bp, Artificial Sequence
  Synthetic oligonucleotide
accacatggtggtctcattcgtttttgctacattc

SEQ ID NO: 31572 - DNA, 35 bp, Artificial Sequence
  Synthetic oligonucleotide
tgtcccttactgcatgtcccgccaatcaaacgttc

SEQ ID NO: 31573 - DNA, 35 bp, Artificial Sequence
  Synthetic oligonucleotide
gtgttgccctcgctgtgcgttatcgccgaacgttc

SEQ ID NO: 31574 - DNA, 35 bp, Artificial Sequence
  Synthetic oligonucleotide
gaacgccccatacacgccactcttgagcgtcactg

SEQ ID NO: 31575 - DNA, 35 bp, Artificial Sequence
  Synthetic oligonucleotide
ttcatggcccactgtcccaccaaccatacacattg

SEQ ID NO: 31576 - DNA, 35 bp, Artificial Sequence
  Synthetic oligonucleotide
gcaaacacaacaacgcagtcttccacccgctgaat

SEQ ID NO: 31577 - DNA, 35 bp, Artificial Sequence
  Synthetic oligonucleotide
agcgacgtcatagccctccctcgctggttttgcct

SEQ ID NO: 31578 - DNA, 35 bp, Artificial Sequence
  Synthetic oligonucleotide
aaggggcgacaacgcgacatcaccacccttttcgt

SEQ ID NO: 31579 - DNA, 34 bp, Artificial Sequence
  Synthetic oligonucleotide
tctgtctcacctctctccgattttatttggccca

SEQ ID NO: 31580 - DNA, 37 bp, Artificial Sequence
  Synthetic oligonucleotide
taagatggccggcacgtggggagtaggggcggttgga

SEQ ID NO: 31581 - DNA, 38 bp, Artificial Sequence
  Synthetic oligonucleotide
atcatatcggccacccctgtcccttcggtaccgcttga

SEQ ID NO: 31582 - DNA, 35 bp, Artificial Sequence
  Synthetic oligonucleotide
gtcttccgtccgtctgagctcttatcacgccttta

SEQ ID NO: 31583 - DNA, 35 bp, Artificial Sequence
  Synthetic oligonucleotide
gtagggtccagggaacgggaatggggcggtgagac

SEQ ID NO: 31584 - DNA, 35 bp, Artificial Sequence
  Synthetic oligonucleotide
aatgcgctcccaaacgctggtaccactaactagac

SEQ ID NO: 31585 - DNA, 35 bp, Artificial Sequence
  Synthetic oligonucleotide
ttgcccgtgggccagcagttctatctcctattccc

SEQ ID NO: 31586 - DNA, 35 bp, Artificial Sequence
  Synthetic oligonucleotide
atcctcacccaactggtgtgctgttcgctttcgcc

SEQ ID NO: 31587 - DNA, 35 bp, Artificial Sequence
  Synthetic oligonucleotide
accgaccccattggtatgccctcagggtcatttcc

SEQ ID NO: 31588 - DNA, 35 bp, Artificial Sequence
  Synthetic oligonucleotide
gtccgactcataggccttccccattccgagccctc

SEQ ID NO: 31589 - DNA, 35 bp, Artificial Sequence
  Synthetic oligonucleotide
tgcgaatcacccagctttcccccatatgagcctcg

SEQ ID NO: 31590 - DNA, 35 bp, Artificial Sequence
  Synthetic oligonucleotide
atcacagtcctcgcaccgatgcaacacccgctctg

SEQ ID NO: 31591 - DNA, 35 bp, Artificial Sequence
  Synthetic oligonucleotide
tcagccatttcttcgcgccgccttcgactcctgat

SEQ ID NO: 31592 - DNA, 35 bp, Artificial Sequence
  Synthetic oligonucleotide
gttgatccgacacggatatgaaatagtctccgcct

SEQ ID NO: 31593 - DNA, 36 bp, Artificial Sequence
  Synthetic oligonucleotide
tttgcctatgagcctcaccgacgtagttcgcaccca

SEQ ID NO: 31594 - DNA, 36 bp, Artificial Sequence
  Synthetic oligonucleotide
tcacgccattctgctccttcactagtagtttttgca

SEQ ID NO: 31595 - DNA, 36 bp, Artificial Sequence
  Synthetic oligonucleotide
tcctgtcgcagaaaagtgtggccttcgcccctctca

SEQ ID NO: 31596 - DNA, 36 bp, Artificial Sequence
  Synthetic oligonucleotide
gactacgtcgttcgcccgaagcctatcgttctttca

SEQ ID NO: 31597 - DNA, 37 bp, Artificial Sequence
  Synthetic oligonucleotide
tccgaatctgcccccacccatttagcatttgagccga

SEQ ID NO: 31598 - DNA, 37 bp, Artificial Sequence
  Synthetic oligonucleotide
tgtcacggggagcaattgagcatggtggcgtgaggga

SEQ ID NO: 31599 - DNA, 37 bp, Artificial Sequence
  Synthetic oligonucleotide
accgggccgaggactacgggggaagcacgaacgggga

SEQ ID NO: 31600 - DNA, 37 bp, Artificial Sequence
  Synthetic oligonucleotide
acacactacctcatttgcgcgacgcccatttcaatga

SEQ ID NO: 31601 - DNA, 38 bp, Artificial Sequence
  Synthetic oligonucleotide
tcaagccgccttccgaggaacctattgaacaccgctga

SEQ ID NO: 31602 - DNA, 38 bp, Artificial Sequence
  Synthetic oligonucleotide
accccatcacaaccatctacagagctgctgttttctga

SEQ ID NO: 31603 - DNA, 38 bp, Artificial Sequence
  Synthetic oligonucleotide
atcgctcaccagtgacaaccagcgtacatcccccgtga

SEQ ID NO: 31604 - DNA, 38 bp, Artificial Sequence
  Synthetic oligonucleotide
accccctccgttattttttgttagcgatagcgcattga

SEQ ID NO: 31605 - DNA, 35 bp, Artificial Sequence
  Synthetic oligonucleotide
acaactacccgctgtgtgtcactgcggcacaccac

SEQ ID NO: 31606 - DNA, 35 bp, Artificial Sequence
  Synthetic oligonucleotide
tctcagtcacgcgcaatacgcgggttttgttcttc

SEQ ID NO: 31607 - DNA, 35 bp, Artificial Sequence
  Synthetic oligonucleotide
acgcactggcccggttaattttccacttctatgag

SEQ ID NO: 31608 - DNA, 35 bp, Artificial Sequence
  Synthetic oligonucleotide
ggtggggggcagagggaggcggtgaaggtgcttag

SEQ ID NO: 31609 - DNA, 35 bp, Artificial Sequence
  Synthetic oligonucleotide
acccgaaaaataggcgaaagagcgagggggtgggg

SEQ ID NO: 31610 - DNA, 35 bp, Artificial Sequence
  Synthetic oligonucleotide
ggttatgccgcagggtctacacctctctcgctctg

SEQ ID NO: 31611 - DNA, 35 bp, Artificial Sequence
  Synthetic oligonucleotide
gagagtggactcagggggtttgggtgggggtgtat

SEQ ID NO: 31612 - DNA, 35 bp, Artificial Sequence
  Synthetic oligonucleotide
gtgccccttgccatcgaatctttgcatcagcataa

SEQ ID NO: 31613 - DNA, 36 bp, Artificial Sequence
  Synthetic oligonucleotide
gttgagtgtccatgatcacctagttgccttccccca

SEQ ID NO: 31614 - DNA, 35 bp, Artificial Sequence
  Synthetic oligonucleotide
acatgtcactctgtcctagaaccgaactcgctcca

SEQ ID NO: 31615 - DNA, 35 bp, Artificial Sequence
  Synthetic oligonucleotide
acacatccacccctggagcctaatcaatgtacgca

SEQ ID NO: 31616 - DNA, 35 bp, Artificial Sequence
  Synthetic oligonucleotide
tgtgccgatgctagaagctccacctaaaccgctca

SEQ ID NO: 31617 - DNA, 37 bp, Artificial Sequence
  Synthetic oligonucleotide
ttgtcgccatgcccgcgcgcccactaggaactcccga

SEQ ID NO: 31618 - DNA, 37 bp, Artificial Sequence
  Synthetic oligonucleotide
ggtcgcatcaccgtcgcaataacatctgctctcccga

SEQ ID NO: 31619 - DNA, 37 bp, Artificial Sequence
  Synthetic oligonucleotide
tagtctcggagctatgtgtccttctccatctggccga

SEQ ID NO: 31620 - DNA, 37 bp, Artificial Sequence
  Synthetic oligonucleotide
ggagagtgaggacatgggtagataggaggggttcgga

SEQ ID NO: 31621 - DNA, 37 bp, Artificial Sequence
  Synthetic oligonucleotide
aacctatggttcgcactccttcctggtccacacggga

SEQ ID NO: 31622 - DNA, 37 bp, Artificial Sequence
  Synthetic oligonucleotide
gaagaccgtaagacgtagggggaaggcgggtagtgga

SEQ ID NO: 31623 - DNA, 37 bp, Artificial Sequence
  Synthetic oligonucleotide
tagatccaccatcccaggtgcctaaaaattgccctga

SEQ ID NO: 31624 - DNA, 37 bp, Artificial Sequence
  Synthetic oligonucleotide
accggctcgccccccgtccgttacaactgcccgctga

SEQ ID NO: 31625 - DNA, 38 bp, Artificial Sequence
  Synthetic oligonucleotide
gtcgtccccgcagtctcatctacgcactacagatctga

SEQ ID NO: 31626 - DNA, 38 bp, Artificial Sequence
  Synthetic oligonucleotide
gttcaacgcagggtcaaaaggggggagtggtaatgtga

SEQ ID NO: 31627 - DNA, 38 bp, Artificial Sequence
  Synthetic oligonucleotide
aatgaagacgagaggaggatggagcgatgttcgtgtga

SEQ ID NO: 31628 - DNA, 36 bp, Artificial Sequence
  Synthetic oligonucleotide
accgaaccctggctcttgacgcgtatctcgctagta

SEQ ID NO: 31629 - DNA, 36 bp, Artificial Sequence
  Synthetic oligonucleotide
tccactccaaatgatcgaacgcccaggtcgacatta

SEQ ID NO: 31630 - DNA, 36 bp, Artificial Sequence
  Synthetic oligonucleotide
actaccccacactatgttacaggccgcccgttctta

SEQ ID NO: 31631 - DNA, 35 bp, Artificial Sequence
  Synthetic oligonucleotide
gtaccgtaccggttaatttctacagccatcttgcc

SEQ ID NO: 31632 - DNA, 35 bp, Artificial Sequence
  Synthetic oligonucleotide
tcatagctgttaagccgagtttacatcgctcctcc

SEQ ID NO: 31633 - DNA, 35 bp, Artificial Sequence
  Synthetic oligonucleotide
gaagctcgccagtcaaccatcccaatccatgcctc

SEQ ID NO: 31634 - DNA, 35 bp, Artificial Sequence
  Synthetic oligonucleotide
ttgatcattgcactctgttattgcctactggaccg

SEQ ID NO: 31635 - DNA, 35 bp, Artificial Sequence
  Synthetic oligonucleotide
acacaaagacgctcctccgcccacgcgatagtccg

SEQ ID NO: 31636 - DNA, 35 bp, Artificial Sequence
  Synthetic oligonucleotide
tacccgttccagcctttcaactctgcatcgcactg

SEQ ID NO: 31637 - DNA, 35 bp, Artificial Sequence
  Synthetic oligonucleotide
tgtgccatggcgttactttcgatctgttctccttg

SEQ ID NO: 31638 - DNA, 36 bp, Artificial Sequence
  Synthetic oligonucleotide
ttagcagggtgaggggtttatgaatggcaaggggaa

SEQ ID NO: 31639 - DNA, 35 bp, Artificial Sequence
  Synthetic oligonucleotide
gaatggtgggggaggttcttgaagatacggacgca

SEQ ID NO: 31640 - DNA, 36 bp, Artificial Sequence
  Synthetic oligonucleotide
aaaacacggtctgctctgcctactggtcgctgttca

SEQ ID NO: 31641 - DNA, 36 bp, Artificial Sequence
  Synthetic oligonucleotide
atcacgttcttacgtgatgcacatgcttatttttca

SEQ ID NO: 31642 - DNA, 36 bp, Artificial Sequence
  Synthetic oligonucleotide
gtgcgctccgtatcctgcattctccttgttttcaga

SEQ ID NO: 31643 - DNA, 37 bp, Artificial Sequence
  Synthetic oligonucleotide
gcacacgcattacaccatcctacgcgaaccttggcga

SEQ ID NO: 31644 - DNA, 37 bp, Artificial Sequence
  Synthetic oligonucleotide
acatcctccgcgtgcctttctatcaatgcccctagga

SEQ ID NO: 31645 - DNA, 35 bp, Artificial Sequence
  Synthetic oligonucleotide
tagatagggcgaaatgggtgcgggcatttggggga

SEQ ID NO: 31646 - DNA, 37 bp, Artificial Sequence
  Synthetic oligonucleotide
tgcatccatgaccgatagggccgccacacatctatga

SEQ ID NO: 31647 - DNA, 35 bp, Artificial Sequence
  Synthetic oligonucleotide
tatccccgtacgtgcttccaaatctcagcaacaac

SEQ ID NO: 31648 - DNA, 35 bp, Artificial Sequence
  Synthetic oligonucleotide
gaaccaccccctttggctcttcgtgcttttaacgc

SEQ ID NO: 31649 - DNA, 35 bp, Artificial Sequence
  Synthetic oligonucleotide
ccattacctgactgttattgtgagcccgcccacgc

SEQ ID NO: 31650 - DNA, 35 bp, Artificial Sequence
  Synthetic oligonucleotide
gagcgtccatgcccgtcaatccccccacgaatccg

SEQ ID NO: 31651 - DNA, 35 bp, Artificial Sequence
  Synthetic oligonucleotide
agcgggcacgggcgggcaggggttcttacaaattg

SEQ ID NO: 31652 - DNA, 35 bp, Artificial Sequence
  Synthetic oligonucleotide
tgacgatgctccacctaccttcctccattttccct

SEQ ID NO: 31653 - DNA, 35 bp, Artificial Sequence
  Synthetic oligonucleotide
gaaatgacgggggtcacggggggagggtacgtagt

SEQ ID NO: 31654 - DNA, 35 bp, Artificial Sequence
  Synthetic oligonucleotide
gaattcctgcatacacatctgtggtcctatccctt

SEQ ID NO: 31655 - DNA, 35 bp, Artificial Sequence
  Synthetic oligonucleotide
ccaccctagcctgttttgttctaaccatcattgtt

SEQ ID NO: 31656 - DNA, 36 bp, Artificial Sequence
  Synthetic oligonucleotide
aatggggagggtgtccggaaggccaaatggtcaaaa

SEQ ID NO: 31657 - DNA, 35 bp, Artificial Sequence
  Synthetic oligonucleotide
tgaccctgcccctgccccgaaggatttaaataaca

SEQ ID NO: 31658 - DNA, 35 bp, Artificial Sequence
  Synthetic oligonucleotide
acacccacccttcgctcgcgtgcgcaatagttaca

SEQ ID NO: 31659 - DNA, 37 bp, Artificial Sequence
  Synthetic oligonucleotide
gagtgccctttcacatctctctattttagtccgtaga

SEQ ID NO: 31660 - DNA, 37 bp, Artificial Sequence
  Synthetic oligonucleotide
gagtcaggtcatccccggttctatgctctcgtcccga

SEQ ID NO: 31661 - DNA, 36 bp, Artificial Sequence
  Synthetic oligonucleotide
gtgcgagagagccgttgtttcatgcctccttcccga

SEQ ID NO: 31662 - DNA, 38 bp, Artificial Sequence
  Synthetic oligonucleotide
gatggggagtgttcaagggagggggaggtggggcatga

SEQ ID NO: 31663 - DNA, 38 bp, Artificial Sequence
  Synthetic oligonucleotide
tcaaccaccggtacatctcgctttagaggacaacctga

SEQ ID NO: 31664 - DNA, 38 bp, Artificial Sequence
  Synthetic oligonucleotide
ggaatagggtgggacgggtttggtaggggttgtcttga

SEQ ID NO: 31665 - DNA, 35 bp, Artificial Sequence
  Synthetic oligonucleotide
tattgcctcagatacaaccgacccctttgtcccgc

SEQ ID NO: 31666 - DNA, 35 bp, Artificial Sequence
  Synthetic oligonucleotide
gttagaggtgggggcgcaaaagaggtcggagtggg

SEQ ID NO: 31667 - DNA, 35 bp, Artificial Sequence
  Synthetic oligonucleotide
gcttagcatcggcaaaaaccctgctgcttacccct

SEQ ID NO: 31668 - DNA, 35 bp, Artificial Sequence
  Synthetic oligonucleotide
ccacgccacccacctctagcaccaccggtcgtgct

SEQ ID NO: 31669 - DNA, 35 bp, Artificial Sequence
  Synthetic oligonucleotide
taaatccgcccataatgctctatcttgtcgtctct

SEQ ID NO: 31670 - DNA, 35 bp, Artificial Sequence
  Synthetic oligonucleotide
ttggaacccaggtcttgcgcatgggaccatccttt

SEQ ID NO: 31671 - DNA, 36 bp, Artificial Sequence
  Synthetic oligonucleotide
agcccaccacgactcccgtaccaccgaaggaccgaa

SEQ ID NO: 31672 - DNA, 36 bp, Artificial Sequence
  Synthetic oligonucleotide
tgccattgaaactgccatctaataacgttcgggaca

SEQ ID NO: 31673 - DNA, 36 bp, Artificial Sequence
  Synthetic oligonucleotide
tccacgatccagctgctcgtaccactggtgtctcca

SEQ ID NO: 31674 - DNA, 33 bp, Artificial Sequence
  Synthetic oligonucleotide
cgcctcaccgcaattatgttcatacttccctca

SEQ ID NO: 31675 - DNA, 37 bp, Artificial Sequence
  Synthetic oligonucleotide
gtgcgcttgattcgtccctgaccctcgcttcaccaga

SEQ ID NO: 31676 - DNA, 37 bp, Artificial Sequence
  Synthetic oligonucleotide
tttacctccccatcgtgcttgacgacacacgattaga

SEQ ID NO: 31677 - DNA, 37 bp, Artificial Sequence
  Synthetic oligonucleotide
tgtggggaaggaaggggcccgcgagtaggatattaga

SEQ ID NO: 31678 - DNA, 37 bp, Artificial Sequence
  Synthetic oligonucleotide
agccatcctactggctccaccccagacgcgatagcga

SEQ ID NO: 31679 - DNA, 38 bp, Artificial Sequence
  Synthetic oligonucleotide
gacatgagagcaaggggggggacattgtaactagggga

SEQ ID NO: 31680 - DNA, 36 bp, Artificial Sequence
  Synthetic oligonucleotide
gatcgcacacgaagggtgtttttcccgttgatccta

SEQ ID NO: 31681 - DNA, 36 bp, Artificial Sequence
  Synthetic oligonucleotide
acacatcctcgaagcatgacgaaactgaaaaccgta

SEQ ID NO: 31682 - DNA, 35 bp, Artificial Sequence
  Synthetic oligonucleotide
gaggttcagaccgccctctgcccctgcatcctgta

SEQ ID NO: 31683 - DNA, 36 bp, Artificial Sequence
  Synthetic oligonucleotide
atcgtcaaccgtggtgtcccctgttgttcctattta

SEQ ID NO: 31684 - DNA, 35 bp, Artificial Sequence
  Synthetic oligonucleotide
atcaggacaccacccagacaaagtgtttttgcacc

SEQ ID NO: 31685 - DNA, 35 bp, Artificial Sequence
  Synthetic oligonucleotide
gcgaatgcccatcgcgttctggatcaccaacagcc

SEQ ID NO: 31686 - DNA, 35 bp, Artificial Sequence
  Synthetic oligonucleotide
actcgaacactccgcgatggctatagcgctgttcc

SEQ ID NO: 31687 - DNA, 35 bp, Artificial Sequence
  Synthetic oligonucleotide
tctacactgaccgcctatcaccgggatctgcttgc

SEQ ID NO: 31688 - DNA, 35 bp, Artificial Sequence
  Synthetic oligonucleotide
atgatgatacgacaagcagtattgtcaatcctatc

SEQ ID NO: 31689 - DNA, 35 bp, Artificial Sequence
  Synthetic oligonucleotide
tttccactgcccctgttcctttgacctgcatggct

SEQ ID NO: 31690 - DNA, 35 bp, Artificial Sequence
  Synthetic oligonucleotide
gtgccccactgtgttctgccgatggtccggtatct

SEQ ID NO: 31691 - DNA, 37 bp, Artificial Sequence
  Synthetic oligonucleotide
tcacgtgctccctcagtaacatccatcaccgtggcga

SEQ ID NO: 31692 - DNA, 35 bp, Artificial Sequence
  Synthetic oligonucleotide
atgtcactactatcattctggccccacagtctcga

SEQ ID NO: 31693 - DNA, 37 bp, Artificial Sequence
  Synthetic oligonucleotide
gcgcctatggggcacggggggaataccggatggagga

SEQ ID NO: 31694 - DNA, 37 bp, Artificial Sequence
  Synthetic oligonucleotide
atcacgcattccattgtcttcaccacttctcaacgga

SEQ ID NO: 31695 - DNA, 36 bp, Artificial Sequence
  Synthetic oligonucleotide
atgcggacctccactttttagatttgcccacctgga

SEQ ID NO: 31696 - DNA, 38 bp, Artificial Sequence
  Synthetic oligonucleotide
tagtagcaccaactgcggttcccgaccttacctgctga

SEQ ID NO: 31697 - DNA, 38 bp, Artificial Sequence
  Synthetic oligonucleotide
agcgatgggtctgggggggtggggtcacggcacagtga

SEQ ID NO: 31698 - DNA, 37 bp, Artificial Sequence
  Synthetic oligonucleotide
tcattcacactccagacgtgcccccaacgtacattga

SEQ ID NO: 31699 - DNA, 36 bp, Artificial Sequence
  Synthetic oligonucleotide
gtgacgccttggcctgaaactgtcccccccttcata

SEQ ID NO: 31700 - DNA, 36 bp, Artificial Sequence
  Synthetic oligonucleotide
tcgaacgccccccatgtccggtatgtatctccagta

SEQ ID NO: 31701 - DNA, 35 bp, Artificial Sequence
  Synthetic oligonucleotide
acgcgctccggtttctgtccacccctcacagcggc

SEQ ID NO: 31702 - DNA, 32 bp, Artificial Sequence
  Synthetic oligonucleotide
ttatgccccgcgctgggtccattctgcatatc

SEQ ID NO: 31703 - DNA, 35 bp, Artificial Sequence
  Synthetic oligonucleotide
gtgcaccctcataaacacacccttactgttgtctc

SEQ ID NO: 31704 - DNA, 35 bp, Artificial Sequence
  Synthetic oligonucleotide
ttggcccccacgctattgatatcttcttttactgg

SEQ ID NO: 31705 - DNA, 35 bp, Artificial Sequence
  Synthetic oligonucleotide
tgcgccgggatcacgtctaagtcgtcgccccccct

SEQ ID NO: 31706 - DNA, 35 bp, Artificial Sequence
  Synthetic oligonucleotide
aaacaagccgtgggggtggaaaatacggcgagagt

SEQ ID NO: 31707 - DNA, 35 bp, Artificial Sequence
  Synthetic oligonucleotide
gtggtccgcgctgtgctttcgttagccaccacttt

SEQ ID NO: 31708 - DNA, 36 bp, Artificial Sequence
  Synthetic oligonucleotide
ttcccgttaactgccccctgccgactggctattcca

SEQ ID NO: 31709 - DNA, 35 bp, Artificial Sequence
  Synthetic oligonucleotide
agccctccatacaggtgcttccgttatgccactca

SEQ ID NO: 31710 - DNA, 35 bp, Artificial Sequence
  Synthetic oligonucleotide
tcatggcggagtcgcacctcgccacgttatgttca

SEQ ID NO: 31711 - DNA, 37 bp, Artificial Sequence
  Synthetic oligonucleotide
gccctatgctaacgactgcagccctccgcccccccga

SEQ ID NO: 31712 - DNA, 37 bp, Artificial Sequence
  Synthetic oligonucleotide
tgatgccacgatactccacgcctacttcgcgacgcga

SEQ ID NO: 31713 - DNA, 37 bp, Artificial Sequence
  Synthetic oligonucleotide
gtcaggttaccggtaggcaaggggtggcacgaaggga

SEQ ID NO: 31714 - DNA, 38 bp, Artificial Sequence
  Synthetic oligonucleotide
taatccccgccctcaaaagcgtcaccacccgtacatga

SEQ ID NO: 31715 - DNA, 38 bp, Artificial Sequence
  Synthetic oligonucleotide
gtcatgttaggtgggaaatgggtgaggggtggtgatga

SEQ ID NO: 31716 - DNA, 35 bp, Artificial Sequence
  Synthetic oligonucleotide
ttagcccccttctccaagagcaatgtccatgccta

SEQ ID NO: 31717 - DNA, 36 bp, Artificial Sequence
  Synthetic oligonucleotide
tcaaccgatcgccgggttttctatcatgcgctccta

SEQ ID NO: 31718 - DNA, 34 bp, Artificial Sequence
  Synthetic oligonucleotide
tgccctctcaccgaccctcctgtttgatttcatc

SEQ ID NO: 31719 - DNA, 35 bp, Artificial Sequence
  Synthetic oligonucleotide
atgatccaccgtatagcctgctagtttaccatatc

SEQ ID NO: 31720 - DNA, 35 bp, Artificial Sequence
  Synthetic oligonucleotide
ccatgggcctttccagttcacctattgcacctctc

SEQ ID NO: 31721 - DNA, 35 bp, Artificial Sequence
  Synthetic oligonucleotide
gcggttgtgaaggggtgggtagtcgggttgggtag

SEQ ID NO: 31722 - DNA, 35 bp, Artificial Sequence
  Synthetic oligonucleotide
aatgcgcaatccaaatgtagcactcatacctacct

SEQ ID NO: 31723 - DNA, 35 bp, Artificial Sequence
  Synthetic oligonucleotide
atcgcagcccctccggtctctggttatccatttct

SEQ ID NO: 31724 - DNA, 35 bp, Artificial Sequence
  Synthetic oligonucleotide
acgcaacgcctgtcatcgcactccactgtcatgtt

SEQ ID NO: 31725 - DNA, 37 bp, Artificial Sequence
  Synthetic oligonucleotide
tcatcgccatctacctttcgcagctctgtgctcgcaa

SEQ ID NO: 31726 - DNA, 36 bp, Artificial Sequence
  Synthetic oligonucleotide
ttccccgcccatgcctaataacgtatgttttattca

SEQ ID NO: 31727 - DNA, 35 bp, Artificial Sequence
  Synthetic oligonucleotide
tgtaccaccacgtcccgcaccatggccccggacga

SEQ ID NO: 31728 - DNA, 36 bp, Artificial Sequence
  Synthetic oligonucleotide
ataacgcaacgctccctacctctgccattcaaccga

SEQ ID NO: 31729 - DNA, 37 bp, Artificial Sequence
  Synthetic oligonucleotide
ccaccacggcagcctgcgacccgtccaccgcccccga

SEQ ID NO: 31730 - DNA, 34 bp, Artificial Sequence
  Synthetic oligonucleotide
accgttcctgcctcgcttaatgctttatactgga

SEQ ID NO: 31731 - DNA, 37 bp, Artificial Sequence
  Synthetic oligonucleotide
tcccacccccccgttctatgttacttccgtgagtgga

SEQ ID NO: 31732 - DNA, 37 bp, Artificial Sequence
  Synthetic oligonucleotide
gtgacgtgagtcaaaggaggggagagaggtaaaatga

SEQ ID NO: 31733 - DNA, 38 bp, Artificial Sequence
  Synthetic oligonucleotide
gtcctgccgacctgcattctaccgtactcccccactga

SEQ ID NO: 31734 - DNA, 38 bp, Artificial Sequence
  Synthetic oligonucleotide
acccatctcacataccgcactcactccgccgggactga

SEQ ID NO: 31735 - DNA, 38 bp, Artificial Sequence
  Synthetic oligonucleotide
aagtaggagaaggaggggcatgtctgagaccggagtga

SEQ ID NO: 31736 - DNA, 38 bp, Artificial Sequence
  Synthetic oligonucleotide
gacctgactcatcacttagcctctccgacacatcgtga

SEQ ID NO: 31737 - DNA, 35 bp, Artificial Sequence
  Synthetic oligonucleotide
gcaccttcatctatctgttcttagccccttcatta

SEQ ID NO: 31738 - DNA, 35 bp, Artificial Sequence
  Synthetic oligonucleotide
acgcactcctaagacgccgccttatgcacgcccac

SEQ ID NO: 31739 - DNA, 35 bp, Artificial Sequence
  Synthetic oligonucleotide
gccaccggcacggacattaccactgcaccttaatc

SEQ ID NO: 31740 - DNA, 35 bp, Artificial Sequence
  Synthetic oligonucleotide
agtggaccgggaatggaggtttagggatgggcacg

SEQ ID NO: 31741 - DNA, 35 bp, Artificial Sequence
  Synthetic oligonucleotide
taaccatcagtccgcttatacttcctccctctgcg

SEQ ID NO: 31742 - DNA, 35 bp, Artificial Sequence
  Synthetic oligonucleotide
gtggacccccgacagacgtacgctgtgcctcctcg

SEQ ID NO: 31743 - DNA, 35 bp, Artificial Sequence
  Synthetic oligonucleotide
aacccgatcatgtagtcgctctgcctgggctctct

SEQ ID NO: 31744 - DNA, 35 bp, Artificial Sequence
  Synthetic oligonucleotide
ggacccgcttttctgctatcttactgagcttcgtt

SEQ ID NO: 31745 - DNA, 37 bp, Artificial Sequence
  Synthetic oligonucleotide
gacaccctgaaatcccgcatgtgcctgtcaatcaaga

SEQ ID NO: 31746 - DNA, 37 bp, Artificial Sequence
  Synthetic oligonucleotide
gcacccgccgaattccaccagctgctcgtgttgcaga

SEQ ID NO: 31747 - DNA, 37 bp, Artificial Sequence
  Synthetic oligonucleotide
attgacctcgtcctactgccttgcaccttctcgccga

SEQ ID NO: 31748 - DNA, 37 bp, Artificial Sequence
  Synthetic oligonucleotide
gatcgcgagtggttgctggggcgggaggaggatttga

SEQ ID NO: 31749 - DNA, 36 bp, Artificial Sequence
  Synthetic oligonucleotide
gtcattcacccggacgctgatttccccacaagccta

SEQ ID NO: 31750 - DNA, 36 bp, Artificial Sequence
  Synthetic oligonucleotide
gccacacccggtgccgtgccctctgacgtaggctta

SEQ ID NO: 31751 - DNA, 35 bp, Artificial Sequence
  Synthetic oligonucleotide
tccgcgatttcatgctccactcctcagttcgggac

SEQ ID NO: 31752 - DNA, 35 bp, Artificial Sequence
  Synthetic oligonucleotide
acgtgaccatactccgtcccgccactttcccacgc

SEQ ID NO: 31753 - DNA, 35 bp, Artificial Sequence
  Synthetic oligonucleotide
gtgtgccctatgtctcctattgcatgtaactattc

SEQ ID NO: 31754 - DNA, 35 bp, Artificial Sequence
  Synthetic oligonucleotide
gcgcgcccgccacgttcttaatatgttccgccccg

SEQ ID NO: 31755 - DNA, 33 bp, Artificial Sequence
  Synthetic oligonucleotide
atggagcaaggggggtgccgggggtgtgaaggg

SEQ ID NO: 31756 - DNA, 35 bp, Artificial Sequence
  Synthetic oligonucleotide
tggtcacgggagtatggggaaataaaaatggcggg

SEQ ID NO: 31757 - DNA, 35 bp, Artificial Sequence
  Synthetic oligonucleotide
gtactgtgtgcccgccgccttttaaatctgctctg

SEQ ID NO: 31758 - DNA, 35 bp, Artificial Sequence
  Synthetic oligonucleotide
gcttgatccccccagccggtctcacggacattttg

SEQ ID NO: 31759 - DNA, 36 bp, Artificial Sequence
  Synthetic oligonucleotide
accgccacccggccagagcgctatcatcccgccaca

SEQ ID NO: 31760 - DNA, 36 bp, Artificial Sequence
  Synthetic oligonucleotide
gaccacacattgcctcaaaggttattgatttctcca

SEQ ID NO: 31761 - DNA, 36 bp, Artificial Sequence
  Synthetic oligonucleotide
gatctgctcccttacgaccctggtgccctgattcca

SEQ ID NO: 31762 - DNA, 35 bp, Artificial Sequence
  Synthetic oligonucleotide
ttgatcagcactgttccactagggccattcactca

SEQ ID NO: 31763 - DNA, 37 bp, Artificial Sequence
  Synthetic oligonucleotide
acacagccggggagtttggctaggaggtggagaaaga

SEQ ID NO: 31764 - DNA, 36 bp, Artificial Sequence
  Synthetic oligonucleotide
aagaacaggaggaaaaggaaaacgtaaactgtgaga

SEQ ID NO: 31765 - DNA, 36 bp, Artificial Sequence
  Synthetic oligonucleotide
gaaaggaacgagcggttacggggctggtctttggga

SEQ ID NO: 31766 - DNA, 38 bp, Artificial Sequence
  Synthetic oligonucleotide
tccactggaagtagcgcgcttgccctgaacctgcatga

SEQ ID NO: 31767 - DNA, 35 bp, Artificial Sequence
  Synthetic oligonucleotide
gcccctcgaacattctttcctacatgtcaccctga

SEQ ID NO: 31768 - DNA, 37 bp, Artificial Sequence
  Synthetic oligonucleotide
attccggccgtatggttctccgcttgttactgcctga

SEQ ID NO: 31769 - DNA, 35 bp, Artificial Sequence
  Synthetic oligonucleotide
gagggcgacccgccggggtggtggaggtgggagta

SEQ ID NO: 31770 - DNA, 35 bp, Artificial Sequence
  Synthetic oligonucleotide
gtacgctgccacgcactttcgttttttgcaccgta

SEQ ID NO: 31771 - DNA, 36 bp, Artificial Sequence
  Synthetic oligonucleotide
agcgacccgccccctccctggcacctccctccggta

SEQ ID NO: 31772 - DNA, 35 bp, Artificial Sequence
  Synthetic oligonucleotide
gcaaccttaggcctagcccgtagcccccgcaccac

SEQ ID NO: 31773 - DNA, 35 bp, Artificial Sequence
  Synthetic oligonucleotide
tctacaggggggggatgggtcacctgcggggatac

SEQ ID NO: 31774 - DNA, 35 bp, Artificial Sequence
  Synthetic oligonucleotide
tctaggccgcatgtaattcctcccgcgtgcccccc

SEQ ID NO: 31775 - DNA, 35 bp, Artificial Sequence
  Synthetic oligonucleotide
attgccgacccactagtgacgctggagtcacctgc

SEQ ID NO: 31776 - DNA, 35 bp, Artificial Sequence
  Synthetic oligonucleotide
tctacagatcatgcttcccgcacctccgattcccg

SEQ ID NO: 31777 - DNA, 35 bp, Artificial Sequence
  Synthetic oligonucleotide
tctactcatcgtgcctactctggtgcctttttccg

SEQ ID NO: 31778 - DNA, 35 bp, Artificial Sequence
  Synthetic oligonucleotide
atcacacggccgttgcgtctggctcgatccatcat

SEQ ID NO: 31779 - DNA, 35 bp, Artificial Sequence
  Synthetic oligonucleotide
acccgcaagccgatcaacacccacatatatgccct

SEQ ID NO: 31780 - DNA, 35 bp, Artificial Sequence
  Synthetic oligonucleotide
gtgacgggctggttatttgcggaagcccatctctt

SEQ ID NO: 31781 - DNA, 36 bp, Artificial Sequence
  Synthetic oligonucleotide
actaaccgccgtagcgcgaattcttttacaccgaaa

SEQ ID NO: 31782 - DNA, 36 bp, Artificial Sequence
  Synthetic oligonucleotide
gcgccccctgcgctggtacacatgttctcccgccaa

SEQ ID NO: 31783 - DNA, 36 bp, Artificial Sequence
  Synthetic oligonucleotide
tagctggaacgtgggggggaggatgcacgcgggaca

SEQ ID NO: 31784 - DNA, 38 bp, Artificial Sequence
  Synthetic oligonucleotide
tccccgccccatttgtcgcattccgttgtattccttga

SEQ ID NO: 31785 - DNA, 38 bp, Artificial Sequence
  Synthetic oligonucleotide
tcacccaacccacgagttcgcctctgtcaagtttttga

SEQ ID NO: 31786 - DNA, 35 bp, Artificial Sequence
  Synthetic oligonucleotide
tgttaccaatatctgcacgtaggcctccgtcccac

SEQ ID NO: 31787 - DNA, 35 bp, Artificial Sequence
  Synthetic oligonucleotide
agactacgcggcacttcttttcacacattacgcac

SEQ ID NO: 31788 - DNA, 35 bp, Artificial Sequence
  Synthetic oligonucleotide
atcctcaccaccaacacgcgtcttcaggctgatac

SEQ ID NO: 31789 - DNA, 35 bp, Artificial Sequence
  Synthetic oligonucleotide
gacgctatgttacccccatcgtttgcggtccatcc

SEQ ID NO: 31790 - DNA, 35 bp, Artificial Sequence
  Synthetic oligonucleotide
gtcagtctcctgtgacctttaactagccctcttcc

SEQ ID NO: 31791 - DNA, 35 bp, Artificial Sequence
  Synthetic oligonucleotide
atgtctctacacccgtttgccccgttagacagtgc

SEQ ID NO: 31792 - DNA, 36 bp, Artificial Sequence
  Synthetic oligonucleotide
aagtactgggaggggaatgtttaaatgtgtgaggcg

SEQ ID NO: 31793 - DNA, 35 bp, Artificial Sequence
  Synthetic oligonucleotide
gacaagccacaatccacagctctcgcctttattcg

SEQ ID NO: 31794 - DNA, 35 bp, Artificial Sequence
  Synthetic oligonucleotide
gactgaactggaaggtggtgtagagatgaatgggg

SEQ ID NO: 31795 - DNA, 35 bp, Artificial Sequence
  Synthetic oligonucleotide
ttgtcccatgcttcaccagcacctccatctttatg

SEQ ID NO: 31796 - DNA, 35 bp, Artificial Sequence
  Synthetic oligonucleotide
atcaccctcagcatttaccctaaccttcatccagt

SEQ ID NO: 31797 - DNA, 35 bp, Artificial Sequence
  Synthetic oligonucleotide
ttctacgtcttcacatctccagtcaccgccccgtt

SEQ ID NO: 31798 - DNA, 36 bp, Artificial Sequence
  Synthetic oligonucleotide
gtcgagaggggagggcgtaggggataaagtgcaaaa

SEQ ID NO: 31799 - DNA, 36 bp, Artificial Sequence
  Synthetic oligonucleotide
gacacgggaaatcggagaagcgaagagggggtacca

SEQ ID NO: 31800 - DNA, 35 bp, Artificial Sequence
  Synthetic oligonucleotide
ggttgtcgaccgtcctgcatcgatacaccacccca

SEQ ID NO: 31801 - DNA, 36 bp, Artificial Sequence
  Synthetic oligonucleotide
acctcaacgccgctccccgtttcgaagcccgatgca

SEQ ID NO: 31802 - DNA, 36 bp, Artificial Sequence
  Synthetic oligonucleotide
gtacctccatcctccattattgggaacagattctca

SEQ ID NO: 31803 - DNA, 37 bp, Artificial Sequence
  Synthetic oligonucleotide
taacctgtcccttctgtacttcgcacaacctccaaga

SEQ ID NO: 31804 - DNA, 35 bp, Artificial Sequence
  Synthetic oligonucleotide
tgaagtaggtgagggatggtagatgggaggttaga

SEQ ID NO: 31805 - DNA, 36 bp, Artificial Sequence
  Synthetic oligonucleotide
tccaacattctgccacatcccgtcccgcgtccgcga

SEQ ID NO: 31806 - DNA, 37 bp, Artificial Sequence
  Synthetic oligonucleotide
tccctagacagtgaattcacacccgccccccgctcga

SEQ ID NO: 31807 - DNA, 37 bp, Artificial Sequence
  Synthetic oligonucleotide
attgcaagggagagccggtaagggacgggtatgggga

SEQ ID NO: 31808 - DNA, 37 bp, Artificial Sequence
  Synthetic oligonucleotide
tctagctcagtgcctttccgtcaatgtacgctcctga

SEQ ID NO: 31809 - DNA, 38 bp, Artificial Sequence
  Synthetic oligonucleotide
accatccccttccagtaagtctgttcgagccttgctga

SEQ ID NO: 31810 - DNA, 38 bp, Artificial Sequence
  Synthetic oligonucleotide
gggggtgagggaggaggccggaagtgacaagttggtga

SEQ ID NO: 31811 - DNA, 37 bp, Artificial Sequence
  Synthetic oligonucleotide
gatggggggaggggggacaacaaagggtgttatgtga

SEQ ID NO: 31812 - DNA, 36 bp, Artificial Sequence
  Synthetic oligonucleotide
ttgatcagccccagcccttcactgtacacatttcta

SEQ ID NO: 31813 - DNA, 36 bp, Artificial Sequence
  Synthetic oligonucleotide
tatggcatcatctagcctgcctctttgactcacgta

SEQ ID NO: 31814 - DNA, 35 bp, Artificial Sequence
  Synthetic oligonucleotide
attgtcgatccaggcatccgcaaccctcacccacc

SEQ ID NO: 31815 - DNA, 35 bp, Artificial Sequence
  Synthetic oligonucleotide
atcccgctgttccttcgctgcctgtcatccgaccc

SEQ ID NO: 31816 - DNA, 35 bp, Artificial Sequence
  Synthetic oligonucleotide
gaccacaaacgtctaggtccttttgaagctgttcc

SEQ ID NO: 31817 - DNA, 35 bp, Artificial Sequence
  Synthetic oligonucleotide
tagtgagggggaccaattggtggagaaggccattc

SEQ ID NO: 31818 - DNA, 35 bp, Artificial Sequence
  Synthetic oligonucleotide
ttgcaccatcactacacaacgcttgtcccagcagg

SEQ ID NO: 31819 - DNA, 35 bp, Artificial Sequence
  Synthetic oligonucleotide
gctaacacctctatgatctgctacacttaaacgtg

SEQ ID NO: 31820 - DNA, 35 bp, Artificial Sequence
  Synthetic oligonucleotide
cacatcccggcctcccgagccccgcaccatctttg

SEQ ID NO: 31821 - DNA, 35 bp, Artificial Sequence
  Synthetic oligonucleotide
gctccactaacatgtcccttcgcgcatagcccagt

SEQ ID NO: 31822 - DNA, 35 bp, Artificial Sequence
  Synthetic oligonucleotide
gtgtcgcgcgctgattcacccaccatcgttttgtt

SEQ ID NO: 31823 - DNA, 36 bp, Artificial Sequence
  Synthetic oligonucleotide
tccgtactccgcacaagttcctcgcgtgactcctaa

SEQ ID NO: 31824 - DNA, 35 bp, Artificial Sequence
  Synthetic oligonucleotide
tctacccctgccgaatgagcgtaccgggcttttaa

SEQ ID NO: 31825 - DNA, 36 bp, Artificial Sequence
  Synthetic oligonucleotide
aatcatccgggcgcacctcctgtcctcatcaatgca

SEQ ID NO: 31826 - DNA, 37 bp, Artificial Sequence
  Synthetic oligonucleotide
atacgactcagcctacgtccaatcactgttctatcga

SEQ ID NO: 31827 - DNA, 37 bp, Artificial Sequence
  Synthetic oligonucleotide
accaaccgacaagtggtggcagccccttactactcga

SEQ ID NO: 31828 - DNA, 37 bp, Artificial Sequence
  Synthetic oligonucleotide
tgttccagcccgccttcgcctacagctagtacttcga

SEQ ID NO: 31829 - DNA, 37 bp, Artificial Sequence
  Synthetic oligonucleotide
tcccccttcccaccggactgctgactgtctccaatga

SEQ ID NO: 31830 - DNA, 38 bp, Artificial Sequence
  Synthetic oligonucleotide
gccaccggcgtggggtgcaagcgggagggaactaatga

SEQ ID NO: 31831 - DNA, 38 bp, Artificial Sequence
  Synthetic oligonucleotide
accggacggggtacggtacgctaacatccacttcatga

SEQ ID NO: 31832 - DNA, 38 bp, Artificial Sequence
  Synthetic oligonucleotide
tttccaccgctcctatcctaccgcgacaccgcccctga

SEQ ID NO: 31833 - DNA, 38 bp, Artificial Sequence
  Synthetic oligonucleotide
gaggtccaccccactgctttacactccactgacagtga

SEQ ID NO: 31834 - DNA, 38 bp, Artificial Sequence
  Synthetic oligonucleotide
atcgaacgttctccatctgcgttttctacttggcttga

SEQ ID NO: 31835 - DNA, 37 bp, Artificial Sequence
  Synthetic oligonucleotide
gaaccggtgggggtggaaacaatggcatgtcgtttga

SEQ ID NO: 31836 - DNA, 35 bp, Artificial Sequence
  Synthetic oligonucleotide
tccgcccgccatgccgcatatgccaacatgccata

SEQ ID NO: 31837 - DNA, 36 bp, Artificial Sequence
  Synthetic oligonucleotide
gcacccgcaagctgtccgccacccattcctgcgcta

SEQ ID NO: 31838 - DNA, 35 bp, Artificial Sequence
  Synthetic oligonucleotide
agagcactgaaccagttttccctcgctttcgtacc

SEQ ID NO: 31839 - DNA, 35 bp, Artificial Sequence
  Synthetic oligonucleotide
atgcacccaaccttcatgtcaaagccacccacccc

SEQ ID NO: 31840 - DNA, 35 bp, Artificial Sequence
  Synthetic oligonucleotide
gccctgactaggatggctttgtccgcgccctgccc

SEQ ID NO: 31841 - DNA, 35 bp, Artificial Sequence
  Synthetic oligonucleotide
acatcccgatccgttagttcctcactgctggcgcc

SEQ ID NO: 31842 - DNA, 35 bp, Artificial Sequence
  Synthetic oligonucleotide
tcattcgcttgcaactggctcatctccgctcaatc

SEQ ID NO: 31843 - DNA, 35 bp, Artificial Sequence
  Synthetic oligonucleotide
ttgcacgtgctctctcgattccgatccgtgttatc

SEQ ID NO: 31844 - DNA, 35 bp, Artificial Sequence
  Synthetic oligonucleotide
gagcctcctcacggcgatcctacatgatccaacct

SEQ ID NO: 31845 - DNA, 35 bp, Artificial Sequence
  Synthetic oligonucleotide
gtgcaagggcgcctatttggtccggtccttcctct

SEQ ID NO: 31846 - DNA, 35 bp, Artificial Sequence
  Synthetic oligonucleotide
gccgccgctcccgatcacctgccctggggcattct

SEQ ID NO: 31847 - DNA, 35 bp, Artificial Sequence
  Synthetic oligonucleotide
tgctacgaccggttacctgttactttatggccatt

SEQ ID NO: 31848 - DNA, 35 bp, Artificial Sequence
  Synthetic oligonucleotide
actgcaaggctcctgcggactcccttttcatcctt

SEQ ID NO: 31849 - DNA, 37 bp, Artificial Sequence
  Synthetic oligonucleotide
actccgcacgccctatctcacaaatcatcttggtaga

SEQ ID NO: 31850 - DNA, 37 bp, Artificial Sequence
  Synthetic oligonucleotide
gcacccttgctccacacccttgtattatcgtcgtcga

SEQ ID NO: 31851 - DNA, 37 bp, Artificial Sequence
  Synthetic oligonucleotide
gagggactgtagagctggcacagggaggtaggaggga

SEQ ID NO: 31852 - DNA, 37 bp, Artificial Sequence
  Synthetic oligonucleotide
agacatgaggcgggaacggggggcatgacgctaggga

SEQ ID NO: 31853 - DNA, 35 bp, Artificial Sequence
  Synthetic oligonucleotide
ttccgccccaaattcatctgctcatccttgcggga

SEQ ID NO: 31854 - DNA, 37 bp, Artificial Sequence
  Synthetic oligonucleotide
tacgacccatccgctccttaaaagacctggtcctgga

SEQ ID NO: 31855 - DNA, 35 bp, Artificial Sequence
  Synthetic oligonucleotide
tcctactcgccccatgattcatttctagacttgga

SEQ ID NO: 31856 - DNA, 38 bp, Artificial Sequence
  Synthetic oligonucleotide
gcacagcatcggcgacttaccctccctctcactgctga

SEQ ID NO: 31857 - DNA, 38 bp, Artificial Sequence
  Synthetic oligonucleotide
ttccacctcaactctgcttctacctactgtgctcgtga

SEQ ID NO: 31858 - DNA, 38 bp, Artificial Sequence
  Synthetic oligonucleotide
aattacccgccctttgctccgacctcccccaggggtga

SEQ ID NO: 31859 - DNA, 36 bp, Artificial Sequence
  Synthetic oligonucleotide
ttgggcgcagttttgcaatcgctaccgtcctgccta

SEQ ID NO: 31860 - DNA, 35 bp, Artificial Sequence
  Synthetic oligonucleotide
gcaccaatgacccagattcggtttcccccgttgta

SEQ ID NO: 31861 - DNA, 35 bp, Artificial Sequence
  Synthetic oligonucleotide
gctcacccccacatttgtaggcctatccgggacac

SEQ ID NO: 31862 - DNA, 35 bp, Artificial Sequence
  Synthetic oligonucleotide
agcccccactgcgattttacccgttctaggtcgac

SEQ ID NO: 31863 - DNA, 35 bp, Artificial Sequence
  Synthetic oligonucleotide
tgattgctagagcctaagaccaccgcaccattacc

SEQ ID NO: 31864 - DNA, 35 bp, Artificial Sequence
  Synthetic oligonucleotide
tgctctctgcggttcgacatcccccgttagttgcc

SEQ ID NO: 31865 - DNA, 35 bp, Artificial Sequence
  Synthetic oligonucleotide
gatgtcctgcgaggctctcttggttccagcccctc

SEQ ID NO: 31866 - DNA, 35 bp, Artificial Sequence
  Synthetic oligonucleotide
tatgcatggacaaacaagtgaataggtggtggcat

SEQ ID NO: 31867 - DNA, 35 bp, Artificial Sequence
  Synthetic oligonucleotide
agcctgtgcatcccaagccacacatttgttccgtt

SEQ ID NO: 31868 - DNA, 36 bp, Artificial Sequence
  Synthetic oligonucleotide
gaggggtaagagggaagagggtaaggggctcaggaa

SEQ ID NO: 31869 - DNA, 35 bp, Artificial Sequence
  Synthetic oligonucleotide
gacggggggagggggtggctagcatacagggctaa

SEQ ID NO: 31870 - DNA, 36 bp, Artificial Sequence
  Synthetic oligonucleotide
tagggcaatctatcggggagggacgggcggtcgaca

SEQ ID NO: 31871 - DNA, 34 bp, Artificial Sequence
  Synthetic oligonucleotide
tgacacctgtatctcgcccacttgcagacgccca

SEQ ID NO: 31872 - DNA, 36 bp, Artificial Sequence
  Synthetic oligonucleotide
gaaccaggttcgcagccgcacataacctttatatca

SEQ ID NO: 31873 - DNA, 37 bp, Artificial Sequence
  Synthetic oligonucleotide
tgttgcctcctcccgattttgactgctggccttgaga

SEQ ID NO: 31874 - DNA, 37 bp, Artificial Sequence
  Synthetic oligonucleotide
gccaccgttattggcctctggtaatacgtccccccga

SEQ ID NO: 31875 - DNA, 37 bp, Artificial Sequence
  Synthetic oligonucleotide
agtgcccacccccgcgccgtacttttttgccatctga

SEQ ID NO: 31876 - DNA, 35 bp, Artificial Sequence
  Synthetic oligonucleotide
gccactcacgggtttcggcggtcctcctactctac

SEQ ID NO: 31877 - DNA, 35 bp, Artificial Sequence
  Synthetic oligonucleotide
gaagtcgaaggcgcgttactcatccctccgtaccc

SEQ ID NO: 31878 - DNA, 35 bp, Artificial Sequence
  Synthetic oligonucleotide
aagattcaccgcctgctatcctggcaagctaccgc

SEQ ID NO: 31879 - DNA, 35 bp, Artificial Sequence
  Synthetic oligonucleotide
accatacacgcgctctggatgcctactccttactc

SEQ ID NO: 31880 - DNA, 35 bp, Artificial Sequence
  Synthetic oligonucleotide
tctgaacgcacgtagtctgctcattccttctcttc

SEQ ID NO: 31881 - DNA, 35 bp, Artificial Sequence
  Synthetic oligonucleotide
gtaaacatgggtggagcgggtcaccgggagaaaag

SEQ ID NO: 31882 - DNA, 35 bp, Artificial Sequence
  Synthetic oligonucleotide
gtaggggaacgagaaaaaaggtaagaacagggaag

SEQ ID NO: 31883 - DNA, 35 bp, Artificial Sequence
  Synthetic oligonucleotide
gtaacggcaacttttgcatccctggccactcctag

SEQ ID NO: 31884 - DNA, 34 bp, Artificial Sequence
  Synthetic oligonucleotide
taatcggggcaggaggacaattgcgggagggagg

SEQ ID NO: 31885 - DNA, 35 bp, Artificial Sequence
  Synthetic oligonucleotide
tcgttcaaccagcactttgtaaactccccacctgg

SEQ ID NO: 31886 - DNA, 35 bp, Artificial Sequence
  Synthetic oligonucleotide
gcacaggacagtggggaagtaacaataggggaagt

SEQ ID NO: 31887 - DNA, 35 bp, Artificial Sequence
  Synthetic oligonucleotide
tatgggaaggggggcagtcctagaacaggtgaatt

SEQ ID NO: 31888 - DNA, 35 bp, Artificial Sequence
  Synthetic oligonucleotide
gaaagggcgtggaattggaaagggggtaagtcatt

SEQ ID NO: 31889 - DNA, 35 bp, Artificial Sequence
  Synthetic oligonucleotide
ttgagtagcgctatcgtcgcactgccgtatttctt

SEQ ID NO: 31890 - DNA, 36 bp, Artificial Sequence
  Synthetic oligonucleotide
tctaatggaggagggaatgggatgaggggtcgggaa

SEQ ID NO: 31891 - DNA, 36 bp, Artificial Sequence
  Synthetic oligonucleotide
agaggacggggaggggaaaggtttgaagaaggtaca

SEQ ID NO: 31892 - DNA, 35 bp, Artificial Sequence
  Synthetic oligonucleotide
tacgccccgggcttacagccgttcaatacacacca

SEQ ID NO: 31893 - DNA, 35 bp, Artificial Sequence
  Synthetic oligonucleotide
agcccgaccaatcgtcattaatgcggaccccccca

SEQ ID NO: 31894 - DNA, 36 bp, Artificial Sequence
  Synthetic oligonucleotide
tgctctgcccttgcccttgccctcgagccggttcca

SEQ ID NO: 31895 - DNA, 37 bp, Artificial Sequence
  Synthetic oligonucleotide
tgagagggaatatgggaaaagcggaattggcgacgga

SEQ ID NO: 31896 - DNA, 36 bp, Artificial Sequence
  Synthetic oligonucleotide
tacctgattagctctggactacgacccactcccgga

SEQ ID NO: 31897 - DNA, 36 bp, Artificial Sequence
  Synthetic oligonucleotide
gacccaaagaaagcggaaaggaactgacgggcggga

SEQ ID NO: 31898 - DNA, 37 bp, Artificial Sequence
  Synthetic oligonucleotide
atcggggccgtcatttcttggccctccctcacatgga

SEQ ID NO: 31899 - DNA, 38 bp, Artificial Sequence
  Synthetic oligonucleotide
tgagagggggctggggtgtgggcgcagcatagacatga

SEQ ID NO: 31900 - DNA, 38 bp, Artificial Sequence
  Synthetic oligonucleotide
tgtccactagcagagtaggccatcttaatccatcttga

SEQ ID NO: 31901 - DNA, 38 bp, Artificial Sequence
  Synthetic oligonucleotide
gcatgtgggtgcacgggggaaacggaatggccagttga

SEQ ID NO: 31902 - DNA, 36 bp, Artificial Sequence
  Synthetic oligonucleotide
acacacccccttcgatgtatccaggtcttgacctta

SEQ ID NO: 31903 - DNA, 36 bp, Artificial Sequence
  Synthetic oligonucleotide
attgtcacccttacattgttgagcgcaccaggctta

SEQ ID NO: 31904 - DNA, 35 bp, Artificial Sequence
  Synthetic oligonucleotide
atcatgttaggtgggtaccaccggacctttctcac

SEQ ID NO: 31905 - DNA, 35 bp, Artificial Sequence
  Synthetic oligonucleotide
tggtgagggccgcctgtctcattatcttggtcacc

SEQ ID NO: 31906 - DNA, 35 bp, Artificial Sequence
  Synthetic oligonucleotide
tgcgtacgcactgagcgatacatcccgaacgcatc

SEQ ID NO: 31907 - DNA, 36 bp, Artificial Sequence
  Synthetic oligonucleotide
ggattgcaccgccctgaactttttctactttacaaa

SEQ ID NO: 31908 - DNA, 35 bp, Artificial Sequence
  Synthetic oligonucleotide
atccgactctgactatgtcttcctctaccacatca

SEQ ID NO: 31909 - DNA, 36 bp, Artificial Sequence
  Synthetic oligonucleotide
gaatacgtcgcctgcaccgctcaccaccaccattca

SEQ ID NO: 31910 - DNA, 37 bp, Artificial Sequence
  Synthetic oligonucleotide
agtgtgggaagggtgggaggcaggcacaggaccgaga

SEQ ID NO: 31911 - DNA, 36 bp, Artificial Sequence
  Synthetic oligonucleotide
tagtcccgcctaacttttgccttcgcttatcgacga

SEQ ID NO: 31912 - DNA, 37 bp, Artificial Sequence
  Synthetic oligonucleotide
tcattccgacactatgcacgcactgttctcatcatga

SEQ ID NO: 31913 - DNA, 37 bp, Artificial Sequence
  Synthetic oligonucleotide
gacccatgcccacagtgaatgcccgatcctgccctga

SEQ ID NO: 31914 - DNA, 38 bp, Artificial Sequence
  Synthetic oligonucleotide
acgtaggtcatcgggaagaagggggggctagtgggtga

SEQ ID NO: 31915 - DNA, 38 bp, Artificial Sequence
  Synthetic oligonucleotide
atatggtgcgggaagagagggagcatcgcgcagattga

SEQ ID NO: 31916 - DNA, 38 bp, Artificial Sequence
  Synthetic oligonucleotide
accccccttgaccttacccgcactgacagtttgattga

SEQ ID NO: 31917 - DNA, 36 bp, Artificial Sequence
  Synthetic oligonucleotide
actgcccacgcgctctaccgccccgtttagtctcta

SEQ ID NO: 31918 - DNA, 34 bp, Artificial Sequence
  Synthetic oligonucleotide
ttgtcctgaccttaccctgcttggagccaccgta

SEQ ID NO: 31919 - DNA, 36 bp, Artificial Sequence
  Synthetic oligonucleotide
gcacagacaatggattagggtcgggggagtcgggta

SEQ ID NO: 31920 - DNA, 35 bp, Artificial Sequence
  Synthetic oligonucleotide
gacaaccacctaagcccgcccgcctggagtttcac

SEQ ID NO: 31921 - DNA, 35 bp, Artificial Sequence
  Synthetic oligonucleotide
gtgactccgacaagaaccctgttagtttttccacc

SEQ ID NO: 31922 - DNA, 35 bp, Artificial Sequence
  Synthetic oligonucleotide
tatacccctcatggcctccccgtaccgcgggcgcc

SEQ ID NO: 31923 - DNA, 35 bp, Artificial Sequence
  Synthetic oligonucleotide
aatccccacccaagcctccgcctgatgaattcacg

SEQ ID NO: 31924 - DNA, 35 bp, Artificial Sequence
  Synthetic oligonucleotide
tgaatgggagcaaaggatagcgggcaaggtaaagg

SEQ ID NO: 31925 - DNA, 35 bp, Artificial Sequence
  Synthetic oligonucleotide
acttacttgcatccaccgacgaccctgctaccggg

SEQ ID NO: 31926 - DNA, 35 bp, Artificial Sequence
  Synthetic oligonucleotide
attgcccaagtgctgaacctggccataatgtaaat

SEQ ID NO: 31927 - DNA, 35 bp, Artificial Sequence
  Synthetic oligonucleotide
tacacatttgatgcctttgtgatccaatccgccct

SEQ ID NO: 31928 - DNA, 37 bp, Artificial Sequence
  Synthetic oligonucleotide
accccctcgttaccctgtcgttatactttttgctaga

SEQ ID NO: 31929 - DNA, 37 bp, Artificial Sequence
  Synthetic oligonucleotide
tccagatccgcaatgccgccgattccatcctcttaga

SEQ ID NO: 31930 - DNA, 37 bp, Artificial Sequence
  Synthetic oligonucleotide
gatgcgcctcggtccagaaccgcattatccctgccga

SEQ ID NO: 31931 - DNA, 38 bp, Artificial Sequence
  Synthetic oligonucleotide
tcacctcccgtttgcactgctcatagtgcctatcatga

SEQ ID NO: 31932 - DNA, 37 bp, Artificial Sequence
  Synthetic oligonucleotide
tacgaggcctgttctttgaattttcgccaccccgtga

SEQ ID NO: 31933 - DNA, 37 bp, Artificial Sequence
  Synthetic oligonucleotide
gattggcaatcgtccattgattccattgcccttttga

SEQ ID NO: 31934 - DNA, 35 bp, Artificial Sequence
  Synthetic oligonucleotide
tgctcaacccacggactctattaaatgcgatgcta

SEQ ID NO: 31935 - DNA, 35 bp, Artificial Sequence
  Synthetic oligonucleotide
gatacacctcttgattgtgcacacatttagtccac

SEQ ID NO: 31936 - DNA, 35 bp, Artificial Sequence
  Synthetic oligonucleotide
ggagcctccggtacgtttcatttactcgccacacc

SEQ ID NO: 31937 - DNA, 35 bp, Artificial Sequence
  Synthetic oligonucleotide
attcatttcagccctccatactgcttaacaggtcc

SEQ ID NO: 31938 - DNA, 35 bp, Artificial Sequence
  Synthetic oligonucleotide
gtgaccacttgattcgttcgagcccgctacaccgc

SEQ ID NO: 31939 - DNA, 35 bp, Artificial Sequence
  Synthetic oligonucleotide
atccagtcaccctcttggttttcgtatacacccgc

SEQ ID NO: 31940 - DNA, 35 bp, Artificial Sequence
  Synthetic oligonucleotide
actgcgacaagatgtcgttacctcccactgtgttc

SEQ ID NO: 31941 - DNA, 35 bp, Artificial Sequence
  Synthetic oligonucleotide
ggtgggaggggactgaataatggtaggccttttag

SEQ ID NO: 31942 - DNA, 35 bp, Artificial Sequence
  Synthetic oligonucleotide
ccgacgcccacttccgcacctgccgctcctgtacg

SEQ ID NO: 31943 - DNA, 35 bp, Artificial Sequence
  Synthetic oligonucleotide
tgtagcagtgcccacatcctacacactcatctgct

SEQ ID NO: 31944 - DNA, 35 bp, Artificial Sequence
  Synthetic oligonucleotide
ttgcgagtgtgcactactatctccatttgctctct

SEQ ID NO: 31945 - DNA, 35 bp, Artificial Sequence
  Synthetic oligonucleotide
gcgatggacgcacgggagcggaaaaatacctttgt

SEQ ID NO: 31946 - DNA, 36 bp, Artificial Sequence
  Synthetic oligonucleotide
gaagtccacgtcgccgtcttttagtacccggtccaa

SEQ ID NO: 31947 - DNA, 36 bp, Artificial Sequence
  Synthetic oligonucleotide
taatacctgccacacgtcgtaccactaccaccggaa

SEQ ID NO: 31948 - DNA, 36 bp, Artificial Sequence
  Synthetic oligonucleotide
aatgaaggaggggaaagttgggtagccgttcgtgca

SEQ ID NO: 31949 - DNA, 36 bp, Artificial Sequence
  Synthetic oligonucleotide
atcgcaatgcgtactaacttaacgttccaccttgca

SEQ ID NO: 31950 - DNA, 36 bp, Artificial Sequence
  Synthetic oligonucleotide
ttgtagcgctccttggtcatttcgcgctcactctca

SEQ ID NO: 31951 - DNA, 37 bp, Artificial Sequence
  Synthetic oligonucleotide
atcccgctccatcccgttttgccagcagcttggggga

SEQ ID NO: 31952 - DNA, 38 bp, Artificial Sequence
  Synthetic oligonucleotide
ttgacctaccgccccaagccttgcctgtcatcgaatga

SEQ ID NO: 31953 - DNA, 38 bp, Artificial Sequence
  Synthetic oligonucleotide
gatgctccacgtgttattccctccgcctgtatagctga

SEQ ID NO: 31954 - DNA, 38 bp, Artificial Sequence
  Synthetic oligonucleotide
tgagggaccggccgaggaggggcaagggtttggagtga

SEQ ID NO: 31955 - DNA, 38 bp, Artificial Sequence
  Synthetic oligonucleotide
atgttgccacattgccgggtaggcgccttcactcttga

SEQ ID NO: 31956 - DNA, 35 bp, Artificial Sequence
  Synthetic oligonucleotide
gcctaccatgcccctcgctgaatgaaatgcaaata

SEQ ID NO: 31957 - DNA, 36 bp, Artificial Sequence
  Synthetic oligonucleotide
acttcccgcctcacttcgggcaattggaatgccata

SEQ ID NO: 31958 - DNA, 35 bp, Artificial Sequence
  Synthetic oligonucleotide
tgaatccactcgcacacagcagcacgcttttgcta

SEQ ID NO: 31959 - DNA, 35 bp, Artificial Sequence
  Synthetic oligonucleotide
agctctacccgctgagcatcatgagcctatgcccc

SEQ ID NO: 31960 - DNA, 35 bp, Artificial Sequence
  Synthetic oligonucleotide
acttatagccggtcgcctccctacttttccgctgc

SEQ ID NO: 31961 - DNA, 35 bp, Artificial Sequence
  Synthetic oligonucleotide
gacggaccgccatcactctttgtggtcacatcatc

SEQ ID NO: 31962 - DNA, 35 bp, Artificial Sequence
  Synthetic oligonucleotide
gtgaaggggagtatgggtgtatatttgggatggag

SEQ ID NO: 31963 - DNA, 35 bp, Artificial Sequence
  Synthetic oligonucleotide
gtatgggccggggagggtctctcaaaggggggtat

SEQ ID NO: 31964 - DNA, 35 bp, Artificial Sequence
  Synthetic oligonucleotide
actatcaaccgtccatccgcatgggtcttctctgt

SEQ ID NO: 31965 - DNA, 35 bp, Artificial Sequence
  Synthetic oligonucleotide
acatcacgtgcggatctaacccgctgcccgacctt

SEQ ID NO: 31966 - DNA, 36 bp, Artificial Sequence
  Synthetic oligonucleotide
gccctcttgccccatgcgtgcttctacagcaaagca

SEQ ID NO: 31967 - DNA, 36 bp, Artificial Sequence
  Synthetic oligonucleotide
gacccgtcacgcaatgcatacatagctgtcccctca

SEQ ID NO: 31968 - DNA, 37 bp, Artificial Sequence
  Synthetic oligonucleotide
aaacgtagaggggattaatggcacgaaggagggcgga

SEQ ID NO: 31969 - DNA, 36 bp, Artificial Sequence
  Synthetic oligonucleotide
gggggatagcctgaggggaggatgagggtgtctgga

SEQ ID NO: 31970 - DNA, 37 bp, Artificial Sequence
  Synthetic oligonucleotide
gaacggggaggttgggaaggggtagtgactggtatga

SEQ ID NO: 31971 - DNA, 38 bp, Artificial Sequence
  Synthetic oligonucleotide
tactcgtcgaactgctgcattccatcatggccatttga

SEQ ID NO: 31972 - DNA, 35 bp, Artificial Sequence
  Synthetic oligonucleotide
gtgatacacaacctcactcgcctaatctacaggta

SEQ ID NO: 31973 - DNA, 35 bp, Artificial Sequence
  Synthetic oligonucleotide
acgatccgcaaccattcacactttgcgctccaccc

SEQ ID NO: 31974 - DNA, 35 bp, Artificial Sequence
  Synthetic oligonucleotide
gttggcgcactcgttcaccatacacccactctatg

SEQ ID NO: 31975 - DNA, 35 bp, Artificial Sequence
  Synthetic oligonucleotide
gtgccactcatacgaatgcttgagcccctgtaact

SEQ ID NO: 31976 - DNA, 35 bp, Artificial Sequence
  Synthetic oligonucleotide
atctcgcgcaggatttaattggctgtctgcttttt

SEQ ID NO: 31977 - DNA, 36 bp, Artificial Sequence
  Synthetic oligonucleotide
tgatccggtcagggctttcactacgtctctaccgca

SEQ ID NO: 31978 - DNA, 36 bp, Artificial Sequence
  Synthetic oligonucleotide
acatagcctgctgcattcctgtccacagtaacatca

SEQ ID NO: 31979 - DNA, 37 bp, Artificial Sequence
  Synthetic oligonucleotide
tcacacccacctcgtataccgtatcatcgatgccgga

SEQ ID NO: 31980 - DNA, 38 bp, Artificial Sequence
  Synthetic oligonucleotide
atcgaagggggggtaaaggaaggcgagacgagaactga

SEQ ID NO: 31981 - DNA, 38 bp, Artificial Sequence
  Synthetic oligonucleotide
tcatcagacgatcccacctgtcgttaacaaacttttga

SEQ ID NO: 31982 - DNA, 35 bp, Artificial Sequence
  Synthetic oligonucleotide
gaggacatgtatgttgtggcgctctccatttccac

SEQ ID NO: 31983 - DNA, 35 bp, Artificial Sequence
  Synthetic oligonucleotide
gttgtgggtgtggggggacgtgcgtatttgggtac

SEQ ID NO: 31984 - DNA, 35 bp, Artificial Sequence
  Synthetic oligonucleotide
gtcacgacccgcactgctagtccagcctctccccc

SEQ ID NO: 31985 - DNA, 35 bp, Artificial Sequence
  Synthetic oligonucleotide
gtgccagcaagggtgcacacacttatgcctctgcc

SEQ ID NO: 31986 - DNA, 35 bp, Artificial Sequence
  Synthetic oligonucleotide
tctgccgccccaacggccaggtatctgaaccacct

SEQ ID NO: 31987 - DNA, 35 bp, Artificial Sequence
  Synthetic oligonucleotide
ttgcccggtcctgtctgtactaacctggctgccct

SEQ ID NO: 31988 - DNA, 35 bp, Artificial Sequence
  Synthetic oligonucleotide
tacacgtgtcgtcgtagcgaaacaccattctgcct

SEQ ID NO: 31989 - DNA, 35 bp, Artificial Sequence
  Synthetic oligonucleotide
tctgagtggggggagaggtagggtgccgaatgagt

SEQ ID NO: 31990 - DNA, 31 bp, Artificial Sequence
  Synthetic oligonucleotide
ttcccgccccggtccgccgtttctcatccca

SEQ ID NO: 31991 - DNA, 36 bp, Artificial Sequence
  Synthetic oligonucleotide
gatgtagcccatattccgcggcacctatgctttcca

SEQ ID NO: 31992 - DNA, 37 bp, Artificial Sequence
  Synthetic oligonucleotide
aaagagggatggaacagtattagtaagggaggtccga

SEQ ID NO: 31993 - DNA, 36 bp, Artificial Sequence
  Synthetic oligonucleotide
attcacccgtgacctgattttcgcttccttcttcga

SEQ ID NO: 31994 - DNA, 37 bp, Artificial Sequence
  Synthetic oligonucleotide
acaccactggctttggcgtaccttgcttctctttcga

SEQ ID NO: 31995 - DNA, 37 bp, Artificial Sequence
  Synthetic oligonucleotide
actcagcacgagaggggaaaattgtggcggtgctgga

SEQ ID NO: 31996 - DNA, 38 bp, Artificial Sequence
  Synthetic oligonucleotide
tctgccggttcgccgccatttcgcttcttcaatcctga

SEQ ID NO: 31997 - DNA, 36 bp, Artificial Sequence
  Synthetic oligonucleotide
tccccacccgcagacgaggtaaacaccgggatttga

SEQ ID NO: 31998 - DNA, 36 bp, Artificial Sequence
  Synthetic oligonucleotide
gcctatctccagcctcacgccaaggggcctcctata

SEQ ID NO: 31999 - DNA, 36 bp, Artificial Sequence
  Synthetic oligonucleotide
tgtacccatgcaccccgatttattgccacgtcgcta

SEQ ID NO: 32000 - DNA, 35 bp, Artificial Sequence
  Synthetic oligonucleotide
tagttcgtgctagcttgcctatggttcctccctta

SEQ ID NO: 32001 - DNA, 35 bp, Artificial Sequence
  Synthetic oligonucleotide
gtccatctccgtgaatgatcgccaacattggccac

SEQ ID NO: 32002 - DNA, 35 bp, Artificial Sequence
  Synthetic oligonucleotide
atttccccgccgaccgtgcgtagtccaaccgtacg

SEQ ID NO: 32003 - DNA, 35 bp, Artificial Sequence
  Synthetic oligonucleotide
taggggggtaacgcggaaggggagcggttgtaggg

SEQ ID NO: 32004 - DNA, 35 bp, Artificial Sequence
  Synthetic oligonucleotide
accttccgcgccaccctgatcgatcgtcattccat

SEQ ID NO: 32005 - DNA, 35 bp, Artificial Sequence
  Synthetic oligonucleotide
gacatctcctgtctcgccgaggccgtacactcgct

SEQ ID NO: 32006 - DNA, 35 bp, Artificial Sequence
  Synthetic oligonucleotide
tccccgccgcgcactccgttttggctgcttacatt

SEQ ID NO: 32007 - DNA, 36 bp, Artificial Sequence
  Synthetic oligonucleotide
ttcgccacagccccacagatagtttttacctttcaa

SEQ ID NO: 32008 - DNA, 36 bp, Artificial Sequence
  Synthetic oligonucleotide
gtggttcgccggctctggcctccatctgttttttaa

SEQ ID NO: 32009 - DNA, 35 bp, Artificial Sequence
  Synthetic oligonucleotide
tttacctgccctccccttttcccgagcggaccaca

SEQ ID NO: 32010 - DNA, 37 bp, Artificial Sequence
  Synthetic oligonucleotide
tacgcacgttcctttttttttagctctactgtcgcga

SEQ ID NO: 32011 - DNA, 37 bp, Artificial Sequence
  Synthetic oligonucleotide
tactgaggggagggaacacattggaagggatggtgga

SEQ ID NO: 32012 - DNA, 38 bp, Artificial Sequence
  Synthetic oligonucleotide
gaacgcaggtggttgtgggcggatagtagtggtaatga

SEQ ID NO: 32013 - DNA, 36 bp, Artificial Sequence
  Synthetic oligonucleotide
accgccacttgtgcgtccacgctgtccacccacata

SEQ ID NO: 32014 - DNA, 35 bp, Artificial Sequence
  Synthetic oligonucleotide
agcacgcaatggcagatctaccgcccccctttata

SEQ ID NO: 32015 - DNA, 35 bp, Artificial Sequence
  Synthetic oligonucleotide
gaccatgcctgtcgtttctgccctactggcctcta

SEQ ID NO: 32016 - DNA, 35 bp, Artificial Sequence
  Synthetic oligonucleotide
agcctccgcacagaccatctcgggcacccgcaaac

SEQ ID NO: 32017 - DNA, 35 bp, Artificial Sequence
  Synthetic oligonucleotide
gctcggggacgcactgtgctctgctccctcgctac

SEQ ID NO: 32018 - DNA, 35 bp, Artificial Sequence
  Synthetic oligonucleotide
gaccctagttctggtcgcgcatatgaggccccccc

SEQ ID NO: 32019 - DNA, 35 bp, Artificial Sequence
  Synthetic oligonucleotide
ttaccccatcatgtcactccagccacgagccattg

SEQ ID NO: 32020 - DNA, 35 bp, Artificial Sequence
  Synthetic oligonucleotide
atcgactaccatgcccgtggcgctccctcttcgat

SEQ ID NO: 32021 - DNA, 34 bp, Artificial Sequence
  Synthetic oligonucleotide
acacgcgcagagccaattcctccagcttctgtct

SEQ ID NO: 32022 - DNA, 34 bp, Artificial Sequence
  Synthetic oligonucleotide
tcacatgtagcccgtcggcccttcatttgtcttt

SEQ ID NO: 32023 - DNA, 36 bp, Artificial Sequence
  Synthetic oligonucleotide
tgtgtgaaaggcaagggtagcaagaaattagggaga

SEQ ID NO: 32024 - DNA, 36 bp, Artificial Sequence
  Synthetic oligonucleotide
acagatgtctgggggtggtggtggggggtctagcga

SEQ ID NO: 32025 - DNA, 37 bp, Artificial Sequence
  Synthetic oligonucleotide
accggggggctggagaggggcggttgggaaagcggga

SEQ ID NO: 32026 - DNA, 37 bp, Artificial Sequence
  Synthetic oligonucleotide
tcaggccacaacactttgttctcacctcgaacgggga

SEQ ID NO: 32027 - DNA, 36 bp, Artificial Sequence
  Synthetic oligonucleotide
atgcaaacagcaacagcggaaaaactggggggatga

SEQ ID NO: 32028 - DNA, 38 bp, Artificial Sequence
  Synthetic oligonucleotide
agaagggccggggggtaaagggattgaggagcaggtga

SEQ ID NO: 32029 - DNA, 38 bp, Artificial Sequence
  Synthetic oligonucleotide
gtgggggagggggatgagctgggaggttatgccggtga

SEQ ID NO: 32030 - DNA, 36 bp, Artificial Sequence
  Synthetic oligonucleotide
tacgccacccttattgcgtgtttttattacgtcgta

SEQ ID NO: 32031 - DNA, 35 bp, Artificial Sequence
  Synthetic oligonucleotide
ttgggagccgggggggggaggtctcagcaagggta

SEQ ID NO: 32032 - DNA, 35 bp, Artificial Sequence
  Synthetic oligonucleotide
tttcacgccccgactgaccgggcaactttccctta

SEQ ID NO: 32033 - DNA, 35 bp, Artificial Sequence
  Synthetic oligonucleotide
gccccgcttgcgagtgagccctccatctgaatacc

SEQ ID NO: 32034 - DNA, 35 bp, Artificial Sequence
  Synthetic oligonucleotide
gtcacacgcggccaccggtaccctcgacatacgcc

SEQ ID NO: 32035 - DNA, 35 bp, Artificial Sequence
  Synthetic oligonucleotide
gatgcggggctggcttttttcgtgtgactcccgcc

SEQ ID NO: 32036 - DNA, 35 bp, Artificial Sequence
  Synthetic oligonucleotide
tcacacgttggtgcccccctcatcatgtctcctgc

SEQ ID NO: 32037 - DNA, 35 bp, Artificial Sequence
  Synthetic oligonucleotide
atcgccaaccgtaactacccaatgtccaaatagtc

SEQ ID NO: 32038 - DNA, 35 bp, Artificial Sequence
  Synthetic oligonucleotide
attgctgacgtgcgctgccgcctgggtcccctttc

SEQ ID NO: 32039 - DNA, 35 bp, Artificial Sequence
  Synthetic oligonucleotide
agcctaacaccatagtccgaagaccccacaccttg

SEQ ID NO: 32040 - DNA, 35 bp, Artificial Sequence
  Synthetic oligonucleotide
taccccgcgcgttcccgctaccttatcaggccttg

SEQ ID NO: 32041 - DNA, 35 bp, Artificial Sequence
  Synthetic oligonucleotide
tctatccgtgcccccccttgccttgcgagtttcat

SEQ ID NO: 32042 - DNA, 35 bp, Artificial Sequence
  Synthetic oligonucleotide
ggagcctcactgagcctcgtccccggacttaccct

SEQ ID NO: 32043 - DNA, 35 bp, Artificial Sequence
  Synthetic oligonucleotide
tccaacgccttagtattatcctgttcccgtaagct

SEQ ID NO: 32044 - DNA, 35 bp, Artificial Sequence
  Synthetic oligonucleotide
gattcgcggcccgatactgccatccattcttcaaa

SEQ ID NO: 32045 - DNA, 36 bp, Artificial Sequence
  Synthetic oligonucleotide
gaacaccacctctgtctatatgctttttaatacgaa

SEQ ID NO: 32046 - DNA, 36 bp, Artificial Sequence
  Synthetic oligonucleotide
atcaccgcgctccactacggtctcagcctaccaaca

SEQ ID NO: 32047 - DNA, 36 bp, Artificial Sequence
  Synthetic oligonucleotide
aacgacccggtgccgggcgtggcttccttataccca

SEQ ID NO: 32048 - DNA, 37 bp, Artificial Sequence
  Synthetic oligonucleotide
tgcacccacaatatccaattggcacttacattctcga

SEQ ID NO: 32049 - DNA, 36 bp, Artificial Sequence
  Synthetic oligonucleotide
gccaactctggtacttcttgtgcccccattacagga

SEQ ID NO: 32050 - DNA, 37 bp, Artificial Sequence
  Synthetic oligonucleotide
gcgtgatggggacgtggggggaaggaaagctgatgga

SEQ ID NO: 32051 - DNA, 37 bp, Artificial Sequence
  Synthetic oligonucleotide
tcgtgacccgaatgcgcgcctatccatgccctgctga

SEQ ID NO: 32052 - DNA, 37 bp, Artificial Sequence
  Synthetic oligonucleotide
gacccgcttacatgcctatgacgctgtttcgctttga

SEQ ID NO: 32053 - DNA, 36 bp, Artificial Sequence
  Synthetic oligonucleotide
gccgactgagcacggggtcgtgacgccctccaccta

SEQ ID NO: 32054 - DNA, 36 bp, Artificial Sequence
  Synthetic oligonucleotide
gcccgaccgcacctagtccacatgcctattaggcgc

SEQ ID NO: 32055 - DNA, 35 bp, Artificial Sequence
  Synthetic oligonucleotide
gcaccacacgcactgccatcaaagcaggtatgcgc

SEQ ID NO: 32056 - DNA, 35 bp, Artificial Sequence
  Synthetic oligonucleotide
aattccccactcttcagccgtgctctcgttatatc

SEQ ID NO: 32057 - DNA, 35 bp, Artificial Sequence
  Synthetic oligonucleotide
accactacagcgagccatccggcaatattctcccg

SEQ ID NO: 32058 - DNA, 35 bp, Artificial Sequence
  Synthetic oligonucleotide
tacgcatgcgctttcttttggcgattaccatcttg

SEQ ID NO: 32059 - DNA, 35 bp, Artificial Sequence
  Synthetic oligonucleotide
gctgatcgtcggtctcgatggttctcgttgcccct

SEQ ID NO: 32060 - DNA, 35 bp, Artificial Sequence
  Synthetic oligonucleotide
tcctccagccgtaaaccgccgccgtgactcgggct

SEQ ID NO: 32061 - DNA, 35 bp, Artificial Sequence
  Synthetic oligonucleotide
gatagcagcagattctgcccccgtcattacatgct

SEQ ID NO: 32062 - DNA, 36 bp, Artificial Sequence
  Synthetic oligonucleotide
acccgtgcctgaactcctgtctcccgagcccgcgaa

SEQ ID NO: 32063 - DNA, 35 bp, Artificial Sequence
  Synthetic oligonucleotide
tctatacggcatcataccctgcgcacacactccca

SEQ ID NO: 32064 - DNA, 36 bp, Artificial Sequence
  Synthetic oligonucleotide
tcatgatctcccctgctgctacctcgaacgggtcca

SEQ ID NO: 32065 - DNA, 36 bp, Artificial Sequence
  Synthetic oligonucleotide
tgcctcagccgcaaattttacctcgcttagcgagca

SEQ ID NO: 32066 - DNA, 35 bp, Artificial Sequence
  Synthetic oligonucleotide
gaatgtcgccggcctccccttgttatagcccccga

SEQ ID NO: 32067 - DNA, 37 bp, Artificial Sequence
  Synthetic oligonucleotide
tccgagcgtagcctctcgcacccctttccattgccga

SEQ ID NO: 32068 - DNA, 37 bp, Artificial Sequence
  Synthetic oligonucleotide
gccatcaccaatccagtcccacggcgatcattatcga

SEQ ID NO: 32069 - DNA, 38 bp, Artificial Sequence
  Synthetic oligonucleotide
gccgacgggcccctgtgcttcattatctttttcgctga

SEQ ID NO: 32070 - DNA, 38 bp, Artificial Sequence
  Synthetic oligonucleotide
tgtcgtcctcctcgcgataccagccgtaactccattga

SEQ ID NO: 32071 - DNA, 38 bp, Artificial Sequence
  Synthetic oligonucleotide
gccatgtgcgcccagtcttactccaccttgcactttga

SEQ ID NO: 32072 - DNA, 35 bp, Artificial Sequence
  Synthetic oligonucleotide
tcctggtccgttctctcctgtagcgtagtacacta

SEQ ID NO: 32073 - DNA, 35 bp, Artificial Sequence
  Synthetic oligonucleotide
gaagctcaaccgccgtcttttgtttggctctgcta

SEQ ID NO: 32074 - DNA, 36 bp, Artificial Sequence
  Synthetic oligonucleotide
gtcgaaggagcaacgggtaggaaagaatgtctggta

SEQ ID NO: 32075 - DNA, 35 bp, Artificial Sequence
  Synthetic oligonucleotide
gtcgatcatcagaacgtacaattcgcttccactcc

SEQ ID NO: 32076 - DNA, 35 bp, Artificial Sequence
  Synthetic oligonucleotide
ttcgaacggccgcctacgctctctgtgcactttgc

SEQ ID NO: 32077 - DNA, 35 bp, Artificial Sequence
  Synthetic oligonucleotide
atgccggcgggagggggtggagggcaccagagcat

SEQ ID NO: 32078 - DNA, 35 bp, Artificial Sequence
  Synthetic oligonucleotide
gcccccgtgatctctgtgacaccgatctgtttttt

SEQ ID NO: 32079 - DNA, 36 bp, Artificial Sequence
  Synthetic oligonucleotide
tccccacattgcttggatacttcacggtactcttaa

SEQ ID NO: 32080 - DNA, 37 bp, Artificial Sequence
  Synthetic oligonucleotide
aagggatggagcgaaggggagattgaatagggtcaga

SEQ ID NO: 32081 - DNA, 37 bp, Artificial Sequence
  Synthetic oligonucleotide
tagtccaccgcctattttcggtccagccacgtttgga

SEQ ID NO: 32082 - DNA, 37 bp, Artificial Sequence
  Synthetic oligonucleotide
tcctgccgagcccaggttcccttttatgctttcttga

SEQ ID NO: 32083 - DNA, 35 bp, Artificial Sequence
  Synthetic oligonucleotide
taccccgcgcgtatcgcttactgtccaacgtacac

SEQ ID NO: 32084 - DNA, 34 bp, Artificial Sequence
  Synthetic oligonucleotide
gagcgcacccggatttttctctgccaatctcacc

SEQ ID NO: 32085 - DNA, 35 bp, Artificial Sequence
  Synthetic oligonucleotide
ttcgccacacccacgtgacgggcatttaccaaccc

SEQ ID NO: 32086 - DNA, 35 bp, Artificial Sequence
  Synthetic oligonucleotide
tgtctgcctttcccatgcatactgtttgtcccttc

SEQ ID NO: 32087 - DNA, 35 bp, Artificial Sequence
  Synthetic oligonucleotide
taagcgggtcggggagggattttaagggtaatgcg

SEQ ID NO: 32088 - DNA, 35 bp, Artificial Sequence
  Synthetic oligonucleotide
tcccgtaaacctaccgtctgcgctgaatccccctg

SEQ ID NO: 32089 - DNA, 35 bp, Artificial Sequence
  Synthetic oligonucleotide
gtcacatccagcagtactacgacctgtactttcat

SEQ ID NO: 32090 - DNA, 36 bp, Artificial Sequence
  Synthetic oligonucleotide
acacaccagcagcacggtcgtcgtcactgtctatca

SEQ ID NO: 32091 - DNA, 36 bp, Artificial Sequence
  Synthetic oligonucleotide
gtacctatgctcgccctgatacgccagtatatctca

SEQ ID NO: 32092 - DNA, 36 bp, Artificial Sequence
  Synthetic oligonucleotide
gccaatacccccagccggtaacaaactctcctaaga

SEQ ID NO: 32093 - DNA, 37 bp, Artificial Sequence
  Synthetic oligonucleotide
tgcccccactctcaccctgggcttacaaacctataga

SEQ ID NO: 32094 - DNA, 36 bp, Artificial Sequence
  Synthetic oligonucleotide
attctgcaccgccttaacccagccaccctccgcgga

SEQ ID NO: 32095 - DNA, 37 bp, Artificial Sequence
  Synthetic oligonucleotide
gcaaagggggctgtgggtgggcttatttagtggggga

SEQ ID NO: 32096 - DNA, 37 bp, Artificial Sequence
  Synthetic oligonucleotide
atcgacgtcccgcgctccatctttcgtttcttgggga

SEQ ID NO: 32097 - DNA, 37 bp, Artificial Sequence
  Synthetic oligonucleotide
accgccccgtttatctcaccatggagcctcgtatgga

SEQ ID NO: 32098 - DNA, 36 bp, Artificial Sequence
  Synthetic oligonucleotide
gatcgcaactgcttgttttttctcccattacttgga

SEQ ID NO: 32099 - DNA, 38 bp, Artificial Sequence
  Synthetic oligonucleotide
tagacgggtaccggggtggaggatgggaggaagactga

SEQ ID NO: 32100 - DNA, 38 bp, Artificial Sequence
  Synthetic oligonucleotide
ttagggtggggcgggtagaggaggttgatttccggtga

SEQ ID NO: 32101 - DNA, 38 bp, Artificial Sequence
  Synthetic oligonucleotide
tcagacctccttaatcatcacggccaccacatctgtga

SEQ ID NO: 32102 - DNA, 38 bp, Artificial Sequence
  Synthetic oligonucleotide
ttgccggcctacgtcttttagtttcctctgccgcttga

SEQ ID NO: 32103 - DNA, 35 bp, Artificial Sequence
  Synthetic oligonucleotide
gtccacccacttgtcaagccatccatgtagtggta

SEQ ID NO: 32104 - DNA, 35 bp, Artificial Sequence
  Synthetic oligonucleotide
tttcccgccaccactgttccagtcaagcatcaacc

SEQ ID NO: 32105 - DNA, 35 bp, Artificial Sequence
  Synthetic oligonucleotide
ttacaaccgctgggtagcactcttttcctattggc

SEQ ID NO: 32106 - DNA, 35 bp, Artificial Sequence
  Synthetic oligonucleotide
gttgccacggtgtcccagcctccccctagctgtgc

SEQ ID NO: 32107 - DNA, 35 bp, Artificial Sequence
  Synthetic oligonucleotide
ttcacccactaacactgtcacagtgctttattctc

SEQ ID NO: 32108 - DNA, 35 bp, Artificial Sequence
  Synthetic oligonucleotide
taagcgtggcccgggaatctgcatttacatcctcg

SEQ ID NO: 32109 - DNA, 35 bp, Artificial Sequence
  Synthetic oligonucleotide
tcacttcacccgaccgcttgatgttccccacgttg

SEQ ID NO: 32110 - DNA, 35 bp, Artificial Sequence
  Synthetic oligonucleotide
ttgacgttggccaggcaccaccacagtctttccat

SEQ ID NO: 32111 - DNA, 35 bp, Artificial Sequence
  Synthetic oligonucleotide
gaggtagcccagaactgtccgttgtctccgtacct

SEQ ID NO: 32112 - DNA, 35 bp, Artificial Sequence
  Synthetic oligonucleotide
tatagcagccccacccgtgccttgctacatattct

SEQ ID NO: 32113 - DNA, 36 bp, Artificial Sequence
  Synthetic oligonucleotide
gtaaccgcccgcctgtcacgctcatggtctcaccaa

SEQ ID NO: 32114 - DNA, 36 bp, Artificial Sequence
  Synthetic oligonucleotide
acaccactcttcgccgatcgaaggactacctataca

SEQ ID NO: 32115 - DNA, 36 bp, Artificial Sequence
  Synthetic oligonucleotide
tttccgattcgacccccatggtgttccatgctacca

SEQ ID NO: 32116 - DNA, 35 bp, Artificial Sequence
  Synthetic oligonucleotide
taacaaccggacatcacctacaagtgccattacga

SEQ ID NO: 32117 - DNA, 37 bp, Artificial Sequence
  Synthetic oligonucleotide
gcaagtgctgccggttgtttcgttgcttcccccccga

SEQ ID NO: 32118 - DNA, 37 bp, Artificial Sequence
  Synthetic oligonucleotide
accgtgcgcctactttttctgcattcccctgttgcga

SEQ ID NO: 32119 - DNA, 37 bp, Artificial Sequence
  Synthetic oligonucleotide
ttgtgcaaacccctatactatcgctctgcccttagga

SEQ ID NO: 32120 - DNA, 38 bp, Artificial Sequence
  Synthetic oligonucleotide
gtgccaccacaccctaccaatgaaatagacctcgctga

SEQ ID NO: 32121 - DNA, 37 bp, Artificial Sequence
  Synthetic oligonucleotide
gtcgaggtccgtctgagtcccgccctccgttccttga

SEQ ID NO: 32122 - DNA, 38 bp, Artificial Sequence
  Synthetic oligonucleotide
gtgcccccttcctcccccgccttagtctgacacgttga

SEQ ID NO: 32123 - DNA, 36 bp, Artificial Sequence
  Synthetic oligonucleotide
ttacgtcccgccgttcagaggcattcgcccccacta

SEQ ID NO: 32124 - DNA, 35 bp, Artificial Sequence
  Synthetic oligonucleotide
gcgcccctggtcacgattacctttgtcccgcgcta

SEQ ID NO: 32125 - DNA, 35 bp, Artificial Sequence
  Synthetic oligonucleotide
gagaccagcagcccttgccgtgtcacacctttcac

SEQ ID NO: 32126 - DNA, 35 bp, Artificial Sequence
  Synthetic oligonucleotide
gggtacgagaccctgccgtagagcccccgatcccc

SEQ ID NO: 32127 - DNA, 35 bp, Artificial Sequence
  Synthetic oligonucleotide
tccatgccttcatagtacctaccgctaatatcgcg

SEQ ID NO: 32128 - DNA, 35 bp, Artificial Sequence
  Synthetic oligonucleotide
gaggtctcgctacaccccctccttctttgtctagg

SEQ ID NO: 32129 - DNA, 35 bp, Artificial Sequence
  Synthetic oligonucleotide
aacaccccagactccttccttaactgtagcttagg

SEQ ID NO: 32130 - DNA, 35 bp, Artificial Sequence
  Synthetic oligonucleotide
tgtcgcccccccctgtcgtcttaggtcatcggtgg

SEQ ID NO: 32131 - DNA, 35 bp, Artificial Sequence
  Synthetic oligonucleotide
ttgaaccgccccaaatcctaaaacgctgcagtttg

SEQ ID NO: 32132 - DNA, 35 bp, Artificial Sequence
  Synthetic oligonucleotide
ttacgatcgccgaggccgccattagcaccacccat

SEQ ID NO: 32133 - DNA, 35 bp, Artificial Sequence
  Synthetic oligonucleotide
actgcctgacaccatagcccgcgcaatttcgttct

SEQ ID NO: 32134 - DNA, 35 bp, Artificial Sequence
  Synthetic oligonucleotide
gcctcacgtgcgaagcctttaggaaatttcaacaa

SEQ ID NO: 32135 - DNA, 36 bp, Artificial Sequence
  Synthetic oligonucleotide
gcgcacccactgtacgtgtgcaactctattagccaa

SEQ ID NO: 32136 - DNA, 36 bp, Artificial Sequence
  Synthetic oligonucleotide
acttggcacgcacctgcaatagtttcatgccaccca

SEQ ID NO: 32137 - DNA, 35 bp, Artificial Sequence
  Synthetic oligonucleotide
gtacacgccctacgccggccttactctactcgcca

SEQ ID NO: 32138 - DNA, 37 bp, Artificial Sequence
  Synthetic oligonucleotide
atctccgactgtcacatttagcgcattactcccacga

SEQ ID NO: 32139 - DNA, 37 bp, Artificial Sequence
  Synthetic oligonucleotide
attcacctgcgcacacctctacctcgagctgagacga

SEQ ID NO: 32140 - DNA, 37 bp, Artificial Sequence
  Synthetic oligonucleotide
atccgaaacatgccccggcgactcgacccatcttcga

SEQ ID NO: 32141 - DNA, 36 bp, Artificial Sequence
  Synthetic oligonucleotide
gacatcgaggagagacgggaggtctaaacggttgga

SEQ ID NO: 32142 - DNA, 35 bp, Artificial Sequence
  Synthetic oligonucleotide
tcagagaccaaccatgttttcggggtcattaccac

SEQ ID NO: 32143 - DNA, 35 bp, Artificial Sequence
  Synthetic oligonucleotide
gcgtcgtacggtcaccgaaccctcttatgctaccc

SEQ ID NO: 32144 - DNA, 35 bp, Artificial Sequence
  Synthetic oligonucleotide
atgaatgcaggtacaattacgtactacgctccctc

SEQ ID NO: 32145 - DNA, 35 bp, Artificial Sequence
  Synthetic oligonucleotide
gagtccgttccttccagtttagcgccctacccccg

SEQ ID NO: 32146 - DNA, 35 bp, Artificial Sequence
  Synthetic oligonucleotide
gtgcacgggggggaccgggatcgtaacagggtgcg

SEQ ID NO: 32147 - DNA, 35 bp, Artificial Sequence
  Synthetic oligonucleotide
atctcccacgccggccacgctcacatgcctcgaat

SEQ ID NO: 32148 - DNA, 35 bp, Artificial Sequence
  Synthetic oligonucleotide
tatgacgcccacataacgcgtagcctctgtttcat

SEQ ID NO: 32149 - DNA, 35 bp, Artificial Sequence
  Synthetic oligonucleotide
gggtggggccagatatcacactaggggaacggggt

SEQ ID NO: 32150 - DNA, 35 bp, Artificial Sequence
  Synthetic oligonucleotide
tatgctgcctttgatttcatccgtggagtctcgtt

SEQ ID NO: 32151 - DNA, 35 bp, Artificial Sequence
  Synthetic oligonucleotide
tatccgggccatgaacctatcttgacgctctattt

SEQ ID NO: 32152 - DNA, 36 bp, Artificial Sequence
  Synthetic oligonucleotide
ttctgcccttcacgacttaccgctcggtctgtaaga

SEQ ID NO: 32153 - DNA, 37 bp, Artificial Sequence
  Synthetic oligonucleotide
agtgatccgcacgacctcaatttggacctacccacga

SEQ ID NO: 32154 - DNA, 37 bp, Artificial Sequence
  Synthetic oligonucleotide
ttttccccaccgcctcccgggactagccctggaccga

SEQ ID NO: 32155 - DNA, 37 bp, Artificial Sequence
  Synthetic oligonucleotide
agccaccggagccgtatcgatctcccagtaactccga

SEQ ID NO: 32156 - DNA, 37 bp, Artificial Sequence
  Synthetic oligonucleotide
gtacgtccatcgaactttccaccactcgtctcacgga

SEQ ID NO: 32157 - DNA, 38 bp, Artificial Sequence
  Synthetic oligonucleotide
tcgaagcctccagacacacgcatctctagcattcatga

SEQ ID NO: 32158 - DNA, 38 bp, Artificial Sequence
  Synthetic oligonucleotide
acgcatcgtatatcgccatccgttccgccctttcatga

SEQ ID NO: 32159 - DNA, 36 bp, Artificial Sequence
  Synthetic oligonucleotide
ttactcccgccctggtcacgcgaatgacaattctga

SEQ ID NO: 32160 - DNA, 38 bp, Artificial Sequence
  Synthetic oligonucleotide
tccgacgcatgtgtagtgttttttttctgcactcttga

SEQ ID NO: 32161 - DNA, 35 bp, Artificial Sequence
  Synthetic oligonucleotide
atacgcccgtactctactatctttttttgactgac

SEQ ID NO: 32162 - DNA, 35 bp, Artificial Sequence
  Synthetic oligonucleotide
gcccagtagtaattgcgttcatatcacctcctgtc

SEQ ID NO: 32163 - DNA, 35 bp, Artificial Sequence
  Synthetic oligonucleotide
aagtgtcggtccgctccctagtacgctttccctgt

SEQ ID NO: 32164 - DNA, 36 bp, Artificial Sequence
  Synthetic oligonucleotide
gtcacccgacacggggagggaagagtcggtgattaa

SEQ ID NO: 32165 - DNA, 37 bp, Artificial Sequence
  Synthetic oligonucleotide
tgtgatatgccgcaacgcttcccctgtacttgtccga

SEQ ID NO: 32166 - DNA, 35 bp, Artificial Sequence
  Synthetic oligonucleotide
gcccaccttcactaccactatgcccgtccaggcga

SEQ ID NO: 32167 - DNA, 36 bp, Artificial Sequence
  Synthetic oligonucleotide
tgcgcaccccctttatcctgttcgacatttgcggga

SEQ ID NO: 32168 - DNA, 37 bp, Artificial Sequence
  Synthetic oligonucleotide
tacgaggaaaatcgggtagggaacgagtaacggggga

SEQ ID NO: 32169 - DNA, 38 bp, Artificial Sequence
  Synthetic oligonucleotide
acctccaccgccacataggagcgtggcttcatacatga

SEQ ID NO: 32170 - DNA, 37 bp, Artificial Sequence
  Synthetic oligonucleotide
taccattccgttcaagctctacaccgccattcgatga

SEQ ID NO: 32171 - DNA, 38 bp, Artificial Sequence
  Synthetic oligonucleotide
tgatcctcctccaagtgttccggaaatctgccctatga

SEQ ID NO: 32172 - DNA, 35 bp, Artificial Sequence
  Synthetic oligonucleotide
tacgacggacgctttgccgcacccataatgttgcc

SEQ ID NO: 32173 - DNA, 35 bp, Artificial Sequence
  Synthetic oligonucleotide
tgaccatccagcccgccccttacacgtgaacttcg

SEQ ID NO: 32174 - DNA, 35 bp, Artificial Sequence
  Synthetic oligonucleotide
tcatcccccgtatccgtggttatcgtactaccgat

SEQ ID NO: 32175 - DNA, 34 bp, Artificial Sequence
  Synthetic oligonucleotide
atgccctgcccctgccctccttttttaccctggt

SEQ ID NO: 32176 - DNA, 35 bp, Artificial Sequence
  Synthetic oligonucleotide
gcaaccgcactgccactgatacacacagctgctgt

SEQ ID NO: 32177 - DNA, 35 bp, Artificial Sequence
  Synthetic oligonucleotide
gatgccttccgactctgacctactgttcctgcttt

SEQ ID NO: 32178 - DNA, 36 bp, Artificial Sequence
  Synthetic oligonucleotide
gaatgcagggggtcccaagggatacggggtggccaa

SEQ ID NO: 32179 - DNA, 36 bp, Artificial Sequence
  Synthetic oligonucleotide
tcacgcccaagcacaattccgtcacacgctgacaca

SEQ ID NO: 32180 - DNA, 35 bp, Artificial Sequence
  Synthetic oligonucleotide
actttctgcccgaatattgaccgcattagcccaca

SEQ ID NO: 32181 - DNA, 35 bp, Artificial Sequence
  Synthetic oligonucleotide
gcactcaccgttcctcaaggctatatgtaactaca

SEQ ID NO: 32182 - DNA, 35 bp, Artificial Sequence
  Synthetic oligonucleotide
gatccacgtctgacatctcgctcgcggtcctacca

SEQ ID NO: 32183 - DNA, 37 bp, Artificial Sequence
  Synthetic oligonucleotide
gtcatccaggcgggagggtagggttgtaattcgggga

SEQ ID NO: 32184 - DNA, 37 bp, Artificial Sequence
  Synthetic oligonucleotide
ttacgtgcgcagactagggggcgggcgggctggtgga

SEQ ID NO: 32185 - DNA, 38 bp, Artificial Sequence
  Synthetic oligonucleotide
acacagggaacaatagggatatatgacggggtggatga

SEQ ID NO: 32186 - DNA, 38 bp, Artificial Sequence
  Synthetic oligonucleotide
acacgtcgcatcgtggccttgttaccgtgtacctctga

SEQ ID NO: 32187 - DNA, 38 bp, Artificial Sequence
  Synthetic oligonucleotide
gtcagggagggactgggtgggaacaatcacccacgtga

SEQ ID NO: 32188 - DNA, 35 bp, Artificial Sequence
  Synthetic oligonucleotide
tcaccacctcttccttccacatatgtactaggtga

SEQ ID NO: 32189 - DNA, 36 bp, Artificial Sequence
  Synthetic oligonucleotide
gcgatctggaggggaatgatggaggtgtggctgtta

SEQ ID NO: 32190 - DNA, 35 bp, Artificial Sequence
  Synthetic oligonucleotide
tgacacccaaggcccagtgctcttcatgcccttta

SEQ ID NO: 32191 - DNA, 36 bp, Artificial Sequence
  Synthetic oligonucleotide
tacatcacccacgcttgatcgttgtcactggtttta

SEQ ID NO: 32192 - DNA, 35 bp, Artificial Sequence
  Synthetic oligonucleotide
tcatcaggccccccagtattactccttcatgtaac

SEQ ID NO: 32193 - DNA, 34 bp, Artificial Sequence
  Synthetic oligonucleotide
gatttcatcgcctttttccatgcatgttctatcc

SEQ ID NO: 32194 - DNA, 35 bp, Artificial Sequence
  Synthetic oligonucleotide
acgaggagggggcaggggggaacgacattgaaatc

SEQ ID NO: 32195 - DNA, 35 bp, Artificial Sequence
  Synthetic oligonucleotide
atccccactgaccgtgactccccatggctgacttc

SEQ ID NO: 32196 - DNA, 35 bp, Artificial Sequence
  Synthetic oligonucleotide
gaccgacccaggcactacgctgtcggtttctgttc

SEQ ID NO: 32197 - DNA, 34 bp, Artificial Sequence
  Synthetic oligonucleotide
acactaatggccaccaacgtcccgactctccgag

SEQ ID NO: 32198 - DNA, 35 bp, Artificial Sequence
  Synthetic oligonucleotide
gaagagcgacagagttccgcggtgaagggggaggg

SEQ ID NO: 32199 - DNA, 35 bp, Artificial Sequence
  Synthetic oligonucleotide
taccccatcggacgccttcctccatagattgccat

SEQ ID NO: 32200 - DNA, 35 bp, Artificial Sequence
  Synthetic oligonucleotide
gccctgacatcctacttctacgcgccacgtgcaca

SEQ ID NO: 32201 - DNA, 37 bp, Artificial Sequence
  Synthetic oligonucleotide
tccccatgtacaggccaatcagtcgcaccaccaatga

SEQ ID NO: 32202 - DNA, 38 bp, Artificial Sequence
  Synthetic oligonucleotide
atccccctcgcgccacaaaggcatcctggccattctga

SEQ ID NO: 32203 - DNA, 34 bp, Artificial Sequence
  Synthetic oligonucleotide
aacagccgaaccgaatccaccaaggccaccgata

SEQ ID NO: 32204 - DNA, 36 bp, Artificial Sequence
  Synthetic oligonucleotide
agcacgccgtttccgtaatttgctgttccgtttcta

SEQ ID NO: 32205 - DNA, 36 bp, Artificial Sequence
  Synthetic oligonucleotide
atcaacctcccacgaatctgttgcctacattggtta

SEQ ID NO: 32206 - DNA, 36 bp, Artificial Sequence
  Synthetic oligonucleotide
atcacgacatgtgccccctcatatcatcgaatgtta

SEQ ID NO: 32207 - DNA, 35 bp, Artificial Sequence
  Synthetic oligonucleotide
ttggggggtgatgaacggggggtaaatggccattc

SEQ ID NO: 32208 - DNA, 35 bp, Artificial Sequence
  Synthetic oligonucleotide
tcccatctcagaccaccctactaccttaggttcag

SEQ ID NO: 32209 - DNA, 35 bp, Artificial Sequence
  Synthetic oligonucleotide
tagatccatctgtgatcgactgactcctgtaacat

SEQ ID NO: 32210 - DNA, 35 bp, Artificial Sequence
  Synthetic oligonucleotide
atcatccgtaactatgttaccaccgttgactacat

SEQ ID NO: 32211 - DNA, 35 bp, Artificial Sequence
  Synthetic oligonucleotide
aactgtcgcaccagagatgactcttcgctccccct

SEQ ID NO: 32212 - DNA, 35 bp, Artificial Sequence
  Synthetic oligonucleotide
taccccacgaactgacagtgctcgggatcacttct

SEQ ID NO: 32213 - DNA, 35 bp, Artificial Sequence
  Synthetic oligonucleotide
gttgggagcccggtgctggcctatccactcccttt

SEQ ID NO: 32214 - DNA, 35 bp, Artificial Sequence
  Synthetic oligonucleotide
tgacagaaccgcaccctcaatgctgccatggtaaa

SEQ ID NO: 32215 - DNA, 36 bp, Artificial Sequence
  Synthetic oligonucleotide
acccatccttaggcgctaatgacctcccctagttaa

SEQ ID NO: 32216 - DNA, 36 bp, Artificial Sequence
  Synthetic oligonucleotide
gaccaccactactcttaggtaccgactacacttgca

SEQ ID NO: 32217 - DNA, 36 bp, Artificial Sequence
  Synthetic oligonucleotide
acagcactactgcctctcatcctacgctcccctaga

SEQ ID NO: 32218 - DNA, 36 bp, Artificial Sequence
  Synthetic oligonucleotide
tgtaggccccactgttggtccccttctgtctaacga

SEQ ID NO: 32219 - DNA, 36 bp, Artificial Sequence
  Synthetic oligonucleotide
gcgacaaggcgaatcacgcgcatttcaacacaccga

SEQ ID NO: 32220 - DNA, 36 bp, Artificial Sequence
  Synthetic oligonucleotide
tctgagcgccacttctaaaaacactcacgcgatcga

SEQ ID NO: 32221 - DNA, 36 bp, Artificial Sequence
  Synthetic oligonucleotide
gttaggggtaggaaaagggggggttagaacaaagga

SEQ ID NO: 32222 - DNA, 38 bp, Artificial Sequence
  Synthetic oligonucleotide
gggggggtgatcagtggaggccggggaggtaagaatga

SEQ ID NO: 32223 - DNA, 35 bp, Artificial Sequence
  Synthetic oligonucleotide
ttcgcgacggatcgatctcctaaccgtcccttaac

SEQ ID NO: 32224 - DNA, 35 bp, Artificial Sequence
  Synthetic oligonucleotide
aacacgcattgcggaatagccctcttcgatcctac

SEQ ID NO: 32225 - DNA, 35 bp, Artificial Sequence
  Synthetic oligonucleotide
ggactacaacctgatcgacgcaaaccagacgcgcc

SEQ ID NO: 32226 - DNA, 35 bp, Artificial Sequence
  Synthetic oligonucleotide
gcgatccttgtcacccgttgtcccttgcccaggcc

SEQ ID NO: 32227 - DNA, 35 bp, Artificial Sequence
  Synthetic oligonucleotide
ggatagcctccatccatagcactgcatacctctcg

SEQ ID NO: 32228 - DNA, 35 bp, Artificial Sequence
  Synthetic oligonucleotide
gatgatagcagaatcagtgccccgccccctccatg

SEQ ID NO: 32229 - DNA, 34 bp, Artificial Sequence
  Synthetic oligonucleotide
gtttcaccgttcagcacaacctccttcacgttct

SEQ ID NO: 32230 - DNA, 35 bp, Artificial Sequence
  Synthetic oligonucleotide
tgtcctctgagcgataagcgaacggtgcattcctt

SEQ ID NO: 32231 - DNA, 36 bp, Artificial Sequence
  Synthetic oligonucleotide
gcacatccaccatgtccccacgctgcctgggcaaaa

SEQ ID NO: 32232 - DNA, 36 bp, Artificial Sequence
  Synthetic oligonucleotide
accactagcccaggccacctaatcgtttcactgcaa

SEQ ID NO: 32233 - DNA, 35 bp, Artificial Sequence
  Synthetic oligonucleotide
tcacgcgaacgcccctatggttacccggctcataa

SEQ ID NO: 32234 - DNA, 36 bp, Artificial Sequence
  Synthetic oligonucleotide
cccgctccatacattattaggctcaagatctttaca

SEQ ID NO: 32235 - DNA, 37 bp, Artificial Sequence
  Synthetic oligonucleotide
acctcgaccatcacgccatctaccgcagaacgctaga

SEQ ID NO: 32236 - DNA, 37 bp, Artificial Sequence
  Synthetic oligonucleotide
ttagacgcattcccctttgcacttgccactgtaccga

SEQ ID NO: 32237 - DNA, 37 bp, Artificial Sequence
  Synthetic oligonucleotide
ttgccagtaggtgcacccctcgtagtccttagcagga

SEQ ID NO: 32238 - DNA, 37 bp, Artificial Sequence
  Synthetic oligonucleotide
tagtgcgagacagaaatgttggcatagggtgggcgga

SEQ ID NO: 32239 - DNA, 37 bp, Artificial Sequence
  Synthetic oligonucleotide
gcccctcccgcatgtgcctgctgcctttctgctcgga

SEQ ID NO: 32240 - DNA, 37 bp, Artificial Sequence
  Synthetic oligonucleotide
actcaagaggaagatagggacaggggaggacaaggga

SEQ ID NO: 32241 - DNA, 38 bp, Artificial Sequence
  Synthetic oligonucleotide
tcacgccctgcatgttcccagctcactcgccgaaatga

SEQ ID NO: 32242 - DNA, 38 bp, Artificial Sequence
  Synthetic oligonucleotide
taggccatcagggcctctagcttatcactcttttatga

SEQ ID NO: 32243 - DNA, 37 bp, Artificial Sequence
  Synthetic oligonucleotide
gcactcgcgctctgtccgccacctccctctatagtga

SEQ ID NO: 32244 - DNA, 38 bp, Artificial Sequence
  Synthetic oligonucleotide
ccaccccctcgctttatagttcgatcacgcctcggtga

SEQ ID NO: 32245 - DNA, 35 bp, Artificial Sequence
  Synthetic oligonucleotide
atagcgagtcacactcacgacgataccctggccac

SEQ ID NO: 32246 - DNA, 35 bp, Artificial Sequence
  Synthetic oligonucleotide
aactcactcacactggcctaattaaagtacctgac

SEQ ID NO: 32247 - DNA, 35 bp, Artificial Sequence
  Synthetic oligonucleotide
agcgccaactgtcggtttccaccacctcaccttac

SEQ ID NO: 32248 - DNA, 35 bp, Artificial Sequence
  Synthetic oligonucleotide
atgccctgacttcacgccattggtgcctggttgcc

SEQ ID NO: 32249 - DNA, 35 bp, Artificial Sequence
  Synthetic oligonucleotide
tttgcaatccgtgtcaatgcctccgatcctgtctc

SEQ ID NO: 32250 - DNA, 35 bp, Artificial Sequence
  Synthetic oligonucleotide
gtctgacggctcaacctcctttcatcccgcaggtc

SEQ ID NO: 32251 - DNA, 35 bp, Artificial Sequence
  Synthetic oligonucleotide
tacgtggccgccctcccgttgtcgcttgtaacttc

SEQ ID NO: 32252 - DNA, 36 bp, Artificial Sequence
  Synthetic oligonucleotide
ttccgccccctcacctgctcttaggcatcaaccttg

SEQ ID NO: 32253 - DNA, 35 bp, Artificial Sequence
  Synthetic oligonucleotide
gaaccgcccggagaatctaccctatgcaaactgct

SEQ ID NO: 32254 - DNA, 35 bp, Artificial Sequence
  Synthetic oligonucleotide
tgttacgccgatattactcccttgtgcttacatct

SEQ ID NO: 32255 - DNA, 35 bp, Artificial Sequence
  Synthetic oligonucleotide
gtgctactgactcttcgccactcctcacaggctct

SEQ ID NO: 32256 - DNA, 36 bp, Artificial Sequence
  Synthetic oligonucleotide
tacttcccgcacatcccaacgtttcaccagtgaaaa

SEQ ID NO: 32257 - DNA, 36 bp, Artificial Sequence
  Synthetic oligonucleotide
acgatagccccgcactgcccggagctctcacacaca

SEQ ID NO: 32258 - DNA, 36 bp, Artificial Sequence
  Synthetic oligonucleotide
ttacgccccctgctttgaccgccaagatatcgtcca

SEQ ID NO: 32259 - DNA, 36 bp, Artificial Sequence
  Synthetic oligonucleotide
tgcgacgaacagctctcccaccgcgtccctacagca

SEQ ID NO: 32260 - DNA, 37 bp, Artificial Sequence
  Synthetic oligonucleotide
tgcggagccactatatttggccatacacgcttaacga

SEQ ID NO: 32261 - DNA, 36 bp, Artificial Sequence
  Synthetic oligonucleotide
atcctcgccaaccccctcgttgtgaatcaaccacga

SEQ ID NO: 32262 - DNA, 38 bp, Artificial Sequence
  Synthetic oligonucleotide
tcatgcctcacagtgcttgcccgaatttgcccttatga

SEQ ID NO: 32263 - DNA, 37 bp, Artificial Sequence
  Synthetic oligonucleotide
acatccgttcctgctgtcgtgcctctactcccggtga

SEQ ID NO: 32264 - DNA, 38 bp, Artificial Sequence
  Synthetic oligonucleotide
ttccggagggagcgacgggtcgggagggcaccgggtga

SEQ ID NO: 32265 - DNA, 37 bp, Artificial Sequence
  Synthetic oligonucleotide
gtcttggccccacgttttctcgatcgtacctccttga

SEQ ID NO: 32266 - DNA, 37 bp, Artificial Sequence
  Synthetic oligonucleotide
acccgcattatcatgtacgtaccgttatccctgttga

SEQ ID NO: 32267 - DNA, 35 bp, Artificial Sequence
  Synthetic oligonucleotide
tcgtggtccgcttccgtttcgctcctcgcatccac

SEQ ID NO: 32268 - DNA, 35 bp, Artificial Sequence
  Synthetic oligonucleotide
tcagcccacaatcctaaggcacttatgagtacccc

SEQ ID NO: 32269 - DNA, 35 bp, Artificial Sequence
  Synthetic oligonucleotide
gtagctggtgacacacgtacgccttaaattctgcc

SEQ ID NO: 32270 - DNA, 31 bp, Artificial Sequence
  Synthetic oligonucleotide
aaccccacactagttcgtcacccgctcacgc

SEQ ID NO: 32271 - DNA, 35 bp, Artificial Sequence
  Synthetic oligonucleotide
attgcggctgttcactatcctgctgtgtccccatg

SEQ ID NO: 32272 - DNA, 35 bp, Artificial Sequence
  Synthetic oligonucleotide
agtggggggggaggggaatagtcgcaggcttgttg

SEQ ID NO: 32273 - DNA, 37 bp, Artificial Sequence
  Synthetic oligonucleotide
gatgggggagggtaagggcttgtggatgaagggacga

SEQ ID NO: 32274 - DNA, 37 bp, Artificial Sequence
  Synthetic oligonucleotide
taaagggcacatgggggaatgggcacgaataaaggga

SEQ ID NO: 32275 - DNA, 38 bp, Artificial Sequence
  Synthetic oligonucleotide
gacgaggggaacaaggggggctttacgactgtccatga

SEQ ID NO: 32276 - DNA, 38 bp, Artificial Sequence
  Synthetic oligonucleotide
gacaggtgtagcggtggaacatgagggggggtacgtga

SEQ ID NO: 32277 - DNA, 38 bp, Artificial Sequence
  Synthetic oligonucleotide
gccacccctgcatgcacacttctgcggtccctgcttga

SEQ ID NO: 32278 - DNA, 36 bp, Artificial Sequence
  Synthetic oligonucleotide
agaaccgccccatatcaatggaacctgctaatttta

SEQ ID NO: 32279 - DNA, 35 bp, Artificial Sequence
  Synthetic oligonucleotide
acgtacggccgagtattaccaccccgccctacggc

SEQ ID NO: 32280 - DNA, 35 bp, Artificial Sequence
  Synthetic oligonucleotide
taacctgcacgcgccccgcaaaatccgtagtctat

SEQ ID NO: 32281 - DNA, 35 bp, Artificial Sequence
  Synthetic oligonucleotide
gcatgtggagaaggggatgaagcaaatacggtggt

SEQ ID NO: 32282 - DNA, 35 bp, Artificial Sequence
  Synthetic oligonucleotide
agtggagaggtaagaaaaggggatcgtagtgctgt

SEQ ID NO: 32283 - DNA, 35 bp, Artificial Sequence
  Synthetic oligonucleotide
tgatggtaggggcatggaggcaggtaggtaattgt

SEQ ID NO: 32284 - DNA, 36 bp, Artificial Sequence
  Synthetic oligonucleotide
taccgctacattgttgtttcgtctaattttcctcca

SEQ ID NO: 32285 - DNA, 37 bp, Artificial Sequence
  Synthetic oligonucleotide
attcctgccgaccccgctgtggttcattaccattcga

SEQ ID NO: 32286 - DNA, 37 bp, Artificial Sequence
  Synthetic oligonucleotide
ataccgatcgggtagggttaaagggtgggatagggga

SEQ ID NO: 32287 - DNA, 35 bp, Artificial Sequence
  Synthetic oligonucleotide
tgagggcatgttctggtggtggggggggaggtgga

SEQ ID NO: 32288 - DNA, 38 bp, Artificial Sequence
  Synthetic oligonucleotide
acaaataggccaggggggaaagtaggacggggacatga

SEQ ID NO: 32289 - DNA, 37 bp, Artificial Sequence
  Synthetic oligonucleotide
ggagtgggcgggcgggggtgacgggctgttattctga

SEQ ID NO: 32290 - DNA, 36 bp, Artificial Sequence
  Synthetic oligonucleotide
acgaagcactgtctgctccaccatcttgcgccgtta

SEQ ID NO: 32291 - DNA, 36 bp, Artificial Sequence
  Synthetic oligonucleotide
gtaggtgaataggttaaggggagagatggaggggag

SEQ ID NO: 32292 - DNA, 35 bp, Artificial Sequence
  Synthetic oligonucleotide
tgacgaaagagagagaagtaggacgggtgcgtgcg

SEQ ID NO: 32293 - DNA, 35 bp, Artificial Sequence
  Synthetic oligonucleotide
tccaacgtctcgcctgccctgcggtccactttggt

SEQ ID NO: 32294 - DNA, 34 bp, Artificial Sequence
  Synthetic oligonucleotide
acctagcctacctacccctctgcgtagcaacgaa

SEQ ID NO: 32295 - DNA, 36 bp, Artificial Sequence
  Synthetic oligonucleotide
gcccgtaacatcacgtgtcacaatgtcgctctttaa

SEQ ID NO: 32296 - DNA, 36 bp, Artificial Sequence
  Synthetic oligonucleotide
acacttcacaagcgccgattacgtccgtaccttcca

SEQ ID NO: 32297 - DNA, 36 bp, Artificial Sequence
  Synthetic oligonucleotide
gcctaagggcgctgtctctacctattactcctggca

SEQ ID NO: 32298 - DNA, 36 bp, Artificial Sequence
  Synthetic oligonucleotide
agtgctcaccgccgccctcagtccgctgtgccctca

SEQ ID NO: 32299 - DNA, 35 bp, Artificial Sequence
  Synthetic oligonucleotide
acttgcctactgcctcgataccatttcttaaacga

SEQ ID NO: 32300 - DNA, 37 bp, Artificial Sequence
  Synthetic oligonucleotide
acgcactccacaaccttcagtatgttcttcctgccga

SEQ ID NO: 32301 - DNA, 38 bp, Artificial Sequence
  Synthetic oligonucleotide
tgccacggtgtgggatgggattagggctggtggaatga

SEQ ID NO: 32302 - DNA, 37 bp, Artificial Sequence
  Synthetic oligonucleotide
gcatccccgccaactttgtagcgcactcgttccgtga

SEQ ID NO: 32303 - DNA, 35 bp, Artificial Sequence
  Synthetic oligonucleotide
agagctgcaaggctcgaaaatatgggtaggggata

SEQ ID NO: 32304 - DNA, 36 bp, Artificial Sequence
  Synthetic oligonucleotide
gctggtcgctacgaaactgccattccaatcgctcta

SEQ ID NO: 32305 - DNA, 35 bp, Artificial Sequence
  Synthetic oligonucleotide
gcatcctacgcagtaggtcctcccgatattactta

SEQ ID NO: 32306 - DNA, 34 bp, Artificial Sequence
  Synthetic oligonucleotide
tagcaagccccgcctgtccctacgatgaaatcac

SEQ ID NO: 32307 - DNA, 35 bp, Artificial Sequence
  Synthetic oligonucleotide
aacgacaccaggcctcgagtgaggctaacctgccc

SEQ ID NO: 32308 - DNA, 32 bp, Artificial Sequence
  Synthetic oligonucleotide
tcgagacgactctgtgtttccccccgccgtcc

SEQ ID NO: 32309 - DNA, 35 bp, Artificial Sequence
  Synthetic oligonucleotide
gcccacaccttcaaggtgttctttgccctctttcc

SEQ ID NO: 32310 - DNA, 35 bp, Artificial Sequence
  Synthetic oligonucleotide
gccaccggcactgacattaccaccgcaccttaatc

SEQ ID NO: 32311 - DNA, 35 bp, Artificial Sequence
  Synthetic oligonucleotide
acttacaccgactcttcgaacagccatgtacattg

SEQ ID NO: 32312 - DNA, 35 bp, Artificial Sequence
  Synthetic oligonucleotide
atgcacttggccgccgctcccgacgtcttcctttg

SEQ ID NO: 32313 - DNA, 35 bp, Artificial Sequence
  Synthetic oligonucleotide
gtgagcccttcggtacatggtccctttcttgccat

SEQ ID NO: 32314 - DNA, 36 bp, Artificial Sequence
  Synthetic oligonucleotide
atcatccgatccgctccgctaacaagtattggccct

SEQ ID NO: 32315 - DNA, 35 bp, Artificial Sequence
  Synthetic oligonucleotide
tccgcacttttggaatcggctcaggccttccttct

SEQ ID NO: 32316 - DNA, 35 bp, Artificial Sequence
  Synthetic oligonucleotide
actctgcgccttgtctcgccccatcctcagtggtt

SEQ ID NO: 32317 - DNA, 36 bp, Artificial Sequence
  Synthetic oligonucleotide
tcagtcacacccgctggatccccactgaacgaagaa

SEQ ID NO: 32318 - DNA, 36 bp, Artificial Sequence
  Synthetic oligonucleotide
gttaagcaccgagcggttacgccccacccgccctca

SEQ ID NO: 32319 - DNA, 35 bp, Artificial Sequence
  Synthetic oligonucleotide
actatgcccaccgcctctcctcatccctgacaaga

SEQ ID NO: 32320 - DNA, 37 bp, Artificial Sequence
  Synthetic oligonucleotide
gaacatccaactcacttaatacggtctctctcggaga

SEQ ID NO: 32321 - DNA, 37 bp, Artificial Sequence
  Synthetic oligonucleotide
agtccggtcggatctatagccgccgccgcccccacga

SEQ ID NO: 32322 - DNA, 37 bp, Artificial Sequence
  Synthetic oligonucleotide
gcaaagccacccctgcgatcccccacaattctatcga

SEQ ID NO: 32323 - DNA, 37 bp, Artificial Sequence
  Synthetic oligonucleotide
gcaaccccctcatcgtacccgcttggttaaacccgga

SEQ ID NO: 32324 - DNA, 37 bp, Artificial Sequence
  Synthetic oligonucleotide
acgtaatggcgagggagcaagacggtgtgggcgggga

SEQ ID NO: 32325 - DNA, 38 bp, Artificial Sequence
  Synthetic oligonucleotide
tgcctctcgcctcatcgaacactacgtcctacctttga

SEQ ID NO: 32326 - DNA, 35 bp, Artificial Sequence
  Synthetic oligonucleotide
tagccacatgtgtctgtccatcgcgttatccccta

SEQ ID NO: 32327 - DNA, 35 bp, Artificial Sequence
  Synthetic oligonucleotide
tactgcccgcacgagttatgtctagtcattctcta

SEQ ID NO: 32328 - DNA, 35 bp, Artificial Sequence
  Synthetic oligonucleotide
gccaaccgtacgtggcctatgttctgtctgtacac

SEQ ID NO: 32329 - DNA, 35 bp, Artificial Sequence
  Synthetic oligonucleotide
atagtagggtggaacggtaaggtgatgggagtccg

SEQ ID NO: 32330 - DNA, 35 bp, Artificial Sequence
  Synthetic oligonucleotide
tgacgtgacactacaccgctcaactttccacctcg

SEQ ID NO: 32331 - DNA, 36 bp, Artificial Sequence
  Synthetic oligonucleotide
gcgctagtttctgttcctctatttgcttaccgtttg

SEQ ID NO: 32332 - DNA, 35 bp, Artificial Sequence
  Synthetic oligonucleotide
aaagtgcaggaggggggtcaggaaagtacgcagat

SEQ ID NO: 32333 - DNA, 35 bp, Artificial Sequence
  Synthetic oligonucleotide
tgattccacgaacgtgtccgctcccaggatttact

SEQ ID NO: 32334 - DNA, 35 bp, Artificial Sequence
  Synthetic oligonucleotide
gtcagtacactgctttgctttaatctgtccctttt

SEQ ID NO: 32335 - DNA, 36 bp, Artificial Sequence
  Synthetic oligonucleotide
ttactgccagccctcgccatcttcgcctaggatcaa

SEQ ID NO: 32336 - DNA, 35 bp, Artificial Sequence
  Synthetic oligonucleotide
actgtcgccaaactcatttcatcacttcttcgaca

SEQ ID NO: 32337 - DNA, 35 bp, Artificial Sequence
  Synthetic oligonucleotide
ttaactccgccgtacgtgcccacccggatcttaca

SEQ ID NO: 32338 - DNA, 35 bp, Artificial Sequence
  Synthetic oligonucleotide
gctgccctatgacgtcttaccccgccaacgaatca

SEQ ID NO: 32339 - DNA, 35 bp, Artificial Sequence
  Synthetic oligonucleotide
taggaagtacggggggtgataggaggaggtgaaga

SEQ ID NO: 32340 - DNA, 37 bp, Artificial Sequence
  Synthetic oligonucleotide
gaacacctcaccgtttcacccattctgacactctaga

SEQ ID NO: 32341 - DNA, 37 bp, Artificial Sequence
  Synthetic oligonucleotide
tggggacgcctcgttcgatacttcgccatcctcccga

SEQ ID NO: 32342 - DNA, 37 bp, Artificial Sequence
  Synthetic oligonucleotide
acgggcgagggctgcaggggggattggtagtggggga

SEQ ID NO: 32343 - DNA, 38 bp, Artificial Sequence
  Synthetic oligonucleotide
gatactcccacccctacgctatacgattctgcccctga

SEQ ID NO: 32344 - DNA, 37 bp, Artificial Sequence
  Synthetic oligonucleotide
accgcacgcgtacctatttggcttccatctcgcctga

SEQ ID NO: 32345 - DNA, 37 bp, Artificial Sequence
  Synthetic oligonucleotide
tacgaggcgcacattgatccatgccatccgaaattga

SEQ ID NO: 32346 - DNA, 35 bp, Artificial Sequence
  Synthetic oligonucleotide
ttaacccatccgacggtgactttggtctgcatccc

SEQ ID NO: 32347 - DNA, 35 bp, Artificial Sequence
  Synthetic oligonucleotide
gataggcccccgaggtccctacatgttcttcctgc

SEQ ID NO: 32348 - DNA, 35 bp, Artificial Sequence
  Synthetic oligonucleotide
gacacagactgttcgtcgccaaccacttattttag

SEQ ID NO: 32349 - DNA, 35 bp, Artificial Sequence
  Synthetic oligonucleotide
tgctcacacccggccttgaacccaataaaccttcg

SEQ ID NO: 32350 - DNA, 35 bp, Artificial Sequence
  Synthetic oligonucleotide
ataacgcccggccctttctttgtctgccgcccagg

SEQ ID NO: 32351 - DNA, 35 bp, Artificial Sequence
  Synthetic oligonucleotide
atgaacccatcgccgctgcagtccctgcttcctat

SEQ ID NO: 32352 - DNA, 35 bp, Artificial Sequence
  Synthetic oligonucleotide
agtgctactgtacacctggcgatatccaataatct

SEQ ID NO: 32353 - DNA, 33 bp, Artificial Sequence
  Synthetic oligonucleotide
acccatgtagtacttgccgtccattctagttct

SEQ ID NO: 32354 - DNA, 35 bp, Artificial Sequence
  Synthetic oligonucleotide
acacacctaacctttgcgtttgagtactcgccttt

SEQ ID NO: 32355 - DNA, 36 bp, Artificial Sequence
  Synthetic oligonucleotide
gtcgcctcacctaaatgcatctgtttcttcctacaa

SEQ ID NO: 32356 - DNA, 36 bp, Artificial Sequence
  Synthetic oligonucleotide
aagcaatctatcagtggccgtcgctactccacccca

SEQ ID NO: 32357 - DNA, 36 bp, Artificial Sequence
  Synthetic oligonucleotide
gcactgtgtgcccttatttgccttcccttgatgtca

SEQ ID NO: 32358 - DNA, 37 bp, Artificial Sequence
  Synthetic oligonucleotide
gtgaatgtgtaggagtaggtaagaagtgcggtgaaga

SEQ ID NO: 32359 - DNA, 37 bp, Artificial Sequence
  Synthetic oligonucleotide
ggtgaggccacgtactgaaattggtaggggctggaga

SEQ ID NO: 32360 - DNA, 37 bp, Artificial Sequence
  Synthetic oligonucleotide
accgcaatgctatccgcttagattactgatccataga

SEQ ID NO: 32361 - DNA, 37 bp, Artificial Sequence
  Synthetic oligonucleotide
accatccacaagtttaattggcctgcccttcgaccga

SEQ ID NO: 32362 - DNA, 35 bp, Artificial Sequence
  Synthetic oligonucleotide
gtcatcctggctcccagttaacgcactcctaccga

SEQ ID NO: 32363 - DNA, 37 bp, Artificial Sequence
  Synthetic oligonucleotide
actcgccagcttccactcccttccgtccacatggcga

SEQ ID NO: 32364 - DNA, 37 bp, Artificial Sequence
  Synthetic oligonucleotide
tgttggaggcgcaacacggggggacaggggatcggga

SEQ ID NO: 32365 - DNA, 38 bp, Artificial Sequence
  Synthetic oligonucleotide
gtagccccgccctttattagcccatcccgctaccctga

SEQ ID NO: 32366 - DNA, 38 bp, Artificial Sequence
  Synthetic oligonucleotide
gtcaaaagaggcatggtggaggagatgggaacatgtga

SEQ ID NO: 32367 - DNA, 38 bp, Artificial Sequence
  Synthetic oligonucleotide
gaccccattaccggtggtactatgtccagtacctgtga

SEQ ID NO: 32368 - DNA, 38 bp, Artificial Sequence
  Synthetic oligonucleotide
tcgataacctctccgaatgtttgcacagttagctgtga

SEQ ID NO: 32369 - DNA, 38 bp, Artificial Sequence
  Synthetic oligonucleotide
tcaccagttgacgaatcttgtaccgaccccttgcttga

SEQ ID NO: 32370 - DNA, 38 bp, Artificial Sequence
  Synthetic oligonucleotide
gatgcccagccttcctgctagtataccttgcactttga

SEQ ID NO: 32371 - DNA, 35 bp, Artificial Sequence
  Synthetic oligonucleotide
tccacttgcccacatatattcccacacgtggggac

SEQ ID NO: 32372 - DNA, 35 bp, Artificial Sequence
  Synthetic oligonucleotide
ggactcagcagaacctacactcgtctgttacctac

SEQ ID NO: 32373 - DNA, 35 bp, Artificial Sequence
  Synthetic oligonucleotide
tcgacctgagcatctggaatgggaccatcttcacc

SEQ ID NO: 32374 - DNA, 35 bp, Artificial Sequence
  Synthetic oligonucleotide
acccctcgaacggactagtatgtctcacaatcccc

SEQ ID NO: 32375 - DNA, 35 bp, Artificial Sequence
  Synthetic oligonucleotide
tgagcatcactctcgcaactgccctgcctttgtcg

SEQ ID NO: 32376 - DNA, 35 bp, Artificial Sequence
  Synthetic oligonucleotide
gctacacctcgatctcgccatggacaagtgtccct

SEQ ID NO: 32377 - DNA, 35 bp, Artificial Sequence
  Synthetic oligonucleotide
acatgtcctcgtgtccatgtgcctttgcctcgcct

SEQ ID NO: 32378 - DNA, 35 bp, Artificial Sequence
  Synthetic oligonucleotide
aactctagggaggggtcagccggggatgaggggaa

SEQ ID NO: 32379 - DNA, 36 bp, Artificial Sequence
  Synthetic oligonucleotide
tctgcccaccttatatatgctgtcatagccaatgaa

SEQ ID NO: 32380 - DNA, 36 bp, Artificial Sequence
  Synthetic oligonucleotide
gttcactcgcttgacatcacttgcccaggttcctaa

SEQ ID NO: 32381 - DNA, 36 bp, Artificial Sequence
  Synthetic oligonucleotide
gtgatggggaggaatcgaaagaaaggaagtcgctaa

SEQ ID NO: 32382 - DNA, 34 bp, Artificial Sequence
  Synthetic oligonucleotide
agtgatcgtgctgtcacatccaggttcactgcca

SEQ ID NO: 32383 - DNA, 36 bp, Artificial Sequence
  Synthetic oligonucleotide
gccacataatatcgggctgagaacacccaacctgca

SEQ ID NO: 32384 - DNA, 36 bp, Artificial Sequence
  Synthetic oligonucleotide
tgatcacctggggccctagttttgttacctcgttca

SEQ ID NO: 32385 - DNA, 37 bp, Artificial Sequence
  Synthetic oligonucleotide
actggtgcctcagctatctacgtaccatccaatgcga

SEQ ID NO: 32386 - DNA, 37 bp, Artificial Sequence
  Synthetic oligonucleotide
tccgaacctcgcgcctaacccgtcccacccacccgga

SEQ ID NO: 32387 - DNA, 35 bp, Artificial Sequence
  Synthetic oligonucleotide
gcatacgtacaatgcctcaccctccgacccaggga

SEQ ID NO: 32388 - DNA, 37 bp, Artificial Sequence
  Synthetic oligonucleotide
aatggaggagggtgggtgaacgcatcggactggggga

SEQ ID NO: 32389 - DNA, 37 bp, Artificial Sequence
  Synthetic oligonucleotide
agacaggcggggcgggaaaggggaaactcggaatgga

SEQ ID NO: 32390 - DNA, 38 bp, Artificial Sequence
  Synthetic oligonucleotide
tgaaacccccccaacagtgctagcaccagtcaccatga

SEQ ID NO: 32391 - DNA, 38 bp, Artificial Sequence
  Synthetic oligonucleotide
acaccccgatggtgccagaacatcccatatccccatga

SEQ ID NO: 32392 - DNA, 38 bp, Artificial Sequence
  Synthetic oligonucleotide
accctgcgaccggtaatgaactccggcctccctcttga

SEQ ID NO: 32393 - DNA, 36 bp, Artificial Sequence
  Synthetic oligonucleotide
gagtcggtgcaccgttaatagcctctaccttctcta

SEQ ID NO: 32394 - DNA, 35 bp, Artificial Sequence
  Synthetic oligonucleotide
agacgcccatctctggcgtcccatttccttccgta

SEQ ID NO: 32395 - DNA, 36 bp, Artificial Sequence
  Synthetic oligonucleotide
tagcaccacaaccccttggtaagctcgacactggta

SEQ ID NO: 32396 - DNA, 35 bp, Artificial Sequence
  Synthetic oligonucleotide
gaccacttggagctcgccttggtttaaatccaccc

SEQ ID NO: 32397 - DNA, 35 bp, Artificial Sequence
  Synthetic oligonucleotide
aacacgcgcccacgcacgtttacatccgccttccc

SEQ ID NO: 32398 - DNA, 35 bp, Artificial Sequence
  Synthetic oligonucleotide
ttagccctgacggaaccccccgagacctgttctcc

SEQ ID NO: 32399 - DNA, 35 bp, Artificial Sequence
  Synthetic oligonucleotide
acgcctacccccccagaatgcgcgaatatctgtcc

SEQ ID NO: 32400 - DNA, 35 bp, Artificial Sequence
  Synthetic oligonucleotide
tgtttatggcccactcgagcgcacccgcaccattc

SEQ ID NO: 32401 - DNA, 35 bp, Artificial Sequence
  Synthetic oligonucleotide
ttcccatgcccgcctactcacgaacataacttatg

SEQ ID NO: 32402 - DNA, 35 bp, Artificial Sequence
  Synthetic oligonucleotide
gcgtgtgggaggggaaaggtaggagaaagatcgtg

SEQ ID NO: 32403 - DNA, 28 bp, Artificial Sequence
  Synthetic oligonucleotide
tctacctggcccgacgcctctgcctggt

SEQ ID NO: 32404 - DNA, 35 bp, Artificial Sequence
  Synthetic oligonucleotide
gacacgtgtgaggcccctctcaacaccaccttgtt

SEQ ID NO: 32405 - DNA, 36 bp, Artificial Sequence
  Synthetic oligonucleotide
tcaggtccccatccattgttttgttttaccgcctaa

SEQ ID NO: 32406 - DNA, 36 bp, Artificial Sequence
  Synthetic oligonucleotide
actcagacttacacctctgctaaattgcacctgcca

SEQ ID NO: 32407 - DNA, 35 bp, Artificial Sequence
  Synthetic oligonucleotide
gtgtcatccgctgcggtagtcataccacatgtcca

SEQ ID NO: 32408 - DNA, 36 bp, Artificial Sequence
  Synthetic oligonucleotide
tcacgtagagcacctgtcccacaccgttcctgtgca

SEQ ID NO: 32409 - DNA, 35 bp, Artificial Sequence
  Synthetic oligonucleotide
tcccagaacatcacccgcactacattcgagacaga

SEQ ID NO: 32410 - DNA, 37 bp, Artificial Sequence
  Synthetic oligonucleotide
tgttccatgccctctacccatgtcgatttaatgtcga

SEQ ID NO: 32411 - DNA, 37 bp, Artificial Sequence
  Synthetic oligonucleotide
tgcactgccgatgacctcgcctacttggattaactga

SEQ ID NO: 32412 - DNA, 38 bp, Artificial Sequence
  Synthetic oligonucleotide
ttctccatccctgccgccacccagccacagacacctga

SEQ ID NO: 32413 - DNA, 35 bp, Artificial Sequence
  Synthetic oligonucleotide
tcactgccgggcttactctcaggttccacttttga

SEQ ID NO: 32414 - DNA, 36 bp, Artificial Sequence
  Synthetic oligonucleotide
ttcgtcccagacgaaggctgccaacaccactccgta

SEQ ID NO: 32415 - DNA, 35 bp, Artificial Sequence
  Synthetic oligonucleotide
ttgtccgtcgtggtcctgtttccccaaattcctta

SEQ ID NO: 32416 - DNA, 36 bp, Artificial Sequence
  Synthetic oligonucleotide
atgggcacatgggggagagtgataggggcgcggtta

SEQ ID NO: 32417 - DNA, 35 bp, Artificial Sequence
  Synthetic oligonucleotide
atgacgtacattacgtcgttcacctttgctctgcc

SEQ ID NO: 32418 - DNA, 35 bp, Artificial Sequence
  Synthetic oligonucleotide
tccgggacggcttcttaaactgcgtgctttcatcc

SEQ ID NO: 32419 - DNA, 35 bp, Artificial Sequence
  Synthetic oligonucleotide
ttggtaggtgccgaagcgaaattacccgatcctcc

SEQ ID NO: 32420 - DNA, 35 bp, Artificial Sequence
  Synthetic oligonucleotide
agacccgccattacctgtccactattctccttcag

SEQ ID NO: 32421 - DNA, 35 bp, Artificial Sequence
  Synthetic oligonucleotide
tgcctacgctctacacgggttacgttcctccatag

SEQ ID NO: 32422 - DNA, 35 bp, Artificial Sequence
  Synthetic oligonucleotide
gtcattacctcatcgccatttatctaacacgcttg

SEQ ID NO: 32423 - DNA, 35 bp, Artificial Sequence
  Synthetic oligonucleotide
agaatggtacggggcgagggacttgaatgagcggt

SEQ ID NO: 32424 - DNA, 36 bp, Artificial Sequence
  Synthetic oligonucleotide
caccctacccgccctatgtgctacacccaccttcaa

SEQ ID NO: 32425 - DNA, 35 bp, Artificial Sequence
  Synthetic oligonucleotide
gtcaacttcgccgtaaagtccttcgttcacatcca

SEQ ID NO: 32426 - DNA, 36 bp, Artificial Sequence
  Synthetic oligonucleotide
gcctactctgcccctgatggctcagtgcccatccga

SEQ ID NO: 32427 - DNA, 38 bp, Artificial Sequence
  Synthetic oligonucleotide
gtacgccctccccccgtacgtgtctatcgtccccatga

SEQ ID NO: 32428 - DNA, 38 bp, Artificial Sequence
  Synthetic oligonucleotide
attcgacaaccgccacaactctctacccctgcatatga

SEQ ID NO: 32429 - DNA, 38 bp, Artificial Sequence
  Synthetic oligonucleotide
atgagaacagggtcagggaggagagagaaggcacgtga

SEQ ID NO: 32430 - DNA, 38 bp, Artificial Sequence
  Synthetic oligonucleotide
gacgcaaccccacgaccttgtctacgtaccatacttga

SEQ ID NO: 32431 - DNA, 35 bp, Artificial Sequence
  Synthetic oligonucleotide
gtgtcggacacccctcgccgccttcgccaaccgta

SEQ ID NO: 32432 - DNA, 36 bp, Artificial Sequence
  Synthetic oligonucleotide
acccacccgtttctcctggcaagtattggccgttta

SEQ ID NO: 32433 - DNA, 35 bp, Artificial Sequence
  Synthetic oligonucleotide
aacaccgtatgatcaacggttacatgatctccccc

SEQ ID NO: 32434 - DNA, 35 bp, Artificial Sequence
  Synthetic oligonucleotide
aacaccctggtccatcattttcgctggtgtcccct

SEQ ID NO: 32435 - DNA, 35 bp, Artificial Sequence
  Synthetic oligonucleotide
tccaaccttacggacctcgactgcacccggccatt

SEQ ID NO: 32436 - DNA, 37 bp, Artificial Sequence
  Synthetic oligonucleotide
attgcaggccccaccatgacgaacgactcacctccga

SEQ ID NO: 32437 - DNA, 37 bp, Artificial Sequence
  Synthetic oligonucleotide
ttgggtgacaatacatacgtatgaagggaggggggga

SEQ ID NO: 32438 - DNA, 38 bp, Artificial Sequence
  Synthetic oligonucleotide
tgagggggggggcgaagatgatgcaggggcgatcgtga

SEQ ID NO: 32439 - DNA, 38 bp, Artificial Sequence
  Synthetic oligonucleotide
gggaggttgagggcaggaagttggctacgggtgggtga

SEQ ID NO: 32440 - DNA, 38 bp, Artificial Sequence
  Synthetic oligonucleotide
tcccagtcgcccacgccgtgcgcctccagccatgttga

SEQ ID NO: 32441 - DNA, 35 bp, Artificial Sequence
  Synthetic oligonucleotide
gctgacacccttaccttcactgtacgctaccaata

SEQ ID NO: 32442 - DNA, 35 bp, Artificial Sequence
  Synthetic oligonucleotide
tgcatactatctcgatgattactcgccatccatac

SEQ ID NO: 32443 - DNA, 35 bp, Artificial Sequence
  Synthetic oligonucleotide
ttatcgttgcgctatacgctgcccctccgctcctc

SEQ ID NO: 32444 - DNA, 35 bp, Artificial Sequence
  Synthetic oligonucleotide
tcagttactgttcgccaattccctctccggaggag

SEQ ID NO: 32445 - DNA, 35 bp, Artificial Sequence
  Synthetic oligonucleotide
gactgactgatctcccctgctttcttttcaacgcg

SEQ ID NO: 32446 - DNA, 35 bp, Artificial Sequence
  Synthetic oligonucleotide
acccccctcaagccgtgtcattctgctcacgactg

SEQ ID NO: 32447 - DNA, 35 bp, Artificial Sequence
  Synthetic oligonucleotide
gtcgatgcgtggtctatctttctcccccgatgctt

SEQ ID NO: 32448 - DNA, 35 bp, Artificial Sequence
  Synthetic oligonucleotide
tcaccacggacctccgcaactctaacgcacttgtt

SEQ ID NO: 32449 - DNA, 36 bp, Artificial Sequence
  Synthetic oligonucleotide
gaacggggtggcacaggacggaagaactgagggcga

SEQ ID NO: 32450 - DNA, 37 bp, Artificial Sequence
  Synthetic oligonucleotide
gacccttgcctctctcctggccgccatccgttccgga

SEQ ID NO: 32451 - DNA, 37 bp, Artificial Sequence
  Synthetic oligonucleotide
gtcccagggaggtggaatggaaggggtaggtttggga

SEQ ID NO: 32452 - DNA, 37 bp, Artificial Sequence
  Synthetic oligonucleotide
acacttccggccatgactatacgcccaaccaatatga

SEQ ID NO: 32453 - DNA, 38 bp, Artificial Sequence
  Synthetic oligonucleotide
ggatcctgcccactgacaaattaactgcttgtctctga

SEQ ID NO: 32454 - DNA, 38 bp, Artificial Sequence
  Synthetic oligonucleotide
tgccagccgccggtgtgccggcctacctgcccctttga

SEQ ID NO: 32455 - DNA, 35 bp, Artificial Sequence
  Synthetic oligonucleotide
agttcgatgcctttcccgccacgccatgtctgcac

SEQ ID NO: 32456 - DNA, 35 bp, Artificial Sequence
  Synthetic oligonucleotide
taggcgaaagccaacaatctctatcactgccggac

SEQ ID NO: 32457 - DNA, 35 bp, Artificial Sequence
  Synthetic oligonucleotide
acccatgcaggccattgctcccatatgcccactac

SEQ ID NO: 32458 - DNA, 35 bp, Artificial Sequence
  Synthetic oligonucleotide
tgacgacagccgcggagctttgacgtctagccacc

SEQ ID NO: 32459 - DNA, 35 bp, Artificial Sequence
  Synthetic oligonucleotide
gctgacgactgactgccctgatcgacctcgcacgc

SEQ ID NO: 32460 - DNA, 35 bp, Artificial Sequence
  Synthetic oligonucleotide
actcgttgtctgtcacccccgccaccgtcgacctc

SEQ ID NO: 32461 - DNA, 28 bp, Artificial Sequence
  Synthetic oligonucleotide
ttgaccgggtcgccttctgcccatttcg

SEQ ID NO: 32462 - DNA, 35 bp, Artificial Sequence
  Synthetic oligonucleotide
tacagggagggaagagtggcgtgtcctgggtaagg

SEQ ID NO: 32463 - DNA, 35 bp, Artificial Sequence
  Synthetic oligonucleotide
actccggcgctcaccacatcgttcatcgtcctcct

SEQ ID NO: 32464 - DNA, 35 bp, Artificial Sequence
  Synthetic oligonucleotide
tgtaacgcgtctgcttattccattgcctcaccgct

SEQ ID NO: 32465 - DNA, 35 bp, Artificial Sequence
  Synthetic oligonucleotide
gtttgtcacccaggcctccatactgatcagtttgt

SEQ ID NO: 32466 - DNA, 35 bp, Artificial Sequence
  Synthetic oligonucleotide
aaccgccggattctccacacccgcgatttcccgtt

SEQ ID NO: 32467 - DNA, 36 bp, Artificial Sequence
  Synthetic oligonucleotide
ttagtcagacatcgcttgccctatctgaccctgtaa

SEQ ID NO: 32468 - DNA, 36 bp, Artificial Sequence
  Synthetic oligonucleotide
acaccatgcactgggctgaaggtcaaaggcccccca

SEQ ID NO: 32469 - DNA, 36 bp, Artificial Sequence
  Synthetic oligonucleotide
gcgatgtagggggaggggactcatagcacgtggtca

SEQ ID NO: 32470 - DNA, 37 bp, Artificial Sequence
  Synthetic oligonucleotide
agcgaaggggtggccgggataggggcgctgaagaaga

SEQ ID NO: 32471 - DNA, 37 bp, Artificial Sequence
  Synthetic oligonucleotide
agttcaccactgttccctcaccatgagacggtaacga

SEQ ID NO: 32472 - DNA, 37 bp, Artificial Sequence
  Synthetic oligonucleotide
tgtttgcgcatcctctttacagcatagctctccccga

SEQ ID NO: 32473 - DNA, 37 bp, Artificial Sequence
  Synthetic oligonucleotide
tatccctccgcacgggtttatcttagcctcgtatcga

SEQ ID NO: 32474 - DNA, 37 bp, Artificial Sequence
  Synthetic oligonucleotide
agcgctcgcaacccgttcttttgtctgttcccaagga

SEQ ID NO: 32475 - DNA, 36 bp, Artificial Sequence
  Synthetic oligonucleotide
gcacggccactcacctacgttattatgcaccacgga

SEQ ID NO: 32476 - DNA, 38 bp, Artificial Sequence
  Synthetic oligonucleotide
actcagggcggggcatggagcagatatgcggaacatga

SEQ ID NO: 32477 - DNA, 38 bp, Artificial Sequence
  Synthetic oligonucleotide
gatccgatccatggcccatatacccgctagtcacttga

SEQ ID NO: 32478 - DNA, 38 bp, Artificial Sequence
  Synthetic oligonucleotide
tgcacaaggggggaaagagagactgaacgcagcgttga

SEQ ID NO: 32479 - DNA, 38 bp, Artificial Sequence
  Synthetic oligonucleotide
gcgtaggacagggagaaaggtgagggggcgtgggttga

SEQ ID NO: 32480 - DNA, 37 bp, Artificial Sequence
  Synthetic oligonucleotide
gtcaccatcgaatccgtcgcacccttgccaagtttga

SEQ ID NO: 32481 - DNA, 36 bp, Artificial Sequence
  Synthetic oligonucleotide
gccgactgcgagccgaattttccgccgtttctcata

SEQ ID NO: 32482 - DNA, 36 bp, Artificial Sequence
  Synthetic oligonucleotide
acatccccacggcactttaaccacctgacaccgcta

SEQ ID NO: 32483 - DNA, 36 bp, Artificial Sequence
  Synthetic oligonucleotide
tgaccggtagttaccactgaactactgccttccgta

SEQ ID NO: 32484 - DNA, 35 bp, Artificial Sequence
  Synthetic oligonucleotide
tagcgctcatgccccctttatctctcgacttccac

SEQ ID NO: 32485 - DNA, 35 bp, Artificial Sequence
  Synthetic oligonucleotide
gagctcacagtccgtctacctgcccttttgtggac

SEQ ID NO: 32486 - DNA, 35 bp, Artificial Sequence
  Synthetic oligonucleotide
gtcccatgtcgaacccgcccccaactttgtgacaa

SEQ ID NO: 32487 - DNA, 36 bp, Artificial Sequence
  Synthetic oligonucleotide
acgcaatggcacatctgtggtccatccatcttgcaa

SEQ ID NO: 32488 - DNA, 36 bp, Artificial Sequence
  Synthetic oligonucleotide
gtagggaaggttgggggggggcgggtacccagtgca

SEQ ID NO: 32489 - DNA, 37 bp, Artificial Sequence
  Synthetic oligonucleotide
tcaagaacagtggcaaagactgcagggagggtggtga

SEQ ID NO: 32490 - DNA, 37 bp, Artificial Sequence
  Synthetic oligonucleotide
gccacctcgggccgatctacataactagcaccattga

SEQ ID NO: 32491 - DNA, 35 bp, Artificial Sequence
  Synthetic oligonucleotide
ttgagccacttaccatcttgtttttggggaggacc

SEQ ID NO: 32492 - DNA, 35 bp, Artificial Sequence
  Synthetic oligonucleotide
atcgcggggctccatttcgtttatctcatcggtcc

SEQ ID NO: 32493 - DNA, 35 bp, Artificial Sequence
  Synthetic oligonucleotide
tcaacagacacaaggccagctgaggctccttttcc

SEQ ID NO: 32494 - DNA, 35 bp, Artificial Sequence
  Synthetic oligonucleotide
agcgtgggggagggggcggtggcaaagtgggcatc

SEQ ID NO: 32495 - DNA, 35 bp, Artificial Sequence
  Synthetic oligonucleotide
taacccggcgtgctatggctccttgacacatcctc

SEQ ID NO: 32496 - DNA, 36 bp, Artificial Sequence
  Synthetic oligonucleotide
aaccgacacgggaaggcctccacaacgccacttttg

SEQ ID NO: 32497 - DNA, 35 bp, Artificial Sequence
  Synthetic oligonucleotide
acccaagccctcggagtcatccacgctcatactgt

SEQ ID NO: 32498 - DNA, 35 bp, Artificial Sequence
  Synthetic oligonucleotide
tcaacccaaccattcagttacgcttgcgctttgtt

SEQ ID NO: 32499 - DNA, 35 bp, Artificial Sequence
  Synthetic oligonucleotide
gaaatccattcatgcgcacattgaccttgccccaa

SEQ ID NO: 32500 - DNA, 36 bp, Artificial Sequence
  Synthetic oligonucleotide
attggcggaggaatccgtgatgctgggggggagtaa

SEQ ID NO: 32501 - DNA, 36 bp, Artificial Sequence
  Synthetic oligonucleotide
ttggcccacaaatcgtgccgctctcatctattacca

SEQ ID NO: 32502 - DNA, 36 bp, Artificial Sequence
  Synthetic oligonucleotide
tccgacacgaaatcggaacgggaaaagggggggcca

SEQ ID NO: 32503 - DNA, 37 bp, Artificial Sequence
  Synthetic oligonucleotide
tgaatgacaaaggtgggaattactggctcggggacga

SEQ ID NO: 32504 - DNA, 37 bp, Artificial Sequence
  Synthetic oligonucleotide
gcggggggggaagggtgggtgcgtggtctgtacggga

SEQ ID NO: 32505 - DNA, 36 bp, Artificial Sequence
  Synthetic oligonucleotide
gacgatgagggaaacgttgtatgggtgatgggggga

SEQ ID NO: 32506 - DNA, 38 bp, Artificial Sequence
  Synthetic oligonucleotide
gcagacccgtttcaccctttatccctgcccgactgtga

SEQ ID NO: 32507 - DNA, 36 bp, Artificial Sequence
  Synthetic oligonucleotide
tagcacaccctctgaagaactaaacgtcgctgccta

SEQ ID NO: 32508 - DNA, 35 bp, Artificial Sequence
  Synthetic oligonucleotide
gaagggcgaaagggtgaacgggggtgcacagtgta

SEQ ID NO: 32509 - DNA, 35 bp, Artificial Sequence
  Synthetic oligonucleotide
atggtcactccagctctgccggtccggcttccacc

SEQ ID NO: 32510 - DNA, 35 bp, Artificial Sequence
  Synthetic oligonucleotide
ttcagtctgccccgtcgcccgctattcccaaatcc

SEQ ID NO: 32511 - DNA, 35 bp, Artificial Sequence
  Synthetic oligonucleotide
gtcactcctgccgctgtattattttgagtgcgatc

SEQ ID NO: 32512 - DNA, 35 bp, Artificial Sequence
  Synthetic oligonucleotide
tgtcgcgacgtttagtctcccttcagtacggcctc

SEQ ID NO: 32513 - DNA, 35 bp, Artificial Sequence
  Synthetic oligonucleotide
tacacgacgggtgaagatgttagggggagtagggg

SEQ ID NO: 32514 - DNA, 35 bp, Artificial Sequence
  Synthetic oligonucleotide
tgcactctaagtatgtcgctttaccctattgccct

SEQ ID NO: 32515 - DNA, 35 bp, Artificial Sequence
  Synthetic oligonucleotide
actgacctaccatgtaactgagctgcttggcctct

SEQ ID NO: 32516 - DNA, 35 bp, Artificial Sequence
  Synthetic oligonucleotide
ggaatccgtacggagggtggtgttggctttgattt

SEQ ID NO: 32517 - DNA, 35 bp, Artificial Sequence
  Synthetic oligonucleotide
ttcgtcccgtcctgcttgacctcccttaccagttt

SEQ ID NO: 32518 - DNA, 36 bp, Artificial Sequence
  Synthetic oligonucleotide
ttcgctcccgcccctcgcgtagactcaaaagtctaa

SEQ ID NO: 32519 - DNA, 36 bp, Artificial Sequence
  Synthetic oligonucleotide
tccacacgccctatctttacactgcttcccggaaga

SEQ ID NO: 32520 - DNA, 36 bp, Artificial Sequence
  Synthetic oligonucleotide
gtgccacagcaatggctgcctaggagagggggtgga

SEQ ID NO: 32521 - DNA, 38 bp, Artificial Sequence
  Synthetic oligonucleotide
ttcacgccacgtgatgcatagttcacacctctacatga

SEQ ID NO: 32522 - DNA, 38 bp, Artificial Sequence
  Synthetic oligonucleotide
gagacacgaaggaagaacgcgggaactggtgggggtga

SEQ ID NO: 32523 - DNA, 35 bp, Artificial Sequence
  Synthetic oligonucleotide
gtccatccccgtaagtctgctccaaatctagcgac

SEQ ID NO: 32524 - DNA, 35 bp, Artificial Sequence
  Synthetic oligonucleotide
ggtgcgggctgccattcactctctctctagtttcc

SEQ ID NO: 32525 - DNA, 34 bp, Artificial Sequence
  Synthetic oligonucleotide
gtagaccccacccactcggccttgctcggatcgc

SEQ ID NO: 32526 - DNA, 35 bp, Artificial Sequence
  Synthetic oligonucleotide
gcgtgccagtcctctatagtccatacacgtccgtc

SEQ ID NO: 32527 - DNA, 35 bp, Artificial Sequence
  Synthetic oligonucleotide
gccacagctcttgcagtccatttgaatgacctttc

SEQ ID NO: 32528 - DNA, 35 bp, Artificial Sequence
  Synthetic oligonucleotide
acaacccatggcccaacttatcgcaacagtattag

SEQ ID NO: 32529 - DNA, 35 bp, Artificial Sequence
  Synthetic oligonucleotide
tgttgctcctccacatgttccgtatcactgtaccg

SEQ ID NO: 32530 - DNA, 35 bp, Artificial Sequence
  Synthetic oligonucleotide
acctctccgatccaccgcgccttttcgactccagg

SEQ ID NO: 32531 - DNA, 35 bp, Artificial Sequence
  Synthetic oligonucleotide
attaacgaaaaggcgacgaagagggaggtagatgg

SEQ ID NO: 32532 - DNA, 35 bp, Artificial Sequence
  Synthetic oligonucleotide
tcgtaggaccgccgcatgatacctcgtaatgtcct

SEQ ID NO: 32533 - DNA, 35 bp, Artificial Sequence
  Synthetic oligonucleotide
gtcactcaacaaaggggaaggaaagggcgatcttt

SEQ ID NO: 32534 - DNA, 36 bp, Artificial Sequence
  Synthetic oligonucleotide
gcataccgacccggggctacctccacatacacgcaa

SEQ ID NO: 32535 - DNA, 36 bp, Artificial Sequence
  Synthetic oligonucleotide
gactcgtggccccgtatctgggtctgtcaccctcaa

SEQ ID NO: 32536 - DNA, 34 bp, Artificial Sequence
  Synthetic oligonucleotide
gatacctcaaatgcccttgctccatcgacataca

SEQ ID NO: 32537 - DNA, 29 bp, Artificial Sequence
  Synthetic oligonucleotide
gagcacctcatcccacactatgattgcca

SEQ ID NO: 32538 - DNA, 36 bp, Artificial Sequence
  Synthetic oligonucleotide
tccgtgcgtggtttctgtccagtaccctcccatcca

SEQ ID NO: 32539 - DNA, 37 bp, Artificial Sequence
  Synthetic oligonucleotide
gcaggaatggggtaggcgggcagggcgttctgggaga

SEQ ID NO: 32540 - DNA, 37 bp, Artificial Sequence
  Synthetic oligonucleotide
gccgatcgccttcctccatgtcatttcaaagactaga

SEQ ID NO: 32541 - DNA, 37 bp, Artificial Sequence
  Synthetic oligonucleotide
atcgcctcaatttttaaccaccaccctggtccctaga

SEQ ID NO: 32542 - DNA, 36 bp, Artificial Sequence
  Synthetic oligonucleotide
ggacccggtcagttatcactacgcgctcattcccga

SEQ ID NO: 32543 - DNA, 37 bp, Artificial Sequence
  Synthetic oligonucleotide
taggagtagcagggggaagagggaacctatcatggga

SEQ ID NO: 32544 - DNA, 37 bp, Artificial Sequence
  Synthetic oligonucleotide
ttacctgtacgcctgtctcccatctgccccaattgga

SEQ ID NO: 32545 - DNA, 38 bp, Artificial Sequence
  Synthetic oligonucleotide
acctgcaccctgctcccaccgagtcactggaaaagtga

SEQ ID NO: 32546 - DNA, 37 bp, Artificial Sequence
  Synthetic oligonucleotide
agcgaacgcaaaaggttgggagctggggattctgtga

SEQ ID NO: 32547 - DNA, 35 bp, Artificial Sequence
  Synthetic oligonucleotide
tttaaggcccctccgacagccacgccgccatatgc

SEQ ID NO: 32548 - DNA, 35 bp, Artificial Sequence
  Synthetic oligonucleotide
gccacaatctgctcagggctctcgtaacattggtc

SEQ ID NO: 32549 - DNA, 35 bp, Artificial Sequence
  Synthetic oligonucleotide
taagtcaggggcaaaggaagggtgcaagtcacacg

SEQ ID NO: 32550 - DNA, 35 bp, Artificial Sequence
  Synthetic oligonucleotide
gtccccattcacttttgtactgcatactttccacg

SEQ ID NO: 32551 - DNA, 35 bp, Artificial Sequence
  Synthetic oligonucleotide
atccgtccttggccttattaaccgctccctgcttg

SEQ ID NO: 32552 - DNA, 35 bp, Artificial Sequence
  Synthetic oligonucleotide
gcttgtcaccttatcgagtcaatcccgttccttct

SEQ ID NO: 32553 - DNA, 35 bp, Artificial Sequence
  Synthetic oligonucleotide
atcctcctgctccgttcaaccgcttgaagaccctt

SEQ ID NO: 32554 - DNA, 35 bp, Artificial Sequence
  Synthetic oligonucleotide
tcctgccgacacagccctgtccaaacgaatgtttt

SEQ ID NO: 32555 - DNA, 35 bp, Artificial Sequence
  Synthetic oligonucleotide
tatgcccattcatcgcgtacgaccctcttattttt

SEQ ID NO: 32556 - DNA, 36 bp, Artificial Sequence
  Synthetic oligonucleotide
tcatcgcccgaccggatcgtccacacccgtcccaaa

SEQ ID NO: 32557 - DNA, 35 bp, Artificial Sequence
  Synthetic oligonucleotide
acacgcaagctattcctcgggccatgccgccccaa

SEQ ID NO: 32558 - DNA, 36 bp, Artificial Sequence
  Synthetic oligonucleotide
tcagggaagggaatagatggcttgatcggggagcaa

SEQ ID NO: 32559 - DNA, 36 bp, Artificial Sequence
  Synthetic oligonucleotide
acatgccgaacattacgagtaccactgacgaacgca

SEQ ID NO: 32560 - DNA, 36 bp, Artificial Sequence
  Synthetic oligonucleotide
gacccctcacccgtactgatacacacaaatgaccga

SEQ ID NO: 32561 - DNA, 37 bp, Artificial Sequence
  Synthetic oligonucleotide
taccgcacctgcccgcctatctggtcgcttactgcga

SEQ ID NO: 32562 - DNA, 37 bp, Artificial Sequence
  Synthetic oligonucleotide
gcgaacacttcgtccttgtcacttcttgacctctcga

SEQ ID NO: 32563 - DNA, 37 bp, Artificial Sequence
  Synthetic oligonucleotide
ttggccccataatctgcccttgagccgggaccttcga

SEQ ID NO: 32564 - DNA, 37 bp, Artificial Sequence
  Synthetic oligonucleotide
gaggagcaaaaggggaggggggtgcatgggagttcga

SEQ ID NO: 32565 - DNA, 36 bp, Artificial Sequence
  Synthetic oligonucleotide
tcaaatagaggggcgacggtaggggagagggcagga

SEQ ID NO: 32566 - DNA, 36 bp, Artificial Sequence
  Synthetic oligonucleotide
tgtgacggggtgcaggctctgggcacggaaggggga

SEQ ID NO: 32567 - DNA, 37 bp, Artificial Sequence
  Synthetic oligonucleotide
ggtcgaacatggtgaatggtgtgcaggggtgggggga

SEQ ID NO: 32568 - DNA, 38 bp, Artificial Sequence
  Synthetic oligonucleotide
acgaaccctcagtcccctatcgtgagaatctttgctga

SEQ ID NO: 32569 - DNA, 38 bp, Artificial Sequence
  Synthetic oligonucleotide
gtgcacgcggctcatgcccgcccagctaaaccttctga

SEQ ID NO: 32570 - DNA, 38 bp, Artificial Sequence
  Synthetic oligonucleotide
accctcgcacccccacgtatgtacgttgccctacgtga

SEQ ID NO: 32571 - DNA, 38 bp, Artificial Sequence
  Synthetic oligonucleotide
tcgaggagcaataaaggtggtgccgggggggggtgtga

SEQ ID NO: 32572 - DNA, 38 bp, Artificial Sequence
  Synthetic oligonucleotide
tactccacctcggcttccggttatgctccccgtgttga

SEQ ID NO: 32573 - DNA, 38 bp, Artificial Sequence
  Synthetic oligonucleotide
acacgacgcagtgtacctgctatatttacgttttttga

SEQ ID NO: 32574 - DNA, 35 bp, Artificial Sequence
  Synthetic oligonucleotide
tgtggaggagtgggaggagaacgtgccacaaagta

SEQ ID NO: 32575 - DNA, 35 bp, Artificial Sequence
  Synthetic oligonucleotide
gactccacctgtacatgtcgctttggagcataaac

SEQ ID NO: 32576 - DNA, 35 bp, Artificial Sequence
  Synthetic oligonucleotide
gtgcctccacacttcaatgattttgcgccctcctc

SEQ ID NO: 32577 - DNA, 35 bp, Artificial Sequence
  Synthetic oligonucleotide
gtcgaaccacccttacaacgtggacaatttttctc

SEQ ID NO: 32578 - DNA, 35 bp, Artificial Sequence
  Synthetic oligonucleotide
gaatgcgctacgtcagcttcgccttctcttgtttc

SEQ ID NO: 32579 - DNA, 35 bp, Artificial Sequence
  Synthetic oligonucleotide
gtccgtgccgaatgtcttcccctgccctgtctgag

SEQ ID NO: 32580 - DNA, 35 bp, Artificial Sequence
  Synthetic oligonucleotide
gccaggccccccttaaactcccgccgtacagggat

SEQ ID NO: 32581 - DNA, 35 bp, Artificial Sequence
  Synthetic oligonucleotide
tgagggatgatgacgggagggcggctcagtgatgt

SEQ ID NO: 32582 - DNA, 35 bp, Artificial Sequence
  Synthetic oligonucleotide
acccccacaacttcccattcgtgtacagcttatgt

SEQ ID NO: 32583 - DNA, 35 bp, Artificial Sequence
  Synthetic oligonucleotide
gccactgccgcaacagttcttactgcaccgttctt

SEQ ID NO: 32584 - DNA, 35 bp, Artificial Sequence
  Synthetic oligonucleotide
gagcccctcctgcggtgaccgtttcccaccaagtt

SEQ ID NO: 32585 - DNA, 35 bp, Artificial Sequence
  Synthetic oligonucleotide
gaccccacactcgatggaattttctcgcgcccttt

SEQ ID NO: 32586 - DNA, 35 bp, Artificial Sequence
  Synthetic oligonucleotide
tcccaccagacatgagttcctattttctttgccaa

SEQ ID NO: 32587 - DNA, 36 bp, Artificial Sequence
  Synthetic oligonucleotide
ttgccactttcatcccgcttctggacctgcgcacca

SEQ ID NO: 32588 - DNA, 35 bp, Artificial Sequence
  Synthetic oligonucleotide
gacggtgaggtccgtcctgcgcgctgttacatcca

SEQ ID NO: 32589 - DNA, 36 bp, Artificial Sequence
  Synthetic oligonucleotide
atcatgccccaaccctggatctagtccccgttttca

SEQ ID NO: 32590 - DNA, 37 bp, Artificial Sequence
  Synthetic oligonucleotide
gcgaacggtagggaaaggttgatggcaatgttaacga

SEQ ID NO: 32591 - DNA, 36 bp, Artificial Sequence
  Synthetic oligonucleotide
tcacagagtagggcgggacgtaaaaatgggggggga

SEQ ID NO: 32592 - DNA, 38 bp, Artificial Sequence
  Synthetic oligonucleotide
gaccagccatcacccgcgcgtgcgctcactcaccctga

SEQ ID NO: 32593 - DNA, 38 bp, Artificial Sequence
  Synthetic oligonucleotide
gaaccatcccgggaatgcacactctgtccatctattga

SEQ ID NO: 32594 - DNA, 37 bp, Artificial Sequence
  Synthetic oligonucleotide
tcaaccctaatggtctcatgcatattgttcctcttga

SEQ ID NO: 32595 - DNA, 34 bp, Artificial Sequence
  Synthetic oligonucleotide
tacgagcagaggagtcgcgtctcatcccgcctgc

SEQ ID NO: 32596 - DNA, 35 bp, Artificial Sequence
  Synthetic oligonucleotide
gctaccacctcactgtcacccgtgctaggccctag

SEQ ID NO: 32597 - DNA, 35 bp, Artificial Sequence
  Synthetic oligonucleotide
ttcgaacgccccacacttacttccgcaggtggcct

SEQ ID NO: 32598 - DNA, 35 bp, Artificial Sequence
  Synthetic oligonucleotide
tctcgccggccccttgcattcatccaccgtcctgt

SEQ ID NO: 32599 - DNA, 35 bp, Artificial Sequence
  Synthetic oligonucleotide
gcacacacgccttgtaacccgggacccactatctt

SEQ ID NO: 32600 - DNA, 36 bp, Artificial Sequence
  Synthetic oligonucleotide
acaacacacgtactgcattgcctttctgcagtcaaa

SEQ ID NO: 32601 - DNA, 35 bp, Artificial Sequence
  Synthetic oligonucleotide
aatccatgaccacgcacccgctgcacattctcaca

SEQ ID NO: 32602 - DNA, 35 bp, Artificial Sequence
  Synthetic oligonucleotide
accacaattcagtccgcctttacagccctgcagca

SEQ ID NO: 32603 - DNA, 37 bp, Artificial Sequence
  Synthetic oligonucleotide
tactccagcaaccatcgttcttcgctctatcgctaga

SEQ ID NO: 32604 - DNA, 37 bp, Artificial Sequence
  Synthetic oligonucleotide
gtggtgagggatagaagcaaggggggtcaacgtccga

SEQ ID NO: 32605 - DNA, 38 bp, Artificial Sequence
  Synthetic oligonucleotide
ttgaatggttggggggtaccggtgaggcggactgggga

SEQ ID NO: 32606 - DNA, 38 bp, Artificial Sequence
  Synthetic oligonucleotide
ggacacacaatggcaagggtgaaaggggtgaggtatga

SEQ ID NO: 32607 - DNA, 37 bp, Artificial Sequence
  Synthetic oligonucleotide
tagcactgccctccgacgttgcttgattttgcggtga

SEQ ID NO: 32608 - DNA, 36 bp, Artificial Sequence
  Synthetic oligonucleotide
tagtggaccgtcgccttctcttcactgtactctata

SEQ ID NO: 32609 - DNA, 35 bp, Artificial Sequence
  Synthetic oligonucleotide
gacggtgacgaatgtttgccatccactttacccta

SEQ ID NO: 32610 - DNA, 35 bp, Artificial Sequence
  Synthetic oligonucleotide
ggtgcattatcatcgcgtccactggtcaccatgcc

SEQ ID NO: 32611 - DNA, 35 bp, Artificial Sequence
  Synthetic oligonucleotide
atccgccactgaagcacatatagtcaaactatctc

SEQ ID NO: 32612 - DNA, 35 bp, Artificial Sequence
  Synthetic oligonucleotide
gataccctattgatgcctcatgacctgcccttccg

SEQ ID NO: 32613 - DNA, 35 bp, Artificial Sequence
  Synthetic oligonucleotide
aaggtgagcctgccagcacccaaatcgctgtacct

SEQ ID NO: 32614 - DNA, 35 bp, Artificial Sequence
  Synthetic oligonucleotide
gaaccacgacgctatatgacaccacgacgacttct

SEQ ID NO: 32615 - DNA, 35 bp, Artificial Sequence
  Synthetic oligonucleotide
aacgacggggcagagattatttctgtgcgctcctt

SEQ ID NO: 32616 - DNA, 36 bp, Artificial Sequence
  Synthetic oligonucleotide
tcgcctcccgccgaagtactagcccgaagttatcca

SEQ ID NO: 32617 - DNA, 35 bp, Artificial Sequence
  Synthetic oligonucleotide
tcacattcgaccaatacgtcccgacaccagctcca

SEQ ID NO: 32618 - DNA, 35 bp, Artificial Sequence
  Synthetic oligonucleotide
gcatcgggacgctgcaagttcacactcacccttca

SEQ ID NO: 32619 - DNA, 37 bp, Artificial Sequence
  Synthetic oligonucleotide
acccgtctcccacatagctgatcgataccttcctaga

SEQ ID NO: 32620 - DNA, 37 bp, Artificial Sequence
  Synthetic oligonucleotide
gtgtccatccggcgttccaataccctcctttcgtgga

SEQ ID NO: 32621 - DNA, 38 bp, Artificial Sequence
  Synthetic oligonucleotide
cgccaccgcagagcctcttctcccgttccatccaatga

SEQ ID NO: 32622 - DNA, 38 bp, Artificial Sequence
  Synthetic oligonucleotide
tcaccactccagtgagcgtatggcactccatcctatga

SEQ ID NO: 32623 - DNA, 37 bp, Artificial Sequence
  Synthetic oligonucleotide
gagggagggtcggaggggtgtggtggcttggaattga

SEQ ID NO: 32624 - DNA, 38 bp, Artificial Sequence
  Synthetic oligonucleotide
tcctccaccgaactgcgggatttgccgctcattattga

SEQ ID NO: 32625 - DNA, 34 bp, Artificial Sequence
  Synthetic oligonucleotide
taagagagcgggggtggagcatacagaattgata

SEQ ID NO: 32626 - DNA, 36 bp, Artificial Sequence
  Synthetic oligonucleotide
tctctgcccatacgtttagacctccctttacagcta

SEQ ID NO: 32627 - DNA, 35 bp, Artificial Sequence
  Synthetic oligonucleotide
agggccaagcaactgtctccccatcgccctgaccc

SEQ ID NO: 32628 - DNA, 35 bp, Artificial Sequence
  Synthetic oligonucleotide
attggctcagcccacttctgaatactggtgcgccc

SEQ ID NO: 32629 - DNA, 35 bp, Artificial Sequence
  Synthetic oligonucleotide
actgctgacttattgctgccctggaactccaccgc

SEQ ID NO: 32630 - DNA, 35 bp, Artificial Sequence
  Synthetic oligonucleotide
taacgcggagttccggcgttcctactgttgccatc

SEQ ID NO: 32631 - DNA, 35 bp, Artificial Sequence
  Synthetic oligonucleotide
attgcagtcggcctttcaagtctggccactccctg

SEQ ID NO: 32632 - DNA, 35 bp, Artificial Sequence
  Synthetic oligonucleotide
tcagccggcggtttccactacaatcgaactccttg

SEQ ID NO: 32633 - DNA, 35 bp, Artificial Sequence
  Synthetic oligonucleotide
tgccacagctcaccactttatccgtgatctgcctt

SEQ ID NO: 32634 - DNA, 35 bp, Artificial Sequence
  Synthetic oligonucleotide
agtcatcgctaatgatagcccagttccatcctctt

SEQ ID NO: 32635 - DNA, 35 bp, Artificial Sequence
  Synthetic oligonucleotide
gacattactgctagcccctcctgcatcttaggaca

SEQ ID NO: 32636 - DNA, 36 bp, Artificial Sequence
  Synthetic oligonucleotide
gcccacttaaaatggcttatcttctcaccaggagca

SEQ ID NO: 32637 - DNA, 36 bp, Artificial Sequence
  Synthetic oligonucleotide
gccgtcaacttctatttctccccgcgacctgcttca

SEQ ID NO: 32638 - DNA, 37 bp, Artificial Sequence
  Synthetic oligonucleotide
atgagacaggtaagggagaggaaagcttgacggaaga

SEQ ID NO: 32639 - DNA, 37 bp, Artificial Sequence
  Synthetic oligonucleotide
gtggccgacacttgatcattgccccactggttactga

SEQ ID NO: 32640 - DNA, 38 bp, Artificial Sequence
  Synthetic oligonucleotide
tatgacgccccctcacatccctgactgataaaagctga

SEQ ID NO: 32641 - DNA, 36 bp, Artificial Sequence
  Synthetic oligonucleotide
gccagccggctaaccttctgcgatccatcccccata

SEQ ID NO: 32642 - DNA, 31 bp, Artificial Sequence
  Synthetic oligonucleotide
ggtgcattgccccttcctcacatgaccagta

SEQ ID NO: 32643 - DNA, 36 bp, Artificial Sequence
  Synthetic oligonucleotide
tagtcacctcggccctgttgctacccctcgctagta

SEQ ID NO: 32644 - DNA, 36 bp, Artificial Sequence
  Synthetic oligonucleotide
tgaggagacgagagagcaggcatcaaaagaaacgta

SEQ ID NO: 32645 - DNA, 36 bp, Artificial Sequence
  Synthetic oligonucleotide
aatcccccgcgcccgaataaattaggcccttccgta

SEQ ID NO: 32646 - DNA, 36 bp, Artificial Sequence
  Synthetic oligonucleotide
tcttgccacagattgccactccatcctgctcgcgta

SEQ ID NO: 32647 - DNA, 35 bp, Artificial Sequence
  Synthetic oligonucleotide
agccccccgacgcttttcataaatctgcgcttaac

SEQ ID NO: 32648 - DNA, 35 bp, Artificial Sequence
  Synthetic oligonucleotide
tccactcccccacgcatttaagtttggacagtccg

SEQ ID NO: 32649 - DNA, 35 bp, Artificial Sequence
  Synthetic oligonucleotide
gcccagccgcgaagccagggccacccacccttgct

SEQ ID NO: 32650 - DNA, 35 bp, Artificial Sequence
  Synthetic oligonucleotide
gtacagaccgccagcatattagcccaatccagagt

SEQ ID NO: 32651 - DNA, 35 bp, Artificial Sequence
  Synthetic oligonucleotide
gcccgattgtccccggtcccccatctcacgcccaa

SEQ ID NO: 32652 - DNA, 36 bp, Artificial Sequence
  Synthetic oligonucleotide
aaactcggcccggcctttgacctcctgctgatccaa

SEQ ID NO: 32653 - DNA, 34 bp, Artificial Sequence
  Synthetic oligonucleotide
tcatactacccgccgagccgcagttgttgtgcaa

SEQ ID NO: 32654 - DNA, 36 bp, Artificial Sequence
  Synthetic oligonucleotide
gtgcactatcagcatagcgagcccacgactcactca

SEQ ID NO: 32655 - DNA, 37 bp, Artificial Sequence
  Synthetic oligonucleotide
gttagcagtgccacccccgccgcctaccgatcactga

SEQ ID NO: 32656 - DNA, 38 bp, Artificial Sequence
  Synthetic oligonucleotide
gacccctggcctggtttaacgtagtccacttttactga

SEQ ID NO: 32657 - DNA, 38 bp, Artificial Sequence
  Synthetic oligonucleotide
acaccagactcgcacacaccctcgtcagaccgttgtga

SEQ ID NO: 32658 - DNA, 36 bp, Artificial Sequence
  Synthetic oligonucleotide
gcatcaccgccccggactaatcatcaatgttattga

SEQ ID NO: 32659 - DNA, 38 bp, Artificial Sequence
  Synthetic oligonucleotide
gatgtagaacctcccgcattgcaccttgccacacttga

SEQ ID NO: 32660 - DNA, 36 bp, Artificial Sequence
  Synthetic oligonucleotide
gatcaccgccctgaaaactcatagagggcttcccta

SEQ ID NO: 32661 - DNA, 35 bp, Artificial Sequence
  Synthetic oligonucleotide
accgatcgccgacgttgcgccggacccaatgccac

SEQ ID NO: 32662 - DNA, 35 bp, Artificial Sequence
  Synthetic oligonucleotide
gcataaccggaaccgcctagccacttcacccgtgc

SEQ ID NO: 32663 - DNA, 35 bp, Artificial Sequence
  Synthetic oligonucleotide
agaccacctgctatgatttctcgtttccctgagcg

SEQ ID NO: 32664 - DNA, 35 bp, Artificial Sequence
  Synthetic oligonucleotide
agactagggtgggaacagtgaagatggtcacgatg

SEQ ID NO: 32665 - DNA, 35 bp, Artificial Sequence
  Synthetic oligonucleotide
accgcccccccctcgtaaagaccatgctggcacat

SEQ ID NO: 32666 - DNA, 35 bp, Artificial Sequence
  Synthetic oligonucleotide
ggaatccgattcggtaagggggggcgggtggagtt

SEQ ID NO: 32667 - DNA, 36 bp, Artificial Sequence
  Synthetic oligonucleotide
gtgcgcacgatcctttagccgcccatttcgcaagaa

SEQ ID NO: 32668 - DNA, 36 bp, Artificial Sequence
  Synthetic oligonucleotide
ttaaacggggaagaggatgggtgttggtggtgggaa

SEQ ID NO: 32669 - DNA, 36 bp, Artificial Sequence
  Synthetic oligonucleotide
gccaccaagggttgattattgctctgcgctggaaca

SEQ ID NO: 32670 - DNA, 36 bp, Artificial Sequence
  Synthetic oligonucleotide
acacaccgccatacgtgtggcacataacgtactgca

SEQ ID NO: 32671 - DNA, 35 bp, Artificial Sequence
  Synthetic oligonucleotide
taatccccccgctcttccgcccacacgctgctgca

SEQ ID NO: 32672 - DNA, 37 bp, Artificial Sequence
  Synthetic oligonucleotide
tggaagggcggagggcggaacagggatgaaggctaga

SEQ ID NO: 32673 - DNA, 36 bp, Artificial Sequence
  Synthetic oligonucleotide
tcccccgtagtgtcctagtcgtcactctcttctaga

SEQ ID NO: 32674 - DNA, 37 bp, Artificial Sequence
  Synthetic oligonucleotide
tgcaacgctgaggctacctttatcccatctttcccga

SEQ ID NO: 32675 - DNA, 37 bp, Artificial Sequence
  Synthetic oligonucleotide
gcccactcagcagggttcgcctccttgattacgccga

SEQ ID NO: 32676 - DNA, 36 bp, Artificial Sequence
  Synthetic oligonucleotide
gtccaaatctgctcctcgtttgttcctatccttcga

SEQ ID NO: 32677 - DNA, 35 bp, Artificial Sequence
  Synthetic oligonucleotide
aaccacattccggagcgcatctacctttcccatga

SEQ ID NO: 32678 - DNA, 38 bp, Artificial Sequence
  Synthetic oligonucleotide
gtaccatcgcctccctgatataacccatttcatgctga

SEQ ID NO: 32679 - DNA, 38 bp, Artificial Sequence
  Synthetic oligonucleotide
ggagcgggaagcagaaaacgggagggcgagcttgctga

SEQ ID NO: 32680 - DNA, 37 bp, Artificial Sequence
  Synthetic oligonucleotide
taacgcccgagccgcctaacacttatgattgtcttga

SEQ ID NO: 32681 - DNA, 35 bp, Artificial Sequence
  Synthetic oligonucleotide
gatctcgcgcgcgttattagagcgccatccaccac

SEQ ID NO: 32682 - DNA, 35 bp, Artificial Sequence
  Synthetic oligonucleotide
tgccacccgccctgccgtctgatgctccctaccac

SEQ ID NO: 32683 - DNA, 35 bp, Artificial Sequence
  Synthetic oligonucleotide
gacacgtcccacatttgtcggttcttgcagtcccc

SEQ ID NO: 32684 - DNA, 35 bp, Artificial Sequence
  Synthetic oligonucleotide
tattccaccagccgttgttcgtcaaattcgttctc

SEQ ID NO: 32685 - DNA, 35 bp, Artificial Sequence
  Synthetic oligonucleotide
tgcgaccccacgtatcttttcgccctcgggaatgg

SEQ ID NO: 32686 - DNA, 36 bp, Artificial Sequence
  Synthetic oligonucleotide
gattgtggcgggggtaaacttgacgggtaggaagaa

SEQ ID NO: 32687 - DNA, 36 bp, Artificial Sequence
  Synthetic oligonucleotide
gcctcgaacccagtcaaccgtcctgatcccccgtaa

SEQ ID NO: 32688 - DNA, 36 bp, Artificial Sequence
  Synthetic oligonucleotide
gcccccgtaggactttacctgaacgccatgtctaca

SEQ ID NO: 32689 - DNA, 36 bp, Artificial Sequence
  Synthetic oligonucleotide
taccatctgttgctggattctacgcccgattcccga

SEQ ID NO: 32690 - DNA, 38 bp, Artificial Sequence
  Synthetic oligonucleotide
acccaccatcacagaacgcggaatacactgaatcctga

SEQ ID NO: 32691 - DNA, 38 bp, Artificial Sequence
  Synthetic oligonucleotide
tgcgaaccgggatcgtgttgcccttgttatcttcctga

SEQ ID NO: 32692 - DNA, 35 bp, Artificial Sequence
  Synthetic oligonucleotide
tatgccaggcattcaatcgcgtcttcggtcatccc

SEQ ID NO: 32693 - DNA, 35 bp, Artificial Sequence
  Synthetic oligonucleotide
ttgtgaccacgcccttcccatacccgtctcagtcc

SEQ ID NO: 32694 - DNA, 35 bp, Artificial Sequence
  Synthetic oligonucleotide
gacacctcggctcttgccatgcctacttatcgtcc

SEQ ID NO: 32695 - DNA, 35 bp, Artificial Sequence
  Synthetic oligonucleotide
gcaccagcagcccgtgtactccgcttaactcgtcc

SEQ ID NO: 32696 - DNA, 35 bp, Artificial Sequence
  Synthetic oligonucleotide
gtaccacgtcaagaaatggggggagtggtgtagtg

SEQ ID NO: 32697 - DNA, 35 bp, Artificial Sequence
  Synthetic oligonucleotide
agagctagggcaggagggcattggaaggttgggtg

SEQ ID NO: 32698 - DNA, 35 bp, Artificial Sequence
  Synthetic oligonucleotide
ggagtgggggcaatagtaaaggaatggcggtgttg

SEQ ID NO: 32699 - DNA, 35 bp, Artificial Sequence
  Synthetic oligonucleotide
gcccaacgcacgtcacccgccgcctattggtcact

SEQ ID NO: 32700 - DNA, 35 bp, Artificial Sequence
  Synthetic oligonucleotide
ttgctgtagccctcagcaaacactcctcccggatt

SEQ ID NO: 32701 - DNA, 35 bp, Artificial Sequence
  Synthetic oligonucleotide
tgtcccggtccggcgtgactccttccattgtcaaa

SEQ ID NO: 32702 - DNA, 36 bp, Artificial Sequence
  Synthetic oligonucleotide
gagccacataccccccatgttgttaacaaagcaaca

SEQ ID NO: 32703 - DNA, 36 bp, Artificial Sequence
  Synthetic oligonucleotide
tgccccgatcctgagctccttaatcatcctaagcca

SEQ ID NO: 32704 - DNA, 35 bp, Artificial Sequence
  Synthetic oligonucleotide
atacccctgtcattggctaacctcgaattgtctca

SEQ ID NO: 32705 - DNA, 36 bp, Artificial Sequence
  Synthetic oligonucleotide
tagacagcgcagcccgaccccacgacatcccgttca

SEQ ID NO: 32706 - DNA, 37 bp, Artificial Sequence
  Synthetic oligonucleotide
ttgcctacgtcgtttagcctctcttcattccaccaga

SEQ ID NO: 32707 - DNA, 36 bp, Artificial Sequence
  Synthetic oligonucleotide
atcccacccggaactcgcgcaagccagccccctaga

SEQ ID NO: 32708 - DNA, 37 bp, Artificial Sequence
  Synthetic oligonucleotide
tcgatcctctgacctggtccttgctggcttacaccga

SEQ ID NO: 32709 - DNA, 37 bp, Artificial Sequence
  Synthetic oligonucleotide
gtggtgcgtagggccggtgagggggtagattgaagga

SEQ ID NO: 32710 - DNA, 37 bp, Artificial Sequence
  Synthetic oligonucleotide
aatcgcaggagggggggttctaaactcggaggcggga

SEQ ID NO: 32711 - DNA, 36 bp, Artificial Sequence
  Synthetic oligonucleotide
ttacgcctacctgggccttcactcacttatgtggga

SEQ ID NO: 32712 - DNA, 38 bp, Artificial Sequence
  Synthetic oligonucleotide
actgcagctaccactcccagccggcgttcttcctctga

SEQ ID NO: 32713 - DNA, 37 bp, Artificial Sequence
  Synthetic oligonucleotide
gtggcccgtagctgtccctctgccccctcctttctga

SEQ ID NO: 32714 - DNA, 38 bp, Artificial Sequence
  Synthetic oligonucleotide
aaccaccaaccgatgcttttcagcgagcgagaccttga

SEQ ID NO: 32715 - DNA, 35 bp, Artificial Sequence
  Synthetic oligonucleotide
acgaccccacccacgaactgcatgctacgagttga

SEQ ID NO: 32716 - DNA, 38 bp, Artificial Sequence
  Synthetic oligonucleotide
attgctcagcctcttctcaatgtccccacccacgttga

SEQ ID NO: 32717 - DNA, 36 bp, Artificial Sequence
  Synthetic oligonucleotide
gaaccagactccacgtgacgcaaaatacgcccaata

SEQ ID NO: 32718 - DNA, 30 bp, Artificial Sequence
  Synthetic oligonucleotide
gacaaccccctcattcaacctgcctggtac

SEQ ID NO: 32719 - DNA, 35 bp, Artificial Sequence
  Synthetic oligonucleotide
gcccgtgactcgtgttcttatcctttttgtgctcc

SEQ ID NO: 32720 - DNA, 35 bp, Artificial Sequence
  Synthetic oligonucleotide
actctgcgccctgctccaccacttacgccgaaatc

SEQ ID NO: 32721 - DNA, 35 bp, Artificial Sequence
  Synthetic oligonucleotide
tatctctgccgcctcacgcgcctcggtgattcctc

SEQ ID NO: 32722 - DNA, 35 bp, Artificial Sequence
  Synthetic oligonucleotide
tagcatcatcgcctcatccgcaaactcccagggtc

SEQ ID NO: 32723 - DNA, 35 bp, Artificial Sequence
  Synthetic oligonucleotide
acaaaaccacccctgcggcacagagccattaaacg

SEQ ID NO: 32724 - DNA, 35 bp, Artificial Sequence
  Synthetic oligonucleotide
taccccctcgtcgtcctgacaggcgttccgttccg

SEQ ID NO: 32725 - DNA, 35 bp, Artificial Sequence
  Synthetic oligonucleotide
tatggcggggggagaatggggccggaacggatctg

SEQ ID NO: 32726 - DNA, 35 bp, Artificial Sequence
  Synthetic oligonucleotide
gtgcactaccatacgagcgctttcacgcaatcttg

SEQ ID NO: 32727 - DNA, 35 bp, Artificial Sequence
  Synthetic oligonucleotide
tgatgccccggcccgctcttgcaacgcgcatttat

SEQ ID NO: 32728 - DNA, 35 bp, Artificial Sequence
  Synthetic oligonucleotide
gcacgctggtctgtcttttgattttgcttaacttt

SEQ ID NO: 32729 - DNA, 35 bp, Artificial Sequence
  Synthetic oligonucleotide
gcaactcacattccaccgctagaacctggttacca

SEQ ID NO: 32730 - DNA, 36 bp, Artificial Sequence
  Synthetic oligonucleotide
ttgaatccccaaccacagctccagaaggagcgatca

SEQ ID NO: 32731 - DNA, 36 bp, Artificial Sequence
  Synthetic oligonucleotide
tacatgccatgatctcacccaccaatctgtcggaga

SEQ ID NO: 32732 - DNA, 37 bp, Artificial Sequence
  Synthetic oligonucleotide
acgccgggaccacttgcgacctccattttcgatacga

SEQ ID NO: 32733 - DNA, 37 bp, Artificial Sequence
  Synthetic oligonucleotide
tgttcactcatgctttctccttagtcccgttgcccga

SEQ ID NO: 32734 - DNA, 37 bp, Artificial Sequence
  Synthetic oligonucleotide
aggagcaccaccccccactgcaagcagttctttccga

SEQ ID NO: 32735 - DNA, 37 bp, Artificial Sequence
  Synthetic oligonucleotide
gatacggcgttgtactatttttgcacctgccccgcga

SEQ ID NO: 32736 - DNA, 36 bp, Artificial Sequence
  Synthetic oligonucleotide
actccctccttgtgcctgccctgcccgggctgtgga

SEQ ID NO: 32737 - DNA, 38 bp, Artificial Sequence
  Synthetic oligonucleotide
taccatccgctcatcgttaacctccgtacaccaaatga

SEQ ID NO: 32738 - DNA, 38 bp, Artificial Sequence
  Synthetic oligonucleotide
actgatgtgagtggggaagatggagccggtgtggatga

SEQ ID NO: 32739 - DNA, 38 bp, Artificial Sequence
  Synthetic oligonucleotide
actcgcccagtcatttgactcttgtcctgcctttctga

SEQ ID NO: 32740 - DNA, 38 bp, Artificial Sequence
  Synthetic oligonucleotide
tggaggaagggagcagggtagcggggcatcgggattga

SEQ ID NO: 32741 - DNA, 37 bp, Artificial Sequence
  Synthetic oligonucleotide
gagtgcccctacgtgattcttgacacaccgttcttga

SEQ ID NO: 32742 - DNA, 37 bp, Artificial Sequence
  Synthetic oligonucleotide
tcgcaccccagacgcttttcacttatttacctgttga

SEQ ID NO: 32743 - DNA, 38 bp, Artificial Sequence
  Synthetic oligonucleotide
aacgaaggcagttggtacacaataagggggaagtttga

SEQ ID NO: 32744 - DNA, 35 bp, Artificial Sequence
  Synthetic oligonucleotide
gatcaccaccaaccctgcagcgaactacaaattcc

SEQ ID NO: 32745 - DNA, 35 bp, Artificial Sequence
  Synthetic oligonucleotide
tcagcacgttaccgcgtcttggtaccatcgctccg

SEQ ID NO: 32746 - DNA, 35 bp, Artificial Sequence
  Synthetic oligonucleotide
gactaaggggggaagacaaaatggggtagacgctg

SEQ ID NO: 32747 - DNA, 35 bp, Artificial Sequence
  Synthetic oligonucleotide
gtcgccgttcttcactcgtcagccccaggctccat

SEQ ID NO: 32748 - DNA, 35 bp, Artificial Sequence
  Synthetic oligonucleotide
ggtgccgctcccgaccgcctacagccccgttccat

SEQ ID NO: 32749 - DNA, 35 bp, Artificial Sequence
  Synthetic oligonucleotide
gcactggtcagtgcttcacattcctgctccctgat

SEQ ID NO: 32750 - DNA, 35 bp, Artificial Sequence
  Synthetic oligonucleotide
ggaaacgccccgcacaatcatcagccatctcatct

SEQ ID NO: 32751 - DNA, 35 bp, Artificial Sequence
  Synthetic oligonucleotide
gatccaccgcactaatgaaccctaaccagtcactt

SEQ ID NO: 32752 - DNA, 36 bp, Artificial Sequence
  Synthetic oligonucleotide
atcgtccatacctgtcacctatcgtcctggtcttaa

SEQ ID NO: 32753 - DNA, 36 bp, Artificial Sequence
  Synthetic oligonucleotide
gaaacaaccccaactgcgtactactgcagtttgtca

SEQ ID NO: 32754 - DNA, 38 bp, Artificial Sequence
  Synthetic oligonucleotide
gcaaggctagcctcgagcgttctccgtgcttcccctga

SEQ ID NO: 32755 - DNA, 38 bp, Artificial Sequence
  Synthetic oligonucleotide
gtgacaactcagttcctaacttcgctcgacctccctga

SEQ ID NO: 32756 - DNA, 38 bp, Artificial Sequence
  Synthetic oligonucleotide
ttctgccacaatttctccccccacagccctgtacgtga

SEQ ID NO: 32757 - DNA, 36 bp, Artificial Sequence
  Synthetic oligonucleotide
tgagcggaacgggggtagaggtacaattggcggtga

SEQ ID NO: 32758 - DNA, 38 bp, Artificial Sequence
  Synthetic oligonucleotide
tggacaatcaccatccagcactgcactaccttatgtga

SEQ ID NO: 32759 - DNA, 37 bp, Artificial Sequence
  Synthetic oligonucleotide
acacatgtcctgcatccttactagcctgctacgttga

SEQ ID NO: 32760 - DNA, 35 bp, Artificial Sequence
  Synthetic oligonucleotide
tgatacgagcgccacgagcacctgcctttcgaata

SEQ ID NO: 32761 - DNA, 35 bp, Artificial Sequence
  Synthetic oligonucleotide
taggaggagggtgggagttagacaaaagcggtgta

SEQ ID NO: 32762 - DNA, 35 bp, Artificial Sequence
  Synthetic oligonucleotide
gacccgctgggacactctccaatgccttttgctta

SEQ ID NO: 32763 - DNA, 36 bp, Artificial Sequence
  Synthetic oligonucleotide
tagttgggaagggttggagggggaacgggggagtta

SEQ ID NO: 32764 - DNA, 35 bp, Artificial Sequence
  Synthetic oligonucleotide
tgtcccccagtaatccctccaccgatatcgggacc

SEQ ID NO: 32765 - DNA, 35 bp, Artificial Sequence
  Synthetic oligonucleotide
gactctggtcgatagctcctccatcattagctccc

SEQ ID NO: 32766 - DNA, 35 bp, Artificial Sequence
  Synthetic oligonucleotide
ggaccgctgcctcgcttcctgaaaatcctaatgcc

SEQ ID NO: 32767 - DNA, 35 bp, Artificial Sequence
  Synthetic oligonucleotide
tacagatctcaccaccccatgctgggaagtttgcc

SEQ ID NO: 32768 - DNA, 35 bp, Artificial Sequence
  Synthetic oligonucleotide
tccacctcgttgtacctgaaactagactcatccgc

SEQ ID NO: 32769 - DNA, 35 bp, Artificial Sequence
  Synthetic oligonucleotide
acgacctagcaggctctgacccagccagccttatc

SEQ ID NO: 32770 - DNA, 35 bp, Artificial Sequence
  Synthetic oligonucleotide
taccctgacccattttttaaagtgccgatcttgtc

SEQ ID NO: 32771 - DNA, 35 bp, Artificial Sequence
  Synthetic oligonucleotide
tgtcgaagcaggaaatacatgagggggtaggagag

SEQ ID NO: 32772 - DNA, 35 bp, Artificial Sequence
  Synthetic oligonucleotide
gtatagtcacgggagtggatcgtggagggtgggcg

SEQ ID NO: 32773 - DNA, 36 bp, Artificial Sequence
  Synthetic oligonucleotide
gcgcctacccgccccatcctaatagcaactacgtcg

SEQ ID NO: 32774 - DNA, 35 bp, Artificial Sequence
  Synthetic oligonucleotide
aacatatacgcaagacgcatcgcccctccggcctg

SEQ ID NO: 32775 - DNA, 35 bp, Artificial Sequence
  Synthetic oligonucleotide
gagaagagagggggggggtggacgtggttctagtg

SEQ ID NO: 32776 - DNA, 35 bp, Artificial Sequence
  Synthetic oligonucleotide
acgcaacgcacacatgccgttgaactgtacacagt

SEQ ID NO: 32777 - DNA, 35 bp, Artificial Sequence
  Synthetic oligonucleotide
ggaggtggccgggggcatactaggcttggggtggt

SEQ ID NO: 32778 - DNA, 35 bp, Artificial Sequence
  Synthetic oligonucleotide
tacattcccctcagcaccttcccgtgagcctttgt

SEQ ID NO: 32779 - DNA, 36 bp, Artificial Sequence
  Synthetic oligonucleotide
taacacccttatctgcatggctctgacactcggtaa

SEQ ID NO: 32780 - DNA, 36 bp, Artificial Sequence
  Synthetic oligonucleotide
tgtcacttgcacggtcagacctcacttaccactcca

SEQ ID NO: 32781 - DNA, 37 bp, Artificial Sequence
  Synthetic oligonucleotide
aatgtgcgccaggaggggcaattgggattctggagga

SEQ ID NO: 32782 - DNA, 36 bp, Artificial Sequence
  Synthetic oligonucleotide
atggtcaaggccacggaaaaagggatcggcaatgga

SEQ ID NO: 32783 - DNA, 38 bp, Artificial Sequence
  Synthetic oligonucleotide
agttagccccaattgtcacccttccacgttccaactga

SEQ ID NO: 32784 - DNA, 38 bp, Artificial Sequence
  Synthetic oligonucleotide
atgccacgtcggactagcttcccgctgcaccatcctga

SEQ ID NO: 32785 - DNA, 37 bp, Artificial Sequence
  Synthetic oligonucleotide
gcaggcctccccccatccattatgtcgttagccttga

SEQ ID NO: 32786 - DNA, 35 bp, Artificial Sequence
  Synthetic oligonucleotide
gtcgtcacagtccttaccgccttcctgcctcagta

SEQ ID NO: 32787 - DNA, 35 bp, Artificial Sequence
  Synthetic oligonucleotide
gatcccactgttcctgtgccgtcccgagccactta

SEQ ID NO: 32788 - DNA, 35 bp, Artificial Sequence
  Synthetic oligonucleotide
gtacggagcccgtacgtttttctggatccttgcac

SEQ ID NO: 32789 - DNA, 35 bp, Artificial Sequence
  Synthetic oligonucleotide
gtgctccacatttattcattttaggccggttcacc

SEQ ID NO: 32790 - DNA, 35 bp, Artificial Sequence
  Synthetic oligonucleotide
tctaatccgtgacgccctccccttgtcgcctgacc

SEQ ID NO: 32791 - DNA, 35 bp, Artificial Sequence
  Synthetic oligonucleotide
gtcaccaactaccagggttcatacgcggttccatc

SEQ ID NO: 32792 - DNA, 35 bp, Artificial Sequence
  Synthetic oligonucleotide
gctcagactgcaaaccccaccccccattgtatttc

SEQ ID NO: 32793 - DNA, 35 bp, Artificial Sequence
  Synthetic oligonucleotide
cactcccctcgccgacggtgatcgatcctcctacg

SEQ ID NO: 32794 - DNA, 35 bp, Artificial Sequence
  Synthetic oligonucleotide
gtgtggtctggtgcaaggaaggtgggagggtggtg

SEQ ID NO: 32795 - DNA, 35 bp, Artificial Sequence
  Synthetic oligonucleotide
acctaacccgtcccgtcccttgtggttctcaatct

SEQ ID NO: 32796 - DNA, 36 bp, Artificial Sequence
  Synthetic oligonucleotide
aaatggggaaagtaggggtggtgcaaggtaacaaaa

SEQ ID NO: 32797 - DNA, 35 bp, Artificial Sequence
  Synthetic oligonucleotide
gccctgcggaccccatttgctttacccctacgaaa

SEQ ID NO: 32798 - DNA, 36 bp, Artificial Sequence
  Synthetic oligonucleotide
gacattcagaggcacgtacaccctagctgcaacgaa

SEQ ID NO: 32799 - DNA, 35 bp, Artificial Sequence
  Synthetic oligonucleotide
gatcaccctagcctgagaacgttcacttgacttaa

SEQ ID NO: 32800 - DNA, 36 bp, Artificial Sequence
  Synthetic oligonucleotide
gagcacaatgcactggaccacctacgggctctccca

SEQ ID NO: 32801 - DNA, 36 bp, Artificial Sequence
  Synthetic oligonucleotide
gtttagccccctcctgccgaaggtcgagcccatcca

SEQ ID NO: 32802 - DNA, 35 bp, Artificial Sequence
  Synthetic oligonucleotide
gcaacgccaccgcgtttgtcgcgtccccccttcca

SEQ ID NO: 32803 - DNA, 34 bp, Artificial Sequence
  Synthetic oligonucleotide
gcccagcgttccgtcttttcccaccttcctatca

SEQ ID NO: 32804 - DNA, 35 bp, Artificial Sequence
  Synthetic oligonucleotide
gaccacgatattactagctacactccttgcactca

SEQ ID NO: 32805 - DNA, 37 bp, Artificial Sequence
  Synthetic oligonucleotide
attcgaggagggaaagaggtggcaggtgaggacgaga

SEQ ID NO: 32806 - DNA, 37 bp, Artificial Sequence
  Synthetic oligonucleotide
gaacgaggggggggctgggggagctagctcgactaga

SEQ ID NO: 32807 - DNA, 36 bp, Artificial Sequence
  Synthetic oligonucleotide
gatgtgcgaggaggaagcggtagggaggagatgcga

SEQ ID NO: 32808 - DNA, 37 bp, Artificial Sequence
  Synthetic oligonucleotide
gacaaatggtggggagtcggggtgggggctaaaggga

SEQ ID NO: 32809 - DNA, 38 bp, Artificial Sequence
  Synthetic oligonucleotide
tcaccccatgtccatcagatccctctgccgcaccctga

SEQ ID NO: 32810 - DNA, 35 bp, Artificial Sequence
  Synthetic oligonucleotide
gctgccacctcgttttgtagcctcgagttttttta

SEQ ID NO: 32811 - DNA, 35 bp, Artificial Sequence
  Synthetic oligonucleotide
gcagaagccgcctcccgattatcatggggtgaacc

SEQ ID NO: 32812 - DNA, 35 bp, Artificial Sequence
  Synthetic oligonucleotide
tgaccgttggttcgattctacaatgttccgtttcc

SEQ ID NO: 32813 - DNA, 35 bp, Artificial Sequence
  Synthetic oligonucleotide
gccctcaggccggtctctataagtcttctgcctgc

SEQ ID NO: 32814 - DNA, 35 bp, Artificial Sequence
  Synthetic oligonucleotide
gcactgtcccccaaacggccacaacagctgcactc

SEQ ID NO: 32815 - DNA, 35 bp, Artificial Sequence
  Synthetic oligonucleotide
ggacattggccccagttatttcttttgataccgcg

SEQ ID NO: 32816 - DNA, 35 bp, Artificial Sequence
  Synthetic oligonucleotide
aaccccgccagcacctcttcgttcatctcacaagg

SEQ ID NO: 32817 - DNA, 35 bp, Artificial Sequence
  Synthetic oligonucleotide
gacaatcaaacagatggatgggctggtgaaggggg

SEQ ID NO: 32818 - DNA, 35 bp, Artificial Sequence
  Synthetic oligonucleotide
tacgacgagtccttgtcgctacctaatcacactct

SEQ ID NO: 32819 - DNA, 36 bp, Artificial Sequence
  Synthetic oligonucleotide
aacacgctaaggtcgccgattaatgcatgcacacaa

SEQ ID NO: 32820 - DNA, 35 bp, Artificial Sequence
  Synthetic oligonucleotide
tcctccgcctgggttgtcctcttgtctgccgagaa

SEQ ID NO: 32821 - DNA, 36 bp, Artificial Sequence
  Synthetic oligonucleotide
tcgactacagcctgcccgagcttaccccaaactgca

SEQ ID NO: 32822 - DNA, 36 bp, Artificial Sequence
  Synthetic oligonucleotide
gcccgacgtcgttccacaatgcgtgattctgcctca

SEQ ID NO: 32823 - DNA, 37 bp, Artificial Sequence
  Synthetic oligonucleotide
atgcgacatcaccaaggctgacctgctttctcctcga

SEQ ID NO: 32824 - DNA, 37 bp, Artificial Sequence
  Synthetic oligonucleotide
tcgtgagagctcacctgctcgccccagtccctttcga

SEQ ID NO: 32825 - DNA, 37 bp, Artificial Sequence
  Synthetic oligonucleotide
ttccacctcctgcccccggttccacaatgtcaccgga

SEQ ID NO: 32826 - DNA, 37 bp, Artificial Sequence
  Synthetic oligonucleotide
aaggagggtgagtgtgtgggcgggtcgttataaggga

SEQ ID NO: 32827 - DNA, 38 bp, Artificial Sequence
  Synthetic oligonucleotide
acgcgacacctcctggccacattaagtcaacaacctga

SEQ ID NO: 32828 - DNA, 37 bp, Artificial Sequence
  Synthetic oligonucleotide
ttgtgccactcgtactcgttagtcctgccatctgtga

SEQ ID NO: 32829 - DNA, 35 bp, Artificial Sequence
  Synthetic oligonucleotide
ttttgccgtccgcccatatctgctccggtgtcata

SEQ ID NO: 32830 - DNA, 34 bp, Artificial Sequence
  Synthetic oligonucleotide
gaagccgacctcctctctccattacacgacgcta

SEQ ID NO: 32831 - DNA, 35 bp, Artificial Sequence
  Synthetic oligonucleotide
aagtccctgccctaattttgtagtctgcacccgta

SEQ ID NO: 32832 - DNA, 36 bp, Artificial Sequence
  Synthetic oligonucleotide
tcagggcgaacattgccggcgccaacaccattcgta

SEQ ID NO: 32833 - DNA, 35 bp, Artificial Sequence
  Synthetic oligonucleotide
tcccaggaacatcagcacacttgtcttcttctacc

SEQ ID NO: 32834 - DNA, 35 bp, Artificial Sequence
  Synthetic oligonucleotide
aactcgcaggccttataatctgttggtactcgccc

SEQ ID NO: 32835 - DNA, 34 bp, Artificial Sequence
  Synthetic oligonucleotide
atccatcaagcacagctggtcttttaccccggtc

SEQ ID NO: 32836 - DNA, 35 bp, Artificial Sequence
  Synthetic oligonucleotide
gccatgtgcccgggttagtttttcgctcttcagcg

SEQ ID NO: 32837 - DNA, 35 bp, Artificial Sequence
  Synthetic oligonucleotide
gatcagccatacgctcacctggaacctaattgggg

SEQ ID NO: 32838 - DNA, 35 bp, Artificial Sequence
  Synthetic oligonucleotide
tgctatcctacggaaggagcgaaagggagggggtg

SEQ ID NO: 32839 - DNA, 36 bp, Artificial Sequence
  Synthetic oligonucleotide
aacatgcattgcggatgagtcatctcgcccttgcaa

SEQ ID NO: 32840 - DNA, 36 bp, Artificial Sequence
  Synthetic oligonucleotide
atgtcaccacggcatagcccacgtcgctaataccca

SEQ ID NO: 32841 - DNA, 36 bp, Artificial Sequence
  Synthetic oligonucleotide
tgcgacacgcaatgcctccgcttgttcatgctttca

SEQ ID NO: 32842 - DNA, 36 bp, Artificial Sequence
  Synthetic oligonucleotide
atacctgcgcataacccgtgctcccacccctgccga

SEQ ID NO: 32843 - DNA, 37 bp, Artificial Sequence
  Synthetic oligonucleotide
gctggtcaactaggggatggaggtagtggaagggcga

SEQ ID NO: 32844 - DNA, 35 bp, Artificial Sequence
  Synthetic oligonucleotide
accctccgctgtatgaactagggcctagccctcga

SEQ ID NO: 32845 - DNA, 37 bp, Artificial Sequence
  Synthetic oligonucleotide
atcccggggagagagaggatggagggctatagtggga

SEQ ID NO: 32846 - DNA, 38 bp, Artificial Sequence
  Synthetic oligonucleotide
atcccaactcacatcatagcctcagtccgatttcatga

SEQ ID NO: 32847 - DNA, 36 bp, Artificial Sequence
  Synthetic oligonucleotide
gtgccggagcatcacgccgcatcttttcatgactga

SEQ ID NO: 32848 - DNA, 35 bp, Artificial Sequence
  Synthetic oligonucleotide
tagcgcccgtaccgcctttcggagcttccacctga

SEQ ID NO: 32849 - DNA, 38 bp, Artificial Sequence
  Synthetic oligonucleotide
agactctccgcacctgttatttgtctacccgtcattga

SEQ ID NO: 32850 - DNA, 38 bp, Artificial Sequence
  Synthetic oligonucleotide
agtcaactgcaggattggatagggtggggtgtgattga

SEQ ID NO: 32851 - DNA, 36 bp, Artificial Sequence
  Synthetic oligonucleotide
ggaaaccatcaacgctgtctatctcctcggtatcta

SEQ ID NO: 32852 - DNA, 35 bp, Artificial Sequence
  Synthetic oligonucleotide
tgcaatcacacacaatatcatgacacaccgataac

SEQ ID NO: 32853 - DNA, 35 bp, Artificial Sequence
  Synthetic oligonucleotide
gatccaggccacttcccatgcattccggatttcac

SEQ ID NO: 32854 - DNA, 35 bp, Artificial Sequence
  Synthetic oligonucleotide
gccatccccctttggacacccgaagctgtaatacc

SEQ ID NO: 32855 - DNA, 35 bp, Artificial Sequence
  Synthetic oligonucleotide
acatgtcataggcggcttttcctgtccccctcccc

SEQ ID NO: 32856 - DNA, 35 bp, Artificial Sequence
  Synthetic oligonucleotide
tcattcgctcccggacatcgcagccgacacccgtc

SEQ ID NO: 32857 - DNA, 34 bp, Artificial Sequence
  Synthetic oligonucleotide
ttcgccccattggataatggtaaccctgactttc

SEQ ID NO: 32858 - DNA, 35 bp, Artificial Sequence
  Synthetic oligonucleotide
atgacacgctgaagcttagtgcggctccctctttc

SEQ ID NO: 32859 - DNA, 35 bp, Artificial Sequence
  Synthetic oligonucleotide
gacaatatgagtgggaagcaaaagagaagaggacg

SEQ ID NO: 32860 - DNA, 35 bp, Artificial Sequence
  Synthetic oligonucleotide
acgattgaccactatatgcgcctccatccacattg

SEQ ID NO: 32861 - DNA, 35 bp, Artificial Sequence
  Synthetic oligonucleotide
tgaccatcctccgttttcgtgcgcaccttagttat

SEQ ID NO: 32862 - DNA, 35 bp, Artificial Sequence
  Synthetic oligonucleotide
atcacgggctgggggccgctcaaacacttgtcctt

SEQ ID NO: 32863 - DNA, 36 bp, Artificial Sequence
  Synthetic oligonucleotide
gccagagcgccatctgctcgccgacccactacaaaa

SEQ ID NO: 32864 - DNA, 35 bp, Artificial Sequence
  Synthetic oligonucleotide
gcatgttgcagcactccttgccgccctactagcaa

SEQ ID NO: 32865 - DNA, 37 bp, Artificial Sequence
  Synthetic oligonucleotide
gtgtctagccgcagcactatagtaaacccttcccaga

SEQ ID NO: 32866 - DNA, 37 bp, Artificial Sequence
  Synthetic oligonucleotide
tacgggaaggttcactgcccacccaacagtcccccga

SEQ ID NO: 32867 - DNA, 37 bp, Artificial Sequence
  Synthetic oligonucleotide
aatcaaacgaggtggggccggaaaaatgggggcagga

SEQ ID NO: 32868 - DNA, 38 bp, Artificial Sequence
  Synthetic oligonucleotide
taacccaacgtcggcctactatacgtcgctaccactga

SEQ ID NO: 32869 - DNA, 35 bp, Artificial Sequence
  Synthetic oligonucleotide
atgtgcggggggggtggtggcataaaggtggacgc

SEQ ID NO: 32870 - DNA, 35 bp, Artificial Sequence
  Synthetic oligonucleotide
tgcgagttctgtcgaggttccgcgtgccacccatc

SEQ ID NO: 32871 - DNA, 35 bp, Artificial Sequence
  Synthetic oligonucleotide
tgaccatccagccctccccttacacgtgaactgcg

SEQ ID NO: 32872 - DNA, 35 bp, Artificial Sequence
  Synthetic oligonucleotide
gacacaaactgggtggaggtttcagggatatcggg

SEQ ID NO: 32873 - DNA, 35 bp, Artificial Sequence
  Synthetic oligonucleotide
aagacacacccatggtccgactaccttacatcctg

SEQ ID NO: 32874 - DNA, 35 bp, Artificial Sequence
  Synthetic oligonucleotide
ggtgctaaccccgctcgtttgaccactgtcctttg

SEQ ID NO: 32875 - DNA, 35 bp, Artificial Sequence
  Synthetic oligonucleotide
tagtaccggcgtgcacataccaggcgaccatcact

SEQ ID NO: 32876 - DNA, 35 bp, Artificial Sequence
  Synthetic oligonucleotide
tcactcccccaacatttggactgactttgagtact

SEQ ID NO: 32877 - DNA, 35 bp, Artificial Sequence
  Synthetic oligonucleotide
tgtcatccgcatatctaacttcagggcacgtctct

SEQ ID NO: 32878 - DNA, 35 bp, Artificial Sequence
  Synthetic oligonucleotide
caacacccttgctctttactgaccgaatcatgctt

SEQ ID NO: 32879 - DNA, 36 bp, Artificial Sequence
  Synthetic oligonucleotide
tctgcctcctgcactagccgttataacacgaatcaa

SEQ ID NO: 32880 - DNA, 36 bp, Artificial Sequence
  Synthetic oligonucleotide
aacgatgcacacctattcctagtgccgccctgcaca

SEQ ID NO: 32881 - DNA, 36 bp, Artificial Sequence
  Synthetic oligonucleotide
agtggcggggaaaaggggaacaacgtacgaggcaga

SEQ ID NO: 32882 - DNA, 37 bp, Artificial Sequence
  Synthetic oligonucleotide
atagcaccgggccagtccgaacaggtggagggtggga

SEQ ID NO: 32883 - DNA, 38 bp, Artificial Sequence
  Synthetic oligonucleotide
ttgacaccgcatattaatacaattgccacgttctctga

SEQ ID NO: 32884 - DNA, 35 bp, Artificial Sequence
  Synthetic oligonucleotide
aaacccgtcccatgcctagcactcacgttccaata

SEQ ID NO: 32885 - DNA, 35 bp, Artificial Sequence
  Synthetic oligonucleotide
tactatgatggtgattcacactgtgcccccccgtc

SEQ ID NO: 32886 - DNA, 35 bp, Artificial Sequence
  Synthetic oligonucleotide
gtcagttctccgcacctccctattagtcttccctg

SEQ ID NO: 32887 - DNA, 35 bp, Artificial Sequence
  Synthetic oligonucleotide
atcaccgaccagacctccccttatcgacaagcgtg

SEQ ID NO: 32888 - DNA, 35 bp, Artificial Sequence
  Synthetic oligonucleotide
agtcatggactgcggtattttagtttttttggttg

SEQ ID NO: 32889 - DNA, 35 bp, Artificial Sequence
  Synthetic oligonucleotide
ggtgcgctcaagccgaccgacttcccgacctacct

SEQ ID NO: 32890 - DNA, 35 bp, Artificial Sequence
  Synthetic oligonucleotide
acacacccctcatccattacgcttgaaacacagct

SEQ ID NO: 32891 - DNA, 35 bp, Artificial Sequence
  Synthetic oligonucleotide
aaggagggatcagggggctacacgcgggaaggagt

SEQ ID NO: 32892 - DNA, 35 bp, Artificial Sequence
  Synthetic oligonucleotide
gggccatgcccgtattcaattgccttacgtacctt

SEQ ID NO: 32893 - DNA, 35 bp, Artificial Sequence
  Synthetic oligonucleotide
tcagcgagcccccgtcgttgatcaaacttttggtt

SEQ ID NO: 32894 - DNA, 36 bp, Artificial Sequence
  Synthetic oligonucleotide
tgaaagctactcctgcccgctgtgcccctctttgaa

SEQ ID NO: 32895 - DNA, 36 bp, Artificial Sequence
  Synthetic oligonucleotide
tacgaggctacctcagaagcgtcggaacgtacataa

SEQ ID NO: 32896 - DNA, 36 bp, Artificial Sequence
  Synthetic oligonucleotide
tccctgggatcgtggcatcccaagctgttcctctaa

SEQ ID NO: 32897 - DNA, 35 bp, Artificial Sequence
  Synthetic oligonucleotide
gactcggttgcctgtacgttgcctttcccgcctca

SEQ ID NO: 32898 - DNA, 37 bp, Artificial Sequence
  Synthetic oligonucleotide
taacgcataggggagataggaagggttgagggggaga

SEQ ID NO: 32899 - DNA, 37 bp, Artificial Sequence
  Synthetic oligonucleotide
ttggacgtagatctgcccttcgcatgcaacccttcga

SEQ ID NO: 32900 - DNA, 37 bp, Artificial Sequence
  Synthetic oligonucleotide
gacactcgacgccttccgcccactccatacgtgtgga

SEQ ID NO: 32901 - DNA, 37 bp, Artificial Sequence
  Synthetic oligonucleotide
cggtgcacctgcccagacttagccacgaccgacatga

SEQ ID NO: 32902 - DNA, 38 bp, Artificial Sequence
  Synthetic oligonucleotide
tgctggcctacagaagccactttgacctcgacccatga

SEQ ID NO: 32903 - DNA, 38 bp, Artificial Sequence
  Synthetic oligonucleotide
tcacctgccctttggttattatgcccaccaggacgtga

SEQ ID NO: 32904 - DNA, 36 bp, Artificial Sequence
  Synthetic oligonucleotide
acgcccacccccagcaaaggcttacgttccagcata

SEQ ID NO: 32905 - DNA, 35 bp, Artificial Sequence
  Synthetic oligonucleotide
cacgtccctgcccacctcggaattcgtatatccta

SEQ ID NO: 32906 - DNA, 34 bp, Artificial Sequence
  Synthetic oligonucleotide
tcacccccattgcaaggctgccttggctatccta

SEQ ID NO: 32907 - DNA, 35 bp, Artificial Sequence
  Synthetic oligonucleotide
tgcgagccacctcaccgggcacccgacccaacgta

SEQ ID NO: 32908 - DNA, 35 bp, Artificial Sequence
  Synthetic oligonucleotide
aatcaacgcccgacggcccaatccccgcgcaatac

SEQ ID NO: 32909 - DNA, 35 bp, Artificial Sequence
  Synthetic oligonucleotide
gacttgcgcgacctggtacttagatgcctttgccc

SEQ ID NO: 32910 - DNA, 35 bp, Artificial Sequence
  Synthetic oligonucleotide
gcagccacgtgctccgtcgctatcgctccatcgtc

SEQ ID NO: 32911 - DNA, 35 bp, Artificial Sequence
  Synthetic oligonucleotide
aacggccataccaatgcgataactcccttcctgtc

SEQ ID NO: 32912 - DNA, 35 bp, Artificial Sequence
  Synthetic oligonucleotide
agggtggaggggatacggggttaagggttatcggg

SEQ ID NO: 32913 - DNA, 35 bp, Artificial Sequence
  Synthetic oligonucleotide
tccctcgcttccacttctttcgcccttctgtaatg

SEQ ID NO: 32914 - DNA, 35 bp, Artificial Sequence
  Synthetic oligonucleotide
aaacggaacctcacatggttttacaccttctccat

SEQ ID NO: 32915 - DNA, 35 bp, Artificial Sequence
  Synthetic oligonucleotide
tcgactcgccccatggcttcatggcttatttctat

SEQ ID NO: 32916 - DNA, 35 bp, Artificial Sequence
  Synthetic oligonucleotide
gcgcactgcgggcggggcgggctgggaaaacccgt

SEQ ID NO: 32917 - DNA, 36 bp, Artificial Sequence
  Synthetic oligonucleotide
gattgtcgcgcgcttgacccccgccgtttttaccaa

SEQ ID NO: 32918 - DNA, 36 bp, Artificial Sequence
  Synthetic oligonucleotide
gtccccgtacccttctatttggatccgtctttggca

SEQ ID NO: 32919 - DNA, 37 bp, Artificial Sequence
  Synthetic oligonucleotide
gactccccgcggatctgcggacttcccataccctaga

SEQ ID NO: 32920 - DNA, 37 bp, Artificial Sequence
  Synthetic oligonucleotide
gtgggtcaccggcctgccacccatttttgatgaacga

SEQ ID NO: 32921 - DNA, 35 bp, Artificial Sequence
  Synthetic oligonucleotide
gccccctagccccatgtaactactcagttcaccga

SEQ ID NO: 32922 - DNA, 36 bp, Artificial Sequence
  Synthetic oligonucleotide
accccataccaattgtcaataacatcatcgatccga

SEQ ID NO: 32923 - DNA, 37 bp, Artificial Sequence
  Synthetic oligonucleotide
tacacaacaccggccatcaccgcctgccttcctccga

SEQ ID NO: 32924 - DNA, 37 bp, Artificial Sequence
  Synthetic oligonucleotide
ttgccacaccaacgcccatggtcgactaatgttccga

SEQ ID NO: 32925 - DNA, 36 bp, Artificial Sequence
  Synthetic oligonucleotide
gatccgacacggtctccctgacttcttacgccctga

SEQ ID NO: 32926 - DNA, 37 bp, Artificial Sequence
  Synthetic oligonucleotide
aagggcgtgagtaggggacgggcgggtaaggtcgtga

SEQ ID NO: 32927 - DNA, 36 bp, Artificial Sequence
  Synthetic oligonucleotide
gctgacccacgacactcgcctacggacccactgata

SEQ ID NO: 32928 - DNA, 35 bp, Artificial Sequence
  Synthetic oligonucleotide
gtgctcttgccccagttaccaatcacaagcacacc

SEQ ID NO: 32929 - DNA, 35 bp, Artificial Sequence
  Synthetic oligonucleotide
tacctgtcgaccacgccccccagcccggggttacc

SEQ ID NO: 32930 - DNA, 35 bp, Artificial Sequence
  Synthetic oligonucleotide
agctatctcgcactgcctcatgtacctcctactgc

SEQ ID NO: 32931 - DNA, 35 bp, Artificial Sequence
  Synthetic oligonucleotide
gccctcacacggcgtttgaggctcaacccgctatc

SEQ ID NO: 32932 - DNA, 35 bp, Artificial Sequence
  Synthetic oligonucleotide
tcaaacatcgcttacaggccggattagccattctc

SEQ ID NO: 32933 - DNA, 35 bp, Artificial Sequence
  Synthetic oligonucleotide
tgtaccgaacacaggccaaacgccacctccgtgcg

SEQ ID NO: 32934 - DNA, 34 bp, Artificial Sequence
  Synthetic oligonucleotide
tagcacgcacccctccccagcgctctcccatctg

SEQ ID NO: 32935 - DNA, 35 bp, Artificial Sequence
  Synthetic oligonucleotide
gactaggctctgcacaacatgacgcttcacttcct

SEQ ID NO: 32936 - DNA, 35 bp, Artificial Sequence
  Synthetic oligonucleotide
gcactacgcggttaggatatcttctcatggctggt

SEQ ID NO: 32937 - DNA, 35 bp, Artificial Sequence
  Synthetic oligonucleotide
aagtgagcgtcccatccaaagtccccccacttgtt

SEQ ID NO: 32938 - DNA, 36 bp, Artificial Sequence
  Synthetic oligonucleotide
gatgcatccgtcttacacatctgattgctccgaaca

SEQ ID NO: 32939 - DNA, 36 bp, Artificial Sequence
  Synthetic oligonucleotide
atcaacgcccgctggtcccgcagtcatttggaccga

SEQ ID NO: 32940 - DNA, 37 bp, Artificial Sequence
  Synthetic oligonucleotide
gctagggaagcagggagtaaggcgaagaggaacagga

SEQ ID NO: 32941 - DNA, 37 bp, Artificial Sequence
  Synthetic oligonucleotide
aggtggccaggggggatggacatagggcggtagagga

SEQ ID NO: 32942 - DNA, 36 bp, Artificial Sequence
  Synthetic oligonucleotide
gtggaatgtgatgggggggcaagggcgggattagga

SEQ ID NO: 32943 - DNA, 37 bp, Artificial Sequence
  Synthetic oligonucleotide
tgagcccagactctttgccatccgccgtagccacgga

SEQ ID NO: 32944 - DNA, 37 bp, Artificial Sequence
  Synthetic oligonucleotide
tctagagcgggagggcgggatattcaggggtttcgga

SEQ ID NO: 32945 - DNA, 36 bp, Artificial Sequence
  Synthetic oligonucleotide
gagggagtgaggcgtctagagaaaggtggaggggga

SEQ ID NO: 32946 - DNA, 37 bp, Artificial Sequence
  Synthetic oligonucleotide
gacgcagagtaggggacgcaggatgcctaggaatgga

SEQ ID NO: 32947 - DNA, 38 bp, Artificial Sequence
  Synthetic oligonucleotide
gctgggctcgaacgcacgcatttttttacagtttatga

SEQ ID NO: 32948 - DNA, 38 bp, Artificial Sequence
  Synthetic oligonucleotide
agccatagccagcactatggtgcccaatatacccctga

SEQ ID NO: 32949 - DNA, 37 bp, Artificial Sequence
  Synthetic oligonucleotide
gtgcaaacgcccagcattgttctatcttgcttcctga

SEQ ID NO: 32950 - DNA, 38 bp, Artificial Sequence
  Synthetic oligonucleotide
tttcagcggcccttgtctcccccgtagtacctcgctga

SEQ ID NO: 32951 - DNA, 38 bp, Artificial Sequence
  Synthetic oligonucleotide
aaacgaagcacgctgtaggctaggaaggtgaagggtga

SEQ ID NO: 32952 - DNA, 38 bp, Artificial Sequence
  Synthetic oligonucleotide
aacgccccgcggtaacgcttgtccgtgacagctgttga

SEQ ID NO: 32953 - DNA, 35 bp, Artificial Sequence
  Synthetic oligonucleotide
tcctgacccctcccgatccgtacgagtgcccccta

SEQ ID NO: 32954 - DNA, 36 bp, Artificial Sequence
  Synthetic oligonucleotide
tcatcccaagcccaactgagggtggtcccgtattta

SEQ ID NO: 32955 - DNA, 35 bp, Artificial Sequence
  Synthetic oligonucleotide
ttcctcctcaatagtcaatccagttgactgtcgcc

SEQ ID NO: 32956 - DNA, 35 bp, Artificial Sequence
  Synthetic oligonucleotide
tcagcacataccacgatccggagccgtgctactcc

SEQ ID NO: 32957 - DNA, 35 bp, Artificial Sequence
  Synthetic oligonucleotide
gcaactcaccggtacctacttttcgcgcgcttggc

SEQ ID NO: 32958 - DNA, 35 bp, Artificial Sequence
  Synthetic oligonucleotide
tctaccttacactcagccctcgcaagagaatttgc

SEQ ID NO: 32959 - DNA, 35 bp, Artificial Sequence
  Synthetic oligonucleotide
tcccaaaccacccgctatttatcaagtggtacatc

SEQ ID NO: 32960 - DNA, 35 bp, Artificial Sequence
  Synthetic oligonucleotide
tgttacgttaatctgccagatttcgttgttccatc

SEQ ID NO: 32961 - DNA, 35 bp, Artificial Sequence
  Synthetic oligonucleotide
acacccgtagcattactggtatgtaccaagttctc

SEQ ID NO: 32962 - DNA, 35 bp, Artificial Sequence
  Synthetic oligonucleotide
gacgactctgcttttcctccttgcgagcttttaag

SEQ ID NO: 32963 - DNA, 35 bp, Artificial Sequence
  Synthetic oligonucleotide
tccaagcactggctgcttgtagtgctttcacgctt

SEQ ID NO: 32964 - DNA, 35 bp, Artificial Sequence
  Synthetic oligonucleotide
tctggatcctcctttgcgctttcccacttgctgtt

SEQ ID NO: 32965 - DNA, 36 bp, Artificial Sequence
  Synthetic oligonucleotide
gaaaggatgggagcataataagtggctgctgaaaaa

SEQ ID NO: 32966 - DNA, 36 bp, Artificial Sequence
  Synthetic oligonucleotide
tttacaggacgggagggcaccagggttgggttgcaa

SEQ ID NO: 32967 - DNA, 36 bp, Artificial Sequence
  Synthetic oligonucleotide
gtgccggatggtgggttgattgggccaaggggataa

SEQ ID NO: 32968 - DNA, 35 bp, Artificial Sequence
  Synthetic oligonucleotide
gtgccttccacccccctgacgatcaggaattctaa

SEQ ID NO: 32969 - DNA, 35 bp, Artificial Sequence
  Synthetic oligonucleotide
gtccgtccacaattgctatcctgtgtctcaaccga

SEQ ID NO: 32970 - DNA, 36 bp, Artificial Sequence
  Synthetic oligonucleotide
gcaccctgacaggtcgtcctttaggcgttcccccga

SEQ ID NO: 32971 - DNA, 37 bp, Artificial Sequence
  Synthetic oligonucleotide
gcccaggctagcgtgcgcctgcctccatcgcctccga

SEQ ID NO: 32972 - DNA, 37 bp, Artificial Sequence
  Synthetic oligonucleotide
gccgatccccatcttgcctgtgcacacctccccgcga

SEQ ID NO: 32973 - DNA, 37 bp, Artificial Sequence
  Synthetic oligonucleotide
gacacgcagtgggtaacatcttattctcttgctgcga

SEQ ID NO: 32974 - DNA, 36 bp, Artificial Sequence
  Synthetic oligonucleotide
agtacgcctccgcccatattcgtacgtccactggga

SEQ ID NO: 32975 - DNA, 38 bp, Artificial Sequence
  Synthetic oligonucleotide
tgtggtagggccaggggaagaaggcgtgagcgggtgga

SEQ ID NO: 32976 - DNA, 37 bp, Artificial Sequence
  Synthetic oligonucleotide
accaagcccctctgttgcccgaaatctaccatcctga

SEQ ID NO: 32977 - DNA, 38 bp, Artificial Sequence
  Synthetic oligonucleotide
gaggagcgggtggaagggtagctggggggatgttgtga

SEQ ID NO: 32978 - DNA, 38 bp, Artificial Sequence
  Synthetic oligonucleotide
tccacacgggctatactatcgtgccgtcgaatccttga

SEQ ID NO: 32979 - DNA, 35 bp, Artificial Sequence
  Synthetic oligonucleotide
gtggcccctgcaacatctaatttggccacggatta

SEQ ID NO: 32980 - DNA, 35 bp, Artificial Sequence
  Synthetic oligonucleotide
tcctccccagtaaggtgatcgactcatccttgccc

SEQ ID NO: 32981 - DNA, 35 bp, Artificial Sequence
  Synthetic oligonucleotide
acatccctatccgttagtgcctcactgctggcgcc

SEQ ID NO: 32982 - DNA, 35 bp, Artificial Sequence
  Synthetic oligonucleotide
tcttaccacccaggttcgtgagggtaacccccatc

SEQ ID NO: 32983 - DNA, 35 bp, Artificial Sequence
  Synthetic oligonucleotide
tacgacgccgtgcacccgggtgcctactccccctc

SEQ ID NO: 32984 - DNA, 35 bp, Artificial Sequence
  Synthetic oligonucleotide
tgggtgaactccgtttgggtcctgctcgccgattc

SEQ ID NO: 32985 - DNA, 35 bp, Artificial Sequence
  Synthetic oligonucleotide
ttcgatacgccagcatacgcattcaccgaccatcg

SEQ ID NO: 32986 - DNA, 35 bp, Artificial Sequence
  Synthetic oligonucleotide
agctacgtagctcgcttaaccattccctctcatgg

SEQ ID NO: 32987 - DNA, 35 bp, Artificial Sequence
  Synthetic oligonucleotide
aggagggaataggggtggaacggataatcatgttg

SEQ ID NO: 32988 - DNA, 35 bp, Artificial Sequence
  Synthetic oligonucleotide
gcaccccgcaaggtacatccgcttacacaaaaact

SEQ ID NO: 32989 - DNA, 35 bp, Artificial Sequence
  Synthetic oligonucleotide
ggtagcccacactcttgtctgtcattctcccggtt

SEQ ID NO: 32990 - DNA, 35 bp, Artificial Sequence
  Synthetic oligonucleotide
gctaagcctacatggtcaagtccatcatcccacca

SEQ ID NO: 32991 - DNA, 36 bp, Artificial Sequence
  Synthetic oligonucleotide
tcaccgccactccactaatccttgtcccccgacgca

SEQ ID NO: 32992 - DNA, 35 bp, Artificial Sequence
  Synthetic oligonucleotide
gtgcacacctccaaccaccttctgctataggggca

SEQ ID NO: 32993 - DNA, 36 bp, Artificial Sequence
  Synthetic oligonucleotide
gctggcctcactccaaggtccactacgagttactca

SEQ ID NO: 32994 - DNA, 37 bp, Artificial Sequence
  Synthetic oligonucleotide
tgactacctcgggggggccttttcatcttgatttcga

SEQ ID NO: 32995 - DNA, 36 bp, Artificial Sequence
  Synthetic oligonucleotide
gcaacccaggcctgaaccacagaaccttccttcgga

SEQ ID NO: 32996 - DNA, 37 bp, Artificial Sequence
  Synthetic oligonucleotide
attgcgacacgctgtgcactcccgcctttacccatga

SEQ ID NO: 32997 - DNA, 35 bp, Artificial Sequence
  Synthetic oligonucleotide
agcccccgcacaggaattaatgctcgccccactga

SEQ ID NO: 32998 - DNA, 35 bp, Artificial Sequence
  Synthetic oligonucleotide
agacagggtgtggggggtgggttttcgtctggtta

SEQ ID NO: 32999 - DNA, 35 bp, Artificial Sequence
  Synthetic oligonucleotide
gatgtccctaacctcagtgcctagttccacattta

SEQ ID NO: 33000 - DNA, 35 bp, Artificial Sequence
  Synthetic oligonucleotide
gatggtacagattggctcactaaccttacccccgc

SEQ ID NO: 33001 - DNA, 35 bp, Artificial Sequence
  Synthetic oligonucleotide
ttacacgagtccaggaactggctcacctcctaatc

SEQ ID NO: 33002 - DNA, 35 bp, Artificial Sequence
  Synthetic oligonucleotide
acactactggtgacaacccctacgcctcgatatcg

SEQ ID NO: 33003 - DNA, 35 bp, Artificial Sequence
  Synthetic oligonucleotide
tgagtggtggaattaggtgtgtggaagaaagagtg

SEQ ID NO: 33004 - DNA, 35 bp, Artificial Sequence
  Synthetic oligonucleotide
aaccttacgacgagggggaggtgggagtaggggtg

SEQ ID NO: 33005 - DNA, 36 bp, Artificial Sequence
  Synthetic oligonucleotide
gtgtgagggtgatcatgggaaatatgtaggggtcaa

SEQ ID NO: 33006 - DNA, 35 bp, Artificial Sequence
  Synthetic oligonucleotide
agtggccacaactgataccacatcgccccggacca

SEQ ID NO: 33007 - DNA, 37 bp, Artificial Sequence
  Synthetic oligonucleotide
atcctgcaaggatgtctcccaccctgctatcttccga

SEQ ID NO: 33008 - DNA, 37 bp, Artificial Sequence
  Synthetic oligonucleotide
aaagcgaagggggtgaggtaggagggggttaaggcga

SEQ ID NO: 33009 - DNA, 36 bp, Artificial Sequence
  Synthetic oligonucleotide
tcaaacgaccagtagtctcccttttccactcacgga

SEQ ID NO: 33010 - DNA, 38 bp, Artificial Sequence
  Synthetic oligonucleotide
tccgtacaagcgttctaggttttatcactcccccctga

SEQ ID NO: 33011 - DNA, 37 bp, Artificial Sequence
  Synthetic oligonucleotide
gagcaccgttgccctcccgttagtgcgaattccctga

SEQ ID NO: 33012 - DNA, 38 bp, Artificial Sequence
  Synthetic oligonucleotide
tacgccgtccacaatcaaaagacctctcatatcgctga

SEQ ID NO: 33013 - DNA, 38 bp, Artificial Sequence
  Synthetic oligonucleotide
acctccggtgccttgtgcttttagttcttgctctctga

SEQ ID NO: 33014 - DNA, 37 bp, Artificial Sequence
  Synthetic oligonucleotide
tttacaccgcacatcaaccttgtccaacctcccgtga

SEQ ID NO: 33015 - DNA, 37 bp, Artificial Sequence
  Synthetic oligonucleotide
tccactccccacgtagggacctctaggacctccttga

SEQ ID NO: 33016 - DNA, 38 bp, Artificial Sequence
  Synthetic oligonucleotide
atgtgccccggtgtcttttttcatcatttgctggttga

SEQ ID NO: 33017 - DNA, 36 bp, Artificial Sequence
  Synthetic oligonucleotide
ggtagagggggggtgacggggtcggtggatggggta

SEQ ID NO: 33018 - DNA, 35 bp, Artificial Sequence
  Synthetic oligonucleotide
acatcacgaaacgaatcggttccatgggcactacc

SEQ ID NO: 33019 - DNA, 35 bp, Artificial Sequence
  Synthetic oligonucleotide
acaacacacatgcctccatcgacctcgttatgccc

SEQ ID NO: 33020 - DNA, 35 bp, Artificial Sequence
  Synthetic oligonucleotide
attgggccggtgacgctgcactgttcctagtcttc

SEQ ID NO: 33021 - DNA, 35 bp, Artificial Sequence
  Synthetic oligonucleotide
tccaatcgtcattcggcgtcacacaattcttcttc

SEQ ID NO: 33022 - DNA, 35 bp, Artificial Sequence
  Synthetic oligonucleotide
gatagaggcaggctggcccactaccccaattttag

SEQ ID NO: 33023 - DNA, 35 bp, Artificial Sequence
  Synthetic oligonucleotide
tgactccctgcctatttctggtgactttatcatat

SEQ ID NO: 33024 - DNA, 35 bp, Artificial Sequence
  Synthetic oligonucleotide
taacaccgctacaagcaccgctaacccgttgctat

SEQ ID NO: 33025 - DNA, 35 bp, Artificial Sequence
  Synthetic oligonucleotide
gttcccacctggctccccttgattgatcccgcact

SEQ ID NO: 33026 - DNA, 35 bp, Artificial Sequence
  Synthetic oligonucleotide
gatggaggggccgggtggagaatgatgtaatccct

SEQ ID NO: 33027 - DNA, 35 bp, Artificial Sequence
  Synthetic oligonucleotide
accctcaccgtccacactaaaaaaagcctttctgt

SEQ ID NO: 33028 - DNA, 34 bp, Artificial Sequence
  Synthetic oligonucleotide
gaacgccacaccccatggttaaccgaataaaaaa

SEQ ID NO: 33029 - DNA, 36 bp, Artificial Sequence
  Synthetic oligonucleotide
ttcgctggccccacgatcatagtcccgacaaacaaa

SEQ ID NO: 33030 - DNA, 36 bp, Artificial Sequence
  Synthetic oligonucleotide
aagtcaaccacaccccttcgtttacaggccaccaaa

SEQ ID NO: 33031 - DNA, 36 bp, Artificial Sequence
  Synthetic oligonucleotide
gtgcatgctacatgcccgtcctgatcgccgctccaa

SEQ ID NO: 33032 - DNA, 36 bp, Artificial Sequence
  Synthetic oligonucleotide
accatcatccgactcgtaagggtttgaatttataca

SEQ ID NO: 33033 - DNA, 36 bp, Artificial Sequence
  Synthetic oligonucleotide
tgttgcgctcctgttcgctgcttgcaattaccctca

SEQ ID NO: 33034 - DNA, 38 bp, Artificial Sequence
  Synthetic oligonucleotide
tagccgcctgctagcatcgacccacgccaaattcatga

SEQ ID NO: 33035 - DNA, 37 bp, Artificial Sequence
  Synthetic oligonucleotide
tctactgccacccaccggctgcagtccctttcattga

SEQ ID NO: 33036 - DNA, 36 bp, Artificial Sequence
  Synthetic oligonucleotide
gagcctccacgcattatagcatctccgttaccttga

SEQ ID NO: 33037 - DNA, 35 bp, Artificial Sequence
  Synthetic oligonucleotide
tacatgacaactgagctaaggcgattcacccttga

SEQ ID NO: 33038 - DNA, 36 bp, Artificial Sequence
  Synthetic oligonucleotide
gcctccacctcatcctctctaaagcttgggtacgta

SEQ ID NO: 33039 - DNA, 35 bp, Artificial Sequence
  Synthetic oligonucleotide
aagccggactcctgtctaccctccctatgttagac

SEQ ID NO: 33040 - DNA, 35 bp, Artificial Sequence
  Synthetic oligonucleotide
taccacctcgccgactacatgtagcagctgcgtgc

SEQ ID NO: 33041 - DNA, 35 bp, Artificial Sequence
  Synthetic oligonucleotide
gagcgcactgccaaatttttcacacgctattagtc

SEQ ID NO: 33042 - DNA, 35 bp, Artificial Sequence
  Synthetic oligonucleotide
gtccactccaagcattggcatacgaccttacatat

SEQ ID NO: 33043 - DNA, 35 bp, Artificial Sequence
  Synthetic oligonucleotide
tgctcagtcgccggtcttactcgctctgctgtcct

SEQ ID NO: 33044 - DNA, 35 bp, Artificial Sequence
  Synthetic oligonucleotide
gtctaccacccgatactctgcctgttcgttcagct

SEQ ID NO: 33045 - DNA, 35 bp, Artificial Sequence
  Synthetic oligonucleotide
agcatgccaggaacccgcaactcgtctctcctcgt

SEQ ID NO: 33046 - DNA, 36 bp, Artificial Sequence
  Synthetic oligonucleotide
gacacacagcgaccactggacaaacacgtacaccaa

SEQ ID NO: 33047 - DNA, 37 bp, Artificial Sequence
  Synthetic oligonucleotide
gtgaacgagggggattttgagagcaaggtgaacgaga

SEQ ID NO: 33048 - DNA, 38 bp, Artificial Sequence
  Synthetic oligonucleotide
gtggcacgcccgtccatagcgctaccctaccatcctga

SEQ ID NO: 33049 - DNA, 38 bp, Artificial Sequence
  Synthetic oligonucleotide
ggtgccacaccacggtacatatgaattctacttgctga

SEQ ID NO: 33050 - DNA, 37 bp, Artificial Sequence
  Synthetic oligonucleotide
tatactcggcccctaccgccccatgcgttctccgtga

SEQ ID NO: 33051 - DNA, 36 bp, Artificial Sequence
  Synthetic oligonucleotide
gccaccacctttgacacagggcttaaactgagctta

SEQ ID NO: 33052 - DNA, 35 bp, Artificial Sequence
  Synthetic oligonucleotide
atacgtagcgatcaccggcattggccccacccaac

SEQ ID NO: 33053 - DNA, 35 bp, Artificial Sequence
  Synthetic oligonucleotide
gccacatcccgaggcaccgtatgcaagtgcttcac

SEQ ID NO: 33054 - DNA, 35 bp, Artificial Sequence
  Synthetic oligonucleotide
atgcagagggttgcactaccagaccttcattgccc

SEQ ID NO: 33055 - DNA, 35 bp, Artificial Sequence
  Synthetic oligonucleotide
ggaccggtgcaggtctggcaaatagccgtttttcc

SEQ ID NO: 33056 - DNA, 35 bp, Artificial Sequence
  Synthetic oligonucleotide
acaccctgctcgcagtccgaaagacgaacgtgctc

SEQ ID NO: 33057 - DNA, 35 bp, Artificial Sequence
  Synthetic oligonucleotide
tcactgcccgcccaacagtgatcgttttaataacg

SEQ ID NO: 33058 - DNA, 35 bp, Artificial Sequence
  Synthetic oligonucleotide
tgttgttcctcccactccacgcacagtattatgtg

SEQ ID NO: 33059 - DNA, 35 bp, Artificial Sequence
  Synthetic oligonucleotide
tgcaccccttctgccgcattcacatgctttggaat

SEQ ID NO: 33060 - DNA, 36 bp, Artificial Sequence
  Synthetic oligonucleotide
acgcatccccccccatttttccgtagtcggacgaca

SEQ ID NO: 33061 - DNA, 35 bp, Artificial Sequence
  Synthetic oligonucleotide
tcacctctatcacacattcaagcaccaggtcccca

SEQ ID NO: 33062 - DNA, 36 bp, Artificial Sequence
  Synthetic oligonucleotide
agtccatagcatgcactatcactatgtccctgttca

SEQ ID NO: 33063 - DNA, 36 bp, Artificial Sequence
  Synthetic oligonucleotide
tcccgcccctgactccggcattagactgcctctaga

SEQ ID NO: 33064 - DNA, 37 bp, Artificial Sequence
  Synthetic oligonucleotide
ttccgctgatcaccaccgacaagaatcccgcccccga

SEQ ID NO: 33065 - DNA, 36 bp, Artificial Sequence
  Synthetic oligonucleotide
gatgccttaccttcccgttgctagtgccgacctcga

SEQ ID NO: 33066 - DNA, 38 bp, Artificial Sequence
  Synthetic oligonucleotide
tacacggtcctgggggggtgggatggggcccatttcga

SEQ ID NO: 33067 - DNA, 37 bp, Artificial Sequence
  Synthetic oligonucleotide
acgacgagcaggcaaagggaggctaggagtaaaagga

SEQ ID NO: 33068 - DNA, 36 bp, Artificial Sequence
  Synthetic oligonucleotide
gaccacgcactctgtacgcctacggctctttttgga

SEQ ID NO: 33069 - DNA, 38 bp, Artificial Sequence
  Synthetic oligonucleotide
tcccgtcgccaccacgcccatcttgctcaagcaagtga

SEQ ID NO: 33070 - DNA, 37 bp, Artificial Sequence
  Synthetic oligonucleotide
tacacggtggggcatgggagcgagggatagcatgtga

SEQ ID NO: 33071 - DNA, 35 bp, Artificial Sequence
  Synthetic oligonucleotide
gttctcccctcacgacctgttgaacgctacgaaac

SEQ ID NO: 33072 - DNA, 35 bp, Artificial Sequence
  Synthetic oligonucleotide
ttcccacgctgtgcatctttcgtttactttgtcac

SEQ ID NO: 33073 - DNA, 35 bp, Artificial Sequence
  Synthetic oligonucleotide
ggaccatattctgagctacacccggaaggcctacc

SEQ ID NO: 33074 - DNA, 35 bp, Artificial Sequence
  Synthetic oligonucleotide
gtctgcccactctttagtttaatcgctctgattcc

SEQ ID NO: 33075 - DNA, 35 bp, Artificial Sequence
  Synthetic oligonucleotide
acttgtcgcgtgtaggcccttcgcgctctgttatc

SEQ ID NO: 33076 - DNA, 35 bp, Artificial Sequence
  Synthetic oligonucleotide
taacaggcccccttcgtgcgtaaatgctacttgtc

SEQ ID NO: 33077 - DNA, 35 bp, Artificial Sequence
  Synthetic oligonucleotide
attgggtgaggtggccggtatggcggggtgcggcg

SEQ ID NO: 33078 - DNA, 35 bp, Artificial Sequence
  Synthetic oligonucleotide
acacccatgagtacgaccgcccaccccagcttatg

SEQ ID NO: 33079 - DNA, 35 bp, Artificial Sequence
  Synthetic oligonucleotide
taggaccattcatccggagtttcatatcgatccat

SEQ ID NO: 33080 - DNA, 35 bp, Artificial Sequence
  Synthetic oligonucleotide
tgccgtgtgtggtatcccagccatccttctcttat

SEQ ID NO: 33081 - DNA, 35 bp, Artificial Sequence
  Synthetic oligonucleotide
gcccccgcgcaaatctcgtcacccgaggcatagct

SEQ ID NO: 33082 - DNA, 35 bp, Artificial Sequence
  Synthetic oligonucleotide
gatcctgcccgagaacggaccagttctacatattt

SEQ ID NO: 33083 - DNA, 36 bp, Artificial Sequence
  Synthetic oligonucleotide
gtcactcctccttctgcatcggtactactggtgtca

SEQ ID NO: 33084 - DNA, 37 bp, Artificial Sequence
  Synthetic oligonucleotide
tcacgtgaagggagggtttggttaatacggtaaagga

SEQ ID NO: 33085 - DNA, 35 bp, Artificial Sequence
  Synthetic oligonucleotide
gttgcacaccctgctctatatcacccaaggacgga

SEQ ID NO: 33086 - DNA, 38 bp, Artificial Sequence
  Synthetic oligonucleotide
tatcacttgcatgtctgttcacgccgcactatcgctga

SEQ ID NO: 33087 - DNA, 36 bp, Artificial Sequence
  Synthetic oligonucleotide
taggaaccatcacaccagtccccccctccggtgtga

SEQ ID NO: 33088 - DNA, 37 bp, Artificial Sequence
  Synthetic oligonucleotide
accctgtcatcccctcccaaagggcacccattcttga

SEQ ID NO: 33089 - DNA, 37 bp, Artificial Sequence
  Synthetic oligonucleotide
accgacatcaccacacgtgtaacccggatccttttga

SEQ ID NO: 33090 - DNA, 35 bp, Artificial Sequence
  Synthetic oligonucleotide
gagcaaagcgacctgccacgaacacaactgcacta

SEQ ID NO: 33091 - DNA, 36 bp, Artificial Sequence
  Synthetic oligonucleotide
tctgactcacctctctgcaatgcagtaatctgctta

SEQ ID NO: 33092 - DNA, 35 bp, Artificial Sequence
  Synthetic oligonucleotide
ttcgagccgtccagcgttcacctctcaccttgccc

SEQ ID NO: 33093 - DNA, 35 bp, Artificial Sequence
  Synthetic oligonucleotide
ttttatgcccccttcagtgccggaaggcatgatcc

SEQ ID NO: 33094 - DNA, 35 bp, Artificial Sequence
  Synthetic oligonucleotide
gtctcggcctggtccaaacccgcaccccctgctag

SEQ ID NO: 33095 - DNA, 35 bp, Artificial Sequence
  Synthetic oligonucleotide
gaccaacctacgtccgactcacacattcttcaggg

SEQ ID NO: 33096 - DNA, 35 bp, Artificial Sequence
  Synthetic oligonucleotide
atgcgcgttaccccgcattcttttccttccgctgg

SEQ ID NO: 33097 - DNA, 35 bp, Artificial Sequence
  Synthetic oligonucleotide
tccaaccgacggccctgtttgtatttcggtcagtg

SEQ ID NO: 33098 - DNA, 35 bp, Artificial Sequence
  Synthetic oligonucleotide
tgccgagcacccccgcactgatctacaagcgcttg

SEQ ID NO: 33099 - DNA, 35 bp, Artificial Sequence
  Synthetic oligonucleotide
tcccaccacactgctattcgatgcggtaaatctct

SEQ ID NO: 33100 - DNA, 35 bp, Artificial Sequence
  Synthetic oligonucleotide
tatggcccggtaccggtttctcgctaacaatttct

SEQ ID NO: 33101 - DNA, 35 bp, Artificial Sequence
  Synthetic oligonucleotide
gtgaaccatccttgctgctttgacgaaaacgccaa

SEQ ID NO: 33102 - DNA, 36 bp, Artificial Sequence
  Synthetic oligonucleotide
agtactccctccatgcctccgtatccgcgttttgca

SEQ ID NO: 33103 - DNA, 36 bp, Artificial Sequence
  Synthetic oligonucleotide
aacgtccacttaacgcgctcgctgtactactcttca

SEQ ID NO: 33104 - DNA, 37 bp, Artificial Sequence
  Synthetic oligonucleotide
gctgcctgcatcgacgtacactgttactatccttcga

SEQ ID NO: 33105 - DNA, 25 bp, Artificial Sequence
  Synthetic oligonucleotide
gcatgcctccgaactcctgctctga

SEQ ID NO: 33106 - DNA, 37 bp, Artificial Sequence
  Synthetic oligonucleotide
gattagcagggggggcatgtgggtacacggaatgtga

SEQ ID NO: 33107 - DNA, 35 bp, Artificial Sequence
  Synthetic oligonucleotide
gccctgccatgtctttccctgccacaacattgtga

SEQ ID NO: 33108 - DNA, 37 bp, Artificial Sequence
  Synthetic oligonucleotide
gcccgcctcatcttcggttaacgctgacccactttga

SEQ ID NO: 33109 - DNA, 35 bp, Artificial Sequence
  Synthetic oligonucleotide
ggaataccacctgagccctgtaatcgtaccgaacc

SEQ ID NO: 33110 - DNA, 35 bp, Artificial Sequence
  Synthetic oligonucleotide
gctgacgcaccttcgccttttgtccggtttctggc

SEQ ID NO: 33111 - DNA, 35 bp, Artificial Sequence
  Synthetic oligonucleotide
acccctgcgctggcatgacacgcccccacaccgag

SEQ ID NO: 33112 - DNA, 35 bp, Artificial Sequence
  Synthetic oligonucleotide
ggaccaggtgcccagtttccaattattgcctaacg

SEQ ID NO: 33113 - DNA, 35 bp, Artificial Sequence
  Synthetic oligonucleotide
ttgtttcaccctcggacggcactcatcccgtatgg

SEQ ID NO: 33114 - DNA, 35 bp, Artificial Sequence
  Synthetic oligonucleotide
ttcagtgctccggccgtcctaattcagttttcctg

SEQ ID NO: 33115 - DNA, 35 bp, Artificial Sequence
  Synthetic oligonucleotide
gctgagcaagggaaaagacttcgggttggatgctg

SEQ ID NO: 33116 - DNA, 35 bp, Artificial Sequence
  Synthetic oligonucleotide
atccagtgtgcacttcatgttttctggccatgcat

SEQ ID NO: 33117 - DNA, 35 bp, Artificial Sequence
  Synthetic oligonucleotide
gtatcccacggctttccaccacacagatccctcat

SEQ ID NO: 33118 - DNA, 35 bp, Artificial Sequence
  Synthetic oligonucleotide
accgtcaggccggatccgtaatatctgtctccatt

SEQ ID NO: 33119 - DNA, 35 bp, Artificial Sequence
  Synthetic oligonucleotide
accacctggggggcccttactcttccggacgccaa

SEQ ID NO: 33120 - DNA, 36 bp, Artificial Sequence
  Synthetic oligonucleotide
acttcccgccacacccgctccccgccatttcttgaa

SEQ ID NO: 33121 - DNA, 36 bp, Artificial Sequence
  Synthetic oligonucleotide
gtggatcgacctcgctaacctgtgcccctcataaca

SEQ ID NO: 33122 - DNA, 36 bp, Artificial Sequence
  Synthetic oligonucleotide
tcgcaacaccttctatcgacaacactgtgtggtcca

SEQ ID NO: 33123 - DNA, 35 bp, Artificial Sequence
  Synthetic oligonucleotide
gacctgtcttgcgccctgctactggcccatttcca

SEQ ID NO: 33124 - DNA, 37 bp, Artificial Sequence
  Synthetic oligonucleotide
agacctcgggaggtggagagcggggcagggcgggaga

SEQ ID NO: 33125 - DNA, 35 bp, Artificial Sequence
  Synthetic oligonucleotide
gccatgacccattacgtccccctcggtgagaccga

SEQ ID NO: 33126 - DNA, 36 bp, Artificial Sequence
  Synthetic oligonucleotide
acagaccacccctggagtccacaagaccccgcccga

SEQ ID NO: 33127 - DNA, 35 bp, Artificial Sequence
  Synthetic oligonucleotide
tattgcaggcctctgttccgctttttcactcccga

SEQ ID NO: 33128 - DNA, 36 bp, Artificial Sequence
  Synthetic oligonucleotide
atcaccatgagcctcacagaccccgccatgcccgga

SEQ ID NO: 33129 - DNA, 37 bp, Artificial Sequence
  Synthetic oligonucleotide
accgaactaggtcgggcacgaaataggggggcgggga

SEQ ID NO: 33130 - DNA, 37 bp, Artificial Sequence
  Synthetic oligonucleotide
gatagagtgcggtgggcttaatcatattggggtggga

SEQ ID NO: 33131 - DNA, 38 bp, Artificial Sequence
  Synthetic oligonucleotide
atgcggaaggggcggcctaaaaaggttggttggaatga

SEQ ID NO: 33132 - DNA, 37 bp, Artificial Sequence
  Synthetic oligonucleotide
gccccatccgcacatgttagggtacttgccttaatga

SEQ ID NO: 33133 - DNA, 38 bp, Artificial Sequence
  Synthetic oligonucleotide
gccgtcccccacgttttcaccgtcgacttccaccttga

SEQ ID NO: 33134 - DNA, 38 bp, Artificial Sequence
  Synthetic oligonucleotide
gtgagccggacgatgagaggaggaggaatgcgggttga

SEQ ID NO: 33135 - DNA, 36 bp, Artificial Sequence
  Synthetic oligonucleotide
ttgggcacgggccttcttgctcacttcaccactcta

SEQ ID NO: 33136 - DNA, 36 bp, Artificial Sequence
  Synthetic oligonucleotide
tgcacccaactctatctttagcacttgagcaggtta

SEQ ID NO: 33137 - DNA, 35 bp, Artificial Sequence
  Synthetic oligonucleotide
gcaaccgagaatctcaagcagcctggcactaccac

SEQ ID NO: 33138 - DNA, 35 bp, Artificial Sequence
  Synthetic oligonucleotide
atacccgccgaagcacccgcctcacaccggcgacc

SEQ ID NO: 33139 - DNA, 35 bp, Artificial Sequence
  Synthetic oligonucleotide
tatgtccctgccttcctttaatgggcaccgttccc

SEQ ID NO: 33140 - DNA, 35 bp, Artificial Sequence
  Synthetic oligonucleotide
tgtcgccgctcctcgcattttctgtttgcatacgc

SEQ ID NO: 33141 - DNA, 35 bp, Artificial Sequence
  Synthetic oligonucleotide
gaaggccgtgtgcctgagcgtactgaatgtgaggc

SEQ ID NO: 33142 - DNA, 35 bp, Artificial Sequence
  Synthetic oligonucleotide
tctcctggacgcaggccagctttacacttctgctc

SEQ ID NO: 33143 - DNA, 35 bp, Artificial Sequence
  Synthetic oligonucleotide
aacccaaccacgtccatactgacactatcaactcg

SEQ ID NO: 33144 - DNA, 35 bp, Artificial Sequence
  Synthetic oligonucleotide
ttgatgtcatcacgtctgtccccgttatcaactcg

SEQ ID NO: 33145 - DNA, 35 bp, Artificial Sequence
  Synthetic oligonucleotide
gcacacgtatgactgggggcggaggaacacgaaat

SEQ ID NO: 33146 - DNA, 35 bp, Artificial Sequence
  Synthetic oligonucleotide
cccgctgccccatccgcacatctaatctgcagcct

SEQ ID NO: 33147 - DNA, 35 bp, Artificial Sequence
  Synthetic oligonucleotide
tagtgacgtaccgcggcggcgcatctccatccctt

SEQ ID NO: 33148 - DNA, 36 bp, Artificial Sequence
  Synthetic oligonucleotide
actgtccgagctcatcaccacaagtcccagcccaca

SEQ ID NO: 33149 - DNA, 36 bp, Artificial Sequence
  Synthetic oligonucleotide
tgatgcgtcattccgcgcacaccacattgttctaca

SEQ ID NO: 33150 - DNA, 35 bp, Artificial Sequence
  Synthetic oligonucleotide
ttagcaaaactgcgtgtccctgtcgttaccatcca

SEQ ID NO: 33151 - DNA, 36 bp, Artificial Sequence
  Synthetic oligonucleotide
gggaccgtgggaaagcaatagtaagggatgggttca

SEQ ID NO: 33152 - DNA, 37 bp, Artificial Sequence
  Synthetic oligonucleotide
tcaactgcgctaaatttcgcctcgcgctcccgaacga

SEQ ID NO: 33153 - DNA, 36 bp, Artificial Sequence
  Synthetic oligonucleotide
tgtctcgccgcatccgacttccatcttctgtcacga

SEQ ID NO: 33154 - DNA, 38 bp, Artificial Sequence
  Synthetic oligonucleotide
accagcctcgttgctatggccttacatccttttcgtga

SEQ ID NO: 33155 - DNA, 38 bp, Artificial Sequence
  Synthetic oligonucleotide
gacgtgacgcgctgtgctgcctccaattgcctgtgtga

SEQ ID NO: 33156 - DNA, 37 bp, Artificial Sequence
  Synthetic oligonucleotide
tccaccaagacagcgcatctgtactgccccctcttga

SEQ ID NO: 33157 - DNA, 36 bp, Artificial Sequence
  Synthetic oligonucleotide
atgtatccctccatgaagtatcccctgtctcgccta

SEQ ID NO: 33158 - DNA, 36 bp, Artificial Sequence
  Synthetic oligonucleotide
gaacccctccaacgttaactacaagccaatcccgta

SEQ ID NO: 33159 - DNA, 35 bp, Artificial Sequence
  Synthetic oligonucleotide
gccttgtcgtcctgcgatttactaccaccacctta

SEQ ID NO: 33160 - DNA, 36 bp, Artificial Sequence
  Synthetic oligonucleotide
tcatctcgacgcagtcttctctggggctcttgttta

SEQ ID NO: 33161 - DNA, 35 bp, Artificial Sequence
  Synthetic oligonucleotide
tccccctcttgcgacaccagtggtcccaattctac

SEQ ID NO: 33162 - DNA, 35 bp, Artificial Sequence
  Synthetic oligonucleotide
gttatcaccgcagcccttgtacccccaggttgtgc

SEQ ID NO: 33163 - DNA, 35 bp, Artificial Sequence
  Synthetic oligonucleotide
gcctcctcaccaatgatccgcaccatacattcacg

SEQ ID NO: 33164 - DNA, 35 bp, Artificial Sequence
  Synthetic oligonucleotide
gcacactcaccccaggatcattcaccatccagtcg

SEQ ID NO: 33165 - DNA, 35 bp, Artificial Sequence
  Synthetic oligonucleotide
tttggctacctcctcaactcccttatcgcccgggg

SEQ ID NO: 33166 - DNA, 35 bp, Artificial Sequence
  Synthetic oligonucleotide
gagtcagtttgcccatcccgttccacctggttcct

SEQ ID NO: 33167 - DNA, 35 bp, Artificial Sequence
  Synthetic oligonucleotide
gatggagctgcggtcctatagcaccagcacccctt

SEQ ID NO: 33168 - DNA, 35 bp, Artificial Sequence
  Synthetic oligonucleotide
acgcctcacgttaaactgagcgacccttccatgtt

SEQ ID NO: 33169 - DNA, 36 bp, Artificial Sequence
  Synthetic oligonucleotide
tgaacgcctacaatgctctctgcgtattaatccaca

SEQ ID NO: 33170 - DNA, 35 bp, Artificial Sequence
  Synthetic oligonucleotide
tgacgtcctggcccccctgattcactggtgtcgca

SEQ ID NO: 33171 - DNA, 36 bp, Artificial Sequence
  Synthetic oligonucleotide
gaaccaccgctgtattcttggcgcctaacgttctca

SEQ ID NO: 33172 - DNA, 37 bp, Artificial Sequence
  Synthetic oligonucleotide
aaggggtgaagcaggagtagtggacggtcacaacaga

SEQ ID NO: 33173 - DNA, 37 bp, Artificial Sequence
  Synthetic oligonucleotide
gtgggggattaggagaaaaacatgaagagacgcggga

SEQ ID NO: 33174 - DNA, 37 bp, Artificial Sequence
  Synthetic oligonucleotide
atcaagctcgcgccccccctccgatctccacatgtga

SEQ ID NO: 33175 - DNA, 36 bp, Artificial Sequence
  Synthetic oligonucleotide
acaccaccattctttctcacttgtgtaaatgccata

SEQ ID NO: 33176 - DNA, 36 bp, Artificial Sequence
  Synthetic oligonucleotide
agtgctagaggttagggggggtggaatgagtagata

SEQ ID NO: 33177 - DNA, 35 bp, Artificial Sequence
  Synthetic oligonucleotide
ttccggactccgctatgctttgcctccccctacta

SEQ ID NO: 33178 - DNA, 36 bp, Artificial Sequence
  Synthetic oligonucleotide
tatattaccgcatggtgcacatggctcacttctcta

SEQ ID NO: 33179 - DNA, 36 bp, Artificial Sequence
  Synthetic oligonucleotide
tcgctacaagcgtgctcgcccccgtcttttcacgta

SEQ ID NO: 33180 - DNA, 35 bp, Artificial Sequence
  Synthetic oligonucleotide
gtctactgtgaacgccatgagtttcgccttgatta

SEQ ID NO: 33181 - DNA, 38 bp, Artificial Sequence
  Synthetic oligonucleotide
cccgccgtcaccccctacccgcacgcagaaggacctta

SEQ ID NO: 33182 - DNA, 36 bp, Artificial Sequence
  Synthetic oligonucleotide
aacgtgcatatacgtcctttttgtcccttcctctta

SEQ ID NO: 33183 - DNA, 35 bp, Artificial Sequence
  Synthetic oligonucleotide
tccatgccacatatcgaggcaacgccccactaaac

SEQ ID NO: 33184 - DNA, 35 bp, Artificial Sequence
  Synthetic oligonucleotide
gtccaattgcagtcccgcatcgagtcgaaccatac

SEQ ID NO: 33185 - DNA, 35 bp, Artificial Sequence
  Synthetic oligonucleotide
tactgcggcaatacacgccctctggtgccaaggcc

SEQ ID NO: 33186 - DNA, 35 bp, Artificial Sequence
  Synthetic oligonucleotide
atcgaccttgccctatagctgatttgcacctggcc

SEQ ID NO: 33187 - DNA, 35 bp, Artificial Sequence
  Synthetic oligonucleotide
tgctacctatgggctgaacaactttgactagcttc

SEQ ID NO: 33188 - DNA, 35 bp, Artificial Sequence
  Synthetic oligonucleotide
gttggtgtaccatcactctcactccgtgcttcttc

SEQ ID NO: 33189 - DNA, 35 bp, Artificial Sequence
  Synthetic oligonucleotide
atggacgtgctgcaggtcaacatcacttttcgagg

SEQ ID NO: 33190 - DNA, 35 bp, Artificial Sequence
  Synthetic oligonucleotide
atactcgcgacttgatctcctggaacgctccatct

SEQ ID NO: 33191 - DNA, 35 bp, Artificial Sequence
  Synthetic oligonucleotide
gacaggcgaaggaatgacgttaggggagggggtgt

SEQ ID NO: 33192 - DNA, 35 bp, Artificial Sequence
  Synthetic oligonucleotide
ttgcaccaacacccctgatttttgcctagctaatt

SEQ ID NO: 33193 - DNA, 36 bp, Artificial Sequence
  Synthetic oligonucleotide
acatgccccctgccggtgttgcgacgcgattcaaca

SEQ ID NO: 33194 - DNA, 36 bp, Artificial Sequence
  Synthetic oligonucleotide
gtgaaggggcaggaaactttatgcaagggctcggca

SEQ ID NO: 33195 - DNA, 35 bp, Artificial Sequence
  Synthetic oligonucleotide
actccctgcacaacctgacgattcacccatctaga

SEQ ID NO: 33196 - DNA, 37 bp, Artificial Sequence
  Synthetic oligonucleotide
tacgccaccatgattaccgcgcgtagttcccttagga

SEQ ID NO: 33197 - DNA, 37 bp, Artificial Sequence
  Synthetic oligonucleotide
gaaagagagatagaggggaggagcgagaagcaacgga

SEQ ID NO: 33198 - DNA, 37 bp, Artificial Sequence
  Synthetic oligonucleotide
gacctgatccatccgctgccccaccctttggtaggga

SEQ ID NO: 33199 - DNA, 38 bp, Artificial Sequence
  Synthetic oligonucleotide
tactgtccatctgcgcccgccccccctctcgaccatga

SEQ ID NO: 33200 - DNA, 38 bp, Artificial Sequence
  Synthetic oligonucleotide
gtgccgcagctgtataggcttctccctcgtatccctga

SEQ ID NO: 33201 - DNA, 38 bp, Artificial Sequence
  Synthetic oligonucleotide
gtccacgtactggtgcctcctccccttggattctctga

SEQ ID NO: 33202 - DNA, 36 bp, Artificial Sequence
  Synthetic oligonucleotide
tcatccaccacctggtcatgtctttttacaagttga

SEQ ID NO: 33203 - DNA, 38 bp, Artificial Sequence
  Synthetic oligonucleotide
gagacagggggtagggcattgtagcaaggagtggttga

SEQ ID NO: 33204 - DNA, 35 bp, Artificial Sequence
  Synthetic oligonucleotide
tgctgaatccgctttccacttcgcctcggtatcta

SEQ ID NO: 33205 - DNA, 36 bp, Artificial Sequence
  Synthetic oligonucleotide
tatcatgcaggctgtcctttctgcgctgttaccgta

SEQ ID NO: 33206 - DNA, 36 bp, Artificial Sequence
  Synthetic oligonucleotide
atcgtaaacgcccacattagctctcctccgcatgta

SEQ ID NO: 33207 - DNA, 35 bp, Artificial Sequence
  Synthetic oligonucleotide
tgcatgtgagctgcacttcctgcgacccttctacc

SEQ ID NO: 33208 - DNA, 34 bp, Artificial Sequence
  Synthetic oligonucleotide
gggacacccatagtataccgttcctccgggcccc

SEQ ID NO: 33209 - DNA, 35 bp, Artificial Sequence
  Synthetic oligonucleotide
aggaccccttgccattgaagccctgaccgtggttc

SEQ ID NO: 33210 - DNA, 35 bp, Artificial Sequence
  Synthetic oligonucleotide
tgccatatcgccctccatactgcagacggtgcctg

SEQ ID NO: 33211 - DNA, 35 bp, Artificial Sequence
  Synthetic oligonucleotide
gagcctccgtcgtccctattaccgctgtcatgaat

SEQ ID NO: 33212 - DNA, 35 bp, Artificial Sequence
  Synthetic oligonucleotide
tgacgcatcggtcttagccgcgttttcgctcctct

SEQ ID NO: 33213 - DNA, 35 bp, Artificial Sequence
  Synthetic oligonucleotide
ggtccccccttgcgccaatagccttccttccttgt

SEQ ID NO: 33214 - DNA, 35 bp, Artificial Sequence
  Synthetic oligonucleotide
ggacgctctcttcgctttttgttcctggctccgtt

SEQ ID NO: 33215 - DNA, 35 bp, Artificial Sequence
  Synthetic oligonucleotide
tcctcatccgcacatgcctagggctcttcccattt

SEQ ID NO: 33216 - DNA, 34 bp, Artificial Sequence
  Synthetic oligonucleotide
atgcgcctatggctgccgctcgaccctcactttt

SEQ ID NO: 33217 - DNA, 35 bp, Artificial Sequence
  Synthetic oligonucleotide
tggtacatcagggtccctccgttccacctagcaca

SEQ ID NO: 33218 - DNA, 36 bp, Artificial Sequence
  Synthetic oligonucleotide
ccaccatagccgcctcatctcggtctcaccctgtca

SEQ ID NO: 33219 - DNA, 36 bp, Artificial Sequence
  Synthetic oligonucleotide
gtctcacatgtatgtcccattcccgtttcggtttca

SEQ ID NO: 33220 - DNA, 37 bp, Artificial Sequence
  Synthetic oligonucleotide
gcgtggggggggagggttgtaataggagggctcaaga

SEQ ID NO: 33221 - DNA, 37 bp, Artificial Sequence
  Synthetic oligonucleotide
ttcaccccgcccctatatcgccatcctctgggtccga

SEQ ID NO: 33222 - DNA, 37 bp, Artificial Sequence
  Synthetic oligonucleotide
gtacaaggacgagcaggtgtgggagttgggagatgga

SEQ ID NO: 33223 - DNA, 38 bp, Artificial Sequence
  Synthetic oligonucleotide
gttagggagggaacgtggggcaaagcaaagacagatga

SEQ ID NO: 33224 - DNA, 36 bp, Artificial Sequence
  Synthetic oligonucleotide
gccattgcgcctcctacagtttctagccgacactga

SEQ ID NO: 33225 - DNA, 38 bp, Artificial Sequence
  Synthetic oligonucleotide
atcgcaatcagcccgaagcccagcactcccgcccctga

SEQ ID NO: 33226 - DNA, 38 bp, Artificial Sequence
  Synthetic oligonucleotide
atagtggatgcaggggggataaaatgggatggtgctga

SEQ ID NO: 33227 - DNA, 37 bp, Artificial Sequence
  Synthetic oligonucleotide
atggtgggtgtgggaggaaagtggggtccgggcgtga

SEQ ID NO: 33228 - DNA, 37 bp, Artificial Sequence
  Synthetic oligonucleotide
gattgggagtaagcaaaaaccaggggacgggcggtga

SEQ ID NO: 33229 - DNA, 38 bp, Artificial Sequence
  Synthetic oligonucleotide
ttagtgcgctcccagcttctctatgattcacctgttga

SEQ ID NO: 33230 - DNA, 36 bp, Artificial Sequence
  Synthetic oligonucleotide
acgacggatccctgtttggtcgccacgcatttcata

SEQ ID NO: 33231 - DNA, 37 bp, Artificial Sequence
  Synthetic oligonucleotide
tgcgcatcggttcatctgctactcactcgtccgacta

SEQ ID NO: 33232 - DNA, 35 bp, Artificial Sequence
  Synthetic oligonucleotide
gcagagctgtgggaccagccgcctatttccctcta

SEQ ID NO: 33233 - DNA, 36 bp, Artificial Sequence
  Synthetic oligonucleotide
tctaaccccagcgctcggattcgtaacttccccgta

SEQ ID NO: 33234 - DNA, 35 bp, Artificial Sequence
  Synthetic oligonucleotide
gactcccatttcaatctcgacctcatgtgcgtgcc

SEQ ID NO: 33235 - DNA, 35 bp, Artificial Sequence
  Synthetic oligonucleotide
gtagtacggctctctggttttcggtccctttctcc

SEQ ID NO: 33236 - DNA, 35 bp, Artificial Sequence
  Synthetic oligonucleotide
ggtacggttcacccccgggacttacggtacaaatc

SEQ ID NO: 33237 - DNA, 35 bp, Artificial Sequence
  Synthetic oligonucleotide
gccggaggcccttctctgtaaacacgaataatgtc

SEQ ID NO: 33238 - DNA, 35 bp, Artificial Sequence
  Synthetic oligonucleotide
tagatccccttctacctgcgcaaatgacttgctag

SEQ ID NO: 33239 - DNA, 35 bp, Artificial Sequence
  Synthetic oligonucleotide
gccgcccggcacctgagcatcttgaaccgatactg

SEQ ID NO: 33240 - DNA, 35 bp, Artificial Sequence
  Synthetic oligonucleotide
gcccctctggccccccctgttaaggatgacacctg

SEQ ID NO: 33241 - DNA, 35 bp, Artificial Sequence
  Synthetic oligonucleotide
agtgggccggttagcctccgtctatagcacctttt

SEQ ID NO: 33242 - DNA, 36 bp, Artificial Sequence
  Synthetic oligonucleotide
gcatccccacatgcgaagggtacgcatcaaccacga

SEQ ID NO: 33243 - DNA, 37 bp, Artificial Sequence
  Synthetic oligonucleotide
gtccgccactccgacttgcattcgttcggcctgccga

SEQ ID NO: 33244 - DNA, 37 bp, Artificial Sequence
  Synthetic oligonucleotide
gcctgcatccaccgttgactgtcctcatggcctccga

SEQ ID NO: 33245 - DNA, 37 bp, Artificial Sequence
  Synthetic oligonucleotide
atcactgttacggcctgtaaaacacacttcccatcga

SEQ ID NO: 33246 - DNA, 37 bp, Artificial Sequence
  Synthetic oligonucleotide
gcgagagtcgggggatttggcagtggcgcacgtatga

SEQ ID NO: 33247 - DNA, 38 bp, Artificial Sequence
  Synthetic oligonucleotide
ttcccgcccccttacctcaccttgtcaaagttacgtga

SEQ ID NO: 33248 - DNA, 38 bp, Artificial Sequence
  Synthetic oligonucleotide
gagtcgataggaggggcggagggtaagtctaattttga

SEQ ID NO: 33249 - DNA, 35 bp, Artificial Sequence
  Synthetic oligonucleotide
tgcacccccccgccgatggctttgtgaactgtata

SEQ ID NO: 33250 - DNA, 35 bp, Artificial Sequence
  Synthetic oligonucleotide
gagcgccagtccgaagcttcactcactgccgctac

SEQ ID NO: 33251 - DNA, 35 bp, Artificial Sequence
  Synthetic oligonucleotide
agccaaacccagtacctcgagcccgtgcgacctgc

SEQ ID NO: 33252 - DNA, 35 bp, Artificial Sequence
  Synthetic oligonucleotide
cacaacaccctctcgtcttggtgcctgccatttgc

SEQ ID NO: 33253 - DNA, 35 bp, Artificial Sequence
  Synthetic oligonucleotide
gcacgataagggcgtcacacatgccttttagcttc

SEQ ID NO: 33254 - DNA, 35 bp, Artificial Sequence
  Synthetic oligonucleotide
tagcaacccacataccatccgttcacatagcttag

SEQ ID NO: 33255 - DNA, 35 bp, Artificial Sequence
  Synthetic oligonucleotide
aacaagacggagcatggcatggaagggagtagaat

SEQ ID NO: 33256 - DNA, 35 bp, Artificial Sequence
  Synthetic oligonucleotide
atgtgcgagcgcgttatccgtccatactggcccat

SEQ ID NO: 33257 - DNA, 35 bp, Artificial Sequence
  Synthetic oligonucleotide
tagacgcactgccttttcacgctatctgttgtagt

SEQ ID NO: 33258 - DNA, 36 bp, Artificial Sequence
  Synthetic oligonucleotide
atccatacctcacaagtgtaacgcgtagttcgttca

SEQ ID NO: 33259 - DNA, 37 bp, Artificial Sequence
  Synthetic oligonucleotide
aactcccgccgcataccttatacgtactaccctgaga

SEQ ID NO: 33260 - DNA, 37 bp, Artificial Sequence
  Synthetic oligonucleotide
tcccagcctaacgattccgcttttactcgctgcacga

SEQ ID NO: 33261 - DNA, 35 bp, Artificial Sequence
  Synthetic oligonucleotide
gttagccacatggtccccgcatcaactgtatccga

SEQ ID NO: 33262 - DNA, 36 bp, Artificial Sequence
  Synthetic oligonucleotide
gatctccgctgcatctgcgcaaccatcgtacctcga

SEQ ID NO: 33263 - DNA, 37 bp, Artificial Sequence
  Synthetic oligonucleotide
tcgacaccactttcgatcctattgctcattcttagga

SEQ ID NO: 33264 - DNA, 36 bp, Artificial Sequence
  Synthetic oligonucleotide
aaggtagagaaaggggaaaaccgagtgacaggggga

SEQ ID NO: 33265 - DNA, 37 bp, Artificial Sequence
  Synthetic oligonucleotide
ttcacaccgcacactatcatggacaccgatgtcatga

SEQ ID NO: 33266 - DNA, 38 bp, Artificial Sequence
  Synthetic oligonucleotide
tgtgaacggcgatgtgccaatctttcttcctacgctga

SEQ ID NO: 33267 - DNA, 38 bp, Artificial Sequence
  Synthetic oligonucleotide
ggaagggggaacaggagagagggctgcgatcgcgctga

SEQ ID NO: 33268 - DNA, 38 bp, Artificial Sequence
  Synthetic oligonucleotide
gaaggggtggcatgttaccagggatgagggggtggtga

SEQ ID NO: 33269 - DNA, 38 bp, Artificial Sequence
  Synthetic oligonucleotide
gccacagacagtggtactaaaccctcctccactattga

SEQ ID NO: 33270 - DNA, 38 bp, Artificial Sequence
  Synthetic oligonucleotide
gccaccctcggtgcttaacgccaaaatgtttcacttga

SEQ ID NO: 33271 - DNA, 38 bp, Artificial Sequence
  Synthetic oligonucleotide
accccacggagttttgctacctcttgcccgagccttga

SEQ ID NO: 33272 - DNA, 37 bp, Artificial Sequence
  Synthetic oligonucleotide
acgaacatcgccattgcccctccatccatgcatttga

SEQ ID NO: 33273 - DNA, 31 bp, Artificial Sequence
  Synthetic oligonucleotide
tataccacccccgtctcagtcctcactcata

SEQ ID NO: 33274 - DNA, 36 bp, Artificial Sequence
  Synthetic oligonucleotide
tcacttcgccactttctaaaggactccttcatccta

SEQ ID NO: 33275 - DNA, 36 bp, Artificial Sequence
  Synthetic oligonucleotide
gaacccctcctgttgcataactcacgagaaccagta

SEQ ID NO: 33276 - DNA, 36 bp, Artificial Sequence
  Synthetic oligonucleotide
gcctagctcccgcggctaggccttgttccttacgta

SEQ ID NO: 33277 - DNA, 35 bp, Artificial Sequence
  Synthetic oligonucleotide
accatcgtatgagtgtttgtcccttcgctctctgc

SEQ ID NO: 33278 - DNA, 35 bp, Artificial Sequence
  Synthetic oligonucleotide
tatggggaccggtgagttttacggggggggaaggg

SEQ ID NO: 33279 - DNA, 35 bp, Artificial Sequence
  Synthetic oligonucleotide
acgacaaggaggtcaactaatacagtgggaacggg

SEQ ID NO: 33280 - DNA, 35 bp, Artificial Sequence
  Synthetic oligonucleotide
aacacactttggtattcttagtcccctctttttgg

SEQ ID NO: 33281 - DNA, 35 bp, Artificial Sequence
  Synthetic oligonucleotide
acacacaggcgatccacgactccgcattcccactg

SEQ ID NO: 33282 - DNA, 35 bp, Artificial Sequence
  Synthetic oligonucleotide
tctgcggagccgcctttgataattcccccgctctg

SEQ ID NO: 33283 - DNA, 35 bp, Artificial Sequence
  Synthetic oligonucleotide
gtggggtcacattcgcgtttcaagctgccattctt

SEQ ID NO: 33284 - DNA, 35 bp, Artificial Sequence
  Synthetic oligonucleotide
ggacagccatcggttctcctctgcagcctgttctt

SEQ ID NO: 33285 - DNA, 36 bp, Artificial Sequence
  Synthetic oligonucleotide
ggtcatgtacacgtgctgcatcaccgctttcgacaa

SEQ ID NO: 33286 - DNA, 37 bp, Artificial Sequence
  Synthetic oligonucleotide
gagaggaggaatgagatggaagatcgtggaaggcaga

SEQ ID NO: 33287 - DNA, 37 bp, Artificial Sequence
  Synthetic oligonucleotide
tcacgccacagatgcgcgctcccgtctcttcccccga

SEQ ID NO: 33288 - DNA, 36 bp, Artificial Sequence
  Synthetic oligonucleotide
aatgatgccttccctggttttgtgacgctcgggcga

SEQ ID NO: 33289 - DNA, 35 bp, Artificial Sequence
  Synthetic oligonucleotide
aatcgtacccgcgccccccgccgcctctcatggga

SEQ ID NO: 33290 - DNA, 37 bp, Artificial Sequence
  Synthetic oligonucleotide
ttgaatggcagaatgatggaaggtgcgggatggtgga

SEQ ID NO: 33291 - DNA, 38 bp, Artificial Sequence
  Synthetic oligonucleotide
gctcaccctccctctggtcggacaatcatgttctctga

SEQ ID NO: 33292 - DNA, 37 bp, Artificial Sequence
  Synthetic oligonucleotide
ttggatcatgcggggggtcgaagaaggagggcggtga

SEQ ID NO: 33293 - DNA, 38 bp, Artificial Sequence
  Synthetic oligonucleotide
gcccgggggttagggagaaggagggaggaacttattga

SEQ ID NO: 33294 - DNA, 36 bp, Artificial Sequence
  Synthetic oligonucleotide
atgtgcacaccactggcctgctcaccggtctttcta

SEQ ID NO: 33295 - DNA, 36 bp, Artificial Sequence
  Synthetic oligonucleotide
atgcactgtatccgctgtcgcctttatttcgcatta

SEQ ID NO: 33296 - DNA, 36 bp, Artificial Sequence
  Synthetic oligonucleotide
gttgatcgcctccgttccgtaaacgacgggttttta

SEQ ID NO: 33297 - DNA, 35 bp, Artificial Sequence
  Synthetic oligonucleotide
gtgcaaactcgaacgttgcaacgtttccgactacc

SEQ ID NO: 33298 - DNA, 35 bp, Artificial Sequence
  Synthetic oligonucleotide
gatatcaatcgtgcagtaactgctcccgccttgcc

SEQ ID NO: 33299 - DNA, 35 bp, Artificial Sequence
  Synthetic oligonucleotide
gtccggggcctaaggctcgctaaaaccattacctc

SEQ ID NO: 33300 - DNA, 35 bp, Artificial Sequence
  Synthetic oligonucleotide
ttcactccccgtcagccctaattcgatcttgttat

SEQ ID NO: 33301 - DNA, 35 bp, Artificial Sequence
  Synthetic oligonucleotide
tccacatgccaacgctagtatacctctgggaggtt

SEQ ID NO: 33302 - DNA, 35 bp, Artificial Sequence
  Synthetic oligonucleotide
cccgtcgacgcccagtcgatgttcgccatctcttt

SEQ ID NO: 33303 - DNA, 36 bp, Artificial Sequence
  Synthetic oligonucleotide
gtgcaaagcccatgaagcggcataacaaaagggaaa

SEQ ID NO: 33304 - DNA, 35 bp, Artificial Sequence
  Synthetic oligonucleotide
ggttacatccgaccgcttatcacttgccccggcaa

SEQ ID NO: 33305 - DNA, 35 bp, Artificial Sequence
  Synthetic oligonucleotide
tgtccaatcacctccatccagttatgacgtctcaa

SEQ ID NO: 33306 - DNA, 36 bp, Artificial Sequence
  Synthetic oligonucleotide
agcccaacagtgtcaacgctcatacaactccacaca

SEQ ID NO: 33307 - DNA, 37 bp, Artificial Sequence
  Synthetic oligonucleotide
aaatggagaggggtacataggaatgtagatgagacga

SEQ ID NO: 33308 - DNA, 37 bp, Artificial Sequence
  Synthetic oligonucleotide
tgttctatcccgctatctgtcttacggtccagaagga

SEQ ID NO: 33309 - DNA, 38 bp, Artificial Sequence
  Synthetic oligonucleotide
tccacactactccaggccataccactttggtgctatga

SEQ ID NO: 33310 - DNA, 38 bp, Artificial Sequence
  Synthetic oligonucleotide
tacgcctcatacttgaagacacctgaccctgcaactga

SEQ ID NO: 33311 - DNA, 38 bp, Artificial Sequence
  Synthetic oligonucleotide
attacaccgacgtttagccaccagctgggccacactga

SEQ ID NO: 33312 - DNA, 38 bp, Artificial Sequence
  Synthetic oligonucleotide
gacaccctcgctgactaaggtctacccctactacctga

SEQ ID NO: 33313 - DNA, 36 bp, Artificial Sequence
  Synthetic oligonucleotide
tctgtcttcaccagccgagaattttgcccatcctga

SEQ ID NO: 33314 - DNA, 37 bp, Artificial Sequence
  Synthetic oligonucleotide
gctgtgctacctcatactaacatgtaccagtccttga

SEQ ID NO: 33315 - DNA, 38 bp, Artificial Sequence
  Synthetic oligonucleotide
gtcgaccccatcaaatccgaatatacagaacttcttga

SEQ ID NO: 33316 - DNA, 36 bp, Artificial Sequence
  Synthetic oligonucleotide
tcttggacgcctctgtccgccttgccacggttccta

SEQ ID NO: 33317 - DNA, 35 bp, Artificial Sequence
  Synthetic oligonucleotide
ttgcatcccataggttctcccctttcctcacttac

SEQ ID NO: 33318 - DNA, 35 bp, Artificial Sequence
  Synthetic oligonucleotide
aagtgcgcccgcatacacactttccgtcttctccc

SEQ ID NO: 33319 - DNA, 35 bp, Artificial Sequence
  Synthetic oligonucleotide
aagcaacagtgccgcttcttgttatttctccttcc

SEQ ID NO: 33320 - DNA, 35 bp, Artificial Sequence
  Synthetic oligonucleotide
tccgctacactagtcttcgtcgccgcccccagtgc

SEQ ID NO: 33321 - DNA, 35 bp, Artificial Sequence
  Synthetic oligonucleotide
gaccatcgcgggttccctctgttagaacacgcctc

SEQ ID NO: 33322 - DNA, 35 bp, Artificial Sequence
  Synthetic oligonucleotide
acccgacacagaccactccacggagctcttcgctc

SEQ ID NO: 33323 - DNA, 35 bp, Artificial Sequence
  Synthetic oligonucleotide
tgaatgacttagccgtaacacacctccgcctcgag

SEQ ID NO: 33324 - DNA, 35 bp, Artificial Sequence
  Synthetic oligonucleotide
aacatcctgccccccacgccgactccgaacgcctg

SEQ ID NO: 33325 - DNA, 35 bp, Artificial Sequence
  Synthetic oligonucleotide
gagtcccatcgcactgaaggcagacccattacact

SEQ ID NO: 33326 - DNA, 35 bp, Artificial Sequence
  Synthetic oligonucleotide
acgacgagacgcaagaaatcatcctcttctcctct

SEQ ID NO: 33327 - DNA, 35 bp, Artificial Sequence
  Synthetic oligonucleotide
atgtcgtgccagtattatccacgtcccttcctgaa

SEQ ID NO: 33328 - DNA, 35 bp, Artificial Sequence
  Synthetic oligonucleotide
tgtgcatgacaccacctcgacgcatggacccaaca

SEQ ID NO: 33329 - DNA, 36 bp, Artificial Sequence
  Synthetic oligonucleotide
gcgcaaccgaccgagctttaacagcttgcttccaca

SEQ ID NO: 33330 - DNA, 36 bp, Artificial Sequence
  Synthetic oligonucleotide
tactaacaccgacctgctactctaggtgtctttaca

SEQ ID NO: 33331 - DNA, 36 bp, Artificial Sequence
  Synthetic oligonucleotide
gccacccccctgtcatacaaccatgccgcttgctca

SEQ ID NO: 33332 - DNA, 37 bp, Artificial Sequence
  Synthetic oligonucleotide
gaccgccacacctataatctggctcgatgttgcccga

SEQ ID NO: 33333 - DNA, 37 bp, Artificial Sequence
  Synthetic oligonucleotide
tcagcctgcgcacagcacccctcttatagcctggcga

SEQ ID NO: 33334 - DNA, 37 bp, Artificial Sequence
  Synthetic oligonucleotide
taaggggagcgaacggagccgtaagcagggaggcgga

SEQ ID NO: 33335 - DNA, 36 bp, Artificial Sequence
  Synthetic oligonucleotide
tctcggaccctaccgttctcacccactgccactgga

SEQ ID NO: 33336 - DNA, 38 bp, Artificial Sequence
  Synthetic oligonucleotide
gctgcaggagggggggatagggactagcgcacatatga

SEQ ID NO: 33337 - DNA, 38 bp, Artificial Sequence
  Synthetic oligonucleotide
tacgacagagtcgtagcgtacggatgaaatatgggtga

SEQ ID NO: 33338 - DNA, 37 bp, Artificial Sequence
  Synthetic oligonucleotide
acgtgtcgcccccatctattcgttactgaaaccttga

SEQ ID NO: 33339 - DNA, 37 bp, Artificial Sequence
  Synthetic oligonucleotide
aacggtggtacggcgggtgaagtaggctgctgtttga

SEQ ID NO: 33340 - DNA, 35 bp, Artificial Sequence
  Synthetic oligonucleotide
tgcaactagaaccactggcaccttgtacccaccta

SEQ ID NO: 33341 - DNA, 36 bp, Artificial Sequence
  Synthetic oligonucleotide
gcatcactcgcgtctctcccatagaactgctctcta

SEQ ID NO: 33342 - DNA, 35 bp, Artificial Sequence
  Synthetic oligonucleotide
ttgacgtgaggcgcccctggttccgcccctgctta

SEQ ID NO: 33343 - DNA, 35 bp, Artificial Sequence
  Synthetic oligonucleotide
gtcctgcgcatcatgaccttccgtcgcagaaccac

SEQ ID NO: 33344 - DNA, 35 bp, Artificial Sequence
  Synthetic oligonucleotide
gacgcgaacaatttattatctgccgtcccttgtac

SEQ ID NO: 33345 - DNA, 35 bp, Artificial Sequence
  Synthetic oligonucleotide
tgcacccgtcgttaccaaaacgctactatgcctcc

SEQ ID NO: 33346 - DNA, 35 bp, Artificial Sequence
  Synthetic oligonucleotide
gacatctggggaacatcagcggccccccctactgc

SEQ ID NO: 33347 - DNA, 35 bp, Artificial Sequence
  Synthetic oligonucleotide
tgtccgtgcgccgagcgactttcatacccgcactc

SEQ ID NO: 33348 - DNA, 35 bp, Artificial Sequence
  Synthetic oligonucleotide
gtcctcccgccacacgtctaacaatggatgatttc

SEQ ID NO: 33349 - DNA, 35 bp, Artificial Sequence
  Synthetic oligonucleotide
gcaccccatctctcggagctacggaaccgctgact

SEQ ID NO: 33350 - DNA, 36 bp, Artificial Sequence
  Synthetic oligonucleotide
accaccacaaacattctgtacaaaagcatatacgaa

SEQ ID NO: 33351 - DNA, 35 bp, Artificial Sequence
  Synthetic oligonucleotide
tggtccccgccccacagagaatctggctccctaca

SEQ ID NO: 33352 - DNA, 35 bp, Artificial Sequence
  Synthetic oligonucleotide
gccctcgaatgcgccgttgcatcaaatcctgccca

SEQ ID NO: 33353 - DNA, 36 bp, Artificial Sequence
  Synthetic oligonucleotide
gccacaactgaatgcacacacacgactaggaatgca

SEQ ID NO: 33354 - DNA, 37 bp, Artificial Sequence
  Synthetic oligonucleotide
gaaccactctgtactcactccgagctttgctctcgga

SEQ ID NO: 33355 - DNA, 37 bp, Artificial Sequence
  Synthetic oligonucleotide
gacacggaagagggccaggaggaaccggtgctgggga

SEQ ID NO: 33356 - DNA, 38 bp, Artificial Sequence
  Synthetic oligonucleotide
gctggtcgagtggaggggagggatgaaagatctactga

SEQ ID NO: 33357 - DNA, 38 bp, Artificial Sequence
  Synthetic oligonucleotide
gtgccccgcgcccccctccgtcagccctaccttcctga

SEQ ID NO: 33358 - DNA, 37 bp, Artificial Sequence
  Synthetic oligonucleotide
gttgtaccaccctcctgggctttcgacactcacttga

SEQ ID NO: 33359 - DNA, 36 bp, Artificial Sequence
  Synthetic oligonucleotide
gacttcctgcctcaccccgccaagatctacgtgata

SEQ ID NO: 33360 - DNA, 35 bp, Artificial Sequence
  Synthetic oligonucleotide
ggaggttgcctcgaaaagggaagggaaaaacggta

SEQ ID NO: 33361 - DNA, 35 bp, Artificial Sequence
  Synthetic oligonucleotide
gcttgcaatgcgctcacggtaaccacacacccacc

SEQ ID NO: 33362 - DNA, 35 bp, Artificial Sequence
  Synthetic oligonucleotide
accccccaatgcgcacataggtgagcacccgcccc

SEQ ID NO: 33363 - DNA, 35 bp, Artificial Sequence
  Synthetic oligonucleotide
tcctcctgcgactccagctcaacacgcctacgccc

SEQ ID NO: 33364 - DNA, 35 bp, Artificial Sequence
  Synthetic oligonucleotide
tgaaaaccctgctccccacgcccataacttacgcc

SEQ ID NO: 33365 - DNA, 35 bp, Artificial Sequence
  Synthetic oligonucleotide
tacgtcaccgggccaaggcgggagggtggggcggc

SEQ ID NO: 33366 - DNA, 33 bp, Artificial Sequence
  Synthetic oligonucleotide
attccccgtggcgctctagcccgcacccactgc

SEQ ID NO: 33367 - DNA, 35 bp, Artificial Sequence
  Synthetic oligonucleotide
gccaccggcaaggacattaccaccgcaccttaatc

SEQ ID NO: 33368 - DNA, 35 bp, Artificial Sequence
  Synthetic oligonucleotide
gttagcccgtccccgtttgtgcgaaagctcctctc

SEQ ID NO: 33369 - DNA, 35 bp, Artificial Sequence
  Synthetic oligonucleotide
tccagcctggaacttgcattatctaacgtcttacg

SEQ ID NO: 33370 - DNA, 34 bp, Artificial Sequence
  Synthetic oligonucleotide
tagggggtggttggtggacactgggtacggaggg

SEQ ID NO: 33371 - DNA, 35 bp, Artificial Sequence
  Synthetic oligonucleotide
taccccgttgtgtgccctgaactaccattgatctg

SEQ ID NO: 33372 - DNA, 36 bp, Artificial Sequence
  Synthetic oligonucleotide
gccggccacgcgcacgccacatctgtaccgactctg

SEQ ID NO: 33373 - DNA, 35 bp, Artificial Sequence
  Synthetic oligonucleotide
cccgctccctagtctgggaccggtactaacccttt

SEQ ID NO: 33374 - DNA, 37 bp, Artificial Sequence
  Synthetic oligonucleotide
gctcgcaacaatgcagtacctcagcccgccttgacga

SEQ ID NO: 33375 - DNA, 37 bp, Artificial Sequence
  Synthetic oligonucleotide
gcacgtagcttacatacctgcacaccgattattccga

SEQ ID NO: 33376 - DNA, 38 bp, Artificial Sequence
  Synthetic oligonucleotide
aaccggtaggtagagtaggggagtgcggtcagaaatga

SEQ ID NO: 33377 - DNA, 38 bp, Artificial Sequence
  Synthetic oligonucleotide
tgatgcaccggcaaaaaaagttagggaaaagggagtga

SEQ ID NO: 33378 - DNA, 38 bp, Artificial Sequence
  Synthetic oligonucleotide
tacccgtctgaccttctttttccaccgtatcctcgtga

SEQ ID NO: 33379 - DNA, 38 bp, Artificial Sequence
  Synthetic oligonucleotide
gagaaacgaggagggtattgctgcttgagggttggtga

SEQ ID NO: 33380 - DNA, 38 bp, Artificial Sequence
  Synthetic oligonucleotide
gtcccaggtcccagcgcgacaccgtaccaactccttga

SEQ ID NO: 33381 - DNA, 36 bp, Artificial Sequence
  Synthetic oligonucleotide
gaggggacgagaggacacgggcctggatgttacata

SEQ ID NO: 33382 - DNA, 35 bp, Artificial Sequence
  Synthetic oligonucleotide
gaccctcatcattcaacgccttgggctatacccta

SEQ ID NO: 33383 - DNA, 35 bp, Artificial Sequence
  Synthetic oligonucleotide
tgagatcccccacgatccgcttcgaaagaagcaac

SEQ ID NO: 33384 - DNA, 35 bp, Artificial Sequence
  Synthetic oligonucleotide
tacatccgaactttgaatttaatacgtagtaccac

SEQ ID NO: 33385 - DNA, 35 bp, Artificial Sequence
  Synthetic oligonucleotide
gcctcactccggaccgttcttacgtcctctcctac

SEQ ID NO: 33386 - DNA, 35 bp, Artificial Sequence
  Synthetic oligonucleotide
ccgactcatcgcccaccggtgcctgtccacacacc

SEQ ID NO: 33387 - DNA, 35 bp, Artificial Sequence
  Synthetic oligonucleotide
taacccggtacacacccgccggctctcgtgccatc

SEQ ID NO: 33388 - DNA, 36 bp, Artificial Sequence
  Synthetic oligonucleotide
tcaccgcccggccggtcctaaacttttaaatgccct

SEQ ID NO: 33389 - DNA, 35 bp, Artificial Sequence
  Synthetic oligonucleotide
accaaaccagtccagacccggctccatcttgatct

SEQ ID NO: 33390 - DNA, 35 bp, Artificial Sequence
  Synthetic oligonucleotide
cacctctgcatcctggcgtaattcgctccgggttt

SEQ ID NO: 33391 - DNA, 36 bp, Artificial Sequence
  Synthetic oligonucleotide
tcgcaatacgcctatgcctcatcaatactctccaaa

SEQ ID NO: 33392 - DNA, 35 bp, Artificial Sequence
  Synthetic oligonucleotide
ggacagcccacaggttcatcttcgcccttcgccaa

SEQ ID NO: 33393 - DNA, 36 bp, Artificial Sequence
  Synthetic oligonucleotide
aaacagccacactgtcccagccctgtcccgttcgca

SEQ ID NO: 33394 - DNA, 36 bp, Artificial Sequence
  Synthetic oligonucleotide
gcctgccaccccgcatgttcgggtcccgactaatca

SEQ ID NO: 33395 - DNA, 37 bp, Artificial Sequence
  Synthetic oligonucleotide
agccaaatggcacatgtttcagcactacctcctgcga

SEQ ID NO: 33396 - DNA, 36 bp, Artificial Sequence
  Synthetic oligonucleotide
agacgaggggcgatgggggggagtggaaatgctcga

SEQ ID NO: 33397 - DNA, 37 bp, Artificial Sequence
  Synthetic oligonucleotide
tttgacccatccgccttggcatcgcctttagctatga

SEQ ID NO: 33398 - DNA, 38 bp, Artificial Sequence
  Synthetic oligonucleotide
accgtcctccctcactcgcgaaccgagatcatcattga

SEQ ID NO: 33399 - DNA, 36 bp, Artificial Sequence
  Synthetic oligonucleotide
actcgcgagcactgtcacttgtctcttcttccgata

SEQ ID NO: 33400 - DNA, 36 bp, Artificial Sequence
  Synthetic oligonucleotide
acgtaccaccccacacttcggagcgaacattactta

SEQ ID NO: 33401 - DNA, 35 bp, Artificial Sequence
  Synthetic oligonucleotide
gcaacgctggtgcgcgtttaggctcttacacttac

SEQ ID NO: 33402 - DNA, 35 bp, Artificial Sequence
  Synthetic oligonucleotide
accgcgccgcaagcgctcattatttcaactcgccc

SEQ ID NO: 33403 - DNA, 35 bp, Artificial Sequence
  Synthetic oligonucleotide
attcctcaactcatctggtgcactcatgtatgccc

SEQ ID NO: 33404 - DNA, 35 bp, Artificial Sequence
  Synthetic oligonucleotide
tgcggtgtgctcgtgcccgagttccttcattcgcc

SEQ ID NO: 33405 - DNA, 35 bp, Artificial Sequence
  Synthetic oligonucleotide
tccacgtcacctatgtcgccccgttgtgcttcagt

SEQ ID NO: 33406 - DNA, 35 bp, Artificial Sequence
  Synthetic oligonucleotide
ccctgccccaccacatccagcacggatgttcctgt

SEQ ID NO: 33407 - DNA, 35 bp, Artificial Sequence
  Synthetic oligonucleotide
gatccccgcttagagtacaattattgcctcaccaa

SEQ ID NO: 33408 - DNA, 36 bp, Artificial Sequence
  Synthetic oligonucleotide
gacgaccgagccctgacctgccagcatacactgaca

SEQ ID NO: 33409 - DNA, 36 bp, Artificial Sequence
  Synthetic oligonucleotide
gatcgacctgagttccccgcccgccagaatctccca

SEQ ID NO: 33410 - DNA, 36 bp, Artificial Sequence
  Synthetic oligonucleotide
gattgtcgccgggaagacgagggcaggtggggagca

SEQ ID NO: 33411 - DNA, 37 bp, Artificial Sequence
  Synthetic oligonucleotide
ggagggaatgacggattaaaaagctaaggaagggaga

SEQ ID NO: 33412 - DNA, 37 bp, Artificial Sequence
  Synthetic oligonucleotide
gagggcccacccacttgaatccctggacgtttgacga

SEQ ID NO: 33413 - DNA, 37 bp, Artificial Sequence
  Synthetic oligonucleotide
gcacttcgcggtccatcctctacgtcctgttcatcga

SEQ ID NO: 33414 - DNA, 36 bp, Artificial Sequence
  Synthetic oligonucleotide
actggcccgagcacgaggatggaaatggtggaggga

SEQ ID NO: 33415 - DNA, 38 bp, Artificial Sequence
  Synthetic oligonucleotide
gacagattgatgtgtctgcccctcccgtacccgcttga

SEQ ID NO: 33416 - DNA, 36 bp, Artificial Sequence
  Synthetic oligonucleotide
gccctaaccgcacccttataagaattccccatcgta

SEQ ID NO: 33417 - DNA, 36 bp, Artificial Sequence
  Synthetic oligonucleotide
acatggaggcaacatcgggttgcgcgtcccacatta

SEQ ID NO: 33418 - DNA, 35 bp, Artificial Sequence
  Synthetic oligonucleotide
actcgctgtaaactcgccgcctgatcagctatcac

SEQ ID NO: 33419 - DNA, 35 bp, Artificial Sequence
  Synthetic oligonucleotide
aagacatcccaaccttactgacacgacaatcattc

SEQ ID NO: 33420 - DNA, 35 bp, Artificial Sequence
  Synthetic oligonucleotide
gtgggaggcatggatttagaacgatagggacgaag

SEQ ID NO: 33421 - DNA, 35 bp, Artificial Sequence
  Synthetic oligonucleotide
atctgggaagttaacgggggggtgggttaagaacg

SEQ ID NO: 33422 - DNA, 35 bp, Artificial Sequence
  Synthetic oligonucleotide
gtaggggatggtacagggaagtgtgcagtgttacg

SEQ ID NO: 33423 - DNA, 34 bp, Artificial Sequence
  Synthetic oligonucleotide
gccccactatgctgctgccacactatacgaaaat

SEQ ID NO: 33424 - DNA, 36 bp, Artificial Sequence
  Synthetic oligonucleotide
tcagcacggcacaagcggtcccggaactctttcact

SEQ ID NO: 33425 - DNA, 35 bp, Artificial Sequence
  Synthetic oligonucleotide
atcctcccgtccacacactaatactacacatgact

SEQ ID NO: 33426 - DNA, 35 bp, Artificial Sequence
  Synthetic oligonucleotide
tgatacatccctacactcgtgcgcttatcggacct

SEQ ID NO: 33427 - DNA, 35 bp, Artificial Sequence
  Synthetic oligonucleotide
gaccaccacagcggggacccggtaccgccacttct

SEQ ID NO: 33428 - DNA, 35 bp, Artificial Sequence
  Synthetic oligonucleotide
gtgttacggccacatgtacgttggtacgttcttct

SEQ ID NO: 33429 - DNA, 35 bp, Artificial Sequence
  Synthetic oligonucleotide
ttggggaagggtgccggggtggtaattctcacttt

SEQ ID NO: 33430 - DNA, 35 bp, Artificial Sequence
  Synthetic oligonucleotide
actacacccgcaaacaccatgtcacacggctacaa

SEQ ID NO: 33431 - DNA, 36 bp, Artificial Sequence
  Synthetic oligonucleotide
tcaactacgctgacacgtgacacaccgaaccttaca

SEQ ID NO: 33432 - DNA, 36 bp, Artificial Sequence
  Synthetic oligonucleotide
gcgaggtccacctgggctccttttagtcatatctca

SEQ ID NO: 33433 - DNA, 37 bp, Artificial Sequence
  Synthetic oligonucleotide
gcgaagggataaggggtaagggtcgcggacagataga

SEQ ID NO: 33434 - DNA, 37 bp, Artificial Sequence
  Synthetic oligonucleotide
gtgcttggccagcaaactacgaaggctcactccacga

SEQ ID NO: 33435 - DNA, 37 bp, Artificial Sequence
  Synthetic oligonucleotide
gtgaagggggggaagcggagcggacgcgcacgtagga

SEQ ID NO: 33436 - DNA, 37 bp, Artificial Sequence
  Synthetic oligonucleotide
acgagagacgaaggtgcataggtaacgaagggccgga

SEQ ID NO: 33437 - DNA, 37 bp, Artificial Sequence
  Synthetic oligonucleotide
gatgcatcctgccgtgaatgtgtgggcttttgcgtga

SEQ ID NO: 33438 - DNA, 37 bp, Artificial Sequence
  Synthetic oligonucleotide
gaccgaccggcacgttgacttccctacctcttattga

SEQ ID NO: 33439 - DNA, 38 bp, Artificial Sequence
  Synthetic oligonucleotide
tccgcatccaccggggtgacattatctcctcttcttga

SEQ ID NO: 33440 - DNA, 36 bp, Artificial Sequence
  Synthetic oligonucleotide
agaccaactgattcgccagttcgccttacctaacta

SEQ ID NO: 33441 - DNA, 36 bp, Artificial Sequence
  Synthetic oligonucleotide
aaacatccgcaagattaagaggtcttgcgcccccta

SEQ ID NO: 33442 - DNA, 35 bp, Artificial Sequence
  Synthetic oligonucleotide
gctgactaattgcgtactcgccgtctctgtttcac

SEQ ID NO: 33443 - DNA, 35 bp, Artificial Sequence
  Synthetic oligonucleotide
tccgacgactatcatctgcacgctcgctggtcgac

SEQ ID NO: 33444 - DNA, 35 bp, Artificial Sequence
  Synthetic oligonucleotide
atcgagggcactcctctgaaacttagtcatccccc

SEQ ID NO: 33445 - DNA, 34 bp, Artificial Sequence
  Synthetic oligonucleotide
gacgcacgccttgccttatcaagtatgaatatcc

SEQ ID NO: 33446 - DNA, 35 bp, Artificial Sequence
  Synthetic oligonucleotide
tactctcctgtccggggtcccttcattacgtttgc

SEQ ID NO: 33447 - DNA, 35 bp, Artificial Sequence
  Synthetic oligonucleotide
accagccactaattgagcttagcttgcctgcactc

SEQ ID NO: 33448 - DNA, 36 bp, Artificial Sequence
  Synthetic oligonucleotide
actagaaccgccctaccacaagttcgtccactgacg

SEQ ID NO: 33449 - DNA, 35 bp, Artificial Sequence
  Synthetic oligonucleotide
accaccgacccattccccagataacgtagtctagg

SEQ ID NO: 33450 - DNA, 35 bp, Artificial Sequence
  Synthetic oligonucleotide
ttagccacactactgaccgtcgcatattatcgtct

SEQ ID NO: 33451 - DNA, 35 bp, Artificial Sequence
  Synthetic oligonucleotide
aaaaggggggagtcgacgaaaggagatcgaggtct

SEQ ID NO: 33452 - DNA, 36 bp, Artificial Sequence
  Synthetic oligonucleotide
tacgctcagtgagctcccggagtccttataccccca

SEQ ID NO: 33453 - DNA, 36 bp, Artificial Sequence
  Synthetic oligonucleotide
attcccgcaccgtgctgctagcctcaaactcgtcca

SEQ ID NO: 33454 - DNA, 37 bp, Artificial Sequence
  Synthetic oligonucleotide
acccaccccccaactgcccgtgttgtcgctcccttca

SEQ ID NO: 33455 - DNA, 36 bp, Artificial Sequence
  Synthetic oligonucleotide
aacgcctggcgcatttcctaagtaccgcgcttttca

SEQ ID NO: 33456 - DNA, 37 bp, Artificial Sequence
  Synthetic oligonucleotide
tctcatcacgcgcactcgcctttccccatcaagccga

SEQ ID NO: 33457 - DNA, 38 bp, Artificial Sequence
  Synthetic oligonucleotide
ttgacgccaccatcttatgatccatcctgtttcactga

SEQ ID NO: 33458 - DNA, 37 bp, Artificial Sequence
  Synthetic oligonucleotide
accaccctcaacagtgtagctatcgctcctaccgtga

SEQ ID NO: 33459 - DNA, 35 bp, Artificial Sequence
  Synthetic oligonucleotide
ttagcaccaccagttctgcagcgtgaccgcattac

SEQ ID NO: 33460 - DNA, 35 bp, Artificial Sequence
  Synthetic oligonucleotide
gccaacgggcctaagcacatgtcgcagtttcccgc

SEQ ID NO: 33461 - DNA, 35 bp, Artificial Sequence
  Synthetic oligonucleotide
gccctagcctctgctcctggtccctaatggagtgc

SEQ ID NO: 33462 - DNA, 35 bp, Artificial Sequence
  Synthetic oligonucleotide
tctatgccccgttcgttccaggcctggccatcatc

SEQ ID NO: 33463 - DNA, 35 bp, Artificial Sequence
  Synthetic oligonucleotide
accccgggtcgcccctcttttgcggattccaccat

SEQ ID NO: 33464 - DNA, 35 bp, Artificial Sequence
  Synthetic oligonucleotide
tacaagacgaacagggcacgctacccaccttctat

SEQ ID NO: 33465 - DNA, 35 bp, Artificial Sequence
  Synthetic oligonucleotide
tgccatcaagactcctcctgcctcatcttgtcggt

SEQ ID NO: 33466 - DNA, 34 bp, Artificial Sequence
  Synthetic oligonucleotide
tatccgacggacattactttctttcttgcacatt

SEQ ID NO: 33467 - DNA, 35 bp, Artificial Sequence
  Synthetic oligonucleotide
gtgcctccgtggctctggccaatgaatcttgaaaa

SEQ ID NO: 33468 - DNA, 36 bp, Artificial Sequence
  Synthetic oligonucleotide
tgcgacttaatccctgctagctgactgcactcccaa

SEQ ID NO: 33469 - DNA, 35 bp, Artificial Sequence
  Synthetic oligonucleotide
agccacccccacgttttgaagggtcctcgcactaa

SEQ ID NO: 33470 - DNA, 36 bp, Artificial Sequence
  Synthetic oligonucleotide
tacccacatgggtgtgataggtgggggtgagaggca

SEQ ID NO: 33471 - DNA, 37 bp, Artificial Sequence
  Synthetic oligonucleotide
gtggtccggcctgacccttttcacctacgtcctggga

SEQ ID NO: 33472 - DNA, 37 bp, Artificial Sequence
  Synthetic oligonucleotide
acgacctccccttcacgattgactactcttggcctga

SEQ ID NO: 33473 - DNA, 37 bp, Artificial Sequence
  Synthetic oligonucleotide
agtagccagatgtcctcgctcgacctttctctcctga

SEQ ID NO: 33474 - DNA, 37 bp, Artificial Sequence
  Synthetic oligonucleotide
aatccatgcacctgaacctgcctccaaactttcgtga

SEQ ID NO: 33475 - DNA, 37 bp, Artificial Sequence
  Synthetic oligonucleotide
gacttggaccaaacatggtaaaccgcactcactttga

SEQ ID NO: 33476 - DNA, 35 bp, Artificial Sequence
  Synthetic oligonucleotide
aagcccccagaacttcatatcaggtcgactcccta

SEQ ID NO: 33477 - DNA, 36 bp, Artificial Sequence
  Synthetic oligonucleotide
gtctactcgccgccattcggtatccgattctgccta

SEQ ID NO: 33478 - DNA, 36 bp, Artificial Sequence
  Synthetic oligonucleotide
aaacctccacccacagactggtcatacctgttatta

SEQ ID NO: 33479 - DNA, 36 bp, Artificial Sequence
  Synthetic oligonucleotide
accgtgcctgttagactttttagccctctcttgtta

SEQ ID NO: 33480 - DNA, 35 bp, Artificial Sequence
  Synthetic oligonucleotide
aaccgtgggcccgtacttctacatgcgctgttcac

SEQ ID NO: 33481 - DNA, 35 bp, Artificial Sequence
  Synthetic oligonucleotide
gtggtcccagccttttcagacgcccctcctgttgc

SEQ ID NO: 33482 - DNA, 35 bp, Artificial Sequence
  Synthetic oligonucleotide
ttgccgaaccaccggagccactgaacgccacagtc

SEQ ID NO: 33483 - DNA, 35 bp, Artificial Sequence
  Synthetic oligonucleotide
gattaccctcagcctccctttccggactactcttc

SEQ ID NO: 33484 - DNA, 35 bp, Artificial Sequence
  Synthetic oligonucleotide
ttgtcgcgtacgttgatccatctgcccccttaatg

SEQ ID NO: 33485 - DNA, 35 bp, Artificial Sequence
  Synthetic oligonucleotide
taaccccctatgagctcctagccgtactccaagtg

SEQ ID NO: 33486 - DNA, 35 bp, Artificial Sequence
  Synthetic oligonucleotide
tcatgcaccgcgcgggctgaatcaccaccgctcct

SEQ ID NO: 33487 - DNA, 35 bp, Artificial Sequence
  Synthetic oligonucleotide
gtagcggttcgtcaggtttttgctctgtgccctct

SEQ ID NO: 33488 - DNA, 35 bp, Artificial Sequence
  Synthetic oligonucleotide
aaccatccaccccactccgcagacacctcgtccgt

SEQ ID NO: 33489 - DNA, 35 bp, Artificial Sequence
  Synthetic oligonucleotide
accccaccgaatattggcgcccggaacatacgctt

SEQ ID NO: 33490 - DNA, 35 bp, Artificial Sequence
  Synthetic oligonucleotide
gatcatgccctgtcacaccttttccgtcgttgaca

SEQ ID NO: 33491 - DNA, 36 bp, Artificial Sequence
  Synthetic oligonucleotide
tctcacctcagcccttaggtttcttgacgccctaca

SEQ ID NO: 33492 - DNA, 35 bp, Artificial Sequence
  Synthetic oligonucleotide
gccagcctagagtcatccccttgtccatgttgcca

SEQ ID NO: 33493 - DNA, 36 bp, Artificial Sequence
  Synthetic oligonucleotide
gatcctccgcgctaagtgctatgcttatacctctca

SEQ ID NO: 33494 - DNA, 36 bp, Artificial Sequence
  Synthetic oligonucleotide
gtccgatccaggctgttcttgtacctatgtgcttca

SEQ ID NO: 33495 - DNA, 36 bp, Artificial Sequence
  Synthetic oligonucleotide
gaggtaagggagggaatggacataaatgatcagcga

SEQ ID NO: 33496 - DNA, 38 bp, Artificial Sequence
  Synthetic oligonucleotide
gggagtgagggggcggggggtgagcacatggtggatga

SEQ ID NO: 33497 - DNA, 38 bp, Artificial Sequence
  Synthetic oligonucleotide
atcgcagaacgaaaagggagggggacagaataacgtga

SEQ ID NO: 33498 - DNA, 38 bp, Artificial Sequence
  Synthetic oligonucleotide
gatggtgcacgcgccccccacgctggtttatttcgtga

SEQ ID NO: 33499 - DNA, 38 bp, Artificial Sequence
  Synthetic oligonucleotide
gaccacaccccacgatgcctgtgctgagtcacaggtga

SEQ ID NO: 33500 - DNA, 35 bp, Artificial Sequence
  Synthetic oligonucleotide
tccctgatccacccatccggttatcggatacttga

SEQ ID NO: 33501 - DNA, 36 bp, Artificial Sequence
  Synthetic oligonucleotide
gcgtaggcacctgccgctggaaccttccggacccta

SEQ ID NO: 33502 - DNA, 36 bp, Artificial Sequence
  Synthetic oligonucleotide
gccgaacatctgaggcatcgctattcctcacctcta

SEQ ID NO: 33503 - DNA, 35 bp, Artificial Sequence
  Synthetic oligonucleotide
atgtcatcccaggagcctagacccaagaccacaac

SEQ ID NO: 33504 - DNA, 35 bp, Artificial Sequence
  Synthetic oligonucleotide
gcgactcttagtaccgcccgttttctcaaaagacc

SEQ ID NO: 33505 - DNA, 35 bp, Artificial Sequence
  Synthetic oligonucleotide
gcctgggaggccggtccgttatcgccttctctgcc

SEQ ID NO: 33506 - DNA, 35 bp, Artificial Sequence
  Synthetic oligonucleotide
acactcggccttaaccagggctaaattgctacctc

SEQ ID NO: 33507 - DNA, 35 bp, Artificial Sequence
  Synthetic oligonucleotide
gacgacagtctacctagtcatcacagatcctgctc

SEQ ID NO: 33508 - DNA, 35 bp, Artificial Sequence
  Synthetic oligonucleotide
tatgaccccatgccacttgaccgataggacgctag

SEQ ID NO: 33509 - DNA, 35 bp, Artificial Sequence
  Synthetic oligonucleotide
tacatgaggccccatatcacccgcctgcattcccg

SEQ ID NO: 33510 - DNA, 35 bp, Artificial Sequence
  Synthetic oligonucleotide
gcccttcgatgcacctattaccaccgtcctgacat

SEQ ID NO: 33511 - DNA, 35 bp, Artificial Sequence
  Synthetic oligonucleotide
gaggagaccaatcctgcccttagtgagcctgttct

SEQ ID NO: 33512 - DNA, 35 bp, Artificial Sequence
  Synthetic oligonucleotide
tcacacggtctgtttctgcgcacccgaatctcaaa

SEQ ID NO: 33513 - DNA, 37 bp, Artificial Sequence
  Synthetic oligonucleotide
aagccccctcgcccctagacccacttctggagacaca

SEQ ID NO: 33514 - DNA, 36 bp, Artificial Sequence
  Synthetic oligonucleotide
tcccccccagcacctgtttccgaagtgttgccgaca

SEQ ID NO: 33515 - DNA, 36 bp, Artificial Sequence
  Synthetic oligonucleotide
gtggacacctgcttacgatgcgattatggcatcgca

SEQ ID NO: 33516 - DNA, 35 bp, Artificial Sequence
  Synthetic oligonucleotide
actgcaggaaacgaggagagggccaacacgaaaga

SEQ ID NO: 33517 - DNA, 37 bp, Artificial Sequence
  Synthetic oligonucleotide
aagacaggaagacaagtgaccggaggggggagcgaga

SEQ ID NO: 33518 - DNA, 33 bp, Artificial Sequence
  Synthetic oligonucleotide
ttgtcatcccccccggacagacaccgaccccga

SEQ ID NO: 33519 - DNA, 38 bp, Artificial Sequence
  Synthetic oligonucleotide
agctgccaatccatagccactgcattgctttcccatga

SEQ ID NO: 33520 - DNA, 38 bp, Artificial Sequence
  Synthetic oligonucleotide
ttaaactgcagcctgtcctcctcgtaatggccccctga

SEQ ID NO: 33521 - DNA, 37 bp, Artificial Sequence
  Synthetic oligonucleotide
ttcgctcccttcatattctacaaatgccgctccctga

SEQ ID NO: 33522 - DNA, 38 bp, Artificial Sequence
  Synthetic oligonucleotide
tgctggtccggtccacaattttcgcgtcctctatctga

SEQ ID NO: 33523 - DNA, 35 bp, Artificial Sequence
  Synthetic oligonucleotide
gcactacacttcatcacatggccgattatggttcc

SEQ ID NO: 33524 - DNA, 35 bp, Artificial Sequence
  Synthetic oligonucleotide
aaactacagccctcctgccccgtcccttcagccgc

SEQ ID NO: 33525 - DNA, 35 bp, Artificial Sequence
  Synthetic oligonucleotide
tgtccacggcgaagctacacggccctcctaccgtc

SEQ ID NO: 33526 - DNA, 35 bp, Artificial Sequence
  Synthetic oligonucleotide
gcttcaccacgcagattattccccacttaccccag

SEQ ID NO: 33527 - DNA, 35 bp, Artificial Sequence
  Synthetic oligonucleotide
atgtgcccatgaatcggggggtgacgcgggtgggg

SEQ ID NO: 33528 - DNA, 35 bp, Artificial Sequence
  Synthetic oligonucleotide
agggggttggccggaagggaagggaggactcaatg

SEQ ID NO: 33529 - DNA, 35 bp, Artificial Sequence
  Synthetic oligonucleotide
atggcctcccgcccgtcgaacaacccgttccccct

SEQ ID NO: 33530 - DNA, 35 bp, Artificial Sequence
  Synthetic oligonucleotide
aaaggagcggaaggcgggaaaaagttttgggaatt

SEQ ID NO: 33531 - DNA, 37 bp, Artificial Sequence
  Synthetic oligonucleotide
atcgacgggaccagggggataaggatggtgtagaaga

SEQ ID NO: 33532 - DNA, 37 bp, Artificial Sequence
  Synthetic oligonucleotide
gcacctgtccgtcacacgcctcagcgaaccttcccga

SEQ ID NO: 33533 - DNA, 37 bp, Artificial Sequence
  Synthetic oligonucleotide
gaggcatcccaccttgcactagctgtctcctccgcga

SEQ ID NO: 33534 - DNA, 37 bp, Artificial Sequence
  Synthetic oligonucleotide
tccgtgccagcatctcccccgcgtccctttcactcga

SEQ ID NO: 33535 - DNA, 38 bp, Artificial Sequence
  Synthetic oligonucleotide
gagtgaggacgggagggattggaggaaaccggctatga

SEQ ID NO: 33536 - DNA, 36 bp, Artificial Sequence
  Synthetic oligonucleotide
aatcacgaggtgggctgggagggctaagtacggtga

SEQ ID NO: 33537 - DNA, 35 bp, Artificial Sequence
  Synthetic oligonucleotide
tagttgggaaacgagtcgtgggagggctgggtgac

SEQ ID NO: 33538 - DNA, 35 bp, Artificial Sequence
  Synthetic oligonucleotide
tcctgtacgctgccggagatctaacacatcaatac

SEQ ID NO: 33539 - DNA, 35 bp, Artificial Sequence
  Synthetic oligonucleotide
gccacctccgatatccaacgagtgccacctaatac

SEQ ID NO: 33540 - DNA, 35 bp, Artificial Sequence
  Synthetic oligonucleotide
tgccacgccttttaccacaaagttccatgtactac

SEQ ID NO: 33541 - DNA, 35 bp, Artificial Sequence
  Synthetic oligonucleotide
gaagttcacgcgggtggagagggaagatttctggg

SEQ ID NO: 33542 - DNA, 35 bp, Artificial Sequence
  Synthetic oligonucleotide
accgcactgcccgttattttccttgcatttgtttg

SEQ ID NO: 33543 - DNA, 35 bp, Artificial Sequence
  Synthetic oligonucleotide
tgacatacactggggccttgttcttttcaccctat

SEQ ID NO: 33544 - DNA, 35 bp, Artificial Sequence
  Synthetic oligonucleotide
tcacctttcgacgctgtgacccgcccgttaaccct

SEQ ID NO: 33545 - DNA, 35 bp, Artificial Sequence
  Synthetic oligonucleotide
gtgtgctcggcacggtcgatttcaccctgcgctct

SEQ ID NO: 33546 - DNA, 35 bp, Artificial Sequence
  Synthetic oligonucleotide
accttacctcctgtcgaagtgagaccttttctctt

SEQ ID NO: 33547 - DNA, 36 bp, Artificial Sequence
  Synthetic oligonucleotide
ttgggaggacatggggttggggagttatggtgagaa

SEQ ID NO: 33548 - DNA, 35 bp, Artificial Sequence
  Synthetic oligonucleotide
gaagtgcaacaaagtggagggatggaatcaggtca

SEQ ID NO: 33549 - DNA, 37 bp, Artificial Sequence
  Synthetic oligonucleotide
gtgtgcggtcctatcaatgcgatcaaccacctctaga

SEQ ID NO: 33550 - DNA, 37 bp, Artificial Sequence
  Synthetic oligonucleotide
tgccaccattctgaacttgccgctgctacctccccga

SEQ ID NO: 33551 - DNA, 37 bp, Artificial Sequence
  Synthetic oligonucleotide
ttggggtcggtgcagggagggtattatgctaaaggga

SEQ ID NO: 33552 - DNA, 38 bp, Artificial Sequence
  Synthetic oligonucleotide
atgacccgtctgagcccctccttccagattcgccctga

SEQ ID NO: 33553 - DNA, 37 bp, Artificial Sequence
  Synthetic oligonucleotide
atgcaatgccggagcgcatcgatctgcttcttcctga

SEQ ID NO: 33554 - DNA, 38 bp, Artificial Sequence
  Synthetic oligonucleotide
tgtgcgagctgtggttcacctgcgcatcttctctctga

SEQ ID NO: 33555 - DNA, 37 bp, Artificial Sequence
  Synthetic oligonucleotide
tgacatggttagggctggggggctggggggaccgtga

SEQ ID NO: 33556 - DNA, 36 bp, Artificial Sequence
  Synthetic oligonucleotide
gttcgcgctcttgcaaattgctccccttacctgtga

SEQ ID NO: 33557 - DNA, 36 bp, Artificial Sequence
  Synthetic oligonucleotide
gacgcccttaaatgcacttgtcaggttcaataccta

SEQ ID NO: 33558 - DNA, 36 bp, Artificial Sequence
  Synthetic oligonucleotide
atcactaccgtgctcatctgggcctctgcacactta

SEQ ID NO: 33559 - DNA, 35 bp, Artificial Sequence
  Synthetic oligonucleotide
gttgcccacagacttcacacgtacgaagccccgcc

SEQ ID NO: 33560 - DNA, 35 bp, Artificial Sequence
  Synthetic oligonucleotide
gttacgctcgcacccctttccgtccgacaaatgcg

SEQ ID NO: 33561 - DNA, 35 bp, Artificial Sequence
  Synthetic oligonucleotide
tcccgtccgttacgtcatcgtacttacgcccatct

SEQ ID NO: 33562 - DNA, 35 bp, Artificial Sequence
  Synthetic oligonucleotide
tcgcgacttcaactgatatgctgcaatccttcctt

SEQ ID NO: 33563 - DNA, 35 bp, Artificial Sequence
  Synthetic oligonucleotide
ggaaggtgctggcgtagggcaaatgggtgggggtt

SEQ ID NO: 33564 - DNA, 35 bp, Artificial Sequence
  Synthetic oligonucleotide
tgagccgggctttctgttcgcttcctttgtcattt

SEQ ID NO: 33565 - DNA, 35 bp, Artificial Sequence
  Synthetic oligonucleotide
accccccacggggcaccctcacctaagtagccaca

SEQ ID NO: 33566 - DNA, 36 bp, Artificial Sequence
  Synthetic oligonucleotide
agttcgtcgccgattccctccgtcgctttcgttcca

SEQ ID NO: 33567 - DNA, 37 bp, Artificial Sequence
  Synthetic oligonucleotide
agacgggcagggtgtagtgttattgggtgggtcacga

SEQ ID NO: 33568 - DNA, 37 bp, Artificial Sequence
  Synthetic oligonucleotide
gcgctcgccgctttggttctcgctgcctccattccga

SEQ ID NO: 33569 - DNA, 37 bp, Artificial Sequence
  Synthetic oligonucleotide
tccaaggtgatccggatgagaaggaattgggaaggga

SEQ ID NO: 33570 - DNA, 38 bp, Artificial Sequence
  Synthetic oligonucleotide
gaccgcctcgtggaaacatgccactcccgactacatga

SEQ ID NO: 33571 - DNA, 36 bp, Artificial Sequence
  Synthetic oligonucleotide
gccactatgccgtttcacctcttactgctcccatga

SEQ ID NO: 33572 - DNA, 37 bp, Artificial Sequence
  Synthetic oligonucleotide
accctcgcgctactgctttgataaaccatcctcctga

SEQ ID NO: 33573 - DNA, 37 bp, Artificial Sequence
  Synthetic oligonucleotide
tggtcgacgcatttgccatcgttccccttcttcctga

SEQ ID NO: 33574 - DNA, 38 bp, Artificial Sequence
  Synthetic oligonucleotide
gacgcgagggtggttgagaaagagatagagagtggtga

SEQ ID NO: 33575 - DNA, 37 bp, Artificial Sequence
  Synthetic oligonucleotide
gggggacgggggaaagggtgctagtacacggatgtga

SEQ ID NO: 33576 - DNA, 38 bp, Artificial Sequence
  Synthetic oligonucleotide
agacgccccatgttccaccgcattcccaacttttgtga

SEQ ID NO: 33577 - DNA, 37 bp, Artificial Sequence
  Synthetic oligonucleotide
tgccgactccttcccagccgtcataacatacgattga

SEQ ID NO: 33578 - DNA, 38 bp, Artificial Sequence
  Synthetic oligonucleotide
ggggtagccaaaaggggtgggaaacaacgggtagttga

SEQ ID NO: 33579 - DNA, 36 bp, Artificial Sequence
  Synthetic oligonucleotide
gatagaatgaagtgggtggactgcacggaaggatta

SEQ ID NO: 33580 - DNA, 35 bp, Artificial Sequence
  Synthetic oligonucleotide
gacacacatcctgcaccccgagtttattgcctgac

SEQ ID NO: 33581 - DNA, 35 bp, Artificial Sequence
  Synthetic oligonucleotide
gaactcgccagcccgaactgagcgcgcacttgacc

SEQ ID NO: 33582 - DNA, 35 bp, Artificial Sequence
  Synthetic oligonucleotide
atccctccgtcgcaggtagttaatattttcccgtc

SEQ ID NO: 33583 - DNA, 35 bp, Artificial Sequence
  Synthetic oligonucleotide
gctcatcaccagactttgccttttgccgtttgtag

SEQ ID NO: 33584 - DNA, 35 bp, Artificial Sequence
  Synthetic oligonucleotide
gagcgactcgcggtcactctggtctacaccactat

SEQ ID NO: 33585 - DNA, 34 bp, Artificial Sequence
  Synthetic oligonucleotide
aatggcctagccactgccccctcgcaatacagct

SEQ ID NO: 33586 - DNA, 35 bp, Artificial Sequence
  Synthetic oligonucleotide
ggactggtcccttctcattcggagtctctccacca

SEQ ID NO: 33587 - DNA, 37 bp, Artificial Sequence
  Synthetic oligonucleotide
agaaacaaggggggatgacgggagttgagacgggaga

SEQ ID NO: 33588 - DNA, 37 bp, Artificial Sequence
  Synthetic oligonucleotide
gtcaccagacccacctccgccattttgaacgtaacga

SEQ ID NO: 33589 - DNA, 37 bp, Artificial Sequence
  Synthetic oligonucleotide
gcacgaaggcctcgtgccgacctcacttctttaccga

SEQ ID NO: 33590 - DNA, 37 bp, Artificial Sequence
  Synthetic oligonucleotide
accgccaactgaacatggctttgaatgacccactcga

SEQ ID NO: 33591 - DNA, 37 bp, Artificial Sequence
  Synthetic oligonucleotide
ggacaccgggatgatggggggctggagaaggagagga

SEQ ID NO: 33592 - DNA, 37 bp, Artificial Sequence
  Synthetic oligonucleotide
gaatcgaatgtcaggtagaactgcggggggaatggga

SEQ ID NO: 33593 - DNA, 38 bp, Artificial Sequence
  Synthetic oligonucleotide
aagcatccgccgcaccccccgtaaccctgcccatgtga

SEQ ID NO: 33594 - DNA, 36 bp, Artificial Sequence
  Synthetic oligonucleotide
tccattcccgttccgactgatcgacttccaacttta

SEQ ID NO: 33595 - DNA, 36 bp, Artificial Sequence
  Synthetic oligonucleotide
ggtgaagggtgaaggtggatggtcctggtggtttta

SEQ ID NO: 33596 - DNA, 35 bp, Artificial Sequence
  Synthetic oligonucleotide
gaatccatccagtttactgctccaagtgcatgccc

SEQ ID NO: 33597 - DNA, 35 bp, Artificial Sequence
  Synthetic oligonucleotide
atctgctggaccaagtcataaaagtcctcctgccc

SEQ ID NO: 33598 - DNA, 35 bp, Artificial Sequence
  Synthetic oligonucleotide
tgatcccaccccactgttcgggtcgaactatagag

SEQ ID NO: 33599 - DNA, 35 bp, Artificial Sequence
  Synthetic oligonucleotide
tccaataggttcaaagctgggaaaggtggggtggg

SEQ ID NO: 33600 - DNA, 35 bp, Artificial Sequence
  Synthetic oligonucleotide
tgcaccattgcgcccgtccgacccgatattagtgg

SEQ ID NO: 33601 - DNA, 35 bp, Artificial Sequence
  Synthetic oligonucleotide
agtcagggttagggcggaggggtggatgagctgat

SEQ ID NO: 33602 - DNA, 35 bp, Artificial Sequence
  Synthetic oligonucleotide
gaacttgccactgccctaggagctactcttcgtat

SEQ ID NO: 33603 - DNA, 36 bp, Artificial Sequence
  Synthetic oligonucleotide
gacgctagcttccgccgtcccccgttccctgtaaaa

SEQ ID NO: 33604 - DNA, 36 bp, Artificial Sequence
  Synthetic oligonucleotide
gaacgcgacccctgggctgtctccagattctttgaa

SEQ ID NO: 33605 - DNA, 35 bp, Artificial Sequence
  Synthetic oligonucleotide
accactgacgcggtttgcgcattctcgcccgccca

SEQ ID NO: 33606 - DNA, 36 bp, Artificial Sequence
  Synthetic oligonucleotide
taccacccttcttagagtctgccgaacctatctcca

SEQ ID NO: 33607 - DNA, 35 bp, Artificial Sequence
  Synthetic oligonucleotide
ttcccacaccgactcagacttactgccgcagttca

SEQ ID NO: 33608 - DNA, 37 bp, Artificial Sequence
  Synthetic oligonucleotide
atcccgccggtactgtttatctcgctccatacataga

SEQ ID NO: 33609 - DNA, 37 bp, Artificial Sequence
  Synthetic oligonucleotide
tctagagtggggggacgagtacggggcgggatgacga

SEQ ID NO: 33610 - DNA, 37 bp, Artificial Sequence
  Synthetic oligonucleotide
gcaaacaaaatggagcagggaagggcaatggatgcga

SEQ ID NO: 33611 - DNA, 37 bp, Artificial Sequence
  Synthetic oligonucleotide
agtgagccgccgcgaccctaattagacccacctatga

SEQ ID NO: 33612 - DNA, 38 bp, Artificial Sequence
  Synthetic oligonucleotide
aagcctgccccgcgtgtaacgccattgttgcctattga

SEQ ID NO: 33613 - DNA, 38 bp, Artificial Sequence
  Synthetic oligonucleotide
gaggggcaccgctgtacccgttattctacctggcttga

SEQ ID NO: 33614 - DNA, 38 bp, Artificial Sequence
  Synthetic oligonucleotide
gcaccacttgtcatgatgtataccacctgtatgcttga

SEQ ID NO: 33615 - DNA, 36 bp, Artificial Sequence
  Synthetic oligonucleotide
atgtacagtggatggcagggtaacatgaggggttga

SEQ ID NO: 33616 - DNA, 36 bp, Artificial Sequence
  Synthetic oligonucleotide
tccacccgcatttctgaccatgcacagtgggcacta

SEQ ID NO: 33617 - DNA, 36 bp, Artificial Sequence
  Synthetic oligonucleotide
ggtaacccagcgcgctttttgactcattgcccccta

SEQ ID NO: 33618 - DNA, 36 bp, Artificial Sequence
  Synthetic oligonucleotide
gcctacgttccccgcaaatcgcactggccaaccgta

SEQ ID NO: 33619 - DNA, 35 bp, Artificial Sequence
  Synthetic oligonucleotide
tctgcgtgcaccgaccccggccttccttgctaaac

SEQ ID NO: 33620 - DNA, 35 bp, Artificial Sequence
  Synthetic oligonucleotide
tcctcaagtcgccaagcgcggtcctagcccaccac

SEQ ID NO: 33621 - DNA, 35 bp, Artificial Sequence
  Synthetic oligonucleotide
acactccacccaatccaaaggaaagggctctatcc

SEQ ID NO: 33622 - DNA, 35 bp, Artificial Sequence
  Synthetic oligonucleotide
ttactccaggcgtccatgacaatattttcccgcgc

SEQ ID NO: 33623 - DNA, 35 bp, Artificial Sequence
  Synthetic oligonucleotide
acccccatgatcccgacgtgctgcatgctaactgc

SEQ ID NO: 33624 - DNA, 35 bp, Artificial Sequence
  Synthetic oligonucleotide
gtgacagtcccttccagttgttgccgctctccgtc

SEQ ID NO: 33625 - DNA, 35 bp, Artificial Sequence
  Synthetic oligonucleotide
acgcaccgaccaaaccaccacaacatgctgctttc

SEQ ID NO: 33626 - DNA, 35 bp, Artificial Sequence
  Synthetic oligonucleotide
gcattgctccagggccgtctctttcttcggttttc

SEQ ID NO: 33627 - DNA, 35 bp, Artificial Sequence
  Synthetic oligonucleotide
gctattacaccctgcccccccgcacgtactatgtt

SEQ ID NO: 33628 - DNA, 35 bp, Artificial Sequence
  Synthetic oligonucleotide
attcgcttgctgcccgtggactgtccctctccttt

SEQ ID NO: 33629 - DNA, 36 bp, Artificial Sequence
  Synthetic oligonucleotide
acaacaaatccatggcttatgcgagccacaccacca

SEQ ID NO: 33630 - DNA, 36 bp, Artificial Sequence
  Synthetic oligonucleotide
ttgttgcccgcagtaccggaacgccctctttcacca

SEQ ID NO: 33631 - DNA, 36 bp, Artificial Sequence
  Synthetic oligonucleotide
aacacgaaatcgatcaatgcctgccccagttccgca

SEQ ID NO: 33632 - DNA, 35 bp, Artificial Sequence
  Synthetic oligonucleotide
gagagggctgtcccacacgttatatccaccttaga

SEQ ID NO: 33633 - DNA, 37 bp, Artificial Sequence
  Synthetic oligonucleotide
gtatcgcgccgcactgcccgtttttatcttctcacga

SEQ ID NO: 33634 - DNA, 37 bp, Artificial Sequence
  Synthetic oligonucleotide
attgtgccgtcatccatccgctatcccacgtgtccga

SEQ ID NO: 33635 - DNA, 37 bp, Artificial Sequence
  Synthetic oligonucleotide
tcagtcacatcccatccagctacaccgctcttactga

SEQ ID NO: 33636 - DNA, 37 bp, Artificial Sequence
  Synthetic oligonucleotide
gtgacgacgttccagcaattcttacgcaagcccttga

SEQ ID NO: 33637 - DNA, 36 bp, Artificial Sequence
  Synthetic oligonucleotide
gccatgctggcattgtacccgtttatctgctaccta

SEQ ID NO: 33638 - DNA, 35 bp, Artificial Sequence
  Synthetic oligonucleotide
gggccctcctacccgttgccgccgttctttcgcac

SEQ ID NO: 33639 - DNA, 35 bp, Artificial Sequence
  Synthetic oligonucleotide
ggtacgtatgttgtcaactgcctgctcatcaatcc

SEQ ID NO: 33640 - DNA, 35 bp, Artificial Sequence
  Synthetic oligonucleotide
aaccaccgccgatgctatgtgcatttttaggcctc

SEQ ID NO: 33641 - DNA, 35 bp, Artificial Sequence
  Synthetic oligonucleotide
tcagctctaccctttgccatgtcgactactttgtc

SEQ ID NO: 33642 - DNA, 35 bp, Artificial Sequence
  Synthetic oligonucleotide
ttgcggtcgcaactccatctcaggttctattccag

SEQ ID NO: 33643 - DNA, 35 bp, Artificial Sequence
  Synthetic oligonucleotide
gtgacatttcctgataccactacaccgaccttacg

SEQ ID NO: 33644 - DNA, 35 bp, Artificial Sequence
  Synthetic oligonucleotide
gatggccccatcttcgtatttcgtttccgttgtcg

SEQ ID NO: 33645 - DNA, 35 bp, Artificial Sequence
  Synthetic oligonucleotide
atgcttgcaaccgcattatcctcacccgcaccagg

SEQ ID NO: 33646 - DNA, 35 bp, Artificial Sequence
  Synthetic oligonucleotide
gacccaacgccctagttccggacctttacctccgg

SEQ ID NO: 33647 - DNA, 35 bp, Artificial Sequence
  Synthetic oligonucleotide
gttggcaaagtagacaatggacggagggtaatggg

SEQ ID NO: 33648 - DNA, 35 bp, Artificial Sequence
  Synthetic oligonucleotide
gacgacgtttacagccgtagccgttctagttccat

SEQ ID NO: 33649 - DNA, 35 bp, Artificial Sequence
  Synthetic oligonucleotide
tcgaccatatggggaaagtggctggggggggtggt

SEQ ID NO: 33650 - DNA, 35 bp, Artificial Sequence
  Synthetic oligonucleotide
gcgtgactgggataggggggcattgtcgggaaaaa

SEQ ID NO: 33651 - DNA, 34 bp, Artificial Sequence
  Synthetic oligonucleotide
tactccctggtcctctcactagcccccctgcaga

SEQ ID NO: 33652 - DNA, 37 bp, Artificial Sequence
  Synthetic oligonucleotide
atcccagatggcgctcacacctatacgaactctccga

SEQ ID NO: 33653 - DNA, 36 bp, Artificial Sequence
  Synthetic oligonucleotide
ttaccagagtcggagcggttttccccatccatctga

SEQ ID NO: 33654 - DNA, 38 bp, Artificial Sequence
  Synthetic oligonucleotide
ggaaccccggccttgctttatgcccttcaatcctgtga

SEQ ID NO: 33655 - DNA, 38 bp, Artificial Sequence
  Synthetic oligonucleotide
tacctctgccgtgaatcgtcctttgggtcgccccttga

SEQ ID NO: 33656 - DNA, 37 bp, Artificial Sequence
  Synthetic oligonucleotide
atccgaatcgccgacctcccggtccaacctcctttga

SEQ ID NO: 33657 - DNA, 35 bp, Artificial Sequence
  Synthetic oligonucleotide
aactatccgcaggctagactcgccaccctcaccta

SEQ ID NO: 33658 - DNA, 35 bp, Artificial Sequence
  Synthetic oligonucleotide
tccacctaacctttatactttgacagtactcgcta

SEQ ID NO: 33659 - DNA, 35 bp, Artificial Sequence
  Synthetic oligonucleotide
agtgccatctcacagcatcatgttccataccccgc

SEQ ID NO: 33660 - DNA, 35 bp, Artificial Sequence
  Synthetic oligonucleotide
ggatcgcataactggatcttaacgtgctcttgctc

SEQ ID NO: 33661 - DNA, 35 bp, Artificial Sequence
  Synthetic oligonucleotide
tcagacaacacgcatcgatctatgaaaaccctctc

SEQ ID NO: 33662 - DNA, 35 bp, Artificial Sequence
  Synthetic oligonucleotide
gtcagacagggcgggggaccaagcagaaggggaag

SEQ ID NO: 33663 - DNA, 35 bp, Artificial Sequence
  Synthetic oligonucleotide
acttcctccgtgttgtccttccactcgtccattgg

SEQ ID NO: 33664 - DNA, 35 bp, Artificial Sequence
  Synthetic oligonucleotide
tgacggaccagggtgggagtaggactgaaatggtg

SEQ ID NO: 33665 - DNA, 35 bp, Artificial Sequence
  Synthetic oligonucleotide
ggatcctgtctcctgatcgttgcctgctccgtact

SEQ ID NO: 33666 - DNA, 35 bp, Artificial Sequence
  Synthetic oligonucleotide
agctgacgtcccactcgcgacctcaatcactgctt

SEQ ID NO: 33667 - DNA, 36 bp, Artificial Sequence
  Synthetic oligonucleotide
tgatcacctctgtaccttcaaatgcacgcgtgacaa

SEQ ID NO: 33668 - DNA, 36 bp, Artificial Sequence
  Synthetic oligonucleotide
gagcaccactttctgtcctcaggccctccctccgaa

SEQ ID NO: 33669 - DNA, 35 bp, Artificial Sequence
  Synthetic oligonucleotide
gccgaaacacggactgctgcctaaacgaactttaa

SEQ ID NO: 33670 - DNA, 36 bp, Artificial Sequence
  Synthetic oligonucleotide
gttcaccctgagtgccgcaatttgcctcccgacaca

SEQ ID NO: 33671 - DNA, 36 bp, Artificial Sequence
  Synthetic oligonucleotide
tcaacctacacttgttactgcgaagtcactctcgca

SEQ ID NO: 33672 - DNA, 36 bp, Artificial Sequence
  Synthetic oligonucleotide
gtctgtgttcggctcaggactgctacactcctctca

SEQ ID NO: 33673 - DNA, 37 bp, Artificial Sequence
  Synthetic oligonucleotide
atggtggggatacggggaactcgagtggagtgtcgga

SEQ ID NO: 33674 - DNA, 35 bp, Artificial Sequence
  Synthetic oligonucleotide
gaggtgtagggtcgtttaaagggttaagggaggga

SEQ ID NO: 33675 - DNA, 37 bp, Artificial Sequence
  Synthetic oligonucleotide
atcatgcgggatagcagttaaagggggcattggggga

SEQ ID NO: 33676 - DNA, 38 bp, Artificial Sequence
  Synthetic oligonucleotide
tcaccccgactgtgcttgaccgtggaaacacctcctga

SEQ ID NO: 33677 - DNA, 36 bp, Artificial Sequence
  Synthetic oligonucleotide
attcaactcctgccaacttccccgcacagacattga

SEQ ID NO: 33678 - DNA, 38 bp, Artificial Sequence
  Synthetic oligonucleotide
tccatcctgcttggatgtcatctcgtgccctgacttga

SEQ ID NO: 33679 - DNA, 36 bp, Artificial Sequence
  Synthetic oligonucleotide
atggtcataacgctgctacacgtcacagtccatcta

SEQ ID NO: 33680 - DNA, 35 bp, Artificial Sequence
  Synthetic oligonucleotide
tcaccggcgatagtcatcccgtaccccgcatgcac

SEQ ID NO: 33681 - DNA, 35 bp, Artificial Sequence
  Synthetic oligonucleotide
agcctcagcctaccacgtactcccctagcgctcac

SEQ ID NO: 33682 - DNA, 35 bp, Artificial Sequence
  Synthetic oligonucleotide
acgctgtcctcccgccgaatgcacaccaccaaccc

SEQ ID NO: 33683 - DNA, 34 bp, Artificial Sequence
  Synthetic oligonucleotide
tcaaccttcgctcacacataacgtcgccgccgcc

SEQ ID NO: 33684 - DNA, 36 bp, Artificial Sequence
  Synthetic oligonucleotide
tgtgaagagaggaaggaggacagtggaggagtagaa

SEQ ID NO: 33685 - DNA, 35 bp, Artificial Sequence
  Synthetic oligonucleotide
ttacgggccgtttcccccgtcctcgccccagccca

SEQ ID NO: 33686 - DNA, 36 bp, Artificial Sequence
  Synthetic oligonucleotide
gacgggacggtggaacgtggggagaaaataattgca

SEQ ID NO: 33687 - DNA, 36 bp, Artificial Sequence
  Synthetic oligonucleotide
tagcactacctgccacacgatctttcctattcacga

SEQ ID NO: 33688 - DNA, 36 bp, Artificial Sequence
  Synthetic oligonucleotide
gtagacaggatagaaaaaatgggcttgggacggcga

SEQ ID NO: 33689 - DNA, 37 bp, Artificial Sequence
  Synthetic oligonucleotide
ggagttaaggcggaaggaaagggggaatgaggccgga

SEQ ID NO: 33690 - DNA, 36 bp, Artificial Sequence
  Synthetic oligonucleotide
tcgaacagcctccatcgtcgttactctatctcggga

SEQ ID NO: 33691 - DNA, 37 bp, Artificial Sequence
  Synthetic oligonucleotide
gaggagcagaggggtgaatcggtggggcagggtggga

SEQ ID NO: 33692 - DNA, 38 bp, Artificial Sequence
  Synthetic oligonucleotide
agggcggggaggggttgggggtataagttcatcactga

SEQ ID NO: 33693 - DNA, 38 bp, Artificial Sequence
  Synthetic oligonucleotide
gcccaccgcaccgctattgccaccacgcgtttcactga

SEQ ID NO: 33694 - DNA, 38 bp, Artificial Sequence
  Synthetic oligonucleotide
atgcctactaagagcatgcgtaccacccccatctctga

SEQ ID NO: 33695 - DNA, 38 bp, Artificial Sequence
  Synthetic oligonucleotide
gacgaagaagggcggtggaatcagcaggtggcccgtga

SEQ ID NO: 33696 - DNA, 35 bp, Artificial Sequence
  Synthetic oligonucleotide
aagtgatggaagggtagagcggccaggcggtgtga

SEQ ID NO: 33697 - DNA, 35 bp, Artificial Sequence
  Synthetic oligonucleotide
tacatcacctaggcgtggacttcgtgctcaccccc

SEQ ID NO: 33698 - DNA, 35 bp, Artificial Sequence
  Synthetic oligonucleotide
accgtccagccaaggaatagatccaccatcctccc

SEQ ID NO: 33699 - DNA, 35 bp, Artificial Sequence
  Synthetic oligonucleotide
ataccacacctacgctcaaaaggcgaggaccccgc

SEQ ID NO: 33700 - DNA, 35 bp, Artificial Sequence
  Synthetic oligonucleotide
atacccgtgcccgccctaatcgatctcagggcctc

SEQ ID NO: 33701 - DNA, 35 bp, Artificial Sequence
  Synthetic oligonucleotide
gttggccaacacattcctatgggccgaaacctttc

SEQ ID NO: 33702 - DNA, 35 bp, Artificial Sequence
  Synthetic oligonucleotide
gcaccaagccagccatctttttccattcttttgat

SEQ ID NO: 33703 - DNA, 35 bp, Artificial Sequence
  Synthetic oligonucleotide
actgaaaccagacctgtggcgaccgttccctccct

SEQ ID NO: 33704 - DNA, 35 bp, Artificial Sequence
  Synthetic oligonucleotide
gatgccgtcaaggcattagccacatctctccctct

SEQ ID NO: 33705 - DNA, 35 bp, Artificial Sequence
  Synthetic oligonucleotide
acattcaccgcctcccaattttcctcagctttctt

SEQ ID NO: 33706 - DNA, 34 bp, Artificial Sequence
  Synthetic oligonucleotide
tgatggggaaattgggggggagctacgaaacaaa

SEQ ID NO: 33707 - DNA, 36 bp, Artificial Sequence
  Synthetic oligonucleotide
gcccagagggtgaaggaatgaggatggataatggaa

SEQ ID NO: 33708 - DNA, 36 bp, Artificial Sequence
  Synthetic oligonucleotide
taactcggcctcacgtgatacacgaaatttcaccca

SEQ ID NO: 33709 - DNA, 34 bp, Artificial Sequence
  Synthetic oligonucleotide
ttggacatcatctcctcctgacacagttgggcca

SEQ ID NO: 33710 - DNA, 35 bp, Artificial Sequence
  Synthetic oligonucleotide
acgcggtcctccgatacatcactccgcggccttca

SEQ ID NO: 33711 - DNA, 36 bp, Artificial Sequence
  Synthetic oligonucleotide
accacaaaccatggccttcgcattactctcacgaga

SEQ ID NO: 33712 - DNA, 37 bp, Artificial Sequence
  Synthetic oligonucleotide
agcatccctgttgaaccactatctgtccagctcccga

SEQ ID NO: 33713 - DNA, 37 bp, Artificial Sequence
  Synthetic oligonucleotide
tgacaccttcagctacctctcgccactcctagttcga

SEQ ID NO: 33714 - DNA, 37 bp, Artificial Sequence
  Synthetic oligonucleotide
gcagagcatcctatccgccccgagctttgttaacgga

SEQ ID NO: 33715 - DNA, 37 bp, Artificial Sequence
  Synthetic oligonucleotide
gatcagcctagtaatcaccatcatgcctcgcttctga

SEQ ID NO: 33716 - DNA, 38 bp, Artificial Sequence
  Synthetic oligonucleotide
tcacccgccccgccccaatcaaaccactgtccaagtga

SEQ ID NO: 33717 - DNA, 36 bp, Artificial Sequence
  Synthetic oligonucleotide
aaccccagatatctgttgttgttactttgcccgtga

SEQ ID NO: 33718 - DNA, 38 bp, Artificial Sequence
  Synthetic oligonucleotide
agctgcctcactccatctgatattgccctattatgtga

SEQ ID NO: 33719 - DNA, 36 bp, Artificial Sequence
  Synthetic oligonucleotide
gttcagacaccgcgccacttctactcctttgaccta

SEQ ID NO: 33720 - DNA, 35 bp, Artificial Sequence
  Synthetic oligonucleotide
acccctgtgcggttacttcgttgattcttcgccta

SEQ ID NO: 33721 - DNA, 36 bp, Artificial Sequence
  Synthetic oligonucleotide
tttgtccgcatacgtacgcgtaccctagccctctta

SEQ ID NO: 33722 - DNA, 36 bp, Artificial Sequence
  Synthetic oligonucleotide
agatggtcccgctcctattaccgccactagctttta

SEQ ID NO: 33723 - DNA, 35 bp, Artificial Sequence
  Synthetic oligonucleotide
gtccatcaagacttttgatcaagatccacgcccac

SEQ ID NO: 33724 - DNA, 35 bp, Artificial Sequence
  Synthetic oligonucleotide
gccgcactgttcgctaccctggtgcaggcctaacc

SEQ ID NO: 33725 - DNA, 35 bp, Artificial Sequence
  Synthetic oligonucleotide
atggcacgctatcccgtcacatctacgcgttgccc

SEQ ID NO: 33726 - DNA, 35 bp, Artificial Sequence
  Synthetic oligonucleotide
gtgacgtgctcatacgtttttgctgctaacttgcc

SEQ ID NO: 33727 - DNA, 35 bp, Artificial Sequence
  Synthetic oligonucleotide
acacgatgctcgccctgccaatgcctggatactgc

SEQ ID NO: 33728 - DNA, 35 bp, Artificial Sequence
  Synthetic oligonucleotide
atcctcagcacagggattccaatcgcatcttcatc

SEQ ID NO: 33729 - DNA, 35 bp, Artificial Sequence
  Synthetic oligonucleotide
tcgacaaccgcttagtaactcgcccaatcgctatc

SEQ ID NO: 33730 - DNA, 35 bp, Artificial Sequence
  Synthetic oligonucleotide
agccgtagagcactgtcgaattatccgccggcctc

SEQ ID NO: 33731 - DNA, 35 bp, Artificial Sequence
  Synthetic oligonucleotide
acgaacgtcactccattttacgtacaccaggattc

SEQ ID NO: 33732 - DNA, 35 bp, Artificial Sequence
  Synthetic oligonucleotide
tctcactccggggagtccgccaacctctttttacg

SEQ ID NO: 33733 - DNA, 35 bp, Artificial Sequence
  Synthetic oligonucleotide
gcacgacgcgactcacgctccgctggtaacttttt

SEQ ID NO: 33734 - DNA, 35 bp, Artificial Sequence
  Synthetic oligonucleotide
gtctgtccagcgatccgtcctgcctgagttcccaa

SEQ ID NO: 33735 - DNA, 35 bp, Artificial Sequence
  Synthetic oligonucleotide
tgcgctctacccacgaccttaatgccttgctctaa

SEQ ID NO: 33736 - DNA, 36 bp, Artificial Sequence
  Synthetic oligonucleotide
gcaccgcatgggcgttttgattgcgctccccctgca

SEQ ID NO: 33737 - DNA, 36 bp, Artificial Sequence
  Synthetic oligonucleotide
acgtacgccctgatcggcgcccgcactcctacttca

SEQ ID NO: 33738 - DNA, 37 bp, Artificial Sequence
  Synthetic oligonucleotide
acgcaaggcctcagttatcatcaccttctatcgtcga

SEQ ID NO: 33739 - DNA, 37 bp, Artificial Sequence
  Synthetic oligonucleotide
acaaggccatacagcacaaccacacgcgcctccggga

SEQ ID NO: 33740 - DNA, 37 bp, Artificial Sequence
  Synthetic oligonucleotide
acccccgcccccacatctgtaagctttcaatacctga

SEQ ID NO: 33741 - DNA, 38 bp, Artificial Sequence
  Synthetic oligonucleotide
gtgccgttcccaccagcatacaaccacccatgctctga

SEQ ID NO: 33742 - DNA, 37 bp, Artificial Sequence
  Synthetic oligonucleotide
atccaccctccgtctagacattacttgatccttgtga

SEQ ID NO: 33743 - DNA, 36 bp, Artificial Sequence
  Synthetic oligonucleotide
gagcaccctcgccatttttgccaaagcccacgttga

SEQ ID NO: 33744 - DNA, 38 bp, Artificial Sequence
  Synthetic oligonucleotide
gtgcaatggcggggcgaaggagggggaaacgcggttga

SEQ ID NO: 33745 - DNA, 36 bp, Artificial Sequence
  Synthetic oligonucleotide
gccatttacctcactccccaggtcgcacagtgacta

SEQ ID NO: 33746 - DNA, 35 bp, Artificial Sequence
  Synthetic oligonucleotide
ttctaacccgcatgacgccaccaaattgcccgcta

SEQ ID NO: 33747 - DNA, 36 bp, Artificial Sequence
  Synthetic oligonucleotide
atcatgcgcatatacacagcgcgtacattgccctta

SEQ ID NO: 33748 - DNA, 36 bp, Artificial Sequence
  Synthetic oligonucleotide
acacgcgcgggccgcacgcgaggtgtacgtcgctta

SEQ ID NO: 33749 - DNA, 35 bp, Artificial Sequence
  Synthetic oligonucleotide
taccgccctggtcactttatcgcgggactttctta

SEQ ID NO: 33750 - DNA, 35 bp, Artificial Sequence
  Synthetic oligonucleotide
atcgctccaacaaactggtgcacgcttcctgttac

SEQ ID NO: 33751 - DNA, 35 bp, Artificial Sequence
  Synthetic oligonucleotide
gctcgcggtcgcacacgtcccgatcattccccccc

SEQ ID NO: 33752 - DNA, 35 bp, Artificial Sequence
  Synthetic oligonucleotide
acaccctcacattgattgtcgatcttatctgcctc

SEQ ID NO: 33753 - DNA, 35 bp, Artificial Sequence
  Synthetic oligonucleotide
tactgatcacaaccgtcattttcacaccggtaccg

SEQ ID NO: 33754 - DNA, 35 bp, Artificial Sequence
  Synthetic oligonucleotide
gagccaactgcacggtgcacccttgcctttctaat

SEQ ID NO: 33755 - DNA, 35 bp, Artificial Sequence
  Synthetic oligonucleotide
ttggcccacccgtccaagctcatcataatacccat

SEQ ID NO: 33756 - DNA, 35 bp, Artificial Sequence
  Synthetic oligonucleotide
accacacatcccagggcgtagggccactagctgct

SEQ ID NO: 33757 - DNA, 35 bp, Artificial Sequence
  Synthetic oligonucleotide
acctcattccctgtttcaataagtcataacccggt

SEQ ID NO: 33758 - DNA, 35 bp, Artificial Sequence
  Synthetic oligonucleotide
gataggacagaaggggggtgcgaggggtgatctgt

SEQ ID NO: 33759 - DNA, 35 bp, Artificial Sequence
  Synthetic oligonucleotide
gtgcgcctcgcgtgatctttctcaaacggctcctt

SEQ ID NO: 33760 - DNA, 35 bp, Artificial Sequence
  Synthetic oligonucleotide
tgccatcaacttcgagtgtccacttcattcctctt

SEQ ID NO: 33761 - DNA, 35 bp, Artificial Sequence
  Synthetic oligonucleotide
gatgtcgtcctgccacctttaagtgatcacacttt

SEQ ID NO: 33762 - DNA, 35 bp, Artificial Sequence
  Synthetic oligonucleotide
tccatcctgcctcgctgagctacgatcatgcgtaa

SEQ ID NO: 33763 - DNA, 36 bp, Artificial Sequence
  Synthetic oligonucleotide
gggacatactccactgccggacacagggtacactca

SEQ ID NO: 33764 - DNA, 35 bp, Artificial Sequence
  Synthetic oligonucleotide
tccggaccgccatagggttcggcttgttcccttca

SEQ ID NO: 33765 - DNA, 36 bp, Artificial Sequence
  Synthetic oligonucleotide
accggtgcaagtagacgttgggggtggcaaaatgga

SEQ ID NO: 33766 - DNA, 38 bp, Artificial Sequence
  Synthetic oligonucleotide
actgtgctgcactatgaccatacaatcccgtctcctga

SEQ ID NO: 33767 - DNA, 38 bp, Artificial Sequence
  Synthetic oligonucleotide
gaatcactgcctatgttcacgctacctctactcattga

SEQ ID NO: 33768 - DNA, 37 bp, Artificial Sequence
  Synthetic oligonucleotide
gacaaccctgcaatctgctgctgtgctcttactttga

SEQ ID NO: 33769 - DNA, 35 bp, Artificial Sequence
  Synthetic oligonucleotide
gcacccgccttcttaattcggcattccagcccata

SEQ ID NO: 33770 - DNA, 36 bp, Artificial Sequence
  Synthetic oligonucleotide
gtcatccctcggctccacttaagagtatctacgcta

SEQ ID NO: 33771 - DNA, 35 bp, Artificial Sequence
  Synthetic oligonucleotide
tccttgcacatctctcgccactaggccaggacgcc

SEQ ID NO: 33772 - DNA, 35 bp, Artificial Sequence
  Synthetic oligonucleotide
gaccccggccaaaaacaggcgcactctctccaatc

SEQ ID NO: 33773 - DNA, 34 bp, Artificial Sequence
  Synthetic oligonucleotide
ttgccgggccatagacctaccggaccttcgactc

SEQ ID NO: 33774 - DNA, 35 bp, Artificial Sequence
  Synthetic oligonucleotide
gagctcagactcgcattcatccaactggtctggtc

SEQ ID NO: 33775 - DNA, 35 bp, Artificial Sequence
  Synthetic oligonucleotide
tgttactctcccgtcaccgagcccttgtctgcttc

SEQ ID NO: 33776 - DNA, 35 bp, Artificial Sequence
  Synthetic oligonucleotide
gactatcgctcgtattaatctggttgcccttcccg

SEQ ID NO: 33777 - DNA, 35 bp, Artificial Sequence
  Synthetic oligonucleotide
gggtcggtggtggggtggattcggaagggggctcg

SEQ ID NO: 33778 - DNA, 35 bp, Artificial Sequence
  Synthetic oligonucleotide
gagtaatggcccacatacggaattcgtgaccacct

SEQ ID NO: 33779 - DNA, 35 bp, Artificial Sequence
  Synthetic oligonucleotide
gttgagggagcatagggggggcgttattggagtct

SEQ ID NO: 33780 - DNA, 35 bp, Artificial Sequence
  Synthetic oligonucleotide
taggggtgcagtatcccatcgctgttccaactatt

SEQ ID NO: 33781 - DNA, 35 bp, Artificial Sequence
  Synthetic oligonucleotide
tcgcccacatccccgatttatcccttctaggcctt

SEQ ID NO: 33782 - DNA, 35 bp, Artificial Sequence
  Synthetic oligonucleotide
tttgccgcacggcctcacgataccctttacacgtt

SEQ ID NO: 33783 - DNA, 35 bp, Artificial Sequence
  Synthetic oligonucleotide
aaccagccttggttcaaaatcgctgtctttccttt

SEQ ID NO: 33784 - DNA, 36 bp, Artificial Sequence
  Synthetic oligonucleotide
aacacaagccaagattgttcaccacgcatcacccca

SEQ ID NO: 33785 - DNA, 36 bp, Artificial Sequence
  Synthetic oligonucleotide
gagcccgctatcattgcagctcccacttacacacga

SEQ ID NO: 33786 - DNA, 38 bp, Artificial Sequence
  Synthetic oligonucleotide
tagcgtgcttcatacgacctgcgacgcctatcccccga

SEQ ID NO: 33787 - DNA, 36 bp, Artificial Sequence
  Synthetic oligonucleotide
atccacgactcgcctaccctgtggtgccacatccga

SEQ ID NO: 33788 - DNA, 37 bp, Artificial Sequence
  Synthetic oligonucleotide
gatacgtgggtggaggtgcgaggaagctgctggagga

SEQ ID NO: 33789 - DNA, 36 bp, Artificial Sequence
  Synthetic oligonucleotide
gaaaagggctggagaggaaaatgcaggggcgcatga

SEQ ID NO: 33790 - DNA, 38 bp, Artificial Sequence
  Synthetic oligonucleotide
gtacaggtcagcccgctccaccgcaatatttgtgctga

SEQ ID NO: 33791 - DNA, 38 bp, Artificial Sequence
  Synthetic oligonucleotide
tagtgccattgacacgggtcatgcgagccaccccttga

SEQ ID NO: 33792 - DNA, 35 bp, Artificial Sequence
  Synthetic oligonucleotide
gccaacgtgcaatagtcacgaccccgaatgtccac

SEQ ID NO: 33793 - DNA, 35 bp, Artificial Sequence
  Synthetic oligonucleotide
gtttcaactgagccaattcgaatgccgaccaatcc

SEQ ID NO: 33794 - DNA, 35 bp, Artificial Sequence
  Synthetic oligonucleotide
tcccatcgtcatattggcgtttgtctgcccctgtc

SEQ ID NO: 33795 - DNA, 35 bp, Artificial Sequence
  Synthetic oligonucleotide
tcccgtcacccccgcctatccggtttccaatcttc

SEQ ID NO: 33796 - DNA, 35 bp, Artificial Sequence
  Synthetic oligonucleotide
gccggggagtgaaggctggctggaggatcggtcgg

SEQ ID NO: 33797 - DNA, 35 bp, Artificial Sequence
  Synthetic oligonucleotide
gatggccaccacactcctcaaatcgctttctcgct

SEQ ID NO: 33798 - DNA, 35 bp, Artificial Sequence
  Synthetic oligonucleotide
ggtctacccaggcgccctaaagcacgtccttctct

SEQ ID NO: 33799 - DNA, 36 bp, Artificial Sequence
  Synthetic oligonucleotide
gctcaggccccctcactcgacggacagtacggccca

SEQ ID NO: 33800 - DNA, 35 bp, Artificial Sequence
  Synthetic oligonucleotide
atccatctatgcggagtctgtgcccatttctccca

SEQ ID NO: 33801 - DNA, 36 bp, Artificial Sequence
  Synthetic oligonucleotide
tctgtgccgcgctacaactttgtccgatcccgtcca

SEQ ID NO: 33802 - DNA, 37 bp, Artificial Sequence
  Synthetic oligonucleotide
tcactacctccctatcaggataatctgtccgattaga

SEQ ID NO: 33803 - DNA, 37 bp, Artificial Sequence
  Synthetic oligonucleotide
tgaggggagaatcacgtgggggctatccagggaggga

SEQ ID NO: 33804 - DNA, 36 bp, Artificial Sequence
  Synthetic oligonucleotide
tccaccgcgcgcctcattgtctttttgttcagtgga

SEQ ID NO: 33805 - DNA, 36 bp, Artificial Sequence
  Synthetic oligonucleotide
tgtctgaggggggttggtagagggtgggtcggtgga

SEQ ID NO: 33806 - DNA, 37 bp, Artificial Sequence
  Synthetic oligonucleotide
gtccaactacatccgtttgtcccatggacatgtatga

SEQ ID NO: 33807 - DNA, 38 bp, Artificial Sequence
  Synthetic oligonucleotide
agttcagtcatcacacgtcgtactgccacctcctctga

SEQ ID NO: 33808 - DNA, 38 bp, Artificial Sequence
  Synthetic oligonucleotide
gacgaagacggtcagccttgaacatttcaccacattga

SEQ ID NO: 33809 - DNA, 38 bp, Artificial Sequence
  Synthetic oligonucleotide
gcactgcgcaagtatcactctccgacctccctcattga

SEQ ID NO: 33810 - DNA, 37 bp, Artificial Sequence
  Synthetic oligonucleotide
acgcggacacgatcactggcaccacccgccctcttga

SEQ ID NO: 33811 - DNA, 38 bp, Artificial Sequence
  Synthetic oligonucleotide
attgggccagggtgggatggtgattcgggtcctgttga

SEQ ID NO: 33812 - DNA, 38 bp, Artificial Sequence
  Synthetic oligonucleotide
aacgccgccacctaccaccgtgagtttgcacactttga

SEQ ID NO: 33813 - DNA, 36 bp, Artificial Sequence
  Synthetic oligonucleotide
atagccccgactgttgtctttcttgcctacgcccta

SEQ ID NO: 33814 - DNA, 36 bp, Artificial Sequence
  Synthetic oligonucleotide
acgacggctctctcctgcgtgtgcccaaatcctcta

SEQ ID NO: 33815 - DNA, 35 bp, Artificial Sequence
  Synthetic oligonucleotide
gtcaatcctccggtgcttggtccttaacatgcgta

SEQ ID NO: 33816 - DNA, 35 bp, Artificial Sequence
  Synthetic oligonucleotide
ggatcgtcgaacattgcttacgtccccacacctta

SEQ ID NO: 33817 - DNA, 35 bp, Artificial Sequence
  Synthetic oligonucleotide
tacgcgatatgcaggtggtgcattcgtttctttac

SEQ ID NO: 33818 - DNA, 35 bp, Artificial Sequence
  Synthetic oligonucleotide
aacacattcgggcctcctctgcgcctatgcatacc

SEQ ID NO: 33819 - DNA, 35 bp, Artificial Sequence
  Synthetic oligonucleotide
gtagacccttgcttccctgaatcgtttctacgccc

SEQ ID NO: 33820 - DNA, 35 bp, Artificial Sequence
  Synthetic oligonucleotide
gaggtccgactctgtctccactttgtaattccccg

SEQ ID NO: 33821 - DNA, 35 bp, Artificial Sequence
  Synthetic oligonucleotide
acacaacaccgcacgaatccgccttctagagcgtg

SEQ ID NO: 33822 - DNA, 35 bp, Artificial Sequence
  Synthetic oligonucleotide
gttcccctcccatgtttacagccactggccttgat

SEQ ID NO: 33823 - DNA, 34 bp, Artificial Sequence
  Synthetic oligonucleotide
ccccgatgcgcctatcgtcccttttgccctttat

SEQ ID NO: 33824 - DNA, 35 bp, Artificial Sequence
  Synthetic oligonucleotide
gactggagcggcacttttcccatacatcatgtagt

SEQ ID NO: 33825 - DNA, 35 bp, Artificial Sequence
  Synthetic oligonucleotide
accacgcggagcacgatctcactgcacatttttgt

SEQ ID NO: 33826 - DNA, 35 bp, Artificial Sequence
  Synthetic oligonucleotide
gtgcgtgacggctacgtaccttgacccatactcaa

SEQ ID NO: 33827 - DNA, 36 bp, Artificial Sequence
  Synthetic oligonucleotide
ttgcgacccggcgcttttacttccgtttgttcctaa

SEQ ID NO: 33828 - DNA, 35 bp, Artificial Sequence
  Synthetic oligonucleotide
tctggcaatgccacgccaactgccattggaaccca

SEQ ID NO: 33829 - DNA, 36 bp, Artificial Sequence
  Synthetic oligonucleotide
agcactcgccgcgcccaattcatgcaatccctggca

SEQ ID NO: 33830 - DNA, 37 bp, Artificial Sequence
  Synthetic oligonucleotide
gcctgatcgcagctgcgtgcacctctaccgttaacga

SEQ ID NO: 33831 - DNA, 37 bp, Artificial Sequence
  Synthetic oligonucleotide
agtccacacatcatctgcctccgttagccttatacga

SEQ ID NO: 33832 - DNA, 35 bp, Artificial Sequence
  Synthetic oligonucleotide
tcctgacccctcccgatccttacgagtgcccccga

SEQ ID NO: 33833 - DNA, 37 bp, Artificial Sequence
  Synthetic oligonucleotide
ttgcgtatgctcccccatctgcatgtttgactcggga

SEQ ID NO: 33834 - DNA, 36 bp, Artificial Sequence
  Synthetic oligonucleotide
gacacctcctgcaccttcgggtttactacaattgga

SEQ ID NO: 33835 - DNA, 38 bp, Artificial Sequence
  Synthetic oligonucleotide
tgagaagcacgaacggaggggggctagtggagggctga

SEQ ID NO: 33836 - DNA, 37 bp, Artificial Sequence
  Synthetic oligonucleotide
ggagtcgtgtggcttcggcgggtagggagggtcgtga

SEQ ID NO: 33837 - DNA, 38 bp, Artificial Sequence
  Synthetic oligonucleotide
tacctgcccacgttcattatacgtcatacgacctgtga

SEQ ID NO: 33838 - DNA, 36 bp, Artificial Sequence
  Synthetic oligonucleotide
gatcccgctgtcctccacccatgtcgcttaagacta

SEQ ID NO: 33839 - DNA, 35 bp, Artificial Sequence
  Synthetic oligonucleotide
gaccccgcctccaactccgattcgccgatgatcta

SEQ ID NO: 33840 - DNA, 35 bp, Artificial Sequence
  Synthetic oligonucleotide
agccgatcacagtgataacctcgctgcttactacc

SEQ ID NO: 33841 - DNA, 35 bp, Artificial Sequence
  Synthetic oligonucleotide
tctatcgccgatcaacgtaagtcacctgtctcgtc

SEQ ID NO: 33842 - DNA, 35 bp, Artificial Sequence
  Synthetic oligonucleotide
ttgttccccctgagcgatgcggactgatcttcttc

SEQ ID NO: 33843 - DNA, 35 bp, Artificial Sequence
  Synthetic oligonucleotide
tcaccaactccacttgcgaagaataggcttgtttc

SEQ ID NO: 33844 - DNA, 35 bp, Artificial Sequence
  Synthetic oligonucleotide
gaatctgacgatagagggaggagttggaggttggg

SEQ ID NO: 33845 - DNA, 35 bp, Artificial Sequence
  Synthetic oligonucleotide
tgcggggtgtaaggtgtttggggaaaggtaggatg

SEQ ID NO: 33846 - DNA, 35 bp, Artificial Sequence
  Synthetic oligonucleotide
ggagtgcacgataggaaatgttgcccttataccct

SEQ ID NO: 33847 - DNA, 35 bp, Artificial Sequence
  Synthetic oligonucleotide
ggagaccccacaagccccgaacgtccgtatcggaa

SEQ ID NO: 33848 - DNA, 36 bp, Artificial Sequence
  Synthetic oligonucleotide
ggaccctctcagccttcccgtcccgtcataagcaca

SEQ ID NO: 33849 - DNA, 37 bp, Artificial Sequence
  Synthetic oligonucleotide
ggggtggaacagggggagaagtagggcgcctcgtaga

SEQ ID NO: 33850 - DNA, 37 bp, Artificial Sequence
  Synthetic oligonucleotide
atcagcctgcgcggccttgcttatcctcataccacga

SEQ ID NO: 33851 - DNA, 36 bp, Artificial Sequence
  Synthetic oligonucleotide
acagggaggtgggcaagggtgcgactgttaggagga

SEQ ID NO: 33852 - DNA, 37 bp, Artificial Sequence
  Synthetic oligonucleotide
gaccctagctcaatctagtaccactgccacacaatga

SEQ ID NO: 33853 - DNA, 38 bp, Artificial Sequence
  Synthetic oligonucleotide
tccccaacttgttcgtgttccctactgccgctttatga

SEQ ID NO: 33854 - DNA, 38 bp, Artificial Sequence
  Synthetic oligonucleotide
tcatggcgcgacctccctgacctgcttgacactactga

SEQ ID NO: 33855 - DNA, 38 bp, Artificial Sequence
  Synthetic oligonucleotide
tcacccacctcgtacttttatactagccagaactttga

SEQ ID NO: 33856 - DNA, 35 bp, Artificial Sequence
  Synthetic oligonucleotide
gtctgccattccgtacggtcccttgtttcccctac

SEQ ID NO: 33857 - DNA, 35 bp, Artificial Sequence
  Synthetic oligonucleotide
gtccatctgggacaatgtctcccgttccctgctac

SEQ ID NO: 33858 - DNA, 35 bp, Artificial Sequence
  Synthetic oligonucleotide
atcagcgcgcccgatccgcattacatcacttctcc

SEQ ID NO: 33859 - DNA, 35 bp, Artificial Sequence
  Synthetic oligonucleotide
tctattcactcccaggggcctcgcttcatttctgc

SEQ ID NO: 33860 - DNA, 35 bp, Artificial Sequence
  Synthetic oligonucleotide
agacctggcctcacttgcgatagcccctgcttatc

SEQ ID NO: 33861 - DNA, 35 bp, Artificial Sequence
  Synthetic oligonucleotide
gtgcaaccttcaaatctaatcaaagcccacccgtc

SEQ ID NO: 33862 - DNA, 35 bp, Artificial Sequence
  Synthetic oligonucleotide
acccatgctctgctatcttacaactttggtttttc

SEQ ID NO: 33863 - DNA, 35 bp, Artificial Sequence
  Synthetic oligonucleotide
attatcacgcatacccccgcctccctactagtagg

SEQ ID NO: 33864 - DNA, 35 bp, Artificial Sequence
  Synthetic oligonucleotide
ggacccgtcaggccccatctacaccaggattccct

SEQ ID NO: 33865 - DNA, 35 bp, Artificial Sequence
  Synthetic oligonucleotide
gcacaacgctaaacttatgaactcaccgcttggct

SEQ ID NO: 33866 - DNA, 35 bp, Artificial Sequence
  Synthetic oligonucleotide
aatcccgcactgtcgctgacgtctcgttgctatct

SEQ ID NO: 33867 - DNA, 35 bp, Artificial Sequence
  Synthetic oligonucleotide
atcatccctcgcgttcggcaagctacctagccatt

SEQ ID NO: 33868 - DNA, 36 bp, Artificial Sequence
  Synthetic oligonucleotide
ggagggcaggaaggggtaatcaaggggaaatggaaa

SEQ ID NO: 33869 - DNA, 36 bp, Artificial Sequence
  Synthetic oligonucleotide
tggtcaccaacctgctgccgacgccttcgtatgaaa

SEQ ID NO: 33870 - DNA, 36 bp, Artificial Sequence
  Synthetic oligonucleotide
accgtcgcagagttcctctaccctcatcccctccca

SEQ ID NO: 33871 - DNA, 34 bp, Artificial Sequence
  Synthetic oligonucleotide
gtgccgctagtacttatagcctttccacgctcca

SEQ ID NO: 33872 - DNA, 36 bp, Artificial Sequence
  Synthetic oligonucleotide
acgcacgatacaggttagtctttggccccggttgca

SEQ ID NO: 33873 - DNA, 36 bp, Artificial Sequence
  Synthetic oligonucleotide
atccactacggcagtccgtaccttccttgctcgcga

SEQ ID NO: 33874 - DNA, 38 bp, Artificial Sequence
  Synthetic oligonucleotide
tcccacccgcactactacagtgatgaaccgtttactga

SEQ ID NO: 33875 - DNA, 38 bp, Artificial Sequence
  Synthetic oligonucleotide
gtctcacacaaatgccttctccggggacaaccccctga

SEQ ID NO: 33876 - DNA, 38 bp, Artificial Sequence
  Synthetic oligonucleotide
attgacagaggatggggggggaggagcatagcgagtga

SEQ ID NO: 33877 - DNA, 38 bp, Artificial Sequence
  Synthetic oligonucleotide
gcgcctccgacccttctgtaaggactgccctgtcgtga

SEQ ID NO: 33878 - DNA, 36 bp, Artificial Sequence
  Synthetic oligonucleotide
tccgcgagggggttagaggggccaattggacggata

SEQ ID NO: 33879 - DNA, 35 bp, Artificial Sequence
  Synthetic oligonucleotide
ttactcccgctgcgggcctcgcctccctgctaaac

SEQ ID NO: 33880 - DNA, 35 bp, Artificial Sequence
  Synthetic oligonucleotide
ggttcaccgaactcaaggaacacctacctgccaac

SEQ ID NO: 33881 - DNA, 35 bp, Artificial Sequence
  Synthetic oligonucleotide
gtcgcctccagtgcatttcctaagttcaatgttac

SEQ ID NO: 33882 - DNA, 35 bp, Artificial Sequence
  Synthetic oligonucleotide
acctcccatcgtacaattaccctactcatatgacc

SEQ ID NO: 33883 - DNA, 35 bp, Artificial Sequence
  Synthetic oligonucleotide
gatacctaaccgttcacttcacacgggatatcatc

SEQ ID NO: 33884 - DNA, 35 bp, Artificial Sequence
  Synthetic oligonucleotide
aaacaccctcacgctttagttacttttaggacctc

SEQ ID NO: 33885 - DNA, 35 bp, Artificial Sequence
  Synthetic oligonucleotide
tacaaacacctcggtcatagacgcatgacgaattc

SEQ ID NO: 33886 - DNA, 35 bp, Artificial Sequence
  Synthetic oligonucleotide
taaggagaggaactgttgttggtggggaagattag

SEQ ID NO: 33887 - DNA, 35 bp, Artificial Sequence
  Synthetic oligonucleotide
tggacactccgccagtgcctcccaccgctacctcg

SEQ ID NO: 33888 - DNA, 35 bp, Artificial Sequence
  Synthetic oligonucleotide
tgatgggggtaaggggctatggagcacgggtttcg

SEQ ID NO: 33889 - DNA, 35 bp, Artificial Sequence
  Synthetic oligonucleotide
gagacatgccagtatgaaggtattggaaggctcgg

SEQ ID NO: 33890 - DNA, 35 bp, Artificial Sequence
  Synthetic oligonucleotide
aagtcagggcaataaaaagggtggtaggagtcgat

SEQ ID NO: 33891 - DNA, 35 bp, Artificial Sequence
  Synthetic oligonucleotide
gtgatcgcacccgccattgccccgctcctttccct

SEQ ID NO: 33892 - DNA, 36 bp, Artificial Sequence
  Synthetic oligonucleotide
gtcgctccgccccatgctcttgtatgcctcgtacgt

SEQ ID NO: 33893 - DNA, 36 bp, Artificial Sequence
  Synthetic oligonucleotide
accatccccccaaggtgtccggtcctcgggtttaca

SEQ ID NO: 33894 - DNA, 36 bp, Artificial Sequence
  Synthetic oligonucleotide
tagccacattgcctttccctgaccggagccgtgcca

SEQ ID NO: 33895 - DNA, 36 bp, Artificial Sequence
  Synthetic oligonucleotide
atgtggaatgtggtgagggtggatcgaaggtgggca

SEQ ID NO: 33896 - DNA, 35 bp, Artificial Sequence
  Synthetic oligonucleotide
ataccacccccatgtttagccaccgcgggtttgca

SEQ ID NO: 33897 - DNA, 36 bp, Artificial Sequence
  Synthetic oligonucleotide
gaaacagggggggcgatcgactttggatggggcaga

SEQ ID NO: 33898 - DNA, 37 bp, Artificial Sequence
  Synthetic oligonucleotide
gacgacgcgacctggttatgttcttgttcctgatcga

SEQ ID NO: 33899 - DNA, 38 bp, Artificial Sequence
  Synthetic oligonucleotide
ttgtccaccatctgctgcccatttttggcttcccatga

SEQ ID NO: 33900 - DNA, 37 bp, Artificial Sequence
  Synthetic oligonucleotide
tgcgaagccaacccgatatttgccacacctgtcgtga

SEQ ID NO: 33901 - DNA, 37 bp, Artificial Sequence
  Synthetic oligonucleotide
tgcgggataggaggggtaaagggcagaggggttttga

SEQ ID NO: 33902 - DNA, 36 bp, Artificial Sequence
  Synthetic oligonucleotide
agtgtggtcaggtctcctgttccgttggttgcccta

SEQ ID NO: 33903 - DNA, 35 bp, Artificial Sequence
  Synthetic oligonucleotide
tctgagcattcgcaccttttgttttccgtactcta

SEQ ID NO: 33904 - DNA, 36 bp, Artificial Sequence
  Synthetic oligonucleotide
gccatgtccgacgtgccccccgccaccccccccgta

SEQ ID NO: 33905 - DNA, 35 bp, Artificial Sequence
  Synthetic oligonucleotide
ccacccgatacgttcatcttcattgctaggcctcc

SEQ ID NO: 33906 - DNA, 36 bp, Artificial Sequence
  Synthetic oligonucleotide
taccactgtccaggccaccgggccagaatctcaatc

SEQ ID NO: 33907 - DNA, 36 bp, Artificial Sequence
  Synthetic oligonucleotide
gtcccatccagttgaacccattagtgcctccggaaa

SEQ ID NO: 33908 - DNA, 36 bp, Artificial Sequence
  Synthetic oligonucleotide
acgtcccccctgatcacgcgaattaccctgccacaa

SEQ ID NO: 33909 - DNA, 35 bp, Artificial Sequence
  Synthetic oligonucleotide
tcgacgctccgtagtttcactcacctgttcccaca

SEQ ID NO: 33910 - DNA, 36 bp, Artificial Sequence
  Synthetic oligonucleotide
aaacggtcccatttgccctacatctgtccatgtcca

SEQ ID NO: 33911 - DNA, 36 bp, Artificial Sequence
  Synthetic oligonucleotide
gcgcacacctccatcactcttatccggtcacgagca

SEQ ID NO: 33912 - DNA, 34 bp, Artificial Sequence
  Synthetic oligonucleotide
tgtggagacgcccatattatcgccgggttgctca

SEQ ID NO: 33913 - DNA, 37 bp, Artificial Sequence
  Synthetic oligonucleotide
aacgcccgtggtctgctatcatgtcttctctgcccga

SEQ ID NO: 33914 - DNA, 37 bp, Artificial Sequence
  Synthetic oligonucleotide
gcacgcccatcatctcacctgcgaccttccaattcga

SEQ ID NO: 33915 - DNA, 37 bp, Artificial Sequence
  Synthetic oligonucleotide
tgcacctttcactattatgaccgctccatctccatga

SEQ ID NO: 33916 - DNA, 38 bp, Artificial Sequence
  Synthetic oligonucleotide
gaccgcctccattttcgctgcttcgagcttttgcctga

SEQ ID NO: 33917 - DNA, 38 bp, Artificial Sequence
  Synthetic oligonucleotide
tagtcccacactcatgcatacgattcgccactatgtga

SEQ ID NO: 33918 - DNA, 38 bp, Artificial Sequence
  Synthetic oligonucleotide
ggtcgttgtcggaaggggggtgggaaaaaggtggttga

SEQ ID NO: 33919 - DNA, 36 bp, Artificial Sequence
  Synthetic oligonucleotide
tgtcaccgcgaccttttttagtcttgcccgggttta

SEQ ID NO: 33920 - DNA, 35 bp, Artificial Sequence
  Synthetic oligonucleotide
gagcacgtgcacagaatgcacatctgccgcctcac

SEQ ID NO: 33921 - DNA, 34 bp, Artificial Sequence
  Synthetic oligonucleotide
acccactcatgtatcttcgcattttcattaggac

SEQ ID NO: 33922 - DNA, 35 bp, Artificial Sequence
  Synthetic oligonucleotide
atacatcacaccagttgctaactactccatgttac

SEQ ID NO: 33923 - DNA, 35 bp, Artificial Sequence
  Synthetic oligonucleotide
atacggagcaggcgataaactaccatctgcactcc

SEQ ID NO: 33924 - DNA, 35 bp, Artificial Sequence
  Synthetic oligonucleotide
gatgcccatcgtgcctacgtccgcaacatttttcc

SEQ ID NO: 33925 - DNA, 35 bp, Artificial Sequence
  Synthetic oligonucleotide
agagtcacaacactcagccactgattaacctggtc

SEQ ID NO: 33926 - DNA, 35 bp, Artificial Sequence
  Synthetic oligonucleotide
gtcgaggggggagaatagagcggcgggtgcaaacg

SEQ ID NO: 33927 - DNA, 35 bp, Artificial Sequence
  Synthetic oligonucleotide
gttcgcctgttttgctaattctccgtgaccacatg

SEQ ID NO: 33928 - DNA, 35 bp, Artificial Sequence
  Synthetic oligonucleotide
atagccttacgtacgcatattgtcacacctttctg

SEQ ID NO: 33929 - DNA, 35 bp, Artificial Sequence
  Synthetic oligonucleotide
gtccatcgacctcacagtagcaaacgtgcacccca

SEQ ID NO: 33930 - DNA, 35 bp, Artificial Sequence
  Synthetic oligonucleotide
gaacgggagtggttagggctcaagagagaagggca

SEQ ID NO: 33931 - DNA, 36 bp, Artificial Sequence
  Synthetic oligonucleotide
acatgcccccacgccaccttgcttagtgccaaatca

SEQ ID NO: 33932 - DNA, 36 bp, Artificial Sequence
  Synthetic oligonucleotide
aactcgccggtcacgggggttctcgtgcttttatca

SEQ ID NO: 33933 - DNA, 37 bp, Artificial Sequence
  Synthetic oligonucleotide
ttgcggtcgccgcgaacccacctaccctgttaaacga

SEQ ID NO: 33934 - DNA, 35 bp, Artificial Sequence
  Synthetic oligonucleotide
gtcaagttgccccacattgaatatagccttcccga

SEQ ID NO: 33935 - DNA, 37 bp, Artificial Sequence
  Synthetic oligonucleotide
gacatcctccaactgtacaactgtgcatgaaatccga

SEQ ID NO: 33936 - DNA, 38 bp, Artificial Sequence
  Synthetic oligonucleotide
tgtgcccagggcccttcgtgctcaagtaccaccactga

SEQ ID NO: 33937 - DNA, 37 bp, Artificial Sequence
  Synthetic oligonucleotide
aagtacagtggggtggaaatcaagataggagacgtga

SEQ ID NO: 33938 - DNA, 37 bp, Artificial Sequence
  Synthetic oligonucleotide
accgaaccacctttgccgcgcctccccttactgttga

SEQ ID NO: 33939 - DNA, 38 bp, Artificial Sequence
  Synthetic oligonucleotide
aacacgcaactgacacacgagggttccatttattttga

SEQ ID NO: 33940 - DNA, 36 bp, Artificial Sequence
  Synthetic oligonucleotide
acgcgacaccaaccgttgatcccggcatttccacta

SEQ ID NO: 33941 - DNA, 35 bp, Artificial Sequence
  Synthetic oligonucleotide
gacgtgcccacttacccgccaatccctaagccgta

SEQ ID NO: 33942 - DNA, 35 bp, Artificial Sequence
  Synthetic oligonucleotide
acgacctgcccttgagcctttttaatctaccaaac

SEQ ID NO: 33943 - DNA, 35 bp, Artificial Sequence
  Synthetic oligonucleotide
aagtcgcgcccaccccgtatgccccgtgcacggac

SEQ ID NO: 33944 - DNA, 35 bp, Artificial Sequence
  Synthetic oligonucleotide
gaagagagccgatgacacccgcccactatttcccc

SEQ ID NO: 33945 - DNA, 35 bp, Artificial Sequence
  Synthetic oligonucleotide
ttatcaccacactggattgaattgcgccgctgccc

SEQ ID NO: 33946 - DNA, 35 bp, Artificial Sequence
  Synthetic oligonucleotide
cacggggacagaatctatggtaacgatagtgttcc

SEQ ID NO: 33947 - DNA, 35 bp, Artificial Sequence
  Synthetic oligonucleotide
tgcatcgcgtacatctctatgactttaccgacctc

SEQ ID NO: 33948 - DNA, 35 bp, Artificial Sequence
  Synthetic oligonucleotide
gcggagcagatgtcgcctttttaccgttctacctc

SEQ ID NO: 33949 - DNA, 35 bp, Artificial Sequence
  Synthetic oligonucleotide
tgacccccaacttggtctatcgagagagaaatttc

SEQ ID NO: 33950 - DNA, 35 bp, Artificial Sequence
  Synthetic oligonucleotide
atcgtcaagcctctcactcccactctcccagttcg

SEQ ID NO: 33951 - DNA, 35 bp, Artificial Sequence
  Synthetic oligonucleotide
tattccagccgaccctccgaatactacactcttgg

SEQ ID NO: 33952 - DNA, 35 bp, Artificial Sequence
  Synthetic oligonucleotide
tctgcaacacacactcaggcaatctccccctcctg

SEQ ID NO: 33953 - DNA, 35 bp, Artificial Sequence
  Synthetic oligonucleotide
aacctagcgtctcacctgctttcttgtctgcaaat

SEQ ID NO: 33954 - DNA, 35 bp, Artificial Sequence
  Synthetic oligonucleotide
atgaccacgccggacggcggtcccttacttcacat

SEQ ID NO: 33955 - DNA, 35 bp, Artificial Sequence
  Synthetic oligonucleotide
atgcaacactcaatcctatttgtacataggccctt

SEQ ID NO: 33956 - DNA, 35 bp, Artificial Sequence
  Synthetic oligonucleotide
gcaacccgtttccctcccatctatggcgaagcttt

SEQ ID NO: 33957 - DNA, 36 bp, Artificial Sequence
  Synthetic oligonucleotide
gtacatcttccgagtcgactctgccaacacgtacca

SEQ ID NO: 33958 - DNA, 36 bp, Artificial Sequence
  Synthetic oligonucleotide
tatgtccctcactgcgcacgtccccagtacctgtca

SEQ ID NO: 33959 - DNA, 37 bp, Artificial Sequence
  Synthetic oligonucleotide
atcgcccggacagtagcaacaccgcaacactcataga

SEQ ID NO: 33960 - DNA, 35 bp, Artificial Sequence
  Synthetic oligonucleotide
ttcgacacatcgctccaaacttttccctcagacga

SEQ ID NO: 33961 - DNA, 37 bp, Artificial Sequence
  Synthetic oligonucleotide
gaccggtacgtcttcactagttaatccctgcctccga

SEQ ID NO: 33962 - DNA, 36 bp, Artificial Sequence
  Synthetic oligonucleotide
tcatagacaccctcagccccgacccgcttatcgcga

SEQ ID NO: 33963 - DNA, 37 bp, Artificial Sequence
  Synthetic oligonucleotide
tccgatctccgactgttcgcaaccgctggctcttcga

SEQ ID NO: 33964 - DNA, 37 bp, Artificial Sequence
  Synthetic oligonucleotide
attgcacgcagttggctctgcccgcctcatacccgga

SEQ ID NO: 33965 - DNA, 38 bp, Artificial Sequence
  Synthetic oligonucleotide
gtaacgccgccatccctgctctcgtcgccttacgctga

SEQ ID NO: 33966 - DNA, 34 bp, Artificial Sequence
  Synthetic oligonucleotide
aatgtgtgctccaccctcaatgctctgtccgtga

SEQ ID NO: 33967 - DNA, 38 bp, Artificial Sequence
  Synthetic oligonucleotide
tttcccccccagcccgatagttgactcccttctcgtga

SEQ ID NO: 33968 - DNA, 37 bp, Artificial Sequence
  Synthetic oligonucleotide
gcgtcacggactagggggggacgggtgagcaatgtga

SEQ ID NO: 33969 - DNA, 38 bp, Artificial Sequence
  Synthetic oligonucleotide
tcacgggaggcccacattaatttcgacttgccaattga

SEQ ID NO: 33970 - DNA, 35 bp, Artificial Sequence
  Synthetic oligonucleotide
tgtcggtgccccgcgtgcgaacctgcccaacttcc

SEQ ID NO: 33971 - DNA, 35 bp, Artificial Sequence
  Synthetic oligonucleotide
gcgatttccgttacaagatcctgcttacctgcctc

SEQ ID NO: 33972 - DNA, 35 bp, Artificial Sequence
  Synthetic oligonucleotide
aacctgcatagtcgcctctgttctgggtactcctc

SEQ ID NO: 33973 - DNA, 35 bp, Artificial Sequence
  Synthetic oligonucleotide
aacagcacagctcccttgttaaaacgctttatctc

SEQ ID NO: 33974 - DNA, 35 bp, Artificial Sequence
  Synthetic oligonucleotide
tgtgggagccacacatccgcatcatctaatccgcg

SEQ ID NO: 33975 - DNA, 35 bp, Artificial Sequence
  Synthetic oligonucleotide
tgactctcgcctgcgcacacgttaaactcccatcg

SEQ ID NO: 33976 - DNA, 35 bp, Artificial Sequence
  Synthetic oligonucleotide
actcatcccattgccctactcacatatttgatgtg

SEQ ID NO: 33977 - DNA, 35 bp, Artificial Sequence
  Synthetic oligonucleotide
atccaagcctaccgcccctggttgattcataaact

SEQ ID NO: 33978 - DNA, 35 bp, Artificial Sequence
  Synthetic oligonucleotide
gtgtgttccctgctgcgcccccttttagctgttct

SEQ ID NO: 33979 - DNA, 36 bp, Artificial Sequence
  Synthetic oligonucleotide
gagtgctgtcaccgtctatcactcgcttccatcaca

SEQ ID NO: 33980 - DNA, 36 bp, Artificial Sequence
  Synthetic oligonucleotide
tcgccatgcaaccaccatcaggtaaggcttttccca

SEQ ID NO: 33981 - DNA, 35 bp, Artificial Sequence
  Synthetic oligonucleotide
atccggcaaacgtgggggaaaacaaggtagcagca

SEQ ID NO: 33982 - DNA, 37 bp, Artificial Sequence
  Synthetic oligonucleotide
acacctcccccctaacagtgtgtaagacagtaagaga

SEQ ID NO: 33983 - DNA, 37 bp, Artificial Sequence
  Synthetic oligonucleotide
gtgatggggtggtaatggtggtgaggtcctggggaga

SEQ ID NO: 33984 - DNA, 37 bp, Artificial Sequence
  Synthetic oligonucleotide
gtccacgctccacctggctgttgctagtcccgaccga

SEQ ID NO: 33985 - DNA, 36 bp, Artificial Sequence
  Synthetic oligonucleotide
gtgccccttcccggtctggttactagctccgcccga

SEQ ID NO: 33986 - DNA, 37 bp, Artificial Sequence
  Synthetic oligonucleotide
gctgctcggcggggggagggtcttgtcacggggagga

SEQ ID NO: 33987 - DNA, 36 bp, Artificial Sequence
  Synthetic oligonucleotide
gttcccacacatctatttcatcccgcacttagcgga

SEQ ID NO: 33988 - DNA, 37 bp, Artificial Sequence
  Synthetic oligonucleotide
agagggggggggcgcaataagcggagcgtggcatgga

SEQ ID NO: 33989 - DNA, 37 bp, Artificial Sequence
  Synthetic oligonucleotide
ggtgggggggaagggctggcggaaaggcgcgtttgga

SEQ ID NO: 33990 - DNA, 38 bp, Artificial Sequence
  Synthetic oligonucleotide
ggaccacgggaacggaaggattaccttggtaatgatga

SEQ ID NO: 33991 - DNA, 38 bp, Artificial Sequence
  Synthetic oligonucleotide
gcataccacatcggacctgcatttgaaactgttgctga

SEQ ID NO: 33992 - DNA, 37 bp, Artificial Sequence
  Synthetic oligonucleotide
gcgagagaccatagcgtgtgaagcgggggggtagtga

SEQ ID NO: 33993 - DNA, 37 bp, Artificial Sequence
  Synthetic oligonucleotide
gagcccccacgctgctattatgaattttttcctgtga

SEQ ID NO: 33994 - DNA, 38 bp, Artificial Sequence
  Synthetic oligonucleotide
gcgtaacgccggcgttccctgtcttgcctcaccattga

SEQ ID NO: 33995 - DNA, 38 bp, Artificial Sequence
  Synthetic oligonucleotide
attccccgccacagtagccgccttccactgcctgttga

SEQ ID NO: 33996 - DNA, 37 bp, Artificial Sequence
  Synthetic oligonucleotide
tacctgactccgcgtgcaatcagcacctcgtatttga

SEQ ID NO: 33997 - DNA, 38 bp, Artificial Sequence
  Synthetic oligonucleotide
tccgggccctcactcttactgtacgtttttggctttga

SEQ ID NO: 33998 - DNA, 37 bp, Artificial Sequence
  Synthetic oligonucleotide
attggggtgaggaagtacgagggtagagggagtttga

SEQ ID NO: 33999 - DNA, 36 bp, Artificial Sequence
  Synthetic oligonucleotide
ttacccgtatgtccgtcgcatccctgcatcatgcta

SEQ ID NO: 34000 - DNA, 36 bp, Artificial Sequence
  Synthetic oligonucleotide
gatcaaccccacctatacacacacgaggcacctcta

SEQ ID NO: 34001 - DNA, 35 bp, Artificial Sequence
  Synthetic oligonucleotide
taccgaccgatctgtcgaaagcttccatcacgtta

SEQ ID NO: 34002 - DNA, 35 bp, Artificial Sequence
  Synthetic oligonucleotide
tatgcgcaaccacacgtacgggagttccatgcccc

SEQ ID NO: 34003 - DNA, 35 bp, Artificial Sequence
  Synthetic oligonucleotide
cacacccgcgctttgctattgcacttgttttcccc

SEQ ID NO: 34004 - DNA, 35 bp, Artificial Sequence
  Synthetic oligonucleotide
gtcccacgggttcctactcgttgttaactatctcc

SEQ ID NO: 34005 - DNA, 35 bp, Artificial Sequence
  Synthetic oligonucleotide
tgaaccccgcgatgcgaggcgcctaactccatctc

SEQ ID NO: 34006 - DNA, 35 bp, Artificial Sequence
  Synthetic oligonucleotide
tgtcgcggtcccgaatacgcaacaatctcccgttc

SEQ ID NO: 34007 - DNA, 35 bp, Artificial Sequence
  Synthetic oligonucleotide
tgtgctggggaggtgggggtagtttaggatattag

SEQ ID NO: 34008 - DNA, 35 bp, Artificial Sequence
  Synthetic oligonucleotide
tcctgcacacattatggatgcctagtttcctctcg

SEQ ID NO: 34009 - DNA, 35 bp, Artificial Sequence
  Synthetic oligonucleotide
gtggaacagggggctggaagggctccaagttgggg

SEQ ID NO: 34010 - DNA, 35 bp, Artificial Sequence
  Synthetic oligonucleotide
tgccatctatgtcccgtgaccgaactcttctactg

SEQ ID NO: 34011 - DNA, 35 bp, Artificial Sequence
  Synthetic oligonucleotide
taacccatcccgacagtgaatcgcgaagccctttt

SEQ ID NO: 34012 - DNA, 35 bp, Artificial Sequence
  Synthetic oligonucleotide
attccactgcgctttaccgccatcctgtctagcaa

SEQ ID NO: 34013 - DNA, 35 bp, Artificial Sequence
  Synthetic oligonucleotide
gcgagcaccatcttccgttccgcttgccacttcaa

SEQ ID NO: 34014 - DNA, 36 bp, Artificial Sequence
  Synthetic oligonucleotide
ggtggaacaacgggtttaaaggagggtatgccaaca

SEQ ID NO: 34015 - DNA, 38 bp, Artificial Sequence
  Synthetic oligonucleotide
gtttggcgtacattgcgtttttcccccgtttctccgga

SEQ ID NO: 34016 - DNA, 37 bp, Artificial Sequence
  Synthetic oligonucleotide
tgagccggggtgaagtaggggcggcatccgaatggga

SEQ ID NO: 34017 - DNA, 37 bp, Artificial Sequence
  Synthetic oligonucleotide
gagtgggggagaacaaatgtgtggtgtggcgatggga

SEQ ID NO: 34018 - DNA, 38 bp, Artificial Sequence
  Synthetic oligonucleotide
ttccaccgcagggagcttaattcccacttctacactga

SEQ ID NO: 34019 - DNA, 38 bp, Artificial Sequence
  Synthetic oligonucleotide
atagcgcactgtcacaacccgttcttctgccaacctga

SEQ ID NO: 34020 - DNA, 35 bp, Artificial Sequence
  Synthetic oligonucleotide
acttccaacactgcattgctaagtacacccatata

SEQ ID NO: 34021 - DNA, 35 bp, Artificial Sequence
  Synthetic oligonucleotide
agacctctcaccgcccgcccggcatcgtcctcgcc

SEQ ID NO: 34022 - DNA, 35 bp, Artificial Sequence
  Synthetic oligonucleotide
agtcccctccgcgggtctatgtaaactcacattcc

SEQ ID NO: 34023 - DNA, 35 bp, Artificial Sequence
  Synthetic oligonucleotide
tcacaacctctatcatttctgggaacatgcattcc

SEQ ID NO: 34024 - DNA, 35 bp, Artificial Sequence
  Synthetic oligonucleotide
gcgagcacgtttgccactttctgaagcttcccatc

SEQ ID NO: 34025 - DNA, 35 bp, Artificial Sequence
  Synthetic oligonucleotide
cacgttcgccggccaactctgtcatcccccgggtc

SEQ ID NO: 34026 - DNA, 35 bp, Artificial Sequence
  Synthetic oligonucleotide
attgcccactaacgtgcctgtcccctgtaacgtct

SEQ ID NO: 34027 - DNA, 35 bp, Artificial Sequence
  Synthetic oligonucleotide
tactgcctcctcgcactaaactgttattttgccgt

SEQ ID NO: 34028 - DNA, 35 bp, Artificial Sequence
  Synthetic oligonucleotide
gattcccgacacgcctaccagggtttggcccactt

SEQ ID NO: 34029 - DNA, 35 bp, Artificial Sequence
  Synthetic oligonucleotide
tggacccctgaggaaacactttttatgctgccttt

SEQ ID NO: 34030 - DNA, 35 bp, Artificial Sequence
  Synthetic oligonucleotide
accgcctcctgtcacaccttcccgatcgttttttt

SEQ ID NO: 34031 - DNA, 36 bp, Artificial Sequence
  Synthetic oligonucleotide
gctacgtgaagggtggtgggtgtaatggggggaaga

SEQ ID NO: 34032 - DNA, 35 bp, Artificial Sequence
  Synthetic oligonucleotide
tcgaacgagaggagggagggcgaaggggaataaga

SEQ ID NO: 34033 - DNA, 36 bp, Artificial Sequence
  Synthetic oligonucleotide
gagtgatataggggagtatgggagggtacggggaga

SEQ ID NO: 34034 - DNA, 37 bp, Artificial Sequence
  Synthetic oligonucleotide
gttagccacctccgttcgcaagaaccaagccactcga

SEQ ID NO: 34035 - DNA, 37 bp, Artificial Sequence
  Synthetic oligonucleotide
gccctgttcccgatggtccgcttgattcccgcctcga

SEQ ID NO: 34036 - DNA, 38 bp, Artificial Sequence
  Synthetic oligonucleotide
accactccggattcgcccttccagtaccctgaaactga

SEQ ID NO: 34037 - DNA, 37 bp, Artificial Sequence
  Synthetic oligonucleotide
tgcccgccagggcctgtcttgtcaccctctcaactga

SEQ ID NO: 34038 - DNA, 38 bp, Artificial Sequence
  Synthetic oligonucleotide
gagcccacccctactggctagtaacgactttcccctga

SEQ ID NO: 34039 - DNA, 38 bp, Artificial Sequence
  Synthetic oligonucleotide
tcccacccatggaggttttctttgatcacgaactgtga

SEQ ID NO: 34040 - DNA, 36 bp, Artificial Sequence
  Synthetic oligonucleotide
attgatgctcctgccgaacactgggtctcacgcata

SEQ ID NO: 34041 - DNA, 35 bp, Artificial Sequence
  Synthetic oligonucleotide
tagtactacagccccctgccttcttagagccttta

SEQ ID NO: 34042 - DNA, 35 bp, Artificial Sequence
  Synthetic oligonucleotide
atgatcactactggggctgtctccaacctttcacc

SEQ ID NO: 34043 - DNA, 35 bp, Artificial Sequence
  Synthetic oligonucleotide
ccgatgccccagctctgtcaaaccggaaccctccc

SEQ ID NO: 34044 - DNA, 35 bp, Artificial Sequence
  Synthetic oligonucleotide
gaccgatcattacagccacctggttcctcataagc

SEQ ID NO: 34045 - DNA, 35 bp, Artificial Sequence
  Synthetic oligonucleotide
agctgaatagcgtgataacctaaacatgccctctc

SEQ ID NO: 34046 - DNA, 35 bp, Artificial Sequence
  Synthetic oligonucleotide
cacaacaccggctgcccatcctgtccccgtgcctg

SEQ ID NO: 34047 - DNA, 35 bp, Artificial Sequence
  Synthetic oligonucleotide
atgccacgcactacccgggatctggatcgataagt

SEQ ID NO: 34048 - DNA, 35 bp, Artificial Sequence
  Synthetic oligonucleotide
tcaacaacagtcatgataaatggtacctctgctgt

SEQ ID NO: 34049 - DNA, 35 bp, Artificial Sequence
  Synthetic oligonucleotide
agtagaagccaacgggaaagggtagagggtgggaa

SEQ ID NO: 34050 - DNA, 35 bp, Artificial Sequence
  Synthetic oligonucleotide
atcaacccacttcccgacccagacggctttaacca

SEQ ID NO: 34051 - DNA, 35 bp, Artificial Sequence
  Synthetic oligonucleotide
ttcccctcctcgacgcctagctgagtctcaaccca

SEQ ID NO: 34052 - DNA, 35 bp, Artificial Sequence
  Synthetic oligonucleotide
gccaagaccctgccttgccccttgccagtgagcca

SEQ ID NO: 34053 - DNA, 36 bp, Artificial Sequence
  Synthetic oligonucleotide
tgccatcctccaccttcccaactagtagaactgtca

SEQ ID NO: 34054 - DNA, 36 bp, Artificial Sequence
  Synthetic oligonucleotide
tagcacgactccgccctcttgcaagtctttacacga

SEQ ID NO: 34055 - DNA, 36 bp, Artificial Sequence
  Synthetic oligonucleotide
atccgagtggcgccccgtagcttatgtttctaccga

SEQ ID NO: 34056 - DNA, 37 bp, Artificial Sequence
  Synthetic oligonucleotide
tttgccgacccgactacgcctggctatctccccccga

SEQ ID NO: 34057 - DNA, 37 bp, Artificial Sequence
  Synthetic oligonucleotide
acctgccatgtacgggttacgtcctatttccttccga

SEQ ID NO: 34058 - DNA, 37 bp, Artificial Sequence
  Synthetic oligonucleotide
gttgcacacatgatacccggggttgggttgggcggga

SEQ ID NO: 34059 - DNA, 38 bp, Artificial Sequence
  Synthetic oligonucleotide
gcacactctcctgctcgtgtcacagacgttcactgtga

SEQ ID NO: 34060 - DNA, 38 bp, Artificial Sequence
  Synthetic oligonucleotide
gtgtctgctcaggatgtccaattctcgtgctctgttga

SEQ ID NO: 34061 - DNA, 38 bp, Artificial Sequence
  Synthetic oligonucleotide
ggactgactccatacttccggcgtggaccgccttttga

SEQ ID NO: 34062 - DNA, 35 bp, Artificial Sequence
  Synthetic oligonucleotide
ttcatccacagtttccgcctaagtgctcctcggtc

SEQ ID NO: 34063 - DNA, 35 bp, Artificial Sequence
  Synthetic oligonucleotide
tgtgaaccagcctccgttccccgcttgcattgtag

SEQ ID NO: 34064 - DNA, 35 bp, Artificial Sequence
  Synthetic oligonucleotide
tacccctacagcccgcaccccaccgctattatgcg

SEQ ID NO: 34065 - DNA, 35 bp, Artificial Sequence
  Synthetic oligonucleotide
gttgcctctccgcctgggcctaaagccactcgctg

SEQ ID NO: 34066 - DNA, 36 bp, Artificial Sequence
  Synthetic oligonucleotide
tgccacaccgttccgttcatataacgcacaacttca

SEQ ID NO: 34067 - DNA, 37 bp, Artificial Sequence
  Synthetic oligonucleotide
tccccaaaactgaacaacaatgccaggcgcataacga

SEQ ID NO: 34068 - DNA, 37 bp, Artificial Sequence
  Synthetic oligonucleotide
aaagaagcaagtgaaggggagaacgacaagtagacga

SEQ ID NO: 34069 - DNA, 37 bp, Artificial Sequence
  Synthetic oligonucleotide
acccacatctgctttcaaggcccaaccacatctccga

SEQ ID NO: 34070 - DNA, 37 bp, Artificial Sequence
  Synthetic oligonucleotide
tacaccgcccaatgcttgcaacccccattgacttcga

SEQ ID NO: 34071 - DNA, 36 bp, Artificial Sequence
  Synthetic oligonucleotide
gccgactacgaacatcccctgccaactttcccagga

SEQ ID NO: 34072 - DNA, 36 bp, Artificial Sequence
  Synthetic oligonucleotide
accgcactctcaatcgtttcatcctacccggacgga

SEQ ID NO: 34073 - DNA, 38 bp, Artificial Sequence
  Synthetic oligonucleotide
atccgcccagccgcattcccagctacaacggctcctga

SEQ ID NO: 34074 - DNA, 38 bp, Artificial Sequence
  Synthetic oligonucleotide
atcccaccacctctgcctgtgaaggtttgtactgctga

SEQ ID NO: 34075 - DNA, 36 bp, Artificial Sequence
  Synthetic oligonucleotide
gtccctccagttgcataccttctctcattaaagtga

SEQ ID NO: 34076 - DNA, 35 bp, Artificial Sequence
  Synthetic oligonucleotide
gttgatcctgagctgtccgtatttatgtctgcaac

SEQ ID NO: 34077 - DNA, 35 bp, Artificial Sequence
  Synthetic oligonucleotide
tgacatccccctcctcgacaattcgggtataccac

SEQ ID NO: 34078 - DNA, 35 bp, Artificial Sequence
  Synthetic oligonucleotide
gacatccctagccctgtaaagtacgtgcccggtac

SEQ ID NO: 34079 - DNA, 35 bp, Artificial Sequence
  Synthetic oligonucleotide
gcggttccgccacccacgttatgtcgcgtcgaccc

SEQ ID NO: 34080 - DNA, 35 bp, Artificial Sequence
  Synthetic oligonucleotide
gtctgttggggttatggggatgggagggggcatgc

SEQ ID NO: 34081 - DNA, 35 bp, Artificial Sequence
  Synthetic oligonucleotide
atgttgtccctcttgtcgccgggcacgggccattc

SEQ ID NO: 34082 - DNA, 35 bp, Artificial Sequence
  Synthetic oligonucleotide
gaaacaacgtggctacctctgttcttgtttgattc

SEQ ID NO: 34083 - DNA, 35 bp, Artificial Sequence
  Synthetic oligonucleotide
gctaaaccacgcaccgccaacccgagccctccgcg

SEQ ID NO: 34084 - DNA, 35 bp, Artificial Sequence
  Synthetic oligonucleotide
acattgaccatcccgtctgtcgcatcatcctatcg

SEQ ID NO: 34085 - DNA, 35 bp, Artificial Sequence
  Synthetic oligonucleotide
tgtggacttgaccatcctgcctcattttttccagg

SEQ ID NO: 34086 - DNA, 35 bp, Artificial Sequence
  Synthetic oligonucleotide
ggtgcacaacacactgcgcgctattggtacctttg

SEQ ID NO: 34087 - DNA, 35 bp, Artificial Sequence
  Synthetic oligonucleotide
gtacttcccgacatccgactggccaatacaccaat

SEQ ID NO: 34088 - DNA, 35 bp, Artificial Sequence
  Synthetic oligonucleotide
agcaatgatcgcctgcttcgactaccacttcgctt

SEQ ID NO: 34089 - DNA, 36 bp, Artificial Sequence
  Synthetic oligonucleotide
gacaccaattcgtaccgcccagacttagccatgtaa

SEQ ID NO: 34090 - DNA, 35 bp, Artificial Sequence
  Synthetic oligonucleotide
acagtagccccacgcgcgacgggcccttccacaca

SEQ ID NO: 34091 - DNA, 36 bp, Artificial Sequence
  Synthetic oligonucleotide
tagacccccaaccgcggcactgactaccaggggtca

SEQ ID NO: 34092 - DNA, 37 bp, Artificial Sequence
  Synthetic oligonucleotide
gggacgcaaggcaaacggataggggaattggaataga

SEQ ID NO: 34093 - DNA, 37 bp, Artificial Sequence
  Synthetic oligonucleotide
gccacatcccagtgctgaacatacctcagctcgtaga

SEQ ID NO: 34094 - DNA, 36 bp, Artificial Sequence
  Synthetic oligonucleotide
tccatccctcgcacctggatcaccgcatactttaga

SEQ ID NO: 34095 - DNA, 37 bp, Artificial Sequence
  Synthetic oligonucleotide
tagggtctccgccaccatgccttgtttgaaatcccga

SEQ ID NO: 34096 - DNA, 37 bp, Artificial Sequence
  Synthetic oligonucleotide
tccgggctctcccgcatactttctctgttctcgccga

SEQ ID NO: 34097 - DNA, 37 bp, Artificial Sequence
  Synthetic oligonucleotide
aaacctgcagagtgggttgacgggtgggcaaacggga

SEQ ID NO: 34098 - DNA, 37 bp, Artificial Sequence
  Synthetic oligonucleotide
accaccaccacggtcaaccacagtcactcgttcatga

SEQ ID NO: 34099 - DNA, 37 bp, Artificial Sequence
  Synthetic oligonucleotide
acatcgaccacccgccgcacagcatagtaatttatga

SEQ ID NO: 34100 - DNA, 35 bp, Artificial Sequence
  Synthetic oligonucleotide
aacccacactgctagtctttcagtccatccactga

SEQ ID NO: 34101 - DNA, 38 bp, Artificial Sequence
  Synthetic oligonucleotide
ttgggtgcgccaccgaatactgcgctgagccctactga

SEQ ID NO: 34102 - DNA, 37 bp, Artificial Sequence
  Synthetic oligonucleotide
tacagccgcccctgtatgcccgtgatcctggtcctga

SEQ ID NO: 34103 - DNA, 38 bp, Artificial Sequence
  Synthetic oligonucleotide
tgtggggggagtaggggaagggagatgtgcaaaagtga

SEQ ID NO: 34104 - DNA, 38 bp, Artificial Sequence
  Synthetic oligonucleotide
gcggagcacccgttgcctaaatacctcccctgtggtga

SEQ ID NO: 34105 - DNA, 38 bp, Artificial Sequence
  Synthetic oligonucleotide
acccagaccacaccctgagttaccctgtccattggtga

SEQ ID NO: 34106 - DNA, 36 bp, Artificial Sequence
  Synthetic oligonucleotide
ggaacccgccggctacaccatcatccccatctgtga

SEQ ID NO: 34107 - DNA, 38 bp, Artificial Sequence
  Synthetic oligonucleotide
aacgtcaccaagccaccgaatcatattgaccaccttga

SEQ ID NO: 34108 - DNA, 38 bp, Artificial Sequence
  Synthetic oligonucleotide
gtggcctcatccctgaggttgttttgttctgcccttga

SEQ ID NO: 34109 - DNA, 37 bp, Artificial Sequence
  Synthetic oligonucleotide
gtacagggcctactgcatctccgaaatcaccttttga

SEQ ID NO: 34110 - DNA, 36 bp, Artificial Sequence
  Synthetic oligonucleotide
aacggtcacactgcactctcccgtacatatcgtata

SEQ ID NO: 34111 - DNA, 36 bp, Artificial Sequence
  Synthetic oligonucleotide
tgatgcgtgtgtggtctcctgggcccttctttctta

SEQ ID NO: 34112 - DNA, 35 bp, Artificial Sequence
  Synthetic oligonucleotide
tgagcctcccatctgggcgtttaacacctgctcac

SEQ ID NO: 34113 - DNA, 35 bp, Artificial Sequence
  Synthetic oligonucleotide
gtccaggtcctataggtcaccttgtccacacttac

SEQ ID NO: 34114 - DNA, 35 bp, Artificial Sequence
  Synthetic oligonucleotide
gccggatcacccagcccatcaccgcgctgattccc

SEQ ID NO: 34115 - DNA, 35 bp, Artificial Sequence
  Synthetic oligonucleotide
ttgaccggccccccatgttactggcaaagaattcc

SEQ ID NO: 34116 - DNA, 35 bp, Artificial Sequence
  Synthetic oligonucleotide
aatcgcataaggctattcagacccacccgtccatc

SEQ ID NO: 34117 - DNA, 35 bp, Artificial Sequence
  Synthetic oligonucleotide
acccccgccgacaacgggtgttttcccatacattg

SEQ ID NO: 34118 - DNA, 35 bp, Artificial Sequence
  Synthetic oligonucleotide
tccgtccaccccctctattctgggcacacaaatct

SEQ ID NO: 34119 - DNA, 35 bp, Artificial Sequence
  Synthetic oligonucleotide
gccccgccctcgccttgtctataacacgccgccgt

SEQ ID NO: 34120 - DNA, 35 bp, Artificial Sequence
  Synthetic oligonucleotide
gtcccatcacaacagatctgttgacgtgtaattgt

SEQ ID NO: 34121 - DNA, 35 bp, Artificial Sequence
  Synthetic oligonucleotide
tccggagcgcaacatgcggtctactccactccctt

SEQ ID NO: 34122 - DNA, 36 bp, Artificial Sequence
  Synthetic oligonucleotide
agggaggaatgggtggagaaggcgtgggaggtcaaa

SEQ ID NO: 34123 - DNA, 36 bp, Artificial Sequence
  Synthetic oligonucleotide
tgatccttactccgaccgtgcgctgtaccgttccaa

SEQ ID NO: 34124 - DNA, 35 bp, Artificial Sequence
  Synthetic oligonucleotide
tgccgactcacgcttcctttaaatcgccgttgcaa

SEQ ID NO: 34125 - DNA, 36 bp, Artificial Sequence
  Synthetic oligonucleotide
tgcataccgcaatctttctgaccttgacgtcttcca

SEQ ID NO: 34126 - DNA, 36 bp, Artificial Sequence
  Synthetic oligonucleotide
atgacccctctgcccgcctatagggacgttgtatca

SEQ ID NO: 34127 - DNA, 35 bp, Artificial Sequence
  Synthetic oligonucleotide
tatcaccgaccgccttcacctagattaaaccttca

SEQ ID NO: 34128 - DNA, 37 bp, Artificial Sequence
  Synthetic oligonucleotide
gaggggagccagtgcgtagctgagtgttgggggagga

SEQ ID NO: 34129 - DNA, 36 bp, Artificial Sequence
  Synthetic oligonucleotide
gatccacccgctcacttgttatcgcgcgtacttgga

SEQ ID NO: 34130 - DNA, 38 bp, Artificial Sequence
  Synthetic oligonucleotide
gttgctccctctgccacgctcgtcacccactgggatga

SEQ ID NO: 34131 - DNA, 38 bp, Artificial Sequence
  Synthetic oligonucleotide
atcggtacagcgcaagctgccgtgccccgaccccttga

SEQ ID NO: 34132 - DNA, 38 bp, Artificial Sequence
  Synthetic oligonucleotide
atgacaccgctgggtctgcgttacgtaaccccttttga

SEQ ID NO: 34133 - DNA, 35 bp, Artificial Sequence
  Synthetic oligonucleotide
ggtgcaactgcccttcccgaatccttagtgcaata

SEQ ID NO: 34134 - DNA, 35 bp, Artificial Sequence
  Synthetic oligonucleotide
gttaccgcacaccctcgttcgtaagcctatagcta

SEQ ID NO: 34135 - DNA, 35 bp, Artificial Sequence
  Synthetic oligonucleotide
tgtgcggccatttagtcgctattgcctgcccctcc

SEQ ID NO: 34136 - DNA, 35 bp, Artificial Sequence
  Synthetic oligonucleotide
gttgcgcccgctgtggttattggttccatcgctcc

SEQ ID NO: 34137 - DNA, 36 bp, Artificial Sequence
  Synthetic oligonucleotide
accgccgcagttcgttctgggtccgtcccttcctgc

SEQ ID NO: 34138 - DNA, 35 bp, Artificial Sequence
  Synthetic oligonucleotide
agcggggggggtgtatggtgtcgatgtaggagcag

SEQ ID NO: 34139 - DNA, 35 bp, Artificial Sequence
  Synthetic oligonucleotide
attgccccttcgcaagtaacctattgcccgttccg

SEQ ID NO: 34140 - DNA, 35 bp, Artificial Sequence
  Synthetic oligonucleotide
tccgaccccgcttctgtaaaatctctcaacgatcg

SEQ ID NO: 34141 - DNA, 35 bp, Artificial Sequence
  Synthetic oligonucleotide
agcaggacgaagtcagtaagggaggaatggggcgt

SEQ ID NO: 34142 - DNA, 35 bp, Artificial Sequence
  Synthetic oligonucleotide
ttcatgtcgcacatgtttcacgaacaacttttttt

SEQ ID NO: 34143 - DNA, 35 bp, Artificial Sequence
  Synthetic oligonucleotide
gtaccatccttcctgccatcaacgcgtacttggaa

SEQ ID NO: 34144 - DNA, 36 bp, Artificial Sequence
  Synthetic oligonucleotide
gggtcaccaacaggctggaaatgaccgcactcacca

SEQ ID NO: 34145 - DNA, 35 bp, Artificial Sequence
  Synthetic oligonucleotide
atgggaagggggggcgtaatggggttcgcggacca

SEQ ID NO: 34146 - DNA, 36 bp, Artificial Sequence
  Synthetic oligonucleotide
gcccactgccccgcgctgggttgattcctagcccca

SEQ ID NO: 34147 - DNA, 36 bp, Artificial Sequence
  Synthetic oligonucleotide
gagtgacaggtaggagcgggtcaatgggagggtgca

SEQ ID NO: 34148 - DNA, 36 bp, Artificial Sequence
  Synthetic oligonucleotide
gtctcactccaccgtgccttttcacacagataaaga

SEQ ID NO: 34149 - DNA, 37 bp, Artificial Sequence
  Synthetic oligonucleotide
tccacgcacccccggttaaatagtgtgtccattccga

SEQ ID NO: 34150 - DNA, 37 bp, Artificial Sequence
  Synthetic oligonucleotide
aacgtgggagcatactgagggaggggggaaggctcga

SEQ ID NO: 34151 - DNA, 35 bp, Artificial Sequence
  Synthetic oligonucleotide
tatccccccccatcacgtacccagcactctgtgga

SEQ ID NO: 34152 - DNA, 37 bp, Artificial Sequence
  Synthetic oligonucleotide
ttgtcgggggacacagcggggaaaggagggggtatga

SEQ ID NO: 34153 - DNA, 38 bp, Artificial Sequence
  Synthetic oligonucleotide
tagaggggtggggggcataatcgggagagggtcgttga

SEQ ID NO: 34154 - DNA, 35 bp, Artificial Sequence
  Synthetic oligonucleotide
atgtcactgtcctggctaatgcacgctgtacttac

SEQ ID NO: 34155 - DNA, 35 bp, Artificial Sequence
  Synthetic oligonucleotide
gacccaaacgctgatattatgcgtcgtactctgcc

SEQ ID NO: 34156 - DNA, 35 bp, Artificial Sequence
  Synthetic oligonucleotide
atcatcgcccgtctggatacgaccatccgccgctc

SEQ ID NO: 34157 - DNA, 35 bp, Artificial Sequence
  Synthetic oligonucleotide
tactttcaccatccggcccgactagtccgctattc

SEQ ID NO: 34158 - DNA, 35 bp, Artificial Sequence
  Synthetic oligonucleotide
attgaacgccggatcgcttcgttattcccacttcg

SEQ ID NO: 34159 - DNA, 35 bp, Artificial Sequence
  Synthetic oligonucleotide
ttccccacccctcccctgaatagcttactctgctg

SEQ ID NO: 34160 - DNA, 35 bp, Artificial Sequence
  Synthetic oligonucleotide
gttcccctcccatgtttacagccactgtcctggat

SEQ ID NO: 34161 - DNA, 35 bp, Artificial Sequence
  Synthetic oligonucleotide
gacaacgaatgtctagcccccgctttgaactctct

SEQ ID NO: 34162 - DNA, 35 bp, Artificial Sequence
  Synthetic oligonucleotide
tacaccgctcgcttggtttatggtcacactgcctt

SEQ ID NO: 34163 - DNA, 35 bp, Artificial Sequence
  Synthetic oligonucleotide
gaagatccaccgttgctccagagtttagtcttctt

SEQ ID NO: 34164 - DNA, 35 bp, Artificial Sequence
  Synthetic oligonucleotide
gaatcacctacagacgctgtacggtcagtatagtt

SEQ ID NO: 34165 - DNA, 35 bp, Artificial Sequence
  Synthetic oligonucleotide
ggaacattatcctgcctgcaccttgccgagtgcaa

SEQ ID NO: 34166 - DNA, 37 bp, Artificial Sequence
  Synthetic oligonucleotide
attgaaaaaagggtagtgaaggaggaagggacggaga

SEQ ID NO: 34167 - DNA, 37 bp, Artificial Sequence
  Synthetic oligonucleotide
gaacccacatatgcatgcgccgggctccacaccccga

SEQ ID NO: 34168 - DNA, 36 bp, Artificial Sequence
  Synthetic oligonucleotide
aacaccgtaccgactgcaggtcatccgaacccccga

SEQ ID NO: 34169 - DNA, 37 bp, Artificial Sequence
  Synthetic oligonucleotide
tcctcgaccctattgcgctgtcgctactctctctcga

SEQ ID NO: 34170 - DNA, 37 bp, Artificial Sequence
  Synthetic oligonucleotide
tctacgccccaaatatgttagatccgctggtgccgga

SEQ ID NO: 34171 - DNA, 37 bp, Artificial Sequence
  Synthetic oligonucleotide
gccgacttctcccgcggagtgcatcttaacttttgga

SEQ ID NO: 34172 - DNA, 38 bp, Artificial Sequence
  Synthetic oligonucleotide
gcctgccatctttcgtgtcttcccaggttcaaatctga

SEQ ID NO: 34173 - DNA, 38 bp, Artificial Sequence
  Synthetic oligonucleotide
aagcgggaagacgcggggggtagaatgcatttgggtga

SEQ ID NO: 34174 - DNA, 37 bp, Artificial Sequence
  Synthetic oligonucleotide
tagcctgcgtagagcccgatcgccttccattccttga

SEQ ID NO: 34175 - DNA, 38 bp, Artificial Sequence
  Synthetic oligonucleotide
gtgtgccttaccattgttttacctgaacgacatgttga

SEQ ID NO: 34176 - DNA, 38 bp, Artificial Sequence
  Synthetic oligonucleotide
gccaacccgccgaacttgccattttacgacagatttga

SEQ ID NO: 34177 - DNA, 35 bp, Artificial Sequence
  Synthetic oligonucleotide
gccgaacttccgacgtaactctcagaatcactcta

SEQ ID NO: 34178 - DNA, 36 bp, Artificial Sequence
  Synthetic oligonucleotide
gccaacttgcatgtctcgcgtctcacctacccagta

SEQ ID NO: 34179 - DNA, 35 bp, Artificial Sequence
  Synthetic oligonucleotide
gtcacatatccggacccgtatcctccccgctgtta

SEQ ID NO: 34180 - DNA, 36 bp, Artificial Sequence
  Synthetic oligonucleotide
gcactggccagccagcacactaacgccgggctttta

SEQ ID NO: 34181 - DNA, 35 bp, Artificial Sequence
  Synthetic oligonucleotide
taccttagcccgccaccatataacgcgtgatcaac

SEQ ID NO: 34182 - DNA, 34 bp, Artificial Sequence
  Synthetic oligonucleotide
tcgccccctcgtattaataacatcgcacaactac

SEQ ID NO: 34183 - DNA, 37 bp, Artificial Sequence
  Synthetic oligonucleotide
ggagacaccattgaacctcgactgactaggtttttac

SEQ ID NO: 34184 - DNA, 35 bp, Artificial Sequence
  Synthetic oligonucleotide
tcccgcattacgctcctcttgcgatgattcgatcc

SEQ ID NO: 34185 - DNA, 35 bp, Artificial Sequence
  Synthetic oligonucleotide
ttgtggcctaaactcgtgaaacgcgcccatgctcc

SEQ ID NO: 34186 - DNA, 35 bp, Artificial Sequence
  Synthetic oligonucleotide
gctgcaacttgtcacggtctaattcggccccttcc

SEQ ID NO: 34187 - DNA, 35 bp, Artificial Sequence
  Synthetic oligonucleotide
tgagtgctgggccccacatctccttctcatcaccg

SEQ ID NO: 34188 - DNA, 35 bp, Artificial Sequence
  Synthetic oligonucleotide
aatggagcacgtggaggaggaacgattggagcgcg

SEQ ID NO: 34189 - DNA, 35 bp, Artificial Sequence
  Synthetic oligonucleotide
gacgttagccgacctttgccccctcacctttgcgg

SEQ ID NO: 34190 - DNA, 35 bp, Artificial Sequence
  Synthetic oligonucleotide
tctttccgccccactcttggctaaccttcgccctg

SEQ ID NO: 34191 - DNA, 35 bp, Artificial Sequence
  Synthetic oligonucleotide
gcaccttgtcttccgtgctcttcatcctcgttctg

SEQ ID NO: 34192 - DNA, 35 bp, Artificial Sequence
  Synthetic oligonucleotide
attgacgacacccctgcactactcatcgcgattat

SEQ ID NO: 34193 - DNA, 35 bp, Artificial Sequence
  Synthetic oligonucleotide
aaacaccagctgaggacgtacctatctacctgtct

SEQ ID NO: 34194 - DNA, 35 bp, Artificial Sequence
  Synthetic oligonucleotide
gtttaccaccgtaccaggctttatcccactcaatt

SEQ ID NO: 34195 - DNA, 35 bp, Artificial Sequence
  Synthetic oligonucleotide
acgtggtcactgtaacaccggtcaactttcccaaa

SEQ ID NO: 34196 - DNA, 35 bp, Artificial Sequence
  Synthetic oligonucleotide
atttgcccaccctgactgcgacacatcccgtgaca

SEQ ID NO: 34197 - DNA, 36 bp, Artificial Sequence
  Synthetic oligonucleotide
tgtgcccctctggctgaccatccaatgttttcccca

SEQ ID NO: 34198 - DNA, 36 bp, Artificial Sequence
  Synthetic oligonucleotide
ttcaccggcacacttccggtttctaaatcaattcca

SEQ ID NO: 34199 - DNA, 35 bp, Artificial Sequence
  Synthetic oligonucleotide
tacacggtcgcccacacacggctgtgcccgttcca

SEQ ID NO: 34200 - DNA, 36 bp, Artificial Sequence
  Synthetic oligonucleotide
aatcccgccacttcccctctcagtcctgcaatcgca

SEQ ID NO: 34201 - DNA, 37 bp, Artificial Sequence
  Synthetic oligonucleotide
ttcaccttgtccatccctgcgtaactgccttgaaaga

SEQ ID NO: 34202 - DNA, 37 bp, Artificial Sequence
  Synthetic oligonucleotide
tgccatcctttcccgccacggacctctcgatagaaga

SEQ ID NO: 34203 - DNA, 37 bp, Artificial Sequence
  Synthetic oligonucleotide
ggtacgtatgcagttacccgattcccacctcccgaga

SEQ ID NO: 34204 - DNA, 37 bp, Artificial Sequence
  Synthetic oligonucleotide
actcccacccgactacacgaggttcacgttgacagga

SEQ ID NO: 34205 - DNA, 37 bp, Artificial Sequence
  Synthetic oligonucleotide
tccaccgcactatcatgcctatgcagatgactcatga

SEQ ID NO: 34206 - DNA, 38 bp, Artificial Sequence
  Synthetic oligonucleotide
gttcgcccacattcgctaccacacctaccgtctcctga

SEQ ID NO: 34207 - DNA, 38 bp, Artificial Sequence
  Synthetic oligonucleotide
gcacgcgatgcatggtggtgagggggaaggagtgttga

SEQ ID NO: 34208 - DNA, 38 bp, Artificial Sequence
  Synthetic oligonucleotide
tccgtctccacgccctgagttgatagaactctatttga

SEQ ID NO: 34209 - DNA, 36 bp, Artificial Sequence
  Synthetic oligonucleotide
atctacgccgaatctttgaacccccgcccagtgcta

SEQ ID NO: 34210 - DNA, 36 bp, Artificial Sequence
  Synthetic oligonucleotide
gagagggggtgggtgggtctcgagatggaaagggta

SEQ ID NO: 34211 - DNA, 36 bp, Artificial Sequence
  Synthetic oligonucleotide
gatcattgcgtcgacttacgtctctgtcctattgta

SEQ ID NO: 34212 - DNA, 36 bp, Artificial Sequence
  Synthetic oligonucleotide
gcgcccgcccagctactcctacttgctcgtatgtta

SEQ ID NO: 34213 - DNA, 35 bp, Artificial Sequence
  Synthetic oligonucleotide
acccaggatcgacgtaggcgcgcttatctcccaac

SEQ ID NO: 34214 - DNA, 35 bp, Artificial Sequence
  Synthetic oligonucleotide
gtcatccagccttactacgcatttaagccttggac

SEQ ID NO: 34215 - DNA, 35 bp, Artificial Sequence
  Synthetic oligonucleotide
gacactcttccgtacacctgggctccccaccgtac

SEQ ID NO: 34216 - DNA, 35 bp, Artificial Sequence
  Synthetic oligonucleotide
tattcccctctcaccctgtgtgattctaacgcacc

SEQ ID NO: 34217 - DNA, 35 bp, Artificial Sequence
  Synthetic oligonucleotide
accccttgcacctcttcagtttgcgtccccctccc

SEQ ID NO: 34218 - DNA, 35 bp, Artificial Sequence
  Synthetic oligonucleotide
ggagcccagcgatcctcacaccacaatgtcgaatc

SEQ ID NO: 34219 - DNA, 35 bp, Artificial Sequence
  Synthetic oligonucleotide
tacgtcggtcctttagttgtaataacaccattctc

SEQ ID NO: 34220 - DNA, 35 bp, Artificial Sequence
  Synthetic oligonucleotide
gacccaacgtgtacgctggggttatcgtatccttc

SEQ ID NO: 34221 - DNA, 35 bp, Artificial Sequence
  Synthetic oligonucleotide
gaggtacgttgctctggaaaaggggtcgggagggg

SEQ ID NO: 34222 - DNA, 35 bp, Artificial Sequence
  Synthetic oligonucleotide
tcccgagcaacggcacgccattcttcttatcgctg

SEQ ID NO: 34223 - DNA, 35 bp, Artificial Sequence
  Synthetic oligonucleotide
acagactcatctccccagcattgtttatcgcgtat

SEQ ID NO: 34224 - DNA, 36 bp, Artificial Sequence
  Synthetic oligonucleotide
aacacactcctgaatgatgactatgcgccccacaaa

SEQ ID NO: 34225 - DNA, 36 bp, Artificial Sequence
  Synthetic oligonucleotide
gagctggctcgccttacatatcgccatttgggccca

SEQ ID NO: 34226 - DNA, 36 bp, Artificial Sequence
  Synthetic oligonucleotide
tcccgatccagggggccttcaaccgtagccaaatca

SEQ ID NO: 34227 - DNA, 37 bp, Artificial Sequence
  Synthetic oligonucleotide
tcgagtgaggggggaggcagaacggggcatgaggaga

SEQ ID NO: 34228 - DNA, 37 bp, Artificial Sequence
  Synthetic oligonucleotide
tacgaccggttccagcagcttgactcgccatccccga

SEQ ID NO: 34229 - DNA, 37 bp, Artificial Sequence
  Synthetic oligonucleotide
gtcaccgttgttcctgcctttcagccctgcgatgcga

SEQ ID NO: 34230 - DNA, 37 bp, Artificial Sequence
  Synthetic oligonucleotide
tgtagacgcggacactagagggatggggaacgcggga

SEQ ID NO: 34231 - DNA, 36 bp, Artificial Sequence
  Synthetic oligonucleotide
attacaccaccgctgcagtctttcccctttttccta

SEQ ID NO: 34232 - DNA, 35 bp, Artificial Sequence
  Synthetic oligonucleotide
acacactgtttcgactcccatcattggtacactac

SEQ ID NO: 34233 - DNA, 35 bp, Artificial Sequence
  Synthetic oligonucleotide
gatgcccggtcttccgatagtttgccctgcatgcc

SEQ ID NO: 34234 - DNA, 35 bp, Artificial Sequence
  Synthetic oligonucleotide
gccacagtcgtagagccacgacacgtcctaatact

SEQ ID NO: 34235 - DNA, 35 bp, Artificial Sequence
  Synthetic oligonucleotide
gaatgcacctccgctttccagtagttcatgaacgt

SEQ ID NO: 34236 - DNA, 36 bp, Artificial Sequence
  Synthetic oligonucleotide
atggacagctaccacattgtcgtccactcttaacaa

SEQ ID NO: 34237 - DNA, 35 bp, Artificial Sequence
  Synthetic oligonucleotide
tctggggccggccatgggggatctctggtggggaa

SEQ ID NO: 34238 - DNA, 36 bp, Artificial Sequence
  Synthetic oligonucleotide
tccagcatcctcatgcacaccttactactcccgcca

SEQ ID NO: 34239 - DNA, 36 bp, Artificial Sequence
  Synthetic oligonucleotide
acgccccgcgcctctaacaccatgggtctacttcca

SEQ ID NO: 34240 - DNA, 35 bp, Artificial Sequence
  Synthetic oligonucleotide
tagatcatccccccgccgttagaaccgacatagca

SEQ ID NO: 34241 - DNA, 37 bp, Artificial Sequence
  Synthetic oligonucleotide
atcgataacaagggggcggaggggaaaggggttacga

SEQ ID NO: 34242 - DNA, 36 bp, Artificial Sequence
  Synthetic oligonucleotide
tctgatgcaccgcgctaactatctcccgaggcccga

SEQ ID NO: 34243 - DNA, 36 bp, Artificial Sequence
  Synthetic oligonucleotide
gttacgatagggtaggaaggcaagggaaataatcga

SEQ ID NO: 34244 - DNA, 37 bp, Artificial Sequence
  Synthetic oligonucleotide
acaacatccccgtctcgcagaaatccccgccgaggga

SEQ ID NO: 34245 - DNA, 38 bp, Artificial Sequence
  Synthetic oligonucleotide
ttcgcgcatatacttatccgctactcaatccgccctga

SEQ ID NO: 34246 - DNA, 37 bp, Artificial Sequence
  Synthetic oligonucleotide
gttgcctgtccccacctatgattacgctgcaccgtga

SEQ ID NO: 34247 - DNA, 38 bp, Artificial Sequence
  Synthetic oligonucleotide
gcaaccccttccgcttaacagcacccgtctcccggtga

SEQ ID NO: 34248 - DNA, 38 bp, Artificial Sequence
  Synthetic oligonucleotide
ttgtccacgggggggaggagtaggggtgaaggttgtga

SEQ ID NO: 34249 - DNA, 35 bp, Artificial Sequence
  Synthetic oligonucleotide
aagcggacgaaacgcggttagggaagggaaggata

SEQ ID NO: 34250 - DNA, 35 bp, Artificial Sequence
  Synthetic oligonucleotide
ttggctgctgccgtacattgcccccgatttagtcc

SEQ ID NO: 34251 - DNA, 35 bp, Artificial Sequence
  Synthetic oligonucleotide
gacctcgtcaaccagtcctacctgatttcacttgc

SEQ ID NO: 34252 - DNA, 35 bp, Artificial Sequence
  Synthetic oligonucleotide
tctaaaggccccgggattcatgtcgctcaccttgc

SEQ ID NO: 34253 - DNA, 35 bp, Artificial Sequence
  Synthetic oligonucleotide
tcatgacaaacgtcgcacctttccaatcgttttgc

SEQ ID NO: 34254 - DNA, 35 bp, Artificial Sequence
  Synthetic oligonucleotide
gttgatacgcaacatcgggtcacaggtccaccctc

SEQ ID NO: 34255 - DNA, 35 bp, Artificial Sequence
  Synthetic oligonucleotide
atcactcgctcgacggtttcctttacaatctgccg

SEQ ID NO: 34256 - DNA, 35 bp, Artificial Sequence
  Synthetic oligonucleotide
tccgtggtccgcttccgactgtctccccatcatgg

SEQ ID NO: 34257 - DNA, 35 bp, Artificial Sequence
  Synthetic oligonucleotide
tcccgctcacattccttctttcaacgtcgcgccat

SEQ ID NO: 34258 - DNA, 35 bp, Artificial Sequence
  Synthetic oligonucleotide
ataccccatccgagattattgagcatctcattgtt

SEQ ID NO: 34259 - DNA, 35 bp, Artificial Sequence
  Synthetic oligonucleotide
tatttgtgcgctgtttcttggcccgttttttcttt

SEQ ID NO: 34260 - DNA, 35 bp, Artificial Sequence
  Synthetic oligonucleotide
accgcccccgcccccttctcaaacagccgctaaaa

SEQ ID NO: 34261 - DNA, 36 bp, Artificial Sequence
  Synthetic oligonucleotide
aagcgaaagctccggccccgtttctccatccccgca

SEQ ID NO: 34262 - DNA, 35 bp, Artificial Sequence
  Synthetic oligonucleotide
gtcaatctcatcacggaatatctgcacatacatca

SEQ ID NO: 34263 - DNA, 37 bp, Artificial Sequence
  Synthetic oligonucleotide
agcacgggaaggagctgactcatgacaaaggcgaaga

SEQ ID NO: 34264 - DNA, 37 bp, Artificial Sequence
  Synthetic oligonucleotide
gattgtcgccggtgctcatccacactgtcccagcaga

SEQ ID NO: 34265 - DNA, 38 bp, Artificial Sequence
  Synthetic oligonucleotide
accctgtcccagttccggtttgtgccccattgaactga

SEQ ID NO: 34266 - DNA, 38 bp, Artificial Sequence
  Synthetic oligonucleotide
acctgacgccggtgatcacctgttcggccccaccctga

SEQ ID NO: 34267 - DNA, 38 bp, Artificial Sequence
  Synthetic oligonucleotide
ttacggactcgacgcgggtgggagggaggtgttcgtga

SEQ ID NO: 34268 - DNA, 38 bp, Artificial Sequence
  Synthetic oligonucleotide
tcacgttgagatgcaggtggaattagcatgggaggtga

SEQ ID NO: 34269 - DNA, 38 bp, Artificial Sequence
  Synthetic oligonucleotide
ttccggtggggaggagggggagcagtgcttaagggtga

SEQ ID NO: 34270 - DNA, 38 bp, Artificial Sequence
  Synthetic oligonucleotide
tccgccggacacctgttcacctttcatcccacgtgtga

SEQ ID NO: 34271 - DNA, 36 bp, Artificial Sequence
  Synthetic oligonucleotide
gctaaccgccctgccattgcgactccttaaagttga

SEQ ID NO: 34272 - DNA, 37 bp, Artificial Sequence
  Synthetic oligonucleotide
ggtactcgcctgccttcttcatgtcctttccagttga

SEQ ID NO: 34273 - DNA, 38 bp, Artificial Sequence
  Synthetic oligonucleotide
gcgactccatcactgtctgcgtgcaacaccaattttga

SEQ ID NO: 34274 - DNA, 38 bp, Artificial Sequence
  Synthetic oligonucleotide
tcgaatcacctccaagttctatagccgcctacttttga

SEQ ID NO: 34275 - DNA, 38 bp, Artificial Sequence
  Synthetic oligonucleotide
gcgaacgcacgagcacctcggtgaccgctcttttttga

SEQ ID NO: 34276 - DNA, 36 bp, Artificial Sequence
  Synthetic oligonucleotide
gccgcatttcctagtttttgtctgccgcctgtctta

SEQ ID NO: 34277 - DNA, 35 bp, Artificial Sequence
  Synthetic oligonucleotide
tacaacgctcgccgccatggaaccacacgctacac

SEQ ID NO: 34278 - DNA, 35 bp, Artificial Sequence
  Synthetic oligonucleotide
gaagcccaaactgactcgtcttattcaccagtacc

SEQ ID NO: 34279 - DNA, 35 bp, Artificial Sequence
  Synthetic oligonucleotide
agccacaacgtacgtgatgcgacgcaccagtcccc

SEQ ID NO: 34280 - DNA, 35 bp, Artificial Sequence
  Synthetic oligonucleotide
gtgcaggtcggtaactcgcccctactcccactgcc

SEQ ID NO: 34281 - DNA, 35 bp, Artificial Sequence
  Synthetic oligonucleotide
ttgacctgaactcggttgactgacgtagaccccgc

SEQ ID NO: 34282 - DNA, 35 bp, Artificial Sequence
  Synthetic oligonucleotide
gccacctgcacggacattaccaccgcaccttaatc

SEQ ID NO: 34283 - DNA, 35 bp, Artificial Sequence
  Synthetic oligonucleotide
actgtcaggccacccgcgcttttatcacggagatc

SEQ ID NO: 34284 - DNA, 35 bp, Artificial Sequence
  Synthetic oligonucleotide
gtgcacctcgtattcagttcacccgagttcgccct

SEQ ID NO: 34285 - DNA, 35 bp, Artificial Sequence
  Synthetic oligonucleotide
tagatccccccgcagggtaatattcactggtttgt

SEQ ID NO: 34286 - DNA, 35 bp, Artificial Sequence
  Synthetic oligonucleotide
tcctaccccagatccagttgcttcgcactcaattt

SEQ ID NO: 34287 - DNA, 35 bp, Artificial Sequence
  Synthetic oligonucleotide
tatggcgatcgcccaccgcccacaaatccacattt

SEQ ID NO: 34288 - DNA, 36 bp, Artificial Sequence
  Synthetic oligonucleotide
tactgacctgccctctcaaacgtgctcacggttgaa

SEQ ID NO: 34289 - DNA, 35 bp, Artificial Sequence
  Synthetic oligonucleotide
gcaatagggggttgtgagcgggaaggaggatgcca

SEQ ID NO: 34290 - DNA, 36 bp, Artificial Sequence
  Synthetic oligonucleotide
gttggggtgagaggaagacagagacatggactagca

SEQ ID NO: 34291 - DNA, 36 bp, Artificial Sequence
  Synthetic oligonucleotide
aggagcaccgatcacgctaacagccattccctcgca

SEQ ID NO: 34292 - DNA, 35 bp, Artificial Sequence
  Synthetic oligonucleotide
atgggcgaaaaagtggggagggatgacatcgggca

SEQ ID NO: 34293 - DNA, 37 bp, Artificial Sequence
  Synthetic oligonucleotide
gagcaccaactttcgctttaccaccgctgtataccga

SEQ ID NO: 34294 - DNA, 37 bp, Artificial Sequence
  Synthetic oligonucleotide
tgcaccaccaacgatcactcttccccagtaagctcga

SEQ ID NO: 34295 - DNA, 37 bp, Artificial Sequence
  Synthetic oligonucleotide
aaccacccgtagcccgctcttaggacctcgatgagga

SEQ ID NO: 34296 - DNA, 36 bp, Artificial Sequence
  Synthetic oligonucleotide
tgactccacgacacgcgcttatttccctctcatgga

SEQ ID NO: 34297 - DNA, 38 bp, Artificial Sequence
  Synthetic oligonucleotide
tgcatggcctcatggtctacttacgtcgctcctcatga

SEQ ID NO: 34298 - DNA, 37 bp, Artificial Sequence
  Synthetic oligonucleotide
tccacgcctccctcaagcgcacgtttaataccgctga

SEQ ID NO: 34299 - DNA, 37 bp, Artificial Sequence
  Synthetic oligonucleotide
tcagggaatggcgaggacgatagaggggcgagggtga

SEQ ID NO: 34300 - DNA, 37 bp, Artificial Sequence
  Synthetic oligonucleotide
gtcatgggtcacatatgccaatcccacgccaccttga

SEQ ID NO: 34301 - DNA, 38 bp, Artificial Sequence
  Synthetic oligonucleotide
ggacgcccaagccgcaaatgccttcgatccccttttga

SEQ ID NO: 34302 - DNA, 35 bp, Artificial Sequence
  Synthetic oligonucleotide
gtaccagtcagggagggggctacgggggagagaac

SEQ ID NO: 34303 - DNA, 35 bp, Artificial Sequence
  Synthetic oligonucleotide
gattggaagctacgcccatctttgcactgccacac

SEQ ID NO: 34304 - DNA, 35 bp, Artificial Sequence
  Synthetic oligonucleotide
gtgcggccttaacttgtttcctgcttccctctcac

SEQ ID NO: 34305 - DNA, 35 bp, Artificial Sequence
  Synthetic oligonucleotide
atcctatgctcaccatcgcaagaggacgctaaccc

SEQ ID NO: 34306 - DNA, 35 bp, Artificial Sequence
  Synthetic oligonucleotide
agaccagtcattcagcctacctcgctggtcctccc

SEQ ID NO: 34307 - DNA, 35 bp, Artificial Sequence
  Synthetic oligonucleotide
tcactgcagattaccctaaggtcctgcactttttc

SEQ ID NO: 34308 - DNA, 35 bp, Artificial Sequence
  Synthetic oligonucleotide
acgaacagagggcaggagctggggagaagggtcag

SEQ ID NO: 34309 - DNA, 35 bp, Artificial Sequence
  Synthetic oligonucleotide
agagaaaggcgcgaatagcggggggggcgagggag

SEQ ID NO: 34310 - DNA, 35 bp, Artificial Sequence
  Synthetic oligonucleotide
gaacaaacgcagttattattgcccttctcttgaat

SEQ ID NO: 34311 - DNA, 35 bp, Artificial Sequence
  Synthetic oligonucleotide
ttacatgctggcccccgtgctgttgcaatcatact

SEQ ID NO: 34312 - DNA, 35 bp, Artificial Sequence
  Synthetic oligonucleotide
gtgtatccccctttgttgtcgttcagctagtgcct

SEQ ID NO: 34313 - DNA, 35 bp, Artificial Sequence
  Synthetic oligonucleotide
atctacgaccgagcgaggtagggccctcatccttt

SEQ ID NO: 34314 - DNA, 36 bp, Artificial Sequence
  Synthetic oligonucleotide
ggtaaccgacagcaccttttcttagcctgtacgcaa

SEQ ID NO: 34315 - DNA, 36 bp, Artificial Sequence
  Synthetic oligonucleotide
gagcaaaagtactaaacgggaagaaggcacaacgaa

SEQ ID NO: 34316 - DNA, 36 bp, Artificial Sequence
  Synthetic oligonucleotide
tcccgcatccccgacggtcccacatacaattgctaa

SEQ ID NO: 34317 - DNA, 35 bp, Artificial Sequence
  Synthetic oligonucleotide
accactgcccacgcccggtcgaagcccgctaccca

SEQ ID NO: 34318 - DNA, 36 bp, Artificial Sequence
  Synthetic oligonucleotide
tgcgccggttagcagccgtgcgctctttttgcccca

SEQ ID NO: 34319 - DNA, 36 bp, Artificial Sequence
  Synthetic oligonucleotide
acagtcatcaccttccccgttttgcgataaagccca

SEQ ID NO: 34320 - DNA, 35 bp, Artificial Sequence
  Synthetic oligonucleotide
ttttgcagcctctccgttcccctcgcggcccgcca

SEQ ID NO: 34321 - DNA, 36 bp, Artificial Sequence
  Synthetic oligonucleotide
cattccgatcacacgcacgtcacacgctaatcgcca

SEQ ID NO: 34322 - DNA, 35 bp, Artificial Sequence
  Synthetic oligonucleotide
tgccagtcccctttgtttgctgtttcgatttgcca

SEQ ID NO: 34323 - DNA, 36 bp, Artificial Sequence
  Synthetic oligonucleotide
gcacctgtacaacctgcgcgtccacacgtctttcca

SEQ ID NO: 34324 - DNA, 37 bp, Artificial Sequence
  Synthetic oligonucleotide
atccgcccccgcctcgcacacacgtttcaaagctaga

SEQ ID NO: 34325 - DNA, 37 bp, Artificial Sequence
  Synthetic oligonucleotide
tatggggccgagaagccgtagtaggggggcgggtaga

SEQ ID NO: 34326 - DNA, 36 bp, Artificial Sequence
  Synthetic oligonucleotide
ttgtacgccccacacgtggtgttagaaacctcacga

SEQ ID NO: 34327 - DNA, 37 bp, Artificial Sequence
  Synthetic oligonucleotide
ttgtgcacccacttttaagacacttttgctctcccga

SEQ ID NO: 34328 - DNA, 35 bp, Artificial Sequence
  Synthetic oligonucleotide
acgcccacatgaattataccgtgcccaacactcga

SEQ ID NO: 34329 - DNA, 36 bp, Artificial Sequence
  Synthetic oligonucleotide
actctctgcgccgccccatcaacgtcgactgaagga

SEQ ID NO: 34330 - DNA, 38 bp, Artificial Sequence
  Synthetic oligonucleotide
atgggggggcaaaccggctaggcgaatgggtgggatga

SEQ ID NO: 34331 - DNA, 38 bp, Artificial Sequence
  Synthetic oligonucleotide
gcttgggaggaggattggtgcgcgggcaggaacggtga

SEQ ID NO: 34332 - DNA, 38 bp, Artificial Sequence
  Synthetic oligonucleotide
tcatcctacgtcctggttttctgccattttgtccttga

SEQ ID NO: 34333 - DNA, 36 bp, Artificial Sequence
  Synthetic oligonucleotide
aattccgccaaccagtgagctctggcctccatagta

SEQ ID NO: 34334 - DNA, 36 bp, Artificial Sequence
  Synthetic oligonucleotide
tgacaagggacacaagggggaaacacaatagcttta

SEQ ID NO: 34335 - DNA, 35 bp, Artificial Sequence
  Synthetic oligonucleotide
tgccagggcttgttctgctcttaccgaagtaccac

SEQ ID NO: 34336 - DNA, 35 bp, Artificial Sequence
  Synthetic oligonucleotide
ttaacgccgtccgggccagccgcacacacatagcc

SEQ ID NO: 34337 - DNA, 35 bp, Artificial Sequence
  Synthetic oligonucleotide
gaccgcactccccgctgctcccagggcgcccgtcc

SEQ ID NO: 34338 - DNA, 35 bp, Artificial Sequence
  Synthetic oligonucleotide
gaccaatcacaggggtaaaacgcaatctggtcatc

SEQ ID NO: 34339 - DNA, 35 bp, Artificial Sequence
  Synthetic oligonucleotide
tacacatagcagacccccctgctgtcttcttagtc

SEQ ID NO: 34340 - DNA, 34 bp, Artificial Sequence
  Synthetic oligonucleotide
tgtcccccaccatgttaccgcctctcgcaccgag

SEQ ID NO: 34341 - DNA, 35 bp, Artificial Sequence
  Synthetic oligonucleotide
tgaccatccatcccgccccttacacgtgaactgcg

SEQ ID NO: 34342 - DNA, 35 bp, Artificial Sequence
  Synthetic oligonucleotide
tatcgaccatcatcgcaactcttgttatttaggat

SEQ ID NO: 34343 - DNA, 36 bp, Artificial Sequence
  Synthetic oligonucleotide
tcatctgacgctgtcttaccatccccctgcctgcaa

SEQ ID NO: 34344 - DNA, 35 bp, Artificial Sequence
  Synthetic oligonucleotide
agtgaggccaaaggagtgtgggaggcgggcaagaa

SEQ ID NO: 34345 - DNA, 36 bp, Artificial Sequence
  Synthetic oligonucleotide
atcgacttgactctgtatccctcacctgtgcgcgaa

SEQ ID NO: 34346 - DNA, 36 bp, Artificial Sequence
  Synthetic oligonucleotide
actaccggtcgtcactagtccgggtcacctttccca

SEQ ID NO: 34347 - DNA, 37 bp, Artificial Sequence
  Synthetic oligonucleotide
ttggatgggtgggcaaagtggtggtaacgcgggcaga

SEQ ID NO: 34348 - DNA, 36 bp, Artificial Sequence
  Synthetic oligonucleotide
tatgagcccaggttcggtagggggggtgggagagga

SEQ ID NO: 34349 - DNA, 37 bp, Artificial Sequence
  Synthetic oligonucleotide
attgccccggtccctggcttttattatatgtaactga

SEQ ID NO: 34350 - DNA, 36 bp, Artificial Sequence
  Synthetic oligonucleotide
gtattacagggaggatcgaaagcagggcggaaggta

SEQ ID NO: 34351 - DNA, 36 bp, Artificial Sequence
  Synthetic oligonucleotide
atccccgagtccggtcactgcctctctggtctttta

SEQ ID NO: 34352 - DNA, 35 bp, Artificial Sequence
  Synthetic oligonucleotide
gccatgcccacgcattttcaaccctattggggtac

SEQ ID NO: 34353 - DNA, 35 bp, Artificial Sequence
  Synthetic oligonucleotide
tgatgccctatcagccctctctcttcctttgtacc

SEQ ID NO: 34354 - DNA, 37 bp, Artificial Sequence
  Synthetic oligonucleotide
acataccgcacacactggatcgtcgccctgatatcgc

SEQ ID NO: 34355 - DNA, 35 bp, Artificial Sequence
  Synthetic oligonucleotide
gacgggacgtgtcgtttttctccatgaccctcatc

SEQ ID NO: 34356 - DNA, 35 bp, Artificial Sequence
  Synthetic oligonucleotide
atcgcactgcctactctgttccgagtattcgtatc

SEQ ID NO: 34357 - DNA, 35 bp, Artificial Sequence
  Synthetic oligonucleotide
tccactgcgtctctatcgaccgctccagtcccctc

SEQ ID NO: 34358 - DNA, 35 bp, Artificial Sequence
  Synthetic oligonucleotide
tcggtatagcctcgcccgaactgaccattatgctc

SEQ ID NO: 34359 - DNA, 35 bp, Artificial Sequence
  Synthetic oligonucleotide
tccacaaaacgttggctgttagtttcccctgcccg

SEQ ID NO: 34360 - DNA, 35 bp, Artificial Sequence
  Synthetic oligonucleotide
tcttgcaggaggaataggggaagaaggccgggact

SEQ ID NO: 34361 - DNA, 35 bp, Artificial Sequence
  Synthetic oligonucleotide
tctgttcatcctcaggtcattgaccgattcaccct

SEQ ID NO: 34362 - DNA, 35 bp, Artificial Sequence
  Synthetic oligonucleotide
tgttgactgcactcatacctatccacccgagccct

SEQ ID NO: 34363 - DNA, 35 bp, Artificial Sequence
  Synthetic oligonucleotide
tacgtatgggagtataggggggtggggaatacggt

SEQ ID NO: 34364 - DNA, 35 bp, Artificial Sequence
  Synthetic oligonucleotide
tcagaaaaactgccacaaaccgctacgacgtgcaa

SEQ ID NO: 34365 - DNA, 36 bp, Artificial Sequence
  Synthetic oligonucleotide
gagcaggggatccgggttgggggagagggattggaa

SEQ ID NO: 34366 - DNA, 36 bp, Artificial Sequence
  Synthetic oligonucleotide
agtacaggtcccctcctccgtatgcgcttctctgca

SEQ ID NO: 34367 - DNA, 36 bp, Artificial Sequence
  Synthetic oligonucleotide
tgcacacgccccctgtctccatccattcactgtgca

SEQ ID NO: 34368 - DNA, 37 bp, Artificial Sequence
  Synthetic oligonucleotide
tttgtacctgcctagcatctctcctactcgtcgtaga

SEQ ID NO: 34369 - DNA, 37 bp, Artificial Sequence
  Synthetic oligonucleotide
tatctgtgccacatacttacacgcggtcgatctacga

SEQ ID NO: 34370 - DNA, 37 bp, Artificial Sequence
  Synthetic oligonucleotide
tacccaacctgccccttctttgctgagcactgttcga

SEQ ID NO: 34371 - DNA, 37 bp, Artificial Sequence
  Synthetic oligonucleotide
gaagcaagggggaggtggggagcgcaaatcagacgga

SEQ ID NO: 34372 - DNA, 37 bp, Artificial Sequence
  Synthetic oligonucleotide
atacacggacgggaaagggaaccgaggccacctggga

SEQ ID NO: 34373 - DNA, 37 bp, Artificial Sequence
  Synthetic oligonucleotide
ggccacatccccccggccaccctcgaaccatcatgga

SEQ ID NO: 34374 - DNA, 38 bp, Artificial Sequence
  Synthetic oligonucleotide
ttagcacacgccgtcccgatccccctgccatagtatga

SEQ ID NO: 34375 - DNA, 37 bp, Artificial Sequence
  Synthetic oligonucleotide
tacacacactggtaccactgactttacttggttatga

SEQ ID NO: 34376 - DNA, 38 bp, Artificial Sequence
  Synthetic oligonucleotide
gaagcacccgatcttctccgcaccccgaccctggctga

SEQ ID NO: 34377 - DNA, 38 bp, Artificial Sequence
  Synthetic oligonucleotide
tcacaagtcggaggagccgcaagaaggagcacaggtga

SEQ ID NO: 34378 - DNA, 38 bp, Artificial Sequence
  Synthetic oligonucleotide
tccaggactatcgcggtgccaacactcttttttattga

SEQ ID NO: 34379 - DNA, 37 bp, Artificial Sequence
  Synthetic oligonucleotide
gcctacacctgaccatttactgcttaccttaggttga

SEQ ID NO: 34380 - DNA, 38 bp, Artificial Sequence
  Synthetic oligonucleotide
gatgcactcgatccgtacattttacacatcctttttga

SEQ ID NO: 34381 - DNA, 35 bp, Artificial Sequence
  Synthetic oligonucleotide
gcacgttccagtcgccttatcaacgtgtcctcata

SEQ ID NO: 34382 - DNA, 35 bp, Artificial Sequence
  Synthetic oligonucleotide
atgctcgaatcgcatgctacgccgctcttacgccc

SEQ ID NO: 34383 - DNA, 35 bp, Artificial Sequence
  Synthetic oligonucleotide
tttgcgcctgaacaagaacccgtcctccgagtagc

SEQ ID NO: 34384 - DNA, 35 bp, Artificial Sequence
  Synthetic oligonucleotide
gcacctatcgagtgcgactcgcttgtatctccttc

SEQ ID NO: 34385 - DNA, 35 bp, Artificial Sequence
  Synthetic oligonucleotide
gtgatagcacggctcctacaatcagtcttagcttc

SEQ ID NO: 34386 - DNA, 35 bp, Artificial Sequence
  Synthetic oligonucleotide
ttcgatgccgaaacgtcgctccttacaccgtaagg

SEQ ID NO: 34387 - DNA, 35 bp, Artificial Sequence
  Synthetic oligonucleotide
gagcggtgtggcacagaggggtggtaactaggggg

SEQ ID NO: 34388 - DNA, 35 bp, Artificial Sequence
  Synthetic oligonucleotide
gacaagtgggagggaagggggtgtcaagttctctg

SEQ ID NO: 34389 - DNA, 35 bp, Artificial Sequence
  Synthetic oligonucleotide
gaccggaccaatgctacactatgctaccatacaat

SEQ ID NO: 34390 - DNA, 35 bp, Artificial Sequence
  Synthetic oligonucleotide
tcgtacatctgccctcccctctatactaaggccat

SEQ ID NO: 34391 - DNA, 35 bp, Artificial Sequence
  Synthetic oligonucleotide
aatagcgcgtgggggtggtaggtggtggttgggat

SEQ ID NO: 34392 - DNA, 35 bp, Artificial Sequence
  Synthetic oligonucleotide
tcctcgccggcacccactcatcgctccatcggcct

SEQ ID NO: 34393 - DNA, 35 bp, Artificial Sequence
  Synthetic oligonucleotide
atccgatccgacccttgtcctatttgtctcccagt

SEQ ID NO: 34394 - DNA, 35 bp, Artificial Sequence
  Synthetic oligonucleotide
tccgtctgcccactgcccacgaccaaaaaccaggt

SEQ ID NO: 34395 - DNA, 36 bp, Artificial Sequence
  Synthetic oligonucleotide
tccgtgcaccacctattacttaacgcgaccttcgaa

SEQ ID NO: 34396 - DNA, 36 bp, Artificial Sequence
  Synthetic oligonucleotide
gccgtcccattgccataacacccaggggccaccaca

SEQ ID NO: 34397 - DNA, 35 bp, Artificial Sequence
  Synthetic oligonucleotide
tcaattgcgccgactactctttcagcatctcctca

SEQ ID NO: 34398 - DNA, 37 bp, Artificial Sequence
  Synthetic oligonucleotide
accacccgttgcaccgactgttctctttggccggaga

SEQ ID NO: 34399 - DNA, 37 bp, Artificial Sequence
  Synthetic oligonucleotide
taccacaagcagtggcgaaaatagcaaccaggggaga

SEQ ID NO: 34400 - DNA, 37 bp, Artificial Sequence
  Synthetic oligonucleotide
tcaggtggccccctcgcgtctcagtctcggctcccga

SEQ ID NO: 34401 - DNA, 37 bp, Artificial Sequence
  Synthetic oligonucleotide
tgatggtggataagttgggaaatgggaggaacaagga

SEQ ID NO: 34402 - DNA, 37 bp, Artificial Sequence
  Synthetic oligonucleotide
tagtcgcaagagacaattaaagaggagatgagacgga

SEQ ID NO: 34403 - DNA, 38 bp, Artificial Sequence
  Synthetic oligonucleotide
accgccagtcgtgttgccgcgcatcccatccccactga

SEQ ID NO: 34404 - DNA, 38 bp, Artificial Sequence
  Synthetic oligonucleotide
tgtcctccgtacctcatgtcttctcctcacgaaagtga

SEQ ID NO: 34405 - DNA, 36 bp, Artificial Sequence
  Synthetic oligonucleotide
agctcgcattccctgtcctcatcgcgcggtttcata

SEQ ID NO: 34406 - DNA, 36 bp, Artificial Sequence
  Synthetic oligonucleotide
gacgtactcccccgcctgttggttcgacccaccgta

SEQ ID NO: 34407 - DNA, 36 bp, Artificial Sequence
  Synthetic oligonucleotide
tgcgacttctcgccgtccaatgctaccccgctctta

SEQ ID NO: 34408 - DNA, 36 bp, Artificial Sequence
  Synthetic oligonucleotide
agccactcaacctccagccctaggtctcccttgtta

SEQ ID NO: 34409 - DNA, 29 bp, Artificial Sequence
  Synthetic oligonucleotide
gatagaccgcatcttagccccatctgcgc

SEQ ID NO: 34410 - DNA, 35 bp, Artificial Sequence
  Synthetic oligonucleotide
gcccatcgcccaccgtatcttctagaggttgttgc

SEQ ID NO: 34411 - DNA, 35 bp, Artificial Sequence
  Synthetic oligonucleotide
tccgcaccctgtttctggtggcttagctcccgccg

SEQ ID NO: 34412 - DNA, 35 bp, Artificial Sequence
  Synthetic oligonucleotide
tgcctgaatcctatcttttacagcggcatcctcct

SEQ ID NO: 34413 - DNA, 35 bp, Artificial Sequence
  Synthetic oligonucleotide
ttacccgcagacaacatgtatgtccattctacctt

SEQ ID NO: 34414 - DNA, 35 bp, Artificial Sequence
  Synthetic oligonucleotide
atacgtcctccatcgctttcccgcgtctcttcgtt

SEQ ID NO: 34415 - DNA, 36 bp, Artificial Sequence
  Synthetic oligonucleotide
ggacacccccagtcttacctagccgcctgacttaaa

SEQ ID NO: 34416 - DNA, 36 bp, Artificial Sequence
  Synthetic oligonucleotide
tgtcactaccgaaccatctaacgcgtcctgctggaa

SEQ ID NO: 34417 - DNA, 37 bp, Artificial Sequence
  Synthetic oligonucleotide
gatctccaccgaccatgctttgcaaaatgctccacga

SEQ ID NO: 34418 - DNA, 37 bp, Artificial Sequence
  Synthetic oligonucleotide
agaggagataatgggggtggaggggagtggtgaccga

SEQ ID NO: 34419 - DNA, 37 bp, Artificial Sequence
  Synthetic oligonucleotide
tgccgacccgacatgtctatcgcttcctgacttccga

SEQ ID NO: 34420 - DNA, 37 bp, Artificial Sequence
  Synthetic oligonucleotide
tcccttcgtactcacttcgcctactcgctgttagcga

SEQ ID NO: 34421 - DNA, 35 bp, Artificial Sequence
  Synthetic oligonucleotide
actccctacgttttgcgacctcgcccccttttgga

SEQ ID NO: 34422 - DNA, 38 bp, Artificial Sequence
  Synthetic oligonucleotide
tgccatccaagggcgcacttaccccagcctcctcatga

SEQ ID NO: 34423 - DNA, 38 bp, Artificial Sequence
  Synthetic oligonucleotide
agcatcccccgtgtttcgggccacccgccctttcatga

SEQ ID NO: 34424 - DNA, 37 bp, Artificial Sequence
  Synthetic oligonucleotide
actcggtaccagccgctgagcgaacccttcctgctga

SEQ ID NO: 34425 - DNA, 38 bp, Artificial Sequence
  Synthetic oligonucleotide
gcgctagccccactcgagatcttgcttacacccattga

SEQ ID NO: 34426 - DNA, 38 bp, Artificial Sequence
  Synthetic oligonucleotide
tcgtacatcccccagcttaaggcctcgcatctacttga

SEQ ID NO: 34427 - DNA, 37 bp, Artificial Sequence
  Synthetic oligonucleotide
gtcgcacccctacattggcacttttttctcccgttga

SEQ ID NO: 34428 - DNA, 38 bp, Artificial Sequence
  Synthetic oligonucleotide
gggacgggcagtagggggttgatcgggcatagggttga

SEQ ID NO: 34429 - DNA, 38 bp, Artificial Sequence
  Synthetic oligonucleotide
aactgtggccccccgctccgttccatgatgatctttga

SEQ ID NO: 34430 - DNA, 38 bp, Artificial Sequence
  Synthetic oligonucleotide
tacacccaccgtttgaaccacagcccctttagttttga

SEQ ID NO: 34431 - DNA, 36 bp, Artificial Sequence
  Synthetic oligonucleotide
gctacgccagtccacgttcaactcacactttgttta

SEQ ID NO: 34432 - DNA, 35 bp, Artificial Sequence
  Synthetic oligonucleotide
gccatggctgtgttatactgtctgcccactgtaac

SEQ ID NO: 34433 - DNA, 36 bp, Artificial Sequence
  Synthetic oligonucleotide
ttccacatccagcgactcatcttcgtacgggtaccc

SEQ ID NO: 34434 - DNA, 35 bp, Artificial Sequence
  Synthetic oligonucleotide
ttggtggcaccggttctcattggtctatgatctcc

SEQ ID NO: 34435 - DNA, 35 bp, Artificial Sequence
  Synthetic oligonucleotide
attaccgttcgatgccgtcgctcttgggcctttcc

SEQ ID NO: 34436 - DNA, 35 bp, Artificial Sequence
  Synthetic oligonucleotide
tccacgcctctgcaacatttcacggcattaatggc

SEQ ID NO: 34437 - DNA, 35 bp, Artificial Sequence
  Synthetic oligonucleotide
attcgccttaagggtgcgcccgtatttccactctc

SEQ ID NO: 34438 - DNA, 35 bp, Artificial Sequence
  Synthetic oligonucleotide
gagtgcagagtgggagggggttgttcacattgacg

SEQ ID NO: 34439 - DNA, 35 bp, Artificial Sequence
  Synthetic oligonucleotide
tgtgtgagacaaagagaagggtgagtgcagacgtg

SEQ ID NO: 34440 - DNA, 34 bp, Artificial Sequence
  Synthetic oligonucleotide
atgccctgcccctgccctccttgtttaccctgct

SEQ ID NO: 34441 - DNA, 35 bp, Artificial Sequence
  Synthetic oligonucleotide
gcgatatgcctgccaccaatagtttgtcacccctt

SEQ ID NO: 34442 - DNA, 35 bp, Artificial Sequence
  Synthetic oligonucleotide
accgatggggtgggggtggttcgggggatgatgtt

SEQ ID NO: 34443 - DNA, 35 bp, Artificial Sequence
  Synthetic oligonucleotide
gtaagcggatcctgcgcccactgccgattctgttt

SEQ ID NO: 34444 - DNA, 37 bp, Artificial Sequence
  Synthetic oligonucleotide
agacgcagagaaaggcaataggagaacgagaggtaga

SEQ ID NO: 34445 - DNA, 38 bp, Artificial Sequence
  Synthetic oligonucleotide
aagggcggggagtagggttgttgaggagggtaggatga

SEQ ID NO: 34446 - DNA, 37 bp, Artificial Sequence
  Synthetic oligonucleotide
tatcccccgcactccaaggacgaagtcacatcggtga

SEQ ID NO: 34447 - DNA, 37 bp, Artificial Sequence
  Synthetic oligonucleotide
atgacccgtcggttctttctgcccgcttccatggtga

SEQ ID NO: 34448 - DNA, 37 bp, Artificial Sequence
  Synthetic oligonucleotide
gaagtgggagaggcataaagataaaggtggcggttga

SEQ ID NO: 34449 - DNA, 38 bp, Artificial Sequence
  Synthetic oligonucleotide
ttgcccaaccgccgggggtcgttttttcgttactttga

SEQ ID NO: 34450 - DNA, 36 bp, Artificial Sequence
  Synthetic oligonucleotide
tcaacatccaccgaggttcaagattcgtgcccccta

SEQ ID NO: 34451 - DNA, 36 bp, Artificial Sequence
  Synthetic oligonucleotide
gccccactatcccgtcccccaggacgatcctgccta

SEQ ID NO: 34452 - DNA, 35 bp, Artificial Sequence
  Synthetic oligonucleotide
gccacggtctgcaggtattaccgtccctaccctta

SEQ ID NO: 34453 - DNA, 36 bp, Artificial Sequence
  Synthetic oligonucleotide
gtcaaccgacgctccggctcacagttttcctcgtta

SEQ ID NO: 34454 - DNA, 36 bp, Artificial Sequence
  Synthetic oligonucleotide
acacttgccctccgagcttaggttcattaccattta

SEQ ID NO: 34455 - DNA, 35 bp, Artificial Sequence
  Synthetic oligonucleotide
tcaccaggccggtagtttttcggtgtcccttttta

SEQ ID NO: 34456 - DNA, 35 bp, Artificial Sequence
  Synthetic oligonucleotide
tacccacacgtatctaccgccagagtaaccaccac

SEQ ID NO: 34457 - DNA, 35 bp, Artificial Sequence
  Synthetic oligonucleotide
acagcacccgtgcagtattggtcattctgttcacc

SEQ ID NO: 34458 - DNA, 35 bp, Artificial Sequence
  Synthetic oligonucleotide
atccatacctccaaacggtggatttttgccctacc

SEQ ID NO: 34459 - DNA, 35 bp, Artificial Sequence
  Synthetic oligonucleotide
acagacgaggggcatactcctgtcgatccctaccc

SEQ ID NO: 34460 - DNA, 35 bp, Artificial Sequence
  Synthetic oligonucleotide
tattcgcccaccttgaaagccagaaacgcattggc

SEQ ID NO: 34461 - DNA, 35 bp, Artificial Sequence
  Synthetic oligonucleotide
ttcccccgcactgacgttgcccgatctggttatgc

SEQ ID NO: 34462 - DNA, 35 bp, Artificial Sequence
  Synthetic oligonucleotide
gcatggccagcccacgaaatgcctattgctatatc

SEQ ID NO: 34463 - DNA, 35 bp, Artificial Sequence
  Synthetic oligonucleotide
aagcgtagctccatgaacggtcttcgtgctttctc

SEQ ID NO: 34464 - DNA, 35 bp, Artificial Sequence
  Synthetic oligonucleotide
gacccatgcccaactataaatatcggtttcatttc

SEQ ID NO: 34465 - DNA, 35 bp, Artificial Sequence
  Synthetic oligonucleotide
cacgtaccaccgctggcgccacggatcacttcacg

SEQ ID NO: 34466 - DNA, 35 bp, Artificial Sequence
  Synthetic oligonucleotide
tcagtcggcttcctacattattttcacttcctggg

SEQ ID NO: 34467 - DNA, 35 bp, Artificial Sequence
  Synthetic oligonucleotide
gtcgcgactcatccgcccctcgaccaacgcaacat

SEQ ID NO: 34468 - DNA, 35 bp, Artificial Sequence
  Synthetic oligonucleotide
accacataagcttgcccaataccgcacctcctgct

SEQ ID NO: 34469 - DNA, 35 bp, Artificial Sequence
  Synthetic oligonucleotide
gtcaccccgattttcgttcgacctttgtgcatttt

SEQ ID NO: 34470 - DNA, 35 bp, Artificial Sequence
  Synthetic oligonucleotide
atccgacacacccagcctctgacttgtgcctccaa

SEQ ID NO: 34471 - DNA, 35 bp, Artificial Sequence
  Synthetic oligonucleotide
gacccacactgcagtgcttcttcgtctcctcttaa

SEQ ID NO: 34472 - DNA, 37 bp, Artificial Sequence
  Synthetic oligonucleotide
gccaccgccacagtcaccgcccgtttatcattacaga

SEQ ID NO: 34473 - DNA, 37 bp, Artificial Sequence
  Synthetic oligonucleotide
gcgccacgggaagggtgtggggggctcatgatgcaga

SEQ ID NO: 34474 - DNA, 38 bp, Artificial Sequence
  Synthetic oligonucleotide
gcgttagcgaagggggcgggggcaataaaggcaagaga

SEQ ID NO: 34475 - DNA, 37 bp, Artificial Sequence
  Synthetic oligonucleotide
tatcgacaacgacatcttttctcctctgagcccccga

SEQ ID NO: 34476 - DNA, 37 bp, Artificial Sequence
  Synthetic oligonucleotide
accggagccacccatgaatagaaaaacacaaccgcga

SEQ ID NO: 34477 - DNA, 37 bp, Artificial Sequence
  Synthetic oligonucleotide
tcgacggtatgtcgttctatatccctgcctctcgcga

SEQ ID NO: 34478 - DNA, 37 bp, Artificial Sequence
  Synthetic oligonucleotide
tacgggccttcccgttcgttatttactgttccatcga

SEQ ID NO: 34479 - DNA, 36 bp, Artificial Sequence
  Synthetic oligonucleotide
tcaccagacactccttatgtatcggttttcattcga

SEQ ID NO: 34480 - DNA, 37 bp, Artificial Sequence
  Synthetic oligonucleotide
gccaccctcatgtatgatttaggatttcacttttgga

SEQ ID NO: 34481 - DNA, 38 bp, Artificial Sequence
  Synthetic oligonucleotide
ttgcgcctgcatcacatttcgattcttagcaccactga

SEQ ID NO: 34482 - DNA, 38 bp, Artificial Sequence
  Synthetic oligonucleotide
actcgctagccgatccgaatgcccgttagcgctgttga

SEQ ID NO: 34483 - DNA, 36 bp, Artificial Sequence
  Synthetic oligonucleotide
gtgcctggggacgttgcccagtacccttcttccata

SEQ ID NO: 34484 - DNA, 36 bp, Artificial Sequence
  Synthetic oligonucleotide
tctacccctcgttacacctttgcattccctatgcta

SEQ ID NO: 34485 - DNA, 35 bp, Artificial Sequence
  Synthetic oligonucleotide
ggaggcactcctctatgcactccctggtcacttta

SEQ ID NO: 34486 - DNA, 35 bp, Artificial Sequence
  Synthetic oligonucleotide
tcccatggtcaccgctttatctcatgtttaggcac

SEQ ID NO: 34487 - DNA, 35 bp, Artificial Sequence
  Synthetic oligonucleotide
tcagctgctgttggcatacccaccgcgcactttgc

SEQ ID NO: 34488 - DNA, 35 bp, Artificial Sequence
  Synthetic oligonucleotide
taaccgtgtatggccgcacctgggaccgtctcatc

SEQ ID NO: 34489 - DNA, 35 bp, Artificial Sequence
  Synthetic oligonucleotide
gtccccaaagccccgcccccacatctcaatggtag

SEQ ID NO: 34490 - DNA, 35 bp, Artificial Sequence
  Synthetic oligonucleotide
gtgctcagtatgtcactcatccttcttttcaactg

SEQ ID NO: 34491 - DNA, 35 bp, Artificial Sequence
  Synthetic oligonucleotide
gcaaccaccccgctatgtattaaacctcgtcccat

SEQ ID NO: 34492 - DNA, 35 bp, Artificial Sequence
  Synthetic oligonucleotide
gcaacacgtgctagcaggcgtccttatctgcctat

SEQ ID NO: 34493 - DNA, 35 bp, Artificial Sequence
  Synthetic oligonucleotide
gccgacagtaccacaaccgctcagccctccgaact

SEQ ID NO: 34494 - DNA, 35 bp, Artificial Sequence
  Synthetic oligonucleotide
gcaacgcatacccccaccaaatcattaggcacact

SEQ ID NO: 34495 - DNA, 35 bp, Artificial Sequence
  Synthetic oligonucleotide
aagcgccgcaatcaaattgcctagtccacgctact

SEQ ID NO: 34496 - DNA, 35 bp, Artificial Sequence
  Synthetic oligonucleotide
ttgaactcgcctgacacacggcctattactttatt

SEQ ID NO: 34497 - DNA, 35 bp, Artificial Sequence
  Synthetic oligonucleotide
tacagttccgcacccgaccatcgcgctataacttt

SEQ ID NO: 34498 - DNA, 36 bp, Artificial Sequence
  Synthetic oligonucleotide
agccaccagtcccgaccgaccggaacccactgcaaa

SEQ ID NO: 34499 - DNA, 36 bp, Artificial Sequence
  Synthetic oligonucleotide
gtccaccctcattcgtacccgcatactgccaccaca

SEQ ID NO: 34500 - DNA, 36 bp, Artificial Sequence
  Synthetic oligonucleotide
atctgtgcatcacgcgtaaacactccctacgcacca

SEQ ID NO: 34501 - DNA, 36 bp, Artificial Sequence
  Synthetic oligonucleotide
ttcaccgctcagtcgaattcactatcacccccccca

SEQ ID NO: 34502 - DNA, 36 bp, Artificial Sequence
  Synthetic oligonucleotide
gcacgacagcctcccatcgcaaagttgtgccttcca

SEQ ID NO: 34503 - DNA, 36 bp, Artificial Sequence
  Synthetic oligonucleotide
gatcaccgtgcatccgtcgtaacatatttcccagca

SEQ ID NO: 34504 - DNA, 36 bp, Artificial Sequence
  Synthetic oligonucleotide
ttagccgccaggtcgttggcgctcctgcttttcgca

SEQ ID NO: 34505 - DNA, 36 bp, Artificial Sequence
  Synthetic oligonucleotide
atgtgcctgcctcttgtcgtcgaatcaacctgcaga

SEQ ID NO: 34506 - DNA, 35 bp, Artificial Sequence
  Synthetic oligonucleotide
gcgctaccccgacaaccccacttaccaccgttcga

SEQ ID NO: 34507 - DNA, 36 bp, Artificial Sequence
  Synthetic oligonucleotide
ttgttccgcccgtcctcgtacactcccgtatatgga

SEQ ID NO: 34508 - DNA, 35 bp, Artificial Sequence
  Synthetic oligonucleotide
tcagcccactaccgaacacccgcgctccacctgga

SEQ ID NO: 34509 - DNA, 38 bp, Artificial Sequence
  Synthetic oligonucleotide
aacgcatgtccgagaagccactcccctgctgtctatga

SEQ ID NO: 34510 - DNA, 38 bp, Artificial Sequence
  Synthetic oligonucleotide
tcatgtacacctccgccccacacgcctgtaagcactga

SEQ ID NO: 34511 - DNA, 38 bp, Artificial Sequence
  Synthetic oligonucleotide
agaggagagctggtggggttggagggagtagaggttga

SEQ ID NO: 34512 - DNA, 35 bp, Artificial Sequence
  Synthetic oligonucleotide
tacccaccggttggacgcctaccataatgactctc

SEQ ID NO: 34513 - DNA, 35 bp, Artificial Sequence
  Synthetic oligonucleotide
ttgtcccactcagcagtgctctttgctttccacgg

SEQ ID NO: 34514 - DNA, 35 bp, Artificial Sequence
  Synthetic oligonucleotide
tagggaggcgaacggggggaaacggtggccaaatg

SEQ ID NO: 34515 - DNA, 35 bp, Artificial Sequence
  Synthetic oligonucleotide
tcatacacatcgatattgcgaaagtctcattcact

SEQ ID NO: 34516 - DNA, 35 bp, Artificial Sequence
  Synthetic oligonucleotide
gtcgctctgcagtaaatcttgtcttttacaaccct

SEQ ID NO: 34517 - DNA, 35 bp, Artificial Sequence
  Synthetic oligonucleotide
attacaactccccgctggcacgtgcgcttttccgt

SEQ ID NO: 34518 - DNA, 35 bp, Artificial Sequence
  Synthetic oligonucleotide
gcactcccatattcgtacgatttgactcctcttgt

SEQ ID NO: 34519 - DNA, 32 bp, Artificial Sequence
  Synthetic oligonucleotide
atgaccgttctccgtctgtactcgctttactt

SEQ ID NO: 34520 - DNA, 35 bp, Artificial Sequence
  Synthetic oligonucleotide
tgagccatccccagactggccgtcgcccctgctaa

SEQ ID NO: 34521 - DNA, 35 bp, Artificial Sequence
  Synthetic oligonucleotide
tgccggtcatgacaccaaccgctgcctcggaccca

SEQ ID NO: 34522 - DNA, 36 bp, Artificial Sequence
  Synthetic oligonucleotide
tgctaaccatccccacactccatgtccattaagtca

SEQ ID NO: 34523 - DNA, 37 bp, Artificial Sequence
  Synthetic oligonucleotide
gtggacggggtggtctaacagggagagatggtgcaga

SEQ ID NO: 34524 - DNA, 36 bp, Artificial Sequence
  Synthetic oligonucleotide
gttgggaggagaaaaaggcgaaaaggacgtaagaga

SEQ ID NO: 34525 - DNA, 36 bp, Artificial Sequence
  Synthetic oligonucleotide
aaggtaaagtactgggaaattggagagggtcagaga

SEQ ID NO: 34526 - DNA, 37 bp, Artificial Sequence
  Synthetic oligonucleotide
gattcacccggggtacagttaccgagagtcgaggaga

SEQ ID NO: 34527 - DNA, 37 bp, Artificial Sequence
  Synthetic oligonucleotide
gtagtcgcctattcctgctctaaccgtttttgcacga

SEQ ID NO: 34528 - DNA, 37 bp, Artificial Sequence
  Synthetic oligonucleotide
gtaccctcgttgtctttcattgcttgccgcccggcga

SEQ ID NO: 34529 - DNA, 38 bp, Artificial Sequence
  Synthetic oligonucleotide
tattcgccccgcccccttgagtatgcaactctatctga

SEQ ID NO: 34530 - DNA, 38 bp, Artificial Sequence
  Synthetic oligonucleotide
ttcaccgccgttacatctggtctggttccttatagtga

SEQ ID NO: 34531 - DNA, 38 bp, Artificial Sequence
  Synthetic oligonucleotide
ggagggctaaggggctagtaaggagggtggagctgtga

SEQ ID NO: 34532 - DNA, 35 bp, Artificial Sequence
  Synthetic oligonucleotide
accaccgcttcctcctgttctaaatatcggtttga

SEQ ID NO: 34533 - DNA, 36 bp, Artificial Sequence
  Synthetic oligonucleotide
ttcaacgacagggccaacgtcccctgctcacctcta

SEQ ID NO: 34534 - DNA, 36 bp, Artificial Sequence
  Synthetic oligonucleotide
tgcttcaccatggaccgcgttgcaacacactttgta

SEQ ID NO: 34535 - DNA, 35 bp, Artificial Sequence
  Synthetic oligonucleotide
tagacctgccccactagtaccaacaagaatacaac

SEQ ID NO: 34536 - DNA, 35 bp, Artificial Sequence
  Synthetic oligonucleotide
tacacgtcaatagtactctccgccttggcacaacc

SEQ ID NO: 34537 - DNA, 35 bp, Artificial Sequence
  Synthetic oligonucleotide
tatgacggtcgaaacacatgccctaatgaatcccc

SEQ ID NO: 34538 - DNA, 35 bp, Artificial Sequence
  Synthetic oligonucleotide
tgacggatcgcttgaatcggccgcttaacatctcc

SEQ ID NO: 34539 - DNA, 35 bp, Artificial Sequence
  Synthetic oligonucleotide
attgaaagcaggccaggggaaggaacgcaggtggc

SEQ ID NO: 34540 - DNA, 35 bp, Artificial Sequence
  Synthetic oligonucleotide
aaacagcacgacctcatcatagactacgattcctc

SEQ ID NO: 34541 - DNA, 35 bp, Artificial Sequence
  Synthetic oligonucleotide
atggtgggggagagaggcggacacaacaacattag

SEQ ID NO: 34542 - DNA, 35 bp, Artificial Sequence
  Synthetic oligonucleotide
tcgaacctcaatccgcttccatggccaagaacatg

SEQ ID NO: 34543 - DNA, 35 bp, Artificial Sequence
  Synthetic oligonucleotide
gcatacacaaagtagtgtaccggctccatcctctg

SEQ ID NO: 34544 - DNA, 35 bp, Artificial Sequence
  Synthetic oligonucleotide
gacatgagggaagggtctggtcacaacggggggtg

SEQ ID NO: 34545 - DNA, 35 bp, Artificial Sequence
  Synthetic oligonucleotide
tcaggagggacccgttcgttctacatatgccattt

SEQ ID NO: 34546 - DNA, 36 bp, Artificial Sequence
  Synthetic oligonucleotide
gcactacaagccacacctgtcgcgaaccgaccgcaa

SEQ ID NO: 34547 - DNA, 35 bp, Artificial Sequence
  Synthetic oligonucleotide
gcaaccacccggcacaccgctccttaaggaagcca

SEQ ID NO: 34548 - DNA, 36 bp, Artificial Sequence
  Synthetic oligonucleotide
ttcacgtcacagaaatccacgcttcctcccagcgca

SEQ ID NO: 34549 - DNA, 36 bp, Artificial Sequence
  Synthetic oligonucleotide
gcacatacgacgccatatcgaggctgctctttttca

SEQ ID NO: 34550 - DNA, 37 bp, Artificial Sequence
  Synthetic oligonucleotide
tccacccttgtacgcaactgatcctcctgtaaggaga

SEQ ID NO: 34551 - DNA, 37 bp, Artificial Sequence
  Synthetic oligonucleotide
gatccgggtcccagatgaaaacaaccctcccacccga

SEQ ID NO: 34552 - DNA, 38 bp, Artificial Sequence
  Synthetic oligonucleotide
aggacccccacacacgttgcctagatcgagcacactga

SEQ ID NO: 34553 - DNA, 38 bp, Artificial Sequence
  Synthetic oligonucleotide
aatggggcgaggtaggacatcatgggggggtggcgtga

SEQ ID NO: 34554 - DNA, 38 bp, Artificial Sequence
  Synthetic oligonucleotide
tcagcgatcgggaacagggtcattggtggagggtgtga

SEQ ID NO: 34555 - DNA, 37 bp, Artificial Sequence
  Synthetic oligonucleotide
acctcatccccatctgcgattagctgactactcttga

SEQ ID NO: 34556 - DNA, 38 bp, Artificial Sequence
  Synthetic oligonucleotide
gttcgcctcggttcttatgctcactattctttggttga

SEQ ID NO: 34557 - DNA, 36 bp, Artificial Sequence
  Synthetic oligonucleotide
gacccgttgcccttgaccgaacactcgcttatgcta

SEQ ID NO: 34558 - DNA, 36 bp, Artificial Sequence
  Synthetic oligonucleotide
ttcgccgtgcagaactatatcccctctgctgtttta

SEQ ID NO: 34559 - DNA, 35 bp, Artificial Sequence
  Synthetic oligonucleotide
acacccgtgcgaccgaccctattactctgcgaagg

SEQ ID NO: 34560 - DNA, 36 bp, Artificial Sequence
  Synthetic oligonucleotide
aaatgggaatgccggatggacggggatagatgacat

SEQ ID NO: 34561 - DNA, 35 bp, Artificial Sequence
  Synthetic oligonucleotide
agccaaccgcatgttgcacccgacttccatcttct

SEQ ID NO: 34562 - DNA, 35 bp, Artificial Sequence
  Synthetic oligonucleotide
ggtgcccggccacacgttaatcgcatcactcaaaa

SEQ ID NO: 34563 - DNA, 36 bp, Artificial Sequence
  Synthetic oligonucleotide
ttgctccaccgataggctagctttaacatccgtaaa

SEQ ID NO: 34564 - DNA, 36 bp, Artificial Sequence
  Synthetic oligonucleotide
accgacgtacccatctccgacttagtgaccgctcaa

SEQ ID NO: 34565 - DNA, 36 bp, Artificial Sequence
  Synthetic oligonucleotide
gagtcctgaaatcgagtaaggaggggaatggggaca

SEQ ID NO: 34566 - DNA, 37 bp, Artificial Sequence
  Synthetic oligonucleotide
ttggcggtagccgcatatcgatcttcgcgttccccga

SEQ ID NO: 34567 - DNA, 37 bp, Artificial Sequence
  Synthetic oligonucleotide
accggtacggcaatctacttggaccctctatactcga

SEQ ID NO: 34568 - DNA, 37 bp, Artificial Sequence
  Synthetic oligonucleotide
gaccggacgggggccagggattcgaggaaagggagga

SEQ ID NO: 34569 - DNA, 37 bp, Artificial Sequence
  Synthetic oligonucleotide
tgacgactctgagttaccagccgccgttttattctga

SEQ ID NO: 34570 - DNA, 38 bp, Artificial Sequence
  Synthetic oligonucleotide
accctaccccgtgcccgtccaccccgactccgtcgtga

SEQ ID NO: 34571 - DNA, 38 bp, Artificial Sequence
  Synthetic oligonucleotide
gcagggaggaacataactaaggggataggcttgattga

SEQ ID NO: 34572 - DNA, 35 bp, Artificial Sequence
  Synthetic oligonucleotide
gcgcggggacaatcgcgcggagggggggcgggcta

SEQ ID NO: 34573 - DNA, 35 bp, Artificial Sequence
  Synthetic oligonucleotide
gacgcccatcctttgtctgaaagccatgtactcta

SEQ ID NO: 34574 - DNA, 35 bp, Artificial Sequence
  Synthetic oligonucleotide
attcattagcacgtcacaccgtcatggttccatcc

SEQ ID NO: 34575 - DNA, 35 bp, Artificial Sequence
  Synthetic oligonucleotide
taggcccgtccgcacactcccttggacccgttacg

SEQ ID NO: 34576 - DNA, 35 bp, Artificial Sequence
  Synthetic oligonucleotide
tcaatcgcatcactgttcttcgatctcctgtaggg

SEQ ID NO: 34577 - DNA, 35 bp, Artificial Sequence
  Synthetic oligonucleotide
atgttcgcacggcgggggggggagatggaggtggg

SEQ ID NO: 34578 - DNA, 35 bp, Artificial Sequence
  Synthetic oligonucleotide
gacaacggacggaaacttgtgctgcatgggttggg

SEQ ID NO: 34579 - DNA, 35 bp, Artificial Sequence
  Synthetic oligonucleotide
tccccacgcgcacattgtttggttctgtcttcgat

SEQ ID NO: 34580 - DNA, 35 bp, Artificial Sequence
  Synthetic oligonucleotide
gtatacatctgtccctgtctagaaaagccccccct

SEQ ID NO: 34581 - DNA, 35 bp, Artificial Sequence
  Synthetic oligonucleotide
tttgcgcggaggcacctctcacacgttcccgggct

SEQ ID NO: 34582 - DNA, 35 bp, Artificial Sequence
  Synthetic oligonucleotide
gatttgcccacccccgaatgtgtagttttgctctt

SEQ ID NO: 34583 - DNA, 35 bp, Artificial Sequence
  Synthetic oligonucleotide
ttgcccccatactgaattcacagcttatcatagtt

SEQ ID NO: 34584 - DNA, 36 bp, Artificial Sequence
  Synthetic oligonucleotide
ggacgcctctcaaggctctataacatttcaccaaaa

SEQ ID NO: 34585 - DNA, 36 bp, Artificial Sequence
  Synthetic oligonucleotide
gacgacaaacggtcggaatcgttttatctactccca

SEQ ID NO: 34586 - DNA, 36 bp, Artificial Sequence
  Synthetic oligonucleotide
gatgatcgcactccatgtccggaggtcaactcctca

SEQ ID NO: 34587 - DNA, 36 bp, Artificial Sequence
  Synthetic oligonucleotide
ttagctcgcctcaactgacctggtagtactttttca

SEQ ID NO: 34588 - DNA, 37 bp, Artificial Sequence
  Synthetic oligonucleotide
gacctgaacgcctccgaatccttcgcccctctcaaga

SEQ ID NO: 34589 - DNA, 37 bp, Artificial Sequence
  Synthetic oligonucleotide
tagcattcgccaactgccctgagtcccgctgtcccga

SEQ ID NO: 34590 - DNA, 35 bp, Artificial Sequence
  Synthetic oligonucleotide
acacctctccactcccgtatgcgctattatatcga

SEQ ID NO: 34591 - DNA, 37 bp, Artificial Sequence
  Synthetic oligonucleotide
gctgccacgacagcctttttcagcccgacccactcga

SEQ ID NO: 34592 - DNA, 38 bp, Artificial Sequence
  Synthetic oligonucleotide
acgaagctagcacgcctagcacgtacactctaccttga

SEQ ID NO: 34593 - DNA, 35 bp, Artificial Sequence
  Synthetic oligonucleotide
ggactagaggaggtcgaaacgacgggggaagggta

SEQ ID NO: 34594 - DNA, 35 bp, Artificial Sequence
  Synthetic oligonucleotide
aaacacatcaccattttcgcccttagcgcacttta

SEQ ID NO: 34595 - DNA, 35 bp, Artificial Sequence
  Synthetic oligonucleotide
gtgcgcttgcgccttatcatccatttcgctcccac

SEQ ID NO: 34596 - DNA, 35 bp, Artificial Sequence
  Synthetic oligonucleotide
taaccagctctcgttctgtccacgaattacccccc

SEQ ID NO: 34597 - DNA, 35 bp, Artificial Sequence
  Synthetic oligonucleotide
acccccggtgtcacgcccgcatcaccccaccggcc

SEQ ID NO: 34598 - DNA, 35 bp, Artificial Sequence
  Synthetic oligonucleotide
ttccccccgcccatcctggtgtctgcaaactctcc

SEQ ID NO: 34599 - DNA, 35 bp, Artificial Sequence
  Synthetic oligonucleotide
gagactcgacattggcggggggagaactgggggag

SEQ ID NO: 34600 - DNA, 35 bp, Artificial Sequence
  Synthetic oligonucleotide
tgtatggggggtaaggaagacgggtaacagatgag

SEQ ID NO: 34601 - DNA, 35 bp, Artificial Sequence
  Synthetic oligonucleotide
gcacatcgcgcaacctagcctcgcgaaacctcctg

SEQ ID NO: 34602 - DNA, 35 bp, Artificial Sequence
  Synthetic oligonucleotide
acttccgaagcaccctccatcgcatgttttttctg

SEQ ID NO: 34603 - DNA, 36 bp, Artificial Sequence
  Synthetic oligonucleotide
gaagcgctttacccccccgttttctagtggccgcat

SEQ ID NO: 34604 - DNA, 34 bp, Artificial Sequence
  Synthetic oligonucleotide
gagcacgcaagtcggtactcttttgaatgcccct

SEQ ID NO: 34605 - DNA, 35 bp, Artificial Sequence
  Synthetic oligonucleotide
tgtcaacttatgccagcccttggtgtcccgctcct

SEQ ID NO: 34606 - DNA, 35 bp, Artificial Sequence
  Synthetic oligonucleotide
tcctctgcagtccatacccaccatagactttggct

SEQ ID NO: 34607 - DNA, 35 bp, Artificial Sequence
  Synthetic oligonucleotide
tgcccccgattcctcctatgtcctattattagggt

SEQ ID NO: 34608 - DNA, 35 bp, Artificial Sequence
  Synthetic oligonucleotide
tgcgccctgaaattttgcacgtcactacttttggt

SEQ ID NO: 34609 - DNA, 35 bp, Artificial Sequence
  Synthetic oligonucleotide
taggagggtccgcttttgtcgctgtcgccttcctt

SEQ ID NO: 34610 - DNA, 35 bp, Artificial Sequence
  Synthetic oligonucleotide
gtggagccgttgattgtttgcccccactctcattt

SEQ ID NO: 34611 - DNA, 36 bp, Artificial Sequence
  Synthetic oligonucleotide
atccccaccgcctgttgatctaacactgtccaacaa

SEQ ID NO: 34612 - DNA, 35 bp, Artificial Sequence
  Synthetic oligonucleotide
tgtgggtgggtgggacatgtgggccatattaagaa

SEQ ID NO: 34613 - DNA, 36 bp, Artificial Sequence
  Synthetic oligonucleotide
tagtcacgccgaagggaacgttgggggaaagcggaa

SEQ ID NO: 34614 - DNA, 36 bp, Artificial Sequence
  Synthetic oligonucleotide
gtctcaacatcaaagtgcatgctgttatccacctca

SEQ ID NO: 34615 - DNA, 37 bp, Artificial Sequence
  Synthetic oligonucleotide
taaggggggtagtggagggccacggtgaaatttgaga

SEQ ID NO: 34616 - DNA, 37 bp, Artificial Sequence
  Synthetic oligonucleotide
gccgcacgtaccctttgcttataccttaccatttaga

SEQ ID NO: 34617 - DNA, 37 bp, Artificial Sequence
  Synthetic oligonucleotide
cacctctacccactcttcgtccagtcatgtctggcga

SEQ ID NO: 34618 - DNA, 37 bp, Artificial Sequence
  Synthetic oligonucleotide
gtctatgccgcctcccgattacgccacctctcaagga

SEQ ID NO: 34619 - DNA, 38 bp, Artificial Sequence
  Synthetic oligonucleotide
gacacccccataaacataaagcgaacaccttgctctga

SEQ ID NO: 34620 - DNA, 35 bp, Artificial Sequence
  Synthetic oligonucleotide
tcgctacacccgcccggtcactgtcgcgcatcgac

SEQ ID NO: 34621 - DNA, 35 bp, Artificial Sequence
  Synthetic oligonucleotide
gtgtgcgcccattgactcccacgcaaatccccccc

SEQ ID NO: 34622 - DNA, 35 bp, Artificial Sequence
  Synthetic oligonucleotide
tacgtcccctctgactggaccgtagctgtgcctcc

SEQ ID NO: 34623 - DNA, 35 bp, Artificial Sequence
  Synthetic oligonucleotide
acgcggagcctcgcttatttggggtcccatgttcc

SEQ ID NO: 34624 - DNA, 35 bp, Artificial Sequence
  Synthetic oligonucleotide
tccacacccacgtgcctcggtgcgcggttcctagc

SEQ ID NO: 34625 - DNA, 35 bp, Artificial Sequence
  Synthetic oligonucleotide
tatccccctgcctaacccttgaccgcatgcgcatc

SEQ ID NO: 34626 - DNA, 35 bp, Artificial Sequence
  Synthetic oligonucleotide
tagacagcaagggtaagtaggagtgagcggggggg

SEQ ID NO: 34627 - DNA, 35 bp, Artificial Sequence
  Synthetic oligonucleotide
agacccctccgccgaatcagtcgcccgactataat

SEQ ID NO: 34628 - DNA, 35 bp, Artificial Sequence
  Synthetic oligonucleotide
gttacgcctctacctgtcattattcaaggacgcat

SEQ ID NO: 34629 - DNA, 35 bp, Artificial Sequence
  Synthetic oligonucleotide
gccccgcaggctacataatagtactgttctttgtt

SEQ ID NO: 34630 - DNA, 35 bp, Artificial Sequence
  Synthetic oligonucleotide
gcgcacacgcagttccatccacccatgaatatttt

SEQ ID NO: 34631 - DNA, 35 bp, Artificial Sequence
  Synthetic oligonucleotide
ttgcacggacgggttagtggaaaagtggagggaaa

SEQ ID NO: 34632 - DNA, 37 bp, Artificial Sequence
  Synthetic oligonucleotide
tgcctccacgccatttacacaggtcacgctgtcttca

SEQ ID NO: 34633 - DNA, 37 bp, Artificial Sequence
  Synthetic oligonucleotide
ttcgcggggtcaagagggggggccacgaagggtaaga

SEQ ID NO: 34634 - DNA, 36 bp, Artificial Sequence
  Synthetic oligonucleotide
agccgcaaccgcactatacgcaactcaacaggccga

SEQ ID NO: 34635 - DNA, 36 bp, Artificial Sequence
  Synthetic oligonucleotide
accgttcgcattctaactctgtatttcgtacctcga

SEQ ID NO: 34636 - DNA, 37 bp, Artificial Sequence
  Synthetic oligonucleotide
agccgtccgccgaacgcactacttgttttatcttgga

SEQ ID NO: 34637 - DNA, 38 bp, Artificial Sequence
  Synthetic oligonucleotide
attccacccctaatcgtgtataacgttccaatgtatga

SEQ ID NO: 34638 - DNA, 37 bp, Artificial Sequence
  Synthetic oligonucleotide
aacctgacccagtacggtatgtccgctcttttactga

SEQ ID NO: 34639 - DNA, 37 bp, Artificial Sequence
  Synthetic oligonucleotide
acaatacaccgccccatgctacatcgctatcccctga

SEQ ID NO: 34640 - DNA, 37 bp, Artificial Sequence
  Synthetic oligonucleotide
tgctatgccgcacatctcgcgttgtgacccttgttga

SEQ ID NO: 34641 - DNA, 35 bp, Artificial Sequence
  Synthetic oligonucleotide
accattacgatcctgactctgctacaacacttcta

SEQ ID NO: 34642 - DNA, 35 bp, Artificial Sequence
  Synthetic oligonucleotide
ggatcgccccacagcggtgtgctctcattctgtta

SEQ ID NO: 34643 - DNA, 35 bp, Artificial Sequence
  Synthetic oligonucleotide
ggtaagatcgccctacccgtacaattcatggccac

SEQ ID NO: 34644 - DNA, 35 bp, Artificial Sequence
  Synthetic oligonucleotide
gtatcgctgtatcaccattgcatctctttaacacc

SEQ ID NO: 34645 - DNA, 35 bp, Artificial Sequence
  Synthetic oligonucleotide
gtgaccgctatatttcgctcaagcgcgcataaccc

SEQ ID NO: 34646 - DNA, 35 bp, Artificial Sequence
  Synthetic oligonucleotide
aaaccgaggcctggcctcctcacgctttagtgccc

SEQ ID NO: 34647 - DNA, 35 bp, Artificial Sequence
  Synthetic oligonucleotide
gacgacctgtcgccttggggttacctgcatcttgc

SEQ ID NO: 34648 - DNA, 35 bp, Artificial Sequence
  Synthetic oligonucleotide
aagctgacgagtgactcttgtatcattccatcctc

SEQ ID NO: 34649 - DNA, 35 bp, Artificial Sequence
  Synthetic oligonucleotide
tgatgcatccattgcgtctctctgatcaactatcg

SEQ ID NO: 34650 - DNA, 35 bp, Artificial Sequence
  Synthetic oligonucleotide
tccgatcagaccggacctttccattctcccgcctg

SEQ ID NO: 34651 - DNA, 35 bp, Artificial Sequence
  Synthetic oligonucleotide
taagctcgttacatcagtgcactgccattccttct

SEQ ID NO: 34652 - DNA, 35 bp, Artificial Sequence
  Synthetic oligonucleotide
atcctacgcagtgtatccttatccgcacatcatgt

SEQ ID NO: 34653 - DNA, 35 bp, Artificial Sequence
  Synthetic oligonucleotide
tccgtttcgcacgctgtacatgcctatccctacaa

SEQ ID NO: 34654 - DNA, 36 bp, Artificial Sequence
  Synthetic oligonucleotide
ttgaggtatcacggtggagaggggcggtgaagggaa

SEQ ID NO: 34655 - DNA, 36 bp, Artificial Sequence
  Synthetic oligonucleotide
accgacgcgtacaaggtctaaactcatcactgctca

SEQ ID NO: 34656 - DNA, 37 bp, Artificial Sequence
  Synthetic oligonucleotide
gagagtgcgacgaaggtgtgaggagggcatagggaga

SEQ ID NO: 34657 - DNA, 37 bp, Artificial Sequence
  Synthetic oligonucleotide
taaccgaccagatgcttaccctcctcttggttcccga

SEQ ID NO: 34658 - DNA, 37 bp, Artificial Sequence
  Synthetic oligonucleotide
gtgggacacctgacactttctgtattgcactacatga

SEQ ID NO: 34659 - DNA, 38 bp, Artificial Sequence
  Synthetic oligonucleotide
taaccgcgcctgggggatataactgggagggagggtga

SEQ ID NO: 34660 - DNA, 37 bp, Artificial Sequence
  Synthetic oligonucleotide
accaccactcgcccacattccctctccattagtgtga

SEQ ID NO: 34661 - DNA, 35 bp, Artificial Sequence
  Synthetic oligonucleotide
tttcccgcattgccacctttatcctgccagggcta

SEQ ID NO: 34662 - DNA, 35 bp, Artificial Sequence
  Synthetic oligonucleotide
tcatggagcaaacgacacaagatccctgttccacc

SEQ ID NO: 34663 - DNA, 35 bp, Artificial Sequence
  Synthetic oligonucleotide
tattgagcccacccctgtcgttatagactctgccc

SEQ ID NO: 34664 - DNA, 35 bp, Artificial Sequence
  Synthetic oligonucleotide
atcgaggcttccccacacgcttgactgaggtccgc

SEQ ID NO: 34665 - DNA, 35 bp, Artificial Sequence
  Synthetic oligonucleotide
acagctgggccacatcacttgttagacgcctgctc

SEQ ID NO: 34666 - DNA, 35 bp, Artificial Sequence
  Synthetic oligonucleotide
gctctccgcaggcaataaccccacgactacttctc

SEQ ID NO: 34667 - DNA, 35 bp, Artificial Sequence
  Synthetic oligonucleotide
aatcactccctacgccaggctgacccaatatcttc

SEQ ID NO: 34668 - DNA, 35 bp, Artificial Sequence
  Synthetic oligonucleotide
gtggccagtggtggttggatcgggggggtgaggag

SEQ ID NO: 34669 - DNA, 35 bp, Artificial Sequence
  Synthetic oligonucleotide
tgaggtggcggggacggggtagataaagttgtgag

SEQ ID NO: 34670 - DNA, 35 bp, Artificial Sequence
  Synthetic oligonucleotide
gcattgccccccgaactttaccgcaagtcatcttg

SEQ ID NO: 34671 - DNA, 32 bp, Artificial Sequence
  Synthetic oligonucleotide
gactaggccgcccatttagctcctgggattat

SEQ ID NO: 34672 - DNA, 35 bp, Artificial Sequence
  Synthetic oligonucleotide
tagtctaccggtctggtgcacactgcaattcatct

SEQ ID NO: 34673 - DNA, 36 bp, Artificial Sequence
  Synthetic oligonucleotide
gagcacatcctcgcaccggacaccaccgtaggcaaa

SEQ ID NO: 34674 - DNA, 36 bp, Artificial Sequence
  Synthetic oligonucleotide
ggacctagcatccgtattgctcatcctcctgcacaa

SEQ ID NO: 34675 - DNA, 35 bp, Artificial Sequence
  Synthetic oligonucleotide
gatccatccgcttggatgatatatcctactaccaa

SEQ ID NO: 34676 - DNA, 35 bp, Artificial Sequence
  Synthetic oligonucleotide
atcaagtgcacatacatacatttgcttggccccaa

SEQ ID NO: 34677 - DNA, 36 bp, Artificial Sequence
  Synthetic oligonucleotide
tccgcatactcaggagcaacgccctccttcctgcaa

SEQ ID NO: 34678 - DNA, 36 bp, Artificial Sequence
  Synthetic oligonucleotide
atgtggcgcagattagagggggggggaaaacaatca

SEQ ID NO: 34679 - DNA, 35 bp, Artificial Sequence
  Synthetic oligonucleotide
gaagcgacacgctcgtacttggctagccccactca

SEQ ID NO: 34680 - DNA, 37 bp, Artificial Sequence
  Synthetic oligonucleotide
gcatcatccggccggcacatcacgcgtacatctcaga

SEQ ID NO: 34681 - DNA, 37 bp, Artificial Sequence
  Synthetic oligonucleotide
ggagaataggtggaagggtaagggtgtatgagtgaga

SEQ ID NO: 34682 - DNA, 37 bp, Artificial Sequence
  Synthetic oligonucleotide
gccccctcctctctgcgattcgccccttgacaggcga

SEQ ID NO: 34683 - DNA, 37 bp, Artificial Sequence
  Synthetic oligonucleotide
atccagggcgaacgtggcgtggggtggctctcgggga

SEQ ID NO: 34684 - DNA, 37 bp, Artificial Sequence
  Synthetic oligonucleotide
tagccctgcaccacccgacctgacttcttgtaaatga

SEQ ID NO: 34685 - DNA, 38 bp, Artificial Sequence
  Synthetic oligonucleotide
acgttgtacgttcaccgattgccttctgatccacctga

SEQ ID NO: 34686 - DNA, 38 bp, Artificial Sequence
  Synthetic oligonucleotide
gcccagggcacgctgagaacaggtaggaaggttattga

SEQ ID NO: 34687 - DNA, 38 bp, Artificial Sequence
  Synthetic oligonucleotide
tgcccaccggcccacgcatgggctaacgaccaccttga

SEQ ID NO: 34688 - DNA, 38 bp, Artificial Sequence
  Synthetic oligonucleotide
ttgcacgtgctctggtactgctttatctctgttgttga

SEQ ID NO: 34689 - DNA, 36 bp, Artificial Sequence
  Synthetic oligonucleotide
acatcgccgtggcggttagcaccaccgcatacccta

SEQ ID NO: 34690 - DNA, 35 bp, Artificial Sequence
  Synthetic oligonucleotide
gccttgaggcgtacttgcagtgttccattttccta

SEQ ID NO: 34691 - DNA, 36 bp, Artificial Sequence
  Synthetic oligonucleotide
acccgcaaccgcattcgccgcattctatctacagta

SEQ ID NO: 34692 - DNA, 36 bp, Artificial Sequence
  Synthetic oligonucleotide
tactgcatccctgtgaaatcacccgctgcaccgtta

SEQ ID NO: 34693 - DNA, 35 bp, Artificial Sequence
  Synthetic oligonucleotide
tcaggccaaaccttctggccccccctgactcgacc

SEQ ID NO: 34694 - DNA, 35 bp, Artificial Sequence
  Synthetic oligonucleotide
acctgacccaccatgtattcgatgatctcgcaccc

SEQ ID NO: 34695 - DNA, 35 bp, Artificial Sequence
  Synthetic oligonucleotide
acgacaccgagtccacccccgagcacatcaaactc

SEQ ID NO: 34696 - DNA, 35 bp, Artificial Sequence
  Synthetic oligonucleotide
acagacgaacacgctctttatgcacctaccaatgg

SEQ ID NO: 34697 - DNA, 35 bp, Artificial Sequence
  Synthetic oligonucleotide
gaagaacgactaagccccgcctgcccttggtcctg

SEQ ID NO: 34698 - DNA, 35 bp, Artificial Sequence
  Synthetic oligonucleotide
gtacaccctctgcatgcactattgagtcattgcct

SEQ ID NO: 34699 - DNA, 35 bp, Artificial Sequence
  Synthetic oligonucleotide
attgttgcgcatagaccgttttcccctgtccgctt

SEQ ID NO: 34700 - DNA, 35 bp, Artificial Sequence
  Synthetic oligonucleotide
tcaacatctgcgtctccggtacttgcctcttccaa

SEQ ID NO: 34701 - DNA, 35 bp, Artificial Sequence
  Synthetic oligonucleotide
tagtcgccttatgtgatgtgtcccgccccttgcca

SEQ ID NO: 34702 - DNA, 36 bp, Artificial Sequence
  Synthetic oligonucleotide
ggtcacgctacgttcccggtcgccaatacttcatca

SEQ ID NO: 34703 - DNA, 37 bp, Artificial Sequence
  Synthetic oligonucleotide
aatccagtccctgctgttcgtgtccagccccactaga

SEQ ID NO: 34704 - DNA, 36 bp, Artificial Sequence
  Synthetic oligonucleotide
gagggtgggggatggaatgcttagcggagggcctga

SEQ ID NO: 34705 - DNA, 38 bp, Artificial Sequence
  Synthetic oligonucleotide
tcagatgcgcagggggcggagaacggattaaggtgtga

SEQ ID NO: 34706 - DNA, 38 bp, Artificial Sequence
  Synthetic oligonucleotide
atctctcaggcccacatggttttgcacatttctgttga

SEQ ID NO: 34707 - DNA, 36 bp, Artificial Sequence
  Synthetic oligonucleotide
acaggcctgcctccagcacgcacatcctcccgcata

SEQ ID NO: 34708 - DNA, 36 bp, Artificial Sequence
  Synthetic oligonucleotide
gtatccctggtcccatgtgcacactcctgaatacta

SEQ ID NO: 34709 - DNA, 35 bp, Artificial Sequence
  Synthetic oligonucleotide
atcccgtctatgctccagcctttatgcccacccta

SEQ ID NO: 34710 - DNA, 36 bp, Artificial Sequence
  Synthetic oligonucleotide
tctaccgagccccccccagttacaagcttacgttta

SEQ ID NO: 34711 - DNA, 35 bp, Artificial Sequence
  Synthetic oligonucleotide
gatctcatcgcctatcacatactgtctcgttatac

SEQ ID NO: 34712 - DNA, 35 bp, Artificial Sequence
  Synthetic oligonucleotide
gcgcccgctaggggcagccacatactcccttttcc

SEQ ID NO: 34713 - DNA, 35 bp, Artificial Sequence
  Synthetic oligonucleotide
gagtggagaaggtgcggtaggcggactagaaagtc

SEQ ID NO: 34714 - DNA, 35 bp, Artificial Sequence
  Synthetic oligonucleotide
accgccccttcagcccctcgcacacgctcccatag

SEQ ID NO: 34715 - DNA, 35 bp, Artificial Sequence
  Synthetic oligonucleotide
accactcctgactaagcattcacgtaccctgggat

SEQ ID NO: 34716 - DNA, 35 bp, Artificial Sequence
  Synthetic oligonucleotide
actacacctcggcttctacctcccttgcccctggt

SEQ ID NO: 34717 - DNA, 35 bp, Artificial Sequence
  Synthetic oligonucleotide
acatccgctgctgtcgctgtctaccatggtctctt

SEQ ID NO: 34718 - DNA, 36 bp, Artificial Sequence
  Synthetic oligonucleotide
gcacatctgccgttgcgaaaccttgccttgcatcaa

SEQ ID NO: 34719 - DNA, 36 bp, Artificial Sequence
  Synthetic oligonucleotide
tctgtctgtcgcccgtcagtcatcatcctgtttaca

SEQ ID NO: 34720 - DNA, 36 bp, Artificial Sequence
  Synthetic oligonucleotide
tagggctcaggtctcgacgcaccgttcttccagcca

SEQ ID NO: 34721 - DNA, 36 bp, Artificial Sequence
  Synthetic oligonucleotide
tgccgacgcccctacccgtatcaatggaactggcca

SEQ ID NO: 34722 - DNA, 37 bp, Artificial Sequence
  Synthetic oligonucleotide
tcgtaaccaatccatccgagggcccactctttccaga

SEQ ID NO: 34723 - DNA, 36 bp, Artificial Sequence
  Synthetic oligonucleotide
gacagtaggaagaaaaaggcatagcgggagagacga

SEQ ID NO: 34724 - DNA, 37 bp, Artificial Sequence
  Synthetic oligonucleotide
gtcccaacccgccctacacttgatacgatgagcccga

SEQ ID NO: 34725 - DNA, 37 bp, Artificial Sequence
  Synthetic oligonucleotide
ttaaccacgcgcggctatctccaccttctctttgcga

SEQ ID NO: 34726 - DNA, 37 bp, Artificial Sequence
  Synthetic oligonucleotide
gtgaacatgcggagggggaggaaaacatactagagga

SEQ ID NO: 34727 - DNA, 37 bp, Artificial Sequence
  Synthetic oligonucleotide
atgtgtgagggtagggacgatgggagttgcgagggga

SEQ ID NO: 34728 - DNA, 37 bp, Artificial Sequence
  Synthetic oligonucleotide
gccacccccagcactcttaatcgtctacctatgggga

SEQ ID NO: 34729 - DNA, 38 bp, Artificial Sequence
  Synthetic oligonucleotide
actgatgacaagatagggggtaagctggggcaggatga

SEQ ID NO: 34730 - DNA, 38 bp, Artificial Sequence
  Synthetic oligonucleotide
gcgagagttaacggggaggggtaggaaggaacatatga

SEQ ID NO: 34731 - DNA, 37 bp, Artificial Sequence
  Synthetic oligonucleotide
ttgcacccacctctgctggcgaacctaagtctactga

SEQ ID NO: 34732 - DNA, 38 bp, Artificial Sequence
  Synthetic oligonucleotide
tcagtggataagacgaggattaagtggggggatggtga

SEQ ID NO: 34733 - DNA, 36 bp, Artificial Sequence
  Synthetic oligonucleotide
gaactgtgaccgccggggcttgaaactactattgta

SEQ ID NO: 34734 - DNA, 35 bp, Artificial Sequence
  Synthetic oligonucleotide
gtcactacctagccgtttagcgcatacccgcctta

SEQ ID NO: 34735 - DNA, 35 bp, Artificial Sequence
  Synthetic oligonucleotide
ttcacaagccatgcgtaaacggctccactcgcaac

SEQ ID NO: 34736 - DNA, 35 bp, Artificial Sequence
  Synthetic oligonucleotide
tctacccctgtcctgatagggcgactcaaccattc

SEQ ID NO: 34737 - DNA, 35 bp, Artificial Sequence
  Synthetic oligonucleotide
gcgacgcccccgggatcggtacctaaacattactg

SEQ ID NO: 34738 - DNA, 35 bp, Artificial Sequence
  Synthetic oligonucleotide
attcaagccgtccgttcactctccctgtccggcat

SEQ ID NO: 34739 - DNA, 35 bp, Artificial Sequence
  Synthetic oligonucleotide
agacctgtccttcctagcggcgctgttgctcccct

SEQ ID NO: 34740 - DNA, 35 bp, Artificial Sequence
  Synthetic oligonucleotide
gtctgggctctcctgcctgccttcgcctatcatct

SEQ ID NO: 34741 - DNA, 34 bp, Artificial Sequence
  Synthetic oligonucleotide
tcccccaaccaccatgttctttcgagtacgtatt

SEQ ID NO: 34742 - DNA, 35 bp, Artificial Sequence
  Synthetic oligonucleotide
aagtggtcacccatctgttactcgccacccttctt

SEQ ID NO: 34743 - DNA, 35 bp, Artificial Sequence
  Synthetic oligonucleotide
atgccaccgtggtgactttgtttcagccccacttt

SEQ ID NO: 34744 - DNA, 36 bp, Artificial Sequence
  Synthetic oligonucleotide
tgaccgcctctcgcaccgcctgtatcatctgtacca

SEQ ID NO: 34745 - DNA, 36 bp, Artificial Sequence
  Synthetic oligonucleotide
aatcatccgcacggtcgtatgcgtgcacttagccca

SEQ ID NO: 34746 - DNA, 36 bp, Artificial Sequence
  Synthetic oligonucleotide
accttccctcgcctcgtagtcttttttgtcttccca

SEQ ID NO: 34747 - DNA, 36 bp, Artificial Sequence
  Synthetic oligonucleotide
agaggcctcgcctccaccacgattctaatattgcca

SEQ ID NO: 34748 - DNA, 36 bp, Artificial Sequence
  Synthetic oligonucleotide
gtctcgtcccttgttctggctacgtttctctgctca

SEQ ID NO: 34749 - DNA, 36 bp, Artificial Sequence
  Synthetic oligonucleotide
aaacgcaccgaatagccggcctgcccttcactacga

SEQ ID NO: 34750 - DNA, 37 bp, Artificial Sequence
  Synthetic oligonucleotide
tatgcacccagaagcggaacaacgcacgctccaccga

SEQ ID NO: 34751 - DNA, 37 bp, Artificial Sequence
  Synthetic oligonucleotide
gtgccacgtacgttcgttaatctcccaactgaatcga

SEQ ID NO: 34752 - DNA, 37 bp, Artificial Sequence
  Synthetic oligonucleotide
gccccccacccgggttcagtgacacaaccgccatcga

SEQ ID NO: 34753 - DNA, 36 bp, Artificial Sequence
  Synthetic oligonucleotide
gaaggtaacacaggatcaatgggaagtggggtagga

SEQ ID NO: 34754 - DNA, 37 bp, Artificial Sequence
  Synthetic oligonucleotide
tcaggaccacctctttggcttgtataccacccacgga

SEQ ID NO: 34755 - DNA, 37 bp, Artificial Sequence
  Synthetic oligonucleotide
atccggggagagtaggagcaagaaggctggttacgga

SEQ ID NO: 34756 - DNA, 37 bp, Artificial Sequence
  Synthetic oligonucleotide
tgcggggtcgcaagagaataaatgaagggatggtgga

SEQ ID NO: 34757 - DNA, 36 bp, Artificial Sequence
  Synthetic oligonucleotide
tagagagacgcagccctatctcctgacacttactga

SEQ ID NO: 34758 - DNA, 38 bp, Artificial Sequence
  Synthetic oligonucleotide
tcttgtgccgaccgtttaattaaacctctctatcctga

SEQ ID NO: 34759 - DNA, 38 bp, Artificial Sequence
  Synthetic oligonucleotide
taccgtactgtcctccccaccccgctaggtgcctctga

SEQ ID NO: 34760 - DNA, 38 bp, Artificial Sequence
  Synthetic oligonucleotide
atagcttagggaggggcggggcaaatgaggggccgtga

SEQ ID NO: 34761 - DNA, 37 bp, Artificial Sequence
  Synthetic oligonucleotide
acaccaactcccactggacctagacactctgccgtga

SEQ ID NO: 34762 - DNA, 37 bp, Artificial Sequence
  Synthetic oligonucleotide
acaacgccccacattgccactcgaaccagttgcgtga

SEQ ID NO: 34763 - DNA, 35 bp, Artificial Sequence
  Synthetic oligonucleotide
tgaaccgccgtatccttccatgtaatgctgccgcc

SEQ ID NO: 34764 - DNA, 35 bp, Artificial Sequence
  Synthetic oligonucleotide
atggcccaccccccgagttcatttatagcgcgcgc

SEQ ID NO: 34765 - DNA, 35 bp, Artificial Sequence
  Synthetic oligonucleotide
gatcatcccccatatagtttcacggagtaagtctc

SEQ ID NO: 34766 - DNA, 35 bp, Artificial Sequence
  Synthetic oligonucleotide
tacgcacattcgttcgactgactccttttggccct

SEQ ID NO: 34767 - DNA, 35 bp, Artificial Sequence
  Synthetic oligonucleotide
tgaagcgcgatccaccaaggttttccacttcgcct

SEQ ID NO: 34768 - DNA, 36 bp, Artificial Sequence
  Synthetic oligonucleotide
tagtgatgccctgccctgtcctatgaaaccaaccaa

SEQ ID NO: 34769 - DNA, 34 bp, Artificial Sequence
  Synthetic oligonucleotide
gccaacccctttctgttaaccgctacgcattcaa

SEQ ID NO: 34770 - DNA, 37 bp, Artificial Sequence
  Synthetic oligonucleotide
tcgaatctccagcccgtttcctcaccccttttgtgaa

SEQ ID NO: 34771 - DNA, 36 bp, Artificial Sequence
  Synthetic oligonucleotide
acccggtcgggactatatcacatgcatgcatatcca

SEQ ID NO: 34772 - DNA, 37 bp, Artificial Sequence
  Synthetic oligonucleotide
gacgccctgttcttcgttcctttgtcgactgcaccga

SEQ ID NO: 34773 - DNA, 37 bp, Artificial Sequence
  Synthetic oligonucleotide
tagcaagcgcgtatcccaccttgtgccctattcccga

SEQ ID NO: 34774 - DNA, 37 bp, Artificial Sequence
  Synthetic oligonucleotide
actcctgcctgtgatgacgcgcccgtcacgttcccga

SEQ ID NO: 34775 - DNA, 38 bp, Artificial Sequence
  Synthetic oligonucleotide
gccgcatgaaggggattggtggtggtgcagggagatga

SEQ ID NO: 34776 - DNA, 37 bp, Artificial Sequence
  Synthetic oligonucleotide
accagcagggtgcgttgtgaccttcccttgctcctga

SEQ ID NO: 34777 - DNA, 38 bp, Artificial Sequence
  Synthetic oligonucleotide
agggaagtcacagggggacgagggaaggggagatgtga

SEQ ID NO: 34778 - DNA, 38 bp, Artificial Sequence
  Synthetic oligonucleotide
gagtacgatcgcccccatccataagcaacctgcattga

SEQ ID NO: 34779 - DNA, 38 bp, Artificial Sequence
  Synthetic oligonucleotide
gacgagggaggcaagagagttaaaagtgagcggattga

SEQ ID NO: 34780 - DNA, 36 bp, Artificial Sequence
  Synthetic oligonucleotide
aacgcacccgtagaagagttcccaggggtacaggta

SEQ ID NO: 34781 - DNA, 35 bp, Artificial Sequence
  Synthetic oligonucleotide
gaagggcggggaggcgtaggggctggagtcgggta

SEQ ID NO: 34782 - DNA, 36 bp, Artificial Sequence
  Synthetic oligonucleotide
gttgcactccgtctcgcggttcataaacatcactta

SEQ ID NO: 34783 - DNA, 36 bp, Artificial Sequence
  Synthetic oligonucleotide
gtccttgcccaaccaccccggactcacaggatatac

SEQ ID NO: 34784 - DNA, 35 bp, Artificial Sequence
  Synthetic oligonucleotide
taccccgggacttgcccactgagttgttactaccc

SEQ ID NO: 34785 - DNA, 35 bp, Artificial Sequence
  Synthetic oligonucleotide
acgcctcatccccgtagcccttgttacttaaatgc

SEQ ID NO: 34786 - DNA, 35 bp, Artificial Sequence
  Synthetic oligonucleotide
tgaagtaccgcaaccggatcccgccgccatatccg

SEQ ID NO: 34787 - DNA, 35 bp, Artificial Sequence
  Synthetic oligonucleotide
acatgcactccaaaccgaccggcctcttctccgcg

SEQ ID NO: 34788 - DNA, 35 bp, Artificial Sequence
  Synthetic oligonucleotide
gccaccgtgttccagtaatcgttgccttttgtgcg

SEQ ID NO: 34789 - DNA, 35 bp, Artificial Sequence
  Synthetic oligonucleotide
tgccgcccgctcttgaaggcgtcctcccccctagg

SEQ ID NO: 34790 - DNA, 35 bp, Artificial Sequence
  Synthetic oligonucleotide
gtgccagcagattcagtcttcgcccttcacacact

SEQ ID NO: 34791 - DNA, 35 bp, Artificial Sequence
  Synthetic oligonucleotide
ttgatgctcactgtctggcccgaatagccgttgct

SEQ ID NO: 34792 - DNA, 35 bp, Artificial Sequence
  Synthetic oligonucleotide
atgactcgacacgtactgtggtcagtcatcctatt

SEQ ID NO: 34793 - DNA, 35 bp, Artificial Sequence
  Synthetic oligonucleotide
gatccgctacgaccaaccgtcctttacaacgtaaa

SEQ ID NO: 34794 - DNA, 36 bp, Artificial Sequence
  Synthetic oligonucleotide
gtcgccgttattacagttttacgatcaccctgccaa

SEQ ID NO: 34795 - DNA, 36 bp, Artificial Sequence
  Synthetic oligonucleotide
agcgtggcatcccaggcattgtccccatcgtaacca

SEQ ID NO: 34796 - DNA, 35 bp, Artificial Sequence
  Synthetic oligonucleotide
aacgccctctcaacatcaccaaacgtggaactcca

SEQ ID NO: 34797 - DNA, 36 bp, Artificial Sequence
  Synthetic oligonucleotide
tgtctactcacgacgaccgcctctaaaccatttgca

SEQ ID NO: 34798 - DNA, 36 bp, Artificial Sequence
  Synthetic oligonucleotide
tgataatctgacgctcatgccccgctcccatgctca

SEQ ID NO: 34799 - DNA, 37 bp, Artificial Sequence
  Synthetic oligonucleotide
aggatgtgtgggagctgataggatgactggggggaga

SEQ ID NO: 34800 - DNA, 35 bp, Artificial Sequence
  Synthetic oligonucleotide
tgtacacctcactagcaacgccgcatctttgccga

SEQ ID NO: 34801 - DNA, 37 bp, Artificial Sequence
  Synthetic oligonucleotide
atggagaggagcctgggagtattgtgcaggagtggga

SEQ ID NO: 34802 - DNA, 35 bp, Artificial Sequence
  Synthetic oligonucleotide
gagccgaacacctaggctacgacgtcccatctgga

SEQ ID NO: 34803 - DNA, 37 bp, Artificial Sequence
  Synthetic oligonucleotide
gacacacgcccctacatatcagccccgattcaactga

SEQ ID NO: 34804 - DNA, 37 bp, Artificial Sequence
  Synthetic oligonucleotide
agatccaccgactctatcttatttagaaactctctga

SEQ ID NO: 34805 - DNA, 38 bp, Artificial Sequence
  Synthetic oligonucleotide
ttagcgatcctgctgcctagtaacaccttatacgttga

SEQ ID NO: 34806 - DNA, 35 bp, Artificial Sequence
  Synthetic oligonucleotide
acactgcatctctgctaatagcctttggtcatcta

SEQ ID NO: 34807 - DNA, 35 bp, Artificial Sequence
  Synthetic oligonucleotide
taatcctagcccctgccgttgaggccgtgcaaaac

SEQ ID NO: 34808 - DNA, 35 bp, Artificial Sequence
  Synthetic oligonucleotide
tgtccggtgcacggccgcatctacacctcagtccc

SEQ ID NO: 34809 - DNA, 35 bp, Artificial Sequence
  Synthetic oligonucleotide
gagatcgcccgacacttttcacaccaatctgcgcc

SEQ ID NO: 34810 - DNA, 35 bp, Artificial Sequence
  Synthetic oligonucleotide
ataccgccactgctaacgtgtctgctttgttttgc

SEQ ID NO: 34811 - DNA, 35 bp, Artificial Sequence
  Synthetic oligonucleotide
gtgttgcagaaccccgccacgccgcccgccacatc

SEQ ID NO: 34812 - DNA, 35 bp, Artificial Sequence
  Synthetic oligonucleotide
gatcgaccgtaatcgatggcgaactaacccgtctc

SEQ ID NO: 34813 - DNA, 35 bp, Artificial Sequence
  Synthetic oligonucleotide
tactaccagtcgtcacggatctcgtctcgttcttc

SEQ ID NO: 34814 - DNA, 35 bp, Artificial Sequence
  Synthetic oligonucleotide
tgcccctcacggcacccactcccgaagacttcacg

SEQ ID NO: 34815 - DNA, 35 bp, Artificial Sequence
  Synthetic oligonucleotide
gccttgtagccccgacacactttacagaactttcg

SEQ ID NO: 34816 - DNA, 35 bp, Artificial Sequence
  Synthetic oligonucleotide
acgttcaggggtaggtgggtgggagtagatgtctg

SEQ ID NO: 34817 - DNA, 35 bp, Artificial Sequence
  Synthetic oligonucleotide
tacttagcctgcattacctgcccttgtcccctttg

SEQ ID NO: 34818 - DNA, 35 bp, Artificial Sequence
  Synthetic oligonucleotide
gtccgccggctttcctggccccatcccgtggacct

SEQ ID NO: 34819 - DNA, 35 bp, Artificial Sequence
  Synthetic oligonucleotide
gtcgccgaacgctctattcaccgtcttgttagcct

SEQ ID NO: 34820 - DNA, 35 bp, Artificial Sequence
  Synthetic oligonucleotide
ggacacgctgacccctgtaaattgtaacgccatct

SEQ ID NO: 34821 - DNA, 34 bp, Artificial Sequence
  Synthetic oligonucleotide
tactgctcctcgtatcgtttacgcactaacttct

SEQ ID NO: 34822 - DNA, 35 bp, Artificial Sequence
  Synthetic oligonucleotide
tcacgaccggccgcgatgccactgcccatctctgt

SEQ ID NO: 34823 - DNA, 36 bp, Artificial Sequence
  Synthetic oligonucleotide
gagcgaggtagaggagcgggccaaaggtaggacaaa

SEQ ID NO: 34824 - DNA, 37 bp, Artificial Sequence
  Synthetic oligonucleotide
ggggaggaccgtggaaatgggcaggaaaaaacgcaga

SEQ ID NO: 34825 - DNA, 37 bp, Artificial Sequence
  Synthetic oligonucleotide
agccgccacacgccactgacttccaatactgaaacga

SEQ ID NO: 34826 - DNA, 37 bp, Artificial Sequence
  Synthetic oligonucleotide
gacagtggccgacttactatctcaacactttccacga

SEQ ID NO: 34827 - DNA, 35 bp, Artificial Sequence
  Synthetic oligonucleotide
aacatcccaggttctaatacgattacttgccccga

SEQ ID NO: 34828 - DNA, 37 bp, Artificial Sequence
  Synthetic oligonucleotide
tgaagtggagggggggcgcgtgagttcaggaggagga

SEQ ID NO: 34829 - DNA, 37 bp, Artificial Sequence
  Synthetic oligonucleotide
ttccagtccgtaccgcttgaatggcccacttttcgga

SEQ ID NO: 34830 - DNA, 38 bp, Artificial Sequence
  Synthetic oligonucleotide
gaacaggccagtgtacttcgccgcctcaccttatatga

SEQ ID NO: 34831 - DNA, 37 bp, Artificial Sequence
  Synthetic oligonucleotide
ttgcgcctggaactaccactcatgacgccccccttga

SEQ ID NO: 34832 - DNA, 38 bp, Artificial Sequence
  Synthetic oligonucleotide
tgcggacaaggtggagagggaggaacggggaggcttga

SEQ ID NO: 34833 - DNA, 38 bp, Artificial Sequence
  Synthetic oligonucleotide
atgttcgccactatggctttgtatgctggttccgttga

SEQ ID NO: 34834 - DNA, 36 bp, Artificial Sequence
  Synthetic oligonucleotide
ccaacaggacgccactgcgatttctagcccctttga

SEQ ID NO: 34835 - DNA, 35 bp, Artificial Sequence
  Synthetic oligonucleotide
agaccaacctcacattcaacagaagcattcctgac

SEQ ID NO: 34836 - DNA, 35 bp, Artificial Sequence
  Synthetic oligonucleotide
acccggctcaccgtgcagctggtcactttttcccc

SEQ ID NO: 34837 - DNA, 35 bp, Artificial Sequence
  Synthetic oligonucleotide
gccggtaccacgtgaatgcagcttcttcgccttcc

SEQ ID NO: 34838 - DNA, 35 bp, Artificial Sequence
  Synthetic oligonucleotide
ttacgctgttacgggtcccattcgttctatctgtc

SEQ ID NO: 34839 - DNA, 35 bp, Artificial Sequence
  Synthetic oligonucleotide
attgacaccttcccgccctgattcgatattatagg

SEQ ID NO: 34840 - DNA, 35 bp, Artificial Sequence
  Synthetic oligonucleotide
ttgctcgggaggtcagtaattccaaccggctcact

SEQ ID NO: 34841 - DNA, 35 bp, Artificial Sequence
  Synthetic oligonucleotide
ttccttgcagcccatttctcagaagcctccctact

SEQ ID NO: 34842 - DNA, 35 bp, Artificial Sequence
  Synthetic oligonucleotide
gttgcccaggccggtgggagttaacactgggccct

SEQ ID NO: 34843 - DNA, 35 bp, Artificial Sequence
  Synthetic oligonucleotide
atcgccgaccttccaccaccttcggtatattatgt

SEQ ID NO: 34844 - DNA, 35 bp, Artificial Sequence
  Synthetic oligonucleotide
tccattccgctcctacgcccgtcagtggaacactt

SEQ ID NO: 34845 - DNA, 36 bp, Artificial Sequence
  Synthetic oligonucleotide
tcgtccaatccggttcttgtgtactgctttcttaca

SEQ ID NO: 34846 - DNA, 35 bp, Artificial Sequence
  Synthetic oligonucleotide
agccctacctggattcccgaacttttctgtcgcca

SEQ ID NO: 34847 - DNA, 35 bp, Artificial Sequence
  Synthetic oligonucleotide
gaagggtgaaagagtttgatggagataatggggca

SEQ ID NO: 34848 - DNA, 38 bp, Artificial Sequence
  Synthetic oligonucleotide
acccaggcccagactctccggatccgctactaacatga

SEQ ID NO: 34849 - DNA, 38 bp, Artificial Sequence
  Synthetic oligonucleotide
ggaaatggtgggagtgcggagggaggtagacgggctga

SEQ ID NO: 34850 - DNA, 38 bp, Artificial Sequence
  Synthetic oligonucleotide
tcagtcccttcagttcctttttcgcacgttcctgctga

SEQ ID NO: 34851 - DNA, 37 bp, Artificial Sequence
  Synthetic oligonucleotide
acctgtgcccgcccctactatataagtgcccctctga

SEQ ID NO: 34852 - DNA, 38 bp, Artificial Sequence
  Synthetic oligonucleotide
accaccactgtatgctggattcttccacctctaattga

SEQ ID NO: 34853 - DNA, 35 bp, Artificial Sequence
  Synthetic oligonucleotide
tcaggcctacctggtttcgttcttagggccgcacc

SEQ ID NO: 34854 - DNA, 35 bp, Artificial Sequence
  Synthetic oligonucleotide
tcacctttcagaactatcggtgttgcctcttgccc

SEQ ID NO: 34855 - DNA, 35 bp, Artificial Sequence
  Synthetic oligonucleotide
tacagccccggatcttcgtttatacattctccatc

SEQ ID NO: 34856 - DNA, 33 bp, Artificial Sequence
  Synthetic oligonucleotide
atcgaccatcccaccgcccgcgtgcctatccgg

SEQ ID NO: 34857 - DNA, 35 bp, Artificial Sequence
  Synthetic oligonucleotide
tcacgcatcagtaccccccccttggctctacttgg

SEQ ID NO: 34858 - DNA, 35 bp, Artificial Sequence
  Synthetic oligonucleotide
gtggaggagggggagaggggcggggtaatatcact

SEQ ID NO: 34859 - DNA, 35 bp, Artificial Sequence
  Synthetic oligonucleotide
tccgaaaagcccacttgttacctagatcacctact

SEQ ID NO: 34860 - DNA, 35 bp, Artificial Sequence
  Synthetic oligonucleotide
gtccgggcccctatcaagtatgcagctgccgccct

SEQ ID NO: 34861 - DNA, 35 bp, Artificial Sequence
  Synthetic oligonucleotide
gacgatggtaatggcatgggggaagggaaggatct

SEQ ID NO: 34862 - DNA, 33 bp, Artificial Sequence
  Synthetic oligonucleotide
ccaccacgagtcagctttccttccgctctgggt

SEQ ID NO: 34863 - DNA, 35 bp, Artificial Sequence
  Synthetic oligonucleotide
tatctggacctaccgcacaggccgtgcacttcctt

SEQ ID NO: 34864 - DNA, 36 bp, Artificial Sequence
  Synthetic oligonucleotide
gtccgggcctcattgcctcgacgtggaaacatctca

SEQ ID NO: 34865 - DNA, 37 bp, Artificial Sequence
  Synthetic oligonucleotide
ggacagaaaggcgggcgaagggaggtcacggcttaga

SEQ ID NO: 34866 - DNA, 36 bp, Artificial Sequence
  Synthetic oligonucleotide
tatacaccacacttagctactgccagtacagtacga

SEQ ID NO: 34867 - DNA, 37 bp, Artificial Sequence
  Synthetic oligonucleotide
gacgatctgacattggtgatcactcaccccctcccga

SEQ ID NO: 34868 - DNA, 37 bp, Artificial Sequence
  Synthetic oligonucleotide
gacacgacactgatttatggtttgcatctcttctcga

SEQ ID NO: 34869 - DNA, 37 bp, Artificial Sequence
  Synthetic oligonucleotide
ttgcgaagtgtccgattcttttctactcgcctttcga

SEQ ID NO: 34870 - DNA, 37 bp, Artificial Sequence
  Synthetic oligonucleotide
ttcacagtagcgtggggcgggaaggtggtttggggga

SEQ ID NO: 34871 - DNA, 37 bp, Artificial Sequence
  Synthetic oligonucleotide
gaagagacacaggagtacggactgagagggcaatgga

SEQ ID NO: 34872 - DNA, 37 bp, Artificial Sequence
  Synthetic oligonucleotide
tccccctgacaatggttcgcaacacgccactcttgga

SEQ ID NO: 34873 - DNA, 38 bp, Artificial Sequence
  Synthetic oligonucleotide
acacgcaccataacgtgcgtcatctcttaattttctga

SEQ ID NO: 34874 - DNA, 38 bp, Artificial Sequence
  Synthetic oligonucleotide
tagtagtggagtgggaggtcaggagcgttgggggttga

SEQ ID NO: 34875 - DNA, 36 bp, Artificial Sequence
  Synthetic oligonucleotide
gacacacatcatcccgtgacaaccgtccctcatgta

SEQ ID NO: 34876 - DNA, 35 bp, Artificial Sequence
  Synthetic oligonucleotide
atatacctccgaccctgacttgtgaaccgaaaccc

SEQ ID NO: 34877 - DNA, 35 bp, Artificial Sequence
  Synthetic oligonucleotide
gccccccaagacggttccttcataatcagtagtcc

SEQ ID NO: 34878 - DNA, 35 bp, Artificial Sequence
  Synthetic oligonucleotide
gtgaccagcacttctgccaacgtatattatgcggc

SEQ ID NO: 34879 - DNA, 35 bp, Artificial Sequence
  Synthetic oligonucleotide
acagcattagggctcagccggaatgccacatcttc

SEQ ID NO: 34880 - DNA, 35 bp, Artificial Sequence
  Synthetic oligonucleotide
ggggaggctcactgcaatcactcgccaccattttc

SEQ ID NO: 34881 - DNA, 35 bp, Artificial Sequence
  Synthetic oligonucleotide
gacgcacccgacggttctcgcccatgactcttttc

SEQ ID NO: 34882 - DNA, 35 bp, Artificial Sequence
  Synthetic oligonucleotide
aatagtcgccccatcgcttttgaccgcttctctcg

SEQ ID NO: 34883 - DNA, 35 bp, Artificial Sequence
  Synthetic oligonucleotide
acaaggagcaaggcgtgagtaggggtaggataggg

SEQ ID NO: 34884 - DNA, 35 bp, Artificial Sequence
  Synthetic oligonucleotide
gatgtccgaacatatcccgccggggactacatcat

SEQ ID NO: 34885 - DNA, 35 bp, Artificial Sequence
  Synthetic oligonucleotide
gccacctgcccgaaagtacctcctattgagcaact

SEQ ID NO: 34886 - DNA, 35 bp, Artificial Sequence
  Synthetic oligonucleotide
aacatctcgcgctgcctaactccgcgtccgtctct

SEQ ID NO: 34887 - DNA, 35 bp, Artificial Sequence
  Synthetic oligonucleotide
gcacatgtacccagttatctcatctcgctggactt

SEQ ID NO: 34888 - DNA, 36 bp, Artificial Sequence
  Synthetic oligonucleotide
atgaccacctcctcatggcgcattggtcacccgttt

SEQ ID NO: 34889 - DNA, 35 bp, Artificial Sequence
  Synthetic oligonucleotide
aaatggaagggagtaatgtgcgggggaggagcgaa

SEQ ID NO: 34890 - DNA, 36 bp, Artificial Sequence
  Synthetic oligonucleotide
gatgccaagccgcacctaaaaacgaggtatccataa

SEQ ID NO: 34891 - DNA, 36 bp, Artificial Sequence
  Synthetic oligonucleotide
gaaccgagtggccgtaccactccatcctgatccaca

SEQ ID NO: 34892 - DNA, 37 bp, Artificial Sequence
  Synthetic oligonucleotide
tgaagcccacgcgtccagccccattcacgcacccaga

SEQ ID NO: 34893 - DNA, 36 bp, Artificial Sequence
  Synthetic oligonucleotide
gggtcccgactctgcctacactcgctccacccacga

SEQ ID NO: 34894 - DNA, 37 bp, Artificial Sequence
  Synthetic oligonucleotide
tgttcgccctacagtggaacgtagccctctctctgga

SEQ ID NO: 34895 - DNA, 35 bp, Artificial Sequence
  Synthetic oligonucleotide
gccccgcctcccaatccccgtcctctgagtgtgga

SEQ ID NO: 34896 - DNA, 38 bp, Artificial Sequence
  Synthetic oligonucleotide
accacacccgatcctaccttagttgtctgctgagctga

SEQ ID NO: 34897 - DNA, 38 bp, Artificial Sequence
  Synthetic oligonucleotide
gtgcgccgcccaggtctctacgcgaatctatcacttga

SEQ ID NO: 34898 - DNA, 36 bp, Artificial Sequence
  Synthetic oligonucleotide
gcctgtgttgtcgccttgggcccgtttcccctcata

SEQ ID NO: 34899 - DNA, 36 bp, Artificial Sequence
  Synthetic oligonucleotide
tcgtacatccttccccccggcattcagctatgttta

SEQ ID NO: 34900 - DNA, 36 bp, Artificial Sequence
  Synthetic oligonucleotide
gaaaccccatcacgaatgtcttttcgtcactgttta

SEQ ID NO: 34901 - DNA, 35 bp, Artificial Sequence
  Synthetic oligonucleotide
tccccacgcatgtcgaacgctgttccgtgcccacc

SEQ ID NO: 34902 - DNA, 35 bp, Artificial Sequence
  Synthetic oligonucleotide
tcagcacgatcaccttcatgtgatttcactacccc

SEQ ID NO: 34903 - DNA, 35 bp, Artificial Sequence
  Synthetic oligonucleotide
atgttgagcctcaggaaaacaccgtcccaccagtc

SEQ ID NO: 34904 - DNA, 35 bp, Artificial Sequence
  Synthetic oligonucleotide
acgtactcagaatctcctcatggcttcaccctgtc

SEQ ID NO: 34905 - DNA, 35 bp, Artificial Sequence
  Synthetic oligonucleotide
acatcacccatatgacccagacggggcactatttc

SEQ ID NO: 34906 - DNA, 35 bp, Artificial Sequence
  Synthetic oligonucleotide
atccgtgtccggcacctcacatgtctcggcactag

SEQ ID NO: 34907 - DNA, 35 bp, Artificial Sequence
  Synthetic oligonucleotide
tccagcacaactcagcgcgggttcccatcattacg

SEQ ID NO: 34908 - DNA, 35 bp, Artificial Sequence
  Synthetic oligonucleotide
gtatcggggcggcacggagggggaggaacataggg

SEQ ID NO: 34909 - DNA, 35 bp, Artificial Sequence
  Synthetic oligonucleotide
gcttatccatctcgccggcactttccacagccgat

SEQ ID NO: 34910 - DNA, 35 bp, Artificial Sequence
  Synthetic oligonucleotide
tgcgtccctgatctcatccgtttggccaccgatct

SEQ ID NO: 34911 - DNA, 35 bp, Artificial Sequence
  Synthetic oligonucleotide
ttaggaaaggtgcggaatggggagtgagtgcgggt

SEQ ID NO: 34912 - DNA, 35 bp, Artificial Sequence
  Synthetic oligonucleotide
tccacgtgctggaatccaaacctttgttttctggt

SEQ ID NO: 34913 - DNA, 35 bp, Artificial Sequence
  Synthetic oligonucleotide
gccgacggagcgggcaagggaaaaaggtgtgctgt

SEQ ID NO: 34914 - DNA, 35 bp, Artificial Sequence
  Synthetic oligonucleotide
tcatcaacacaccgctgccacgcctagccaccttt

SEQ ID NO: 34915 - DNA, 36 bp, Artificial Sequence
  Synthetic oligonucleotide
gttccacacggccctacatttggtaccttcatgtaa

SEQ ID NO: 34916 - DNA, 36 bp, Artificial Sequence
  Synthetic oligonucleotide
atgacttcctcaactctggtttttgccggggcaaca

SEQ ID NO: 34917 - DNA, 35 bp, Artificial Sequence
  Synthetic oligonucleotide
ggtgaacggagtggaaaacagcaacgaacgagaca

SEQ ID NO: 34918 - DNA, 36 bp, Artificial Sequence
  Synthetic oligonucleotide
gtcattgcccgcgcgcgatattcattcatgcctaca

SEQ ID NO: 34919 - DNA, 36 bp, Artificial Sequence
  Synthetic oligonucleotide
aagtcgcggctccttggtgtttttcctatcccgtca

SEQ ID NO: 34920 - DNA, 36 bp, Artificial Sequence
  Synthetic oligonucleotide
tgtaccggactcgaaaccccccagacacctttgaga

SEQ ID NO: 34921 - DNA, 37 bp, Artificial Sequence
  Synthetic oligonucleotide
gtgagaacgtcaggttttacggatcctcccccgccga

SEQ ID NO: 34922 - DNA, 37 bp, Artificial Sequence
  Synthetic oligonucleotide
tgatgcgagggtagagggggagcacatctggaaagga

SEQ ID NO: 34923 - DNA, 37 bp, Artificial Sequence
  Synthetic oligonucleotide
atcaagacggtcgggggaatggcatatggacagggga

SEQ ID NO: 34924 - DNA, 37 bp, Artificial Sequence
  Synthetic oligonucleotide
actcgccgcccgccccgtaaaggtctcatcattggga

SEQ ID NO: 34925 - DNA, 37 bp, Artificial Sequence
  Synthetic oligonucleotide
atgcagtgcgagcggggcaaggggggattggggatga

SEQ ID NO: 34926 - DNA, 38 bp, Artificial Sequence
  Synthetic oligonucleotide
tcgcaatgcatcgcctcctctgataacacacctcctga

SEQ ID NO: 34927 - DNA, 36 bp, Artificial Sequence
  Synthetic oligonucleotide
gaggtgacgaggggaatgttaaatggtgcacggtga

SEQ ID NO: 34928 - DNA, 38 bp, Artificial Sequence
  Synthetic oligonucleotide
gccaggggcgggacgaaaagccggggtggagcgggtga

SEQ ID NO: 34929 - DNA, 36 bp, Artificial Sequence
  Synthetic oligonucleotide
aatccgccctgtatgcaccctccgtcattgtggtga

SEQ ID NO: 34930 - DNA, 38 bp, Artificial Sequence
  Synthetic oligonucleotide
agtcagcctctgtgcgctttattccgtaccttccttga

SEQ ID NO: 34931 - DNA, 35 bp, Artificial Sequence
  Synthetic oligonucleotide
gcccgaaccaccacatcacctgtcgctggacacac

SEQ ID NO: 34932 - DNA, 35 bp, Artificial Sequence
  Synthetic oligonucleotide
gctaacccagggttcggcataacacacatcttcac

SEQ ID NO: 34933 - DNA, 35 bp, Artificial Sequence
  Synthetic oligonucleotide
gtaccatacacgacactcgcctcgaagactcttac

SEQ ID NO: 34934 - DNA, 35 bp, Artificial Sequence
  Synthetic oligonucleotide
tcccctcctgcctgcaccttaaatacgcatcgagc

SEQ ID NO: 34935 - DNA, 35 bp, Artificial Sequence
  Synthetic oligonucleotide
gagggacgggggacggggggccagggcgccagatc

SEQ ID NO: 34936 - DNA, 35 bp, Artificial Sequence
  Synthetic oligonucleotide
aagatgcaacgctccgcccctatcccgaccgactg

SEQ ID NO: 34937 - DNA, 35 bp, Artificial Sequence
  Synthetic oligonucleotide
gagacaatacgcacatgccctgctcccactcggtg

SEQ ID NO: 34938 - DNA, 37 bp, Artificial Sequence
  Synthetic oligonucleotide
ttgaggagaggatggtgtggcgacggtggtagatgtg

SEQ ID NO: 34939 - DNA, 35 bp, Artificial Sequence
  Synthetic oligonucleotide
agtccttggctcatgctccgtccacacaccttgtg

SEQ ID NO: 34940 - DNA, 35 bp, Artificial Sequence
  Synthetic oligonucleotide
gacatgctgccgttattgggatcgccttgtttcgt

SEQ ID NO: 34941 - DNA, 35 bp, Artificial Sequence
  Synthetic oligonucleotide
gtaacagtgatggcgtgagagggtttgggtgggtt

SEQ ID NO: 34942 - DNA, 36 bp, Artificial Sequence
  Synthetic oligonucleotide
gtcgccactccgaatcctgtaaattagccactgtaa

SEQ ID NO: 34943 - DNA, 35 bp, Artificial Sequence
  Synthetic oligonucleotide
gtcattcgatagccctgtgcctcctccgttcaaca

SEQ ID NO: 34944 - DNA, 37 bp, Artificial Sequence
  Synthetic oligonucleotide
tctagccctcctccagaagcggccgtgaccccgccga

SEQ ID NO: 34945 - DNA, 37 bp, Artificial Sequence
  Synthetic oligonucleotide
acatggcacactgtttcgcgtaccatcgatttgtcga

SEQ ID NO: 34946 - DNA, 38 bp, Artificial Sequence
  Synthetic oligonucleotide
gtgtgtacgcatacggagggaaaattgggctgtagtga

SEQ ID NO: 34947 - DNA, 37 bp, Artificial Sequence
  Synthetic oligonucleotide
tctcgtcccctctacccgacacctgcccaggccttga

SEQ ID NO: 34948 - DNA, 35 bp, Artificial Sequence
  Synthetic oligonucleotide
acgttccctggcgcctgcacatcgcacaccgcata

SEQ ID NO: 34949 - DNA, 36 bp, Artificial Sequence
  Synthetic oligonucleotide
agtcgcagccccggctttacccgcgccgccccccta

SEQ ID NO: 34950 - DNA, 35 bp, Artificial Sequence
  Synthetic oligonucleotide
ttgccggttggctgcctttcgccccttcctataac

SEQ ID NO: 34951 - DNA, 35 bp, Artificial Sequence
  Synthetic oligonucleotide
ttggaaggccttcatccctgtgtccctcttcgccc

SEQ ID NO: 34952 - DNA, 35 bp, Artificial Sequence
  Synthetic oligonucleotide
gcgtatggccagaacacctgctctatattacatcc

SEQ ID NO: 34953 - DNA, 35 bp, Artificial Sequence
  Synthetic oligonucleotide
gcggtgggcgcttaatgcatcttccgacctcattc

SEQ ID NO: 34954 - DNA, 35 bp, Artificial Sequence
  Synthetic oligonucleotide
tgatcacccccgcggagccacttctcttgttagcg

SEQ ID NO: 34955 - DNA, 35 bp, Artificial Sequence
  Synthetic oligonucleotide
ttaccccatcctctatgtcgaatacgcattgcaat

SEQ ID NO: 34956 - DNA, 35 bp, Artificial Sequence
  Synthetic oligonucleotide
tctatctgtgaaccgactgttgtacgcttttccct

SEQ ID NO: 34957 - DNA, 35 bp, Artificial Sequence
  Synthetic oligonucleotide
gacacgtgccaaggtttacttatccctccttaggt

SEQ ID NO: 34958 - DNA, 35 bp, Artificial Sequence
  Synthetic oligonucleotide
taccactcacaaactcgcccggggcacccttcggt

SEQ ID NO: 34959 - DNA, 36 bp, Artificial Sequence
  Synthetic oligonucleotide
gccgtagtctcatatttttcccgggtctgctactca

SEQ ID NO: 34960 - DNA, 37 bp, Artificial Sequence
  Synthetic oligonucleotide
tgcatccatatacactaccgcgtcgccatccccacga

SEQ ID NO: 34961 - DNA, 37 bp, Artificial Sequence
  Synthetic oligonucleotide
gacaggccatctggactttacaacttacctcacccga

SEQ ID NO: 34962 - DNA, 35 bp, Artificial Sequence
  Synthetic oligonucleotide
ggatagccttccgctgctcccaccttactgtccga

SEQ ID NO: 34963 - DNA, 37 bp, Artificial Sequence
  Synthetic oligonucleotide
gcctctccgactgcatcctccctcccacatcttgcga

SEQ ID NO: 34964 - DNA, 37 bp, Artificial Sequence
  Synthetic oligonucleotide
gccattcggctcattgtcatcgcgtcaatcctatcga

SEQ ID NO: 34965 - DNA, 37 bp, Artificial Sequence
  Synthetic oligonucleotide
ttaagccgcctatccacttccaccctaggcctcggga

SEQ ID NO: 34966 - DNA, 35 bp, Artificial Sequence
  Synthetic oligonucleotide
actctgtcccgcactgatgccacctacttttctga

SEQ ID NO: 34967 - DNA, 35 bp, Artificial Sequence
  Synthetic oligonucleotide
actggggcatccctaggtacacattctccttccta

SEQ ID NO: 34968 - DNA, 35 bp, Artificial Sequence
  Synthetic oligonucleotide
gttcgctctatcatcgccatcccgccctggttcac

SEQ ID NO: 34969 - DNA, 35 bp, Artificial Sequence
  Synthetic oligonucleotide
tgtgtgcgaccctgagttttcctcccagcttatac

SEQ ID NO: 34970 - DNA, 35 bp, Artificial Sequence
  Synthetic oligonucleotide
attgtcactcccattttgcatattcgaccccgacc

SEQ ID NO: 34971 - DNA, 35 bp, Artificial Sequence
  Synthetic oligonucleotide
atatcacacatcacacatggcgactgagcttggcc

SEQ ID NO: 34972 - DNA, 35 bp, Artificial Sequence
  Synthetic oligonucleotide
tgatccgcgccttcaagcaccccccgacatgtgcc

SEQ ID NO: 34973 - DNA, 35 bp, Artificial Sequence
  Synthetic oligonucleotide
tcgaccggttttggcccggtaataccttggtctcc

SEQ ID NO: 34974 - DNA, 35 bp, Artificial Sequence
  Synthetic oligonucleotide
gcatcgaccatgaccgtttcttttgccatcgacgc

SEQ ID NO: 34975 - DNA, 35 bp, Artificial Sequence
  Synthetic oligonucleotide
ttctgacaccgctactgactatccgaccttccatc

SEQ ID NO: 34976 - DNA, 35 bp, Artificial Sequence
  Synthetic oligonucleotide
taatcatgccggagagtccccggctggtcttactc

SEQ ID NO: 34977 - DNA, 35 bp, Artificial Sequence
  Synthetic oligonucleotide
ttcgacgcctcgcttgtgcctggctcgttatattc

SEQ ID NO: 34978 - DNA, 35 bp, Artificial Sequence
  Synthetic oligonucleotide
tccaacgtaccaacgcaaatcatcttttttctttc

SEQ ID NO: 34979 - DNA, 35 bp, Artificial Sequence
  Synthetic oligonucleotide
gacgggtcagggtatgccgggcggggagggggaag

SEQ ID NO: 34980 - DNA, 35 bp, Artificial Sequence
  Synthetic oligonucleotide
agtgcccggggaggaggatgggtcacattggattt

SEQ ID NO: 34981 - DNA, 36 bp, Artificial Sequence
  Synthetic oligonucleotide
atgacatccacccttcccgacgccagtctacgataa

SEQ ID NO: 34982 - DNA, 36 bp, Artificial Sequence
  Synthetic oligonucleotide
attgttgccacgcttgccgtgcgccttccttgccca

SEQ ID NO: 34983 - DNA, 36 bp, Artificial Sequence
  Synthetic oligonucleotide
tagcgcctgtcctgtccgtggtttcgttatgcttca

SEQ ID NO: 34984 - DNA, 36 bp, Artificial Sequence
  Synthetic oligonucleotide
gcaaaacaaaggtaattgagggcggtttgggggaga

SEQ ID NO: 34985 - DNA, 37 bp, Artificial Sequence
  Synthetic oligonucleotide
gtctcgccggcctcttactgtctcttccgtcgctaga

SEQ ID NO: 34986 - DNA, 37 bp, Artificial Sequence
  Synthetic oligonucleotide
tcacgcgctgactaccccggtgtcgccgaattcccga

SEQ ID NO: 34987 - DNA, 35 bp, Artificial Sequence
  Synthetic oligonucleotide
gcactccgcctctcccttcgcagtttgtgcgtgga

SEQ ID NO: 34988 - DNA, 36 bp, Artificial Sequence
  Synthetic oligonucleotide
tgcggaggggagggaagtagcctgataagttgtgga

SEQ ID NO: 34989 - DNA, 37 bp, Artificial Sequence
  Synthetic oligonucleotide
gatgctgaggcatgggaactgaagtgggaggtttgga

SEQ ID NO: 34990 - DNA, 38 bp, Artificial Sequence
  Synthetic oligonucleotide
atgcccactgttgcgactaatttactcggcctccttga

SEQ ID NO: 34991 - DNA, 36 bp, Artificial Sequence
  Synthetic oligonucleotide
gacggtcacatggctacttcagtcacacaacccata

SEQ ID NO: 34992 - DNA, 35 bp, Artificial Sequence
  Synthetic oligonucleotide
tatgaccgactcgggcgactactatccaccttata

SEQ ID NO: 34993 - DNA, 36 bp, Artificial Sequence
  Synthetic oligonucleotide
ttcaccgctcacttcaatccgtcttagcacagttta

SEQ ID NO: 34994 - DNA, 35 bp, Artificial Sequence
  Synthetic oligonucleotide
accaactccagtctttctacgagtcaccactgaac

SEQ ID NO: 34995 - DNA, 35 bp, Artificial Sequence
  Synthetic oligonucleotide
gttgcgcagacggcccgaatattccttatcgcccc

SEQ ID NO: 34996 - DNA, 35 bp, Artificial Sequence
  Synthetic oligonucleotide
gccaccggcacggacattaccacctcaccttaatc

SEQ ID NO: 34997 - DNA, 35 bp, Artificial Sequence
  Synthetic oligonucleotide
agccgtgaggagatagtggggggctagtgaaaagg

SEQ ID NO: 34998 - DNA, 35 bp, Artificial Sequence
  Synthetic oligonucleotide
tccatgcacctgcgggttttctacattacctcaat

SEQ ID NO: 34999 - DNA, 35 bp, Artificial Sequence
  Synthetic oligonucleotide
tcatgcgtggggggctacacgtaccatcataacct

SEQ ID NO: 35000 - DNA, 36 bp, Artificial Sequence
  Synthetic oligonucleotide
accacacagtcttttcgtgcacgccttgccatacaa

SEQ ID NO: 35001 - DNA, 36 bp, Artificial Sequence
  Synthetic oligonucleotide
tcacatccctttggtgtctattattctgccggaaca

SEQ ID NO: 35002 - DNA, 36 bp, Artificial Sequence
  Synthetic oligonucleotide
actcagtgtcctgcatttccctccacacatctatca

SEQ ID NO: 35003 - DNA, 35 bp, Artificial Sequence
  Synthetic oligonucleotide
tcgttaccgcatagggccatctgtcctcaccttca

SEQ ID NO: 35004 - DNA, 36 bp, Artificial Sequence
  Synthetic oligonucleotide
tacgaccgcattgcctcgccccggaaccctgaagga

SEQ ID NO: 35005 - DNA, 37 bp, Artificial Sequence
  Synthetic oligonucleotide
tttgctgacgtaccgaccgttctattgcgccaccgga

SEQ ID NO: 35006 - DNA, 37 bp, Artificial Sequence
  Synthetic oligonucleotide
gggacctccatctcgcttgtgccctaaaccaccggga

SEQ ID NO: 35007 - DNA, 37 bp, Artificial Sequence
  Synthetic oligonucleotide
acaagcgctgcccccctcaccattccgacttcatgga

SEQ ID NO: 35008 - DNA, 38 bp, Artificial Sequence
  Synthetic oligonucleotide
tctaccaccgctcttaccgctatttagttcgtcactga

SEQ ID NO: 35009 - DNA, 38 bp, Artificial Sequence
  Synthetic oligonucleotide
caaaatgggagggcgggttatcctggaaaagggactga

SEQ ID NO: 35010 - DNA, 38 bp, Artificial Sequence
  Synthetic oligonucleotide
tgaccgatgtgactccgattccccgtactcatccctga

SEQ ID NO: 35011 - DNA, 38 bp, Artificial Sequence
  Synthetic oligonucleotide
attaacctgccctgataccgctaacaccatgtcgctga

SEQ ID NO: 35012 - DNA, 38 bp, Artificial Sequence
  Synthetic oligonucleotide
gaacaccgctggcactcccccctggtcccgttctctga

SEQ ID NO: 35013 - DNA, 37 bp, Artificial Sequence
  Synthetic oligonucleotide
gagacgacccctcggtctggtacacacattcttctga

SEQ ID NO: 35014 - DNA, 38 bp, Artificial Sequence
  Synthetic oligonucleotide
tcagcccatctcttagttttcggttgtccctgccttga

SEQ ID NO: 35015 - DNA, 38 bp, Artificial Sequence
  Synthetic oligonucleotide
tgctcccgggccatttggattcgatcttccatctttga

SEQ ID NO: 35016 - DNA, 36 bp, Artificial Sequence
  Synthetic oligonucleotide
tttcaccgcatcgcccggttttcccatcccttcgta

SEQ ID NO: 35017 - DNA, 36 bp, Artificial Sequence
  Synthetic oligonucleotide
ttagcccatcaccggtatgctggagtttttccctta

SEQ ID NO: 35018 - DNA, 35 bp, Artificial Sequence
  Synthetic oligonucleotide
gccccatcgcctgaagcctcccgtggtcgacggac

SEQ ID NO: 35019 - DNA, 35 bp, Artificial Sequence
  Synthetic oligonucleotide
tgacacctgacggagttttatctcaggtagcttac

SEQ ID NO: 35020 - DNA, 35 bp, Artificial Sequence
  Synthetic oligonucleotide
acccgtacgctgcatcgatcctcgctatccaaagc

SEQ ID NO: 35021 - DNA, 35 bp, Artificial Sequence
  Synthetic oligonucleotide
agaccaagacagctcttccactcacgcgaccgggc

SEQ ID NO: 35022 - DNA, 35 bp, Artificial Sequence
  Synthetic oligonucleotide
aactatcaagccaccctcagctctgcctatatttg

SEQ ID NO: 35023 - DNA, 35 bp, Artificial Sequence
  Synthetic oligonucleotide
gtccccactagtctcgcgctgtcaccccccattat

SEQ ID NO: 35024 - DNA, 35 bp, Artificial Sequence
  Synthetic oligonucleotide
tcaattaccgcttgccatgactgggacatcatact

SEQ ID NO: 35025 - DNA, 35 bp, Artificial Sequence
  Synthetic oligonucleotide
acaaactcgccagcttgccgttagtctctttctct

SEQ ID NO: 35026 - DNA, 35 bp, Artificial Sequence
  Synthetic oligonucleotide
atgctcaacggtatgcgtttccacgatccccaagt

SEQ ID NO: 35027 - DNA, 36 bp, Artificial Sequence
  Synthetic oligonucleotide
gcaccttccacaccgctgacgcgaaagttcaacgaa

SEQ ID NO: 35028 - DNA, 35 bp, Artificial Sequence
  Synthetic oligonucleotide
tatcgccacgaacgctttaacacgcaaccaccaca

SEQ ID NO: 35029 - DNA, 36 bp, Artificial Sequence
  Synthetic oligonucleotide
tgcggtcccacgttctcattgccggaactaactaca

SEQ ID NO: 35030 - DNA, 36 bp, Artificial Sequence
  Synthetic oligonucleotide
gcgcactgcacgtggctgtctggaatgatctcccca

SEQ ID NO: 35031 - DNA, 36 bp, Artificial Sequence
  Synthetic oligonucleotide
acccccccgagatgcggagccgttatcatttcgcca

SEQ ID NO: 35032 - DNA, 36 bp, Artificial Sequence
  Synthetic oligonucleotide
gaacccgacggttcgtctccccccatctctggttca

SEQ ID NO: 35033 - DNA, 36 bp, Artificial Sequence
  Synthetic oligonucleotide
gcgtcgcacctcactctgacgcatcctgttcccaga

SEQ ID NO: 35034 - DNA, 37 bp, Artificial Sequence
  Synthetic oligonucleotide
tgcccccgactcctgaccacctcatgacactgaatga

SEQ ID NO: 35035 - DNA, 38 bp, Artificial Sequence
  Synthetic oligonucleotide
ttgtggggagcggggggagatggtagcgaagggcttga

SEQ ID NO: 35036 - DNA, 37 bp, Artificial Sequence
  Synthetic oligonucleotide
aacttgtgggggaggaatggaacaaggagaaggttga

SEQ ID NO: 35037 - DNA, 37 bp, Artificial Sequence
  Synthetic oligonucleotide
tgtgcaagcaatgggtggtgggcggtagaggatttga

SEQ ID NO: 35038 - DNA, 38 bp, Artificial Sequence
  Synthetic oligonucleotide
acagacgacgctaagtccacaccatctacacattttga

SEQ ID NO: 35039 - DNA, 35 bp, Artificial Sequence
  Synthetic oligonucleotide
gccgctcgtacacatcatctacgcgacctcgatta

SEQ ID NO: 35040 - DNA, 35 bp, Artificial Sequence
  Synthetic oligonucleotide
tgcgaccgcccttattcacttctacgccgatttac

SEQ ID NO: 35041 - DNA, 35 bp, Artificial Sequence
  Synthetic oligonucleotide
tctgacatccgacgcgtaccaccgtgccaggtacc

SEQ ID NO: 35042 - DNA, 35 bp, Artificial Sequence
  Synthetic oligonucleotide
atccgagatcacctccatgtcttctcacatatgcc

SEQ ID NO: 35043 - DNA, 35 bp, Artificial Sequence
  Synthetic oligonucleotide
ggggggggaggaacggactgaaaagtcgcagggcg

SEQ ID NO: 35044 - DNA, 35 bp, Artificial Sequence
  Synthetic oligonucleotide
tcagtaacgcggttatatcttgctctcccgttgtg

SEQ ID NO: 35045 - DNA, 37 bp, Artificial Sequence
  Synthetic oligonucleotide
ggacaggggtggcggaacagggtgggtgcggtcaaga

SEQ ID NO: 35046 - DNA, 37 bp, Artificial Sequence
  Synthetic oligonucleotide
gactcggtgtctggggagttggggggagcacggacga

SEQ ID NO: 35047 - DNA, 37 bp, Artificial Sequence
  Synthetic oligonucleotide
gacgtagcccccacgaagcaccaaacacctcgttcga

SEQ ID NO: 35048 - DNA, 37 bp, Artificial Sequence
  Synthetic oligonucleotide
tgtgggccatctgtttcctagccacccttgatatgga

SEQ ID NO: 35049 - DNA, 35 bp, Artificial Sequence
  Synthetic oligonucleotide
tcaagggggccgatcgggtagggggtttgagtgga

SEQ ID NO: 35050 - DNA, 38 bp, Artificial Sequence
  Synthetic oligonucleotide
ggggtgaggaagaaagtggtagtagctgttgggactga

SEQ ID NO: 35051 - DNA, 36 bp, Artificial Sequence
  Synthetic oligonucleotide
tgttcgcctgacgttcgtttacctttccctacctga

SEQ ID NO: 35052 - DNA, 38 bp, Artificial Sequence
  Synthetic oligonucleotide
tgccccgacccgcattccccataaacaggttcccgtga

SEQ ID NO: 35053 - DNA, 37 bp, Artificial Sequence
  Synthetic oligonucleotide
tacaaccgtacaggcatatgcgcacacaccttcccta

SEQ ID NO: 35054 - DNA, 35 bp, Artificial Sequence
  Synthetic oligonucleotide
gcccacacccaccgactgctcgaccgtttgaatgc

SEQ ID NO: 35055 - DNA, 35 bp, Artificial Sequence
  Synthetic oligonucleotide
atccacggatccattttcgaccaccgtcctgttct

SEQ ID NO: 35056 - DNA, 35 bp, Artificial Sequence
  Synthetic oligonucleotide
tgctgtacgagcctgtctaccactcctatttctgt

SEQ ID NO: 35057 - DNA, 35 bp, Artificial Sequence
  Synthetic oligonucleotide
aaggtagggtgggttggtgggtatggagtgtgtgt

SEQ ID NO: 35058 - DNA, 35 bp, Artificial Sequence
  Synthetic oligonucleotide
tgcgacaccttaggcgcatcattttcccctacctt

SEQ ID NO: 35059 - DNA, 36 bp, Artificial Sequence
  Synthetic oligonucleotide
gctccaccatcacataggccttctgttgtttacaaa

SEQ ID NO: 35060 - DNA, 36 bp, Artificial Sequence
  Synthetic oligonucleotide
ggtgcgtacaagactatttgccacctgcccacacaa

SEQ ID NO: 35061 - DNA, 35 bp, Artificial Sequence
  Synthetic oligonucleotide
gtaggagggcccaaagtaaatcgggggaagaagaa

SEQ ID NO: 35062 - DNA, 36 bp, Artificial Sequence
  Synthetic oligonucleotide
ttgcaggacggtggcaaaagggggggggaaggttaa

SEQ ID NO: 35063 - DNA, 36 bp, Artificial Sequence
  Synthetic oligonucleotide
atccgcaggccgtaaccatgcgtactgtacttaaca

SEQ ID NO: 35064 - DNA, 36 bp, Artificial Sequence
  Synthetic oligonucleotide
atacctgaggtcgcccttgtttgagcacccctgcca

SEQ ID NO: 35065 - DNA, 36 bp, Artificial Sequence
  Synthetic oligonucleotide
ggaagaggggggtgagtggagtggctgaagggatca

SEQ ID NO: 35066 - DNA, 35 bp, Artificial Sequence
  Synthetic oligonucleotide
tggtccctcctcggtcacgcattaccatcgcctca

SEQ ID NO: 35067 - DNA, 37 bp, Artificial Sequence
  Synthetic oligonucleotide
acacggagcagccacccagccttacaccctctttaga

SEQ ID NO: 35068 - DNA, 37 bp, Artificial Sequence
  Synthetic oligonucleotide
gagtgggggacggcataaaggtttcgtagggcgggga

SEQ ID NO: 35069 - DNA, 37 bp, Artificial Sequence
  Synthetic oligonucleotide
tagggggcggtggtatggggaagctagcttcggtgga

SEQ ID NO: 35070 - DNA, 38 bp, Artificial Sequence
  Synthetic oligonucleotide
aacacccggcgccctttactctctggccctttacctga

SEQ ID NO: 35071 - DNA, 37 bp, Artificial Sequence
  Synthetic oligonucleotide
atggacactccactcagccctctaccacacaacgtga

SEQ ID NO: 35072 - DNA, 37 bp, Artificial Sequence
  Synthetic oligonucleotide
gtccgaggtcggcttacttctctgcgccatcctttga

SEQ ID NO: 35073 - DNA, 35 bp, Artificial Sequence
  Synthetic oligonucleotide
tgacggtcgtacgtctagtgccacgtgctctcaac

SEQ ID NO: 35074 - DNA, 35 bp, Artificial Sequence
  Synthetic oligonucleotide
gtgggggcaagggtccctcatagccatctttacac

SEQ ID NO: 35075 - DNA, 35 bp, Artificial Sequence
  Synthetic oligonucleotide
tgattacctcatttggcttctcatagccagtccac

SEQ ID NO: 35076 - DNA, 35 bp, Artificial Sequence
  Synthetic oligonucleotide
tcaatcatcactttttaagtaccgttctcccagcc

SEQ ID NO: 35077 - DNA, 35 bp, Artificial Sequence
  Synthetic oligonucleotide
gcgcattgtccactttattctccataccacgggcc

SEQ ID NO: 35078 - DNA, 35 bp, Artificial Sequence
  Synthetic oligonucleotide
gtggtgaagagacgagtgaagggggtggataggcg

SEQ ID NO: 35079 - DNA, 35 bp, Artificial Sequence
  Synthetic oligonucleotide
tacccagcgcagaccgtcaggcccatcccgtactg

SEQ ID NO: 35080 - DNA, 35 bp, Artificial Sequence
  Synthetic oligonucleotide
gccgacgtagcccctgatgcattcgtcgaacctct

SEQ ID NO: 35081 - DNA, 35 bp, Artificial Sequence
  Synthetic oligonucleotide
aattgcggcactgtttgttgttccctggcccttct

SEQ ID NO: 35082 - DNA, 35 bp, Artificial Sequence
  Synthetic oligonucleotide
agcaacaccattacacccattcacacacgtgcctt

SEQ ID NO: 35083 - DNA, 35 bp, Artificial Sequence
  Synthetic oligonucleotide
gctttgtccgctactacttccctgcatttgctgtt

SEQ ID NO: 35084 - DNA, 35 bp, Artificial Sequence
  Synthetic oligonucleotide
gcttcccatgcgctatggctctatcaccctgcaaa

SEQ ID NO: 35085 - DNA, 36 bp, Artificial Sequence
  Synthetic oligonucleotide
tttaccgtgcactgacgcgactcgaccttctcccaa

SEQ ID NO: 35086 - DNA, 35 bp, Artificial Sequence
  Synthetic oligonucleotide
agcaccccccaattgtatcccatcatcgatcataa

SEQ ID NO: 35087 - DNA, 36 bp, Artificial Sequence
  Synthetic oligonucleotide
tgtacctgggcccagactttatatcgaacctgcaca

SEQ ID NO: 35088 - DNA, 36 bp, Artificial Sequence
  Synthetic oligonucleotide
acacacctgactgtggacctattcccgttcttgtca

SEQ ID NO: 35089 - DNA, 37 bp, Artificial Sequence
  Synthetic oligonucleotide
atgatcgagagatgggaagaacgggaagaattgaaga

SEQ ID NO: 35090 - DNA, 35 bp, Artificial Sequence
  Synthetic oligonucleotide
tctgaccccaccaacctgttcacttggactttaga

SEQ ID NO: 35091 - DNA, 37 bp, Artificial Sequence
  Synthetic oligonucleotide
gcacagaggtgggtggaggggctagtggatagtcgga

SEQ ID NO: 35092 - DNA, 37 bp, Artificial Sequence
  Synthetic oligonucleotide
acggactgaggctgaaggttaggggggatggagggga

SEQ ID NO: 35093 - DNA, 38 bp, Artificial Sequence
  Synthetic oligonucleotide
ggatcactctgcactggagccgccataccccaacctga

SEQ ID NO: 35094 - DNA, 38 bp, Artificial Sequence
  Synthetic oligonucleotide
ttacacgctgggacgtacctatgccttatctaccgtga

SEQ ID NO: 35095 - DNA, 37 bp, Artificial Sequence
  Synthetic oligonucleotide
aacccaccgctgaatcgttctctatggtcctgattga

SEQ ID NO: 35096 - DNA, 36 bp, Artificial Sequence
  Synthetic oligonucleotide
tctgccaggctggctgctggcattcattcgatccta

SEQ ID NO: 35097 - DNA, 35 bp, Artificial Sequence
  Synthetic oligonucleotide
gatgtccatgtgtggccccgctggcgctatctcta

SEQ ID NO: 35098 - DNA, 35 bp, Artificial Sequence
  Synthetic oligonucleotide
accccgtcgagcccccatttgacctttggtgatac

SEQ ID NO: 35099 - DNA, 35 bp, Artificial Sequence
  Synthetic oligonucleotide
gcccagtgtataggtcccattatctcgaccccacc

SEQ ID NO: 35100 - DNA, 35 bp, Artificial Sequence
  Synthetic oligonucleotide
acactgacgagaacccttatgccccgtgtaagccc

SEQ ID NO: 35101 - DNA, 35 bp, Artificial Sequence
  Synthetic oligonucleotide
agatcataccgttccgcttattcgacacctttgcc

SEQ ID NO: 35102 - DNA, 35 bp, Artificial Sequence
  Synthetic oligonucleotide
tactagggtcccagctgggcaatctaacatctctc

SEQ ID NO: 35103 - DNA, 35 bp, Artificial Sequence
  Synthetic oligonucleotide
actcccccgggatcacacttgtatattcgtacccg

SEQ ID NO: 35104 - DNA, 35 bp, Artificial Sequence
  Synthetic oligonucleotide
gcaccgcctgtcgcaaggccctcctattgtttccg

SEQ ID NO: 35105 - DNA, 35 bp, Artificial Sequence
  Synthetic oligonucleotide
ttcatgggacctatcggtggtgggtggttggggtg

SEQ ID NO: 35106 - DNA, 35 bp, Artificial Sequence
  Synthetic oligonucleotide
agatcacgtcctcatcgctgacctgtaccgcctat

SEQ ID NO: 35107 - DNA, 35 bp, Artificial Sequence
  Synthetic oligonucleotide
ttgcgtctggcccctcttgcttcactcctcgtggt

SEQ ID NO: 35108 - DNA, 36 bp, Artificial Sequence
  Synthetic oligonucleotide
actcagggccatctttatactgccttcccgctcgaa

SEQ ID NO: 35109 - DNA, 36 bp, Artificial Sequence
  Synthetic oligonucleotide
gactatgagcgttgaccttcactcctccgtctcaca

SEQ ID NO: 35110 - DNA, 36 bp, Artificial Sequence
  Synthetic oligonucleotide
gctcgccaaactcctacatcggtatccatgcacgca

SEQ ID NO: 35111 - DNA, 36 bp, Artificial Sequence
  Synthetic oligonucleotide
tctgattcggtcgggccatggcgatttcttctttca

SEQ ID NO: 35112 - DNA, 37 bp, Artificial Sequence
  Synthetic oligonucleotide
gtgtgcccgagtcctgcctaacttctgccccttacga

SEQ ID NO: 35113 - DNA, 37 bp, Artificial Sequence
  Synthetic oligonucleotide
gtcacgtgtgacacggatgcagggaccagttagagga

SEQ ID NO: 35114 - DNA, 36 bp, Artificial Sequence
  Synthetic oligonucleotide
gcctacagcactaaagcctacactacccacactgga

SEQ ID NO: 35115 - DNA, 38 bp, Artificial Sequence
  Synthetic oligonucleotide
gagtcgttaccaccccgccgcattaacatttcgcctga

SEQ ID NO: 35116 - DNA, 38 bp, Artificial Sequence
  Synthetic oligonucleotide
tgcccgcacactacacctcatctaatctcagtcgttga

SEQ ID NO: 35117 - DNA, 35 bp, Artificial Sequence
  Synthetic oligonucleotide
gcttcgcacagcacagctcgccccagtcctgcaac

SEQ ID NO: 35118 - DNA, 35 bp, Artificial Sequence
  Synthetic oligonucleotide
gaacacggacttctatattggcctcggtaccccac

SEQ ID NO: 35119 - DNA, 35 bp, Artificial Sequence
  Synthetic oligonucleotide
gctcgcgaagtgtctcacgtgcgattccccccacc

SEQ ID NO: 35120 - DNA, 34 bp, Artificial Sequence
  Synthetic oligonucleotide
gaggtcaacataccacctcagcagtccgccggcc

SEQ ID NO: 35121 - DNA, 35 bp, Artificial Sequence
  Synthetic oligonucleotide
gacttgcaggccggcccgatttctttccatttgcc

SEQ ID NO: 35122 - DNA, 35 bp, Artificial Sequence
  Synthetic oligonucleotide
tcagattgagctggctccacctcattaacccttcc

SEQ ID NO: 35123 - DNA, 35 bp, Artificial Sequence
  Synthetic oligonucleotide
gttgggaagccctatccctcgttcgaatcgttgtc

SEQ ID NO: 35124 - DNA, 35 bp, Artificial Sequence
  Synthetic oligonucleotide
tacgttcactatcactgtgtgtgaatccttttgtc

SEQ ID NO: 35125 - DNA, 35 bp, Artificial Sequence
  Synthetic oligonucleotide
attgcccgccccattctccgtacgtccaccgctcg

SEQ ID NO: 35126 - DNA, 35 bp, Artificial Sequence
  Synthetic oligonucleotide
gtatggagggcgggtttggcaaaaatggtggatgg

SEQ ID NO: 35127 - DNA, 35 bp, Artificial Sequence
  Synthetic oligonucleotide
tccagctcagacgtctcccacgcgcccctttcctg

SEQ ID NO: 35128 - DNA, 35 bp, Artificial Sequence
  Synthetic oligonucleotide
agccgcaatgctgtaatcctacctctctagttttg

SEQ ID NO: 35129 - DNA, 35 bp, Artificial Sequence
  Synthetic oligonucleotide
gccaatagctcaggagaggaaggggggtaagcact

SEQ ID NO: 35130 - DNA, 35 bp, Artificial Sequence
  Synthetic oligonucleotide
tgtcatccctcctctctctaggtccataagaccgt

SEQ ID NO: 35131 - DNA, 35 bp, Artificial Sequence
  Synthetic oligonucleotide
atcccatcagcctagccctatccccgttttacggt

SEQ ID NO: 35132 - DNA, 36 bp, Artificial Sequence
  Synthetic oligonucleotide
gcacccgaaggtactttggaccgaagccttgcacca

SEQ ID NO: 35133 - DNA, 36 bp, Artificial Sequence
  Synthetic oligonucleotide
gaaacgtgcagtacaaatcttgccactacgtaccca

SEQ ID NO: 35134 - DNA, 36 bp, Artificial Sequence
  Synthetic oligonucleotide
tgaaacctcagtaacggttgagttacgtacttccca

SEQ ID NO: 35135 - DNA, 35 bp, Artificial Sequence
  Synthetic oligonucleotide
ataaagggggggcgggaccgaagttggggcatcca

SEQ ID NO: 35136 - DNA, 35 bp, Artificial Sequence
  Synthetic oligonucleotide
ttagcaattcccgctgctgaataccacacaacgca

SEQ ID NO: 35137 - DNA, 35 bp, Artificial Sequence
  Synthetic oligonucleotide
actcatccgccacccgctcagtccccgcactcgca

SEQ ID NO: 35138 - DNA, 36 bp, Artificial Sequence
  Synthetic oligonucleotide
gacacgacgggtcatgactaaccgctttcccctgca

SEQ ID NO: 35139 - DNA, 35 bp, Artificial Sequence
  Synthetic oligonucleotide
ttgggaaggttggaggtgtgggcgtggggaataga

SEQ ID NO: 35140 - DNA, 36 bp, Artificial Sequence
  Synthetic oligonucleotide
gcataccaattaaccccgccgccaatggtccaccga

SEQ ID NO: 35141 - DNA, 37 bp, Artificial Sequence
  Synthetic oligonucleotide
tcaccacctctaggtgccttcgataccttcccctcga

SEQ ID NO: 35142 - DNA, 36 bp, Artificial Sequence
  Synthetic oligonucleotide
aaaacgggggaaggaggaaatcgcagccagctcgga

SEQ ID NO: 35143 - DNA, 37 bp, Artificial Sequence
  Synthetic oligonucleotide
ccccaaaccgtatgtctatccaggttacgtatcgtga

SEQ ID NO: 35144 - DNA, 38 bp, Artificial Sequence
  Synthetic oligonucleotide
ccagtgctcagccgaggccctgacatccgcccccttga

SEQ ID NO: 35145 - DNA, 35 bp, Artificial Sequence
  Synthetic oligonucleotide
gccatccatctctttgtgcgaccgtacccaacata

SEQ ID NO: 35146 - DNA, 36 bp, Artificial Sequence
  Synthetic oligonucleotide
tcgaagcgattccgactggtcaccctcgctcccgta

SEQ ID NO: 35147 - DNA, 35 bp, Artificial Sequence
  Synthetic oligonucleotide
ttgtgccaccttgtaagcgctgcaattaccgtaac

SEQ ID NO: 35148 - DNA, 35 bp, Artificial Sequence
  Synthetic oligonucleotide
gacaaccacataacactcagctccaccgtcaaagc

SEQ ID NO: 35149 - DNA, 35 bp, Artificial Sequence
  Synthetic oligonucleotide
tcatacgctagctcttctcgtacctacgccacggc

SEQ ID NO: 35150 - DNA, 35 bp, Artificial Sequence
  Synthetic oligonucleotide
atccctccattcaccgttgcaagctacaagccggc

SEQ ID NO: 35151 - DNA, 35 bp, Artificial Sequence
  Synthetic oligonucleotide
gcagccgcaccatccccatttgaaggcacccaatc

SEQ ID NO: 35152 - DNA, 35 bp, Artificial Sequence
  Synthetic oligonucleotide
taaccgtagaggtgtctcccttaccggcccctttc

SEQ ID NO: 35153 - DNA, 35 bp, Artificial Sequence
  Synthetic oligonucleotide
ggtcgcgactgtcccccgagttccgctccctcgct

SEQ ID NO: 35154 - DNA, 35 bp, Artificial Sequence
  Synthetic oligonucleotide
gtccccgcacccacccgggagctcccaatcaaatt

SEQ ID NO: 35155 - DNA, 35 bp, Artificial Sequence
  Synthetic oligonucleotide
ttaccttccccgccttgttgtgtgcgtcgtacctt

SEQ ID NO: 35156 - DNA, 36 bp, Artificial Sequence
  Synthetic oligonucleotide
gccgaccgtctcccgtaacattccacctgctaccaa

SEQ ID NO: 35157 - DNA, 36 bp, Artificial Sequence
  Synthetic oligonucleotide
aaacgcctcgcgtgcccgttcaccccgtccctccaa

SEQ ID NO: 35158 - DNA, 36 bp, Artificial Sequence
  Synthetic oligonucleotide
aagactcgaccacggtccgccctgataaaccacaca

SEQ ID NO: 35159 - DNA, 36 bp, Artificial Sequence
  Synthetic oligonucleotide
ggacccaacctatcgtatgcaccccgccgtgggcca

SEQ ID NO: 35160 - DNA, 35 bp, Artificial Sequence
  Synthetic oligonucleotide
actgggtcctatccgcacgcctgcacttctccgca

SEQ ID NO: 35161 - DNA, 36 bp, Artificial Sequence
  Synthetic oligonucleotide
tcccgttgaccggcgttggttctccccgctgcctca

SEQ ID NO: 35162 - DNA, 37 bp, Artificial Sequence
  Synthetic oligonucleotide
gaaggggaggagaggtcgcgtggaacaggcgagtaga

SEQ ID NO: 35163 - DNA, 37 bp, Artificial Sequence
  Synthetic oligonucleotide
gcccgagtcgtttgctcatcacccgccccttacacga

SEQ ID NO: 35164 - DNA, 37 bp, Artificial Sequence
  Synthetic oligonucleotide
gagtggagggcgggatttgcgcacacagggagaagga

SEQ ID NO: 35165 - DNA, 37 bp, Artificial Sequence
  Synthetic oligonucleotide
tagagagagggaagtcgtttaggggaagtcgggtgga

SEQ ID NO: 35166 - DNA, 35 bp, Artificial Sequence
  Synthetic oligonucleotide
tgcgctgaccactttgattctcatttacaccatga

SEQ ID NO: 35167 - DNA, 38 bp, Artificial Sequence
  Synthetic oligonucleotide
acgctgatgtccgcggcttttactttttttcccagtga

SEQ ID NO: 35168 - DNA, 38 bp, Artificial Sequence
  Synthetic oligonucleotide
gtggtccgcgcgtgagggggagggtgcagagggattga

SEQ ID NO: 35169 - DNA, 38 bp, Artificial Sequence
  Synthetic oligonucleotide
atgcaacccgatgtcgcaaccctcctagctgactttga

SEQ ID NO: 35170 - DNA, 35 bp, Artificial Sequence
  Synthetic oligonucleotide
tactccacaccctgagtcgaatccgcgaccaacta

SEQ ID NO: 35171 - DNA, 36 bp, Artificial Sequence
  Synthetic oligonucleotide
tgacctggactcatgcctctctttactagcaaccta

SEQ ID NO: 35172 - DNA, 35 bp, Artificial Sequence
  Synthetic oligonucleotide
gacgcaacacatcgggcggcgcgggggtggggtta

SEQ ID NO: 35173 - DNA, 35 bp, Artificial Sequence
  Synthetic oligonucleotide
atccgcccctcctagttcgttttccgggccctaac

SEQ ID NO: 35174 - DNA, 35 bp, Artificial Sequence
  Synthetic oligonucleotide
tcatcccatcgtcttgtttccagcgattttgaacc

SEQ ID NO: 35175 - DNA, 35 bp, Artificial Sequence
  Synthetic oligonucleotide
atatccacaggtgccccacgatacgtgcctattgc

SEQ ID NO: 35176 - DNA, 35 bp, Artificial Sequence
  Synthetic oligonucleotide
gtgagacgtcttattctctcttgtctgctctttgc

SEQ ID NO: 35177 - DNA, 35 bp, Artificial Sequence
  Synthetic oligonucleotide
ttccacgtaatcacctgtcacaacccgacgactcg

SEQ ID NO: 35178 - DNA, 35 bp, Artificial Sequence
  Synthetic oligonucleotide
actgcctaccatgccacttgttccgaaaggcctat

SEQ ID NO: 35179 - DNA, 35 bp, Artificial Sequence
  Synthetic oligonucleotide
tgccccgtccctcgtccttgtagctacggccaact

SEQ ID NO: 35180 - DNA, 35 bp, Artificial Sequence
  Synthetic oligonucleotide
agcctgcgcccggaacatcatgtctctatcacttt

SEQ ID NO: 35181 - DNA, 35 bp, Artificial Sequence
  Synthetic oligonucleotide
tcatgatccagggctctcgtattgctgcctgcaca

SEQ ID NO: 35182 - DNA, 36 bp, Artificial Sequence
  Synthetic oligonucleotide
ttacccgaacactgtcaagacctgaatgtcacccca

SEQ ID NO: 35183 - DNA, 37 bp, Artificial Sequence
  Synthetic oligonucleotide
gtcaatgtgccgagagggagggaaagtggatccggga

SEQ ID NO: 35184 - DNA, 37 bp, Artificial Sequence
  Synthetic oligonucleotide
tgacatgaacggggtagggagcggtagtatcattgga

SEQ ID NO: 35185 - DNA, 37 bp, Artificial Sequence
  Synthetic oligonucleotide
atgtcccccgcaaatcaaattgaatcgtctctttgga

SEQ ID NO: 35186 - DNA, 38 bp, Artificial Sequence
  Synthetic oligonucleotide
agctcgcacgctgaactcgcccaatcacacgccaatga

SEQ ID NO: 35187 - DNA, 35 bp, Artificial Sequence
  Synthetic oligonucleotide
gtccgccgtatctggcaatggatttgtctttcgta

SEQ ID NO: 35188 - DNA, 35 bp, Artificial Sequence
  Synthetic oligonucleotide
tagtacactcccttgggcctaggggaaccgctacc

SEQ ID NO: 35189 - DNA, 36 bp, Artificial Sequence
  Synthetic oligonucleotide
acctgccccgaataaggcctctcatcgcaacgtgcc

SEQ ID NO: 35190 - DNA, 35 bp, Artificial Sequence
  Synthetic oligonucleotide
agacaccacatctcttggatatgcaatgttacatc

SEQ ID NO: 35191 - DNA, 35 bp, Artificial Sequence
  Synthetic oligonucleotide
gcaggggtacaagtttctgtccgtgccgttacctc

SEQ ID NO: 35192 - DNA, 35 bp, Artificial Sequence
  Synthetic oligonucleotide
ttggtcactaccatctactgctctgcctctgaccg

SEQ ID NO: 35193 - DNA, 35 bp, Artificial Sequence
  Synthetic oligonucleotide
actttcccccgaccgcactgtaacctggatagaat

SEQ ID NO: 35194 - DNA, 35 bp, Artificial Sequence
  Synthetic oligonucleotide
taacaggaccgcccggccccagacacgccccttct

SEQ ID NO: 35195 - DNA, 35 bp, Artificial Sequence
  Synthetic oligonucleotide
agcccgatggcgggaaaaaggggaactggagcggt

SEQ ID NO: 35196 - DNA, 36 bp, Artificial Sequence
  Synthetic oligonucleotide
atgtagcacgggggggaggcgaatttcgtcagtgaa

SEQ ID NO: 35197 - DNA, 35 bp, Artificial Sequence
  Synthetic oligonucleotide
ggacgcccgatataaacctcccgtttgctgcccca

SEQ ID NO: 35198 - DNA, 36 bp, Artificial Sequence
  Synthetic oligonucleotide
tttcgcgtccacgtcacgtccacgattctgcttcca

SEQ ID NO: 35199 - DNA, 37 bp, Artificial Sequence
  Synthetic oligonucleotide
agatgaccatcattgttgcattagttttcttttccga

SEQ ID NO: 35200 - DNA, 35 bp, Artificial Sequence
  Synthetic oligonucleotide
tgagggtgacgggatccggggaatggtagctggga

SEQ ID NO: 35201 - DNA, 38 bp, Artificial Sequence
  Synthetic oligonucleotide
gcttggcctccatcctgtaccgggaagctttttattga

SEQ ID NO: 35202 - DNA, 37 bp, Artificial Sequence
  Synthetic oligonucleotide
gtacgctcccccatatcaaataccgaacctgccttga

SEQ ID NO: 35203 - DNA, 35 bp, Artificial Sequence
  Synthetic oligonucleotide
gcaaccacactcggtctagtccccacgcaccaata

SEQ ID NO: 35204 - DNA, 36 bp, Artificial Sequence
  Synthetic oligonucleotide
tacgcagggccaacgttacgactctcgccttgcata

SEQ ID NO: 35205 - DNA, 36 bp, Artificial Sequence
  Synthetic oligonucleotide
tactaccgcccggcggctttactagttcatccttta

SEQ ID NO: 35206 - DNA, 35 bp, Artificial Sequence
  Synthetic oligonucleotide
ttgcccggggcattaaattcgggcagttacccccc

SEQ ID NO: 35207 - DNA, 35 bp, Artificial Sequence
  Synthetic oligonucleotide
gccttacaagcgcaccgaatcttgataccgtctcc

SEQ ID NO: 35208 - DNA, 35 bp, Artificial Sequence
  Synthetic oligonucleotide
tgagtggtcgacaagccggcatccgaaaattctcc

SEQ ID NO: 35209 - DNA, 35 bp, Artificial Sequence
  Synthetic oligonucleotide
acagtgcgacatttaggtttgtggttccatctttc

SEQ ID NO: 35210 - DNA, 35 bp, Artificial Sequence
  Synthetic oligonucleotide
gacatccgtgccgtttgccattcgctctgcggtct

SEQ ID NO: 35211 - DNA, 36 bp, Artificial Sequence
  Synthetic oligonucleotide
gcacccacagccgactctcaagatctcgacgcgcca

SEQ ID NO: 35212 - DNA, 35 bp, Artificial Sequence
  Synthetic oligonucleotide
gcctccgtagccccccgatcaagctctgttggcca

SEQ ID NO: 35213 - DNA, 37 bp, Artificial Sequence
  Synthetic oligonucleotide
accaccccatcccaagtcctcattcgttcgatggaga

SEQ ID NO: 35214 - DNA, 38 bp, Artificial Sequence
  Synthetic oligonucleotide
agcgacgtgctcaaggaaatatgggatctgggggggga

SEQ ID NO: 35215 - DNA, 37 bp, Artificial Sequence
  Synthetic oligonucleotide
gcgaccatcacctgacgtaatgctctacctacttgga

SEQ ID NO: 35216 - DNA, 38 bp, Artificial Sequence
  Synthetic oligonucleotide
tcaacaacgccctatctcccgcagtgcttacacaatga

SEQ ID NO: 35217 - DNA, 38 bp, Artificial Sequence
  Synthetic oligonucleotide
gatctccagtccgtccagcccaccctagttcaccatga

SEQ ID NO: 35218 - DNA, 37 bp, Artificial Sequence
  Synthetic oligonucleotide
gaaccgccttactgactccagcagtttttaccactga

SEQ ID NO: 35219 - DNA, 38 bp, Artificial Sequence
  Synthetic oligonucleotide
acctaccaacgccgtagaccggtttacattgatcctga

SEQ ID NO: 35220 - DNA, 38 bp, Artificial Sequence
  Synthetic oligonucleotide
tgtcacgtgggggcatggaacgggctcaagaaggctga

SEQ ID NO: 35221 - DNA, 37 bp, Artificial Sequence
  Synthetic oligonucleotide
gccatgcatcggcttcgcaccaccccagttatgctga

SEQ ID NO: 35222 - DNA, 38 bp, Artificial Sequence
  Synthetic oligonucleotide
tcacgtgcgtaacttctcttaccaccctcactggttga

SEQ ID NO: 35223 - DNA, 37 bp, Artificial Sequence
  Synthetic oligonucleotide
gacatccgccgtatttccctcgtctccgtttctttga

SEQ ID NO: 35224 - DNA, 38 bp, Artificial Sequence
  Synthetic oligonucleotide
agagggaggggaacagggaaaatattcgtcaagtttga

SEQ ID NO: 35225 - DNA, 36 bp, Artificial Sequence
  Synthetic oligonucleotide
gggacacctcctcaatcttccgcatctggaaccata

SEQ ID NO: 35226 - DNA, 35 bp, Artificial Sequence
  Synthetic oligonucleotide
tcattgcacccgttcactgaatgctctatctcata

SEQ ID NO: 35227 - DNA, 34 bp, Artificial Sequence
  Synthetic oligonucleotide
gtgatgccccgtttctccatttgcttgggttcta

SEQ ID NO: 35228 - DNA, 35 bp, Artificial Sequence
  Synthetic oligonucleotide
ttcgaacaatctctcctgttctcttgagcacccac

SEQ ID NO: 35229 - DNA, 35 bp, Artificial Sequence
  Synthetic oligonucleotide
gttcggaccgccctacctaggatgatacccattac

SEQ ID NO: 35230 - DNA, 35 bp, Artificial Sequence
  Synthetic oligonucleotide
gccaagtactaatctgcgacgcctacccgggtgcc

SEQ ID NO: 35231 - DNA, 35 bp, Artificial Sequence
  Synthetic oligonucleotide
tcacgtactactgccatccgtttccttgagtcctc

SEQ ID NO: 35232 - DNA, 35 bp, Artificial Sequence
  Synthetic oligonucleotide
gtggccccatcttaccgagccctagcacattagtc

SEQ ID NO: 35233 - DNA, 35 bp, Artificial Sequence
  Synthetic oligonucleotide
ggggggggacgggcgggggtggcaagaatgggtag

SEQ ID NO: 35234 - DNA, 35 bp, Artificial Sequence
  Synthetic oligonucleotide
tcaccagggatacctgagctcacaggccattaccg

SEQ ID NO: 35235 - DNA, 34 bp, Artificial Sequence
  Synthetic oligonucleotide
tggaccacacacgggcaactcaccactctttggg

SEQ ID NO: 35236 - DNA, 35 bp, Artificial Sequence
  Synthetic oligonucleotide
gacatgcacgctgttcctcgccttacaccttcttg

SEQ ID NO: 35237 - DNA, 35 bp, Artificial Sequence
  Synthetic oligonucleotide
acacttgtacggcctctttcacataactggatttg

SEQ ID NO: 35238 - DNA, 35 bp, Artificial Sequence
  Synthetic oligonucleotide
gtccaggctcatcattttctttttgtacgttttat

SEQ ID NO: 35239 - DNA, 35 bp, Artificial Sequence
  Synthetic oligonucleotide
tcagatacgccatgccaccatcgccgccccggggt

SEQ ID NO: 35240 - DNA, 35 bp, Artificial Sequence
  Synthetic oligonucleotide
taaaacccacagtctcgtcctgaattgccttcgtt

SEQ ID NO: 35241 - DNA, 35 bp, Artificial Sequence
  Synthetic oligonucleotide
tgcatatctcccgcgatcctgccattttgcgtgtt

SEQ ID NO: 35242 - DNA, 36 bp, Artificial Sequence
  Synthetic oligonucleotide
acacgcacaccaacacgcctgcagatggccatccaa

SEQ ID NO: 35243 - DNA, 36 bp, Artificial Sequence
  Synthetic oligonucleotide
acacagccccatcatctcaccggggtcacttcgcaa

SEQ ID NO: 35244 - DNA, 36 bp, Artificial Sequence
  Synthetic oligonucleotide
aaccacctttcgttgactgtaacgttttgtaccaca

SEQ ID NO: 35245 - DNA, 35 bp, Artificial Sequence
  Synthetic oligonucleotide
tgtacatctcccatacccgacgtctcagccgacca

SEQ ID NO: 35246 - DNA, 35 bp, Artificial Sequence
  Synthetic oligonucleotide
gtgcctcaactctgcgccttactcaacgtatgcca

SEQ ID NO: 35247 - DNA, 37 bp, Artificial Sequence
  Synthetic oligonucleotide
gtgcgacgcgcaccgtcttccccgtacccttttcgga

SEQ ID NO: 35248 - DNA, 38 bp, Artificial Sequence
  Synthetic oligonucleotide
tcccggggaggaacgtataggtgggttagggtaaatga

SEQ ID NO: 35249 - DNA, 38 bp, Artificial Sequence
  Synthetic oligonucleotide
gcgccactgcacccatttgcaaatcgtactctcaatga

SEQ ID NO: 35250 - DNA, 38 bp, Artificial Sequence
  Synthetic oligonucleotide
tgtcaccccgtcttttcttactaaccgccacaccatga

SEQ ID NO: 35251 - DNA, 38 bp, Artificial Sequence
  Synthetic oligonucleotide
attacggacagaggaatagccggggatatggaggatga

SEQ ID NO: 35252 - DNA, 38 bp, Artificial Sequence
  Synthetic oligonucleotide
tccgctagagcacgagcacctcgccccatcttctatga

SEQ ID NO: 35253 - DNA, 38 bp, Artificial Sequence
  Synthetic oligonucleotide
ttagccccgcccgttattagcccatcccgctaccctga

SEQ ID NO: 35254 - DNA, 38 bp, Artificial Sequence
  Synthetic oligonucleotide
actgccactattggtgctaccgacgtttccttccctga

SEQ ID NO: 35255 - DNA, 38 bp, Artificial Sequence
  Synthetic oligonucleotide
tttgctcgtgcaatgtagtgtttctgggttttgagtga

SEQ ID NO: 35256 - DNA, 38 bp, Artificial Sequence
  Synthetic oligonucleotide
ggaggggagggagagagggagctggctgaacttcgtga

SEQ ID NO: 35257 - DNA, 37 bp, Artificial Sequence
  Synthetic oligonucleotide
tccgcatggaccgcgcttaacactgctcctcgattga

SEQ ID NO: 35258 - DNA, 38 bp, Artificial Sequence
  Synthetic oligonucleotide
aaaccaagcaggctcatgaaggaggggtgaaggtttga

SEQ ID NO: 35259 - DNA, 36 bp, Artificial Sequence
  Synthetic oligonucleotide
gatgatggtggcctgaatcttaacactcctcgtgta

SEQ ID NO: 35260 - DNA, 35 bp, Artificial Sequence
  Synthetic oligonucleotide
aacagagagagagagaaggcggaggggtaggtaac

SEQ ID NO: 35261 - DNA, 35 bp, Artificial Sequence
  Synthetic oligonucleotide
accacgccttgtcacagttatccggcgatcaacac

SEQ ID NO: 35262 - DNA, 35 bp, Artificial Sequence
  Synthetic oligonucleotide
gcattcccccatattcgcctgctgtagtgaatgcc

SEQ ID NO: 35263 - DNA, 36 bp, Artificial Sequence
  Synthetic oligonucleotide
gtgtccgcatccattcttctcacgcttgctcgtagc

SEQ ID NO: 35264 - DNA, 35 bp, Artificial Sequence
  Synthetic oligonucleotide
ttacatcatcctagctcatctgtactgatctctgc

SEQ ID NO: 35265 - DNA, 35 bp, Artificial Sequence
  Synthetic oligonucleotide
agatagcaccacccatgattcccggatcacccccg

SEQ ID NO: 35266 - DNA, 35 bp, Artificial Sequence
  Synthetic oligonucleotide
gtcacgctgcgttcggcttatccttgcttgtccct

SEQ ID NO: 35267 - DNA, 35 bp, Artificial Sequence
  Synthetic oligonucleotide
tgccccaactgcctgaaattacacccttgtcactt

SEQ ID NO: 35268 - DNA, 35 bp, Artificial Sequence
  Synthetic oligonucleotide
tgaaccccatgatgagacacctgccattcgtaaca

SEQ ID NO: 35269 - DNA, 36 bp, Artificial Sequence
  Synthetic oligonucleotide
tacgcggatcggtcttcgcttaggtcccggttaaca

SEQ ID NO: 35270 - DNA, 35 bp, Artificial Sequence
  Synthetic oligonucleotide
gccaagccgacgacgctattaccacattttgtgca

SEQ ID NO: 35271 - DNA, 35 bp, Artificial Sequence
  Synthetic oligonucleotide
tcatactgcacccgcgattctttgggccgattgca

SEQ ID NO: 35272 - DNA, 35 bp, Artificial Sequence
  Synthetic oligonucleotide
aaaactaccgctgcacgagcctatttcacacagga

SEQ ID NO: 35273 - DNA, 37 bp, Artificial Sequence
  Synthetic oligonucleotide
atcatcggagagacgcacattacagctaccaccatga

SEQ ID NO: 35274 - DNA, 38 bp, Artificial Sequence
  Synthetic oligonucleotide
tccacgtccccactgctacgcctattaccgaccggtga

SEQ ID NO: 35275 - DNA, 38 bp, Artificial Sequence
  Synthetic oligonucleotide
acgtccatctgcgcccgcaaatgtgactcccctcttga

SEQ ID NO: 35276 - DNA, 38 bp, Artificial Sequence
  Synthetic oligonucleotide
ttgacagcgatacacagcgccgtcccccttttcgttga

SEQ ID NO: 35277 - DNA, 36 bp, Artificial Sequence
  Synthetic oligonucleotide
tccaccccgttaagtttaaagctggcaaagctgaac

SEQ ID NO: 35278 - DNA, 34 bp, Artificial Sequence
  Synthetic oligonucleotide
gtcctcttcacgtactcctttcggctttgcctcc

SEQ ID NO: 35279 - DNA, 35 bp, Artificial Sequence
  Synthetic oligonucleotide
atcagcctactaacatctcgggcccgtgtttctcc

SEQ ID NO: 35280 - DNA, 35 bp, Artificial Sequence
  Synthetic oligonucleotide
aacgcatggccgaatgctatagcctgcaatctatc

SEQ ID NO: 35281 - DNA, 35 bp, Artificial Sequence
  Synthetic oligonucleotide
gagcaactggtccccgttttcacactctatatgtc

SEQ ID NO: 35282 - DNA, 35 bp, Artificial Sequence
  Synthetic oligonucleotide
aagattcacccccgttcgacgctgactgccttttc

SEQ ID NO: 35283 - DNA, 35 bp, Artificial Sequence
  Synthetic oligonucleotide
tagccccccttcgcccacatcagcaagtgcaaacg

SEQ ID NO: 35284 - DNA, 35 bp, Artificial Sequence
  Synthetic oligonucleotide
tactgaaaaggccccatctctccacacgcacatgg

SEQ ID NO: 35285 - DNA, 35 bp, Artificial Sequence
  Synthetic oligonucleotide
gacatgcactacgagctcacccagtcacttctatg

SEQ ID NO: 35286 - DNA, 35 bp, Artificial Sequence
  Synthetic oligonucleotide
tgccaagctacctggtttcggcccccatcagcact

SEQ ID NO: 35287 - DNA, 34 bp, Artificial Sequence
  Synthetic oligonucleotide
gcgccatgtccttggatctccctgctggttcact

SEQ ID NO: 35288 - DNA, 35 bp, Artificial Sequence
  Synthetic oligonucleotide
acgagcctgccacgggtcacacctcattttccggt

SEQ ID NO: 35289 - DNA, 36 bp, Artificial Sequence
  Synthetic oligonucleotide
acactagcttcccgttaccattgcgctgactactaa

SEQ ID NO: 35290 - DNA, 36 bp, Artificial Sequence
  Synthetic oligonucleotide
atttcaccgctgctgttgcctgcgaaacaacaccca

SEQ ID NO: 35291 - DNA, 36 bp, Artificial Sequence
  Synthetic oligonucleotide
gcctccccccgcgactctaggtatctttataacgca

SEQ ID NO: 35292 - DNA, 36 bp, Artificial Sequence
  Synthetic oligonucleotide
gacgcttacccctcgaccccgcgctatttctatgca

SEQ ID NO: 35293 - DNA, 36 bp, Artificial Sequence
  Synthetic oligonucleotide
ttcgttaaccgccaccaagaccctgaccataccaga

SEQ ID NO: 35294 - DNA, 37 bp, Artificial Sequence
  Synthetic oligonucleotide
acatcccacctcgattgcctagccgtcccagttgaga

SEQ ID NO: 35295 - DNA, 37 bp, Artificial Sequence
  Synthetic oligonucleotide
tcgccctgtggcggttgcacgcccgtcttccctccga

SEQ ID NO: 35296 - DNA, 37 bp, Artificial Sequence
  Synthetic oligonucleotide
tgatgcgcactcggttctcttcgatctcggccctcga

SEQ ID NO: 35297 - DNA, 35 bp, Artificial Sequence
  Synthetic oligonucleotide
agttcaaccgctatcattcagtactacgctctcga

SEQ ID NO: 35298 - DNA, 37 bp, Artificial Sequence
  Synthetic oligonucleotide
tcccggtcaccatactcctgacgcactctgttttcga

SEQ ID NO: 35299 - DNA, 37 bp, Artificial Sequence
  Synthetic oligonucleotide
tacacccgacacagctggctagctttctcataatgga

SEQ ID NO: 35300 - DNA, 38 bp, Artificial Sequence
  Synthetic oligonucleotide
tgcaatcaaactgctacctgacttccgcccatctatga

SEQ ID NO: 35301 - DNA, 38 bp, Artificial Sequence
  Synthetic oligonucleotide
acaaccgcggccccaccccggacactcctcccgcctga

SEQ ID NO: 35302 - DNA, 38 bp, Artificial Sequence
  Synthetic oligonucleotide
tgaccgctctgcaactcctaacgtttgtccccttctga

SEQ ID NO: 35303 - DNA, 38 bp, Artificial Sequence
  Synthetic oligonucleotide
aatgccacagcactatccccttgagatcagtcgggtga

SEQ ID NO: 35304 - DNA, 38 bp, Artificial Sequence
  Synthetic oligonucleotide
gattcaccctccgtattccattgagtcttgataattga

SEQ ID NO: 35305 - DNA, 36 bp, Artificial Sequence
  Synthetic oligonucleotide
attcgccgttcgcccatttgctgccagacgccttga

SEQ ID NO: 35306 - DNA, 35 bp, Artificial Sequence
  Synthetic oligonucleotide
ccgacccgccacctacgaatagccaccatgtcacc

SEQ ID NO: 35307 - DNA, 35 bp, Artificial Sequence
  Synthetic oligonucleotide
gtgtggcaaaatgcgggaaaaggggggtatggtgc

SEQ ID NO: 35308 - DNA, 35 bp, Artificial Sequence
  Synthetic oligonucleotide
tcatgccacttctatcgtcttgtcttccaatggtc

SEQ ID NO: 35309 - DNA, 35 bp, Artificial Sequence
  Synthetic oligonucleotide
gtcatcactcgagcacccgtgaagctatcccattc

SEQ ID NO: 35310 - DNA, 35 bp, Artificial Sequence
  Synthetic oligonucleotide
tgcatctctgctctttcatacctgccgactgtcct

SEQ ID NO: 35311 - DNA, 35 bp, Artificial Sequence
  Synthetic oligonucleotide
gcccacgcacgactgttcacccaactacgcttagt

SEQ ID NO: 35312 - DNA, 35 bp, Artificial Sequence
  Synthetic oligonucleotide
actatcacaccctaaccgcgcggacggacttatgt

SEQ ID NO: 35313 - DNA, 35 bp, Artificial Sequence
  Synthetic oligonucleotide
acccccgacatggttccccacccaggagttttgtt

SEQ ID NO: 35314 - DNA, 35 bp, Artificial Sequence
  Synthetic oligonucleotide
tcgtgtcgacaaccaggtccctttgacaccctaca

SEQ ID NO: 35315 - DNA, 36 bp, Artificial Sequence
  Synthetic oligonucleotide
atgcccctccgtaacatccgaggctagagaacacca

SEQ ID NO: 35316 - DNA, 36 bp, Artificial Sequence
  Synthetic oligonucleotide
atcaatctgccacataacgtgccttcctgggtacca

SEQ ID NO: 35317 - DNA, 37 bp, Artificial Sequence
  Synthetic oligonucleotide
agcgggaccgcaatactggtaggcttcttttcttcga

SEQ ID NO: 35318 - DNA, 36 bp, Artificial Sequence
  Synthetic oligonucleotide
tgggacaccataagggaggggactaaagatgtggga

SEQ ID NO: 35319 - DNA, 38 bp, Artificial Sequence
  Synthetic oligonucleotide
gaccctacccgacccagtgaccgcgccccgctccctga

SEQ ID NO: 35320 - DNA, 38 bp, Artificial Sequence
  Synthetic oligonucleotide
gtgaggtcgccccttggaatactggatcctgcttttga

SEQ ID NO: 35321 - DNA, 36 bp, Artificial Sequence
  Synthetic oligonucleotide
taaccgctgtatgtccggcgattcattcctttccta

SEQ ID NO: 35322 - DNA, 35 bp, Artificial Sequence
  Synthetic oligonucleotide
tgagaccattttcgcagtctagtacctgcccctac

SEQ ID NO: 35323 - DNA, 35 bp, Artificial Sequence
  Synthetic oligonucleotide
tcacacctatacctggagcggtatcttgccagccc

SEQ ID NO: 35324 - DNA, 35 bp, Artificial Sequence
  Synthetic oligonucleotide
ttcggggacagtattgcctgtttttgttcgttccc

SEQ ID NO: 35325 - DNA, 35 bp, Artificial Sequence
  Synthetic oligonucleotide
aacttgcccgcgccgttctggtcattgccagcctc

SEQ ID NO: 35326 - DNA, 35 bp, Artificial Sequence
  Synthetic oligonucleotide
gtgtgtccctgagccccgtgattagtccgtttctc

SEQ ID NO: 35327 - DNA, 35 bp, Artificial Sequence
  Synthetic oligonucleotide
aaaggaagagggaggacgaaaaaaaaatgcggatg

SEQ ID NO: 35328 - DNA, 35 bp, Artificial Sequence
  Synthetic oligonucleotide
tgtgacgacgacgcgtgtgcatcggttacctcctg

SEQ ID NO: 35329 - DNA, 35 bp, Artificial Sequence
  Synthetic oligonucleotide
gccaacctttagccccaggtaacctgactttacat

SEQ ID NO: 35330 - DNA, 35 bp, Artificial Sequence
  Synthetic oligonucleotide
tcttcacaccgcgtactacacgcatccacacccat

SEQ ID NO: 35331 - DNA, 35 bp, Artificial Sequence
  Synthetic oligonucleotide
gtgacccacctctatccacagtggtcccatggcct

SEQ ID NO: 35332 - DNA, 35 bp, Artificial Sequence
  Synthetic oligonucleotide
tacgcttaagcccgccctttcacgctcttgccgtt

SEQ ID NO: 35333 - DNA, 35 bp, Artificial Sequence
  Synthetic oligonucleotide
acgcgcacgtcctttctcgtcggactcctgcattt

SEQ ID NO: 35334 - DNA, 36 bp, Artificial Sequence
  Synthetic oligonucleotide
tcatgggtgaatcacatgctaacaactcccccacaa

SEQ ID NO: 35335 - DNA, 36 bp, Artificial Sequence
  Synthetic oligonucleotide
aatcccagggtgtagtggggatagggagaggtggaa

SEQ ID NO: 35336 - DNA, 36 bp, Artificial Sequence
  Synthetic oligonucleotide
gacgcgagatgcacatttgcccttacttgactgcca

SEQ ID NO: 35337 - DNA, 37 bp, Artificial Sequence
  Synthetic oligonucleotide
gcgggtgggggaggtaggaaagacgcgcagacagaga

SEQ ID NO: 35338 - DNA, 35 bp, Artificial Sequence
  Synthetic oligonucleotide
cactgtcttgccgttgcctctgctacattccgtga

SEQ ID NO: 35339 - DNA, 37 bp, Artificial Sequence
  Synthetic oligonucleotide
tcaaacacacatctgcacacggaacacccaggcgtga

SEQ ID NO: 35340 - DNA, 37 bp, Artificial Sequence
  Synthetic oligonucleotide
atgcaactccgccctctttcgataatttacctggtga

SEQ ID NO: 35341 - DNA, 37 bp, Artificial Sequence
  Synthetic oligonucleotide
actgccctgtccttcattcccggctcgtcgcctgtga

SEQ ID NO: 35342 - DNA, 38 bp, Artificial Sequence
  Synthetic oligonucleotide
gttgccacagctttcgaccccccatcccgcggacttga

SEQ ID NO: 35343 - DNA, 38 bp, Artificial Sequence
  Synthetic oligonucleotide
atcccccgtagcatccttcttctgtccgtctttgttga

SEQ ID NO: 35344 - DNA, 34 bp, Artificial Sequence
  Synthetic oligonucleotide
tcccatcccatcgtctagacttcgttttctttga

SEQ ID NO: 35345 - DNA, 35 bp, Artificial Sequence
  Synthetic oligonucleotide
tctgacttgccaccaaagtccaggtttcctccata

SEQ ID NO: 35346 - DNA, 35 bp, Artificial Sequence
  Synthetic oligonucleotide
gttcagcccgccctacccgtcgtcccccctgatta

SEQ ID NO: 35347 - DNA, 36 bp, Artificial Sequence
  Synthetic oligonucleotide
gcagggccggaccgtcgctccctctgcctcctgtta

SEQ ID NO: 35348 - DNA, 35 bp, Artificial Sequence
  Synthetic oligonucleotide
agtatggaggggggggacgcgcataacggaaggac

SEQ ID NO: 35349 - DNA, 35 bp, Artificial Sequence
  Synthetic oligonucleotide
gagccatccctttaattttcgttgtccttatggac

SEQ ID NO: 35350 - DNA, 35 bp, Artificial Sequence
  Synthetic oligonucleotide
accacgcccgttacaattcgccactgtctcactac

SEQ ID NO: 35351 - DNA, 35 bp, Artificial Sequence
  Synthetic oligonucleotide
gcacactctcgcccagcggtgccgttaattcgtac

SEQ ID NO: 35352 - DNA, 35 bp, Artificial Sequence
  Synthetic oligonucleotide
tccccccggcacctctcatccaggacacgccttcc

SEQ ID NO: 35353 - DNA, 35 bp, Artificial Sequence
  Synthetic oligonucleotide
atccaggccatgcaccttcagtgccccctcaacgc

SEQ ID NO: 35354 - DNA, 35 bp, Artificial Sequence
  Synthetic oligonucleotide
gaaggacacctcgaatcacgcatcgataaccaacg

SEQ ID NO: 35355 - DNA, 36 bp, Artificial Sequence
  Synthetic oligonucleotide
ggacgaaggcgctggaaaacggaaaatgggggccgg

SEQ ID NO: 35356 - DNA, 35 bp, Artificial Sequence
  Synthetic oligonucleotide
ttggtaactcccgtggtcacaccttaacgccttct

SEQ ID NO: 35357 - DNA, 36 bp, Artificial Sequence
  Synthetic oligonucleotide
tccaacacgtacgggggtagtagtggtgcattgaaa

SEQ ID NO: 35358 - DNA, 36 bp, Artificial Sequence
  Synthetic oligonucleotide
ggacccagctgcatatcaactgccacgtgacaccaa

SEQ ID NO: 35359 - DNA, 36 bp, Artificial Sequence
  Synthetic oligonucleotide
gcccctactgccccagactgagacttagaagtcgaa

SEQ ID NO: 35360 - DNA, 36 bp, Artificial Sequence
  Synthetic oligonucleotide
gttaatgtcacgcacccagctggccgagcccaaaca

SEQ ID NO: 35361 - DNA, 37 bp, Artificial Sequence
  Synthetic oligonucleotide
atgcccgaactatgcttaatgcttcctttacactaga

SEQ ID NO: 35362 - DNA, 37 bp, Artificial Sequence
  Synthetic oligonucleotide
aattgccgggaagggaggtccatggagaagggggcga

SEQ ID NO: 35363 - DNA, 37 bp, Artificial Sequence
  Synthetic oligonucleotide
gaagggtgaccggggcactaagccgattgggagggga

SEQ ID NO: 35364 - DNA, 37 bp, Artificial Sequence
  Synthetic oligonucleotide
tatgacgggggcaattaggaaccaaaagcatagtgga

SEQ ID NO: 35365 - DNA, 37 bp, Artificial Sequence
  Synthetic oligonucleotide
aatgtcgccggatcccgcacacccacgatgcccatga

SEQ ID NO: 35366 - DNA, 38 bp, Artificial Sequence
  Synthetic oligonucleotide
tctcgaccggactccctatctgcctgacgcacctatga

SEQ ID NO: 35367 - DNA, 38 bp, Artificial Sequence
  Synthetic oligonucleotide
tagcacaccgcctctgttctatcgcgatacatgtatga

SEQ ID NO: 35368 - DNA, 38 bp, Artificial Sequence
  Synthetic oligonucleotide
actcctcgccccgtcgcccattgccgaggaaaccctga

SEQ ID NO: 35369 - DNA, 38 bp, Artificial Sequence
  Synthetic oligonucleotide
tagatcgcagcccgcctggcgtactcatccacatctga

SEQ ID NO: 35370 - DNA, 36 bp, Artificial Sequence
  Synthetic oligonucleotide
tgcacgttctcgcatctcctcctgccacgatattga

SEQ ID NO: 35371 - DNA, 38 bp, Artificial Sequence
  Synthetic oligonucleotide
tcaacgcccacatttcttccacttgctcccgtagttga

SEQ ID NO: 35372 - DNA, 38 bp, Artificial Sequence
  Synthetic oligonucleotide
ggacaccggcgctctgccttcccctgtttggtttttga

SEQ ID NO: 35373 - DNA, 36 bp, Artificial Sequence
  Synthetic oligonucleotide
gttacatgcctccacggttcacgacacagcacccta

SEQ ID NO: 35374 - DNA, 35 bp, Artificial Sequence
  Synthetic oligonucleotide
atcccgtgtcagccgcactacgtcacgaattcgcc

SEQ ID NO: 35375 - DNA, 35 bp, Artificial Sequence
  Synthetic oligonucleotide
tgtcggtgcccctcgtgcgaacctgcccaactgcc

SEQ ID NO: 35376 - DNA, 35 bp, Artificial Sequence
  Synthetic oligonucleotide
gccattcgctactcttaacgccagacaggtccctc

SEQ ID NO: 35377 - DNA, 35 bp, Artificial Sequence
  Synthetic oligonucleotide
gtccgcgccgagccgcaacgaccacacatttattc

SEQ ID NO: 35378 - DNA, 35 bp, Artificial Sequence
  Synthetic oligonucleotide
ggaggtaggcaatggttggctttgggtaaggtggg

SEQ ID NO: 35379 - DNA, 35 bp, Artificial Sequence
  Synthetic oligonucleotide
tcattcctggttcttgctcgctacgtaagtgcggt

SEQ ID NO: 35380 - DNA, 35 bp, Artificial Sequence
  Synthetic oligonucleotide
tccacctgcgcagctcgtattacccttgctaatgt

SEQ ID NO: 35381 - DNA, 35 bp, Artificial Sequence
  Synthetic oligonucleotide
acacgttccacggcactcccgcttgcattaatgtt

SEQ ID NO: 35382 - DNA, 36 bp, Artificial Sequence
  Synthetic oligonucleotide
aaagtcaggggggaggggttactgcgcaggggcaaa

SEQ ID NO: 35383 - DNA, 35 bp, Artificial Sequence
  Synthetic oligonucleotide
gtctgagccgctcagactatccttgcctccgccaa

SEQ ID NO: 35384 - DNA, 35 bp, Artificial Sequence
  Synthetic oligonucleotide
tcctggaacatgcaaactgtgccctctctctggaa

SEQ ID NO: 35385 - DNA, 35 bp, Artificial Sequence
  Synthetic oligonucleotide
acgacggtcccttaaactcatttccgtgcttcaca

SEQ ID NO: 35386 - DNA, 36 bp, Artificial Sequence
  Synthetic oligonucleotide
gattcaggtaggggggtggccggtggggaatggaca

SEQ ID NO: 35387 - DNA, 36 bp, Artificial Sequence
  Synthetic oligonucleotide
gttcactttcagctcctgcactgtttcaccacacca

SEQ ID NO: 35388 - DNA, 35 bp, Artificial Sequence
  Synthetic oligonucleotide
tcctcaccgcctcgctaacgaagacacatcgagca

SEQ ID NO: 35389 - DNA, 37 bp, Artificial Sequence
  Synthetic oligonucleotide
atgaaggggggggccgagggaggcgtgagtccggaga

SEQ ID NO: 35390 - DNA, 37 bp, Artificial Sequence
  Synthetic oligonucleotide
tatcatgccgtccgagcacctccagcccgactaacga

SEQ ID NO: 35391 - DNA, 36 bp, Artificial Sequence
  Synthetic oligonucleotide
tcgctcctcatgtctgttatctcttttctgccacga

SEQ ID NO: 35392 - DNA, 37 bp, Artificial Sequence
  Synthetic oligonucleotide
tcaacccagtcctgctccggtatccgagcccttccga

SEQ ID NO: 35393 - DNA, 37 bp, Artificial Sequence
  Synthetic oligonucleotide
tccacaccgcatcccgcccccaaagggtactttccga

SEQ ID NO: 35394 - DNA, 37 bp, Artificial Sequence
  Synthetic oligonucleotide
ttgcacccgccggttctactaatttcgttcattgcga

SEQ ID NO: 35395 - DNA, 37 bp, Artificial Sequence
  Synthetic oligonucleotide
gtttgccacgccccactcaggttccatccgaactcga

SEQ ID NO: 35396 - DNA, 37 bp, Artificial Sequence
  Synthetic oligonucleotide
gcggggcacaggaagctgacggggagctggggaagga

SEQ ID NO: 35397 - DNA, 37 bp, Artificial Sequence
  Synthetic oligonucleotide
actaactgcggtgtatgggggggaaggagggcgggga

SEQ ID NO: 35398 - DNA, 35 bp, Artificial Sequence
  Synthetic oligonucleotide
acagggagtggaatggtaactggatggcgggggga

SEQ ID NO: 35399 - DNA, 37 bp, Artificial Sequence
  Synthetic oligonucleotide
gacccatcatccgtattttactccgtagagactggga

SEQ ID NO: 35400 - DNA, 38 bp, Artificial Sequence
  Synthetic oligonucleotide
gccgactcgccgcggataatctctactgcctattatga

SEQ ID NO: 35401 - DNA, 38 bp, Artificial Sequence
  Synthetic oligonucleotide
tagcatgatcacaagtttgccaccacccggtcacgtga

SEQ ID NO: 35402 - DNA, 38 bp, Artificial Sequence
  Synthetic oligonucleotide
tctccctcaaccttctgtagccatgcacctgcatgtga

SEQ ID NO: 35403 - DNA, 38 bp, Artificial Sequence
  Synthetic oligonucleotide
atgccaccttccgaccgctgttatgtcctattcattga

SEQ ID NO: 35404 - DNA, 38 bp, Artificial Sequence
  Synthetic oligonucleotide
acacccgcgaactgcgatttcatagcctccgcacttga

SEQ ID NO: 35405 - DNA, 35 bp, Artificial Sequence
  Synthetic oligonucleotide
ttgcggagcagcctactcgttcacgtttccgttta

SEQ ID NO: 35406 - DNA, 35 bp, Artificial Sequence
  Synthetic oligonucleotide
gagtcccttcacactgccgatttagaccgcgtgcc

SEQ ID NO: 35407 - DNA, 35 bp, Artificial Sequence
  Synthetic oligonucleotide
actcgcgtaccctgattggtttgtcatcccactgc

SEQ ID NO: 35408 - DNA, 35 bp, Artificial Sequence
  Synthetic oligonucleotide
ttgagtccccgaaccaacgctaccctagatactgc

SEQ ID NO: 35409 - DNA, 35 bp, Artificial Sequence
  Synthetic oligonucleotide
ttgcaaccgggttcgcccgtgccacttatattgtc

SEQ ID NO: 35410 - DNA, 35 bp, Artificial Sequence
  Synthetic oligonucleotide
atgtcccgcgcttgatccatccgtgatatctattc

SEQ ID NO: 35411 - DNA, 35 bp, Artificial Sequence
  Synthetic oligonucleotide
acgcacactcacagcctgtcgttgcccccgccttc

SEQ ID NO: 35412 - DNA, 35 bp, Artificial Sequence
  Synthetic oligonucleotide
tgtgtgggggcggggacgcgaggggccaatgggag

SEQ ID NO: 35413 - DNA, 35 bp, Artificial Sequence
  Synthetic oligonucleotide
gaccaccgtgcaagtgaactatcggaccccccacg

SEQ ID NO: 35414 - DNA, 35 bp, Artificial Sequence
  Synthetic oligonucleotide
tcgcatcccaaagctgcctaccgttcgaacaaccg

SEQ ID NO: 35415 - DNA, 35 bp, Artificial Sequence
  Synthetic oligonucleotide
attgtccaccgccttagtctgtacgacccgtttat

SEQ ID NO: 35416 - DNA, 35 bp, Artificial Sequence
  Synthetic oligonucleotide
tattccccaccgttctccgcggtgcccgaaacatt

SEQ ID NO: 35417 - DNA, 35 bp, Artificial Sequence
  Synthetic oligonucleotide
agtaggagggaggagaacgagggagtgaggcgctt

SEQ ID NO: 35418 - DNA, 36 bp, Artificial Sequence
  Synthetic oligonucleotide
ttgaaagggaaccgggtatatggctggagtgagaaa

SEQ ID NO: 35419 - DNA, 36 bp, Artificial Sequence
  Synthetic oligonucleotide
tgatcaatcgtgccccgccgctataatgccctcgaa

SEQ ID NO: 35420 - DNA, 36 bp, Artificial Sequence
  Synthetic oligonucleotide
aatcgactcgaacggtctccgccccgccccctgcca

SEQ ID NO: 35421 - DNA, 36 bp, Artificial Sequence
  Synthetic oligonucleotide
tccgccacgaactgtttacctttgtcttcctccaga

SEQ ID NO: 35422 - DNA, 37 bp, Artificial Sequence
  Synthetic oligonucleotide
ttgcccctcctgactgctgtcgatcagaaaacaagga

SEQ ID NO: 35423 - DNA, 37 bp, Artificial Sequence
  Synthetic oligonucleotide
tttcagactcagccctcctccaccagcgtagacagga

SEQ ID NO: 35424 - DNA, 35 bp, Artificial Sequence
  Synthetic oligonucleotide
gacaccgtgatgcgtctgatctcacctctccggga

SEQ ID NO: 35425 - DNA, 37 bp, Artificial Sequence
  Synthetic oligonucleotide
tctgaaaccgaagggggggtggttacttgcagtggga

SEQ ID NO: 35426 - DNA, 37 bp, Artificial Sequence
  Synthetic oligonucleotide
tcacaacgtctcgtctgcttaagcctgctcttcctga

SEQ ID NO: 35427 - DNA, 38 bp, Artificial Sequence
  Synthetic oligonucleotide
tgaacgcatcgtgagctaccccttatcgcctttcctga

SEQ ID NO: 35428 - DNA, 37 bp, Artificial Sequence
  Synthetic oligonucleotide
gtcaagccacggattggcctacctgctccataattga

SEQ ID NO: 35429 - DNA, 36 bp, Artificial Sequence
  Synthetic oligonucleotide
gacccactgtcccatttaatgattgtcatacccgta

SEQ ID NO: 35430 - DNA, 35 bp, Artificial Sequence
  Synthetic oligonucleotide
gaaagcctactggaaattcgccctgtacctgccac

SEQ ID NO: 35431 - DNA, 35 bp, Artificial Sequence
  Synthetic oligonucleotide
actaccggtgcgttccaccggacctctctatcacc

SEQ ID NO: 35432 - DNA, 35 bp, Artificial Sequence
  Synthetic oligonucleotide
tcatcagtgtgcagcaatccgctcagcgttccatc

SEQ ID NO: 35433 - DNA, 35 bp, Artificial Sequence
  Synthetic oligonucleotide
gatgggtggaccaggagtttagagccgaaggaagg

SEQ ID NO: 35434 - DNA, 35 bp, Artificial Sequence
  Synthetic oligonucleotide
gatgctcctccgcttggggtcccccccttttaggg

SEQ ID NO: 35435 - DNA, 35 bp, Artificial Sequence
  Synthetic oligonucleotide
gatggcacgggggttgatagggccggggggtatct

SEQ ID NO: 35436 - DNA, 35 bp, Artificial Sequence
  Synthetic oligonucleotide
gcggagcatccttcctattcctccccagccgacgt

SEQ ID NO: 35437 - DNA, 36 bp, Artificial Sequence
  Synthetic oligonucleotide
ttcattcgccgaacctgctctagccgactcgtaaaa

SEQ ID NO: 35438 - DNA, 36 bp, Artificial Sequence
  Synthetic oligonucleotide
gccactatgtcgcgtttgtctctacctacttctcaa

SEQ ID NO: 35439 - DNA, 35 bp, Artificial Sequence
  Synthetic oligonucleotide
gcccacccttatcgaatatatgaatacccaccgaa

SEQ ID NO: 35440 - DNA, 37 bp, Artificial Sequence
  Synthetic oligonucleotide
tgagccctctctgcaattcatcaatgccgtcctacga

SEQ ID NO: 35441 - DNA, 37 bp, Artificial Sequence
  Synthetic oligonucleotide
acaccctcctcgtcttatttgtcgcccgacgattcga

SEQ ID NO: 35442 - DNA, 37 bp, Artificial Sequence
  Synthetic oligonucleotide
gcacaatcccttaactccgacacatggctcctacgga

SEQ ID NO: 35443 - DNA, 38 bp, Artificial Sequence
  Synthetic oligonucleotide
gtgaccacccgacggcacccgcaccacctcggaactga

SEQ ID NO: 35444 - DNA, 37 bp, Artificial Sequence
  Synthetic oligonucleotide
gacgccacgcccgcttctttgggccgtatacacctga

SEQ ID NO: 35445 - DNA, 38 bp, Artificial Sequence
  Synthetic oligonucleotide
tccacatgcctggtcccagctacacggttcacgggtga

SEQ ID NO: 35446 - DNA, 38 bp, Artificial Sequence
  Synthetic oligonucleotide
tgcgtcgagcatccctggccccatgtccattcctgtga

SEQ ID NO: 35447 - DNA, 37 bp, Artificial Sequence
  Synthetic oligonucleotide
tcccaacccacggttaccccacgtatcgccgccttga

SEQ ID NO: 35448 - DNA, 35 bp, Artificial Sequence
  Synthetic oligonucleotide
ttgtatcctcaggtccgcttctagcttacacctta

SEQ ID NO: 35449 - DNA, 35 bp, Artificial Sequence
  Synthetic oligonucleotide
actgccatggcaccactgttgctcttaccgctgac

SEQ ID NO: 35450 - DNA, 35 bp, Artificial Sequence
  Synthetic oligonucleotide
gtgatcggtgctgacctactgcaccttgtttttcc

SEQ ID NO: 35451 - DNA, 35 bp, Artificial Sequence
  Synthetic oligonucleotide
gttatcccatcgccgacgtttattaggctgtcttc

SEQ ID NO: 35452 - DNA, 35 bp, Artificial Sequence
  Synthetic oligonucleotide
gccccaactgcaacagcgctccgctcaggattttc

SEQ ID NO: 35453 - DNA, 35 bp, Artificial Sequence
  Synthetic oligonucleotide
gcccacaacctgagctcttcataccgtctcgcgat

SEQ ID NO: 35454 - DNA, 35 bp, Artificial Sequence
  Synthetic oligonucleotide
tgatcaccacctgttcgtcagaatcaaatccggtt

SEQ ID NO: 35455 - DNA, 36 bp, Artificial Sequence
  Synthetic oligonucleotide
gatcccgccggaattgccgattgccccattgttcca

SEQ ID NO: 35456 - DNA, 35 bp, Artificial Sequence
  Synthetic oligonucleotide
cgtgccggagtccgtccccccgtatttcctgctca

SEQ ID NO: 35457 - DNA, 37 bp, Artificial Sequence
  Synthetic oligonucleotide
gaccacctcgttcgagacgcacacttattaccgcaga

SEQ ID NO: 35458 - DNA, 37 bp, Artificial Sequence
  Synthetic oligonucleotide
gccatccaccggacctgcattcatggacacctggaga

SEQ ID NO: 35459 - DNA, 37 bp, Artificial Sequence
  Synthetic oligonucleotide
acggatacgccttagccgcactttccccctgttatga

SEQ ID NO: 35460 - DNA, 37 bp, Artificial Sequence
  Synthetic oligonucleotide
gcacacaccgatccgtttgtcgcgattgcatccctga

SEQ ID NO: 35461 - DNA, 37 bp, Artificial Sequence
  Synthetic oligonucleotide
tgtgaccgaaggacttcagcgacgcttccactcctga

SEQ ID NO: 35462 - DNA, 38 bp, Artificial Sequence
  Synthetic oligonucleotide
gttggtagccatcgttggttcttacgttttcttcctga

SEQ ID NO: 35463 - DNA, 38 bp, Artificial Sequence
  Synthetic oligonucleotide
gacccccacgcgccttgcgaactgcctactggaattga

SEQ ID NO: 35464 - DNA, 38 bp, Artificial Sequence
  Synthetic oligonucleotide
gccgcacgacctcgggggggtggcaggagggggattga

SEQ ID NO: 35465 - DNA, 37 bp, Artificial Sequence
  Synthetic oligonucleotide
tacgcgagggtgggggatgaaggagtcttagcgttga

SEQ ID NO: 35466 - DNA, 38 bp, Artificial Sequence
  Synthetic oligonucleotide
gatgtacgggtgtaggtaaagggagggggcaggtttga

SEQ ID NO: 35467 - DNA, 38 bp, Artificial Sequence
  Synthetic oligonucleotide
gaagccggcccacccatccccacgagcgcactgtttga

SEQ ID NO: 35468 - DNA, 36 bp, Artificial Sequence
  Synthetic oligonucleotide
tcaagcctggtgcaagttaaccgtttctccctacta

SEQ ID NO: 35469 - DNA, 36 bp, Artificial Sequence
  Synthetic oligonucleotide
cacacccccacttcctgcgctataggacgcccgtta

SEQ ID NO: 35470 - DNA, 36 bp, Artificial Sequence
  Synthetic oligonucleotide
gcctactctcgattcttcccatcgcccagactttta

SEQ ID NO: 35471 - DNA, 35 bp, Artificial Sequence
  Synthetic oligonucleotide
ggtcgagtgacggtccttacccaggctattccacc

SEQ ID NO: 35472 - DNA, 35 bp, Artificial Sequence
  Synthetic oligonucleotide
gcaagggatgccggactgtcagtgccttgttcccc

SEQ ID NO: 35473 - DNA, 35 bp, Artificial Sequence
  Synthetic oligonucleotide
ttggacgctctaatactgtcttcgcatttacttcc

SEQ ID NO: 35474 - DNA, 35 bp, Artificial Sequence
  Synthetic oligonucleotide
ttacaaatcgcgggtcactgtcacaagtcccttcc

SEQ ID NO: 35475 - DNA, 35 bp, Artificial Sequence
  Synthetic oligonucleotide
gatttggtccgtactgcccatcgtgtcactgccgc

SEQ ID NO: 35476 - DNA, 35 bp, Artificial Sequence
  Synthetic oligonucleotide
gtgtggtaaggggggaataaaaattagacgtgggc

SEQ ID NO: 35477 - DNA, 35 bp, Artificial Sequence
  Synthetic oligonucleotide
gttccgccatggcaacatgaatacttcccccgtgc

SEQ ID NO: 35478 - DNA, 35 bp, Artificial Sequence
  Synthetic oligonucleotide
accatgcctgccataggacgaacagtaacatgctc

SEQ ID NO: 35479 - DNA, 35 bp, Artificial Sequence
  Synthetic oligonucleotide
tacgcaccgtcgctctccaccttcccccgacgacg

SEQ ID NO: 35480 - DNA, 35 bp, Artificial Sequence
  Synthetic oligonucleotide
gcctaggcctccggtattcgccatccatcccaggg

SEQ ID NO: 35481 - DNA, 35 bp, Artificial Sequence
  Synthetic oligonucleotide
gtcctgcgcgtcacctcttgcccggcctaccgact

SEQ ID NO: 35482 - DNA, 35 bp, Artificial Sequence
  Synthetic oligonucleotide
ttacctgctgaatgagcgcccctgtactgtcacct

SEQ ID NO: 35483 - DNA, 35 bp, Artificial Sequence
  Synthetic oligonucleotide
gccggtacaaactcccacgccatcctctctcgtgt

SEQ ID NO: 35484 - DNA, 35 bp, Artificial Sequence
  Synthetic oligonucleotide
tccagcatacttcactatggtctagcctggtcctt

SEQ ID NO: 35485 - DNA, 36 bp, Artificial Sequence
  Synthetic oligonucleotide
atcgactcaccgccggtgaactccaccaagttattt

SEQ ID NO: 35486 - DNA, 35 bp, Artificial Sequence
  Synthetic oligonucleotide
gaacccgcgataacccggcctggtcaaccgccttt

SEQ ID NO: 35487 - DNA, 36 bp, Artificial Sequence
  Synthetic oligonucleotide
tccccccagggaccgtaaagtgctcgcttcaccaca

SEQ ID NO: 35488 - DNA, 36 bp, Artificial Sequence
  Synthetic oligonucleotide
gccactcgcacgatacccaccataaccgagcaccca

SEQ ID NO: 35489 - DNA, 36 bp, Artificial Sequence
  Synthetic oligonucleotide
gcccacgtaggcggcgatctcctatacccggcccca

SEQ ID NO: 35490 - DNA, 36 bp, Artificial Sequence
  Synthetic oligonucleotide
tccgccgcaaccgggagtcctcctgaacccttcgca

SEQ ID NO: 35491 - DNA, 36 bp, Artificial Sequence
  Synthetic oligonucleotide
accctaccatccgtgacgacccgaccgcgccgtgca

SEQ ID NO: 35492 - DNA, 35 bp, Artificial Sequence
  Synthetic oligonucleotide
gtcccattattgttgtcttcactgccttcggctca

SEQ ID NO: 35493 - DNA, 36 bp, Artificial Sequence
  Synthetic oligonucleotide
acaacgccagtctatcaacatcgcactaccctttca

SEQ ID NO: 35494 - DNA, 37 bp, Artificial Sequence
  Synthetic oligonucleotide
gtaaagaggtgcaagggtaagggaagtagggaaaaga

SEQ ID NO: 35495 - DNA, 37 bp, Artificial Sequence
  Synthetic oligonucleotide
tagtcgagaagaggaagaattaaaggtagtgcagaga

SEQ ID NO: 35496 - DNA, 37 bp, Artificial Sequence
  Synthetic oligonucleotide
gatacaggtggggcggggacgctgtggggaatcggga

SEQ ID NO: 35497 - DNA, 37 bp, Artificial Sequence
  Synthetic oligonucleotide
ttaacccctccgcgcgcattacaccctgcaatcatga

SEQ ID NO: 35498 - DNA, 38 bp, Artificial Sequence
  Synthetic oligonucleotide
gacacagtcccatcagtatcaacgtgaacctcatatga

SEQ ID NO: 35499 - DNA, 38 bp, Artificial Sequence
  Synthetic oligonucleotide
gtagccccgcccgttattagcccatccctctaccctga

SEQ ID NO: 35500 - DNA, 38 bp, Artificial Sequence
  Synthetic oligonucleotide
gatcgcctcgtgctccaattacggacgtactatcctga

SEQ ID NO: 35501 - DNA, 38 bp, Artificial Sequence
  Synthetic oligonucleotide
aacgcccatcactgtttacttcacacagtcgatattga

SEQ ID NO: 35502 - DNA, 36 bp, Artificial Sequence
  Synthetic oligonucleotide
ttgccacggccttctccccccggttcgcgcaccata

SEQ ID NO: 35503 - DNA, 35 bp, Artificial Sequence
  Synthetic oligonucleotide
tgaccgcctgccataccactccgagagtcggtcta

SEQ ID NO: 35504 - DNA, 36 bp, Artificial Sequence
  Synthetic oligonucleotide
aactaggggcatagttgggaggaggatgatagcgta

SEQ ID NO: 35505 - DNA, 35 bp, Artificial Sequence
  Synthetic oligonucleotide
gtccaacacgctgccaatgtaggcatcccatttta

SEQ ID NO: 35506 - DNA, 35 bp, Artificial Sequence
  Synthetic oligonucleotide
gaccatccaatccccctggtagagagacttccgcc

SEQ ID NO: 35507 - DNA, 35 bp, Artificial Sequence
  Synthetic oligonucleotide
ggacgcagttacagtccaccatgcttcctcgttcc

SEQ ID NO: 35508 - DNA, 35 bp, Artificial Sequence
  Synthetic oligonucleotide
gaacacaggcatcctttacactccgcttacctggc

SEQ ID NO: 35509 - DNA, 35 bp, Artificial Sequence
  Synthetic oligonucleotide
gctgaaactggcctccgattatggcgcccccactc

SEQ ID NO: 35510 - DNA, 35 bp, Artificial Sequence
  Synthetic oligonucleotide
gtctactcccatatcgtttttgttttcggtacctc

SEQ ID NO: 35511 - DNA, 35 bp, Artificial Sequence
  Synthetic oligonucleotide
actcacccttttgctgcacgaatcgacgattggtc

SEQ ID NO: 35512 - DNA, 35 bp, Artificial Sequence
  Synthetic oligonucleotide
gccgttcgagccggaccctcgagtcgtataccttc

SEQ ID NO: 35513 - DNA, 35 bp, Artificial Sequence
  Synthetic oligonucleotide
tgcccgaattgcggttgtttattgccgtgtttaat

SEQ ID NO: 35514 - DNA, 35 bp, Artificial Sequence
  Synthetic oligonucleotide
gcccccctagttttgtctgtacgctttctgtggct

SEQ ID NO: 35515 - DNA, 35 bp, Artificial Sequence
  Synthetic oligonucleotide
tcaaccacaagagccgaagtgatcggctttcatct

SEQ ID NO: 35516 - DNA, 35 bp, Artificial Sequence
  Synthetic oligonucleotide
gatcctgcttgcgagtctagttcctttgcttctct

SEQ ID NO: 35517 - DNA, 35 bp, Artificial Sequence
  Synthetic oligonucleotide
ttgcgaggccattattgcacttctcatgttttggt

SEQ ID NO: 35518 - DNA, 35 bp, Artificial Sequence
  Synthetic oligonucleotide
tagacacccccgtgtccgccgagccttcgtatctt

SEQ ID NO: 35519 - DNA, 30 bp, Artificial Sequence
  Synthetic oligonucleotide
gtgcaaaacactggtctacatggtcctgaa

SEQ ID NO: 35520 - DNA, 36 bp, Artificial Sequence
  Synthetic oligonucleotide
tcatctactgctattgcccttgttaaccatgtgcca

SEQ ID NO: 35521 - DNA, 36 bp, Artificial Sequence
  Synthetic oligonucleotide
tctgacgcaagggtatgggagggccgggactgtgca

SEQ ID NO: 35522 - DNA, 35 bp, Artificial Sequence
  Synthetic oligonucleotide
tcagaccagatttcattcaacctcctgcaccatca

SEQ ID NO: 35523 - DNA, 36 bp, Artificial Sequence
  Synthetic oligonucleotide
tctcatctccatccgcgcccgtctcgcgttgactca

SEQ ID NO: 35524 - DNA, 37 bp, Artificial Sequence
  Synthetic oligonucleotide
tcgaaggtaacgggccgggagcacgggaaaagggaga

SEQ ID NO: 35525 - DNA, 37 bp, Artificial Sequence
  Synthetic oligonucleotide
tccgaaggcgccttacgttcatccggtttcgattcga

SEQ ID NO: 35526 - DNA, 36 bp, Artificial Sequence
  Synthetic oligonucleotide
gatgttcaccccgcccccccgatgccgatgcaagga

SEQ ID NO: 35527 - DNA, 36 bp, Artificial Sequence
  Synthetic oligonucleotide
aagtaccccccattctgcccttggagacaatctgga

SEQ ID NO: 35528 - DNA, 38 bp, Artificial Sequence
  Synthetic oligonucleotide
tagcctcgatcgggggggcaggggagggctgaggatga

SEQ ID NO: 35529 - DNA, 37 bp, Artificial Sequence
  Synthetic oligonucleotide
gtttgcggtaagggtgggaggggtgtatgggtgttga

SEQ ID NO: 35530 - DNA, 36 bp, Artificial Sequence
  Synthetic oligonucleotide
accaacaaccttctgccttatctccacggaggctta

SEQ ID NO: 35531 - DNA, 35 bp, Artificial Sequence
  Synthetic oligonucleotide
tgaccatggcgccctcccccaacttatccagacac

SEQ ID NO: 35532 - DNA, 35 bp, Artificial Sequence
  Synthetic oligonucleotide
agtacacgtgctgatcgcggtcgtaaccacccacc

SEQ ID NO: 35533 - DNA, 34 bp, Artificial Sequence
  Synthetic oligonucleotide
aaccccctcgggcttcctttttgccgaccagacc

SEQ ID NO: 35534 - DNA, 35 bp, Artificial Sequence
  Synthetic oligonucleotide
tcccaccgtaactgtatgtacagctatacgctacc

SEQ ID NO: 35535 - DNA, 35 bp, Artificial Sequence
  Synthetic oligonucleotide
acgaccgcccgcttgccaccatttatggtacaccc

SEQ ID NO: 35536 - DNA, 35 bp, Artificial Sequence
  Synthetic oligonucleotide
acccagacctcgttacccatactgccttaggattc

SEQ ID NO: 35537 - DNA, 35 bp, Artificial Sequence
  Synthetic oligonucleotide
ttcatccgttatcctgcgggcctattgcacccttc

SEQ ID NO: 35538 - DNA, 35 bp, Artificial Sequence
  Synthetic oligonucleotide
gacggagcggacacctcttaattggctcctgcttg

SEQ ID NO: 35539 - DNA, 35 bp, Artificial Sequence
  Synthetic oligonucleotide
ttaaaccttccgtacgccattcgccgctctcagct

SEQ ID NO: 35540 - DNA, 35 bp, Artificial Sequence
  Synthetic oligonucleotide
gatggcaacctctgcttctcgcactcgttgtccaa

SEQ ID NO: 35541 - DNA, 35 bp, Artificial Sequence
  Synthetic oligonucleotide
ttacttgccgcttgactgcgcattcacccccggaa

SEQ ID NO: 35542 - DNA, 36 bp, Artificial Sequence
  Synthetic oligonucleotide
tatgcaaagcgcgcgtttttatttcacctccacaca

SEQ ID NO: 35543 - DNA, 36 bp, Artificial Sequence
  Synthetic oligonucleotide
gccacccttataaatgtgcccacgaagtcccccaca

SEQ ID NO: 35544 - DNA, 35 bp, Artificial Sequence
  Synthetic oligonucleotide
acatggtagccccacaagtctctcgggagcctaca

SEQ ID NO: 35545 - DNA, 36 bp, Artificial Sequence
  Synthetic oligonucleotide
acacaagggggcacgcctcatacaatatacacgcca

SEQ ID NO: 35546 - DNA, 36 bp, Artificial Sequence
  Synthetic oligonucleotide
gatagctacatccatccatagcgcactgatccttca

SEQ ID NO: 35547 - DNA, 36 bp, Artificial Sequence
  Synthetic oligonucleotide
gttccatgacctcatcacgtggccctcttctgttca

SEQ ID NO: 35548 - DNA, 37 bp, Artificial Sequence
  Synthetic oligonucleotide
gggagggaagggagacacagcgggggtacttagacga

SEQ ID NO: 35549 - DNA, 38 bp, Artificial Sequence
  Synthetic oligonucleotide
tgcgcatactgctgttcgaccacactctgttgccatga

SEQ ID NO: 35550 - DNA, 37 bp, Artificial Sequence
  Synthetic oligonucleotide
gtcctcatcatgttcacatgcacctttcacttcatga

SEQ ID NO: 35551 - DNA, 37 bp, Artificial Sequence
  Synthetic oligonucleotide
gccacgggcacccccccataatcgagtctgaacctga

SEQ ID NO: 35552 - DNA, 37 bp, Artificial Sequence
  Synthetic oligonucleotide
gttaacatcactggcctctgtatgcacttccacctga

SEQ ID NO: 35553 - DNA, 38 bp, Artificial Sequence
  Synthetic oligonucleotide
ggatggagggaggtgttatagtggcggagggatgctga

SEQ ID NO: 35554 - DNA, 35 bp, Artificial Sequence
  Synthetic oligonucleotide
gacgtcccgccccatattactgtcttgtctagtga

SEQ ID NO: 35555 - DNA, 38 bp, Artificial Sequence
  Synthetic oligonucleotide
aacgcaccctttgcttttttgccgtcccgccttagtga

SEQ ID NO: 35556 - DNA, 38 bp, Artificial Sequence
  Synthetic oligonucleotide
gacgacccggtcgtcacaccgtgagaacaatgacttga

SEQ ID NO: 35557 - DNA, 38 bp, Artificial Sequence
  Synthetic oligonucleotide
gtccactcgctcagctttgccctctaaccacgtcttga

SEQ ID NO: 35558 - DNA, 38 bp, Artificial Sequence
  Synthetic oligonucleotide
tctggatcctcctgctgtttttcttggcacattcttga

SEQ ID NO: 35559 - DNA, 37 bp, Artificial Sequence
  Synthetic oligonucleotide
ttctgctttgcccagggtcaccacacaccctctttga

SEQ ID NO: 35560 - DNA, 34 bp, Artificial Sequence
  Synthetic oligonucleotide
gcgtaaccactgcacacccacgcgatcgggccta

SEQ ID NO: 35561 - DNA, 36 bp, Artificial Sequence
  Synthetic oligonucleotide
gcctacttccccccccctctgccgcctgtgtatgta

SEQ ID NO: 35562 - DNA, 36 bp, Artificial Sequence
  Synthetic oligonucleotide
actgtgccatcctccggtcgttccattcatctatta

SEQ ID NO: 35563 - DNA, 36 bp, Artificial Sequence
  Synthetic oligonucleotide
gacacgatcacacgtactggaaagaatggaagctta

SEQ ID NO: 35564 - DNA, 35 bp, Artificial Sequence
  Synthetic oligonucleotide
gtcaggagaccacccctgcgccctccggaactaac

SEQ ID NO: 35565 - DNA, 35 bp, Artificial Sequence
  Synthetic oligonucleotide
accccaatcccccgcctctgtgcagttcctgtgcc

SEQ ID NO: 35566 - DNA, 36 bp, Artificial Sequence
  Synthetic oligonucleotide
gcaagccccgttgttcgttttgtgattcgttcatcc

SEQ ID NO: 35567 - DNA, 35 bp, Artificial Sequence
  Synthetic oligonucleotide
gccgtccaacgttagtctgtccaaccttcacctcc

SEQ ID NO: 35568 - DNA, 35 bp, Artificial Sequence
  Synthetic oligonucleotide
cacgtaccaccgcgggcgccacggatcacttcaag

SEQ ID NO: 35569 - DNA, 35 bp, Artificial Sequence
  Synthetic oligonucleotide
tatgctggcaggctatcgtctgtccccacttcctg

SEQ ID NO: 35570 - DNA, 35 bp, Artificial Sequence
  Synthetic oligonucleotide
accccacgttagtacaccgcatcctccgtttgact

SEQ ID NO: 35571 - DNA, 35 bp, Artificial Sequence
  Synthetic oligonucleotide
gactcggtatgagcttgcccactgttacatcgcct

SEQ ID NO: 35572 - DNA, 35 bp, Artificial Sequence
  Synthetic oligonucleotide
ttcatctgcccccccatctactcatcgctgttggt

SEQ ID NO: 35573 - DNA, 35 bp, Artificial Sequence
  Synthetic oligonucleotide
tgggccgcctgtcaccatcccgcccaataaacgtt

SEQ ID NO: 35574 - DNA, 36 bp, Artificial Sequence
  Synthetic oligonucleotide
aacacgccgggacttactgcaaaaacacattgaaca

SEQ ID NO: 35575 - DNA, 36 bp, Artificial Sequence
  Synthetic oligonucleotide
aacaatgcactctcggcttggctgtgcctccaccca

SEQ ID NO: 35576 - DNA, 37 bp, Artificial Sequence
  Synthetic oligonucleotide
acagccctcgcacctatctgcctctaactgtaccgga

SEQ ID NO: 35577 - DNA, 36 bp, Artificial Sequence
  Synthetic oligonucleotide
ttgtgcagtccctagctcggcgcaaccctgtctgga

SEQ ID NO: 35578 - DNA, 38 bp, Artificial Sequence
  Synthetic oligonucleotide
gcattcgcaccaatgataatggccctcaaatcctatga

SEQ ID NO: 35579 - DNA, 35 bp, Artificial Sequence
  Synthetic oligonucleotide
gcatggttcgaggaggagggcggaaagcagggtga

SEQ ID NO: 35580 - DNA, 38 bp, Artificial Sequence
  Synthetic oligonucleotide
gtgacacggcactcttctatcatgaccgaccatggtga

SEQ ID NO: 35581 - DNA, 36 bp, Artificial Sequence
  Synthetic oligonucleotide
tcaatcaccgccaaccattgaccatataaacattga

SEQ ID NO: 35582 - DNA, 38 bp, Artificial Sequence
  Synthetic oligonucleotide
gcgaagcgggcaatcccctcgccctggtaccaccttga

SEQ ID NO: 35583 - DNA, 38 bp, Artificial Sequence
  Synthetic oligonucleotide
gtgatcgctccgggctcattcctgtaaacataccttga

SEQ ID NO: 35584 - DNA, 37 bp, Artificial Sequence
  Synthetic oligonucleotide
tccgcaagtacatcaggcactcttgcccctctcttga

SEQ ID NO: 35585 - DNA, 36 bp, Artificial Sequence
  Synthetic oligonucleotide
gctgcactaccacccgccttaagaccgcatacctta

SEQ ID NO: 35586 - DNA, 36 bp, Artificial Sequence
  Synthetic oligonucleotide
gtcacgcgaatggtcatcgttacgcccatctcttta

SEQ ID NO: 35587 - DNA, 35 bp, Artificial Sequence
  Synthetic oligonucleotide
tccgcccattgccaccccctgcaaaggtgatcccc

SEQ ID NO: 35588 - DNA, 35 bp, Artificial Sequence
  Synthetic oligonucleotide
tccacagccgagtttgatccgaattaccctccgcc

SEQ ID NO: 35589 - DNA, 35 bp, Artificial Sequence
  Synthetic oligonucleotide
tactgtgtccgcacctttgtagtccgcttggcgcc

SEQ ID NO: 35590 - DNA, 35 bp, Artificial Sequence
  Synthetic oligonucleotide
gctgggggcatcgcgctaaacagggagggacgggc

SEQ ID NO: 35591 - DNA, 35 bp, Artificial Sequence
  Synthetic oligonucleotide
atctgcacaccctcatgctaacagcctcagacacg

SEQ ID NO: 35592 - DNA, 35 bp, Artificial Sequence
  Synthetic oligonucleotide
tccatcccgttgccacgcaggcaaatttttcctgg

SEQ ID NO: 35593 - DNA, 35 bp, Artificial Sequence
  Synthetic oligonucleotide
tcaccctgagcgtgttcgctccatctccacgaaat

SEQ ID NO: 35594 - DNA, 35 bp, Artificial Sequence
  Synthetic oligonucleotide
tgtccatggttggttacgtttaacaattgttccat

SEQ ID NO: 35595 - DNA, 35 bp, Artificial Sequence
  Synthetic oligonucleotide
aacccacgcatggacaatggccccatcgctgcact

SEQ ID NO: 35596 - DNA, 35 bp, Artificial Sequence
  Synthetic oligonucleotide
tgagcgggggggtggggagggagcaatatcgtact

SEQ ID NO: 35597 - DNA, 35 bp, Artificial Sequence
  Synthetic oligonucleotide
tgaggctggtatcccttctgcaatcgtttctggct

SEQ ID NO: 35598 - DNA, 35 bp, Artificial Sequence
  Synthetic oligonucleotide
acgcctccaactggcatcctaagtccatttatggt

SEQ ID NO: 35599 - DNA, 35 bp, Artificial Sequence
  Synthetic oligonucleotide
tgccccccgtgcacggactgtctcgtccacttaaa

SEQ ID NO: 35600 - DNA, 36 bp, Artificial Sequence
  Synthetic oligonucleotide
gtccccaccccacaccctagactcactgcgccctaa

SEQ ID NO: 35601 - DNA, 35 bp, Artificial Sequence
  Synthetic oligonucleotide
tgccgagccgcccacatcttccatcgctccccaca

SEQ ID NO: 35602 - DNA, 37 bp, Artificial Sequence
  Synthetic oligonucleotide
atccgctggcccccgaccttatactccgtttgcgcga

SEQ ID NO: 35603 - DNA, 36 bp, Artificial Sequence
  Synthetic oligonucleotide
atcagccagggaggggataaggttgtgggggtagga

SEQ ID NO: 35604 - DNA, 37 bp, Artificial Sequence
  Synthetic oligonucleotide
gagaggagtgggctgtcgtcgacacgaggggaatgga

SEQ ID NO: 35605 - DNA, 37 bp, Artificial Sequence
  Synthetic oligonucleotide
gtcacgtgggggaggctctttggggtgggtggctgga

SEQ ID NO: 35606 - DNA, 38 bp, Artificial Sequence
  Synthetic oligonucleotide
tgctgcaagccgcctcccaaattagctcactcccatga

SEQ ID NO: 35607 - DNA, 38 bp, Artificial Sequence
  Synthetic oligonucleotide
ttattgccgccgggtggttcggggtgggtgatggatga

SEQ ID NO: 35608 - DNA, 38 bp, Artificial Sequence
  Synthetic oligonucleotide
acccggggcaaggaacgtatgggggctcggcttggtga

SEQ ID NO: 35609 - DNA, 37 bp, Artificial Sequence
  Synthetic oligonucleotide
tctcatcaaatgtctatacgccactctcgtttcttga

SEQ ID NO: 35610 - DNA, 36 bp, Artificial Sequence
  Synthetic oligonucleotide
gctcagctccccaccacggtttggcttcacgaacta

SEQ ID NO: 35611 - DNA, 36 bp, Artificial Sequence
  Synthetic oligonucleotide
acatgcctaccacacgccttcagatccgttcccgta

SEQ ID NO: 35612 - DNA, 36 bp, Artificial Sequence
  Synthetic oligonucleotide
gacgagccccgttatctcgcaccaaacttcacttta

SEQ ID NO: 35613 - DNA, 35 bp, Artificial Sequence
  Synthetic oligonucleotide
tacatcccaatcgtttaggatgtaccatagccccc

SEQ ID NO: 35614 - DNA, 35 bp, Artificial Sequence
  Synthetic oligonucleotide
aatcaggcccccattatctggcccaccattcccgc

SEQ ID NO: 35615 - DNA, 35 bp, Artificial Sequence
  Synthetic oligonucleotide
gctcaactcagcgaccactattagtactcactggc

SEQ ID NO: 35616 - DNA, 35 bp, Artificial Sequence
  Synthetic oligonucleotide
gagtgcccctggcccactaattggtacccgtgatc

SEQ ID NO: 35617 - DNA, 35 bp, Artificial Sequence
  Synthetic oligonucleotide
gattcaacccttaccgatttgtcctagcaccaacg

SEQ ID NO: 35618 - DNA, 35 bp, Artificial Sequence
  Synthetic oligonucleotide
gcgaacccttaccaccaggactgtttaacctatcg

SEQ ID NO: 35619 - DNA, 35 bp, Artificial Sequence
  Synthetic oligonucleotide
acgccccatgtacctccaccgctcaagaatcttcg

SEQ ID NO: 35620 - DNA, 35 bp, Artificial Sequence
  Synthetic oligonucleotide
gtcagaacaccttttcctcgcattccatcaggggg

SEQ ID NO: 35621 - DNA, 35 bp, Artificial Sequence
  Synthetic oligonucleotide
gtgcgcgatcttttgctaccgtgaccccccccatg

SEQ ID NO: 35622 - DNA, 35 bp, Artificial Sequence
  Synthetic oligonucleotide
tcatcacgcaactacttttaggtttgccctgcact

SEQ ID NO: 35623 - DNA, 35 bp, Artificial Sequence
  Synthetic oligonucleotide
tgagggccgcattgtgtgggtgggtgtggggttct

SEQ ID NO: 35624 - DNA, 34 bp, Artificial Sequence
  Synthetic oligonucleotide
gtgccagttcccgtttaggtattcccccccccgt

SEQ ID NO: 35625 - DNA, 35 bp, Artificial Sequence
  Synthetic oligonucleotide
gagccgcactgcgtacagccttaatctacgccctt

SEQ ID NO: 35626 - DNA, 36 bp, Artificial Sequence
  Synthetic oligonucleotide
ggatcagccccgtcgcttcccattctgtcatctcaa

SEQ ID NO: 35627 - DNA, 36 bp, Artificial Sequence
  Synthetic oligonucleotide
gagaacgtggctaggggatagaagggagggtgtgaa

SEQ ID NO: 35628 - DNA, 37 bp, Artificial Sequence
  Synthetic oligonucleotide
acgaaaagtacgggactggagaaagggatagacaaga

SEQ ID NO: 35629 - DNA, 36 bp, Artificial Sequence
  Synthetic oligonucleotide
acgatgctcaatcggtaattctacacttttccacga

SEQ ID NO: 35630 - DNA, 37 bp, Artificial Sequence
  Synthetic oligonucleotide
acctcccgcgattacgtccccgctttttgtcccccga

SEQ ID NO: 35631 - DNA, 37 bp, Artificial Sequence
  Synthetic oligonucleotide
accctcgcgaccaatttgaccgcgctgaactcatgga

SEQ ID NO: 35632 - DNA, 37 bp, Artificial Sequence
  Synthetic oligonucleotide
ttgagtgggcgtggagtaaatgggcggttaagctgga

SEQ ID NO: 35633 - DNA, 38 bp, Artificial Sequence
  Synthetic oligonucleotide
tcaccaccgatccacgtctcagaaccatctcgcgatga

SEQ ID NO: 35634 - DNA, 38 bp, Artificial Sequence
  Synthetic oligonucleotide
aacggagctaccgtgctcattcgccctatacttgctga

SEQ ID NO: 35635 - DNA, 37 bp, Artificial Sequence
  Synthetic oligonucleotide
aaccgcgcctttttgtcattgccgcctttactagtga

SEQ ID NO: 35636 - DNA, 38 bp, Artificial Sequence
  Synthetic oligonucleotide
aacactgtacaccgagccaccactagtattacccttga

SEQ ID NO: 35637 - DNA, 36 bp, Artificial Sequence
  Synthetic oligonucleotide
tgatacatcgcgtccgcatagtccccggccatacta

SEQ ID NO: 35638 - DNA, 35 bp, Artificial Sequence
  Synthetic oligonucleotide
accagagctagtattcgcctctcttgttgcaccac

SEQ ID NO: 35639 - DNA, 35 bp, Artificial Sequence
  Synthetic oligonucleotide
tgttgacagcgcattttgcctatcccagcccggac

SEQ ID NO: 35640 - DNA, 35 bp, Artificial Sequence
  Synthetic oligonucleotide
taacaagcctgactctgcctgcctggcgcctctac

SEQ ID NO: 35641 - DNA, 35 bp, Artificial Sequence
  Synthetic oligonucleotide
catcactacgcgtggttatgcgccggcttacatcc

SEQ ID NO: 35642 - DNA, 35 bp, Artificial Sequence
  Synthetic oligonucleotide
tccgcctcctatattgactcatgagtagtccgttc

SEQ ID NO: 35643 - DNA, 35 bp, Artificial Sequence
  Synthetic oligonucleotide
tcacagcccacctagtctaagttgctttccagttg

SEQ ID NO: 35644 - DNA, 35 bp, Artificial Sequence
  Synthetic oligonucleotide
tacggggttgtccgcaccctgtaatatcctccact

SEQ ID NO: 35645 - DNA, 35 bp, Artificial Sequence
  Synthetic oligonucleotide
tagtcatcctcctatgttatgttgccattcctcct

SEQ ID NO: 35646 - DNA, 35 bp, Artificial Sequence
  Synthetic oligonucleotide
gagatagtgagagggtggttcgctaccgtggttgt

SEQ ID NO: 35647 - DNA, 35 bp, Artificial Sequence
  Synthetic oligonucleotide
gtcccaactgcttcttactctgagccctgcactaa

SEQ ID NO: 35648 - DNA, 36 bp, Artificial Sequence
  Synthetic oligonucleotide
gcgcccccgcagccctagctcgacccttttcacaca

SEQ ID NO: 35649 - DNA, 35 bp, Artificial Sequence
  Synthetic oligonucleotide
accactgcccacgcccggtcgacgccctctaccca

SEQ ID NO: 35650 - DNA, 36 bp, Artificial Sequence
  Synthetic oligonucleotide
gtgtagcgccactatgatacccttcggcttccttca

SEQ ID NO: 35651 - DNA, 36 bp, Artificial Sequence
  Synthetic oligonucleotide
agcacctccacctcaattgtcttatgacaattacga

SEQ ID NO: 35652 - DNA, 37 bp, Artificial Sequence
  Synthetic oligonucleotide
tgtgatgtcctgctacgacctgcccgatttgccccga

SEQ ID NO: 35653 - DNA, 37 bp, Artificial Sequence
  Synthetic oligonucleotide
tcatgaagggtaggggaaggccggggcataagaagga

SEQ ID NO: 35654 - DNA, 36 bp, Artificial Sequence
  Synthetic oligonucleotide
ttgtgccactccgcagcttacttgacgttatccgga

SEQ ID NO: 35655 - DNA, 37 bp, Artificial Sequence
  Synthetic oligonucleotide
agtacgtcgcaggtaacgagtgggcataaagggggga

SEQ ID NO: 35656 - DNA, 37 bp, Artificial Sequence
  Synthetic oligonucleotide
atcccctcccgacgtttcactctcccggtttctggga

SEQ ID NO: 35657 - DNA, 38 bp, Artificial Sequence
  Synthetic oligonucleotide
tactgccacgaagtggacccaatatttaccatctatga

SEQ ID NO: 35658 - DNA, 37 bp, Artificial Sequence
  Synthetic oligonucleotide
gtgcaactctgtctctgaatagcctcctgaaaactga

SEQ ID NO: 35659 - DNA, 37 bp, Artificial Sequence
  Synthetic oligonucleotide
agccaccttcatcctcgccatactacgccggcgctga

SEQ ID NO: 35660 - DNA, 37 bp, Artificial Sequence
  Synthetic oligonucleotide
tggggaaggaaaccagggggcaacatggacaggctga

SEQ ID NO: 35661 - DNA, 38 bp, Artificial Sequence
  Synthetic oligonucleotide
ttagtcagcccctatcctccattaagctcgtcacgtga

SEQ ID NO: 35662 - DNA, 38 bp, Artificial Sequence
  Synthetic oligonucleotide
tcaccctcacctccccgtacctgtcgttgactaggtga

SEQ ID NO: 35663 - DNA, 38 bp, Artificial Sequence
  Synthetic oligonucleotide
gccactgccacggtagtgcttcccaaattcgtttttga

SEQ ID NO: 35664 - DNA, 36 bp, Artificial Sequence
  Synthetic oligonucleotide
gatttgcctcccgtggttgctgtcccctctgtcata

SEQ ID NO: 35665 - DNA, 36 bp, Artificial Sequence
  Synthetic oligonucleotide
ttctgtcccaccccggatggcatccacctcattata

SEQ ID NO: 35666 - DNA, 35 bp, Artificial Sequence
  Synthetic oligonucleotide
gcgttctcttccagccctcaccggtttgatcccac

SEQ ID NO: 35667 - DNA, 35 bp, Artificial Sequence
  Synthetic oligonucleotide
tccgtcctcgcaagtcgcctccgacggctcttacc

SEQ ID NO: 35668 - DNA, 35 bp, Artificial Sequence
  Synthetic oligonucleotide
gtgcgttctgtcatccggtagtcccactcatgcgc

SEQ ID NO: 35669 - DNA, 35 bp, Artificial Sequence
  Synthetic oligonucleotide
gcacgccatcacggcgtttagtcctgcaccattgc

SEQ ID NO: 35670 - DNA, 35 bp, Artificial Sequence
  Synthetic oligonucleotide
gactcccgctcggtgctcagcttactgttggcctc

SEQ ID NO: 35671 - DNA, 35 bp, Artificial Sequence
  Synthetic oligonucleotide
aaaatggggggggagttagtgataagcacagccgg

SEQ ID NO: 35672 - DNA, 35 bp, Artificial Sequence
  Synthetic oligonucleotide
aaagtccggattagggtggaatggggggggtaagt

SEQ ID NO: 35673 - DNA, 35 bp, Artificial Sequence
  Synthetic oligonucleotide
gtgacgcgcgatcgagttttgcctgtactctgggt

SEQ ID NO: 35674 - DNA, 35 bp, Artificial Sequence
  Synthetic oligonucleotide
acacgtgtccctgcttagcacttgatctcccgatt

SEQ ID NO: 35675 - DNA, 36 bp, Artificial Sequence
  Synthetic oligonucleotide
tacgcaagggataggaatgggcggtagagttacgaa

SEQ ID NO: 35676 - DNA, 36 bp, Artificial Sequence
  Synthetic oligonucleotide
atgatcgcggtgcccatcgtcctccctgcccaacca

SEQ ID NO: 35677 - DNA, 36 bp, Artificial Sequence
  Synthetic oligonucleotide
gtgatcgtcctcactcgccgggcctctagtattcca

SEQ ID NO: 35678 - DNA, 36 bp, Artificial Sequence
  Synthetic oligonucleotide
acagcgcaacaatctggctgcattctcgatcaatca

SEQ ID NO: 35679 - DNA, 36 bp, Artificial Sequence
  Synthetic oligonucleotide
tattctgccacgcctaaccacccaaacagtgactca

SEQ ID NO: 35680 - DNA, 35 bp, Artificial Sequence
  Synthetic oligonucleotide
atggtggagagtgggggcgataatgtagccgcaga

SEQ ID NO: 35681 - DNA, 37 bp, Artificial Sequence
  Synthetic oligonucleotide
tgccaacatccattcataacagcattattcgcaagga

SEQ ID NO: 35682 - DNA, 36 bp, Artificial Sequence
  Synthetic oligonucleotide
tatcacccggctggtagccctttatccaaccatgga

SEQ ID NO: 35683 - DNA, 38 bp, Artificial Sequence
  Synthetic oligonucleotide
ggtccacgcaacctattttacattgtccgtctccctga

SEQ ID NO: 35684 - DNA, 36 bp, Artificial Sequence
  Synthetic oligonucleotide
gatacctccccactgatagtaatcggaccaataata

SEQ ID NO: 35685 - DNA, 35 bp, Artificial Sequence
  Synthetic oligonucleotide
tccctggccccactacatactgtacgcttagacta

SEQ ID NO: 35686 - DNA, 35 bp, Artificial Sequence
  Synthetic oligonucleotide
gggggccacccaattttgttctatctgtctatcta

SEQ ID NO: 35687 - DNA, 35 bp, Artificial Sequence
  Synthetic oligonucleotide
gacaccgtgccttattcctccagtcttcttatcta

SEQ ID NO: 35688 - DNA, 36 bp, Artificial Sequence
  Synthetic oligonucleotide
gtagtgagggatggaggaaggagagggtatttggta

SEQ ID NO: 35689 - DNA, 36 bp, Artificial Sequence
  Synthetic oligonucleotide
gtgcgaatgccttctcgtctcgttatgctctcgtta

SEQ ID NO: 35690 - DNA, 35 bp, Artificial Sequence
  Synthetic oligonucleotide
gagtcgccgttacggccggtctaccattttgttac

SEQ ID NO: 35691 - DNA, 35 bp, Artificial Sequence
  Synthetic oligonucleotide
tgatcatgcaccgaagggcctaaacggcctacacc

SEQ ID NO: 35692 - DNA, 35 bp, Artificial Sequence
  Synthetic oligonucleotide
agacacgccgcacaaaaactaatgcattcgtgacc

SEQ ID NO: 35693 - DNA, 35 bp, Artificial Sequence
  Synthetic oligonucleotide
tgcatggtgattcctgtgtcaactcctccttgttc

SEQ ID NO: 35694 - DNA, 35 bp, Artificial Sequence
  Synthetic oligonucleotide
tacctgcagggtactatctgcttatttgctttttc

SEQ ID NO: 35695 - DNA, 35 bp, Artificial Sequence
  Synthetic oligonucleotide
gttacacctgcaccactggcacgcccgccttgaag

SEQ ID NO: 35696 - DNA, 35 bp, Artificial Sequence
  Synthetic oligonucleotide
tcagacgcacgccaccgctcgctttaacacagccg

SEQ ID NO: 35697 - DNA, 35 bp, Artificial Sequence
  Synthetic oligonucleotide
tcgtaccatcacagctacatccgcccctctggtct

SEQ ID NO: 35698 - DNA, 35 bp, Artificial Sequence
  Synthetic oligonucleotide
tccaggagaggtagaacggaaggggacaacacggt

SEQ ID NO: 35699 - DNA, 36 bp, Artificial Sequence
  Synthetic oligonucleotide
gaccaaggacgaacaagggagtgacgggtggtaaaa

SEQ ID NO: 35700 - DNA, 35 bp, Artificial Sequence
  Synthetic oligonucleotide
tccagtcacacctcatggcctgctcttcttgacaa

SEQ ID NO: 35701 - DNA, 36 bp, Artificial Sequence
  Synthetic oligonucleotide
tcaggagcgcgcctgcctcctgtacccgataaccaa

SEQ ID NO: 35702 - DNA, 35 bp, Artificial Sequence
  Synthetic oligonucleotide
gccgccaatggggggaaggaaagcgggaagatcaa

SEQ ID NO: 35703 - DNA, 36 bp, Artificial Sequence
  Synthetic oligonucleotide
aatgcgagtatacggagaggggagagactgagcgaa

SEQ ID NO: 35704 - DNA, 36 bp, Artificial Sequence
  Synthetic oligonucleotide
agaggcactctccgtcctacccgtttccctcgcgca

SEQ ID NO: 35705 - DNA, 35 bp, Artificial Sequence
  Synthetic oligonucleotide
acccgccgtgcggtctcctacgacgaaatgactca

SEQ ID NO: 35706 - DNA, 36 bp, Artificial Sequence
  Synthetic oligonucleotide
gttaacctgccctgatttacctaactcacatcccga

SEQ ID NO: 35707 - DNA, 35 bp, Artificial Sequence
  Synthetic oligonucleotide
gacgacccgcatacacactctactagcacactcga

SEQ ID NO: 35708 - DNA, 37 bp, Artificial Sequence
  Synthetic oligonucleotide
tcaacaccctctcaggtgatagtacccatttcgctga

SEQ ID NO: 35709 - DNA, 38 bp, Artificial Sequence
  Synthetic oligonucleotide
gaccccgccccacaactgctatagacaagcgacagtga

SEQ ID NO: 35710 - DNA, 38 bp, Artificial Sequence
  Synthetic oligonucleotide
gacaggccgaactatccaatgcaatcacactcacttga

SEQ ID NO: 35711 - DNA, 37 bp, Artificial Sequence
  Synthetic oligonucleotide
ggatatgggagggatgagggcgggggcacaggtttga

SEQ ID NO: 35712 - DNA, 35 bp, Artificial Sequence
  Synthetic oligonucleotide
tgtcctagctcgccgaggtcctccgcatcccacta

SEQ ID NO: 35713 - DNA, 36 bp, Artificial Sequence
  Synthetic oligonucleotide
gtcagagcagtcttccgtccatcaagccctgtatta

SEQ ID NO: 35714 - DNA, 36 bp, Artificial Sequence
  Synthetic oligonucleotide
tcctgcctgccccaacccaggggtacacttttctta

SEQ ID NO: 35715 - DNA, 35 bp, Artificial Sequence
  Synthetic oligonucleotide
tcattccatgggtcaaatcctgcaccacgcttccc

SEQ ID NO: 35716 - DNA, 35 bp, Artificial Sequence
  Synthetic oligonucleotide
tgtcaccaacagaccgcctcagccttaacgacgcc

SEQ ID NO: 35717 - DNA, 35 bp, Artificial Sequence
  Synthetic oligonucleotide
aatgggataccgccacgaaaagcctcgctactgcc

SEQ ID NO: 35718 - DNA, 35 bp, Artificial Sequence
  Synthetic oligonucleotide
cacaccaccaattgcgcaacattgtccttcggtcc

SEQ ID NO: 35719 - DNA, 35 bp, Artificial Sequence
  Synthetic oligonucleotide
ataccacccaggtccctatgtcttgttatctctcg

SEQ ID NO: 35720 - DNA, 35 bp, Artificial Sequence
  Synthetic oligonucleotide
gaggggggaatgaagataatatgttccgatagggg

SEQ ID NO: 35721 - DNA, 35 bp, Artificial Sequence
  Synthetic oligonucleotide
aagccacgtcgccaacattctcagtcctaccctat

SEQ ID NO: 35722 - DNA, 35 bp, Artificial Sequence
  Synthetic oligonucleotide
tccccccgccgcacatatctgcgatccacgttact

SEQ ID NO: 35723 - DNA, 35 bp, Artificial Sequence
  Synthetic oligonucleotide
tgtgctgaccccgtctcctatatgcatcatgacct

SEQ ID NO: 35724 - DNA, 35 bp, Artificial Sequence
  Synthetic oligonucleotide
gacacaaccatggattcgctgagaacaatttgcct

SEQ ID NO: 35725 - DNA, 35 bp, Artificial Sequence
  Synthetic oligonucleotide
gaccagggggcacaatgggttaacaagggtggtgt

SEQ ID NO: 35726 - DNA, 35 bp, Artificial Sequence
  Synthetic oligonucleotide
actcatgcactggcgcggttagtaccatttttttt

SEQ ID NO: 35727 - DNA, 36 bp, Artificial Sequence
  Synthetic oligonucleotide
gcacaggaagcaatactaaaaggggagaggcaaaaa

SEQ ID NO: 35728 - DNA, 36 bp, Artificial Sequence
  Synthetic oligonucleotide
gccgcgcgacctaccatgcccggcttccctgaccaa

SEQ ID NO: 35729 - DNA, 36 bp, Artificial Sequence
  Synthetic oligonucleotide
tctccagaccaccttgcgttgaacgccccagtttaa

SEQ ID NO: 35730 - DNA, 36 bp, Artificial Sequence
  Synthetic oligonucleotide
gacgcaaagatggctccaggttcttccactttacca

SEQ ID NO: 35731 - DNA, 37 bp, Artificial Sequence
  Synthetic oligonucleotide
gccatgacagcattccaacttcacgtctaacatccga

SEQ ID NO: 35732 - DNA, 37 bp, Artificial Sequence
  Synthetic oligonucleotide
gttgtcagcacaccttgtctcactcttttcgcctgga

SEQ ID NO: 35733 - DNA, 36 bp, Artificial Sequence
  Synthetic oligonucleotide
gccttgctccatctttgaatacctcgtcacttctga

SEQ ID NO: 35734 - DNA, 38 bp, Artificial Sequence
  Synthetic oligonucleotide
ctgtaggtcctactctggtaacaagccacactaagtga

SEQ ID NO: 35735 - DNA, 38 bp, Artificial Sequence
  Synthetic oligonucleotide
gatgcacgagtgtcgtaactccgcctttgttcctgtga

SEQ ID NO: 35736 - DNA, 38 bp, Artificial Sequence
  Synthetic oligonucleotide
tccttacccgtgtctggccgtcgtggcccctctattga

SEQ ID NO: 35737 - DNA, 38 bp, Artificial Sequence
  Synthetic oligonucleotide
acctccccatgtgaccacccgtgatcccaacactttga

SEQ ID NO: 35738 - DNA, 38 bp, Artificial Sequence
  Synthetic oligonucleotide
agcacccgcgagatttttcggtgtatcggcccttttga

SEQ ID NO: 35739 - DNA, 36 bp, Artificial Sequence
  Synthetic oligonucleotide
tagacaaggggagtggaatgagcatcacgggggata

SEQ ID NO: 35740 - DNA, 35 bp, Artificial Sequence
  Synthetic oligonucleotide
gagaggcccctcatactcgcttcatcgttcccgta

SEQ ID NO: 35741 - DNA, 36 bp, Artificial Sequence
  Synthetic oligonucleotide
gcacagaacaccccgttctggcacctttcttccgta

SEQ ID NO: 35742 - DNA, 35 bp, Artificial Sequence
  Synthetic oligonucleotide
agccgccaccttctgtccttgttagtcggtcctta

SEQ ID NO: 35743 - DNA, 35 bp, Artificial Sequence
  Synthetic oligonucleotide
tgccttagccaaagtggtctcattgccctcaaacc

SEQ ID NO: 35744 - DNA, 35 bp, Artificial Sequence
  Synthetic oligonucleotide
gggtacgcaacccgctgatcctctcggtccccccc

SEQ ID NO: 35745 - DNA, 35 bp, Artificial Sequence
  Synthetic oligonucleotide
gctgtgctatcgcctccgagctgtctctcccgctc

SEQ ID NO: 35746 - DNA, 35 bp, Artificial Sequence
  Synthetic oligonucleotide
tgacactcagtcgcaattaatactgtcaccaattc

SEQ ID NO: 35747 - DNA, 35 bp, Artificial Sequence
  Synthetic oligonucleotide
gccggagggtccagagttcagctcatggccggttc

SEQ ID NO: 35748 - DNA, 35 bp, Artificial Sequence
  Synthetic oligonucleotide
acacctcaatcctatttagttgccttcctgccccg

SEQ ID NO: 35749 - DNA, 35 bp, Artificial Sequence
  Synthetic oligonucleotide
gacccaacgacctccgtgcgcatccactggatccg

SEQ ID NO: 35750 - DNA, 35 bp, Artificial Sequence
  Synthetic oligonucleotide
ttgccggaatcagcgcagcttgcctctgtcactct

SEQ ID NO: 35751 - DNA, 36 bp, Artificial Sequence
  Synthetic oligonucleotide
gagccccttcacgatacacacgaccgacctccacaa

SEQ ID NO: 35752 - DNA, 36 bp, Artificial Sequence
  Synthetic oligonucleotide
tcatcaccattgcccgttattatcttagtgcttgaa

SEQ ID NO: 35753 - DNA, 36 bp, Artificial Sequence
  Synthetic oligonucleotide
acgcccctctcccagtccatatcgttgtgcttcaca

SEQ ID NO: 35754 - DNA, 35 bp, Artificial Sequence
  Synthetic oligonucleotide
tacgcccaaccgttgtgcacacattccgtcgacca

SEQ ID NO: 35755 - DNA, 35 bp, Artificial Sequence
  Synthetic oligonucleotide
tctagtgaatccggtgccgcccgacctgcctccca

SEQ ID NO: 35756 - DNA, 35 bp, Artificial Sequence
  Synthetic oligonucleotide
gggttgggcagggggggggtagattcaaggtttca

SEQ ID NO: 35757 - DNA, 35 bp, Artificial Sequence
  Synthetic oligonucleotide
atggagggagacggacgaatggtgaaggtaagcga

SEQ ID NO: 35758 - DNA, 36 bp, Artificial Sequence
  Synthetic oligonucleotide
tactgcgcaacccgtttgtcttgtccgttcaacata

SEQ ID NO: 35759 - DNA, 35 bp, Artificial Sequence
  Synthetic oligonucleotide
gcatcctgcaccaggtgccacacatggactccaac

SEQ ID NO: 35760 - DNA, 35 bp, Artificial Sequence
  Synthetic oligonucleotide
atcgagccggccggcttcggttcctttagcattac

SEQ ID NO: 35761 - DNA, 35 bp, Artificial Sequence
  Synthetic oligonucleotide
gccaccctcgctgggaattctctgcgcttggatcc

SEQ ID NO: 35762 - DNA, 35 bp, Artificial Sequence
  Synthetic oligonucleotide
tcgaccatctctactgcactataggccttctctag

SEQ ID NO: 35763 - DNA, 35 bp, Artificial Sequence
  Synthetic oligonucleotide
ttactaccaccgccccgccgacgctgaattgcacg

SEQ ID NO: 35764 - DNA, 35 bp, Artificial Sequence
  Synthetic oligonucleotide
agatcaacctccccttgcctcacatctgcatagcg

SEQ ID NO: 35765 - DNA, 36 bp, Artificial Sequence
  Synthetic oligonucleotide
gtccctcgcacccaggctctccggaaccttccatcg

SEQ ID NO: 35766 - DNA, 35 bp, Artificial Sequence
  Synthetic oligonucleotide
acgcgtcgggggggaggacggtttcgaaatgagtg

SEQ ID NO: 35767 - DNA, 35 bp, Artificial Sequence
  Synthetic oligonucleotide
attgagggccggcacttgtcttttcccgttaatat

SEQ ID NO: 35768 - DNA, 36 bp, Artificial Sequence
  Synthetic oligonucleotide
tcacgacgcaatattccatacatacgctttcctaaa

SEQ ID NO: 35769 - DNA, 36 bp, Artificial Sequence
  Synthetic oligonucleotide
agtgagcctcacgtaattttttgatggcctcccaca

SEQ ID NO: 35770 - DNA, 36 bp, Artificial Sequence
  Synthetic oligonucleotide
atcactgcaagagctactcgggcacttacactacca

SEQ ID NO: 35771 - DNA, 35 bp, Artificial Sequence
  Synthetic oligonucleotide
aaccgggttgacgaaggaaagccgtattgacccca

SEQ ID NO: 35772 - DNA, 36 bp, Artificial Sequence
  Synthetic oligonucleotide
ggagcccatgacctctaacgtgccccattggtccca

SEQ ID NO: 35773 - DNA, 36 bp, Artificial Sequence
  Synthetic oligonucleotide
tagataaccgcccgctcgctccactacttaatgtca

SEQ ID NO: 35774 - DNA, 37 bp, Artificial Sequence
  Synthetic oligonucleotide
ttgtatcgcacgtattcttagcccttctgtccctaga

SEQ ID NO: 35775 - DNA, 34 bp, Artificial Sequence
  Synthetic oligonucleotide
gcccctgctggcccaccgaccactccatggacga

SEQ ID NO: 35776 - DNA, 37 bp, Artificial Sequence
  Synthetic oligonucleotide
tccgccactgcctcttttggatccgttctctccagga

SEQ ID NO: 35777 - DNA, 37 bp, Artificial Sequence
  Synthetic oligonucleotide
tggggggacgggagaaaagtagtatggttcgggagga

SEQ ID NO: 35778 - DNA, 38 bp, Artificial Sequence
  Synthetic oligonucleotide
gcaatggttggaggaggataggcggtggggcaatgtga

SEQ ID NO: 35779 - DNA, 38 bp, Artificial Sequence
  Synthetic oligonucleotide
gtcgcctgttcaattcgccccctcatgttccacattga

SEQ ID NO: 35780 - DNA, 36 bp, Artificial Sequence
  Synthetic oligonucleotide
acctctacctgctgcaccctttttggtctgacttga

SEQ ID NO: 35781 - DNA, 38 bp, Artificial Sequence
  Synthetic oligonucleotide
acgaagggacacccgtacagcccactcgacccttttga

SEQ ID NO: 35782 - DNA, 36 bp, Artificial Sequence
  Synthetic oligonucleotide
tgagtgtagagtatacggggagtgcgggtggctata

SEQ ID NO: 35783 - DNA, 35 bp, Artificial Sequence
  Synthetic oligonucleotide
aaccgacagaccttggctaccctgaccactctgta

SEQ ID NO: 35784 - DNA, 36 bp, Artificial Sequence
  Synthetic oligonucleotide
tcctacgcggtgtgcatccgctcctccgacctatta

SEQ ID NO: 35785 - DNA, 35 bp, Artificial Sequence
  Synthetic oligonucleotide
acagtcatttccctgattcccccgccgcgcacgcc

SEQ ID NO: 35786 - DNA, 35 bp, Artificial Sequence
  Synthetic oligonucleotide
gtggtcacacacgtctgtcgcgttatcatgatcgc

SEQ ID NO: 35787 - DNA, 35 bp, Artificial Sequence
  Synthetic oligonucleotide
gatccagtacgaagctacggcgaacgcccttactc

SEQ ID NO: 35788 - DNA, 35 bp, Artificial Sequence
  Synthetic oligonucleotide
gagccaaatctactgcgtaagaacgcctacccctc

SEQ ID NO: 35789 - DNA, 35 bp, Artificial Sequence
  Synthetic oligonucleotide
gtgaaacgtcgaaagaactgctatcttcacctgtc

SEQ ID NO: 35790 - DNA, 35 bp, Artificial Sequence
  Synthetic oligonucleotide
tgaggcccagctatgtaatgcggtagccccccttc

SEQ ID NO: 35791 - DNA, 35 bp, Artificial Sequence
  Synthetic oligonucleotide
agtggtcgcaggggggggaggtgcggattgcggcg

SEQ ID NO: 35792 - DNA, 35 bp, Artificial Sequence
  Synthetic oligonucleotide
gcccacttcctactcaccgacggcctatgtacctg

SEQ ID NO: 35793 - DNA, 35 bp, Artificial Sequence
  Synthetic oligonucleotide
tcactctcattccgacccaaggtgggctagccact

SEQ ID NO: 35794 - DNA, 35 bp, Artificial Sequence
  Synthetic oligonucleotide
gtcctcgtgaggaattcacaatcctgtcccactct

SEQ ID NO: 35795 - DNA, 35 bp, Artificial Sequence
  Synthetic oligonucleotide
gcaggggagctttaacggggtggggaagtggagtt

SEQ ID NO: 35796 - DNA, 35 bp, Artificial Sequence
  Synthetic oligonucleotide
ttccacctaacgttgtacgccttacagcccctttt

SEQ ID NO: 35797 - DNA, 36 bp, Artificial Sequence
  Synthetic oligonucleotide
ttgagagagtaggaggagtaggtagggtagctcaaa

SEQ ID NO: 35798 - DNA, 35 bp, Artificial Sequence
  Synthetic oligonucleotide
gcacagggagtgggaggtgcgacatgaggcggaaa

SEQ ID NO: 35799 - DNA, 36 bp, Artificial Sequence
  Synthetic oligonucleotide
gtacatccgcaatggatcccctggacaaataaaaca

SEQ ID NO: 35800 - DNA, 35 bp, Artificial Sequence
  Synthetic oligonucleotide
gactgagaactcccgcatgccgcctttcatggaca

SEQ ID NO: 35801 - DNA, 36 bp, Artificial Sequence
  Synthetic oligonucleotide
gatggtcggatccacccgctcccctgttccacaaga

SEQ ID NO: 35802 - DNA, 35 bp, Artificial Sequence
  Synthetic oligonucleotide
tcaatgctgcctttacccccctggcccacacccga

SEQ ID NO: 35803 - DNA, 37 bp, Artificial Sequence
  Synthetic oligonucleotide
tctgcctcggagtgtctgcgccccctccgttcttcga

SEQ ID NO: 35804 - DNA, 37 bp, Artificial Sequence
  Synthetic oligonucleotide
tgtctctcctgcatacccactgcctccggaattcgga

SEQ ID NO: 35805 - DNA, 38 bp, Artificial Sequence
  Synthetic oligonucleotide
ataccgcccccgcatctgaccccatgggacccttatga

SEQ ID NO: 35806 - DNA, 38 bp, Artificial Sequence
  Synthetic oligonucleotide
acgaccccccacagtctttgaaggatccacccacctga

SEQ ID NO: 35807 - DNA, 38 bp, Artificial Sequence
  Synthetic oligonucleotide
tgcggtgccagccgcttgaacgactctccgtgccctga

SEQ ID NO: 35808 - DNA, 38 bp, Artificial Sequence
  Synthetic oligonucleotide
acctgccctccgttgagtaatcggcttcacatcgctga

SEQ ID NO: 35809 - DNA, 35 bp, Artificial Sequence
  Synthetic oligonucleotide
atctctgcgcttattctatcgggccctgttccata

SEQ ID NO: 35810 - DNA, 36 bp, Artificial Sequence
  Synthetic oligonucleotide
gtgggacggggttgggtgggggcctggcatctccta

SEQ ID NO: 35811 - DNA, 35 bp, Artificial Sequence
  Synthetic oligonucleotide
gcctcgtgaactctgctgttacatccttgcttgcc

SEQ ID NO: 35812 - DNA, 35 bp, Artificial Sequence
  Synthetic oligonucleotide
cccctgccctgtactccccgtgccttgcgccctgc

SEQ ID NO: 35813 - DNA, 35 bp, Artificial Sequence
  Synthetic oligonucleotide
aactccgcactctatcattatggccatacacaatc

SEQ ID NO: 35814 - DNA, 35 bp, Artificial Sequence
  Synthetic oligonucleotide
attgcccgccccattctccttacgtccaccgctgg

SEQ ID NO: 35815 - DNA, 35 bp, Artificial Sequence
  Synthetic oligonucleotide
gctcagctgctgcgataggtccctgcctctctaaa

SEQ ID NO: 35816 - DNA, 36 bp, Artificial Sequence
  Synthetic oligonucleotide
tgcctctccattgttaggtctttacgtatcttcaca

SEQ ID NO: 35817 - DNA, 36 bp, Artificial Sequence
  Synthetic oligonucleotide
tctaacggaacgcgcgctcgtacactctccacgcca

SEQ ID NO: 35818 - DNA, 35 bp, Artificial Sequence
  Synthetic oligonucleotide
gcctaccgttctcgtcgtctcgggcactacaatca

SEQ ID NO: 35819 - DNA, 37 bp, Artificial Sequence
  Synthetic oligonucleotide
acacatcctactcatatgcatgtaatgcctttcaaga

SEQ ID NO: 35820 - DNA, 37 bp, Artificial Sequence
  Synthetic oligonucleotide
acacacccacaccatctctctcgcaggataagggcga

SEQ ID NO: 35821 - DNA, 37 bp, Artificial Sequence
  Synthetic oligonucleotide
tctcactcacgcttgctcctaactaatccaggccgga

SEQ ID NO: 35822 - DNA, 34 bp, Artificial Sequence
  Synthetic oligonucleotide
ttgaaccatccctctgcacccaatactggaatga

SEQ ID NO: 35823 - DNA, 38 bp, Artificial Sequence
  Synthetic oligonucleotide
atccgcgacccgcccaatccctggccgctaggccctga

SEQ ID NO: 35824 - DNA, 38 bp, Artificial Sequence
  Synthetic oligonucleotide
atagccgtccacgctcttatatgcttgtccctcgctga

SEQ ID NO: 35825 - DNA, 37 bp, Artificial Sequence
  Synthetic oligonucleotide
gtcccccttcgttgagtttcgttacccgtaccattga

SEQ ID NO: 35826 - DNA, 38 bp, Artificial Sequence
  Synthetic oligonucleotide
tacgactccagcgccatcctgtacatggcgtaccttga

SEQ ID NO: 35827 - DNA, 38 bp, Artificial Sequence
  Synthetic oligonucleotide
tacatccaggctatgctgcttcgaacatcacaagttga

SEQ ID NO: 35828 - DNA, 38 bp, Artificial Sequence
  Synthetic oligonucleotide
tccacacgcaccacctcaaatatgggcacgtcatttga

SEQ ID NO: 35829 - DNA, 36 bp, Artificial Sequence
  Synthetic oligonucleotide
tacgcactcacttttgtgtctcgtgcgtgtacccta

SEQ ID NO: 35830 - DNA, 35 bp, Artificial Sequence
  Synthetic oligonucleotide
aaacataggcacatcaaagtgcttgccatgccacc

SEQ ID NO: 35831 - DNA, 35 bp, Artificial Sequence
  Synthetic oligonucleotide
gtgcctgctctcttaatcggaccgagccctccacc

SEQ ID NO: 35832 - DNA, 35 bp, Artificial Sequence
  Synthetic oligonucleotide
gtggggacccaggctcgtacactccctccgctccc

SEQ ID NO: 35833 - DNA, 34 bp, Artificial Sequence
  Synthetic oligonucleotide
aacatcccaatattcgccatgtacattggcatcc

SEQ ID NO: 35834 - DNA, 35 bp, Artificial Sequence
  Synthetic oligonucleotide
tagatccgccttaagtcctgtccttggttctctgc

SEQ ID NO: 35835 - DNA, 34 bp, Artificial Sequence
  Synthetic oligonucleotide
tggatgcgcctcatctttctcttagttgcctatc

SEQ ID NO: 35836 - DNA, 35 bp, Artificial Sequence
  Synthetic oligonucleotide
tgtgatactcgtccaaccgtggtccctagttcctc

SEQ ID NO: 35837 - DNA, 35 bp, Artificial Sequence
  Synthetic oligonucleotide
agccgtactgccctccgtgttttaatattgttgtc

SEQ ID NO: 35838 - DNA, 35 bp, Artificial Sequence
  Synthetic oligonucleotide
atcccgcaagtgcgctacagatcccttcattcacg

SEQ ID NO: 35839 - DNA, 35 bp, Artificial Sequence
  Synthetic oligonucleotide
tccccaccccgcacgttcgctatcatagctggcat

SEQ ID NO: 35840 - DNA, 35 bp, Artificial Sequence
  Synthetic oligonucleotide
taccacacctatatcacacgactgtggctcctgct

SEQ ID NO: 35841 - DNA, 35 bp, Artificial Sequence
  Synthetic oligonucleotide
gagcacattccgctcttcgctgggccccccgatct

SEQ ID NO: 35842 - DNA, 36 bp, Artificial Sequence
  Synthetic oligonucleotide
gaaggaggagtaggggtatctgggtaccatgggaca

SEQ ID NO: 35843 - DNA, 36 bp, Artificial Sequence
  Synthetic oligonucleotide
atcccccgctgataggggatcacatactactaccca

SEQ ID NO: 35844 - DNA, 35 bp, Artificial Sequence
  Synthetic oligonucleotide
atggtgcacgctagccccgaatttaattccgccca

SEQ ID NO: 35845 - DNA, 35 bp, Artificial Sequence
  Synthetic oligonucleotide
gcgagcgccacgttgcagtctctacctccactcca

SEQ ID NO: 35846 - DNA, 36 bp, Artificial Sequence
  Synthetic oligonucleotide
gttgttacatcaccgccgccttccttacggtacaga

SEQ ID NO: 35847 - DNA, 37 bp, Artificial Sequence
  Synthetic oligonucleotide
tcaccccgggttccttgctcacgtgccctagccacga

SEQ ID NO: 35848 - DNA, 37 bp, Artificial Sequence
  Synthetic oligonucleotide
tcacccgcgacatggattaactttacccttctaccga

SEQ ID NO: 35849 - DNA, 37 bp, Artificial Sequence
  Synthetic oligonucleotide
tgtcctgtatcacctggctgataatacaattccccga

SEQ ID NO: 35850 - DNA, 37 bp, Artificial Sequence
  Synthetic oligonucleotide
tacgcaggcgcatgctttgaatctcgttgttccccga

SEQ ID NO: 35851 - DNA, 36 bp, Artificial Sequence
  Synthetic oligonucleotide
tctctcccacctcagcatgttatgcgttaacctcga

SEQ ID NO: 35852 - DNA, 36 bp, Artificial Sequence
  Synthetic oligonucleotide
tgattcaccgcctccccttatccgcggaccgaagga

SEQ ID NO: 35853 - DNA, 37 bp, Artificial Sequence
  Synthetic oligonucleotide
acacacctacacaatccgttcctctatctctgtggga

SEQ ID NO: 35854 - DNA, 38 bp, Artificial Sequence
  Synthetic oligonucleotide
accaccatctagtagctctcgttttgccgtgcctatga

SEQ ID NO: 35855 - DNA, 38 bp, Artificial Sequence
  Synthetic oligonucleotide
gtgtcacgcgaacagcacatccacagccccactactga

SEQ ID NO: 35856 - DNA, 36 bp, Artificial Sequence
  Synthetic oligonucleotide
gtctcactgtcacatctctttgaccgctccacgtga

SEQ ID NO: 35857 - DNA, 37 bp, Artificial Sequence
  Synthetic oligonucleotide
gtgtggtcgcaacgtccaacctctctcccttcggtga

SEQ ID NO: 35858 - DNA, 38 bp, Artificial Sequence
  Synthetic oligonucleotide
aactcccaccactgtatgacgataacacagcgatgtga

SEQ ID NO: 35859 - DNA, 38 bp, Artificial Sequence
  Synthetic oligonucleotide
tccacgccctcctaaccgttatgtgttatccgcgttga

SEQ ID NO: 35860 - DNA, 35 bp, Artificial Sequence
  Synthetic oligonucleotide
acccccgcgctatccagaacggcatgaattcgccc

SEQ ID NO: 35861 - DNA, 35 bp, Artificial Sequence
  Synthetic oligonucleotide
gatggacgagggggagaagttaggtcgcagcaagc

SEQ ID NO: 35862 - DNA, 35 bp, Artificial Sequence
  Synthetic oligonucleotide
tgaacagtcgctgtactttctcccaatctggtttc

SEQ ID NO: 35863 - DNA, 35 bp, Artificial Sequence
  Synthetic oligonucleotide
tgcacacgtggtcccgccccatttacttactcaag

SEQ ID NO: 35864 - DNA, 35 bp, Artificial Sequence
  Synthetic oligonucleotide
aaacgtccgatcctctccactcacccgtaatgtag

SEQ ID NO: 35865 - DNA, 35 bp, Artificial Sequence
  Synthetic oligonucleotide
gcaatggggaggagcatggggatgcgggctgaccg

SEQ ID NO: 35866 - DNA, 35 bp, Artificial Sequence
  Synthetic oligonucleotide
tgtgctcgtaacctgcatactttctgacctaaggg

SEQ ID NO: 35867 - DNA, 35 bp, Artificial Sequence
  Synthetic oligonucleotide
gcgacacgcaggtatcgtagcctcatacacccttg

SEQ ID NO: 35868 - DNA, 35 bp, Artificial Sequence
  Synthetic oligonucleotide
gatgcgccccacatctatttctgactctaatatgt

SEQ ID NO: 35869 - DNA, 35 bp, Artificial Sequence
  Synthetic oligonucleotide
tgcaaagttccgtcccaggtcagccacacacactt

SEQ ID NO: 35870 - DNA, 35 bp, Artificial Sequence
  Synthetic oligonucleotide
tccactatactcctcccttgcgtcctgccagcctt

SEQ ID NO: 35871 - DNA, 36 bp, Artificial Sequence
  Synthetic oligonucleotide
gatagtaggggtggaggaagtatacgtgaggcgcaa

SEQ ID NO: 35872 - DNA, 36 bp, Artificial Sequence
  Synthetic oligonucleotide
tttcgcctgtatcccgcctactactcgcctgtacca

SEQ ID NO: 35873 - DNA, 36 bp, Artificial Sequence
  Synthetic oligonucleotide
gtgacaggcggcgagtccgcccaccaacactactca

SEQ ID NO: 35874 - DNA, 35 bp, Artificial Sequence
  Synthetic oligonucleotide
aagtagtgcggtagaaatgattgggtagggcgtca

SEQ ID NO: 35875 - DNA, 36 bp, Artificial Sequence
  Synthetic oligonucleotide
tcccgttccagctggcccgcctcttttatggtgtca

SEQ ID NO: 35876 - DNA, 36 bp, Artificial Sequence
  Synthetic oligonucleotide
tgtctccgccacccagtacggctttttcaatgttca

SEQ ID NO: 35877 - DNA, 37 bp, Artificial Sequence
  Synthetic oligonucleotide
tcccactcgcttggcccctgttttgcttacctgcaga

SEQ ID NO: 35878 - DNA, 36 bp, Artificial Sequence
  Synthetic oligonucleotide
gaactgtgtgggcttggtgcacgggagggggtggga

SEQ ID NO: 35879 - DNA, 38 bp, Artificial Sequence
  Synthetic oligonucleotide
acctcccgcctaccttgaaacttgtataacacaggtga

SEQ ID NO: 35880 - DNA, 38 bp, Artificial Sequence
  Synthetic oligonucleotide
tcatgcccctccgctgcatctcattaggttttcattga

SEQ ID NO: 35881 - DNA, 36 bp, Artificial Sequence
  Synthetic oligonucleotide
tcccagaccgcccgcgcacctgtatccgttccgtta

SEQ ID NO: 35882 - DNA, 35 bp, Artificial Sequence
  Synthetic oligonucleotide
gagcccatccatcttgcagacccgtgggtgctacc

SEQ ID NO: 35883 - DNA, 35 bp, Artificial Sequence
  Synthetic oligonucleotide
acctcacccgcgagacactacaaactacagaatcc

SEQ ID NO: 35884 - DNA, 35 bp, Artificial Sequence
  Synthetic oligonucleotide
gcctgagtccattgatgccgctcctgtttcgctcc

SEQ ID NO: 35885 - DNA, 35 bp, Artificial Sequence
  Synthetic oligonucleotide
tccataaccgccgcccgagcgtatattttggttcc

SEQ ID NO: 35886 - DNA, 35 bp, Artificial Sequence
  Synthetic oligonucleotide
atcgaccgccccctgatcgttgcatttccgtaggc

SEQ ID NO: 35887 - DNA, 35 bp, Artificial Sequence
  Synthetic oligonucleotide
ttgttgccgcatattgacgtttccccccagtttgc

SEQ ID NO: 35888 - DNA, 35 bp, Artificial Sequence
  Synthetic oligonucleotide
gcgtcgctccacttctgccgggctatcaacaactc

SEQ ID NO: 35889 - DNA, 35 bp, Artificial Sequence
  Synthetic oligonucleotide
gcactgcaaggcgcttattttcgggactcgacctc

SEQ ID NO: 35890 - DNA, 35 bp, Artificial Sequence
  Synthetic oligonucleotide
acctccgccgctcgacctgtcttgcctttacctag

SEQ ID NO: 35891 - DNA, 35 bp, Artificial Sequence
  Synthetic oligonucleotide
gccggaatagtcgggggtgggggtgttgggtgagg

SEQ ID NO: 35892 - DNA, 35 bp, Artificial Sequence
  Synthetic oligonucleotide
gaactacgtggggttcgattggacggaggggaggg

SEQ ID NO: 35893 - DNA, 35 bp, Artificial Sequence
  Synthetic oligonucleotide
acacgaaaacccatcatcccagctccctttatggg

SEQ ID NO: 35894 - DNA, 35 bp, Artificial Sequence
  Synthetic oligonucleotide
tcgaggccctcacattttcatagcatgccgcacat

SEQ ID NO: 35895 - DNA, 35 bp, Artificial Sequence
  Synthetic oligonucleotide
actcatctgcccactcggctgacaaccgggactct

SEQ ID NO: 35896 - DNA, 35 bp, Artificial Sequence
  Synthetic oligonucleotide
acccaccgctagattaatactcgatctccgtctct

SEQ ID NO: 35897 - DNA, 36 bp, Artificial Sequence
  Synthetic oligonucleotide
aactgccgtcattttccacgccatgtacgttcaaca

SEQ ID NO: 35898 - DNA, 36 bp, Artificial Sequence
  Synthetic oligonucleotide
atgccaaccccctttgcagttgacacttagactaca

SEQ ID NO: 35899 - DNA, 36 bp, Artificial Sequence
  Synthetic oligonucleotide
tcaccgaacaagcctcacctcatacccgccagacca

SEQ ID NO: 35900 - DNA, 36 bp, Artificial Sequence
  Synthetic oligonucleotide
gtctcgccccggaccggccatacaatgcctgcccca

SEQ ID NO: 35901 - DNA, 36 bp, Artificial Sequence
  Synthetic oligonucleotide
gaacaccctctcgattaggtcacgctacgcaccgca

SEQ ID NO: 35902 - DNA, 36 bp, Artificial Sequence
  Synthetic oligonucleotide
tcctgcacaatcgaatgcccaggtatcccactatca

SEQ ID NO: 35903 - DNA, 37 bp, Artificial Sequence
  Synthetic oligonucleotide
agcctgtcctcacacgaaccacctgagtcatccaaga

SEQ ID NO: 35904 - DNA, 34 bp, Artificial Sequence
  Synthetic oligonucleotide
gtgaacacatgttccgacctcctccactctgaga

SEQ ID NO: 35905 - DNA, 37 bp, Artificial Sequence
  Synthetic oligonucleotide
atggccaggttctaacgcgcaaattgcccagcctcga

SEQ ID NO: 35906 - DNA, 36 bp, Artificial Sequence
  Synthetic oligonucleotide
ggtagaggggtcatataggtggctgcatggtgagga

SEQ ID NO: 35907 - DNA, 35 bp, Artificial Sequence
  Synthetic oligonucleotide
acgtgtgcaagcaaagtatgaaaggcgggtgggga

SEQ ID NO: 35908 - DNA, 38 bp, Artificial Sequence
  Synthetic oligonucleotide
gatcacaagtgtgtcatgtacaccaccatcctcactga

SEQ ID NO: 35909 - DNA, 38 bp, Artificial Sequence
  Synthetic oligonucleotide
tccaatccctcgcaggtacgactctgctcctgtgctga

SEQ ID NO: 35910 - DNA, 38 bp, Artificial Sequence
  Synthetic oligonucleotide
accgatccagtcatattgggtgagggatgggtgggtga

SEQ ID NO: 35911 - DNA, 38 bp, Artificial Sequence
  Synthetic oligonucleotide
acgaccccgtacggcctggtttggtctgcccacattga

SEQ ID NO: 35912 - DNA, 38 bp, Artificial Sequence
  Synthetic oligonucleotide
gtggcgagtgcaccactgccgattctctcactcattga

SEQ ID NO: 35913 - DNA, 38 bp, Artificial Sequence
  Synthetic oligonucleotide
aacctctcaaccgctgatcttgacgccacccgtattga

SEQ ID NO: 35914 - DNA, 38 bp, Artificial Sequence
  Synthetic oligonucleotide
acccgtatcaggcgggttgtagccatccgaattattga

SEQ ID NO: 35915 - DNA, 38 bp, Artificial Sequence
  Synthetic oligonucleotide
tgagctccgtaggttacttcttgccctgactcctttga

SEQ ID NO: 35916 - DNA, 38 bp, Artificial Sequence
  Synthetic oligonucleotide
gggggtccacgcacttccctttccctcgcagtctttga

SEQ ID NO: 35917 - DNA, 38 bp, Artificial Sequence
  Synthetic oligonucleotide
gggacgggagtcggcctgggaggggagggaagttttga

SEQ ID NO: 35918 - DNA, 36 bp, Artificial Sequence
  Synthetic oligonucleotide
gatccacattctgctttgctgggactcgataaccta

SEQ ID NO: 35919 - DNA, 35 bp, Artificial Sequence
  Synthetic oligonucleotide
gtaacaaggcgagcctcactactcgggccttccta

SEQ ID NO: 35920 - DNA, 35 bp, Artificial Sequence
  Synthetic oligonucleotide
ttatgccgcccacataaagctatccccccttagta

SEQ ID NO: 35921 - DNA, 36 bp, Artificial Sequence
  Synthetic oligonucleotide
tgatcacatggaccacgcatatgaattctttcctta

SEQ ID NO: 35922 - DNA, 35 bp, Artificial Sequence
  Synthetic oligonucleotide
gtttgcgcatcttgtcccgcggaacacccctgaac

SEQ ID NO: 35923 - DNA, 35 bp, Artificial Sequence
  Synthetic oligonucleotide
aggacgtgccccgagagttagcttttctgtgccac

SEQ ID NO: 35924 - DNA, 35 bp, Artificial Sequence
  Synthetic oligonucleotide
taagactcgcacgccgtgtccatccacttgaaacc

SEQ ID NO: 35925 - DNA, 35 bp, Artificial Sequence
  Synthetic oligonucleotide
gttgcccacagactgcacacgtacgaagccccgcc

SEQ ID NO: 35926 - DNA, 35 bp, Artificial Sequence
  Synthetic oligonucleotide
tgtccaactggagtcgacacaaactagcctgtatc

SEQ ID NO: 35927 - DNA, 36 bp, Artificial Sequence
  Synthetic oligonucleotide
gatacgcagtggaactaacaacgcaataccaaactc

SEQ ID NO: 35928 - DNA, 35 bp, Artificial Sequence
  Synthetic oligonucleotide
tcctgcacccccgccttgttgatcccctcctctcg

SEQ ID NO: 35929 - DNA, 35 bp, Artificial Sequence
  Synthetic oligonucleotide
gcctgtttcccacgtactttaatggcctcatctat

SEQ ID NO: 35930 - DNA, 36 bp, Artificial Sequence
  Synthetic oligonucleotide
atttgccgacggttccattatgtaccgattttccaa

SEQ ID NO: 35931 - DNA, 35 bp, Artificial Sequence
  Synthetic oligonucleotide
tttcgaccacctctataggcccttactgacagaca

SEQ ID NO: 35932 - DNA, 36 bp, Artificial Sequence
  Synthetic oligonucleotide
tacatgtatgccaacgttcgcccccgcacacctcca

SEQ ID NO: 35933 - DNA, 36 bp, Artificial Sequence
  Synthetic oligonucleotide
tctccaaacggtcccctgttccattgttcttccgca

SEQ ID NO: 35934 - DNA, 36 bp, Artificial Sequence
  Synthetic oligonucleotide
gctatcaccccaccgcgagtacttgagttacgctca

SEQ ID NO: 35935 - DNA, 35 bp, Artificial Sequence
  Synthetic oligonucleotide
gtgcccggctctatgaggctacatcaattttctca

SEQ ID NO: 35936 - DNA, 36 bp, Artificial Sequence
  Synthetic oligonucleotide
tgtacacgccagggtccaaacacaaacaccaccaga

SEQ ID NO: 35937 - DNA, 37 bp, Artificial Sequence
  Synthetic oligonucleotide
actgacaccgccgaaccctaatatcccacctgcgaga

SEQ ID NO: 35938 - DNA, 37 bp, Artificial Sequence
  Synthetic oligonucleotide
acaatccttgcatgcccgtcgttcacccccctcccga

SEQ ID NO: 35939 - DNA, 37 bp, Artificial Sequence
  Synthetic oligonucleotide
gagacggaggacacgagggggtaggagatgaagtgga

SEQ ID NO: 35940 - DNA, 36 bp, Artificial Sequence
  Synthetic oligonucleotide
gaacacatgcagggtttaggaaccaattgcagtgga

SEQ ID NO: 35941 - DNA, 38 bp, Artificial Sequence
  Synthetic oligonucleotide
tctgatgggtgggtggtttgtgggggtccttaacatga

SEQ ID NO: 35942 - DNA, 38 bp, Artificial Sequence
  Synthetic oligonucleotide
ttgcggaccgcctgaccttatttaaactgcctgactga

SEQ ID NO: 35943 - DNA, 38 bp, Artificial Sequence
  Synthetic oligonucleotide
tccgtcagagttttcccgccaatgttcctcgccgctga

SEQ ID NO: 35944 - DNA, 37 bp, Artificial Sequence
  Synthetic oligonucleotide
acaaccacagtagcttacgtcctctgtcccgtggtga

SEQ ID NO: 35945 - DNA, 37 bp, Artificial Sequence
  Synthetic oligonucleotide
atgtggtcatcacagctactgactcccactgacttga

SEQ ID NO: 35946 - DNA, 38 bp, Artificial Sequence
  Synthetic oligonucleotide
acccccctcccatgccccctaataggtatttagcttga

SEQ ID NO: 35947 - DNA, 38 bp, Artificial Sequence
  Synthetic oligonucleotide
gtacgatcggcaatgcctatctcgtcctgttcatttga

SEQ ID NO: 35948 - DNA, 36 bp, Artificial Sequence
  Synthetic oligonucleotide
aagactacggagggggggcatggaacgtacttgcta

SEQ ID NO: 35949 - DNA, 36 bp, Artificial Sequence
  Synthetic oligonucleotide
gtcacatccatgctgtggatcgatttgatccttcta

SEQ ID NO: 35950 - DNA, 36 bp, Artificial Sequence
  Synthetic oligonucleotide
atcccctcatgtttaaccgatacctgttgtgaggta

SEQ ID NO: 35951 - DNA, 35 bp, Artificial Sequence
  Synthetic oligonucleotide
tgcggatcagtctgcgtacggctttcatttgtcac

SEQ ID NO: 35952 - DNA, 35 bp, Artificial Sequence
  Synthetic oligonucleotide
aacctccctagacgttagtactgctaaaacccgac

SEQ ID NO: 35953 - DNA, 35 bp, Artificial Sequence
  Synthetic oligonucleotide
ataccgatagtaccgcagcacccatggtccttccc

SEQ ID NO: 35954 - DNA, 35 bp, Artificial Sequence
  Synthetic oligonucleotide
tcatacaccgcaaatggtttgccctttctttggcc

SEQ ID NO: 35955 - DNA, 35 bp, Artificial Sequence
  Synthetic oligonucleotide
acagacgacccaaacggtgatacacgctaccatcc

SEQ ID NO: 35956 - DNA, 35 bp, Artificial Sequence
  Synthetic oligonucleotide
gtgcctggaactccttgtcctatggtttacacatc

SEQ ID NO: 35957 - DNA, 35 bp, Artificial Sequence
  Synthetic oligonucleotide
gagtgcgtagccgatgcccctccgttgccaggttc

SEQ ID NO: 35958 - DNA, 35 bp, Artificial Sequence
  Synthetic oligonucleotide
atccgatcgtgcccgccagactcccgccactattg

SEQ ID NO: 35959 - DNA, 35 bp, Artificial Sequence
  Synthetic oligonucleotide
tagccacacgtttcatcccattagaataatgcgct

SEQ ID NO: 35960 - DNA, 35 bp, Artificial Sequence
  Synthetic oligonucleotide
gcctggtacacatgggttgtccaatcctgaccatt

SEQ ID NO: 35961 - DNA, 35 bp, Artificial Sequence
  Synthetic oligonucleotide
tgaatctgtcagcgcgactaaaatcctgcactgtt

SEQ ID NO: 35962 - DNA, 35 bp, Artificial Sequence
  Synthetic oligonucleotide
tctccgctccgcctgtactgacggccttttcattt

SEQ ID NO: 35963 - DNA, 35 bp, Artificial Sequence
  Synthetic oligonucleotide
tagtacccccgagtgactcacaccgtagtaccttt

SEQ ID NO: 35964 - DNA, 36 bp, Artificial Sequence
  Synthetic oligonucleotide
acagacgccccccttgtcatatctggtcgtcttcaa

SEQ ID NO: 35965 - DNA, 35 bp, Artificial Sequence
  Synthetic oligonucleotide
tctggaggggttttggggaagggaggggctggcca

SEQ ID NO: 35966 - DNA, 36 bp, Artificial Sequence
  Synthetic oligonucleotide
gatttccacccatgcgtttcgtctcaacccttgcca

SEQ ID NO: 35967 - DNA, 36 bp, Artificial Sequence
  Synthetic oligonucleotide
tccatctagccaccaggttgccaccgtgcctacgca

SEQ ID NO: 35968 - DNA, 36 bp, Artificial Sequence
  Synthetic oligonucleotide
aacgcccaccaaatgtcatcactgccacgaacggca

SEQ ID NO: 35969 - DNA, 35 bp, Artificial Sequence
  Synthetic oligonucleotide
gttggggtgatggtggggatggatatgagtgtgca

SEQ ID NO: 35970 - DNA, 37 bp, Artificial Sequence
  Synthetic oligonucleotide
acaactgagtgggtgtgtgaaaagggggggcgggaga

SEQ ID NO: 35971 - DNA, 35 bp, Artificial Sequence
  Synthetic oligonucleotide
aacgggggggaggagggttactgtagttattacga

SEQ ID NO: 35972 - DNA, 37 bp, Artificial Sequence
  Synthetic oligonucleotide
actgaggtacgtacgtgatgagaaacaacgaaaccga

SEQ ID NO: 35973 - DNA, 36 bp, Artificial Sequence
  Synthetic oligonucleotide
tgactcctctgacaccggcgctagggcccccaccga

SEQ ID NO: 35974 - DNA, 35 bp, Artificial Sequence
  Synthetic oligonucleotide
gccattcccgcagacgatgccggttttctatccga

SEQ ID NO: 35975 - DNA, 37 bp, Artificial Sequence
  Synthetic oligonucleotide
tgccaccgcttgcgctgacacatacctgctttttgga

SEQ ID NO: 35976 - DNA, 38 bp, Artificial Sequence
  Synthetic oligonucleotide
gaatgggagcacgggtttggttttgggtgggcaagtga

SEQ ID NO: 35977 - DNA, 38 bp, Artificial Sequence
  Synthetic oligonucleotide
tatcggggagggtggaatggaagaacggtgtatcgtga

SEQ ID NO: 35978 - DNA, 36 bp, Artificial Sequence
  Synthetic oligonucleotide
gtgaccacatcctgccttaccgtgactcgactttga

SEQ ID NO: 35979 - DNA, 36 bp, Artificial Sequence
  Synthetic oligonucleotide
ggagccatcctcacccccatgggacacctgcaaata

SEQ ID NO: 35980 - DNA, 36 bp, Artificial Sequence
  Synthetic oligonucleotide
gcaaacccatcgttactgcgcaaagcctcatccata

SEQ ID NO: 35981 - DNA, 36 bp, Artificial Sequence
  Synthetic oligonucleotide
tgacgaacgcaccctcccgcataatagtggccgcta

SEQ ID NO: 35982 - DNA, 35 bp, Artificial Sequence
  Synthetic oligonucleotide
tccatacctgatgtcctcgcctgagttatctaaac

SEQ ID NO: 35983 - DNA, 34 bp, Artificial Sequence
  Synthetic oligonucleotide
acatgccttaggttttgatcccgttctgttttac

SEQ ID NO: 35984 - DNA, 35 bp, Artificial Sequence
  Synthetic oligonucleotide
tctcgccaaactcgttcctaagtcacctcagcctc

SEQ ID NO: 35985 - DNA, 35 bp, Artificial Sequence
  Synthetic oligonucleotide
gtcagacctccctgctctcgaaaatcggtcactcg

SEQ ID NO: 35986 - DNA, 35 bp, Artificial Sequence
  Synthetic oligonucleotide
atgccacgtgcgaatctttttttgaccggctactg

SEQ ID NO: 35987 - DNA, 34 bp, Artificial Sequence
  Synthetic oligonucleotide
accgccaccatgtttcactcgatctctttaggtg

SEQ ID NO: 35988 - DNA, 35 bp, Artificial Sequence
  Synthetic oligonucleotide
accgaccgggcaagatgaccaacccgctcctgact

SEQ ID NO: 35989 - DNA, 35 bp, Artificial Sequence
  Synthetic oligonucleotide
gtgacgtacgcattcctcttccgccaccatcatct

SEQ ID NO: 35990 - DNA, 35 bp, Artificial Sequence
  Synthetic oligonucleotide
tcactaggtgaaaccacgccttatctttcgacatt

SEQ ID NO: 35991 - DNA, 35 bp, Artificial Sequence
  Synthetic oligonucleotide
tgatccctcacggtcctctaatcctactgccgttt

SEQ ID NO: 35992 - DNA, 36 bp, Artificial Sequence
  Synthetic oligonucleotide
gaatccccctctgcagtgttggagtcccacctgtaa

SEQ ID NO: 35993 - DNA, 37 bp, Artificial Sequence
  Synthetic oligonucleotide
aatcgccacccacccagttattgcagccttcgttaga

SEQ ID NO: 35994 - DNA, 37 bp, Artificial Sequence
  Synthetic oligonucleotide
actggggcgccacgacgtccattattcccattcacga

SEQ ID NO: 35995 - DNA, 36 bp, Artificial Sequence
  Synthetic oligonucleotide
accacactagcctgcgtatctctctaaggttttcga

SEQ ID NO: 35996 - DNA, 37 bp, Artificial Sequence
  Synthetic oligonucleotide
tactggccacacctctgttattatttcctgtgctgga

SEQ ID NO: 35997 - DNA, 38 bp, Artificial Sequence
  Synthetic oligonucleotide
tttcacctacctgccccagcagacatcgccgacggtga

SEQ ID NO: 35998 - DNA, 35 bp, Artificial Sequence
  Synthetic oligonucleotide
accgctctcacatcttatagtgattcacttgaaac

SEQ ID NO: 35999 - DNA, 35 bp, Artificial Sequence
  Synthetic oligonucleotide
gccggccacacccgcgcttcgccccatctcatgac

SEQ ID NO: 36000 - DNA, 35 bp, Artificial Sequence
  Synthetic oligonucleotide
ttacagcaggtcacactcgtagctatacaaacctc

SEQ ID NO: 36001 - DNA, 35 bp, Artificial Sequence
  Synthetic oligonucleotide
tccgacccatacgtgcgttatttttcgaaatgctc

SEQ ID NO: 36002 - DNA, 35 bp, Artificial Sequence
  Synthetic oligonucleotide
tacgacaagaagggtgagtggctgatggaattgtc

SEQ ID NO: 36003 - DNA, 35 bp, Artificial Sequence
  Synthetic oligonucleotide
tcacggacacattcccgtacatccgtctttttgtc

SEQ ID NO: 36004 - DNA, 35 bp, Artificial Sequence
  Synthetic oligonucleotide
agacaagtagtgggggaattagggggcgttgaaag

SEQ ID NO: 36005 - DNA, 35 bp, Artificial Sequence
  Synthetic oligonucleotide
accgattgaacacatcccataaggaccagagaacg

SEQ ID NO: 36006 - DNA, 35 bp, Artificial Sequence
  Synthetic oligonucleotide
gccaccccctccccgttccgagaatacgattgccg

SEQ ID NO: 36007 - DNA, 35 bp, Artificial Sequence
  Synthetic oligonucleotide
gcaccggcggacaattaatggccactgtttcctct

SEQ ID NO: 36008 - DNA, 35 bp, Artificial Sequence
  Synthetic oligonucleotide
tctgagaaaactgccccattagactcgaaccctgt

SEQ ID NO: 36009 - DNA, 35 bp, Artificial Sequence
  Synthetic oligonucleotide
tcctcatcacgtgcgtcctcagcctctgttgcatt

SEQ ID NO: 36010 - DNA, 35 bp, Artificial Sequence
  Synthetic oligonucleotide
gtactcccccttattgctaaagcaactgcatattt

SEQ ID NO: 36011 - DNA, 36 bp, Artificial Sequence
  Synthetic oligonucleotide
taaagcctccctgtacccgcctttcacccgcacgaa

SEQ ID NO: 36012 - DNA, 36 bp, Artificial Sequence
  Synthetic oligonucleotide
actgccggacgtcacccgctatgaccgtctacccca

SEQ ID NO: 36013 - DNA, 36 bp, Artificial Sequence
  Synthetic oligonucleotide
acgtatttccccctgcccacgacggccttacgccca

SEQ ID NO: 36014 - DNA, 35 bp, Artificial Sequence
  Synthetic oligonucleotide
acatcatcatcgacacaaatcacagtccttgtgca

SEQ ID NO: 36015 - DNA, 37 bp, Artificial Sequence
  Synthetic oligonucleotide
acatccactgagatccgtttacccgacctatatatca

SEQ ID NO: 36016 - DNA, 37 bp, Artificial Sequence
  Synthetic oligonucleotide
tcgacccctctttggccttctgactgatctgttcaga

SEQ ID NO: 36017 - DNA, 36 bp, Artificial Sequence
  Synthetic oligonucleotide
gccccaccatcctctctcctctcgatacttcgtaga

SEQ ID NO: 36018 - DNA, 37 bp, Artificial Sequence
  Synthetic oligonucleotide
ttggccggaagttcttcgccacccctcttggacccga

SEQ ID NO: 36019 - DNA, 37 bp, Artificial Sequence
  Synthetic oligonucleotide
gttgaaggaaggatggtgaggtgcaggggaaaagcga

SEQ ID NO: 36020 - DNA, 35 bp, Artificial Sequence
  Synthetic oligonucleotide
gcccactctctccgccccgttgttcagactttgga

SEQ ID NO: 36021 - DNA, 35 bp, Artificial Sequence
  Synthetic oligonucleotide
atactctcaccgtcaccgccacgcacgctccatga

SEQ ID NO: 36022 - DNA, 38 bp, Artificial Sequence
  Synthetic oligonucleotide
tcagctcagcctattccgccatctgacccgccaattga

SEQ ID NO: 36023 - DNA, 38 bp, Artificial Sequence
  Synthetic oligonucleotide
atcctcatccccgtgtgctactaatggctctcgcttga

SEQ ID NO: 36024 - DNA, 36 bp, Artificial Sequence
  Synthetic oligonucleotide
tgcacgtgctctgctaaatcattgccgcccatccta

SEQ ID NO: 36025 - DNA, 35 bp, Artificial Sequence
  Synthetic oligonucleotide
tgttcctcccccatgtttccacatttaggtgttac

SEQ ID NO: 36026 - DNA, 35 bp, Artificial Sequence
  Synthetic oligonucleotide
acccacccatcacatctactggtgtccatcctacc

SEQ ID NO: 36027 - DNA, 35 bp, Artificial Sequence
  Synthetic oligonucleotide
gcgacggctcaaactccttctcgctccgggtcggc

SEQ ID NO: 36028 - DNA, 35 bp, Artificial Sequence
  Synthetic oligonucleotide
ttgccctggcacaccctgcgacgtacttgcgaatc

SEQ ID NO: 36029 - DNA, 35 bp, Artificial Sequence
  Synthetic oligonucleotide
gacgcgcaaacgcgttggttcgatcgcctgtcatc

SEQ ID NO: 36030 - DNA, 35 bp, Artificial Sequence
  Synthetic oligonucleotide
gtcgggcccttgtcttcattaatcaccttttaacg

SEQ ID NO: 36031 - DNA, 35 bp, Artificial Sequence
  Synthetic oligonucleotide
tcgcctctaccaactgccacatggcccacttcgcg

SEQ ID NO: 36032 - DNA, 35 bp, Artificial Sequence
  Synthetic oligonucleotide
gataggatggaacatggatagaggtacacaggggg

SEQ ID NO: 36033 - DNA, 35 bp, Artificial Sequence
  Synthetic oligonucleotide
gcatgcacggctcccatgcgaacctggaatttcat

SEQ ID NO: 36034 - DNA, 35 bp, Artificial Sequence
  Synthetic oligonucleotide
atccctgttcacgtctccacattgactgcctcact

SEQ ID NO: 36035 - DNA, 35 bp, Artificial Sequence
  Synthetic oligonucleotide
acgcccctcatccccagatgacccaacacattact

SEQ ID NO: 36036 - DNA, 35 bp, Artificial Sequence
  Synthetic oligonucleotide
gtctcagtgtcccatgcccccgggctcgtttccct

SEQ ID NO: 36037 - DNA, 35 bp, Artificial Sequence
  Synthetic oligonucleotide
tgtgactgtaccgctccctccgttgccgtatcaaa

SEQ ID NO: 36038 - DNA, 35 bp, Artificial Sequence
  Synthetic oligonucleotide
gtcacctccgccccgctatgctcacagttcatcaa

SEQ ID NO: 36039 - DNA, 36 bp, Artificial Sequence
  Synthetic oligonucleotide
gcgaaggggggtcgggatagggacaaaattggagca

SEQ ID NO: 36040 - DNA, 36 bp, Artificial Sequence
  Synthetic oligonucleotide
tgacatgtccggttgcatcttcatcactttatctca

SEQ ID NO: 36041 - DNA, 36 bp, Artificial Sequence
  Synthetic oligonucleotide
atccgacacggcgcgtagccttagctgatcctttca

SEQ ID NO: 36042 - DNA, 38 bp, Artificial Sequence
  Synthetic oligonucleotide
agcgaggggaccgggcgtggtaggcgaaggaaaaatga

SEQ ID NO: 36043 - DNA, 38 bp, Artificial Sequence
  Synthetic oligonucleotide
agctgggaggagaagaggagaggggaagttgtaaatga

SEQ ID NO: 36044 - DNA, 36 bp, Artificial Sequence
  Synthetic oligonucleotide
aagtgctgcagatagcatggtagggaaggagcatga

SEQ ID NO: 36045 - DNA, 37 bp, Artificial Sequence
  Synthetic oligonucleotide
atggggagagcaagggagggaggtcaccgaatcatga

SEQ ID NO: 36046 - DNA, 38 bp, Artificial Sequence
  Synthetic oligonucleotide
tgaggtgggtcgggcaaggagtagtgggaggaagatga

SEQ ID NO: 36047 - DNA, 38 bp, Artificial Sequence
  Synthetic oligonucleotide
tccatctaccggtcgtccttttgccccagtctgcctga

SEQ ID NO: 36048 - DNA, 38 bp, Artificial Sequence
  Synthetic oligonucleotide
tacccggcaactttccacattataacgccttgtcctga

SEQ ID NO: 36049 - DNA, 37 bp, Artificial Sequence
  Synthetic oligonucleotide
aacgtgacgcagtagggagggattatatcgggggtga

SEQ ID NO: 36050 - DNA, 36 bp, Artificial Sequence
  Synthetic oligonucleotide
aggatcgtgccgcctgtctaactttccctcctaata

SEQ ID NO: 36051 - DNA, 35 bp, Artificial Sequence
  Synthetic oligonucleotide
gtacacttgcctgttctagttgccccctcgttata

SEQ ID NO: 36052 - DNA, 36 bp, Artificial Sequence
  Synthetic oligonucleotide
acaccccttacgacgctatctacagttggcatttta

SEQ ID NO: 36053 - DNA, 35 bp, Artificial Sequence
  Synthetic oligonucleotide
agcatgcccggtactcgttttccagctttaacacc

SEQ ID NO: 36054 - DNA, 35 bp, Artificial Sequence
  Synthetic oligonucleotide
agcgagccgactattcaggcccacatccttccgcc

SEQ ID NO: 36055 - DNA, 35 bp, Artificial Sequence
  Synthetic oligonucleotide
gatgagatctgctctgcgcacggttcctacctctc

SEQ ID NO: 36056 - DNA, 35 bp, Artificial Sequence
  Synthetic oligonucleotide
tccccgacgccccagccccaccagacaaaggcttc

SEQ ID NO: 36057 - DNA, 35 bp, Artificial Sequence
  Synthetic oligonucleotide
aagacggggagaaacgttaatggagcagatcggag

SEQ ID NO: 36058 - DNA, 35 bp, Artificial Sequence
  Synthetic oligonucleotide
gtaggggggtgaggggtagaatagtccttcgggag

SEQ ID NO: 36059 - DNA, 35 bp, Artificial Sequence
  Synthetic oligonucleotide
gagagagaagccaggttgtaagtggaagggcgagg

SEQ ID NO: 36060 - DNA, 35 bp, Artificial Sequence
  Synthetic oligonucleotide
gcgaaatgggtgaaaggaggaagggtagtcggttg

SEQ ID NO: 36061 - DNA, 35 bp, Artificial Sequence
  Synthetic oligonucleotide
tccagcgctccatgccaacggtcgaagccaaccat

SEQ ID NO: 36062 - DNA, 35 bp, Artificial Sequence
  Synthetic oligonucleotide
ttgtccacctctatgccactctgcgcggttcctat

SEQ ID NO: 36063 - DNA, 35 bp, Artificial Sequence
  Synthetic oligonucleotide
ttcctaggccgtagtgctccagctttgtccacact

SEQ ID NO: 36064 - DNA, 35 bp, Artificial Sequence
  Synthetic oligonucleotide
ggatctatcgaacgtatggtcttgcactcactcct

SEQ ID NO: 36065 - DNA, 35 bp, Artificial Sequence
  Synthetic oligonucleotide
agtagcccaaacccagctgtaaccaccgaacctct

SEQ ID NO: 36066 - DNA, 35 bp, Artificial Sequence
  Synthetic oligonucleotide
tatctgcatcaccatgtgcgatcaccccacgcctt

SEQ ID NO: 36067 - DNA, 35 bp, Artificial Sequence
  Synthetic oligonucleotide
tgatacatgcatcacaggccacccacgatcatctt

SEQ ID NO: 36068 - DNA, 36 bp, Artificial Sequence
  Synthetic oligonucleotide
actgcgggctccttctacactatgcattgcgccaaa

SEQ ID NO: 36069 - DNA, 36 bp, Artificial Sequence
  Synthetic oligonucleotide
tagggggacagggccggaaactgtaggataggcaaa

SEQ ID NO: 36070 - DNA, 36 bp, Artificial Sequence
  Synthetic oligonucleotide
gttacaaccccggcctggtctctctcttcatgcgaa

SEQ ID NO: 36071 - DNA, 35 bp, Artificial Sequence
  Synthetic oligonucleotide
gaagacgcacctgctacgtaactggtgctgtgaca

SEQ ID NO: 36072 - DNA, 36 bp, Artificial Sequence
  Synthetic oligonucleotide
gacgccacggctttatgcttccatggtacatttaca

SEQ ID NO: 36073 - DNA, 36 bp, Artificial Sequence
  Synthetic oligonucleotide
attccgcccctcggaccgcccgtataccagctctca

SEQ ID NO: 36074 - DNA, 37 bp, Artificial Sequence
  Synthetic oligonucleotide
gcgacgtgcccaggtaacgccctccgcttctttgaga

SEQ ID NO: 36075 - DNA, 37 bp, Artificial Sequence
  Synthetic oligonucleotide
agcgagggcctaacattgattccaccgtcctcaacga

SEQ ID NO: 36076 - DNA, 37 bp, Artificial Sequence
  Synthetic oligonucleotide
gccagtcgaattcttgcctccgtttcgcccaaaccga

SEQ ID NO: 36077 - DNA, 37 bp, Artificial Sequence
  Synthetic oligonucleotide
acagcacccgcccgattcacccctcctggcatatcga

SEQ ID NO: 36078 - DNA, 37 bp, Artificial Sequence
  Synthetic oligonucleotide
atgacaacagaccagcaactgcgtacccgaacttcga

SEQ ID NO: 36079 - DNA, 35 bp, Artificial Sequence
  Synthetic oligonucleotide
tgaggaggagggcaactgcaggtaggggcggagga

SEQ ID NO: 36080 - DNA, 38 bp, Artificial Sequence
  Synthetic oligonucleotide
ccaatgctcaggtccaccacgcctcgtcatatctctga

SEQ ID NO: 36081 - DNA, 38 bp, Artificial Sequence
  Synthetic oligonucleotide
tggatgggaaaaggcgctgctggaagggaattgagtga

SEQ ID NO: 36082 - DNA, 38 bp, Artificial Sequence
  Synthetic oligonucleotide
acggggctgggcggcggggctcgggaaggcacaggtga

SEQ ID NO: 36083 - DNA, 38 bp, Artificial Sequence
  Synthetic oligonucleotide
tacacaaggggggcaagcagtgctgctgggaacggtga

SEQ ID NO: 36084 - DNA, 37 bp, Artificial Sequence
  Synthetic oligonucleotide
gttgacgccgaatgtatccggttcaccctgcccttga

SEQ ID NO: 36085 - DNA, 38 bp, Artificial Sequence
  Synthetic oligonucleotide
tcccaccttcagatttatgctctccactcatgcgttga

SEQ ID NO: 36086 - DNA, 38 bp, Artificial Sequence
  Synthetic oligonucleotide
acaactcccgcgggcacgtgctatccccgaactgttga

SEQ ID NO: 36087 - DNA, 35 bp, Artificial Sequence
  Synthetic oligonucleotide
tctgaagctgttggccatttctccttagtcgcccc

SEQ ID NO: 36088 - DNA, 35 bp, Artificial Sequence
  Synthetic oligonucleotide
aacgagagtgtgctgcacctatccatgtcttagcc

SEQ ID NO: 36089 - DNA, 35 bp, Artificial Sequence
  Synthetic oligonucleotide
tcccgcagggggcaaaaactggtccgacgaacgcc

SEQ ID NO: 36090 - DNA, 35 bp, Artificial Sequence
  Synthetic oligonucleotide
taccgacgatggtaccacattactaccccgccgcc

SEQ ID NO: 36091 - DNA, 35 bp, Artificial Sequence
  Synthetic oligonucleotide
tttccatcccagcacgagcgttcctcgcgttcgcc

SEQ ID NO: 36092 - DNA, 35 bp, Artificial Sequence
  Synthetic oligonucleotide
atagcacacgacccgttgcatgatcggtgttctcc

SEQ ID NO: 36093 - DNA, 35 bp, Artificial Sequence
  Synthetic oligonucleotide
attaccgaaacacttcgccccttgacacgcggagc

SEQ ID NO: 36094 - DNA, 35 bp, Artificial Sequence
  Synthetic oligonucleotide
taatgcaactgtcaaccgtcgacccactctactgc

SEQ ID NO: 36095 - DNA, 35 bp, Artificial Sequence
  Synthetic oligonucleotide
gaaatgtcccggccgctttcgctcccacgcaactc

SEQ ID NO: 36096 - DNA, 35 bp, Artificial Sequence
  Synthetic oligonucleotide
atgactcatatcccatcctgtactatcgcacattg

SEQ ID NO: 36097 - DNA, 35 bp, Artificial Sequence
  Synthetic oligonucleotide
gtgataccgtgtcgttatgcaaacgtgcacctact

SEQ ID NO: 36098 - DNA, 35 bp, Artificial Sequence
  Synthetic oligonucleotide
acgtggtcgcctcctacgccttccagtatattgtt

SEQ ID NO: 36099 - DNA, 35 bp, Artificial Sequence
  Synthetic oligonucleotide
tcccagcaacatcttcgggcgatggcatacttttt

SEQ ID NO: 36100 - DNA, 35 bp, Artificial Sequence
  Synthetic oligonucleotide
gttatcgctcgcaccacatctccagcacacccgaa

SEQ ID NO: 36101 - DNA, 36 bp, Artificial Sequence
  Synthetic oligonucleotide
tgctccccacgatagcacgtaactcttcatccgaca

SEQ ID NO: 36102 - DNA, 36 bp, Artificial Sequence
  Synthetic oligonucleotide
attacgccgacgggggtcttcgccataccttataca

SEQ ID NO: 36103 - DNA, 37 bp, Artificial Sequence
  Synthetic oligonucleotide
aggaggccacagttctgttccccccgtgccaaaacca

SEQ ID NO: 36104 - DNA, 36 bp, Artificial Sequence
  Synthetic oligonucleotide
gccccaaatcgtgtttacccctcgtcacgccaccca

SEQ ID NO: 36105 - DNA, 36 bp, Artificial Sequence
  Synthetic oligonucleotide
gtgtcccagcaccgatgcaccctattgcttctatca

SEQ ID NO: 36106 - DNA, 37 bp, Artificial Sequence
  Synthetic oligonucleotide
gcgtggagcaacaggggggggaagcgcaatagggaga

SEQ ID NO: 36107 - DNA, 37 bp, Artificial Sequence
  Synthetic oligonucleotide
gcctagtgactgccttgatccacaccgctcccatcga

SEQ ID NO: 36108 - DNA, 37 bp, Artificial Sequence
  Synthetic oligonucleotide
tgatagccgccgatccacccacagtcacacccctcga

SEQ ID NO: 36109 - DNA, 37 bp, Artificial Sequence
  Synthetic oligonucleotide
gataccgtccgatgccctctacttgaaatctgctcga

SEQ ID NO: 36110 - DNA, 37 bp, Artificial Sequence
  Synthetic oligonucleotide
tagacactgagggcggacggtggaagagagggaggga

SEQ ID NO: 36111 - DNA, 36 bp, Artificial Sequence
  Synthetic oligonucleotide
tacgccactacacacgctgttcttcctgccctggga

SEQ ID NO: 36112 - DNA, 37 bp, Artificial Sequence
  Synthetic oligonucleotide
gataacggccgggggaagatcggagggggggcgatga

SEQ ID NO: 36113 - DNA, 37 bp, Artificial Sequence
  Synthetic oligonucleotide
acaccgtccctattctccaggtcgtccccccacgtga

SEQ ID NO: 36114 - DNA, 36 bp, Artificial Sequence
  Synthetic oligonucleotide
gccccacgcagggcctgtcttctgggaaactcttga

SEQ ID NO: 36115 - DNA, 38 bp, Artificial Sequence
  Synthetic oligonucleotide
gtaccggccatatctgcaatgacgacttccccctttga

SEQ ID NO: 36116 - DNA, 35 bp, Artificial Sequence
  Synthetic oligonucleotide
gacgagttcaggtccctcatcaacccagctcacta

SEQ ID NO: 36117 - DNA, 35 bp, Artificial Sequence
  Synthetic oligonucleotide
aaccgacgacgacatctttgcccacacgatataac

SEQ ID NO: 36118 - DNA, 35 bp, Artificial Sequence
  Synthetic oligonucleotide
acaccacttctgacaggtaaacgccggttgctaac

SEQ ID NO: 36119 - DNA, 35 bp, Artificial Sequence
  Synthetic oligonucleotide
actgggccctgcatatcaactgctgtttgtggtac

SEQ ID NO: 36120 - DNA, 33 bp, Artificial Sequence
  Synthetic oligonucleotide
gtaccatagccgcccttccgctaaccgggttac

SEQ ID NO: 36121 - DNA, 35 bp, Artificial Sequence
  Synthetic oligonucleotide
taacaacggaatcctgtaccaacacctgcgaaccc

SEQ ID NO: 36122 - DNA, 35 bp, Artificial Sequence
  Synthetic oligonucleotide
tagcgatcgcaccttggcgagtacctcaagcaccc

SEQ ID NO: 36123 - DNA, 35 bp, Artificial Sequence
  Synthetic oligonucleotide
gcaggggtccattcgtacatatttggcctttcccc

SEQ ID NO: 36124 - DNA, 35 bp, Artificial Sequence
  Synthetic oligonucleotide
atctccgccatctttcgttgagcttccgtccaggc

SEQ ID NO: 36125 - DNA, 35 bp, Artificial Sequence
  Synthetic oligonucleotide
accacgacggcgcctttaactgtttgtgatctcct

SEQ ID NO: 36126 - DNA, 35 bp, Artificial Sequence
  Synthetic oligonucleotide
acgtaacacacaccgctagctcaacgcgtgcttct

SEQ ID NO: 36127 - DNA, 35 bp, Artificial Sequence
  Synthetic oligonucleotide
gtccatccccctatacatcacccatgaatgacggt

SEQ ID NO: 36128 - DNA, 36 bp, Artificial Sequence
  Synthetic oligonucleotide
gtccatattatcaggccagccccgtcctcccgacca

SEQ ID NO: 36129 - DNA, 38 bp, Artificial Sequence
  Synthetic oligonucleotide
gtagccccgcccgttattagcccatcccgctaccctca

SEQ ID NO: 36130 - DNA, 36 bp, Artificial Sequence
  Synthetic oligonucleotide
acaacacaccccgcctcccttttttgcgcggaaaga

SEQ ID NO: 36131 - DNA, 37 bp, Artificial Sequence
  Synthetic oligonucleotide
ggggttgcaggggtgaagggcaaatcggatgggcaga

SEQ ID NO: 36132 - DNA, 37 bp, Artificial Sequence
  Synthetic oligonucleotide
acaacgcgtgtacgtgcataggtcagccatatgcaga

SEQ ID NO: 36133 - DNA, 37 bp, Artificial Sequence
  Synthetic oligonucleotide
tagtacggaggaagcggagggggggtgggttacacga

SEQ ID NO: 36134 - DNA, 37 bp, Artificial Sequence
  Synthetic oligonucleotide
tgcgaggcgggacacgaggagggacagaatatagcga

SEQ ID NO: 36135 - DNA, 36 bp, Artificial Sequence
  Synthetic oligonucleotide
ttcaccttacacactgacatatgtccaccttggcga

SEQ ID NO: 36136 - DNA, 37 bp, Artificial Sequence
  Synthetic oligonucleotide
gagatgtcagccatcgggaccaccttttttcatgcga

SEQ ID NO: 36137 - DNA, 38 bp, Artificial Sequence
  Synthetic oligonucleotide
gacgggggggagtggggcagtgaaatggcagttcttga

SEQ ID NO: 36138 - DNA, 38 bp, Artificial Sequence
  Synthetic oligonucleotide
gtcgcccgtccaccctcccgaaagcacattgcctttga

SEQ ID NO: 36139 - DNA, 36 bp, Artificial Sequence
  Synthetic oligonucleotide
tcatctccccgcgcagtcacgccgagccctcacata

SEQ ID NO: 36140 - DNA, 35 bp, Artificial Sequence
  Synthetic oligonucleotide
acccccgtattctgtgcaggcctctcccgttgtta

SEQ ID NO: 36141 - DNA, 35 bp, Artificial Sequence
  Synthetic oligonucleotide
acacgtcgaatgctaccccgtgcctcgtggactac

SEQ ID NO: 36142 - DNA, 35 bp, Artificial Sequence
  Synthetic oligonucleotide
tgccgctgagcgagtacaacattcacgacccttac

SEQ ID NO: 36143 - DNA, 35 bp, Artificial Sequence
  Synthetic oligonucleotide
tcacaatcctccttgcgtaacgtcgctaggcttac

SEQ ID NO: 36144 - DNA, 35 bp, Artificial Sequence
  Synthetic oligonucleotide
gaagtccgccatcatactcattccttaagactacc

SEQ ID NO: 36145 - DNA, 35 bp, Artificial Sequence
  Synthetic oligonucleotide
gcgaagctacacgcttggctaggaacaccaccgcc

SEQ ID NO: 36146 - DNA, 35 bp, Artificial Sequence
  Synthetic oligonucleotide
tgtgtatcgcaagtagcttacatctcccccacagc

SEQ ID NO: 36147 - DNA, 35 bp, Artificial Sequence
  Synthetic oligonucleotide
gtaacctgtgccggatccggacgcccctgactcgc

SEQ ID NO: 36148 - DNA, 35 bp, Artificial Sequence
  Synthetic oligonucleotide
accgaaccatctgtccaatcctgttaacaattctc

SEQ ID NO: 36149 - DNA, 35 bp, Artificial Sequence
  Synthetic oligonucleotide
gccgaccctgtttgtcggacaacaaccctgttctc

SEQ ID NO: 36150 - DNA, 35 bp, Artificial Sequence
  Synthetic oligonucleotide
aatgaaggtggggtggagctagtagggctatttag

SEQ ID NO: 36151 - DNA, 35 bp, Artificial Sequence
  Synthetic oligonucleotide
atatgccgccatcacccacccagtctgggcaatcg

SEQ ID NO: 36152 - DNA, 35 bp, Artificial Sequence
  Synthetic oligonucleotide
tggtcgcctccctgagtttttctgtgctctttggg

SEQ ID NO: 36153 - DNA, 35 bp, Artificial Sequence
  Synthetic oligonucleotide
gaatcacccccgacttagctggtcctactggctct

SEQ ID NO: 36154 - DNA, 35 bp, Artificial Sequence
  Synthetic oligonucleotide
gcctacgagttatgcttcgtgaccttctcccgttt

SEQ ID NO: 36155 - DNA, 35 bp, Artificial Sequence
  Synthetic oligonucleotide
tcattgcaaggcgtacggtaggttggatggggaaa

SEQ ID NO: 36156 - DNA, 36 bp, Artificial Sequence
  Synthetic oligonucleotide
tagaatcgacgtggtaaacaaaggagggctagggaa

SEQ ID NO: 36157 - DNA, 36 bp, Artificial Sequence
  Synthetic oligonucleotide
taggatcggccaacgcagtattttatgcccccccca

SEQ ID NO: 36158 - DNA, 36 bp, Artificial Sequence
  Synthetic oligonucleotide
taccatgattatgtggccattttcccgttctttcga

SEQ ID NO: 36159 - DNA, 37 bp, Artificial Sequence
  Synthetic oligonucleotide
actacgccacacatagccgcccaggacactcaaagga

SEQ ID NO: 36160 - DNA, 37 bp, Artificial Sequence
  Synthetic oligonucleotide
aagcgagagaaagcggaagaaggcaatggtgtacgga

SEQ ID NO: 36161 - DNA, 37 bp, Artificial Sequence
  Synthetic oligonucleotide
gcaaggggataggagggccataggagcacaagcggga

SEQ ID NO: 36162 - DNA, 37 bp, Artificial Sequence
  Synthetic oligonucleotide
tctctcgcggggagttgggttaggggatgggagggga

SEQ ID NO: 36163 - DNA, 38 bp, Artificial Sequence
  Synthetic oligonucleotide
tcataccgcagcccgcctgctgtcacccacctaactga

SEQ ID NO: 36164 - DNA, 38 bp, Artificial Sequence
  Synthetic oligonucleotide
gagcggacctcagctgggcctgctgttttttttgctga

SEQ ID NO: 36165 - DNA, 36 bp, Artificial Sequence
  Synthetic oligonucleotide
gcacttgggtgtctattgtttgctttcctccgtata

SEQ ID NO: 36166 - DNA, 35 bp, Artificial Sequence
  Synthetic oligonucleotide
ggaacgtcccatctggcgagtctcctttgcagtac

SEQ ID NO: 36167 - DNA, 35 bp, Artificial Sequence
  Synthetic oligonucleotide
gccacccgccttttgttcttgcttactgtaatacc

SEQ ID NO: 36168 - DNA, 35 bp, Artificial Sequence
  Synthetic oligonucleotide
gccatccaccgaccgtatgactcttaggattacgc

SEQ ID NO: 36169 - DNA, 35 bp, Artificial Sequence
  Synthetic oligonucleotide
ttacacgcactttttcacacgccacacctgccttg

SEQ ID NO: 36170 - DNA, 35 bp, Artificial Sequence
  Synthetic oligonucleotide
gatccccgtctacataggtagttttattcatccat

SEQ ID NO: 36171 - DNA, 35 bp, Artificial Sequence
  Synthetic oligonucleotide
gcctcatccccccacagcctatgtagacccctgat

SEQ ID NO: 36172 - DNA, 35 bp, Artificial Sequence
  Synthetic oligonucleotide
aagtgcggggcatggaaagcggaaaggaagggggt

SEQ ID NO: 36173 - DNA, 35 bp, Artificial Sequence
  Synthetic oligonucleotide
aatgatcacagctgggattacattcgatttttttt

SEQ ID NO: 36174 - DNA, 35 bp, Artificial Sequence
  Synthetic oligonucleotide
accaccgttctctacttatacgtgttctgccacca

SEQ ID NO: 36175 - DNA, 36 bp, Artificial Sequence
  Synthetic oligonucleotide
gattgctggcacactgactgggtctttcatccacca

SEQ ID NO: 36176 - DNA, 36 bp, Artificial Sequence
  Synthetic oligonucleotide
tccagtgcgctccgtataggtaatattttcccctca

SEQ ID NO: 36177 - DNA, 37 bp, Artificial Sequence
  Synthetic oligonucleotide
tacgacgtcacgacggacagtgagtgaggagggaaga

SEQ ID NO: 36178 - DNA, 35 bp, Artificial Sequence
  Synthetic oligonucleotide
tccccaccgcagttaagtcccctcgcttccctcga

SEQ ID NO: 36179 - DNA, 36 bp, Artificial Sequence
  Synthetic oligonucleotide
ttcgggagagagggaaagaaaataatgggaatcgga

SEQ ID NO: 36180 - DNA, 37 bp, Artificial Sequence
  Synthetic oligonucleotide
gtgacactcctgaggcgctaatgccacttcgccctga

SEQ ID NO: 36181 - DNA, 38 bp, Artificial Sequence
  Synthetic oligonucleotide
agttgccgacttatcctgcctacatggcctatccctga

SEQ ID NO: 36182 - DNA, 38 bp, Artificial Sequence
  Synthetic oligonucleotide
ggaggacggaggagctcgtaagggtgagttgaatgtga

SEQ ID NO: 36183 - DNA, 33 bp, Artificial Sequence
  Synthetic oligonucleotide
ggatgccctggtaccacaccttcaaatccttga

SEQ ID NO: 36184 - DNA, 37 bp, Artificial Sequence
  Synthetic oligonucleotide
ggacccccgcatcgatccatctcaatccatcctttga

SEQ ID NO: 36185 - DNA, 36 bp, Artificial Sequence
  Synthetic oligonucleotide
tgaccaaatcggccaggagggtcaaggggggcgata

SEQ ID NO: 36186 - DNA, 35 bp, Artificial Sequence
  Synthetic oligonucleotide
tcccacgcgccagagattcaatcccgcaccacacc

SEQ ID NO: 36187 - DNA, 35 bp, Artificial Sequence
  Synthetic oligonucleotide
tacacaccgccccttaatgtcaattaacactcacc

SEQ ID NO: 36188 - DNA, 35 bp, Artificial Sequence
  Synthetic oligonucleotide
atgggccaccttgtgcccactccacccgagttacc

SEQ ID NO: 36189 - DNA, 35 bp, Artificial Sequence
  Synthetic oligonucleotide
cgaccacccggttatgttaggctccacctcaactc

SEQ ID NO: 36190 - DNA, 35 bp, Artificial Sequence
  Synthetic oligonucleotide
agcgcgcgcggtccatagtcgcccatatgcctgtc

SEQ ID NO: 36191 - DNA, 35 bp, Artificial Sequence
  Synthetic oligonucleotide
tgccaacaccgtgagttgttcctcgtgcaacattc

SEQ ID NO: 36192 - DNA, 35 bp, Artificial Sequence
  Synthetic oligonucleotide
acccacgttgctctccttctcggcatccaaactgg

SEQ ID NO: 36193 - DNA, 35 bp, Artificial Sequence
  Synthetic oligonucleotide
atgccggttcgaccactttgccgatatcaacccct

SEQ ID NO: 36194 - DNA, 35 bp, Artificial Sequence
  Synthetic oligonucleotide
gccttgttccgtagcgttccgttcgcgctctggct

SEQ ID NO: 36195 - DNA, 35 bp, Artificial Sequence
  Synthetic oligonucleotide
agagccgacgacggttactgctgatcgttctctct

SEQ ID NO: 36196 - DNA, 35 bp, Artificial Sequence
  Synthetic oligonucleotide
acgttcctacctcttgcctagtacaaccaacgtgt

SEQ ID NO: 36197 - DNA, 36 bp, Artificial Sequence
  Synthetic oligonucleotide
ttcgcacccgcatatacacacgtcactccccacgaa

SEQ ID NO: 36198 - DNA, 36 bp, Artificial Sequence
  Synthetic oligonucleotide
gcctggacacccactgagtctcatgccagaacttaa

SEQ ID NO: 36199 - DNA, 37 bp, Artificial Sequence
  Synthetic oligonucleotide
gtgggaactagggaaatattgcgggactggagacgga

SEQ ID NO: 36200 - DNA, 36 bp, Artificial Sequence
  Synthetic oligonucleotide
gttggccctcgccccaattaggattaacgccgtata

SEQ ID NO: 36201 - DNA, 36 bp, Artificial Sequence
  Synthetic oligonucleotide
tcctgtgcaccattgcgagatccccacaattctgta

SEQ ID NO: 36202 - DNA, 35 bp, Artificial Sequence
  Synthetic oligonucleotide
cacgacctgccgccctggtacacgaacacgctgac

SEQ ID NO: 36203 - DNA, 35 bp, Artificial Sequence
  Synthetic oligonucleotide
tgaatgcaggcccgctgatcgatccatgcgtaacc

SEQ ID NO: 36204 - DNA, 35 bp, Artificial Sequence
  Synthetic oligonucleotide
gccaccttctaggcggcccggcgcagcccctcccc

SEQ ID NO: 36205 - DNA, 35 bp, Artificial Sequence
  Synthetic oligonucleotide
tagtccacccagctatcgacacgttcagttttccc

SEQ ID NO: 36206 - DNA, 35 bp, Artificial Sequence
  Synthetic oligonucleotide
tcatatgccagttttcctccgttactcgcgctccg

SEQ ID NO: 36207 - DNA, 35 bp, Artificial Sequence
  Synthetic oligonucleotide
gccgctgtgcagatttccctgtcgtcctatctcgg

SEQ ID NO: 36208 - DNA, 35 bp, Artificial Sequence
  Synthetic oligonucleotide
gactagcgtcgttacatcaaaactcccccatgctg

SEQ ID NO: 36209 - DNA, 35 bp, Artificial Sequence
  Synthetic oligonucleotide
tacgacgtgtgtagactgggggggagtgagcagat

SEQ ID NO: 36210 - DNA, 35 bp, Artificial Sequence
  Synthetic oligonucleotide
tagcggggtatgcaagcccactgtcgcctcactct

SEQ ID NO: 36211 - DNA, 35 bp, Artificial Sequence
  Synthetic oligonucleotide
gctgtgccccgatagtgattgtcatcgctgctgtt

SEQ ID NO: 36212 - DNA, 36 bp, Artificial Sequence
  Synthetic oligonucleotide
aacaggacaagctcacaacgtcgccacaccttccaa

SEQ ID NO: 36213 - DNA, 36 bp, Artificial Sequence
  Synthetic oligonucleotide
gtcgacattctcctacacgcgccatagggccatgaa

SEQ ID NO: 36214 - DNA, 36 bp, Artificial Sequence
  Synthetic oligonucleotide
ggaccagtccactgcggccctagcattttccattaa

SEQ ID NO: 36215 - DNA, 36 bp, Artificial Sequence
  Synthetic oligonucleotide
tccagggacaccgttgccatccaccgcataatcaca

SEQ ID NO: 36216 - DNA, 35 bp, Artificial Sequence
  Synthetic oligonucleotide
gacgtatatcgccctgctctgttctttggattaca

SEQ ID NO: 36217 - DNA, 36 bp, Artificial Sequence
  Synthetic oligonucleotide
gatgagggaggatctctgggggtggaaggttacgca

SEQ ID NO: 36218 - DNA, 36 bp, Artificial Sequence
  Synthetic oligonucleotide
gacgcccacttctaaatttacccactgaaaagtgca

SEQ ID NO: 36219 - DNA, 37 bp, Artificial Sequence
  Synthetic oligonucleotide
acaaaaggggggccgcctggttaggtggaggagcaga

SEQ ID NO: 36220 - DNA, 37 bp, Artificial Sequence
  Synthetic oligonucleotide
cccggaggggcggggaagagggaggcgttgggtgaga

SEQ ID NO: 36221 - DNA, 37 bp, Artificial Sequence
  Synthetic oligonucleotide
gacgggacgagcgctcggtttaacaggatggggagga

SEQ ID NO: 36222 - DNA, 37 bp, Artificial Sequence
  Synthetic oligonucleotide
atacagtgcgacgcgctgcctctttccgtggacctga

SEQ ID NO: 36223 - DNA, 38 bp, Artificial Sequence
  Synthetic oligonucleotide
ggggggaacaaagggtcgcgaagggactgggggggtga

SEQ ID NO: 36224 - DNA, 38 bp, Artificial Sequence
  Synthetic oligonucleotide
taccatcctatcgccgcgcatagctactgcctccttga

SEQ ID NO: 36225 - DNA, 38 bp, Artificial Sequence
  Synthetic oligonucleotide
agccgccacccctcgatctatcctgcaaagcctcttga

SEQ ID NO: 36226 - DNA, 37 bp, Artificial Sequence
  Synthetic oligonucleotide
gcacttccagacaacttttgccgacccaatcctttga

SEQ ID NO: 36227 - DNA, 36 bp, Artificial Sequence
  Synthetic oligonucleotide
tacccccccgttggctcccccgctctatacttttga

SEQ ID NO: 36228 - DNA, 36 bp, Artificial Sequence
  Synthetic oligonucleotide
gagcgtagcgcaacccacgtaaacctgtctcccata

SEQ ID NO: 36229 - DNA, 35 bp, Artificial Sequence
  Synthetic oligonucleotide
gtacatgcaatcatacgaggtcacgacgcactacc

SEQ ID NO: 36230 - DNA, 35 bp, Artificial Sequence
  Synthetic oligonucleotide
gtaatgccgatacaacccaccaggcactccatccc

SEQ ID NO: 36231 - DNA, 35 bp, Artificial Sequence
  Synthetic oligonucleotide
ttgtcaccatcacgtcagcccgctccgtccttggc

SEQ ID NO: 36232 - DNA, 35 bp, Artificial Sequence
  Synthetic oligonucleotide
gcatatggggaggtttcggagagtaggtggaaggg

SEQ ID NO: 36233 - DNA, 35 bp, Artificial Sequence
  Synthetic oligonucleotide
tatcataccgaaggcacacgccgagccttatccct

SEQ ID NO: 36234 - DNA, 35 bp, Artificial Sequence
  Synthetic oligonucleotide
acatcatctgcaccatgggcctactgagcagctct

SEQ ID NO: 36235 - DNA, 35 bp, Artificial Sequence
  Synthetic oligonucleotide
tgacttgccctcgcattcaccttgtttgaaattct

SEQ ID NO: 36236 - DNA, 35 bp, Artificial Sequence
  Synthetic oligonucleotide
tgatcatggcaccgtgctaccgttccccatctctt

SEQ ID NO: 36237 - DNA, 36 bp, Artificial Sequence
  Synthetic oligonucleotide
ttcaacctgaatggtttattgatcctcccgctcgaa

SEQ ID NO: 36238 - DNA, 36 bp, Artificial Sequence
  Synthetic oligonucleotide
gagccgttccccacgcatatgcctaccacgtcctaa

SEQ ID NO: 36239 - DNA, 35 bp, Artificial Sequence
  Synthetic oligonucleotide
taccgctgttccacatgagatcaccatcacttcca

SEQ ID NO: 36240 - DNA, 36 bp, Artificial Sequence
  Synthetic oligonucleotide
aatcagggcgtactgactggtgggtgggggggtgca

SEQ ID NO: 36241 - DNA, 36 bp, Artificial Sequence
  Synthetic oligonucleotide
atcccccccgccggttcggtttaagcggctccctca

SEQ ID NO: 36242 - DNA, 37 bp, Artificial Sequence
  Synthetic oligonucleotide
tacatcctccacctcttgtttaacgggcctcagccga

SEQ ID NO: 36243 - DNA, 37 bp, Artificial Sequence
  Synthetic oligonucleotide
gcacccccgcaatcatcctccttggccgttcatagga

SEQ ID NO: 36244 - DNA, 37 bp, Artificial Sequence
  Synthetic oligonucleotide
gttgactccctgatcgtccgtatcttatccctcggga

SEQ ID NO: 36245 - DNA, 36 bp, Artificial Sequence
  Synthetic oligonucleotide
aaacagtttggtaggggacggaagggcggaggggga

SEQ ID NO: 36246 - DNA, 36 bp, Artificial Sequence
  Synthetic oligonucleotide
ttcacaccacccggcgcattcctgccactttgggga

SEQ ID NO: 36247 - DNA, 36 bp, Artificial Sequence
  Synthetic oligonucleotide
taacacacctctacgttgcgctttttcctagactga

SEQ ID NO: 36248 - DNA, 38 bp, Artificial Sequence
  Synthetic oligonucleotide
gcatccgcagacgccgtacgtgcctaaccatttactga

SEQ ID NO: 36249 - DNA, 37 bp, Artificial Sequence
  Synthetic oligonucleotide
ttgtcgcctcccaaatgtacttcgttgttccagctga

SEQ ID NO: 36250 - DNA, 36 bp, Artificial Sequence
  Synthetic oligonucleotide
tcgttagccacacaccaaaagctgaccaccgtgtta

SEQ ID NO: 36251 - DNA, 36 bp, Artificial Sequence
  Synthetic oligonucleotide
tccatgcccttgtaatcatcaccgggacccgcttta

SEQ ID NO: 36252 - DNA, 35 bp, Artificial Sequence
  Synthetic oligonucleotide
gcccgcaccaccacatcacctgtctctggacacac

SEQ ID NO: 36253 - DNA, 35 bp, Artificial Sequence
  Synthetic oligonucleotide
acctcgatactcacgttccacagggctcctgccac

SEQ ID NO: 36254 - DNA, 35 bp, Artificial Sequence
  Synthetic oligonucleotide
tatgctcaacctaaacacggtatttgctgctttcc

SEQ ID NO: 36255 - DNA, 36 bp, Artificial Sequence
  Synthetic oligonucleotide
tgtcctaccccgacccactagtctaagttcatccgc

SEQ ID NO: 36256 - DNA, 35 bp, Artificial Sequence
  Synthetic oligonucleotide
tacgacaatgttgccgccttctgacgactccactc

SEQ ID NO: 36257 - DNA, 35 bp, Artificial Sequence
  Synthetic oligonucleotide
taaccaccacgcgagttacgggtcccttacgtgtc

SEQ ID NO: 36258 - DNA, 35 bp, Artificial Sequence
  Synthetic oligonucleotide
taagttgggggggggacggtgcgcaaagcatgggg

SEQ ID NO: 36259 - DNA, 35 bp, Artificial Sequence
  Synthetic oligonucleotide
tgaaaaggcgtggacccggtattggtggggaatgg

SEQ ID NO: 36260 - DNA, 35 bp, Artificial Sequence
  Synthetic oligonucleotide
ggccccccgaacatacaatttcctgagcccgctat

SEQ ID NO: 36261 - DNA, 35 bp, Artificial Sequence
  Synthetic oligonucleotide
acatccttgcgccatacagcatccagaccaacctt

SEQ ID NO: 36262 - DNA, 35 bp, Artificial Sequence
  Synthetic oligonucleotide
agtgagcagagcgggtgggatgggcggctgcccaa

SEQ ID NO: 36263 - DNA, 36 bp, Artificial Sequence
  Synthetic oligonucleotide
tgtccgcaagcccaccgcacattctccgccgtccaa

SEQ ID NO: 36264 - DNA, 36 bp, Artificial Sequence
  Synthetic oligonucleotide
gtcccagtacgttatggtgcgttatcaaccataaca

SEQ ID NO: 36265 - DNA, 35 bp, Artificial Sequence
  Synthetic oligonucleotide
tagtccacacagcagccacatctcagcacccccca

SEQ ID NO: 36266 - DNA, 36 bp, Artificial Sequence
  Synthetic oligonucleotide
tacacactcgcgtggagggaggggggtactttgcca

SEQ ID NO: 36267 - DNA, 35 bp, Artificial Sequence
  Synthetic oligonucleotide
tcaaccatctgcatccccctagtaccgatcaaaga

SEQ ID NO: 36268 - DNA, 37 bp, Artificial Sequence
  Synthetic oligonucleotide
tacccctgcccggcccttctgtcgtacggttgataga

SEQ ID NO: 36269 - DNA, 35 bp, Artificial Sequence
  Synthetic oligonucleotide
tgacccctccacataattacgtcgtgactacccga

SEQ ID NO: 36270 - DNA, 37 bp, Artificial Sequence
  Synthetic oligonucleotide
agcatcaccaccccgttaggctcacagcataccccga

SEQ ID NO: 36271 - DNA, 37 bp, Artificial Sequence
  Synthetic oligonucleotide
ataggggtgggtgggcactttagtcgaaggccgggga

SEQ ID NO: 36272 - DNA, 35 bp, Artificial Sequence
  Synthetic oligonucleotide
aacaatctgcagcctgcgaacgactcccgcaagac

SEQ ID NO: 36273 - DNA, 35 bp, Artificial Sequence
  Synthetic oligonucleotide
tttcgatcaacgcttaccctgcacctatcacggac

SEQ ID NO: 36274 - DNA, 35 bp, Artificial Sequence
  Synthetic oligonucleotide
agaggccctcatcgctaagcggttccatctagccc

SEQ ID NO: 36275 - DNA, 35 bp, Artificial Sequence
  Synthetic oligonucleotide
gtgcgttagccggcatccttaactactcgccgccc

SEQ ID NO: 36276 - DNA, 35 bp, Artificial Sequence
  Synthetic oligonucleotide
ttcgcctgctcccttcacgcctcgaactactctgc

SEQ ID NO: 36277 - DNA, 35 bp, Artificial Sequence
  Synthetic oligonucleotide
gcctgccctcacattgtaggaggcctcctctttcg

SEQ ID NO: 36278 - DNA, 35 bp, Artificial Sequence
  Synthetic oligonucleotide
tgccaccacacagggggttcacgaaccttttctat

SEQ ID NO: 36279 - DNA, 35 bp, Artificial Sequence
  Synthetic oligonucleotide
ggagagggtggcgggaaggggagcaatcgaagtct

SEQ ID NO: 36280 - DNA, 35 bp, Artificial Sequence
  Synthetic oligonucleotide
tgtctccgctcttgcgctttccgcagtccacttct

SEQ ID NO: 36281 - DNA, 35 bp, Artificial Sequence
  Synthetic oligonucleotide
ttatcggtagcccatgccaccccgtagcagccctt

SEQ ID NO: 36282 - DNA, 36 bp, Artificial Sequence
  Synthetic oligonucleotide
gttcgacatccacacgccaatttagcactcggagca

SEQ ID NO: 36283 - DNA, 35 bp, Artificial Sequence
  Synthetic oligonucleotide
tccaccgttctatgcataatgtcactcttccctca

SEQ ID NO: 36284 - DNA, 36 bp, Artificial Sequence
  Synthetic oligonucleotide
gtgcccacccccctgcggtcttgttccgttctacga

SEQ ID NO: 36285 - DNA, 37 bp, Artificial Sequence
  Synthetic oligonucleotide
attgccgtcacactgctctggcactccgtaaatccga

SEQ ID NO: 36286 - DNA, 37 bp, Artificial Sequence
  Synthetic oligonucleotide
ttacacgccttcgccctctgtctattgattacatcga

SEQ ID NO: 36287 - DNA, 36 bp, Artificial Sequence
  Synthetic oligonucleotide
gatgagcaaggaggggtaaataaatgggggagtcga

SEQ ID NO: 36288 - DNA, 37 bp, Artificial Sequence
  Synthetic oligonucleotide
tctaacgccgccacatatcgcccctggaacatgcgga

SEQ ID NO: 36289 - DNA, 37 bp, Artificial Sequence
  Synthetic oligonucleotide
gacgcaccccatcccaacgttgccatatccttgggga

SEQ ID NO: 36290 - DNA, 38 bp, Artificial Sequence
  Synthetic oligonucleotide
tcaggggaacggttcaaaggggcgggccggggacatga

SEQ ID NO: 36291 - DNA, 35 bp, Artificial Sequence
  Synthetic oligonucleotide
tccgcgtccccctcctgcactgtttgtctttgtga

SEQ ID NO: 36292 - DNA, 38 bp, Artificial Sequence
  Synthetic oligonucleotide
tcgacgaaacgccgtaggttatgacccgtgccctttga

SEQ ID NO: 36293 - DNA, 36 bp, Artificial Sequence
  Synthetic oligonucleotide
acccacccttcgatttcgccagtgggttccacccta

SEQ ID NO: 36294 - DNA, 35 bp, Artificial Sequence
  Synthetic oligonucleotide
ttaattccgccacatcagtactcgtccgtccccta

SEQ ID NO: 36295 - DNA, 35 bp, Artificial Sequence
  Synthetic oligonucleotide
acgaacgcgcacacgggcccctgttatactcatta

SEQ ID NO: 36296 - DNA, 36 bp, Artificial Sequence
  Synthetic oligonucleotide
gactgccggttccgttggcaatacggttgttcctta

SEQ ID NO: 36297 - DNA, 35 bp, Artificial Sequence
  Synthetic oligonucleotide
atacaagaggacccatctggccgcctccctccgcc

SEQ ID NO: 36298 - DNA, 35 bp, Artificial Sequence
  Synthetic oligonucleotide
gtggggatgggcacggtttggtaaggggtagtcag

SEQ ID NO: 36299 - DNA, 35 bp, Artificial Sequence
  Synthetic oligonucleotide
gacgtcgggcggggagggcttagggggtaagatcg

SEQ ID NO: 36300 - DNA, 35 bp, Artificial Sequence
  Synthetic oligonucleotide
tgagggagggatcggaggctggagggtcacacttg

SEQ ID NO: 36301 - DNA, 35 bp, Artificial Sequence
  Synthetic oligonucleotide
tccgatctcgccaatagctttagtacttcctcgat

SEQ ID NO: 36302 - DNA, 36 bp, Artificial Sequence
  Synthetic oligonucleotide
aaccgccacactcctagaccatccgtggctctacaa

SEQ ID NO: 36303 - DNA, 36 bp, Artificial Sequence
  Synthetic oligonucleotide
gtaacgtcgttcgcatcccacataccaagcctccaa

SEQ ID NO: 36304 - DNA, 36 bp, Artificial Sequence
  Synthetic oligonucleotide
gagtcacgggacgaagggggaggtaaatgtgtcgaa

SEQ ID NO: 36305 - DNA, 36 bp, Artificial Sequence
  Synthetic oligonucleotide
tcgtgacataccacctcccacctgctaaggtcgaca

SEQ ID NO: 36306 - DNA, 29 bp, Artificial Sequence
  Synthetic oligonucleotide
gtactatcacgccgcatgtctccagtaca

SEQ ID NO: 36307 - DNA, 35 bp, Artificial Sequence
  Synthetic oligonucleotide
tagtagcgacctgcgtcccactccatatgccatca

SEQ ID NO: 36308 - DNA, 36 bp, Artificial Sequence
  Synthetic oligonucleotide
ttcggtcctgacctccatgctgcgctttcattctca

SEQ ID NO: 36309 - DNA, 37 bp, Artificial Sequence
  Synthetic oligonucleotide
acacgctcaccaggttcttccacgtcacacacggcga

SEQ ID NO: 36310 - DNA, 37 bp, Artificial Sequence
  Synthetic oligonucleotide
gagggaacgacgatgagaaaacgggccggctgggcga

SEQ ID NO: 36311 - DNA, 35 bp, Artificial Sequence
  Synthetic oligonucleotide
gcccgaacaccgacggttaaaccacacgcattcga

SEQ ID NO: 36312 - DNA, 37 bp, Artificial Sequence
  Synthetic oligonucleotide
gtccttcaccgctcccaaagcagcccgattgttcgga

SEQ ID NO: 36313 - DNA, 35 bp, Artificial Sequence
  Synthetic oligonucleotide
tgctgttgcggcgcctccgcattgtaccaccctga

SEQ ID NO: 36314 - DNA, 38 bp, Artificial Sequence
  Synthetic oligonucleotide
gctccactctgctgccatatcattaatccgctatctga

SEQ ID NO: 36315 - DNA, 38 bp, Artificial Sequence
  Synthetic oligonucleotide
acctgcaggagtaagtagggggtgggcgaaggtggtga

SEQ ID NO: 36316 - DNA, 38 bp, Artificial Sequence
  Synthetic oligonucleotide
tcagaccaaatctgccaagccacatcggatcttcttga

SEQ ID NO: 36317 - DNA, 36 bp, Artificial Sequence
  Synthetic oligonucleotide
attcacccctgcgcctaaccggagcccggttaccta

SEQ ID NO: 36318 - DNA, 36 bp, Artificial Sequence
  Synthetic oligonucleotide
gtcggacacgatgccccggatacgcctccccccgta

SEQ ID NO: 36319 - DNA, 36 bp, Artificial Sequence
  Synthetic oligonucleotide
taccctctactggtttcgtgaccgaccctgatcgta

SEQ ID NO: 36320 - DNA, 36 bp, Artificial Sequence
  Synthetic oligonucleotide
aatgtaggaacatgtgaggggtggtagttgaaggta

SEQ ID NO: 36321 - DNA, 36 bp, Artificial Sequence
  Synthetic oligonucleotide
ttaccctctgctgtgcgctctacaccttttgactta

SEQ ID NO: 36322 - DNA, 34 bp, Artificial Sequence
  Synthetic oligonucleotide
tggtgtacccattggcccatgttcttgtccctta

SEQ ID NO: 36323 - DNA, 35 bp, Artificial Sequence
  Synthetic oligonucleotide
attccatcccacagtggtgagaagtgcgccaccac

SEQ ID NO: 36324 - DNA, 35 bp, Artificial Sequence
  Synthetic oligonucleotide
acctcatgtcgacctgctagcatatacactatcac

SEQ ID NO: 36325 - DNA, 35 bp, Artificial Sequence
  Synthetic oligonucleotide
aaccacacccgtttcgagctcattcggtctttgac

SEQ ID NO: 36326 - DNA, 35 bp, Artificial Sequence
  Synthetic oligonucleotide
gccctatccccatgtcgagctgtccgttcctcatc

SEQ ID NO: 36327 - DNA, 35 bp, Artificial Sequence
  Synthetic oligonucleotide
ttgtcgaaggtccctacatgtcctcagtgccattc

SEQ ID NO: 36328 - DNA, 34 bp, Artificial Sequence
  Synthetic oligonucleotide
aacccgtccataaacacaccatagtagcgcaccg

SEQ ID NO: 36329 - DNA, 35 bp, Artificial Sequence
  Synthetic oligonucleotide
gttccccgttcccgaccgcgcttgaggtattcccg

SEQ ID NO: 36330 - DNA, 35 bp, Artificial Sequence
  Synthetic oligonucleotide
gtccgcgagccgccacctgcttctgttcgttacct

SEQ ID NO: 36331 - DNA, 35 bp, Artificial Sequence
  Synthetic oligonucleotide
gagggacgtgcccccttgatgccttctcgcccctt

SEQ ID NO: 36332 - DNA, 35 bp, Artificial Sequence
  Synthetic oligonucleotide
gcgctgaactccatgggctatctccgacccgcctt

SEQ ID NO: 36333 - DNA, 36 bp, Artificial Sequence
  Synthetic oligonucleotide
accgagtgccgcccccagtccgataactgcgattaa

SEQ ID NO: 36334 - DNA, 36 bp, Artificial Sequence
  Synthetic oligonucleotide
tatcgcgcagttccccgcacacatatctagtgatca

SEQ ID NO: 36335 - DNA, 36 bp, Artificial Sequence
  Synthetic oligonucleotide
tgcccatggtcacccgtctattgtctgtcttggtca

SEQ ID NO: 36336 - DNA, 36 bp, Artificial Sequence
  Synthetic oligonucleotide
gcccacttgtgagatttcttacattcacggttttca

SEQ ID NO: 36337 - DNA, 37 bp, Artificial Sequence
  Synthetic oligonucleotide
agtcgcccgcccgtagccctccccacagtttcccaga

SEQ ID NO: 36338 - DNA, 36 bp, Artificial Sequence
  Synthetic oligonucleotide
gtagccctggagcgtgcgaccatttaactcccacga

SEQ ID NO: 36339 - DNA, 37 bp, Artificial Sequence
  Synthetic oligonucleotide
tcctgccgcatgtcccgcactcacctaagcgaagcga

SEQ ID NO: 36340 - DNA, 37 bp, Artificial Sequence
  Synthetic oligonucleotide
gatgatagctgggaagaacaggcggggcacataggga

SEQ ID NO: 36341 - DNA, 38 bp, Artificial Sequence
  Synthetic oligonucleotide
tcacgcaccaggccttcaggttccataccgacccatga

SEQ ID NO: 36342 - DNA, 38 bp, Artificial Sequence
  Synthetic oligonucleotide
tctctcccccttcgatcgtttcactatacaggccatga

SEQ ID NO: 36343 - DNA, 37 bp, Artificial Sequence
  Synthetic oligonucleotide
tcccatcaatccgacgcttacattcccaatgctgtga

SEQ ID NO: 36344 - DNA, 37 bp, Artificial Sequence
  Synthetic oligonucleotide
atagagccgccgggcgacatttgtttcaccaccttga

SEQ ID NO: 36345 - DNA, 38 bp, Artificial Sequence
  Synthetic oligonucleotide
gtttcctcgcgccaacgtgctcttgcccttacccttga

SEQ ID NO: 36346 - DNA, 36 bp, Artificial Sequence
  Synthetic oligonucleotide
tcagtcagtcgtccatctgcactatggtccaactta

SEQ ID NO: 36347 - DNA, 35 bp, Artificial Sequence
  Synthetic oligonucleotide
gatgtctacaccatgataatatgccttaccgttta

SEQ ID NO: 36348 - DNA, 35 bp, Artificial Sequence
  Synthetic oligonucleotide
tccacaccgcgcgtatggaaagcgaaccaaccacc

SEQ ID NO: 36349 - DNA, 35 bp, Artificial Sequence
  Synthetic oligonucleotide
tcacgcaatgaaacttttgaggtaccgcactttcc

SEQ ID NO: 36350 - DNA, 35 bp, Artificial Sequence
  Synthetic oligonucleotide
tctccaccccaggactggttaccacctctcaaaag

SEQ ID NO: 36351 - DNA, 35 bp, Artificial Sequence
  Synthetic oligonucleotide
gcaacgcaataccttccccgaccattaaacctaag

SEQ ID NO: 36352 - DNA, 35 bp, Artificial Sequence
  Synthetic oligonucleotide
taagggaggccgtaaaggggcgggggagttggtag

SEQ ID NO: 36353 - DNA, 35 bp, Artificial Sequence
  Synthetic oligonucleotide
gagcgaagacgggtcgggacggaggtaagaaaagg

SEQ ID NO: 36354 - DNA, 35 bp, Artificial Sequence
  Synthetic oligonucleotide
tttccacagggtgcactgtcgctctactctcgcct

SEQ ID NO: 36355 - DNA, 35 bp, Artificial Sequence
  Synthetic oligonucleotide
actttacgcgcgatacgtcatcgaacgtcttctct

SEQ ID NO: 36356 - DNA, 35 bp, Artificial Sequence
  Synthetic oligonucleotide
aaccatgcccctcgaagacgtagctgtgatccttt

SEQ ID NO: 36357 - DNA, 35 bp, Artificial Sequence
  Synthetic oligonucleotide
tctgccgagaaggctattttgttcgcccccctttt

SEQ ID NO: 36358 - DNA, 36 bp, Artificial Sequence
  Synthetic oligonucleotide
tcaggaccccctgcccccacgtgatttttggactaa

SEQ ID NO: 36359 - DNA, 35 bp, Artificial Sequence
  Synthetic oligonucleotide
tcttgacatgccggttatgtctgtccccgatccca

SEQ ID NO: 36360 - DNA, 36 bp, Artificial Sequence
  Synthetic oligonucleotide
gtcgaagacacgggctgtggcaggtttcacgtttca

SEQ ID NO: 36361 - DNA, 36 bp, Artificial Sequence
  Synthetic oligonucleotide
ggggagggtgaaaactggggaggattcttggggaga

SEQ ID NO: 36362 - DNA, 35 bp, Artificial Sequence
  Synthetic oligonucleotide
gcgcaccgtatgcaacttcctcttcagccaagcga

SEQ ID NO: 36363 - DNA, 37 bp, Artificial Sequence
  Synthetic oligonucleotide
gaggggtgatcaggggattagtgggggcgggattcga

SEQ ID NO: 36364 - DNA, 35 bp, Artificial Sequence
  Synthetic oligonucleotide
tccacactaccctatggacaggctgttccctcgga

SEQ ID NO: 36365 - DNA, 37 bp, Artificial Sequence
  Synthetic oligonucleotide
gccaatgcctgtactgcgcattacccccattaaggga

SEQ ID NO: 36366 - DNA, 37 bp, Artificial Sequence
  Synthetic oligonucleotide
gcgcgaagcgcaaaactgaatcgttgggggacttgga

SEQ ID NO: 36367 - DNA, 38 bp, Artificial Sequence
  Synthetic oligonucleotide
gttccaccactgaagaccgcgtaagcgccattccatga

SEQ ID NO: 36368 - DNA, 38 bp, Artificial Sequence
  Synthetic oligonucleotide
gtgaggacgtgggagtgggtacggaaggagcgccctga

SEQ ID NO: 36369 - DNA, 37 bp, Artificial Sequence
  Synthetic oligonucleotide
tcctcctcgtcacctgcccgcgtcgacagatccctga

SEQ ID NO: 36370 - DNA, 38 bp, Artificial Sequence
  Synthetic oligonucleotide
atccggcctggcacgacacttatgcgcacccaccttga

SEQ ID NO: 36371 - DNA, 37 bp, Artificial Sequence
  Synthetic oligonucleotide
tacgctaccgagcatactgacgcgacctactccttga

SEQ ID NO: 36372 - DNA, 35 bp, Artificial Sequence
  Synthetic oligonucleotide
gcgtaccgcctttccacgctgatcctgtccgagta

SEQ ID NO: 36373 - DNA, 36 bp, Artificial Sequence
  Synthetic oligonucleotide
gtcgggcccctgccaggattcccgtatgttctttta

SEQ ID NO: 36374 - DNA, 35 bp, Artificial Sequence
  Synthetic oligonucleotide
gacgccttcattctccgggtacgccactttttaac

SEQ ID NO: 36375 - DNA, 35 bp, Artificial Sequence
  Synthetic oligonucleotide
acgcctggccgtccctcttagtcggcttttgcatc

SEQ ID NO: 36376 - DNA, 35 bp, Artificial Sequence
  Synthetic oligonucleotide
tgcatccgatctattcgagctccgccatgttcatc

SEQ ID NO: 36377 - DNA, 35 bp, Artificial Sequence
  Synthetic oligonucleotide
gtgtaacggaagttactcaccgatatccacgcttc

SEQ ID NO: 36378 - DNA, 35 bp, Artificial Sequence
  Synthetic oligonucleotide
tatgactccccacccagtacggtttcggacgtgcg

SEQ ID NO: 36379 - DNA, 35 bp, Artificial Sequence
  Synthetic oligonucleotide
tcaccagggcgagggcgggacataacatacaaggg

SEQ ID NO: 36380 - DNA, 35 bp, Artificial Sequence
  Synthetic oligonucleotide
gcatagccattaaggttctccaccgtgtcttcgct

SEQ ID NO: 36381 - DNA, 35 bp, Artificial Sequence
  Synthetic oligonucleotide
tcccctgtctgtcagggtcctgcctatctcgtgct

SEQ ID NO: 36382 - DNA, 35 bp, Artificial Sequence
  Synthetic oligonucleotide
tatgactgccgtccgacatctgcagctacgtctct

SEQ ID NO: 36383 - DNA, 36 bp, Artificial Sequence
  Synthetic oligonucleotide
caaccgacaaactgccatatcgccctcccgccgaaa

SEQ ID NO: 36384 - DNA, 36 bp, Artificial Sequence
  Synthetic oligonucleotide
gtaacccccgcccaccgcaaatagttgagaggtcaa

SEQ ID NO: 36385 - DNA, 35 bp, Artificial Sequence
  Synthetic oligonucleotide
ttcacccgctcccagttctttgccgaaagagaaca

SEQ ID NO: 36386 - DNA, 36 bp, Artificial Sequence
  Synthetic oligonucleotide
tgggcctcatcttcacgcgaatgctcacgccacaca

SEQ ID NO: 36387 - DNA, 36 bp, Artificial Sequence
  Synthetic oligonucleotide
tgtccacctgacggatcttcaggaacttcctctcca

SEQ ID NO: 36388 - DNA, 37 bp, Artificial Sequence
  Synthetic oligonucleotide
tgacgggtgtggacaaaacggggggggaagtggtcga

SEQ ID NO: 36389 - DNA, 36 bp, Artificial Sequence
  Synthetic oligonucleotide
tgtgatcggagaggggcaattggcttgggagaagga

SEQ ID NO: 36390 - DNA, 37 bp, Artificial Sequence
  Synthetic oligonucleotide
gggtcgagggtgggatgggggaatggcctagggagga

SEQ ID NO: 36391 - DNA, 37 bp, Artificial Sequence
  Synthetic oligonucleotide
gtgccactagtgccccccgtattcttgttatcccgga

SEQ ID NO: 36392 - DNA, 37 bp, Artificial Sequence
  Synthetic oligonucleotide
tcagtcgggggtggtttgaaaaggcttacgggtcgga

SEQ ID NO: 36393 - DNA, 38 bp, Artificial Sequence
  Synthetic oligonucleotide
gctgggagtggatgggtgggtttataatatgtgtatga

SEQ ID NO: 36394 - DNA, 38 bp, Artificial Sequence
  Synthetic oligonucleotide
gcacatctacccaccgcctattgtcgctccgtgactga

SEQ ID NO: 36395 - DNA, 37 bp, Artificial Sequence
  Synthetic oligonucleotide
tcgacacgctccttagtttcatcggcccttgtactga

SEQ ID NO: 36396 - DNA, 38 bp, Artificial Sequence
  Synthetic oligonucleotide
aagtgcaggtagggggggagggatgaaatgcgccgtga

SEQ ID NO: 36397 - DNA, 37 bp, Artificial Sequence
  Synthetic oligonucleotide
tcgacactcagatcacctcccgtgctttctccggtga

SEQ ID NO: 36398 - DNA, 38 bp, Artificial Sequence
  Synthetic oligonucleotide
agtgaggcatgtggggttggtggggccgtacgggttga

SEQ ID NO: 36399 - DNA, 36 bp, Artificial Sequence
  Synthetic oligonucleotide
gctgtgcgaatggaggacgaggaggcgaacgggata

SEQ ID NO: 36400 - DNA, 35 bp, Artificial Sequence
  Synthetic oligonucleotide
gcacctacttggctacatcgcttagagtttaccac

SEQ ID NO: 36401 - DNA, 35 bp, Artificial Sequence
  Synthetic oligonucleotide
ttggcccgccgacaacgctcgcataacatttctac

SEQ ID NO: 36402 - DNA, 35 bp, Artificial Sequence
  Synthetic oligonucleotide
aagggggtcgccgcttccacctctgttagtaaacc

SEQ ID NO: 36403 - DNA, 35 bp, Artificial Sequence
  Synthetic oligonucleotide
atgccatcaggcgccgtcctcttcttcagccgagc

SEQ ID NO: 36404 - DNA, 35 bp, Artificial Sequence
  Synthetic oligonucleotide
atcgctcacgacctcaacttcgtacttcacgtagc

SEQ ID NO: 36405 - DNA, 35 bp, Artificial Sequence
  Synthetic oligonucleotide
tcagttgccacattcgagttgaataggcctccctc

SEQ ID NO: 36406 - DNA, 35 bp, Artificial Sequence
  Synthetic oligonucleotide
aagtggaggggcgcggtctaggtccgggggtggtc

SEQ ID NO: 36407 - DNA, 35 bp, Artificial Sequence
  Synthetic oligonucleotide
agagcacgaagggggggcaagggaagaatgagaag

SEQ ID NO: 36408 - DNA, 35 bp, Artificial Sequence
  Synthetic oligonucleotide
gctacttccgccgtctattcactgtaccgttccgg

SEQ ID NO: 36409 - DNA, 35 bp, Artificial Sequence
  Synthetic oligonucleotide
gcactacagcggggtatctccatcattctacgcgg

SEQ ID NO: 36410 - DNA, 35 bp, Artificial Sequence
  Synthetic oligonucleotide
tgactcgcgccccactaactttatccgcttatttg

SEQ ID NO: 36411 - DNA, 35 bp, Artificial Sequence
  Synthetic oligonucleotide
gccggatggcgctaatactcgctctgtgcttggtt

SEQ ID NO: 36412 - DNA, 36 bp, Artificial Sequence
  Synthetic oligonucleotide
gactccgccgacaccgcactctaattatgcttagca

SEQ ID NO: 36413 - DNA, 36 bp, Artificial Sequence
  Synthetic oligonucleotide
atcgtacccgcgcatatctaggtttccgttgcatca

SEQ ID NO: 36414 - DNA, 37 bp, Artificial Sequence
  Synthetic oligonucleotide
atgaggagtgatgggacgcacagggagtccgggaaga

SEQ ID NO: 36415 - DNA, 37 bp, Artificial Sequence
  Synthetic oligonucleotide
gtgacgcaccgtgggacgccaacgcactctcctccga

SEQ ID NO: 36416 - DNA, 37 bp, Artificial Sequence
  Synthetic oligonucleotide
gaggggcaggtagatctgggtggttgggtgggatgga

SEQ ID NO: 36417 - DNA, 38 bp, Artificial Sequence
  Synthetic oligonucleotide
tcatcaagcgtgctgctcaccccccattatggcactga

SEQ ID NO: 36418 - DNA, 36 bp, Artificial Sequence
  Synthetic oligonucleotide
aaacgaccgcaccaccgctcccccatttggtcttga

SEQ ID NO: 36419 - DNA, 38 bp, Artificial Sequence
  Synthetic oligonucleotide
tgaaacgccgtttgcgagagttccaccctatgctttga

SEQ ID NO: 36420 - DNA, 36 bp, Artificial Sequence
  Synthetic oligonucleotide
gcaatcggggtgcccatgtaggaggggggaaatgta

SEQ ID NO: 36421 - DNA, 34 bp, Artificial Sequence
  Synthetic oligonucleotide
aaccaccttcgataatacggtctacctgtattcc

SEQ ID NO: 36422 - DNA, 35 bp, Artificial Sequence
  Synthetic oligonucleotide
gaaccggacaggcccttcacgttttaatccgttcc

SEQ ID NO: 36423 - DNA, 35 bp, Artificial Sequence
  Synthetic oligonucleotide
tacacctacatgtctccgcatcgtttccatgcgag

SEQ ID NO: 36424 - DNA, 35 bp, Artificial Sequence
  Synthetic oligonucleotide
gttgcgcggtaccaacttcgctcccctcatcgact

SEQ ID NO: 36425 - DNA, 35 bp, Artificial Sequence
  Synthetic oligonucleotide
atgtccggctcgatcacattctactcgtacaatct

SEQ ID NO: 36426 - DNA, 35 bp, Artificial Sequence
  Synthetic oligonucleotide
gaactccacgctagtgttttctttacccgcattct

SEQ ID NO: 36427 - DNA, 36 bp, Artificial Sequence
  Synthetic oligonucleotide
ggggagtacgggtggggaggtttaatggagagaaaa

SEQ ID NO: 36428 - DNA, 35 bp, Artificial Sequence
  Synthetic oligonucleotide
tcacgtaccccagaagatctagctagggccgcaaa

SEQ ID NO: 36429 - DNA, 36 bp, Artificial Sequence
  Synthetic oligonucleotide
atcacaccccagctccgacatctggtccgctgccaa

SEQ ID NO: 36430 - DNA, 35 bp, Artificial Sequence
  Synthetic oligonucleotide
ggtgaggagaagacgggagtgataggcctcaggaa

SEQ ID NO: 36431 - DNA, 35 bp, Artificial Sequence
  Synthetic oligonucleotide
tagttactcacgacgcgaatagcccatcacaaaca

SEQ ID NO: 36432 - DNA, 35 bp, Artificial Sequence
  Synthetic oligonucleotide
actatggccatcactttttcgccccctgccttgca

SEQ ID NO: 36433 - DNA, 35 bp, Artificial Sequence
  Synthetic oligonucleotide
tatccgcccatatttgagccctaacttacgttgca

SEQ ID NO: 36434 - DNA, 36 bp, Artificial Sequence
  Synthetic oligonucleotide
acacgacaccccacggaactaacatcagggttatca

SEQ ID NO: 36435 - DNA, 35 bp, Artificial Sequence
  Synthetic oligonucleotide
gacccgcagcctgatcttttctatcctacaagtca

SEQ ID NO: 36436 - DNA, 37 bp, Artificial Sequence
  Synthetic oligonucleotide
atcgtgcaccactcatctaacatcaacaagtcaacga

SEQ ID NO: 36437 - DNA, 37 bp, Artificial Sequence
  Synthetic oligonucleotide
acgttccaacatctttggtccttttgcctacttccga

SEQ ID NO: 36438 - DNA, 37 bp, Artificial Sequence
  Synthetic oligonucleotide
tgcgtagcaactgttcaatcttacgaccatcttgcga

SEQ ID NO: 36439 - DNA, 37 bp, Artificial Sequence
  Synthetic oligonucleotide
agccaagggagggggggatggaagttataggttgcga

SEQ ID NO: 36440 - DNA, 37 bp, Artificial Sequence
  Synthetic oligonucleotide
accacgtgtaaagaggcaaatgtgaaaggggggcgga

SEQ ID NO: 36441 - DNA, 37 bp, Artificial Sequence
  Synthetic oligonucleotide
gaaaaagtacgaggaggggagagtcacgagggaggga

SEQ ID NO: 36442 - DNA, 37 bp, Artificial Sequence
  Synthetic oligonucleotide
gatcattgaggagggaaaatctggccaaccaggggga

SEQ ID NO: 36443 - DNA, 38 bp, Artificial Sequence
  Synthetic oligonucleotide
taccgcccggtcccttttgcgccctatacctggcatga

SEQ ID NO: 36444 - DNA, 37 bp, Artificial Sequence
  Synthetic oligonucleotide
gacattggtctcggcccgcaccaccacaccctattga

SEQ ID NO: 36445 - DNA, 37 bp, Artificial Sequence
  Synthetic oligonucleotide
taaacatccgcccacagtcccagtcctccgtcgttga

SEQ ID NO: 36446 - DNA, 36 bp, Artificial Sequence
  Synthetic oligonucleotide
tatccccagtgcacactcatggctttgcaccatcta

SEQ ID NO: 36447 - DNA, 38 bp, Artificial Sequence
  Synthetic oligonucleotide
tattagcccgcctcatccgttcttcaacttgtacgtta

SEQ ID NO: 36448 - DNA, 35 bp, Artificial Sequence
  Synthetic oligonucleotide
tgcccagtgcattgttccggctgccccccgctaac

SEQ ID NO: 36449 - DNA, 35 bp, Artificial Sequence
  Synthetic oligonucleotide
tctatccccgacttccgtgtcacctagccaccgac

SEQ ID NO: 36450 - DNA, 35 bp, Artificial Sequence
  Synthetic oligonucleotide
atcccacccacgcgccaatcttgagggttagtctc

SEQ ID NO: 36451 - DNA, 35 bp, Artificial Sequence
  Synthetic oligonucleotide
actatctcgcatacatccccgtgctttgggctttc

SEQ ID NO: 36452 - DNA, 35 bp, Artificial Sequence
  Synthetic oligonucleotide
atggacacaactcgatccccgctatgccgaaaccg

SEQ ID NO: 36453 - DNA, 35 bp, Artificial Sequence
  Synthetic oligonucleotide
atgaccacgccggacggctgtcccttacttcacct

SEQ ID NO: 36454 - DNA, 35 bp, Artificial Sequence
  Synthetic oligonucleotide
tacatccgtccacacctccctgagcatgatcgcct

SEQ ID NO: 36455 - DNA, 35 bp, Artificial Sequence
  Synthetic oligonucleotide
attgcgctgactatctctctcttccaataactgct

SEQ ID NO: 36456 - DNA, 36 bp, Artificial Sequence
  Synthetic oligonucleotide
acagaaagggagcctgggaaaggggttggcgtgaaa

SEQ ID NO: 36457 - DNA, 35 bp, Artificial Sequence
  Synthetic oligonucleotide
atcaacccacgatccgctaatcaacatttcctgaa

SEQ ID NO: 36458 - DNA, 36 bp, Artificial Sequence
  Synthetic oligonucleotide
tccatactggtgccaacagcattgtcttcccttgaa

SEQ ID NO: 36459 - DNA, 35 bp, Artificial Sequence
  Synthetic oligonucleotide
agccatccccattatctctcgctggtgcacatcca

SEQ ID NO: 36460 - DNA, 35 bp, Artificial Sequence
  Synthetic oligonucleotide
ttctgcccgcattgcgacgaggctggtttctttca

SEQ ID NO: 36461 - DNA, 37 bp, Artificial Sequence
  Synthetic oligonucleotide
gaatggtagattgggcgaaggggggaggaaggataga

SEQ ID NO: 36462 - DNA, 37 bp, Artificial Sequence
  Synthetic oligonucleotide
gacgcactctaacacgaaccttaagctgcctctccga

SEQ ID NO: 36463 - DNA, 37 bp, Artificial Sequence
  Synthetic oligonucleotide
agcgggctcgcaatagggcggagtaggggggaggcga

SEQ ID NO: 36464 - DNA, 37 bp, Artificial Sequence
  Synthetic oligonucleotide
attcgaaccacgcccacttttaggacctttgactcga

SEQ ID NO: 36465 - DNA, 37 bp, Artificial Sequence
  Synthetic oligonucleotide
ggagtggcgtgcaaacaaattgggggcgggtggggga

SEQ ID NO: 36466 - DNA, 36 bp, Artificial Sequence
  Synthetic oligonucleotide
ttggccgttcacgctttcaccgttgctaccctctga

SEQ ID NO: 36467 - DNA, 36 bp, Artificial Sequence
  Synthetic oligonucleotide
gacagaccggggggtgaaataggtgagaaggcgtga

SEQ ID NO: 36468 - DNA, 38 bp, Artificial Sequence
  Synthetic oligonucleotide
agtgaaggggattgaggagcggaagagagggaaggtga

SEQ ID NO: 36469 - DNA, 38 bp, Artificial Sequence
  Synthetic oligonucleotide
gaagccggtgctgaggggtggcgtacgggagtgggtga

SEQ ID NO: 36470 - DNA, 37 bp, Artificial Sequence
  Synthetic oligonucleotide
tttggacaccccttagcttgtacttcaacctttttga

SEQ ID NO: 36471 - DNA, 36 bp, Artificial Sequence
  Synthetic oligonucleotide
gtacgcctgccatcaaaacataactgctctgcctta

SEQ ID NO: 36472 - DNA, 35 bp, Artificial Sequence
  Synthetic oligonucleotide
gccggttgagtcctacacgttcccgattgctctgc

SEQ ID NO: 36473 - DNA, 35 bp, Artificial Sequence
  Synthetic oligonucleotide
tcctcacccccctttgtttacggcctgtgaatctc

SEQ ID NO: 36474 - DNA, 35 bp, Artificial Sequence
  Synthetic oligonucleotide
gtgaccctgcagtatatggtctgtcgcctttgttc

SEQ ID NO: 36475 - DNA, 35 bp, Artificial Sequence
  Synthetic oligonucleotide
gatctgctccccactgtacctttaatccttttagg

SEQ ID NO: 36476 - DNA, 35 bp, Artificial Sequence
  Synthetic oligonucleotide
gaagtgtggggcgaggggggattaatgcgtacgtg

SEQ ID NO: 36477 - DNA, 34 bp, Artificial Sequence
  Synthetic oligonucleotide
ggttcggccctggactcatcaatttgccactttg

SEQ ID NO: 36478 - DNA, 35 bp, Artificial Sequence
  Synthetic oligonucleotide
tccaagccgcggtgaagtaatttgttccttgccct

SEQ ID NO: 36479 - DNA, 35 bp, Artificial Sequence
  Synthetic oligonucleotide
gagagggggcgggtaatccgggctctgtggggtgt

SEQ ID NO: 36480 - DNA, 35 bp, Artificial Sequence
  Synthetic oligonucleotide
actcccgcaactctgcatctcgatcacgtgctatt

SEQ ID NO: 36481 - DNA, 35 bp, Artificial Sequence
  Synthetic oligonucleotide
gcgtgcctcccgccgtttcactgctcatataacaa

SEQ ID NO: 36482 - DNA, 36 bp, Artificial Sequence
  Synthetic oligonucleotide
tcaccccagctcagctctcgaactcccgagcatcaa

SEQ ID NO: 36483 - DNA, 36 bp, Artificial Sequence
  Synthetic oligonucleotide
gcacagagcgctccattgcgttcctcttagtgctaa

SEQ ID NO: 36484 - DNA, 36 bp, Artificial Sequence
  Synthetic oligonucleotide
acagtccccccactgcgaatttgccttcctgcaaca

SEQ ID NO: 36485 - DNA, 35 bp, Artificial Sequence
  Synthetic oligonucleotide
atctacacaacgagtgtcccacgctggatttatca

SEQ ID NO: 36486 - DNA, 37 bp, Artificial Sequence
  Synthetic oligonucleotide
gagtggtgagtggtggggagcgtaactatagcagaga

SEQ ID NO: 36487 - DNA, 37 bp, Artificial Sequence
  Synthetic oligonucleotide
gctcaccggaaaaaaaaaaataatgacacgggggaga

SEQ ID NO: 36488 - DNA, 37 bp, Artificial Sequence
  Synthetic oligonucleotide
tccgcctcctccagatcccgccgcctcgggcatacga

SEQ ID NO: 36489 - DNA, 37 bp, Artificial Sequence
  Synthetic oligonucleotide
tcagtgcaagcgaatcgcgacccgcctgcctccccga

SEQ ID NO: 36490 - DNA, 37 bp, Artificial Sequence
  Synthetic oligonucleotide
gacggtgtagggatcctggaaatagggacgtacggga

SEQ ID NO: 36491 - DNA, 37 bp, Artificial Sequence
  Synthetic oligonucleotide
gctgggggaaagctacgggaactgggagtggtgggga

SEQ ID NO: 36492 - DNA, 38 bp, Artificial Sequence
  Synthetic oligonucleotide
tgcccaatgccgccgcctgaacgctcccgggaccctga

SEQ ID NO: 36493 - DNA, 38 bp, Artificial Sequence
  Synthetic oligonucleotide
gacgcccgctgcgcaccctactttacacatattcgtga

SEQ ID NO: 36494 - DNA, 37 bp, Artificial Sequence
  Synthetic oligonucleotide
gaacattgtcgtgggaacgggggaggtgtgtaggtga

SEQ ID NO: 36495 - DNA, 38 bp, Artificial Sequence
  Synthetic oligonucleotide
gacaacgtatggaaggaaggtggtcgacggtagggtga

SEQ ID NO: 36496 - DNA, 36 bp, Artificial Sequence
  Synthetic oligonucleotide
tgagctcatccatctccatgcccgacgttctcagta

SEQ ID NO: 36497 - DNA, 36 bp, Artificial Sequence
  Synthetic oligonucleotide
tgcatcccactcacactagggcccttagcatacgta

SEQ ID NO: 36498 - DNA, 35 bp, Artificial Sequence
  Synthetic oligonucleotide
cccactgctgagtcccatgtatcccctcctgcgta

SEQ ID NO: 36499 - DNA, 35 bp, Artificial Sequence
  Synthetic oligonucleotide
ttcaccaactgttgtctcttcgccttcgctcgaac

SEQ ID NO: 36500 - DNA, 35 bp, Artificial Sequence
  Synthetic oligonucleotide
tttgcccatgggcaatctgacctccctatgactac

SEQ ID NO: 36501 - DNA, 35 bp, Artificial Sequence
  Synthetic oligonucleotide
gagcacattcccccaggctagggcaaagcaaaacc

SEQ ID NO: 36502 - DNA, 35 bp, Artificial Sequence
  Synthetic oligonucleotide
atgtaaacgaccaccagcctaggcgcaccgctatc

SEQ ID NO: 36503 - DNA, 35 bp, Artificial Sequence
  Synthetic oligonucleotide
gaagcctgttgccctcctaatactcgaccgctatc

SEQ ID NO: 36504 - DNA, 35 bp, Artificial Sequence
  Synthetic oligonucleotide
tattcaccgccagctgcggacccgactccctgaag

SEQ ID NO: 36505 - DNA, 36 bp, Artificial Sequence
  Synthetic oligonucleotide
tcggagggacacaatgtcgcccggcccttctccacg

SEQ ID NO: 36506 - DNA, 35 bp, Artificial Sequence
  Synthetic oligonucleotide
attcacgcgtctgtcccgggcccgtcattttcctg

SEQ ID NO: 36507 - DNA, 35 bp, Artificial Sequence
  Synthetic oligonucleotide
gtctcaacctggcgccgtctattttaccgtttctg

SEQ ID NO: 36508 - DNA, 35 bp, Artificial Sequence
  Synthetic oligonucleotide
tcggaccaccccctcccagaaaacgttctgtttct

SEQ ID NO: 36509 - DNA, 36 bp, Artificial Sequence
  Synthetic oligonucleotide
agactacaagcagcgggtgaagaggggggtgtcgaa

SEQ ID NO: 36510 - DNA, 37 bp, Artificial Sequence
  Synthetic oligonucleotide
ggaggggagggattaggagggtgaagccagattaaga

SEQ ID NO: 36511 - DNA, 37 bp, Artificial Sequence
  Synthetic oligonucleotide
acacccacggtccgttcgcgttaaaactgcgcccaga

SEQ ID NO: 36512 - DNA, 37 bp, Artificial Sequence
  Synthetic oligonucleotide
ttcgacgctcgtatcctgagtgccacctttgtctcga

SEQ ID NO: 36513 - DNA, 36 bp, Artificial Sequence
  Synthetic oligonucleotide
gcacttctcgccgaaaccgatccctccgcaaacgga

SEQ ID NO: 36514 - DNA, 37 bp, Artificial Sequence
  Synthetic oligonucleotide
tgtcctcacccgtttctccagccctccgttagttgga

SEQ ID NO: 36515 - DNA, 36 bp, Artificial Sequence
  Synthetic oligonucleotide
tagtcgtgtcctgttctgcccaattgtcctccctga

SEQ ID NO: 36516 - DNA, 36 bp, Artificial Sequence
  Synthetic oligonucleotide
ttaccatcgcactaatggatcttcacctaacgctga

SEQ ID NO: 36517 - DNA, 37 bp, Artificial Sequence
  Synthetic oligonucleotide
gtcagggcgtaatggttggcgggggtggcttttgtga

SEQ ID NO: 36518 - DNA, 38 bp, Artificial Sequence
  Synthetic oligonucleotide
gttgcccattatagttcatttgccagaccccttgttga

SEQ ID NO: 36519 - DNA, 36 bp, Artificial Sequence
  Synthetic oligonucleotide
gcatccttcccagtcacggcggtgacttcaacacta

SEQ ID NO: 36520 - DNA, 36 bp, Artificial Sequence
  Synthetic oligonucleotide
agcgcaacctctggactccgccttgcttttttagta

SEQ ID NO: 36521 - DNA, 35 bp, Artificial Sequence
  Synthetic oligonucleotide
ctcgactaccgttcgcctgtccctagtctattgta

SEQ ID NO: 36522 - DNA, 36 bp, Artificial Sequence
  Synthetic oligonucleotide
ttccagcgtgtcatccgaatatgtctccttgcctta

SEQ ID NO: 36523 - DNA, 35 bp, Artificial Sequence
  Synthetic oligonucleotide
atgttcacccatagtttcaaccgtgtgtctcacac

SEQ ID NO: 36524 - DNA, 35 bp, Artificial Sequence
  Synthetic oligonucleotide
gccgagcacgccgcgtgaccttttgctgaaaatac

SEQ ID NO: 36525 - DNA, 35 bp, Artificial Sequence
  Synthetic oligonucleotide
agtcgaatgcctcgtcctgtttccgtttcgttccc

SEQ ID NO: 36526 - DNA, 35 bp, Artificial Sequence
  Synthetic oligonucleotide
ttttaaccgccactaccgttctcctgcaatgggcc

SEQ ID NO: 36527 - DNA, 35 bp, Artificial Sequence
  Synthetic oligonucleotide
gagttgccacatccgtttgccgttcacacacacag

SEQ ID NO: 36528 - DNA, 35 bp, Artificial Sequence
  Synthetic oligonucleotide
atccacacatgccaagcctgtttatcaaccttgat

SEQ ID NO: 36529 - DNA, 35 bp, Artificial Sequence
  Synthetic oligonucleotide
tagggctgatatgtgcatttacctcctgtctccgt

SEQ ID NO: 36530 - DNA, 36 bp, Artificial Sequence
  Synthetic oligonucleotide
gaaaggcggtgtcctgccctgatattcctcttgcaa

SEQ ID NO: 36531 - DNA, 35 bp, Artificial Sequence
  Synthetic oligonucleotide
tgcacggacgtgccatttgccgtgctcccctgtaa

SEQ ID NO: 36532 - DNA, 36 bp, Artificial Sequence
  Synthetic oligonucleotide
atctactcattatggtcctttgctagcacccctgca

SEQ ID NO: 36533 - DNA, 36 bp, Artificial Sequence
  Synthetic oligonucleotide
gagtcactctgcccaaaccatctgacagtaccacga

SEQ ID NO: 36534 - DNA, 37 bp, Artificial Sequence
  Synthetic oligonucleotide
taagaccctcgaattcgttaaacaccgtccactccga

SEQ ID NO: 36535 - DNA, 35 bp, Artificial Sequence
  Synthetic oligonucleotide
accacgctagagctctccgccggtattcccctcga

SEQ ID NO: 36536 - DNA, 37 bp, Artificial Sequence
  Synthetic oligonucleotide
aactaagaagggacgcaagaaggacgaggagcgagga

SEQ ID NO: 36537 - DNA, 36 bp, Artificial Sequence
  Synthetic oligonucleotide
tggggggggggggaatgggtctcaaggtgggatgga

SEQ ID NO: 36538 - DNA, 38 bp, Artificial Sequence
  Synthetic oligonucleotide
tattgggggagggaaggtgggcgaacacggcctaatga

SEQ ID NO: 36539 - DNA, 38 bp, Artificial Sequence
  Synthetic oligonucleotide
tactccaccacgccttcaggtatcctccaccggtgtga

SEQ ID NO: 36540 - DNA, 37 bp, Artificial Sequence
  Synthetic oligonucleotide
accacacgcgcggctcctagacgccccttacttttga

SEQ ID NO: 36541 - DNA, 35 bp, Artificial Sequence
  Synthetic oligonucleotide
gagacactccgttcgctctttacttcaccactcac

SEQ ID NO: 36542 - DNA, 35 bp, Artificial Sequence
  Synthetic oligonucleotide
aacgccttacccgcctctaccagggctcatacgac

SEQ ID NO: 36543 - DNA, 35 bp, Artificial Sequence
  Synthetic oligonucleotide
atgccgtctcatatgcttttgcgccttgcctcgac

SEQ ID NO: 36544 - DNA, 35 bp, Artificial Sequence
  Synthetic oligonucleotide
acccgctccgttttgcagtcccaccccacggctac

SEQ ID NO: 36545 - DNA, 35 bp, Artificial Sequence
  Synthetic oligonucleotide
ttgatcagcgatttctccatccggaccattgctac

SEQ ID NO: 36546 - DNA, 35 bp, Artificial Sequence
  Synthetic oligonucleotide
tgtaccgcacgcccccttcccgagaccacttatcc

SEQ ID NO: 36547 - DNA, 35 bp, Artificial Sequence
  Synthetic oligonucleotide
gaactctcgttgtccgtccttagcaattacatggc

SEQ ID NO: 36548 - DNA, 35 bp, Artificial Sequence
  Synthetic oligonucleotide
gcacccaaacgcggtaccccttcgtccagctttgc

SEQ ID NO: 36549 - DNA, 35 bp, Artificial Sequence
  Synthetic oligonucleotide
gtcacaaggcgcacttaacttggttcgttcctgtc

SEQ ID NO: 36550 - DNA, 35 bp, Artificial Sequence
  Synthetic oligonucleotide
gactcgtgtcgtcctagctgcgcgacttcttccat

SEQ ID NO: 36551 - DNA, 35 bp, Artificial Sequence
  Synthetic oligonucleotide
gcgtgggaggggggtggacgtcaatatgagcagat

SEQ ID NO: 36552 - DNA, 35 bp, Artificial Sequence
  Synthetic oligonucleotide
gtgcccagactcccccagactaggcgtatttccct

SEQ ID NO: 36553 - DNA, 35 bp, Artificial Sequence
  Synthetic oligonucleotide
tacctccttgccccgttagatccaatgcgttctct

SEQ ID NO: 36554 - DNA, 35 bp, Artificial Sequence
  Synthetic oligonucleotide
gttgccttacctgcttccccgctcgctgcgcgtgt

SEQ ID NO: 36555 - DNA, 35 bp, Artificial Sequence
  Synthetic oligonucleotide
tccgcccgaattctcttgtcccgcctttgatgctt

SEQ ID NO: 36556 - DNA, 35 bp, Artificial Sequence
  Synthetic oligonucleotide
agatgccgccgttgtctgtctacctaattccgttt

SEQ ID NO: 36557 - DNA, 35 bp, Artificial Sequence
  Synthetic oligonucleotide
gactgtgccgatggacttctgcgctattttttttt

SEQ ID NO: 36558 - DNA, 36 bp, Artificial Sequence
  Synthetic oligonucleotide
gtgactgcatacgcgacccagccatttatctacgca

SEQ ID NO: 36559 - DNA, 35 bp, Artificial Sequence
  Synthetic oligonucleotide
atcagctcctggccgtcgtgcgtcgctccatctca

SEQ ID NO: 36560 - DNA, 37 bp, Artificial Sequence
  Synthetic oligonucleotide
gagcaaagggggcgtgggtacgggttctagtacaaga

SEQ ID NO: 36561 - DNA, 36 bp, Artificial Sequence
  Synthetic oligonucleotide
acgcctgaccgctacagtgtccaatccatcccacga

SEQ ID NO: 36562 - DNA, 37 bp, Artificial Sequence
  Synthetic oligonucleotide
atcactgctacctgccactcatctaataacggaccga

SEQ ID NO: 36563 - DNA, 37 bp, Artificial Sequence
  Synthetic oligonucleotide
taccaccgatccgcactgttgcactttcttgacccga

SEQ ID NO: 36564 - DNA, 37 bp, Artificial Sequence
  Synthetic oligonucleotide
tgatgtccggccattcccttgcatatcgtttctagga

SEQ ID NO: 36565 - DNA, 37 bp, Artificial Sequence
  Synthetic oligonucleotide
tactccgcctacctccacttctgaaacagtccacgga

SEQ ID NO: 36566 - DNA, 37 bp, Artificial Sequence
  Synthetic oligonucleotide
tctgtcccccaactgttcatctccggccataccggga

SEQ ID NO: 36567 - DNA, 37 bp, Artificial Sequence
  Synthetic oligonucleotide
acccccgtaaactcgttctaatgcttccatctctgga

SEQ ID NO: 36568 - DNA, 37 bp, Artificial Sequence
  Synthetic oligonucleotide
tacgtcgaacctatcctgcgccatcctccggtactga

SEQ ID NO: 36569 - DNA, 37 bp, Artificial Sequence
  Synthetic oligonucleotide
attacgcgcctcgaactgaaactatgctcttacctga

SEQ ID NO: 36570 - DNA, 38 bp, Artificial Sequence
  Synthetic oligonucleotide
gcacaccgacttattacacatctgcaccctcctcctga

SEQ ID NO: 36571 - DNA, 38 bp, Artificial Sequence
  Synthetic oligonucleotide
acacaatccgggccaagggaagggaaagggacgtgtga

SEQ ID NO: 36572 - DNA, 38 bp, Artificial Sequence
  Synthetic oligonucleotide
aacccggactcactttgcataaactcgcaccagcttga

SEQ ID NO: 36573 - DNA, 36 bp, Artificial Sequence
  Synthetic oligonucleotide
agatttggcggtggggggaaggaggcacagacgacc

SEQ ID NO: 36574 - DNA, 35 bp, Artificial Sequence
  Synthetic oligonucleotide
gcgcatgtccgcgccaatatacccaggcatgtacc

SEQ ID NO: 36575 - DNA, 35 bp, Artificial Sequence
  Synthetic oligonucleotide
actgatcggtgtaactatctaagatcgttcttccc

SEQ ID NO: 36576 - DNA, 35 bp, Artificial Sequence
  Synthetic oligonucleotide
gtccatcgtggtcgtgcgaacttcccttgcttgcc

SEQ ID NO: 36577 - DNA, 35 bp, Artificial Sequence
  Synthetic oligonucleotide
taacccccgcactctgcctggttcttctagtgagc

SEQ ID NO: 36578 - DNA, 35 bp, Artificial Sequence
  Synthetic oligonucleotide
gatcccggcacactacctccgccagccgccgaatc

SEQ ID NO: 36579 - DNA, 35 bp, Artificial Sequence
  Synthetic oligonucleotide
tgccttccgtcgtctatccctgttaaatctgcgtc

SEQ ID NO: 36580 - DNA, 35 bp, Artificial Sequence
  Synthetic oligonucleotide
gtccaccgctaccgttccgattccccgtcgcctag

SEQ ID NO: 36581 - DNA, 35 bp, Artificial Sequence
  Synthetic oligonucleotide
ggatcgaaggaggggcatgaaggggaattcgcgat

SEQ ID NO: 36582 - DNA, 35 bp, Artificial Sequence
  Synthetic oligonucleotide
tgcttgaccccatctgaatgcccacatacaaatat

SEQ ID NO: 36583 - DNA, 35 bp, Artificial Sequence
  Synthetic oligonucleotide
tagcgcataactatgttgtcaccagccaattcact

SEQ ID NO: 36584 - DNA, 35 bp, Artificial Sequence
  Synthetic oligonucleotide
ggtcgttgcacctctgttccatggcactgctacct

SEQ ID NO: 36585 - DNA, 35 bp, Artificial Sequence
  Synthetic oligonucleotide
gtgtccagggcccatcacctacttgtcctgcatct

SEQ ID NO: 36586 - DNA, 35 bp, Artificial Sequence
  Synthetic oligonucleotide
gtagcacgacggtagcagcacctctgttcctatct

SEQ ID NO: 36587 - DNA, 35 bp, Artificial Sequence
  Synthetic oligonucleotide
acgcaaggggggatagaaggcgtaggggtctaggt

SEQ ID NO: 36588 - DNA, 36 bp, Artificial Sequence
  Synthetic oligonucleotide
tacatgccacactgcctaggaggaaaatttattggt

SEQ ID NO: 36589 - DNA, 35 bp, Artificial Sequence
  Synthetic oligonucleotide
aagccggctgatccgcacaccactacctcacaatt

SEQ ID NO: 36590 - DNA, 35 bp, Artificial Sequence
  Synthetic oligonucleotide
ttgtgctcacacaactcctgaattaaaaagccctt

SEQ ID NO: 36591 - DNA, 35 bp, Artificial Sequence
  Synthetic oligonucleotide
tcgctggcacgcccgtcttctcgtctcacttggtt

SEQ ID NO: 36592 - DNA, 36 bp, Artificial Sequence
  Synthetic oligonucleotide
gcaccccattctctcttctttggccctagggaccaa

SEQ ID NO: 36593 - DNA, 34 bp, Artificial Sequence
  Synthetic oligonucleotide
ggttactccactcgcataatgtgcgttaccccaa

SEQ ID NO: 36594 - DNA, 35 bp, Artificial Sequence
  Synthetic oligonucleotide
tctctgcccagtgtcattcttggtacttcccgcaa

SEQ ID NO: 36595 - DNA, 36 bp, Artificial Sequence
  Synthetic oligonucleotide
gacttccacgacatattaatttcgggccatccacca

SEQ ID NO: 36596 - DNA, 36 bp, Artificial Sequence
  Synthetic oligonucleotide
gctgtgcatccagggctcatagttaccgccaaccca

SEQ ID NO: 36597 - DNA, 36 bp, Artificial Sequence
  Synthetic oligonucleotide
atgttgggaagggtggcgaggggataaagcttccca

SEQ ID NO: 36598 - DNA, 36 bp, Artificial Sequence
  Synthetic oligonucleotide
acgcaccacaaaaacagtcaccacaccactccagca

SEQ ID NO: 36599 - DNA, 37 bp, Artificial Sequence
  Synthetic oligonucleotide
gtgagagtagagcgtaaataggggagtggaggtcaga

SEQ ID NO: 36600 - DNA, 37 bp, Artificial Sequence
  Synthetic oligonucleotide
tgcccttctcctgctctgttccgctccgccaggccga

SEQ ID NO: 36601 - DNA, 37 bp, Artificial Sequence
  Synthetic oligonucleotide
gagcccccacccccgatgcttatgatatcttgccgga

SEQ ID NO: 36602 - DNA, 37 bp, Artificial Sequence
  Synthetic oligonucleotide
atgataaggcggggaaattggggtgctagtatgggga

SEQ ID NO: 36603 - DNA, 37 bp, Artificial Sequence
  Synthetic oligonucleotide
tgtcctggtacccgactgcaactttgtacaatcatga

SEQ ID NO: 36604 - DNA, 38 bp, Artificial Sequence
  Synthetic oligonucleotide
tccctccccccgctattggtcacgattcaaggcgatga

SEQ ID NO: 36605 - DNA, 38 bp, Artificial Sequence
  Synthetic oligonucleotide
gtgcactggcaccgtatgcagtgctctcccccccctga

SEQ ID NO: 36606 - DNA, 38 bp, Artificial Sequence
  Synthetic oligonucleotide
gtcggatgccccggtattcctgtttttccctgccgtga

SEQ ID NO: 36607 - DNA, 37 bp, Artificial Sequence
  Synthetic oligonucleotide
gtgggaagggataacgaggggaatgaggtccaggtga

SEQ ID NO: 36608 - DNA, 37 bp, Artificial Sequence
  Synthetic oligonucleotide
tctgtgcctccccccaagtgattccgcactcatgtga

SEQ ID NO: 36609 - DNA, 37 bp, Artificial Sequence
  Synthetic oligonucleotide
accaatcaacccactgcaacaccatcagcctttgtga

SEQ ID NO: 36610 - DNA, 36 bp, Artificial Sequence
  Synthetic oligonucleotide
ttgccacacttccaagccccactagccctggtcata

SEQ ID NO: 36611 - DNA, 35 bp, Artificial Sequence
  Synthetic oligonucleotide
atacccccgtccgtacttcatgatctacagctcta

SEQ ID NO: 36612 - DNA, 35 bp, Artificial Sequence
  Synthetic oligonucleotide
accctcgccaaacaggtattggttccaccgctaac

SEQ ID NO: 36613 - DNA, 35 bp, Artificial Sequence
  Synthetic oligonucleotide
attccgcacgaccgtcattcccgcctagtgcgcac

SEQ ID NO: 36614 - DNA, 35 bp, Artificial Sequence
  Synthetic oligonucleotide
gtgtgaccacgcccttcccatacccgtctcagtac

SEQ ID NO: 36615 - DNA, 35 bp, Artificial Sequence
  Synthetic oligonucleotide
tcgcactttcacgcccctactagacattccggccc

SEQ ID NO: 36616 - DNA, 35 bp, Artificial Sequence
  Synthetic oligonucleotide
aacccgggcccatgaccactttaatacgataagcc

SEQ ID NO: 36617 - DNA, 35 bp, Artificial Sequence
  Synthetic oligonucleotide
tgtaggttagcgcacattcatccacggccatatcc

SEQ ID NO: 36618 - DNA, 35 bp, Artificial Sequence
  Synthetic oligonucleotide
tccgcattccacaacgcgatagctgaaacgattcc

SEQ ID NO: 36619 - DNA, 35 bp, Artificial Sequence
  Synthetic oligonucleotide
tgtgaggtagcccctcccctcctaacttaccatgc

SEQ ID NO: 36620 - DNA, 35 bp, Artificial Sequence
  Synthetic oligonucleotide
aaggacggtgatccattgaatgtttttgttctctc

SEQ ID NO: 36621 - DNA, 35 bp, Artificial Sequence
  Synthetic oligonucleotide
tgctgtgcctattggcgatctgccgcctcaccttc

SEQ ID NO: 36622 - DNA, 35 bp, Artificial Sequence
  Synthetic oligonucleotide
gcctgttccccctatctcgacctgtaatgtgtgcg

SEQ ID NO: 36623 - DNA, 35 bp, Artificial Sequence
  Synthetic oligonucleotide
ggagacatgagcgtaggactgcagaggtggaaggg

SEQ ID NO: 36624 - DNA, 35 bp, Artificial Sequence
  Synthetic oligonucleotide
gtagtcagacctcaacccatcgtgtgcatcggcct

SEQ ID NO: 36625 - DNA, 35 bp, Artificial Sequence
  Synthetic oligonucleotide
gccccccacctgcagaggtgcttccgctaccgggt

SEQ ID NO: 36626 - DNA, 35 bp, Artificial Sequence
  Synthetic oligonucleotide
tccacccgataaccctcgtcgtcaagtacgtgggt

SEQ ID NO: 36627 - DNA, 35 bp, Artificial Sequence
  Synthetic oligonucleotide
gcagagcttaaccactccatcgtgttctatctggt

SEQ ID NO: 36628 - DNA, 35 bp, Artificial Sequence
  Synthetic oligonucleotide
actattgctgcccacgctagggcacagcacccatt

SEQ ID NO: 36629 - DNA, 35 bp, Artificial Sequence
  Synthetic oligonucleotide
tacagcaggccagcaacagttgttaacatcctctt

SEQ ID NO: 36630 - DNA, 35 bp, Artificial Sequence
  Synthetic oligonucleotide
tctccgcaacacggactgtctcatagccctccttt

SEQ ID NO: 36631 - DNA, 36 bp, Artificial Sequence
  Synthetic oligonucleotide
gaccaccctaacgctcgacttaaatgcactggaaaa

SEQ ID NO: 36632 - DNA, 36 bp, Artificial Sequence
  Synthetic oligonucleotide
tccaacctccgtctgcctttatcacgatgaatgcaa

SEQ ID NO: 36633 - DNA, 35 bp, Artificial Sequence
  Synthetic oligonucleotide
gggtcaactgccctctcactttgtccagattacca

SEQ ID NO: 36634 - DNA, 35 bp, Artificial Sequence
  Synthetic oligonucleotide
actaacgcgacgttggcccttcccgtcctacttca

SEQ ID NO: 36635 - DNA, 36 bp, Artificial Sequence
  Synthetic oligonucleotide
gcaagattaggaaaggaggagagggtacgggtaaga

SEQ ID NO: 36636 - DNA, 37 bp, Artificial Sequence
  Synthetic oligonucleotide
agtgcgggccacctatctgttcacgtcgaactcgaga

SEQ ID NO: 36637 - DNA, 37 bp, Artificial Sequence
  Synthetic oligonucleotide
accctctccgtgacctcgatcttttgccgtaacacga

SEQ ID NO: 36638 - DNA, 37 bp, Artificial Sequence
  Synthetic oligonucleotide
tctcaatcgtatatcatcgccacccgtaacgccggga

SEQ ID NO: 36639 - DNA, 38 bp, Artificial Sequence
  Synthetic oligonucleotide
gccgggtagccctgccctcttataaggccccccactga

SEQ ID NO: 36640 - DNA, 37 bp, Artificial Sequence
  Synthetic oligonucleotide
gccccgctctggcagtagccaccgttatccctcttga

SEQ ID NO: 36641 - DNA, 35 bp, Artificial Sequence
  Synthetic oligonucleotide
ttctagtcggcatcactccacaccagcctgcacta

SEQ ID NO: 36642 - DNA, 36 bp, Artificial Sequence
  Synthetic oligonucleotide
tacctccgcctggtcgctgaatcctcctgattagta

SEQ ID NO: 36643 - DNA, 36 bp, Artificial Sequence
  Synthetic oligonucleotide
agtgtctggggggcaaagggaaattggaacatgtta

SEQ ID NO: 36644 - DNA, 34 bp, Artificial Sequence
  Synthetic oligonucleotide
ttggggccctcgcccgtagaccattttcttatcc

SEQ ID NO: 36645 - DNA, 35 bp, Artificial Sequence
  Synthetic oligonucleotide
agtgacgaaccagtagtgctgcataccctctctcc

SEQ ID NO: 36646 - DNA, 35 bp, Artificial Sequence
  Synthetic oligonucleotide
agtgcatccgggatccctgtagccccactccactc

SEQ ID NO: 36647 - DNA, 35 bp, Artificial Sequence
  Synthetic oligonucleotide
aaactcgcgttcctccttgtcttactccgaatgtc

SEQ ID NO: 36648 - DNA, 35 bp, Artificial Sequence
  Synthetic oligonucleotide
gaacaccaccagtccgctcgctaacgtgcaatccg

SEQ ID NO: 36649 - DNA, 35 bp, Artificial Sequence
  Synthetic oligonucleotide
actcgcaagggggaaatggttatggttgtgtagcg

SEQ ID NO: 36650 - DNA, 35 bp, Artificial Sequence
  Synthetic oligonucleotide
tggtacgagtagggaggggaatgcaggggacaagg

SEQ ID NO: 36651 - DNA, 35 bp, Artificial Sequence
  Synthetic oligonucleotide
gacctcgcaggcatatcaccaaccattttactctg

SEQ ID NO: 36652 - DNA, 35 bp, Artificial Sequence
  Synthetic oligonucleotide
accatcgtaggaagagggagggtggaggttacttg

SEQ ID NO: 36653 - DNA, 36 bp, Artificial Sequence
  Synthetic oligonucleotide
atgaagtagcgagaggtagggagggggcatctaaaa

SEQ ID NO: 36654 - DNA, 35 bp, Artificial Sequence
  Synthetic oligonucleotide
tctccaccgactcggcctacttaacagatcgccca

SEQ ID NO: 36655 - DNA, 36 bp, Artificial Sequence
  Synthetic oligonucleotide
gacatccttcagctccccacgtcctgctgatttgca

SEQ ID NO: 36656 - DNA, 37 bp, Artificial Sequence
  Synthetic oligonucleotide
gagcaagacccgggactccaatggggggatagaaaga

SEQ ID NO: 36657 - DNA, 37 bp, Artificial Sequence
  Synthetic oligonucleotide
acacacaggtaagtaggggtgtggttgtgagtagaga

SEQ ID NO: 36658 - DNA, 36 bp, Artificial Sequence
  Synthetic oligonucleotide
accttgccatcctcaatctctcgcgaagttcggaga

SEQ ID NO: 36659 - DNA, 37 bp, Artificial Sequence
  Synthetic oligonucleotide
tacgcaacatcgcatttatagcaacctgagctcccga

SEQ ID NO: 36660 - DNA, 37 bp, Artificial Sequence
  Synthetic oligonucleotide
gtacgggagaggggaaagggcaatggttcgacgagga

SEQ ID NO: 36661 - DNA, 37 bp, Artificial Sequence
  Synthetic oligonucleotide
gacgtcggttcaatgatgggggaatgggggatgggga

SEQ ID NO: 36662 - DNA, 38 bp, Artificial Sequence
  Synthetic oligonucleotide
gaacaccgcccacgctgcacctagggactattcaatga

SEQ ID NO: 36663 - DNA, 36 bp, Artificial Sequence
  Synthetic oligonucleotide
tcctacccgttacatctgcttacagaactgtaatga

SEQ ID NO: 36664 - DNA, 38 bp, Artificial Sequence
  Synthetic oligonucleotide
tgatagccggctaatttatttggctccctcctaactga

SEQ ID NO: 36665 - DNA, 37 bp, Artificial Sequence
  Synthetic oligonucleotide
attgcgcccctgttacctcctttaagacaccctctga

SEQ ID NO: 36666 - DNA, 38 bp, Artificial Sequence
  Synthetic oligonucleotide
tcaacctcgcaaatacgcgcgctgtcccctccctctga

SEQ ID NO: 36667 - DNA, 36 bp, Artificial Sequence
  Synthetic oligonucleotide
gtgggcggggtttaacttggggtgtggggtaaggta

SEQ ID NO: 36668 - DNA, 33 bp, Artificial Sequence
  Synthetic oligonucleotide
ggtaccacctacatccgcaagtttcattctgta

SEQ ID NO: 36669 - DNA, 35 bp, Artificial Sequence
  Synthetic oligonucleotide
gtacgctcaactccactctccacgctacgttcaac

SEQ ID NO: 36670 - DNA, 35 bp, Artificial Sequence
  Synthetic oligonucleotide
ggtcaggcgcagccggttgcaccctactccccgac

SEQ ID NO: 36671 - DNA, 34 bp, Artificial Sequence
  Synthetic oligonucleotide
tactgtttgcacgctccgccatgtcttacgttcc

SEQ ID NO: 36672 - DNA, 35 bp, Artificial Sequence
  Synthetic oligonucleotide
gaccccgctgacttgaccccgaactagagcttagc

SEQ ID NO: 36673 - DNA, 35 bp, Artificial Sequence
  Synthetic oligonucleotide
tgtagatcgcgtgttgtaccctcccacgctcgctc

SEQ ID NO: 36674 - DNA, 35 bp, Artificial Sequence
  Synthetic oligonucleotide
tcaccctactacaaattgcacgcctcattaaggcg

SEQ ID NO: 36675 - DNA, 35 bp, Artificial Sequence
  Synthetic oligonucleotide
acacccccacggttcctcctgtctgagctgatatg

SEQ ID NO: 36676 - DNA, 35 bp, Artificial Sequence
  Synthetic oligonucleotide
accccgcttggtaggcaccgcaacaattgccccct

SEQ ID NO: 36677 - DNA, 35 bp, Artificial Sequence
  Synthetic oligonucleotide
ccatctactgactatgcccccgcaagcttgtgcct

SEQ ID NO: 36678 - DNA, 35 bp, Artificial Sequence
  Synthetic oligonucleotide
tctcccgccactgttggcccgatactgcgtgttct

SEQ ID NO: 36679 - DNA, 35 bp, Artificial Sequence
  Synthetic oligonucleotide
gtacctcttcctggctcatgatacactacttttgt

SEQ ID NO: 36680 - DNA, 35 bp, Artificial Sequence
  Synthetic oligonucleotide
gggaaagaaagggtggacgggatgcagggttgttt

SEQ ID NO: 36681 - DNA, 36 bp, Artificial Sequence
  Synthetic oligonucleotide
ttacgcccccgtgagctcctacttcgtgcttcgcaa

SEQ ID NO: 36682 - DNA, 36 bp, Artificial Sequence
  Synthetic oligonucleotide
tcagcgcttttggccatttttgcacagcccaccaca

SEQ ID NO: 36683 - DNA, 36 bp, Artificial Sequence
  Synthetic oligonucleotide
tgccattaaccaccatcgtaaagagtgcgctttcca

SEQ ID NO: 36684 - DNA, 37 bp, Artificial Sequence
  Synthetic oligonucleotide
gacaaggaagggagcgggaggggggatccgtagacga

SEQ ID NO: 36685 - DNA, 36 bp, Artificial Sequence
  Synthetic oligonucleotide
tcagtcccctcctagttgtcctcttaggaccatcga

SEQ ID NO: 36686 - DNA, 38 bp, Artificial Sequence
  Synthetic oligonucleotide
gaccgtaggaagggataggaaattggatcgggtactga

SEQ ID NO: 36687 - DNA, 36 bp, Artificial Sequence
  Synthetic oligonucleotide
acccatactagccccgtccatgcattcggcccctga

SEQ ID NO: 36688 - DNA, 38 bp, Artificial Sequence
  Synthetic oligonucleotide
ttccctgccctacccatgtgggatgaattcccacgtga

SEQ ID NO: 36689 - DNA, 38 bp, Artificial Sequence
  Synthetic oligonucleotide
tagtgaggccggggagaggaacatggcaatgggcgtga

SEQ ID NO: 36690 - DNA, 38 bp, Artificial Sequence
  Synthetic oligonucleotide
attgacggaggtagtgggcgggggggtaacgccattga

SEQ ID NO: 36691 - DNA, 38 bp, Artificial Sequence
  Synthetic oligonucleotide
gaccaccaaggcccgttatttgccctcattctttttga

SEQ ID NO: 36692 - DNA, 35 bp, Artificial Sequence
  Synthetic oligonucleotide
tatgtccgacatacgcccctcctttacacagcata

SEQ ID NO: 36693 - DNA, 36 bp, Artificial Sequence
  Synthetic oligonucleotide
ttgaccgcttacccccttgaccgtgcgtcgagacta

SEQ ID NO: 36694 - DNA, 36 bp, Artificial Sequence
  Synthetic oligonucleotide
atgtgccattctcatggtacttatccccgaatacta

SEQ ID NO: 36695 - DNA, 36 bp, Artificial Sequence
  Synthetic oligonucleotide
taagcctcacccactgctgcccagtcgacctccgta

SEQ ID NO: 36696 - DNA, 36 bp, Artificial Sequence
  Synthetic oligonucleotide
gcctagttccgcagcacctccgcctctaccgtatta

SEQ ID NO: 36697 - DNA, 36 bp, Artificial Sequence
  Synthetic oligonucleotide
gagtaaggcggacagcaggaaggggagcaggtttta

SEQ ID NO: 36698 - DNA, 35 bp, Artificial Sequence
  Synthetic oligonucleotide
gcgagcacttcaccctggcctcaaggaatcctgcc

SEQ ID NO: 36699 - DNA, 35 bp, Artificial Sequence
  Synthetic oligonucleotide
ttgtgcccgccggactcaagagcccgccacccatc

SEQ ID NO: 36700 - DNA, 35 bp, Artificial Sequence
  Synthetic oligonucleotide
attggaggctgtccgtctcccctccggcgattctc

SEQ ID NO: 36701 - DNA, 35 bp, Artificial Sequence
  Synthetic oligonucleotide
taaccggccgatgtcagtcgaccgttttccttttc

SEQ ID NO: 36702 - DNA, 35 bp, Artificial Sequence
  Synthetic oligonucleotide
gccgttatcaccccggggcactccgccatgcacct

SEQ ID NO: 36703 - DNA, 35 bp, Artificial Sequence
  Synthetic oligonucleotide
gccacctacatggttcgaatggccttttgcctgct

SEQ ID NO: 36704 - DNA, 35 bp, Artificial Sequence
  Synthetic oligonucleotide
actgacagtgtgggagggaggaatatgggacagaa

SEQ ID NO: 36705 - DNA, 36 bp, Artificial Sequence
  Synthetic oligonucleotide
ggacggtcatctgagtcctcgctactcccatcctca

SEQ ID NO: 36706 - DNA, 37 bp, Artificial Sequence
  Synthetic oligonucleotide
gtgatggggaggcatgattcggagaggatagaacaga

SEQ ID NO: 36707 - DNA, 36 bp, Artificial Sequence
  Synthetic oligonucleotide
tagccgtcgcactcttcgctccgcaggtctcgtcga

SEQ ID NO: 36708 - DNA, 35 bp, Artificial Sequence
  Synthetic oligonucleotide
tcaccgcccatgactggtagccccagcccacagga

SEQ ID NO: 36709 - DNA, 37 bp, Artificial Sequence
  Synthetic oligonucleotide
attgcaagcgatctgcggtggggggggaggggaggga

SEQ ID NO: 36710 - DNA, 36 bp, Artificial Sequence
  Synthetic oligonucleotide
tcaccatctgcactattgcatagacgtccccaatga

SEQ ID NO: 36711 - DNA, 38 bp, Artificial Sequence
  Synthetic oligonucleotide
gtcggagccgcaccacctcctgcatcatagtgccctga

SEQ ID NO: 36712 - DNA, 35 bp, Artificial Sequence
  Synthetic oligonucleotide
tgccatccttcttccttacgtgctctgctgtcaac

SEQ ID NO: 36713 - DNA, 35 bp, Artificial Sequence
  Synthetic oligonucleotide
agttgcagtccccatccaatgctattaccgataac

SEQ ID NO: 36714 - DNA, 35 bp, Artificial Sequence
  Synthetic oligonucleotide
atcgggccccaactcaccagtcctgtacgccgcac

SEQ ID NO: 36715 - DNA, 35 bp, Artificial Sequence
  Synthetic oligonucleotide
atcacttagccctgtttcggcgttcttcttacgac

SEQ ID NO: 36716 - DNA, 35 bp, Artificial Sequence
  Synthetic oligonucleotide
ttgatacgcactttacatttgtgctttgtggttcc

SEQ ID NO: 36717 - DNA, 35 bp, Artificial Sequence
  Synthetic oligonucleotide
atgatccatcggggtatggctctcccctttaaatc

SEQ ID NO: 36718 - DNA, 35 bp, Artificial Sequence
  Synthetic oligonucleotide
tgagacgccgcacgatcgcctggcccttccctgtc

SEQ ID NO: 36719 - DNA, 35 bp, Artificial Sequence
  Synthetic oligonucleotide
atgcccgtcacctggcctagtcttctcacggtgtc

SEQ ID NO: 36720 - DNA, 35 bp, Artificial Sequence
  Synthetic oligonucleotide
tcctggtagctgtagcctccttggtccacatattc

SEQ ID NO: 36721 - DNA, 35 bp, Artificial Sequence
  Synthetic oligonucleotide
actaggccgcagctattccctcactttcccatgag

SEQ ID NO: 36722 - DNA, 35 bp, Artificial Sequence
  Synthetic oligonucleotide
tgggtacagctcccaacgatccatctctccgtgcg

SEQ ID NO: 36723 - DNA, 35 bp, Artificial Sequence
  Synthetic oligonucleotide
agggggggatggggacggaggacaagagacgacgg

SEQ ID NO: 36724 - DNA, 35 bp, Artificial Sequence
  Synthetic oligonucleotide
gcaagattggaagaaaggtcatagaaggggatgtg

SEQ ID NO: 36725 - DNA, 35 bp, Artificial Sequence
  Synthetic oligonucleotide
tcacttccgcctgctcgccctactatgttaaatct

SEQ ID NO: 36726 - DNA, 35 bp, Artificial Sequence
  Synthetic oligonucleotide
accaagcccattgaatcggccggaatcaccctctt

SEQ ID NO: 36727 - DNA, 36 bp, Artificial Sequence
  Synthetic oligonucleotide
acaagtcaagtcgctgttgcctcgggttgcttttca

SEQ ID NO: 36728 - DNA, 37 bp, Artificial Sequence
  Synthetic oligonucleotide
tgcatccagacaatctcttaaagctcacctcggccga

SEQ ID NO: 36729 - DNA, 37 bp, Artificial Sequence
  Synthetic oligonucleotide
gacgcctgcctagtactccatcagcacactctaagga

SEQ ID NO: 36730 - DNA, 37 bp, Artificial Sequence
  Synthetic oligonucleotide
gaagggacgggtgtggaattcctggataatgagtgga

SEQ ID NO: 36731 - DNA, 36 bp, Artificial Sequence
  Synthetic oligonucleotide
ggacgcggcatggagagggaggatggggagggatga

SEQ ID NO: 36732 - DNA, 37 bp, Artificial Sequence
  Synthetic oligonucleotide
catccagctcttccctggtaaccttaagattccctga

SEQ ID NO: 36733 - DNA, 37 bp, Artificial Sequence
  Synthetic oligonucleotide
ttgccctgtgccacaattattcccgaccgaccgctga

SEQ ID NO: 36734 - DNA, 37 bp, Artificial Sequence
  Synthetic oligonucleotide
acgacaacaccggccagctctttttgtcccatcgtga

SEQ ID NO: 36735 - DNA, 38 bp, Artificial Sequence
  Synthetic oligonucleotide
acagagaggggacgacggcttggggcattgggagttga

SEQ ID NO: 36736 - DNA, 38 bp, Artificial Sequence
  Synthetic oligonucleotide
tgcaatcccgccttgtctatttcaccatctttatttga

SEQ ID NO: 36737 - DNA, 36 bp, Artificial Sequence
  Synthetic oligonucleotide
tatctactgctacttgccacttgtgcctgccaccta

SEQ ID NO: 36738 - DNA, 34 bp, Artificial Sequence
  Synthetic oligonucleotide
gtccaatcccgccacacctggccaacccttcgta

SEQ ID NO: 36739 - DNA, 35 bp, Artificial Sequence
  Synthetic oligonucleotide
tttgcaccgtacaagttttaatgcgtcgcaccccc

SEQ ID NO: 36740 - DNA, 35 bp, Artificial Sequence
  Synthetic oligonucleotide
gtctatggcaaacctccttaacgaactgttccatc

SEQ ID NO: 36741 - DNA, 35 bp, Artificial Sequence
  Synthetic oligonucleotide
ggtacgggtgaggaggagcggtatgggtcgcggag

SEQ ID NO: 36742 - DNA, 36 bp, Artificial Sequence
  Synthetic oligonucleotide
gtgtagaactccgccccatgcccctacgctacatag

SEQ ID NO: 36743 - DNA, 35 bp, Artificial Sequence
  Synthetic oligonucleotide
gtactccacgatcacgccaccacgcacgtagtacg

SEQ ID NO: 36744 - DNA, 35 bp, Artificial Sequence
  Synthetic oligonucleotide
gcacgcacaaccccgaccagaactcccctcactcg

SEQ ID NO: 36745 - DNA, 35 bp, Artificial Sequence
  Synthetic oligonucleotide
agtgaggtcgcgtaccccctgcaaactttggccct

SEQ ID NO: 36746 - DNA, 35 bp, Artificial Sequence
  Synthetic oligonucleotide
atccgcccttccggtatccgggcatgaaacacctt

SEQ ID NO: 36747 - DNA, 36 bp, Artificial Sequence
  Synthetic oligonucleotide
ttcgatgcgcgtgcacacggacgcccagacaacaca

SEQ ID NO: 36748 - DNA, 35 bp, Artificial Sequence
  Synthetic oligonucleotide
acctcgacatcgcctatcctccacgcccttgacca

SEQ ID NO: 36749 - DNA, 36 bp, Artificial Sequence
  Synthetic oligonucleotide
tgtttgtgcgggaagggagggtttgggcggtatcca

SEQ ID NO: 36750 - DNA, 36 bp, Artificial Sequence
  Synthetic oligonucleotide
ttgcgaacaatcacctgtatggtgtccacttattca

SEQ ID NO: 36751 - DNA, 36 bp, Artificial Sequence
  Synthetic oligonucleotide
tatcaagccacaatctgtacgcccaagctggtttca

SEQ ID NO: 36752 - DNA, 37 bp, Artificial Sequence
  Synthetic oligonucleotide
gcacgtgcgcatcttgtctcagcaccatctaccaaga

SEQ ID NO: 36753 - DNA, 37 bp, Artificial Sequence
  Synthetic oligonucleotide
tagaacccggacgtgatccctttaccgccccgcccga

SEQ ID NO: 36754 - DNA, 35 bp, Artificial Sequence
  Synthetic oligonucleotide
gtcccacctggattcacgctgttccaatgcttcga

SEQ ID NO: 36755 - DNA, 36 bp, Artificial Sequence
  Synthetic oligonucleotide
tagacgtgagcgcgttggggtagggcgttgggggga

SEQ ID NO: 36756 - DNA, 37 bp, Artificial Sequence
  Synthetic oligonucleotide
tgaacctaacagcatgcgccaccacccctccactgga

SEQ ID NO: 36757 - DNA, 38 bp, Artificial Sequence
  Synthetic oligonucleotide
gcccaacacacaggttaattaccgtcacttcaacatga

SEQ ID NO: 36758 - DNA, 38 bp, Artificial Sequence
  Synthetic oligonucleotide
gggtagggcctggagggtgggatgggaagaattgttga

SEQ ID NO: 36759 - DNA, 36 bp, Artificial Sequence
  Synthetic oligonucleotide
gcagtaggaagaggaaacgacaaacacgaggaaata

SEQ ID NO: 36760 - DNA, 35 bp, Artificial Sequence
  Synthetic oligonucleotide
accatgccggtgaaacgtttggcccccacacaacc

SEQ ID NO: 36761 - DNA, 35 bp, Artificial Sequence
  Synthetic oligonucleotide
agccacagcaatcgggttagtgagtgctgcctacc

SEQ ID NO: 36762 - DNA, 35 bp, Artificial Sequence
  Synthetic oligonucleotide
gcccatctctagggcactttcttgtcccgccaccc

SEQ ID NO: 36763 - DNA, 35 bp, Artificial Sequence
  Synthetic oligonucleotide
gcgacaactctgcttccggccttctcttgttcccc

SEQ ID NO: 36764 - DNA, 35 bp, Artificial Sequence
  Synthetic oligonucleotide
gacaaccgacttggaacgtcctgatcacctcattc

SEQ ID NO: 36765 - DNA, 35 bp, Artificial Sequence
  Synthetic oligonucleotide
accacgggcgaggagtggaatagtagggtacgatg

SEQ ID NO: 36766 - DNA, 35 bp, Artificial Sequence
  Synthetic oligonucleotide
ttagggacggcgccgggggagagggaagggttttg

SEQ ID NO: 36767 - DNA, 35 bp, Artificial Sequence
  Synthetic oligonucleotide
taagctcagccctcagttgccgtcctgttgatcgt

SEQ ID NO: 36768 - DNA, 35 bp, Artificial Sequence
  Synthetic oligonucleotide
tctcgccccgaccacctaccattgccttaggaaaa

SEQ ID NO: 36769 - DNA, 34 bp, Artificial Sequence
  Synthetic oligonucleotide
atgatacgccgacgtctcgcccgaaaacctgaaa

SEQ ID NO: 36770 - DNA, 36 bp, Artificial Sequence
  Synthetic oligonucleotide
agcacacaatggatcacctgttcgacccttctgcaa

SEQ ID NO: 36771 - DNA, 36 bp, Artificial Sequence
  Synthetic oligonucleotide
gctgagccttggtgacccacaatagccttgtactaa

SEQ ID NO: 36772 - DNA, 35 bp, Artificial Sequence
  Synthetic oligonucleotide
aacgggcgtgggtttggagggctaaatgggagtaa

SEQ ID NO: 36773 - DNA, 36 bp, Artificial Sequence
  Synthetic oligonucleotide
ggatcactactgagccggctatcagctccccaccca

SEQ ID NO: 36774 - DNA, 36 bp, Artificial Sequence
  Synthetic oligonucleotide
gatctcaggattgatatgatcccgctactcacgcca

SEQ ID NO: 36775 - DNA, 35 bp, Artificial Sequence
  Synthetic oligonucleotide
ccccaacccctaactgagccgacccctacatggca

SEQ ID NO: 36776 - DNA, 36 bp, Artificial Sequence
  Synthetic oligonucleotide
tagtctgttccggttcccgtttggccctacctctca

SEQ ID NO: 36777 - DNA, 37 bp, Artificial Sequence
  Synthetic oligonucleotide
aaccccgtatcgcaacgccccgtcgccctcccaacga

SEQ ID NO: 36778 - DNA, 36 bp, Artificial Sequence
  Synthetic oligonucleotide
tcacgcctctccgacccctttcggactcgtatccga

SEQ ID NO: 36779 - DNA, 37 bp, Artificial Sequence
  Synthetic oligonucleotide
gcaccaagcgccctggttttctcctgtcagttagcga

SEQ ID NO: 36780 - DNA, 31 bp, Artificial Sequence
  Synthetic oligonucleotide
gccgaccctgtcacccacattctgtccgcga

SEQ ID NO: 36781 - DNA, 37 bp, Artificial Sequence
  Synthetic oligonucleotide
gccggagagatcggcgggttggagggaggtggcagga

SEQ ID NO: 36782 - DNA, 37 bp, Artificial Sequence
  Synthetic oligonucleotide
aaaccatcgcagagttgctcttctcgttacccttgga

SEQ ID NO: 36783 - DNA, 38 bp, Artificial Sequence
  Synthetic oligonucleotide
acagaggaggaaagctgactagaggagggtagagctga

SEQ ID NO: 36784 - DNA, 38 bp, Artificial Sequence
  Synthetic oligonucleotide
atgcacgcacgcgtttcttgttgaacctcaatcgctga

SEQ ID NO: 36785 - DNA, 38 bp, Artificial Sequence
  Synthetic oligonucleotide
aatcagggggaggggggcataagcaaaagtgcgtctga

SEQ ID NO: 36786 - DNA, 36 bp, Artificial Sequence
  Synthetic oligonucleotide
gtccacccatttccggttacgtcacaaccccggtga

SEQ ID NO: 36787 - DNA, 38 bp, Artificial Sequence
  Synthetic oligonucleotide
taagtgggcggaaggggggacgcgctagtgctggttga

SEQ ID NO: 36788 - DNA, 37 bp, Artificial Sequence
  Synthetic oligonucleotide
tttaggcgtaggccgccgctccttggtcccctgttga

SEQ ID NO: 36789 - DNA, 36 bp, Artificial Sequence
  Synthetic oligonucleotide
aataccgcagcatatagcgcaagggggggggtacta

SEQ ID NO: 36790 - DNA, 35 bp, Artificial Sequence
  Synthetic oligonucleotide
gcgttgtcggaaacacgagtccttgtccgcctccc

SEQ ID NO: 36791 - DNA, 35 bp, Artificial Sequence
  Synthetic oligonucleotide
ataccccccgagacttgagctgtttggcaacttcc

SEQ ID NO: 36792 - DNA, 35 bp, Artificial Sequence
  Synthetic oligonucleotide
atagcgaacattccgctctgcccacgaccctatgc

SEQ ID NO: 36793 - DNA, 35 bp, Artificial Sequence
  Synthetic oligonucleotide
tcgagaccacgttacggaccgcgccccctatctgc

SEQ ID NO: 36794 - DNA, 35 bp, Artificial Sequence
  Synthetic oligonucleotide
acccgctccatccgtccaattccagacaacgtgag

SEQ ID NO: 36795 - DNA, 35 bp, Artificial Sequence
  Synthetic oligonucleotide
tttgaatggtgctcttacccctcccccctgaaggg

SEQ ID NO: 36796 - DNA, 35 bp, Artificial Sequence
  Synthetic oligonucleotide
ttcgtaacggagtagggggtgaggtgcggggctgg

SEQ ID NO: 36797 - DNA, 35 bp, Artificial Sequence
  Synthetic oligonucleotide
atcatctactgtcacagtcctgcagaaccctacct

SEQ ID NO: 36798 - DNA, 35 bp, Artificial Sequence
  Synthetic oligonucleotide
tcatcagcccgtgttgcatcttgggcgaaatccct

SEQ ID NO: 36799 - DNA, 35 bp, Artificial Sequence
  Synthetic oligonucleotide
tagttcgcccgtatacccgaagacccctggagttt

SEQ ID NO: 36800 - DNA, 36 bp, Artificial Sequence
  Synthetic oligonucleotide
ataacagggggggtgtgtttcacgggtcgggtgaaa

SEQ ID NO: 36801 - DNA, 35 bp, Artificial Sequence
  Synthetic oligonucleotide
attgtccgccccatcgtttcgtttcggtcttacaa

SEQ ID NO: 36802 - DNA, 36 bp, Artificial Sequence
  Synthetic oligonucleotide
agtgacatgaggccggtgtggtcagggggaagttaa

SEQ ID NO: 36803 - DNA, 35 bp, Artificial Sequence
  Synthetic oligonucleotide
ttgatcgccgagtgttcttctccttacggcccaca

SEQ ID NO: 36804 - DNA, 36 bp, Artificial Sequence
  Synthetic oligonucleotide
acatcttcacccggcgccacaagcacaaccaagcca

SEQ ID NO: 36805 - DNA, 35 bp, Artificial Sequence
  Synthetic oligonucleotide
tacgaacacacccgtacgcgcacatccgtgtgcca

SEQ ID NO: 36806 - DNA, 36 bp, Artificial Sequence
  Synthetic oligonucleotide
atctgaccatcgaaggtcgttacaacacacctctca

SEQ ID NO: 36807 - DNA, 37 bp, Artificial Sequence
  Synthetic oligonucleotide
acgcacgccgtaaccactttgaggccatcctgataga

SEQ ID NO: 36808 - DNA, 37 bp, Artificial Sequence
  Synthetic oligonucleotide
ggggggacgggggtgaaagaagctgatgagcggggga

SEQ ID NO: 36809 - DNA, 37 bp, Artificial Sequence
  Synthetic oligonucleotide
tcgtgcaaactccccctgtcttccctaggcatctgga

SEQ ID NO: 36810 - DNA, 36 bp, Artificial Sequence
  Synthetic oligonucleotide
gacatagcccgtgcttcgagtacctcttttattgga

SEQ ID NO: 36811 - DNA, 38 bp, Artificial Sequence
  Synthetic oligonucleotide
gccacatccacgaaatgtgcctcgactcttttgcctga

SEQ ID NO: 36812 - DNA, 38 bp, Artificial Sequence
  Synthetic oligonucleotide
actccctcgtacccacattaaaagctgttgcatcctga

SEQ ID NO: 36813 - DNA, 38 bp, Artificial Sequence
  Synthetic oligonucleotide
gggtggttaggtgagaggagggagggggcaggtcctga

SEQ ID NO: 36814 - DNA, 38 bp, Artificial Sequence
  Synthetic oligonucleotide
gccaagagcccgttgtacacccgccttacctttgttga

SEQ ID NO: 36815 - DNA, 37 bp, Artificial Sequence
  Synthetic oligonucleotide
acctccatgccgtcaagtgaggaagcccctcatttga

SEQ ID NO: 36816 - DNA, 36 bp, Artificial Sequence
  Synthetic oligonucleotide
gtcataaccgctcccccatgctacaaaggagcaata

SEQ ID NO: 36817 - DNA, 35 bp, Artificial Sequence
  Synthetic oligonucleotide
cacacgcctgtaatgctgcccctccttctccgata

SEQ ID NO: 36818 - DNA, 35 bp, Artificial Sequence
  Synthetic oligonucleotide
gccacgggaactgtgggatagatggggggcttata

SEQ ID NO: 36819 - DNA, 36 bp, Artificial Sequence
  Synthetic oligonucleotide
aactcccaacctctggtgccactaatccgggtccta

SEQ ID NO: 36820 - DNA, 36 bp, Artificial Sequence
  Synthetic oligonucleotide
gtagcacacgatgtctcgccctagtcattctcgcta

SEQ ID NO: 36821 - DNA, 36 bp, Artificial Sequence
  Synthetic oligonucleotide
gtctcgccaccggactaaagtaacttcctacacgta

SEQ ID NO: 36822 - DNA, 36 bp, Artificial Sequence
  Synthetic oligonucleotide
ttagacgcgtattggtttcgtttttttcgcctcgta

SEQ ID NO: 36823 - DNA, 35 bp, Artificial Sequence
  Synthetic oligonucleotide
ggacccgttctcccgccatccaaatcgtccctgcc

SEQ ID NO: 36824 - DNA, 35 bp, Artificial Sequence
  Synthetic oligonucleotide
tagatccactatgcgtgtcatcttgtcttcgttcc

SEQ ID NO: 36825 - DNA, 35 bp, Artificial Sequence
  Synthetic oligonucleotide
ttacgacctggcctagtactcacttcctttgttgg

SEQ ID NO: 36826 - DNA, 35 bp, Artificial Sequence
  Synthetic oligonucleotide
aggaccacgccgcatcttcttcccccatcatttgg

SEQ ID NO: 36827 - DNA, 35 bp, Artificial Sequence
  Synthetic oligonucleotide
ttccgccacatcataaacttcaagcagccgggact

SEQ ID NO: 36828 - DNA, 35 bp, Artificial Sequence
  Synthetic oligonucleotide
ttgggccaggtattgggtccgttcgccattgttct

SEQ ID NO: 36829 - DNA, 35 bp, Artificial Sequence
  Synthetic oligonucleotide
acttccgatcgctctcctccctgttgagtcgtttt

SEQ ID NO: 36830 - DNA, 35 bp, Artificial Sequence
  Synthetic oligonucleotide
gcgcatcagtgtccgttgccttttttgctctacca

SEQ ID NO: 36831 - DNA, 36 bp, Artificial Sequence
  Synthetic oligonucleotide
acatcccctccggcgcctcgttttgacgttgtgcca

SEQ ID NO: 36832 - DNA, 35 bp, Artificial Sequence
  Synthetic oligonucleotide
agtctccgccctagctatcactataccgcactgca

SEQ ID NO: 36833 - DNA, 35 bp, Artificial Sequence
  Synthetic oligonucleotide
accactcgaattcacggacctggtctcaccactca

SEQ ID NO: 36834 - DNA, 36 bp, Artificial Sequence
  Synthetic oligonucleotide
tacctgttagccaccgtccaagtccgtaacctctca

SEQ ID NO: 36835 - DNA, 37 bp, Artificial Sequence
  Synthetic oligonucleotide
gtagacaagtgtggggaaataggggccggaggaaaga

SEQ ID NO: 36836 - DNA, 37 bp, Artificial Sequence
  Synthetic oligonucleotide
accatccgccttgctcttgccgcccttggagatagga

SEQ ID NO: 36837 - DNA, 36 bp, Artificial Sequence
  Synthetic oligonucleotide
gtcaacaacacgcgtgaactcaaactccccatgtga

SEQ ID NO: 36838 - DNA, 37 bp, Artificial Sequence
  Synthetic oligonucleotide
tgctcggtcggttgccgtgccattctcttttgtgtga

SEQ ID NO: 36839 - DNA, 36 bp, Artificial Sequence
  Synthetic oligonucleotide
gaaacgaacagccttctcctgcccatatgaccttga

SEQ ID NO: 36840 - DNA, 38 bp, Artificial Sequence
  Synthetic oligonucleotide
gatcactccttcctttgcagactgcacagaatccttga

SEQ ID NO: 36841 - DNA, 36 bp, Artificial Sequence
  Synthetic oligonucleotide
gcccagggcgcctgaagaatttcgctgcacttatta

SEQ ID NO: 36842 - DNA, 35 bp, Artificial Sequence
  Synthetic oligonucleotide
atgcccatcatgactccagcctgctgacccgtgac

SEQ ID NO: 36843 - DNA, 34 bp, Artificial Sequence
  Synthetic oligonucleotide
gcgaaacaaggctcgccccccacccaactcgtcc

SEQ ID NO: 36844 - DNA, 35 bp, Artificial Sequence
  Synthetic oligonucleotide
gatcacctatcccgttctggaaaactggctctggc

SEQ ID NO: 36845 - DNA, 35 bp, Artificial Sequence
  Synthetic oligonucleotide
tcccttatgcctcgccctcgacgttctatttatgc

SEQ ID NO: 36846 - DNA, 34 bp, Artificial Sequence
  Synthetic oligonucleotide
gattcacgataccccgttcatatagccttcgctc

SEQ ID NO: 36847 - DNA, 35 bp, Artificial Sequence
  Synthetic oligonucleotide
tccaggttccgccctatcgtacttcagtattggtc

SEQ ID NO: 36848 - DNA, 35 bp, Artificial Sequence
  Synthetic oligonucleotide
gtgctgccgtccaactgcggtcaactaatctattc

SEQ ID NO: 36849 - DNA, 35 bp, Artificial Sequence
  Synthetic oligonucleotide
ttagcccctgcaccaactttctagcccacatggag

SEQ ID NO: 36850 - DNA, 35 bp, Artificial Sequence
  Synthetic oligonucleotide
gacctgctgaccccatgcgctaacaaagtaacacg

SEQ ID NO: 36851 - DNA, 35 bp, Artificial Sequence
  Synthetic oligonucleotide
atcaagggtcgacaaagaatgaagggggcaaatgg

SEQ ID NO: 36852 - DNA, 35 bp, Artificial Sequence
  Synthetic oligonucleotide
ttacacatccggcacttgccgctaaataccccgtt

SEQ ID NO: 36853 - DNA, 35 bp, Artificial Sequence
  Synthetic oligonucleotide
tccacctggtcctcttggctttggcaccttgtaaa

SEQ ID NO: 36854 - DNA, 36 bp, Artificial Sequence
  Synthetic oligonucleotide
gctctgccaagcgctccatgccctcccaatccataa

SEQ ID NO: 36855 - DNA, 35 bp, Artificial Sequence
  Synthetic oligonucleotide
tacagtcaccaacaaggcactagaggagggggaca

SEQ ID NO: 36856 - DNA, 36 bp, Artificial Sequence
  Synthetic oligonucleotide
atcctgacgacaattcctacgccactgcgctgagca

SEQ ID NO: 36857 - DNA, 36 bp, Artificial Sequence
  Synthetic oligonucleotide
gtaacggggtcggaggttgggcgcaagggggggtca

SEQ ID NO: 36858 - DNA, 35 bp, Artificial Sequence
  Synthetic oligonucleotide
acctcgcgtaggcctaggtcacacgtttcacttca

SEQ ID NO: 36859 - DNA, 37 bp, Artificial Sequence
  Synthetic oligonucleotide
aacgatggggaggggggaaaacactgccgaagtgaga

SEQ ID NO: 36860 - DNA, 37 bp, Artificial Sequence
  Synthetic oligonucleotide
tgagaacatcgtcaagccctttatcgccatcccacga

SEQ ID NO: 36861 - DNA, 37 bp, Artificial Sequence
  Synthetic oligonucleotide
acacaccgtccaaatacgtgaaccatgttacttccga

SEQ ID NO: 36862 - DNA, 38 bp, Artificial Sequence
  Synthetic oligonucleotide
ggtgctctccgccgacaacactagatcgccttcttcga

SEQ ID NO: 36863 - DNA, 37 bp, Artificial Sequence
  Synthetic oligonucleotide
tgatggggggggcgcgtggtggggttcttgggttcga

SEQ ID NO: 36864 - DNA, 37 bp, Artificial Sequence
  Synthetic oligonucleotide
gtacgcaccctagctggaccatctttctgactacgga

SEQ ID NO: 36865 - DNA, 37 bp, Artificial Sequence
  Synthetic oligonucleotide
gcaagccgccagggcagggcgcggggaggggagggga

SEQ ID NO: 36866 - DNA, 37 bp, Artificial Sequence
  Synthetic oligonucleotide
ttctgcaccgcgcgggtgggacggggccaattgggga

SEQ ID NO: 36867 - DNA, 38 bp, Artificial Sequence
  Synthetic oligonucleotide
tacaagggcataatgtatgggggcgtgggggtttatga

SEQ ID NO: 36868 - DNA, 38 bp, Artificial Sequence
  Synthetic oligonucleotide
tagcccaacacatcggcttacaatacgtcccttactga

SEQ ID NO: 36869 - DNA, 38 bp, Artificial Sequence
  Synthetic oligonucleotide
acagacaatcgcgccaaaaccggtacccttccacctga

SEQ ID NO: 36870 - DNA, 38 bp, Artificial Sequence
  Synthetic oligonucleotide
taccccccgcgatgactgtcccccctgtctctacctga

SEQ ID NO: 36871 - DNA, 38 bp, Artificial Sequence
  Synthetic oligonucleotide
tcacccccggacatgcacctatgaccacagtcagctga

SEQ ID NO: 36872 - DNA, 35 bp, Artificial Sequence
  Synthetic oligonucleotide
tgtagtgcaccgcattcgttgtttctcttgtctga

SEQ ID NO: 36873 - DNA, 38 bp, Artificial Sequence
  Synthetic oligonucleotide
gtgacacccgtagtgatccttcctgtagtccttcgtga

SEQ ID NO: 36874 - DNA, 38 bp, Artificial Sequence
  Synthetic oligonucleotide
aaacaaaggggtggttgggctggaaagacaggtattga

SEQ ID NO: 36875 - DNA, 38 bp, Artificial Sequence
  Synthetic oligonucleotide
acgatcacacctctattcaactcttcagccaaacttga

SEQ ID NO: 36876 - DNA, 38 bp, Artificial Sequence
  Synthetic oligonucleotide
gacgtattgggtgggagggaacacaagacgggtcttga

SEQ ID NO: 36877 - DNA, 38 bp, Artificial Sequence
  Synthetic oligonucleotide
atcgtgcctgagtgctgacttcctttcccggcttttga

SEQ ID NO: 36878 - DNA, 36 bp, Artificial Sequence
  Synthetic oligonucleotide
tcctgttcgctatgttcaactcatcccacccaggta

SEQ ID NO: 36879 - DNA, 35 bp, Artificial Sequence
  Synthetic oligonucleotide
ttgcacacaagaggaaaaaaacaaaaccggccaac

SEQ ID NO: 36880 - DNA, 35 bp, Artificial Sequence
  Synthetic oligonucleotide
tcgccctcctcccccaactgttgacgtaatattcc

SEQ ID NO: 36881 - DNA, 35 bp, Artificial Sequence
  Synthetic oligonucleotide
gacgcatccgacacgtagtatgctcgcgaactttc

SEQ ID NO: 36882 - DNA, 35 bp, Artificial Sequence
  Synthetic oligonucleotide
tcgtgatctgttccgcacctactgggattgcttct

SEQ ID NO: 36883 - DNA, 35 bp, Artificial Sequence
  Synthetic oligonucleotide
atgacacagtgcactccaattatacgcgcctactt

SEQ ID NO: 36884 - DNA, 35 bp, Artificial Sequence
  Synthetic oligonucleotide
aacaccacttcagcgttgtatccgtattccatgtt

SEQ ID NO: 36885 - DNA, 36 bp, Artificial Sequence
  Synthetic oligonucleotide
atcccatgccgggaggctggtaaaccgtgacataca

SEQ ID NO: 36886 - DNA, 35 bp, Artificial Sequence
  Synthetic oligonucleotide
gtaacgcatcacgacccgatctaaacatcttgcca

SEQ ID NO: 36887 - DNA, 36 bp, Artificial Sequence
  Synthetic oligonucleotide
acgcacctgatctgctcccattagcccacagtggca

SEQ ID NO: 36888 - DNA, 37 bp, Artificial Sequence
  Synthetic oligonucleotide
accccctgccttacccccctttagtgtcaacttgaga

SEQ ID NO: 36889 - DNA, 37 bp, Artificial Sequence
  Synthetic oligonucleotide
gacgccgtacgccgccacctcctggatctataaacga

SEQ ID NO: 36890 - DNA, 37 bp, Artificial Sequence
  Synthetic oligonucleotide
aaccgagggagggagcagggtgaaaggggatccagga

SEQ ID NO: 36891 - DNA, 37 bp, Artificial Sequence
  Synthetic oligonucleotide
gaacacccgtatctcgcctcatctacgcccatgcgga

SEQ ID NO: 36892 - DNA, 37 bp, Artificial Sequence
  Synthetic oligonucleotide
tccaacctcccgctactctgccagtacgccttaggga

SEQ ID NO: 36893 - DNA, 38 bp, Artificial Sequence
  Synthetic oligonucleotide
gcgggggtcctagtgagttgggtgggagggttcaatga

SEQ ID NO: 36894 - DNA, 37 bp, Artificial Sequence
  Synthetic oligonucleotide
attacccgttacgccctgaacaagaccctcctaatga

SEQ ID NO: 36895 - DNA, 38 bp, Artificial Sequence
  Synthetic oligonucleotide
gctccgagtccaacgatcgatacctgcatactccctga

SEQ ID NO: 36896 - DNA, 37 bp, Artificial Sequence
  Synthetic oligonucleotide
tgtagctcaggcctgacgttaatctcctctcttctga

SEQ ID NO: 36897 - DNA, 38 bp, Artificial Sequence
  Synthetic oligonucleotide
tgaaaggacacaggtgaagagcagggaagtaggtgtga

SEQ ID NO: 36898 - DNA, 37 bp, Artificial Sequence
  Synthetic oligonucleotide
taggacgtacccactttcttagaacctgctccattga

SEQ ID NO: 36899 - DNA, 38 bp, Artificial Sequence
  Synthetic oligonucleotide
acacaacgtgcgtcgtctctttaatcccccgcccttga

SEQ ID NO: 36900 - DNA, 38 bp, Artificial Sequence
  Synthetic oligonucleotide
accaccctatcaagccggctcgccactcaggcccttga

SEQ ID NO: 36901 - DNA, 36 bp, Artificial Sequence
  Synthetic oligonucleotide
gtgaagacgaccaatttgccatggatcaaccacata

SEQ ID NO: 36902 - DNA, 36 bp, Artificial Sequence
  Synthetic oligonucleotide
tctccacactcaatccctcgttaggctggctaccta

SEQ ID NO: 36903 - DNA, 36 bp, Artificial Sequence
  Synthetic oligonucleotide
acacctcaactagttcgtgatcgtcgtcgatcccta

SEQ ID NO: 36904 - DNA, 35 bp, Artificial Sequence
  Synthetic oligonucleotide
ttcacccgactttgtagtccgaattacggttatac

SEQ ID NO: 36905 - DNA, 35 bp, Artificial Sequence
  Synthetic oligonucleotide
tcaggccaccttaatcgttgcacaggcttcgtacc

SEQ ID NO: 36906 - DNA, 35 bp, Artificial Sequence
  Synthetic oligonucleotide
tacacggtggtttcacgccacattaacaccttacc

SEQ ID NO: 36907 - DNA, 35 bp, Artificial Sequence
  Synthetic oligonucleotide
agtccccgcggccgccaaatacaaggctcatcccc

SEQ ID NO: 36908 - DNA, 35 bp, Artificial Sequence
  Synthetic oligonucleotide
ttggaacaagctcccatatacacctgagttacgcc

SEQ ID NO: 36909 - DNA, 35 bp, Artificial Sequence
  Synthetic oligonucleotide
tccatgtgggcgcacgtatgcactcgttttccagc

SEQ ID NO: 36910 - DNA, 35 bp, Artificial Sequence
  Synthetic oligonucleotide
tagtgggtccctcctgaatgtacagcctgtttgtc

SEQ ID NO: 36911 - DNA, 35 bp, Artificial Sequence
  Synthetic oligonucleotide
gtaagcccccctgctaaaatggtccatgtgccttc

SEQ ID NO: 36912 - DNA, 35 bp, Artificial Sequence
  Synthetic oligonucleotide
tccaccgtcgcgcgacccttccatctcgatgccag

SEQ ID NO: 36913 - DNA, 35 bp, Artificial Sequence
  Synthetic oligonucleotide
taatcgagcaccttccctgactctgcaccaggccg

SEQ ID NO: 36914 - DNA, 35 bp, Artificial Sequence
  Synthetic oligonucleotide
tcgaccatgccatgcttcaagcttactttactctg

SEQ ID NO: 36915 - DNA, 35 bp, Artificial Sequence
  Synthetic oligonucleotide
gtatagtgcggtagggggcctgaggaggggcgttg

SEQ ID NO: 36916 - DNA, 35 bp, Artificial Sequence
  Synthetic oligonucleotide
gacaggtgctcctacaaattctgtccgtttctgct

SEQ ID NO: 36917 - DNA, 35 bp, Artificial Sequence
  Synthetic oligonucleotide
gactgctcgggggaacaggaatgggtggttgaagt

SEQ ID NO: 36918 - DNA, 35 bp, Artificial Sequence
  Synthetic oligonucleotide
gtctagtgctcatcctgtccgcccactcgttatgt

SEQ ID NO: 36919 - DNA, 35 bp, Artificial Sequence
  Synthetic oligonucleotide
tcaaaccaacgcagcttcgtcttgacttccttgtt

SEQ ID NO: 36920 - DNA, 35 bp, Artificial Sequence
  Synthetic oligonucleotide
tccatcgcccccgccgcctggtataccgttcattt

SEQ ID NO: 36921 - DNA, 35 bp, Artificial Sequence
  Synthetic oligonucleotide
gcgaatgtcacgactatctgccataatctgccttt

SEQ ID NO: 36922 - DNA, 36 bp, Artificial Sequence
  Synthetic oligonucleotide
tgtgcccggacccccatacctgggccgacctcccaa

SEQ ID NO: 36923 - DNA, 35 bp, Artificial Sequence
  Synthetic oligonucleotide
acatacacccccgccgagtcgcgtatgcgttcaca

SEQ ID NO: 36924 - DNA, 36 bp, Artificial Sequence
  Synthetic oligonucleotide
tctctccgcctccatgaatcatgggtacactgttca

SEQ ID NO: 36925 - DNA, 35 bp, Artificial Sequence
  Synthetic oligonucleotide
gcgatcacatccaccggtcactcgccattactaga

SEQ ID NO: 36926 - DNA, 37 bp, Artificial Sequence
  Synthetic oligonucleotide
ggagtcgtccaacctgcccctgagcccgtatcttcga

SEQ ID NO: 36927 - DNA, 37 bp, Artificial Sequence
  Synthetic oligonucleotide
gagaagggggtcacgggtggggggtagagggcgtgga

SEQ ID NO: 36928 - DNA, 38 bp, Artificial Sequence
  Synthetic oligonucleotide
gacctgcctatgcaatgctccactcagactcatcctga

SEQ ID NO: 36929 - DNA, 38 bp, Artificial Sequence
  Synthetic oligonucleotide
gaaatggagcgtgagaaggaaggccggctgagtggtga

SEQ ID NO: 36930 - DNA, 37 bp, Artificial Sequence
  Synthetic oligonucleotide
gatacctcctgctccgtcttagcgcccatctagttga

SEQ ID NO: 36931 - DNA, 37 bp, Artificial Sequence
  Synthetic oligonucleotide
gaacccctcgccccctagtacagccccggaaggttga

SEQ ID NO: 36932 - DNA, 35 bp, Artificial Sequence
  Synthetic oligonucleotide
taatcgtaccggcaactaatcccacctgctgcata

SEQ ID NO: 36933 - DNA, 36 bp, Artificial Sequence
  Synthetic oligonucleotide
tcagagcaagctgtcccacgctacgataacccttta

SEQ ID NO: 36934 - DNA, 35 bp, Artificial Sequence
  Synthetic oligonucleotide
gctctcgccacgaactttctaacctaagccgtacc

SEQ ID NO: 36935 - DNA, 35 bp, Artificial Sequence
  Synthetic oligonucleotide
tgactcctcgccgactcttgtagtgggctctcccc

SEQ ID NO: 36936 - DNA, 35 bp, Artificial Sequence
  Synthetic oligonucleotide
tgtgcttgtgcggttatatttttgcctcctagtcc

SEQ ID NO: 36937 - DNA, 35 bp, Artificial Sequence
  Synthetic oligonucleotide
gttggtcaaactgtgtacctactctattcctcgtc

SEQ ID NO: 36938 - DNA, 35 bp, Artificial Sequence
  Synthetic oligonucleotide
accccggactggacaatgctcacaataattcccct

SEQ ID NO: 36939 - DNA, 35 bp, Artificial Sequence
  Synthetic oligonucleotide
gttaggcccctcctttctcctttatgggtcactct

SEQ ID NO: 36940 - DNA, 35 bp, Artificial Sequence
  Synthetic oligonucleotide
agcaggcctgtcccccactccgagtccttagttct

SEQ ID NO: 36941 - DNA, 35 bp, Artificial Sequence
  Synthetic oligonucleotide
gcctttacgccggtatctaaagctcactacccctt

SEQ ID NO: 36942 - DNA, 35 bp, Artificial Sequence
  Synthetic oligonucleotide
tgccacgtccgacggtaattttccccaccacagtt

SEQ ID NO: 36943 - DNA, 35 bp, Artificial Sequence
  Synthetic oligonucleotide
gatgggcctgcagtgccaagttcgcgactttcgtt

SEQ ID NO: 36944 - DNA, 36 bp, Artificial Sequence
  Synthetic oligonucleotide
atcgcgccccgtattctgtcctggttcgtgtctcaa

SEQ ID NO: 36945 - DNA, 36 bp, Artificial Sequence
  Synthetic oligonucleotide
ggaggaggagggggaagtaggtaagttctgtttcaa

SEQ ID NO: 36946 - DNA, 37 bp, Artificial Sequence
  Synthetic oligonucleotide
ttgtgcgcgcacaccttttcgcatagcctggatccga

SEQ ID NO: 36947 - DNA, 36 bp, Artificial Sequence
  Synthetic oligonucleotide
atgtagaggggattggtcggggacgtacatgcagga

SEQ ID NO: 36948 - DNA, 37 bp, Artificial Sequence
  Synthetic oligonucleotide
atgggtgggccgtgtcgattcccgacaatgggcggga

SEQ ID NO: 36949 - DNA, 37 bp, Artificial Sequence
  Synthetic oligonucleotide
gaacgggccgcggaaaaaggaaggggattcgggggga

SEQ ID NO: 36950 - DNA, 37 bp, Artificial Sequence
  Synthetic oligonucleotide
tagcacctccatcgctggatccttgacgattacctga

SEQ ID NO: 36951 - DNA, 38 bp, Artificial Sequence
  Synthetic oligonucleotide
tctgagctgagactgcgcatcaccgtaccctggcctga

SEQ ID NO: 36952 - DNA, 38 bp, Artificial Sequence
  Synthetic oligonucleotide
gccgtgcgccctcggtttcgggcccatcattttgctga

SEQ ID NO: 36953 - DNA, 37 bp, Artificial Sequence
  Synthetic oligonucleotide
atgcgagcaggagggagcggaattgatgacggtttga

SEQ ID NO: 36954 - DNA, 36 bp, Artificial Sequence
  Synthetic oligonucleotide
ttggaactgacccatctgttttacatatcgaactta

SEQ ID NO: 36955 - DNA, 35 bp, Artificial Sequence
  Synthetic oligonucleotide
gcacccaattcacgcctgcgcaaacaactcttcac

SEQ ID NO: 36956 - DNA, 35 bp, Artificial Sequence
  Synthetic oligonucleotide
gccaaaagcgcgacacctgaactacctggcgcacc

SEQ ID NO: 36957 - DNA, 35 bp, Artificial Sequence
  Synthetic oligonucleotide
gcctggtcaacagctgggccggaagcacctactcc

SEQ ID NO: 36958 - DNA, 35 bp, Artificial Sequence
  Synthetic oligonucleotide
tgtgctcggagcttcttgcaatatatcccctccgc

SEQ ID NO: 36959 - DNA, 35 bp, Artificial Sequence
  Synthetic oligonucleotide
gccccacgcagccgtgtggccctacgctccatgtc

SEQ ID NO: 36960 - DNA, 35 bp, Artificial Sequence
  Synthetic oligonucleotide
gatctgcgcgtcccagccgcaaccccaataccctg

SEQ ID NO: 36961 - DNA, 35 bp, Artificial Sequence
  Synthetic oligonucleotide
tctccatgtgccgtactcaaggcccccgcccaact

SEQ ID NO: 36962 - DNA, 35 bp, Artificial Sequence
  Synthetic oligonucleotide
tccccttgtcaactgaagccgaacgaccgcctcct

SEQ ID NO: 36963 - DNA, 35 bp, Artificial Sequence
  Synthetic oligonucleotide
acgaccaacccgaatgaacctcacgaccctcagct

SEQ ID NO: 36964 - DNA, 36 bp, Artificial Sequence
  Synthetic oligonucleotide
tccgctctttgtcgtgtcctcccctggtttcatcaa

SEQ ID NO: 36965 - DNA, 36 bp, Artificial Sequence
  Synthetic oligonucleotide
atgccctaacgaacgtgtcggtcttcctttatcaca

SEQ ID NO: 36966 - DNA, 36 bp, Artificial Sequence
  Synthetic oligonucleotide
gccccctcgcgacccccccaaacggcttagttgaca

SEQ ID NO: 36967 - DNA, 28 bp, Artificial Sequence
  Synthetic oligonucleotide
agatacatagcctagctcgcccctgcca

SEQ ID NO: 36968 - DNA, 35 bp, Artificial Sequence
  Synthetic oligonucleotide
gacaaccggtggggcttacacactctgccattcca

SEQ ID NO: 36969 - DNA, 36 bp, Artificial Sequence
  Synthetic oligonucleotide
cacgcgtacgaccccacgcgtaacaatggtatctca

SEQ ID NO: 36970 - DNA, 37 bp, Artificial Sequence
  Synthetic oligonucleotide
tccaccttccacacttcctcgctggtataactacaga

SEQ ID NO: 36971 - DNA, 37 bp, Artificial Sequence
  Synthetic oligonucleotide
agcgcctcacgacgtttgcttctccttcctggtacga

SEQ ID NO: 36972 - DNA, 37 bp, Artificial Sequence
  Synthetic oligonucleotide
gaatgcaagtggaaatgggacgaaaaactggcaagga

SEQ ID NO: 36973 - DNA, 37 bp, Artificial Sequence
  Synthetic oligonucleotide
gccttgctccaaacctgtttatacttcgctcttggga

SEQ ID NO: 36974 - DNA, 37 bp, Artificial Sequence
  Synthetic oligonucleotide
gaggccgctttcgtctccggcacacacacacccatga

SEQ ID NO: 36975 - DNA, 38 bp, Artificial Sequence
  Synthetic oligonucleotide
actgctccgtaggaccaccttcgccatgccccgagtga

SEQ ID NO: 36976 - DNA, 37 bp, Artificial Sequence
  Synthetic oligonucleotide
gaagagatgagagctggataatttgggcggagggtga

SEQ ID NO: 36977 - DNA, 38 bp, Artificial Sequence
  Synthetic oligonucleotide
gcacccccgcagaccgtacatttctttctccagtgtga

SEQ ID NO: 36978 - DNA, 38 bp, Artificial Sequence
  Synthetic oligonucleotide
gcacatatgagctaggggataggagggaaggcacttga

SEQ ID NO: 36979 - DNA, 38 bp, Artificial Sequence
  Synthetic oligonucleotide
tccacccccattgctccaaattgttccaccccggttga

SEQ ID NO: 36980 - DNA, 36 bp, Artificial Sequence
  Synthetic oligonucleotide
gaaccgatctcccgcacctctacatgcggtcgccta

SEQ ID NO: 36981 - DNA, 36 bp, Artificial Sequence
  Synthetic oligonucleotide
ataccacacgggcccttgaatactgttgaactccta

SEQ ID NO: 36982 - DNA, 36 bp, Artificial Sequence
  Synthetic oligonucleotide
attcacactgcctcatctgatttttgccgcggggta

SEQ ID NO: 36983 - DNA, 36 bp, Artificial Sequence
  Synthetic oligonucleotide
gtgtcaccacgatctcctgtgtccattatagcatta

SEQ ID NO: 36984 - DNA, 35 bp, Artificial Sequence
  Synthetic oligonucleotide
atctaccaactcgataggggtttcatcaacactac

SEQ ID NO: 36985 - DNA, 35 bp, Artificial Sequence
  Synthetic oligonucleotide
gcatctcggcgtggcctaagcctgccatccaaacc

SEQ ID NO: 36986 - DNA, 35 bp, Artificial Sequence
  Synthetic oligonucleotide
tagacgcatcggccccagctcgcacacccaggacc

SEQ ID NO: 36987 - DNA, 35 bp, Artificial Sequence
  Synthetic oligonucleotide
aacgccgtcaatatcctcgtctctcacacataccc

SEQ ID NO: 36988 - DNA, 35 bp, Artificial Sequence
  Synthetic oligonucleotide
gcgttacctctcagctgcccatcttgtgcattccc

SEQ ID NO: 36989 - DNA, 35 bp, Artificial Sequence
  Synthetic oligonucleotide
gaatcgccgaactgtgcagtgattcctgtcctgcc

SEQ ID NO: 36990 - DNA, 35 bp, Artificial Sequence
  Synthetic oligonucleotide
gggtaagataaagggggctgataaaggggacgggg

SEQ ID NO: 36991 - DNA, 35 bp, Artificial Sequence
  Synthetic oligonucleotide
agcacagtcgccgaattcaagttaccccgcaccat

SEQ ID NO: 36992 - DNA, 35 bp, Artificial Sequence
  Synthetic oligonucleotide
tgccgccttcggccatactgcattgactttactat

SEQ ID NO: 36993 - DNA, 35 bp, Artificial Sequence
  Synthetic oligonucleotide
gcccacacgacaaggaaaaattcccggcccaccct

SEQ ID NO: 36994 - DNA, 35 bp, Artificial Sequence
  Synthetic oligonucleotide
gggttgcacgccatccctctgcttacgtaacgcct

SEQ ID NO: 36995 - DNA, 34 bp, Artificial Sequence
  Synthetic oligonucleotide
atgtccccaggcgcgggtatctcacttcattgtt

SEQ ID NO: 36996 - DNA, 35 bp, Artificial Sequence
  Synthetic oligonucleotide
ttcacgaaacagcaacgggtctgtttctattattt

SEQ ID NO: 36997 - DNA, 36 bp, Artificial Sequence
  Synthetic oligonucleotide
aaccacacccccatacacactcgcccaggtcgtgaa

SEQ ID NO: 36998 - DNA, 36 bp, Artificial Sequence
  Synthetic oligonucleotide
gcgcgaccgaattaaggtcggcacattacaccaaca

SEQ ID NO: 36999 - DNA, 36 bp, Artificial Sequence
  Synthetic oligonucleotide
gcattgcagcctgtagcaccctaatcatagcctaca

SEQ ID NO: 37000 - DNA, 35 bp, Artificial Sequence
  Synthetic oligonucleotide
tcccgtgtgcctgcctttccgctccccaagaggca

SEQ ID NO: 37001 - DNA, 35 bp, Artificial Sequence
  Synthetic oligonucleotide
actgaccttgccgtaacaggttttctatcacatca

SEQ ID NO: 37002 - DNA, 37 bp, Artificial Sequence
  Synthetic oligonucleotide
gtcgccactacaacgcggtgaagtcacctactaccga

SEQ ID NO: 37003 - DNA, 37 bp, Artificial Sequence
  Synthetic oligonucleotide
ggtcgaaggggccaccggtggtaaactgaaagaggga

SEQ ID NO: 37004 - DNA, 35 bp, Artificial Sequence
  Synthetic oligonucleotide
ataccgacaccaccgcaacaacctgggatgaatga

SEQ ID NO: 37005 - DNA, 38 bp, Artificial Sequence
  Synthetic oligonucleotide
gaaagagacgagagaagttgggggtaggcgtaagatga

SEQ ID NO: 37006 - DNA, 37 bp, Artificial Sequence
  Synthetic oligonucleotide
tccgccaccacctcagctcaaaaatctgcatttatga

SEQ ID NO: 37007 - DNA, 37 bp, Artificial Sequence
  Synthetic oligonucleotide
ttgccacaagcggattggtctcatgccctccttttga

SEQ ID NO: 37008 - DNA, 36 bp, Artificial Sequence
  Synthetic oligonucleotide
tataggctgagataaatggggaaatgggtggaggta

SEQ ID NO: 37009 - DNA, 36 bp, Artificial Sequence
  Synthetic oligonucleotide
acggaccatcacagccccgcattcatcccaccggta

SEQ ID NO: 37010 - DNA, 36 bp, Artificial Sequence
  Synthetic oligonucleotide
accaacgccatcgaggccggcggaggttttcactta

SEQ ID NO: 37011 - DNA, 34 bp, Artificial Sequence
  Synthetic oligonucleotide
gttgactgtcgccccccccctcgattgtagagcc

SEQ ID NO: 37012 - DNA, 35 bp, Artificial Sequence
  Synthetic oligonucleotide
acctgccactcccccgagttcccactggtgtacgc

SEQ ID NO: 37013 - DNA, 35 bp, Artificial Sequence
  Synthetic oligonucleotide
acccatccctcccacgcttcacctagaaagtaggc

SEQ ID NO: 37014 - DNA, 35 bp, Artificial Sequence
  Synthetic oligonucleotide
ttgacaggatgtgcagtctaattcctcccatatgc

SEQ ID NO: 37015 - DNA, 35 bp, Artificial Sequence
  Synthetic oligonucleotide
actgactcactatttggttatactcttcgaacctc

SEQ ID NO: 37016 - DNA, 35 bp, Artificial Sequence
  Synthetic oligonucleotide
aaaacaccgctggtggtccatttattcacctggtc

SEQ ID NO: 37017 - DNA, 35 bp, Artificial Sequence
  Synthetic oligonucleotide
gtaacctgacgtgcgttcgagtttcacgcttattc

SEQ ID NO: 37018 - DNA, 35 bp, Artificial Sequence
  Synthetic oligonucleotide
gaaccaatctcacgaccgcgtcctccgtcttctgg

SEQ ID NO: 37019 - DNA, 35 bp, Artificial Sequence
  Synthetic oligonucleotide
tgaacccgtcccctccatatactttagtccgtctg

SEQ ID NO: 37020 - DNA, 35 bp, Artificial Sequence
  Synthetic oligonucleotide
gatgaggtgcctatcggaaaaaaatgcaaggcttg

SEQ ID NO: 37021 - DNA, 35 bp, Artificial Sequence
  Synthetic oligonucleotide
tcattcctcaacgcagagcttcgcccgcaacacct

SEQ ID NO: 37022 - DNA, 35 bp, Artificial Sequence
  Synthetic oligonucleotide
gtccgtgtccacgcggataaacccctgcctcccgt

SEQ ID NO: 37023 - DNA, 36 bp, Artificial Sequence
  Synthetic oligonucleotide
gaatgcagcacaattatatatactctgccccccaca

SEQ ID NO: 37024 - DNA, 36 bp, Artificial Sequence
  Synthetic oligonucleotide
ttcaagtgcaatgtctacttgttgtaccacccttca

SEQ ID NO: 37025 - DNA, 36 bp, Artificial Sequence
  Synthetic oligonucleotide
tgcactccggttcacgttacatccgttggcttacga

SEQ ID NO: 37026 - DNA, 37 bp, Artificial Sequence
  Synthetic oligonucleotide
acccccaactaccatgcgatttcgcagcagaactcga

SEQ ID NO: 37027 - DNA, 37 bp, Artificial Sequence
  Synthetic oligonucleotide
acgaacgaccgcgtggttgaaacgcacacatactcga

SEQ ID NO: 37028 - DNA, 36 bp, Artificial Sequence
  Synthetic oligonucleotide
gccgagcacacccataacaatcctctcgctactcga

SEQ ID NO: 37029 - DNA, 36 bp, Artificial Sequence
  Synthetic oligonucleotide
gtgctccgtccacatttcaccccgatccacgctcga

SEQ ID NO: 37030 - DNA, 37 bp, Artificial Sequence
  Synthetic oligonucleotide
atcaatccaccacgcccgcttatagtacgacttagga

SEQ ID NO: 37031 - DNA, 34 bp, Artificial Sequence
  Synthetic oligonucleotide
gccaatttcccgcgtatttacaccttcccacgga

SEQ ID NO: 37032 - DNA, 35 bp, Artificial Sequence
  Synthetic oligonucleotide
tgagggaggggcaagaagtgggaatatgtagggga

SEQ ID NO: 37033 - DNA, 38 bp, Artificial Sequence
  Synthetic oligonucleotide
tcacttggctccagtctcatattgccaccgttccctga

SEQ ID NO: 37034 - DNA, 38 bp, Artificial Sequence
  Synthetic oligonucleotide
gtttgcgccgtcccccctacgaatccaatcgtgcctga

SEQ ID NO: 37035 - DNA, 38 bp, Artificial Sequence
  Synthetic oligonucleotide
acatcacagaggcacgatgccatccttgcgcctcctga

SEQ ID NO: 37036 - DNA, 38 bp, Artificial Sequence
  Synthetic oligonucleotide
gattcagggcagcccactggccacagacctccctctga

SEQ ID NO: 37037 - DNA, 37 bp, Artificial Sequence
  Synthetic oligonucleotide
acgccggggcaatgggtgggttggtggtccggggtga

SEQ ID NO: 37038 - DNA, 36 bp, Artificial Sequence
  Synthetic oligonucleotide
ggatgaaggggttacaaagggtatgtggaactgtga

SEQ ID NO: 37039 - DNA, 37 bp, Artificial Sequence
  Synthetic oligonucleotide
atcacggtcccatccatgaagccccgacagaccttga

SEQ ID NO: 37040 - DNA, 38 bp, Artificial Sequence
  Synthetic oligonucleotide
tcgaaacgaggggggtggtggcagtaattacgggttga

SEQ ID NO: 37041 - DNA, 35 bp, Artificial Sequence
  Synthetic oligonucleotide
tccgaccgttaatccgtttacctcttcgacaactc

SEQ ID NO: 37042 - DNA, 35 bp, Artificial Sequence
  Synthetic oligonucleotide
gccccaaacgctagaacttgcgttccccacttctc

SEQ ID NO: 37043 - DNA, 35 bp, Artificial Sequence
  Synthetic oligonucleotide
tccgctgttcggcatcccctctggtctttgttcgg

SEQ ID NO: 37044 - DNA, 34 bp, Artificial Sequence
  Synthetic oligonucleotide
aacgccaaccatcgcatagacaccttaccttttg

SEQ ID NO: 37045 - DNA, 35 bp, Artificial Sequence
  Synthetic oligonucleotide
gacgtgccagctcccgtctatcagccctacaccat

SEQ ID NO: 37046 - DNA, 35 bp, Artificial Sequence
  Synthetic oligonucleotide
gctccacccatgttttatgatcgctgtacactcat

SEQ ID NO: 37047 - DNA, 35 bp, Artificial Sequence
  Synthetic oligonucleotide
gtggtggctgtcgttctggtaggcgccccccctct

SEQ ID NO: 37048 - DNA, 35 bp, Artificial Sequence
  Synthetic oligonucleotide
actcgactcggtcccctgctgatgtccaaccttct

SEQ ID NO: 37049 - DNA, 35 bp, Artificial Sequence
  Synthetic oligonucleotide
actccaaccaaacgctgtcgcccgaaatcatcggt

SEQ ID NO: 37050 - DNA, 35 bp, Artificial Sequence
  Synthetic oligonucleotide
gaaccgctgcttatcgctgcactgccctatactgt

SEQ ID NO: 37051 - DNA, 35 bp, Artificial Sequence
  Synthetic oligonucleotide
gtccttgccgctagagctacccatttaatctgctt

SEQ ID NO: 37052 - DNA, 34 bp, Artificial Sequence
  Synthetic oligonucleotide
gccattcgcatccccgttctagtttccggtggtt

SEQ ID NO: 37053 - DNA, 35 bp, Artificial Sequence
  Synthetic oligonucleotide
accatcatagggccgtcctatactctcgtgccttt

SEQ ID NO: 37054 - DNA, 35 bp, Artificial Sequence
  Synthetic oligonucleotide
tagacccatcccgcgtacctacttaacagacgttt

SEQ ID NO: 37055 - DNA, 35 bp, Artificial Sequence
  Synthetic oligonucleotide
tacaccatcacttccacccggagcgagtctcgttt

SEQ ID NO: 37056 - DNA, 36 bp, Artificial Sequence
  Synthetic oligonucleotide
gtcactccgcaccttcgggccttcctttgccgcaaa

SEQ ID NO: 37057 - DNA, 35 bp, Artificial Sequence
  Synthetic oligonucleotide
aaaggacgggcgtaggacaactgggaaggtagaaa

SEQ ID NO: 37058 - DNA, 34 bp, Artificial Sequence
  Synthetic oligonucleotide
gatgagcgccgaactccgcccgccttcccttcaa

SEQ ID NO: 37059 - DNA, 35 bp, Artificial Sequence
  Synthetic oligonucleotide
tacttcccgcccggagaacgctctatctctgacca

SEQ ID NO: 37060 - DNA, 37 bp, Artificial Sequence
  Synthetic oligonucleotide
tgacacctctgaccacatttgcacccgatgactgaga

SEQ ID NO: 37061 - DNA, 36 bp, Artificial Sequence
  Synthetic oligonucleotide
tccacctctcactatctcgccagtttcctaagacga

SEQ ID NO: 37062 - DNA, 38 bp, Artificial Sequence
  Synthetic oligonucleotide
gacctccccgatcgactcatgctgctgaactcccccga

SEQ ID NO: 37063 - DNA, 35 bp, Artificial Sequence
  Synthetic oligonucleotide
gcacacctgggcccacgaacacccccggattccga

SEQ ID NO: 37064 - DNA, 36 bp, Artificial Sequence
  Synthetic oligonucleotide
tgcataagcgtagtaccctgattgcaccctcttcga

SEQ ID NO: 37065 - DNA, 37 bp, Artificial Sequence
  Synthetic oligonucleotide
ggatgctcccgctcttcttctgcctacctcgtccgga

SEQ ID NO: 37066 - DNA, 38 bp, Artificial Sequence
  Synthetic oligonucleotide
aacccacgttcgctactcccacgtcactctggtcatga

SEQ ID NO: 37067 - DNA, 36 bp, Artificial Sequence
  Synthetic oligonucleotide
gcgctacacccacattcggccattcacgactactga

SEQ ID NO: 37068 - DNA, 38 bp, Artificial Sequence
  Synthetic oligonucleotide
gaccttgcggccattccatttgcgccatcaattactga

SEQ ID NO: 37069 - DNA, 35 bp, Artificial Sequence
  Synthetic oligonucleotide
gtgcgctccagatgcactggcctcttcccatctga

SEQ ID NO: 37070 - DNA, 38 bp, Artificial Sequence
  Synthetic oligonucleotide
tcgctggtcccgaagcttcactgttcgcctttttctga

SEQ ID NO: 37071 - DNA, 38 bp, Artificial Sequence
  Synthetic oligonucleotide
acattccgcccgatagcctcacagtccgccctcagtga

SEQ ID NO: 37072 - DNA, 37 bp, Artificial Sequence
  Synthetic oligonucleotide
atcacagccccttccccctactacgtgggtactttga

SEQ ID NO: 37073 - DNA, 35 bp, Artificial Sequence
  Synthetic oligonucleotide
tttagcacacttgctcactacccttcgcttgccta

SEQ ID NO: 37074 - DNA, 35 bp, Artificial Sequence
  Synthetic oligonucleotide
gcaccctgagtgcacaagccgtgcctgcaatctac

SEQ ID NO: 37075 - DNA, 35 bp, Artificial Sequence
  Synthetic oligonucleotide
gaccgccgcggaaggtcgccatcccacaaactccc

SEQ ID NO: 37076 - DNA, 35 bp, Artificial Sequence
  Synthetic oligonucleotide
gatacacaccaatcttcagagtcgttacatacgcc

SEQ ID NO: 37077 - DNA, 35 bp, Artificial Sequence
  Synthetic oligonucleotide
gccttatcagtcatccctatcaaacgcgccttgcc

SEQ ID NO: 37078 - DNA, 35 bp, Artificial Sequence
  Synthetic oligonucleotide
tagcggaaggctatacttatcacacctgcactggc

SEQ ID NO: 37079 - DNA, 35 bp, Artificial Sequence
  Synthetic oligonucleotide
aaccgcgtaaggccgccccccgcagtcatctcatc

SEQ ID NO: 37080 - DNA, 35 bp, Artificial Sequence
  Synthetic oligonucleotide
acgatatgccctgagccaacttacagactaccttc

SEQ ID NO: 37081 - DNA, 35 bp, Artificial Sequence
  Synthetic oligonucleotide
ggaatgggggaggaggaaacagagacttataagag

SEQ ID NO: 37082 - DNA, 35 bp, Artificial Sequence
  Synthetic oligonucleotide
gacctcaccctgttagttagctccctgaacacgct

SEQ ID NO: 37083 - DNA, 35 bp, Artificial Sequence
  Synthetic oligonucleotide
gtacccgaacgctgccgccctcaatttatgccatt

SEQ ID NO: 37084 - DNA, 36 bp, Artificial Sequence
  Synthetic oligonucleotide
agcacgagccgcttgtctttaggatttttgccctaa

SEQ ID NO: 37085 - DNA, 36 bp, Artificial Sequence
  Synthetic oligonucleotide
tctgcgtacgactgctaccgttcaaaccattccaca

SEQ ID NO: 37086 - DNA, 35 bp, Artificial Sequence
  Synthetic oligonucleotide
aattccaggtccggtcgcggttccctaccactcca

SEQ ID NO: 37087 - DNA, 35 bp, Artificial Sequence
  Synthetic oligonucleotide
taatgtccagaggttccagcctcctaccctctcca

SEQ ID NO: 37088 - DNA, 36 bp, Artificial Sequence
  Synthetic oligonucleotide
tatgccctagcgtgtggttctgtccttttgtcttca

SEQ ID NO: 37089 - DNA, 35 bp, Artificial Sequence
  Synthetic oligonucleotide
acgtgccaccataccctgcctggctcttagcaaga

SEQ ID NO: 37090 - DNA, 36 bp, Artificial Sequence
  Synthetic oligonucleotide
gttccggtcccgccctcattcccctccggtccacga

SEQ ID NO: 37091 - DNA, 35 bp, Artificial Sequence
  Synthetic oligonucleotide
actgactacaccttgtggttacctacctccccgga

SEQ ID NO: 37092 - DNA, 38 bp, Artificial Sequence
  Synthetic oligonucleotide
tccaccgtcctggggacccattcgacacgccctcctga

SEQ ID NO: 37093 - DNA, 38 bp, Artificial Sequence
  Synthetic oligonucleotide
gagtggtgaggggaacgggaagtgagggccgtacgtga

SEQ ID NO: 37094 - DNA, 37 bp, Artificial Sequence
  Synthetic oligonucleotide
gagcagacttcagtctgggagggtgggttaggggtga

SEQ ID NO: 37095 - DNA, 37 bp, Artificial Sequence
  Synthetic oligonucleotide
gcgtaccgtcgttaccctctctgcacaccggttttga

SEQ ID NO: 37096 - DNA, 36 bp, Artificial Sequence
  Synthetic oligonucleotide
aacctcgcagctgagctatttcagccccatacacta

SEQ ID NO: 37097 - DNA, 35 bp, Artificial Sequence
  Synthetic oligonucleotide
tgcccccctcggcgctttcttcatgtcctgtccac

SEQ ID NO: 37098 - DNA, 35 bp, Artificial Sequence
  Synthetic oligonucleotide
agcaccatatctcctatccgatcgatttttgggac

SEQ ID NO: 37099 - DNA, 36 bp, Artificial Sequence
  Synthetic oligonucleotide
ttcgtgtgcactaactgcttgaatgtagccaccacc

SEQ ID NO: 37100 - DNA, 35 bp, Artificial Sequence
  Synthetic oligonucleotide
tctgagcttgtccgcccagtccacccaagcacccc

SEQ ID NO: 37101 - DNA, 35 bp, Artificial Sequence
  Synthetic oligonucleotide
acttgatctccgcagaacgcatacttcactcgtcc

SEQ ID NO: 37102 - DNA, 35 bp, Artificial Sequence
  Synthetic oligonucleotide
aaccgtgccaacctgtgcgaataccctctgggtcc

SEQ ID NO: 37103 - DNA, 35 bp, Artificial Sequence
  Synthetic oligonucleotide
agcccacacccggatggatccgccttacctgccgc

SEQ ID NO: 37104 - DNA, 35 bp, Artificial Sequence
  Synthetic oligonucleotide
gcaaaccatctgcaattaatgccctgctgcactgc

SEQ ID NO: 37105 - DNA, 35 bp, Artificial Sequence
  Synthetic oligonucleotide
attcgaacgtctctgttgtcatcatccttcaccag

SEQ ID NO: 37106 - DNA, 35 bp, Artificial Sequence
  Synthetic oligonucleotide
atggacgtcaagtctaccctccctccacctctccg

SEQ ID NO: 37107 - DNA, 35 bp, Artificial Sequence
  Synthetic oligonucleotide
tggattcctggacctccctcgtgcccccctacgat

SEQ ID NO: 37108 - DNA, 35 bp, Artificial Sequence
  Synthetic oligonucleotide
tgcctaacacatgcttggggcctttgcctaacact

SEQ ID NO: 37109 - DNA, 35 bp, Artificial Sequence
  Synthetic oligonucleotide
tcggaaggtccggcaagccctgtccacttccctgt

SEQ ID NO: 37110 - DNA, 35 bp, Artificial Sequence
  Synthetic oligonucleotide
gccagtcctgcatgcgcactcgtgtctgccccttt

SEQ ID NO: 37111 - DNA, 36 bp, Artificial Sequence
  Synthetic oligonucleotide
atcgccaaacgtatacacgcgcacacgaggtcccaa

SEQ ID NO: 37112 - DNA, 36 bp, Artificial Sequence
  Synthetic oligonucleotide
tagccacaggcatcgcattttttcagtttcttagca

SEQ ID NO: 37113 - DNA, 34 bp, Artificial Sequence
  Synthetic oligonucleotide
gcccccatcattcatgttagatgtgtcacattca

SEQ ID NO: 37114 - DNA, 36 bp, Artificial Sequence
  Synthetic oligonucleotide
tgtgcctctactgagcattatcgccggtatccttca

SEQ ID NO: 37115 - DNA, 37 bp, Artificial Sequence
  Synthetic oligonucleotide
acgaccctgggtagggtgggtagggacaagtaaacga

SEQ ID NO: 37116 - DNA, 37 bp, Artificial Sequence
  Synthetic oligonucleotide
tgtattgttccatccgtcagagctgtctcctcgtcga

SEQ ID NO: 37117 - DNA, 35 bp, Artificial Sequence
  Synthetic oligonucleotide
acccccgaccgtgaacccgccctggcctatgcgga

SEQ ID NO: 37118 - DNA, 37 bp, Artificial Sequence
  Synthetic oligonucleotide
gagagatgggggctaggggagcgggagtaaaaaggga

SEQ ID NO: 37119 - DNA, 36 bp, Artificial Sequence
  Synthetic oligonucleotide
actcacactcaccaaatatgactctgatctagctga

SEQ ID NO: 37120 - DNA, 37 bp, Artificial Sequence
  Synthetic oligonucleotide
gctgggaggggaccggaagtgaggggtagaaaggtga

SEQ ID NO: 37121 - DNA, 36 bp, Artificial Sequence
  Synthetic oligonucleotide
tcacctggtcctagttaatcagactccatgccccta

SEQ ID NO: 37122 - DNA, 35 bp, Artificial Sequence
  Synthetic oligonucleotide
atgcatggcagttaaacctctctgtcgccggaaac

SEQ ID NO: 37123 - DNA, 35 bp, Artificial Sequence
  Synthetic oligonucleotide
agactgcaccaccatcacaccatgtccgcttctcc

SEQ ID NO: 37124 - DNA, 35 bp, Artificial Sequence
  Synthetic oligonucleotide
gtgagacgccgaccgcgcatcctccccaagatggc

SEQ ID NO: 37125 - DNA, 35 bp, Artificial Sequence
  Synthetic oligonucleotide
tctgcggcgcacgcgtccacagcctcggtcctatc

SEQ ID NO: 37126 - DNA, 35 bp, Artificial Sequence
  Synthetic oligonucleotide
tgacgcagcctgcgtaatggggtgcgcctctcctc

SEQ ID NO: 37127 - DNA, 35 bp, Artificial Sequence
  Synthetic oligonucleotide
gccgcgcataccgcatcctatccgtattctcctgg

SEQ ID NO: 37128 - DNA, 35 bp, Artificial Sequence
  Synthetic oligonucleotide
tacaggatgggggtcggtatgttaaactgtgggtg

SEQ ID NO: 37129 - DNA, 35 bp, Artificial Sequence
  Synthetic oligonucleotide
atattcccgcccatccgtcaacccaatcgacggaa

SEQ ID NO: 37130 - DNA, 35 bp, Artificial Sequence
  Synthetic oligonucleotide
atgtgtaggcaacactggtacctgctccaaccaca

SEQ ID NO: 37131 - DNA, 36 bp, Artificial Sequence
  Synthetic oligonucleotide
tgcaccatccaggaatgatccccagtggcatatgca

SEQ ID NO: 37132 - DNA, 37 bp, Artificial Sequence
  Synthetic oligonucleotide
gtcacagggggggggcgtgttaggaaggaacatacga

SEQ ID NO: 37133 - DNA, 36 bp, Artificial Sequence
  Synthetic oligonucleotide
atgcaaccgaagagaaagggtgggcgggtttgtcga

SEQ ID NO: 37134 - DNA, 37 bp, Artificial Sequence
  Synthetic oligonucleotide
actccttccgcagctgccttgatccttacatattcga

SEQ ID NO: 37135 - DNA, 38 bp, Artificial Sequence
  Synthetic oligonucleotide
tttgcagtcggggggtaccagcagagagggcaagatga

SEQ ID NO: 37136 - DNA, 38 bp, Artificial Sequence
  Synthetic oligonucleotide
gactcgcggagatatacgcacccactgatcttaactga

SEQ ID NO: 37137 - DNA, 36 bp, Artificial Sequence
  Synthetic oligonucleotide
tgcagtccgccccgaatgcctaatcagctaatccta

SEQ ID NO: 37138 - DNA, 35 bp, Artificial Sequence
  Synthetic oligonucleotide
gtcgatacatctttctcccgtgttttcccgctgac

SEQ ID NO: 37139 - DNA, 35 bp, Artificial Sequence
  Synthetic oligonucleotide
taccgaaacgttgtgtccgcagccctgccctctac

SEQ ID NO: 37140 - DNA, 35 bp, Artificial Sequence
  Synthetic oligonucleotide
gaccaattcggttgacttattagcattttctatcc

SEQ ID NO: 37141 - DNA, 35 bp, Artificial Sequence
  Synthetic oligonucleotide
acgtccgtccgcccccctgtcctagccatttatgc

SEQ ID NO: 37142 - DNA, 35 bp, Artificial Sequence
  Synthetic oligonucleotide
acttccagccgcctcgtttcgcttgcttctacctc

SEQ ID NO: 37143 - DNA, 35 bp, Artificial Sequence
  Synthetic oligonucleotide
gactggcaccagggcatctttcgtcataacttttc

SEQ ID NO: 37144 - DNA, 35 bp, Artificial Sequence
  Synthetic oligonucleotide
ttggtaccagcacacataaccctctccgtcgagag

SEQ ID NO: 37145 - DNA, 34 bp, Artificial Sequence
  Synthetic oligonucleotide
gtctcacagcgtgccacgcaccgaaatcaattct

SEQ ID NO: 37146 - DNA, 35 bp, Artificial Sequence
  Synthetic oligonucleotide
actgggggtggggaatggggatacggaggtggggt

SEQ ID NO: 37147 - DNA, 35 bp, Artificial Sequence
  Synthetic oligonucleotide
gagtccctctgcgttttcttgatcatttgaattgt

SEQ ID NO: 37148 - DNA, 35 bp, Artificial Sequence
  Synthetic oligonucleotide
tctcccgaccctctcagactacgccagtcaccatt

SEQ ID NO: 37149 - DNA, 35 bp, Artificial Sequence
  Synthetic oligonucleotide
tagtactgttactcccgccgccagcctgctatctt

SEQ ID NO: 37150 - DNA, 35 bp, Artificial Sequence
  Synthetic oligonucleotide
gcggggtgggaagggtggtttaattggcatgtgtt

SEQ ID NO: 37151 - DNA, 36 bp, Artificial Sequence
  Synthetic oligonucleotide
gcaggaactgcgtgcggataaaggggggtgcagcaa

SEQ ID NO: 37152 - DNA, 35 bp, Artificial Sequence
  Synthetic oligonucleotide
ttatagtcatgagggtggaagtgggatggtgggaa

SEQ ID NO: 37153 - DNA, 35 bp, Artificial Sequence
  Synthetic oligonucleotide
ttgtgtcgccacccacctgtacgcgtgttccataa

SEQ ID NO: 37154 - DNA, 35 bp, Artificial Sequence
  Synthetic oligonucleotide
aagtgaccacgctaccctaagaccctgtgtcctaa

SEQ ID NO: 37155 - DNA, 35 bp, Artificial Sequence
  Synthetic oligonucleotide
gaccccagtccggttggtctttcctgcccctccca

SEQ ID NO: 37156 - DNA, 36 bp, Artificial Sequence
  Synthetic oligonucleotide
acgtatcaccagcgcgcacgcttctacacgccatca

SEQ ID NO: 37157 - DNA, 35 bp, Artificial Sequence
  Synthetic oligonucleotide
gacaggcctccaacgtatgatatccactccgctca

SEQ ID NO: 37158 - DNA, 37 bp, Artificial Sequence
  Synthetic oligonucleotide
agtggctgggagggaaggatagaggatcaaagagaga

SEQ ID NO: 37159 - DNA, 37 bp, Artificial Sequence
  Synthetic oligonucleotide
ttcaacacgcctccggtgcattgtctattgttcccga

SEQ ID NO: 37160 - DNA, 34 bp, Artificial Sequence
  Synthetic oligonucleotide
tccgaccctccgaccctccaggccagactcgcga

SEQ ID NO: 37161 - DNA, 37 bp, Artificial Sequence
  Synthetic oligonucleotide
tactcaccctctctgaataggaatcatccgccaatga

SEQ ID NO: 37162 - DNA, 38 bp, Artificial Sequence
  Synthetic oligonucleotide
accatgacgagcctgtttgccttcaaagattcccctga

SEQ ID NO: 37163 - DNA, 38 bp, Artificial Sequence
  Synthetic oligonucleotide
gacacggatcattctccagacctgcctcttctacgtga

SEQ ID NO: 37164 - DNA, 37 bp, Artificial Sequence
  Synthetic oligonucleotide
aacgaggccagaagcaatctgggggggtatggggtga

SEQ ID NO: 37165 - DNA, 36 bp, Artificial Sequence
  Synthetic oligonucleotide
gggtgtgtggggaatgggacggaatgtgcgcgttga

SEQ ID NO: 37166 - DNA, 36 bp, Artificial Sequence
  Synthetic oligonucleotide
ttgtcgtggtctgccattcctccgaatccgccgtta

SEQ ID NO: 37167 - DNA, 36 bp, Artificial Sequence
  Synthetic oligonucleotide
acttcgcaggcacacggtttctagcccgatctttta

SEQ ID NO: 37168 - DNA, 35 bp, Artificial Sequence
  Synthetic oligonucleotide
aacacgcgcccacgcacgtttccatccgccttcac

SEQ ID NO: 37169 - DNA, 35 bp, Artificial Sequence
  Synthetic oligonucleotide
gcgaccacacagactccgagccctacgtcactacc

SEQ ID NO: 37170 - DNA, 35 bp, Artificial Sequence
  Synthetic oligonucleotide
acgcaaatacatccctcggcacggtcttcgtcgcc

SEQ ID NO: 37171 - DNA, 35 bp, Artificial Sequence
  Synthetic oligonucleotide
ttcaacccaaggcctcaaatcgcgcgttatcctgc

SEQ ID NO: 37172 - DNA, 35 bp, Artificial Sequence
  Synthetic oligonucleotide
acccacgcggaatatccgcctgcagcccgtggctc

SEQ ID NO: 37173 - DNA, 35 bp, Artificial Sequence
  Synthetic oligonucleotide
attgccccggcatccaaaatgtaacatttctgttc

SEQ ID NO: 37174 - DNA, 35 bp, Artificial Sequence
  Synthetic oligonucleotide
gacgatggtggggataggcgatgctttggttgagg

SEQ ID NO: 37175 - DNA, 35 bp, Artificial Sequence
  Synthetic oligonucleotide
aacgatgaagggagggggtgaagtgtacagaatgg

SEQ ID NO: 37176 - DNA, 35 bp, Artificial Sequence
  Synthetic oligonucleotide
agtacgacgggggggtcaatgtagagtaatgaatg

SEQ ID NO: 37177 - DNA, 35 bp, Artificial Sequence
  Synthetic oligonucleotide
acaccatcgctggcacaggacgatcgactcaccct

SEQ ID NO: 37178 - DNA, 35 bp, Artificial Sequence
  Synthetic oligonucleotide
attgccggtgcggggtgggatggccatgtttgtct

SEQ ID NO: 37179 - DNA, 35 bp, Artificial Sequence
  Synthetic oligonucleotide
tccatatctcatcccctcggccccgacctaggggt

SEQ ID NO: 37180 - DNA, 35 bp, Artificial Sequence
  Synthetic oligonucleotide
aaccacatccaccatttgcccgatgactgtgaaaa

SEQ ID NO: 37181 - DNA, 35 bp, Artificial Sequence
  Synthetic oligonucleotide
tcagtctgagccctggcttccagcaatacacccaa

SEQ ID NO: 37182 - DNA, 36 bp, Artificial Sequence
  Synthetic oligonucleotide
ttcacgtagcttgttccacctgcaactcccgttcaa

SEQ ID NO: 37183 - DNA, 36 bp, Artificial Sequence
  Synthetic oligonucleotide
gcatggcacctccgcacacattttttttatgttcaa

SEQ ID NO: 37184 - DNA, 35 bp, Artificial Sequence
  Synthetic oligonucleotide
tcactacaaccgacttgcctgagcatctgctataa

SEQ ID NO: 37185 - DNA, 36 bp, Artificial Sequence
  Synthetic oligonucleotide
accagcctcgacaacttgaaacgggctgccctaaca

SEQ ID NO: 37186 - DNA, 35 bp, Artificial Sequence
  Synthetic oligonucleotide
gctacaccccatatggataggtattcctgccttca

SEQ ID NO: 37187 - DNA, 35 bp, Artificial Sequence
  Synthetic oligonucleotide
tgctgtagctcatccctctctcaggtccactttca

SEQ ID NO: 37188 - DNA, 35 bp, Artificial Sequence
  Synthetic oligonucleotide
gccacgtttgcacccctccccatcctgatttcaga

SEQ ID NO: 37189 - DNA, 37 bp, Artificial Sequence
  Synthetic oligonucleotide
gaatggagtgaaggggtggagaatgggtcttacacga

SEQ ID NO: 37190 - DNA, 37 bp, Artificial Sequence
  Synthetic oligonucleotide
gcaccgctgatcaaagctcaacctccatcatcgccga

SEQ ID NO: 37191 - DNA, 36 bp, Artificial Sequence
  Synthetic oligonucleotide
tcgtgcctctctcgtgcctagtccgtccctttccga

SEQ ID NO: 37192 - DNA, 37 bp, Artificial Sequence
  Synthetic oligonucleotide
ttgtccggtacgtcttaacaacacccaccacctgcga

SEQ ID NO: 37193 - DNA, 37 bp, Artificial Sequence
  Synthetic oligonucleotide
tctggcctcttgctcccgtttgcctcttttagttcga

SEQ ID NO: 37194 - DNA, 36 bp, Artificial Sequence
  Synthetic oligonucleotide
gccaagaagcctgtctgtatgccctctttccccgga

SEQ ID NO: 37195 - DNA, 37 bp, Artificial Sequence
  Synthetic oligonucleotide
tacggccacccttcgatgcgcaccttactccacctga

SEQ ID NO: 37196 - DNA, 38 bp, Artificial Sequence
  Synthetic oligonucleotide
ttcgcagcccgcatgcacgcttccacaaccgtccctga

SEQ ID NO: 37197 - DNA, 38 bp, Artificial Sequence
  Synthetic oligonucleotide
gcgaccgacgccttaccatcttcataccagtatcttga

SEQ ID NO: 37198 - DNA, 38 bp, Artificial Sequence
  Synthetic oligonucleotide
atcaatgagctgcaatgcgaaccgcccactccctttga

SEQ ID NO: 37199 - DNA, 36 bp, Artificial Sequence
  Synthetic oligonucleotide
taggacaacaaatggtcctattgccctcctttttga

SEQ ID NO: 37200 - DNA, 36 bp, Artificial Sequence
  Synthetic oligonucleotide
tcacccgaccctcaatgattgctcctacggtttgta

SEQ ID NO: 37201 - DNA, 35 bp, Artificial Sequence
  Synthetic oligonucleotide
gtcgcctcgccccagcgcaacccggctaacaccac

SEQ ID NO: 37202 - DNA, 35 bp, Artificial Sequence
  Synthetic oligonucleotide
accgcctgcatctcagcatctcgccgtttacttcc

SEQ ID NO: 37203 - DNA, 35 bp, Artificial Sequence
  Synthetic oligonucleotide
ttgaccatcctccttagtcgttgaggccgactcgc

SEQ ID NO: 37204 - DNA, 35 bp, Artificial Sequence
  Synthetic oligonucleotide
tcttccactcacagttagtccttccgccagacaag

SEQ ID NO: 37205 - DNA, 35 bp, Artificial Sequence
  Synthetic oligonucleotide
actcatgccttgtctattcaattccgcctgttccg

SEQ ID NO: 37206 - DNA, 35 bp, Artificial Sequence
  Synthetic oligonucleotide
tcaagccacggccgttctgtttctttatgaattcg

SEQ ID NO: 37207 - DNA, 35 bp, Artificial Sequence
  Synthetic oligonucleotide
tcagcccaaccttatcctcaccaccctaccatggg

SEQ ID NO: 37208 - DNA, 35 bp, Artificial Sequence
  Synthetic oligonucleotide
acagcctgtaactgcgtacgcataggtccttttct

SEQ ID NO: 37209 - DNA, 35 bp, Artificial Sequence
  Synthetic oligonucleotide
gtactatcactcccgccgtatctgcttcctgtagt

SEQ ID NO: 37210 - DNA, 35 bp, Artificial Sequence
  Synthetic oligonucleotide
ttacccgcttatgttgagatttttcacggtttctt

SEQ ID NO: 37211 - DNA, 35 bp, Artificial Sequence
  Synthetic oligonucleotide
gcttgtgaggggggtggggctcgaggcagggaaaa

SEQ ID NO: 37212 - DNA, 36 bp, Artificial Sequence
  Synthetic oligonucleotide
gccagagtggactgtcggattggggggagggggaaa

SEQ ID NO: 37213 - DNA, 36 bp, Artificial Sequence
  Synthetic oligonucleotide
tgaaaccccctccctccgtgcctctaatgagtgcaa

SEQ ID NO: 37214 - DNA, 36 bp, Artificial Sequence
  Synthetic oligonucleotide
ttcaaacacggcgtccgtgccctttcctaccccgaa

SEQ ID NO: 37215 - DNA, 37 bp, Artificial Sequence
  Synthetic oligonucleotide
gactcccagcacgatatttgacttcagcacgacacga

SEQ ID NO: 37216 - DNA, 37 bp, Artificial Sequence
  Synthetic oligonucleotide
gtttcgatccaaatgtcttttcccccgtcactaccga

SEQ ID NO: 37217 - DNA, 37 bp, Artificial Sequence
  Synthetic oligonucleotide
gaccagtgagaaggggggaaggggtctcggtgtccga

SEQ ID NO: 37218 - DNA, 37 bp, Artificial Sequence
  Synthetic oligonucleotide
gatggaagaacgaatgggtaaggtcgggcacccgcga

SEQ ID NO: 37219 - DNA, 37 bp, Artificial Sequence
  Synthetic oligonucleotide
atgaacgggcggggggttgacatggtggtttgaagga

SEQ ID NO: 37220 - DNA, 38 bp, Artificial Sequence
  Synthetic oligonucleotide
taagcaatgaggagaaacgggacgggggtggctcatga

SEQ ID NO: 37221 - DNA, 38 bp, Artificial Sequence
  Synthetic oligonucleotide
gcccaagcacccgcggactcacaaactgcacaacctga

SEQ ID NO: 37222 - DNA, 38 bp, Artificial Sequence
  Synthetic oligonucleotide
tccgaatcgcccccgggtgatcctgtctatccccctga

SEQ ID NO: 37223 - DNA, 38 bp, Artificial Sequence
  Synthetic oligonucleotide
tcccccacgctcacctacttccctcgggacactgctga

SEQ ID NO: 37224 - DNA, 36 bp, Artificial Sequence
  Synthetic oligonucleotide
gccaccgtgtctcttacacgcattacaccctcgtga

SEQ ID NO: 37225 - DNA, 36 bp, Artificial Sequence
  Synthetic oligonucleotide
tcaccatactggtctgccttccactctctcacaata

SEQ ID NO: 37226 - DNA, 36 bp, Artificial Sequence
  Synthetic oligonucleotide
gcaagcagcctgtggaatcacccccgtccccaagta

SEQ ID NO: 37227 - DNA, 35 bp, Artificial Sequence
  Synthetic oligonucleotide
ttgcgtcgctcccttgcatatcgaggtctgcttac

SEQ ID NO: 37228 - DNA, 35 bp, Artificial Sequence
  Synthetic oligonucleotide
ccacactcaagccagccgctacccgccctgcgccc

SEQ ID NO: 37229 - DNA, 35 bp, Artificial Sequence
  Synthetic oligonucleotide
tttgcgaagcctccgcgattactctcttcagttcc

SEQ ID NO: 37230 - DNA, 35 bp, Artificial Sequence
  Synthetic oligonucleotide
aactgggggtcggtctgcccctctagctacccatc

SEQ ID NO: 37231 - DNA, 35 bp, Artificial Sequence
  Synthetic oligonucleotide
tcctacttagctacattcgggtgcccacgaccgag

SEQ ID NO: 37232 - DNA, 35 bp, Artificial Sequence
  Synthetic oligonucleotide
aactgggcagggaacgtaggtgggagtgatttggg

SEQ ID NO: 37233 - DNA, 35 bp, Artificial Sequence
  Synthetic oligonucleotide
acttgctccctcttactgcacgtgatttcttttgg

SEQ ID NO: 37234 - DNA, 35 bp, Artificial Sequence
  Synthetic oligonucleotide
ggtagccccaccggtcgacaataccttccaccaat

SEQ ID NO: 37235 - DNA, 35 bp, Artificial Sequence
  Synthetic oligonucleotide
gtgatggcgttgcccggcatttctagtcccatcct

SEQ ID NO: 37236 - DNA, 35 bp, Artificial Sequence
  Synthetic oligonucleotide
gtccacgcctcggcatctattaatgatcttaccgt

SEQ ID NO: 37237 - DNA, 35 bp, Artificial Sequence
  Synthetic oligonucleotide
agtccatggccacgtggttcccctcaccgacctgt

SEQ ID NO: 37238 - DNA, 35 bp, Artificial Sequence
  Synthetic oligonucleotide
tggagcatttgtccgctgctcactctttaccctgt

SEQ ID NO: 37239 - DNA, 35 bp, Artificial Sequence
  Synthetic oligonucleotide
ttcatcggcggtgggtggtggggggtcgggatatt

SEQ ID NO: 37240 - DNA, 35 bp, Artificial Sequence
  Synthetic oligonucleotide
tccatcctgatcacccgacctgtgtgtctgcaaca

SEQ ID NO: 37241 - DNA, 36 bp, Artificial Sequence
  Synthetic oligonucleotide
atgtaccagtccctcggttcgccaatttcgcttaca

SEQ ID NO: 37242 - DNA, 36 bp, Artificial Sequence
  Synthetic oligonucleotide
tccacccgagctttgagtttggctttcgttgcccca

SEQ ID NO: 37243 - DNA, 36 bp, Artificial Sequence
  Synthetic oligonucleotide
gaccgcccccaccggccaaagggctggtgtctccca

SEQ ID NO: 37244 - DNA, 35 bp, Artificial Sequence
  Synthetic oligonucleotide
tgtgcgctgaacgttcatcttacctagtaccgcca

SEQ ID NO: 37245 - DNA, 35 bp, Artificial Sequence
  Synthetic oligonucleotide
acgcactttagctcttcggtcccgctctccgcgca

SEQ ID NO: 37246 - DNA, 35 bp, Artificial Sequence
  Synthetic oligonucleotide
aactggcgcggccgcactatgcacctgatcgctca

SEQ ID NO: 37247 - DNA, 37 bp, Artificial Sequence
  Synthetic oligonucleotide
gccatcctagcactcgcccatgcctgtccgatagaga

SEQ ID NO: 37248 - DNA, 37 bp, Artificial Sequence
  Synthetic oligonucleotide
ggaaggggggtacgggggggaatgggtgcgaaaacga

SEQ ID NO: 37249 - DNA, 37 bp, Artificial Sequence
  Synthetic oligonucleotide
gcccacctctcccttcgcccacgttgccagttacgga

SEQ ID NO: 37250 - DNA, 35 bp, Artificial Sequence
  Synthetic oligonucleotide
ggagacatggtagggttcagtaagggcggggtgga

SEQ ID NO: 37251 - DNA, 37 bp, Artificial Sequence
  Synthetic oligonucleotide
aactaggtaagcgcaggtggagttatctgggggtgga

SEQ ID NO: 37252 - DNA, 38 bp, Artificial Sequence
  Synthetic oligonucleotide
acgctcacacgccggtggtcctcataatatcccattga

SEQ ID NO: 37253 - DNA, 37 bp, Artificial Sequence
  Synthetic oligonucleotide
gatctcgccagctgttacagcccctgtccctggttga

SEQ ID NO: 37254 - DNA, 36 bp, Artificial Sequence
  Synthetic oligonucleotide
gccaggtccacatcaccgtacccccaagcaggacta

SEQ ID NO: 37255 - DNA, 36 bp, Artificial Sequence
  Synthetic oligonucleotide
acctacccaaccccgactctgcgactttaagcctta

SEQ ID NO: 37256 - DNA, 35 bp, Artificial Sequence
  Synthetic oligonucleotide
tgccaccggactggcactttctagcgctaaaacac

SEQ ID NO: 37257 - DNA, 35 bp, Artificial Sequence
  Synthetic oligonucleotide
tacgcgttacgtatccttcgcattagctgtcaccc

SEQ ID NO: 37258 - DNA, 35 bp, Artificial Sequence
  Synthetic oligonucleotide
tctcccgcccatatcaaaacagaggacccgaagcc

SEQ ID NO: 37259 - DNA, 35 bp, Artificial Sequence
  Synthetic oligonucleotide
ataccgccatgagagtgttcctgcatttccgatcc

SEQ ID NO: 37260 - DNA, 35 bp, Artificial Sequence
  Synthetic oligonucleotide
atgacccattagttgctcttggtaacctgctttcc

SEQ ID NO: 37261 - DNA, 35 bp, Artificial Sequence
  Synthetic oligonucleotide
gaccccttgatggtaacatacattctcctgtttcc

SEQ ID NO: 37262 - DNA, 35 bp, Artificial Sequence
  Synthetic oligonucleotide
gcaccgacctcattgcacctcacgtatcttttacg

SEQ ID NO: 37263 - DNA, 35 bp, Artificial Sequence
  Synthetic oligonucleotide
ggggttggttggggtgtgcggtgggcagggtagcg

SEQ ID NO: 37264 - DNA, 35 bp, Artificial Sequence
  Synthetic oligonucleotide
tcagttagcccggcctatattcccgcccttccgat

SEQ ID NO: 37265 - DNA, 35 bp, Artificial Sequence
  Synthetic oligonucleotide
gcccgtaggaactgttctaccgtggcctttactat

SEQ ID NO: 37266 - DNA, 35 bp, Artificial Sequence
  Synthetic oligonucleotide
atcggatgtcactcattgcttaccaaccaccgtgt

SEQ ID NO: 37267 - DNA, 36 bp, Artificial Sequence
  Synthetic oligonucleotide
ttgtacggccccaccttgctttctatctcagcgtgt

SEQ ID NO: 37268 - DNA, 35 bp, Artificial Sequence
  Synthetic oligonucleotide
agtccaagccaccgtcctccaaatggcatgcactt

SEQ ID NO: 37269 - DNA, 35 bp, Artificial Sequence
  Synthetic oligonucleotide
gatacgacatcttatcctctgctcatggaccgctt

SEQ ID NO: 37270 - DNA, 35 bp, Artificial Sequence
  Synthetic oligonucleotide
gcaaccacaactcacgcctacggcccaggcgcaca

SEQ ID NO: 37271 - DNA, 36 bp, Artificial Sequence
  Synthetic oligonucleotide
gggacgccgcaaccctcccctgcgcactcccgccca

SEQ ID NO: 37272 - DNA, 36 bp, Artificial Sequence
  Synthetic oligonucleotide
ttcgcgctatcaattcgccctcatgcccagcaggca

SEQ ID NO: 37273 - DNA, 36 bp, Artificial Sequence
  Synthetic oligonucleotide
accctacactgcgcaccttgtttcctttaacgctca

SEQ ID NO: 37274 - DNA, 37 bp, Artificial Sequence
  Synthetic oligonucleotide
gtacacccccgacgatgagcttcgcccctcccgtaga

SEQ ID NO: 37275 - DNA, 37 bp, Artificial Sequence
  Synthetic oligonucleotide
atcggacggagttagggtaaaggaaggaggcggacga

SEQ ID NO: 37276 - DNA, 37 bp, Artificial Sequence
  Synthetic oligonucleotide
accacctccaccaagagcgaaatctcctgtcgtacga

SEQ ID NO: 37277 - DNA, 37 bp, Artificial Sequence
  Synthetic oligonucleotide
ataccttccgccccagttgcttcctgccccgtcccga

SEQ ID NO: 37278 - DNA, 37 bp, Artificial Sequence
  Synthetic oligonucleotide
aacgggcaaccctcggtaattttggatcgcctctcga

SEQ ID NO: 37279 - DNA, 38 bp, Artificial Sequence
  Synthetic oligonucleotide
gtcataggcagatttcctgatcccgtttttacacctga

SEQ ID NO: 37280 - DNA, 38 bp, Artificial Sequence
  Synthetic oligonucleotide
gacgaggagggtgattgaaagggcacagggaggcctga

SEQ ID NO: 37281 - DNA, 37 bp, Artificial Sequence
  Synthetic oligonucleotide
acgctggtccgaaattcacccctccgcacatctctga

SEQ ID NO: 37282 - DNA, 38 bp, Artificial Sequence
  Synthetic oligonucleotide
tcatcatcccacatattaacactcgaaccttcacgtga

SEQ ID NO: 37283 - DNA, 36 bp, Artificial Sequence
  Synthetic oligonucleotide
tcctcaccgcgcgtcgtaaacctgttcgtccctcta

SEQ ID NO: 37284 - DNA, 35 bp, Artificial Sequence
  Synthetic oligonucleotide
gccgaacccgcattatatatacatctggaacctta

SEQ ID NO: 37285 - DNA, 35 bp, Artificial Sequence
  Synthetic oligonucleotide
ttactccacctgagtgctgagcgcacttcctctac

SEQ ID NO: 37286 - DNA, 35 bp, Artificial Sequence
  Synthetic oligonucleotide
tacactgcaacacgtcttctgcactaattgatccc

SEQ ID NO: 37287 - DNA, 35 bp, Artificial Sequence
  Synthetic oligonucleotide
tcgggacccttcgcctgcaccgtatctccactccc

SEQ ID NO: 37288 - DNA, 35 bp, Artificial Sequence
  Synthetic oligonucleotide
aaaccgaaccattcccgctgtacatatgcagtgcc

SEQ ID NO: 37289 - DNA, 35 bp, Artificial Sequence
  Synthetic oligonucleotide
actcccctcgtgcctgacctggtgttatgctccgc

SEQ ID NO: 37290 - DNA, 35 bp, Artificial Sequence
  Synthetic oligonucleotide
gatcccttcccgtcacctggtcgctccgtgactgc

SEQ ID NO: 37291 - DNA, 35 bp, Artificial Sequence
  Synthetic oligonucleotide
agacatgccggcacccccctcacaatttgctgtgc

SEQ ID NO: 37292 - DNA, 35 bp, Artificial Sequence
  Synthetic oligonucleotide
tactacctgggccatatcttccgaagggatacatc

SEQ ID NO: 37293 - DNA, 35 bp, Artificial Sequence
  Synthetic oligonucleotide
tatgacgtgcgatcgtacccccctattcaatcaag

SEQ ID NO: 37294 - DNA, 35 bp, Artificial Sequence
  Synthetic oligonucleotide
ggacgcatgccagatttatttgtctccccccgttg

SEQ ID NO: 37295 - DNA, 35 bp, Artificial Sequence
  Synthetic oligonucleotide
ggtacgccccccttttgaccttgctcccagactat

SEQ ID NO: 37296 - DNA, 35 bp, Artificial Sequence
  Synthetic oligonucleotide
taaccgccacctaactcggactgtgttcgattact

SEQ ID NO: 37297 - DNA, 35 bp, Artificial Sequence
  Synthetic oligonucleotide
gccacctatcgagcccagtatgatcctgcgtgtct

SEQ ID NO: 37298 - DNA, 35 bp, Artificial Sequence
  Synthetic oligonucleotide
gttagccccgttgccatcctgcgaggactcatatt

SEQ ID NO: 37299 - DNA, 35 bp, Artificial Sequence
  Synthetic oligonucleotide
ttcatttgaccatcccccgcacgacccctctggtt

SEQ ID NO: 37300 - DNA, 35 bp, Artificial Sequence
  Synthetic oligonucleotide
tacgtgaagggggaaaggaagtcggtgagtgataa

SEQ ID NO: 37301 - DNA, 36 bp, Artificial Sequence
  Synthetic oligonucleotide
tcctcgccaagccattggactcccactgcatcccca

SEQ ID NO: 37302 - DNA, 36 bp, Artificial Sequence
  Synthetic oligonucleotide
tccctcgatcggtagatcgttactcaatgttggcca

SEQ ID NO: 37303 - DNA, 36 bp, Artificial Sequence
  Synthetic oligonucleotide
gttctgcccatatgtatcgctctgaccatcctgcca

SEQ ID NO: 37304 - DNA, 36 bp, Artificial Sequence
  Synthetic oligonucleotide
tctgcctgcctgttggtatccatcccttttagctca

SEQ ID NO: 37305 - DNA, 37 bp, Artificial Sequence
  Synthetic oligonucleotide
agaggccgcaaagcgcgggtggcgggaaaggaaagga

SEQ ID NO: 37306 - DNA, 37 bp, Artificial Sequence
  Synthetic oligonucleotide
gacggaaggagggcatggtgggggacctgtaacggga

SEQ ID NO: 37307 - DNA, 37 bp, Artificial Sequence
  Synthetic oligonucleotide
gattggacggtgaggggcttaacaacataaaagggga

SEQ ID NO: 37308 - DNA, 38 bp, Artificial Sequence
  Synthetic oligonucleotide
gtgcaagggaggtcgtggatcaaatggggagggtatga

SEQ ID NO: 37309 - DNA, 37 bp, Artificial Sequence
  Synthetic oligonucleotide
ggtagacctcagtgtcgctaccttacccctgttctga

SEQ ID NO: 37310 - DNA, 38 bp, Artificial Sequence
  Synthetic oligonucleotide
aactagcacgtgcgcatcatcttcccacttattggtga

SEQ ID NO: 37311 - DNA, 38 bp, Artificial Sequence
  Synthetic oligonucleotide
ggtccaacctcgagcttacgcaacgccgccccttgtga

SEQ ID NO: 37312 - DNA, 38 bp, Artificial Sequence
  Synthetic oligonucleotide
tgagccatcgggagcgctatgtcccattatcttcttga

SEQ ID NO: 37313 - DNA, 36 bp, Artificial Sequence
  Synthetic oligonucleotide
tcatcgcacatgtacgagagtgcctgacgacatgta

SEQ ID NO: 37314 - DNA, 35 bp, Artificial Sequence
  Synthetic oligonucleotide
tcgccggacgccatactcctgaacgattgctaaac

SEQ ID NO: 37315 - DNA, 35 bp, Artificial Sequence
  Synthetic oligonucleotide
attcgtaatgaacgccccgctgcccgctctctcac

SEQ ID NO: 37316 - DNA, 35 bp, Artificial Sequence
  Synthetic oligonucleotide
tgtgatcatggcaagcccgccccaattgctgccgc

SEQ ID NO: 37317 - DNA, 35 bp, Artificial Sequence
  Synthetic oligonucleotide
gtgcacacccatacgaacaaatctcgtcgttaatc

SEQ ID NO: 37318 - DNA, 35 bp, Artificial Sequence
  Synthetic oligonucleotide
tgactttcctcgctgcctggacgttcagccttctc

SEQ ID NO: 37319 - DNA, 35 bp, Artificial Sequence
  Synthetic oligonucleotide
gccacctccgacttagatgtcctcacttaactgtc

SEQ ID NO: 37320 - DNA, 35 bp, Artificial Sequence
  Synthetic oligonucleotide
gagacgccgcaaataggccattctgtttgacattc

SEQ ID NO: 37321 - DNA, 35 bp, Artificial Sequence
  Synthetic oligonucleotide
tgtgaagggtgaagggatttgtgctggtggtttag

SEQ ID NO: 37322 - DNA, 35 bp, Artificial Sequence
  Synthetic oligonucleotide
ttaccctctgccctttttacctacaccgagtctcg

SEQ ID NO: 37323 - DNA, 35 bp, Artificial Sequence
  Synthetic oligonucleotide
ggtgggggtcgggggaaggcgaagaaaggtgacat

SEQ ID NO: 37324 - DNA, 35 bp, Artificial Sequence
  Synthetic oligonucleotide
attgaagcctccccatgcctgcgcgagctgtaact

SEQ ID NO: 37325 - DNA, 36 bp, Artificial Sequence
  Synthetic oligonucleotide
agcccgccgactagatcacgctgtccgttcttcgct

SEQ ID NO: 37326 - DNA, 35 bp, Artificial Sequence
  Synthetic oligonucleotide
gccttcctccacgcttctgcggacaaccggtatct

SEQ ID NO: 37327 - DNA, 35 bp, Artificial Sequence
  Synthetic oligonucleotide
ttcactgccggcaagagcccgctaacgctcactct

SEQ ID NO: 37328 - DNA, 35 bp, Artificial Sequence
  Synthetic oligonucleotide
tatgactgcaggccgcagacttctaccgcatttct

SEQ ID NO: 37329 - DNA, 35 bp, Artificial Sequence
  Synthetic oligonucleotide
tacgcgagaccccgctgcctgaaccgcaaattcgt

SEQ ID NO: 37330 - DNA, 36 bp, Artificial Sequence
  Synthetic oligonucleotide
tcctcaccctggtactagattcggtacattccttaa

SEQ ID NO: 37331 - DNA, 35 bp, Artificial Sequence
  Synthetic oligonucleotide
gacacctcttagtcactcgtgactcttgccataca

SEQ ID NO: 37332 - DNA, 37 bp, Artificial Sequence
  Synthetic oligonucleotide
acacccctgcccacaacttttgttatgtgtcccagga

SEQ ID NO: 37333 - DNA, 35 bp, Artificial Sequence
  Synthetic oligonucleotide
atgaagccgaggctgtagcagggtgggtggcggga

SEQ ID NO: 37334 - DNA, 37 bp, Artificial Sequence
  Synthetic oligonucleotide
acaccgggggtgaatgtcatgaggctgtgcgggggga

SEQ ID NO: 37335 - DNA, 37 bp, Artificial Sequence
  Synthetic oligonucleotide
gcgacgaggatgaactgtggggagtaggatggtggga

SEQ ID NO: 37336 - DNA, 38 bp, Artificial Sequence
  Synthetic oligonucleotide
tacagggaggggggggtgcgaatttaatgcatcaatga

SEQ ID NO: 37337 - DNA, 37 bp, Artificial Sequence
  Synthetic oligonucleotide
gattgcacgatgaccagcgggcggggggaagggatga

SEQ ID NO: 37338 - DNA, 37 bp, Artificial Sequence
  Synthetic oligonucleotide
ttctcgccactgatcctcttgtcacataacactctga

SEQ ID NO: 37339 - DNA, 38 bp, Artificial Sequence
  Synthetic oligonucleotide
gtgaagggaataactggggcagagaggaggatcagtga

SEQ ID NO: 37340 - DNA, 37 bp, Artificial Sequence
  Synthetic oligonucleotide
ttagtagcccttgtctgtccctccactactcacgtga

SEQ ID NO: 37341 - DNA, 37 bp, Artificial Sequence
  Synthetic oligonucleotide
gataggaagggagtaaattaggggaaggttttggtga

SEQ ID NO: 37342 - DNA, 38 bp, Artificial Sequence
  Synthetic oligonucleotide
tgtgcccttgcccatccggcgtccccccgtacttgtga

SEQ ID NO: 37343 - DNA, 36 bp, Artificial Sequence
  Synthetic oligonucleotide
agacacgcgcgagggaaggtaggtcgtgcgggaata

SEQ ID NO: 37344 - DNA, 36 bp, Artificial Sequence
  Synthetic oligonucleotide
aacgagtgtagaaagaagggatcaaagagcggagta

SEQ ID NO: 37345 - DNA, 35 bp, Artificial Sequence
  Synthetic oligonucleotide
atcgccgcattcgcacatcctgtttcatgctacac

SEQ ID NO: 37346 - DNA, 35 bp, Artificial Sequence
  Synthetic oligonucleotide
gcgccatagctgataacattcgccggaacaccccc

SEQ ID NO: 37347 - DNA, 35 bp, Artificial Sequence
  Synthetic oligonucleotide
tcttgtacgtaggctcgggatcgcgaccatctgcc

SEQ ID NO: 37348 - DNA, 35 bp, Artificial Sequence
  Synthetic oligonucleotide
agttgagccatcatcgatcatctacgcctgaaatc

SEQ ID NO: 37349 - DNA, 35 bp, Artificial Sequence
  Synthetic oligonucleotide
ataacgggagaaagggccagggggggtggtgtaag

SEQ ID NO: 37350 - DNA, 35 bp, Artificial Sequence
  Synthetic oligonucleotide
acgccaagcattctcgcgcgctgactctgtcacct

SEQ ID NO: 37351 - DNA, 35 bp, Artificial Sequence
  Synthetic oligonucleotide
aatcagccgtaactgtcttacttgcacaactggct

SEQ ID NO: 37352 - DNA, 36 bp, Artificial Sequence
  Synthetic oligonucleotide
actcgcaactccaggttcagccaagtgcccttctaa

SEQ ID NO: 37353 - DNA, 36 bp, Artificial Sequence
  Synthetic oligonucleotide
tgcacgtagcctcgaccagccggcctacctgcttaa

SEQ ID NO: 37354 - DNA, 36 bp, Artificial Sequence
  Synthetic oligonucleotide
tacatcacctctcgaccgtctgaaacgggggtccca

SEQ ID NO: 37355 - DNA, 35 bp, Artificial Sequence
  Synthetic oligonucleotide
ccctactcggaatcgcgaacttgcacctggctcca

SEQ ID NO: 37356 - DNA, 37 bp, Artificial Sequence
  Synthetic oligonucleotide
gagggtgggtggggggctaccggagtggcgataggga

SEQ ID NO: 37357 - DNA, 37 bp, Artificial Sequence
  Synthetic oligonucleotide
gcatgccccaccacatttctgattaagacgtccggga

SEQ ID NO: 37358 - DNA, 38 bp, Artificial Sequence
  Synthetic oligonucleotide
tacgacaccgctccacccacaccattcgagccccatga

SEQ ID NO: 37359 - DNA, 35 bp, Artificial Sequence
  Synthetic oligonucleotide
atgcaggtgctgtgtcggtggggtgggggggatga

SEQ ID NO: 37360 - DNA, 36 bp, Artificial Sequence
  Synthetic oligonucleotide
tcctctacaggtgcgtccagcactacctcatcctga

SEQ ID NO: 37361 - DNA, 36 bp, Artificial Sequence
  Synthetic oligonucleotide
acctccgtcccatcgcccagctgagagttcctctga

SEQ ID NO: 37362 - DNA, 38 bp, Artificial Sequence
  Synthetic oligonucleotide
gcccgcctccgctaatcacttgaaccaggtcgccttga

SEQ ID NO: 37363 - DNA, 37 bp, Artificial Sequence
  Synthetic oligonucleotide
tccttcacccgcaggatgcgtgggtctcccctgttga

SEQ ID NO: 37364 - DNA, 35 bp, Artificial Sequence
  Synthetic oligonucleotide
tatgccaccaactcacatttgtagataatgtgata

SEQ ID NO: 37365 - DNA, 36 bp, Artificial Sequence
  Synthetic oligonucleotide
tgccattggcgcacttgttacccgtctgctcttata

SEQ ID NO: 37366 - DNA, 36 bp, Artificial Sequence
  Synthetic oligonucleotide
agagtgttcacgcataaccccccgtactgttcccta

SEQ ID NO: 37367 - DNA, 35 bp, Artificial Sequence
  Synthetic oligonucleotide
gcggacccaccgttgctcaccctatcgtagtgaac

SEQ ID NO: 37368 - DNA, 35 bp, Artificial Sequence
  Synthetic oligonucleotide
tctatcgctcgcccgccaggaaaccacttgctcac

SEQ ID NO: 37369 - DNA, 35 bp, Artificial Sequence
  Synthetic oligonucleotide
gtggctccagccaattcacttcttttgggtctccc

SEQ ID NO: 37370 - DNA, 35 bp, Artificial Sequence
  Synthetic oligonucleotide
ttgttccaccccgcctatgtgccgttgccgctgcc

SEQ ID NO: 37371 - DNA, 35 bp, Artificial Sequence
  Synthetic oligonucleotide
gggaagccatagtctcccgccgctcgccgtatcgc

SEQ ID NO: 37372 - DNA, 35 bp, Artificial Sequence
  Synthetic oligonucleotide
tgcccgtcacgttaccgttgtcttccgtcatctcg

SEQ ID NO: 37373 - DNA, 35 bp, Artificial Sequence
  Synthetic oligonucleotide
attggggggtggtagcgggaaactggcatccggtg

SEQ ID NO: 37374 - DNA, 34 bp, Artificial Sequence
  Synthetic oligonucleotide
tcatcctgttcgctagttcgttctgcctgaatat

SEQ ID NO: 37375 - DNA, 35 bp, Artificial Sequence
  Synthetic oligonucleotide
ccaacgtcgacatcttgccttgactgtacccccct

SEQ ID NO: 37376 - DNA, 35 bp, Artificial Sequence
  Synthetic oligonucleotide
gacgcgggtaaagccagaaaggcaaggtgggtggt

SEQ ID NO: 37377 - DNA, 35 bp, Artificial Sequence
  Synthetic oligonucleotide
tcgtgccacccagatatttgtcgcttcggtccatt

SEQ ID NO: 37378 - DNA, 35 bp, Artificial Sequence
  Synthetic oligonucleotide
tgggtcgcagaggaccagcgatagcgactcgcctt

SEQ ID NO: 37379 - DNA, 36 bp, Artificial Sequence
  Synthetic oligonucleotide
tgaaccaaggaggggactgatagacagagggatgaa

SEQ ID NO: 37380 - DNA, 36 bp, Artificial Sequence
  Synthetic oligonucleotide
gagcaggcaggagaggctggcgggcgggatttataa

SEQ ID NO: 37381 - DNA, 35 bp, Artificial Sequence
  Synthetic oligonucleotide
accaccactggactgcccatgatcacaccatttaa

SEQ ID NO: 37382 - DNA, 35 bp, Artificial Sequence
  Synthetic oligonucleotide
aacccgccgttttcctgtttcttaacgtggtccca

SEQ ID NO: 37383 - DNA, 34 bp, Artificial Sequence
  Synthetic oligonucleotide
gcgatcacaccgtaacggtccagcccaacttgca

SEQ ID NO: 37384 - DNA, 35 bp, Artificial Sequence
  Synthetic oligonucleotide
aacctgtgctcgcttcaccatccttttttgtctca

SEQ ID NO: 37385 - DNA, 37 bp, Artificial Sequence
  Synthetic oligonucleotide
gcaccacgcccaggggccatccaaacgttccaacaga

SEQ ID NO: 37386 - DNA, 37 bp, Artificial Sequence
  Synthetic oligonucleotide
agcgaagcgtgctgccacctttaaatgccttactcga

SEQ ID NO: 37387 - DNA, 36 bp, Artificial Sequence
  Synthetic oligonucleotide
atcgactatccccaaatcgtgagtcacctccttcga

SEQ ID NO: 37388 - DNA, 37 bp, Artificial Sequence
  Synthetic oligonucleotide
tgttgtacgaagggtagggaggggggaggcgtaagga

SEQ ID NO: 37389 - DNA, 38 bp, Artificial Sequence
  Synthetic oligonucleotide
tagcagatccccgtgcttatgctgctctccgattctga

SEQ ID NO: 37390 - DNA, 37 bp, Artificial Sequence
  Synthetic oligonucleotide
tgtgccgtgccatccgcactcaacactaactctgtga

SEQ ID NO: 37391 - DNA, 36 bp, Artificial Sequence
  Synthetic oligonucleotide
ggagacatcagacacacacatcgcctttcccgttga

SEQ ID NO: 37392 - DNA, 38 bp, Artificial Sequence
  Synthetic oligonucleotide
tccccatcctcgacaactatggttgtgtcccctgttga

SEQ ID NO: 37393 - DNA, 38 bp, Artificial Sequence
  Synthetic oligonucleotide
gcaggtccggctgcttaggcattcccctttcctgttga

SEQ ID NO: 37394 - DNA, 36 bp, Artificial Sequence
  Synthetic oligonucleotide
tctggggggaggatactttacggggggacggtgcta

SEQ ID NO: 37395 - DNA, 36 bp, Artificial Sequence
  Synthetic oligonucleotide
tgtaaccctcacctatgccacgagtattagtctcta

SEQ ID NO: 37396 - DNA, 35 bp, Artificial Sequence
  Synthetic oligonucleotide
gtcggggtgggaggggtgaatcatagggtacctta

SEQ ID NO: 37397 - DNA, 36 bp, Artificial Sequence
  Synthetic oligonucleotide
tcccggaccgaccgtacaatggtgtcgtctctctta

SEQ ID NO: 37398 - DNA, 36 bp, Artificial Sequence
  Synthetic oligonucleotide
gcaaaccgcattgttttccgtcctttcacgcattta

SEQ ID NO: 37399 - DNA, 35 bp, Artificial Sequence
  Synthetic oligonucleotide
accggttcccggtcgaggcccttgaactacctcac

SEQ ID NO: 37400 - DNA, 35 bp, Artificial Sequence
  Synthetic oligonucleotide
tatgccgggcgcaccaagctcgcctggtccacccc

SEQ ID NO: 37401 - DNA, 35 bp, Artificial Sequence
  Synthetic oligonucleotide
acgcactcctaagacgcctccttatgcacgccccc

SEQ ID NO: 37402 - DNA, 35 bp, Artificial Sequence
  Synthetic oligonucleotide
tgccttaactgcggtacgcgtgctgcacctttgcc

SEQ ID NO: 37403 - DNA, 35 bp, Artificial Sequence
  Synthetic oligonucleotide
tcttaagcgggttcactcttctttgtcctgtcctc

SEQ ID NO: 37404 - DNA, 35 bp, Artificial Sequence
  Synthetic oligonucleotide
tcaccatcccgccatagtactcggtatctggtttc

SEQ ID NO: 37405 - DNA, 35 bp, Artificial Sequence
  Synthetic oligonucleotide
gttcagcacaaatcaatcataatgtccacttgtag

SEQ ID NO: 37406 - DNA, 35 bp, Artificial Sequence
  Synthetic oligonucleotide
ttgggaagaacgacttggacgtgggggttgggagg

SEQ ID NO: 37407 - DNA, 35 bp, Artificial Sequence
  Synthetic oligonucleotide
gaaccatctcggcccgactaccccgccattcatgg

SEQ ID NO: 37408 - DNA, 35 bp, Artificial Sequence
  Synthetic oligonucleotide
gatgatccgcagggtccactccatgcgcccccaat

SEQ ID NO: 37409 - DNA, 35 bp, Artificial Sequence
  Synthetic oligonucleotide
agcatccgctgagtgcccgtaattcactgtttcct

SEQ ID NO: 37410 - DNA, 33 bp, Artificial Sequence
  Synthetic oligonucleotide
gttgcccccaatctttgtttgttcctgagcttt

SEQ ID NO: 37411 - DNA, 35 bp, Artificial Sequence
  Synthetic oligonucleotide
gcacgtgccacttaatctggtgtatctcgctccaa

SEQ ID NO: 37412 - DNA, 35 bp, Artificial Sequence
  Synthetic oligonucleotide
tactgcacacgatgcatcacttacccgtgtttgaa

SEQ ID NO: 37413 - DNA, 36 bp, Artificial Sequence
  Synthetic oligonucleotide
gttgcgcccagttcggaattacgtaatgctgccaca

SEQ ID NO: 37414 - DNA, 35 bp, Artificial Sequence
  Synthetic oligonucleotide
ttgaggcgagtcgctcactgcaacaccaccagaca

SEQ ID NO: 37415 - DNA, 36 bp, Artificial Sequence
  Synthetic oligonucleotide
tgcgaactagctcctccgtggaatgtgccacttaca

SEQ ID NO: 37416 - DNA, 36 bp, Artificial Sequence
  Synthetic oligonucleotide
gattccagcgttacctctgctaccatcatcgttaca

SEQ ID NO: 37417 - DNA, 35 bp, Artificial Sequence
  Synthetic oligonucleotide
gcgccgttccaccatggcacatcgactttatgtca

SEQ ID NO: 37418 - DNA, 37 bp, Artificial Sequence
  Synthetic oligonucleotide
atgtcgggatgagggaaatggcgggcggggagataga

SEQ ID NO: 37419 - DNA, 37 bp, Artificial Sequence
  Synthetic oligonucleotide
gacgggcctgtgttcccgtcacctcttttctcttaga

SEQ ID NO: 37420 - DNA, 37 bp, Artificial Sequence
  Synthetic oligonucleotide
gcagggtagtgggtaatggggtagaatggaaggcgga

SEQ ID NO: 37421 - DNA, 37 bp, Artificial Sequence
  Synthetic oligonucleotide
taacctaccccccctgtatatgtccgcttaaggcgga

SEQ ID NO: 37422 - DNA, 37 bp, Artificial Sequence
  Synthetic oligonucleotide
gcacctccggggcacgagtttaggacggaacgatgga

SEQ ID NO: 37423 - DNA, 38 bp, Artificial Sequence
  Synthetic oligonucleotide
tctctgccccgcctattccccgccaggtcaatttatga

SEQ ID NO: 37424 - DNA, 38 bp, Artificial Sequence
  Synthetic oligonucleotide
accacatctcgctcattatcggtagacctcattactga

SEQ ID NO: 37425 - DNA, 38 bp, Artificial Sequence
  Synthetic oligonucleotide
acaaatcagctgtcccatctctactcacatgaccctga

SEQ ID NO: 37426 - DNA, 38 bp, Artificial Sequence
  Synthetic oligonucleotide
tagagcccggcccgcacacgcaccccctgactgcctga

SEQ ID NO: 37427 - DNA, 37 bp, Artificial Sequence
  Synthetic oligonucleotide
gcgctctgtcgccttccgttctttggatcattcctga

SEQ ID NO: 37428 - DNA, 38 bp, Artificial Sequence
  Synthetic oligonucleotide
ttacccggtccgggtgatgtccacttctcctttgctga

SEQ ID NO: 37429 - DNA, 38 bp, Artificial Sequence
  Synthetic oligonucleotide
acagggtgcgcacactgcatcttgttatttcaccttga

SEQ ID NO: 37430 - DNA, 38 bp, Artificial Sequence
  Synthetic oligonucleotide
tgccaaccaactccccacgacgacaaaagtccttttga

SEQ ID NO: 37431 - DNA, 36 bp, Artificial Sequence
  Synthetic oligonucleotide
gtcatgaccagcaggttcaccccacactactaaata

SEQ ID NO: 37432 - DNA, 36 bp, Artificial Sequence
  Synthetic oligonucleotide
gcacattcccgcccgcatactattttatgatacata

SEQ ID NO: 37433 - DNA, 35 bp, Artificial Sequence
  Synthetic oligonucleotide
gcatccaccaaggtctctcatcgcaccagttgata

SEQ ID NO: 37434 - DNA, 35 bp, Artificial Sequence
  Synthetic oligonucleotide
tcagacccagtgctccaacgttaatcgtcattcac

SEQ ID NO: 37435 - DNA, 35 bp, Artificial Sequence
  Synthetic oligonucleotide
gaaacgccgatgttaaacggctacattcttcttac

SEQ ID NO: 37436 - DNA, 35 bp, Artificial Sequence
  Synthetic oligonucleotide
gttccacaccataaactgccccctaagaggctccc

SEQ ID NO: 37437 - DNA, 35 bp, Artificial Sequence
  Synthetic oligonucleotide
aagcccgccggacggcatcacaatatagtttttcc

SEQ ID NO: 37438 - DNA, 35 bp, Artificial Sequence
  Synthetic oligonucleotide
tatgcacggttataccggactccgctaacgcccgc

SEQ ID NO: 37439 - DNA, 35 bp, Artificial Sequence
  Synthetic oligonucleotide
gcctaccgacctagtcctgtttgggtcggtccctc

SEQ ID NO: 37440 - DNA, 35 bp, Artificial Sequence
  Synthetic oligonucleotide
gaccaccgttcgcttatagatttctgacatcgctc

SEQ ID NO: 37441 - DNA, 35 bp, Artificial Sequence
  Synthetic oligonucleotide
ttgagcgtactgtactcatcatcgtgctctatccg

SEQ ID NO: 37442 - DNA, 35 bp, Artificial Sequence
  Synthetic oligonucleotide
aacaccagagcgtgggtaggtgggaccaaagggcg

SEQ ID NO: 37443 - DNA, 35 bp, Artificial Sequence
  Synthetic oligonucleotide
atagcgcccccgacgaacctatcccgaaacttgcg

SEQ ID NO: 37444 - DNA, 35 bp, Artificial Sequence
  Synthetic oligonucleotide
gtgctaggagagcaagtggagaagcagatgggggg

SEQ ID NO: 37445 - DNA, 35 bp, Artificial Sequence
  Synthetic oligonucleotide
gaagtccggccggttgcatctgcccccaattcttg

SEQ ID NO: 37446 - DNA, 36 bp, Artificial Sequence
  Synthetic oligonucleotide
aagaggaggggatacgggaatcagtggtgagaaaat

SEQ ID NO: 37447 - DNA, 35 bp, Artificial Sequence
  Synthetic oligonucleotide
atacggacccaaaccacacctgacgagctatacct

SEQ ID NO: 37448 - DNA, 35 bp, Artificial Sequence
  Synthetic oligonucleotide
acactcggtgcgttgacttgactttgctcctctct

SEQ ID NO: 37449 - DNA, 35 bp, Artificial Sequence
  Synthetic oligonucleotide
gtgcgcatcgctggttctctattatttttgattct

SEQ ID NO: 37450 - DNA, 36 bp, Artificial Sequence
  Synthetic oligonucleotide
atcctaacccgatccacgcctcacaatgattaggaa

SEQ ID NO: 37451 - DNA, 36 bp, Artificial Sequence
  Synthetic oligonucleotide
gaccaccatccctgcactacgtacgtgagccctgaa

SEQ ID NO: 37452 - DNA, 36 bp, Artificial Sequence
  Synthetic oligonucleotide
ttaccccggcggctctcacgagtcgcaaatccacca

SEQ ID NO: 37453 - DNA, 35 bp, Artificial Sequence
  Synthetic oligonucleotide
gacacaccgcgctattctcacttaattaaggtcca

SEQ ID NO: 37454 - DNA, 36 bp, Artificial Sequence
  Synthetic oligonucleotide
tcattgtacaatctgtttgctaaggcaccaattcca

SEQ ID NO: 37455 - DNA, 37 bp, Artificial Sequence
  Synthetic oligonucleotide
gaggtgcaaggggatgggcggtattggggtagtacga

SEQ ID NO: 37456 - DNA, 36 bp, Artificial Sequence
  Synthetic oligonucleotide
tcaacacgcaagcctgtctacctcccttctgtggga

SEQ ID NO: 37457 - DNA, 36 bp, Artificial Sequence
  Synthetic oligonucleotide
gatgccgtaggcaggtaggagcgaggtatccttgga

SEQ ID NO: 37458 - DNA, 38 bp, Artificial Sequence
  Synthetic oligonucleotide
gaccagcccccttgaccgtagtcacggtgacaccctga

SEQ ID NO: 37459 - DNA, 37 bp, Artificial Sequence
  Synthetic oligonucleotide
acatccagggagactaggaacgggaaggtgggggtga

SEQ ID NO: 37460 - DNA, 38 bp, Artificial Sequence
  Synthetic oligonucleotide
taacacccctcatggctatctacgtaaacccgttgtga

SEQ ID NO: 37461 - DNA, 38 bp, Artificial Sequence
  Synthetic oligonucleotide
tctggtgcaggaatggtaaaaaaaggggagagagttga

SEQ ID NO: 37462 - DNA, 36 bp, Artificial Sequence
  Synthetic oligonucleotide
aatccgcacccgcaaacatttttcgctgggacacta

SEQ ID NO: 37463 - DNA, 34 bp, Artificial Sequence
  Synthetic oligonucleotide
tcacctgcggaccaccctcgcccatagagtgcta

SEQ ID NO: 37464 - DNA, 35 bp, Artificial Sequence
  Synthetic oligonucleotide
tcccatgcaccagctggatggggcccaccgcacac

SEQ ID NO: 37465 - DNA, 35 bp, Artificial Sequence
  Synthetic oligonucleotide
tctagccgacggacctctattgtccccaccctcac

SEQ ID NO: 37466 - DNA, 35 bp, Artificial Sequence
  Synthetic oligonucleotide
gtgacgattctttagagtgttccatccttgccccc

SEQ ID NO: 37467 - DNA, 35 bp, Artificial Sequence
  Synthetic oligonucleotide
ttggtctgtctatacttccacgtttcatggcctcc

SEQ ID NO: 37468 - DNA, 35 bp, Artificial Sequence
  Synthetic oligonucleotide
gaccgtgctaccatcagcgcccactgaaccatatc

SEQ ID NO: 37469 - DNA, 35 bp, Artificial Sequence
  Synthetic oligonucleotide
acacctcctcggtcgtccagagccatcacttacgg

SEQ ID NO: 37470 - DNA, 35 bp, Artificial Sequence
  Synthetic oligonucleotide
attagcctcctgcctcaaacgtttcatgcatactg

SEQ ID NO: 37471 - DNA, 35 bp, Artificial Sequence
  Synthetic oligonucleotide
ggatgcacatctccgccctcactcatgatctccct

SEQ ID NO: 37472 - DNA, 33 bp, Artificial Sequence
  Synthetic oligonucleotide
taccgctgacaggatcatctccatcaccctaaa

SEQ ID NO: 37473 - DNA, 36 bp, Artificial Sequence
  Synthetic oligonucleotide
gtcagaccccgccagccggttccatatcgtccgcaa

SEQ ID NO: 37474 - DNA, 36 bp, Artificial Sequence
  Synthetic oligonucleotide
tcccccttgccgatgttgcccatgttcgggtctcaa

SEQ ID NO: 37475 - DNA, 35 bp, Artificial Sequence
  Synthetic oligonucleotide
cacaacagaacctgcactcacccgaccgccgcaca

SEQ ID NO: 37476 - DNA, 37 bp, Artificial Sequence
  Synthetic oligonucleotide
tcctcacccgtcctgggggtgttttccactctaacga

SEQ ID NO: 37477 - DNA, 37 bp, Artificial Sequence
  Synthetic oligonucleotide
taaaggagcagtgggggtagggacggtctagcgacga

SEQ ID NO: 37478 - DNA, 37 bp, Artificial Sequence
  Synthetic oligonucleotide
gagaatatggacggaaggcggaagggtcgtcggtcga

SEQ ID NO: 37479 - DNA, 37 bp, Artificial Sequence
  Synthetic oligonucleotide
atcgttcccatcgccctctaattcgtcccaagtggga

SEQ ID NO: 37480 - DNA, 37 bp, Artificial Sequence
  Synthetic oligonucleotide
tgctagcaacgtacgccctctgcagactatagctgga

SEQ ID NO: 37481 - DNA, 37 bp, Artificial Sequence
  Synthetic oligonucleotide
tccgacaccccgtacgctctatccggtcccagcctga

SEQ ID NO: 37482 - DNA, 38 bp, Artificial Sequence
  Synthetic oligonucleotide
ttgacaccgcccactcgccttcataaataacatggtga

SEQ ID NO: 37483 - DNA, 37 bp, Artificial Sequence
  Synthetic oligonucleotide
acacgccgtttgtaattcgcccgttcattgcccttga

SEQ ID NO: 37484 - DNA, 38 bp, Artificial Sequence
  Synthetic oligonucleotide
taggatgcagcctctcttgccgccgaaacctcccttga

SEQ ID NO: 37485 - DNA, 37 bp, Artificial Sequence
  Synthetic oligonucleotide
attagggccagacctccccgtactcgcctcctcttga

SEQ ID NO: 37486 - DNA, 35 bp, Artificial Sequence
  Synthetic oligonucleotide
gatccccgctatggactgaagattttggttccacc

SEQ ID NO: 37487 - DNA, 35 bp, Artificial Sequence
  Synthetic oligonucleotide
tctccgggcaacgcttacgtcgctccccatggtcc

SEQ ID NO: 37488 - DNA, 35 bp, Artificial Sequence
  Synthetic oligonucleotide
atgctaggctgcctcccctttcgctacaatattcc

SEQ ID NO: 37489 - DNA, 35 bp, Artificial Sequence
  Synthetic oligonucleotide
ttggtgggcactggggaattggggtgcacaggggc

SEQ ID NO: 37490 - DNA, 35 bp, Artificial Sequence
  Synthetic oligonucleotide
tgcactcccacgcgtctcatccgggcttgtcgctc

SEQ ID NO: 37491 - DNA, 35 bp, Artificial Sequence
  Synthetic oligonucleotide
gatagtgcaccatggacaagtaacaccctcacccg

SEQ ID NO: 37492 - DNA, 35 bp, Artificial Sequence
  Synthetic oligonucleotide
attaccagaaaggggggggcggaaggataggctcg

SEQ ID NO: 37493 - DNA, 35 bp, Artificial Sequence
  Synthetic oligonucleotide
tcagacgaaaagtgaagggaacggtagatagctgg

SEQ ID NO: 37494 - DNA, 35 bp, Artificial Sequence
  Synthetic oligonucleotide
atcgcgctggcacaatcctggaccgttccaaccct

SEQ ID NO: 37495 - DNA, 35 bp, Artificial Sequence
  Synthetic oligonucleotide
gccgggaagcagcttacaataataccaccgtggct

SEQ ID NO: 37496 - DNA, 35 bp, Artificial Sequence
  Synthetic oligonucleotide
ggagagggccaaagtaagggaggatctgagtcatt

SEQ ID NO: 37497 - DNA, 36 bp, Artificial Sequence
  Synthetic oligonucleotide
atgggagtggaacgcgtggagggcttcggtgaggaa

SEQ ID NO: 37498 - DNA, 36 bp, Artificial Sequence
  Synthetic oligonucleotide
tgcaccggaatctgcccccgtatcaacactgtccca

SEQ ID NO: 37499 - DNA, 36 bp, Artificial Sequence
  Synthetic oligonucleotide
tgagtgtcctgctgcccacaggcctttatcttgcca

SEQ ID NO: 37500 - DNA, 36 bp, Artificial Sequence
  Synthetic oligonucleotide
gccgttacgccagtcgatctttaccttgttctttca

SEQ ID NO: 37501 - DNA, 37 bp, Artificial Sequence
  Synthetic oligonucleotide
gattcgcccctccagctagccctttctccgtcgtaga

SEQ ID NO: 37502 - DNA, 37 bp, Artificial Sequence
  Synthetic oligonucleotide
gtaagaccagggaaatgaggagactggggggtggcga

SEQ ID NO: 37503 - DNA, 37 bp, Artificial Sequence
  Synthetic oligonucleotide
tcaataccgcaactatgcttcccctcttttggacgga

SEQ ID NO: 37504 - DNA, 37 bp, Artificial Sequence
  Synthetic oligonucleotide
gccatcaaccatccgcccttcacatcccgcttgtgga

SEQ ID NO: 37505 - DNA, 38 bp, Artificial Sequence
  Synthetic oligonucleotide
acttcaccccttccctgaatgctattaagtcattatga

SEQ ID NO: 37506 - DNA, 38 bp, Artificial Sequence
  Synthetic oligonucleotide
gtccgtccgggagagcggggggaggcgtactgcggtga

SEQ ID NO: 37507 - DNA, 38 bp, Artificial Sequence
  Synthetic oligonucleotide
gaccgtgcccctacttctacgccatgacaattcattga

SEQ ID NO: 37508 - DNA, 35 bp, Artificial Sequence
  Synthetic oligonucleotide
actgggacacacgcacccctctttttatcagacta

SEQ ID NO: 37509 - DNA, 36 bp, Artificial Sequence
  Synthetic oligonucleotide
tccgaggcctggacccccgacactcgccctttccta

SEQ ID NO: 37510 - DNA, 35 bp, Artificial Sequence
  Synthetic oligonucleotide
tgcatccaccctgattttggcgcactttctgagta

SEQ ID NO: 37511 - DNA, 36 bp, Artificial Sequence
  Synthetic oligonucleotide
gatccccaggtactttgtatttgcgcccctctttta

SEQ ID NO: 37512 - DNA, 36 bp, Artificial Sequence
  Synthetic oligonucleotide
tgttccaactcagctgtgccgctaccatgtcgtcac

SEQ ID NO: 37513 - DNA, 35 bp, Artificial Sequence
  Synthetic oligonucleotide
tctacctctgacccgttagagcaccctatatcccc

SEQ ID NO: 37514 - DNA, 35 bp, Artificial Sequence
  Synthetic oligonucleotide
ttgcctccccgtcccgtttaggtagatcggcttcc

SEQ ID NO: 37515 - DNA, 35 bp, Artificial Sequence
  Synthetic oligonucleotide
atccatctctgctagagttccttacacaagggttc

SEQ ID NO: 37516 - DNA, 35 bp, Artificial Sequence
  Synthetic oligonucleotide
gcgagtagagtttgggggcgggggggagtggatgg

SEQ ID NO: 37517 - DNA, 35 bp, Artificial Sequence
  Synthetic oligonucleotide
tctcacctcacgatacaatgcagactctcccactg

SEQ ID NO: 37518 - DNA, 35 bp, Artificial Sequence
  Synthetic oligonucleotide
gttcgcccgttcgtccgctggtaatatcctccgtg

SEQ ID NO: 37519 - DNA, 35 bp, Artificial Sequence
  Synthetic oligonucleotide
tcgagctctgttctcccgcatctgttctcacgcct

SEQ ID NO: 37520 - DNA, 35 bp, Artificial Sequence
  Synthetic oligonucleotide
ttccaccttggctgtaccggtaccccaccctggct

SEQ ID NO: 37521 - DNA, 35 bp, Artificial Sequence
  Synthetic oligonucleotide
atcgaagtcagagctgctcatgatcgcccccactt

SEQ ID NO: 37522 - DNA, 36 bp, Artificial Sequence
  Synthetic oligonucleotide
gcgagacctaatggtcggggggtgggaagggggcaa

SEQ ID NO: 37523 - DNA, 36 bp, Artificial Sequence
  Synthetic oligonucleotide
ggagtcccgcgggccactcccgaccccacccactaa

SEQ ID NO: 37524 - DNA, 35 bp, Artificial Sequence
  Synthetic oligonucleotide
ttgcccacagattcgtccgcgctgatattacccca

SEQ ID NO: 37525 - DNA, 35 bp, Artificial Sequence
  Synthetic oligonucleotide
gaacgtcctggtccactcaatccctgttctcccca

SEQ ID NO: 37526 - DNA, 36 bp, Artificial Sequence
  Synthetic oligonucleotide
taaccccgtatcctggcacccttttcctaatggtca

SEQ ID NO: 37527 - DNA, 37 bp, Artificial Sequence
  Synthetic oligonucleotide
aagtactaccgccgctggcccccgctatcgctcccga

SEQ ID NO: 37528 - DNA, 37 bp, Artificial Sequence
  Synthetic oligonucleotide
gagggaaaacagaaggaagaaacacgggtcacaggga

SEQ ID NO: 37529 - DNA, 37 bp, Artificial Sequence
  Synthetic oligonucleotide
aacactgggcgttggggctaacatggggatgctggga

SEQ ID NO: 37530 - DNA, 38 bp, Artificial Sequence
  Synthetic oligonucleotide
taccacccctgcatagttccacaacaagtcccaactga

SEQ ID NO: 37531 - DNA, 38 bp, Artificial Sequence
  Synthetic oligonucleotide
gaaaccacccgagtgcggccccgagcccttatgcctga

SEQ ID NO: 37532 - DNA, 38 bp, Artificial Sequence
  Synthetic oligonucleotide
gactccgatccatgtttgtggacatactcttcctctga

SEQ ID NO: 37533 - DNA, 38 bp, Artificial Sequence
  Synthetic oligonucleotide
ttcaaccacctaacgccgacgccttcactttgtagtga

SEQ ID NO: 37534 - DNA, 38 bp, Artificial Sequence
  Synthetic oligonucleotide
atggggggaacgaggagaattcggagtaacattagtga

SEQ ID NO: 37535 - DNA, 38 bp, Artificial Sequence
  Synthetic oligonucleotide
gatggaggagggatggaagactatggaaggggatgtga

SEQ ID NO: 37536 - DNA, 37 bp, Artificial Sequence
  Synthetic oligonucleotide
tgagtccccgcattcctcatttttcgtagccatttga

SEQ ID NO: 37537 - DNA, 35 bp, Artificial Sequence
  Synthetic oligonucleotide
ggacccatctctcggcctaccatgaatcactgcta

SEQ ID NO: 37538 - DNA, 36 bp, Artificial Sequence
  Synthetic oligonucleotide
gcacccgcaagctgtccgccacccatgcctgctcta

SEQ ID NO: 37539 - DNA, 36 bp, Artificial Sequence
  Synthetic oligonucleotide
agacacagccagccctcacacaacaacagccgtcta

SEQ ID NO: 37540 - DNA, 35 bp, Artificial Sequence
  Synthetic oligonucleotide
tcagtgctaccctgcttaaactaccgtgtgtacac

SEQ ID NO: 37541 - DNA, 35 bp, Artificial Sequence
  Synthetic oligonucleotide
atgcccgcattggaggctgccgataaaacttgccc

SEQ ID NO: 37542 - DNA, 35 bp, Artificial Sequence
  Synthetic oligonucleotide
tgcggccacttcgactctgcctaaccagttcttgc

SEQ ID NO: 37543 - DNA, 35 bp, Artificial Sequence
  Synthetic oligonucleotide
atcaacccacagagcgtaccccatggtgattcatc

SEQ ID NO: 37544 - DNA, 35 bp, Artificial Sequence
  Synthetic oligonucleotide
tatttagcgcacaccactctcccggaacgtttatc

SEQ ID NO: 37545 - DNA, 35 bp, Artificial Sequence
  Synthetic oligonucleotide
gacacctgccacgatacacctgcccgtatttgttc

SEQ ID NO: 37546 - DNA, 35 bp, Artificial Sequence
  Synthetic oligonucleotide
acatgggattggctccctactgcgtaccacatttc

SEQ ID NO: 37547 - DNA, 35 bp, Artificial Sequence
  Synthetic oligonucleotide
tccaccaccccccattcagaagaaacctgtcatag

SEQ ID NO: 37548 - DNA, 35 bp, Artificial Sequence
  Synthetic oligonucleotide
gaaccaccaccaccgtaagcgttcgagacacaagg

SEQ ID NO: 37549 - DNA, 35 bp, Artificial Sequence
  Synthetic oligonucleotide
agcccggctatcacccactccctcttcgacggaat

SEQ ID NO: 37550 - DNA, 35 bp, Artificial Sequence
  Synthetic oligonucleotide
tagcaaccccaatgcaaacactgacatagccacat

SEQ ID NO: 37551 - DNA, 35 bp, Artificial Sequence
  Synthetic oligonucleotide
gtccacctctatcagtaaaaaacgccactcggact

SEQ ID NO: 37552 - DNA, 35 bp, Artificial Sequence
  Synthetic oligonucleotide
ttaccaccccccagtaatgaacaaacccgtgctct

SEQ ID NO: 37553 - DNA, 35 bp, Artificial Sequence
  Synthetic oligonucleotide
ttgcaccgtgcggaccatcccctaggtttttctct

SEQ ID NO: 37554 - DNA, 35 bp, Artificial Sequence
  Synthetic oligonucleotide
aacgcccctgcttggctctatacccattcacctgt

SEQ ID NO: 37555 - DNA, 36 bp, Artificial Sequence
  Synthetic oligonucleotide
tccaggcgacgtcacaatgcatcggccaccttaatt

SEQ ID NO: 37556 - DNA, 35 bp, Artificial Sequence
  Synthetic oligonucleotide
gaggagacgtgaaggtcgaatgtacgggatgattt

SEQ ID NO: 37557 - DNA, 36 bp, Artificial Sequence
  Synthetic oligonucleotide
gtccaccgacgagatcttcttcaccgccaatcggaa

SEQ ID NO: 37558 - DNA, 36 bp, Artificial Sequence
  Synthetic oligonucleotide
gtgagccagctctcaatcacctccatcattagccca

SEQ ID NO: 37559 - DNA, 37 bp, Artificial Sequence
  Synthetic oligonucleotide
acaccctcacagttgttccctatggggacatggtaga

SEQ ID NO: 37560 - DNA, 37 bp, Artificial Sequence
  Synthetic oligonucleotide
tgtgtgggccggaaataggagagacatgatgagacga

SEQ ID NO: 37561 - DNA, 37 bp, Artificial Sequence
  Synthetic oligonucleotide
tcgctccgtagtcgctacccgtccccgttctgctcga

SEQ ID NO: 37562 - DNA, 37 bp, Artificial Sequence
  Synthetic oligonucleotide
tcccgtgatcattgcctagccctcgcccttcatagga

SEQ ID NO: 37563 - DNA, 37 bp, Artificial Sequence
  Synthetic oligonucleotide
gaagatacgagccaggagattgggaggtacagaggga

SEQ ID NO: 37564 - DNA, 37 bp, Artificial Sequence
  Synthetic oligonucleotide
gatggcactcatgggaagggaaggaggaggtgcggga

SEQ ID NO: 37565 - DNA, 35 bp, Artificial Sequence
  Synthetic oligonucleotide
tccatgactgcttgccacacatcctcgtctcatga

SEQ ID NO: 37566 - DNA, 38 bp, Artificial Sequence
  Synthetic oligonucleotide
gttgccacccatttggttgactgaccttcatacactga

SEQ ID NO: 37567 - DNA, 37 bp, Artificial Sequence
  Synthetic oligonucleotide
acctgcgacctatcgccctgccttttgtcttccgtga

SEQ ID NO: 37568 - DNA, 38 bp, Artificial Sequence
  Synthetic oligonucleotide
aaaaaggagggtgagggacggtaagtgagttgtggtga

SEQ ID NO: 37569 - DNA, 37 bp, Artificial Sequence
  Synthetic oligonucleotide
taatcggcctcaccctcgatgtaattcccccgtgtga

SEQ ID NO: 37570 - DNA, 38 bp, Artificial Sequence
  Synthetic oligonucleotide
tacctgcacgacaggacccgtcccgttacccgcattga

SEQ ID NO: 37571 - DNA, 38 bp, Artificial Sequence
  Synthetic oligonucleotide
aagcacgcccgcctttctgctccccatcaattcattga

SEQ ID NO: 37572 - DNA, 38 bp, Artificial Sequence
  Synthetic oligonucleotide
aaccgaccggcctctgcgattgctgtccttctccttga

SEQ ID NO: 37573 - DNA, 38 bp, Artificial Sequence
  Synthetic oligonucleotide
tcgctccctctcccttgccccgagttgcctgttcttga

SEQ ID NO: 37574 - DNA, 36 bp, Artificial Sequence
  Synthetic oligonucleotide
gagtggtggtgggataaatcaaggcgggagtagata

SEQ ID NO: 37575 - DNA, 36 bp, Artificial Sequence
  Synthetic oligonucleotide
acagcccggacgacctcaatccacggccctacgcta

SEQ ID NO: 37576 - DNA, 35 bp, Artificial Sequence
  Synthetic oligonucleotide
gcacagtgctttgttgcgtgcttttaccacatcac

SEQ ID NO: 37577 - DNA, 35 bp, Artificial Sequence
  Synthetic oligonucleotide
ctcagctcctgttctgaaatgactgccgccattcc

SEQ ID NO: 37578 - DNA, 35 bp, Artificial Sequence
  Synthetic oligonucleotide
acccaccccgacgagcgctggaccaaaacccccag

SEQ ID NO: 37579 - DNA, 35 bp, Artificial Sequence
  Synthetic oligonucleotide
actgtacatcctgccctacttctagagagcctccg

SEQ ID NO: 37580 - DNA, 35 bp, Artificial Sequence
  Synthetic oligonucleotide
aggacagtgaggggggtaaagtacgggagagaggg

SEQ ID NO: 37581 - DNA, 36 bp, Artificial Sequence
  Synthetic oligonucleotide
tacaatcggcgaggagacaggaaccaccaatacatg

SEQ ID NO: 37582 - DNA, 35 bp, Artificial Sequence
  Synthetic oligonucleotide
agccacccgccacttccggacatcgcggagccaat

SEQ ID NO: 37583 - DNA, 35 bp, Artificial Sequence
  Synthetic oligonucleotide
tccagggctcgcatccgttcgccaataacaaacat

SEQ ID NO: 37584 - DNA, 35 bp, Artificial Sequence
  Synthetic oligonucleotide
ttggagagggagcgggaggagtagtttatgtggat

SEQ ID NO: 37585 - DNA, 35 bp, Artificial Sequence
  Synthetic oligonucleotide
tctccggaacgtacctgcttgctgtttgttcacct

SEQ ID NO: 37586 - DNA, 36 bp, Artificial Sequence
  Synthetic oligonucleotide
ttagtggtggcccctcgcttgcgttttgaactctct

SEQ ID NO: 37587 - DNA, 35 bp, Artificial Sequence
  Synthetic oligonucleotide
tcaccaccgcaaccccctgaactgtaatttacctt

SEQ ID NO: 37588 - DNA, 36 bp, Artificial Sequence
  Synthetic oligonucleotide
gttccccctccacatctgtttaagcacggtaccaaa

SEQ ID NO: 37589 - DNA, 36 bp, Artificial Sequence
  Synthetic oligonucleotide
gtcacataacaccccgaaccgccttggtcgacacca

SEQ ID NO: 37590 - DNA, 36 bp, Artificial Sequence
  Synthetic oligonucleotide
tgtgcccattgcagctccctccccgtctcccctcca

SEQ ID NO: 37591 - DNA, 36 bp, Artificial Sequence
  Synthetic oligonucleotide
gcatccccctcgggggccaatcatactcccgttcca

SEQ ID NO: 37592 - DNA, 37 bp, Artificial Sequence
  Synthetic oligonucleotide
gagacatggaggaagggatggtactgaacgtaagaga

SEQ ID NO: 37593 - DNA, 35 bp, Artificial Sequence
  Synthetic oligonucleotide
tggaatgaggggtgcatggagcgggtggacggaga

SEQ ID NO: 37594 - DNA, 37 bp, Artificial Sequence
  Synthetic oligonucleotide
gcggggggtcggggataaagcatggcaggagggggga

SEQ ID NO: 37595 - DNA, 37 bp, Artificial Sequence
  Synthetic oligonucleotide
acacgccgccttcgcccctcaaccaacacaacgtgga

SEQ ID NO: 37596 - DNA, 38 bp, Artificial Sequence
  Synthetic oligonucleotide
acactcatcaataggcgattcagacaccatcgccatga

SEQ ID NO: 37597 - DNA, 38 bp, Artificial Sequence
  Synthetic oligonucleotide
gtgcaccatcccgcagcattagctttgcgcaatcatga

SEQ ID NO: 37598 - DNA, 37 bp, Artificial Sequence
  Synthetic oligonucleotide
acgcggtcctgaagccctgccgtaaccctcgccctga

SEQ ID NO: 37599 - DNA, 38 bp, Artificial Sequence
  Synthetic oligonucleotide
gccacacacattcacggtgccacactcctcattggtga

SEQ ID NO: 37600 - DNA, 38 bp, Artificial Sequence
  Synthetic oligonucleotide
tctgcccatccactgctagcaactctactgctcgttga

SEQ ID NO: 37601 - DNA, 38 bp, Artificial Sequence
  Synthetic oligonucleotide
gcaacgcactcgtgccgccaagccagcccccactttga

SEQ ID NO: 37602 - DNA, 36 bp, Artificial Sequence
  Synthetic oligonucleotide
atcgccctccgagaaccccggctccttactcgagta

SEQ ID NO: 37603 - DNA, 36 bp, Artificial Sequence
  Synthetic oligonucleotide
aattgggaagggtgggagtgggacttgtcagcgccc

SEQ ID NO: 37604 - DNA, 35 bp, Artificial Sequence
  Synthetic oligonucleotide
gtggtcggggggaaggagcgccagtggccatctgc

SEQ ID NO: 37605 - DNA, 35 bp, Artificial Sequence
  Synthetic oligonucleotide
aggacgatccgtacataacgcacccgtatcccatc

SEQ ID NO: 37606 - DNA, 35 bp, Artificial Sequence
  Synthetic oligonucleotide
ttgctcaaccgttcgtgacgtgtgagcgctttttc

SEQ ID NO: 37607 - DNA, 35 bp, Artificial Sequence
  Synthetic oligonucleotide
ctgtcacgaactcgtcgccactcgtatttagtaat

SEQ ID NO: 37608 - DNA, 35 bp, Artificial Sequence
  Synthetic oligonucleotide
acatgcagattccaacccggcccttttttcgtgat

SEQ ID NO: 37609 - DNA, 35 bp, Artificial Sequence
  Synthetic oligonucleotide
tagtggcgctatatcctggccatccatccgatact

SEQ ID NO: 37610 - DNA, 35 bp, Artificial Sequence
  Synthetic oligonucleotide
gctaacctcactagctctcccgtcagttccctact

SEQ ID NO: 37611 - DNA, 35 bp, Artificial Sequence
  Synthetic oligonucleotide
gaagccccgcacccccctttcgatctagttcagct

SEQ ID NO: 37612 - DNA, 35 bp, Artificial Sequence
  Synthetic oligonucleotide
ttgccctccttgtcccttgctcgtgatctgcacgt

SEQ ID NO: 37613 - DNA, 35 bp, Artificial Sequence
  Synthetic oligonucleotide
tgcaggggcgaatagtttttcacatgctcctcctt

SEQ ID NO: 37614 - DNA, 35 bp, Artificial Sequence
  Synthetic oligonucleotide
tgcacaccaatgacaccgacacatcgcaaaacttt

SEQ ID NO: 37615 - DNA, 35 bp, Artificial Sequence
  Synthetic oligonucleotide
atgagggccaacacagccaccgtgcaattcttttt

SEQ ID NO: 37616 - DNA, 35 bp, Artificial Sequence
  Synthetic oligonucleotide
gccggaagagctatctgtctctgctaccactttaa

SEQ ID NO: 37617 - DNA, 36 bp, Artificial Sequence
  Synthetic oligonucleotide
taacaaccagccctggacggccatgacagccctaca

SEQ ID NO: 37618 - DNA, 35 bp, Artificial Sequence
  Synthetic oligonucleotide
gcacccacgcaggcgttggcttccgctcccgtaca

SEQ ID NO: 37619 - DNA, 36 bp, Artificial Sequence
  Synthetic oligonucleotide
aactgctagtgcgtttctgacctcgctccccgccca

SEQ ID NO: 37620 - DNA, 35 bp, Artificial Sequence
  Synthetic oligonucleotide
tcccactgacgaggttagttaagcttgtcttctca

SEQ ID NO: 37621 - DNA, 36 bp, Artificial Sequence
  Synthetic oligonucleotide
tgaagtccgcagcccgtaatcctaaaccccttgtca

SEQ ID NO: 37622 - DNA, 37 bp, Artificial Sequence
  Synthetic oligonucleotide
tcgatgcgcggtccgaacgcatcttctcccctctaga

SEQ ID NO: 37623 - DNA, 36 bp, Artificial Sequence
  Synthetic oligonucleotide
tctcctgacctctaacaccgatttgtgccttcccga

SEQ ID NO: 37624 - DNA, 37 bp, Artificial Sequence
  Synthetic oligonucleotide
gcatccacacatgcaacccttgattcatacatgccga

SEQ ID NO: 37625 - DNA, 37 bp, Artificial Sequence
  Synthetic oligonucleotide
accaccctcatccggcccaaggatctgcaaactagga

SEQ ID NO: 37626 - DNA, 37 bp, Artificial Sequence
  Synthetic oligonucleotide
acacgggggaatgggtttgggaggttcttcatgggga

SEQ ID NO: 37627 - DNA, 37 bp, Artificial Sequence
  Synthetic oligonucleotide
acgaaggcccgtcacactgagtaccccccttccctga

SEQ ID NO: 37628 - DNA, 38 bp, Artificial Sequence
  Synthetic oligonucleotide
gtactacgcaagggccccatcacgctacatttgcctga

SEQ ID NO: 37629 - DNA, 37 bp, Artificial Sequence
  Synthetic oligonucleotide
gctgagtcgtaatctgcgggtggcttctcttatctga

SEQ ID NO: 37630 - DNA, 38 bp, Artificial Sequence
  Synthetic oligonucleotide
gttgggcgggcaggagggaaaaagtagaactattctga

SEQ ID NO: 37631 - DNA, 38 bp, Artificial Sequence
  Synthetic oligonucleotide
tgactcagcgcaaccgccattttcatcaacacacgtga

SEQ ID NO: 37632 - DNA, 36 bp, Artificial Sequence
  Synthetic oligonucleotide
gttggacgccgtactgactaccccctacacgcttga

SEQ ID NO: 37633 - DNA, 38 bp, Artificial Sequence
  Synthetic oligonucleotide
tagcccgccctcacatcatctttcttgtgttcctttga

SEQ ID NO: 37634 - DNA, 35 bp, Artificial Sequence
  Synthetic oligonucleotide
atgaactccgagccccttgtagaccgcatggaacc

SEQ ID NO: 37635 - DNA, 35 bp, Artificial Sequence
  Synthetic oligonucleotide
actgggaccggcactagactcctccacatgtcccc

SEQ ID NO: 37636 - DNA, 35 bp, Artificial Sequence
  Synthetic oligonucleotide
tgatgaccacatttgctcccctgaagcccaatccc

SEQ ID NO: 37637 - DNA, 35 bp, Artificial Sequence
  Synthetic oligonucleotide
gcctgtgcctactagactcctgttcgctttgttgc

SEQ ID NO: 37638 - DNA, 35 bp, Artificial Sequence
  Synthetic oligonucleotide
tattcgccgctggtaccgcgggaaccaatctcttc

SEQ ID NO: 37639 - DNA, 35 bp, Artificial Sequence
  Synthetic oligonucleotide
actcatacaccaccaaatgagatgtgtcacttttc

SEQ ID NO: 37640 - DNA, 35 bp, Artificial Sequence
  Synthetic oligonucleotide
agaccccctcgagatttgtcctttcgcatcctggt

SEQ ID NO: 37641 - DNA, 36 bp, Artificial Sequence
  Synthetic oligonucleotide
agcccacgacgcaattcgccatgtactacccactaa

SEQ ID NO: 37642 - DNA, 35 bp, Artificial Sequence
  Synthetic oligonucleotide
acccgaccctgtcgtaaatggagtttttctgtcca

SEQ ID NO: 37643 - DNA, 37 bp, Artificial Sequence
  Synthetic oligonucleotide
acccgcgcattgcttttttctccacatgctttttaga

SEQ ID NO: 37644 - DNA, 37 bp, Artificial Sequence
  Synthetic oligonucleotide
tcacattgccacgttgaccttctggcctccgaaccga

SEQ ID NO: 37645 - DNA, 37 bp, Artificial Sequence
  Synthetic oligonucleotide
tgcatgagcccatctaacactttttgcgtgataccga

SEQ ID NO: 37646 - DNA, 37 bp, Artificial Sequence
  Synthetic oligonucleotide
ttcgactcctcacctaactcgtctgtctttcatccga

SEQ ID NO: 37647 - DNA, 36 bp, Artificial Sequence
  Synthetic oligonucleotide
ggaaacatcctgaccaacgttaccccacccctcgga

SEQ ID NO: 37648 - DNA, 37 bp, Artificial Sequence
  Synthetic oligonucleotide
tgaaccactctgttcacctaggtacccagtctttgga

SEQ ID NO: 37649 - DNA, 38 bp, Artificial Sequence
  Synthetic oligonucleotide
gtcgaccgtccacggcgcccaccaatatgaccttatga

SEQ ID NO: 37650 - DNA, 38 bp, Artificial Sequence
  Synthetic oligonucleotide
acacccactgtctggtaccatcgtaacagtcgtactga

SEQ ID NO: 37651 - DNA, 38 bp, Artificial Sequence
  Synthetic oligonucleotide
ttcagtgccactttatgtccaccttgtagatcccctga

SEQ ID NO: 37652 - DNA, 38 bp, Artificial Sequence
  Synthetic oligonucleotide
ttgcaccctactgaagaccctcggttcccgcccattga

SEQ ID NO: 37653 - DNA, 37 bp, Artificial Sequence
  Synthetic oligonucleotide
ggtgaccgatccattgcgcccgcgactccacgcttga

SEQ ID NO: 37654 - DNA, 35 bp, Artificial Sequence
  Synthetic oligonucleotide
gcaactggtcgcttccactcctccgttgcctaata

SEQ ID NO: 37655 - DNA, 36 bp, Artificial Sequence
  Synthetic oligonucleotide
ggaagaccacccatttcaatccgcattctagcttta

SEQ ID NO: 37656 - DNA, 35 bp, Artificial Sequence
  Synthetic oligonucleotide
gaagcaccggtgcgggcggagggtgaggggcgtac

SEQ ID NO: 37657 - DNA, 35 bp, Artificial Sequence
  Synthetic oligonucleotide
tgtcctttcaaccagcctgaggtccgctcctttac

SEQ ID NO: 37658 - DNA, 35 bp, Artificial Sequence
  Synthetic oligonucleotide
attacgggtccacatgatccccacccccagtcccc

SEQ ID NO: 37659 - DNA, 35 bp, Artificial Sequence
  Synthetic oligonucleotide
gtgccgccaagctccgcacgccacaatccatcgcc

SEQ ID NO: 37660 - DNA, 35 bp, Artificial Sequence
  Synthetic oligonucleotide
tccgtagggtggggcgggggttacattggatcatc

SEQ ID NO: 37661 - DNA, 35 bp, Artificial Sequence
  Synthetic oligonucleotide
gtctcgatcatcgggttacttctgtacgttgtctc

SEQ ID NO: 37662 - DNA, 35 bp, Artificial Sequence
  Synthetic oligonucleotide
cacgtgtgccccacgggttacccagttttatgttc

SEQ ID NO: 37663 - DNA, 35 bp, Artificial Sequence
  Synthetic oligonucleotide
gaggaggtgggacaggggcaggcagggtgaagacg

SEQ ID NO: 37664 - DNA, 34 bp, Artificial Sequence
  Synthetic oligonucleotide
tgcgcccccaatgtacctcccacatacttcattg

SEQ ID NO: 37665 - DNA, 35 bp, Artificial Sequence
  Synthetic oligonucleotide
gtccactcccacaccctaggctatactgctgccat

SEQ ID NO: 37666 - DNA, 35 bp, Artificial Sequence
  Synthetic oligonucleotide
acccaccttggccttgagtaggcccgccaccaact

SEQ ID NO: 37667 - DNA, 35 bp, Artificial Sequence
  Synthetic oligonucleotide
gaaccaactcactgttcttaaactaccattttggt

SEQ ID NO: 37668 - DNA, 35 bp, Artificial Sequence
  Synthetic oligonucleotide
gacgttcgggggccacatactgcacgctttctttt

SEQ ID NO: 37669 - DNA, 36 bp, Artificial Sequence
  Synthetic oligonucleotide
acatggtgcggactgcggagttgacgggaacgggaa

SEQ ID NO: 37670 - DNA, 36 bp, Artificial Sequence
  Synthetic oligonucleotide
gacaccatatgctgtgcttgccctcgcacataacca

SEQ ID NO: 37671 - DNA, 36 bp, Artificial Sequence
  Synthetic oligonucleotide
gtgggcgggtgcggttggggagtaattagtgttcca

SEQ ID NO: 37672 - DNA, 36 bp, Artificial Sequence
  Synthetic oligonucleotide
ttctccccgctctcgccatcagacttactgtgcgca

SEQ ID NO: 37673 - DNA, 36 bp, Artificial Sequence
  Synthetic oligonucleotide
gtgatgccacccgcccggaccattagaacgccatca

SEQ ID NO: 37674 - DNA, 37 bp, Artificial Sequence
  Synthetic oligonucleotide
ttggaaaggggtgaggggtggttaccggggccgccga

SEQ ID NO: 37675 - DNA, 37 bp, Artificial Sequence
  Synthetic oligonucleotide
actgatgggaggggaagggattagcgacgagggccga

SEQ ID NO: 37676 - DNA, 36 bp, Artificial Sequence
  Synthetic oligonucleotide
acttaccgttgctgccattcaatccctgaccttgga

SEQ ID NO: 37677 - DNA, 38 bp, Artificial Sequence
  Synthetic oligonucleotide
tgaacatgcgcactttgggcatcattgtccctctctga

SEQ ID NO: 37678 - DNA, 37 bp, Artificial Sequence
  Synthetic oligonucleotide
tgacccgtcgaggtccaagctctctaccctttcgtga

SEQ ID NO: 37679 - DNA, 36 bp, Artificial Sequence
  Synthetic oligonucleotide
gtagtgacaggagaagagtagtgggaggaggtgtga

SEQ ID NO: 37680 - DNA, 37 bp, Artificial Sequence
  Synthetic oligonucleotide
acctgagcaatagccatcctagcagaccacccattga

SEQ ID NO: 37681 - DNA, 38 bp, Artificial Sequence
  Synthetic oligonucleotide
aacccacctgctccctgtctcgtgtccgtcattcttga

SEQ ID NO: 37682 - DNA, 38 bp, Artificial Sequence
  Synthetic oligonucleotide
aacgttcggtgggaggggtggggcaggacgccgtttga

SEQ ID NO: 37683 - DNA, 36 bp, Artificial Sequence
  Synthetic oligonucleotide
gtcctcgccaaccgtgcgtatatgtcgctccttcta

SEQ ID NO: 37684 - DNA, 35 bp, Artificial Sequence
  Synthetic oligonucleotide
gaagtaggtacaaagggtggggaagcggtgccgta

SEQ ID NO: 37685 - DNA, 36 bp, Artificial Sequence
  Synthetic oligonucleotide
gcccaatagccgctccttacgcttgattcgccctta

SEQ ID NO: 37686 - DNA, 35 bp, Artificial Sequence
  Synthetic oligonucleotide
tccgacccagcactcgacggctagagttcaatccc

SEQ ID NO: 37687 - DNA, 35 bp, Artificial Sequence
  Synthetic oligonucleotide
gtagcaaccgcacgttcggtattatccaattcgcc

SEQ ID NO: 37688 - DNA, 35 bp, Artificial Sequence
  Synthetic oligonucleotide
agtgtcgcgtccaccgtgaccccctccctttatcc

SEQ ID NO: 37689 - DNA, 35 bp, Artificial Sequence
  Synthetic oligonucleotide
tgtgctgccacgccaccttttgtcaacattaactc

SEQ ID NO: 37690 - DNA, 35 bp, Artificial Sequence
  Synthetic oligonucleotide
tgccacatactatgattatgtatcctagccccgtc

SEQ ID NO: 37691 - DNA, 35 bp, Artificial Sequence
  Synthetic oligonucleotide
gatatcgtgcgccaattctcaatccaccccctttg

SEQ ID NO: 37692 - DNA, 35 bp, Artificial Sequence
  Synthetic oligonucleotide
ggtcgctccctgatcgccccgtgcctgttcctaat

SEQ ID NO: 37693 - DNA, 35 bp, Artificial Sequence
  Synthetic oligonucleotide
gatgcgtccacacgccgccaacaatttcacccact

SEQ ID NO: 37694 - DNA, 35 bp, Artificial Sequence
  Synthetic oligonucleotide
gatgcgtacagttcagaccgccgatcaaacttttt

SEQ ID NO: 37695 - DNA, 36 bp, Artificial Sequence
  Synthetic oligonucleotide
gcgaatcccgtcagctcgcacctcagggccccacaa

SEQ ID NO: 37696 - DNA, 36 bp, Artificial Sequence
  Synthetic oligonucleotide
tgcagcctatgctgcactaccattcgggtatcccaa

SEQ ID NO: 37697 - DNA, 36 bp, Artificial Sequence
  Synthetic oligonucleotide
tatggccctcttttgctgaatacgttgccttttgaa

SEQ ID NO: 37698 - DNA, 35 bp, Artificial Sequence
  Synthetic oligonucleotide
tctgaccatcaatcgggtgttgccacatgcattaa

SEQ ID NO: 37699 - DNA, 36 bp, Artificial Sequence
  Synthetic oligonucleotide
tatccgcccggtctttgcggccctttcaggcaacca

SEQ ID NO: 37700 - DNA, 36 bp, Artificial Sequence
  Synthetic oligonucleotide
gatgtccagccgtattcatgctttcgttgtgatcca

SEQ ID NO: 37701 - DNA, 36 bp, Artificial Sequence
  Synthetic oligonucleotide
accctaccccgtgcagaatccccataattcaaggca

SEQ ID NO: 37702 - DNA, 36 bp, Artificial Sequence
  Synthetic oligonucleotide
acctgccgtcgagcctcccattcgattcctgtggca

SEQ ID NO: 37703 - DNA, 37 bp, Artificial Sequence
  Synthetic oligonucleotide
gatagggaagaatgggagattatgaataggtgtagga

SEQ ID NO: 37704 - DNA, 37 bp, Artificial Sequence
  Synthetic oligonucleotide
gttgaacaggaatagggaatatggcggaaaaaaggga

SEQ ID NO: 37705 - DNA, 35 bp, Artificial Sequence
  Synthetic oligonucleotide
tcaccgcacctgaacattttcttttacgacttgga

SEQ ID NO: 37706 - DNA, 38 bp, Artificial Sequence
  Synthetic oligonucleotide
gaccaccacaatccggcctatgttctgacttccaatga

SEQ ID NO: 37707 - DNA, 38 bp, Artificial Sequence
  Synthetic oligonucleotide
gaggtcagtcacagtgcctactatttttgccttcatga

SEQ ID NO: 37708 - DNA, 37 bp, Artificial Sequence
  Synthetic oligonucleotide
tttcgaccgccgccctgcctcttcacagtcaggctga

SEQ ID NO: 37709 - DNA, 37 bp, Artificial Sequence
  Synthetic oligonucleotide
aatggggagggtagtgggaattagcgggtagcagtga

SEQ ID NO: 37710 - DNA, 37 bp, Artificial Sequence
  Synthetic oligonucleotide
ttggactccctcccttgagcattccaggcccttgtga

SEQ ID NO: 37711 - DNA, 38 bp, Artificial Sequence
  Synthetic oligonucleotide
actgatccgcactgttataccacgggtcttcacattga

SEQ ID NO: 37712 - DNA, 37 bp, Artificial Sequence
  Synthetic oligonucleotide
acgaaggggtagaagggaatgaaaacatcgcgattga

SEQ ID NO: 37713 - DNA, 38 bp, Artificial Sequence
  Synthetic oligonucleotide
gacacgtgaacgtagttatcccggttttcatatcttga

SEQ ID NO: 37714 - DNA, 38 bp, Artificial Sequence
  Synthetic oligonucleotide
actcccgtcgtccacactgccaccgataacccttttga

SEQ ID NO: 37715 - DNA, 36 bp, Artificial Sequence
  Synthetic oligonucleotide
gaagaaggtaatacgggtggggatgagggaggggta

SEQ ID NO: 37716 - DNA, 35 bp, Artificial Sequence
  Synthetic oligonucleotide
accctgtccccaccccatgcgactcgtttctctta

SEQ ID NO: 37717 - DNA, 35 bp, Artificial Sequence
  Synthetic oligonucleotide
tgacgcccctgtgccatccagttccggcgtgttac

SEQ ID NO: 37718 - DNA, 35 bp, Artificial Sequence
  Synthetic oligonucleotide
atttgccccatgagatctcttgagtggtttcctcc

SEQ ID NO: 37719 - DNA, 35 bp, Artificial Sequence
  Synthetic oligonucleotide
tcatgcactgcattacgcacacctgaactctgagc

SEQ ID NO: 37720 - DNA, 35 bp, Artificial Sequence
  Synthetic oligonucleotide
ttctgcgtaggactatatccgcattcacgcctcgc

SEQ ID NO: 37721 - DNA, 35 bp, Artificial Sequence
  Synthetic oligonucleotide
gtgaccctacgagcgcgaatactatctccacgtgc

SEQ ID NO: 37722 - DNA, 35 bp, Artificial Sequence
  Synthetic oligonucleotide
tactagacaccacatgatcggtcgtagacgacctc

SEQ ID NO: 37723 - DNA, 35 bp, Artificial Sequence
  Synthetic oligonucleotide
gatgcgggctgggggggctcgatagcgggaaagcg

SEQ ID NO: 37724 - DNA, 35 bp, Artificial Sequence
  Synthetic oligonucleotide
tgacgcttctgtagcatgtctctcctctcgcccat

SEQ ID NO: 37725 - DNA, 35 bp, Artificial Sequence
  Synthetic oligonucleotide
agcaggatcacctcatgcccagccacggtccccct

SEQ ID NO: 37726 - DNA, 35 bp, Artificial Sequence
  Synthetic oligonucleotide
ttccactatcgaggccaccagttccgtacgcctgt

SEQ ID NO: 37727 - DNA, 35 bp, Artificial Sequence
  Synthetic oligonucleotide
gctgcccagtcgtcacttcgcacccagtaaccgtt

SEQ ID NO: 37728 - DNA, 34 bp, Artificial Sequence
  Synthetic oligonucleotide
gatgctacgtgtctgccaccacgcacaccaacca

SEQ ID NO: 37729 - DNA, 36 bp, Artificial Sequence
  Synthetic oligonucleotide
atgtccgcaaggacagaattccattattagctccca

SEQ ID NO: 37730 - DNA, 37 bp, Artificial Sequence
  Synthetic oligonucleotide
tgcaacctcctctctgccctgtaagcttgtgactaga

SEQ ID NO: 37731 - DNA, 37 bp, Artificial Sequence
  Synthetic oligonucleotide
agtccgaactcacctggcataaaaatggccttcccga

SEQ ID NO: 37732 - DNA, 37 bp, Artificial Sequence
  Synthetic oligonucleotide
gaagtgacagagggtggactgaatgaagtaaatgcga

SEQ ID NO: 37733 - DNA, 37 bp, Artificial Sequence
  Synthetic oligonucleotide
acgcacgacggagtactcttaactctgcgtttctcga

SEQ ID NO: 37734 - DNA, 35 bp, Artificial Sequence
  Synthetic oligonucleotide
atgaccggagtcacccaccccctctgcttcttcga

SEQ ID NO: 37735 - DNA, 37 bp, Artificial Sequence
  Synthetic oligonucleotide
agacgcggggagcggagggttgctgggggcgaaagga

SEQ ID NO: 37736 - DNA, 38 bp, Artificial Sequence
  Synthetic oligonucleotide
aacccgtccctgcttgttctcgtcttttcctatcatga

SEQ ID NO: 37737 - DNA, 37 bp, Artificial Sequence
  Synthetic oligonucleotide
tccaacgttcctgcactgccatcaccgccatctatga

SEQ ID NO: 37738 - DNA, 37 bp, Artificial Sequence
  Synthetic oligonucleotide
gtgcccacgcgtgcgcagtacacaattctccaactga

SEQ ID NO: 37739 - DNA, 38 bp, Artificial Sequence
  Synthetic oligonucleotide
gcgcactcagtggcatgatcgaacaccctgacccctga

SEQ ID NO: 37740 - DNA, 38 bp, Artificial Sequence
  Synthetic oligonucleotide
gacacgcccatataccgccgtaattgaaactcccctga

SEQ ID NO: 37741 - DNA, 38 bp, Artificial Sequence
  Synthetic oligonucleotide
gccgggtgggaaaggggataggggtttgtaacgcctga

SEQ ID NO: 37742 - DNA, 37 bp, Artificial Sequence
  Synthetic oligonucleotide
actgtcgtggagcaaatagataggggatggggcgtga

SEQ ID NO: 37743 - DNA, 38 bp, Artificial Sequence
  Synthetic oligonucleotide
tccgccagtgggaggggggggcggttgaatgaaggtga

SEQ ID NO: 37744 - DNA, 38 bp, Artificial Sequence
  Synthetic oligonucleotide
gcgcatgcgctcgaacgggagggacgggatttgggtga

SEQ ID NO: 37745 - DNA, 38 bp, Artificial Sequence
  Synthetic oligonucleotide
tacgaccccaccgccggcctcttactattttggtgtga

SEQ ID NO: 37746 - DNA, 38 bp, Artificial Sequence
  Synthetic oligonucleotide
taccccacccattcctgtctgtttagattacaacttga

SEQ ID NO: 37747 - DNA, 36 bp, Artificial Sequence
  Synthetic oligonucleotide
gaattgtatcgctccgtgccttgctatatcttgtta

SEQ ID NO: 37748 - DNA, 34 bp, Artificial Sequence
  Synthetic oligonucleotide
gaacgtacggccgactgagactgtaactacctcc

SEQ ID NO: 37749 - DNA, 35 bp, Artificial Sequence
  Synthetic oligonucleotide
gacccttccaccgcccgatgcttggccaactcatc

SEQ ID NO: 37750 - DNA, 35 bp, Artificial Sequence
  Synthetic oligonucleotide
tgttgcaggaggggcgtggggggggattattagag

SEQ ID NO: 37751 - DNA, 35 bp, Artificial Sequence
  Synthetic oligonucleotide
gtactcgctccacttgcagtatactactccgaacg

SEQ ID NO: 37752 - DNA, 35 bp, Artificial Sequence
  Synthetic oligonucleotide
accccagggaccggggttgaggggtggaggggggg

SEQ ID NO: 37753 - DNA, 35 bp, Artificial Sequence
  Synthetic oligonucleotide
gttggggaaggtagaggttggaagtgcagctggct

SEQ ID NO: 37754 - DNA, 35 bp, Artificial Sequence
  Synthetic oligonucleotide
actgtacgaggcggggagagctacgggcagaattt

SEQ ID NO: 37755 - DNA, 35 bp, Artificial Sequence
  Synthetic oligonucleotide
gcgcgctccatcagcattttaacacgggccccttt

SEQ ID NO: 37756 - DNA, 35 bp, Artificial Sequence
  Synthetic oligonucleotide
gcctccgtagaccggtgatagcgatctcaccccaa

SEQ ID NO: 37757 - DNA, 36 bp, Artificial Sequence
  Synthetic oligonucleotide
tgttgcatagtgggtctctgccgccatcacactcca

SEQ ID NO: 37758 - DNA, 36 bp, Artificial Sequence
  Synthetic oligonucleotide
ttgagcactgcatccggtccttattcttctccagca

SEQ ID NO: 37759 - DNA, 37 bp, Artificial Sequence
  Synthetic oligonucleotide
ttagcacgttcgccacaacaaatatgccactttacga

SEQ ID NO: 37760 - DNA, 35 bp, Artificial Sequence
  Synthetic oligonucleotide
gacgcctctcatgtatgctttgttaactcactcga

SEQ ID NO: 37761 - DNA, 37 bp, Artificial Sequence
  Synthetic oligonucleotide
tttatgcccctccgtgccatttgttctgttttttcga

SEQ ID NO: 37762 - DNA, 36 bp, Artificial Sequence
  Synthetic oligonucleotide
gtcctcacgtccaactcctcccattgaagactatga

SEQ ID NO: 37763 - DNA, 38 bp, Artificial Sequence
  Synthetic oligonucleotide
atgacgctccgtttcctctaccactacgtgctttatga

SEQ ID NO: 37764 - DNA, 38 bp, Artificial Sequence
  Synthetic oligonucleotide
tcagtacactcccactagcaccagtccccctgcactga

SEQ ID NO: 37765 - DNA, 37 bp, Artificial Sequence
  Synthetic oligonucleotide
acgccccgtgcttacccgtcttttcaatcctgcctga

SEQ ID NO: 37766 - DNA, 38 bp, Artificial Sequence
  Synthetic oligonucleotide
gaccggacactcctgcatattgctcttagcccacgtga

SEQ ID NO: 37767 - DNA, 36 bp, Artificial Sequence
  Synthetic oligonucleotide
aactacccgcccgatacacctttcgaagccacttga

SEQ ID NO: 37768 - DNA, 38 bp, Artificial Sequence
  Synthetic oligonucleotide
ttcacccccccgagacatgtcatgcttccctgacttga

SEQ ID NO: 37769 - DNA, 38 bp, Artificial Sequence
  Synthetic oligonucleotide
tcacactcgctcttgaactttctgtgcacctttcttga

SEQ ID NO: 37770 - DNA, 38 bp, Artificial Sequence
  Synthetic oligonucleotide
agtgagggagaaggggcatttacgacagtgaagtttga

SEQ ID NO: 37771 - DNA, 35 bp, Artificial Sequence
  Synthetic oligonucleotide
agccgaacgctaggctatcatgttaactgcccgcc

SEQ ID NO: 37772 - DNA, 35 bp, Artificial Sequence
  Synthetic oligonucleotide
gtacgctgaagcaaacaatgtcactatcttggtcc

SEQ ID NO: 37773 - DNA, 35 bp, Artificial Sequence
  Synthetic oligonucleotide
ttatcgctaccatccaggcggggttatcttatctc

SEQ ID NO: 37774 - DNA, 35 bp, Artificial Sequence
  Synthetic oligonucleotide
taactacctgccccgttactccgtttgacctgaag

SEQ ID NO: 37775 - DNA, 35 bp, Artificial Sequence
  Synthetic oligonucleotide
tgtcattctctcgcccccgcacggtgtccccctag

SEQ ID NO: 37776 - DNA, 35 bp, Artificial Sequence
  Synthetic oligonucleotide
atcgcccgacaaccacacttatacgccaatcacgg

SEQ ID NO: 37777 - DNA, 35 bp, Artificial Sequence
  Synthetic oligonucleotide
atgtactgcaaggataagatgatcgcactgtgtgg

SEQ ID NO: 37778 - DNA, 35 bp, Artificial Sequence
  Synthetic oligonucleotide
gaacgtacccatccagccatgtatgttgcattttg

SEQ ID NO: 37779 - DNA, 35 bp, Artificial Sequence
  Synthetic oligonucleotide
ggtacttgcacccttcattgctgctctactaacct

SEQ ID NO: 37780 - DNA, 35 bp, Artificial Sequence
  Synthetic oligonucleotide
accgcacaacaggattaagctgttctaccccccct

SEQ ID NO: 37781 - DNA, 35 bp, Artificial Sequence
  Synthetic oligonucleotide
acgaccccacgcgatttatacacctttaggtgcct

SEQ ID NO: 37782 - DNA, 35 bp, Artificial Sequence
  Synthetic oligonucleotide
gttgtacccaccccctgtacattcgttagacactt

SEQ ID NO: 37783 - DNA, 35 bp, Artificial Sequence
  Synthetic oligonucleotide
atgcgctcgaactgctcaccgctaaacaggcgctt

SEQ ID NO: 37784 - DNA, 35 bp, Artificial Sequence
  Synthetic oligonucleotide
tacagcgcattcccatgtactcctggctgcaagtt

SEQ ID NO: 37785 - DNA, 35 bp, Artificial Sequence
  Synthetic oligonucleotide
agtcgcccaaattcgcatgtccactcacggttcaa

SEQ ID NO: 37786 - DNA, 34 bp, Artificial Sequence
  Synthetic oligonucleotide
atacgccaccgactctcccgcccatcacccggaa

SEQ ID NO: 37787 - DNA, 35 bp, Artificial Sequence
  Synthetic oligonucleotide
atcgccccccttactggcaagctgtaagccctcca

SEQ ID NO: 37788 - DNA, 35 bp, Artificial Sequence
  Synthetic oligonucleotide
tgcgccaccaagcttcctcgtcacttgtcttagca

SEQ ID NO: 37789 - DNA, 35 bp, Artificial Sequence
  Synthetic oligonucleotide
ttagctcagtcgcattcatctgtccccgtatcgca

SEQ ID NO: 37790 - DNA, 36 bp, Artificial Sequence
  Synthetic oligonucleotide
gacggttagggacggggggggtatcagtccggggca

SEQ ID NO: 37791 - DNA, 37 bp, Artificial Sequence
  Synthetic oligonucleotide
tgccctcaccagacaacattgggccttttgtcgaaga

SEQ ID NO: 37792 - DNA, 37 bp, Artificial Sequence
  Synthetic oligonucleotide
tctgcgggcgaagggaaccagggaggacgagcacaga

SEQ ID NO: 37793 - DNA, 37 bp, Artificial Sequence
  Synthetic oligonucleotide
ttccccccgcccgttataagaacactaattcgtcaga

SEQ ID NO: 37794 - DNA, 38 bp, Artificial Sequence
  Synthetic oligonucleotide
acgcgcgagagtgtcctttccctcccagttccatctga

SEQ ID NO: 37795 - DNA, 38 bp, Artificial Sequence
  Synthetic oligonucleotide
atcgccgctgtgccttcgtcttgtcctacgcattttga

SEQ ID NO: 37796 - DNA, 36 bp, Artificial Sequence
  Synthetic oligonucleotide
tcaaaagaacgggagggggattcgggtgcgggtgta

SEQ ID NO: 37797 - DNA, 35 bp, Artificial Sequence
  Synthetic oligonucleotide
accacatgatcctgtaacagatttgcttcctctta

SEQ ID NO: 37798 - DNA, 35 bp, Artificial Sequence
  Synthetic oligonucleotide
gttcacccatcttttcagagcaatgctctgtcagc

SEQ ID NO: 37799 - DNA, 35 bp, Artificial Sequence
  Synthetic oligonucleotide
tagatgtcccatccactcacgcaccaataccttgc

SEQ ID NO: 37800 - DNA, 35 bp, Artificial Sequence
  Synthetic oligonucleotide
ggcacaactgcacgattgcgcgccatccttctttc

SEQ ID NO: 37801 - DNA, 34 bp, Artificial Sequence
  Synthetic oligonucleotide
gttccgtcctctacgcttttatcactccgcccgt

SEQ ID NO: 37802 - DNA, 35 bp, Artificial Sequence
  Synthetic oligonucleotide
tcgctacgtgccatccgaccgcacacatgtctttt

SEQ ID NO: 37803 - DNA, 36 bp, Artificial Sequence
  Synthetic oligonucleotide
tggacgaaccccccttcccgacgcatcacgcacgaa

SEQ ID NO: 37804 - DNA, 36 bp, Artificial Sequence
  Synthetic oligonucleotide
agtgtgccgacctgggccccctgttgattgccgaca

SEQ ID NO: 37805 - DNA, 35 bp, Artificial Sequence
  Synthetic oligonucleotide
gcgcaagggtagggtagaggtaataggcggtggca

SEQ ID NO: 37806 - DNA, 36 bp, Artificial Sequence
  Synthetic oligonucleotide
agtgtgcccgccctataactatgtttctctgcttca

SEQ ID NO: 37807 - DNA, 37 bp, Artificial Sequence
  Synthetic oligonucleotide
atcgccaccccgcctcatgagacccaaaaggcaaaga

SEQ ID NO: 37808 - DNA, 37 bp, Artificial Sequence
  Synthetic oligonucleotide
gtgagtgtcgcaattgaaggaagggcgcgggaataga

SEQ ID NO: 37809 - DNA, 37 bp, Artificial Sequence
  Synthetic oligonucleotide
accccaaccgtccatagtgccttcacgtgctctacga

SEQ ID NO: 37810 - DNA, 37 bp, Artificial Sequence
  Synthetic oligonucleotide
gactcacccatctccatctgatttgactcgcttagga

SEQ ID NO: 37811 - DNA, 37 bp, Artificial Sequence
  Synthetic oligonucleotide
gacccctccaccgaactgcgaaactgaagcccatgga

SEQ ID NO: 37812 - DNA, 38 bp, Artificial Sequence
  Synthetic oligonucleotide
tacaccagtcggcttctggcctcaacgtctcgccctga

SEQ ID NO: 37813 - DNA, 38 bp, Artificial Sequence
  Synthetic oligonucleotide
tcccggtgtcacagcacacccatcacttgtcaccttga

SEQ ID NO: 37814 - DNA, 36 bp, Artificial Sequence
  Synthetic oligonucleotide
aatgcccggggaccgcattataaacttgcacacata

SEQ ID NO: 37815 - DNA, 35 bp, Artificial Sequence
  Synthetic oligonucleotide
tgggtgcacctggtatcctgccaccttcttttgta

SEQ ID NO: 37816 - DNA, 36 bp, Artificial Sequence
  Synthetic oligonucleotide
atcttcggcctcaacaactgctgaatgaccctttta

SEQ ID NO: 37817 - DNA, 35 bp, Artificial Sequence
  Synthetic oligonucleotide
tacacggcgtttccatctgttccaattttgttgcc

SEQ ID NO: 37818 - DNA, 35 bp, Artificial Sequence
  Synthetic oligonucleotide
ttaactgtcgtcacgtcatttcgcacccactccgc

SEQ ID NO: 37819 - DNA, 35 bp, Artificial Sequence
  Synthetic oligonucleotide
tgacactttgctctggtaccccccgtcatcagctc

SEQ ID NO: 37820 - DNA, 35 bp, Artificial Sequence
  Synthetic oligonucleotide
actctcccagcgctatttttgaataactcccaccg

SEQ ID NO: 37821 - DNA, 35 bp, Artificial Sequence
  Synthetic oligonucleotide
gttgacgcacattctctagtacgttttctattgtt

SEQ ID NO: 37822 - DNA, 35 bp, Artificial Sequence
  Synthetic oligonucleotide
actgacgcgcagtaccacttcgggcaggtcccttt

SEQ ID NO: 37823 - DNA, 35 bp, Artificial Sequence
  Synthetic oligonucleotide
ggacatcagacagtcagttccacatctcacttttt

SEQ ID NO: 37824 - DNA, 36 bp, Artificial Sequence
  Synthetic oligonucleotide
gagtgccaaccagccccctcactcctgactgcaaaa

SEQ ID NO: 37825 - DNA, 36 bp, Artificial Sequence
  Synthetic oligonucleotide
tatgccgtcggccaaccaaaagccactaactcgcaa

SEQ ID NO: 37826 - DNA, 36 bp, Artificial Sequence
  Synthetic oligonucleotide
taccggtacagaggagttcgccctacccacctgcaa

SEQ ID NO: 37827 - DNA, 36 bp, Artificial Sequence
  Synthetic oligonucleotide
tccaacccataccttccccttcgtcgagacgattca

SEQ ID NO: 37828 - DNA, 35 bp, Artificial Sequence
  Synthetic oligonucleotide
agctcacgccctgctgcctacttctaaggtattca

SEQ ID NO: 37829 - DNA, 35 bp, Artificial Sequence
  Synthetic oligonucleotide
tttgccccctcgccaggaggacactggtctcttca

SEQ ID NO: 37830 - DNA, 37 bp, Artificial Sequence
  Synthetic oligonucleotide
tccatcacccgacctttgcgtagttctgcctgtttca

SEQ ID NO: 37831 - DNA, 35 bp, Artificial Sequence
  Synthetic oligonucleotide
actcagggagggtggggaaaggtagagttcccaga

SEQ ID NO: 37832 - DNA, 37 bp, Artificial Sequence
  Synthetic oligonucleotide
gatcccccgcctggtgagtctccaagctctgccacga

SEQ ID NO: 37833 - DNA, 37 bp, Artificial Sequence
  Synthetic oligonucleotide
tcatcactcttcatttctgttattccactgctgggga

SEQ ID NO: 37834 - DNA, 36 bp, Artificial Sequence
  Synthetic oligonucleotide
acatggtaacgcgcaacttgcccctaaccacttgga

SEQ ID NO: 37835 - DNA, 35 bp, Artificial Sequence
  Synthetic oligonucleotide
tacattccaaatgtcttaaccaacctggcctctga

SEQ ID NO: 37836 - DNA, 38 bp, Artificial Sequence
  Synthetic oligonucleotide
gattgcagaccttgatttcgttctgttcccttttctga

SEQ ID NO: 37837 - DNA, 38 bp, Artificial Sequence
  Synthetic oligonucleotide
gaggggccaccgggtgtggaggggttggatggaagtga

SEQ ID NO: 37838 - DNA, 38 bp, Artificial Sequence
  Synthetic oligonucleotide
agccccatcatcggttagggttcgtacttcccttgtga

SEQ ID NO: 37839 - DNA, 38 bp, Artificial Sequence
  Synthetic oligonucleotide
agacaacccccagcgcggcctgaactataccacattga

SEQ ID NO: 37840 - DNA, 38 bp, Artificial Sequence
  Synthetic oligonucleotide
tacgaacccacacctgtgctaatccatgtcctgcttga

SEQ ID NO: 37841 - DNA, 35 bp, Artificial Sequence
  Synthetic oligonucleotide
tcccacaaactcttcatcatgtcctcaagaatcac

SEQ ID NO: 37842 - DNA, 35 bp, Artificial Sequence
  Synthetic oligonucleotide
agatccgatcgccgggtcccctatgccgcaacacc

SEQ ID NO: 37843 - DNA, 35 bp, Artificial Sequence
  Synthetic oligonucleotide
tacggtcccgcgatggctcacccttacctactacc

SEQ ID NO: 37844 - DNA, 35 bp, Artificial Sequence
  Synthetic oligonucleotide
aaatgtcctcgtgtgtgcacctgccgctacctccc

SEQ ID NO: 37845 - DNA, 35 bp, Artificial Sequence
  Synthetic oligonucleotide
tgcgaaccatgaccacaagcccatatttcctggcc

SEQ ID NO: 37846 - DNA, 35 bp, Artificial Sequence
  Synthetic oligonucleotide
atatgcctgttcacccatggaattgggtccttgcc

SEQ ID NO: 37847 - DNA, 35 bp, Artificial Sequence
  Synthetic oligonucleotide
ttgcctcaccgcaaagcactaccctatggtgccgc

SEQ ID NO: 37848 - DNA, 35 bp, Artificial Sequence
  Synthetic oligonucleotide
ggtacgtacttgccctgtcactcatcaacgccatc

SEQ ID NO: 37849 - DNA, 35 bp, Artificial Sequence
  Synthetic oligonucleotide
tgatacacggctctcggaacagccaaccatctatc

SEQ ID NO: 37850 - DNA, 35 bp, Artificial Sequence
  Synthetic oligonucleotide
taacagccaccacgagcccacctcttatacgcgcg

SEQ ID NO: 37851 - DNA, 35 bp, Artificial Sequence
  Synthetic oligonucleotide
agcccaaatcacgcctttaactgttagccttatcg

SEQ ID NO: 37852 - DNA, 35 bp, Artificial Sequence
  Synthetic oligonucleotide
tcctaccgaccttgggacttcaataacgctcctgg

SEQ ID NO: 37853 - DNA, 35 bp, Artificial Sequence
  Synthetic oligonucleotide
gtgatgtctctccgctggccaccgttccctttact

SEQ ID NO: 37854 - DNA, 35 bp, Artificial Sequence
  Synthetic oligonucleotide
tcactctgcactcttcgtttctgtttggaatcgct

SEQ ID NO: 37855 - DNA, 35 bp, Artificial Sequence
  Synthetic oligonucleotide
accatccgtttctacatctccgaaccagttatggt

SEQ ID NO: 37856 - DNA, 35 bp, Artificial Sequence
  Synthetic oligonucleotide
gtcagaacccaagtgccattacattaccatccttt

SEQ ID NO: 37857 - DNA, 35 bp, Artificial Sequence
  Synthetic oligonucleotide
accattcacgcttagacacacagactaacatgttt

SEQ ID NO: 37858 - DNA, 35 bp, Artificial Sequence
  Synthetic oligonucleotide
atacacctacggtggtttggcgtatctcttcgcaa

SEQ ID NO: 37859 - DNA, 36 bp, Artificial Sequence
  Synthetic oligonucleotide
gccgatacaatcttgtaagcactgcactattatcaa

SEQ ID NO: 37860 - DNA, 36 bp, Artificial Sequence
  Synthetic oligonucleotide
taccgccccacgcccagtactcccattaccttagaa

SEQ ID NO: 37861 - DNA, 36 bp, Artificial Sequence
  Synthetic oligonucleotide
ttacgccctcgaaccgaacgttccaaacttgtccca

SEQ ID NO: 37862 - DNA, 35 bp, Artificial Sequence
  Synthetic oligonucleotide
taatccgctgtttcctgttaggccttgttctgcca

SEQ ID NO: 37863 - DNA, 37 bp, Artificial Sequence
  Synthetic oligonucleotide
acgtggtgtaagtccgggggttgagagggggggcaga

SEQ ID NO: 37864 - DNA, 37 bp, Artificial Sequence
  Synthetic oligonucleotide
acctcagcaaaccgcgctgcattacgacctcccgaga

SEQ ID NO: 37865 - DNA, 37 bp, Artificial Sequence
  Synthetic oligonucleotide
tgtagccagagcctaccacttcccgccggatgaccga

SEQ ID NO: 37866 - DNA, 37 bp, Artificial Sequence
  Synthetic oligonucleotide
ctagtgccggttcgctcacgcacatgtccacgcccga

SEQ ID NO: 37867 - DNA, 36 bp, Artificial Sequence
  Synthetic oligonucleotide
tgcacgcacctccttcctaaaagctgcggactccga

SEQ ID NO: 37868 - DNA, 37 bp, Artificial Sequence
  Synthetic oligonucleotide
aacgcccatcctgaactttgtccgcactctcgcgcga

SEQ ID NO: 37869 - DNA, 37 bp, Artificial Sequence
  Synthetic oligonucleotide
agggtgtggggtggaatagtgagtatgtgcagaggga

SEQ ID NO: 37870 - DNA, 37 bp, Artificial Sequence
  Synthetic oligonucleotide
tgtggggggagaactgtacgaaggcgaggcgggtgga

SEQ ID NO: 37871 - DNA, 38 bp, Artificial Sequence
  Synthetic oligonucleotide
tacgccctgccccaatccctgtggactcgcctgagtga

SEQ ID NO: 37872 - DNA, 38 bp, Artificial Sequence
  Synthetic oligonucleotide
acaggagcatacaacggcgatacggtaggagagcgtga

SEQ ID NO: 37873 - DNA, 38 bp, Artificial Sequence
  Synthetic oligonucleotide
gaactgcgctcacccctgccctggcctcccgagcgtga

SEQ ID NO: 37874 - DNA, 37 bp, Artificial Sequence
  Synthetic oligonucleotide
aattcccagcacctgttctatctagtgtgcccattga

SEQ ID NO: 37875 - DNA, 38 bp, Artificial Sequence
  Synthetic oligonucleotide
gcgaggctgtccgacgatctactcttgacccattttga

SEQ ID NO: 37876 - DNA, 35 bp, Artificial Sequence
  Synthetic oligonucleotide
tccagttcgcgcctgcaactcgcactttccctcta

SEQ ID NO: 37877 - DNA, 35 bp, Artificial Sequence
  Synthetic oligonucleotide
aagataccgccatccacactccgcacagtgcaacc

SEQ ID NO: 37878 - DNA, 35 bp, Artificial Sequence
  Synthetic oligonucleotide
aaaccgtcccgttgaaccgtaagctctccatccgc

SEQ ID NO: 37879 - DNA, 35 bp, Artificial Sequence
  Synthetic oligonucleotide
actttcaccgctaacccatccgttccacgtcgcgc

SEQ ID NO: 37880 - DNA, 35 bp, Artificial Sequence
  Synthetic oligonucleotide
ttcagaactgctctcgcgcgaaccatgcccttctc

SEQ ID NO: 37881 - DNA, 35 bp, Artificial Sequence
  Synthetic oligonucleotide
tgcctattaccagtacaccctgctgtcactccttg

SEQ ID NO: 37882 - DNA, 35 bp, Artificial Sequence
  Synthetic oligonucleotide
ttgtcgtgctgttctttcttgtttacctgcgtact

SEQ ID NO: 37883 - DNA, 35 bp, Artificial Sequence
  Synthetic oligonucleotide
gaccggcccttgttttcgtaccgttccacccccct

SEQ ID NO: 37884 - DNA, 34 bp, Artificial Sequence
  Synthetic oligonucleotide
attccctgcgcaccgcctgaccgatcatgtgcct

SEQ ID NO: 37885 - DNA, 35 bp, Artificial Sequence
  Synthetic oligonucleotide
atggattcgatacatcactgcccgggccaccattt

SEQ ID NO: 37886 - DNA, 35 bp, Artificial Sequence
  Synthetic oligonucleotide
attgccacctcggggaggcccatcggactatattt

SEQ ID NO: 37887 - DNA, 35 bp, Artificial Sequence
  Synthetic oligonucleotide
acagcacgcgaggcgggcggtctatctttcctttt

SEQ ID NO: 37888 - DNA, 36 bp, Artificial Sequence
  Synthetic oligonucleotide
acacagagggcggggcattaatatgagggtggcaaa

SEQ ID NO: 37889 - DNA, 36 bp, Artificial Sequence
  Synthetic oligonucleotide
gcgacacccaaggcatctgcacctccgtctccccaa

SEQ ID NO: 37890 - DNA, 36 bp, Artificial Sequence
  Synthetic oligonucleotide
gcgagagaagggggctagtggtagaggggtagaaca

SEQ ID NO: 37891 - DNA, 36 bp, Artificial Sequence
  Synthetic oligonucleotide
acacaagggcgacccattgctttacgctgacctaca

SEQ ID NO: 37892 - DNA, 36 bp, Artificial Sequence
  Synthetic oligonucleotide
gctctcacggcctgaagcaccaccccactgattaca

SEQ ID NO: 37893 - DNA, 35 bp, Artificial Sequence
  Synthetic oligonucleotide
tctcgggcccctccgactcctttctagatattaca

SEQ ID NO: 37894 - DNA, 36 bp, Artificial Sequence
  Synthetic oligonucleotide
tcgagctcaccaacgtggtgggccgttcacctctca

SEQ ID NO: 37895 - DNA, 36 bp, Artificial Sequence
  Synthetic oligonucleotide
atgttaccaagcccgccgctgttttgccacagtaga

SEQ ID NO: 37896 - DNA, 37 bp, Artificial Sequence
  Synthetic oligonucleotide
tggacctcgcaggtgtacctcgcttcctccgccacga

SEQ ID NO: 37897 - DNA, 37 bp, Artificial Sequence
  Synthetic oligonucleotide
attgtccgcgtccatcccctgtttggcctgcgctcga

SEQ ID NO: 37898 - DNA, 37 bp, Artificial Sequence
  Synthetic oligonucleotide
gaacgctcccattgtttcttgcctcatcatctaagga

SEQ ID NO: 37899 - DNA, 37 bp, Artificial Sequence
  Synthetic oligonucleotide
gtggcctccacccgactcgcctttattgatgccagga

SEQ ID NO: 37900 - DNA, 37 bp, Artificial Sequence
  Synthetic oligonucleotide
gatccgtcccgacctccctgttgtggctactttagga

SEQ ID NO: 37901 - DNA, 37 bp, Artificial Sequence
  Synthetic oligonucleotide
tatccctcccttcacattgcgaacaccggaccacgga

SEQ ID NO: 37902 - DNA, 37 bp, Artificial Sequence
  Synthetic oligonucleotide
aacattatggcagcctgtgcaccacctgccccccgga

SEQ ID NO: 37903 - DNA, 37 bp, Artificial Sequence
  Synthetic oligonucleotide
gcgccctccagtggtaacctcctgccgcgtatccgga

SEQ ID NO: 37904 - DNA, 37 bp, Artificial Sequence
  Synthetic oligonucleotide
agaccagggcgggagggttggtgaagggagctccgga

SEQ ID NO: 37905 - DNA, 36 bp, Artificial Sequence
  Synthetic oligonucleotide
tgcagtaggggtcatgggaagggggatgggcctgga

SEQ ID NO: 37906 - DNA, 37 bp, Artificial Sequence
  Synthetic oligonucleotide
atgaccgtgaggttggtgcttctttcatcgctctgga

SEQ ID NO: 37907 - DNA, 38 bp, Artificial Sequence
  Synthetic oligonucleotide
gtagcgcacattgcgcgatctcagtattgacctcctga

SEQ ID NO: 37908 - DNA, 37 bp, Artificial Sequence
  Synthetic oligonucleotide
tgatcacaacgtagcaccttggccccaggattcctga

SEQ ID NO: 37909 - DNA, 38 bp, Artificial Sequence
  Synthetic oligonucleotide
ggggtgggcgggatgttcgagggtacctaagtaggtga

SEQ ID NO: 37910 - DNA, 38 bp, Artificial Sequence
  Synthetic oligonucleotide
aagccccgcccgcatacctcccttccagttctgggtga

SEQ ID NO: 37911 - DNA, 36 bp, Artificial Sequence
  Synthetic oligonucleotide
accctgactccgctccgatcggaccgacctgcttga

SEQ ID NO: 37912 - DNA, 38 bp, Artificial Sequence
  Synthetic oligonucleotide
cggacggaacggacctgcattctcgctatcatctttga

SEQ ID NO: 37913 - DNA, 38 bp, Artificial Sequence
  Synthetic oligonucleotide
gagtggcatgtaatcgcgtgtactcccttcttttttga

SEQ ID NO: 37914 - DNA, 38 bp, Artificial Sequence
  Synthetic oligonucleotide
taccaccccgacgaggttccctctgccttcttttttga

SEQ ID NO: 37915 - DNA, 35 bp, Artificial Sequence
  Synthetic oligonucleotide
tctttcacaccatgtaccaccgtgccactttgcta

SEQ ID NO: 37916 - DNA, 37 bp, Artificial Sequence
  Synthetic oligonucleotide
tgtccatccgcatggaggcctctcccttttcattcta

SEQ ID NO: 37917 - DNA, 36 bp, Artificial Sequence
  Synthetic oligonucleotide
aatgcgaatgcaggataaaggaggtggggttattta

SEQ ID NO: 37918 - DNA, 35 bp, Artificial Sequence
  Synthetic oligonucleotide
gactagccccgttgaggcggcaagtacctcccaac

SEQ ID NO: 37919 - DNA, 35 bp, Artificial Sequence
  Synthetic oligonucleotide
actggtccgcccgcacctttacctgtctgaattac

SEQ ID NO: 37920 - DNA, 35 bp, Artificial Sequence
  Synthetic oligonucleotide
tgcaaaccatgctccccacgcccataacttacgcc

SEQ ID NO: 37921 - DNA, 35 bp, Artificial Sequence
  Synthetic oligonucleotide
actcgttccgtgttgcaccctcctctctttaatcc

SEQ ID NO: 37922 - DNA, 35 bp, Artificial Sequence
  Synthetic oligonucleotide
gttggggggtggggaggtgttagcatgatgatggc

SEQ ID NO: 37923 - DNA, 35 bp, Artificial Sequence
  Synthetic oligonucleotide
gtgacacaaccactttggggcgtacttttacttgc

SEQ ID NO: 37924 - DNA, 35 bp, Artificial Sequence
  Synthetic oligonucleotide
aagtccagtccccccttaccgattgagtctgtctc

SEQ ID NO: 37925 - DNA, 35 bp, Artificial Sequence
  Synthetic oligonucleotide
gattatgcgcccgctctttgacaaatctccagttc

SEQ ID NO: 37926 - DNA, 35 bp, Artificial Sequence
  Synthetic oligonucleotide
ttcccaccgccttattacaactgccatcttgaccg

SEQ ID NO: 37927 - DNA, 35 bp, Artificial Sequence
  Synthetic oligonucleotide
tggactacatcatttctccactttatctgctatcg

SEQ ID NO: 37928 - DNA, 35 bp, Artificial Sequence
  Synthetic oligonucleotide
ttcgtgacttgccctgttccgtccacatcgattcg

SEQ ID NO: 37929 - DNA, 35 bp, Artificial Sequence
  Synthetic oligonucleotide
tgatgtagccgcacggttcgataccacttttctat

SEQ ID NO: 37930 - DNA, 35 bp, Artificial Sequence
  Synthetic oligonucleotide
gcgttaataacgccgcaagttccctccacctctgt

SEQ ID NO: 37931 - DNA, 35 bp, Artificial Sequence
  Synthetic oligonucleotide
gcacgagggctacctccatctgcactttgatattt

SEQ ID NO: 37932 - DNA, 36 bp, Artificial Sequence
  Synthetic oligonucleotide
acgatacggcctcacgcatctaccgtctttgccaaa

SEQ ID NO: 37933 - DNA, 36 bp, Artificial Sequence
  Synthetic oligonucleotide
tacaaggtggtggtagcgggactcgggatggctcaa

SEQ ID NO: 37934 - DNA, 35 bp, Artificial Sequence
  Synthetic oligonucleotide
gctccccgcggtcttctgctctttgattccacgaa

SEQ ID NO: 37935 - DNA, 35 bp, Artificial Sequence
  Synthetic oligonucleotide
gttctcgcgagccgtcgccccaatttgccgcccga

SEQ ID NO: 37936 - DNA, 37 bp, Artificial Sequence
  Synthetic oligonucleotide
tgccatacactgatttagcccacatcgcggactccga

SEQ ID NO: 37937 - DNA, 36 bp, Artificial Sequence
  Synthetic oligonucleotide
acccgccctccctcagttgatgcagaaataccggga

SEQ ID NO: 37938 - DNA, 37 bp, Artificial Sequence
  Synthetic oligonucleotide
gccaagcagggagggagggggtgtgtaggttctggga

SEQ ID NO: 37939 - DNA, 38 bp, Artificial Sequence
  Synthetic oligonucleotide
acgcaccgcacgagcgccgcccaatccacacataatga

SEQ ID NO: 37940 - DNA, 36 bp, Artificial Sequence
  Synthetic oligonucleotide
tagaaccacgttggtatctgcaccccaaatcactga

SEQ ID NO: 37941 - DNA, 38 bp, Artificial Sequence
  Synthetic oligonucleotide
tcaaatccgtgacaactgatatccccactgtaccctga

SEQ ID NO: 37942 - DNA, 38 bp, Artificial Sequence
  Synthetic oligonucleotide
gactcagccaccacatgctttacggtaaggcccagtga

SEQ ID NO: 37943 - DNA, 38 bp, Artificial Sequence
  Synthetic oligonucleotide
aacacgctaatgctatcccggccttacaccacacttga

SEQ ID NO: 37944 - DNA, 38 bp, Artificial Sequence
  Synthetic oligonucleotide
gaccagctggacatccttggccgcccgcatttccttga

SEQ ID NO: 37945 - DNA, 35 bp, Artificial Sequence
  Synthetic oligonucleotide
atcatacgaacaccatccggccactgccttggaac

SEQ ID NO: 37946 - DNA, 35 bp, Artificial Sequence
  Synthetic oligonucleotide
atcgacgcaatagtctatcacccgtactctgtcac

SEQ ID NO: 37947 - DNA, 35 bp, Artificial Sequence
  Synthetic oligonucleotide
atatgccagcctactatttccacccatgaatggac

SEQ ID NO: 37948 - DNA, 35 bp, Artificial Sequence
  Synthetic oligonucleotide
gccccctccaacaacgggtgtactctttgccgtac

SEQ ID NO: 37949 - DNA, 35 bp, Artificial Sequence
  Synthetic oligonucleotide
tcgactaccacgttgctgcctagctacttataacc

SEQ ID NO: 37950 - DNA, 37 bp, Artificial Sequence
  Synthetic oligonucleotide
acaccctgagacggtactacctacatgcacgggctcc

SEQ ID NO: 37951 - DNA, 35 bp, Artificial Sequence
  Synthetic oligonucleotide
ttccgtcagtccccagcttccattcccgactgcgc

SEQ ID NO: 37952 - DNA, 35 bp, Artificial Sequence
  Synthetic oligonucleotide
gtgcccattctggttacctcgcgcatacatatcgc

SEQ ID NO: 37953 - DNA, 35 bp, Artificial Sequence
  Synthetic oligonucleotide
tcgaagcaacgcaccataccgattcatacgtgctc

SEQ ID NO: 37954 - DNA, 35 bp, Artificial Sequence
  Synthetic oligonucleotide
tttgacactatctgtccatctctggtcctcgcttc

SEQ ID NO: 37955 - DNA, 35 bp, Artificial Sequence
  Synthetic oligonucleotide
gctaccatccatgcgtcgtttcgtcgtaacctgct

SEQ ID NO: 37956 - DNA, 36 bp, Artificial Sequence
  Synthetic oligonucleotide
gaaaccacagcaggggttagggagggcctccggaaa

SEQ ID NO: 37957 - DNA, 36 bp, Artificial Sequence
  Synthetic oligonucleotide
tgaccatcccggacgctcgctattgacacatcccaa

SEQ ID NO: 37958 - DNA, 35 bp, Artificial Sequence
  Synthetic oligonucleotide
agtagcaccccttgcccaaacccgctgccatagca

SEQ ID NO: 37959 - DNA, 37 bp, Artificial Sequence
  Synthetic oligonucleotide
tctaaccgggctgggagggggggaaggttgggcacga

SEQ ID NO: 37960 - DNA, 37 bp, Artificial Sequence
  Synthetic oligonucleotide
tcacaacacccggcaacgagcaaccttatctctagga

SEQ ID NO: 37961 - DNA, 37 bp, Artificial Sequence
  Synthetic oligonucleotide
taagcgcttccataccgtttagtcacctccccccgga

SEQ ID NO: 37962 - DNA, 36 bp, Artificial Sequence
  Synthetic oligonucleotide
acagtaaagctaaaggggcgggtacggagaatggga

SEQ ID NO: 37963 - DNA, 37 bp, Artificial Sequence
  Synthetic oligonucleotide
ttactcccctcgacgtactagggccccacctatggga

SEQ ID NO: 37964 - DNA, 38 bp, Artificial Sequence
  Synthetic oligonucleotide
ggggaagaggacgggcggtgaggagcgggggaggatga

SEQ ID NO: 37965 - DNA, 38 bp, Artificial Sequence
  Synthetic oligonucleotide
tgtacggtcgtgccatagtgccctcccctttaccctga

SEQ ID NO: 37966 - DNA, 38 bp, Artificial Sequence
  Synthetic oligonucleotide
acattgctctcagccgcgtgaaacgcaatccatcctga

SEQ ID NO: 37967 - DNA, 36 bp, Artificial Sequence
  Synthetic oligonucleotide
gttgcatcagctcattcacgaaatcacctatgctga

SEQ ID NO: 37968 - DNA, 36 bp, Artificial Sequence
  Synthetic oligonucleotide
taggagggggggaacggggtgggttattgagggtga

SEQ ID NO: 37969 - DNA, 36 bp, Artificial Sequence
  Synthetic oligonucleotide
gtaaagtggtactgaagggaagggaaaggtgggtga

SEQ ID NO: 37970 - DNA, 37 bp, Artificial Sequence
  Synthetic oligonucleotide
aatccacagacgtcagcattcgcctccatcttcttga

SEQ ID NO: 37971 - DNA, 37 bp, Artificial Sequence
  Synthetic oligonucleotide
gatgcgatgtcctcctattgttcttgttaccgtttga

SEQ ID NO: 37972 - DNA, 38 bp, Artificial Sequence
  Synthetic oligonucleotide
taccccgccgaagctattgtctgcctactcgcttttga

SEQ ID NO: 37973 - DNA, 36 bp, Artificial Sequence
  Synthetic oligonucleotide
tccacatactggagccattagaccgaccaccgttta

SEQ ID NO: 37974 - DNA, 35 bp, Artificial Sequence
  Synthetic oligonucleotide
gatgtcaccactagtaacacccaggccatatttac

SEQ ID NO: 37975 - DNA, 35 bp, Artificial Sequence
  Synthetic oligonucleotide
agtgggcgggaattttggggtaatgggatagcacc

SEQ ID NO: 37976 - DNA, 35 bp, Artificial Sequence
  Synthetic oligonucleotide
gacgtcgcttgacgtacatctcatctaaacttgcc

SEQ ID NO: 37977 - DNA, 35 bp, Artificial Sequence
  Synthetic oligonucleotide
acgacattcactttcttgatcacccgcttacttgc

SEQ ID NO: 37978 - DNA, 35 bp, Artificial Sequence
  Synthetic oligonucleotide
aactgtcggtccgcaggttttctctggtccctctc

SEQ ID NO: 37979 - DNA, 35 bp, Artificial Sequence
  Synthetic oligonucleotide
tcccctgggcgaatgccccctgacttccggttctc

SEQ ID NO: 37980 - DNA, 35 bp, Artificial Sequence
  Synthetic oligonucleotide
aacacgcacgcgcctttcacacttcatgcggggtc

SEQ ID NO: 37981 - DNA, 35 bp, Artificial Sequence
  Synthetic oligonucleotide
gagccataccacagctttgagtctcgtagtcgttc

SEQ ID NO: 37982 - DNA, 35 bp, Artificial Sequence
  Synthetic oligonucleotide
gacatcgtgccggaaagaacggggaaaagcggtgg

SEQ ID NO: 37983 - DNA, 35 bp, Artificial Sequence
  Synthetic oligonucleotide
tggacccatgttttccggagcctgtcccacccctg

SEQ ID NO: 37984 - DNA, 35 bp, Artificial Sequence
  Synthetic oligonucleotide
tcactgcaggggggaaggatgtccattgttggaat

SEQ ID NO: 37985 - DNA, 35 bp, Artificial Sequence
  Synthetic oligonucleotide
gacaattggagggaccagggaaggggaatggtaat

SEQ ID NO: 37986 - DNA, 35 bp, Artificial Sequence
  Synthetic oligonucleotide
tgttgggccatcattgtgcgtctcacactccggtt

SEQ ID NO: 37987 - DNA, 35 bp, Artificial Sequence
  Synthetic oligonucleotide
ggagaggggaagggtactagggtgatggcatgcaa

SEQ ID NO: 37988 - DNA, 35 bp, Artificial Sequence
  Synthetic oligonucleotide
gatgtccacgaactcatgcagaatgaactctctaa

SEQ ID NO: 37989 - DNA, 36 bp, Artificial Sequence
  Synthetic oligonucleotide
taccagttgccttcgaatgttccacgatccttcaca

SEQ ID NO: 37990 - DNA, 36 bp, Artificial Sequence
  Synthetic oligonucleotide
taagtccacgctgactcggcctgttcgttcccacca

SEQ ID NO: 37991 - DNA, 36 bp, Artificial Sequence
  Synthetic oligonucleotide
atctgtccacggcctagcacaccgtttaaccctcca

SEQ ID NO: 37992 - DNA, 37 bp, Artificial Sequence
  Synthetic oligonucleotide
gatacgtaagggaaaggagataacgcggacgagaaga

SEQ ID NO: 37993 - DNA, 37 bp, Artificial Sequence
  Synthetic oligonucleotide
gagatacgcaatgtatcggccccttctacttgtacga

SEQ ID NO: 37994 - DNA, 37 bp, Artificial Sequence
  Synthetic oligonucleotide
gagggccgaagtccgtaggggggtgaggtcacaagga

SEQ ID NO: 37995 - DNA, 36 bp, Artificial Sequence
  Synthetic oligonucleotide
tgaccacacactatgaacaagcacctcatttaagga

SEQ ID NO: 37996 - DNA, 36 bp, Artificial Sequence
  Synthetic oligonucleotide
gtagctcacagccccaccccgtcccctatcagagga

SEQ ID NO: 37997 - DNA, 37 bp, Artificial Sequence
  Synthetic oligonucleotide
agcgggtgggggtgcttccagcgaaggggaaggagga

SEQ ID NO: 37998 - DNA, 37 bp, Artificial Sequence
  Synthetic oligonucleotide
agaaggggtggtgaaattggagtgagggtatttggga

SEQ ID NO: 37999 - DNA, 37 bp, Artificial Sequence
  Synthetic oligonucleotide
tccgaatcccgcaatccaggcccacactcttacgtga

SEQ ID NO: 38000 - DNA, 37 bp, Artificial Sequence
  Synthetic oligonucleotide
gacctccctacgtaccgtcctgaccgtcatccggtga

SEQ ID NO: 38001 - DNA, 35 bp, Artificial Sequence
  Synthetic oligonucleotide
gtgaagccgcgggttagccacctgtcccttgacta

SEQ ID NO: 38002 - DNA, 36 bp, Artificial Sequence
  Synthetic oligonucleotide
tatcgcccatgatccgaacaagggtttttttttcta

SEQ ID NO: 38003 - DNA, 35 bp, Artificial Sequence
  Synthetic oligonucleotide
tgcatagcccctataaatatgcgttttctgtccac

SEQ ID NO: 38004 - DNA, 35 bp, Artificial Sequence
  Synthetic oligonucleotide
tccgagtcagtctctttatcttctgccccatttac

SEQ ID NO: 38005 - DNA, 35 bp, Artificial Sequence
  Synthetic oligonucleotide
aagcgtggaccagccgagtctttaccattagcccc

SEQ ID NO: 38006 - DNA, 35 bp, Artificial Sequence
  Synthetic oligonucleotide
gacaacacaccccttgaacccttcttgcataagcc

SEQ ID NO: 38007 - DNA, 34 bp, Artificial Sequence
  Synthetic oligonucleotide
ttatgtgccctgaaatgacttgtgccactaatcc

SEQ ID NO: 38008 - DNA, 35 bp, Artificial Sequence
  Synthetic oligonucleotide
tcgagtgcgccctcatgtactatctttggtcagtc

SEQ ID NO: 38009 - DNA, 35 bp, Artificial Sequence
  Synthetic oligonucleotide
tgcgtgtacgtagttactttcgccctcctcacgtc

SEQ ID NO: 38010 - DNA, 35 bp, Artificial Sequence
  Synthetic oligonucleotide
ttggtggcctggacggggtgggagaaataggtgcg

SEQ ID NO: 38011 - DNA, 35 bp, Artificial Sequence
  Synthetic oligonucleotide
tcacaacccatgccgcttgccccgagcatagaatg

SEQ ID NO: 38012 - DNA, 35 bp, Artificial Sequence
  Synthetic oligonucleotide
gctgtcctcgttgccccataaataccatacctttg

SEQ ID NO: 38013 - DNA, 35 bp, Artificial Sequence
  Synthetic oligonucleotide
acatccgtgtctcccatgccgcgatcctatcaaat

SEQ ID NO: 38014 - DNA, 35 bp, Artificial Sequence
  Synthetic oligonucleotide
tgggacgtgcgtgcccaggccaacatcccttccct

SEQ ID NO: 38015 - DNA, 35 bp, Artificial Sequence
  Synthetic oligonucleotide
gatgccggcctattccttacacaaacagacttgct

SEQ ID NO: 38016 - DNA, 35 bp, Artificial Sequence
  Synthetic oligonucleotide
tagtgcaggccgccactcatgtcagcaacaactct

SEQ ID NO: 38017 - DNA, 35 bp, Artificial Sequence
  Synthetic oligonucleotide
gtaccctccccacggcgtcgtccaagccctctcaa

SEQ ID NO: 38018 - DNA, 36 bp, Artificial Sequence
  Synthetic oligonucleotide
gtaacgctccaccttccatagctcctgtcatccaca

SEQ ID NO: 38019 - DNA, 36 bp, Artificial Sequence
  Synthetic oligonucleotide
tgcgctctgccgtcctggcaaaaacggtctcctcca

SEQ ID NO: 38020 - DNA, 35 bp, Artificial Sequence
  Synthetic oligonucleotide
tgctggacgttgggcactctttcctccgactatca

SEQ ID NO: 38021 - DNA, 37 bp, Artificial Sequence
  Synthetic oligonucleotide
cagtgggcgctgggtagtgaaggtgcgggtgggcaga

SEQ ID NO: 38022 - DNA, 37 bp, Artificial Sequence
  Synthetic oligonucleotide
tgccggggggaaaagggatgggttacgagcagataga

SEQ ID NO: 38023 - DNA, 37 bp, Artificial Sequence
  Synthetic oligonucleotide
actgaccccgcacgagtattagttccaacacccccga

SEQ ID NO: 38024 - DNA, 36 bp, Artificial Sequence
  Synthetic oligonucleotide
ggaccgggtacgctttttttcgccatcattccccga

SEQ ID NO: 38025 - DNA, 37 bp, Artificial Sequence
  Synthetic oligonucleotide
tgacacctcttaaatcagttcgtcccttctcctccga

SEQ ID NO: 38026 - DNA, 37 bp, Artificial Sequence
  Synthetic oligonucleotide
aaccgcatcagcatcatggctgcccctaaattctcga

SEQ ID NO: 38027 - DNA, 37 bp, Artificial Sequence
  Synthetic oligonucleotide
ttatgctaccgcccagtcgtccactatcccccgtcga

SEQ ID NO: 38028 - DNA, 37 bp, Artificial Sequence
  Synthetic oligonucleotide
atccgcactgaccatttgcctcttcatccaacacgga

SEQ ID NO: 38029 - DNA, 38 bp, Artificial Sequence
  Synthetic oligonucleotide
agaccaagcgcccaaactgaatccccgcgccatcatga

SEQ ID NO: 38030 - DNA, 37 bp, Artificial Sequence
  Synthetic oligonucleotide
atgactcaccgggtgtcctacgcaccacttcctatga

SEQ ID NO: 38031 - DNA, 38 bp, Artificial Sequence
  Synthetic oligonucleotide
ttactgaccgcttttgctctatctcagggacaccctga

SEQ ID NO: 38032 - DNA, 38 bp, Artificial Sequence
  Synthetic oligonucleotide
agcctccacacaaccagaatatccgctcacaactgtga

SEQ ID NO: 38033 - DNA, 37 bp, Artificial Sequence
  Synthetic oligonucleotide
actcacccggcatgaaggctccgttcctattccttga

SEQ ID NO: 38034 - DNA, 36 bp, Artificial Sequence
  Synthetic oligonucleotide
gtcctgccatcctgcacctctgaactatttccagta

SEQ ID NO: 38035 - DNA, 35 bp, Artificial Sequence
  Synthetic oligonucleotide
aatttccccacgtgccactctttcgcgcccatgta

SEQ ID NO: 38036 - DNA, 35 bp, Artificial Sequence
  Synthetic oligonucleotide
gcacacgacccggtagagcgcgcaacactcattta

SEQ ID NO: 38037 - DNA, 35 bp, Artificial Sequence
  Synthetic oligonucleotide
gtaacttcacacacaccccgctaactggtatcagc

SEQ ID NO: 38038 - DNA, 35 bp, Artificial Sequence
  Synthetic oligonucleotide
attgcctgcacctcacctttggcttaatctagagc

SEQ ID NO: 38039 - DNA, 35 bp, Artificial Sequence
  Synthetic oligonucleotide
aactccaatgcacgccacgtacgcttcaccccctc

SEQ ID NO: 38040 - DNA, 35 bp, Artificial Sequence
  Synthetic oligonucleotide
gatttgtcgagggctatcaatccattccaccggtc

SEQ ID NO: 38041 - DNA, 35 bp, Artificial Sequence
  Synthetic oligonucleotide
tgaccatccagcccgccccttacacgttaactgcg

SEQ ID NO: 38042 - DNA, 35 bp, Artificial Sequence
  Synthetic oligonucleotide
ggtcagccataccaaccgtgccctcgcccatcttg

SEQ ID NO: 38043 - DNA, 35 bp, Artificial Sequence
  Synthetic oligonucleotide
ggaccgaggcctccttcttatcgccatacgatttg

SEQ ID NO: 38044 - DNA, 35 bp, Artificial Sequence
  Synthetic oligonucleotide
tgagtaccgcccaagccacgatccccgaaccgact

SEQ ID NO: 38045 - DNA, 35 bp, Artificial Sequence
  Synthetic oligonucleotide
tcacaccccggagtgtacgcaagtcaacaaggcct

SEQ ID NO: 38046 - DNA, 35 bp, Artificial Sequence
  Synthetic oligonucleotide
gtgtggcgcgctgcggggcaagggcatggggtggt

SEQ ID NO: 38047 - DNA, 35 bp, Artificial Sequence
  Synthetic oligonucleotide
gtgaacccttgctgttgcgattcctcccgccactt

SEQ ID NO: 38048 - DNA, 36 bp, Artificial Sequence
  Synthetic oligonucleotide
acatccctccacatgtgagatcgcaacgctctccaa

SEQ ID NO: 38049 - DNA, 35 bp, Artificial Sequence
  Synthetic oligonucleotide
gactggctggggtgggagtgaagtggtagaaggaa

SEQ ID NO: 38050 - DNA, 35 bp, Artificial Sequence
  Synthetic oligonucleotide
agtccagctcctacgttacctctatgctgcaaaca

SEQ ID NO: 38051 - DNA, 36 bp, Artificial Sequence
  Synthetic oligonucleotide
aagtgcaccgtctcgtcagcttagtttacctaccca

SEQ ID NO: 38052 - DNA, 36 bp, Artificial Sequence
  Synthetic oligonucleotide
accctccatcatctccgcactctggcacctcgtgca

SEQ ID NO: 38053 - DNA, 37 bp, Artificial Sequence
  Synthetic oligonucleotide
acgcatagagggggggatcggtgggctcgcagggcga

SEQ ID NO: 38054 - DNA, 38 bp, Artificial Sequence
  Synthetic oligonucleotide
ggtaaccgcctcatcctgttagctgattctatgcctga

SEQ ID NO: 38055 - DNA, 38 bp, Artificial Sequence
  Synthetic oligonucleotide
gtccgagaaccgttgtactcttgttctgcctatcctga

SEQ ID NO: 38056 - DNA, 38 bp, Artificial Sequence
  Synthetic oligonucleotide
tacgcccttgcccaccaggacaccgcaccagtgagtga

SEQ ID NO: 38057 - DNA, 38 bp, Artificial Sequence
  Synthetic oligonucleotide
gcacatcccggtcatcctcttaactacctcactagtga

SEQ ID NO: 38058 - DNA, 38 bp, Artificial Sequence
  Synthetic oligonucleotide
acagcaatcagggcgggtgggaaaggggttttcattga

SEQ ID NO: 38059 - DNA, 36 bp, Artificial Sequence
  Synthetic oligonucleotide
ggacaatcgggctaatgggctggggagggggattga

SEQ ID NO: 38060 - DNA, 38 bp, Artificial Sequence
  Synthetic oligonucleotide
ttgacgcgagtcattcgtgtcatatccctccgctttga

SEQ ID NO: 38061 - DNA, 38 bp, Artificial Sequence
  Synthetic oligonucleotide
ttccgatctgcgccgcttgcttcccttagtccgtttga

SEQ ID NO: 38062 - DNA, 35 bp, Artificial Sequence
  Synthetic oligonucleotide
gagttcatgtcacatcctgctcctacacaactcta

SEQ ID NO: 38063 - DNA, 35 bp, Artificial Sequence
  Synthetic oligonucleotide
tctgtgcgcctccttttgggtgcatcagttcacac

SEQ ID NO: 38064 - DNA, 35 bp, Artificial Sequence
  Synthetic oligonucleotide
tcagccttacttgtgcccgttccaccgcctgcgac

SEQ ID NO: 38065 - DNA, 35 bp, Artificial Sequence
  Synthetic oligonucleotide
gttcccatcgcctatgcctcagaccccaaaaaagc

SEQ ID NO: 38066 - DNA, 35 bp, Artificial Sequence
  Synthetic oligonucleotide
gtcctacgccgactgtgctactatttcgtttctgc

SEQ ID NO: 38067 - DNA, 35 bp, Artificial Sequence
  Synthetic oligonucleotide
agagccccgccactgaacaaaatcgaccaattgcg

SEQ ID NO: 38068 - DNA, 35 bp, Artificial Sequence
  Synthetic oligonucleotide
aaacactgcgctttaccttctaagacccttccatg

SEQ ID NO: 38069 - DNA, 35 bp, Artificial Sequence
  Synthetic oligonucleotide
ggaccgcttgccatccgcgctttttgttgattctg

SEQ ID NO: 38070 - DNA, 35 bp, Artificial Sequence
  Synthetic oligonucleotide
tcgcatgacaggcctccatctaccgtttgaacgtg

SEQ ID NO: 38071 - DNA, 35 bp, Artificial Sequence
  Synthetic oligonucleotide
ttgctacgttcatcctcacattcgcgcctatcaat

SEQ ID NO: 38072 - DNA, 35 bp, Artificial Sequence
  Synthetic oligonucleotide
ccaccgaaggtgttcgccataacatcaccattctt

SEQ ID NO: 38073 - DNA, 35 bp, Artificial Sequence
  Synthetic oligonucleotide
agccatgtgttccgcacctgtacatctagctcttt

SEQ ID NO: 38074 - DNA, 35 bp, Artificial Sequence
  Synthetic oligonucleotide
tgatacgcgatggctctccatttacctcttttcaa

SEQ ID NO: 38075 - DNA, 37 bp, Artificial Sequence
  Synthetic oligonucleotide
atacaccggcgatgcctcgactctacttcttcaacga

SEQ ID NO: 38076 - DNA, 37 bp, Artificial Sequence
  Synthetic oligonucleotide
atcgcaccctggctatgaatctaccgcttccttacga

SEQ ID NO: 38077 - DNA, 38 bp, Artificial Sequence
  Synthetic oligonucleotide
gcgctgagtgagcaggaggtagggtgggggttcgatga

SEQ ID NO: 38078 - DNA, 38 bp, Artificial Sequence
  Synthetic oligonucleotide
aacctggtggggcaaaaacgggtgagaagatgggctga

SEQ ID NO: 38079 - DNA, 38 bp, Artificial Sequence
  Synthetic oligonucleotide
gctgcgctcgagtggctgggggggtggtgggcttctga

SEQ ID NO: 38080 - DNA, 38 bp, Artificial Sequence
  Synthetic oligonucleotide
ggagcggggaaccgaggtaaggggcggggttgcagtga

SEQ ID NO: 38081 - DNA, 38 bp, Artificial Sequence
  Synthetic oligonucleotide
gatgcgtgcagagctaggaagctggggaagaacggtga

SEQ ID NO: 38082 - DNA, 38 bp, Artificial Sequence
  Synthetic oligonucleotide
gcgagggtgggatgcacggttacggtggaggggggtga

SEQ ID NO: 38083 - DNA, 37 bp, Artificial Sequence
  Synthetic oligonucleotide
atcacactccgggtcgtatagttaacccccgctttga

SEQ ID NO: 38084 - DNA, 38 bp, Artificial Sequence
  Synthetic oligonucleotide
taccccgtctagctgcgtgctgctcctgtaccttttga

SEQ ID NO: 38085 - DNA, 35 bp, Artificial Sequence
  Synthetic oligonucleotide
atacaccccccggacttgatgccttgcgcttttga

SEQ ID NO: 38086 - DNA, 36 bp, Artificial Sequence
  Synthetic oligonucleotide
gtccgatcgaattgtattcgtaactatcactccata

SEQ ID NO: 38087 - DNA, 35 bp, Artificial Sequence
  Synthetic oligonucleotide
gacagaacgagccaggggaagggttggactgcata

SEQ ID NO: 38088 - DNA, 36 bp, Artificial Sequence
  Synthetic oligonucleotide
gccaaccacggccattcttttagcatgcaatattta

SEQ ID NO: 38089 - DNA, 35 bp, Artificial Sequence
  Synthetic oligonucleotide
gatggggtggttaaggcggtggaatgagcgtgcac

SEQ ID NO: 38090 - DNA, 35 bp, Artificial Sequence
  Synthetic oligonucleotide
tctctccccgccggaactagctactaactcttgac

SEQ ID NO: 38091 - DNA, 35 bp, Artificial Sequence
  Synthetic oligonucleotide
tcatgagtatccgccccccgtgagcttcttccacc

SEQ ID NO: 38092 - DNA, 35 bp, Artificial Sequence
  Synthetic oligonucleotide
tatgtccccgctagcctacggttcataggttaccc

SEQ ID NO: 38093 - DNA, 35 bp, Artificial Sequence
  Synthetic oligonucleotide
gtaccgagatcattgaacgaccccactatcatgcc

SEQ ID NO: 38094 - DNA, 35 bp, Artificial Sequence
  Synthetic oligonucleotide
tatagcacctggccattcatcttcgcctctcatcc

SEQ ID NO: 38095 - DNA, 35 bp, Artificial Sequence
  Synthetic oligonucleotide
ggatacgcatgccacacgttacgtgccttcgatcc

SEQ ID NO: 38096 - DNA, 35 bp, Artificial Sequence
  Synthetic oligonucleotide
aggtgatgcctcgacctgtacttagctaacctcgc

SEQ ID NO: 38097 - DNA, 35 bp, Artificial Sequence
  Synthetic oligonucleotide
tatgcgctagaacctttttacgcttcactacatgc

SEQ ID NO: 38098 - DNA, 36 bp, Artificial Sequence
  Synthetic oligonucleotide
accacccggatcttggtgcccttaaaatcagactgc

SEQ ID NO: 38099 - DNA, 35 bp, Artificial Sequence
  Synthetic oligonucleotide
gcacctccctgtattaccagcggctatacatgctc

SEQ ID NO: 38100 - DNA, 35 bp, Artificial Sequence
  Synthetic oligonucleotide
atgcccacgtccgtatcctgcggtctctggttctc

SEQ ID NO: 38101 - DNA, 35 bp, Artificial Sequence
  Synthetic oligonucleotide
aaaccgtgtcatccggttctagtgcaagggtattc

SEQ ID NO: 38102 - DNA, 35 bp, Artificial Sequence
  Synthetic oligonucleotide
gtgacaaaacgaaatctggagatggggccgggatg

SEQ ID NO: 38103 - DNA, 34 bp, Artificial Sequence
  Synthetic oligonucleotide
atgggcgggttgggcttactcggggcctatattg

SEQ ID NO: 38104 - DNA, 34 bp, Artificial Sequence
  Synthetic oligonucleotide
gccacggaatgcctattttaactcccctgcaact

SEQ ID NO: 38105 - DNA, 35 bp, Artificial Sequence
  Synthetic oligonucleotide
gtcaccaccttcccctcacttcgacatgttgtggt

SEQ ID NO: 38106 - DNA, 36 bp, Artificial Sequence
  Synthetic oligonucleotide
tgcggaatgggaagaaaaacggaaaaagcacgacaa

SEQ ID NO: 38107 - DNA, 35 bp, Artificial Sequence
  Synthetic oligonucleotide
taaccccacaccttcctgcgctcgactccggccaa

SEQ ID NO: 38108 - DNA, 35 bp, Artificial Sequence
  Synthetic oligonucleotide
acattattgccccccccactgaccgctgtgcgcaa

SEQ ID NO: 38109 - DNA, 36 bp, Artificial Sequence
  Synthetic oligonucleotide
tcactctcccactcctgccagcttgttccctgggaa

SEQ ID NO: 38110 - DNA, 36 bp, Artificial Sequence
  Synthetic oligonucleotide
tcacgtctgctatggttccctgctcattccccctaa

SEQ ID NO: 38111 - DNA, 36 bp, Artificial Sequence
  Synthetic oligonucleotide
agaccccgctgtacatccccggtttcaagtgcatca

SEQ ID NO: 38112 - DNA, 36 bp, Artificial Sequence
  Synthetic oligonucleotide
agacaacatcggctaatgtgctcctctatcccttca

SEQ ID NO: 38113 - DNA, 37 bp, Artificial Sequence
  Synthetic oligonucleotide
tactgtcgactggccgacgcctcaacatagcccccga

SEQ ID NO: 38114 - DNA, 37 bp, Artificial Sequence
  Synthetic oligonucleotide
tgcacagtgtcccgtaccgcccagcaccttctccgga

SEQ ID NO: 38115 - DNA, 37 bp, Artificial Sequence
  Synthetic oligonucleotide
gctgccgttaggcgatggggagctgggcgggtgggga

SEQ ID NO: 38116 - DNA, 37 bp, Artificial Sequence
  Synthetic oligonucleotide
aaaataggggagcttgggcgggggaatggagtctgga

SEQ ID NO: 38117 - DNA, 38 bp, Artificial Sequence
  Synthetic oligonucleotide
ttggtgaggccaagatgacttggttagggaatgggtga

SEQ ID NO: 38118 - DNA, 38 bp, Artificial Sequence
  Synthetic oligonucleotide
ggagacgggggtaatgaaaggggaagtgaagatggtga

SEQ ID NO: 38119 - DNA, 38 bp, Artificial Sequence
  Synthetic oligonucleotide
gtgcaacgggccgtaagtcaaagggggatgggagttga

SEQ ID NO: 38120 - DNA, 35 bp, Artificial Sequence
  Synthetic oligonucleotide
acgtccagtccagccgctgttcacgccgatacacc

SEQ ID NO: 38121 - DNA, 35 bp, Artificial Sequence
  Synthetic oligonucleotide
gagagtgcgcaggccaccatgtctggctaatcacc

SEQ ID NO: 38122 - DNA, 35 bp, Artificial Sequence
  Synthetic oligonucleotide
gtgcccccgtgatctagtttttccatttttagccc

SEQ ID NO: 38123 - DNA, 35 bp, Artificial Sequence
  Synthetic oligonucleotide
tagtggcatcctatcgcacctaacaaacgttctcc

SEQ ID NO: 38124 - DNA, 35 bp, Artificial Sequence
  Synthetic oligonucleotide
tccctcgcccactgttctgtttccagcggtcaagc

SEQ ID NO: 38125 - DNA, 35 bp, Artificial Sequence
  Synthetic oligonucleotide
atcacaggggaggagaaaggatgataggggggtgc

SEQ ID NO: 38126 - DNA, 35 bp, Artificial Sequence
  Synthetic oligonucleotide
actacattcactcgtcagcacccctcgctctagtc

SEQ ID NO: 38127 - DNA, 35 bp, Artificial Sequence
  Synthetic oligonucleotide
gacaaatcccatccatcgagacgccgtctccggtc

SEQ ID NO: 38128 - DNA, 35 bp, Artificial Sequence
  Synthetic oligonucleotide
tacgcatggcgcatggtaattcccggcctcctgtc

SEQ ID NO: 38129 - DNA, 35 bp, Artificial Sequence
  Synthetic oligonucleotide
gtccacacaataaatcaacgctggctatccacccg

SEQ ID NO: 38130 - DNA, 35 bp, Artificial Sequence
  Synthetic oligonucleotide
tgacatccatcccatcacctgcgtcgtttatcgtg

SEQ ID NO: 38131 - DNA, 35 bp, Artificial Sequence
  Synthetic oligonucleotide
tacgatcagccgcatttccgccctacctttgacat

SEQ ID NO: 38132 - DNA, 36 bp, Artificial Sequence
  Synthetic oligonucleotide
actcccgggtggtggtgccatccgcatctttgacaa

SEQ ID NO: 38133 - DNA, 35 bp, Artificial Sequence
  Synthetic oligonucleotide
ttggtgcataatgacctgccgtaacactctctcaa

SEQ ID NO: 38134 - DNA, 36 bp, Artificial Sequence
  Synthetic oligonucleotide
attttcatggccctgtccagcctgtaccaccaccca

SEQ ID NO: 38135 - DNA, 36 bp, Artificial Sequence
  Synthetic oligonucleotide
cacctgcatcacctctatgcggacccctgtttatca

SEQ ID NO: 38136 - DNA, 36 bp, Artificial Sequence
  Synthetic oligonucleotide
acatttcgctgtccaccatcaaggcccccccctaga

SEQ ID NO: 38137 - DNA, 37 bp, Artificial Sequence
  Synthetic oligonucleotide
tctaccgtccatactgccttttacttccattgctaga

SEQ ID NO: 38138 - DNA, 36 bp, Artificial Sequence
  Synthetic oligonucleotide
ggacccccacggtccatcgccctcttatctaacgga

SEQ ID NO: 38139 - DNA, 35 bp, Artificial Sequence
  Synthetic oligonucleotide
gtgagatggctgggtgtttgatggagggaggtgga

SEQ ID NO: 38140 - DNA, 38 bp, Artificial Sequence
  Synthetic oligonucleotide
tttacccggagcacccctccccgcctcttgtctggtga

SEQ ID NO: 38141 - DNA, 36 bp, Artificial Sequence
  Synthetic oligonucleotide
aaatggggcgaacaaactaggggcgtcggaggctta

SEQ ID NO: 38142 - DNA, 35 bp, Artificial Sequence
  Synthetic oligonucleotide
ttcactagcaaccacacatagcacgggggacggac

SEQ ID NO: 38143 - DNA, 35 bp, Artificial Sequence
  Synthetic oligonucleotide
gaccacctgcagcgctacaaccatgagcccctatc

SEQ ID NO: 38144 - DNA, 35 bp, Artificial Sequence
  Synthetic oligonucleotide
gggacaccacgtacgcggaactggcggtggaagag

SEQ ID NO: 38145 - DNA, 35 bp, Artificial Sequence
  Synthetic oligonucleotide
ggaacgcccccctgtcttgatctgtttttgtcacg

SEQ ID NO: 38146 - DNA, 35 bp, Artificial Sequence
  Synthetic oligonucleotide
tccaaacgtgcaccaattccccaggctttaccgcg

SEQ ID NO: 38147 - DNA, 35 bp, Artificial Sequence
  Synthetic oligonucleotide
accaggacagtcccatttaaagccaatacccgtcg

SEQ ID NO: 38148 - DNA, 35 bp, Artificial Sequence
  Synthetic oligonucleotide
acacgccttaatcaactgcacgaatctctgcctgg

SEQ ID NO: 38149 - DNA, 35 bp, Artificial Sequence
  Synthetic oligonucleotide
gtacctcccacgcatctcggacatagtagcacact

SEQ ID NO: 38150 - DNA, 35 bp, Artificial Sequence
  Synthetic oligonucleotide
gaggcgccgcagcatgctcatccttacccgcacct

SEQ ID NO: 38151 - DNA, 36 bp, Artificial Sequence
  Synthetic oligonucleotide
tatcgctcctccgactctgacttttgatgcctccaa

SEQ ID NO: 38152 - DNA, 35 bp, Artificial Sequence
  Synthetic oligonucleotide
agaacggggggggagagcacaagaacagggaagaa

SEQ ID NO: 38153 - DNA, 36 bp, Artificial Sequence
  Synthetic oligonucleotide
ttattaccacccgcctttgcctagagtcgttacgaa

SEQ ID NO: 38154 - DNA, 36 bp, Artificial Sequence
  Synthetic oligonucleotide
gacaaacctgatagtaggaggaggaaaaggggtgaa

SEQ ID NO: 38155 - DNA, 35 bp, Artificial Sequence
  Synthetic oligonucleotide
gaccacgcccacgtaatacaccctcgggaattgaa

SEQ ID NO: 38156 - DNA, 35 bp, Artificial Sequence
  Synthetic oligonucleotide
agaacgtccacggtcttctctctgactcacataca

SEQ ID NO: 38157 - DNA, 35 bp, Artificial Sequence
  Synthetic oligonucleotide
acaccccatctctccgttaggttgcttgtcatgca

SEQ ID NO: 38158 - DNA, 35 bp, Artificial Sequence
  Synthetic oligonucleotide
agtgctagggggacggtcttgggcgggggggatca

SEQ ID NO: 38159 - DNA, 36 bp, Artificial Sequence
  Synthetic oligonucleotide
atccacgcacagtggtgcatgcgtatcctctcacga

SEQ ID NO: 38160 - DNA, 37 bp, Artificial Sequence
  Synthetic oligonucleotide
acccattgtgcacattgtccccttcaagcctgagcga

SEQ ID NO: 38161 - DNA, 37 bp, Artificial Sequence
  Synthetic oligonucleotide
atcgacaccccttcatttatactccctctcactagga

SEQ ID NO: 38162 - DNA, 35 bp, Artificial Sequence
  Synthetic oligonucleotide
tgaacggtggaagggatagaggggtgatagtagga

SEQ ID NO: 38163 - DNA, 38 bp, Artificial Sequence
  Synthetic oligonucleotide
gatgcccacagggcgtcgacccagccttctccgtagga

SEQ ID NO: 38164 - DNA, 37 bp, Artificial Sequence
  Synthetic oligonucleotide
ggtggttgggtggtcggttctcgagcgggggagggga

SEQ ID NO: 38165 - DNA, 38 bp, Artificial Sequence
  Synthetic oligonucleotide
gccaacggggggggtgggtagtcagtttcgggccatga

SEQ ID NO: 38166 - DNA, 38 bp, Artificial Sequence
  Synthetic oligonucleotide
tgccttcgcctccctgtcaaggcacctgttatttatga

SEQ ID NO: 38167 - DNA, 38 bp, Artificial Sequence
  Synthetic oligonucleotide
ttgccaaagggggtaactgagggggaaaggagcactga

SEQ ID NO: 38168 - DNA, 38 bp, Artificial Sequence
  Synthetic oligonucleotide
gtgcctccacttccagccgccgtactacccccgagtga

SEQ ID NO: 38169 - DNA, 36 bp, Artificial Sequence
  Synthetic oligonucleotide
tctaacgccccttcttgctctgccttattcggacta

SEQ ID NO: 38170 - DNA, 36 bp, Artificial Sequence
  Synthetic oligonucleotide
ttgactagggcacattgaggggatctggggaactta

SEQ ID NO: 38171 - DNA, 36 bp, Artificial Sequence
  Synthetic oligonucleotide
tgcgatcgcccggatagcctattttcccttacgtta

SEQ ID NO: 38172 - DNA, 35 bp, Artificial Sequence
  Synthetic oligonucleotide
accgctttgcctccttctgcgttatccgtaatgcc

SEQ ID NO: 38173 - DNA, 35 bp, Artificial Sequence
  Synthetic oligonucleotide
tggatgttccaaccacggctggtcccttgtccctc

SEQ ID NO: 38174 - DNA, 35 bp, Artificial Sequence
  Synthetic oligonucleotide
agggccaactttgctatcgcgtgtactacgccttc

SEQ ID NO: 38175 - DNA, 35 bp, Artificial Sequence
  Synthetic oligonucleotide
acatcccagcctctcgtcctatacagaaccatgcg

SEQ ID NO: 38176 - DNA, 35 bp, Artificial Sequence
  Synthetic oligonucleotide
ttgaccccgtagcggggaacccctgtcccctcact

SEQ ID NO: 38177 - DNA, 35 bp, Artificial Sequence
  Synthetic oligonucleotide
aatgcgccctcgagaagttcagcatcatcctcact

SEQ ID NO: 38178 - DNA, 35 bp, Artificial Sequence
  Synthetic oligonucleotide
agtccacgtccaaagtctcggcgacgtttccccct

SEQ ID NO: 38179 - DNA, 35 bp, Artificial Sequence
  Synthetic oligonucleotide
aaagtgccacctgcccctcccgagtacgatattct

SEQ ID NO: 38180 - DNA, 35 bp, Artificial Sequence
  Synthetic oligonucleotide
tctactcacacccgtagctcggtgacaccttcttt

SEQ ID NO: 38181 - DNA, 35 bp, Artificial Sequence
  Synthetic oligonucleotide
tccaggcatggtttgcattaaacttcaccgcccca

SEQ ID NO: 38182 - DNA, 35 bp, Artificial Sequence
  Synthetic oligonucleotide
tagccgacgtttgtcttactcggttgcttatccca

SEQ ID NO: 38183 - DNA, 35 bp, Artificial Sequence
  Synthetic oligonucleotide
tccgggacggggcacatttgacgcatacatcttca

SEQ ID NO: 38184 - DNA, 35 bp, Artificial Sequence
  Synthetic oligonucleotide
gcaccgctcacccgcacccacactcgaggcgaaga

SEQ ID NO: 38185 - DNA, 37 bp, Artificial Sequence
  Synthetic oligonucleotide
accacccaaacgtcctatacacacttcgcagggccga

SEQ ID NO: 38186 - DNA, 37 bp, Artificial Sequence
  Synthetic oligonucleotide
tcaggaatcagccgccgacgtttgtcccctcttccga

SEQ ID NO: 38187 - DNA, 37 bp, Artificial Sequence
  Synthetic oligonucleotide
ttagggggaggtgattcgggagtggaggagcaaggga

SEQ ID NO: 38188 - DNA, 36 bp, Artificial Sequence
  Synthetic oligonucleotide
acagaggggcaaaggtgtgggtagtgttggggggga

SEQ ID NO: 38189 - DNA, 38 bp, Artificial Sequence
  Synthetic oligonucleotide
acttcatccgaacctggtgatttgcctctctccaatga

SEQ ID NO: 38190 - DNA, 36 bp, Artificial Sequence
  Synthetic oligonucleotide
ggggggttggggtagtggggtgccaaggagtgatga

SEQ ID NO: 38191 - DNA, 38 bp, Artificial Sequence
  Synthetic oligonucleotide
agagccgtctcctcacggtttttgcttacatcccctga

SEQ ID NO: 38192 - DNA, 38 bp, Artificial Sequence
  Synthetic oligonucleotide
tagagtgccaaccgatcttccatgtcgcccaccagtga

SEQ ID NO: 38193 - DNA, 38 bp, Artificial Sequence
  Synthetic oligonucleotide
tcagggagagatggaagtgggcttgtgggtacgagtga

SEQ ID NO: 38194 - DNA, 37 bp, Artificial Sequence
  Synthetic oligonucleotide
gattagtgggagtaggtagggtgcgtacagcgggtga

SEQ ID NO: 38195 - DNA, 38 bp, Artificial Sequence
  Synthetic oligonucleotide
agcacgggtatggggtagaaggagggcggaggcattga

SEQ ID NO: 38196 - DNA, 36 bp, Artificial Sequence
  Synthetic oligonucleotide
tcgccgtcccgtacgcgtgtccagtcctcgtcttta

SEQ ID NO: 38197 - DNA, 35 bp, Artificial Sequence
  Synthetic oligonucleotide
tacccccacgtgcagcactcgtactcttaaacaac

SEQ ID NO: 38198 - DNA, 35 bp, Artificial Sequence
  Synthetic oligonucleotide
gtccgtcgatctgctccctactcctgcatatacac

SEQ ID NO: 38199 - DNA, 35 bp, Artificial Sequence
  Synthetic oligonucleotide
ataccaccgcactttttcttgctgtcctgtttcac

SEQ ID NO: 38200 - DNA, 35 bp, Artificial Sequence
  Synthetic oligonucleotide
acggtcaccatccttctgccgggtaactttctgac

SEQ ID NO: 38201 - DNA, 35 bp, Artificial Sequence
  Synthetic oligonucleotide
tacgtgccacctacattactttatggacgatttac

SEQ ID NO: 38202 - DNA, 35 bp, Artificial Sequence
  Synthetic oligonucleotide
gccacgtgaccagtgactgtttaccacgtatcacc

SEQ ID NO: 38203 - DNA, 35 bp, Artificial Sequence
  Synthetic oligonucleotide
gttcatccctcacccccgcgctttacggctctacc

SEQ ID NO: 38204 - DNA, 35 bp, Artificial Sequence
  Synthetic oligonucleotide
gcctaccacgtattatcctcatttaagggtgcccc

SEQ ID NO: 38205 - DNA, 35 bp, Artificial Sequence
  Synthetic oligonucleotide
acttgcggtacatggtactctgtcacgcctcctcc

SEQ ID NO: 38206 - DNA, 35 bp, Artificial Sequence
  Synthetic oligonucleotide
gacggtctctcctattgcactctcacactacctgc

SEQ ID NO: 38207 - DNA, 35 bp, Artificial Sequence
  Synthetic oligonucleotide
gccttacgctcccccaatatagagtgcgccccctc

SEQ ID NO: 38208 - DNA, 35 bp, Artificial Sequence
  Synthetic oligonucleotide
gcattccctaactggtgtaccttccgtgaacgtat

SEQ ID NO: 38209 - DNA, 35 bp, Artificial Sequence
  Synthetic oligonucleotide
tgcaccatttgaactctggctgtgtctccttcact

SEQ ID NO: 38210 - DNA, 35 bp, Artificial Sequence
  Synthetic oligonucleotide
tgtggcgttcgaccggcatccagcaatcacactct

SEQ ID NO: 38211 - DNA, 35 bp, Artificial Sequence
  Synthetic oligonucleotide
atgtcggaagaagggggggagatgagacaacttgt

SEQ ID NO: 38212 - DNA, 36 bp, Artificial Sequence
  Synthetic oligonucleotide
gatgccgttcgtatgcgcccctagctcctaccggaa

SEQ ID NO: 38213 - DNA, 35 bp, Artificial Sequence
  Synthetic oligonucleotide
gttgttcgtcggataccccagcccgttccctttaa

SEQ ID NO: 38214 - DNA, 36 bp, Artificial Sequence
  Synthetic oligonucleotide
gaccgctccttagatccgattgccctcccctgtgca

SEQ ID NO: 38215 - DNA, 36 bp, Artificial Sequence
  Synthetic oligonucleotide
gcccacgtgccggggtcctccccacattggtattca

SEQ ID NO: 38216 - DNA, 37 bp, Artificial Sequence
  Synthetic oligonucleotide
acgtaagcaaactacagggtcgggaaaggggaggaga

SEQ ID NO: 38217 - DNA, 36 bp, Artificial Sequence
  Synthetic oligonucleotide
gcctccgccgaccagcccaacatagtattgcctcga

SEQ ID NO: 38218 - DNA, 37 bp, Artificial Sequence
  Synthetic oligonucleotide
tacgcgcacattactaaattgaatcctgctttttcga

SEQ ID NO: 38219 - DNA, 37 bp, Artificial Sequence
  Synthetic oligonucleotide
gtagcctccctgctgctaaaccggggccctttctgga

SEQ ID NO: 38220 - DNA, 36 bp, Artificial Sequence
  Synthetic oligonucleotide
ggggatgttggcctgagtgggcgaagggggggtgga

SEQ ID NO: 38221 - DNA, 36 bp, Artificial Sequence
  Synthetic oligonucleotide
gtggagaaggtcgttaaggaggagcaaggacggtga

SEQ ID NO: 38222 - DNA, 38 bp, Artificial Sequence
  Synthetic oligonucleotide
gtccaaccgcacactaatttaattgcgcctgtctttga

SEQ ID NO: 38223 - DNA, 35 bp, Artificial Sequence
  Synthetic oligonucleotide
attggcacttccctatgccgttttgcgttccttac

SEQ ID NO: 38224 - DNA, 35 bp, Artificial Sequence
  Synthetic oligonucleotide
gaacacgagagcgctctgttcgcctttcgccaccc

SEQ ID NO: 38225 - DNA, 35 bp, Artificial Sequence
  Synthetic oligonucleotide
ttgcctgaggagcatgcgcggctcctaccttcccc

SEQ ID NO: 38226 - DNA, 35 bp, Artificial Sequence
  Synthetic oligonucleotide
accatcatgctcatgttcctttatgcccgagctcc

SEQ ID NO: 38227 - DNA, 35 bp, Artificial Sequence
  Synthetic oligonucleotide
atgggtgggagggtggcggccggtttcgcgagtgc

SEQ ID NO: 38228 - DNA, 35 bp, Artificial Sequence
  Synthetic oligonucleotide
tgtcgttcactacgccctcccggcccttgtcttgc

SEQ ID NO: 38229 - DNA, 35 bp, Artificial Sequence
  Synthetic oligonucleotide
aatgcttagtgaagcgggtgggagggtgatgggcg

SEQ ID NO: 38230 - DNA, 35 bp, Artificial Sequence
  Synthetic oligonucleotide
acgctctggcaggacgtcttcatcaccttcttttg

SEQ ID NO: 38231 - DNA, 35 bp, Artificial Sequence
  Synthetic oligonucleotide
accatccgttcggcgatatctccacggcaccctat

SEQ ID NO: 38232 - DNA, 35 bp, Artificial Sequence
  Synthetic oligonucleotide
gcctacctggtggagaatacctgccgcgcctccgt

SEQ ID NO: 38233 - DNA, 35 bp, Artificial Sequence
  Synthetic oligonucleotide
gcgtggcgagctttcgctgcttcctgaaaccctgt

SEQ ID NO: 38234 - DNA, 35 bp, Artificial Sequence
  Synthetic oligonucleotide
acgcactgccgacctcgtatattctcaccacgctt

SEQ ID NO: 38235 - DNA, 36 bp, Artificial Sequence
  Synthetic oligonucleotide
gccccggccaagtgtcgaggcctacctccattccaa

SEQ ID NO: 38236 - DNA, 36 bp, Artificial Sequence
  Synthetic oligonucleotide
accacccttcccttccatgcatacagtccttgtaca

SEQ ID NO: 38237 - DNA, 35 bp, Artificial Sequence
  Synthetic oligonucleotide
agttacccgaccatgtcctttactcacttgaatca

SEQ ID NO: 38238 - DNA, 36 bp, Artificial Sequence
  Synthetic oligonucleotide
actctcgccactactatgaccattcatgtcccctca

SEQ ID NO: 38239 - DNA, 37 bp, Artificial Sequence
  Synthetic oligonucleotide
tgcggagggagtagagggggtgggaacgataagccga

SEQ ID NO: 38240 - DNA, 37 bp, Artificial Sequence
  Synthetic oligonucleotide
cctgtccccacgcacccgtactgtcaccttatgccga

SEQ ID NO: 38241 - DNA, 37 bp, Artificial Sequence
  Synthetic oligonucleotide
gcatgtactctggctgcacgttgcactcctacctcga

SEQ ID NO: 38242 - DNA, 37 bp, Artificial Sequence
  Synthetic oligonucleotide
gtgaagagggaaatggggttgaagggtctcgcgggga

SEQ ID NO: 38243 - DNA, 38 bp, Artificial Sequence
  Synthetic oligonucleotide
tcatgtgccagagttgtgatctcccctctgctgcctga

SEQ ID NO: 38244 - DNA, 36 bp, Artificial Sequence
  Synthetic oligonucleotide
tgctggtggtccagagggggggcagggaacgggtga

SEQ ID NO: 38245 - DNA, 38 bp, Artificial Sequence
  Synthetic oligonucleotide
gactcacgcctccgaactaaacttctcactcagtgtga

SEQ ID NO: 38246 - DNA, 37 bp, Artificial Sequence
  Synthetic oligonucleotide
tcaagcccgcaacagtgctggcgtttttttcttgtga

SEQ ID NO: 38247 - DNA, 38 bp, Artificial Sequence
  Synthetic oligonucleotide
gtgaagcccccatgtcttcggccctttgcttccattga

SEQ ID NO: 38248 - DNA, 38 bp, Artificial Sequence
  Synthetic oligonucleotide
tgcacccctgactcgcacttgaagaaggcacttattga

SEQ ID NO: 38249 - DNA, 38 bp, Artificial Sequence
  Synthetic oligonucleotide
accgacggtacgtacgttaacgcctcaactttttttga

SEQ ID NO: 38250 - DNA, 35 bp, Artificial Sequence
  Synthetic oligonucleotide
aatccacactgcatgtactccgtctcgggttacac

SEQ ID NO: 38251 - DNA, 35 bp, Artificial Sequence
  Synthetic oligonucleotide
ttcgggtccgccacctgtcgtgcatgcatactgcc

SEQ ID NO: 38252 - DNA, 35 bp, Artificial Sequence
  Synthetic oligonucleotide
tcacatgcacctggattttacataccacgtactcg

SEQ ID NO: 38253 - DNA, 35 bp, Artificial Sequence
  Synthetic oligonucleotide
ggacactcccctcggcgcgagaacacgcacctcat

SEQ ID NO: 38254 - DNA, 35 bp, Artificial Sequence
  Synthetic oligonucleotide
gatggaactggggggggaagggttgtactgcggtt

SEQ ID NO: 38255 - DNA, 35 bp, Artificial Sequence
  Synthetic oligonucleotide
gtagccacaaaagggggctggaaggacaaagggtt

SEQ ID NO: 38256 - DNA, 35 bp, Artificial Sequence
  Synthetic oligonucleotide
ttgcggtcacattctggttctgcttatccatccaa

SEQ ID NO: 38257 - DNA, 36 bp, Artificial Sequence
  Synthetic oligonucleotide
gggaacgtggaaataggcaagcggattaggggagaa

SEQ ID NO: 38258 - DNA, 36 bp, Artificial Sequence
  Synthetic oligonucleotide
tcctggccgcccctcgataccttcttgttcggttca

SEQ ID NO: 38259 - DNA, 36 bp, Artificial Sequence
  Synthetic oligonucleotide
tcaccatccagctaggtcagggggggtggagtttca

SEQ ID NO: 38260 - DNA, 37 bp, Artificial Sequence
  Synthetic oligonucleotide
ttccaccgcccgtcccaccactcactagggccctaga

SEQ ID NO: 38261 - DNA, 37 bp, Artificial Sequence
  Synthetic oligonucleotide
gaccaccacaccagtgcattcgatgtcaattaatcga

SEQ ID NO: 38262 - DNA, 37 bp, Artificial Sequence
  Synthetic oligonucleotide
ggaataccgcacaactccgccgcctcttggtcctgga

SEQ ID NO: 38263 - DNA, 37 bp, Artificial Sequence
  Synthetic oligonucleotide
atcggggggggtggttgaatctttagggcaatgtgga

SEQ ID NO: 38264 - DNA, 38 bp, Artificial Sequence
  Synthetic oligonucleotide
gatacgcacaccctcaccatcgcagatcacatgaatga

SEQ ID NO: 38265 - DNA, 38 bp, Artificial Sequence
  Synthetic oligonucleotide
gagcagaaagggcgcttatcaggggggacatgggatga

SEQ ID NO: 38266 - DNA, 38 bp, Artificial Sequence
  Synthetic oligonucleotide
taagcacgcaacttgcatgatgtgtactctctacgtga

SEQ ID NO: 38267 - DNA, 37 bp, Artificial Sequence
  Synthetic oligonucleotide
gaaggagtgggctgggtgtctcggaggattagggtga

SEQ ID NO: 38268 - DNA, 36 bp, Artificial Sequence
  Synthetic oligonucleotide
agccacggtgcgcatcgcactgccccacccccttga

SEQ ID NO: 38269 - DNA, 36 bp, Artificial Sequence
  Synthetic oligonucleotide
acatcgagtgctgcattggctaccccctttccgtta

SEQ ID NO: 38270 - DNA, 35 bp, Artificial Sequence
  Synthetic oligonucleotide
atcatggccagtggacattagcataacttccccac

SEQ ID NO: 38271 - DNA, 35 bp, Artificial Sequence
  Synthetic oligonucleotide
ttttgcgccccatggcgttcactgcttttcacccc

SEQ ID NO: 38272 - DNA, 35 bp, Artificial Sequence
  Synthetic oligonucleotide
tgcaccctgcgcgacttaccggtcattggatcccc

SEQ ID NO: 38273 - DNA, 35 bp, Artificial Sequence
  Synthetic oligonucleotide
ttagcctgacatcgttgacccgcattatttcattc

SEQ ID NO: 38274 - DNA, 35 bp, Artificial Sequence
  Synthetic oligonucleotide
gtcacactccgtttctgtactcaactaaaattttc

SEQ ID NO: 38275 - DNA, 35 bp, Artificial Sequence
  Synthetic oligonucleotide
tcaggccgcgcacctcgtctgcctccacatctacg

SEQ ID NO: 38276 - DNA, 35 bp, Artificial Sequence
  Synthetic oligonucleotide
cacgatcgcccttgtcctattgtagttccttcctg

SEQ ID NO: 38277 - DNA, 35 bp, Artificial Sequence
  Synthetic oligonucleotide
atgatggaggacgtgaggaacaggggtttgaggtg

SEQ ID NO: 38278 - DNA, 34 bp, Artificial Sequence
  Synthetic oligonucleotide
agtcgcacggcttctgccccattgactctccact

SEQ ID NO: 38279 - DNA, 35 bp, Artificial Sequence
  Synthetic oligonucleotide
gctgccgtcggttgaacccttcctcgcatacgctt

SEQ ID NO: 38280 - DNA, 35 bp, Artificial Sequence
  Synthetic oligonucleotide
tgcctttgccagaccatacacacattacggcctaa

SEQ ID NO: 38281 - DNA, 36 bp, Artificial Sequence
  Synthetic oligonucleotide
gcggagcacactgcctgaccatgcataatctcttaa

SEQ ID NO: 38282 - DNA, 36 bp, Artificial Sequence
  Synthetic oligonucleotide
gtaccgaccgtctgccacgctcaaattcacccccca

SEQ ID NO: 38283 - DNA, 35 bp, Artificial Sequence
  Synthetic oligonucleotide
tccgccctagtcccgctctcgttggatggccccca

SEQ ID NO: 38284 - DNA, 36 bp, Artificial Sequence
  Synthetic oligonucleotide
tctagccaacctgcccttcgaaccagatacgagcca

SEQ ID NO: 38285 - DNA, 36 bp, Artificial Sequence
  Synthetic oligonucleotide
gcaacccgccgctgaacctgtcacattagaatggca

SEQ ID NO: 38286 - DNA, 35 bp, Artificial Sequence
  Synthetic oligonucleotide
gccggggaaagaggagtgggaggggacggtgatca

SEQ ID NO: 38287 - DNA, 36 bp, Artificial Sequence
  Synthetic oligonucleotide
taaccaccggtgcctgggcttacacattttttttca

SEQ ID NO: 38288 - DNA, 37 bp, Artificial Sequence
  Synthetic oligonucleotide
ggaactaaggtgaggggggtggaatgagaagggcaga

SEQ ID NO: 38289 - DNA, 37 bp, Artificial Sequence
  Synthetic oligonucleotide
ttagacgcctctgcttatgttcgccctggaccaccga

SEQ ID NO: 38290 - DNA, 37 bp, Artificial Sequence
  Synthetic oligonucleotide
ttgcagccgcgaccatgtaaagcttccaccgccccga

SEQ ID NO: 38291 - DNA, 37 bp, Artificial Sequence
  Synthetic oligonucleotide
ttcagctgcctatcgcgtagtccaccccggatcccga

SEQ ID NO: 38292 - DNA, 37 bp, Artificial Sequence
  Synthetic oligonucleotide
acgcccccatattgattagctccttcaacctctccga

SEQ ID NO: 38293 - DNA, 37 bp, Artificial Sequence
  Synthetic oligonucleotide
gacgtgagttcgaagcgagggagagtggggaggggga

SEQ ID NO: 38294 - DNA, 37 bp, Artificial Sequence
  Synthetic oligonucleotide
gaccgcgtgggtgagaagggcaagggacgggggggga

SEQ ID NO: 38295 - DNA, 37 bp, Artificial Sequence
  Synthetic oligonucleotide
tctcggccccgcactcaccacgcttttatcaccctga

SEQ ID NO: 38296 - DNA, 38 bp, Artificial Sequence
  Synthetic oligonucleotide
ttcgaggcgtggtccctgctctcacatacattgcctga

SEQ ID NO: 38297 - DNA, 37 bp, Artificial Sequence
  Synthetic oligonucleotide
tgctccgtcacctgcctcagaatctcactttcgctga

SEQ ID NO: 38298 - DNA, 36 bp, Artificial Sequence
  Synthetic oligonucleotide
ttgtccccagccttcctcgttctcttgcactggtga

SEQ ID NO: 38299 - DNA, 38 bp, Artificial Sequence
  Synthetic oligonucleotide
gccgatctgcggccccctcccctacatacacggcttga

SEQ ID NO: 38300 - DNA, 37 bp, Artificial Sequence
  Synthetic oligonucleotide
tccacccactgcacagtaaacgatcaacagcgtttga

SEQ ID NO: 38301 - DNA, 35 bp, Artificial Sequence
  Synthetic oligonucleotide
gtcccgctctattcaccctaaccatagcccttagc

SEQ ID NO: 38302 - DNA, 35 bp, Artificial Sequence
  Synthetic oligonucleotide
tgcaggaccacgatgtctagtactgcacccctctc

SEQ ID NO: 38303 - DNA, 35 bp, Artificial Sequence
  Synthetic oligonucleotide
atgcccccacccggcaaatttttagcgtgttgttc

SEQ ID NO: 38304 - DNA, 35 bp, Artificial Sequence
  Synthetic oligonucleotide
tcactttgggccgtatatctgccactgttactgtg

SEQ ID NO: 38305 - DNA, 35 bp, Artificial Sequence
  Synthetic oligonucleotide
ggtcgggcctcactattctccgcgtgtttcattat

SEQ ID NO: 38306 - DNA, 35 bp, Artificial Sequence
  Synthetic oligonucleotide
tactcgccttttctgtagcgcccttttgctcgcct

SEQ ID NO: 38307 - DNA, 35 bp, Artificial Sequence
  Synthetic oligonucleotide
acaacccgccgaaatctacagtttctggtttgcct

SEQ ID NO: 38308 - DNA, 35 bp, Artificial Sequence
  Synthetic oligonucleotide
gttcgacatgcctaactacatccaccaccaagtgt

SEQ ID NO: 38309 - DNA, 35 bp, Artificial Sequence
  Synthetic oligonucleotide
gacccccagaatccatgtccagcccccgctctcaa

SEQ ID NO: 38310 - DNA, 35 bp, Artificial Sequence
  Synthetic oligonucleotide
ggtaccacttgcctgctttgattcatggccttcaa

SEQ ID NO: 38311 - DNA, 36 bp, Artificial Sequence
  Synthetic oligonucleotide
tccacatcctctcaacttcgctccacgtgctcgtca

SEQ ID NO: 38312 - DNA, 36 bp, Artificial Sequence
  Synthetic oligonucleotide
tcctcacgatacatatgctatacctcttctgcttca

SEQ ID NO: 38313 - DNA, 37 bp, Artificial Sequence
  Synthetic oligonucleotide
agcacgcactatgtttttctgcacatcatatgcccga

SEQ ID NO: 38314 - DNA, 37 bp, Artificial Sequence
  Synthetic oligonucleotide
tgcgtgccttcattcgtagttatctttgctccatgga

SEQ ID NO: 38315 - DNA, 35 bp, Artificial Sequence
  Synthetic oligonucleotide
ttcacgccgccctcgcctcacaattcctattatga

SEQ ID NO: 38316 - DNA, 38 bp, Artificial Sequence
  Synthetic oligonucleotide
acatcaccctcacgcaactgcataacctgttcttctga

SEQ ID NO: 38317 - DNA, 38 bp, Artificial Sequence
  Synthetic oligonucleotide
tcgatgccagccggtaacccatttctccacgcccgtga

SEQ ID NO: 38318 - DNA, 38 bp, Artificial Sequence
  Synthetic oligonucleotide
taagaggatgggccagtgagaagggtgaatagtattga

SEQ ID NO: 38319 - DNA, 38 bp, Artificial Sequence
  Synthetic oligonucleotide
ttgacccgaccgacaatgtgttttcttccatcctttga

SEQ ID NO: 38320 - DNA, 36 bp, Artificial Sequence
  Synthetic oligonucleotide
tgccactgtgtccgacctttatcttgcaacgtacta

SEQ ID NO: 38321 - DNA, 36 bp, Artificial Sequence
  Synthetic oligonucleotide
aacaccagacccttttcttcacgcctcgccactgta

SEQ ID NO: 38322 - DNA, 36 bp, Artificial Sequence
  Synthetic oligonucleotide
gatggcggagtaagggaatgcttgggagggaaatta

SEQ ID NO: 38323 - DNA, 35 bp, Artificial Sequence
  Synthetic oligonucleotide
taacatcaccggactttcgccgaacagggcccaac

SEQ ID NO: 38324 - DNA, 33 bp, Artificial Sequence
  Synthetic oligonucleotide
gtcgtggcgtccctcgttcgcttccctgtacac

SEQ ID NO: 38325 - DNA, 35 bp, Artificial Sequence
  Synthetic oligonucleotide
gacccaacccaactacggtaccagagatcaagcac

SEQ ID NO: 38326 - DNA, 35 bp, Artificial Sequence
  Synthetic oligonucleotide
gaccccccaagtaatctgtcgcactcatagtcgcc

SEQ ID NO: 38327 - DNA, 35 bp, Artificial Sequence
  Synthetic oligonucleotide
acaacaaccaccgtccgacatacagggctctatcc

SEQ ID NO: 38328 - DNA, 35 bp, Artificial Sequence
  Synthetic oligonucleotide
gatacccatcccggcgaaccgtcaaactcgacggc

SEQ ID NO: 38329 - DNA, 35 bp, Artificial Sequence
  Synthetic oligonucleotide
gatggccagaccgcctaaggtagcctcttgttctc

SEQ ID NO: 38330 - DNA, 35 bp, Artificial Sequence
  Synthetic oligonucleotide
acagccgttacactggctaaattggttcgatcttc

SEQ ID NO: 38331 - DNA, 35 bp, Artificial Sequence
  Synthetic oligonucleotide
atttacctcacccgttgccgccctggtaccacagg

SEQ ID NO: 38332 - DNA, 35 bp, Artificial Sequence
  Synthetic oligonucleotide
tggtcacacgccgacgttcatcgcgcctcccttct

SEQ ID NO: 38333 - DNA, 35 bp, Artificial Sequence
  Synthetic oligonucleotide
tgacaaccctatccggaatagttgtagccttcctt

SEQ ID NO: 38334 - DNA, 36 bp, Artificial Sequence
  Synthetic oligonucleotide
gaagaggatgggattgggcaagcataaccgaggaaa

SEQ ID NO: 38335 - DNA, 36 bp, Artificial Sequence
  Synthetic oligonucleotide
ttacccctccctcagagacgtgacacccaacatgaa

SEQ ID NO: 38336 - DNA, 36 bp, Artificial Sequence
  Synthetic oligonucleotide
tagcacccacccactctgacggcctttagtagtgaa

SEQ ID NO: 38337 - DNA, 35 bp, Artificial Sequence
  Synthetic oligonucleotide
ggaacatccctgtgcaaggataaccacacaccaca

SEQ ID NO: 38338 - DNA, 36 bp, Artificial Sequence
  Synthetic oligonucleotide
aaatccatgccctgtgccttgttacgtttatccaca

SEQ ID NO: 38339 - DNA, 36 bp, Artificial Sequence
  Synthetic oligonucleotide
tctggcccctgctattttcatgaactgctttgacca

SEQ ID NO: 38340 - DNA, 37 bp, Artificial Sequence
  Synthetic oligonucleotide
taccgcctcatcacacggcacacacccttgtcaccca

SEQ ID NO: 38341 - DNA, 36 bp, Artificial Sequence
  Synthetic oligonucleotide
tagtccccgcacgaaccatagatgatgccactgcca

SEQ ID NO: 38342 - DNA, 37 bp, Artificial Sequence
  Synthetic oligonucleotide
acccgacggccaggatacgcacttactctaccccaga

SEQ ID NO: 38343 - DNA, 35 bp, Artificial Sequence
  Synthetic oligonucleotide
aaccgcactggccctaaccatacctctatccacga

SEQ ID NO: 38344 - DNA, 37 bp, Artificial Sequence
  Synthetic oligonucleotide
ggatcggcctcatccctgccttttcagaccataagga

SEQ ID NO: 38345 - DNA, 35 bp, Artificial Sequence
  Synthetic oligonucleotide
atgggggtagggtaggcaagggtgtcagggccgga

SEQ ID NO: 38346 - DNA, 37 bp, Artificial Sequence
  Synthetic oligonucleotide
gtgagggagcaagttaggacagggatagtgggaggga

SEQ ID NO: 38347 - DNA, 37 bp, Artificial Sequence
  Synthetic oligonucleotide
aacaacacacgaccacactgatactagaggctctgga

SEQ ID NO: 38348 - DNA, 37 bp, Artificial Sequence
  Synthetic oligonucleotide
atgctgtggcgggacaaagggaagaacgaagacatga

SEQ ID NO: 38349 - DNA, 38 bp, Artificial Sequence
  Synthetic oligonucleotide
accaccgaccaagacgctcccattccttgcttacatga

SEQ ID NO: 38350 - DNA, 37 bp, Artificial Sequence
  Synthetic oligonucleotide
gagggtgccaccggttcgttttcctgcaccaccatga

SEQ ID NO: 38351 - DNA, 36 bp, Artificial Sequence
  Synthetic oligonucleotide
agtcgaaccttcaggcgccctcccgtctttacctga

SEQ ID NO: 38352 - DNA, 38 bp, Artificial Sequence
  Synthetic oligonucleotide
acatcgtaccgaacgtcaacctctgcatccttccctga

SEQ ID NO: 38353 - DNA, 38 bp, Artificial Sequence
  Synthetic oligonucleotide
gagacacgaaggtggagtccatgattacaggtaggtga

SEQ ID NO: 38354 - DNA, 37 bp, Artificial Sequence
  Synthetic oligonucleotide
gagataaccgggtatggggagcatagggtgagggtga

SEQ ID NO: 38355 - DNA, 36 bp, Artificial Sequence
  Synthetic oligonucleotide
atacgaccgctccatcctattccagcttttatttga

SEQ ID NO: 38356 - DNA, 36 bp, Artificial Sequence
  Synthetic oligonucleotide
gcttgatcgtagcatctggccatggaccttgcccta

SEQ ID NO: 38357 - DNA, 36 bp, Artificial Sequence
  Synthetic oligonucleotide
gccctcttagccggtcgcattcatctcccgccctta

SEQ ID NO: 38358 - DNA, 35 bp, Artificial Sequence
  Synthetic oligonucleotide
tacgatttcctgcccgtcccttcatgcgcttgcac

SEQ ID NO: 38359 - DNA, 35 bp, Artificial Sequence
  Synthetic oligonucleotide
tttgcacggacgctataccactgccttctacagcc

SEQ ID NO: 38360 - DNA, 35 bp, Artificial Sequence
  Synthetic oligonucleotide
tcccatcacgtatttaacgtctgactttaaacgcc

SEQ ID NO: 38361 - DNA, 35 bp, Artificial Sequence
  Synthetic oligonucleotide
tcccgacctctcatctctgtttgtgtctatcggtc

SEQ ID NO: 38362 - DNA, 35 bp, Artificial Sequence
  Synthetic oligonucleotide
tcagcacccgctgctcttattggtttcaacgcttc

SEQ ID NO: 38363 - DNA, 35 bp, Artificial Sequence
  Synthetic oligonucleotide
gatccccgggcagcttcactcgaacgcactctttc

SEQ ID NO: 38364 - DNA, 35 bp, Artificial Sequence
  Synthetic oligonucleotide
acgcactgccattctgcgaaggtcgccccctccag

SEQ ID NO: 38365 - DNA, 35 bp, Artificial Sequence
  Synthetic oligonucleotide
tacgcgacgtgggagggtagtctactgtaatttag

SEQ ID NO: 38366 - DNA, 35 bp, Artificial Sequence
  Synthetic oligonucleotide
gctgcatacatggcatttaccgctcaccatcgccg

SEQ ID NO: 38367 - DNA, 35 bp, Artificial Sequence
  Synthetic oligonucleotide
gcgaccctcggggcctatttactcactttctcgcg

SEQ ID NO: 38368 - DNA, 35 bp, Artificial Sequence
  Synthetic oligonucleotide
tgtgacaccaatctgatgacgtactgccacctctg

SEQ ID NO: 38369 - DNA, 35 bp, Artificial Sequence
  Synthetic oligonucleotide
tcatacgctcaacctggccgggagtttacatcttg

SEQ ID NO: 38370 - DNA, 35 bp, Artificial Sequence
  Synthetic oligonucleotide
tcttagacgactctgcttttttttgcgatacttct

SEQ ID NO: 38371 - DNA, 35 bp, Artificial Sequence
  Synthetic oligonucleotide
acttgcctctccgtatttgtctctcccgctggctt

SEQ ID NO: 38372 - DNA, 35 bp, Artificial Sequence
  Synthetic oligonucleotide
ggatcggcgcacgtggttggctgttgtcgctcttt

SEQ ID NO: 38373 - DNA, 36 bp, Artificial Sequence
  Synthetic oligonucleotide
ggcccacagcctgtcgaattatgcttctcacccaca

SEQ ID NO: 38374 - DNA, 35 bp, Artificial Sequence
  Synthetic oligonucleotide
gcacgatcaacgagcaggcaccagttattcccaca

SEQ ID NO: 38375 - DNA, 37 bp, Artificial Sequence
  Synthetic oligonucleotide
gtacactacaccgtcattcttcttcccgcggacccga

SEQ ID NO: 38376 - DNA, 37 bp, Artificial Sequence
  Synthetic oligonucleotide
agtacgtgcacaaaactcgacgcatcattcacctcga

SEQ ID NO: 38377 - DNA, 36 bp, Artificial Sequence
  Synthetic oligonucleotide
gacgtcccgtaacatctctttcttatcgcccttgga

SEQ ID NO: 38378 - DNA, 38 bp, Artificial Sequence
  Synthetic oligonucleotide
acggtcgggggggcacggaggcaagaaaaaggggatga

SEQ ID NO: 38379 - DNA, 38 bp, Artificial Sequence
  Synthetic oligonucleotide
acagggggtagggaggagaggactgatgatccaactga

SEQ ID NO: 38380 - DNA, 37 bp, Artificial Sequence
  Synthetic oligonucleotide
tgaccttgcctcccttctaccgatgtacgtttactga

SEQ ID NO: 38381 - DNA, 38 bp, Artificial Sequence
  Synthetic oligonucleotide
tgccacccccgtcctaatgcccgggtccccgagattga

SEQ ID NO: 38382 - DNA, 37 bp, Artificial Sequence
  Synthetic oligonucleotide
aatgcgcggtctccatgtagtaatggttccgcgttga

SEQ ID NO: 38383 - DNA, 35 bp, Artificial Sequence
  Synthetic oligonucleotide
gtcaccatcgccacctagtaagtttgagctcacta

SEQ ID NO: 38384 - DNA, 35 bp, Artificial Sequence
  Synthetic oligonucleotide
gaaagtggtgaacgcgggggcgggctgacatacta

SEQ ID NO: 38385 - DNA, 36 bp, Artificial Sequence
  Synthetic oligonucleotide
tgcgcatggcaccctgtcacaaaactaccgctatta

SEQ ID NO: 38386 - DNA, 35 bp, Artificial Sequence
  Synthetic oligonucleotide
gtcattcccaaacgtgtttcgctctgcagatccac

SEQ ID NO: 38387 - DNA, 35 bp, Artificial Sequence
  Synthetic oligonucleotide
acgccaagtgcccccctgggatctcccgcctggcc

SEQ ID NO: 38388 - DNA, 35 bp, Artificial Sequence
  Synthetic oligonucleotide
accgaccgttccgcttcttatttatatgatctgcc

SEQ ID NO: 38389 - DNA, 35 bp, Artificial Sequence
  Synthetic oligonucleotide
gaacccgaccaagtggcgtatagttaacccattcc

SEQ ID NO: 38390 - DNA, 35 bp, Artificial Sequence
  Synthetic oligonucleotide
ttcgccaatcaatgagcccctcgttttgcacccgc

SEQ ID NO: 38391 - DNA, 35 bp, Artificial Sequence
  Synthetic oligonucleotide
actgcacgccggagcccagcatcaccagcaaactc

SEQ ID NO: 38392 - DNA, 35 bp, Artificial Sequence
  Synthetic oligonucleotide
aggaaaggtaacgtggtggggacgaacgaggaggg

SEQ ID NO: 38393 - DNA, 36 bp, Artificial Sequence
  Synthetic oligonucleotide
acgcacactacccgtctacccggaatcaccattggg

SEQ ID NO: 38394 - DNA, 35 bp, Artificial Sequence
  Synthetic oligonucleotide
gtgcctagctcagccacgccctcctaaccaccttg

SEQ ID NO: 38395 - DNA, 34 bp, Artificial Sequence
  Synthetic oligonucleotide
tctggaccttcctccctcatctggcttaccttgt

SEQ ID NO: 38396 - DNA, 36 bp, Artificial Sequence
  Synthetic oligonucleotide
aagccatccctgtcatcgctattgtgctgctctaaa

SEQ ID NO: 38397 - DNA, 36 bp, Artificial Sequence
  Synthetic oligonucleotide
aaacgggccgacgagggggaggtgggtgctgcggaa

SEQ ID NO: 38398 - DNA, 36 bp, Artificial Sequence
  Synthetic oligonucleotide
acccacctgctgagggatgcatgactacgccgccca

SEQ ID NO: 38399 - DNA, 35 bp, Artificial Sequence
  Synthetic oligonucleotide
gacagaaggggcagggagggcgtcactggagcgca

SEQ ID NO: 38400 - DNA, 36 bp, Artificial Sequence
  Synthetic oligonucleotide
gagtcccgttcatctccactacacctcgcagtttca

SEQ ID NO: 38401 - DNA, 36 bp, Artificial Sequence
  Synthetic oligonucleotide
tgccttcccatcgttatggaagctcacacattttca

SEQ ID NO: 38402 - DNA, 37 bp, Artificial Sequence
  Synthetic oligonucleotide
ggggatcagcgagcagacatggggtggggtgctacga

SEQ ID NO: 38403 - DNA, 37 bp, Artificial Sequence
  Synthetic oligonucleotide
acccctccagcgggttcctaaatactccttcgcccga

SEQ ID NO: 38404 - DNA, 37 bp, Artificial Sequence
  Synthetic oligonucleotide
gatccggaggctctattcgtaaacataccctctccga

SEQ ID NO: 38405 - DNA, 37 bp, Artificial Sequence
  Synthetic oligonucleotide
acagacacaagggggtgacgaactgaccagacggcga

SEQ ID NO: 38406 - DNA, 36 bp, Artificial Sequence
  Synthetic oligonucleotide
gaagtgatgggccgcgaaaattgggagtggaaagga

SEQ ID NO: 38407 - DNA, 37 bp, Artificial Sequence
  Synthetic oligonucleotide
gagaagggttgaaggagaggaaagggaacttgcggga

SEQ ID NO: 38408 - DNA, 37 bp, Artificial Sequence
  Synthetic oligonucleotide
gaggggggccgcagggataaggcgggtatgatttgga

SEQ ID NO: 38409 - DNA, 38 bp, Artificial Sequence
  Synthetic oligonucleotide
gcactacctcatcatggccaatgggggtcctgacctga

SEQ ID NO: 38410 - DNA, 38 bp, Artificial Sequence
  Synthetic oligonucleotide
gtcctccgcaagatcctttcaccgttcattgtcgctga

SEQ ID NO: 38411 - DNA, 38 bp, Artificial Sequence
  Synthetic oligonucleotide
aatgggtgggaacggaggaggatgggagcgtagcgtga

SEQ ID NO: 38412 - DNA, 38 bp, Artificial Sequence
  Synthetic oligonucleotide
gatggtaggggggggttaggaagaggacgaactattga

SEQ ID NO: 38413 - DNA, 38 bp, Artificial Sequence
  Synthetic oligonucleotide
tgatgcgagagctctcttagcctggataccctttttga

SEQ ID NO: 38414 - DNA, 36 bp, Artificial Sequence
  Synthetic oligonucleotide
actaagctcgaaccccctggccgcctgtagcaccta

SEQ ID NO: 38415 - DNA, 36 bp, Artificial Sequence
  Synthetic oligonucleotide
gccgcccgccgtagcctgcacctggcgtttcttcta

SEQ ID NO: 38416 - DNA, 36 bp, Artificial Sequence
  Synthetic oligonucleotide
ccaaaaatggcccctcccgcctgcattcggacctta

SEQ ID NO: 38417 - DNA, 36 bp, Artificial Sequence
  Synthetic oligonucleotide
tgcaaatccccactgcggtacgaccactcatgttta

SEQ ID NO: 38418 - DNA, 35 bp, Artificial Sequence
  Synthetic oligonucleotide
gtcattcgccatttgttgcacgctggccatttaac

SEQ ID NO: 38419 - DNA, 35 bp, Artificial Sequence
  Synthetic oligonucleotide
tacttccgcttattagtcggcgccgcttgccgccc

SEQ ID NO: 38420 - DNA, 35 bp, Artificial Sequence
  Synthetic oligonucleotide
tacccgccatagcacgtagtttctgctttccctcc

SEQ ID NO: 38421 - DNA, 35 bp, Artificial Sequence
  Synthetic oligonucleotide
gcgtagggcggccctggtttggatccctctcctgc

SEQ ID NO: 38422 - DNA, 35 bp, Artificial Sequence
  Synthetic oligonucleotide
gccttccgcatcgcgaccccctcctcggagtaatc

SEQ ID NO: 38423 - DNA, 35 bp, Artificial Sequence
  Synthetic oligonucleotide
agtgggatgaaagacctgggaaagtagaggtgggg

SEQ ID NO: 38424 - DNA, 35 bp, Artificial Sequence
  Synthetic oligonucleotide
acccgctcaagttcttaggtctatgccgtttgcct

SEQ ID NO: 38425 - DNA, 35 bp, Artificial Sequence
  Synthetic oligonucleotide
aacccgaccccgacccgagagtatatgtttctggt

SEQ ID NO: 38426 - DNA, 36 bp, Artificial Sequence
  Synthetic oligonucleotide
ttggcctcccacctgtgctttgttcgcccacaccaa

SEQ ID NO: 38427 - DNA, 35 bp, Artificial Sequence
  Synthetic oligonucleotide
tcagcatactgccaatcatcctgagttattttaca

SEQ ID NO: 38428 - DNA, 36 bp, Artificial Sequence
  Synthetic oligonucleotide
gtttcctcccacccataagattgtcagctcactcca

SEQ ID NO: 38429 - DNA, 35 bp, Artificial Sequence
  Synthetic oligonucleotide
gtgacccgtgagcacttgcctcccttcgacctgca

SEQ ID NO: 38430 - DNA, 36 bp, Artificial Sequence
  Synthetic oligonucleotide
atcccagtcaacctgtttgtttcaataatccgctca

SEQ ID NO: 38431 - DNA, 37 bp, Artificial Sequence
  Synthetic oligonucleotide
gacatcccatctcattgtatggctccctgtcaacaga

SEQ ID NO: 38432 - DNA, 37 bp, Artificial Sequence
  Synthetic oligonucleotide
agtggacgtgactggggaaacaaggaggaagtgcaga

SEQ ID NO: 38433 - DNA, 37 bp, Artificial Sequence
  Synthetic oligonucleotide
tgacactcccaggaaccacagctctactcgataccga

SEQ ID NO: 38434 - DNA, 37 bp, Artificial Sequence
  Synthetic oligonucleotide
gccctccaaaaccgctatatcgtcctccttcccggga

SEQ ID NO: 38435 - DNA, 37 bp, Artificial Sequence
  Synthetic oligonucleotide
agcgaaggagaaaatgtgtgggggaagcattggggga

SEQ ID NO: 38436 - DNA, 35 bp, Artificial Sequence
  Synthetic oligonucleotide
accgaggtacgggtgggtgtcataatacgtgggga

SEQ ID NO: 38437 - DNA, 37 bp, Artificial Sequence
  Synthetic oligonucleotide
actgccatcggccccagccctgatcccttggccatga

SEQ ID NO: 38438 - DNA, 38 bp, Artificial Sequence
  Synthetic oligonucleotide
tgttgcactggcctattctcgtttactcccccgcatga

SEQ ID NO: 38439 - DNA, 36 bp, Artificial Sequence
  Synthetic oligonucleotide
tcacacacagctgcatcacggactccaatcaactga

SEQ ID NO: 38440 - DNA, 38 bp, Artificial Sequence
  Synthetic oligonucleotide
ttgatgcttagcccactgtcgtacctcgcttaccctga

SEQ ID NO: 38441 - DNA, 38 bp, Artificial Sequence
  Synthetic oligonucleotide
gtacgctccacacacgataaatatgctcacaatggtga

SEQ ID NO: 38442 - DNA, 37 bp, Artificial Sequence
  Synthetic oligonucleotide
gccccaccttcctcattgccgttagtagacgttgtga

SEQ ID NO: 38443 - DNA, 38 bp, Artificial Sequence
  Synthetic oligonucleotide
agacccacctctgccagactgtcagttctatagtttga

SEQ ID NO: 38444 - DNA, 36 bp, Artificial Sequence
  Synthetic oligonucleotide
tgcctgccgccactctgcaaagtctcattctatata

SEQ ID NO: 38445 - DNA, 36 bp, Artificial Sequence
  Synthetic oligonucleotide
gccacgcttgctatcatggccgcacattaacaccta

SEQ ID NO: 38446 - DNA, 36 bp, Artificial Sequence
  Synthetic oligonucleotide
gacagaccttctgtcactccgagaccacctttctta

SEQ ID NO: 38447 - DNA, 36 bp, Artificial Sequence
  Synthetic oligonucleotide
tccactgcccttctgtgttcctctgtacgttcttta

SEQ ID NO: 38448 - DNA, 35 bp, Artificial Sequence
  Synthetic oligonucleotide
tttacgccttctcccgctatccccgtgccgttgcc

SEQ ID NO: 38449 - DNA, 35 bp, Artificial Sequence
  Synthetic oligonucleotide
gaacttcccacttgccaggtccgctcctgccgagc

SEQ ID NO: 38450 - DNA, 35 bp, Artificial Sequence
  Synthetic oligonucleotide
gaccccacacaccactttcagccgtggataaagag

SEQ ID NO: 38451 - DNA, 35 bp, Artificial Sequence
  Synthetic oligonucleotide
tcacacattgttccacgtatttcttccgaatgacg

SEQ ID NO: 38452 - DNA, 35 bp, Artificial Sequence
  Synthetic oligonucleotide
agatccaccggatctctgtgcctcaacttacatcg

SEQ ID NO: 38453 - DNA, 35 bp, Artificial Sequence
  Synthetic oligonucleotide
tacaggcaccgacttcttactctcaggcgcctcat

SEQ ID NO: 38454 - DNA, 35 bp, Artificial Sequence
  Synthetic oligonucleotide
ggaaccaatcatcacttcaacgagcccagctactt

SEQ ID NO: 38455 - DNA, 35 bp, Artificial Sequence
  Synthetic oligonucleotide
gaaatcgcagcccgcttcaattgtcccagttactt

SEQ ID NO: 38456 - DNA, 35 bp, Artificial Sequence
  Synthetic oligonucleotide
tttgccccctcttctggattggcatttttttcctt

SEQ ID NO: 38457 - DNA, 35 bp, Artificial Sequence
  Synthetic oligonucleotide
tccgtgaccctgcctctctattggccctataacaa

SEQ ID NO: 38458 - DNA, 35 bp, Artificial Sequence
  Synthetic oligonucleotide
tgaaagcctcaccatattccctcgttctctagcaa

SEQ ID NO: 38459 - DNA, 36 bp, Artificial Sequence
  Synthetic oligonucleotide
gccacccttcacgtatctcctgggtcaaatttttaa

SEQ ID NO: 38460 - DNA, 36 bp, Artificial Sequence
  Synthetic oligonucleotide
gaagcattagccgcctgacccaactacctcagccca

SEQ ID NO: 38461 - DNA, 36 bp, Artificial Sequence
  Synthetic oligonucleotide
ttctaccctgccagatcccgtgaatcctccacctca

SEQ ID NO: 38462 - DNA, 37 bp, Artificial Sequence
  Synthetic oligonucleotide
gtccctcacagggtacgccccaaccatcttcacacga

SEQ ID NO: 38463 - DNA, 36 bp, Artificial Sequence
  Synthetic oligonucleotide
atacgtgatggaggcaatttggtggggggagggcga

SEQ ID NO: 38464 - DNA, 37 bp, Artificial Sequence
  Synthetic oligonucleotide
gctacagcccatggctatttacagcaccctccttcga

SEQ ID NO: 38465 - DNA, 36 bp, Artificial Sequence
  Synthetic oligonucleotide
gaacgcgacgaataaaaggggtagagaaggggatga

SEQ ID NO: 38466 - DNA, 38 bp, Artificial Sequence
  Synthetic oligonucleotide
tcaaccatcccactcttcctacgctgtacgctgggtga

SEQ ID NO: 38467 - DNA, 36 bp, Artificial Sequence
  Synthetic oligonucleotide
tgcgccccattgcatccggtccatattccttagata

SEQ ID NO: 38468 - DNA, 36 bp, Artificial Sequence
  Synthetic oligonucleotide
gttgcccatatctgtgtgtttctcgaaatcctccta

SEQ ID NO: 38469 - DNA, 36 bp, Artificial Sequence
  Synthetic oligonucleotide
tgtcccttcgcccgtttcgatcccatttggtaatta

SEQ ID NO: 38470 - DNA, 35 bp, Artificial Sequence
  Synthetic oligonucleotide
atgaccgcgtacctgcgctaatacgtcccgcaaac

SEQ ID NO: 38471 - DNA, 35 bp, Artificial Sequence
  Synthetic oligonucleotide
tccacacatacgtaatcttacctctgcctgttcac

SEQ ID NO: 38472 - DNA, 35 bp, Artificial Sequence
  Synthetic oligonucleotide
ttgagagcgtcccttacacgtctcatctggttccc

SEQ ID NO: 38473 - DNA, 35 bp, Artificial Sequence
  Synthetic oligonucleotide
atgccgccattaggttcccgctcagaagcttttcc

SEQ ID NO: 38474 - DNA, 35 bp, Artificial Sequence
  Synthetic oligonucleotide
tgagttcctgccttcgcgagccttttccctttggc

SEQ ID NO: 38475 - DNA, 35 bp, Artificial Sequence
  Synthetic oligonucleotide
gccgtttggcaaaggtcgtatcgacccattctctc

SEQ ID NO: 38476 - DNA, 35 bp, Artificial Sequence
  Synthetic oligonucleotide
atcacgtgcagaggaaatgaagtagtaaactgggg

SEQ ID NO: 38477 - DNA, 35 bp, Artificial Sequence
  Synthetic oligonucleotide
gatcaaaggtggtgaggtagttggaactctctggg

SEQ ID NO: 38478 - DNA, 35 bp, Artificial Sequence
  Synthetic oligonucleotide
tgcacgactaccctcgtcctcccagcgctccaaat

SEQ ID NO: 38479 - DNA, 35 bp, Artificial Sequence
  Synthetic oligonucleotide
agatgcgctgtctcgcgccctgcactgccttccct

SEQ ID NO: 38480 - DNA, 35 bp, Artificial Sequence
  Synthetic oligonucleotide
acttgaccgtgagtggctgccgcctgtcttttcct

SEQ ID NO: 38481 - DNA, 35 bp, Artificial Sequence
  Synthetic oligonucleotide
accatgcccctacagtcccataggtgagcctttct

SEQ ID NO: 38482 - DNA, 35 bp, Artificial Sequence
  Synthetic oligonucleotide
ggtacactgctagccacatgaccacccccaacctt

SEQ ID NO: 38483 - DNA, 35 bp, Artificial Sequence
  Synthetic oligonucleotide
gccctggtactcggtgaccctacactccttttctt

SEQ ID NO: 38484 - DNA, 36 bp, Artificial Sequence
  Synthetic oligonucleotide
gcaccttccaccagatatctgcaatgcaccacgtaa

SEQ ID NO: 38485 - DNA, 35 bp, Artificial Sequence
  Synthetic oligonucleotide
ttccaatccccgaagggctaatccatgaggagaca

SEQ ID NO: 38486 - DNA, 36 bp, Artificial Sequence
  Synthetic oligonucleotide
tgtaacgatcggtgactggtttccgtccttgcccca

SEQ ID NO: 38487 - DNA, 35 bp, Artificial Sequence
  Synthetic oligonucleotide
attgctgtcgcctccaatggctaaattcctcttca

SEQ ID NO: 38488 - DNA, 37 bp, Artificial Sequence
  Synthetic oligonucleotide
tgcagacgcactttgagctctgaacccaatctatcga

SEQ ID NO: 38489 - DNA, 37 bp, Artificial Sequence
  Synthetic oligonucleotide
tatgcgcgccccatcacattttcattagacccacgga

SEQ ID NO: 38490 - DNA, 37 bp, Artificial Sequence
  Synthetic oligonucleotide
tccggtaccatctctcgactaaagccgcctactggga

SEQ ID NO: 38491 - DNA, 37 bp, Artificial Sequence
  Synthetic oligonucleotide
ttcaccccacccgttaccagggcacaagccgcatgga

SEQ ID NO: 38492 - DNA, 37 bp, Artificial Sequence
  Synthetic oligonucleotide
tgttggccctaatggtcttcttcccctctcacgtgga

SEQ ID NO: 38493 - DNA, 38 bp, Artificial Sequence
  Synthetic oligonucleotide
gctgtcaccacctcgctggtacttttccgcccccctga

SEQ ID NO: 38494 - DNA, 38 bp, Artificial Sequence
  Synthetic oligonucleotide
accaccttcccgtagctctccacgaccattattcgtga

SEQ ID NO: 38495 - DNA, 36 bp, Artificial Sequence
  Synthetic oligonucleotide
gttacccgccattctgagatgcgctacatcctttga

SEQ ID NO: 38496 - DNA, 35 bp, Artificial Sequence
  Synthetic oligonucleotide
ttggtcacagaacgaaattgcatccacctctttga

SEQ ID NO: 38497 - DNA, 36 bp, Artificial Sequence
  Synthetic oligonucleotide
gggggggagggggtgatcagggcgggcttgcaacta

SEQ ID NO: 38498 - DNA, 35 bp, Artificial Sequence
  Synthetic oligonucleotide
gctgtctcctatcacgctcgacgtgcatttaccac

SEQ ID NO: 38499 - DNA, 35 bp, Artificial Sequence
  Synthetic oligonucleotide
ttctccaccgcacctgatagttccttttccccagc

SEQ ID NO: 38500 - DNA, 35 bp, Artificial Sequence
  Synthetic oligonucleotide
gacgacaacgcttcaccaactttacgaactctggc

SEQ ID NO: 38501 - DNA, 35 bp, Artificial Sequence
  Synthetic oligonucleotide
tacccaagcaccgccgccccatgagctacactatc

SEQ ID NO: 38502 - DNA, 35 bp, Artificial Sequence
  Synthetic oligonucleotide
gaccaacccgaacgccgtggctacactggtgactc

SEQ ID NO: 38503 - DNA, 35 bp, Artificial Sequence
  Synthetic oligonucleotide
agccacctatacatcgtttgtttcaactatttgtc

SEQ ID NO: 38504 - DNA, 35 bp, Artificial Sequence
  Synthetic oligonucleotide
ttcatgccaagaacgcccccccctcgcgcttgacg

SEQ ID NO: 38505 - DNA, 35 bp, Artificial Sequence
  Synthetic oligonucleotide
gttaaaacggggaggggaccactggggaggtgggg

SEQ ID NO: 38506 - DNA, 35 bp, Artificial Sequence
  Synthetic oligonucleotide
acgcctgtgcttgaatttgtcttttcccctgctgg

SEQ ID NO: 38507 - DNA, 35 bp, Artificial Sequence
  Synthetic oligonucleotide
tagccggacacctcaacattcaaccaatagctgtg

SEQ ID NO: 38508 - DNA, 35 bp, Artificial Sequence
  Synthetic oligonucleotide
gtagggggggtccagggggggtatgctctagcttg

SEQ ID NO: 38509 - DNA, 35 bp, Artificial Sequence
  Synthetic oligonucleotide
gccgccgttttcgtcatctatttaggtcgtccact

SEQ ID NO: 38510 - DNA, 35 bp, Artificial Sequence
  Synthetic oligonucleotide
atgctcctttacgctgccctatcataccgctgttt

SEQ ID NO: 38511 - DNA, 36 bp, Artificial Sequence
  Synthetic oligonucleotide
ttaggtcacccccaatcttactacctccgtcctgaa

SEQ ID NO: 38512 - DNA, 36 bp, Artificial Sequence
  Synthetic oligonucleotide
tagatcgctcagctaaaaccctgctttaccaccgca

SEQ ID NO: 38513 - DNA, 35 bp, Artificial Sequence
  Synthetic oligonucleotide
tttgtctgtcccaccgtatcctttgtgccatccga

SEQ ID NO: 38514 - DNA, 34 bp, Artificial Sequence
  Synthetic oligonucleotide
tacacatcactgtaccaccatcgcgtatttggga

SEQ ID NO: 38515 - DNA, 37 bp, Artificial Sequence
  Synthetic oligonucleotide
attccccacgtagctgggcccacaaacccgtattgga

SEQ ID NO: 38516 - DNA, 38 bp, Artificial Sequence
  Synthetic oligonucleotide
ggagcaccatccttactgcatttatctgcctgacatga

SEQ ID NO: 38517 - DNA, 37 bp, Artificial Sequence
  Synthetic oligonucleotide
tgatccacccgaggcgttcactgccttctcacgctga

SEQ ID NO: 38518 - DNA, 36 bp, Artificial Sequence
  Synthetic oligonucleotide
tccgacgcctgctatcaaacccatcacgacgaggta

SEQ ID NO: 38519 - DNA, 35 bp, Artificial Sequence
  Synthetic oligonucleotide
tcacgctggtcccccttcatcagctcatgaggaac

SEQ ID NO: 38520 - DNA, 35 bp, Artificial Sequence
  Synthetic oligonucleotide
tcccacgagcgaccgtctccgcttccacgggtcac

SEQ ID NO: 38521 - DNA, 35 bp, Artificial Sequence
  Synthetic oligonucleotide
gaccgaaaggcccatcttggttttcctgtaccacc

SEQ ID NO: 38522 - DNA, 35 bp, Artificial Sequence
  Synthetic oligonucleotide
agtggcatcataccgcgcgccatctacccatcccc

SEQ ID NO: 38523 - DNA, 35 bp, Artificial Sequence
  Synthetic oligonucleotide
aagtccaacgttagatatacaccttctacattgcc

SEQ ID NO: 38524 - DNA, 35 bp, Artificial Sequence
  Synthetic oligonucleotide
atgtgcccacggtccactcgtggccgtcccctcgc

SEQ ID NO: 38525 - DNA, 35 bp, Artificial Sequence
  Synthetic oligonucleotide
ttaccccactgtgaggcctttattatgtctctgtc

SEQ ID NO: 38526 - DNA, 35 bp, Artificial Sequence
  Synthetic oligonucleotide
gcgtaacccacatacgactagtccggtaccctttc

SEQ ID NO: 38527 - DNA, 35 bp, Artificial Sequence
  Synthetic oligonucleotide
atcgggggggagaaaccattgggatgggcacatag

SEQ ID NO: 38528 - DNA, 35 bp, Artificial Sequence
  Synthetic oligonucleotide
tttggcattgcctacaggaactcaacacatccacg

SEQ ID NO: 38529 - DNA, 35 bp, Artificial Sequence
  Synthetic oligonucleotide
taaagacacggggaggaagcatgcgaggggtagcg

SEQ ID NO: 38530 - DNA, 35 bp, Artificial Sequence
  Synthetic oligonucleotide
gacggaggagaactggggtgtagtagcggtattcg

SEQ ID NO: 38531 - DNA, 35 bp, Artificial Sequence
  Synthetic oligonucleotide
gggggtagggttgaagaatgggtgtgggtgtgcgg

SEQ ID NO: 38532 - DNA, 35 bp, Artificial Sequence
  Synthetic oligonucleotide
tgccacaccctctctccggcgcaaggtccttagtg

SEQ ID NO: 38533 - DNA, 35 bp, Artificial Sequence
  Synthetic oligonucleotide
gatcccgacgggttcgcgatgagctccatctattg

SEQ ID NO: 38534 - DNA, 35 bp, Artificial Sequence
  Synthetic oligonucleotide
accgctcgtcttacgttacccttcttgcttgtcgt

SEQ ID NO: 38535 - DNA, 35 bp, Artificial Sequence
  Synthetic oligonucleotide
gtgatccgggtctggggcaaaagtggggtgggtgt

SEQ ID NO: 38536 - DNA, 35 bp, Artificial Sequence
  Synthetic oligonucleotide
acactacgccttggcttactctatctgggcccctt

SEQ ID NO: 38537 - DNA, 35 bp, Artificial Sequence
  Synthetic oligonucleotide
gtaggagaggataggcggggggaaaacgtggggtt

SEQ ID NO: 38538 - DNA, 35 bp, Artificial Sequence
  Synthetic oligonucleotide
gcccgcacgacttagtagcctgtgatccaccgttt

SEQ ID NO: 38539 - DNA, 35 bp, Artificial Sequence
  Synthetic oligonucleotide
gcgtcaacgcactctatatgctcatttctgctttt

SEQ ID NO: 38540 - DNA, 36 bp, Artificial Sequence
  Synthetic oligonucleotide
actacgtgcgctccctctatgtccgtcttgcctaaa

SEQ ID NO: 38541 - DNA, 36 bp, Artificial Sequence
  Synthetic oligonucleotide
atgcgccgaccacgtcccactctcgcaccaagcgaa

SEQ ID NO: 38542 - DNA, 36 bp, Artificial Sequence
  Synthetic oligonucleotide
accatcgtccgaagggttcaaattcctctgcccaca

SEQ ID NO: 38543 - DNA, 36 bp, Artificial Sequence
  Synthetic oligonucleotide
taccacccacgggcagaatgctatggtccttgtaca

SEQ ID NO: 38544 - DNA, 35 bp, Artificial Sequence
  Synthetic oligonucleotide
ttcggggggggccgacgaagagagaaggaacggca

SEQ ID NO: 38545 - DNA, 35 bp, Artificial Sequence
  Synthetic oligonucleotide
ggacgaacgcgataactgcaccactacccgtatca

SEQ ID NO: 38546 - DNA, 35 bp, Artificial Sequence
  Synthetic oligonucleotide
acccgcaccccatcgcacccgccgccttgcactca

SEQ ID NO: 38547 - DNA, 36 bp, Artificial Sequence
  Synthetic oligonucleotide
gatcttgtcgcctgtcatgactcgggcctcccttca

SEQ ID NO: 38548 - DNA, 35 bp, Artificial Sequence
  Synthetic oligonucleotide
tctcactacagccacaatttcctcccaccgcttca

SEQ ID NO: 38549 - DNA, 37 bp, Artificial Sequence
  Synthetic oligonucleotide
gccaacccagccgcaacttccagcgctcgtctaccga

SEQ ID NO: 38550 - DNA, 37 bp, Artificial Sequence
  Synthetic oligonucleotide
ctcaccacctgtgacatatcgcggctggcacacccga

SEQ ID NO: 38551 - DNA, 36 bp, Artificial Sequence
  Synthetic oligonucleotide
gggacgggccagggaatggagttgaagggaacggga

SEQ ID NO: 38552 - DNA, 38 bp, Artificial Sequence
  Synthetic oligonucleotide
gacgcgggagtggcgtggcatgattgggaggattgtga

SEQ ID NO: 38553 - DNA, 37 bp, Artificial Sequence
  Synthetic oligonucleotide
gtcggtctcaggcgtattcttctcactatccccgcta

SEQ ID NO: 38554 - DNA, 36 bp, Artificial Sequence
  Synthetic oligonucleotide
tgtgccccctatccggttctgatattgcccaatgta

SEQ ID NO: 38555 - DNA, 35 bp, Artificial Sequence
  Synthetic oligonucleotide
taccctcccgccgggctcatcacgccgcttaatta

SEQ ID NO: 38556 - DNA, 35 bp, Artificial Sequence
  Synthetic oligonucleotide
tccacgcacgagcgatgcaactgctctgattttta

SEQ ID NO: 38557 - DNA, 35 bp, Artificial Sequence
  Synthetic oligonucleotide
tagtcatcgtcttcgcgttaggctccttgttccac

SEQ ID NO: 38558 - DNA, 35 bp, Artificial Sequence
  Synthetic oligonucleotide
gttgtatcgccacccccaatctgagttcgaagcac

SEQ ID NO: 38559 - DNA, 35 bp, Artificial Sequence
  Synthetic oligonucleotide
tccaatccgccatatatgaactaacaaagcccccc

SEQ ID NO: 38560 - DNA, 34 bp, Artificial Sequence
  Synthetic oligonucleotide
gcccaccgcgaggtccgtctctacacaccaatcc

SEQ ID NO: 38561 - DNA, 35 bp, Artificial Sequence
  Synthetic oligonucleotide
aacgctctaaccgctgtacccaggcccaggactcc

SEQ ID NO: 38562 - DNA, 35 bp, Artificial Sequence
  Synthetic oligonucleotide
tgatgcccctagtgtcccgccatcacatgccgtcc

SEQ ID NO: 38563 - DNA, 35 bp, Artificial Sequence
  Synthetic oligonucleotide
gttccgcgcctaatttccccggtgtttccgtattc

SEQ ID NO: 38564 - DNA, 35 bp, Artificial Sequence
  Synthetic oligonucleotide
gcgctacccgtgtgcacctctgtcatagcttcttc

SEQ ID NO: 38565 - DNA, 35 bp, Artificial Sequence
  Synthetic oligonucleotide
atgacagccgtagctgcttttcggttctccactgg

SEQ ID NO: 38566 - DNA, 35 bp, Artificial Sequence
  Synthetic oligonucleotide
acccaagtcagatcacgcgatttcttctctcgtct

SEQ ID NO: 38567 - DNA, 35 bp, Artificial Sequence
  Synthetic oligonucleotide
ttcgatcacgccctgctcacaagccaccacaaatt

SEQ ID NO: 38568 - DNA, 37 bp, Artificial Sequence
  Synthetic oligonucleotide
gattggaggggatggccgtagggagggggcccaggca

SEQ ID NO: 38569 - DNA, 36 bp, Artificial Sequence
  Synthetic oligonucleotide
aaccatcaacgacactatgcgtgcccttgctattca

SEQ ID NO: 38570 - DNA, 36 bp, Artificial Sequence
  Synthetic oligonucleotide
gactacgcccccccctcgaaaacgtggtgttgttca

SEQ ID NO: 38571 - DNA, 36 bp, Artificial Sequence
  Synthetic oligonucleotide
tgcactgggccccacctcattgtccttttgtcccga

SEQ ID NO: 38572 - DNA, 37 bp, Artificial Sequence
  Synthetic oligonucleotide
tctgccctgcatacgatcaggtctcctgctttcccga

SEQ ID NO: 38573 - DNA, 37 bp, Artificial Sequence
  Synthetic oligonucleotide
atctgggaagggactatagggtgcggttatgggagga

SEQ ID NO: 38574 - DNA, 37 bp, Artificial Sequence
  Synthetic oligonucleotide
gaacgggggggaatggtagatggcgcccggctgagga

SEQ ID NO: 38575 - DNA, 35 bp, Artificial Sequence
  Synthetic oligonucleotide
gatacgtcaagggtggaggcatcaggaaggtagga

SEQ ID NO: 38576 - DNA, 37 bp, Artificial Sequence
  Synthetic oligonucleotide
aacacactgtcgtcgccgactcttattgcccatggga

SEQ ID NO: 38577 - DNA, 37 bp, Artificial Sequence
  Synthetic oligonucleotide
gagacatctgcttgcctactaaattcgcctccttgga

SEQ ID NO: 38578 - DNA, 38 bp, Artificial Sequence
  Synthetic oligonucleotide
tagagtgagaggcataggataggaggggcgggaaatga

SEQ ID NO: 38579 - DNA, 38 bp, Artificial Sequence
  Synthetic oligonucleotide
tgcagtggggtgggactaaggcgaaggggagggaatga

SEQ ID NO: 38580 - DNA, 38 bp, Artificial Sequence
  Synthetic oligonucleotide
gattggcaacatctaccttccctctgctcaccgcctga

SEQ ID NO: 38581 - DNA, 38 bp, Artificial Sequence
  Synthetic oligonucleotide
ataccgcactggctccttcttcctgccactcacggtga

SEQ ID NO: 38582 - DNA, 35 bp, Artificial Sequence
  Synthetic oligonucleotide
gagaaccatcccgagtacgctcgttacgagtgcta

SEQ ID NO: 38583 - DNA, 35 bp, Artificial Sequence
  Synthetic oligonucleotide
agcaaatgcctgagctcaccatccaatcccatgta

SEQ ID NO: 38584 - DNA, 35 bp, Artificial Sequence
  Synthetic oligonucleotide
tcgtgcgccttgctctcactggcttttccgatcac

SEQ ID NO: 38585 - DNA, 35 bp, Artificial Sequence
  Synthetic oligonucleotide
tcactcatgtgtacccaatcggttatgatcacccc

SEQ ID NO: 38586 - DNA, 35 bp, Artificial Sequence
  Synthetic oligonucleotide
tattcctgcccacatacggtacgcacatcctctcc

SEQ ID NO: 38587 - DNA, 35 bp, Artificial Sequence
  Synthetic oligonucleotide
aaattgcggggcggagcgggggggttggagaaccg

SEQ ID NO: 38588 - DNA, 35 bp, Artificial Sequence
  Synthetic oligonucleotide
gtgacagctattccattacagtacctgctgccatg

SEQ ID NO: 38589 - DNA, 35 bp, Artificial Sequence
  Synthetic oligonucleotide
aagcaaagggtaattcaagggaaggggcgggggtg

SEQ ID NO: 38590 - DNA, 36 bp, Artificial Sequence
  Synthetic oligonucleotide
actgcccggaggcagtcactaaacgaccagcaccat

SEQ ID NO: 38591 - DNA, 35 bp, Artificial Sequence
  Synthetic oligonucleotide
agcaggctccaccccgtcctattcgctgatttcgt

SEQ ID NO: 38592 - DNA, 35 bp, Artificial Sequence
  Synthetic oligonucleotide
ggatcatgcgcccccggccccctcttgcttcgttt

SEQ ID NO: 38593 - DNA, 35 bp, Artificial Sequence
  Synthetic oligonucleotide
agacgaaaggggggaatggtgtaggcgtggggttt

SEQ ID NO: 38594 - DNA, 36 bp, Artificial Sequence
  Synthetic oligonucleotide
atggccacatgccctactgtctagcctggtacacaa

SEQ ID NO: 38595 - DNA, 36 bp, Artificial Sequence
  Synthetic oligonucleotide
acaactccattgcatgccaccgggacttccaagaca

SEQ ID NO: 38596 - DNA, 36 bp, Artificial Sequence
  Synthetic oligonucleotide
tcgaacggcaccccgacgcatgggcacttctctcca

SEQ ID NO: 38597 - DNA, 35 bp, Artificial Sequence
  Synthetic oligonucleotide
tgagtgccttagcgagttgcccaccctggattcca

SEQ ID NO: 38598 - DNA, 35 bp, Artificial Sequence
  Synthetic oligonucleotide
acccgcacaccctcgcacccgccgccttgcactca

SEQ ID NO: 38599 - DNA, 35 bp, Artificial Sequence
  Synthetic oligonucleotide
gccctcctccgttctaccgcttgccacttctcaga

SEQ ID NO: 38600 - DNA, 37 bp, Artificial Sequence
  Synthetic oligonucleotide
aaccgcgtaagagtcttgtttcctcgccccaccccga

SEQ ID NO: 38601 - DNA, 37 bp, Artificial Sequence
  Synthetic oligonucleotide
tgtaacgccggcctcctctgcacaatcccgctgccga

SEQ ID NO: 38602 - DNA, 37 bp, Artificial Sequence
  Synthetic oligonucleotide
ttcaactgcccatatactcggctcaggccttctccga

SEQ ID NO: 38603 - DNA, 37 bp, Artificial Sequence
  Synthetic oligonucleotide
gatgacacctccgttcttgagctcaggacactagcga

SEQ ID NO: 38604 - DNA, 37 bp, Artificial Sequence
  Synthetic oligonucleotide
acgtccaccctcaattgaaaccgcgcgcaacacatga

SEQ ID NO: 38605 - DNA, 37 bp, Artificial Sequence
  Synthetic oligonucleotide
taccaaccattcgcgctcttcggcctgtttctcctga

SEQ ID NO: 38606 - DNA, 38 bp, Artificial Sequence
  Synthetic oligonucleotide
tcctgcaccgggtactcgctgccaccccaattttttga

SEQ ID NO: 38607 - DNA, 35 bp, Artificial Sequence
  Synthetic oligonucleotide
atagttcacgcggcccattgcatacctcgccgata

SEQ ID NO: 38608 - DNA, 36 bp, Artificial Sequence
  Synthetic oligonucleotide
tctagcgcgatctatagttccttggtgctttctcta

SEQ ID NO: 38609 - DNA, 36 bp, Artificial Sequence
  Synthetic oligonucleotide
gtaaaggggcagaacaaggtaagagggtaggtggta

SEQ ID NO: 38610 - DNA, 35 bp, Artificial Sequence
  Synthetic oligonucleotide
ttcgccaaccgatcaacgtagttaatgtcctctta

SEQ ID NO: 38611 - DNA, 35 bp, Artificial Sequence
  Synthetic oligonucleotide
aaagggcggtagtggggagggggaacaaaccacac

SEQ ID NO: 38612 - DNA, 35 bp, Artificial Sequence
  Synthetic oligonucleotide
tcacagtcatttagctcaagcgctttcaccaccac

SEQ ID NO: 38613 - DNA, 35 bp, Artificial Sequence
  Synthetic oligonucleotide
agcaactggcatcttgcggacacctccatttctcc

SEQ ID NO: 38614 - DNA, 35 bp, Artificial Sequence
  Synthetic oligonucleotide
tacgcactgagtgctattttgtttggtccgattcc

SEQ ID NO: 38615 - DNA, 34 bp, Artificial Sequence
  Synthetic oligonucleotide
gccccctctgaccgattccagcgacgcttgttcc

SEQ ID NO: 38616 - DNA, 35 bp, Artificial Sequence
  Synthetic oligonucleotide
taactgcctttgcgcccactcgtccgtgactactc

SEQ ID NO: 38617 - DNA, 35 bp, Artificial Sequence
  Synthetic oligonucleotide
tcactacccacctgacgctattacaaggtttggtc

SEQ ID NO: 38618 - DNA, 35 bp, Artificial Sequence
  Synthetic oligonucleotide
gttgcccccacttgcaagctcccgacctgactagg

SEQ ID NO: 38619 - DNA, 35 bp, Artificial Sequence
  Synthetic oligonucleotide
ttacgtcgcttacgttgctccgtcccctcttcgtg

SEQ ID NO: 38620 - DNA, 35 bp, Artificial Sequence
  Synthetic oligonucleotide
gcctgaacgccggttgaccaaagccttactcattg

SEQ ID NO: 38621 - DNA, 35 bp, Artificial Sequence
  Synthetic oligonucleotide
accctatcccagacgatcgtaaactcccattattg

SEQ ID NO: 38622 - DNA, 35 bp, Artificial Sequence
  Synthetic oligonucleotide
tgcgactgctcagcggcacataccccagtttcact

SEQ ID NO: 38623 - DNA, 35 bp, Artificial Sequence
  Synthetic oligonucleotide
acacgcgccagagccccttacaatacgctcaacct

SEQ ID NO: 38624 - DNA, 36 bp, Artificial Sequence
  Synthetic oligonucleotide
gcaccgacgacgctaggacaccggcacacttcactt

SEQ ID NO: 38625 - DNA, 36 bp, Artificial Sequence
  Synthetic oligonucleotide
gtgcgccccccattgctgtgcccgctccaataccaa

SEQ ID NO: 38626 - DNA, 35 bp, Artificial Sequence
  Synthetic oligonucleotide
ggtgacacggggcaggaggggggaagagctaggaa

SEQ ID NO: 38627 - DNA, 35 bp, Artificial Sequence
  Synthetic oligonucleotide
tcccaatctttcagtctgcgtgacctacgctccca

SEQ ID NO: 38628 - DNA, 35 bp, Artificial Sequence
  Synthetic oligonucleotide
gttgcacgaccccgccttgtatctaatttgtgtca

SEQ ID NO: 38629 - DNA, 37 bp, Artificial Sequence
  Synthetic oligonucleotide
acgatcaacctcacctgcgctagtctgcatctccaga

SEQ ID NO: 38630 - DNA, 37 bp, Artificial Sequence
  Synthetic oligonucleotide
tggaaggaccgggtgaggatgggaagtttaacagaga

SEQ ID NO: 38631 - DNA, 36 bp, Artificial Sequence
  Synthetic oligonucleotide
aaaacagcctggtcagtccatccctccactctacga

SEQ ID NO: 38632 - DNA, 37 bp, Artificial Sequence
  Synthetic oligonucleotide
gtgcacgccgtatctttctctgtacatgaccacgcga

SEQ ID NO: 38633 - DNA, 37 bp, Artificial Sequence
  Synthetic oligonucleotide
gattggggggaaaagggtggattaaaggttcaaggga

SEQ ID NO: 38634 - DNA, 36 bp, Artificial Sequence
  Synthetic oligonucleotide
gaagtggggtgctttcggaggaaagggatgggggga

SEQ ID NO: 38635 - DNA, 38 bp, Artificial Sequence
  Synthetic oligonucleotide
tgagacggggcaaaggctgagggaatggcagattatga

SEQ ID NO: 38636 - DNA, 38 bp, Artificial Sequence
  Synthetic oligonucleotide
tagaggacgctcagagtccttctcacaattactgctga

SEQ ID NO: 38637 - DNA, 38 bp, Artificial Sequence
  Synthetic oligonucleotide
tcccaccatcaccgccgcccgagaggccatgctgctga

SEQ ID NO: 38638 - DNA, 38 bp, Artificial Sequence
  Synthetic oligonucleotide
gacccatgcccctcctggttctgcgacccgtcttctga

SEQ ID NO: 38639 - DNA, 38 bp, Artificial Sequence
  Synthetic oligonucleotide
tcgcgcatcgcaatgcttccccgggcgctcctacttga

SEQ ID NO: 38640 - DNA, 37 bp, Artificial Sequence
  Synthetic oligonucleotide
gtgtccccccacccccatcatcaattgtgtcgcttga

SEQ ID NO: 38641 - DNA, 35 bp, Artificial Sequence
  Synthetic oligonucleotide
acaaccccaaggtgtcgtagcaatttccccgttga

SEQ ID NO: 38642 - DNA, 37 bp, Artificial Sequence
  Synthetic oligonucleotide
ttcccgaccccggggcctaagtactaccgccctttga

SEQ ID NO: 38643 - DNA, 35 bp, Artificial Sequence
  Synthetic oligonucleotide
atgacagtcagccggctcacccgccaatgcaacta

SEQ ID NO: 38644 - DNA, 35 bp, Artificial Sequence
  Synthetic oligonucleotide
atgcaacacactttactagggaaagacaccacaac

SEQ ID NO: 38645 - DNA, 35 bp, Artificial Sequence
  Synthetic oligonucleotide
gatacaccacatccgttggagtagcggtactccac

SEQ ID NO: 38646 - DNA, 35 bp, Artificial Sequence
  Synthetic oligonucleotide
gacctgtgtcgtcacgctctaaacccggttgttac

SEQ ID NO: 38647 - DNA, 35 bp, Artificial Sequence
  Synthetic oligonucleotide
attcagactgtctcatcatgcctacgcctccctcc

SEQ ID NO: 38648 - DNA, 35 bp, Artificial Sequence
  Synthetic oligonucleotide
tagacgccgtgttccaccctccacccaagagacgc

SEQ ID NO: 38649 - DNA, 35 bp, Artificial Sequence
  Synthetic oligonucleotide
aataaggaaggagtgcatggaaggcggttatgtgg

SEQ ID NO: 38650 - DNA, 35 bp, Artificial Sequence
  Synthetic oligonucleotide
gtgatgagcacgaagtggtgtggggtgaggggttg

SEQ ID NO: 38651 - DNA, 35 bp, Artificial Sequence
  Synthetic oligonucleotide
accagccccacttcaatcataccctagccattttg

SEQ ID NO: 38652 - DNA, 35 bp, Artificial Sequence
  Synthetic oligonucleotide
atcgtgtacccgccctcaccttgctggatgctcat

SEQ ID NO: 38653 - DNA, 35 bp, Artificial Sequence
  Synthetic oligonucleotide
atggcccgatagctttgctgctaccatggttccct

SEQ ID NO: 38654 - DNA, 35 bp, Artificial Sequence
  Synthetic oligonucleotide
gagacaccaatggtaacacccgtctttgaacctct

SEQ ID NO: 38655 - DNA, 35 bp, Artificial Sequence
  Synthetic oligonucleotide
gagtgctctcgcctctaccaatgacctcgtaccgt

SEQ ID NO: 38656 - DNA, 35 bp, Artificial Sequence
  Synthetic oligonucleotide
atcgcccgaggtcgcaaatcatcatctgtctcgtt

SEQ ID NO: 38657 - DNA, 35 bp, Artificial Sequence
  Synthetic oligonucleotide
tcataccttcgtgtgccgaatcacctcattgcaaa

SEQ ID NO: 38658 - DNA, 36 bp, Artificial Sequence
  Synthetic oligonucleotide
acttacctcagcaccatccactcagctacggacaca

SEQ ID NO: 38659 - DNA, 36 bp, Artificial Sequence
  Synthetic oligonucleotide
ttgcccccgcttgtatttccgctattagataaccca

SEQ ID NO: 38660 - DNA, 34 bp, Artificial Sequence
  Synthetic oligonucleotide
taccgccagccgcccaataccacccgaaggtcca

SEQ ID NO: 38661 - DNA, 36 bp, Artificial Sequence
  Synthetic oligonucleotide
tgacaaatacaccaacgatctgcttccggacctgca

SEQ ID NO: 38662 - DNA, 37 bp, Artificial Sequence
  Synthetic oligonucleotide
ttaacgcggcttgcaatctggctactgctcccctcga

SEQ ID NO: 38663 - DNA, 37 bp, Artificial Sequence
  Synthetic oligonucleotide
gcatccgtggatgcgttttgttcttctgttttctcga

SEQ ID NO: 38664 - DNA, 38 bp, Artificial Sequence
  Synthetic oligonucleotide
tagaacgttactgccttgttcccatctgctcactctga

SEQ ID NO: 38665 - DNA, 38 bp, Artificial Sequence
  Synthetic oligonucleotide
gaggaacggagggaagagtaaatgacagtacattctga

SEQ ID NO: 38666 - DNA, 38 bp, Artificial Sequence
  Synthetic oligonucleotide
tgctgtgtgcggctgcgtacactttttcccatcattga

SEQ ID NO: 38667 - DNA, 38 bp, Artificial Sequence
  Synthetic oligonucleotide
aagggagggtggcgtggggaaagtgctggcactgttga

SEQ ID NO: 38668 - DNA, 38 bp, Artificial Sequence
  Synthetic oligonucleotide
gatgtagctccaatgccgcctccgacaccccattttga

SEQ ID NO: 38669 - DNA, 36 bp, Artificial Sequence
  Synthetic oligonucleotide
taaaccgccccgaaacgtcttctccaacagtaccta

SEQ ID NO: 38670 - DNA, 36 bp, Artificial Sequence
  Synthetic oligonucleotide
ttacgaacagtcgctttgtcccgtttcgcgttttta

SEQ ID NO: 38671 - DNA, 35 bp, Artificial Sequence
  Synthetic oligonucleotide
gtattcgcagcccgttcgtactgcaactgactcac

SEQ ID NO: 38672 - DNA, 35 bp, Artificial Sequence
  Synthetic oligonucleotide
gatcagcgcgttgcagtgacctcgtgatttgcccc

SEQ ID NO: 38673 - DNA, 35 bp, Artificial Sequence
  Synthetic oligonucleotide
attgcgctccatcatgccggtgcaccacccttccc

SEQ ID NO: 38674 - DNA, 35 bp, Artificial Sequence
  Synthetic oligonucleotide
tcaaggaagcccaattaccacctggtctagccgcc

SEQ ID NO: 38675 - DNA, 35 bp, Artificial Sequence
  Synthetic oligonucleotide
tcgcacaccctcattaatctgcccactattaacgc

SEQ ID NO: 38676 - DNA, 35 bp, Artificial Sequence
  Synthetic oligonucleotide
atgtgcccttcgcctttcaatctcaggcattacgc

SEQ ID NO: 38677 - DNA, 35 bp, Artificial Sequence
  Synthetic oligonucleotide
gttgcgctaactccgctggtcgaaattgctctatc

SEQ ID NO: 38678 - DNA, 35 bp, Artificial Sequence
  Synthetic oligonucleotide
tccgcccctgaccggtattttgccttcacgacctc

SEQ ID NO: 38679 - DNA, 35 bp, Artificial Sequence
  Synthetic oligonucleotide
gcctccgcatgcctcggtttaattccgcctactag

SEQ ID NO: 38680 - DNA, 35 bp, Artificial Sequence
  Synthetic oligonucleotide
tcgactaccatctctgaatgtcctctggaccaacg

SEQ ID NO: 38681 - DNA, 35 bp, Artificial Sequence
  Synthetic oligonucleotide
aataagcgacgccatacaccctgcgaaggcccacg

SEQ ID NO: 38682 - DNA, 35 bp, Artificial Sequence
  Synthetic oligonucleotide
gacggttaaacaacatgagggaggagaggttagcg

SEQ ID NO: 38683 - DNA, 35 bp, Artificial Sequence
  Synthetic oligonucleotide
taatgggggagctggagggcaggaatgtagtaggg

SEQ ID NO: 38684 - DNA, 35 bp, Artificial Sequence
  Synthetic oligonucleotide
gcacacatgattctttgcgtactcccctgctgtgg

SEQ ID NO: 38685 - DNA, 35 bp, Artificial Sequence
  Synthetic oligonucleotide
gccccgccctgcccatctatttagacggattcctg

SEQ ID NO: 38686 - DNA, 35 bp, Artificial Sequence
  Synthetic oligonucleotide
tgttcaatcccgcagtgcgttacttgttgtagcat

SEQ ID NO: 38687 - DNA, 35 bp, Artificial Sequence
  Synthetic oligonucleotide
tctacgcgcatcatcatccttgcgtactgtatcat

SEQ ID NO: 38688 - DNA, 35 bp, Artificial Sequence
  Synthetic oligonucleotide
ttccaccagcccgcacctctagcagagcaacgact

SEQ ID NO: 38689 - DNA, 35 bp, Artificial Sequence
  Synthetic oligonucleotide
ttcacatgtgggggttgtcgggggataagggtggt

SEQ ID NO: 38690 - DNA, 35 bp, Artificial Sequence
  Synthetic oligonucleotide
tgccctgacctggatccgatctccttgttggcctt

SEQ ID NO: 38691 - DNA, 35 bp, Artificial Sequence
  Synthetic oligonucleotide
gatgtgccctatgccccgtacggaatccgactctt

SEQ ID NO: 38692 - DNA, 35 bp, Artificial Sequence
  Synthetic oligonucleotide
gtccaacctacgcatgtctttgacactgagccgtt

SEQ ID NO: 38693 - DNA, 35 bp, Artificial Sequence
  Synthetic oligonucleotide
gtcactgctgcctatcctactgtcccgtgcgcgtt

SEQ ID NO: 38694 - DNA, 35 bp, Artificial Sequence
  Synthetic oligonucleotide
tggagttcccatatcgtgcgtgtccttctcccttt

SEQ ID NO: 38695 - DNA, 37 bp, Artificial Sequence
  Synthetic oligonucleotide
agtgctgccatatccacgccccccgctgttgccgaga

SEQ ID NO: 38696 - DNA, 36 bp, Artificial Sequence
  Synthetic oligonucleotide
acctgcatcgctccctgcgcatggtcgactctccga

SEQ ID NO: 38697 - DNA, 37 bp, Artificial Sequence
  Synthetic oligonucleotide
tgcaggtgcacgttgctgctacggtttttgcttccga

SEQ ID NO: 38698 - DNA, 37 bp, Artificial Sequence
  Synthetic oligonucleotide
acgtatcaccgcggtatctgttcccctcctcttagga

SEQ ID NO: 38699 - DNA, 37 bp, Artificial Sequence
  Synthetic oligonucleotide
gcacacactcgccctagatcctgctgtacttactgga

SEQ ID NO: 38700 - DNA, 38 bp, Artificial Sequence
  Synthetic oligonucleotide
tggaccccgcacattccctctttgatatcagcctctga

SEQ ID NO: 38701 - DNA, 37 bp, Artificial Sequence
  Synthetic oligonucleotide
atcgcacggcgcccttgtccggttcctcgtatgttga

SEQ ID NO: 38702 - DNA, 38 bp, Artificial Sequence
  Synthetic oligonucleotide
tccccgcacctgccctcggtctcaaagcatggttttga

SEQ ID NO: 38703 - DNA, 36 bp, Artificial Sequence
  Synthetic oligonucleotide
acaccccatcgcgtacatgcagaacacactacgcta

SEQ ID NO: 38704 - DNA, 35 bp, Artificial Sequence
  Synthetic oligonucleotide
gtgccggagcaaatcacatgcgaatgtttctccac

SEQ ID NO: 38705 - DNA, 35 bp, Artificial Sequence
  Synthetic oligonucleotide
ggtaaacgtcgcatgccatccctgccgactccgac

SEQ ID NO: 38706 - DNA, 35 bp, Artificial Sequence
  Synthetic oligonucleotide
tgatgcccctagtgtcccgccatcccatgccgtac

SEQ ID NO: 38707 - DNA, 35 bp, Artificial Sequence
  Synthetic oligonucleotide
gcagtcctcttaactgttagcgcttctaccagccc

SEQ ID NO: 38708 - DNA, 35 bp, Artificial Sequence
  Synthetic oligonucleotide
tgatgcccctagtgtcccgccataccatgccgtcc

SEQ ID NO: 38709 - DNA, 35 bp, Artificial Sequence
  Synthetic oligonucleotide
gttcactgtacgccatttttcttacgtttgtgctc

SEQ ID NO: 38710 - DNA, 35 bp, Artificial Sequence
  Synthetic oligonucleotide
ttgttggccccacccctcctgcctcgcgtgatagg

SEQ ID NO: 38711 - DNA, 35 bp, Artificial Sequence
  Synthetic oligonucleotide
ttgcaggcctaggcattccctgcttgtccaacttg

SEQ ID NO: 38712 - DNA, 35 bp, Artificial Sequence
  Synthetic oligonucleotide
taggcgccatcgctctgcggcccgcctccccccct

SEQ ID NO: 38713 - DNA, 35 bp, Artificial Sequence
  Synthetic oligonucleotide
taaatcgcccacgcctctaacatctgccacgacgt

SEQ ID NO: 38714 - DNA, 35 bp, Artificial Sequence
  Synthetic oligonucleotide
gcgaacgccctacttatccctgctgctggattcaa

SEQ ID NO: 38715 - DNA, 36 bp, Artificial Sequence
  Synthetic oligonucleotide
gtgtgccaggtgtcgggggggtggagaggcggggaa

SEQ ID NO: 38716 - DNA, 35 bp, Artificial Sequence
  Synthetic oligonucleotide
gttgaccgaagagcaaggagaaggagagccgataa

SEQ ID NO: 38717 - DNA, 35 bp, Artificial Sequence
  Synthetic oligonucleotide
ggatcctgggctggtcccccccactccttgcttaa

SEQ ID NO: 38718 - DNA, 36 bp, Artificial Sequence
  Synthetic oligonucleotide
gatccccgcccggtgttgttcaatttcttcgtttaa

SEQ ID NO: 38719 - DNA, 36 bp, Artificial Sequence
  Synthetic oligonucleotide
gtccatcggcctcgagccccatattcgatcccaaca

SEQ ID NO: 38720 - DNA, 36 bp, Artificial Sequence
  Synthetic oligonucleotide
taccaaccgccagtattatttggtttagttttccca

SEQ ID NO: 38721 - DNA, 36 bp, Artificial Sequence
  Synthetic oligonucleotide
ggtcgcctgctcattccctagggtcacataacgcca

SEQ ID NO: 38722 - DNA, 37 bp, Artificial Sequence
  Synthetic oligonucleotide
agactgagagggggagaaggggacgcgaacccggaga

SEQ ID NO: 38723 - DNA, 37 bp, Artificial Sequence
  Synthetic oligonucleotide
ggtccaatcccactcgcacgtagccaccggtacacga

SEQ ID NO: 38724 - DNA, 36 bp, Artificial Sequence
  Synthetic oligonucleotide
acaaacatcaccgccagcttctgctgaactgaccga

SEQ ID NO: 38725 - DNA, 37 bp, Artificial Sequence
  Synthetic oligonucleotide
atagacaggggggaagtggagcgaatagcgcgtgcga

SEQ ID NO: 38726 - DNA, 37 bp, Artificial Sequence
  Synthetic oligonucleotide
agctccaccgctggtcagtaccgcacgcaccactcga

SEQ ID NO: 38727 - DNA, 37 bp, Artificial Sequence
  Synthetic oligonucleotide
gcgcccacaaccctgcctccaatacgccagcccggga

SEQ ID NO: 38728 - DNA, 38 bp, Artificial Sequence
  Synthetic oligonucleotide
accggaacggacttgggtgaaggggatgaggaggatga

SEQ ID NO: 38729 - DNA, 38 bp, Artificial Sequence
  Synthetic oligonucleotide
ggactggtgtggtggagaggtgggggcggaggaactga

SEQ ID NO: 38730 - DNA, 38 bp, Artificial Sequence
  Synthetic oligonucleotide
gtgcacacgccacctcgcctagtctaagaatctcctga

SEQ ID NO: 38731 - DNA, 37 bp, Artificial Sequence
  Synthetic oligonucleotide
gtgccctccccgtttaccttagagtttcatgctttga

SEQ ID NO: 38732 - DNA, 35 bp, Artificial Sequence
  Synthetic oligonucleotide
gaacatcgacattggagatgccacgcccatactta

SEQ ID NO: 38733 - DNA, 35 bp, Artificial Sequence
  Synthetic oligonucleotide
tctactccgatctgcctggattggctcaactaacc

SEQ ID NO: 38734 - DNA, 36 bp, Artificial Sequence
  Synthetic oligonucleotide
tatgcgaacaccgtttttgttcattccatgctaccc

SEQ ID NO: 38735 - DNA, 35 bp, Artificial Sequence
  Synthetic oligonucleotide
gtgttcggcggaaagtggggttaaatggtgggggc

SEQ ID NO: 38736 - DNA, 35 bp, Artificial Sequence
  Synthetic oligonucleotide
atcactgccgtctctaagatcgctcatctccgtgc

SEQ ID NO: 38737 - DNA, 35 bp, Artificial Sequence
  Synthetic oligonucleotide
aacctgcggctgaccatatccttcctttgatcctc

SEQ ID NO: 38738 - DNA, 35 bp, Artificial Sequence
  Synthetic oligonucleotide
ttgacccactcgctggtcccacgcgtttctctctc

SEQ ID NO: 38739 - DNA, 35 bp, Artificial Sequence
  Synthetic oligonucleotide
acactacccagtctcgacccagttatgacgaattc

SEQ ID NO: 38740 - DNA, 35 bp, Artificial Sequence
  Synthetic oligonucleotide
tgcgccctacgcacatagtcgcgaatacccggttc

SEQ ID NO: 38741 - DNA, 35 bp, Artificial Sequence
  Synthetic oligonucleotide
gaacgacaggataatcatagggcaagcatgggggg

SEQ ID NO: 38742 - DNA, 35 bp, Artificial Sequence
  Synthetic oligonucleotide
acatctttcgcaccgctcctagaactcgcctatgg

SEQ ID NO: 38743 - DNA, 35 bp, Artificial Sequence
  Synthetic oligonucleotide
tcacacccgatcagtctaccccgtacggattagat

SEQ ID NO: 38744 - DNA, 35 bp, Artificial Sequence
  Synthetic oligonucleotide
gccgttcaggcaccctacatccacagccctcccgt

SEQ ID NO: 38745 - DNA, 35 bp, Artificial Sequence
  Synthetic oligonucleotide
tatcgcacttaaccattgcgtatgggtcacccctt

SEQ ID NO: 38746 - DNA, 35 bp, Artificial Sequence
  Synthetic oligonucleotide
gagccgtgacttgcatagcctcttgtcctcatttt

SEQ ID NO: 38747 - DNA, 35 bp, Artificial Sequence
  Synthetic oligonucleotide
gatgccctgcgaagctccccgcctaaccacccaaa

SEQ ID NO: 38748 - DNA, 36 bp, Artificial Sequence
  Synthetic oligonucleotide
gtccgacaacgcgattgctctttatacccttacaca

SEQ ID NO: 38749 - DNA, 36 bp, Artificial Sequence
  Synthetic oligonucleotide
acgctcacacccttcggaattcgttcgcatggccca

SEQ ID NO: 38750 - DNA, 36 bp, Artificial Sequence
  Synthetic oligonucleotide
gtaacgcgttcaccctctgccattcgccatcccgca

SEQ ID NO: 38751 - DNA, 36 bp, Artificial Sequence
  Synthetic oligonucleotide
aacgactcccccgcaacttccctgccgtctccggca

SEQ ID NO: 38752 - DNA, 36 bp, Artificial Sequence
  Synthetic oligonucleotide
cggactgggtgggagggacaggaacaagggcgggca

SEQ ID NO: 38753 - DNA, 37 bp, Artificial Sequence
  Synthetic oligonucleotide
gcgagtagggggtgagaaggcggagaaccaagtaaga

SEQ ID NO: 38754 - DNA, 37 bp, Artificial Sequence
  Synthetic oligonucleotide
gtgtagagggtggggaggggacggattttgcactaga

SEQ ID NO: 38755 - DNA, 37 bp, Artificial Sequence
  Synthetic oligonucleotide
gttacccctcatcgtacagtgactacaccctatgcga

SEQ ID NO: 38756 - DNA, 37 bp, Artificial Sequence
  Synthetic oligonucleotide
tcatctcccacctgttaagccacgatacccagatcga

SEQ ID NO: 38757 - DNA, 37 bp, Artificial Sequence
  Synthetic oligonucleotide
tatctggtggggcgaaaagccgagagggggtagagga

SEQ ID NO: 38758 - DNA, 35 bp, Artificial Sequence
  Synthetic oligonucleotide
agttccacccctgtggggccacactcacactagga

SEQ ID NO: 38759 - DNA, 36 bp, Artificial Sequence
  Synthetic oligonucleotide
tatggagggctagggaaggggaatgcaactaacgga

SEQ ID NO: 38760 - DNA, 37 bp, Artificial Sequence
  Synthetic oligonucleotide
ttgtagggaggggtgtacggggtctatgctctgggga

SEQ ID NO: 38761 - DNA, 38 bp, Artificial Sequence
  Synthetic oligonucleotide
acagggtacggggaggaaacacgggggaagaattatga

SEQ ID NO: 38762 - DNA, 38 bp, Artificial Sequence
  Synthetic oligonucleotide
tcagatgtagggtggtaggggtactataatggatgtga

SEQ ID NO: 38763 - DNA, 38 bp, Artificial Sequence
  Synthetic oligonucleotide
gagtatggagaggggacggaagacaaggacagtgttga

SEQ ID NO: 38764 - DNA, 36 bp, Artificial Sequence
  Synthetic oligonucleotide
tcaaacgcctggccgcccgccccgcctacccaccta

SEQ ID NO: 38765 - DNA, 36 bp, Artificial Sequence
  Synthetic oligonucleotide
ggggatgcgccactttgctgatctttctaccgccta

SEQ ID NO: 38766 - DNA, 35 bp, Artificial Sequence
  Synthetic oligonucleotide
atgatccctacgctgttctaacgttccctagaaac

SEQ ID NO: 38767 - DNA, 35 bp, Artificial Sequence
  Synthetic oligonucleotide
atttacacatccgtcctgcgttagtcccgccacac

SEQ ID NO: 38768 - DNA, 35 bp, Artificial Sequence
  Synthetic oligonucleotide
actttagcccccgttttccagcgcgctcacctggc

SEQ ID NO: 38769 - DNA, 35 bp, Artificial Sequence
  Synthetic oligonucleotide
tatgcagcccatccgtctatcccggcgagcatatc

SEQ ID NO: 38770 - DNA, 35 bp, Artificial Sequence
  Synthetic oligonucleotide
aacactgccttccccgtgctacatggttaggcctc

SEQ ID NO: 38771 - DNA, 35 bp, Artificial Sequence
  Synthetic oligonucleotide
gttgcccgccttgcttatattcccaaactcaggtc

SEQ ID NO: 38772 - DNA, 35 bp, Artificial Sequence
  Synthetic oligonucleotide
ttcagccacccaaggtccatccgcaaacaaggttc

SEQ ID NO: 38773 - DNA, 35 bp, Artificial Sequence
  Synthetic oligonucleotide
ataccccaagctgggtcacttgtccctttcactcg

SEQ ID NO: 38774 - DNA, 35 bp, Artificial Sequence
  Synthetic oligonucleotide
gaactggatagagggaaaggtagaaactgagcctg

SEQ ID NO: 38775 - DNA, 35 bp, Artificial Sequence
  Synthetic oligonucleotide
agacccccacacacccctaatccggcactaccttg

SEQ ID NO: 38776 - DNA, 35 bp, Artificial Sequence
  Synthetic oligonucleotide
tatcctcccgcccgcagtgacgcgccctaagctat

SEQ ID NO: 38777 - DNA, 35 bp, Artificial Sequence
  Synthetic oligonucleotide
tccttgtatcagccgggctgcaccgacatccccct

SEQ ID NO: 38778 - DNA, 35 bp, Artificial Sequence
  Synthetic oligonucleotide
tacaggcataccgcgcattcacgccccctatccct

SEQ ID NO: 38779 - DNA, 35 bp, Artificial Sequence
  Synthetic oligonucleotide
gaaacgctcaccgaaccccgctaggcccactcgct

SEQ ID NO: 38780 - DNA, 35 bp, Artificial Sequence
  Synthetic oligonucleotide
gtggaacggggcgcccttttctcctcgaaccctct

SEQ ID NO: 38781 - DNA, 35 bp, Artificial Sequence
  Synthetic oligonucleotide
gcgatagccccctgggtggatcgcttccccaactt

SEQ ID NO: 38782 - DNA, 35 bp, Artificial Sequence
  Synthetic oligonucleotide
gccccccccgacacccatcgattatgaacagattt

SEQ ID NO: 38783 - DNA, 36 bp, Artificial Sequence
  Synthetic oligonucleotide
tgaagtgggtggtaaagcgggcaaggacagggggaa

SEQ ID NO: 38784 - DNA, 35 bp, Artificial Sequence
  Synthetic oligonucleotide
agtgactccccccactttcgatctgcccttttgaa

SEQ ID NO: 38785 - DNA, 35 bp, Artificial Sequence
  Synthetic oligonucleotide
attggagggtgggtgggtctgtttcattgtctaca

SEQ ID NO: 38786 - DNA, 35 bp, Artificial Sequence
  Synthetic oligonucleotide
gtaactactgagggtgccagattacgcacacacca

SEQ ID NO: 38787 - DNA, 36 bp, Artificial Sequence
  Synthetic oligonucleotide
agcgcccgaaccctgcccccatcccacctggcgtca

SEQ ID NO: 38788 - DNA, 37 bp, Artificial Sequence
  Synthetic oligonucleotide
ggttgtgtgaaatcaagtaggaagggcggtaggaaga

SEQ ID NO: 38789 - DNA, 37 bp, Artificial Sequence
  Synthetic oligonucleotide
ggtcactacacccatcgcctcccacccttttggcaga

SEQ ID NO: 38790 - DNA, 37 bp, Artificial Sequence
  Synthetic oligonucleotide
ataggggtgggaggcttgtgagccaatgggagggaga

SEQ ID NO: 38791 - DNA, 37 bp, Artificial Sequence
  Synthetic oligonucleotide
acacttctgcctccctgctaaaccctgttctgataga

SEQ ID NO: 38792 - DNA, 37 bp, Artificial Sequence
  Synthetic oligonucleotide
ggagggtcacacggaaagggggaatactgagaagcga

SEQ ID NO: 38793 - DNA, 37 bp, Artificial Sequence
  Synthetic oligonucleotide
ggggatgactctagtaaatgggggtgggcggggagga

SEQ ID NO: 38794 - DNA, 36 bp, Artificial Sequence
  Synthetic oligonucleotide
tgacactcttgaccgctactgcttatatctgcctga

SEQ ID NO: 38795 - DNA, 38 bp, Artificial Sequence
  Synthetic oligonucleotide
tactgtaccgcccccccgcccgtactcctggagggtga

SEQ ID NO: 38796 - DNA, 37 bp, Artificial Sequence
  Synthetic oligonucleotide
ttccacccctgtatagtccaccgaggcttgacattga

SEQ ID NO: 38797 - DNA, 38 bp, Artificial Sequence
  Synthetic oligonucleotide
aatcgagggtggaggaaaatagaggtgagacgtattga

SEQ ID NO: 38798 - DNA, 36 bp, Artificial Sequence
  Synthetic oligonucleotide
gtgcgcatgcgacacccgccacgtcccttcgtacta

SEQ ID NO: 38799 - DNA, 36 bp, Artificial Sequence
  Synthetic oligonucleotide
ataagcggggggtaggggagagtatcggtggtatta

SEQ ID NO: 38800 - DNA, 36 bp, Artificial Sequence
  Synthetic oligonucleotide
tagttggtcccaccgcgactccgccatagcccttta

SEQ ID NO: 38801 - DNA, 35 bp, Artificial Sequence
  Synthetic oligonucleotide
tcgcactcctcaatcacgcatcattctggaccaac

SEQ ID NO: 38802 - DNA, 35 bp, Artificial Sequence
  Synthetic oligonucleotide
atccacgaccagcttaaagccgcacccaccgatac

SEQ ID NO: 38803 - DNA, 35 bp, Artificial Sequence
  Synthetic oligonucleotide
gacctggatctatgttcgtgcattttgttccaccc

SEQ ID NO: 38804 - DNA, 35 bp, Artificial Sequence
  Synthetic oligonucleotide
gacggagccgcaggccatacggatcttagcacctc

SEQ ID NO: 38805 - DNA, 35 bp, Artificial Sequence
  Synthetic oligonucleotide
gtgcatacactccatcgctatcctactccgttgtc

SEQ ID NO: 38806 - DNA, 35 bp, Artificial Sequence
  Synthetic oligonucleotide
aagagtgctgcacctacttccatgtcctgtcctag

SEQ ID NO: 38807 - DNA, 35 bp, Artificial Sequence
  Synthetic oligonucleotide
tcacgacaccgcattattctgcctgcctttcctcg

SEQ ID NO: 38808 - DNA, 34 bp, Artificial Sequence
  Synthetic oligonucleotide
tgcctacaccctcgtataattattgtaacccttg

SEQ ID NO: 38809 - DNA, 35 bp, Artificial Sequence
  Synthetic oligonucleotide
gtacacgaggcacgtttttgcatttactcccgttg

SEQ ID NO: 38810 - DNA, 35 bp, Artificial Sequence
  Synthetic oligonucleotide
tgcatcaacggtgctactgtccatatggtcccact

SEQ ID NO: 38811 - DNA, 35 bp, Artificial Sequence
  Synthetic oligonucleotide
ttagcacctcttcacctggatggatcctcttcaaa

SEQ ID NO: 38812 - DNA, 36 bp, Artificial Sequence
  Synthetic oligonucleotide
tgtgtacgggtggtttttcgtctggccctctatcaa

SEQ ID NO: 38813 - DNA, 35 bp, Artificial Sequence
  Synthetic oligonucleotide
tcacgacaaggtcgtgatagcgggataggggggaa

SEQ ID NO: 38814 - DNA, 36 bp, Artificial Sequence
  Synthetic oligonucleotide
gcctcctccgatacttctcttcaagagcggtcgcca

SEQ ID NO: 38815 - DNA, 36 bp, Artificial Sequence
  Synthetic oligonucleotide
gttgcacccatatgctttaagtctctctaatgtcca

SEQ ID NO: 38816 - DNA, 35 bp, Artificial Sequence
  Synthetic oligonucleotide
gtgcagtcccgaccttgtggccttattaccttcca

SEQ ID NO: 38817 - DNA, 35 bp, Artificial Sequence
  Synthetic oligonucleotide
ggtgcggtgcctgcttttactatttttgggttcca

SEQ ID NO: 38818 - DNA, 37 bp, Artificial Sequence
  Synthetic oligonucleotide
ggggagtggtgaggttagcggaaggttcgggaaaaga

SEQ ID NO: 38819 - DNA, 37 bp, Artificial Sequence
  Synthetic oligonucleotide
gacggtctcacatacgatatgacctgcttaaaaccga

SEQ ID NO: 38820 - DNA, 37 bp, Artificial Sequence
  Synthetic oligonucleotide
ggagggaatggtgtgaatagggctgcgatgtatggga

SEQ ID NO: 38821 - DNA, 38 bp, Artificial Sequence
  Synthetic oligonucleotide
atgccccccgagtattctatcctgtattttaccaatga

SEQ ID NO: 38822 - DNA, 38 bp, Artificial Sequence
  Synthetic oligonucleotide
aatacctcccaggacgctctttcatagtcatgcaatga

SEQ ID NO: 38823 - DNA, 38 bp, Artificial Sequence
  Synthetic oligonucleotide
gcacaccccttcttgactgcacaaatcaggcctactga

SEQ ID NO: 38824 - DNA, 38 bp, Artificial Sequence
  Synthetic oligonucleotide
ggttacctcctgcattaagcccctgcctaccagtttga

SEQ ID NO: 38825 - DNA, 36 bp, Artificial Sequence
  Synthetic oligonucleotide
tgccaaaccatcacaatgacccctccgtgcctacta

SEQ ID NO: 38826 - DNA, 36 bp, Artificial Sequence
  Synthetic oligonucleotide
gccgtactagcccagctacatcgctttccaaaccta

SEQ ID NO: 38827 - DNA, 35 bp, Artificial Sequence
  Synthetic oligonucleotide
tccgattcggagcctgcctgctgtcctacgcccta

SEQ ID NO: 38828 - DNA, 36 bp, Artificial Sequence
  Synthetic oligonucleotide
gccggtgcaaacattagcagccttctcgctcttcta

SEQ ID NO: 38829 - DNA, 35 bp, Artificial Sequence
  Synthetic oligonucleotide
gaaatggcggtggggagggctggggttaatcggta

SEQ ID NO: 38830 - DNA, 35 bp, Artificial Sequence
  Synthetic oligonucleotide
gcgcatccgccgctctcgttggttctctacatgta

SEQ ID NO: 38831 - DNA, 34 bp, Artificial Sequence
  Synthetic oligonucleotide
ttgtcctggcgacttttgagccaccttaactaac

SEQ ID NO: 38832 - DNA, 35 bp, Artificial Sequence
  Synthetic oligonucleotide
tacgccccagcccttccatatcgtcaacctgcgcc

SEQ ID NO: 38833 - DNA, 35 bp, Artificial Sequence
  Synthetic oligonucleotide
gtgagaagccctctgtgtctccattttagcctgcc

SEQ ID NO: 38834 - DNA, 35 bp, Artificial Sequence
  Synthetic oligonucleotide
tcctgaacccaacaactgccagcctgcatattggc

SEQ ID NO: 38835 - DNA, 35 bp, Artificial Sequence
  Synthetic oligonucleotide
gacttcacacacgccacatctgcctggccctggtc

SEQ ID NO: 38836 - DNA, 35 bp, Artificial Sequence
  Synthetic oligonucleotide
gcaaacagcgcgaccggccccttgaactgatttcg

SEQ ID NO: 38837 - DNA, 35 bp, Artificial Sequence
  Synthetic oligonucleotide
gacatccacttacgttaggtcctctctcatacctg

SEQ ID NO: 38838 - DNA, 35 bp, Artificial Sequence
  Synthetic oligonucleotide
accaactggtccatagctaaacaggcactgactct

SEQ ID NO: 38839 - DNA, 35 bp, Artificial Sequence
  Synthetic oligonucleotide
agtgcgactggatcattcgtgtcgtgcacctctct

SEQ ID NO: 38840 - DNA, 35 bp, Artificial Sequence
  Synthetic oligonucleotide
aactctgccaaggcccacctcccgcgtaagcgatt

SEQ ID NO: 38841 - DNA, 35 bp, Artificial Sequence
  Synthetic oligonucleotide
aggagacctgctccatgttccatcatacatgcctt

SEQ ID NO: 38842 - DNA, 35 bp, Artificial Sequence
  Synthetic oligonucleotide
tctgtgagcaccattaattatcagggcccactctt

SEQ ID NO: 38843 - DNA, 36 bp, Artificial Sequence
  Synthetic oligonucleotide
acaaggggtggttggaaaagtgtggggagcggttaa

SEQ ID NO: 38844 - DNA, 36 bp, Artificial Sequence
  Synthetic oligonucleotide
atggcgaacgccatccatttgaatggtacatctaca

SEQ ID NO: 38845 - DNA, 36 bp, Artificial Sequence
  Synthetic oligonucleotide
aagtactgcactggtagggtcggagggagctgtaca

SEQ ID NO: 38846 - DNA, 36 bp, Artificial Sequence
  Synthetic oligonucleotide
atcgctacaggcgtcactctctgcaggttccgccca

SEQ ID NO: 38847 - DNA, 35 bp, Artificial Sequence
  Synthetic oligonucleotide
gaccccagtccggttggtcttgccttcccctccca

SEQ ID NO: 38848 - DNA, 35 bp, Artificial Sequence
  Synthetic oligonucleotide
tcccccgcccccactacatgtcctgctgttgtcca

SEQ ID NO: 38849 - DNA, 35 bp, Artificial Sequence
  Synthetic oligonucleotide
accacacgtgcgcaagctcaccttatcggtgttca

SEQ ID NO: 38850 - DNA, 37 bp, Artificial Sequence
  Synthetic oligonucleotide
gtggcgctttgcccgctgttgtacctgctctgcccga

SEQ ID NO: 38851 - DNA, 37 bp, Artificial Sequence
  Synthetic oligonucleotide
atcggccctatcagtctcgttcccgtgtaccctccga

SEQ ID NO: 38852 - DNA, 36 bp, Artificial Sequence
  Synthetic oligonucleotide
tccaatccattgtcgcgaaagacgcactctcctcga

SEQ ID NO: 38853 - DNA, 37 bp, Artificial Sequence
  Synthetic oligonucleotide
tagccaacgtccgtctcgtttgcttccgttgattcga

SEQ ID NO: 38854 - DNA, 36 bp, Artificial Sequence
  Synthetic oligonucleotide
gagggggggggctataaaggcacgaatacggtagga

SEQ ID NO: 38855 - DNA, 38 bp, Artificial Sequence
  Synthetic oligonucleotide
gagtgcatccactctcgctaggtgacctctatacatga

SEQ ID NO: 38856 - DNA, 37 bp, Artificial Sequence
  Synthetic oligonucleotide
accctccagccgccacagctgactataacacccatga

SEQ ID NO: 38857 - DNA, 37 bp, Artificial Sequence
  Synthetic oligonucleotide
atcgttgcctcttcttcaccgcgtatagtcttcctga

SEQ ID NO: 38858 - DNA, 37 bp, Artificial Sequence
  Synthetic oligonucleotide
tccaggccacgacccccataactgcaaccacatctga

SEQ ID NO: 38859 - DNA, 38 bp, Artificial Sequence
  Synthetic oligonucleotide
actgacgccccttcggagtatgtactttccctctctga

SEQ ID NO: 38860 - DNA, 38 bp, Artificial Sequence
  Synthetic oligonucleotide
tgcccccacctgagctctgtccaccaacaatgtcgtga

SEQ ID NO: 38861 - DNA, 36 bp, Artificial Sequence
  Synthetic oligonucleotide
tcacaccgccgcaccacagaatctactacgctgtga

SEQ ID NO: 38862 - DNA, 38 bp, Artificial Sequence
  Synthetic oligonucleotide
accatccacaaggagctactgccatccatagatcttga

SEQ ID NO: 38863 - DNA, 37 bp, Artificial Sequence
  Synthetic oligonucleotide
gtgcctacccttcacggtctgttcatcaaagctttga

SEQ ID NO: 38864 - DNA, 35 bp, Artificial Sequence
  Synthetic oligonucleotide
gaactcaaccctctgcaggctcgcatgcctacaac

SEQ ID NO: 38865 - DNA, 35 bp, Artificial Sequence
  Synthetic oligonucleotide
atgtgcccgccgtacacgcgaaagcctcacgtaac

SEQ ID NO: 38866 - DNA, 35 bp, Artificial Sequence
  Synthetic oligonucleotide
tttacccccgccggttcccccaaggccttgaggac

SEQ ID NO: 38867 - DNA, 35 bp, Artificial Sequence
  Synthetic oligonucleotide
tcctgacgcgggggaacgaaaacgcgccaatctac

SEQ ID NO: 38868 - DNA, 35 bp, Artificial Sequence
  Synthetic oligonucleotide
ttgcgcatcgtgtatgttcagtctgattcaccccc

SEQ ID NO: 38869 - DNA, 35 bp, Artificial Sequence
  Synthetic oligonucleotide
gctgccagagtatgcttttgttaactcttcccacg

SEQ ID NO: 38870 - DNA, 35 bp, Artificial Sequence
  Synthetic oligonucleotide
tcgcacgggactcggtgggggggtgttatggaagg

SEQ ID NO: 38871 - DNA, 35 bp, Artificial Sequence
  Synthetic oligonucleotide
gcgcccacccttccatcgctggcaccgtgaaacgg

SEQ ID NO: 38872 - DNA, 35 bp, Artificial Sequence
  Synthetic oligonucleotide
gcatcgactagagccaacacatgccatcacctctg

SEQ ID NO: 38873 - DNA, 35 bp, Artificial Sequence
  Synthetic oligonucleotide
tcccccatcagtgggccgctgactaaccattcgct

SEQ ID NO: 38874 - DNA, 36 bp, Artificial Sequence
  Synthetic oligonucleotide
actgcaacccacgtggttggtcctgtgcttcctcaa

SEQ ID NO: 38875 - DNA, 36 bp, Artificial Sequence
  Synthetic oligonucleotide
gaacgtcgatggccttttgcccctttccaactgtaa

SEQ ID NO: 38876 - DNA, 36 bp, Artificial Sequence
  Synthetic oligonucleotide
tgtctgcctaccagcttgtcaccttcctttccatca

SEQ ID NO: 38877 - DNA, 35 bp, Artificial Sequence
  Synthetic oligonucleotide
gcgcaacctgcgcgacctctccccgtaactggtca

SEQ ID NO: 38878 - DNA, 36 bp, Artificial Sequence
  Synthetic oligonucleotide
actaccgtaccaccagccgctatattacctagttca

SEQ ID NO: 38879 - DNA, 36 bp, Artificial Sequence
  Synthetic oligonucleotide
acccaccactctccggttacagatgcccttcaaaga

SEQ ID NO: 38880 - DNA, 37 bp, Artificial Sequence
  Synthetic oligonucleotide
accaacctagcgtacctttccatgccatatgcgccga

SEQ ID NO: 38881 - DNA, 37 bp, Artificial Sequence
  Synthetic oligonucleotide
tacgtgtcagccttatgccactggccctggttcgcga

SEQ ID NO: 38882 - DNA, 37 bp, Artificial Sequence
  Synthetic oligonucleotide
tccaccgcgtccggcacgccgaccctacttccccgga

SEQ ID NO: 38883 - DNA, 37 bp, Artificial Sequence
  Synthetic oligonucleotide
ggacggggagggcgggttgataaacctcggataggga

SEQ ID NO: 38884 - DNA, 37 bp, Artificial Sequence
  Synthetic oligonucleotide
aagccaccgctatcttctactgctctatgactctgga

SEQ ID NO: 38885 - DNA, 37 bp, Artificial Sequence
  Synthetic oligonucleotide
gaactccctcaatctctctaggttaacatcctactga

SEQ ID NO: 38886 - DNA, 38 bp, Artificial Sequence
  Synthetic oligonucleotide
gtgcaggccctagatcgcattatacccttcgcctgtga

SEQ ID NO: 38887 - DNA, 37 bp, Artificial Sequence
  Synthetic oligonucleotide
gacgagcccccgttactgtggtgcccctattgtgtga

SEQ ID NO: 38888 - DNA, 37 bp, Artificial Sequence
  Synthetic oligonucleotide
atagtccgcacagcgccgttactgtccctccccttga

SEQ ID NO: 38889 - DNA, 38 bp, Artificial Sequence
  Synthetic oligonucleotide
gccagtgacgatactgttaattaccgcccccatcttga

SEQ ID NO: 38890 - DNA, 37 bp, Artificial Sequence
  Synthetic oligonucleotide
tggttcgtcccggcgcacctctactcattcttgttga

SEQ ID NO: 38891 - DNA, 35 bp, Artificial Sequence
  Synthetic oligonucleotide
atccactgtacatgcctcgacttacgcgcactata

SEQ ID NO: 38892 - DNA, 35 bp, Artificial Sequence
  Synthetic oligonucleotide
ttgccctgtcatcggtatccgtttgtacacgccta

SEQ ID NO: 38893 - DNA, 36 bp, Artificial Sequence
  Synthetic oligonucleotide
ttagtccgcgctctaccttcatttttcgactgccta

SEQ ID NO: 38894 - DNA, 36 bp, Artificial Sequence
  Synthetic oligonucleotide
gatctgtccgacacttatgcttgtgccaaaattcta

SEQ ID NO: 38895 - DNA, 35 bp, Artificial Sequence
  Synthetic oligonucleotide
acacgcaaagtggacacgccgcttgctaccattta

SEQ ID NO: 38896 - DNA, 35 bp, Artificial Sequence
  Synthetic oligonucleotide
gtgaaccgctggtacgtaccgtggggcccacttta

SEQ ID NO: 38897 - DNA, 35 bp, Artificial Sequence
  Synthetic oligonucleotide
ttgcactcacgccctcctatcctgtattcaatcac

SEQ ID NO: 38898 - DNA, 35 bp, Artificial Sequence
  Synthetic oligonucleotide
tccacatcctccactccggcctccccgagccgtac

SEQ ID NO: 38899 - DNA, 34 bp, Artificial Sequence
  Synthetic oligonucleotide
tatgccacacaccccgacgcactttacgagcacc

SEQ ID NO: 38900 - DNA, 35 bp, Artificial Sequence
  Synthetic oligonucleotide
gttgcatccgcttaactcaccgcacctccgtggag

SEQ ID NO: 38901 - DNA, 35 bp, Artificial Sequence
  Synthetic oligonucleotide
gaggggggagaactggggtcggggcatcgtgaagg

SEQ ID NO: 38902 - DNA, 35 bp, Artificial Sequence
  Synthetic oligonucleotide
tgcgcctaccggccccaccgccctcctcttaggtg

SEQ ID NO: 38903 - DNA, 35 bp, Artificial Sequence
  Synthetic oligonucleotide
acgaggtgaggattgttggtgggggtgtgggattg

SEQ ID NO: 38904 - DNA, 35 bp, Artificial Sequence
  Synthetic oligonucleotide
gccacaagtaatgggcggggttgggagaggtcttg

SEQ ID NO: 38905 - DNA, 35 bp, Artificial Sequence
  Synthetic oligonucleotide
gccatcccgtctactttggtctggttttatctcat

SEQ ID NO: 38906 - DNA, 35 bp, Artificial Sequence
  Synthetic oligonucleotide
tcacagctatgacgtcgccctgctctcgatcttct

SEQ ID NO: 38907 - DNA, 35 bp, Artificial Sequence
  Synthetic oligonucleotide
tcactcccgtgtgctgcatgtttaccccaaccggt

SEQ ID NO: 38908 - DNA, 34 bp, Artificial Sequence
  Synthetic oligonucleotide
aattggtgccggtagagcgttcgggggcgggggt

SEQ ID NO: 38909 - DNA, 35 bp, Artificial Sequence
  Synthetic oligonucleotide
gctagctcgcagccctgtgcaccacctgttttatt

SEQ ID NO: 38910 - DNA, 35 bp, Artificial Sequence
  Synthetic oligonucleotide
gtcccatctagccaaagttactgtgtactttgttt

SEQ ID NO: 38911 - DNA, 36 bp, Artificial Sequence
  Synthetic oligonucleotide
gttcaagcgccgacttcatacgcaatgccctccgaa

SEQ ID NO: 38912 - DNA, 36 bp, Artificial Sequence
  Synthetic oligonucleotide
tgattgtgtacgcgcgtctcctcgatcttgccaaca

SEQ ID NO: 38913 - DNA, 35 bp, Artificial Sequence
  Synthetic oligonucleotide
attccacgactcgcctacgaaccttgcccggacca

SEQ ID NO: 38914 - DNA, 36 bp, Artificial Sequence
  Synthetic oligonucleotide
tgacctcacagcaaattaacggactgctttgcccca

SEQ ID NO: 38915 - DNA, 36 bp, Artificial Sequence
  Synthetic oligonucleotide
actgctccccaggtcacaaaaccctcctgaatgcca

SEQ ID NO: 38916 - DNA, 35 bp, Artificial Sequence
  Synthetic oligonucleotide
atccaccgggctccctcactgacctgatggttcca

SEQ ID NO: 38917 - DNA, 35 bp, Artificial Sequence
  Synthetic oligonucleotide
actagcccgcctcccgccgccaagtcctttactca

SEQ ID NO: 38918 - DNA, 36 bp, Artificial Sequence
  Synthetic oligonucleotide
tgtgtctatcgaggacgcagccagccacgcccttca

SEQ ID NO: 38919 - DNA, 36 bp, Artificial Sequence
  Synthetic oligonucleotide
ggaagaagaaaagcgattaggggtaagcaggaaaga

SEQ ID NO: 38920 - DNA, 38 bp, Artificial Sequence
  Synthetic oligonucleotide
tccaacctcctccctggtcacattttgccggttaatga

SEQ ID NO: 38921 - DNA, 38 bp, Artificial Sequence
  Synthetic oligonucleotide
tccacggaaggggaggagggacgggtgtcttgtactga

SEQ ID NO: 38922 - DNA, 38 bp, Artificial Sequence
  Synthetic oligonucleotide
gattccaccacacgctacacccagtgtcaggtacctga

SEQ ID NO: 38923 - DNA, 37 bp, Artificial Sequence
  Synthetic oligonucleotide
acatcgccgaactacaccccctcccaggtatgcctga

SEQ ID NO: 38924 - DNA, 38 bp, Artificial Sequence
  Synthetic oligonucleotide
gcctaggctacggcacctctccgctctttaattgctga

SEQ ID NO: 38925 - DNA, 36 bp, Artificial Sequence
  Synthetic oligonucleotide
gagtccggaggtgagtattgtgggaggtggaagtga

SEQ ID NO: 38926 - DNA, 36 bp, Artificial Sequence
  Synthetic oligonucleotide
ttccgatcgcacaggcctttacttctccacgcttga

SEQ ID NO: 38927 - DNA, 38 bp, Artificial Sequence
  Synthetic oligonucleotide
gtgtccaccgctagatccccttgcctattttcgcttga

SEQ ID NO: 38928 - DNA, 35 bp, Artificial Sequence
  Synthetic oligonucleotide
tcaccgactgatcgtttctgtccctgacctcaata

SEQ ID NO: 38929 - DNA, 36 bp, Artificial Sequence
  Synthetic oligonucleotide
attgagcgccctcggtctggttctctgtttacgcta

SEQ ID NO: 38930 - DNA, 36 bp, Artificial Sequence
  Synthetic oligonucleotide
gaactggtgtcgggaagaggaggggaaaccgcgcta

SEQ ID NO: 38931 - DNA, 36 bp, Artificial Sequence
  Synthetic oligonucleotide
atgcccctccaatctcttcacgtggctaacacggta

SEQ ID NO: 38932 - DNA, 36 bp, Artificial Sequence
  Synthetic oligonucleotide
tccatccgacgccttgcttcacctttcacttcggta

SEQ ID NO: 38933 - DNA, 34 bp, Artificial Sequence
  Synthetic oligonucleotide
tccgtcactcgcacacgcctgggtttcctctcac

SEQ ID NO: 38934 - DNA, 35 bp, Artificial Sequence
  Synthetic oligonucleotide
ttgagcccttctcgcttgggcagtcctgccacacc

SEQ ID NO: 38935 - DNA, 35 bp, Artificial Sequence
  Synthetic oligonucleotide
taccgatcaagcccctaatgggtccccgctttacc

SEQ ID NO: 38936 - DNA, 35 bp, Artificial Sequence
  Synthetic oligonucleotide
gccgacccttggggtccctatcaggctctccaccc

SEQ ID NO: 38937 - DNA, 35 bp, Artificial Sequence
  Synthetic oligonucleotide
gatggatcactcctcgcctggtctctttattgccc

SEQ ID NO: 38938 - DNA, 35 bp, Artificial Sequence
  Synthetic oligonucleotide
ttgaaaaacgacgaaataggagggtgggaaagcgc

SEQ ID NO: 38939 - DNA, 35 bp, Artificial Sequence
  Synthetic oligonucleotide
actatccaccctgatcatcggtgcacctagctcgc

SEQ ID NO: 38940 - DNA, 35 bp, Artificial Sequence
  Synthetic oligonucleotide
tcctcggatcacttgccgcctagttgacctcaatc

SEQ ID NO: 38941 - DNA, 35 bp, Artificial Sequence
  Synthetic oligonucleotide
tacgtacctccacttaaataatacgagcttgagct

SEQ ID NO: 38942 - DNA, 35 bp, Artificial Sequence
  Synthetic oligonucleotide
tctaacagcgaatattgcactcttgcccacgctct

SEQ ID NO: 38943 - DNA, 35 bp, Artificial Sequence
  Synthetic oligonucleotide
agcacgagaacactatctgcactgttactggctct

SEQ ID NO: 38944 - DNA, 35 bp, Artificial Sequence
  Synthetic oligonucleotide
gacacctctcgctttgagcagcacgtacctccggt

SEQ ID NO: 38945 - DNA, 35 bp, Artificial Sequence
  Synthetic oligonucleotide
gaggatcacccttcggatcgctactttccccactt

SEQ ID NO: 38946 - DNA, 35 bp, Artificial Sequence
  Synthetic oligonucleotide
agaaaatctacgccgctccccacctgtccgtttaa

SEQ ID NO: 38947 - DNA, 36 bp, Artificial Sequence
  Synthetic oligonucleotide
tactcgcgtcgcatatttctgtcctttctatgccca

SEQ ID NO: 38948 - DNA, 37 bp, Artificial Sequence
  Synthetic oligonucleotide
gggtgggtgggcaattgtagtctgggagtaacgacga

SEQ ID NO: 38949 - DNA, 37 bp, Artificial Sequence
  Synthetic oligonucleotide
aacgctagcacaaccagccgcatacatgattacccga

SEQ ID NO: 38950 - DNA, 37 bp, Artificial Sequence
  Synthetic oligonucleotide
agacagagtagggatgggaagctgcgtgggggaagga

SEQ ID NO: 38951 - DNA, 37 bp, Artificial Sequence
  Synthetic oligonucleotide
gcgaccacctctctttgtgctgcccgaattctgtgga

SEQ ID NO: 38952 - DNA, 37 bp, Artificial Sequence
  Synthetic oligonucleotide
gtcgcggtaaactcgcatattacattcaccccttgga

SEQ ID NO: 38953 - DNA, 37 bp, Artificial Sequence
  Synthetic oligonucleotide
gaaggagaaggttccgaaatgggaggggataggatga

SEQ ID NO: 38954 - DNA, 38 bp, Artificial Sequence
  Synthetic oligonucleotide
acacagtctcagatcgccgatgcctctctcccgactga

SEQ ID NO: 38955 - DNA, 38 bp, Artificial Sequence
  Synthetic oligonucleotide
ttgtccgcgatgcccgccctgtcaatctttaccgctga

SEQ ID NO: 38956 - DNA, 37 bp, Artificial Sequence
  Synthetic oligonucleotide
ggacgaggggagaggtagggctaaagtttacgagtga

SEQ ID NO: 38957 - DNA, 38 bp, Artificial Sequence
  Synthetic oligonucleotide
tacccgcccaaccccattgccaggtccccttaacgtga

SEQ ID NO: 38958 - DNA, 37 bp, Artificial Sequence
  Synthetic oligonucleotide
agagcgtgccatacatttcatcccgtccactccttga

SEQ ID NO: 38959 - DNA, 36 bp, Artificial Sequence
  Synthetic oligonucleotide
gcaaccaccaattgactcagttccgtacttccaata

SEQ ID NO: 38960 - DNA, 35 bp, Artificial Sequence
  Synthetic oligonucleotide
acgcccggtgcgcgacgacttcacgccagtctaac

SEQ ID NO: 38961 - DNA, 35 bp, Artificial Sequence
  Synthetic oligonucleotide
cctgacgccggtcttagcacacgacgctttatcac

SEQ ID NO: 38962 - DNA, 35 bp, Artificial Sequence
  Synthetic oligonucleotide
tgcctacgttgcgtgcgacatctgcactatccgac

SEQ ID NO: 38963 - DNA, 35 bp, Artificial Sequence
  Synthetic oligonucleotide
tagcataagcgtgagcttccccacatcctctcgac

SEQ ID NO: 38964 - DNA, 35 bp, Artificial Sequence
  Synthetic oligonucleotide
tcccaggctacgttggttccccgcgcggctccacc

SEQ ID NO: 38965 - DNA, 35 bp, Artificial Sequence
  Synthetic oligonucleotide
acgaccggaggctgcctgtttgtgctgattctacc

SEQ ID NO: 38966 - DNA, 35 bp, Artificial Sequence
  Synthetic oligonucleotide
gtgggagcctttccttctgtatcgtcctgatagcc

SEQ ID NO: 38967 - DNA, 35 bp, Artificial Sequence
  Synthetic oligonucleotide
gtcaccttgcagacccccctagtgatacgtacctc

SEQ ID NO: 38968 - DNA, 35 bp, Artificial Sequence
  Synthetic oligonucleotide
catccaccccagtactcacgacaacgagtgggtcg

SEQ ID NO: 38969 - DNA, 35 bp, Artificial Sequence
  Synthetic oligonucleotide
taacggtgcccacgttcacacgcctaccctggttg

SEQ ID NO: 38970 - DNA, 35 bp, Artificial Sequence
  Synthetic oligonucleotide
gatggtcgctgccgcctgggaatcttgcttaacat

SEQ ID NO: 38971 - DNA, 35 bp, Artificial Sequence
  Synthetic oligonucleotide
gccatcaaactccatcccgccttctgagctaggct

SEQ ID NO: 38972 - DNA, 35 bp, Artificial Sequence
  Synthetic oligonucleotide
gcgcactcctaccacctgccccatatgtatgatgt

SEQ ID NO: 38973 - DNA, 35 bp, Artificial Sequence
  Synthetic oligonucleotide
tttcacaggccctccacggtgatctttctatgatt

SEQ ID NO: 38974 - DNA, 35 bp, Artificial Sequence
  Synthetic oligonucleotide
taccgccgactgggccaggcccctctgccttcttt

SEQ ID NO: 38975 - DNA, 36 bp, Artificial Sequence
  Synthetic oligonucleotide
ttgggaggagggcggggacatgggacagagacgaaa

SEQ ID NO: 38976 - DNA, 36 bp, Artificial Sequence
  Synthetic oligonucleotide
gactcggacttcctggcaagccccatccacttagaa

SEQ ID NO: 38977 - DNA, 36 bp, Artificial Sequence
  Synthetic oligonucleotide
tccgcaaccaggggctttgcgattttcctttttcca

SEQ ID NO: 38978 - DNA, 36 bp, Artificial Sequence
  Synthetic oligonucleotide
gccacgatccccatcattgacctgatcttatttgca

SEQ ID NO: 38979 - DNA, 36 bp, Artificial Sequence
  Synthetic oligonucleotide
acagagcccgtccaaacctgcctatacattatctca

SEQ ID NO: 38980 - DNA, 37 bp, Artificial Sequence
  Synthetic oligonucleotide
actatccaccgtccggacggggtcttatcctttctga

SEQ ID NO: 38981 - DNA, 38 bp, Artificial Sequence
  Synthetic oligonucleotide
tggtggaggactggggtaggtggcacggtagtgagtga

SEQ ID NO: 38982 - DNA, 38 bp, Artificial Sequence
  Synthetic oligonucleotide
acccgccacttgctactaacacggtgcccatttcgtga

SEQ ID NO: 38983 - DNA, 36 bp, Artificial Sequence
  Synthetic oligonucleotide
gcacgtcaaagccgcgccgttaccatttgtcaccta

SEQ ID NO: 38984 - DNA, 36 bp, Artificial Sequence
  Synthetic oligonucleotide
tcccaccgccgccgatacgctatgcgctctttagta

SEQ ID NO: 38985 - DNA, 35 bp, Artificial Sequence
  Synthetic oligonucleotide
gcctacctctcatgcgcctcgaccactgtgccacc

SEQ ID NO: 38986 - DNA, 35 bp, Artificial Sequence
  Synthetic oligonucleotide
gtgatgcgcactatgttgccgtctgcccagttacc

SEQ ID NO: 38987 - DNA, 35 bp, Artificial Sequence
  Synthetic oligonucleotide
tcagcggttcgttctttctgtcgcttggtcggccc

SEQ ID NO: 38988 - DNA, 35 bp, Artificial Sequence
  Synthetic oligonucleotide
acacgcattcatggcctctcatatctacgttcgcc

SEQ ID NO: 38989 - DNA, 35 bp, Artificial Sequence
  Synthetic oligonucleotide
accccaatcccccgcctctttgcaggtcctgtgcc

SEQ ID NO: 38990 - DNA, 35 bp, Artificial Sequence
  Synthetic oligonucleotide
aacctcgatacaactctctccttgacaggagttcc

SEQ ID NO: 38991 - DNA, 35 bp, Artificial Sequence
  Synthetic oligonucleotide
gatccatccaccgattcgctggtcgctccattggc

SEQ ID NO: 38992 - DNA, 35 bp, Artificial Sequence
  Synthetic oligonucleotide
tgaccccaaggctatatttaccatccattacatgc

SEQ ID NO: 38993 - DNA, 35 bp, Artificial Sequence
  Synthetic oligonucleotide
acccaaccccgaagctcagctacatcccacgtatc

SEQ ID NO: 38994 - DNA, 35 bp, Artificial Sequence
  Synthetic oligonucleotide
agtgtgcgccccacgctgctatccgctcggacctc

SEQ ID NO: 38995 - DNA, 35 bp, Artificial Sequence
  Synthetic oligonucleotide
aagacgtgggttggtcttgcgtttttggctccctc

SEQ ID NO: 38996 - DNA, 35 bp, Artificial Sequence
  Synthetic oligonucleotide
atggacccccgatgtagcgtcacatttcacacttc

SEQ ID NO: 38997 - DNA, 35 bp, Artificial Sequence
  Synthetic oligonucleotide
acggagtaggtggagggggacccgggggggaaatg

SEQ ID NO: 38998 - DNA, 35 bp, Artificial Sequence
  Synthetic oligonucleotide
gatgaagacgggtgaggggtataggggtctaaatg

SEQ ID NO: 38999 - DNA, 35 bp, Artificial Sequence
  Synthetic oligonucleotide
tgaccggaactcggcatgtacctggccacctacat

SEQ ID NO: 39000 - DNA, 35 bp, Artificial Sequence
  Synthetic oligonucleotide
tctcacctcccatctcgtatttgccatttcaccat

SEQ ID NO: 39001 - DNA, 35 bp, Artificial Sequence
  Synthetic oligonucleotide
gaccccgactccgcaggtttgccttcgctaccgat

SEQ ID NO: 39002 - DNA, 35 bp, Artificial Sequence
  Synthetic oligonucleotide
gatggacctcagccattgtctattcctacatcgat

SEQ ID NO: 39003 - DNA, 35 bp, Artificial Sequence
  Synthetic oligonucleotide
gttgaattgaacctgcctccgccgaccgggaacct

SEQ ID NO: 39004 - DNA, 35 bp, Artificial Sequence
  Synthetic oligonucleotide
ggtctcgcccacattactaccgacgggttgcccct

SEQ ID NO: 39005 - DNA, 35 bp, Artificial Sequence
  Synthetic oligonucleotide
aatcgcaccacccgcacatttctattacctagcct

SEQ ID NO: 39006 - DNA, 35 bp, Artificial Sequence
  Synthetic oligonucleotide
tctcatctatacgccacatgataatgtgttacctt

SEQ ID NO: 39007 - DNA, 35 bp, Artificial Sequence
  Synthetic oligonucleotide
gcaaacctctcaaacggacgctctctggagccctt

SEQ ID NO: 39008 - DNA, 35 bp, Artificial Sequence
  Synthetic oligonucleotide
atcccacgaacagtaacgtttccggaccactcttt

SEQ ID NO: 39009 - DNA, 35 bp, Artificial Sequence
  Synthetic oligonucleotide
taccgagcctcatcccgacgctttgatttacccaa

SEQ ID NO: 39010 - DNA, 36 bp, Artificial Sequence
  Synthetic oligonucleotide
gcgacccgcactcaccactatggcaccgaccacgaa

SEQ ID NO: 39011 - DNA, 36 bp, Artificial Sequence
  Synthetic oligonucleotide
gtattcacaatgggaacggagaagggggctggggca

SEQ ID NO: 39012 - DNA, 36 bp, Artificial Sequence
  Synthetic oligonucleotide
gacactacatgaacagccctgtccccgcggagtgca

SEQ ID NO: 39013 - DNA, 37 bp, Artificial Sequence
  Synthetic oligonucleotide
gaggaggttcaggaggagcaaatgcagggggacaaga

SEQ ID NO: 39014 - DNA, 37 bp, Artificial Sequence
  Synthetic oligonucleotide
acgtgacagtgctccctgcgattgatttcaccataga

SEQ ID NO: 39015 - DNA, 36 bp, Artificial Sequence
  Synthetic oligonucleotide
acccacatagctagtcgttggcctggtactcaacga

SEQ ID NO: 39016 - DNA, 37 bp, Artificial Sequence
  Synthetic oligonucleotide
gcacgtttgttgttgccaatgcccctcactcacacga

SEQ ID NO: 39017 - DNA, 35 bp, Artificial Sequence
  Synthetic oligonucleotide
gccgcacggccattatccccagcaacccccggcga

SEQ ID NO: 39018 - DNA, 37 bp, Artificial Sequence
  Synthetic oligonucleotide
tatcccccgtacagattgcccctacctctcttatcga

SEQ ID NO: 39019 - DNA, 37 bp, Artificial Sequence
  Synthetic oligonucleotide
tgtttgccaacgatcagcccccctcctgcgatctcga

SEQ ID NO: 39020 - DNA, 37 bp, Artificial Sequence
  Synthetic oligonucleotide
gcaacgatagcagggattaggcaatggggagggtcga

SEQ ID NO: 39021 - DNA, 37 bp, Artificial Sequence
  Synthetic oligonucleotide
tcgccaaatagcaggaactggggaaaggtagtgggga

SEQ ID NO: 39022 - DNA, 37 bp, Artificial Sequence
  Synthetic oligonucleotide
gaacggtcggacaaaggacaagggatgggctatggga

SEQ ID NO: 39023 - DNA, 37 bp, Artificial Sequence
  Synthetic oligonucleotide
tccgtaacatcactcgggggtattgggtcgggtggga

SEQ ID NO: 39024 - DNA, 37 bp, Artificial Sequence
  Synthetic oligonucleotide
gaccccgcctcaacatccagtatagtcaacgttggga

SEQ ID NO: 39025 - DNA, 37 bp, Artificial Sequence
  Synthetic oligonucleotide
gtcacctccaacggtagttatcctcaccctaaatgga

SEQ ID NO: 39026 - DNA, 36 bp, Artificial Sequence
  Synthetic oligonucleotide
tgcccgacggggcccccctactccccattcccatga

SEQ ID NO: 39027 - DNA, 38 bp, Artificial Sequence
  Synthetic oligonucleotide
gccgcaccaagcgtctgagaatccgcacctctacctga

SEQ ID NO: 39028 - DNA, 37 bp, Artificial Sequence
  Synthetic oligonucleotide
tcggacaaccgaacctcatccttatatgctctcctga

SEQ ID NO: 39029 - DNA, 38 bp, Artificial Sequence
  Synthetic oligonucleotide
tacaacgcattttaacacctgccgccccccaagcgtga

SEQ ID NO: 39030 - DNA, 35 bp, Artificial Sequence
  Synthetic oligonucleotide
gacgcatcccgtacaactcttcgtaggtcgccata

SEQ ID NO: 39031 - DNA, 36 bp, Artificial Sequence
  Synthetic oligonucleotide
tcgccattctatccggtgtttccttcgctctaccta

SEQ ID NO: 39032 - DNA, 35 bp, Artificial Sequence
  Synthetic oligonucleotide
gtcgtaaggccgtcgacctccccccccatccagta

SEQ ID NO: 39033 - DNA, 35 bp, Artificial Sequence
  Synthetic oligonucleotide
gttatgggtgggggcaaaatgggcgggtagtacac

SEQ ID NO: 39034 - DNA, 35 bp, Artificial Sequence
  Synthetic oligonucleotide
gccgaccgccacacgtcaccgctaatttttatacc

SEQ ID NO: 39035 - DNA, 35 bp, Artificial Sequence
  Synthetic oligonucleotide
ttgtccgatcctcgcgtggtcatcgtattctgccc

SEQ ID NO: 39036 - DNA, 35 bp, Artificial Sequence
  Synthetic oligonucleotide
tcacattttctctcgacacgcgcttatcctcagcc

SEQ ID NO: 39037 - DNA, 35 bp, Artificial Sequence
  Synthetic oligonucleotide
tctattctccgccattttcgttcacccagaccgcc

SEQ ID NO: 39038 - DNA, 35 bp, Artificial Sequence
  Synthetic oligonucleotide
agtctaccctcccgtcaatcttgtacgctacctgc

SEQ ID NO: 39039 - DNA, 35 bp, Artificial Sequence
  Synthetic oligonucleotide
gtcacccgaatgtttgtcctgctattttggcctgc

SEQ ID NO: 39040 - DNA, 35 bp, Artificial Sequence
  Synthetic oligonucleotide
tcccgttcctctagtgcgaccgccactccgttccg

SEQ ID NO: 39041 - DNA, 35 bp, Artificial Sequence
  Synthetic oligonucleotide
aatgctcccaaccactgctctacaacagcctagcg

SEQ ID NO: 39042 - DNA, 35 bp, Artificial Sequence
  Synthetic oligonucleotide
gaagcacactctgccatctttaaactcgtcattcg

SEQ ID NO: 39043 - DNA, 35 bp, Artificial Sequence
  Synthetic oligonucleotide
attcgcggcgtgcgggggggggtacggaggatggg

SEQ ID NO: 39044 - DNA, 35 bp, Artificial Sequence
  Synthetic oligonucleotide
gagttgcgaaggcagaggtgcgttggtgttgggtg

SEQ ID NO: 39045 - DNA, 35 bp, Artificial Sequence
  Synthetic oligonucleotide
tcccccactacagagcccagttctgcccccgagat

SEQ ID NO: 39046 - DNA, 35 bp, Artificial Sequence
  Synthetic oligonucleotide
tcccaccgttgctatcatccctttttcagtattat

SEQ ID NO: 39047 - DNA, 35 bp, Artificial Sequence
  Synthetic oligonucleotide
aacacgcccagcctcaccacagccgccatcgtcct

SEQ ID NO: 39048 - DNA, 35 bp, Artificial Sequence
  Synthetic oligonucleotide
tccccgtagtccctccttcatatcgagtgtgcttt

SEQ ID NO: 39049 - DNA, 35 bp, Artificial Sequence
  Synthetic oligonucleotide
gggtacccacgcgcagccctcgtcttgcacttttt

SEQ ID NO: 39050 - DNA, 36 bp, Artificial Sequence
  Synthetic oligonucleotide
cacaccaccatcatgcgaaatcccccggctcttcaa

SEQ ID NO: 39051 - DNA, 36 bp, Artificial Sequence
  Synthetic oligonucleotide
tctgacgctgcggtgccattacccttcgccgtgaca

SEQ ID NO: 39052 - DNA, 35 bp, Artificial Sequence
  Synthetic oligonucleotide
actctacaccgccagaataccacgaatatactcca

SEQ ID NO: 39053 - DNA, 37 bp, Artificial Sequence
  Synthetic oligonucleotide
ttcactgtcggttcaaactgcctttcatcatctggga

SEQ ID NO: 39054 - DNA, 38 bp, Artificial Sequence
  Synthetic oligonucleotide
ggaatggaaaggaaggtgcgggggacagttcacagtga

SEQ ID NO: 39055 - DNA, 37 bp, Artificial Sequence
  Synthetic oligonucleotide
atgatgaaagcacggggtgagggggaatggtcggtga

SEQ ID NO: 39056 - DNA, 38 bp, Artificial Sequence
  Synthetic oligonucleotide
aacacaagatgggggagggcgggttaaagacggggtga

SEQ ID NO: 39057 - DNA, 38 bp, Artificial Sequence
  Synthetic oligonucleotide
gctcgccacgtggtatcctctcttttttctggtggtga

SEQ ID NO: 39058 - DNA, 38 bp, Artificial Sequence
  Synthetic oligonucleotide
gactatgcgcggtgggtgtgctccctcttttcatgtga

SEQ ID NO: 39059 - DNA, 37 bp, Artificial Sequence
  Synthetic oligonucleotide
gctgcttccccgcctaagcctgcataaccttgattga

SEQ ID NO: 39060 - DNA, 35 bp, Artificial Sequence
  Synthetic oligonucleotide
aattatgccgtgcacactgaatctgcccttacgta

SEQ ID NO: 39061 - DNA, 36 bp, Artificial Sequence
  Synthetic oligonucleotide
tgagcgtaacacacgctgctaaaaggtccacccgta

SEQ ID NO: 39062 - DNA, 36 bp, Artificial Sequence
  Synthetic oligonucleotide
gtgcggctccatctcgcttctgatatgcacgcctta

SEQ ID NO: 39063 - DNA, 35 bp, Artificial Sequence
  Synthetic oligonucleotide
tccccccggaccaatgccttttgtctgcaaaacac

SEQ ID NO: 39064 - DNA, 35 bp, Artificial Sequence
  Synthetic oligonucleotide
taaacacctccaccacagcttgagtagctgtcgac

SEQ ID NO: 39065 - DNA, 35 bp, Artificial Sequence
  Synthetic oligonucleotide
tgtagcctcacgtagtgagccaccatccaattgac

SEQ ID NO: 39066 - DNA, 35 bp, Artificial Sequence
  Synthetic oligonucleotide
gttgcctatggcctttactgggtctgcggacccgc

SEQ ID NO: 39067 - DNA, 35 bp, Artificial Sequence
  Synthetic oligonucleotide
tgcgcatcccgacgctgtcgcattaaccctccatc

SEQ ID NO: 39068 - DNA, 35 bp, Artificial Sequence
  Synthetic oligonucleotide
atcgaccgacacctccgacttactcgttactggag

SEQ ID NO: 39069 - DNA, 35 bp, Artificial Sequence
  Synthetic oligonucleotide
gtgcgtccctcctaccatgccgtttttggcgcccg

SEQ ID NO: 39070 - DNA, 35 bp, Artificial Sequence
  Synthetic oligonucleotide
tttggtcgcctcgtatcgttcaccgtgtctcttat

SEQ ID NO: 39071 - DNA, 35 bp, Artificial Sequence
  Synthetic oligonucleotide
tgacccacgcagaatagggaaatacactcactgct

SEQ ID NO: 39072 - DNA, 35 bp, Artificial Sequence
  Synthetic oligonucleotide
gaagggaaggtagggagtctcagtgtgggatgggt

SEQ ID NO: 39073 - DNA, 35 bp, Artificial Sequence
  Synthetic oligonucleotide
tatcctcgtcgccgcctagctctttgaacatttgt

SEQ ID NO: 39074 - DNA, 35 bp, Artificial Sequence
  Synthetic oligonucleotide
atcgtcctaccctgcgcacgtcggtcctgattttt

SEQ ID NO: 39075 - DNA, 36 bp, Artificial Sequence
  Synthetic oligonucleotide
gatggggagtggggaacggataaacgtcggtggaaa

SEQ ID NO: 39076 - DNA, 36 bp, Artificial Sequence
  Synthetic oligonucleotide
tagacgccggcccgcccagctcccaaacgcccttaa

SEQ ID NO: 39077 - DNA, 36 bp, Artificial Sequence
  Synthetic oligonucleotide
aaagacgatccagcatagggaatgaagggtggcaca

SEQ ID NO: 39078 - DNA, 36 bp, Artificial Sequence
  Synthetic oligonucleotide
acccggcccgcacttcgcatatagccttatcataca

SEQ ID NO: 39079 - DNA, 36 bp, Artificial Sequence
  Synthetic oligonucleotide
gtagaagccgtccggtacttgtcgccccttgtctca

SEQ ID NO: 39080 - DNA, 36 bp, Artificial Sequence
  Synthetic oligonucleotide
gtacccatgccggactgtaaactgccagttcgccga

SEQ ID NO: 39081 - DNA, 37 bp, Artificial Sequence
  Synthetic oligonucleotide
actcagtgggcacggaacaataggggcagaaactcga

SEQ ID NO: 39082 - DNA, 38 bp, Artificial Sequence
  Synthetic oligonucleotide
atgacgggccgttgggggcggagggcagtattatatga

SEQ ID NO: 39083 - DNA, 38 bp, Artificial Sequence
  Synthetic oligonucleotide
gccactaacctgcataggactactccactcctgactga

SEQ ID NO: 39084 - DNA, 38 bp, Artificial Sequence
  Synthetic oligonucleotide
attcgcacacgttgattcttctctgatccttgtcctga

SEQ ID NO: 39085 - DNA, 38 bp, Artificial Sequence
  Synthetic oligonucleotide
ttcatgccaacgctccccgatcatctgcctcttcgtga

SEQ ID NO: 39086 - DNA, 38 bp, Artificial Sequence
  Synthetic oligonucleotide
gtgcctcagacgtttcgcctcacttttacttttgttga

SEQ ID NO: 39087 - DNA, 36 bp, Artificial Sequence
  Synthetic oligonucleotide
atctccgcccttgtccctatctaccacgcttgcata

SEQ ID NO: 39088 - DNA, 35 bp, Artificial Sequence
  Synthetic oligonucleotide
accccccctgagcgctcttcgatctcttgccgata

SEQ ID NO: 39089 - DNA, 36 bp, Artificial Sequence
  Synthetic oligonucleotide
tgcgaccgcccaataacgcggcacctagtacatcta

SEQ ID NO: 39090 - DNA, 36 bp, Artificial Sequence
  Synthetic oligonucleotide
tcaccgcgcgagtctcctccgtctatgccccccgta

SEQ ID NO: 39091 - DNA, 35 bp, Artificial Sequence
  Synthetic oligonucleotide
gcctatgcttctcagctttactatccactactgcc

SEQ ID NO: 39092 - DNA, 35 bp, Artificial Sequence
  Synthetic oligonucleotide
gccaattcaacactgtccgccattttccgtgtagc

SEQ ID NO: 39093 - DNA, 35 bp, Artificial Sequence
  Synthetic oligonucleotide
ttgcgcaccagtagatctcacctctcctacttatc

SEQ ID NO: 39094 - DNA, 35 bp, Artificial Sequence
  Synthetic oligonucleotide
gattcgcggctgtttcactttgcgaaccctttatc

SEQ ID NO: 39095 - DNA, 36 bp, Artificial Sequence
  Synthetic oligonucleotide
gcagatcgccctcattacgtacgaccttatagcctc

SEQ ID NO: 39096 - DNA, 35 bp, Artificial Sequence
  Synthetic oligonucleotide
gatgaagaaggtgaacgggggcggttattagagcg

SEQ ID NO: 39097 - DNA, 35 bp, Artificial Sequence
  Synthetic oligonucleotide
gtgctccccaacccctactcgacgcaacataatgg

SEQ ID NO: 39098 - DNA, 35 bp, Artificial Sequence
  Synthetic oligonucleotide
ataggagggcctaaagcaaaggggtggggtgtaat

SEQ ID NO: 39099 - DNA, 35 bp, Artificial Sequence
  Synthetic oligonucleotide
ttgtcacacctcaccttgctatcatctataaccct

SEQ ID NO: 39100 - DNA, 35 bp, Artificial Sequence
  Synthetic oligonucleotide
gagacgtacatgtaggtcgagtgctgtttcttcct

SEQ ID NO: 39101 - DNA, 35 bp, Artificial Sequence
  Synthetic oligonucleotide
aacgtgacccatctaccctcgcgtttagttcctct

SEQ ID NO: 39102 - DNA, 35 bp, Artificial Sequence
  Synthetic oligonucleotide
accacccctgctgaacggaatcttgttggtacctt

SEQ ID NO: 39103 - DNA, 35 bp, Artificial Sequence
  Synthetic oligonucleotide
attccaccgacaaaacttacgtcgaccttttgttt

SEQ ID NO: 39104 - DNA, 35 bp, Artificial Sequence
  Synthetic oligonucleotide
actctgtggacgtagtgtcccacgcctatcctttt

SEQ ID NO: 39105 - DNA, 31 bp, Artificial Sequence
  Synthetic oligonucleotide
atcattcgccccacgccgggacacgtaacaa

SEQ ID NO: 39106 - DNA, 36 bp, Artificial Sequence
  Synthetic oligonucleotide
atgaaaaatgggcgagggggaggctactgaggataa

SEQ ID NO: 39107 - DNA, 36 bp, Artificial Sequence
  Synthetic oligonucleotide
agctgtgctgtgtccttcagcttgatcacctaccca

SEQ ID NO: 39108 - DNA, 36 bp, Artificial Sequence
  Synthetic oligonucleotide
atcaccccccccacatgcaactgccttgaggttcca

SEQ ID NO: 39109 - DNA, 36 bp, Artificial Sequence
  Synthetic oligonucleotide
tcaatgcctgggcgttctaccatcgatatctcctca

SEQ ID NO: 39110 - DNA, 37 bp, Artificial Sequence
  Synthetic oligonucleotide
atctgccgggtgggggggacgggcggtaggacggcga

SEQ ID NO: 39111 - DNA, 37 bp, Artificial Sequence
  Synthetic oligonucleotide
aacacgctgactctgcagtttcccaccatttatgcga

SEQ ID NO: 39112 - DNA, 37 bp, Artificial Sequence
  Synthetic oligonucleotide
tgcgacccccttgctcccatcgcgtatatctctagga

SEQ ID NO: 39113 - DNA, 37 bp, Artificial Sequence
  Synthetic oligonucleotide
tgacacaaaacatgtacatatgggggcgtatggggga

SEQ ID NO: 39114 - DNA, 38 bp, Artificial Sequence
  Synthetic oligonucleotide
gcctccatcccccctgttaatccgacgtcggtcaatga

SEQ ID NO: 39115 - DNA, 37 bp, Artificial Sequence
  Synthetic oligonucleotide
aaatgagacacaggggcggggaggggcaaggtgatga

SEQ ID NO: 39116 - DNA, 37 bp, Artificial Sequence
  Synthetic oligonucleotide
gttggtgcaccaacacgtggttatggccctgtgatga

SEQ ID NO: 39117 - DNA, 38 bp, Artificial Sequence
  Synthetic oligonucleotide
ttgagttcgcttcatccgtaactagtgtacctccctga

SEQ ID NO: 39118 - DNA, 38 bp, Artificial Sequence
  Synthetic oligonucleotide
gctcaccaacgcctgaacatcatcgcctccagacttga

SEQ ID NO: 39119 - DNA, 36 bp, Artificial Sequence
  Synthetic oligonucleotide
gccaagagggggggtggggaatttccggtggacgta

SEQ ID NO: 39120 - DNA, 36 bp, Artificial Sequence
  Synthetic oligonucleotide
acatcgtgttgtcctctcattcccaccgttcctgta

SEQ ID NO: 39121 - DNA, 36 bp, Artificial Sequence
  Synthetic oligonucleotide
gctcggaacgggtagggggggtcctaggtgggtgta

SEQ ID NO: 39122 - DNA, 36 bp, Artificial Sequence
  Synthetic oligonucleotide
gtcccgccacgtgaacgtccggaacctacctttgta

SEQ ID NO: 39123 - DNA, 35 bp, Artificial Sequence
  Synthetic oligonucleotide
tatcacacacggttccacacccccgcctgctctta

SEQ ID NO: 39124 - DNA, 35 bp, Artificial Sequence
  Synthetic oligonucleotide
actaccgtgcaagtacagggcgttgctatttccac

SEQ ID NO: 39125 - DNA, 35 bp, Artificial Sequence
  Synthetic oligonucleotide
gtagggtgcagtagcaacccacagtaccttttgcc

SEQ ID NO: 39126 - DNA, 35 bp, Artificial Sequence
  Synthetic oligonucleotide
gtcgagataccggctctggtacccgctgttcctcc

SEQ ID NO: 39127 - DNA, 35 bp, Artificial Sequence
  Synthetic oligonucleotide
gtgtagacagctattccgttccattcgctccggtc

SEQ ID NO: 39128 - DNA, 35 bp, Artificial Sequence
  Synthetic oligonucleotide
atggtccagaccctgcggttttgcaatcacacttc

SEQ ID NO: 39129 - DNA, 35 bp, Artificial Sequence
  Synthetic oligonucleotide
ttgaccgcgctaactttcaaggcaccactctagcg

SEQ ID NO: 39130 - DNA, 35 bp, Artificial Sequence
  Synthetic oligonucleotide
aaccccctccccctgttgccatctttgtcataagg

SEQ ID NO: 39131 - DNA, 35 bp, Artificial Sequence
  Synthetic oligonucleotide
agttgaatgtggggggctgggaagggatattgggg

SEQ ID NO: 39132 - DNA, 35 bp, Artificial Sequence
  Synthetic oligonucleotide
atcaccgcttacccacttcctccacagatgcgtgg

SEQ ID NO: 39133 - DNA, 35 bp, Artificial Sequence
  Synthetic oligonucleotide
gaaacggaatgtggcccagtaaaagtgtggtgtgg

SEQ ID NO: 39134 - DNA, 35 bp, Artificial Sequence
  Synthetic oligonucleotide
acagcccaacttggtagttttctatgcttctcctg

SEQ ID NO: 39135 - DNA, 35 bp, Artificial Sequence
  Synthetic oligonucleotide
aacccgctgtggtggcgtgaatagtgtcactcaat

SEQ ID NO: 39136 - DNA, 35 bp, Artificial Sequence
  Synthetic oligonucleotide
gctggtggtccaatactcgtttccccgctgttcct

SEQ ID NO: 39137 - DNA, 35 bp, Artificial Sequence
  Synthetic oligonucleotide
taaccagtgtcgcaatggatctccacacaccactt

SEQ ID NO: 39138 - DNA, 35 bp, Artificial Sequence
  Synthetic oligonucleotide
tccaaggagtgatctgaggggagggggaatgggtt

SEQ ID NO: 39139 - DNA, 35 bp, Artificial Sequence
  Synthetic oligonucleotide
tatttccgcccagtgaggcctgacgtgcccgtttt

SEQ ID NO: 39140 - DNA, 36 bp, Artificial Sequence
  Synthetic oligonucleotide
ttcggacccttcaatggcaaccgcacctattcccaa

SEQ ID NO: 39141 - DNA, 36 bp, Artificial Sequence
  Synthetic oligonucleotide
acaatagtgctcgggtaatcggggggagagggagaa

SEQ ID NO: 39142 - DNA, 35 bp, Artificial Sequence
  Synthetic oligonucleotide
ttagacggccgttactagctgcctccgtcacctca

SEQ ID NO: 39143 - DNA, 36 bp, Artificial Sequence
  Synthetic oligonucleotide
agggcataaggggcccggagtaactgagcatgcaga

SEQ ID NO: 39144 - DNA, 37 bp, Artificial Sequence
  Synthetic oligonucleotide
tcagggccacccccgctaatgagccctgccaacccga

SEQ ID NO: 39145 - DNA, 37 bp, Artificial Sequence
  Synthetic oligonucleotide
aacatgcagctcgactttacattgatgccctccccga

SEQ ID NO: 39146 - DNA, 37 bp, Artificial Sequence
  Synthetic oligonucleotide
ttgctggccccttgccctatactggtccgccatccga

SEQ ID NO: 39147 - DNA, 36 bp, Artificial Sequence
  Synthetic oligonucleotide
tccacccgccctcccgctgtgtcccagatcaagcga

SEQ ID NO: 39148 - DNA, 36 bp, Artificial Sequence
  Synthetic oligonucleotide
tccccaccgccgccattgtacggttctcacctggga

SEQ ID NO: 39149 - DNA, 38 bp, Artificial Sequence
  Synthetic oligonucleotide
cactcccccgccaccaagtactatgtacggcctcctga

SEQ ID NO: 39150 - DNA, 36 bp, Artificial Sequence
  Synthetic oligonucleotide
gtgcgcccttccctaatccctgttgcctgactctga

SEQ ID NO: 39151 - DNA, 38 bp, Artificial Sequence
  Synthetic oligonucleotide
gcgtcggggggactggggtgaggaggtgccagaagtga

SEQ ID NO: 39152 - DNA, 38 bp, Artificial Sequence
  Synthetic oligonucleotide
tatgtgcgtagaagggaccaacgtggaggtgggggtga

SEQ ID NO: 39153 - DNA, 37 bp, Artificial Sequence
  Synthetic oligonucleotide
gtgagtgggatgggagggtgccgagcttaaggtgtga

SEQ ID NO: 39154 - DNA, 38 bp, Artificial Sequence
  Synthetic oligonucleotide
tgatgccctgctctaacaagtacgtcacctggctttga

SEQ ID NO: 39155 - DNA, 35 bp, Artificial Sequence
  Synthetic oligonucleotide
cccccccgatgagtgccctacctgcctgtactaac

SEQ ID NO: 39156 - DNA, 35 bp, Artificial Sequence
  Synthetic oligonucleotide
tccaacgggcattactttctattactcgagtgacc

SEQ ID NO: 39157 - DNA, 35 bp, Artificial Sequence
  Synthetic oligonucleotide
gatgtcatcggccccttcatccggcacagcgcccc

SEQ ID NO: 39158 - DNA, 35 bp, Artificial Sequence
  Synthetic oligonucleotide
tcaagccaccgcgagaatacttttgtccgttttgc

SEQ ID NO: 39159 - DNA, 35 bp, Artificial Sequence
  Synthetic oligonucleotide
gcactgcatgaacaggggcacttactctatccatc

SEQ ID NO: 39160 - DNA, 35 bp, Artificial Sequence
  Synthetic oligonucleotide
ggaacgttagaacttctacacccagtcctttcatc

SEQ ID NO: 39161 - DNA, 35 bp, Artificial Sequence
  Synthetic oligonucleotide
gacgtccatctcctggactccatcttctggatctc

SEQ ID NO: 39162 - DNA, 35 bp, Artificial Sequence
  Synthetic oligonucleotide
tactcagccttcacgttcacggcgaaaaacctctc

SEQ ID NO: 39163 - DNA, 35 bp, Artificial Sequence
  Synthetic oligonucleotide
tagtgctgttggggagggcgaggtaagtagcccag

SEQ ID NO: 39164 - DNA, 35 bp, Artificial Sequence
  Synthetic oligonucleotide
tccatctactattctgccgcccacagattctgaat

SEQ ID NO: 39165 - DNA, 35 bp, Artificial Sequence
  Synthetic oligonucleotide
gtggagcgctcccatacccgtggctcgtacgccct

SEQ ID NO: 39166 - DNA, 35 bp, Artificial Sequence
  Synthetic oligonucleotide
atcactcctttgtcatctgatctgcgcccagcagt

SEQ ID NO: 39167 - DNA, 35 bp, Artificial Sequence
  Synthetic oligonucleotide
gcgataccaccacctccgtcgagtcccttacatgt

SEQ ID NO: 39168 - DNA, 36 bp, Artificial Sequence
  Synthetic oligonucleotide
aacaggcgaatgtcacatgcccctccctattcacaa

SEQ ID NO: 39169 - DNA, 36 bp, Artificial Sequence
  Synthetic oligonucleotide
actcaagcttgctgttagctgccccacctaccccaa

SEQ ID NO: 39170 - DNA, 36 bp, Artificial Sequence
  Synthetic oligonucleotide
ttcctccgccccgtttactaccagtggtgtttccaa

SEQ ID NO: 39171 - DNA, 36 bp, Artificial Sequence
  Synthetic oligonucleotide
tgagtagggaaggccgtaagagggacgggcggcgaa

SEQ ID NO: 39172 - DNA, 36 bp, Artificial Sequence
  Synthetic oligonucleotide
ggaaatcccgcagaagaggtcctgctgccctcccca

SEQ ID NO: 39173 - DNA, 36 bp, Artificial Sequence
  Synthetic oligonucleotide
actgtgcttatgttctttccgcggtactcctcatca

SEQ ID NO: 39174 - DNA, 37 bp, Artificial Sequence
  Synthetic oligonucleotide
ggatgcagtagaataaagcgggtttggttggaggaga

SEQ ID NO: 39175 - DNA, 37 bp, Artificial Sequence
  Synthetic oligonucleotide
tgagagtgggtgggaaaccgacaatgcggaacaggga

SEQ ID NO: 39176 - DNA, 38 bp, Artificial Sequence
  Synthetic oligonucleotide
tctaaatgcagaagggagggcacgggtaatggcaatga

SEQ ID NO: 39177 - DNA, 38 bp, Artificial Sequence
  Synthetic oligonucleotide
gcgaggtaggaaaaggggccgggtaggagagggcatga

SEQ ID NO: 39178 - DNA, 38 bp, Artificial Sequence
  Synthetic oligonucleotide
gccattcctgcgtggtctcggtgtccattcctgcctga

SEQ ID NO: 39179 - DNA, 38 bp, Artificial Sequence
  Synthetic oligonucleotide
accacccattgcgggcgtagagcactcccatctgctga

SEQ ID NO: 39180 - DNA, 38 bp, Artificial Sequence
  Synthetic oligonucleotide
gactgccgaaggttcatagcgatggaaatggtgggtga

SEQ ID NO: 39181 - DNA, 35 bp, Artificial Sequence
  Synthetic oligonucleotide
ccagccgtttctgctctctgccttcttgctattga

SEQ ID NO: 39182 - DNA, 37 bp, Artificial Sequence
  Synthetic oligonucleotide
acactccgtccgcctcattctctgttatcatgtttga

SEQ ID NO: 39183 - DNA, 36 bp, Artificial Sequence
  Synthetic oligonucleotide
tcttagctccaatcacctgctatttgcttcgcccta

SEQ ID NO: 39184 - DNA, 35 bp, Artificial Sequence
  Synthetic oligonucleotide
tcccgccggctgggatgtttgcgctccctcatcta

SEQ ID NO: 39185 - DNA, 35 bp, Artificial Sequence
  Synthetic oligonucleotide
agattgcgtagcggaggggtggggagtgggattgg

SEQ ID NO: 39186 - DNA, 35 bp, Artificial Sequence
  Synthetic oligonucleotide
gtccccaactatatgatcacctgcaccagttgcat

SEQ ID NO: 39187 - DNA, 35 bp, Artificial Sequence
  Synthetic oligonucleotide
atgaacccatcgcctctgcaggccctgcttcctat

SEQ ID NO: 39188 - DNA, 35 bp, Artificial Sequence
  Synthetic oligonucleotide
aacgggacccccctcttcgcctgagctttaccatt

SEQ ID NO: 39189 - DNA, 35 bp, Artificial Sequence
  Synthetic oligonucleotide
gcattccatccgcagagctccgacgcctctacgtt

SEQ ID NO: 39190 - DNA, 35 bp, Artificial Sequence
  Synthetic oligonucleotide
gcagggaataggggcggcggaccaggtaagtcaaa

SEQ ID NO: 39191 - DNA, 36 bp, Artificial Sequence
  Synthetic oligonucleotide
gagggggcggggagtccgggcagggcgagccataaa

SEQ ID NO: 39192 - DNA, 36 bp, Artificial Sequence
  Synthetic oligonucleotide
atacacgccgccctatgatttccacgctggtggcca

SEQ ID NO: 39193 - DNA, 37 bp, Artificial Sequence
  Synthetic oligonucleotide
tcacacccatgatacatgcttaccaggcctgacgaga

SEQ ID NO: 39194 - DNA, 35 bp, Artificial Sequence
  Synthetic oligonucleotide
tgcgcatcacccatcgtaacatcctgtggacccga

SEQ ID NO: 39195 - DNA, 36 bp, Artificial Sequence
  Synthetic oligonucleotide
ttggtcactctcgcgactgtttcaccctctgcgcga

SEQ ID NO: 39196 - DNA, 35 bp, Artificial Sequence
  Synthetic oligonucleotide
tcaagggtaggtggatgataaagctgggggatgga

SEQ ID NO: 39197 - DNA, 36 bp, Artificial Sequence
  Synthetic oligonucleotide
acccgtacaggatcttactacccgcccgctatatga

SEQ ID NO: 39198 - DNA, 38 bp, Artificial Sequence
  Synthetic oligonucleotide
gtgccctacctcacatgtttcactatcctgagcactga

SEQ ID NO: 39199 - DNA, 38 bp, Artificial Sequence
  Synthetic oligonucleotide
gagagcgcctctctgatccacctttcctgcgcatctga

SEQ ID NO: 39200 - DNA, 36 bp, Artificial Sequence
  Synthetic oligonucleotide
atgctgcccctctcgagttgtttcaatcagccacta

SEQ ID NO: 39201 - DNA, 35 bp, Artificial Sequence
  Synthetic oligonucleotide
gatggggaggcggggggcttggcactcatgttcta

SEQ ID NO: 39202 - DNA, 36 bp, Artificial Sequence
  Synthetic oligonucleotide
tagccggaactacgcgtaaaggcggaggggaatgta

SEQ ID NO: 39203 - DNA, 34 bp, Artificial Sequence
  Synthetic oligonucleotide
ggtcatcccccgccaatgtctctgtcaccttcac

SEQ ID NO: 39204 - DNA, 35 bp, Artificial Sequence
  Synthetic oligonucleotide
gccctccctggggctacccgtacactcatgacgac

SEQ ID NO: 39205 - DNA, 35 bp, Artificial Sequence
  Synthetic oligonucleotide
gcccctgcacggatcttactttaccagttggcacc

SEQ ID NO: 39206 - DNA, 35 bp, Artificial Sequence
  Synthetic oligonucleotide
accaccttatcctgagttgtctttaaacaacgacc

SEQ ID NO: 39207 - DNA, 35 bp, Artificial Sequence
  Synthetic oligonucleotide
tttgaggtagcctcactccaccatatgatctggtc

SEQ ID NO: 39208 - DNA, 35 bp, Artificial Sequence
  Synthetic oligonucleotide
tcagcactgagttgcactccccctgcgttactttc

SEQ ID NO: 39209 - DNA, 35 bp, Artificial Sequence
  Synthetic oligonucleotide
gacaatacatgccatcacatccactctggaatctg

SEQ ID NO: 39210 - DNA, 35 bp, Artificial Sequence
  Synthetic oligonucleotide
gacactcctcccccgtatcatacattgctccacat

SEQ ID NO: 39211 - DNA, 35 bp, Artificial Sequence
  Synthetic oligonucleotide
gacaactcgcggagcttccctgaaacatttcccct

SEQ ID NO: 39212 - DNA, 35 bp, Artificial Sequence
  Synthetic oligonucleotide
acagaatcgatcacgtcctcgcacccatacttgct

SEQ ID NO: 39213 - DNA, 35 bp, Artificial Sequence
  Synthetic oligonucleotide
agtaacgctcaccagcgatcccccacggaccatct

SEQ ID NO: 39214 - DNA, 35 bp, Artificial Sequence
  Synthetic oligonucleotide
tccgcctccctcttggctacttgggctctaataaa

SEQ ID NO: 39215 - DNA, 36 bp, Artificial Sequence
  Synthetic oligonucleotide
tcatcgcctatcttgttagattctctcccgtacgaa

SEQ ID NO: 39216 - DNA, 35 bp, Artificial Sequence
  Synthetic oligonucleotide
acagacctccagaagtaggcacatccccgctcgaa

SEQ ID NO: 39217 - DNA, 36 bp, Artificial Sequence
  Synthetic oligonucleotide
tccaggactctcagtgccctatcatgccacccataa

SEQ ID NO: 39218 - DNA, 36 bp, Artificial Sequence
  Synthetic oligonucleotide
gcatacatccatcctttcgctgagtctctcttcgca

SEQ ID NO: 39219 - DNA, 36 bp, Artificial Sequence
  Synthetic oligonucleotide
gcctcaacgctccaccccaggctttttattagcaga

SEQ ID NO: 39220 - DNA, 37 bp, Artificial Sequence
  Synthetic oligonucleotide
agcctcctcccccttcacttcgatatgcgcctgacga

SEQ ID NO: 39221 - DNA, 37 bp, Artificial Sequence
  Synthetic oligonucleotide
gtccaccactgtggtccatttgataaacctgctacga

SEQ ID NO: 39222 - DNA, 37 bp, Artificial Sequence
  Synthetic oligonucleotide
acggagaggggaggggtagctttgggtgggactcgga

SEQ ID NO: 39223 - DNA, 37 bp, Artificial Sequence
  Synthetic oligonucleotide
tcagccccactccgcgcattaactaggcaatcatgga

SEQ ID NO: 39224 - DNA, 37 bp, Artificial Sequence
  Synthetic oligonucleotide
gcggagggttgggtgaggctttgggaaggaggttgga

SEQ ID NO: 39225 - DNA, 36 bp, Artificial Sequence
  Synthetic oligonucleotide
agagaacgggtggaacatactaagggacgcgactga

SEQ ID NO: 39226 - DNA, 38 bp, Artificial Sequence
  Synthetic oligonucleotide
atctagccgccgcatgttcctgccccttagtatactga

SEQ ID NO: 39227 - DNA, 36 bp, Artificial Sequence
  Synthetic oligonucleotide
gaaaacaagggcaacgggcgggggaaggtgcagtga

SEQ ID NO: 39228 - DNA, 38 bp, Artificial Sequence
  Synthetic oligonucleotide
gttacatccccgccgttgcgctcctacgtgtcccgtga

SEQ ID NO: 39229 - DNA, 35 bp, Artificial Sequence
  Synthetic oligonucleotide
gagccaccccgacacagcgcgccttcagtctgtga

SEQ ID NO: 39230 - DNA, 37 bp, Artificial Sequence
  Synthetic oligonucleotide
tgatgcgaccaacttttatgagcttctgccttcttga

SEQ ID NO: 39231 - DNA, 38 bp, Artificial Sequence
  Synthetic oligonucleotide
acatcgcctgttttcctgccccgcgtactccatgttga

SEQ ID NO: 39232 - DNA, 36 bp, Artificial Sequence
  Synthetic oligonucleotide
atgtatgcccctgctctgtaggattccacgttatta

SEQ ID NO: 39233 - DNA, 36 bp, Artificial Sequence
  Synthetic oligonucleotide
atcgccatgcctacctgtaccctgtgattgtccgac

SEQ ID NO: 39234 - DNA, 35 bp, Artificial Sequence
  Synthetic oligonucleotide
atgtcactgtcatggctaatgcacgctgtacttcc

SEQ ID NO: 39235 - DNA, 35 bp, Artificial Sequence
  Synthetic oligonucleotide
tccctcccgatgatatccgtacggaactcgatctc

SEQ ID NO: 39236 - DNA, 35 bp, Artificial Sequence
  Synthetic oligonucleotide
aagcgagacagagtgggaaaaaggaatggtgaggg

SEQ ID NO: 39237 - DNA, 35 bp, Artificial Sequence
  Synthetic oligonucleotide
atgcgcaccaatcgccccgtcacatcttagcgact

SEQ ID NO: 39238 - DNA, 35 bp, Artificial Sequence
  Synthetic oligonucleotide
gaagcccgtcatgagttttcatctttgcgatccct

SEQ ID NO: 39239 - DNA, 35 bp, Artificial Sequence
  Synthetic oligonucleotide
ggagctctacaccgctactacaacgacctgcctgt

SEQ ID NO: 39240 - DNA, 35 bp, Artificial Sequence
  Synthetic oligonucleotide
tgcaccgccattacctgcttatgttactgcctttt

SEQ ID NO: 39241 - DNA, 36 bp, Artificial Sequence
  Synthetic oligonucleotide
tcatggccgctgatcatccgtctcgccccaatagaa

SEQ ID NO: 39242 - DNA, 36 bp, Artificial Sequence
  Synthetic oligonucleotide
gtgagctcacacggcactcccctcgctcgattacca

SEQ ID NO: 39243 - DNA, 35 bp, Artificial Sequence
  Synthetic oligonucleotide
gatctcgcactcatctcagttcccctgtatcccca

SEQ ID NO: 39244 - DNA, 36 bp, Artificial Sequence
  Synthetic oligonucleotide
tcccagccgtcacttggcgtccatcttgttcattca

SEQ ID NO: 39245 - DNA, 36 bp, Artificial Sequence
  Synthetic oligonucleotide
agtgagccgctggactcgcttgtaactacctattca

SEQ ID NO: 39246 - DNA, 37 bp, Artificial Sequence
  Synthetic oligonucleotide
gcataccccccgcctgcatgcttctattcatgaccga

SEQ ID NO: 39247 - DNA, 36 bp, Artificial Sequence
  Synthetic oligonucleotide
tcccctgtccccgtattgcaaccatggaacacccga

SEQ ID NO: 39248 - DNA, 37 bp, Artificial Sequence
  Synthetic oligonucleotide
tgaccgcgcaactcggtgcttcactctccctatccga

SEQ ID NO: 39249 - DNA, 37 bp, Artificial Sequence
  Synthetic oligonucleotide
gaccaccactttcaatcagagaacagccggaacgcga

SEQ ID NO: 39250 - DNA, 38 bp, Artificial Sequence
  Synthetic oligonucleotide
atgactgcaggcatcggtggattagaagggggagatga

SEQ ID NO: 39251 - DNA, 37 bp, Artificial Sequence
  Synthetic oligonucleotide
gttgactcatcccgcgtgccccttgtcttgaccgtga

SEQ ID NO: 39252 - DNA, 38 bp, Artificial Sequence
  Synthetic oligonucleotide
tccacgcgcggtggaacatcagtgcacaccctccttga

SEQ ID NO: 39253 - DNA, 38 bp, Artificial Sequence
  Synthetic oligonucleotide
attgcctcatcgagcgtcctacttcctccgaatcttga

SEQ ID NO: 39254 - DNA, 35 bp, Artificial Sequence
  Synthetic oligonucleotide
cacttggtcgcatcgctcacattaggccccaaata

SEQ ID NO: 39255 - DNA, 36 bp, Artificial Sequence
  Synthetic oligonucleotide
gcatagcgcctatcagttgaaacgtgcctcccccta

SEQ ID NO: 39256 - DNA, 35 bp, Artificial Sequence
  Synthetic oligonucleotide
gctgacctccatcgtaacgcctcttgttgtaaaac

SEQ ID NO: 39257 - DNA, 35 bp, Artificial Sequence
  Synthetic oligonucleotide
gcacaccatccttgccgtagtacatgaacaatcac

SEQ ID NO: 39258 - DNA, 35 bp, Artificial Sequence
  Synthetic oligonucleotide
tcactgcacagatgagtacgttcgcatcatctcac

SEQ ID NO: 39259 - DNA, 35 bp, Artificial Sequence
  Synthetic oligonucleotide
acactgtggtcctgtgcttctccgctcctttaccc

SEQ ID NO: 39260 - DNA, 35 bp, Artificial Sequence
  Synthetic oligonucleotide
actcaccggtgggtttttatgttcatttcgtttcc

SEQ ID NO: 39261 - DNA, 35 bp, Artificial Sequence
  Synthetic oligonucleotide
tactaacgagcccccgccctccgacggaatgaatc

SEQ ID NO: 39262 - DNA, 35 bp, Artificial Sequence
  Synthetic oligonucleotide
aagcgaccccctcatgatatctggcctcgttcgtc

SEQ ID NO: 39263 - DNA, 35 bp, Artificial Sequence
  Synthetic oligonucleotide
ttcagcctcctgccccacttctttggtattttttc

SEQ ID NO: 39264 - DNA, 35 bp, Artificial Sequence
  Synthetic oligonucleotide
gagctccaccgtgaaaatcacacacatcacacagg

SEQ ID NO: 39265 - DNA, 35 bp, Artificial Sequence
  Synthetic oligonucleotide
ggaagatgaaggtccggaaagagcgggtggtagtg

SEQ ID NO: 39266 - DNA, 35 bp, Artificial Sequence
  Synthetic oligonucleotide
acccaatcccacccgtcatgtcttccatgtgcaat

SEQ ID NO: 39267 - DNA, 35 bp, Artificial Sequence
  Synthetic oligonucleotide
tatgcgtccgctcccaagttccgaagcatcaccat

SEQ ID NO: 39268 - DNA, 35 bp, Artificial Sequence
  Synthetic oligonucleotide
tgccctccccgccccatgtccttacaatgcaccct

SEQ ID NO: 39269 - DNA, 35 bp, Artificial Sequence
  Synthetic oligonucleotide
gtttgctccttcgaaggtcatagtcttccccccct

SEQ ID NO: 39270 - DNA, 35 bp, Artificial Sequence
  Synthetic oligonucleotide
tcacgtgataccgtgctctggtattgtatccctct

SEQ ID NO: 39271 - DNA, 35 bp, Artificial Sequence
  Synthetic oligonucleotide
gatcgctcaactttttatgtctggtcccattaggt

SEQ ID NO: 39272 - DNA, 35 bp, Artificial Sequence
  Synthetic oligonucleotide
gtaccactctcgctatgcttttcatcaagaagctt

SEQ ID NO: 39273 - DNA, 36 bp, Artificial Sequence
  Synthetic oligonucleotide
ttgagggaacacaggggggagcccggacaaagggaa

SEQ ID NO: 39274 - DNA, 36 bp, Artificial Sequence
  Synthetic oligonucleotide
ttctatccgcccactgcccattggagacttaagcca

SEQ ID NO: 39275 - DNA, 36 bp, Artificial Sequence
  Synthetic oligonucleotide
gtgaccgcccaactttcgcgcaagaataatagcgca

SEQ ID NO: 39276 - DNA, 35 bp, Artificial Sequence
  Synthetic oligonucleotide
gtgaacaaagggaagcaagggatcggacttggaga

SEQ ID NO: 39277 - DNA, 37 bp, Artificial Sequence
  Synthetic oligonucleotide
gtctgcttgcaccccgttgtcaccggccccccgacga

SEQ ID NO: 39278 - DNA, 37 bp, Artificial Sequence
  Synthetic oligonucleotide
tccgcacgaaaacggcctgccctcaccaatctccgga

SEQ ID NO: 39279 - DNA, 37 bp, Artificial Sequence
  Synthetic oligonucleotide
gacacgaacggtacagtgggggcgtgaaggaggtgga

SEQ ID NO: 39280 - DNA, 38 bp, Artificial Sequence
  Synthetic oligonucleotide
aagtacatcccccatattttgcagtcactttgcgctga

SEQ ID NO: 39281 - DNA, 38 bp, Artificial Sequence
  Synthetic oligonucleotide
atcctatcgccgctttctcagtcagcatacgtttctga

SEQ ID NO: 39282 - DNA, 38 bp, Artificial Sequence
  Synthetic oligonucleotide
gggaagagcacgacaaacgggaggcgggaaaagggtga

SEQ ID NO: 39283 - DNA, 37 bp, Artificial Sequence
  Synthetic oligonucleotide
actacccctacgcggtttaaccactgccatgacttga

SEQ ID NO: 39284 - DNA, 37 bp, Artificial Sequence
  Synthetic oligonucleotide
tgcgaaagggcgggctactgagaggggcgggggttga

SEQ ID NO: 39285 - DNA, 37 bp, Artificial Sequence
  Synthetic oligonucleotide
gaggggtcaaggtgggatggatgggtgcggggtttga

SEQ ID NO: 39286 - DNA, 38 bp, Artificial Sequence
  Synthetic oligonucleotide
tcaccaactgctgaaactaacgacgtactatcttttga

SEQ ID NO: 39287 - DNA, 35 bp, Artificial Sequence
  Synthetic oligonucleotide
gacgccacccaactataccttccctggtaaggcac

SEQ ID NO: 39288 - DNA, 35 bp, Artificial Sequence
  Synthetic oligonucleotide
acaacattcgcagccctacttcgattgcctccacc

SEQ ID NO: 39289 - DNA, 35 bp, Artificial Sequence
  Synthetic oligonucleotide
actgcctgttcccccggtcagttaacatcattccc

SEQ ID NO: 39290 - DNA, 35 bp, Artificial Sequence
  Synthetic oligonucleotide
tgccaacccgctctcctgattcctttgatgcgttc

SEQ ID NO: 39291 - DNA, 35 bp, Artificial Sequence
  Synthetic oligonucleotide
agataccggcaccatattcacaccgcctattgttc

SEQ ID NO: 39292 - DNA, 34 bp, Artificial Sequence
  Synthetic oligonucleotide
gccaacatccgcctattctacgcttattgtgtag

SEQ ID NO: 39293 - DNA, 35 bp, Artificial Sequence
  Synthetic oligonucleotide
tgtcctacccgcaaattacccgtctaccccaacgg

SEQ ID NO: 39294 - DNA, 35 bp, Artificial Sequence
  Synthetic oligonucleotide
ggacaaggggggatgaacggcaccaggtggagggg

SEQ ID NO: 39295 - DNA, 35 bp, Artificial Sequence
  Synthetic oligonucleotide
gctcaccacaattacgaccatgtgctaccattatg

SEQ ID NO: 39296 - DNA, 35 bp, Artificial Sequence
  Synthetic oligonucleotide
gatttcagcccaggtcgccttcacctgctccactg

SEQ ID NO: 39297 - DNA, 35 bp, Artificial Sequence
  Synthetic oligonucleotide
gaaacatgatggtcacatacaccgccgctccctct

SEQ ID NO: 39298 - DNA, 35 bp, Artificial Sequence
  Synthetic oligonucleotide
accatctcgcgatatgtacaatggcatatcgcctt

SEQ ID NO: 39299 - DNA, 35 bp, Artificial Sequence
  Synthetic oligonucleotide
gggacctatgcctcgcttggattcgcacacctttt

SEQ ID NO: 39300 - DNA, 35 bp, Artificial Sequence
  Synthetic oligonucleotide
accgtaagcagagcccacggttatggtactttttt

SEQ ID NO: 39301 - DNA, 36 bp, Artificial Sequence
  Synthetic oligonucleotide
gcaacccggtgtcgccttccttcagttcaatggaaa

SEQ ID NO: 39302 - DNA, 36 bp, Artificial Sequence
  Synthetic oligonucleotide
tctggggccattgacggacaccgacaccacttgaaa

SEQ ID NO: 39303 - DNA, 36 bp, Artificial Sequence
  Synthetic oligonucleotide
tagaactcaccgccgattcacgcatttccgaccgaa

SEQ ID NO: 39304 - DNA, 36 bp, Artificial Sequence
  Synthetic oligonucleotide
tcccctgcctccccatttagatacacgctgttataa

SEQ ID NO: 39305 - DNA, 36 bp, Artificial Sequence
  Synthetic oligonucleotide
acgacccgccatccgtttcgacacactgtccaccca

SEQ ID NO: 39306 - DNA, 35 bp, Artificial Sequence
  Synthetic oligonucleotide
aacgctccactacgccacatctattgtccagcaga

SEQ ID NO: 39307 - DNA, 36 bp, Artificial Sequence
  Synthetic oligonucleotide
gtcatatcggcagtgctcgcatagccttcccaccga

SEQ ID NO: 39308 - DNA, 37 bp, Artificial Sequence
  Synthetic oligonucleotide
tccgtgctgcaagcttattccccgttccgtatgccga

SEQ ID NO: 39309 - DNA, 37 bp, Artificial Sequence
  Synthetic oligonucleotide
taccttgcaggctggtttttgctcctttcacagtgga

SEQ ID NO: 39310 - DNA, 37 bp, Artificial Sequence
  Synthetic oligonucleotide
gatggaacgaaggaggagtggacggtcccctggatga

SEQ ID NO: 39311 - DNA, 38 bp, Artificial Sequence
  Synthetic oligonucleotide
ggggcatggctgctttcttcatatcggacctcacctga

SEQ ID NO: 39312 - DNA, 37 bp, Artificial Sequence
  Synthetic oligonucleotide
tccaggagtaggaacgatagggggccaaggaaagtga

SEQ ID NO: 39313 - DNA, 36 bp, Artificial Sequence
  Synthetic oligonucleotide
gtgagaggttaggaaaggcggagggaagtgaggata

SEQ ID NO: 39314 - DNA, 36 bp, Artificial Sequence
  Synthetic oligonucleotide
acaccaaccctaagaacgttaagtcttcgccaccta

SEQ ID NO: 39315 - DNA, 36 bp, Artificial Sequence
  Synthetic oligonucleotide
taagaagggtttgaggggttatggatgggcaaggta

SEQ ID NO: 39316 - DNA, 35 bp, Artificial Sequence
  Synthetic oligonucleotide
gttccccccccatcacacccgaacgctcacgggta

SEQ ID NO: 39317 - DNA, 35 bp, Artificial Sequence
  Synthetic oligonucleotide
taatgccaactgaaccatcaggcatccctgcctac

SEQ ID NO: 39318 - DNA, 35 bp, Artificial Sequence
  Synthetic oligonucleotide
acatcaccgtcgcttttccgccgaggttagcttac

SEQ ID NO: 39319 - DNA, 35 bp, Artificial Sequence
  Synthetic oligonucleotide
tcccttcacgcgccttggtgcccacccccctaccc

SEQ ID NO: 39320 - DNA, 35 bp, Artificial Sequence
  Synthetic oligonucleotide
tagtgctgtcgtgacccgaggcacccatacccccc

SEQ ID NO: 39321 - DNA, 35 bp, Artificial Sequence
  Synthetic oligonucleotide
gacagacctacaactggtttacccgtccatactcc

SEQ ID NO: 39322 - DNA, 35 bp, Artificial Sequence
  Synthetic oligonucleotide
ggtcgccactccgccactgaccacaccgactgagc

SEQ ID NO: 39323 - DNA, 35 bp, Artificial Sequence
  Synthetic oligonucleotide
gggtccaccacactgttggccacctgcctggcatc

SEQ ID NO: 39324 - DNA, 35 bp, Artificial Sequence
  Synthetic oligonucleotide
gccgactgcaagaaggcatgcttgtacttaagctc

SEQ ID NO: 39325 - DNA, 35 bp, Artificial Sequence
  Synthetic oligonucleotide
tgaaactgcgatgtctccccgcgttctttatagtc

SEQ ID NO: 39326 - DNA, 35 bp, Artificial Sequence
  Synthetic oligonucleotide
aatgcgctaatgcttcgcgtcccgcccactttgtc

SEQ ID NO: 39327 - DNA, 35 bp, Artificial Sequence
  Synthetic oligonucleotide
gtgcatggttctatcatcggcctgtatccttcacg

SEQ ID NO: 39328 - DNA, 35 bp, Artificial Sequence
  Synthetic oligonucleotide
tacgtgcaccccaagtaccatcactggctctcgat

SEQ ID NO: 39329 - DNA, 35 bp, Artificial Sequence
  Synthetic oligonucleotide
agacgggtctcgtagttgtctcggctgttcctcct

SEQ ID NO: 39330 - DNA, 35 bp, Artificial Sequence
  Synthetic oligonucleotide
tcatgcacgacgcccactccatcgagcgcccctct

SEQ ID NO: 39331 - DNA, 35 bp, Artificial Sequence
  Synthetic oligonucleotide
gtttcgggcggtatcaaccctgccatcatttcatt

SEQ ID NO: 39332 - DNA, 35 bp, Artificial Sequence
  Synthetic oligonucleotide
gtcgaagcacccgccggaccgaatttttacgccaa

SEQ ID NO: 39333 - DNA, 35 bp, Artificial Sequence
  Synthetic oligonucleotide
gtccatacctgccgatcgctcacatttgcacttaa

SEQ ID NO: 39334 - DNA, 36 bp, Artificial Sequence
  Synthetic oligonucleotide
ttgccctcgtacgaatcactcagtgcgccgccccca

SEQ ID NO: 39335 - DNA, 35 bp, Artificial Sequence
  Synthetic oligonucleotide
gacgaagaggctcccagcgcacccaatcctgccca

SEQ ID NO: 39336 - DNA, 36 bp, Artificial Sequence
  Synthetic oligonucleotide
accgactccacggtggttctcttatatcttctgcca

SEQ ID NO: 39337 - DNA, 36 bp, Artificial Sequence
  Synthetic oligonucleotide
atcgccgcagtgtatatcctctcgaaccatatcgca

SEQ ID NO: 39338 - DNA, 36 bp, Artificial Sequence
  Synthetic oligonucleotide
tgaggtgaggggtggataacggtggggcgaaccaga

SEQ ID NO: 39339 - DNA, 35 bp, Artificial Sequence
  Synthetic oligonucleotide
gagtgggggggatggagcattttgcgaagaataga

SEQ ID NO: 39340 - DNA, 37 bp, Artificial Sequence
  Synthetic oligonucleotide
tgagaaggcgggagggactggtggaacgctggagcga

SEQ ID NO: 39341 - DNA, 36 bp, Artificial Sequence
  Synthetic oligonucleotide
tcacccctccattcacattgccgtagaggcgatcga

SEQ ID NO: 39342 - DNA, 36 bp, Artificial Sequence
  Synthetic oligonucleotide
atcccaccacctccggagacctatctcacccctgga

SEQ ID NO: 39343 - DNA, 37 bp, Artificial Sequence
  Synthetic oligonucleotide
atgcgtcactcatcatccctttccgccactgcactga

SEQ ID NO: 39344 - DNA, 38 bp, Artificial Sequence
  Synthetic oligonucleotide
ttctccaccggatgtggttagcccttctcgttccctga

SEQ ID NO: 39345 - DNA, 38 bp, Artificial Sequence
  Synthetic oligonucleotide
gagttggagggtgagctggaggggaagtgagtggctga

SEQ ID NO: 39346 - DNA, 38 bp, Artificial Sequence
  Synthetic oligonucleotide
taacacacccgcaggctcgccacctctcatttacgtga

SEQ ID NO: 39347 - DNA, 38 bp, Artificial Sequence
  Synthetic oligonucleotide
gcacgcaacgccgttgcctatagttcgacctccggtga

SEQ ID NO: 39348 - DNA, 37 bp, Artificial Sequence
  Synthetic oligonucleotide
attgtccgccactcgctcgttctttaaccttcattga

SEQ ID NO: 39349 - DNA, 38 bp, Artificial Sequence
  Synthetic oligonucleotide
aaagtgctgccactgggtgggaatgggtagggtattga

SEQ ID NO: 39350 - DNA, 38 bp, Artificial Sequence
  Synthetic oligonucleotide
atcccacacgttcgctccatctgcgtgatcctcgttga

SEQ ID NO: 39351 - DNA, 36 bp, Artificial Sequence
  Synthetic oligonucleotide
gatggccacgacgggttgcctctttcgtgtcttcta

SEQ ID NO: 39352 - DNA, 35 bp, Artificial Sequence
  Synthetic oligonucleotide
gagggagaaactaaacagggaggcgagagggaaac

SEQ ID NO: 39353 - DNA, 35 bp, Artificial Sequence
  Synthetic oligonucleotide
tacacgggtccgccgtacataaaatcaatgttgcc

SEQ ID NO: 39354 - DNA, 36 bp, Artificial Sequence
  Synthetic oligonucleotide
tcccaagaggctcctgcactttgactttgcacttcc

SEQ ID NO: 39355 - DNA, 35 bp, Artificial Sequence
  Synthetic oligonucleotide
gccattccccaacctgtcgacgtttcttgtcgggc

SEQ ID NO: 39356 - DNA, 35 bp, Artificial Sequence
  Synthetic oligonucleotide
atccctgtcaaagtttaattcctgcatttgccctg

SEQ ID NO: 39357 - DNA, 35 bp, Artificial Sequence
  Synthetic oligonucleotide
atcgacgaagaggaatcaggaatggggggatcgtg

SEQ ID NO: 39358 - DNA, 35 bp, Artificial Sequence
  Synthetic oligonucleotide
gttgtcccgtcgctcacttccatgcattatacaat

SEQ ID NO: 39359 - DNA, 35 bp, Artificial Sequence
  Synthetic oligonucleotide
tcaggtcgaatcccgtgcgccttcatcgaatccct

SEQ ID NO: 39360 - DNA, 35 bp, Artificial Sequence
  Synthetic oligonucleotide
tcagcaccccacagactactctcctcttcgggtct

SEQ ID NO: 39361 - DNA, 36 bp, Artificial Sequence
  Synthetic oligonucleotide
gtgtgagcacgcagcatctccccaccacgatttaaa

SEQ ID NO: 39362 - DNA, 36 bp, Artificial Sequence
  Synthetic oligonucleotide
tgcgcccctcatgccgtcccgctccgggccacctaa

SEQ ID NO: 39363 - DNA, 36 bp, Artificial Sequence
  Synthetic oligonucleotide
gaggagaagggattggatatcggtcgagggtgggca

SEQ ID NO: 39364 - DNA, 36 bp, Artificial Sequence
  Synthetic oligonucleotide
gcaccacccttcaattgggggatattgccctgttca

SEQ ID NO: 39365 - DNA, 37 bp, Artificial Sequence
  Synthetic oligonucleotide
gccgccctattatttgccactcctcgtacctggacga

SEQ ID NO: 39366 - DNA, 37 bp, Artificial Sequence
  Synthetic oligonucleotide
tcaagggggggggaggtagagtagtgtgagcgtccga

SEQ ID NO: 39367 - DNA, 37 bp, Artificial Sequence
  Synthetic oligonucleotide
atttggccaggagagggaggtagaatttggtgggcga

SEQ ID NO: 39368 - DNA, 37 bp, Artificial Sequence
  Synthetic oligonucleotide
gacagggcatactgcatgattcaaccctcccctagga

SEQ ID NO: 39369 - DNA, 37 bp, Artificial Sequence
  Synthetic oligonucleotide
gcgcaagcacgtggaacacgcaattaattcttctgga

SEQ ID NO: 39370 - DNA, 37 bp, Artificial Sequence
  Synthetic oligonucleotide
gttgaggcaaaactgtgtgggggtggggcatcgtgga

SEQ ID NO: 39371 - DNA, 36 bp, Artificial Sequence
  Synthetic oligonucleotide
tcacgttccgcataaccgtcatattccttctgctga

SEQ ID NO: 39372 - DNA, 38 bp, Artificial Sequence
  Synthetic oligonucleotide
tatgcggtccaggtaattggagcggagggggacagtga

SEQ ID NO: 39373 - DNA, 38 bp, Artificial Sequence
  Synthetic oligonucleotide
tgtcgccccattgtcagtactccgctcgaacccattga

SEQ ID NO: 39374 - DNA, 35 bp, Artificial Sequence
  Synthetic oligonucleotide
aaccacctaaagcgcaacttgcccccgaccgtata

SEQ ID NO: 39375 - DNA, 36 bp, Artificial Sequence
  Synthetic oligonucleotide
aacgtaactgcactgacccctgtaacaccttctcta

SEQ ID NO: 39376 - DNA, 35 bp, Artificial Sequence
  Synthetic oligonucleotide
gaccctcacgccgttctggcagtcacctccaatta

SEQ ID NO: 39377 - DNA, 36 bp, Artificial Sequence
  Synthetic oligonucleotide
ttcagtacacgcctcggagctttcacaaccgactta

SEQ ID NO: 39378 - DNA, 36 bp, Artificial Sequence
  Synthetic oligonucleotide
gtccgggaaatgggtgggcgtagggcaatcatgtta

SEQ ID NO: 39379 - DNA, 35 bp, Artificial Sequence
  Synthetic oligonucleotide
gcccacgaaaacgccgaaccccccgccgcaccgac

SEQ ID NO: 39380 - DNA, 34 bp, Artificial Sequence
  Synthetic oligonucleotide
actcgtacctgtcacctcgtgcactcagacaacc

SEQ ID NO: 39381 - DNA, 35 bp, Artificial Sequence
  Synthetic oligonucleotide
gcatatcatagcgagtcacaagcgaccccagcccc

SEQ ID NO: 39382 - DNA, 35 bp, Artificial Sequence
  Synthetic oligonucleotide
ttgagccattgcggcgggtctccatccttcgcccc

SEQ ID NO: 39383 - DNA, 35 bp, Artificial Sequence
  Synthetic oligonucleotide
gtacccgggctcgcaaggccgagcttgacccctcc

SEQ ID NO: 39384 - DNA, 35 bp, Artificial Sequence
  Synthetic oligonucleotide
tcgaccgaaccttatgtctgcgatgcttttgccgc

SEQ ID NO: 39385 - DNA, 35 bp, Artificial Sequence
  Synthetic oligonucleotide
tcagatcgacattctgcacgccgaaatcactactc

SEQ ID NO: 39386 - DNA, 35 bp, Artificial Sequence
  Synthetic oligonucleotide
tacctcgcagccgaccttagtttctcgctcggttc

SEQ ID NO: 39387 - DNA, 35 bp, Artificial Sequence
  Synthetic oligonucleotide
actactgacacccggtatggtaccccaagcatacg

SEQ ID NO: 39388 - DNA, 35 bp, Artificial Sequence
  Synthetic oligonucleotide
ggaacgggggtgcgaagagagggaagaacgggggg

SEQ ID NO: 39389 - DNA, 35 bp, Artificial Sequence
  Synthetic oligonucleotide
gcacagttcacggtacgacccgtcaccacaccttg

SEQ ID NO: 39390 - DNA, 36 bp, Artificial Sequence
  Synthetic oligonucleotide
gtagccagactctatcactcgttttccctgtgcgaa

SEQ ID NO: 39391 - DNA, 36 bp, Artificial Sequence
  Synthetic oligonucleotide
ttccatggctatggcacgacacacaccacacttgaa

SEQ ID NO: 39392 - DNA, 36 bp, Artificial Sequence
  Synthetic oligonucleotide
tgaatccgcggacaagtcgaggagggggggggataa

SEQ ID NO: 39393 - DNA, 35 bp, Artificial Sequence
  Synthetic oligonucleotide
atcgtcaacgctgcgtttttcgatcctttccctaa

SEQ ID NO: 39394 - DNA, 36 bp, Artificial Sequence
  Synthetic oligonucleotide
tgatatagcgcaatgcctattccattccctcacaca

SEQ ID NO: 39395 - DNA, 35 bp, Artificial Sequence
  Synthetic oligonucleotide
tgtcccaccttgtgccttccttggatggttcatca

SEQ ID NO: 39396 - DNA, 37 bp, Artificial Sequence
  Synthetic oligonucleotide
tacacggtctcatgaattggccatttactacctacga

SEQ ID NO: 39397 - DNA, 37 bp, Artificial Sequence
  Synthetic oligonucleotide
tcacagccgacgctgaacatgccaccttagctgccga

SEQ ID NO: 39398 - DNA, 37 bp, Artificial Sequence
  Synthetic oligonucleotide
tgccacaaccctaggttattctgcacttgtactccga

SEQ ID NO: 39399 - DNA, 37 bp, Artificial Sequence
  Synthetic oligonucleotide
gtacccgtcctccatcttggcgtttcgaacttgtcga

SEQ ID NO: 39400 - DNA, 37 bp, Artificial Sequence
  Synthetic oligonucleotide
tcccctttcaccacatgtcgattttcccgtcccagga

SEQ ID NO: 39401 - DNA, 37 bp, Artificial Sequence
  Synthetic oligonucleotide
tagtaaggggacggaagtggaatatgccggtaaggga

SEQ ID NO: 39402 - DNA, 36 bp, Artificial Sequence
  Synthetic oligonucleotide
cctccgccaccctgaactcagcagcaacgcccctga

SEQ ID NO: 39403 - DNA, 35 bp, Artificial Sequence
  Synthetic oligonucleotide
tgaggacaacggccctgttcaccattccagcctga

SEQ ID NO: 39404 - DNA, 37 bp, Artificial Sequence
  Synthetic oligonucleotide
acactccgccgacgccgcctacttatgcaattcctga

SEQ ID NO: 39405 - DNA, 36 bp, Artificial Sequence
  Synthetic oligonucleotide
ttgccccagcccccttggatatttactgcaaaccta

SEQ ID NO: 39406 - DNA, 36 bp, Artificial Sequence
  Synthetic oligonucleotide
attgtacacctctagttgcccgggccctgcacatta

SEQ ID NO: 39407 - DNA, 35 bp, Artificial Sequence
  Synthetic oligonucleotide
actgtgagcgcaaacggctcattacctttctcgac

SEQ ID NO: 39408 - DNA, 35 bp, Artificial Sequence
  Synthetic oligonucleotide
ttggtccaccccgcctatgtgccgttgccgctgac

SEQ ID NO: 39409 - DNA, 35 bp, Artificial Sequence
  Synthetic oligonucleotide
gattccccgcccgtgcaagtaaccgtacatctccc

SEQ ID NO: 39410 - DNA, 35 bp, Artificial Sequence
  Synthetic oligonucleotide
gaccgcggaacatgaatatttaccatgtccctgcc

SEQ ID NO: 39411 - DNA, 35 bp, Artificial Sequence
  Synthetic oligonucleotide
tcagccctcgatagtacaaacccagctccggtgcc

SEQ ID NO: 39412 - DNA, 35 bp, Artificial Sequence
  Synthetic oligonucleotide
attgctcatccgcactcttcacacccttagaccgc

SEQ ID NO: 39413 - DNA, 35 bp, Artificial Sequence
  Synthetic oligonucleotide
tgcaaaccctgctccccacgcccataacttacggc

SEQ ID NO: 39414 - DNA, 35 bp, Artificial Sequence
  Synthetic oligonucleotide
gacctgaacggattcgattcataccgatgccatgc

SEQ ID NO: 39415 - DNA, 35 bp, Artificial Sequence
  Synthetic oligonucleotide
gccacacgccagtatcctccattcgcgcgtttgtc

SEQ ID NO: 39416 - DNA, 35 bp, Artificial Sequence
  Synthetic oligonucleotide
tacacccgagacgaacgtgattttaccgtccattc

SEQ ID NO: 39417 - DNA, 35 bp, Artificial Sequence
  Synthetic oligonucleotide
aagtggggggggggctgatagaggatatttaatag

SEQ ID NO: 39418 - DNA, 35 bp, Artificial Sequence
  Synthetic oligonucleotide
tcgatcccgcgcctttgccccacgactggaactcg

SEQ ID NO: 39419 - DNA, 35 bp, Artificial Sequence
  Synthetic oligonucleotide
gccttaccgctgaggtctgctctcttctcgcttgg

SEQ ID NO: 39420 - DNA, 35 bp, Artificial Sequence
  Synthetic oligonucleotide
tttgacctgaccccacaatccatggcgaagctatg

SEQ ID NO: 39421 - DNA, 35 bp, Artificial Sequence
  Synthetic oligonucleotide
aagagcacgtgtcctgctcctccatcaccgtagat

SEQ ID NO: 39422 - DNA, 35 bp, Artificial Sequence
  Synthetic oligonucleotide
gtaaacgtacgggactggcattcctctacttacct

SEQ ID NO: 39423 - DNA, 35 bp, Artificial Sequence
  Synthetic oligonucleotide
gaccacgtcgcatgggattaaatgggaggggggct

SEQ ID NO: 39424 - DNA, 35 bp, Artificial Sequence
  Synthetic oligonucleotide
tcacacccccgtttatggtttgttcacttttctct

SEQ ID NO: 39425 - DNA, 35 bp, Artificial Sequence
  Synthetic oligonucleotide
aagacgataggtgggaagccgtcgaaggagagggt

SEQ ID NO: 39426 - DNA, 35 bp, Artificial Sequence
  Synthetic oligonucleotide
acactcaaacgcagacatcattagatccaccttgt

SEQ ID NO: 39427 - DNA, 36 bp, Artificial Sequence
  Synthetic oligonucleotide
tccattgtccgctatgtgtctgaacattctttttaa

SEQ ID NO: 39428 - DNA, 36 bp, Artificial Sequence
  Synthetic oligonucleotide
taccatcctcccacatgagctatagcgcaaaaagca

SEQ ID NO: 39429 - DNA, 36 bp, Artificial Sequence
  Synthetic oligonucleotide
ggagaggatcacacaggaggggcgaatggtggagca

SEQ ID NO: 39430 - DNA, 35 bp, Artificial Sequence
  Synthetic oligonucleotide
agacaccgtcctgcactcacttgtaacacccggca

SEQ ID NO: 39431 - DNA, 37 bp, Artificial Sequence
  Synthetic oligonucleotide
gatggggaggggaaggcgcaatacgacaccaggggga

SEQ ID NO: 39432 - DNA, 37 bp, Artificial Sequence
  Synthetic oligonucleotide
aagaaagggcggggaggggtaacactcccgttgggga

SEQ ID NO: 39433 - DNA, 37 bp, Artificial Sequence
  Synthetic oligonucleotide
acccgcgggcgtggaggccgggggtggaagtgtggga

SEQ ID NO: 39434 - DNA, 38 bp, Artificial Sequence
  Synthetic oligonucleotide
tcaacagcctttgcaccacgtatctgcttatacaatga

SEQ ID NO: 39435 - DNA, 38 bp, Artificial Sequence
  Synthetic oligonucleotide
tccaggagggataagggtagggggggaaagatgtatga

SEQ ID NO: 39436 - DNA, 38 bp, Artificial Sequence
  Synthetic oligonucleotide
aacccgctcccggagttttaccttcgctccctcactga

SEQ ID NO: 39437 - DNA, 38 bp, Artificial Sequence
  Synthetic oligonucleotide
tgaccgccccggagtaatcgttcttccccgtgccctga

SEQ ID NO: 39438 - DNA, 38 bp, Artificial Sequence
  Synthetic oligonucleotide
acacccctggtcccccgtttgctttattcactaagtga

SEQ ID NO: 39439 - DNA, 37 bp, Artificial Sequence
  Synthetic oligonucleotide
gtcccacctgtcgtactgcttttttgacacttggtga

SEQ ID NO: 39440 - DNA, 35 bp, Artificial Sequence
  Synthetic oligonucleotide
ttacgcccctacgcctgttgacatgaccttattga

SEQ ID NO: 39441 - DNA, 35 bp, Artificial Sequence
  Synthetic oligonucleotide
gtgacgtccgtcactttaacaccctggattaaccc

SEQ ID NO: 39442 - DNA, 35 bp, Artificial Sequence
  Synthetic oligonucleotide
atggccccgaacgctgtttacgtaaaacatccccc

SEQ ID NO: 39443 - DNA, 35 bp, Artificial Sequence
  Synthetic oligonucleotide
tgaggatgtcggagcaaatcggggacggaggtgcg

SEQ ID NO: 39444 - DNA, 35 bp, Artificial Sequence
  Synthetic oligonucleotide
gtcacgcaattaaaacaccaccactgtagctactg

SEQ ID NO: 39445 - DNA, 35 bp, Artificial Sequence
  Synthetic oligonucleotide
gttcacctccgcttataaatgcacgaatggcctat

SEQ ID NO: 39446 - DNA, 35 bp, Artificial Sequence
  Synthetic oligonucleotide
gtggacccgcactatattcgttaaaggcctcccct

SEQ ID NO: 39447 - DNA, 35 bp, Artificial Sequence
  Synthetic oligonucleotide
tcccatcctacaatctgattccgccctaaggcgct

SEQ ID NO: 39448 - DNA, 35 bp, Artificial Sequence
  Synthetic oligonucleotide
ttgccacgacaccaccgcccgcttccaagtacagt

SEQ ID NO: 39449 - DNA, 35 bp, Artificial Sequence
  Synthetic oligonucleotide
ggtcggataccttatctgtgccgtgcatatacatt

SEQ ID NO: 39450 - DNA, 35 bp, Artificial Sequence
  Synthetic oligonucleotide
gaacagtccagcagacgcgccttccatcgttattt

SEQ ID NO: 39451 - DNA, 36 bp, Artificial Sequence
  Synthetic oligonucleotide
acacgactaacagtcgcttcaggatccccgccttaa

SEQ ID NO: 39452 - DNA, 35 bp, Artificial Sequence
  Synthetic oligonucleotide
gaccaaactgccatgttatgcatatcgattgcaca

SEQ ID NO: 39453 - DNA, 36 bp, Artificial Sequence
  Synthetic oligonucleotide
gtcctcccagaattgaaccccgtcgcgctttagcca

SEQ ID NO: 39454 - DNA, 36 bp, Artificial Sequence
  Synthetic oligonucleotide
tcatccgtcgggcctccacagtccgtagtctgtcca

SEQ ID NO: 39455 - DNA, 36 bp, Artificial Sequence
  Synthetic oligonucleotide
acacacgtctcctcacgctcctcgcaccaagtgtca

SEQ ID NO: 39456 - DNA, 36 bp, Artificial Sequence
  Synthetic oligonucleotide
acctctatcgcctgcatttaggaccaaccctccaga

SEQ ID NO: 39457 - DNA, 37 bp, Artificial Sequence
  Synthetic oligonucleotide
accacccgtcccagtaatgtgtcaacgcgcctccaga

SEQ ID NO: 39458 - DNA, 37 bp, Artificial Sequence
  Synthetic oligonucleotide
gccaactgtgcattgacctatattgcctaacctgaga

SEQ ID NO: 39459 - DNA, 37 bp, Artificial Sequence
  Synthetic oligonucleotide
aaacacgggtgaggagggagggagggtaaacccccga

SEQ ID NO: 39460 - DNA, 37 bp, Artificial Sequence
  Synthetic oligonucleotide
aagagggagtggcatgggtgagattaagcggggggga

SEQ ID NO: 39461 - DNA, 37 bp, Artificial Sequence
  Synthetic oligonucleotide
tgtcccatccaccgttttaattatgaagttacttgga

SEQ ID NO: 39462 - DNA, 37 bp, Artificial Sequence
  Synthetic oligonucleotide
gggtggggaagtggtggtgggtgcgtaactgggatga

SEQ ID NO: 39463 - DNA, 38 bp, Artificial Sequence
  Synthetic oligonucleotide
gaacatcgcctcgaacttttgatattgtaccatactga

SEQ ID NO: 39464 - DNA, 38 bp, Artificial Sequence
  Synthetic oligonucleotide
agtaccaccaatcgttaaagtttgcccacacattctga

SEQ ID NO: 39465 - DNA, 37 bp, Artificial Sequence
  Synthetic oligonucleotide
gcctgaacttccgttgtattccaccccatcttcgtga

SEQ ID NO: 39466 - DNA, 38 bp, Artificial Sequence
  Synthetic oligonucleotide
gatgaaaagaagtggggagttgggacaggctagggtga

SEQ ID NO: 39467 - DNA, 38 bp, Artificial Sequence
  Synthetic oligonucleotide
gcactcaacgtcaaggagggcaactggagggtgggtga

SEQ ID NO: 39468 - DNA, 38 bp, Artificial Sequence
  Synthetic oligonucleotide
gacggggaaggagagaaaagaataactcgaggcattga

SEQ ID NO: 39469 - DNA, 37 bp, Artificial Sequence
  Synthetic oligonucleotide
gctatccgacgcatcggattttctacctttcttttga

SEQ ID NO: 39470 - DNA, 36 bp, Artificial Sequence
  Synthetic oligonucleotide
gaatagccaatggagtgcacgggggggatctggata

SEQ ID NO: 39471 - DNA, 36 bp, Artificial Sequence
  Synthetic oligonucleotide
ttatccctcccgctagaccgtcttgacacggctata

SEQ ID NO: 39472 - DNA, 36 bp, Artificial Sequence
  Synthetic oligonucleotide
agagaggacagtgggtgggctcgtttgtcatgggta

SEQ ID NO: 39473 - DNA, 35 bp, Artificial Sequence
  Synthetic oligonucleotide
gatccaccactaccagcccgggcgcagtcgcacac

SEQ ID NO: 39474 - DNA, 35 bp, Artificial Sequence
  Synthetic oligonucleotide
aagatcccgacgcgtactttgattcccggcccacc

SEQ ID NO: 39475 - DNA, 35 bp, Artificial Sequence
  Synthetic oligonucleotide
tacacaaccccctggcgtgactacagggcaagacc

SEQ ID NO: 39476 - DNA, 35 bp, Artificial Sequence
  Synthetic oligonucleotide
ggaggtcgccacgagtgcgtgcctcatgttctccc

SEQ ID NO: 39477 - DNA, 35 bp, Artificial Sequence
  Synthetic oligonucleotide
acatttgcgcggtgtaccctctttatcccttgtcg

SEQ ID NO: 39478 - DNA, 35 bp, Artificial Sequence
  Synthetic oligonucleotide
tctagtacccggccgcagcatcccatttttcttat

SEQ ID NO: 39479 - DNA, 35 bp, Artificial Sequence
  Synthetic oligonucleotide
gtgacaggatccttcccttgtgatcgactacccct

SEQ ID NO: 39480 - DNA, 35 bp, Artificial Sequence
  Synthetic oligonucleotide
tgaccatccagcccgccccttacacgtgaactgct

SEQ ID NO: 39481 - DNA, 35 bp, Artificial Sequence
  Synthetic oligonucleotide
tcacccagaaggagttacgcccggcgcctgcctct

SEQ ID NO: 39482 - DNA, 35 bp, Artificial Sequence
  Synthetic oligonucleotide
gaccacctacgtaccaccagcttggattctggtct

SEQ ID NO: 39483 - DNA, 35 bp, Artificial Sequence
  Synthetic oligonucleotide
tgtgcctcctccgacgacatactgtcagccaccgt

SEQ ID NO: 39484 - DNA, 35 bp, Artificial Sequence
  Synthetic oligonucleotide
acgccgcaccctcagcgagctccgcctctgctcaa

SEQ ID NO: 39485 - DNA, 36 bp, Artificial Sequence
  Synthetic oligonucleotide
gcacgccaagaactacgtcctctttgcctttgctaa

SEQ ID NO: 39486 - DNA, 36 bp, Artificial Sequence
  Synthetic oligonucleotide
tcagtccccagaccgggatactccttaacattgcca

SEQ ID NO: 39487 - DNA, 36 bp, Artificial Sequence
  Synthetic oligonucleotide
gtctgcctgaatagtctatccaacatgtcacctcca

SEQ ID NO: 39488 - DNA, 36 bp, Artificial Sequence
  Synthetic oligonucleotide
gatgtgggtgggcgggtggctggggtgtttgggcga

SEQ ID NO: 39489 - DNA, 37 bp, Artificial Sequence
  Synthetic oligonucleotide
tcccaaccccccccaatctcgtgaacccgcacacgga

SEQ ID NO: 39490 - DNA, 38 bp, Artificial Sequence
  Synthetic oligonucleotide
gagagcgtgggtaaagttggggggagaggctgagatga

SEQ ID NO: 39491 - DNA, 37 bp, Artificial Sequence
  Synthetic oligonucleotide
gagaggggggtatgtgggtgtgctacaaagctgatga

SEQ ID NO: 39492 - DNA, 38 bp, Artificial Sequence
  Synthetic oligonucleotide
tgatctgcggggcctgggtggggggagtagtgggctga

SEQ ID NO: 39493 - DNA, 37 bp, Artificial Sequence
  Synthetic oligonucleotide
tacgcccatcgactctctgttgccgtttagtccttga

SEQ ID NO: 39494 - DNA, 36 bp, Artificial Sequence
  Synthetic oligonucleotide
agtgagcacactattgacctgcacccaagcctccta

SEQ ID NO: 39495 - DNA, 35 bp, Artificial Sequence
  Synthetic oligonucleotide
gatggaggggtgggataggctggaagacttgtgta

SEQ ID NO: 39496 - DNA, 36 bp, Artificial Sequence
  Synthetic oligonucleotide
accaagggccacctcttgggttatgttttcgcctta

SEQ ID NO: 39497 - DNA, 35 bp, Artificial Sequence
  Synthetic oligonucleotide
gcctgcatgatacgcacgtcgctgacctcccgcac

SEQ ID NO: 39498 - DNA, 35 bp, Artificial Sequence
  Synthetic oligonucleotide
atccacagttactagtggttaccgcacctccaacc

SEQ ID NO: 39499 - DNA, 35 bp, Artificial Sequence
  Synthetic oligonucleotide
gtcatcagacatcttggtttctcgcttggtattcc

SEQ ID NO: 39500 - DNA, 35 bp, Artificial Sequence
  Synthetic oligonucleotide
atacgcctgtgtcgaacgctataccactgttttcc

SEQ ID NO: 39501 - DNA, 35 bp, Artificial Sequence
  Synthetic oligonucleotide
actaaccgttcccattgccttctgcgatctactgc

SEQ ID NO: 39502 - DNA, 35 bp, Artificial Sequence
  Synthetic oligonucleotide
gccccggacaaccgggcctattatcattcttctgc

SEQ ID NO: 39503 - DNA, 35 bp, Artificial Sequence
  Synthetic oligonucleotide
tcccatccgtgaggggcatctcacgaacccggttc

SEQ ID NO: 39504 - DNA, 35 bp, Artificial Sequence
  Synthetic oligonucleotide
tccccaagtcccaggccccctaagaaatacacgag

SEQ ID NO: 39505 - DNA, 35 bp, Artificial Sequence
  Synthetic oligonucleotide
gcttggggagggaggggaggggctttgcggtgtag

SEQ ID NO: 39506 - DNA, 35 bp, Artificial Sequence
  Synthetic oligonucleotide
accacacaggccctccccattattcgcccgatggg

SEQ ID NO: 39507 - DNA, 35 bp, Artificial Sequence
  Synthetic oligonucleotide
tgatgcccctgcccgctcttgcaacgcgcatttat

SEQ ID NO: 39508 - DNA, 35 bp, Artificial Sequence
  Synthetic oligonucleotide
ttgtgctcaggcttgacttgccccatgcctcacct

SEQ ID NO: 39509 - DNA, 35 bp, Artificial Sequence
  Synthetic oligonucleotide
tgccctcccggtcccctcccagatatagtcgcgct

SEQ ID NO: 39510 - DNA, 35 bp, Artificial Sequence
  Synthetic oligonucleotide
tttgcccagtcgcccatttcggtctatcgtgacgt

SEQ ID NO: 39511 - DNA, 36 bp, Artificial Sequence
  Synthetic oligonucleotide
gccccgcaatttcccgctttgctctgtttcctaaaa

SEQ ID NO: 39512 - DNA, 36 bp, Artificial Sequence
  Synthetic oligonucleotide
gtggaacgctactgctaatacctttgacgacgagca

SEQ ID NO: 39513 - DNA, 36 bp, Artificial Sequence
  Synthetic oligonucleotide
gctcaccgcgcaccacatttgagcaacactactgca

SEQ ID NO: 39514 - DNA, 36 bp, Artificial Sequence
  Synthetic oligonucleotide
accggccctcatgtgacccaccagccccgtatctca

SEQ ID NO: 39515 - DNA, 35 bp, Artificial Sequence
  Synthetic oligonucleotide
gtggggacgatggcggtgcttggggcgattgaaga

SEQ ID NO: 39516 - DNA, 37 bp, Artificial Sequence
  Synthetic oligonucleotide
gcccaccgcgcgcgccctcttcatcatgcccccgaga

SEQ ID NO: 39517 - DNA, 37 bp, Artificial Sequence
  Synthetic oligonucleotide
agcctccgcgccaccttccctgttttggctacttaga

SEQ ID NO: 39518 - DNA, 35 bp, Artificial Sequence
  Synthetic oligonucleotide
ggaggcggtggggctacgtgattggtctcggcgga

SEQ ID NO: 39519 - DNA, 37 bp, Artificial Sequence
  Synthetic oligonucleotide
ttagccatcgatacgccaccgctccaccaccttcgga

SEQ ID NO: 39520 - DNA, 36 bp, Artificial Sequence
  Synthetic oligonucleotide
atctgcagtagggagaggggacggaaatggtgtgga

SEQ ID NO: 39521 - DNA, 38 bp, Artificial Sequence
  Synthetic oligonucleotide
catacccgccttattgtgtcatcgtgagcggggcatga

SEQ ID NO: 39522 - DNA, 38 bp, Artificial Sequence
  Synthetic oligonucleotide
tattcgccaggcacgctccatcctccagccgatcatga

SEQ ID NO: 39523 - DNA, 38 bp, Artificial Sequence
  Synthetic oligonucleotide
acgaccggcctgcatttactttcccccagacctcatga

SEQ ID NO: 39524 - DNA, 37 bp, Artificial Sequence
  Synthetic oligonucleotide
gaatccggccatgggtaatccgttctctcttctatga

SEQ ID NO: 39525 - DNA, 38 bp, Artificial Sequence
  Synthetic oligonucleotide
tagctcagcacagcggttcccgtgtctttgtttcctga

SEQ ID NO: 39526 - DNA, 37 bp, Artificial Sequence
  Synthetic oligonucleotide
atgtgcccctccacgttctctccagtcgcaagagtga

SEQ ID NO: 39527 - DNA, 38 bp, Artificial Sequence
  Synthetic oligonucleotide
gagggccaacgcgtgagggtgggacggggttagggtga

SEQ ID NO: 39528 - DNA, 35 bp, Artificial Sequence
  Synthetic oligonucleotide
tcgcacggtcaacacagcacgcatttctttccaac

SEQ ID NO: 39529 - DNA, 35 bp, Artificial Sequence
  Synthetic oligonucleotide
tcgtgtccggccccctatattatgtcgctgaccac

SEQ ID NO: 39530 - DNA, 35 bp, Artificial Sequence
  Synthetic oligonucleotide
tgatactgacgcccttaacctgctacagctatgtc

SEQ ID NO: 39531 - DNA, 35 bp, Artificial Sequence
  Synthetic oligonucleotide
gtgccaagcaatcccaagcccagtaattgtcattc

SEQ ID NO: 39532 - DNA, 35 bp, Artificial Sequence
  Synthetic oligonucleotide
accgccccccagcatacgctacagtcgaccgccgg

SEQ ID NO: 39533 - DNA, 35 bp, Artificial Sequence
  Synthetic oligonucleotide
aagcccctccgccctccgtgttttccgttccggat

SEQ ID NO: 39534 - DNA, 35 bp, Artificial Sequence
  Synthetic oligonucleotide
gtcgccgacagcctgcgctctgaatcggtaccact

SEQ ID NO: 39535 - DNA, 35 bp, Artificial Sequence
  Synthetic oligonucleotide
gtgaaatgccactaatatccctgaactggtcctct

SEQ ID NO: 39536 - DNA, 35 bp, Artificial Sequence
  Synthetic oligonucleotide
tatgagtgtgccgttggaagaagtttggggggggt

SEQ ID NO: 39537 - DNA, 35 bp, Artificial Sequence
  Synthetic oligonucleotide
ttagtccgtgcgtcgattctctggtctccccgctt

SEQ ID NO: 39538 - DNA, 35 bp, Artificial Sequence
  Synthetic oligonucleotide
tgactgcccgctatacacctgccgcaacacttttt

SEQ ID NO: 39539 - DNA, 35 bp, Artificial Sequence
  Synthetic oligonucleotide
aaaagagggtgataggtgagggtggggaaagtgaa

SEQ ID NO: 39540 - DNA, 36 bp, Artificial Sequence
  Synthetic oligonucleotide
tatgtcgccgtcactccccgctggggcctattctaa

SEQ ID NO: 39541 - DNA, 35 bp, Artificial Sequence
  Synthetic oligonucleotide
gaccccagtccggtttgtcttgcctgcccctccca

SEQ ID NO: 39542 - DNA, 35 bp, Artificial Sequence
  Synthetic oligonucleotide
catacaaccactcgcacaccatggatccagatcca

SEQ ID NO: 39543 - DNA, 36 bp, Artificial Sequence
  Synthetic oligonucleotide
gcatcgctacagtttcgcgaactggcctcacttcca

SEQ ID NO: 39544 - DNA, 37 bp, Artificial Sequence
  Synthetic oligonucleotide
actcacggcggtgtggaggagggggaatcgcagcaga

SEQ ID NO: 39545 - DNA, 35 bp, Artificial Sequence
  Synthetic oligonucleotide
ggagcaacgtgctaatatggcacccatctccccga

SEQ ID NO: 39546 - DNA, 37 bp, Artificial Sequence
  Synthetic oligonucleotide
aaaacagggagaagcgacataagggtgtcgggaggga

SEQ ID NO: 39547 - DNA, 35 bp, Artificial Sequence
  Synthetic oligonucleotide
gagagggcaaggttagtttctggttagtaggggga

SEQ ID NO: 39548 - DNA, 38 bp, Artificial Sequence
  Synthetic oligonucleotide
gccagccctccatctgcataccgactagccgagaatga

SEQ ID NO: 39549 - DNA, 38 bp, Artificial Sequence
  Synthetic oligonucleotide
agagtccgcctccccgacgttattccaaagttccctga

SEQ ID NO: 39550 - DNA, 37 bp, Artificial Sequence
  Synthetic oligonucleotide
gtcactacccggcaccgtgaacacttccagggattga

SEQ ID NO: 39551 - DNA, 35 bp, Artificial Sequence
  Synthetic oligonucleotide
cacatgcactgcctgccgcccataataacccttga

SEQ ID NO: 39552 - DNA, 36 bp, Artificial Sequence
  Synthetic oligonucleotide
gatcaggcacctggctcttgggcaacataccgaata

SEQ ID NO: 39553 - DNA, 34 bp, Artificial Sequence
  Synthetic oligonucleotide
tggacgtgcctcgctttgctcacctactcgttta

SEQ ID NO: 39554 - DNA, 35 bp, Artificial Sequence
  Synthetic oligonucleotide
taccccgacctgagctcttttagcgagcttacgac

SEQ ID NO: 39555 - DNA, 35 bp, Artificial Sequence
  Synthetic oligonucleotide
gtccatcccggcaactttaataggcatctctcacc

SEQ ID NO: 39556 - DNA, 35 bp, Artificial Sequence
  Synthetic oligonucleotide
acgccttggaacaacaccctgcttcacctgcgccc

SEQ ID NO: 39557 - DNA, 35 bp, Artificial Sequence
  Synthetic oligonucleotide
gtacacacgtatcaacgggtaagacccccctttgc

SEQ ID NO: 39558 - DNA, 36 bp, Artificial Sequence
  Synthetic oligonucleotide
acccacgctgtttacgtcgctgcccgctttcctccg

SEQ ID NO: 39559 - DNA, 35 bp, Artificial Sequence
  Synthetic oligonucleotide
tcgtaagtcccggttctgcatttcccatcccatgg

SEQ ID NO: 39560 - DNA, 35 bp, Artificial Sequence
  Synthetic oligonucleotide
gtcccgtctccgtttcgcttggtaaagttctcttg

SEQ ID NO: 39561 - DNA, 35 bp, Artificial Sequence
  Synthetic oligonucleotide
tgccacccgaaggctgagtgaaaatgccatcccat

SEQ ID NO: 39562 - DNA, 35 bp, Artificial Sequence
  Synthetic oligonucleotide
gtacacccagtgtctgtacacgatctatcccacct

SEQ ID NO: 39563 - DNA, 37 bp, Artificial Sequence
  Synthetic oligonucleotide
gcccacgctgtgtgcttttctttgtagtcgaccggtt

SEQ ID NO: 39564 - DNA, 36 bp, Artificial Sequence
  Synthetic oligonucleotide
tcaacccacagccttatgcaggcgctaccaagggaa

SEQ ID NO: 39565 - DNA, 36 bp, Artificial Sequence
  Synthetic oligonucleotide
tactgacctgcattgcatttcaagtaccttgactaa

SEQ ID NO: 39566 - DNA, 35 bp, Artificial Sequence
  Synthetic oligonucleotide
acctggctcattctgacaacatgcacgtgcacaca

SEQ ID NO: 39567 - DNA, 36 bp, Artificial Sequence
  Synthetic oligonucleotide
tgtcaccacccctattttcacacgatccgctgcgca

SEQ ID NO: 39568 - DNA, 36 bp, Artificial Sequence
  Synthetic oligonucleotide
atcgatcgcgccacatctgtcccttggtttgggtca

SEQ ID NO: 39569 - DNA, 36 bp, Artificial Sequence
  Synthetic oligonucleotide
gacgagtctgcccagtgcccccgcgactttctttca

SEQ ID NO: 39570 - DNA, 37 bp, Artificial Sequence
  Synthetic oligonucleotide
acaaagcgggaacgagggggaggaatattgactaaga

SEQ ID NO: 39571 - DNA, 37 bp, Artificial Sequence
  Synthetic oligonucleotide
ttggatggttggatgggaacaggggtggggtaggaga

SEQ ID NO: 39572 - DNA, 37 bp, Artificial Sequence
  Synthetic oligonucleotide
acaccactgcaaatctcgttcttgatcatccgttaga

SEQ ID NO: 39573 - DNA, 36 bp, Artificial Sequence
  Synthetic oligonucleotide
actgaacaccagttcatcagtctatccgactttaga

SEQ ID NO: 39574 - DNA, 37 bp, Artificial Sequence
  Synthetic oligonucleotide
tgccactacctccattcgtcccagcacgtccacacga

SEQ ID NO: 39575 - DNA, 36 bp, Artificial Sequence
  Synthetic oligonucleotide
atgacatgaagttccagacccctccgtcgcacacga

SEQ ID NO: 39576 - DNA, 37 bp, Artificial Sequence
  Synthetic oligonucleotide
taaggtcacaaaggcacacacatcgcccctaccccga

SEQ ID NO: 39577 - DNA, 37 bp, Artificial Sequence
  Synthetic oligonucleotide
aacgtgtctgcccgtctcctgtttcgcttagccccga

SEQ ID NO: 39578 - DNA, 37 bp, Artificial Sequence
  Synthetic oligonucleotide
acaaaagccactttgcactatcccgcacatgcgccga

SEQ ID NO: 39579 - DNA, 37 bp, Artificial Sequence
  Synthetic oligonucleotide
tagggcggggcagaaggggaacaactaacgaggggga

SEQ ID NO: 39580 - DNA, 36 bp, Artificial Sequence
  Synthetic oligonucleotide
tcctcatgtccgaccctgctacctaaaccagattga

SEQ ID NO: 39581 - DNA, 37 bp, Artificial Sequence
  Synthetic oligonucleotide
ttgcacgctgggggagattatagggggcatggattga

SEQ ID NO: 39582 - DNA, 37 bp, Artificial Sequence
  Synthetic oligonucleotide
gaagcctctgccgcgaatgttcttctcaatgtcttga

SEQ ID NO: 39583 - DNA, 36 bp, Artificial Sequence
  Synthetic oligonucleotide
tccacccatttccgtaatgtgcattacctgcaacta

SEQ ID NO: 39584 - DNA, 36 bp, Artificial Sequence
  Synthetic oligonucleotide
tccaccattcgctggccttttaactgccttgcacta

SEQ ID NO: 39585 - DNA, 36 bp, Artificial Sequence
  Synthetic oligonucleotide
tctgacacccaccagaacccgagtacgctacaatta

SEQ ID NO: 39586 - DNA, 36 bp, Artificial Sequence
  Synthetic oligonucleotide
tccgtacgttggacgtcgtacgcacacaccccatta

SEQ ID NO: 39587 - DNA, 35 bp, Artificial Sequence
  Synthetic oligonucleotide
gggaaggggaggggagtagtccgcagggatagtac

SEQ ID NO: 39588 - DNA, 35 bp, Artificial Sequence
  Synthetic oligonucleotide
ggaaccatcaggttattcgtagttatagtccttcc

SEQ ID NO: 39589 - DNA, 35 bp, Artificial Sequence
  Synthetic oligonucleotide
gctcaaccaaccgatgttggccaatcgttatcatc

SEQ ID NO: 39590 - DNA, 35 bp, Artificial Sequence
  Synthetic oligonucleotide
tggacatacccgccccgtgagggacaaaatctctc

SEQ ID NO: 39591 - DNA, 35 bp, Artificial Sequence
  Synthetic oligonucleotide
gagaccgttgatgtaccctcccttcacccaatacg

SEQ ID NO: 39592 - DNA, 35 bp, Artificial Sequence
  Synthetic oligonucleotide
tgtcctgctgccattcccatgaacaattctcttcg

SEQ ID NO: 39593 - DNA, 35 bp, Artificial Sequence
  Synthetic oligonucleotide
atggtacccctgcgcaccactcgttcaccattaat

SEQ ID NO: 39594 - DNA, 35 bp, Artificial Sequence
  Synthetic oligonucleotide
tgcgtgccccactaaattcgctatacaagtccgtt

SEQ ID NO: 39595 - DNA, 35 bp, Artificial Sequence
  Synthetic oligonucleotide
tgcccacctggaactaatggatgatgccctgcaca

SEQ ID NO: 39596 - DNA, 36 bp, Artificial Sequence
  Synthetic oligonucleotide
agcccagtcgttcctttttcgtctgtctagttccca

SEQ ID NO: 39597 - DNA, 35 bp, Artificial Sequence
  Synthetic oligonucleotide
aagaagcgcactgaacctttcgataaccgtctgca

SEQ ID NO: 39598 - DNA, 36 bp, Artificial Sequence
  Synthetic oligonucleotide
ttgccctcgaggcgcttgagctatcttcattcatca

SEQ ID NO: 39599 - DNA, 37 bp, Artificial Sequence
  Synthetic oligonucleotide
atgcgcgggagggaggttagggcaggcatacggagga

SEQ ID NO: 39600 - DNA, 37 bp, Artificial Sequence
  Synthetic oligonucleotide
gagtaggggagatagggcacgaaatgaacaggctgga

SEQ ID NO: 39601 - DNA, 38 bp, Artificial Sequence
  Synthetic oligonucleotide
tcacgctcctctctctgcgcctactgttccctggatga

SEQ ID NO: 39602 - DNA, 38 bp, Artificial Sequence
  Synthetic oligonucleotide
gaccatcgcctggctctgacaccctcccaccattatga

SEQ ID NO: 39603 - DNA, 38 bp, Artificial Sequence
  Synthetic oligonucleotide
gacgcctagggtctcattccctatacttcctgacctga

SEQ ID NO: 39604 - DNA, 38 bp, Artificial Sequence
  Synthetic oligonucleotide
tgagctgccgttggatccattctacctgcatttcctga

SEQ ID NO: 39605 - DNA, 38 bp, Artificial Sequence
  Synthetic oligonucleotide
tgcgcgttgagtgtccattcatttcctgcctcacgtga

SEQ ID NO: 39606 - DNA, 37 bp, Artificial Sequence
  Synthetic oligonucleotide
ttgacggcattgcaataaacacacctactcgccgtga

SEQ ID NO: 39607 - DNA, 38 bp, Artificial Sequence
  Synthetic oligonucleotide
acctgacagtcaggaagtcgggtggcaaacatggttga

SEQ ID NO: 39608 - DNA, 35 bp, Artificial Sequence
  Synthetic oligonucleotide
accacctctgcccaggctctttgatttctttttga

SEQ ID NO: 39609 - DNA, 36 bp, Artificial Sequence
  Synthetic oligonucleotide
gatgggcacactcccttcctccgcccgcccccaata

SEQ ID NO: 39610 - DNA, 35 bp, Artificial Sequence
  Synthetic oligonucleotide
ggggtagagagtatggtgtgatggtgggtgaagta

SEQ ID NO: 39611 - DNA, 36 bp, Artificial Sequence
  Synthetic oligonucleotide
tggagggcgggcgggtgtgtctggggttttcaggta

SEQ ID NO: 39612 - DNA, 35 bp, Artificial Sequence
  Synthetic oligonucleotide
acacactcgaaacgggatgacctgtgaactctgta

SEQ ID NO: 39613 - DNA, 36 bp, Artificial Sequence
  Synthetic oligonucleotide
gaccgctagcggattcccaccctgttcgtcctgtta

SEQ ID NO: 39614 - DNA, 35 bp, Artificial Sequence
  Synthetic oligonucleotide
atgcgtattcgctgagcggctacatcttgcccccc

SEQ ID NO: 39615 - DNA, 35 bp, Artificial Sequence
  Synthetic oligonucleotide
ttcatgctcgccggccccacggtctctgactgccc

SEQ ID NO: 39616 - DNA, 35 bp, Artificial Sequence
  Synthetic oligonucleotide
gggtgcccagctatgctcattaggttccttcgtcc

SEQ ID NO: 39617 - DNA, 35 bp, Artificial Sequence
  Synthetic oligonucleotide
gcgacactctgggcctatacaataaaatcctgctc

SEQ ID NO: 39618 - DNA, 35 bp, Artificial Sequence
  Synthetic oligonucleotide
atgcctgccggaacgtttcatcgctgtcgccaccg

SEQ ID NO: 39619 - DNA, 35 bp, Artificial Sequence
  Synthetic oligonucleotide
gggacgcttgggacaacacagaggggtcaagaggg

SEQ ID NO: 39620 - DNA, 35 bp, Artificial Sequence
  Synthetic oligonucleotide
acactcacactccttgcatgaaagctttatttctg

SEQ ID NO: 39621 - DNA, 36 bp, Artificial Sequence
  Synthetic oligonucleotide
acataggggggggatggagacatttgacgcaaagtg

SEQ ID NO: 39622 - DNA, 35 bp, Artificial Sequence
  Synthetic oligonucleotide
acctcacttccgcctatacgacgtatcgcccatat

SEQ ID NO: 39623 - DNA, 35 bp, Artificial Sequence
  Synthetic oligonucleotide
tccacgtcccgttcatagcactccggtacttatat

SEQ ID NO: 39624 - DNA, 35 bp, Artificial Sequence
  Synthetic oligonucleotide
aataggccaatggaggggggaatgagggctaaact

SEQ ID NO: 39625 - DNA, 35 bp, Artificial Sequence
  Synthetic oligonucleotide
gacgtccggactgctagaccccactacccgccact

SEQ ID NO: 39626 - DNA, 35 bp, Artificial Sequence
  Synthetic oligonucleotide
ggtaatgcccgcagacatgtgtcgcccacccttct

SEQ ID NO: 39627 - DNA, 35 bp, Artificial Sequence
  Synthetic oligonucleotide
taatagtcgccccgagctcgcatcatgaccgaatt

SEQ ID NO: 39628 - DNA, 35 bp, Artificial Sequence
  Synthetic oligonucleotide
gctgtccccagattccttatacccccatagtgctt

SEQ ID NO: 39629 - DNA, 35 bp, Artificial Sequence
  Synthetic oligonucleotide
tccaacgtttgttcctttatgtccagtcaccggtt

SEQ ID NO: 39630 - DNA, 36 bp, Artificial Sequence
  Synthetic oligonucleotide
atcgctccccgttcgcgtactcgttatcgaatgtaa

SEQ ID NO: 39631 - DNA, 36 bp, Artificial Sequence
  Synthetic oligonucleotide
ttccgctaagccgaccttgccttcccgtcaatagca

SEQ ID NO: 39632 - DNA, 35 bp, Artificial Sequence
  Synthetic oligonucleotide
atgagcccacgaccttcaatactgttttcctagca

SEQ ID NO: 39633 - DNA, 36 bp, Artificial Sequence
  Synthetic oligonucleotide
tcactgctccgacttattcctctcactcgagcctca

SEQ ID NO: 39634 - DNA, 37 bp, Artificial Sequence
  Synthetic oligonucleotide
agcccactgcctttcgtaacggaccaaccttgctaga

SEQ ID NO: 39635 - DNA, 37 bp, Artificial Sequence
  Synthetic oligonucleotide
tcaacgggggggaggggtagatccgttgctacaacga

SEQ ID NO: 39636 - DNA, 38 bp, Artificial Sequence
  Synthetic oligonucleotide
taatcagggggaaggggtcaggttcgggagtgaaccga

SEQ ID NO: 39637 - DNA, 37 bp, Artificial Sequence
  Synthetic oligonucleotide
taacgccccctgtctgtccgctcacccaggcatgcga

SEQ ID NO: 39638 - DNA, 37 bp, Artificial Sequence
  Synthetic oligonucleotide
aagtacagagcctgttcccgttcactaccctttgcga

SEQ ID NO: 39639 - DNA, 36 bp, Artificial Sequence
  Synthetic oligonucleotide
agtcaggtatggggggggaggaggggtcgatgagga

SEQ ID NO: 39640 - DNA, 37 bp, Artificial Sequence
  Synthetic oligonucleotide
aaacacacgtcgagtcatatcgtcttacctctccgga

SEQ ID NO: 39641 - DNA, 37 bp, Artificial Sequence
  Synthetic oligonucleotide
gatgggtcgtggtgggccgggtggacatatgttggga

SEQ ID NO: 39642 - DNA, 38 bp, Artificial Sequence
  Synthetic oligonucleotide
gcgcaagcagcccagccttccgtcttctctcttcatga

SEQ ID NO: 39643 - DNA, 37 bp, Artificial Sequence
  Synthetic oligonucleotide
gttcccgtcgccggtccccccttccagcaagtgctga

SEQ ID NO: 39644 - DNA, 38 bp, Artificial Sequence
  Synthetic oligonucleotide
tcaccgccaacgccctttgttaagccccagcttgttga

SEQ ID NO: 39645 - DNA, 36 bp, Artificial Sequence
  Synthetic oligonucleotide
tctcgcatcactgggcctgtttttacctttttacta

SEQ ID NO: 39646 - DNA, 36 bp, Artificial Sequence
  Synthetic oligonucleotide
atggggcccaatcggtttagttcctaatttcctgta

SEQ ID NO: 39647 - DNA, 35 bp, Artificial Sequence
  Synthetic oligonucleotide
acgaggcctccacccagctgagggacctacactta

SEQ ID NO: 39648 - DNA, 36 bp, Artificial Sequence
  Synthetic oligonucleotide
gcaccacggaccaggctggtatggtcccccccttta

SEQ ID NO: 39649 - DNA, 35 bp, Artificial Sequence
  Synthetic oligonucleotide
acttacccgcaaatctgttcaattcttggttcaac

SEQ ID NO: 39650 - DNA, 35 bp, Artificial Sequence
  Synthetic oligonucleotide
attctgctgacccacgcacattgtaacctcccccc

SEQ ID NO: 39651 - DNA, 35 bp, Artificial Sequence
  Synthetic oligonucleotide
acgcaatcgcgctccatataatcgtacctaccgcc

SEQ ID NO: 39652 - DNA, 35 bp, Artificial Sequence
  Synthetic oligonucleotide
ttggtagctcaccgcccaacagtcctatttccgcc

SEQ ID NO: 39653 - DNA, 35 bp, Artificial Sequence
  Synthetic oligonucleotide
ggacatatcacgtattccgacccccctcccatgag

SEQ ID NO: 39654 - DNA, 35 bp, Artificial Sequence
  Synthetic oligonucleotide
ggggaggtagagcataagagcgagggcggggtagg

SEQ ID NO: 39655 - DNA, 35 bp, Artificial Sequence
  Synthetic oligonucleotide
gtagccgtcctttatgcatctagctttttctttgg

SEQ ID NO: 39656 - DNA, 35 bp, Artificial Sequence
  Synthetic oligonucleotide
tgcaacctacacctactgcgaagccgaactacgtg

SEQ ID NO: 39657 - DNA, 35 bp, Artificial Sequence
  Synthetic oligonucleotide
tgacggagaggaggggtagaacataatcgacgact

SEQ ID NO: 39658 - DNA, 35 bp, Artificial Sequence
  Synthetic oligonucleotide
aagccgcccacctctataacaccaacgcgtctact

SEQ ID NO: 39659 - DNA, 35 bp, Artificial Sequence
  Synthetic oligonucleotide
gtgatggtcgacccaggcctttctttgattctcct

SEQ ID NO: 39660 - DNA, 35 bp, Artificial Sequence
  Synthetic oligonucleotide
agcgtcccgtccgtgagcccatatcccctccagct

SEQ ID NO: 39661 - DNA, 36 bp, Artificial Sequence
  Synthetic oligonucleotide
gacgaatggtcaggggactctgagcaagggggcaaa

SEQ ID NO: 39662 - DNA, 35 bp, Artificial Sequence
  Synthetic oligonucleotide
gccaccggctgattcactcgccaggttacttccaa

SEQ ID NO: 39663 - DNA, 35 bp, Artificial Sequence
  Synthetic oligonucleotide
aacccgcaagcgtagtcgcatccacacatcgaaca

SEQ ID NO: 39664 - DNA, 35 bp, Artificial Sequence
  Synthetic oligonucleotide
gccacttacgattcatgcagagccaccactgaaca

SEQ ID NO: 39665 - DNA, 35 bp, Artificial Sequence
  Synthetic oligonucleotide
aacactcgccttatttatacgaccatcgatacgca

SEQ ID NO: 39666 - DNA, 35 bp, Artificial Sequence
  Synthetic oligonucleotide
actgcctccccacgttcatttctctatcaggttca

SEQ ID NO: 39667 - DNA, 37 bp, Artificial Sequence
  Synthetic oligonucleotide
gccgcattcaacaccatcgtcccctacgtcacgacga

SEQ ID NO: 39668 - DNA, 37 bp, Artificial Sequence
  Synthetic oligonucleotide
gttagagggtggggtggagttaagggcctgtgtccga

SEQ ID NO: 39669 - DNA, 37 bp, Artificial Sequence
  Synthetic oligonucleotide
atcttccgactccacctcccaggacatcgcattgcga

SEQ ID NO: 39670 - DNA, 37 bp, Artificial Sequence
  Synthetic oligonucleotide
gagtgggagcgagaggaagggttacgtgggaatagga

SEQ ID NO: 39671 - DNA, 37 bp, Artificial Sequence
  Synthetic oligonucleotide
acacaagcgggggcgaaccgaaaaaaggtcggaggga

SEQ ID NO: 39672 - DNA, 37 bp, Artificial Sequence
  Synthetic oligonucleotide
tacaggcattcctcgcccggttaccgattctcttgga

SEQ ID NO: 39673 - DNA, 37 bp, Artificial Sequence
  Synthetic oligonucleotide
accatccatccgacgtttgcaggctcaaacctttgga

SEQ ID NO: 39674 - DNA, 38 bp, Artificial Sequence
  Synthetic oligonucleotide
gcttaatgcagagtgtggggtggggggtgcaacgatga

SEQ ID NO: 39675 - DNA, 37 bp, Artificial Sequence
  Synthetic oligonucleotide
gccgagggcagggaagggcatggagaggagttgatga

SEQ ID NO: 39676 - DNA, 38 bp, Artificial Sequence
  Synthetic oligonucleotide
agccaacgtagagcttccgtctgccatcctcgaactga

SEQ ID NO: 39677 - DNA, 37 bp, Artificial Sequence
  Synthetic oligonucleotide
gtttgctactgatagcgtaacacccatcccccactga

SEQ ID NO: 39678 - DNA, 38 bp, Artificial Sequence
  Synthetic oligonucleotide
tgttgcctatcgtatccctcacgccaccacgctcctga

SEQ ID NO: 39679 - DNA, 38 bp, Artificial Sequence
  Synthetic oligonucleotide
gtgaaaggtagagggcgaaatgggaaataactaggtga

SEQ ID NO: 39680 - DNA, 38 bp, Artificial Sequence
  Synthetic oligonucleotide
tcacatacgccagtgctacctgaccttcttcacattga

SEQ ID NO: 39681 - DNA, 38 bp, Artificial Sequence
  Synthetic oligonucleotide
acgagtggttaccaggggtgggctgaagggggggttga

SEQ ID NO: 39682 - DNA, 36 bp, Artificial Sequence
  Synthetic oligonucleotide
tgttacgcccacttttttgaactgctttgattttga

SEQ ID NO: 39683 - DNA, 36 bp, Artificial Sequence
  Synthetic oligonucleotide
atctgccacataacctagtcgaacgtgaccacatta

SEQ ID NO: 39684 - DNA, 35 bp, Artificial Sequence
  Synthetic oligonucleotide
atcgtacaacacccagttgatcatccatgctgaac

SEQ ID NO: 39685 - DNA, 35 bp, Artificial Sequence
  Synthetic oligonucleotide
attaccgacgtaccgccctctagccttagactaac

SEQ ID NO: 39686 - DNA, 35 bp, Artificial Sequence
  Synthetic oligonucleotide
accagtactcgtactaggtcatggcctttcttccc

SEQ ID NO: 39687 - DNA, 35 bp, Artificial Sequence
  Synthetic oligonucleotide
gtggcccgccccgtccctactagcaaaatatggcc

SEQ ID NO: 39688 - DNA, 35 bp, Artificial Sequence
  Synthetic oligonucleotide
taccctgttccagtgccatttttagcattcgatcc

SEQ ID NO: 39689 - DNA, 35 bp, Artificial Sequence
  Synthetic oligonucleotide
tcacggtgcctttcattactatgcagtccatctcc

SEQ ID NO: 39690 - DNA, 35 bp, Artificial Sequence
  Synthetic oligonucleotide
gatggtgtcatcggccactgtatcttctcacctgc

SEQ ID NO: 39691 - DNA, 35 bp, Artificial Sequence
  Synthetic oligonucleotide
aagggggggggaagtggagtataaacctcgggtag

SEQ ID NO: 39692 - DNA, 35 bp, Artificial Sequence
  Synthetic oligonucleotide
gtgccccatcgcccatctccacagctatcctgccg

SEQ ID NO: 39693 - DNA, 35 bp, Artificial Sequence
  Synthetic oligonucleotide
ggagaagagcaagtggggcgggatagtctcatagg

SEQ ID NO: 39694 - DNA, 35 bp, Artificial Sequence
  Synthetic oligonucleotide
agtgaagcgcaatccgttgactcacacgtgtcctg

SEQ ID NO: 39695 - DNA, 35 bp, Artificial Sequence
  Synthetic oligonucleotide
tgcaactccccgtcgtccttaacttgatcggtcct

SEQ ID NO: 39696 - DNA, 35 bp, Artificial Sequence
  Synthetic oligonucleotide
ctgtcccatctcgctgtcgttaggcttccgtgcgt

SEQ ID NO: 39697 - DNA, 35 bp, Artificial Sequence
  Synthetic oligonucleotide
gtgtgggagggtaaaacatttatcatgagtgcggt

SEQ ID NO: 39698 - DNA, 35 bp, Artificial Sequence
  Synthetic oligonucleotide
gcaacactgcaccttttgttatcgcctcggataaa

SEQ ID NO: 39699 - DNA, 36 bp, Artificial Sequence
  Synthetic oligonucleotide
gaacacccccatgactctacaattcgatcgttcaca

SEQ ID NO: 39700 - DNA, 35 bp, Artificial Sequence
  Synthetic oligonucleotide
ttggacaccgctgacctggggcttctacgtttcca

SEQ ID NO: 39701 - DNA, 36 bp, Artificial Sequence
  Synthetic oligonucleotide
tgaagccccacccagaagccccatactctcgaggca

SEQ ID NO: 39702 - DNA, 37 bp, Artificial Sequence
  Synthetic oligonucleotide
acatcaccacaaatctccagtcaagacatcctcaaga

SEQ ID NO: 39703 - DNA, 37 bp, Artificial Sequence
  Synthetic oligonucleotide
aaacgcccaacgcaagcaccacctctgacactgtaga

SEQ ID NO: 39704 - DNA, 36 bp, Artificial Sequence
  Synthetic oligonucleotide
gtccaccgcccccatgtctccgccccgtgaagacga

SEQ ID NO: 39705 - DNA, 37 bp, Artificial Sequence
  Synthetic oligonucleotide
tagccactacccttcagaccaccgccatcgtatccga

SEQ ID NO: 39706 - DNA, 37 bp, Artificial Sequence
  Synthetic oligonucleotide
gacgccacctacctatgctgcgaagctaacagcgcga

SEQ ID NO: 39707 - DNA, 35 bp, Artificial Sequence
  Synthetic oligonucleotide
atcctgtccctcgcgttccttctcgttgtaacgga

SEQ ID NO: 39708 - DNA, 37 bp, Artificial Sequence
  Synthetic oligonucleotide
gttcctgacctctgttcccacgtccctctagccggga

SEQ ID NO: 39709 - DNA, 37 bp, Artificial Sequence
  Synthetic oligonucleotide
ggatgagacgaggggggaacgcgcgtactaaggggga

SEQ ID NO: 39710 - DNA, 37 bp, Artificial Sequence
  Synthetic oligonucleotide
agcgagcggagtcgcgggttaggggaggggtgctgga

SEQ ID NO: 39711 - DNA, 37 bp, Artificial Sequence
  Synthetic oligonucleotide
taaccaaccccacccgggtcatgcggtcaccacgtga

SEQ ID NO: 39712 - DNA, 38 bp, Artificial Sequence
  Synthetic oligonucleotide
gtccccaccagcctagccccgccccacctaatgcgtga

SEQ ID NO: 39713 - DNA, 38 bp, Artificial Sequence
  Synthetic oligonucleotide
attctgactccgaccccttgcgacttgcacctcgttga

SEQ ID NO: 39714 - DNA, 36 bp, Artificial Sequence
  Synthetic oligonucleotide
acaggccttactatggttcgaatgccaccctgccta

SEQ ID NO: 39715 - DNA, 36 bp, Artificial Sequence
  Synthetic oligonucleotide
tgtgggtgaggaccggcggtgaagcgggggtgggta

SEQ ID NO: 39716 - DNA, 36 bp, Artificial Sequence
  Synthetic oligonucleotide
acgcagggggggatgactacggtatgatgggtggta

SEQ ID NO: 39717 - DNA, 36 bp, Artificial Sequence
  Synthetic oligonucleotide
aaggtggagaaaaagggagcgaacgggccggatgta

SEQ ID NO: 39718 - DNA, 36 bp, Artificial Sequence
  Synthetic oligonucleotide
gtgcatgccaggcttagggctccccatccttgatta

SEQ ID NO: 39719 - DNA, 35 bp, Artificial Sequence
  Synthetic oligonucleotide
actcatgcgtacaccatatttggttcgtactcacc

SEQ ID NO: 39720 - DNA, 35 bp, Artificial Sequence
  Synthetic oligonucleotide
cccactgccccactgttaattctgacgatactgcc

SEQ ID NO: 39721 - DNA, 35 bp, Artificial Sequence
  Synthetic oligonucleotide
tcctgagctcaagggttgagcgaaagtacatatcc

SEQ ID NO: 39722 - DNA, 35 bp, Artificial Sequence
  Synthetic oligonucleotide
tcacccagctcaccgcgcgtcttgcctgtaccatc

SEQ ID NO: 39723 - DNA, 35 bp, Artificial Sequence
  Synthetic oligonucleotide
ttactcccactatgttcacgtcttgaccctgggtc

SEQ ID NO: 39724 - DNA, 35 bp, Artificial Sequence
  Synthetic oligonucleotide
gtgctacctatcaatcggctaaccatgaacggttc

SEQ ID NO: 39725 - DNA, 35 bp, Artificial Sequence
  Synthetic oligonucleotide
gcactccacttcacagggacccacttcaccttgag

SEQ ID NO: 39726 - DNA, 34 bp, Artificial Sequence
  Synthetic oligonucleotide
aaccggagggcgggggggagtgtaatgtaccggg

SEQ ID NO: 39727 - DNA, 35 bp, Artificial Sequence
  Synthetic oligonucleotide
actcggtccttcccttacagtttagcaacacatgg

SEQ ID NO: 39728 - DNA, 35 bp, Artificial Sequence
  Synthetic oligonucleotide
gcaccgggtgtcgcactctgtcttcttattggtct

SEQ ID NO: 39729 - DNA, 34 bp, Artificial Sequence
  Synthetic oligonucleotide
tacagtatccccatacccagcccccgcacttcgt

SEQ ID NO: 39730 - DNA, 35 bp, Artificial Sequence
  Synthetic oligonucleotide
aaggggagggggatgtaggcgttgttatatagggt

SEQ ID NO: 39731 - DNA, 35 bp, Artificial Sequence
  Synthetic oligonucleotide
aatagcccacgcatctccgtatgcgacatccactt

SEQ ID NO: 39732 - DNA, 36 bp, Artificial Sequence
  Synthetic oligonucleotide
gccaccacatcaagcacaaaaacgcacatgctcgaa

SEQ ID NO: 39733 - DNA, 35 bp, Artificial Sequence
  Synthetic oligonucleotide
gtcccgccttgccttataacttgctccttcgggaa

SEQ ID NO: 39734 - DNA, 36 bp, Artificial Sequence
  Synthetic oligonucleotide
tttccccccccatgttagctttcgccagggccgtaa

SEQ ID NO: 39735 - DNA, 36 bp, Artificial Sequence
  Synthetic oligonucleotide
gctgcgcacacctcatgtcctaccctaccggtacca

SEQ ID NO: 39736 - DNA, 36 bp, Artificial Sequence
  Synthetic oligonucleotide
gacgtactcacgaggacgcgttttaggcccatccca

SEQ ID NO: 39737 - DNA, 35 bp, Artificial Sequence
  Synthetic oligonucleotide
acccgcaccccctagcacccgccgccttgcactca

SEQ ID NO: 39738 - DNA, 36 bp, Artificial Sequence
  Synthetic oligonucleotide
accaccgaattcaagagctcactcgacgtccattca

SEQ ID NO: 39739 - DNA, 37 bp, Artificial Sequence
  Synthetic oligonucleotide
gctaagggggtggaacgtacggggaagtcatgagaga

SEQ ID NO: 39740 - DNA, 37 bp, Artificial Sequence
  Synthetic oligonucleotide
gctacccccacacttagcctgacccgaacgtctacga

SEQ ID NO: 39741 - DNA, 37 bp, Artificial Sequence
  Synthetic oligonucleotide
tactgacacccacccgcccggcgtattttgataccga

SEQ ID NO: 39742 - DNA, 37 bp, Artificial Sequence
  Synthetic oligonucleotide
ttccactacgccctgtcgcatatgccccttctctcga

SEQ ID NO: 39743 - DNA, 37 bp, Artificial Sequence
  Synthetic oligonucleotide
tagttaccgacaccccctctccgcacagtatattcga

SEQ ID NO: 39744 - DNA, 37 bp, Artificial Sequence
  Synthetic oligonucleotide
gtactgcaccaaaagtagggggaaatgggtgggagga

SEQ ID NO: 39745 - DNA, 37 bp, Artificial Sequence
  Synthetic oligonucleotide
aaacggtggaggggtaggaggtctgttggggcgtgga

SEQ ID NO: 39746 - DNA, 37 bp, Artificial Sequence
  Synthetic oligonucleotide
ggccaaccttcaattgccttatccgatcatctttgga

SEQ ID NO: 39747 - DNA, 38 bp, Artificial Sequence
  Synthetic oligonucleotide
aagtccgggggaggggggaacggagaaggtacacatga

SEQ ID NO: 39748 - DNA, 37 bp, Artificial Sequence
  Synthetic oligonucleotide
gcacaccgttgcgctggctaaatcaacaccttcatga

SEQ ID NO: 39749 - DNA, 38 bp, Artificial Sequence
  Synthetic oligonucleotide
atgcaaactgtcatgaaccccccgacctcagtccctga

SEQ ID NO: 39750 - DNA, 37 bp, Artificial Sequence
  Synthetic oligonucleotide
actcccacccgggctattgtggtatgcctatgcctga

SEQ ID NO: 39751 - DNA, 37 bp, Artificial Sequence
  Synthetic oligonucleotide
gccatcctgctgctggttaacttcgtctctagcgtga

SEQ ID NO: 39752 - DNA, 36 bp, Artificial Sequence
  Synthetic oligonucleotide
agttccccacgtgcaattacgccctcttttttgtga

SEQ ID NO: 39753 - DNA, 38 bp, Artificial Sequence
  Synthetic oligonucleotide
tagacacgcgcaccgccggacgctcacgccattcttga

SEQ ID NO: 39754 - DNA, 36 bp, Artificial Sequence
  Synthetic oligonucleotide
tcacgcctcccttaggtcgacccgtttaacttgata

SEQ ID NO: 39755 - DNA, 36 bp, Artificial Sequence
  Synthetic oligonucleotide
tcacatctagatgctctttacgcccacgaaacccta

SEQ ID NO: 39756 - DNA, 36 bp, Artificial Sequence
  Synthetic oligonucleotide
aagggatgtagggggtggagatgagaggtgtaagta

SEQ ID NO: 39757 - DNA, 35 bp, Artificial Sequence
  Synthetic oligonucleotide
tactaccccactgtgacttcctgctagataggtta

SEQ ID NO: 39758 - DNA, 35 bp, Artificial Sequence
  Synthetic oligonucleotide
gttcgcgcttcacactgcgatacttcgcctccacc

SEQ ID NO: 39759 - DNA, 35 bp, Artificial Sequence
  Synthetic oligonucleotide
tccgccgtgacacactgaaatttaccttacgtagc

SEQ ID NO: 39760 - DNA, 35 bp, Artificial Sequence
  Synthetic oligonucleotide
ttagtgcgcatccgttattatactttattcctggc

SEQ ID NO: 39761 - DNA, 35 bp, Artificial Sequence
  Synthetic oligonucleotide
taaggtgcatgctccagcgacgcattttacctcct

SEQ ID NO: 39762 - DNA, 35 bp, Artificial Sequence
  Synthetic oligonucleotide
tcaccgcgcactccagcagtaatcggtttttatct

SEQ ID NO: 39763 - DNA, 35 bp, Artificial Sequence
  Synthetic oligonucleotide
aatcctgccccgtaatcgacccgatatgaaactct

SEQ ID NO: 39764 - DNA, 34 bp, Artificial Sequence
  Synthetic oligonucleotide
gagaatgaggggagatgggtgggcggttaattct

SEQ ID NO: 39765 - DNA, 35 bp, Artificial Sequence
  Synthetic oligonucleotide
tctaacacctcgggtaccactgaccttaatgttct

SEQ ID NO: 39766 - DNA, 35 bp, Artificial Sequence
  Synthetic oligonucleotide
acaactgggctcaaagagggggagaactctggtgt

SEQ ID NO: 39767 - DNA, 35 bp, Artificial Sequence
  Synthetic oligonucleotide
tccacggacaaacctagtaccaaccaccagtcttt

SEQ ID NO: 39768 - DNA, 36 bp, Artificial Sequence
  Synthetic oligonucleotide
tgaaggcatacgcatacgcacatccagccaccacaa

SEQ ID NO: 39769 - DNA, 36 bp, Artificial Sequence
  Synthetic oligonucleotide
gcacacaggaatggaagttacggcaatgggcggtaa

SEQ ID NO: 39770 - DNA, 35 bp, Artificial Sequence
  Synthetic oligonucleotide
tagtacccacccctgcctgcatgaacttttttaca

SEQ ID NO: 39771 - DNA, 36 bp, Artificial Sequence
  Synthetic oligonucleotide
gtgtcacgcaaggtcgttctcccatgatgatttcca

SEQ ID NO: 39772 - DNA, 36 bp, Artificial Sequence
  Synthetic oligonucleotide
gaaccgccgtggaatacgcaaaatctgtgcccatca

SEQ ID NO: 39773 - DNA, 36 bp, Artificial Sequence
  Synthetic oligonucleotide
tacatccgaaccgatcaggcacaatgctcccttaga

SEQ ID NO: 39774 - DNA, 37 bp, Artificial Sequence
  Synthetic oligonucleotide
tccccaactggtgcactctcgctgtccctgtccccga

SEQ ID NO: 39775 - DNA, 38 bp, Artificial Sequence
  Synthetic oligonucleotide
acagggtgcgcggagttgggggaggtaggtaagcttga

SEQ ID NO: 39776 - DNA, 36 bp, Artificial Sequence
  Synthetic oligonucleotide
tccgtgcccaatgtgtccttatcgcacctttcgcta

SEQ ID NO: 39777 - DNA, 35 bp, Artificial Sequence
  Synthetic oligonucleotide
gtcatccccactcctgaagtctgtgcctgctgtac

SEQ ID NO: 39778 - DNA, 35 bp, Artificial Sequence
  Synthetic oligonucleotide
accacccgaggatttattaactattacatttcccc

SEQ ID NO: 39779 - DNA, 35 bp, Artificial Sequence
  Synthetic oligonucleotide
attcccgaggaattggtcgcgtccaccatcatgcc

SEQ ID NO: 39780 - DNA, 35 bp, Artificial Sequence
  Synthetic oligonucleotide
acctcgcaactgccctcacaggatataacgttcgc

SEQ ID NO: 39781 - DNA, 35 bp, Artificial Sequence
  Synthetic oligonucleotide
actaccattgctctcagagccgcgatctttccctc

SEQ ID NO: 39782 - DNA, 35 bp, Artificial Sequence
  Synthetic oligonucleotide
ggacatctccgctactcccctctgtctgtcatttc

SEQ ID NO: 39783 - DNA, 35 bp, Artificial Sequence
  Synthetic oligonucleotide
gggtgagtgggggggtggatagcatgcccaggacg

SEQ ID NO: 39784 - DNA, 35 bp, Artificial Sequence
  Synthetic oligonucleotide
tccgcatcccttccgcttgtgaccccttagattcg

SEQ ID NO: 39785 - DNA, 35 bp, Artificial Sequence
  Synthetic oligonucleotide
tgactgtccctgccgcgtccgcccgcacctatact

SEQ ID NO: 39786 - DNA, 35 bp, Artificial Sequence
  Synthetic oligonucleotide
aaattgggagggtgggtcgagtccgggtagtaagt

SEQ ID NO: 39787 - DNA, 36 bp, Artificial Sequence
  Synthetic oligonucleotide
tctgccccccacagctagcgactccagctataccaa

SEQ ID NO: 39788 - DNA, 36 bp, Artificial Sequence
  Synthetic oligonucleotide
gatgggtggccgccaattgcctcttctcctactgaa

SEQ ID NO: 39789 - DNA, 36 bp, Artificial Sequence
  Synthetic oligonucleotide
accacaccggtgttgatacttaccgctcacgtgcca

SEQ ID NO: 39790 - DNA, 36 bp, Artificial Sequence
  Synthetic oligonucleotide
tgccacatcaacaattcgacctaacctcaggcttca

SEQ ID NO: 39791 - DNA, 36 bp, Artificial Sequence
  Synthetic oligonucleotide
atccacgcataccttgcgatacacccgatggtttca

SEQ ID NO: 39792 - DNA, 37 bp, Artificial Sequence
  Synthetic oligonucleotide
tgtagtggggtgggaaatgggcgttcccgggggaaga

SEQ ID NO: 39793 - DNA, 37 bp, Artificial Sequence
  Synthetic oligonucleotide
ggagggggtttgggcgaaatgagggtgggtcaaggga

SEQ ID NO: 39794 - DNA, 37 bp, Artificial Sequence
  Synthetic oligonucleotide
acaccccggggtccgcacattccccaactccactgga

SEQ ID NO: 39795 - DNA, 37 bp, Artificial Sequence
  Synthetic oligonucleotide
acccccaccacatagcccaccggaacattaatctgga

SEQ ID NO: 39796 - DNA, 38 bp, Artificial Sequence
  Synthetic oligonucleotide
gagctccgggcgaacgtatttccacaaaccatgcatga

SEQ ID NO: 39797 - DNA, 38 bp, Artificial Sequence
  Synthetic oligonucleotide
ggaggggggggtggagtagtggatagtgcgagctctga

SEQ ID NO: 39798 - DNA, 38 bp, Artificial Sequence
  Synthetic oligonucleotide
aacgcaccatcgatccctgtccgccctgcctgccgtga

SEQ ID NO: 39799 - DNA, 37 bp, Artificial Sequence
  Synthetic oligonucleotide
ggtaggaagaaggcgacggggaaaaagaaggaggtga

SEQ ID NO: 39800 - DNA, 38 bp, Artificial Sequence
  Synthetic oligonucleotide
tccaacacgcccctctgtaccgttttgacctcgattga

SEQ ID NO: 39801 - DNA, 38 bp, Artificial Sequence
  Synthetic oligonucleotide
ttgctgggcagtcataaggggaggggtggagcgtttga

SEQ ID NO: 39802 - DNA, 35 bp, Artificial Sequence
  Synthetic oligonucleotide
gaccggagcctcactgctctcgggaaattatacta

SEQ ID NO: 39803 - DNA, 35 bp, Artificial Sequence
  Synthetic oligonucleotide
gctcacacaccaccgagctgctccatctgccccta

SEQ ID NO: 39804 - DNA, 36 bp, Artificial Sequence
  Synthetic oligonucleotide
tgcacccttccagtatattgttcaaaccgcctgcta

SEQ ID NO: 39805 - DNA, 36 bp, Artificial Sequence
  Synthetic oligonucleotide
tgcaaccattctcgcgcgctatatggttttttgtta

SEQ ID NO: 39806 - DNA, 35 bp, Artificial Sequence
  Synthetic oligonucleotide
acacagtccgcgccgccatccgcaggaacattaac

SEQ ID NO: 39807 - DNA, 35 bp, Artificial Sequence
  Synthetic oligonucleotide
gtccaaccggattgctattcgcttcggtaattcac

SEQ ID NO: 39808 - DNA, 35 bp, Artificial Sequence
  Synthetic oligonucleotide
atcagcgccgccagctatccacgttcgcccagtac

SEQ ID NO: 39809 - DNA, 35 bp, Artificial Sequence
  Synthetic oligonucleotide
ataccaccgccttgtcacgctatattccccggtac

SEQ ID NO: 39810 - DNA, 35 bp, Artificial Sequence
  Synthetic oligonucleotide
gcccgacaaatcggtgccctagcacggtaacttcc

SEQ ID NO: 39811 - DNA, 35 bp, Artificial Sequence
  Synthetic oligonucleotide
gatgccctgccccttatccttatgcttcaaccatc

SEQ ID NO: 39812 - DNA, 35 bp, Artificial Sequence
  Synthetic oligonucleotide
tcacccgcctgaattcaccattgggctatatcgtc

SEQ ID NO: 39813 - DNA, 35 bp, Artificial Sequence
  Synthetic oligonucleotide
tacgcggtaaattggggcaaaggggtgagttatcg

SEQ ID NO: 39814 - DNA, 35 bp, Artificial Sequence
  Synthetic oligonucleotide
aaagcacccatcgcctcttgtcctccattgtatat

SEQ ID NO: 39815 - DNA, 35 bp, Artificial Sequence
  Synthetic oligonucleotide
gacttggcacagtcgcatccggatcaccatctagt

SEQ ID NO: 39816 - DNA, 35 bp, Artificial Sequence
  Synthetic oligonucleotide
gtcaccccattgcatccatacacagggtcacctgt

SEQ ID NO: 39817 - DNA, 35 bp, Artificial Sequence
  Synthetic oligonucleotide
tacgccgggtactgggctctgttttattgctaatt

SEQ ID NO: 39818 - DNA, 35 bp, Artificial Sequence
  Synthetic oligonucleotide
atcacggtcccgttttcttgcgtgccactgttttt

SEQ ID NO: 39819 - DNA, 36 bp, Artificial Sequence
  Synthetic oligonucleotide
ggagccgctaccgcatggacccgtaacctcctcaaa

SEQ ID NO: 39820 - DNA, 35 bp, Artificial Sequence
  Synthetic oligonucleotide
accaacggagtgaagtgccatatccgttcatacca

SEQ ID NO: 39821 - DNA, 36 bp, Artificial Sequence
  Synthetic oligonucleotide
gaacgtactatcgctgctaactatacagtgtaatca

SEQ ID NO: 39822 - DNA, 37 bp, Artificial Sequence
  Synthetic oligonucleotide
tgacagtcaactgggtgggagggatggtagaggtaga

SEQ ID NO: 39823 - DNA, 37 bp, Artificial Sequence
  Synthetic oligonucleotide
aacacagagggggaaaacagcacgtgggtgcagacga

SEQ ID NO: 39824 - DNA, 37 bp, Artificial Sequence
  Synthetic oligonucleotide
cacgttacgtctggtttacctttatcattctttgcga

SEQ ID NO: 39825 - DNA, 36 bp, Artificial Sequence
  Synthetic oligonucleotide
ttggagacggaaaaagcattagtgggatgggaggga

SEQ ID NO: 39826 - DNA, 38 bp, Artificial Sequence
  Synthetic oligonucleotide
agacaacgactccccatcacgctccccgttcgcactga

SEQ ID NO: 39827 - DNA, 38 bp, Artificial Sequence
  Synthetic oligonucleotide
tccacccccaatttatgttactgaaatcagttaagtga

SEQ ID NO: 39828 - DNA, 38 bp, Artificial Sequence
  Synthetic oligonucleotide
tgggacacggagaataaagggcggacggtgatgggtga

SEQ ID NO: 39829 - DNA, 38 bp, Artificial Sequence
  Synthetic oligonucleotide
acttggagccggctccgttttcgaatttgctaccttga

SEQ ID NO: 39830 - DNA, 38 bp, Artificial Sequence
  Synthetic oligonucleotide
gcatggcgccttttttcttttgcacggcctacccttga

SEQ ID NO: 39831 - DNA, 38 bp, Artificial Sequence
  Synthetic oligonucleotide
gacacaccgcagccctctcatattacggttaatcttga

SEQ ID NO: 39832 - DNA, 38 bp, Artificial Sequence
  Synthetic oligonucleotide
gccatgcactcaaattatgaatccggtcctgactttga

SEQ ID NO: 39833 - DNA, 38 bp, Artificial Sequence
  Synthetic oligonucleotide
gcagtgcgtgcgtgcgtcgattctctcttccgttttga

SEQ ID NO: 39834 - DNA, 36 bp, Artificial Sequence
  Synthetic oligonucleotide
aagccggtccacgtaccataacgccatcaccatcta

SEQ ID NO: 39835 - DNA, 35 bp, Artificial Sequence
  Synthetic oligonucleotide
acgtgtacgcccgctacctaggttccttatctcta

SEQ ID NO: 39836 - DNA, 36 bp, Artificial Sequence
  Synthetic oligonucleotide
gccccatccccactagcgctggccctacaggtcgta

SEQ ID NO: 39837 - DNA, 34 bp, Artificial Sequence
  Synthetic oligonucleotide
acctcatgcccattttatctctatgcaagctgta

SEQ ID NO: 39838 - DNA, 36 bp, Artificial Sequence
  Synthetic oligonucleotide
gttacctccatcccacgtcacgagcgaccatcttta

SEQ ID NO: 39839 - DNA, 35 bp, Artificial Sequence
  Synthetic oligonucleotide
tttgtaccgcctgctccttcccaagtgcactttta

SEQ ID NO: 39840 - DNA, 35 bp, Artificial Sequence
  Synthetic oligonucleotide
ttacgccttctgatcttacattgctcgcacgtccc

SEQ ID NO: 39841 - DNA, 35 bp, Artificial Sequence
  Synthetic oligonucleotide
ttgtgcccctaccctgcccctgggcacgtgccatc

SEQ ID NO: 39842 - DNA, 35 bp, Artificial Sequence
  Synthetic oligonucleotide
gaagcacagttcaccctgacaaccacgccgcactc

SEQ ID NO: 39843 - DNA, 35 bp, Artificial Sequence
  Synthetic oligonucleotide
atctcacccgtggtacgcggggttcatcctggttc

SEQ ID NO: 39844 - DNA, 35 bp, Artificial Sequence
  Synthetic oligonucleotide
atcctcaccgccccccacttttgcattgagatgag

SEQ ID NO: 39845 - DNA, 35 bp, Artificial Sequence
  Synthetic oligonucleotide
atgagcatgttctcaccgcaacctttcgcctgacg

SEQ ID NO: 39846 - DNA, 35 bp, Artificial Sequence
  Synthetic oligonucleotide
gaatccaccctccgtcgagaagttggcttctgacg

SEQ ID NO: 39847 - DNA, 35 bp, Artificial Sequence
  Synthetic oligonucleotide
tgtgcgagaagcagtcttttccacaccatcatggg

SEQ ID NO: 39848 - DNA, 35 bp, Artificial Sequence
  Synthetic oligonucleotide
gactggacgggggaacaaagacaatacggactcat

SEQ ID NO: 39849 - DNA, 35 bp, Artificial Sequence
  Synthetic oligonucleotide
ggtccggctcacaatcttttacagctcaactccct

SEQ ID NO: 39850 - DNA, 35 bp, Artificial Sequence
  Synthetic oligonucleotide
atgccccacaaactggtggaagttacattgtctct

SEQ ID NO: 39851 - DNA, 36 bp, Artificial Sequence
  Synthetic oligonucleotide
atcaccctcttccggcacccgtcctgcagtaccaaa

SEQ ID NO: 39852 - DNA, 35 bp, Artificial Sequence
  Synthetic oligonucleotide
gtgagcggcggagggggtgggcaggtacgggtcaa

SEQ ID NO: 39853 - DNA, 36 bp, Artificial Sequence
  Synthetic oligonucleotide
tcacgtcggtccgggcttccttggcattctcgcgaa

SEQ ID NO: 39854 - DNA, 35 bp, Artificial Sequence
  Synthetic oligonucleotide
tcctgcctaactgcgaggccttcgacttttcataa

SEQ ID NO: 39855 - DNA, 36 bp, Artificial Sequence
  Synthetic oligonucleotide
aacacgtcgcatctcagcgctcggtttcttccaaca

SEQ ID NO: 39856 - DNA, 35 bp, Artificial Sequence
  Synthetic oligonucleotide
gaggacctggacaacgggattccgactttttcaca

SEQ ID NO: 39857 - DNA, 35 bp, Artificial Sequence
  Synthetic oligonucleotide
aacgtgagctcccgcgatacctttcgaccgagaca

SEQ ID NO: 39858 - DNA, 36 bp, Artificial Sequence
  Synthetic oligonucleotide
aacacccccgtatgcatgatctctggcgactggaca

SEQ ID NO: 39859 - DNA, 36 bp, Artificial Sequence
  Synthetic oligonucleotide
gttacccctcggggtatcgtctccgttcccttgcca

SEQ ID NO: 39860 - DNA, 36 bp, Artificial Sequence
  Synthetic oligonucleotide
tacgtaccaccacttcatctgttctcccgaccccga

SEQ ID NO: 39861 - DNA, 37 bp, Artificial Sequence
  Synthetic oligonucleotide
aacagggagggattcttgttgggggggtgcacacgga

SEQ ID NO: 39862 - DNA, 37 bp, Artificial Sequence
  Synthetic oligonucleotide
atgcctcgatgggagtatgtaagtggtggagggggga

SEQ ID NO: 39863 - DNA, 38 bp, Artificial Sequence
  Synthetic oligonucleotide
actgacccgtgatttcttgctgttgtgcctgtacctga

SEQ ID NO: 39864 - DNA, 38 bp, Artificial Sequence
  Synthetic oligonucleotide
tgccgaccaggacgtccgagccacccaacctcatttga

SEQ ID NO: 39865 - DNA, 35 bp, Artificial Sequence
  Synthetic oligonucleotide
gtgctgctcaggcacgcacgcgaactaccctttga

SEQ ID NO: 39866 - DNA, 36 bp, Artificial Sequence
  Synthetic oligonucleotide
gcggatgccccgttgccttcttattctccgtcgcta

SEQ ID NO: 39867 - DNA, 36 bp, Artificial Sequence
  Synthetic oligonucleotide
gcttccagcgcttccttaatttggtcttcccacgta

SEQ ID NO: 39868 - DNA, 36 bp, Artificial Sequence
  Synthetic oligonucleotide
gtaccctgcccgttgcgcgttagacttgacctttta

SEQ ID NO: 39869 - DNA, 34 bp, Artificial Sequence
  Synthetic oligonucleotide
gccgtcactctcacacgcctgggtttcctctcac

SEQ ID NO: 39870 - DNA, 35 bp, Artificial Sequence
  Synthetic oligonucleotide
acaagtcgacagactcctgctagccaacgcctacc

SEQ ID NO: 39871 - DNA, 35 bp, Artificial Sequence
  Synthetic oligonucleotide
agatgtacttccactgtctatgcccttcgtgtacc

SEQ ID NO: 39872 - DNA, 35 bp, Artificial Sequence
  Synthetic oligonucleotide
tgaaccctcttcccgcacgaatttttacacgaccc

SEQ ID NO: 39873 - DNA, 35 bp, Artificial Sequence
  Synthetic oligonucleotide
ggaacgccctgtacgcgcggggccttacgctttcc

SEQ ID NO: 39874 - DNA, 35 bp, Artificial Sequence
  Synthetic oligonucleotide
gagaagggagggaggaacgatcggattgggcatgc

SEQ ID NO: 39875 - DNA, 35 bp, Artificial Sequence
  Synthetic oligonucleotide
tccacacctcactggaaccgaccctcctttgtaag

SEQ ID NO: 39876 - DNA, 35 bp, Artificial Sequence
  Synthetic oligonucleotide
ggtgtaccacgaggggagggcgggcaattagggag

SEQ ID NO: 39877 - DNA, 35 bp, Artificial Sequence
  Synthetic oligonucleotide
gcgaaggagggtgttacggtcgctgggggtgcatg

SEQ ID NO: 39878 - DNA, 35 bp, Artificial Sequence
  Synthetic oligonucleotide
tttcaccacccaacggcccaacaccacaggtgaat

SEQ ID NO: 39879 - DNA, 35 bp, Artificial Sequence
  Synthetic oligonucleotide
atcaaccacgctaacttacagactcccagtacatt

SEQ ID NO: 39880 - DNA, 35 bp, Artificial Sequence
  Synthetic oligonucleotide
aatcccccaatgggcatagttgcctatacatactt

SEQ ID NO: 39881 - DNA, 36 bp, Artificial Sequence
  Synthetic oligonucleotide
gtttgcccgcattgttcctgttgattccagcccaaa

SEQ ID NO: 39882 - DNA, 36 bp, Artificial Sequence
  Synthetic oligonucleotide
gccccacctccagtctttgtctcaccgccataagaa

SEQ ID NO: 39883 - DNA, 36 bp, Artificial Sequence
  Synthetic oligonucleotide
accacgttacatgcctgatactacgctcggtccaca

SEQ ID NO: 39884 - DNA, 37 bp, Artificial Sequence
  Synthetic oligonucleotide
attatccgggcggtgagggagggcaggtgctgccgga

SEQ ID NO: 39885 - DNA, 36 bp, Artificial Sequence
  Synthetic oligonucleotide
tcacggggatagtatggtcatgggagggcttaggga

SEQ ID NO: 39886 - DNA, 37 bp, Artificial Sequence
  Synthetic oligonucleotide
gcgtaagcacgacgatcggtgggaccgaggatgggga

SEQ ID NO: 39887 - DNA, 36 bp, Artificial Sequence
  Synthetic oligonucleotide
ggaaagagtagggtgaacggttgttgagtgatggga

SEQ ID NO: 39888 - DNA, 38 bp, Artificial Sequence
  Synthetic oligonucleotide
gggacgaaggtaggggatcgagggaaaggaattgatga

SEQ ID NO: 39889 - DNA, 37 bp, Artificial Sequence
  Synthetic oligonucleotide
gtgacgaaacggggtgtgggggggcgaagtggagtga

SEQ ID NO: 39890 - DNA, 38 bp, Artificial Sequence
  Synthetic oligonucleotide
aaactgcaaaaggtgcggattcctggggggatgggtga

SEQ ID NO: 39891 - DNA, 36 bp, Artificial Sequence
  Synthetic oligonucleotide
aactcgccgacttgcctactgcgctttaccatggta

SEQ ID NO: 39892 - DNA, 36 bp, Artificial Sequence
  Synthetic oligonucleotide
tcgtagacgtgcaccatctaacaccttgcttcctta

SEQ ID NO: 39893 - DNA, 36 bp, Artificial Sequence
  Synthetic oligonucleotide
gcactacatgtttcccgcgcacttagccttctctta

SEQ ID NO: 39894 - DNA, 35 bp, Artificial Sequence
  Synthetic oligonucleotide
gtccccgtaagagtcgactaaaactcgtaacctac

SEQ ID NO: 39895 - DNA, 35 bp, Artificial Sequence
  Synthetic oligonucleotide
agttcctcgcagtacattgtcacctcgcttgcacc

SEQ ID NO: 39896 - DNA, 35 bp, Artificial Sequence
  Synthetic oligonucleotide
tccataccccgtttctagtttttgctgttcggacc

SEQ ID NO: 39897 - DNA, 35 bp, Artificial Sequence
  Synthetic oligonucleotide
ataccctgcgaacatggaacccacgctgaaccccc

SEQ ID NO: 39898 - DNA, 35 bp, Artificial Sequence
  Synthetic oligonucleotide
accaacgcatgtatcaaatcaccttctctagtccc

SEQ ID NO: 39899 - DNA, 35 bp, Artificial Sequence
  Synthetic oligonucleotide
ttccatgccctctaactgcatgtcctggagatatc

SEQ ID NO: 39900 - DNA, 35 bp, Artificial Sequence
  Synthetic oligonucleotide
ttcaggggtgggtggttcctcatggttctggttag

SEQ ID NO: 39901 - DNA, 35 bp, Artificial Sequence
  Synthetic oligonucleotide
gaccgcccggtttcaccatagctccaacatattgg

SEQ ID NO: 39902 - DNA, 34 bp, Artificial Sequence
  Synthetic oligonucleotide
aaactctccacctgccgataccactgatgtcaat

SEQ ID NO: 39903 - DNA, 35 bp, Artificial Sequence
  Synthetic oligonucleotide
tatggaagggggagcgggctgggggtgggtttcct

SEQ ID NO: 39904 - DNA, 36 bp, Artificial Sequence
  Synthetic oligonucleotide
acaaagccaacaaggaaaacactcagcttacacaaa

SEQ ID NO: 39905 - DNA, 36 bp, Artificial Sequence
  Synthetic oligonucleotide
gtccacacctcatgctatgggaccgctcttactcaa

SEQ ID NO: 39906 - DNA, 36 bp, Artificial Sequence
  Synthetic oligonucleotide
ttgcgggagcttgacggcattccactcgctacctaa

SEQ ID NO: 39907 - DNA, 36 bp, Artificial Sequence
  Synthetic oligonucleotide
actcccacatgtgcagtccgcattgctcaagcccca

SEQ ID NO: 39908 - DNA, 36 bp, Artificial Sequence
  Synthetic oligonucleotide
tagaccccgtatgggaacgttctaccgacttttgca

SEQ ID NO: 39909 - DNA, 36 bp, Artificial Sequence
  Synthetic oligonucleotide
gcgaacaacggccttttgcactcgaacgcaccctca

SEQ ID NO: 39910 - DNA, 35 bp, Artificial Sequence
  Synthetic oligonucleotide
agaccaactagcctggcttataccctccgtcctca

SEQ ID NO: 39911 - DNA, 36 bp, Artificial Sequence
  Synthetic oligonucleotide
gaacaaagaaaaggacggatatcgggaaaggacaga

SEQ ID NO: 39912 - DNA, 37 bp, Artificial Sequence
  Synthetic oligonucleotide
gaacacgtaaggttcagggtgactggtcaggaggaga

SEQ ID NO: 39913 - DNA, 37 bp, Artificial Sequence
  Synthetic oligonucleotide
atacgccagagccttttgatccgactcttcttgccga

SEQ ID NO: 39914 - DNA, 37 bp, Artificial Sequence
  Synthetic oligonucleotide
gagggggtctgagggtaagaaggcgaagagggcggga

SEQ ID NO: 39915 - DNA, 38 bp, Artificial Sequence
  Synthetic oligonucleotide
acagcccggagataggggaacggagtaatgattgatga

SEQ ID NO: 39916 - DNA, 38 bp, Artificial Sequence
  Synthetic oligonucleotide
gagtagccaacctttgccgtactacaccttctccctga

SEQ ID NO: 39917 - DNA, 37 bp, Artificial Sequence
  Synthetic oligonucleotide
acccatccggtcagctaccgtcattgctttctcctga

SEQ ID NO: 39918 - DNA, 37 bp, Artificial Sequence
  Synthetic oligonucleotide
acccggtgctaatgtggcccatgcccgcccccagtga

SEQ ID NO: 39919 - DNA, 38 bp, Artificial Sequence
  Synthetic oligonucleotide
acgcgagtggggaggacgagaggaggacgcactgttga

SEQ ID NO: 39920 - DNA, 36 bp, Artificial Sequence
  Synthetic oligonucleotide
taggtccaatcgcccgtgattcctccataaacatta

SEQ ID NO: 39921 - DNA, 35 bp, Artificial Sequence
  Synthetic oligonucleotide
attgacagggaacgggaggaggatcgggtcagaac

SEQ ID NO: 39922 - DNA, 35 bp, Artificial Sequence
  Synthetic oligonucleotide
ggacatacctccccttattggcccactcatgtggc

SEQ ID NO: 39923 - DNA, 35 bp, Artificial Sequence
  Synthetic oligonucleotide
acaccgcctcatccgacacagggtatcggtcgatc

SEQ ID NO: 39924 - DNA, 35 bp, Artificial Sequence
  Synthetic oligonucleotide
gtcggaccaaatcgcctagagtcaactttctcttc

SEQ ID NO: 39925 - DNA, 35 bp, Artificial Sequence
  Synthetic oligonucleotide
ggtcaaccatagcggtggttctcgtattcccttct

SEQ ID NO: 39926 - DNA, 35 bp, Artificial Sequence
  Synthetic oligonucleotide
tgcatccagcattacgggtgtcttctttccttcgt

SEQ ID NO: 39927 - DNA, 35 bp, Artificial Sequence
  Synthetic oligonucleotide
ttcgcctcatcacgggtgcaagtctgctctctctt

SEQ ID NO: 39928 - DNA, 35 bp, Artificial Sequence
  Synthetic oligonucleotide
actttgccctgccaaagctgtttaatccatctgtt

SEQ ID NO: 39929 - DNA, 35 bp, Artificial Sequence
  Synthetic oligonucleotide
ttgccccataccgattaaccttggcaccggggttt

SEQ ID NO: 39930 - DNA, 36 bp, Artificial Sequence
  Synthetic oligonucleotide
accacgcaatcttgtatcttgtcgctacattcaaaa

SEQ ID NO: 39931 - DNA, 36 bp, Artificial Sequence
  Synthetic oligonucleotide
ttccgatcacctggccagtttagtaaacgcatgcaa

SEQ ID NO: 39932 - DNA, 36 bp, Artificial Sequence
  Synthetic oligonucleotide
gcacgccgcaccttttagggcctcgacccacccaca

SEQ ID NO: 39933 - DNA, 36 bp, Artificial Sequence
  Synthetic oligonucleotide
ggagccgcacgcaacatttgtctcttccgccgccca

SEQ ID NO: 39934 - DNA, 36 bp, Artificial Sequence
  Synthetic oligonucleotide
gtgataggcacggctctgttaatcagcattcctcca

SEQ ID NO: 39935 - DNA, 35 bp, Artificial Sequence
  Synthetic oligonucleotide
atttaatccgactgcctctacgcgtagaactctca

SEQ ID NO: 39936 - DNA, 36 bp, Artificial Sequence
  Synthetic oligonucleotide
ttcgcatagtttggccacctcttgtatcttttgtca

SEQ ID NO: 39937 - DNA, 37 bp, Artificial Sequence
  Synthetic oligonucleotide
aaagacaaaggggcgggaggagggaaaggaataaaga

SEQ ID NO: 39938 - DNA, 35 bp, Artificial Sequence
  Synthetic oligonucleotide
gggaacaggcaggagaatatggtgtgggcgtagga

SEQ ID NO: 39939 - DNA, 37 bp, Artificial Sequence
  Synthetic oligonucleotide
acaccaccggccccaccgcgcgacgctagacaccgga

SEQ ID NO: 39940 - DNA, 36 bp, Artificial Sequence
  Synthetic oligonucleotide
taagccgggaaattgaatgggggacttaggggtgga

SEQ ID NO: 39941 - DNA, 37 bp, Artificial Sequence
  Synthetic oligonucleotide
gccagacgggcacggtgggtcaacgggttggatatga

SEQ ID NO: 39942 - DNA, 36 bp, Artificial Sequence
  Synthetic oligonucleotide
gccccagagtgcaacgttgccccgtcctatccctga

SEQ ID NO: 39943 - DNA, 35 bp, Artificial Sequence
  Synthetic oligonucleotide
tttcccagcccttctatcgcttccatgccttctga

SEQ ID NO: 39944 - DNA, 38 bp, Artificial Sequence
  Synthetic oligonucleotide
caccctgcaggggcctttgcctttctgttttcgcttga

SEQ ID NO: 39945 - DNA, 38 bp, Artificial Sequence
  Synthetic oligonucleotide
gcacgcccgccgtgtgcagtacgtgccttctctgttga

SEQ ID NO: 39946 - DNA, 36 bp, Artificial Sequence
  Synthetic oligonucleotide
gtcagagaatgggaggggctagggtgagtgagtgta

SEQ ID NO: 39947 - DNA, 32 bp, Artificial Sequence
  Synthetic oligonucleotide
gccgttcatctatctgctctgttatacaccac

SEQ ID NO: 39948 - DNA, 35 bp, Artificial Sequence
  Synthetic oligonucleotide
atcccaggccgacacatgctcccctgttcacctac

SEQ ID NO: 39949 - DNA, 35 bp, Artificial Sequence
  Synthetic oligonucleotide
attgcgagcaccgaggacgcgactgctactattac

SEQ ID NO: 39950 - DNA, 35 bp, Artificial Sequence
  Synthetic oligonucleotide
cactgccccggaacacctggtccctagcactcccc

SEQ ID NO: 39951 - DNA, 35 bp, Artificial Sequence
  Synthetic oligonucleotide
gaagcgcatcggtaaaagcacgatgctgcacttcc

SEQ ID NO: 39952 - DNA, 35 bp, Artificial Sequence
  Synthetic oligonucleotide
attccgaccgttaccgcaatgtcagggtcccttcc

SEQ ID NO: 39953 - DNA, 35 bp, Artificial Sequence
  Synthetic oligonucleotide
tgcttgtccgccccagcagttatccagccgaaatc

SEQ ID NO: 39954 - DNA, 35 bp, Artificial Sequence
  Synthetic oligonucleotide
aatgtccttctgccgggtgtcccgttttcctgttc

SEQ ID NO: 39955 - DNA, 35 bp, Artificial Sequence
  Synthetic oligonucleotide
gaggagcacccggaaaggtcatcggccctccacat

SEQ ID NO: 39956 - DNA, 35 bp, Artificial Sequence
  Synthetic oligonucleotide
caccaagcctcctctctgtaatacctcgtgttact

SEQ ID NO: 39957 - DNA, 35 bp, Artificial Sequence
  Synthetic oligonucleotide
atttctcagccccacttagcttcgcgcgtatgcct

SEQ ID NO: 39958 - DNA, 35 bp, Artificial Sequence
  Synthetic oligonucleotide
ttagcgacaaggcccatcctcgtcatgttgctatt

SEQ ID NO: 39959 - DNA, 35 bp, Artificial Sequence
  Synthetic oligonucleotide
tcctactcccgcaatctccaataacgagttacgtt

SEQ ID NO: 39960 - DNA, 35 bp, Artificial Sequence
  Synthetic oligonucleotide
gattcgacccctgttctgactatttggcaccacca

SEQ ID NO: 39961 - DNA, 36 bp, Artificial Sequence
  Synthetic oligonucleotide
gagaccacgcacaatatcagccacctgtaaccagca

SEQ ID NO: 39962 - DNA, 36 bp, Artificial Sequence
  Synthetic oligonucleotide
agacgcgccattcgctccttccgcccatgtagatca

SEQ ID NO: 39963 - DNA, 37 bp, Artificial Sequence
  Synthetic oligonucleotide
gcgaacacgcacgacaagttttctctcgttggaacga

SEQ ID NO: 39964 - DNA, 37 bp, Artificial Sequence
  Synthetic oligonucleotide
ggggaggtgagcggaaataaagtaaatttgagtagga

SEQ ID NO: 39965 - DNA, 37 bp, Artificial Sequence
  Synthetic oligonucleotide
ggtcaacccactcgattcatgcatacgccccaacgga

SEQ ID NO: 39966 - DNA, 38 bp, Artificial Sequence
  Synthetic oligonucleotide
gctcagggagccgcagggctgggggaaaggtggaatga

SEQ ID NO: 39967 - DNA, 37 bp, Artificial Sequence
  Synthetic oligonucleotide
tcactatagctcctgtgcacgtttctaccacctatga

SEQ ID NO: 39968 - DNA, 37 bp, Artificial Sequence
  Synthetic oligonucleotide
tcttgaaccgccactcccgtcgcaccgctatacctga

SEQ ID NO: 39969 - DNA, 38 bp, Artificial Sequence
  Synthetic oligonucleotide
acacaccgcccggctatcaaggagagacccctgcctga

SEQ ID NO: 39970 - DNA, 38 bp, Artificial Sequence
  Synthetic oligonucleotide
aggagacgattgacgcgcacacgaaccacccactctga

SEQ ID NO: 39971 - DNA, 38 bp, Artificial Sequence
  Synthetic oligonucleotide
aaacccccgacctgtgatcatctgcataacccctctga

SEQ ID NO: 39972 - DNA, 38 bp, Artificial Sequence
  Synthetic oligonucleotide
aacgcgcacgcccccacgccccgcacaaaccacggtga

SEQ ID NO: 39973 - DNA, 38 bp, Artificial Sequence
  Synthetic oligonucleotide
tactcagcctcccacttgcgccacgcccctcatcttga

SEQ ID NO: 39974 - DNA, 36 bp, Artificial Sequence
  Synthetic oligonucleotide
atgtgcccccatttctgattactgtctcgcaactta

SEQ ID NO: 39975 - DNA, 35 bp, Artificial Sequence
  Synthetic oligonucleotide
aaccccctatcaacgtttattgtcctgctgttaac

SEQ ID NO: 39976 - DNA, 35 bp, Artificial Sequence
  Synthetic oligonucleotide
acccccccaccctccacctccaaatgataagtcac

SEQ ID NO: 39977 - DNA, 35 bp, Artificial Sequence
  Synthetic oligonucleotide
gacactctctccgcccttctttcagtttgagcagc

SEQ ID NO: 39978 - DNA, 35 bp, Artificial Sequence
  Synthetic oligonucleotide
tcgcaacccgctctcgacgccatcccagacatggc

SEQ ID NO: 39979 - DNA, 35 bp, Artificial Sequence
  Synthetic oligonucleotide
tccaccgcccgcggcacattcggagttttttctgc

SEQ ID NO: 39980 - DNA, 35 bp, Artificial Sequence
  Synthetic oligonucleotide
aatccacgagccacattgaatgctcttgctatctc

SEQ ID NO: 39981 - DNA, 35 bp, Artificial Sequence
  Synthetic oligonucleotide
acttccagtcaccaccggtgttccctctaattgtc

SEQ ID NO: 39982 - DNA, 35 bp, Artificial Sequence
  Synthetic oligonucleotide
gcgtagcccttgaccggtctgttctttctttccag

SEQ ID NO: 39983 - DNA, 33 bp, Artificial Sequence
  Synthetic oligonucleotide
gtggaccgacacactttgcgattacatgactag

SEQ ID NO: 39984 - DNA, 35 bp, Artificial Sequence
  Synthetic oligonucleotide
gattacacagcgacactcatactcctcctgaccgg

SEQ ID NO: 39985 - DNA, 35 bp, Artificial Sequence
  Synthetic oligonucleotide
gggaggttgaggaagttcagggatggagtgaatgg

SEQ ID NO: 39986 - DNA, 35 bp, Artificial Sequence
  Synthetic oligonucleotide
ttctccgcctaagtagctgaacctccactcgatct

SEQ ID NO: 39987 - DNA, 35 bp, Artificial Sequence
  Synthetic oligonucleotide
tctccattcccttctgtgtcaagcttaaccccggt

SEQ ID NO: 39988 - DNA, 35 bp, Artificial Sequence
  Synthetic oligonucleotide
gcacccgtttgtgattccgccacatcgaatgcctt

SEQ ID NO: 39989 - DNA, 35 bp, Artificial Sequence
  Synthetic oligonucleotide
gattgcacccgtttcaggtctatgtttgcctgttt

SEQ ID NO: 39990 - DNA, 36 bp, Artificial Sequence
  Synthetic oligonucleotide
attcctgccttccctatagctattttgctagacaaa

SEQ ID NO: 39991 - DNA, 36 bp, Artificial Sequence
  Synthetic oligonucleotide
aagcgggggcgtgggggggttgggaccgaatgagaa

SEQ ID NO: 39992 - DNA, 36 bp, Artificial Sequence
  Synthetic oligonucleotide
accgaccccgatcgaaccaatacccagccccgacca

SEQ ID NO: 39993 - DNA, 36 bp, Artificial Sequence
  Synthetic oligonucleotide
gcacctgtctcccacctgaaacacagaccggctcca

SEQ ID NO: 39994 - DNA, 36 bp, Artificial Sequence
  Synthetic oligonucleotide
tagatcccacgagccggcgcaacatcatcctacgca

SEQ ID NO: 39995 - DNA, 36 bp, Artificial Sequence
  Synthetic oligonucleotide
aacactcacattagttggcttctattacaccatgca

SEQ ID NO: 39996 - DNA, 37 bp, Artificial Sequence
  Synthetic oligonucleotide
ttcgggaaatgcatgggtgcaggggagggggtttaga

SEQ ID NO: 39997 - DNA, 37 bp, Artificial Sequence
  Synthetic oligonucleotide
tgtgagggcaaggggctctgaaacactacacacacga

SEQ ID NO: 39998 - DNA, 37 bp, Artificial Sequence
  Synthetic oligonucleotide
tgcacctctaacccgcaattagatcgcccctctccga

SEQ ID NO: 39999 - DNA, 37 bp, Artificial Sequence
  Synthetic oligonucleotide
agtgggaagcgagtgggtgggaggaggaggggttgga

SEQ ID NO: 40000 - DNA, 38 bp, Artificial Sequence
  Synthetic oligonucleotide
atggggcgagggggcaaggaatggggtctgttaaatga

SEQ ID NO: 40001 - DNA, 38 bp, Artificial Sequence
  Synthetic oligonucleotide
tcacggcccaggacggcagacacccgcccccgatatga

SEQ ID NO: 40002 - DNA, 38 bp, Artificial Sequence
  Synthetic oligonucleotide
ttcacatccaccgccctcgccgtcagttgccagtatga

SEQ ID NO: 40003 - DNA, 38 bp, Artificial Sequence
  Synthetic oligonucleotide
gtgacctgccctggtcctctgcctttaatctagactga

SEQ ID NO: 40004 - DNA, 35 bp, Artificial Sequence
  Synthetic oligonucleotide
tgccactggcaacaaatctatatgtacttccgtga

SEQ ID NO: 40005 - DNA, 37 bp, Artificial Sequence
  Synthetic oligonucleotide
gttgcacaatggtggatgctatgggtgggtgctgtga

SEQ ID NO: 40006 - DNA, 35 bp, Artificial Sequence
  Synthetic oligonucleotide
acacacccctcaggtacgtgttgtagtcaacccta

SEQ ID NO: 40007 - DNA, 35 bp, Artificial Sequence
  Synthetic oligonucleotide
gccttgcacgaccatctaccatatacatcgtttta

SEQ ID NO: 40008 - DNA, 35 bp, Artificial Sequence
  Synthetic oligonucleotide
gaacaacatcttattgctttggcacatctcttaac

SEQ ID NO: 40009 - DNA, 35 bp, Artificial Sequence
  Synthetic oligonucleotide
tagatcccccgctgtcatctaccgcagtcaccgac

SEQ ID NO: 40010 - DNA, 35 bp, Artificial Sequence
  Synthetic oligonucleotide
tcccgcgccttagttagtccgccttgtcatacccc

SEQ ID NO: 40011 - DNA, 35 bp, Artificial Sequence
  Synthetic oligonucleotide
tccttcccagtggttgctcttagctaggaaatccc

SEQ ID NO: 40012 - DNA, 35 bp, Artificial Sequence
  Synthetic oligonucleotide
tgactccctggccttatgactcggttgctattatc

SEQ ID NO: 40013 - DNA, 35 bp, Artificial Sequence
  Synthetic oligonucleotide
agttgcaccgggcctggtaggcttcactcacactc

SEQ ID NO: 40014 - DNA, 35 bp, Artificial Sequence
  Synthetic oligonucleotide
tcttcatccgagtgccccaggttcgttatcatttc

SEQ ID NO: 40015 - DNA, 34 bp, Artificial Sequence
  Synthetic oligonucleotide
gccattgtctctcaccatcgtttttacgccaccg

SEQ ID NO: 40016 - DNA, 35 bp, Artificial Sequence
  Synthetic oligonucleotide
gttcacgtcactccctcggtccgtaacagctgctg

SEQ ID NO: 40017 - DNA, 35 bp, Artificial Sequence
  Synthetic oligonucleotide
tctggggggtgcggggaccgtgggtggggaacgtg

SEQ ID NO: 40018 - DNA, 35 bp, Artificial Sequence
  Synthetic oligonucleotide
gcttacgtcggctagtcacctgttctatcggttat

SEQ ID NO: 40019 - DNA, 35 bp, Artificial Sequence
  Synthetic oligonucleotide
tctccctagcgcactttttatccggtacacattgt

SEQ ID NO: 40020 - DNA, 35 bp, Artificial Sequence
  Synthetic oligonucleotide
ttcaattcctggccgatacattggttgcttacttt

SEQ ID NO: 40021 - DNA, 35 bp, Artificial Sequence
  Synthetic oligonucleotide
aagaccggctcaacctccgatacacttccacgcaa

SEQ ID NO: 40022 - DNA, 36 bp, Artificial Sequence
  Synthetic oligonucleotide
accacctcctgtgcttacattttttgttctagtgaa

SEQ ID NO: 40023 - DNA, 36 bp, Artificial Sequence
  Synthetic oligonucleotide
ttcatccgccgtaccctgtggaatccggctcataca

SEQ ID NO: 40024 - DNA, 37 bp, Artificial Sequence
  Synthetic oligonucleotide
acgacccacgttctctcaattctgtccgtctagcaga

SEQ ID NO: 40025 - DNA, 37 bp, Artificial Sequence
  Synthetic oligonucleotide
ttgacgcccatcaggatgcggttctcgtcccccgcga

SEQ ID NO: 40026 - DNA, 37 bp, Artificial Sequence
  Synthetic oligonucleotide
tgatgccgtgggggaaaaagggcaagaagttggtcga

SEQ ID NO: 40027 - DNA, 38 bp, Artificial Sequence
  Synthetic oligonucleotide
gccacgtaatgtgtgctgctaccgcccctaattcatga

SEQ ID NO: 40028 - DNA, 38 bp, Artificial Sequence
  Synthetic oligonucleotide
gagaccatcccgaccgtttcatgtcagcattatcctga

SEQ ID NO: 40029 - DNA, 37 bp, Artificial Sequence
  Synthetic oligonucleotide
gcctatctgagctccgttgtgctacgctcctctctga

SEQ ID NO: 40030 - DNA, 38 bp, Artificial Sequence
  Synthetic oligonucleotide
tgcaccgcccccgcactagctcgtacaggtttccttga

SEQ ID NO: 40031 - DNA, 38 bp, Artificial Sequence
  Synthetic oligonucleotide
aaacacccgcactccctgtatacgtcatctttgcttga

SEQ ID NO: 40032 - DNA, 37 bp, Artificial Sequence
  Synthetic oligonucleotide
acgtgccggcaccttggttacgcacttattactttga

SEQ ID NO: 40033 - DNA, 38 bp, Artificial Sequence
  Synthetic oligonucleotide
gtcgctccccgcatggtgtcccgccgtatccgttttga

SEQ ID NO: 40034 - DNA, 35 bp, Artificial Sequence
  Synthetic oligonucleotide
ttcatttctcgccaccatcatgcctctatggacta

SEQ ID NO: 40035 - DNA, 36 bp, Artificial Sequence
  Synthetic oligonucleotide
attgtcacgctccacaacccctgcctccagtgctta

SEQ ID NO: 40036 - DNA, 35 bp, Artificial Sequence
  Synthetic oligonucleotide
tcgaccagcccctgtcagtcacgaacgaataccac

SEQ ID NO: 40037 - DNA, 35 bp, Artificial Sequence
  Synthetic oligonucleotide
gctgaacctcccccagcggattttttcagtcctac

SEQ ID NO: 40038 - DNA, 35 bp, Artificial Sequence
  Synthetic oligonucleotide
tgactgcgacacgcttttctccgtcgacgttctac

SEQ ID NO: 40039 - DNA, 34 bp, Artificial Sequence
  Synthetic oligonucleotide
acaactggaatatacttgaaccacgcccatgccc

SEQ ID NO: 40040 - DNA, 35 bp, Artificial Sequence
  Synthetic oligonucleotide
ttgccgcacactcagaccacctactatttttcgcc

SEQ ID NO: 40041 - DNA, 35 bp, Artificial Sequence
  Synthetic oligonucleotide
gcgatcatagcaatgatcatcgtggtccttcgctc

SEQ ID NO: 40042 - DNA, 35 bp, Artificial Sequence
  Synthetic oligonucleotide
acctgcaacagtggttcataaccttggtccttgtc

SEQ ID NO: 40043 - DNA, 35 bp, Artificial Sequence
  Synthetic oligonucleotide
acgacatcctccttgcccgcgttaccctcgtaaag

SEQ ID NO: 40044 - DNA, 34 bp, Artificial Sequence
  Synthetic oligonucleotide
acactgtcacactgcggcatacttttttttttag

SEQ ID NO: 40045 - DNA, 35 bp, Artificial Sequence
  Synthetic oligonucleotide
acactctggatctgtgctgccacgtcgctgttgcg

SEQ ID NO: 40046 - DNA, 35 bp, Artificial Sequence
  Synthetic oligonucleotide
tcactccgcgtcatatctggtccgcccctcctgtg

SEQ ID NO: 40047 - DNA, 35 bp, Artificial Sequence
  Synthetic oligonucleotide
gtcctcgacccctgttctgggtaataacctccttg

SEQ ID NO: 40048 - DNA, 35 bp, Artificial Sequence
  Synthetic oligonucleotide
gcaagggaaggtacacggggagaggggccgtggct

SEQ ID NO: 40049 - DNA, 35 bp, Artificial Sequence
  Synthetic oligonucleotide
gacctgcaccaacgctcccttattagccagtgatt

SEQ ID NO: 40050 - DNA, 35 bp, Artificial Sequence
  Synthetic oligonucleotide
ttcaccgcagacataaacgttaacctgcctgagaa

SEQ ID NO: 40051 - DNA, 36 bp, Artificial Sequence
  Synthetic oligonucleotide
tgctagtggcctcgcaggactctatttctaccccca

SEQ ID NO: 40052 - DNA, 35 bp, Artificial Sequence
  Synthetic oligonucleotide
tatcaccccatccgatttaggggctactacctcca

SEQ ID NO: 40053 - DNA, 36 bp, Artificial Sequence
  Synthetic oligonucleotide
ttgcaactacaccacgacggctctcgagcaccatca

SEQ ID NO: 40054 - DNA, 37 bp, Artificial Sequence
  Synthetic oligonucleotide
actcaccctatttgcctcatggacgttgcccttaaga

SEQ ID NO: 40055 - DNA, 37 bp, Artificial Sequence
  Synthetic oligonucleotide
atccccgcgctcgcattataccgcgttttgtcgacga

SEQ ID NO: 40056 - DNA, 37 bp, Artificial Sequence
  Synthetic oligonucleotide
aggtgcaactctgtgcaccatgaacatacccacccga

SEQ ID NO: 40057 - DNA, 37 bp, Artificial Sequence
  Synthetic oligonucleotide
gcactaaacgagctcggcttcccttccttcccgtcga

SEQ ID NO: 40058 - DNA, 37 bp, Artificial Sequence
  Synthetic oligonucleotide
gcgagccgacgcacggcttacgataaccacttaggga

SEQ ID NO: 40059 - DNA, 38 bp, Artificial Sequence
  Synthetic oligonucleotide
tgttgccagggcccttctccccacggctcattccatga

SEQ ID NO: 40060 - DNA, 38 bp, Artificial Sequence
  Synthetic oligonucleotide
tcctgctcgcccaactgcccaatttgactacgacttga

SEQ ID NO: 40061 - DNA, 37 bp, Artificial Sequence
  Synthetic oligonucleotide
gttcgcccggccgcacttatcatcctcgtcctgttga

SEQ ID NO: 40062 - DNA, 35 bp, Artificial Sequence
  Synthetic oligonucleotide
gtgacaggtagtgggcaaagtcgggagggaaatta

SEQ ID NO: 40063 - DNA, 35 bp, Artificial Sequence
  Synthetic oligonucleotide
tcaccgcatgggctagcgggcagtaatttcaccac

SEQ ID NO: 40064 - DNA, 35 bp, Artificial Sequence
  Synthetic oligonucleotide
tcaccatgagcgcccctagacgtagtgttgcatcc

SEQ ID NO: 40065 - DNA, 35 bp, Artificial Sequence
  Synthetic oligonucleotide
agtccgcataccctgccctaccttaccggactctc

SEQ ID NO: 40066 - DNA, 35 bp, Artificial Sequence
  Synthetic oligonucleotide
gtacggtacagaaagtggcatgtgtgggttgtcgg

SEQ ID NO: 40067 - DNA, 35 bp, Artificial Sequence
  Synthetic oligonucleotide
agattgtgccatgttcgacccccaattatcctttg

SEQ ID NO: 40068 - DNA, 35 bp, Artificial Sequence
  Synthetic oligonucleotide
gctcggggaaccgcacttgctcgatatttcaccct

SEQ ID NO: 40069 - DNA, 35 bp, Artificial Sequence
  Synthetic oligonucleotide
gacgacatctcgtcggtctcactaaagtttttcct

SEQ ID NO: 40070 - DNA, 35 bp, Artificial Sequence
  Synthetic oligonucleotide
gccgccaactcaccgctacgttgacgccttctctt

SEQ ID NO: 40071 - DNA, 35 bp, Artificial Sequence
  Synthetic oligonucleotide
atccaccatgctggtcactgtctcgttcctagttt

SEQ ID NO: 40072 - DNA, 36 bp, Artificial Sequence
  Synthetic oligonucleotide
tgcacaccgaccgctttccatttggttcattgacaa

SEQ ID NO: 40073 - DNA, 35 bp, Artificial Sequence
  Synthetic oligonucleotide
gacccatcttacgcgttcaacgataccgtcccgaa

SEQ ID NO: 40074 - DNA, 35 bp, Artificial Sequence
  Synthetic oligonucleotide
tgtggccccgttccttgctggacctgcccgctcca

SEQ ID NO: 40075 - DNA, 36 bp, Artificial Sequence
  Synthetic oligonucleotide
gatccacaccgtccgcatacatgcaacctgctctca

SEQ ID NO: 40076 - DNA, 37 bp, Artificial Sequence
  Synthetic oligonucleotide
actcgggttgggtgggaggagtgggtcctagtaaaga

SEQ ID NO: 40077 - DNA, 37 bp, Artificial Sequence
  Synthetic oligonucleotide
gtagacgatgaagacgagtaggaaagaatggaggaga

SEQ ID NO: 40078 - DNA, 37 bp, Artificial Sequence
  Synthetic oligonucleotide
gaaccaccactggtaacagcctgaccgcactatacga

SEQ ID NO: 40079 - DNA, 37 bp, Artificial Sequence
  Synthetic oligonucleotide
accgcaccccggccttcatattctagtctagtcccga

SEQ ID NO: 40080 - DNA, 37 bp, Artificial Sequence
  Synthetic oligonucleotide
tcatgccagtggtggaaaatacgggggatgcaagcga

SEQ ID NO: 40081 - DNA, 37 bp, Artificial Sequence
  Synthetic oligonucleotide
ataccagtcgccacgtttacgtcataggttgtcgcga

SEQ ID NO: 40082 - DNA, 37 bp, Artificial Sequence
  Synthetic oligonucleotide
agaccacctcgggaccttttccttgacactcgcagga

SEQ ID NO: 40083 - DNA, 36 bp, Artificial Sequence
  Synthetic oligonucleotide
gtggaggggacacggggacgaagaacgcgaaatgga

SEQ ID NO: 40084 - DNA, 37 bp, Artificial Sequence
  Synthetic oligonucleotide
agcgacgctgtactatgtcggcaatacctctcctgga

SEQ ID NO: 40085 - DNA, 37 bp, Artificial Sequence
  Synthetic oligonucleotide
tacagccaccctgacatatccttttcctgtctttgga

SEQ ID NO: 40086 - DNA, 38 bp, Artificial Sequence
  Synthetic oligonucleotide
tacccccgcaacctagtgttacgggaacctgataatga

SEQ ID NO: 40087 - DNA, 36 bp, Artificial Sequence
  Synthetic oligonucleotide
gaggagcatgcttgttgaacccttctcttttgctga

SEQ ID NO: 40088 - DNA, 37 bp, Artificial Sequence
  Synthetic oligonucleotide
aatgcccgcagattgtggtccgtgttccctcttctga

SEQ ID NO: 40089 - DNA, 37 bp, Artificial Sequence
  Synthetic oligonucleotide
ttaatgtcgggggaggaaaaggggctcgaaggcgtga

SEQ ID NO: 40090 - DNA, 38 bp, Artificial Sequence
  Synthetic oligonucleotide
tacgaaacgtccagactgcttctccaccgcgaatgtga

SEQ ID NO: 40091 - DNA, 36 bp, Artificial Sequence
  Synthetic oligonucleotide
gcgcccgggctagactggaacgcacctatttctcta

SEQ ID NO: 40092 - DNA, 36 bp, Artificial Sequence
  Synthetic oligonucleotide
atgtccggaggacgtctcgcctcattccccatcgta

SEQ ID NO: 40093 - DNA, 36 bp, Artificial Sequence
  Synthetic oligonucleotide
gtaccgacgtacgtgatcactgtcacctttcaatta

SEQ ID NO: 40094 - DNA, 36 bp, Artificial Sequence
  Synthetic oligonucleotide
tgtgcaggcccctgttcctgttaacacccctagtta

SEQ ID NO: 40095 - DNA, 35 bp, Artificial Sequence
  Synthetic oligonucleotide
aatcctgacccgtgtactacgctcttatactgacc

SEQ ID NO: 40096 - DNA, 35 bp, Artificial Sequence
  Synthetic oligonucleotide
tgcgctggctccgtgccgtatatcctgcgcctccc

SEQ ID NO: 40097 - DNA, 35 bp, Artificial Sequence
  Synthetic oligonucleotide
atcggggcctccatattgcacgtcataccgactcc

SEQ ID NO: 40098 - DNA, 35 bp, Artificial Sequence
  Synthetic oligonucleotide
aaccgacccgctatgacacatttctagtaccactc

SEQ ID NO: 40099 - DNA, 35 bp, Artificial Sequence
  Synthetic oligonucleotide
tcgcacttctccattcacgctcgttggttttactc

SEQ ID NO: 40100 - DNA, 34 bp, Artificial Sequence
  Synthetic oligonucleotide
tagcacgcacccctccccagctcgctcccatctg

SEQ ID NO: 40101 - DNA, 35 bp, Artificial Sequence
  Synthetic oligonucleotide
acaaggagccacctcgtatccatttatcagcattg

SEQ ID NO: 40102 - DNA, 35 bp, Artificial Sequence
  Synthetic oligonucleotide
gttgctcatcgttctcgatccacccgctcctttat

SEQ ID NO: 40103 - DNA, 35 bp, Artificial Sequence
  Synthetic oligonucleotide
tccccacacatgtattttggctatgcacccaggct

SEQ ID NO: 40104 - DNA, 35 bp, Artificial Sequence
  Synthetic oligonucleotide
tccaccgacaggattacatatgccgtcatccctgt

SEQ ID NO: 40105 - DNA, 35 bp, Artificial Sequence
  Synthetic oligonucleotide
gttacggaggcccatccactcctaaacgatcctgt

SEQ ID NO: 40106 - DNA, 35 bp, Artificial Sequence
  Synthetic oligonucleotide
ttgcctccacaatgctgcttgcggtccaataactt

SEQ ID NO: 40107 - DNA, 35 bp, Artificial Sequence
  Synthetic oligonucleotide
agccgaggatcggttgtctttagcccaatgtcctt

SEQ ID NO: 40108 - DNA, 36 bp, Artificial Sequence
  Synthetic oligonucleotide
gcaagccgtaaagtactcacctgcgttgtttgcaca

SEQ ID NO: 40109 - DNA, 36 bp, Artificial Sequence
  Synthetic oligonucleotide
aatgcaacaaggaagacacagaacggagggactgca

SEQ ID NO: 40110 - DNA, 36 bp, Artificial Sequence
  Synthetic oligonucleotide
gtggtctgcgcaatattcaccgatcaccgtttttca

SEQ ID NO: 40111 - DNA, 37 bp, Artificial Sequence
  Synthetic oligonucleotide
taacacccccttgctttgaagacgcgcgtaaatgcga

SEQ ID NO: 40112 - DNA, 37 bp, Artificial Sequence
  Synthetic oligonucleotide
actccacgcaccaccacgtctagaaggtacccttgga

SEQ ID NO: 40113 - DNA, 38 bp, Artificial Sequence
  Synthetic oligonucleotide
tcccaagctggcctgccatgactacctcaacaacctga

SEQ ID NO: 40114 - DNA, 38 bp, Artificial Sequence
  Synthetic oligonucleotide
agcccacgtccccctttatgttcgcgcatctcacctga

SEQ ID NO: 40115 - DNA, 37 bp, Artificial Sequence
  Synthetic oligonucleotide
acactgcagcactagttagtctatcatcacaccctga

SEQ ID NO: 40116 - DNA, 38 bp, Artificial Sequence
  Synthetic oligonucleotide
acgagcggtcttctgtcgttttacctactctttgctga

SEQ ID NO: 40117 - DNA, 37 bp, Artificial Sequence
  Synthetic oligonucleotide
gagagggtggaggtgtttcggagcggaatcgaggtga

SEQ ID NO: 40118 - DNA, 37 bp, Artificial Sequence
  Synthetic oligonucleotide
gagctggttaaagcagggtggacggtgggggtggtga

SEQ ID NO: 40119 - DNA, 36 bp, Artificial Sequence
  Synthetic oligonucleotide
gtagggccacgcgacctaccgtaaatgctcacctta

SEQ ID NO: 40120 - DNA, 36 bp, Artificial Sequence
  Synthetic oligonucleotide
tcccccgccgactcactaatcggaagacttccctta

SEQ ID NO: 40121 - DNA, 35 bp, Artificial Sequence
  Synthetic oligonucleotide
tccttagccctctatcgttcttcagggaatttctc

SEQ ID NO: 40122 - DNA, 35 bp, Artificial Sequence
  Synthetic oligonucleotide
tgaataggggtgacgggtgcaggggagactggaag

SEQ ID NO: 40123 - DNA, 35 bp, Artificial Sequence
  Synthetic oligonucleotide
accacactaacatcacctctgacgggactggaacg

SEQ ID NO: 40124 - DNA, 35 bp, Artificial Sequence
  Synthetic oligonucleotide
gaaagttggggatggaaatacactgatgcaagggg

SEQ ID NO: 40125 - DNA, 35 bp, Artificial Sequence
  Synthetic oligonucleotide
tagctgccctgctacaacccttactcgaatcactg

SEQ ID NO: 40126 - DNA, 35 bp, Artificial Sequence
  Synthetic oligonucleotide
gcacatgcacctttttttgatctgttactgcgctg

SEQ ID NO: 40127 - DNA, 35 bp, Artificial Sequence
  Synthetic oligonucleotide
tagataactgtcaccggtctgtcttgctctcccat

SEQ ID NO: 40128 - DNA, 35 bp, Artificial Sequence
  Synthetic oligonucleotide
gctccgattacgtcggacactttagctgaccacct

SEQ ID NO: 40129 - DNA, 35 bp, Artificial Sequence
  Synthetic oligonucleotide
atgcgccccgccttcattatttgcctggccctttt

SEQ ID NO: 40130 - DNA, 35 bp, Artificial Sequence
  Synthetic oligonucleotide
aaaatcatgaggggtgaagtggagggcaggtgaaa

SEQ ID NO: 40131 - DNA, 36 bp, Artificial Sequence
  Synthetic oligonucleotide
gtgagcccactctgcctttcgcagtcattatgccaa

SEQ ID NO: 40132 - DNA, 36 bp, Artificial Sequence
  Synthetic oligonucleotide
agtaggaagggggggaaatacactggtaaaatgcaa

SEQ ID NO: 40133 - DNA, 36 bp, Artificial Sequence
  Synthetic oligonucleotide
acatccagctgttattgaatcagctgttcattttaa

SEQ ID NO: 40134 - DNA, 36 bp, Artificial Sequence
  Synthetic oligonucleotide
tgtgacgggcggactcatggggggatgatgggggca

SEQ ID NO: 40135 - DNA, 36 bp, Artificial Sequence
  Synthetic oligonucleotide
gatcgctgccagcaccctctgccaattgtcattgca

SEQ ID NO: 40136 - DNA, 36 bp, Artificial Sequence
  Synthetic oligonucleotide
cataagcacccgcctggtaccgtgcgtgctaaatca

SEQ ID NO: 40137 - DNA, 35 bp, Artificial Sequence
  Synthetic oligonucleotide
ttacgccacgcctgcccacattcaatcttatatca

SEQ ID NO: 40138 - DNA, 36 bp, Artificial Sequence
  Synthetic oligonucleotide
gtgctgcaaaggtgtttgtctctccttcctccttca

SEQ ID NO: 40139 - DNA, 37 bp, Artificial Sequence
  Synthetic oligonucleotide
gtacggagtcgacgcgcatcttcttttttctctccga

SEQ ID NO: 40140 - DNA, 37 bp, Artificial Sequence
  Synthetic oligonucleotide
gtttgcaagcgtaggttggggcgggtggaagggagga

SEQ ID NO: 40141 - DNA, 37 bp, Artificial Sequence
  Synthetic oligonucleotide
gcatgtcctcagctgtcctcttcgcacttaatgctga

SEQ ID NO: 40142 - DNA, 37 bp, Artificial Sequence
  Synthetic oligonucleotide
tgccagcccgttagccttggttgccttgattttctga

SEQ ID NO: 40143 - DNA, 38 bp, Artificial Sequence
  Synthetic oligonucleotide
aacttagtgacagggggggataaaagggcaaagagtga

SEQ ID NO: 40144 - DNA, 35 bp, Artificial Sequence
  Synthetic oligonucleotide
gtatccgctacagtgtcacctcactcccgccgtga

SEQ ID NO: 40145 - DNA, 38 bp, Artificial Sequence
  Synthetic oligonucleotide
tgaagtggcaagtgggagggacagctaggggggggtga

SEQ ID NO: 40146 - DNA, 38 bp, Artificial Sequence
  Synthetic oligonucleotide
tgttcgtcaagcgcttggcccttcattcttccttgtga

SEQ ID NO: 40147 - DNA, 38 bp, Artificial Sequence
  Synthetic oligonucleotide
ttgccgacgggggtctcactgcccttacttgctcttga

SEQ ID NO: 40148 - DNA, 38 bp, Artificial Sequence
  Synthetic oligonucleotide
gcataggggtcatcgggcgaaaggggtgaaggggttga

SEQ ID NO: 40149 - DNA, 38 bp, Artificial Sequence
  Synthetic oligonucleotide
gtgcgatcggactcaccttaccgccacactctttttga

SEQ ID NO: 40150 - DNA, 36 bp, Artificial Sequence
  Synthetic oligonucleotide
agttcgcgggtggcttatctcagcgttcttgcccta

SEQ ID NO: 40151 - DNA, 36 bp, Artificial Sequence
  Synthetic oligonucleotide
atccagccgtaatgcgccgcccgctcacctatttta

SEQ ID NO: 40152 - DNA, 35 bp, Artificial Sequence
  Synthetic oligonucleotide
tcagactgctccaatcccggcgccgatttacttgc

SEQ ID NO: 40153 - DNA, 35 bp, Artificial Sequence
  Synthetic oligonucleotide
tcccgtacgtaacggccgaatcacccaggctcatc

SEQ ID NO: 40154 - DNA, 35 bp, Artificial Sequence
  Synthetic oligonucleotide
acgttctccctaggccctgctcgtactggcttatc

SEQ ID NO: 40155 - DNA, 35 bp, Artificial Sequence
  Synthetic oligonucleotide
agcgatggagcagttggagggacggagatgtttag

SEQ ID NO: 40156 - DNA, 35 bp, Artificial Sequence
  Synthetic oligonucleotide
tttcacgcccacgtccatcccggctcaggccaccg

SEQ ID NO: 40157 - DNA, 35 bp, Artificial Sequence
  Synthetic oligonucleotide
acccggagcccacttagtttatcccattttaggtg

SEQ ID NO: 40158 - DNA, 35 bp, Artificial Sequence
  Synthetic oligonucleotide
aacacactgtaccgagctcgatgtctcctgccgat

SEQ ID NO: 40159 - DNA, 35 bp, Artificial Sequence
  Synthetic oligonucleotide
acatttggcccatcctttcccacggacctctgcct

SEQ ID NO: 40160 - DNA, 35 bp, Artificial Sequence
  Synthetic oligonucleotide
tcactatgatccgcaccatgtttgtacctcttcct

SEQ ID NO: 40161 - DNA, 35 bp, Artificial Sequence
  Synthetic oligonucleotide
gtccacaccgcaactattatgcagagccaccatgt

SEQ ID NO: 40162 - DNA, 36 bp, Artificial Sequence
  Synthetic oligonucleotide
gcaaaagggcatcaggagggcgggcgccgggaaaaa

SEQ ID NO: 40163 - DNA, 35 bp, Artificial Sequence
  Synthetic oligonucleotide
ttcgccctccgtcctatggcactgtccctccaaaa

SEQ ID NO: 40164 - DNA, 36 bp, Artificial Sequence
  Synthetic oligonucleotide
tgatcacatcaaattcccacgtgttccgttttccaa

SEQ ID NO: 40165 - DNA, 36 bp, Artificial Sequence
  Synthetic oligonucleotide
gtcaccctaactaccatgtaatgccaccgatatgaa

SEQ ID NO: 40166 - DNA, 35 bp, Artificial Sequence
  Synthetic oligonucleotide
gactaaccctcgcctatcactgtgttaacgtctca

SEQ ID NO: 40167 - DNA, 37 bp, Artificial Sequence
  Synthetic oligonucleotide
ttgcgggggaaacgggggagacggggccaagcagaga

SEQ ID NO: 40168 - DNA, 36 bp, Artificial Sequence
  Synthetic oligonucleotide
gtgctctccccgccgtttactcgttccctccggaga

SEQ ID NO: 40169 - DNA, 37 bp, Artificial Sequence
  Synthetic oligonucleotide
acatagcgggattgttaaacggggtggaaggggagga

SEQ ID NO: 40170 - DNA, 38 bp, Artificial Sequence
  Synthetic oligonucleotide
acccaccatcatccgtcgaacatgaacatgactaatga

SEQ ID NO: 40171 - DNA, 38 bp, Artificial Sequence
  Synthetic oligonucleotide
tggaacccgctgcccccctgagcccgacacgaatatga

SEQ ID NO: 40172 - DNA, 38 bp, Artificial Sequence
  Synthetic oligonucleotide
actcaccgttcacctacctcgctcactgtttgacctga

SEQ ID NO: 40173 - DNA, 38 bp, Artificial Sequence
  Synthetic oligonucleotide
tatacgcaggccacatatatctcccgtctgtcccctga

SEQ ID NO: 40174 - DNA, 37 bp, Artificial Sequence
  Synthetic oligonucleotide
gagtgaagtagggtggggttaaaggctttgagggtga

SEQ ID NO: 40175 - DNA, 38 bp, Artificial Sequence
  Synthetic oligonucleotide
aaaggggaggtacaagcatgggggaggtatgggggtga

SEQ ID NO: 40176 - DNA, 35 bp, Artificial Sequence
  Synthetic oligonucleotide
aagccacttgcgccgcccgccctttattaacttga

SEQ ID NO: 40177 - DNA, 37 bp, Artificial Sequence
  Synthetic oligonucleotide
tcgcactgatcacatagcacttaagcatctcccttga

SEQ ID NO: 40178 - DNA, 37 bp, Artificial Sequence
  Synthetic oligonucleotide
gtgtgaggcggagaggggtttcgggcgtttgagttga

SEQ ID NO: 40179 - DNA, 36 bp, Artificial Sequence
  Synthetic oligonucleotide
actccaatcccaatggccacacgactacgggcacta

SEQ ID NO: 40180 - DNA, 36 bp, Artificial Sequence
  Synthetic oligonucleotide
acacatccggaaaccctgcgcactagcttatcgcta

SEQ ID NO: 40181 - DNA, 36 bp, Artificial Sequence
  Synthetic oligonucleotide
gcacctcctgagatttagtttacctgtcaccctcta

SEQ ID NO: 40182 - DNA, 35 bp, Artificial Sequence
  Synthetic oligonucleotide
tacaaccacatgacgtttgtacccaatcgctttta

SEQ ID NO: 40183 - DNA, 35 bp, Artificial Sequence
  Synthetic oligonucleotide
ttcacaccgccaatcgttcatatccttttgaacac

SEQ ID NO: 40184 - DNA, 35 bp, Artificial Sequence
  Synthetic oligonucleotide
gtatggtgcgcctccgttcgctccccagttattcc

SEQ ID NO: 40185 - DNA, 35 bp, Artificial Sequence
  Synthetic oligonucleotide
gaccagagtgcaagtagtagggtgctgggggaggc

SEQ ID NO: 40186 - DNA, 35 bp, Artificial Sequence
  Synthetic oligonucleotide
acctcgacccctgttggtatggccgatcctggctc

SEQ ID NO: 40187 - DNA, 35 bp, Artificial Sequence
  Synthetic oligonucleotide
tagcatactccgttgagtcgtccgggtcccttctc

SEQ ID NO: 40188 - DNA, 35 bp, Artificial Sequence
  Synthetic oligonucleotide
ttacaccactggagcctacgtttacaacataaacg

SEQ ID NO: 40189 - DNA, 35 bp, Artificial Sequence
  Synthetic oligonucleotide
tatattcccgtcccggtcacgttccttcacaagtt

SEQ ID NO: 40190 - DNA, 35 bp, Artificial Sequence
  Synthetic oligonucleotide
agccaccggtcgttcccttcagctcaattggcttt

SEQ ID NO: 40191 - DNA, 35 bp, Artificial Sequence
  Synthetic oligonucleotide
tgtggtgcgatcccactgtctctccttgggtgttt

SEQ ID NO: 40192 - DNA, 36 bp, Artificial Sequence
  Synthetic oligonucleotide
tgatgtgtagtaccgtctaacaccgctcctccataa

SEQ ID NO: 40193 - DNA, 36 bp, Artificial Sequence
  Synthetic oligonucleotide
actcttacgtcctcggtatctgcacccttctcacca

SEQ ID NO: 40194 - DNA, 35 bp, Artificial Sequence
  Synthetic oligonucleotide
accaacattccacagccgagcctacgagtggccca

SEQ ID NO: 40195 - DNA, 35 bp, Artificial Sequence
  Synthetic oligonucleotide
tatacggccccaacgcatacgcccttactcaccga

SEQ ID NO: 40196 - DNA, 37 bp, Artificial Sequence
  Synthetic oligonucleotide
gactcacacctgatacttactaccaaggaccacccga

SEQ ID NO: 40197 - DNA, 37 bp, Artificial Sequence
  Synthetic oligonucleotide
acgccgaggtgcccgccgcccctgtgtcctttcccga

SEQ ID NO: 40198 - DNA, 37 bp, Artificial Sequence
  Synthetic oligonucleotide
tgccacctgtctgctttatttcggttcaatatgtcga

SEQ ID NO: 40199 - DNA, 36 bp, Artificial Sequence
  Synthetic oligonucleotide
atgggcagaagggttggcatgggaatcggggaggga

SEQ ID NO: 40200 - DNA, 36 bp, Artificial Sequence
  Synthetic oligonucleotide
aagcctaggagagggacaagcagggcgtggcgggga

SEQ ID NO: 40201 - DNA, 37 bp, Artificial Sequence
  Synthetic oligonucleotide
ttaccacccgctcgcgtatgtattttccccacttgga

SEQ ID NO: 40202 - DNA, 37 bp, Artificial Sequence
  Synthetic oligonucleotide
tgtggctcaaagccgcgttacctctgcccccttatga

SEQ ID NO: 40203 - DNA, 35 bp, Artificial Sequence
  Synthetic oligonucleotide
acgccgacggccctcatctatctatctgttactga

SEQ ID NO: 40204 - DNA, 38 bp, Artificial Sequence
  Synthetic oligonucleotide
gataggggtggggtacggaggatagcagcagtctttga

SEQ ID NO: 40205 - DNA, 38 bp, Artificial Sequence
  Synthetic oligonucleotide
taacaacctcggccgtatcaaacatcgttccattttga

SEQ ID NO: 40206 - DNA, 35 bp, Artificial Sequence
  Synthetic oligonucleotide
attacccacgacggtacctcagacacctctgaaac

SEQ ID NO: 40207 - DNA, 35 bp, Artificial Sequence
  Synthetic oligonucleotide
ccacggggccgcatataacaagattccacccacac

SEQ ID NO: 40208 - DNA, 35 bp, Artificial Sequence
  Synthetic oligonucleotide
ctattggcccgctaccatgaccgttattgcgtcac

SEQ ID NO: 40209 - DNA, 35 bp, Artificial Sequence
  Synthetic oligonucleotide
gacccggcaccgatcggtcctgggcactccaaccc

SEQ ID NO: 40210 - DNA, 35 bp, Artificial Sequence
  Synthetic oligonucleotide
acacctgccaaacgcagccccaagccactgtggtc

SEQ ID NO: 40211 - DNA, 35 bp, Artificial Sequence
  Synthetic oligonucleotide
tcgcccctccgcttggttcttgctcctcttggtag

SEQ ID NO: 40212 - DNA, 34 bp, Artificial Sequence
  Synthetic oligonucleotide
cttgggtcgcctttacagtcattgctaccaacct

SEQ ID NO: 40213 - DNA, 35 bp, Artificial Sequence
  Synthetic oligonucleotide
gcacccggctcaccctgataccgcaactgcatgct

SEQ ID NO: 40214 - DNA, 35 bp, Artificial Sequence
  Synthetic oligonucleotide
tgctgcctgcaagtaaggtcgcgccctgctctctt

SEQ ID NO: 40215 - DNA, 35 bp, Artificial Sequence
  Synthetic oligonucleotide
tacccacttccgacgcgcccagcccgcaatttcaa

SEQ ID NO: 40216 - DNA, 31 bp, Artificial Sequence
  Synthetic oligonucleotide
aaccttggcaccatctactcactccgttaca

SEQ ID NO: 40217 - DNA, 37 bp, Artificial Sequence
  Synthetic oligonucleotide
gaatagtcagctcgaacgggtagggtggggcatgaga

SEQ ID NO: 40218 - DNA, 37 bp, Artificial Sequence
  Synthetic oligonucleotide
gaaaccgtgcccatgtgcttacttttcgcatactaga

SEQ ID NO: 40219 - DNA, 37 bp, Artificial Sequence
  Synthetic oligonucleotide
gtgtcagccaccatttctgcatccctcctagcctaga

SEQ ID NO: 40220 - DNA, 37 bp, Artificial Sequence
  Synthetic oligonucleotide
atgctccacacaacggccatctacatcgattttccga

SEQ ID NO: 40221 - DNA, 36 bp, Artificial Sequence
  Synthetic oligonucleotide
gcacgcaccgtccattcccgtcacaattgaagtcga

SEQ ID NO: 40222 - DNA, 37 bp, Artificial Sequence
  Synthetic oligonucleotide
ggtcatgggggagcggaaaggggctcggcttgaagga

SEQ ID NO: 40223 - DNA, 37 bp, Artificial Sequence
  Synthetic oligonucleotide
gtgcgcccacgtgcattggcacctccgcctttttgga

SEQ ID NO: 40224 - DNA, 38 bp, Artificial Sequence
  Synthetic oligonucleotide
tcccaggccgtcccagtagtccccagcctatcacatga

SEQ ID NO: 40225 - DNA, 38 bp, Artificial Sequence
  Synthetic oligonucleotide
gatcccagaagagggggctagggtgggaactgaggtga

SEQ ID NO: 40226 - DNA, 38 bp, Artificial Sequence
  Synthetic oligonucleotide
gatggtcgaggggggtggaagcaaaggttcaagtgtga

SEQ ID NO: 40227 - DNA, 37 bp, Artificial Sequence
  Synthetic oligonucleotide
acacacgcctgtacgcctagttttgccatttacttga

SEQ ID NO: 40228 - DNA, 36 bp, Artificial Sequence
  Synthetic oligonucleotide
tgcactaaccccggtcattggcactgcttagcacta

SEQ ID NO: 40229 - DNA, 36 bp, Artificial Sequence
  Synthetic oligonucleotide
tacctacactccgggtgcatttactggaaatctcta

SEQ ID NO: 40230 - DNA, 35 bp, Artificial Sequence
  Synthetic oligonucleotide
gataccttcgaggcctcctcctgtcgtgcgactcc

SEQ ID NO: 40231 - DNA, 35 bp, Artificial Sequence
  Synthetic oligonucleotide
attggcattcattccgccttggttcttgctccagc

SEQ ID NO: 40232 - DNA, 35 bp, Artificial Sequence
  Synthetic oligonucleotide
atacctcgcgatctgttctgtcgacccccaaatgc

SEQ ID NO: 40233 - DNA, 35 bp, Artificial Sequence
  Synthetic oligonucleotide
tagtacgacgagattgacctcgctcgtccctcatc

SEQ ID NO: 40234 - DNA, 35 bp, Artificial Sequence
  Synthetic oligonucleotide
acctactgggtccaccattgtctcaagcctttccg

SEQ ID NO: 40235 - DNA, 35 bp, Artificial Sequence
  Synthetic oligonucleotide
aatgaggggaagggggtacggggtatgttcgtagg

SEQ ID NO: 40236 - DNA, 35 bp, Artificial Sequence
  Synthetic oligonucleotide
aagtcgacggctgacacacccatctttccctgcgg

SEQ ID NO: 40237 - DNA, 35 bp, Artificial Sequence
  Synthetic oligonucleotide
atgctcccctgttctcatggcacccctccccaggg

SEQ ID NO: 40238 - DNA, 35 bp, Artificial Sequence
  Synthetic oligonucleotide
acaccaccggttagagcgcagactcgccctctttg

SEQ ID NO: 40239 - DNA, 35 bp, Artificial Sequence
  Synthetic oligonucleotide
gggggaggggggctcagttaatatagggcggtttg

SEQ ID NO: 40240 - DNA, 35 bp, Artificial Sequence
  Synthetic oligonucleotide
tacctcgaccagctcacgggtacgtcgtcacctct

SEQ ID NO: 40241 - DNA, 35 bp, Artificial Sequence
  Synthetic oligonucleotide
attgcgttagcgactgtaccatctgtcaatacctt

SEQ ID NO: 40242 - DNA, 36 bp, Artificial Sequence
  Synthetic oligonucleotide
gcagtcagaaggcgggagggccgggggcgttacgaa

SEQ ID NO: 40243 - DNA, 36 bp, Artificial Sequence
  Synthetic oligonucleotide
aagcctacgtggaggatgtactagctgtggggggaa

SEQ ID NO: 40244 - DNA, 35 bp, Artificial Sequence
  Synthetic oligonucleotide
tcatccgcattgatttttcgcccatcagcctttaa

SEQ ID NO: 40245 - DNA, 36 bp, Artificial Sequence
  Synthetic oligonucleotide
tcatgtcaactggttgccatgaaccaccctttccca

SEQ ID NO: 40246 - DNA, 36 bp, Artificial Sequence
  Synthetic oligonucleotide
tctccgcactgattcgctgtccatgcctatcccgca

SEQ ID NO: 40247 - DNA, 35 bp, Artificial Sequence
  Synthetic oligonucleotide
tacatgggaccggggagggaggggtaaacgtggca

SEQ ID NO: 40248 - DNA, 36 bp, Artificial Sequence
  Synthetic oligonucleotide
gaccaccatccctgcactacgtacttgagccctgca

SEQ ID NO: 40249 - DNA, 37 bp, Artificial Sequence
  Synthetic oligonucleotide
gtgcggggaatgggggtaaggagggtagaagtttaga

SEQ ID NO: 40250 - DNA, 37 bp, Artificial Sequence
  Synthetic oligonucleotide
atagcttgcgactgtaaccccccctgcgtttgtccga

SEQ ID NO: 40251 - DNA, 37 bp, Artificial Sequence
  Synthetic oligonucleotide
atacggtccacacaattgtacgccccactcctctcga

SEQ ID NO: 40252 - DNA, 37 bp, Artificial Sequence
  Synthetic oligonucleotide
gttcctacgccatcatccccccctagtccgttttcga

SEQ ID NO: 40253 - DNA, 37 bp, Artificial Sequence
  Synthetic oligonucleotide
gagttgcgcactttcatacaccaatgacccccgagga

SEQ ID NO: 40254 - DNA, 38 bp, Artificial Sequence
  Synthetic oligonucleotide
aacgctctgccctctctacgcgctctgtcattgactga

SEQ ID NO: 40255 - DNA, 38 bp, Artificial Sequence
  Synthetic oligonucleotide
ttatcacctctcgcacccgttgtatgtcgatcacctga

SEQ ID NO: 40256 - DNA, 38 bp, Artificial Sequence
  Synthetic oligonucleotide
gcccccactcgatatcccagacacttctgaacatctga

SEQ ID NO: 40257 - DNA, 38 bp, Artificial Sequence
  Synthetic oligonucleotide
agagggaaggggaagacgagcggcggaacgaaaggtga

SEQ ID NO: 40258 - DNA, 36 bp, Artificial Sequence
  Synthetic oligonucleotide
tcataggcggtttgcatcctctcctgttaccggtga

SEQ ID NO: 40259 - DNA, 37 bp, Artificial Sequence
  Synthetic oligonucleotide
atccacgtgtcccgtacggcttattacctctacttga

SEQ ID NO: 40260 - DNA, 35 bp, Artificial Sequence
  Synthetic oligonucleotide
tgactccgaaccaatcatatgctacgtccgcgccc

SEQ ID NO: 40261 - DNA, 35 bp, Artificial Sequence
  Synthetic oligonucleotide
gccatttgcccaaccacaatagaatacaccatgcc

SEQ ID NO: 40262 - DNA, 35 bp, Artificial Sequence
  Synthetic oligonucleotide
tagagcctactgaataagtacctggcctctcctcc

SEQ ID NO: 40263 - DNA, 33 bp, Artificial Sequence
  Synthetic oligonucleotide
aatttcgacccgcgcgagtacctatcgttctcc

SEQ ID NO: 40264 - DNA, 35 bp, Artificial Sequence
  Synthetic oligonucleotide
gtgtcttcacgcggcatcatttctagcccccgtcc

SEQ ID NO: 40265 - DNA, 35 bp, Artificial Sequence
  Synthetic oligonucleotide
gcaacgccgcacggtcgtccactcagctacgttcc

SEQ ID NO: 40266 - DNA, 35 bp, Artificial Sequence
  Synthetic oligonucleotide
ggcccacgtatcgttgcgcttaccaccccaatcgc

SEQ ID NO: 40267 - DNA, 35 bp, Artificial Sequence
  Synthetic oligonucleotide
taattcacgtccaatgccctgtcttgccccgcccg

SEQ ID NO: 40268 - DNA, 35 bp, Artificial Sequence
  Synthetic oligonucleotide
gccaggcgcagcttacccttaagttccttccccgg

SEQ ID NO: 40269 - DNA, 35 bp, Artificial Sequence
  Synthetic oligonucleotide
acacttgaatcccgccgctccagtaccctttcgtg

SEQ ID NO: 40270 - DNA, 35 bp, Artificial Sequence
  Synthetic oligonucleotide
ggatggaggggtagggagaaacggcagtataggtg

SEQ ID NO: 40271 - DNA, 35 bp, Artificial Sequence
  Synthetic oligonucleotide
accatgctgctggggactctagttcatcgctccct

SEQ ID NO: 40272 - DNA, 35 bp, Artificial Sequence
  Synthetic oligonucleotide
ccacatcctcagcgagatctgacccccttgccgct

SEQ ID NO: 40273 - DNA, 35 bp, Artificial Sequence
  Synthetic oligonucleotide
agcagtgcctgggacgggagggctggggcgatcgt

SEQ ID NO: 40274 - DNA, 36 bp, Artificial Sequence
  Synthetic oligonucleotide
gcgcaagggcgaaactacattcacagcacgaaaaca

SEQ ID NO: 40275 - DNA, 36 bp, Artificial Sequence
  Synthetic oligonucleotide
tatcccgctctcgtaaagccgaccgttatcacacca

SEQ ID NO: 40276 - DNA, 36 bp, Artificial Sequence
  Synthetic oligonucleotide
tccgcatccggaactcttttcctcagggttctacca

SEQ ID NO: 40277 - DNA, 35 bp, Artificial Sequence
  Synthetic oligonucleotide
acttgacctgcccacctatcaaacgcgacgtttca

SEQ ID NO: 40278 - DNA, 37 bp, Artificial Sequence
  Synthetic oligonucleotide
actggaagtagaaaagggctaaggagggtgggtgaga

SEQ ID NO: 40279 - DNA, 37 bp, Artificial Sequence
  Synthetic oligonucleotide
gactgccaacgacagggcagtacacgtacagtcacga

SEQ ID NO: 40280 - DNA, 37 bp, Artificial Sequence
  Synthetic oligonucleotide
gatggtcaaagtcgggagagggggggcgtgggcgcga

SEQ ID NO: 40281 - DNA, 36 bp, Artificial Sequence
  Synthetic oligonucleotide
gacccagcgttgcggttcgtcacctttcgccatcga

SEQ ID NO: 40282 - DNA, 38 bp, Artificial Sequence
  Synthetic oligonucleotide
gtgggccttggggtagggtgggtgtcatgggtcactga

SEQ ID NO: 40283 - DNA, 38 bp, Artificial Sequence
  Synthetic oligonucleotide
gactaccctcacgtaatttaacgttctgcctggcctga

SEQ ID NO: 40284 - DNA, 38 bp, Artificial Sequence
  Synthetic oligonucleotide
acttcagggcacatatgcccatatagtccttctcctga

SEQ ID NO: 40285 - DNA, 38 bp, Artificial Sequence
  Synthetic oligonucleotide
gttaccccccgatagtgaatgccatgctctacaagtga

SEQ ID NO: 40286 - DNA, 38 bp, Artificial Sequence
  Synthetic oligonucleotide
gcggtggtggaaaggtagacgggatggatctggagtga

SEQ ID NO: 40287 - DNA, 37 bp, Artificial Sequence
  Synthetic oligonucleotide
gccactacctgccagacccatcatgttacgaccttga

SEQ ID NO: 40288 - DNA, 38 bp, Artificial Sequence
  Synthetic oligonucleotide
tgatcgcccgcaccatagggaggacttctacatcttga

SEQ ID NO: 40289 - DNA, 35 bp, Artificial Sequence
  Synthetic oligonucleotide
tctggtgacaggacggactgctcgaatgatgttga

SEQ ID NO: 40290 - DNA, 36 bp, Artificial Sequence
  Synthetic oligonucleotide
ataaatgtccgcctgtctgtcctagccttcattgta

SEQ ID NO: 40291 - DNA, 35 bp, Artificial Sequence
  Synthetic oligonucleotide
tctgactcccctgggccgattacttcggcactcac

SEQ ID NO: 40292 - DNA, 35 bp, Artificial Sequence
  Synthetic oligonucleotide
atcgttcatgcatgcccttgccgcccagacactac

SEQ ID NO: 40293 - DNA, 35 bp, Artificial Sequence
  Synthetic oligonucleotide
aaacgcaagctccccgacctaagtccctcgtatgc

SEQ ID NO: 40294 - DNA, 35 bp, Artificial Sequence
  Synthetic oligonucleotide
gctttgccggagtgcttttctcgtctcacctcatc

SEQ ID NO: 40295 - DNA, 35 bp, Artificial Sequence
  Synthetic oligonucleotide
tgccagagcaatctaatttgttagccctagccttc

SEQ ID NO: 40296 - DNA, 35 bp, Artificial Sequence
  Synthetic oligonucleotide
gccctccaacgttcgccgccccacctgaattggcg

SEQ ID NO: 40297 - DNA, 35 bp, Artificial Sequence
  Synthetic oligonucleotide
gactgcaaacctccccatccacacatgattccatg

SEQ ID NO: 40298 - DNA, 35 bp, Artificial Sequence
  Synthetic oligonucleotide
ggacagtccacggtcctgtcttaacactctactgt

SEQ ID NO: 40299 - DNA, 35 bp, Artificial Sequence
  Synthetic oligonucleotide
agacctcacacgtactcgcgttcccttttggattt

SEQ ID NO: 40300 - DNA, 36 bp, Artificial Sequence
  Synthetic oligonucleotide
actccagcactttccatgtcccctgtcgcttatgaa

SEQ ID NO: 40301 - DNA, 36 bp, Artificial Sequence
  Synthetic oligonucleotide
tacagacccgccccgatatttgcccaccagtgctca

SEQ ID NO: 40302 - DNA, 37 bp, Artificial Sequence
  Synthetic oligonucleotide
accactcagcacccctgcgaaccacctcccacccaga

SEQ ID NO: 40303 - DNA, 37 bp, Artificial Sequence
  Synthetic oligonucleotide
gcgggctatgccgcgcctttcctacgttacaccacga

SEQ ID NO: 40304 - DNA, 35 bp, Artificial Sequence
  Synthetic oligonucleotide
agcatagcggggattccgcaccaccaccaccacga

SEQ ID NO: 40305 - DNA, 36 bp, Artificial Sequence
  Synthetic oligonucleotide
attccagggcgatgctctatgcctcgtaacacccga

SEQ ID NO: 40306 - DNA, 35 bp, Artificial Sequence
  Synthetic oligonucleotide
tgtactgtaccatctgcttaatcgtcgctccagga

SEQ ID NO: 40307 - DNA, 37 bp, Artificial Sequence
  Synthetic oligonucleotide
aatcatcccgccgactgccctaggcatcctcctcgga

SEQ ID NO: 40308 - DNA, 37 bp, Artificial Sequence
  Synthetic oligonucleotide
atggtggggcgaaaggaagtaggcggagcaccctgga

SEQ ID NO: 40309 - DNA, 38 bp, Artificial Sequence
  Synthetic oligonucleotide
gtgccgccaacgttaaactctcccgccttactgcatga

SEQ ID NO: 40310 - DNA, 38 bp, Artificial Sequence
  Synthetic oligonucleotide
tgtcgtgggggggatcaggggcaagtagaggaggatga

SEQ ID NO: 40311 - DNA, 38 bp, Artificial Sequence
  Synthetic oligonucleotide
gccgaccgccccgatatattgctgtttgtcttggatga

SEQ ID NO: 40312 - DNA, 37 bp, Artificial Sequence
  Synthetic oligonucleotide
taaccgccacgttctgcggaccgcccatacacactga

SEQ ID NO: 40313 - DNA, 38 bp, Artificial Sequence
  Synthetic oligonucleotide
ttggacgcaatccagcctgcttattggtgatcccgtga

SEQ ID NO: 40314 - DNA, 38 bp, Artificial Sequence
  Synthetic oligonucleotide
attgtcctctcagcttatccgaacgttccccccgttga

SEQ ID NO: 40315 - DNA, 35 bp, Artificial Sequence
  Synthetic oligonucleotide
tcactagctgtacaaagggttgggacgggaaagta

SEQ ID NO: 40316 - DNA, 35 bp, Artificial Sequence
  Synthetic oligonucleotide
tagcacgggagcctgcctgggctaacattttcgta

SEQ ID NO: 40317 - DNA, 36 bp, Artificial Sequence
  Synthetic oligonucleotide
gacacccctcacctttaattccgtcactgtacatta

SEQ ID NO: 40318 - DNA, 35 bp, Artificial Sequence
  Synthetic oligonucleotide
actaccctgacctatggtgtgccagccctgcccac

SEQ ID NO: 40319 - DNA, 35 bp, Artificial Sequence
  Synthetic oligonucleotide
ttgaccgcaatctaccggtttacttcccccgcccc

SEQ ID NO: 40320 - DNA, 35 bp, Artificial Sequence
  Synthetic oligonucleotide
gatttgtccctcctcgcacccctgacgatgcacgc

SEQ ID NO: 40321 - DNA, 35 bp, Artificial Sequence
  Synthetic oligonucleotide
acgctgcccaccttacctacgcaccagttagtgtc

SEQ ID NO: 40322 - DNA, 35 bp, Artificial Sequence
  Synthetic oligonucleotide
agtcggttaggagtagggaaggacgggggatgggg

SEQ ID NO: 40323 - DNA, 35 bp, Artificial Sequence
  Synthetic oligonucleotide
gcctccagtggaacgctgccttgaaccaaaatcat

SEQ ID NO: 40324 - DNA, 35 bp, Artificial Sequence
  Synthetic oligonucleotide
acatgcgccgccaaggctattcgccatttgatcct

SEQ ID NO: 40325 - DNA, 35 bp, Artificial Sequence
  Synthetic oligonucleotide
tctggaccgttcttgggttcatctttgtttgtctt

SEQ ID NO: 40326 - DNA, 35 bp, Artificial Sequence
  Synthetic oligonucleotide
gagcctggtactcgaatctgtcattgatactccaa

SEQ ID NO: 40327 - DNA, 36 bp, Artificial Sequence
  Synthetic oligonucleotide
aacatgagcgcaagcagtgggatcacacctcttgaa

SEQ ID NO: 40328 - DNA, 36 bp, Artificial Sequence
  Synthetic oligonucleotide
tgactcagacatttgcgtacttacaccttcatccca

SEQ ID NO: 40329 - DNA, 36 bp, Artificial Sequence
  Synthetic oligonucleotide
gacggtagggccacccgactgactccgaaatctcca

SEQ ID NO: 40330 - DNA, 36 bp, Artificial Sequence
  Synthetic oligonucleotide
acttgacgccgtcctatgccttaccatctaacatca

SEQ ID NO: 40331 - DNA, 36 bp, Artificial Sequence
  Synthetic oligonucleotide
tccgggtcagtgtcaaatccatgcccactgccctca

SEQ ID NO: 40332 - DNA, 36 bp, Artificial Sequence
  Synthetic oligonucleotide
tgaggcacacctgccagcacatctgtacacccgaga

SEQ ID NO: 40333 - DNA, 37 bp, Artificial Sequence
  Synthetic oligonucleotide
gaaggttaggggtgaaccgagggaggggttaggggga

SEQ ID NO: 40334 - DNA, 35 bp, Artificial Sequence
  Synthetic oligonucleotide
ggtaacatccgcacattctctattcttagcctgga

SEQ ID NO: 40335 - DNA, 37 bp, Artificial Sequence
  Synthetic oligonucleotide
gccaccgcctcacctcgaggaactgttcgccctatga

SEQ ID NO: 40336 - DNA, 38 bp, Artificial Sequence
  Synthetic oligonucleotide
gtttgctccctacctgtaaccgagccccttgtacctga

SEQ ID NO: 40337 - DNA, 38 bp, Artificial Sequence
  Synthetic oligonucleotide
tcacgccccacaatatcattacggtcgacttgtgctga

SEQ ID NO: 40338 - DNA, 37 bp, Artificial Sequence
  Synthetic oligonucleotide
atgcacaggaggaatataacgtggcgaaggggagtga

SEQ ID NO: 40339 - DNA, 38 bp, Artificial Sequence
  Synthetic oligonucleotide
agtgtcacatctgccgatcgcgttttttcctctggtga

SEQ ID NO: 40340 - DNA, 38 bp, Artificial Sequence
  Synthetic oligonucleotide
tcgaaacgtcaccgacttgaccccgcggtaccacttga

SEQ ID NO: 40341 - DNA, 37 bp, Artificial Sequence
  Synthetic oligonucleotide
gacaaccactgcgccacttaatacctccgcgtcttga

SEQ ID NO: 40342 - DNA, 37 bp, Artificial Sequence
  Synthetic oligonucleotide
ggaggtggctgggcatagggaaggtggttcgggttga

SEQ ID NO: 40343 - DNA, 38 bp, Artificial Sequence
  Synthetic oligonucleotide
accacagcctctaatggcctcccaactcacttgtttga

SEQ ID NO: 40344 - DNA, 36 bp, Artificial Sequence
  Synthetic oligonucleotide
tccgcgaaccgccgatttgatagccgcaccccgata

SEQ ID NO: 40345 - DNA, 36 bp, Artificial Sequence
  Synthetic oligonucleotide
tcacacccttgtcctaagaatatccgctgttcgcta

SEQ ID NO: 40346 - DNA, 35 bp, Artificial Sequence
  Synthetic oligonucleotide
gggtcagcccacgacttgctgcctctcattccgta

SEQ ID NO: 40347 - DNA, 35 bp, Artificial Sequence
  Synthetic oligonucleotide
aaccgagcgttattccagccctacccttgcctgta

SEQ ID NO: 40348 - DNA, 35 bp, Artificial Sequence
  Synthetic oligonucleotide
gcctacctgcatgagtttccggttacggctacacc

SEQ ID NO: 40349 - DNA, 35 bp, Artificial Sequence
  Synthetic oligonucleotide
ccagaccgctcacagtcaccctgtctggccattcc

SEQ ID NO: 40350 - DNA, 35 bp, Artificial Sequence
  Synthetic oligonucleotide
gagttaccgcccatagtaatcatatcttctagttc

SEQ ID NO: 40351 - DNA, 35 bp, Artificial Sequence
  Synthetic oligonucleotide
ccacgactccatttcagtcaccgccccttcctgcg

SEQ ID NO: 40352 - DNA, 35 bp, Artificial Sequence
  Synthetic oligonucleotide
tcacctcagtccggagtcacatataatcctctgcg

SEQ ID NO: 40353 - DNA, 35 bp, Artificial Sequence
  Synthetic oligonucleotide
gaaactacaggcgcgatacacctccccacgaacgg

SEQ ID NO: 40354 - DNA, 35 bp, Artificial Sequence
  Synthetic oligonucleotide
aatgggagaaggttggggatgatggaagttgcaat

SEQ ID NO: 40355 - DNA, 35 bp, Artificial Sequence
  Synthetic oligonucleotide
gcataacaccatggctcgtccctccaccacaccat

SEQ ID NO: 40356 - DNA, 35 bp, Artificial Sequence
  Synthetic oligonucleotide
tctcacctcccatcgcgtatttgccatttcaccct

SEQ ID NO: 40357 - DNA, 36 bp, Artificial Sequence
  Synthetic oligonucleotide
ggtcacagcgcagctaatatcttttggtggcctcct

SEQ ID NO: 40358 - DNA, 35 bp, Artificial Sequence
  Synthetic oligonucleotide
aacgtgcgacgcacatacgatccccacagctactt

SEQ ID NO: 40359 - DNA, 35 bp, Artificial Sequence
  Synthetic oligonucleotide
gcgcgacgcattctatccttccttagcagtcgttt

SEQ ID NO: 40360 - DNA, 36 bp, Artificial Sequence
  Synthetic oligonucleotide
atacacccgcgtggtaatttggcactctcccgaaaa

SEQ ID NO: 40361 - DNA, 34 bp, Artificial Sequence
  Synthetic oligonucleotide
agtgcgcccaataggtcatcacaacacactggaa

SEQ ID NO: 40362 - DNA, 35 bp, Artificial Sequence
  Synthetic oligonucleotide
tgtggcacgcggatcgtcacgcgccctcccgttaa

SEQ ID NO: 40363 - DNA, 36 bp, Artificial Sequence
  Synthetic oligonucleotide
tgaagtgcgacatttaggaggggaggggggcaaaca

SEQ ID NO: 40364 - DNA, 36 bp, Artificial Sequence
  Synthetic oligonucleotide
tagcagccacaaactgccgcattaccacgccccaca

SEQ ID NO: 40365 - DNA, 36 bp, Artificial Sequence
  Synthetic oligonucleotide
ttcgcgagcgcacgacgttaccacctcaccagcaca

SEQ ID NO: 40366 - DNA, 36 bp, Artificial Sequence
  Synthetic oligonucleotide
acccgatatcgccgccaatgatacacatcaccacca

SEQ ID NO: 40367 - DNA, 36 bp, Artificial Sequence
  Synthetic oligonucleotide
gcatgcgaacttcgagtatgatctccacccctgcca

SEQ ID NO: 40368 - DNA, 36 bp, Artificial Sequence
  Synthetic oligonucleotide
tgcacgcccgtcatccgactgccataacagcatcca

SEQ ID NO: 40369 - DNA, 37 bp, Artificial Sequence
  Synthetic oligonucleotide
gtggggtggggacttggcggtaagggtcttgttgaga

SEQ ID NO: 40370 - DNA, 36 bp, Artificial Sequence
  Synthetic oligonucleotide
gaatcgagtgtaggggggtgggcatgggtcgttcga

SEQ ID NO: 40371 - DNA, 37 bp, Artificial Sequence
  Synthetic oligonucleotide
atggacaggaccatcctctatcatgtggccacccgga

SEQ ID NO: 40372 - DNA, 37 bp, Artificial Sequence
  Synthetic oligonucleotide
gaggtgcgaaggggcaaggatagcatagctgacggga

SEQ ID NO: 40373 - DNA, 37 bp, Artificial Sequence
  Synthetic oligonucleotide
gttgagcccaccaaaccgttaacgtcacggaccatga

SEQ ID NO: 40374 - DNA, 38 bp, Artificial Sequence
  Synthetic oligonucleotide
aaccaggtgcgggaaacggatagggtgcaggtagatga

SEQ ID NO: 40375 - DNA, 38 bp, Artificial Sequence
  Synthetic oligonucleotide
gtcacgcggactgttatgtccacacatcttacccctga

SEQ ID NO: 40376 - DNA, 38 bp, Artificial Sequence
  Synthetic oligonucleotide
accggagccgtcagccgttcgtcttcattgtgtcctga

SEQ ID NO: 40377 - DNA, 38 bp, Artificial Sequence
  Synthetic oligonucleotide
taaccccgcaattgaccaccgcccaccgacctagctga

SEQ ID NO: 40378 - DNA, 38 bp, Artificial Sequence
  Synthetic oligonucleotide
gtgagtgccccaccttgcgtaacgccctgtccccgtga

SEQ ID NO: 40379 - DNA, 38 bp, Artificial Sequence
  Synthetic oligonucleotide
gaaggtgtagttgcctaaacggtgggtgggtggggtga

SEQ ID NO: 40380 - DNA, 37 bp, Artificial Sequence
  Synthetic oligonucleotide
gacgagggaaattgggaggtagagaataaacttgtga

SEQ ID NO: 40381 - DNA, 38 bp, Artificial Sequence
  Synthetic oligonucleotide
aacgcgagtggatggaggggcctacaggcgtaaattga

SEQ ID NO: 40382 - DNA, 38 bp, Artificial Sequence
  Synthetic oligonucleotide
gtgggcgcaaatcaccggcctcacagtatctaccttga

SEQ ID NO: 40383 - DNA, 38 bp, Artificial Sequence
  Synthetic oligonucleotide
ttgcacaacaggtgctcatctcgtcacgccatgcttga

SEQ ID NO: 40384 - DNA, 37 bp, Artificial Sequence
  Synthetic oligonucleotide
gacgtactccggccgttctctcataggttcatgttga

SEQ ID NO: 40385 - DNA, 37 bp, Artificial Sequence
  Synthetic oligonucleotide
gtccgacccatcagctcacgtacgccactcggtttga

SEQ ID NO: 40386 - DNA, 36 bp, Artificial Sequence
  Synthetic oligonucleotide
gacgggtggagaatcgcttgaattttaacggtggta

SEQ ID NO: 40387 - DNA, 36 bp, Artificial Sequence
  Synthetic oligonucleotide
gtgtgggaatcgaaagggatggggggccgcaatgta

SEQ ID NO: 40388 - DNA, 35 bp, Artificial Sequence
  Synthetic oligonucleotide
attgtacccagttcatcattagttgttctcagccc

SEQ ID NO: 40389 - DNA, 35 bp, Artificial Sequence
  Synthetic oligonucleotide
gcccacactgcattatttgtgacagccacttgagc

SEQ ID NO: 40390 - DNA, 35 bp, Artificial Sequence
  Synthetic oligonucleotide
acagagggaggcgggtgacgcgtttatgttcgtag

SEQ ID NO: 40391 - DNA, 35 bp, Artificial Sequence
  Synthetic oligonucleotide
tgcctatgatcaccaccgtcgtgtatggttccctg

SEQ ID NO: 40392 - DNA, 35 bp, Artificial Sequence
  Synthetic oligonucleotide
gtgcatttacctgtggtatcacggcccattccact

SEQ ID NO: 40393 - DNA, 35 bp, Artificial Sequence
  Synthetic oligonucleotide
gtagctcgatcactgtgccagcaacccttgaccct

SEQ ID NO: 40394 - DNA, 35 bp, Artificial Sequence
  Synthetic oligonucleotide
gtgacaggctatgattgccctctggcttcccctct

SEQ ID NO: 40395 - DNA, 35 bp, Artificial Sequence
  Synthetic oligonucleotide
gcaggtccagaccgctaaatttttggtaccgctct

SEQ ID NO: 40396 - DNA, 35 bp, Artificial Sequence
  Synthetic oligonucleotide
ttccccgctagactctcgtcagtacactactctct

SEQ ID NO: 40397 - DNA, 35 bp, Artificial Sequence
  Synthetic oligonucleotide
gactccgcccctgctaaaggctggtttcctcttct

SEQ ID NO: 40398 - DNA, 35 bp, Artificial Sequence
  Synthetic oligonucleotide
aagaccacaccgccgaaagtagccgctctacccaa

SEQ ID NO: 40399 - DNA, 36 bp, Artificial Sequence
  Synthetic oligonucleotide
taataaaccgccgaatgtccacgcccttgccgcaca

SEQ ID NO: 40400 - DNA, 35 bp, Artificial Sequence
  Synthetic oligonucleotide
atgcaatgcggggtaatgggggaggggtgcagaca

SEQ ID NO: 40401 - DNA, 36 bp, Artificial Sequence
  Synthetic oligonucleotide
ggttggaggccatgaggaacaatcgggcacgagaca

SEQ ID NO: 40402 - DNA, 35 bp, Artificial Sequence
  Synthetic oligonucleotide
gatggtggccaccggatatcggtaaatttttcgca

SEQ ID NO: 40403 - DNA, 36 bp, Artificial Sequence
  Synthetic oligonucleotide
gtacgcctgcaggtacacgttaaaaaagcactggca

SEQ ID NO: 40404 - DNA, 36 bp, Artificial Sequence
  Synthetic oligonucleotide
aggagttggagggtagggtgcgtgaagggggttaga

SEQ ID NO: 40405 - DNA, 36 bp, Artificial Sequence
  Synthetic oligonucleotide
tgtcaactggcaacgttaactctcacgctcatccga

SEQ ID NO: 40406 - DNA, 36 bp, Artificial Sequence
  Synthetic oligonucleotide
tgccactgtctgcacttttctgattgccttggtcga

SEQ ID NO: 40407 - DNA, 37 bp, Artificial Sequence
  Synthetic oligonucleotide
gtatcccacatcattcgccttccaagccgcttgcgga

SEQ ID NO: 40408 - DNA, 36 bp, Artificial Sequence
  Synthetic oligonucleotide
gcttaggaaggggtagtacggggcattaggtgggga

SEQ ID NO: 40409 - DNA, 38 bp, Artificial Sequence
  Synthetic oligonucleotide
acgacaagctccacgacgcctttcacgattgacgctga

SEQ ID NO: 40410 - DNA, 38 bp, Artificial Sequence
  Synthetic oligonucleotide
tcacctccccgaagttcgttcccagtacaccggtgtga

SEQ ID NO: 40411 - DNA, 37 bp, Artificial Sequence
  Synthetic oligonucleotide
gcgctcccaccgtctctgctttaaccgcacgcattga

SEQ ID NO: 40412 - DNA, 38 bp, Artificial Sequence
  Synthetic oligonucleotide
tgtggtccgtactgctgacgtacatttcacacccttga

SEQ ID NO: 40413 - DNA, 36 bp, Artificial Sequence
  Synthetic oligonucleotide
tcccgtgcctccgtcctactttcatgccttttacta

SEQ ID NO: 40414 - DNA, 36 bp, Artificial Sequence
  Synthetic oligonucleotide
tgtctggaccacggttgcgttttggcccctgttcta

SEQ ID NO: 40415 - DNA, 35 bp, Artificial Sequence
  Synthetic oligonucleotide
gccgagacctttgtgccggcacgctcccattgacc

SEQ ID NO: 40416 - DNA, 34 bp, Artificial Sequence
  Synthetic oligonucleotide
aagtaacgatcagttcccatattgccgatgcccc

SEQ ID NO: 40417 - DNA, 35 bp, Artificial Sequence
  Synthetic oligonucleotide
tttcgtacgtccaattccagtccactctcatccgc

SEQ ID NO: 40418 - DNA, 35 bp, Artificial Sequence
  Synthetic oligonucleotide
tttgcatcgggccttatagggctcttcactacctc

SEQ ID NO: 40419 - DNA, 35 bp, Artificial Sequence
  Synthetic oligonucleotide
acccaagcatgactcgtcttctttgccccctgctc

SEQ ID NO: 40420 - DNA, 28 bp, Artificial Sequence
  Synthetic oligonucleotide
tcccaaccaatcgtatacgcgctgtttc

SEQ ID NO: 40421 - DNA, 36 bp, Artificial Sequence
  Synthetic oligonucleotide
accatgcttaacgcatcatgaacctccgactggacg

SEQ ID NO: 40422 - DNA, 35 bp, Artificial Sequence
  Synthetic oligonucleotide
gacgcaccctcctcggttctggataaaacccctcg

SEQ ID NO: 40423 - DNA, 35 bp, Artificial Sequence
  Synthetic oligonucleotide
gtcgggctcctgtgcctttacctccaccttatcgg

SEQ ID NO: 40424 - DNA, 35 bp, Artificial Sequence
  Synthetic oligonucleotide
aacgcgggtgcggtggggccacgatgaggggttgg

SEQ ID NO: 40425 - DNA, 35 bp, Artificial Sequence
  Synthetic oligonucleotide
attacggccacatacagccgccgcgcacctattat

SEQ ID NO: 40426 - DNA, 36 bp, Artificial Sequence
  Synthetic oligonucleotide
tcatgcaccgcccatcttgcgtgttcccgcgccctt

SEQ ID NO: 40427 - DNA, 35 bp, Artificial Sequence
  Synthetic oligonucleotide
accaccctcaatggtcctttactctattgcaccaa

SEQ ID NO: 40428 - DNA, 36 bp, Artificial Sequence
  Synthetic oligonucleotide
tgagcctgccaattgtccttcactacctgccgagaa

SEQ ID NO: 40429 - DNA, 36 bp, Artificial Sequence
  Synthetic oligonucleotide
tacacgtctgaaggtacggacccaccttcttcacca

SEQ ID NO: 40430 - DNA, 36 bp, Artificial Sequence
  Synthetic oligonucleotide
tcaggaaggacggggaaggggccgggactagatcca

SEQ ID NO: 40431 - DNA, 36 bp, Artificial Sequence
  Synthetic oligonucleotide
atggggcacaagtgatttacgggggagatgggagca

SEQ ID NO: 40432 - DNA, 36 bp, Artificial Sequence
  Synthetic oligonucleotide
atggagtggcacaagaactatcgtacggctcaatca

SEQ ID NO: 40433 - DNA, 36 bp, Artificial Sequence
  Synthetic oligonucleotide
tcactgcacctcgactttcgtttggtaccaaactca

SEQ ID NO: 40434 - DNA, 37 bp, Artificial Sequence
  Synthetic oligonucleotide
tacccggaatgggggacatagagggcgggaataacga

SEQ ID NO: 40435 - DNA, 38 bp, Artificial Sequence
  Synthetic oligonucleotide
gctcgcacgccacacacctttcgtcagtctagaaatga

SEQ ID NO: 40436 - DNA, 38 bp, Artificial Sequence
  Synthetic oligonucleotide
acaaaggctccgggcggggttgggggtggcaattatga

SEQ ID NO: 40437 - DNA, 37 bp, Artificial Sequence
  Synthetic oligonucleotide
agcccgctcggtcgttttggcccctcttcttttatga

SEQ ID NO: 40438 - DNA, 38 bp, Artificial Sequence
  Synthetic oligonucleotide
ttagcacatcacgaccacattttgcacagcgcaactga

SEQ ID NO: 40439 - DNA, 37 bp, Artificial Sequence
  Synthetic oligonucleotide
aatgcgaaccggcatagcgcaattaccgtacccctga

SEQ ID NO: 40440 - DNA, 37 bp, Artificial Sequence
  Synthetic oligonucleotide
gaagggggtgtatggggatggggaggggtgctcctga

SEQ ID NO: 40441 - DNA, 36 bp, Artificial Sequence
  Synthetic oligonucleotide
taagcgggaccctcgatctttgccccaccgctctga

SEQ ID NO: 40442 - DNA, 37 bp, Artificial Sequence
  Synthetic oligonucleotide
aactcaccctccgttccatccacagcagtaccggtga

SEQ ID NO: 40443 - DNA, 38 bp, Artificial Sequence
  Synthetic oligonucleotide
gagggaggttgtggggccggatttggagcgcttggtga

SEQ ID NO: 40444 - DNA, 37 bp, Artificial Sequence
  Synthetic oligonucleotide
ttcgccctcgctacctccacttatttgttttgtgtga

SEQ ID NO: 40445 - DNA, 38 bp, Artificial Sequence
  Synthetic oligonucleotide
tctgccaccgcaacgaccactatttactgtgcacttga

SEQ ID NO: 40446 - DNA, 37 bp, Artificial Sequence
  Synthetic oligonucleotide
acatgcctgacctgcgggccctgcctactttttttga

SEQ ID NO: 40447 - DNA, 35 bp, Artificial Sequence
  Synthetic oligonucleotide
gagcgtgcatctggtccctcttttccccttgttta

SEQ ID NO: 40448 - DNA, 35 bp, Artificial Sequence
  Synthetic oligonucleotide
tccctgccaccgaactgacgaatccaccattttta

SEQ ID NO: 40449 - DNA, 35 bp, Artificial Sequence
  Synthetic oligonucleotide
ctcagcgccagtctctaactgctcccaagtgtaac

SEQ ID NO: 40450 - DNA, 35 bp, Artificial Sequence
  Synthetic oligonucleotide
tccgcggatgtctgtagatcgtcattcttttccac

SEQ ID NO: 40451 - DNA, 35 bp, Artificial Sequence
  Synthetic oligonucleotide
atgtacgcgggggcgagaagggcgtggggttagac

SEQ ID NO: 40452 - DNA, 35 bp, Artificial Sequence
  Synthetic oligonucleotide
gcacaccgtatgacttttaacctctgctggcctac

SEQ ID NO: 40453 - DNA, 35 bp, Artificial Sequence
  Synthetic oligonucleotide
gcgtggtccgcgcactcccgatttcgccagtctcc

SEQ ID NO: 40454 - DNA, 35 bp, Artificial Sequence
  Synthetic oligonucleotide
tagtagcacacatgtggactaccgtttcgccattc

SEQ ID NO: 40455 - DNA, 35 bp, Artificial Sequence
  Synthetic oligonucleotide
gtgtaccctctatgaagtacgctcccaacattttc

SEQ ID NO: 40456 - DNA, 35 bp, Artificial Sequence
  Synthetic oligonucleotide
gatggaggaggaggggtcgaggtggacgggtaccg

SEQ ID NO: 40457 - DNA, 35 bp, Artificial Sequence
  Synthetic oligonucleotide
tgtgcggtagagactacgggtggagaggggggcgg

SEQ ID NO: 40458 - DNA, 35 bp, Artificial Sequence
  Synthetic oligonucleotide
ttgcgacgtagggggacaactaggtaacgggatgg

SEQ ID NO: 40459 - DNA, 36 bp, Artificial Sequence
  Synthetic oligonucleotide
gtcaattcaccccacccgacgccgacgccacgatat

SEQ ID NO: 40460 - DNA, 35 bp, Artificial Sequence
  Synthetic oligonucleotide
atcgcaccgcacgctgatttggtgcacaacttcct

SEQ ID NO: 40461 - DNA, 35 bp, Artificial Sequence
  Synthetic oligonucleotide
tcatgctcactggtcccgggcacatcccacatgct

SEQ ID NO: 40462 - DNA, 35 bp, Artificial Sequence
  Synthetic oligonucleotide
tcaccaccccgttttaaagcctcaaccgagttatt

SEQ ID NO: 40463 - DNA, 35 bp, Artificial Sequence
  Synthetic oligonucleotide
ggcacatgcctatgtgtacttttccccgtgtattt

SEQ ID NO: 40464 - DNA, 36 bp, Artificial Sequence
  Synthetic oligonucleotide
acccacgaacgagactgcttcttgcccattttccaa

SEQ ID NO: 40465 - DNA, 36 bp, Artificial Sequence
  Synthetic oligonucleotide
tgacagtagcccttagtcctgcattgctcgtttcaa

SEQ ID NO: 40466 - DNA, 35 bp, Artificial Sequence
  Synthetic oligonucleotide
atatcgcaccgccaatatcgcccctcaacccagaa

SEQ ID NO: 40467 - DNA, 36 bp, Artificial Sequence
  Synthetic oligonucleotide
tgctcatcgctgcctttctcctaactccctgttaca

SEQ ID NO: 40468 - DNA, 35 bp, Artificial Sequence
  Synthetic oligonucleotide
gtcgcacccccgcccacaatcgatatctgcttcca

SEQ ID NO: 40469 - DNA, 37 bp, Artificial Sequence
  Synthetic oligonucleotide
gcctgccccactgtgcacttcctcaagcatactgaga

SEQ ID NO: 40470 - DNA, 36 bp, Artificial Sequence
  Synthetic oligonucleotide
gccgccacggagcgttcttactaaccagtacaccga

SEQ ID NO: 40471 - DNA, 37 bp, Artificial Sequence
  Synthetic oligonucleotide
accacccacggtggtattcgccctacgggtttcccga

SEQ ID NO: 40472 - DNA, 36 bp, Artificial Sequence
  Synthetic oligonucleotide
tcccacattctccccgacgtcgcctgttactacgga

SEQ ID NO: 40473 - DNA, 38 bp, Artificial Sequence
  Synthetic oligonucleotide
accccgcgactctgtcggtttccggccctcacacctga

SEQ ID NO: 40474 - DNA, 37 bp, Artificial Sequence
  Synthetic oligonucleotide
agctgccgatcgctcgatatcttgccctacattctga

SEQ ID NO: 40475 - DNA, 37 bp, Artificial Sequence
  Synthetic oligonucleotide
agtgggtccctgtgcgccttgccttattcccggttga

SEQ ID NO: 40476 - DNA, 38 bp, Artificial Sequence
  Synthetic oligonucleotide
gtcaaagagaccgggtgggatcgcagggtagggtttga

SEQ ID NO: 40477 - DNA, 35 bp, Artificial Sequence
  Synthetic oligonucleotide
gtaccgataccgctcgatctcgcacaggctaccac

SEQ ID NO: 40478 - DNA, 35 bp, Artificial Sequence
  Synthetic oligonucleotide
tcatccccgactactcgatcccttctggtagctac

SEQ ID NO: 40479 - DNA, 35 bp, Artificial Sequence
  Synthetic oligonucleotide
ttcaccacgcttcatctaaggtctaacgcctcacc

SEQ ID NO: 40480 - DNA, 35 bp, Artificial Sequence
  Synthetic oligonucleotide
tttcatctatgccctgccccagttacgtaccatcc

SEQ ID NO: 40481 - DNA, 35 bp, Artificial Sequence
  Synthetic oligonucleotide
gtaggcatactttacactgcattggtttggcttcc

SEQ ID NO: 40482 - DNA, 35 bp, Artificial Sequence
  Synthetic oligonucleotide
tctacgtttcccatgcctgacccgcttccttatgc

SEQ ID NO: 40483 - DNA, 35 bp, Artificial Sequence
  Synthetic oligonucleotide
gcccaagcgactcctccgcctttgtagttgctatc

SEQ ID NO: 40484 - DNA, 35 bp, Artificial Sequence
  Synthetic oligonucleotide
gttgacaccttgttctttgcgtacactgggcactc

SEQ ID NO: 40485 - DNA, 35 bp, Artificial Sequence
  Synthetic oligonucleotide
tacatcaggccaaccacgtacttataccgaaggtc

SEQ ID NO: 40486 - DNA, 35 bp, Artificial Sequence
  Synthetic oligonucleotide
gtgacctcaggcaatcgcattaactgaactctttc

SEQ ID NO: 40487 - DNA, 35 bp, Artificial Sequence
  Synthetic oligonucleotide
agttcgcctaccctccttgcttgcctcattttacg

SEQ ID NO: 40488 - DNA, 35 bp, Artificial Sequence
  Synthetic oligonucleotide
attagcctcagtccctacatcttcgaccaggtcct

SEQ ID NO: 40489 - DNA, 35 bp, Artificial Sequence
  Synthetic oligonucleotide
gtagcgtacccctagttgacccgttgatcatggct

SEQ ID NO: 40490 - DNA, 35 bp, Artificial Sequence
  Synthetic oligonucleotide
ttatcccagctgtctaccattgcgtggtctgttct

SEQ ID NO: 40491 - DNA, 35 bp, Artificial Sequence
  Synthetic oligonucleotide
taagggcacgcccagctcctgccttgtagttttct

SEQ ID NO: 40492 - DNA, 35 bp, Artificial Sequence
  Synthetic oligonucleotide
aacacccgctccaccaacggaaacatgatgcacaa

SEQ ID NO: 40493 - DNA, 36 bp, Artificial Sequence
  Synthetic oligonucleotide
aagggcgcaggccattgtacgatctatcttcctcca

SEQ ID NO: 40494 - DNA, 35 bp, Artificial Sequence
  Synthetic oligonucleotide
gaccggccctggtgcttctactctggctacccgca

SEQ ID NO: 40495 - DNA, 36 bp, Artificial Sequence
  Synthetic oligonucleotide
aactgatcgcacccccattcgtaaaaccgcgtttca

SEQ ID NO: 40496 - DNA, 37 bp, Artificial Sequence
  Synthetic oligonucleotide
aaggctggagagagggtggaaacgtgagagggtcaga

SEQ ID NO: 40497 - DNA, 35 bp, Artificial Sequence
  Synthetic oligonucleotide
aaccctccacctgccagctgtcatcattgggccga

SEQ ID NO: 40498 - DNA, 37 bp, Artificial Sequence
  Synthetic oligonucleotide
gaacggggagggggttgttactggaacgaggtgcgga

SEQ ID NO: 40499 - DNA, 37 bp, Artificial Sequence
  Synthetic oligonucleotide
atgtgcgggaggaagggactagcgaaagagaaatgga

SEQ ID NO: 40500 - DNA, 38 bp, Artificial Sequence
  Synthetic oligonucleotide
gaagagagagggaggcgattaacagagagccacaatga

SEQ ID NO: 40501 - DNA, 38 bp, Artificial Sequence
  Synthetic oligonucleotide
gacccatcaccatcacactaagccaggattaggaatga

SEQ ID NO: 40502 - DNA, 36 bp, Artificial Sequence
  Synthetic oligonucleotide
ttggacgacgttcggagctccttacccccattatga

SEQ ID NO: 40503 - DNA, 38 bp, Artificial Sequence
  Synthetic oligonucleotide
accgaccgcctgactcttccaaccgtcccgtttactga

SEQ ID NO: 40504 - DNA, 38 bp, Artificial Sequence
  Synthetic oligonucleotide
tcccactcccaggcttatctcggcactgtcatgcctga

SEQ ID NO: 40505 - DNA, 37 bp, Artificial Sequence
  Synthetic oligonucleotide
agacaccttcgtttgcccacccacacttccccgctga

SEQ ID NO: 40506 - DNA, 37 bp, Artificial Sequence
  Synthetic oligonucleotide
tggttgttgcccaagcgtattttctcctctctcgtga

SEQ ID NO: 40507 - DNA, 38 bp, Artificial Sequence
  Synthetic oligonucleotide
atactccgctgcacctccctttgcgtgccatttattga

SEQ ID NO: 40508 - DNA, 38 bp, Artificial Sequence
  Synthetic oligonucleotide
tcactgggccgggactcttaagcgcgtactatccttga

SEQ ID NO: 40509 - DNA, 38 bp, Artificial Sequence
  Synthetic oligonucleotide
agaacgcgccccccgagtccatctagcactacttttga

SEQ ID NO: 40510 - DNA, 35 bp, Artificial Sequence
  Synthetic oligonucleotide
tttggcgtcccagtcgcatttcaccttccttctta

SEQ ID NO: 40511 - DNA, 36 bp, Artificial Sequence
  Synthetic oligonucleotide
tgagtgcgttctctggtctagtcctgcctcttgtta

SEQ ID NO: 40512 - DNA, 35 bp, Artificial Sequence
  Synthetic oligonucleotide
gcacacggagctcttagtatggtcccactgccgcc

SEQ ID NO: 40513 - DNA, 35 bp, Artificial Sequence
  Synthetic oligonucleotide
gcctccatgcccacggagtgactacacaacatagc

SEQ ID NO: 40514 - DNA, 35 bp, Artificial Sequence
  Synthetic oligonucleotide
acagcccctgccaggaagtcttctttcgtacaatc

SEQ ID NO: 40515 - DNA, 35 bp, Artificial Sequence
  Synthetic oligonucleotide
ttcaacgacactcggtcgccttaaactcacttatc

SEQ ID NO: 40516 - DNA, 35 bp, Artificial Sequence
  Synthetic oligonucleotide
gcgatcaacactctggtcacgttagcgagttcttc

SEQ ID NO: 40517 - DNA, 35 bp, Artificial Sequence
  Synthetic oligonucleotide
tcctgtaccactgactcgcttgacttgttgctatg

SEQ ID NO: 40518 - DNA, 35 bp, Artificial Sequence
  Synthetic oligonucleotide
aagaaaaccgccgttgccctctaccatggtccact

SEQ ID NO: 40519 - DNA, 35 bp, Artificial Sequence
  Synthetic oligonucleotide
tctgagctcgtgcaactccgtatactcttgtctct

SEQ ID NO: 40520 - DNA, 35 bp, Artificial Sequence
  Synthetic oligonucleotide
tcttgatagcatcccgccccccgacgcaaacacgt

SEQ ID NO: 40521 - DNA, 35 bp, Artificial Sequence
  Synthetic oligonucleotide
gtctcgaggccccccccccagaagcacgcttgctt

SEQ ID NO: 40522 - DNA, 36 bp, Artificial Sequence
  Synthetic oligonucleotide
tcaatgtgatcagccgtccaatcaacacagggtaaa

SEQ ID NO: 40523 - DNA, 36 bp, Artificial Sequence
  Synthetic oligonucleotide
acatactgccggcgcaccgcactcacggggtcacca

SEQ ID NO: 40524 - DNA, 36 bp, Artificial Sequence
  Synthetic oligonucleotide
gctccggtacgttcccggcctctttctccctgcgca

SEQ ID NO: 40525 - DNA, 36 bp, Artificial Sequence
  Synthetic oligonucleotide
agtatcgcccacaccctactcgggtcaaagacctca

SEQ ID NO: 40526 - DNA, 37 bp, Artificial Sequence
  Synthetic oligonucleotide
atcgcctggcccacctctttgaacgtgcattgcacga

SEQ ID NO: 40527 - DNA, 37 bp, Artificial Sequence
  Synthetic oligonucleotide
ggactggtcaagctggagatcgaggggaggaagacga

SEQ ID NO: 40528 - DNA, 36 bp, Artificial Sequence
  Synthetic oligonucleotide
agtacacaggggggggtaggaaaggagctaggacga

SEQ ID NO: 40529 - DNA, 37 bp, Artificial Sequence
  Synthetic oligonucleotide
agcaccacgtgacccatgtttaacttccaagttccga

SEQ ID NO: 40530 - DNA, 35 bp, Artificial Sequence
  Synthetic oligonucleotide
gatggggcagccagagaaagttgggcgggggggga

SEQ ID NO: 40531 - DNA, 38 bp, Artificial Sequence
  Synthetic oligonucleotide
gatccctccggtaccctcctctgattagcacagcctga

SEQ ID NO: 40532 - DNA, 38 bp, Artificial Sequence
  Synthetic oligonucleotide
gaggagggggtgtcggaaaggcgggtaggtggttctga

SEQ ID NO: 40533 - DNA, 37 bp, Artificial Sequence
  Synthetic oligonucleotide
ggagggggccgggtaaatggggatcatcgcgatgtga

SEQ ID NO: 40534 - DNA, 38 bp, Artificial Sequence
  Synthetic oligonucleotide
ttgcccattgtccgacggcatcctatcaaccccattga

SEQ ID NO: 40535 - DNA, 38 bp, Artificial Sequence
  Synthetic oligonucleotide
agcatgggaggactgggtgggggagttagagcagttga

SEQ ID NO: 40536 - DNA, 36 bp, Artificial Sequence
  Synthetic oligonucleotide
gtcgacggatgtagagtacggggggtgggagtttga

SEQ ID NO: 40537 - DNA, 36 bp, Artificial Sequence
  Synthetic oligonucleotide
gactacctgttcgcatcgtgttatcatcacacgcta

SEQ ID NO: 40538 - DNA, 36 bp, Artificial Sequence
  Synthetic oligonucleotide
atgccacccctacccgcccgccaggcccagactcta

SEQ ID NO: 40539 - DNA, 36 bp, Artificial Sequence
  Synthetic oligonucleotide
ttgggtgtgcggcaactgctttttgggtcccttcta

SEQ ID NO: 40540 - DNA, 36 bp, Artificial Sequence
  Synthetic oligonucleotide
tcagctcacctgcttcctttccacccttggccctta

SEQ ID NO: 40541 - DNA, 35 bp, Artificial Sequence
  Synthetic oligonucleotide
agtagccctcaggcgtcgtagcttttacccctccc

SEQ ID NO: 40542 - DNA, 35 bp, Artificial Sequence
  Synthetic oligonucleotide
gatcgaagaactcgttatggcctcccattgtctcc

SEQ ID NO: 40543 - DNA, 35 bp, Artificial Sequence
  Synthetic oligonucleotide
tacacacttcctgaaacgatagcaggctcgccatc

SEQ ID NO: 40544 - DNA, 35 bp, Artificial Sequence
  Synthetic oligonucleotide
taccctcgcccggttaatcctcgatgtcctttgtc

SEQ ID NO: 40545 - DNA, 35 bp, Artificial Sequence
  Synthetic oligonucleotide
tgtgacggccctccgctccacagagcttcttgttc

SEQ ID NO: 40546 - DNA, 35 bp, Artificial Sequence
  Synthetic oligonucleotide
acgtccatatccccggtcaatcactcttcatcgag

SEQ ID NO: 40547 - DNA, 35 bp, Artificial Sequence
  Synthetic oligonucleotide
gaacaatgccgagtagcaccttcccctttttgacg

SEQ ID NO: 40548 - DNA, 35 bp, Artificial Sequence
  Synthetic oligonucleotide
gcacatagagcgcttatttccagtccgtcgcatcg

SEQ ID NO: 40549 - DNA, 35 bp, Artificial Sequence
  Synthetic oligonucleotide
tttgacgccccactcagctttgactcacgctggtg

SEQ ID NO: 40550 - DNA, 35 bp, Artificial Sequence
  Synthetic oligonucleotide
tgccctgagcgatggacttttgccctctgttacat

SEQ ID NO: 40551 - DNA, 35 bp, Artificial Sequence
  Synthetic oligonucleotide
tagttacattcccctgcgccgccgtcccaagctgt

SEQ ID NO: 40552 - DNA, 35 bp, Artificial Sequence
  Synthetic oligonucleotide
tagtacccctccacctacttgtattgtaggttatt

SEQ ID NO: 40553 - DNA, 35 bp, Artificial Sequence
  Synthetic oligonucleotide
tcatgacatcctcactcggtcaccgaccgttactt

SEQ ID NO: 40554 - DNA, 35 bp, Artificial Sequence
  Synthetic oligonucleotide
aatggagaccccgcgcgtaacgatcacgatccctt

SEQ ID NO: 40555 - DNA, 35 bp, Artificial Sequence
  Synthetic oligonucleotide
gctacccctacacaggcttaaacgagccgtgcctt

SEQ ID NO: 40556 - DNA, 36 bp, Artificial Sequence
  Synthetic oligonucleotide
tgcatcacgatcaggccttcttgtaaatctccccga

SEQ ID NO: 40557 - DNA, 37 bp, Artificial Sequence
  Synthetic oligonucleotide
ttggtccgccgccacttgctacatcccttactgtcga

SEQ ID NO: 40558 - DNA, 35 bp, Artificial Sequence
  Synthetic oligonucleotide
acaatcccgattgatattgccccccctttatcgga

SEQ ID NO: 40559 - DNA, 37 bp, Artificial Sequence
  Synthetic oligonucleotide
tgaccaccactcagctagcttctgttccgacctatga

SEQ ID NO: 40560 - DNA, 38 bp, Artificial Sequence
  Synthetic oligonucleotide
tcatagggatgggggggagggtaagcgcggctgtatga

SEQ ID NO: 40561 - DNA, 36 bp, Artificial Sequence
  Synthetic oligonucleotide
agccctagtctcccccgtagccgccgacctcacgta

SEQ ID NO: 40562 - DNA, 37 bp, Artificial Sequence
  Synthetic oligonucleotide
ttccgctcactcactctgcttcttggccgtttttgta

SEQ ID NO: 40563 - DNA, 36 bp, Artificial Sequence
  Synthetic oligonucleotide
ttcgaaatcgtctgccgcgttccatcttgctcgtta

SEQ ID NO: 40564 - DNA, 35 bp, Artificial Sequence
  Synthetic oligonucleotide
acctgaacctgctatcacaccctacggggtcccac

SEQ ID NO: 40565 - DNA, 35 bp, Artificial Sequence
  Synthetic oligonucleotide
ttggaaacctcatccctttcaccgtggacggatac

SEQ ID NO: 40566 - DNA, 35 bp, Artificial Sequence
  Synthetic oligonucleotide
gcatgccattctgaggccctacactgcacttttac

SEQ ID NO: 40567 - DNA, 35 bp, Artificial Sequence
  Synthetic oligonucleotide
gcagatacgctctgcttgcttgcactgttcactgc

SEQ ID NO: 40568 - DNA, 35 bp, Artificial Sequence
  Synthetic oligonucleotide
gtgttgacgcaatgccagcacctccacttggactc

SEQ ID NO: 40569 - DNA, 35 bp, Artificial Sequence
  Synthetic oligonucleotide
ggggggctaagggggaagagggtagagcttttaat

SEQ ID NO: 40570 - DNA, 35 bp, Artificial Sequence
  Synthetic oligonucleotide
ttagcacctcaacgtctaactgctctcggctttat

SEQ ID NO: 40571 - DNA, 35 bp, Artificial Sequence
  Synthetic oligonucleotide
tgcacattcttgagtatttgtcccacccttcgctt

SEQ ID NO: 40572 - DNA, 36 bp, Artificial Sequence
  Synthetic oligonucleotide
acccccacctggtttcgtgtagtatcgctctgcaaa

SEQ ID NO: 40573 - DNA, 35 bp, Artificial Sequence
  Synthetic oligonucleotide
taccgtaccatcccccacgccttgagcgtttacaa

SEQ ID NO: 40574 - DNA, 35 bp, Artificial Sequence
  Synthetic oligonucleotide
gggggaaggggcagggcgaaatttggggaggtgaa

SEQ ID NO: 40575 - DNA, 36 bp, Artificial Sequence
  Synthetic oligonucleotide
gaacgcatcagtgagttctccttagcgcccctctaa

SEQ ID NO: 40576 - DNA, 35 bp, Artificial Sequence
  Synthetic oligonucleotide
acaactcattcggttccgacctgccgtacccacca

SEQ ID NO: 40577 - DNA, 36 bp, Artificial Sequence
  Synthetic oligonucleotide
gcgacatgtcgcatatgattcttgcaacaccccgca

SEQ ID NO: 40578 - DNA, 37 bp, Artificial Sequence
  Synthetic oligonucleotide
gctgggggggcgggaaaggaacgataatggtaccaga

SEQ ID NO: 40579 - DNA, 37 bp, Artificial Sequence
  Synthetic oligonucleotide
gctcccaggcgcccctgtcacccgtagctccccgaga

SEQ ID NO: 40580 - DNA, 37 bp, Artificial Sequence
  Synthetic oligonucleotide
taacgatcgagacaggagcggaaaggaaggcaggaga

SEQ ID NO: 40581 - DNA, 37 bp, Artificial Sequence
  Synthetic oligonucleotide
tccaatgttcgttcctgtttccacacgtccactacga

SEQ ID NO: 40582 - DNA, 36 bp, Artificial Sequence
  Synthetic oligonucleotide
ggagtaggcggggacggggcttgggatgctacagga

SEQ ID NO: 40583 - DNA, 35 bp, Artificial Sequence
  Synthetic oligonucleotide
tttcccccgttgccgccgcattcgaacttccagga

SEQ ID NO: 40584 - DNA, 37 bp, Artificial Sequence
  Synthetic oligonucleotide
gtactgcaggagttggctagggggtacgtatctagga

SEQ ID NO: 40585 - DNA, 36 bp, Artificial Sequence
  Synthetic oligonucleotide
atgaccacctgcactttatctagaccctgtctcgga

SEQ ID NO: 40586 - DNA, 37 bp, Artificial Sequence
  Synthetic oligonucleotide
acgagaggccgaccggcggtgaagggggcgatatgga

SEQ ID NO: 40587 - DNA, 37 bp, Artificial Sequence
  Synthetic oligonucleotide
gatgcccactcgctgttcttccgacggttggaaatga

SEQ ID NO: 40588 - DNA, 38 bp, Artificial Sequence
  Synthetic oligonucleotide
tcgacacagcaggacgggggagggggacggaactatga

SEQ ID NO: 40589 - DNA, 37 bp, Artificial Sequence
  Synthetic oligonucleotide
ggagaaacaaagagggggtaaaacagaagcgaactga

SEQ ID NO: 40590 - DNA, 38 bp, Artificial Sequence
  Synthetic oligonucleotide
agcttggccattgcgtacccccctgccagcatcactga

SEQ ID NO: 40591 - DNA, 36 bp, Artificial Sequence
  Synthetic oligonucleotide
tcctcgctctcaatcctactgtcacctgactcttga

SEQ ID NO: 40592 - DNA, 38 bp, Artificial Sequence
  Synthetic oligonucleotide
gccctggtcacccgctccgataatgctcagccatttga

SEQ ID NO: 40593 - DNA, 35 bp, Artificial Sequence
  Synthetic oligonucleotide
atcgaaccaaccgcccgtttattctttcaacaata

SEQ ID NO: 40594 - DNA, 36 bp, Artificial Sequence
  Synthetic oligonucleotide
acccggccatggtgctaccctcatcccgcctgaata

SEQ ID NO: 40595 - DNA, 35 bp, Artificial Sequence
  Synthetic oligonucleotide
gactaccaccgacgcttgtcctctgcgtagacata

SEQ ID NO: 40596 - DNA, 35 bp, Artificial Sequence
  Synthetic oligonucleotide
tgaggattaagtggggaagggagttgaacagggta

SEQ ID NO: 40597 - DNA, 35 bp, Artificial Sequence
  Synthetic oligonucleotide
ggaccaaccacctaagttcatggacctgcactgta

SEQ ID NO: 40598 - DNA, 36 bp, Artificial Sequence
  Synthetic oligonucleotide
tgtagtccacctcactgacctgagccgtcttactta

SEQ ID NO: 40599 - DNA, 35 bp, Artificial Sequence
  Synthetic oligonucleotide
gatcgccaccggcctcaccgactgacctcccccac

SEQ ID NO: 40600 - DNA, 35 bp, Artificial Sequence
  Synthetic oligonucleotide
gtggctacttctaccctcgctggcacccctcgcac

SEQ ID NO: 40601 - DNA, 35 bp, Artificial Sequence
  Synthetic oligonucleotide
aacaacgaagcaatcttccatgggaactgctctac

SEQ ID NO: 40602 - DNA, 35 bp, Artificial Sequence
  Synthetic oligonucleotide
tccacgcacgctgagacttaaccccccggtagccc

SEQ ID NO: 40603 - DNA, 35 bp, Artificial Sequence
  Synthetic oligonucleotide
gttactccgcgtggtatcctcgtctatgcgcgccc

SEQ ID NO: 40604 - DNA, 35 bp, Artificial Sequence
  Synthetic oligonucleotide
gactgccctccaactgtctacccactaccggatcc

SEQ ID NO: 40605 - DNA, 35 bp, Artificial Sequence
  Synthetic oligonucleotide
caacgtctatcccgctgattctgaagtgtctttcc

SEQ ID NO: 40606 - DNA, 35 bp, Artificial Sequence
  Synthetic oligonucleotide
ggggacccgcccgaaaagcctcctgtaccttatag

SEQ ID NO: 40607 - DNA, 35 bp, Artificial Sequence
  Synthetic oligonucleotide
tcccgcccccagctccgttttgcccttccttggcg

SEQ ID NO: 40608 - DNA, 35 bp, Artificial Sequence
  Synthetic oligonucleotide
ttcgttgatcgcctgctgccatcccctctacactg

SEQ ID NO: 40609 - DNA, 35 bp, Artificial Sequence
  Synthetic oligonucleotide
gacgatcgcgcttattactgcttccctggtatcct

SEQ ID NO: 40610 - DNA, 35 bp, Artificial Sequence
  Synthetic oligonucleotide
gattgctgactcccattatgactcaccccacgtct

SEQ ID NO: 40611 - DNA, 35 bp, Artificial Sequence
  Synthetic oligonucleotide
gtcgcacgggtcgcatctccgtcttaaattactgt

SEQ ID NO: 40612 - DNA, 36 bp, Artificial Sequence
  Synthetic oligonucleotide
gagctcaccagcaccgacgattcctcgcttaccgaa

SEQ ID NO: 40613 - DNA, 35 bp, Artificial Sequence
  Synthetic oligonucleotide
gtccgggtaactcggggggtgggtgacggatggaa

SEQ ID NO: 40614 - DNA, 35 bp, Artificial Sequence
  Synthetic oligonucleotide
actccaggcttacagtgagtgtagcctgcactaca

SEQ ID NO: 40615 - DNA, 36 bp, Artificial Sequence
  Synthetic oligonucleotide
gatcccgcttctcaattgcttcagtgcttgctccca

SEQ ID NO: 40616 - DNA, 36 bp, Artificial Sequence
  Synthetic oligonucleotide
tcccagccagagcaccgtagccagcttttacttcca

SEQ ID NO: 40617 - DNA, 35 bp, Artificial Sequence
  Synthetic oligonucleotide
gctatcctgcacggccacttttcttgtcactagca

SEQ ID NO: 40618 - DNA, 37 bp, Artificial Sequence
  Synthetic oligonucleotide
tgctcaggggggggaggtatactaattaaacggcaga

SEQ ID NO: 40619 - DNA, 37 bp, Artificial Sequence
  Synthetic oligonucleotide
tccggggaaacggaaggggaagtgggggatggggaga

SEQ ID NO: 40620 - DNA, 37 bp, Artificial Sequence
  Synthetic oligonucleotide
gtcgtgctcgccgcccgtattttttgttgatggccga

SEQ ID NO: 40621 - DNA, 37 bp, Artificial Sequence
  Synthetic oligonucleotide
aagggctaggggggtggagagttgtggcggattcgga

SEQ ID NO: 40622 - DNA, 37 bp, Artificial Sequence
  Synthetic oligonucleotide
atgcgggaggggaaaagaaacacagcggggtgaggga

SEQ ID NO: 40623 - DNA, 37 bp, Artificial Sequence
  Synthetic oligonucleotide
gaatgtggacagggaggatcggactgcgaaacgtgga

SEQ ID NO: 40624 - DNA, 38 bp, Artificial Sequence
  Synthetic oligonucleotide
gtacgcgaatgtgccgtgctacctttggccccccatga

SEQ ID NO: 40625 - DNA, 38 bp, Artificial Sequence
  Synthetic oligonucleotide
gatgcggggggaagtagaaagcgggagttcagcgatga

SEQ ID NO: 40626 - DNA, 38 bp, Artificial Sequence
  Synthetic oligonucleotide
gtagcccaccgaaacaacttgcgccgaactggctatga

SEQ ID NO: 40627 - DNA, 38 bp, Artificial Sequence
  Synthetic oligonucleotide
gagaccacacgctgctctcggattagtcccgtacctga

SEQ ID NO: 40628 - DNA, 37 bp, Artificial Sequence
  Synthetic oligonucleotide
tatctgcgcatacatgcatccccatcacgcaccctga

SEQ ID NO: 40629 - DNA, 37 bp, Artificial Sequence
  Synthetic oligonucleotide
atggggcgcaatcctcccgtcctctctaaggccctga

SEQ ID NO: 40630 - DNA, 37 bp, Artificial Sequence
  Synthetic oligonucleotide
gagataagccggggggtgaaaaggtgtgtgtaggtga

SEQ ID NO: 40631 - DNA, 35 bp, Artificial Sequence
  Synthetic oligonucleotide
gcaaacgtacaagtgtcttttttttttttcggtga

SEQ ID NO: 40632 - DNA, 38 bp, Artificial Sequence
  Synthetic oligonucleotide
gatgcatcctgtcctttcaagcatagccgcccttttga

SEQ ID NO: 40633 - DNA, 36 bp, Artificial Sequence
  Synthetic oligonucleotide
ccagcctccgctccgttcctgcatacctataaacta

SEQ ID NO: 40634 - DNA, 36 bp, Artificial Sequence
  Synthetic oligonucleotide
gtcgccactagcagggaattctcgcgcctcttatta

SEQ ID NO: 40635 - DNA, 35 bp, Artificial Sequence
  Synthetic oligonucleotide
tgtcgcccccttcttgggatctttctgccagtccc

SEQ ID NO: 40636 - DNA, 35 bp, Artificial Sequence
  Synthetic oligonucleotide
gagacactcagcacaaccgtgcatccacgcgttcc

SEQ ID NO: 40637 - DNA, 36 bp, Artificial Sequence
  Synthetic oligonucleotide
aatgaccccatagctgaactgctgaacttaagtttc

SEQ ID NO: 40638 - DNA, 35 bp, Artificial Sequence
  Synthetic oligonucleotide
aagaaaggagggtgtggtgggaggccatttcgcag

SEQ ID NO: 40639 - DNA, 35 bp, Artificial Sequence
  Synthetic oligonucleotide
gatggctcccaccacgtaatagtaaccaatatctg

SEQ ID NO: 40640 - DNA, 35 bp, Artificial Sequence
  Synthetic oligonucleotide
gtacgccctgtcctgtttgttcattcatgatgttg

SEQ ID NO: 40641 - DNA, 35 bp, Artificial Sequence
  Synthetic oligonucleotide
atttcgagcctgatagcccttatttgttccttcat

SEQ ID NO: 40642 - DNA, 35 bp, Artificial Sequence
  Synthetic oligonucleotide
gaccgttgttcttgttcaagtcgtcattccacact

SEQ ID NO: 40643 - DNA, 35 bp, Artificial Sequence
  Synthetic oligonucleotide
gatgatccgtagggtaatgtaaccagtatttcgct

SEQ ID NO: 40644 - DNA, 35 bp, Artificial Sequence
  Synthetic oligonucleotide
gtacaacaccaaacggaatgtaaagttacctctct

SEQ ID NO: 40645 - DNA, 35 bp, Artificial Sequence
  Synthetic oligonucleotide
aactacggccacagtcgttcacttcaccaaggagt

SEQ ID NO: 40646 - DNA, 36 bp, Artificial Sequence
  Synthetic oligonucleotide
accaccaccagaaacatcccggttttatcggtaaaa

SEQ ID NO: 40647 - DNA, 36 bp, Artificial Sequence
  Synthetic oligonucleotide
tcccgtcgcgacaagcgttcggcccaatttatcaca

SEQ ID NO: 40648 - DNA, 36 bp, Artificial Sequence
  Synthetic oligonucleotide
gtcgtcggacaacggctcattccctttcaccaccca

SEQ ID NO: 40649 - DNA, 37 bp, Artificial Sequence
  Synthetic oligonucleotide
agttgagagcaagaacggggggggcggggataacaga

SEQ ID NO: 40650 - DNA, 36 bp, Artificial Sequence
  Synthetic oligonucleotide
gtgccctccacacgtggccaattcacaccactgcga

SEQ ID NO: 40651 - DNA, 37 bp, Artificial Sequence
  Synthetic oligonucleotide
tccagcttcgcgcaacacacgtgcatccgtttctcga

SEQ ID NO: 40652 - DNA, 37 bp, Artificial Sequence
  Synthetic oligonucleotide
tgcacccccctaagatttgatcccattgccttccgga

SEQ ID NO: 40653 - DNA, 36 bp, Artificial Sequence
  Synthetic oligonucleotide
aagcggtgggggaactctggtaaacggctgggggga

SEQ ID NO: 40654 - DNA, 38 bp, Artificial Sequence
  Synthetic oligonucleotide
attagagcgggaggagaatttgagggggggtggcctga

SEQ ID NO: 40655 - DNA, 38 bp, Artificial Sequence
  Synthetic oligonucleotide
tctccctcgccccgcgtaacgaagtgagcgaactctga

SEQ ID NO: 40656 - DNA, 38 bp, Artificial Sequence
  Synthetic oligonucleotide
atacctccatggcttccctcagtctcacttccaggtga

SEQ ID NO: 40657 - DNA, 38 bp, Artificial Sequence
  Synthetic oligonucleotide
gattgtgcacaggggataggatgagtgggggagggtga

SEQ ID NO: 40658 - DNA, 38 bp, Artificial Sequence
  Synthetic oligonucleotide
gagttgggggcgggacaggttgaaacggggctgggtga

SEQ ID NO: 40659 - DNA, 38 bp, Artificial Sequence
  Synthetic oligonucleotide
gaaggaagagcccgcccatacacctggaccctgattga

SEQ ID NO: 40660 - DNA, 36 bp, Artificial Sequence
  Synthetic oligonucleotide
gacaggtgcttctcgcgttatatcattcttttcgac

SEQ ID NO: 40661 - DNA, 35 bp, Artificial Sequence
  Synthetic oligonucleotide
gtcagagccttaatttgtgccctgtgcgtgctcgc

SEQ ID NO: 40662 - DNA, 35 bp, Artificial Sequence
  Synthetic oligonucleotide
gccacgcaccgcaacccgacacatcccgttacctc

SEQ ID NO: 40663 - DNA, 35 bp, Artificial Sequence
  Synthetic oligonucleotide
tgatcatccaacccctcgcagcttcctcttcgtcg

SEQ ID NO: 40664 - DNA, 35 bp, Artificial Sequence
  Synthetic oligonucleotide
gtgtcatggtggggaatgacggtggggagaagctg

SEQ ID NO: 40665 - DNA, 35 bp, Artificial Sequence
  Synthetic oligonucleotide
ttaacgaggagaagaagggagaatagatgttggtg

SEQ ID NO: 40666 - DNA, 35 bp, Artificial Sequence
  Synthetic oligonucleotide
gtgacgccccatcacgttacaattctcgtggccat

SEQ ID NO: 40667 - DNA, 35 bp, Artificial Sequence
  Synthetic oligonucleotide
gacacgactgcctctagtatcgatcgtccctttat

SEQ ID NO: 40668 - DNA, 35 bp, Artificial Sequence
  Synthetic oligonucleotide
taactagtggacatttccccgtgaagctactgcct

SEQ ID NO: 40669 - DNA, 35 bp, Artificial Sequence
  Synthetic oligonucleotide
gttacaccgcgatctccaccatctcctggttcggt

SEQ ID NO: 40670 - DNA, 35 bp, Artificial Sequence
  Synthetic oligonucleotide
agccacgtttccgtttcgtaccttccccttcactt

SEQ ID NO: 40671 - DNA, 35 bp, Artificial Sequence
  Synthetic oligonucleotide
gagcacaggagcccccccattgccgccgaacggtt

SEQ ID NO: 40672 - DNA, 36 bp, Artificial Sequence
  Synthetic oligonucleotide
aaagagcagagggttggaacaggaagcgtggggaaa

SEQ ID NO: 40673 - DNA, 35 bp, Artificial Sequence
  Synthetic oligonucleotide
tgcgaccacagaccgcgccgtacagctttttacca

SEQ ID NO: 40674 - DNA, 37 bp, Artificial Sequence
  Synthetic oligonucleotide
gcactcccttggcgatccagttgccttttcaccccga

SEQ ID NO: 40675 - DNA, 37 bp, Artificial Sequence
  Synthetic oligonucleotide
gacatgtcggggaggagtttacaacaaacgggtgcga

SEQ ID NO: 40676 - DNA, 37 bp, Artificial Sequence
  Synthetic oligonucleotide
ttggagacaaagattgagaaagggagatgtgtgagga

SEQ ID NO: 40677 - DNA, 35 bp, Artificial Sequence
  Synthetic oligonucleotide
aacgggagatgtagggcgggatactatggaaggga

SEQ ID NO: 40678 - DNA, 35 bp, Artificial Sequence
  Synthetic oligonucleotide
ggaccagggggcaatcatggattatggatggggga

SEQ ID NO: 40679 - DNA, 38 bp, Artificial Sequence
  Synthetic oligonucleotide
tcgaccccttagctgtgttgacccccctgcacccatga

SEQ ID NO: 40680 - DNA, 37 bp, Artificial Sequence
  Synthetic oligonucleotide
tagtgcagtaaccgccttggtcccccgttccacctga

SEQ ID NO: 40681 - DNA, 37 bp, Artificial Sequence
  Synthetic oligonucleotide
ttgggccgtgcatctgtttccatgttcttttctctga

SEQ ID NO: 40682 - DNA, 38 bp, Artificial Sequence
  Synthetic oligonucleotide
ttgtccccctcatcgcgcctcctcgtcgacgcaggtga

SEQ ID NO: 40683 - DNA, 38 bp, Artificial Sequence
  Synthetic oligonucleotide
tgcatgacaaggaaagaaggcaaggagaggtggtgtga

SEQ ID NO: 40684 - DNA, 38 bp, Artificial Sequence
  Synthetic oligonucleotide
aacagcaggagccggggcaaggaaaagccgttttgtga

SEQ ID NO: 40685 - DNA, 36 bp, Artificial Sequence
  Synthetic oligonucleotide
tacagaccatccgacggctcttttttgacatacgta

SEQ ID NO: 40686 - DNA, 36 bp, Artificial Sequence
  Synthetic oligonucleotide
gattcacccatagcgaccacacctcagcactgcgta

SEQ ID NO: 40687 - DNA, 36 bp, Artificial Sequence
  Synthetic oligonucleotide
atcaccccctctcaaggcccgcaggaaaccttcgta

SEQ ID NO: 40688 - DNA, 36 bp, Artificial Sequence
  Synthetic oligonucleotide
atccgcaccgaggaagccaccgattacttaccttta

SEQ ID NO: 40689 - DNA, 35 bp, Artificial Sequence
  Synthetic oligonucleotide
tatgcccctccgttgtagtactcccgttatgttta

SEQ ID NO: 40690 - DNA, 35 bp, Artificial Sequence
  Synthetic oligonucleotide
gtagacgggcgcacccaccccgctatactaatttc

SEQ ID NO: 40691 - DNA, 35 bp, Artificial Sequence
  Synthetic oligonucleotide
tagtggagtgagaggaagaggtgtgctgctgtggg

SEQ ID NO: 40692 - DNA, 35 bp, Artificial Sequence
  Synthetic oligonucleotide
tcacactgcaccaatcctttcactacaccagctgg

SEQ ID NO: 40693 - DNA, 35 bp, Artificial Sequence
  Synthetic oligonucleotide
aacgcccatcgactttctacgctttagagctcgtg

SEQ ID NO: 40694 - DNA, 35 bp, Artificial Sequence
  Synthetic oligonucleotide
agtcaccccgtctccttctgacattcgcaatacat

SEQ ID NO: 40695 - DNA, 35 bp, Artificial Sequence
  Synthetic oligonucleotide
gaccaactggctcggttacatcgcaattgtcccat

SEQ ID NO: 40696 - DNA, 35 bp, Artificial Sequence
  Synthetic oligonucleotide
ttccatcctgctccgagggcgttaactcaacctat

SEQ ID NO: 40697 - DNA, 35 bp, Artificial Sequence
  Synthetic oligonucleotide
gtcatccacgcatgtctgggggacacattctctat

SEQ ID NO: 40698 - DNA, 35 bp, Artificial Sequence
  Synthetic oligonucleotide
gggacctcgctttctgagttttgtctgttctacct

SEQ ID NO: 40699 - DNA, 35 bp, Artificial Sequence
  Synthetic oligonucleotide
acgcaatacctcattgtcgaaacatatgccttcct

SEQ ID NO: 40700 - DNA, 35 bp, Artificial Sequence
  Synthetic oligonucleotide
accactgggggtacttcttttgctctgttcatgct

SEQ ID NO: 40701 - DNA, 35 bp, Artificial Sequence
  Synthetic oligonucleotide
aaacgaccggcccctcattcctctctagttacgca

SEQ ID NO: 40702 - DNA, 36 bp, Artificial Sequence
  Synthetic oligonucleotide
atacgcatggccaacgtcagacactgaccacctgca

SEQ ID NO: 40703 - DNA, 36 bp, Artificial Sequence
  Synthetic oligonucleotide
tagtgaggggtgaaacggtagaggacgttaaataga

SEQ ID NO: 40704 - DNA, 35 bp, Artificial Sequence
  Synthetic oligonucleotide
gccccttatcttgttctccgtgcccgcctcaccga

SEQ ID NO: 40705 - DNA, 37 bp, Artificial Sequence
  Synthetic oligonucleotide
cacgacccccctctttcggctttaaaccataacccga

SEQ ID NO: 40706 - DNA, 37 bp, Artificial Sequence
  Synthetic oligonucleotide
gctcaggcgcggtggcacaaaaacacaatacacccga

SEQ ID NO: 40707 - DNA, 37 bp, Artificial Sequence
  Synthetic oligonucleotide
aagagacagggctgggttcaggggcatggaggtagga

SEQ ID NO: 40708 - DNA, 37 bp, Artificial Sequence
  Synthetic oligonucleotide
tcccacactgattcagccttcccctcctgcattagga

SEQ ID NO: 40709 - DNA, 36 bp, Artificial Sequence
  Synthetic oligonucleotide
tcaaccaactgccgacagttgaccctatctattgga

SEQ ID NO: 40710 - DNA, 38 bp, Artificial Sequence
  Synthetic oligonucleotide
gtgcgcaacccttttgaccactcactatgcactaatga

SEQ ID NO: 40711 - DNA, 38 bp, Artificial Sequence
  Synthetic oligonucleotide
tgcgccgcaggtcctatcccttctccactcttacctga

SEQ ID NO: 40712 - DNA, 38 bp, Artificial Sequence
  Synthetic oligonucleotide
accagagggtagggtgggactaggacgatgggaagtga

SEQ ID NO: 40713 - DNA, 38 bp, Artificial Sequence
  Synthetic oligonucleotide
aaccacgtaaaggtggttacgttcaactcttacagtga

SEQ ID NO: 40714 - DNA, 38 bp, Artificial Sequence
  Synthetic oligonucleotide
acctccctccgatacgtcttttgacctcaacgacgtga

SEQ ID NO: 40715 - DNA, 38 bp, Artificial Sequence
  Synthetic oligonucleotide
tcttgttgttgcctcgctagctcctccatccttggtga

SEQ ID NO: 40716 - DNA, 37 bp, Artificial Sequence
  Synthetic oligonucleotide
tgagggaacgggtaagggggagatcgtgggcgtgtga

SEQ ID NO: 40717 - DNA, 38 bp, Artificial Sequence
  Synthetic oligonucleotide
ttcacgtggccccaggtgcctcaactccacacttgtga

SEQ ID NO: 40718 - DNA, 37 bp, Artificial Sequence
  Synthetic oligonucleotide
accctcatggtcctccacagacttgccattcacttga

SEQ ID NO: 40719 - DNA, 36 bp, Artificial Sequence
  Synthetic oligonucleotide
aatgtgcgcatcactgaagggtaggagcaggggata

SEQ ID NO: 40720 - DNA, 36 bp, Artificial Sequence
  Synthetic oligonucleotide
tagcaaggcaacatcgtttcgtccctccccgcggta

SEQ ID NO: 40721 - DNA, 36 bp, Artificial Sequence
  Synthetic oligonucleotide
gccaacgttggtatcccggtgtcctgtctttcgtta

SEQ ID NO: 40722 - DNA, 35 bp, Artificial Sequence
  Synthetic oligonucleotide
tcatgtcaccggcacgcctaactctcctcgtgcac

SEQ ID NO: 40723 - DNA, 35 bp, Artificial Sequence
  Synthetic oligonucleotide
gtccttctgctcgcccgtccactgtcaacaatcac

SEQ ID NO: 40724 - DNA, 35 bp, Artificial Sequence
  Synthetic oligonucleotide
tgaatgacgtcccagtaatcgtacccttctatgcc

SEQ ID NO: 40725 - DNA, 35 bp, Artificial Sequence
  Synthetic oligonucleotide
caagtccccctgtacgttcaccgccgacttgtgcc

SEQ ID NO: 40726 - DNA, 35 bp, Artificial Sequence
  Synthetic oligonucleotide
atccgtgccgaacttcctcaacctaccgagtgttg

SEQ ID NO: 40727 - DNA, 35 bp, Artificial Sequence
  Synthetic oligonucleotide
taacctacattgccgaaaagccatgggcaccacct

SEQ ID NO: 40728 - DNA, 35 bp, Artificial Sequence
  Synthetic oligonucleotide
cactatgcctgcctgcaagttatccacatcaccct

SEQ ID NO: 40729 - DNA, 35 bp, Artificial Sequence
  Synthetic oligonucleotide
tgagcccccacctgattattcgctgtccgccccct

SEQ ID NO: 40730 - DNA, 35 bp, Artificial Sequence
  Synthetic oligonucleotide
aagaaagataaacggggtgaagcaggaagaagggt

SEQ ID NO: 40731 - DNA, 35 bp, Artificial Sequence
  Synthetic oligonucleotide
ggaaggcaccgacctgtctgcaattgccgtccctt

SEQ ID NO: 40732 - DNA, 36 bp, Artificial Sequence
  Synthetic oligonucleotide
atcgatcaccggtcgggacttttaacatcaacgaaa

SEQ ID NO: 40733 - DNA, 36 bp, Artificial Sequence
  Synthetic oligonucleotide
tcatcccgcaaccgagaattatccgtcccgctataa

SEQ ID NO: 40734 - DNA, 36 bp, Artificial Sequence
  Synthetic oligonucleotide
agggagagctgaggggggccggaataggtcgggtaa

SEQ ID NO: 40735 - DNA, 36 bp, Artificial Sequence
  Synthetic oligonucleotide
tgcaaagcacaatcgcgggaggcctcttgctcttaa

SEQ ID NO: 40736 - DNA, 36 bp, Artificial Sequence
  Synthetic oligonucleotide
acccgcccaactcgtcgtagggacctaccttcttaa

SEQ ID NO: 40737 - DNA, 36 bp, Artificial Sequence
  Synthetic oligonucleotide
acatgccatccatcccctcagcagagaacagacaca

SEQ ID NO: 40738 - DNA, 36 bp, Artificial Sequence
  Synthetic oligonucleotide
tagagctcagtatctctatcccgcgttgcccttcca

SEQ ID NO: 40739 - DNA, 35 bp, Artificial Sequence
  Synthetic oligonucleotide
ggaaccttgaacagaccgcgcatgacccactatca

SEQ ID NO: 40740 - DNA, 37 bp, Artificial Sequence
  Synthetic oligonucleotide
tgaccgcatcctcttcgcccgattttgttgctctaga

SEQ ID NO: 40741 - DNA, 37 bp, Artificial Sequence
  Synthetic oligonucleotide
gccactcacgtcctgccatccgttcctaagtagtaga

SEQ ID NO: 40742 - DNA, 37 bp, Artificial Sequence
  Synthetic oligonucleotide
acactttctcagcggcacgcatctcaccactcaccga

SEQ ID NO: 40743 - DNA, 37 bp, Artificial Sequence
  Synthetic oligonucleotide
aaacaaccccgttcttactgacagtgggccattccga

SEQ ID NO: 40744 - DNA, 37 bp, Artificial Sequence
  Synthetic oligonucleotide
accaccgtagcacttgcctcgatcgatctctttccga

SEQ ID NO: 40745 - DNA, 35 bp, Artificial Sequence
  Synthetic oligonucleotide
gcaaaacacccccggacacacgctcgcaccagcga

SEQ ID NO: 40746 - DNA, 36 bp, Artificial Sequence
  Synthetic oligonucleotide
aactgccgacgtcttcgctctctttatccatctcga

SEQ ID NO: 40747 - DNA, 37 bp, Artificial Sequence
  Synthetic oligonucleotide
tgtacgacggacggtgggatagtagtgcggggatgga

SEQ ID NO: 40748 - DNA, 37 bp, Artificial Sequence
  Synthetic oligonucleotide
gaagggatggttgaagcaggatgggagtcggattgga

SEQ ID NO: 40749 - DNA, 36 bp, Artificial Sequence
  Synthetic oligonucleotide
acctcatcaccttcctcctacccattgttgtacgta

SEQ ID NO: 40750 - DNA, 34 bp, Artificial Sequence
  Synthetic oligonucleotide
gccgtcactcgcacactcctgggtttcctctcac

SEQ ID NO: 40751 - DNA, 35 bp, Artificial Sequence
  Synthetic oligonucleotide
gagaccagcatcccgtgccgtgtcacacctttcac

SEQ ID NO: 40752 - DNA, 35 bp, Artificial Sequence
  Synthetic oligonucleotide
tgattcaccacccgtttacatagtgtaatatctcc

SEQ ID NO: 40753 - DNA, 35 bp, Artificial Sequence
  Synthetic oligonucleotide
acacacacctgtactacgatatagctcgcctaggc

SEQ ID NO: 40754 - DNA, 35 bp, Artificial Sequence
  Synthetic oligonucleotide
tgacacatgggcatccccttagtgcttcaccaatc

SEQ ID NO: 40755 - DNA, 35 bp, Artificial Sequence
  Synthetic oligonucleotide
ttgccctgcacgcatgccgtagacccgttcccatc

SEQ ID NO: 40756 - DNA, 34 bp, Artificial Sequence
  Synthetic oligonucleotide
acatctcccacgccaagtcgctgtgcaccgggtc

SEQ ID NO: 40757 - DNA, 35 bp, Artificial Sequence
  Synthetic oligonucleotide
acttgcaacaactcgttgtttctatccacattgtc

SEQ ID NO: 40758 - DNA, 35 bp, Artificial Sequence
  Synthetic oligonucleotide
actccctcgcagtttttacaccgcacgccacccag

SEQ ID NO: 40759 - DNA, 35 bp, Artificial Sequence
  Synthetic oligonucleotide
tatacgtccggccctcaccatccctcctataccgg

SEQ ID NO: 40760 - DNA, 35 bp, Artificial Sequence
  Synthetic oligonucleotide
tacacctgaccacgaccccgcggcgactccactat

SEQ ID NO: 40761 - DNA, 35 bp, Artificial Sequence
  Synthetic oligonucleotide
tgtacgaccaagcctactacggtacccttacgcct

SEQ ID NO: 40762 - DNA, 35 bp, Artificial Sequence
  Synthetic oligonucleotide
acagggggtgccaaggacggggagggatacggagt

SEQ ID NO: 40763 - DNA, 34 bp, Artificial Sequence
  Synthetic oligonucleotide
attccctgcccctgccctccttgtttaccctggt

SEQ ID NO: 40764 - DNA, 35 bp, Artificial Sequence
  Synthetic oligonucleotide
tgtggatgcagttgtgtgatggggctgggaagttt

SEQ ID NO: 40765 - DNA, 36 bp, Artificial Sequence
  Synthetic oligonucleotide
gaacgtggtgacgaacaaagcaataggggcgtggaa

SEQ ID NO: 40766 - DNA, 36 bp, Artificial Sequence
  Synthetic oligonucleotide
tccagcatgtcacccgactttcctaccctctcgtaa

SEQ ID NO: 40767 - DNA, 36 bp, Artificial Sequence
  Synthetic oligonucleotide
gatccggtcgaaatgaccacggggcctacccatcca

SEQ ID NO: 40768 - DNA, 35 bp, Artificial Sequence
  Synthetic oligonucleotide
actcatactcacgccgtaggcatactgtttcatca

SEQ ID NO: 40769 - DNA, 36 bp, Artificial Sequence
  Synthetic oligonucleotide
tccgccgaaccccccagactggtgcccccgagcaga

SEQ ID NO: 40770 - DNA, 35 bp, Artificial Sequence
  Synthetic oligonucleotide
taccaaacccatgctacgctccccctcgctggaga

SEQ ID NO: 40771 - DNA, 35 bp, Artificial Sequence
  Synthetic oligonucleotide
gacggaccagaagggagggatttatgactgggcga

SEQ ID NO: 40772 - DNA, 37 bp, Artificial Sequence
  Synthetic oligonucleotide
atcaagcacggccctgagctacttgcatccttctcga

SEQ ID NO: 40773 - DNA, 37 bp, Artificial Sequence
  Synthetic oligonucleotide
gagtgcgtgaataggtactgaggaggggtaggatgga

SEQ ID NO: 40774 - DNA, 38 bp, Artificial Sequence
  Synthetic oligonucleotide
tcctatcgccgttgtttcgtttcggcgggttttactga

SEQ ID NO: 40775 - DNA, 37 bp, Artificial Sequence
  Synthetic oligonucleotide
tactacgactgtggcgtcacgtgccccacctgcctga

SEQ ID NO: 40776 - DNA, 37 bp, Artificial Sequence
  Synthetic oligonucleotide
ggaggccatcggcggagggggaggagggacaggctga

SEQ ID NO: 40777 - DNA, 37 bp, Artificial Sequence
  Synthetic oligonucleotide
acctaaaggattcagggtgcccgcgaggttcgggtga

SEQ ID NO: 40778 - DNA, 38 bp, Artificial Sequence
  Synthetic oligonucleotide
tcaccactccagactaggttccgatcttctccgtgtga

SEQ ID NO: 40779 - DNA, 38 bp, Artificial Sequence
  Synthetic oligonucleotide
gtgcagccacctgaccgctactgtgcccttctaattga

SEQ ID NO: 40780 - DNA, 38 bp, Artificial Sequence
  Synthetic oligonucleotide
gtagcgttcaagcgccttcatcacacatacacctttga

SEQ ID NO: 40781 - DNA, 36 bp, Artificial Sequence
  Synthetic oligonucleotide
tgtagctcgccgcaacgttcgactcccgtgcctcta

SEQ ID NO: 40782 - DNA, 35 bp, Artificial Sequence
  Synthetic oligonucleotide
ggtgtaagaaaagggcatgggcgatgggtggggta

SEQ ID NO: 40783 - DNA, 36 bp, Artificial Sequence
  Synthetic oligonucleotide
tccctccacgctctgttctcccatccgaggggctta

SEQ ID NO: 40784 - DNA, 36 bp, Artificial Sequence
  Synthetic oligonucleotide
tcctcttacccgttcatgcgcactggtccagcttta

SEQ ID NO: 40785 - DNA, 35 bp, Artificial Sequence
  Synthetic oligonucleotide
acccgtcaccaccgatacgtggcatgctactcccg

SEQ ID NO: 40786 - DNA, 35 bp, Artificial Sequence
  Synthetic oligonucleotide
tcaccaccgtgcaacatttcatgtccttagatccg

SEQ ID NO: 40787 - DNA, 35 bp, Artificial Sequence
  Synthetic oligonucleotide
aaaacgcccctgtaccccgcactccttggatcgat

SEQ ID NO: 40788 - DNA, 35 bp, Artificial Sequence
  Synthetic oligonucleotide
tgtgcatcatgtcccttcgtctccctttcaatgct

SEQ ID NO: 40789 - DNA, 35 bp, Artificial Sequence
  Synthetic oligonucleotide
cacgccttgtagatctgaagtttcgcgtctctttt

SEQ ID NO: 40790 - DNA, 35 bp, Artificial Sequence
  Synthetic oligonucleotide
tgatacgccctgccttggagtgccgtttccttttt

SEQ ID NO: 40791 - DNA, 35 bp, Artificial Sequence
  Synthetic oligonucleotide
acagggcctagccacgcaaatactcctgtcccaca

SEQ ID NO: 40792 - DNA, 36 bp, Artificial Sequence
  Synthetic oligonucleotide
aatcccacgtacctttccacagactcgagacgtaca

SEQ ID NO: 40793 - DNA, 36 bp, Artificial Sequence
  Synthetic oligonucleotide
gtgcagtcaatctcatttctcgcgccctgctttaca

SEQ ID NO: 40794 - DNA, 36 bp, Artificial Sequence
  Synthetic oligonucleotide
tctcaaccacatgagggtgcagtttagctcatttca

SEQ ID NO: 40795 - DNA, 37 bp, Artificial Sequence
  Synthetic oligonucleotide
gctacaactggccctgacgatccctgctcctacgaga

SEQ ID NO: 40796 - DNA, 36 bp, Artificial Sequence
  Synthetic oligonucleotide
ttagaagcccggcactgctagccacctgccccacga

SEQ ID NO: 40797 - DNA, 37 bp, Artificial Sequence
  Synthetic oligonucleotide
gatctgtccccgaggcgttaactcctgtcccgcccga

SEQ ID NO: 40798 - DNA, 37 bp, Artificial Sequence
  Synthetic oligonucleotide
gtcgtccttccggtacacgctccccctcttttggcga

SEQ ID NO: 40799 - DNA, 37 bp, Artificial Sequence
  Synthetic oligonucleotide
tttgactctgcacatatcactgaaccatcctatgcga

SEQ ID NO: 40800 - DNA, 36 bp, Artificial Sequence
  Synthetic oligonucleotide
agcactgctggtttaggtccctccatggcttttcga

SEQ ID NO: 40801 - DNA, 37 bp, Artificial Sequence
  Synthetic oligonucleotide
actcccctgcactgcttgccccttgtggttccacgga

SEQ ID NO: 40802 - DNA, 37 bp, Artificial Sequence
  Synthetic oligonucleotide
atcagcccgcgcaaacattacagtactaccgccttga

SEQ ID NO: 40803 - DNA, 37 bp, Artificial Sequence
  Synthetic oligonucleotide
tccaccaccgttcgcttcattggacatctccagttga

SEQ ID NO: 40804 - DNA, 36 bp, Artificial Sequence
  Synthetic oligonucleotide
aaccagagccgatcagctcccttgttcatctcgcta

SEQ ID NO: 40805 - DNA, 36 bp, Artificial Sequence
  Synthetic oligonucleotide
tgacgggcttcggaccgtggggggtgcaaggggtta

SEQ ID NO: 40806 - DNA, 35 bp, Artificial Sequence
  Synthetic oligonucleotide
gcccgcaacaccacatcacctgtcgctggacacac

SEQ ID NO: 40807 - DNA, 35 bp, Artificial Sequence
  Synthetic oligonucleotide
tctgtaccagccggactatccgtcacaatacatac

SEQ ID NO: 40808 - DNA, 35 bp, Artificial Sequence
  Synthetic oligonucleotide
taaaccatctgacctcaggagccacgttgtacccc

SEQ ID NO: 40809 - DNA, 35 bp, Artificial Sequence
  Synthetic oligonucleotide
gttccggaccgcagtaagcacgctgctaccgatcc

SEQ ID NO: 40810 - DNA, 35 bp, Artificial Sequence
  Synthetic oligonucleotide
tagcctaccgcaaacacgcgacacgccgccaccgc

SEQ ID NO: 40811 - DNA, 35 bp, Artificial Sequence
  Synthetic oligonucleotide
tacacgtactgtggcgctgggtggtcggggcgggc

SEQ ID NO: 40812 - DNA, 35 bp, Artificial Sequence
  Synthetic oligonucleotide
gacaggggggggaaattaaatgattggaaagagtc

SEQ ID NO: 40813 - DNA, 35 bp, Artificial Sequence
  Synthetic oligonucleotide
attaggggagggtgagggctctgcacatgaagggg

SEQ ID NO: 40814 - DNA, 35 bp, Artificial Sequence
  Synthetic oligonucleotide
acaaagtgggggagtagcaaactgatcgaccgggg

SEQ ID NO: 40815 - DNA, 35 bp, Artificial Sequence
  Synthetic oligonucleotide
tctacctcagcgctatcatgaatccaccgttattg

SEQ ID NO: 40816 - DNA, 35 bp, Artificial Sequence
  Synthetic oligonucleotide
ttcaacgtagcatattccctcccatcgactttact

SEQ ID NO: 40817 - DNA, 35 bp, Artificial Sequence
  Synthetic oligonucleotide
tctgatcctgtacgccgtgtccctaaatcgtagct

SEQ ID NO: 40818 - DNA, 35 bp, Artificial Sequence
  Synthetic oligonucleotide
tgcgggccacgccaaaacaggtaaatcaccgctct

SEQ ID NO: 40819 - DNA, 35 bp, Artificial Sequence
  Synthetic oligonucleotide
tcccaccgggcggttggtaactccacacgacttgt

SEQ ID NO: 40820 - DNA, 35 bp, Artificial Sequence
  Synthetic oligonucleotide
atctgcagggcactcgctcccactcccctgatcaa

SEQ ID NO: 40821 - DNA, 36 bp, Artificial Sequence
  Synthetic oligonucleotide
gccgacgacggctcggtggcattataggtaagggaa

SEQ ID NO: 40822 - DNA, 36 bp, Artificial Sequence
  Synthetic oligonucleotide
acgtgacaacagcggataggggtatcaatcgtaaca

SEQ ID NO: 40823 - DNA, 35 bp, Artificial Sequence
  Synthetic oligonucleotide
taccatcatgcatgcccccctcgcttattttgcca

SEQ ID NO: 40824 - DNA, 36 bp, Artificial Sequence
  Synthetic oligonucleotide
aaccatgcgtaatttgatctgcgccggctaccctca

SEQ ID NO: 40825 - DNA, 35 bp, Artificial Sequence
  Synthetic oligonucleotide
tccctctcgccattcactgcatcaagacattgtca

SEQ ID NO: 40826 - DNA, 35 bp, Artificial Sequence
  Synthetic oligonucleotide
tatgggcactggaaaggtggggaacggaatgaaga

SEQ ID NO: 40827 - DNA, 36 bp, Artificial Sequence
  Synthetic oligonucleotide
gatccgagccgaacgagtagatcgccccccttgaga

SEQ ID NO: 40828 - DNA, 36 bp, Artificial Sequence
  Synthetic oligonucleotide
gtgagtgacatgtgggggcgggggagtagcattaga

SEQ ID NO: 40829 - DNA, 36 bp, Artificial Sequence
  Synthetic oligonucleotide
aaccacgccagcccttttgccgctacagatcttaga

SEQ ID NO: 40830 - DNA, 37 bp, Artificial Sequence
  Synthetic oligonucleotide
ttcgcctctgatctgcaggcctctttgaccccaccga

SEQ ID NO: 40831 - DNA, 37 bp, Artificial Sequence
  Synthetic oligonucleotide
gatggtgaccatagcgaaaaagagtcagggaggcgga

SEQ ID NO: 40832 - DNA, 36 bp, Artificial Sequence
  Synthetic oligonucleotide
tccattgcgccgaactcctcgctccccacattcgga

SEQ ID NO: 40833 - DNA, 38 bp, Artificial Sequence
  Synthetic oligonucleotide
tgaaacgaactagaaagggaacgggcatgatcgaatga

SEQ ID NO: 40834 - DNA, 38 bp, Artificial Sequence
  Synthetic oligonucleotide
agatgccccgcagctgaattgccatcttttagccatga

SEQ ID NO: 40835 - DNA, 38 bp, Artificial Sequence
  Synthetic oligonucleotide
actatgcagtaggggggggcggaggggagaggtgatga

SEQ ID NO: 40836 - DNA, 36 bp, Artificial Sequence
  Synthetic oligonucleotide
actggttgatcggggggagtaatggaggattgatga

SEQ ID NO: 40837 - DNA, 35 bp, Artificial Sequence
  Synthetic oligonucleotide
gataccctggcgagctcaggccccacaccacctga

SEQ ID NO: 40838 - DNA, 38 bp, Artificial Sequence
  Synthetic oligonucleotide
attactgcgcccaccgtttgctgcactagaatttctga

SEQ ID NO: 40839 - DNA, 38 bp, Artificial Sequence
  Synthetic oligonucleotide
aactgcacctgcatgcccgtggatggtcctctccttga

SEQ ID NO: 40840 - DNA, 36 bp, Artificial Sequence
  Synthetic oligonucleotide
ttgcaacgaatgcctctacttttctctgcctgttga

SEQ ID NO: 40841 - DNA, 35 bp, Artificial Sequence
  Synthetic oligonucleotide
aatgggcccacggatccgtaccttcccctttgata

SEQ ID NO: 40842 - DNA, 35 bp, Artificial Sequence
  Synthetic oligonucleotide
tccctgtcctagcttcgtatccgggcctttatata

SEQ ID NO: 40843 - DNA, 36 bp, Artificial Sequence
  Synthetic oligonucleotide
gcgccttccgtcctccctctgtcaacgcgcgatcta

SEQ ID NO: 40844 - DNA, 35 bp, Artificial Sequence
  Synthetic oligonucleotide
tggaaccctacatgcctacatctgccggaacccac

SEQ ID NO: 40845 - DNA, 35 bp, Artificial Sequence
  Synthetic oligonucleotide
tgtcccctcacgtgaacatgcatccctttcgatac

SEQ ID NO: 40846 - DNA, 35 bp, Artificial Sequence
  Synthetic oligonucleotide
gccgccatcggacctacggaactccattttactac

SEQ ID NO: 40847 - DNA, 35 bp, Artificial Sequence
  Synthetic oligonucleotide
gcccccgttagaacttccccaattacccctgcacc

SEQ ID NO: 40848 - DNA, 35 bp, Artificial Sequence
  Synthetic oligonucleotide
acaccgccaccagacaatcgtggatcccaatggcc

SEQ ID NO: 40849 - DNA, 35 bp, Artificial Sequence
  Synthetic oligonucleotide
actgcgcctggggcgatcctcctgtaccattctgc

SEQ ID NO: 40850 - DNA, 35 bp, Artificial Sequence
  Synthetic oligonucleotide
tccaagagcacccctcttaccccccgtcaacgatc

SEQ ID NO: 40851 - DNA, 35 bp, Artificial Sequence
  Synthetic oligonucleotide
aagccgaatcgccatgttaactcccggtgaatctc

SEQ ID NO: 40852 - DNA, 35 bp, Artificial Sequence
  Synthetic oligonucleotide
gccgacgcgtgccgaccagtgtctgtcatcttgtc

SEQ ID NO: 40853 - DNA, 35 bp, Artificial Sequence
  Synthetic oligonucleotide
ttgtaaagcagcccatcttctgaaagttcttcttc

SEQ ID NO: 40854 - DNA, 35 bp, Artificial Sequence
  Synthetic oligonucleotide
gaaggccgaactttattatgccagcttactttttc

SEQ ID NO: 40855 - DNA, 35 bp, Artificial Sequence
  Synthetic oligonucleotide
atagggggagtggttggggtacataggactagctg

SEQ ID NO: 40856 - DNA, 35 bp, Artificial Sequence
  Synthetic oligonucleotide
accgacccaccacgacagatcactgataaacgttg

SEQ ID NO: 40857 - DNA, 35 bp, Artificial Sequence
  Synthetic oligonucleotide
tcacctcgcgcgttgaccccctcttaatcatgttg

SEQ ID NO: 40858 - DNA, 35 bp, Artificial Sequence
  Synthetic oligonucleotide
ggtataccatctgagcgaatcctgtttcttctttg

SEQ ID NO: 40859 - DNA, 35 bp, Artificial Sequence
  Synthetic oligonucleotide
gctagggtactggcccggtcataacgcaacaccat

SEQ ID NO: 40860 - DNA, 35 bp, Artificial Sequence
  Synthetic oligonucleotide
tctctcagcactgctcgtaaaacctggcctttcat

SEQ ID NO: 40861 - DNA, 35 bp, Artificial Sequence
  Synthetic oligonucleotide
gccgtgcactgcccctgtccctcctcatcctcagt

SEQ ID NO: 40862 - DNA, 35 bp, Artificial Sequence
  Synthetic oligonucleotide
gtcacacatccgaggttagtcccaggcgccaactt

SEQ ID NO: 40863 - DNA, 35 bp, Artificial Sequence
  Synthetic oligonucleotide
acttacccccctgtgacgaacgctcgaatttcgtt

SEQ ID NO: 40864 - DNA, 36 bp, Artificial Sequence
  Synthetic oligonucleotide
gcacgcacatgccccgccccttgccagcagtgataa

SEQ ID NO: 40865 - DNA, 36 bp, Artificial Sequence
  Synthetic oligonucleotide
gcaactgtcatcacgattgcgcatcataacctaaca

SEQ ID NO: 40866 - DNA, 36 bp, Artificial Sequence
  Synthetic oligonucleotide
gatgccacggacaaacggtaattctcggtcgcacca

SEQ ID NO: 40867 - DNA, 36 bp, Artificial Sequence
  Synthetic oligonucleotide
tactacccagccacaccggtatcttccgttatagca

SEQ ID NO: 40868 - DNA, 35 bp, Artificial Sequence
  Synthetic oligonucleotide
ttgtgaccccctcccccagcctacccaggacaaga

SEQ ID NO: 40869 - DNA, 37 bp, Artificial Sequence
  Synthetic oligonucleotide
tgtccgtagcatccccttgtattttgttcctcccaga

SEQ ID NO: 40870 - DNA, 35 bp, Artificial Sequence
  Synthetic oligonucleotide
gactgtccaggatgaatgggggcaagggggggcga

SEQ ID NO: 40871 - DNA, 37 bp, Artificial Sequence
  Synthetic oligonucleotide
tgaggggaaggtagagcgacaaagggaggcaacggga

SEQ ID NO: 40872 - DNA, 37 bp, Artificial Sequence
  Synthetic oligonucleotide
gacggtgtcaccatgtgtccctgtaacttctcgctga

SEQ ID NO: 40873 - DNA, 38 bp, Artificial Sequence
  Synthetic oligonucleotide
gaagctgtcactattcttcgctgccatgccactgctga

SEQ ID NO: 40874 - DNA, 38 bp, Artificial Sequence
  Synthetic oligonucleotide
agggtgtacccgcccctgtgtctcttcctgttccgtga

SEQ ID NO: 40875 - DNA, 38 bp, Artificial Sequence
  Synthetic oligonucleotide
tgtgagcgcaatacaccccggccccaatttcatcgtga

SEQ ID NO: 40876 - DNA, 38 bp, Artificial Sequence
  Synthetic oligonucleotide
aactcagggcgtgactggggggtaatgatagggggtga

SEQ ID NO: 40877 - DNA, 36 bp, Artificial Sequence
  Synthetic oligonucleotide
ttgagctggccttccttcgccaacatgctatgcata

SEQ ID NO: 40878 - DNA, 36 bp, Artificial Sequence
  Synthetic oligonucleotide
tgcatccgaatttgctgctctacccagctggcccta

SEQ ID NO: 40879 - DNA, 36 bp, Artificial Sequence
  Synthetic oligonucleotide
gcgaacgggctctcgttcgtcccccccactcacgta

SEQ ID NO: 40880 - DNA, 35 bp, Artificial Sequence
  Synthetic oligonucleotide
tcacccgccctagtatatgctgatgtgccccctta

SEQ ID NO: 40881 - DNA, 36 bp, Artificial Sequence
  Synthetic oligonucleotide
acacgcgtacactgctaccccaagatctgtaagtta

SEQ ID NO: 40882 - DNA, 35 bp, Artificial Sequence
  Synthetic oligonucleotide
agaccacgcctgcattctctacggagcgtacacac

SEQ ID NO: 40883 - DNA, 37 bp, Artificial Sequence
  Synthetic oligonucleotide
actccaccccaggcatggtctatctatttcgtgcgac

SEQ ID NO: 40884 - DNA, 35 bp, Artificial Sequence
  Synthetic oligonucleotide
gccactcttcgcttaccctagctgtccgaatcgac

SEQ ID NO: 40885 - DNA, 35 bp, Artificial Sequence
  Synthetic oligonucleotide
aatgacacatactcgacagtaaaacggaccttacc

SEQ ID NO: 40886 - DNA, 35 bp, Artificial Sequence
  Synthetic oligonucleotide
tctcccagggctaatctcgtgttttcgcacacgcc

SEQ ID NO: 40887 - DNA, 35 bp, Artificial Sequence
  Synthetic oligonucleotide
ggaccacgtgtccgcctaatacacccctctcgtcc

SEQ ID NO: 40888 - DNA, 35 bp, Artificial Sequence
  Synthetic oligonucleotide
taaaccagccactgcctcctgtaagtcaactccgc

SEQ ID NO: 40889 - DNA, 35 bp, Artificial Sequence
  Synthetic oligonucleotide
actgggccgaggccttgattttgcttttggtctgc

SEQ ID NO: 40890 - DNA, 35 bp, Artificial Sequence
  Synthetic oligonucleotide
agcaacacactctctgcccgcgctcgtcatacccg

SEQ ID NO: 40891 - DNA, 35 bp, Artificial Sequence
  Synthetic oligonucleotide
atccacacaccggtgaccgaaccgcaatagactcg

SEQ ID NO: 40892 - DNA, 35 bp, Artificial Sequence
  Synthetic oligonucleotide
atctcaagtgataacgcctgcactctctctaccat

SEQ ID NO: 40893 - DNA, 35 bp, Artificial Sequence
  Synthetic oligonucleotide
acaaccgacccgccttcctgccgaactagaccgat

SEQ ID NO: 40894 - DNA, 35 bp, Artificial Sequence
  Synthetic oligonucleotide
acctgtgcccgtttcctcagatcttgcatatacct

SEQ ID NO: 40895 - DNA, 35 bp, Artificial Sequence
  Synthetic oligonucleotide
gcacgcctctaagcatcttaggccctgagctacct

SEQ ID NO: 40896 - DNA, 35 bp, Artificial Sequence
  Synthetic oligonucleotide
tcgactctgcgactcatcattttatcgcgtctcct

SEQ ID NO: 40897 - DNA, 35 bp, Artificial Sequence
  Synthetic oligonucleotide
tcatctacaccgtcctatgcctctctttactctgt

SEQ ID NO: 40898 - DNA, 35 bp, Artificial Sequence
  Synthetic oligonucleotide
gtagtgccctcatcgttttcttagcaaccacgttt

SEQ ID NO: 40899 - DNA, 35 bp, Artificial Sequence
  Synthetic oligonucleotide
gagccacccctactgtattaaaacgtggcgctttt

SEQ ID NO: 40900 - DNA, 35 bp, Artificial Sequence
  Synthetic oligonucleotide
gacatagtgatagaaaatggtggccgcacgggaaa

SEQ ID NO: 40901 - DNA, 36 bp, Artificial Sequence
  Synthetic oligonucleotide
gacactgatatgtcctctaatagttgatgctacgaa

SEQ ID NO: 40902 - DNA, 35 bp, Artificial Sequence
  Synthetic oligonucleotide
tgcatcatcactgcagcgccgcacgttccctctaa

SEQ ID NO: 40903 - DNA, 35 bp, Artificial Sequence
  Synthetic oligonucleotide
tgccgacagtccattttgcccctataactttgtaa

SEQ ID NO: 40904 - DNA, 35 bp, Artificial Sequence
  Synthetic oligonucleotide
gagtgcgcccgaacgttcatggccacaccagacca

SEQ ID NO: 40905 - DNA, 36 bp, Artificial Sequence
  Synthetic oligonucleotide
tcacccttccaccgattagaagtgtcgtttcaccca

SEQ ID NO: 40906 - DNA, 35 bp, Artificial Sequence
  Synthetic oligonucleotide
tagccagcatcacacttgcttccggttaagcccca

SEQ ID NO: 40907 - DNA, 36 bp, Artificial Sequence
  Synthetic oligonucleotide
gtatcgccgacatttcctggtgacatccacttccca

SEQ ID NO: 40908 - DNA, 35 bp, Artificial Sequence
  Synthetic oligonucleotide
tccaccgcaaggtaatttaacatgacatgcaagca

SEQ ID NO: 40909 - DNA, 36 bp, Artificial Sequence
  Synthetic oligonucleotide
agcggtaccgaaggtaatgcgattcactccacctca

SEQ ID NO: 40910 - DNA, 37 bp, Artificial Sequence
  Synthetic oligonucleotide
gattgggtagagggggaaagggagcgactagtgacga

SEQ ID NO: 40911 - DNA, 37 bp, Artificial Sequence
  Synthetic oligonucleotide
gttcgcccacttcaaatactattggatcaacattgga

SEQ ID NO: 40912 - DNA, 38 bp, Artificial Sequence
  Synthetic oligonucleotide
acacttgacctccatgctcccgcggtcttatctaatga

SEQ ID NO: 40913 - DNA, 38 bp, Artificial Sequence
  Synthetic oligonucleotide
tcccagccgcccctttccgtaggactgacttcccctga

SEQ ID NO: 40914 - DNA, 38 bp, Artificial Sequence
  Synthetic oligonucleotide
agcgagagcccgctgtaacaactcgtgtccctccctga

SEQ ID NO: 40915 - DNA, 37 bp, Artificial Sequence
  Synthetic oligonucleotide
ggtcaacagaccgcgttcccatcatatcgttatctga

SEQ ID NO: 40916 - DNA, 37 bp, Artificial Sequence
  Synthetic oligonucleotide
gtctacccccactccgtcacgcaccctgtagtggtga

SEQ ID NO: 40917 - DNA, 37 bp, Artificial Sequence
  Synthetic oligonucleotide
tagaacacagatgcgggttaagtaaggaggggtgtga

SEQ ID NO: 40918 - DNA, 37 bp, Artificial Sequence
  Synthetic oligonucleotide
gtagtgggacggggtatggggggatgctgtgatttga

SEQ ID NO: 40919 - DNA, 37 bp, Artificial Sequence
  Synthetic oligonucleotide
atggtccagaccgctgcctatccaatagttattttga

SEQ ID NO: 40920 - DNA, 34 bp, Artificial Sequence
  Synthetic oligonucleotide
tacgtggacgtgtaccggttttctgtttcgtgcc

SEQ ID NO: 40921 - DNA, 35 bp, Artificial Sequence
  Synthetic oligonucleotide
atcaccccgcttagtagtgcttttccggttgaatc

SEQ ID NO: 40922 - DNA, 35 bp, Artificial Sequence
  Synthetic oligonucleotide
acatcttgctctacctcgcccctctggatcgactc

SEQ ID NO: 40923 - DNA, 35 bp, Artificial Sequence
  Synthetic oligonucleotide
ttcgcgcactaatcgtgttagtcgcccgccatttc

SEQ ID NO: 40924 - DNA, 35 bp, Artificial Sequence
  Synthetic oligonucleotide
tcgagctccgcaatatcgttaatctttcccccgcg

SEQ ID NO: 40925 - DNA, 35 bp, Artificial Sequence
  Synthetic oligonucleotide
gcccacaacttccgcgcattgcacactccgagggg

SEQ ID NO: 40926 - DNA, 35 bp, Artificial Sequence
  Synthetic oligonucleotide
gtgaggtaaaggtgatggagtggtactagtgtggg

SEQ ID NO: 40927 - DNA, 35 bp, Artificial Sequence
  Synthetic oligonucleotide
ggtgagaggttgggtagggcaagggcacgacatgg

SEQ ID NO: 40928 - DNA, 35 bp, Artificial Sequence
  Synthetic oligonucleotide
atcacccgctggaacaacgaaataacttaattggt

SEQ ID NO: 40929 - DNA, 35 bp, Artificial Sequence
  Synthetic oligonucleotide
atgtgagttgtgagggggtgggagaaggagacaaa

SEQ ID NO: 40930 - DNA, 36 bp, Artificial Sequence
  Synthetic oligonucleotide
gtgggaaggaagagcggcataggggatgaggcgtaa

SEQ ID NO: 40931 - DNA, 35 bp, Artificial Sequence
  Synthetic oligonucleotide
ttaaccccgcctcgggctagaaccacattcacgca

SEQ ID NO: 40932 - DNA, 36 bp, Artificial Sequence
  Synthetic oligonucleotide
ttgatcggcgcaccttgtctacccgcccgctttgca

SEQ ID NO: 40933 - DNA, 37 bp, Artificial Sequence
  Synthetic oligonucleotide
gatggatggaggggcggggggatagttcttgggaaga

SEQ ID NO: 40934 - DNA, 37 bp, Artificial Sequence
  Synthetic oligonucleotide
aacacaggggatgtatagaggggaagtgtatataaga

SEQ ID NO: 40935 - DNA, 37 bp, Artificial Sequence
  Synthetic oligonucleotide
aacatgtacatcaacacctgcttgcagccctccccga

SEQ ID NO: 40936 - DNA, 37 bp, Artificial Sequence
  Synthetic oligonucleotide
tgcctgagcccttgttgcacggttgtccgttctccga

SEQ ID NO: 40937 - DNA, 37 bp, Artificial Sequence
  Synthetic oligonucleotide
ttcgacacgagtgtgtcagtttccccttcatcatcga

SEQ ID NO: 40938 - DNA, 38 bp, Artificial Sequence
  Synthetic oligonucleotide
gaggacagaagccatcgtggaaggggagggggtgatga

SEQ ID NO: 40939 - DNA, 37 bp, Artificial Sequence
  Synthetic oligonucleotide
gaattcgtaaggagggcggagggggggacgtctatga

SEQ ID NO: 40940 - DNA, 37 bp, Artificial Sequence
  Synthetic oligonucleotide
gcaacagcctctcgtaatccgttcctgacacatctga

SEQ ID NO: 40941 - DNA, 38 bp, Artificial Sequence
  Synthetic oligonucleotide
gatgatggagtggataaagcagggctgattaaaagtga

SEQ ID NO: 40942 - DNA, 38 bp, Artificial Sequence
  Synthetic oligonucleotide
acagtagccccctatcccgctcgtctaggcacacttga

SEQ ID NO: 40943 - DNA, 38 bp, Artificial Sequence
  Synthetic oligonucleotide
tgcgcttatgcccaccgccacgtcactccatcccttga

SEQ ID NO: 40944 - DNA, 36 bp, Artificial Sequence
  Synthetic oligonucleotide
atgcctaccgccaaaggaacaaacgggtgccaaata

SEQ ID NO: 40945 - DNA, 36 bp, Artificial Sequence
  Synthetic oligonucleotide
ggtcgccccattgcgcccaactgaatcctgagttta

SEQ ID NO: 40946 - DNA, 35 bp, Artificial Sequence
  Synthetic oligonucleotide
ggtccagctccacccacttactacgcatgccagcc

SEQ ID NO: 40947 - DNA, 35 bp, Artificial Sequence
  Synthetic oligonucleotide
gaacagcgcgtagtccgggtccgtcgaatccttcc

SEQ ID NO: 40948 - DNA, 35 bp, Artificial Sequence
  Synthetic oligonucleotide
tgtatgggcccgggcacgttcactatacgctttcc

SEQ ID NO: 40949 - DNA, 35 bp, Artificial Sequence
  Synthetic oligonucleotide
ttagacactgtcaccatattgttctcttattcgtc

SEQ ID NO: 40950 - DNA, 35 bp, Artificial Sequence
  Synthetic oligonucleotide
aacacagccggagcttccttgcaccttatactaat

SEQ ID NO: 40951 - DNA, 35 bp, Artificial Sequence
  Synthetic oligonucleotide
gccacactgagcccttaacaatcacgttctttgat

SEQ ID NO: 40952 - DNA, 35 bp, Artificial Sequence
  Synthetic oligonucleotide
ccagtgaaccttgctgttgtcatccccctcctcct

SEQ ID NO: 40953 - DNA, 35 bp, Artificial Sequence
  Synthetic oligonucleotide
tctgcaccagctctcctgcaacgtcacctggtttt

SEQ ID NO: 40954 - DNA, 36 bp, Artificial Sequence
  Synthetic oligonucleotide
ttgcacccatgcactccctggccgacctgtcctaaa

SEQ ID NO: 40955 - DNA, 35 bp, Artificial Sequence
  Synthetic oligonucleotide
gcgggagacgatgtagaggggggagggagtgtaaa

SEQ ID NO: 40956 - DNA, 37 bp, Artificial Sequence
  Synthetic oligonucleotide
tctacaggcacatctttcttgcgagtcacgcccccaa

SEQ ID NO: 40957 - DNA, 35 bp, Artificial Sequence
  Synthetic oligonucleotide
atgcccgacgcattcccaccatgtaagttcatcaa

SEQ ID NO: 40958 - DNA, 35 bp, Artificial Sequence
  Synthetic oligonucleotide
acagtccccggtccgtaagctctctcttaaacaca

SEQ ID NO: 40959 - DNA, 35 bp, Artificial Sequence
  Synthetic oligonucleotide
ttagtcacccctgtccgcgtagtgcgccgagccca

SEQ ID NO: 40960 - DNA, 36 bp, Artificial Sequence
  Synthetic oligonucleotide
tatgccagccggctagtcccaaatgcctgtaatcca

SEQ ID NO: 40961 - DNA, 36 bp, Artificial Sequence
  Synthetic oligonucleotide
gaacccccctcgagccaccccaactcagtgcattca

SEQ ID NO: 40962 - DNA, 36 bp, Artificial Sequence
  Synthetic oligonucleotide
acgagaagccactgacctacgcgctacactacaaga

SEQ ID NO: 40963 - DNA, 37 bp, Artificial Sequence
  Synthetic oligonucleotide
aaccccaacaacctcctgcccggctaccacctgcaga

SEQ ID NO: 40964 - DNA, 37 bp, Artificial Sequence
  Synthetic oligonucleotide
taatgaagacatgagggggcatggtgacacagataga

SEQ ID NO: 40965 - DNA, 36 bp, Artificial Sequence
  Synthetic oligonucleotide
acacaacaccaaactggacatgctacgaccttagga

SEQ ID NO: 40966 - DNA, 37 bp, Artificial Sequence
  Synthetic oligonucleotide
aaccacccagacactcccgataggttcgctttgcgga

SEQ ID NO: 40967 - DNA, 37 bp, Artificial Sequence
  Synthetic oligonucleotide
tggagaggaggaatacccgagagagagtggagaggga

SEQ ID NO: 40968 - DNA, 38 bp, Artificial Sequence
  Synthetic oligonucleotide
acacacccactgaagtggttgcgcttcttcctccggga

SEQ ID NO: 40969 - DNA, 37 bp, Artificial Sequence
  Synthetic oligonucleotide
tgtgcctgccttacagtgcaagcttctctcaccatga

SEQ ID NO: 40970 - DNA, 38 bp, Artificial Sequence
  Synthetic oligonucleotide
tgtgccatctcacagggcctttgaatcaccaatcatga

SEQ ID NO: 40971 - DNA, 38 bp, Artificial Sequence
  Synthetic oligonucleotide
gcctgctgggacacactgcctctcgacactgttcatga

SEQ ID NO: 40972 - DNA, 38 bp, Artificial Sequence
  Synthetic oligonucleotide
aacacaacactcaacgcattaactgagacagccactga

SEQ ID NO: 40973 - DNA, 38 bp, Artificial Sequence
  Synthetic oligonucleotide
tgtgcgcccgtcatggaaatctcgtccatccatcctga

SEQ ID NO: 40974 - DNA, 37 bp, Artificial Sequence
  Synthetic oligonucleotide
ttgcccacacgccgacccgcatgatcacgtatcgtga

SEQ ID NO: 40975 - DNA, 36 bp, Artificial Sequence
  Synthetic oligonucleotide
tcaggggggtaagatcggggtgcgggggtaaggtga

SEQ ID NO: 40976 - DNA, 37 bp, Artificial Sequence
  Synthetic oligonucleotide
tcgatgagcacatatcctgagcctgcttttcctgtga

SEQ ID NO: 40977 - DNA, 38 bp, Artificial Sequence
  Synthetic oligonucleotide
tgacgcccgtcgccctgttgtcactgtatgtcccttga

SEQ ID NO: 40978 - DNA, 38 bp, Artificial Sequence
  Synthetic oligonucleotide
gctgcctgcccgccttgcgtaatatgcgctatccttga

SEQ ID NO: 40979 - DNA, 37 bp, Artificial Sequence
  Synthetic oligonucleotide
tcacacccagtgccttaaccgcccacgagaacgttga

SEQ ID NO: 40980 - DNA, 38 bp, Artificial Sequence
  Synthetic oligonucleotide
acaggcacccgcgctcagtagacctgccgcccttttga

SEQ ID NO: 40981 - DNA, 36 bp, Artificial Sequence
  Synthetic oligonucleotide
atagtgctccgggcacgggtagggcgggcacgaata

SEQ ID NO: 40982 - DNA, 36 bp, Artificial Sequence
  Synthetic oligonucleotide
gccacatatgccgcgtaatcggcgaatcacacacta

SEQ ID NO: 40983 - DNA, 35 bp, Artificial Sequence
  Synthetic oligonucleotide
gatcctcgcattctatataggcttagcctccccta

SEQ ID NO: 40984 - DNA, 35 bp, Artificial Sequence
  Synthetic oligonucleotide
gaccactgacgagggctcccccacctgttgaatta

SEQ ID NO: 40985 - DNA, 36 bp, Artificial Sequence
  Synthetic oligonucleotide
gtcgtaccatccagtatgccatcgactccaggttta

SEQ ID NO: 40986 - DNA, 35 bp, Artificial Sequence
  Synthetic oligonucleotide
gctgactacccgaactctgtttgactgttatcaac

SEQ ID NO: 40987 - DNA, 35 bp, Artificial Sequence
  Synthetic oligonucleotide
atccacacaatacatacgagtttcattacctgcac

SEQ ID NO: 40988 - DNA, 35 bp, Artificial Sequence
  Synthetic oligonucleotide
acaaggcctcccgcccagtctatcgtaacaaccgc

SEQ ID NO: 40989 - DNA, 35 bp, Artificial Sequence
  Synthetic oligonucleotide
aatccgcaggcttgggcgttcaaccagctggcctc

SEQ ID NO: 40990 - DNA, 35 bp, Artificial Sequence
  Synthetic oligonucleotide
gagccaaccctcactccgtcttttcgtctctccag

SEQ ID NO: 40991 - DNA, 35 bp, Artificial Sequence
  Synthetic oligonucleotide
gtctaaccctgtgccactctcgtttttgatgatag

SEQ ID NO: 40992 - DNA, 35 bp, Artificial Sequence
  Synthetic oligonucleotide
taccagggggggagatatggagtggtatggcttgg

SEQ ID NO: 40993 - DNA, 35 bp, Artificial Sequence
  Synthetic oligonucleotide
gtagcgcaacctttcttatctatcggtgagccact

SEQ ID NO: 40994 - DNA, 35 bp, Artificial Sequence
  Synthetic oligonucleotide
actgaaaccagctcacaggtatgcgtcatccatct

SEQ ID NO: 40995 - DNA, 35 bp, Artificial Sequence
  Synthetic oligonucleotide
acaacgccctccccagtgcccatagggcattaggt

SEQ ID NO: 40996 - DNA, 35 bp, Artificial Sequence
  Synthetic oligonucleotide
accactgcccactcccggtcgacgcccgctaccca

SEQ ID NO: 40997 - DNA, 35 bp, Artificial Sequence
  Synthetic oligonucleotide
tcatacaccatcgaatgtaacctgagcgaacccca

SEQ ID NO: 40998 - DNA, 37 bp, Artificial Sequence
  Synthetic oligonucleotide
ttggggtgactcaggggaaaagtagcagggagagaga

SEQ ID NO: 40999 - DNA, 36 bp, Artificial Sequence
  Synthetic oligonucleotide
gcccaagtcagtcttttctaatttgcctaacccgga

SEQ ID NO: 41000 - DNA, 35 bp, Artificial Sequence
  Synthetic oligonucleotide
atccgatctgacacatcctgtaattactgacctga

SEQ ID NO: 41001 - DNA, 37 bp, Artificial Sequence
  Synthetic oligonucleotide
gtcgatgtcttccacgcctcccgatcatttagcctga

SEQ ID NO: 41002 - DNA, 38 bp, Artificial Sequence
  Synthetic oligonucleotide
ttcccgcctcgattttcaccgccttccggaattcctga

SEQ ID NO: 41003 - DNA, 37 bp, Artificial Sequence
  Synthetic oligonucleotide
tccacggccccgctccaaaacgctccgtgtttcctga

SEQ ID NO: 41004 - DNA, 38 bp, Artificial Sequence
  Synthetic oligonucleotide
aaggtggggagtcaacggtaagggcggtgggaggctga

SEQ ID NO: 41005 - DNA, 37 bp, Artificial Sequence
  Synthetic oligonucleotide
tcgccccacctggcatcgtaacttacatctctgctga

SEQ ID NO: 41006 - DNA, 38 bp, Artificial Sequence
  Synthetic oligonucleotide
aacccaccctcgtcccagtgcggccatgtacgctttga

SEQ ID NO: 41007 - DNA, 38 bp, Artificial Sequence
  Synthetic oligonucleotide
acagcctccgaccatcccttaggcactccgatttttga

SEQ ID NO: 41008 - DNA, 35 bp, Artificial Sequence
  Synthetic oligonucleotide
gttgtaagggtggattggggatggggcgtttgcta

SEQ ID NO: 41009 - DNA, 36 bp, Artificial Sequence
  Synthetic oligonucleotide
tttgtcgcccacttcactgaccccacaatgggagta

SEQ ID NO: 41010 - DNA, 36 bp, Artificial Sequence
  Synthetic oligonucleotide
tttggcgccgccatctgcacattttgtaggctatta

SEQ ID NO: 41011 - DNA, 35 bp, Artificial Sequence
  Synthetic oligonucleotide
gtaggcccccccttctccatacctcaggacctcac

SEQ ID NO: 41012 - DNA, 35 bp, Artificial Sequence
  Synthetic oligonucleotide
atggtcaccaattgggacctcacttctctgacgcc

SEQ ID NO: 41013 - DNA, 35 bp, Artificial Sequence
  Synthetic oligonucleotide
ttgccaccgtgttccaagaatgccttgttcgtgcc

SEQ ID NO: 41014 - DNA, 35 bp, Artificial Sequence
  Synthetic oligonucleotide
acgcacatcgccatgatcttttaccgcggctatcc

SEQ ID NO: 41015 - DNA, 35 bp, Artificial Sequence
  Synthetic oligonucleotide
acgttactcctgaatgtccatgtttcttggcttcc

SEQ ID NO: 41016 - DNA, 35 bp, Artificial Sequence
  Synthetic oligonucleotide
caggtcacccgctgatgccctagccgacccttctc

SEQ ID NO: 41017 - DNA, 35 bp, Artificial Sequence
  Synthetic oligonucleotide
atccacagcgtatgcaccgcgttatcatcttttag

SEQ ID NO: 41018 - DNA, 35 bp, Artificial Sequence
  Synthetic oligonucleotide
tgccacctccatcgccttccggagttccacgtatg

SEQ ID NO: 41019 - DNA, 35 bp, Artificial Sequence
  Synthetic oligonucleotide
ttggtcctcatccctgtcttctccatctgatcctg

SEQ ID NO: 41020 - DNA, 35 bp, Artificial Sequence
  Synthetic oligonucleotide
tcaccgcctcagacccgttttcgcattgtactgct

SEQ ID NO: 41021 - DNA, 35 bp, Artificial Sequence
  Synthetic oligonucleotide
tgacgtcagaaagccgcaatcgctccctctactct

SEQ ID NO: 41022 - DNA, 35 bp, Artificial Sequence
  Synthetic oligonucleotide
gagggggaatgaatgagaggggtcgggaggtgctt

SEQ ID NO: 41023 - DNA, 35 bp, Artificial Sequence
  Synthetic oligonucleotide
tatttgccgccaacttagtcatagctgccctgttt

SEQ ID NO: 41024 - DNA, 35 bp, Artificial Sequence
  Synthetic oligonucleotide
gcatagccgtaacctgcttctcggatcacccacca

SEQ ID NO: 41025 - DNA, 37 bp, Artificial Sequence
  Synthetic oligonucleotide
gagcgccctggctgcacatatttcatctattccccga

SEQ ID NO: 41026 - DNA, 37 bp, Artificial Sequence
  Synthetic oligonucleotide
ttcgcccccattggagcggacgttgccattaccgcga

SEQ ID NO: 41027 - DNA, 37 bp, Artificial Sequence
  Synthetic oligonucleotide
gggaagggagaggggaggggttaaatcaaagggcgga

SEQ ID NO: 41028 - DNA, 37 bp, Artificial Sequence
  Synthetic oligonucleotide
gaggagggaagggattgaataagggcaaagcctggga

SEQ ID NO: 41029 - DNA, 36 bp, Artificial Sequence
  Synthetic oligonucleotide
aacacacgttaggggacggggattatgggaaatgga

SEQ ID NO: 41030 - DNA, 37 bp, Artificial Sequence
  Synthetic oligonucleotide
gcatctgggaggggaatacaaggtgtgtgtggctgga

SEQ ID NO: 41031 - DNA, 38 bp, Artificial Sequence
  Synthetic oligonucleotide
acgaatgaggggggggtggatgacgacagactaaatga

SEQ ID NO: 41032 - DNA, 38 bp, Artificial Sequence
  Synthetic oligonucleotide
tgacaccgcaaacgcaccaacaccctacgtccgcatga

SEQ ID NO: 41033 - DNA, 38 bp, Artificial Sequence
  Synthetic oligonucleotide
gacatgcctatgttagcccttcgtccattctttcatga

SEQ ID NO: 41034 - DNA, 38 bp, Artificial Sequence
  Synthetic oligonucleotide
gtgtgggacacgtgttggagaagaggtgatagggatga

SEQ ID NO: 41035 - DNA, 37 bp, Artificial Sequence
  Synthetic oligonucleotide
tcccaccatcgcgctatctgcagtccgcatagactga

SEQ ID NO: 41036 - DNA, 38 bp, Artificial Sequence
  Synthetic oligonucleotide
gtcaccgcctttctcctgtttcgcagtcgctctgctga

SEQ ID NO: 41037 - DNA, 38 bp, Artificial Sequence
  Synthetic oligonucleotide
gcaacgtaaccgggcggtgtaggggggcgggatggtga

SEQ ID NO: 41038 - DNA, 38 bp, Artificial Sequence
  Synthetic oligonucleotide
taagcactgactaactactcagccagcacacttcttga

SEQ ID NO: 41039 - DNA, 38 bp, Artificial Sequence
  Synthetic oligonucleotide
atgcacccgtagcttggtctctgtcctgtcctcgttga

SEQ ID NO: 41040 - DNA, 36 bp, Artificial Sequence
  Synthetic oligonucleotide
gattccccatatggtttagctcgattacctgcttta

SEQ ID NO: 41041 - DNA, 35 bp, Artificial Sequence
  Synthetic oligonucleotide
gcaccgcgagtcatctcaacagcgattcggttccc

SEQ ID NO: 41042 - DNA, 35 bp, Artificial Sequence
  Synthetic oligonucleotide
ttgccgaactctcatctatgtcctgttgcaacgcc

SEQ ID NO: 41043 - DNA, 35 bp, Artificial Sequence
  Synthetic oligonucleotide
taacaccctggccacgaccttcaactgtggcactc

SEQ ID NO: 41044 - DNA, 36 bp, Artificial Sequence
  Synthetic oligonucleotide
gcacgggcggagggaagggaactctgggtagtggtc

SEQ ID NO: 41045 - DNA, 35 bp, Artificial Sequence
  Synthetic oligonucleotide
ttggagcgtgcctgagcttaacaccacattaattc

SEQ ID NO: 41046 - DNA, 35 bp, Artificial Sequence
  Synthetic oligonucleotide
aaccgcaacctccggccgagcccttgtaccgtttc

SEQ ID NO: 41047 - DNA, 35 bp, Artificial Sequence
  Synthetic oligonucleotide
gtagtatagatgggaagggtggatatgggggggag

SEQ ID NO: 41048 - DNA, 33 bp, Artificial Sequence
  Synthetic oligonucleotide
actttgcaccgcatcactacaagcacccgctag

SEQ ID NO: 41049 - DNA, 35 bp, Artificial Sequence
  Synthetic oligonucleotide
gaggacggaatggtggtgtctaatttgtgggttgg

SEQ ID NO: 41050 - DNA, 35 bp, Artificial Sequence
  Synthetic oligonucleotide
taccttacggtgctgacgtccatcccgccccactg

SEQ ID NO: 41051 - DNA, 35 bp, Artificial Sequence
  Synthetic oligonucleotide
gtgaaaccctcgcccggggcaccatatctcgctct

SEQ ID NO: 41052 - DNA, 35 bp, Artificial Sequence
  Synthetic oligonucleotide
acctcccccccttgctcacattgcgcctgggacaa

SEQ ID NO: 41053 - DNA, 35 bp, Artificial Sequence
  Synthetic oligonucleotide
tgtacatgccctcgtatacaataccctgctacgaa

SEQ ID NO: 41054 - DNA, 36 bp, Artificial Sequence
  Synthetic oligonucleotide
gaaccgactgtagcgccctatatcgccaactcctaa

SEQ ID NO: 41055 - DNA, 36 bp, Artificial Sequence
  Synthetic oligonucleotide
ttgcccgtcaatcaggaatctgtagcgctcccacca

SEQ ID NO: 41056 - DNA, 36 bp, Artificial Sequence
  Synthetic oligonucleotide
gtccgccactcaccgctcattacttgtcgttcagca

SEQ ID NO: 41057 - DNA, 36 bp, Artificial Sequence
  Synthetic oligonucleotide
tgagacgctcaatgttgcaccacatctgtaatcgca

SEQ ID NO: 41058 - DNA, 35 bp, Artificial Sequence
  Synthetic oligonucleotide
acacaccgctccatgttccctctcctgccggggca

SEQ ID NO: 41059 - DNA, 36 bp, Artificial Sequence
  Synthetic oligonucleotide
gtgatgaaccatgggggtaggggcttgaaatattca

SEQ ID NO: 41060 - DNA, 37 bp, Artificial Sequence
  Synthetic oligonucleotide
gaaggtccggccagtccccttatgcatgccactccga

SEQ ID NO: 41061 - DNA, 37 bp, Artificial Sequence
  Synthetic oligonucleotide
acgcgtagcgcgctagttctacccgccacctcatcga

SEQ ID NO: 41062 - DNA, 37 bp, Artificial Sequence
  Synthetic oligonucleotide
atgagaagtggacggatatggaaggtgcgaattagga

SEQ ID NO: 41063 - DNA, 37 bp, Artificial Sequence
  Synthetic oligonucleotide
acagcggtacgcctgtacgcatcatcccttctatgga

SEQ ID NO: 41064 - DNA, 36 bp, Artificial Sequence
  Synthetic oligonucleotide
aacggagaccagcagcttatctccctcattcctgga

SEQ ID NO: 41065 - DNA, 37 bp, Artificial Sequence
  Synthetic oligonucleotide
gtcctccgccccacacacagcctccaatctcagtgga

SEQ ID NO: 41066 - DNA, 38 bp, Artificial Sequence
  Synthetic oligonucleotide
gtcacgccacatctctgtcaagctcatgttgtccatga

SEQ ID NO: 41067 - DNA, 38 bp, Artificial Sequence
  Synthetic oligonucleotide
aaccaccccagttatccgcacctgttgaccgactatga

SEQ ID NO: 41068 - DNA, 38 bp, Artificial Sequence
  Synthetic oligonucleotide
acactccacgcaagtgagaacccaaacctcacccctga

SEQ ID NO: 41069 - DNA, 38 bp, Artificial Sequence
  Synthetic oligonucleotide
gttggacatggaggaaacgggatggaggagatgtctga

SEQ ID NO: 41070 - DNA, 38 bp, Artificial Sequence
  Synthetic oligonucleotide
gcaccgattgatcctgcctctttcgcctcgctaattga

SEQ ID NO: 41071 - DNA, 38 bp, Artificial Sequence
  Synthetic oligonucleotide
gcccaccgccttaaccaatgatagcgggaactctttga

SEQ ID NO: 41072 - DNA, 37 bp, Artificial Sequence
  Synthetic oligonucleotide
atccaccgatatggtctcactggcctggttgttttga

SEQ ID NO: 41073 - DNA, 36 bp, Artificial Sequence
  Synthetic oligonucleotide
tcgcatcgccgcccttgccaccattagtaacccgta

SEQ ID NO: 41074 - DNA, 35 bp, Artificial Sequence
  Synthetic oligonucleotide
gactggtcctcgtggtttcactggtttgcccctta

SEQ ID NO: 41075 - DNA, 35 bp, Artificial Sequence
  Synthetic oligonucleotide
tcgaaccccatctggcccccatcgcactgagttac

SEQ ID NO: 41076 - DNA, 35 bp, Artificial Sequence
  Synthetic oligonucleotide
gtctccaccgaacttcactagttgtcatcccctcc

SEQ ID NO: 41077 - DNA, 35 bp, Artificial Sequence
  Synthetic oligonucleotide
ggatgccctgccgcaccaacgatcaaaacatgttc

SEQ ID NO: 41078 - DNA, 35 bp, Artificial Sequence
  Synthetic oligonucleotide
ttgaacccccctgggactagatatttgatgctttc

SEQ ID NO: 41079 - DNA, 35 bp, Artificial Sequence
  Synthetic oligonucleotide
gactgacctctggaattgctgcctattcataaacg

SEQ ID NO: 41080 - DNA, 35 bp, Artificial Sequence
  Synthetic oligonucleotide
tctgcaccacccatgtccgaccattcttccgctgg

SEQ ID NO: 41081 - DNA, 35 bp, Artificial Sequence
  Synthetic oligonucleotide
gtgatgtggacggggttggtgcctcgaaaagtttg

SEQ ID NO: 41082 - DNA, 35 bp, Artificial Sequence
  Synthetic oligonucleotide
acacacgcccctccatcgttgcacttggctctcat

SEQ ID NO: 41083 - DNA, 35 bp, Artificial Sequence
  Synthetic oligonucleotide
gaccaccggctccgcttattagctttcgggtacct

SEQ ID NO: 41084 - DNA, 35 bp, Artificial Sequence
  Synthetic oligonucleotide
atccttgctgccaagatgccttatgtccccgccct

SEQ ID NO: 41085 - DNA, 35 bp, Artificial Sequence
  Synthetic oligonucleotide
ttgccatcagaatgcgacacgtctgttcaccatct

SEQ ID NO: 41086 - DNA, 35 bp, Artificial Sequence
  Synthetic oligonucleotide
tgtcgaaggccacagccttcattttggatccctct

SEQ ID NO: 41087 - DNA, 35 bp, Artificial Sequence
  Synthetic oligonucleotide
acgcccactagctttcctgctacagagcattcctt

SEQ ID NO: 41088 - DNA, 35 bp, Artificial Sequence
  Synthetic oligonucleotide
gcaacgttgcgcacttgttaccctataaccctctt

SEQ ID NO: 41089 - DNA, 35 bp, Artificial Sequence
  Synthetic oligonucleotide
gcgacaagcaggctccgttgttctcatctagcgtt

SEQ ID NO: 41090 - DNA, 36 bp, Artificial Sequence
  Synthetic oligonucleotide
tcataccatctgtcctgtatctttctcgattcaaaa

SEQ ID NO: 41091 - DNA, 36 bp, Artificial Sequence
  Synthetic oligonucleotide
ttcagcctcggtctacttataccttggcccacacaa

SEQ ID NO: 41092 - DNA, 36 bp, Artificial Sequence
  Synthetic oligonucleotide
acgctccgcccaccttctattcgtgcgtgctcccca

SEQ ID NO: 41093 - DNA, 36 bp, Artificial Sequence
  Synthetic oligonucleotide
atgtggccacggagtcgtttttattactgccctcca

SEQ ID NO: 41094 - DNA, 37 bp, Artificial Sequence
  Synthetic oligonucleotide
ggatacgtgatattggtgggcggggggtggcgtaaga

SEQ ID NO: 41095 - DNA, 35 bp, Artificial Sequence
  Synthetic oligonucleotide
attgcatgggggagtgagaatggtagggtgataga

SEQ ID NO: 41096 - DNA, 37 bp, Artificial Sequence
  Synthetic oligonucleotide
gcactgtcgggaagggtgaggtataaccaagggggga

SEQ ID NO: 41097 - DNA, 37 bp, Artificial Sequence
  Synthetic oligonucleotide
actagcgctggtcagacacttcgcacaacttcctgga

SEQ ID NO: 41098 - DNA, 38 bp, Artificial Sequence
  Synthetic oligonucleotide
tacgtccccttccatggccttccgttttgtcctcatga

SEQ ID NO: 41099 - DNA, 38 bp, Artificial Sequence
  Synthetic oligonucleotide
gtcgcacatcgccggatcttgccatgccaacccactga

SEQ ID NO: 41100 - DNA, 38 bp, Artificial Sequence
  Synthetic oligonucleotide
taccgcacctccacgggaaaaatggtcctcacccctga

SEQ ID NO: 41101 - DNA, 38 bp, Artificial Sequence
  Synthetic oligonucleotide
gtgcacttagcgcgtgcccttccgtaacttcttcctga

SEQ ID NO: 41102 - DNA, 37 bp, Artificial Sequence
  Synthetic oligonucleotide
tacagatcgatctgcctgatttaccgcctgtttctga

SEQ ID NO: 41103 - DNA, 35 bp, Artificial Sequence
  Synthetic oligonucleotide
atctgccaaccgcactctctactctttgatcgtga

SEQ ID NO: 41104 - DNA, 36 bp, Artificial Sequence
  Synthetic oligonucleotide
atggggtggaaatagtggaatggggcccagctcata

SEQ ID NO: 41105 - DNA, 35 bp, Artificial Sequence
  Synthetic oligonucleotide
gtggggacaatcagcaatctcggttcaggctcccc

SEQ ID NO: 41106 - DNA, 35 bp, Artificial Sequence
  Synthetic oligonucleotide
gtcccacttgacacacacacgctcccacgtaagcc

SEQ ID NO: 41107 - DNA, 35 bp, Artificial Sequence
  Synthetic oligonucleotide
gttccaactacgctccacctggtttccgacgcgcc

SEQ ID NO: 41108 - DNA, 35 bp, Artificial Sequence
  Synthetic oligonucleotide
tgccacctagctcttcggctcagacctcttgcgcc

SEQ ID NO: 41109 - DNA, 35 bp, Artificial Sequence
  Synthetic oligonucleotide
ttgccaacccagttacttgtacgcgtctcttctcc

SEQ ID NO: 41110 - DNA, 34 bp, Artificial Sequence
  Synthetic oligonucleotide
gctcgtagcccatgtttaaatcaaactgtaccgc

SEQ ID NO: 41111 - DNA, 35 bp, Artificial Sequence
  Synthetic oligonucleotide
gagtgtagggggtggtacataagtcgtacgtgggc

SEQ ID NO: 41112 - DNA, 35 bp, Artificial Sequence
  Synthetic oligonucleotide
gactcgatgttcttgtaaatccgtctgtctctgtc

SEQ ID NO: 41113 - DNA, 35 bp, Artificial Sequence
  Synthetic oligonucleotide
gcgacggaccaccgggccactgtctcccttcattc

SEQ ID NO: 41114 - DNA, 35 bp, Artificial Sequence
  Synthetic oligonucleotide
atcgctactgtgaaggtgtgctacctgtccctttg

SEQ ID NO: 41115 - DNA, 35 bp, Artificial Sequence
  Synthetic oligonucleotide
atacggatcaccccacagccgcttcgcacgaacct

SEQ ID NO: 41116 - DNA, 35 bp, Artificial Sequence
  Synthetic oligonucleotide
tccctacgccactcctacatcgtttaaaggcactt

SEQ ID NO: 41117 - DNA, 35 bp, Artificial Sequence
  Synthetic oligonucleotide
gatgcactgcacctattgactaaatagcccgtttt

SEQ ID NO: 41118 - DNA, 35 bp, Artificial Sequence
  Synthetic oligonucleotide
gcgaccctgccttttatttggttaaccaccaccca

SEQ ID NO: 41119 - DNA, 35 bp, Artificial Sequence
  Synthetic oligonucleotide
gtctcatgccttctacgtgcctttgcgattaatca

SEQ ID NO: 41120 - DNA, 37 bp, Artificial Sequence
  Synthetic oligonucleotide
acacccacacccaagaccggctccttatccaataaga

SEQ ID NO: 41121 - DNA, 37 bp, Artificial Sequence
  Synthetic oligonucleotide
tgtcgcactccaccatcgtgttccgaccccctcccga

SEQ ID NO: 41122 - DNA, 37 bp, Artificial Sequence
  Synthetic oligonucleotide
tttaccgcaaccgctcctacattgctcaattttgcga

SEQ ID NO: 41123 - DNA, 37 bp, Artificial Sequence
  Synthetic oligonucleotide
gttctcaacaggcaggaaagggggacgtaagttagga

SEQ ID NO: 41124 - DNA, 38 bp, Artificial Sequence
  Synthetic oligonucleotide
tcatcctgcctaatcgtgcacggtcccattcacactga

SEQ ID NO: 41125 - DNA, 38 bp, Artificial Sequence
  Synthetic oligonucleotide
attcgccccctcacagacccggagggatcctacactga

SEQ ID NO: 41126 - DNA, 38 bp, Artificial Sequence
  Synthetic oligonucleotide
ctagcagggactgcgaaccgatccctcaatacctgtga

SEQ ID NO: 41127 - DNA, 38 bp, Artificial Sequence
  Synthetic oligonucleotide
ttagccacacgtgcggctccctcgaatcgccccattga

SEQ ID NO: 41128 - DNA, 35 bp, Artificial Sequence
  Synthetic oligonucleotide
atcaggcccacctctccttatccagtgtctattga

SEQ ID NO: 41129 - DNA, 37 bp, Artificial Sequence
  Synthetic oligonucleotide
gcccaaccaaacctggaggccctgttctatcctttga

SEQ ID NO: 41130 - DNA, 36 bp, Artificial Sequence
  Synthetic oligonucleotide
aattgcaacgcactgcacaacgttcccactaagcta

SEQ ID NO: 41131 - DNA, 36 bp, Artificial Sequence
  Synthetic oligonucleotide
gtgcgatcccggtccttatatccatatgttcatcta

SEQ ID NO: 41132 - DNA, 36 bp, Artificial Sequence
  Synthetic oligonucleotide
actccgctcccgcccccccgagatggcatgccttta

SEQ ID NO: 41133 - DNA, 35 bp, Artificial Sequence
  Synthetic oligonucleotide
accacaccattacacttccaggctcgagggaacac

SEQ ID NO: 41134 - DNA, 35 bp, Artificial Sequence
  Synthetic oligonucleotide
gacgctgtacataatcggccagcccgatctcgccc

SEQ ID NO: 41135 - DNA, 35 bp, Artificial Sequence
  Synthetic oligonucleotide
gtgccatgccaatacctcttccgatggtttcttcc

SEQ ID NO: 41136 - DNA, 34 bp, Artificial Sequence
  Synthetic oligonucleotide
tgtgtcgtcaatccctttcgaatcccacttggtc

SEQ ID NO: 41137 - DNA, 35 bp, Artificial Sequence
  Synthetic oligonucleotide
aatgcccgggccgaatgttcaaataatattttccg

SEQ ID NO: 41138 - DNA, 35 bp, Artificial Sequence
  Synthetic oligonucleotide
gctgaccaggtggtgaacgcgggtggaaaggtggg

SEQ ID NO: 41139 - DNA, 35 bp, Artificial Sequence
  Synthetic oligonucleotide
tgtcaacccgtgtcactcaagccctcaccaaactg

SEQ ID NO: 41140 - DNA, 35 bp, Artificial Sequence
  Synthetic oligonucleotide
gctacttccgcctcggaccggggacctcttatact

SEQ ID NO: 41141 - DNA, 35 bp, Artificial Sequence
  Synthetic oligonucleotide
aacccgaacactggggcacatttccttggtaatct

SEQ ID NO: 41142 - DNA, 35 bp, Artificial Sequence
  Synthetic oligonucleotide
gcaccacgtggtgagccactcgcaacatgaattgt

SEQ ID NO: 41143 - DNA, 35 bp, Artificial Sequence
  Synthetic oligonucleotide
atgtaagacagacgttcctccctgccctgtcgctt

SEQ ID NO: 41144 - DNA, 36 bp, Artificial Sequence
  Synthetic oligonucleotide
tccaccccgttccactgtcacttcgaggaatgagaa

SEQ ID NO: 41145 - DNA, 36 bp, Artificial Sequence
  Synthetic oligonucleotide
tctgtgcaacaggcagtcttttcatttggtcctaca

SEQ ID NO: 41146 - DNA, 36 bp, Artificial Sequence
  Synthetic oligonucleotide
accaggcgaaccatgccagctttgaccccggtacca

SEQ ID NO: 41147 - DNA, 35 bp, Artificial Sequence
  Synthetic oligonucleotide
acacccctactgcacatcgggagttaatgcccgca

SEQ ID NO: 41148 - DNA, 37 bp, Artificial Sequence
  Synthetic oligonucleotide
acgagtcagccgcgtggtgggaacggaagggggaaga

SEQ ID NO: 41149 - DNA, 37 bp, Artificial Sequence
  Synthetic oligonucleotide
agggtgggagaaatagggaaggcgataggaactgaga

SEQ ID NO: 41150 - DNA, 37 bp, Artificial Sequence
  Synthetic oligonucleotide
tgagcaaggagcggggtgagggtagttggggtgccga

SEQ ID NO: 41151 - DNA, 37 bp, Artificial Sequence
  Synthetic oligonucleotide
ttggtagagggaggtaggggtgtcatgcgaacggcga

SEQ ID NO: 41152 - DNA, 37 bp, Artificial Sequence
  Synthetic oligonucleotide
tgtacggctcaggccccgacctaatctccgccttcga

SEQ ID NO: 41153 - DNA, 37 bp, Artificial Sequence
  Synthetic oligonucleotide
aaagagggaaggtagggatcccgagcacagcggggga

SEQ ID NO: 41154 - DNA, 37 bp, Artificial Sequence
  Synthetic oligonucleotide
gaaacaggggctaagtggtgcacaggggttgtgggga

SEQ ID NO: 41155 - DNA, 37 bp, Artificial Sequence
  Synthetic oligonucleotide
tgaaggggggtagggcgaaaggcatacgtttttggga

SEQ ID NO: 41156 - DNA, 37 bp, Artificial Sequence
  Synthetic oligonucleotide
aaaccgcacgccctttaccttctactagagacgtgga

SEQ ID NO: 41157 - DNA, 35 bp, Artificial Sequence
  Synthetic oligonucleotide
tcatgtgcgtttcatcgctgtacccctctgttgga

SEQ ID NO: 41158 - DNA, 38 bp, Artificial Sequence
  Synthetic oligonucleotide
ttgaccactctgtcgtgtaaacccgcccccagtgatga

SEQ ID NO: 41159 - DNA, 38 bp, Artificial Sequence
  Synthetic oligonucleotide
gtcccacccaccagtatgcaggtatcacgcccaagtga

SEQ ID NO: 41160 - DNA, 38 bp, Artificial Sequence
  Synthetic oligonucleotide
actgccccgcaatgctttctttttccatgataccttga

SEQ ID NO: 41161 - DNA, 38 bp, Artificial Sequence
  Synthetic oligonucleotide
atccacgtccaagcgcacgccttgaaacccttccttga

SEQ ID NO: 41162 - DNA, 36 bp, Artificial Sequence
  Synthetic oligonucleotide
acgcactggccgcaaagaacgcgccctccttccgta

SEQ ID NO: 41163 - DNA, 36 bp, Artificial Sequence
  Synthetic oligonucleotide
tccgccgccgcgcctctttatgacccccacgctgta

SEQ ID NO: 41164 - DNA, 36 bp, Artificial Sequence
  Synthetic oligonucleotide
gttctgtgcaccatcttggccgtctaaacaccctta

SEQ ID NO: 41165 - DNA, 35 bp, Artificial Sequence
  Synthetic oligonucleotide
agtgcccggccaatctagcgccattgtctccgtta

SEQ ID NO: 41166 - DNA, 35 bp, Artificial Sequence
  Synthetic oligonucleotide
gagaccagcagcccgtgccttgtcacacctttcac

SEQ ID NO: 41167 - DNA, 35 bp, Artificial Sequence
  Synthetic oligonucleotide
ttaccaccctgcgaaaatagccctcgcatctttcc

SEQ ID NO: 41168 - DNA, 35 bp, Artificial Sequence
  Synthetic oligonucleotide
acagccacttagttatccactcacgttactactgc

SEQ ID NO: 41169 - DNA, 35 bp, Artificial Sequence
  Synthetic oligonucleotide
gtaatggggtcaggggggggtagttaagggaaaag

SEQ ID NO: 41170 - DNA, 36 bp, Artificial Sequence
  Synthetic oligonucleotide
gttagcacggactgggctgggaacgattggtgggag

SEQ ID NO: 41171 - DNA, 35 bp, Artificial Sequence
  Synthetic oligonucleotide
gttgcgtgcacaagcctatccttttttatctgccg

SEQ ID NO: 41172 - DNA, 35 bp, Artificial Sequence
  Synthetic oligonucleotide
acgtgactggaggggggggattagcaatagtgcgg

SEQ ID NO: 41173 - DNA, 35 bp, Artificial Sequence
  Synthetic oligonucleotide
tttgcgcgccctatttctaactaccgccacagcct

SEQ ID NO: 41174 - DNA, 35 bp, Artificial Sequence
  Synthetic oligonucleotide
tagacgcccaccccatgtcgcacaccacatctcgt

SEQ ID NO: 41175 - DNA, 35 bp, Artificial Sequence
  Synthetic oligonucleotide
ttcggtgcctctgcccgctttcagttattgcgatt

SEQ ID NO: 41176 - DNA, 35 bp, Artificial Sequence
  Synthetic oligonucleotide
gtcgggggccgaatagttgcgtcaattcacccctt

SEQ ID NO: 41177 - DNA, 35 bp, Artificial Sequence
  Synthetic oligonucleotide
tcgatcatccgtcactgaccaccacctctgttctt

SEQ ID NO: 41178 - DNA, 33 bp, Artificial Sequence
  Synthetic oligonucleotide
tgccggccgtccgtgcccgctacccccatcgaa

SEQ ID NO: 41179 - DNA, 35 bp, Artificial Sequence
  Synthetic oligonucleotide
gtgtgcggttagacgcacttggatttccttcttaa

SEQ ID NO: 41180 - DNA, 35 bp, Artificial Sequence
  Synthetic oligonucleotide
accacccctcgagtggcatcccgaacccgcttaca

SEQ ID NO: 41181 - DNA, 35 bp, Artificial Sequence
  Synthetic oligonucleotide
tccaatttcgcacatgcttactgtcctgaccccca

SEQ ID NO: 41182 - DNA, 36 bp, Artificial Sequence
  Synthetic oligonucleotide
atcaggtggccctcgtcggtaacaataccctctcca

SEQ ID NO: 41183 - DNA, 36 bp, Artificial Sequence
  Synthetic oligonucleotide
tatgcgcaggcgttcactttgaaaaccaatcgtcca

SEQ ID NO: 41184 - DNA, 35 bp, Artificial Sequence
  Synthetic oligonucleotide
attcatccggtgagtttttaggccttccacaagca

SEQ ID NO: 41185 - DNA, 35 bp, Artificial Sequence
  Synthetic oligonucleotide
atgccaagtctcgcctgtccagcctcttacgcgca

SEQ ID NO: 41186 - DNA, 37 bp, Artificial Sequence
  Synthetic oligonucleotide
aacatgcgcacaagctcgtctccaaggcctcctaaga

SEQ ID NO: 41187 - DNA, 36 bp, Artificial Sequence
  Synthetic oligonucleotide
ttccaccacacagcccacgtttccttttttaacgga

SEQ ID NO: 41188 - DNA, 36 bp, Artificial Sequence
  Synthetic oligonucleotide
ttgacatgtcagcaaacctccactctacaacacgga

SEQ ID NO: 41189 - DNA, 37 bp, Artificial Sequence
  Synthetic oligonucleotide
atcaagccaagtatggtgaaggaaagggggggctgga

SEQ ID NO: 41190 - DNA, 37 bp, Artificial Sequence
  Synthetic oligonucleotide
gaacgtcatgttccaaatcgatgcctcctttccctga

SEQ ID NO: 41191 - DNA, 38 bp, Artificial Sequence
  Synthetic oligonucleotide
accgatcacaccccctaatgcgtcgaatcttctcctga

SEQ ID NO: 41192 - DNA, 38 bp, Artificial Sequence
  Synthetic oligonucleotide
ttgagcaacccagttatcactgcacacccaattggtga

SEQ ID NO: 41193 - DNA, 38 bp, Artificial Sequence
  Synthetic oligonucleotide
gtacacaaggggggccgagataaaaggaaggggattga

SEQ ID NO: 41194 - DNA, 35 bp, Artificial Sequence
  Synthetic oligonucleotide
gaacaggccactccttgtgcaactttcccagaata

SEQ ID NO: 41195 - DNA, 36 bp, Artificial Sequence
  Synthetic oligonucleotide
ttgagcctcggaactcttctcccgtacacgttaata

SEQ ID NO: 41196 - DNA, 35 bp, Artificial Sequence
  Synthetic oligonucleotide
tacctggaacacgaggcctactcctttgctgcata

SEQ ID NO: 41197 - DNA, 36 bp, Artificial Sequence
  Synthetic oligonucleotide
tcatactccacggaactgttacgccaggtacgccta

SEQ ID NO: 41198 - DNA, 35 bp, Artificial Sequence
  Synthetic oligonucleotide
acattcagccccatcgataggtaccatccgtgcac

SEQ ID NO: 41199 - DNA, 35 bp, Artificial Sequence
  Synthetic oligonucleotide
tggtccactgcggtcccattactaagcccctctac

SEQ ID NO: 41200 - DNA, 35 bp, Artificial Sequence
  Synthetic oligonucleotide
gaagacgcgaggagttccggctttttttctcgtac

SEQ ID NO: 41201 - DNA, 35 bp, Artificial Sequence
  Synthetic oligonucleotide
gatgtgctagccaccgcgataaataccatgggtcc

SEQ ID NO: 41202 - DNA, 35 bp, Artificial Sequence
  Synthetic oligonucleotide
acctcggaaggacgaaaggaggggcatggaggagc

SEQ ID NO: 41203 - DNA, 35 bp, Artificial Sequence
  Synthetic oligonucleotide
gccaccgacttggtgcacgcaatagtacatcacgc

SEQ ID NO: 41204 - DNA, 35 bp, Artificial Sequence
  Synthetic oligonucleotide
tacccacgcaccgccgccccattagctacactatc

SEQ ID NO: 41205 - DNA, 35 bp, Artificial Sequence
  Synthetic oligonucleotide
aactctcgatccaatgcaagacatctcttgccctc

SEQ ID NO: 41206 - DNA, 35 bp, Artificial Sequence
  Synthetic oligonucleotide
gacgatggcgggagctcttcggcataatttttgtc

SEQ ID NO: 41207 - DNA, 35 bp, Artificial Sequence
  Synthetic oligonucleotide
tggtcgccccctgcactggctttaattacgttgcg

SEQ ID NO: 41208 - DNA, 35 bp, Artificial Sequence
  Synthetic oligonucleotide
gactccagacgggactgagggatgacggtaagggg

SEQ ID NO: 41209 - DNA, 35 bp, Artificial Sequence
  Synthetic oligonucleotide
agtcgaaaggtgcgaatgggcggagtgaaggtggg

SEQ ID NO: 41210 - DNA, 35 bp, Artificial Sequence
  Synthetic oligonucleotide
gagccccataccacgccgctgtgtctcccaagcat

SEQ ID NO: 41211 - DNA, 35 bp, Artificial Sequence
  Synthetic oligonucleotide
tacaccggagccctgaggggacacctcttcctcct

SEQ ID NO: 41212 - DNA, 35 bp, Artificial Sequence
  Synthetic oligonucleotide
actaaacccgataccaccttgaagcatagcttgct

SEQ ID NO: 41213 - DNA, 35 bp, Artificial Sequence
  Synthetic oligonucleotide
aaacaccccttggcaatccccgaaccgactagtgt

SEQ ID NO: 41214 - DNA, 37 bp, Artificial Sequence
  Synthetic oligonucleotide
gacgaacgacctgggggaagtgggtcaaggggtgaga

SEQ ID NO: 41215 - DNA, 35 bp, Artificial Sequence
  Synthetic oligonucleotide
gtgagcccactactgccgactgatactgccctcga

SEQ ID NO: 41216 - DNA, 37 bp, Artificial Sequence
  Synthetic oligonucleotide
gcagtgcacgaactgcttttatcgcgataccccggga

SEQ ID NO: 41217 - DNA, 37 bp, Artificial Sequence
  Synthetic oligonucleotide
agtggggccggtagttggttttggttcgtggggtgga

SEQ ID NO: 41218 - DNA, 38 bp, Artificial Sequence
  Synthetic oligonucleotide
ggagggagggaagacgagggaagttacgtcggagctga

SEQ ID NO: 41219 - DNA, 38 bp, Artificial Sequence
  Synthetic oligonucleotide
tccatgagcgccccgaagcttgcatctgccatacttga

SEQ ID NO: 41220 - DNA, 38 bp, Artificial Sequence
  Synthetic oligonucleotide
tcaccggtgggcgagataagccctctgtaccttcttga

SEQ ID NO: 41221 - DNA, 37 bp, Artificial Sequence
  Synthetic oligonucleotide
gtggagcctttgccgctttaggcgttagccgatttga

SEQ ID NO: 41222 - DNA, 36 bp, Artificial Sequence
  Synthetic oligonucleotide
tccgctacgccatcacgctcgaattagctgtcccta

SEQ ID NO: 41223 - DNA, 35 bp, Artificial Sequence
  Synthetic oligonucleotide
tcaaacctcgcatgcctaaggccattatctgctta

SEQ ID NO: 41224 - DNA, 36 bp, Artificial Sequence
  Synthetic oligonucleotide
tccacgcattgataccgataccgagggctcccgtta

SEQ ID NO: 41225 - DNA, 35 bp, Artificial Sequence
  Synthetic oligonucleotide
gttttcagtccgccccgctcgtgattccctccaac

SEQ ID NO: 41226 - DNA, 35 bp, Artificial Sequence
  Synthetic oligonucleotide
aacgctagcgcctgctctccagcataccagcaacc

SEQ ID NO: 41227 - DNA, 35 bp, Artificial Sequence
  Synthetic oligonucleotide
tacccgccatcaaactagccacgtaagacagaacc

SEQ ID NO: 41228 - DNA, 35 bp, Artificial Sequence
  Synthetic oligonucleotide
gatccaggccctttatcccgtctccatccttggcc

SEQ ID NO: 41229 - DNA, 35 bp, Artificial Sequence
  Synthetic oligonucleotide
tccaccctcgctacgagccattggcgtggtctgcc

SEQ ID NO: 41230 - DNA, 35 bp, Artificial Sequence
  Synthetic oligonucleotide
atccaatccaccttgctgcactgttcattacgcgc

SEQ ID NO: 41231 - DNA, 35 bp, Artificial Sequence
  Synthetic oligonucleotide
gtcgtaacggcaccatgatctaaactcttgctcgc

SEQ ID NO: 41232 - DNA, 35 bp, Artificial Sequence
  Synthetic oligonucleotide
gcccagggggattatggtcaacgcactcacttctc

SEQ ID NO: 41233 - DNA, 35 bp, Artificial Sequence
  Synthetic oligonucleotide
tgagacgcctcacgctcgcctggcccttccctgtc

SEQ ID NO: 41234 - DNA, 35 bp, Artificial Sequence
  Synthetic oligonucleotide
cctcccgcccaatgacacaccaccacccactttag

SEQ ID NO: 41235 - DNA, 36 bp, Artificial Sequence
  Synthetic oligonucleotide
tcccaccgccgcagggtggtctagtacctaattgcg

SEQ ID NO: 41236 - DNA, 35 bp, Artificial Sequence
  Synthetic oligonucleotide
gcaacccaccattggcctaaccgaaggaaaggtat

SEQ ID NO: 41237 - DNA, 35 bp, Artificial Sequence
  Synthetic oligonucleotide
gaagcgaccgcctattgccttatgacctacattct

SEQ ID NO: 41238 - DNA, 35 bp, Artificial Sequence
  Synthetic oligonucleotide
tctgtcatctgcgctacacgggccccagtactatt

SEQ ID NO: 41239 - DNA, 36 bp, Artificial Sequence
  Synthetic oligonucleotide
tgcgccggggatagggctggggcctttgaagggaaa

SEQ ID NO: 41240 - DNA, 36 bp, Artificial Sequence
  Synthetic oligonucleotide
ttcatgcgggcacggaaaaggctagggtggggggaa

SEQ ID NO: 41241 - DNA, 36 bp, Artificial Sequence
  Synthetic oligonucleotide
gtccccacaaatatctggttagcttacacacctgca

SEQ ID NO: 41242 - DNA, 35 bp, Artificial Sequence
  Synthetic oligonucleotide
aagcgagaattgtgcgccctgctaccgtcccctca

SEQ ID NO: 41243 - DNA, 37 bp, Artificial Sequence
  Synthetic oligonucleotide
gccctccacacacatgtccaagtaatgccactcgcga

SEQ ID NO: 41244 - DNA, 35 bp, Artificial Sequence
  Synthetic oligonucleotide
gtcatcacccacaattcgttttgtacaaccaggga

SEQ ID NO: 41245 - DNA, 37 bp, Artificial Sequence
  Synthetic oligonucleotide
actgccgagacaagtaaagggcgggaggtgtggtgga

SEQ ID NO: 41246 - DNA, 38 bp, Artificial Sequence
  Synthetic oligonucleotide
tgccacgcgcgctacacgtccctcatagaccctactga

SEQ ID NO: 41247 - DNA, 38 bp, Artificial Sequence
  Synthetic oligonucleotide
ttgacgccgctgccattgacactcatcccacgtactga

SEQ ID NO: 41248 - DNA, 38 bp, Artificial Sequence
  Synthetic oligonucleotide
acccaaccggctagccgctacaaccttatctccgttga

SEQ ID NO: 41249 - DNA, 35 bp, Artificial Sequence
  Synthetic oligonucleotide
gccaagcggatggccacagcctagcactcccgcac

SEQ ID NO: 41250 - DNA, 35 bp, Artificial Sequence
  Synthetic oligonucleotide
tatgcacctcactggacgaaacgtcatccttagcc

SEQ ID NO: 41251 - DNA, 35 bp, Artificial Sequence
  Synthetic oligonucleotide
tttgcatcctcgcattggccgccgctttatgcgcc

SEQ ID NO: 41252 - DNA, 35 bp, Artificial Sequence
  Synthetic oligonucleotide
gcacactactcacttcagtccttcggtcaattggc

SEQ ID NO: 41253 - DNA, 35 bp, Artificial Sequence
  Synthetic oligonucleotide
ggatcagcaaacaaatcgtcttcgcccaggttggc

SEQ ID NO: 41254 - DNA, 35 bp, Artificial Sequence
  Synthetic oligonucleotide
gtgaaaccacacgtaccgcccgctgtatttcctgc

SEQ ID NO: 41255 - DNA, 35 bp, Artificial Sequence
  Synthetic oligonucleotide
accatccgccgttcgatgactattttcgctagctc

SEQ ID NO: 41256 - DNA, 35 bp, Artificial Sequence
  Synthetic oligonucleotide
tccaataccccactcccgaggttggataccatgtc

SEQ ID NO: 41257 - DNA, 35 bp, Artificial Sequence
  Synthetic oligonucleotide
acaccgatgggcccttcaccaacagattacatttc

SEQ ID NO: 41258 - DNA, 34 bp, Artificial Sequence
  Synthetic oligonucleotide
gtcgcacactgtgcattccccccggttttgagcg

SEQ ID NO: 41259 - DNA, 35 bp, Artificial Sequence
  Synthetic oligonucleotide
ccatccacttcctgccccccgttttatgagacagg

SEQ ID NO: 41260 - DNA, 35 bp, Artificial Sequence
  Synthetic oligonucleotide
gccgcctccggccgcgattttcgcaccaattacct

SEQ ID NO: 41261 - DNA, 35 bp, Artificial Sequence
  Synthetic oligonucleotide
tgccccgggcccatgccacccccctggtccgccct

SEQ ID NO: 41262 - DNA, 35 bp, Artificial Sequence
  Synthetic oligonucleotide
gtccttccctctcttcagtgcttatgttcgtgcct

SEQ ID NO: 41263 - DNA, 35 bp, Artificial Sequence
  Synthetic oligonucleotide
tcagaggccatgaagccaaggttcgtttccccgtt

SEQ ID NO: 41264 - DNA, 36 bp, Artificial Sequence
  Synthetic oligonucleotide
actaacccccatcacactatgactctgcctgtgaaa

SEQ ID NO: 41265 - DNA, 36 bp, Artificial Sequence
  Synthetic oligonucleotide
gccctaccgagtccaatctgtcccgtaacccttcaa

SEQ ID NO: 41266 - DNA, 35 bp, Artificial Sequence
  Synthetic oligonucleotide
gagtaccgcctccggttgcccttaattactaggaa

SEQ ID NO: 41267 - DNA, 36 bp, Artificial Sequence
  Synthetic oligonucleotide
tacgccatacctgttccgctgccccgtgttacataa

SEQ ID NO: 41268 - DNA, 35 bp, Artificial Sequence
  Synthetic oligonucleotide
gccgacgcacgttatgccggcacaccgatcctaca

SEQ ID NO: 41269 - DNA, 36 bp, Artificial Sequence
  Synthetic oligonucleotide
gcatcgcacgtccacgcaatttttaggtttgatcca

SEQ ID NO: 41270 - DNA, 36 bp, Artificial Sequence
  Synthetic oligonucleotide
gtcaaagtcccagagcaggagaggggggttaaagca

SEQ ID NO: 41271 - DNA, 36 bp, Artificial Sequence
  Synthetic oligonucleotide
tgcaatgagagggggaagacgaaaggacaagaggca

SEQ ID NO: 41272 - DNA, 36 bp, Artificial Sequence
  Synthetic oligonucleotide
actccactgcctaggccatctcattaacgtcgttca

SEQ ID NO: 41273 - DNA, 37 bp, Artificial Sequence
  Synthetic oligonucleotide
tccctcgcctccttactcgtgaccgacaattttggga

SEQ ID NO: 41274 - DNA, 37 bp, Artificial Sequence
  Synthetic oligonucleotide
gacggcccacgtgagtggttttggttttttttttgga

SEQ ID NO: 41275 - DNA, 38 bp, Artificial Sequence
  Synthetic oligonucleotide
gatcgattgcgctggtcttaatgctcactcctcactga

SEQ ID NO: 41276 - DNA, 38 bp, Artificial Sequence
  Synthetic oligonucleotide
gtcccccacccgtggcgtctgtttgccttcctgtctga

SEQ ID NO: 41277 - DNA, 38 bp, Artificial Sequence
  Synthetic oligonucleotide
tccacgcaggttgctcgatgtccgctcgtccctcttga

SEQ ID NO: 41278 - DNA, 37 bp, Artificial Sequence
  Synthetic oligonucleotide
ggtgacaacgcctcccatggccaacttcttcttttga

SEQ ID NO: 41279 - DNA, 36 bp, Artificial Sequence
  Synthetic oligonucleotide
gccatgtggcaccttcaactccgaagccatttgcta

SEQ ID NO: 41280 - DNA, 35 bp, Artificial Sequence
  Synthetic oligonucleotide
tactgcaggcacctaaagcttacccggttggacac

SEQ ID NO: 41281 - DNA, 35 bp, Artificial Sequence
  Synthetic oligonucleotide
aagtccatcggccgacaactcttatggcttcatac

SEQ ID NO: 41282 - DNA, 35 bp, Artificial Sequence
  Synthetic oligonucleotide
gtagcacgtgccacaatgcaagcaagtttatcacc

SEQ ID NO: 41283 - DNA, 35 bp, Artificial Sequence
  Synthetic oligonucleotide
gtcaccgcgcctcaagttccctgacaaaactcgcc

SEQ ID NO: 41284 - DNA, 35 bp, Artificial Sequence
  Synthetic oligonucleotide
gttgtgcccgcgagacgcttctctaaaccctggcc

SEQ ID NO: 41285 - DNA, 35 bp, Artificial Sequence
  Synthetic oligonucleotide
ttatgcgagcgatcactcttctgttcaccttatgc

SEQ ID NO: 41286 - DNA, 33 bp, Artificial Sequence
  Synthetic oligonucleotide
tacacatcatgtcgctatcaactccgacggtgc

SEQ ID NO: 41287 - DNA, 35 bp, Artificial Sequence
  Synthetic oligonucleotide
agacacagcgtatattgcatttcaaccccctcttc

SEQ ID NO: 41288 - DNA, 35 bp, Artificial Sequence
  Synthetic oligonucleotide
gcacgtaccgatccgtcttcgtgggccgaggtttc

SEQ ID NO: 41289 - DNA, 34 bp, Artificial Sequence
  Synthetic oligonucleotide
gaaaccatcaatgaatacgcactctctcgaaccg

SEQ ID NO: 41290 - DNA, 35 bp, Artificial Sequence
  Synthetic oligonucleotide
tcaacgactatatcctaagcccccaccgacgcccg

SEQ ID NO: 41291 - DNA, 35 bp, Artificial Sequence
  Synthetic oligonucleotide
aggacggaagaaggggggtaagggtaactccggtg

SEQ ID NO: 41292 - DNA, 35 bp, Artificial Sequence
  Synthetic oligonucleotide
tcatcccctgtccaggacgtatgtcggtttttcat

SEQ ID NO: 41293 - DNA, 35 bp, Artificial Sequence
  Synthetic oligonucleotide
taacacagacgagtccgtctccttaccctgcctat

SEQ ID NO: 41294 - DNA, 35 bp, Artificial Sequence
  Synthetic oligonucleotide
attaacccatcgccgctgcaggccctgcttcctat

SEQ ID NO: 41295 - DNA, 35 bp, Artificial Sequence
  Synthetic oligonucleotide
atgtgtgcccccttacgtgaacttacctgcgtgct

SEQ ID NO: 41296 - DNA, 35 bp, Artificial Sequence
  Synthetic oligonucleotide
tgcatcccctggctggttataccttctcttagagt

SEQ ID NO: 41297 - DNA, 35 bp, Artificial Sequence
  Synthetic oligonucleotide
accgtgaagcccccatctccaacctctgttcacgt

SEQ ID NO: 41298 - DNA, 35 bp, Artificial Sequence
  Synthetic oligonucleotide
atcccagggtacgccacccttcttcgccttgttgt

SEQ ID NO: 41299 - DNA, 36 bp, Artificial Sequence
  Synthetic oligonucleotide
tgcctaccatcttacgtcttaactgcacgggcctaa

SEQ ID NO: 41300 - DNA, 36 bp, Artificial Sequence
  Synthetic oligonucleotide
ttgccctgcctaccgtgcaatcatgtccggcccaca

SEQ ID NO: 41301 - DNA, 36 bp, Artificial Sequence
  Synthetic oligonucleotide
tcacccagcctttctgtgggatctttgttcactcca

SEQ ID NO: 41302 - DNA, 36 bp, Artificial Sequence
  Synthetic oligonucleotide
actccagcacaagcaggcgagagggaagggatggca

SEQ ID NO: 41303 - DNA, 35 bp, Artificial Sequence
  Synthetic oligonucleotide
gacgttgacgcactgttcacctcccatgcacatca

SEQ ID NO: 41304 - DNA, 37 bp, Artificial Sequence
  Synthetic oligonucleotide
gtgatgatgaggtgtaagataggcgaggtgggagaga

SEQ ID NO: 41305 - DNA, 37 bp, Artificial Sequence
  Synthetic oligonucleotide
gctgtgcctcgtccaccaactcctgcgctatcgacga

SEQ ID NO: 41306 - DNA, 37 bp, Artificial Sequence
  Synthetic oligonucleotide
aaacaggcggatacatgggataaaggtgaatgggcga

SEQ ID NO: 41307 - DNA, 37 bp, Artificial Sequence
  Synthetic oligonucleotide
gagcctgactcgactccctcatagccaaacatctcga

SEQ ID NO: 41308 - DNA, 37 bp, Artificial Sequence
  Synthetic oligonucleotide
tgaagaacgacgggtgggtggcattggtttgagggga

SEQ ID NO: 41309 - DNA, 37 bp, Artificial Sequence
  Synthetic oligonucleotide
gtaggagctgtcatggagcagggggggggcggatgga

SEQ ID NO: 41310 - DNA, 37 bp, Artificial Sequence
  Synthetic oligonucleotide
aaaagggagcaggaacgagagggaggccgaaactgga

SEQ ID NO: 41311 - DNA, 37 bp, Artificial Sequence
  Synthetic oligonucleotide
tgtccactttacggtgctagtactccgccccactgga

SEQ ID NO: 41312 - DNA, 38 bp, Artificial Sequence
  Synthetic oligonucleotide
agctgccagccgctacattacttcccatcatgatatga

SEQ ID NO: 41313 - DNA, 37 bp, Artificial Sequence
  Synthetic oligonucleotide
ggaccaacggacctgactcccttataccgaggcctga

SEQ ID NO: 41314 - DNA, 38 bp, Artificial Sequence
  Synthetic oligonucleotide
tacccagcaccttcacggcaactgcacgacctgcctga

SEQ ID NO: 41315 - DNA, 38 bp, Artificial Sequence
  Synthetic oligonucleotide
gcatcaagcaaagaaatgggcgaaagggatgggggtga

SEQ ID NO: 41316 - DNA, 36 bp, Artificial Sequence
  Synthetic oligonucleotide
acacaacaatcggggggtcgcgagaggagtgggtga

SEQ ID NO: 41317 - DNA, 38 bp, Artificial Sequence
  Synthetic oligonucleotide
ttcgcccaccaggactattacgctacactttgtcttga

SEQ ID NO: 41318 - DNA, 37 bp, Artificial Sequence
  Synthetic oligonucleotide
aatgcgggaggcatacgggatcatggggtagctttga

SEQ ID NO: 41319 - DNA, 36 bp, Artificial Sequence
  Synthetic oligonucleotide
aaaccacagccaactcactcgtacgtcccgtaacta

SEQ ID NO: 41320 - DNA, 36 bp, Artificial Sequence
  Synthetic oligonucleotide
ttcgctgccgcctcgtttattgcttttatctggtta

SEQ ID NO: 41321 - DNA, 33 bp, Artificial Sequence
  Synthetic oligonucleotide
tcaaaccatcgctctcgctccccgatcttttta

SEQ ID NO: 41322 - DNA, 35 bp, Artificial Sequence
  Synthetic oligonucleotide
gtgtggacctcgtcccctctcactcgccggtatac

SEQ ID NO: 41323 - DNA, 35 bp, Artificial Sequence
  Synthetic oligonucleotide
gtgcacgtacttaggcgattacctggtccgtggcc

SEQ ID NO: 41324 - DNA, 35 bp, Artificial Sequence
  Synthetic oligonucleotide
tcctgtcgtagccacatacacactatgcccttacg

SEQ ID NO: 41325 - DNA, 35 bp, Artificial Sequence
  Synthetic oligonucleotide
gtgataggtaaagcacggggacaaggactgaaagg

SEQ ID NO: 41326 - DNA, 35 bp, Artificial Sequence
  Synthetic oligonucleotide
atttcgcacactcctgccttcctatgttcaatttg

SEQ ID NO: 41327 - DNA, 35 bp, Artificial Sequence
  Synthetic oligonucleotide
gactgaagccccaactgacctgccaatggaccaat

SEQ ID NO: 41328 - DNA, 35 bp, Artificial Sequence
  Synthetic oligonucleotide
gtaacccctcgcccgcctataacgcggcgctccat

SEQ ID NO: 41329 - DNA, 35 bp, Artificial Sequence
  Synthetic oligonucleotide
ccccctgacccaccacaggaaagatacttcagtat

SEQ ID NO: 41330 - DNA, 35 bp, Artificial Sequence
  Synthetic oligonucleotide
agactcacagctagaccgtgcttctctaatgtcct

SEQ ID NO: 41331 - DNA, 35 bp, Artificial Sequence
  Synthetic oligonucleotide
tcccagttcgtggctgcacaacgtatccatacctt

SEQ ID NO: 41332 - DNA, 34 bp, Artificial Sequence
  Synthetic oligonucleotide
gagagagggcactcctccttacccacatcccgtt

SEQ ID NO: 41333 - DNA, 36 bp, Artificial Sequence
  Synthetic oligonucleotide
gccgcctggctccgactgttccttttctccacgcaa

SEQ ID NO: 41334 - DNA, 36 bp, Artificial Sequence
  Synthetic oligonucleotide
gcgtcccgcagccacatcgggatccctgtctttgaa

SEQ ID NO: 41335 - DNA, 35 bp, Artificial Sequence
  Synthetic oligonucleotide
actgacctcatattcgttcctttgatcccactaca

SEQ ID NO: 41336 - DNA, 35 bp, Artificial Sequence
  Synthetic oligonucleotide
tgatcatccaatgcacagccctaaagcttttttca

SEQ ID NO: 41337 - DNA, 37 bp, Artificial Sequence
  Synthetic oligonucleotide
aactggcccacatccgctttttatccggttatcgaga

SEQ ID NO: 41338 - DNA, 37 bp, Artificial Sequence
  Synthetic oligonucleotide
gttaaaggtggtgaagaggggtccggcagagagacga

SEQ ID NO: 41339 - DNA, 37 bp, Artificial Sequence
  Synthetic oligonucleotide
ggagacgcctagtgccacaacgctttctgtacctcga

SEQ ID NO: 41340 - DNA, 36 bp, Artificial Sequence
  Synthetic oligonucleotide
gacgtgtggggcacgtaggggaaaatgtcgatggga

SEQ ID NO: 41341 - DNA, 35 bp, Artificial Sequence
  Synthetic oligonucleotide
gaccaaccacaaacctacgtcccgcttaaattgga

SEQ ID NO: 41342 - DNA, 38 bp, Artificial Sequence
  Synthetic oligonucleotide
acactacctgcctcaggcctcccagaaactcaaaatga

SEQ ID NO: 41343 - DNA, 38 bp, Artificial Sequence
  Synthetic oligonucleotide
gtctgtaccacctgctgcaagcataaaaccatccatga

SEQ ID NO: 41344 - DNA, 38 bp, Artificial Sequence
  Synthetic oligonucleotide
ttccgtcgcccctggtcctggctcccgtggttttatga

SEQ ID NO: 41345 - DNA, 38 bp, Artificial Sequence
  Synthetic oligonucleotide
tcctgccgactctgctccttaaccctgcgcgtagctga

SEQ ID NO: 41346 - DNA, 38 bp, Artificial Sequence
  Synthetic oligonucleotide
acgacgcaagatggggggaaggaataaggatcgagtga

SEQ ID NO: 41347 - DNA, 38 bp, Artificial Sequence
  Synthetic oligonucleotide
gcgtacgcgatctctccccctacttgggcccgacttga

SEQ ID NO: 41348 - DNA, 37 bp, Artificial Sequence
  Synthetic oligonucleotide
tgacgccaccggtagcaccccagcgaactctctttga

SEQ ID NO: 41349 - DNA, 35 bp, Artificial Sequence
  Synthetic oligonucleotide
tcacgccgatcttgcccaccgtcaacccgtaaata

SEQ ID NO: 41350 - DNA, 35 bp, Artificial Sequence
  Synthetic oligonucleotide
gatactgccggttcgtgccctccgtcctctcggcc

SEQ ID NO: 41351 - DNA, 35 bp, Artificial Sequence
  Synthetic oligonucleotide
gcctcgcacaccatgttggtcctcccttgtgcatc

SEQ ID NO: 41352 - DNA, 35 bp, Artificial Sequence
  Synthetic oligonucleotide
ttcgtagccgtcgttacttaacccgaccctgcttc

SEQ ID NO: 41353 - DNA, 35 bp, Artificial Sequence
  Synthetic oligonucleotide
accgcccgttcaaggcgagggggctatctttcttc

SEQ ID NO: 41354 - DNA, 35 bp, Artificial Sequence
  Synthetic oligonucleotide
acatcctcacgatcgccatcagcccattcgattcg

SEQ ID NO: 41355 - DNA, 35 bp, Artificial Sequence
  Synthetic oligonucleotide
aaccacacgaggccaaggctaaacccgagctttcg

SEQ ID NO: 41356 - DNA, 35 bp, Artificial Sequence
  Synthetic oligonucleotide
gccgatcaggattccggcttatttcattccatcct

SEQ ID NO: 41357 - DNA, 35 bp, Artificial Sequence
  Synthetic oligonucleotide
tacccgacactgacactacaccatattcggatcct

SEQ ID NO: 41358 - DNA, 35 bp, Artificial Sequence
  Synthetic oligonucleotide
tgtcgagccgcaaggggttcttttttttttcatct

SEQ ID NO: 41359 - DNA, 35 bp, Artificial Sequence
  Synthetic oligonucleotide
tgaccggacataatgatccacaaccccacaagtct

SEQ ID NO: 41360 - DNA, 36 bp, Artificial Sequence
  Synthetic oligonucleotide
tatgactccccgcttcacatatgttgtgcccgtaaa

SEQ ID NO: 41361 - DNA, 36 bp, Artificial Sequence
  Synthetic oligonucleotide
tgcatccgctggccgccaagcacatactccctgaca

SEQ ID NO: 41362 - DNA, 35 bp, Artificial Sequence
  Synthetic oligonucleotide
ttgcgtatgcctccccacgctctcagccatcgcca

SEQ ID NO: 41363 - DNA, 35 bp, Artificial Sequence
  Synthetic oligonucleotide
tattccatccatgccgtgccgcgctgactttatca

SEQ ID NO: 41364 - DNA, 36 bp, Artificial Sequence
  Synthetic oligonucleotide
ggagcccgccgtacaacgcaccgttcgtctttttca

SEQ ID NO: 41365 - DNA, 37 bp, Artificial Sequence
  Synthetic oligonucleotide
gcccccagataggaacaaaaaagggtagggagggaga

SEQ ID NO: 41366 - DNA, 37 bp, Artificial Sequence
  Synthetic oligonucleotide
tgttactcacctggccccttgcactacatccagacga

SEQ ID NO: 41367 - DNA, 36 bp, Artificial Sequence
  Synthetic oligonucleotide
actcctccaccgggccgcaatcctttactccctcga

SEQ ID NO: 41368 - DNA, 37 bp, Artificial Sequence
  Synthetic oligonucleotide
tgccctcacatgggacctccgtttttcagttcctcga

SEQ ID NO: 41369 - DNA, 37 bp, Artificial Sequence
  Synthetic oligonucleotide
gccggagcatccacgcatttcttcgtctgactctcga

SEQ ID NO: 41370 - DNA, 37 bp, Artificial Sequence
  Synthetic oligonucleotide
gtcgacccgacgagtcccttatctgcctatgtttcga

SEQ ID NO: 41371 - DNA, 37 bp, Artificial Sequence
  Synthetic oligonucleotide
gcatatccgccactgcgaaccgctactgacttgagga

SEQ ID NO: 41372 - DNA, 37 bp, Artificial Sequence
  Synthetic oligonucleotide
gtaacgccaggtgagaagagggcatgttcgtgtggga

SEQ ID NO: 41373 - DNA, 37 bp, Artificial Sequence
  Synthetic oligonucleotide
taggttgaggggtggagggtgtgggagggacactgga

SEQ ID NO: 41374 - DNA, 38 bp, Artificial Sequence
  Synthetic oligonucleotide
gacatgacgcagggggaggtggggccattggttcatga

SEQ ID NO: 41375 - DNA, 38 bp, Artificial Sequence
  Synthetic oligonucleotide
atgccagtcgcggctgtagccctttcaccctaatatga

SEQ ID NO: 41376 - DNA, 38 bp, Artificial Sequence
  Synthetic oligonucleotide
ggagccctgtgctgcctgtttccctgtctcacctatga

SEQ ID NO: 41377 - DNA, 38 bp, Artificial Sequence
  Synthetic oligonucleotide
accaacataccacatacatgagtcagcctcgcctctga

SEQ ID NO: 41378 - DNA, 37 bp, Artificial Sequence
  Synthetic oligonucleotide
ggtgggccgggtgggctaggggtacgggcgaacgtga

SEQ ID NO: 41379 - DNA, 38 bp, Artificial Sequence
  Synthetic oligonucleotide
tatgtgtgaacgagggtggtgtggtagagccgacgtga

SEQ ID NO: 41380 - DNA, 37 bp, Artificial Sequence
  Synthetic oligonucleotide
tttgtggtgagggggggacttgctacagcacgggtga

SEQ ID NO: 41381 - DNA, 38 bp, Artificial Sequence
  Synthetic oligonucleotide
gtacctcaacggtgtcacacacatccaaaacaaattga

SEQ ID NO: 41382 - DNA, 38 bp, Artificial Sequence
  Synthetic oligonucleotide
aatgctaggggagcgaggaagaaaaaggcatgtgttga

SEQ ID NO: 41383 - DNA, 37 bp, Artificial Sequence
  Synthetic oligonucleotide
gacgcatccttggagtctcgctcgttatctcttttga

SEQ ID NO: 41384 - DNA, 36 bp, Artificial Sequence
  Synthetic oligonucleotide
ttaaccgccgataggcctgaatatcatgtccgctta

SEQ ID NO: 41385 - DNA, 35 bp, Artificial Sequence
  Synthetic oligonucleotide
ttgcaaccgtaacatagaacgctctccattggccc

SEQ ID NO: 41386 - DNA, 35 bp, Artificial Sequence
  Synthetic oligonucleotide
tcaccacccttactaccaacgccgcgctaaacgcc

SEQ ID NO: 41387 - DNA, 35 bp, Artificial Sequence
  Synthetic oligonucleotide
tatccccgtccacttaggggtcacgtagcctactc

SEQ ID NO: 41388 - DNA, 35 bp, Artificial Sequence
  Synthetic oligonucleotide
atagcgcccttttctggcccatgactcgttttttc

SEQ ID NO: 41389 - DNA, 35 bp, Artificial Sequence
  Synthetic oligonucleotide
gttgggcagggttgggtgggcaagtcgctgaccag

SEQ ID NO: 41390 - DNA, 35 bp, Artificial Sequence
  Synthetic oligonucleotide
tgacgcgcgctgtgtctacacacctcccccatacg

SEQ ID NO: 41391 - DNA, 35 bp, Artificial Sequence
  Synthetic oligonucleotide
ggacccactccgttgtgactctcacttacaccgcg

SEQ ID NO: 41392 - DNA, 35 bp, Artificial Sequence
  Synthetic oligonucleotide
cagacatcctgctccctcgcgccacatccccttcg

SEQ ID NO: 41393 - DNA, 35 bp, Artificial Sequence
  Synthetic oligonucleotide
ttcagctgagcgttcgcataccacttactctctgg

SEQ ID NO: 41394 - DNA, 35 bp, Artificial Sequence
  Synthetic oligonucleotide
tgtggaagaacggggggagtgcgggtggtccgtgg

SEQ ID NO: 41395 - DNA, 35 bp, Artificial Sequence
  Synthetic oligonucleotide
tcaaaacgcgctccttgccggcaacacactaactg

SEQ ID NO: 41396 - DNA, 35 bp, Artificial Sequence
  Synthetic oligonucleotide
gtcaccctgtagtggtagccgcccctcactcgctg

SEQ ID NO: 41397 - DNA, 35 bp, Artificial Sequence
  Synthetic oligonucleotide
gcacaagcccaacggttttttcctgtcgcaaattg

SEQ ID NO: 41398 - DNA, 35 bp, Artificial Sequence
  Synthetic oligonucleotide
tactctgtcgccctttattgtctcaggtatgccct

SEQ ID NO: 41399 - DNA, 35 bp, Artificial Sequence
  Synthetic oligonucleotide
gaccacaatgagacacaagcaaagccccttacagt

SEQ ID NO: 41400 - DNA, 35 bp, Artificial Sequence
  Synthetic oligonucleotide
gagggcccgtctcggacactttgctcgttcccatt

SEQ ID NO: 41401 - DNA, 35 bp, Artificial Sequence
  Synthetic oligonucleotide
tacaccctcacattcagcgcgagctttcgatacaa

SEQ ID NO: 41402 - DNA, 35 bp, Artificial Sequence
  Synthetic oligonucleotide
gttgacgcgaattccacccatgcgcacactgagaa

SEQ ID NO: 41403 - DNA, 36 bp, Artificial Sequence
  Synthetic oligonucleotide
gagagggagagctgggcggattataggttggaagca

SEQ ID NO: 41404 - DNA, 36 bp, Artificial Sequence
  Synthetic oligonucleotide
tgttggtcccgcccggttcaatacatagtctccgca

SEQ ID NO: 41405 - DNA, 36 bp, Artificial Sequence
  Synthetic oligonucleotide
gtcgcaaaggtggaggaatcggggatgtaacgtgca

SEQ ID NO: 41406 - DNA, 37 bp, Artificial Sequence
  Synthetic oligonucleotide
gcatatccccgcccgcatcttactccagagacttaga

SEQ ID NO: 41407 - DNA, 37 bp, Artificial Sequence
  Synthetic oligonucleotide
acgcgagtcaactgtgaccacccaccatatacgccga

SEQ ID NO: 41408 - DNA, 37 bp, Artificial Sequence
  Synthetic oligonucleotide
aatgccgcaccatccttatcctgacccaaggtctcga

SEQ ID NO: 41409 - DNA, 37 bp, Artificial Sequence
  Synthetic oligonucleotide
ggaacgaggagagaaggcaaggtacgggccgtacgga

SEQ ID NO: 41410 - DNA, 37 bp, Artificial Sequence
  Synthetic oligonucleotide
tactgcctgtgggtgggtttgagggaaaggggaggga

SEQ ID NO: 41411 - DNA, 36 bp, Artificial Sequence
  Synthetic oligonucleotide
acgctcgccgctccgtgcacctttccttatctggga

SEQ ID NO: 41412 - DNA, 35 bp, Artificial Sequence
  Synthetic oligonucleotide
gcattgaccgccgattgagtgctacttccccatga

SEQ ID NO: 41413 - DNA, 38 bp, Artificial Sequence
  Synthetic oligonucleotide
gtaccccgcacctccagctcagcccctcatgtgactga

SEQ ID NO: 41414 - DNA, 38 bp, Artificial Sequence
  Synthetic oligonucleotide
gcaacccgatcgtccttggaacgcactttgtttactga

SEQ ID NO: 41415 - DNA, 38 bp, Artificial Sequence
  Synthetic oligonucleotide
gtgtgacaccgttggccctttgcgatattactacctga

SEQ ID NO: 41416 - DNA, 37 bp, Artificial Sequence
  Synthetic oligonucleotide
gttggccacccatttatccttccgtgcatctgcctga

SEQ ID NO: 41417 - DNA, 37 bp, Artificial Sequence
  Synthetic oligonucleotide
tgacgcccgccctagaactggatccgaccctagctga

SEQ ID NO: 41418 - DNA, 38 bp, Artificial Sequence
  Synthetic oligonucleotide
gtgagacgaagatattgtggtgggtggggttgaagtga

SEQ ID NO: 41419 - DNA, 38 bp, Artificial Sequence
  Synthetic oligonucleotide
tcatgcgtcgcttactgccctgacttccatacatgtga

SEQ ID NO: 41420 - DNA, 38 bp, Artificial Sequence
  Synthetic oligonucleotide
gccacaggctgatcggtacacctgcacccgctaattga

SEQ ID NO: 41421 - DNA, 35 bp, Artificial Sequence
  Synthetic oligonucleotide
gtctggcttagctacactcctccccggcttccata

SEQ ID NO: 41422 - DNA, 36 bp, Artificial Sequence
  Synthetic oligonucleotide
gtactgaccactggagtgataccgttacccgtacta

SEQ ID NO: 41423 - DNA, 36 bp, Artificial Sequence
  Synthetic oligonucleotide
tcaaggcgcagctttagttcgccttcttccacttta

SEQ ID NO: 41424 - DNA, 35 bp, Artificial Sequence
  Synthetic oligonucleotide
tcacacacagccgctcaactttacaggatcgacac

SEQ ID NO: 41425 - DNA, 35 bp, Artificial Sequence
  Synthetic oligonucleotide
acccatccgagggctcgtgccaccgcctgttctac

SEQ ID NO: 41426 - DNA, 35 bp, Artificial Sequence
  Synthetic oligonucleotide
tacgagtaaactaaaacgagtgctgctctcgcccc

SEQ ID NO: 41427 - DNA, 35 bp, Artificial Sequence
  Synthetic oligonucleotide
ttgtagcccgcctaccacccgccaccgattcatgc

SEQ ID NO: 41428 - DNA, 35 bp, Artificial Sequence
  Synthetic oligonucleotide
tttgaaacccaggccacaggatgcacgatcctctc

SEQ ID NO: 41429 - DNA, 35 bp, Artificial Sequence
  Synthetic oligonucleotide
tgcctaagcctgtaaatgcgcgatttttccacttc

SEQ ID NO: 41430 - DNA, 35 bp, Artificial Sequence
  Synthetic oligonucleotide
gtcctacctactcctgctacacatagacagcgggg

SEQ ID NO: 41431 - DNA, 35 bp, Artificial Sequence
  Synthetic oligonucleotide
tgttcccgggtcgcttaatttgaactcctcacctg

SEQ ID NO: 41432 - DNA, 35 bp, Artificial Sequence
  Synthetic oligonucleotide
accgtccagcccccgcttgcccataaaattttgtg

SEQ ID NO: 41433 - DNA, 34 bp, Artificial Sequence
  Synthetic oligonucleotide
aaagggaatgaaactgggaataggggcggtaaat

SEQ ID NO: 41434 - DNA, 35 bp, Artificial Sequence
  Synthetic oligonucleotide
tagacactcgcttttgaatctgatatcgcctcaat

SEQ ID NO: 41435 - DNA, 35 bp, Artificial Sequence
  Synthetic oligonucleotide
tttactcagtccgggcgacactgaccaccatttat

SEQ ID NO: 41436 - DNA, 35 bp, Artificial Sequence
  Synthetic oligonucleotide
gagccccctacgccttagttaaagccctgtgttct

SEQ ID NO: 41437 - DNA, 35 bp, Artificial Sequence
  Synthetic oligonucleotide
tgctacccgaacatctcgtgaacacgaccccacgt

SEQ ID NO: 41438 - DNA, 35 bp, Artificial Sequence
  Synthetic oligonucleotide
gaccagtcggtaaaggaacggggggataggtacgt

SEQ ID NO: 41439 - DNA, 35 bp, Artificial Sequence
  Synthetic oligonucleotide
gtaccctgctcgcacttttctctcgcttttcatgt

SEQ ID NO: 41440 - DNA, 35 bp, Artificial Sequence
  Synthetic oligonucleotide
gcgtaatcggccccatccacgctgcacaacctgtt

SEQ ID NO: 41441 - DNA, 35 bp, Artificial Sequence
  Synthetic oligonucleotide
gcaacaagcaacacggaattgggggcagtaggttt

SEQ ID NO: 41442 - DNA, 35 bp, Artificial Sequence
  Synthetic oligonucleotide
acgccatccatctacgtaaattaggtcgatccaaa

SEQ ID NO: 41443 - DNA, 34 bp, Artificial Sequence
  Synthetic oligonucleotide
gtgataggtgggggggggaaagcattcaatcgaa

SEQ ID NO: 41444 - DNA, 36 bp, Artificial Sequence
  Synthetic oligonucleotide
ggagggtgggcgggctacttttgttagggcggtgaa

SEQ ID NO: 41445 - DNA, 35 bp, Artificial Sequence
  Synthetic oligonucleotide
tcgctacctgttagtccgtcgccctttctccagca

SEQ ID NO: 41446 - DNA, 36 bp, Artificial Sequence
  Synthetic oligonucleotide
ggagctcaccggttggccgtccactctttaattgca

SEQ ID NO: 41447 - DNA, 36 bp, Artificial Sequence
  Synthetic oligonucleotide
aaacatcacacccaacgcgcgacgcctgttgcttca

SEQ ID NO: 41448 - DNA, 36 bp, Artificial Sequence
  Synthetic oligonucleotide
ggaaggggccggcgcctgtctttgttggtttcttca

SEQ ID NO: 41449 - DNA, 37 bp, Artificial Sequence
  Synthetic oligonucleotide
acatccacgcgccccctttccgttcctgggcactaga

SEQ ID NO: 41450 - DNA, 37 bp, Artificial Sequence
  Synthetic oligonucleotide
gcaatcgccgtagcgccccttctcatccaggaaacga

SEQ ID NO: 41451 - DNA, 37 bp, Artificial Sequence
  Synthetic oligonucleotide
gatcgacgttcattggctcttccgtcccactactcga

SEQ ID NO: 41452 - DNA, 37 bp, Artificial Sequence
  Synthetic oligonucleotide
tgtcattcctgcctgcgagcggccttcccattctcga

SEQ ID NO: 41453 - DNA, 37 bp, Artificial Sequence
  Synthetic oligonucleotide
ttactcgccccccctgcttgtttaaaatggtcttcga

SEQ ID NO: 41454 - DNA, 38 bp, Artificial Sequence
  Synthetic oligonucleotide
ttcacccccgtctgccactgacccgcaaccaggcatga

SEQ ID NO: 41455 - DNA, 37 bp, Artificial Sequence
  Synthetic oligonucleotide
tcatactcgaatgttgcctgttcacgcccagccctga

SEQ ID NO: 41456 - DNA, 35 bp, Artificial Sequence
  Synthetic oligonucleotide
gcttcacacagtgctctaccgtgcccctgccctga

SEQ ID NO: 41457 - DNA, 38 bp, Artificial Sequence
  Synthetic oligonucleotide
gtgccaaccgagccgatattctatcaactgatccctga

SEQ ID NO: 41458 - DNA, 38 bp, Artificial Sequence
  Synthetic oligonucleotide
gattcatcagacgcctcacgacccatcgttctccctga

SEQ ID NO: 41459 - DNA, 38 bp, Artificial Sequence
  Synthetic oligonucleotide
atcggacatcagttcacatcattgcctcactctcctga

SEQ ID NO: 41460 - DNA, 38 bp, Artificial Sequence
  Synthetic oligonucleotide
atcgcgaacttgcctcctcaccccctggacgactctga

SEQ ID NO: 41461 - DNA, 37 bp, Artificial Sequence
  Synthetic oligonucleotide
aatcggttccagcccagcttcctccctttagccgtga

SEQ ID NO: 41462 - DNA, 37 bp, Artificial Sequence
  Synthetic oligonucleotide
aacgacaccgaacatcgtgtatatgggggtgaggtga

SEQ ID NO: 41463 - DNA, 38 bp, Artificial Sequence
  Synthetic oligonucleotide
agaggctacgcactgcaacctgtaccgttccatcttga

SEQ ID NO: 41464 - DNA, 37 bp, Artificial Sequence
  Synthetic oligonucleotide
tgcgacaaccgactctaccctcgtggcctcttcttga

SEQ ID NO: 41465 - DNA, 38 bp, Artificial Sequence
  Synthetic oligonucleotide
tacacgaaccgctctccgtactatcagtccttgtttga

SEQ ID NO: 41466 - DNA, 35 bp, Artificial Sequence
  Synthetic oligonucleotide
tcagccatggacgtttctgccgacatcacaccata

SEQ ID NO: 41467 - DNA, 35 bp, Artificial Sequence
  Synthetic oligonucleotide
ggtatgcccgcacccggcctacaagccacctatac

SEQ ID NO: 41468 - DNA, 35 bp, Artificial Sequence
  Synthetic oligonucleotide
ggatgcacgccccccatatttgagtcatcacaacc

SEQ ID NO: 41469 - DNA, 35 bp, Artificial Sequence
  Synthetic oligonucleotide
accatcgctgtacatcttgcgagcatatactatgc

SEQ ID NO: 41470 - DNA, 35 bp, Artificial Sequence
  Synthetic oligonucleotide
gcaccgctacgccaatttagggagcccctttaatc

SEQ ID NO: 41471 - DNA, 35 bp, Artificial Sequence
  Synthetic oligonucleotide
gctggcgcctttcacccggctatcgttcgcacatc

SEQ ID NO: 41472 - DNA, 35 bp, Artificial Sequence
  Synthetic oligonucleotide
actctcacgcacacaccctcgaggtccgctgattc

SEQ ID NO: 41473 - DNA, 35 bp, Artificial Sequence
  Synthetic oligonucleotide
actcctgttaccagcggacctttgctgccactccg

SEQ ID NO: 41474 - DNA, 35 bp, Artificial Sequence
  Synthetic oligonucleotide
acccgatccaaactcatttctgcgcgaactcgtcg

SEQ ID NO: 41475 - DNA, 35 bp, Artificial Sequence
  Synthetic oligonucleotide
tccaacctcgtcctatacgcctaccatatgcatgg

SEQ ID NO: 41476 - DNA, 35 bp, Artificial Sequence
  Synthetic oligonucleotide
gaaggaagtggtgggcgggggtcgcaggtaggatg

SEQ ID NO: 41477 - DNA, 35 bp, Artificial Sequence
  Synthetic oligonucleotide
gtgcctgtccacaattaccttacctgaagttccat

SEQ ID NO: 41478 - DNA, 35 bp, Artificial Sequence
  Synthetic oligonucleotide
tccacaacaagcgttgtacaaacggcctacaccct

SEQ ID NO: 41479 - DNA, 35 bp, Artificial Sequence
  Synthetic oligonucleotide
ttcacgcaacacaggtgactttgctccctaaattt

SEQ ID NO: 41480 - DNA, 35 bp, Artificial Sequence
  Synthetic oligonucleotide
tgtcacgtattctgcgtgctcatgccaaacccttt

SEQ ID NO: 41481 - DNA, 36 bp, Artificial Sequence
  Synthetic oligonucleotide
attacatcagcgctgcctgcaccccttcctccagaa

SEQ ID NO: 41482 - DNA, 36 bp, Artificial Sequence
  Synthetic oligonucleotide
tctgaaccaccagccccctgtacccctagtacggaa

SEQ ID NO: 41483 - DNA, 35 bp, Artificial Sequence
  Synthetic oligonucleotide
tacccgacccaccagcaagaacgctttttctctaa

SEQ ID NO: 41484 - DNA, 36 bp, Artificial Sequence
  Synthetic oligonucleotide
tccacctatgctgactcctttgcctacattctacca

SEQ ID NO: 41485 - DNA, 36 bp, Artificial Sequence
  Synthetic oligonucleotide
tgactagtgcatggtgatctgctcatcgtaactcca

SEQ ID NO: 41486 - DNA, 37 bp, Artificial Sequence
  Synthetic oligonucleotide
tatccacccagccgaaagcgctggcccattccttaga

SEQ ID NO: 41487 - DNA, 37 bp, Artificial Sequence
  Synthetic oligonucleotide
gttcggactgaggggtgggttggaatggggctaacga

SEQ ID NO: 41488 - DNA, 37 bp, Artificial Sequence
  Synthetic oligonucleotide
acgctccaacctccgcatcgttatgtggccgtcccga

SEQ ID NO: 41489 - DNA, 37 bp, Artificial Sequence
  Synthetic oligonucleotide
tctgggcaacaactgctattccaccacacatacggga

SEQ ID NO: 41490 - DNA, 37 bp, Artificial Sequence
  Synthetic oligonucleotide
ggtcaagggagtatggggggggcgggggtagttggga

SEQ ID NO: 41491 - DNA, 37 bp, Artificial Sequence
  Synthetic oligonucleotide
tacggtcagtgaggcataggaaagggtgggagctgga

SEQ ID NO: 41492 - DNA, 37 bp, Artificial Sequence
  Synthetic oligonucleotide
tcaagtgggcaccgggggggaagagcgaaaggttgga

SEQ ID NO: 41493 - DNA, 37 bp, Artificial Sequence
  Synthetic oligonucleotide
atgcggggtgttagacgtatgggggtgcaaggttgga

SEQ ID NO: 41494 - DNA, 38 bp, Artificial Sequence
  Synthetic oligonucleotide
gcgaccgcacaccacactgtccccgccggtaaacatga

SEQ ID NO: 41495 - DNA, 37 bp, Artificial Sequence
  Synthetic oligonucleotide
gatccccgtcccattaaaccgcgcccaaccccgctga

SEQ ID NO: 41496 - DNA, 37 bp, Artificial Sequence
  Synthetic oligonucleotide
tatcgcttccgccgctttaacgcacaattccatctga

SEQ ID NO: 41497 - DNA, 38 bp, Artificial Sequence
  Synthetic oligonucleotide
agaacggatggaagggttggaggtgagctcgtcagtga

SEQ ID NO: 41498 - DNA, 35 bp, Artificial Sequence
  Synthetic oligonucleotide
gccctacgccttcttattttctcagcccgccgtga

SEQ ID NO: 41499 - DNA, 38 bp, Artificial Sequence
  Synthetic oligonucleotide
tccggtggctcgccctgttcctgtcttctgtgcggtga

SEQ ID NO: 41500 - DNA, 38 bp, Artificial Sequence
  Synthetic oligonucleotide
ttgcccatcgcatgtcttctagcccgttggtaacttga

SEQ ID NO: 41501 - DNA, 38 bp, Artificial Sequence
  Synthetic oligonucleotide
accaggcccacttacgctttacagcccgaagcccttga

SEQ ID NO: 41502 - DNA, 37 bp, Artificial Sequence
  Synthetic oligonucleotide
gtcatacgcccacggtgatacattgggtaccctttga

SEQ ID NO: 41503 - DNA, 38 bp, Artificial Sequence
  Synthetic oligonucleotide
gtcgcacccccatctgccaaatgtagtctccgctttga

SEQ ID NO: 41504 - DNA, 36 bp, Artificial Sequence
  Synthetic oligonucleotide
tccggactcgctgccgacgccccactagttgtttga

SEQ ID NO: 41505 - DNA, 37 bp, Artificial Sequence
  Synthetic oligonucleotide
tctgtcgccctcgcctaaaagaagtccgttcttttga

SEQ ID NO: 41506 - DNA, 36 bp, Artificial Sequence
  Synthetic oligonucleotide
tgaaagcaagcccgaagtgtaatttccaccccccta

SEQ ID NO: 41507 - DNA, 35 bp, Artificial Sequence
  Synthetic oligonucleotide
tccatccgcactattggctgggagtttactcagta

SEQ ID NO: 41508 - DNA, 35 bp, Artificial Sequence
  Synthetic oligonucleotide
acatctgtcgcgtactatctttccacagccattta

SEQ ID NO: 41509 - DNA, 36 bp, Artificial Sequence
  Synthetic oligonucleotide
gctgacaatcgtggccttgcactttgccatatttta

SEQ ID NO: 41510 - DNA, 35 bp, Artificial Sequence
  Synthetic oligonucleotide
tcactcctttccgactttcccccggtgtgaaccac

SEQ ID NO: 41511 - DNA, 35 bp, Artificial Sequence
  Synthetic oligonucleotide
taactccggcccagcattaccgcgcgcaatcgacc

SEQ ID NO: 41512 - DNA, 35 bp, Artificial Sequence
  Synthetic oligonucleotide
taatccctccccagccatgcaggggctcccctccc

SEQ ID NO: 41513 - DNA, 35 bp, Artificial Sequence
  Synthetic oligonucleotide
tcgtgctgcccgcccaaatttgtaacttgtcccgc

SEQ ID NO: 41514 - DNA, 35 bp, Artificial Sequence
  Synthetic oligonucleotide
tccgaacttctcatctctccagacctatatttggc

SEQ ID NO: 41515 - DNA, 35 bp, Artificial Sequence
  Synthetic oligonucleotide
tcatgtctccgtttaattccctagcactgtgatgc

SEQ ID NO: 41516 - DNA, 35 bp, Artificial Sequence
  Synthetic oligonucleotide
ttaccccggcgatagtaatccagctcttaatcatc

SEQ ID NO: 41517 - DNA, 35 bp, Artificial Sequence
  Synthetic oligonucleotide
gttgtagctaggcgtccggtttccctttatccttc

SEQ ID NO: 41518 - DNA, 35 bp, Artificial Sequence
  Synthetic oligonucleotide
tcccgtgcactgccttgcgccccaacaaatgacat

SEQ ID NO: 41519 - DNA, 35 bp, Artificial Sequence
  Synthetic oligonucleotide
gtggctggcactacggtacgattccacccgcttct

SEQ ID NO: 41520 - DNA, 35 bp, Artificial Sequence
  Synthetic oligonucleotide
tggtccctcccgtcctacttcaccactgtcgccgt

SEQ ID NO: 41521 - DNA, 35 bp, Artificial Sequence
  Synthetic oligonucleotide
tagcccattcaaccgtttgtacagtccccacattt

SEQ ID NO: 41522 - DNA, 36 bp, Artificial Sequence
  Synthetic oligonucleotide
gtgtgggggaatagggtagcagcgagggaggacaaa

SEQ ID NO: 41523 - DNA, 36 bp, Artificial Sequence
  Synthetic oligonucleotide
gatgacacaggtagttaagggagggcggttatagaa

SEQ ID NO: 41524 - DNA, 35 bp, Artificial Sequence
  Synthetic oligonucleotide
actgtgggaggggaacggggaacctagagaaataa

SEQ ID NO: 41525 - DNA, 36 bp, Artificial Sequence
  Synthetic oligonucleotide
gcccacctgaacaatttacagatctgcttgtgctaa

SEQ ID NO: 41526 - DNA, 36 bp, Artificial Sequence
  Synthetic oligonucleotide
atttacgccaccgctacttcatctgtacaacatgca

SEQ ID NO: 41527 - DNA, 36 bp, Artificial Sequence
  Synthetic oligonucleotide
tgttggcctagattcaccatgttctccttcgtgtca

SEQ ID NO: 41528 - DNA, 36 bp, Artificial Sequence
  Synthetic oligonucleotide
tcccgaacctcaacgtacccccctgccgtggattca

SEQ ID NO: 41529 - DNA, 36 bp, Artificial Sequence
  Synthetic oligonucleotide
acatctgctgcctgttcttgttaacggttggcccga

SEQ ID NO: 41530 - DNA, 36 bp, Artificial Sequence
  Synthetic oligonucleotide
gcacgaggcattggggaatagcagggagtggtcgga

SEQ ID NO: 41531 - DNA, 37 bp, Artificial Sequence
  Synthetic oligonucleotide
gaagaacacgaggggaaggggataagtgcaataggga

SEQ ID NO: 41532 - DNA, 37 bp, Artificial Sequence
  Synthetic oligonucleotide
gcacgacgagggggtagccggggatgggggactggga

SEQ ID NO: 41533 - DNA, 37 bp, Artificial Sequence
  Synthetic oligonucleotide
tctcacacctcccgagccttcatttgtcgccgtatga

SEQ ID NO: 41534 - DNA, 38 bp, Artificial Sequence
  Synthetic oligonucleotide
tgtcgccgctgttttctcgttagctccctactgcctga

SEQ ID NO: 41535 - DNA, 38 bp, Artificial Sequence
  Synthetic oligonucleotide
ttgacatccggcctatgcacgtatatactggggtgtga

SEQ ID NO: 41536 - DNA, 37 bp, Artificial Sequence
  Synthetic oligonucleotide
gccgccgcaacgaccatgcattgacctatacccttga

SEQ ID NO: 41537 - DNA, 36 bp, Artificial Sequence
  Synthetic oligonucleotide
accgacttggtcattctcaacagccccgtacttata

SEQ ID NO: 41538 - DNA, 36 bp, Artificial Sequence
  Synthetic oligonucleotide
ttgttcagtcgagacccccaccccttatttgagcta

SEQ ID NO: 41539 - DNA, 35 bp, Artificial Sequence
  Synthetic oligonucleotide
gcaccattgccgccaattgaccattaactatagta

SEQ ID NO: 41540 - DNA, 35 bp, Artificial Sequence
  Synthetic oligonucleotide
taagggagggaggaggggccaataacggctatgta

SEQ ID NO: 41541 - DNA, 35 bp, Artificial Sequence
  Synthetic oligonucleotide
accatctcacaagacccgatccagccatagcacac

SEQ ID NO: 41542 - DNA, 35 bp, Artificial Sequence
  Synthetic oligonucleotide
tacatagggtagggaaagcatctcggaaggaggac

SEQ ID NO: 41543 - DNA, 35 bp, Artificial Sequence
  Synthetic oligonucleotide
acccgtgcccacgtttatgtcaatgttctcacgcc

SEQ ID NO: 41544 - DNA, 35 bp, Artificial Sequence
  Synthetic oligonucleotide
tcgcccctacgaaaagactgttttacttggtttcc

SEQ ID NO: 41545 - DNA, 35 bp, Artificial Sequence
  Synthetic oligonucleotide
tgccatcatcgcatttatcccatcgcgattcgctc

SEQ ID NO: 41546 - DNA, 35 bp, Artificial Sequence
  Synthetic oligonucleotide
tcacctcacacacgtatagaccgtaacagcgcttc

SEQ ID NO: 41547 - DNA, 35 bp, Artificial Sequence
  Synthetic oligonucleotide
ataactccagccttgaccgttgaccccaattgttc

SEQ ID NO: 41548 - DNA, 35 bp, Artificial Sequence
  Synthetic oligonucleotide
acatccctacattctgcctcgtgaccacttagcag

SEQ ID NO: 41549 - DNA, 35 bp, Artificial Sequence
  Synthetic oligonucleotide
actaacgcactacacccatatttaaacgccgactg

SEQ ID NO: 41550 - DNA, 35 bp, Artificial Sequence
  Synthetic oligonucleotide
tacgcctgccgctggacatccacaacttagacttg

SEQ ID NO: 41551 - DNA, 35 bp, Artificial Sequence
  Synthetic oligonucleotide
tcacactgcaccaatccgttcactacaccagcttg

SEQ ID NO: 41552 - DNA, 35 bp, Artificial Sequence
  Synthetic oligonucleotide
gccccatacccgacaagtagcagtatacgcgcttg

SEQ ID NO: 41553 - DNA, 36 bp, Artificial Sequence
  Synthetic oligonucleotide
tccgcctccactgatgatcccggtttcatctcacaa

SEQ ID NO: 41554 - DNA, 36 bp, Artificial Sequence
  Synthetic oligonucleotide
gcagtccttaccccatttgcctgcgatccctgagaa

SEQ ID NO: 41555 - DNA, 35 bp, Artificial Sequence
  Synthetic oligonucleotide
ttgacgtacacgttgcttcccttgtaattgtaaca

SEQ ID NO: 41556 - DNA, 35 bp, Artificial Sequence
  Synthetic oligonucleotide
gccctcatcaagcctgcattacatccttccttgca

SEQ ID NO: 41557 - DNA, 35 bp, Artificial Sequence
  Synthetic oligonucleotide
aacccggccctttcacttgacgcacgtttacatca

SEQ ID NO: 41558 - DNA, 35 bp, Artificial Sequence
  Synthetic oligonucleotide
accgcaaccttccagctgctgctaaccctatctca

SEQ ID NO: 41559 - DNA, 36 bp, Artificial Sequence
  Synthetic oligonucleotide
gctaaaggaggagagcgtaacagaggaagggcgtca

SEQ ID NO: 41560 - DNA, 37 bp, Artificial Sequence
  Synthetic oligonucleotide
tcagcatccgtccgcaccgccccgcctctgtttgaga

SEQ ID NO: 41561 - DNA, 35 bp, Artificial Sequence
  Synthetic oligonucleotide
agttccatccgccgcatgccagcttaaacgaacga

SEQ ID NO: 41562 - DNA, 35 bp, Artificial Sequence
  Synthetic oligonucleotide
gttgggcctccacacaatgattcatcgctccacga

SEQ ID NO: 41563 - DNA, 37 bp, Artificial Sequence
  Synthetic oligonucleotide
tgtcaacaccgtattttccaccccgtcgcgaagacga

SEQ ID NO: 41564 - DNA, 37 bp, Artificial Sequence
  Synthetic oligonucleotide
gttgggcccaccaccctctgccattgataccgcccga

SEQ ID NO: 41565 - DNA, 37 bp, Artificial Sequence
  Synthetic oligonucleotide
gtagcgcctccttccccagtactcacacccacggcga

SEQ ID NO: 41566 - DNA, 36 bp, Artificial Sequence
  Synthetic oligonucleotide
acccatctccgatctgcaacaccccgggtactgcga

SEQ ID NO: 41567 - DNA, 37 bp, Artificial Sequence
  Synthetic oligonucleotide
tacccgagggttcgtgcgtaccacccagctcactcga

SEQ ID NO: 41568 - DNA, 37 bp, Artificial Sequence
  Synthetic oligonucleotide
ggacaccctccggactggccgctcccaaactcttcga

SEQ ID NO: 41569 - DNA, 37 bp, Artificial Sequence
  Synthetic oligonucleotide
tgtgccaggggttggctaggtgttggatggtagtgga

SEQ ID NO: 41570 - DNA, 38 bp, Artificial Sequence
  Synthetic oligonucleotide
tccactccgcctccgtgtccgagacttcgatgccatga

SEQ ID NO: 41571 - DNA, 37 bp, Artificial Sequence
  Synthetic oligonucleotide
ttcgcacgcccctggatatcctcagtatttagcctga

SEQ ID NO: 41572 - DNA, 37 bp, Artificial Sequence
  Synthetic oligonucleotide
acccgtacacctctgactaattgccaaaactgcctga

SEQ ID NO: 41573 - DNA, 38 bp, Artificial Sequence
  Synthetic oligonucleotide
acaggcccgttacatcgattccaccgccgccgtagtga

SEQ ID NO: 41574 - DNA, 36 bp, Artificial Sequence
  Synthetic oligonucleotide
gggggggtcacctctgttcttcttcctccatcgtga

SEQ ID NO: 41575 - DNA, 37 bp, Artificial Sequence
  Synthetic oligonucleotide
taggggggggagagttacgggtataggcatggattga

SEQ ID NO: 41576 - DNA, 37 bp, Artificial Sequence
  Synthetic oligonucleotide
tccccgcacatctggacgactatgcactcttctttga

SEQ ID NO: 41577 - DNA, 35 bp, Artificial Sequence
  Synthetic oligonucleotide
gagcctacctccgacgctgatcacgagttttttga

SEQ ID NO: 41578 - DNA, 36 bp, Artificial Sequence
  Synthetic oligonucleotide
tgaacatcatggcggccatacatcctcttggtccta

SEQ ID NO: 41579 - DNA, 36 bp, Artificial Sequence
  Synthetic oligonucleotide
accacacctcctttatatccggaccttgccgcatta

SEQ ID NO: 41580 - DNA, 35 bp, Artificial Sequence
  Synthetic oligonucleotide
tctcatcacctgctagatcctttcgaagaactaac

SEQ ID NO: 41581 - DNA, 36 bp, Artificial Sequence
  Synthetic oligonucleotide
tagcgcacattcatagtcccagtctgtgccctgccc

SEQ ID NO: 41582 - DNA, 35 bp, Artificial Sequence
  Synthetic oligonucleotide
tccgactcatctcgcatactcctgtatcatggctc

SEQ ID NO: 41583 - DNA, 35 bp, Artificial Sequence
  Synthetic oligonucleotide
gacacattaaggcacctacgataccccgacttctg

SEQ ID NO: 41584 - DNA, 35 bp, Artificial Sequence
  Synthetic oligonucleotide
aacacgctggctcccacttgctcacattagaaaat

SEQ ID NO: 41585 - DNA, 35 bp, Artificial Sequence
  Synthetic oligonucleotide
gattggtgctccgggacgttctgtttcatccctct

SEQ ID NO: 41586 - DNA, 35 bp, Artificial Sequence
  Synthetic oligonucleotide
accttcattactccgccgacttgcataaagtctct

SEQ ID NO: 41587 - DNA, 35 bp, Artificial Sequence
  Synthetic oligonucleotide
gcttacttccatggctctctaatgactttttgtgt

SEQ ID NO: 41588 - DNA, 35 bp, Artificial Sequence
  Synthetic oligonucleotide
accgaaccgcggtgagttgaagtcgtttcaccatt

SEQ ID NO: 41589 - DNA, 35 bp, Artificial Sequence
  Synthetic oligonucleotide
tccacatccttggatggaaactcaaccatgccatt

SEQ ID NO: 41590 - DNA, 36 bp, Artificial Sequence
  Synthetic oligonucleotide
gaacccctgtccgcccaactgtgcaacctcctttaa

SEQ ID NO: 41591 - DNA, 35 bp, Artificial Sequence
  Synthetic oligonucleotide
tgagcctccggaaacattgcttgctcgtgcctcca

SEQ ID NO: 41592 - DNA, 35 bp, Artificial Sequence
  Synthetic oligonucleotide
tcatggcacatggaaccgatccctcttttatggca

SEQ ID NO: 41593 - DNA, 37 bp, Artificial Sequence
  Synthetic oligonucleotide
taaaccgaggagggtggtggtggctcagggatcgaga

SEQ ID NO: 41594 - DNA, 37 bp, Artificial Sequence
  Synthetic oligonucleotide
acaacatccctcggtctgtgatctgtcactccggaga

SEQ ID NO: 41595 - DNA, 37 bp, Artificial Sequence
  Synthetic oligonucleotide
gacacacccctaacggccaactatcctgtctcctaga

SEQ ID NO: 41596 - DNA, 36 bp, Artificial Sequence
  Synthetic oligonucleotide
gacacctgaaccgacgccaaaccacaaagaccacga

SEQ ID NO: 41597 - DNA, 37 bp, Artificial Sequence
  Synthetic oligonucleotide
tacattggcccgaccccattcgttttgacctgaccga

SEQ ID NO: 41598 - DNA, 37 bp, Artificial Sequence
  Synthetic oligonucleotide
gggaagggtgacaatgggaaagttggagggggtgcga

SEQ ID NO: 41599 - DNA, 36 bp, Artificial Sequence
  Synthetic oligonucleotide
gttaacgcacgaaacacaacaagggacggttctcga

SEQ ID NO: 41600 - DNA, 37 bp, Artificial Sequence
  Synthetic oligonucleotide
atgccctcaacatgaggtattgtttggtgcccttcga

SEQ ID NO: 41601 - DNA, 37 bp, Artificial Sequence
  Synthetic oligonucleotide
ttctatccccgccaccgcttaacatgttccgaccgga

SEQ ID NO: 41602 - DNA, 38 bp, Artificial Sequence
  Synthetic oligonucleotide
agacacctttcccgccttttctacaggtcagttactga

SEQ ID NO: 41603 - DNA, 37 bp, Artificial Sequence
  Synthetic oligonucleotide
tgccggttacaccatcgcaataattacatcccgctga

SEQ ID NO: 41604 - DNA, 37 bp, Artificial Sequence
  Synthetic oligonucleotide
acgcagtgcgctcgccttgtttcctcgttaactctga

SEQ ID NO: 41605 - DNA, 38 bp, Artificial Sequence
  Synthetic oligonucleotide
gcgaccgcgcacctgctcagccctttttgtttccgtga

SEQ ID NO: 41606 - DNA, 37 bp, Artificial Sequence
  Synthetic oligonucleotide
acccctctgacccaatacactctcgctgactgcgtga

SEQ ID NO: 41607 - DNA, 38 bp, Artificial Sequence
  Synthetic oligonucleotide
tgagcaatgcaattcaacggtaggaaggctgggggtga

SEQ ID NO: 41608 - DNA, 36 bp, Artificial Sequence
  Synthetic oligonucleotide
tatggcattcgtagcgccgcattactccactcacta

SEQ ID NO: 41609 - DNA, 35 bp, Artificial Sequence
  Synthetic oligonucleotide
tgccctccactatccacggtctgcactgttcacta

SEQ ID NO: 41610 - DNA, 35 bp, Artificial Sequence
  Synthetic oligonucleotide
gtacgctgaccatcttacggagcaactcaatccta

SEQ ID NO: 41611 - DNA, 36 bp, Artificial Sequence
  Synthetic oligonucleotide
acgaccgcctcgttgctcccacttgcgttactctta

SEQ ID NO: 41612 - DNA, 35 bp, Artificial Sequence
  Synthetic oligonucleotide
gaccaccgcgggggtcttcctaagttgattcccac

SEQ ID NO: 41613 - DNA, 35 bp, Artificial Sequence
  Synthetic oligonucleotide
accccctactgaccatgtgcgctgtttcaatcgac

SEQ ID NO: 41614 - DNA, 35 bp, Artificial Sequence
  Synthetic oligonucleotide
acccagagcatcgtgctactttacgttccgggccc

SEQ ID NO: 41615 - DNA, 35 bp, Artificial Sequence
  Synthetic oligonucleotide
tgtaacgtctctgcacatgttattttctcctttgc

SEQ ID NO: 41616 - DNA, 35 bp, Artificial Sequence
  Synthetic oligonucleotide
gcgagcctgaaactttacgcacgcatgacttttgc

SEQ ID NO: 41617 - DNA, 35 bp, Artificial Sequence
  Synthetic oligonucleotide
gctacggtcagggaaaaagggcgggcgggattttc

SEQ ID NO: 41618 - DNA, 35 bp, Artificial Sequence
  Synthetic oligonucleotide
tgcgaagaggaaatcgaattgatgcaggagtgaag

SEQ ID NO: 41619 - DNA, 35 bp, Artificial Sequence
  Synthetic oligonucleotide
gaagggccgggagagggtggtgggtgcatcagggg

SEQ ID NO: 41620 - DNA, 35 bp, Artificial Sequence
  Synthetic oligonucleotide
gacacgtaacgggaagaagggcatatatttagggg

SEQ ID NO: 41621 - DNA, 35 bp, Artificial Sequence
  Synthetic oligonucleotide
acaaaaccacagtcctgatccacctactctgtgtt

SEQ ID NO: 41622 - DNA, 34 bp, Artificial Sequence
  Synthetic oligonucleotide
atcgggacccaagggtgggaagggagttggtaaa

SEQ ID NO: 41623 - DNA, 36 bp, Artificial Sequence
  Synthetic oligonucleotide
gccgtcggtcgtaaatgccttgggtccttcctgcaa

SEQ ID NO: 41624 - DNA, 36 bp, Artificial Sequence
  Synthetic oligonucleotide
actatcacaccaccgttaatgtccgcgctttaaaca

SEQ ID NO: 41625 - DNA, 36 bp, Artificial Sequence
  Synthetic oligonucleotide
taaggtaggaagggctgattgctggtggatggcaca

SEQ ID NO: 41626 - DNA, 36 bp, Artificial Sequence
  Synthetic oligonucleotide
gtctttcaccagagctccctcgtgcctgtgtttcca

SEQ ID NO: 41627 - DNA, 36 bp, Artificial Sequence
  Synthetic oligonucleotide
taacgcgccgccgactatcgtgggcctccaacatca

SEQ ID NO: 41628 - DNA, 36 bp, Artificial Sequence
  Synthetic oligonucleotide
ttacgtccaacgcctacaactctgtgtgagttctca

SEQ ID NO: 41629 - DNA, 37 bp, Artificial Sequence
  Synthetic oligonucleotide
ggagtggtccactgcgcctaatttgcttgcactccga

SEQ ID NO: 41630 - DNA, 36 bp, Artificial Sequence
  Synthetic oligonucleotide
tctagcgcaccactgattcgagcgtgatccttccga

SEQ ID NO: 41631 - DNA, 37 bp, Artificial Sequence
  Synthetic oligonucleotide
aacgccactgcggagctagacccattcccatcttcga

SEQ ID NO: 41632 - DNA, 37 bp, Artificial Sequence
  Synthetic oligonucleotide
gggtgggcaggggctgggactaactgttcccccagga

SEQ ID NO: 41633 - DNA, 37 bp, Artificial Sequence
  Synthetic oligonucleotide
tagtactgcacagttggggtccgtgtcggttgtagga

SEQ ID NO: 41634 - DNA, 37 bp, Artificial Sequence
  Synthetic oligonucleotide
tccacctttcaatccgtgactactacttgtcctatga

SEQ ID NO: 41635 - DNA, 37 bp, Artificial Sequence
  Synthetic oligonucleotide
tccaaagcgggggggaaggtgatgaggtagtcggtga

SEQ ID NO: 41636 - DNA, 38 bp, Artificial Sequence
  Synthetic oligonucleotide
gttgcgatcaaacaactttagcccatgtcttcctgtga

SEQ ID NO: 41637 - DNA, 38 bp, Artificial Sequence
  Synthetic oligonucleotide
gtcgccgaaccctcgttggtaacttgatgatccattga

SEQ ID NO: 41638 - DNA, 38 bp, Artificial Sequence
  Synthetic oligonucleotide
ggggcgggtgcgggtgggctgttcacggttaaacttga

SEQ ID NO: 41639 - DNA, 38 bp, Artificial Sequence
  Synthetic oligonucleotide
tctacacccacctggatattcatgaatgaccattttga

SEQ ID NO: 41640 - DNA, 35 bp, Artificial Sequence
  Synthetic oligonucleotide
gactgcacaggcccataggatgcatcccactacac

SEQ ID NO: 41641 - DNA, 35 bp, Artificial Sequence
  Synthetic oligonucleotide
gacgccccggtactatccgcattctaggctttcac

SEQ ID NO: 41642 - DNA, 35 bp, Artificial Sequence
  Synthetic oligonucleotide
aacaacgcaccgtcacgaaattcacggtttccacc

SEQ ID NO: 41643 - DNA, 35 bp, Artificial Sequence
  Synthetic oligonucleotide
gagcgccaccgtacgttggccactactttcccccc

SEQ ID NO: 41644 - DNA, 35 bp, Artificial Sequence
  Synthetic oligonucleotide
gacccactctcacctcagcgcggttcctacgtatc

SEQ ID NO: 41645 - DNA, 35 bp, Artificial Sequence
  Synthetic oligonucleotide
atgtgggtgagggatttacgggaaaggcgagggcg

SEQ ID NO: 41646 - DNA, 35 bp, Artificial Sequence
  Synthetic oligonucleotide
tgccacccgcaagcgaactttgtgactctccgtcg

SEQ ID NO: 41647 - DNA, 35 bp, Artificial Sequence
  Synthetic oligonucleotide
actcgagggagaaaaagcagggctttaagagaggg

SEQ ID NO: 41648 - DNA, 35 bp, Artificial Sequence
  Synthetic oligonucleotide
ggaatgggtacggggggggattcaaggacccagtg

SEQ ID NO: 41649 - DNA, 35 bp, Artificial Sequence
  Synthetic oligonucleotide
tccgtgacgagtgcgaaccgtaagggtagggggtg

SEQ ID NO: 41650 - DNA, 35 bp, Artificial Sequence
  Synthetic oligonucleotide
gtcaacgaccaagtctcaacactattcactccaat

SEQ ID NO: 41651 - DNA, 35 bp, Artificial Sequence
  Synthetic oligonucleotide
gatccgacctcaacgcacgttcagggccattacct

SEQ ID NO: 41652 - DNA, 35 bp, Artificial Sequence
  Synthetic oligonucleotide
tccgccttccactagtggctcaaactctaccatct

SEQ ID NO: 41653 - DNA, 34 bp, Artificial Sequence
  Synthetic oligonucleotide
attacccacataccagcgtagttgccctcccagt

SEQ ID NO: 41654 - DNA, 35 bp, Artificial Sequence
  Synthetic oligonucleotide
gtgccttgccttcgatcactttttggctctagttt

SEQ ID NO: 41655 - DNA, 36 bp, Artificial Sequence
  Synthetic oligonucleotide
gagcccacgtccctcttctcccttgcattagttcaa

SEQ ID NO: 41656 - DNA, 36 bp, Artificial Sequence
  Synthetic oligonucleotide
gcccctatcaggttgttctcttgtcaccatatctaa

SEQ ID NO: 41657 - DNA, 36 bp, Artificial Sequence
  Synthetic oligonucleotide
ttgtgttcagcgctacgtcctggttcttattgccca

SEQ ID NO: 41658 - DNA, 36 bp, Artificial Sequence
  Synthetic oligonucleotide
agcgtcccgtccacgcgcgagggccataccgttcca

SEQ ID NO: 41659 - DNA, 37 bp, Artificial Sequence
  Synthetic oligonucleotide
gccccactccgcaaaccgaacgcccagtcacgagaga

SEQ ID NO: 41660 - DNA, 37 bp, Artificial Sequence
  Synthetic oligonucleotide
aatgcccacttggctatggaaacactctgacagtaga

SEQ ID NO: 41661 - DNA, 37 bp, Artificial Sequence
  Synthetic oligonucleotide
taacgcaatcagtttcccagcccccatttagttgcga

SEQ ID NO: 41662 - DNA, 37 bp, Artificial Sequence
  Synthetic oligonucleotide
atcaccgaactcgacagtgaccttcccgttctatcga

SEQ ID NO: 41663 - DNA, 37 bp, Artificial Sequence
  Synthetic oligonucleotide
accgagtggggatatggggagaggcatgcagaaggga

SEQ ID NO: 41664 - DNA, 36 bp, Artificial Sequence
  Synthetic oligonucleotide
accatgaacagggttggacggaggggagttctggga

SEQ ID NO: 41665 - DNA, 36 bp, Artificial Sequence
  Synthetic oligonucleotide
ggtaactaccaccttacactcgcgccttcccctgga

SEQ ID NO: 41666 - DNA, 37 bp, Artificial Sequence
  Synthetic oligonucleotide
gtcgatcgacgacacggaatctgattatgtgggtgga

SEQ ID NO: 41667 - DNA, 38 bp, Artificial Sequence
  Synthetic oligonucleotide
agaaggggtaggtgggtgcggggtggagggttagctga

SEQ ID NO: 41668 - DNA, 38 bp, Artificial Sequence
  Synthetic oligonucleotide
gcactagcacaccactatctactgcccctctttagtga

SEQ ID NO: 41669 - DNA, 35 bp, Artificial Sequence
  Synthetic oligonucleotide
ttacgtagcaccgcttatctcctgtgtcccgcata

SEQ ID NO: 41670 - DNA, 35 bp, Artificial Sequence
  Synthetic oligonucleotide
gccggttcgcgcgttctgtttttttatccctcata

SEQ ID NO: 41671 - DNA, 36 bp, Artificial Sequence
  Synthetic oligonucleotide
tagctacgcggggcccatgcatacaccggtcttcta

SEQ ID NO: 41672 - DNA, 36 bp, Artificial Sequence
  Synthetic oligonucleotide
taaggaaagccggatcagggggagggtagcaggtta

SEQ ID NO: 41673 - DNA, 36 bp, Artificial Sequence
  Synthetic oligonucleotide
atctcgcgtgcccgggcctgcacttctggttattta

SEQ ID NO: 41674 - DNA, 35 bp, Artificial Sequence
  Synthetic oligonucleotide
gtccccattaccgccccaaaagttgaaaagtctac

SEQ ID NO: 41675 - DNA, 35 bp, Artificial Sequence
  Synthetic oligonucleotide
gccgtgggagggtgggtggtcgtaacgaagcgtac

SEQ ID NO: 41676 - DNA, 35 bp, Artificial Sequence
  Synthetic oligonucleotide
tgccattcactgacatctccctctcaaggcacagc

SEQ ID NO: 41677 - DNA, 35 bp, Artificial Sequence
  Synthetic oligonucleotide
gacacaacccaatcgacgtcatatctttagccatc

SEQ ID NO: 41678 - DNA, 35 bp, Artificial Sequence
  Synthetic oligonucleotide
gtggtgggtcagcgggcccagctcgacgctctatc

SEQ ID NO: 41679 - DNA, 35 bp, Artificial Sequence
  Synthetic oligonucleotide
atcctgccccgagacctgttccagagcgtgctctc

SEQ ID NO: 41680 - DNA, 35 bp, Artificial Sequence
  Synthetic oligonucleotide
ggaatctgccctcccgccttcttttgaagtcattc

SEQ ID NO: 41681 - DNA, 35 bp, Artificial Sequence
  Synthetic oligonucleotide
accccccccatgatgcatagcccacgtttcccttc

SEQ ID NO: 41682 - DNA, 34 bp, Artificial Sequence
  Synthetic oligonucleotide
aaccgatcctcctcgatttagctttgacgactcg

SEQ ID NO: 41683 - DNA, 35 bp, Artificial Sequence
  Synthetic oligonucleotide
ggtggtgtcgggggggggccagggcgctaaatatg

SEQ ID NO: 41684 - DNA, 35 bp, Artificial Sequence
  Synthetic oligonucleotide
gcctgagttttcgccgtcccctcccacccgcgctg

SEQ ID NO: 41685 - DNA, 35 bp, Artificial Sequence
  Synthetic oligonucleotide
agatcattcgatcgtgggtcccgcctcccttcact

SEQ ID NO: 41686 - DNA, 35 bp, Artificial Sequence
  Synthetic oligonucleotide
gtacactacccctccgcaccagccgtattaaggct

SEQ ID NO: 41687 - DNA, 36 bp, Artificial Sequence
  Synthetic oligonucleotide
atcccgctcgcgccaactgcccgccgcataccgaaa

SEQ ID NO: 41688 - DNA, 36 bp, Artificial Sequence
  Synthetic oligonucleotide
acgtcacccccatccctcagcacttagtctcggtaa

SEQ ID NO: 41689 - DNA, 36 bp, Artificial Sequence
  Synthetic oligonucleotide
gtcaacacccgacattaaccatgtgaacattccaca

SEQ ID NO: 41690 - DNA, 36 bp, Artificial Sequence
  Synthetic oligonucleotide
gtggaacccagaccgaaccgaggcccctgctccgca

SEQ ID NO: 41691 - DNA, 37 bp, Artificial Sequence
  Synthetic oligonucleotide
gaaccaacctccgagctgcacatacgcgcctactaga

SEQ ID NO: 41692 - DNA, 37 bp, Artificial Sequence
  Synthetic oligonucleotide
taccctccctcgacccgtcaaaagcaatcttccccga

SEQ ID NO: 41693 - DNA, 37 bp, Artificial Sequence
  Synthetic oligonucleotide
gagcctctgcgtccaactggaacttcacacctcccga

SEQ ID NO: 41694 - DNA, 37 bp, Artificial Sequence
  Synthetic oligonucleotide
tgagctgacctccatgccattaagtttcgtttgccga

SEQ ID NO: 41695 - DNA, 37 bp, Artificial Sequence
  Synthetic oligonucleotide
tcaccatatgccctctactcgcggtactacctgagga

SEQ ID NO: 41696 - DNA, 37 bp, Artificial Sequence
  Synthetic oligonucleotide
acagtagtgaaggagtggggggggaatcaaagcggga

SEQ ID NO: 41697 - DNA, 37 bp, Artificial Sequence
  Synthetic oligonucleotide
gctgctcgttaattcccatgcgcgtcgtttccctgga

SEQ ID NO: 41698 - DNA, 38 bp, Artificial Sequence
  Synthetic oligonucleotide
ttgttgcctcctgcccggacctccattctcctaaatga

SEQ ID NO: 41699 - DNA, 38 bp, Artificial Sequence
  Synthetic oligonucleotide
aatcccatcctgaattgtatcccctgtccgccgcatga

SEQ ID NO: 41700 - DNA, 38 bp, Artificial Sequence
  Synthetic oligonucleotide
gaaccagtatctgtgacctctgccccctgcttaactga

SEQ ID NO: 41701 - DNA, 38 bp, Artificial Sequence
  Synthetic oligonucleotide
gcgagggaaagaacggttggtcatcgagacggtactga

SEQ ID NO: 41702 - DNA, 38 bp, Artificial Sequence
  Synthetic oligonucleotide
acaacgtgcaccatccaccccctacgccacgtgcgtga

SEQ ID NO: 41703 - DNA, 37 bp, Artificial Sequence
  Synthetic oligonucleotide
ttgcatcgggcacaaggaggagcgggaggggctttga

SEQ ID NO: 41704 - DNA, 36 bp, Artificial Sequence
  Synthetic oligonucleotide
gacagactgtaagggtggcatgggcttggtggagta

SEQ ID NO: 41705 - DNA, 35 bp, Artificial Sequence
  Synthetic oligonucleotide
gcttgcctgccctctgcaccgtctgacctgcccac

SEQ ID NO: 41706 - DNA, 35 bp, Artificial Sequence
  Synthetic oligonucleotide
actgaccttcacccccgaatacgatctcggtgccc

SEQ ID NO: 41707 - DNA, 35 bp, Artificial Sequence
  Synthetic oligonucleotide
tcctaatcagaacgaccgcgcaaagcatcctccgc

SEQ ID NO: 41708 - DNA, 35 bp, Artificial Sequence
  Synthetic oligonucleotide
tacgcagagcattattttcctgctgggccattgtc

SEQ ID NO: 41709 - DNA, 35 bp, Artificial Sequence
  Synthetic oligonucleotide
gccacccgtcgtaaagcttcatttcccctttcttc

SEQ ID NO: 41710 - DNA, 35 bp, Artificial Sequence
  Synthetic oligonucleotide
atgctccattacacctgtttcacgaggctcttaag

SEQ ID NO: 41711 - DNA, 35 bp, Artificial Sequence
  Synthetic oligonucleotide
agccacctaccctgtgccacttttctgtatttcag

SEQ ID NO: 41712 - DNA, 35 bp, Artificial Sequence
  Synthetic oligonucleotide
gaccgggaatggttggtaggaaagtagtatggtag

SEQ ID NO: 41713 - DNA, 34 bp, Artificial Sequence
  Synthetic oligonucleotide
ccgagagccgccccttgaatccatcacgcatccg

SEQ ID NO: 41714 - DNA, 35 bp, Artificial Sequence
  Synthetic oligonucleotide
tccaccaatccatggtaatatcaatacctaagtat

SEQ ID NO: 41715 - DNA, 35 bp, Artificial Sequence
  Synthetic oligonucleotide
gttggccgcactcagccacgatctgctttgtcact

SEQ ID NO: 41716 - DNA, 35 bp, Artificial Sequence
  Synthetic oligonucleotide
aacgcgtccccgcacaccccgattgctgccacagt

SEQ ID NO: 41717 - DNA, 35 bp, Artificial Sequence
  Synthetic oligonucleotide
ttccccctccttacgtccagccctgccgtgccggt

SEQ ID NO: 41718 - DNA, 35 bp, Artificial Sequence
  Synthetic oligonucleotide
gcgacccacacgccccgaacgtctactaacattgt

SEQ ID NO: 41719 - DNA, 35 bp, Artificial Sequence
  Synthetic oligonucleotide
tcagttgcgaatcagtcctcccccaataggtcctt

SEQ ID NO: 41720 - DNA, 35 bp, Artificial Sequence
  Synthetic oligonucleotide
gcaccttccgcccgcagttgttgtcttccattgtt

SEQ ID NO: 41721 - DNA, 35 bp, Artificial Sequence
  Synthetic oligonucleotide
gacatcgcattgctgccttttaaattttctctttt

SEQ ID NO: 41722 - DNA, 35 bp, Artificial Sequence
  Synthetic oligonucleotide
ttgccctgtaagtgcgatcccctaggccatttttt

SEQ ID NO: 41723 - DNA, 35 bp, Artificial Sequence
  Synthetic oligonucleotide
gcacctcctgcgctgcccgttccttccccgtttaa

SEQ ID NO: 41724 - DNA, 36 bp, Artificial Sequence
  Synthetic oligonucleotide
atcaccagagagctaacgtcacgcggaatttcacca

SEQ ID NO: 41725 - DNA, 35 bp, Artificial Sequence
  Synthetic oligonucleotide
tctgacgccccgcattatctgctccctggccccca

SEQ ID NO: 41726 - DNA, 36 bp, Artificial Sequence
  Synthetic oligonucleotide
atcggcaacaggcctgtttcctgttctattctccca

SEQ ID NO: 41727 - DNA, 35 bp, Artificial Sequence
  Synthetic oligonucleotide
gttccgtgacacatccgcctcctatgattgttcca

SEQ ID NO: 41728 - DNA, 36 bp, Artificial Sequence
  Synthetic oligonucleotide
tgatcgaactgttgcgtatgctgcccatcctctgca

SEQ ID NO: 41729 - DNA, 37 bp, Artificial Sequence
  Synthetic oligonucleotide
accatttcactccagccgccacacagtttgcccaaga

SEQ ID NO: 41730 - DNA, 37 bp, Artificial Sequence
  Synthetic oligonucleotide
accccacacctgctttgctttcagttagaactgaaga

SEQ ID NO: 41731 - DNA, 37 bp, Artificial Sequence
  Synthetic oligonucleotide
tcctggccgccaccgactgcacttttctagtttgaga

SEQ ID NO: 41732 - DNA, 37 bp, Artificial Sequence
  Synthetic oligonucleotide
tccctctacccgagcttaattccaggacgttatacga

SEQ ID NO: 41733 - DNA, 36 bp, Artificial Sequence
  Synthetic oligonucleotide
ttcacacacttcactgtaacagctcgccacctacga

SEQ ID NO: 41734 - DNA, 36 bp, Artificial Sequence
  Synthetic oligonucleotide
tgagcgcagactccccgctttcctagagtccaccga

SEQ ID NO: 41735 - DNA, 37 bp, Artificial Sequence
  Synthetic oligonucleotide
gagaggcgtgcatagggcttagaccggaggggaggga

SEQ ID NO: 41736 - DNA, 38 bp, Artificial Sequence
  Synthetic oligonucleotide
tgcggaggggtgaagttaggtaggggctggctacgtga

SEQ ID NO: 41737 - DNA, 38 bp, Artificial Sequence
  Synthetic oligonucleotide
gcacaacctcggttttaatgccttccttccttgtgtga

SEQ ID NO: 41738 - DNA, 38 bp, Artificial Sequence
  Synthetic oligonucleotide
gacaactcccgcgacgtggctcacacactataacttga

SEQ ID NO: 41739 - DNA, 37 bp, Artificial Sequence
  Synthetic oligonucleotide
acccaccccccaacttcccgtgttgtcgctcccttga

SEQ ID NO: 41740 - DNA, 38 bp, Artificial Sequence
  Synthetic oligonucleotide
tgccaccatcatattttggatgctcccgctctccttga

SEQ ID NO: 41741 - DNA, 38 bp, Artificial Sequence
  Synthetic oligonucleotide
acactggcccactgtaccccgccacagacatctgttga

SEQ ID NO: 41742 - DNA, 36 bp, Artificial Sequence
  Synthetic oligonucleotide
ttcatcccaccaaacccccgcacgcgtcgaacccta

SEQ ID NO: 41743 - DNA, 35 bp, Artificial Sequence
  Synthetic oligonucleotide
tcgcacacaccaccgagctgctccatctgccccta

SEQ ID NO: 41744 - DNA, 36 bp, Artificial Sequence
  Synthetic oligonucleotide
tgagacaagcgcatcaagtccgctccacgagccacc

SEQ ID NO: 41745 - DNA, 35 bp, Artificial Sequence
  Synthetic oligonucleotide
tctgacggctcccgcgcctagaccgtacaccgccc

SEQ ID NO: 41746 - DNA, 35 bp, Artificial Sequence
  Synthetic oligonucleotide
tgacatcgcacgagagcatgcatcaatgggctccc

SEQ ID NO: 41747 - DNA, 35 bp, Artificial Sequence
  Synthetic oligonucleotide
acggacgccacagccccctatgttttttgtttgcc

SEQ ID NO: 41748 - DNA, 35 bp, Artificial Sequence
  Synthetic oligonucleotide
tgagcgccaattcgctcgcaatgagtttcccatcc

SEQ ID NO: 41749 - DNA, 35 bp, Artificial Sequence
  Synthetic oligonucleotide
gccatccgagcgcagtataaaaccgctcacattgc

SEQ ID NO: 41750 - DNA, 35 bp, Artificial Sequence
  Synthetic oligonucleotide
aaatcgcgcagtatcccggttctgtattctctagg

SEQ ID NO: 41751 - DNA, 35 bp, Artificial Sequence
  Synthetic oligonucleotide
gtgcttgtgcgcgtacattccccgtcctaccccgg

SEQ ID NO: 41752 - DNA, 35 bp, Artificial Sequence
  Synthetic oligonucleotide
gagaagcccttaccgctggccatggatcgacctat

SEQ ID NO: 41753 - DNA, 35 bp, Artificial Sequence
  Synthetic oligonucleotide
accctaggtgctgtcacgctccgttccatgaatct

SEQ ID NO: 41754 - DNA, 35 bp, Artificial Sequence
  Synthetic oligonucleotide
ttcgacaggtcctttgcgtcacctcggctcactct

SEQ ID NO: 41755 - DNA, 35 bp, Artificial Sequence
  Synthetic oligonucleotide
atacctggtcaaatacgttacgtagtcgctctctt

SEQ ID NO: 41756 - DNA, 35 bp, Artificial Sequence
  Synthetic oligonucleotide
ggtccatccggctacattaacctcggcacccattt

SEQ ID NO: 41757 - DNA, 36 bp, Artificial Sequence
  Synthetic oligonucleotide
tgccaatcttcactgtgcgtttatcttaccacccaa

SEQ ID NO: 41758 - DNA, 36 bp, Artificial Sequence
  Synthetic oligonucleotide
tcactacacgcatcattcccactccgctctcgtcaa

SEQ ID NO: 41759 - DNA, 36 bp, Artificial Sequence
  Synthetic oligonucleotide
tgtcgccgccatcctcactatctttccccggtcaca

SEQ ID NO: 41760 - DNA, 36 bp, Artificial Sequence
  Synthetic oligonucleotide
gtctaccaaatgggcaattgtgcctaccccacgcca

SEQ ID NO: 41761 - DNA, 36 bp, Artificial Sequence
  Synthetic oligonucleotide
aatcaccaaccccgccttcaaaccgaggccttgcca

SEQ ID NO: 41762 - DNA, 37 bp, Artificial Sequence
  Synthetic oligonucleotide
gacctgaatgagctcgggtggggtggctgaggggaga

SEQ ID NO: 41763 - DNA, 36 bp, Artificial Sequence
  Synthetic oligonucleotide
atacgacagggggatgggacggggcgtagtggcgga

SEQ ID NO: 41764 - DNA, 37 bp, Artificial Sequence
  Synthetic oligonucleotide
tgtagatgagaggtaggaaggggtcggcgtgaaggga

SEQ ID NO: 41765 - DNA, 37 bp, Artificial Sequence
  Synthetic oligonucleotide
gttcacgctagttccatctccactcgtccctcgtgga

SEQ ID NO: 41766 - DNA, 37 bp, Artificial Sequence
  Synthetic oligonucleotide
gctgtctccagacctctacctgctacttgctcttgga

SEQ ID NO: 41767 - DNA, 38 bp, Artificial Sequence
  Synthetic oligonucleotide
tgcacctcacccctgcatcctgtatactgccccaatga

SEQ ID NO: 41768 - DNA, 38 bp, Artificial Sequence
  Synthetic oligonucleotide
gagcagtgcgcattgtaaaccccctccgtcccacatga

SEQ ID NO: 41769 - DNA, 38 bp, Artificial Sequence
  Synthetic oligonucleotide
attgcggatcacccgtgccccgctacattccaccatga

SEQ ID NO: 41770 - DNA, 38 bp, Artificial Sequence
  Synthetic oligonucleotide
agcctgccactccgggattctgctacaccagcttatga

SEQ ID NO: 41771 - DNA, 38 bp, Artificial Sequence
  Synthetic oligonucleotide
gccccccgtatgtacgccctaatatccaaactgcctga

SEQ ID NO: 41772 - DNA, 38 bp, Artificial Sequence
  Synthetic oligonucleotide
gatgcataccatcattgtccactcgttactgctcctga

SEQ ID NO: 41773 - DNA, 38 bp, Artificial Sequence
  Synthetic oligonucleotide
gtggcacccctgtgtgccttattgcgtgccatctttga

SEQ ID NO: 41774 - DNA, 35 bp, Artificial Sequence
  Synthetic oligonucleotide
gttgactttgggccccgatagaacctattctttga

SEQ ID NO: 41775 - DNA, 35 bp, Artificial Sequence
  Synthetic oligonucleotide
ttcacgtgtccatctcgtccatggggttccacata

SEQ ID NO: 41776 - DNA, 35 bp, Artificial Sequence
  Synthetic oligonucleotide
agctccccaagccgatataggccaccgcctaggta

SEQ ID NO: 41777 - DNA, 35 bp, Artificial Sequence
  Synthetic oligonucleotide
tttcgaccgccacacattttcccacatagctgtac

SEQ ID NO: 41778 - DNA, 35 bp, Artificial Sequence
  Synthetic oligonucleotide
gattggtacacctctcttgatatatgctcacaacc

SEQ ID NO: 41779 - DNA, 35 bp, Artificial Sequence
  Synthetic oligonucleotide
tgtgattgccccgggctgcgcatcatacctgtccc

SEQ ID NO: 41780 - DNA, 35 bp, Artificial Sequence
  Synthetic oligonucleotide
gaccatatgctggacgacctactgacctctcatgc

SEQ ID NO: 41781 - DNA, 35 bp, Artificial Sequence
  Synthetic oligonucleotide
acgtgcctcgtagccaccattctcgacaacacctc

SEQ ID NO: 41782 - DNA, 35 bp, Artificial Sequence
  Synthetic oligonucleotide
actgggatggggtacggggtggataggaccaggcg

SEQ ID NO: 41783 - DNA, 35 bp, Artificial Sequence
  Synthetic oligonucleotide
agaccccgacatacacctcaagtattaatcttgcg

SEQ ID NO: 41784 - DNA, 35 bp, Artificial Sequence
  Synthetic oligonucleotide
tccaagcggtcattgctgccccccgtataatctcg

SEQ ID NO: 41785 - DNA, 35 bp, Artificial Sequence
  Synthetic oligonucleotide
gttcgcccaggtgaccccaatttgtccactccagg

SEQ ID NO: 41786 - DNA, 35 bp, Artificial Sequence
  Synthetic oligonucleotide
gggggttcgagagggtgggtgatcggggctatgtg

SEQ ID NO: 41787 - DNA, 35 bp, Artificial Sequence
  Synthetic oligonucleotide
gatgcggaacaggggggcatctaggaataagcaat

SEQ ID NO: 41788 - DNA, 35 bp, Artificial Sequence
  Synthetic oligonucleotide
actcctgccatcacacatcctgcttagcgaacagt

SEQ ID NO: 41789 - DNA, 35 bp, Artificial Sequence
  Synthetic oligonucleotide
tcataccgtagtgctcgtgttgttactcctccgtt

SEQ ID NO: 41790 - DNA, 35 bp, Artificial Sequence
  Synthetic oligonucleotide
ggtgcaccatactgctacttttccaggacgttttt

SEQ ID NO: 41791 - DNA, 35 bp, Artificial Sequence
  Synthetic oligonucleotide
aacgggtgttacgggggggaggaaacgggtctcaa

SEQ ID NO: 41792 - DNA, 35 bp, Artificial Sequence
  Synthetic oligonucleotide
atctcatccacgtacctcagggctcgaacgagcca

SEQ ID NO: 41793 - DNA, 36 bp, Artificial Sequence
  Synthetic oligonucleotide
tccacgtagacaagtgacgggggagagggtagagca

SEQ ID NO: 41794 - DNA, 36 bp, Artificial Sequence
  Synthetic oligonucleotide
tcaatagcccatccctcttacatcagaacagtggca

SEQ ID NO: 41795 - DNA, 36 bp, Artificial Sequence
  Synthetic oligonucleotide
accgtctccaggcgcctctaacattgcagtccatca

SEQ ID NO: 41796 - DNA, 36 bp, Artificial Sequence
  Synthetic oligonucleotide
gacaccatcattggtcgcctaagttctattccttca

SEQ ID NO: 41797 - DNA, 37 bp, Artificial Sequence
  Synthetic oligonucleotide
gcagtgctggggaaggcagaaagggcgtgctcaaaga

SEQ ID NO: 41798 - DNA, 37 bp, Artificial Sequence
  Synthetic oligonucleotide
actgccccggccctcgtgcaactttcactactgaaga

SEQ ID NO: 41799 - DNA, 37 bp, Artificial Sequence
  Synthetic oligonucleotide
gcatgagctcaaagtaggcgaacagggacagagacga

SEQ ID NO: 41800 - DNA, 37 bp, Artificial Sequence
  Synthetic oligonucleotide
tccccatatcacgtaatcgcctcgccacaactgacga

SEQ ID NO: 41801 - DNA, 36 bp, Artificial Sequence
  Synthetic oligonucleotide
aggaccagcccacacacgccgcaatgatctagccga

SEQ ID NO: 41802 - DNA, 36 bp, Artificial Sequence
  Synthetic oligonucleotide
tgagccactccgcacttggatccgtgttgtaacgga

SEQ ID NO: 41803 - DNA, 37 bp, Artificial Sequence
  Synthetic oligonucleotide
tcaggggggggtgagtcatactgaggctacggtggga

SEQ ID NO: 41804 - DNA, 36 bp, Artificial Sequence
  Synthetic oligonucleotide
gtacggggggagccgtagggagaatgcgatggtgga

SEQ ID NO: 41805 - DNA, 38 bp, Artificial Sequence
  Synthetic oligonucleotide
atgagccctggacccgctttcaagtaccttctgcctga

SEQ ID NO: 41806 - DNA, 38 bp, Artificial Sequence
  Synthetic oligonucleotide
gcgcgtttcgatctgctttgtctattttccgtctctga

SEQ ID NO: 41807 - DNA, 38 bp, Artificial Sequence
  Synthetic oligonucleotide
gttgagtacgggaagactaaagaaaaggatcgacgtga

SEQ ID NO: 41808 - DNA, 38 bp, Artificial Sequence
  Synthetic oligonucleotide
tgaaacgcaattcagtttccagcccctcccgctcgtga

SEQ ID NO: 41809 - DNA, 35 bp, Artificial Sequence
  Synthetic oligonucleotide
ttgaaacacgtcctggcctcccaatgataacttga

SEQ ID NO: 41810 - DNA, 38 bp, Artificial Sequence
  Synthetic oligonucleotide
acagcctcattgcattcaacccacgtgacgacccttga

SEQ ID NO: 41811 - DNA, 38 bp, Artificial Sequence
  Synthetic oligonucleotide
tcagacccactttaatgtagcaatccgcccgcccttga

SEQ ID NO: 41812 - DNA, 36 bp, Artificial Sequence
  Synthetic oligonucleotide
gaagcatagaccccgttccgcccccgctaggctcta

SEQ ID NO: 41813 - DNA, 36 bp, Artificial Sequence
  Synthetic oligonucleotide
agcgatcccacgctccacgggccataccccttcgta

SEQ ID NO: 41814 - DNA, 36 bp, Artificial Sequence
  Synthetic oligonucleotide
agaggtgctgggggggaaagggaggatccggtgtta

SEQ ID NO: 41815 - DNA, 35 bp, Artificial Sequence
  Synthetic oligonucleotide
aagtctcccgctagcccgctctaaccacagtcaac

SEQ ID NO: 41816 - DNA, 35 bp, Artificial Sequence
  Synthetic oligonucleotide
agtgtacgcacattaggaacatctcagctcaccac

SEQ ID NO: 41817 - DNA, 35 bp, Artificial Sequence
  Synthetic oligonucleotide
tcccacaatcatcgtcgcctatgcatgttacatac

SEQ ID NO: 41818 - DNA, 35 bp, Artificial Sequence
  Synthetic oligonucleotide
aaccaaccgaacgcaggggcttcatcggccactac

SEQ ID NO: 41819 - DNA, 35 bp, Artificial Sequence
  Synthetic oligonucleotide
tcacgggcacatcatcgactgaactgctgctactc

SEQ ID NO: 41820 - DNA, 35 bp, Artificial Sequence
  Synthetic oligonucleotide
atgcgctcttatgcggtggcgcacatactattctc

SEQ ID NO: 41821 - DNA, 35 bp, Artificial Sequence
  Synthetic oligonucleotide
ttcccccgcttagcatttaccccgccataatggtc

SEQ ID NO: 41822 - DNA, 35 bp, Artificial Sequence
  Synthetic oligonucleotide
actcctaccctctcgtggtatctcgcgaatacacg

SEQ ID NO: 41823 - DNA, 35 bp, Artificial Sequence
  Synthetic oligonucleotide
aacggtgacacctcgatctcgtttagctactctcg

SEQ ID NO: 41824 - DNA, 33 bp, Artificial Sequence
  Synthetic oligonucleotide
gtgtgaaaaagcctgtaccctgcaaccccttcg

SEQ ID NO: 41825 - DNA, 35 bp, Artificial Sequence
  Synthetic oligonucleotide
gcccccttccgccttttttgtttggcccacgaatg

SEQ ID NO: 41826 - DNA, 35 bp, Artificial Sequence
  Synthetic oligonucleotide
acgcgatgactcggaacctagctatccctctgcat

SEQ ID NO: 41827 - DNA, 35 bp, Artificial Sequence
  Synthetic oligonucleotide
attcctacgtcacccggtgggtcgccgacctccct

SEQ ID NO: 41828 - DNA, 35 bp, Artificial Sequence
  Synthetic oligonucleotide
tccctgtggcctcccataaacgtcaccttgcttct

SEQ ID NO: 41829 - DNA, 35 bp, Artificial Sequence
  Synthetic oligonucleotide
tgataggggggatacacaagaaaggtaggcggagt

SEQ ID NO: 41830 - DNA, 35 bp, Artificial Sequence
  Synthetic oligonucleotide
acgcgggtggtgagttcgcgggtgggccacattgt

SEQ ID NO: 41831 - DNA, 35 bp, Artificial Sequence
  Synthetic oligonucleotide
gaacaccgccattctgcctatcattgtctgacaca

SEQ ID NO: 41832 - DNA, 36 bp, Artificial Sequence
  Synthetic oligonucleotide
tcacactcgcggtttgagtcaactcatgcgattcca

SEQ ID NO: 41833 - DNA, 36 bp, Artificial Sequence
  Synthetic oligonucleotide
agcgcgcacgggtggttcctcttctggttttcgtca

SEQ ID NO: 41834 - DNA, 35 bp, Artificial Sequence
  Synthetic oligonucleotide
tccacgatgccaaatccattacgtgcgagttttca

SEQ ID NO: 41835 - DNA, 37 bp, Artificial Sequence
  Synthetic oligonucleotide
tgcgcaacacccggctctgctattccgccctgctaga

SEQ ID NO: 41836 - DNA, 38 bp, Artificial Sequence
  Synthetic oligonucleotide
tcaggaccggagggaattggagcactacaaggacacga

SEQ ID NO: 41837 - DNA, 37 bp, Artificial Sequence
  Synthetic oligonucleotide
acgccccacagtatcttctcagtgcgctaattctcga

SEQ ID NO: 41838 - DNA, 35 bp, Artificial Sequence
  Synthetic oligonucleotide
tcaacaacaccacaccaccctttagacgttttcga

SEQ ID NO: 41839 - DNA, 37 bp, Artificial Sequence
  Synthetic oligonucleotide
tcataccacctcaccgtgctcatgcatcccgaaggga

SEQ ID NO: 41840 - DNA, 37 bp, Artificial Sequence
  Synthetic oligonucleotide
agtggtgtgtggggtggcaaaagtatggtttggggga

SEQ ID NO: 41841 - DNA, 37 bp, Artificial Sequence
  Synthetic oligonucleotide
gatgagaatacaaaggtgcgtaggtgcggtgtgggga

SEQ ID NO: 41842 - DNA, 37 bp, Artificial Sequence
  Synthetic oligonucleotide
tgctatccagccctattcgacacctggctttttatga

SEQ ID NO: 41843 - DNA, 37 bp, Artificial Sequence
  Synthetic oligonucleotide
tgtgattgccccgaatcgtgcgttacccttctcctga

SEQ ID NO: 41844 - DNA, 38 bp, Artificial Sequence
  Synthetic oligonucleotide
tcatccccagttccaccaagcacagtctaggaacgtga

SEQ ID NO: 41845 - DNA, 37 bp, Artificial Sequence
  Synthetic oligonucleotide
accgcctatcggtcctttattgcattactctcggtga

SEQ ID NO: 41846 - DNA, 36 bp, Artificial Sequence
  Synthetic oligonucleotide
gggtgaagtccggagggaacgggtgcaagagggtga

SEQ ID NO: 41847 - DNA, 38 bp, Artificial Sequence
  Synthetic oligonucleotide
gcaggaatgagggtgtggtgaggagtgttagcgtgtga

SEQ ID NO: 41848 - DNA, 37 bp, Artificial Sequence
  Synthetic oligonucleotide
gtacctccacgaggcgtatttttccccttcaacttga

SEQ ID NO: 41849 - DNA, 36 bp, Artificial Sequence
  Synthetic oligonucleotide
gtctctgccctccgtccgcatatccctgcggcacta

SEQ ID NO: 41850 - DNA, 36 bp, Artificial Sequence
  Synthetic oligonucleotide
tacacccaagcggttcgctgcctgttttcaactcta

SEQ ID NO: 41851 - DNA, 36 bp, Artificial Sequence
  Synthetic oligonucleotide
tcatgcccccagtttcctattactaccttccaggta

SEQ ID NO: 41852 - DNA, 35 bp, Artificial Sequence
  Synthetic oligonucleotide
aagtcgtgggtgggtaagtacatgggaaaggggta

SEQ ID NO: 41853 - DNA, 35 bp, Artificial Sequence
  Synthetic oligonucleotide
acctaacgtgtgccttgccgcagccctataccacc

SEQ ID NO: 41854 - DNA, 35 bp, Artificial Sequence
  Synthetic oligonucleotide
ccaacctgccctatcgaagcttgatacctcacgcc

SEQ ID NO: 41855 - DNA, 35 bp, Artificial Sequence
  Synthetic oligonucleotide
atgtgagtgaccagcgccctttatcgtttaccatc

SEQ ID NO: 41856 - DNA, 35 bp, Artificial Sequence
  Synthetic oligonucleotide
gcccccttaggtggactagcgattgtcacgccttc

SEQ ID NO: 41857 - DNA, 35 bp, Artificial Sequence
  Synthetic oligonucleotide
tcatccaccactctccacggctcgatgtgtcggag

SEQ ID NO: 41858 - DNA, 35 bp, Artificial Sequence
  Synthetic oligonucleotide
gtggggggggaggggcatacaagtcatagaggggg

SEQ ID NO: 41859 - DNA, 35 bp, Artificial Sequence
  Synthetic oligonucleotide
acgactttcacacgcgtggactctcctgttcgcct

SEQ ID NO: 41860 - DNA, 35 bp, Artificial Sequence
  Synthetic oligonucleotide
gtcaatgctgaacccaccgatggcctcagtcttct

SEQ ID NO: 41861 - DNA, 35 bp, Artificial Sequence
  Synthetic oligonucleotide
aatttgcacatggcaatgttctgtactctctttct

SEQ ID NO: 41862 - DNA, 35 bp, Artificial Sequence
  Synthetic oligonucleotide
tgacagactcagatacaccgctctcgccctccagt

SEQ ID NO: 41863 - DNA, 35 bp, Artificial Sequence
  Synthetic oligonucleotide
tcccccctgtcctacctttgactctttccccgaaa

SEQ ID NO: 41864 - DNA, 36 bp, Artificial Sequence
  Synthetic oligonucleotide
acaagcgctgaccttcgtccctgtctttccaccgaa

SEQ ID NO: 41865 - DNA, 36 bp, Artificial Sequence
  Synthetic oligonucleotide
gcacggcctatactaatgacccaccatcctcctgaa

SEQ ID NO: 41866 - DNA, 35 bp, Artificial Sequence
  Synthetic oligonucleotide
ggtaacccgcaaatggcatcgtactgcgcatcaca

SEQ ID NO: 41867 - DNA, 35 bp, Artificial Sequence
  Synthetic oligonucleotide
gttcgaccacattagctcccctttcgtgctgtaca

SEQ ID NO: 41868 - DNA, 36 bp, Artificial Sequence
  Synthetic oligonucleotide
tgtgtccagttccacatgcgcctcccgctttttcca

SEQ ID NO: 41869 - DNA, 37 bp, Artificial Sequence
  Synthetic oligonucleotide
gaactgtgaggataaagtgggaaaaatgataggcaga

SEQ ID NO: 41870 - DNA, 36 bp, Artificial Sequence
  Synthetic oligonucleotide
ttcacaatcagtccccagcgaccagcggttcataga

SEQ ID NO: 41871 - DNA, 37 bp, Artificial Sequence
  Synthetic oligonucleotide
tacaccgtcccctggtttcgcccccactaactttaga

SEQ ID NO: 41872 - DNA, 37 bp, Artificial Sequence
  Synthetic oligonucleotide
gctcttcgccctcacataataccgtcccagccaacga

SEQ ID NO: 41873 - DNA, 37 bp, Artificial Sequence
  Synthetic oligonucleotide
agtgcgagctcacccccattgcgtacatgtacaccga

SEQ ID NO: 41874 - DNA, 37 bp, Artificial Sequence
  Synthetic oligonucleotide
gatggctgggcctgcctctgtgcttctatctcgccga

SEQ ID NO: 41875 - DNA, 38 bp, Artificial Sequence
  Synthetic oligonucleotide
gggggcgatagtggtgctaggaaataggggtggaatga

SEQ ID NO: 41876 - DNA, 35 bp, Artificial Sequence
  Synthetic oligonucleotide
gctcgggtgattgggagggagggaacagaccatga

SEQ ID NO: 41877 - DNA, 36 bp, Artificial Sequence
  Synthetic oligonucleotide
tacaactcgccccatcggaccccacgccctgcctga

SEQ ID NO: 41878 - DNA, 38 bp, Artificial Sequence
  Synthetic oligonucleotide
gtagccgaggcttctgcacgttctttctccctgcctga

SEQ ID NO: 41879 - DNA, 38 bp, Artificial Sequence
  Synthetic oligonucleotide
acccatgtagagtcagtgggggaggggtgttggggtga

SEQ ID NO: 41880 - DNA, 36 bp, Artificial Sequence
  Synthetic oligonucleotide
aatcaggcggagagacgcggaggtagaaggtggtga

SEQ ID NO: 41881 - DNA, 35 bp, Artificial Sequence
  Synthetic oligonucleotide
ggtgtgggcatgtggtagggaagggcggaactgta

SEQ ID NO: 41882 - DNA, 35 bp, Artificial Sequence
  Synthetic oligonucleotide
gccgaaacgtccaagtcgtcctgccaatgacctac

SEQ ID NO: 41883 - DNA, 35 bp, Artificial Sequence
  Synthetic oligonucleotide
tctgccgaaacgtttcaagtccccgcaccttaggc

SEQ ID NO: 41884 - DNA, 35 bp, Artificial Sequence
  Synthetic oligonucleotide
gtcattctacccccgtttggaacaatgcccactgc

SEQ ID NO: 41885 - DNA, 35 bp, Artificial Sequence
  Synthetic oligonucleotide
tgggggggaagtagcaaatttcaaagtaggaggtc

SEQ ID NO: 41886 - DNA, 35 bp, Artificial Sequence
  Synthetic oligonucleotide
accgactcccccttattaaacagagcctcttggtc

SEQ ID NO: 41887 - DNA, 35 bp, Artificial Sequence
  Synthetic oligonucleotide
gacctggacaccgtcaacacacctagccctttgcg

SEQ ID NO: 41888 - DNA, 35 bp, Artificial Sequence
  Synthetic oligonucleotide
atgattgcaccctccgcctcctcacttccacacgg

SEQ ID NO: 41889 - DNA, 35 bp, Artificial Sequence
  Synthetic oligonucleotide
gaccgacctacacggccctttcagtattcttctgg

SEQ ID NO: 41890 - DNA, 35 bp, Artificial Sequence
  Synthetic oligonucleotide
gtaagtgcaggaagtaagtttagggggtaggggtg

SEQ ID NO: 41891 - DNA, 35 bp, Artificial Sequence
  Synthetic oligonucleotide
accattgtcagtagtttacctcccctgctgcgaat

SEQ ID NO: 41892 - DNA, 35 bp, Artificial Sequence
  Synthetic oligonucleotide
gttgcctcccgcgaggccacacgccacaataatct

SEQ ID NO: 41893 - DNA, 35 bp, Artificial Sequence
  Synthetic oligonucleotide
atcgcctataaacatgcgcatagactcaagcctct

SEQ ID NO: 41894 - DNA, 35 bp, Artificial Sequence
  Synthetic oligonucleotide
tctcacccgcccaccacttttaataaacccgaagt

SEQ ID NO: 41895 - DNA, 35 bp, Artificial Sequence
  Synthetic oligonucleotide
acagacgacggggagaacggttcataaacgggggt

SEQ ID NO: 41896 - DNA, 35 bp, Artificial Sequence
  Synthetic oligonucleotide
agtggtggtgagggctatcataggggtggtaactt

SEQ ID NO: 41897 - DNA, 35 bp, Artificial Sequence
  Synthetic oligonucleotide
tcacggtcccctctatgccgcatgccgttccgtaa

SEQ ID NO: 41898 - DNA, 36 bp, Artificial Sequence
  Synthetic oligonucleotide
ttgaaggacggggtgacgggggcggtcgcgtgttaa

SEQ ID NO: 41899 - DNA, 37 bp, Artificial Sequence
  Synthetic oligonucleotide
acttcccgacccaagccttaccccttgtcgagcccga

SEQ ID NO: 41900 - DNA, 37 bp, Artificial Sequence
  Synthetic oligonucleotide
ttagtccggctccctcccttctttccttgagacgcga

SEQ ID NO: 41901 - DNA, 37 bp, Artificial Sequence
  Synthetic oligonucleotide
gatgcgcaagttatgtccaatgacccctcaccatcga

SEQ ID NO: 41902 - DNA, 37 bp, Artificial Sequence
  Synthetic oligonucleotide
gagccctcaagcagacgtgcttttccctgctcttcga

SEQ ID NO: 41903 - DNA, 37 bp, Artificial Sequence
  Synthetic oligonucleotide
gtgacgccaaaactccccgactggtaccttcgccgga

SEQ ID NO: 41904 - DNA, 37 bp, Artificial Sequence
  Synthetic oligonucleotide
tcaacacgccagcccccccgtaagctcgcactgcgga

SEQ ID NO: 41905 - DNA, 37 bp, Artificial Sequence
  Synthetic oligonucleotide
tacgctccgacccacacccgcgcctggcttgactgga

SEQ ID NO: 41906 - DNA, 38 bp, Artificial Sequence
  Synthetic oligonucleotide
ggagcatagaaacgtaaatgggggaaggaaggggtgga

SEQ ID NO: 41907 - DNA, 38 bp, Artificial Sequence
  Synthetic oligonucleotide
atccagaccagtgtccacgcccgtcctcagaaacctga

SEQ ID NO: 41908 - DNA, 38 bp, Artificial Sequence
  Synthetic oligonucleotide
gtgggagagcaggggagacaaagatcgggtaacagtga

SEQ ID NO: 41909 - DNA, 38 bp, Artificial Sequence
  Synthetic oligonucleotide
ggacgaaagggatgaccgtggagtgacgggaaaggtga

SEQ ID NO: 41910 - DNA, 38 bp, Artificial Sequence
  Synthetic oligonucleotide
tggacccgtacctcgtgcacccatatccgatccattga

SEQ ID NO: 41911 - DNA, 37 bp, Artificial Sequence
  Synthetic oligonucleotide
gtctcccgcccccgctttttactgagctagcatttga

SEQ ID NO: 41912 - DNA, 35 bp, Artificial Sequence
  Synthetic oligonucleotide
tagggctcgcaccactttctttcccgcgcacgaac

SEQ ID NO: 41913 - DNA, 35 bp, Artificial Sequence
  Synthetic oligonucleotide
acccccctacctcacaggagaacattaggagtaac

SEQ ID NO: 41914 - DNA, 35 bp, Artificial Sequence
  Synthetic oligonucleotide
accaaccatgagacctcggtgctcattactttccc

SEQ ID NO: 41915 - DNA, 35 bp, Artificial Sequence
  Synthetic oligonucleotide
acattccgccctgtgacaagtcgttgcccccggcc

SEQ ID NO: 41916 - DNA, 35 bp, Artificial Sequence
  Synthetic oligonucleotide
aactagcgcacacttagctgctttggtggccactc

SEQ ID NO: 41917 - DNA, 35 bp, Artificial Sequence
  Synthetic oligonucleotide
ttaatccatcgtatcaacaccagtccctcgtagtc

SEQ ID NO: 41918 - DNA, 35 bp, Artificial Sequence
  Synthetic oligonucleotide
tgtgtcgtccgacttcccgtttgctatgtcaacag

SEQ ID NO: 41919 - DNA, 35 bp, Artificial Sequence
  Synthetic oligonucleotide
gattcagcctctcattggagttcatttctattccg

SEQ ID NO: 41920 - DNA, 35 bp, Artificial Sequence
  Synthetic oligonucleotide
tgattcatcgcattcctcctccaaggccctgtgcg

SEQ ID NO: 41921 - DNA, 35 bp, Artificial Sequence
  Synthetic oligonucleotide
tcaatgctccacctcacaaccgtggtacccactcg

SEQ ID NO: 41922 - DNA, 35 bp, Artificial Sequence
  Synthetic oligonucleotide
tcaaagggcccactacgttccgctacaatagcctg

SEQ ID NO: 41923 - DNA, 35 bp, Artificial Sequence
  Synthetic oligonucleotide
actgtcgcggtcctaccccagcctacaacatcaat

SEQ ID NO: 41924 - DNA, 35 bp, Artificial Sequence
  Synthetic oligonucleotide
gccatgttcgatacccttaacgcacttcaccccct

SEQ ID NO: 41925 - DNA, 34 bp, Artificial Sequence
  Synthetic oligonucleotide
atcccgggcatcctcgtagctgcaccactaactt

SEQ ID NO: 41926 - DNA, 35 bp, Artificial Sequence
  Synthetic oligonucleotide
agagcgggtctgcgtacttctacctcattgttctt

SEQ ID NO: 41927 - DNA, 35 bp, Artificial Sequence
  Synthetic oligonucleotide
gtcgtacgctcagcgccatggaccatccgtacttt

SEQ ID NO: 41928 - DNA, 35 bp, Artificial Sequence
  Synthetic oligonucleotide
gtaccgaccaaacaccatcaaagtgcgcctcacaa

SEQ ID NO: 41929 - DNA, 36 bp, Artificial Sequence
  Synthetic oligonucleotide
tcgccacacaacttggaacatctcgagctactgcaa

SEQ ID NO: 41930 - DNA, 36 bp, Artificial Sequence
  Synthetic oligonucleotide
actcaccctcaatcctagcacgcccacatcttgcaa

SEQ ID NO: 41931 - DNA, 35 bp, Artificial Sequence
  Synthetic oligonucleotide
gccacgggtcggccgttttcttaagtccccgcgaa

SEQ ID NO: 41932 - DNA, 35 bp, Artificial Sequence
  Synthetic oligonucleotide
tagagcccgccggtcacgtccactgctttggtaca

SEQ ID NO: 41933 - DNA, 37 bp, Artificial Sequence
  Synthetic oligonucleotide
agtatcatgcaaaggaggaaggtgggactatcgacga

SEQ ID NO: 41934 - DNA, 36 bp, Artificial Sequence
  Synthetic oligonucleotide
accgatcagtcgggccttctttcgtcgaccccccga

SEQ ID NO: 41935 - DNA, 37 bp, Artificial Sequence
  Synthetic oligonucleotide
tcttcccccccatgaaacggaaacaccggtattccga

SEQ ID NO: 41936 - DNA, 35 bp, Artificial Sequence
  Synthetic oligonucleotide
gtgactccacgaccatcaccactaactaacggcga

SEQ ID NO: 41937 - DNA, 37 bp, Artificial Sequence
  Synthetic oligonucleotide
tccaccaacggacacctttcatcggaacatcctggga

SEQ ID NO: 41938 - DNA, 36 bp, Artificial Sequence
  Synthetic oligonucleotide
accgcccctccgtatttgccctgaaacttgtcctga

SEQ ID NO: 41939 - DNA, 37 bp, Artificial Sequence
  Synthetic oligonucleotide
acacaccttgaaccgtatagcactcatcaacctctga

SEQ ID NO: 41940 - DNA, 37 bp, Artificial Sequence
  Synthetic oligonucleotide
gatatcaccgcccgctacatccgtttttaatccgtga

SEQ ID NO: 41941 - DNA, 38 bp, Artificial Sequence
  Synthetic oligonucleotide
cctgccgcaagcaacacctatggcctgtttcaccttga

SEQ ID NO: 41942 - DNA, 38 bp, Artificial Sequence
  Synthetic oligonucleotide
gagagcacggtaagcaaaagggaatgagcagaagttga

SEQ ID NO: 41943 - DNA, 36 bp, Artificial Sequence
  Synthetic oligonucleotide
agcgagggagaagggtgggggagtgggcggatttta

SEQ ID NO: 41944 - DNA, 35 bp, Artificial Sequence
  Synthetic oligonucleotide
ttgaggctcgcacattttggctatttgtccttacc

SEQ ID NO: 41945 - DNA, 35 bp, Artificial Sequence
  Synthetic oligonucleotide
actcccatcttgatcgctttagccgtttttagccc

SEQ ID NO: 41946 - DNA, 35 bp, Artificial Sequence
  Synthetic oligonucleotide
tcccccgtaccccacctcacgtaaaacagtgagcc

SEQ ID NO: 41947 - DNA, 35 bp, Artificial Sequence
  Synthetic oligonucleotide
agcccaacatcgcccgtaccgagttgacctatgcc

SEQ ID NO: 41948 - DNA, 36 bp, Artificial Sequence
  Synthetic oligonucleotide
gggtccatctgtccgctctttaaccgagtctctgcc

SEQ ID NO: 41949 - DNA, 35 bp, Artificial Sequence
  Synthetic oligonucleotide
aacgcgatctcaccggcgttctccttggtatctcc

SEQ ID NO: 41950 - DNA, 35 bp, Artificial Sequence
  Synthetic oligonucleotide
ttcagcctctgcgcactgacacgcaggtctcttcc

SEQ ID NO: 41951 - DNA, 35 bp, Artificial Sequence
  Synthetic oligonucleotide
gaatgttcagcgtagtgtcatcgccccctctctgc

SEQ ID NO: 41952 - DNA, 35 bp, Artificial Sequence
  Synthetic oligonucleotide
gcaatccaccgtccagccacgctcctcctagcctc

SEQ ID NO: 41953 - DNA, 35 bp, Artificial Sequence
  Synthetic oligonucleotide
agttcgttccaactccgccttcctctaccgtttcg

SEQ ID NO: 41954 - DNA, 35 bp, Artificial Sequence
  Synthetic oligonucleotide
tagggaggaactggcaggggagagaatgggacatg

SEQ ID NO: 41955 - DNA, 35 bp, Artificial Sequence
  Synthetic oligonucleotide
gacgacccccgctttggtccttacactctcgtttg

SEQ ID NO: 41956 - DNA, 35 bp, Artificial Sequence
  Synthetic oligonucleotide
atcatctcccggcctctagcagccccatcgatcat

SEQ ID NO: 41957 - DNA, 35 bp, Artificial Sequence
  Synthetic oligonucleotide
gatcaccccgacgctgactccggtactacttcgat

SEQ ID NO: 41958 - DNA, 35 bp, Artificial Sequence
  Synthetic oligonucleotide
ttggtcacctcctcggccctttctgaacttgtcct

SEQ ID NO: 41959 - DNA, 35 bp, Artificial Sequence
  Synthetic oligonucleotide
acgctacagcagatcctcctacgagtcctcctgct

SEQ ID NO: 41960 - DNA, 35 bp, Artificial Sequence
  Synthetic oligonucleotide
gcccaccacccctcataacgatatgatcttacctt

SEQ ID NO: 41961 - DNA, 36 bp, Artificial Sequence
  Synthetic oligonucleotide
atgaaccccactcgccgcctggattagccccgccaa

SEQ ID NO: 41962 - DNA, 36 bp, Artificial Sequence
  Synthetic oligonucleotide
acacgtgctgctgcccagtgatggtaggtgatggaa

SEQ ID NO: 41963 - DNA, 35 bp, Artificial Sequence
  Synthetic oligonucleotide
tatggctacaaccgcctaaggccccccaccctgca

SEQ ID NO: 41964 - DNA, 37 bp, Artificial Sequence
  Synthetic oligonucleotide
gatggccaagaagggggggcactagggggttgacaga

SEQ ID NO: 41965 - DNA, 37 bp, Artificial Sequence
  Synthetic oligonucleotide
atcccccccgatcctcaagtgcagtactgcatccgga

SEQ ID NO: 41966 - DNA, 37 bp, Artificial Sequence
  Synthetic oligonucleotide
actgaggcgcggtatttagaatcggggaagggtggga

SEQ ID NO: 41967 - DNA, 37 bp, Artificial Sequence
  Synthetic oligonucleotide
actccccatcatctgcctttcgtcttcgacctctgga

SEQ ID NO: 41968 - DNA, 36 bp, Artificial Sequence
  Synthetic oligonucleotide
agactagggacgatccaggcataggggggggaacta

SEQ ID NO: 41969 - DNA, 36 bp, Artificial Sequence
  Synthetic oligonucleotide
agcccccgcagccggctccggccccactccacggta

SEQ ID NO: 41970 - DNA, 36 bp, Artificial Sequence
  Synthetic oligonucleotide
tcccgaggccgccgcgcacacccacaggactcgtta

SEQ ID NO: 41971 - DNA, 35 bp, Artificial Sequence
  Synthetic oligonucleotide
tgaattagggccctacctgctttgcctagtaacac

SEQ ID NO: 41972 - DNA, 35 bp, Artificial Sequence
  Synthetic oligonucleotide
acactgccttggggagcatatccaccctgttgcac

SEQ ID NO: 41973 - DNA, 35 bp, Artificial Sequence
  Synthetic oligonucleotide
atgcgatacaggccccttctccggtcttgcattac

SEQ ID NO: 41974 - DNA, 35 bp, Artificial Sequence
  Synthetic oligonucleotide
taccaatgagggtgccgcggccaacagaatatacc

SEQ ID NO: 41975 - DNA, 35 bp, Artificial Sequence
  Synthetic oligonucleotide
gtgcggagcatggattgctcatactgcgtactccc

SEQ ID NO: 41976 - DNA, 35 bp, Artificial Sequence
  Synthetic oligonucleotide
ggtcacctagaatcggtatccggccctatcctgcc

SEQ ID NO: 41977 - DNA, 35 bp, Artificial Sequence
  Synthetic oligonucleotide
gcaatcctccgtgtgtcaggtttgccacctattcc

SEQ ID NO: 41978 - DNA, 35 bp, Artificial Sequence
  Synthetic oligonucleotide
ggtgctagtggggtggaggagtgaggtatgtacag

SEQ ID NO: 41979 - DNA, 35 bp, Artificial Sequence
  Synthetic oligonucleotide
tcgaccacccgctagtgaccgatacattcatatcg

SEQ ID NO: 41980 - DNA, 35 bp, Artificial Sequence
  Synthetic oligonucleotide
ttcagctgcctcttcaccctagcgataaatcgaat

SEQ ID NO: 41981 - DNA, 35 bp, Artificial Sequence
  Synthetic oligonucleotide
tcacgtccccgctttccgtctgcttcgttttacat

SEQ ID NO: 41982 - DNA, 35 bp, Artificial Sequence
  Synthetic oligonucleotide
tttggactgcccacctgatctctacaactggtcct

SEQ ID NO: 41983 - DNA, 35 bp, Artificial Sequence
  Synthetic oligonucleotide
accgcaattccgtggtctgtccacgggttcccctt

SEQ ID NO: 41984 - DNA, 35 bp, Artificial Sequence
  Synthetic oligonucleotide
atagcccgggcaattcgtacaccaccaacatctaa

SEQ ID NO: 41985 - DNA, 35 bp, Artificial Sequence
  Synthetic oligonucleotide
aacaactatcgacggcaccccataccatggctaca

SEQ ID NO: 41986 - DNA, 36 bp, Artificial Sequence
  Synthetic oligonucleotide
tagtggctgccactgttccggttaccgtagcttcca

SEQ ID NO: 41987 - DNA, 36 bp, Artificial Sequence
  Synthetic oligonucleotide
agtccacacggcgaacatcactcacgctggtttcca

SEQ ID NO: 41988 - DNA, 36 bp, Artificial Sequence
  Synthetic oligonucleotide
tgaaaacaactgccccctgggtacgaacgcacatca

SEQ ID NO: 41989 - DNA, 37 bp, Artificial Sequence
  Synthetic oligonucleotide
gcgccctcccagactcggccttgtcttttcattgcga

SEQ ID NO: 41990 - DNA, 37 bp, Artificial Sequence
  Synthetic oligonucleotide
gagcggtgacgaggagactgggtgaggttggggggga

SEQ ID NO: 41991 - DNA, 37 bp, Artificial Sequence
  Synthetic oligonucleotide
gaaaggacggggggggaatctcgcagcataggactga

SEQ ID NO: 41992 - DNA, 36 bp, Artificial Sequence
  Synthetic oligonucleotide
tcaaccccacctgtattgcctggctctgccccctga

SEQ ID NO: 41993 - DNA, 38 bp, Artificial Sequence
  Synthetic oligonucleotide
taggtgcgggaggattgggaaaaaatgttcgaagctga

SEQ ID NO: 41994 - DNA, 37 bp, Artificial Sequence
  Synthetic oligonucleotide
agaccgccgatcccctggttcaagggccttcctctga

SEQ ID NO: 41995 - DNA, 36 bp, Artificial Sequence
  Synthetic oligonucleotide
gcctcgctcctgttcaaggaaccccacgttatctta

SEQ ID NO: 41996 - DNA, 35 bp, Artificial Sequence
  Synthetic oligonucleotide
attgaccgtcttcgtacttatgatcctgcccacac

SEQ ID NO: 41997 - DNA, 35 bp, Artificial Sequence
  Synthetic oligonucleotide
agcgggcgtagtcgtccccccacaatgtagtccac

SEQ ID NO: 41998 - DNA, 35 bp, Artificial Sequence
  Synthetic oligonucleotide
tccccggcccatgcaatcccgagctttcaatgcac

SEQ ID NO: 41999 - DNA, 35 bp, Artificial Sequence
  Synthetic oligonucleotide
tacaacattgttctttacctcgaccgaccgtgagc

SEQ ID NO: 42000 - DNA, 35 bp, Artificial Sequence
  Synthetic oligonucleotide
ttgactacccgttgaccttgagtcgtacataactc

SEQ ID NO: 42001 - DNA, 35 bp, Artificial Sequence
  Synthetic oligonucleotide
ttcccccctcaccgactgctactatggccacctag

SEQ ID NO: 42002 - DNA, 35 bp, Artificial Sequence
  Synthetic oligonucleotide
actagccagcctagtccataacttccctgctcaat

SEQ ID NO: 42003 - DNA, 35 bp, Artificial Sequence
  Synthetic oligonucleotide
atcctccccgtcgctccgtttgcactagcctgcat

SEQ ID NO: 42004 - DNA, 35 bp, Artificial Sequence
  Synthetic oligonucleotide
gtcgtggacacggcacctttgcaattgttacttct

SEQ ID NO: 42005 - DNA, 35 bp, Artificial Sequence
  Synthetic oligonucleotide
accgagctagtccacacactgttcctcgattttgt

SEQ ID NO: 42006 - DNA, 35 bp, Artificial Sequence
  Synthetic oligonucleotide
tgtgtcgtactccgcgttcttcagcgtgaccattt

SEQ ID NO: 42007 - DNA, 36 bp, Artificial Sequence
  Synthetic oligonucleotide
gcccgctcgcccgcggtggtccattaatcacttgaa

SEQ ID NO: 42008 - DNA, 35 bp, Artificial Sequence
  Synthetic oligonucleotide
tcaccataccctccgtatcttgtagttccaagtaa

SEQ ID NO: 42009 - DNA, 36 bp, Artificial Sequence
  Synthetic oligonucleotide
acattccccgaccccatatgagggtttgccctcaca

SEQ ID NO: 42010 - DNA, 35 bp, Artificial Sequence
  Synthetic oligonucleotide
tcatatcctccacgctggtcgacctttcggaacca

SEQ ID NO: 42011 - DNA, 36 bp, Artificial Sequence
  Synthetic oligonucleotide
ttcaactgccaacgcacctgacacttttgcgatcca

SEQ ID NO: 42012 - DNA, 36 bp, Artificial Sequence
  Synthetic oligonucleotide
ttgtcgaggaaaagggggagagtctagagctgggca

SEQ ID NO: 42013 - DNA, 35 bp, Artificial Sequence
  Synthetic oligonucleotide
gcgcaactcggctttttccccccggcacctattca

SEQ ID NO: 42014 - DNA, 35 bp, Artificial Sequence
  Synthetic oligonucleotide
gccaccctcacaaattcggtcggtctacttggaga

SEQ ID NO: 42015 - DNA, 37 bp, Artificial Sequence
  Synthetic oligonucleotide
ttggctgtgtacgtaggggggcgggaaaagggataga

SEQ ID NO: 42016 - DNA, 36 bp, Artificial Sequence
  Synthetic oligonucleotide
aatcgcaccccacacgactctacactacttggacga

SEQ ID NO: 42017 - DNA, 37 bp, Artificial Sequence
  Synthetic oligonucleotide
tcccacatccgccaacaatgaatcgcccccgatacga

SEQ ID NO: 42018 - DNA, 36 bp, Artificial Sequence
  Synthetic oligonucleotide
tgccgaacacgcggcaatcgatcgaccacccttcga

SEQ ID NO: 42019 - DNA, 36 bp, Artificial Sequence
  Synthetic oligonucleotide
tgtgacgcacacgggggcataggggtgatgcacgga

SEQ ID NO: 42020 - DNA, 37 bp, Artificial Sequence
  Synthetic oligonucleotide
gcgaaggcagtcgaggaaagaagaattggggagggga

SEQ ID NO: 42021 - DNA, 37 bp, Artificial Sequence
  Synthetic oligonucleotide
gagaagtcggaggaggaggttcacggatgacatggga

SEQ ID NO: 42022 - DNA, 37 bp, Artificial Sequence
  Synthetic oligonucleotide
acccacctagacacgcaataattagctcttccttgga

SEQ ID NO: 42023 - DNA, 38 bp, Artificial Sequence
  Synthetic oligonucleotide
tactccaccccagagcgcgtgagctcacgtcttaatga

SEQ ID NO: 42024 - DNA, 37 bp, Artificial Sequence
  Synthetic oligonucleotide
gcgaaaggggggagattgcacgtgggaatatttatga

SEQ ID NO: 42025 - DNA, 38 bp, Artificial Sequence
  Synthetic oligonucleotide
tagtactgccgtggtggttactgcctctttccatctga

SEQ ID NO: 42026 - DNA, 37 bp, Artificial Sequence
  Synthetic oligonucleotide
atccagccatcttctcccatcgcgtagttccatgtga

SEQ ID NO: 42027 - DNA, 37 bp, Artificial Sequence
  Synthetic oligonucleotide
tgaaacggcaccccctcctaggctgtaatacctttga

SEQ ID NO: 42028 - DNA, 38 bp, Artificial Sequence
  Synthetic oligonucleotide
agaccctcagtgtgacgtcccctaccccgccattttga

SEQ ID NO: 42029 - DNA, 35 bp, Artificial Sequence
  Synthetic oligonucleotide
tatgggaaaggaacggtgataagaaaatgcagcta

SEQ ID NO: 42030 - DNA, 35 bp, Artificial Sequence
  Synthetic oligonucleotide
gccggtgtccgtcatttctaatactgattgctcac

SEQ ID NO: 42031 - DNA, 35 bp, Artificial Sequence
  Synthetic oligonucleotide
atactacttccccagacgtctgcacccatggaacc

SEQ ID NO: 42032 - DNA, 35 bp, Artificial Sequence
  Synthetic oligonucleotide
gcccgacttccgacttgcctccgtccgtatgaacc

SEQ ID NO: 42033 - DNA, 35 bp, Artificial Sequence
  Synthetic oligonucleotide
tgtcctcaaagccaactaagccgacccgaataccc

SEQ ID NO: 42034 - DNA, 35 bp, Artificial Sequence
  Synthetic oligonucleotide
tcgtgcgccaatccccatgccacccccgacgggcc

SEQ ID NO: 42035 - DNA, 35 bp, Artificial Sequence
  Synthetic oligonucleotide
tatctgcaccaagtctgcgcccgctcccccctggc

SEQ ID NO: 42036 - DNA, 35 bp, Artificial Sequence
  Synthetic oligonucleotide
acactcctgttgtcttctagctttgacctaacatc

SEQ ID NO: 42037 - DNA, 35 bp, Artificial Sequence
  Synthetic oligonucleotide
gtcacccggtatattcgttaacttaggcccccatc

SEQ ID NO: 42038 - DNA, 35 bp, Artificial Sequence
  Synthetic oligonucleotide
gtacccacgcaaatttcggactccagtctcaactc

SEQ ID NO: 42039 - DNA, 35 bp, Artificial Sequence
  Synthetic oligonucleotide
ttgatcgccgtgccgttccacatgtcctgaacctc

SEQ ID NO: 42040 - DNA, 35 bp, Artificial Sequence
  Synthetic oligonucleotide
gagctgctccggctcttttcttacgtgactcgctc

SEQ ID NO: 42041 - DNA, 35 bp, Artificial Sequence
  Synthetic oligonucleotide
tagacgggacagctttccctcggcgacacttcgtc

SEQ ID NO: 42042 - DNA, 35 bp, Artificial Sequence
  Synthetic oligonucleotide
tacgaggggatggaggttagagaggcgagtggtgg

SEQ ID NO: 42043 - DNA, 35 bp, Artificial Sequence
  Synthetic oligonucleotide
gttagcacaaaacggaggagggggcatggcacgtg

SEQ ID NO: 42044 - DNA, 35 bp, Artificial Sequence
  Synthetic oligonucleotide
agtaaatggggggtgtaaaaatagggttggtggtg

SEQ ID NO: 42045 - DNA, 35 bp, Artificial Sequence
  Synthetic oligonucleotide
tgcccgaccctcactattcgacgactctccgtgtg

SEQ ID NO: 42046 - DNA, 35 bp, Artificial Sequence
  Synthetic oligonucleotide
acattcgacatcgcccatgtcttccaccccactat

SEQ ID NO: 42047 - DNA, 35 bp, Artificial Sequence
  Synthetic oligonucleotide
tagcgacttatcctccgcgcctgaacaccgctcct

SEQ ID NO: 42048 - DNA, 35 bp, Artificial Sequence
  Synthetic oligonucleotide
gctccgcgccatttgcaacactttttcgctacgct

SEQ ID NO: 42049 - DNA, 35 bp, Artificial Sequence
  Synthetic oligonucleotide
gatgtgctcgcctactgaacgacactggtttctct

SEQ ID NO: 42050 - DNA, 35 bp, Artificial Sequence
  Synthetic oligonucleotide
gccgagcaatcagctctctcacggtgaatcccatt

SEQ ID NO: 42051 - DNA, 35 bp, Artificial Sequence
  Synthetic oligonucleotide
acatacaaccgcaagacttccacgatcggtccatt

SEQ ID NO: 42052 - DNA, 36 bp, Artificial Sequence
  Synthetic oligonucleotide
tgccagaccctgtgcctctcgttgtaatgcctccaa

SEQ ID NO: 42053 - DNA, 36 bp, Artificial Sequence
  Synthetic oligonucleotide
ttacgaacaccctcttctgctctctcgtggggaaca

SEQ ID NO: 42054 - DNA, 36 bp, Artificial Sequence
  Synthetic oligonucleotide
gacactctgcacgagcatttaggatctcctgttaca

SEQ ID NO: 42055 - DNA, 35 bp, Artificial Sequence
  Synthetic oligonucleotide
accactgcccacgcccggtcgactcccgctaccca

SEQ ID NO: 42056 - DNA, 36 bp, Artificial Sequence
  Synthetic oligonucleotide
gcataggtcagccagatacaccgccgcatctcagca

SEQ ID NO: 42057 - DNA, 36 bp, Artificial Sequence
  Synthetic oligonucleotide
agtagggaggaagggtaaggtatgacaaattagaga

SEQ ID NO: 42058 - DNA, 37 bp, Artificial Sequence
  Synthetic oligonucleotide
ttccggggctcccctttgttctttatcgtgatcccga

SEQ ID NO: 42059 - DNA, 37 bp, Artificial Sequence
  Synthetic oligonucleotide
acaggagccgccattctatcttctctcgtgatctcga

SEQ ID NO: 42060 - DNA, 36 bp, Artificial Sequence
  Synthetic oligonucleotide
gaacacaggagggtgggacgaaagtacgaatgggga

SEQ ID NO: 42061 - DNA, 37 bp, Artificial Sequence
  Synthetic oligonucleotide
tgtcacctcgcctggtaccacccttatatagccatga

SEQ ID NO: 42062 - DNA, 37 bp, Artificial Sequence
  Synthetic oligonucleotide
ggacgaaaaagcaagggagagggattgggcgaagtga

SEQ ID NO: 42063 - DNA, 38 bp, Artificial Sequence
  Synthetic oligonucleotide
aacacctgtaccagcctactgatcttcgccttacttga

SEQ ID NO: 42064 - DNA, 36 bp, Artificial Sequence
  Synthetic oligonucleotide
tagctgacgcctcgccatcactcgctgttaccttga

SEQ ID NO: 42065 - DNA, 36 bp, Artificial Sequence
  Synthetic oligonucleotide
gagaatgcgagagacgcggggggtgccggaggaata

SEQ ID NO: 42066 - DNA, 36 bp, Artificial Sequence
  Synthetic oligonucleotide
gtcacccccgacaccgggtggctcttgtactctcta

SEQ ID NO: 42067 - DNA, 36 bp, Artificial Sequence
  Synthetic oligonucleotide
gcgccacagccccgagccgacaaaccactttgctta

SEQ ID NO: 42068 - DNA, 35 bp, Artificial Sequence
  Synthetic oligonucleotide
tgctcactctcccgggccaatgctgtgactgtacc

SEQ ID NO: 42069 - DNA, 35 bp, Artificial Sequence
  Synthetic oligonucleotide
gccaccaaagggttacccaaatatagacctgaccc

SEQ ID NO: 42070 - DNA, 35 bp, Artificial Sequence
  Synthetic oligonucleotide
gtgtcccatcctattgggtatttggtaaccctgcc

SEQ ID NO: 42071 - DNA, 35 bp, Artificial Sequence
  Synthetic oligonucleotide
cagatcacgccctgctgtctttcgtacatctctcc

SEQ ID NO: 42072 - DNA, 35 bp, Artificial Sequence
  Synthetic oligonucleotide
ttccccacaagcgaacgcactcgttctttttcagc

SEQ ID NO: 42073 - DNA, 35 bp, Artificial Sequence
  Synthetic oligonucleotide
tccgaaaggggcatccagacccgtccctcattgtc

SEQ ID NO: 42074 - DNA, 35 bp, Artificial Sequence
  Synthetic oligonucleotide
aaccggtacacagccgctgttcaagccatccctag

SEQ ID NO: 42075 - DNA, 35 bp, Artificial Sequence
  Synthetic oligonucleotide
gtccccaaagcccctcccccacatctcaatggtcg

SEQ ID NO: 42076 - DNA, 35 bp, Artificial Sequence
  Synthetic oligonucleotide
tagattgggcgggaggggttgatggaaccgattgg

SEQ ID NO: 42077 - DNA, 35 bp, Artificial Sequence
  Synthetic oligonucleotide
gctaggggtggattggggcggggacacggaggaat

SEQ ID NO: 42078 - DNA, 35 bp, Artificial Sequence
  Synthetic oligonucleotide
gacaacatactgtgcagtttcgcacgctcgcaact

SEQ ID NO: 42079 - DNA, 35 bp, Artificial Sequence
  Synthetic oligonucleotide
gatccaacctcagcttaggtccatcgtgacattgt

SEQ ID NO: 42080 - DNA, 35 bp, Artificial Sequence
  Synthetic oligonucleotide
atccacgtaacatccggtacagtatcggtcctatt

SEQ ID NO: 42081 - DNA, 35 bp, Artificial Sequence
  Synthetic oligonucleotide
tgccgccggcatcttttcccccgtctgctcccaca

SEQ ID NO: 42082 - DNA, 36 bp, Artificial Sequence
  Synthetic oligonucleotide
tcactccgccacccttttcatagtcaaaactagaca

SEQ ID NO: 42083 - DNA, 36 bp, Artificial Sequence
  Synthetic oligonucleotide
gtagggccaccttgtaaattttgttctgttgctaca

SEQ ID NO: 42084 - DNA, 36 bp, Artificial Sequence
  Synthetic oligonucleotide
tctcccacccgggccctgttcggtcgcaccgctcca

SEQ ID NO: 42085 - DNA, 36 bp, Artificial Sequence
  Synthetic oligonucleotide
accgccacacttgctaatgtctaaccgaaatgatca

SEQ ID NO: 42086 - DNA, 37 bp, Artificial Sequence
  Synthetic oligonucleotide
gacttgcgacacgactgctatcctacactccacacga

SEQ ID NO: 42087 - DNA, 37 bp, Artificial Sequence
  Synthetic oligonucleotide
acatgcgagccgtacacaacatgtcaagtggtaccga

SEQ ID NO: 42088 - DNA, 37 bp, Artificial Sequence
  Synthetic oligonucleotide
gcgcatggggggaacacaaaaggtctttaaggaagga

SEQ ID NO: 42089 - DNA, 37 bp, Artificial Sequence
  Synthetic oligonucleotide
gagcaacaccccacataactgtatgtagccccaatga

SEQ ID NO: 42090 - DNA, 38 bp, Artificial Sequence
  Synthetic oligonucleotide
tctccacctcaatccatgcggacctactcggaccatga

SEQ ID NO: 42091 - DNA, 38 bp, Artificial Sequence
  Synthetic oligonucleotide
tcactgcagtgctccccattagcgttcgtggcccatga

SEQ ID NO: 42092 - DNA, 38 bp, Artificial Sequence
  Synthetic oligonucleotide
tcatccatactaccgcctgtccccgtgcccgcctatga

SEQ ID NO: 42093 - DNA, 38 bp, Artificial Sequence
  Synthetic oligonucleotide
gtccatccttacacctgcgccgtcagtccacgctctga

SEQ ID NO: 42094 - DNA, 37 bp, Artificial Sequence
  Synthetic oligonucleotide
tctagccctcccgctcttgtggtcaccctggtcgtga

SEQ ID NO: 42095 - DNA, 37 bp, Artificial Sequence
  Synthetic oligonucleotide
tctccttgccgtgcctccccgtaatcccgcctggtga

SEQ ID NO: 42096 - DNA, 37 bp, Artificial Sequence
  Synthetic oligonucleotide
tgacctcccacttatagcactcatcacgctctggtga

SEQ ID NO: 42097 - DNA, 37 bp, Artificial Sequence
  Synthetic oligonucleotide
accactgtgcttacttgcatatagttccatattttga

SEQ ID NO: 42098 - DNA, 38 bp, Artificial Sequence
  Synthetic oligonucleotide
accgcgttcaaacactgcctaaccgttccctattttga

SEQ ID NO: 42099 - DNA, 35 bp, Artificial Sequence
  Synthetic oligonucleotide
atcacactgttgagcaacgcacccctgaggttcta

SEQ ID NO: 42100 - DNA, 35 bp, Artificial Sequence
  Synthetic oligonucleotide
gcaacagtacacctccaaacactgtcttaacagta

SEQ ID NO: 42101 - DNA, 35 bp, Artificial Sequence
  Synthetic oligonucleotide
gacgcctacagtcaatttcttttgattcacctaac

SEQ ID NO: 42102 - DNA, 35 bp, Artificial Sequence
  Synthetic oligonucleotide
acagtacgccgcgaagggcctacccaatattcacc

SEQ ID NO: 42103 - DNA, 35 bp, Artificial Sequence
  Synthetic oligonucleotide
ttcccaaccgtttggtttcgcgcttacccgacgcc

SEQ ID NO: 42104 - DNA, 35 bp, Artificial Sequence
  Synthetic oligonucleotide
tcaccgtccaatcatcccgctgtacttcagctagc

SEQ ID NO: 42105 - DNA, 35 bp, Artificial Sequence
  Synthetic oligonucleotide
tgtgtgctctctgccccctcggcgactctattagc

SEQ ID NO: 42106 - DNA, 35 bp, Artificial Sequence
  Synthetic oligonucleotide
acaccttatccccccgatggtcttgtgacgcccgc

SEQ ID NO: 42107 - DNA, 35 bp, Artificial Sequence
  Synthetic oligonucleotide
tcctcagttgccagaacctcgtcacccaccttggc

SEQ ID NO: 42108 - DNA, 35 bp, Artificial Sequence
  Synthetic oligonucleotide
acccttggctcccatgccaggtacactccacaatc

SEQ ID NO: 42109 - DNA, 35 bp, Artificial Sequence
  Synthetic oligonucleotide
tacctaacgaccagtgcgatattcttggttccctc

SEQ ID NO: 42110 - DNA, 35 bp, Artificial Sequence
  Synthetic oligonucleotide
actgtgcccatgtgttttatccctgttccgttcag

SEQ ID NO: 42111 - DNA, 35 bp, Artificial Sequence
  Synthetic oligonucleotide
agtcatacccgcaatgtttggcctgtacctgcccg

SEQ ID NO: 42112 - DNA, 35 bp, Artificial Sequence
  Synthetic oligonucleotide
gacgcggtttaagcgctttttctagacctcccctg

SEQ ID NO: 42113 - DNA, 35 bp, Artificial Sequence
  Synthetic oligonucleotide
gtgtcggcaaactttccgtttttgttacaccattg

SEQ ID NO: 42114 - DNA, 35 bp, Artificial Sequence
  Synthetic oligonucleotide
tgagagtgcccggttttaagcgcccaccacccttg

SEQ ID NO: 42115 - DNA, 35 bp, Artificial Sequence
  Synthetic oligonucleotide
gcttaccgtcctgactgccttccttaaccgtttat

SEQ ID NO: 42116 - DNA, 35 bp, Artificial Sequence
  Synthetic oligonucleotide
accatcgcaacatcctctagcttggttcctggact

SEQ ID NO: 42117 - DNA, 35 bp, Artificial Sequence
  Synthetic oligonucleotide
tccccacttccatacacgcacgaatagcgtggact

SEQ ID NO: 42118 - DNA, 35 bp, Artificial Sequence
  Synthetic oligonucleotide
tctaagcgcaatcgactgtcccggcttgttcacct

SEQ ID NO: 42119 - DNA, 35 bp, Artificial Sequence
  Synthetic oligonucleotide
tccacgcctcttcagcacgctggacgattctgttt

SEQ ID NO: 42120 - DNA, 35 bp, Artificial Sequence
  Synthetic oligonucleotide
gcatagtcttatgctcggcactttttcaacaccaa

SEQ ID NO: 42121 - DNA, 36 bp, Artificial Sequence
  Synthetic oligonucleotide
tccgagcgcgcggagaaacgggggggcatactggaa

SEQ ID NO: 42122 - DNA, 35 bp, Artificial Sequence
  Synthetic oligonucleotide
tccgatcgcgctgagccaattaaattcatccgcca

SEQ ID NO: 42123 - DNA, 35 bp, Artificial Sequence
  Synthetic oligonucleotide
accgatcccagttcccgccattgttaatatggtca

SEQ ID NO: 42124 - DNA, 37 bp, Artificial Sequence
  Synthetic oligonucleotide
tactgggggcgagggagacaaggaggccgggagtaga

SEQ ID NO: 42125 - DNA, 35 bp, Artificial Sequence
  Synthetic oligonucleotide
aatgatccggcccctcgttcgcactcacaaaccga

SEQ ID NO: 42126 - DNA, 37 bp, Artificial Sequence
  Synthetic oligonucleotide
ttgtcctcccacccggcttgtttgattacaccttcga

SEQ ID NO: 42127 - DNA, 37 bp, Artificial Sequence
  Synthetic oligonucleotide
agaatgtcgtggtaagtcagggggaagggtggaagga

SEQ ID NO: 42128 - DNA, 38 bp, Artificial Sequence
  Synthetic oligonucleotide
aatgggaacggcggtagggaaatacagcgatcaagtga

SEQ ID NO: 42129 - DNA, 38 bp, Artificial Sequence
  Synthetic oligonucleotide
aacaatcgcgggtgggagcaggaggatagggtgcgtga

SEQ ID NO: 42130 - DNA, 38 bp, Artificial Sequence
  Synthetic oligonucleotide
gatcgcagggaggagggagagcgcgtggcttcgggtga

SEQ ID NO: 42131 - DNA, 38 bp, Artificial Sequence
  Synthetic oligonucleotide
gggagggccgtagcgggagttaggggtcctgggggtga

SEQ ID NO: 42132 - DNA, 38 bp, Artificial Sequence
  Synthetic oligonucleotide
acaccgtcggtccaccggccacaagcccatatctgtga

SEQ ID NO: 42133 - DNA, 37 bp, Artificial Sequence
  Synthetic oligonucleotide
ggagccgtatcctgccgtaccagctcatcatgcttga

SEQ ID NO: 42134 - DNA, 38 bp, Artificial Sequence
  Synthetic oligonucleotide
atggtcgtgtctcgttgcctccccgaaccacctcttga

SEQ ID NO: 42135 - DNA, 38 bp, Artificial Sequence
  Synthetic oligonucleotide
gttggtccccagttacgcacttgtaccttcatttttga

SEQ ID NO: 42136 - DNA, 36 bp, Artificial Sequence
  Synthetic oligonucleotide
gtctcactacgccacgacgccctatactccctgata

SEQ ID NO: 42137 - DNA, 35 bp, Artificial Sequence
  Synthetic oligonucleotide
gcagggcgtgaatggagggcaatatgggataggta

SEQ ID NO: 42138 - DNA, 36 bp, Artificial Sequence
  Synthetic oligonucleotide
atcaccgggcctcgcagctccctcttccacatggta

SEQ ID NO: 42139 - DNA, 35 bp, Artificial Sequence
  Synthetic oligonucleotide
tgcgcacaggttagaccttggccctttctccttac

SEQ ID NO: 42140 - DNA, 35 bp, Artificial Sequence
  Synthetic oligonucleotide
gagccccagccctgaatgctggtatgtcacccgcc

SEQ ID NO: 42141 - DNA, 35 bp, Artificial Sequence
  Synthetic oligonucleotide
tcattcacaacgcctgtccgttgtcctgactgtcc

SEQ ID NO: 42142 - DNA, 34 bp, Artificial Sequence
  Synthetic oligonucleotide
tcaacgtgggtgccagttgttaactcatttgtcc

SEQ ID NO: 42143 - DNA, 35 bp, Artificial Sequence
  Synthetic oligonucleotide
taaggcctcacctggccgtgatcttccatgcttgc

SEQ ID NO: 42144 - DNA, 35 bp, Artificial Sequence
  Synthetic oligonucleotide
tacatgccctaggtacatgtggtccccggttaatc

SEQ ID NO: 42145 - DNA, 35 bp, Artificial Sequence
  Synthetic oligonucleotide
tccaccatacgtattccccgtcctatgctcatttc

SEQ ID NO: 42146 - DNA, 35 bp, Artificial Sequence
  Synthetic oligonucleotide
ttcagcgctgcctatctcgacgcctcttcccaaag

SEQ ID NO: 42147 - DNA, 35 bp, Artificial Sequence
  Synthetic oligonucleotide
gcgatgccacccgtccctagtacatatttgtcagg

SEQ ID NO: 42148 - DNA, 35 bp, Artificial Sequence
  Synthetic oligonucleotide
atgttccccaggtgacattggtctacttttccttg

SEQ ID NO: 42149 - DNA, 35 bp, Artificial Sequence
  Synthetic oligonucleotide
cacgtgcccctgactgacccaatttacttcgtttg

SEQ ID NO: 42150 - DNA, 35 bp, Artificial Sequence
  Synthetic oligonucleotide
aatgacttccatcctacacctatgatgagacacat

SEQ ID NO: 42151 - DNA, 35 bp, Artificial Sequence
  Synthetic oligonucleotide
tacgatccggtgccgtccgttttgtagcctttcct

SEQ ID NO: 42152 - DNA, 35 bp, Artificial Sequence
  Synthetic oligonucleotide
gcagatcacgcttgacgttcggcactcgcccatct

SEQ ID NO: 42153 - DNA, 35 bp, Artificial Sequence
  Synthetic oligonucleotide
tatcaccccaccctacagcagctttcccctcgggt

SEQ ID NO: 42154 - DNA, 35 bp, Artificial Sequence
  Synthetic oligonucleotide
accatggcaccgtggcataatctggttcatctatt

SEQ ID NO: 42155 - DNA, 36 bp, Artificial Sequence
  Synthetic oligonucleotide
aacccacccgcgcatatccgatcgaaatttacgaaa

SEQ ID NO: 42156 - DNA, 36 bp, Artificial Sequence
  Synthetic oligonucleotide
gaccaacaacccgtcataacgccttcctgacgtgaa

SEQ ID NO: 42157 - DNA, 35 bp, Artificial Sequence
  Synthetic oligonucleotide
accgtgcgtaatctgcagggcctcctccctccaca

SEQ ID NO: 42158 - DNA, 35 bp, Artificial Sequence
  Synthetic oligonucleotide
gcacaagcctggcaaacacctcgtgaaaactcaca

SEQ ID NO: 42159 - DNA, 36 bp, Artificial Sequence
  Synthetic oligonucleotide
acgttcgactcggatctattacacactctcgctcca

SEQ ID NO: 42160 - DNA, 37 bp, Artificial Sequence
  Synthetic oligonucleotide
gccgcaggccctttcttgcacaatctgccgtgaacga

SEQ ID NO: 42161 - DNA, 37 bp, Artificial Sequence
  Synthetic oligonucleotide
atatcgcccccgcacatttttatttagatccacacga

SEQ ID NO: 42162 - DNA, 37 bp, Artificial Sequence
  Synthetic oligonucleotide
agtcgacttccctgtttttaaccatgcatacccccga

SEQ ID NO: 42163 - DNA, 37 bp, Artificial Sequence
  Synthetic oligonucleotide
aacaccttcctcttgcgatctcgcgaagatcgcccga

SEQ ID NO: 42164 - DNA, 37 bp, Artificial Sequence
  Synthetic oligonucleotide
gtaggtcgggagtgtggcatggggtggtaacatgcga

SEQ ID NO: 42165 - DNA, 37 bp, Artificial Sequence
  Synthetic oligonucleotide
cacaaggcggagaaggaagcaagccgtaggaccagga

SEQ ID NO: 42166 - DNA, 37 bp, Artificial Sequence
  Synthetic oligonucleotide
gaacggtgaccggaggggcttagggaaggggagggga

SEQ ID NO: 42167 - DNA, 37 bp, Artificial Sequence
  Synthetic oligonucleotide
accaccacaccctattactagcccacatcatcgtgga

SEQ ID NO: 42168 - DNA, 35 bp, Artificial Sequence
  Synthetic oligonucleotide
gccgggcgacggagggaccaaatgtctggggtgga

SEQ ID NO: 42169 - DNA, 38 bp, Artificial Sequence
  Synthetic oligonucleotide
gcactccctctcatgttcatcaggttcacagagaatga

SEQ ID NO: 42170 - DNA, 38 bp, Artificial Sequence
  Synthetic oligonucleotide
gccgacggtgtcgactaacgaaagggggcgaggaatga

SEQ ID NO: 42171 - DNA, 38 bp, Artificial Sequence
  Synthetic oligonucleotide
acgaccgatccgacgctgttaccgttcctggctcatga

SEQ ID NO: 42172 - DNA, 35 bp, Artificial Sequence
  Synthetic oligonucleotide
taccatgacacccacacgccccgcttttgtgatga

SEQ ID NO: 42173 - DNA, 38 bp, Artificial Sequence
  Synthetic oligonucleotide
gtcacgctgctttgttatccttagttccctgttactga

SEQ ID NO: 42174 - DNA, 38 bp, Artificial Sequence
  Synthetic oligonucleotide
gcgcaccgcaccattcccccaggccttcttcctggtga

SEQ ID NO: 42175 - DNA, 38 bp, Artificial Sequence
  Synthetic oligonucleotide
acacttgcctcccgaaccgaagaatgacgcgtatttga

SEQ ID NO: 42176 - DNA, 35 bp, Artificial Sequence
  Synthetic oligonucleotide
ttccccacccggtcgagtctcttattggatcgata

SEQ ID NO: 42177 - DNA, 35 bp, Artificial Sequence
  Synthetic oligonucleotide
gaccgagtctcatgttttgtcccgttcatgcccta

SEQ ID NO: 42178 - DNA, 36 bp, Artificial Sequence
  Synthetic oligonucleotide
gtccccccgcgccctggaactcacagttcatatgta

SEQ ID NO: 42179 - DNA, 35 bp, Artificial Sequence
  Synthetic oligonucleotide
tactgtcacagtttctatttagcttctagttcgcc

SEQ ID NO: 42180 - DNA, 35 bp, Artificial Sequence
  Synthetic oligonucleotide
tctgaacgcctaacacgccacactacatctttgcc

SEQ ID NO: 42181 - DNA, 35 bp, Artificial Sequence
  Synthetic oligonucleotide
acgacccacgccgtgagtgagaaaccaatgtccgc

SEQ ID NO: 42182 - DNA, 35 bp, Artificial Sequence
  Synthetic oligonucleotide
gcccatatgagattgggcggcctctcttctacctc

SEQ ID NO: 42183 - DNA, 35 bp, Artificial Sequence
  Synthetic oligonucleotide
atggacccaatgcctgaatgacttccaaagtgctc

SEQ ID NO: 42184 - DNA, 35 bp, Artificial Sequence
  Synthetic oligonucleotide
gccacatcctctcttctcgtgaacatgcataattc

SEQ ID NO: 42185 - DNA, 35 bp, Artificial Sequence
  Synthetic oligonucleotide
aattcgcgaaaccctgaagaggcccaccctacccg

SEQ ID NO: 42186 - DNA, 35 bp, Artificial Sequence
  Synthetic oligonucleotide
tctcacgaggcacagagttccccgcattctttccg

SEQ ID NO: 42187 - DNA, 35 bp, Artificial Sequence
  Synthetic oligonucleotide
ttattcccgccgtttttggcctccaccgaccatcg

SEQ ID NO: 42188 - DNA, 35 bp, Artificial Sequence
  Synthetic oligonucleotide
aacccccttatccactgttctttatatacagctgg

SEQ ID NO: 42189 - DNA, 35 bp, Artificial Sequence
  Synthetic oligonucleotide
aaactaacagccgtcgcgacccctgacccataatg

SEQ ID NO: 42190 - DNA, 35 bp, Artificial Sequence
  Synthetic oligonucleotide
tcctcatcacccgctactgactgagttcctacatg

SEQ ID NO: 42191 - DNA, 35 bp, Artificial Sequence
  Synthetic oligonucleotide
acatctggatcgctgcatcgtgagcctacgtacct

SEQ ID NO: 42192 - DNA, 35 bp, Artificial Sequence
  Synthetic oligonucleotide
gatcgtcctgccgtctttttcaccgttataggcct

SEQ ID NO: 42193 - DNA, 35 bp, Artificial Sequence
  Synthetic oligonucleotide
tgtcctcccctgtaaggtgcatgcctttgttgcct

SEQ ID NO: 42194 - DNA, 35 bp, Artificial Sequence
  Synthetic oligonucleotide
gacaacaggccccgctatacgcgattttactccgt

SEQ ID NO: 42195 - DNA, 35 bp, Artificial Sequence
  Synthetic oligonucleotide
agaacacggaaagggaaagtgagcagtgtgagctt

SEQ ID NO: 42196 - DNA, 35 bp, Artificial Sequence
  Synthetic oligonucleotide
acaggctggctcgggaagggagggatctgggcgtt

SEQ ID NO: 42197 - DNA, 36 bp, Artificial Sequence
  Synthetic oligonucleotide
tgagggagcggggggcggggaatccataacacttaa

SEQ ID NO: 42198 - DNA, 35 bp, Artificial Sequence
  Synthetic oligonucleotide
tgccgagcctcccacatctgccatcgctccccaca

SEQ ID NO: 42199 - DNA, 36 bp, Artificial Sequence
  Synthetic oligonucleotide
aacagcggaagctccattgcattcctccgtttgaca

SEQ ID NO: 42200 - DNA, 36 bp, Artificial Sequence
  Synthetic oligonucleotide
tacgtctcccaggcgctcgttcatccaggcactaca

SEQ ID NO: 42201 - DNA, 35 bp, Artificial Sequence
  Synthetic oligonucleotide
gatgcgtgcccagcagccgccatctttctgaatca

SEQ ID NO: 42202 - DNA, 35 bp, Artificial Sequence
  Synthetic oligonucleotide
tgtgcacctagtatttggctctcgttcacacatca

SEQ ID NO: 42203 - DNA, 36 bp, Artificial Sequence
  Synthetic oligonucleotide
accaagcctccatgctaactcacagttcaaccctca

SEQ ID NO: 42204 - DNA, 36 bp, Artificial Sequence
  Synthetic oligonucleotide
tgacctccaccaccgaggcaagatgactggggttca

SEQ ID NO: 42205 - DNA, 37 bp, Artificial Sequence
  Synthetic oligonucleotide
gtgtgggaagtgggggtggaatctcgtttggaagcga

SEQ ID NO: 42206 - DNA, 37 bp, Artificial Sequence
  Synthetic oligonucleotide
tgagcgggagatgtcggcccggcaccccctacttcga

SEQ ID NO: 42207 - DNA, 37 bp, Artificial Sequence
  Synthetic oligonucleotide
atggggccgaaaagtgggaatagtgggctcgtaagga

SEQ ID NO: 42208 - DNA, 37 bp, Artificial Sequence
  Synthetic oligonucleotide
tccggtccatcctcctgaatttgccatgtttatcgga

SEQ ID NO: 42209 - DNA, 36 bp, Artificial Sequence
  Synthetic oligonucleotide
tactcaacctaccctagcctcgcgatgtcctgtgga

SEQ ID NO: 42210 - DNA, 37 bp, Artificial Sequence
  Synthetic oligonucleotide
gccacgtctgatgagatgccgcctcccctcccactga

SEQ ID NO: 42211 - DNA, 37 bp, Artificial Sequence
  Synthetic oligonucleotide
tgctccccagcaacatcgacgcattccctcattctga

SEQ ID NO: 42212 - DNA, 38 bp, Artificial Sequence
  Synthetic oligonucleotide
tcaggtgcgcacactactaccacccacgcacgacgtga

SEQ ID NO: 42213 - DNA, 38 bp, Artificial Sequence
  Synthetic oligonucleotide
acgtgaggtacgggaatctggccaggaggggggggtga

SEQ ID NO: 42214 - DNA, 38 bp, Artificial Sequence
  Synthetic oligonucleotide
atacaccacaccttcttccctacgtgctcaggccttga

SEQ ID NO: 42215 - DNA, 37 bp, Artificial Sequence
  Synthetic oligonucleotide
ggtgcgacggccttgactttgttctttgcttccttga

SEQ ID NO: 42216 - DNA, 37 bp, Artificial Sequence
  Synthetic oligonucleotide
gcaccgattatgcccccatcacgacacccgcggttga

SEQ ID NO: 42217 - DNA, 35 bp, Artificial Sequence
  Synthetic oligonucleotide
gcaaactggagtgtcccatcgccttcttctctgac

SEQ ID NO: 42218 - DNA, 35 bp, Artificial Sequence
  Synthetic oligonucleotide
atgcccggactattgaaaccccagatgctttgccc

SEQ ID NO: 42219 - DNA, 35 bp, Artificial Sequence
  Synthetic oligonucleotide
tgacgccgccaaactcgtatagctcggcctaatcc

SEQ ID NO: 42220 - DNA, 35 bp, Artificial Sequence
  Synthetic oligonucleotide
tagaccttgatgccatgtgcgtcccttaccaccgc

SEQ ID NO: 42221 - DNA, 35 bp, Artificial Sequence
  Synthetic oligonucleotide
tcccaccataaggcggcatcattcccacgttccgc

SEQ ID NO: 42222 - DNA, 35 bp, Artificial Sequence
  Synthetic oligonucleotide
acgccaccaaacatcaaagttttttgccacccatc

SEQ ID NO: 42223 - DNA, 35 bp, Artificial Sequence
  Synthetic oligonucleotide
cccaccgccccgaccctgattgtgccaaactcacg

SEQ ID NO: 42224 - DNA, 35 bp, Artificial Sequence
  Synthetic oligonucleotide
gttacgggacaagttaaggaggtggttagtgaagg

SEQ ID NO: 42225 - DNA, 35 bp, Artificial Sequence
  Synthetic oligonucleotide
gacacccgcagcaagtttcgtctaacatatcgttg

SEQ ID NO: 42226 - DNA, 35 bp, Artificial Sequence
  Synthetic oligonucleotide
gatctgtccgagtgcttgtctaaccgtacccacct

SEQ ID NO: 42227 - DNA, 35 bp, Artificial Sequence
  Synthetic oligonucleotide
tgcaccagtctctagcctaaccccgcacgtactct

SEQ ID NO: 42228 - DNA, 35 bp, Artificial Sequence
  Synthetic oligonucleotide
gatcatcctccgatccgcaaaactacacgtgccgt

SEQ ID NO: 42229 - DNA, 35 bp, Artificial Sequence
  Synthetic oligonucleotide
tctctacctggtgttcgcccgctctttaccgcggt

SEQ ID NO: 42230 - DNA, 35 bp, Artificial Sequence
  Synthetic oligonucleotide
aacgaggtttaggggagtaatctggggccgtggtt

SEQ ID NO: 42231 - DNA, 35 bp, Artificial Sequence
  Synthetic oligonucleotide
gacaccgtcacacgtcactccacgaccatctccaa

SEQ ID NO: 42232 - DNA, 36 bp, Artificial Sequence
  Synthetic oligonucleotide
accccgcttatagccgatctacccttgcttgtgcaa

SEQ ID NO: 42233 - DNA, 36 bp, Artificial Sequence
  Synthetic oligonucleotide
agtgcggtcccgcctgttcactttgagcccccagca

SEQ ID NO: 42234 - DNA, 35 bp, Artificial Sequence
  Synthetic oligonucleotide
tatcagagcgccgcttgcccttttagcccatttca

SEQ ID NO: 42235 - DNA, 37 bp, Artificial Sequence
  Synthetic oligonucleotide
accttccagctccctgggcccctccacacagttacga

SEQ ID NO: 42236 - DNA, 37 bp, Artificial Sequence
  Synthetic oligonucleotide
ccaccaaccttcacatctccagatgtgtctaaggcga

SEQ ID NO: 42237 - DNA, 36 bp, Artificial Sequence
  Synthetic oligonucleotide
atcactagcaccgcatgagctgcctttttcccagga

SEQ ID NO: 42238 - DNA, 37 bp, Artificial Sequence
  Synthetic oligonucleotide
ataccccgcccttaacattcacagtcatgacctagga

SEQ ID NO: 42239 - DNA, 37 bp, Artificial Sequence
  Synthetic oligonucleotide
aagcactcgctgccttcctttgcctgatccgtgcgga

SEQ ID NO: 42240 - DNA, 37 bp, Artificial Sequence
  Synthetic oligonucleotide
tatgacccaccccttatgtccaatgtctgcccatgga

SEQ ID NO: 42241 - DNA, 37 bp, Artificial Sequence
  Synthetic oligonucleotide
gcatgaactgggtaggagggccagtgagtgcacatga

SEQ ID NO: 42242 - DNA, 38 bp, Artificial Sequence
  Synthetic oligonucleotide
gcaccacgagctttttgcccataatacgtactacatga

SEQ ID NO: 42243 - DNA, 37 bp, Artificial Sequence
  Synthetic oligonucleotide
gcagacccgccgccgacgactgtaatcaatctcctga

SEQ ID NO: 42244 - DNA, 38 bp, Artificial Sequence
  Synthetic oligonucleotide
acgcgggggaataccatgtgacgttggagggcgggtga

SEQ ID NO: 42245 - DNA, 38 bp, Artificial Sequence
  Synthetic oligonucleotide
ttactgcgccccttctttgctactcatctacgctgtga

SEQ ID NO: 42246 - DNA, 35 bp, Artificial Sequence
  Synthetic oligonucleotide
accttccgaacgcatctaatgcctttatcttgtga

SEQ ID NO: 42247 - DNA, 36 bp, Artificial Sequence
  Synthetic oligonucleotide
tacgaagctggctgtgtaccccatttcggccccata

SEQ ID NO: 42248 - DNA, 36 bp, Artificial Sequence
  Synthetic oligonucleotide
aagatcgtcagggctcgttctcaatcgtcctctcta

SEQ ID NO: 42249 - DNA, 36 bp, Artificial Sequence
  Synthetic oligonucleotide
gatgacgcagatatcactaagcctgcccaacttcta

SEQ ID NO: 42250 - DNA, 35 bp, Artificial Sequence
  Synthetic oligonucleotide
cccactgccgccacttagctccgttccgccactta

SEQ ID NO: 42251 - DNA, 36 bp, Artificial Sequence
  Synthetic oligonucleotide
gtccgcccacctatggtctgtttagtttttcgctta

SEQ ID NO: 42252 - DNA, 35 bp, Artificial Sequence
  Synthetic oligonucleotide
gtcgctgtccctttagccactagcctgtccgaaac

SEQ ID NO: 42253 - DNA, 35 bp, Artificial Sequence
  Synthetic oligonucleotide
aaccccgtgcgcacgcacctgatatggttttgtac

SEQ ID NO: 42254 - DNA, 35 bp, Artificial Sequence
  Synthetic oligonucleotide
tttcgttgtcccactttcctgtatctgccatggcc

SEQ ID NO: 42255 - DNA, 35 bp, Artificial Sequence
  Synthetic oligonucleotide
taccaggaccttggggacccccgtacttccttgcc

SEQ ID NO: 42256 - DNA, 36 bp, Artificial Sequence
  Synthetic oligonucleotide
tacagatcgcacccagcctcaccgacaagttaatcc

SEQ ID NO: 42257 - DNA, 35 bp, Artificial Sequence
  Synthetic oligonucleotide
accgacctgatccattaggtcttaagactatttcc

SEQ ID NO: 42258 - DNA, 35 bp, Artificial Sequence
  Synthetic oligonucleotide
aactcgcacgactgcttgaatttccgcttcctggc

SEQ ID NO: 42259 - DNA, 35 bp, Artificial Sequence
  Synthetic oligonucleotide
gtacgcaccgaagtcattggaccatccgcaactag

SEQ ID NO: 42260 - DNA, 35 bp, Artificial Sequence
  Synthetic oligonucleotide
tcagatggacaaaccacccaacgcattcttccacg

SEQ ID NO: 42261 - DNA, 35 bp, Artificial Sequence
  Synthetic oligonucleotide
atccacggtcgggttccttactccccttcgtttcg

SEQ ID NO: 42262 - DNA, 35 bp, Artificial Sequence
  Synthetic oligonucleotide
ttgaggacggatagccagggagtaggacgaaggtg

SEQ ID NO: 42263 - DNA, 35 bp, Artificial Sequence
  Synthetic oligonucleotide
gagcaaaccacaacgttatgcataacaggatattg

SEQ ID NO: 42264 - DNA, 35 bp, Artificial Sequence
  Synthetic oligonucleotide
tgctcgacccgtatgattttgatcaccacccgttg

SEQ ID NO: 42265 - DNA, 35 bp, Artificial Sequence
  Synthetic oligonucleotide
gttgagccatatcccataccagtctcgctaaccat

SEQ ID NO: 42266 - DNA, 35 bp, Artificial Sequence
  Synthetic oligonucleotide
gttgactgcaatcggtgtacgaatgctctctttct

SEQ ID NO: 42267 - DNA, 35 bp, Artificial Sequence
  Synthetic oligonucleotide
atttgcttgtccgaaccacgctcgattcaccctgt

SEQ ID NO: 42268 - DNA, 35 bp, Artificial Sequence
  Synthetic oligonucleotide
gagcaagaccacgctctatccccgttaaaaccttt

SEQ ID NO: 42269 - DNA, 35 bp, Artificial Sequence
  Synthetic oligonucleotide
tatccggcccatggactttgcgactatcaaccttt

SEQ ID NO: 42270 - DNA, 36 bp, Artificial Sequence
  Synthetic oligonucleotide
tcaccatcagcccccgttttgtgactattagcaaaa

SEQ ID NO: 42271 - DNA, 35 bp, Artificial Sequence
  Synthetic oligonucleotide
actaccctgagcagcccccctagagcgtcgacaca

SEQ ID NO: 42272 - DNA, 35 bp, Artificial Sequence
  Synthetic oligonucleotide
ttccgagccgcccacatctgccatcgctccccaca

SEQ ID NO: 42273 - DNA, 36 bp, Artificial Sequence
  Synthetic oligonucleotide
acgctctgggactccggcaataacgcacttttacca

SEQ ID NO: 42274 - DNA, 36 bp, Artificial Sequence
  Synthetic oligonucleotide
attgctgtgtcaggtaccacgcccctcattatcgca

SEQ ID NO: 42275 - DNA, 36 bp, Artificial Sequence
  Synthetic oligonucleotide
tgcattgctgcacccgtactcctgaataattttgca

SEQ ID NO: 42276 - DNA, 36 bp, Artificial Sequence
  Synthetic oligonucleotide
acgcgtcccacacgttgcgcattatccgctgattca

SEQ ID NO: 42277 - DNA, 35 bp, Artificial Sequence
  Synthetic oligonucleotide
agtccacatcccacgggtaaaatatctattcttca

SEQ ID NO: 42278 - DNA, 36 bp, Artificial Sequence
  Synthetic oligonucleotide
gacccagggccccacatctaccagtctgaccacaga

SEQ ID NO: 42279 - DNA, 37 bp, Artificial Sequence
  Synthetic oligonucleotide
ttaggagagggcaaagtgggggtggatgtgcatcaga

SEQ ID NO: 42280 - DNA, 37 bp, Artificial Sequence
  Synthetic oligonucleotide
gctgggcggggggatagagtcggggagaccaggacga

SEQ ID NO: 42281 - DNA, 36 bp, Artificial Sequence
  Synthetic oligonucleotide
agtacgcctgttctgcattccacattagttatccga

SEQ ID NO: 42282 - DNA, 37 bp, Artificial Sequence
  Synthetic oligonucleotide
gcactgcctcggaacttggttacctcctccccggcga

SEQ ID NO: 42283 - DNA, 36 bp, Artificial Sequence
  Synthetic oligonucleotide
gacggaacgaggggaaattctgtaggtgaaggagga

SEQ ID NO: 42284 - DNA, 36 bp, Artificial Sequence
  Synthetic oligonucleotide
tccaaccaccgagaacggacaatatacccacctgga

SEQ ID NO: 42285 - DNA, 37 bp, Artificial Sequence
  Synthetic oligonucleotide
acttcgcctccattctcacaacttgctagtcgcatga

SEQ ID NO: 42286 - DNA, 36 bp, Artificial Sequence
  Synthetic oligonucleotide
gccctactcgccggctgttacatagccttgttatga

SEQ ID NO: 42287 - DNA, 38 bp, Artificial Sequence
  Synthetic oligonucleotide
gacttctagcgtcacccctatgctgctccatccactga

SEQ ID NO: 42288 - DNA, 37 bp, Artificial Sequence
  Synthetic oligonucleotide
tattgagcgccaacgaccgttactcccctttgcctga

SEQ ID NO: 42289 - DNA, 38 bp, Artificial Sequence
  Synthetic oligonucleotide
tcaatttgcagccgccacactaccttccgccgtgctga

SEQ ID NO: 42290 - DNA, 35 bp, Artificial Sequence
  Synthetic oligonucleotide
gagggggggtgccgggggcgggagggaagcagtga

SEQ ID NO: 42291 - DNA, 38 bp, Artificial Sequence
  Synthetic oligonucleotide
accgcccgtacgatctcattccttcctatccttcgtga

SEQ ID NO: 42292 - DNA, 38 bp, Artificial Sequence
  Synthetic oligonucleotide
tcatgatcctaccctgcctagtgaccctccatctgtga

SEQ ID NO: 42293 - DNA, 38 bp, Artificial Sequence
  Synthetic oligonucleotide
gtaacccacgtgctaaacagcacttcgccttcgcttga

SEQ ID NO: 42294 - DNA, 36 bp, Artificial Sequence
  Synthetic oligonucleotide
gcaagggggcttagccgtgaaacacgccacgcatta

SEQ ID NO: 42295 - DNA, 36 bp, Artificial Sequence
  Synthetic oligonucleotide
gccagacacgcctagcccccgccctccggtttgtta

SEQ ID NO: 42296 - DNA, 35 bp, Artificial Sequence
  Synthetic oligonucleotide
tctaagtcggcgcccccatggccttgcacgcgcac

SEQ ID NO: 42297 - DNA, 35 bp, Artificial Sequence
  Synthetic oligonucleotide
gctgtaccactgcctttgatcagtctgaacttgac

SEQ ID NO: 42298 - DNA, 35 bp, Artificial Sequence
  Synthetic oligonucleotide
tcaaccccagggactcgaccaggattaataccgcc

SEQ ID NO: 42299 - DNA, 35 bp, Artificial Sequence
  Synthetic oligonucleotide
gtctgtggaaggggatatcggggaagagttacagc

SEQ ID NO: 42300 - DNA, 35 bp, Artificial Sequence
  Synthetic oligonucleotide
tgaggggtgtagtcaactaaggggggcgggggagc

SEQ ID NO: 42301 - DNA, 35 bp, Artificial Sequence
  Synthetic oligonucleotide
tacagctagcctatgatctcacaaccgacccttgc

SEQ ID NO: 42302 - DNA, 35 bp, Artificial Sequence
  Synthetic oligonucleotide
ggcatcctgcagccgttcctgacccgatctacctc

SEQ ID NO: 42303 - DNA, 35 bp, Artificial Sequence
  Synthetic oligonucleotide
tgatgtctcgcccggaacaagttatatccttcctc

SEQ ID NO: 42304 - DNA, 35 bp, Artificial Sequence
  Synthetic oligonucleotide
atgcccatccaccccacgctcgcccctcattgaag

SEQ ID NO: 42305 - DNA, 35 bp, Artificial Sequence
  Synthetic oligonucleotide
gacgcccccaacactcgaacagacatccttgacgg

SEQ ID NO: 42306 - DNA, 35 bp, Artificial Sequence
  Synthetic oligonucleotide
gcgcatgcccccacgccgcagccgtcttatcccgg

SEQ ID NO: 42307 - DNA, 35 bp, Artificial Sequence
  Synthetic oligonucleotide
gcacgcgcagcactaggtccggacgccatatccct

SEQ ID NO: 42308 - DNA, 35 bp, Artificial Sequence
  Synthetic oligonucleotide
tgcattgtgaactacgttgatgacattcgccctct

SEQ ID NO: 42309 - DNA, 36 bp, Artificial Sequence
  Synthetic oligonucleotide
gacctggctcaatgcatgagccgatccccgtttcca

SEQ ID NO: 42310 - DNA, 35 bp, Artificial Sequence
  Synthetic oligonucleotide
gacgcgcattcgctgggttgccccctacgcactca

SEQ ID NO: 42311 - DNA, 36 bp, Artificial Sequence
  Synthetic oligonucleotide
ttccacacgatgttctgggtcctacgccattattca

SEQ ID NO: 42312 - DNA, 37 bp, Artificial Sequence
  Synthetic oligonucleotide
accgacaggacagaccttcacctaacggcctctacga

SEQ ID NO: 42313 - DNA, 37 bp, Artificial Sequence
  Synthetic oligonucleotide
acgccggacctccacctttacaacgaaatggcttcga

SEQ ID NO: 42314 - DNA, 37 bp, Artificial Sequence
  Synthetic oligonucleotide
gaaaggatgtagcggttgagggaaggcggtgcgagga

SEQ ID NO: 42315 - DNA, 36 bp, Artificial Sequence
  Synthetic oligonucleotide
ttgcccaattgccttaggccgttcctccatctagga

SEQ ID NO: 42316 - DNA, 35 bp, Artificial Sequence
  Synthetic oligonucleotide
gattggcctgagggggagggtgccgtaggcaatga

SEQ ID NO: 42317 - DNA, 38 bp, Artificial Sequence
  Synthetic oligonucleotide
actccacacctccgcactatcgagtgttctactaatga

SEQ ID NO: 42318 - DNA, 38 bp, Artificial Sequence
  Synthetic oligonucleotide
ttaccacgccaattccgtacgaaactgcgcacccatga

SEQ ID NO: 42319 - DNA, 38 bp, Artificial Sequence
  Synthetic oligonucleotide
gcataaagggggaggcacaagggaggggtgggggctga

SEQ ID NO: 42320 - DNA, 37 bp, Artificial Sequence
  Synthetic oligonucleotide
gacacggagttggcgggaggagattgcagacgcgtga

SEQ ID NO: 42321 - DNA, 37 bp, Artificial Sequence
  Synthetic oligonucleotide
tgcccaccgcaccctttactgttagtcttttttgtga

SEQ ID NO: 42322 - DNA, 37 bp, Artificial Sequence
  Synthetic oligonucleotide
tctcatacacagcgcacgctcctctgtcttcgcttga

SEQ ID NO: 42323 - DNA, 38 bp, Artificial Sequence
  Synthetic oligonucleotide
acgaccgtcactattttttacctacttcacgccgttga

SEQ ID NO: 42324 - DNA, 38 bp, Artificial Sequence
  Synthetic oligonucleotide
gtgcaatctcggctttctttatctcgtcaccgggttga

SEQ ID NO: 42325 - DNA, 36 bp, Artificial Sequence
  Synthetic oligonucleotide
gtttgtgcccttgcctgttttatccagtggctttta

SEQ ID NO: 42326 - DNA, 35 bp, Artificial Sequence
  Synthetic oligonucleotide
gtgaatgtgcagcatattccgtacccccgactgac

SEQ ID NO: 42327 - DNA, 35 bp, Artificial Sequence
  Synthetic oligonucleotide
tccatcgcccgactagcgaggtccttaccacgacc

SEQ ID NO: 42328 - DNA, 35 bp, Artificial Sequence
  Synthetic oligonucleotide
tgtgtgaccgctcgcatacttggccaatagtagcc

SEQ ID NO: 42329 - DNA, 35 bp, Artificial Sequence
  Synthetic oligonucleotide
tcaccacccgtaataccaacgccgcgctaaacgcc

SEQ ID NO: 42330 - DNA, 35 bp, Artificial Sequence
  Synthetic oligonucleotide
tgccctccacacattggatatacggtctcgccgcc

SEQ ID NO: 42331 - DNA, 35 bp, Artificial Sequence
  Synthetic oligonucleotide
tgcctcttccatctacctcctgccatagtgttgcc

SEQ ID NO: 42332 - DNA, 35 bp, Artificial Sequence
  Synthetic oligonucleotide
gaggacaccccgcccttcgaattgaaatcaatcgc

SEQ ID NO: 42333 - DNA, 35 bp, Artificial Sequence
  Synthetic oligonucleotide
gtccttacaccctccagggatcatctggcctgatc

SEQ ID NO: 42334 - DNA, 35 bp, Artificial Sequence
  Synthetic oligonucleotide
tccacccgccttttgttcttgcttactgtaatatc

SEQ ID NO: 42335 - DNA, 35 bp, Artificial Sequence
  Synthetic oligonucleotide
tcacccccttagcctccaaaggtatactttcttag

SEQ ID NO: 42336 - DNA, 35 bp, Artificial Sequence
  Synthetic oligonucleotide
acctgaacagctctacacgcatcctgatgaacctg

SEQ ID NO: 42337 - DNA, 35 bp, Artificial Sequence
  Synthetic oligonucleotide
attacgcgaatgtgatctttcctctgctgttcaca

SEQ ID NO: 42338 - DNA, 36 bp, Artificial Sequence
  Synthetic oligonucleotide
accgcacgcaacctagcttgtctagtaacctttaca

SEQ ID NO: 42339 - DNA, 36 bp, Artificial Sequence
  Synthetic oligonucleotide
aagtgcggcacagaagtttcctgcgctcaactctca

SEQ ID NO: 42340 - DNA, 36 bp, Artificial Sequence
  Synthetic oligonucleotide
gctgagagcggccgcttcacatccttggttttctca

SEQ ID NO: 42341 - DNA, 36 bp, Artificial Sequence
  Synthetic oligonucleotide
tacttgccatacatacatcacgcctgactgccgaga

SEQ ID NO: 42342 - DNA, 37 bp, Artificial Sequence
  Synthetic oligonucleotide
tctagcccactagttttctcatcagccctacccgcga

SEQ ID NO: 42343 - DNA, 36 bp, Artificial Sequence
  Synthetic oligonucleotide
ttaggcggggtgagaggtgggggggaattgggtcga

SEQ ID NO: 42344 - DNA, 37 bp, Artificial Sequence
  Synthetic oligonucleotide
gccacatacgcaccatccctaaagagatattgctgga

SEQ ID NO: 42345 - DNA, 37 bp, Artificial Sequence
  Synthetic oligonucleotide
gatgctgcagagcatctggtaccctttcttaattgga

SEQ ID NO: 42346 - DNA, 38 bp, Artificial Sequence
  Synthetic oligonucleotide
tccgtcgccgccgtttggtccaattctatcactactga

SEQ ID NO: 42347 - DNA, 38 bp, Artificial Sequence
  Synthetic oligonucleotide
gtcgaggggagagcggtgtaggagtgatatggaagtga

SEQ ID NO: 42348 - DNA, 38 bp, Artificial Sequence
  Synthetic oligonucleotide
ggacgccatcgggtgctccggatcttccctcttcttga

SEQ ID NO: 42349 - DNA, 37 bp, Artificial Sequence
  Synthetic oligonucleotide
accaccttgcagtgtgcgccattatccctccatttga

SEQ ID NO: 42350 - DNA, 37 bp, Artificial Sequence
  Synthetic oligonucleotide
gtagccacctcgcccggttctcgcttgatagctttga

SEQ ID NO: 42351 - DNA, 35 bp, Artificial Sequence
  Synthetic oligonucleotide
gacctccgcatggcctgttttccactgcaaaatta

SEQ ID NO: 42352 - DNA, 35 bp, Artificial Sequence
  Synthetic oligonucleotide
gacctcaaaccgaaaagccacaggaccctgccgac

SEQ ID NO: 42353 - DNA, 34 bp, Artificial Sequence
  Synthetic oligonucleotide
ttggacccgccatggaacgcgtaccaatttaccc

SEQ ID NO: 42354 - DNA, 35 bp, Artificial Sequence
  Synthetic oligonucleotide
tgacactccccgtcactgcctctttgtttgctgcc

SEQ ID NO: 42355 - DNA, 35 bp, Artificial Sequence
  Synthetic oligonucleotide
gttccctgccatcttagcccgatgcggaccttgtc

SEQ ID NO: 42356 - DNA, 35 bp, Artificial Sequence
  Synthetic oligonucleotide
tcacccgcgcgtatgtgcctacccccttataattc

SEQ ID NO: 42357 - DNA, 35 bp, Artificial Sequence
  Synthetic oligonucleotide
gcacgactcgccttatcaatcctatggaccgcacg

SEQ ID NO: 42358 - DNA, 35 bp, Artificial Sequence
  Synthetic oligonucleotide
agtgccgtggccgttccggtacgcatattccttcg

SEQ ID NO: 42359 - DNA, 35 bp, Artificial Sequence
  Synthetic oligonucleotide
ttaggcaactgttgctgtctttggccctacatcct

SEQ ID NO: 42360 - DNA, 35 bp, Artificial Sequence
  Synthetic oligonucleotide
gtctacacaagactgcgattgcccacgttcccatt

SEQ ID NO: 42361 - DNA, 35 bp, Artificial Sequence
  Synthetic oligonucleotide
gccctgtgcgccaggcttttacgtatgttcacctt

SEQ ID NO: 42362 - DNA, 35 bp, Artificial Sequence
  Synthetic oligonucleotide
acgtacaccctctcgccttggtccacgaagtcctt

SEQ ID NO: 42363 - DNA, 36 bp, Artificial Sequence
  Synthetic oligonucleotide
ggggccgtccatcttagtaatttgattctcctgcaa

SEQ ID NO: 42364 - DNA, 36 bp, Artificial Sequence
  Synthetic oligonucleotide
gcgtggaggagtgggaaatgctgatatcgggaggaa

SEQ ID NO: 42365 - DNA, 36 bp, Artificial Sequence
  Synthetic oligonucleotide
gacctcgagagctggaccttcgagggtacctattaa

SEQ ID NO: 42366 - DNA, 35 bp, Artificial Sequence
  Synthetic oligonucleotide
gtacatccctcgtcctatcctacggtctcttgaca

SEQ ID NO: 42367 - DNA, 35 bp, Artificial Sequence
  Synthetic oligonucleotide
aagcctggggccaggctacctctttaaactgtaca

SEQ ID NO: 42368 - DNA, 36 bp, Artificial Sequence
  Synthetic oligonucleotide
acccacgtctcgcgacgcggtatctttacttcacca

SEQ ID NO: 42369 - DNA, 36 bp, Artificial Sequence
  Synthetic oligonucleotide
tacccctagggtacacgtgaccactatcctattgca

SEQ ID NO: 42370 - DNA, 36 bp, Artificial Sequence
  Synthetic oligonucleotide
atctcatgccggttcgtagcctacacctgtgaatca

SEQ ID NO: 42371 - DNA, 37 bp, Artificial Sequence
  Synthetic oligonucleotide
taccctggtacgctgcgtcgcctcccaatcctgcaga

SEQ ID NO: 42372 - DNA, 36 bp, Artificial Sequence
  Synthetic oligonucleotide
tacaaccacatcttcaccgctcgtaggactgcacga

SEQ ID NO: 42373 - DNA, 36 bp, Artificial Sequence
  Synthetic oligonucleotide
agacatcctacctcgtgttccacatccaatcttcga

SEQ ID NO: 42374 - DNA, 37 bp, Artificial Sequence
  Synthetic oligonucleotide
gtggagagcctcccactggtacaatccgccatccgga

SEQ ID NO: 42375 - DNA, 37 bp, Artificial Sequence
  Synthetic oligonucleotide
aaaacgacgagcggattggaacgctggagggggggga

SEQ ID NO: 42376 - DNA, 37 bp, Artificial Sequence
  Synthetic oligonucleotide
accgcaataccccctgctccggagtcttccgtatgga

SEQ ID NO: 42377 - DNA, 37 bp, Artificial Sequence
  Synthetic oligonucleotide
gatgacaggtggaggatgggtgaccgctgttagtgga

SEQ ID NO: 42378 - DNA, 38 bp, Artificial Sequence
  Synthetic oligonucleotide
tccagacgactcactaataatgctagctccccacatga

SEQ ID NO: 42379 - DNA, 37 bp, Artificial Sequence
  Synthetic oligonucleotide
gtcagatcgccaccatctagctgctacttccgcctga

SEQ ID NO: 42380 - DNA, 38 bp, Artificial Sequence
  Synthetic oligonucleotide
tatgacaccgctgagttactacctatccacatagctga

SEQ ID NO: 42381 - DNA, 37 bp, Artificial Sequence
  Synthetic oligonucleotide
gaaaagagtggggggaaggagaatgtacaccggttga

SEQ ID NO: 42382 - DNA, 35 bp, Artificial Sequence
  Synthetic oligonucleotide
tactatgcgcaagctttacccttctggacatcata

SEQ ID NO: 42383 - DNA, 35 bp, Artificial Sequence
  Synthetic oligonucleotide
gagaccctagcaagtctttcacgccctggtaatac

SEQ ID NO: 42384 - DNA, 35 bp, Artificial Sequence
  Synthetic oligonucleotide
tgttcaagcgcagtaaccatcttgcttctttcccc

SEQ ID NO: 42385 - DNA, 35 bp, Artificial Sequence
  Synthetic oligonucleotide
atgagtccgtccaaccatccagtaggaacttagcc

SEQ ID NO: 42386 - DNA, 35 bp, Artificial Sequence
  Synthetic oligonucleotide
gtgtgaccacgcccttcccatacccgtatcagtcc

SEQ ID NO: 42387 - DNA, 35 bp, Artificial Sequence
  Synthetic oligonucleotide
attgccatgacgcagacgacatctcttctcgcatc

SEQ ID NO: 42388 - DNA, 35 bp, Artificial Sequence
  Synthetic oligonucleotide
gtattcagccggtcccttcgcaaaagctggctatc

SEQ ID NO: 42389 - DNA, 35 bp, Artificial Sequence
  Synthetic oligonucleotide
gttgcacctagcccaccggcgattgagctttagtc

SEQ ID NO: 42390 - DNA, 35 bp, Artificial Sequence
  Synthetic oligonucleotide
tctacattctaccggtgctttcctgggcctttgtc

SEQ ID NO: 42391 - DNA, 35 bp, Artificial Sequence
  Synthetic oligonucleotide
gcgctgcctcctccgggagcagcccaatgaatttc

SEQ ID NO: 42392 - DNA, 35 bp, Artificial Sequence
  Synthetic oligonucleotide
ttctctcagccacggtctctccttccactcaacgg

SEQ ID NO: 42393 - DNA, 35 bp, Artificial Sequence
  Synthetic oligonucleotide
tcatgccaaacccggcctcccccccggcctttaat

SEQ ID NO: 42394 - DNA, 35 bp, Artificial Sequence
  Synthetic oligonucleotide
acttgtcccctgatccgaagctgcctgcctgccat

SEQ ID NO: 42395 - DNA, 35 bp, Artificial Sequence
  Synthetic oligonucleotide
acagacaggggggaggagcaaagtgtgactgatct

SEQ ID NO: 42396 - DNA, 35 bp, Artificial Sequence
  Synthetic oligonucleotide
accaaaccgagcgccacaattctgtcgtactttct

SEQ ID NO: 42397 - DNA, 35 bp, Artificial Sequence
  Synthetic oligonucleotide
aacacggtccgtgtaagcctacttatttcgcctgt

SEQ ID NO: 42398 - DNA, 35 bp, Artificial Sequence
  Synthetic oligonucleotide
ttcgtcctggcccccatctaagtgaaactgcgatt

SEQ ID NO: 42399 - DNA, 35 bp, Artificial Sequence
  Synthetic oligonucleotide
ggacgaacatcaccctagaactgaacacaggcctt

SEQ ID NO: 42400 - DNA, 35 bp, Artificial Sequence
  Synthetic oligonucleotide
tcacgcctacccccagtttaacactcttgatattt

SEQ ID NO: 42401 - DNA, 36 bp, Artificial Sequence
  Synthetic oligonucleotide
atcgacgatctgcgccgcccgaacgcactcccacaa

SEQ ID NO: 42402 - DNA, 36 bp, Artificial Sequence
  Synthetic oligonucleotide
gcgcactgtagccaggtcccgcatacgtatccctaa

SEQ ID NO: 42403 - DNA, 35 bp, Artificial Sequence
  Synthetic oligonucleotide
atgtccactacccatactgtagcagtaccttgaca

SEQ ID NO: 42404 - DNA, 36 bp, Artificial Sequence
  Synthetic oligonucleotide
gtatgcgtaagcctgtcccatcccttttacgactca

SEQ ID NO: 42405 - DNA, 37 bp, Artificial Sequence
  Synthetic oligonucleotide
acaaagggtaggggacgaaccagagagggtgtgcaga

SEQ ID NO: 42406 - DNA, 37 bp, Artificial Sequence
  Synthetic oligonucleotide
accaagccgcatttaaaggatcgcccgccctgcccga

SEQ ID NO: 42407 - DNA, 37 bp, Artificial Sequence
  Synthetic oligonucleotide
ttgagccaaccacctgaccgcttgactagacactgga

SEQ ID NO: 42408 - DNA, 37 bp, Artificial Sequence
  Synthetic oligonucleotide
tagggatgcaggtttgacggaggggctggagggtgga

SEQ ID NO: 42409 - DNA, 37 bp, Artificial Sequence
  Synthetic oligonucleotide
ggaagttgggtgggaatgggaatgggacatggtatga

SEQ ID NO: 42410 - DNA, 36 bp, Artificial Sequence
  Synthetic oligonucleotide
tagtccagcgtaaccactgcgaccccctacccctga

SEQ ID NO: 42411 - DNA, 38 bp, Artificial Sequence
  Synthetic oligonucleotide
gtgacgtgtgcatcagcttattcttgccctcttagtga

SEQ ID NO: 42412 - DNA, 37 bp, Artificial Sequence
  Synthetic oligonucleotide
aaatccactgaggcagggggtgggggggactacgtga

SEQ ID NO: 42413 - DNA, 36 bp, Artificial Sequence
  Synthetic oligonucleotide
aacaggctgaagtggggaaaatgggttacagggtga

SEQ ID NO: 42414 - DNA, 38 bp, Artificial Sequence
  Synthetic oligonucleotide
aaccgcaactgggcaccggctcccctcaacgaagttga

SEQ ID NO: 42415 - DNA, 38 bp, Artificial Sequence
  Synthetic oligonucleotide
gatctccacgcccactgaccacgcactcaaaatgttga

SEQ ID NO: 42416 - DNA, 36 bp, Artificial Sequence
  Synthetic oligonucleotide
gacctctcatcactatagtcgcaatggttccccata

SEQ ID NO: 42417 - DNA, 35 bp, Artificial Sequence
  Synthetic oligonucleotide
tgtggtgggccgccggcattactcctggatctcac

SEQ ID NO: 42418 - DNA, 35 bp, Artificial Sequence
  Synthetic oligonucleotide
atcggaatgcacttccaaccgagtaaacgctgccc

SEQ ID NO: 42419 - DNA, 35 bp, Artificial Sequence
  Synthetic oligonucleotide
ttagcaaacgtgttacgtgcagctccaaccactcc

SEQ ID NO: 42420 - DNA, 35 bp, Artificial Sequence
  Synthetic oligonucleotide
gtccccagtccgccatcaactcactgttagcgagc

SEQ ID NO: 42421 - DNA, 35 bp, Artificial Sequence
  Synthetic oligonucleotide
ttatccctgctggtgtctggacgtaccgtgccctc

SEQ ID NO: 42422 - DNA, 36 bp, Artificial Sequence
  Synthetic oligonucleotide
gccacccatgatatggtcctaaacctaagccaaccg

SEQ ID NO: 42423 - DNA, 35 bp, Artificial Sequence
  Synthetic oligonucleotide
ggtggtcggagggtccgttgctccccacttgatcg

SEQ ID NO: 42424 - DNA, 35 bp, Artificial Sequence
  Synthetic oligonucleotide
gcacatccctgctggaatagcgtaccatctatcat

SEQ ID NO: 42425 - DNA, 35 bp, Artificial Sequence
  Synthetic oligonucleotide
atccttccaatgctgtgatgcatcgcaatagccct

SEQ ID NO: 42426 - DNA, 35 bp, Artificial Sequence
  Synthetic oligonucleotide
atgcatgcaacaaatgactatcccgattccgccct

SEQ ID NO: 42427 - DNA, 35 bp, Artificial Sequence
  Synthetic oligonucleotide
taaaccagttggtaccgcccacccgatgcttccct

SEQ ID NO: 42428 - DNA, 36 bp, Artificial Sequence
  Synthetic oligonucleotide
ttcgcggtcacccatccctgcattccaactgcgaca

SEQ ID NO: 42429 - DNA, 35 bp, Artificial Sequence
  Synthetic oligonucleotide
gcctgactgctgttcaacgtctgccggatccacca

SEQ ID NO: 42430 - DNA, 36 bp, Artificial Sequence
  Synthetic oligonucleotide
gacgggctctctgacgccgcacactaaacttctcca

SEQ ID NO: 42431 - DNA, 35 bp, Artificial Sequence
  Synthetic oligonucleotide
gcaatcactagcgtgtcttttctatcacgtcatca

SEQ ID NO: 42432 - DNA, 35 bp, Artificial Sequence
  Synthetic oligonucleotide
acatgcgcactaacgggttggtgctacgaatttca

SEQ ID NO: 42433 - DNA, 37 bp, Artificial Sequence
  Synthetic oligonucleotide
atgtgccctccatgccccggaaaactgtttctcgaga

SEQ ID NO: 42434 - DNA, 37 bp, Artificial Sequence
  Synthetic oligonucleotide
acatctcctgttactcgcatacatcacccctgtggga

SEQ ID NO: 42435 - DNA, 36 bp, Artificial Sequence
  Synthetic oligonucleotide
tctcagcgggagggcacggggggcgagaggtttgga

SEQ ID NO: 42436 - DNA, 37 bp, Artificial Sequence
  Synthetic oligonucleotide
aacgggcgtggagatggagggcgggctaaacatatga

SEQ ID NO: 42437 - DNA, 37 bp, Artificial Sequence
  Synthetic oligonucleotide
accgttatcccctcgttgtgcctgtttgtgaacctga

SEQ ID NO: 42438 - DNA, 37 bp, Artificial Sequence
  Synthetic oligonucleotide
gcgtgccctcccccccatgctagcttgtttcgcctga

SEQ ID NO: 42439 - DNA, 38 bp, Artificial Sequence
  Synthetic oligonucleotide
gccatgtgggggtagggagcgggggtagacgcccttga

SEQ ID NO: 42440 - DNA, 36 bp, Artificial Sequence
  Synthetic oligonucleotide
gcaacgccattgtaacactctgtacacctctcttga

SEQ ID NO: 42441 - DNA, 36 bp, Artificial Sequence
  Synthetic oligonucleotide
tgtccgggatcccttccgcaacaacacccccgttta

SEQ ID NO: 42442 - DNA, 35 bp, Artificial Sequence
  Synthetic oligonucleotide
gccctgcctgccgcccttctgggtacatcctcaac

SEQ ID NO: 42443 - DNA, 35 bp, Artificial Sequence
  Synthetic oligonucleotide
actctactaccccgcagaatactagctgaaagccc

SEQ ID NO: 42444 - DNA, 35 bp, Artificial Sequence
  Synthetic oligonucleotide
tactgaatccgctattttacgcccgttaccttgcc

SEQ ID NO: 42445 - DNA, 35 bp, Artificial Sequence
  Synthetic oligonucleotide
ttatccccccattatgtgtagagttcgtttcatcc

SEQ ID NO: 42446 - DNA, 35 bp, Artificial Sequence
  Synthetic oligonucleotide
ccacgtccatatccctgtagtgtcttcctgtctgc

SEQ ID NO: 42447 - DNA, 35 bp, Artificial Sequence
  Synthetic oligonucleotide
atgtacatgtcgcccgtctatataacgccgcgtgc

SEQ ID NO: 42448 - DNA, 35 bp, Artificial Sequence
  Synthetic oligonucleotide
gcacacaactctagcaaggttttctggacgtggtc

SEQ ID NO: 42449 - DNA, 35 bp, Artificial Sequence
  Synthetic oligonucleotide
ttcgcgtgaccctactgtaccaaacacccgagttc

SEQ ID NO: 42450 - DNA, 35 bp, Artificial Sequence
  Synthetic oligonucleotide
ttggtgctcctcacaagatccctcagttcaccgcg

SEQ ID NO: 42451 - DNA, 35 bp, Artificial Sequence
  Synthetic oligonucleotide
gacttgtctcatatccgtctctttgccactccgcg

SEQ ID NO: 42452 - DNA, 35 bp, Artificial Sequence
  Synthetic oligonucleotide
gcgtggatcaatggcttagggggagtgggggcatg

SEQ ID NO: 42453 - DNA, 35 bp, Artificial Sequence
  Synthetic oligonucleotide
aatgctgtctgcaaacatgcggtactatcttcact

SEQ ID NO: 42454 - DNA, 35 bp, Artificial Sequence
  Synthetic oligonucleotide
acttcggggccttgcgattcaccgtcctctactct

SEQ ID NO: 42455 - DNA, 35 bp, Artificial Sequence
  Synthetic oligonucleotide
gtcctgtccttcatccacggagcttttgttactct

SEQ ID NO: 42456 - DNA, 35 bp, Artificial Sequence
  Synthetic oligonucleotide
tttgacatgccacaccagcacttgattattggtct

SEQ ID NO: 42457 - DNA, 36 bp, Artificial Sequence
  Synthetic oligonucleotide
gtgccgagtgcaacgcatcatcctcgttccccacaa

SEQ ID NO: 42458 - DNA, 34 bp, Artificial Sequence
  Synthetic oligonucleotide
actccgtcagactctacaaccctcttagcttcaa

SEQ ID NO: 42459 - DNA, 36 bp, Artificial Sequence
  Synthetic oligonucleotide
gaaaagccatgtggtgtatgaaaagtgggaggggaa

SEQ ID NO: 42460 - DNA, 36 bp, Artificial Sequence
  Synthetic oligonucleotide
actgccccataatacgtgggaactccacttgcacca

SEQ ID NO: 42461 - DNA, 36 bp, Artificial Sequence
  Synthetic oligonucleotide
agtatagcctcctcactcgctccgttacgttcacca

SEQ ID NO: 42462 - DNA, 36 bp, Artificial Sequence
  Synthetic oligonucleotide
taccaatcccagctctctaggcctcttccagaagca

SEQ ID NO: 42463 - DNA, 37 bp, Artificial Sequence
  Synthetic oligonucleotide
gaccacgtgccctgtggttcgcaaatcattattccga

SEQ ID NO: 42464 - DNA, 36 bp, Artificial Sequence
  Synthetic oligonucleotide
gtgccacgaaccgaaactgaatgccttatgcttgga

SEQ ID NO: 42465 - DNA, 37 bp, Artificial Sequence
  Synthetic oligonucleotide
gtgtgagcaaactggggggagatcgggtgctggctga

SEQ ID NO: 42466 - DNA, 37 bp, Artificial Sequence
  Synthetic oligonucleotide
aaacccgctccttacctaactgcacgatgtaccgtga

SEQ ID NO: 42467 - DNA, 38 bp, Artificial Sequence
  Synthetic oligonucleotide
tcctggtgctccccgtctatccagtccaatgtttgtga

SEQ ID NO: 42468 - DNA, 37 bp, Artificial Sequence
  Synthetic oligonucleotide
tccccatacacgccaggtgccaccactccttgcttga

SEQ ID NO: 42469 - DNA, 36 bp, Artificial Sequence
  Synthetic oligonucleotide
tgcatcagcataccatcctacttagtctccgctcta

SEQ ID NO: 42470 - DNA, 36 bp, Artificial Sequence
  Synthetic oligonucleotide
gtccacatacccatgcgctaagcccccccagttgta

SEQ ID NO: 42471 - DNA, 35 bp, Artificial Sequence
  Synthetic oligonucleotide
actgccaccaacactgccacttataggactcatcc

SEQ ID NO: 42472 - DNA, 35 bp, Artificial Sequence
  Synthetic oligonucleotide
aaacctgaggctgcgcggtattcgcccactcctcc

SEQ ID NO: 42473 - DNA, 35 bp, Artificial Sequence
  Synthetic oligonucleotide
gtgttcctaccgctatcctactatgtcagggctcc

SEQ ID NO: 42474 - DNA, 35 bp, Artificial Sequence
  Synthetic oligonucleotide
gtcgctttgcacacgtgggctttacttatctcatc

SEQ ID NO: 42475 - DNA, 35 bp, Artificial Sequence
  Synthetic oligonucleotide
gtcgcgacactcgagagtcctagccactttctatc

SEQ ID NO: 42476 - DNA, 35 bp, Artificial Sequence
  Synthetic oligonucleotide
gttctccggccactttccttacgtctcgtaggctc

SEQ ID NO: 42477 - DNA, 35 bp, Artificial Sequence
  Synthetic oligonucleotide
tccccttcgatgtgatgttcgccctcattccgttc

SEQ ID NO: 42478 - DNA, 35 bp, Artificial Sequence
  Synthetic oligonucleotide
tctgcggggttagggcgggagggatcaatggtaag

SEQ ID NO: 42479 - DNA, 35 bp, Artificial Sequence
  Synthetic oligonucleotide
gtgaaggtgggggaaagtcaatgcagcagctggag

SEQ ID NO: 42480 - DNA, 35 bp, Artificial Sequence
  Synthetic oligonucleotide
gccacgaccgcaacgttttagtctgccactgtacg

SEQ ID NO: 42481 - DNA, 35 bp, Artificial Sequence
  Synthetic oligonucleotide
ttgcacccactccgtccatagtctctgaacgccgt

SEQ ID NO: 42482 - DNA, 36 bp, Artificial Sequence
  Synthetic oligonucleotide
catgggaccggcccacacttgcattcccgacgtaaa

SEQ ID NO: 42483 - DNA, 35 bp, Artificial Sequence
  Synthetic oligonucleotide
gacccgcatctattagcccacaacaacgagggaca

SEQ ID NO: 42484 - DNA, 35 bp, Artificial Sequence
  Synthetic oligonucleotide
gagtcgaccgatcactcatttggcctggtttgaca

SEQ ID NO: 42485 - DNA, 35 bp, Artificial Sequence
  Synthetic oligonucleotide
gactcgggtcctctcccttcacgttacgccttaca

SEQ ID NO: 42486 - DNA, 36 bp, Artificial Sequence
  Synthetic oligonucleotide
gtgcgtcattcctgtccatttttgcttaggtccgca

SEQ ID NO: 42487 - DNA, 36 bp, Artificial Sequence
  Synthetic oligonucleotide
aaatgctgtgaagggggaaccggagggggaggtgca

SEQ ID NO: 42488 - DNA, 35 bp, Artificial Sequence
  Synthetic oligonucleotide
tacgccgcaaggtcatcatgactcaacaccttgca

SEQ ID NO: 42489 - DNA, 36 bp, Artificial Sequence
  Synthetic oligonucleotide
gttcggggtgggacttgggctgaagggagagaatca

SEQ ID NO: 42490 - DNA, 36 bp, Artificial Sequence
  Synthetic oligonucleotide
cccggtggccacccatgcctattgcttccgttatca

SEQ ID NO: 42491 - DNA, 36 bp, Artificial Sequence
  Synthetic oligonucleotide
gaccgcccaataagttgcacgtaccgatctctttca

SEQ ID NO: 42492 - DNA, 37 bp, Artificial Sequence
  Synthetic oligonucleotide
atatcaccccatgcccaggcgaatcaaacgattccga

SEQ ID NO: 42493 - DNA, 36 bp, Artificial Sequence
  Synthetic oligonucleotide
agcaaactaaaagcggtaggaatcaagggagggcga

SEQ ID NO: 42494 - DNA, 37 bp, Artificial Sequence
  Synthetic oligonucleotide
gtgcctgtccactatctgaccctgccccggtcccgga

SEQ ID NO: 42495 - DNA, 38 bp, Artificial Sequence
  Synthetic oligonucleotide
gactggcccagaccgtcttttacactttttacctatga

SEQ ID NO: 42496 - DNA, 38 bp, Artificial Sequence
  Synthetic oligonucleotide
acatccgcggcacctttacgcgattgtacccccactga

SEQ ID NO: 42497 - DNA, 38 bp, Artificial Sequence
  Synthetic oligonucleotide
tacgtgcacatattcgggtgggtgggggagggccctga

SEQ ID NO: 42498 - DNA, 38 bp, Artificial Sequence
  Synthetic oligonucleotide
gccgccctgcgcccccgcaccaagcatacgttccctga

SEQ ID NO: 42499 - DNA, 38 bp, Artificial Sequence
  Synthetic oligonucleotide
gtccaccctctaaaatctgcctccaacaggtctagtga

SEQ ID NO: 42500 - DNA, 36 bp, Artificial Sequence
  Synthetic oligonucleotide
atctaggcaacaaatctatctccggacctgtagtga

SEQ ID NO: 42501 - DNA, 35 bp, Artificial Sequence
  Synthetic oligonucleotide
gccaactaactccagaacgaacagcggtcacaata

SEQ ID NO: 42502 - DNA, 36 bp, Artificial Sequence
  Synthetic oligonucleotide
gcagatcgggtcccatctctagtccactgcagtata

SEQ ID NO: 42503 - DNA, 36 bp, Artificial Sequence
  Synthetic oligonucleotide
atctgctacctggcctgggtacccaccgttttgcta

SEQ ID NO: 42504 - DNA, 36 bp, Artificial Sequence
  Synthetic oligonucleotide
tagtagcctcgcctgctcatgatccttttcccagta

SEQ ID NO: 42505 - DNA, 36 bp, Artificial Sequence
  Synthetic oligonucleotide
ttggagcacaaggggccaccctaaacctgctcttta

SEQ ID NO: 42506 - DNA, 35 bp, Artificial Sequence
  Synthetic oligonucleotide
ttcccccactccctcggaactgtcttcttcgttta

SEQ ID NO: 42507 - DNA, 35 bp, Artificial Sequence
  Synthetic oligonucleotide
ttggtccgtctaaacgcccgctttaccttgatcac

SEQ ID NO: 42508 - DNA, 35 bp, Artificial Sequence
  Synthetic oligonucleotide
aacactgctgatcctgaacttcattactatttgac

SEQ ID NO: 42509 - DNA, 35 bp, Artificial Sequence
  Synthetic oligonucleotide
gatgcaacaacataacgactcccctggcagtaccc

SEQ ID NO: 42510 - DNA, 35 bp, Artificial Sequence
  Synthetic oligonucleotide
actaaggaccagctcacacttccatggtccacccc

SEQ ID NO: 42511 - DNA, 35 bp, Artificial Sequence
  Synthetic oligonucleotide
tccggaccacgcgaaactgtttcctcccctacagc

SEQ ID NO: 42512 - DNA, 35 bp, Artificial Sequence
  Synthetic oligonucleotide
gaaaccaaccacgacccgagctaccctggcatagc

SEQ ID NO: 42513 - DNA, 35 bp, Artificial Sequence
  Synthetic oligonucleotide
aacagtcagtcacccctgcgtgcccaaaatcccgc

SEQ ID NO: 42514 - DNA, 35 bp, Artificial Sequence
  Synthetic oligonucleotide
gccaccgtacacctcctaccgtcaggaagtccctc

SEQ ID NO: 42515 - DNA, 34 bp, Artificial Sequence
  Synthetic oligonucleotide
actgctcactcaaccttccctcgtggcaacggtc

SEQ ID NO: 42516 - DNA, 35 bp, Artificial Sequence
  Synthetic oligonucleotide
acgttcctgtgcactgtgccttaacgccgataccg

SEQ ID NO: 42517 - DNA, 35 bp, Artificial Sequence
  Synthetic oligonucleotide
ttccctccccgccccatgtccttacaatgcacccg

SEQ ID NO: 42518 - DNA, 35 bp, Artificial Sequence
  Synthetic oligonucleotide
tcccggttccacccctactggacagtccatattgg

SEQ ID NO: 42519 - DNA, 35 bp, Artificial Sequence
  Synthetic oligonucleotide
accaactcatgcacttgcagatgcatctagtgcat

SEQ ID NO: 42520 - DNA, 35 bp, Artificial Sequence
  Synthetic oligonucleotide
gttccaaacccgccatattgtccgaactccagtat

SEQ ID NO: 42521 - DNA, 35 bp, Artificial Sequence
  Synthetic oligonucleotide
gaccgggccaccgaaaacccttagccctacgcact

SEQ ID NO: 42522 - DNA, 35 bp, Artificial Sequence
  Synthetic oligonucleotide
tcatagtcagctgtcatagtaacctatccgcacct

SEQ ID NO: 42523 - DNA, 35 bp, Artificial Sequence
  Synthetic oligonucleotide
ttgcacgccccggccctttactattggctgtgcct

SEQ ID NO: 42524 - DNA, 34 bp, Artificial Sequence
  Synthetic oligonucleotide
tgctacccgactgagttctgcaatttccctcgct

SEQ ID NO: 42525 - DNA, 35 bp, Artificial Sequence
  Synthetic oligonucleotide
agtggccggtgattccaactgctcgtgtcctctct

SEQ ID NO: 42526 - DNA, 35 bp, Artificial Sequence
  Synthetic oligonucleotide
taccgcattagctgccggtcaaacaacttttgtct

SEQ ID NO: 42527 - DNA, 35 bp, Artificial Sequence
  Synthetic oligonucleotide
gtctggctcctctgtgctcgccaggtcccgcttct

SEQ ID NO: 42528 - DNA, 35 bp, Artificial Sequence
  Synthetic oligonucleotide
ttcagctcccgcgcgacctcttatcatgtactagt

SEQ ID NO: 42529 - DNA, 36 bp, Artificial Sequence
  Synthetic oligonucleotide
tgacctgttaagggtgaggggcaagggagacactaa

SEQ ID NO: 42530 - DNA, 35 bp, Artificial Sequence
  Synthetic oligonucleotide
tgccaactgcactggctccgaagtatctgccccca

SEQ ID NO: 42531 - DNA, 36 bp, Artificial Sequence
  Synthetic oligonucleotide
gaccaaacggccagccgctattcagcctgccctcca

SEQ ID NO: 42532 - DNA, 36 bp, Artificial Sequence
  Synthetic oligonucleotide
acgggccacgcctgcctctctcgtcttttggttgca

SEQ ID NO: 42533 - DNA, 36 bp, Artificial Sequence
  Synthetic oligonucleotide
agactctggcgcaacaactatacgtcctgctactca

SEQ ID NO: 42534 - DNA, 36 bp, Artificial Sequence
  Synthetic oligonucleotide
atccaccctggattcgacccgccgttattctgctca

SEQ ID NO: 42535 - DNA, 36 bp, Artificial Sequence
  Synthetic oligonucleotide
ggtcctatcgttgctgttctccgcctgtccccttca

SEQ ID NO: 42536 - DNA, 37 bp, Artificial Sequence
  Synthetic oligonucleotide
tccatgcactgatacgcgccccgccacgagcccacga

SEQ ID NO: 42537 - DNA, 37 bp, Artificial Sequence
  Synthetic oligonucleotide
ggatcccaacccgatatgtaaactgcctccgttacga

SEQ ID NO: 42538 - DNA, 36 bp, Artificial Sequence
  Synthetic oligonucleotide
gtcccccgctgttgcctgtagtagctctgtttccga

SEQ ID NO: 42539 - DNA, 35 bp, Artificial Sequence
  Synthetic oligonucleotide
gcattgcagatcccctgttcctgtttcttacgcga

SEQ ID NO: 42540 - DNA, 36 bp, Artificial Sequence
  Synthetic oligonucleotide
gaccactcacccagatctgcgtatcgatgccgtcga

SEQ ID NO: 42541 - DNA, 37 bp, Artificial Sequence
  Synthetic oligonucleotide
gcccgagacctcaccacaccctcctccatgacaggga

SEQ ID NO: 42542 - DNA, 37 bp, Artificial Sequence
  Synthetic oligonucleotide
aagagcgtggaggccggaagcagacgggaggtaggga

SEQ ID NO: 42543 - DNA, 38 bp, Artificial Sequence
  Synthetic oligonucleotide
atggtacagtaggcgggaaaaggggcgggcttaaatga

SEQ ID NO: 42544 - DNA, 36 bp, Artificial Sequence
  Synthetic oligonucleotide
tccatcacacgccccacggccagtagagcagtatga

SEQ ID NO: 42545 - DNA, 38 bp, Artificial Sequence
  Synthetic oligonucleotide
acctcacccacatcattccgagccggagacggtcctga

SEQ ID NO: 42546 - DNA, 37 bp, Artificial Sequence
  Synthetic oligonucleotide
aactgtcagggaccgaggaactgaagggaaggagtga

SEQ ID NO: 42547 - DNA, 38 bp, Artificial Sequence
  Synthetic oligonucleotide
tatggcgtgacacgacttgctttctttcccttacgtga

SEQ ID NO: 42548 - DNA, 37 bp, Artificial Sequence
  Synthetic oligonucleotide
aagggccctcacgactaacttgcgcaacatctattga

SEQ ID NO: 42549 - DNA, 34 bp, Artificial Sequence
  Synthetic oligonucleotide
tgtgaagcccgcttcatacctcaccttcccagta

SEQ ID NO: 42550 - DNA, 36 bp, Artificial Sequence
  Synthetic oligonucleotide
gaggcgacagcttcacacaccgacccgcctcctgta

SEQ ID NO: 42551 - DNA, 35 bp, Artificial Sequence
  Synthetic oligonucleotide
acatccaccgccttgatcttatccgccgcctgtta

SEQ ID NO: 42552 - DNA, 35 bp, Artificial Sequence
  Synthetic oligonucleotide
accctacctcgagtgatacacccgccgctgcccac

SEQ ID NO: 42553 - DNA, 35 bp, Artificial Sequence
  Synthetic oligonucleotide
gtccatagggccagttccatcacaccgtcgcaacc

SEQ ID NO: 42554 - DNA, 35 bp, Artificial Sequence
  Synthetic oligonucleotide
tctaccgggtttcccctgtgcaccttcccgagacc

SEQ ID NO: 42555 - DNA, 35 bp, Artificial Sequence
  Synthetic oligonucleotide
ggaacacgtactagtgcagagtgaagccgctaccc

SEQ ID NO: 42556 - DNA, 35 bp, Artificial Sequence
  Synthetic oligonucleotide
ataacgagcagataccgcgatttcccatacctgcc

SEQ ID NO: 42557 - DNA, 35 bp, Artificial Sequence
  Synthetic oligonucleotide
gcctcctggtcttctctgtccatcatgccaacagc

SEQ ID NO: 42558 - DNA, 35 bp, Artificial Sequence
  Synthetic oligonucleotide
tgtaggtctcacctacgtcgtacaatccatcctgc

SEQ ID NO: 42559 - DNA, 35 bp, Artificial Sequence
  Synthetic oligonucleotide
tgtaccaaccggtccccgttgtcacgaaaaatctc

SEQ ID NO: 42560 - DNA, 35 bp, Artificial Sequence
  Synthetic oligonucleotide
agtctggcatcacctgcctcctgaagactcttttc

SEQ ID NO: 42561 - DNA, 35 bp, Artificial Sequence
  Synthetic oligonucleotide
gaagagacacggtggttaaagatggggagctggag

SEQ ID NO: 42562 - DNA, 35 bp, Artificial Sequence
  Synthetic oligonucleotide
tctccaccccatgactggttaccacctctcaaacg

SEQ ID NO: 42563 - DNA, 35 bp, Artificial Sequence
  Synthetic oligonucleotide
gtgagcgaaacgggcggggtgatgctctggagggg

SEQ ID NO: 42564 - DNA, 35 bp, Artificial Sequence
  Synthetic oligonucleotide
gattgcgatacggaacgtccttatgtcccaccaat

SEQ ID NO: 42565 - DNA, 35 bp, Artificial Sequence
  Synthetic oligonucleotide
tgcattacctcgcgccatgtctattcttctggtct

SEQ ID NO: 42566 - DNA, 34 bp, Artificial Sequence
  Synthetic oligonucleotide
gcccaaaaccgttgcatttgtctgcttgtcctgt

SEQ ID NO: 42567 - DNA, 35 bp, Artificial Sequence
  Synthetic oligonucleotide
accgtctaagcctgcctgctcgcatttctcataaa

SEQ ID NO: 42568 - DNA, 36 bp, Artificial Sequence
  Synthetic oligonucleotide
ttgtaagacgggaggggtgcgacaaaggacgagtaa

SEQ ID NO: 42569 - DNA, 36 bp, Artificial Sequence
  Synthetic oligonucleotide
acaggccgggcctgtactcttatgtctcgccgtaca

SEQ ID NO: 42570 - DNA, 36 bp, Artificial Sequence
  Synthetic oligonucleotide
gcacgcgcactttaagtttcggtcaagctccttcca

SEQ ID NO: 42571 - DNA, 36 bp, Artificial Sequence
  Synthetic oligonucleotide
tggggatccgacacgcgtacttacttcctgtttgca

SEQ ID NO: 42572 - DNA, 37 bp, Artificial Sequence
  Synthetic oligonucleotide
gtatagaggactggaaggcgaaaaagacagggggaga

SEQ ID NO: 42573 - DNA, 37 bp, Artificial Sequence
  Synthetic oligonucleotide
gtgcccccgcatcggtcctcacacacaacccacgcga

SEQ ID NO: 42574 - DNA, 37 bp, Artificial Sequence
  Synthetic oligonucleotide
tgaagcggaacatacgaaattctctgccacccaagga

SEQ ID NO: 42575 - DNA, 37 bp, Artificial Sequence
  Synthetic oligonucleotide
tccaccatacagtctattagcgcagattactaccgga

SEQ ID NO: 42576 - DNA, 37 bp, Artificial Sequence
  Synthetic oligonucleotide
gtcagggagcaaggagtgtggggcctgaggatgcgga

SEQ ID NO: 42577 - DNA, 37 bp, Artificial Sequence
  Synthetic oligonucleotide
gtggcgagggcggagaacaatttactgcagggtggga

SEQ ID NO: 42578 - DNA, 37 bp, Artificial Sequence
  Synthetic oligonucleotide
acaccaccacgctttgtgggatctgttctcatactga

SEQ ID NO: 42579 - DNA, 38 bp, Artificial Sequence
  Synthetic oligonucleotide
ttacacccaccatctagagagcttgtctgaggacctga

SEQ ID NO: 42580 - DNA, 38 bp, Artificial Sequence
  Synthetic oligonucleotide
accacgctgcggacattaactgcttctccccgggctga

SEQ ID NO: 42581 - DNA, 37 bp, Artificial Sequence
  Synthetic oligonucleotide
acaacaacgacgggagggggcgaaggcttcttagtga

SEQ ID NO: 42582 - DNA, 38 bp, Artificial Sequence
  Synthetic oligonucleotide
tggagggaactagtggaatggatgagtgaaatgggtga

SEQ ID NO: 42583 - DNA, 38 bp, Artificial Sequence
  Synthetic oligonucleotide
aagcccgcccacgtattaacccctttcacttttattga

SEQ ID NO: 42584 - DNA, 38 bp, Artificial Sequence
  Synthetic oligonucleotide
actgcgtgtagcttctttacctgacttcttcctcttga

SEQ ID NO: 42585 - DNA, 38 bp, Artificial Sequence
  Synthetic oligonucleotide
tgccctagtaccgtccatctcgttcctgtcttggttga

SEQ ID NO: 42586 - DNA, 36 bp, Artificial Sequence
  Synthetic oligonucleotide
gcgtaatgccccccatgctgttatgccacatttgta

SEQ ID NO: 42587 - DNA, 36 bp, Artificial Sequence
  Synthetic oligonucleotide
gtatggcgttgtcgagtcaccacttgcctgctttta

SEQ ID NO: 42588 - DNA, 35 bp, Artificial Sequence
  Synthetic oligonucleotide
atgctggggcggctgccgtaactccgattgcgtac

SEQ ID NO: 42589 - DNA, 35 bp, Artificial Sequence
  Synthetic oligonucleotide
actgggcactaccgcgtgctcccgatatcctaacc

SEQ ID NO: 42590 - DNA, 35 bp, Artificial Sequence
  Synthetic oligonucleotide
gcccacctatttagggtgtctctctatagctaacc

SEQ ID NO: 42591 - DNA, 35 bp, Artificial Sequence
  Synthetic oligonucleotide
ttcgcacgcaatctccgtccccgcccgaaaccacc

SEQ ID NO: 42592 - DNA, 35 bp, Artificial Sequence
  Synthetic oligonucleotide
aactcatgctcccccaccttatgcgcagcatggcc

SEQ ID NO: 42593 - DNA, 35 bp, Artificial Sequence
  Synthetic oligonucleotide
gatgaagcccattccccggcacccccctacttggc

SEQ ID NO: 42594 - DNA, 35 bp, Artificial Sequence
  Synthetic oligonucleotide
ctacgctcgcctctcgactccgccatttttagaag

SEQ ID NO: 42595 - DNA, 35 bp, Artificial Sequence
  Synthetic oligonucleotide
acgccgtcgcgcccacccaactgtatcgaacccag

SEQ ID NO: 42596 - DNA, 35 bp, Artificial Sequence
  Synthetic oligonucleotide
tacgaccgagcttggattcattgccttcatgcccg

SEQ ID NO: 42597 - DNA, 36 bp, Artificial Sequence
  Synthetic oligonucleotide
tcttccacctcgatagcgttaccgggccccatactg

SEQ ID NO: 42598 - DNA, 35 bp, Artificial Sequence
  Synthetic oligonucleotide
aacagtgcggagggatagaaagcagagagcgtgtg

SEQ ID NO: 42599 - DNA, 35 bp, Artificial Sequence
  Synthetic oligonucleotide
gttgtgccagatcggactccttatggcattatcct

SEQ ID NO: 42600 - DNA, 35 bp, Artificial Sequence
  Synthetic oligonucleotide
tggttgtcccagccacaagcaatagccgttttcct

SEQ ID NO: 42601 - DNA, 35 bp, Artificial Sequence
  Synthetic oligonucleotide
tagtacccaacacctgaacatacgaacacattggt

SEQ ID NO: 42602 - DNA, 35 bp, Artificial Sequence
  Synthetic oligonucleotide
tctaccaccctgagctttgtaccgcggagccaatt

SEQ ID NO: 42603 - DNA, 35 bp, Artificial Sequence
  Synthetic oligonucleotide
gcactcttggtgcccgcacctgtctgctatctttt

SEQ ID NO: 42604 - DNA, 36 bp, Artificial Sequence
  Synthetic oligonucleotide
acgaccccccacagcgccttattgtccgttgtctca

SEQ ID NO: 42605 - DNA, 37 bp, Artificial Sequence
  Synthetic oligonucleotide
agcacccgtgtgatatggggtggggggttagaagcga

SEQ ID NO: 42606 - DNA, 37 bp, Artificial Sequence
  Synthetic oligonucleotide
ttgatatcatcgggagggggaagaggagacaatagga

SEQ ID NO: 42607 - DNA, 37 bp, Artificial Sequence
  Synthetic oligonucleotide
accccctccgttcccagtggtagcctggtcactagga

SEQ ID NO: 42608 - DNA, 36 bp, Artificial Sequence
  Synthetic oligonucleotide
gccatgggaggagggagtgagttagcttgcgaggga

SEQ ID NO: 42609 - DNA, 35 bp, Artificial Sequence
  Synthetic oligonucleotide
gcgtaaccctcgggcgttatctctcaccttactga

SEQ ID NO: 42610 - DNA, 35 bp, Artificial Sequence
  Synthetic oligonucleotide
accatcaccggcgggaccaggttcttcgttgctga

SEQ ID NO: 42611 - DNA, 38 bp, Artificial Sequence
  Synthetic oligonucleotide
tgtcgacggaggtcaaaaggggggcaagggggtagtga

SEQ ID NO: 42612 - DNA, 36 bp, Artificial Sequence
  Synthetic oligonucleotide
tagccagtgtacctccacgtgtcccagtttttgcta

SEQ ID NO: 42613 - DNA, 36 bp, Artificial Sequence
  Synthetic oligonucleotide
tagcccaactccccttcccattgcaggaagagtcta

SEQ ID NO: 42614 - DNA, 36 bp, Artificial Sequence
  Synthetic oligonucleotide
ttccggcaacagctgttcccccgccctttcctcgta

SEQ ID NO: 42615 - DNA, 36 bp, Artificial Sequence
  Synthetic oligonucleotide
gcgcccgcaagtcctctctaacgcaccgtgctctta

SEQ ID NO: 42616 - DNA, 34 bp, Artificial Sequence
  Synthetic oligonucleotide
gctaacccgctagacctgccttgagtggcccccc

SEQ ID NO: 42617 - DNA, 35 bp, Artificial Sequence
  Synthetic oligonucleotide
cctcggacaccatgccacctattgatttttacgcc

SEQ ID NO: 42618 - DNA, 35 bp, Artificial Sequence
  Synthetic oligonucleotide
gccaaggtcgttcgcgtgggcttactgctccttcc

SEQ ID NO: 42619 - DNA, 35 bp, Artificial Sequence
  Synthetic oligonucleotide
gcatgttatcagtccaacaccgcattcgcctctgc

SEQ ID NO: 42620 - DNA, 35 bp, Artificial Sequence
  Synthetic oligonucleotide
ggaaccaaagccgccagccggtcttactgctgttc

SEQ ID NO: 42621 - DNA, 35 bp, Artificial Sequence
  Synthetic oligonucleotide
tatggtcataacggcagtctttacttcctgctttc

SEQ ID NO: 42622 - DNA, 35 bp, Artificial Sequence
  Synthetic oligonucleotide
gaacgaggaaggggcaaggcatgcgaagctgaaag

SEQ ID NO: 42623 - DNA, 35 bp, Artificial Sequence
  Synthetic oligonucleotide
tcatcgcccttgttagcccattggacacctgcccg

SEQ ID NO: 42624 - DNA, 35 bp, Artificial Sequence
  Synthetic oligonucleotide
atagcaaggagtgggtgggaaattagtatcaaggg

SEQ ID NO: 42625 - DNA, 35 bp, Artificial Sequence
  Synthetic oligonucleotide
acccccggtagctccccctgtacctggctaccctg

SEQ ID NO: 42626 - DNA, 35 bp, Artificial Sequence
  Synthetic oligonucleotide
gtccgcctcgctgtaagccccccacaatcgatact

SEQ ID NO: 42627 - DNA, 35 bp, Artificial Sequence
  Synthetic oligonucleotide
atcaacacctcaacatgggctccaggcggactact

SEQ ID NO: 42628 - DNA, 35 bp, Artificial Sequence
  Synthetic oligonucleotide
atctcgcctctgctcgttcccgccctctagccagt

SEQ ID NO: 42629 - DNA, 35 bp, Artificial Sequence
  Synthetic oligonucleotide
atcacctcacgtctattattgacctttaaaacttt

SEQ ID NO: 42630 - DNA, 35 bp, Artificial Sequence
  Synthetic oligonucleotide
gacgaactgcctatgttccttgctaaaccctgttt

SEQ ID NO: 42631 - DNA, 36 bp, Artificial Sequence
  Synthetic oligonucleotide
ggagactacaccgccgagtcccacagttcaccgtaa

SEQ ID NO: 42632 - DNA, 36 bp, Artificial Sequence
  Synthetic oligonucleotide
ggagccccagccgactccgcttctacctacgtttaa

SEQ ID NO: 42633 - DNA, 36 bp, Artificial Sequence
  Synthetic oligonucleotide
aatgtgacacccgtctgcagctgcccctggaaaaca

SEQ ID NO: 42634 - DNA, 36 bp, Artificial Sequence
  Synthetic oligonucleotide
gcgtgccaccaccaattcacggtgtcaactctcaca

SEQ ID NO: 42635 - DNA, 36 bp, Artificial Sequence
  Synthetic oligonucleotide
gcacgtttcgagctatctctgtcctcgctgttccca

SEQ ID NO: 42636 - DNA, 37 bp, Artificial Sequence
  Synthetic oligonucleotide
acacgtcactctggtcctcttcctctggtcatgtaga

SEQ ID NO: 42637 - DNA, 37 bp, Artificial Sequence
  Synthetic oligonucleotide
taccgcctcatcacacggcacacatccttgtcaccga

SEQ ID NO: 42638 - DNA, 36 bp, Artificial Sequence
  Synthetic oligonucleotide
gccatcacccagcccgctcgcaaatgagccttgcga

SEQ ID NO: 42639 - DNA, 37 bp, Artificial Sequence
  Synthetic oligonucleotide
tcgcacgcccccgccctcgcgcctcgctctccaagga

SEQ ID NO: 42640 - DNA, 37 bp, Artificial Sequence
  Synthetic oligonucleotide
atgtgcaagagaggacggagtgaagggaaacgaagga

SEQ ID NO: 42641 - DNA, 37 bp, Artificial Sequence
  Synthetic oligonucleotide
taacgctggggtaagcatgatactcatgggggtggga

SEQ ID NO: 42642 - DNA, 37 bp, Artificial Sequence
  Synthetic oligonucleotide
gacgagctaggtcacactgctttatgcctttctatga

SEQ ID NO: 42643 - DNA, 37 bp, Artificial Sequence
  Synthetic oligonucleotide
accccccgcatccgttccccggcacatcgaaaactga

SEQ ID NO: 42644 - DNA, 36 bp, Artificial Sequence
  Synthetic oligonucleotide
taccagcgcctcccgttctcccagcccagcttgtga

SEQ ID NO: 42645 - DNA, 36 bp, Artificial Sequence
  Synthetic oligonucleotide
tcaacggtaccactctgccgacttataccaggccta

SEQ ID NO: 42646 - DNA, 36 bp, Artificial Sequence
  Synthetic oligonucleotide
acgcctgccatcagtcaccccattttgctgctagta

SEQ ID NO: 42647 - DNA, 35 bp, Artificial Sequence
  Synthetic oligonucleotide
tgccaccggcgggcgacctgcctttacttaccaac

SEQ ID NO: 42648 - DNA, 35 bp, Artificial Sequence
  Synthetic oligonucleotide
aacacgatgttgcctccgctatgcctggttgaacc

SEQ ID NO: 42649 - DNA, 35 bp, Artificial Sequence
  Synthetic oligonucleotide
gattcatcggtcatgacttaaaccaccaccatccc

SEQ ID NO: 42650 - DNA, 35 bp, Artificial Sequence
  Synthetic oligonucleotide
acaaactgtgccgtctagccattacagatcctccc

SEQ ID NO: 42651 - DNA, 35 bp, Artificial Sequence
  Synthetic oligonucleotide
aacattcgctactgatatgtcatatcatctccgcc

SEQ ID NO: 42652 - DNA, 35 bp, Artificial Sequence
  Synthetic oligonucleotide
gcttcccagcccattattacagcgcctcagtcgcc

SEQ ID NO: 42653 - DNA, 35 bp, Artificial Sequence
  Synthetic oligonucleotide
actgcggtctccatccacgcgctctacgccgggcc

SEQ ID NO: 42654 - DNA, 35 bp, Artificial Sequence
  Synthetic oligonucleotide
tgcgaccttcatacaaccaccgggactcacctcgc

SEQ ID NO: 42655 - DNA, 35 bp, Artificial Sequence
  Synthetic oligonucleotide
tgcccttccatggccctgtcatatatccggttgtc

SEQ ID NO: 42656 - DNA, 35 bp, Artificial Sequence
  Synthetic oligonucleotide
tagcaacatctccgcctcggccctctccgaattag

SEQ ID NO: 42657 - DNA, 35 bp, Artificial Sequence
  Synthetic oligonucleotide
gtgtggataggggcggaggtggtctgaggtaaagg

SEQ ID NO: 42658 - DNA, 35 bp, Artificial Sequence
  Synthetic oligonucleotide
actgccatgggccatcacttgaactttttttgaat

SEQ ID NO: 42659 - DNA, 35 bp, Artificial Sequence
  Synthetic oligonucleotide
tgtgcgtggtccttctacccggctgtccccattat

SEQ ID NO: 42660 - DNA, 35 bp, Artificial Sequence
  Synthetic oligonucleotide
agaacgggccgacacgtttctcgcccatatgacct

SEQ ID NO: 42661 - DNA, 35 bp, Artificial Sequence
  Synthetic oligonucleotide
gcatcgctaaggcagctttgcctctccggtcctct

SEQ ID NO: 42662 - DNA, 35 bp, Artificial Sequence
  Synthetic oligonucleotide
tgtttcaccccgggtctggcgcctgcgggccaatt

SEQ ID NO: 42663 - DNA, 35 bp, Artificial Sequence
  Synthetic oligonucleotide
gtgactcacggcttatgccacttacaccttgcctt

SEQ ID NO: 42664 - DNA, 35 bp, Artificial Sequence
  Synthetic oligonucleotide
gtacaacactgatgactatcttctctacactggtt

SEQ ID NO: 42665 - DNA, 36 bp, Artificial Sequence
  Synthetic oligonucleotide
gtacaggcatgagggactcaaaggggcggtttggaa

SEQ ID NO: 42666 - DNA, 36 bp, Artificial Sequence
  Synthetic oligonucleotide
tcacgaccgcttaggcttagcgtattcatctcttaa

SEQ ID NO: 42667 - DNA, 36 bp, Artificial Sequence
  Synthetic oligonucleotide
gaccccaccacgtgtaccgtctacaacaacaaaaca

SEQ ID NO: 42668 - DNA, 35 bp, Artificial Sequence
  Synthetic oligonucleotide
gaataccactgaaggttttggacctcttcttcaca

SEQ ID NO: 42669 - DNA, 36 bp, Artificial Sequence
  Synthetic oligonucleotide
gccaacatacgactaacgattagctgtttcacccca

SEQ ID NO: 42670 - DNA, 35 bp, Artificial Sequence
  Synthetic oligonucleotide
gcgccctccgcgcacttcgccctctgctctgccca

SEQ ID NO: 42671 - DNA, 36 bp, Artificial Sequence
  Synthetic oligonucleotide
accatcccccccgctctataaggtattctgtgggca

SEQ ID NO: 42672 - DNA, 37 bp, Artificial Sequence
  Synthetic oligonucleotide
tccggacaggggctggggggtgatggggttgtggcga

SEQ ID NO: 42673 - DNA, 37 bp, Artificial Sequence
  Synthetic oligonucleotide
tactgcccagcggacaccgtagcaatcacgccctcga

SEQ ID NO: 42674 - DNA, 37 bp, Artificial Sequence
  Synthetic oligonucleotide
acccgattacagcgcgccccattgttggtactctcga

SEQ ID NO: 42675 - DNA, 37 bp, Artificial Sequence
  Synthetic oligonucleotide
cacgacccacaatcgtaacggatctgttcttcttcga

SEQ ID NO: 42676 - DNA, 37 bp, Artificial Sequence
  Synthetic oligonucleotide
acccaaaagaagagggaaacagaggggagcagttcga

SEQ ID NO: 42677 - DNA, 35 bp, Artificial Sequence
  Synthetic oligonucleotide
taaccctgggcagagggactaaagctggggtggga

SEQ ID NO: 42678 - DNA, 38 bp, Artificial Sequence
  Synthetic oligonucleotide
tcccataacccactgtatcaatgcttgccctaccatga

SEQ ID NO: 42679 - DNA, 38 bp, Artificial Sequence
  Synthetic oligonucleotide
acttcccctaccatgactgtgcccgcataaggccatga

SEQ ID NO: 42680 - DNA, 38 bp, Artificial Sequence
  Synthetic oligonucleotide
tctgctcagcgactgacgtacccccccacttccactga

SEQ ID NO: 42681 - DNA, 38 bp, Artificial Sequence
  Synthetic oligonucleotide
gttgactccagatagccctcacccccgttgtagcctga

SEQ ID NO: 42682 - DNA, 38 bp, Artificial Sequence
  Synthetic oligonucleotide
acgagcccgccctttcctgtcgtagtgatctttgctga

SEQ ID NO: 42683 - DNA, 36 bp, Artificial Sequence
  Synthetic oligonucleotide
ttgggaatcgaacggggacggggaaggagcaattga

SEQ ID NO: 42684 - DNA, 38 bp, Artificial Sequence
  Synthetic oligonucleotide
gctgccttgtcgctatgctcgggctcccctcaacttga

SEQ ID NO: 42685 - DNA, 38 bp, Artificial Sequence
  Synthetic oligonucleotide
acatccaccgacagacaactcgctaccgacatggttga

SEQ ID NO: 42686 - DNA, 35 bp, Artificial Sequence
  Synthetic oligonucleotide
gacgctcgtgcctccacgcaaaccgatacttttga

SEQ ID NO: 42687 - DNA, 36 bp, Artificial Sequence
  Synthetic oligonucleotide
gcatcacgaccacatacagaccgttcccccacacta

SEQ ID NO: 42688 - DNA, 36 bp, Artificial Sequence
  Synthetic oligonucleotide
accctggattcaccccgaccctgacttgcttgacta

SEQ ID NO: 42689 - DNA, 36 bp, Artificial Sequence
  Synthetic oligonucleotide
tgtgggatggaaggggtggagtcggaggtgctagta

SEQ ID NO: 42690 - DNA, 36 bp, Artificial Sequence
  Synthetic oligonucleotide
gatttgtaggcacgtgggaagggcgggatgggatta

SEQ ID NO: 42691 - DNA, 35 bp, Artificial Sequence
  Synthetic oligonucleotide
gatcacccgccgcctggactccctccttcgcctta

SEQ ID NO: 42692 - DNA, 35 bp, Artificial Sequence
  Synthetic oligonucleotide
acatccaccgccttgagcttatccgcctcctgtta

SEQ ID NO: 42693 - DNA, 35 bp, Artificial Sequence
  Synthetic oligonucleotide
agagagagtagaggaggtagtggatgtactgggac

SEQ ID NO: 42694 - DNA, 35 bp, Artificial Sequence
  Synthetic oligonucleotide
tgtgcttggcacattctctatttagtcgtacatcc

SEQ ID NO: 42695 - DNA, 35 bp, Artificial Sequence
  Synthetic oligonucleotide
tactcgtaccatctcgcgttctgaacttcgcaggc

SEQ ID NO: 42696 - DNA, 35 bp, Artificial Sequence
  Synthetic oligonucleotide
tcggacacggcatcttattactgcctatgcccctc

SEQ ID NO: 42697 - DNA, 35 bp, Artificial Sequence
  Synthetic oligonucleotide
tcacctccaacgcgggtctgctcttacttccgctc

SEQ ID NO: 42698 - DNA, 35 bp, Artificial Sequence
  Synthetic oligonucleotide
acctaaggccagtcgtttccacgtttcaattagtc

SEQ ID NO: 42699 - DNA, 34 bp, Artificial Sequence
  Synthetic oligonucleotide
atgtgctccattgcacaacagttcccacctcgtc

SEQ ID NO: 42700 - DNA, 35 bp, Artificial Sequence
  Synthetic oligonucleotide
gatcgggaggagacagggttggtgtgtggtgggag

SEQ ID NO: 42701 - DNA, 35 bp, Artificial Sequence
  Synthetic oligonucleotide
acagatgcctgaacgccatattacccactctggag

SEQ ID NO: 42702 - DNA, 35 bp, Artificial Sequence
  Synthetic oligonucleotide
ccacaccctcacgccggctccgctactgccaatag

SEQ ID NO: 42703 - DNA, 35 bp, Artificial Sequence
  Synthetic oligonucleotide
agcacccaacgtagctacgaaactccggttccccg

SEQ ID NO: 42704 - DNA, 35 bp, Artificial Sequence
  Synthetic oligonucleotide
tcacccctatggtcctatatgcgagccgagtatcg

SEQ ID NO: 42705 - DNA, 35 bp, Artificial Sequence
  Synthetic oligonucleotide
gtccgcccccgctatctattgaatttattcgttcg

SEQ ID NO: 42706 - DNA, 35 bp, Artificial Sequence
  Synthetic oligonucleotide
gacgtcccgctctatctatctaccgtaaaatttgg

SEQ ID NO: 42707 - DNA, 35 bp, Artificial Sequence
  Synthetic oligonucleotide
agccgcacggccctcccctgacgaattcatgactg

SEQ ID NO: 42708 - DNA, 35 bp, Artificial Sequence
  Synthetic oligonucleotide
tgtaggacgggttggggggagaaaatttgctattg

SEQ ID NO: 42709 - DNA, 35 bp, Artificial Sequence
  Synthetic oligonucleotide
gtcatcaccggactgactccttccacactcgtgat

SEQ ID NO: 42710 - DNA, 35 bp, Artificial Sequence
  Synthetic oligonucleotide
acatcgataggcgccgacccagcaccactggtact

SEQ ID NO: 42711 - DNA, 35 bp, Artificial Sequence
  Synthetic oligonucleotide
atgaacaccaccaccctaaaccgttcgccaccgct

SEQ ID NO: 42712 - DNA, 35 bp, Artificial Sequence
  Synthetic oligonucleotide
gcccgcaccctattccgaatccatagaatgtctct

SEQ ID NO: 42713 - DNA, 36 bp, Artificial Sequence
  Synthetic oligonucleotide
ggggggggggagggaggaaagggggagaaggacaaa

SEQ ID NO: 42714 - DNA, 36 bp, Artificial Sequence
  Synthetic oligonucleotide
tagccacatcttgccgaagttgacgcacacccccaa

SEQ ID NO: 42715 - DNA, 36 bp, Artificial Sequence
  Synthetic oligonucleotide
ttgtgcacctatcagcggcgtacttaatgcccccaa

SEQ ID NO: 42716 - DNA, 36 bp, Artificial Sequence
  Synthetic oligonucleotide
gatttcccgacacgatctggcatgggccactacaca

SEQ ID NO: 42717 - DNA, 36 bp, Artificial Sequence
  Synthetic oligonucleotide
gtcgtacaccctggtaccgcgccctatgcttccaca

SEQ ID NO: 42718 - DNA, 36 bp, Artificial Sequence
  Synthetic oligonucleotide
gtccaagcgacgcagacatattttcatcactgcaca

SEQ ID NO: 42719 - DNA, 35 bp, Artificial Sequence
  Synthetic oligonucleotide
tcacaaacatggtgtccgttccacacttgcataca

SEQ ID NO: 42720 - DNA, 35 bp, Artificial Sequence
  Synthetic oligonucleotide
agtacccctgacatataccccatacttagagacca

SEQ ID NO: 42721 - DNA, 36 bp, Artificial Sequence
  Synthetic oligonucleotide
actgacctgctagactccctggcgtagaacgtttca

SEQ ID NO: 42722 - DNA, 35 bp, Artificial Sequence
  Synthetic oligonucleotide
actccatccgcttagatcccacacatcgggaaaga

SEQ ID NO: 42723 - DNA, 37 bp, Artificial Sequence
  Synthetic oligonucleotide
gatccgccgagactcggcatgtaccacccatccaaga

SEQ ID NO: 42724 - DNA, 37 bp, Artificial Sequence
  Synthetic oligonucleotide
acgagggccatgagcagggttaaggggcacggtaaga

SEQ ID NO: 42725 - DNA, 37 bp, Artificial Sequence
  Synthetic oligonucleotide
gtcccaacccgcgcgtaccacttcgttagctacacga

SEQ ID NO: 42726 - DNA, 37 bp, Artificial Sequence
  Synthetic oligonucleotide
tgatccgccaatatgcccgcgatcggacctaatccga

SEQ ID NO: 42727 - DNA, 37 bp, Artificial Sequence
  Synthetic oligonucleotide
acttgcggactagcacaacctgtctcattcccatcga

SEQ ID NO: 42728 - DNA, 37 bp, Artificial Sequence
  Synthetic oligonucleotide
agacagtgggggacacgggaaaacagaacttgtggga

SEQ ID NO: 42729 - DNA, 38 bp, Artificial Sequence
  Synthetic oligonucleotide
gaagagggtactagcgggtaggcggggaacagtcatga

SEQ ID NO: 42730 - DNA, 38 bp, Artificial Sequence
  Synthetic oligonucleotide
acctcacgcgtcttgtcttcctccgaaaccccggctga

SEQ ID NO: 42731 - DNA, 38 bp, Artificial Sequence
  Synthetic oligonucleotide
ttagcccaccgcctggtaccgagcgcaaaattttctga

SEQ ID NO: 42732 - DNA, 38 bp, Artificial Sequence
  Synthetic oligonucleotide
tgatcgtgcaccatcctttcttgctcttcgtcctttga

SEQ ID NO: 42733 - DNA, 38 bp, Artificial Sequence
  Synthetic oligonucleotide
gccgaactcgcgtctgactaccttgctctacggtttga

SEQ ID NO: 42734 - DNA, 36 bp, Artificial Sequence
  Synthetic oligonucleotide
acccgcagcaccaatacttcgctaccactcgccgta

SEQ ID NO: 42735 - DNA, 36 bp, Artificial Sequence
  Synthetic oligonucleotide
gtcgcggacgagactgaggacgacgggaggtaggta

SEQ ID NO: 42736 - DNA, 36 bp, Artificial Sequence
  Synthetic oligonucleotide
gcgtgtaggcgcatctcccccccacgatctgtctta

SEQ ID NO: 42737 - DNA, 35 bp, Artificial Sequence
  Synthetic oligonucleotide
gtcgagccgttagacatgccgtttttgccactaac

SEQ ID NO: 42738 - DNA, 35 bp, Artificial Sequence
  Synthetic oligonucleotide
tcaccctgtcgcatagaccactccataatcgggcc

SEQ ID NO: 42739 - DNA, 35 bp, Artificial Sequence
  Synthetic oligonucleotide
aaacatcaccgctcgaaacgaagtagagtgtttcc

SEQ ID NO: 42740 - DNA, 35 bp, Artificial Sequence
  Synthetic oligonucleotide
gtagccgccatcaattccggtttatgctcatgcgc

SEQ ID NO: 42741 - DNA, 35 bp, Artificial Sequence
  Synthetic oligonucleotide
ggaccgagcccgttgcgaggcatgcatgttacatc

SEQ ID NO: 42742 - DNA, 35 bp, Artificial Sequence
  Synthetic oligonucleotide
gcaaccgtatgcactttgtcgagttccctgtttag

SEQ ID NO: 42743 - DNA, 35 bp, Artificial Sequence
  Synthetic oligonucleotide
gtccgggttccattcgcctaatctcgcccttctcg

SEQ ID NO: 42744 - DNA, 35 bp, Artificial Sequence
  Synthetic oligonucleotide
aactaaagcgcattactgatctctctcccgttcat

SEQ ID NO: 42745 - DNA, 35 bp, Artificial Sequence
  Synthetic oligonucleotide
ttccgaagcgggctcttgtctcgtgctttttttat

SEQ ID NO: 42746 - DNA, 35 bp, Artificial Sequence
  Synthetic oligonucleotide
gaaccctcactcgtttgctacatcccgcaacgact

SEQ ID NO: 42747 - DNA, 35 bp, Artificial Sequence
  Synthetic oligonucleotide
gtgtcctctctggctttccacgctaccagtctcct

SEQ ID NO: 42748 - DNA, 35 bp, Artificial Sequence
  Synthetic oligonucleotide
aattgaaccgatcgcgcccaggccactgacctgct

SEQ ID NO: 42749 - DNA, 36 bp, Artificial Sequence
  Synthetic oligonucleotide
tctccaacctcagcccgttcgttctctaaatcgtct

SEQ ID NO: 42750 - DNA, 35 bp, Artificial Sequence
  Synthetic oligonucleotide
tgcgtgctgctgcgtgtcagcttatccttccttgt

SEQ ID NO: 42751 - DNA, 35 bp, Artificial Sequence
  Synthetic oligonucleotide
aaccaccatgcccggcaccgagactctacctcatt

SEQ ID NO: 42752 - DNA, 35 bp, Artificial Sequence
  Synthetic oligonucleotide
taggatgccgagccgtggaggggggtgccgctatt

SEQ ID NO: 42753 - DNA, 35 bp, Artificial Sequence
  Synthetic oligonucleotide
tgagactgcacttcgtcatcagcctgttgtctctt

SEQ ID NO: 42754 - DNA, 35 bp, Artificial Sequence
  Synthetic oligonucleotide
aaggtgggcgaaggggagtaatagctggggttgtt

SEQ ID NO: 42755 - DNA, 35 bp, Artificial Sequence
  Synthetic oligonucleotide
acgtacggaccttgcgcatgggcttccaccgtttt

SEQ ID NO: 42756 - DNA, 36 bp, Artificial Sequence
  Synthetic oligonucleotide
aacgggtgggagtggaagaagaagcaggagtaacaa

SEQ ID NO: 42757 - DNA, 35 bp, Artificial Sequence
  Synthetic oligonucleotide
atgcacattagcctcccttcgttacactgccctaa

SEQ ID NO: 42758 - DNA, 35 bp, Artificial Sequence
  Synthetic oligonucleotide
ttccagccccaattaaggtaacgaaccactacaca

SEQ ID NO: 42759 - DNA, 36 bp, Artificial Sequence
  Synthetic oligonucleotide
gatccgtggaccctgtgtcactagtaacacttcaca

SEQ ID NO: 42760 - DNA, 36 bp, Artificial Sequence
  Synthetic oligonucleotide
ttgcggagctgccgtaccaacttcccacctaataca

SEQ ID NO: 42761 - DNA, 36 bp, Artificial Sequence
  Synthetic oligonucleotide
ttccgcgtacctccgttgatcttccgcgcattgcca

SEQ ID NO: 42762 - DNA, 36 bp, Artificial Sequence
  Synthetic oligonucleotide
atccccgtgcgacgcttatcgtctaacactttatca

SEQ ID NO: 42763 - DNA, 37 bp, Artificial Sequence
  Synthetic oligonucleotide
acacgtgcgctccggttccatacacgccttttagaga

SEQ ID NO: 42764 - DNA, 37 bp, Artificial Sequence
  Synthetic oligonucleotide
gctggggactgggattagggaggggtatgctgtacga

SEQ ID NO: 42765 - DNA, 36 bp, Artificial Sequence
  Synthetic oligonucleotide
gaaaagcggagaaggggaaggacggctcgctaccga

SEQ ID NO: 42766 - DNA, 37 bp, Artificial Sequence
  Synthetic oligonucleotide
tatgctgcatattgtctacgtcttggcctctctccga

SEQ ID NO: 42767 - DNA, 38 bp, Artificial Sequence
  Synthetic oligonucleotide
ggcaaagaggggaggaaaaaaagcggaaccaagcgcga

SEQ ID NO: 42768 - DNA, 37 bp, Artificial Sequence
  Synthetic oligonucleotide
aacgccgcaaggtaggtgcaagtggaggaaacggcga

SEQ ID NO: 42769 - DNA, 37 bp, Artificial Sequence
  Synthetic oligonucleotide
gacaacacaagtgcagtggaggatagagggggtgcga

SEQ ID NO: 42770 - DNA, 36 bp, Artificial Sequence
  Synthetic oligonucleotide
tccttgcaccatcttagcactagtagtttagttcga

SEQ ID NO: 42771 - DNA, 37 bp, Artificial Sequence
  Synthetic oligonucleotide
aacgagcggcaatggattgctgggggtggggaaggga

SEQ ID NO: 42772 - DNA, 37 bp, Artificial Sequence
  Synthetic oligonucleotide
acatctacctcacactttctttgcagttcgataggga

SEQ ID NO: 42773 - DNA, 35 bp, Artificial Sequence
  Synthetic oligonucleotide
gttgggagaagaaaagggattgtcggatatcggga

SEQ ID NO: 42774 - DNA, 37 bp, Artificial Sequence
  Synthetic oligonucleotide
ggaaagaggagggaatatgggcattagatggggtgga

SEQ ID NO: 42775 - DNA, 37 bp, Artificial Sequence
  Synthetic oligonucleotide
gcatgctgcgcctcttagtttcggccccttccttgga

SEQ ID NO: 42776 - DNA, 38 bp, Artificial Sequence
  Synthetic oligonucleotide
tgacacgcgaccatctccgggaacgttcctctccatga

SEQ ID NO: 42777 - DNA, 38 bp, Artificial Sequence
  Synthetic oligonucleotide
aaccgacgggagtcgaactacacacatccgatcactga

SEQ ID NO: 42778 - DNA, 37 bp, Artificial Sequence
  Synthetic oligonucleotide
tgcaaacaccatagacgtttctccgcgccctccctga

SEQ ID NO: 42779 - DNA, 38 bp, Artificial Sequence
  Synthetic oligonucleotide
actgctgtccactacgcgcaatcccaggccactgctga

SEQ ID NO: 42780 - DNA, 38 bp, Artificial Sequence
  Synthetic oligonucleotide
tgacatcccgtaaccgcccgtggatcccgaaattctga

SEQ ID NO: 42781 - DNA, 38 bp, Artificial Sequence
  Synthetic oligonucleotide
gaggatgatgcaaaatgcgtggaggcgggtgagggtga

SEQ ID NO: 42782 - DNA, 38 bp, Artificial Sequence
  Synthetic oligonucleotide
atgcccccacgcttgccatatctgagtaccttgggtga

SEQ ID NO: 42783 - DNA, 38 bp, Artificial Sequence
  Synthetic oligonucleotide
gcgcagagcgcaccgcctatacaaccaccacgccttga

SEQ ID NO: 42784 - DNA, 35 bp, Artificial Sequence
  Synthetic oligonucleotide
agatgcgggggcgggagggtggccaggggaatcta

SEQ ID NO: 42785 - DNA, 36 bp, Artificial Sequence
  Synthetic oligonucleotide
ttacacgcctgtacctttcgatgagatccggccgta

SEQ ID NO: 42786 - DNA, 36 bp, Artificial Sequence
  Synthetic oligonucleotide
taacctgtgccctcggtgattgattgccccgctgta

SEQ ID NO: 42787 - DNA, 36 bp, Artificial Sequence
  Synthetic oligonucleotide
tacgtgacgcgatgccgctcccttcttgacaactta

SEQ ID NO: 42788 - DNA, 35 bp, Artificial Sequence
  Synthetic oligonucleotide
tcatcatcgaaacaatcccatctcgtgcagcctta

SEQ ID NO: 42789 - DNA, 36 bp, Artificial Sequence
  Synthetic oligonucleotide
acatctccccccgtcgatcactcaaccttgctgtta

SEQ ID NO: 42790 - DNA, 35 bp, Artificial Sequence
  Synthetic oligonucleotide
tgttcactcgctctttcgttatcaaaacatcccac

SEQ ID NO: 42791 - DNA, 35 bp, Artificial Sequence
  Synthetic oligonucleotide
gcatggcccctctcctcttatccggctctcaggac

SEQ ID NO: 42792 - DNA, 35 bp, Artificial Sequence
  Synthetic oligonucleotide
tcccctctcagagctactgaccctctcacaagacc

SEQ ID NO: 42793 - DNA, 35 bp, Artificial Sequence
  Synthetic oligonucleotide
tcgaaccccatctgtcccccatcgcactgagttcc

SEQ ID NO: 42794 - DNA, 35 bp, Artificial Sequence
  Synthetic oligonucleotide
ttaccccccgcccacttggtcattacacctcttgc

SEQ ID NO: 42795 - DNA, 35 bp, Artificial Sequence
  Synthetic oligonucleotide
tccctgctcgcatgcacactttcctaccgccaacg

SEQ ID NO: 42796 - DNA, 35 bp, Artificial Sequence
  Synthetic oligonucleotide
aatcccagccgctcgcgttccgacatctgccaccg

SEQ ID NO: 42797 - DNA, 35 bp, Artificial Sequence
  Synthetic oligonucleotide
gagtgttccgcccgtctcttaagcttcaccgtccg

SEQ ID NO: 42798 - DNA, 35 bp, Artificial Sequence
  Synthetic oligonucleotide
tatgtgggcacgattaccctccccaacgcaccatg

SEQ ID NO: 42799 - DNA, 35 bp, Artificial Sequence
  Synthetic oligonucleotide
gctgcatggcgtcattctcctcggggtcgctatct

SEQ ID NO: 42800 - DNA, 35 bp, Artificial Sequence
  Synthetic oligonucleotide
gacccacacttggctacttcgtggtgactctatct

SEQ ID NO: 42801 - DNA, 35 bp, Artificial Sequence
  Synthetic oligonucleotide
tgaatatgtactgtgtcttccttgtggcacccttt

SEQ ID NO: 42802 - DNA, 36 bp, Artificial Sequence
  Synthetic oligonucleotide
gcccccgcccagggtaccatgtcctatcataacgaa

SEQ ID NO: 42803 - DNA, 36 bp, Artificial Sequence
  Synthetic oligonucleotide
aacgcctcaggcgacttcctctgctggttcacttaa

SEQ ID NO: 42804 - DNA, 36 bp, Artificial Sequence
  Synthetic oligonucleotide
actgagcggatcctcttgttactacgtctggcgcca

SEQ ID NO: 42805 - DNA, 36 bp, Artificial Sequence
  Synthetic oligonucleotide
tattcatcgcgttctccctgttccggtcgcctcgca

SEQ ID NO: 42806 - DNA, 36 bp, Artificial Sequence
  Synthetic oligonucleotide
gtagcccacatagtagttctgtccgttgtcaatgca

SEQ ID NO: 42807 - DNA, 36 bp, Artificial Sequence
  Synthetic oligonucleotide
agacgccaccgcaccacatctagtaacgtaacttca

SEQ ID NO: 42808 - DNA, 37 bp, Artificial Sequence
  Synthetic oligonucleotide
gcctggagtcggtgagggaaaaaatgacggagagaga

SEQ ID NO: 42809 - DNA, 37 bp, Artificial Sequence
  Synthetic oligonucleotide
acaccgaccatcggggtatcgccgcactccctcgcga

SEQ ID NO: 42810 - DNA, 38 bp, Artificial Sequence
  Synthetic oligonucleotide
gtgagacggaggaggacttgactgggagggcgagatga

SEQ ID NO: 42811 - DNA, 38 bp, Artificial Sequence
  Synthetic oligonucleotide
tagtggagggggaaggcccagaaggggagtctctatga

SEQ ID NO: 42812 - DNA, 37 bp, Artificial Sequence
  Synthetic oligonucleotide
tgtggcctaggcaccgtctataacctacctcacctga

SEQ ID NO: 42813 - DNA, 38 bp, Artificial Sequence
  Synthetic oligonucleotide
aactagctgtctcacggcctactgatgccccaccctga

SEQ ID NO: 42814 - DNA, 38 bp, Artificial Sequence
  Synthetic oligonucleotide
tagtgcctgcctttagtccaccgaaccactcccgctga

SEQ ID NO: 42815 - DNA, 38 bp, Artificial Sequence
  Synthetic oligonucleotide
tgaggacaggtggggagtggtgagcggggtgagagtga

SEQ ID NO: 42816 - DNA, 38 bp, Artificial Sequence
  Synthetic oligonucleotide
gccatggtgagcaaggcggaggagtcatggggcggtga

SEQ ID NO: 42817 - DNA, 38 bp, Artificial Sequence
  Synthetic oligonucleotide
gactgcccaatcccccgttaacagccttcagaacttga

SEQ ID NO: 42818 - DNA, 36 bp, Artificial Sequence
  Synthetic oligonucleotide
taacccacttctcgctggcgaataaatgccacttga

SEQ ID NO: 42819 - DNA, 38 bp, Artificial Sequence
  Synthetic oligonucleotide
ttccactttccgtttctccgacaagactgtccctttga

SEQ ID NO: 42820 - DNA, 33 bp, Artificial Sequence
  Synthetic oligonucleotide
tacttgataacgctagcacctgagcatccaacc

SEQ ID NO: 42821 - DNA, 36 bp, Artificial Sequence
  Synthetic oligonucleotide
actcctcatctgactatcctacagtcgtctcccgcc

SEQ ID NO: 42822 - DNA, 35 bp, Artificial Sequence
  Synthetic oligonucleotide
gcaccaatcgcgttctacctcaattacacgccgcc

SEQ ID NO: 42823 - DNA, 35 bp, Artificial Sequence
  Synthetic oligonucleotide
gcccactggccgtattgtatttgcgcccagccatc

SEQ ID NO: 42824 - DNA, 35 bp, Artificial Sequence
  Synthetic oligonucleotide
gtacgggaatgcggtcaagctgacccacccttctc

SEQ ID NO: 42825 - DNA, 35 bp, Artificial Sequence
  Synthetic oligonucleotide
gtatggcgaagtgaaggtggaggattgtgggctag

SEQ ID NO: 42826 - DNA, 35 bp, Artificial Sequence
  Synthetic oligonucleotide
aagcaaccgacacgcactacatcatccattatcgg

SEQ ID NO: 42827 - DNA, 34 bp, Artificial Sequence
  Synthetic oligonucleotide
ggggggttgggacggcggaaggggtgaaaggtgg

SEQ ID NO: 42828 - DNA, 35 bp, Artificial Sequence
  Synthetic oligonucleotide
actgggtgggggcggataaggttacggggtgagct

SEQ ID NO: 42829 - DNA, 35 bp, Artificial Sequence
  Synthetic oligonucleotide
gacccccacacctggattaccatgcttataacgct

SEQ ID NO: 42830 - DNA, 35 bp, Artificial Sequence
  Synthetic oligonucleotide
tcacgaccggccgctatgccactgcccatctctgt

SEQ ID NO: 42831 - DNA, 35 bp, Artificial Sequence
  Synthetic oligonucleotide
gaatccaccgaggccctgcattacatcgctttttt

SEQ ID NO: 42832 - DNA, 36 bp, Artificial Sequence
  Synthetic oligonucleotide
gatcgccattggctaactttcaccttggctaccaaa

SEQ ID NO: 42833 - DNA, 37 bp, Artificial Sequence
  Synthetic oligonucleotide
gtggaaaggggcaagaatctgggaggtaggttacgaa

SEQ ID NO: 42834 - DNA, 35 bp, Artificial Sequence
  Synthetic oligonucleotide
tgaacccactagccggacacgtgaacacccctgaa

SEQ ID NO: 42835 - DNA, 35 bp, Artificial Sequence
  Synthetic oligonucleotide
gtcgtgccagaatcgttcacctctccaatcgtaca

SEQ ID NO: 42836 - DNA, 35 bp, Artificial Sequence
  Synthetic oligonucleotide
gacacacaactctgcccgcgcggaacgcggtacca

SEQ ID NO: 42837 - DNA, 37 bp, Artificial Sequence
  Synthetic oligonucleotide
cctggtgcctcggccatcgaattcacaccctcccaga

SEQ ID NO: 42838 - DNA, 37 bp, Artificial Sequence
  Synthetic oligonucleotide
tcatcctgtatacacccctctgctttgtagtcgcaga

SEQ ID NO: 42839 - DNA, 37 bp, Artificial Sequence
  Synthetic oligonucleotide
tctgtccactgcctattgaacggtgccctccctgaga

SEQ ID NO: 42840 - DNA, 36 bp, Artificial Sequence
  Synthetic oligonucleotide
atgggcgggtcgggtgaggcggagtgctagagtaga

SEQ ID NO: 42841 - DNA, 36 bp, Artificial Sequence
  Synthetic oligonucleotide
gcatgagtcgctcaggaataggtggggattgttaga

SEQ ID NO: 42842 - DNA, 37 bp, Artificial Sequence
  Synthetic oligonucleotide
ggtgggcgaaaaaaacctttatgagggaggctatgga

SEQ ID NO: 42843 - DNA, 37 bp, Artificial Sequence
  Synthetic oligonucleotide
gacgcaggaacgtctaacgtttggggatggcaaatga

SEQ ID NO: 42844 - DNA, 37 bp, Artificial Sequence
  Synthetic oligonucleotide
gcacgagggagtggtgcacggatgacatatggtatga

SEQ ID NO: 42845 - DNA, 38 bp, Artificial Sequence
  Synthetic oligonucleotide
taatgcctcgtacccttgtgttacttcccccttcctga

SEQ ID NO: 42846 - DNA, 38 bp, Artificial Sequence
  Synthetic oligonucleotide
gcaacacctcactttcccattgaccagccgcaagctga

SEQ ID NO: 42847 - DNA, 38 bp, Artificial Sequence
  Synthetic oligonucleotide
ggtggggggggaggctgaggagtggactcctagggtga

SEQ ID NO: 42848 - DNA, 38 bp, Artificial Sequence
  Synthetic oligonucleotide
tgaacccatcggaagtgctcaccctctcttctcattga

SEQ ID NO: 42849 - DNA, 38 bp, Artificial Sequence
  Synthetic oligonucleotide
agaccccactacggtacctcgcatatacagttttttga

SEQ ID NO: 42850 - DNA, 36 bp, Artificial Sequence
  Synthetic oligonucleotide
atgccgggcaacctagtcacaacccccatcccgcta

SEQ ID NO: 42851 - DNA, 35 bp, Artificial Sequence
  Synthetic oligonucleotide
tctgtcgggcactcttggccacgtgatctcctaac

SEQ ID NO: 42852 - DNA, 35 bp, Artificial Sequence
  Synthetic oligonucleotide
atcgcctgcgcattattattagccacctgttgacc

SEQ ID NO: 42853 - DNA, 35 bp, Artificial Sequence
  Synthetic oligonucleotide
ataccaattggccatgcggttgagaacccgcctcc

SEQ ID NO: 42854 - DNA, 35 bp, Artificial Sequence
  Synthetic oligonucleotide
accccgtgcccccgtagacaaggcggtccgcacgc

SEQ ID NO: 42855 - DNA, 35 bp, Artificial Sequence
  Synthetic oligonucleotide
attctgctcagaactcccatcctcccgtttgccgc

SEQ ID NO: 42856 - DNA, 35 bp, Artificial Sequence
  Synthetic oligonucleotide
acacgccctcctgtcgcgtcctaattatttccgag

SEQ ID NO: 42857 - DNA, 35 bp, Artificial Sequence
  Synthetic oligonucleotide
aagaattgccggggtgaggtggggggaacagggag

SEQ ID NO: 42858 - DNA, 35 bp, Artificial Sequence
  Synthetic oligonucleotide
ggtacgtaccggtgagggggataggggggttaacg

SEQ ID NO: 42859 - DNA, 35 bp, Artificial Sequence
  Synthetic oligonucleotide
accgtagcgtactctttgttttcactcggtttctg

SEQ ID NO: 42860 - DNA, 35 bp, Artificial Sequence
  Synthetic oligonucleotide
tcagtaggacggacccgttacttacaacctccttg

SEQ ID NO: 42861 - DNA, 35 bp, Artificial Sequence
  Synthetic oligonucleotide
tcgttaatcgccctgccgttcgacttacctacact

SEQ ID NO: 42862 - DNA, 35 bp, Artificial Sequence
  Synthetic oligonucleotide
acttcccatctggtgcctttcttcgactatccact

SEQ ID NO: 42863 - DNA, 35 bp, Artificial Sequence
  Synthetic oligonucleotide
tagagccgccgttactagctccctcatactctcct

SEQ ID NO: 42864 - DNA, 35 bp, Artificial Sequence
  Synthetic oligonucleotide
aaccaatggggccgctacgcacaccatccacctct

SEQ ID NO: 42865 - DNA, 35 bp, Artificial Sequence
  Synthetic oligonucleotide
tgtccactacccgcgttccggtcctagtacattgt

SEQ ID NO: 42866 - DNA, 35 bp, Artificial Sequence
  Synthetic oligonucleotide
actcccaccgtttgtattttggcctatcagcttgt

SEQ ID NO: 42867 - DNA, 35 bp, Artificial Sequence
  Synthetic oligonucleotide
accacctgccctaactgtcccgtatagcccatgaa

SEQ ID NO: 42868 - DNA, 36 bp, Artificial Sequence
  Synthetic oligonucleotide
gctggcggcccggtaagcaatttagcccttctttca

SEQ ID NO: 42869 - DNA, 37 bp, Artificial Sequence
  Synthetic oligonucleotide
aaagggaggaggaaggtacgccaacgggtagacaaga

SEQ ID NO: 42870 - DNA, 36 bp, Artificial Sequence
  Synthetic oligonucleotide
ggaggggatgggtaaatggttaaggggtgtgcgaga

SEQ ID NO: 42871 - DNA, 35 bp, Artificial Sequence
  Synthetic oligonucleotide
tttccctgcccaactgtaagcatgatctacaacga

SEQ ID NO: 42872 - DNA, 37 bp, Artificial Sequence
  Synthetic oligonucleotide
gtccactcccccgacttatctctgtctatacgcacga

SEQ ID NO: 42873 - DNA, 37 bp, Artificial Sequence
  Synthetic oligonucleotide
tcaacatgggcgggagaggccgggattgggggcacga

SEQ ID NO: 42874 - DNA, 36 bp, Artificial Sequence
  Synthetic oligonucleotide
gcccctccatcggccccgtttggtttgccgtgccga

SEQ ID NO: 42875 - DNA, 37 bp, Artificial Sequence
  Synthetic oligonucleotide
gaacacttcatgggcgggtggtaaaggcatggaagga

SEQ ID NO: 42876 - DNA, 37 bp, Artificial Sequence
  Synthetic oligonucleotide
aatgagggggagccagaagtcggtaggaggaacagga

SEQ ID NO: 42877 - DNA, 37 bp, Artificial Sequence
  Synthetic oligonucleotide
gacccgtgagtgaggtttagtgggatggtagggagga

SEQ ID NO: 42878 - DNA, 36 bp, Artificial Sequence
  Synthetic oligonucleotide
atccacgccttcttctacctgccagagttttacgga

SEQ ID NO: 42879 - DNA, 37 bp, Artificial Sequence
  Synthetic oligonucleotide
gaagaatgggggggcgtttttgagggagtccgcggga

SEQ ID NO: 42880 - DNA, 37 bp, Artificial Sequence
  Synthetic oligonucleotide
tgcgtgaactcccaccctcgatatgctgtaccttgga

SEQ ID NO: 42881 - DNA, 38 bp, Artificial Sequence
  Synthetic oligonucleotide
acacaccccgtttcagttccatcatcctacctcgatga

SEQ ID NO: 42882 - DNA, 38 bp, Artificial Sequence
  Synthetic oligonucleotide
ttggaagaacgcagctgggggtaggtggggagctgtga

SEQ ID NO: 42883 - DNA, 38 bp, Artificial Sequence
  Synthetic oligonucleotide
gccccgatcgcacttgcattggtaatttactttgttga

SEQ ID NO: 42884 - DNA, 38 bp, Artificial Sequence
  Synthetic oligonucleotide
aaatggggcgggagggctcggggggataactgttttga

SEQ ID NO: 42885 - DNA, 35 bp, Artificial Sequence
  Synthetic oligonucleotide
tcgatgatggggggatggattagtgtgtgtgtata

SEQ ID NO: 42886 - DNA, 36 bp, Artificial Sequence
  Synthetic oligonucleotide
ggaaccacctgtgcgatgtccatcctcaccactgta

SEQ ID NO: 42887 - DNA, 35 bp, Artificial Sequence
  Synthetic oligonucleotide
acccaatcctgtgtatggcgtatccatttacttac

SEQ ID NO: 42888 - DNA, 35 bp, Artificial Sequence
  Synthetic oligonucleotide
accgtgaatacgttaatcacctgatgacttgctcc

SEQ ID NO: 42889 - DNA, 35 bp, Artificial Sequence
  Synthetic oligonucleotide
tatcaaacctccgcctcatagcaaacacgccgagc

SEQ ID NO: 42890 - DNA, 35 bp, Artificial Sequence
  Synthetic oligonucleotide
ttagttcctccagcattgccctagacactgtccgc

SEQ ID NO: 42891 - DNA, 35 bp, Artificial Sequence
  Synthetic oligonucleotide
gtggggcggctctgcttccctcttcttttgtactc

SEQ ID NO: 42892 - DNA, 35 bp, Artificial Sequence
  Synthetic oligonucleotide
gtgtgcatttccacgctcctcccctcgccgccttc

SEQ ID NO: 42893 - DNA, 35 bp, Artificial Sequence
  Synthetic oligonucleotide
acccaaccatgtatcgtcagtcctggtgcgttttc

SEQ ID NO: 42894 - DNA, 35 bp, Artificial Sequence
  Synthetic oligonucleotide
gtcaaacgcccatatgagcctgttttccacacact

SEQ ID NO: 42895 - DNA, 35 bp, Artificial Sequence
  Synthetic oligonucleotide
gttgacatgaattagcgtgttattacactacccct

SEQ ID NO: 42896 - DNA, 35 bp, Artificial Sequence
  Synthetic oligonucleotide
actccttccgaccactaccaatggtagcactttgt

SEQ ID NO: 42897 - DNA, 35 bp, Artificial Sequence
  Synthetic oligonucleotide
actttccctcgccgtgcctacgacagccacacgtt

SEQ ID NO: 42898 - DNA, 35 bp, Artificial Sequence
  Synthetic oligonucleotide
tccaaccgcttccgtcacttctttctccatgggtt

SEQ ID NO: 42899 - DNA, 35 bp, Artificial Sequence
  Synthetic oligonucleotide
tccatcacagtcggcctgagatcattctaacgttt

SEQ ID NO: 42900 - DNA, 36 bp, Artificial Sequence
  Synthetic oligonucleotide
ttccaccgtcgcaccgcccacataacgtctcaataa

SEQ ID NO: 42901 - DNA, 36 bp, Artificial Sequence
  Synthetic oligonucleotide
taccacgtcgggggatggtggtaggggttgtgctaa

SEQ ID NO: 42902 - DNA, 36 bp, Artificial Sequence
  Synthetic oligonucleotide
acacacagcgcagcgttatgccccattatcttgtca

SEQ ID NO: 42903 - DNA, 37 bp, Artificial Sequence
  Synthetic oligonucleotide
tgatggtcgcgggaaaagacaggggctggattgcaga

SEQ ID NO: 42904 - DNA, 36 bp, Artificial Sequence
  Synthetic oligonucleotide
gtgcaaggtcccaacctctgggcccacactccgaga

SEQ ID NO: 42905 - DNA, 37 bp, Artificial Sequence
  Synthetic oligonucleotide
tgctaccccacccctattggctacagttgttgcacga

SEQ ID NO: 42906 - DNA, 37 bp, Artificial Sequence
  Synthetic oligonucleotide
tcacccccccaagtccccgtcctgcacgactatgcga

SEQ ID NO: 42907 - DNA, 36 bp, Artificial Sequence
  Synthetic oligonucleotide
gatgggagagggtggaagtatcggagttagggtcga

SEQ ID NO: 42908 - DNA, 37 bp, Artificial Sequence
  Synthetic oligonucleotide
cggtccggcaccccccccacttgttgtacagttcgga

SEQ ID NO: 42909 - DNA, 37 bp, Artificial Sequence
  Synthetic oligonucleotide
gttgctaccacacccatggccccactcttttcgatga

SEQ ID NO: 42910 - DNA, 37 bp, Artificial Sequence
  Synthetic oligonucleotide
ttcatacctccatctgcttcctgccgtatcacactga

SEQ ID NO: 42911 - DNA, 38 bp, Artificial Sequence
  Synthetic oligonucleotide
gtacacgcgagtggcgcttaccgtttccattttgctga

SEQ ID NO: 42912 - DNA, 36 bp, Artificial Sequence
  Synthetic oligonucleotide
gagacaagtgagaggtgagggcggcctgggtagtga

SEQ ID NO: 42913 - DNA, 38 bp, Artificial Sequence
  Synthetic oligonucleotide
accgccccgcggacttacaacataacattccaccgtga

SEQ ID NO: 42914 - DNA, 38 bp, Artificial Sequence
  Synthetic oligonucleotide
gggacaacgtacggtgcgtgggtggggcttgaaattga

SEQ ID NO: 42915 - DNA, 38 bp, Artificial Sequence
  Synthetic oligonucleotide
tccgtggagcccacttgattcttgacccgtagccttga

SEQ ID NO: 42916 - DNA, 37 bp, Artificial Sequence
  Synthetic oligonucleotide
gatacccccgcctggttaaaccttcgaagttccttga

SEQ ID NO: 42917 - DNA, 38 bp, Artificial Sequence
  Synthetic oligonucleotide
accgccgctgcctctccgcacgttgaccccaggtttga

SEQ ID NO: 42918 - DNA, 35 bp, Artificial Sequence
  Synthetic oligonucleotide
aaaccgccgattggtttgtccgctcctggcctcta

SEQ ID NO: 42919 - DNA, 36 bp, Artificial Sequence
  Synthetic oligonucleotide
tatgctgcggacttggcatctccactgcggttttta

SEQ ID NO: 42920 - DNA, 35 bp, Artificial Sequence
  Synthetic oligonucleotide
tttcccgccaccactgttcccgtcaagcatcaaac

SEQ ID NO: 42921 - DNA, 35 bp, Artificial Sequence
  Synthetic oligonucleotide
tctgccgataacatggctccattgtccgctttgac

SEQ ID NO: 42922 - DNA, 35 bp, Artificial Sequence
  Synthetic oligonucleotide
tgtaccaacgatgttaggccctcgtaccctctacc

SEQ ID NO: 42923 - DNA, 35 bp, Artificial Sequence
  Synthetic oligonucleotide
agtacggactgcagatcgaccagttcagaatcccc

SEQ ID NO: 42924 - DNA, 35 bp, Artificial Sequence
  Synthetic oligonucleotide
gaccgtctcaacctttagtcggcctccatccactc

SEQ ID NO: 42925 - DNA, 35 bp, Artificial Sequence
  Synthetic oligonucleotide
tcaccatactccagaaagactacaatatgcgcctc

SEQ ID NO: 42926 - DNA, 35 bp, Artificial Sequence
  Synthetic oligonucleotide
tcccaacctcaccttgccctcattgtaccgaagtc

SEQ ID NO: 42927 - DNA, 35 bp, Artificial Sequence
  Synthetic oligonucleotide
aacacctggcacctaccacagaataccatcagtcg

SEQ ID NO: 42928 - DNA, 35 bp, Artificial Sequence
  Synthetic oligonucleotide
gcataggggcacaggcaaggaggggggtaactggg

SEQ ID NO: 42929 - DNA, 35 bp, Artificial Sequence
  Synthetic oligonucleotide
gatccccaacgttgttttttctactgtttaccatg

SEQ ID NO: 42930 - DNA, 36 bp, Artificial Sequence
  Synthetic oligonucleotide
tcacgctggtcgtagtcgctgttgcgcgaaccccct

SEQ ID NO: 42931 - DNA, 35 bp, Artificial Sequence
  Synthetic oligonucleotide
ttgcgatagcaccgcatggactcgcacgtattcct

SEQ ID NO: 42932 - DNA, 35 bp, Artificial Sequence
  Synthetic oligonucleotide
aaaccgactgcgtgcgctagtttgccttgtttcct

SEQ ID NO: 42933 - DNA, 35 bp, Artificial Sequence
  Synthetic oligonucleotide
gtggattgcctgccctgctgagtgccaaaaattct

SEQ ID NO: 42934 - DNA, 35 bp, Artificial Sequence
  Synthetic oligonucleotide
acgtgaatgtggccgcttggggtgatgtggtgggt

SEQ ID NO: 42935 - DNA, 35 bp, Artificial Sequence
  Synthetic oligonucleotide
atccacgcagggagcaagtgggaaataaaaaatgt

SEQ ID NO: 42936 - DNA, 35 bp, Artificial Sequence
  Synthetic oligonucleotide
acacacaagcccaacctcccaacccgctcgacatt

SEQ ID NO: 42937 - DNA, 36 bp, Artificial Sequence
  Synthetic oligonucleotide
acccgcaccatcactagcacccgctcctggtcgtaa

SEQ ID NO: 42938 - DNA, 36 bp, Artificial Sequence
  Synthetic oligonucleotide
tcgtgccacaactacattccgctctcgtgtcttaca

SEQ ID NO: 42939 - DNA, 36 bp, Artificial Sequence
  Synthetic oligonucleotide
aacacaccctcccccgatcgctacgtagaccaaaga

SEQ ID NO: 42940 - DNA, 37 bp, Artificial Sequence
  Synthetic oligonucleotide
gtagctgccacatgttgtgatcctcgcccatatccga

SEQ ID NO: 42941 - DNA, 37 bp, Artificial Sequence
  Synthetic oligonucleotide
gcaatagggagctaaagggggcaacaaaggacaagga

SEQ ID NO: 42942 - DNA, 37 bp, Artificial Sequence
  Synthetic oligonucleotide
tgagcgggggagggggggctaagtagaggaccaggga

SEQ ID NO: 42943 - DNA, 36 bp, Artificial Sequence
  Synthetic oligonucleotide
gtcgggtacgatggaatggatcaaaggggggaggga

SEQ ID NO: 42944 - DNA, 35 bp, Artificial Sequence
  Synthetic oligonucleotide
gactgggggggactcagtaataggtggatgttgga

SEQ ID NO: 42945 - DNA, 37 bp, Artificial Sequence
  Synthetic oligonucleotide
attgcgccgactcgtctgaccgatccaccacaaatga

SEQ ID NO: 42946 - DNA, 38 bp, Artificial Sequence
  Synthetic oligonucleotide
agcgtcgtacactgaacattggcctctgcactcactga

SEQ ID NO: 42947 - DNA, 38 bp, Artificial Sequence
  Synthetic oligonucleotide
ttgagatgtccgttccctgtagcgcccctgcctcctga

SEQ ID NO: 42948 - DNA, 37 bp, Artificial Sequence
  Synthetic oligonucleotide
gtccgccaatcccccgtgcccgcccccatctagctga

SEQ ID NO: 42949 - DNA, 37 bp, Artificial Sequence
  Synthetic oligonucleotide
actgaccacaagtgcatctccttcgcctatcacgtga

SEQ ID NO: 42950 - DNA, 37 bp, Artificial Sequence
  Synthetic oligonucleotide
gcctgccccggcacttttcaccccagacatcgtttga

SEQ ID NO: 42951 - DNA, 36 bp, Artificial Sequence
  Synthetic oligonucleotide
gtcaccctcccaccgtaagcaggcatccactttata

SEQ ID NO: 42952 - DNA, 36 bp, Artificial Sequence
  Synthetic oligonucleotide
gcgcccgaagctactgcacaagttaccctcgctcta

SEQ ID NO: 42953 - DNA, 36 bp, Artificial Sequence
  Synthetic oligonucleotide
gcgacggccaggtttctcagtcctcctgctccggta

SEQ ID NO: 42954 - DNA, 35 bp, Artificial Sequence
  Synthetic oligonucleotide
tatcacctctattgccctccagacactacaggtta

SEQ ID NO: 42955 - DNA, 35 bp, Artificial Sequence
  Synthetic oligonucleotide
tcacaaccccgccacacggaaccccgccacgcacc

SEQ ID NO: 42956 - DNA, 35 bp, Artificial Sequence
  Synthetic oligonucleotide
ggtgcaacacctccgtatcgccctgcaaggtcccc

SEQ ID NO: 42957 - DNA, 35 bp, Artificial Sequence
  Synthetic oligonucleotide
accacagggcctagctaacagtaatcgcccgcgcc

SEQ ID NO: 42958 - DNA, 35 bp, Artificial Sequence
  Synthetic oligonucleotide
agcataggccgcttttccgccagtactcgttcgcc

SEQ ID NO: 42959 - DNA, 35 bp, Artificial Sequence
  Synthetic oligonucleotide
gtaccaccaccgtcaatccccaaatctcctttgcc

SEQ ID NO: 42960 - DNA, 35 bp, Artificial Sequence
  Synthetic oligonucleotide
tattcgggccacacctagaccttaagcactcccgc

SEQ ID NO: 42961 - DNA, 35 bp, Artificial Sequence
  Synthetic oligonucleotide
acactacttcacgcatccacggtcccgctaacatc

SEQ ID NO: 42962 - DNA, 35 bp, Artificial Sequence
  Synthetic oligonucleotide
gtgaagcctcgtgcgtgtacgtttcccctagcctc

SEQ ID NO: 42963 - DNA, 35 bp, Artificial Sequence
  Synthetic oligonucleotide
gccgttcgccgaccctttttttgctttcctgagag

SEQ ID NO: 42964 - DNA, 35 bp, Artificial Sequence
  Synthetic oligonucleotide
tcccaacggaatcattctatacttttgtgacctct

SEQ ID NO: 42965 - DNA, 35 bp, Artificial Sequence
  Synthetic oligonucleotide
aggtcactccatgtgcgcaccatcttttgttttct

SEQ ID NO: 42966 - DNA, 35 bp, Artificial Sequence
  Synthetic oligonucleotide
tccgtgcactgcccctgtccctccgcatcctcagt

SEQ ID NO: 42967 - DNA, 35 bp, Artificial Sequence
  Synthetic oligonucleotide
gacgtggccaaagtgatttatctgtttcatgcttt

SEQ ID NO: 42968 - DNA, 36 bp, Artificial Sequence
  Synthetic oligonucleotide
gcgacaacttgtgctgtgtgtgtgtgtgcgatcgaa

SEQ ID NO: 42969 - DNA, 36 bp, Artificial Sequence
  Synthetic oligonucleotide
gcacctaccatcgccctaattagcggactttcacca

SEQ ID NO: 42970 - DNA, 36 bp, Artificial Sequence
  Synthetic oligonucleotide
tcccgaccttgccccgactcgtctagactcacgcca

SEQ ID NO: 42971 - DNA, 36 bp, Artificial Sequence
  Synthetic oligonucleotide
tgccacacgctacactgttctcgccccgccactgca

SEQ ID NO: 42972 - DNA, 35 bp, Artificial Sequence
  Synthetic oligonucleotide
attccccgcaatgcactcccccatctacgacaaga

SEQ ID NO: 42973 - DNA, 37 bp, Artificial Sequence
  Synthetic oligonucleotide
gtggtgtggggagagttgggggagcagccggtggaga

SEQ ID NO: 42974 - DNA, 37 bp, Artificial Sequence
  Synthetic oligonucleotide
gactcagtgccttcaccttttccttaagcagtctcga

SEQ ID NO: 42975 - DNA, 35 bp, Artificial Sequence
  Synthetic oligonucleotide
attgcacctcgatcaccacaccgacgctggttcga

SEQ ID NO: 42976 - DNA, 37 bp, Artificial Sequence
  Synthetic oligonucleotide
tcaggggagtaccctgatgggagggagggataaagga

SEQ ID NO: 42977 - DNA, 37 bp, Artificial Sequence
  Synthetic oligonucleotide
gtcgtcggaacgtggtgcaggggggaggggcgaagga

SEQ ID NO: 42978 - DNA, 37 bp, Artificial Sequence
  Synthetic oligonucleotide
actctcacgcaccctgttactgctccctacggtggga

SEQ ID NO: 42979 - DNA, 37 bp, Artificial Sequence
  Synthetic oligonucleotide
aaagggtacgtgcagggggcgcggttcgtgggatgga

SEQ ID NO: 42980 - DNA, 37 bp, Artificial Sequence
  Synthetic oligonucleotide
tctccgatcaccaccgcctctcaagtgcactcctgga

SEQ ID NO: 42981 - DNA, 37 bp, Artificial Sequence
  Synthetic oligonucleotide
gccgttaccctgtctaacaccacctgcttttgaatga

SEQ ID NO: 42982 - DNA, 37 bp, Artificial Sequence
  Synthetic oligonucleotide
ggtcactgcccaacacatacgcttcccgctcccatga

SEQ ID NO: 42983 - DNA, 38 bp, Artificial Sequence
  Synthetic oligonucleotide
gaaaacagggacgggacggtggggcatgttaggtatga

SEQ ID NO: 42984 - DNA, 38 bp, Artificial Sequence
  Synthetic oligonucleotide
actccgccgaatccctggtcaacacacatttagcctga

SEQ ID NO: 42985 - DNA, 38 bp, Artificial Sequence
  Synthetic oligonucleotide
attgccaccaccatgggacacacatttctttaatctga

SEQ ID NO: 42986 - DNA, 37 bp, Artificial Sequence
  Synthetic oligonucleotide
actgtccctttcgttgttttgctctttcatgccttga

SEQ ID NO: 42987 - DNA, 36 bp, Artificial Sequence
  Synthetic oligonucleotide
aacaccacgcctgacctgctgtgtgaatccgtacta

SEQ ID NO: 42988 - DNA, 35 bp, Artificial Sequence
  Synthetic oligonucleotide
attgaacccgccctgatcgtaatcaggtctgccac

SEQ ID NO: 42989 - DNA, 35 bp, Artificial Sequence
  Synthetic oligonucleotide
gccatttagaccctcctgagccaccgtacggtccc

SEQ ID NO: 42990 - DNA, 35 bp, Artificial Sequence
  Synthetic oligonucleotide
gattccatcataaccccttcatctgtatttggtcc

SEQ ID NO: 42991 - DNA, 35 bp, Artificial Sequence
  Synthetic oligonucleotide
acacggtggagcaatcgtcgacccccgacctttcc

SEQ ID NO: 42992 - DNA, 35 bp, Artificial Sequence
  Synthetic oligonucleotide
gacttgacctcgcaggattcacatacacctctgtc

SEQ ID NO: 42993 - DNA, 35 bp, Artificial Sequence
  Synthetic oligonucleotide
taccgctacatccaggcgctcctcagttcatcttg

SEQ ID NO: 42994 - DNA, 35 bp, Artificial Sequence
  Synthetic oligonucleotide
tagaacgtagggctggaccgaggaaaagtagggat

SEQ ID NO: 42995 - DNA, 35 bp, Artificial Sequence
  Synthetic oligonucleotide
tcattcgctgcactcttcgatcctcggggtgccct

SEQ ID NO: 42996 - DNA, 35 bp, Artificial Sequence
  Synthetic oligonucleotide
tactctgaacgtcccgcagcctccgactctcgtct

SEQ ID NO: 42997 - DNA, 35 bp, Artificial Sequence
  Synthetic oligonucleotide
tccctcgcccaccgttattcttagctgacagcagt

SEQ ID NO: 42998 - DNA, 35 bp, Artificial Sequence
  Synthetic oligonucleotide
gtcccgccccccccagttgccacgacgataaatgt

SEQ ID NO: 42999 - DNA, 35 bp, Artificial Sequence
  Synthetic oligonucleotide
gctgcgcgtggagggggcaaaattggtaggtctgt

SEQ ID NO: 43000 - DNA, 35 bp, Artificial Sequence
  Synthetic oligonucleotide
gtgccatgttcattcttgcgatctgtcccctactt

SEQ ID NO: 43001 - DNA, 35 bp, Artificial Sequence
  Synthetic oligonucleotide
acacactgcgtaaatcttatatttgcacctctgtt

SEQ ID NO: 43002 - DNA, 35 bp, Artificial Sequence
  Synthetic oligonucleotide
tcaccatgccaaagctgtcacccattggtttgttt

SEQ ID NO: 43003 - DNA, 35 bp, Artificial Sequence
  Synthetic oligonucleotide
attggccacctctcggccacttggacttactctaa

SEQ ID NO: 43004 - DNA, 35 bp, Artificial Sequence
  Synthetic oligonucleotide
atgaatcgcccacctcacctgcacatcgagtttaa

SEQ ID NO: 43005 - DNA, 36 bp, Artificial Sequence
  Synthetic oligonucleotide
aacaacaccccacaacctgggatctacggatcacca

SEQ ID NO: 43006 - DNA, 35 bp, Artificial Sequence
  Synthetic oligonucleotide
tctagcgtaccgacaccgcactttatcattcatca

SEQ ID NO: 43007 - DNA, 36 bp, Artificial Sequence
  Synthetic oligonucleotide
atggattggggggccggggtggtaattgtgggaaga

SEQ ID NO: 43008 - DNA, 34 bp, Artificial Sequence
  Synthetic oligonucleotide
gccacaccctttcactgacagtgcgagtgcacga

SEQ ID NO: 43009 - DNA, 37 bp, Artificial Sequence
  Synthetic oligonucleotide
gcgatgagacttggaggatagggagggagggagtcga

SEQ ID NO: 43010 - DNA, 37 bp, Artificial Sequence
  Synthetic oligonucleotide
accgcgtacgccccgtttacttctgtcatagattcga

SEQ ID NO: 43011 - DNA, 37 bp, Artificial Sequence
  Synthetic oligonucleotide
acgcactcggctatgctcgtctcacctaaaacttcga

SEQ ID NO: 43012 - DNA, 37 bp, Artificial Sequence
  Synthetic oligonucleotide
gctgagtacgctggtttgggaaccgggaagggaggga

SEQ ID NO: 43013 - DNA, 37 bp, Artificial Sequence
  Synthetic oligonucleotide
gtcacaggtaaagtgggatcatgcagggaacgcggga

SEQ ID NO: 43014 - DNA, 37 bp, Artificial Sequence
  Synthetic oligonucleotide
atactgccagactccccgcctcactgtaaccaatgga

SEQ ID NO: 43015 - DNA, 38 bp, Artificial Sequence
  Synthetic oligonucleotide
acacggcaacttgcatacgtactcttcttgccccatga

SEQ ID NO: 43016 - DNA, 37 bp, Artificial Sequence
  Synthetic oligonucleotide
acccactatccttccagggtgtcacatccctctatga

SEQ ID NO: 43017 - DNA, 37 bp, Artificial Sequence
  Synthetic oligonucleotide
agaagagtgcaggaggggagataactggggcgactga

SEQ ID NO: 43018 - DNA, 38 bp, Artificial Sequence
  Synthetic oligonucleotide
accaccctagaccacctgagccagtaccgtgtgcctga

SEQ ID NO: 43019 - DNA, 36 bp, Artificial Sequence
  Synthetic oligonucleotide
aatgggagggaagttggggttgatgtagggaattga

SEQ ID NO: 43020 - DNA, 38 bp, Artificial Sequence
  Synthetic oligonucleotide
gacaccgcagaattaggtatctccgcacatttggttga

SEQ ID NO: 43021 - DNA, 38 bp, Artificial Sequence
  Synthetic oligonucleotide
actcactcgcatgagtcgtacccatttttctcttttga

SEQ ID NO: 43022 - DNA, 35 bp, Artificial Sequence
  Synthetic oligonucleotide
tcctgctcctgctccgatttagttgatcctcagta

SEQ ID NO: 43023 - DNA, 35 bp, Artificial Sequence
  Synthetic oligonucleotide
ggagccgccgccaccctccgatttacgtacgatta

SEQ ID NO: 43024 - DNA, 35 bp, Artificial Sequence
  Synthetic oligonucleotide
acacggctgtactatatgacaaccgtccgttctac

SEQ ID NO: 43025 - DNA, 35 bp, Artificial Sequence
  Synthetic oligonucleotide
ttagcaccgggacaaaagagttacggtgaactacc

SEQ ID NO: 43026 - DNA, 35 bp, Artificial Sequence
  Synthetic oligonucleotide
tgacatttcccctcacttgttgcattagtgagagc

SEQ ID NO: 43027 - DNA, 35 bp, Artificial Sequence
  Synthetic oligonucleotide
tatccatgcggctcattcacttgtactctctaggg

SEQ ID NO: 43028 - DNA, 35 bp, Artificial Sequence
  Synthetic oligonucleotide
caccaagcctcctcgctgtaatacctcgtgttaat

SEQ ID NO: 43029 - DNA, 35 bp, Artificial Sequence
  Synthetic oligonucleotide
tagagtggggcctgagcaatggtggaaggggctat

SEQ ID NO: 43030 - DNA, 35 bp, Artificial Sequence
  Synthetic oligonucleotide
gtactgcccgctctccatcatacgtacaaactact

SEQ ID NO: 43031 - DNA, 35 bp, Artificial Sequence
  Synthetic oligonucleotide
gccgacgacgtgagccctccgagtattccgccgct

SEQ ID NO: 43032 - DNA, 35 bp, Artificial Sequence
  Synthetic oligonucleotide
gaccccgactccgcaggtttgccttcgctacctct

SEQ ID NO: 43033 - DNA, 36 bp, Artificial Sequence
  Synthetic oligonucleotide
acccaccatacaattgtgcctttcatgcgaataaaa

SEQ ID NO: 43034 - DNA, 36 bp, Artificial Sequence
  Synthetic oligonucleotide
acgaccacctggcaggactatactacgctcttccaa

SEQ ID NO: 43035 - DNA, 35 bp, Artificial Sequence
  Synthetic oligonucleotide
accatcgcatccatcagtccctgtttaactgcgaa

SEQ ID NO: 43036 - DNA, 36 bp, Artificial Sequence
  Synthetic oligonucleotide
tgcactgctctttccgtcttgaccgtccgtttttaa

SEQ ID NO: 43037 - DNA, 36 bp, Artificial Sequence
  Synthetic oligonucleotide
gagggggggccggctgggcaagagaatttaatgaca

SEQ ID NO: 43038 - DNA, 36 bp, Artificial Sequence
  Synthetic oligonucleotide
gctatctgccccaccctggtaggtccctttcaccca

SEQ ID NO: 43039 - DNA, 37 bp, Artificial Sequence
  Synthetic oligonucleotide
gacaggagacaattggacatgagtgggaggatagaga

SEQ ID NO: 43040 - DNA, 37 bp, Artificial Sequence
  Synthetic oligonucleotide
tgtgtatgatccctcccgctcacgccgcatattgaga

SEQ ID NO: 43041 - DNA, 37 bp, Artificial Sequence
  Synthetic oligonucleotide
tgccaaccgactcccagtcaagcaccccgcccataga

SEQ ID NO: 43042 - DNA, 35 bp, Artificial Sequence
  Synthetic oligonucleotide
gcactctgcaggccagcatatttcgcgccccacga

SEQ ID NO: 43043 - DNA, 36 bp, Artificial Sequence
  Synthetic oligonucleotide
gacattaccacctgcaacctccttatggtacaccga

SEQ ID NO: 43044 - DNA, 37 bp, Artificial Sequence
  Synthetic oligonucleotide
tttatggggaggggtgggtagggtcattcgccgagga

SEQ ID NO: 43045 - DNA, 37 bp, Artificial Sequence
  Synthetic oligonucleotide
aagtggattgggagaagaaagggagtgtgcgatagga

SEQ ID NO: 43046 - DNA, 37 bp, Artificial Sequence
  Synthetic oligonucleotide
gccacactcacaagtatttatttgcccgctgcacgga

SEQ ID NO: 43047 - DNA, 37 bp, Artificial Sequence
  Synthetic oligonucleotide
tcaccgccctgttctgctgcctagagtttcctaatga

SEQ ID NO: 43048 - DNA, 37 bp, Artificial Sequence
  Synthetic oligonucleotide
tgctatgccacgttctcacctaagtcgtcctgcctga

SEQ ID NO: 43049 - DNA, 38 bp, Artificial Sequence
  Synthetic oligonucleotide
gttgtgtcgtccaaatgcatctgtgcctcttttcctga

SEQ ID NO: 43050 - DNA, 38 bp, Artificial Sequence
  Synthetic oligonucleotide
atcactcccgatcggggttcaccaatctacactgctga

SEQ ID NO: 43051 - DNA, 35 bp, Artificial Sequence
  Synthetic oligonucleotide
gcaacacaagaactgcgccaactcgaattccgtga

SEQ ID NO: 43052 - DNA, 37 bp, Artificial Sequence
  Synthetic oligonucleotide
aacgcacaatcccgtcaccagtcgcgtcttttcttga

SEQ ID NO: 43053 - DNA, 38 bp, Artificial Sequence
  Synthetic oligonucleotide
gtgatcacctctgagccacatgacctcctcgctgttga

SEQ ID NO: 43054 - DNA, 38 bp, Artificial Sequence
  Synthetic oligonucleotide
gatgaccacacatgccttagcagatcataatcatttga

SEQ ID NO: 43055 - DNA, 36 bp, Artificial Sequence
  Synthetic oligonucleotide
acgagcggccagccttgtttggtcctgcttattcta

SEQ ID NO: 43056 - DNA, 35 bp, Artificial Sequence
  Synthetic oligonucleotide
gtcccctcccattatggattccgggtttactccac

SEQ ID NO: 43057 - DNA, 35 bp, Artificial Sequence
  Synthetic oligonucleotide
acttaacggtgggaggtggggcggggctacgtcac

SEQ ID NO: 43058 - DNA, 35 bp, Artificial Sequence
  Synthetic oligonucleotide
tcgctaacccttatgggcctacctaccccgtgctc

SEQ ID NO: 43059 - DNA, 35 bp, Artificial Sequence
  Synthetic oligonucleotide
gtctgagcagtaacaaaaagcctgcaactccattc

SEQ ID NO: 43060 - DNA, 35 bp, Artificial Sequence
  Synthetic oligonucleotide
gaagtagggagaaatggaatgaaagaaatcgctcg

SEQ ID NO: 43061 - DNA, 35 bp, Artificial Sequence
  Synthetic oligonucleotide
gaacaagcggataagggaatagagccaaaacgagg

SEQ ID NO: 43062 - DNA, 35 bp, Artificial Sequence
  Synthetic oligonucleotide
tccatgagctccgaaaatacatgactgccgtttct

SEQ ID NO: 43063 - DNA, 36 bp, Artificial Sequence
  Synthetic oligonucleotide
ggagacgatccacgctgctttgccatcttgtttgaa

SEQ ID NO: 43064 - DNA, 36 bp, Artificial Sequence
  Synthetic oligonucleotide
agtatcgcggtcgcatctctctgcccgtttgaacca

SEQ ID NO: 43065 - DNA, 35 bp, Artificial Sequence
  Synthetic oligonucleotide
gccactacccttagaaatcgtgctggaccacacga

SEQ ID NO: 43066 - DNA, 37 bp, Artificial Sequence
  Synthetic oligonucleotide
aacatgcgccgaatacataacaacacttcatgcccga

SEQ ID NO: 43067 - DNA, 37 bp, Artificial Sequence
  Synthetic oligonucleotide
gagagtacagtggagtcggagaggagtaggagtagga

SEQ ID NO: 43068 - DNA, 37 bp, Artificial Sequence
  Synthetic oligonucleotide
tccaccatccaggaagtcccaagtgattgaggacgga

SEQ ID NO: 43069 - DNA, 37 bp, Artificial Sequence
  Synthetic oligonucleotide
gacgacgcgggacacgggctagtattaggggctggga

SEQ ID NO: 43070 - DNA, 37 bp, Artificial Sequence
  Synthetic oligonucleotide
ttggacgccttcacctgttcctcttgaccgcttggga

SEQ ID NO: 43071 - DNA, 38 bp, Artificial Sequence
  Synthetic oligonucleotide
tgcggaatggggcggggggctacaacgacaacaactga

SEQ ID NO: 43072 - DNA, 37 bp, Artificial Sequence
  Synthetic oligonucleotide
gaaccctcgggggggtcacggccacccttttccctga

SEQ ID NO: 43073 - DNA, 38 bp, Artificial Sequence
  Synthetic oligonucleotide
acgcgccacatcgcccccgactctgcttacagtcctga

SEQ ID NO: 43074 - DNA, 38 bp, Artificial Sequence
  Synthetic oligonucleotide
gtatcgcagtccggttccctccaccccttgtcatctga

SEQ ID NO: 43075 - DNA, 38 bp, Artificial Sequence
  Synthetic oligonucleotide
acagggcacacgagctatctgaaggggggggcgggtga

SEQ ID NO: 43076 - DNA, 38 bp, Artificial Sequence
  Synthetic oligonucleotide
aacatgtccaggttggaggggtttaaagggtggggtga

SEQ ID NO: 43077 - DNA, 38 bp, Artificial Sequence
  Synthetic oligonucleotide
tcaacttgcccctctaacattagaatgtcgtgacttga

SEQ ID NO: 43078 - DNA, 36 bp, Artificial Sequence
  Synthetic oligonucleotide
gatccgctggccatacctgctatgaaaacctcttga

SEQ ID NO: 43079 - DNA, 37 bp, Artificial Sequence
  Synthetic oligonucleotide
ggagccagtcaggatcgttttcctttgcctttcttga

SEQ ID NO: 43080 - DNA, 38 bp, Artificial Sequence
  Synthetic oligonucleotide
gtggcctacgcctgctatccctcttctttcaaggttga

SEQ ID NO: 43081 - DNA, 37 bp, Artificial Sequence
  Synthetic oligonucleotide
gggggggtggaggggccgacgaggaatggaatgttga

SEQ ID NO: 43082 - DNA, 38 bp, Artificial Sequence
  Synthetic oligonucleotide
ggacacctgccgcaccacccgccgttcgatcgatttga

SEQ ID NO: 43083 - DNA, 36 bp, Artificial Sequence
  Synthetic oligonucleotide
gtctctcagccgctatatcaccccgtctggtcgtta

SEQ ID NO: 43084 - DNA, 35 bp, Artificial Sequence
  Synthetic oligonucleotide
gtgcaaaacgcacgcacgaccacgcaggctcccac

SEQ ID NO: 43085 - DNA, 35 bp, Artificial Sequence
  Synthetic oligonucleotide
atgttactgacacgttgcctccgttctggtcccac

SEQ ID NO: 43086 - DNA, 34 bp, Artificial Sequence
  Synthetic oligonucleotide
gaaccgctggcatctgcagacggtctcccttacc

SEQ ID NO: 43087 - DNA, 35 bp, Artificial Sequence
  Synthetic oligonucleotide
acgcataacatcaccctgtgcccgactctgaagcc

SEQ ID NO: 43088 - DNA, 35 bp, Artificial Sequence
  Synthetic oligonucleotide
acgccggacgggcgccctttttaccccccaaatgc

SEQ ID NO: 43089 - DNA, 35 bp, Artificial Sequence
  Synthetic oligonucleotide
gcggacgccccccccagcatttatcaatcgtttgc

SEQ ID NO: 43090 - DNA, 35 bp, Artificial Sequence
  Synthetic oligonucleotide
gtgtatcctcactgctttgtgattcggattctctc

SEQ ID NO: 43091 - DNA, 35 bp, Artificial Sequence
  Synthetic oligonucleotide
gggtccctcccgactcgagttccatctacccctag

SEQ ID NO: 43092 - DNA, 35 bp, Artificial Sequence
  Synthetic oligonucleotide
gcatttccaccttgtctagacccatcaccccgacg

SEQ ID NO: 43093 - DNA, 35 bp, Artificial Sequence
  Synthetic oligonucleotide
actcgccgcgcccaatctcccgctcaccacaggtg

SEQ ID NO: 43094 - DNA, 35 bp, Artificial Sequence
  Synthetic oligonucleotide
gattagcaggagcgtatctgccgattacatttttg

SEQ ID NO: 43095 - DNA, 35 bp, Artificial Sequence
  Synthetic oligonucleotide
tgtccactgacctgtcgaacttccttacggctcat

SEQ ID NO: 43096 - DNA, 35 bp, Artificial Sequence
  Synthetic oligonucleotide
acgcgaatgtctttcgctgtactccatcctccgct

SEQ ID NO: 43097 - DNA, 36 bp, Artificial Sequence
  Synthetic oligonucleotide
tagaccgttaccctgattcagggccgttcattccaa

SEQ ID NO: 43098 - DNA, 35 bp, Artificial Sequence
  Synthetic oligonucleotide
gtggatgtaggggggtgatagactcggtggggcaa

SEQ ID NO: 43099 - DNA, 36 bp, Artificial Sequence
  Synthetic oligonucleotide
aacacccatgttggcaccgatccttgtcctgattaa

SEQ ID NO: 43100 - DNA, 36 bp, Artificial Sequence
  Synthetic oligonucleotide
gtaccgattcgtgccgattgagcctctaccgactca

SEQ ID NO: 43101 - DNA, 37 bp, Artificial Sequence
  Synthetic oligonucleotide
aacagccacgcccttgtgctcctgccctcactcgaga

SEQ ID NO: 43102 - DNA, 37 bp, Artificial Sequence
  Synthetic oligonucleotide
ggagatcgctcagccgcccaatggcccgcctctacga

SEQ ID NO: 43103 - DNA, 37 bp, Artificial Sequence
  Synthetic oligonucleotide
ccacactcaccacatgcttgtcccagactaacaccga

SEQ ID NO: 43104 - DNA, 37 bp, Artificial Sequence
  Synthetic oligonucleotide
actgcggaggagggatgtatgagtagggggaggccga

SEQ ID NO: 43105 - DNA, 37 bp, Artificial Sequence
  Synthetic oligonucleotide
accatcacactgggggtttgaaggtctgtaccttcga

SEQ ID NO: 43106 - DNA, 37 bp, Artificial Sequence
  Synthetic oligonucleotide
actccctgccctccctgtatcggagcactttaaggga

SEQ ID NO: 43107 - DNA, 37 bp, Artificial Sequence
  Synthetic oligonucleotide
gaactcgaggggtgaaggtgtgggtagcaatagggga

SEQ ID NO: 43108 - DNA, 37 bp, Artificial Sequence
  Synthetic oligonucleotide
ttgaaggacaggcggataggagagaacggcggatgga

SEQ ID NO: 43109 - DNA, 34 bp, Artificial Sequence
  Synthetic oligonucleotide
gatctccgcctgcttacgacctagcccctgtgga

SEQ ID NO: 43110 - DNA, 38 bp, Artificial Sequence
  Synthetic oligonucleotide
ggagacaggtacgtggggatgggcgatagtgtggatga

SEQ ID NO: 43111 - DNA, 38 bp, Artificial Sequence
  Synthetic oligonucleotide
tacacactggccatcattgatactcagtacacccctga

SEQ ID NO: 43112 - DNA, 37 bp, Artificial Sequence
  Synthetic oligonucleotide
actaactcgccccgccgaccttcaccgcccattgtga

SEQ ID NO: 43113 - DNA, 37 bp, Artificial Sequence
  Synthetic oligonucleotide
tgcgcaagcaacactgaaatcagggccggggcattga

SEQ ID NO: 43114 - DNA, 38 bp, Artificial Sequence
  Synthetic oligonucleotide
gcattgcgcagtattaccctccgtcgttccatacttga

SEQ ID NO: 43115 - DNA, 35 bp, Artificial Sequence
  Synthetic oligonucleotide
agaccattctccgactctcgtacacgacatttcta

SEQ ID NO: 43116 - DNA, 35 bp, Artificial Sequence
  Synthetic oligonucleotide
tcaagcctccctgttctattcccatctcttttgta

SEQ ID NO: 43117 - DNA, 35 bp, Artificial Sequence
  Synthetic oligonucleotide
gcaccccaggtgactcacgtcacactcctctttta

SEQ ID NO: 43118 - DNA, 35 bp, Artificial Sequence
  Synthetic oligonucleotide
aacatcaactgcaaactattagggccctatcaacc

SEQ ID NO: 43119 - DNA, 35 bp, Artificial Sequence
  Synthetic oligonucleotide
acaactctgctcataatggtcacgactgccattcc

SEQ ID NO: 43120 - DNA, 35 bp, Artificial Sequence
  Synthetic oligonucleotide
gacaacactatgtgctgtttttttgatctagttcc

SEQ ID NO: 43121 - DNA, 35 bp, Artificial Sequence
  Synthetic oligonucleotide
tccacccttgctagtgactctaaagaagccgcatc

SEQ ID NO: 43122 - DNA, 35 bp, Artificial Sequence
  Synthetic oligonucleotide
tcacagttcccaactggtctctcaccctcaacgag

SEQ ID NO: 43123 - DNA, 35 bp, Artificial Sequence
  Synthetic oligonucleotide
gtccgcctgcacacattgcctcctaagttatcgag

SEQ ID NO: 43124 - DNA, 35 bp, Artificial Sequence
  Synthetic oligonucleotide
tctcccgctcgaacctggcactctagggcttcccg

SEQ ID NO: 43125 - DNA, 35 bp, Artificial Sequence
  Synthetic oligonucleotide
tccctcccggtccgtatattgtcaatccctatttg

SEQ ID NO: 43126 - DNA, 35 bp, Artificial Sequence
  Synthetic oligonucleotide
tacctatcgcaatccatgatgtggatcgccaccat

SEQ ID NO: 43127 - DNA, 35 bp, Artificial Sequence
  Synthetic oligonucleotide
aataaaggcacccgacaccccgtaaccctgccact

SEQ ID NO: 43128 - DNA, 35 bp, Artificial Sequence
  Synthetic oligonucleotide
ttcgcgtgaaggttccgccccattgcttgtctcgt

SEQ ID NO: 43129 - DNA, 35 bp, Artificial Sequence
  Synthetic oligonucleotide
gatgcacaacacctagctactgaccttagtccctt

SEQ ID NO: 43130 - DNA, 34 bp, Artificial Sequence
  Synthetic oligonucleotide
tcccgctgggaccgcgattactgctctgtctctt

SEQ ID NO: 43131 - DNA, 36 bp, Artificial Sequence
  Synthetic oligonucleotide
acacaccctcctgtttcatgtaggtcacttataaaa

SEQ ID NO: 43132 - DNA, 35 bp, Artificial Sequence
  Synthetic oligonucleotide
tgacgcctccctgatactgaagtcgcaacatcaaa

SEQ ID NO: 43133 - DNA, 36 bp, Artificial Sequence
  Synthetic oligonucleotide
tcacttccccggcttcatcccgtccggcccctcaaa

SEQ ID NO: 43134 - DNA, 35 bp, Artificial Sequence
  Synthetic oligonucleotide
acgggggagggcacgagggccgggaagtaacgcaa

SEQ ID NO: 43135 - DNA, 36 bp, Artificial Sequence
  Synthetic oligonucleotide
tcatcactccttaacctgcgctctgtgcttttcgaa

SEQ ID NO: 43136 - DNA, 35 bp, Artificial Sequence
  Synthetic oligonucleotide
gcccctcaactgacacacggctcttctgcttccca

SEQ ID NO: 43137 - DNA, 36 bp, Artificial Sequence
  Synthetic oligonucleotide
aacggggcacacactccggttactctgctacttcca

SEQ ID NO: 43138 - DNA, 35 bp, Artificial Sequence
  Synthetic oligonucleotide
tgactgccttaaggtacaacattcaccggcttcca

SEQ ID NO: 43139 - DNA, 36 bp, Artificial Sequence
  Synthetic oligonucleotide
acccgccacactgccttctgccggcaatctcaagca

SEQ ID NO: 43140 - DNA, 36 bp, Artificial Sequence
  Synthetic oligonucleotide
gatagggacggacatggttaaggataggcgacggca

SEQ ID NO: 43141 - DNA, 37 bp, Artificial Sequence
  Synthetic oligonucleotide
gctcgtagctcctgcccgctctcacttccgttataga

SEQ ID NO: 43142 - DNA, 37 bp, Artificial Sequence
  Synthetic oligonucleotide
gtgtgacgggagagggggtacaagtgtaaatattaga

SEQ ID NO: 43143 - DNA, 37 bp, Artificial Sequence
  Synthetic oligonucleotide
agccctgcgcgcgcttcccccatgctatacataccga

SEQ ID NO: 43144 - DNA, 37 bp, Artificial Sequence
  Synthetic oligonucleotide
gacaatagtcggaatctgtcccgcctctcttatccga

SEQ ID NO: 43145 - DNA, 36 bp, Artificial Sequence
  Synthetic oligonucleotide
tccagatgccggttttttttacttgatctctttcga

SEQ ID NO: 43146 - DNA, 37 bp, Artificial Sequence
  Synthetic oligonucleotide
tagggccgttccctcacctctctgcctgttacacgga

SEQ ID NO: 43147 - DNA, 37 bp, Artificial Sequence
  Synthetic oligonucleotide
tggggcagtacgagtacggttggaggggggcaatgga

SEQ ID NO: 43148 - DNA, 37 bp, Artificial Sequence
  Synthetic oligonucleotide
gtcgaaggagctagcgactgagccctttccttactga

SEQ ID NO: 43149 - DNA, 38 bp, Artificial Sequence
  Synthetic oligonucleotide
tcgacggccgtcgccgcctatgttccgtttccacctga

SEQ ID NO: 43150 - DNA, 37 bp, Artificial Sequence
  Synthetic oligonucleotide
gacacggaacctttgctaatctcgtcgctcttgctga

SEQ ID NO: 43151 - DNA, 38 bp, Artificial Sequence
  Synthetic oligonucleotide
tgacaggacgacgggaagggtactggtaaaaagtgtga

SEQ ID NO: 43152 - DNA, 38 bp, Artificial Sequence
  Synthetic oligonucleotide
aaagtggagggcaaagtaaaaacggacaaaggagttga

SEQ ID NO: 43153 - DNA, 35 bp, Artificial Sequence
  Synthetic oligonucleotide
gaaccgacctgcccgccgatgcttcgtccctcata

SEQ ID NO: 43154 - DNA, 35 bp, Artificial Sequence
  Synthetic oligonucleotide
gagacaggagggggtcttgggtgcgtgcgttatta

SEQ ID NO: 43155 - DNA, 35 bp, Artificial Sequence
  Synthetic oligonucleotide
accacccgggtacctcctgacttgttgctgcttta

SEQ ID NO: 43156 - DNA, 35 bp, Artificial Sequence
  Synthetic oligonucleotide
gacccttccaccgcccgatgcttggccaacgcacc

SEQ ID NO: 43157 - DNA, 35 bp, Artificial Sequence
  Synthetic oligonucleotide
actacgatccgcattcggacacacgatcgccaccc

SEQ ID NO: 43158 - DNA, 35 bp, Artificial Sequence
  Synthetic oligonucleotide
ttcctgtcactctcccagtcgtcatgttccatccc

SEQ ID NO: 43159 - DNA, 35 bp, Artificial Sequence
  Synthetic oligonucleotide
gtgctgcagtgaccccataccctaggcttctgctc

SEQ ID NO: 43160 - DNA, 35 bp, Artificial Sequence
  Synthetic oligonucleotide
gacacatctctccttgccacctgactctggcaccg

SEQ ID NO: 43161 - DNA, 35 bp, Artificial Sequence
  Synthetic oligonucleotide
tgtagcctggccactggtaacaacgccgcctcccg

SEQ ID NO: 43162 - DNA, 35 bp, Artificial Sequence
  Synthetic oligonucleotide
atgacgaaggatagacgggaatggttttcggcgcg

SEQ ID NO: 43163 - DNA, 35 bp, Artificial Sequence
  Synthetic oligonucleotide
atgttgtacgcatcccttgccccattcctcgttcg

SEQ ID NO: 43164 - DNA, 35 bp, Artificial Sequence
  Synthetic oligonucleotide
atcaacagggggtagggggcgggttgtgggtccgg

SEQ ID NO: 43165 - DNA, 35 bp, Artificial Sequence
  Synthetic oligonucleotide
acgaacgttcttgccactgctacccacaaacattg

SEQ ID NO: 43166 - DNA, 35 bp, Artificial Sequence
  Synthetic oligonucleotide
gaccgacgcaattcaagatctttgcctgtaccttg

SEQ ID NO: 43167 - DNA, 34 bp, Artificial Sequence
  Synthetic oligonucleotide
ggactcctgccgtcccagatctcaatttgcccat

SEQ ID NO: 43168 - DNA, 35 bp, Artificial Sequence
  Synthetic oligonucleotide
ttgtcacgggcccgggctgttttcactattttggt

SEQ ID NO: 43169 - DNA, 35 bp, Artificial Sequence
  Synthetic oligonucleotide
gtgggggcacccccctctcagcacaccctccgtgt

SEQ ID NO: 43170 - DNA, 35 bp, Artificial Sequence
  Synthetic oligonucleotide
agcagacctcgcacaggccctcattcgcacgactt

SEQ ID NO: 43171 - DNA, 35 bp, Artificial Sequence
  Synthetic oligonucleotide
accccccgcaaaaatcagggtgctactaccgcaca

SEQ ID NO: 43172 - DNA, 35 bp, Artificial Sequence
  Synthetic oligonucleotide
gccgcccgctcaggcgaataatccccgctcgcaca

SEQ ID NO: 43173 - DNA, 35 bp, Artificial Sequence
  Synthetic oligonucleotide
gtcacgaacacgacttgcgtagccagatcctcaca

SEQ ID NO: 43174 - DNA, 35 bp, Artificial Sequence
  Synthetic oligonucleotide
acatcggtccactccttggccccgctcaaactaca

SEQ ID NO: 43175 - DNA, 36 bp, Artificial Sequence
  Synthetic oligonucleotide
acctccagggcactccccattcctgatctgtaagca

SEQ ID NO: 43176 - DNA, 37 bp, Artificial Sequence
  Synthetic oligonucleotide
gaccaaccgtatactgcaacatgaacctctttacaga

SEQ ID NO: 43177 - DNA, 37 bp, Artificial Sequence
  Synthetic oligonucleotide
tcacaccacgtcgcatcgcacacggaccatcgtacga

SEQ ID NO: 43178 - DNA, 35 bp, Artificial Sequence
  Synthetic oligonucleotide
tttggccacacgcttcattctgcctcccccttcga

SEQ ID NO: 43179 - DNA, 37 bp, Artificial Sequence
  Synthetic oligonucleotide
gctggactctagataaggggcaatatggggctgagga

SEQ ID NO: 43180 - DNA, 36 bp, Artificial Sequence
  Synthetic oligonucleotide
ttcaccctcgtaacccgtttcctccgatctgccgga

SEQ ID NO: 43181 - DNA, 37 bp, Artificial Sequence
  Synthetic oligonucleotide
gggggggagggggaaggaccgagagttggcatttgga

SEQ ID NO: 43182 - DNA, 37 bp, Artificial Sequence
  Synthetic oligonucleotide
taatgcactcgatggcttggtttgtttgttcccctga

SEQ ID NO: 43183 - DNA, 38 bp, Artificial Sequence
  Synthetic oligonucleotide
atgcaacgatgccttccgccactgccatctgtctctga

SEQ ID NO: 43184 - DNA, 38 bp, Artificial Sequence
  Synthetic oligonucleotide
tatgccgtgtggtggtaggtctcctggccttttcgtga

SEQ ID NO: 43185 - DNA, 38 bp, Artificial Sequence
  Synthetic oligonucleotide
gagccctctagtgttcttaatccgctattcccttgtga

SEQ ID NO: 43186 - DNA, 38 bp, Artificial Sequence
  Synthetic oligonucleotide
gtgacaccgcctcacaacgtgacatataatacgattga

SEQ ID NO: 43187 - DNA, 37 bp, Artificial Sequence
  Synthetic oligonucleotide
acgaggactcctgctcttaaccaagccaccaccttga

SEQ ID NO: 43188 - DNA, 35 bp, Artificial Sequence
  Synthetic oligonucleotide
gatcccccccattgttggtcccccttaggagcata

SEQ ID NO: 43189 - DNA, 36 bp, Artificial Sequence
  Synthetic oligonucleotide
gcagggatgaggaggtggtgaggatgcgatagtata

SEQ ID NO: 43190 - DNA, 36 bp, Artificial Sequence
  Synthetic oligonucleotide
gcagtgcccaattatctggctgccgtaccatgccta

SEQ ID NO: 43191 - DNA, 35 bp, Artificial Sequence
  Synthetic oligonucleotide
ttgcccgaccgacacgggtatcccgcctcaccgta

SEQ ID NO: 43192 - DNA, 35 bp, Artificial Sequence
  Synthetic oligonucleotide
agttcccacgtccagtagatctacaccatgctcac

SEQ ID NO: 43193 - DNA, 35 bp, Artificial Sequence
  Synthetic oligonucleotide
tccgtgccgtgcctgcttacgttgaactcgattac

SEQ ID NO: 43194 - DNA, 35 bp, Artificial Sequence
  Synthetic oligonucleotide
acatgcccagccagtccaccggtcctttcgtggcc

SEQ ID NO: 43195 - DNA, 35 bp, Artificial Sequence
  Synthetic oligonucleotide
gtcagaagccccaccgtgttaacccagtctagtcc

SEQ ID NO: 43196 - DNA, 35 bp, Artificial Sequence
  Synthetic oligonucleotide
ttccacagcggacgacgcatctatcttctttttcc

SEQ ID NO: 43197 - DNA, 35 bp, Artificial Sequence
  Synthetic oligonucleotide
agtcacaccttccatcgcttccatcatatgctggc

SEQ ID NO: 43198 - DNA, 35 bp, Artificial Sequence
  Synthetic oligonucleotide
ttcgccgtacgttttctacatttgttagtctttgc

SEQ ID NO: 43199 - DNA, 35 bp, Artificial Sequence
  Synthetic oligonucleotide
gacttggcacactatccaacgagtagaccgcactc

SEQ ID NO: 43200 - DNA, 35 bp, Artificial Sequence
  Synthetic oligonucleotide
tccctccatcactatcggacttccgaagtccgttc

SEQ ID NO: 43201 - DNA, 35 bp, Artificial Sequence
  Synthetic oligonucleotide
acgccactcaaaactttattcactacttcgcttgg

SEQ ID NO: 43202 - DNA, 35 bp, Artificial Sequence
  Synthetic oligonucleotide
gcctcatctaatgcagtcccttgcacacagccgtg

SEQ ID NO: 43203 - DNA, 35 bp, Artificial Sequence
  Synthetic oligonucleotide
tgcttggcgcgttgtctcatcaccacctgtatact

SEQ ID NO: 43204 - DNA, 35 bp, Artificial Sequence
  Synthetic oligonucleotide
gtgcaacaacaattttatccgaaacaatacgctct

SEQ ID NO: 43205 - DNA, 35 bp, Artificial Sequence
  Synthetic oligonucleotide
acgacacccgccgactggaaacctccctctctcgt

SEQ ID NO: 43206 - DNA, 35 bp, Artificial Sequence
  Synthetic oligonucleotide
gccaccgagcatattccagtatcaatccccactgt

SEQ ID NO: 43207 - DNA, 35 bp, Artificial Sequence
  Synthetic oligonucleotide
acatccgcgctagactcgcttatttctacaccatt

SEQ ID NO: 43208 - DNA, 35 bp, Artificial Sequence
  Synthetic oligonucleotide
acgttagtcggctcttttttgtacgtcccattctt

SEQ ID NO: 43209 - DNA, 36 bp, Artificial Sequence
  Synthetic oligonucleotide
ttgttgcctttcccgctcaagcacaccttgttccaa

SEQ ID NO: 43210 - DNA, 36 bp, Artificial Sequence
  Synthetic oligonucleotide
tccgcccatccttgttagtccgttgtcccaaccgaa

SEQ ID NO: 43211 - DNA, 35 bp, Artificial Sequence
  Synthetic oligonucleotide
gagtgctatccatcggcctgggcctcttttatgaa

SEQ ID NO: 43212 - DNA, 36 bp, Artificial Sequence
  Synthetic oligonucleotide
gcctgcaggcctcaatccgtggtttgtatctcttaa

SEQ ID NO: 43213 - DNA, 35 bp, Artificial Sequence
  Synthetic oligonucleotide
gtagcaccggctggcagacttcaccccaaccaaca

SEQ ID NO: 43214 - DNA, 37 bp, Artificial Sequence
  Synthetic oligonucleotide
acccgtcacttcgccctgaatgttcaccatctataga

SEQ ID NO: 43215 - DNA, 35 bp, Artificial Sequence
  Synthetic oligonucleotide
gcaccgatactaccagcgctgctccgtcctgccga

SEQ ID NO: 43216 - DNA, 36 bp, Artificial Sequence
  Synthetic oligonucleotide
acgcaacagcctagcccgcaagcacccacctccgga

SEQ ID NO: 43217 - DNA, 36 bp, Artificial Sequence
  Synthetic oligonucleotide
gctccgccacatccgctgattaaccccatcgctgga

SEQ ID NO: 43218 - DNA, 35 bp, Artificial Sequence
  Synthetic oligonucleotide
gaaatgccagagggaggaaggcttgggggagatga

SEQ ID NO: 43219 - DNA, 38 bp, Artificial Sequence
  Synthetic oligonucleotide
acttgcatccgcctacgtttcaacatcgtaacacctga

SEQ ID NO: 43220 - DNA, 37 bp, Artificial Sequence
  Synthetic oligonucleotide
tgacaccacaaactgctctagacctaggtttccgtga

SEQ ID NO: 43221 - DNA, 38 bp, Artificial Sequence
  Synthetic oligonucleotide
gtgaggcacatggattgggatgggggcctggccggtga

SEQ ID NO: 43222 - DNA, 37 bp, Artificial Sequence
  Synthetic oligonucleotide
agcggaatgcaagttagaaaaagggaggatcgggtga

SEQ ID NO: 43223 - DNA, 38 bp, Artificial Sequence
  Synthetic oligonucleotide
aacaggctgaagggaatgatgggatgatggggctgtga

SEQ ID NO: 43224 - DNA, 38 bp, Artificial Sequence
  Synthetic oligonucleotide
aactcccacgacgtcctctagtgccacttattgtttga

SEQ ID NO: 43225 - DNA, 36 bp, Artificial Sequence
  Synthetic oligonucleotide
tgcgaaggtcaggagcgagaggaaggggttgagata

SEQ ID NO: 43226 - DNA, 36 bp, Artificial Sequence
  Synthetic oligonucleotide
tgatccaccgtaggatctggcctcccaaatatagta

SEQ ID NO: 43227 - DNA, 35 bp, Artificial Sequence
  Synthetic oligonucleotide
taaaacctgctctcaccgtcgttcagtgcctccac

SEQ ID NO: 43228 - DNA, 35 bp, Artificial Sequence
  Synthetic oligonucleotide
gtgggagcccgccacctgagttttgaatcttcgac

SEQ ID NO: 43229 - DNA, 35 bp, Artificial Sequence
  Synthetic oligonucleotide
tctgtcgcccttgttgcccaactgattaccatgac

SEQ ID NO: 43230 - DNA, 35 bp, Artificial Sequence
  Synthetic oligonucleotide
agcatgagcgaccacctcactttgcactcgactac

SEQ ID NO: 43231 - DNA, 35 bp, Artificial Sequence
  Synthetic oligonucleotide
tgcaaaaccactgatcggaaggtgcatctccaccc

SEQ ID NO: 43232 - DNA, 35 bp, Artificial Sequence
  Synthetic oligonucleotide
tcaccgtcgccaccggtcttgacaactcccatgcc

SEQ ID NO: 43233 - DNA, 35 bp, Artificial Sequence
  Synthetic oligonucleotide
gttcgcccgccacctccaatgttcgagtttcgttc

SEQ ID NO: 43234 - DNA, 35 bp, Artificial Sequence
  Synthetic oligonucleotide
ttcagtcgggcggtgggaatataaactggaagaag

SEQ ID NO: 43235 - DNA, 35 bp, Artificial Sequence
  Synthetic oligonucleotide
accctaacctcgctcgtacccgcaatgctcattgg

SEQ ID NO: 43236 - DNA, 35 bp, Artificial Sequence
  Synthetic oligonucleotide
ccacctgacaccaaagggaccccctctctgatctg

SEQ ID NO: 43237 - DNA, 35 bp, Artificial Sequence
  Synthetic oligonucleotide
tcggagctgtaccgaacgcctttctacactcatct

SEQ ID NO: 43238 - DNA, 35 bp, Artificial Sequence
  Synthetic oligonucleotide
agtgtggcacagtcgtcgaaactgaaaatgcctct

SEQ ID NO: 43239 - DNA, 35 bp, Artificial Sequence
  Synthetic oligonucleotide
acccacaacctcatcttatccagcctatctgaggt

SEQ ID NO: 43240 - DNA, 35 bp, Artificial Sequence
  Synthetic oligonucleotide
gccgttcatggccctctcgattcaaccctcactgt

SEQ ID NO: 43241 - DNA, 35 bp, Artificial Sequence
  Synthetic oligonucleotide
gacagaacctacgtttaactgaccccacaacctgt

SEQ ID NO: 43242 - DNA, 34 bp, Artificial Sequence
  Synthetic oligonucleotide
gccaacgccctccggtacttcgtttccattttgt

SEQ ID NO: 43243 - DNA, 35 bp, Artificial Sequence
  Synthetic oligonucleotide
gccgaatggcccatctcccgccaccgaaaccgctt

SEQ ID NO: 43244 - DNA, 36 bp, Artificial Sequence
  Synthetic oligonucleotide
tgatccatcctgacgagccttaccagcgagagcaaa

SEQ ID NO: 43245 - DNA, 36 bp, Artificial Sequence
  Synthetic oligonucleotide
gtcgaacccagcagaactgcatccgttattttccaa

SEQ ID NO: 43246 - DNA, 36 bp, Artificial Sequence
  Synthetic oligonucleotide
ttgagaaggggcgggatggtggggctaggttggtaa

SEQ ID NO: 43247 - DNA, 37 bp, Artificial Sequence
  Synthetic oligonucleotide
taactcccaagcctttgcccgccttgttcgttgtaca

SEQ ID NO: 43248 - DNA, 35 bp, Artificial Sequence
  Synthetic oligonucleotide
tctacccccccgatcgcgaaggctcagaccatcca

SEQ ID NO: 43249 - DNA, 36 bp, Artificial Sequence
  Synthetic oligonucleotide
atgccactgccctcatcacggtattcaagctctcca

SEQ ID NO: 43250 - DNA, 36 bp, Artificial Sequence
  Synthetic oligonucleotide
gaaggaagggggagagacgggttaaggtgctaagca

SEQ ID NO: 43251 - DNA, 36 bp, Artificial Sequence
  Synthetic oligonucleotide
tccctcctccgtttgccatcatcttgcacatagtca

SEQ ID NO: 43252 - DNA, 36 bp, Artificial Sequence
  Synthetic oligonucleotide
gccgtccctcgcatactatcacgacactatatccga

SEQ ID NO: 43253 - DNA, 36 bp, Artificial Sequence
  Synthetic oligonucleotide
ttggccggatgacccccccaccgcagcctgttccga

SEQ ID NO: 43254 - DNA, 35 bp, Artificial Sequence
  Synthetic oligonucleotide
tcccgaccattactgaactgctcacgacgacagga

SEQ ID NO: 43255 - DNA, 37 bp, Artificial Sequence
  Synthetic oligonucleotide
gatggaaggggcaagagaacgagtgcgagagagcgga

SEQ ID NO: 43256 - DNA, 38 bp, Artificial Sequence
  Synthetic oligonucleotide
ttggagccgtaccatccatgggcgacgttccacaatga

SEQ ID NO: 43257 - DNA, 38 bp, Artificial Sequence
  Synthetic oligonucleotide
ggacgggcataatcctgcggaggctactacaccaatga

SEQ ID NO: 43258 - DNA, 37 bp, Artificial Sequence
  Synthetic oligonucleotide
taacggggaaggggcggggtgagtcagtatagtatga

SEQ ID NO: 43259 - DNA, 37 bp, Artificial Sequence
  Synthetic oligonucleotide
taaacctcagaaccgctcacagcccactcgtacctga

SEQ ID NO: 43260 - DNA, 37 bp, Artificial Sequence
  Synthetic oligonucleotide
atcatccacattgcttcgaacatccctcacccgctga

SEQ ID NO: 43261 - DNA, 38 bp, Artificial Sequence
  Synthetic oligonucleotide
acgcctcacacgcccttgtacttcgcttctattgctga

SEQ ID NO: 43262 - DNA, 37 bp, Artificial Sequence
  Synthetic oligonucleotide
agacgactgggcggacggggggggtggggcaaagtga

SEQ ID NO: 43263 - DNA, 38 bp, Artificial Sequence
  Synthetic oligonucleotide
ggacagggtgaagggggggttgacgcaacagagcgtga

SEQ ID NO: 43264 - DNA, 38 bp, Artificial Sequence
  Synthetic oligonucleotide
gtaggcggccggaggggaaaggactagaaggtgggtga

SEQ ID NO: 43265 - DNA, 38 bp, Artificial Sequence
  Synthetic oligonucleotide
aatggactggggggcgagtgggataggtgcggtggtga

SEQ ID NO: 43266 - DNA, 37 bp, Artificial Sequence
  Synthetic oligonucleotide
gcaggctcacaatctgccaatcaactgttcgctttga

SEQ ID NO: 43267 - DNA, 38 bp, Artificial Sequence
  Synthetic oligonucleotide
tcaccatcagcctcgtatgcttgcatcccctagtttga

SEQ ID NO: 43268 - DNA, 36 bp, Artificial Sequence
  Synthetic oligonucleotide
cccgcactaccatccggaacatgcattagaacgcta

SEQ ID NO: 43269 - DNA, 36 bp, Artificial Sequence
  Synthetic oligonucleotide
gagagataactggttggggagtagggaaggactgta

SEQ ID NO: 43270 - DNA, 35 bp, Artificial Sequence
  Synthetic oligonucleotide
acaaacagcccgtataccgaccccaccagcactta

SEQ ID NO: 43271 - DNA, 36 bp, Artificial Sequence
  Synthetic oligonucleotide
acgagggggacgtgggtgagaaactgggggatgtta

SEQ ID NO: 43272 - DNA, 35 bp, Artificial Sequence
  Synthetic oligonucleotide
tccgtgtactgctgactacctttatttaccgttta

SEQ ID NO: 43273 - DNA, 36 bp, Artificial Sequence
  Synthetic oligonucleotide
gtaaaacgcggcacagcgataactcctgcctgttta

SEQ ID NO: 43274 - DNA, 35 bp, Artificial Sequence
  Synthetic oligonucleotide
gtccaccataactatgccgggcctgtcccgagacc

SEQ ID NO: 43275 - DNA, 35 bp, Artificial Sequence
  Synthetic oligonucleotide
tcacaccctgtgcgtaaaaaactcctggtaatcgc

SEQ ID NO: 43276 - DNA, 35 bp, Artificial Sequence
  Synthetic oligonucleotide
agccccctgcatgccggccttcaatcttgacttgc

SEQ ID NO: 43277 - DNA, 35 bp, Artificial Sequence
  Synthetic oligonucleotide
acactaccatccctgtcctccggtgaccactcccg

SEQ ID NO: 43278 - DNA, 35 bp, Artificial Sequence
  Synthetic oligonucleotide
ggagttacagaggacggtggtcgaagagggtggtg

SEQ ID NO: 43279 - DNA, 35 bp, Artificial Sequence
  Synthetic oligonucleotide
gtgatccaggcaccatttcaggtccctctcatcat

SEQ ID NO: 43280 - DNA, 35 bp, Artificial Sequence
  Synthetic oligonucleotide
ggacacccggtgccttttggattatgtttacttgt

SEQ ID NO: 43281 - DNA, 35 bp, Artificial Sequence
  Synthetic oligonucleotide
gtccctttccaactggcaaacactgaatcctgctt

SEQ ID NO: 43282 - DNA, 36 bp, Artificial Sequence
  Synthetic oligonucleotide
cacgccaaacgtaccacttccatctgtgcccgccaa

SEQ ID NO: 43283 - DNA, 36 bp, Artificial Sequence
  Synthetic oligonucleotide
atttgggtccgttgggggcgagtgggaggggggcaa

SEQ ID NO: 43284 - DNA, 36 bp, Artificial Sequence
  Synthetic oligonucleotide
ataccagccttccaccaagttattgggcctttgcaa

SEQ ID NO: 43285 - DNA, 36 bp, Artificial Sequence
  Synthetic oligonucleotide
acttacacctatacatgccttgacggtgctctcaca

SEQ ID NO: 43286 - DNA, 36 bp, Artificial Sequence
  Synthetic oligonucleotide
aacatccgctacgtaaaggtgcccgtcggtctcaca

SEQ ID NO: 43287 - DNA, 35 bp, Artificial Sequence
  Synthetic oligonucleotide
tcccggtacactaaaatctgcaaaacagccagcca

SEQ ID NO: 43288 - DNA, 35 bp, Artificial Sequence
  Synthetic oligonucleotide
ttaatcccacatgttaactgtccgtactttggcca

SEQ ID NO: 43289 - DNA, 36 bp, Artificial Sequence
  Synthetic oligonucleotide
taacgcccccttccaggtgaactttgtgaggttcca

SEQ ID NO: 43290 - DNA, 35 bp, Artificial Sequence
  Synthetic oligonucleotide
gaggaacagtgggaagcgaaagggtgtccagggca

SEQ ID NO: 43291 - DNA, 35 bp, Artificial Sequence
  Synthetic oligonucleotide
aacgcgactcggaccatcaacgcagagccccttca

SEQ ID NO: 43292 - DNA, 37 bp, Artificial Sequence
  Synthetic oligonucleotide
tccccgcatgccccctatcgaccgtttcctactaaga

SEQ ID NO: 43293 - DNA, 37 bp, Artificial Sequence
  Synthetic oligonucleotide
tcacgtcgttcaatcgttcctccgttctactttccga

SEQ ID NO: 43294 - DNA, 37 bp, Artificial Sequence
  Synthetic oligonucleotide
atcgcgacctgagcatttaaccccctcgtgctatcga

SEQ ID NO: 43295 - DNA, 35 bp, Artificial Sequence
  Synthetic oligonucleotide
agagcgagacggcggtagagtcggaggaggaagga

SEQ ID NO: 43296 - DNA, 37 bp, Artificial Sequence
  Synthetic oligonucleotide
gtggtcgatggtgctcggttgtgggctggtggaagga

SEQ ID NO: 43297 - DNA, 37 bp, Artificial Sequence
  Synthetic oligonucleotide
tcactaccagaaatccatacacacagcccggccggga

SEQ ID NO: 43298 - DNA, 37 bp, Artificial Sequence
  Synthetic oligonucleotide
atgggtgagtgggcatggaagagttaggggtgtggga

SEQ ID NO: 43299 - DNA, 37 bp, Artificial Sequence
  Synthetic oligonucleotide
tgatggtacgggggattgagaaggggaaggtatatga

SEQ ID NO: 43300 - DNA, 38 bp, Artificial Sequence
  Synthetic oligonucleotide
gctgtaggcactatctgacgctgaaacaccccacctga

SEQ ID NO: 43301 - DNA, 37 bp, Artificial Sequence
  Synthetic oligonucleotide
actccccgctcgggtgtgcctccctttgtgtttctga

SEQ ID NO: 43302 - DNA, 35 bp, Artificial Sequence
  Synthetic oligonucleotide
gcgcacatcgacctatcctcgtttcgcttttctga

SEQ ID NO: 43303 - DNA, 38 bp, Artificial Sequence
  Synthetic oligonucleotide
ttgccccctcacagtttgccttgtttgtcgctgcgtga

SEQ ID NO: 43304 - DNA, 38 bp, Artificial Sequence
  Synthetic oligonucleotide
gaacaaacgggaaggctaggcaggcggtactatcgtga

SEQ ID NO: 43305 - DNA, 38 bp, Artificial Sequence
  Synthetic oligonucleotide
aagcggacatgtcggggttgaacgggggaaggtcgtga

SEQ ID NO: 43306 - DNA, 38 bp, Artificial Sequence
  Synthetic oligonucleotide
agtgggggaaaggtggaacaagtagctgaacactgtga

SEQ ID NO: 43307 - DNA, 38 bp, Artificial Sequence
  Synthetic oligonucleotide
tccccacggagcacgtggttcatcattccagcccttga

SEQ ID NO: 43308 - DNA, 38 bp, Artificial Sequence
  Synthetic oligonucleotide
gtttacacggactgcgatgaagacgacggccatcttga

SEQ ID NO: 43309 - DNA, 35 bp, Artificial Sequence
  Synthetic oligonucleotide
gcctaggacacctgaaccattcacactatgcaata

SEQ ID NO: 43310 - DNA, 36 bp, Artificial Sequence
  Synthetic oligonucleotide
aacatggaccgggcgcagtatcacaccctctgagta

SEQ ID NO: 43311 - DNA, 35 bp, Artificial Sequence
  Synthetic oligonucleotide
gtggaaagtgtgatgggggaaagcggttgagggta

SEQ ID NO: 43312 - DNA, 35 bp, Artificial Sequence
  Synthetic oligonucleotide
tctggggcatcttccaaccgctgcgatcctacaac

SEQ ID NO: 43313 - DNA, 35 bp, Artificial Sequence
  Synthetic oligonucleotide
agatctaccgggggggaataggcggggaaaggcac

SEQ ID NO: 43314 - DNA, 35 bp, Artificial Sequence
  Synthetic oligonucleotide
gatcagccctgttagcactctcgggtcacgcatac

SEQ ID NO: 43315 - DNA, 35 bp, Artificial Sequence
  Synthetic oligonucleotide
cagacgacagattcgccttcactgctgctccctac

SEQ ID NO: 43316 - DNA, 35 bp, Artificial Sequence
  Synthetic oligonucleotide
gccttgttacatagcctacccacgtgaggttcgcc

SEQ ID NO: 43317 - DNA, 35 bp, Artificial Sequence
  Synthetic oligonucleotide
acacctcagtctaaaactctccgcgtgccaagtcc

SEQ ID NO: 43318 - DNA, 35 bp, Artificial Sequence
  Synthetic oligonucleotide
gcgcatcaacttccatctctcatggccttggtggc

SEQ ID NO: 43319 - DNA, 35 bp, Artificial Sequence
  Synthetic oligonucleotide
gaagggcgatatccgctcctcccggttcccgaatc

SEQ ID NO: 43320 - DNA, 35 bp, Artificial Sequence
  Synthetic oligonucleotide
ttcctaccgcggcaatacccgtgccactctagctc

SEQ ID NO: 43321 - DNA, 35 bp, Artificial Sequence
  Synthetic oligonucleotide
tacaaagcagggggaatgagggacacaagagtctc

SEQ ID NO: 43322 - DNA, 35 bp, Artificial Sequence
  Synthetic oligonucleotide
ggttcgggccggatcccgcctagcacattttggtc

SEQ ID NO: 43323 - DNA, 35 bp, Artificial Sequence
  Synthetic oligonucleotide
gtcgcaacacactctgctgtcctatccgtgcgaag

SEQ ID NO: 43324 - DNA, 35 bp, Artificial Sequence
  Synthetic oligonucleotide
gctgggggtgttcggatggagggtttagggaagtg

SEQ ID NO: 43325 - DNA, 35 bp, Artificial Sequence
  Synthetic oligonucleotide
tgatcatacgaaccgcttgttcctgtaactcccat

SEQ ID NO: 43326 - DNA, 35 bp, Artificial Sequence
  Synthetic oligonucleotide
tactacgccatcacccgagacgcattaccatcatt

SEQ ID NO: 43327 - DNA, 35 bp, Artificial Sequence
  Synthetic oligonucleotide
gcccacttcacgccgcaaacctgtaaacggatctt

SEQ ID NO: 43328 - DNA, 35 bp, Artificial Sequence
  Synthetic oligonucleotide
tgtccatgaccctgaagttgcgctttaatgccttt

SEQ ID NO: 43329 - DNA, 36 bp, Artificial Sequence
  Synthetic oligonucleotide
ttcgccgcaaccgaggtatctcgcgcgacccccaaa

SEQ ID NO: 43330 - DNA, 35 bp, Artificial Sequence
  Synthetic oligonucleotide
aacaccttcccatattccggagtacagtcaatcaa

SEQ ID NO: 43331 - DNA, 35 bp, Artificial Sequence
  Synthetic oligonucleotide
acacttcgtacccgcgcgcgctatcatctcgcgaa

SEQ ID NO: 43332 - DNA, 36 bp, Artificial Sequence
  Synthetic oligonucleotide
gcctccctgcaccccatagctttacctgggctctaa

SEQ ID NO: 43333 - DNA, 35 bp, Artificial Sequence
  Synthetic oligonucleotide
acatggtcacgtaggtccactcgtatcgcttacca

SEQ ID NO: 43334 - DNA, 35 bp, Artificial Sequence
  Synthetic oligonucleotide
aaggacgacctctttccattagtatgaccatccca

SEQ ID NO: 43335 - DNA, 36 bp, Artificial Sequence
  Synthetic oligonucleotide
tccaccagttggcctttatgtattcgctcacgtcca

SEQ ID NO: 43336 - DNA, 36 bp, Artificial Sequence
  Synthetic oligonucleotide
gttcaagcgatcagtcacttcattcacggttcttca

SEQ ID NO: 43337 - DNA, 36 bp, Artificial Sequence
  Synthetic oligonucleotide
agccaatccgaggattgtcttatgattaccctttca

SEQ ID NO: 43338 - DNA, 37 bp, Artificial Sequence
  Synthetic oligonucleotide
gccgagctcccatccgttcctacactcatattcaaga

SEQ ID NO: 43339 - DNA, 36 bp, Artificial Sequence
  Synthetic oligonucleotide
atcacttcacatcctagcctcagtgcttcatgccga

SEQ ID NO: 43340 - DNA, 37 bp, Artificial Sequence
  Synthetic oligonucleotide
gtagcgagccgaaagacaagggaagggccgggcagga

SEQ ID NO: 43341 - DNA, 36 bp, Artificial Sequence
  Synthetic oligonucleotide
gtaccgtccttacctctcgcatgatcgccccaggga

SEQ ID NO: 43342 - DNA, 37 bp, Artificial Sequence
  Synthetic oligonucleotide
taaaatcaatgggagggtggggcacaggggctaggga

SEQ ID NO: 43343 - DNA, 37 bp, Artificial Sequence
  Synthetic oligonucleotide
tgggtaggcaattggggagggcctgggggtgttggga

SEQ ID NO: 43344 - DNA, 38 bp, Artificial Sequence
  Synthetic oligonucleotide
tttcccccgccctgatccaccgtgttcggtccgaatga

SEQ ID NO: 43345 - DNA, 38 bp, Artificial Sequence
  Synthetic oligonucleotide
gttacgaacacgaggatgaaggggttgggggccgatga

SEQ ID NO: 43346 - DNA, 37 bp, Artificial Sequence
  Synthetic oligonucleotide
agtcacgtgttttgggttggtttggttggcaacgtga

SEQ ID NO: 43347 - DNA, 35 bp, Artificial Sequence
  Synthetic oligonucleotide
tgctacaccatcatctgccctgccgtatagggata

SEQ ID NO: 43348 - DNA, 36 bp, Artificial Sequence
  Synthetic oligonucleotide
tccccactcgtggctatccttgtcggttttcatcta

SEQ ID NO: 43349 - DNA, 35 bp, Artificial Sequence
  Synthetic oligonucleotide
actgtccccgtcccccagcgttctctgtcgagcac

SEQ ID NO: 43350 - DNA, 35 bp, Artificial Sequence
  Synthetic oligonucleotide
agactacacagccctacagtcctggttcctcgccc

SEQ ID NO: 43351 - DNA, 35 bp, Artificial Sequence
  Synthetic oligonucleotide
actgaaccccgattggccgccttcccgacaccgcc

SEQ ID NO: 43352 - DNA, 35 bp, Artificial Sequence
  Synthetic oligonucleotide
gccaccctccttttgttcttgcttactgtaatatc

SEQ ID NO: 43353 - DNA, 35 bp, Artificial Sequence
  Synthetic oligonucleotide
tcacgagtaacgtatgcacctatagccattcattc

SEQ ID NO: 43354 - DNA, 35 bp, Artificial Sequence
  Synthetic oligonucleotide
ggacgggagcccttctcgacatcctccatctgttc

SEQ ID NO: 43355 - DNA, 35 bp, Artificial Sequence
  Synthetic oligonucleotide
gacagagggatagggggattcggagcggttatgag

SEQ ID NO: 43356 - DNA, 35 bp, Artificial Sequence
  Synthetic oligonucleotide
acccccgcttttgcgaagacccgcccctcacgacg

SEQ ID NO: 43357 - DNA, 35 bp, Artificial Sequence
  Synthetic oligonucleotide
ggtaaggcccccgctttacttctctcacaccatcg

SEQ ID NO: 43358 - DNA, 35 bp, Artificial Sequence
  Synthetic oligonucleotide
acagcaagttggtttgggctggaggaggagaagtg

SEQ ID NO: 43359 - DNA, 35 bp, Artificial Sequence
  Synthetic oligonucleotide
ggatccgccaccacgcaggccacccgtttcaccat

SEQ ID NO: 43360 - DNA, 35 bp, Artificial Sequence
  Synthetic oligonucleotide
tcctagacctctttgttatcatgcgcccccctcat

SEQ ID NO: 43361 - DNA, 35 bp, Artificial Sequence
  Synthetic oligonucleotide
aagcctggcctacacctatactgctgggattaact

SEQ ID NO: 43362 - DNA, 34 bp, Artificial Sequence
  Synthetic oligonucleotide
gatcaatcatgttgaagactcgcccttaccctgt

SEQ ID NO: 43363 - DNA, 35 bp, Artificial Sequence
  Synthetic oligonucleotide
gcttcgaacgtcctcacgtcaactaatctctttgt

SEQ ID NO: 43364 - DNA, 35 bp, Artificial Sequence
  Synthetic oligonucleotide
tctacgagtaatatcgcatttgtcacccctgcctt

SEQ ID NO: 43365 - DNA, 35 bp, Artificial Sequence
  Synthetic oligonucleotide
gcccacatctgccgtgcaacttcacacccctggtt

SEQ ID NO: 43366 - DNA, 35 bp, Artificial Sequence
  Synthetic oligonucleotide
tctaccgtacgcccttgatcttgataggccccgaa

SEQ ID NO: 43367 - DNA, 35 bp, Artificial Sequence
  Synthetic oligonucleotide
atcaccctgaagtacacgccacagtacaccaataa

SEQ ID NO: 43368 - DNA, 36 bp, Artificial Sequence
  Synthetic oligonucleotide
tcgatgcttcccgacaagctcctggcgctcttccca

SEQ ID NO: 43369 - DNA, 35 bp, Artificial Sequence
  Synthetic oligonucleotide
gaaagcccatccgcacacgaagcaagcagccgcca

SEQ ID NO: 43370 - DNA, 36 bp, Artificial Sequence
  Synthetic oligonucleotide
acacgactaacagtcgcctcaggatccccgccttca

SEQ ID NO: 43371 - DNA, 35 bp, Artificial Sequence
  Synthetic oligonucleotide
ggtccctcgatacccatactgctggccccttttca

SEQ ID NO: 43372 - DNA, 37 bp, Artificial Sequence
  Synthetic oligonucleotide
tggtcatggggtccgggggtgggcagggagtgaacga

SEQ ID NO: 43373 - DNA, 37 bp, Artificial Sequence
  Synthetic oligonucleotide
gtagaagagggaaatgcggaggggaatgtggggtcga

SEQ ID NO: 43374 - DNA, 36 bp, Artificial Sequence
  Synthetic oligonucleotide
gaaggttgaggatgggggggcgtgtggcagaaagga

SEQ ID NO: 43375 - DNA, 36 bp, Artificial Sequence
  Synthetic oligonucleotide
tcgaagtcgcgaggcggagagagaggagagaaggga

SEQ ID NO: 43376 - DNA, 37 bp, Artificial Sequence
  Synthetic oligonucleotide
aatgcgaacggactgattaggtgggaaggagggtgga

SEQ ID NO: 43377 - DNA, 37 bp, Artificial Sequence
  Synthetic oligonucleotide
gataagtgagtgggcgagggacggaagggctattgga

SEQ ID NO: 43378 - DNA, 37 bp, Artificial Sequence
  Synthetic oligonucleotide
tcagtccctccgtttgacttctcccactccggaatga

SEQ ID NO: 43379 - DNA, 38 bp, Artificial Sequence
  Synthetic oligonucleotide
gagggtggctcacccgcccttagaccctacacccatga

SEQ ID NO: 43380 - DNA, 38 bp, Artificial Sequence
  Synthetic oligonucleotide
tcaccgccacataccgacatctaggcctacacctctga

SEQ ID NO: 43381 - DNA, 38 bp, Artificial Sequence
  Synthetic oligonucleotide
gttgccgagcatacccatattcccagatcacctagtga

SEQ ID NO: 43382 - DNA, 38 bp, Artificial Sequence
  Synthetic oligonucleotide
tccgacctcatgatcctggttgtccatgtcgctattga

SEQ ID NO: 43383 - DNA, 38 bp, Artificial Sequence
  Synthetic oligonucleotide
taacacccgccggtggtcgcatgaaatcggccatttga

SEQ ID NO: 43384 - DNA, 36 bp, Artificial Sequence
  Synthetic oligonucleotide
gacatggcatgatctcagccgccttactccgccata

SEQ ID NO: 43385 - DNA, 35 bp, Artificial Sequence
  Synthetic oligonucleotide
accacactcctgggatccattcaccgaatgtccta

SEQ ID NO: 43386 - DNA, 36 bp, Artificial Sequence
  Synthetic oligonucleotide
gtactcgacgtcctcttttatgtcatgtcctttcta

SEQ ID NO: 43387 - DNA, 35 bp, Artificial Sequence
  Synthetic oligonucleotide
gactcatggaggttgggtgcttgtggaggggggta

SEQ ID NO: 43388 - DNA, 35 bp, Artificial Sequence
  Synthetic oligonucleotide
gtggacccggccagccattttagtggtaactaacc

SEQ ID NO: 43389 - DNA, 35 bp, Artificial Sequence
  Synthetic oligonucleotide
atggcccatccacttttgccgcgtgattcgttccc

SEQ ID NO: 43390 - DNA, 35 bp, Artificial Sequence
  Synthetic oligonucleotide
attccactcccgcctgccgagtgtcctcatatgcc

SEQ ID NO: 43391 - DNA, 35 bp, Artificial Sequence
  Synthetic oligonucleotide
gccccatcctcacgcgcacccgattatgtcgtgcc

SEQ ID NO: 43392 - DNA, 35 bp, Artificial Sequence
  Synthetic oligonucleotide
gccctgacgacagtaacagcgccaatccatcacgc

SEQ ID NO: 43393 - DNA, 35 bp, Artificial Sequence
  Synthetic oligonucleotide
acgcccctcccaatcctgtacacctgcggggcatc

SEQ ID NO: 43394 - DNA, 35 bp, Artificial Sequence
  Synthetic oligonucleotide
actcgcgtgtaccaaacgtggactcgcctcttatc

SEQ ID NO: 43395 - DNA, 35 bp, Artificial Sequence
  Synthetic oligonucleotide
gaacaggttcccggtgctcgattctttgttttgtc

SEQ ID NO: 43396 - DNA, 35 bp, Artificial Sequence
  Synthetic oligonucleotide
actgtacatccggccctacttctagagagcctccg

SEQ ID NO: 43397 - DNA, 35 bp, Artificial Sequence
  Synthetic oligonucleotide
taacatctatctgtccgaatccacattcgcactat

SEQ ID NO: 43398 - DNA, 35 bp, Artificial Sequence
  Synthetic oligonucleotide
tctggtgtgctcccaccaaaatgttcttgcttact

SEQ ID NO: 43399 - DNA, 35 bp, Artificial Sequence
  Synthetic oligonucleotide
gcactccatacgtccgccctttaaaatgattgcct

SEQ ID NO: 43400 - DNA, 35 bp, Artificial Sequence
  Synthetic oligonucleotide
gtacacggcaacggacatcacatctcccggtcgct

SEQ ID NO: 43401 - DNA, 35 bp, Artificial Sequence
  Synthetic oligonucleotide
gttccgcaacccaatacgtactttgtcactgaatt

SEQ ID NO: 43402 - DNA, 35 bp, Artificial Sequence
  Synthetic oligonucleotide
aggataagggtgggggctgtaaaggatgggaggtt

SEQ ID NO: 43403 - DNA, 35 bp, Artificial Sequence
  Synthetic oligonucleotide
gcaacccatgcttgcatttctagctctgcatcttt

SEQ ID NO: 43404 - DNA, 36 bp, Artificial Sequence
  Synthetic oligonucleotide
ttggacccccacttgagtagtaccgagtaccacgaa

SEQ ID NO: 43405 - DNA, 36 bp, Artificial Sequence
  Synthetic oligonucleotide
gtgacaagtcagggaactggattgaaggtgctgtaa

SEQ ID NO: 43406 - DNA, 35 bp, Artificial Sequence
  Synthetic oligonucleotide
tgcatctctacggcctggatcccgctcattgcaca

SEQ ID NO: 43407 - DNA, 36 bp, Artificial Sequence
  Synthetic oligonucleotide
tcactctatctcgaaattcggtacagctgtagccca

SEQ ID NO: 43408 - DNA, 35 bp, Artificial Sequence
  Synthetic oligonucleotide
taagccatgcctctgtttcgcactcaaattatgca

SEQ ID NO: 43409 - DNA, 36 bp, Artificial Sequence
  Synthetic oligonucleotide
acgccaccctgtccccgttggcacttagaaacaaga

SEQ ID NO: 43410 - DNA, 37 bp, Artificial Sequence
  Synthetic oligonucleotide
gcctagagtagggagggaagagcctggatggcacaga

SEQ ID NO: 43411 - DNA, 37 bp, Artificial Sequence
  Synthetic oligonucleotide
tgccatgacaaagccgtactcttcgcaccatctccga

SEQ ID NO: 43412 - DNA, 37 bp, Artificial Sequence
  Synthetic oligonucleotide
gaatcgcctgtgctctgttcctctgtctggagtccga

SEQ ID NO: 43413 - DNA, 37 bp, Artificial Sequence
  Synthetic oligonucleotide
agatacgaatgggagggacatggagggggcgtggcga

SEQ ID NO: 43414 - DNA, 37 bp, Artificial Sequence
  Synthetic oligonucleotide
gagtgtagaaatagtggtagagataaggatggtgcga

SEQ ID NO: 43415 - DNA, 37 bp, Artificial Sequence
  Synthetic oligonucleotide
gtaggatatgagtgcatgggggctgggcacgatagga

SEQ ID NO: 43416 - DNA, 37 bp, Artificial Sequence
  Synthetic oligonucleotide
tagcggaggaaggatagtggcaacatgaaaaagggga

SEQ ID NO: 43417 - DNA, 37 bp, Artificial Sequence
  Synthetic oligonucleotide
atggtgggagggatcgggcagatggccggtgggggga

SEQ ID NO: 43418 - DNA, 37 bp, Artificial Sequence
  Synthetic oligonucleotide
gaaggggggcaattcgtggggcggtggtcacggtgga

SEQ ID NO: 43419 - DNA, 38 bp, Artificial Sequence
  Synthetic oligonucleotide
cccacccgcactgtatcgcctacacatctaacacatga

SEQ ID NO: 43420 - DNA, 37 bp, Artificial Sequence
  Synthetic oligonucleotide
gagagctcagctctcgtcccatccttaactaccatga

SEQ ID NO: 43421 - DNA, 38 bp, Artificial Sequence
  Synthetic oligonucleotide
ggagaagaaggggtgggctagaccaagactagtgatga

SEQ ID NO: 43422 - DNA, 38 bp, Artificial Sequence
  Synthetic oligonucleotide
gcgaccggggggtgggtgattgcaggtcgggtcgctga

SEQ ID NO: 43423 - DNA, 38 bp, Artificial Sequence
  Synthetic oligonucleotide
acacacgcttcccatttatacggttttctgccctctga

SEQ ID NO: 43424 - DNA, 37 bp, Artificial Sequence
  Synthetic oligonucleotide
ataccctcatgcctgacagttgttcaatcccccgtga

SEQ ID NO: 43425 - DNA, 37 bp, Artificial Sequence
  Synthetic oligonucleotide
gttgcacaactgtaacgttactcagccaatcccgtga

SEQ ID NO: 43426 - DNA, 38 bp, Artificial Sequence
  Synthetic oligonucleotide
attggaaagtaggtgcgaagggctaagggaggaggtga

SEQ ID NO: 43427 - DNA, 38 bp, Artificial Sequence
  Synthetic oligonucleotide
aagccacgaggagtcggagggaaaggggaaaacattga

SEQ ID NO: 43428 - DNA, 37 bp, Artificial Sequence
  Synthetic oligonucleotide
tcgccccagccctctatactacttggcctgtgattga

SEQ ID NO: 43429 - DNA, 38 bp, Artificial Sequence
  Synthetic oligonucleotide
tcccgacaaccagctaattagcttacgtctccccttga

SEQ ID NO: 43430 - DNA, 38 bp, Artificial Sequence
  Synthetic oligonucleotide
ggtgcccgcctgcacccgtcaacatccaatacttttga

SEQ ID NO: 43431 - DNA, 35 bp, Artificial Sequence
  Synthetic oligonucleotide
tagccatggcgtgcaactttttcgcgtccactcta

SEQ ID NO: 43432 - DNA, 36 bp, Artificial Sequence
  Synthetic oligonucleotide
gagccattcgaggttgcttgattatcctgcccttta

SEQ ID NO: 43433 - DNA, 35 bp, Artificial Sequence
  Synthetic oligonucleotide
tgcatcccgcccatcgcttaaacccttaactgcac

SEQ ID NO: 43434 - DNA, 35 bp, Artificial Sequence
  Synthetic oligonucleotide
gacactatacgccttgttatcaagctgatccaccc

SEQ ID NO: 43435 - DNA, 35 bp, Artificial Sequence
  Synthetic oligonucleotide
tccgatcccaattgtacggactcggatttaacccc

SEQ ID NO: 43436 - DNA, 35 bp, Artificial Sequence
  Synthetic oligonucleotide
atgccgcatggtgcacatcttctaggataatatcc

SEQ ID NO: 43437 - DNA, 35 bp, Artificial Sequence
  Synthetic oligonucleotide
gcgagtacacattccttccccgagtgtttcacctc

SEQ ID NO: 43438 - DNA, 35 bp, Artificial Sequence
  Synthetic oligonucleotide
tcatcgggtcgcctgcctcttctccgaatattacg

SEQ ID NO: 43439 - DNA, 35 bp, Artificial Sequence
  Synthetic oligonucleotide
gatcgaggtatagcaggggggcatgttggggaagg

SEQ ID NO: 43440 - DNA, 35 bp, Artificial Sequence
  Synthetic oligonucleotide
tccacccgccttctaccgttctctatccgcggatg

SEQ ID NO: 43441 - DNA, 35 bp, Artificial Sequence
  Synthetic oligonucleotide
aacacggagaaggagtagaagggggccgttcactg

SEQ ID NO: 43442 - DNA, 35 bp, Artificial Sequence
  Synthetic oligonucleotide
ttggaccggacccccccctcactacgagactattg

SEQ ID NO: 43443 - DNA, 35 bp, Artificial Sequence
  Synthetic oligonucleotide
acttattgcaccaggactggtctcgcttactttct

SEQ ID NO: 43444 - DNA, 35 bp, Artificial Sequence
  Synthetic oligonucleotide
ttcgattcaagccactgcatcaacatctcttctgt

SEQ ID NO: 43445 - DNA, 35 bp, Artificial Sequence
  Synthetic oligonucleotide
tcagcccactgcccccttacgatgcacgcctcctt

SEQ ID NO: 43446 - DNA, 35 bp, Artificial Sequence
  Synthetic oligonucleotide
aatacgcattgccacttatgcactcgctaattttt

SEQ ID NO: 43447 - DNA, 36 bp, Artificial Sequence
  Synthetic oligonucleotide
atggatcacagcccctcgcgccccacttgtttaaaa

SEQ ID NO: 43448 - DNA, 36 bp, Artificial Sequence
  Synthetic oligonucleotide
gtacatgccgtgttctacctggggtcccgctttcaa

SEQ ID NO: 43449 - DNA, 36 bp, Artificial Sequence
  Synthetic oligonucleotide
gcccatgtgtctccctcctctacgtccgccttagaa

SEQ ID NO: 43450 - DNA, 36 bp, Artificial Sequence
  Synthetic oligonucleotide
atgcgcatcattctcctgttctgtgtcctgttctaa

SEQ ID NO: 43451 - DNA, 35 bp, Artificial Sequence
  Synthetic oligonucleotide
tctggacaaaaggccggatcataaggggggcaaca

SEQ ID NO: 43452 - DNA, 35 bp, Artificial Sequence
  Synthetic oligonucleotide
gacagtcatgtactggttccgcatctcgtttcaca

SEQ ID NO: 43453 - DNA, 35 bp, Artificial Sequence
  Synthetic oligonucleotide
taggcaccggtatttcatttttgtctgcttctcca

SEQ ID NO: 43454 - DNA, 36 bp, Artificial Sequence
  Synthetic oligonucleotide
acgcgcacggatcgtcgttcctgctgtcgcatctca

SEQ ID NO: 43455 - DNA, 37 bp, Artificial Sequence
  Synthetic oligonucleotide
gataggggggaaggcacaaatgacgagggggcggaga

SEQ ID NO: 43456 - DNA, 36 bp, Artificial Sequence
  Synthetic oligonucleotide
tgcgcctcaatacattaccgccttcttttcaataga

SEQ ID NO: 43457 - DNA, 36 bp, Artificial Sequence
  Synthetic oligonucleotide
atgaccatgaagcagcaaaaaaggtgacggaaggga

SEQ ID NO: 43458 - DNA, 37 bp, Artificial Sequence
  Synthetic oligonucleotide
gtcaatcggggggagacggtcaaggatgacgcaggga

SEQ ID NO: 43459 - DNA, 36 bp, Artificial Sequence
  Synthetic oligonucleotide
gcgccattatcctcacgatctgccttcctcacggga

SEQ ID NO: 43460 - DNA, 37 bp, Artificial Sequence
  Synthetic oligonucleotide
gtccaagtgaaatgcggggggggagtgttggtgggga

SEQ ID NO: 43461 - DNA, 37 bp, Artificial Sequence
  Synthetic oligonucleotide
aagtgcggggctggagcggggggatagagcggaatga

SEQ ID NO: 43462 - DNA, 38 bp, Artificial Sequence
  Synthetic oligonucleotide
tcacgcgcctcttatccgcttcctgttactccgtatga

SEQ ID NO: 43463 - DNA, 37 bp, Artificial Sequence
  Synthetic oligonucleotide
tgctcatacgtcgctaatcggccctgatcctccgtga

SEQ ID NO: 43464 - DNA, 38 bp, Artificial Sequence
  Synthetic oligonucleotide
gccacctcaaatacaatacactccgccgagaggcgtga

SEQ ID NO: 43465 - DNA, 38 bp, Artificial Sequence
  Synthetic oligonucleotide
tcaatgaaagaacagaggggtaggggacgggagtgtga

SEQ ID NO: 43466 - DNA, 38 bp, Artificial Sequence
  Synthetic oligonucleotide
gtcctgggcaaaaatggagtagggataaggcggattga

SEQ ID NO: 43467 - DNA, 38 bp, Artificial Sequence
  Synthetic oligonucleotide
aatagcgcacctgtgaccattagctctttccccgttga

SEQ ID NO: 43468 - DNA, 38 bp, Artificial Sequence
  Synthetic oligonucleotide
acgacgggggtagggatcttggacgggcataatgttga

SEQ ID NO: 43469 - DNA, 38 bp, Artificial Sequence
  Synthetic oligonucleotide
tgccccccgcatgccctcactccggccacctggtttga

SEQ ID NO: 43470 - DNA, 37 bp, Artificial Sequence
  Synthetic oligonucleotide
tgcctgcgagcacgagcaccacacactggcccatcta

SEQ ID NO: 43471 - DNA, 35 bp, Artificial Sequence
  Synthetic oligonucleotide
gacatatacagggggagaaatctgggtgcagggta

SEQ ID NO: 43472 - DNA, 35 bp, Artificial Sequence
  Synthetic oligonucleotide
acccacgggaagcctgtctctgtagcacattttta

SEQ ID NO: 43473 - DNA, 35 bp, Artificial Sequence
  Synthetic oligonucleotide
gcctcgcaccccatgaccgcataggtcgataggac

SEQ ID NO: 43474 - DNA, 35 bp, Artificial Sequence
  Synthetic oligonucleotide
tgttgccggcccacagctcattaccttgccttgac

SEQ ID NO: 43475 - DNA, 35 bp, Artificial Sequence
  Synthetic oligonucleotide
tcctccggcccgggcttatcaattgtcgatcctac

SEQ ID NO: 43476 - DNA, 35 bp, Artificial Sequence
  Synthetic oligonucleotide
gaacccgccacaatttactcacgcagccgagaacc

SEQ ID NO: 43477 - DNA, 35 bp, Artificial Sequence
  Synthetic oligonucleotide
accgctcctccattatccatctcgctatgtacacc

SEQ ID NO: 43478 - DNA, 35 bp, Artificial Sequence
  Synthetic oligonucleotide
tgcccgcgatcctccccctcgtcgtgcgtaggccc

SEQ ID NO: 43479 - DNA, 35 bp, Artificial Sequence
  Synthetic oligonucleotide
actacctcattcactggtccgccaccttcgggtgc

SEQ ID NO: 43480 - DNA, 35 bp, Artificial Sequence
  Synthetic oligonucleotide
tcagtgcaccctaccctgggaatcacagctccctc

SEQ ID NO: 43481 - DNA, 35 bp, Artificial Sequence
  Synthetic oligonucleotide
gatgacgcattggactctgtacgaccctaagcctc

SEQ ID NO: 43482 - DNA, 35 bp, Artificial Sequence
  Synthetic oligonucleotide
tcacgcccaatgccccagtatagtcacttcgcgtc

SEQ ID NO: 43483 - DNA, 35 bp, Artificial Sequence
  Synthetic oligonucleotide
gtccccttggatgacattatactattcacgctttc

SEQ ID NO: 43484 - DNA, 35 bp, Artificial Sequence
  Synthetic oligonucleotide
ttgtccccccgttttaacactccaccatcttggcg

SEQ ID NO: 43485 - DNA, 35 bp, Artificial Sequence
  Synthetic oligonucleotide
gaggcccccatgctgctcatatttacacaatcgat

SEQ ID NO: 43486 - DNA, 35 bp, Artificial Sequence
  Synthetic oligonucleotide
tagatcgggggggaaggcacggagtgagggactct

SEQ ID NO: 43487 - DNA, 35 bp, Artificial Sequence
  Synthetic oligonucleotide
tgggagagcggggggttggggaaagcctataaatt

SEQ ID NO: 43488 - DNA, 35 bp, Artificial Sequence
  Synthetic oligonucleotide
tgggtgtactgggtggttaatgggggggggaggtt

SEQ ID NO: 43489 - DNA, 36 bp, Artificial Sequence
  Synthetic oligonucleotide
gacacatccagcccactgttattaccaccatgtaca

SEQ ID NO: 43490 - DNA, 35 bp, Artificial Sequence
  Synthetic oligonucleotide
agactccctctgggcttgaaccgccatggacacca

SEQ ID NO: 43491 - DNA, 36 bp, Artificial Sequence
  Synthetic oligonucleotide
tttacaagctcagcagaggatccaccaccattccca

SEQ ID NO: 43492 - DNA, 36 bp, Artificial Sequence
  Synthetic oligonucleotide
tacaaaccacaccggtcatcgacagtgcacatgcca

SEQ ID NO: 43493 - DNA, 36 bp, Artificial Sequence
  Synthetic oligonucleotide
taagcctggccaggaacccgttttcgcgcatttcca

SEQ ID NO: 43494 - DNA, 35 bp, Artificial Sequence
  Synthetic oligonucleotide
aaaaaccggttgtaaggggatggaagatggcggca

SEQ ID NO: 43495 - DNA, 36 bp, Artificial Sequence
  Synthetic oligonucleotide
tgcgaaccgttccatctccgttaaaaacccgtggca

SEQ ID NO: 43496 - DNA, 35 bp, Artificial Sequence
  Synthetic oligonucleotide
atcctcgcacatatcctagccgtttcaatcttgca

SEQ ID NO: 43497 - DNA, 36 bp, Artificial Sequence
  Synthetic oligonucleotide
gatgcgacgaagaggaattggtattgacgtgggtca

SEQ ID NO: 43498 - DNA, 36 bp, Artificial Sequence
  Synthetic oligonucleotide
gaaggaggagaacaaagtggttggggatattgtaga

SEQ ID NO: 43499 - DNA, 37 bp, Artificial Sequence
  Synthetic oligonucleotide
gatgcacattcgctcagtttactccctgccaacacga

SEQ ID NO: 43500 - DNA, 37 bp, Artificial Sequence
  Synthetic oligonucleotide
tccagtccgactcctttcgttggctatcacacaccga

SEQ ID NO: 43501 - DNA, 37 bp, Artificial Sequence
  Synthetic oligonucleotide
tcactggcgcaggtcgttgccttccccgacacgcgga

SEQ ID NO: 43502 - DNA, 38 bp, Artificial Sequence
  Synthetic oligonucleotide
gtgcccggacctggtcccttccccgacgttatccatga

SEQ ID NO: 43503 - DNA, 37 bp, Artificial Sequence
  Synthetic oligonucleotide
ggggggggacggggcaagttgaacttttaagggatga

SEQ ID NO: 43504 - DNA, 38 bp, Artificial Sequence
  Synthetic oligonucleotide
atgcggctccgatcctcgcttgtaccaccatcttatga

SEQ ID NO: 43505 - DNA, 38 bp, Artificial Sequence
  Synthetic oligonucleotide
acggaaggtcgcttggtttcctgttccgttctgcctga

SEQ ID NO: 43506 - DNA, 38 bp, Artificial Sequence
  Synthetic oligonucleotide
aacatccgactacattcgcttgagctactggtccgtga

SEQ ID NO: 43507 - DNA, 37 bp, Artificial Sequence
  Synthetic oligonucleotide
agcacaaccatgactccccacttgcccctggacttga

SEQ ID NO: 43508 - DNA, 36 bp, Artificial Sequence
  Synthetic oligonucleotide
gtgctcacttaaccgcttttacatcgctccagttga

SEQ ID NO: 43509 - DNA, 38 bp, Artificial Sequence
  Synthetic oligonucleotide
ttgccctgcacccctgtgaggaccgatccctacgttga

SEQ ID NO: 43510 - DNA, 38 bp, Artificial Sequence
  Synthetic oligonucleotide
tatgcgcaacacatctaactacacgctacccatgttga

SEQ ID NO: 43511 - DNA, 36 bp, Artificial Sequence
  Synthetic oligonucleotide
taatcacccaccatgccgaacaagattacaggccta

SEQ ID NO: 43512 - DNA, 35 bp, Artificial Sequence
  Synthetic oligonucleotide
tacgttcggtgggctgggggggggttctggtagta

SEQ ID NO: 43513 - DNA, 36 bp, Artificial Sequence
  Synthetic oligonucleotide
aacccattgccgtgtagacgcccccgctcacagtta

SEQ ID NO: 43514 - DNA, 35 bp, Artificial Sequence
  Synthetic oligonucleotide
tgacacttgaaccccccgtcccaaggtctaagcac

SEQ ID NO: 43515 - DNA, 35 bp, Artificial Sequence
  Synthetic oligonucleotide
agcacctcccccagaccgtgacacccatctacgac

SEQ ID NO: 43516 - DNA, 35 bp, Artificial Sequence
  Synthetic oligonucleotide
gtctagcacatcactggccatttttcgacaccgac

SEQ ID NO: 43517 - DNA, 35 bp, Artificial Sequence
  Synthetic oligonucleotide
aaccctccctactagccaccgaaggaaacagaacc

SEQ ID NO: 43518 - DNA, 35 bp, Artificial Sequence
  Synthetic oligonucleotide
tcaccttgttcagtcgttcgttggtcctgtcaccc

SEQ ID NO: 43519 - DNA, 35 bp, Artificial Sequence
  Synthetic oligonucleotide
tgctcgagtcgcccattgcatggctttcttcaccc

SEQ ID NO: 43520 - DNA, 35 bp, Artificial Sequence
  Synthetic oligonucleotide
ttggcgaccgacctgcaaccgctattagccacgcc

SEQ ID NO: 43521 - DNA, 35 bp, Artificial Sequence
  Synthetic oligonucleotide
acaccacttacaaacgcgctagagttacgacccgc

SEQ ID NO: 43522 - DNA, 35 bp, Artificial Sequence
  Synthetic oligonucleotide
tgacaccgcccaaatcaacgtcagaatctctctgc

SEQ ID NO: 43523 - DNA, 35 bp, Artificial Sequence
  Synthetic oligonucleotide
tacctgagctgggaccgcttaagttcattcacctc

SEQ ID NO: 43524 - DNA, 35 bp, Artificial Sequence
  Synthetic oligonucleotide
tacgcactgggggttagtgtattattctgtctctc

SEQ ID NO: 43525 - DNA, 35 bp, Artificial Sequence
  Synthetic oligonucleotide
gcgataagcccacctgcaaagcacggaacgtattc

SEQ ID NO: 43526 - DNA, 35 bp, Artificial Sequence
  Synthetic oligonucleotide
tcatacgaccgatctgattttcgtcaaacaccgcg

SEQ ID NO: 43527 - DNA, 35 bp, Artificial Sequence
  Synthetic oligonucleotide
ggggatggaggagggcggtgtagtcatgagtgtcg

SEQ ID NO: 43528 - DNA, 35 bp, Artificial Sequence
  Synthetic oligonucleotide
actggaacatctaacccgcccctgtccccgtaggg

SEQ ID NO: 43529 - DNA, 35 bp, Artificial Sequence
  Synthetic oligonucleotide
tgcggagcggtcatccacttcagcccctgtccctg

SEQ ID NO: 43530 - DNA, 35 bp, Artificial Sequence
  Synthetic oligonucleotide
tcctggcactggcctgatcaccttgcccaatacct

SEQ ID NO: 43531 - DNA, 35 bp, Artificial Sequence
  Synthetic oligonucleotide
gtgcccccaatgcacgagttcaaagtccttgccct

SEQ ID NO: 43532 - DNA, 35 bp, Artificial Sequence
  Synthetic oligonucleotide
gtatgtactcgctcccacaccaaccgctagaggct

SEQ ID NO: 43533 - DNA, 35 bp, Artificial Sequence
  Synthetic oligonucleotide
gaccccctctttcgcttcccatacgcaacagtgct

SEQ ID NO: 43534 - DNA, 35 bp, Artificial Sequence
  Synthetic oligonucleotide
tcaggacctcttaaccgttctttcgtggcttatct

SEQ ID NO: 43535 - DNA, 35 bp, Artificial Sequence
  Synthetic oligonucleotide
tgatgcctgaccctctccaatcgccttaagaatgt

SEQ ID NO: 43536 - DNA, 35 bp, Artificial Sequence
  Synthetic oligonucleotide
tccgccatccgaacacgtcacaaggggaccacttt

SEQ ID NO: 43537 - DNA, 35 bp, Artificial Sequence
  Synthetic oligonucleotide
taacgagcgaggtaggagaaaagctgagagaagaa

SEQ ID NO: 43538 - DNA, 34 bp, Artificial Sequence
  Synthetic oligonucleotide
gtgaagtttgggggggcgctaaaggaggactgaa

SEQ ID NO: 43539 - DNA, 36 bp, Artificial Sequence
  Synthetic oligonucleotide
tgcatcaaccaatggccttaactcttatactgctaa

SEQ ID NO: 43540 - DNA, 36 bp, Artificial Sequence
  Synthetic oligonucleotide
gcgccccgctccaccactgaacaggttttatgttaa

SEQ ID NO: 43541 - DNA, 36 bp, Artificial Sequence
  Synthetic oligonucleotide
agcacgtacagccagcaacgaagcggtcccttccca

SEQ ID NO: 43542 - DNA, 37 bp, Artificial Sequence
  Synthetic oligonucleotide
gcacgcccatcatctcacctgcgacctgccaattcca

SEQ ID NO: 43543 - DNA, 36 bp, Artificial Sequence
  Synthetic oligonucleotide
accgcgcatgttccttgtttcggcgctggtctatca

SEQ ID NO: 43544 - DNA, 36 bp, Artificial Sequence
  Synthetic oligonucleotide
aacgccaccgcaacttgcttgaaagactccacctca

SEQ ID NO: 43545 - DNA, 37 bp, Artificial Sequence
  Synthetic oligonucleotide
actagcctccatcatgaccacatctgcctctattaga

SEQ ID NO: 43546 - DNA, 37 bp, Artificial Sequence
  Synthetic oligonucleotide
gaccagaccggagaaactaaatatggtggtgggacga

SEQ ID NO: 43547 - DNA, 37 bp, Artificial Sequence
  Synthetic oligonucleotide
ttacatgtcctggttgcctttttgtgtccgttgccga

SEQ ID NO: 43548 - DNA, 37 bp, Artificial Sequence
  Synthetic oligonucleotide
gtgccaagaaggcagggggggaaaatattgtcaagga

SEQ ID NO: 43549 - DNA, 36 bp, Artificial Sequence
  Synthetic oligonucleotide
gtgtaccccgtttctcatgtaaaacccgttttggga

SEQ ID NO: 43550 - DNA, 37 bp, Artificial Sequence
  Synthetic oligonucleotide
agaccggggagcaacaaaaggggtgaagtagtgtgga

SEQ ID NO: 43551 - DNA, 37 bp, Artificial Sequence
  Synthetic oligonucleotide
gcccgtactcctggccctttctcgtatctgacttgga

SEQ ID NO: 43552 - DNA, 38 bp, Artificial Sequence
  Synthetic oligonucleotide
tcaccgttcgccacaaagccagccacgtcctcctatga

SEQ ID NO: 43553 - DNA, 38 bp, Artificial Sequence
  Synthetic oligonucleotide
acgcaacgcaccctgccccaccgcagcaacaacactga

SEQ ID NO: 43554 - DNA, 38 bp, Artificial Sequence
  Synthetic oligonucleotide
gcctccatccccgcgattagtaccaccttactaggtga

SEQ ID NO: 43555 - DNA, 37 bp, Artificial Sequence
  Synthetic oligonucleotide
tgcgggaagggtgtggaatggaatccgtagagggtga

SEQ ID NO: 43556 - DNA, 36 bp, Artificial Sequence
  Synthetic oligonucleotide
taggagccactgccatccgccagcacatccaattga

SEQ ID NO: 43557 - DNA, 35 bp, Artificial Sequence
  Synthetic oligonucleotide
acactgtggagcaatcgtcgacccccgccctttcc

SEQ ID NO: 43558 - DNA, 35 bp, Artificial Sequence
  Synthetic oligonucleotide
acatcatcctgatcgtcgtcactgcctcctccgtc

SEQ ID NO: 43559 - DNA, 35 bp, Artificial Sequence
  Synthetic oligonucleotide
accctacagccgagctctgtcctctacgcgttgtc

SEQ ID NO: 43560 - DNA, 35 bp, Artificial Sequence
  Synthetic oligonucleotide
gttgctaaggagagacggagtggtagccgggggag

SEQ ID NO: 43561 - DNA, 35 bp, Artificial Sequence
  Synthetic oligonucleotide
atcactatcgaagtatatgccaaccataccccttg

SEQ ID NO: 43562 - DNA, 35 bp, Artificial Sequence
  Synthetic oligonucleotide
gaaccaaaaaagccaacgggggtactaggggaggt

SEQ ID NO: 43563 - DNA, 35 bp, Artificial Sequence
  Synthetic oligonucleotide
acctcgatccaggtttttaatgcttcgctgttctt

SEQ ID NO: 43564 - DNA, 35 bp, Artificial Sequence
  Synthetic oligonucleotide
tgtgtcccgaggttgcccaccctctttggcctgtt

SEQ ID NO: 43565 - DNA, 35 bp, Artificial Sequence
  Synthetic oligonucleotide
ggaccacttctgctactgcaaaaaacagtcttttt

SEQ ID NO: 43566 - DNA, 36 bp, Artificial Sequence
  Synthetic oligonucleotide
tcctcgtgacaacgtattctagggccccctccccaa

SEQ ID NO: 43567 - DNA, 36 bp, Artificial Sequence
  Synthetic oligonucleotide
tccgtaacccacggtgattcgccaaccggtatccaa

SEQ ID NO: 43568 - DNA, 36 bp, Artificial Sequence
  Synthetic oligonucleotide
gagtccaccacggctttttaccttatccacccggaa

SEQ ID NO: 43569 - DNA, 36 bp, Artificial Sequence
  Synthetic oligonucleotide
gacaacctcgatagtccgcaggacacactaacccca

SEQ ID NO: 43570 - DNA, 36 bp, Artificial Sequence
  Synthetic oligonucleotide
gcgtcaacccacagactccaagccgctacgttatca

SEQ ID NO: 43571 - DNA, 37 bp, Artificial Sequence
  Synthetic oligonucleotide
tgttggtgccagcctttgacactgatccacctcccga

SEQ ID NO: 43572 - DNA, 37 bp, Artificial Sequence
  Synthetic oligonucleotide
acggatcgaggggcagagatggggggtacggtggcga

SEQ ID NO: 43573 - DNA, 37 bp, Artificial Sequence
  Synthetic oligonucleotide
gacaccacccaacctcgaaaagacgataatcgtagga

SEQ ID NO: 43574 - DNA, 38 bp, Artificial Sequence
  Synthetic oligonucleotide
gacaagtcgcggcaagggatttagtggggagtaaatga

SEQ ID NO: 43575 - DNA, 38 bp, Artificial Sequence
  Synthetic oligonucleotide
gacgtatggcaaaggagggatggggcaactttaaatga

SEQ ID NO: 43576 - DNA, 36 bp, Artificial Sequence
  Synthetic oligonucleotide
gagagagatggagtaaggggtggtttgcgattatga

SEQ ID NO: 43577 - DNA, 36 bp, Artificial Sequence
  Synthetic oligonucleotide
gcagtgcccactcccccccgtactctgtgagactga

SEQ ID NO: 43578 - DNA, 38 bp, Artificial Sequence
  Synthetic oligonucleotide
atgacgtggggaggggaacggtagaggcgctgagctga

SEQ ID NO: 43579 - DNA, 38 bp, Artificial Sequence
  Synthetic oligonucleotide
aaacgcaacgcatcgaccctctccgtctacagtgctga

SEQ ID NO: 43580 - DNA, 38 bp, Artificial Sequence
  Synthetic oligonucleotide
atcgcggcctcactttctccgctatgcatacacattga

SEQ ID NO: 43581 - DNA, 38 bp, Artificial Sequence
  Synthetic oligonucleotide
acgactgctcagtcgggcgagggggaaggcattgttga

SEQ ID NO: 43582 - DNA, 36 bp, Artificial Sequence
  Synthetic oligonucleotide
gacgcccaatacgaatcgaatcacaggtactaggta

SEQ ID NO: 43583 - DNA, 35 bp, Artificial Sequence
  Synthetic oligonucleotide
acgagacgtcgtacgcaacggtgctcttgtcccac

SEQ ID NO: 43584 - DNA, 35 bp, Artificial Sequence
  Synthetic oligonucleotide
agtccccgcacccaatcccgtttgcgcaggttcac

SEQ ID NO: 43585 - DNA, 35 bp, Artificial Sequence
  Synthetic oligonucleotide
gtccgacggaggattccccttgcgacttccctgac

SEQ ID NO: 43586 - DNA, 35 bp, Artificial Sequence
  Synthetic oligonucleotide
gacgctcgggaccgcgcggaatcactctctttgcc

SEQ ID NO: 43587 - DNA, 35 bp, Artificial Sequence
  Synthetic oligonucleotide
gttcgaccgccacacattttcccacatagctgtcc

SEQ ID NO: 43588 - DNA, 35 bp, Artificial Sequence
  Synthetic oligonucleotide
acatcccctcatactcgcttagaccagacgggctc

SEQ ID NO: 43589 - DNA, 35 bp, Artificial Sequence
  Synthetic oligonucleotide
gctgttccgcctgtcttggtccgcctcacgccgtc

SEQ ID NO: 43590 - DNA, 35 bp, Artificial Sequence
  Synthetic oligonucleotide
gcaccgggttgcggggggatgggaaggagtaaaag

SEQ ID NO: 43591 - DNA, 35 bp, Artificial Sequence
  Synthetic oligonucleotide
tccacaatccgtgccaccataacaaccctgtctag

SEQ ID NO: 43592 - DNA, 35 bp, Artificial Sequence
  Synthetic oligonucleotide
tgcgagtgtcagcaccttataaattttgcccgcct

SEQ ID NO: 43593 - DNA, 35 bp, Artificial Sequence
  Synthetic oligonucleotide
aacacgacgagcaactgctaatcggccaattaaaa

SEQ ID NO: 43594 - DNA, 36 bp, Artificial Sequence
  Synthetic oligonucleotide
ttgcctcccacatcctgttctgtaatttgcgagcaa

SEQ ID NO: 43595 - DNA, 36 bp, Artificial Sequence
  Synthetic oligonucleotide
atggaccgatcgcgcttttatccgacccctagttaa

SEQ ID NO: 43596 - DNA, 36 bp, Artificial Sequence
  Synthetic oligonucleotide
gtcagaggcccacccgcacgcccctgtcctttttaa

SEQ ID NO: 43597 - DNA, 35 bp, Artificial Sequence
  Synthetic oligonucleotide
tcatctcgctatgttctccgagctcaaccacaaca

SEQ ID NO: 43598 - DNA, 36 bp, Artificial Sequence
  Synthetic oligonucleotide
actacgctcccatcctattgcgccacgagctataca

SEQ ID NO: 43599 - DNA, 35 bp, Artificial Sequence
  Synthetic oligonucleotide
acaagctggatatgcgcaagcaccgtcgcccacca

SEQ ID NO: 43600 - DNA, 36 bp, Artificial Sequence
  Synthetic oligonucleotide
atccgcctcggttcaatcgctccagctttaagacca

SEQ ID NO: 43601 - DNA, 36 bp, Artificial Sequence
  Synthetic oligonucleotide
ggaacacatccaagggattagccatagatgcaccca

SEQ ID NO: 43602 - DNA, 36 bp, Artificial Sequence
  Synthetic oligonucleotide
gctcagctccgttctatccaattcaagtcaccgcca

SEQ ID NO: 43603 - DNA, 36 bp, Artificial Sequence
  Synthetic oligonucleotide
atgtgcacaacagatcactcaaagtccgtccctcca

SEQ ID NO: 43604 - DNA, 36 bp, Artificial Sequence
  Synthetic oligonucleotide
tcaacccgacgagcattctgttatgcccctacggca

SEQ ID NO: 43605 - DNA, 37 bp, Artificial Sequence
  Synthetic oligonucleotide
tatgcctcatgatctagttccctgccctgctgccaga

SEQ ID NO: 43606 - DNA, 37 bp, Artificial Sequence
  Synthetic oligonucleotide
agacaaaggggggagagaaggttaacggtcggtacga

SEQ ID NO: 43607 - DNA, 37 bp, Artificial Sequence
  Synthetic oligonucleotide
aacccaccgaacctttaatgtcttttgcaacccccga

SEQ ID NO: 43608 - DNA, 36 bp, Artificial Sequence
  Synthetic oligonucleotide
gcacgtgccacaacacccatatttcgcttcgagcga

SEQ ID NO: 43609 - DNA, 36 bp, Artificial Sequence
  Synthetic oligonucleotide
acaaggcaactacacccgcgatacgtgccaattcga

SEQ ID NO: 43610 - DNA, 37 bp, Artificial Sequence
  Synthetic oligonucleotide
gtaacaggaggggtggaaactgcatagcactgtggga

SEQ ID NO: 43611 - DNA, 36 bp, Artificial Sequence
  Synthetic oligonucleotide
tacattcgcctaaccacgggagtaacatacactgga

SEQ ID NO: 43612 - DNA, 38 bp, Artificial Sequence
  Synthetic oligonucleotide
tatcaactcagcgcgcctcccgtgtcactgcccactga

SEQ ID NO: 43613 - DNA, 37 bp, Artificial Sequence
  Synthetic oligonucleotide
gtccctaccccccccagctgcgcaacatttacgctga

SEQ ID NO: 43614 - DNA, 38 bp, Artificial Sequence
  Synthetic oligonucleotide
tcaacgcctccacctgaatgggcttcatgtacctctga

SEQ ID NO: 43615 - DNA, 36 bp, Artificial Sequence
  Synthetic oligonucleotide
tccaccaccggctattgtactatccccacggagtga

SEQ ID NO: 43616 - DNA, 37 bp, Artificial Sequence
  Synthetic oligonucleotide
tttagcgtgaccatatatcctgtcctgctccccgtga

SEQ ID NO: 43617 - DNA, 37 bp, Artificial Sequence
  Synthetic oligonucleotide
gctcgcagagcctccgagccctctttcaacaaattga

SEQ ID NO: 43618 - DNA, 38 bp, Artificial Sequence
  Synthetic oligonucleotide
tagccgaccccgcctacgcacctgcaactgaaccttga

SEQ ID NO: 43619 - DNA, 36 bp, Artificial Sequence
  Synthetic oligonucleotide
ggacggtctcaccctgtcgtctcactagtccgccta

SEQ ID NO: 43620 - DNA, 36 bp, Artificial Sequence
  Synthetic oligonucleotide
gcacttccattccggccatattacaggtctttagta

SEQ ID NO: 43621 - DNA, 35 bp, Artificial Sequence
  Synthetic oligonucleotide
taccgaaagcgcccgtttcatttctgtctttggta

SEQ ID NO: 43622 - DNA, 36 bp, Artificial Sequence
  Synthetic oligonucleotide
tctccacatcctgttcggcttctatgaacccgttta

SEQ ID NO: 43623 - DNA, 35 bp, Artificial Sequence
  Synthetic oligonucleotide
gcctacacatgcctcctcctcccttccgggtgcac

SEQ ID NO: 43624 - DNA, 35 bp, Artificial Sequence
  Synthetic oligonucleotide
gtgtggcctccctctccgttaatgtgccatacccc

SEQ ID NO: 43625 - DNA, 35 bp, Artificial Sequence
  Synthetic oligonucleotide
atcatgagcccctgaagtcactccttctatagtcc

SEQ ID NO: 43626 - DNA, 35 bp, Artificial Sequence
  Synthetic oligonucleotide
gtggtctgtccaccctattacgttccgatactcgc

SEQ ID NO: 43627 - DNA, 35 bp, Artificial Sequence
  Synthetic oligonucleotide
gcgacagtgcggagaaaaaaagtggtgcagtgggc

SEQ ID NO: 43628 - DNA, 35 bp, Artificial Sequence
  Synthetic oligonucleotide
ggaaaccagccctcacatgcccggtttggtacttc

SEQ ID NO: 43629 - DNA, 35 bp, Artificial Sequence
  Synthetic oligonucleotide
tcagtaaccccgccgtcgtctttggtaattgttcg

SEQ ID NO: 43630 - DNA, 35 bp, Artificial Sequence
  Synthetic oligonucleotide
gctgatttccatctcaccgttttgccccaaacctg

SEQ ID NO: 43631 - DNA, 35 bp, Artificial Sequence
  Synthetic oligonucleotide
tgatcccatcgtagtcatcacccgcgataaaacat

SEQ ID NO: 43632 - DNA, 35 bp, Artificial Sequence
  Synthetic oligonucleotide
actgccatcggtatactctgtcattcgctattcat

SEQ ID NO: 43633 - DNA, 35 bp, Artificial Sequence
  Synthetic oligonucleotide
gtgtagacctctgtagattggtccttatccccgct

SEQ ID NO: 43634 - DNA, 34 bp, Artificial Sequence
  Synthetic oligonucleotide
tgagggacgctgccacgtggtcatttttacgtct

SEQ ID NO: 43635 - DNA, 35 bp, Artificial Sequence
  Synthetic oligonucleotide
gaggataaaagcggtggaagggataacgggggggt

SEQ ID NO: 43636 - DNA, 36 bp, Artificial Sequence
  Synthetic oligonucleotide
gtccgcgccttctgctatgcctctcagccggtgcca

SEQ ID NO: 43637 - DNA, 36 bp, Artificial Sequence
  Synthetic oligonucleotide
gccactgaaccgacgggtcatcaacctatgcctcca

SEQ ID NO: 43638 - DNA, 36 bp, Artificial Sequence
  Synthetic oligonucleotide
tgaaacccggtacctctccatcacagtgaaatgtca

SEQ ID NO: 43639 - DNA, 37 bp, Artificial Sequence
  Synthetic oligonucleotide
ggttcacctcgctggtttgcccaactcgttccataga

SEQ ID NO: 43640 - DNA, 37 bp, Artificial Sequence
  Synthetic oligonucleotide
tcatccgccatttactcgacagggcacctctccacga

SEQ ID NO: 43641 - DNA, 37 bp, Artificial Sequence
  Synthetic oligonucleotide
actgcaccacagcgttcggcaaacttctcccttgcga

SEQ ID NO: 43642 - DNA, 37 bp, Artificial Sequence
  Synthetic oligonucleotide
ggtgggggaggtagagggtagcacaagggtttcagga

SEQ ID NO: 43643 - DNA, 37 bp, Artificial Sequence
  Synthetic oligonucleotide
gggaagggagtggggatcgttggactggcgcatggga

SEQ ID NO: 43644 - DNA, 37 bp, Artificial Sequence
  Synthetic oligonucleotide
gcccccactcctgttcgcgccgtatggaactcctgga

SEQ ID NO: 43645 - DNA, 38 bp, Artificial Sequence
  Synthetic oligonucleotide
gccgccgcctgcccttgagcaacgactgcccataatga

SEQ ID NO: 43646 - DNA, 37 bp, Artificial Sequence
  Synthetic oligonucleotide
actgacacctcgcacttactaggatgctgatccatga

SEQ ID NO: 43647 - DNA, 35 bp, Artificial Sequence
  Synthetic oligonucleotide
tgacacctctaatcttaccgccactgcacatatga

SEQ ID NO: 43648 - DNA, 37 bp, Artificial Sequence
  Synthetic oligonucleotide
gcgcaaactgcatatcgatcccggcgacaccccctga

SEQ ID NO: 43649 - DNA, 37 bp, Artificial Sequence
  Synthetic oligonucleotide
tgcaccatctcacccaacgcagtacagcagtatctga

SEQ ID NO: 43650 - DNA, 38 bp, Artificial Sequence
  Synthetic oligonucleotide
acctgaactcacgcaccgtcaccctacgctcacggtga

SEQ ID NO: 43651 - DNA, 38 bp, Artificial Sequence
  Synthetic oligonucleotide
gtggtagggcctgtggtctcttggagggggtggtgtga

SEQ ID NO: 43652 - DNA, 36 bp, Artificial Sequence
  Synthetic oligonucleotide
atccgcatacccacgtgagttctcgtctatacatta

SEQ ID NO: 43653 - DNA, 34 bp, Artificial Sequence
  Synthetic oligonucleotide
gaggactacctcacttcttctcagaacatggaac

SEQ ID NO: 43654 - DNA, 35 bp, Artificial Sequence
  Synthetic oligonucleotide
tttacccacccctatcaccggcacccacatacgac

SEQ ID NO: 43655 - DNA, 35 bp, Artificial Sequence
  Synthetic oligonucleotide
ccccacctcaaacattgctacccccagtcttcgac

SEQ ID NO: 43656 - DNA, 35 bp, Artificial Sequence
  Synthetic oligonucleotide
tctgaccgtagttgtcagccttcgccattctcccc

SEQ ID NO: 43657 - DNA, 35 bp, Artificial Sequence
  Synthetic oligonucleotide
ggtatccgcatacctcgttggtttcactccgtccc

SEQ ID NO: 43658 - DNA, 36 bp, Artificial Sequence
  Synthetic oligonucleotide
tcctccattgcgctgaagtgcattcactcaattccc

SEQ ID NO: 43659 - DNA, 35 bp, Artificial Sequence
  Synthetic oligonucleotide
gccaacggcattttgtgacttctctctttctctcc

SEQ ID NO: 43660 - DNA, 35 bp, Artificial Sequence
  Synthetic oligonucleotide
tcacctccgacccgtcatgcacgtcatgcaacagc

SEQ ID NO: 43661 - DNA, 35 bp, Artificial Sequence
  Synthetic oligonucleotide
gacccaccgataagggtctttcttgagttacccgc

SEQ ID NO: 43662 - DNA, 35 bp, Artificial Sequence
  Synthetic oligonucleotide
acctgtcgcgcggtctggatacgcatcacaccgtc

SEQ ID NO: 43663 - DNA, 35 bp, Artificial Sequence
  Synthetic oligonucleotide
atgacgtcgcaccacgcaccacccttgccgcaagg

SEQ ID NO: 43664 - DNA, 35 bp, Artificial Sequence
  Synthetic oligonucleotide
gatgcgtgggacccttgaaagatagaagtcgtgtg

SEQ ID NO: 43665 - DNA, 35 bp, Artificial Sequence
  Synthetic oligonucleotide
tcgactattcgctttcatgtaccctcggcacccat

SEQ ID NO: 43666 - DNA, 35 bp, Artificial Sequence
  Synthetic oligonucleotide
tacaagtgattcggcctccctcgatcttgatccat

SEQ ID NO: 43667 - DNA, 35 bp, Artificial Sequence
  Synthetic oligonucleotide
gcccatctcgtactgaatctttgatgaatttttct

SEQ ID NO: 43668 - DNA, 35 bp, Artificial Sequence
  Synthetic oligonucleotide
tgtgttcacgcagtgtttcgtccatggtccacttt

SEQ ID NO: 43669 - DNA, 35 bp, Artificial Sequence
  Synthetic oligonucleotide
tgcacaggtgcgacatgcatgccactactaccttt

SEQ ID NO: 43670 - DNA, 35 bp, Artificial Sequence
  Synthetic oligonucleotide
accaatgccgtgctctcgatcacctttcggatttt

SEQ ID NO: 43671 - DNA, 36 bp, Artificial Sequence
  Synthetic oligonucleotide
tagacgagccaggcgcgctaagccccaccgttccaa

SEQ ID NO: 43672 - DNA, 35 bp, Artificial Sequence
  Synthetic oligonucleotide
tacctgcaacgtccgctgaacatcccacattgcaa

SEQ ID NO: 43673 - DNA, 36 bp, Artificial Sequence
  Synthetic oligonucleotide
gggatagagaggttgtcgaaaagggaggagatagaa

SEQ ID NO: 43674 - DNA, 36 bp, Artificial Sequence
  Synthetic oligonucleotide
gggaagggcgggagaagggcaaacgtggctaaataa

SEQ ID NO: 43675 - DNA, 36 bp, Artificial Sequence
  Synthetic oligonucleotide
tttcccacgggcacctttcgcgattaccccagtcca

SEQ ID NO: 43676 - DNA, 36 bp, Artificial Sequence
  Synthetic oligonucleotide
taaaggcaccatccggctaaaacgctcgctgtcgca

SEQ ID NO: 43677 - DNA, 36 bp, Artificial Sequence
  Synthetic oligonucleotide
gacacgggaatgcgggtcgggagttcaaaacaaaga

SEQ ID NO: 43678 - DNA, 37 bp, Artificial Sequence
  Synthetic oligonucleotide
gacaacatgggggtaaactaagaaacagcggaagaga

SEQ ID NO: 43679 - DNA, 37 bp, Artificial Sequence
  Synthetic oligonucleotide
acagggagcctagttgttacccaatgcctcctctcga

SEQ ID NO: 43680 - DNA, 37 bp, Artificial Sequence
  Synthetic oligonucleotide
gacctacaccctcttgaaatcgtcctgttccccggga

SEQ ID NO: 43681 - DNA, 37 bp, Artificial Sequence
  Synthetic oligonucleotide
tgactgatacagaatcggcgcaggagggagaggggga

SEQ ID NO: 43682 - DNA, 37 bp, Artificial Sequence
  Synthetic oligonucleotide
tgcccacacccaacccgtggattgttctatctaatga

SEQ ID NO: 43683 - DNA, 38 bp, Artificial Sequence
  Synthetic oligonucleotide
atgtgcccgccgctgcatatagttggcttgccctatga

SEQ ID NO: 43684 - DNA, 36 bp, Artificial Sequence
  Synthetic oligonucleotide
tgacccccacatttttaacacctgcaagccaactga

SEQ ID NO: 43685 - DNA, 38 bp, Artificial Sequence
  Synthetic oligonucleotide
gagacgggccaatccgtcgctgtacaacaatttactga

SEQ ID NO: 43686 - DNA, 38 bp, Artificial Sequence
  Synthetic oligonucleotide
gatcgcagaacagccctcccaccgcattctccgcctga

SEQ ID NO: 43687 - DNA, 38 bp, Artificial Sequence
  Synthetic oligonucleotide
aacaccaactttccattgacatctcgtcacttacgtga

SEQ ID NO: 43688 - DNA, 38 bp, Artificial Sequence
  Synthetic oligonucleotide
aaggatggtgacaaaggtaaggtgttgggcctgggtga

SEQ ID NO: 43689 - DNA, 38 bp, Artificial Sequence
  Synthetic oligonucleotide
acctgccttgaactccgtctccatctcacgtagtgtga

SEQ ID NO: 43690 - DNA, 38 bp, Artificial Sequence
  Synthetic oligonucleotide
tgtgagccatccactggtgcccataattttacacttga

SEQ ID NO: 43691 - DNA, 38 bp, Artificial Sequence
  Synthetic oligonucleotide
accgctacaacgccacaagccttttgactataccttga

SEQ ID NO: 43692 - DNA, 38 bp, Artificial Sequence
  Synthetic oligonucleotide
gtccaccgcaacccgattcttgtttagcgtatccttga

SEQ ID NO: 43693 - DNA, 38 bp, Artificial Sequence
  Synthetic oligonucleotide
tgtaatcgccccgctgtactggtaccacgctcctttga

SEQ ID NO: 43694 - DNA, 38 bp, Artificial Sequence
  Synthetic oligonucleotide
gcacacgcgcttcagaactccttttcttctggctttga

SEQ ID NO: 43695 - DNA, 37 bp, Artificial Sequence
  Synthetic oligonucleotide
atcctcacaaccttatggcgaagagcctcttgtccta

SEQ ID NO: 43696 - DNA, 36 bp, Artificial Sequence
  Synthetic oligonucleotide
agctaacaccatcctggcataaaccctgtacacgta

SEQ ID NO: 43697 - DNA, 35 bp, Artificial Sequence
  Synthetic oligonucleotide
ggacacatcactgtcgatgttcccacctctcatac

SEQ ID NO: 43698 - DNA, 35 bp, Artificial Sequence
  Synthetic oligonucleotide
agttccacagccgaatttatatcgcgcccgcaacc

SEQ ID NO: 43699 - DNA, 35 bp, Artificial Sequence
  Synthetic oligonucleotide
tacatgccctgggtggtttggtgttatctttaccc

SEQ ID NO: 43700 - DNA, 35 bp, Artificial Sequence
  Synthetic oligonucleotide
gcctgatcacgtctgaagaattctcatttggcccc

SEQ ID NO: 43701 - DNA, 35 bp, Artificial Sequence
  Synthetic oligonucleotide
agagccgacctgcctttcgactattctttgattcc

SEQ ID NO: 43702 - DNA, 35 bp, Artificial Sequence
  Synthetic oligonucleotide
gtgctcacaatctgtttcctcgggctcccgtacgc

SEQ ID NO: 43703 - DNA, 35 bp, Artificial Sequence
  Synthetic oligonucleotide
gctcacctcactcggacatcacctccgacatctgc

SEQ ID NO: 43704 - DNA, 34 bp, Artificial Sequence
  Synthetic oligonucleotide
gtaccagttcaggttatatgtcatttttccctcg

SEQ ID NO: 43705 - DNA, 35 bp, Artificial Sequence
  Synthetic oligonucleotide
gcgaagtcgggaatgacggaaggagtacgatgggg

SEQ ID NO: 43706 - DNA, 35 bp, Artificial Sequence
  Synthetic oligonucleotide
gaaagggtagagagcaagtatagaacgcggtttgg

SEQ ID NO: 43707 - DNA, 35 bp, Artificial Sequence
  Synthetic oligonucleotide
gcccaccatgccggcctatgcctcaccctatactg

SEQ ID NO: 43708 - DNA, 35 bp, Artificial Sequence
  Synthetic oligonucleotide
tgaccacatttccaacagtcctttaacggactact

SEQ ID NO: 43709 - DNA, 35 bp, Artificial Sequence
  Synthetic oligonucleotide
gacccgatcaaaccgtgcctcattgcggcaatcct

SEQ ID NO: 43710 - DNA, 35 bp, Artificial Sequence
  Synthetic oligonucleotide
tatacgtgcgtagactgtcccctcgaccacatgct

SEQ ID NO: 43711 - DNA, 35 bp, Artificial Sequence
  Synthetic oligonucleotide
gatgcttccacagcgaatttcagtcaccactccgt

SEQ ID NO: 43712 - DNA, 35 bp, Artificial Sequence
  Synthetic oligonucleotide
ggaactgacattgacctattgttgagcccgccctt

SEQ ID NO: 43713 - DNA, 35 bp, Artificial Sequence
  Synthetic oligonucleotide
atgactgcaggagtttttgattaggctgagggttt

SEQ ID NO: 43714 - DNA, 36 bp, Artificial Sequence
  Synthetic oligonucleotide
attaccctgccgccatgtacaccgttgttatgcaaa

SEQ ID NO: 43715 - DNA, 35 bp, Artificial Sequence
  Synthetic oligonucleotide
gtcacacctgcctatgtccctcttttggtgatgaa

SEQ ID NO: 43716 - DNA, 36 bp, Artificial Sequence
  Synthetic oligonucleotide
aaccacacctgtgccgcgcacaccgatgatcttaca

SEQ ID NO: 43717 - DNA, 35 bp, Artificial Sequence
  Synthetic oligonucleotide
gcgtggtggggttaataacaaccgggagggaggca

SEQ ID NO: 43718 - DNA, 37 bp, Artificial Sequence
  Synthetic oligonucleotide
agcatacgccgcccttttgcattccacgttcctaaga

SEQ ID NO: 43719 - DNA, 37 bp, Artificial Sequence
  Synthetic oligonucleotide
gtcgtagggggagggtgacggacataagacagccaga

SEQ ID NO: 43720 - DNA, 36 bp, Artificial Sequence
  Synthetic oligonucleotide
ggtaggtgggagtagtactggggctgtattcataga

SEQ ID NO: 43721 - DNA, 37 bp, Artificial Sequence
  Synthetic oligonucleotide
atccaacgcacctggactaccgctaggtctctgacga

SEQ ID NO: 43722 - DNA, 37 bp, Artificial Sequence
  Synthetic oligonucleotide
ggaccgcgagcataaggtccacgtctgaattcaccga

SEQ ID NO: 43723 - DNA, 37 bp, Artificial Sequence
  Synthetic oligonucleotide
acagtgtgacaggtgggggtgtggacaaagggtgcga

SEQ ID NO: 43724 - DNA, 37 bp, Artificial Sequence
  Synthetic oligonucleotide
gccgagagcaggaaagctggggggcggataaggagga

SEQ ID NO: 43725 - DNA, 36 bp, Artificial Sequence
  Synthetic oligonucleotide
gccacaggtccgtccacgtctatgcaacctctggga

SEQ ID NO: 43726 - DNA, 38 bp, Artificial Sequence
  Synthetic oligonucleotide
aagtgctgcaccgcccgttcacctttgatgccgcatga

SEQ ID NO: 43727 - DNA, 38 bp, Artificial Sequence
  Synthetic oligonucleotide
ttgtatcgccccactggtttctcgagctccctgtatga

SEQ ID NO: 43728 - DNA, 38 bp, Artificial Sequence
  Synthetic oligonucleotide
gttggagccccatgttattgcccacgcccgttcactga

SEQ ID NO: 43729 - DNA, 38 bp, Artificial Sequence
  Synthetic oligonucleotide
tcccatcgctgacgggttacagccgtttgacttcctga

SEQ ID NO: 43730 - DNA, 38 bp, Artificial Sequence
  Synthetic oligonucleotide
atactcatccgaagccgccccgcaacttactctgctga

SEQ ID NO: 43731 - DNA, 38 bp, Artificial Sequence
  Synthetic oligonucleotide
tgcccccctcattacaagacccaccgcttcgttgctga

SEQ ID NO: 43732 - DNA, 38 bp, Artificial Sequence
  Synthetic oligonucleotide
atcgcaccttccggctcaatacttcactgtcccggtga

SEQ ID NO: 43733 - DNA, 38 bp, Artificial Sequence
  Synthetic oligonucleotide
ggggggtgaagggaagaggggtgcggaataggtggtga

SEQ ID NO: 43734 - DNA, 36 bp, Artificial Sequence
  Synthetic oligonucleotide
gtcgcggtcctactgccctttctttcccgattgtga

SEQ ID NO: 43735 - DNA, 36 bp, Artificial Sequence
  Synthetic oligonucleotide
gtgtcacgccggctctgtgacaccgtttaacttata

SEQ ID NO: 43736 - DNA, 36 bp, Artificial Sequence
  Synthetic oligonucleotide
tccacgccgcggtactgcaccgtcactaaaggccta

SEQ ID NO: 43737 - DNA, 35 bp, Artificial Sequence
  Synthetic oligonucleotide
acccctacctgtgctttcgccgaccatctctcgta

SEQ ID NO: 43738 - DNA, 35 bp, Artificial Sequence
  Synthetic oligonucleotide
acaccgatcgcgcactttgagcttcctatgcaaac

SEQ ID NO: 43739 - DNA, 34 bp, Artificial Sequence
  Synthetic oligonucleotide
gtggtgggggcacgcgatctactcagaattacac

SEQ ID NO: 43740 - DNA, 35 bp, Artificial Sequence
  Synthetic oligonucleotide
ttgacgagaacgacgagtgaactatacttttccac

SEQ ID NO: 43741 - DNA, 35 bp, Artificial Sequence
  Synthetic oligonucleotide
tcccactcacggctctctgtttcccctgttagtac

SEQ ID NO: 43742 - DNA, 35 bp, Artificial Sequence
  Synthetic oligonucleotide
actcacaccatgatagtcctttgattacacagtcc

SEQ ID NO: 43743 - DNA, 35 bp, Artificial Sequence
  Synthetic oligonucleotide
gcaccgggcaatctactttcacgcgacgatcacgc

SEQ ID NO: 43744 - DNA, 35 bp, Artificial Sequence
  Synthetic oligonucleotide
accgtggtaagccctttcctccactactgcctcgc

SEQ ID NO: 43745 - DNA, 35 bp, Artificial Sequence
  Synthetic oligonucleotide
gtgcattgcagtacgcgtccttacctgtcatcggc

SEQ ID NO: 43746 - DNA, 35 bp, Artificial Sequence
  Synthetic oligonucleotide
actcagccgaccctgaataaagcgtccttcggctc

SEQ ID NO: 43747 - DNA, 35 bp, Artificial Sequence
  Synthetic oligonucleotide
gcccgtcccatgtcgaaccctgcaacttagtcttc

SEQ ID NO: 43748 - DNA, 35 bp, Artificial Sequence
  Synthetic oligonucleotide
tgatgtggaggagtaggtgtggcaggctatgagag

SEQ ID NO: 43749 - DNA, 34 bp, Artificial Sequence
  Synthetic oligonucleotide
accgctcactccgctagattaccctcacgactgg

SEQ ID NO: 43750 - DNA, 35 bp, Artificial Sequence
  Synthetic oligonucleotide
tgccccgaccctcactgctgtccctaagcgcctgg

SEQ ID NO: 43751 - DNA, 35 bp, Artificial Sequence
  Synthetic oligonucleotide
gtccgcctcactggcattcctgtgcttccacgcat

SEQ ID NO: 43752 - DNA, 35 bp, Artificial Sequence
  Synthetic oligonucleotide
gtcacatccatcagtactacgacctgtactttcct

SEQ ID NO: 43753 - DNA, 35 bp, Artificial Sequence
  Synthetic oligonucleotide
accaatcactgctggcctgagtctacctacgcgct

SEQ ID NO: 43754 - DNA, 35 bp, Artificial Sequence
  Synthetic oligonucleotide
aatggcgcatcaacttctctgtcattctggttcgt

SEQ ID NO: 43755 - DNA, 35 bp, Artificial Sequence
  Synthetic oligonucleotide
gagtcgagtggtggttgaatggtgcatgggtggtt

SEQ ID NO: 43756 - DNA, 35 bp, Artificial Sequence
  Synthetic oligonucleotide
gcaccccttgttgttgataatttgtcgcgtaattt

SEQ ID NO: 43757 - DNA, 35 bp, Artificial Sequence
  Synthetic oligonucleotide
acttagcccagacgtccacaaaccaggctctgttt

SEQ ID NO: 43758 - DNA, 36 bp, Artificial Sequence
  Synthetic oligonucleotide
aatcctcccgccctgccgatcagtacattatctcaa

SEQ ID NO: 43759 - DNA, 36 bp, Artificial Sequence
  Synthetic oligonucleotide
atctagggaccgggaagagaacggattggacatgaa

SEQ ID NO: 43760 - DNA, 36 bp, Artificial Sequence
  Synthetic oligonucleotide
gtgagcaccccacgttggtaacataatgcgcacaca

SEQ ID NO: 43761 - DNA, 36 bp, Artificial Sequence
  Synthetic oligonucleotide
gcacccctacggcgtccaacgctataccatgcctca

SEQ ID NO: 43762 - DNA, 37 bp, Artificial Sequence
  Synthetic oligonucleotide
gtcacggtgagatctcgcgtctcgtgggcctctctca

SEQ ID NO: 43763 - DNA, 35 bp, Artificial Sequence
  Synthetic oligonucleotide
atgacacgccaccacaattcgtctagggctcacga

SEQ ID NO: 43764 - DNA, 37 bp, Artificial Sequence
  Synthetic oligonucleotide
tcgacatagacacttgtcccggcacagcacccaccga

SEQ ID NO: 43765 - DNA, 37 bp, Artificial Sequence
  Synthetic oligonucleotide
tgcgcgcgagcccctccctctcaccctgctggaccga

SEQ ID NO: 43766 - DNA, 37 bp, Artificial Sequence
  Synthetic oligonucleotide
gatacacctcggttctgtcagctttgtcctttgccga

SEQ ID NO: 43767 - DNA, 37 bp, Artificial Sequence
  Synthetic oligonucleotide
tgtgctacgctgatcgttgccactaattgctcctcga

SEQ ID NO: 43768 - DNA, 37 bp, Artificial Sequence
  Synthetic oligonucleotide
gaccaccttcggaatactttcactgcgcctggctcga

SEQ ID NO: 43769 - DNA, 37 bp, Artificial Sequence
  Synthetic oligonucleotide
gctgactgccctctgcgattagactagcctctctcga

SEQ ID NO: 43770 - DNA, 37 bp, Artificial Sequence
  Synthetic oligonucleotide
tgcccgggctaccccgacgcttttcatgttctctcga

SEQ ID NO: 43771 - DNA, 36 bp, Artificial Sequence
  Synthetic oligonucleotide
acgcataatagcaaatctgtcctgcctgtctgtcga

SEQ ID NO: 43772 - DNA, 37 bp, Artificial Sequence
  Synthetic oligonucleotide
ggatcagccgaggttggttttttttttcttttttcga

SEQ ID NO: 43773 - DNA, 38 bp, Artificial Sequence
  Synthetic oligonucleotide
ttggtgccgccacatccattggttctgttcatccatga

SEQ ID NO: 43774 - DNA, 37 bp, Artificial Sequence
  Synthetic oligonucleotide
tcactacccggtttcagtcacgatgtacgacgagtga

SEQ ID NO: 43775 - DNA, 38 bp, Artificial Sequence
  Synthetic oligonucleotide
ttcgggaagaggggatgggtgggggtgtaccaacgtga

SEQ ID NO: 43776 - DNA, 38 bp, Artificial Sequence
  Synthetic oligonucleotide
gatgctcggtgcgttccattctcctttccctcgattga

SEQ ID NO: 43777 - DNA, 38 bp, Artificial Sequence
  Synthetic oligonucleotide
gaagagggaccagagaggagtgggagagggagtattga

SEQ ID NO: 43778 - DNA, 38 bp, Artificial Sequence
  Synthetic oligonucleotide
acacccatgaggtcccttcccgctgtctctggccttga

SEQ ID NO: 43779 - DNA, 36 bp, Artificial Sequence
  Synthetic oligonucleotide
tacgtgggtggaccggggaagaggaggaactcgata

SEQ ID NO: 43780 - DNA, 36 bp, Artificial Sequence
  Synthetic oligonucleotide
tgcacctaacgcgagcctggacccaagtttcaccta

SEQ ID NO: 43781 - DNA, 36 bp, Artificial Sequence
  Synthetic oligonucleotide
attgccccccaacaggacgtttcattctcggactta

SEQ ID NO: 43782 - DNA, 35 bp, Artificial Sequence
  Synthetic oligonucleotide
gtttaccgcattcccgacgctggctcccctgctta

SEQ ID NO: 43783 - DNA, 35 bp, Artificial Sequence
  Synthetic oligonucleotide
gccaccaggccgaatactggaattctgttgtcccc

SEQ ID NO: 43784 - DNA, 35 bp, Artificial Sequence
  Synthetic oligonucleotide
gtacctgctgcatatcattgaacaacattcccgcc

SEQ ID NO: 43785 - DNA, 35 bp, Artificial Sequence
  Synthetic oligonucleotide
gatcacacgcctgtaaccgcggcgactacacctcc

SEQ ID NO: 43786 - DNA, 35 bp, Artificial Sequence
  Synthetic oligonucleotide
ttactccaacctagccccgttgccactgcacttgc

SEQ ID NO: 43787 - DNA, 35 bp, Artificial Sequence
  Synthetic oligonucleotide
gactccgttactccatcgtaccgcacggtactgcg

SEQ ID NO: 43788 - DNA, 35 bp, Artificial Sequence
  Synthetic oligonucleotide
gccatggccgtccacaatcaccgctacagttactg

SEQ ID NO: 43789 - DNA, 35 bp, Artificial Sequence
  Synthetic oligonucleotide
gacctctacgtaggcctcgccttttctgcaccctg

SEQ ID NO: 43790 - DNA, 35 bp, Artificial Sequence
  Synthetic oligonucleotide
tacaccggttcacacctggagctaatgtcaatttg

SEQ ID NO: 43791 - DNA, 35 bp, Artificial Sequence
  Synthetic oligonucleotide
agcatcgtactagccacgtctctgggaagctccct

SEQ ID NO: 43792 - DNA, 35 bp, Artificial Sequence
  Synthetic oligonucleotide
acatgagttccacctatttagccaccagacgacgt

SEQ ID NO: 43793 - DNA, 36 bp, Artificial Sequence
  Synthetic oligonucleotide
atggggggctagggggggagggctgaaggaagtctt

SEQ ID NO: 43794 - DNA, 36 bp, Artificial Sequence
  Synthetic oligonucleotide
tctcacccagagggttgccacctttattgttagaaa

SEQ ID NO: 43795 - DNA, 36 bp, Artificial Sequence
  Synthetic oligonucleotide
actcaggggcatgctcatgtcttacccagcactaca

SEQ ID NO: 43796 - DNA, 36 bp, Artificial Sequence
  Synthetic oligonucleotide
tccccttcatgatagttggatccccgtgccacccca

SEQ ID NO: 43797 - DNA, 36 bp, Artificial Sequence
  Synthetic oligonucleotide
acaccctgtttagttattcaccccgttgccctgtca

SEQ ID NO: 43798 - DNA, 37 bp, Artificial Sequence
  Synthetic oligonucleotide
tccgcgacgacggccacccaataccaccactccgaga

SEQ ID NO: 43799 - DNA, 37 bp, Artificial Sequence
  Synthetic oligonucleotide
acgaaccacatcccaggaccgtgcagtaccttcgcga

SEQ ID NO: 43800 - DNA, 35 bp, Artificial Sequence
  Synthetic oligonucleotide
tgaccgtttcctatagcgtccctcatccccatcga

SEQ ID NO: 43801 - DNA, 36 bp, Artificial Sequence
  Synthetic oligonucleotide
tgataccgcgttattcccctgtatgctcctgttcga

SEQ ID NO: 43802 - DNA, 37 bp, Artificial Sequence
  Synthetic oligonucleotide
gaggggttatggaatggaaggcgaagagggggaagga

SEQ ID NO: 43803 - DNA, 35 bp, Artificial Sequence
  Synthetic oligonucleotide
ttccacccacacaccggttattctttaagcaggga

SEQ ID NO: 43804 - DNA, 35 bp, Artificial Sequence
  Synthetic oligonucleotide
gctgaaccccacctacatagctcaaccacctggga

SEQ ID NO: 43805 - DNA, 37 bp, Artificial Sequence
  Synthetic oligonucleotide
tcaacacccgcacgtctccgcggaccccgcccctgga

SEQ ID NO: 43806 - DNA, 37 bp, Artificial Sequence
  Synthetic oligonucleotide
ggtgccatgtgtgcgggggggtgggggagtaggtgga

SEQ ID NO: 43807 - DNA, 37 bp, Artificial Sequence
  Synthetic oligonucleotide
tcattgctgcgggcgtgagtagggtgggtgggtatga

SEQ ID NO: 43808 - DNA, 38 bp, Artificial Sequence
  Synthetic oligonucleotide
gcatgccacaccccgcactggcccccgtatcattatga

SEQ ID NO: 43809 - DNA, 37 bp, Artificial Sequence
  Synthetic oligonucleotide
ttgccgttcaaactgccacatttcgttgttctcctga

SEQ ID NO: 43810 - DNA, 37 bp, Artificial Sequence
  Synthetic oligonucleotide
gactagcagccccgagaagaaaaccatgccgccttga

SEQ ID NO: 43811 - DNA, 38 bp, Artificial Sequence
  Synthetic oligonucleotide
gtccccgcctctgtaagccgatccgtccggatccttga

SEQ ID NO: 43812 - DNA, 36 bp, Artificial Sequence
  Synthetic oligonucleotide
ggacgccacctaattggtccatttctcccaccggta

SEQ ID NO: 43813 - DNA, 35 bp, Artificial Sequence
  Synthetic oligonucleotide
gcgtgttcctctgcgctatacacccctgtttcaac

SEQ ID NO: 43814 - DNA, 35 bp, Artificial Sequence
  Synthetic oligonucleotide
tactgcggaatcctcgtaggcacgtaattaaccac

SEQ ID NO: 43815 - DNA, 35 bp, Artificial Sequence
  Synthetic oligonucleotide
tgactacacacccaacagcgcgcacttcggcaacc

SEQ ID NO: 43816 - DNA, 35 bp, Artificial Sequence
  Synthetic oligonucleotide
tggttgtatccgcaccatcgccttcaccgtgtacg

SEQ ID NO: 43817 - DNA, 35 bp, Artificial Sequence
  Synthetic oligonucleotide
ggaaggggggccggaggaagcctggagagggtgcg

SEQ ID NO: 43818 - DNA, 35 bp, Artificial Sequence
  Synthetic oligonucleotide
gtccatcctctcgcaccatgttgctgcaaagcctg

SEQ ID NO: 43819 - DNA, 35 bp, Artificial Sequence
  Synthetic oligonucleotide
atgtcgggcgatttgcctctcactgccttctcctg

SEQ ID NO: 43820 - DNA, 35 bp, Artificial Sequence
  Synthetic oligonucleotide
acacaaacgaaacgtacgaagaggagatgagcttg

SEQ ID NO: 43821 - DNA, 35 bp, Artificial Sequence
  Synthetic oligonucleotide
tctttgacggcccgtaccgcctactgcctttccat

SEQ ID NO: 43822 - DNA, 35 bp, Artificial Sequence
  Synthetic oligonucleotide
tacgaggtgcgacagccttacttctcatttctctt

SEQ ID NO: 43823 - DNA, 36 bp, Artificial Sequence
  Synthetic oligonucleotide
tctccccacaccaaatggtatgcggtacgcataaaa

SEQ ID NO: 43824 - DNA, 36 bp, Artificial Sequence
  Synthetic oligonucleotide
tctcatctccgcaggcaccaagtcgtaccacacaca

SEQ ID NO: 43825 - DNA, 36 bp, Artificial Sequence
  Synthetic oligonucleotide
ggaagcagtgaggataggggttggggggagggcaca

SEQ ID NO: 43826 - DNA, 36 bp, Artificial Sequence
  Synthetic oligonucleotide
tcaatagccagtcgttgcttagctatcccctttgca

SEQ ID NO: 43827 - DNA, 36 bp, Artificial Sequence
  Synthetic oligonucleotide
tcactcgcacctatcgatgctttctcaaaagcctca

SEQ ID NO: 43828 - DNA, 36 bp, Artificial Sequence
  Synthetic oligonucleotide
tccgcagaggtaccgatctatagctgcaattcttca

SEQ ID NO: 43829 - DNA, 37 bp, Artificial Sequence
  Synthetic oligonucleotide
accgccacgggtggcgtgcgatatcccgcctgtacga

SEQ ID NO: 43830 - DNA, 37 bp, Artificial Sequence
  Synthetic oligonucleotide
gtgtgcccgacaatcctcttaccgtgagcctagccga

SEQ ID NO: 43831 - DNA, 37 bp, Artificial Sequence
  Synthetic oligonucleotide
agtactgccctcctcttgtattttgctctggtatcga

SEQ ID NO: 43832 - DNA, 37 bp, Artificial Sequence
  Synthetic oligonucleotide
acctgtgtcgacgcgcctccccatgtccattaaggga

SEQ ID NO: 43833 - DNA, 37 bp, Artificial Sequence
  Synthetic oligonucleotide
aaagtaaaggcaatgaaggggcaaacggtcctaggga

SEQ ID NO: 43834 - DNA, 37 bp, Artificial Sequence
  Synthetic oligonucleotide
accccaaatgtgacgcctccactctgtgccatcatga

SEQ ID NO: 43835 - DNA, 38 bp, Artificial Sequence
  Synthetic oligonucleotide
agtaggaggcgggaagtaaagaagcagaggactgatga

SEQ ID NO: 43836 - DNA, 37 bp, Artificial Sequence
  Synthetic oligonucleotide
gatacgcgtaggagattccgcctgccccaacaactga

SEQ ID NO: 43837 - DNA, 38 bp, Artificial Sequence
  Synthetic oligonucleotide
gcaccccagtgaccgttgaggtgccttctcatctttga

SEQ ID NO: 43838 - DNA, 36 bp, Artificial Sequence
  Synthetic oligonucleotide
gccccgcctagactattgcttccaaccacgcgcata

SEQ ID NO: 43839 - DNA, 37 bp, Artificial Sequence
  Synthetic oligonucleotide
taccgcctcatcacacggcacacacccttgtcaccta

SEQ ID NO: 43840 - DNA, 36 bp, Artificial Sequence
  Synthetic oligonucleotide
tcactggaccaggctcatacgttctcgcctgcggta

SEQ ID NO: 43841 - DNA, 36 bp, Artificial Sequence
  Synthetic oligonucleotide
tcccgcttaacttctcttccgtccgcacacttggta

SEQ ID NO: 43842 - DNA, 35 bp, Artificial Sequence
  Synthetic oligonucleotide
gcgacgccgccactagctccggaacacttgcctta

SEQ ID NO: 43843 - DNA, 36 bp, Artificial Sequence
  Synthetic oligonucleotide
acgctaacccacaccacaaacgagcaggagccgtta

SEQ ID NO: 43844 - DNA, 35 bp, Artificial Sequence
  Synthetic oligonucleotide
gaggccatagtgcgatcactgcctacgccccccgc

SEQ ID NO: 43845 - DNA, 35 bp, Artificial Sequence
  Synthetic oligonucleotide
gctcacctcgaaccctacgtcatgggatcatcctc

SEQ ID NO: 43846 - DNA, 35 bp, Artificial Sequence
  Synthetic oligonucleotide
atcgcctcccctggattcgtagcccccatgttggg

SEQ ID NO: 43847 - DNA, 35 bp, Artificial Sequence
  Synthetic oligonucleotide
gtcaccacttcatcgggccacccttgtcgatcttg

SEQ ID NO: 43848 - DNA, 35 bp, Artificial Sequence
  Synthetic oligonucleotide
accatgcacaggccttagccccaccgcacattaat

SEQ ID NO: 43849 - DNA, 35 bp, Artificial Sequence
  Synthetic oligonucleotide
tccagtagtgccccgttatttccatcctgaccgat

SEQ ID NO: 43850 - DNA, 35 bp, Artificial Sequence
  Synthetic oligonucleotide
ttcgtgggaacagggatgggtggaaggcgggtgat

SEQ ID NO: 43851 - DNA, 35 bp, Artificial Sequence
  Synthetic oligonucleotide
attgccacatatcgatggatccgtcgaggccacct

SEQ ID NO: 43852 - DNA, 35 bp, Artificial Sequence
  Synthetic oligonucleotide
acccagcaaactacgcaatttcaccgtctcgttct

SEQ ID NO: 43853 - DNA, 35 bp, Artificial Sequence
  Synthetic oligonucleotide
gaatccgctcccttggtcgttctacctcaactcgt

SEQ ID NO: 43854 - DNA, 35 bp, Artificial Sequence
  Synthetic oligonucleotide
acatcactcaacttgcccccgctgaacaccgtcgt

SEQ ID NO: 43855 - DNA, 35 bp, Artificial Sequence
  Synthetic oligonucleotide
agtagcacggggaagggatggcggattttgtctgt

SEQ ID NO: 43856 - DNA, 35 bp, Artificial Sequence
  Synthetic oligonucleotide
tgactcgacaatcgttcaaggattgctgcctcctt

SEQ ID NO: 43857 - DNA, 36 bp, Artificial Sequence
  Synthetic oligonucleotide
aagtcgcccttgccccgtaattttgtgtgaacggaa

SEQ ID NO: 43858 - DNA, 36 bp, Artificial Sequence
  Synthetic oligonucleotide
tacacccccccgcttgcctttgaagtgtgcgccgca

SEQ ID NO: 43859 - DNA, 35 bp, Artificial Sequence
  Synthetic oligonucleotide
tctgaccataacaggcgtcataacatccctggtca

SEQ ID NO: 43860 - DNA, 36 bp, Artificial Sequence
  Synthetic oligonucleotide
tcacatctttgtgcaagggcataagcaccatcttca

SEQ ID NO: 43861 - DNA, 37 bp, Artificial Sequence
  Synthetic oligonucleotide
ggtggtgggccggggagggggggtctaggttgagaga

SEQ ID NO: 43862 - DNA, 37 bp, Artificial Sequence
  Synthetic oligonucleotide
agacacattgttgcgcgacaccccatctcaggcgaga

SEQ ID NO: 43863 - DNA, 37 bp, Artificial Sequence
  Synthetic oligonucleotide
tacgtaccgtagggagtaagggggggggggatcgcga

SEQ ID NO: 43864 - DNA, 37 bp, Artificial Sequence
  Synthetic oligonucleotide
ttcggagggatgtcagtgcgggagggcgggaagagga

SEQ ID NO: 43865 - DNA, 37 bp, Artificial Sequence
  Synthetic oligonucleotide
tctgcgaaggaacggggaattcgggttggtagaggga

SEQ ID NO: 43866 - DNA, 36 bp, Artificial Sequence
  Synthetic oligonucleotide
tgttgtgaagggcggggacggggggatgaacatgga

SEQ ID NO: 43867 - DNA, 37 bp, Artificial Sequence
  Synthetic oligonucleotide
gcacgttcatcggccaccaccaccgaaccattttgga

SEQ ID NO: 43868 - DNA, 38 bp, Artificial Sequence
  Synthetic oligonucleotide
acgcaacaacccgttgcgatcctccgatactgccatga

SEQ ID NO: 43869 - DNA, 38 bp, Artificial Sequence
  Synthetic oligonucleotide
gacactaacgtacttatcaaggccaacccactcgctga

SEQ ID NO: 43870 - DNA, 37 bp, Artificial Sequence
  Synthetic oligonucleotide
gtactgctgctaattcaacccgcccactcctgtgtga

SEQ ID NO: 43871 - DNA, 38 bp, Artificial Sequence
  Synthetic oligonucleotide
acacagagcggacgggaaggaaacgtggcgaatgttga

SEQ ID NO: 43872 - DNA, 36 bp, Artificial Sequence
  Synthetic oligonucleotide
tacagagtcggtcgctcctccctgtaaatgctccta

SEQ ID NO: 43873 - DNA, 36 bp, Artificial Sequence
  Synthetic oligonucleotide
gtagcgcaacccctgtcctggacgcctttccgatta

SEQ ID NO: 43874 - DNA, 35 bp, Artificial Sequence
  Synthetic oligonucleotide
gaacgcacgcggacgaccttaaactacatcattac

SEQ ID NO: 43875 - DNA, 35 bp, Artificial Sequence
  Synthetic oligonucleotide
tgcggaccgtcgctcttcgagttcccgcgcttacc

SEQ ID NO: 43876 - DNA, 36 bp, Artificial Sequence
  Synthetic oligonucleotide
tcccataacgtcacctccgaccatcagtatgttccc

SEQ ID NO: 43877 - DNA, 35 bp, Artificial Sequence
  Synthetic oligonucleotide
gagcgcagccataacccctcggcacaactcttgcc

SEQ ID NO: 43878 - DNA, 35 bp, Artificial Sequence
  Synthetic oligonucleotide
ggtcatacccggaagccaagtcagcattatcctcc

SEQ ID NO: 43879 - DNA, 35 bp, Artificial Sequence
  Synthetic oligonucleotide
attggtacgccctattgcggtcggaatcctgctcc

SEQ ID NO: 43880 - DNA, 35 bp, Artificial Sequence
  Synthetic oligonucleotide
ggacaacccacaactatcacttgttcaagccttcc

SEQ ID NO: 43881 - DNA, 35 bp, Artificial Sequence
  Synthetic oligonucleotide
ttgccgccccgaggggccttttttcgatgtacctc

SEQ ID NO: 43882 - DNA, 35 bp, Artificial Sequence
  Synthetic oligonucleotide
atattgcctgccctatcatgttgactttttttctc

SEQ ID NO: 43883 - DNA, 35 bp, Artificial Sequence
  Synthetic oligonucleotide
acccgtcaaaccgagtccccatttcacagcaggag

SEQ ID NO: 43884 - DNA, 35 bp, Artificial Sequence
  Synthetic oligonucleotide
attcgacaggaagtggtagaatggtggtagaaggg

SEQ ID NO: 43885 - DNA, 35 bp, Artificial Sequence
  Synthetic oligonucleotide
gcctgattctgtcacgtatccttcttcctaccctg

SEQ ID NO: 43886 - DNA, 36 bp, Artificial Sequence
  Synthetic oligonucleotide
tccgccggtcggctccgattctttgctcctgctctg

SEQ ID NO: 43887 - DNA, 35 bp, Artificial Sequence
  Synthetic oligonucleotide
tcagatcccgctatgactttgtagcaagcccccct

SEQ ID NO: 43888 - DNA, 35 bp, Artificial Sequence
  Synthetic oligonucleotide
aacccgcaaccgctgttgtgagcctgttggatcct

SEQ ID NO: 43889 - DNA, 35 bp, Artificial Sequence
  Synthetic oligonucleotide
agctgggggtggaccgggggttctggagaggacgt

SEQ ID NO: 43890 - DNA, 35 bp, Artificial Sequence
  Synthetic oligonucleotide
tgtccaacaatgtcggcttccgcaagacctctctt

SEQ ID NO: 43891 - DNA, 35 bp, Artificial Sequence
  Synthetic oligonucleotide
tagacgccccagacccgtaattcgctctgtttctt

SEQ ID NO: 43892 - DNA, 35 bp, Artificial Sequence
  Synthetic oligonucleotide
gtgtgctcggaggaactaggagggaggtacaggtt

SEQ ID NO: 43893 - DNA, 36 bp, Artificial Sequence
  Synthetic oligonucleotide
taccgctcgtcacacgtactaccgtaataccctaaa

SEQ ID NO: 43894 - DNA, 36 bp, Artificial Sequence
  Synthetic oligonucleotide
agacgtcggggaggtggggggaaaaaggcgctgtaa

SEQ ID NO: 43895 - DNA, 36 bp, Artificial Sequence
  Synthetic oligonucleotide
aactccctactccgactatacagacacttctccaca

SEQ ID NO: 43896 - DNA, 35 bp, Artificial Sequence
  Synthetic oligonucleotide
tagccacggtcgctctatagtcaaacgccgatcca

SEQ ID NO: 43897 - DNA, 35 bp, Artificial Sequence
  Synthetic oligonucleotide
aacgtcccgctcacctcgtacgtttggtaactcca

SEQ ID NO: 43898 - DNA, 37 bp, Artificial Sequence
  Synthetic oligonucleotide
acacatcgtgtggaacatcccagccccgtaacttgca

SEQ ID NO: 43899 - DNA, 37 bp, Artificial Sequence
  Synthetic oligonucleotide
gaccgaacccacctttgaatgacccagcacttaacga

SEQ ID NO: 43900 - DNA, 37 bp, Artificial Sequence
  Synthetic oligonucleotide
gtgtcctcgctccccgccacaaacacttttgccccga

SEQ ID NO: 43901 - DNA, 37 bp, Artificial Sequence
  Synthetic oligonucleotide
ttatcccacgccgctacctgaaacacgacgtctccga

SEQ ID NO: 43902 - DNA, 37 bp, Artificial Sequence
  Synthetic oligonucleotide
gtgggtagttgacggagggagcgctcgacagaaagga

SEQ ID NO: 43903 - DNA, 37 bp, Artificial Sequence
  Synthetic oligonucleotide
gtcgctcatcacaccgctaaaccaatggtccactgga

SEQ ID NO: 43904 - DNA, 38 bp, Artificial Sequence
  Synthetic oligonucleotide
ggggccccccaccacacacacgcccttgtagtacatga

SEQ ID NO: 43905 - DNA, 35 bp, Artificial Sequence
  Synthetic oligonucleotide
acactatcccgccgtttgagtaactcgccttatga

SEQ ID NO: 43906 - DNA, 38 bp, Artificial Sequence
  Synthetic oligonucleotide
acgccgacggtaggagcgcgtgtcacctgaaaatctga

SEQ ID NO: 43907 - DNA, 38 bp, Artificial Sequence
  Synthetic oligonucleotide
tcactaacgggaaagaatgaagacgggacgagcagtga

SEQ ID NO: 43908 - DNA, 38 bp, Artificial Sequence
  Synthetic oligonucleotide
tccagaaagcggatctgcccttgctccatcgaacgtga

SEQ ID NO: 43909 - DNA, 38 bp, Artificial Sequence
  Synthetic oligonucleotide
gccccggtctaccacacctcgccccatccctgacgtga

SEQ ID NO: 43910 - DNA, 37 bp, Artificial Sequence
  Synthetic oligonucleotide
gatgggcacaggcgaggtatgtgaactttgttcttga

SEQ ID NO: 43911 - DNA, 37 bp, Artificial Sequence
  Synthetic oligonucleotide
gacaagtgcgccgctagccttctaggaatacctttga

SEQ ID NO: 43912 - DNA, 36 bp, Artificial Sequence
  Synthetic oligonucleotide
aatgggagggagggacctccagcgtgggatagcata

SEQ ID NO: 43913 - DNA, 36 bp, Artificial Sequence
  Synthetic oligonucleotide
gagacaccgcacccgttccaactattacatacgcta

SEQ ID NO: 43914 - DNA, 35 bp, Artificial Sequence
  Synthetic oligonucleotide
taccatccaatcgcattatttagccacctacggta

SEQ ID NO: 43915 - DNA, 36 bp, Artificial Sequence
  Synthetic oligonucleotide
gtcgcctactaaagccttcttcactgcactgtggta

SEQ ID NO: 43916 - DNA, 36 bp, Artificial Sequence
  Synthetic oligonucleotide
gctaactacgcactttgttggaactactgccttgta

SEQ ID NO: 43917 - DNA, 35 bp, Artificial Sequence
  Synthetic oligonucleotide
tacaatccgcacctcggttcgccacaccgtcccac

SEQ ID NO: 43918 - DNA, 35 bp, Artificial Sequence
  Synthetic oligonucleotide
gttgcacctgaaagggccgccgcatcaccatcccc

SEQ ID NO: 43919 - DNA, 35 bp, Artificial Sequence
  Synthetic oligonucleotide
gctcggcacctggttaacacccctcacccgctggc

SEQ ID NO: 43920 - DNA, 35 bp, Artificial Sequence
  Synthetic oligonucleotide
gtgacggtgcgttgcgcgcctgtacatccgttatc

SEQ ID NO: 43921 - DNA, 35 bp, Artificial Sequence
  Synthetic oligonucleotide
gataccgacggaccgcttatgattgcactctcgtc

SEQ ID NO: 43922 - DNA, 35 bp, Artificial Sequence
  Synthetic oligonucleotide
accacatggatcgagtcgcgtattattgcccctcg

SEQ ID NO: 43923 - DNA, 35 bp, Artificial Sequence
  Synthetic oligonucleotide
gaacttagccattgcatctccccacccattagggg

SEQ ID NO: 43924 - DNA, 35 bp, Artificial Sequence
  Synthetic oligonucleotide
gccgggaatggtagaggggtaatgctagggatggg

SEQ ID NO: 43925 - DNA, 35 bp, Artificial Sequence
  Synthetic oligonucleotide
ggtacccgctcacccatcagttctgagttaacctg

SEQ ID NO: 43926 - DNA, 35 bp, Artificial Sequence
  Synthetic oligonucleotide
gccacgcgcgtctcgtttctttggcactggccctg

SEQ ID NO: 43927 - DNA, 35 bp, Artificial Sequence
  Synthetic oligonucleotide
agtaacgcgaacatcaccgcaccacgaacaccgtg

SEQ ID NO: 43928 - DNA, 35 bp, Artificial Sequence
  Synthetic oligonucleotide
gatacagcagggggttatgcaccatttccgcaact

SEQ ID NO: 43929 - DNA, 35 bp, Artificial Sequence
  Synthetic oligonucleotide
tgcacctcagccttcagaaacctgacatgcccact

SEQ ID NO: 43930 - DNA, 35 bp, Artificial Sequence
  Synthetic oligonucleotide
gcccacgcatgacgttataccgcgtctcctgctct

SEQ ID NO: 43931 - DNA, 35 bp, Artificial Sequence
  Synthetic oligonucleotide
gaggactgcgcgcacagggctcccaccatccccgt

SEQ ID NO: 43932 - DNA, 35 bp, Artificial Sequence
  Synthetic oligonucleotide
acatgccggcacaactactaacataaaatttcggt

SEQ ID NO: 43933 - DNA, 35 bp, Artificial Sequence
  Synthetic oligonucleotide
tgcccttccagcgcgcctggtcggccattcttctt

SEQ ID NO: 43934 - DNA, 35 bp, Artificial Sequence
  Synthetic oligonucleotide
gctcacctcccgcgatgattcccacgtcatggttt

SEQ ID NO: 43935 - DNA, 36 bp, Artificial Sequence
  Synthetic oligonucleotide
atcccgaaccctatggcacttgagcctctttttaaa

SEQ ID NO: 43936 - DNA, 36 bp, Artificial Sequence
  Synthetic oligonucleotide
tgtaagaagcagggaagggaacaatgagcagcgcaa

SEQ ID NO: 43937 - DNA, 36 bp, Artificial Sequence
  Synthetic oligonucleotide
aaccggttcgtacggtccatctgttccgatcattaa

SEQ ID NO: 43938 - DNA, 36 bp, Artificial Sequence
  Synthetic oligonucleotide
gagcatccgcctctgccaaattttcggatcacttaa

SEQ ID NO: 43939 - DNA, 35 bp, Artificial Sequence
  Synthetic oligonucleotide
agcgaccaacgcctctccatcacgcagactagaca

SEQ ID NO: 43940 - DNA, 36 bp, Artificial Sequence
  Synthetic oligonucleotide
gatctgcaaggtaagatctccatcgtccctcataca

SEQ ID NO: 43941 - DNA, 36 bp, Artificial Sequence
  Synthetic oligonucleotide
gatcaccacgcagacggccctaccatctttatgcca

SEQ ID NO: 43942 - DNA, 37 bp, Artificial Sequence
  Synthetic oligonucleotide
tgacgctaccatccattctctcagcaccctctcgaga

SEQ ID NO: 43943 - DNA, 37 bp, Artificial Sequence
  Synthetic oligonucleotide
gccctgccatttgctaaatgctacttcctccacacga

SEQ ID NO: 43944 - DNA, 37 bp, Artificial Sequence
  Synthetic oligonucleotide
accgccgccgggagcaatccgccacgactttttacga

SEQ ID NO: 43945 - DNA, 37 bp, Artificial Sequence
  Synthetic oligonucleotide
gtgggatggagaaggggtacttaggtgaggatacgga

SEQ ID NO: 43946 - DNA, 37 bp, Artificial Sequence
  Synthetic oligonucleotide
tgtaggagggatgggaaggggaaacattgggtaggga

SEQ ID NO: 43947 - DNA, 38 bp, Artificial Sequence
  Synthetic oligonucleotide
atcaacgtggggtcaccgccgctttccctgttccatga

SEQ ID NO: 43948 - DNA, 37 bp, Artificial Sequence
  Synthetic oligonucleotide
tcttcatgccactgccacttgccaatctcagaactga

SEQ ID NO: 43949 - DNA, 38 bp, Artificial Sequence
  Synthetic oligonucleotide
gctgtagcgcgcaatccgtcgccgccatcctattctga

SEQ ID NO: 43950 - DNA, 38 bp, Artificial Sequence
  Synthetic oligonucleotide
tccaggaggtgcggagaaagaaggggggcacaaggtga

SEQ ID NO: 43951 - DNA, 38 bp, Artificial Sequence
  Synthetic oligonucleotide
gggggccgtggtgcaatggagagggttgggcggggtga

SEQ ID NO: 43952 - DNA, 37 bp, Artificial Sequence
  Synthetic oligonucleotide
gcaggagaaagggttgacggacggtggagtagtgtga

SEQ ID NO: 43953 - DNA, 37 bp, Artificial Sequence
  Synthetic oligonucleotide
tccactgaccaaacatgctgtctgttcaccccattga

SEQ ID NO: 43954 - DNA, 38 bp, Artificial Sequence
  Synthetic oligonucleotide
tgcgctccacacttaggttctgcattggccgtttttga

SEQ ID NO: 43955 - DNA, 36 bp, Artificial Sequence
  Synthetic oligonucleotide
gggagagccgcattctcgtacttcttgatctaccta

SEQ ID NO: 43956 - DNA, 35 bp, Artificial Sequence
  Synthetic oligonucleotide
gtgactcggggcatccgcattcgaccatctctcta

SEQ ID NO: 43957 - DNA, 36 bp, Artificial Sequence
  Synthetic oligonucleotide
tctgacatgtcccccatgattccgtcgcctcggtta

SEQ ID NO: 43958 - DNA, 35 bp, Artificial Sequence
  Synthetic oligonucleotide
tagtcatcctagctgcactccgctagccacccagc

SEQ ID NO: 43959 - DNA, 35 bp, Artificial Sequence
  Synthetic oligonucleotide
gcgcgaagccacgaaccggatctcatggttacctc

SEQ ID NO: 43960 - DNA, 35 bp, Artificial Sequence
  Synthetic oligonucleotide
gccatgccactttaccctcagctccaagtctattc

SEQ ID NO: 43961 - DNA, 35 bp, Artificial Sequence
  Synthetic oligonucleotide
acaattggaggcgtccgtctgcccacttaaccttc

SEQ ID NO: 43962 - DNA, 35 bp, Artificial Sequence
  Synthetic oligonucleotide
gtagacggggggtccattcatgggagggcgaaacg

SEQ ID NO: 43963 - DNA, 35 bp, Artificial Sequence
  Synthetic oligonucleotide
acaaataactgctgccctcctgttcgggatcccat

SEQ ID NO: 43964 - DNA, 35 bp, Artificial Sequence
  Synthetic oligonucleotide
catgttcgctgacgccaatcctcatttgctggact

SEQ ID NO: 43965 - DNA, 35 bp, Artificial Sequence
  Synthetic oligonucleotide
atcgtggaggctcaatcctgcatgccgtttactct

SEQ ID NO: 43966 - DNA, 35 bp, Artificial Sequence
  Synthetic oligonucleotide
tcaatcgccctctgcaaacccttctacaaggtctt

SEQ ID NO: 43967 - DNA, 35 bp, Artificial Sequence
  Synthetic oligonucleotide
accgaaccggaactataagcctgaacccagctaca

SEQ ID NO: 43968 - DNA, 36 bp, Artificial Sequence
  Synthetic oligonucleotide
ttccgcagctgcgcccgttactacctagtgccacca

SEQ ID NO: 43969 - DNA, 35 bp, Artificial Sequence
  Synthetic oligonucleotide
gcacacatccaatagtctcgaagaatcttaggtca

SEQ ID NO: 43970 - DNA, 36 bp, Artificial Sequence
  Synthetic oligonucleotide
acacaacgccggccaacttatagcaccttcaaaaga

SEQ ID NO: 43971 - DNA, 37 bp, Artificial Sequence
  Synthetic oligonucleotide
atggtacgccatgagcgtcacacccacgcaataccga

SEQ ID NO: 43972 - DNA, 35 bp, Artificial Sequence
  Synthetic oligonucleotide
taacgctatcccatcgccgccgatcaagcccccga

SEQ ID NO: 43973 - DNA, 37 bp, Artificial Sequence
  Synthetic oligonucleotide
tatcactccctgccaaatagtgaagccgctttagcga

SEQ ID NO: 43974 - DNA, 37 bp, Artificial Sequence
  Synthetic oligonucleotide
gacataccttgtactagccacttccatcttgtgagga

SEQ ID NO: 43975 - DNA, 36 bp, Artificial Sequence
  Synthetic oligonucleotide
attccaccgccatgagtttcactcgtccccagcgga

SEQ ID NO: 43976 - DNA, 37 bp, Artificial Sequence
  Synthetic oligonucleotide
accatgtcgctccccgcaaccacctgctttaatggga

SEQ ID NO: 43977 - DNA, 37 bp, Artificial Sequence
  Synthetic oligonucleotide
gtccccccgaaatatgtcgggtagccccttccatgga

SEQ ID NO: 43978 - DNA, 37 bp, Artificial Sequence
  Synthetic oligonucleotide
gagggcacgggagggatgggaggggccgccttctgga

SEQ ID NO: 43979 - DNA, 37 bp, Artificial Sequence
  Synthetic oligonucleotide
tttggctcccctgctttgtttgcttcactgtattgga

SEQ ID NO: 43980 - DNA, 37 bp, Artificial Sequence
  Synthetic oligonucleotide
gcctgcataatggagaaaaaaggataggaagtaatga

SEQ ID NO: 43981 - DNA, 38 bp, Artificial Sequence
  Synthetic oligonucleotide
acgactgtaccacatagttacgtaaccgttttcactga

SEQ ID NO: 43982 - DNA, 38 bp, Artificial Sequence
  Synthetic oligonucleotide
actgacccgcatagtacctgccccccagatagccctga

SEQ ID NO: 43983 - DNA, 38 bp, Artificial Sequence
  Synthetic oligonucleotide
acgacaagccttcacctcatctctaccgggtacgctga

SEQ ID NO: 43984 - DNA, 38 bp, Artificial Sequence
  Synthetic oligonucleotide
gcagagagagggggatagaaaacggcatgggtggctga

SEQ ID NO: 43985 - DNA, 38 bp, Artificial Sequence
  Synthetic oligonucleotide
gtagtgggtaggcggggggaaaacttaagaacgggtga

SEQ ID NO: 43986 - DNA, 38 bp, Artificial Sequence
  Synthetic oligonucleotide
agccgccgccccacacccttgctaggacataacattga

SEQ ID NO: 43987 - DNA, 37 bp, Artificial Sequence
  Synthetic oligonucleotide
tatgaggggggtgggccgagaccgtgatggagcttga

SEQ ID NO: 43988 - DNA, 36 bp, Artificial Sequence
  Synthetic oligonucleotide
gtctacgcccgccttctaacgtcttactccagttta

SEQ ID NO: 43989 - DNA, 35 bp, Artificial Sequence
  Synthetic oligonucleotide
acacgggggggtgtaggtggggaattttattttta

SEQ ID NO: 43990 - DNA, 35 bp, Artificial Sequence
  Synthetic oligonucleotide
tcctggtacaatgcacactgacggctccctgcaac

SEQ ID NO: 43991 - DNA, 35 bp, Artificial Sequence
  Synthetic oligonucleotide
attggggcacggcacaaggaacctcgactcaccac

SEQ ID NO: 43992 - DNA, 35 bp, Artificial Sequence
  Synthetic oligonucleotide
ttcatcacacgaggggcaccatggacgctcgatcc

SEQ ID NO: 43993 - DNA, 35 bp, Artificial Sequence
  Synthetic oligonucleotide
tacgcctgtcatgggcctagcattccctctttcgc

SEQ ID NO: 43994 - DNA, 36 bp, Artificial Sequence
  Synthetic oligonucleotide
gccccacccactaatgatcggtcctgactagcggtc

SEQ ID NO: 43995 - DNA, 35 bp, Artificial Sequence
  Synthetic oligonucleotide
gtattccccccgaccaacgtttctgactccatccg

SEQ ID NO: 43996 - DNA, 35 bp, Artificial Sequence
  Synthetic oligonucleotide
tccacacgcacccatcctgactcaagtcccatgcg

SEQ ID NO: 43997 - DNA, 35 bp, Artificial Sequence
  Synthetic oligonucleotide
atcaccatagtgactatcttgtcagtcctccctcg

SEQ ID NO: 43998 - DNA, 35 bp, Artificial Sequence
  Synthetic oligonucleotide
acgcgggtgggatcatagcgggaaaggaatttggg

SEQ ID NO: 43999 - DNA, 35 bp, Artificial Sequence
  Synthetic oligonucleotide
tagccgcgcctacttcccccgactccttttgatgg

SEQ ID NO: 44000 - DNA, 35 bp, Artificial Sequence
  Synthetic oligonucleotide
caatcccagtgctagacgatcccccctgtaacctg

SEQ ID NO: 44001 - DNA, 35 bp, Artificial Sequence
  Synthetic oligonucleotide
gacaacgacatcccaaattatccccatccctgctg

SEQ ID NO: 44002 - DNA, 35 bp, Artificial Sequence
  Synthetic oligonucleotide
gacgcatcctgggccagcaagcgtgccttcttgat

SEQ ID NO: 44003 - DNA, 34 bp, Artificial Sequence
  Synthetic oligonucleotide
gtctgaccgcccctatctggcagtgtagtgccct

SEQ ID NO: 44004 - DNA, 35 bp, Artificial Sequence
  Synthetic oligonucleotide
gaccatgccccttccgtgcaacgtcgtagctttct

SEQ ID NO: 44005 - DNA, 35 bp, Artificial Sequence
  Synthetic oligonucleotide
ggtcccgttctctgtgctttctcgcccgtctgttt

SEQ ID NO: 44006 - DNA, 36 bp, Artificial Sequence
  Synthetic oligonucleotide
attcactcacgaccattgctgccccctatgcgtcaa

SEQ ID NO: 44007 - DNA, 36 bp, Artificial Sequence
  Synthetic oligonucleotide
gcatgagcgcctatgcccctttatcggcccctaaca

SEQ ID NO: 44008 - DNA, 35 bp, Artificial Sequence
  Synthetic oligonucleotide
gaggggggtgaggttattcgtactgcagggagcca

SEQ ID NO: 44009 - DNA, 36 bp, Artificial Sequence
  Synthetic oligonucleotide
gcgcaacgcacactaactttccgatcccggtagcca

SEQ ID NO: 44010 - DNA, 35 bp, Artificial Sequence
  Synthetic oligonucleotide
gctggactcctgcaacaccgctgaaccttctagca

SEQ ID NO: 44011 - DNA, 35 bp, Artificial Sequence
  Synthetic oligonucleotide
gcctccacgttccccccccctgacaatcgggtgca

SEQ ID NO: 44012 - DNA, 36 bp, Artificial Sequence
  Synthetic oligonucleotide
atcgcccatcagccgatcttgttacctttctcgtca

SEQ ID NO: 44013 - DNA, 37 bp, Artificial Sequence
  Synthetic oligonucleotide
gacaaccaatgggacaaagggggctcgcattcgacga

SEQ ID NO: 44014 - DNA, 37 bp, Artificial Sequence
  Synthetic oligonucleotide
tctggtcgcctctccactcgtcacaggccagttacga

SEQ ID NO: 44015 - DNA, 37 bp, Artificial Sequence
  Synthetic oligonucleotide
gtgcgctctgtcctcttggtctatatatacccttcga

SEQ ID NO: 44016 - DNA, 37 bp, Artificial Sequence
  Synthetic oligonucleotide
gtgaggagggctgttagcgaaaggggggccatgagga

SEQ ID NO: 44017 - DNA, 37 bp, Artificial Sequence
  Synthetic oligonucleotide
gtgggggaggatgggggaagagcctaagaagaatgga

SEQ ID NO: 44018 - DNA, 37 bp, Artificial Sequence
  Synthetic oligonucleotide
gccgtcccaggcggaagacccctacactacttctgga

SEQ ID NO: 44019 - DNA, 35 bp, Artificial Sequence
  Synthetic oligonucleotide
tcaaccatcccgcctattgctaataaatacaatga

SEQ ID NO: 44020 - DNA, 37 bp, Artificial Sequence
  Synthetic oligonucleotide
gtcaacctttggtattttgttatcttacgccccctga

SEQ ID NO: 44021 - DNA, 38 bp, Artificial Sequence
  Synthetic oligonucleotide
gcccactgaacgtcactaggtcccctgctcattcctga

SEQ ID NO: 44022 - DNA, 36 bp, Artificial Sequence
  Synthetic oligonucleotide
tcgcaacgtacagtcaaccagcccaatacatgccta

SEQ ID NO: 44023 - DNA, 35 bp, Artificial Sequence
  Synthetic oligonucleotide
ggatcccgtagcctatttgtcttttatgcctatcc

SEQ ID NO: 44024 - DNA, 35 bp, Artificial Sequence
  Synthetic oligonucleotide
agcgacccattctatgatccggttcccgtttgtcc

SEQ ID NO: 44025 - DNA, 35 bp, Artificial Sequence
  Synthetic oligonucleotide
gacgtcgcattcactctcacaatcagtttcccatc

SEQ ID NO: 44026 - DNA, 35 bp, Artificial Sequence
  Synthetic oligonucleotide
aatcatggcgcgtacgttcattccaaccttcgctc

SEQ ID NO: 44027 - DNA, 35 bp, Artificial Sequence
  Synthetic oligonucleotide
gagcgagcagagagccgcttcctactcatcgattc

SEQ ID NO: 44028 - DNA, 35 bp, Artificial Sequence
  Synthetic oligonucleotide
taccaacccagaccattaacgctcagctatgtgag

SEQ ID NO: 44029 - DNA, 35 bp, Artificial Sequence
  Synthetic oligonucleotide
tcactccatcaatacgcgtaaagacgtagacgtcg

SEQ ID NO: 44030 - DNA, 35 bp, Artificial Sequence
  Synthetic oligonucleotide
gacccctagggcctgccgctttacccaatccgtcg

SEQ ID NO: 44031 - DNA, 35 bp, Artificial Sequence
  Synthetic oligonucleotide
gcaccctgcccctaagcccagctgataaaacgagg

SEQ ID NO: 44032 - DNA, 36 bp, Artificial Sequence
  Synthetic oligonucleotide
acacgcacacaccatgactatctacggcgctgtggg

SEQ ID NO: 44033 - DNA, 35 bp, Artificial Sequence
  Synthetic oligonucleotide
aatcacggcaatctactacggtccaacacatccat

SEQ ID NO: 44034 - DNA, 34 bp, Artificial Sequence
  Synthetic oligonucleotide
tcacatccccggacctgttatcacatgtattcat

SEQ ID NO: 44035 - DNA, 35 bp, Artificial Sequence
  Synthetic oligonucleotide
tcccccccacgactaaggccaaaattcgctttcat

SEQ ID NO: 44036 - DNA, 35 bp, Artificial Sequence
  Synthetic oligonucleotide
acgagctccccaatattgctatcgccgggctccct

SEQ ID NO: 44037 - DNA, 35 bp, Artificial Sequence
  Synthetic oligonucleotide
ggacagtgcaacacgcggttgtacttggttctcct

SEQ ID NO: 44038 - DNA, 35 bp, Artificial Sequence
  Synthetic oligonucleotide
tcgcacctccaccttgttctcgttaccgttgtcct

SEQ ID NO: 44039 - DNA, 35 bp, Artificial Sequence
  Synthetic oligonucleotide
tgttccgacacagtgcttcaagcttaccatcacaa

SEQ ID NO: 44040 - DNA, 36 bp, Artificial Sequence
  Synthetic oligonucleotide
gctggtgccgtctgtctcggcccattttctgttgaa

SEQ ID NO: 44041 - DNA, 36 bp, Artificial Sequence
  Synthetic oligonucleotide
gtcgccctgcatgcccgcctttacggtgccattaca

SEQ ID NO: 44042 - DNA, 35 bp, Artificial Sequence
  Synthetic oligonucleotide
tgagcaccacctgcttacaatcctcagttcgggca

SEQ ID NO: 44043 - DNA, 36 bp, Artificial Sequence
  Synthetic oligonucleotide
gtggttgctctgctcctggttcctgtcgctgtttca

SEQ ID NO: 44044 - DNA, 37 bp, Artificial Sequence
  Synthetic oligonucleotide
gtacactccccgcgcctatagcccatttgccgaacga

SEQ ID NO: 44045 - DNA, 35 bp, Artificial Sequence
  Synthetic oligonucleotide
agtgagagatcggcataaaggaatatagggaggga

SEQ ID NO: 44046 - DNA, 37 bp, Artificial Sequence
  Synthetic oligonucleotide
gttgacgggaaaaaagtaggtgggggcccggctggga

SEQ ID NO: 44047 - DNA, 37 bp, Artificial Sequence
  Synthetic oligonucleotide
ttaagcaggggggatcggcggtgaccgggggctggga

SEQ ID NO: 44048 - DNA, 35 bp, Artificial Sequence
  Synthetic oligonucleotide
tcagcccactaccgacaacccgcgctccacctgga

SEQ ID NO: 44049 - DNA, 35 bp, Artificial Sequence
  Synthetic oligonucleotide
tgctgagtgcggaaggaggggaggtggatcttgga

SEQ ID NO: 44050 - DNA, 38 bp, Artificial Sequence
  Synthetic oligonucleotide
ggtcccccctcatcactggacatttgaacgttttatga

SEQ ID NO: 44051 - DNA, 38 bp, Artificial Sequence
  Synthetic oligonucleotide
atccactcccgtgtgtccgttaagacacatttgcctga

SEQ ID NO: 44052 - DNA, 38 bp, Artificial Sequence
  Synthetic oligonucleotide
tcccgtcggggaaggctaaaaggaatggaaagaagtga

SEQ ID NO: 44053 - DNA, 38 bp, Artificial Sequence
  Synthetic oligonucleotide
tttcagcctcccgaccccgaccagttatcttgcagtga

SEQ ID NO: 44054 - DNA, 38 bp, Artificial Sequence
  Synthetic oligonucleotide
tcacccggccccccgtgaccatagggcccttcccgtga

SEQ ID NO: 44055 - DNA, 38 bp, Artificial Sequence
  Synthetic oligonucleotide
tccatcgggcgttcacgtatctacctgcatcatcttga

SEQ ID NO: 44056 - DNA, 38 bp, Artificial Sequence
  Synthetic oligonucleotide
gtgacgatcacaccttataatgtctgcctatctcttga

SEQ ID NO: 44057 - DNA, 38 bp, Artificial Sequence
  Synthetic oligonucleotide
gtgtcacagcccccacttcccgtacaaacggtctttga

SEQ ID NO: 44058 - DNA, 36 bp, Artificial Sequence
  Synthetic oligonucleotide
ttgacccactcactgccattacgagccatcagcata

SEQ ID NO: 44059 - DNA, 35 bp, Artificial Sequence
  Synthetic oligonucleotide
attctcccgccgagatcctccatatgtctggcata

SEQ ID NO: 44060 - DNA, 36 bp, Artificial Sequence
  Synthetic oligonucleotide
gcacttgcggaatacccatccgccttccacacacta

SEQ ID NO: 44061 - DNA, 35 bp, Artificial Sequence
  Synthetic oligonucleotide
aatacaccacgggcagccttgcactcagcaaccta

SEQ ID NO: 44062 - DNA, 35 bp, Artificial Sequence
  Synthetic oligonucleotide
tcgcccatgcctccttcataccacttacctgtcta

SEQ ID NO: 44063 - DNA, 36 bp, Artificial Sequence
  Synthetic oligonucleotide
atgaacaggcgataggcaagtaattgggtggtggta

SEQ ID NO: 44064 - DNA, 35 bp, Artificial Sequence
  Synthetic oligonucleotide
gaacgcctcttagccatactatgtagggaaccgac

SEQ ID NO: 44065 - DNA, 35 bp, Artificial Sequence
  Synthetic oligonucleotide
gttcccgcaaattcccattcctgagacctgtctac

SEQ ID NO: 44066 - DNA, 35 bp, Artificial Sequence
  Synthetic oligonucleotide
tgttactgcaggccttccgtcaagcctgcccttcc

SEQ ID NO: 44067 - DNA, 35 bp, Artificial Sequence
  Synthetic oligonucleotide
attccaaccggtcccattcgcatctagccaaatgc

SEQ ID NO: 44068 - DNA, 35 bp, Artificial Sequence
  Synthetic oligonucleotide
tagcacgtccatacacacctttgattgagcttatc

SEQ ID NO: 44069 - DNA, 35 bp, Artificial Sequence
  Synthetic oligonucleotide
agactacgcctggctcaattcgcgtgcgctcactc

SEQ ID NO: 44070 - DNA, 35 bp, Artificial Sequence
  Synthetic oligonucleotide
gccgggttacggccgtccactgtactcattgcctc

SEQ ID NO: 44071 - DNA, 35 bp, Artificial Sequence
  Synthetic oligonucleotide
gttggtacatccctcgcggaggccctgccttcctc

SEQ ID NO: 44072 - DNA, 35 bp, Artificial Sequence
  Synthetic oligonucleotide
atctagtgcgacatgcctggcccattgaacccttc

SEQ ID NO: 44073 - DNA, 32 bp, Artificial Sequence
  Synthetic oligonucleotide
gatgtgggtggagggcgggtgggaagaagttc

SEQ ID NO: 44074 - DNA, 35 bp, Artificial Sequence
  Synthetic oligonucleotide
agtcgccatcattgactccccctagtgcacgtttc

SEQ ID NO: 44075 - DNA, 35 bp, Artificial Sequence
  Synthetic oligonucleotide
gcccacttggtccatccacgtctccgcctttgaag

SEQ ID NO: 44076 - DNA, 35 bp, Artificial Sequence
  Synthetic oligonucleotide
aggatcgaacccgacttgtactcccccgctcctcg

SEQ ID NO: 44077 - DNA, 35 bp, Artificial Sequence
  Synthetic oligonucleotide
gacgtcaacaacgctgcttacactttcgccttagg

SEQ ID NO: 44078 - DNA, 35 bp, Artificial Sequence
  Synthetic oligonucleotide
gaccgggcacgggtgggtgacgggaagcgcacgtg

SEQ ID NO: 44079 - DNA, 35 bp, Artificial Sequence
  Synthetic oligonucleotide
agttccgcccccgctttaatcttgtggtcatacct

SEQ ID NO: 44080 - DNA, 35 bp, Artificial Sequence
  Synthetic oligonucleotide
tgtccagcagtgcacacttcttggatcccccttct

SEQ ID NO: 44081 - DNA, 35 bp, Artificial Sequence
  Synthetic oligonucleotide
acgctccactatcaccggctccctctgaagcacgt

SEQ ID NO: 44082 - DNA, 35 bp, Artificial Sequence
  Synthetic oligonucleotide
atcccggagtccatctgccacgtttttgttacggt

SEQ ID NO: 44083 - DNA, 35 bp, Artificial Sequence
  Synthetic oligonucleotide
gttcgttccgcctgatcctgcatcgaatcgttatt

SEQ ID NO: 44084 - DNA, 35 bp, Artificial Sequence
  Synthetic oligonucleotide
tcccctgctgctacgtcccgctacttcgatcggtt

SEQ ID NO: 44085 - DNA, 36 bp, Artificial Sequence
  Synthetic oligonucleotide
ggcaagggggggtggtcggaaatacgggggaagaaa

SEQ ID NO: 44086 - DNA, 35 bp, Artificial Sequence
  Synthetic oligonucleotide
agccaccacattctaagcgcttccttccgccgcaa

SEQ ID NO: 44087 - DNA, 36 bp, Artificial Sequence
  Synthetic oligonucleotide
gatgcaacaccgtaacggatcgttttactgccgcca

SEQ ID NO: 44088 - DNA, 36 bp, Artificial Sequence
  Synthetic oligonucleotide
acgaaccatctcactgtctttaatattatctgctca

SEQ ID NO: 44089 - DNA, 36 bp, Artificial Sequence
  Synthetic oligonucleotide
tcatgtgttcgccgccgccaacctacctcctttaga

SEQ ID NO: 44090 - DNA, 37 bp, Artificial Sequence
  Synthetic oligonucleotide
tccctcccacttagcttttagcacattcgttgaacga

SEQ ID NO: 44091 - DNA, 37 bp, Artificial Sequence
  Synthetic oligonucleotide
aatctgtgtcggcgccttgccctctcgtttcacccga

SEQ ID NO: 44092 - DNA, 36 bp, Artificial Sequence
  Synthetic oligonucleotide
gttgagtgatgggtgggtgggtttggtggtcgccga

SEQ ID NO: 44093 - DNA, 37 bp, Artificial Sequence
  Synthetic oligonucleotide
tcgtggtgaggtgggtgggcgccgtgggttaaaagga

SEQ ID NO: 44094 - DNA, 37 bp, Artificial Sequence
  Synthetic oligonucleotide
accccctgccatgttgactgttcacacaccattagga

SEQ ID NO: 44095 - DNA, 37 bp, Artificial Sequence
  Synthetic oligonucleotide
tctgtctcccagcacgctttcgacgtcccgtgccgga

SEQ ID NO: 44096 - DNA, 35 bp, Artificial Sequence
  Synthetic oligonucleotide
tttgcccctgcgggtggaccatcctgccttccgga

SEQ ID NO: 44097 - DNA, 38 bp, Artificial Sequence
  Synthetic oligonucleotide
tcacgccggtcgtccagactctctcaacacgtgcctga

SEQ ID NO: 44098 - DNA, 38 bp, Artificial Sequence
  Synthetic oligonucleotide
ggactggcacggcgggtcataaaaggggaaattgctga

SEQ ID NO: 44099 - DNA, 38 bp, Artificial Sequence
  Synthetic oligonucleotide
gcccaacgaaatctctgcaatccagcactcccttctga

SEQ ID NO: 44100 - DNA, 37 bp, Artificial Sequence
  Synthetic oligonucleotide
tttcgcaccccatctatatcgcttttctgacacgtga

SEQ ID NO: 44101 - DNA, 38 bp, Artificial Sequence
  Synthetic oligonucleotide
gcgcctgggcgcactttctccagacctactcaccttga

SEQ ID NO: 44102 - DNA, 38 bp, Artificial Sequence
  Synthetic oligonucleotide
tgatagccgcattttctgtcatcccccgtcatcgttga

SEQ ID NO: 44103 - DNA, 38 bp, Artificial Sequence
  Synthetic oligonucleotide
accaccgctaggagtacgcatgcacctcctccatttga

SEQ ID NO: 44104 - DNA, 36 bp, Artificial Sequence
  Synthetic oligonucleotide
gacaccggctctaccactacgcacatcggacaacta

SEQ ID NO: 44105 - DNA, 35 bp, Artificial Sequence
  Synthetic oligonucleotide
cactagacaccctgccagactttttatgccaccta

SEQ ID NO: 44106 - DNA, 35 bp, Artificial Sequence
  Synthetic oligonucleotide
gcacaccactaccaactgccttcaaggtatcatta

SEQ ID NO: 44107 - DNA, 36 bp, Artificial Sequence
  Synthetic oligonucleotide
ggacctgtcctgaccgtctttctcctctagcactta

SEQ ID NO: 44108 - DNA, 36 bp, Artificial Sequence
  Synthetic oligonucleotide
acttacctgacctccgcgcttttgagtttgcttcac

SEQ ID NO: 44109 - DNA, 35 bp, Artificial Sequence
  Synthetic oligonucleotide
gatggcaccccgggcctatggtcggtttcccctac

SEQ ID NO: 44110 - DNA, 35 bp, Artificial Sequence
  Synthetic oligonucleotide
tccctgtcctgcgcgcctaatccaacagccgttac

SEQ ID NO: 44111 - DNA, 35 bp, Artificial Sequence
  Synthetic oligonucleotide
atgctcagcgactttggctgctagttcgtcacacc

SEQ ID NO: 44112 - DNA, 35 bp, Artificial Sequence
  Synthetic oligonucleotide
gttatgtgcatcgattgcacgcctctatctctgcc

SEQ ID NO: 44113 - DNA, 35 bp, Artificial Sequence
  Synthetic oligonucleotide
actcaccgcgtttagcaccagcaccgccatttagc

SEQ ID NO: 44114 - DNA, 35 bp, Artificial Sequence
  Synthetic oligonucleotide
gagatcctacccccgtgccccacccattgtaatgc

SEQ ID NO: 44115 - DNA, 35 bp, Artificial Sequence
  Synthetic oligonucleotide
tagatgccgcccgcctatactccctgagtcgctgc

SEQ ID NO: 44116 - DNA, 35 bp, Artificial Sequence
  Synthetic oligonucleotide
tgcaagccactggcgcagctacaaccaactttatc

SEQ ID NO: 44117 - DNA, 35 bp, Artificial Sequence
  Synthetic oligonucleotide
gcccttcgggtgtcatcccgccgccaacctttgtc

SEQ ID NO: 44118 - DNA, 35 bp, Artificial Sequence
  Synthetic oligonucleotide
gcaacgtgaccttcgcttcactggccgccccactg

SEQ ID NO: 44119 - DNA, 35 bp, Artificial Sequence
  Synthetic oligonucleotide
agtccactcccactgcctctctggtcgcaaccctg

SEQ ID NO: 44120 - DNA, 35 bp, Artificial Sequence
  Synthetic oligonucleotide
ttgcccgccaggtctcttttccaattgaatccctg

SEQ ID NO: 44121 - DNA, 35 bp, Artificial Sequence
  Synthetic oligonucleotide
gtggagttgaaagtagggggagtacgtgaacattg

SEQ ID NO: 44122 - DNA, 35 bp, Artificial Sequence
  Synthetic oligonucleotide
tagacccacacatcttacgacgaccgtccgtacct

SEQ ID NO: 44123 - DNA, 35 bp, Artificial Sequence
  Synthetic oligonucleotide
acccattccccggcacattttcacgaccaacgggt

SEQ ID NO: 44124 - DNA, 35 bp, Artificial Sequence
  Synthetic oligonucleotide
tcgatatccggcaagtttcattggcactacctctt

SEQ ID NO: 44125 - DNA, 36 bp, Artificial Sequence
  Synthetic oligonucleotide
gagcacatttgtcatctctgttaccatgcctcttaa

SEQ ID NO: 44126 - DNA, 35 bp, Artificial Sequence
  Synthetic oligonucleotide
aattgccctcaccttatgagttttccacattcaca

SEQ ID NO: 44127 - DNA, 36 bp, Artificial Sequence
  Synthetic oligonucleotide
ttcgctccccactcccttcaccggcctgatatcgca

SEQ ID NO: 44128 - DNA, 35 bp, Artificial Sequence
  Synthetic oligonucleotide
gagtctctagccaccctgtcttctatccagtatca

SEQ ID NO: 44129 - DNA, 36 bp, Artificial Sequence
  Synthetic oligonucleotide
gacaggtatccgttaccccttttttgtctgttgtca

SEQ ID NO: 44130 - DNA, 35 bp, Artificial Sequence
  Synthetic oligonucleotide
tgaatgacggttataataggggggaggtcgacaga

SEQ ID NO: 44131 - DNA, 36 bp, Artificial Sequence
  Synthetic oligonucleotide
atttcccgcccccgaacattgcgatcgccctataga

SEQ ID NO: 44132 - DNA, 35 bp, Artificial Sequence
  Synthetic oligonucleotide
tccccttcgtagcccgtcctgttactccttctaga

SEQ ID NO: 44133 - DNA, 37 bp, Artificial Sequence
  Synthetic oligonucleotide
gaagggaagagggggataaagagaagtgacgtgacga

SEQ ID NO: 44134 - DNA, 37 bp, Artificial Sequence
  Synthetic oligonucleotide
gttgccaccatcaatagttctatcggtttcatgccga

SEQ ID NO: 44135 - DNA, 36 bp, Artificial Sequence
  Synthetic oligonucleotide
gaggggcgagggaagctggggggccatggaagagga

SEQ ID NO: 44136 - DNA, 37 bp, Artificial Sequence
  Synthetic oligonucleotide
tcacgtccgcacctcatgattttccgttcattacgga

SEQ ID NO: 44137 - DNA, 38 bp, Artificial Sequence
  Synthetic oligonucleotide
gctgtcaccgacgcctctggacattgctacccacctga

SEQ ID NO: 44138 - DNA, 38 bp, Artificial Sequence
  Synthetic oligonucleotide
gacctgcctcttaccaccgagttgatgacacccgctga

SEQ ID NO: 44139 - DNA, 35 bp, Artificial Sequence
  Synthetic oligonucleotide
taccccccggcctccatgaattgcttttccgctga

SEQ ID NO: 44140 - DNA, 38 bp, Artificial Sequence
  Synthetic oligonucleotide
gtggtgggagggtattggtgggtggataataaatctga

SEQ ID NO: 44141 - DNA, 38 bp, Artificial Sequence
  Synthetic oligonucleotide
aagaagggaggatagggcgggggtaggctggggagtga

SEQ ID NO: 44142 - DNA, 38 bp, Artificial Sequence
  Synthetic oligonucleotide
acaccccaatggatccctaagtcatcactcttgggtga

SEQ ID NO: 44143 - DNA, 38 bp, Artificial Sequence
  Synthetic oligonucleotide
tcaaagagtgggaatgggtgggggatcgaccggattga

SEQ ID NO: 44144 - DNA, 37 bp, Artificial Sequence
  Synthetic oligonucleotide
gggggcagaagaggatgagggttcggggaagggttga

SEQ ID NO: 44145 - DNA, 38 bp, Artificial Sequence
  Synthetic oligonucleotide
acatcctgcccagagcccaatggcctcttatattttga

SEQ ID NO: 44146 - DNA, 35 bp, Artificial Sequence
  Synthetic oligonucleotide
tctccgaccaatcccaccactatgactacggccta

SEQ ID NO: 44147 - DNA, 35 bp, Artificial Sequence
  Synthetic oligonucleotide
aaccaccggactcactttaggtgtcaaacctccta

SEQ ID NO: 44148 - DNA, 36 bp, Artificial Sequence
  Synthetic oligonucleotide
gctgccactccgcgccgttcttagaaccttatgcta

SEQ ID NO: 44149 - DNA, 36 bp, Artificial Sequence
  Synthetic oligonucleotide
tgagtgcctggccaactctccttatatgacgctcta

SEQ ID NO: 44150 - DNA, 35 bp, Artificial Sequence
  Synthetic oligonucleotide
tgtcttaccatcctgcctatcatgtagcaattcta

SEQ ID NO: 44151 - DNA, 35 bp, Artificial Sequence
  Synthetic oligonucleotide
gccatgctcatggaacgtcccgcctaacacgatac

SEQ ID NO: 44152 - DNA, 35 bp, Artificial Sequence
  Synthetic oligonucleotide
tgatccatggtatgtctcgttacggttccaaaccc

SEQ ID NO: 44153 - DNA, 35 bp, Artificial Sequence
  Synthetic oligonucleotide
gccctaacgctatcccttacttacgacggctaccc

SEQ ID NO: 44154 - DNA, 35 bp, Artificial Sequence
  Synthetic oligonucleotide
actcccgcggacttgcctcgctcggcatttgcccc

SEQ ID NO: 44155 - DNA, 35 bp, Artificial Sequence
  Synthetic oligonucleotide
attgcgagacgtccttttatgcctcaatcgttccc

SEQ ID NO: 44156 - DNA, 35 bp, Artificial Sequence
  Synthetic oligonucleotide
gtacccgcacgagttctctgttaaatcgcgattcc

SEQ ID NO: 44157 - DNA, 35 bp, Artificial Sequence
  Synthetic oligonucleotide
gtacaccgctgacatgcctaggcactctgaaacgc

SEQ ID NO: 44158 - DNA, 35 bp, Artificial Sequence
  Synthetic oligonucleotide
tactccacccgccgcaaataataattttctgccgc

SEQ ID NO: 44159 - DNA, 35 bp, Artificial Sequence
  Synthetic oligonucleotide
taccctcgaccactattgaatatcatttccgctgc

SEQ ID NO: 44160 - DNA, 35 bp, Artificial Sequence
  Synthetic oligonucleotide
aatcgcactcaatttctccctaggaccatcaatag

SEQ ID NO: 44161 - DNA, 35 bp, Artificial Sequence
  Synthetic oligonucleotide
gaaccgatagtcttcatcacgccacacttccctcg

SEQ ID NO: 44162 - DNA, 35 bp, Artificial Sequence
  Synthetic oligonucleotide
gaaaaacgggtagggagcaaacggataaagtaggg

SEQ ID NO: 44163 - DNA, 35 bp, Artificial Sequence
  Synthetic oligonucleotide
gagacaacggatcaggcggaggtgttgagtggtgg

SEQ ID NO: 44164 - DNA, 35 bp, Artificial Sequence
  Synthetic oligonucleotide
tatcccacacattttccccgccagtgtaatccctg

SEQ ID NO: 44165 - DNA, 35 bp, Artificial Sequence
  Synthetic oligonucleotide
gcaactactagggtgggcttttatgatggtgggtg

SEQ ID NO: 44166 - DNA, 35 bp, Artificial Sequence
  Synthetic oligonucleotide
tcttccatctcaggtctccacactccccttctttg

SEQ ID NO: 44167 - DNA, 35 bp, Artificial Sequence
  Synthetic oligonucleotide
ttgccgttcctgcttcaacaacgtagactcgctat

SEQ ID NO: 44168 - DNA, 35 bp, Artificial Sequence
  Synthetic oligonucleotide
aatccccgaggtaccgacggaggttccatcacact

SEQ ID NO: 44169 - DNA, 34 bp, Artificial Sequence
  Synthetic oligonucleotide
gcataatgcgcacgccaattgccttgatgcacct

SEQ ID NO: 44170 - DNA, 35 bp, Artificial Sequence
  Synthetic oligonucleotide
gttccaacaccccttcgatcgtaagataacctgct

SEQ ID NO: 44171 - DNA, 35 bp, Artificial Sequence
  Synthetic oligonucleotide
acacgccaatttcgtgccagtacaatccccacggt

SEQ ID NO: 44172 - DNA, 35 bp, Artificial Sequence
  Synthetic oligonucleotide
gtgcgatgcgccggcgcccactttgttcacctatt

SEQ ID NO: 44173 - DNA, 35 bp, Artificial Sequence
  Synthetic oligonucleotide
gagaagagccacgcaacactatctgccacacattt

SEQ ID NO: 44174 - DNA, 35 bp, Artificial Sequence
  Synthetic oligonucleotide
acctgcacagccagcagaccgaaaccctgctcaaa

SEQ ID NO: 44175 - DNA, 36 bp, Artificial Sequence
  Synthetic oligonucleotide
tcaacgcagacgacggccgctcccggtgcactccaa

SEQ ID NO: 44176 - DNA, 35 bp, Artificial Sequence
  Synthetic oligonucleotide
tgccctgtacctggtagttcaatacacctgctcaa

SEQ ID NO: 44177 - DNA, 36 bp, Artificial Sequence
  Synthetic oligonucleotide
gccgacagggtggtttctagggcctggggtggtgaa

SEQ ID NO: 44178 - DNA, 36 bp, Artificial Sequence
  Synthetic oligonucleotide
gtggggcctaggtcgcccgaatttctgacactatca

SEQ ID NO: 44179 - DNA, 37 bp, Artificial Sequence
  Synthetic oligonucleotide
gagggtagtggggcggtgagtaggggcaaagtctgga

SEQ ID NO: 44180 - DNA, 38 bp, Artificial Sequence
  Synthetic oligonucleotide
tccaccactttcttcgtattaccacaggccggcactga

SEQ ID NO: 44181 - DNA, 38 bp, Artificial Sequence
  Synthetic oligonucleotide
agcgcccgacgaaggggtgggatggatccgggcactga

SEQ ID NO: 44182 - DNA, 38 bp, Artificial Sequence
  Synthetic oligonucleotide
aattgcgcaccgtcaagcccgttactactctcacctga

SEQ ID NO: 44183 - DNA, 38 bp, Artificial Sequence
  Synthetic oligonucleotide
acgcccccccaatttcgtgccccccctggtttgcctga

SEQ ID NO: 44184 - DNA, 38 bp, Artificial Sequence
  Synthetic oligonucleotide
gatgggggtggaatcgaaaggccggaaggactgagtga

SEQ ID NO: 44185 - DNA, 38 bp, Artificial Sequence
  Synthetic oligonucleotide
gacgcgacgctttttgctatcctccttacctgtcgtga

SEQ ID NO: 44186 - DNA, 38 bp, Artificial Sequence
  Synthetic oligonucleotide
gaccacatactgtatgctatttgccctcccggaggtga

SEQ ID NO: 44187 - DNA, 38 bp, Artificial Sequence
  Synthetic oligonucleotide
gagagggcatgaaggaagaagggctggttacctattga

SEQ ID NO: 44188 - DNA, 36 bp, Artificial Sequence
  Synthetic oligonucleotide
gacgaaccacaccatcagcattaacactttctgata

SEQ ID NO: 44189 - DNA, 36 bp, Artificial Sequence
  Synthetic oligonucleotide
aaggggggaggggaggtgtggatgagcggatacgta

SEQ ID NO: 44190 - DNA, 35 bp, Artificial Sequence
  Synthetic oligonucleotide
gacttacccagcccgttcctctcacatcgtggtta

SEQ ID NO: 44191 - DNA, 35 bp, Artificial Sequence
  Synthetic oligonucleotide
gccctcctagcccccggttgagaccccctctttta

SEQ ID NO: 44192 - DNA, 35 bp, Artificial Sequence
  Synthetic oligonucleotide
gcccctctctgatacgaccgacccagaagtctaac

SEQ ID NO: 44193 - DNA, 35 bp, Artificial Sequence
  Synthetic oligonucleotide
atctggcacaagtcacctgcgcttccaagtcacac

SEQ ID NO: 44194 - DNA, 34 bp, Artificial Sequence
  Synthetic oligonucleotide
ttacgacctactccccatgctaagcaacgggccc

SEQ ID NO: 44195 - DNA, 35 bp, Artificial Sequence
  Synthetic oligonucleotide
gcatacaccgcaaatggtttgccctttctttgtcc

SEQ ID NO: 44196 - DNA, 35 bp, Artificial Sequence
  Synthetic oligonucleotide
tgacgcccctgtgccatccagttccggcttgttcc

SEQ ID NO: 44197 - DNA, 35 bp, Artificial Sequence
  Synthetic oligonucleotide
ttccctgctgccgtgaaatttttcccacctctcgc

SEQ ID NO: 44198 - DNA, 35 bp, Artificial Sequence
  Synthetic oligonucleotide
atagaccccgcctaagccccgccgccttttgactc

SEQ ID NO: 44199 - DNA, 35 bp, Artificial Sequence
  Synthetic oligonucleotide
agcaacactactggttcttctcagacccttcctgg

SEQ ID NO: 44200 - DNA, 35 bp, Artificial Sequence
  Synthetic oligonucleotide
tccgccccgccccatttccactaggcagccaagct

SEQ ID NO: 44201 - DNA, 35 bp, Artificial Sequence
  Synthetic oligonucleotide
aacgtgcgaagtgtggctctcttgtgttccatctt

SEQ ID NO: 44202 - DNA, 35 bp, Artificial Sequence
  Synthetic oligonucleotide
agtccggcctcctcaaagtttcaaccctgcacttt

SEQ ID NO: 44203 - DNA, 36 bp, Artificial Sequence
  Synthetic oligonucleotide
gctcactgaacctcgggtgtgagtccctcttgccca

SEQ ID NO: 44204 - DNA, 36 bp, Artificial Sequence
  Synthetic oligonucleotide
acacagcagggcgtacccggtcaacctcccctgcca

SEQ ID NO: 44205 - DNA, 35 bp, Artificial Sequence
  Synthetic oligonucleotide
ttgaacagcttgcctcctatcatattgtcattcca

SEQ ID NO: 44206 - DNA, 36 bp, Artificial Sequence
  Synthetic oligonucleotide
gggtgcacccgtcctggtcaatgcgcttgtctctca

SEQ ID NO: 44207 - DNA, 36 bp, Artificial Sequence
  Synthetic oligonucleotide
gcccgctggaggcctttctttcgttacttgtattca

SEQ ID NO: 44208 - DNA, 36 bp, Artificial Sequence
  Synthetic oligonucleotide
tacgccggcatcactaccggtcttcgtacactttca

SEQ ID NO: 44209 - DNA, 37 bp, Artificial Sequence
  Synthetic oligonucleotide
gaggggagtaccgggggagggtgtaaacgggttgaga

SEQ ID NO: 44210 - DNA, 37 bp, Artificial Sequence
  Synthetic oligonucleotide
actccctccgaccgagtccattgcctacaacacacga

SEQ ID NO: 44211 - DNA, 36 bp, Artificial Sequence
  Synthetic oligonucleotide
tcgatgccacctcgacccccaccttaagattcacga

SEQ ID NO: 44212 - DNA, 36 bp, Artificial Sequence
  Synthetic oligonucleotide
gtaagcacgtctgccctcctcctaccttcgctacga

SEQ ID NO: 44213 - DNA, 36 bp, Artificial Sequence
  Synthetic oligonucleotide
cagtaggggcgcctcactgcctcttggcccaaccga

SEQ ID NO: 44214 - DNA, 37 bp, Artificial Sequence
  Synthetic oligonucleotide
ttcagtcccacgccctgcagcccccctatgccaccga

SEQ ID NO: 44215 - DNA, 37 bp, Artificial Sequence
  Synthetic oligonucleotide
tcgatgacagattgacgtggccctcccctgttcccga

SEQ ID NO: 44216 - DNA, 37 bp, Artificial Sequence
  Synthetic oligonucleotide
attgccctgcacttgccaattaaagtcactttgccga

SEQ ID NO: 44217 - DNA, 37 bp, Artificial Sequence
  Synthetic oligonucleotide
gccagtcactttggttcaatgaccacacctcttgcga

SEQ ID NO: 44218 - DNA, 34 bp, Artificial Sequence
  Synthetic oligonucleotide
gctgaaccccgccaccgcgtgccttcttcaagga

SEQ ID NO: 44219 - DNA, 37 bp, Artificial Sequence
  Synthetic oligonucleotide
aattgacaagcctcagacacctccgcaccaactggga

SEQ ID NO: 44220 - DNA, 37 bp, Artificial Sequence
  Synthetic oligonucleotide
gcggaagccctatcggtccccacacacacgcacctga

SEQ ID NO: 44221 - DNA, 38 bp, Artificial Sequence
  Synthetic oligonucleotide
gatgcggtagcaacacggggtgaaggtagcctttgtga

SEQ ID NO: 44222 - DNA, 38 bp, Artificial Sequence
  Synthetic oligonucleotide
tcccgccctccatattcggccgaaagagcctccattga

SEQ ID NO: 44223 - DNA, 37 bp, Artificial Sequence
  Synthetic oligonucleotide
gttcccccatcggcgttcatcaacatcgctatcttga

SEQ ID NO: 44224 - DNA, 36 bp, Artificial Sequence
  Synthetic oligonucleotide
gcacacactcaatgagccattttgctcagcacacta

SEQ ID NO: 44225 - DNA, 37 bp, Artificial Sequence
  Synthetic oligonucleotide
attccccccattcgcgttagcgactcgtttgacccta

SEQ ID NO: 44226 - DNA, 35 bp, Artificial Sequence
  Synthetic oligonucleotide
agcccgcccctcagaatgaactggtcgccccatta

SEQ ID NO: 44227 - DNA, 35 bp, Artificial Sequence
  Synthetic oligonucleotide
acatccctgagctgatctgaccgcgcaagcgcaac

SEQ ID NO: 44228 - DNA, 35 bp, Artificial Sequence
  Synthetic oligonucleotide
ttcttcgcccaacacacggattctgagcgtgtaac

SEQ ID NO: 44229 - DNA, 35 bp, Artificial Sequence
  Synthetic oligonucleotide
aacccacaaccttatgtgccttgtcagacgcacac

SEQ ID NO: 44230 - DNA, 35 bp, Artificial Sequence
  Synthetic oligonucleotide
tacatcgccacagcattctaggcgagccgccaacc

SEQ ID NO: 44231 - DNA, 35 bp, Artificial Sequence
  Synthetic oligonucleotide
tctagacgccccaccgccgcgttgcatagatctcc

SEQ ID NO: 44232 - DNA, 35 bp, Artificial Sequence
  Synthetic oligonucleotide
accgatgaacccagtcgccatattaatcccatcgc

SEQ ID NO: 44233 - DNA, 33 bp, Artificial Sequence
  Synthetic oligonucleotide
ggccatcaccaaacgcccaatctgtccccttgc

SEQ ID NO: 44234 - DNA, 35 bp, Artificial Sequence
  Synthetic oligonucleotide
acctaacttcaccctcgatacggtcacttcgagtc

SEQ ID NO: 44235 - DNA, 35 bp, Artificial Sequence
  Synthetic oligonucleotide
tcaaaacgaaggggaactaaaagggtaaacgagcg

SEQ ID NO: 44236 - DNA, 35 bp, Artificial Sequence
  Synthetic oligonucleotide
aatagccagtgcagtcgcccccccatgtagcctgg

SEQ ID NO: 44237 - DNA, 35 bp, Artificial Sequence
  Synthetic oligonucleotide
gccatcccttctctcccacatcggtgacatacatg

SEQ ID NO: 44238 - DNA, 35 bp, Artificial Sequence
  Synthetic oligonucleotide
aattgaccctcccatgcacgtggacatcgtgttct

SEQ ID NO: 44239 - DNA, 35 bp, Artificial Sequence
  Synthetic oligonucleotide
ggagaacccacggagtgttagatcatttgttcttt

SEQ ID NO: 44240 - DNA, 36 bp, Artificial Sequence
  Synthetic oligonucleotide
gagccaaccgaggttgccgcatacattactagccaa

SEQ ID NO: 44241 - DNA, 36 bp, Artificial Sequence
  Synthetic oligonucleotide
aatgcccaggtggttaagggaggcataagggtccaa

SEQ ID NO: 44242 - DNA, 35 bp, Artificial Sequence
  Synthetic oligonucleotide
tagacccagcacggacttttttttggcgttttgaa

SEQ ID NO: 44243 - DNA, 36 bp, Artificial Sequence
  Synthetic oligonucleotide
tctcggacctgccgagccaacctgacatcattgaca

SEQ ID NO: 44244 - DNA, 36 bp, Artificial Sequence
  Synthetic oligonucleotide
tacgccccctctttcgttgctcaagctgatcttaca

SEQ ID NO: 44245 - DNA, 35 bp, Artificial Sequence
  Synthetic oligonucleotide
tgcgtaaaccccgcttagttctggctcccctacca

SEQ ID NO: 44246 - DNA, 36 bp, Artificial Sequence
  Synthetic oligonucleotide
tcccatccgtctccgatcatcactgtttcaggtgca

SEQ ID NO: 44247 - DNA, 36 bp, Artificial Sequence
  Synthetic oligonucleotide
tttgtcgcctcaggaacttggcccaatccgctctca

SEQ ID NO: 44248 - DNA, 36 bp, Artificial Sequence
  Synthetic oligonucleotide
gtctcccgcccccggcacattttaactgcaatttca

SEQ ID NO: 44249 - DNA, 37 bp, Artificial Sequence
  Synthetic oligonucleotide
tattggagggtgggtggggtaaagtgggcggtgcaga

SEQ ID NO: 44250 - DNA, 37 bp, Artificial Sequence
  Synthetic oligonucleotide
gaaggataccggggagggcaaggggaacgcgaaacga

SEQ ID NO: 44251 - DNA, 37 bp, Artificial Sequence
  Synthetic oligonucleotide
ttgcaccataagcttccgctgaacattcctacaccga

SEQ ID NO: 44252 - DNA, 36 bp, Artificial Sequence
  Synthetic oligonucleotide
cctggcccgaatcgtactctcgccctgcgctaccga

SEQ ID NO: 44253 - DNA, 37 bp, Artificial Sequence
  Synthetic oligonucleotide
tactcacacagtagtttaacaacaacacacacgccga

SEQ ID NO: 44254 - DNA, 37 bp, Artificial Sequence
  Synthetic oligonucleotide
aaacatggtggtgggggagcgagcacagttgacagga

SEQ ID NO: 44255 - DNA, 37 bp, Artificial Sequence
  Synthetic oligonucleotide
gggtgagacctggggtgggagtcggcgtgtaggggga

SEQ ID NO: 44256 - DNA, 37 bp, Artificial Sequence
  Synthetic oligonucleotide
tggagagacatcgggggaagcgggtctggtagtggga

SEQ ID NO: 44257 - DNA, 37 bp, Artificial Sequence
  Synthetic oligonucleotide
aacgagtgcagggggacggcttagggtagcggatgga

SEQ ID NO: 44258 - DNA, 38 bp, Artificial Sequence
  Synthetic oligonucleotide
gacgtcactggtgggcatggaggagggctggcgaatga

SEQ ID NO: 44259 - DNA, 38 bp, Artificial Sequence
  Synthetic oligonucleotide
gaccgagatagagggagatagtgaagcgcggatgatga

SEQ ID NO: 44260 - DNA, 38 bp, Artificial Sequence
  Synthetic oligonucleotide
aagtggagtgcaggaggtcgggcaacgagagagactga

SEQ ID NO: 44261 - DNA, 37 bp, Artificial Sequence
  Synthetic oligonucleotide
gcctgatcgggcgcccccactttgctgaacatcgtga

SEQ ID NO: 44262 - DNA, 38 bp, Artificial Sequence
  Synthetic oligonucleotide
acaagtcagagtgaccgcataccaccactccccattga

SEQ ID NO: 44263 - DNA, 37 bp, Artificial Sequence
  Synthetic oligonucleotide
aaagccgcctcctctgcccgacatgctttgttcttga

SEQ ID NO: 44264 - DNA, 36 bp, Artificial Sequence
  Synthetic oligonucleotide
gccagtcaatcctgctatttatgccactcaaccata

SEQ ID NO: 44265 - DNA, 35 bp, Artificial Sequence
  Synthetic oligonucleotide
tcaaaccgagggcaattattagcgcaacaccgtcc

SEQ ID NO: 44266 - DNA, 35 bp, Artificial Sequence
  Synthetic oligonucleotide
caatgccccccggctctctcccctaataacgtggc

SEQ ID NO: 44267 - DNA, 35 bp, Artificial Sequence
  Synthetic oligonucleotide
tcgattcgcacgaacatttcaccgccatcctttgc

SEQ ID NO: 44268 - DNA, 35 bp, Artificial Sequence
  Synthetic oligonucleotide
tccttcgggcccactctctatcgtgaaagtccctc

SEQ ID NO: 44269 - DNA, 35 bp, Artificial Sequence
  Synthetic oligonucleotide
tcaaccacactattggactcagaccgcccagcttc

SEQ ID NO: 44270 - DNA, 35 bp, Artificial Sequence
  Synthetic oligonucleotide
gagggaagagtatgggccggtggaactataggaag

SEQ ID NO: 44271 - DNA, 35 bp, Artificial Sequence
  Synthetic oligonucleotide
atcgtgtggtaggacggtatgggtagtaatggaag

SEQ ID NO: 44272 - DNA, 35 bp, Artificial Sequence
  Synthetic oligonucleotide
cacgtaccaccgcgggcgccactgatcacttcacg

SEQ ID NO: 44273 - DNA, 35 bp, Artificial Sequence
  Synthetic oligonucleotide
gtggtggaagggcgatcagcgagaggaaattgggg

SEQ ID NO: 44274 - DNA, 35 bp, Artificial Sequence
  Synthetic oligonucleotide
agagggaagagacgtgggtggcggtgtgaggttgg

SEQ ID NO: 44275 - DNA, 35 bp, Artificial Sequence
  Synthetic oligonucleotide
aatcggtacgttacccgccccaaggtcctccacat

SEQ ID NO: 44276 - DNA, 35 bp, Artificial Sequence
  Synthetic oligonucleotide
cgccattcgctgccgaaccgcgcacttatcgctat

SEQ ID NO: 44277 - DNA, 35 bp, Artificial Sequence
  Synthetic oligonucleotide
gaaacgccctgcgcgaagtactgcgatatccccct

SEQ ID NO: 44278 - DNA, 35 bp, Artificial Sequence
  Synthetic oligonucleotide
acccctccagtctcgctgacttagtctggtttcct

SEQ ID NO: 44279 - DNA, 35 bp, Artificial Sequence
  Synthetic oligonucleotide
acatcaccatcttgaatttatactgcggagtacgt

SEQ ID NO: 44280 - DNA, 35 bp, Artificial Sequence
  Synthetic oligonucleotide
gataccagcccagcacattgaatacccaaatcggt

SEQ ID NO: 44281 - DNA, 35 bp, Artificial Sequence
  Synthetic oligonucleotide
tagtccccgcatctagacccgttaacctgatgatt

SEQ ID NO: 44282 - DNA, 35 bp, Artificial Sequence
  Synthetic oligonucleotide
aatcgaaacgcctgactttgtcactttttacactt

SEQ ID NO: 44283 - DNA, 35 bp, Artificial Sequence
  Synthetic oligonucleotide
tgccaaggcgacatgacctttctacttttcctgtt

SEQ ID NO: 44284 - DNA, 35 bp, Artificial Sequence
  Synthetic oligonucleotide
agcactggcccacaccctatttcgtccctgctttt

SEQ ID NO: 44285 - DNA, 35 bp, Artificial Sequence
  Synthetic oligonucleotide
gcattccacagggttggtgtcgctgctcctctttt

SEQ ID NO: 44286 - DNA, 35 bp, Artificial Sequence
  Synthetic oligonucleotide
tcagacgcaagcacggcgctacacacaggagccaa

SEQ ID NO: 44287 - DNA, 35 bp, Artificial Sequence
  Synthetic oligonucleotide
ggacagtaccacctgcagaaatctcatcacacgaa

SEQ ID NO: 44288 - DNA, 36 bp, Artificial Sequence
  Synthetic oligonucleotide
acatacagcgttcggcgaggtaccatccccaattaa

SEQ ID NO: 44289 - DNA, 35 bp, Artificial Sequence
  Synthetic oligonucleotide
gcattcgcctgggggaactacaacaccaattgcca

SEQ ID NO: 44290 - DNA, 36 bp, Artificial Sequence
  Synthetic oligonucleotide
gatgcaaccgggacaaaggtgcatggagcacgagca

SEQ ID NO: 44291 - DNA, 37 bp, Artificial Sequence
  Synthetic oligonucleotide
tatcattaccacctgttcgcgccatccggtgacacga

SEQ ID NO: 44292 - DNA, 37 bp, Artificial Sequence
  Synthetic oligonucleotide
actacatcgcctgccttgaccacccggagcataccga

SEQ ID NO: 44293 - DNA, 37 bp, Artificial Sequence
  Synthetic oligonucleotide
gccgttcctgcctcttcgaatcactcggtgcacccga

SEQ ID NO: 44294 - DNA, 36 bp, Artificial Sequence
  Synthetic oligonucleotide
acgcacgggcgcacatcggctatctcggtttcccga

SEQ ID NO: 44295 - DNA, 37 bp, Artificial Sequence
  Synthetic oligonucleotide
ggtgtcgtgtaaggggtgggtgcggatgggagggcga

SEQ ID NO: 44296 - DNA, 37 bp, Artificial Sequence
  Synthetic oligonucleotide
tttacgccgcccctatacctgaacgatgatcgttcga

SEQ ID NO: 44297 - DNA, 37 bp, Artificial Sequence
  Synthetic oligonucleotide
acctcatctgcttgtcccttctcatccgtctgcagga

SEQ ID NO: 44298 - DNA, 36 bp, Artificial Sequence
  Synthetic oligonucleotide
gctcaccccgccctagttgctttgttggacttcgga

SEQ ID NO: 44299 - DNA, 37 bp, Artificial Sequence
  Synthetic oligonucleotide
gattcgtcaggtggataggggaagtggtggtggtgga

SEQ ID NO: 44300 - DNA, 37 bp, Artificial Sequence
  Synthetic oligonucleotide
gatgacatcagttaggtggaagcggggggatagatga

SEQ ID NO: 44301 - DNA, 38 bp, Artificial Sequence
  Synthetic oligonucleotide
agtgaggggaaggatatcggaaaaagcggcgctgatga

SEQ ID NO: 44302 - DNA, 38 bp, Artificial Sequence
  Synthetic oligonucleotide
gagtggaaggagcggagggagctgacattgaatcgtga

SEQ ID NO: 44303 - DNA, 38 bp, Artificial Sequence
  Synthetic oligonucleotide
gtagtcgggccggcggggagaggacagggtgggggtga

SEQ ID NO: 44304 - DNA, 38 bp, Artificial Sequence
  Synthetic oligonucleotide
tcatgtcagtgattatctctcactctcgccacctgtga

SEQ ID NO: 44305 - DNA, 37 bp, Artificial Sequence
  Synthetic oligonucleotide
gtgcccttctggctactattaatcactgtacacttga

SEQ ID NO: 44306 - DNA, 38 bp, Artificial Sequence
  Synthetic oligonucleotide
atgctccctaggtgagaaccgaaccgtccccattttga

SEQ ID NO: 44307 - DNA, 36 bp, Artificial Sequence
  Synthetic oligonucleotide
tggagccgcaccattcgtgtccttactctctatata

SEQ ID NO: 44308 - DNA, 35 bp, Artificial Sequence
  Synthetic oligonucleotide
tcccatcctccctgactcccttgattatggcgcta

SEQ ID NO: 44309 - DNA, 36 bp, Artificial Sequence
  Synthetic oligonucleotide
gttggggaagaacgggagagacaatgatgccaggta

SEQ ID NO: 44310 - DNA, 36 bp, Artificial Sequence
  Synthetic oligonucleotide
ggatgtgacgggtgaaaatcttgggttggggctgta

SEQ ID NO: 44311 - DNA, 35 bp, Artificial Sequence
  Synthetic oligonucleotide
atccgtccggtagccgttttgctagttacgcacac

SEQ ID NO: 44312 - DNA, 35 bp, Artificial Sequence
  Synthetic oligonucleotide
tagccctcatgactgcacctggtaggaacatccac

SEQ ID NO: 44313 - DNA, 35 bp, Artificial Sequence
  Synthetic oligonucleotide
ggtgatccaactcgcgccttcatctgttccacccc

SEQ ID NO: 44314 - DNA, 35 bp, Artificial Sequence
  Synthetic oligonucleotide
aactgcgaaagcagacgttgatgagccatctcccc

SEQ ID NO: 44315 - DNA, 35 bp, Artificial Sequence
  Synthetic oligonucleotide
actgagctcagggcaaaggcaaagggtggtgaagc

SEQ ID NO: 44316 - DNA, 35 bp, Artificial Sequence
  Synthetic oligonucleotide
ttacgagcactcccacttcgctgccacctattcgc

SEQ ID NO: 44317 - DNA, 35 bp, Artificial Sequence
  Synthetic oligonucleotide
gaccggccccttcccgaatagagtttgtcgcgctc

SEQ ID NO: 44318 - DNA, 35 bp, Artificial Sequence
  Synthetic oligonucleotide
tagactgtcgcaggcatccggtccccgccaccttc

SEQ ID NO: 44319 - DNA, 35 bp, Artificial Sequence
  Synthetic oligonucleotide
tgactctcagcaaacctcgcaccatcttagcttag

SEQ ID NO: 44320 - DNA, 35 bp, Artificial Sequence
  Synthetic oligonucleotide
ttgtcaacacaataccctgcgccccttcgcgatcg

SEQ ID NO: 44321 - DNA, 35 bp, Artificial Sequence
  Synthetic oligonucleotide
acgagcagaatcctgccctaatggtccgcctactg

SEQ ID NO: 44322 - DNA, 35 bp, Artificial Sequence
  Synthetic oligonucleotide
gtcccctctctcgcatgttacactaagccgcaact

SEQ ID NO: 44323 - DNA, 35 bp, Artificial Sequence
  Synthetic oligonucleotide
atatccacgaacacgtggaaacacacattattact

SEQ ID NO: 44324 - DNA, 35 bp, Artificial Sequence
  Synthetic oligonucleotide
atgaagcgtgttgctgttcctcatgtccctacctt

SEQ ID NO: 44325 - DNA, 35 bp, Artificial Sequence
  Synthetic oligonucleotide
tcgagacctgcccgagaaacgtcaatacagctctt

SEQ ID NO: 44326 - DNA, 35 bp, Artificial Sequence
  Synthetic oligonucleotide
tgcgagccaacaatcgttcttttgaatttctgttt

SEQ ID NO: 44327 - DNA, 36 bp, Artificial Sequence
  Synthetic oligonucleotide
tgtaccatcatgcactcgatgcaaccttacccgaaa

SEQ ID NO: 44328 - DNA, 36 bp, Artificial Sequence
  Synthetic oligonucleotide
ttacgactaccgacctgccgcctgaggcctgcacaa

SEQ ID NO: 44329 - DNA, 36 bp, Artificial Sequence
  Synthetic oligonucleotide
gggcctgccaccttctgtcccacacttgcctgctaa

SEQ ID NO: 44330 - DNA, 36 bp, Artificial Sequence
  Synthetic oligonucleotide
ttcatggctgccacttgccttgacttctacgacaca

SEQ ID NO: 44331 - DNA, 36 bp, Artificial Sequence
  Synthetic oligonucleotide
gcccaccttgtcatacgaagtatatttatctgtaca

SEQ ID NO: 44332 - DNA, 36 bp, Artificial Sequence
  Synthetic oligonucleotide
gtttcacgcagttctccgagcccactcctaagccca

SEQ ID NO: 44333 - DNA, 36 bp, Artificial Sequence
  Synthetic oligonucleotide
gtggtcgtacatactgtgtccatacccccgtgcgca

SEQ ID NO: 44334 - DNA, 35 bp, Artificial Sequence
  Synthetic oligonucleotide
agtgggggggggaacagggatcgtgagacatgtca

SEQ ID NO: 44335 - DNA, 36 bp, Artificial Sequence
  Synthetic oligonucleotide
taattgtcccgccgaggcactgacaaacacacttca

SEQ ID NO: 44336 - DNA, 36 bp, Artificial Sequence
  Synthetic oligonucleotide
ttcgaatggggtggagggcgtttaagcagggtgaga

SEQ ID NO: 44337 - DNA, 37 bp, Artificial Sequence
  Synthetic oligonucleotide
tcctcgcctgcttccgctatcttccgctagacttaga

SEQ ID NO: 44338 - DNA, 37 bp, Artificial Sequence
  Synthetic oligonucleotide
gttaacgaacgtccgccatcatcactctcccttccga

SEQ ID NO: 44339 - DNA, 37 bp, Artificial Sequence
  Synthetic oligonucleotide
gcatgtgggaaggtggaaaattctgcatgggaatcga

SEQ ID NO: 44340 - DNA, 35 bp, Artificial Sequence
  Synthetic oligonucleotide
atccacgtacatgaatcataactccctgttcagga

SEQ ID NO: 44341 - DNA, 37 bp, Artificial Sequence
  Synthetic oligonucleotide
tattccagcagtctaagaggggaagggggtgagcgga

SEQ ID NO: 44342 - DNA, 37 bp, Artificial Sequence
  Synthetic oligonucleotide
atcatacaccctggtctaactccctcgatttcgggga

SEQ ID NO: 44343 - DNA, 38 bp, Artificial Sequence
  Synthetic oligonucleotide
aacaccacacatcgatagtccgaacggattacccctga

SEQ ID NO: 44344 - DNA, 38 bp, Artificial Sequence
  Synthetic oligonucleotide
tacgccatacgaaccgccgcaatcaaccaccgccctga

SEQ ID NO: 44345 - DNA, 38 bp, Artificial Sequence
  Synthetic oligonucleotide
atgcgggagtggaccaaggattctgggacttagagtga

SEQ ID NO: 44346 - DNA, 38 bp, Artificial Sequence
  Synthetic oligonucleotide
gtcagaggacaagggggaggccaggggcggtgaggtga

SEQ ID NO: 44347 - DNA, 37 bp, Artificial Sequence
  Synthetic oligonucleotide
acacgctagtgaccaacatagcccgattgacccttga

SEQ ID NO: 44348 - DNA, 38 bp, Artificial Sequence
  Synthetic oligonucleotide
gatgcacgcaggggacaagggtagaggtagaaagttga

SEQ ID NO: 44349 - DNA, 37 bp, Artificial Sequence
  Synthetic oligonucleotide
gtctgccccgcgaccccgattcgccccaatgatttga

SEQ ID NO: 44350 - DNA, 36 bp, Artificial Sequence
  Synthetic oligonucleotide
gcgtaaccgacgaaccgcttgaaagtcctgtctcta

SEQ ID NO: 44351 - DNA, 36 bp, Artificial Sequence
  Synthetic oligonucleotide
tttacgtccccatgttcctatgcctgtgccccatta

SEQ ID NO: 44352 - DNA, 36 bp, Artificial Sequence
  Synthetic oligonucleotide
atcgtccaatacatctgcgccttacctcatgcctta

SEQ ID NO: 44353 - DNA, 36 bp, Artificial Sequence
  Synthetic oligonucleotide
agcacgcaactggttcccccatcatcacctttctta

SEQ ID NO: 44354 - DNA, 35 bp, Artificial Sequence
  Synthetic oligonucleotide
gctggcctgttgcaaaaatatcgcacgtactacac

SEQ ID NO: 44355 - DNA, 35 bp, Artificial Sequence
  Synthetic oligonucleotide
taaccatgcctcttgctatgccttatggtacatac

SEQ ID NO: 44356 - DNA, 34 bp, Artificial Sequence
  Synthetic oligonucleotide
aacgccgacccgccctttcagataagggccatac

SEQ ID NO: 44357 - DNA, 35 bp, Artificial Sequence
  Synthetic oligonucleotide
tgacgaggacaagagtccaacacaaccccaacacc

SEQ ID NO: 44358 - DNA, 35 bp, Artificial Sequence
  Synthetic oligonucleotide
acctgcgctaccgccctttcttgtgtgcctttacc

SEQ ID NO: 44359 - DNA, 35 bp, Artificial Sequence
  Synthetic oligonucleotide
accgtgtgcctctaccgggctacgagtcctcaccc

SEQ ID NO: 44360 - DNA, 35 bp, Artificial Sequence
  Synthetic oligonucleotide
gttccacgccccgaagcagtactaacatttcgccc

SEQ ID NO: 44361 - DNA, 35 bp, Artificial Sequence
  Synthetic oligonucleotide
atgccaaagtcccctccagcactacgatttcagcc

SEQ ID NO: 44362 - DNA, 35 bp, Artificial Sequence
  Synthetic oligonucleotide
acgctaacccacacctgtgaggaacctgctactcc

SEQ ID NO: 44363 - DNA, 35 bp, Artificial Sequence
  Synthetic oligonucleotide
aagcgggctctggctactcgactcactaaccattc

SEQ ID NO: 44364 - DNA, 35 bp, Artificial Sequence
  Synthetic oligonucleotide
tcctttcgtcgcccgccctgtaaacttttcgattc

SEQ ID NO: 44365 - DNA, 35 bp, Artificial Sequence
  Synthetic oligonucleotide
ggtagagagggaagggaacgcgctggaacgaacag

SEQ ID NO: 44366 - DNA, 35 bp, Artificial Sequence
  Synthetic oligonucleotide
tcacattaaccctcgcgctaccgttgcttgcatag

SEQ ID NO: 44367 - DNA, 35 bp, Artificial Sequence
  Synthetic oligonucleotide
taaccttccacgcctatccggctatcaagaacccg

SEQ ID NO: 44368 - DNA, 35 bp, Artificial Sequence
  Synthetic oligonucleotide
gggggtggggtgaaaggcaagtaggattgcagagg

SEQ ID NO: 44369 - DNA, 35 bp, Artificial Sequence
  Synthetic oligonucleotide
tacgccgctcaccctttgtctgcacttctacgtgg

SEQ ID NO: 44370 - DNA, 35 bp, Artificial Sequence
  Synthetic oligonucleotide
acaacacacgacgttacaagtttctccagtactat

SEQ ID NO: 44371 - DNA, 35 bp, Artificial Sequence
  Synthetic oligonucleotide
gcaatattgcactggccccttcctgcccccactct

SEQ ID NO: 44372 - DNA, 35 bp, Artificial Sequence
  Synthetic oligonucleotide
gcccacgtacggatcttttgcgtgtctctatgggt

SEQ ID NO: 44373 - DNA, 35 bp, Artificial Sequence
  Synthetic oligonucleotide
gagatgccgcaagagcatagttagctacttccctt

SEQ ID NO: 44374 - DNA, 35 bp, Artificial Sequence
  Synthetic oligonucleotide
gcatcctcacaactgtaccgcctcttggattctaa

SEQ ID NO: 44375 - DNA, 35 bp, Artificial Sequence
  Synthetic oligonucleotide
gaccgccgaggttaccaccatctataagcccacca

SEQ ID NO: 44376 - DNA, 35 bp, Artificial Sequence
  Synthetic oligonucleotide
aatataacgcatgggagggagggatgggaagctca

SEQ ID NO: 44377 - DNA, 36 bp, Artificial Sequence
  Synthetic oligonucleotide
tgcacccgcactctgcccccgacctctatcgggaga

SEQ ID NO: 44378 - DNA, 37 bp, Artificial Sequence
  Synthetic oligonucleotide
gtggaccggtcgtagagggggaggttcatgagtccga

SEQ ID NO: 44379 - DNA, 37 bp, Artificial Sequence
  Synthetic oligonucleotide
gtgccggcccacgactccgattaatacaccggtccga

SEQ ID NO: 44380 - DNA, 37 bp, Artificial Sequence
  Synthetic oligonucleotide
tttgggtgacgcagcactgtcagacacaccacctcga

SEQ ID NO: 44381 - DNA, 35 bp, Artificial Sequence
  Synthetic oligonucleotide
acctaccaccctctaggtaccgataacactttcga

SEQ ID NO: 44382 - DNA, 35 bp, Artificial Sequence
  Synthetic oligonucleotide
taggacatcaccacccttcccgaatgtagcacgga

SEQ ID NO: 44383 - DNA, 37 bp, Artificial Sequence
  Synthetic oligonucleotide
accccccttcccagccttacgccgctcactatgcgga

SEQ ID NO: 44384 - DNA, 37 bp, Artificial Sequence
  Synthetic oligonucleotide
atgtgaggggattgggcaaggcaatcagggatgggga

SEQ ID NO: 44385 - DNA, 37 bp, Artificial Sequence
  Synthetic oligonucleotide
gcgacatggaagttgtcgcactcaaaaatgcaatgga

SEQ ID NO: 44386 - DNA, 38 bp, Artificial Sequence
  Synthetic oligonucleotide
gacattgcccctgtacgggaccgttccaccaacaatga

SEQ ID NO: 44387 - DNA, 37 bp, Artificial Sequence
  Synthetic oligonucleotide
tcccactactactgctgccaattgaacccaacactga

SEQ ID NO: 44388 - DNA, 38 bp, Artificial Sequence
  Synthetic oligonucleotide
tgctcaacgcccacaacgcacagaccgtcgaatactga

SEQ ID NO: 44389 - DNA, 38 bp, Artificial Sequence
  Synthetic oligonucleotide
gggggcgccacaactcaccacacctgtctcgaacctga

SEQ ID NO: 44390 - DNA, 38 bp, Artificial Sequence
  Synthetic oligonucleotide
gccggacggaacacgaaaagggagaacagtattagtga

SEQ ID NO: 44391 - DNA, 38 bp, Artificial Sequence
  Synthetic oligonucleotide
ttagggggtaggtgcgggggatcggatagctagggtga

SEQ ID NO: 44392 - DNA, 38 bp, Artificial Sequence
  Synthetic oligonucleotide
gctgacccccgctgtctttccggtgcctgttcccttga

SEQ ID NO: 44393 - DNA, 36 bp, Artificial Sequence
  Synthetic oligonucleotide
gtaccaccgaaggcactgttagtttccgttccttga

SEQ ID NO: 44394 - DNA, 37 bp, Artificial Sequence
  Synthetic oligonucleotide
tccccccccgtggcatcgcatttcgcctcacctttga

SEQ ID NO: 44395 - DNA, 35 bp, Artificial Sequence
  Synthetic oligonucleotide
tagtacggagtggggggtgtaaaaatgggtgcgta

SEQ ID NO: 44396 - DNA, 35 bp, Artificial Sequence
  Synthetic oligonucleotide
ttgatcctagttcctgccctaacgcgtatggacac

SEQ ID NO: 44397 - DNA, 35 bp, Artificial Sequence
  Synthetic oligonucleotide
gtggttgatcgctctctgctaatgtttccagctac

SEQ ID NO: 44398 - DNA, 35 bp, Artificial Sequence
  Synthetic oligonucleotide
tcagtccatagcctagcccgcatacgagttgttac

SEQ ID NO: 44399 - DNA, 35 bp, Artificial Sequence
  Synthetic oligonucleotide
gcccgtggacgtttacgggccgctgttactaaccc

SEQ ID NO: 44400 - DNA, 35 bp, Artificial Sequence
  Synthetic oligonucleotide
gtccgagctcgcaggttgagccgaggtcgtccccc

SEQ ID NO: 44401 - DNA, 35 bp, Artificial Sequence
  Synthetic oligonucleotide
gtgggttctccgcattcgttacacctgatcttttc

SEQ ID NO: 44402 - DNA, 35 bp, Artificial Sequence
  Synthetic oligonucleotide
tgtgtccgcctgctatcaccggtctccagactacg

SEQ ID NO: 44403 - DNA, 35 bp, Artificial Sequence
  Synthetic oligonucleotide
tgatccacgtggccccccgaaccgacccatctacg

SEQ ID NO: 44404 - DNA, 35 bp, Artificial Sequence
  Synthetic oligonucleotide
gcaatcgcctatactgcgtctacttcccgtctact

SEQ ID NO: 44405 - DNA, 35 bp, Artificial Sequence
  Synthetic oligonucleotide
tacatccgatgaggttatcatccgttcttcactct

SEQ ID NO: 44406 - DNA, 35 bp, Artificial Sequence
  Synthetic oligonucleotide
aaccacatacaccccggtgagccgttcccgccgtt

SEQ ID NO: 44407 - DNA, 35 bp, Artificial Sequence
  Synthetic oligonucleotide
tataactcatgcgctgccattgccctattggaaca

SEQ ID NO: 44408 - DNA, 36 bp, Artificial Sequence
  Synthetic oligonucleotide
tgatgtcctcgcttgagccaaatgcatgtgcactca

SEQ ID NO: 44409 - DNA, 36 bp, Artificial Sequence
  Synthetic oligonucleotide
tagtacgctacaactcactggacgaaacgtctttca

SEQ ID NO: 44410 - DNA, 37 bp, Artificial Sequence
  Synthetic oligonucleotide
tccgagagcgtaaggctccctctccactttacgtaga

SEQ ID NO: 44411 - DNA, 37 bp, Artificial Sequence
  Synthetic oligonucleotide
gtgccctaacatcgatcgcgccatttcctttgtccga

SEQ ID NO: 44412 - DNA, 37 bp, Artificial Sequence
  Synthetic oligonucleotide
atgacacctggcataccctttgcgataactttcgcga

SEQ ID NO: 44413 - DNA, 37 bp, Artificial Sequence
  Synthetic oligonucleotide
gtagcgacggggagcaactatggactggaaagggcga

SEQ ID NO: 44414 - DNA, 36 bp, Artificial Sequence
  Synthetic oligonucleotide
tagatgcgccgatatttgataattccctttcctcga

SEQ ID NO: 44415 - DNA, 37 bp, Artificial Sequence
  Synthetic oligonucleotide
gacgccggtcaaaaattcgtctctatctcctcttgga

SEQ ID NO: 44416 - DNA, 38 bp, Artificial Sequence
  Synthetic oligonucleotide
acggacgggaagaggaattggaaacggggtggtaatga

SEQ ID NO: 44417 - DNA, 38 bp, Artificial Sequence
  Synthetic oligonucleotide
acacagccttacctccagtttaatcgccatgtgcctga

SEQ ID NO: 44418 - DNA, 37 bp, Artificial Sequence
  Synthetic oligonucleotide
tcgcagtccgccctgcccaatggcctccataaagtga

SEQ ID NO: 44419 - DNA, 38 bp, Artificial Sequence
  Synthetic oligonucleotide
tcagagctccctcccatttgcccctcgagacatagtga

SEQ ID NO: 44420 - DNA, 38 bp, Artificial Sequence
  Synthetic oligonucleotide
gacacccctgatccatactccgcccgaagacgtggtga

SEQ ID NO: 44421 - DNA, 38 bp, Artificial Sequence
  Synthetic oligonucleotide
ttggagtgcattaagggttggggtggtgctgggattga

SEQ ID NO: 44422 - DNA, 38 bp, Artificial Sequence
  Synthetic oligonucleotide
gcccagcccggcaacttttcacgaccgccctatattga

SEQ ID NO: 44423 - DNA, 38 bp, Artificial Sequence
  Synthetic oligonucleotide
gtttacccaatcgcaaccgtgcgaccatctcccgttga

SEQ ID NO: 44424 - DNA, 38 bp, Artificial Sequence
  Synthetic oligonucleotide
tgaacctcctccggcgacgtcacacctatccatgttga

SEQ ID NO: 44425 - DNA, 35 bp, Artificial Sequence
  Synthetic oligonucleotide
gcccagcctcaccctcgagtcgatatacttgttga

SEQ ID NO: 44426 - DNA, 37 bp, Artificial Sequence
  Synthetic oligonucleotide
agacaccagcggtattcacacggccctatcttgttga

SEQ ID NO: 44427 - DNA, 37 bp, Artificial Sequence
  Synthetic oligonucleotide
gagaccaaccacaccgcaattgtccgcaacactttga

SEQ ID NO: 44428 - DNA, 37 bp, Artificial Sequence
  Synthetic oligonucleotide
atccgccctgcactgcgttgaccacttatatgtttga

SEQ ID NO: 44429 - DNA, 36 bp, Artificial Sequence
  Synthetic oligonucleotide
atgccagacccccgctgtagtctcttttacaacata

SEQ ID NO: 44430 - DNA, 36 bp, Artificial Sequence
  Synthetic oligonucleotide
gatcccaacccattcacatgacggaactgacctata

SEQ ID NO: 44431 - DNA, 36 bp, Artificial Sequence
  Synthetic oligonucleotide
tctgcatcaactctgcgtaaattcccctgttgctta

SEQ ID NO: 44432 - DNA, 35 bp, Artificial Sequence
  Synthetic oligonucleotide
tgccgcagatcgcccgcttaaccccgtgccactac

SEQ ID NO: 44433 - DNA, 35 bp, Artificial Sequence
  Synthetic oligonucleotide
atgatcccgacaattatctgtctctgtacataccc

SEQ ID NO: 44434 - DNA, 34 bp, Artificial Sequence
  Synthetic oligonucleotide
gccgccgccacaacgctttaggccaaactcatgc

SEQ ID NO: 44435 - DNA, 35 bp, Artificial Sequence
  Synthetic oligonucleotide
gagcccgcctaacgcagcaacaacgactccgtttc

SEQ ID NO: 44436 - DNA, 35 bp, Artificial Sequence
  Synthetic oligonucleotide
atgaccccgttgcacacacagcagagatgctatcg

SEQ ID NO: 44437 - DNA, 35 bp, Artificial Sequence
  Synthetic oligonucleotide
tcgccctgtgttcgcttgcctccgccataaccctg

SEQ ID NO: 44438 - DNA, 35 bp, Artificial Sequence
  Synthetic oligonucleotide
actgtagagccgtcactcggaactctccactgcct

SEQ ID NO: 44439 - DNA, 35 bp, Artificial Sequence
  Synthetic oligonucleotide
acctgccaactgacgaatacgccaacaaccgtcct

SEQ ID NO: 44440 - DNA, 35 bp, Artificial Sequence
  Synthetic oligonucleotide
acgctgctaatatagttcatcgttccaccccgcgt

SEQ ID NO: 44441 - DNA, 35 bp, Artificial Sequence
  Synthetic oligonucleotide
tcacgcctgtagttgtcacatacccgggccacttt

SEQ ID NO: 44442 - DNA, 35 bp, Artificial Sequence
  Synthetic oligonucleotide
taaaggaagagacagaggtagtgtggtgtgaaaaa

SEQ ID NO: 44443 - DNA, 35 bp, Artificial Sequence
  Synthetic oligonucleotide
agacgacggtcgaaaacagtcattatgaagtggaa

SEQ ID NO: 44444 - DNA, 35 bp, Artificial Sequence
  Synthetic oligonucleotide
gcccatctgtccgctctttgtcgtcattgttctaa

SEQ ID NO: 44445 - DNA, 35 bp, Artificial Sequence
  Synthetic oligonucleotide
gacccactatgcatccctaggctcctggtgcaaca

SEQ ID NO: 44446 - DNA, 36 bp, Artificial Sequence
  Synthetic oligonucleotide
tctaacacctggccaacgagcctatgtccacacaca

SEQ ID NO: 44447 - DNA, 36 bp, Artificial Sequence
  Synthetic oligonucleotide
agctaacgcctgaccctgtcgcccacgttcaaccca

SEQ ID NO: 44448 - DNA, 35 bp, Artificial Sequence
  Synthetic oligonucleotide
acccaccgcgatccggcccacatgtcacataagca

SEQ ID NO: 44449 - DNA, 36 bp, Artificial Sequence
  Synthetic oligonucleotide
actccaccacttcagcctatttcttggacaagctca

SEQ ID NO: 44450 - DNA, 36 bp, Artificial Sequence
  Synthetic oligonucleotide
gttgttgccgccaggataatgtcgaacctcctctca

SEQ ID NO: 44451 - DNA, 36 bp, Artificial Sequence
  Synthetic oligonucleotide
accatcttcctctccgtcttgctcaaacgacagtca

SEQ ID NO: 44452 - DNA, 36 bp, Artificial Sequence
  Synthetic oligonucleotide
gatgcattactccatgtttctctgctccgacattca

SEQ ID NO: 44453 - DNA, 36 bp, Artificial Sequence
  Synthetic oligonucleotide
actcgtacgccacttcattgggccacgctcatttca

SEQ ID NO: 44454 - DNA, 37 bp, Artificial Sequence
  Synthetic oligonucleotide
ttcgaactcacagacccactcgtgccctgacaaccga

SEQ ID NO: 44455 - DNA, 36 bp, Artificial Sequence
  Synthetic oligonucleotide
tgtggactagccctcccctttactcctcgcgtccga

SEQ ID NO: 44456 - DNA, 37 bp, Artificial Sequence
  Synthetic oligonucleotide
ggtgccgtaccatgttctctcctatgttttctcgcga

SEQ ID NO: 44457 - DNA, 37 bp, Artificial Sequence
  Synthetic oligonucleotide
gctctgacctgcaaattgcactgcccccacttggcga

SEQ ID NO: 44458 - DNA, 37 bp, Artificial Sequence
  Synthetic oligonucleotide
ttgcggggccggggggaggattggcttactacaagga

SEQ ID NO: 44459 - DNA, 37 bp, Artificial Sequence
  Synthetic oligonucleotide
tgacctctggcctcatgttccttcgcacgaccgggga

SEQ ID NO: 44460 - DNA, 37 bp, Artificial Sequence
  Synthetic oligonucleotide
tgagggacgcgttgaattgggtgggtctgttttggga

SEQ ID NO: 44461 - DNA, 38 bp, Artificial Sequence
  Synthetic oligonucleotide
gcatgcttgaaaatggggggaaatggtggcgggtatga

SEQ ID NO: 44462 - DNA, 38 bp, Artificial Sequence
  Synthetic oligonucleotide
acagcccaacaagccctgcctccacactgcaaagctga

SEQ ID NO: 44463 - DNA, 37 bp, Artificial Sequence
  Synthetic oligonucleotide
tgcccacatagcccaaacgagactccgtgttatctga

SEQ ID NO: 44464 - DNA, 38 bp, Artificial Sequence
  Synthetic oligonucleotide
ttgcggaggtgggcggagggggtgctagtttgggttga

SEQ ID NO: 44465 - DNA, 36 bp, Artificial Sequence
  Synthetic oligonucleotide
gcgacattgcagtctgattactcacctactgccata

SEQ ID NO: 44466 - DNA, 36 bp, Artificial Sequence
  Synthetic oligonucleotide
tcccctcatgccccttgcggatggtaccacttccta

SEQ ID NO: 44467 - DNA, 36 bp, Artificial Sequence
  Synthetic oligonucleotide
gacactgcaatttcggtacattccacctgagggcta

SEQ ID NO: 44468 - DNA, 35 bp, Artificial Sequence
  Synthetic oligonucleotide
ttcgccgacccctattcgctggcctgaggcatcta

SEQ ID NO: 44469 - DNA, 35 bp, Artificial Sequence
  Synthetic oligonucleotide
atccttccagcaccgcgttcggcacccctataccc

SEQ ID NO: 44470 - DNA, 35 bp, Artificial Sequence
  Synthetic oligonucleotide
atctattcgaccaaactgtccgtgactgccgggcc

SEQ ID NO: 44471 - DNA, 35 bp, Artificial Sequence
  Synthetic oligonucleotide
actaacgccccaccctggcgtcgccgccctaatcc

SEQ ID NO: 44472 - DNA, 36 bp, Artificial Sequence
  Synthetic oligonucleotide
gctctccgtccgtcctctccgagccatgctccgcgc

SEQ ID NO: 44473 - DNA, 35 bp, Artificial Sequence
  Synthetic oligonucleotide
tgtacgtcactatccagtcaattttaccccttggc

SEQ ID NO: 44474 - DNA, 35 bp, Artificial Sequence
  Synthetic oligonucleotide
taacacgcccccaaagtgagacgaaccacccgtgc

SEQ ID NO: 44475 - DNA, 35 bp, Artificial Sequence
  Synthetic oligonucleotide
atggcctatcgcacacctactcagcaacttctatc

SEQ ID NO: 44476 - DNA, 35 bp, Artificial Sequence
  Synthetic oligonucleotide
ttaccaaccggacaggtcccgtcacacagggcctc

SEQ ID NO: 44477 - DNA, 35 bp, Artificial Sequence
  Synthetic oligonucleotide
gacatgcagtaaggcaagaataggatcgaggggag

SEQ ID NO: 44478 - DNA, 35 bp, Artificial Sequence
  Synthetic oligonucleotide
atgcgctctcccttatcacgatacctacttgcctg

SEQ ID NO: 44479 - DNA, 35 bp, Artificial Sequence
  Synthetic oligonucleotide
accaggtgaggaaggaggggtatttgggcactgtg

SEQ ID NO: 44480 - DNA, 35 bp, Artificial Sequence
  Synthetic oligonucleotide
ggtccattacgtacgtgcctcatatgcataccact

SEQ ID NO: 44481 - DNA, 35 bp, Artificial Sequence
  Synthetic oligonucleotide
atacatcgctgcagggcgagccttttacttatact

SEQ ID NO: 44482 - DNA, 35 bp, Artificial Sequence
  Synthetic oligonucleotide
gagacgttgtggtagcctccgtgagtttctcctct

SEQ ID NO: 44483 - DNA, 35 bp, Artificial Sequence
  Synthetic oligonucleotide
tgcacgtatggtgctggtcgtggtcggttcctctt

SEQ ID NO: 44484 - DNA, 35 bp, Artificial Sequence
  Synthetic oligonucleotide
tagtgtcgacgaccagggaaataaaagggggggaa

SEQ ID NO: 44485 - DNA, 36 bp, Artificial Sequence
  Synthetic oligonucleotide
acacgccactgccatctaaagtcaaacgctcgctaa

SEQ ID NO: 44486 - DNA, 35 bp, Artificial Sequence
  Synthetic oligonucleotide
tccatcgtgctttcgaaatttttacgcccgctaca

SEQ ID NO: 44487 - DNA, 36 bp, Artificial Sequence
  Synthetic oligonucleotide
acaccatcctgcccgaaacacctaggctagttgcca

SEQ ID NO: 44488 - DNA, 36 bp, Artificial Sequence
  Synthetic oligonucleotide
gcacgatggccacctatcgccacactacgcactcca

SEQ ID NO: 44489 - DNA, 36 bp, Artificial Sequence
  Synthetic oligonucleotide
aaacgcggggcgtggggaggggagcacgttgatgca

SEQ ID NO: 44490 - DNA, 35 bp, Artificial Sequence
  Synthetic oligonucleotide
tccgagacctgaaccccgctgtactttcccagtca

SEQ ID NO: 44491 - DNA, 37 bp, Artificial Sequence
  Synthetic oligonucleotide
gggacgggaatacaacttggataaggggatggggaga

SEQ ID NO: 44492 - DNA, 37 bp, Artificial Sequence
  Synthetic oligonucleotide
agatcaccgccccactctctagccgtcgtgtccgcga

SEQ ID NO: 44493 - DNA, 37 bp, Artificial Sequence
  Synthetic oligonucleotide
gagggtgaggtggaccgatcggagagatggggaagga

SEQ ID NO: 44494 - DNA, 37 bp, Artificial Sequence
  Synthetic oligonucleotide
acacgggggcaaaactaaaatactggagaagtacgga

SEQ ID NO: 44495 - DNA, 37 bp, Artificial Sequence
  Synthetic oligonucleotide
aatgaagtgggggaaggtgaatatcgtgagtagcgga

SEQ ID NO: 44496 - DNA, 37 bp, Artificial Sequence
  Synthetic oligonucleotide
gtacatacccgcatggtgatctccgtttctcgtggga

SEQ ID NO: 44497 - DNA, 36 bp, Artificial Sequence
  Synthetic oligonucleotide
accagaggaaggacgaaagtagggctcagcgatgga

SEQ ID NO: 44498 - DNA, 38 bp, Artificial Sequence
  Synthetic oligonucleotide
gatttggggggagagtacatgacgaggggggaaactga

SEQ ID NO: 44499 - DNA, 38 bp, Artificial Sequence
  Synthetic oligonucleotide
tggataccccgcacatctcattgaccacgttttactga

SEQ ID NO: 44500 - DNA, 38 bp, Artificial Sequence
  Synthetic oligonucleotide
ttgggccaccctatgagtgaatgcaccacctaacctga

SEQ ID NO: 44501 - DNA, 37 bp, Artificial Sequence
  Synthetic oligonucleotide
gcccaggtacggggcacggggcgatagttcaccctga

SEQ ID NO: 44502 - DNA, 38 bp, Artificial Sequence
  Synthetic oligonucleotide
ggcacaccatgatgtgccacccgttcatccttccctga

SEQ ID NO: 44503 - DNA, 37 bp, Artificial Sequence
  Synthetic oligonucleotide
gtccactgcggacatctccgttaaccatcttccgtga

SEQ ID NO: 44504 - DNA, 38 bp, Artificial Sequence
  Synthetic oligonucleotide
agtagggcgaggagtggatgagacgggggtagttgtga

SEQ ID NO: 44505 - DNA, 37 bp, Artificial Sequence
  Synthetic oligonucleotide
aaactcacctcacctgggatcgacgtctgtacattga

SEQ ID NO: 44506 - DNA, 37 bp, Artificial Sequence
  Synthetic oligonucleotide
atcaccccagccactgaaatttctgacccccggttga

SEQ ID NO: 44507 - DNA, 38 bp, Artificial Sequence
  Synthetic oligonucleotide
tccgtgcgtgcttttgctttactatcccgccctgttga

SEQ ID NO: 44508 - DNA, 36 bp, Artificial Sequence
  Synthetic oligonucleotide
tcctgctcacagcgatttccaacacgcaatacccta

SEQ ID NO: 44509 - DNA, 35 bp, Artificial Sequence
  Synthetic oligonucleotide
gtgtgacccccgccaataatagagctatcctccta

SEQ ID NO: 44510 - DNA, 36 bp, Artificial Sequence
  Synthetic oligonucleotide
cttgtatccgcacgttcattagttgatgtcttcgta

SEQ ID NO: 44511 - DNA, 35 bp, Artificial Sequence
  Synthetic oligonucleotide
atccacacagcattttcttttgtagccctagggta

SEQ ID NO: 44512 - DNA, 35 bp, Artificial Sequence
  Synthetic oligonucleotide
ttgtaacgtaccccccgtatacgacgctgtccacc

SEQ ID NO: 44513 - DNA, 35 bp, Artificial Sequence
  Synthetic oligonucleotide
ttggccacaggctactgcttaccgacacctgtacc

SEQ ID NO: 44514 - DNA, 35 bp, Artificial Sequence
  Synthetic oligonucleotide
tacgcgaaccagttgcaactactaagtttccaccc

SEQ ID NO: 44515 - DNA, 35 bp, Artificial Sequence
  Synthetic oligonucleotide
atgatgccattatagtgttgcaatattttcccttc

SEQ ID NO: 44516 - DNA, 35 bp, Artificial Sequence
  Synthetic oligonucleotide
tgttcaactcctggcaaccacctggctttttgttc

SEQ ID NO: 44517 - DNA, 35 bp, Artificial Sequence
  Synthetic oligonucleotide
tgcctgcccattagcgactagacattggccttttc

SEQ ID NO: 44518 - DNA, 35 bp, Artificial Sequence
  Synthetic oligonucleotide
ttgacaatgggggggtttatgtacacgaaggagtg

SEQ ID NO: 44519 - DNA, 35 bp, Artificial Sequence
  Synthetic oligonucleotide
aagggccagacacagagagggttgagggaggagat

SEQ ID NO: 44520 - DNA, 35 bp, Artificial Sequence
  Synthetic oligonucleotide
gtgtaggccccacttgttgctcagctcttccacct

SEQ ID NO: 44521 - DNA, 35 bp, Artificial Sequence
  Synthetic oligonucleotide
tgttgtatggcccaccccgccgcccacttcacgct

SEQ ID NO: 44522 - DNA, 35 bp, Artificial Sequence
  Synthetic oligonucleotide
atccgcatctcccctccactgcgccggtgctggtt

SEQ ID NO: 44523 - DNA, 36 bp, Artificial Sequence
  Synthetic oligonucleotide
gccccaccccttattgtcatttcaggcataccgaaa

SEQ ID NO: 44524 - DNA, 35 bp, Artificial Sequence
  Synthetic oligonucleotide
gtccaccgtccgcgaagccctcagaataacttgca

SEQ ID NO: 44525 - DNA, 37 bp, Artificial Sequence
  Synthetic oligonucleotide
ttgctccctcccccgctcaaactccattctgcggaga

SEQ ID NO: 44526 - DNA, 37 bp, Artificial Sequence
  Synthetic oligonucleotide
gacacacgctacattgcctttaggctgctcttggaga

SEQ ID NO: 44527 - DNA, 38 bp, Artificial Sequence
  Synthetic oligonucleotide
agtgccactgatatcgccctgttctaccaccactatga

SEQ ID NO: 44528 - DNA, 38 bp, Artificial Sequence
  Synthetic oligonucleotide
acccattgggccgattttagcattgctcacatacctga

SEQ ID NO: 44529 - DNA, 38 bp, Artificial Sequence
  Synthetic oligonucleotide
gttccacctcgtaggctctgtgccacaacactccctga

SEQ ID NO: 44530 - DNA, 35 bp, Artificial Sequence
  Synthetic oligonucleotide
gctgtccgcctacgtcctgggttgccctatcctga

SEQ ID NO: 44531 - DNA, 37 bp, Artificial Sequence
  Synthetic oligonucleotide
agtcggggtgcaagtgggggcatggacgtggaggtga

SEQ ID NO: 44532 - DNA, 35 bp, Artificial Sequence
  Synthetic oligonucleotide
tgcacaacccacctgctcgtagaaacctggtcata

SEQ ID NO: 44533 - DNA, 35 bp, Artificial Sequence
  Synthetic oligonucleotide
atagtccctccggaagccagctcgcctcctacaac

SEQ ID NO: 44534 - DNA, 35 bp, Artificial Sequence
  Synthetic oligonucleotide
aacaccaagcgccgtttttgattttttgtaaccac

SEQ ID NO: 44535 - DNA, 35 bp, Artificial Sequence
  Synthetic oligonucleotide
attacactgccgccgttgttggccttgcgcacgac

SEQ ID NO: 44536 - DNA, 35 bp, Artificial Sequence
  Synthetic oligonucleotide
tcaatcggctcagacataccacccgtacgaccccc

SEQ ID NO: 44537 - DNA, 35 bp, Artificial Sequence
  Synthetic oligonucleotide
tccccactcccctcgtccaccttaggctctccgcc

SEQ ID NO: 44538 - DNA, 35 bp, Artificial Sequence
  Synthetic oligonucleotide
tacgacggacgccggacggttttgcccttgttagc

SEQ ID NO: 44539 - DNA, 35 bp, Artificial Sequence
  Synthetic oligonucleotide
atcccgcatcaccttatacctgcctgtgtccctgc

SEQ ID NO: 44540 - DNA, 35 bp, Artificial Sequence
  Synthetic oligonucleotide
tgtaggacccgcagcatcgcatatcattctcctgc

SEQ ID NO: 44541 - DNA, 35 bp, Artificial Sequence
  Synthetic oligonucleotide
gccatatcaggcccttttgttaactgtcttatatc

SEQ ID NO: 44542 - DNA, 35 bp, Artificial Sequence
  Synthetic oligonucleotide
taaagccgagcctggtcccttttgcccgttctatc

SEQ ID NO: 44543 - DNA, 35 bp, Artificial Sequence
  Synthetic oligonucleotide
ggaaaccgtcccagctatcacacgtaaacgcgctc

SEQ ID NO: 44544 - DNA, 35 bp, Artificial Sequence
  Synthetic oligonucleotide
aagccggtagaccccgcgtatccctgttcatgttc

SEQ ID NO: 44545 - DNA, 35 bp, Artificial Sequence
  Synthetic oligonucleotide
aacgcggaacggttaaggagtgggtgatcggctag

SEQ ID NO: 44546 - DNA, 35 bp, Artificial Sequence
  Synthetic oligonucleotide
tgttcatacgcccgttactccccttggtgctgccg

SEQ ID NO: 44547 - DNA, 35 bp, Artificial Sequence
  Synthetic oligonucleotide
ggctgggagggtgggcggagggagagtggaatagg

SEQ ID NO: 44548 - DNA, 35 bp, Artificial Sequence
  Synthetic oligonucleotide
taccaacacagatgtcgcaccgtacgcccaaaatt

SEQ ID NO: 44549 - DNA, 35 bp, Artificial Sequence
  Synthetic oligonucleotide
tgacccaagaagttgctagttgtcctcactccatt

SEQ ID NO: 44550 - DNA, 35 bp, Artificial Sequence
  Synthetic oligonucleotide
tgtacacgcagacacatttgagtgctcctggattt

SEQ ID NO: 44551 - DNA, 35 bp, Artificial Sequence
  Synthetic oligonucleotide
tcctatgttgccacatcaggtttattctagccttt

SEQ ID NO: 44552 - DNA, 35 bp, Artificial Sequence
  Synthetic oligonucleotide
actacaccttactatccggcccccgaactacgttt

SEQ ID NO: 44553 - DNA, 35 bp, Artificial Sequence
  Synthetic oligonucleotide
gtttaacccgccccatttgacagctgtaggccaaa

SEQ ID NO: 44554 - DNA, 35 bp, Artificial Sequence
  Synthetic oligonucleotide
aagtagcaaggggggagacgcgtagtgttaggaaa

SEQ ID NO: 44555 - DNA, 35 bp, Artificial Sequence
  Synthetic oligonucleotide
taccgaatccgccgccaacgtgtccatcctggaaa

SEQ ID NO: 44556 - DNA, 35 bp, Artificial Sequence
  Synthetic oligonucleotide
gcataagaggacgcgatggtaatggggcgatagaa

SEQ ID NO: 44557 - DNA, 36 bp, Artificial Sequence
  Synthetic oligonucleotide
acccccctcaaactgccattcctgcttcggtacgaa

SEQ ID NO: 44558 - DNA, 36 bp, Artificial Sequence
  Synthetic oligonucleotide
gcggacccttccgacgctctgtagactcttatggaa

SEQ ID NO: 44559 - DNA, 35 bp, Artificial Sequence
  Synthetic oligonucleotide
acagtaccatcataggcttggcactgcttatttaa

SEQ ID NO: 44560 - DNA, 36 bp, Artificial Sequence
  Synthetic oligonucleotide
tgaatcacccgacgttcctgggccaacctatgagca

SEQ ID NO: 44561 - DNA, 36 bp, Artificial Sequence
  Synthetic oligonucleotide
tcgtatcacccttgcccgctgtccctgacgtagtca

SEQ ID NO: 44562 - DNA, 35 bp, Artificial Sequence
  Synthetic oligonucleotide
gtgaccgtcgtaggttttcaaattctctggtgtca

SEQ ID NO: 44563 - DNA, 37 bp, Artificial Sequence
  Synthetic oligonucleotide
ggggagggaaaaagcgggtttgacaccgaggaagaga

SEQ ID NO: 44564 - DNA, 37 bp, Artificial Sequence
  Synthetic oligonucleotide
gcaatcaccaaatgcgtacccgtacttcctccgtaga

SEQ ID NO: 44565 - DNA, 37 bp, Artificial Sequence
  Synthetic oligonucleotide
attccaccgctgtttcgcgtcttctatccttcttaga

SEQ ID NO: 44566 - DNA, 37 bp, Artificial Sequence
  Synthetic oligonucleotide
gcacgggtcgtagggaggagtgggcgggagactgcga

SEQ ID NO: 44567 - DNA, 37 bp, Artificial Sequence
  Synthetic oligonucleotide
gcaccacattaacactgggcccagttcatcttacgga

SEQ ID NO: 44568 - DNA, 37 bp, Artificial Sequence
  Synthetic oligonucleotide
atgcaagagcatcgggggttttaggggtggaaaggga

SEQ ID NO: 44569 - DNA, 37 bp, Artificial Sequence
  Synthetic oligonucleotide
gcgaactagtgggtagaggaagggggcgaggtgggga

SEQ ID NO: 44570 - DNA, 37 bp, Artificial Sequence
  Synthetic oligonucleotide
tgtcgatacggcactgatccgcctcatccaatactga

SEQ ID NO: 44571 - DNA, 38 bp, Artificial Sequence
  Synthetic oligonucleotide
accgcgatggtggttgggatgagggaagggtacggtga

SEQ ID NO: 44572 - DNA, 38 bp, Artificial Sequence
  Synthetic oligonucleotide
acgcctgccccaccttttttttaatgcagcacgattga

SEQ ID NO: 44573 - DNA, 38 bp, Artificial Sequence
  Synthetic oligonucleotide
tcatcgctttcatcatatgcattgttcccttgccttga

SEQ ID NO: 44574 - DNA, 38 bp, Artificial Sequence
  Synthetic oligonucleotide
tccgcctcatgtacaatgtcatcgctgcccccctttga

SEQ ID NO: 44575 - DNA, 38 bp, Artificial Sequence
  Synthetic oligonucleotide
tccggaggcctccgagctccgaacgacatcctgtttga

SEQ ID NO: 44576 - DNA, 38 bp, Artificial Sequence
  Synthetic oligonucleotide
gattgccagcccgcgacgcatcacggacttctttttga

SEQ ID NO: 44577 - DNA, 35 bp, Artificial Sequence
  Synthetic oligonucleotide
gtaactggcgcacctcggaatgaagccccacacta

SEQ ID NO: 44578 - DNA, 36 bp, Artificial Sequence
  Synthetic oligonucleotide
ttacctcgagggagggagaggggagggcggacagta

SEQ ID NO: 44579 - DNA, 35 bp, Artificial Sequence
  Synthetic oligonucleotide
tgctcctcacactgcctgagtacatggataaatta

SEQ ID NO: 44580 - DNA, 36 bp, Artificial Sequence
  Synthetic oligonucleotide
gtcgcccgggtgggggggagggtaagtccttgttta

SEQ ID NO: 44581 - DNA, 35 bp, Artificial Sequence
  Synthetic oligonucleotide
tgtgggcaccccgcctattgtaactcccgatcaac

SEQ ID NO: 44582 - DNA, 35 bp, Artificial Sequence
  Synthetic oligonucleotide
gctcacacgacccaccccgttttgattcccaggac

SEQ ID NO: 44583 - DNA, 35 bp, Artificial Sequence
  Synthetic oligonucleotide
agacacacacgaaacgccttcgggctcgccttccc

SEQ ID NO: 44584 - DNA, 35 bp, Artificial Sequence
  Synthetic oligonucleotide
ggtgccaacgtgaatccctgtctcgctgcattgcc

SEQ ID NO: 44585 - DNA, 33 bp, Artificial Sequence
  Synthetic oligonucleotide
accacccgaatacagacttcccgctaccagggc

SEQ ID NO: 44586 - DNA, 35 bp, Artificial Sequence
  Synthetic oligonucleotide
tcttccatcgctcatgagtacgttcacaccatggc

SEQ ID NO: 44587 - DNA, 35 bp, Artificial Sequence
  Synthetic oligonucleotide
attgagcagcttgcatccaatccctgtcccatggc

SEQ ID NO: 44588 - DNA, 35 bp, Artificial Sequence
  Synthetic oligonucleotide
aagctctaccgccaccactttcatgtaacgcgttc

SEQ ID NO: 44589 - DNA, 35 bp, Artificial Sequence
  Synthetic oligonucleotide
tcttaactgcggctcccactccgtcgacctccgag

SEQ ID NO: 44590 - DNA, 35 bp, Artificial Sequence
  Synthetic oligonucleotide
acgaatggagaatggaagggacggggccaccgtcg

SEQ ID NO: 44591 - DNA, 35 bp, Artificial Sequence
  Synthetic oligonucleotide
attccagccagcctacgcccacccattcagacgtg

SEQ ID NO: 44592 - DNA, 35 bp, Artificial Sequence
  Synthetic oligonucleotide
atgcggccagccctgttaatgatttcctcccggct

SEQ ID NO: 44593 - DNA, 35 bp, Artificial Sequence
  Synthetic oligonucleotide
atgcacccgacatctggcgccatcacattccgttt

SEQ ID NO: 44594 - DNA, 36 bp, Artificial Sequence
  Synthetic oligonucleotide
acacccccgatcggtctttggggcctgctaatccaa

SEQ ID NO: 44595 - DNA, 35 bp, Artificial Sequence
  Synthetic oligonucleotide
gccaaacactggttccatcacgtatagttatccaa

SEQ ID NO: 44596 - DNA, 35 bp, Artificial Sequence
  Synthetic oligonucleotide
gtcatgcacgggactcatggtgcattacccctgaa

SEQ ID NO: 44597 - DNA, 36 bp, Artificial Sequence
  Synthetic oligonucleotide
accacccgcaccgctagtgctatcgaacatgagtaa

SEQ ID NO: 44598 - DNA, 35 bp, Artificial Sequence
  Synthetic oligonucleotide
tgcttaagggccccgaacgacctacctctgctaca

SEQ ID NO: 44599 - DNA, 36 bp, Artificial Sequence
  Synthetic oligonucleotide
tcacaacggtcggttcaaacacagcttggtatgcca

SEQ ID NO: 44600 - DNA, 36 bp, Artificial Sequence
  Synthetic oligonucleotide
gatgtggaccgcctctgttgctatattgttcgttca

SEQ ID NO: 44601 - DNA, 36 bp, Artificial Sequence
  Synthetic oligonucleotide
taaacagggcggatttacgagtgagggaatgggaga

SEQ ID NO: 44602 - DNA, 37 bp, Artificial Sequence
  Synthetic oligonucleotide
gtacgccatataagaccgctacccccccttgttgaga

SEQ ID NO: 44603 - DNA, 35 bp, Artificial Sequence
  Synthetic oligonucleotide
ggacaggtgatctgcctttttcccacgatgaacga

SEQ ID NO: 44604 - DNA, 37 bp, Artificial Sequence
  Synthetic oligonucleotide
gagcacgcccacgcccgacacccgcccccggatccga

SEQ ID NO: 44605 - DNA, 37 bp, Artificial Sequence
  Synthetic oligonucleotide
accgcggtgcaaagtagtggaggatggggtgttcgga

SEQ ID NO: 44606 - DNA, 37 bp, Artificial Sequence
  Synthetic oligonucleotide
gcagtggggttgggcatggagatgtagggcaatggga

SEQ ID NO: 44607 - DNA, 35 bp, Artificial Sequence
  Synthetic oligonucleotide
gtacgccttgaagccccaccattaaatgccctgga

SEQ ID NO: 44608 - DNA, 37 bp, Artificial Sequence
  Synthetic oligonucleotide
agggaaaatgtagcaggaagggcgggaggtgacatga

SEQ ID NO: 44609 - DNA, 38 bp, Artificial Sequence
  Synthetic oligonucleotide
ttaggtccgcctcaccctgttcttcgcattctctatga

SEQ ID NO: 44610 - DNA, 37 bp, Artificial Sequence
  Synthetic oligonucleotide
gaccccctgccacacagctaatacgcgcgtatgctga

SEQ ID NO: 44611 - DNA, 35 bp, Artificial Sequence
  Synthetic oligonucleotide
gtgattgggaagtgatgcaaaaggtatgggggtga

SEQ ID NO: 44612 - DNA, 36 bp, Artificial Sequence
  Synthetic oligonucleotide
ttccccacggaagaatgatgtgggaggtgggggtga

SEQ ID NO: 44613 - DNA, 37 bp, Artificial Sequence
  Synthetic oligonucleotide
tcattcacctcatctgggcacagcaacgcaactgtga

SEQ ID NO: 44614 - DNA, 36 bp, Artificial Sequence
  Synthetic oligonucleotide
ttaggggcccaactgagctgcccgaaacacccttga

SEQ ID NO: 44615 - DNA, 37 bp, Artificial Sequence
  Synthetic oligonucleotide
tcctccctccgtatgggtaccacttaatttgctttga

SEQ ID NO: 44616 - DNA, 37 bp, Artificial Sequence
  Synthetic oligonucleotide
actctagccacatatcggctaccactgaactttttga

SEQ ID NO: 44617 - DNA, 36 bp, Artificial Sequence
  Synthetic oligonucleotide
gagatgatggtggcgggtggcgagggtgacaaccta

SEQ ID NO: 44618 - DNA, 36 bp, Artificial Sequence
  Synthetic oligonucleotide
gcacacgctgcgatatgccagctccgcttgatccta

SEQ ID NO: 44619 - DNA, 36 bp, Artificial Sequence
  Synthetic oligonucleotide
tagttcccacccccccttgtgtccattgattcttta

SEQ ID NO: 44620 - DNA, 35 bp, Artificial Sequence
  Synthetic oligonucleotide
ttatggcaacccagcatttatcactgtcttcgaac

SEQ ID NO: 44621 - DNA, 35 bp, Artificial Sequence
  Synthetic oligonucleotide
ttcaacgaccgtcatcttcattcaccgccagtcac

SEQ ID NO: 44622 - DNA, 35 bp, Artificial Sequence
  Synthetic oligonucleotide
gacgcaacgcgctagatccttgcggaaattacccc

SEQ ID NO: 44623 - DNA, 35 bp, Artificial Sequence
  Synthetic oligonucleotide
tattgcactctcgtagttgcgtactctctcagccc

SEQ ID NO: 44624 - DNA, 35 bp, Artificial Sequence
  Synthetic oligonucleotide
gacgccaccccactataccttccctggtaaggccc

SEQ ID NO: 44625 - DNA, 35 bp, Artificial Sequence
  Synthetic oligonucleotide
tgatcgacgccctaaaccctggtattggtcctgcc

SEQ ID NO: 44626 - DNA, 35 bp, Artificial Sequence
  Synthetic oligonucleotide
gtcccgcctcggcagtttttcgggccaaatcctcc

SEQ ID NO: 44627 - DNA, 35 bp, Artificial Sequence
  Synthetic oligonucleotide
gccaccactctcttattcggaccgtacggtcgagc

SEQ ID NO: 44628 - DNA, 35 bp, Artificial Sequence
  Synthetic oligonucleotide
atcacgaagatgggcaattgaaatgatggggcggg

SEQ ID NO: 44629 - DNA, 35 bp, Artificial Sequence
  Synthetic oligonucleotide
gacaatagggagccacgggaggggtaggtgttggg

SEQ ID NO: 44630 - DNA, 35 bp, Artificial Sequence
  Synthetic oligonucleotide
tctgagcgcccacagtttcctctcgtcgttttaat

SEQ ID NO: 44631 - DNA, 35 bp, Artificial Sequence
  Synthetic oligonucleotide
gcccgcctactgaattatgattgaactatgcccct

SEQ ID NO: 44632 - DNA, 35 bp, Artificial Sequence
  Synthetic oligonucleotide
ttcaccccccgctggccatagcccctcctacatgt

SEQ ID NO: 44633 - DNA, 35 bp, Artificial Sequence
  Synthetic oligonucleotide
tccgcgtagcgcaacgtaatgccgcctgtccgttt

SEQ ID NO: 44634 - DNA, 36 bp, Artificial Sequence
  Synthetic oligonucleotide
atcaccgccaagaatccacactccccgctctgacaa

SEQ ID NO: 44635 - DNA, 35 bp, Artificial Sequence
  Synthetic oligonucleotide
tatccgtccgctcggactctctctattattcccaa

SEQ ID NO: 44636 - DNA, 36 bp, Artificial Sequence
  Synthetic oligonucleotide
gcccacccaacttcgcaacaggccctacctccgaca

SEQ ID NO: 44637 - DNA, 35 bp, Artificial Sequence
  Synthetic oligonucleotide
acgcccccatccacacccgataggatcttccacca

SEQ ID NO: 44638 - DNA, 36 bp, Artificial Sequence
  Synthetic oligonucleotide
gacgtagcatatgccgcgcattattacatacttcca

SEQ ID NO: 44639 - DNA, 36 bp, Artificial Sequence
  Synthetic oligonucleotide
tactactcgtgcacttgtaccgcgctcccttttgca

SEQ ID NO: 44640 - DNA, 36 bp, Artificial Sequence
  Synthetic oligonucleotide
ggactccacatatcgccgtcctaaccagtcctgtca

SEQ ID NO: 44641 - DNA, 35 bp, Artificial Sequence
  Synthetic oligonucleotide
gaaccgatgccacctatcagtttggacttttgtca

SEQ ID NO: 44642 - DNA, 36 bp, Artificial Sequence
  Synthetic oligonucleotide
accgacggccccgagaattctgccttctctccttca

SEQ ID NO: 44643 - DNA, 37 bp, Artificial Sequence
  Synthetic oligonucleotide
taccctgacacatgactccttctggacctcccaaaga

SEQ ID NO: 44644 - DNA, 36 bp, Artificial Sequence
  Synthetic oligonucleotide
gaacaatccctcatcttggcgtggacccatcataga

SEQ ID NO: 44645 - DNA, 36 bp, Artificial Sequence
  Synthetic oligonucleotide
atctagcactgactacactaactgccctgtaaacga

SEQ ID NO: 44646 - DNA, 37 bp, Artificial Sequence
  Synthetic oligonucleotide
acaaagcacggtggcggaggcagtagattagggggga

SEQ ID NO: 44647 - DNA, 37 bp, Artificial Sequence
  Synthetic oligonucleotide
gcatgtgtaatgtgggctgtggaggtattgggctgga

SEQ ID NO: 44648 - DNA, 38 bp, Artificial Sequence
  Synthetic oligonucleotide
attccccgttcacccggcactgccactgtactgcatga

SEQ ID NO: 44649 - DNA, 38 bp, Artificial Sequence
  Synthetic oligonucleotide
tgaagggcgaggagggaatacgggagtcactcagatga

SEQ ID NO: 44650 - DNA, 38 bp, Artificial Sequence
  Synthetic oligonucleotide
gagtggtggggatcaagcagaggcacagacaggtatga

SEQ ID NO: 44651 - DNA, 38 bp, Artificial Sequence
  Synthetic oligonucleotide
atcccgccgaacctgccctacccgagccgtcgcactga

SEQ ID NO: 44652 - DNA, 38 bp, Artificial Sequence
  Synthetic oligonucleotide
acaggcccctcgccgaacctgaaagccgatccccctga

SEQ ID NO: 44653 - DNA, 37 bp, Artificial Sequence
  Synthetic oligonucleotide
aacagacactctaatggttgccacacttcatttctga

SEQ ID NO: 44654 - DNA, 38 bp, Artificial Sequence
  Synthetic oligonucleotide
agaagaggaatgggctgcaaggggttgggacggggtga

SEQ ID NO: 44655 - DNA, 38 bp, Artificial Sequence
  Synthetic oligonucleotide
ggtaccacccctctcctcttgattggacacatctttga

SEQ ID NO: 44656 - DNA, 37 bp, Artificial Sequence
  Synthetic oligonucleotide
tggggacgctccatttggcattaggttttttttttga

SEQ ID NO: 44657 - DNA, 35 bp, Artificial Sequence
  Synthetic oligonucleotide
gccacaccagcacatatccgctgctaacggaccta

SEQ ID NO: 44658 - DNA, 36 bp, Artificial Sequence
  Synthetic oligonucleotide
tctaccccgcactctgttttccatctaatctgggta

SEQ ID NO: 44659 - DNA, 35 bp, Artificial Sequence
  Synthetic oligonucleotide
tcacagcacgtggcacatgctgttttcctgtgtac

SEQ ID NO: 44660 - DNA, 35 bp, Artificial Sequence
  Synthetic oligonucleotide
actcctgctacaagcttggtgcaaaccgttctacc

SEQ ID NO: 44661 - DNA, 35 bp, Artificial Sequence
  Synthetic oligonucleotide
ttgccgagcacctcctagtgaaacgccctaccgcc

SEQ ID NO: 44662 - DNA, 35 bp, Artificial Sequence
  Synthetic oligonucleotide
tgtctcgcgtttgccctttagcgtcactatcatcc

SEQ ID NO: 44663 - DNA, 35 bp, Artificial Sequence
  Synthetic oligonucleotide
ttgtcgccgagaacggtctgggtgcggtcttctcc

SEQ ID NO: 44664 - DNA, 35 bp, Artificial Sequence
  Synthetic oligonucleotide
gatgaacacgaaactgcattagcgctagcactggc

SEQ ID NO: 44665 - DNA, 35 bp, Artificial Sequence
  Synthetic oligonucleotide
aacccgcgtactccctccgtcaggcacacaccatc

SEQ ID NO: 44666 - DNA, 35 bp, Artificial Sequence
  Synthetic oligonucleotide
atacaccccttggcatattggtcaccggaccggtc

SEQ ID NO: 44667 - DNA, 35 bp, Artificial Sequence
  Synthetic oligonucleotide
tgccatgccgcctgtttcaccaggagttcttacgg

SEQ ID NO: 44668 - DNA, 35 bp, Artificial Sequence
  Synthetic oligonucleotide
atgaaagcgatccgtagtcctccaaatacctcttg

SEQ ID NO: 44669 - DNA, 35 bp, Artificial Sequence
  Synthetic oligonucleotide
aacatgtctgtcgaaacatttcctccgtccttgct

SEQ ID NO: 44670 - DNA, 35 bp, Artificial Sequence
  Synthetic oligonucleotide
ggttgctcgcactgtcttgtaacctctgctcatct

SEQ ID NO: 44671 - DNA, 35 bp, Artificial Sequence
  Synthetic oligonucleotide
ggaccatgtgatggccatcttatacttgtaccatt

SEQ ID NO: 44672 - DNA, 35 bp, Artificial Sequence
  Synthetic oligonucleotide
gtacccggttcgctcgccactgctacccccctatt

SEQ ID NO: 44673 - DNA, 35 bp, Artificial Sequence
  Synthetic oligonucleotide
gtcccgaggtccgttgcctttcatctcacaagttt

SEQ ID NO: 44674 - DNA, 36 bp, Artificial Sequence
  Synthetic oligonucleotide
gtcgacgcagtgccctttcggttttctccgctcaaa

SEQ ID NO: 44675 - DNA, 36 bp, Artificial Sequence
  Synthetic oligonucleotide
acattctcaacgcccctgttgtttcctccacgacaa

SEQ ID NO: 44676 - DNA, 36 bp, Artificial Sequence
  Synthetic oligonucleotide
tagtacaccgtaactccgcattatcccttgccgcaa

SEQ ID NO: 44677 - DNA, 36 bp, Artificial Sequence
  Synthetic oligonucleotide
gtgtagccacctgcatacggaaacccctctgttcaa

SEQ ID NO: 44678 - DNA, 35 bp, Artificial Sequence
  Synthetic oligonucleotide
gcccatggatgtgggctgggggagggggggctaca

SEQ ID NO: 44679 - DNA, 35 bp, Artificial Sequence
  Synthetic oligonucleotide
tttgactcccatggccaccgattcgaataattcca

SEQ ID NO: 44680 - DNA, 35 bp, Artificial Sequence
  Synthetic oligonucleotide
gtccaggtcccggggcgcatcaatattttcttcca

SEQ ID NO: 44681 - DNA, 36 bp, Artificial Sequence
  Synthetic oligonucleotide
atgacgcctcccaccgttcaccaagaatacctggca

SEQ ID NO: 44682 - DNA, 35 bp, Artificial Sequence
  Synthetic oligonucleotide
tccaacagcactctggcacggcatacaatatctca

SEQ ID NO: 44683 - DNA, 37 bp, Artificial Sequence
  Synthetic oligonucleotide
gttccgtttcggcgcacactccccgcttctttcgaga

SEQ ID NO: 44684 - DNA, 37 bp, Artificial Sequence
  Synthetic oligonucleotide
tacgcctcggcgcccccgttctaatcttctgacgcga

SEQ ID NO: 44685 - DNA, 37 bp, Artificial Sequence
  Synthetic oligonucleotide
tgtgcttatcactggttttagctcgtacccctctcga

SEQ ID NO: 44686 - DNA, 36 bp, Artificial Sequence
  Synthetic oligonucleotide
gatgcacacctcttcccgcgccccctagacgttcga

SEQ ID NO: 44687 - DNA, 37 bp, Artificial Sequence
  Synthetic oligonucleotide
gacacctcaaggtgatcatgcgccctacctcacagga

SEQ ID NO: 44688 - DNA, 37 bp, Artificial Sequence
  Synthetic oligonucleotide
tatgccacgtcctctcgctatattttgtcatcccgga

SEQ ID NO: 44689 - DNA, 37 bp, Artificial Sequence
  Synthetic oligonucleotide
ttgagtaaggccgtgggagtgggtggaattggctgga

SEQ ID NO: 44690 - DNA, 37 bp, Artificial Sequence
  Synthetic oligonucleotide
acatggaactggtgggtgggagggatgttacagatga

SEQ ID NO: 44691 - DNA, 36 bp, Artificial Sequence
  Synthetic oligonucleotide
tgagaccatcgggcgggtgcggggggtcattgatga

SEQ ID NO: 44692 - DNA, 38 bp, Artificial Sequence
  Synthetic oligonucleotide
gcatgcacaggcgcactgaaccacatctcggctactga

SEQ ID NO: 44693 - DNA, 37 bp, Artificial Sequence
  Synthetic oligonucleotide
gtgcatccacctttagagttcgagtgatccctcctga

SEQ ID NO: 44694 - DNA, 38 bp, Artificial Sequence
  Synthetic oligonucleotide
ggtggggaagtggcaagggcccaggagcttgaatgtga

SEQ ID NO: 44695 - DNA, 36 bp, Artificial Sequence
  Synthetic oligonucleotide
gctggtgggagtcagggcgggttagaacaaggttga

SEQ ID NO: 44696 - DNA, 38 bp, Artificial Sequence
  Synthetic oligonucleotide
gtttacgccccagtagcccaccacctcaaactctttga

SEQ ID NO: 44697 - DNA, 36 bp, Artificial Sequence
  Synthetic oligonucleotide
tgacccgccttattgccttcgttacacctgcatata

SEQ ID NO: 44698 - DNA, 36 bp, Artificial Sequence
  Synthetic oligonucleotide
gactaaacgaggttgtcatgaaccgccccttttcta

SEQ ID NO: 44699 - DNA, 36 bp, Artificial Sequence
  Synthetic oligonucleotide
tgttcgggggaggggttggttaaaggtgtgcaatta

SEQ ID NO: 44700 - DNA, 35 bp, Artificial Sequence
  Synthetic oligonucleotide
atcccatccgtgcaccgcctggaatcccggagtta

SEQ ID NO: 44701 - DNA, 35 bp, Artificial Sequence
  Synthetic oligonucleotide
accttctccattgtgcatgcaccgaacacgctacc

SEQ ID NO: 44702 - DNA, 36 bp, Artificial Sequence
  Synthetic oligonucleotide
gcgagagctctgacaccaaagttctggcccagtccc

SEQ ID NO: 44703 - DNA, 33 bp, Artificial Sequence
  Synthetic oligonucleotide
gggcaaactgcattggaactcacaccctctgcc

SEQ ID NO: 44704 - DNA, 35 bp, Artificial Sequence
  Synthetic oligonucleotide
gatctcctcgcatcacgtttgaaacattttgctcc

SEQ ID NO: 44705 - DNA, 35 bp, Artificial Sequence
  Synthetic oligonucleotide
acacacgacaaagttattagctcgacgtgaattcc

SEQ ID NO: 44706 - DNA, 35 bp, Artificial Sequence
  Synthetic oligonucleotide
acttgggccctctgactctgctccctctaagcagc

SEQ ID NO: 44707 - DNA, 35 bp, Artificial Sequence
  Synthetic oligonucleotide
tcctacatcaagacaaccactggtactcgctacgc

SEQ ID NO: 44708 - DNA, 35 bp, Artificial Sequence
  Synthetic oligonucleotide
gccaccctcattatacataccatcacttcaaatgc

SEQ ID NO: 44709 - DNA, 35 bp, Artificial Sequence
  Synthetic oligonucleotide
tcaccgtgctcctgtggttctcgtgctcctggtgc

SEQ ID NO: 44710 - DNA, 35 bp, Artificial Sequence
  Synthetic oligonucleotide
tcaaccagccactcaacgaacgtaataattacctc

SEQ ID NO: 44711 - DNA, 35 bp, Artificial Sequence
  Synthetic oligonucleotide
gagcgcaaccccgagtctcttacctttcacctcag

SEQ ID NO: 44712 - DNA, 35 bp, Artificial Sequence
  Synthetic oligonucleotide
ggattcatctccgctccacctcacgcgagacctcg

SEQ ID NO: 44713 - DNA, 35 bp, Artificial Sequence
  Synthetic oligonucleotide
ggtcaagaccacgcatccgcattcctcacctgggg

SEQ ID NO: 44714 - DNA, 35 bp, Artificial Sequence
  Synthetic oligonucleotide
agaccccttcacactgagctagctcccgtccgcat

SEQ ID NO: 44715 - DNA, 35 bp, Artificial Sequence
  Synthetic oligonucleotide
ttcgccctacgcccatcgctgcattaccgtacact

SEQ ID NO: 44716 - DNA, 35 bp, Artificial Sequence
  Synthetic oligonucleotide
accctgccacgtccagcctatcaaagtcacgcgct

SEQ ID NO: 44717 - DNA, 35 bp, Artificial Sequence
  Synthetic oligonucleotide
acctgatcgcgggtatcaaagtcctgccacattct

SEQ ID NO: 44718 - DNA, 35 bp, Artificial Sequence
  Synthetic oligonucleotide
gtgtaccgtacgctgcgtaatctccttccaatcgt

SEQ ID NO: 44719 - DNA, 35 bp, Artificial Sequence
  Synthetic oligonucleotide
agtccccacctttatcctaaggcccttcccatggt

SEQ ID NO: 44720 - DNA, 35 bp, Artificial Sequence
  Synthetic oligonucleotide
atccagcggtgagtctcttttttcctgtgctagtt

SEQ ID NO: 44721 - DNA, 36 bp, Artificial Sequence
  Synthetic oligonucleotide
tctacccgtccgctcccaccgtagttgcacgcataa

SEQ ID NO: 44722 - DNA, 36 bp, Artificial Sequence
  Synthetic oligonucleotide
ttagcccgacggccacaaacgaccacgtcccaagca

SEQ ID NO: 44723 - DNA, 37 bp, Artificial Sequence
  Synthetic oligonucleotide
ttctcctctgccgtgatctctactcgtcacacataga

SEQ ID NO: 44724 - DNA, 37 bp, Artificial Sequence
  Synthetic oligonucleotide
gctctcacgaactcgcatacacctgtggttccaccga

SEQ ID NO: 44725 - DNA, 36 bp, Artificial Sequence
  Synthetic oligonucleotide
gcaccctactccagcgtaacgttttctcgcacccga

SEQ ID NO: 44726 - DNA, 37 bp, Artificial Sequence
  Synthetic oligonucleotide
atgtccggtgacgcgtgcttcaaaaatcctctctcga

SEQ ID NO: 44727 - DNA, 38 bp, Artificial Sequence
  Synthetic oligonucleotide
atgctcggctggtgtggggggcaggatggcacggatga

SEQ ID NO: 44728 - DNA, 38 bp, Artificial Sequence
  Synthetic oligonucleotide
actagcacatctgccctgctgctatctatctgtactga

SEQ ID NO: 44729 - DNA, 38 bp, Artificial Sequence
  Synthetic oligonucleotide
tcgataccgttcggcccgtgacgtcgcttcacccctga

SEQ ID NO: 44730 - DNA, 38 bp, Artificial Sequence
  Synthetic oligonucleotide
ggaggtcgaccgagttactccatacctctcatgcctga

SEQ ID NO: 44731 - DNA, 38 bp, Artificial Sequence
  Synthetic oligonucleotide
gcccccccgaccccgcaaaagatcagaacctcaagtga

SEQ ID NO: 44732 - DNA, 38 bp, Artificial Sequence
  Synthetic oligonucleotide
tgagacgtgtgggggcggaaatgaacaagaacgggtga

SEQ ID NO: 44733 - DNA, 37 bp, Artificial Sequence
  Synthetic oligonucleotide
actcgataccgccacttctgttaactcctctgggtga

SEQ ID NO: 44734 - DNA, 37 bp, Artificial Sequence
  Synthetic oligonucleotide
ttcaccctgacccgttacgctgcactgcttgctgtga

SEQ ID NO: 44735 - DNA, 36 bp, Artificial Sequence
  Synthetic oligonucleotide
acgtcgcccacactcagctctgaattctatctgtga

SEQ ID NO: 44736 - DNA, 38 bp, Artificial Sequence
  Synthetic oligonucleotide
caaccacccctgctgtgcccgcgccctcatttccttga

SEQ ID NO: 44737 - DNA, 38 bp, Artificial Sequence
  Synthetic oligonucleotide
actctcgccacacgcaatctagtccccgcccagcttga

SEQ ID NO: 44738 - DNA, 36 bp, Artificial Sequence
  Synthetic oligonucleotide
gcaatccatgtcacacgcccacgttcactcctccta

SEQ ID NO: 44739 - DNA, 36 bp, Artificial Sequence
  Synthetic oligonucleotide
acaaaccgccgccgatgccattgtgccacaacatta

SEQ ID NO: 44740 - DNA, 36 bp, Artificial Sequence
  Synthetic oligonucleotide
gacacctaactgccaacgtgagcacaactgtcctta

SEQ ID NO: 44741 - DNA, 35 bp, Artificial Sequence
  Synthetic oligonucleotide
accaccgagtgctgggctggttgagcacttgacac

SEQ ID NO: 44742 - DNA, 35 bp, Artificial Sequence
  Synthetic oligonucleotide
atccaggcctaactctgttgctctttgctgttcac

SEQ ID NO: 44743 - DNA, 35 bp, Artificial Sequence
  Synthetic oligonucleotide
gcacacaagcgagataacagcacgctgccgactac

SEQ ID NO: 44744 - DNA, 35 bp, Artificial Sequence
  Synthetic oligonucleotide
tgtgcaggaactcacgttgccgtccccgcttcacc

SEQ ID NO: 44745 - DNA, 35 bp, Artificial Sequence
  Synthetic oligonucleotide
actaggccgttaccaggctcggcaacacttttacc

SEQ ID NO: 44746 - DNA, 35 bp, Artificial Sequence
  Synthetic oligonucleotide
agtccgatatgcctggtaagcaccctcaatcctcc

SEQ ID NO: 44747 - DNA, 35 bp, Artificial Sequence
  Synthetic oligonucleotide
gcagatgcgggctgtctcctctgctttatcgctcc

SEQ ID NO: 44748 - DNA, 36 bp, Artificial Sequence
  Synthetic oligonucleotide
ttataaccagcagccttcgtttcgctaccattttcc

SEQ ID NO: 44749 - DNA, 35 bp, Artificial Sequence
  Synthetic oligonucleotide
tgttctggcgggtggggagggtcggaacgggaagc

SEQ ID NO: 44750 - DNA, 35 bp, Artificial Sequence
  Synthetic oligonucleotide
gtgactacattcttgatccctcctgtcttagtagc

SEQ ID NO: 44751 - DNA, 35 bp, Artificial Sequence
  Synthetic oligonucleotide
gacccccgcactatggttctcaacacctatcccgc

SEQ ID NO: 44752 - DNA, 35 bp, Artificial Sequence
  Synthetic oligonucleotide
ttacttcacagacagtgtaagtcccacctccactc

SEQ ID NO: 44753 - DNA, 35 bp, Artificial Sequence
  Synthetic oligonucleotide
tgattgcgatgaactggcctacctcttactacctc

SEQ ID NO: 44754 - DNA, 35 bp, Artificial Sequence
  Synthetic oligonucleotide
gttgtcgggggggggcatggggaacacttataatg

SEQ ID NO: 44755 - DNA, 35 bp, Artificial Sequence
  Synthetic oligonucleotide
atctcggcacagttcaccatatcctgaagcaacat

SEQ ID NO: 44756 - DNA, 35 bp, Artificial Sequence
  Synthetic oligonucleotide
taatgcacgcgttctttattgcagccctcacctat

SEQ ID NO: 44757 - DNA, 35 bp, Artificial Sequence
  Synthetic oligonucleotide
gtgcctagctcgcctactcgtgttttttctcctat

SEQ ID NO: 44758 - DNA, 35 bp, Artificial Sequence
  Synthetic oligonucleotide
tcctatcacgactttgcgacccaatggtacgccct

SEQ ID NO: 44759 - DNA, 35 bp, Artificial Sequence
  Synthetic oligonucleotide
tatcacgcgggcttcttctgccctttggttttcct

SEQ ID NO: 44760 - DNA, 35 bp, Artificial Sequence
  Synthetic oligonucleotide
taagggccacctcgctccatagcattcgaccggtt

SEQ ID NO: 44761 - DNA, 36 bp, Artificial Sequence
  Synthetic oligonucleotide
gtgagtcgagggaccatcaagggggggaaacgaaaa

SEQ ID NO: 44762 - DNA, 35 bp, Artificial Sequence
  Synthetic oligonucleotide
gaatgcacaggggaaaactagttacggagtgagaa

SEQ ID NO: 44763 - DNA, 36 bp, Artificial Sequence
  Synthetic oligonucleotide
gccccccgccgtatcattagagcgggtcactaacca

SEQ ID NO: 44764 - DNA, 36 bp, Artificial Sequence
  Synthetic oligonucleotide
gccatcacacgccaaacgagcaagacgttgttgcca

SEQ ID NO: 44765 - DNA, 36 bp, Artificial Sequence
  Synthetic oligonucleotide
ccaccgttcgcttgctcgcccctgttctctttggca

SEQ ID NO: 44766 - DNA, 36 bp, Artificial Sequence
  Synthetic oligonucleotide
gacaaaaacggaaggagggttggacgtggccatgca

SEQ ID NO: 44767 - DNA, 36 bp, Artificial Sequence
  Synthetic oligonucleotide
gtggagaccacattcggcataatcacttctcctgca

SEQ ID NO: 44768 - DNA, 36 bp, Artificial Sequence
  Synthetic oligonucleotide
gaagaccggtcgctgctaattttgtctttcttatca

SEQ ID NO: 44769 - DNA, 37 bp, Artificial Sequence
  Synthetic oligonucleotide
aaataggcgaggtgtccaacgtgggggtggggcaaga

SEQ ID NO: 44770 - DNA, 36 bp, Artificial Sequence
  Synthetic oligonucleotide
tcctaaccacctgcgtcttttaaccgccctctccga

SEQ ID NO: 44771 - DNA, 37 bp, Artificial Sequence
  Synthetic oligonucleotide
tctgagccgcctcttgaatgacctcacaccgaatcga

SEQ ID NO: 44772 - DNA, 35 bp, Artificial Sequence
  Synthetic oligonucleotide
gactacacttcgcacgttaattcagcacccctcga

SEQ ID NO: 44773 - DNA, 37 bp, Artificial Sequence
  Synthetic oligonucleotide
aataccaccaacgactcgtctctcgctccgtgctcga

SEQ ID NO: 44774 - DNA, 36 bp, Artificial Sequence
  Synthetic oligonucleotide
tgatcggtatgtgctacgtactctctttcccttcga

SEQ ID NO: 44775 - DNA, 37 bp, Artificial Sequence
  Synthetic oligonucleotide
gaacgttggggagggttacactgggagggatctagga

SEQ ID NO: 44776 - DNA, 37 bp, Artificial Sequence
  Synthetic oligonucleotide
gactcccgtaaacctcttcccagactgctcttgggga

SEQ ID NO: 44777 - DNA, 37 bp, Artificial Sequence
  Synthetic oligonucleotide
gaagcgcaacctatcgtcactctcctctcttattgga

SEQ ID NO: 44778 - DNA, 37 bp, Artificial Sequence
  Synthetic oligonucleotide
ggagtgctgcaaaagggtaggtagattggtggtatga

SEQ ID NO: 44779 - DNA, 38 bp, Artificial Sequence
  Synthetic oligonucleotide
tgccactctccacactcgatttttggtctggctcctga

SEQ ID NO: 44780 - DNA, 38 bp, Artificial Sequence
  Synthetic oligonucleotide
accataaccgtagggtatgcacatcctagaccagctga

SEQ ID NO: 44781 - DNA, 38 bp, Artificial Sequence
  Synthetic oligonucleotide
agacccgcccccgctccccgtacagattgtccggctga

SEQ ID NO: 44782 - DNA, 37 bp, Artificial Sequence
  Synthetic oligonucleotide
tccgaaccggcaatactgttctatgttcttcttctga

SEQ ID NO: 44783 - DNA, 38 bp, Artificial Sequence
  Synthetic oligonucleotide
atgcccctactctttgtccctgacacgtccttatgtga

SEQ ID NO: 44784 - DNA, 38 bp, Artificial Sequence
  Synthetic oligonucleotide
aaaaagtgagtgggagggtgttgttggtgtgagtgtga

SEQ ID NO: 44785 - DNA, 38 bp, Artificial Sequence
  Synthetic oligonucleotide
gaagggcgggtctagaatggtagcatgggtgggattga

SEQ ID NO: 44786 - DNA, 38 bp, Artificial Sequence
  Synthetic oligonucleotide
ccgtaccgaaacgggagttcacaagcgcacttccttga

SEQ ID NO: 44787 - DNA, 36 bp, Artificial Sequence
  Synthetic oligonucleotide
ttccgatacgaacctgatctgtttactttctcccta

SEQ ID NO: 44788 - DNA, 36 bp, Artificial Sequence
  Synthetic oligonucleotide
tctgctcacctcactccctatcttactttgcgagta

SEQ ID NO: 44789 - DNA, 36 bp, Artificial Sequence
  Synthetic oligonucleotide
tgaccactactgtggtacccggtctagaacaccgta

SEQ ID NO: 44790 - DNA, 36 bp, Artificial Sequence
  Synthetic oligonucleotide
agcaacacgcgcaactaactcgatcccgcacccgta

SEQ ID NO: 44791 - DNA, 35 bp, Artificial Sequence
  Synthetic oligonucleotide
gacgctctgcaagttaactgaaaccggcccttgta

SEQ ID NO: 44792 - DNA, 36 bp, Artificial Sequence
  Synthetic oligonucleotide
ttactccatcctcagtgagcatccccgtccacatta

SEQ ID NO: 44793 - DNA, 36 bp, Artificial Sequence
  Synthetic oligonucleotide
tgcattgatcctggcgataacagcctccccgcctta

SEQ ID NO: 44794 - DNA, 36 bp, Artificial Sequence
  Synthetic oligonucleotide
tggacgccaatacccatcgcgctggtactcccgtta

SEQ ID NO: 44795 - DNA, 35 bp, Artificial Sequence
  Synthetic oligonucleotide
attaccgcccgggtctatccaacgcacacaggtta

SEQ ID NO: 44796 - DNA, 36 bp, Artificial Sequence
  Synthetic oligonucleotide
acacatcaccgacccgaggggtctccaccgctgtta

SEQ ID NO: 44797 - DNA, 35 bp, Artificial Sequence
  Synthetic oligonucleotide
tcatcaagccaccgagctagtttcctgtatgcccc

SEQ ID NO: 44798 - DNA, 35 bp, Artificial Sequence
  Synthetic oligonucleotide
actggtgacacccattgtctctgaaaacctactcc

SEQ ID NO: 44799 - DNA, 35 bp, Artificial Sequence
  Synthetic oligonucleotide
agttgccgtccctatgccacctaatactttccggc

SEQ ID NO: 44800 - DNA, 35 bp, Artificial Sequence
  Synthetic oligonucleotide
gctcgttgtccgcctctcatgagccttcccgtggc

SEQ ID NO: 44801 - DNA, 35 bp, Artificial Sequence
  Synthetic oligonucleotide
ttgatgttacggtccccctcatccccacctattgc

SEQ ID NO: 44802 - DNA, 35 bp, Artificial Sequence
  Synthetic oligonucleotide
aattcaccagcaggaggtcatatcccgccctttgc

SEQ ID NO: 44803 - DNA, 35 bp, Artificial Sequence
  Synthetic oligonucleotide
tactgtactctcccgggccactctcgctcgtgctc

SEQ ID NO: 44804 - DNA, 35 bp, Artificial Sequence
  Synthetic oligonucleotide
atggggtgagtaagtgagggggtgtcgggagttag

SEQ ID NO: 44805 - DNA, 35 bp, Artificial Sequence
  Synthetic oligonucleotide
tgacccgaactacccgattctcaccatctcaaggg

SEQ ID NO: 44806 - DNA, 35 bp, Artificial Sequence
  Synthetic oligonucleotide
tatgcagacataacgccaatcacacacagaagggg

SEQ ID NO: 44807 - DNA, 35 bp, Artificial Sequence
  Synthetic oligonucleotide
tgtactgggcccaggggaaatgggacatactagtg

SEQ ID NO: 44808 - DNA, 35 bp, Artificial Sequence
  Synthetic oligonucleotide
atgttcggcccgagctgccccttaaaccctgctat

SEQ ID NO: 44809 - DNA, 35 bp, Artificial Sequence
  Synthetic oligonucleotide
aggaccctccctgctcgtccagcggtcatccaact

SEQ ID NO: 44810 - DNA, 35 bp, Artificial Sequence
  Synthetic oligonucleotide
atgcaccctcaacctgtgcgtgcattacattctct

SEQ ID NO: 44811 - DNA, 35 bp, Artificial Sequence
  Synthetic oligonucleotide
tgctaccactcatcgccttgagacgaagctattct

SEQ ID NO: 44812 - DNA, 35 bp, Artificial Sequence
  Synthetic oligonucleotide
acttaccaacagtgctgttcgccattcataccagt

SEQ ID NO: 44813 - DNA, 35 bp, Artificial Sequence
  Synthetic oligonucleotide
tccgtgtgcagaatttccaacaaccataaccctgt

SEQ ID NO: 44814 - DNA, 35 bp, Artificial Sequence
  Synthetic oligonucleotide
gaaacaccaggcttagcattgcggtacactttatt

SEQ ID NO: 44815 - DNA, 35 bp, Artificial Sequence
  Synthetic oligonucleotide
tgtgcggacgacttgattcgtccccaatatttttt

SEQ ID NO: 44816 - DNA, 35 bp, Artificial Sequence
  Synthetic oligonucleotide
atcagccgccaagctcatctgtttcttgccctgaa

SEQ ID NO: 44817 - DNA, 35 bp, Artificial Sequence
  Synthetic oligonucleotide
gtgattccgcattatacaccttgagtgtgaccaca

SEQ ID NO: 44818 - DNA, 36 bp, Artificial Sequence
  Synthetic oligonucleotide
gctccattcatcactgccatcacacgagtagggcca

SEQ ID NO: 44819 - DNA, 36 bp, Artificial Sequence
  Synthetic oligonucleotide
agcgtcgggggaggacgacgggaggacgggccggca

SEQ ID NO: 44820 - DNA, 36 bp, Artificial Sequence
  Synthetic oligonucleotide
gattgggtggtggtaggggaactatcaggggactca

SEQ ID NO: 44821 - DNA, 36 bp, Artificial Sequence
  Synthetic oligonucleotide
agaccaacgtcgacctgcgttcacctagtttcctca

SEQ ID NO: 44822 - DNA, 37 bp, Artificial Sequence
  Synthetic oligonucleotide
gaggaagggagcaaatccaggcggagaggacggaaga

SEQ ID NO: 44823 - DNA, 37 bp, Artificial Sequence
  Synthetic oligonucleotide
gaaacggggcaggggaaacctataatgcgggggaaga

SEQ ID NO: 44824 - DNA, 37 bp, Artificial Sequence
  Synthetic oligonucleotide
gattgggagtgggtaaaggaaggaatatacgggtcga

SEQ ID NO: 44825 - DNA, 36 bp, Artificial Sequence
  Synthetic oligonucleotide
atcctccactcgtctccttgctcccgtcctgcagga

SEQ ID NO: 44826 - DNA, 37 bp, Artificial Sequence
  Synthetic oligonucleotide
ttagccccactgaaaagtggacccacccccttgcgga

SEQ ID NO: 44827 - DNA, 37 bp, Artificial Sequence
  Synthetic oligonucleotide
ggtctcatgggaaagggtggaggaaatgggaggggga

SEQ ID NO: 44828 - DNA, 36 bp, Artificial Sequence
  Synthetic oligonucleotide
agcgcaccccttgcaacacctgcattatccttatga

SEQ ID NO: 44829 - DNA, 38 bp, Artificial Sequence
  Synthetic oligonucleotide
tcatccctcccccatgtttgaaggtcgatcgtaactga

SEQ ID NO: 44830 - DNA, 38 bp, Artificial Sequence
  Synthetic oligonucleotide
atcgcgaactgcatcatatctcgcccatgccttcctga

SEQ ID NO: 44831 - DNA, 38 bp, Artificial Sequence
  Synthetic oligonucleotide
gggtgggggccggaggtgggggtactaataggaggtga

SEQ ID NO: 44832 - DNA, 38 bp, Artificial Sequence
  Synthetic oligonucleotide
tgcgtcatcgcccccgttcggttcacatacctctttga

SEQ ID NO: 44833 - DNA, 37 bp, Artificial Sequence
  Synthetic oligonucleotide
tacatcacccgacctttgcgtagttctgcctgtttga

SEQ ID NO: 44834 - DNA, 35 bp, Artificial Sequence
  Synthetic oligonucleotide
acttgcgcttcctgcacgctgccatgacacccgta

SEQ ID NO: 44835 - DNA, 35 bp, Artificial Sequence
  Synthetic oligonucleotide
gaagggagaatcggtgggggggatcatgaagggta

SEQ ID NO: 44836 - DNA, 36 bp, Artificial Sequence
  Synthetic oligonucleotide
attgtgccagcgccccccgcgttccatgtatcgtta

SEQ ID NO: 44837 - DNA, 35 bp, Artificial Sequence
  Synthetic oligonucleotide
gcccccaacacccgcttccttggtttatcacacac

SEQ ID NO: 44838 - DNA, 35 bp, Artificial Sequence
  Synthetic oligonucleotide
ttgccagctagctagttcaattctcctcaatgccc

SEQ ID NO: 44839 - DNA, 35 bp, Artificial Sequence
  Synthetic oligonucleotide
taagcctcctacattgccctgattgcaacctcgcc

SEQ ID NO: 44840 - DNA, 35 bp, Artificial Sequence
  Synthetic oligonucleotide
tcatctctgtggtaggttcttcgctccggttcgcc

SEQ ID NO: 44841 - DNA, 35 bp, Artificial Sequence
  Synthetic oligonucleotide
accactgcacattcacatcaagcctttcttactcc

SEQ ID NO: 44842 - DNA, 35 bp, Artificial Sequence
  Synthetic oligonucleotide
agtgcacgagccccgtgctgggcgcaaccctcctc

SEQ ID NO: 44843 - DNA, 35 bp, Artificial Sequence
  Synthetic oligonucleotide
gtcatcgaagccctcccatccttctgattctgttc

SEQ ID NO: 44844 - DNA, 35 bp, Artificial Sequence
  Synthetic oligonucleotide
gctgagcgggtatgaaaggctgaacggtgggggag

SEQ ID NO: 44845 - DNA, 35 bp, Artificial Sequence
  Synthetic oligonucleotide
tctgcaggtaggggcttgggggtaagaaaattggg

SEQ ID NO: 44846 - DNA, 35 bp, Artificial Sequence
  Synthetic oligonucleotide
gtgaccgtgcggttgctattctcttcattcgtgtg

SEQ ID NO: 44847 - DNA, 35 bp, Artificial Sequence
  Synthetic oligonucleotide
tgcttccccgctaacgttcatgacctacaatcttg

SEQ ID NO: 44848 - DNA, 35 bp, Artificial Sequence
  Synthetic oligonucleotide
gtgacccctcgcctacgccgactcagccgggtaat

SEQ ID NO: 44849 - DNA, 35 bp, Artificial Sequence
  Synthetic oligonucleotide
tctccaccggtagatgtgccgaactctccacccgt

SEQ ID NO: 44850 - DNA, 35 bp, Artificial Sequence
  Synthetic oligonucleotide
agtacgtccgtagggcgaggagaggggggactcgt

SEQ ID NO: 44851 - DNA, 35 bp, Artificial Sequence
  Synthetic oligonucleotide
gatcaacctcggtgtggcttcttgttttacgcttt

SEQ ID NO: 44852 - DNA, 35 bp, Artificial Sequence
  Synthetic oligonucleotide
gatgcctccaataacatgacaatagtcccgctttt

SEQ ID NO: 44853 - DNA, 36 bp, Artificial Sequence
  Synthetic oligonucleotide
tcagcacgaaatgctcaggcctgcccagtccttaca

SEQ ID NO: 44854 - DNA, 35 bp, Artificial Sequence
  Synthetic oligonucleotide
atcccgcgaaattgccaagtcagacgcacttccca

SEQ ID NO: 44855 - DNA, 36 bp, Artificial Sequence
  Synthetic oligonucleotide
gtctaggcgggcttagcttaactgttccatcctcca

SEQ ID NO: 44856 - DNA, 36 bp, Artificial Sequence
  Synthetic oligonucleotide
acgtatccatcccctagtgctacccattgccatgca

SEQ ID NO: 44857 - DNA, 36 bp, Artificial Sequence
  Synthetic oligonucleotide
gcaacgggttagtttacgactctgcccttccaatca

SEQ ID NO: 44858 - DNA, 36 bp, Artificial Sequence
  Synthetic oligonucleotide
aagacgatgccgatcgcagtctcctacctgaactca

SEQ ID NO: 44859 - DNA, 35 bp, Artificial Sequence
  Synthetic oligonucleotide
gtcatgagcagttgcccattttctgatgcccctca

SEQ ID NO: 44860 - DNA, 37 bp, Artificial Sequence
  Synthetic oligonucleotide
acattcgcgccgccactccaccaatgccgactaccga

SEQ ID NO: 44861 - DNA, 36 bp, Artificial Sequence
  Synthetic oligonucleotide
ttgatactcactgacgaccgctaactgaccgcccga

SEQ ID NO: 44862 - DNA, 35 bp, Artificial Sequence
  Synthetic oligonucleotide
aaccagcctttctcgcagccaacactctttgccga

SEQ ID NO: 44863 - DNA, 35 bp, Artificial Sequence
  Synthetic oligonucleotide
ttggcccttaggtatttgaatgatttccctctcga

SEQ ID NO: 44864 - DNA, 36 bp, Artificial Sequence
  Synthetic oligonucleotide
gtcgagactgcaggtcaagggggatcgggggtggga

SEQ ID NO: 44865 - DNA, 36 bp, Artificial Sequence
  Synthetic oligonucleotide
tccccaacccgctcatggccgtaagaaccacgtgga

SEQ ID NO: 44866 - DNA, 37 bp, Artificial Sequence
  Synthetic oligonucleotide
gaccagggtgatggggccatttggtggaaggggtgga

SEQ ID NO: 44867 - DNA, 38 bp, Artificial Sequence
  Synthetic oligonucleotide
agcaagtcagtggtcccctgctgttgttccatccttga

SEQ ID NO: 44868 - DNA, 38 bp, Artificial Sequence
  Synthetic oligonucleotide
tacccccatctctcgattgacacattccaccgcgttga

SEQ ID NO: 44869 - DNA, 36 bp, Artificial Sequence
  Synthetic oligonucleotide
agcccatgcagatctagttactttccctatctttga

SEQ ID NO: 44870 - DNA, 36 bp, Artificial Sequence
  Synthetic oligonucleotide
gtactccatccaggctcaaacgacccgttccctata

SEQ ID NO: 44871 - DNA, 36 bp, Artificial Sequence
  Synthetic oligonucleotide
ttgcgcactacggtcgctgccgtaaattccacccta

SEQ ID NO: 44872 - DNA, 36 bp, Artificial Sequence
  Synthetic oligonucleotide
aacgccgccttccactttggtcccgcagccgagcta

SEQ ID NO: 44873 - DNA, 36 bp, Artificial Sequence
  Synthetic oligonucleotide
gattccctgcccgcctgtgcagcccaccattaagta

SEQ ID NO: 44874 - DNA, 35 bp, Artificial Sequence
  Synthetic oligonucleotide
acgccgacccctcgcactgttccttgccccgaaac

SEQ ID NO: 44875 - DNA, 35 bp, Artificial Sequence
  Synthetic oligonucleotide
atgatcttgcggcccggctccaaccccgaggtacc

SEQ ID NO: 44876 - DNA, 35 bp, Artificial Sequence
  Synthetic oligonucleotide
gaccgaacccgttacatgccctggcacccaaaccc

SEQ ID NO: 44877 - DNA, 35 bp, Artificial Sequence
  Synthetic oligonucleotide
tatcaggctcctaaatctgcgggtccctcacttcc

SEQ ID NO: 44878 - DNA, 31 bp, Artificial Sequence
  Synthetic oligonucleotide
aaccccacactagtgcttcacccgctcacgc

SEQ ID NO: 44879 - DNA, 35 bp, Artificial Sequence
  Synthetic oligonucleotide
tagttcgtccacaatctgagttttgctgttcccgc

SEQ ID NO: 44880 - DNA, 35 bp, Artificial Sequence
  Synthetic oligonucleotide
ggacccacacgctatcgtgataggtgatttcctgc

SEQ ID NO: 44881 - DNA, 35 bp, Artificial Sequence
  Synthetic oligonucleotide
tcagctcacctctccgcctttcgtacgtgctgtgc

SEQ ID NO: 44882 - DNA, 35 bp, Artificial Sequence
  Synthetic oligonucleotide
gaatgccgactccgaccgaaaatagcgttacttgc

SEQ ID NO: 44883 - DNA, 35 bp, Artificial Sequence
  Synthetic oligonucleotide
tccaccatccgcgctgacgccgcttattgcccctc

SEQ ID NO: 44884 - DNA, 35 bp, Artificial Sequence
  Synthetic oligonucleotide
gaaccccctccgcacaagcactacgaactaaagtc

SEQ ID NO: 44885 - DNA, 35 bp, Artificial Sequence
  Synthetic oligonucleotide
acatctcaccactccgctctatgaagaattgtgtc

SEQ ID NO: 44886 - DNA, 35 bp, Artificial Sequence
  Synthetic oligonucleotide
gccagaagccgaacctgcttcgatttgacctctcg

SEQ ID NO: 44887 - DNA, 35 bp, Artificial Sequence
  Synthetic oligonucleotide
gctctgcgaactattgcacccacctgccggtactg

SEQ ID NO: 44888 - DNA, 35 bp, Artificial Sequence
  Synthetic oligonucleotide
taccacctggccctgtcttacatcgactgctgtct

SEQ ID NO: 44889 - DNA, 35 bp, Artificial Sequence
  Synthetic oligonucleotide
agcctcccacctagcattaacactgacaatcacgt

SEQ ID NO: 44890 - DNA, 35 bp, Artificial Sequence
  Synthetic oligonucleotide
tgcaatgtctaaactcgtctgggtcaacctcctgt

SEQ ID NO: 44891 - DNA, 35 bp, Artificial Sequence
  Synthetic oligonucleotide
gttcgccatccgcactaggttacattgtccccatt

SEQ ID NO: 44892 - DNA, 35 bp, Artificial Sequence
  Synthetic oligonucleotide
atgactcccaggcgcccttatcgtctgtcgccatt

SEQ ID NO: 44893 - DNA, 35 bp, Artificial Sequence
  Synthetic oligonucleotide
atccacaacgggcgtatttccgactgcttcttctt

SEQ ID NO: 44894 - DNA, 35 bp, Artificial Sequence
  Synthetic oligonucleotide
tcgcacactctttatgtcggtcgaacgcctttttt

SEQ ID NO: 44895 - DNA, 36 bp, Artificial Sequence
  Synthetic oligonucleotide
atcgtgccattgcccttgatcgctggttatgtacaa

SEQ ID NO: 44896 - DNA, 36 bp, Artificial Sequence
  Synthetic oligonucleotide
atcccgcacagtaccgccgcttgccccgtccttcaa

SEQ ID NO: 44897 - DNA, 36 bp, Artificial Sequence
  Synthetic oligonucleotide
actaccccgttcatccttctcgagctcggtgacgaa

SEQ ID NO: 44898 - DNA, 36 bp, Artificial Sequence
  Synthetic oligonucleotide
tgcgcctggccgagtatcggtattcgctcttacaca

SEQ ID NO: 44899 - DNA, 36 bp, Artificial Sequence
  Synthetic oligonucleotide
actcacacagagcttgcggggtatgatccacccaca

SEQ ID NO: 44900 - DNA, 36 bp, Artificial Sequence
  Synthetic oligonucleotide
atatcacccacagcattttacggcgacccccaacca

SEQ ID NO: 44901 - DNA, 36 bp, Artificial Sequence
  Synthetic oligonucleotide
gtaccatgcacggatccccttattgttcggccctca

SEQ ID NO: 44902 - DNA, 36 bp, Artificial Sequence
  Synthetic oligonucleotide
ttttgcgcacccgttcgtttatgtctacccagctca

SEQ ID NO: 44903 - DNA, 37 bp, Artificial Sequence
  Synthetic oligonucleotide
tgaccctcattgacaatattgcgcttataatcctcga

SEQ ID NO: 44904 - DNA, 36 bp, Artificial Sequence
  Synthetic oligonucleotide
gtcactctccgatcgaaacttacgacaaactctcga

SEQ ID NO: 44905 - DNA, 37 bp, Artificial Sequence
  Synthetic oligonucleotide
acgcggaaggtctgtttcgccgctgccctcgtttcga

SEQ ID NO: 44906 - DNA, 37 bp, Artificial Sequence
  Synthetic oligonucleotide
atgagggacgaaggagtctaggcactgagagggagga

SEQ ID NO: 44907 - DNA, 37 bp, Artificial Sequence
  Synthetic oligonucleotide
agtacgccacctaattgttctgctgcatgttactgga

SEQ ID NO: 44908 - DNA, 38 bp, Artificial Sequence
  Synthetic oligonucleotide
gaacatgggcccagctgttttgatctctcccaccatga

SEQ ID NO: 44909 - DNA, 38 bp, Artificial Sequence
  Synthetic oligonucleotide
atgcccatcgcagcccagtactccactcgtacgtatga

SEQ ID NO: 44910 - DNA, 38 bp, Artificial Sequence
  Synthetic oligonucleotide
gtggggcaagggggggaaacgttcgaggcgcgcactga

SEQ ID NO: 44911 - DNA, 37 bp, Artificial Sequence
  Synthetic oligonucleotide
gccgcccgccttatgcgcttcgtatgtctatcactga

SEQ ID NO: 44912 - DNA, 38 bp, Artificial Sequence
  Synthetic oligonucleotide
gacactcccacctccagcttacaatcgagaccgactga

SEQ ID NO: 44913 - DNA, 36 bp, Artificial Sequence
  Synthetic oligonucleotide
aaccccttcagccattccaaggccccctgctcctga

SEQ ID NO: 44914 - DNA, 38 bp, Artificial Sequence
  Synthetic oligonucleotide
tacccatcatgcattggttgcatcttcttcttaattga

SEQ ID NO: 44915 - DNA, 38 bp, Artificial Sequence
  Synthetic oligonucleotide
tagccgaccacgccacgtttaacaactgccttacttga

SEQ ID NO: 44916 - DNA, 38 bp, Artificial Sequence
  Synthetic oligonucleotide
gcgaacgtagatgttctgggacgtgggtggggggttga

SEQ ID NO: 44917 - DNA, 36 bp, Artificial Sequence
  Synthetic oligonucleotide
ggataccgagttaaggaaaaggagcggggtggttga

SEQ ID NO: 44918 - DNA, 38 bp, Artificial Sequence
  Synthetic oligonucleotide
tgattgaggcgggggatagaggagggtgtacggtttga

SEQ ID NO: 44919 - DNA, 35 bp, Artificial Sequence
  Synthetic oligonucleotide
gcctacccgctatggtctgaaaccctccaggccta

SEQ ID NO: 44920 - DNA, 36 bp, Artificial Sequence
  Synthetic oligonucleotide
tttattccccagatctgtcctaggctcactttgcta

SEQ ID NO: 44921 - DNA, 36 bp, Artificial Sequence
  Synthetic oligonucleotide
actaccacccactaaagtatcgtgactgccctagta

SEQ ID NO: 44922 - DNA, 35 bp, Artificial Sequence
  Synthetic oligonucleotide
gccacactccccccactcttgtattcagcctggac

SEQ ID NO: 44923 - DNA, 35 bp, Artificial Sequence
  Synthetic oligonucleotide
tgccatccttgttctggacagaccccagctcgtac

SEQ ID NO: 44924 - DNA, 35 bp, Artificial Sequence
  Synthetic oligonucleotide
acatgcacctcatcttgccatggtgtaacatcgcc

SEQ ID NO: 44925 - DNA, 35 bp, Artificial Sequence
  Synthetic oligonucleotide
tgccaattccgagcgcttctgacccagcttctgcc

SEQ ID NO: 44926 - DNA, 35 bp, Artificial Sequence
  Synthetic oligonucleotide
ttggtcggtaggaccaacgtctttctttttacacg

SEQ ID NO: 44927 - DNA, 35 bp, Artificial Sequence
  Synthetic oligonucleotide
gatgacattggaaagggtgggagatgggacaaggg

SEQ ID NO: 44928 - DNA, 35 bp, Artificial Sequence
  Synthetic oligonucleotide
agaccgtgccatcctttctgttatgtctacaatat

SEQ ID NO: 44929 - DNA, 35 bp, Artificial Sequence
  Synthetic oligonucleotide
ttcagtcgtccacatttgactccttttgttcctat

SEQ ID NO: 44930 - DNA, 35 bp, Artificial Sequence
  Synthetic oligonucleotide
taccaacgacaaagggatctcccttctccgaccct

SEQ ID NO: 44931 - DNA, 35 bp, Artificial Sequence
  Synthetic oligonucleotide
acatctgtgcgatacgttcatacggtcacctagct

SEQ ID NO: 44932 - DNA, 35 bp, Artificial Sequence
  Synthetic oligonucleotide
tatccgataaccgccatgtttatattgccctcgct

SEQ ID NO: 44933 - DNA, 34 bp, Artificial Sequence
  Synthetic oligonucleotide
tccggacagaacaattccccacctcgccttggct

SEQ ID NO: 44934 - DNA, 35 bp, Artificial Sequence
  Synthetic oligonucleotide
aggtcgcgcgccatccaaacttcaccacactctct

SEQ ID NO: 44935 - DNA, 35 bp, Artificial Sequence
  Synthetic oligonucleotide
gccacctccgatcaatcccatataccggttacctt

SEQ ID NO: 44936 - DNA, 35 bp, Artificial Sequence
  Synthetic oligonucleotide
attgccccctcatgagtctttatcaggtttatttt

SEQ ID NO: 44937 - DNA, 36 bp, Artificial Sequence
  Synthetic oligonucleotide
tcctgctcccggggtacttgatcaccattgtttaaa

SEQ ID NO: 44938 - DNA, 36 bp, Artificial Sequence
  Synthetic oligonucleotide
atgctggaccctggtgtactcttcctgtccaactaa

SEQ ID NO: 44939 - DNA, 36 bp, Artificial Sequence
  Synthetic oligonucleotide
tctgagtcctggtccccctccgagctgtatgccaca

SEQ ID NO: 44940 - DNA, 36 bp, Artificial Sequence
  Synthetic oligonucleotide
taacccagcctcactaccagcacatatcttcttaca

SEQ ID NO: 44941 - DNA, 35 bp, Artificial Sequence
  Synthetic oligonucleotide
gagacaaaaacgtagggtaggtcacagcgagggca

SEQ ID NO: 44942 - DNA, 36 bp, Artificial Sequence
  Synthetic oligonucleotide
aacgcaacaggatgagtggatgggtagtcagggtca

SEQ ID NO: 44943 - DNA, 37 bp, Artificial Sequence
  Synthetic oligonucleotide
tcgctggccctcccatcttactcgtgtacgcattcga

SEQ ID NO: 44944 - DNA, 37 bp, Artificial Sequence
  Synthetic oligonucleotide
tagaacggggcagtacgggggaggaatcggtttcgga

SEQ ID NO: 44945 - DNA, 37 bp, Artificial Sequence
  Synthetic oligonucleotide
gctgggggagtgacatggaattgcggggatataggga

SEQ ID NO: 44946 - DNA, 37 bp, Artificial Sequence
  Synthetic oligonucleotide
atgggggggagagggaggtgatggccgctgtagggga

SEQ ID NO: 44947 - DNA, 38 bp, Artificial Sequence
  Synthetic oligonucleotide
attgacagtctcagcaccatctgggatcccatacatga

SEQ ID NO: 44948 - DNA, 38 bp, Artificial Sequence
  Synthetic oligonucleotide
gccagggggcgaaggtgggaggagaaggtgggcgatga

SEQ ID NO: 44949 - DNA, 38 bp, Artificial Sequence
  Synthetic oligonucleotide
agaaaagcgatctgcaataccaccgccgctatttatga

SEQ ID NO: 44950 - DNA, 38 bp, Artificial Sequence
  Synthetic oligonucleotide
acatacgcagtcactgtgagcaaagcgcacccccctga

SEQ ID NO: 44951 - DNA, 37 bp, Artificial Sequence
  Synthetic oligonucleotide
attcctcagcccatcgacacgccctgtctttttctga

SEQ ID NO: 44952 - DNA, 38 bp, Artificial Sequence
  Synthetic oligonucleotide
acagccaagcaatgcacatcaccgcctactcctattga

SEQ ID NO: 44953 - DNA, 38 bp, Artificial Sequence
  Synthetic oligonucleotide
tgcagggaggggacgggagggcacaactcggcctttga

SEQ ID NO: 44954 - DNA, 36 bp, Artificial Sequence
  Synthetic oligonucleotide
aggagaaacgcagaattgggcggggggggtatgata

SEQ ID NO: 44955 - DNA, 35 bp, Artificial Sequence
  Synthetic oligonucleotide
ggttcatcacagtcaaatataccgtccctgctcta

SEQ ID NO: 44956 - DNA, 36 bp, Artificial Sequence
  Synthetic oligonucleotide
gcctcgcatcgtgcgcacttctccggtgactccgta

SEQ ID NO: 44957 - DNA, 36 bp, Artificial Sequence
  Synthetic oligonucleotide
actcacggcaatccctactactgttaccactcctta

SEQ ID NO: 44958 - DNA, 35 bp, Artificial Sequence
  Synthetic oligonucleotide
ttacgtccttgcatcgattttgttccttggctcac

SEQ ID NO: 44959 - DNA, 35 bp, Artificial Sequence
  Synthetic oligonucleotide
tacatccgatcgccggaatatgctaacttttcccc

SEQ ID NO: 44960 - DNA, 35 bp, Artificial Sequence
  Synthetic oligonucleotide
acaccaaagacggtgtggcgaatatgctctatccc

SEQ ID NO: 44961 - DNA, 35 bp, Artificial Sequence
  Synthetic oligonucleotide
taggatagccctctcacataacgtggacgcttccc

SEQ ID NO: 44962 - DNA, 35 bp, Artificial Sequence
  Synthetic oligonucleotide
gttcgtcccccatgtcctccttctgagaatgcgcc

SEQ ID NO: 44963 - DNA, 35 bp, Artificial Sequence
  Synthetic oligonucleotide
tcgaactggcacacgcattttcacagtcacaacgc

SEQ ID NO: 44964 - DNA, 35 bp, Artificial Sequence
  Synthetic oligonucleotide
gccactttcccatgccctttctacagccacgactc

SEQ ID NO: 44965 - DNA, 35 bp, Artificial Sequence
  Synthetic oligonucleotide
tctcgaccgatacaaatcttgaaacacgttatttc

SEQ ID NO: 44966 - DNA, 35 bp, Artificial Sequence
  Synthetic oligonucleotide
gcaccgcaggactctccacctcactaagccctcag

SEQ ID NO: 44967 - DNA, 35 bp, Artificial Sequence
  Synthetic oligonucleotide
agcgggtggagtgggcgggtagcgggttcatgacg

SEQ ID NO: 44968 - DNA, 35 bp, Artificial Sequence
  Synthetic oligonucleotide
acttccagagcgtgacctccttatcataccatacg

SEQ ID NO: 44969 - DNA, 35 bp, Artificial Sequence
  Synthetic oligonucleotide
ttcccgacctcaactcgttacttgctcctctttcg

SEQ ID NO: 44970 - DNA, 35 bp, Artificial Sequence
  Synthetic oligonucleotide
gtccatctacgacgtgggctacaagtacttcatct

SEQ ID NO: 44971 - DNA, 35 bp, Artificial Sequence
  Synthetic oligonucleotide
ttgcacccaccaattctagtgctcccttagcctgt

SEQ ID NO: 44972 - DNA, 35 bp, Artificial Sequence
  Synthetic oligonucleotide
gccccgttcgtcgcctgccccccgcctgttgtttt

SEQ ID NO: 44973 - DNA, 36 bp, Artificial Sequence
  Synthetic oligonucleotide
tgacccgttctaaatgctacccccagcacctcgcaa

SEQ ID NO: 44974 - DNA, 36 bp, Artificial Sequence
  Synthetic oligonucleotide
tgaacctgacattgggaccttacctgactttttgaa

SEQ ID NO: 44975 - DNA, 36 bp, Artificial Sequence
  Synthetic oligonucleotide
tttcccacgccacgttgctaatactatccaatataa

SEQ ID NO: 44976 - DNA, 36 bp, Artificial Sequence
  Synthetic oligonucleotide
tttcggagggtgggtgagggctaaattccgggaaca

SEQ ID NO: 44977 - DNA, 35 bp, Artificial Sequence
  Synthetic oligonucleotide
tgcgacatctccaccgaactcatagaaactgccca

SEQ ID NO: 44978 - DNA, 36 bp, Artificial Sequence
  Synthetic oligonucleotide
tgatgctcctctgactccgcaagacctctacaatca

SEQ ID NO: 44979 - DNA, 37 bp, Artificial Sequence
  Synthetic oligonucleotide
gatatggcaaatgtgaaccgtttccctcgtcctccga

SEQ ID NO: 44980 - DNA, 37 bp, Artificial Sequence
  Synthetic oligonucleotide
gaccagggccaggagtgggggatggaaagtgcggcga

SEQ ID NO: 44981 - DNA, 37 bp, Artificial Sequence
  Synthetic oligonucleotide
tgccgcctttaccgtactcctcagcgcagaatggcga

SEQ ID NO: 44982 - DNA, 37 bp, Artificial Sequence
  Synthetic oligonucleotide
atgctgcccgagtcttaccatcctcctgaaccacgga

SEQ ID NO: 44983 - DNA, 36 bp, Artificial Sequence
  Synthetic oligonucleotide
gtgcggtgatcctgttctttatcgttacatccggga

SEQ ID NO: 44984 - DNA, 36 bp, Artificial Sequence
  Synthetic oligonucleotide
gtgcccatcctccgaatcaaccccgacacccgggga

SEQ ID NO: 44985 - DNA, 37 bp, Artificial Sequence
  Synthetic oligonucleotide
gccgacgcgataaggcatttaaaggagggctggggga

SEQ ID NO: 44986 - DNA, 37 bp, Artificial Sequence
  Synthetic oligonucleotide
tccggagtggctcatttcttttctgtcttggtttgga

SEQ ID NO: 44987 - DNA, 37 bp, Artificial Sequence
  Synthetic oligonucleotide
atcaacggtacaacgtgctatccgtaccgatttatga

SEQ ID NO: 44988 - DNA, 38 bp, Artificial Sequence
  Synthetic oligonucleotide
gtcacgttactgactatgtaccccacgccttcaactga

SEQ ID NO: 44989 - DNA, 38 bp, Artificial Sequence
  Synthetic oligonucleotide
acatagcgcatgtacaccacatcacacactgttactga

SEQ ID NO: 44990 - DNA, 38 bp, Artificial Sequence
  Synthetic oligonucleotide
cccatcggccacctttgcacacacggcttctaacctga

SEQ ID NO: 44991 - DNA, 38 bp, Artificial Sequence
  Synthetic oligonucleotide
gtcgaggcacctgacgagtcacactcccccctccctga

SEQ ID NO: 44992 - DNA, 38 bp, Artificial Sequence
  Synthetic oligonucleotide
tttgggtgcatggacggaagggagtggaacgtgagtga

SEQ ID NO: 44993 - DNA, 38 bp, Artificial Sequence
  Synthetic oligonucleotide
gagcccaataccgatttgtgcctgttctatacgtgtga

SEQ ID NO: 44994 - DNA, 38 bp, Artificial Sequence
  Synthetic oligonucleotide
ggtgaccgtctaatgtccactcccgctcacactattga

SEQ ID NO: 44995 - DNA, 38 bp, Artificial Sequence
  Synthetic oligonucleotide
atgcacttgcgcctagctcacatttcaaaacaccttga

SEQ ID NO: 44996 - DNA, 38 bp, Artificial Sequence
  Synthetic oligonucleotide
agtactagatgtgcttgcccccacctggccctccttga

SEQ ID NO: 44997 - DNA, 36 bp, Artificial Sequence
  Synthetic oligonucleotide
gacacctctcacgccttcgcaaaagccttacgttga

SEQ ID NO: 44998 - DNA, 36 bp, Artificial Sequence
  Synthetic oligonucleotide
tgaacatctcgcgtcgtagtcccatctaacttttga

SEQ ID NO: 44999 - DNA, 36 bp, Artificial Sequence
  Synthetic oligonucleotide
gagtgtaactagggtgggtgggtaattggggaccta

SEQ ID NO: 45000 - DNA, 35 bp, Artificial Sequence
  Synthetic oligonucleotide
gcacgtggtgcccgttgcatttagttccgcttcta

SEQ ID NO: 45001 - DNA, 35 bp, Artificial Sequence
  Synthetic oligonucleotide
gacactatatccgccggttctcttcataaggcccc

SEQ ID NO: 45002 - DNA, 35 bp, Artificial Sequence
  Synthetic oligonucleotide
tcacctctgcttagtagtctcgcctagttccgcgc

SEQ ID NO: 45003 - DNA, 35 bp, Artificial Sequence
  Synthetic oligonucleotide
gtggaccggaggtgctacgttacaagtcttctatc

SEQ ID NO: 45004 - DNA, 35 bp, Artificial Sequence
  Synthetic oligonucleotide
gccccaatcgcgataccccaggagttcacttcctc

SEQ ID NO: 45005 - DNA, 35 bp, Artificial Sequence
  Synthetic oligonucleotide
aacgcccctgcccaggttaggagtcctcatgtctc

SEQ ID NO: 45006 - DNA, 35 bp, Artificial Sequence
  Synthetic oligonucleotide
tccattatcaccgcggtcacctgggctacaacttc

SEQ ID NO: 45007 - DNA, 35 bp, Artificial Sequence
  Synthetic oligonucleotide
gcgtactcccatttctgcccttgtctctcatagag

SEQ ID NO: 45008 - DNA, 35 bp, Artificial Sequence
  Synthetic oligonucleotide
gaagaacttgggatgaaggggcgggaaagagaacg

SEQ ID NO: 45009 - DNA, 35 bp, Artificial Sequence
  Synthetic oligonucleotide
gtacaatcctcgtggggtctacaatcattctttcg

SEQ ID NO: 45010 - DNA, 35 bp, Artificial Sequence
  Synthetic oligonucleotide
gtgacgagccgtggctctagctatcccgaactaat

SEQ ID NO: 45011 - DNA, 35 bp, Artificial Sequence
  Synthetic oligonucleotide
tcagcacatccacctactcccacgagagaattagt

SEQ ID NO: 45012 - DNA, 35 bp, Artificial Sequence
  Synthetic oligonucleotide
gcgacattagtccaccccatctgcctttgagttgt

SEQ ID NO: 45013 - DNA, 35 bp, Artificial Sequence
  Synthetic oligonucleotide
taccactgtaacgagttccaaccaccatcagactt

SEQ ID NO: 45014 - DNA, 35 bp, Artificial Sequence
  Synthetic oligonucleotide
tgtcccgcgtgcccttacatcaatatattgccctt

SEQ ID NO: 45015 - DNA, 35 bp, Artificial Sequence
  Synthetic oligonucleotide
gtccacccgtgctcctacttgaaccgatatagctt

SEQ ID NO: 45016 - DNA, 35 bp, Artificial Sequence
  Synthetic oligonucleotide
tcagtcggtcagcccattatgtctaccatcttctt

SEQ ID NO: 45017 - DNA, 35 bp, Artificial Sequence
  Synthetic oligonucleotide
gctaacatcctcgcacactgaacaggccggtcttt

SEQ ID NO: 45018 - DNA, 36 bp, Artificial Sequence
  Synthetic oligonucleotide
aagtactggggggggggaaggaaacatctaggacaa

SEQ ID NO: 45019 - DNA, 35 bp, Artificial Sequence
  Synthetic oligonucleotide
ttgccgccgactacgaacccacccgtccacacgaa

SEQ ID NO: 45020 - DNA, 36 bp, Artificial Sequence
  Synthetic oligonucleotide
acggaacggaggtgattggaagtcggagggtgggaa

SEQ ID NO: 45021 - DNA, 35 bp, Artificial Sequence
  Synthetic oligonucleotide
ttcgttcctgagttccccggctatgtaccgcccca

SEQ ID NO: 45022 - DNA, 36 bp, Artificial Sequence
  Synthetic oligonucleotide
ttccgcgctcgcacgcacacatccggtcaccttcca

SEQ ID NO: 45023 - DNA, 35 bp, Artificial Sequence
  Synthetic oligonucleotide
gtgttacctctgccttttgtgcatttatgatctca

SEQ ID NO: 45024 - DNA, 37 bp, Artificial Sequence
  Synthetic oligonucleotide
agacatcgcgcgagccatacagctacccccgctgaga

SEQ ID NO: 45025 - DNA, 34 bp, Artificial Sequence
  Synthetic oligonucleotide
acttccagcattttgcatccacctgacttctaga

SEQ ID NO: 45026 - DNA, 37 bp, Artificial Sequence
  Synthetic oligonucleotide
acaaaaggcccaccagctatccgtttacgtaacacga

SEQ ID NO: 45027 - DNA, 36 bp, Artificial Sequence
  Synthetic oligonucleotide
atcctcctcaccgacggcttcatgccttagacccga

SEQ ID NO: 45028 - DNA, 37 bp, Artificial Sequence
  Synthetic oligonucleotide
acgcacgctatcctagtgcgctacatttccagcccga

SEQ ID NO: 45029 - DNA, 37 bp, Artificial Sequence
  Synthetic oligonucleotide
tgcatccgctgatcgcccacgccgccccgaggcccga

SEQ ID NO: 45030 - DNA, 37 bp, Artificial Sequence
  Synthetic oligonucleotide
agccgaatctatcccccgcccgctccctccgtggcga

SEQ ID NO: 45031 - DNA, 37 bp, Artificial Sequence
  Synthetic oligonucleotide
gcgctcaccgccacccacggtctaaaagtgctttcga

SEQ ID NO: 45032 - DNA, 35 bp, Artificial Sequence
  Synthetic oligonucleotide
accacatgcgacacggcaactagcccttctgcgga

SEQ ID NO: 45033 - DNA, 37 bp, Artificial Sequence
  Synthetic oligonucleotide
gtgcgaacatgcggcgcgtgggggaagggagtaggga

SEQ ID NO: 45034 - DNA, 37 bp, Artificial Sequence
  Synthetic oligonucleotide
ggggggagggtcggaaattcaaagtgggtagggggga

SEQ ID NO: 45035 - DNA, 37 bp, Artificial Sequence
  Synthetic oligonucleotide
accccacgttccaccccaacatgctcgggcatttgga

SEQ ID NO: 45036 - DNA, 35 bp, Artificial Sequence
  Synthetic oligonucleotide
tagccaaccgttagtcaattgccacttggtcctga

SEQ ID NO: 45037 - DNA, 37 bp, Artificial Sequence
  Synthetic oligonucleotide
tcaaaccctctactggtaccgacatccatattgctga

SEQ ID NO: 45038 - DNA, 37 bp, Artificial Sequence
  Synthetic oligonucleotide
gtcgcaaaggagaaagggaaggttgttggtgatctga

SEQ ID NO: 45039 - DNA, 38 bp, Artificial Sequence
  Synthetic oligonucleotide
acgatactacgccttcacacactacctcccgtgcgtga

SEQ ID NO: 45040 - DNA, 38 bp, Artificial Sequence
  Synthetic oligonucleotide
ttacggatgacagtggagtaggtgaaggggataggtga

SEQ ID NO: 45041 - DNA, 38 bp, Artificial Sequence
  Synthetic oligonucleotide
gatggaagaggcggaacgaattataggtgcaggggtga

SEQ ID NO: 45042 - DNA, 38 bp, Artificial Sequence
  Synthetic oligonucleotide
aatcaccggcgttcctctacaagcctttgcctccttga

SEQ ID NO: 45043 - DNA, 38 bp, Artificial Sequence
  Synthetic oligonucleotide
ggggcaggacacatagcctactcctccgtcctccttga

SEQ ID NO: 45044 - DNA, 38 bp, Artificial Sequence
  Synthetic oligonucleotide
agcccgacccgttctgcacattttaaggctccgcttga

SEQ ID NO: 45045 - DNA, 37 bp, Artificial Sequence
  Synthetic oligonucleotide
atgcaccgccccacatctcatcgttcctattttttga

SEQ ID NO: 45046 - DNA, 36 bp, Artificial Sequence
  Synthetic oligonucleotide
aacatgcccctacgctcatagcaccatcgcgatcta

SEQ ID NO: 45047 - DNA, 36 bp, Artificial Sequence
  Synthetic oligonucleotide
acaccccctggtccctaacacgctcgtccctgcgta

SEQ ID NO: 45048 - DNA, 36 bp, Artificial Sequence
  Synthetic oligonucleotide
aaaccccgtctccccgcgcgttccaccgtcagatta

SEQ ID NO: 45049 - DNA, 35 bp, Artificial Sequence
  Synthetic oligonucleotide
gatgcctggccaggtaccgctattgacacattgac

SEQ ID NO: 45050 - DNA, 35 bp, Artificial Sequence
  Synthetic oligonucleotide
ttccacgccaacattagttttaacaccggagctac

SEQ ID NO: 45051 - DNA, 35 bp, Artificial Sequence
  Synthetic oligonucleotide
tctcgatcggcccttttgccttgcttttctgagcc

SEQ ID NO: 45052 - DNA, 35 bp, Artificial Sequence
  Synthetic oligonucleotide
gtgcacgtacatgtaagcttctccgacactccgcc

SEQ ID NO: 45053 - DNA, 35 bp, Artificial Sequence
  Synthetic oligonucleotide
aattcatctcaccgttccgtttacgaacctatgcc

SEQ ID NO: 45054 - DNA, 35 bp, Artificial Sequence
  Synthetic oligonucleotide
taccacccagctcgcgctcccgtgacagccggtcc

SEQ ID NO: 45055 - DNA, 35 bp, Artificial Sequence
  Synthetic oligonucleotide
atgagggcctggttgcgaacctaatcccaccttcc

SEQ ID NO: 45056 - DNA, 35 bp, Artificial Sequence
  Synthetic oligonucleotide
taatgctccaatcctggcgcttggaaccatcttcc

SEQ ID NO: 45057 - DNA, 35 bp, Artificial Sequence
  Synthetic oligonucleotide
tttgatcgcaccagccactatatttacggagttcc

SEQ ID NO: 45058 - DNA, 35 bp, Artificial Sequence
  Synthetic oligonucleotide
gacatagcggaacggttgcaaaaggcggaagacag

SEQ ID NO: 45059 - DNA, 35 bp, Artificial Sequence
  Synthetic oligonucleotide
tctcccctccgcttggttcttgctcctcttggtcg

SEQ ID NO: 45060 - DNA, 35 bp, Artificial Sequence
  Synthetic oligonucleotide
tgcacggtttgacggttccattccactcgcacctg

SEQ ID NO: 45061 - DNA, 35 bp, Artificial Sequence
  Synthetic oligonucleotide
tcacccctcttgcccgtcttccatcccacggtgat

SEQ ID NO: 45062 - DNA, 35 bp, Artificial Sequence
  Synthetic oligonucleotide
tcttaatcgcccgaagtcgatccatctgcctttat

SEQ ID NO: 45063 - DNA, 35 bp, Artificial Sequence
  Synthetic oligonucleotide
gaccgggggatgtgcggtgggtgagtgttggcggt

SEQ ID NO: 45064 - DNA, 35 bp, Artificial Sequence
  Synthetic oligonucleotide
gtcgggtggttcactaagggagggtggagattgtt

SEQ ID NO: 45065 - DNA, 35 bp, Artificial Sequence
  Synthetic oligonucleotide
acaacacgaccgcacccatgccccatagacagaaa

SEQ ID NO: 45066 - DNA, 36 bp, Artificial Sequence
  Synthetic oligonucleotide
aactgacgctctagcctgtttttcctcctcctgcaa

SEQ ID NO: 45067 - DNA, 36 bp, Artificial Sequence
  Synthetic oligonucleotide
tgccgccaccacccacgttatttgaattgcttgcaa

SEQ ID NO: 45068 - DNA, 36 bp, Artificial Sequence
  Synthetic oligonucleotide
gtgcactacattacccggatcctgcagttctgtgaa

SEQ ID NO: 45069 - DNA, 35 bp, Artificial Sequence
  Synthetic oligonucleotide
tcaatcacaagtcccggttgggcaaatccctcaca

SEQ ID NO: 45070 - DNA, 35 bp, Artificial Sequence
  Synthetic oligonucleotide
gccaccgacgcgtaagctttttccctctacagaca

SEQ ID NO: 45071 - DNA, 36 bp, Artificial Sequence
  Synthetic oligonucleotide
gatcaccctacaattgaaccacttccacggtcacca

SEQ ID NO: 45072 - DNA, 36 bp, Artificial Sequence
  Synthetic oligonucleotide
tcagcccggtacccgccacgtcgcctatacgatgca

SEQ ID NO: 45073 - DNA, 36 bp, Artificial Sequence
  Synthetic oligonucleotide
attccgatcaatctgccgccgcccacgcaaactgca

SEQ ID NO: 45074 - DNA, 36 bp, Artificial Sequence
  Synthetic oligonucleotide
accccaagcttgttggccaatacttagcacttctca

SEQ ID NO: 45075 - DNA, 37 bp, Artificial Sequence
  Synthetic oligonucleotide
gggtgcgcactggcgtagaataggggggaaggagaga

SEQ ID NO: 45076 - DNA, 37 bp, Artificial Sequence
  Synthetic oligonucleotide
tttgatggggtggggagtagagtgagtgtgggtgaga

SEQ ID NO: 45077 - DNA, 37 bp, Artificial Sequence
  Synthetic oligonucleotide
ttcatacctctgacttactggtcgtcagtccacccga

SEQ ID NO: 45078 - DNA, 37 bp, Artificial Sequence
  Synthetic oligonucleotide
taactgccccattttgcaatcaaccctacagttccga

SEQ ID NO: 45079 - DNA, 37 bp, Artificial Sequence
  Synthetic oligonucleotide
acatgtcctgcgtgccatcatactgggttccccgcga

SEQ ID NO: 45080 - DNA, 36 bp, Artificial Sequence
  Synthetic oligonucleotide
tacggtggacgggcattttgctggtgatggggggga

SEQ ID NO: 45081 - DNA, 37 bp, Artificial Sequence
  Synthetic oligonucleotide
acaatggggtcaaggggtaattgggagggggtgtgga

SEQ ID NO: 45082 - DNA, 37 bp, Artificial Sequence
  Synthetic oligonucleotide
aagcccccttggccggttttatctgcacttacttgga

SEQ ID NO: 45083 - DNA, 38 bp, Artificial Sequence
  Synthetic oligonucleotide
gccctctgacgtatcaattctgtgcacaccgcccctga

SEQ ID NO: 45084 - DNA, 37 bp, Artificial Sequence
  Synthetic oligonucleotide
tgaggccgcttgatcctttactatccaccccttctga

SEQ ID NO: 45085 - DNA, 38 bp, Artificial Sequence
  Synthetic oligonucleotide
gtcaactcactgccttttggggcttatcctgtttctga

SEQ ID NO: 45086 - DNA, 38 bp, Artificial Sequence
  Synthetic oligonucleotide
gaaaagtagctgggggggaaatggcaaggtgctagtga

SEQ ID NO: 45087 - DNA, 38 bp, Artificial Sequence
  Synthetic oligonucleotide
gtggatggccggatctgagagagatcgggtgtgggtga

SEQ ID NO: 45088 - DNA, 38 bp, Artificial Sequence
  Synthetic oligonucleotide
agcgacggtcgtggagatagggtgggaacggcgtgtga

SEQ ID NO: 45089 - DNA, 37 bp, Artificial Sequence
  Synthetic oligonucleotide
gcgcgaccgaccttatacacatctctgccttgattga

SEQ ID NO: 45090 - DNA, 38 bp, Artificial Sequence
  Synthetic oligonucleotide
gttgaggcgtgagggggggtacgttggggggttattga

SEQ ID NO: 45091 - DNA, 38 bp, Artificial Sequence
  Synthetic oligonucleotide
atccccccgacaactgcgtgaccacgatcgtgccttga

SEQ ID NO: 45092 - DNA, 37 bp, Artificial Sequence
  Synthetic oligonucleotide
tgtaccttcacaccgctctcgtttttactgccgttga

SEQ ID NO: 45093 - DNA, 37 bp, Artificial Sequence
  Synthetic oligonucleotide
tgctaaccttctagcgtgctagcccacccccatttga

SEQ ID NO: 45094 - DNA, 38 bp, Artificial Sequence
  Synthetic oligonucleotide
tgtcgccactgactcacatcgagccctactcactttga

SEQ ID NO: 45095 - DNA, 36 bp, Artificial Sequence
  Synthetic oligonucleotide
ttcagccgacatgttttctaccactggggccccgta

SEQ ID NO: 45096 - DNA, 35 bp, Artificial Sequence
  Synthetic oligonucleotide
gaccagccgctgctctactggcaagtacaccaccc

SEQ ID NO: 45097 - DNA, 35 bp, Artificial Sequence
  Synthetic oligonucleotide
ggagacccgtgccctattatcctaactcgcaactc

SEQ ID NO: 45098 - DNA, 35 bp, Artificial Sequence
  Synthetic oligonucleotide
taccccgtgttttggaattcttcgctagggctctc

SEQ ID NO: 45099 - DNA, 34 bp, Artificial Sequence
  Synthetic oligonucleotide
aggtcgatcccacccaggctcaacaggtaatgtc

SEQ ID NO: 45100 - DNA, 35 bp, Artificial Sequence
  Synthetic oligonucleotide
gtgggatgggggtggcggggtagggggttgattag

SEQ ID NO: 45101 - DNA, 35 bp, Artificial Sequence
  Synthetic oligonucleotide
ttctgtaggcctcgttggcgatctttcttcctctg

SEQ ID NO: 45102 - DNA, 35 bp, Artificial Sequence
  Synthetic oligonucleotide
tacgcacacaaatggccatccgagccactcgcttg

SEQ ID NO: 45103 - DNA, 35 bp, Artificial Sequence
  Synthetic oligonucleotide
gtcaggccactgcttttccgccttaatcccatgat

SEQ ID NO: 45104 - DNA, 35 bp, Artificial Sequence
  Synthetic oligonucleotide
gaaacaccggtgtgaggtgttcatgcccccaacct

SEQ ID NO: 45105 - DNA, 35 bp, Artificial Sequence
  Synthetic oligonucleotide
gaccgggcaaaggggtagagtggggacgttacgct

SEQ ID NO: 45106 - DNA, 35 bp, Artificial Sequence
  Synthetic oligonucleotide
ataccccgcactccgtccacacggcgactcgagtt

SEQ ID NO: 45107 - DNA, 35 bp, Artificial Sequence
  Synthetic oligonucleotide
gaacgggggaaattaaggaagggcaagagggataa

SEQ ID NO: 45108 - DNA, 35 bp, Artificial Sequence
  Synthetic oligonucleotide
tactacccgtttcttcccgcatcctgcctgagaca

SEQ ID NO: 45109 - DNA, 35 bp, Artificial Sequence
  Synthetic oligonucleotide
gcgctcaccaggtccatcaaatacacgggtttcca

SEQ ID NO: 45110 - DNA, 36 bp, Artificial Sequence
  Synthetic oligonucleotide
aagcctgggatatgggtggggtgagggaggcgggca

SEQ ID NO: 45111 - DNA, 38 bp, Artificial Sequence
  Synthetic oligonucleotide
gtcgaccaacctcacccttctaagtaccctcatcctca

SEQ ID NO: 45112 - DNA, 36 bp, Artificial Sequence
  Synthetic oligonucleotide
gaatcccccagccaagatcgtccttctccgctctca

SEQ ID NO: 45113 - DNA, 35 bp, Artificial Sequence
  Synthetic oligonucleotide
tgccaccttcccccgtagcagagcttgtgacgtca

SEQ ID NO: 45114 - DNA, 36 bp, Artificial Sequence
  Synthetic oligonucleotide
gatgtggcggtcggctctcgcaaaacgttttcttca

SEQ ID NO: 45115 - DNA, 37 bp, Artificial Sequence
  Synthetic oligonucleotide
tatcctgtcccacccgcctgcagtgcaaatcttcaga

SEQ ID NO: 45116 - DNA, 37 bp, Artificial Sequence
  Synthetic oligonucleotide
ttagcgtgggggataaactgagggggcaagggatcga

SEQ ID NO: 45117 - DNA, 37 bp, Artificial Sequence
  Synthetic oligonucleotide
ggtgggagccaagtggcaaataggagggaggggtcga

SEQ ID NO: 45118 - DNA, 37 bp, Artificial Sequence
  Synthetic oligonucleotide
gtgggcacacaccgcttcctgctccctctatcttcga

SEQ ID NO: 45119 - DNA, 37 bp, Artificial Sequence
  Synthetic oligonucleotide
aatggagacaaggaggtatgtaggaagcgaagcagga

SEQ ID NO: 45120 - DNA, 37 bp, Artificial Sequence
  Synthetic oligonucleotide
acgccgggcctcacaccgttcgcaagttgtactggga

SEQ ID NO: 45121 - DNA, 38 bp, Artificial Sequence
  Synthetic oligonucleotide
agccgagcacctgtaccccgccgtttcattggtaatga

SEQ ID NO: 45122 - DNA, 37 bp, Artificial Sequence
  Synthetic oligonucleotide
gccgcccatatctgtccagggcccgatcacctcatga

SEQ ID NO: 45123 - DNA, 37 bp, Artificial Sequence
  Synthetic oligonucleotide
atgcgcacacactatctttcaaacgcgactcgactga

SEQ ID NO: 45124 - DNA, 36 bp, Artificial Sequence
  Synthetic oligonucleotide
tagattgccaccgcttgaccttgatccccaacctga

SEQ ID NO: 45125 - DNA, 38 bp, Artificial Sequence
  Synthetic oligonucleotide
ttgtgttacccagcggcacttccctcgcttgaacctga

SEQ ID NO: 45126 - DNA, 38 bp, Artificial Sequence
  Synthetic oligonucleotide
gacgcccaagaagaatcgagtcactctcaacatcctga

SEQ ID NO: 45127 - DNA, 37 bp, Artificial Sequence
  Synthetic oligonucleotide
atcacttgcgcaggttgtccacctcgctctttcctga

SEQ ID NO: 45128 - DNA, 38 bp, Artificial Sequence
  Synthetic oligonucleotide
gacggagtcaatacggggaaagggtgagttcaatgtga

SEQ ID NO: 45129 - DNA, 38 bp, Artificial Sequence
  Synthetic oligonucleotide
tcagaccggtgagtgtctcgtcttgcctgccaccttga

SEQ ID NO: 45130 - DNA, 38 bp, Artificial Sequence
  Synthetic oligonucleotide
tgagaccaagttggtgtaccgcgctctccttcccttga

SEQ ID NO: 45131 - DNA, 38 bp, Artificial Sequence
  Synthetic oligonucleotide
tgaccccagtggtacgtcgcacctgtctttgtctttga

SEQ ID NO: 45132 - DNA, 36 bp, Artificial Sequence
  Synthetic oligonucleotide
actgcactacccggcgtacacctttcatgttcaata

SEQ ID NO: 45133 - DNA, 35 bp, Artificial Sequence
  Synthetic oligonucleotide
gccaacagggcaaaactgactccgtgcctccacta

SEQ ID NO: 45134 - DNA, 35 bp, Artificial Sequence
  Synthetic oligonucleotide
aatccctgtgacgcctccgcgatgctactcgccta

SEQ ID NO: 45135 - DNA, 36 bp, Artificial Sequence
  Synthetic oligonucleotide
gacaccaaacttgtagcacacactggaaaatcatta

SEQ ID NO: 45136 - DNA, 36 bp, Artificial Sequence
  Synthetic oligonucleotide
tcccaaacgactgttctgccccttcgtgttatatta

SEQ ID NO: 45137 - DNA, 35 bp, Artificial Sequence
  Synthetic oligonucleotide
tcaccccgccacttgggtccttccagtctttcaac

SEQ ID NO: 45138 - DNA, 35 bp, Artificial Sequence
  Synthetic oligonucleotide
tcgaccactcgttctgcccgacccaacggatacac

SEQ ID NO: 45139 - DNA, 35 bp, Artificial Sequence
  Synthetic oligonucleotide
tgatgtcccgggtccctggtcttccttgttgttac

SEQ ID NO: 45140 - DNA, 35 bp, Artificial Sequence
  Synthetic oligonucleotide
atccggtgcacatcatctcttttagcccgaggacc

SEQ ID NO: 45141 - DNA, 35 bp, Artificial Sequence
  Synthetic oligonucleotide
ttgtgcatgtctattggtcttcactcgtactaccc

SEQ ID NO: 45142 - DNA, 35 bp, Artificial Sequence
  Synthetic oligonucleotide
tggaccactcgcactcttggcagtaccagaccgcc

SEQ ID NO: 45143 - DNA, 34 bp, Artificial Sequence
  Synthetic oligonucleotide
ggtggacaggtgactgtttccgttttgccttgcc

SEQ ID NO: 45144 - DNA, 35 bp, Artificial Sequence
  Synthetic oligonucleotide
tataatgcagacctcaagctcccgtcgctcttgcc

SEQ ID NO: 45145 - DNA, 33 bp, Artificial Sequence
  Synthetic oligonucleotide
tgacatcccgcgcacggaaatgccattcttctc

SEQ ID NO: 45146 - DNA, 35 bp, Artificial Sequence
  Synthetic oligonucleotide
gactctagcgacaccctggtccctccaccccttag

SEQ ID NO: 45147 - DNA, 35 bp, Artificial Sequence
  Synthetic oligonucleotide
gtgcgaagcggatcgggggagttacagggggaaat

SEQ ID NO: 45148 - DNA, 35 bp, Artificial Sequence
  Synthetic oligonucleotide
taccccgattgccgtgttgttccacccattcatgt

SEQ ID NO: 45149 - DNA, 35 bp, Artificial Sequence
  Synthetic oligonucleotide
aaacaactccgagtgctaccaccgcctttctaatt

SEQ ID NO: 45150 - DNA, 35 bp, Artificial Sequence
  Synthetic oligonucleotide
agtactggtggtggggaaaaataatcaagcaagtt

SEQ ID NO: 45151 - DNA, 35 bp, Artificial Sequence
  Synthetic oligonucleotide
taccgcccgttcatacacgctatgggcctatggtt

SEQ ID NO: 45152 - DNA, 35 bp, Artificial Sequence
  Synthetic oligonucleotide
gactcgccgcccatcctccaatccaggctatcaaa

SEQ ID NO: 45153 - DNA, 36 bp, Artificial Sequence
  Synthetic oligonucleotide
gacactcgactgtctcttcatcctagcagtcgccca

SEQ ID NO: 45154 - DNA, 35 bp, Artificial Sequence
  Synthetic oligonucleotide
atcgcctacctgttgccattacgatacccgagaga

SEQ ID NO: 45155 - DNA, 37 bp, Artificial Sequence
  Synthetic oligonucleotide
atcccgcgctctatcatcattcaccagcgcaacacga

SEQ ID NO: 45156 - DNA, 36 bp, Artificial Sequence
  Synthetic oligonucleotide
gtgctcagaacccctccagcacgcaaccatggacga

SEQ ID NO: 45157 - DNA, 37 bp, Artificial Sequence
  Synthetic oligonucleotide
tagacctgcgcccatgttacggggcccctctctccga

SEQ ID NO: 45158 - DNA, 38 bp, Artificial Sequence
  Synthetic oligonucleotide
gtagagggcagggaaaggagggaaatcttgggtcatga

SEQ ID NO: 45159 - DNA, 38 bp, Artificial Sequence
  Synthetic oligonucleotide
ttcccagcctccacggcccaacagactggttaatctga

SEQ ID NO: 45160 - DNA, 37 bp, Artificial Sequence
  Synthetic oligonucleotide
acgagacgtgatcggtggttgaacggtgggggagtga

SEQ ID NO: 45161 - DNA, 35 bp, Artificial Sequence
  Synthetic oligonucleotide
gtgaatggatgaaggggtgggcgatgtcatggtga

SEQ ID NO: 45162 - DNA, 37 bp, Artificial Sequence
  Synthetic oligonucleotide
tcatgcaccagcacctgcgtctccggtcaatacttga

SEQ ID NO: 45163 - DNA, 37 bp, Artificial Sequence
  Synthetic oligonucleotide
tgcgacgcggtgcggcgaaacgggggttactttttga

SEQ ID NO: 45164 - DNA, 36 bp, Artificial Sequence
  Synthetic oligonucleotide
aaactcacgccggagccatttcggacctttaacata

SEQ ID NO: 45165 - DNA, 36 bp, Artificial Sequence
  Synthetic oligonucleotide
tgaggaaccggtaacgggtggggggtacgggaacta

SEQ ID NO: 45166 - DNA, 35 bp, Artificial Sequence
  Synthetic oligonucleotide
ttatgcacacatcgctatctagcacctgactgcta

SEQ ID NO: 45167 - DNA, 35 bp, Artificial Sequence
  Synthetic oligonucleotide
gtgcggaagccctggtcgtcgcctatatcctcgta

SEQ ID NO: 45168 - DNA, 35 bp, Artificial Sequence
  Synthetic oligonucleotide
gcccgcaccaccacatcacctgtcgctgtacacac

SEQ ID NO: 45169 - DNA, 35 bp, Artificial Sequence
  Synthetic oligonucleotide
gcacaaccccgcctccatcacgttcgatagccgcc

SEQ ID NO: 45170 - DNA, 35 bp, Artificial Sequence
  Synthetic oligonucleotide
gacactaccccggggtcggtgtaatcttcgcttcc

SEQ ID NO: 45171 - DNA, 35 bp, Artificial Sequence
  Synthetic oligonucleotide
actaccgtgcccctacttaacgattcccggatcgc

SEQ ID NO: 45172 - DNA, 35 bp, Artificial Sequence
  Synthetic oligonucleotide
gacacctccacgatttcaattgcacatataccatc

SEQ ID NO: 45173 - DNA, 35 bp, Artificial Sequence
  Synthetic oligonucleotide
gtagccgcctgtcccgtggccccaattgaaatgtc

SEQ ID NO: 45174 - DNA, 35 bp, Artificial Sequence
  Synthetic oligonucleotide
gtccctccgcctcctcttacggttaagttttggag

SEQ ID NO: 45175 - DNA, 35 bp, Artificial Sequence
  Synthetic oligonucleotide
gtgtagcgagaggggaggaagggtgcgatagaggg

SEQ ID NO: 45176 - DNA, 35 bp, Artificial Sequence
  Synthetic oligonucleotide
gtacatcccccagttttatgcgcatgcacacattg

SEQ ID NO: 45177 - DNA, 35 bp, Artificial Sequence
  Synthetic oligonucleotide
agtgccaaatgtatccaacccgtcgtccgttacat

SEQ ID NO: 45178 - DNA, 35 bp, Artificial Sequence
  Synthetic oligonucleotide
agcaagaactcccccactcctccgtagtaggccct

SEQ ID NO: 45179 - DNA, 35 bp, Artificial Sequence
  Synthetic oligonucleotide
ttggtgttcagagcgtgccgtctgccctcatgcct

SEQ ID NO: 45180 - DNA, 35 bp, Artificial Sequence
  Synthetic oligonucleotide
gattgcaatgcgtaagttcattgcttgctactcct

SEQ ID NO: 45181 - DNA, 35 bp, Artificial Sequence
  Synthetic oligonucleotide
gtcccaccaggaattttggccactatttgtactct

SEQ ID NO: 45182 - DNA, 35 bp, Artificial Sequence
  Synthetic oligonucleotide
agttcgggccactacaatataccgtgatatccctt

SEQ ID NO: 45183 - DNA, 35 bp, Artificial Sequence
  Synthetic oligonucleotide
gctggacctgcactgccctccgccggtttaataca

SEQ ID NO: 45184 - DNA, 36 bp, Artificial Sequence
  Synthetic oligonucleotide
gattggcaacactccctgggtttcagcttacatcca

SEQ ID NO: 45185 - DNA, 36 bp, Artificial Sequence
  Synthetic oligonucleotide
gacgaggcaaacaacggatccagctaatcatcatca

SEQ ID NO: 45186 - DNA, 36 bp, Artificial Sequence
  Synthetic oligonucleotide
gagtggatgggggggcgtaaccgtaaacgtgggtca

SEQ ID NO: 45187 - DNA, 37 bp, Artificial Sequence
  Synthetic oligonucleotide
taccaatgacgcctctttccttattcagtcttcgaga

SEQ ID NO: 45188 - DNA, 37 bp, Artificial Sequence
  Synthetic oligonucleotide
gatgcgttacaaacttgtaagtgtcctttccttccga

SEQ ID NO: 45189 - DNA, 35 bp, Artificial Sequence
  Synthetic oligonucleotide
gttcccccacgggagtcacttccattttcgatcga

SEQ ID NO: 45190 - DNA, 36 bp, Artificial Sequence
  Synthetic oligonucleotide
atggcgtgccaccatgcgatgccatgtccctatcga

SEQ ID NO: 45191 - DNA, 36 bp, Artificial Sequence
  Synthetic oligonucleotide
atttggcgcagcatccgcaatttccttccctgagga

SEQ ID NO: 45192 - DNA, 38 bp, Artificial Sequence
  Synthetic oligonucleotide
tcgtggtggggcagggtatgctaaaaatggggggatga

SEQ ID NO: 45193 - DNA, 35 bp, Artificial Sequence
  Synthetic oligonucleotide
acgtgccgcatcactgtccgttccccacctgatga

SEQ ID NO: 45194 - DNA, 38 bp, Artificial Sequence
  Synthetic oligonucleotide
gcatacgcaaagtgtcaatcctaccatagttcaactga

SEQ ID NO: 45195 - DNA, 38 bp, Artificial Sequence
  Synthetic oligonucleotide
aacactcgtccgacctgcttcaaaaactccctctctga

SEQ ID NO: 45196 - DNA, 37 bp, Artificial Sequence
  Synthetic oligonucleotide
tgaggtactgaaggcgaaggagggaagggtttagtga

SEQ ID NO: 45197 - DNA, 37 bp, Artificial Sequence
  Synthetic oligonucleotide
ccatacaccgccgcctagtaccccgccatcctggtga

SEQ ID NO: 45198 - DNA, 37 bp, Artificial Sequence
  Synthetic oligonucleotide
gcccacctgaatggtcctacgccacaacgaattgtga

SEQ ID NO: 45199 - DNA, 38 bp, Artificial Sequence
  Synthetic oligonucleotide
ggagccatcctcgggttcaccgatcatcccgcccttga

SEQ ID NO: 45200 - DNA, 37 bp, Artificial Sequence
  Synthetic oligonucleotide
ttcgtcacccatccctgtttagtactcgtgttgttga

SEQ ID NO: 45201 - DNA, 36 bp, Artificial Sequence
  Synthetic oligonucleotide
gtctggcgaccccgatcacgtccttagccactatta

SEQ ID NO: 45202 - DNA, 35 bp, Artificial Sequence
  Synthetic oligonucleotide
tgcatgtggctgcactgtccatggcccgcttatta

SEQ ID NO: 45203 - DNA, 36 bp, Artificial Sequence
  Synthetic oligonucleotide
tgcgactgctctccgtccaatgctaccccgctctta

SEQ ID NO: 45204 - DNA, 35 bp, Artificial Sequence
  Synthetic oligonucleotide
tgtgccccctctcaatcagtctcaaaggaaatccc

SEQ ID NO: 45205 - DNA, 35 bp, Artificial Sequence
  Synthetic oligonucleotide
atgcatgctctgcagaccctgcactcatccctagc

SEQ ID NO: 45206 - DNA, 35 bp, Artificial Sequence
  Synthetic oligonucleotide
tcgagtcggccccttacaagcgctgccaacattgc

SEQ ID NO: 45207 - DNA, 35 bp, Artificial Sequence
  Synthetic oligonucleotide
aagtccgttaatgcaccacgccttcttctctggtc

SEQ ID NO: 45208 - DNA, 35 bp, Artificial Sequence
  Synthetic oligonucleotide
gtatgactgggtgagttggggatagggaggtattg

SEQ ID NO: 45209 - DNA, 35 bp, Artificial Sequence
  Synthetic oligonucleotide
tgccgagccgctccccaacacttacaggcagacat

SEQ ID NO: 45210 - DNA, 35 bp, Artificial Sequence
  Synthetic oligonucleotide
gacgctctcataggcctctcttatgccggttccct

SEQ ID NO: 45211 - DNA, 35 bp, Artificial Sequence
  Synthetic oligonucleotide
tgttactagccaccacctttctgcataaagtttgt

SEQ ID NO: 45212 - DNA, 35 bp, Artificial Sequence
  Synthetic oligonucleotide
aacaccgatatgcgaagtactggtcgccttccctt

SEQ ID NO: 45213 - DNA, 35 bp, Artificial Sequence
  Synthetic oligonucleotide
ttgtccgatacaccagcttgttgcactatctcttt

SEQ ID NO: 45214 - DNA, 36 bp, Artificial Sequence
  Synthetic oligonucleotide
tgccccgacgatcaggcggcaccatttccatccgaa

SEQ ID NO: 45215 - DNA, 36 bp, Artificial Sequence
  Synthetic oligonucleotide
gggggagccaactggggggtggaagggaggctgaca

SEQ ID NO: 45216 - DNA, 35 bp, Artificial Sequence
  Synthetic oligonucleotide
agtgactcacgactctgtaacaactcatccctaca

SEQ ID NO: 45217 - DNA, 36 bp, Artificial Sequence
  Synthetic oligonucleotide
gtgccgacctgtcttcaccctgctttcagcccacca

SEQ ID NO: 45218 - DNA, 37 bp, Artificial Sequence
  Synthetic oligonucleotide
tgacgttcacatcccagcccgactatcttgagcaaga

SEQ ID NO: 45219 - DNA, 37 bp, Artificial Sequence
  Synthetic oligonucleotide
ggggaaaacaggaatgatagtaggggggaaacgaaga

SEQ ID NO: 45220 - DNA, 37 bp, Artificial Sequence
  Synthetic oligonucleotide
gaggagggttcaatactgaggggggggtaggacgaga

SEQ ID NO: 45221 - DNA, 37 bp, Artificial Sequence
  Synthetic oligonucleotide
ggatttgggagggtggggacaaagctgggggacgaga

SEQ ID NO: 45222 - DNA, 36 bp, Artificial Sequence
  Synthetic oligonucleotide
gacactgtgttagtaggagggaatgtaagggggaga

SEQ ID NO: 45223 - DNA, 36 bp, Artificial Sequence
  Synthetic oligonucleotide
gactcagtcagttccgctacaccagcaaattaccga

SEQ ID NO: 45224 - DNA, 36 bp, Artificial Sequence
  Synthetic oligonucleotide
gtgacgtaagggaactagggatggggcggaaatcga

SEQ ID NO: 45225 - DNA, 37 bp, Artificial Sequence
  Synthetic oligonucleotide
gcccccgtgccaaggttgtcttactccacgtactcga

SEQ ID NO: 45226 - DNA, 37 bp, Artificial Sequence
  Synthetic oligonucleotide
attgcagggagagtgcaatacgtacgtatggtttcga

SEQ ID NO: 45227 - DNA, 37 bp, Artificial Sequence
  Synthetic oligonucleotide
tgcacccctcagctctccctcgccaatctttccggga

SEQ ID NO: 45228 - DNA, 36 bp, Artificial Sequence
  Synthetic oligonucleotide
ttggaggtcacaaggggcaatttctggggttgggga

SEQ ID NO: 45229 - DNA, 38 bp, Artificial Sequence
  Synthetic oligonucleotide
gctactgctaggagggaaacggggcaacgggcatggga

SEQ ID NO: 45230 - DNA, 38 bp, Artificial Sequence
  Synthetic oligonucleotide
ttgactcgccgcccagtgtctccgctacgttttcatga

SEQ ID NO: 45231 - DNA, 37 bp, Artificial Sequence
  Synthetic oligonucleotide
gcatgcatgagggaggcaaagggattaagtggattga

SEQ ID NO: 45232 - DNA, 38 bp, Artificial Sequence
  Synthetic oligonucleotide
atgccaccgtcaacggtgctcccatgcctcccccttga

SEQ ID NO: 45233 - DNA, 37 bp, Artificial Sequence
  Synthetic oligonucleotide
gcccatcacgtgagtccctcttccaggtgccctacta

SEQ ID NO: 45234 - DNA, 36 bp, Artificial Sequence
  Synthetic oligonucleotide
tcacgccgggcttcttactcggtacgtatccgttta

SEQ ID NO: 45235 - DNA, 35 bp, Artificial Sequence
  Synthetic oligonucleotide
gccatgttcgccttctcgacaacgctaagttccac

SEQ ID NO: 45236 - DNA, 35 bp, Artificial Sequence
  Synthetic oligonucleotide
aaccccgcatccataaagaaagctaggctttatac

SEQ ID NO: 45237 - DNA, 35 bp, Artificial Sequence
  Synthetic oligonucleotide
agacgaagatctggtcgtcctatcctcagcttacc

SEQ ID NO: 45238 - DNA, 35 bp, Artificial Sequence
  Synthetic oligonucleotide
acctgcacattgagaaatcaaggcacatgctatcc

SEQ ID NO: 45239 - DNA, 35 bp, Artificial Sequence
  Synthetic oligonucleotide
attgtcgagcaggatcttacggcctccgatcctcc

SEQ ID NO: 45240 - DNA, 35 bp, Artificial Sequence
  Synthetic oligonucleotide
gtccctcgaattgctgtagcatacgcacccctcgc

SEQ ID NO: 45241 - DNA, 35 bp, Artificial Sequence
  Synthetic oligonucleotide
gaagaacatgagggagggtgaaggcgtaatgggtc

SEQ ID NO: 45242 - DNA, 35 bp, Artificial Sequence
  Synthetic oligonucleotide
aaagaaggcaggttaggggataggctggaaaatgg

SEQ ID NO: 45243 - DNA, 35 bp, Artificial Sequence
  Synthetic oligonucleotide
acccaaatagcctccaccctcgcgctccggactat

SEQ ID NO: 45244 - DNA, 35 bp, Artificial Sequence
  Synthetic oligonucleotide
tatgtgtacaagctcccgtggctcggtttctctat

SEQ ID NO: 45245 - DNA, 35 bp, Artificial Sequence
  Synthetic oligonucleotide
aacccgcggacgcactttcacctcggctagatact

SEQ ID NO: 45246 - DNA, 35 bp, Artificial Sequence
  Synthetic oligonucleotide
gcccctgacaacgcatatcagctaacattttagtt

SEQ ID NO: 45247 - DNA, 34 bp, Artificial Sequence
  Synthetic oligonucleotide
ttatgggcgctccccctcgattacctggcttgtt

SEQ ID NO: 45248 - DNA, 35 bp, Artificial Sequence
  Synthetic oligonucleotide
gttgtcgagagccctttcgcccccaccgcccaaaa

SEQ ID NO: 45249 - DNA, 36 bp, Artificial Sequence
  Synthetic oligonucleotide
gtgccttgccacacccctaatgatttcgcatggaaa

SEQ ID NO: 45250 - DNA, 36 bp, Artificial Sequence
  Synthetic oligonucleotide
tcctgtcgcccggcctaccaatattcatacgtgaaa

SEQ ID NO: 45251 - DNA, 35 bp, Artificial Sequence
  Synthetic oligonucleotide
tcacacctcccggttgccgttcacagtagagtaaa

SEQ ID NO: 45252 - DNA, 36 bp, Artificial Sequence
  Synthetic oligonucleotide
gaccgacccgaagctgacctgctcaatactaagtaa

SEQ ID NO: 45253 - DNA, 36 bp, Artificial Sequence
  Synthetic oligonucleotide
gccgtcatatctgctcgcctgctgctcatcaattaa

SEQ ID NO: 45254 - DNA, 35 bp, Artificial Sequence
  Synthetic oligonucleotide
gcgtagacaccctctgcctccacacgcccgcacca

SEQ ID NO: 45255 - DNA, 35 bp, Artificial Sequence
  Synthetic oligonucleotide
gatcggcctgaatcccctgtctttacgcaatgcca

SEQ ID NO: 45256 - DNA, 36 bp, Artificial Sequence
  Synthetic oligonucleotide
ttccatgcacgacgtcaagtcccgccccttcgcgca

SEQ ID NO: 45257 - DNA, 37 bp, Artificial Sequence
  Synthetic oligonucleotide
gcacgacacatctctccgcttcttccgcgagtcgaga

SEQ ID NO: 45258 - DNA, 37 bp, Artificial Sequence
  Synthetic oligonucleotide
gcagtagaggaagggcaaggtttctgaaggcgggaga

SEQ ID NO: 45259 - DNA, 34 bp, Artificial Sequence
  Synthetic oligonucleotide
atgcctacgccttgtcgcactgccgccataacga

SEQ ID NO: 45260 - DNA, 37 bp, Artificial Sequence
  Synthetic oligonucleotide
tccacagcaacagctaacctttgacactatgcgtcga

SEQ ID NO: 45261 - DNA, 36 bp, Artificial Sequence
  Synthetic oligonucleotide
gatatggccctccaatggtaacccgactcatgctga

SEQ ID NO: 45262 - DNA, 38 bp, Artificial Sequence
  Synthetic oligonucleotide
gtctcccgcggcacctgcgccctttgtacaccatctga

SEQ ID NO: 45263 - DNA, 38 bp, Artificial Sequence
  Synthetic oligonucleotide
acgcgccgatcgtccatccttcgtaacctcctacgtga

SEQ ID NO: 45264 - DNA, 38 bp, Artificial Sequence
  Synthetic oligonucleotide
tgcgcccgagagcatgcctctcttactgccaccattga

SEQ ID NO: 45265 - DNA, 38 bp, Artificial Sequence
  Synthetic oligonucleotide
tgaaccacctttgtcagctcgtaaccttcgttcattga

SEQ ID NO: 45266 - DNA, 38 bp, Artificial Sequence
  Synthetic oligonucleotide
tccgggtgggaatgggtggggttggcgggggaccttga

SEQ ID NO: 45267 - DNA, 36 bp, Artificial Sequence
  Synthetic oligonucleotide
tactctcgctccctctatggattcctagttgcacta

SEQ ID NO: 45268 - DNA, 35 bp, Artificial Sequence
  Synthetic oligonucleotide
tctcagcaccaggcgtctctccgaccctataccta

SEQ ID NO: 45269 - DNA, 35 bp, Artificial Sequence
  Synthetic oligonucleotide
gactccagggcaccatacctaccaagcgagcgcta

SEQ ID NO: 45270 - DNA, 36 bp, Artificial Sequence
  Synthetic oligonucleotide
ttctcattgcctctcctccttttgcgactgtccgta

SEQ ID NO: 45271 - DNA, 35 bp, Artificial Sequence
  Synthetic oligonucleotide
tagtacgcgcggttcaagtatcccatcaaccaagc

SEQ ID NO: 45272 - DNA, 35 bp, Artificial Sequence
  Synthetic oligonucleotide
tgtgtagagccatacatttcctcacgtaattcttc

SEQ ID NO: 45273 - DNA, 35 bp, Artificial Sequence
  Synthetic oligonucleotide
atccgcggactttagtgacctatcctgcccacacg

SEQ ID NO: 45274 - DNA, 35 bp, Artificial Sequence
  Synthetic oligonucleotide
gcctgactcttctctgcacatgcatccagtacccg

SEQ ID NO: 45275 - DNA, 35 bp, Artificial Sequence
  Synthetic oligonucleotide
tttgccgaggccgtgcccgcatcattgatccctcg

SEQ ID NO: 45276 - DNA, 35 bp, Artificial Sequence
  Synthetic oligonucleotide
acatgccagccggtttcgcttcgtcatctccgctg

SEQ ID NO: 45277 - DNA, 35 bp, Artificial Sequence
  Synthetic oligonucleotide
gacaccgccatggagcattgcacatgtttctcttg

SEQ ID NO: 45278 - DNA, 35 bp, Artificial Sequence
  Synthetic oligonucleotide
tctgcgccagtaaccccctccgcttgcttcccaat

SEQ ID NO: 45279 - DNA, 35 bp, Artificial Sequence
  Synthetic oligonucleotide
gtatgtagacccgccgagttcgcgttcctcccact

SEQ ID NO: 45280 - DNA, 35 bp, Artificial Sequence
  Synthetic oligonucleotide
gcaaacacccattagatgatactttgtgctcacct

SEQ ID NO: 45281 - DNA, 35 bp, Artificial Sequence
  Synthetic oligonucleotide
ttcacactcacgccggagtactcgtcttagtacct

SEQ ID NO: 45282 - DNA, 35 bp, Artificial Sequence
  Synthetic oligonucleotide
tctaagggtaggggtcatgggggaggacaacggct

SEQ ID NO: 45283 - DNA, 35 bp, Artificial Sequence
  Synthetic oligonucleotide
ggtcaaaccacatcaccccactcaaccatgagggt

SEQ ID NO: 45284 - DNA, 35 bp, Artificial Sequence
  Synthetic oligonucleotide
ttcagccgccgattatacgcctctcttggtcatgt

SEQ ID NO: 45285 - DNA, 35 bp, Artificial Sequence
  Synthetic oligonucleotide
gaacagcagcctcttctgcacgactcctgcctatt

SEQ ID NO: 45286 - DNA, 35 bp, Artificial Sequence
  Synthetic oligonucleotide
ggtctaggtccccacgatggccccactgttccctt

SEQ ID NO: 45287 - DNA, 35 bp, Artificial Sequence
  Synthetic oligonucleotide
gggttgggaagtgggacgcttgagggagataattt

SEQ ID NO: 45288 - DNA, 35 bp, Artificial Sequence
  Synthetic oligonucleotide
gtagaaccggttggggaggagcatatcgggggaaa

SEQ ID NO: 45289 - DNA, 35 bp, Artificial Sequence
  Synthetic oligonucleotide
tgataactgcccattcctgcccttagagttcaaca

SEQ ID NO: 45290 - DNA, 35 bp, Artificial Sequence
  Synthetic oligonucleotide
acttgcctcgagagaacaataactgtcgacctcca

SEQ ID NO: 45291 - DNA, 36 bp, Artificial Sequence
  Synthetic oligonucleotide
gagcgacgcacatctcttttggcctcatcacgcgca

SEQ ID NO: 45292 - DNA, 37 bp, Artificial Sequence
  Synthetic oligonucleotide
gtgtcgccactgcctgttgattttcagaatgagacga

SEQ ID NO: 45293 - DNA, 37 bp, Artificial Sequence
  Synthetic oligonucleotide
tccagcgcaactttgaattcttcgcatcgtcccccga

SEQ ID NO: 45294 - DNA, 36 bp, Artificial Sequence
  Synthetic oligonucleotide
actaacatgctgcctaccactgcacctctcgcccga

SEQ ID NO: 45295 - DNA, 38 bp, Artificial Sequence
  Synthetic oligonucleotide
gcacgtggtaggggagggggagcactttggaggcatga

SEQ ID NO: 45296 - DNA, 37 bp, Artificial Sequence
  Synthetic oligonucleotide
gaaggggggagtggaatcttagggcaggtgaaactga

SEQ ID NO: 45297 - DNA, 37 bp, Artificial Sequence
  Synthetic oligonucleotide
tcaaccactcctcatgcccgtacgcatcctccactga

SEQ ID NO: 45298 - DNA, 38 bp, Artificial Sequence
  Synthetic oligonucleotide
gccatctcgcacaaaaacaccaggtccacgtcacctga

SEQ ID NO: 45299 - DNA, 37 bp, Artificial Sequence
  Synthetic oligonucleotide
accaccctcacctcgaagggagactgactcatattga

SEQ ID NO: 45300 - DNA, 37 bp, Artificial Sequence
  Synthetic oligonucleotide
gccgacgcacgttttatcgtgaacgatcctttcttga

SEQ ID NO: 45301 - DNA, 37 bp, Artificial Sequence
  Synthetic oligonucleotide
tccaccaaccagtgttctcacttaaacagctctttga

SEQ ID NO: 45302 - DNA, 35 bp, Artificial Sequence
  Synthetic oligonucleotide
tctggagggccgtggtgcttgctatctcctctgta

SEQ ID NO: 45303 - DNA, 36 bp, Artificial Sequence
  Synthetic oligonucleotide
gccccggactactctgctggaacctaactcccttta

SEQ ID NO: 45304 - DNA, 35 bp, Artificial Sequence
  Synthetic oligonucleotide
tgatggcgcatttgcaaccttagccaccccacacc

SEQ ID NO: 45305 - DNA, 35 bp, Artificial Sequence
  Synthetic oligonucleotide
gagtcgccacccccattatagttgtacactagcgc

SEQ ID NO: 45306 - DNA, 35 bp, Artificial Sequence
  Synthetic oligonucleotide
gtcccatccggtactttcagcggctgtattcgatc

SEQ ID NO: 45307 - DNA, 35 bp, Artificial Sequence
  Synthetic oligonucleotide
gttgacccgagcactcgctagtacatcaggaattc

SEQ ID NO: 45308 - DNA, 35 bp, Artificial Sequence
  Synthetic oligonucleotide
gctgtgaccaacctctcgacgctcatgaaccgttc

SEQ ID NO: 45309 - DNA, 35 bp, Artificial Sequence
  Synthetic oligonucleotide
gctcattcagcgcactcacggtcgtcttggctttc

SEQ ID NO: 45310 - DNA, 35 bp, Artificial Sequence
  Synthetic oligonucleotide
acttagcgctaatccaactcaccgcacccatctgg

SEQ ID NO: 45311 - DNA, 35 bp, Artificial Sequence
  Synthetic oligonucleotide
acttggctccacattacccctgcttgtttcgtttg

SEQ ID NO: 45312 - DNA, 35 bp, Artificial Sequence
  Synthetic oligonucleotide
ggggtaacgaggaaggcagtgagaggagcgcggat

SEQ ID NO: 45313 - DNA, 35 bp, Artificial Sequence
  Synthetic oligonucleotide
gccgaccgttatcgcttacgaatcgtagaacctct

SEQ ID NO: 45314 - DNA, 35 bp, Artificial Sequence
  Synthetic oligonucleotide
acctacccatccccgaatacatgatagagccttct

SEQ ID NO: 45315 - DNA, 35 bp, Artificial Sequence
  Synthetic oligonucleotide
tccaccgttgtcgccgccattatgctaccgcttct

SEQ ID NO: 45316 - DNA, 35 bp, Artificial Sequence
  Synthetic oligonucleotide
acaccgcactgtatcgcccgctcccaatcactcgt

SEQ ID NO: 45317 - DNA, 36 bp, Artificial Sequence
  Synthetic oligonucleotide
gtggggagggacgggacagggatactacttaaacaa

SEQ ID NO: 45318 - DNA, 36 bp, Artificial Sequence
  Synthetic oligonucleotide
atgggagcgcgaattgctactcccctcgcctgttaa

SEQ ID NO: 45319 - DNA, 36 bp, Artificial Sequence
  Synthetic oligonucleotide
gccctgatccgatttccacttccactactgctgaca

SEQ ID NO: 45320 - DNA, 36 bp, Artificial Sequence
  Synthetic oligonucleotide
gccaccgctcttcgtgtgctacccacttaatcccca

SEQ ID NO: 45321 - DNA, 36 bp, Artificial Sequence
  Synthetic oligonucleotide
acacgactcagcggccaatttcatatttcttcgtca

SEQ ID NO: 45322 - DNA, 36 bp, Artificial Sequence
  Synthetic oligonucleotide
aacgcgaggggaagaaaaggagactctggacgaaga

SEQ ID NO: 45323 - DNA, 36 bp, Artificial Sequence
  Synthetic oligonucleotide
gccaaacaggccggtcttcacgctccatcctagaga

SEQ ID NO: 45324 - DNA, 36 bp, Artificial Sequence
  Synthetic oligonucleotide
gccaaccccctactctaaaggccaatcgccgaccga

SEQ ID NO: 45325 - DNA, 35 bp, Artificial Sequence
  Synthetic oligonucleotide
tttgcgtggcgaaccgaccgatcccatatccccga

SEQ ID NO: 45326 - DNA, 37 bp, Artificial Sequence
  Synthetic oligonucleotide
gcacgaggtggagtccataccgaaacatctctcccga

SEQ ID NO: 45327 - DNA, 37 bp, Artificial Sequence
  Synthetic oligonucleotide
ggagtgaggtatgtagggcggtaatcagggggggcga

SEQ ID NO: 45328 - DNA, 35 bp, Artificial Sequence
  Synthetic oligonucleotide
tgtagcgggaccatcccactttctttacctggcga

SEQ ID NO: 45329 - DNA, 36 bp, Artificial Sequence
  Synthetic oligonucleotide
gacggtgcaggatgcatcagtagagtgattttgcga

SEQ ID NO: 45330 - DNA, 35 bp, Artificial Sequence
  Synthetic oligonucleotide
aaggggggagcaactgcaagaaaagaaacggtcga

SEQ ID NO: 45331 - DNA, 38 bp, Artificial Sequence
  Synthetic oligonucleotide
atcatccgcaggggctttctggctcaggccttccatga

SEQ ID NO: 45332 - DNA, 37 bp, Artificial Sequence
  Synthetic oligonucleotide
gacgactatcccgcctctcactagcatacttgcatga

SEQ ID NO: 45333 - DNA, 37 bp, Artificial Sequence
  Synthetic oligonucleotide
gatgcaaccgccactgatcactgatcctaacctatga

SEQ ID NO: 45334 - DNA, 34 bp, Artificial Sequence
  Synthetic oligonucleotide
taacatctcgcgtatctgcactgccctctgctga

SEQ ID NO: 45335 - DNA, 37 bp, Artificial Sequence
  Synthetic oligonucleotide
tgcacaaggcgactcacctacacactgacctttctga

SEQ ID NO: 45336 - DNA, 37 bp, Artificial Sequence
  Synthetic oligonucleotide
acccaatcctaaccgtcacacttgcctttgacagtga

SEQ ID NO: 45337 - DNA, 37 bp, Artificial Sequence
  Synthetic oligonucleotide
gattcgcacaaagcgatatttaacctcccatacgtga

SEQ ID NO: 45338 - DNA, 38 bp, Artificial Sequence
  Synthetic oligonucleotide
tcagcacacctacacgtcaatgtcccaatcctccgtga

SEQ ID NO: 45339 - DNA, 38 bp, Artificial Sequence
  Synthetic oligonucleotide
gtgagtcacggcgtgggtgggtgggtcgtgtgtggtga

SEQ ID NO: 45340 - DNA, 38 bp, Artificial Sequence
  Synthetic oligonucleotide
tgaaggtccgtcatgccagcccgcacgatttcccttga

SEQ ID NO: 45341 - DNA, 38 bp, Artificial Sequence
  Synthetic oligonucleotide
gcacctacgtccgtttttacttcttgtttttgccttga

SEQ ID NO: 45342 - DNA, 38 bp, Artificial Sequence
  Synthetic oligonucleotide
tcagggcacgcagcctactttattctagctactgttga

SEQ ID NO: 45343 - DNA, 36 bp, Artificial Sequence
  Synthetic oligonucleotide
acccgtacagcccctcgagtttttggtcaaacgata

SEQ ID NO: 45344 - DNA, 36 bp, Artificial Sequence
  Synthetic oligonucleotide
acctcggccgtgcagcttcacttcgcacaccgccta

SEQ ID NO: 45345 - DNA, 36 bp, Artificial Sequence
  Synthetic oligonucleotide
gcgaaccccaccctttactaccattgacacgtgtta

SEQ ID NO: 45346 - DNA, 36 bp, Artificial Sequence
  Synthetic oligonucleotide
taaccaccacacactgtgccgtgatccccggtgtta

SEQ ID NO: 45347 - DNA, 35 bp, Artificial Sequence
  Synthetic oligonucleotide
tacgccgccacataactatccagcgtaatgaggac

SEQ ID NO: 45348 - DNA, 35 bp, Artificial Sequence
  Synthetic oligonucleotide
tcacgaactgactctaatcactcatctttgatgac

SEQ ID NO: 45349 - DNA, 35 bp, Artificial Sequence
  Synthetic oligonucleotide
tgttcactcgctctttcgttatcacaacatccccc

SEQ ID NO: 45350 - DNA, 35 bp, Artificial Sequence
  Synthetic oligonucleotide
taagcccgccgttgcattctccctgttagtaagcc

SEQ ID NO: 45351 - DNA, 36 bp, Artificial Sequence
  Synthetic oligonucleotide
tcacctactatccactagctgtacgacggaaactcc

SEQ ID NO: 45352 - DNA, 35 bp, Artificial Sequence
  Synthetic oligonucleotide
attcaccgcgattatgtcaatcggggtcttgttcc

SEQ ID NO: 45353 - DNA, 35 bp, Artificial Sequence
  Synthetic oligonucleotide
gtgcccatacccaaatgtctgtccaattttctatc

SEQ ID NO: 45354 - DNA, 35 bp, Artificial Sequence
  Synthetic oligonucleotide
atgcgcccatctgagacaccatttccgacagcttc

SEQ ID NO: 45355 - DNA, 35 bp, Artificial Sequence
  Synthetic oligonucleotide
tactgagccgggggaataggaggtctctagaggag

SEQ ID NO: 45356 - DNA, 35 bp, Artificial Sequence
  Synthetic oligonucleotide
tccgttgtaggggtggaatagggtgaaacggtgag

SEQ ID NO: 45357 - DNA, 35 bp, Artificial Sequence
  Synthetic oligonucleotide
gtacaacaccatcgagtattctatctcctgggaat

SEQ ID NO: 45358 - DNA, 35 bp, Artificial Sequence
  Synthetic oligonucleotide
aaccccacttgaaatgtaacttatgtcctgttcat

SEQ ID NO: 45359 - DNA, 35 bp, Artificial Sequence
  Synthetic oligonucleotide
accccattcgagtttctttcttgctgacgttaact

SEQ ID NO: 45360 - DNA, 35 bp, Artificial Sequence
  Synthetic oligonucleotide
ataccaatcgtgccgtgcaattaggttcaccctct

SEQ ID NO: 45361 - DNA, 35 bp, Artificial Sequence
  Synthetic oligonucleotide
ttcccacactctgcaacgccacaagtctcgaactt

SEQ ID NO: 45362 - DNA, 33 bp, Artificial Sequence
  Synthetic oligonucleotide
tcccccccccggtgagatatgtcccttatgttt

SEQ ID NO: 45363 - DNA, 35 bp, Artificial Sequence
  Synthetic oligonucleotide
aaggccaacctcacagcgaccgcgttgccctgttt

SEQ ID NO: 45364 - DNA, 35 bp, Artificial Sequence
  Synthetic oligonucleotide
gcgcacccgccgaacggcctattgaattaattttt

SEQ ID NO: 45365 - DNA, 36 bp, Artificial Sequence
  Synthetic oligonucleotide
atgtgggcacatgtgcacttagccacctttcctcaa

SEQ ID NO: 45366 - DNA, 36 bp, Artificial Sequence
  Synthetic oligonucleotide
ggaccagcccatcacaattttacgccacaattcaca

SEQ ID NO: 45367 - DNA, 35 bp, Artificial Sequence
  Synthetic oligonucleotide
gaatcgctcgactcactccagtaacgcttccctca

SEQ ID NO: 45368 - DNA, 36 bp, Artificial Sequence
  Synthetic oligonucleotide
gaggtacaagggtgggaaatcagaagggaggtgtca

SEQ ID NO: 45369 - DNA, 37 bp, Artificial Sequence
  Synthetic oligonucleotide
atgagccaccccccaccggctagccctgtaaagcaga

SEQ ID NO: 45370 - DNA, 37 bp, Artificial Sequence
  Synthetic oligonucleotide
gaatcctacccccacagaagctctacgtactcgtaga

SEQ ID NO: 45371 - DNA, 37 bp, Artificial Sequence
  Synthetic oligonucleotide
tgccgcctgtctgttgacttctctaccttcgtctcga

SEQ ID NO: 45372 - DNA, 37 bp, Artificial Sequence
  Synthetic oligonucleotide
tcatcatccacctgcgggtatcaatccttttcccgga

SEQ ID NO: 45373 - DNA, 36 bp, Artificial Sequence
  Synthetic oligonucleotide
gatcggggggaaacgaggatgcaggcaagggaggga

SEQ ID NO: 45374 - DNA, 35 bp, Artificial Sequence
  Synthetic oligonucleotide
tgataacagtacatgtgggggcgggcggtggggga

SEQ ID NO: 45375 - DNA, 38 bp, Artificial Sequence
  Synthetic oligonucleotide
gtggagagggagtaatgttggtggtgctggaagggtga

SEQ ID NO: 45376 - DNA, 37 bp, Artificial Sequence
  Synthetic oligonucleotide
acgaccgatcgcaccaccgtacaatggcgcctcttga

SEQ ID NO: 45377 - DNA, 35 bp, Artificial Sequence
  Synthetic oligonucleotide
tagatcaccccgttggtcattttttcctttcttga

SEQ ID NO: 45378 - DNA, 36 bp, Artificial Sequence
  Synthetic oligonucleotide
gagtgggaagtcaattggggttgggtaaagctgcta

SEQ ID NO: 45379 - DNA, 35 bp, Artificial Sequence
  Synthetic oligonucleotide
tttcacacaccgtacccaggttcatggtacctcta

SEQ ID NO: 45380 - DNA, 37 bp, Artificial Sequence
  Synthetic oligonucleotide
tcaccacctatccagaatcttggcctaccgggaggta

SEQ ID NO: 45381 - DNA, 36 bp, Artificial Sequence
  Synthetic oligonucleotide
gtcgcactggccaacacagtctcgtcatcctgctta

SEQ ID NO: 45382 - DNA, 35 bp, Artificial Sequence
  Synthetic oligonucleotide
tgacttcagtcaacaagagtacctctcctttacac

SEQ ID NO: 45383 - DNA, 35 bp, Artificial Sequence
  Synthetic oligonucleotide
acaccaccgccgtgacaccctaggtcattttccac

SEQ ID NO: 45384 - DNA, 35 bp, Artificial Sequence
  Synthetic oligonucleotide
agtcacaaccggtcccaacgtcctttaccaagcac

SEQ ID NO: 45385 - DNA, 35 bp, Artificial Sequence
  Synthetic oligonucleotide
tacccttgcatgcctgtggacctggccgccacacc

SEQ ID NO: 45386 - DNA, 35 bp, Artificial Sequence
  Synthetic oligonucleotide
tcacgcaggcgcttgactgccttgatcccacatcc

SEQ ID NO: 45387 - DNA, 35 bp, Artificial Sequence
  Synthetic oligonucleotide
gggggcctccgtcaaacacactctgcgaatccggc

SEQ ID NO: 45388 - DNA, 35 bp, Artificial Sequence
  Synthetic oligonucleotide
atccacggactgtgtgagggtgtggtgcgtgtggc

SEQ ID NO: 45389 - DNA, 35 bp, Artificial Sequence
  Synthetic oligonucleotide
gtcacagtgcgtttccggtattccccattacaatc

SEQ ID NO: 45390 - DNA, 35 bp, Artificial Sequence
  Synthetic oligonucleotide
agccacagttaaacctccccgctgattcttgagtc

SEQ ID NO: 45391 - DNA, 35 bp, Artificial Sequence
  Synthetic oligonucleotide
taccgtacacgccctccatacgaccgcccctctag

SEQ ID NO: 45392 - DNA, 35 bp, Artificial Sequence
  Synthetic oligonucleotide
accctgtccactagtgccaatttacccagctatcg

SEQ ID NO: 45393 - DNA, 34 bp, Artificial Sequence
  Synthetic oligonucleotide
tgaagcctagaacctggcctcctccccgccgtcg

SEQ ID NO: 45394 - DNA, 35 bp, Artificial Sequence
  Synthetic oligonucleotide
ttgtagctactggctccacttgacctccgttttcg

SEQ ID NO: 45395 - DNA, 35 bp, Artificial Sequence
  Synthetic oligonucleotide
aaggacgagaggacgagcagaacaacgacataagg

SEQ ID NO: 45396 - DNA, 35 bp, Artificial Sequence
  Synthetic oligonucleotide
tagggggtgtggcgtgggttaggcacggttatggg

SEQ ID NO: 45397 - DNA, 35 bp, Artificial Sequence
  Synthetic oligonucleotide
tcactgcacaggcacgtatcaccgcgagctttaat

SEQ ID NO: 45398 - DNA, 35 bp, Artificial Sequence
  Synthetic oligonucleotide
atgccactccctcgcatacgacctgcccatccact

SEQ ID NO: 45399 - DNA, 35 bp, Artificial Sequence
  Synthetic oligonucleotide
attccctcgccacaggtccttactccttagagact

SEQ ID NO: 45400 - DNA, 35 bp, Artificial Sequence
  Synthetic oligonucleotide
aggacggagggtgggaggtaacggcgtgagtgact

SEQ ID NO: 45401 - DNA, 35 bp, Artificial Sequence
  Synthetic oligonucleotide
tgccagaggcatcggagcgtcgttcattcgctggt

SEQ ID NO: 45402 - DNA, 35 bp, Artificial Sequence
  Synthetic oligonucleotide
accggcatactccatgagtcctttccccgaactgt

SEQ ID NO: 45403 - DNA, 35 bp, Artificial Sequence
  Synthetic oligonucleotide
tgacggaccgcattctgtaaccttggtcaattctt

SEQ ID NO: 45404 - DNA, 35 bp, Artificial Sequence
  Synthetic oligonucleotide
tgtgagggtgggggatatgggtgcgaggtggattt

SEQ ID NO: 45405 - DNA, 36 bp, Artificial Sequence
  Synthetic oligonucleotide
tacccccgacattagctcattatgctaagcccccaa

SEQ ID NO: 45406 - DNA, 36 bp, Artificial Sequence
  Synthetic oligonucleotide
tatagtgctgccacccaagtccttatggtcctccaa

SEQ ID NO: 45407 - DNA, 36 bp, Artificial Sequence
  Synthetic oligonucleotide
tctcgccgccatgccactatctgatatgcccacgaa

SEQ ID NO: 45408 - DNA, 36 bp, Artificial Sequence
  Synthetic oligonucleotide
tgagtaggagggggtggtgcgcggcacagttaggaa

SEQ ID NO: 45409 - DNA, 36 bp, Artificial Sequence
  Synthetic oligonucleotide
caagcacggtagcttgcccattcgcgcactgagaca

SEQ ID NO: 45410 - DNA, 36 bp, Artificial Sequence
  Synthetic oligonucleotide
tcagtgcaggcgtcaatagtgatgccgcctttccca

SEQ ID NO: 45411 - DNA, 36 bp, Artificial Sequence
  Synthetic oligonucleotide
acactcgccaaggttaatgcacaactttccttatca

SEQ ID NO: 45412 - DNA, 37 bp, Artificial Sequence
  Synthetic oligonucleotide
agcacaccatctaactacgacactctcatgcgtgcga

SEQ ID NO: 45413 - DNA, 37 bp, Artificial Sequence
  Synthetic oligonucleotide
accgccaaccgctcttcgcacattaacactgtctcga

SEQ ID NO: 45414 - DNA, 37 bp, Artificial Sequence
  Synthetic oligonucleotide
taagagaggaactaatcgtggtaggagggcgacggga

SEQ ID NO: 45415 - DNA, 35 bp, Artificial Sequence
  Synthetic oligonucleotide
agtgggcgataaggagcgtggggaggcgagatgga

SEQ ID NO: 45416 - DNA, 36 bp, Artificial Sequence
  Synthetic oligonucleotide
agccgagcaaaaggagggggggctgggcgtactgga

SEQ ID NO: 45417 - DNA, 38 bp, Artificial Sequence
  Synthetic oligonucleotide
tacgcacagtactaacggaaaatcgcacttcacactga

SEQ ID NO: 45418 - DNA, 37 bp, Artificial Sequence
  Synthetic oligonucleotide
taagcctgcctaatcttctgaacgtcgatagacctga

SEQ ID NO: 45419 - DNA, 38 bp, Artificial Sequence
  Synthetic oligonucleotide
gaaacggcgaattgtgggctatagggatggggggctga

SEQ ID NO: 45420 - DNA, 38 bp, Artificial Sequence
  Synthetic oligonucleotide
gttgtggcaacggtttatcactccccatctgttcgtga

SEQ ID NO: 45421 - DNA, 38 bp, Artificial Sequence
  Synthetic oligonucleotide
aactgccatcgagcacccgaccactgacaacgaattga

SEQ ID NO: 45422 - DNA, 38 bp, Artificial Sequence
  Synthetic oligonucleotide
gtcaacgcgggggagggagagaacacatggggtattga

SEQ ID NO: 45423 - DNA, 37 bp, Artificial Sequence
  Synthetic oligonucleotide
aaccagctgggccatcgctgttcctcttattgcttga

SEQ ID NO: 45424 - DNA, 38 bp, Artificial Sequence
  Synthetic oligonucleotide
tctacatgcccactgcactttggaggacctcatcttga

SEQ ID NO: 45425 - DNA, 38 bp, Artificial Sequence
  Synthetic oligonucleotide
gtacgtgctgcagtaatattgccaaaaatcgagtttga

SEQ ID NO: 45426 - DNA, 35 bp, Artificial Sequence
  Synthetic oligonucleotide
atccacccaaatgctctgactacagacctcgtgta

SEQ ID NO: 45427 - DNA, 35 bp, Artificial Sequence
  Synthetic oligonucleotide
ttattgcgtagtcccctttatcatgcccctggtac

SEQ ID NO: 45428 - DNA, 35 bp, Artificial Sequence
  Synthetic oligonucleotide
gcactacagtcgatctctggcatgcacgtacttac

SEQ ID NO: 45429 - DNA, 35 bp, Artificial Sequence
  Synthetic oligonucleotide
tttcccgccaccactgttcccttcaagcatcaacc

SEQ ID NO: 45430 - DNA, 35 bp, Artificial Sequence
  Synthetic oligonucleotide
acccccccgaatgcgatggccattcagacggaccc

SEQ ID NO: 45431 - DNA, 36 bp, Artificial Sequence
  Synthetic oligonucleotide
tcgtgtgcaggccccccctccatagacacccctccc

SEQ ID NO: 45432 - DNA, 35 bp, Artificial Sequence
  Synthetic oligonucleotide
gtaggcacacggctctcgtatcttggttgtctccc

SEQ ID NO: 45433 - DNA, 35 bp, Artificial Sequence
  Synthetic oligonucleotide
ttaccgacctcgtactggggcgagtacatagctcc

SEQ ID NO: 45434 - DNA, 35 bp, Artificial Sequence
  Synthetic oligonucleotide
tcgctccagattcgctctaaacctctgtcctatgc

SEQ ID NO: 45435 - DNA, 35 bp, Artificial Sequence
  Synthetic oligonucleotide
tgctagcatctggttttctgtctcttgtttcgtgc

SEQ ID NO: 45436 - DNA, 35 bp, Artificial Sequence
  Synthetic oligonucleotide
gccatggaccctggccctgtcactcaagtatcctc

SEQ ID NO: 45437 - DNA, 35 bp, Artificial Sequence
  Synthetic oligonucleotide
aaccccacctcttgtcttgattctcaggtatgttc

SEQ ID NO: 45438 - DNA, 35 bp, Artificial Sequence
  Synthetic oligonucleotide
aactcggcccacgccctctgacacaaatctgctag

SEQ ID NO: 45439 - DNA, 35 bp, Artificial Sequence
  Synthetic oligonucleotide
accgccccacttcattcccggaacccatgcacccg

SEQ ID NO: 45440 - DNA, 35 bp, Artificial Sequence
  Synthetic oligonucleotide
atgaggtgggggggccaaggcaacaggcgagtggg

SEQ ID NO: 45441 - DNA, 35 bp, Artificial Sequence
  Synthetic oligonucleotide
agttggagcctggggataaagagctgatgggtggg

SEQ ID NO: 45442 - DNA, 34 bp, Artificial Sequence
  Synthetic oligonucleotide
acatacaccctcaactctccggacacacccactg

SEQ ID NO: 45443 - DNA, 35 bp, Artificial Sequence
  Synthetic oligonucleotide
gatccgggcgccaattccgggatccaagccctcct

SEQ ID NO: 45444 - DNA, 35 bp, Artificial Sequence
  Synthetic oligonucleotide
gtcgggcatcctttgccccttgtgtttctccatct

SEQ ID NO: 45445 - DNA, 36 bp, Artificial Sequence
  Synthetic oligonucleotide
atgaggctcactcgatacatgcaactcgccctcaaa

SEQ ID NO: 45446 - DNA, 35 bp, Artificial Sequence
  Synthetic oligonucleotide
taacagggagaagggtaggaggggatgtttggcaa

SEQ ID NO: 45447 - DNA, 34 bp, Artificial Sequence
  Synthetic oligonucleotide
aaggggaggcgtggggcacaaaacgagagcgtaa

SEQ ID NO: 45448 - DNA, 36 bp, Artificial Sequence
  Synthetic oligonucleotide
gccattgaggtccttgttgcgattccgcccgcccca

SEQ ID NO: 45449 - DNA, 36 bp, Artificial Sequence
  Synthetic oligonucleotide
tgccgaatgcatcacctttagccacctgttatcgca

SEQ ID NO: 45450 - DNA, 37 bp, Artificial Sequence
  Synthetic oligonucleotide
tccaccccttcatagtctttgagcgaatcgatctaga

SEQ ID NO: 45451 - DNA, 37 bp, Artificial Sequence
  Synthetic oligonucleotide
tgcccttcccctctccggtgcagtacttagccaacga

SEQ ID NO: 45452 - DNA, 37 bp, Artificial Sequence
  Synthetic oligonucleotide
tgattcaccccagtcctcgcttgtcttaatttcacga

SEQ ID NO: 45453 - DNA, 37 bp, Artificial Sequence
  Synthetic oligonucleotide
gacctgggggggaggatgagcaacggaggcttgacga

SEQ ID NO: 45454 - DNA, 37 bp, Artificial Sequence
  Synthetic oligonucleotide
tcacactcgcaaatggccgtgacgtatcaactgccga

SEQ ID NO: 45455 - DNA, 37 bp, Artificial Sequence
  Synthetic oligonucleotide
tcccccgatcagtctcaccttttgctaccgtctccga

SEQ ID NO: 45456 - DNA, 37 bp, Artificial Sequence
  Synthetic oligonucleotide
gagaggaccgggaggggtggaagacttagaggtccga

SEQ ID NO: 45457 - DNA, 37 bp, Artificial Sequence
  Synthetic oligonucleotide
ttagtcgacgtcaagatctccgcctcccaattttcga

SEQ ID NO: 45458 - DNA, 37 bp, Artificial Sequence
  Synthetic oligonucleotide
gttcacaacgcaccatgaactagacgcaagttttcga

SEQ ID NO: 45459 - DNA, 36 bp, Artificial Sequence
  Synthetic oligonucleotide
aaccgcgggagagactggccggaaacagggggagga

SEQ ID NO: 45460 - DNA, 37 bp, Artificial Sequence
  Synthetic oligonucleotide
acgccgcccgctccagcccccttttggtgataacgga

SEQ ID NO: 45461 - DNA, 38 bp, Artificial Sequence
  Synthetic oligonucleotide
atgctaactagctctgtatcccctgctcaccttactga

SEQ ID NO: 45462 - DNA, 36 bp, Artificial Sequence
  Synthetic oligonucleotide
gccttctgaactgtactaccccacctcctcacgtga

SEQ ID NO: 45463 - DNA, 38 bp, Artificial Sequence
  Synthetic oligonucleotide
tgctccagccgccgtgctgcttttctctgacatgttga

SEQ ID NO: 45464 - DNA, 35 bp, Artificial Sequence
  Synthetic oligonucleotide
ttgccgccttcgctaaggggccacacacgaaccta

SEQ ID NO: 45465 - DNA, 36 bp, Artificial Sequence
  Synthetic oligonucleotide
ggtccccatcccccgccaacaacatgcatgctatta

SEQ ID NO: 45466 - DNA, 35 bp, Artificial Sequence
  Synthetic oligonucleotide
tgacatctactgcacttatatctgtcgcttaaacc

SEQ ID NO: 45467 - DNA, 35 bp, Artificial Sequence
  Synthetic oligonucleotide
atgagtcgccgcgcattcgactgccctgccgaacc

SEQ ID NO: 45468 - DNA, 35 bp, Artificial Sequence
  Synthetic oligonucleotide
ttgacaaagcatttgggaccaaacacatgcacacc

SEQ ID NO: 45469 - DNA, 35 bp, Artificial Sequence
  Synthetic oligonucleotide
gccgggctcggcactcttcatatttacaagtcacc

SEQ ID NO: 45470 - DNA, 35 bp, Artificial Sequence
  Synthetic oligonucleotide
ataatggcccacctcccccaacatgtagcctggcc

SEQ ID NO: 45471 - DNA, 35 bp, Artificial Sequence
  Synthetic oligonucleotide
aacccgaaccgataaggtcccacgcgtgccactgc

SEQ ID NO: 45472 - DNA, 35 bp, Artificial Sequence
  Synthetic oligonucleotide
gcaccgctgcgcaacgctgatccactacctggtgc

SEQ ID NO: 45473 - DNA, 35 bp, Artificial Sequence
  Synthetic oligonucleotide
atggcacctccacactcggtaattggctccgttcg

SEQ ID NO: 45474 - DNA, 35 bp, Artificial Sequence
  Synthetic oligonucleotide
acccgattccgacgtggcactacaacactgcgctg

SEQ ID NO: 45475 - DNA, 35 bp, Artificial Sequence
  Synthetic oligonucleotide
gttcgcccccaagcactagctctggttcctacaat

SEQ ID NO: 45476 - DNA, 35 bp, Artificial Sequence
  Synthetic oligonucleotide
tcacagcacacgtgaggatactttcattgttctat

SEQ ID NO: 45477 - DNA, 35 bp, Artificial Sequence
  Synthetic oligonucleotide
tcgcagtagtcgcaccccccgaccgtgttggccct

SEQ ID NO: 45478 - DNA, 34 bp, Artificial Sequence
  Synthetic oligonucleotide
gatttgcctacccccagtttttcatttgttcgtt

SEQ ID NO: 45479 - DNA, 36 bp, Artificial Sequence
  Synthetic oligonucleotide
tccacccacgggcattctcgaggtactcgaccaaaa

SEQ ID NO: 45480 - DNA, 35 bp, Artificial Sequence
  Synthetic oligonucleotide
gtcgagcgcgcacgcctttccccccacataattaa

SEQ ID NO: 45481 - DNA, 36 bp, Artificial Sequence
  Synthetic oligonucleotide
tacccgctagaaccacccttcctgcagtgctcagca

SEQ ID NO: 45482 - DNA, 36 bp, Artificial Sequence
  Synthetic oligonucleotide
acccctacgcgaaagcaagcaccatcccgttatgca

SEQ ID NO: 45483 - DNA, 36 bp, Artificial Sequence
  Synthetic oligonucleotide
tctgtgacaagacccagccaatttctctccggatca

SEQ ID NO: 45484 - DNA, 36 bp, Artificial Sequence
  Synthetic oligonucleotide
ggtcccggggattgggcctcctccactgcttactca

SEQ ID NO: 45485 - DNA, 37 bp, Artificial Sequence
  Synthetic oligonucleotide
agtgcactgctttcgatccatcctctctctcaaccga

SEQ ID NO: 45486 - DNA, 37 bp, Artificial Sequence
  Synthetic oligonucleotide
tcaaatgtacgcccgctcatgtctgccatccacccga

SEQ ID NO: 45487 - DNA, 36 bp, Artificial Sequence
  Synthetic oligonucleotide
gggggggggagggttggggacttaagtcagggccga

SEQ ID NO: 45488 - DNA, 36 bp, Artificial Sequence
  Synthetic oligonucleotide
acacgccgtaggggaaagcgagttcaagaacgagga

SEQ ID NO: 45489 - DNA, 37 bp, Artificial Sequence
  Synthetic oligonucleotide
tgggactggggtaggggcattaggagattggaaggga

SEQ ID NO: 45490 - DNA, 37 bp, Artificial Sequence
  Synthetic oligonucleotide
tgaggcctgagagggagaaatcatgtcaggaagggga

SEQ ID NO: 45491 - DNA, 37 bp, Artificial Sequence
  Synthetic oligonucleotide
gtgacgctgggacggctgttactcctttactccatga

SEQ ID NO: 45492 - DNA, 38 bp, Artificial Sequence
  Synthetic oligonucleotide
tgcccacatgagccttgaccatatgcctatcttgctga

SEQ ID NO: 45493 - DNA, 38 bp, Artificial Sequence
  Synthetic oligonucleotide
atgatgcctcctgctgatttatcgttgctcgccattga

SEQ ID NO: 45494 - DNA, 38 bp, Artificial Sequence
  Synthetic oligonucleotide
ttcgccgtactattgcgtcatcccccactttcgattga

SEQ ID NO: 45495 - DNA, 35 bp, Artificial Sequence
  Synthetic oligonucleotide
gcctatccatctcacgtctggtaatacactgttga

SEQ ID NO: 45496 - DNA, 38 bp, Artificial Sequence
  Synthetic oligonucleotide
acactgtgtacgcctggctctcccatgcccttctttga

SEQ ID NO: 45497 - DNA, 36 bp, Artificial Sequence
  Synthetic oligonucleotide
gctctttgcccacgcctgctcgtacgcccccatata

SEQ ID NO: 45498 - DNA, 35 bp, Artificial Sequence
  Synthetic oligonucleotide
atgtcacacccattctgccaaggtcgccggctcta

SEQ ID NO: 45499 - DNA, 36 bp, Artificial Sequence
  Synthetic oligonucleotide
tacgcggacaagatggagagggaggtgagtgctgta

SEQ ID NO: 45500 - DNA, 35 bp, Artificial Sequence
  Synthetic oligonucleotide
acctggaccggtacattggtaatcacccgctaaac

SEQ ID NO: 45501 - DNA, 35 bp, Artificial Sequence
  Synthetic oligonucleotide
tgaagcagaaccgggtccttattcatgcgctgccc

SEQ ID NO: 45502 - DNA, 35 bp, Artificial Sequence
  Synthetic oligonucleotide
acacagatcggttgagtgagggtggagcggatggc

SEQ ID NO: 45503 - DNA, 35 bp, Artificial Sequence
  Synthetic oligonucleotide
gattgacgtacctgctccatagtactgagctctgc

SEQ ID NO: 45504 - DNA, 35 bp, Artificial Sequence
  Synthetic oligonucleotide
ggatgtacgttgggagtagacggaaggggttgaag

SEQ ID NO: 45505 - DNA, 35 bp, Artificial Sequence
  Synthetic oligonucleotide
gcctgcttaacccccccattccagccgcagagagg

SEQ ID NO: 45506 - DNA, 35 bp, Artificial Sequence
  Synthetic oligonucleotide
aaggtgatgtggatggattggtggtgtggtggtgg

SEQ ID NO: 45507 - DNA, 35 bp, Artificial Sequence
  Synthetic oligonucleotide
actcccaccgttctcgtttttccccgcgacgaatg

SEQ ID NO: 45508 - DNA, 35 bp, Artificial Sequence
  Synthetic oligonucleotide
gccacccgctgctgtaccgtccggagccgactcat

SEQ ID NO: 45509 - DNA, 35 bp, Artificial Sequence
  Synthetic oligonucleotide
gtacctcccgatcgtatctcgcatgactccacgat

SEQ ID NO: 45510 - DNA, 35 bp, Artificial Sequence
  Synthetic oligonucleotide
gttgaaacacccgattggctttttgtactactact

SEQ ID NO: 45511 - DNA, 34 bp, Artificial Sequence
  Synthetic oligonucleotide
tttggaactatcgcatgcctttgcaccttaccct

SEQ ID NO: 45512 - DNA, 35 bp, Artificial Sequence
  Synthetic oligonucleotide
gtgcccccgactcttgtttcgtacacgtccgcgct

SEQ ID NO: 45513 - DNA, 35 bp, Artificial Sequence
  Synthetic oligonucleotide
agtggggttcaggggggggaagaaagctgggaagt

SEQ ID NO: 45514 - DNA, 35 bp, Artificial Sequence
  Synthetic oligonucleotide
gtgaaagagcagaaatgaatgggtggtatagtcgt

SEQ ID NO: 45515 - DNA, 35 bp, Artificial Sequence
  Synthetic oligonucleotide
gccacgtccacaattgcgcccgctgtagtcttcgt

SEQ ID NO: 45516 - DNA, 35 bp, Artificial Sequence
  Synthetic oligonucleotide
ggggcccacaactcatgccgactaaagctccctgt

SEQ ID NO: 45517 - DNA, 35 bp, Artificial Sequence
  Synthetic oligonucleotide
gtcaacaccgccatcatcgaattttggtttcgtgt

SEQ ID NO: 45518 - DNA, 35 bp, Artificial Sequence
  Synthetic oligonucleotide
tcaaccacaagacaaggtaccctttcatctccctt

SEQ ID NO: 45519 - DNA, 35 bp, Artificial Sequence
  Synthetic oligonucleotide
aaccacaacgcccttttttaggccatctcgctttt

SEQ ID NO: 45520 - DNA, 35 bp, Artificial Sequence
  Synthetic oligonucleotide
acccctgtgcatcttattatcgaatacgacttttt

SEQ ID NO: 45521 - DNA, 36 bp, Artificial Sequence
  Synthetic oligonucleotide
gttacctcaccatcgttgtccaccgcgcccaccaaa

SEQ ID NO: 45522 - DNA, 36 bp, Artificial Sequence
  Synthetic oligonucleotide
gccacacccggggagagcccactttatacaacacaa

SEQ ID NO: 45523 - DNA, 36 bp, Artificial Sequence
  Synthetic oligonucleotide
gcacacccgttcgtttcatatgcctgccctccctaa

SEQ ID NO: 45524 - DNA, 36 bp, Artificial Sequence
  Synthetic oligonucleotide
tcgcaactgacaccgggtccacattgcctctcgtaa

SEQ ID NO: 45525 - DNA, 36 bp, Artificial Sequence
  Synthetic oligonucleotide
aaccacacagtgaccgctgttgcgtttacctttaca

SEQ ID NO: 45526 - DNA, 36 bp, Artificial Sequence
  Synthetic oligonucleotide
gtgccagggcactttgaccttttttgagtaccttca

SEQ ID NO: 45527 - DNA, 37 bp, Artificial Sequence
  Synthetic oligonucleotide
tcctccacgtacgctgcaccctacatccagtacccga

SEQ ID NO: 45528 - DNA, 37 bp, Artificial Sequence
  Synthetic oligonucleotide
gtgccccccgccgatttgctttgtccgtttccagcga

SEQ ID NO: 45529 - DNA, 37 bp, Artificial Sequence
  Synthetic oligonucleotide
gtgtgcgggactggaggggtttgcgactcggaaagga

SEQ ID NO: 45530 - DNA, 37 bp, Artificial Sequence
  Synthetic oligonucleotide
agcgacgccacaacctataatgttccggtgccaagga

SEQ ID NO: 45531 - DNA, 37 bp, Artificial Sequence
  Synthetic oligonucleotide
tccgggcaacctcccgcttaaccaccagtatctatga

SEQ ID NO: 45532 - DNA, 38 bp, Artificial Sequence
  Synthetic oligonucleotide
tgtccagcccaccgcgcgtccatacgtacttacactga

SEQ ID NO: 45533 - DNA, 37 bp, Artificial Sequence
  Synthetic oligonucleotide
gagtgtaccgccacttttgggctcaaccctgacctga

SEQ ID NO: 45534 - DNA, 38 bp, Artificial Sequence
  Synthetic oligonucleotide
tattcgccactccccttgctggtgtttaggtctcctga

SEQ ID NO: 45535 - DNA, 38 bp, Artificial Sequence
  Synthetic oligonucleotide
ttgagccggcggataatcaacgtccccagctttcctga

SEQ ID NO: 45536 - DNA, 38 bp, Artificial Sequence
  Synthetic oligonucleotide
gacgtacgcctgcctgggatcggtgccatattttctga

SEQ ID NO: 45537 - DNA, 38 bp, Artificial Sequence
  Synthetic oligonucleotide
gatgtccccacacgctcctcaagaccatgccgcattga

SEQ ID NO: 45538 - DNA, 38 bp, Artificial Sequence
  Synthetic oligonucleotide
gagctcgccgcccccagcatttgcctttcaacccttga

SEQ ID NO: 45539 - DNA, 35 bp, Artificial Sequence
  Synthetic oligonucleotide
gtctctgcccacttatggtcgcctataacccgata

SEQ ID NO: 45540 - DNA, 36 bp, Artificial Sequence
  Synthetic oligonucleotide
tacaagtccctggccgatcacgcatcatccgaccta

SEQ ID NO: 45541 - DNA, 36 bp, Artificial Sequence
  Synthetic oligonucleotide
gtatcaacagggagagagatgggggactggatggta

SEQ ID NO: 45542 - DNA, 36 bp, Artificial Sequence
  Synthetic oligonucleotide
tgtgtctatgcagccgcgtttccgtgtccccctgta

SEQ ID NO: 45543 - DNA, 35 bp, Artificial Sequence
  Synthetic oligonucleotide
cactcacccccgctatctttagatctgcttcttac

SEQ ID NO: 45544 - DNA, 35 bp, Artificial Sequence
  Synthetic oligonucleotide
tctaaccccagaaatgctgttttgctcctgcaccc

SEQ ID NO: 45545 - DNA, 35 bp, Artificial Sequence
  Synthetic oligonucleotide
tgaccacagaatcccgcataggcctccgagctagc

SEQ ID NO: 45546 - DNA, 35 bp, Artificial Sequence
  Synthetic oligonucleotide
gccctttcccacacggtgttatgtcctttacccgc

SEQ ID NO: 45547 - DNA, 35 bp, Artificial Sequence
  Synthetic oligonucleotide
gagttgcgtacttgctaatttgaattacaccccgc

SEQ ID NO: 45548 - DNA, 35 bp, Artificial Sequence
  Synthetic oligonucleotide
acgaggggccaatgcttttccgtccctggtactgc

SEQ ID NO: 45549 - DNA, 35 bp, Artificial Sequence
  Synthetic oligonucleotide
atacgacgacttctttctgtccttagcccctctcg

SEQ ID NO: 45550 - DNA, 35 bp, Artificial Sequence
  Synthetic oligonucleotide
tacaccacatcgggctgccactgcactgccaaagg

SEQ ID NO: 45551 - DNA, 35 bp, Artificial Sequence
  Synthetic oligonucleotide
gaagtttgaggggcgaatagaaaaaaacaaagggg

SEQ ID NO: 45552 - DNA, 35 bp, Artificial Sequence
  Synthetic oligonucleotide
gttggggccccctttcctgttgtgacattgtgctg

SEQ ID NO: 45553 - DNA, 35 bp, Artificial Sequence
  Synthetic oligonucleotide
gtgatctgtggtcaatctgtcgctctctatacttg

SEQ ID NO: 45554 - DNA, 35 bp, Artificial Sequence
  Synthetic oligonucleotide
actaccgcctgaggcatttgcttactcgatccaat

SEQ ID NO: 45555 - DNA, 35 bp, Artificial Sequence
  Synthetic oligonucleotide
tacgcacttacccgtcacgctcgtgtgatgcccct

SEQ ID NO: 45556 - DNA, 35 bp, Artificial Sequence
  Synthetic oligonucleotide
attgtctggctctacccttacgtttgctccctgct

SEQ ID NO: 45557 - DNA, 35 bp, Artificial Sequence
  Synthetic oligonucleotide
tgatgggccacccatttacacttgttgacttactt

SEQ ID NO: 45558 - DNA, 35 bp, Artificial Sequence
  Synthetic oligonucleotide
acgtacaccctctctccttgggccacgaagtcctt

SEQ ID NO: 45559 - DNA, 35 bp, Artificial Sequence
  Synthetic oligonucleotide
acctgggacacagggcatttccgcctccctcccaa

SEQ ID NO: 45560 - DNA, 36 bp, Artificial Sequence
  Synthetic oligonucleotide
gccctgctacttaccctctttatgctgcactcgcca

SEQ ID NO: 45561 - DNA, 36 bp, Artificial Sequence
  Synthetic oligonucleotide
ttgcgcccaccgccgcccttattagatctcgccgca

SEQ ID NO: 45562 - DNA, 36 bp, Artificial Sequence
  Synthetic oligonucleotide
acccgggagctccctggtagcatttccatcctcgca

SEQ ID NO: 45563 - DNA, 36 bp, Artificial Sequence
  Synthetic oligonucleotide
gatcagacactcgaatgtaattacctcacacgtgca

SEQ ID NO: 45564 - DNA, 37 bp, Artificial Sequence
  Synthetic oligonucleotide
ttgcgcaaccgcccgtatcatctgccttccgttacga

SEQ ID NO: 45565 - DNA, 37 bp, Artificial Sequence
  Synthetic oligonucleotide
taccccccacgtacggaacgagtccaatatcctccga

SEQ ID NO: 45566 - DNA, 37 bp, Artificial Sequence
  Synthetic oligonucleotide
tgtccgccgcacctgccctttatgccgatctacggga

SEQ ID NO: 45567 - DNA, 38 bp, Artificial Sequence
  Synthetic oligonucleotide
tttggcgacgcatctttacttttgactccgcgacctga

SEQ ID NO: 45568 - DNA, 38 bp, Artificial Sequence
  Synthetic oligonucleotide
gaagcatcaggcgtcctgccactggaatcaaaccctga

SEQ ID NO: 45569 - DNA, 36 bp, Artificial Sequence
  Synthetic oligonucleotide
gaacagggcaaaacacctgtcactgacctaccctga

SEQ ID NO: 45570 - DNA, 38 bp, Artificial Sequence
  Synthetic oligonucleotide
tgcataagcgggtgggaacgggttgggtcgtttcgtga

SEQ ID NO: 45571 - DNA, 37 bp, Artificial Sequence
  Synthetic oligonucleotide
cacactcctcctattgatttgccgcactgcactgtga

SEQ ID NO: 45572 - DNA, 35 bp, Artificial Sequence
  Synthetic oligonucleotide
ggacacacgggctggtaaatggggttgttacaata

SEQ ID NO: 45573 - DNA, 35 bp, Artificial Sequence
  Synthetic oligonucleotide
gacgccccacgggacttacgaggacgtgcaccata

SEQ ID NO: 45574 - DNA, 35 bp, Artificial Sequence
  Synthetic oligonucleotide
tattggtggccccgttctcgtcacagccattctta

SEQ ID NO: 45575 - DNA, 35 bp, Artificial Sequence
  Synthetic oligonucleotide
tacctcacctgcttctagcaacaatctcgctgtgc

SEQ ID NO: 45576 - DNA, 35 bp, Artificial Sequence
  Synthetic oligonucleotide
gaagccataacgtagctgtgtcgaacttccacctc

SEQ ID NO: 45577 - DNA, 35 bp, Artificial Sequence
  Synthetic oligonucleotide
gcgtgtcccccgacgtgttccaacattttctctcg

SEQ ID NO: 45578 - DNA, 35 bp, Artificial Sequence
  Synthetic oligonucleotide
atccttcagtgccagcccccctctcagcaccgtcg

SEQ ID NO: 45579 - DNA, 35 bp, Artificial Sequence
  Synthetic oligonucleotide
gctaccactgggttcacgctcctttctagatttcg

SEQ ID NO: 45580 - DNA, 35 bp, Artificial Sequence
  Synthetic oligonucleotide
ggggctcgggggggataggaaaatatggtggcagg

SEQ ID NO: 45581 - DNA, 35 bp, Artificial Sequence
  Synthetic oligonucleotide
gttgcgctgctttggttcctcgtatttcgcatctg

SEQ ID NO: 45582 - DNA, 35 bp, Artificial Sequence
  Synthetic oligonucleotide
gccgatgtcttgtcgaacgcccacttccaccacct

SEQ ID NO: 45583 - DNA, 35 bp, Artificial Sequence
  Synthetic oligonucleotide
agtgcataccgcgcctctgcctattaattctctgt

SEQ ID NO: 45584 - DNA, 35 bp, Artificial Sequence
  Synthetic oligonucleotide
atgcacccggaccgaacctgggcgggacgtaactt

SEQ ID NO: 45585 - DNA, 36 bp, Artificial Sequence
  Synthetic oligonucleotide
gaccaaccctccccagaggtaaaaccgtattgccaa

SEQ ID NO: 45586 - DNA, 35 bp, Artificial Sequence
  Synthetic oligonucleotide
atggtggtgtatgggtggggtaaggtgctggagaa

SEQ ID NO: 45587 - DNA, 36 bp, Artificial Sequence
  Synthetic oligonucleotide
gatcaaccgccgcccggactgtgcgtacatcttaca

SEQ ID NO: 45588 - DNA, 36 bp, Artificial Sequence
  Synthetic oligonucleotide
attgacgcaacgcgggttgcatattgccttacacca

SEQ ID NO: 45589 - DNA, 36 bp, Artificial Sequence
  Synthetic oligonucleotide
aacgacggacgtgctattgtaggaggggagggcaga

SEQ ID NO: 45590 - DNA, 37 bp, Artificial Sequence
  Synthetic oligonucleotide
gccccatcccacacttgtacctaggaggctgctccga

SEQ ID NO: 45591 - DNA, 37 bp, Artificial Sequence
  Synthetic oligonucleotide
tactagcctcccatcggcaaaaccagtccttctgcga

SEQ ID NO: 45592 - DNA, 37 bp, Artificial Sequence
  Synthetic oligonucleotide
tgatcaccacactcggtgcgcccctttgctcattcga

SEQ ID NO: 45593 - DNA, 37 bp, Artificial Sequence
  Synthetic oligonucleotide
tgcggtgaagacgcagcgtagtgggcggaggggagga

SEQ ID NO: 45594 - DNA, 37 bp, Artificial Sequence
  Synthetic oligonucleotide
tcgacgtgcatgaaccctgcctccacaaacacacgga

SEQ ID NO: 45595 - DNA, 37 bp, Artificial Sequence
  Synthetic oligonucleotide
gaaggaggggcctgtaggcaactaagcaaagaaggga

SEQ ID NO: 45596 - DNA, 37 bp, Artificial Sequence
  Synthetic oligonucleotide
atgtcaacccagccacggtaaccaagcactaaatgga

SEQ ID NO: 45597 - DNA, 37 bp, Artificial Sequence
  Synthetic oligonucleotide
tcaccatccacgtcatcttgagtcaagtgtacatgga

SEQ ID NO: 45598 - DNA, 37 bp, Artificial Sequence
  Synthetic oligonucleotide
atgccggggggggtaagggtatgtaatatgtgatgga

SEQ ID NO: 45599 - DNA, 37 bp, Artificial Sequence
  Synthetic oligonucleotide
acctcagacatcgccgttgcgccacccaccccctgga

SEQ ID NO: 45600 - DNA, 37 bp, Artificial Sequence
  Synthetic oligonucleotide
gtggtgagctgaggggggaagggttatgcaatctgga

SEQ ID NO: 45601 - DNA, 36 bp, Artificial Sequence
  Synthetic oligonucleotide
gtggagaggggttcgctgcggggggcatactgtgga

SEQ ID NO: 45602 - DNA, 36 bp, Artificial Sequence
  Synthetic oligonucleotide
tcacgcgcttacgtcttctagcgcccactgatatga

SEQ ID NO: 45603 - DNA, 37 bp, Artificial Sequence
  Synthetic oligonucleotide
tccccccacacctcgagcttggaacatcgggaactga

SEQ ID NO: 45604 - DNA, 38 bp, Artificial Sequence
  Synthetic oligonucleotide
accttgtccgcagcagctctgcctaacgatatgcctga

SEQ ID NO: 45605 - DNA, 38 bp, Artificial Sequence
  Synthetic oligonucleotide
actacatcccatgggacctgccttctccaccaaggtga

SEQ ID NO: 45606 - DNA, 38 bp, Artificial Sequence
  Synthetic oligonucleotide
tgccagagccatggagtgggtgatgaattggtgggtga

SEQ ID NO: 45607 - DNA, 37 bp, Artificial Sequence
  Synthetic oligonucleotide
acaaccccgactctgaacagcaacaacgccctcttga

SEQ ID NO: 45608 - DNA, 38 bp, Artificial Sequence
  Synthetic oligonucleotide
tccagactcacaatcagtacatatcccccacacgttga

SEQ ID NO: 45609 - DNA, 36 bp, Artificial Sequence
  Synthetic oligonucleotide
acccagaccactgttgtcgtcgcgggtctccatcta

SEQ ID NO: 45610 - DNA, 35 bp, Artificial Sequence
  Synthetic oligonucleotide
ggagagcattgcaattaccgacccttccccactta

SEQ ID NO: 45611 - DNA, 36 bp, Artificial Sequence
  Synthetic oligonucleotide
tgtgtaccacctctgcccgacttttcggtgatttta

SEQ ID NO: 45612 - DNA, 36 bp, Artificial Sequence
  Synthetic oligonucleotide
ggtgtaccgtgggccacatgcctgaacttcgtttta

SEQ ID NO: 45613 - DNA, 35 bp, Artificial Sequence
  Synthetic oligonucleotide
ttgtaccacctaccaccgcgctcgcgtgagcccac

SEQ ID NO: 45614 - DNA, 35 bp, Artificial Sequence
  Synthetic oligonucleotide
acgagaatcgatccggtctgttttttaccgttcac

SEQ ID NO: 45615 - DNA, 35 bp, Artificial Sequence
  Synthetic oligonucleotide
acgcgaggacctcccccgctgatgaacccacagac

SEQ ID NO: 45616 - DNA, 35 bp, Artificial Sequence
  Synthetic oligonucleotide
atacgtcttgccactggcccttccccggtttcacc

SEQ ID NO: 45617 - DNA, 35 bp, Artificial Sequence
  Synthetic oligonucleotide
gacctaactactgccctatacattcgcctaagacc

SEQ ID NO: 45618 - DNA, 35 bp, Artificial Sequence
  Synthetic oligonucleotide
acacgtcacaaggcacttcaaaagcagccaccgcc

SEQ ID NO: 45619 - DNA, 35 bp, Artificial Sequence
  Synthetic oligonucleotide
atacatccgctatgggtccccaatattctacacgc

SEQ ID NO: 45620 - DNA, 35 bp, Artificial Sequence
  Synthetic oligonucleotide
tcactacaccgcattattctgcctgcctgtcctcg

SEQ ID NO: 45621 - DNA, 35 bp, Artificial Sequence
  Synthetic oligonucleotide
tcctgaccgccacatgttgctttgcgaagctctat

SEQ ID NO: 45622 - DNA, 35 bp, Artificial Sequence
  Synthetic oligonucleotide
aaatccgagggccgcccacttttagccctgttact

SEQ ID NO: 45623 - DNA, 35 bp, Artificial Sequence
  Synthetic oligonucleotide
gaccggatcacggtctggaatactacctggccctt

SEQ ID NO: 45624 - DNA, 35 bp, Artificial Sequence
  Synthetic oligonucleotide
attgccatggcttacgtaatgtctcccccgtcctt

SEQ ID NO: 45625 - DNA, 35 bp, Artificial Sequence
  Synthetic oligonucleotide
tatgcgtggggagttcattctgtgccattcgcttt

SEQ ID NO: 45626 - DNA, 35 bp, Artificial Sequence
  Synthetic oligonucleotide
gccacttaccgcctcttttatgcagggccccacaa

SEQ ID NO: 45627 - DNA, 35 bp, Artificial Sequence
  Synthetic oligonucleotide
ttacgccccccccacggacgccatggagatattaa

SEQ ID NO: 45628 - DNA, 36 bp, Artificial Sequence
  Synthetic oligonucleotide
atcccgccacttgtatgcctgcctccggactggaca

SEQ ID NO: 45629 - DNA, 35 bp, Artificial Sequence
  Synthetic oligonucleotide
tgctagtccctagatcggccctaatccccatgcca

SEQ ID NO: 45630 - DNA, 36 bp, Artificial Sequence
  Synthetic oligonucleotide
agacgacgtacaaccataccccgggaccccgccgca

SEQ ID NO: 45631 - DNA, 38 bp, Artificial Sequence
  Synthetic oligonucleotide
ttggtggaggggtacaaacgggcacggggaaagcaaga

SEQ ID NO: 45632 - DNA, 37 bp, Artificial Sequence
  Synthetic oligonucleotide
gccgggagggaagggtaagatgggactgccggataga

SEQ ID NO: 45633 - DNA, 37 bp, Artificial Sequence
  Synthetic oligonucleotide
accttcccacgtacattaattgctcgcaatccaccga

SEQ ID NO: 45634 - DNA, 37 bp, Artificial Sequence
  Synthetic oligonucleotide
tcactgacacactcgtttggcgatttcgctctcgcga

SEQ ID NO: 45635 - DNA, 37 bp, Artificial Sequence
  Synthetic oligonucleotide
gacccaccctgaatacggtccatctatcctagttcga

SEQ ID NO: 45636 - DNA, 36 bp, Artificial Sequence
  Synthetic oligonucleotide
gttgccggggtgaagaaggatagaaggggggaggga

SEQ ID NO: 45637 - DNA, 36 bp, Artificial Sequence
  Synthetic oligonucleotide
ggggcggggattggggctctggcatggagtggggga

SEQ ID NO: 45638 - DNA, 38 bp, Artificial Sequence
  Synthetic oligonucleotide
tctcccaccgaccttctcgctccgccgttttgcaatga

SEQ ID NO: 45639 - DNA, 36 bp, Artificial Sequence
  Synthetic oligonucleotide
ttagtcgcgagggggtgggacggagttgtaggatga

SEQ ID NO: 45640 - DNA, 38 bp, Artificial Sequence
  Synthetic oligonucleotide
tcaccacccaaccttgtcgctccgcatagctaccctga

SEQ ID NO: 45641 - DNA, 38 bp, Artificial Sequence
  Synthetic oligonucleotide
acagccaccgaccccgactatgtttaacctggcgctga

SEQ ID NO: 45642 - DNA, 38 bp, Artificial Sequence
  Synthetic oligonucleotide
gctgagcaggagggaagaaagatagggggccaggctga

SEQ ID NO: 45643 - DNA, 38 bp, Artificial Sequence
  Synthetic oligonucleotide
accatccgccgacagttatttgacacgcctccgtctga

SEQ ID NO: 45644 - DNA, 38 bp, Artificial Sequence
  Synthetic oligonucleotide
agcgacccgcccctccatgctagagcgctcactgttga

SEQ ID NO: 45645 - DNA, 38 bp, Artificial Sequence
  Synthetic oligonucleotide
aacagggaagccggatgggcgcgggaaggggaatttga

SEQ ID NO: 45646 - DNA, 38 bp, Artificial Sequence
  Synthetic oligonucleotide
gttgcatctatgacgctgtttgcgtgccccctttttga

SEQ ID NO: 45647 - DNA, 36 bp, Artificial Sequence
  Synthetic oligonucleotide
aaccagcccaggactcccgtcaatcccgcggtacta

SEQ ID NO: 45648 - DNA, 36 bp, Artificial Sequence
  Synthetic oligonucleotide
gtgggccatcgcgatggcaccttgcctagacctcta

SEQ ID NO: 45649 - DNA, 36 bp, Artificial Sequence
  Synthetic oligonucleotide
gtgctagtagcagtcccatttcggtgttaaccagta

SEQ ID NO: 45650 - DNA, 36 bp, Artificial Sequence
  Synthetic oligonucleotide
ggcacctccacctgtctttctgtcccatggcccgta

SEQ ID NO: 45651 - DNA, 36 bp, Artificial Sequence
  Synthetic oligonucleotide
gtaccagccattagtgtctcccttgcactgccatta

SEQ ID NO: 45652 - DNA, 36 bp, Artificial Sequence
  Synthetic oligonucleotide
gcaatgctcggcttgccgttatgcacttacgcctta

SEQ ID NO: 45653 - DNA, 35 bp, Artificial Sequence
  Synthetic oligonucleotide
gattgtcccccgtccatcaccccaattccactgac

SEQ ID NO: 45654 - DNA, 35 bp, Artificial Sequence
  Synthetic oligonucleotide
gacccccacgagtacgaagtttcgataaatttacc

SEQ ID NO: 45655 - DNA, 35 bp, Artificial Sequence
  Synthetic oligonucleotide
tgtagcctccccgaaccggtcactacggaacgccc

SEQ ID NO: 45656 - DNA, 35 bp, Artificial Sequence
  Synthetic oligonucleotide
agcgatacatccctatggctggctggtacattccc

SEQ ID NO: 45657 - DNA, 35 bp, Artificial Sequence
  Synthetic oligonucleotide
tcccatcagtccttggggttgggttccttatttcc

SEQ ID NO: 45658 - DNA, 35 bp, Artificial Sequence
  Synthetic oligonucleotide
gtccccagcccccgatggtttctctgttgcccgtc

SEQ ID NO: 45659 - DNA, 35 bp, Artificial Sequence
  Synthetic oligonucleotide
tttgcccggatcgacccgtctaccgttatcccccg

SEQ ID NO: 45660 - DNA, 35 bp, Artificial Sequence
  Synthetic oligonucleotide
actcacgggatccaggttctctaactcgcactccg

SEQ ID NO: 45661 - DNA, 35 bp, Artificial Sequence
  Synthetic oligonucleotide
tgccgaggggaggtggggaaggaaattatgacgtg

SEQ ID NO: 45662 - DNA, 35 bp, Artificial Sequence
  Synthetic oligonucleotide
agctctgtccaccttctacttatgtaccactgttg

SEQ ID NO: 45663 - DNA, 35 bp, Artificial Sequence
  Synthetic oligonucleotide
aaacggtgcctcttgacttgcaatctcactcgtct

SEQ ID NO: 45664 - DNA, 35 bp, Artificial Sequence
  Synthetic oligonucleotide
tgtccttacccccatacgagtgcgactgtcccctt

SEQ ID NO: 45665 - DNA, 35 bp, Artificial Sequence
  Synthetic oligonucleotide
aatcccaagtaacagccgcacgtccttcccccgtt

SEQ ID NO: 45666 - DNA, 35 bp, Artificial Sequence
  Synthetic oligonucleotide
tcaccctggtttgtgtgaccgtgctatttcgcttt

SEQ ID NO: 45667 - DNA, 35 bp, Artificial Sequence
  Synthetic oligonucleotide
gtctcctcgctcaccaggtggtcgtagttcttttt

SEQ ID NO: 45668 - DNA, 36 bp, Artificial Sequence
  Synthetic oligonucleotide
tcagccggtcactttatgccccgtttttttgctaaa

SEQ ID NO: 45669 - DNA, 36 bp, Artificial Sequence
  Synthetic oligonucleotide
agcctgacaagacagtgggttggaggcgggaagtaa

SEQ ID NO: 45670 - DNA, 36 bp, Artificial Sequence
  Synthetic oligonucleotide
acaccttcctagctggaagtccgcacccattccaca

SEQ ID NO: 45671 - DNA, 36 bp, Artificial Sequence
  Synthetic oligonucleotide
tagtactccgcacatatccataacctccgagaacca

SEQ ID NO: 45672 - DNA, 36 bp, Artificial Sequence
  Synthetic oligonucleotide
ttggagcctatctcgttcatcctgggcggcaaccca

SEQ ID NO: 45673 - DNA, 36 bp, Artificial Sequence
  Synthetic oligonucleotide
tgtacctgtcccgctggactcgccgatcatactcca

SEQ ID NO: 45674 - DNA, 36 bp, Artificial Sequence
  Synthetic oligonucleotide
atcacatcgtaacaccccgccacgtctgacactgca

SEQ ID NO: 45675 - DNA, 35 bp, Artificial Sequence
  Synthetic oligonucleotide
ggaggggaagagggaagaactacgtggataataga

SEQ ID NO: 45676 - DNA, 37 bp, Artificial Sequence
  Synthetic oligonucleotide
tgtgtgtgccgcaacacctagctctatccgccctaga

SEQ ID NO: 45677 - DNA, 37 bp, Artificial Sequence
  Synthetic oligonucleotide
accatgccggtggaggctatcagcattctttttacga

SEQ ID NO: 45678 - DNA, 37 bp, Artificial Sequence
  Synthetic oligonucleotide
acgacgatgtcccgccccagctctaccttctgcagga

SEQ ID NO: 45679 - DNA, 37 bp, Artificial Sequence
  Synthetic oligonucleotide
gttgttccccacatcccatacagtgcttgtgcacgga

SEQ ID NO: 45680 - DNA, 37 bp, Artificial Sequence
  Synthetic oligonucleotide
aactaccggggggaggagtagggagtctgtgggcgga

SEQ ID NO: 45681 - DNA, 37 bp, Artificial Sequence
  Synthetic oligonucleotide
gtacgggtgggagagtatacgcggggtaatgggggga

SEQ ID NO: 45682 - DNA, 37 bp, Artificial Sequence
  Synthetic oligonucleotide
tccccaccccatactctttaagctcctgacagttgga

SEQ ID NO: 45683 - DNA, 35 bp, Artificial Sequence
  Synthetic oligonucleotide
atgtcacattcgccaccccaaaactgaccgtatga

SEQ ID NO: 45684 - DNA, 38 bp, Artificial Sequence
  Synthetic oligonucleotide
atggtgtcggccttcgtgacttgcttctgcgcccctga

SEQ ID NO: 45685 - DNA, 37 bp, Artificial Sequence
  Synthetic oligonucleotide
tcgtacaccacagtttaatgccaccgctccacgctga

SEQ ID NO: 45686 - DNA, 35 bp, Artificial Sequence
  Synthetic oligonucleotide
acatgttaccgcggtctttccaccacacgtgctga

SEQ ID NO: 45687 - DNA, 36 bp, Artificial Sequence
  Synthetic oligonucleotide
aatcatcagacccccctgcgcataatacatccgtga

SEQ ID NO: 45688 - DNA, 38 bp, Artificial Sequence
  Synthetic oligonucleotide
atgcccccgcaggatcctggctttggtttgttacttga

SEQ ID NO: 45689 - DNA, 38 bp, Artificial Sequence
  Synthetic oligonucleotide
aacacatccggcgctggagccgacggttcctactttga

SEQ ID NO: 45690 - DNA, 36 bp, Artificial Sequence
  Synthetic oligonucleotide
atccacacatggcgatccaccacggcttgacctcta

SEQ ID NO: 45691 - DNA, 36 bp, Artificial Sequence
  Synthetic oligonucleotide
agaccagtcgcgctatcttaccggccacctttcgta

SEQ ID NO: 45692 - DNA, 36 bp, Artificial Sequence
  Synthetic oligonucleotide
atgacgcgaacttaagtttaggtggccccttttgta

SEQ ID NO: 45693 - DNA, 36 bp, Artificial Sequence
  Synthetic oligonucleotide
gcccacggaaattgttccgctaacatcacacactta

SEQ ID NO: 45694 - DNA, 35 bp, Artificial Sequence
  Synthetic oligonucleotide
tgaaccttggtcacccaatcgttatgtacctccac

SEQ ID NO: 45695 - DNA, 35 bp, Artificial Sequence
  Synthetic oligonucleotide
gacgtgtacctgaggtcttacaccctgacgttgcc

SEQ ID NO: 45696 - DNA, 35 bp, Artificial Sequence
  Synthetic oligonucleotide
tccaaatatgccccccggttgggtaagcaaccagc

SEQ ID NO: 45697 - DNA, 35 bp, Artificial Sequence
  Synthetic oligonucleotide
cactccgccccatctgtactctacactgaaaggtc

SEQ ID NO: 45698 - DNA, 35 bp, Artificial Sequence
  Synthetic oligonucleotide
gccctcgccctttttacgccgcaccacacaacacg

SEQ ID NO: 45699 - DNA, 35 bp, Artificial Sequence
  Synthetic oligonucleotide
gacgcgaccagtctccacacagttctaacctaccg

SEQ ID NO: 45700 - DNA, 35 bp, Artificial Sequence
  Synthetic oligonucleotide
ttcacacacagactagaattggccatgctactccg

SEQ ID NO: 45701 - DNA, 35 bp, Artificial Sequence
  Synthetic oligonucleotide
tgccaactcacgtgcactccctgccaatccggcgg

SEQ ID NO: 45702 - DNA, 34 bp, Artificial Sequence
  Synthetic oligonucleotide
aaacagtgcggttagtcactaagtctcattcttg

SEQ ID NO: 45703 - DNA, 35 bp, Artificial Sequence
  Synthetic oligonucleotide
ggaggagggaggtccgcacgggagtacggggtgat

SEQ ID NO: 45704 - DNA, 35 bp, Artificial Sequence
  Synthetic oligonucleotide
gaccatctagggggccattagcaccagcatttcct

SEQ ID NO: 45705 - DNA, 35 bp, Artificial Sequence
  Synthetic oligonucleotide
gtcattcccggcgccccctcactgccacttgatct

SEQ ID NO: 45706 - DNA, 35 bp, Artificial Sequence
  Synthetic oligonucleotide
gaaccgtccgctcctatcactgctattctccttgt

SEQ ID NO: 45707 - DNA, 35 bp, Artificial Sequence
  Synthetic oligonucleotide
gctgggcaccgccggaccgcctttctgcactgctt

SEQ ID NO: 45708 - DNA, 36 bp, Artificial Sequence
  Synthetic oligonucleotide
ttcagtcaacacccgcctgcctggcccgccgttcaa

SEQ ID NO: 45709 - DNA, 36 bp, Artificial Sequence
  Synthetic oligonucleotide
aagcatttgcatgacctcacacctgcgcactcacca

SEQ ID NO: 45710 - DNA, 36 bp, Artificial Sequence
  Synthetic oligonucleotide
acacccatgtcgcgttacaactctatctcggtacca

SEQ ID NO: 45711 - DNA, 36 bp, Artificial Sequence
  Synthetic oligonucleotide
gggtgccacccaccatcgttcaagaagcccgtgcca

SEQ ID NO: 45712 - DNA, 36 bp, Artificial Sequence
  Synthetic oligonucleotide
ttctgcgcaccctttccagtgtatttttcctccgca

SEQ ID NO: 45713 - DNA, 35 bp, Artificial Sequence
  Synthetic oligonucleotide
attgttacgcagaattaggctccttccatccctca

SEQ ID NO: 45714 - DNA, 36 bp, Artificial Sequence
  Synthetic oligonucleotide
gttaactgatccgtatcctgtcttctgggcctttca

SEQ ID NO: 45715 - DNA, 36 bp, Artificial Sequence
  Synthetic oligonucleotide
tgcgacatcccggcttcataccccacattctgcaga

SEQ ID NO: 45716 - DNA, 37 bp, Artificial Sequence
  Synthetic oligonucleotide
agtgtgagcaacggcgggactacgggcatagggggga

SEQ ID NO: 45717 - DNA, 38 bp, Artificial Sequence
  Synthetic oligonucleotide
acagggcgggttgggctaagcagggagagtcggaatga

SEQ ID NO: 45718 - DNA, 37 bp, Artificial Sequence
  Synthetic oligonucleotide
tctgatgtcgccgctcccgagtccgttttcattatga

SEQ ID NO: 45719 - DNA, 38 bp, Artificial Sequence
  Synthetic oligonucleotide
gaagagcaggacagacgggggagtgggagggtgtctga

SEQ ID NO: 45720 - DNA, 36 bp, Artificial Sequence
  Synthetic oligonucleotide
acgcgagcaaagggagggggcgggcacgtgaagtga

SEQ ID NO: 45721 - DNA, 38 bp, Artificial Sequence
  Synthetic oligonucleotide
gaccccacatatcagtattcttgtatcacgcccattga

SEQ ID NO: 45722 - DNA, 37 bp, Artificial Sequence
  Synthetic oligonucleotide
tacacgcacatgatgtatctttgtgtccaccgcttga

SEQ ID NO: 45723 - DNA, 38 bp, Artificial Sequence
  Synthetic oligonucleotide
accccgcctctgctattctcgtctcttgatcagtttga

SEQ ID NO: 45724 - DNA, 36 bp, Artificial Sequence
  Synthetic oligonucleotide
ggtggtaggaaggggatggtcgataggtagggacta

SEQ ID NO: 45725 - DNA, 35 bp, Artificial Sequence
  Synthetic oligonucleotide
acgaggccctgcagcgatttactgactcctatgac

SEQ ID NO: 45726 - DNA, 34 bp, Artificial Sequence
  Synthetic oligonucleotide
gccaaacccctattccgtatcgctatccggaccc

SEQ ID NO: 45727 - DNA, 35 bp, Artificial Sequence
  Synthetic oligonucleotide
tatgccacggactcatcgcttgcctgggcgtcccc

SEQ ID NO: 45728 - DNA, 35 bp, Artificial Sequence
  Synthetic oligonucleotide
attcatgcggaaccgttgctcacaccattactgcc

SEQ ID NO: 45729 - DNA, 35 bp, Artificial Sequence
  Synthetic oligonucleotide
gtgccctgcaagcatgccgtagacccgttcccatc

SEQ ID NO: 45730 - DNA, 35 bp, Artificial Sequence
  Synthetic oligonucleotide
atcacccggtagcaagggataggggtttggtgttc

SEQ ID NO: 45731 - DNA, 35 bp, Artificial Sequence
  Synthetic oligonucleotide
tcacatccatagtggttcctttagccctcttcacg

SEQ ID NO: 45732 - DNA, 35 bp, Artificial Sequence
  Synthetic oligonucleotide
ttacccctcagactcccgggcacaccatctcattg

SEQ ID NO: 45733 - DNA, 35 bp, Artificial Sequence
  Synthetic oligonucleotide
acctagtccgctagcctttactcgttatcttcgat

SEQ ID NO: 45734 - DNA, 35 bp, Artificial Sequence
  Synthetic oligonucleotide
gttagaggcgggagtgcaatgggcgggggtttgat

SEQ ID NO: 45735 - DNA, 35 bp, Artificial Sequence
  Synthetic oligonucleotide
ggacggttcacacacttactacgagctcgcgccct

SEQ ID NO: 45736 - DNA, 35 bp, Artificial Sequence
  Synthetic oligonucleotide
aactcaacttcaggactgaatcacgtctgctccct

SEQ ID NO: 45737 - DNA, 35 bp, Artificial Sequence
  Synthetic oligonucleotide
accgactagcacctttgctcttttctttccagagt

SEQ ID NO: 45738 - DNA, 35 bp, Artificial Sequence
  Synthetic oligonucleotide
gagcccgccagcgaatagctctccgttactctcgt

SEQ ID NO: 45739 - DNA, 35 bp, Artificial Sequence
  Synthetic oligonucleotide
acgaccatccccccgcagtctccatggcctgtttt

SEQ ID NO: 45740 - DNA, 36 bp, Artificial Sequence
  Synthetic oligonucleotide
tcattacccccattgactaactaaacacagttaaaa

SEQ ID NO: 45741 - DNA, 35 bp, Artificial Sequence
  Synthetic oligonucleotide
agtctaaggcggaagaggaagggaaaaaaggtcaa

SEQ ID NO: 45742 - DNA, 34 bp, Artificial Sequence
  Synthetic oligonucleotide
agcactcccatacttccccgacctacatgctgaa

SEQ ID NO: 45743 - DNA, 36 bp, Artificial Sequence
  Synthetic oligonucleotide
tatgccccacttgttcacgccgatccacttagagca

SEQ ID NO: 45744 - DNA, 35 bp, Artificial Sequence
  Synthetic oligonucleotide
tacgaccccccgtacgactaacacgccggtattca

SEQ ID NO: 45745 - DNA, 37 bp, Artificial Sequence
  Synthetic oligonucleotide
ggtgccgcatacatcttattgcactcactttcctcga

SEQ ID NO: 45746 - DNA, 37 bp, Artificial Sequence
  Synthetic oligonucleotide
acccgtcgcccctcggggtttatgcccgatccttcga

SEQ ID NO: 45747 - DNA, 37 bp, Artificial Sequence
  Synthetic oligonucleotide
aggtgactggaggggaatgggggctgacatacatgga

SEQ ID NO: 45748 - DNA, 37 bp, Artificial Sequence
  Synthetic oligonucleotide
acaccagcatttggtttcgcctctcgtacgccgtgga

SEQ ID NO: 45749 - DNA, 35 bp, Artificial Sequence
  Synthetic oligonucleotide
acccacgtgagtaccttcccacctgtccagtatga

SEQ ID NO: 45750 - DNA, 37 bp, Artificial Sequence
  Synthetic oligonucleotide
gacatcgtacgggcacattccctcccacccggtatga

SEQ ID NO: 45751 - DNA, 38 bp, Artificial Sequence
  Synthetic oligonucleotide
acgccatacctccgagcctcgtgctctgtccattatga

SEQ ID NO: 45752 - DNA, 37 bp, Artificial Sequence
  Synthetic oligonucleotide
gatcccacgccttgacttaaccgtcgttcataactga

SEQ ID NO: 45753 - DNA, 37 bp, Artificial Sequence
  Synthetic oligonucleotide
aacggaacccatttgcccttttcatctgccaccctga

SEQ ID NO: 45754 - DNA, 38 bp, Artificial Sequence
  Synthetic oligonucleotide
tcgaggacgaaggaaatagggcaggagcaattaggtga

SEQ ID NO: 45755 - DNA, 35 bp, Artificial Sequence
  Synthetic oligonucleotide
gccctcccctgactgccccgagtgacaagtgttga

SEQ ID NO: 45756 - DNA, 37 bp, Artificial Sequence
  Synthetic oligonucleotide
accttgcatacggcgcgtctttcgccaccccctttga

SEQ ID NO: 45757 - DNA, 36 bp, Artificial Sequence
  Synthetic oligonucleotide
acatccctcagaatcatcacgggcacattcgtaata

SEQ ID NO: 45758 - DNA, 35 bp, Artificial Sequence
  Synthetic oligonucleotide
atccctcagaccgccgacccactcagcacaaggta

SEQ ID NO: 45759 - DNA, 36 bp, Artificial Sequence
  Synthetic oligonucleotide
gtgcaccaccacctgtaatttctgtacgatcaggta

SEQ ID NO: 45760 - DNA, 36 bp, Artificial Sequence
  Synthetic oligonucleotide
tgcattcccctatcttccctgtgctgttgtagctta

SEQ ID NO: 45761 - DNA, 36 bp, Artificial Sequence
  Synthetic oligonucleotide
gcaagacccgaaataggccaccccgcggagcgttta

SEQ ID NO: 45762 - DNA, 35 bp, Artificial Sequence
  Synthetic oligonucleotide
atcgcatcaacccggccctggcccaagtaccgcac

SEQ ID NO: 45763 - DNA, 35 bp, Artificial Sequence
  Synthetic oligonucleotide
tccccatgccctcttctattccgtaaggcacttac

SEQ ID NO: 45764 - DNA, 35 bp, Artificial Sequence
  Synthetic oligonucleotide
attcgtccacgcagtcgcaaccagcctccggggcc

SEQ ID NO: 45765 - DNA, 35 bp, Artificial Sequence
  Synthetic oligonucleotide
atggtgcctgtcgttatttttattgtccggcctcc

SEQ ID NO: 45766 - DNA, 35 bp, Artificial Sequence
  Synthetic oligonucleotide
gaaacccacatggatcttgtcgaaatgcctccctc

SEQ ID NO: 45767 - DNA, 35 bp, Artificial Sequence
  Synthetic oligonucleotide
gagatcacgggggcaggggtagtagctctgggtgg

SEQ ID NO: 45768 - DNA, 35 bp, Artificial Sequence
  Synthetic oligonucleotide
ttgtcaacaatcgctcaccggagcccagcctcctg

SEQ ID NO: 45769 - DNA, 35 bp, Artificial Sequence
  Synthetic oligonucleotide
acacactgtgctgccaaaactgtcaagttttaact

SEQ ID NO: 45770 - DNA, 35 bp, Artificial Sequence
  Synthetic oligonucleotide
aacccacctcgtgggaaactatcttagggcttact

SEQ ID NO: 45771 - DNA, 35 bp, Artificial Sequence
  Synthetic oligonucleotide
ttacggtctctccgcaccacctctgcgttcctcct

SEQ ID NO: 45772 - DNA, 34 bp, Artificial Sequence
  Synthetic oligonucleotide
acccacgaacgggatctccattacaggattaggt

SEQ ID NO: 45773 - DNA, 35 bp, Artificial Sequence
  Synthetic oligonucleotide
ttcccgtcgcccaaacgagttactggaccatcctt

SEQ ID NO: 45774 - DNA, 35 bp, Artificial Sequence
  Synthetic oligonucleotide
gctgaacggacagttctccgctccacccattcgtt

SEQ ID NO: 45775 - DNA, 35 bp, Artificial Sequence
  Synthetic oligonucleotide
gcacgacggggattacaggcttgggaggactaaaa

SEQ ID NO: 45776 - DNA, 35 bp, Artificial Sequence
  Synthetic oligonucleotide
ccccacctcttggtctctgttttgcggatgcgaaa

SEQ ID NO: 45777 - DNA, 36 bp, Artificial Sequence
  Synthetic oligonucleotide
ttgttcccccatccgctatcatcagttgcgggacaa

SEQ ID NO: 45778 - DNA, 36 bp, Artificial Sequence
  Synthetic oligonucleotide
gccactagggcactccccggcaaaccctgacccgaa

SEQ ID NO: 45779 - DNA, 35 bp, Artificial Sequence
  Synthetic oligonucleotide
tccaccgcctttaacactttccgcaggattgggaa

SEQ ID NO: 45780 - DNA, 36 bp, Artificial Sequence
  Synthetic oligonucleotide
acaccgctagcacacaaacaaaggcccggctgttca

SEQ ID NO: 45781 - DNA, 37 bp, Artificial Sequence
  Synthetic oligonucleotide
aaggatcagaaggacagaggtacggacggtggagaga

SEQ ID NO: 45782 - DNA, 37 bp, Artificial Sequence
  Synthetic oligonucleotide
ggccctgcccccaccccgtgaccaagtacccaataga

SEQ ID NO: 45783 - DNA, 37 bp, Artificial Sequence
  Synthetic oligonucleotide
gcacgcctgtgattttttatcgctacttcctgctaga

SEQ ID NO: 45784 - DNA, 37 bp, Artificial Sequence
  Synthetic oligonucleotide
taccgacatgccgtacatcgctgccatcacaccccga

SEQ ID NO: 45785 - DNA, 36 bp, Artificial Sequence
  Synthetic oligonucleotide
ggataacccaactttgcctcccagctgtaccttcga

SEQ ID NO: 45786 - DNA, 37 bp, Artificial Sequence
  Synthetic oligonucleotide
aaagtgagggtggtgtgacgaaggacctgagggagga

SEQ ID NO: 45787 - DNA, 37 bp, Artificial Sequence
  Synthetic oligonucleotide
atgtagcgacccatcatcttcccagcaactcctcgga

SEQ ID NO: 45788 - DNA, 37 bp, Artificial Sequence
  Synthetic oligonucleotide
caatcggggagggaggggaacaatacaaataggggga

SEQ ID NO: 45789 - DNA, 37 bp, Artificial Sequence
  Synthetic oligonucleotide
atgcctgacgggttgggaggagcgggggagtcttgga

SEQ ID NO: 45790 - DNA, 37 bp, Artificial Sequence
  Synthetic oligonucleotide
tccatccttccatatgtactgtagcctcactacatga

SEQ ID NO: 45791 - DNA, 35 bp, Artificial Sequence
  Synthetic oligonucleotide
tctcgcccacctccggccggttattccgattatga

SEQ ID NO: 45792 - DNA, 37 bp, Artificial Sequence
  Synthetic oligonucleotide
tatgcccatcccctacattgcaagcgacgtctattga

SEQ ID NO: 45793 - DNA, 38 bp, Artificial Sequence
  Synthetic oligonucleotide
accagctgctccgatcgttcctttcgcttgacctttga

SEQ ID NO: 45794 - DNA, 35 bp, Artificial Sequence
  Synthetic oligonucleotide
gtactcccgccctcgcttcaaattgcctcgctata

SEQ ID NO: 45795 - DNA, 36 bp, Artificial Sequence
  Synthetic oligonucleotide
gaaccacagacttaatttgcctacatgaaacacgta

SEQ ID NO: 45796 - DNA, 35 bp, Artificial Sequence
  Synthetic oligonucleotide
gtgcttcccggttcgctcgttgcacattactctta

SEQ ID NO: 45797 - DNA, 35 bp, Artificial Sequence
  Synthetic oligonucleotide
gatcatgcattgccgaattatccactgtcttctta

SEQ ID NO: 45798 - DNA, 35 bp, Artificial Sequence
  Synthetic oligonucleotide
ggaacaggcacaccaccctactcgccttaaaatac

SEQ ID NO: 45799 - DNA, 35 bp, Artificial Sequence
  Synthetic oligonucleotide
tgtgttgtaacacctccttgcctgattataccacc

SEQ ID NO: 45800 - DNA, 35 bp, Artificial Sequence
  Synthetic oligonucleotide
acgcccttcgagcatgaccagttacaattcgcgcc

SEQ ID NO: 45801 - DNA, 35 bp, Artificial Sequence
  Synthetic oligonucleotide
tactcgggcaaaaaggccctctgtactatccgtcc

SEQ ID NO: 45802 - DNA, 35 bp, Artificial Sequence
  Synthetic oligonucleotide
tcgcacactcatacctgatcttgcactcgtatacg

SEQ ID NO: 45803 - DNA, 35 bp, Artificial Sequence
  Synthetic oligonucleotide
aacaccaaccgactgcctgcggcggctagaccccg

SEQ ID NO: 45804 - DNA, 35 bp, Artificial Sequence
  Synthetic oligonucleotide
gaccgcaccccacgactctgtgtgaatgccctctg

SEQ ID NO: 45805 - DNA, 35 bp, Artificial Sequence
  Synthetic oligonucleotide
gccggaaaccttcggtcaccatgccattacgccct

SEQ ID NO: 45806 - DNA, 35 bp, Artificial Sequence
  Synthetic oligonucleotide
gcaccgaaactgtgtggcaacccctccgatacgct

SEQ ID NO: 45807 - DNA, 35 bp, Artificial Sequence
  Synthetic oligonucleotide
gctgagggcacacccgagtttgaacacatcttgct

SEQ ID NO: 45808 - DNA, 35 bp, Artificial Sequence
  Synthetic oligonucleotide
gcattcgccgtatgacactaccctgatccactcgt

SEQ ID NO: 45809 - DNA, 35 bp, Artificial Sequence
  Synthetic oligonucleotide
tctggccgggaggggcgggtctttagaggaacggt

SEQ ID NO: 45810 - DNA, 35 bp, Artificial Sequence
  Synthetic oligonucleotide
acctcaccgcacttacatcctcggtctcttggtgt

SEQ ID NO: 45811 - DNA, 35 bp, Artificial Sequence
  Synthetic oligonucleotide
tgttaccgcacattttttttacgacactgcgtatt

SEQ ID NO: 45812 - DNA, 35 bp, Artificial Sequence
  Synthetic oligonucleotide
tcttgtgcacaaccactgttacatccggttccttt

SEQ ID NO: 45813 - DNA, 36 bp, Artificial Sequence
  Synthetic oligonucleotide
tacagtcgacctatctgcccaactttgcccaacaaa

SEQ ID NO: 45814 - DNA, 36 bp, Artificial Sequence
  Synthetic oligonucleotide
tctccaagcggcttaccatatactacccactggcaa

SEQ ID NO: 45815 - DNA, 36 bp, Artificial Sequence
  Synthetic oligonucleotide
gatggaccacctctatatcttcattcactgtttcaa

SEQ ID NO: 45816 - DNA, 35 bp, Artificial Sequence
  Synthetic oligonucleotide
acgtctctgccgccataaatccctgcgtgtaacca

SEQ ID NO: 45817 - DNA, 36 bp, Artificial Sequence
  Synthetic oligonucleotide
aatggcccaacttatgtggccataaatgaattccca

SEQ ID NO: 45818 - DNA, 35 bp, Artificial Sequence
  Synthetic oligonucleotide
atcacaggccccgtgacaattccaagtcccagcca

SEQ ID NO: 45819 - DNA, 36 bp, Artificial Sequence
  Synthetic oligonucleotide
gacctacgaactaccgacgttgacaatatctatcca

SEQ ID NO: 45820 - DNA, 36 bp, Artificial Sequence
  Synthetic oligonucleotide
ttgcgctccatgttggttggccctttctttgtcgca

SEQ ID NO: 45821 - DNA, 36 bp, Artificial Sequence
  Synthetic oligonucleotide
gcccagcacgagtgccaaggcccccattcgatatca

SEQ ID NO: 45822 - DNA, 35 bp, Artificial Sequence
  Synthetic oligonucleotide
gcaggaccataggtatcatcaccaccaatcactca

SEQ ID NO: 45823 - DNA, 36 bp, Artificial Sequence
  Synthetic oligonucleotide
taggcatgggtggcatggcgcctacgtttcctctca

SEQ ID NO: 45824 - DNA, 37 bp, Artificial Sequence
  Synthetic oligonucleotide
gtgtagcaagtaggggagggagcgcgacaaacaacga

SEQ ID NO: 45825 - DNA, 37 bp, Artificial Sequence
  Synthetic oligonucleotide
tgtcatcctgttccgccgcttttaaagtactatccga

SEQ ID NO: 45826 - DNA, 37 bp, Artificial Sequence
  Synthetic oligonucleotide
actgatgcgggggggggcgggcaaaaggacgtgtcga

SEQ ID NO: 45827 - DNA, 37 bp, Artificial Sequence
  Synthetic oligonucleotide
atggtcccgagcatcccctcccgttggccaccttcga

SEQ ID NO: 45828 - DNA, 37 bp, Artificial Sequence
  Synthetic oligonucleotide
ttccacatcacacaacgcactacgccgggacctggga

SEQ ID NO: 45829 - DNA, 37 bp, Artificial Sequence
  Synthetic oligonucleotide
atcatcaagccgccatacccccgcactgtccgctgga

SEQ ID NO: 45830 - DNA, 37 bp, Artificial Sequence
  Synthetic oligonucleotide
aaagcacgcgagcatgggggaggaaaggcgggttgga

SEQ ID NO: 45831 - DNA, 38 bp, Artificial Sequence
  Synthetic oligonucleotide
gccactgtacggaggatctagcctgcccatgcccatga

SEQ ID NO: 45832 - DNA, 38 bp, Artificial Sequence
  Synthetic oligonucleotide
acccaaccaccaaactgacgagctgctctcggtactga

SEQ ID NO: 45833 - DNA, 38 bp, Artificial Sequence
  Synthetic oligonucleotide
gttcatccgctgtgccctagaccctgcaattggcctga

SEQ ID NO: 45834 - DNA, 38 bp, Artificial Sequence
  Synthetic oligonucleotide
aacgtgcatgagacaggggagggtagatgaagaggtga

SEQ ID NO: 45835 - DNA, 37 bp, Artificial Sequence
  Synthetic oligonucleotide
gaactatcgccgttgttgaccctgatccgataattga

SEQ ID NO: 45836 - DNA, 38 bp, Artificial Sequence
  Synthetic oligonucleotide
gtgcgctacgtgtgatttcgcctttacacccttcttga

SEQ ID NO: 45837 - DNA, 38 bp, Artificial Sequence
  Synthetic oligonucleotide
tcgtagtgcctctgacatcgctgcccgtctcctgttga

SEQ ID NO: 45838 - DNA, 37 bp, Artificial Sequence
  Synthetic oligonucleotide
tccacggccgggaggcatgggaaggagtggggtttga

SEQ ID NO: 45839 - DNA, 36 bp, Artificial Sequence
  Synthetic oligonucleotide
gagcctgcaacacgcctttcacactagcaggaaata

SEQ ID NO: 45840 - DNA, 35 bp, Artificial Sequence
  Synthetic oligonucleotide
tcacgcaatgccactcgttccatccgaaactctta

SEQ ID NO: 45841 - DNA, 36 bp, Artificial Sequence
  Synthetic oligonucleotide
acgggcccgaccctcgacgtttgtaccaccgcttta

SEQ ID NO: 45842 - DNA, 35 bp, Artificial Sequence
  Synthetic oligonucleotide
tcccgtaccagctcgcggtaccactctatttgaac

SEQ ID NO: 45843 - DNA, 35 bp, Artificial Sequence
  Synthetic oligonucleotide
accggtctggcaccctatggccaccttggtttaac

SEQ ID NO: 45844 - DNA, 35 bp, Artificial Sequence
  Synthetic oligonucleotide
taacaacgacggcatgcgcgaccgcccccacgtac

SEQ ID NO: 45845 - DNA, 35 bp, Artificial Sequence
  Synthetic oligonucleotide
acacactccgtccagagcaattgttccgaccgtcc

SEQ ID NO: 45846 - DNA, 35 bp, Artificial Sequence
  Synthetic oligonucleotide
acgttccgaacttgaggatacctacctactccatc

SEQ ID NO: 45847 - DNA, 35 bp, Artificial Sequence
  Synthetic oligonucleotide
atccaagcgcatacaacgggcatcactaattcctc

SEQ ID NO: 45848 - DNA, 35 bp, Artificial Sequence
  Synthetic oligonucleotide
gtgagctttggaggggggatgggggagaatagaag

SEQ ID NO: 45849 - DNA, 35 bp, Artificial Sequence
  Synthetic oligonucleotide
tgcccgctaacctttcttgtcctgcctaaatagcg

SEQ ID NO: 45850 - DNA, 35 bp, Artificial Sequence
  Synthetic oligonucleotide
tcgcaccatcgagttccgtccctttttgtagctcg

SEQ ID NO: 45851 - DNA, 35 bp, Artificial Sequence
  Synthetic oligonucleotide
gactgtacgcctccttctccctatttattccatgg

SEQ ID NO: 45852 - DNA, 35 bp, Artificial Sequence
  Synthetic oligonucleotide
ggtggggagtagtggctgtgtgggcatgaaaggat

SEQ ID NO: 45853 - DNA, 35 bp, Artificial Sequence
  Synthetic oligonucleotide
ttgtacgcatgtagactcatgtggaccttctatct

SEQ ID NO: 45854 - DNA, 36 bp, Artificial Sequence
  Synthetic oligonucleotide
atggggtgggggtcatggtgacagcgggggcgaaaa

SEQ ID NO: 45855 - DNA, 36 bp, Artificial Sequence
  Synthetic oligonucleotide
tcacaaacgtgtctcagctttcgcccctgttcctaa

SEQ ID NO: 45856 - DNA, 36 bp, Artificial Sequence
  Synthetic oligonucleotide
acttaactgcccactccctgtaattgtagggtaaca

SEQ ID NO: 45857 - DNA, 35 bp, Artificial Sequence
  Synthetic oligonucleotide
gcactcccacgccgttgaggcttaaccgactgaca

SEQ ID NO: 45858 - DNA, 35 bp, Artificial Sequence
  Synthetic oligonucleotide
ggggccaggtaggccgccgcataaacactctcgca

SEQ ID NO: 45859 - DNA, 36 bp, Artificial Sequence
  Synthetic oligonucleotide
tacatccgcaggctttttaactttgaagcatctgca

SEQ ID NO: 45860 - DNA, 36 bp, Artificial Sequence
  Synthetic oligonucleotide
atacacacgctggatcgtcatcattctttagcatca

SEQ ID NO: 45861 - DNA, 35 bp, Artificial Sequence
  Synthetic oligonucleotide
tcgaacggcaatcagcctcgtttctgtctgtttca

SEQ ID NO: 45862 - DNA, 37 bp, Artificial Sequence
  Synthetic oligonucleotide
gaccccaggacgccccccttgaccaccttgtttgaga

SEQ ID NO: 45863 - DNA, 37 bp, Artificial Sequence
  Synthetic oligonucleotide
tttggtaggggttaggcttaaagggtgacggggtgga

SEQ ID NO: 45864 - DNA, 38 bp, Artificial Sequence
  Synthetic oligonucleotide
acccagtcgatccccattcgcccacgtcataagaatga

SEQ ID NO: 45865 - DNA, 38 bp, Artificial Sequence
  Synthetic oligonucleotide
gaatccaccacctggaccgactaagttcgtgcccatga

SEQ ID NO: 45866 - DNA, 38 bp, Artificial Sequence
  Synthetic oligonucleotide
gatacatccatgagaagtcgacctccctcccacactga

SEQ ID NO: 45867 - DNA, 38 bp, Artificial Sequence
  Synthetic oligonucleotide
acgctagcaaccgccgggtgggccttaagggggggtga

SEQ ID NO: 45868 - DNA, 38 bp, Artificial Sequence
  Synthetic oligonucleotide
tgtggccggtgcacgtatagggggaagtgggagtgtga

SEQ ID NO: 45869 - DNA, 38 bp, Artificial Sequence
  Synthetic oligonucleotide
tactgtcgaagggaacggaggaggagagcatcaattga

SEQ ID NO: 45870 - DNA, 38 bp, Artificial Sequence
  Synthetic oligonucleotide
gtcctgccccccgagcgaatggaagcaacaatcgttga

SEQ ID NO: 45871 - DNA, 37 bp, Artificial Sequence
  Synthetic oligonucleotide
atagcaaccggcacaccctttcgaacagtagtgttga

SEQ ID NO: 45872 - DNA, 36 bp, Artificial Sequence
  Synthetic oligonucleotide
gcccacccccattgtgcctccgcaaggacggtaata

SEQ ID NO: 45873 - DNA, 36 bp, Artificial Sequence
  Synthetic oligonucleotide
gggatgggggggtgggccactgatacgtttgatata

SEQ ID NO: 45874 - DNA, 36 bp, Artificial Sequence
  Synthetic oligonucleotide
ttacctcaaacgcatatgacgctgactgctctttta

SEQ ID NO: 45875 - DNA, 35 bp, Artificial Sequence
  Synthetic oligonucleotide
tgttgcctgcccacagctcattaccttgccttgcc

SEQ ID NO: 45876 - DNA, 35 bp, Artificial Sequence
  Synthetic oligonucleotide
gccatcttagaccaacgttaacgctcccaggatcc

SEQ ID NO: 45877 - DNA, 35 bp, Artificial Sequence
  Synthetic oligonucleotide
tgtagtgccagggctgtctctcatgtcctgattcc

SEQ ID NO: 45878 - DNA, 35 bp, Artificial Sequence
  Synthetic oligonucleotide
tcgaacgacttgacgtaccaccctagccttgtagc

SEQ ID NO: 45879 - DNA, 35 bp, Artificial Sequence
  Synthetic oligonucleotide
agcgtaccggcctggatctgcctccataaactcgc

SEQ ID NO: 45880 - DNA, 35 bp, Artificial Sequence
  Synthetic oligonucleotide
tgtcattcacccctgtccgttcttaaagaatttgc

SEQ ID NO: 45881 - DNA, 35 bp, Artificial Sequence
  Synthetic oligonucleotide
tcttgcaatccaacttttgtgtccgcgatgccctc

SEQ ID NO: 45882 - DNA, 35 bp, Artificial Sequence
  Synthetic oligonucleotide
tctcagacctaccccggtgccgcatgattatcctc

SEQ ID NO: 45883 - DNA, 35 bp, Artificial Sequence
  Synthetic oligonucleotide
tacaccatcggggttgctgcttatactaacggctc

SEQ ID NO: 45884 - DNA, 35 bp, Artificial Sequence
  Synthetic oligonucleotide
tttctggtccgtcctgtcgcggccctgttcccttc

SEQ ID NO: 45885 - DNA, 35 bp, Artificial Sequence
  Synthetic oligonucleotide
tcgcatcatagtgcactcatagctctttaccatcg

SEQ ID NO: 45886 - DNA, 35 bp, Artificial Sequence
  Synthetic oligonucleotide
tcatcactccgctccaggtcactacaccttgctcg

SEQ ID NO: 45887 - DNA, 35 bp, Artificial Sequence
  Synthetic oligonucleotide
gtgtgggcgggggaggaatcttcaaggttcagagg

SEQ ID NO: 45888 - DNA, 35 bp, Artificial Sequence
  Synthetic oligonucleotide
acacccgcccacttagagccgacatcctccgcggg

SEQ ID NO: 45889 - DNA, 35 bp, Artificial Sequence
  Synthetic oligonucleotide
ggattatgggagggtattggaatgggagggaaatg

SEQ ID NO: 45890 - DNA, 35 bp, Artificial Sequence
  Synthetic oligonucleotide
gtccatctttgtcctgggaaccgtatcttggtaat

SEQ ID NO: 45891 - DNA, 35 bp, Artificial Sequence
  Synthetic oligonucleotide
gagcaacttcgcgacttttgccatttacgccccat

SEQ ID NO: 45892 - DNA, 35 bp, Artificial Sequence
  Synthetic oligonucleotide
aagtactccggtgcatcgggcttgcacacctccct

SEQ ID NO: 45893 - DNA, 35 bp, Artificial Sequence
  Synthetic oligonucleotide
tcccatgctcatcatggtaggcgcccataaatcct

SEQ ID NO: 45894 - DNA, 35 bp, Artificial Sequence
  Synthetic oligonucleotide
agatcatgaaaatgcgaacaataccgattcctgct

SEQ ID NO: 45895 - DNA, 35 bp, Artificial Sequence
  Synthetic oligonucleotide
tcatgtggtgtttataggggggacggggtgggggt

SEQ ID NO: 45896 - DNA, 36 bp, Artificial Sequence
  Synthetic oligonucleotide
agtgcgcgaacaactctgcctgtaatcctcgatggt

SEQ ID NO: 45897 - DNA, 35 bp, Artificial Sequence
  Synthetic oligonucleotide
agacgccggctcgaaagcccatcatcgggaacctt

SEQ ID NO: 45898 - DNA, 35 bp, Artificial Sequence
  Synthetic oligonucleotide
atggttgtgcgccttccgaattctgcctccccgtt

SEQ ID NO: 45899 - DNA, 36 bp, Artificial Sequence
  Synthetic oligonucleotide
atctccgccattccctcctttgaacggttattagaa

SEQ ID NO: 45900 - DNA, 36 bp, Artificial Sequence
  Synthetic oligonucleotide
atcaccagcccccgcaaccctgcttaacggtcctaa

SEQ ID NO: 45901 - DNA, 36 bp, Artificial Sequence
  Synthetic oligonucleotide
tacgaccgagtaagccccagcctgatcttgccaaca

SEQ ID NO: 45902 - DNA, 36 bp, Artificial Sequence
  Synthetic oligonucleotide
acacgacgtatgcgggtaggcctgagggtgggaaca

SEQ ID NO: 45903 - DNA, 36 bp, Artificial Sequence
  Synthetic oligonucleotide
atgactggtttccaggtctttgacacttttacctca

SEQ ID NO: 45904 - DNA, 37 bp, Artificial Sequence
  Synthetic oligonucleotide
ggaatgaggaatgggaagggattaggggtgatcacga

SEQ ID NO: 45905 - DNA, 36 bp, Artificial Sequence
  Synthetic oligonucleotide
acatcggtacatcatctgcacccccgcattccccga

SEQ ID NO: 45906 - DNA, 37 bp, Artificial Sequence
  Synthetic oligonucleotide
tcgcccttgagccgacacgttcctaccaccattccga

SEQ ID NO: 45907 - DNA, 35 bp, Artificial Sequence
  Synthetic oligonucleotide
gaagagggagaaggtttgtggctttcatgaatcga

SEQ ID NO: 45908 - DNA, 37 bp, Artificial Sequence
  Synthetic oligonucleotide
tcccacctccgctgtcgtacctctggcctttactcga

SEQ ID NO: 45909 - DNA, 36 bp, Artificial Sequence
  Synthetic oligonucleotide
tcgatgcgcgactaaacaatccgccctccgtttcga

SEQ ID NO: 45910 - DNA, 34 bp, Artificial Sequence
  Synthetic oligonucleotide
atctaatcacaccctcgtccgccggatgcccgga

SEQ ID NO: 45911 - DNA, 37 bp, Artificial Sequence
  Synthetic oligonucleotide
tggtcggggagggtggggtggtcctgaatagcgggga

SEQ ID NO: 45912 - DNA, 38 bp, Artificial Sequence
  Synthetic oligonucleotide
ttgtcactcctgcgattcctttcagtccctccgaatga

SEQ ID NO: 45913 - DNA, 38 bp, Artificial Sequence
  Synthetic oligonucleotide
aagcccaccacccgcgctaaggaacgtttgaaaactga

SEQ ID NO: 45914 - DNA, 37 bp, Artificial Sequence
  Synthetic oligonucleotide
tccacacccttccttcggtgcccgtccggatacctga

SEQ ID NO: 45915 - DNA, 37 bp, Artificial Sequence
  Synthetic oligonucleotide
actccgccctcctcggtatgacacagatgcctgctga

SEQ ID NO: 45916 - DNA, 38 bp, Artificial Sequence
  Synthetic oligonucleotide
gaatggcgacccaaagggtagagggcggtcggtggtga

SEQ ID NO: 45917 - DNA, 38 bp, Artificial Sequence
  Synthetic oligonucleotide
tggagcctcggcccgagtttcacacgcatcatctttga

SEQ ID NO: 45918 - DNA, 36 bp, Artificial Sequence
  Synthetic oligonucleotide
agatgggccgctccttaaccctcttgccgtacacta

SEQ ID NO: 45919 - DNA, 36 bp, Artificial Sequence
  Synthetic oligonucleotide
tccagtacgcaactactatatcggacgataatgcta

SEQ ID NO: 45920 - DNA, 36 bp, Artificial Sequence
  Synthetic oligonucleotide
agttgccctcgcgaatcgctttaccccgctagggta

SEQ ID NO: 45921 - DNA, 35 bp, Artificial Sequence
  Synthetic oligonucleotide
tacttcgcccccaatgtgattaccattgcccgaac

SEQ ID NO: 45922 - DNA, 35 bp, Artificial Sequence
  Synthetic oligonucleotide
accgacacaaaacaaccgaccgaacctgcatcgac

SEQ ID NO: 45923 - DNA, 35 bp, Artificial Sequence
  Synthetic oligonucleotide
ttccctatcgtactgtcattgccggctacaggtcc

SEQ ID NO: 45924 - DNA, 35 bp, Artificial Sequence
  Synthetic oligonucleotide
ttgtgtcctgcaaacccttgtgccaaccacattcc

SEQ ID NO: 45925 - DNA, 35 bp, Artificial Sequence
  Synthetic oligonucleotide
tcacaggttgacacaagctgtaacaattcactgtc

SEQ ID NO: 45926 - DNA, 35 bp, Artificial Sequence
  Synthetic oligonucleotide
tgacgtctccccatgtcccgtctagccaattacag

SEQ ID NO: 45927 - DNA, 35 bp, Artificial Sequence
  Synthetic oligonucleotide
tggtcgatctcccgctacccacatacatccgcctg

SEQ ID NO: 45928 - DNA, 35 bp, Artificial Sequence
  Synthetic oligonucleotide
acatcccggaatgccatcgattgccactaactctg

SEQ ID NO: 45929 - DNA, 35 bp, Artificial Sequence
  Synthetic oligonucleotide
gccacctcattataacctatagccacctttgtctg

SEQ ID NO: 45930 - DNA, 35 bp, Artificial Sequence
  Synthetic oligonucleotide
tcctggagcgaacgtaagcgtctcaccatactttg

SEQ ID NO: 45931 - DNA, 35 bp, Artificial Sequence
  Synthetic oligonucleotide
taaacgcgggtgggttgtggggtaactggatgcat

SEQ ID NO: 45932 - DNA, 35 bp, Artificial Sequence
  Synthetic oligonucleotide
tcacctcactcctatagcttgcaacaagcttcact

SEQ ID NO: 45933 - DNA, 35 bp, Artificial Sequence
  Synthetic oligonucleotide
taggcccactcccacgtttaatacttctgtgctct

SEQ ID NO: 45934 - DNA, 35 bp, Artificial Sequence
  Synthetic oligonucleotide
atgtcatggctgtgtggtttcatggggggggcggt

SEQ ID NO: 45935 - DNA, 35 bp, Artificial Sequence
  Synthetic oligonucleotide
tgctgccatgtcctcaagccactcattcatcatgt

SEQ ID NO: 45936 - DNA, 35 bp, Artificial Sequence
  Synthetic oligonucleotide
tcaggcgggcacctgtcctgtattcctcaatcatt

SEQ ID NO: 45937 - DNA, 35 bp, Artificial Sequence
  Synthetic oligonucleotide
ggacagccatcgcctttggtttttccgagtccctt

SEQ ID NO: 45938 - DNA, 36 bp, Artificial Sequence
  Synthetic oligonucleotide
tcacgcaccgaagcatagccgcgaccctgttggaaa

SEQ ID NO: 45939 - DNA, 36 bp, Artificial Sequence
  Synthetic oligonucleotide
gcgaatggggcagggggcgaatagtcacacaaagaa

SEQ ID NO: 45940 - DNA, 35 bp, Artificial Sequence
  Synthetic oligonucleotide
tagccggctcctgcctcacacgcactagttcttaa

SEQ ID NO: 45941 - DNA, 37 bp, Artificial Sequence
  Synthetic oligonucleotide
tgacctacgccatccatcaatagtgcgtacacatcca

SEQ ID NO: 45942 - DNA, 36 bp, Artificial Sequence
  Synthetic oligonucleotide
gtttgcaccaccacctcccatcaatcgggtaaaaga

SEQ ID NO: 45943 - DNA, 37 bp, Artificial Sequence
  Synthetic oligonucleotide
gactaggagcgccatcttatgtccccctccatccaga

SEQ ID NO: 45944 - DNA, 37 bp, Artificial Sequence
  Synthetic oligonucleotide
atccaccccgtatttcatgcagtcccactttcgtaga

SEQ ID NO: 45945 - DNA, 37 bp, Artificial Sequence
  Synthetic oligonucleotide
gattgaatggtggaggtggagtttggaccgaacgcga

SEQ ID NO: 45946 - DNA, 36 bp, Artificial Sequence
  Synthetic oligonucleotide
tgtcgtccggtactcgatctcgtcccttcttgtcga

SEQ ID NO: 45947 - DNA, 37 bp, Artificial Sequence
  Synthetic oligonucleotide
taacgattccatcccccgtggcgcctacctcgccgga

SEQ ID NO: 45948 - DNA, 37 bp, Artificial Sequence
  Synthetic oligonucleotide
tctgcctcctgacttgcgcggaagaccctctctcgga

SEQ ID NO: 45949 - DNA, 38 bp, Artificial Sequence
  Synthetic oligonucleotide
gacccatcctcctgcctctcgaagggcagttacaatga

SEQ ID NO: 45950 - DNA, 38 bp, Artificial Sequence
  Synthetic oligonucleotide
gcgttcgcacacttgctatgactctgcaccctgaatga

SEQ ID NO: 45951 - DNA, 37 bp, Artificial Sequence
  Synthetic oligonucleotide
tagcctccaccgcacatctgcattttataccccatga

SEQ ID NO: 45952 - DNA, 37 bp, Artificial Sequence
  Synthetic oligonucleotide
gctgagcggggaccttctctttgcgcctacaacctga

SEQ ID NO: 45953 - DNA, 38 bp, Artificial Sequence
  Synthetic oligonucleotide
atgctcccatatagtgctctccaacccagtgttcctga

SEQ ID NO: 45954 - DNA, 38 bp, Artificial Sequence
  Synthetic oligonucleotide
gacaccgtatcgatcttacccgcccttgtactgtctga

SEQ ID NO: 45955 - DNA, 38 bp, Artificial Sequence
  Synthetic oligonucleotide
accgatggggggtgggaaaggtagataagattcggtga

SEQ ID NO: 45956 - DNA, 37 bp, Artificial Sequence
  Synthetic oligonucleotide
taacacatcaccgcattcgcagcacccattggggtga

SEQ ID NO: 45957 - DNA, 38 bp, Artificial Sequence
  Synthetic oligonucleotide
tcgccccactacgaccggtatctcgcaccaccatgtga

SEQ ID NO: 45958 - DNA, 36 bp, Artificial Sequence
  Synthetic oligonucleotide
tccacaccgtgcactcatattcactcttgaccttga

SEQ ID NO: 45959 - DNA, 36 bp, Artificial Sequence
  Synthetic oligonucleotide
tgtcgcccgcttgcttgtctctcccggttctcttga

SEQ ID NO: 45960 - DNA, 37 bp, Artificial Sequence
  Synthetic oligonucleotide
tcaacccccgaagcgtcgttattcactccaccgttga

SEQ ID NO: 45961 - DNA, 37 bp, Artificial Sequence
  Synthetic oligonucleotide
ttgaccgaacgaataccaagcctgcccctcgttttga

SEQ ID NO: 45962 - DNA, 36 bp, Artificial Sequence
  Synthetic oligonucleotide
ttggcccaccgcccaatctcggattcccgactcata

SEQ ID NO: 45963 - DNA, 36 bp, Artificial Sequence
  Synthetic oligonucleotide
atcccctgtgtccacttcgcttactatttggcccta

SEQ ID NO: 45964 - DNA, 36 bp, Artificial Sequence
  Synthetic oligonucleotide
acacgcggtctatggcgctgggcatacccccttcta

SEQ ID NO: 45965 - DNA, 36 bp, Artificial Sequence
  Synthetic oligonucleotide
tctcgctccaggcacctactcaccaattcgcgtgta

SEQ ID NO: 45966 - DNA, 36 bp, Artificial Sequence
  Synthetic oligonucleotide
gcacatgaacggggaagggagacgagtatgcattta

SEQ ID NO: 45967 - DNA, 35 bp, Artificial Sequence
  Synthetic oligonucleotide
tgtgtcgcaacccgacgctgtacccacctacttta

SEQ ID NO: 45968 - DNA, 35 bp, Artificial Sequence
  Synthetic oligonucleotide
gcataggcccccccatctatgtgtcgccaactcac

SEQ ID NO: 45969 - DNA, 35 bp, Artificial Sequence
  Synthetic oligonucleotide
tcgaaccccttctgattcagctcctgaactctccc

SEQ ID NO: 45970 - DNA, 35 bp, Artificial Sequence
  Synthetic oligonucleotide
tacccttgccttaacattatgctgaacttttagcc

SEQ ID NO: 45971 - DNA, 35 bp, Artificial Sequence
  Synthetic oligonucleotide
tgttggttagcacgtaattgccccatctcttctcc

SEQ ID NO: 45972 - DNA, 35 bp, Artificial Sequence
  Synthetic oligonucleotide
agtgcatcaggatcgtgtacgtcgtgcctgcttcc

SEQ ID NO: 45973 - DNA, 35 bp, Artificial Sequence
  Synthetic oligonucleotide
ttacggcctgccgataactattcgcccaccgtttc

SEQ ID NO: 45974 - DNA, 33 bp, Artificial Sequence
  Synthetic oligonucleotide
atccgccggaagttttacttttcatactgtttc

SEQ ID NO: 45975 - DNA, 35 bp, Artificial Sequence
  Synthetic oligonucleotide
tggacacacatttttgcggtttaactcctccatgg

SEQ ID NO: 45976 - DNA, 35 bp, Artificial Sequence
  Synthetic oligonucleotide
tacaacccgcaatttgcagcacgccctcattcatg

SEQ ID NO: 45977 - DNA, 35 bp, Artificial Sequence
  Synthetic oligonucleotide
tgatagcgcctaccgtcttcagctcagcttaccat

SEQ ID NO: 45978 - DNA, 35 bp, Artificial Sequence
  Synthetic oligonucleotide
gtgtgcccttcattgtcttttgtgacttttcttat

SEQ ID NO: 45979 - DNA, 35 bp, Artificial Sequence
  Synthetic oligonucleotide
agtggctgaaatcgcacccgtggcaaccatacact

SEQ ID NO: 45980 - DNA, 34 bp, Artificial Sequence
  Synthetic oligonucleotide
tcattacccgcttcacccgatccctcggggcact

SEQ ID NO: 45981 - DNA, 35 bp, Artificial Sequence
  Synthetic oligonucleotide
ttgtgtgggcctatctcctgccatgcccaggacct

SEQ ID NO: 45982 - DNA, 35 bp, Artificial Sequence
  Synthetic oligonucleotide
acataggggttagggcgatggaaaggggggcatct

SEQ ID NO: 45983 - DNA, 35 bp, Artificial Sequence
  Synthetic oligonucleotide
atggagcgaacttgggggcatctggctgggggtct

SEQ ID NO: 45984 - DNA, 35 bp, Artificial Sequence
  Synthetic oligonucleotide
gagagacggcatgctgaaccgctcatcgtaccttt

SEQ ID NO: 45985 - DNA, 36 bp, Artificial Sequence
  Synthetic oligonucleotide
aagggggtgaaggggtcgggaggcactgcgtcacaa

SEQ ID NO: 45986 - DNA, 35 bp, Artificial Sequence
  Synthetic oligonucleotide
tcaccggtggggtggcagtaggatgaccactagaa

SEQ ID NO: 45987 - DNA, 36 bp, Artificial Sequence
  Synthetic oligonucleotide
aacaacctctgtccttacacgaaccgctcaaacgaa

SEQ ID NO: 45988 - DNA, 36 bp, Artificial Sequence
  Synthetic oligonucleotide
tgttttgccgtgcacatcatcacttctctctatgaa

SEQ ID NO: 45989 - DNA, 36 bp, Artificial Sequence
  Synthetic oligonucleotide
agacgccccacccagcatgtcagcaacgcgcggtaa

SEQ ID NO: 45990 - DNA, 35 bp, Artificial Sequence
  Synthetic oligonucleotide
tcacctcctgcgctgcccggtccttccccgtttaa

SEQ ID NO: 45991 - DNA, 35 bp, Artificial Sequence
  Synthetic oligonucleotide
tcctcaaccggtgacttcccgtgtttgacccaaca

SEQ ID NO: 45992 - DNA, 36 bp, Artificial Sequence
  Synthetic oligonucleotide
gggacaacacaggccaacatacccgccccgaccaca

SEQ ID NO: 45993 - DNA, 36 bp, Artificial Sequence
  Synthetic oligonucleotide
gcacccatcactgtcaccccgtgctgcgcttccaca

SEQ ID NO: 45994 - DNA, 35 bp, Artificial Sequence
  Synthetic oligonucleotide
ttccctccgctggcattacactcagcgacatccca

SEQ ID NO: 45995 - DNA, 35 bp, Artificial Sequence
  Synthetic oligonucleotide
atgttcgccattgacccgctcctgtcaatactcca

SEQ ID NO: 45996 - DNA, 37 bp, Artificial Sequence
  Synthetic oligonucleotide
actctctacgtcctgttgccctccactcgtaccaaga

SEQ ID NO: 45997 - DNA, 37 bp, Artificial Sequence
  Synthetic oligonucleotide
agaacgtgggaggaatcagggcaccggaaagcgacga

SEQ ID NO: 45998 - DNA, 37 bp, Artificial Sequence
  Synthetic oligonucleotide
gccgaatcccccctcccgtttttacgcctgtgtacga

SEQ ID NO: 45999 - DNA, 37 bp, Artificial Sequence
  Synthetic oligonucleotide
ggactccccctgtaggaatcatgatacttccccccga

SEQ ID NO: 46000 - DNA, 35 bp, Artificial Sequence
  Synthetic oligonucleotide
gcaacacatcctgacatcgctccagccgctgccga

SEQ ID NO: 46001 - DNA, 37 bp, Artificial Sequence
  Synthetic oligonucleotide
gcctactccttccttgtgacttcgtatcgttttgcga

SEQ ID NO: 46002 - DNA, 37 bp, Artificial Sequence
  Synthetic oligonucleotide
tccccccgaccagtagcccattgtggaccacctggga

SEQ ID NO: 46003 - DNA, 38 bp, Artificial Sequence
  Synthetic oligonucleotide
aattgggcagatggacgggagggtcgggaagaaaatga

SEQ ID NO: 46004 - DNA, 37 bp, Artificial Sequence
  Synthetic oligonucleotide
ttaacacgcgcgtgggtggtggggggtatgggcatga

SEQ ID NO: 46005 - DNA, 37 bp, Artificial Sequence
  Synthetic oligonucleotide
gcatcgcagaccctgctgctcccttcacattcgatga

SEQ ID NO: 46006 - DNA, 38 bp, Artificial Sequence
  Synthetic oligonucleotide
gatcactcctgctcagcccccgtacgccatcctactga

SEQ ID NO: 46007 - DNA, 38 bp, Artificial Sequence
  Synthetic oligonucleotide
gtgcgatacccctgatgcccgatacccctcctttgtga

SEQ ID NO: 46008 - DNA, 37 bp, Artificial Sequence
  Synthetic oligonucleotide
gtgcgaccgggactcccgccgctgcctttcttcttga

SEQ ID NO: 46009 - DNA, 38 bp, Artificial Sequence
  Synthetic oligonucleotide
agagtggcgccgatcttcgtccacactctttcctttga

SEQ ID NO: 46010 - DNA, 35 bp, Artificial Sequence
  Synthetic oligonucleotide
ttacaggaatgccaccgtgctccaccttgacccta

SEQ ID NO: 46011 - DNA, 36 bp, Artificial Sequence
  Synthetic oligonucleotide
atgaccaccgctctatctagtagtcaacacactgta

SEQ ID NO: 46012 - DNA, 36 bp, Artificial Sequence
  Synthetic oligonucleotide
atccctcgccggactatacgtgcaccctccatgtta

SEQ ID NO: 46013 - DNA, 35 bp, Artificial Sequence
  Synthetic oligonucleotide
gcttcaccagtagctcggccattcccggtccttac

SEQ ID NO: 46014 - DNA, 35 bp, Artificial Sequence
  Synthetic oligonucleotide
acgcactcctaagactccgccttatgcacgccccc

SEQ ID NO: 46015 - DNA, 35 bp, Artificial Sequence
  Synthetic oligonucleotide
tctctcactgagacccttcacgtacccgctttgcc

SEQ ID NO: 46016 - DNA, 35 bp, Artificial Sequence
  Synthetic oligonucleotide
ataattcacaaccgcggcctgcacttcccgctagc

SEQ ID NO: 46017 - DNA, 35 bp, Artificial Sequence
  Synthetic oligonucleotide
ttcaaccctatctcgcataaggtcacgtttcgtgc

SEQ ID NO: 46018 - DNA, 35 bp, Artificial Sequence
  Synthetic oligonucleotide
aacgataccaccacctgttttcatcacgttttatc

SEQ ID NO: 46019 - DNA, 35 bp, Artificial Sequence
  Synthetic oligonucleotide
aactctgctcacagtcctgtcgagggtttcatctc

SEQ ID NO: 46020 - DNA, 35 bp, Artificial Sequence
  Synthetic oligonucleotide
aagcacaccgaacccagacttttttggtgtcattc

SEQ ID NO: 46021 - DNA, 35 bp, Artificial Sequence
  Synthetic oligonucleotide
attggccaccaccaatctgactcacacgcctattc

SEQ ID NO: 46022 - DNA, 35 bp, Artificial Sequence
  Synthetic oligonucleotide
gcctcaagcaacgcgccgatcctgaaaacgctttc

SEQ ID NO: 46023 - DNA, 35 bp, Artificial Sequence
  Synthetic oligonucleotide
tcaagagtccagcaggggtgccgagaagagagagg

SEQ ID NO: 46024 - DNA, 35 bp, Artificial Sequence
  Synthetic oligonucleotide
atgattgaggaagagggaagggagggatgtcgatg

SEQ ID NO: 46025 - DNA, 35 bp, Artificial Sequence
  Synthetic oligonucleotide
atgcaggacacccactcatcagacaccttacactg

SEQ ID NO: 46026 - DNA, 35 bp, Artificial Sequence
  Synthetic oligonucleotide
gctttacgccgagacacattgaccacctgcccctg

SEQ ID NO: 46027 - DNA, 35 bp, Artificial Sequence
  Synthetic oligonucleotide
ttcaccctgctccgtatcatcttagtacaaaagtg

SEQ ID NO: 46028 - DNA, 35 bp, Artificial Sequence
  Synthetic oligonucleotide
ttgaaaatcacctgcccgcacgtacaaccgccaat

SEQ ID NO: 46029 - DNA, 35 bp, Artificial Sequence
  Synthetic oligonucleotide
tcgtgctcagacagtctttttgcacaccacctgat

SEQ ID NO: 46030 - DNA, 35 bp, Artificial Sequence
  Synthetic oligonucleotide
gtatgccaccacagatcccagctaattgcaagact

SEQ ID NO: 46031 - DNA, 35 bp, Artificial Sequence
  Synthetic oligonucleotide
ttacgacctacatcggctaacgtccccgccaacct

SEQ ID NO: 46032 - DNA, 35 bp, Artificial Sequence
  Synthetic oligonucleotide
acccatcttcctgcgaagactgaaggttttaacct

SEQ ID NO: 46033 - DNA, 35 bp, Artificial Sequence
  Synthetic oligonucleotide
gcataggtgggggggcaggacagggatcgacggct

SEQ ID NO: 46034 - DNA, 35 bp, Artificial Sequence
  Synthetic oligonucleotide
gacaccctcggcgcctgcatcctgttaacttctct

SEQ ID NO: 46035 - DNA, 35 bp, Artificial Sequence
  Synthetic oligonucleotide
aggaacaagggggagggcgaaatcgtgagggcagt

SEQ ID NO: 46036 - DNA, 35 bp, Artificial Sequence
  Synthetic oligonucleotide
gaagaggtgggaagggctttcggtatagatgcagt

SEQ ID NO: 46037 - DNA, 35 bp, Artificial Sequence
  Synthetic oligonucleotide
gtccacaccgccatgcattccttttaactgtgggt

SEQ ID NO: 46038 - DNA, 35 bp, Artificial Sequence
  Synthetic oligonucleotide
acaccagggccggagccttaccgagtggactaatt

SEQ ID NO: 46039 - DNA, 35 bp, Artificial Sequence
  Synthetic oligonucleotide
gtgacgttaatgtgcatggttgcccgcccttaatt

SEQ ID NO: 46040 - DNA, 35 bp, Artificial Sequence
  Synthetic oligonucleotide
acacctgcgagcatcagctaatgcctgttcacatt

SEQ ID NO: 46041 - DNA, 35 bp, Artificial Sequence
  Synthetic oligonucleotide
gagcacgtacgggctccactgttgttagttcgctt

SEQ ID NO: 46042 - DNA, 35 bp, Artificial Sequence
  Synthetic oligonucleotide
ggacgggccgctgggttctgtcccccaatcttctt

SEQ ID NO: 46043 - DNA, 36 bp, Artificial Sequence
  Synthetic oligonucleotide
aactcgcataccgaggtccttctgccctactccgaa

SEQ ID NO: 46044 - DNA, 36 bp, Artificial Sequence
  Synthetic oligonucleotide
gcagtactgcatcaagtatctccattcatttcctaa

SEQ ID NO: 46045 - DNA, 35 bp, Artificial Sequence
  Synthetic oligonucleotide
tatgcgccaagtgctccatcccttaacttccttaa

SEQ ID NO: 46046 - DNA, 36 bp, Artificial Sequence
  Synthetic oligonucleotide
tacccccgatgggacagtcacatcccccgccataca

SEQ ID NO: 46047 - DNA, 36 bp, Artificial Sequence
  Synthetic oligonucleotide
gaatgaaaggagcgtaatttaaggggacgggaccca

SEQ ID NO: 46048 - DNA, 35 bp, Artificial Sequence
  Synthetic oligonucleotide
tcaaggtgctgaccacctctcactactccagtcca

SEQ ID NO: 46049 - DNA, 36 bp, Artificial Sequence
  Synthetic oligonucleotide
gtcacgtcgacatgtcgccccttatccttcctcgca

SEQ ID NO: 46050 - DNA, 36 bp, Artificial Sequence
  Synthetic oligonucleotide
agcgctgcgtagcgctggccccccgttttcttcgca

SEQ ID NO: 46051 - DNA, 36 bp, Artificial Sequence
  Synthetic oligonucleotide
tcaggggcaacgtatgttttcgcgcgcccttactca

SEQ ID NO: 46052 - DNA, 37 bp, Artificial Sequence
  Synthetic oligonucleotide
tctccgaaccgccattgtcctgggccccctacataga

SEQ ID NO: 46053 - DNA, 37 bp, Artificial Sequence
  Synthetic oligonucleotide
gaataccacgaaccactaacataccgcgctcctgcga

SEQ ID NO: 46054 - DNA, 37 bp, Artificial Sequence
  Synthetic oligonucleotide
tgatcccagctccctccacgagtcgcctcgctttcga

SEQ ID NO: 46055 - DNA, 37 bp, Artificial Sequence
  Synthetic oligonucleotide
aacacgcgctgaacatcacaagtaattccgtcacgga

SEQ ID NO: 46056 - DNA, 36 bp, Artificial Sequence
  Synthetic oligonucleotide
gcagatccacgcggctcaagctctgcccctctcgga

SEQ ID NO: 46057 - DNA, 37 bp, Artificial Sequence
  Synthetic oligonucleotide
aagtcaagggcctgaaattagcggagggccggaggga

SEQ ID NO: 46058 - DNA, 37 bp, Artificial Sequence
  Synthetic oligonucleotide
tgagcccccaccccctgtatgttaacggtcgctggga

SEQ ID NO: 46059 - DNA, 37 bp, Artificial Sequence
  Synthetic oligonucleotide
gtgcccctaaggaccccccccgtactgtgtaccctga

SEQ ID NO: 46060 - DNA, 37 bp, Artificial Sequence
  Synthetic oligonucleotide
tcctcgcaccaacactataacataacgtactgcgtga

SEQ ID NO: 46061 - DNA, 38 bp, Artificial Sequence
  Synthetic oligonucleotide
gggggggggtgggaatgggtccagggaggtgtgcgtga

SEQ ID NO: 46062 - DNA, 38 bp, Artificial Sequence
  Synthetic oligonucleotide
aactacactcactcttgcccagggatttcactctgtga

SEQ ID NO: 46063 - DNA, 37 bp, Artificial Sequence
  Synthetic oligonucleotide
tgagttgtgccagaacgtacgggggggcggggattga

SEQ ID NO: 46064 - DNA, 36 bp, Artificial Sequence
  Synthetic oligonucleotide
tatccaatcatacgcgcagtcatcgccttaccttga

SEQ ID NO: 46065 - DNA, 38 bp, Artificial Sequence
  Synthetic oligonucleotide
gaaacgggcatggggctgaactacagggaaggggttga

SEQ ID NO: 46066 - DNA, 38 bp, Artificial Sequence
  Synthetic oligonucleotide
gtcgcgcaaccttgttttttgcccatcgtgactgttga

SEQ ID NO: 46067 - DNA, 36 bp, Artificial Sequence
  Synthetic oligonucleotide
gtgaaagtgcagacgaggggcaagttgaaagtacta

SEQ ID NO: 46068 - DNA, 35 bp, Artificial Sequence
  Synthetic oligonucleotide
ggacggtcgcagcttggccacgcaccatttcgaac

SEQ ID NO: 46069 - DNA, 35 bp, Artificial Sequence
  Synthetic oligonucleotide
tcgtgaccacgtatcctgctttattattgtcccac

SEQ ID NO: 46070 - DNA, 35 bp, Artificial Sequence
  Synthetic oligonucleotide
tcccacacatatagaccgcgaccatgacgtcctgc

SEQ ID NO: 46071 - DNA, 35 bp, Artificial Sequence
  Synthetic oligonucleotide
aacaccgcatgactctggaatctcatcttccgtgc

SEQ ID NO: 46072 - DNA, 35 bp, Artificial Sequence
  Synthetic oligonucleotide
tcccattggggccgggtcagctcatccgcgccatc

SEQ ID NO: 46073 - DNA, 36 bp, Artificial Sequence
  Synthetic oligonucleotide
gtttccgcctgaaagttatttcaagccgttgccatc

SEQ ID NO: 46074 - DNA, 35 bp, Artificial Sequence
  Synthetic oligonucleotide
tgcccacgcggtattttctctcatggaatgccctc

SEQ ID NO: 46075 - DNA, 35 bp, Artificial Sequence
  Synthetic oligonucleotide
tggtggaccggtcgcgctcttatggaaactgtctc

SEQ ID NO: 46076 - DNA, 35 bp, Artificial Sequence
  Synthetic oligonucleotide
tagcatgttttcctcacgttaccgctactggcttc

SEQ ID NO: 46077 - DNA, 35 bp, Artificial Sequence
  Synthetic oligonucleotide
attctgccctatcgtacaatcttcgctgccttttc

SEQ ID NO: 46078 - DNA, 35 bp, Artificial Sequence
  Synthetic oligonucleotide
acaatgctctgcccctgcttaaactgtcagttttc

SEQ ID NO: 46079 - DNA, 35 bp, Artificial Sequence
  Synthetic oligonucleotide
actttgcatcctccgtcccacttacgcgctttgag

SEQ ID NO: 46080 - DNA, 35 bp, Artificial Sequence
  Synthetic oligonucleotide
gacacgtgaaatggactggcctagactccacgcat

SEQ ID NO: 46081 - DNA, 35 bp, Artificial Sequence
  Synthetic oligonucleotide
tgtaccgctgaactatacttctttcgacatgcgat

SEQ ID NO: 46082 - DNA, 34 bp, Artificial Sequence
  Synthetic oligonucleotide
ttaatgacacccctgcacgctccagcctgactat

SEQ ID NO: 46083 - DNA, 35 bp, Artificial Sequence
  Synthetic oligonucleotide
gcacgacccctcactcgttacatcgatcaccttat

SEQ ID NO: 46084 - DNA, 35 bp, Artificial Sequence
  Synthetic oligonucleotide
tcgcgtcatgtccttcatccaacgctctatctgct

SEQ ID NO: 46085 - DNA, 35 bp, Artificial Sequence
  Synthetic oligonucleotide
tcattcgggacccttgttcgcctccgatcgccttt

SEQ ID NO: 46086 - DNA, 35 bp, Artificial Sequence
  Synthetic oligonucleotide
gatacctgtgaaccgaggtttttctgtgtgccttt

SEQ ID NO: 46087 - DNA, 36 bp, Artificial Sequence
  Synthetic oligonucleotide
tccccccacaccctgtctttcccgcggggaaaaaaa

SEQ ID NO: 46088 - DNA, 36 bp, Artificial Sequence
  Synthetic oligonucleotide
gccaggggagggcgggatagcgggataaatgtagaa

SEQ ID NO: 46089 - DNA, 36 bp, Artificial Sequence
  Synthetic oligonucleotide
agatgggggggaagaaaagaaaggggagggagcgaa

SEQ ID NO: 46090 - DNA, 35 bp, Artificial Sequence
  Synthetic oligonucleotide
tcacccgagccttccaaatctgaaacgtggagtaa

SEQ ID NO: 46091 - DNA, 35 bp, Artificial Sequence
  Synthetic oligonucleotide
gggggttggtggaaggggtgctacgcaggaataca

SEQ ID NO: 46092 - DNA, 35 bp, Artificial Sequence
  Synthetic oligonucleotide
tccaccccgccccttggaaaaggtgttaatggcca

SEQ ID NO: 46093 - DNA, 36 bp, Artificial Sequence
  Synthetic oligonucleotide
ggttggacactattgatatgctccgtacctccctca

SEQ ID NO: 46094 - DNA, 37 bp, Artificial Sequence
  Synthetic oligonucleotide
ttgcaagactaatggcggacatgggggggacgggaga

SEQ ID NO: 46095 - DNA, 36 bp, Artificial Sequence
  Synthetic oligonucleotide
gggtagggggggcatgggactcgttcccgcttacga

SEQ ID NO: 46096 - DNA, 37 bp, Artificial Sequence
  Synthetic oligonucleotide
tcctggccgagcaagtattggcgcttccatcctccga

SEQ ID NO: 46097 - DNA, 37 bp, Artificial Sequence
  Synthetic oligonucleotide
tcgaaggaggaccggacgggggaggagctaaaagcga

SEQ ID NO: 46098 - DNA, 37 bp, Artificial Sequence
  Synthetic oligonucleotide
tccgggctccctacgccgtcccactcattatctgcga

SEQ ID NO: 46099 - DNA, 37 bp, Artificial Sequence
  Synthetic oligonucleotide
gcaacgctttacctgcgctgttcatttcctctctcga

SEQ ID NO: 46100 - DNA, 37 bp, Artificial Sequence
  Synthetic oligonucleotide
gtcacggcccatttcttcgacctttctccccagggga

SEQ ID NO: 46101 - DNA, 36 bp, Artificial Sequence
  Synthetic oligonucleotide
atcgatctacctctttgccgtggcccggtccgggga

SEQ ID NO: 46102 - DNA, 36 bp, Artificial Sequence
  Synthetic oligonucleotide
tggaaacgggagggcttgggactcgtgcgggtggga

SEQ ID NO: 46103 - DNA, 38 bp, Artificial Sequence
  Synthetic oligonucleotide
gtgcgaggggaggagcacgctatggacgggatcaatga

SEQ ID NO: 46104 - DNA, 37 bp, Artificial Sequence
  Synthetic oligonucleotide
gatcccgaagcatggccttgaatgattgccaccatga

SEQ ID NO: 46105 - DNA, 38 bp, Artificial Sequence
  Synthetic oligonucleotide
tctaagctgcccccaccccacgtatctcgctagcctga

SEQ ID NO: 46106 - DNA, 38 bp, Artificial Sequence
  Synthetic oligonucleotide
tcacatgtagtgtgtttatttgaatagtgtacgcgtga

SEQ ID NO: 46107 - DNA, 38 bp, Artificial Sequence
  Synthetic oligonucleotide
tccccgctgtattgtgtcggttagcccacgctccttga

SEQ ID NO: 46108 - DNA, 38 bp, Artificial Sequence
  Synthetic oligonucleotide
atgagcacgccccttttgcccggttacttcatctttga

SEQ ID NO: 46109 - DNA, 36 bp, Artificial Sequence
  Synthetic oligonucleotide
gtaccgagaatgggacaggaaagaacggggggagta

SEQ ID NO: 46110 - DNA, 35 bp, Artificial Sequence
  Synthetic oligonucleotide
tccgctatccgactcttcctccggactggacctta

SEQ ID NO: 46111 - DNA, 36 bp, Artificial Sequence
  Synthetic oligonucleotide
tcatcctggagtccagtgctatgttctcgtttctta

SEQ ID NO: 46112 - DNA, 36 bp, Artificial Sequence
  Synthetic oligonucleotide
gctgcaggagcagcattgggccagggcgggtgggac

SEQ ID NO: 46113 - DNA, 35 bp, Artificial Sequence
  Synthetic oligonucleotide
agcaaggctcataaacgctctggcaaccaccaacc

SEQ ID NO: 46114 - DNA, 35 bp, Artificial Sequence
  Synthetic oligonucleotide
gacgcatacgtacaccagaccacaaaccacgcgcc

SEQ ID NO: 46115 - DNA, 35 bp, Artificial Sequence
  Synthetic oligonucleotide
accacacgcgtgttccttcatcctaatatccggcc

SEQ ID NO: 46116 - DNA, 35 bp, Artificial Sequence
  Synthetic oligonucleotide
accgactctcaccctgattcaacctagtaggtgcc

SEQ ID NO: 46117 - DNA, 35 bp, Artificial Sequence
  Synthetic oligonucleotide
gtggggctacggtgccaatgtcctgctgcaactcc

SEQ ID NO: 46118 - DNA, 35 bp, Artificial Sequence
  Synthetic oligonucleotide
gcccgcctttcatcccttggagtccatctatcagc

SEQ ID NO: 46119 - DNA, 35 bp, Artificial Sequence
  Synthetic oligonucleotide
tagcccctcgtttctttagcttgctgttaaccatc

SEQ ID NO: 46120 - DNA, 35 bp, Artificial Sequence
  Synthetic oligonucleotide
tactccacgctgtgtcctgaaatataccttccatc

SEQ ID NO: 46121 - DNA, 35 bp, Artificial Sequence
  Synthetic oligonucleotide
attgctggttgacgcaacttcctgggtactatgtc

SEQ ID NO: 46122 - DNA, 35 bp, Artificial Sequence
  Synthetic oligonucleotide
acaccttgcccatagcccagttatctcttatagcg

SEQ ID NO: 46123 - DNA, 35 bp, Artificial Sequence
  Synthetic oligonucleotide
gacccgcccgcccgttttgttggccctagcagtcg

SEQ ID NO: 46124 - DNA, 35 bp, Artificial Sequence
  Synthetic oligonucleotide
agtgccacaccgcttcccgcccgttttatcgctat

SEQ ID NO: 46125 - DNA, 35 bp, Artificial Sequence
  Synthetic oligonucleotide
gttccacacccgtctacttcccttctacgagatgt

SEQ ID NO: 46126 - DNA, 35 bp, Artificial Sequence
  Synthetic oligonucleotide
gccggtccctgccgaaccccttgaatcttgagatt

SEQ ID NO: 46127 - DNA, 35 bp, Artificial Sequence
  Synthetic oligonucleotide
acacgtcttggaccgttattttgttttcttacctt

SEQ ID NO: 46128 - DNA, 36 bp, Artificial Sequence
  Synthetic oligonucleotide
tctccgcccagccccaagctcaaacagggttaaaca

SEQ ID NO: 46129 - DNA, 35 bp, Artificial Sequence
  Synthetic oligonucleotide
agtgcaactgccatccccctttaaagcattcaaca

SEQ ID NO: 46130 - DNA, 35 bp, Artificial Sequence
  Synthetic oligonucleotide
ttctctctcatgcctcccgcgtgtcattacacaca

SEQ ID NO: 46131 - DNA, 36 bp, Artificial Sequence
  Synthetic oligonucleotide
attctcggtcgccgtatatctagttttttcctggca

SEQ ID NO: 46132 - DNA, 36 bp, Artificial Sequence
  Synthetic oligonucleotide
gatgtagcgcttacaagtttccccaggtctgtctca

SEQ ID NO: 46133 - DNA, 36 bp, Artificial Sequence
  Synthetic oligonucleotide
ttgatctccatcccctgaccgcaagactgttgcaga

SEQ ID NO: 46134 - DNA, 37 bp, Artificial Sequence
  Synthetic oligonucleotide
tgtggcctgccctgcacccttcttcttcccgagtaga

SEQ ID NO: 46135 - DNA, 37 bp, Artificial Sequence
  Synthetic oligonucleotide
atgcacagggctaacgacgggtgggtcgggctgacga

SEQ ID NO: 46136 - DNA, 37 bp, Artificial Sequence
  Synthetic oligonucleotide
ggagtcccggagtagaacgaaggcaagcgggaacgga

SEQ ID NO: 46137 - DNA, 37 bp, Artificial Sequence
  Synthetic oligonucleotide
tggaggaggaacgggaacaggtaagacactggacgga

SEQ ID NO: 46138 - DNA, 37 bp, Artificial Sequence
  Synthetic oligonucleotide
gaggcgccccccgaatgcttgtctgcccgatcctgga

SEQ ID NO: 46139 - DNA, 37 bp, Artificial Sequence
  Synthetic oligonucleotide
gcctatgcctcactatctcatcgcgtaccgcggtgga

SEQ ID NO: 46140 - DNA, 37 bp, Artificial Sequence
  Synthetic oligonucleotide
acacccctggccgatcactgctcatacgcaaagctga

SEQ ID NO: 46141 - DNA, 38 bp, Artificial Sequence
  Synthetic oligonucleotide
gttggggggggtggtagtaacccgtgaggtaatgctga

SEQ ID NO: 46142 - DNA, 38 bp, Artificial Sequence
  Synthetic oligonucleotide
accccagtcccttgcaaaccataagctgccatatctga

SEQ ID NO: 46143 - DNA, 38 bp, Artificial Sequence
  Synthetic oligonucleotide
tagacagtcctccatccagtgtctcgtacgttatctga

SEQ ID NO: 46144 - DNA, 37 bp, Artificial Sequence
  Synthetic oligonucleotide
gaacgggctgcagtcttcttattagttgccccattga

SEQ ID NO: 46145 - DNA, 37 bp, Artificial Sequence
  Synthetic oligonucleotide
aggtccccctgtgctgctttgggttccatctacttga

SEQ ID NO: 46146 - DNA, 37 bp, Artificial Sequence
  Synthetic oligonucleotide
acagatcccgctcacaatctatcgacactcataccta

SEQ ID NO: 46147 - DNA, 35 bp, Artificial Sequence
  Synthetic oligonucleotide
atcccacctcatgtccacacggtatcacctacgta

SEQ ID NO: 46148 - DNA, 36 bp, Artificial Sequence
  Synthetic oligonucleotide
acctgttggcgtgttgattctcctgcccaccattta

SEQ ID NO: 46149 - DNA, 36 bp, Artificial Sequence
  Synthetic oligonucleotide
aatcgcccacctttccactaagtgccacttggttta

SEQ ID NO: 46150 - DNA, 35 bp, Artificial Sequence
  Synthetic oligonucleotide
tacgaacaaccactacgcacaatcgcgatgcgaac

SEQ ID NO: 46151 - DNA, 35 bp, Artificial Sequence
  Synthetic oligonucleotide
ggacggtgcccctgtcgatccgcaagtcccaaacc

SEQ ID NO: 46152 - DNA, 35 bp, Artificial Sequence
  Synthetic oligonucleotide
ttcaagggtgaggaaaccgaagggaaagacgagcc

SEQ ID NO: 46153 - DNA, 35 bp, Artificial Sequence
  Synthetic oligonucleotide
tgcgaacccgcatttaagcacggaaaactgcctgc

SEQ ID NO: 46154 - DNA, 35 bp, Artificial Sequence
  Synthetic oligonucleotide
acgtgaacctacggacactatcttcttcgactctc

SEQ ID NO: 46155 - DNA, 35 bp, Artificial Sequence
  Synthetic oligonucleotide
tgcctgccatcccgatcgtagctaccttacggttc

SEQ ID NO: 46156 - DNA, 36 bp, Artificial Sequence
  Synthetic oligonucleotide
ttgcaaagtgggtaaggcactggcgttggagtgggg

SEQ ID NO: 46157 - DNA, 35 bp, Artificial Sequence
  Synthetic oligonucleotide
gtcagtatgagaggaggaacatggagggggacgtg

SEQ ID NO: 46158 - DNA, 35 bp, Artificial Sequence
  Synthetic oligonucleotide
gcgtattcccgcgcttacattgaacccaagatcct

SEQ ID NO: 46159 - DNA, 35 bp, Artificial Sequence
  Synthetic oligonucleotide
tgctctccctctgctgttccctgggatcacctgct

SEQ ID NO: 46160 - DNA, 35 bp, Artificial Sequence
  Synthetic oligonucleotide
gcgagggccatatcagctcgtcttcacgcattgct

SEQ ID NO: 46161 - DNA, 35 bp, Artificial Sequence
  Synthetic oligonucleotide
tagcaacgcggtcactcccgtctggacaccattct

SEQ ID NO: 46162 - DNA, 35 bp, Artificial Sequence
  Synthetic oligonucleotide
atcccgaagaccttcctggtgcctacttactcatt

SEQ ID NO: 46163 - DNA, 35 bp, Artificial Sequence
  Synthetic oligonucleotide
tacgcacgggcgacccattctagaattcacatctt

SEQ ID NO: 46164 - DNA, 35 bp, Artificial Sequence
  Synthetic oligonucleotide
gccccgtgcgggattttctctggcttcctttggtt

SEQ ID NO: 46165 - DNA, 35 bp, Artificial Sequence
  Synthetic oligonucleotide
tgatacccaccccgttacccattggttaacagttt

SEQ ID NO: 46166 - DNA, 36 bp, Artificial Sequence
  Synthetic oligonucleotide
gcacagcaaggccacagcgctcctcgttccgcccaa

SEQ ID NO: 46167 - DNA, 36 bp, Artificial Sequence
  Synthetic oligonucleotide
gacatcaccagtccacatggtactcgtgcctcctaa

SEQ ID NO: 46168 - DNA, 36 bp, Artificial Sequence
  Synthetic oligonucleotide
gacgggcgaagaggacaaggaaaggggctacagtaa

SEQ ID NO: 46169 - DNA, 36 bp, Artificial Sequence
  Synthetic oligonucleotide
atccacttgcagaacgtatcctcaggaccgactaca

SEQ ID NO: 46170 - DNA, 35 bp, Artificial Sequence
  Synthetic oligonucleotide
agccccgacctgatcttacgtaacgcgtttaccca

SEQ ID NO: 46171 - DNA, 36 bp, Artificial Sequence
  Synthetic oligonucleotide
gcatgccatcgcccatatgcgcgttcattcaatcca

SEQ ID NO: 46172 - DNA, 36 bp, Artificial Sequence
  Synthetic oligonucleotide
tagttcaacacctattgggcatctgcacaccatcca

SEQ ID NO: 46173 - DNA, 35 bp, Artificial Sequence
  Synthetic oligonucleotide
taggtaccccacgctataaccacttagcctaagca

SEQ ID NO: 46174 - DNA, 37 bp, Artificial Sequence
  Synthetic oligonucleotide
gctgcaaaatgggtggtgttgggggggtcaaggaaga

SEQ ID NO: 46175 - DNA, 37 bp, Artificial Sequence
  Synthetic oligonucleotide
tcgaaatgaagggagggagagcggtaacgccaggaga

SEQ ID NO: 46176 - DNA, 36 bp, Artificial Sequence
  Synthetic oligonucleotide
tagccacggtccacacctaacagactgcgagaacga

SEQ ID NO: 46177 - DNA, 36 bp, Artificial Sequence
  Synthetic oligonucleotide
actgacatgcgcgttgcttactggaaacgtacccga

SEQ ID NO: 46178 - DNA, 37 bp, Artificial Sequence
  Synthetic oligonucleotide
tacatggggagccattgcatcgtgggatagtgttcga

SEQ ID NO: 46179 - DNA, 37 bp, Artificial Sequence
  Synthetic oligonucleotide
gaacacaaccacgtacaaccaacttgtcctcttagga

SEQ ID NO: 46180 - DNA, 36 bp, Artificial Sequence
  Synthetic oligonucleotide
tactctgggggggtgggagttgggggtaggtacgga

SEQ ID NO: 46181 - DNA, 35 bp, Artificial Sequence
  Synthetic oligonucleotide
agcgatagaccagggaagggttaagcgcgggggga

SEQ ID NO: 46182 - DNA, 37 bp, Artificial Sequence
  Synthetic oligonucleotide
gcgccatgagcaggggagggcgaggaaaggagtggga

SEQ ID NO: 46183 - DNA, 38 bp, Artificial Sequence
  Synthetic oligonucleotide
gtgctgtgcacccggtcgccttgtcttttagcctctga

SEQ ID NO: 46184 - DNA, 38 bp, Artificial Sequence
  Synthetic oligonucleotide
gcccggttccgacccatgccccaatactctcgccgtga

SEQ ID NO: 46185 - DNA, 37 bp, Artificial Sequence
  Synthetic oligonucleotide
taccgggcccgctctctcccgtcctcagtccatgtga

SEQ ID NO: 46186 - DNA, 38 bp, Artificial Sequence
  Synthetic oligonucleotide
atcgccaaccctgtgcgacctatttgagtttcttgtga

SEQ ID NO: 46187 - DNA, 38 bp, Artificial Sequence
  Synthetic oligonucleotide
agtgcgacgaaaaccgtaacactcacaatcttgcttga

SEQ ID NO: 46188 - DNA, 38 bp, Artificial Sequence
  Synthetic oligonucleotide
aagaccccactatgcccaccacaaccgctgcacgttga

SEQ ID NO: 46189 - DNA, 38 bp, Artificial Sequence
  Synthetic oligonucleotide
gccgtccgcccgccccagttaaggattcttttttttga

SEQ ID NO: 46190 - DNA, 35 bp, Artificial Sequence
  Synthetic oligonucleotide
gttcaatcccatcgatccggctttgcattccctta

SEQ ID NO: 46191 - DNA, 35 bp, Artificial Sequence
  Synthetic oligonucleotide
tacgagtgggacagcagggacggcaacagaaagac

SEQ ID NO: 46192 - DNA, 35 bp, Artificial Sequence
  Synthetic oligonucleotide
gtcctatctagtcgggcgctggacacgcctcttac

SEQ ID NO: 46193 - DNA, 35 bp, Artificial Sequence
  Synthetic oligonucleotide
atggtcacctttctgccggagcataaactgtctcc

SEQ ID NO: 46194 - DNA, 35 bp, Artificial Sequence
  Synthetic oligonucleotide
ttttgccggaccaggctcttcaggcacactatctc

SEQ ID NO: 46195 - DNA, 35 bp, Artificial Sequence
  Synthetic oligonucleotide
tctacgcaggcgtttctcgttattcaagtctgttc

SEQ ID NO: 46196 - DNA, 35 bp, Artificial Sequence
  Synthetic oligonucleotide
attccactggcccacgactggactgacccgtgtcg

SEQ ID NO: 46197 - DNA, 33 bp, Artificial Sequence
  Synthetic oligonucleotide
gatgcctcgccgtacctgggcccgattttaatg

SEQ ID NO: 46198 - DNA, 35 bp, Artificial Sequence
  Synthetic oligonucleotide
gaagcctacggagggagtggtcgaaaattgcgatg

SEQ ID NO: 46199 - DNA, 35 bp, Artificial Sequence
  Synthetic oligonucleotide
tagtacccatcgaggcctttcccctattggaagct

SEQ ID NO: 46200 - DNA, 35 bp, Artificial Sequence
  Synthetic oligonucleotide
tgttcggtcgggcttcacagccaatcaaactctct

SEQ ID NO: 46201 - DNA, 35 bp, Artificial Sequence
  Synthetic oligonucleotide
gatccgtgcgcacctttcgcagctagaccttgtgt

SEQ ID NO: 46202 - DNA, 35 bp, Artificial Sequence
  Synthetic oligonucleotide
gatgtccaccatcggcggtttccaggggccccctt

SEQ ID NO: 46203 - DNA, 35 bp, Artificial Sequence
  Synthetic oligonucleotide
tctaaccaccggcctgggcacatggtctctttcaa

SEQ ID NO: 46204 - DNA, 35 bp, Artificial Sequence
  Synthetic oligonucleotide
tgcgtacacttccgcgctgcccgttctgctacgaa

SEQ ID NO: 46205 - DNA, 36 bp, Artificial Sequence
  Synthetic oligonucleotide
ggatgtggcgggtggcggggaggttggagctgcgaa

SEQ ID NO: 46206 - DNA, 36 bp, Artificial Sequence
  Synthetic oligonucleotide
tcgacaccccccgcattgcatcctaagtcgtttgaa

SEQ ID NO: 46207 - DNA, 36 bp, Artificial Sequence
  Synthetic oligonucleotide
gacctgccacgtatctgtattaactatgatctgcca

SEQ ID NO: 46208 - DNA, 36 bp, Artificial Sequence
  Synthetic oligonucleotide
tgtgaccggacccatccttgcctatgtttttccgca

SEQ ID NO: 46209 - DNA, 36 bp, Artificial Sequence
  Synthetic oligonucleotide
gatccaattgacgcccgacaccgcccgccaccacga

SEQ ID NO: 46210 - DNA, 37 bp, Artificial Sequence
  Synthetic oligonucleotide
ggacacagtagtcgaacacttcacctatgcctcccga

SEQ ID NO: 46211 - DNA, 37 bp, Artificial Sequence
  Synthetic oligonucleotide
actagcacctcaccttatgcatccggaaatctcgcga

SEQ ID NO: 46212 - DNA, 37 bp, Artificial Sequence
  Synthetic oligonucleotide
gggggagcttatcatggtggagggcgcaggtagggga

SEQ ID NO: 46213 - DNA, 35 bp, Artificial Sequence
  Synthetic oligonucleotide
ataggaagggtaggttggcttttaggtttagggga

SEQ ID NO: 46214 - DNA, 37 bp, Artificial Sequence
  Synthetic oligonucleotide
gggtgaagggaggctagaaggctgacgggtggtggga

SEQ ID NO: 46215 - DNA, 37 bp, Artificial Sequence
  Synthetic oligonucleotide
agcgaacgcaaggagaaggcaaagcgatgcgagatga

SEQ ID NO: 46216 - DNA, 37 bp, Artificial Sequence
  Synthetic oligonucleotide
ggtccccccagctgccataggcttccctttctactga

SEQ ID NO: 46217 - DNA, 37 bp, Artificial Sequence
  Synthetic oligonucleotide
agtaactgccactgctcgctggccctaacccacctga

SEQ ID NO: 46218 - DNA, 38 bp, Artificial Sequence
  Synthetic oligonucleotide
gccgagggcccttggtcgttatactatttgctccctga

SEQ ID NO: 46219 - DNA, 37 bp, Artificial Sequence
  Synthetic oligonucleotide
ggaacccgccccgctcgcactttgccgactccgctga

SEQ ID NO: 46220 - DNA, 38 bp, Artificial Sequence
  Synthetic oligonucleotide
tcatagcgtaacgggagggggccgaggaacaatgctga

SEQ ID NO: 46221 - DNA, 37 bp, Artificial Sequence
  Synthetic oligonucleotide
gacagggtggtggcgtacgtagatgaggtggatgtga

SEQ ID NO: 46222 - DNA, 38 bp, Artificial Sequence
  Synthetic oligonucleotide
gttggggactgtggggggataggggcacgtgcgattga

SEQ ID NO: 46223 - DNA, 38 bp, Artificial Sequence
  Synthetic oligonucleotide
gttcggagccgctatcctcgtccgttcaagtcacttga

SEQ ID NO: 46224 - DNA, 38 bp, Artificial Sequence
  Synthetic oligonucleotide
acctggacctccgtgggatatttacaccctcctcttga

SEQ ID NO: 46225 - DNA, 36 bp, Artificial Sequence
  Synthetic oligonucleotide
tatgaccccatgcgtgttccgttataacctttttga

SEQ ID NO: 46226 - DNA, 35 bp, Artificial Sequence
  Synthetic oligonucleotide
acctccatagaggtcccatcccacctctcactata

SEQ ID NO: 46227 - DNA, 35 bp, Artificial Sequence
  Synthetic oligonucleotide
gtggggccgggcgaggacgggacgatagctactta

SEQ ID NO: 46228 - DNA, 36 bp, Artificial Sequence
  Synthetic oligonucleotide
tccgcgcgttaccatacacttgcacctgctctctta

SEQ ID NO: 46229 - DNA, 35 bp, Artificial Sequence
  Synthetic oligonucleotide
tccgacgacgccctctccccgcatatgtcaagtta

SEQ ID NO: 46230 - DNA, 35 bp, Artificial Sequence
  Synthetic oligonucleotide
tcccctcctttcagatctcactggaactcgcaaac

SEQ ID NO: 46231 - DNA, 35 bp, Artificial Sequence
  Synthetic oligonucleotide
tgtaagcacttttccacccacccagcgcatcacac

SEQ ID NO: 46232 - DNA, 35 bp, Artificial Sequence
  Synthetic oligonucleotide
tgtccatggtcgttctctggccattgccctgtacc

SEQ ID NO: 46233 - DNA, 35 bp, Artificial Sequence
  Synthetic oligonucleotide
tctcgagccaggtcgttctgttttgctttttatcc

SEQ ID NO: 46234 - DNA, 35 bp, Artificial Sequence
  Synthetic oligonucleotide
tcctgcaccatcaccgtgatattgttgctagtttc

SEQ ID NO: 46235 - DNA, 35 bp, Artificial Sequence
  Synthetic oligonucleotide
tgaccatccagccccccccttacacgtgaactgcg

SEQ ID NO: 46236 - DNA, 35 bp, Artificial Sequence
  Synthetic oligonucleotide
aacagggaggaattggctcggtgaaaggggagggg

SEQ ID NO: 46237 - DNA, 35 bp, Artificial Sequence
  Synthetic oligonucleotide
gttccaccaacaggtcacctcgatctatcctcgat

SEQ ID NO: 46238 - DNA, 35 bp, Artificial Sequence
  Synthetic oligonucleotide
gttgcctttccaccgccattcattccatcgcgtat

SEQ ID NO: 46239 - DNA, 35 bp, Artificial Sequence
  Synthetic oligonucleotide
ttagaccgaacactctcatccgagcacaatggcct

SEQ ID NO: 46240 - DNA, 35 bp, Artificial Sequence
  Synthetic oligonucleotide
atttacatccgcctccgctcgcaaaccacgtgtct

SEQ ID NO: 46241 - DNA, 35 bp, Artificial Sequence
  Synthetic oligonucleotide
tcaatgctcatgcagctttcacgacggttttttct

SEQ ID NO: 46242 - DNA, 35 bp, Artificial Sequence
  Synthetic oligonucleotide
ttgatgcacggcttggtacggtgcctcaattcctt

SEQ ID NO: 46243 - DNA, 36 bp, Artificial Sequence
  Synthetic oligonucleotide
tgtacccgcctagaactgcatgcatcctggtttaaa

SEQ ID NO: 46244 - DNA, 35 bp, Artificial Sequence
  Synthetic oligonucleotide
acctcacactccgtctctttcggctgaactcctca

SEQ ID NO: 46245 - DNA, 36 bp, Artificial Sequence
  Synthetic oligonucleotide
tcatcacttgcttttttcccgtgctgtgttttctca

SEQ ID NO: 46246 - DNA, 35 bp, Artificial Sequence
  Synthetic oligonucleotide
gaccaacagtccacaccacaagcctggcatattca

SEQ ID NO: 46247 - DNA, 37 bp, Artificial Sequence
  Synthetic oligonucleotide
atgtggaagaggggagaagcaaaagtgaggtagtaga

SEQ ID NO: 46248 - DNA, 37 bp, Artificial Sequence
  Synthetic oligonucleotide
tgcaaaacggaaagggaacagcgtaatctcaggtaga

SEQ ID NO: 46249 - DNA, 37 bp, Artificial Sequence
  Synthetic oligonucleotide
tgccaagcccgcctacttcaaagttaaccagccacga

SEQ ID NO: 46250 - DNA, 37 bp, Artificial Sequence
  Synthetic oligonucleotide
taccaccgccgaatgggcgcgatatctgatctaccga

SEQ ID NO: 46251 - DNA, 37 bp, Artificial Sequence
  Synthetic oligonucleotide
agacacccgccatagccggaattacactggctcccga

SEQ ID NO: 46252 - DNA, 36 bp, Artificial Sequence
  Synthetic oligonucleotide
agtacgtggggcgggtaactgaaattgaatgctcga

SEQ ID NO: 46253 - DNA, 36 bp, Artificial Sequence
  Synthetic oligonucleotide
gatggcggcgaacaggtcggcggggaaggggaagga

SEQ ID NO: 46254 - DNA, 37 bp, Artificial Sequence
  Synthetic oligonucleotide
tagggagggcaataagggggggcgttccaccggagga

SEQ ID NO: 46255 - DNA, 37 bp, Artificial Sequence
  Synthetic oligonucleotide
tccacctcaaacttccgcacgcgtctctacctgggga

SEQ ID NO: 46256 - DNA, 38 bp, Artificial Sequence
  Synthetic oligonucleotide
tgaaccaccgccagtcagctcgcaactccccccactga

SEQ ID NO: 46257 - DNA, 38 bp, Artificial Sequence
  Synthetic oligonucleotide
gtaacccccgatgggccaactgcctcgcttcatactga

SEQ ID NO: 46258 - DNA, 38 bp, Artificial Sequence
  Synthetic oligonucleotide
agccgaccccccgtgccgatctcacaatgacttgctga

SEQ ID NO: 46259 - DNA, 38 bp, Artificial Sequence
  Synthetic oligonucleotide
tagacgccccgcctcatgttctggcatgttgaccgtga

SEQ ID NO: 46260 - DNA, 38 bp, Artificial Sequence
  Synthetic oligonucleotide
gaaggtcgagaatagggagcggtgggggagtttcgtga

SEQ ID NO: 46261 - DNA, 37 bp, Artificial Sequence
  Synthetic oligonucleotide
tctgcgcgcatcctgtaatacccctatcgttttgtga

SEQ ID NO: 46262 - DNA, 38 bp, Artificial Sequence
  Synthetic oligonucleotide
gccgccccggcccactttttccgaaccgactacgttga

SEQ ID NO: 46263 - DNA, 38 bp, Artificial Sequence
  Synthetic oligonucleotide
tccgaaggggcgggtgaaaaattgcggttggaggttga

SEQ ID NO: 46264 - DNA, 38 bp, Artificial Sequence
  Synthetic oligonucleotide
actcacgcacccggtgccatcctacgccctgtctttga

SEQ ID NO: 46265 - DNA, 38 bp, Artificial Sequence
  Synthetic oligonucleotide
gccacattacggcgcccaccgttccaacacagttttga

SEQ ID NO: 46266 - DNA, 35 bp, Artificial Sequence
  Synthetic oligonucleotide
gaatgtcgacgcccttattacagcctcacagtcta

SEQ ID NO: 46267 - DNA, 36 bp, Artificial Sequence
  Synthetic oligonucleotide
gccactactggccggcacgtgccctgtctttttgta

SEQ ID NO: 46268 - DNA, 35 bp, Artificial Sequence
  Synthetic oligonucleotide
accagcgcacgccgtcgcagcttattaaacgctta

SEQ ID NO: 46269 - DNA, 35 bp, Artificial Sequence
  Synthetic oligonucleotide
acgcccccgacatgtctcctgtcagatcccctaac

SEQ ID NO: 46270 - DNA, 35 bp, Artificial Sequence
  Synthetic oligonucleotide
aatgtcgcatcaccgtttctctctcgcaaatttac

SEQ ID NO: 46271 - DNA, 35 bp, Artificial Sequence
  Synthetic oligonucleotide
gccttacgcgacgatatcatacaccgtcacactcc

SEQ ID NO: 46272 - DNA, 35 bp, Artificial Sequence
  Synthetic oligonucleotide
ttgcccccaggtaatccgcacatctcatccacggc

SEQ ID NO: 46273 - DNA, 35 bp, Artificial Sequence
  Synthetic oligonucleotide
ttgcccgctcccaccacttttggctgcggcccctc

SEQ ID NO: 46274 - DNA, 35 bp, Artificial Sequence
  Synthetic oligonucleotide
tggacaaccccatcgatctatttacgccatgattc

SEQ ID NO: 46275 - DNA, 35 bp, Artificial Sequence
  Synthetic oligonucleotide
gtactaagcgtaggtctaggggctggggggggtag

SEQ ID NO: 46276 - DNA, 35 bp, Artificial Sequence
  Synthetic oligonucleotide
taccagaccgttttagcttcccataacacaccacg

SEQ ID NO: 46277 - DNA, 35 bp, Artificial Sequence
  Synthetic oligonucleotide
agtagaggaggaaggaggatagtgggcatttaatg

SEQ ID NO: 46278 - DNA, 35 bp, Artificial Sequence
  Synthetic oligonucleotide
tcacgactccaagctcactggaaacccgcttacat

SEQ ID NO: 46279 - DNA, 36 bp, Artificial Sequence
  Synthetic oligonucleotide
tgaacgctaccctccggtctgttaatctactcattt

SEQ ID NO: 46280 - DNA, 35 bp, Artificial Sequence
  Synthetic oligonucleotide
aactacccacatgcgccatacctgatcaccttaaa

SEQ ID NO: 46281 - DNA, 36 bp, Artificial Sequence
  Synthetic oligonucleotide
gcactcagcaaagagtaaactgctgagtaattaaca

SEQ ID NO: 46282 - DNA, 35 bp, Artificial Sequence
  Synthetic oligonucleotide
acacaccgctccattgtccctctcctgccggggca

SEQ ID NO: 46283 - DNA, 36 bp, Artificial Sequence
  Synthetic oligonucleotide
tgcaacacctatgtcacacactccgatgattgggca

SEQ ID NO: 46284 - DNA, 36 bp, Artificial Sequence
  Synthetic oligonucleotide
acttcgtgccattccacaattgtaaaaattacctca

SEQ ID NO: 46285 - DNA, 37 bp, Artificial Sequence
  Synthetic oligonucleotide
tatgccacccacacatgacgactacggctgttcaaga

SEQ ID NO: 46286 - DNA, 37 bp, Artificial Sequence
  Synthetic oligonucleotide
atctgtcctcctgtcaccttgctcctttcgttggaga

SEQ ID NO: 46287 - DNA, 31 bp, Artificial Sequence
  Synthetic oligonucleotide
ggaacgcttctggcacacacccgatcctaga

SEQ ID NO: 46288 - DNA, 37 bp, Artificial Sequence
  Synthetic oligonucleotide
ggaccaccgcatccgcttcacctctgtccgcattcga

SEQ ID NO: 46289 - DNA, 37 bp, Artificial Sequence
  Synthetic oligonucleotide
gcaaggccgtgataggggcagggcgggcaagtaggga

SEQ ID NO: 46290 - DNA, 36 bp, Artificial Sequence
  Synthetic oligonucleotide
gtgggtcacatggagaggagacagggtgggcgggga

SEQ ID NO: 46291 - DNA, 37 bp, Artificial Sequence
  Synthetic oligonucleotide
tatgggggatccaggtggcggggcatggaaggatgga

SEQ ID NO: 46292 - DNA, 37 bp, Artificial Sequence
  Synthetic oligonucleotide
gaatacagtgggtgtggtgacctagtgggaggatgga

SEQ ID NO: 46293 - DNA, 37 bp, Artificial Sequence
  Synthetic oligonucleotide
gcctgtgacaccatctaccacccgagctactgtatga

SEQ ID NO: 46294 - DNA, 38 bp, Artificial Sequence
  Synthetic oligonucleotide
atgcccgcactcccttatcagcactctacggcacctga

SEQ ID NO: 46295 - DNA, 38 bp, Artificial Sequence
  Synthetic oligonucleotide
agccaagcaaatgttcccagcctagccgctacccctga

SEQ ID NO: 46296 - DNA, 37 bp, Artificial Sequence
  Synthetic oligonucleotide
gccgtcgcagttctttgacacctcgcaccctgcctga

SEQ ID NO: 46297 - DNA, 38 bp, Artificial Sequence
  Synthetic oligonucleotide
agccacgaaggctacgtatgtttgaagctagaagctga

SEQ ID NO: 46298 - DNA, 38 bp, Artificial Sequence
  Synthetic oligonucleotide
gcaaactacgcatgccctcataccatccacgaacgtga

SEQ ID NO: 46299 - DNA, 38 bp, Artificial Sequence
  Synthetic oligonucleotide
taggggggaggacggagagggtacggtgggctccgtga

SEQ ID NO: 46300 - DNA, 38 bp, Artificial Sequence
  Synthetic oligonucleotide
gagagtggcaggacgatttttttctcttggcttggtga

SEQ ID NO: 46301 - DNA, 38 bp, Artificial Sequence
  Synthetic oligonucleotide
tgcctccacgcctcgctctttgctataacatacgttga

SEQ ID NO: 46302 - DNA, 38 bp, Artificial Sequence
  Synthetic oligonucleotide
aagacccctcatgagcatactgcgccccgaatctttga

SEQ ID NO: 46303 - DNA, 38 bp, Artificial Sequence
  Synthetic oligonucleotide
tgatcacctttgccctcaggagccatccatccttttga

SEQ ID NO: 46304 - DNA, 36 bp, Artificial Sequence
  Synthetic oligonucleotide
gacggggggaccgggcggaatcttcatacactacta

SEQ ID NO: 46305 - DNA, 35 bp, Artificial Sequence
  Synthetic oligonucleotide
cttgactcccggatcgtacaactaacacgcaccta

SEQ ID NO: 46306 - DNA, 36 bp, Artificial Sequence
  Synthetic oligonucleotide
agccctgccccggaccctagtcgtgcgctcccatta

SEQ ID NO: 46307 - DNA, 35 bp, Artificial Sequence
  Synthetic oligonucleotide
taacttccgccccttcggtctttgggtgcctgcac

SEQ ID NO: 46308 - DNA, 35 bp, Artificial Sequence
  Synthetic oligonucleotide
gttgttgcaacgaatcgttttttttgacatcaccc

SEQ ID NO: 46309 - DNA, 35 bp, Artificial Sequence
  Synthetic oligonucleotide
atgcggctaactcactggaatttcgactcatggcc

SEQ ID NO: 46310 - DNA, 35 bp, Artificial Sequence
  Synthetic oligonucleotide
gaacacgtgcgcggacggtcctactccttcaacgc

SEQ ID NO: 46311 - DNA, 35 bp, Artificial Sequence
  Synthetic oligonucleotide
agtaacacactgcctcgactagcacgccgtatcgc

SEQ ID NO: 46312 - DNA, 35 bp, Artificial Sequence
  Synthetic oligonucleotide
gacatcatgttttggcccaacctccttaattcgag

SEQ ID NO: 46313 - DNA, 34 bp, Artificial Sequence
  Synthetic oligonucleotide
gacgccctacacccgcatatgcccacctataacg

SEQ ID NO: 46314 - DNA, 35 bp, Artificial Sequence
  Synthetic oligonucleotide
tcctgccgggctccacgcaaaccctatacaccccg

SEQ ID NO: 46315 - DNA, 35 bp, Artificial Sequence
  Synthetic oligonucleotide
acccccatatcagcgactccttcatgtctttctgg

SEQ ID NO: 46316 - DNA, 35 bp, Artificial Sequence
  Synthetic oligonucleotide
tcactacgcctgagttctaccttggccttgccaat

SEQ ID NO: 46317 - DNA, 35 bp, Artificial Sequence
  Synthetic oligonucleotide
gacctcacactgcttgaaatcttgctcttcttgat

SEQ ID NO: 46318 - DNA, 35 bp, Artificial Sequence
  Synthetic oligonucleotide
tccatacgatgtggacaccgcgcacaacatcccct

SEQ ID NO: 46319 - DNA, 35 bp, Artificial Sequence
  Synthetic oligonucleotide
attcccgctcctttgtgtggcacactagtctccct

SEQ ID NO: 46320 - DNA, 35 bp, Artificial Sequence
  Synthetic oligonucleotide
acgtggccactacgaccctggttacttttctatct

SEQ ID NO: 46321 - DNA, 35 bp, Artificial Sequence
  Synthetic oligonucleotide
ggatcggtgcgcgtacccttccttgttgctcgtct

SEQ ID NO: 46322 - DNA, 35 bp, Artificial Sequence
  Synthetic oligonucleotide
acacccctcccgctgcactcgagctaacctagttt

SEQ ID NO: 46323 - DNA, 35 bp, Artificial Sequence
  Synthetic oligonucleotide
tcaacccactcccgccttgcatgctagctgttaaa

SEQ ID NO: 46324 - DNA, 35 bp, Artificial Sequence
  Synthetic oligonucleotide
gatctgttaacccacccttgccctcgaagtgacca

SEQ ID NO: 46325 - DNA, 36 bp, Artificial Sequence
  Synthetic oligonucleotide
atgcgcccgcgcgatcatgccgtcaccgaactgcca

SEQ ID NO: 46326 - DNA, 35 bp, Artificial Sequence
  Synthetic oligonucleotide
taccgaatcgtccaccttgtatcgcctcccggtca

SEQ ID NO: 46327 - DNA, 35 bp, Artificial Sequence
  Synthetic oligonucleotide
gccagtacacgctatgggagcccacatttccttca

SEQ ID NO: 46328 - DNA, 37 bp, Artificial Sequence
  Synthetic oligonucleotide
tgaatgggggggagggcatccgggctcttaaactaga

SEQ ID NO: 46329 - DNA, 37 bp, Artificial Sequence
  Synthetic oligonucleotide
tcccaccccatacgggcttcacccccccgtataacga

SEQ ID NO: 46330 - DNA, 37 bp, Artificial Sequence
  Synthetic oligonucleotide
aagacgcgccctaccctcacatgtcccataccatcga

SEQ ID NO: 46331 - DNA, 37 bp, Artificial Sequence
  Synthetic oligonucleotide
gcgtgctgctgcctccacgtatcctgcgctccatcga

SEQ ID NO: 46332 - DNA, 36 bp, Artificial Sequence
  Synthetic oligonucleotide
ttggagactacaggggacacgggactagggacggga

SEQ ID NO: 46333 - DNA, 37 bp, Artificial Sequence
  Synthetic oligonucleotide
gccgggtggctcgggcggggcgggaaagcttggggga

SEQ ID NO: 46334 - DNA, 37 bp, Artificial Sequence
  Synthetic oligonucleotide
tatctccgacattgcttgccccgacacaccactggga

SEQ ID NO: 46335 - DNA, 38 bp, Artificial Sequence
  Synthetic oligonucleotide
taccccgggagccttctgagtctacctccccatcctga

SEQ ID NO: 46336 - DNA, 37 bp, Artificial Sequence
  Synthetic oligonucleotide
tcctgcccctgttatttcgcgtagtactgcctgctga

SEQ ID NO: 46337 - DNA, 36 bp, Artificial Sequence
  Synthetic oligonucleotide
tatgtcctcgactctgcgccatccccacttttctga

SEQ ID NO: 46338 - DNA, 37 bp, Artificial Sequence
  Synthetic oligonucleotide
tcgggatgaagggggtgctactaaggtgagggggtga

SEQ ID NO: 46339 - DNA, 37 bp, Artificial Sequence
  Synthetic oligonucleotide
accgccctcctcccgatggtggtgtctactttcttga

SEQ ID NO: 46340 - DNA, 37 bp, Artificial Sequence
  Synthetic oligonucleotide
tccttacatccgcttgtcgtagcccccccacagttga

SEQ ID NO: 46341 - DNA, 38 bp, Artificial Sequence
  Synthetic oligonucleotide
tgtgagacgtacaggtgcaggaagtggggttgggttga

SEQ ID NO: 46342 - DNA, 37 bp, Artificial Sequence
  Synthetic oligonucleotide
acgcccccccgctgaccgtacatgcattgttggttga

SEQ ID NO: 46343 - DNA, 38 bp, Artificial Sequence
  Synthetic oligonucleotide
tcaagctggcccccttgttatgtcctttatacgtttga

SEQ ID NO: 46344 - DNA, 38 bp, Artificial Sequence
  Synthetic oligonucleotide
ttgagaggcgggggtaatggggaaggactaaattttga

SEQ ID NO: 46345 - DNA, 38 bp, Artificial Sequence
  Synthetic oligonucleotide
tcaatctgcccggtgcgtgagctagttcccccttttga

SEQ ID NO: 46346 - DNA, 38 bp, Artificial Sequence
  Synthetic oligonucleotide
tactcgcccggctgttcactacggtgcggttcttttga

SEQ ID NO: 46347 - DNA, 35 bp, Artificial Sequence
  Synthetic oligonucleotide
tcatccggtaccgaaaatctagttgcaattcccac

SEQ ID NO: 46348 - DNA, 35 bp, Artificial Sequence
  Synthetic oligonucleotide
tgctacatcgcgccgccctccttttgagctggtac

SEQ ID NO: 46349 - DNA, 35 bp, Artificial Sequence
  Synthetic oligonucleotide
gacgcactcagttacgcccacgttcgttaaaaccc

SEQ ID NO: 46350 - DNA, 35 bp, Artificial Sequence
  Synthetic oligonucleotide
gttgcacaactcctgttctgtattgtctcgttccc

SEQ ID NO: 46351 - DNA, 35 bp, Artificial Sequence
  Synthetic oligonucleotide
gcatacgacgcgccttgaccgtgatgttcttgtcc

SEQ ID NO: 46352 - DNA, 35 bp, Artificial Sequence
  Synthetic oligonucleotide
gcacaatacactgtcttaccgtccctggttaaatc

SEQ ID NO: 46353 - DNA, 35 bp, Artificial Sequence
  Synthetic oligonucleotide
tgcacgggcccggaaactcatatagtacgtccatc

SEQ ID NO: 46354 - DNA, 35 bp, Artificial Sequence
  Synthetic oligonucleotide
acgtgatctcgcattccatctatcagtgaattgtc

SEQ ID NO: 46355 - DNA, 35 bp, Artificial Sequence
  Synthetic oligonucleotide
gcctcccgtcgttatcgcacccgtttaagtttgag

SEQ ID NO: 46356 - DNA, 35 bp, Artificial Sequence
  Synthetic oligonucleotide
gcacgaacctcctagttttgtttccaccaccaggg

SEQ ID NO: 46357 - DNA, 35 bp, Artificial Sequence
  Synthetic oligonucleotide
agagggagatggagcgggagtaaggcttatggaat

SEQ ID NO: 46358 - DNA, 35 bp, Artificial Sequence
  Synthetic oligonucleotide
ctgagacggcctaagacagcatctatatcgcccct

SEQ ID NO: 46359 - DNA, 35 bp, Artificial Sequence
  Synthetic oligonucleotide
tccccggatagcacggttggcttccggtcccactt

SEQ ID NO: 46360 - DNA, 35 bp, Artificial Sequence
  Synthetic oligonucleotide
tcgtcccctacacgctgcgagctccacatcacctt

SEQ ID NO: 46361 - DNA, 35 bp, Artificial Sequence
  Synthetic oligonucleotide
tgacagcctcatttcctccgcctggctggtacctt

SEQ ID NO: 46362 - DNA, 34 bp, Artificial Sequence
  Synthetic oligonucleotide
gacccgggtatgccacgcttggaccgtgattttt

SEQ ID NO: 46363 - DNA, 36 bp, Artificial Sequence
  Synthetic oligonucleotide
gagggtcgacaggaggttagtgggtcggaggtaaaa

SEQ ID NO: 46364 - DNA, 36 bp, Artificial Sequence
  Synthetic oligonucleotide
aagacggcgggaagcatgaacggagatcggagggaa

SEQ ID NO: 46365 - DNA, 36 bp, Artificial Sequence
  Synthetic oligonucleotide
agccacccctccgctttgctatcgagcatcctaaca

SEQ ID NO: 46366 - DNA, 35 bp, Artificial Sequence
  Synthetic oligonucleotide
caactgcccaccacaatttcttgagtcccatccca

SEQ ID NO: 46367 - DNA, 36 bp, Artificial Sequence
  Synthetic oligonucleotide
atgccacccattggtttcagttacactctttctcca

SEQ ID NO: 46368 - DNA, 35 bp, Artificial Sequence
  Synthetic oligonucleotide
acccctcactacgcccggtatgtcgccaacaagca

SEQ ID NO: 46369 - DNA, 36 bp, Artificial Sequence
  Synthetic oligonucleotide
gtcgctgacccgccctaaccgtatcttcaagtgtca

SEQ ID NO: 46370 - DNA, 35 bp, Artificial Sequence
  Synthetic oligonucleotide
tacccacactgcagtgcttcttcgtctcctcttca

SEQ ID NO: 46371 - DNA, 36 bp, Artificial Sequence
  Synthetic oligonucleotide
atttcgtcctccgcagcctcccatcgttattgttca

SEQ ID NO: 46372 - DNA, 37 bp, Artificial Sequence
  Synthetic oligonucleotide
aaagagggacggtatgagggctaggagtaggctgaga

SEQ ID NO: 46373 - DNA, 37 bp, Artificial Sequence
  Synthetic oligonucleotide
gacaacttgttgtgctagtcgctgatccgacccccga

SEQ ID NO: 46374 - DNA, 37 bp, Artificial Sequence
  Synthetic oligonucleotide
tcaaccagtcgcgctaccgagcactcttatactccga

SEQ ID NO: 46375 - DNA, 37 bp, Artificial Sequence
  Synthetic oligonucleotide
taccattgacacttgttgtaccacctccgattacgga

SEQ ID NO: 46376 - DNA, 37 bp, Artificial Sequence
  Synthetic oligonucleotide
tacgcgtgtgagtgcaggggctacggcgggaggggga

SEQ ID NO: 46377 - DNA, 35 bp, Artificial Sequence
  Synthetic oligonucleotide
gtcaacttccatccccatttcgtatcagaccatga

SEQ ID NO: 46378 - DNA, 38 bp, Artificial Sequence
  Synthetic oligonucleotide
accacagaccatgccggctaaaaactgctccaacctga

SEQ ID NO: 46379 - DNA, 35 bp, Artificial Sequence
  Synthetic oligonucleotide
tacatgcagcccacgagtggcgttacttcacctga

SEQ ID NO: 46380 - DNA, 38 bp, Artificial Sequence
  Synthetic oligonucleotide
actttccagccctcccctgcgcacacaatccacgctga

SEQ ID NO: 46381 - DNA, 37 bp, Artificial Sequence
  Synthetic oligonucleotide
tatcccgctccttctcatgttatcctgcgtacgctga

SEQ ID NO: 46382 - DNA, 37 bp, Artificial Sequence
  Synthetic oligonucleotide
tgccctgcctttgcaatatccgtacacactgatctga

SEQ ID NO: 46383 - DNA, 36 bp, Artificial Sequence
  Synthetic oligonucleotide
gctggtggagggcaagtgagttggtagggtgtctga

SEQ ID NO: 46384 - DNA, 38 bp, Artificial Sequence
  Synthetic oligonucleotide
tatggatggaccaggagttgatggggatggatgggtga

SEQ ID NO: 46385 - DNA, 37 bp, Artificial Sequence
  Synthetic oligonucleotide
actacgcaatgctcctccctcaccctatgccatgtga

SEQ ID NO: 46386 - DNA, 37 bp, Artificial Sequence
  Synthetic oligonucleotide
acaacgccaccgtggtgccaatcgtgccgaaacttga

SEQ ID NO: 46387 - DNA, 38 bp, Artificial Sequence
  Synthetic oligonucleotide
aggacggccgaacgcggtcctacctctctccttcttga

SEQ ID NO: 46388 - DNA, 35 bp, Artificial Sequence
  Synthetic oligonucleotide
aacccatcgaagcccactcgtacggctcctatacc

SEQ ID NO: 46389 - DNA, 35 bp, Artificial Sequence
  Synthetic oligonucleotide
gaacccttgccgactcgcacataaacatgacttcc

SEQ ID NO: 46390 - DNA, 35 bp, Artificial Sequence
  Synthetic oligonucleotide
gtccaatgcctctaatgttttccataacctccgcg

SEQ ID NO: 46391 - DNA, 35 bp, Artificial Sequence
  Synthetic oligonucleotide
tgtcctccgtaacatcattagtcgtatttatgtcg

SEQ ID NO: 46392 - DNA, 35 bp, Artificial Sequence
  Synthetic oligonucleotide
gctgcacttctgtagttgtcctttctctcccttcg

SEQ ID NO: 46393 - DNA, 35 bp, Artificial Sequence
  Synthetic oligonucleotide
tgcaccgatcccctcacgtcgctttccagcctagg

SEQ ID NO: 46394 - DNA, 35 bp, Artificial Sequence
  Synthetic oligonucleotide
acagcattgccccacctcctgaactgacccatctg

SEQ ID NO: 46395 - DNA, 35 bp, Artificial Sequence
  Synthetic oligonucleotide
tgtcaccatccggccgttcgacgccccctactact

SEQ ID NO: 46396 - DNA, 35 bp, Artificial Sequence
  Synthetic oligonucleotide
gccacatcgaacggctcccactgaaagtatcccct

SEQ ID NO: 46397 - DNA, 35 bp, Artificial Sequence
  Synthetic oligonucleotide
accatgatgctcgcacggtgtgacctcgtgctttt

SEQ ID NO: 46398 - DNA, 36 bp, Artificial Sequence
  Synthetic oligonucleotide
ttcggtggtggggcggaacgagagggtggttcaaaa

SEQ ID NO: 46399 - DNA, 35 bp, Artificial Sequence
  Synthetic oligonucleotide
tttcagccgacgtaggcctctatcctgccacccaa

SEQ ID NO: 46400 - DNA, 36 bp, Artificial Sequence
  Synthetic oligonucleotide
gcacacgcaaacgagccgaccctgaacttgtacgaa

SEQ ID NO: 46401 - DNA, 36 bp, Artificial Sequence
  Synthetic oligonucleotide
tttggcaccccccccatcccggaagtcccgtagaca

SEQ ID NO: 46402 - DNA, 36 bp, Artificial Sequence
  Synthetic oligonucleotide
gacacgactccagagcaagacgcacgctacccccca

SEQ ID NO: 46403 - DNA, 35 bp, Artificial Sequence
  Synthetic oligonucleotide
acctacatcaacgggtcccctgcctcgctgcccca

SEQ ID NO: 46404 - DNA, 36 bp, Artificial Sequence
  Synthetic oligonucleotide
tttgtccagccccattccatctgtcctcatttccca

SEQ ID NO: 46405 - DNA, 35 bp, Artificial Sequence
  Synthetic oligonucleotide
tgaaatccagcccgtttcatctatgcttgcctcca

SEQ ID NO: 46406 - DNA, 36 bp, Artificial Sequence
  Synthetic oligonucleotide
tcaccacggcaatcttcttgggggcccttctcttca

SEQ ID NO: 46407 - DNA, 37 bp, Artificial Sequence
  Synthetic oligonucleotide
tcccccaccgcagaatcctccgcaactatattgcaga

SEQ ID NO: 46408 - DNA, 37 bp, Artificial Sequence
  Synthetic oligonucleotide
taccaaaccgggagaatggcggctcaagagagagaga

SEQ ID NO: 46409 - DNA, 37 bp, Artificial Sequence
  Synthetic oligonucleotide
gtccacctgcattcatgagcaaccatcccatcaacga

SEQ ID NO: 46410 - DNA, 36 bp, Artificial Sequence
  Synthetic oligonucleotide
gcccttcgccagtcttttatactcttcccgccacga

SEQ ID NO: 46411 - DNA, 37 bp, Artificial Sequence
  Synthetic oligonucleotide
gtgacaaggtcaccggcatccttgctaaccccccgga

SEQ ID NO: 46412 - DNA, 37 bp, Artificial Sequence
  Synthetic oligonucleotide
taacaccgctgcaggagggtagtgggtagaggaggga

SEQ ID NO: 46413 - DNA, 37 bp, Artificial Sequence
  Synthetic oligonucleotide
gagtgggggtggtcagcggtgtcgagggaggtgggga

SEQ ID NO: 46414 - DNA, 36 bp, Artificial Sequence
  Synthetic oligonucleotide
acacggaggtttgggacataggggtaggcttgggga

SEQ ID NO: 46415 - DNA, 38 bp, Artificial Sequence
  Synthetic oligonucleotide
actgtgcaagcagtacgtatcacgggtcatacacatga

SEQ ID NO: 46416 - DNA, 36 bp, Artificial Sequence
  Synthetic oligonucleotide
acgcggcccaactctggtagcctactattctgatga

SEQ ID NO: 46417 - DNA, 38 bp, Artificial Sequence
  Synthetic oligonucleotide
tcttgacgtcgccgccttttctgatgttcctttactga

SEQ ID NO: 46418 - DNA, 38 bp, Artificial Sequence
  Synthetic oligonucleotide
gtggcaacacacctctctgttacttgcgggccccctga

SEQ ID NO: 46419 - DNA, 38 bp, Artificial Sequence
  Synthetic oligonucleotide
gaccacatcccacgctcttctcggaaacatgacgctga

SEQ ID NO: 46420 - DNA, 38 bp, Artificial Sequence
  Synthetic oligonucleotide
atgacgggggtgggaaccgtggggactgacattgctga

SEQ ID NO: 46421 - DNA, 37 bp, Artificial Sequence
  Synthetic oligonucleotide
acgaagtgggtgggtgagagtggttatagtggggtga

SEQ ID NO: 46422 - DNA, 38 bp, Artificial Sequence
  Synthetic oligonucleotide
tgtttcatggccacactgtttttgtccctgccccttga

SEQ ID NO: 46423 - DNA, 38 bp, Artificial Sequence
  Synthetic oligonucleotide
gcctcatccagatgttcagctaccatcacttcccttga

SEQ ID NO: 46424 - DNA, 38 bp, Artificial Sequence
  Synthetic oligonucleotide
gcaccagtccgctgccattcgcctttccttaagtttga

SEQ ID NO: 46425 - DNA, 38 bp, Artificial Sequence
  Synthetic oligonucleotide
gtacgacgaacggagggctgaacgaatatggggtttga

SEQ ID NO: 46426 - DNA, 36 bp, Artificial Sequence
  Synthetic oligonucleotide
gcgacgaccgtgcactcgtttggttccatcttttga

SEQ ID NO: 46427 - DNA, 36 bp, Artificial Sequence
  Synthetic oligonucleotide
cacgacgcccccttgcttttagattgcgcctcccta

SEQ ID NO: 46428 - DNA, 35 bp, Artificial Sequence
  Synthetic oligonucleotide
tgaagcgccggtcactgcaaccccgtacaatccta

SEQ ID NO: 46429 - DNA, 35 bp, Artificial Sequence
  Synthetic oligonucleotide
gaacacctaggctgggtgcgaatgaatgccctgta

SEQ ID NO: 46430 - DNA, 36 bp, Artificial Sequence
  Synthetic oligonucleotide
actctgctgccagtgcgccatcatactggtaactta

SEQ ID NO: 46431 - DNA, 36 bp, Artificial Sequence
  Synthetic oligonucleotide
tccacggggggttggctcaattctgcttcgtagtta

SEQ ID NO: 46432 - DNA, 36 bp, Artificial Sequence
  Synthetic oligonucleotide
tcctcgatggtaccacccttccgacacccgtggtta

SEQ ID NO: 46433 - DNA, 35 bp, Artificial Sequence
  Synthetic oligonucleotide
gcaagctggggggggagaatcttggcgggatgcac

SEQ ID NO: 46434 - DNA, 34 bp, Artificial Sequence
  Synthetic oligonucleotide
tacgcctgacccactcgtacatggaccacatcac

SEQ ID NO: 46435 - DNA, 35 bp, Artificial Sequence
  Synthetic oligonucleotide
actagccaccgtggactctgtgcttccgcctcggc

SEQ ID NO: 46436 - DNA, 35 bp, Artificial Sequence
  Synthetic oligonucleotide
aaccatcccctcaaagtactaccgagaaaccactc

SEQ ID NO: 46437 - DNA, 35 bp, Artificial Sequence
  Synthetic oligonucleotide
tgacccatcatgcataaggtcccccatgtgacctc

SEQ ID NO: 46438 - DNA, 35 bp, Artificial Sequence
  Synthetic oligonucleotide
tgacctcccaccaattacccctgatgcacgacgtc

SEQ ID NO: 46439 - DNA, 35 bp, Artificial Sequence
  Synthetic oligonucleotide
tatgcccccacccattacactcacgaggcgaggtc

SEQ ID NO: 46440 - DNA, 35 bp, Artificial Sequence
  Synthetic oligonucleotide
acaggtgggggggtgtgacgtcctaaattggtctg

SEQ ID NO: 46441 - DNA, 35 bp, Artificial Sequence
  Synthetic oligonucleotide
gggtggagggtaaaggtggaaggagcccggctaat

SEQ ID NO: 46442 - DNA, 35 bp, Artificial Sequence
  Synthetic oligonucleotide
acagggacccgtccgcgcactttgagtacctccat

SEQ ID NO: 46443 - DNA, 35 bp, Artificial Sequence
  Synthetic oligonucleotide
taccatggccccatggtttgtccgaatattcttat

SEQ ID NO: 46444 - DNA, 35 bp, Artificial Sequence
  Synthetic oligonucleotide
tgagcccgctaactggggtcttgatctgctctcct

SEQ ID NO: 46445 - DNA, 35 bp, Artificial Sequence
  Synthetic oligonucleotide
acctgttcgccggaggtcgtcgcgcccgccttgct

SEQ ID NO: 46446 - DNA, 35 bp, Artificial Sequence
  Synthetic oligonucleotide
ggacaccctgataggtcaaacttccccttcacagt

SEQ ID NO: 46447 - DNA, 35 bp, Artificial Sequence
  Synthetic oligonucleotide
tgaccgagcaggccccgtcactttactgcaccatt

SEQ ID NO: 46448 - DNA, 35 bp, Artificial Sequence
  Synthetic oligonucleotide
gaacaccgcccttttcgtcttagccgccacacttt

SEQ ID NO: 46449 - DNA, 35 bp, Artificial Sequence
  Synthetic oligonucleotide
taaggaagaccgaagtgggtggtcgcacggtggaa

SEQ ID NO: 46450 - DNA, 36 bp, Artificial Sequence
  Synthetic oligonucleotide
ttaacgcgccatcgaaacgaaaaaagccctgtcaca

SEQ ID NO: 46451 - DNA, 35 bp, Artificial Sequence
  Synthetic oligonucleotide
ttggtctgcggcgcctatggtccctgtaactccca

SEQ ID NO: 46452 - DNA, 35 bp, Artificial Sequence
  Synthetic oligonucleotide
atgttcccgtcctttccccggctagaatgccgcca

SEQ ID NO: 46453 - DNA, 36 bp, Artificial Sequence
  Synthetic oligonucleotide
gagaaaggccggaagattggacggaaggggaagtca

SEQ ID NO: 46454 - DNA, 37 bp, Artificial Sequence
  Synthetic oligonucleotide
gatgggcgggggggtgcaatgggaactgttgcaaaga

SEQ ID NO: 46455 - DNA, 37 bp, Artificial Sequence
  Synthetic oligonucleotide
gttgtactcagcatcccctttgaggccccttaccaga

SEQ ID NO: 46456 - DNA, 36 bp, Artificial Sequence
  Synthetic oligonucleotide
gcgcccactacggtcctcctactccatcgtcgcaga

SEQ ID NO: 46457 - DNA, 37 bp, Artificial Sequence
  Synthetic oligonucleotide
tcaccgccatgtcaccacacacggtcccttcgctaga

SEQ ID NO: 46458 - DNA, 37 bp, Artificial Sequence
  Synthetic oligonucleotide
actctatgggcccccacactgttctttccttggacga

SEQ ID NO: 46459 - DNA, 37 bp, Artificial Sequence
  Synthetic oligonucleotide
tcaacttccgctcactcctttctggtcacgccttgga

SEQ ID NO: 46460 - DNA, 37 bp, Artificial Sequence
  Synthetic oligonucleotide
attgggagtgtgggagggttcagggtgtcgacaatga

SEQ ID NO: 46461 - DNA, 38 bp, Artificial Sequence
  Synthetic oligonucleotide
tcattcaccgctctcctccaccatgtgcctggcactga

SEQ ID NO: 46462 - DNA, 37 bp, Artificial Sequence
  Synthetic oligonucleotide
ttacagtgatcgcccgcccgcacccctctctcagtga

SEQ ID NO: 46463 - DNA, 38 bp, Artificial Sequence
  Synthetic oligonucleotide
acgaccagagaggggctaggtgaagggctttggcgtga

SEQ ID NO: 46464 - DNA, 38 bp, Artificial Sequence
  Synthetic oligonucleotide
ggagctttgacccacccatgcgcacctgcctgccttga

SEQ ID NO: 46465 - DNA, 38 bp, Artificial Sequence
  Synthetic oligonucleotide
gacgctacctctccatttcaaccccgtctggtccttga

SEQ ID NO: 46466 - DNA, 37 bp, Artificial Sequence
  Synthetic oligonucleotide
gaccttgcgcaatatgttccctatctttctgtgttga

SEQ ID NO: 46467 - DNA, 38 bp, Artificial Sequence
  Synthetic oligonucleotide
tccacaacacatactggtttagacttttagcaatttga

SEQ ID NO: 46468 - DNA, 38 bp, Artificial Sequence
  Synthetic oligonucleotide
gagtgcggtccgcagttatcttttcctcagtagtttga

SEQ ID NO: 46469 - DNA, 36 bp, Artificial Sequence
  Synthetic oligonucleotide
gttcactccaaactgttgcctacgttcctagttcta

SEQ ID NO: 46470 - DNA, 36 bp, Artificial Sequence
  Synthetic oligonucleotide
agccaccgcaattgagaactttccgctttcattgta

SEQ ID NO: 46471 - DNA, 35 bp, Artificial Sequence
  Synthetic oligonucleotide
ttaggaccaccccgtcctatctctatgtacaatta

SEQ ID NO: 46472 - DNA, 36 bp, Artificial Sequence
  Synthetic oligonucleotide
taacactctcctcctcccgcggcggtcaagccgtta

SEQ ID NO: 46473 - DNA, 31 bp, Artificial Sequence
  Synthetic oligonucleotide
ttgcgacgagcgccacatccacgaccgcaac

SEQ ID NO: 46474 - DNA, 35 bp, Artificial Sequence
  Synthetic oligonucleotide
atgctgcagaaacccgagcttatctgtccttgcac

SEQ ID NO: 46475 - DNA, 35 bp, Artificial Sequence
  Synthetic oligonucleotide
ttcgcttcctcctgcacccattagctcgattgccc

SEQ ID NO: 46476 - DNA, 35 bp, Artificial Sequence
  Synthetic oligonucleotide
tcatcaaccctcctgtcaactaggggtcgtgctcc

SEQ ID NO: 46477 - DNA, 35 bp, Artificial Sequence
  Synthetic oligonucleotide
attccctcatgttaacttccgctggtattttgtcc

SEQ ID NO: 46478 - DNA, 35 bp, Artificial Sequence
  Synthetic oligonucleotide
gctgtgcctcgcttccttatcttctgcgtcgctgc

SEQ ID NO: 46479 - DNA, 35 bp, Artificial Sequence
  Synthetic oligonucleotide
gttcgtccttacctgcacttcctgggtcgctttgc

SEQ ID NO: 46480 - DNA, 35 bp, Artificial Sequence
  Synthetic oligonucleotide
agcccctgtagcctatagcgcgtcccattccggtc

SEQ ID NO: 46481 - DNA, 35 bp, Artificial Sequence
  Synthetic oligonucleotide
ttagacgagcagccttccacgtttagcttcatccg

SEQ ID NO: 46482 - DNA, 35 bp, Artificial Sequence
  Synthetic oligonucleotide
gcacccatctccgtctctaaccatgcaacaccgcg

SEQ ID NO: 46483 - DNA, 35 bp, Artificial Sequence
  Synthetic oligonucleotide
gccgaggtaggtggcggggggcttggaaggtggcg

SEQ ID NO: 46484 - DNA, 35 bp, Artificial Sequence
  Synthetic oligonucleotide
aaccatgggcagggatcggttggaggaagggaggg

SEQ ID NO: 46485 - DNA, 35 bp, Artificial Sequence
  Synthetic oligonucleotide
acaaagaggagggcggtttaggatcgagaagttgg

SEQ ID NO: 46486 - DNA, 35 bp, Artificial Sequence
  Synthetic oligonucleotide
gatgccctccggaatgcgtatcccttcttaaaact

SEQ ID NO: 46487 - DNA, 35 bp, Artificial Sequence
  Synthetic oligonucleotide
tcgccgcccggtaaaacaggcacaaataacaccct

SEQ ID NO: 46488 - DNA, 35 bp, Artificial Sequence
  Synthetic oligonucleotide
gtgtactcctcacgcgattttaccatgcaccctgt

SEQ ID NO: 46489 - DNA, 35 bp, Artificial Sequence
  Synthetic oligonucleotide
tgtcacccggcgggatagtagggtgcgggttggtt

SEQ ID NO: 46490 - DNA, 36 bp, Artificial Sequence
  Synthetic oligonucleotide
tccatccctgaatagaggtctcgagcccttctcaaa

SEQ ID NO: 46491 - DNA, 36 bp, Artificial Sequence
  Synthetic oligonucleotide
gtcccgcacctaactgatttcatacgccctttacaa

SEQ ID NO: 46492 - DNA, 36 bp, Artificial Sequence
  Synthetic oligonucleotide
taccgccaaaaccgtgcgcacctgtagtcacctgaa

SEQ ID NO: 46493 - DNA, 36 bp, Artificial Sequence
  Synthetic oligonucleotide
gatgtagggtgggggaatataggccctttgtgaaca

SEQ ID NO: 46494 - DNA, 35 bp, Artificial Sequence
  Synthetic oligonucleotide
gatgaggggggggtgggaaggtgttgggggtccca

SEQ ID NO: 46495 - DNA, 36 bp, Artificial Sequence
  Synthetic oligonucleotide
tgcgaagcaccggccatactacgcgacactgatcca

SEQ ID NO: 46496 - DNA, 35 bp, Artificial Sequence
  Synthetic oligonucleotide
tttcatgcctgtttcctccgctgtcctgggttgca

SEQ ID NO: 46497 - DNA, 36 bp, Artificial Sequence
  Synthetic oligonucleotide
gtttggcactgcccgccggtgcatcacctattttca

SEQ ID NO: 46498 - DNA, 37 bp, Artificial Sequence
  Synthetic oligonucleotide
gagatgccgacggggtattcacaaagcaggggcgaga

SEQ ID NO: 46499 - DNA, 37 bp, Artificial Sequence
  Synthetic oligonucleotide
tgattactgcgcactaaaagcccgtccctcttcacga

SEQ ID NO: 46500 - DNA, 37 bp, Artificial Sequence
  Synthetic oligonucleotide
acccgtctcagtgcctcgcacctaccatcaatgccga

SEQ ID NO: 46501 - DNA, 36 bp, Artificial Sequence
  Synthetic oligonucleotide
gagccccatcccgatgatctccgaacgtccttccga

SEQ ID NO: 46502 - DNA, 36 bp, Artificial Sequence
  Synthetic oligonucleotide
acacacccccacctcgaggaattttgtttcctgcga

SEQ ID NO: 46503 - DNA, 37 bp, Artificial Sequence
  Synthetic oligonucleotide
ttagtatgccaggagggcacgagggggggagcaagga

SEQ ID NO: 46504 - DNA, 36 bp, Artificial Sequence
  Synthetic oligonucleotide
gttcaaagaaaggtgggggtgtgagccaacaaggga

SEQ ID NO: 46505 - DNA, 37 bp, Artificial Sequence
  Synthetic oligonucleotide
gggagggggtaggaagaagtaagggccaaggggggga

SEQ ID NO: 46506 - DNA, 38 bp, Artificial Sequence
  Synthetic oligonucleotide
gcccgctccgtgatttcccacccatctttcccgaatga

SEQ ID NO: 46507 - DNA, 38 bp, Artificial Sequence
  Synthetic oligonucleotide
tcaaagctcattttgcaagcctgcactccggcccctga

SEQ ID NO: 46508 - DNA, 38 bp, Artificial Sequence
  Synthetic oligonucleotide
tacacgcagttctgcaaatccacacccagtctggctga

SEQ ID NO: 46509 - DNA, 38 bp, Artificial Sequence
  Synthetic oligonucleotide
acatgaacgtgaaaggtaggaggggagaaatgaagtga

SEQ ID NO: 46510 - DNA, 38 bp, Artificial Sequence
  Synthetic oligonucleotide
acatcatccgccaaccacgagttatctttgcatcgtga

SEQ ID NO: 46511 - DNA, 38 bp, Artificial Sequence
  Synthetic oligonucleotide
agcggtccatgtcccatccaaacaccacccctgcttga

SEQ ID NO: 46512 - DNA, 38 bp, Artificial Sequence
  Synthetic oligonucleotide
gaggacggaataaggggcataggaatagggcgggttga

SEQ ID NO: 46513 - DNA, 38 bp, Artificial Sequence
  Synthetic oligonucleotide
gaggtcgcccccgccagattgtcgtctctcgcctttga

SEQ ID NO: 46514 - DNA, 36 bp, Artificial Sequence
  Synthetic oligonucleotide
ggagccgggggcggtagggtgaagggcttcggcgta

SEQ ID NO: 46515 - DNA, 36 bp, Artificial Sequence
  Synthetic oligonucleotide
actgtcagggccctacatcgcgctggtttgcactta

SEQ ID NO: 46516 - DNA, 35 bp, Artificial Sequence
  Synthetic oligonucleotide
gtgcaacccctgtatgtctccaaaccttgtacaac

SEQ ID NO: 46517 - DNA, 35 bp, Artificial Sequence
  Synthetic oligonucleotide
gctccactcccattgtctagaatcctcggggtaac

SEQ ID NO: 46518 - DNA, 35 bp, Artificial Sequence
  Synthetic oligonucleotide
tccacgtgagggtttttcggctgcttgttttacac

SEQ ID NO: 46519 - DNA, 35 bp, Artificial Sequence
  Synthetic oligonucleotide
tctaaccagcctcacgcccttgctactaataccac

SEQ ID NO: 46520 - DNA, 35 bp, Artificial Sequence
  Synthetic oligonucleotide
ttccgcccctagttgacccatccctcgtacgtgac

SEQ ID NO: 46521 - DNA, 35 bp, Artificial Sequence
  Synthetic oligonucleotide
gccaccaactgctgtccgctctttttatgccatac

SEQ ID NO: 46522 - DNA, 35 bp, Artificial Sequence
  Synthetic oligonucleotide
gaacagctattcgcaatgcatcaaagcttctttac

SEQ ID NO: 46523 - DNA, 35 bp, Artificial Sequence
  Synthetic oligonucleotide
tcataacgccctgggcccctcgactacctaaaccc

SEQ ID NO: 46524 - DNA, 35 bp, Artificial Sequence
  Synthetic oligonucleotide
tccattcctgcctatccctgtgcttgtaagccccc

SEQ ID NO: 46525 - DNA, 35 bp, Artificial Sequence
  Synthetic oligonucleotide
accatcactcgagcgccttctccggggcggattcc

SEQ ID NO: 46526 - DNA, 35 bp, Artificial Sequence
  Synthetic oligonucleotide
gtcacctccagctagttataaacgcacaacctagc

SEQ ID NO: 46527 - DNA, 35 bp, Artificial Sequence
  Synthetic oligonucleotide
tctaactcgcgtgcggacctccatcgcctgcatgc

SEQ ID NO: 46528 - DNA, 35 bp, Artificial Sequence
  Synthetic oligonucleotide
gcctacctgctgactaccccccagtttttcgaatc

SEQ ID NO: 46529 - DNA, 35 bp, Artificial Sequence
  Synthetic oligonucleotide
actgcaaatacaccggccccttcgtacagcacctc

SEQ ID NO: 46530 - DNA, 35 bp, Artificial Sequence
  Synthetic oligonucleotide
tcacggacgacgctgctgcacatcgatagaatctc

SEQ ID NO: 46531 - DNA, 35 bp, Artificial Sequence
  Synthetic oligonucleotide
agcccgttcatccgccctcacattcgtatcgattc

SEQ ID NO: 46532 - DNA, 35 bp, Artificial Sequence
  Synthetic oligonucleotide
ttgcgtggtatccagctgcccactctcttgtattc

SEQ ID NO: 46533 - DNA, 35 bp, Artificial Sequence
  Synthetic oligonucleotide
gtgaagacctctgctgccctccatacccactgtag

SEQ ID NO: 46534 - DNA, 35 bp, Artificial Sequence
  Synthetic oligonucleotide
gcgatgcccgtgacgccgttcgccagccctccctg

SEQ ID NO: 46535 - DNA, 35 bp, Artificial Sequence
  Synthetic oligonucleotide
gccatctgactgcgaggcaaatccgtcccatacct

SEQ ID NO: 46536 - DNA, 35 bp, Artificial Sequence
  Synthetic oligonucleotide
ctgacaaccaccgtgtctgcaactgctccatctct

SEQ ID NO: 46537 - DNA, 35 bp, Artificial Sequence
  Synthetic oligonucleotide
atcgaaatgcgggaatacaaaaatggggggagagt

SEQ ID NO: 46538 - DNA, 35 bp, Artificial Sequence
  Synthetic oligonucleotide
gttctcgcccttgtctctgctattagctttcgctt

SEQ ID NO: 46539 - DNA, 36 bp, Artificial Sequence
  Synthetic oligonucleotide
gtgggggcctacgccggagaattactggtatgcaaa

SEQ ID NO: 46540 - DNA, 36 bp, Artificial Sequence
  Synthetic oligonucleotide
tcataaacgccgcattgcacatactgcactttgaaa

SEQ ID NO: 46541 - DNA, 36 bp, Artificial Sequence
  Synthetic oligonucleotide
gacctgacccgtactaccacgcctttgcgacgacaa

SEQ ID NO: 46542 - DNA, 36 bp, Artificial Sequence
  Synthetic oligonucleotide
gaggatgagaaggggaggaggggtcaatcaaactaa

SEQ ID NO: 46543 - DNA, 36 bp, Artificial Sequence
  Synthetic oligonucleotide
actacgcccgtcctttctgatgacgacctcacacca

SEQ ID NO: 46544 - DNA, 36 bp, Artificial Sequence
  Synthetic oligonucleotide
agaccacgcgcatggttaaacagataaatggtgcca

SEQ ID NO: 46545 - DNA, 36 bp, Artificial Sequence
  Synthetic oligonucleotide
tttggcaattgcgaatcccgacgtccttacactcca

SEQ ID NO: 46546 - DNA, 35 bp, Artificial Sequence
  Synthetic oligonucleotide
gcgagatgccgcacctagcccccactcttgtatca

SEQ ID NO: 46547 - DNA, 37 bp, Artificial Sequence
  Synthetic oligonucleotide
gacaccatacacatgtgataccccgttcttttacaga

SEQ ID NO: 46548 - DNA, 36 bp, Artificial Sequence
  Synthetic oligonucleotide
tcgtaccccctcactcctctggaaccaacagaacga

SEQ ID NO: 46549 - DNA, 37 bp, Artificial Sequence
  Synthetic oligonucleotide
tcgtcccccccatcatgcgatccgttctagcccacga

SEQ ID NO: 46550 - DNA, 38 bp, Artificial Sequence
  Synthetic oligonucleotide
tagcccagctcccttcaccctgtctccctgctgcacga

SEQ ID NO: 46551 - DNA, 37 bp, Artificial Sequence
  Synthetic oligonucleotide
gtacgtctgcctacgttgtctctttgacccgacccga

SEQ ID NO: 46552 - DNA, 36 bp, Artificial Sequence
  Synthetic oligonucleotide
atccgaggcgcctggtttcggtccgttattgctcga

SEQ ID NO: 46553 - DNA, 36 bp, Artificial Sequence
  Synthetic oligonucleotide
gccggagagaaaaatggggtggataatgagcgggga

SEQ ID NO: 46554 - DNA, 37 bp, Artificial Sequence
  Synthetic oligonucleotide
gtgaggagcgaagtacaggacctaggacagtggggga

SEQ ID NO: 46555 - DNA, 38 bp, Artificial Sequence
  Synthetic oligonucleotide
atcagccaattgctccagtgaaccgcctcgatacatga

SEQ ID NO: 46556 - DNA, 38 bp, Artificial Sequence
  Synthetic oligonucleotide
tagcgaactacaagggcgggatggaggggtgaaagtga

SEQ ID NO: 46557 - DNA, 38 bp, Artificial Sequence
  Synthetic oligonucleotide
tcagaagggtcgtgaaagggggaaaagaagagccgtga

SEQ ID NO: 46558 - DNA, 38 bp, Artificial Sequence
  Synthetic oligonucleotide
tccctccaccgaccccacgttatcgtgataacatgtga

SEQ ID NO: 46559 - DNA, 38 bp, Artificial Sequence
  Synthetic oligonucleotide
gaacgcaggatgtagcgggtaggcgtaaggtaatttga

SEQ ID NO: 46560 - DNA, 38 bp, Artificial Sequence
  Synthetic oligonucleotide
atgggagggccggggtagggtcaaatgaggccctttga

SEQ ID NO: 46561 - DNA, 37 bp, Artificial Sequence
  Synthetic oligonucleotide
agccgatcgagcgtgttcacgccctcctaccttttga

SEQ ID NO: 46562 - DNA, 35 bp, Artificial Sequence
  Synthetic oligonucleotide
tcccactcttccgacttcctgggtggtttccctta

SEQ ID NO: 46563 - DNA, 36 bp, Artificial Sequence
  Synthetic oligonucleotide
gtcccagttcccctcgctgcccaattagtagtctta

SEQ ID NO: 46564 - DNA, 35 bp, Artificial Sequence
  Synthetic oligonucleotide
gtcatcacaatcgacgtgccatactctctcatgac

SEQ ID NO: 46565 - DNA, 35 bp, Artificial Sequence
  Synthetic oligonucleotide
tagactatgccgcagtttcacgcgcacacctgtac

SEQ ID NO: 46566 - DNA, 35 bp, Artificial Sequence
  Synthetic oligonucleotide
gtccctacttgcatattgcacgttcgttcacttac

SEQ ID NO: 46567 - DNA, 35 bp, Artificial Sequence
  Synthetic oligonucleotide
acaccgaacatagcataggcccctacgtctgcacc

SEQ ID NO: 46568 - DNA, 35 bp, Artificial Sequence
  Synthetic oligonucleotide
gacaccaccacagaccacggaccgacaccacgccc

SEQ ID NO: 46569 - DNA, 35 bp, Artificial Sequence
  Synthetic oligonucleotide
taccacacttatacccgtcgttgaggcccgggccc

SEQ ID NO: 46570 - DNA, 35 bp, Artificial Sequence
  Synthetic oligonucleotide
acttgaacggggtgcgctgccctaccccactttcc

SEQ ID NO: 46571 - DNA, 35 bp, Artificial Sequence
  Synthetic oligonucleotide
tcgcctgacgttgtcctaatcacctgctgttccgc

SEQ ID NO: 46572 - DNA, 35 bp, Artificial Sequence
  Synthetic oligonucleotide
gatctcaagccgtcaactgctaccaacacgcaatc

SEQ ID NO: 46573 - DNA, 35 bp, Artificial Sequence
  Synthetic oligonucleotide
gtagacagaaggtctcaaacccatggcccaccctc

SEQ ID NO: 46574 - DNA, 35 bp, Artificial Sequence
  Synthetic oligonucleotide
accacaagcaactgtagttacaagcacgccttctc

SEQ ID NO: 46575 - DNA, 35 bp, Artificial Sequence
  Synthetic oligonucleotide
attccagcactcgtccccccttactatgtgatgtc

SEQ ID NO: 46576 - DNA, 35 bp, Artificial Sequence
  Synthetic oligonucleotide
agtacaccgccaacgcccaccgcactctccattag

SEQ ID NO: 46577 - DNA, 35 bp, Artificial Sequence
  Synthetic oligonucleotide
gcctgctacatcccttcgttcacccctctagtacg

SEQ ID NO: 46578 - DNA, 35 bp, Artificial Sequence
  Synthetic oligonucleotide
caaataccaaaccgtaccgtcgggcgtgacctccg

SEQ ID NO: 46579 - DNA, 34 bp, Artificial Sequence
  Synthetic oligonucleotide
atccaatgtccacactggttctctgctcacccat

SEQ ID NO: 46580 - DNA, 35 bp, Artificial Sequence
  Synthetic oligonucleotide
ggatcgcggggagcatggtagggataaaggaagat

SEQ ID NO: 46581 - DNA, 35 bp, Artificial Sequence
  Synthetic oligonucleotide
tccgagtgccttttttcgatgctaattgatccctt

SEQ ID NO: 46582 - DNA, 35 bp, Artificial Sequence
  Synthetic oligonucleotide
gctcacccttaagctcggtctctctaagtttcctt

SEQ ID NO: 46583 - DNA, 36 bp, Artificial Sequence
  Synthetic oligonucleotide
gctacacccacttatcgtggcattgataactgcaaa

SEQ ID NO: 46584 - DNA, 36 bp, Artificial Sequence
  Synthetic oligonucleotide
ttgcctacacctctgtatggcatccactcatctaaa

SEQ ID NO: 46585 - DNA, 35 bp, Artificial Sequence
  Synthetic oligonucleotide
taccagtcggtacctggcctcttccttacgaccaa

SEQ ID NO: 46586 - DNA, 35 bp, Artificial Sequence
  Synthetic oligonucleotide
gaccgcgcaggccgtcgcacttctcccgctcgcaa

SEQ ID NO: 46587 - DNA, 36 bp, Artificial Sequence
  Synthetic oligonucleotide
aaacgcgcatgcccgtgtcactatgcactatcataa

SEQ ID NO: 46588 - DNA, 36 bp, Artificial Sequence
  Synthetic oligonucleotide
tacatgcgaaaagcccgttccctgtctcaagtcgca

SEQ ID NO: 46589 - DNA, 35 bp, Artificial Sequence
  Synthetic oligonucleotide
tccgtacatactcttaccgggcccgctgtccctca

SEQ ID NO: 46590 - DNA, 37 bp, Artificial Sequence
  Synthetic oligonucleotide
agtacatgggaggcaaaaagttgaaaagaaagggcga

SEQ ID NO: 46591 - DNA, 37 bp, Artificial Sequence
  Synthetic oligonucleotide
tcaacctcgcgcccttttccctcggtccatcgctcga

SEQ ID NO: 46592 - DNA, 37 bp, Artificial Sequence
  Synthetic oligonucleotide
tgcgatgtcactgggcccccgcttctctctgtctcga

SEQ ID NO: 46593 - DNA, 37 bp, Artificial Sequence
  Synthetic oligonucleotide
atgtccgccttcccatacagtctgagctgcttttcga

SEQ ID NO: 46594 - DNA, 36 bp, Artificial Sequence
  Synthetic oligonucleotide
gaagggcgtaggggaggggaacgggaggagtaagga

SEQ ID NO: 46595 - DNA, 37 bp, Artificial Sequence
  Synthetic oligonucleotide
agatcgagggggggagggcgcaccagacatcttagga

SEQ ID NO: 46596 - DNA, 36 bp, Artificial Sequence
  Synthetic oligonucleotide
tccgttcccatgcctcgacttgcacatctattcgga

SEQ ID NO: 46597 - DNA, 36 bp, Artificial Sequence
  Synthetic oligonucleotide
gttcggggaacatgggcggggataagggtgcgggga

SEQ ID NO: 46598 - DNA, 36 bp, Artificial Sequence
  Synthetic oligonucleotide
gacttcgcggcgaggggattgggggggatgggggga

SEQ ID NO: 46599 - DNA, 38 bp, Artificial Sequence
  Synthetic oligonucleotide
tagcccagtcgcagacgggggaggggtaatcatgtgga

SEQ ID NO: 46600 - DNA, 37 bp, Artificial Sequence
  Synthetic oligonucleotide
gcacccgttaggagcgttattaatcttctgccactga

SEQ ID NO: 46601 - DNA, 38 bp, Artificial Sequence
  Synthetic oligonucleotide
tagtaccgccgaaggtgcccagtgtcgcctctatctga

SEQ ID NO: 46602 - DNA, 37 bp, Artificial Sequence
  Synthetic oligonucleotide
tactcactcagccgttaacacactggtactcttctga

SEQ ID NO: 46603 - DNA, 37 bp, Artificial Sequence
  Synthetic oligonucleotide
ttgagggaaacgggtggtgacgcgggtgccatggtga

SEQ ID NO: 46604 - DNA, 37 bp, Artificial Sequence
  Synthetic oligonucleotide
acaccgcaactattccttcacccacagtatcttgtga

SEQ ID NO: 46605 - DNA, 38 bp, Artificial Sequence
  Synthetic oligonucleotide
tgtgcctcatcctcggaacgtcttaatgtacaccttga

SEQ ID NO: 46606 - DNA, 38 bp, Artificial Sequence
  Synthetic oligonucleotide
acgacgctccggtcctcgattatatgttccctccttga

SEQ ID NO: 46607 - DNA, 38 bp, Artificial Sequence
  Synthetic oligonucleotide
atccggcctgttcctccgctgtctcctagggtctttga

SEQ ID NO: 46608 - DNA, 38 bp, Artificial Sequence
  Synthetic oligonucleotide
tggatcgcgagcagacgaggggtggtgggggcttttga

SEQ ID NO: 46609 - DNA, 35 bp, Artificial Sequence
  Synthetic oligonucleotide
tccgccgtacgttctttcgaatagccctccccata

SEQ ID NO: 46610 - DNA, 36 bp, Artificial Sequence
  Synthetic oligonucleotide
accccgctcagcactgcctcacgtcttccagggcta

SEQ ID NO: 46611 - DNA, 35 bp, Artificial Sequence
  Synthetic oligonucleotide
tacagggccattggtgggagggaaggtaagcggta

SEQ ID NO: 46612 - DNA, 35 bp, Artificial Sequence
  Synthetic oligonucleotide
ttgccaaacagaggggagggggcgtggaaccttta

SEQ ID NO: 46613 - DNA, 35 bp, Artificial Sequence
  Synthetic oligonucleotide
tgagctcagaccgtttgccttgcactatcctccac

SEQ ID NO: 46614 - DNA, 35 bp, Artificial Sequence
  Synthetic oligonucleotide
accgcgacatggatgcccgccccatatgcctcacc

SEQ ID NO: 46615 - DNA, 35 bp, Artificial Sequence
  Synthetic oligonucleotide
ccccatgcgccgctctccgccgttcacatgaaccc

SEQ ID NO: 46616 - DNA, 36 bp, Artificial Sequence
  Synthetic oligonucleotide
gtagactggccagctttttgcttttgtggttccccc

SEQ ID NO: 46617 - DNA, 35 bp, Artificial Sequence
  Synthetic oligonucleotide
tgtgagatgtcgtcccccgtattttactgtgctcc

SEQ ID NO: 46618 - DNA, 35 bp, Artificial Sequence
  Synthetic oligonucleotide
gtatcccatccagcggaccgactgccgcggtcttc

SEQ ID NO: 46619 - DNA, 35 bp, Artificial Sequence
  Synthetic oligonucleotide
tctactggtccgaaggtaagtcgccgttcctcccg

SEQ ID NO: 46620 - DNA, 35 bp, Artificial Sequence
  Synthetic oligonucleotide
gcccgctactatccgctacgatcatggccctttgg

SEQ ID NO: 46621 - DNA, 35 bp, Artificial Sequence
  Synthetic oligonucleotide
tcccccatccagttgtcgctaccgtaatctcactg

SEQ ID NO: 46622 - DNA, 35 bp, Artificial Sequence
  Synthetic oligonucleotide
gtgcaagtccccacggatgcccctatatcttattg

SEQ ID NO: 46623 - DNA, 35 bp, Artificial Sequence
  Synthetic oligonucleotide
gcactacaaataccgatcgccagggcgtctcacct

SEQ ID NO: 46624 - DNA, 35 bp, Artificial Sequence
  Synthetic oligonucleotide
tgtcgtgttgcggcatctccctttttgccatacct

SEQ ID NO: 46625 - DNA, 35 bp, Artificial Sequence
  Synthetic oligonucleotide
tagcaagtgattccgccacccgttctcagcctcct

SEQ ID NO: 46626 - DNA, 35 bp, Artificial Sequence
  Synthetic oligonucleotide
gccactcagcgagatctttctacccctgttgtgct

SEQ ID NO: 46627 - DNA, 35 bp, Artificial Sequence
  Synthetic oligonucleotide
attgcccgccccattctccgtacgtccaccgctgt

SEQ ID NO: 46628 - DNA, 36 bp, Artificial Sequence
  Synthetic oligonucleotide
ttctagccgagcatcccctgcacctttcgaacacaa

SEQ ID NO: 46629 - DNA, 36 bp, Artificial Sequence
  Synthetic oligonucleotide
gtatagcatccggtacactgtcacaactacacacaa

SEQ ID NO: 46630 - DNA, 34 bp, Artificial Sequence
  Synthetic oligonucleotide
gattgcgcgtgctctcccagcgttttacctcgaa

SEQ ID NO: 46631 - DNA, 36 bp, Artificial Sequence
  Synthetic oligonucleotide
gcccaccgttagggccgcatcgccccatcctgaaca

SEQ ID NO: 46632 - DNA, 36 bp, Artificial Sequence
  Synthetic oligonucleotide
aaccactcgcctgaactgtagtctatcattaacaca

SEQ ID NO: 46633 - DNA, 35 bp, Artificial Sequence
  Synthetic oligonucleotide
agtcccgcaaaggcctcgtgcacacccccgtcaca

SEQ ID NO: 46634 - DNA, 36 bp, Artificial Sequence
  Synthetic oligonucleotide
tcactgtcctgccgtatttacccattattctggcca

SEQ ID NO: 46635 - DNA, 35 bp, Artificial Sequence
  Synthetic oligonucleotide
tctgcaacagtttctccgcccgcacgatgatcgca

SEQ ID NO: 46636 - DNA, 37 bp, Artificial Sequence
  Synthetic oligonucleotide
gctatcatcgcgccggccgaccgactcatttgcgaga

SEQ ID NO: 46637 - DNA, 37 bp, Artificial Sequence
  Synthetic oligonucleotide
aaccggctgccactgacccttgcctgattcccataga

SEQ ID NO: 46638 - DNA, 37 bp, Artificial Sequence
  Synthetic oligonucleotide
gtcccgctcacctgttaacattttgtctgttggccga

SEQ ID NO: 46639 - DNA, 36 bp, Artificial Sequence
  Synthetic oligonucleotide
tatggtaccccacccagtctctccgccagacttcga

SEQ ID NO: 46640 - DNA, 37 bp, Artificial Sequence
  Synthetic oligonucleotide
acaccaccatgtttttatgcttgcttttgcaaaggga

SEQ ID NO: 46641 - DNA, 37 bp, Artificial Sequence
  Synthetic oligonucleotide
tcctctgggcaggaaagggggggctaggtggtaggga

SEQ ID NO: 46642 - DNA, 38 bp, Artificial Sequence
  Synthetic oligonucleotide
tatgcaggcccccaataagttccgcctctgcctaatga

SEQ ID NO: 46643 - DNA, 38 bp, Artificial Sequence
  Synthetic oligonucleotide
tcgtgtcctcacgggtccttcgatcactcacctcatga

SEQ ID NO: 46644 - DNA, 38 bp, Artificial Sequence
  Synthetic oligonucleotide
gcgcgggggcaaggggaaaccatggacaggggaactga

SEQ ID NO: 46645 - DNA, 38 bp, Artificial Sequence
  Synthetic oligonucleotide
gcaagggagtcaccttgggtgataggggcgggtagtga

SEQ ID NO: 46646 - DNA, 37 bp, Artificial Sequence
  Synthetic oligonucleotide
gccacatcgaatacaaaagggcctaccatcctcgtga

SEQ ID NO: 46647 - DNA, 36 bp, Artificial Sequence
  Synthetic oligonucleotide
gcccatccatagctacacaggacgtgcttaacccta

SEQ ID NO: 46648 - DNA, 36 bp, Artificial Sequence
  Synthetic oligonucleotide
tcctccctccttgactcatcggtgacaataaacgta

SEQ ID NO: 46649 - DNA, 36 bp, Artificial Sequence
  Synthetic oligonucleotide
tttgcgctacccattgcagcctccctacttaagtta

SEQ ID NO: 46650 - DNA, 37 bp, Artificial Sequence
  Synthetic oligonucleotide
acccaccccccaactgcccgtgttgtcgctcccttta

SEQ ID NO: 46651 - DNA, 35 bp, Artificial Sequence
  Synthetic oligonucleotide
gaatcacatcaccacccatgcacgtaattttttac

SEQ ID NO: 46652 - DNA, 35 bp, Artificial Sequence
  Synthetic oligonucleotide
ttgccactgtgccaccattcataaattgtaatccc

SEQ ID NO: 46653 - DNA, 35 bp, Artificial Sequence
  Synthetic oligonucleotide
tgtcctccgctacggaaccgacgatacactttccc

SEQ ID NO: 46654 - DNA, 35 bp, Artificial Sequence
  Synthetic oligonucleotide
ttgcccaagctggactctaccatggcttgacttcc

SEQ ID NO: 46655 - DNA, 35 bp, Artificial Sequence
  Synthetic oligonucleotide
gttccgtacatctgctgtatgtatcctgccacctc

SEQ ID NO: 46656 - DNA, 35 bp, Artificial Sequence
  Synthetic oligonucleotide
tacgatgaggggcggaaggggcgagccgggtgaag

SEQ ID NO: 46657 - DNA, 35 bp, Artificial Sequence
  Synthetic oligonucleotide
gaggggtgaacggatgggacgttacaggggtgacg

SEQ ID NO: 46658 - DNA, 35 bp, Artificial Sequence
  Synthetic oligonucleotide
actccgccttcagttcctgcccgactgttaaatcg

SEQ ID NO: 46659 - DNA, 35 bp, Artificial Sequence
  Synthetic oligonucleotide
gaaagggagtggatgggagtccgtatggaaaaggg

SEQ ID NO: 46660 - DNA, 35 bp, Artificial Sequence
  Synthetic oligonucleotide
gcccacactacgctatctcagcctttcatccgctg

SEQ ID NO: 46661 - DNA, 35 bp, Artificial Sequence
  Synthetic oligonucleotide
acgattcgcgcagattttgaaccggtttgtccttg

SEQ ID NO: 46662 - DNA, 35 bp, Artificial Sequence
  Synthetic oligonucleotide
tcattcgagaaccgggccccccaccgtgcattcct

SEQ ID NO: 46663 - DNA, 35 bp, Artificial Sequence
  Synthetic oligonucleotide
tttctacggcactgctacttctaatggtacttcct

SEQ ID NO: 46664 - DNA, 35 bp, Artificial Sequence
  Synthetic oligonucleotide
acaaccagcacagatcccgtttgcttaattatgct

SEQ ID NO: 46665 - DNA, 35 bp, Artificial Sequence
  Synthetic oligonucleotide
cccaatctcgctacaacaatgactatgacatcggt

SEQ ID NO: 46666 - DNA, 35 bp, Artificial Sequence
  Synthetic oligonucleotide
ttcccccgtgtaccatcgccacacaattcataatt

SEQ ID NO: 46667 - DNA, 35 bp, Artificial Sequence
  Synthetic oligonucleotide
agcgacacccatgagtgtgtaacagcactctcgtt

SEQ ID NO: 46668 - DNA, 35 bp, Artificial Sequence
  Synthetic oligonucleotide
tctatccccgtacacatcgatggaggccttgccaa

SEQ ID NO: 46669 - DNA, 35 bp, Artificial Sequence
  Synthetic oligonucleotide
acgcctcacgcatcgcacttgaatcttctctggaa

SEQ ID NO: 46670 - DNA, 36 bp, Artificial Sequence
  Synthetic oligonucleotide
ggtggaggggggagatttcctggaggcggcttgtaa

SEQ ID NO: 46671 - DNA, 36 bp, Artificial Sequence
  Synthetic oligonucleotide
tcatatctcctgtcgctcaagtccacactggcacca

SEQ ID NO: 46672 - DNA, 36 bp, Artificial Sequence
  Synthetic oligonucleotide
tggttacggctgatgtcaccgcctctctccccccca

SEQ ID NO: 46673 - DNA, 36 bp, Artificial Sequence
  Synthetic oligonucleotide
gaagaagtagacatgatgaagcgggggtgggaaaga

SEQ ID NO: 46674 - DNA, 37 bp, Artificial Sequence
  Synthetic oligonucleotide
tcacggacctgggtgcatgtgttaccctccttcacga

SEQ ID NO: 46675 - DNA, 37 bp, Artificial Sequence
  Synthetic oligonucleotide
tcagggggaggtgatcgggggagtgagattaatcgga

SEQ ID NO: 46676 - DNA, 36 bp, Artificial Sequence
  Synthetic oligonucleotide
tgttcctgtcccaccttctttaacagcctccaggga

SEQ ID NO: 46677 - DNA, 37 bp, Artificial Sequence
  Synthetic oligonucleotide
tgtggtaagacaggggtattggggggaatgggatgga

SEQ ID NO: 46678 - DNA, 37 bp, Artificial Sequence
  Synthetic oligonucleotide
tagcaccctacatgtcacgctcttgccccgtcaatga

SEQ ID NO: 46679 - DNA, 37 bp, Artificial Sequence
  Synthetic oligonucleotide
gagggtgggtggatccgaagggcgagcgaggaactga

SEQ ID NO: 46680 - DNA, 38 bp, Artificial Sequence
  Synthetic oligonucleotide
tgtagcctcccgctgtgaccacctattatacacactga

SEQ ID NO: 46681 - DNA, 37 bp, Artificial Sequence
  Synthetic oligonucleotide
tgtgccactatatattcttaccctgccggttcactga

SEQ ID NO: 46682 - DNA, 38 bp, Artificial Sequence
  Synthetic oligonucleotide
acctcgtgcttgtagcgtagaacgacccatccttctga

SEQ ID NO: 46683 - DNA, 37 bp, Artificial Sequence
  Synthetic oligonucleotide
tccgggccatcgaactggtcctaactgccatccgtga

SEQ ID NO: 46684 - DNA, 38 bp, Artificial Sequence
  Synthetic oligonucleotide
atcttacccctccgatggccaattagccttgtgcgtga

SEQ ID NO: 46685 - DNA, 38 bp, Artificial Sequence
  Synthetic oligonucleotide
tcacgcggcgtttcgccttatatcgcacacgccattga

SEQ ID NO: 46686 - DNA, 38 bp, Artificial Sequence
  Synthetic oligonucleotide
gcagggggggggttcgaggcggagatcaatggcattga

SEQ ID NO: 46687 - DNA, 38 bp, Artificial Sequence
  Synthetic oligonucleotide
atgccgtactcccgctctgtaccacgggccatacttga

SEQ ID NO: 46688 - DNA, 38 bp, Artificial Sequence
  Synthetic oligonucleotide
gatggcaacacccgtgctctatttgtgcgattccttga

SEQ ID NO: 46689 - DNA, 38 bp, Artificial Sequence
  Synthetic oligonucleotide
gcacgccctccgtaatccgcgcctatggactcgcttga

SEQ ID NO: 46690 - DNA, 37 bp, Artificial Sequence
  Synthetic oligonucleotide
gcgtactcggcccacagtgctttgttatttccgttga

SEQ ID NO: 46691 - DNA, 35 bp, Artificial Sequence
  Synthetic oligonucleotide
gccctcgaactgttgttgtttggctctacctttga

SEQ ID NO: 46692 - DNA, 36 bp, Artificial Sequence
  Synthetic oligonucleotide
gcaccctctggaatctgactcaagttcgcccgccta

SEQ ID NO: 46693 - DNA, 36 bp, Artificial Sequence
  Synthetic oligonucleotide
gatacatccggacagccaaccgcattagtaaccgta

SEQ ID NO: 46694 - DNA, 35 bp, Artificial Sequence
  Synthetic oligonucleotide
gaccaacatctcccccctttgctgccggagtatac

SEQ ID NO: 46695 - DNA, 35 bp, Artificial Sequence
  Synthetic oligonucleotide
gggtgccttcccatggtcaagccgctatttgcacc

SEQ ID NO: 46696 - DNA, 35 bp, Artificial Sequence
  Synthetic oligonucleotide
tactgtgtggtgcgcgaagccacctggttcacccc

SEQ ID NO: 46697 - DNA, 35 bp, Artificial Sequence
  Synthetic oligonucleotide
tgatcacagccctgttctgaccttccaggtaagcc

SEQ ID NO: 46698 - DNA, 34 bp, Artificial Sequence
  Synthetic oligonucleotide
taagtcgcccgttactaccacttactaagccgcc

SEQ ID NO: 46699 - DNA, 35 bp, Artificial Sequence
  Synthetic oligonucleotide
gtacgtacacgatcattcttcactcgtttaaacgc

SEQ ID NO: 46700 - DNA, 35 bp, Artificial Sequence
  Synthetic oligonucleotide
gccctccacatctggagcattacgaatcattacgc

SEQ ID NO: 46701 - DNA, 35 bp, Artificial Sequence
  Synthetic oligonucleotide
tctcagccattcgaggtcacaatatcacgctactc

SEQ ID NO: 46702 - DNA, 35 bp, Artificial Sequence
  Synthetic oligonucleotide
gtaagccaatcttcgttcgtgccgggctatatctc

SEQ ID NO: 46703 - DNA, 35 bp, Artificial Sequence
  Synthetic oligonucleotide
gtccaaaccgcattcctgagtccgtgaccaggttc

SEQ ID NO: 46704 - DNA, 35 bp, Artificial Sequence
  Synthetic oligonucleotide
tctgtatcaatggggtgggaagggcgatgactgag

SEQ ID NO: 46705 - DNA, 35 bp, Artificial Sequence
  Synthetic oligonucleotide
gccgctatggcacagtacggccactatttttatag

SEQ ID NO: 46706 - DNA, 35 bp, Artificial Sequence
  Synthetic oligonucleotide
gccacttttacgcacctcttttcagacaccacacg

SEQ ID NO: 46707 - DNA, 35 bp, Artificial Sequence
  Synthetic oligonucleotide
tacgcaccgtcgagctccaccttcccccgacgacg

SEQ ID NO: 46708 - DNA, 35 bp, Artificial Sequence
  Synthetic oligonucleotide
tggaccggaggactccgggaggggatagtgggagg

SEQ ID NO: 46709 - DNA, 35 bp, Artificial Sequence
  Synthetic oligonucleotide
tcccacgctatcatgtatatcttaatttcacacgg

SEQ ID NO: 46710 - DNA, 35 bp, Artificial Sequence
  Synthetic oligonucleotide
aaaccggagccctgactcccttcgcctttggagtg

SEQ ID NO: 46711 - DNA, 35 bp, Artificial Sequence
  Synthetic oligonucleotide
gcccgtgatcacgtcatacgtaacgttactcttat

SEQ ID NO: 46712 - DNA, 35 bp, Artificial Sequence
  Synthetic oligonucleotide
acccccttcccccagcgtttagcaaaggacctcct

SEQ ID NO: 46713 - DNA, 35 bp, Artificial Sequence
  Synthetic oligonucleotide
gcctaccaccgaagcctgtccgctgctgacacttt

SEQ ID NO: 46714 - DNA, 36 bp, Artificial Sequence
  Synthetic oligonucleotide
atgggaggagtcaggcaggcaggtgggcgtctcaaa

SEQ ID NO: 46715 - DNA, 36 bp, Artificial Sequence
  Synthetic oligonucleotide
gttggcgccggaacattagtctcgctcacctcgcaa

SEQ ID NO: 46716 - DNA, 35 bp, Artificial Sequence
  Synthetic oligonucleotide
acagatgccgggaaggaggcaggggtgtgacagaa

SEQ ID NO: 46717 - DNA, 36 bp, Artificial Sequence
  Synthetic oligonucleotide
atcatacaacatcatgccgccctctgctgagccgaa

SEQ ID NO: 46718 - DNA, 35 bp, Artificial Sequence
  Synthetic oligonucleotide
acatagcccgactccgcttctctttgccgtgttaa

SEQ ID NO: 46719 - DNA, 36 bp, Artificial Sequence
  Synthetic oligonucleotide
gggaaacggagccggtaaagtgggggggcggggaca

SEQ ID NO: 46720 - DNA, 36 bp, Artificial Sequence
  Synthetic oligonucleotide
gctgggtggggagctatgaggttaatgggagggcca

SEQ ID NO: 46721 - DNA, 35 bp, Artificial Sequence
  Synthetic oligonucleotide
gagcacagatgccccgtcattcctctcgactagca

SEQ ID NO: 46722 - DNA, 35 bp, Artificial Sequence
  Synthetic oligonucleotide
gactctcgcctcttaggacaacccattctccatca

SEQ ID NO: 46723 - DNA, 36 bp, Artificial Sequence
  Synthetic oligonucleotide
gttgagggagaaaggtgaaggtataggcggtagaga

SEQ ID NO: 46724 - DNA, 37 bp, Artificial Sequence
  Synthetic oligonucleotide
tctgataccctgctgtctactaccgtcctcgtaacga

SEQ ID NO: 46725 - DNA, 36 bp, Artificial Sequence
  Synthetic oligonucleotide
tgtgctaatagggaggggtgggagataaaggatgga

SEQ ID NO: 46726 - DNA, 38 bp, Artificial Sequence
  Synthetic oligonucleotide
ttacccgtcccccatacgttctctgtcccggtaactga

SEQ ID NO: 46727 - DNA, 35 bp, Artificial Sequence
  Synthetic oligonucleotide
taacccaaacctggttcacttgcgatcgcccctga

SEQ ID NO: 46728 - DNA, 37 bp, Artificial Sequence
  Synthetic oligonucleotide
tccatcctgcacttttattcctgcaccgcactcctga

SEQ ID NO: 46729 - DNA, 35 bp, Artificial Sequence
  Synthetic oligonucleotide
tatcgatataacagcgctccctcgcctcctgctga

SEQ ID NO: 46730 - DNA, 38 bp, Artificial Sequence
  Synthetic oligonucleotide
acatcccacctggccatttagcccgactatacaattga

SEQ ID NO: 46731 - DNA, 38 bp, Artificial Sequence
  Synthetic oligonucleotide
ttgtcgtctccaccgtgcgtcctagaaaaccccattga

SEQ ID NO: 46732 - DNA, 38 bp, Artificial Sequence
  Synthetic oligonucleotide
aagccagcctccggttcgcctatttgtaacttcgttga

SEQ ID NO: 46733 - DNA, 36 bp, Artificial Sequence
  Synthetic oligonucleotide
gctaaccctacaacgggctcctgttacgctcccata

SEQ ID NO: 46734 - DNA, 36 bp, Artificial Sequence
  Synthetic oligonucleotide
tccgcaccataggtgatccattcgcgcccatgacta

SEQ ID NO: 46735 - DNA, 35 bp, Artificial Sequence
  Synthetic oligonucleotide
attgcacggatagaaggggggaaaagcacagggta

SEQ ID NO: 46736 - DNA, 35 bp, Artificial Sequence
  Synthetic oligonucleotide
aacagctggcgactcggacctcccacacattgtta

SEQ ID NO: 46737 - DNA, 35 bp, Artificial Sequence
  Synthetic oligonucleotide
accagggtgtccctgtccgcactttccttaccaac

SEQ ID NO: 46738 - DNA, 35 bp, Artificial Sequence
  Synthetic oligonucleotide
gtccactccctgcgctagtttttgctttgttatac

SEQ ID NO: 46739 - DNA, 35 bp, Artificial Sequence
  Synthetic oligonucleotide
tcatgactgactcgccctgtaaatagtgccgaacc

SEQ ID NO: 46740 - DNA, 35 bp, Artificial Sequence
  Synthetic oligonucleotide
ggtgggcaccccgcctattgtaactcccgatcacc

SEQ ID NO: 46741 - DNA, 35 bp, Artificial Sequence
  Synthetic oligonucleotide
tccggaacaagccccacacacacgtgttatatacc

SEQ ID NO: 46742 - DNA, 35 bp, Artificial Sequence
  Synthetic oligonucleotide
tcccattcctgattcagttccacgcgaacgttccc

SEQ ID NO: 46743 - DNA, 35 bp, Artificial Sequence
  Synthetic oligonucleotide
gtccctccactagcattcgacctggcgtaagcgcc

SEQ ID NO: 46744 - DNA, 35 bp, Artificial Sequence
  Synthetic oligonucleotide
aacccaggcgtgtcttctgttagcttttcgtccgc

SEQ ID NO: 46745 - DNA, 35 bp, Artificial Sequence
  Synthetic oligonucleotide
acacgcctcgtgtcctaaagcgtacttggttcgtc

SEQ ID NO: 46746 - DNA, 35 bp, Artificial Sequence
  Synthetic oligonucleotide
tcctcactactcttatgtaccctacccagctacgg

SEQ ID NO: 46747 - DNA, 35 bp, Artificial Sequence
  Synthetic oligonucleotide
ttgcaacctcgtttctgtaagctttgactcctctg

SEQ ID NO: 46748 - DNA, 35 bp, Artificial Sequence
  Synthetic oligonucleotide
tgtcacgcgtattttagtcagcccgtcttcgccct

SEQ ID NO: 46749 - DNA, 35 bp, Artificial Sequence
  Synthetic oligonucleotide
atccgacctgacccctctcacccgtccgccggtct

SEQ ID NO: 46750 - DNA, 35 bp, Artificial Sequence
  Synthetic oligonucleotide
ttcaatacaagggcacaacgggggacaggcaaagt

SEQ ID NO: 46751 - DNA, 35 bp, Artificial Sequence
  Synthetic oligonucleotide
aacctgtccgcctagggctctctatctttcaaggt

SEQ ID NO: 46752 - DNA, 35 bp, Artificial Sequence
  Synthetic oligonucleotide
tcacggcatgcataccctttgtctctgtctctggt

SEQ ID NO: 46753 - DNA, 35 bp, Artificial Sequence
  Synthetic oligonucleotide
taggagggtaggtatggtccgggtgaatgggataa

SEQ ID NO: 46754 - DNA, 36 bp, Artificial Sequence
  Synthetic oligonucleotide
tgagtgccgcgctaatccacctgtcacactcgtaca

SEQ ID NO: 46755 - DNA, 36 bp, Artificial Sequence
  Synthetic oligonucleotide
tttcgacaaagcaccagccgaacgaaacactttaca

SEQ ID NO: 46756 - DNA, 35 bp, Artificial Sequence
  Synthetic oligonucleotide
taacatacctgccacgagctacgagttatttccca

SEQ ID NO: 46757 - DNA, 35 bp, Artificial Sequence
  Synthetic oligonucleotide
gccccactcctccgtttcgagtttgcaaatatgca

SEQ ID NO: 46758 - DNA, 36 bp, Artificial Sequence
  Synthetic oligonucleotide
tgattccaacgttgcccgccctactgatctcagtca

SEQ ID NO: 46759 - DNA, 36 bp, Artificial Sequence
  Synthetic oligonucleotide
gcgatacgaccctgattgttgcgcttgcctatttca

SEQ ID NO: 46760 - DNA, 35 bp, Artificial Sequence
  Synthetic oligonucleotide
tttgcacgcaaagactggtgggggggtaggaaaga

SEQ ID NO: 46761 - DNA, 37 bp, Artificial Sequence
  Synthetic oligonucleotide
gcccatcaagcctggcccatctgttctcgcccccaga

SEQ ID NO: 46762 - DNA, 37 bp, Artificial Sequence
  Synthetic oligonucleotide
tatgacccgcggtcagttctatccgctttatcccaga

SEQ ID NO: 46763 - DNA, 37 bp, Artificial Sequence
  Synthetic oligonucleotide
tcgaaaacgccacgttttcatccggtccctccaccga

SEQ ID NO: 46764 - DNA, 37 bp, Artificial Sequence
  Synthetic oligonucleotide
gagggacggggggccgtcaagcgaactacaaaaagga

SEQ ID NO: 46765 - DNA, 37 bp, Artificial Sequence
  Synthetic oligonucleotide
ggtgggaggtcaaggcgagtagcgtggggaggcagga

SEQ ID NO: 46766 - DNA, 37 bp, Artificial Sequence
  Synthetic oligonucleotide
tatggacgtgggggagtggaaaagtagggcaagcgga

SEQ ID NO: 46767 - DNA, 37 bp, Artificial Sequence
  Synthetic oligonucleotide
tacacaaaaaaggaggtgagtacatggttggacggga

SEQ ID NO: 46768 - DNA, 37 bp, Artificial Sequence
  Synthetic oligonucleotide
agtatggggaacgtacggaatagaggtggtcggtgga

SEQ ID NO: 46769 - DNA, 37 bp, Artificial Sequence
  Synthetic oligonucleotide
ggagacggggccgggggggagttaggatgggggtgga

SEQ ID NO: 46770 - DNA, 38 bp, Artificial Sequence
  Synthetic oligonucleotide
atcgaccggtcactttcaagtcttcaattcacacatga

SEQ ID NO: 46771 - DNA, 37 bp, Artificial Sequence
  Synthetic oligonucleotide
gtgcattggtcaagatccgattccaccctgaccatga

SEQ ID NO: 46772 - DNA, 38 bp, Artificial Sequence
  Synthetic oligonucleotide
atcaggccggcgttgtctattttgcccagctccgatga

SEQ ID NO: 46773 - DNA, 38 bp, Artificial Sequence
  Synthetic oligonucleotide
tcccgaccccgctctgtgcacgttttcagtgctactga

SEQ ID NO: 46774 - DNA, 38 bp, Artificial Sequence
  Synthetic oligonucleotide
ttggagaacgcgtatcgtgtcctcaattacttccctga

SEQ ID NO: 46775 - DNA, 37 bp, Artificial Sequence
  Synthetic oligonucleotide
gcgggaagggggcaatattgtgactggtgaggagtga

SEQ ID NO: 46776 - DNA, 38 bp, Artificial Sequence
  Synthetic oligonucleotide
gccaccaacaacggtaaacgcgaacgtacatcccgtga

SEQ ID NO: 46777 - DNA, 38 bp, Artificial Sequence
  Synthetic oligonucleotide
tctgttcccgccgcttctataggccgacgctcccgtga

SEQ ID NO: 46778 - DNA, 37 bp, Artificial Sequence
  Synthetic oligonucleotide
gctgtccccggcggtttgtcccactccttcacgttga

SEQ ID NO: 46779 - DNA, 38 bp, Artificial Sequence
  Synthetic oligonucleotide
tcctggccccatcagcgcctaactggcttactatttga

SEQ ID NO: 46780 - DNA, 38 bp, Artificial Sequence
  Synthetic oligonucleotide
gtggccacccctccaatcccacgcgcttgacagtttga

SEQ ID NO: 46781 - DNA, 35 bp, Artificial Sequence
  Synthetic oligonucleotide
gatccccgcggccactatccattacgttcgtttga

SEQ ID NO: 46782 - DNA, 35 bp, Artificial Sequence
  Synthetic oligonucleotide
atcccagcatacccgtccaccgtcctccagacata

SEQ ID NO: 46783 - DNA, 36 bp, Artificial Sequence
  Synthetic oligonucleotide
caaagcgatcaccttctgtcccaccgtaaaggccta

SEQ ID NO: 46784 - DNA, 35 bp, Artificial Sequence
  Synthetic oligonucleotide
gtcctatgcccttgttgtccctgtgcatttcttta

SEQ ID NO: 46785 - DNA, 35 bp, Artificial Sequence
  Synthetic oligonucleotide
catcgcacccatctgctggccaagcctcgtgacac

SEQ ID NO: 46786 - DNA, 35 bp, Artificial Sequence
  Synthetic oligonucleotide
gataagactgaggaaatgggatgagcagagatgac

SEQ ID NO: 46787 - DNA, 35 bp, Artificial Sequence
  Synthetic oligonucleotide
gaaccgtacccacatactgactagcattctttgac

SEQ ID NO: 46788 - DNA, 35 bp, Artificial Sequence
  Synthetic oligonucleotide
tcttccaaccgccaagactgcattccttgcgtccc

SEQ ID NO: 46789 - DNA, 35 bp, Artificial Sequence
  Synthetic oligonucleotide
tgaatcctaaccagcgctttgcattggcttcatcc

SEQ ID NO: 46790 - DNA, 34 bp, Artificial Sequence
  Synthetic oligonucleotide
atctaactcgacccatgaccacgcatacatgttc

SEQ ID NO: 46791 - DNA, 35 bp, Artificial Sequence
  Synthetic oligonucleotide
attcgcggtgccgcccccccttacaatttaacgcg

SEQ ID NO: 46792 - DNA, 35 bp, Artificial Sequence
  Synthetic oligonucleotide
gtcgtgcgaccgcggcctatacttcctgttcctcg

SEQ ID NO: 46793 - DNA, 35 bp, Artificial Sequence
  Synthetic oligonucleotide
ggatcgaggcattggcgggaaggtaaggcttaggg

SEQ ID NO: 46794 - DNA, 35 bp, Artificial Sequence
  Synthetic oligonucleotide
acacccactctgtcgtacacctttgatctatctgg

SEQ ID NO: 46795 - DNA, 35 bp, Artificial Sequence
  Synthetic oligonucleotide
aatgtagcgatctgtattcgtgtcactcccccctg

SEQ ID NO: 46796 - DNA, 35 bp, Artificial Sequence
  Synthetic oligonucleotide
ggatcatcacagtggtgtctccttgttcatctgtg

SEQ ID NO: 46797 - DNA, 35 bp, Artificial Sequence
  Synthetic oligonucleotide
gtacgacctgcagtgcaccactcctcgcacccttg

SEQ ID NO: 46798 - DNA, 35 bp, Artificial Sequence
  Synthetic oligonucleotide
agtgtggcgagtccttgtttcatgttgccctcttg

SEQ ID NO: 46799 - DNA, 35 bp, Artificial Sequence
  Synthetic oligonucleotide
attgcccaactagctgtacttaaattttggcctat

SEQ ID NO: 46800 - DNA, 35 bp, Artificial Sequence
  Synthetic oligonucleotide
gcccacgcactgacccatgacacgagcacgattat

SEQ ID NO: 46801 - DNA, 35 bp, Artificial Sequence
  Synthetic oligonucleotide
gtctggctcaggctcgtcgcgcttggtcaccttat

SEQ ID NO: 46802 - DNA, 35 bp, Artificial Sequence
  Synthetic oligonucleotide
gcactctgttatagccccgttgctcgttccatgct

SEQ ID NO: 46803 - DNA, 35 bp, Artificial Sequence
  Synthetic oligonucleotide
gtgtgcgggaaggggatagctgagaagggtttggt

SEQ ID NO: 46804 - DNA, 35 bp, Artificial Sequence
  Synthetic oligonucleotide
ttcgccactggttgctagctgttgccgctttcctt

SEQ ID NO: 46805 - DNA, 35 bp, Artificial Sequence
  Synthetic oligonucleotide
gaacgaagccaagcacaatacgccctgataacttt

SEQ ID NO: 46806 - DNA, 35 bp, Artificial Sequence
  Synthetic oligonucleotide
ttgtcgacaccttctcactggtttcatccttcttt

SEQ ID NO: 46807 - DNA, 36 bp, Artificial Sequence
  Synthetic oligonucleotide
gacggaaagggggcggtttgtgagagggaacggaaa

SEQ ID NO: 46808 - DNA, 36 bp, Artificial Sequence
  Synthetic oligonucleotide
gcagaagggcgagtgttgctatgggggggggtacaa

SEQ ID NO: 46809 - DNA, 36 bp, Artificial Sequence
  Synthetic oligonucleotide
ttgacacagagctgtgccaacacttactatcatcaa

SEQ ID NO: 46810 - DNA, 35 bp, Artificial Sequence
  Synthetic oligonucleotide
tcctccacccatcaattgcgccggaattaccagaa

SEQ ID NO: 46811 - DNA, 36 bp, Artificial Sequence
  Synthetic oligonucleotide
agccccatcttcgtcccttgtgcctacatgctcgaa

SEQ ID NO: 46812 - DNA, 36 bp, Artificial Sequence
  Synthetic oligonucleotide
agagaggggaacggacgatttggggcaggggggcca

SEQ ID NO: 46813 - DNA, 36 bp, Artificial Sequence
  Synthetic oligonucleotide
tacggtggagggtggactggcaagtaagcaggaaga

SEQ ID NO: 46814 - DNA, 37 bp, Artificial Sequence
  Synthetic oligonucleotide
ttgacgccctttgcttccgcctttatcagttgcgaga

SEQ ID NO: 46815 - DNA, 37 bp, Artificial Sequence
  Synthetic oligonucleotide
tgtcactcccgcagccacggcctctcacaaaaggaga

SEQ ID NO: 46816 - DNA, 37 bp, Artificial Sequence
  Synthetic oligonucleotide
gtgcatgggccgtgagaggaataggtaggggaggaga

SEQ ID NO: 46817 - DNA, 37 bp, Artificial Sequence
  Synthetic oligonucleotide
actcccgacacccggcacatcaaggtctagccgtaga

SEQ ID NO: 46818 - DNA, 36 bp, Artificial Sequence
  Synthetic oligonucleotide
tcaccgaggcctccctgccctttatagacctcccga

SEQ ID NO: 46819 - DNA, 37 bp, Artificial Sequence
  Synthetic oligonucleotide
agagaacgaaaggggaaagtgagttcgataatggcga

SEQ ID NO: 46820 - DNA, 37 bp, Artificial Sequence
  Synthetic oligonucleotide
tcccatgccaacgtatggcacccctgataacacagga

SEQ ID NO: 46821 - DNA, 37 bp, Artificial Sequence
  Synthetic oligonucleotide
tcgaggaagggatgggatgggctcaaaccggccggga

SEQ ID NO: 46822 - DNA, 37 bp, Artificial Sequence
  Synthetic oligonucleotide
tcagaactgcatggtgagcggggggtaggtacgggga

SEQ ID NO: 46823 - DNA, 38 bp, Artificial Sequence
  Synthetic oligonucleotide
tcacaatccacgcactactataagacgcttgtccatga

SEQ ID NO: 46824 - DNA, 37 bp, Artificial Sequence
  Synthetic oligonucleotide
gcgtcggtgcctgtttttttttgtttaccatcgatga

SEQ ID NO: 46825 - DNA, 38 bp, Artificial Sequence
  Synthetic oligonucleotide
tgcgacgcacgcgattagcgtcctacttgtaccactga

SEQ ID NO: 46826 - DNA, 38 bp, Artificial Sequence
  Synthetic oligonucleotide
tacgcggaagtgcacgccaccccccctgaaccgactga

SEQ ID NO: 46827 - DNA, 37 bp, Artificial Sequence
  Synthetic oligonucleotide
tatgccgcatattataactcgatgctgctctccgtga

SEQ ID NO: 46828 - DNA, 38 bp, Artificial Sequence
  Synthetic oligonucleotide
atcaccatacgacgaccttaacctgtcaacctctgtga

SEQ ID NO: 46829 - DNA, 38 bp, Artificial Sequence
  Synthetic oligonucleotide
gggcgaacgccgtgagcacactctcacacccaacttga

SEQ ID NO: 46830 - DNA, 38 bp, Artificial Sequence
  Synthetic oligonucleotide
gctgtacgcgctagcattgatttcccctatcaccttga

SEQ ID NO: 46831 - DNA, 38 bp, Artificial Sequence
  Synthetic oligonucleotide
gtcaaggcaagcctgttattcgcacccccacatcttga

SEQ ID NO: 46832 - DNA, 37 bp, Artificial Sequence
  Synthetic oligonucleotide
ccacgggtgcctcccatgtttcgccgaccacatttga

SEQ ID NO: 46833 - DNA, 37 bp, Artificial Sequence
  Synthetic oligonucleotide
tctagcaacgatccctgggacctccgccttcgtttga

SEQ ID NO: 46834 - DNA, 36 bp, Artificial Sequence
  Synthetic oligonucleotide
ttagagcaacagcgagagctgaggcgacttacacta

SEQ ID NO: 46835 - DNA, 35 bp, Artificial Sequence
  Synthetic oligonucleotide
tttctgccatcaccagccctgatcaagcccttcta

SEQ ID NO: 46836 - DNA, 36 bp, Artificial Sequence
  Synthetic oligonucleotide
tcctgtgcgtctctattgccccagccaccgcttgta

SEQ ID NO: 46837 - DNA, 35 bp, Artificial Sequence
  Synthetic oligonucleotide
tatgccgggctgtaactagaattcgatgatcttac

SEQ ID NO: 46838 - DNA, 35 bp, Artificial Sequence
  Synthetic oligonucleotide
ttgccccactcgttgcagagcttgctgccctgtcc

SEQ ID NO: 46839 - DNA, 35 bp, Artificial Sequence
  Synthetic oligonucleotide
acgaacccactcatatcctgcgtaaacgcttaacg

SEQ ID NO: 46840 - DNA, 35 bp, Artificial Sequence
  Synthetic oligonucleotide
tacctagcggaactccatttcatacccttccggcg

SEQ ID NO: 46841 - DNA, 35 bp, Artificial Sequence
  Synthetic oligonucleotide
gtaggacgggagaagcgggtatagaaagttggatg

SEQ ID NO: 46842 - DNA, 35 bp, Artificial Sequence
  Synthetic oligonucleotide
atacccggccatgttttcactcgcctaaagtacct

SEQ ID NO: 46843 - DNA, 35 bp, Artificial Sequence
  Synthetic oligonucleotide
tcccactaccgctagggaaccataacacttagcct

SEQ ID NO: 46844 - DNA, 35 bp, Artificial Sequence
  Synthetic oligonucleotide
ttgcagggcagttcattcatggccaccatcttagt

SEQ ID NO: 46845 - DNA, 35 bp, Artificial Sequence
  Synthetic oligonucleotide
atatagcgccggccatcggtgccatctctgctttt

SEQ ID NO: 46846 - DNA, 35 bp, Artificial Sequence
  Synthetic oligonucleotide
gtcaccctagctcttctcttgtttagttggcgaaa

SEQ ID NO: 46847 - DNA, 36 bp, Artificial Sequence
  Synthetic oligonucleotide
gtaccactctgacgcccaacctatgcgcccccctca

SEQ ID NO: 46848 - DNA, 37 bp, Artificial Sequence
  Synthetic oligonucleotide
gcctccgtgagcggtttttaacgcacacccatcccga

SEQ ID NO: 46849 - DNA, 37 bp, Artificial Sequence
  Synthetic oligonucleotide
gattctcgcgaactgcctcccatttaggtctactcga

SEQ ID NO: 46850 - DNA, 36 bp, Artificial Sequence
  Synthetic oligonucleotide
tcacgatcattactgcaaacaggcctctcgcctcga

SEQ ID NO: 46851 - DNA, 36 bp, Artificial Sequence
  Synthetic oligonucleotide
aaggacgtgctgacacggatgggggagggcaaagga

SEQ ID NO: 46852 - DNA, 36 bp, Artificial Sequence
  Synthetic oligonucleotide
aagatgaaggctgggaaggaccggagggtgaaagga

SEQ ID NO: 46853 - DNA, 37 bp, Artificial Sequence
  Synthetic oligonucleotide
tgaccacctatctgcctacttaatcccggtattggga

SEQ ID NO: 46854 - DNA, 37 bp, Artificial Sequence
  Synthetic oligonucleotide
ttgctacgtaacagtggcactctctatcttcgctgga

SEQ ID NO: 46855 - DNA, 37 bp, Artificial Sequence
  Synthetic oligonucleotide
tagtcagcctcctcctttctctcgtcgcccgtgtgga

SEQ ID NO: 46856 - DNA, 38 bp, Artificial Sequence
  Synthetic oligonucleotide
gtgcctgggggtaggtggcaactagggatcgggaatga

SEQ ID NO: 46857 - DNA, 38 bp, Artificial Sequence
  Synthetic oligonucleotide
ggtacccacacagctgccattagctcctattttcatga

SEQ ID NO: 46858 - DNA, 37 bp, Artificial Sequence
  Synthetic oligonucleotide
atgccgcacaccacgcgctttgacgattaatacttga

SEQ ID NO: 46859 - DNA, 37 bp, Artificial Sequence
  Synthetic oligonucleotide
aatgggaggggagggccgcgaggaaatgggaccttga

SEQ ID NO: 46860 - DNA, 38 bp, Artificial Sequence
  Synthetic oligonucleotide
agcaccgctaggcaacccactctgctcccaatccttga

SEQ ID NO: 46861 - DNA, 38 bp, Artificial Sequence
  Synthetic oligonucleotide
acattacccacattgatcggattatgacctttccttga

SEQ ID NO: 46862 - DNA, 37 bp, Artificial Sequence
  Synthetic oligonucleotide
gttctgcctccacggttcgaccttgtctccctcttga

SEQ ID NO: 46863 - DNA, 38 bp, Artificial Sequence
  Synthetic oligonucleotide
gacgcatcaggaggattgaagatggatgcatggtttga

SEQ ID NO: 46864 - DNA, 36 bp, Artificial Sequence
  Synthetic oligonucleotide
aacgaggcctgcctccatgccccacttttgtaatta

SEQ ID NO: 46865 - DNA, 35 bp, Artificial Sequence
  Synthetic oligonucleotide
atcacaattgccgtcggttcattcggccaccttta

SEQ ID NO: 46866 - DNA, 35 bp, Artificial Sequence
  Synthetic oligonucleotide
attgtttcgccacatcctgtaaacgggtatcctcc

SEQ ID NO: 46867 - DNA, 35 bp, Artificial Sequence
  Synthetic oligonucleotide
tcatgtccagctcacctctctcccatttatgtggc

SEQ ID NO: 46868 - DNA, 35 bp, Artificial Sequence
  Synthetic oligonucleotide
tactcactcccacgctgagcatctctcaaatttgc

SEQ ID NO: 46869 - DNA, 35 bp, Artificial Sequence
  Synthetic oligonucleotide
ttgaacgccggtgcctgcctgcaattgaaactgtc

SEQ ID NO: 46870 - DNA, 35 bp, Artificial Sequence
  Synthetic oligonucleotide
gggcaaagccgctcgtgctgcccatcccactattc

SEQ ID NO: 46871 - DNA, 35 bp, Artificial Sequence
  Synthetic oligonucleotide
tcacatacatcctgacatataggttatggctcttc

SEQ ID NO: 46872 - DNA, 35 bp, Artificial Sequence
  Synthetic oligonucleotide
gcatgcacagtacagccctggggcacaccattttc

SEQ ID NO: 46873 - DNA, 35 bp, Artificial Sequence
  Synthetic oligonucleotide
ggacaccgcacacgccttgcgaaaggcctcactcg

SEQ ID NO: 46874 - DNA, 35 bp, Artificial Sequence
  Synthetic oligonucleotide
gattagttgggtgggaagaggcgggagtgcggtcg

SEQ ID NO: 46875 - DNA, 35 bp, Artificial Sequence
  Synthetic oligonucleotide
gccacatctgcatcgacccgacacattcgctcgtg

SEQ ID NO: 46876 - DNA, 35 bp, Artificial Sequence
  Synthetic oligonucleotide
acattcacctgtcctggatgccgccggacctttat

SEQ ID NO: 46877 - DNA, 35 bp, Artificial Sequence
  Synthetic oligonucleotide
ttagcgttggccgtacgtcctcccatcatgcatct

SEQ ID NO: 46878 - DNA, 35 bp, Artificial Sequence
  Synthetic oligonucleotide
gtcgggccacaggaccgcgtacaactacacttgtt

SEQ ID NO: 46879 - DNA, 36 bp, Artificial Sequence
  Synthetic oligonucleotide
tgatggaggataggtgtagtgggaagggcaaacgaa

SEQ ID NO: 46880 - DNA, 35 bp, Artificial Sequence
  Synthetic oligonucleotide
gacactccccgcaagcctaggtgcgctagcataca

SEQ ID NO: 46881 - DNA, 36 bp, Artificial Sequence
  Synthetic oligonucleotide
attgcatgcacactacattgctcattgacgtgacca

SEQ ID NO: 46882 - DNA, 35 bp, Artificial Sequence
  Synthetic oligonucleotide
aacacaccctcctggtgaccagtacgtgcacccca

SEQ ID NO: 46883 - DNA, 36 bp, Artificial Sequence
  Synthetic oligonucleotide
gtatccacagcctcagcatccgtcgcccctgcccca

SEQ ID NO: 46884 - DNA, 37 bp, Artificial Sequence
  Synthetic oligonucleotide
gtcaatgaggggagcatggaaattgtcggacaaacga

SEQ ID NO: 46885 - DNA, 36 bp, Artificial Sequence
  Synthetic oligonucleotide
gtcagatcatccgccgcccaatccgctcgtctacga

SEQ ID NO: 46886 - DNA, 37 bp, Artificial Sequence
  Synthetic oligonucleotide
gtggggtgggcgctacgaaattgggacaagtcatcga

SEQ ID NO: 46887 - DNA, 37 bp, Artificial Sequence
  Synthetic oligonucleotide
tccccttgacatcctggttttgttgcctagccttcga

SEQ ID NO: 46888 - DNA, 37 bp, Artificial Sequence
  Synthetic oligonucleotide
agagacgtgaggccggctgaagaataagtgggaagga

SEQ ID NO: 46889 - DNA, 37 bp, Artificial Sequence
  Synthetic oligonucleotide
tgtagcatggggcaattgggggagggcatatgtagga

SEQ ID NO: 46890 - DNA, 37 bp, Artificial Sequence
  Synthetic oligonucleotide
gacgccctggttactctgctgcctactaatatcggga

SEQ ID NO: 46891 - DNA, 37 bp, Artificial Sequence
  Synthetic oligonucleotide
gacgcagacgagacagtaagaagggccaaaggatgga

SEQ ID NO: 46892 - DNA, 36 bp, Artificial Sequence
  Synthetic oligonucleotide
gccgcccccacagctccgcggattgtcccttttgga

SEQ ID NO: 46893 - DNA, 38 bp, Artificial Sequence
  Synthetic oligonucleotide
tgacttaccccagcagatcggtcgcaccatggccatga

SEQ ID NO: 46894 - DNA, 38 bp, Artificial Sequence
  Synthetic oligonucleotide
taccagtcagttactaccacgcgccatctgctgactga

SEQ ID NO: 46895 - DNA, 38 bp, Artificial Sequence
  Synthetic oligonucleotide
atcccccgcggatcctgcgtctgaccttccttctctga

SEQ ID NO: 46896 - DNA, 36 bp, Artificial Sequence
  Synthetic oligonucleotide
tcccacactcaagccgagaccccgtacattccgtga

SEQ ID NO: 46897 - DNA, 38 bp, Artificial Sequence
  Synthetic oligonucleotide
atgcacgctcgaggagaaaacataggggaaaggcgtga

SEQ ID NO: 46898 - DNA, 37 bp, Artificial Sequence
  Synthetic oligonucleotide
tgtactgcggtgcgcgggggagattgatcgggggtga

SEQ ID NO: 46899 - DNA, 37 bp, Artificial Sequence
  Synthetic oligonucleotide
ataccaccacttgcgaacgccgcagttctatacttga

SEQ ID NO: 46900 - DNA, 38 bp, Artificial Sequence
  Synthetic oligonucleotide
acgagaccagccgttgtaccctgccagccccgatttga

SEQ ID NO: 46901 - DNA, 35 bp, Artificial Sequence
  Synthetic oligonucleotide
tccgcacggcccaccttagagcgcctggatccacc

SEQ ID NO: 46902 - DNA, 35 bp, Artificial Sequence
  Synthetic oligonucleotide
gctgcgggtagccacgccggcaacaattttgcacc

SEQ ID NO: 46903 - DNA, 35 bp, Artificial Sequence
  Synthetic oligonucleotide
agattgtctctgccattatccttttgagcccatcc

SEQ ID NO: 46904 - DNA, 35 bp, Artificial Sequence
  Synthetic oligonucleotide
gtccgaagctgggcactttggcgctatcttttttc

SEQ ID NO: 46905 - DNA, 35 bp, Artificial Sequence
  Synthetic oligonucleotide
attcgtgcacccctcggccgcctagacgccaaacg

SEQ ID NO: 46906 - DNA, 35 bp, Artificial Sequence
  Synthetic oligonucleotide
tgttatcacggcacatctaccctgcttcctttgcg

SEQ ID NO: 46907 - DNA, 34 bp, Artificial Sequence
  Synthetic oligonucleotide
gacctgctaactgtacttttatctcctctaacgg

SEQ ID NO: 46908 - DNA, 35 bp, Artificial Sequence
  Synthetic oligonucleotide
aaacatggcggagtaccatcaatacctacacttgg

SEQ ID NO: 46909 - DNA, 35 bp, Artificial Sequence
  Synthetic oligonucleotide
taccaacccctgttatgagcattacgaacctactg

SEQ ID NO: 46910 - DNA, 35 bp, Artificial Sequence
  Synthetic oligonucleotide
aactgggaagttagggtgtcaaggggaaggtcaat

SEQ ID NO: 46911 - DNA, 35 bp, Artificial Sequence
  Synthetic oligonucleotide
tatgggcctggtcctttgtaattccttgcctccat

SEQ ID NO: 46912 - DNA, 35 bp, Artificial Sequence
  Synthetic oligonucleotide
aacaggtgccgtacgggggggtggagcattagtat

SEQ ID NO: 46913 - DNA, 35 bp, Artificial Sequence
  Synthetic oligonucleotide
gctctgcccagcggaagtcatccggaaccttttat

SEQ ID NO: 46914 - DNA, 35 bp, Artificial Sequence
  Synthetic oligonucleotide
acgtggacaacagctttcctcacgccttccttagt

SEQ ID NO: 46915 - DNA, 35 bp, Artificial Sequence
  Synthetic oligonucleotide
gacattagaggggaggagtggctaacagtgctatt

SEQ ID NO: 46916 - DNA, 35 bp, Artificial Sequence
  Synthetic oligonucleotide
tttgcgccttgcacgtggcttccgacttctttgtt

SEQ ID NO: 46917 - DNA, 35 bp, Artificial Sequence
  Synthetic oligonucleotide
ttagcctaacctcagcacattagcatccccggttt

SEQ ID NO: 46918 - DNA, 36 bp, Artificial Sequence
  Synthetic oligonucleotide
tacgccgaccgagcgtacatacattacatcacacaa

SEQ ID NO: 46919 - DNA, 36 bp, Artificial Sequence
  Synthetic oligonucleotide
tcctgcgctggctgcccaacttttccttttgaccaa

SEQ ID NO: 46920 - DNA, 36 bp, Artificial Sequence
  Synthetic oligonucleotide
gccgtccacactctgcgttactcgctttggtctcaa

SEQ ID NO: 46921 - DNA, 35 bp, Artificial Sequence
  Synthetic oligonucleotide
tacaccctacccctttacgctcgttacgtgagtaa

SEQ ID NO: 46922 - DNA, 36 bp, Artificial Sequence
  Synthetic oligonucleotide
tcccctgcctcggaacaatagtgccctgggtgaaca

SEQ ID NO: 46923 - DNA, 36 bp, Artificial Sequence
  Synthetic oligonucleotide
gtacgcttcgatctgtctactcaccatttgcctcca

SEQ ID NO: 46924 - DNA, 35 bp, Artificial Sequence
  Synthetic oligonucleotide
actgctcgcgtaacttccccttttcgccggttgca

SEQ ID NO: 46925 - DNA, 35 bp, Artificial Sequence
  Synthetic oligonucleotide
aactctgccccagtagtccaccctggccattctca

SEQ ID NO: 46926 - DNA, 36 bp, Artificial Sequence
  Synthetic oligonucleotide
gaaggaaggagagggcgaagtcgggttggcgagaga

SEQ ID NO: 46927 - DNA, 37 bp, Artificial Sequence
  Synthetic oligonucleotide
tgccacccacgaccatcacctactgctacgaccacga

SEQ ID NO: 46928 - DNA, 37 bp, Artificial Sequence
  Synthetic oligonucleotide
tctgcctgccctcactcatacaccgcctactagccga

SEQ ID NO: 46929 - DNA, 36 bp, Artificial Sequence
  Synthetic oligonucleotide
gtagtcccatggccgtgttcgtccttcatttgccga

SEQ ID NO: 46930 - DNA, 35 bp, Artificial Sequence
  Synthetic oligonucleotide
atgctacaccgccgactttacttggacttcaggga

SEQ ID NO: 46931 - DNA, 37 bp, Artificial Sequence
  Synthetic oligonucleotide
gtgggaggatatgcaggaggggatctttcgtgcggga

SEQ ID NO: 46932 - DNA, 36 bp, Artificial Sequence
  Synthetic oligonucleotide
gagcatgtgggcacaacattcgaggggtggatggga

SEQ ID NO: 46933 - DNA, 37 bp, Artificial Sequence
  Synthetic oligonucleotide
tctgtgggagtggagggaggcgaaatccaggttggga

SEQ ID NO: 46934 - DNA, 37 bp, Artificial Sequence
  Synthetic oligonucleotide
ttgaaggcgtagcagggagtaggaagggcatgttgga

SEQ ID NO: 46935 - DNA, 38 bp, Artificial Sequence
  Synthetic oligonucleotide
agctgggaaggaagtaagccaaaaggggggcgggatga

SEQ ID NO: 46936 - DNA, 38 bp, Artificial Sequence
  Synthetic oligonucleotide
gtcacgtacccacgtcctcacacaagccatcttgatga

SEQ ID NO: 46937 - DNA, 37 bp, Artificial Sequence
  Synthetic oligonucleotide
atggtggagggggagtgtaaaacatagcgtagtatga

SEQ ID NO: 46938 - DNA, 36 bp, Artificial Sequence
  Synthetic oligonucleotide
gcatagcccctcaattgcggtgaaatccttacctga

SEQ ID NO: 46939 - DNA, 37 bp, Artificial Sequence
  Synthetic oligonucleotide
aaccctccgaccctgttatccaccgctatggatctga

SEQ ID NO: 46940 - DNA, 37 bp, Artificial Sequence
  Synthetic oligonucleotide
tgagcccgtgggctgggctgggaggccttgggggtga

SEQ ID NO: 46941 - DNA, 36 bp, Artificial Sequence
  Synthetic oligonucleotide
atcgcacgtctcccgctcctccctctctgcctgcta

SEQ ID NO: 46942 - DNA, 36 bp, Artificial Sequence
  Synthetic oligonucleotide
acggagcaaggaaacaattgggaacggggcggggta

SEQ ID NO: 46943 - DNA, 36 bp, Artificial Sequence
  Synthetic oligonucleotide
tgatccatcggatctctggttaccgcctttacgtta

SEQ ID NO: 46944 - DNA, 35 bp, Artificial Sequence
  Synthetic oligonucleotide
attgacccacatgggtgtgacataacaccgtaaac

SEQ ID NO: 46945 - DNA, 35 bp, Artificial Sequence
  Synthetic oligonucleotide
gcacaagccaaccatcgcctcctcgcgaataccac

SEQ ID NO: 46946 - DNA, 35 bp, Artificial Sequence
  Synthetic oligonucleotide
ttgaccacacctcggtatcgtgagcactactcgac

SEQ ID NO: 46947 - DNA, 35 bp, Artificial Sequence
  Synthetic oligonucleotide
gtgcgacacatctggtccaccattgacgccaaacc

SEQ ID NO: 46948 - DNA, 35 bp, Artificial Sequence
  Synthetic oligonucleotide
gcaggtcactagcgaggcgccttcctgtacatacc

SEQ ID NO: 46949 - DNA, 35 bp, Artificial Sequence
  Synthetic oligonucleotide
tgtgagcacttattgtcgtactcgttgtaccaccc

SEQ ID NO: 46950 - DNA, 35 bp, Artificial Sequence
  Synthetic oligonucleotide
gaccctctagcagccggtgacgactctctattccc

SEQ ID NO: 46951 - DNA, 35 bp, Artificial Sequence
  Synthetic oligonucleotide
tatgccatacccgggggcgtacgtacaactggtcc

SEQ ID NO: 46952 - DNA, 35 bp, Artificial Sequence
  Synthetic oligonucleotide
aaccacgccgtgcagtgattctcaccatcttgtcc

SEQ ID NO: 46953 - DNA, 35 bp, Artificial Sequence
  Synthetic oligonucleotide
acgagaggcgtttcagcagttctatcttcccccgc

SEQ ID NO: 46954 - DNA, 35 bp, Artificial Sequence
  Synthetic oligonucleotide
gagagcgctcctgccctccatcgaagtaattgcgc

SEQ ID NO: 46955 - DNA, 35 bp, Artificial Sequence
  Synthetic oligonucleotide
acacgactaagctgcaagcacacggatcaacttgc

SEQ ID NO: 46956 - DNA, 35 bp, Artificial Sequence
  Synthetic oligonucleotide
atgtactccccgacggaagcaactcgccgcctttc

SEQ ID NO: 46957 - DNA, 35 bp, Artificial Sequence
  Synthetic oligonucleotide
gccaaccttgccaactcatccagtcgctatcgtgg

SEQ ID NO: 46958 - DNA, 35 bp, Artificial Sequence
  Synthetic oligonucleotide
tctcatcccttatatcttgccttgtgaacagcctg

SEQ ID NO: 46959 - DNA, 35 bp, Artificial Sequence
  Synthetic oligonucleotide
ttgcgcttagtcagtcgttcacccttacccccttg

SEQ ID NO: 46960 - DNA, 35 bp, Artificial Sequence
  Synthetic oligonucleotide
gcgaacgtccatctttctgttttggtcccgagttg

SEQ ID NO: 46961 - DNA, 35 bp, Artificial Sequence
  Synthetic oligonucleotide
ggacagtacgttggaagaggggggggttatagggt

SEQ ID NO: 46962 - DNA, 35 bp, Artificial Sequence
  Synthetic oligonucleotide
tactatcctacgccgactacttggtccgccccgtt

SEQ ID NO: 46963 - DNA, 36 bp, Artificial Sequence
  Synthetic oligonucleotide
accaccccgtctctcatcgtcgttagttcatgtcaa

SEQ ID NO: 46964 - DNA, 36 bp, Artificial Sequence
  Synthetic oligonucleotide
atcccaacgcctaccacctccttacaccgcgggtaa

SEQ ID NO: 46965 - DNA, 36 bp, Artificial Sequence
  Synthetic oligonucleotide
gaggagtggggggttattggggataaggtcggggca

SEQ ID NO: 46966 - DNA, 36 bp, Artificial Sequence
  Synthetic oligonucleotide
ttacctgccacccttatcgagtaaatcgtcctgtca

SEQ ID NO: 46967 - DNA, 36 bp, Artificial Sequence
  Synthetic oligonucleotide
gttgggggggccaccaggtggaagagggaatgttca

SEQ ID NO: 46968 - DNA, 36 bp, Artificial Sequence
  Synthetic oligonucleotide
attggtcggtggggtgggtgaggaaccggccggaga

SEQ ID NO: 46969 - DNA, 37 bp, Artificial Sequence
  Synthetic oligonucleotide
gatgcaccatgtcgctttcttacccatgcccgttaga

SEQ ID NO: 46970 - DNA, 37 bp, Artificial Sequence
  Synthetic oligonucleotide
gacgaggcctcgcccccagttttgcgcaattaaccga

SEQ ID NO: 46971 - DNA, 36 bp, Artificial Sequence
  Synthetic oligonucleotide
tgccacgcacactttcggctccaggtactcctccga

SEQ ID NO: 46972 - DNA, 37 bp, Artificial Sequence
  Synthetic oligonucleotide
agtgcgaaaggtggcgtggtaggggaaaccggatcga

SEQ ID NO: 46973 - DNA, 36 bp, Artificial Sequence
  Synthetic oligonucleotide
gttctgcatcccagtcacacgcaccaattccttcga

SEQ ID NO: 46974 - DNA, 38 bp, Artificial Sequence
  Synthetic oligonucleotide
tgctacctctgcgcactcccagccctcaagaacactga

SEQ ID NO: 46975 - DNA, 38 bp, Artificial Sequence
  Synthetic oligonucleotide
ccggtgggcgctctacatcctgcccacatggaccctga

SEQ ID NO: 46976 - DNA, 38 bp, Artificial Sequence
  Synthetic oligonucleotide
tccaaggcacatggcatgaatctcgcctactaccctga

SEQ ID NO: 46977 - DNA, 37 bp, Artificial Sequence
  Synthetic oligonucleotide
tcccattccgcctctggttcgattaacgcttggttga

SEQ ID NO: 46978 - DNA, 38 bp, Artificial Sequence
  Synthetic oligonucleotide
tgctacctcatcgtgacgcatagtaaccgctttgttga

SEQ ID NO: 46979 - DNA, 36 bp, Artificial Sequence
  Synthetic oligonucleotide
gcctatgcgccatctcgttcactgcctgccttgata

SEQ ID NO: 46980 - DNA, 36 bp, Artificial Sequence
  Synthetic oligonucleotide
tgcacccgctggtacccgttaccgacaaacgatcta

SEQ ID NO: 46981 - DNA, 34 bp, Artificial Sequence
  Synthetic oligonucleotide
tgtgaccccgcactgagatttctgccctcgtcta

SEQ ID NO: 46982 - DNA, 36 bp, Artificial Sequence
  Synthetic oligonucleotide
tcgaggaggtacaattgtccatcctgcccactttta

SEQ ID NO: 46983 - DNA, 35 bp, Artificial Sequence
  Synthetic oligonucleotide
tctagacacgccccggaatggcaaactgttgtacc

SEQ ID NO: 46984 - DNA, 35 bp, Artificial Sequence
  Synthetic oligonucleotide
gctaaagcgcggctttcctctttaccaacggcccc

SEQ ID NO: 46985 - DNA, 35 bp, Artificial Sequence
  Synthetic oligonucleotide
tacatctgccttatatgtacctagtacgcggtgcc

SEQ ID NO: 46986 - DNA, 35 bp, Artificial Sequence
  Synthetic oligonucleotide
agcacggcctgacttttcgcgagttcttactatcc

SEQ ID NO: 46987 - DNA, 35 bp, Artificial Sequence
  Synthetic oligonucleotide
gcctcacctcattatctaattcgaacgggtgttcc

SEQ ID NO: 46988 - DNA, 35 bp, Artificial Sequence
  Synthetic oligonucleotide
taacgtgctacaccatatcacttggccaccaacgc

SEQ ID NO: 46989 - DNA, 35 bp, Artificial Sequence
  Synthetic oligonucleotide
tcacctctggctgcaatgctctgcctcgccgtggc

SEQ ID NO: 46990 - DNA, 35 bp, Artificial Sequence
  Synthetic oligonucleotide
atgaacataccgtgcgctatctgccatgcacaatc

SEQ ID NO: 46991 - DNA, 36 bp, Artificial Sequence
  Synthetic oligonucleotide
actgccgggtggaattctcgtgctactgtcgctctc

SEQ ID NO: 46992 - DNA, 35 bp, Artificial Sequence
  Synthetic oligonucleotide
aacccatccgtggcgagtcattttttgccgcgttc

SEQ ID NO: 46993 - DNA, 35 bp, Artificial Sequence
  Synthetic oligonucleotide
aacccgaaaggtgggggaatagggagcgaagggcg

SEQ ID NO: 46994 - DNA, 35 bp, Artificial Sequence
  Synthetic oligonucleotide
gcttagcactgctcgtacgttaaccatctgcgctg

SEQ ID NO: 46995 - DNA, 35 bp, Artificial Sequence
  Synthetic oligonucleotide
ttcaacagccgccgcacgattcaactcttaccttg

SEQ ID NO: 46996 - DNA, 35 bp, Artificial Sequence
  Synthetic oligonucleotide
aacaaggccgatcggaggtcttcttttctggtcat

SEQ ID NO: 46997 - DNA, 35 bp, Artificial Sequence
  Synthetic oligonucleotide
gcctcatggtttctactgcctgcccttttgttcct

SEQ ID NO: 46998 - DNA, 35 bp, Artificial Sequence
  Synthetic oligonucleotide
gtacaatacaccctcctagtcgctcttcgctagct

SEQ ID NO: 46999 - DNA, 35 bp, Artificial Sequence
  Synthetic oligonucleotide
gttcccctcccatgtttacagccactggcctggct

SEQ ID NO: 47000 - DNA, 35 bp, Artificial Sequence
  Synthetic oligonucleotide
gagaagaggtacgggagcgattgcgagagggtgct

SEQ ID NO: 47001 - DNA, 35 bp, Artificial Sequence
  Synthetic oligonucleotide
attgcgacaccacgcccggacgtcaggccctatct

SEQ ID NO: 47002 - DNA, 35 bp, Artificial Sequence
  Synthetic oligonucleotide
gtccggcggtcacgtcatgccagctatcctccctt

SEQ ID NO: 47003 - DNA, 35 bp, Artificial Sequence
  Synthetic oligonucleotide
tggacccttaactggttttcgcgcacacaagcttt

SEQ ID NO: 47004 - DNA, 35 bp, Artificial Sequence
  Synthetic oligonucleotide
tgatggcgggaggacaaaaaagggagcgtgtacaa

SEQ ID NO: 47005 - DNA, 36 bp, Artificial Sequence
  Synthetic oligonucleotide
taggacctgagcccgtcccatgctgcctgctcataa

SEQ ID NO: 47006 - DNA, 36 bp, Artificial Sequence
  Synthetic oligonucleotide
tagctcgcctgcccttcatgagttgatctctgcaca

SEQ ID NO: 47007 - DNA, 36 bp, Artificial Sequence
  Synthetic oligonucleotide
tttggaacgccccaatagtaacgatatcgcctcaca

SEQ ID NO: 47008 - DNA, 36 bp, Artificial Sequence
  Synthetic oligonucleotide
aacaactgcacacactttatttctcactgtgtctca

SEQ ID NO: 47009 - DNA, 37 bp, Artificial Sequence
  Synthetic oligonucleotide
aagatgggcttggcgggggagaagctgggaggatcga

SEQ ID NO: 47010 - DNA, 37 bp, Artificial Sequence
  Synthetic oligonucleotide
gccgggggtgaagataggaatggatcggggttctcga

SEQ ID NO: 47011 - DNA, 37 bp, Artificial Sequence
  Synthetic oligonucleotide
tgggaggggacggagggagtagacggtctaataagga

SEQ ID NO: 47012 - DNA, 37 bp, Artificial Sequence
  Synthetic oligonucleotide
gtgtgagactggggcgggggtggtcgtggtggtagga

SEQ ID NO: 47013 - DNA, 37 bp, Artificial Sequence
  Synthetic oligonucleotide
attggggtggcctgaggaagggagggagggggtcgga

SEQ ID NO: 47014 - DNA, 37 bp, Artificial Sequence
  Synthetic oligonucleotide
attatacgcggggtggcaaataggggtgggcttcgga

SEQ ID NO: 47015 - DNA, 37 bp, Artificial Sequence
  Synthetic oligonucleotide
gtgagattggcgaaagggtgagggggcgtgctgggga

SEQ ID NO: 47016 - DNA, 35 bp, Artificial Sequence
  Synthetic oligonucleotide
acatccactcctgtaccgttttgcctgttgaatga

SEQ ID NO: 47017 - DNA, 38 bp, Artificial Sequence
  Synthetic oligonucleotide
gaggacccgttcacttcgtctttccacttgattcatga

SEQ ID NO: 47018 - DNA, 38 bp, Artificial Sequence
  Synthetic oligonucleotide
gacgctacacccacgctgcccgcttatcgccttcatga

SEQ ID NO: 47019 - DNA, 38 bp, Artificial Sequence
  Synthetic oligonucleotide
tactacccggtggtgtaaggcactcttctttaacctga

SEQ ID NO: 47020 - DNA, 38 bp, Artificial Sequence
  Synthetic oligonucleotide
tccctcctagccgcgcatccgcctgaagccatgcctga

SEQ ID NO: 47021 - DNA, 36 bp, Artificial Sequence
  Synthetic oligonucleotide
gttgaccccccgatagttaggagccatccacgctga

SEQ ID NO: 47022 - DNA, 38 bp, Artificial Sequence
  Synthetic oligonucleotide
tcaccacgtatgccattagtctgttccatctttagtga

SEQ ID NO: 47023 - DNA, 38 bp, Artificial Sequence
  Synthetic oligonucleotide
tcattctcctgccccgtgagacgccgcgttatacgtga

SEQ ID NO: 47024 - DNA, 38 bp, Artificial Sequence
  Synthetic oligonucleotide
agcaacccgccaactcatagctgctcctattctcgtga

SEQ ID NO: 47025 - DNA, 38 bp, Artificial Sequence
  Synthetic oligonucleotide
agagacggcgcctccatcttgccattaacacgaattga

SEQ ID NO: 47026 - DNA, 38 bp, Artificial Sequence
  Synthetic oligonucleotide
tgcactcacagtctctgttcgatcagacttactcttga

SEQ ID NO: 47027 - DNA, 38 bp, Artificial Sequence
  Synthetic oligonucleotide
acgagtaggaatgaggctgggaacatgcgggtctttga

SEQ ID NO: 47028 - DNA, 36 bp, Artificial Sequence
  Synthetic oligonucleotide
actaacctcggaccgggcctttgctacctattaata

SEQ ID NO: 47029 - DNA, 36 bp, Artificial Sequence
  Synthetic oligonucleotide
gtccaactgctctgcaccctcgaatgactctcgata

SEQ ID NO: 47030 - DNA, 36 bp, Artificial Sequence
  Synthetic oligonucleotide
tcaccacctgggtatcgggctacaacatacgctcta

SEQ ID NO: 47031 - DNA, 36 bp, Artificial Sequence
  Synthetic oligonucleotide
gataaatgctgaagggggataatggtggctgaggta

SEQ ID NO: 47032 - DNA, 35 bp, Artificial Sequence
  Synthetic oligonucleotide
gttcagatacgggagggagggatccggtaagggta

SEQ ID NO: 47033 - DNA, 36 bp, Artificial Sequence
  Synthetic oligonucleotide
tcccgctcggtaggccttctgaacaatccccttgta

SEQ ID NO: 47034 - DNA, 35 bp, Artificial Sequence
  Synthetic oligonucleotide
acgccgctgtgccttccacctgaccccaccgctta

SEQ ID NO: 47035 - DNA, 35 bp, Artificial Sequence
  Synthetic oligonucleotide
gctacggtcattagagctcctccccctgatcaacc

SEQ ID NO: 47036 - DNA, 35 bp, Artificial Sequence
  Synthetic oligonucleotide
agccccgctctagcctgtgcgcccagatcgccacc

SEQ ID NO: 47037 - DNA, 35 bp, Artificial Sequence
  Synthetic oligonucleotide
agcttgccctcacgcatcccgtaagcctaggtatc

SEQ ID NO: 47038 - DNA, 35 bp, Artificial Sequence
  Synthetic oligonucleotide
gcaccacgcactgggtgggcgtgaattattacttc

SEQ ID NO: 47039 - DNA, 35 bp, Artificial Sequence
  Synthetic oligonucleotide
gtggagggggggaccgatgtaaatggaggaaaaag

SEQ ID NO: 47040 - DNA, 34 bp, Artificial Sequence
  Synthetic oligonucleotide
attgacaccgtgggggggggtgaggtaggggaag

SEQ ID NO: 47041 - DNA, 35 bp, Artificial Sequence
  Synthetic oligonucleotide
atcgcagggagggggacagggatacgtacgctgag

SEQ ID NO: 47042 - DNA, 35 bp, Artificial Sequence
  Synthetic oligonucleotide
atgacccgggctccacccattttactcccgttacg

SEQ ID NO: 47043 - DNA, 35 bp, Artificial Sequence
  Synthetic oligonucleotide
attacagctcccgctttcccttattggtactatcg

SEQ ID NO: 47044 - DNA, 35 bp, Artificial Sequence
  Synthetic oligonucleotide
gatggaggggctgagggctctactcggtaaaacgg

SEQ ID NO: 47045 - DNA, 35 bp, Artificial Sequence
  Synthetic oligonucleotide
gtgcgcagagagcttgctgaaggggagtatgaggg

SEQ ID NO: 47046 - DNA, 35 bp, Artificial Sequence
  Synthetic oligonucleotide
tctgtcaacctctacaacctttcatttgcgccgtg

SEQ ID NO: 47047 - DNA, 35 bp, Artificial Sequence
  Synthetic oligonucleotide
gtctcgggcaaaccatagggagggggggtacccat

SEQ ID NO: 47048 - DNA, 35 bp, Artificial Sequence
  Synthetic oligonucleotide
tcatgcgaggtgacttaccgaagcactctctctat

SEQ ID NO: 47049 - DNA, 35 bp, Artificial Sequence
  Synthetic oligonucleotide
gacgcctggccaacatcggcgactttctcctcgct

SEQ ID NO: 47050 - DNA, 35 bp, Artificial Sequence
  Synthetic oligonucleotide
tatcacgcgccaatatttcagctacacaagcatct

SEQ ID NO: 47051 - DNA, 35 bp, Artificial Sequence
  Synthetic oligonucleotide
gctccgccgtgtgctgtgctcgccccttccaactt

SEQ ID NO: 47052 - DNA, 35 bp, Artificial Sequence
  Synthetic oligonucleotide
acgggtctgcaagcggttttcgtctggtccccctt

SEQ ID NO: 47053 - DNA, 35 bp, Artificial Sequence
  Synthetic oligonucleotide
tgtccctcagagccttttcaccaagttcgctgctt

SEQ ID NO: 47054 - DNA, 35 bp, Artificial Sequence
  Synthetic oligonucleotide
gataatctgctccatcgaccgtgacccacgccgtt

SEQ ID NO: 47055 - DNA, 36 bp, Artificial Sequence
  Synthetic oligonucleotide
tgatgcaggccacagccacgagcctcaagacctcaa

SEQ ID NO: 47056 - DNA, 36 bp, Artificial Sequence
  Synthetic oligonucleotide
tcaccctcgatagaccgcgtagcgaaacacacctaa

SEQ ID NO: 47057 - DNA, 36 bp, Artificial Sequence
  Synthetic oligonucleotide
gccattccctcgccctcgccggatcctttaacaaca

SEQ ID NO: 47058 - DNA, 36 bp, Artificial Sequence
  Synthetic oligonucleotide
aagccaaccactgatcgacggccatacgtactaaca

SEQ ID NO: 47059 - DNA, 36 bp, Artificial Sequence
  Synthetic oligonucleotide
ggaccacgtgctgcatcgccgttacactcacacaca

SEQ ID NO: 47060 - DNA, 36 bp, Artificial Sequence
  Synthetic oligonucleotide
gctgtccaccgctaacggacgggtgcccccccatca

SEQ ID NO: 47061 - DNA, 35 bp, Artificial Sequence
  Synthetic oligonucleotide
actccccagcagcactatgttcaattctattctca

SEQ ID NO: 47062 - DNA, 35 bp, Artificial Sequence
  Synthetic oligonucleotide
tactacgtcagcaggctccaacccagccctctaga

SEQ ID NO: 47063 - DNA, 37 bp, Artificial Sequence
  Synthetic oligonucleotide
gttgagcgacgccttacgtttggtctcctgttctcga

SEQ ID NO: 47064 - DNA, 36 bp, Artificial Sequence
  Synthetic oligonucleotide
tgaagtcgcaacactgttcgctcctactcttttcga

SEQ ID NO: 47065 - DNA, 37 bp, Artificial Sequence
  Synthetic oligonucleotide
accaccgcgttggtcttcattcttctctcttttcgga

SEQ ID NO: 47066 - DNA, 37 bp, Artificial Sequence
  Synthetic oligonucleotide
actatcccgaacagcctcactcgcttcaacccgtgga

SEQ ID NO: 47067 - DNA, 38 bp, Artificial Sequence
  Synthetic oligonucleotide
tctacacacccaggtccattttattgcactcctcatga

SEQ ID NO: 47068 - DNA, 38 bp, Artificial Sequence
  Synthetic oligonucleotide
aacccggccgaaagccagccgtgatcccgcccctatga

SEQ ID NO: 47069 - DNA, 38 bp, Artificial Sequence
  Synthetic oligonucleotide
accccaccgcctggtgtcttatgcaccaaatagtatga

SEQ ID NO: 47070 - DNA, 35 bp, Artificial Sequence
  Synthetic oligonucleotide
accaagcctcctctcatgccgcccgcgcaagctga

SEQ ID NO: 47071 - DNA, 38 bp, Artificial Sequence
  Synthetic oligonucleotide
tgactcctctagtgcctccccgtacccacatcgagtga

SEQ ID NO: 47072 - DNA, 38 bp, Artificial Sequence
  Synthetic oligonucleotide
tagccaagcgggggggagattcatgctgtggtcggtga

SEQ ID NO: 47073 - DNA, 36 bp, Artificial Sequence
  Synthetic oligonucleotide
gagagggtacggggtaggtgaagatcatcggcttga

SEQ ID NO: 47074 - DNA, 38 bp, Artificial Sequence
  Synthetic oligonucleotide
ttgaccagtaggtcacgttgcgttacatccctcgttga

SEQ ID NO: 47075 - DNA, 36 bp, Artificial Sequence
  Synthetic oligonucleotide
tctgtggagaggaggtagagcgagtagagcggtata

SEQ ID NO: 47076 - DNA, 36 bp, Artificial Sequence
  Synthetic oligonucleotide
taacactgagttacctgtgcacctgctccatttcta

SEQ ID NO: 47077 - DNA, 36 bp, Artificial Sequence
  Synthetic oligonucleotide
tcaccccgctgtgtgactagctcatgaatcctctta

SEQ ID NO: 47078 - DNA, 35 bp, Artificial Sequence
  Synthetic oligonucleotide
tctcgcctcagtcacccgcgcatacggatctcacc

SEQ ID NO: 47079 - DNA, 35 bp, Artificial Sequence
  Synthetic oligonucleotide
tttgccacgtcggaacgctctgttcgcgactcccc

SEQ ID NO: 47080 - DNA, 35 bp, Artificial Sequence
  Synthetic oligonucleotide
atcgtgaaggggtgctggtcgctgttttccttgcc

SEQ ID NO: 47081 - DNA, 35 bp, Artificial Sequence
  Synthetic oligonucleotide
atctcatgcatccgcttttcatgtgcctcaattcc

SEQ ID NO: 47082 - DNA, 35 bp, Artificial Sequence
  Synthetic oligonucleotide
gccacgtaaagtcgatgcaaaaagctgcacttctc

SEQ ID NO: 47083 - DNA, 35 bp, Artificial Sequence
  Synthetic oligonucleotide
tacatcacgcctcgtatccacggtttttggatttc

SEQ ID NO: 47084 - DNA, 35 bp, Artificial Sequence
  Synthetic oligonucleotide
gaactttccgccaccaccgtttccgtcatgagacg

SEQ ID NO: 47085 - DNA, 35 bp, Artificial Sequence
  Synthetic oligonucleotide
actaatagtaccgctcccccgctcgcctccagccg

SEQ ID NO: 47086 - DNA, 35 bp, Artificial Sequence
  Synthetic oligonucleotide
gttgacccagtattgagggagtggaaatggcgggg

SEQ ID NO: 47087 - DNA, 35 bp, Artificial Sequence
  Synthetic oligonucleotide
taagtccccgccctccagccccacacgctccgatg

SEQ ID NO: 47088 - DNA, 35 bp, Artificial Sequence
  Synthetic oligonucleotide
tacgctgtccagttcgtatttctgtccctaaactg

SEQ ID NO: 47089 - DNA, 35 bp, Artificial Sequence
  Synthetic oligonucleotide
accgtgtcgcgaagaatggatggaaaggtggggtg

SEQ ID NO: 47090 - DNA, 35 bp, Artificial Sequence
  Synthetic oligonucleotide
ggaccaggtacgagggagggatgagcaaggaggat

SEQ ID NO: 47091 - DNA, 35 bp, Artificial Sequence
  Synthetic oligonucleotide
tccccaaccctaacgcgaagggtacttgaatcact

SEQ ID NO: 47092 - DNA, 35 bp, Artificial Sequence
  Synthetic oligonucleotide
tgacccccagagtcttttcggtttctgtttttgct

SEQ ID NO: 47093 - DNA, 35 bp, Artificial Sequence
  Synthetic oligonucleotide
tacacagacaaggcctatcgggaaggagtgccttt

SEQ ID NO: 47094 - DNA, 36 bp, Artificial Sequence
  Synthetic oligonucleotide
acaaccccaacgtaatctctgttacgagcctcttaa

SEQ ID NO: 47095 - DNA, 36 bp, Artificial Sequence
  Synthetic oligonucleotide
tatacccaccgctggtcttagccattcccggtcaca

SEQ ID NO: 47096 - DNA, 36 bp, Artificial Sequence
  Synthetic oligonucleotide
gaatgcccgcccaatagcgacctcttactgtgacca

SEQ ID NO: 47097 - DNA, 36 bp, Artificial Sequence
  Synthetic oligonucleotide
gatcaccctcaagatcaatctttctgaccgtctcca

SEQ ID NO: 47098 - DNA, 35 bp, Artificial Sequence
  Synthetic oligonucleotide
gcaggccggttgcacattccttcccgcctccatca

SEQ ID NO: 47099 - DNA, 36 bp, Artificial Sequence
  Synthetic oligonucleotide
ggggtacgccacacattcccgctcttatgaaattca

SEQ ID NO: 47100 - DNA, 37 bp, Artificial Sequence
  Synthetic oligonucleotide
ttggaccctgcaaccatgttcacttataccagcacga

SEQ ID NO: 47101 - DNA, 37 bp, Artificial Sequence
  Synthetic oligonucleotide
agcgtagctgcgtcgcgccccgtaactccctctccga

SEQ ID NO: 47102 - DNA, 37 bp, Artificial Sequence
  Synthetic oligonucleotide
aacccgcggccaccatcccacatccagacagtagcga

SEQ ID NO: 47103 - DNA, 37 bp, Artificial Sequence
  Synthetic oligonucleotide
atgagccgcacttgtggggatttgggcataggaagga

SEQ ID NO: 47104 - DNA, 37 bp, Artificial Sequence
  Synthetic oligonucleotide
tcgctccgtcggggacccattttactctgcattcgga

SEQ ID NO: 47105 - DNA, 37 bp, Artificial Sequence
  Synthetic oligonucleotide
gacgaaggtttggggtagtgaggctgcagcacgggga

SEQ ID NO: 47106 - DNA, 37 bp, Artificial Sequence
  Synthetic oligonucleotide
tactccatgctctcgaccctggtacctattaacatga

SEQ ID NO: 47107 - DNA, 36 bp, Artificial Sequence
  Synthetic oligonucleotide
gtccaggcaccgagctttcgccttgactacccatga

SEQ ID NO: 47108 - DNA, 38 bp, Artificial Sequence
  Synthetic oligonucleotide
gccgagcatgcgatcgtcctctaagctgcctcccatga

SEQ ID NO: 47109 - DNA, 38 bp, Artificial Sequence
  Synthetic oligonucleotide
gtacgccaccgcccctgatccgtaaggcttcgaactga

SEQ ID NO: 47110 - DNA, 38 bp, Artificial Sequence
  Synthetic oligonucleotide
ttgtaccctcatgtttgatcttctgtaactgccgctga

SEQ ID NO: 47111 - DNA, 38 bp, Artificial Sequence
  Synthetic oligonucleotide
acccgcccctccacgttcggaccataagaccggtctga

SEQ ID NO: 47112 - DNA, 37 bp, Artificial Sequence
  Synthetic oligonucleotide
tgaagcgtggtctcgttcgtttcctatcctggtctga

SEQ ID NO: 47113 - DNA, 38 bp, Artificial Sequence
  Synthetic oligonucleotide
accaggaggaaagagtgggagggtaaatagcacggtga

SEQ ID NO: 47114 - DNA, 38 bp, Artificial Sequence
  Synthetic oligonucleotide
ggagagagctggtgtggggggggtaataggtgaattga

SEQ ID NO: 47115 - DNA, 38 bp, Artificial Sequence
  Synthetic oligonucleotide
gcgaagttcgcgcgccctgtttcccgtatcttcattga

SEQ ID NO: 47116 - DNA, 38 bp, Artificial Sequence
  Synthetic oligonucleotide
tgcaaccccgtctagtctgctctagaatcttaccttga

SEQ ID NO: 47117 - DNA, 36 bp, Artificial Sequence
  Synthetic oligonucleotide
ttcactgatccactatgcctgttctgtttcgatata

SEQ ID NO: 47118 - DNA, 36 bp, Artificial Sequence
  Synthetic oligonucleotide
gagcctcgccgtctgtgccgtcgttttccaccgtta

SEQ ID NO: 47119 - DNA, 36 bp, Artificial Sequence
  Synthetic oligonucleotide
agtgtcaagaacatcaccccgccctacgccgcttta

SEQ ID NO: 47120 - DNA, 36 bp, Artificial Sequence
  Synthetic oligonucleotide
atcgagcctccgtaccatgttctcgtctttttttta

SEQ ID NO: 47121 - DNA, 35 bp, Artificial Sequence
  Synthetic oligonucleotide
gttgtcatctatgctacgaccgtatctcctttcac

SEQ ID NO: 47122 - DNA, 35 bp, Artificial Sequence
  Synthetic oligonucleotide
actatgcgcaatctggtactatctccccccacgcc

SEQ ID NO: 47123 - DNA, 35 bp, Artificial Sequence
  Synthetic oligonucleotide
ttagctgcttaatgttcctcttaccacaccctgcc

SEQ ID NO: 47124 - DNA, 35 bp, Artificial Sequence
  Synthetic oligonucleotide
tctgaaacccaatagctgcaatatagtcgccacgc

SEQ ID NO: 47125 - DNA, 35 bp, Artificial Sequence
  Synthetic oligonucleotide
gcccaaatggcagtccacaaatgacctccacctgc

SEQ ID NO: 47126 - DNA, 35 bp, Artificial Sequence
  Synthetic oligonucleotide
gccattgtacgagctgcccgtttgcttatctttgc

SEQ ID NO: 47127 - DNA, 35 bp, Artificial Sequence
  Synthetic oligonucleotide
tcccgcctcgcccattcttagcaattgtcacattc

SEQ ID NO: 47128 - DNA, 35 bp, Artificial Sequence
  Synthetic oligonucleotide
aaccctttacccacagatctctgcggtccccaccg

SEQ ID NO: 47129 - DNA, 35 bp, Artificial Sequence
  Synthetic oligonucleotide
ttacatccgattccatggtggcttctcgcactccg

SEQ ID NO: 47130 - DNA, 35 bp, Artificial Sequence
  Synthetic oligonucleotide
accaggtacgagggagggccggtgttaatggatgg

SEQ ID NO: 47131 - DNA, 35 bp, Artificial Sequence
  Synthetic oligonucleotide
gattgctccaactccgctgcctgctttgtacatat

SEQ ID NO: 47132 - DNA, 35 bp, Artificial Sequence
  Synthetic oligonucleotide
ttggaacgcgctaatttatgcctcatgtcacagct

SEQ ID NO: 47133 - DNA, 35 bp, Artificial Sequence
  Synthetic oligonucleotide
actgacgcatcagacaactatgttcaaaaccatct

SEQ ID NO: 47134 - DNA, 35 bp, Artificial Sequence
  Synthetic oligonucleotide
tgcttgccggtatcctcacccactgtggccgttct

SEQ ID NO: 47135 - DNA, 35 bp, Artificial Sequence
  Synthetic oligonucleotide
tatcgcagagaacgggagggaagcggctacagggt

SEQ ID NO: 47136 - DNA, 35 bp, Artificial Sequence
  Synthetic oligonucleotide
ttttgcgctacacttgcttgttctttcctacctgt

SEQ ID NO: 47137 - DNA, 36 bp, Artificial Sequence
  Synthetic oligonucleotide
aaccctgccactatcatgagttctgacatcagcaaa

SEQ ID NO: 47138 - DNA, 36 bp, Artificial Sequence
  Synthetic oligonucleotide
agtccagccaatctgtctaattcctcgtgcgccgaa

SEQ ID NO: 47139 - DNA, 35 bp, Artificial Sequence
  Synthetic oligonucleotide
gggtgttagggggggaagcagtatggaaggtggaa

SEQ ID NO: 47140 - DNA, 36 bp, Artificial Sequence
  Synthetic oligonucleotide
tcccacttcctatatgaaacgggactcgctcccaca

SEQ ID NO: 47141 - DNA, 36 bp, Artificial Sequence
  Synthetic oligonucleotide
acccccagcgagacccttgcatctggcagtaaacca

SEQ ID NO: 47142 - DNA, 36 bp, Artificial Sequence
  Synthetic oligonucleotide
tgccccctctcggcacaccaacactcatgcgtggca

SEQ ID NO: 47143 - DNA, 36 bp, Artificial Sequence
  Synthetic oligonucleotide
ggttgggaagatctcgggaaaagggggggtggctca

SEQ ID NO: 47144 - DNA, 36 bp, Artificial Sequence
  Synthetic oligonucleotide
tacccctccactaccctgtccgcctggactctgaga

SEQ ID NO: 47145 - DNA, 35 bp, Artificial Sequence
  Synthetic oligonucleotide
ggtatgtcgcgctcacatctacattacgcccccga

SEQ ID NO: 47146 - DNA, 37 bp, Artificial Sequence
  Synthetic oligonucleotide
tacattcatccacccactgcgtgctatttcctcagga

SEQ ID NO: 47147 - DNA, 37 bp, Artificial Sequence
  Synthetic oligonucleotide
gcaaggctgcaataagcgggaggtaaggtggatcgga

SEQ ID NO: 47148 - DNA, 37 bp, Artificial Sequence
  Synthetic oligonucleotide
tcagtggggggaggagggacctatgaccgtagttgga

SEQ ID NO: 47149 - DNA, 37 bp, Artificial Sequence
  Synthetic oligonucleotide
actgccatcggcccccgccctgatcccttgtccatga

SEQ ID NO: 47150 - DNA, 38 bp, Artificial Sequence
  Synthetic oligonucleotide
atgggggggggcatggagggtggactgttggtcactga

SEQ ID NO: 47151 - DNA, 38 bp, Artificial Sequence
  Synthetic oligonucleotide
gcccacaccctcaatctctgctttgacactagccctga

SEQ ID NO: 47152 - DNA, 36 bp, Artificial Sequence
  Synthetic oligonucleotide
gagagtgaacagaccaaggtaggggaaggaggttga

SEQ ID NO: 47153 - DNA, 38 bp, Artificial Sequence
  Synthetic oligonucleotide
gactaggtggggtgggctgcaagggcctagaggtttga

SEQ ID NO: 47154 - DNA, 35 bp, Artificial Sequence
  Synthetic oligonucleotide
tccgggaatgcccacgaagtccagccgctacacta

SEQ ID NO: 47155 - DNA, 35 bp, Artificial Sequence
  Synthetic oligonucleotide
tgtgccccccggtccgcttgcatggccgaccacta

SEQ ID NO: 47156 - DNA, 36 bp, Artificial Sequence
  Synthetic oligonucleotide
ataggtcatctccgccatggttgcgcacttccccta

SEQ ID NO: 47157 - DNA, 36 bp, Artificial Sequence
  Synthetic oligonucleotide
aacacccacagtttagtagcttactagaccctttta

SEQ ID NO: 47158 - DNA, 35 bp, Artificial Sequence
  Synthetic oligonucleotide
gtgtgacgccgcaaacacatgctactcgcttgtcc

SEQ ID NO: 47159 - DNA, 35 bp, Artificial Sequence
  Synthetic oligonucleotide
tacgcccatatgcctattagcctgcggttccttcc

SEQ ID NO: 47160 - DNA, 35 bp, Artificial Sequence
  Synthetic oligonucleotide
gcgcggacaacgttgcttttagttcctcccatcgc

SEQ ID NO: 47161 - DNA, 35 bp, Artificial Sequence
  Synthetic oligonucleotide
actggcacctctgcgcctcctttatcctgtcaggc

SEQ ID NO: 47162 - DNA, 35 bp, Artificial Sequence
  Synthetic oligonucleotide
gcccccgtaattggttatctctgttggtttcttgc

SEQ ID NO: 47163 - DNA, 35 bp, Artificial Sequence
  Synthetic oligonucleotide
caggtagcccccctggtcgtgtttacctgcaaatc

SEQ ID NO: 47164 - DNA, 35 bp, Artificial Sequence
  Synthetic oligonucleotide
tgtgccctgcttgttgaaatctacgaactcctatc

SEQ ID NO: 47165 - DNA, 35 bp, Artificial Sequence
  Synthetic oligonucleotide
gaccaacttcccgcctttagcctggagtgaacttc

SEQ ID NO: 47166 - DNA, 35 bp, Artificial Sequence
  Synthetic oligonucleotide
gatcagcaaccgactgtaatcgtccgaccactttc

SEQ ID NO: 47167 - DNA, 35 bp, Artificial Sequence
  Synthetic oligonucleotide
atgaggggaataggaatcgtgaaatgtaggtgcag

SEQ ID NO: 47168 - DNA, 35 bp, Artificial Sequence
  Synthetic oligonucleotide
tccccagatcgatcacatgaactcaccgcacaccg

SEQ ID NO: 47169 - DNA, 35 bp, Artificial Sequence
  Synthetic oligonucleotide
gtaccctagaacttatgattgctgtcttaccaccg

SEQ ID NO: 47170 - DNA, 35 bp, Artificial Sequence
  Synthetic oligonucleotide
acccgcaccctcagcttacgcgacttaattttctg

SEQ ID NO: 47171 - DNA, 35 bp, Artificial Sequence
  Synthetic oligonucleotide
ttgcaccccgcccctagacttgtaaagttctcttg

SEQ ID NO: 47172 - DNA, 35 bp, Artificial Sequence
  Synthetic oligonucleotide
gcataaaccgagtcttcgtttccgccatatctttg

SEQ ID NO: 47173 - DNA, 35 bp, Artificial Sequence
  Synthetic oligonucleotide
gtactaacctcgatagaagcacatgccgtagttat

SEQ ID NO: 47174 - DNA, 35 bp, Artificial Sequence
  Synthetic oligonucleotide
acgactcgaccaattacttcccactgagcacccct

SEQ ID NO: 47175 - DNA, 35 bp, Artificial Sequence
  Synthetic oligonucleotide
aggacactagctgggccgttctttaatgctttcct

SEQ ID NO: 47176 - DNA, 35 bp, Artificial Sequence
  Synthetic oligonucleotide
tacgctgtagcctgcacaaactacaccgaggactt

SEQ ID NO: 47177 - DNA, 35 bp, Artificial Sequence
  Synthetic oligonucleotide
tccgatctttatggcgcccctcctgtctaccgctt

SEQ ID NO: 47178 - DNA, 35 bp, Artificial Sequence
  Synthetic oligonucleotide
agggaaggggggccagggcacgtagcggtagggtt

SEQ ID NO: 47179 - DNA, 35 bp, Artificial Sequence
  Synthetic oligonucleotide
attcgccgtcccttagctcatctggcaaatgcttt

SEQ ID NO: 47180 - DNA, 35 bp, Artificial Sequence
  Synthetic oligonucleotide
taacgccggacgaacgtttaaactgccatttcttt

SEQ ID NO: 47181 - DNA, 35 bp, Artificial Sequence
  Synthetic oligonucleotide
gagcggtatctactgctccccatccctccgcgaaa

SEQ ID NO: 47182 - DNA, 35 bp, Artificial Sequence
  Synthetic oligonucleotide
gcatgacaagccgaccccatgatattcgcccgcaa

SEQ ID NO: 47183 - DNA, 36 bp, Artificial Sequence
  Synthetic oligonucleotide
gacccaccacctgcgtcaccgacgattacttagtaa

SEQ ID NO: 47184 - DNA, 35 bp, Artificial Sequence
  Synthetic oligonucleotide
accccgactgacacatactaattccagggctcaca

SEQ ID NO: 47185 - DNA, 35 bp, Artificial Sequence
  Synthetic oligonucleotide
aaccagccgaagtcattcgccttttagctacatca

SEQ ID NO: 47186 - DNA, 37 bp, Artificial Sequence
  Synthetic oligonucleotide
acaggtgggagggatgggtgaaccttgaaaataaaga

SEQ ID NO: 47187 - DNA, 36 bp, Artificial Sequence
  Synthetic oligonucleotide
gactgggggaaggtggaaaattgcactttggggaga

SEQ ID NO: 47188 - DNA, 37 bp, Artificial Sequence
  Synthetic oligonucleotide
atgccctggactaccccactgtgttgcgccctcacga

SEQ ID NO: 47189 - DNA, 37 bp, Artificial Sequence
  Synthetic oligonucleotide
tcacgtctccccgctgatgcttgatcccctgtgacga

SEQ ID NO: 47190 - DNA, 36 bp, Artificial Sequence
  Synthetic oligonucleotide
tagatgcccaacacgcacacatatcaaccctggcga

SEQ ID NO: 47191 - DNA, 32 bp, Artificial Sequence
  Synthetic oligonucleotide
gaataccaccgatcgcataaaaccgccatcga

SEQ ID NO: 47192 - DNA, 37 bp, Artificial Sequence
  Synthetic oligonucleotide
aatggatgggaaaggaataggtatggaagaacaagga

SEQ ID NO: 47193 - DNA, 37 bp, Artificial Sequence
  Synthetic oligonucleotide
atgacacgactggataggggcgctagaggagagcgga

SEQ ID NO: 47194 - DNA, 37 bp, Artificial Sequence
  Synthetic oligonucleotide
gtatggacggatgggtggggagatttaggggttcgga

SEQ ID NO: 47195 - DNA, 36 bp, Artificial Sequence
  Synthetic oligonucleotide
gatgaaccgtcttgtcttcgccatttctcccaatga

SEQ ID NO: 47196 - DNA, 38 bp, Artificial Sequence
  Synthetic oligonucleotide
tgacgagtgagcgctaccctgtttttcccttgccatga

SEQ ID NO: 47197 - DNA, 38 bp, Artificial Sequence
  Synthetic oligonucleotide
gcggacgaccctacccccgccgtaacctccgcccctga

SEQ ID NO: 47198 - DNA, 38 bp, Artificial Sequence
  Synthetic oligonucleotide
gtgaccgcccgttttgatccatagcaatgatatgctga

SEQ ID NO: 47199 - DNA, 38 bp, Artificial Sequence
  Synthetic oligonucleotide
ggagagacacacggggaaaactgggacgcagagggtga

SEQ ID NO: 47200 - DNA, 36 bp, Artificial Sequence
  Synthetic oligonucleotide
accaagcccgccgttctgacgccctttttcgattga

SEQ ID NO: 47201 - DNA, 38 bp, Artificial Sequence
  Synthetic oligonucleotide
gccacatggcaactgactgcgtaccttctcgttgttga

SEQ ID NO: 47202 - DNA, 38 bp, Artificial Sequence
  Synthetic oligonucleotide
agcaccactgcctttaggaacctagcccatttttttga

SEQ ID NO: 47203 - DNA, 35 bp, Artificial Sequence
  Synthetic oligonucleotide
acctcactgtagcctgagtattctcaaccgcttta

SEQ ID NO: 47204 - DNA, 35 bp, Artificial Sequence
  Synthetic oligonucleotide
ttcatggctggccccagctaagtttttcccgcaac

SEQ ID NO: 47205 - DNA, 35 bp, Artificial Sequence
  Synthetic oligonucleotide
actgacatcgtacttacaagcctgttcatacttac

SEQ ID NO: 47206 - DNA, 35 bp, Artificial Sequence
  Synthetic oligonucleotide
tcacgggaccagctgctacgccagagctatccacc

SEQ ID NO: 47207 - DNA, 35 bp, Artificial Sequence
  Synthetic oligonucleotide
aaccctctccctgctgtcttgccagacgcatgacc

SEQ ID NO: 47208 - DNA, 35 bp, Artificial Sequence
  Synthetic oligonucleotide
gatgaacccatacatcccaatcgtgtacaatcccc

SEQ ID NO: 47209 - DNA, 35 bp, Artificial Sequence
  Synthetic oligonucleotide
tcccgcgaaagcctgctcttgttttccataatgcc

SEQ ID NO: 47210 - DNA, 35 bp, Artificial Sequence
  Synthetic oligonucleotide
gttgcctgtttccctgtcgtgctattttatcatcc

SEQ ID NO: 47211 - DNA, 35 bp, Artificial Sequence
  Synthetic oligonucleotide
aaacgccatgaaagggttttcgctccttctttcgc

SEQ ID NO: 47212 - DNA, 35 bp, Artificial Sequence
  Synthetic oligonucleotide
aagtccacccgtcacactaaaccttagaatctggc

SEQ ID NO: 47213 - DNA, 35 bp, Artificial Sequence
  Synthetic oligonucleotide
tgtggggccgccccttcgaatcaacatccggagtc

SEQ ID NO: 47214 - DNA, 35 bp, Artificial Sequence
  Synthetic oligonucleotide
gctgatcacccgcgttcccaccatgtcaccgattc

SEQ ID NO: 47215 - DNA, 35 bp, Artificial Sequence
  Synthetic oligonucleotide
tcacccgcacaaactggaccgaggacaaccaacag

SEQ ID NO: 47216 - DNA, 36 bp, Artificial Sequence
  Synthetic oligonucleotide
tatcacccccattgaaagatctgccgtagttctacg

SEQ ID NO: 47217 - DNA, 35 bp, Artificial Sequence
  Synthetic oligonucleotide
tagcccccaacacgccagcctgccgtaacaaagcg

SEQ ID NO: 47218 - DNA, 35 bp, Artificial Sequence
  Synthetic oligonucleotide
atgttgggttcgcttgcttacttattgatctcctg

SEQ ID NO: 47219 - DNA, 35 bp, Artificial Sequence
  Synthetic oligonucleotide
tcactcaccctcccgtatgcaccgaacttcagaat

SEQ ID NO: 47220 - DNA, 35 bp, Artificial Sequence
  Synthetic oligonucleotide
gcgcgggcacccaacggtcgcatatgcacacccat

SEQ ID NO: 47221 - DNA, 35 bp, Artificial Sequence
  Synthetic oligonucleotide
tcccgcccttcctccatattggttgtctctgtgat

SEQ ID NO: 47222 - DNA, 35 bp, Artificial Sequence
  Synthetic oligonucleotide
gcccaccgggggtgtccctagcgccttgcctatct

SEQ ID NO: 47223 - DNA, 35 bp, Artificial Sequence
  Synthetic oligonucleotide
acatccaatcgctccgaaatcacccgttgtgcggt

SEQ ID NO: 47224 - DNA, 35 bp, Artificial Sequence
  Synthetic oligonucleotide
aagcgcacctggcacgacccttccactcaagcttt

SEQ ID NO: 47225 - DNA, 35 bp, Artificial Sequence
  Synthetic oligonucleotide
tgacctcctgattcactgggctttccctacaccaa

SEQ ID NO: 47226 - DNA, 35 bp, Artificial Sequence
  Synthetic oligonucleotide
agcatcactagatcccatcacttccgcacaccgaa

SEQ ID NO: 47227 - DNA, 36 bp, Artificial Sequence
  Synthetic oligonucleotide
attccagtccacccatttgcatcgggtacccgttaa

SEQ ID NO: 47228 - DNA, 35 bp, Artificial Sequence
  Synthetic oligonucleotide
gcaacgacaccagcttcctcgttacagtttacaca

SEQ ID NO: 47229 - DNA, 36 bp, Artificial Sequence
  Synthetic oligonucleotide
gctgataaccacatttctttggatccagtgaccaca

SEQ ID NO: 47230 - DNA, 36 bp, Artificial Sequence
  Synthetic oligonucleotide
ttgcggcccctccggtcatacgccctctgactcaca

SEQ ID NO: 47231 - DNA, 36 bp, Artificial Sequence
  Synthetic oligonucleotide
ttagacgcagcagaacgcgcccttatgtctggccca

SEQ ID NO: 47232 - DNA, 36 bp, Artificial Sequence
  Synthetic oligonucleotide
gtgggggtggaagaattgaagccagggttagaagca

SEQ ID NO: 47233 - DNA, 37 bp, Artificial Sequence
  Synthetic oligonucleotide
tttccgcacaacgacctggatctcccgcgctccacga

SEQ ID NO: 47234 - DNA, 37 bp, Artificial Sequence
  Synthetic oligonucleotide
tgtggttgccaccgagtgcatacttgcataataccga

SEQ ID NO: 47235 - DNA, 37 bp, Artificial Sequence
  Synthetic oligonucleotide
tccgtaggtcaacagtccacgcattccatcatcccga

SEQ ID NO: 47236 - DNA, 37 bp, Artificial Sequence
  Synthetic oligonucleotide
atagggacgcagtagggagagggaaatggggaggcga

SEQ ID NO: 47237 - DNA, 37 bp, Artificial Sequence
  Synthetic oligonucleotide
tgtgagacgctgcatacgaccaccgatcgctcctcga

SEQ ID NO: 47238 - DNA, 37 bp, Artificial Sequence
  Synthetic oligonucleotide
agatcgtcggtcctttgcgccttttcagtactctcga

SEQ ID NO: 47239 - DNA, 37 bp, Artificial Sequence
  Synthetic oligonucleotide
tccccgccacgaactagctatgtaccgcgcttttcga

SEQ ID NO: 47240 - DNA, 35 bp, Artificial Sequence
  Synthetic oligonucleotide
tacaccacccggtcgctcattgtacttttaccgga

SEQ ID NO: 47241 - DNA, 35 bp, Artificial Sequence
  Synthetic oligonucleotide
agtgcgagaggcaagggagaaggtaatatacggga

SEQ ID NO: 47242 - DNA, 37 bp, Artificial Sequence
  Synthetic oligonucleotide
ttgacacacaaaccagcgtagttcgggaaggtgggga

SEQ ID NO: 47243 - DNA, 37 bp, Artificial Sequence
  Synthetic oligonucleotide
gcccgtgcaacggttgggcgggtacgggacaatggga

SEQ ID NO: 47244 - DNA, 36 bp, Artificial Sequence
  Synthetic oligonucleotide
gcgaggggggacacgagcttatggggagttattgga

SEQ ID NO: 47245 - DNA, 37 bp, Artificial Sequence
  Synthetic oligonucleotide
gcccactcgccgcctgttagtcactacaagtacatga

SEQ ID NO: 47246 - DNA, 38 bp, Artificial Sequence
  Synthetic oligonucleotide
accgtgtccctccctgggtgcatttaccgttcccatga

SEQ ID NO: 47247 - DNA, 38 bp, Artificial Sequence
  Synthetic oligonucleotide
tagggaggggtcgcaggtatagggggcttgggctatga

SEQ ID NO: 47248 - DNA, 38 bp, Artificial Sequence
  Synthetic oligonucleotide
acgaagggcgactttgggtaggcgggggttatggctga

SEQ ID NO: 47249 - DNA, 38 bp, Artificial Sequence
  Synthetic oligonucleotide
atctccatcctcaccctgctacgcgttccccgttctga

SEQ ID NO: 47250 - DNA, 38 bp, Artificial Sequence
  Synthetic oligonucleotide
aaagaaggtacagggcggtactggtagagggtgggtga

SEQ ID NO: 47251 - DNA, 38 bp, Artificial Sequence
  Synthetic oligonucleotide
ataccccactcgcccctcgaagcatccccgtatggtga

SEQ ID NO: 47252 - DNA, 38 bp, Artificial Sequence
  Synthetic oligonucleotide
gctgtacggagtcgggggaggagggtgcgggaatgtga

SEQ ID NO: 47253 - DNA, 38 bp, Artificial Sequence
  Synthetic oligonucleotide
tctgcactcactagtccctaatacaccctgctctgtga

SEQ ID NO: 47254 - DNA, 38 bp, Artificial Sequence
  Synthetic oligonucleotide
ttaccccacctgtgagccaccgtaacatattcatttga

SEQ ID NO: 47255 - DNA, 37 bp, Artificial Sequence
  Synthetic oligonucleotide
aaccgcgcgccgtacagcgtcttcatacttcctttga

SEQ ID NO: 47256 - DNA, 36 bp, Artificial Sequence
  Synthetic oligonucleotide
aacgcctgctggtcgcattgtttctttcctccccta

SEQ ID NO: 47257 - DNA, 36 bp, Artificial Sequence
  Synthetic oligonucleotide
acacactactacacatgctgggcttgtgtccctgta

SEQ ID NO: 47258 - DNA, 35 bp, Artificial Sequence
  Synthetic oligonucleotide
gacacgtcttcgatgcacttcgaccccctgtacac

SEQ ID NO: 47259 - DNA, 35 bp, Artificial Sequence
  Synthetic oligonucleotide
atgacaccatgaggacgccaccgtttattatccac

SEQ ID NO: 47260 - DNA, 35 bp, Artificial Sequence
  Synthetic oligonucleotide
tatcccagcacaattctcctgccaaggacatgcac

SEQ ID NO: 47261 - DNA, 35 bp, Artificial Sequence
  Synthetic oligonucleotide
gtggaaccgtcctcatcaccctcccgttgagggac

SEQ ID NO: 47262 - DNA, 35 bp, Artificial Sequence
  Synthetic oligonucleotide
tgagccgccttcgccgccgcaaccgtcctgaatac

SEQ ID NO: 47263 - DNA, 35 bp, Artificial Sequence
  Synthetic oligonucleotide
gtgactcgttgggcccctacgctctagtttccacc

SEQ ID NO: 47264 - DNA, 35 bp, Artificial Sequence
  Synthetic oligonucleotide
ttgtaccttcctgtttatctgtgcgaaacttcacc

SEQ ID NO: 47265 - DNA, 35 bp, Artificial Sequence
  Synthetic oligonucleotide
taaggtccatcccgcctgctatgttcctcaagccc

SEQ ID NO: 47266 - DNA, 35 bp, Artificial Sequence
  Synthetic oligonucleotide
tacacacaaagtgggattgaaggatgggatggtcc

SEQ ID NO: 47267 - DNA, 35 bp, Artificial Sequence
  Synthetic oligonucleotide
tcatcagacacacttagttatcaaagcatcttatc

SEQ ID NO: 47268 - DNA, 35 bp, Artificial Sequence
  Synthetic oligonucleotide
tgcaagctccattcgccatcttgcgtaagccactc

SEQ ID NO: 47269 - DNA, 35 bp, Artificial Sequence
  Synthetic oligonucleotide
tgagacgccgcacgctcgcctgtcccttccctgtc

SEQ ID NO: 47270 - DNA, 35 bp, Artificial Sequence
  Synthetic oligonucleotide
accgcccgcacccggcactgttgttacgctcattc

SEQ ID NO: 47271 - DNA, 35 bp, Artificial Sequence
  Synthetic oligonucleotide
gaccagtccatcgcggctattatccagaaaccttc

SEQ ID NO: 47272 - DNA, 35 bp, Artificial Sequence
  Synthetic oligonucleotide
gtgtcacctacggctgttcttttattaattccacg

SEQ ID NO: 47273 - DNA, 35 bp, Artificial Sequence
  Synthetic oligonucleotide
acacctcacacccggctaaacggggcgctttctcg

SEQ ID NO: 47274 - DNA, 35 bp, Artificial Sequence
  Synthetic oligonucleotide
gtgtagacgagagtggaggggggcttagttctggg

SEQ ID NO: 47275 - DNA, 35 bp, Artificial Sequence
  Synthetic oligonucleotide
gtgccaagctccatcgtacacaaccactacacctg

SEQ ID NO: 47276 - DNA, 35 bp, Artificial Sequence
  Synthetic oligonucleotide
ggacggacccttttcaaatgctgattgatctcctg

SEQ ID NO: 47277 - DNA, 35 bp, Artificial Sequence
  Synthetic oligonucleotide
ggacgaccagggaaacctccgccataactgccttg

SEQ ID NO: 47278 - DNA, 35 bp, Artificial Sequence
  Synthetic oligonucleotide
gactcccacggcatccactctactttctatgtttg

SEQ ID NO: 47279 - DNA, 35 bp, Artificial Sequence
  Synthetic oligonucleotide
tgcctccaccccaattatgcctcgcgcgagtaact

SEQ ID NO: 47280 - DNA, 35 bp, Artificial Sequence
  Synthetic oligonucleotide
gcccgtgccaaagccttcaatccgactacacacgt

SEQ ID NO: 47281 - DNA, 35 bp, Artificial Sequence
  Synthetic oligonucleotide
gccacttcccagctgcgatcgccctgttcacgcgt

SEQ ID NO: 47282 - DNA, 35 bp, Artificial Sequence
  Synthetic oligonucleotide
tgacacacccggtaccaccttacgccttaactcgt

SEQ ID NO: 47283 - DNA, 35 bp, Artificial Sequence
  Synthetic oligonucleotide
gagtgccaccttagtattcggatcccccctttggt

SEQ ID NO: 47284 - DNA, 35 bp, Artificial Sequence
  Synthetic oligonucleotide
actctagctggcttctaatctgtcctgttctaatt

SEQ ID NO: 47285 - DNA, 35 bp, Artificial Sequence
  Synthetic oligonucleotide
tgtgatcccaggcttgaattccgtaacgaccactt

SEQ ID NO: 47286 - DNA, 35 bp, Artificial Sequence
  Synthetic oligonucleotide
gcgtggggatgcctctgttggtttgtgcaccgttt

SEQ ID NO: 47287 - DNA, 36 bp, Artificial Sequence
  Synthetic oligonucleotide
tagtgtaggggtgaggggaaggatcagggtgcacaa

SEQ ID NO: 47288 - DNA, 36 bp, Artificial Sequence
  Synthetic oligonucleotide
gtcacattccgctctatcgcgacttatcctaaagaa

SEQ ID NO: 47289 - DNA, 36 bp, Artificial Sequence
  Synthetic oligonucleotide
tgagcgtcgccctgcacgcccttctcttctattgaa

SEQ ID NO: 47290 - DNA, 35 bp, Artificial Sequence
  Synthetic oligonucleotide
ggctgggggcgagggagggactggggaggtcataa

SEQ ID NO: 47291 - DNA, 35 bp, Artificial Sequence
  Synthetic oligonucleotide
gagacggtccccgatcgataatttcaccgttctaa

SEQ ID NO: 47292 - DNA, 36 bp, Artificial Sequence
  Synthetic oligonucleotide
tctaccagcccatctccccgtggatgttcgcctaca

SEQ ID NO: 47293 - DNA, 36 bp, Artificial Sequence
  Synthetic oligonucleotide
agtgggaaagggataggagtaggagcggtgggtaca

SEQ ID NO: 47294 - DNA, 36 bp, Artificial Sequence
  Synthetic oligonucleotide
gtgaacaggtatgagtggaatggaaaagggtgcgca

SEQ ID NO: 47295 - DNA, 35 bp, Artificial Sequence
  Synthetic oligonucleotide
taatccccaccatcgacgcgtccactgcccttgca

SEQ ID NO: 47296 - DNA, 37 bp, Artificial Sequence
  Synthetic oligonucleotide
tagacactcgtatgccaccaccgcgcccctgtccaga

SEQ ID NO: 47297 - DNA, 37 bp, Artificial Sequence
  Synthetic oligonucleotide
tgcacaatacggaacggcccactccagtcggtgacga

SEQ ID NO: 47298 - DNA, 37 bp, Artificial Sequence
  Synthetic oligonucleotide
tactcgtccactccggcgactctcaccccgtttccga

SEQ ID NO: 47299 - DNA, 37 bp, Artificial Sequence
  Synthetic oligonucleotide
ttagctaccacaacatcccttcgcattcgctttgcga

SEQ ID NO: 47300 - DNA, 37 bp, Artificial Sequence
  Synthetic oligonucleotide
gggtacacacgggggaggggtaatcctgggtcacgga

SEQ ID NO: 47301 - DNA, 37 bp, Artificial Sequence
  Synthetic oligonucleotide
tctgtggggaggcgaggtattgtgcagcggaggggga

SEQ ID NO: 47302 - DNA, 37 bp, Artificial Sequence
  Synthetic oligonucleotide
accccactgccttccatgtccttaaattcgtactgga

SEQ ID NO: 47303 - DNA, 35 bp, Artificial Sequence
  Synthetic oligonucleotide
aactcgcacgcatccccggatcaaccgaccctgga

SEQ ID NO: 47304 - DNA, 36 bp, Artificial Sequence
  Synthetic oligonucleotide
ttgtgcatctgctcctacgctccattcgtctttgga

SEQ ID NO: 47305 - DNA, 37 bp, Artificial Sequence
  Synthetic oligonucleotide
atggaccgccgtcggcctccactagctttccctatga

SEQ ID NO: 47306 - DNA, 37 bp, Artificial Sequence
  Synthetic oligonucleotide
tcctgtcactacggatgcgtccgcactatcacactga

SEQ ID NO: 47307 - DNA, 38 bp, Artificial Sequence
  Synthetic oligonucleotide
gtcactacccccacacgttatcacagaatagtcactga

SEQ ID NO: 47308 - DNA, 38 bp, Artificial Sequence
  Synthetic oligonucleotide
gatcgcggcactccccacctcgtgttcgattcacctga

SEQ ID NO: 47309 - DNA, 37 bp, Artificial Sequence
  Synthetic oligonucleotide
gaacgtgtaagggcgggtaaatggagggacttcgtga

SEQ ID NO: 47310 - DNA, 37 bp, Artificial Sequence
  Synthetic oligonucleotide
gttagccactgcgcgccgactacgaactcctcattga

SEQ ID NO: 47311 - DNA, 37 bp, Artificial Sequence
  Synthetic oligonucleotide
gagacacgggggtctgtgtaggagtgggaaggattga

SEQ ID NO: 47312 - DNA, 38 bp, Artificial Sequence
  Synthetic oligonucleotide
gagccaacatcaagccgccctatggtcccacttcttga

SEQ ID NO: 47313 - DNA, 38 bp, Artificial Sequence
  Synthetic oligonucleotide
accacggggtcgggtacgtacgtgggcttaggtgttga

SEQ ID NO: 47314 - DNA, 36 bp, Artificial Sequence
  Synthetic oligonucleotide
cctgagcgatgcttgctgccttaaacccagtaccta

SEQ ID NO: 47315 - DNA, 36 bp, Artificial Sequence
  Synthetic oligonucleotide
acacgagggcgaaacacacatcacgcaatagacgta

SEQ ID NO: 47316 - DNA, 35 bp, Artificial Sequence
  Synthetic oligonucleotide
tagtgcgccacttcatccaggggtaatcactccac

SEQ ID NO: 47317 - DNA, 35 bp, Artificial Sequence
  Synthetic oligonucleotide
acgacgtggtgggcgggaggtacatagaggggcac

SEQ ID NO: 47318 - DNA, 35 bp, Artificial Sequence
  Synthetic oligonucleotide
gaatcacacgaccgagctcacctcggggtcaaccc

SEQ ID NO: 47319 - DNA, 35 bp, Artificial Sequence
  Synthetic oligonucleotide
gccaccctcaactccacctgacctgaagaatgccc

SEQ ID NO: 47320 - DNA, 35 bp, Artificial Sequence
  Synthetic oligonucleotide
gctcactcacatctacattcctccggacggacgcc

SEQ ID NO: 47321 - DNA, 35 bp, Artificial Sequence
  Synthetic oligonucleotide
ccgctcacatgcgacatcccgcaggttgaccctcc

SEQ ID NO: 47322 - DNA, 35 bp, Artificial Sequence
  Synthetic oligonucleotide
accaatgctacgtacatcgtgatgccccgttctcc

SEQ ID NO: 47323 - DNA, 35 bp, Artificial Sequence
  Synthetic oligonucleotide
tccatgcgcaccgcgtaatggacgatacccctagc

SEQ ID NO: 47324 - DNA, 35 bp, Artificial Sequence
  Synthetic oligonucleotide
acaacccatacctgaatctcatgttagaccctcgc

SEQ ID NO: 47325 - DNA, 35 bp, Artificial Sequence
  Synthetic oligonucleotide
tctgacttcgctgcacgatacttcctcttgcctag

SEQ ID NO: 47326 - DNA, 35 bp, Artificial Sequence
  Synthetic oligonucleotide
tcttgactaaccctcggtgcgctacactacatccg

SEQ ID NO: 47327 - DNA, 35 bp, Artificial Sequence
  Synthetic oligonucleotide
aatgtgccgagctaattgcccgtcctgatcccttg

SEQ ID NO: 47328 - DNA, 35 bp, Artificial Sequence
  Synthetic oligonucleotide
gtcgccctacatgctcacaggttaacattacttat

SEQ ID NO: 47329 - DNA, 35 bp, Artificial Sequence
  Synthetic oligonucleotide
gtgggctaccccttattgtttatgttcgtccttat

SEQ ID NO: 47330 - DNA, 35 bp, Artificial Sequence
  Synthetic oligonucleotide
taccctgttaactctccacccttctgggttgtcct

SEQ ID NO: 47331 - DNA, 35 bp, Artificial Sequence
  Synthetic oligonucleotide
tgtacctcaacctcagactatcgactaccctttgt

SEQ ID NO: 47332 - DNA, 36 bp, Artificial Sequence
  Synthetic oligonucleotide
tttgtcgccgcccttttccccgattggcatgattaa

SEQ ID NO: 47333 - DNA, 36 bp, Artificial Sequence
  Synthetic oligonucleotide
tcagacccctaccgcagattagccacaagacgcaca

SEQ ID NO: 47334 - DNA, 36 bp, Artificial Sequence
  Synthetic oligonucleotide
gcaatcctgcaaatgcgtccactgccttttttagca

SEQ ID NO: 47335 - DNA, 36 bp, Artificial Sequence
  Synthetic oligonucleotide
acacgtcacctgcgctaatgagtcatatccccttca

SEQ ID NO: 47336 - DNA, 36 bp, Artificial Sequence
  Synthetic oligonucleotide
gattcgcactccaattggccctgtcgtgatccttca

SEQ ID NO: 47337 - DNA, 36 bp, Artificial Sequence
  Synthetic oligonucleotide
gacttgccccgcgtatgctggcttttcgaattttca

SEQ ID NO: 47338 - DNA, 37 bp, Artificial Sequence
  Synthetic oligonucleotide
tagcgcatggctgcacttatcgtcccgcctctttcga

SEQ ID NO: 47339 - DNA, 37 bp, Artificial Sequence
  Synthetic oligonucleotide
acgatccggctaccactatagtacgttacatccatga

SEQ ID NO: 47340 - DNA, 38 bp, Artificial Sequence
  Synthetic oligonucleotide
tgccaccagctcccccaagccgtacctcaggtccatga

SEQ ID NO: 47341 - DNA, 37 bp, Artificial Sequence
  Synthetic oligonucleotide
tcagaccgaatccttttgcttttgaactccattatga

SEQ ID NO: 47342 - DNA, 38 bp, Artificial Sequence
  Synthetic oligonucleotide
agtgagggcctcgggttggcggggagaaggagtcctga

SEQ ID NO: 47343 - DNA, 38 bp, Artificial Sequence
  Synthetic oligonucleotide
gaagacgggagcaggctgggaacaatgggggcatctga

SEQ ID NO: 47344 - DNA, 38 bp, Artificial Sequence
  Synthetic oligonucleotide
tagcatcgtgcccgcgattgtgcctgcccccacattga

SEQ ID NO: 47345 - DNA, 38 bp, Artificial Sequence
  Synthetic oligonucleotide
tgactgctggcctcaaactaactgctgtcctatattga

SEQ ID NO: 47346 - DNA, 38 bp, Artificial Sequence
  Synthetic oligonucleotide
tccgaccctccgaattctcaatcccgccgaggatttga

SEQ ID NO: 47347 - DNA, 36 bp, Artificial Sequence
  Synthetic oligonucleotide
tcactgcctcgcatgagttgccaatctcgaacaata

SEQ ID NO: 47348 - DNA, 36 bp, Artificial Sequence
  Synthetic oligonucleotide
aacacttggttcagccgttgtacctccctgtgccta

SEQ ID NO: 47349 - DNA, 36 bp, Artificial Sequence
  Synthetic oligonucleotide
tgtcgtgctgtgccccgttttttgtccgatatccta

SEQ ID NO: 47350 - DNA, 35 bp, Artificial Sequence
  Synthetic oligonucleotide
ttagttccatcacatgtagcaccctttctgcatta

SEQ ID NO: 47351 - DNA, 36 bp, Artificial Sequence
  Synthetic oligonucleotide
ttccagcccccagagggccttccacccgcttgatta

SEQ ID NO: 47352 - DNA, 36 bp, Artificial Sequence
  Synthetic oligonucleotide
gagtgctggggcaaagtgcaaccgggggggatttta

SEQ ID NO: 47353 - DNA, 35 bp, Artificial Sequence
  Synthetic oligonucleotide
tagccgatgcatcacgcccgctgacgcctctttta

SEQ ID NO: 47354 - DNA, 35 bp, Artificial Sequence
  Synthetic oligonucleotide
acactaccggctaatgatttccccaccactgctac

SEQ ID NO: 47355 - DNA, 36 bp, Artificial Sequence
  Synthetic oligonucleotide
tgtgaacccccccccgtcatgtcctgacccttcacc

SEQ ID NO: 47356 - DNA, 35 bp, Artificial Sequence
  Synthetic oligonucleotide
agcctgtggccttttcgctgtcgccttaaccgccc

SEQ ID NO: 47357 - DNA, 35 bp, Artificial Sequence
  Synthetic oligonucleotide
tctgaccaccgtaagcacttgcgaatctcagttcc

SEQ ID NO: 47358 - DNA, 35 bp, Artificial Sequence
  Synthetic oligonucleotide
gcgaaagctaccctatgttgctcctgttctgctgc

SEQ ID NO: 47359 - DNA, 35 bp, Artificial Sequence
  Synthetic oligonucleotide
taacagtgcgatgtctccggtccctccatctctgc

SEQ ID NO: 47360 - DNA, 35 bp, Artificial Sequence
  Synthetic oligonucleotide
actcgcccgccctgctgaccttgggacgaaacctc

SEQ ID NO: 47361 - DNA, 35 bp, Artificial Sequence
  Synthetic oligonucleotide
acatctccgtcctatcttcttctaagtgccacttc

SEQ ID NO: 47362 - DNA, 35 bp, Artificial Sequence
  Synthetic oligonucleotide
gttgctccttttcaacggctttaagtactcccccg

SEQ ID NO: 47363 - DNA, 35 bp, Artificial Sequence
  Synthetic oligonucleotide
tgtcacgtgtcaccttattttttgcccagttcgcg

SEQ ID NO: 47364 - DNA, 35 bp, Artificial Sequence
  Synthetic oligonucleotide
gccgcacccccttggtcgttcattctcgcattctg

SEQ ID NO: 47365 - DNA, 35 bp, Artificial Sequence
  Synthetic oligonucleotide
ttgtgcaggctccgcttccgcataaccgatctttg

SEQ ID NO: 47366 - DNA, 35 bp, Artificial Sequence
  Synthetic oligonucleotide
tgagacgggcgggaacgtgtggggaacaaggggat

SEQ ID NO: 47367 - DNA, 35 bp, Artificial Sequence
  Synthetic oligonucleotide
taagttcgcacgcgttcgataccctccgcccccct

SEQ ID NO: 47368 - DNA, 35 bp, Artificial Sequence
  Synthetic oligonucleotide
atgacccaggtaccgccttgatccactgtatgtct

SEQ ID NO: 47369 - DNA, 35 bp, Artificial Sequence
  Synthetic oligonucleotide
aacaaccgaggaagcaaagatagtagggctagtgt

SEQ ID NO: 47370 - DNA, 35 bp, Artificial Sequence
  Synthetic oligonucleotide
tgcattgggcgctcacggtcccgttttcacttctt

SEQ ID NO: 47371 - DNA, 35 bp, Artificial Sequence
  Synthetic oligonucleotide
gccacctcgccccttcatggatcctctcgaagttt

SEQ ID NO: 47372 - DNA, 35 bp, Artificial Sequence
  Synthetic oligonucleotide
ttgtaccttccggttgttcgttcacttgaccgttt

SEQ ID NO: 47373 - DNA, 35 bp, Artificial Sequence
  Synthetic oligonucleotide
actagcagttgcctgttgaccttactcgcgcccaa

SEQ ID NO: 47374 - DNA, 36 bp, Artificial Sequence
  Synthetic oligonucleotide
aactcccaccgagcatgtggtggcctctcgtgataa

SEQ ID NO: 47375 - DNA, 36 bp, Artificial Sequence
  Synthetic oligonucleotide
gagcctcgtacgctcctgtttgtcgccaccaagtaa

SEQ ID NO: 47376 - DNA, 35 bp, Artificial Sequence
  Synthetic oligonucleotide
ttcacgggagggaggagaggacaagacggaccaca

SEQ ID NO: 47377 - DNA, 36 bp, Artificial Sequence
  Synthetic oligonucleotide
tgctacaagccacctctgctcccatcgcttagacca

SEQ ID NO: 47378 - DNA, 36 bp, Artificial Sequence
  Synthetic oligonucleotide
gacggtcctctgccattcggttagaacatccgacca

SEQ ID NO: 47379 - DNA, 36 bp, Artificial Sequence
  Synthetic oligonucleotide
gccgtcactggtcttatcgctgcaaagcctatcgca

SEQ ID NO: 47380 - DNA, 36 bp, Artificial Sequence
  Synthetic oligonucleotide
acccgccttttacactatcctggttgagtggtctca

SEQ ID NO: 47381 - DNA, 35 bp, Artificial Sequence
  Synthetic oligonucleotide
gcgtgactaactttcccctgtctagatcgttctca

SEQ ID NO: 47382 - DNA, 36 bp, Artificial Sequence
  Synthetic oligonucleotide
tcagccgccgcctaacaacacactccagacccttca

SEQ ID NO: 47383 - DNA, 36 bp, Artificial Sequence
  Synthetic oligonucleotide
atcgatgaggcgaagtatggagtggagtgggtaaga

SEQ ID NO: 47384 - DNA, 37 bp, Artificial Sequence
  Synthetic oligonucleotide
agggtcggtggtaagggctagtggcgtagtggggaga

SEQ ID NO: 47385 - DNA, 37 bp, Artificial Sequence
  Synthetic oligonucleotide
gacacccgccttcgcttaactgggcgttagttaacga

SEQ ID NO: 47386 - DNA, 37 bp, Artificial Sequence
  Synthetic oligonucleotide
gccttaccacgccttctcttcgcagatcgcccagcga

SEQ ID NO: 47387 - DNA, 37 bp, Artificial Sequence
  Synthetic oligonucleotide
gaaacatgcgtcgggaaacaaactggcgaaaggagga

SEQ ID NO: 47388 - DNA, 36 bp, Artificial Sequence
  Synthetic oligonucleotide
acatcacagtgtcgagcgcactctttcttttcggga

SEQ ID NO: 47389 - DNA, 35 bp, Artificial Sequence
  Synthetic oligonucleotide
aatgggtgggaggggaggcgcatctgtcacctgga

SEQ ID NO: 47390 - DNA, 36 bp, Artificial Sequence
  Synthetic oligonucleotide
gtttgctgcaacaagcgcatctcttccctatctgga

SEQ ID NO: 47391 - DNA, 36 bp, Artificial Sequence
  Synthetic oligonucleotide
agtcatcacgccccgcttgctgtccgttccccctga

SEQ ID NO: 47392 - DNA, 38 bp, Artificial Sequence
  Synthetic oligonucleotide
gccatcgccgcctgtttcattctgctctgccctggtga

SEQ ID NO: 47393 - DNA, 38 bp, Artificial Sequence
  Synthetic oligonucleotide
gacgtcgcatcaatgcagctcactcgctcatctcttga

SEQ ID NO: 47394 - DNA, 36 bp, Artificial Sequence
  Synthetic oligonucleotide
gatcccacacttccacactgcgctacccaaagccta

SEQ ID NO: 47395 - DNA, 36 bp, Artificial Sequence
  Synthetic oligonucleotide
actacccaggcatcggatatccccccctatttcgta

SEQ ID NO: 47396 - DNA, 35 bp, Artificial Sequence
  Synthetic oligonucleotide
ggtgacgctcccttcgcatgctttacctgtggcac

SEQ ID NO: 47397 - DNA, 35 bp, Artificial Sequence
  Synthetic oligonucleotide
tagaggaccacagtccccagcgtcctcgcctcccc

SEQ ID NO: 47398 - DNA, 35 bp, Artificial Sequence
  Synthetic oligonucleotide
tccaaccatgaatcttgcaagagctgtttcatccc

SEQ ID NO: 47399 - DNA, 35 bp, Artificial Sequence
  Synthetic oligonucleotide
ttggtccaccccgcctatgtgccgtttccgctgcc

SEQ ID NO: 47400 - DNA, 35 bp, Artificial Sequence
  Synthetic oligonucleotide
taaccgcgaccgcgtgacgttctatctcgccgtgc

SEQ ID NO: 47401 - DNA, 35 bp, Artificial Sequence
  Synthetic oligonucleotide
ggagtgaccaacagtgtctctactcatcgcctctc

SEQ ID NO: 47402 - DNA, 35 bp, Artificial Sequence
  Synthetic oligonucleotide
gacgcgacttgccacactaccttgacgatactttc

SEQ ID NO: 47403 - DNA, 35 bp, Artificial Sequence
  Synthetic oligonucleotide
gcctgatcacaggaagattcgccgttcatttaccg

SEQ ID NO: 47404 - DNA, 35 bp, Artificial Sequence
  Synthetic oligonucleotide
tgtagggtgggggtacgggataaaattcagggtcg

SEQ ID NO: 47405 - DNA, 35 bp, Artificial Sequence
  Synthetic oligonucleotide
acacctatactgcatgagcccattgtgccctactg

SEQ ID NO: 47406 - DNA, 35 bp, Artificial Sequence
  Synthetic oligonucleotide
acccagcccccgtccaatctgacgtttctttcttg

SEQ ID NO: 47407 - DNA, 35 bp, Artificial Sequence
  Synthetic oligonucleotide
tcattccgctgcccccttaccggtctttgaactat

SEQ ID NO: 47408 - DNA, 35 bp, Artificial Sequence
  Synthetic oligonucleotide
tcatgcccgacgcccactccatcgagcgcccctat

SEQ ID NO: 47409 - DNA, 35 bp, Artificial Sequence
  Synthetic oligonucleotide
ttgaaccatcgggtgacatctcgcttttcataact

SEQ ID NO: 47410 - DNA, 35 bp, Artificial Sequence
  Synthetic oligonucleotide
acactacgcgctcctgacaacttatgggggtctct

SEQ ID NO: 47411 - DNA, 35 bp, Artificial Sequence
  Synthetic oligonucleotide
gcacctctagttgcgctcacatttcaatgccttct

SEQ ID NO: 47412 - DNA, 35 bp, Artificial Sequence
  Synthetic oligonucleotide
gttggtccagtgcgagttgtcacgtcatgctttct

SEQ ID NO: 47413 - DNA, 35 bp, Artificial Sequence
  Synthetic oligonucleotide
atgcacgactcacgacctaaccggacatcatgctt

SEQ ID NO: 47414 - DNA, 35 bp, Artificial Sequence
  Synthetic oligonucleotide
gcagtacgagtcgtcccgcaggcatttcaccattt

SEQ ID NO: 47415 - DNA, 36 bp, Artificial Sequence
  Synthetic oligonucleotide
acaccgaccgcatttacctgtagcttccactctaaa

SEQ ID NO: 47416 - DNA, 35 bp, Artificial Sequence
  Synthetic oligonucleotide
ttcaccgccctcaggacctattctttcaccggcaa

SEQ ID NO: 47417 - DNA, 35 bp, Artificial Sequence
  Synthetic oligonucleotide
atgtgaccgggggtgtggtgctgttatgggtggaa

SEQ ID NO: 47418 - DNA, 35 bp, Artificial Sequence
  Synthetic oligonucleotide
gacgtgagcccctgggcgccatctaccacttggaa

SEQ ID NO: 47419 - DNA, 35 bp, Artificial Sequence
  Synthetic oligonucleotide
ttgctccactgctcgccaaaacctgtgaaaacgca

SEQ ID NO: 47420 - DNA, 35 bp, Artificial Sequence
  Synthetic oligonucleotide
agcatacctaccgtttggagctcatcctgtttgca

SEQ ID NO: 47421 - DNA, 36 bp, Artificial Sequence
  Synthetic oligonucleotide
acccatcgaaggcaagtacaggaaaccacacgctca

SEQ ID NO: 47422 - DNA, 35 bp, Artificial Sequence
  Synthetic oligonucleotide
atgcctcgtagtcactatgaacatgcccctcttca

SEQ ID NO: 47423 - DNA, 37 bp, Artificial Sequence
  Synthetic oligonucleotide
gagatgcagtgcaaacggggggggaggagtttacaga

SEQ ID NO: 47424 - DNA, 36 bp, Artificial Sequence
  Synthetic oligonucleotide
gtagccctggtcccccagacactttcgcattcccga

SEQ ID NO: 47425 - DNA, 37 bp, Artificial Sequence
  Synthetic oligonucleotide
tagtccccgttcaattgccctggtttctctttcccga

SEQ ID NO: 47426 - DNA, 37 bp, Artificial Sequence
  Synthetic oligonucleotide
atacgcacgcctttcctgctccatcatcgggatccga

SEQ ID NO: 47427 - DNA, 37 bp, Artificial Sequence
  Synthetic oligonucleotide
gctccccttactccctcggcattgccagccaatgcga

SEQ ID NO: 47428 - DNA, 37 bp, Artificial Sequence
  Synthetic oligonucleotide
gtgctgcaaagcaacttgcccgcgtgcctcccctcga

SEQ ID NO: 47429 - DNA, 35 bp, Artificial Sequence
  Synthetic oligonucleotide
gtccacccatgccaacttgtaagtcagtttctcga

SEQ ID NO: 47430 - DNA, 36 bp, Artificial Sequence
  Synthetic oligonucleotide
tctaaatcacctcgcacacgcgcacgcctacacgga

SEQ ID NO: 47431 - DNA, 35 bp, Artificial Sequence
  Synthetic oligonucleotide
acacggagtaggttagggccaagggtaaggatgga

SEQ ID NO: 47432 - DNA, 37 bp, Artificial Sequence
  Synthetic oligonucleotide
gcccccctcatcagtgccgcacgagtgatcgtttgga

SEQ ID NO: 47433 - DNA, 36 bp, Artificial Sequence
  Synthetic oligonucleotide
tgcacccccacgttctcgattccctgaggtaaatga

SEQ ID NO: 47434 - DNA, 38 bp, Artificial Sequence
  Synthetic oligonucleotide
actcaccaacgctctcttcttgttcatagtactcatga

SEQ ID NO: 47435 - DNA, 36 bp, Artificial Sequence
  Synthetic oligonucleotide
gaacgcccgtctcgtttgaactctctccctcactga

SEQ ID NO: 47436 - DNA, 38 bp, Artificial Sequence
  Synthetic oligonucleotide
agtcgcaaccactgacgaagtaatctcacaatccctga

SEQ ID NO: 47437 - DNA, 38 bp, Artificial Sequence
  Synthetic oligonucleotide
acacactgccacctgcctctccgcctatgtcattgtga

SEQ ID NO: 47438 - DNA, 38 bp, Artificial Sequence
  Synthetic oligonucleotide
tcccgcagggatcgtagtgccatcatctgcttggttga

SEQ ID NO: 47439 - DNA, 38 bp, Artificial Sequence
  Synthetic oligonucleotide
tcacgcggtaatctattacgccagtgcctccttgttga

SEQ ID NO: 47440 - DNA, 36 bp, Artificial Sequence
  Synthetic oligonucleotide
accagccacatccaactgtggaatcgtacccatcta

SEQ ID NO: 47441 - DNA, 36 bp, Artificial Sequence
  Synthetic oligonucleotide
tgttctcgccgaatctttccaaggtcacataacgta

SEQ ID NO: 47442 - DNA, 35 bp, Artificial Sequence
  Synthetic oligonucleotide
gtctcccgcgcaaaacgaaaccttggaagttccac

SEQ ID NO: 47443 - DNA, 35 bp, Artificial Sequence
  Synthetic oligonucleotide
ttcaaggtgtgcctcttcccgtgtcatttccatac

SEQ ID NO: 47444 - DNA, 35 bp, Artificial Sequence
  Synthetic oligonucleotide
atttgcgctcgtgcccgccatttccgtgctcttac

SEQ ID NO: 47445 - DNA, 35 bp, Artificial Sequence
  Synthetic oligonucleotide
acacgtccggctcacgaggcccccctgggtcaacc

SEQ ID NO: 47446 - DNA, 35 bp, Artificial Sequence
  Synthetic oligonucleotide
atcctgccccggtttatgccgttgtttcacccgcc

SEQ ID NO: 47447 - DNA, 35 bp, Artificial Sequence
  Synthetic oligonucleotide
ttcaactgccgttgctccattctcttcataggtcc

SEQ ID NO: 47448 - DNA, 35 bp, Artificial Sequence
  Synthetic oligonucleotide
tcccacccgccattaagttggaccgtcaacccagc

SEQ ID NO: 47449 - DNA, 35 bp, Artificial Sequence
  Synthetic oligonucleotide
actccccgcgcgtagactcttaacttcgatcccgc

SEQ ID NO: 47450 - DNA, 35 bp, Artificial Sequence
  Synthetic oligonucleotide
attccgtcctctctccagccccctggccaatcggc

SEQ ID NO: 47451 - DNA, 35 bp, Artificial Sequence
  Synthetic oligonucleotide
gtcgacgcacgaatctcatccacctttgtaaacag

SEQ ID NO: 47452 - DNA, 35 bp, Artificial Sequence
  Synthetic oligonucleotide
tagggtgggtaggacggatcgaacagaggggggag

SEQ ID NO: 47453 - DNA, 35 bp, Artificial Sequence
  Synthetic oligonucleotide
ggacccctccgccccctcatacgcctgttgggacg

SEQ ID NO: 47454 - DNA, 35 bp, Artificial Sequence
  Synthetic oligonucleotide
gtagaacggcggaacggaaggaacaggctgcatgg

SEQ ID NO: 47455 - DNA, 35 bp, Artificial Sequence
  Synthetic oligonucleotide
tagggggacgtgttaggctaggggaaagggggtgg

SEQ ID NO: 47456 - DNA, 35 bp, Artificial Sequence
  Synthetic oligonucleotide
tcaaccccccgtcaatcgacacatttttagacgtg

SEQ ID NO: 47457 - DNA, 35 bp, Artificial Sequence
  Synthetic oligonucleotide
acttcctggcgcaatgcatcgtactctcccttgtg

SEQ ID NO: 47458 - DNA, 35 bp, Artificial Sequence
  Synthetic oligonucleotide
atcaccaatgcccgatactagctacgtagtgtact

SEQ ID NO: 47459 - DNA, 36 bp, Artificial Sequence
  Synthetic oligonucleotide
acactctgccccgactcccggcctatcttagttaaa

SEQ ID NO: 47460 - DNA, 35 bp, Artificial Sequence
  Synthetic oligonucleotide
tcagctgactcattctgctcgaacaaaacgcccaa

SEQ ID NO: 47461 - DNA, 35 bp, Artificial Sequence
  Synthetic oligonucleotide
tgctacgctcgaccaccatctatgaccgcgacgaa

SEQ ID NO: 47462 - DNA, 36 bp, Artificial Sequence
  Synthetic oligonucleotide
gtgtcacctcgggcattgtcttcaagtccttcttaa

SEQ ID NO: 47463 - DNA, 36 bp, Artificial Sequence
  Synthetic oligonucleotide
agactagcggtctacggcctgactaatctacacaca

SEQ ID NO: 47464 - DNA, 36 bp, Artificial Sequence
  Synthetic oligonucleotide
atcgcgccccattccccactttcatccacgtgcaca

SEQ ID NO: 47465 - DNA, 35 bp, Artificial Sequence
  Synthetic oligonucleotide
acttccccccattggcccgatactgcacgaaacca

SEQ ID NO: 47466 - DNA, 36 bp, Artificial Sequence
  Synthetic oligonucleotide
gttgccgacccacctatttgccccatgtgggaacca

SEQ ID NO: 47467 - DNA, 36 bp, Artificial Sequence
  Synthetic oligonucleotide
gactctctccctacggactattgtgacacctcatca

SEQ ID NO: 47468 - DNA, 35 bp, Artificial Sequence
  Synthetic oligonucleotide
gtgggaacacacgtgcttcattaacgaccgtatca

SEQ ID NO: 47469 - DNA, 37 bp, Artificial Sequence
  Synthetic oligonucleotide
gcctgctgcttgagcctcttgcttttcttccgcacga

SEQ ID NO: 47470 - DNA, 37 bp, Artificial Sequence
  Synthetic oligonucleotide
gttaacaatgctgaggactaggaggggggaaggacga

SEQ ID NO: 47471 - DNA, 37 bp, Artificial Sequence
  Synthetic oligonucleotide
tcatgagcgccggcaatcactgacgcgttacccccga

SEQ ID NO: 47472 - DNA, 36 bp, Artificial Sequence
  Synthetic oligonucleotide
gctggagtttaggaatggaatgaaggtgtggccgga

SEQ ID NO: 47473 - DNA, 37 bp, Artificial Sequence
  Synthetic oligonucleotide
gaagagcgtaagcgggtcacgtaagcaggatacggga

SEQ ID NO: 47474 - DNA, 37 bp, Artificial Sequence
  Synthetic oligonucleotide
gaagagggggggtgcgcctgagataggataaatggga

SEQ ID NO: 47475 - DNA, 38 bp, Artificial Sequence
  Synthetic oligonucleotide
tagtccgtcgccatagcatatccgggtgcctcccatga

SEQ ID NO: 47476 - DNA, 37 bp, Artificial Sequence
  Synthetic oligonucleotide
gcaacatctgctaccatgtcagcatagggttccatga

SEQ ID NO: 47477 - DNA, 38 bp, Artificial Sequence
  Synthetic oligonucleotide
gttgcgacggttcacgtctcatttgttccatctcctga

SEQ ID NO: 47478 - DNA, 38 bp, Artificial Sequence
  Synthetic oligonucleotide
aatgcgggagagggtgggggcgcttttggcctgggtga

SEQ ID NO: 47479 - DNA, 36 bp, Artificial Sequence
  Synthetic oligonucleotide
atttgcaccaccacaccgatgtctttacaactagta

SEQ ID NO: 47480 - DNA, 36 bp, Artificial Sequence
  Synthetic oligonucleotide
gctacactcctcacctttggcagtactagcaccgta

SEQ ID NO: 47481 - DNA, 36 bp, Artificial Sequence
  Synthetic oligonucleotide
atagccagccaccccatcatcaggtaacccttctta

SEQ ID NO: 47482 - DNA, 35 bp, Artificial Sequence
  Synthetic oligonucleotide
gcgagttacatcatatcttcccctgcgccacgtta

SEQ ID NO: 47483 - DNA, 35 bp, Artificial Sequence
  Synthetic oligonucleotide
tcgtgccctcctcggttccctaccttaccccttta

SEQ ID NO: 47484 - DNA, 35 bp, Artificial Sequence
  Synthetic oligonucleotide
tactgccccactgaccgcctgttactataccgacc

SEQ ID NO: 47485 - DNA, 35 bp, Artificial Sequence
  Synthetic oligonucleotide
aacgcatgcagctttctcccgactaactgaacccc

SEQ ID NO: 47486 - DNA, 35 bp, Artificial Sequence
  Synthetic oligonucleotide
acctgcgcgtagacctccatctctcatgactagcc

SEQ ID NO: 47487 - DNA, 35 bp, Artificial Sequence
  Synthetic oligonucleotide
tcaccacccgtactaccaactccgcgctaaacgcc

SEQ ID NO: 47488 - DNA, 35 bp, Artificial Sequence
  Synthetic oligonucleotide
gtagagaagccgctccatctcactttctacgattc

SEQ ID NO: 47489 - DNA, 35 bp, Artificial Sequence
  Synthetic oligonucleotide
atctgtcgcgaaaaagttaccgatctggctccttc

SEQ ID NO: 47490 - DNA, 35 bp, Artificial Sequence
  Synthetic oligonucleotide
gccgtgccatccgcctattctaccttttcaatttc

SEQ ID NO: 47491 - DNA, 35 bp, Artificial Sequence
  Synthetic oligonucleotide
tcctgtgaacgtctactcctttcctccccttggag

SEQ ID NO: 47492 - DNA, 35 bp, Artificial Sequence
  Synthetic oligonucleotide
tatcccgttctagatcaccgttgtgcctcttctcg

SEQ ID NO: 47493 - DNA, 35 bp, Artificial Sequence
  Synthetic oligonucleotide
ggttacttccctagcccccccgtcctgtgtccttg

SEQ ID NO: 47494 - DNA, 35 bp, Artificial Sequence
  Synthetic oligonucleotide
gaacacacacatcagacgttttgtcagtcattcat

SEQ ID NO: 47495 - DNA, 35 bp, Artificial Sequence
  Synthetic oligonucleotide
gtcaggcggacgccttcctcccggtcaccacccct

SEQ ID NO: 47496 - DNA, 35 bp, Artificial Sequence
  Synthetic oligonucleotide
acctagcgtagcaacctttagtttacattacgcct

SEQ ID NO: 47497 - DNA, 35 bp, Artificial Sequence
  Synthetic oligonucleotide
ttggctggccccacctactctgtggctttcctctt

SEQ ID NO: 47498 - DNA, 36 bp, Artificial Sequence
  Synthetic oligonucleotide
tagagtgcctcacttggtacaactgactcacctaaa

SEQ ID NO: 47499 - DNA, 36 bp, Artificial Sequence
  Synthetic oligonucleotide
gcgctccccgcccttgagcttatcactttgttcgaa

SEQ ID NO: 47500 - DNA, 35 bp, Artificial Sequence
  Synthetic oligonucleotide
atcacccttgctgatgacgctccttttttgtggaa

SEQ ID NO: 47501 - DNA, 36 bp, Artificial Sequence
  Synthetic oligonucleotide
gattgctgccagacaccctgctgcctgttctccaca

SEQ ID NO: 47502 - DNA, 36 bp, Artificial Sequence
  Synthetic oligonucleotide
gtcgccacagagacggatacacagcctagctcacca

SEQ ID NO: 47503 - DNA, 36 bp, Artificial Sequence
  Synthetic oligonucleotide
gatctaacgcccgagctagctttcgctcaccttgca

SEQ ID NO: 47504 - DNA, 37 bp, Artificial Sequence
  Synthetic oligonucleotide
atgtgtcgctccctcccgttcggccccattggacaga

SEQ ID NO: 47505 - DNA, 37 bp, Artificial Sequence
  Synthetic oligonucleotide
tgacagggcaccatctcgcctttaactgtctgcccga

SEQ ID NO: 47506 - DNA, 37 bp, Artificial Sequence
  Synthetic oligonucleotide
aatgtggggagacggggaatcaaggcaacgcacagga

SEQ ID NO: 47507 - DNA, 37 bp, Artificial Sequence
  Synthetic oligonucleotide
tcacgcgtacttgggggttggtacgtcacggggagga

SEQ ID NO: 47508 - DNA, 36 bp, Artificial Sequence
  Synthetic oligonucleotide
gtcgagcgacattactctgctcccctcacgatagga

SEQ ID NO: 47509 - DNA, 36 bp, Artificial Sequence
  Synthetic oligonucleotide
gacggggggtggctggacgcaatggtgtgggtagga

SEQ ID NO: 47510 - DNA, 37 bp, Artificial Sequence
  Synthetic oligonucleotide
gcaagggtgtaccaggtaggtgcatgggtgtggtgga

SEQ ID NO: 47511 - DNA, 37 bp, Artificial Sequence
  Synthetic oligonucleotide
atcgcggatacgcgatcctctcacattctctattgga

SEQ ID NO: 47512 - DNA, 36 bp, Artificial Sequence
  Synthetic oligonucleotide
tgtcccccgcgctagcaagttcacaacttatttgga

SEQ ID NO: 47513 - DNA, 37 bp, Artificial Sequence
  Synthetic oligonucleotide
aatgtgggtggagggaggcggacgggcgggttttgga

SEQ ID NO: 47514 - DNA, 37 bp, Artificial Sequence
  Synthetic oligonucleotide
gcctgttccgttgctgatctgacgctttccaccatga

SEQ ID NO: 47515 - DNA, 37 bp, Artificial Sequence
  Synthetic oligonucleotide
gttgcccagatattcgacaccgctttttcccccatga

SEQ ID NO: 47516 - DNA, 36 bp, Artificial Sequence
  Synthetic oligonucleotide
acagcccttccctgcgctatcgataccgtgttctga

SEQ ID NO: 47517 - DNA, 38 bp, Artificial Sequence
  Synthetic oligonucleotide
attgcttggcgtgcaagggataagggacgggagggtga

SEQ ID NO: 47518 - DNA, 38 bp, Artificial Sequence
  Synthetic oligonucleotide
gctgactgtcgtcagtatacttctcttatgcactgtga

SEQ ID NO: 47519 - DNA, 36 bp, Artificial Sequence
  Synthetic oligonucleotide
gccgccaaatcacgccatcaactacggttccattga

SEQ ID NO: 47520 - DNA, 38 bp, Artificial Sequence
  Synthetic oligonucleotide
gggaggtggccgcgaggatacgggtgggtggatcttga

SEQ ID NO: 47521 - DNA, 36 bp, Artificial Sequence
  Synthetic oligonucleotide
acaagccaacattgccgcgatatgacctgtggttga

SEQ ID NO: 47522 - DNA, 36 bp, Artificial Sequence
  Synthetic oligonucleotide
gcgaactagtcccacgttgctcaccccatccgtata

SEQ ID NO: 47523 - DNA, 36 bp, Artificial Sequence
  Synthetic oligonucleotide
gccacaaccgcagtgaccccttctaacgcagaacta

SEQ ID NO: 47524 - DNA, 36 bp, Artificial Sequence
  Synthetic oligonucleotide
tacgaggagtggcgggagtgggcccagggaatggta

SEQ ID NO: 47525 - DNA, 36 bp, Artificial Sequence
  Synthetic oligonucleotide
ttcactaccggcctcatcgacttgcgaaccccttta

SEQ ID NO: 47526 - DNA, 35 bp, Artificial Sequence
  Synthetic oligonucleotide
ttggaccctccttgactatccttgcgtgaatcgac

SEQ ID NO: 47527 - DNA, 35 bp, Artificial Sequence
  Synthetic oligonucleotide
gactacgacgatcaatgggatctcactgcatatac

SEQ ID NO: 47528 - DNA, 35 bp, Artificial Sequence
  Synthetic oligonucleotide
acgaccggtctctcaactacaccgcatctgcaacc

SEQ ID NO: 47529 - DNA, 35 bp, Artificial Sequence
  Synthetic oligonucleotide
tggacccatttcctgataaagtacgacctgtcacc

SEQ ID NO: 47530 - DNA, 35 bp, Artificial Sequence
  Synthetic oligonucleotide
taatcgcacgaaacccagagtcgcgccacatcccc

SEQ ID NO: 47531 - DNA, 35 bp, Artificial Sequence
  Synthetic oligonucleotide
agccgcatggtctaatctcggccacctatttttcc

SEQ ID NO: 47532 - DNA, 35 bp, Artificial Sequence
  Synthetic oligonucleotide
cagcacccttgactgggatcgtttcgggttttcgc

SEQ ID NO: 47533 - DNA, 35 bp, Artificial Sequence
  Synthetic oligonucleotide
actccccgggccccactgtatttcgtacaccatgc

SEQ ID NO: 47534 - DNA, 35 bp, Artificial Sequence
  Synthetic oligonucleotide
ggtgctgacggcaacctccgccattgaggcccatc

SEQ ID NO: 47535 - DNA, 35 bp, Artificial Sequence
  Synthetic oligonucleotide
tgtgccgtccgttgctttcctcccccgcagccatc

SEQ ID NO: 47536 - DNA, 35 bp, Artificial Sequence
  Synthetic oligonucleotide
gtagtgaggccccttatctgctttatatcgtattc

SEQ ID NO: 47537 - DNA, 35 bp, Artificial Sequence
  Synthetic oligonucleotide
gtatacaagggggaggggaacatagaggtgagacg

SEQ ID NO: 47538 - DNA, 35 bp, Artificial Sequence
  Synthetic oligonucleotide
gctgatccgccttcgtaacgactactaccttctgg

SEQ ID NO: 47539 - DNA, 35 bp, Artificial Sequence
  Synthetic oligonucleotide
gcgactcgccttgtactccgccatttcacgacatg

SEQ ID NO: 47540 - DNA, 35 bp, Artificial Sequence
  Synthetic oligonucleotide
tagtctggtctgcaccccgtttattgctccatcat
